United States Patent 7,901,882 (ANALYSIS OF METHYLATION USING NUCLEIC ACID ARRAYS) - sequence listing, part 6

SEQ ID NO: 196853 - DNA, 25 bp, Homo sapien
gtcccggttgtgtctgcacaagcga

SEQ ID NO: 196854 - DNA, 25 bp, Homo sapien
cctcaaagccgtcccggttgtgtct

SEQ ID NO: 196855 - DNA, 25 bp, Homo sapien
cttgggtgtgcacgtcccctcaaag

SEQ ID NO: 196856 - DNA, 25 bp, Homo sapien
cggttgtgtctgcacaagcgagccg

SEQ ID NO: 196857 - DNA, 25 bp, Homo sapien
aagtcctgccgtcactggctcgcag

SEQ ID NO: 196858 - DNA, 25 bp, Homo sapien
cagatgattccaagtcctgccgtca

SEQ ID NO: 196859 - DNA, 25 bp, Homo sapien
tcccagcggggaagtcttgggtgtg

SEQ ID NO: 196860 - DNA, 25 bp, Homo sapien
acatgggcgtcgtgggcaccacggc

SEQ ID NO: 196861 - DNA, 25 bp, Homo sapien
ggcagccgaacctggtgccctccct

SEQ ID NO: 196862 - DNA, 25 bp, Homo sapien
cacgctgtggtttgtcagctgggcc

SEQ ID NO: 196863 - DNA, 25 bp, Homo sapien
ggcaccagcacacgtctcatcagtg

SEQ ID NO: 196864 - DNA, 25 bp, Homo sapien
acacgtctcatcagtggccacagga

SEQ ID NO: 196865 - DNA, 25 bp, Homo sapien
ccacaggagcaaggtgagggacttc

SEQ ID NO: 196866 - DNA, 25 bp, Homo sapien
acaggagcaaggtgagggacttcca

SEQ ID NO: 196867 - DNA, 25 bp, Homo sapien
tccaccagcccagatgattccaagt

SEQ ID NO: 196868 - DNA, 25 bp, Homo sapien
gctcgtcttggcctttcccaggaga

SEQ ID NO: 196869 - DNA, 25 bp, Homo sapien
aagtcaaggccctgtgcgctaaggc

SEQ ID NO: 196870 - DNA, 25 bp, Homo sapien
agaatcgagttgtccgctccgagcc

SEQ ID NO: 196871 - DNA, 25 bp, Homo sapien
cgggccggctctagaatcgagttgt

SEQ ID NO: 196872 - DNA, 25 bp, Homo sapien
tctaagtcaccgtccttagcgcggg

SEQ ID NO: 196873 - DNA, 25 bp, Homo sapien
cggcggtaatagtgcgagactcctc

SEQ ID NO: 196874 - DNA, 25 bp, Homo sapien
aggagcgtgtatgacgccacatccg

SEQ ID NO: 196875 - DNA, 25 bp, Homo sapien
ggaactggcctcctttgcttccgcg

SEQ ID NO: 196876 - DNA, 25 bp, Homo sapien
agcctgagctgtctccactccattg

SEQ ID NO: 196877 - DNA, 25 bp, Homo sapien
ggcgctcacagtccgacagcttctg

SEQ ID NO: 196878 - DNA, 25 bp, Homo sapien
acggagccaagagtcccgggacaca

SEQ ID NO: 196879 - DNA, 25 bp, Homo sapien
gacgcggcctgagctgatttcacag

SEQ ID NO: 196880 - DNA, 25 bp, Homo sapien
cctccaaagttcgaaggcgctcaca

SEQ ID NO: 196881 - DNA, 25 bp, Homo sapien
agcagacgcagatcagccgaggtca

SEQ ID NO: 196882 - DNA, 25 bp, Homo sapien
gcacaggtctataggggcggaaatc

SEQ ID NO: 196883 - DNA, 25 bp, Homo sapien
cttcccggattacacgcgagcctga

SEQ ID NO: 196884 - DNA, 25 bp, Homo sapien
gcaggcgcctggacttgtttacacc

SEQ ID NO: 196885 - DNA, 25 bp, Homo sapien
ataatgacccgcgtttgtccgccgc

SEQ ID NO: 196886 - DNA, 25 bp, Homo sapien
gatgagtataatgacccgcgtttgt

SEQ ID NO: 196887 - DNA, 25 bp, Homo sapien
gcattcctgcttgtggcccgcgcag

SEQ ID NO: 196888 - DNA, 25 bp, Homo sapien
gcctgctcgcattcctgcttgtggc

SEQ ID NO: 196889 - DNA, 25 bp, Homo sapien
atgggcgctccgcatgcaaatgagg

SEQ ID NO: 196890 - DNA, 25 bp, Homo sapien
ggacttgtttacaccgagcccagct

SEQ ID NO: 196891 - DNA, 25 bp, Homo sapien
ccaatgggcgctccgcatgcaaatg

SEQ ID NO: 196892 - DNA, 25 bp, Homo sapien
caactgcgtgtagcgcgggcccacg

SEQ ID NO: 196893 - DNA, 25 bp, Homo sapien
tcctcgggacgctccgcgtctccac

SEQ ID NO: 196894 - DNA, 25 bp, Homo sapien
tccacgtcccggaaagcgctcggcg

SEQ ID NO: 196895 - DNA, 25 bp, Homo sapien
tcacctgaccatgccgtacgcgccc

SEQ ID NO: 196896 - DNA, 25 bp, Homo sapien
cctcgccgatgtactgcaactgcgt

SEQ ID NO: 196897 - DNA, 25 bp, Homo sapien
ccgatgtactgcaactgcgtgtagc

SEQ ID NO: 196898 - DNA, 25 bp, Homo sapien
tactgcaactgcgtgtagcgcgggc

SEQ ID NO: 196899 - DNA, 25 bp, Homo sapien
gctcccgatcatcccgagtctcctg

SEQ ID NO: 196900 - DNA, 25 bp, Homo sapien
tcagcacagtgtcgagggcccgact

SEQ ID NO: 196901 - DNA, 25 bp, Homo sapien
ggctagggaccaccgcggccaagat

SEQ ID NO: 196902 - DNA, 25 bp, Homo sapien
ggggatcactgtcctctctcggcag

SEQ ID NO: 196903 - DNA, 25 bp, Homo sapien
cacctccggcttttgggggatcact

SEQ ID NO: 196904 - DNA, 25 bp, Homo sapien
caagagcatcttcagcgggcgagtc

SEQ ID NO: 196905 - DNA, 25 bp, Homo sapien
gcgcacggctgcttctcattcattg

SEQ ID NO: 196906 - DNA, 25 bp, Homo sapien
cattcattgtcttgacaagagcatc

SEQ ID NO: 196907 - DNA, 25 bp, Homo sapien
gcctgcgctatggttggggaccaac

SEQ ID NO: 196908 - DNA, 25 bp, Homo sapien
ttgcgtgacggttccacgtcaccga

SEQ ID NO: 196909 - DNA, 25 bp, Homo sapien
tttgcgtgacggttccacgtcaccg

SEQ ID NO: 196910 - DNA, 25 bp, Homo sapien
ttcgggtgatgatggttccacgtca

SEQ ID NO: 196911 - DNA, 25 bp, Homo sapien
tgatgatggttccacgtcagcggcc

SEQ ID NO: 196912 - DNA, 25 bp, Homo sapien
tcttgggtttgcgtgacggttccac

SEQ ID NO: 196913 - DNA, 25 bp, Homo sapien
ccgcctcttgggtttgcgtgacggt

SEQ ID NO: 196914 - DNA, 25 bp, Homo sapien
tccgcctcttgggtttgcgtgacgg

SEQ ID NO: 196915 - DNA, 25 bp, Homo sapien
atgatggttccacgtcagcggccct

SEQ ID NO: 196916 - DNA, 25 bp, Homo sapien
ggccggtcacccacctgggttgcca

SEQ ID NO: 196917 - DNA, 25 bp, Homo sapien
ggggctctgcggctcattaccttcc

SEQ ID NO: 196918 - DNA, 25 bp, Homo sapien
gggttgccagtcattccagctccgc

SEQ ID NO: 196919 - DNA, 25 bp, Homo sapien
tgggttgccagtcattccagctccg

SEQ ID NO: 196920 - DNA, 25 bp, Homo sapien
ctgggttgccagtcattccagctcc

SEQ ID NO: 196921 - DNA, 25 bp, Homo sapien
cctgggttgccagtcattccagctc

SEQ ID NO: 196922 - DNA, 25 bp, Homo sapien
ggttgccagtcattccagctccgcg

SEQ ID NO: 196923 - DNA, 25 bp, Homo sapien
cacctgggttgccagtcattccagc

SEQ ID NO: 196924 - DNA, 25 bp, Homo sapien
ctcggtcagtgcagtcgttctaaaa

SEQ ID NO: 196925 - DNA, 25 bp, Homo sapien
cggcctgcgtcactcggtcagtgca

SEQ ID NO: 196926 - DNA, 25 bp, Homo sapien
gcactgccaagacgccgaaaagttc

SEQ ID NO: 196927 - DNA, 25 bp, Homo sapien
gcggtcgagtcacgccaggcactgc

SEQ ID NO: 196928 - DNA, 25 bp, Homo sapien
tctcccgcagcaggccggaggtgac

SEQ ID NO: 196929 - DNA, 25 bp, Homo sapien
cgccgaaaagttctcccgcagcagg

SEQ ID NO: 196930 - DNA, 25 bp, Homo sapien
acctacagcggtcgagtcacgccag

SEQ ID NO: 196931 - DNA, 25 bp, Homo sapien
gtgcagtcgttctaaaatcgaggcg

SEQ ID NO: 196932 - DNA, 25 bp, Homo sapien
catcacccggaagaggactgcggaa

SEQ ID NO: 196933 - DNA, 25 bp, Homo sapien
tgcgataagcgagcgaagacgcctc

SEQ ID NO: 196934 - DNA, 25 bp, Homo sapien
actcacctgggaatccgcggaaggc

SEQ ID NO: 196935 - DNA, 25 bp, Homo sapien
agatgcttgcgccagggctacatcc

SEQ ID NO: 196936 - DNA, 25 bp, Homo sapien
aggagacaggcttcaccacgtgacc

SEQ ID NO: 196937 - DNA, 25 bp, Homo sapien
ccgaactcccaattccgtgtggtga

SEQ ID NO: 196938 - DNA, 25 bp, Homo sapien
tgtcccgggctgtgtacaacttaga

SEQ ID NO: 196939 - DNA, 25 bp, Homo sapien
ccggaagtggcttcactcgggttag

SEQ ID NO: 196940 - DNA, 25 bp, Homo sapien
cccacatcgtggactactcaggtag

SEQ ID NO: 196941 - DNA, 25 bp, Homo sapien
gaagacgtcgctgatcctgtccctg

SEQ ID NO: 196942 - DNA, 25 bp, Homo sapien
ggtccgcagtggagtctctttgtcc

SEQ ID NO: 196943 - DNA, 25 bp, Homo sapien
tgataattctgtgacctccgcactg

SEQ ID NO: 196944 - DNA, 25 bp, Homo sapien
accgctcagtccagtggtgctccag

SEQ ID NO: 196945 - DNA, 25 bp, Homo sapien
tgctccagggataacaggacccttc

SEQ ID NO: 196946 - DNA, 25 bp, Homo sapien
ggcagcagcgtttgctcttcctgtg

SEQ ID NO: 196947 - DNA, 25 bp, Homo sapien
ccgggtgtccttggccctgataatt

SEQ ID NO: 196948 - DNA, 25 bp, Homo sapien
ggactggctcatcgcgctccttttt

SEQ ID NO: 196949 - DNA, 25 bp, Homo sapien
cttctgccaatcgttggaatcgtgg

SEQ ID NO: 196950 - DNA, 25 bp, Homo sapien
agagagagaactgggcttctgccaa

SEQ ID NO: 196951 - DNA, 25 bp, Homo sapien
cccgcctagtcagaggatttggacg

SEQ ID NO: 196952 - DNA, 25 bp, Homo sapien
aagtggccgtagtcactggaggtcc

SEQ ID NO: 196953 - DNA, 25 bp, Homo sapien
ggccagagccctcgatgtctcaact

SEQ ID NO: 196954 - DNA, 25 bp, Homo sapien
gcctcctctgtcttcggcgagtctg

SEQ ID NO: 196955 - DNA, 25 bp, Homo sapien
ggtgagggtcgagcctcctctgtct

SEQ ID NO: 196956 - DNA, 25 bp, Homo sapien
cacaaatgaatggatgcggcctgga

SEQ ID NO: 196957 - DNA, 25 bp, Homo sapien
gccgcgggaagctcagtttttattg

SEQ ID NO: 196958 - DNA, 25 bp, Homo sapien
gctctgctgcatttgggcctgcatc

SEQ ID NO: 196959 - DNA, 25 bp, Homo sapien
cagcatctcttgcatgcggcgcagc

SEQ ID NO: 196960 - DNA, 25 bp, Homo sapien
gtgcgtgctcacctcttcgtctttc

SEQ ID NO: 196961 - DNA, 25 bp, Homo sapien
cttcgtctttctcgcggatcagctt

SEQ ID NO: 196962 - DNA, 25 bp, Homo sapien
atcagcttctcggtgtccgccagag

SEQ ID NO: 196963 - DNA, 25 bp, Homo sapien
ccttggaggctctgatactgtccgc

SEQ ID NO: 196964 - DNA, 25 bp, Homo sapien
ccacaattacgaagagcctcgggcc

SEQ ID NO: 196965 - DNA, 25 bp, Homo sapien
ccggccgagatcctggaagatcgga

SEQ ID NO: 196966 - DNA, 25 bp, Homo sapien
tgcgccgccacggacaggtaacggc

SEQ ID NO: 196967 - DNA, 25 bp, Homo sapien
cgcgggccacacatggctgcgtgac

SEQ ID NO: 196968 - DNA, 25 bp, Homo sapien
ggaggcacacggttaataccaccga

SEQ ID NO: 196969 - DNA, 25 bp, Homo sapien
ggctggagacacacagccacaatta

SEQ ID NO: 196970 - DNA, 25 bp, Homo sapien
ctttggatccctctttctttgtctc

SEQ ID NO: 196971 - DNA, 25 bp, Homo sapien
ctccaaggtcctagagcggctccgt

SEQ ID NO: 196972 - DNA, 25 bp, Homo sapien
cgacacccgagaccctttttatgcg

SEQ ID NO: 196973 - DNA, 25 bp, Homo sapien
tctccgtgcggaaagaatccctgga

SEQ ID NO: 196974 - DNA, 25 bp, Homo sapien
caggtctgcaatccctagcgttttc

SEQ ID NO: 196975 - DNA, 25 bp, Homo sapien
agcatccagcgcgacccttaaaagg

SEQ ID NO: 196976 - DNA, 25 bp, Homo sapien
ctagctccgacgtctggttcaaaaa

SEQ ID NO: 196977 - DNA, 25 bp, Homo sapien
gtagtcagcggctttctagctccga

SEQ ID NO: 196978 - DNA, 25 bp, Homo sapien
ctcgcgagatcgtaagcactggcct

SEQ ID NO: 196979 - DNA, 25 bp, Homo sapien
agcgttttcacaaccactggcctga

SEQ ID NO: 196980 - DNA, 25 bp, Homo sapien
ggggctggagattcgaactgttcaa

SEQ ID NO: 196981 - DNA, 25 bp, Homo sapien
caaggccttgaatgctgggatgagt

SEQ ID NO: 196982 - DNA, 25 bp, Homo sapien
cacgtggcctatttcgggcggagca

SEQ ID NO: 196983 - DNA, 25 bp, Homo sapien
gaactcggcggcaaggaccttgaac

SEQ ID NO: 196984 - DNA, 25 bp, Homo sapien
aggacgccaagtctgagctcgccgc

SEQ ID NO: 196985 - DNA, 25 bp, Homo sapien
gtggggctatatgttcggaccaatg

SEQ ID NO: 196986 - DNA, 25 bp, Homo sapien
atgttcggaccaatgaccggccgtc

SEQ ID NO: 196987 - DNA, 25 bp, Homo sapien
ggcaccgcgagtgccgaaccttcgg

SEQ ID NO: 196988 - DNA, 25 bp, Homo sapien
gggcttcgacctggctgcactaacc

SEQ ID NO: 196989 - DNA, 25 bp, Homo sapien
tgccaccgagcgttgcccggagtgt

SEQ ID NO: 196990 - DNA, 25 bp, Homo sapien
tgcggcgccgcctgtatatttgcgc

SEQ ID NO: 196991 - DNA, 25 bp, Homo sapien
tgcggcacgcgcttcgctcagagct

SEQ ID NO: 196992 - DNA, 25 bp, Homo sapien
gagtgcgacaaacgcttctcggccg

SEQ ID NO: 196993 - DNA, 25 bp, Homo sapien
aagtcggcgctgaccaaacacggcc

SEQ ID NO: 196994 - DNA, 25 bp, Homo sapien
cgaacggcccttcgggtgcaccgag

SEQ ID NO: 196995 - DNA, 25 bp, Homo sapien
cgcttctcacagaagtcggcgctga

SEQ ID NO: 196996 - DNA, 25 bp, Homo sapien
ccgctaggccctgtgtctaaaggta

SEQ ID NO: 196997 - DNA, 25 bp, Homo sapien
cgtcacttcgtttatgggcgccaga

SEQ ID NO: 196998 - DNA, 25 bp, Homo sapien
gtcttaggccctggaattcttccgc

SEQ ID NO: 196999 - DNA, 25 bp, Homo sapien
caagcgcgcgtttctagtcttaggc

SEQ ID NO: 197000 - DNA, 25 bp, Homo sapien
cactggaccaatctgagggagcttc

SEQ ID NO: 197001 - DNA, 25 bp, Homo sapien
tccgaccaattacgggagttctcta

SEQ ID NO: 197002 - DNA, 25 bp, Homo sapien
cgctgcaccgcgacttcacggaaaa

SEQ ID NO: 197003 - DNA, 25 bp, Homo sapien
aggcctgcttacatgtcctcgagcg

SEQ ID NO: 197004 - DNA, 25 bp, Homo sapien
cagtcccgccaggagtttgagcagc

SEQ ID NO: 197005 - DNA, 25 bp, Homo sapien
cttcatgccggagaagcccgtcagc

SEQ ID NO: 197006 - DNA, 25 bp, Homo sapien
gggattctccctagcgctactcaag

SEQ ID NO: 197007 - DNA, 25 bp, Homo sapien
cacggcatgcacaatcttcctgata

SEQ ID NO: 197008 - DNA, 25 bp, Homo sapien
gagccgccggactcccttatttata

SEQ ID NO: 197009 - DNA, 25 bp, Homo sapien
gccctggcgattgacagccgcaaca

SEQ ID NO: 197010 - DNA, 25 bp, Homo sapien
aacctccggcttgcaaaaccgcttg

SEQ ID NO: 197011 - DNA, 25 bp, Homo sapien
gaggcgggcttcctagactctaaaa

SEQ ID NO: 197012 - DNA, 25 bp, Homo sapien
ggtccggctactctgtctctttttc

SEQ ID NO: 197013 - DNA, 25 bp, Homo sapien
ccgtcatggcgtcgcagccaaattc

SEQ ID NO: 197014 - DNA, 25 bp, Homo sapien
cgggacaaacgccacggccagagta

SEQ ID NO: 197015 - DNA, 25 bp, Homo sapien
ctttttcaaattgaggcgccgagtc

SEQ ID NO: 197016 - DNA, 25 bp, Homo sapien
actgcatcccatggtgccttgcgcg

SEQ ID NO: 197017 - DNA, 25 bp, Homo sapien
ttccggagcaagcagacagaccacc

SEQ ID NO: 197018 - DNA, 25 bp, Homo sapien
attctagcgtctcggctctggacta

SEQ ID NO: 197019 - DNA, 25 bp, Homo sapien
cgccgagtcgttgcttagtttctgg

SEQ ID NO: 197020 - DNA, 25 bp, Homo sapien
aaacgggtgagctgtgccccacaag

SEQ ID NO: 197021 - DNA, 25 bp, Homo sapien
ataccgcgtcctgcaggtcggaaac

SEQ ID NO: 197022 - DNA, 25 bp, Homo sapien
ggcactttggataccgcgtcctgca

SEQ ID NO: 197023 - DNA, 25 bp, Homo sapien
ccgggaggcactttggataccgcgt

SEQ ID NO: 197024 - DNA, 25 bp, Homo sapien
cggcctcgagctacaacctggacgt

SEQ ID NO: 197025 - DNA, 25 bp, Homo sapien
ggtcgcagctgacgacccttgcctt

SEQ ID NO: 197026 - DNA, 25 bp, Homo sapien
cctcgcctgggctagtcggtggcac

SEQ ID NO: 197027 - DNA, 25 bp, Homo sapien
cgaccctcgcctgggctagtcggtg

SEQ ID NO: 197028 - DNA, 25 bp, Homo sapien
atgccacagctgaagggcctctgac

SEQ ID NO: 197029 - DNA, 25 bp, Homo sapien
gagaaggcctttccgcagtcatcgc

SEQ ID NO: 197030 - DNA, 25 bp, Homo sapien
tcttgccgcagatgccacagctgaa

SEQ ID NO: 197031 - DNA, 25 bp, Homo sapien
tctgaccggtgtgcaccctctgatg

SEQ ID NO: 197032 - DNA, 25 bp, Homo sapien
cagggacgagttctggctatagcac

SEQ ID NO: 197033 - DNA, 25 bp, Homo sapien
ccttgccacaatgtgggcacttgta

SEQ ID NO: 197034 - DNA, 25 bp, Homo sapien
gccttgccgcaacggggacatttgt

SEQ ID NO: 197035 - DNA, 25 bp, Homo sapien
cgagctctggccaaagcgcttgccg

SEQ ID NO: 197036 - DNA, 25 bp, Homo sapien
ccaacaacgttctctcggaagcaga

SEQ ID NO: 197037 - DNA, 25 bp, Homo sapien
aagagctcaacgctttccaggtgtg

SEQ ID NO: 197038 - DNA, 25 bp, Homo sapien
tgacgcgcatcttcaggctctcaga

SEQ ID NO: 197039 - DNA, 25 bp, Homo sapien
ggtgcaggtttcctcttcctgaaca

SEQ ID NO: 197040 - DNA, 25 bp, Homo sapien
ccaggcgctcagtgacgaagagctc

SEQ ID NO: 197041 - DNA, 25 bp, Homo sapien
tggctggctgactcccaacaacgtt

SEQ ID NO: 197042 - DNA, 25 bp, Homo sapien
ttgaacctccgctgccgttagtgac

SEQ ID NO: 197043 - DNA, 25 bp, Homo sapien
ttagtgactggaacgggtcgtctcc

SEQ ID NO: 197044 - DNA, 25 bp, Homo sapien
cacaggaagtgtccgtccgcggcca

SEQ ID NO: 197045 - DNA, 25 bp, Homo sapien
ctggaggtggaaactcgttggcatt

SEQ ID NO: 197046 - DNA, 25 bp, Homo sapien
tcgttggcattaaccctgggctgga

SEQ ID NO: 197047 - DNA, 25 bp, Homo sapien
ctaccggggcagtgtgtgtgcctat

SEQ ID NO: 197048 - DNA, 25 bp, Homo sapien
tgtgcctatgttctaggtctccgtc

SEQ ID NO: 197049 - DNA, 25 bp, Homo sapien
gaggcgacaagcgagaccaaggtca

SEQ ID NO: 197050 - DNA, 25 bp, Homo sapien
cgccgaggtccttgagcctgggacc

SEQ ID NO: 197051 - DNA, 25 bp, Homo sapien
cctcgagggctaggatagttgccaa

SEQ ID NO: 197052 - DNA, 25 bp, Homo sapien
tgaaggcccgaccacactcgggaca

SEQ ID NO: 197053 - DNA, 25 bp, Homo sapien
gacccattggtgcttggccatgccg

SEQ ID NO: 197054 - DNA, 25 bp, Homo sapien
ccgatggacccattggtgcttggcc

SEQ ID NO: 197055 - DNA, 25 bp, Homo sapien
tggctgtaaatgtgctccaccagtg

SEQ ID NO: 197056 - DNA, 25 bp, Homo sapien
tgcggcgcatgaaggcccgaccaca

SEQ ID NO: 197057 - DNA, 25 bp, Homo sapien
aagcagcggccacactgcgggcagc

SEQ ID NO: 197058 - DNA, 25 bp, Homo sapien
tcttcaggccgaagcagcggccaca

SEQ ID NO: 197059 - DNA, 25 bp, Homo sapien
tggccatgccggtcttcaggccgaa

SEQ ID NO: 197060 - DNA, 25 bp, Homo sapien
atggtcagaactggacgatgtcttc

SEQ ID NO: 197061 - DNA, 25 bp, Homo sapien
tgtcttcaaataaaacggcggcagc

SEQ ID NO: 197062 - DNA, 25 bp, Homo sapien
ctgcgcaattgtacccacgacgacg

SEQ ID NO: 197063 - DNA, 25 bp, Homo sapien
ttgccctaatccaaaatggccgttg

SEQ ID NO: 197064 - DNA, 25 bp, Homo sapien
acaggcgccggccttgaaaaccagc

SEQ ID NO: 197065 - DNA, 25 bp, Homo sapien
tttgcgggaacaaagcagcgccctg

SEQ ID NO: 197066 - DNA, 25 bp, Homo sapien
gcagccctcgtgaactcagaagtta

SEQ ID NO: 197067 - DNA, 25 bp, Homo sapien
tcactgtctcgttttgtcctcagaa

SEQ ID NO: 197068 - DNA, 25 bp, Homo sapien
ctgccatctccgagctctggcggaa

SEQ ID NO: 197069 - DNA, 25 bp, Homo sapien
aacccactggtgtttggccacggct

SEQ ID NO: 197070 - DNA, 25 bp, Homo sapien
cacagtcggcgcagccatagggttt

SEQ ID NO: 197071 - DNA, 25 bp, Homo sapien
tctcgccagtgtgactgtagacgtg

SEQ ID NO: 197072 - DNA, 25 bp, Homo sapien
tgactgtagacgtgctccaccagtg

SEQ ID NO: 197073 - DNA, 25 bp, Homo sapien
tcgggcctcccgtaatgtctagata

SEQ ID NO: 197074 - DNA, 25 bp, Homo sapien
agggtcacagacagacgcccggcga

SEQ ID NO: 197075 - DNA, 25 bp, Homo sapien
ctcctggaatatctccgggtacagc

SEQ ID NO: 197076 - DNA, 25 bp, Homo sapien
gtgactaatacagaggccggccttg

SEQ ID NO: 197077 - DNA, 25 bp, Homo sapien
gcggaacctcctgcgcccgagaaag

SEQ ID NO: 197078 - DNA, 25 bp, Homo sapien
ccctcatccaaaatggccgcggtga

SEQ ID NO: 197079 - DNA, 25 bp, Homo sapien
ccttgaaaactagccgcgcatgttt

SEQ ID NO: 197080 - DNA, 25 bp, Homo sapien
ctacgcagtcgtgcccaagacaacg

SEQ ID NO: 197081 - DNA, 25 bp, Homo sapien
ggcggcgccatggtaactgtcaacc

SEQ ID NO: 197082 - DNA, 25 bp, Homo sapien
gtttgcacgaacaaaagagcgcctc

SEQ ID NO: 197083 - DNA, 25 bp, Homo sapien
ccggccttactgaactcaggcatta

SEQ ID NO: 197084 - DNA, 25 bp, Homo sapien
ggacgcgaacatccctataccgcag

SEQ ID NO: 197085 - DNA, 25 bp, Homo sapien
caggaggttccacggacgcctcgac

SEQ ID NO: 197086 - DNA, 25 bp, Homo sapien
ttccctggttcattggcttggagcc

SEQ ID NO: 197087 - DNA, 25 bp, Homo sapien
acgcctcgacgaccggtagtagctt

SEQ ID NO: 197088 - DNA, 25 bp, Homo sapien
gtcccggatcaggacgcgaacatcc

SEQ ID NO: 197089 - DNA, 25 bp, Homo sapien
caggtcgcggcatcgcgtcccggat

SEQ ID NO: 197090 - DNA, 25 bp, Homo sapien
ttccaccttccctggttcattggct

SEQ ID NO: 197091 - DNA, 25 bp, Homo sapien
ttccgcggagctctcggtcctcaga

SEQ ID NO: 197092 - DNA, 25 bp, Homo sapien
agtccgtgcacacgtggcgccgctg

SEQ ID NO: 197093 - DNA, 25 bp, Homo sapien
tgcgcctgtggctgaccagcagtga

SEQ ID NO: 197094 - DNA, 25 bp, Homo sapien
gaacttcctcttgaagcgcatgcca

SEQ ID NO: 197095 - DNA, 25 bp, Homo sapien
agtgcatgcgcctgtggctgaccag

SEQ ID NO: 197096 - DNA, 25 bp, Homo sapien
tggatccactggtgcgcttccactg

SEQ ID NO: 197097 - DNA, 25 bp, Homo sapien
gctcagccgcactcctcgaagatgt

SEQ ID NO: 197098 - DNA, 25 bp, Homo sapien
gcttccactgcgaacttcctcttga

SEQ ID NO: 197099 - DNA, 25 bp, Homo sapien
tcctcgaagatgtctgggtagtgcc

SEQ ID NO: 197100 - DNA, 25 bp, Homo sapien
cccgaatttcggcagaggtgcctcg

SEQ ID NO: 197101 - DNA, 25 bp, Homo sapien
ggtgaacgactacacgcacgccctg

SEQ ID NO: 197102 - DNA, 25 bp, Homo sapien
tcccgctctgagctcgggaaacggc

SEQ ID NO: 197103 - DNA, 25 bp, Homo sapien
cagccagcgccactgttaatccagg

SEQ ID NO: 197104 - DNA, 25 bp, Homo sapien
tgttaatccagggagcgcacccacc

SEQ ID NO: 197105 - DNA, 25 bp, Homo sapien
cgcacccaccgaggaggcgtcttag

SEQ ID NO: 197106 - DNA, 25 bp, Homo sapien
ggtgtacgagcccacgccgatccat

SEQ ID NO: 197107 - DNA, 25 bp, Homo sapien
ccgacgcccttttacatcgaggaca

SEQ ID NO: 197108 - DNA, 25 bp, Homo sapien
ccgcaatacgcaacggccgatgatt

SEQ ID NO: 197109 - DNA, 25 bp, Homo sapien
agtagcttagctgcggagtccaccc

SEQ ID NO: 197110 - DNA, 25 bp, Homo sapien
caggtgcgtgttttacagtagctta

SEQ ID NO: 197111 - DNA, 25 bp, Homo sapien
cgcggtcctgaagcctctgttgaca

SEQ ID NO: 197112 - DNA, 25 bp, Homo sapien
agggcgccattatttgaccatatca

SEQ ID NO: 197113 - DNA, 25 bp, Homo sapien
tgtcacaggctgctcttaagggcgc

SEQ ID NO: 197114 - DNA, 25 bp, Homo sapien
gtttattcacttcatggccgcttgg

SEQ ID NO: 197115 - DNA, 25 bp, Homo sapien
cgcacaccctggcaaaccatgtgta

SEQ ID NO: 197116 - DNA, 25 bp, Homo sapien
tgaagcgactcttgcagtctgagca

SEQ ID NO: 197117 - DNA, 25 bp, Homo sapien
ggtggatccaccgatgggcttccag

SEQ ID NO: 197118 - DNA, 25 bp, Homo sapien
taggggtaagtgaagcgactcttgc

SEQ ID NO: 197119 - DNA, 25 bp, Homo sapien
cttccagggcggtcttgcgcttgaa

SEQ ID NO: 197120 - DNA, 25 bp, Homo sapien
tgcagtctgagcacgcgtaaggctt

SEQ ID NO: 197121 - DNA, 25 bp, Homo sapien
cccgcctgtggatagccagggaacc

SEQ ID NO: 197122 - DNA, 25 bp, Homo sapien
tcgccggtgtggatgaactgatgct

SEQ ID NO: 197123 - DNA, 25 bp, Homo sapien
aactgatgctggagcaggtacctgc

SEQ ID NO: 197124 - DNA, 25 bp, Homo sapien
gagaatgagactgctccctcggcgc

SEQ ID NO: 197125 - DNA, 25 bp, Homo sapien
tcaccgcttcccaccgacggactgg

SEQ ID NO: 197126 - DNA, 25 bp, Homo sapien
tagcctctggggacaccgatcaccg

SEQ ID NO: 197127 - DNA, 25 bp, Homo sapien
tccttccacccacgagataaaagcg

SEQ ID NO: 197128 - DNA, 25 bp, Homo sapien
cacccacgagataaaagcgggtttg

SEQ ID NO: 197129 - DNA, 25 bp, Homo sapien
ggtttgggaactgaaaatcctgcga

SEQ ID NO: 197130 - DNA, 25 bp, Homo sapien
actgaaaatcctgcgaaggagaaac

SEQ ID NO: 197131 - DNA, 25 bp, Homo sapien
aaggagaaacaatgggctcggctga

SEQ ID NO: 197132 - DNA, 25 bp, Homo sapien
tcacccagcaggtagtcggcaggta

SEQ ID NO: 197133 - DNA, 25 bp, Homo sapien
ttcctcgttatctgcccgacaatgg

SEQ ID NO: 197134 - DNA, 25 bp, Homo sapien
ttccggatccagcaggtacagctcg

SEQ ID NO: 197135 - DNA, 25 bp, Homo sapien
gcacgtcgccctgctcagcgtagaa

SEQ ID NO: 197136 - DNA, 25 bp, Homo sapien
gtgctcagcttgaccacctcgttgg

SEQ ID NO: 197137 - DNA, 25 bp, Homo sapien
agacccttgactacgtggtggcaga

SEQ ID NO: 197138 - DNA, 25 bp, Homo sapien
ctggcaccacacgaagagacccttg

SEQ ID NO: 197139 - DNA, 25 bp, Homo sapien
acccgttcacccaggacgatgagca

SEQ ID NO: 197140 - DNA, 25 bp, Homo sapien
ggaagccgctacgttcacgcgcagg

SEQ ID NO: 197141 - DNA, 25 bp, Homo sapien
acagggaactggagcgttcctccca

SEQ ID NO: 197142 - DNA, 25 bp, Homo sapien
tctcactgggaaagtcgaatgtgtg

SEQ ID NO: 197143 - DNA, 25 bp, Homo sapien
tcagcgaagcaagtgaggcatctca

SEQ ID NO: 197144 - DNA, 25 bp, Homo sapien
gctggcaactcttcccgatacctga

SEQ ID NO: 197145 - DNA, 25 bp, Homo sapien
ttcacagtcaagctgccaggccagc

SEQ ID NO: 197146 - DNA, 25 bp, Homo sapien
cgggttccgaagagacctcagcagg

SEQ ID NO: 197147 - DNA, 25 bp, Homo sapien
tagcacctctcgtggcgctccagaa

SEQ ID NO: 197148 - DNA, 25 bp, Homo sapien
cccaacttggctatgaaggaggtta

SEQ ID NO: 197149 - DNA, 25 bp, Homo sapien
ccctgtgccacagaagcgagacatc

SEQ ID NO: 197150 - DNA, 25 bp, Homo sapien
ctctggcgtcttctcaggtgggtaa

SEQ ID NO: 197151 - DNA, 25 bp, Homo sapien
tcaaggttgagcgtagcatgccacc

SEQ ID NO: 197152 - DNA, 25 bp, Homo sapien
tctgctgttggactctggactgttt

SEQ ID NO: 197153 - DNA, 25 bp, Homo sapien
actgcagcgtgtgggtcattttgac

SEQ ID NO: 197154 - DNA, 25 bp, Homo sapien
gtggcatcacctacgaccgcaagga

SEQ ID NO: 197155 - DNA, 25 bp, Homo sapien
ggccattgccgccactatctgtgta

SEQ ID NO: 197156 - DNA, 25 bp, Homo sapien
cttggagcaaaggtcgcaggcatag

SEQ ID NO: 197157 - DNA, 25 bp, Homo sapien
ggaaggcacgcccacagtctgggca

SEQ ID NO: 197158 - DNA, 25 bp, Homo sapien
ccagagtgcacacgccggtgactga

SEQ ID NO: 197159 - DNA, 25 bp, Homo sapien
gggcctcacagtgctcgcaggcata

SEQ ID NO: 197160 - DNA, 25 bp, Homo sapien
cttctctccggtgtgcaagagctgg

SEQ ID NO: 197161 - DNA, 25 bp, Homo sapien
tgcactcgaggcaagtgtagggctt

SEQ ID NO: 197162 - DNA, 25 bp, Homo sapien
gtgcagcttctcctctgtgtgcgtg

SEQ ID NO: 197163 - DNA, 25 bp, Homo sapien
cgaccacagtcgtcgcaggcgtgca

SEQ ID NO: 197164 - DNA, 25 bp, Homo sapien
tacgcgcgttcattggacgagagcc

SEQ ID NO: 197165 - DNA, 25 bp, Homo sapien
aggcagcttccagctatcgatttta

SEQ ID NO: 197166 - DNA, 25 bp, Homo sapien
cctcaagtgtaatggcgctgcgatt

SEQ ID NO: 197167 - DNA, 25 bp, Homo sapien
ccggaagatgccttcggggaaaatg

SEQ ID NO: 197168 - DNA, 25 bp, Homo sapien
gacgagagccgaagatcgagcgttc

SEQ ID NO: 197169 - DNA, 25 bp, Homo sapien
cgagcgttctgattgggtgctagca

SEQ ID NO: 197170 - DNA, 25 bp, Homo sapien
caggaaactcctgcccgaacttggg

SEQ ID NO: 197171 - DNA, 25 bp, Homo sapien
cggaaaccttttgctgttattcagg

SEQ ID NO: 197172 - DNA, 25 bp, Homo sapien
cagtctctaggatcgcgctcgctga

SEQ ID NO: 197173 - DNA, 25 bp, Homo sapien
ggcccgacaatgtagccacggagtc

SEQ ID NO: 197174 - DNA, 25 bp, Homo sapien
cccacgtgcattctaggtcaacggt

SEQ ID NO: 197175 - DNA, 25 bp, Homo sapien
tccgagactggagactggacctttg

SEQ ID NO: 197176 - DNA, 25 bp, Homo sapien
ccaggccggcgtcattaggatcctg

SEQ ID NO: 197177 - DNA, 25 bp, Homo sapien
tctggtcgaacgtccaaacaaggtg

SEQ ID NO: 197178 - DNA, 25 bp, Homo sapien
cgtcacggatcctggtcagtctcta

SEQ ID NO: 197179 - DNA, 25 bp, Homo sapien
gctcgctgataggacgcttctggtc

SEQ ID NO: 197180 - DNA, 25 bp, Homo sapien
tatctgcttgacagtggatccctgg

SEQ ID NO: 197181 - DNA, 25 bp, Homo sapien
tctcggggcataatctgcagggaca

SEQ ID NO: 197182 - DNA, 25 bp, Homo sapien
ggatccagcggaaatagcctcccag

SEQ ID NO: 197183 - DNA, 25 bp, Homo sapien
agtattgctttggagtcctcggcca

SEQ ID NO: 197184 - DNA, 25 bp, Homo sapien
ggattctttcctcagggatccagtc

SEQ ID NO: 197185 - DNA, 25 bp, Homo sapien
cggaaccgcgctgtaggattctttc

SEQ ID NO: 197186 - DNA, 25 bp, Homo sapien
tctacgctgagttcggagatgctcc

SEQ ID NO: 197187 - DNA, 25 bp, Homo sapien
accgtgccgggaaactacagagcca

SEQ ID NO: 197188 - DNA, 25 bp, Homo sapien
ctgctgttagaaggaccctggactc

SEQ ID NO: 197189 - DNA, 25 bp, Homo sapien
agccggaggacttgagacactttta

SEQ ID NO: 197190 - DNA, 25 bp, Homo sapien
gccgcttgtggaggactagaaacta

SEQ ID NO: 197191 - DNA, 25 bp, Homo sapien
ggactgcaacgccagccttaaaggg

SEQ ID NO: 197192 - DNA, 25 bp, Homo sapien
tggccactgaactcggcggactgca

SEQ ID NO: 197193 - DNA, 25 bp, Homo sapien
ccctaaggcccaagtcggacagaga

SEQ ID NO: 197194 - DNA, 25 bp, Homo sapien
tcttcctcggggagacttgcatcga

SEQ ID NO: 197195 - DNA, 25 bp, Homo sapien
agaagcgccctaagactccaaagga

SEQ ID NO: 197196 - DNA, 25 bp, Homo sapien
ccagttactgtctctcgcgagaaga

SEQ ID NO: 197197 - DNA, 25 bp, Homo sapien
ggagtagcgtctgccctttttccca

SEQ ID NO: 197198 - DNA, 25 bp, Homo sapien
tccgcatctgtgtgctgcgcgaaga

SEQ ID NO: 197199 - DNA, 25 bp, Homo sapien
cgcgcgcccatagagacagactgag

SEQ ID NO: 197200 - DNA, 25 bp, Homo sapien
ttctctcagcctttcgcggtcgggt

SEQ ID NO: 197201 - DNA, 25 bp, Homo sapien
gcttggatgacgagcttcccagccc

SEQ ID NO: 197202 - DNA, 25 bp, Homo sapien
gcaaacggtaaaggcgctccgagga

SEQ ID NO: 197203 - DNA, 25 bp, Homo sapien
ccggcgatagcgattccgagcgagt

SEQ ID NO: 197204 - DNA, 25 bp, Homo sapien
ttccttgggttactgctgggaccgc

SEQ ID NO: 197205 - DNA, 25 bp, Homo sapien
gctaacgttttcacagtgcgccctg

SEQ ID NO: 197206 - DNA, 25 bp, Homo sapien
gccatagcccatggggtggctttaa

SEQ ID NO: 197207 - DNA, 25 bp, Homo sapien
attgacggaaatgttgccatagccc

SEQ ID NO: 197208 - DNA, 25 bp, Homo sapien
gcaaagagtttttcgagctagacca

SEQ ID NO: 197209 - DNA, 25 bp, Homo sapien
gtgcgccctgagtttccttgggtta

SEQ ID NO: 197210 - DNA, 25 bp, Homo sapien
ttggaggctcctcgcgcaacctaat

SEQ ID NO: 197211 - DNA, 25 bp, Homo sapien
gctagaccaacaggaaacacattga

SEQ ID NO: 197212 - DNA, 25 bp, Homo sapien
atgccactcggtgattggccgcgtc

SEQ ID NO: 197213 - DNA, 25 bp, Homo sapien
gttgcagccttaggtccagccgagc

SEQ ID NO: 197214 - DNA, 25 bp, Homo sapien
ttccaattggaagggcttctgagcc

SEQ ID NO: 197215 - DNA, 25 bp, Homo sapien
ctccttcaggatgacgctggacgtg

SEQ ID NO: 197216 - DNA, 25 bp, Homo sapien
gccgccgccaaagagttttaccaga

SEQ ID NO: 197217 - DNA, 25 bp, Homo sapien
ccctaaggacgtcatcggcaggtaa

SEQ ID NO: 197218 - DNA, 25 bp, Homo sapien
ccagcattcccgcttccgtttgaag

SEQ ID NO: 197219 - DNA, 25 bp, Homo sapien
tccgtttgaaggctggagagttcgc

SEQ ID NO: 197220 - DNA, 25 bp, Homo sapien
ggagccggtttataaatattcacga

SEQ ID NO: 197221 - DNA, 25 bp, Homo sapien
gacgtcccgaacgttagtaagcata

SEQ ID NO: 197222 - DNA, 25 bp, Homo sapien
gcccagtgacgtccggtgaaatcca

SEQ ID NO: 197223 - DNA, 25 bp, Homo sapien
gtggcgggaccaagcgtaaccaata

SEQ ID NO: 197224 - DNA, 25 bp, Homo sapien
ttactatgggaactgcctcttggcc

SEQ ID NO: 197225 - DNA, 25 bp, Homo sapien
ggcgccctctcttccaggttgctaa

SEQ ID NO: 197226 - DNA, 25 bp, Homo sapien
cgccgcagctcggagagatgttcaa

SEQ ID NO: 197227 - DNA, 25 bp, Homo sapien
atacgtgagaagttgcgagtgccca

SEQ ID NO: 197228 - DNA, 25 bp, Homo sapien
ccgcagagaaagtgccgatggcctg

SEQ ID NO: 197229 - DNA, 25 bp, Homo sapien
aagtgtagttcctggtccgcacatg

SEQ ID NO: 197230 - DNA, 25 bp, Homo sapien
gagagagctagtttcccggttgcgc

SEQ ID NO: 197231 - DNA, 25 bp, Homo sapien
tcgaatgcacagatcgggacacctc

SEQ ID NO: 197232 - DNA, 25 bp, Homo sapien
gggtgacttccctcgttgcaatcgg

SEQ ID NO: 197233 - DNA, 25 bp, Homo sapien
attgcatcatagagacgcggccacc

SEQ ID NO: 197234 - DNA, 25 bp, Homo sapien
tccgcacatggttaggaggttctcg

SEQ ID NO: 197235 - DNA, 25 bp, Homo sapien
ggtctgaccacgtccttggctgtca

SEQ ID NO: 197236 - DNA, 25 bp, Homo sapien
tccgagctgcggtagaaagcccggc

SEQ ID NO: 197237 - DNA, 25 bp, Homo sapien
tctcatggatcacccggtgctgctc

SEQ ID NO: 197238 - DNA, 25 bp, Homo sapien
gcagtcggagcacacgaacaggttc

SEQ ID NO: 197239 - DNA, 25 bp, Homo sapien
aacaggttctcgtccatgtgcgtgc

SEQ ID NO: 197240 - DNA, 25 bp, Homo sapien
acactgggcacttgaacgggtcctc

SEQ ID NO: 197241 - DNA, 25 bp, Homo sapien
tcttgccgcagtcggaacacttgta

SEQ ID NO: 197242 - DNA, 25 bp, Homo sapien
tgaaggctttctcgcactccgtgca

SEQ ID NO: 197243 - DNA, 25 bp, Homo sapien
gtcagctccgagctctggatgaagc

SEQ ID NO: 197244 - DNA, 25 bp, Homo sapien
gcagggtccagcttgcgcttaaaga

SEQ ID NO: 197245 - DNA, 25 bp, Homo sapien
gtgcgtggtcatgtcccagaccttc

SEQ ID NO: 197246 - DNA, 25 bp, Homo sapien
ggcgcacgtcccaaacatagatgtt

SEQ ID NO: 197247 - DNA, 25 bp, Homo sapien
caggcaattcccgtggtgacgtctc

SEQ ID NO: 197248 - DNA, 25 bp, Homo sapien
cctggctccgtctcaaagacactga

SEQ ID NO: 197249 - DNA, 25 bp, Homo sapien
tgtgtccacaaaccagcgcatgccg

SEQ ID NO: 197250 - DNA, 25 bp, Homo sapien
gccacctttgcgttgtggtcacaga

SEQ ID NO: 197251 - DNA, 25 bp, Homo sapien
gtgacgtctcggtgttcctcaaaca

SEQ ID NO: 197252 - DNA, 25 bp, Homo sapien
aacggcccagggtgaccctgacatg

SEQ ID NO: 197253 - DNA, 25 bp, Homo sapien
ccgcctcccgagagatgtggggaac

SEQ ID NO: 197254 - DNA, 25 bp, Homo sapien
gctgctgatacagagcctgggcatc

SEQ ID NO: 197255 - DNA, 25 bp, Homo sapien
tggggtccttctcaaggggtgattc

SEQ ID NO: 197256 - DNA, 25 bp, Homo sapien
gcctggagtcagagcatcagctcta

SEQ ID NO: 197257 - DNA, 25 bp, Homo sapien
gcatcagctctatgggatttaaccc

SEQ ID NO: 197258 - DNA, 25 bp, Homo sapien
tctggccgctcttcatttcgcaggg

SEQ ID NO: 197259 - DNA, 25 bp, Homo sapien
acgccagcctgagacctcgcgatgg

SEQ ID NO: 197260 - DNA, 25 bp, Homo sapien
cctgactcccgaattccagcaaggg

SEQ ID NO: 197261 - DNA, 25 bp, Homo sapien
ttccagcaagggagaatcaggcgct

SEQ ID NO: 197262 - DNA, 25 bp, Homo sapien
ccttctcaggaggaaagcgagcgaa

SEQ ID NO: 197263 - DNA, 25 bp, Homo sapien
cctccgagctcagaggcagtgccga

SEQ ID NO: 197264 - DNA, 25 bp, Homo sapien
gttattcccactgagacgcggtcgc

SEQ ID NO: 197265 - DNA, 25 bp, Homo sapien
agcgagcgaacacctcacgcggcga

SEQ ID NO: 197266 - DNA, 25 bp, Homo sapien
tcttccaggacctcggctgcttttc

SEQ ID NO: 197267 - DNA, 25 bp, Homo sapien
catcattcggcccttctcaggagga

SEQ ID NO: 197268 - DNA, 25 bp, Homo sapien
cgggtccacagtgcagcctgaatga

SEQ ID NO: 197269 - DNA, 25 bp, Homo sapien
tgcggcgacctagcaaccgtccttg

SEQ ID NO: 197270 - DNA, 25 bp, Homo sapien
tcctttggttctctccgcggcggaa

SEQ ID NO: 197271 - DNA, 25 bp, Homo sapien
tttacaacggtgagccaatcccagg

SEQ ID NO: 197272 - DNA, 25 bp, Homo sapien
gggagattacgcaacacgggtctta

SEQ ID NO: 197273 - DNA, 25 bp, Homo sapien
tccgaattcgctggatctggaccca

SEQ ID NO: 197274 - DNA, 25 bp, Homo sapien
ggccgctgaggattctccgaattcg

SEQ ID NO: 197275 - DNA, 25 bp, Homo sapien
acacgggtcttagttgtctgggccg

SEQ ID NO: 197276 - DNA, 25 bp, Homo sapien
agagggccgaggaagccaccatcac

SEQ ID NO: 197277 - DNA, 25 bp, Homo sapien
ggaagccaccatcacgcagcgtgtc

SEQ ID NO: 197278 - DNA, 25 bp, Homo sapien
gagcccttgacaccgtccagcaggt

SEQ ID NO: 197279 - DNA, 25 bp, Homo sapien
gcgagtcttattccagcgcggcgcc

SEQ ID NO: 197280 - DNA, 25 bp, Homo sapien
ccagtggctgtgctgcgagtcttat

SEQ ID NO: 197281 - DNA, 25 bp, Homo sapien
gcctcagtcaaagccgtgccagtgg

SEQ ID NO: 197282 - DNA, 25 bp, Homo sapien
atcacgcagcgtgtcacggggacca

SEQ ID NO: 197283 - DNA, 25 bp, Homo sapien
acaccgtccagcaggtgggcatgcc

SEQ ID NO: 197284 - DNA, 25 bp, Homo sapien
tatgcatggacgtccaggtgccacg

SEQ ID NO: 197285 - DNA, 25 bp, Homo sapien
gcacgggcctcaacatatgcatgga

SEQ ID NO: 197286 - DNA, 25 bp, Homo sapien
ctaggcctctagcaaggcggcctca

SEQ ID NO: 197287 - DNA, 25 bp, Homo sapien
atggcacactcagaccgctgggagg

SEQ ID NO: 197288 - DNA, 25 bp, Homo sapien
tcaggcactggatgtggtccgagtt

SEQ ID NO: 197289 - DNA, 25 bp, Homo sapien
tcgccctccgatgttaccgcggtgg

SEQ ID NO: 197290 - DNA, 25 bp, Homo sapien
ctggcatacataagccctggcgtgc

SEQ ID NO: 197291 - DNA, 25 bp, Homo sapien
cttcccatgcattcgggcgccagtg

SEQ ID NO: 197292 - DNA, 25 bp, Homo sapien
tgccctctggcacgtcccgacgcgg

SEQ ID NO: 197293 - DNA, 25 bp, Homo sapien
tgctgcagctcagcgagagacaggt

SEQ ID NO: 197294 - DNA, 25 bp, Homo sapien
agcgtctggccaagatgctgcagct

SEQ ID NO: 197295 - DNA, 25 bp, Homo sapien
aagaaattcgagacgcagaaatatc

SEQ ID NO: 197296 - DNA, 25 bp, Homo sapien
ctctccgcccgagaggaagcgtctg

SEQ ID NO: 197297 - DNA, 25 bp, Homo sapien
ccgagaggaagcgtctggccaagat

SEQ ID NO: 197298 - DNA, 25 bp, Homo sapien
agaggaagcgtctggccaagatgct

SEQ ID NO: 197299 - DNA, 25 bp, Homo sapien
agacgcagaaatatctctctccgcc

SEQ ID NO: 197300 - DNA, 25 bp, Homo sapien
ggctgcgtctgtggccttaaccctt

SEQ ID NO: 197301 - DNA, 25 bp, Homo sapien
tgtctccgcggagcgtcacaaaggt

SEQ ID NO: 197302 - DNA, 25 bp, Homo sapien
tctggcctagatgcgagtttcccgc

SEQ ID NO: 197303 - DNA, 25 bp, Homo sapien
ccacagcccagatcgcgagtgcgga

SEQ ID NO: 197304 - DNA, 25 bp, Homo sapien
tccatggcgcaagggagctgaagaa

SEQ ID NO: 197305 - DNA, 25 bp, Homo sapien
taacgggcatacagtgggttccatg

SEQ ID NO: 197306 - DNA, 25 bp, Homo sapien
ctttcctgactgcataacgggcata

SEQ ID NO: 197307 - DNA, 25 bp, Homo sapien
gggttgcagcgtaacgccctccttc

SEQ ID NO: 197308 - DNA, 25 bp, Homo sapien
agttgcgaccggacgcgcgaggcag

SEQ ID NO: 197309 - DNA, 25 bp, Homo sapien
ggccgaggccgtgtgttcagaccac

SEQ ID NO: 197310 - DNA, 25 bp, Homo sapien
acggagagcgggagttgcgaccgga

SEQ ID NO: 197311 - DNA, 25 bp, Homo sapien
cgaggccgtgtgttcagaccacgtg

SEQ ID NO: 197312 - DNA, 25 bp, Homo sapien
gtctgtgtcctgcgctgcgtgagcc

SEQ ID NO: 197313 - DNA, 25 bp, Homo sapien
gggtgcgcgacagggtctgtgtcct

SEQ ID NO: 197314 - DNA, 25 bp, Homo sapien
ccgtgtgttcagaccacgtgggcgc

SEQ ID NO: 197315 - DNA, 25 bp, Homo sapien
gtgtccgcgaaacgctgtgtgtgga

SEQ ID NO: 197316 - DNA, 25 bp, Homo sapien
tgctggacgcagtgtgtcgccgcca

SEQ ID NO: 197317 - DNA, 25 bp, Homo sapien
cctcctcccgctgggttccgtctct

SEQ ID NO: 197318 - DNA, 25 bp, Homo sapien
accgcgagtggctgagccgcaccga

SEQ ID NO: 197319 - DNA, 25 bp, Homo sapien
ctctaccgcgagtggctgagccgca

SEQ ID NO: 197320 - DNA, 25 bp, Homo sapien
tttgcggcctctaccgcgagtggct

SEQ ID NO: 197321 - DNA, 25 bp, Homo sapien
ggggctccgcgtttgcggcctctac

SEQ ID NO: 197322 - DNA, 25 bp, Homo sapien
cgccaggccgagctgaacccgcgcg

SEQ ID NO: 197323 - DNA, 25 bp, Homo sapien
tctctccttccgcttctttgtcttt

SEQ ID NO: 197324 - DNA, 25 bp, Homo sapien
agcctgccatctttacggtagtctc

SEQ ID NO: 197325 - DNA, 25 bp, Homo sapien
gccgtcctgtttgtagttcccgctg

SEQ ID NO: 197326 - DNA, 25 bp, Homo sapien
tcaggtaccacacacgcggagggtt

SEQ ID NO: 197327 - DNA, 25 bp, Homo sapien
atggactgcgactcccgtcaggtac

SEQ ID NO: 197328 - DNA, 25 bp, Homo sapien
gccatcttgcttgtagtcctctttc

SEQ ID NO: 197329 - DNA, 25 bp, Homo sapien
aggtgtatgtccctcttccgccatc

SEQ ID NO: 197330 - DNA, 25 bp, Homo sapien
gtcctcctggttccgccattcttaa

SEQ ID NO: 197331 - DNA, 25 bp, Homo sapien
tcgcacctcgtaagatcgactacta

SEQ ID NO: 197332 - DNA, 25 bp, Homo sapien
cgactcttcgggcacatcgctgagt

SEQ ID NO: 197333 - DNA, 25 bp, Homo sapien
cagagggagaagctagagcgtttca

SEQ ID NO: 197334 - DNA, 25 bp, Homo sapien
acatcgctgagtgaggacgaagccc

SEQ ID NO: 197335 - DNA, 25 bp, Homo sapien
ggcctccacagctggagcggcacgt

SEQ ID NO: 197336 - DNA, 25 bp, Homo sapien
ggagctgtgtatctgcatgcgagtc

SEQ ID NO: 197337 - DNA, 25 bp, Homo sapien
tctgcatgcgagtctgccgaacttg

SEQ ID NO: 197338 - DNA, 25 bp, Homo sapien
cgtttcaagcggatgtgccagctgc

SEQ ID NO: 197339 - DNA, 25 bp, Homo sapien
cgagtctgccgaacttggagccgct

SEQ ID NO: 197340 - DNA, 25 bp, Homo sapien
tactaaaagcgcacggttgtccgga

SEQ ID NO: 197341 - DNA, 25 bp, Homo sapien
ccctctcaggaagtgggcacaaact

SEQ ID NO: 197342 - DNA, 25 bp, Homo sapien
gggacgtcaaggaccgagctactta

SEQ ID NO: 197343 - DNA, 25 bp, Homo sapien
ctacttaaggagctcgaggtgtctg

SEQ ID NO: 197344 - DNA, 25 bp, Homo sapien
gaagtggtcctcttcttacccatcc

SEQ ID NO: 197345 - DNA, 25 bp, Homo sapien
agtgggcacaaactctcgcccgaca

SEQ ID NO: 197346 - DNA, 25 bp, Homo sapien
ctcgccggaagtggtcctcttctta

SEQ ID NO: 197347 - DNA, 25 bp, Homo sapien
cgacaccacgaaagttccgggtcag

SEQ ID NO: 197348 - DNA, 25 bp, Homo sapien
tgagcgccctggacctgagccactg

SEQ ID NO: 197349 - DNA, 25 bp, Homo sapien
gctgccctcgtctacgccgcctaga

SEQ ID NO: 197350 - DNA, 25 bp, Homo sapien
gttgccaccgcctaacggaccactg

SEQ ID NO: 197351 - DNA, 25 bp, Homo sapien
tgtggatccccacggccagtgccaa

SEQ ID NO: 197352 - DNA, 25 bp, Homo sapien
caatcttgctggtaagcacggtccc

SEQ ID NO: 197353 - DNA, 25 bp, Homo sapien
ctggtgcacctcaatcttgctggta

SEQ ID NO: 197354 - DNA, 25 bp, Homo sapien
gcgagaccctggtgcacctcaatct

SEQ ID NO: 197355 - DNA, 25 bp, Homo sapien
acccgaagcttgtgcccggctggca

SEQ ID NO: 197356 - DNA, 25 bp, Homo sapien
gggcagccgctcttcagctcgcggc

SEQ ID NO: 197357 - DNA, 25 bp, Homo sapien
agccgctcttcagctcgcggcccag

SEQ ID NO: 197358 - DNA, 25 bp, Homo sapien
cgcgggcagccgctcttcagctcgc

SEQ ID NO: 197359 - DNA, 25 bp, Homo sapien
gcgggcagccgctcttcagctcgcg

SEQ ID NO: 197360 - DNA, 25 bp, Homo sapien
cgggcagccgctcttcagctcgcgg

SEQ ID NO: 197361 - DNA, 25 bp, Homo sapien
ggcagccgctcttcagctcgcggcc

SEQ ID NO: 197362 - DNA, 25 bp, Homo sapien
gcagccgctcttcagctcgcggccc

SEQ ID NO: 197363 - DNA, 25 bp, Homo sapien
cagccgctcttcagctcgcggccca

SEQ ID NO: 197364 - DNA, 25 bp, Homo sapien
cgcctctccgcacaatacttgaaca

SEQ ID NO: 197365 - DNA, 25 bp, Homo sapien
ccgccggacccgcattatggctggg

SEQ ID NO: 197366 - DNA, 25 bp, Homo sapien
tttactgtattgagcggcggcaccc

SEQ ID NO: 197367 - DNA, 25 bp, Homo sapien
tggaccagcttggactgagacctga

SEQ ID NO: 197368 - DNA, 25 bp, Homo sapien
ccaggcttgttcttgttttactgta

SEQ ID NO: 197369 - DNA, 25 bp, Homo sapien
tgggcgcccatttgggactgcgcca

SEQ ID NO: 197370 - DNA, 25 bp, Homo sapien
ttgaacattcatctgtactgaagtg

SEQ ID NO: 197371 - DNA, 25 bp, Homo sapien
tgtactgaagtgttacttgaaccgg

SEQ ID NO: 197372 - DNA, 25 bp, Homo sapien
cctggactcattttgggagggattt

SEQ ID NO: 197373 - DNA, 25 bp, Homo sapien
tcagccgggccaagctcaaagcttc

SEQ ID NO: 197374 - DNA, 25 bp, Homo sapien
gacgctgcttttcttgctccactgg

SEQ ID NO: 197375 - DNA, 25 bp, Homo sapien
gcttggataacgttcttggtgggta

SEQ ID NO: 197376 - DNA, 25 bp, Homo sapien
cggggtccctacctacagatgagtg

SEQ ID NO: 197377 - DNA, 25 bp, Homo sapien
actcaaaatcttccagccggggctg

SEQ ID NO: 197378 - DNA, 25 bp, Homo sapien
cgggtctgtacaatacggtttgcta

SEQ ID NO: 197379 - DNA, 25 bp, Homo sapien
cgcctctgtcccagttcctgttttg

SEQ ID NO: 197380 - DNA, 25 bp, Homo sapien
atctagatcgtcgtggcgaagccga

SEQ ID NO: 197381 - DNA, 25 bp, Homo sapien
gcgggctattctctcacttgggcca

SEQ ID NO: 197382 - DNA, 25 bp, Homo sapien
gctgaaaattctcatcggactctga

SEQ ID NO: 197383 - DNA, 25 bp, Homo sapien
cgggtccctcgatactcggctgaaa

SEQ ID NO: 197384 - DNA, 25 bp, Homo sapien
ggccgttattttcttgactccacca

SEQ ID NO: 197385 - DNA, 25 bp, Homo sapien
agtggcgaatctgcagcctctcaga

SEQ ID NO: 197386 - DNA, 25 bp, Homo sapien
cgactctgccagcagggattggcta

SEQ ID NO: 197387 - DNA, 25 bp, Homo sapien
tcctcagggactagtcgcagctttc

SEQ ID NO: 197388 - DNA, 25 bp, Homo sapien
ttctgagcctgatgggttcgagtcc

SEQ ID NO: 197389 - DNA, 25 bp, Homo sapien
cggattctgagcctgatgggttcga

SEQ ID NO: 197390 - DNA, 25 bp, Homo sapien
acaccgcgtcatccctcggcggccg

SEQ ID NO: 197391 - DNA, 25 bp, Homo sapien
accggctgagtcaacaccgcgtcat

SEQ ID NO: 197392 - DNA, 25 bp, Homo sapien
tccttgaccggctgagtcaacaccg

SEQ ID NO: 197393 - DNA, 25 bp, Homo sapien
tcgccgtccttgaccggctgagtca

SEQ ID NO: 197394 - DNA, 25 bp, Homo sapien
cccatcgattctcctcggcagccgg

SEQ ID NO: 197395 - DNA, 25 bp, Homo sapien
tcctgccggcggattctgagcctga

SEQ ID NO: 197396 - DNA, 25 bp, Homo sapien
tcctccctgccgtgtgtctcacagg

SEQ ID NO: 197397 - DNA, 25 bp, Homo sapien
tcagcccgcagcgaaggctactacc

SEQ ID NO: 197398 - DNA, 25 bp, Homo sapien
ggctactaccccatcagcaagaagg

SEQ ID NO: 197399 - DNA, 25 bp, Homo sapien
ggcgtggacactcaggtgggcctaa

SEQ ID NO: 197400 - DNA, 25 bp, Homo sapien
aaccgcgtgctgtccgagcgccggt

SEQ ID NO: 197401 - DNA, 25 bp, Homo sapien
tctcacaggggacgaaccgcgtgct

SEQ ID NO: 197402 - DNA, 25 bp, Homo sapien
agaaggacaagtacctggacgtgtg

SEQ ID NO: 197403 - DNA, 25 bp, Homo sapien
tacctggacgtgtgcccagtctcgg

SEQ ID NO: 197404 - DNA, 25 bp, Homo sapien
aaacgtcatccccagggcgagttgc

SEQ ID NO: 197405 - DNA, 25 bp, Homo sapien
tcctcctgttcaatgctttgctcga

SEQ ID NO: 197406 - DNA, 25 bp, Homo sapien
ttcaatgctttgctcgatcgctgcg

SEQ ID NO: 197407 - DNA, 25 bp, Homo sapien
atgctttgctcgatcgctgcgggag

SEQ ID NO: 197408 - DNA, 25 bp, Homo sapien
tccggggcgtacgaatggtcaacac

SEQ ID NO: 197409 - DNA, 25 bp, Homo sapien
tacgaatggtcaacaccccgcggca

SEQ ID NO: 197410 - DNA, 25 bp, Homo sapien
gccaggcccggggagaaacgtcatc

SEQ ID NO: 197411 - DNA, 25 bp, Homo sapien
caggtccgcggaggaacggttcagc

SEQ ID NO: 197412 - DNA, 25 bp, Homo sapien
gttccggtgacggtagcaagttctc

SEQ ID NO: 197413 - DNA, 25 bp, Homo sapien
gcaagttctcgcgtccaggcatctc

SEQ ID NO: 197414 - DNA, 25 bp, Homo sapien
agggtcacattctgcggtccacgag

SEQ ID NO: 197415 - DNA, 25 bp, Homo sapien
gcgggtgtctcggattacgtacaaa

SEQ ID NO: 197416 - DNA, 25 bp, Homo sapien
cggacgaactggaacgcaggacttc

SEQ ID NO: 197417 - DNA, 25 bp, Homo sapien
acgtcgtgatgagaacggcgtccca

SEQ ID NO: 197418 - DNA, 25 bp, Homo sapien
cgcaggacttctggtcttcgggata

SEQ ID NO: 197419 - DNA, 25 bp, Homo sapien
agcgaaacggtggtgccaatgactc

SEQ ID NO: 197420 - DNA, 25 bp, Homo sapien
gatcgtccgcaactgggcgagctgt

SEQ ID NO: 197421 - DNA, 25 bp, Homo sapien
agaccgcgtcgcgtaagcgctggat

SEQ ID NO: 197422 - DNA, 25 bp, Homo sapien
ggcttcgctgatgcacattggaccg

SEQ ID NO: 197423 - DNA, 25 bp, Homo sapien
atgcacattggaccgggctctggac

SEQ ID NO: 197424 - DNA, 25 bp, Homo sapien
ccctggagtgcaggtcttaccgtcc

SEQ ID NO: 197425 - DNA, 25 bp, Homo sapien
gtcttaccgtccgagatcgtccgca

SEQ ID NO: 197426 - DNA, 25 bp, Homo sapien
gccgtggtttggttacgattggcca

SEQ ID NO: 197427 - DNA, 25 bp, Homo sapien
tcccgcgttgccatgtgtgggagac

SEQ ID NO: 197428 - DNA, 25 bp, Homo sapien
gctcgtgcttcctcaggctcgacga

SEQ ID NO: 197429 - DNA, 25 bp, Homo sapien
ggctcgacgacaccacaaaggattt

SEQ ID NO: 197430 - DNA, 25 bp, Homo sapien
aggatttcccacatgcgttacagtg

SEQ ID NO: 197431 - DNA, 25 bp, Homo sapien
agtgcacccggctatgcttcgtgag

SEQ ID NO: 197432 - DNA, 25 bp, Homo sapien
gccacgaacgtcttgtcacattgca

SEQ ID NO: 197433 - DNA, 25 bp, Homo sapien
ttctcgcagtggtatggcttcaccc

SEQ ID NO: 197434 - DNA, 25 bp, Homo sapien
aactgagctgcgtgaagcccttgcc

SEQ ID NO: 197435 - DNA, 25 bp, Homo sapien
gcctcactgcttcgatgggtccgct

SEQ ID NO: 197436 - DNA, 25 bp, Homo sapien
aaggcaccctcaccgctcatggttg

SEQ ID NO: 197437 - DNA, 25 bp, Homo sapien
tcttggtacaggacacgcacttgta

SEQ ID NO: 197438 - DNA, 25 bp, Homo sapien
tcggccacctcttcagagcagtctg

SEQ ID NO: 197439 - DNA, 25 bp, Homo sapien
ttctgtctctggctttggcttcacc

SEQ ID NO: 197440 - DNA, 25 bp, Homo sapien
ggcttcctctgccttagcttctgtc

SEQ ID NO: 197441 - DNA, 25 bp, Homo sapien
actgaagggtcagcaaagctcttgc

SEQ ID NO: 197442 - DNA, 25 bp, Homo sapien
tttgccgcaacgctcacagctgtag

SEQ ID NO: 197443 - DNA, 25 bp, Homo sapien
ccttgagctccgcataggctttgcc

SEQ ID NO: 197444 - DNA, 25 bp, Homo sapien
cgttaatgactccaagcgatcgcca

SEQ ID NO: 197445 - DNA, 25 bp, Homo sapien
cgaccggagtcagctgggatcacgt

SEQ ID NO: 197446 - DNA, 25 bp, Homo sapien
tcacgttaatgactccaagcgatcg

SEQ ID NO: 197447 - DNA, 25 bp, Homo sapien
tcagctgggatcacgttaatgactc

SEQ ID NO: 197448 - DNA, 25 bp, Homo sapien
tgggatcacgttaatgactccaagc

SEQ ID NO: 197449 - DNA, 25 bp, Homo sapien
gcggacaggggactgccccacacag

SEQ ID NO: 197450 - DNA, 25 bp, Homo sapien
ggagtcagctgggatcacgttaatg

SEQ ID NO: 197451 - DNA, 25 bp, Homo sapien
taatgactccaagcgatcgccagcc

SEQ ID NO: 197452 - DNA, 25 bp, Homo sapien
tatacgcccgccttgtgttagtctg

SEQ ID NO: 197453 - DNA, 25 bp, Homo sapien
tgtctgcgtaaaactgcggctcgga

SEQ ID NO: 197454 - DNA, 25 bp, Homo sapien
tcagccgtgcagacctagaacttag

SEQ ID NO: 197455 - DNA, 25 bp, Homo sapien
ccggaacgattctagctgctcttgc

SEQ ID NO: 197456 - DNA, 25 bp, Homo sapien
cgccgacgtttcctacctgatgaga

SEQ ID NO: 197457 - DNA, 25 bp, Homo sapien
caggtcaccggcaatgtcttcaaga

SEQ ID NO: 197458 - DNA, 25 bp, Homo sapien
ctatggcggcagagaagcatcttgc

SEQ ID NO: 197459 - DNA, 25 bp, Homo sapien
tggccagggctgtagaatctttttc

SEQ ID NO: 197460 - DNA, 25 bp, Homo sapien
ttccgcctgcggaaacagctggcca

SEQ ID NO: 197461 - DNA, 25 bp, Homo sapien
cgacgtttccgctgcagcgagtgtg

SEQ ID NO: 197462 - DNA, 25 bp, Homo sapien
ccctgaaggaccaccagaggctgca

SEQ ID NO: 197463 - DNA, 25 bp, Homo sapien
ctgcactcagagaatcggcggcgac

SEQ ID NO: 197464 - DNA, 25 bp, Homo sapien
tactccaaccgcatggccctgaagg

SEQ ID NO: 197465 - DNA, 25 bp, Homo sapien
cgcagccacgagacgggccagtaca

SEQ ID NO: 197466 - DNA, 25 bp, Homo sapien
gcgactcgggaagatcggcccttcc

SEQ ID NO: 197467 - DNA, 25 bp, Homo sapien
caccagcgggtccacatggaacggc

SEQ ID NO: 197468 - DNA, 25 bp, Homo sapien
ggtgctgcccattatctccaggttc

SEQ ID NO: 197469 - DNA, 25 bp, Homo sapien
gtcattatgctaacgcctggccatc

SEQ ID NO: 197470 - DNA, 25 bp, Homo sapien
cccaaatggctgttccagggcgcta

SEQ ID NO: 197471 - DNA, 25 bp, Homo sapien
gcgccgtccttgagaccatcgtcaa

SEQ ID NO: 197472 - DNA, 25 bp, Homo sapien
ctggtcaccgttattccttggcatc

SEQ ID NO: 197473 - DNA, 25 bp, Homo sapien
ttggcatccaattcacgtgcgagtc

SEQ ID NO: 197474 - DNA, 25 bp, Homo sapien
ggtcccttgcctcgcactcttattt

SEQ ID NO: 197475 - DNA, 25 bp, Homo sapien
gcctcctctgtattccgtcattatg

SEQ ID NO: 197476 - DNA, 25 bp, Homo sapien
cgggaaacctcttcagtcggatgta

SEQ ID NO: 197477 - DNA, 25 bp, Homo sapien
tcttgactttggagcatccggccgt

SEQ ID NO: 197478 - DNA, 25 bp, Homo sapien
ccctcagttcctagagcggagcgtg

SEQ ID NO: 197479 - DNA, 25 bp, Homo sapien
cccgagtgtcagtcagaaaagctag

SEQ ID NO: 197480 - DNA, 25 bp, Homo sapien
acagctcttgggttcgcagttgcag

SEQ ID NO: 197481 - DNA, 25 bp, Homo sapien
tctggataacacagagggctgctgc

SEQ ID NO: 197482 - DNA, 25 bp, Homo sapien
ggagctggcagagacatttcctgtc

SEQ ID NO: 197483 - DNA, 25 bp, Homo sapien
cctgtctgcggaggatcttgacttt

SEQ ID NO: 197484 - DNA, 25 bp, Homo sapien
ccacgtgagcgccagattctggcgc

SEQ ID NO: 197485 - DNA, 25 bp, Homo sapien
tgtgccagacctctccacctcggtg

SEQ ID NO: 197486 - DNA, 25 bp, Homo sapien
aggtgcatgtccaacctccgccgcc

SEQ ID NO: 197487 - DNA, 25 bp, Homo sapien
ctttgctgctttgcgcagcctgtcc

SEQ ID NO: 197488 - DNA, 25 bp, Homo sapien
tgccagtcctttgctgctttgcgca

SEQ ID NO: 197489 - DNA, 25 bp, Homo sapien
cgctcccttttaccacgggctccag

SEQ ID NO: 197490 - DNA, 25 bp, Homo sapien
ccgcctggctgtactccaggacgtt

SEQ ID NO: 197491 - DNA, 25 bp, Homo sapien
agattctggcgcacagaccactgcc

SEQ ID NO: 197492 - DNA, 25 bp, Homo sapien
agcggatcctcagtcctagcggcca

SEQ ID NO: 197493 - DNA, 25 bp, Homo sapien
agtggactgttcgagcccttccgct

SEQ ID NO: 197494 - DNA, 25 bp, Homo sapien
agacggggctggcatctaccatatg

SEQ ID NO: 197495 - DNA, 25 bp, Homo sapien
ggcatccgggccgaaccaagtgacc

SEQ ID NO: 197496 - DNA, 25 bp, Homo sapien
cgggttctgtggattcggatcctta

SEQ ID NO: 197497 - DNA, 25 bp, Homo sapien
tgggtcctcagtcctagcggatcct

SEQ ID NO: 197498 - DNA, 25 bp, Homo sapien
gccaccgggtctgaaaggagcaaga

SEQ ID NO: 197499 - DNA, 25 bp, Homo sapien
gggctgagcctgtcagcatcctcga

SEQ ID NO: 197500 - DNA, 25 bp, Homo sapien
tgctgacccggagccaaaagaactg

SEQ ID NO: 197501 - DNA, 25 bp, Homo sapien
gagaaacgtacctgtgccggcgacc

SEQ ID NO: 197502 - DNA, 25 bp, Homo sapien
cggaaaaccaggagctccaagactg

SEQ ID NO: 197503 - DNA, 25 bp, Homo sapien
gacggccacagaagccaatcggctc

SEQ ID NO: 197504 - DNA, 25 bp, Homo sapien
caatcggctcctgctacatcacaga

SEQ ID NO: 197505 - DNA, 25 bp, Homo sapien
aaaagaactgcgtggcgtccgattc

SEQ ID NO: 197506 - DNA, 25 bp, Homo sapien
tggcgtccgattctggcgtcacttc

SEQ ID NO: 197507 - DNA, 25 bp, Homo sapien
tcacggtggagatcggagaaacgta

SEQ ID NO: 197508 - DNA, 25 bp, Homo sapien
aagccgcgctcaggttcacgggcgt

SEQ ID NO: 197509 - DNA, 25 bp, Homo sapien
caggtccgaggcgttgtcccacgaa

SEQ ID NO: 197510 - DNA, 25 bp, Homo sapien
cctccttttcctggtaggcagggca

SEQ ID NO: 197511 - DNA, 25 bp, Homo sapien
aggatcctgcatcctggcgggatcc

SEQ ID NO: 197512 - DNA, 25 bp, Homo sapien
cttgccaggcgaggatcctgcatcc

SEQ ID NO: 197513 - DNA, 25 bp, Homo sapien
ccggcttagacttgccaggcgagga

SEQ ID NO: 197514 - DNA, 25 bp, Homo sapien
acgaagcgttctcgtgctgcaccag

SEQ ID NO: 197515 - DNA, 25 bp, Homo sapien
aggcgttgtcccacgaagcgttctc

SEQ ID NO: 197516 - DNA, 25 bp, Homo sapien
ttggccggcaccacgatggcggcca

SEQ ID NO: 197517 - DNA, 25 bp, Homo sapien
agcgtcccattcctgcgctcgaccg

SEQ ID NO: 197518 - DNA, 25 bp, Homo sapien
gccctaggaacctcacctctcgaag

SEQ ID NO: 197519 - DNA, 25 bp, Homo sapien
cccagcaggcggtgccgtgcacgaa

SEQ ID NO: 197520 - DNA, 25 bp, Homo sapien
ggcgcccagctccacttggctgtag

SEQ ID NO: 197521 - DNA, 25 bp, Homo sapien
ccacttggctgtagttggccggcac

SEQ ID NO: 197522 - DNA, 25 bp, Homo sapien
ggagtgcacgcccagcagtaccgac

SEQ ID NO: 197523 - DNA, 25 bp, Homo sapien
gtcctgggagtgcacgcccagcagt

SEQ ID NO: 197524 - DNA, 25 bp, Homo sapien
aggccgtaccactgtgccttcatgg

SEQ ID NO: 197525 - DNA, 25 bp, Homo sapien
tgagggtggaaaacgcccattctcc

SEQ ID NO: 197526 - DNA, 25 bp, Homo sapien
gtcgccattttgtttcgctcctctg

SEQ ID NO: 197527 - DNA, 25 bp, Homo sapien
ctcccagctgggcttttcgttttca

SEQ ID NO: 197528 - DNA, 25 bp, Homo sapien
cggacatggcctcaaacggtaggta

SEQ ID NO: 197529 - DNA, 25 bp, Homo sapien
tggaacttcgttgcttgcttgcctg

SEQ ID NO: 197530 - DNA, 25 bp, Homo sapien
cggcggagcgtacttaagcttcgac

SEQ ID NO: 197531 - DNA, 25 bp, Homo sapien
cctcgtgttggttcagctttctgtc

SEQ ID NO: 197532 - DNA, 25 bp, Homo sapien
tcctttccggtagagcagctttgtt

SEQ ID NO: 197533 - DNA, 25 bp, Homo sapien
atgtcgcgcagcacgttagcggtga

SEQ ID NO: 197534 - DNA, 25 bp, Homo sapien
tccaaggcgtccatggacagcagcg

SEQ ID NO: 197535 - DNA, 25 bp, Homo sapien
gacagcagcttcagcttgaacttct

SEQ ID NO: 197536 - DNA, 25 bp, Homo sapien
ggttctccagcgcatccaggatggc

SEQ ID NO: 197537 - DNA, 25 bp, Homo sapien
gttgccctccagcaaaaggcgcttc

SEQ ID NO: 197538 - DNA, 25 bp, Homo sapien
aggcgcttccttactacacccttgg

SEQ ID NO: 197539 - DNA, 25 bp, Homo sapien
cgccgtaggtctccaggtagaagct

SEQ ID NO: 197540 - DNA, 25 bp, Homo sapien
ttccgcttaggtcggctgctggata

SEQ ID NO: 197541 - DNA, 25 bp, Homo sapien
agtggaggagcgacttaacgatttc

SEQ ID NO: 197542 - DNA, 25 bp, Homo sapien
ttcagcccgaagtcttgcacctgtc

SEQ ID NO: 197543 - DNA, 25 bp, Homo sapien
taacgatttccgctcgcaccgaggc

SEQ ID NO: 197544 - DNA, 25 bp, Homo sapien
tggcagcaccatcgcaggtagaggc

SEQ ID NO: 197545 - DNA, 25 bp, Homo sapien
tgtccgtgatgcgtacacacctgtg

SEQ ID NO: 197546 - DNA, 25 bp, Homo sapien
gccatccctcgtcttcctgggagtg

SEQ ID NO: 197547 - DNA, 25 bp, Homo sapien
ccgggtgtgagtttgcacaaggacc

SEQ ID NO: 197548 - DNA, 25 bp, Homo sapien
gctggcttcacaggcgttgcattac

SEQ ID NO: 197549 - DNA, 25 bp, Homo sapien
cagccgggatctgcacttatgtgtg

SEQ ID NO: 197550 - DNA, 25 bp, Homo sapien
caccgtcctttcgttggtattcgag

SEQ ID NO: 197551 - DNA, 25 bp, Homo sapien
acacacgtatagctaccggcgggca

SEQ ID NO: 197552 - DNA, 25 bp, Homo sapien
cggccttagtccctagaggaaactg

SEQ ID NO: 197553 - DNA, 25 bp, Homo sapien
gcgtgtcatccgtgtggcaaaagca

SEQ ID NO: 197554 - DNA, 25 bp, Homo sapien
cgcgtcccgaagtacccagcagaga

SEQ ID NO: 197555 - DNA, 25 bp, Homo sapien
cccagtcctagctggtggtctccta

SEQ ID NO: 197556 - DNA, 25 bp, Homo sapien
tgctggcacgacaagggcaagaatg

SEQ ID NO: 197557 - DNA, 25 bp, Homo sapien
ttctacgatgccagcgacgccgacg

SEQ ID NO: 197558 - DNA, 25 bp, Homo sapien
gacggcgtcctctccttctacgatg

SEQ ID NO: 197559 - DNA, 25 bp, Homo sapien
gcgcattggcctttacctgagcttc

SEQ ID NO: 197560 - DNA, 25 bp, Homo sapien
aggacccgcgccagttcgacaaggc

SEQ ID NO: 197561 - DNA, 25 bp, Homo sapien
ccttcttcgacgtgtgctggcacga

SEQ ID NO: 197562 - DNA, 25 bp, Homo sapien
gtgccgctttttgccttccacgagc

SEQ ID NO: 197563 - DNA, 25 bp, Homo sapien
gcaagatcctggaggcacacgtgga

SEQ ID NO: 197564 - DNA, 25 bp, Homo sapien
gcggtttcctccctggcaatacttc

SEQ ID NO: 197565 - DNA, 25 bp, Homo sapien
ctcaagaacaaagcgcggtttcctc

SEQ ID NO: 197566 - DNA, 25 bp, Homo sapien
cctggcaatacttcctcgggatcgt

SEQ ID NO: 197567 - DNA, 25 bp, Homo sapien
cgcggtttcctccctggcaatactt

SEQ ID NO: 197568 - DNA, 25 bp, Homo sapien
cctcgggatcgtgcacgcggttcac

SEQ ID NO: 197569 - DNA, 25 bp, Homo sapien
tcctcgggatcgtgcacgcggttca

SEQ ID NO: 197570 - DNA, 25 bp, Homo sapien
cacctcaagaacaaagcgcggtttc

SEQ ID NO: 197571 - DNA, 25 bp, Homo sapien
ctggcaatacttcctcgggatcgtg

SEQ ID NO: 197572 - DNA, 25 bp, Homo sapien
cggcaatacaaggacatgatgagtg

SEQ ID NO: 197573 - DNA, 25 bp, Homo sapien
cggagaccaaagtggagccgttcga

SEQ ID NO: 197574 - DNA, 25 bp, Homo sapien
tcaccgccgcgctgtacaaggtgct

SEQ ID NO: 197575 - DNA, 25 bp, Homo sapien
ctgcgcctcagtctcttagggaggg

SEQ ID NO: 197576 - DNA, 25 bp, Homo sapien
cgagtcgccctccttgtagtttctg

SEQ ID NO: 197577 - DNA, 25 bp, Homo sapien
agctcggcttcttcaagcggcaata

SEQ ID NO: 197578 - DNA, 25 bp, Homo sapien
tagcggctccttcccgacagagctg

SEQ ID NO: 197579 - DNA, 25 bp, Homo sapien
tggacacgtcggacagcgaagtatc

SEQ ID NO: 197580 - DNA, 25 bp, Homo sapien
ggcacactgtgaaaacttcaacctg

SEQ ID NO: 197581 - DNA, 25 bp, Homo sapien
gaccgcctacaggtgacctccaaag

SEQ ID NO: 197582 - DNA, 25 bp, Homo sapien
accggagtctgagccgagtccgagt

SEQ ID NO: 197583 - DNA, 25 bp, Homo sapien
gctcccggtgcgtctgggcatgaac

SEQ ID NO: 197584 - DNA, 25 bp, Homo sapien
aaacttcaacctgctgctcccggtg

SEQ ID NO: 197585 - DNA, 25 bp, Homo sapien
tcgggctgaaggcacactgtgaaaa

SEQ ID NO: 197586 - DNA, 25 bp, Homo sapien
ccaggaaacaaagaaccggagtctg

SEQ ID NO: 197587 - DNA, 25 bp, Homo sapien
gtgacctccaaagctctgtgacctt

SEQ ID NO: 197588 - DNA, 25 bp, Homo sapien
ttcacgtggctattgtggaacagag

SEQ ID NO: 197589 - DNA, 25 bp, Homo sapien
tggaacagagtgtggttgccgtccc

SEQ ID NO: 197590 - DNA, 25 bp, Homo sapien
tcccgcgtaccttggtgcggatgcg

SEQ ID NO: 197591 - DNA, 25 bp, Homo sapien
cacgaaggtcagcagacgccaggta

SEQ ID NO: 197592 - DNA, 25 bp, Homo sapien
ggaaaagcacgtggagcgcccaccg

SEQ ID NO: 197593 - DNA, 25 bp, Homo sapien
cacctccgtatcagcggcgtgggaa

SEQ ID NO: 197594 - DNA, 25 bp, Homo sapien
gcagactcgaagcttcacaccttta

SEQ ID NO: 197595 - DNA, 25 bp, Homo sapien
ctcagaggcaaagccatgatggtgc

SEQ ID NO: 197596 - DNA, 25 bp, Homo sapien
ctgagattttaaggcgggccgggtg

SEQ ID NO: 197597 - DNA, 25 bp, Homo sapien
actgccggagaatcgctgggaaacg

SEQ ID NO: 197598 - DNA, 25 bp, Homo sapien
cactgccggagaatcgctgggaaac

SEQ ID NO: 197599 - DNA, 25 bp, Homo sapien
ccggagaatcgctgggaaacggctc

SEQ ID NO: 197600 - DNA, 25 bp, Homo sapien
ccgggtgtgctgcagccagcactgc

SEQ ID NO: 197601 - DNA, 25 bp, Homo sapien
ggggaggcggctgagattttaaggc

SEQ ID NO: 197602 - DNA, 25 bp, Homo sapien
cagcactgccggagaatcgctggga

SEQ ID NO: 197603 - DNA, 25 bp, Homo sapien
caggagaatggagggtggacggccg

SEQ ID NO: 197604 - DNA, 25 bp, Homo sapien
ggactccgctaacagctgcctgaga

SEQ ID NO: 197605 - DNA, 25 bp, Homo sapien
ccacggcccaggactaggatgccgg

SEQ ID NO: 197606 - DNA, 25 bp, Homo sapien
gtcctccctaacctcagtcataggg

SEQ ID NO: 197607 - DNA, 25 bp, Homo sapien
agtcatagggcgctccgtatccagc

SEQ ID NO: 197608 - DNA, 25 bp, Homo sapien
cctggccctcaccaagacagggaga

SEQ ID NO: 197609 - DNA, 25 bp, Homo sapien
ggagtccgcgccatgcgcatgcaca

SEQ ID NO: 197610 - DNA, 25 bp, Homo sapien
gacagggagaaacgaccgagacact

SEQ ID NO: 197611 - DNA, 25 bp, Homo sapien
gaccgagacactgaggactccgcta

SEQ ID NO: 197612 - DNA, 25 bp, Homo sapien
tgcatcactgcggtggcgctaaaca

SEQ ID NO: 197613 - DNA, 25 bp, Homo sapien
tcactctaggaagcggcagcgaacg

SEQ ID NO: 197614 - DNA, 25 bp, Homo sapien
cagacttccggggtcgagaactaca

SEQ ID NO: 197615 - DNA, 25 bp, Homo sapien
cgcctcgtgtgcaaggacagacttc

SEQ ID NO: 197616 - DNA, 25 bp, Homo sapien
tgcgattaaggtactgccgcgcctc

SEQ ID NO: 197617 - DNA, 25 bp, Homo sapien
gaagagtttccagcgcttcccgagg

SEQ ID NO: 197618 - DNA, 25 bp, Homo sapien
gcagcgaacgttctcggtaggttta

SEQ ID NO: 197619 - DNA, 25 bp, Homo sapien
ggtgcccgacgatttccctgtcttc

SEQ ID NO: 197620 - DNA, 25 bp, Homo sapien
agcccacgtgcactgcgcattctgt

SEQ ID NO: 197621 - DNA, 25 bp, Homo sapien
caagtggggcacttgtgaccggccc

SEQ ID NO: 197622 - DNA, 25 bp, Homo sapien
ccttcgtgcgcagctatggcgcggc

SEQ ID NO: 197623 - DNA, 25 bp, Homo sapien
ccctgacccaagtggggcacttgtg

SEQ ID NO: 197624 - DNA, 25 bp, Homo sapien
gtgcactgcgcattctgtcacgcct

SEQ ID NO: 197625 - DNA, 25 bp, Homo sapien
tgctgacctatgtgaccggcgcacc

SEQ ID NO: 197626 - DNA, 25 bp, Homo sapien
tgtacggcctgctgacctatgtgac

SEQ ID NO: 197627 - DNA, 25 bp, Homo sapien
cctcgaggccttcgtgcgcagctat

SEQ ID NO: 197628 - DNA, 25 bp, Homo sapien
cttcttacttctgcttttcgcctct

SEQ ID NO: 197629 - DNA, 25 bp, Homo sapien
gcttccttacatggtcacggccggg

SEQ ID NO: 197630 - DNA, 25 bp, Homo sapien
tgtcttcttacttctgcttttcgcc

SEQ ID NO: 197631 - DNA, 25 bp, Homo sapien
catccctgtcttcttacttctgctt

SEQ ID NO: 197632 - DNA, 25 bp, Homo sapien
ggtcccggcttccttacatggtcac

SEQ ID NO: 197633 - DNA, 25 bp, Homo sapien
ccgccgtcgctctcccgcatctccc

SEQ ID NO: 197634 - DNA, 25 bp, Homo sapien
cttacatggtcacggccgggcttcc

SEQ ID NO: 197635 - DNA, 25 bp, Homo sapien
ttccttacatggtcacggccgggct

SEQ ID NO: 197636 - DNA, 25 bp, Homo sapien
tcgctacctcaggtttggggaagga

SEQ ID NO: 197637 - DNA, 25 bp, Homo sapien
caagccgcactttgagagcccacag

SEQ ID NO: 197638 - DNA, 25 bp, Homo sapien
cgaggctctgaggagcgaatttgcc

SEQ ID NO: 197639 - DNA, 25 bp, Homo sapien
gcgcagtgccgatttaggttgaaaa

SEQ ID NO: 197640 - DNA, 25 bp, Homo sapien
ggttgaaaacgctcccagtcatggg

SEQ ID NO: 197641 - DNA, 25 bp, Homo sapien
ctccaggcctcagggtcgagatgga

SEQ ID NO: 197642 - DNA, 25 bp, Homo sapien
gatggagaaaccaagccgcactttg

SEQ ID NO: 197643 - DNA, 25 bp, Homo sapien
tcggcacatgattcgacctcacggc

SEQ ID NO: 197644 - DNA, 25 bp, Homo sapien
atgccttagtccagtcacccgggtt

SEQ ID NO: 197645 - DNA, 25 bp, Homo sapien
ccctgcagaagatggtgaccgcctt

SEQ ID NO: 197646 - DNA, 25 bp, Homo sapien
actggcacccagagcatttctgctg

SEQ ID NO: 197647 - DNA, 25 bp, Homo sapien
tcgactcccatcttaaaagctgcgg

SEQ ID NO: 197648 - DNA, 25 bp, Homo sapien
gtcctcagggccatggttttccttc

SEQ ID NO: 197649 - DNA, 25 bp, Homo sapien
caccggacgggattcttcgcgtcta

SEQ ID NO: 197650 - DNA, 25 bp, Homo sapien
ctctcctaggtttccacgagcgcga

SEQ ID NO: 197651 - DNA, 25 bp, Homo sapien
tggcacccggactgtttcgtctgca

SEQ ID NO: 197652 - DNA, 25 bp, Homo sapien
gcacgagcggatcttgcaggagatc

SEQ ID NO: 197653 - DNA, 25 bp, Homo sapien
ggagatcgagagcaccgacaccgcc

SEQ ID NO: 197654 - DNA, 25 bp, Homo sapien
gaattgaaattgagcgggagacgcc

SEQ ID NO: 197655 - DNA, 25 bp, Homo sapien
ttgggaacacgctagggtgaccctg

SEQ ID NO: 197656 - DNA, 25 bp, Homo sapien
ggtaaagatctcatcccaccgggac

SEQ ID NO: 197657 - DNA, 25 bp, Homo sapien
gcatgccaggctagggtcgacagca

SEQ ID NO: 197658 - DNA, 25 bp, Homo sapien
aggctagggtcgacagcaggcaccc

SEQ ID NO: 197659 - DNA, 25 bp, Homo sapien
cagctgcttgctgcttgggaacacg

SEQ ID NO: 197660 - DNA, 25 bp, Homo sapien
gcagctgaacttggggcactcacga

SEQ ID NO: 197661 - DNA, 25 bp, Homo sapien
gaaggctccatctactccaagcgtg

SEQ ID NO: 197662 - DNA, 25 bp, Homo sapien
gctgcatcctgtgtgggtacctgaa

SEQ ID NO: 197663 - DNA, 25 bp, Homo sapien
ggtacctgaagctgacgcccatgtt

SEQ ID NO: 197664 - DNA, 25 bp, Homo sapien
agccgcattctgtacccaggtaaca

SEQ ID NO: 197665 - DNA, 25 bp, Homo sapien
gtcgcacgcctcctctgctaggatt

SEQ ID NO: 197666 - DNA, 25 bp, Homo sapien
atggacatctacacgcgcctgcggc

SEQ ID NO: 197667 - DNA, 25 bp, Homo sapien
ccacaacggtctaaggcgcagtctg

SEQ ID NO: 197668 - DNA, 25 bp, Homo sapien
gagctgacctgcacggaatcccaca

SEQ ID NO: 197669 - DNA, 25 bp, Homo sapien
tctttcaagaacaggcgccggcctc

SEQ ID NO: 197670 - DNA, 25 bp, Homo sapien
cggctgcagagggacatctttcaag

SEQ ID NO: 197671 - DNA, 25 bp, Homo sapien
agccatgccgagcttttggatccca

SEQ ID NO: 197672 - DNA, 25 bp, Homo sapien
ccggagccgaactgctcggaacaca

SEQ ID NO: 197673 - DNA, 25 bp, Homo sapien
ctcgtccttcaggtttgaccgtgaa

SEQ ID NO: 197674 - DNA, 25 bp, Homo sapien
ccacagctggtagggcaagtagtcc

SEQ ID NO: 197675 - DNA, 25 bp, Homo sapien
gtccgccgcgcagttaggaaactga

SEQ ID NO: 197676 - DNA, 25 bp, Homo sapien
tttccccgcggaggtcatgaggtcc

SEQ ID NO: 197677 - DNA, 25 bp, Homo sapien
tgcactaactgggacgcgccccggg

SEQ ID NO: 197678 - DNA, 25 bp, Homo sapien
gccggcgcctctcagttcccactcc

SEQ ID NO: 197679 - DNA, 25 bp, Homo sapien
tcagttcccactccgcgactccctg

SEQ ID NO: 197680 - DNA, 25 bp, Homo sapien
aggtcatgaggtccccacggcccag

SEQ ID NO: 197681 - DNA, 25 bp, Homo sapien
accggcgctgcactaactgggacgc

SEQ ID NO: 197682 - DNA, 25 bp, Homo sapien
cgcaccggcgctgcactaactggga

SEQ ID NO: 197683 - DNA, 25 bp, Homo sapien
cggcgctgcactaactgggacgcgc

SEQ ID NO: 197684 - DNA, 25 bp, Homo sapien
ttccatagtagccacgtctgtaacg

SEQ ID NO: 197685 - DNA, 25 bp, Homo sapien
gccacgtctgtaacggcgccaatca

SEQ ID NO: 197686 - DNA, 25 bp, Homo sapien
gccatggcgccttccatagtagcca

SEQ ID NO: 197687 - DNA, 25 bp, Homo sapien
ccagagaactgcctatcagtggtag

SEQ ID NO: 197688 - DNA, 25 bp, Homo sapien
aggcgggaaccgctgctgcctgtac

SEQ ID NO: 197689 - DNA, 25 bp, Homo sapien
gcgacggtcaaacgtctgtcccacg

SEQ ID NO: 197690 - DNA, 25 bp, Homo sapien
ggtgagcgacggtcaaacgtctgtc

SEQ ID NO: 197691 - DNA, 25 bp, Homo sapien
taacggcgccaatcagcgcgtaacg

SEQ ID NO: 197692 - DNA, 25 bp, Homo sapien
cgcgctcgcttcttgggctcctcgc

SEQ ID NO: 197693 - DNA, 25 bp, Homo sapien
cggaggcagctcgagcttcgggatg

SEQ ID NO: 197694 - DNA, 25 bp, Homo sapien
ctcgagcttcgggatgcgcgctcgc

SEQ ID NO: 197695 - DNA, 25 bp, Homo sapien
tcgagcttcgggatgcgcgctcgct

SEQ ID NO: 197696 - DNA, 25 bp, Homo sapien
cgagcttcgggatgcgcgctcgctt

SEQ ID NO: 197697 - DNA, 25 bp, Homo sapien
gagcttcgggatgcgcgctcgcttc

SEQ ID NO: 197698 - DNA, 25 bp, Homo sapien
agcttcgggatgcgcgctcgcttct

SEQ ID NO: 197699 - DNA, 25 bp, Homo sapien
gatgcgcgctcgcttcttgggctcc

SEQ ID NO: 197700 - DNA, 25 bp, Homo sapien
tagatcttctttggtgtcatttcga

SEQ ID NO: 197701 - DNA, 25 bp, Homo sapien
tggtgtcatttcgatttataaatcc

SEQ ID NO: 197702 - DNA, 25 bp, Homo sapien
atctcctacactgcgcagatatttc

SEQ ID NO: 197703 - DNA, 25 bp, Homo sapien
gcgcagatatttctgtgggttattc

SEQ ID NO: 197704 - DNA, 25 bp, Homo sapien
ctgtgggttattcttcttgatggca

SEQ ID NO: 197705 - DNA, 25 bp, Homo sapien
cttcttgatggcagtctgatgtata

SEQ ID NO: 197706 - DNA, 25 bp, Homo sapien
ccaaggactttggtggcgagaactt

SEQ ID NO: 197707 - DNA, 25 bp, Homo sapien
cagtctgatgtataaatagatcttc

SEQ ID NO: 197708 - DNA, 25 bp, Homo sapien
gggactttggggcaatgggctatgg

SEQ ID NO: 197709 - DNA, 25 bp, Homo sapien
acaggtgagttaaagggcgctcggc

SEQ ID NO: 197710 - DNA, 25 bp, Homo sapien
ccacaggtgagttaaagggcgctcg

SEQ ID NO: 197711 - DNA, 25 bp, Homo sapien
tgccgcccgggacatgctggagttc

SEQ ID NO: 197712 - DNA, 25 bp, Homo sapien
tcgcggagcgggaactcccgagagg

SEQ ID NO: 197713 - DNA, 25 bp, Homo sapien
cagggagtcgcggagcgggaactcc

SEQ ID NO: 197714 - DNA, 25 bp, Homo sapien
ctctggcggtgtgcggccctccggg

SEQ ID NO: 197715 - DNA, 25 bp, Homo sapien
cccacaggtgagttaaagggcgctc

SEQ ID NO: 197716 - DNA, 25 bp, Homo sapien
ccatgacggcaaaatgccggggcgg

SEQ ID NO: 197717 - DNA, 25 bp, Homo sapien
aagccatgacggcaaaatgccgggg

SEQ ID NO: 197718 - DNA, 25 bp, Homo sapien
gccatgacggcaaaatgccggggcg

SEQ ID NO: 197719 - DNA, 25 bp, Homo sapien
catgacggcaaaatgccggggcggc

SEQ ID NO: 197720 - DNA, 25 bp, Homo sapien
atgacggcaaaatgccggggcggca

SEQ ID NO: 197721 - DNA, 25 bp, Homo sapien
tgacggcaaaatgccggggcggcag

SEQ ID NO: 197722 - DNA, 25 bp, Homo sapien
aaaagccatgacggcaaaatgccgg

SEQ ID NO: 197723 - DNA, 25 bp, Homo sapien
agccatgacggcaaaatgccggggc

SEQ ID NO: 197724 - DNA, 25 bp, Homo sapien
cgccgcggctttttcgctgccatgg

SEQ ID NO: 197725 - DNA, 25 bp, Homo sapien
gctttttcccccaactggtgcagcg

SEQ ID NO: 197726 - DNA, 25 bp, Homo sapien
ggctttttcccccaactggtgcagc

SEQ ID NO: 197727 - DNA, 25 bp, Homo sapien
tttttcccccaactggtgcagcggc

SEQ ID NO: 197728 - DNA, 25 bp, Homo sapien
tttcccccaactggtgcagcggctg

SEQ ID NO: 197729 - DNA, 25 bp, Homo sapien
gcggctttttcgctgccatggcttt

SEQ ID NO: 197730 - DNA, 25 bp, Homo sapien
ttttcccccaactggtgcagcggct

SEQ ID NO: 197731 - DNA, 25 bp, Homo sapien
acctcccgtcatggggagcccggca

SEQ ID NO: 197732 - DNA, 25 bp, Homo sapien
tgaggctgtgcccagataaataagg

SEQ ID NO: 197733 - DNA, 25 bp, Homo sapien
cccagataaataaggccgctttgca

SEQ ID NO: 197734 - DNA, 25 bp, Homo sapien
gagccaatccgggttcgcgagcccg

SEQ ID NO: 197735 - DNA, 25 bp, Homo sapien
cctggctcatgccacgctgtccgcc

SEQ ID NO: 197736 - DNA, 25 bp, Homo sapien
ccttggccaccacttggggaggcga

SEQ ID NO: 197737 - DNA, 25 bp, Homo sapien
cggcaaggacccttcacagccctca

SEQ ID NO: 197738 - DNA, 25 bp, Homo sapien
gcgggcacccgcacaataacaaacc

SEQ ID NO: 197739 - DNA, 25 bp, Homo sapien
cccagcgtccagattggacccaagg

SEQ ID NO: 197740 - DNA, 25 bp, Homo sapien
agatgccgcctcccacgtggttcag

SEQ ID NO: 197741 - DNA, 25 bp, Homo sapien
ccagattggacccaaggggacgatc

SEQ ID NO: 197742 - DNA, 25 bp, Homo sapien
caccactgacgagggtgccacgaat

SEQ ID NO: 197743 - DNA, 25 bp, Homo sapien
gggacacagccgtcctcacgctcgg

SEQ ID NO: 197744 - DNA, 25 bp, Homo sapien
ctcggccaagggtcactggtgacag

SEQ ID NO: 197745 - DNA, 25 bp, Homo sapien
gattggacccaaggggacgatcgcc

SEQ ID NO: 197746 - DNA, 25 bp, Homo sapien
ccaagggtcactggtgacagacggc

SEQ ID NO: 197747 - DNA, 25 bp, Homo sapien
cgagcgctaatacggtcccttcttc

SEQ ID NO: 197748 - DNA, 25 bp, Homo sapien
tgcccatgggatttgtagccagtcc

SEQ ID NO: 197749 - DNA, 25 bp, Homo sapien
ccctcgaagggacctcaagtcactg

SEQ ID NO: 197750 - DNA, 25 bp, Homo sapien
ttcccgtagagtagataccaggccc

SEQ ID NO: 197751 - DNA, 25 bp, Homo sapien
ttgggccctcacttcttcactctga

SEQ ID NO: 197752 - DNA, 25 bp, Homo sapien
ttgttttgtaaacgcgccagccagg

SEQ ID NO: 197753 - DNA, 25 bp, Homo sapien
ggatacactgtgaacccgaccaagg

SEQ ID NO: 197754 - DNA, 25 bp, Homo sapien
cggcgaaacgctgcactggttagtt

SEQ ID NO: 197755 - DNA, 25 bp, Homo sapien
gtgcctccagagctgatgtagcaga

SEQ ID NO: 197756 - DNA, 25 bp, Homo sapien
cttcctacttggagctcacccactg

SEQ ID NO: 197757 - DNA, 25 bp, Homo sapien
ctccagagctgatgtagcagaaatc

SEQ ID NO: 197758 - DNA, 25 bp, Homo sapien
gctgatgtagcagaaatcactgaca

SEQ ID NO: 197759 - DNA, 25 bp, Homo sapien
atcaggtacggagtgcctccagagc

SEQ ID NO: 197760 - DNA, 25 bp, Homo sapien
ccacttagagatagagagaggcagg

SEQ ID NO: 197761 - DNA, 25 bp, Homo sapien
gacccgcgcttaccgccaatcgcaa

SEQ ID NO: 197762 - DNA, 25 bp, Homo sapien
caccacttagagatagagagaggca

SEQ ID NO: 197763 - DNA, 25 bp, Homo sapien
gactccctagccaggatccagcaga

SEQ ID NO: 197764 - DNA, 25 bp, Homo sapien
acacaatgtttattaatatactcca

SEQ ID NO: 197765 - DNA, 25 bp, Homo sapien
atgtttattaatatactccaaagtt

SEQ ID NO: 197766 - DNA, 25 bp, Homo sapien
tagccaggatccagcagatcctggc

SEQ ID NO: 197767 - DNA, 25 bp, Homo sapien
actccctagccaggatccagcagat

SEQ ID NO: 197768 - DNA, 25 bp, Homo sapien
ggggactccctagccaggatccagc

SEQ ID NO: 197769 - DNA, 25 bp, Homo sapien
tcaccttggacctgagcgtcgcctt

SEQ ID NO: 197770 - DNA, 25 bp, Homo sapien
cctagccaggatccagcagatcctg

SEQ ID NO: 197771 - DNA, 25 bp, Homo sapien
ggaacaggacctccgcactccaaga

SEQ ID NO: 197772 - DNA, 25 bp, Homo sapien
cgttcctgaaggaacaggacctccg

SEQ ID NO: 197773 - DNA, 25 bp, Homo sapien
gaaaagctgtctgtcgttcctgaag

SEQ ID NO: 197774 - DNA, 25 bp, Homo sapien
cggggagaaaagctgtctgtcgttc

SEQ ID NO: 197775 - DNA, 25 bp, Homo sapien
cgcaggaccacctcagatctccagt

SEQ ID NO: 197776 - DNA, 25 bp, Homo sapien
cccggctcctcgagacgcaggacca

SEQ ID NO: 197777 - DNA, 25 bp, Homo sapien
ctccttctcacagtcgggcgcccgg

SEQ ID NO: 197778 - DNA, 25 bp, Homo sapien
gacctccgcactccaagaaggaatc

SEQ ID NO: 197779 - DNA, 25 bp, Homo sapien
caggcctcttgggatcgcctcaaga

SEQ ID NO: 197780 - DNA, 25 bp, Homo sapien
ccgttcagacatgggtagtgtagcc

SEQ ID NO: 197781 - DNA, 25 bp, Homo sapien
acgagtgtctcgatttcctgtcagc

SEQ ID NO: 197782 - DNA, 25 bp, Homo sapien
cagggttgtcaaggtaacgctcctc

SEQ ID NO: 197783 - DNA, 25 bp, Homo sapien
cacctggtaattgtgacaccctgtc

SEQ ID NO: 197784 - DNA, 25 bp, Homo sapien
tcctgctgaagagacattggagcta

SEQ ID NO: 197785 - DNA, 25 bp, Homo sapien
aactcccagtatgcaccgcgatgcg

SEQ ID NO: 197786 - DNA, 25 bp, Homo sapien
cctgtcagccaacaaagggccgttc

SEQ ID NO: 197787 - DNA, 25 bp, Homo sapien
ccggttgcgcaacaagtgcgctgtg

SEQ ID NO: 197788 - DNA, 25 bp, Homo sapien
gccggttgcgcaacaagtgcgctgt

SEQ ID NO: 197789 - DNA, 25 bp, Homo sapien
agctccagaagcttgtgggcagctc

SEQ ID NO: 197790 - DNA, 25 bp, Homo sapien
cagctccagaagcttgtgggcagct

SEQ ID NO: 197791 - DNA, 25 bp, Homo sapien
cgctgcgcgtagcggccaggggaga

SEQ ID NO: 197792 - DNA, 25 bp, Homo sapien
gcgctgcgcgtagcggccaggggag

SEQ ID NO: 197793 - DNA, 25 bp, Homo sapien
cggcgctgcgcgtagcggccagggg

SEQ ID NO: 197794 - DNA, 25 bp, Homo sapien
cggttgcgcaacaagtgcgctgtgt

SEQ ID NO: 197795 - DNA, 25 bp, Homo sapien
tgagaaagccggctccaccaacgct

SEQ ID NO: 197796 - DNA, 25 bp, Homo sapien
gcgttctcatgggtggcgtcacagt

SEQ ID NO: 197797 - DNA, 25 bp, Homo sapien
cccgcaacaggctcctggctgagaa

SEQ ID NO: 197798 - DNA, 25 bp, Homo sapien
gagaaatgcaggctgctccgcagcc

SEQ ID NO: 197799 - DNA, 25 bp, Homo sapien
gttttccgagaaatgcaggctgctc

SEQ ID NO: 197800 - DNA, 25 bp, Homo sapien
ctgggccctgttttccgagaaatgc

SEQ ID NO: 197801 - DNA, 25 bp, Homo sapien
ggcgggctcatcttttccccaaagc

SEQ ID NO: 197802 - DNA, 25 bp, Homo sapien
catgggtggcgtcacagtggctcca

SEQ ID NO: 197803 - DNA, 25 bp, Homo sapien
gtccatgtcgctcagcatccttccc

SEQ ID NO: 197804 - DNA, 25 bp, Homo sapien
acctctaaagtccatgtcgctcagc

SEQ ID NO: 197805 - DNA, 25 bp, Homo sapien
cctctaaagtccatgtcgctcagca

SEQ ID NO: 197806 - DNA, 25 bp, Homo sapien
tctaaagtccatgtcgctcagcatc

SEQ ID NO: 197807 - DNA, 25 bp, Homo sapien
ctaaagtccatgtcgctcagcatcc

SEQ ID NO: 197808 - DNA, 25 bp, Homo sapien
taaagtccatgtcgctcagcatcct

SEQ ID NO: 197809 - DNA, 25 bp, Homo sapien
aagtccatgtcgctcagcatccttc

SEQ ID NO: 197810 - DNA, 25 bp, Homo sapien
cacctctaaagtccatgtcgctcag

SEQ ID NO: 197811 - DNA, 25 bp, Homo sapien
cccaggcagtgtagattctgtctgc

SEQ ID NO: 197812 - DNA, 25 bp, Homo sapien
cctcccaggcagtgtagattctgtc

SEQ ID NO: 197813 - DNA, 25 bp, Homo sapien
tcccaggcagtgtagattctgtctg

SEQ ID NO: 197814 - DNA, 25 bp, Homo sapien
ccaggcagtgtagattctgtctgct

SEQ ID NO: 197815 - DNA, 25 bp, Homo sapien
caggcagtgtagattctgtctgctg

SEQ ID NO: 197816 - DNA, 25 bp, Homo sapien
gcctcccaggcagtgtagattctgt

SEQ ID NO: 197817 - DNA, 25 bp, Homo sapien
ctcccaggcagtgtagattctgtct

SEQ ID NO: 197818 - DNA, 25 bp, Homo sapien
ctggccgctacgcgcagcgccgctc

SEQ ID NO: 197819 - DNA, 25 bp, Homo sapien
acagcgcacttgttgcgcaaccggc

SEQ ID NO: 197820 - DNA, 25 bp, Homo sapien
gagctgcccacaagcttctggagct

SEQ ID NO: 197821 - DNA, 25 bp, Homo sapien
acacagcgcacttgttgcgcaaccg

SEQ ID NO: 197822 - DNA, 25 bp, Homo sapien
agctgcccacaagcttctggagctg

SEQ ID NO: 197823 - DNA, 25 bp, Homo sapien
cacagcgcacttgttgcgcaaccgg

SEQ ID NO: 197824 - DNA, 25 bp, Homo sapien
ctcccctggccgctacgcgcagcgc

SEQ ID NO: 197825 - DNA, 25 bp, Homo sapien
gctgcccacaagcttctggagctgc

SEQ ID NO: 197826 - DNA, 25 bp, Homo sapien
cctggcttttcgcaatagtaaattt

SEQ ID NO: 197827 - DNA, 25 bp, Homo sapien
acccttcagcttttggcagcggttc

SEQ ID NO: 197828 - DNA, 25 bp, Homo sapien
aatgggctgagccttgttccacctc

SEQ ID NO: 197829 - DNA, 25 bp, Homo sapien
actgcaaggttagggatctcgtacc

SEQ ID NO: 197830 - DNA, 25 bp, Homo sapien
ctcagccttccgtcctataaaatgg

SEQ ID NO: 197831 - DNA, 25 bp, Homo sapien
cgcaccttcgagctcgacgtaagtg

SEQ ID NO: 197832 - DNA, 25 bp, Homo sapien
tgggtgcttttcatctccacggggc

SEQ ID NO: 197833 - DNA, 25 bp, Homo sapien
acagtcgcggcggtaatagcacttc

SEQ ID NO: 197834 - DNA, 25 bp, Homo sapien
acgtggacgacatgcccaacgcgct

SEQ ID NO: 197835 - DNA, 25 bp, Homo sapien
tgactttctccctcgctagggacgc

SEQ ID NO: 197836 - DNA, 25 bp, Homo sapien
aagcataaaccctggcgcgctcgcg

SEQ ID NO: 197837 - DNA, 25 bp, Homo sapien
gactcagagagaacccaccatggtg

SEQ ID NO: 197838 - DNA, 25 bp, Homo sapien
atggtgctgtctcctgccgacaaga

SEQ ID NO: 197839 - DNA, 25 bp, Homo sapien
tctgcccaggttaagggccacggca

SEQ ID NO: 197840 - DNA, 25 bp, Homo sapien
acctgcacgcgcacaagcttcgggt

SEQ ID NO: 197841 - DNA, 25 bp, Homo sapien
acaagaccaacgtcaaggccgcctg

SEQ ID NO: 197842 - DNA, 25 bp, Homo sapien
cccgcacttaggacggggtgcgctg

SEQ ID NO: 197843 - DNA, 25 bp, Homo sapien
cccaaccctcgaggcgcttggaccg

SEQ ID NO: 197844 - DNA, 25 bp, Homo sapien
cgcttggaccgtgggatagtcctcc

SEQ ID NO: 197845 - DNA, 25 bp, Homo sapien
ttggaccgtgggatagtcctccggc

SEQ ID NO: 197846 - DNA, 25 bp, Homo sapien
cccgcgcctgctattggcggaaagt

SEQ ID NO: 197847 - DNA, 25 bp, Homo sapien
cgactggccgacacgccgcaggccc

SEQ ID NO: 197848 - DNA, 25 bp, Homo sapien
tgctattggcggaaagttccgggcc

SEQ ID NO: 197849 - DNA, 25 bp, Homo sapien
aaggagcctcccttccgcgccaagg

SEQ ID NO: 197850 - DNA, 25 bp, Homo sapien
gttaccttgacaaccctgccgcgga

SEQ ID NO: 197851 - DNA, 25 bp, Homo sapien
tagctccaatgtctcttcagcagga

SEQ ID NO: 197852 - DNA, 25 bp, Homo sapien
ggctacactacccatgtctgaacgg

SEQ ID NO: 197853 - DNA, 25 bp, Homo sapien
aacggccctttgttggctgacagga

SEQ ID NO: 197854 - DNA, 25 bp, Homo sapien
tggctgacaggaaatcgagacactc

SEQ ID NO: 197855 - DNA, 25 bp, Homo sapien
ggggcttcttgaggcgatcccaaga

SEQ ID NO: 197856 - DNA, 25 bp, Homo sapien
caagaggcctgagaactgccacatc

SEQ ID NO: 197857 - DNA, 25 bp, Homo sapien
cccacccttgtctgaggagcgttac

SEQ ID NO: 197858 - DNA, 25 bp, Homo sapien
aggaacgacagacagcttttctccc

SEQ ID NO: 197859 - DNA, 25 bp, Homo sapien
ccgggcgcccgactgtgagaaggag

SEQ ID NO: 197860 - DNA, 25 bp, Homo sapien
cgtctcctcgtttgctcagccggca

SEQ ID NO: 197861 - DNA, 25 bp, Homo sapien
agtgcggaggtcctgttccttcagg

SEQ ID NO: 197862 - DNA, 25 bp, Homo sapien
cggaggtcctgttccttcaggaacg

SEQ ID NO: 197863 - DNA, 25 bp, Homo sapien
tgccaggctcatgaggccggcggcc

SEQ ID NO: 197864 - DNA, 25 bp, Homo sapien
cttcaggaacgacagacagcttttc

SEQ ID NO: 197865 - DNA, 25 bp, Homo sapien
attccttcttggagtgcggaggtcc

SEQ ID NO: 197866 - DNA, 25 bp, Homo sapien
ggatcctggctagggagtccccctc

SEQ ID NO: 197867 - DNA, 25 bp, Homo sapien
ctttggagtatattaataaacattg

SEQ ID NO: 197868 - DNA, 25 bp, Homo sapien
ggagtatattaataaacattgtgtt

SEQ ID NO: 197869 - DNA, 25 bp, Homo sapien
aaggcgacgctcaggtccaaggtga

SEQ ID NO: 197870 - DNA, 25 bp, Homo sapien
cgctcaggtccaaggtgagcggcga

SEQ ID NO: 197871 - DNA, 25 bp, Homo sapien
caggatctgctggatcctggctagg

SEQ ID NO: 197872 - DNA, 25 bp, Homo sapien
ctgctggatcctggctagggagtcc

SEQ ID NO: 197873 - DNA, 25 bp, Homo sapien
atctgctggatcctggctagggagt

SEQ ID NO: 197874 - DNA, 25 bp, Homo sapien
cagtgggtgagctccaagtaggaag

SEQ ID NO: 197875 - DNA, 25 bp, Homo sapien
ctctggaggcactccgtacctgatt

SEQ ID NO: 197876 - DNA, 25 bp, Homo sapien
atcagctctggaggcactccgtacc

SEQ ID NO: 197877 - DNA, 25 bp, Homo sapien
gctacatcagctctggaggcactcc

SEQ ID NO: 197878 - DNA, 25 bp, Homo sapien
ttctgctacatcagctctggaggca

SEQ ID NO: 197879 - DNA, 25 bp, Homo sapien
gtgatttctgctacatcagctctgg

SEQ ID NO: 197880 - DNA, 25 bp, Homo sapien
tgtcagtgatttctgctacatcagc

SEQ ID NO: 197881 - DNA, 25 bp, Homo sapien
ttgcgattggcggtaagcgcgggtc

SEQ ID NO: 197882 - DNA, 25 bp, Homo sapien
tcgcagcggtgaagagtcaaaaacc

SEQ ID NO: 197883 - DNA, 25 bp, Homo sapien
agccgcagcgtacaaaaagccgagg

SEQ ID NO: 197884 - DNA, 25 bp, Homo sapien
agctctagcgttgagggggcaaaaa

SEQ ID NO: 197885 - DNA, 25 bp, Homo sapien
gtcaaaaagctctagcgttgagggg

SEQ ID NO: 197886 - DNA, 25 bp, Homo sapien
agcggtgaagagtcaaaaacccgcg

SEQ ID NO: 197887 - DNA, 25 bp, Homo sapien
aaattcgcagcggtgaagagtcaaa

SEQ ID NO: 197888 - DNA, 25 bp, Homo sapien
aagccaaggcggtgataaagccgcg

SEQ ID NO: 197889 - DNA, 25 bp, Homo sapien
cggtggtcaaaaagctctagcgttg

SEQ ID NO: 197890 - DNA, 25 bp, Homo sapien
gggatgtcagagatgcagtctactc

SEQ ID NO: 197891 - DNA, 25 bp, Homo sapien
cggcgggatcaaaaagccagctgct

SEQ ID NO: 197892 - DNA, 25 bp, Homo sapien
tcactcatgcgctggaagagggatg

SEQ ID NO: 197893 - DNA, 25 bp, Homo sapien
tccatcgtccgtatttcctgctggg

SEQ ID NO: 197894 - DNA, 25 bp, Homo sapien
gatgcagtctactcttcctaaaggg

SEQ ID NO: 197895 - DNA, 25 bp, Homo sapien
cttcctaaagggctgacagggcata

SEQ ID NO: 197896 - DNA, 25 bp, Homo sapien
tttaaagcctctgctcactcatgcg

SEQ ID NO: 197897 - DNA, 25 bp, Homo sapien
cctgggattcctccaattaccctgt

SEQ ID NO: 197898 - DNA, 25 bp, Homo sapien
gcagtccacgaagcacttgaaagtg

SEQ ID NO: 197899 - DNA, 25 bp, Homo sapien
ccgactccggggtgatgtcactatc

SEQ ID NO: 197900 - DNA, 25 bp, Homo sapien
tccatctggcgcgtccaggtctatc

SEQ ID NO: 197901 - DNA, 25 bp, Homo sapien
acacgctacagatgccgttctcggc

SEQ ID NO: 197902 - DNA, 25 bp, Homo sapien
ggcgcagtcagaagcagtccacgaa

SEQ ID NO: 197903 - DNA, 25 bp, Homo sapien
gaagcccacacacgacatgatgaag

SEQ ID NO: 197904 - DNA, 25 bp, Homo sapien
cgatatcggcgctcgcagtctgcaa

SEQ ID NO: 197905 - DNA, 25 bp, Homo sapien
agcctgaagaatctcctgtgtgtca

SEQ ID NO: 197906 - DNA, 25 bp, Homo sapien
tatagcatccgggacacgcacgaga

SEQ ID NO: 197907 - DNA, 25 bp, Homo sapien
gcttccattacatcccgttcggcgg

SEQ ID NO: 197908 - DNA, 25 bp, Homo sapien
atgggctatgcctctgacatgcttg

SEQ ID NO: 197909 - DNA, 25 bp, Homo sapien
tgccgcgccagagaagcatctaagc

SEQ ID NO: 197910 - DNA, 25 bp, Homo sapien
cggtgggacctgcaacccttgtaag

SEQ ID NO: 197911 - DNA, 25 bp, Homo sapien
aggcttcgatccagagcgcttcggc

SEQ ID NO: 197912 - DNA, 25 bp, Homo sapien
acatgcttgcgctctaggacacggc

SEQ ID NO: 197913 - DNA, 25 bp, Homo sapien
taagcccatgggaagatgccttctg

SEQ ID NO: 197914 - DNA, 25 bp, Homo sapien
cgtgtcctccgccagacaccgccgc

SEQ ID NO: 197915 - DNA, 25 bp, Homo sapien
attcgtaccccactgcgctgtggcg

SEQ ID NO: 197916 - DNA, 25 bp, Homo sapien
ttccgccgtgcctacgaggctgccc

SEQ ID NO: 197917 - DNA, 25 bp, Homo sapien
gagttccgccgtgcctacgaggctg

SEQ ID NO: 197918 - DNA, 25 bp, Homo sapien
aggagttccgccgtgcctacgaggc

SEQ ID NO: 197919 - DNA, 25 bp, Homo sapien
tcttcatgggctggagccgctttgg

SEQ ID NO: 197920 - DNA, 25 bp, Homo sapien
cctcttcatgggctggagccgcttt

SEQ ID NO: 197921 - DNA, 25 bp, Homo sapien
cttcctcttcatgggctggagccgc

SEQ ID NO: 197922 - DNA, 25 bp, Homo sapien
tgcggcaatttccagcgtgcaggcc

SEQ ID NO: 197923 - DNA, 25 bp, Homo sapien
gccggagactgaaaccctgcccaga

SEQ ID NO: 197924 - DNA, 25 bp, Homo sapien
ccggcctcgatgtacagatagatta

SEQ ID NO: 197925 - DNA, 25 bp, Homo sapien
tcgccgtgtttacagccaccaaatc

SEQ ID NO: 197926 - DNA, 25 bp, Homo sapien
ctgagaattacctccagcgcgattg

SEQ ID NO: 197927 - DNA, 25 bp, Homo sapien
ccgctcatcttgtgacccggcttga

SEQ ID NO: 197928 - DNA, 25 bp, Homo sapien
gggcaacgcatttaaactctcagga

SEQ ID NO: 197929 - DNA, 25 bp, Homo sapien
agcagagttttccacctccaaggga

SEQ ID NO: 197930 - DNA, 25 bp, Homo sapien
ctgccgctcagggtctcaaggtctg

SEQ ID NO: 197931 - DNA, 25 bp, Homo sapien
ctctggcgacggcaggatcgtaagt

SEQ ID NO: 197932 - DNA, 25 bp, Homo sapien
cacgtgttgtcgctgctgcgaggac

SEQ ID NO: 197933 - DNA, 25 bp, Homo sapien
atcgtaagtgcctgcgtctgggtct

SEQ ID NO: 197934 - DNA, 25 bp, Homo sapien
ccatggagcaggacgacccggtcga

SEQ ID NO: 197935 - DNA, 25 bp, Homo sapien
cgcagagcggaccaacggagccgac

SEQ ID NO: 197936 - DNA, 25 bp, Homo sapien
agcacaggccgcaaacggcggtccg

SEQ ID NO: 197937 - DNA, 25 bp, Homo sapien
cggaaaaacggtggatctgggctct

SEQ ID NO: 197938 - DNA, 25 bp, Homo sapien
atcccagggcgcagcgcgacagtct

SEQ ID NO: 197939 - DNA, 25 bp, Homo sapien
tcccagggcgcagcgcgacagtctg

SEQ ID NO: 197940 - DNA, 25 bp, Homo sapien
cgcgacagtctgaggtgctgcacgc

SEQ ID NO: 197941 - DNA, 25 bp, Homo sapien
cccagggcgcagcgcgacagtctga

SEQ ID NO: 197942 - DNA, 25 bp, Homo sapien
cagcgcgacagtctgaggtgctgca

SEQ ID NO: 197943 - DNA, 25 bp, Homo sapien
acctcctgtgcatcccagggcgcag

SEQ ID NO: 197944 - DNA, 25 bp, Homo sapien
cacctcctgtgcatcccagggcgca

SEQ ID NO: 197945 - DNA, 25 bp, Homo sapien
agcgcgacagtctgaggtgctgcac

SEQ ID NO: 197946 - DNA, 25 bp, Homo sapien
cgcctcggaaggacgcggttctcca

SEQ ID NO: 197947 - DNA, 25 bp, Homo sapien
acgcggttctccagccctttccgtg

SEQ ID NO: 197948 - DNA, 25 bp, Homo sapien
tgcagcgcgttctttaactttccca

SEQ ID NO: 197949 - DNA, 25 bp, Homo sapien
cagcgcgttctttaactttcccaga

SEQ ID NO: 197950 - DNA, 25 bp, Homo sapien
gcctcggaaggacgcggttctccag

SEQ ID NO: 197951 - DNA, 25 bp, Homo sapien
gctgcagcgcgttctttaactttcc

SEQ ID NO: 197952 - DNA, 25 bp, Homo sapien
gcagcgcgttctttaactttcccag

SEQ ID NO: 197953 - DNA, 25 bp, Homo sapien
cggaaggacgcggttctccagccct

SEQ ID NO: 197954 - DNA, 25 bp, Homo sapien
gccctagttcacttctggtggagtt

SEQ ID NO: 197955 - DNA, 25 bp, Homo sapien
ggtcccttgcctacgcgccggcgcc

SEQ ID NO: 197956 - DNA, 25 bp, Homo sapien
acttctggtggagttgcatccttga

SEQ ID NO: 197957 - DNA, 25 bp, Homo sapien
agttcacttctggtggagttgcatc

SEQ ID NO: 197958 - DNA, 25 bp, Homo sapien
ccgccgctgttttttgccggcgcgg

SEQ ID NO: 197959 - DNA, 25 bp, Homo sapien
ccgcgcggccgcgatgtgagagaag

SEQ ID NO: 197960 - DNA, 25 bp, Homo sapien
tccagaacctcatcggcagcctgcg

SEQ ID NO: 197961 - DNA, 25 bp, Homo sapien
ctccgggccctagttcacttctggt

SEQ ID NO: 197962 - DNA, 25 bp, Homo sapien
atattcacagaagtcagcggtggtc

SEQ ID NO: 197963 - DNA, 25 bp, Homo sapien
aagtcagcggtggtcagccggaaca

SEQ ID NO: 197964 - DNA, 25 bp, Homo sapien
ccagcatgtcatcccggtcctcagc

SEQ ID NO: 197965 - DNA, 25 bp, Homo sapien
tcacagaagtcagcggtggtcagcc

SEQ ID NO: 197966 - DNA, 25 bp, Homo sapien
tacacccgcttccactggcgcaggc

SEQ ID NO: 197967 - DNA, 25 bp, Homo sapien
gctccttgctcagcgagagcgagcg

SEQ ID NO: 197968 - DNA, 25 bp, Homo sapien
gtgcctcctcttggtctcgctgtag

SEQ ID NO: 197969 - DNA, 25 bp, Homo sapien
tggtcagccggaacacgtgcctcct

SEQ ID NO: 197970 - DNA, 25 bp, Homo sapien
ccgagaacggcatctgtagcgtgtc

SEQ ID NO: 197971 - DNA, 25 bp, Homo sapien
tgtccggcgaccagaagaagggccc

SEQ ID NO: 197972 - DNA, 25 bp, Homo sapien
gatagacctggacgcgccagatgga

SEQ ID NO: 197973 - DNA, 25 bp, Homo sapien
cttcatcatgtcgtgtgtgggcttc

SEQ ID NO: 197974 - DNA, 25 bp, Homo sapien
cttgcagactgcgagcgccgatatc

SEQ ID NO: 197975 - DNA, 25 bp, Homo sapien
ccctgacacacaggagattcttcag

SEQ ID NO: 197976 - DNA, 25 bp, Homo sapien
gattcttcaggctcactttcaagtg

SEQ ID NO: 197977 - DNA, 25 bp, Homo sapien
caagtgcttcgtggactgcttctga

SEQ ID NO: 197978 - DNA, 25 bp, Homo sapien
tacggcttcatctacaagacgcatc

SEQ ID NO: 197979 - DNA, 25 bp, Homo sapien
tgcgcaccattctgggatctggctg

SEQ ID NO: 197980 - DNA, 25 bp, Homo sapien
caggttagctttcccagctcggaga

SEQ ID NO: 197981 - DNA, 25 bp, Homo sapien
actcaggtgattatgcgggccttca

SEQ ID NO: 197982 - DNA, 25 bp, Homo sapien
actcgaatgctacgtgccggtgatc

SEQ ID NO: 197983 - DNA, 25 bp, Homo sapien
gttccgaatcgccatgcgcatccta

SEQ ID NO: 197984 - DNA, 25 bp, Homo sapien
tcccacagcggaggaagttcctgca

SEQ ID NO: 197985 - DNA, 25 bp, Homo sapien
ggtgaagcgcctcatgttccgaatc

SEQ ID NO: 197986 - DNA, 25 bp, Homo sapien
aatcttgtctttatgccctgtcagc

SEQ ID NO: 197987 - DNA, 25 bp, Homo sapien
ccctgtcagccctttaggaagagta

SEQ ID NO: 197988 - DNA, 25 bp, Homo sapien
gagtagactgcatctctgacatccc

SEQ ID NO: 197989 - DNA, 25 bp, Homo sapien
catccctcttccagcgcatgagtga

SEQ ID NO: 197990 - DNA, 25 bp, Homo sapien
cgcatgagtgagcagaggctttaaa

SEQ ID NO: 197991 - DNA, 25 bp, Homo sapien
taattggaggaatcccaggggagca

SEQ ID NO: 197992 - DNA, 25 bp, Homo sapien
agcagctggctttttgatcccgccg

SEQ ID NO: 197993 - DNA, 25 bp, Homo sapien
cccagcaggaaatacggacgatgga

SEQ ID NO: 197994 - DNA, 25 bp, Homo sapien
ctggcgtcctggcaatggtagagct

SEQ ID NO: 197995 - DNA, 25 bp, Homo sapien
agcctttgctgctttttgatatcgc

SEQ ID NO: 197996 - DNA, 25 bp, Homo sapien
ttgctgctttttgatatcgcggctt

SEQ ID NO: 197997 - DNA, 25 bp, Homo sapien
cgccgccacagtttttgcatctttt

SEQ ID NO: 197998 - DNA, 25 bp, Homo sapien
gccacagtttttgcatcttttttcc

SEQ ID NO: 197999 - DNA, 25 bp, Homo sapien
tgcatcttttttcccacgccttggc

SEQ ID NO: 198000 - DNA, 25 bp, Homo sapien
catcttttttcccacgccttggcgg

SEQ ID NO: 198001 - DNA, 25 bp, Homo sapien
tttgtgcccactgacggggctttat

SEQ ID NO: 198002 - DNA, 25 bp, Homo sapien
tgagccagcccgatatattggaagc

SEQ ID NO: 198003 - DNA, 25 bp, Homo sapien
gtcttcgttggaagaagcgacgatg

SEQ ID NO: 198004 - DNA, 25 bp, Homo sapien
gccagcccgatatattggaagctcg

SEQ ID NO: 198005 - DNA, 25 bp, Homo sapien
tgtcctgagccagcccgatatattg

SEQ ID NO: 198006 - DNA, 25 bp, Homo sapien
cctgtcctgagccagcccgatatat

SEQ ID NO: 198007 - DNA, 25 bp, Homo sapien
gcagccctggcggctgttctctgtg

SEQ ID NO: 198008 - DNA, 25 bp, Homo sapien
cttcgttggaagaagcgacgatggt

SEQ ID NO: 198009 - DNA, 25 bp, Homo sapien
agcccgatatattggaagctcggga

SEQ ID NO: 198010 - DNA, 25 bp, Homo sapien
agcacgctagcagggaatcattttc

SEQ ID NO: 198011 - DNA, 25 bp, Homo sapien
ctgccatctgtttgactcagcctga

SEQ ID NO: 198012 - DNA, 25 bp, Homo sapien
tgagcggcccaaactgtcccattga

SEQ ID NO: 198013 - DNA, 25 bp, Homo sapien
gggagattctttctgcctgcgaagc

SEQ ID NO: 198014 - DNA, 25 bp, Homo sapien
gatgcctggaccttcgattctgaca

SEQ ID NO: 198015 - DNA, 25 bp, Homo sapien
ctggactccaaaaggcaggtctctc

SEQ ID NO: 198016 - DNA, 25 bp, Homo sapien
tgagcggctcaagttgtcccactga

SEQ ID NO: 198017 - DNA, 25 bp, Homo sapien
ctcgctggaatttcacggacacaca

SEQ ID NO: 198018 - DNA, 25 bp, Homo sapien
tgtctctgaccgctgtgctgaccac

SEQ ID NO: 198019 - DNA, 25 bp, Homo sapien
ccgtgctcgaggacaactacatgta

SEQ ID NO: 198020 - DNA, 25 bp, Homo sapien
tctgctctccggaagtcattggcgg

SEQ ID NO: 198021 - DNA, 25 bp, Homo sapien
ccttgtttatcttggggctccctga

SEQ ID NO: 198022 - DNA, 25 bp, Homo sapien
tccctgaagttacggcacctctggc

SEQ ID NO: 198023 - DNA, 25 bp, Homo sapien
gggaccgtctgtgttaccgtcactc

SEQ ID NO: 198024 - DNA, 25 bp, Homo sapien
gccggccacatgagctacttcctgt

SEQ ID NO: 198025 - DNA, 25 bp, Homo sapien
ctttcagctgctggagatcgtgggc

SEQ ID NO: 198026 - DNA, 25 bp, Homo sapien
tggaacccgaaaccacgcttcagtc

SEQ ID NO: 198027 - DNA, 25 bp, Homo sapien
attcgtctgaatcgctcccggatga

SEQ ID NO: 198028 - DNA, 25 bp, Homo sapien
ttgctctctgggcaattcgctcatt

SEQ ID NO: 198029 - DNA, 25 bp, Homo sapien
acgtggggctatctcatctgtgaac

SEQ ID NO: 198030 - DNA, 25 bp, Homo sapien
tcgcgctccgttgcaggctcaacgt

SEQ ID NO: 198031 - DNA, 25 bp, Homo sapien
tggacgggactatccacctcgcgct

SEQ ID NO: 198032 - DNA, 25 bp, Homo sapien
cttcagtcggcctgaatgtgactcc

SEQ ID NO: 198033 - DNA, 25 bp, Homo sapien
tcccggatgaagcaacccaggctgg

SEQ ID NO: 198034 - DNA, 25 bp, Homo sapien
ggtctgtagcttccacgtcggggaa

SEQ ID NO: 198035 - DNA, 25 bp, Homo sapien
tttagcggtggatcactgggcttct

SEQ ID NO: 198036 - DNA, 25 bp, Homo sapien
tgtcgatgaagaacgcagctagctg

SEQ ID NO: 198037 - DNA, 25 bp, Homo sapien
ttgcaggacagattgatcatcgaca

SEQ ID NO: 198038 - DNA, 25 bp, Homo sapien
ttcgaacgcaattgcagcccgggtt

SEQ ID NO: 198039 - DNA, 25 bp, Homo sapien
tctgagcgtcgcttgccgatcagta

SEQ ID NO: 198040 - DNA, 25 bp, Homo sapien
ccgccacccgcgaaaacagagaggg

SEQ ID NO: 198041 - DNA, 25 bp, Homo sapien
gcggtccagattcctccctcggagg

SEQ ID NO: 198042 - DNA, 25 bp, Homo sapien
ttgtgtggcgctgccacgggccact

SEQ ID NO: 198043 - DNA, 25 bp, Homo sapien
ggctccgccttgtgtggcgctgcca

SEQ ID NO: 198044 - DNA, 25 bp, Homo sapien
tgccaggggccgtccggcttcctag

SEQ ID NO: 198045 - DNA, 25 bp, Homo sapien
acaagaaaccagcaacgtggccctg

SEQ ID NO: 198046 - DNA, 25 bp, Homo sapien
ggatggacaagaaaccagcaacgtg

SEQ ID NO: 198047 - DNA, 25 bp, Homo sapien
atgcctggccatgggaagcatccca

SEQ ID NO: 198048 - DNA, 25 bp, Homo sapien
gcggctcgtcacctactgtgtggcc

SEQ ID NO: 198049 - DNA, 25 bp, Homo sapien
ccgccttcatgcttggaggccgctg

SEQ ID NO: 198050 - DNA, 25 bp, Homo sapien
cggtgttattcccatgacccgctgg

SEQ ID NO: 198051 - DNA, 25 bp, Homo sapien
gccgcctggataccgcagctaggaa

SEQ ID NO: 198052 - DNA, 25 bp, Homo sapien
ggggcatttgtattgcaccgctaga

SEQ ID NO: 198053 - DNA, 25 bp, Homo sapien
ttctgaccataaacgatgccgactg

SEQ ID NO: 198054 - DNA, 25 bp, Homo sapien
gcccgcctctactactgataggatg

SEQ ID NO: 198055 - DNA, 25 bp, Homo sapien
ccggcgcagtttggaccagagtgaa

SEQ ID NO: 198056 - DNA, 25 bp, Homo sapien
ggagcctgcggcttaatttgactca

SEQ ID NO: 198057 - DNA, 25 bp, Homo sapien
tggccttcagccacccgaaattgag

SEQ ID NO: 198058 - DNA, 25 bp, Homo sapien
agcgcctctgttctttaaaccctgc

SEQ ID NO: 198059 - DNA, 25 bp, Homo sapien
aagggaactcgagccggcgtcctcg

SEQ ID NO: 198060 - DNA, 25 bp, Homo sapien
ctccgccttgtgtaggaaccggtgc

SEQ ID NO: 198061 - DNA, 25 bp, Homo sapien
cttggccgacagcttgggtgtctct

SEQ ID NO: 198062 - DNA, 25 bp, Homo sapien
tttaaaccctgccacatcctgagac

SEQ ID NO: 198063 - DNA, 25 bp, Homo sapien
ctgctccggctgcttttgccgacgg

SEQ ID NO: 198064 - DNA, 25 bp, Homo sapien
ttttgccgacggaagccgtctcctg

SEQ ID NO: 198065 - DNA, 25 bp, Homo sapien
gtcccgagagtgaagaaccaagaag

SEQ ID NO: 198066 - DNA, 25 bp, Homo sapien
agaagccgttcagcggcgccatctg

SEQ ID NO: 198067 - DNA, 25 bp, Homo sapien
agcccagggaatagcgctcaggacc

SEQ ID NO: 198068 - DNA, 25 bp, Homo sapien
agaccggggcatagaacctgtcctg

SEQ ID NO: 198069 - DNA, 25 bp, Homo sapien
gcgcccaacctgtcgctgcggaaga

SEQ ID NO: 198070 - DNA, 25 bp, Homo sapien
agccaatgtctcctgttgctgtccg

SEQ ID NO: 198071 - DNA, 25 bp, Homo sapien
gtccgcgcctcagcgttgaagccag

SEQ ID NO: 198072 - DNA, 25 bp, Homo sapien
ctggagacgtcgctgagcaccaggt

SEQ ID NO: 198073 - DNA, 25 bp, Homo sapien
tctcgcagcctttttggcgtccgcg

SEQ ID NO: 198074 - DNA, 25 bp, Homo sapien
tttccagcccagatcagaacccttg

SEQ ID NO: 198075 - DNA, 25 bp, Homo sapien
acaattttgctccagagcgagcggc

SEQ ID NO: 198076 - DNA, 25 bp, Homo sapien
tcagacctttctgggtcccggagga

SEQ ID NO: 198077 - DNA, 25 bp, Homo sapien
gcacctctgcatccttttattacgg

SEQ ID NO: 198078 - DNA, 25 bp, Homo sapien
aacggagctagttgcgcacctctgc

SEQ ID NO: 198079 - DNA, 25 bp, Homo sapien
ccacacttggcgcttggcaaactta

SEQ ID NO: 198080 - DNA, 25 bp, Homo sapien
tgaaactggcatcgctctctgcatc

SEQ ID NO: 198081 - DNA, 25 bp, Homo sapien
cccagctcccgaggtggacaatttt

SEQ ID NO: 198082 - DNA, 25 bp, Homo sapien
ggaggaagtgttcccgccctctgtc

SEQ ID NO: 198083 - DNA, 25 bp, Homo sapien
tgcagccgcgggattcaaactcccg

SEQ ID NO: 198084 - DNA, 25 bp, Homo sapien
ttcaaactcccggaagcggcatcca

SEQ ID NO: 198085 - DNA, 25 bp, Homo sapien
acacctgatggtgtgactcggccga

SEQ ID NO: 198086 - DNA, 25 bp, Homo sapien
cgcgcttcgcttcagctgctagctg

SEQ ID NO: 198087 - DNA, 25 bp, Homo sapien
atcccagaattagctggcgggcccg

SEQ ID NO: 198088 - DNA, 25 bp, Homo sapien
ttcagctgctagctggcccaaggga

SEQ ID NO: 198089 - DNA, 25 bp, Homo sapien
ccggaagcggcatccacacctgatg

SEQ ID NO: 198090 - DNA, 25 bp, Homo sapien
acaaacttcccactcttgtagaagc

SEQ ID NO: 198091 - DNA, 25 bp, Homo sapien
ccgcccgcatgttctgactcatagg

SEQ ID NO: 198092 - DNA, 25 bp, Homo sapien
caggttcagctcgtttatgtccttc

SEQ ID NO: 198093 - DNA, 25 bp, Homo sapien
atcacacgtcttgggcaggttcagc

SEQ ID NO: 198094 - DNA, 25 bp, Homo sapien
cgtctggatctgagaagctgatatc

SEQ ID NO: 198095 - DNA, 25 bp, Homo sapien
ccaacttgaagttgaggaggtcgtc

SEQ ID NO: 198096 - DNA, 25 bp, Homo sapien
gtagaagccctcatcaggacagatg

SEQ ID NO: 198097 - DNA, 25 bp, Homo sapien
caggacagatgaccaacttgaagtt

SEQ ID NO: 198098 - DNA, 25 bp, Homo sapien
ccgtttcccaccgagcacgtgagga

SEQ ID NO: 198099 - DNA, 25 bp, Homo sapien
gcccaccatggcagcgcagcgttct

SEQ ID NO: 198100 - DNA, 25 bp, Homo sapien
atcacggcaggtggcctggacggca

SEQ ID NO: 198101 - DNA, 25 bp, Homo sapien
ggcagcatccacacctgtattccgt

SEQ ID NO: 198102 - DNA, 25 bp, Homo sapien
tgtattccgtttcccaccgagcacg

SEQ ID NO: 198103 - DNA, 25 bp, Homo sapien
ccaccgagcacgtgaggaccaacga

SEQ ID NO: 198104 - DNA, 25 bp, Homo sapien
agcacgtgaggaccaacgagcgctc

SEQ ID NO: 198105 - DNA, 25 bp, Homo sapien
agcatccacacctgtattccgtttc

SEQ ID NO: 198106 - DNA, 25 bp, Homo sapien
cgcaataacacttctcccacaggga

SEQ ID NO: 198107 - DNA, 25 bp, Homo sapien
cgtataaggctttccctggcccttg

SEQ ID NO: 198108 - DNA, 25 bp, Homo sapien
gcctgtttcctagaagctgaagccg

SEQ ID NO: 198109 - DNA, 25 bp, Homo sapien
ggttcgcccttccacacacggaata

SEQ ID NO: 198110 - DNA, 25 bp, Homo sapien
aataagctgttggactggctgcctc

SEQ ID NO: 198111 - DNA, 25 bp, Homo sapien
ggctgcctcacctaggacccgagtt

SEQ ID NO: 198112 - DNA, 25 bp, Homo sapien
aggacccgagttgcgccagagaaaa

SEQ ID NO: 198113 - DNA, 25 bp, Homo sapien
gtctgtcactttagcgaccgcaata

SEQ ID NO: 198114 - DNA, 25 bp, Homo sapien
gcggccatttgccaacctctcggga

SEQ ID NO: 198115 - DNA, 25 bp, Homo sapien
ttgagaggccacacgccctatgttg

SEQ ID NO: 198116 - DNA, 25 bp, Homo sapien
caatccggccgaggagcgttaccat

SEQ ID NO: 198117 - DNA, 25 bp, Homo sapien
acgggctgcattgcgcatgtctgca

SEQ ID NO: 198118 - DNA, 25 bp, Homo sapien
gctgcacaacgcatgtctgaaagaa

SEQ ID NO: 198119 - DNA, 25 bp, Homo sapien
tgcgcatgtctgaatgggcagtccc

SEQ ID NO: 198120 - DNA, 25 bp, Homo sapien
gtagcccattcctagcgacgcgctg

SEQ ID NO: 198121 - DNA, 25 bp, Homo sapien
cgccctatgttggtctgcgagaaat

SEQ ID NO: 198122 - DNA, 25 bp, Homo sapien
tgacgccgctctctggcgtagacga

SEQ ID NO: 198123 - DNA, 25 bp, Homo sapien
agcgtgcaaaggtggaaccgcagcc

SEQ ID NO: 198124 - DNA, 25 bp, Homo sapien
ctgctgcagaccctgcttcaggatc

SEQ ID NO: 198125 - DNA, 25 bp, Homo sapien
acttggaatccaaaacgcttcgtgg

SEQ ID NO: 198126 - DNA, 25 bp, Homo sapien
aaacgcttcgtggtgctctcaggac

SEQ ID NO: 198127 - DNA, 25 bp, Homo sapien
gaaccatgaacccagcgcagctgcg

SEQ ID NO: 198128 - DNA, 25 bp, Homo sapien
tgctgctcctactgccgcaacttgg

SEQ ID NO: 198129 - DNA, 25 bp, Homo sapien
gcagcgccgagttgctcctgctagc

SEQ ID NO: 198130 - DNA, 25 bp, Homo sapien
gtcgcacctgcttgccgtgccaaag

SEQ ID NO: 198131 - DNA, 25 bp, Homo sapien
gggcccgctcatacaggagatcatg

SEQ ID NO: 198132 - DNA, 25 bp, Homo sapien
gagggcagcctcttctccagaaaag

SEQ ID NO: 198133 - DNA, 25 bp, Homo sapien
ggccatttgtgccaacatttccaac

SEQ ID NO: 198134 - DNA, 25 bp, Homo sapien
tgtgtccatatcacctcacgtttca

SEQ ID NO: 198135 - DNA, 25 bp, Homo sapien
actgcacttgaacttgactctccca

SEQ ID NO: 198136 - DNA, 25 bp, Homo sapien
acaggcagcagcacgacattctggg

SEQ ID NO: 198137 - DNA, 25 bp, Homo sapien
tgtcctcggaatcgccgcacaaact

SEQ ID NO: 198138 - DNA, 25 bp, Homo sapien
ttctccgggaatgtgcaggattacc

SEQ ID NO: 198139 - DNA, 25 bp, Homo sapien
cacgtcctctctttctccgggaatg

SEQ ID NO: 198140 - DNA, 25 bp, Homo sapien
cagagcctgtggctgttcgccatcc

SEQ ID NO: 198141 - DNA, 25 bp, Homo sapien
gctgacatcggcctctgaagtggtt

SEQ ID NO: 198142 - DNA, 25 bp, Homo sapien
gcggtgcacgatgctcccaatccgt

SEQ ID NO: 198143 - DNA, 25 bp, Homo sapien
ggagatgccttgtcctgctctcagg

SEQ ID NO: 198144 - DNA, 25 bp, Homo sapien
tgctgcctcacgttggaattggaga

SEQ ID NO: 198145 - DNA, 25 bp, Homo sapien
cacctccaaacagctcgggtctttg

SEQ ID NO: 198146 - DNA, 25 bp, Homo sapien
cgcgcccaaagtctggcggaagagc

SEQ ID NO: 198147 - DNA, 25 bp, Homo sapien
cctcccggtgcatccaggagttgta

SEQ ID NO: 198148 - DNA, 25 bp, Homo sapien
acagaaaggcttccctccgcagggc

SEQ ID NO: 198149 - DNA, 25 bp, Homo sapien
ccagcacgagagatttgagaacaga

SEQ ID NO: 198150 - DNA, 25 bp, Homo sapien
acaaggtgtcacaattacaagggga

SEQ ID NO: 198151 - DNA, 25 bp, Homo sapien
tacgaacacgacaagcattagcctg

SEQ ID NO: 198152 - DNA, 25 bp, Homo sapien
gcggaagagcgttaccctggcaacc

SEQ ID NO: 198153 - DNA, 25 bp, Homo sapien
gctgcaggaggacaattcaaattga

SEQ ID NO: 198154 - DNA, 25 bp, Homo sapien
cctgagcttaaattccagtttcaca

SEQ ID NO: 198155 - DNA, 25 bp, Homo sapien
ggtgcattcctccagggctacctgc

SEQ ID NO: 198156 - DNA, 25 bp, Homo sapien
tgtttcttccagtccttccgccggc

SEQ ID NO: 198157 - DNA, 25 bp, Homo sapien
ggccgcttgtctgcctgagcttaaa

SEQ ID NO: 198158 - DNA, 25 bp, Homo sapien
ttccagctgggaaggacgtatccac

SEQ ID NO: 198159 - DNA, 25 bp, Homo sapien
ggaaggacgtatccaccgcgccgtc

SEQ ID NO: 198160 - DNA, 25 bp, Homo sapien
cccatgccggggagggtgcattcct

SEQ ID NO: 198161 - DNA, 25 bp, Homo sapien
gcatccgcagccgtggcttgcttct

SEQ ID NO: 198162 - DNA, 25 bp, Homo sapien
agtctctgtcgttaatgcctcgcgc

SEQ ID NO: 198163 - DNA, 25 bp, Homo sapien
agcggcggatcatctccaggaagcg

SEQ ID NO: 198164 - DNA, 25 bp, Homo sapien
gagtaggaactgcagccgccacatc

SEQ ID NO: 198165 - DNA, 25 bp, Homo sapien
agcgcagtgcagagttgctcctgtt

SEQ ID NO: 198166 - DNA, 25 bp, Homo sapien
cacaggttggaactggagatgcctc

SEQ ID NO: 198167 - DNA, 25 bp, Homo sapien
accgtcctgcgcagtctctttctga

SEQ ID NO: 198168 - DNA, 25 bp, Homo sapien
ctgcgcggtgacatcagtctctgtc

SEQ ID NO: 198169 - DNA, 25 bp, Homo sapien
tttacccggggatgtgcaggattac

SEQ ID NO: 198170 - DNA, 25 bp, Homo sapien
gcgcgactgcctgcctggtactcaa

SEQ ID NO: 198171 - DNA, 25 bp, Homo sapien
agatgagcactctctcagaccgctg

SEQ ID NO: 198172 - DNA, 25 bp, Homo sapien
aaccgtgctggtgctcatctttgca

SEQ ID NO: 198173 - DNA, 25 bp, Homo sapien
tggtactcaacctcttctgcgcgga

SEQ ID NO: 198174 - DNA, 25 bp, Homo sapien
cttcatcagcgctatccctctggtg

SEQ ID NO: 198175 - DNA, 25 bp, Homo sapien
ttctacgtgatgaccctgagcggca

SEQ ID NO: 198176 - DNA, 25 bp, Homo sapien
tctctgcgtcttcttccgagtcgtc

SEQ ID NO: 198177 - DNA, 25 bp, Homo sapien
tcttctccgacgtcaagggcgacca

SEQ ID NO: 198178 - DNA, 25 bp, Homo sapien
ggggttcctcacttcagacagctca

SEQ ID NO: 198179 - DNA, 25 bp, Homo sapien
gcagggctttaccaacaaaatgatc

SEQ ID NO: 198180 - DNA, 25 bp, Homo sapien
gggcccagacagacaccatgagatg

SEQ ID NO: 198181 - DNA, 25 bp, Homo sapien
ctaagtcttgctcttcctctgggtc

SEQ ID NO: 198182 - DNA, 25 bp, Homo sapien
gtcctctcttcggttcgcactttgg

SEQ ID NO: 198183 - DNA, 25 bp, Homo sapien
tcagtttttcgcgtgaccgactctc

SEQ ID NO: 198184 - DNA, 25 bp, Homo sapien
gctgctgatagtggtagtgcccatc

SEQ ID NO: 198185 - DNA, 25 bp, Homo sapien
cgccagcgtgctgatgctgctgata

SEQ ID NO: 198186 - DNA, 25 bp, Homo sapien
aaagccgcaataagcagtggcggca

SEQ ID NO: 198187 - DNA, 25 bp, Homo sapien
gtcaaaatgccaccgcggcaggggt

SEQ ID NO: 198188 - DNA, 25 bp, Homo sapien
atggggtcaaaatgccaccgcggca

SEQ ID NO: 198189 - DNA, 25 bp, Homo sapien
acggtgatggggtcaaaatgccacc

SEQ ID NO: 198190 - DNA, 25 bp, Homo sapien
agccgtggcggcaaaaaactgcggc

SEQ ID NO: 198191 - DNA, 25 bp, Homo sapien
actgcaaaatcccacggcgacgggg

SEQ ID NO: 198192 - DNA, 25 bp, Homo sapien
ccacagtggtgggtccaaaaagccg

SEQ ID NO: 198193 - DNA, 25 bp, Homo sapien
gaaaaactgcaaaatcccacggcga

SEQ ID NO: 198194 - DNA, 25 bp, Homo sapien
gcccgactttgaggtcccgtcactg

SEQ ID NO: 198195 - DNA, 25 bp, Homo sapien
cccggcatggagagctcacctttct

SEQ ID NO: 198196 - DNA, 25 bp, Homo sapien
caaatttccgcggacggcagcccag

SEQ ID NO: 198197 - DNA, 25 bp, Homo sapien
gcccaggcaacgacgtgatgacgca

SEQ ID NO: 198198 - DNA, 25 bp, Homo sapien
tgacgcaggctctgctgatttgata

SEQ ID NO: 198199 - DNA, 25 bp, Homo sapien
ctgatttgatagtcgggccgaggcc

SEQ ID NO: 198200 - DNA, 25 bp, Homo sapien
ccgaggccgtggaccaattagagtc

SEQ ID NO: 198201 - DNA, 25 bp, Homo sapien
agcgacccgtcagccatttcaaatt

SEQ ID NO: 198202 - DNA, 25 bp, Homo sapien
gacaagtccacgttcaccgcatctg

SEQ ID NO: 198203 - DNA, 25 bp, Homo sapien
ccctacaggcggctcattgattggc

SEQ ID NO: 198204 - DNA, 25 bp, Homo sapien
gcctacttctaggaacccgagtctc

SEQ ID NO: 198205 - DNA, 25 bp, Homo sapien
tggccctgtcacttaacgctagatg

SEQ ID NO: 198206 - DNA, 25 bp, Homo sapien
gcgcatgcgcaaaaggaagaccctg

SEQ ID NO: 198207 - DNA, 25 bp, Homo sapien
attgttcgctttagtgccggcgcca

SEQ ID NO: 198208 - DNA, 25 bp, Homo sapien
ctcggccgtgagcttgaatgagatg

SEQ ID NO: 198209 - DNA, 25 bp, Homo sapien
cgagtctcgcgtgcttattggccct

SEQ ID NO: 198210 - DNA, 25 bp, Homo sapien
tgagctgctactcccgaaaggcccg

SEQ ID NO: 198211 - DNA, 25 bp, Homo sapien
ctactcccgaaaggcccggccagct

SEQ ID NO: 198212 - DNA, 25 bp, Homo sapien
cgggccaggtgcacaccaagggcca

SEQ ID NO: 198213 - DNA, 25 bp, Homo sapien
acagcgtggcagctgaggatgcaga

SEQ ID NO: 198214 - DNA, 25 bp, Homo sapien
tgcagacgtggctcacgggctgctc

SEQ ID NO: 198215 - DNA, 25 bp, Homo sapien
caccgccacgttggccagaggagtc

SEQ ID NO: 198216 - DNA, 25 bp, Homo sapien
ggggatccccaagcagctcggagta

SEQ ID NO: 198217 - DNA, 25 bp, Homo sapien
cgcgatgagctgctactcccgaaag

SEQ ID NO: 198218 - DNA, 25 bp, Homo sapien
ttcgaccaacgaatgcataggtagg

SEQ ID NO: 198219 - DNA, 25 bp, Homo sapien
gggcatgatttggtggccatcttca

SEQ ID NO: 198220 - DNA, 25 bp, Homo sapien
tcttcactttcttggctcgagttgc

SEQ ID NO: 198221 - DNA, 25 bp, Homo sapien
ctcgagttgcagacatgctcctctc

SEQ ID NO: 198222 - DNA, 25 bp, Homo sapien
gcgggcctcaaacaagcctctggcg

SEQ ID NO: 198223 - DNA, 25 bp, Homo sapien
cagtaacgggcgtcgagttcgacca

SEQ ID NO: 198224 - DNA, 25 bp, Homo sapien
acccacctgttggtcgcactcgggg

SEQ ID NO: 198225 - DNA, 25 bp, Homo sapien
cgcgagctcgcccagagtatcacga

SEQ ID NO: 198226 - DNA, 25 bp, Homo sapien
ctgctgggtgataagcacggtctct

SEQ ID NO: 198227 - DNA, 25 bp, Homo sapien
gtcgtttagcgagaccttggccttc

SEQ ID NO: 198228 - DNA, 25 bp, Homo sapien
gctgcccttggcaaaacgcgttgtc

SEQ ID NO: 198229 - DNA, 25 bp, Homo sapien
ctgctgggatggatttcaggttaaa

SEQ ID NO: 198230 - DNA, 25 bp, Homo sapien
ttaaagcagagtcaccaggccgacc

SEQ ID NO: 198231 - DNA, 25 bp, Homo sapien
taccttgttagcatctagaaccttc

SEQ ID NO: 198232 - DNA, 25 bp, Homo sapien
agaaccttcttcagctcctcgtggc

SEQ ID NO: 198233 - DNA, 25 bp, Homo sapien
cgctgcacgccaggcagtcgtttag

SEQ ID NO: 198234 - DNA, 25 bp, Homo sapien
gaccagtctctagggcgtccatcgc

SEQ ID NO: 198235 - DNA, 25 bp, Homo sapien
tgaagagtttcaaaccgggagaggc

SEQ ID NO: 198236 - DNA, 25 bp, Homo sapien
agcagtaaatgcctccttcgtttgc

SEQ ID NO: 198237 - DNA, 25 bp, Homo sapien
ccctgttgcacggagatggcccgca

SEQ ID NO: 198238 - DNA, 25 bp, Homo sapien
tcaggtcgggaaactcgtcctgcgc

SEQ ID NO: 198239 - DNA, 25 bp, Homo sapien
tactgtccttgtgccagatgccgcg

SEQ ID NO: 198240 - DNA, 25 bp, Homo sapien
cgcaccgcgagctcaacacagttgg

SEQ ID NO: 198241 - DNA, 25 bp, Homo sapien
accaggaaggtctatactgtccttg

SEQ ID NO: 198242 - DNA, 25 bp, Homo sapien
acgttgcatgcatgccttgggcgca

SEQ ID NO: 198243 - DNA, 25 bp, Homo sapien
tgtagttcgcgtcactctccgcagc

SEQ ID NO: 198244 - DNA, 25 bp, Homo sapien
cgcagcctttgcgaaagccggttgg

SEQ ID NO: 198245 - DNA, 25 bp, Homo sapien
gcaccgctcgctgaaagagcccttg

SEQ ID NO: 198246 - DNA, 25 bp, Homo sapien
gtgcgcgacgtgtttgttctttttc

SEQ ID NO: 198247 - DNA, 25 bp, Homo sapien
ctctttttgtgccagggtttctctc

SEQ ID NO: 198248 - DNA, 25 bp, Homo sapien
ctggagtccatgaacccgcaggtga

SEQ ID NO: 198249 - DNA, 25 bp, Homo sapien
aacagctctagcttcgcagacgcga

SEQ ID NO: 198250 - DNA, 25 bp, Homo sapien
cagcagcttcgttagcttcgaaaga

SEQ ID NO: 198251 - DNA, 25 bp, Homo sapien
tgtttaacctcgcactggctgctga

SEQ ID NO: 198252 - DNA, 25 bp, Homo sapien
tcaaaagccatggttgcgaggtcgc

SEQ ID NO: 198253 - DNA, 25 bp, Homo sapien
ttcgtgtcagccacgttagccatgg

SEQ ID NO: 198254 - DNA, 25 bp, Homo sapien
tcccatcgtgtttgcgcaggagtga

SEQ ID NO: 198255 - DNA, 25 bp, Homo sapien
tgaactttgacccagcgcacggtgc

SEQ ID NO: 198256 - DNA, 25 bp, Homo sapien
gctgaagaagacatccctggccgcg

SEQ ID NO: 198257 - DNA, 25 bp, Homo sapien
ccaggatgtcgtacagcttcgtgtc

SEQ ID NO: 198258 - DNA, 25 bp, Homo sapien
cccggcggccactgacttcaaaaga

SEQ ID NO: 198259 - DNA, 25 bp, Homo sapien
ctggctcagttaccctgcactcgtg

SEQ ID NO: 198260 - DNA, 25 bp, Homo sapien
tccttgactcggaagctgctcactc

SEQ ID NO: 198261 - DNA, 25 bp, Homo sapien
ctacgcgagccttgtcgaagttctc

SEQ ID NO: 198262 - DNA, 25 bp, Homo sapien
tggcgtaccaggtcccagagaactg

SEQ ID NO: 198263 - DNA, 25 bp, Homo sapien
ccgcgacgatgttgtcctgcagaaa

SEQ ID NO: 198264 - DNA, 25 bp, Homo sapien
cttcaaaagacggactcggcccttg

SEQ ID NO: 198265 - DNA, 25 bp, Homo sapien
ctcgagtcaacctggcgggaagacc

SEQ ID NO: 198266 - DNA, 25 bp, Homo sapien
ggtctgtctatgctcagggcagcct

SEQ ID NO: 198267 - DNA, 25 bp, Homo sapien
agaagcgtggccctctggctacctc

SEQ ID NO: 198268 - DNA, 25 bp, Homo sapien
cctctgtggctaaaggaggccagaa

SEQ ID NO: 198269 - DNA, 25 bp, Homo sapien
ggagaaaacctgaacagggcctctg

SEQ ID NO: 198270 - DNA, 25 bp, Homo sapien
gagccaggagaataaggagaaaacc

SEQ ID NO: 198271 - DNA, 25 bp, Homo sapien
tggatccttccagggtctgtctatg

SEQ ID NO: 198272 - DNA, 25 bp, Homo sapien
tctcagcgcctggatccttccaggg

SEQ ID NO: 198273 - DNA, 25 bp, Homo sapien
ccagggtctgtctatgctcagggca

SEQ ID NO: 198274 - DNA, 25 bp, Homo sapien
ggcggagtcaacacagcctggcttc

SEQ ID NO: 198275 - DNA, 25 bp, Homo sapien
ctgcggttcacttgcaccttcttca

SEQ ID NO: 198276 - DNA, 25 bp, Homo sapien
agactcttctctggggatgaggctc

SEQ ID NO: 198277 - DNA, 25 bp, Homo sapien
ccttcgctggtttatctgcggttca

SEQ ID NO: 198278 - DNA, 25 bp, Homo sapien
tccctccgaggcgaagataggaagc

SEQ ID NO: 198279 - DNA, 25 bp, Homo sapien
cccgtgacaaatcgctggtcggaga

SEQ ID NO: 198280 - DNA, 25 bp, Homo sapien
ttggcgtcgagggtctccaccaaag

SEQ ID NO: 198281 - DNA, 25 bp, Homo sapien
aggggtctcgatagtgccatccacc

SEQ ID NO: 198282 - DNA, 25 bp, Homo sapien
ccacgacaggaatctcacaactttg

SEQ ID NO: 198283 - DNA, 25 bp, Homo sapien
atgcgcggaattctacggaagcggc

SEQ ID NO: 198284 - DNA, 25 bp, Homo sapien
tccttacctttgaggaccgagcaga

SEQ ID NO: 198285 - DNA, 25 bp, Homo sapien
ctttgaggaccgagcagagccgctc

SEQ ID NO: 198286 - DNA, 25 bp, Homo sapien
gctccagggccatgttcccgagctg

SEQ ID NO: 198287 - DNA, 25 bp, Homo sapien
gcgcccaggctcatttaaggaggga

SEQ ID NO: 198288 - DNA, 25 bp, Homo sapien
aggaatctcacaactttgcaaaggg

SEQ ID NO: 198289 - DNA, 25 bp, Homo sapien
ctttgcaaagggatgcgcggaattc

SEQ ID NO: 198290 - DNA, 25 bp, Homo sapien
gctgcccttccgacgctaaaaaagc

SEQ ID NO: 198291 - DNA, 25 bp, Homo sapien
aagcaccgcgttaccggccgagaga

SEQ ID NO: 198292 - DNA, 25 bp, Homo sapien
gactcccagtagtgcaagccctgcg

SEQ ID NO: 198293 - DNA, 25 bp, Homo sapien
agatccgtctgcttgtcggagttga

SEQ ID NO: 198294 - DNA, 25 bp, Homo sapien
ttcccgcagcacgaagagatccgtc

SEQ ID NO: 198295 - DNA, 25 bp, Homo sapien
ggcaagcactgactttcccgcagca

SEQ ID NO: 198296 - DNA, 25 bp, Homo sapien
gagaggcacacggacagcgaacaga

SEQ ID NO: 198297 - DNA, 25 bp, Homo sapien
cgacgctaaaaaagcagtggagcta

SEQ ID NO: 198298 - DNA, 25 bp, Homo sapien
tctttccgcataggtaggacgctca

SEQ ID NO: 198299 - DNA, 25 bp, Homo sapien
acgcttgagtgcacgtctttccgca

SEQ ID NO: 198300 - DNA, 25 bp, Homo sapien
ccttctgaagggcacgtcgctgcaa

SEQ ID NO: 198301 - DNA, 25 bp, Homo sapien
aaggctgccagcatgtcatcagtga

SEQ ID NO: 198302 - DNA, 25 bp, Homo sapien
cagctgtctgtctggctctttttga

SEQ ID NO: 198303 - DNA, 25 bp, Homo sapien
gtaggacgctcaagtcttaccggga

SEQ ID NO: 198304 - DNA, 25 bp, Homo sapien
gctgcaaagcaccatcctgggcgtc

SEQ ID NO: 198305 - DNA, 25 bp, Homo sapien
tctcctagagagcagcgcgaagcca

SEQ ID NO: 198306 - DNA, 25 bp, Homo sapien
tcaagagttactgcaggagcctgcc

SEQ ID NO: 198307 - DNA, 25 bp, Homo sapien
atgcccgtcttgctcgcgcaagggt

SEQ ID NO: 198308 - DNA, 25 bp, Homo sapien
tggctgagaaggaagtgcgctccct

SEQ ID NO: 198309 - DNA, 25 bp, Homo sapien
aaggaagtgcgctccctgagccagc

SEQ ID NO: 198310 - DNA, 25 bp, Homo sapien
cctgagccagctcaagagttactgc

SEQ ID NO: 198311 - DNA, 25 bp, Homo sapien
ctgcgttgggaacgcctactccaac

SEQ ID NO: 198312 - DNA, 25 bp, Homo sapien
cgcacagggcgatgcccgtcttgct

SEQ ID NO: 198313 - DNA, 25 bp, Homo sapien
ctgggcctgcgttgggaacgcctac

SEQ ID NO: 198314 - DNA, 25 bp, Homo sapien
gaggttgagccgctcctcagcaaca

SEQ ID NO: 198315 - DNA, 25 bp, Homo sapien
ggctactcggctaccgttgctgcgc

SEQ ID NO: 198316 - DNA, 25 bp, Homo sapien
tcccaaagaaaaagcggctgccctg

SEQ ID NO: 198317 - DNA, 25 bp, Homo sapien
cccttgttttgtctgctgatttagc

SEQ ID NO: 198318 - DNA, 25 bp, Homo sapien
agaagctagcgcttgcccgtcggct

SEQ ID NO: 198319 - DNA, 25 bp, Homo sapien
attcaacggatcctggcacgtggcg

SEQ ID NO: 198320 - DNA, 25 bp, Homo sapien
taaataccacacactgcggcggcgg

SEQ ID NO: 198321 - DNA, 25 bp, Homo sapien
tgcaccgcgcattcaacggatcctg

SEQ ID NO: 198322 - DNA, 25 bp, Homo sapien
ctgagacggcccgatgaagtcatcc

SEQ ID NO: 198323 - DNA, 25 bp, Homo sapien
ggtgctcccggatgcaacccaagaa

SEQ ID NO: 198324 - DNA, 25 bp, Homo sapien
ccttgttggtaagaagcgggcctca

SEQ ID NO: 198325 - DNA, 25 bp, Homo sapien
tcgatagagtccctgacggcccaga

SEQ ID NO: 198326 - DNA, 25 bp, Homo sapien
cccgggattcggatctcattcctca

SEQ ID NO: 198327 - DNA, 25 bp, Homo sapien
gagcaatttccctccgcgcgacagg

SEQ ID NO: 198328 - DNA, 25 bp, Homo sapien
ggatctggctccgtccatttcctca

SEQ ID NO: 198329 - DNA, 25 bp, Homo sapien
ctaaacggcgcgaaacgaagtggct

SEQ ID NO: 198330 - DNA, 25 bp, Homo sapien
cagctctgccgggatcaggcttcac

SEQ ID NO: 198331 - DNA, 25 bp, Homo sapien
tcacagacagcttcggcgggcagca

SEQ ID NO: 198332 - DNA, 25 bp, Homo sapien
agctgtccaggtggaggcagttctc

SEQ ID NO: 198333 - DNA, 25 bp, Homo sapien
caagctgcctcacaggagctgtcca

SEQ ID NO: 198334 - DNA, 25 bp, Homo sapien
cagctcacgggttccggtgatgccg

SEQ ID NO: 198335 - DNA, 25 bp, Homo sapien
aacgccacggagctgcagctcacgg

SEQ ID NO: 198336 - DNA, 25 bp, Homo sapien
ggctcctaaggtccaacgccacgga

SEQ ID NO: 198337 - DNA, 25 bp, Homo sapien
cgggcagcacagctacctgcggatc

SEQ ID NO: 198338 - DNA, 25 bp, Homo sapien
acggctaggctcacgccaaacaggc

SEQ ID NO: 198339 - DNA, 25 bp, Homo sapien
agacccggaccgatcgaggccgcgg

SEQ ID NO: 198340 - DNA, 25 bp, Homo sapien
aaacaggccctcgatacggccgcgg

SEQ ID NO: 198341 - DNA, 25 bp, Homo sapien
atacggccgcggctctgctccagca

SEQ ID NO: 198342 - DNA, 25 bp, Homo sapien
cgagcacggctaggctcacgccaaa

SEQ ID NO: 198343 - DNA, 25 bp, Homo sapien
ctagcgcgccgagcacggctaggct

SEQ ID NO: 198344 - DNA, 25 bp, Homo sapien
gccttctcagctggcgcagtgaact

SEQ ID NO: 198345 - DNA, 25 bp, Homo sapien
agctgcagccagatgcgcgcgggca

SEQ ID NO: 198346 - DNA, 25 bp, Homo sapien
tccggtccgacacggccacgtgtta

SEQ ID NO: 198347 - DNA, 25 bp, Homo sapien
tgttacatctaaatggcaccgtccc

SEQ ID NO: 198348 - DNA, 25 bp, Homo sapien
ccgagtgcgccgaccttgtgctaca

SEQ ID NO: 198349 - DNA, 25 bp, Homo sapien
ttgtgctacagccagaacagctccg

SEQ ID NO: 198350 - DNA, 25 bp, Homo sapien
agaggcttccagctttcgccaagtc

SEQ ID NO: 198351 - DNA, 25 bp, Homo sapien
cagcgacgacccacggcctgagaga

SEQ ID NO: 198352 - DNA, 25 bp, Homo sapien
acagccagaacagctccgggaaaca

SEQ ID NO: 198353 - DNA, 25 bp, Homo sapien
gacccacggcctgagagagccgctg

SEQ ID NO: 198354 - DNA, 25 bp, Homo sapien
ggaaaagcctctgccatcaatcaga

SEQ ID NO: 198355 - DNA, 25 bp, Homo sapien
tcagccctaattgcggcgagctcgg

SEQ ID NO: 198356 - DNA, 25 bp, Homo sapien
ggcagatttagacactcagccctaa

SEQ ID NO: 198357 - DNA, 25 bp, Homo sapien
cagagcacgtctcggcggcaaaaga

SEQ ID NO: 198358 - DNA, 25 bp, Homo sapien
ctctcggatgaacttggcagattta

SEQ ID NO: 198359 - DNA, 25 bp, Homo sapien
cgccgggcatgctctcggatgaact

SEQ ID NO: 198360 - DNA, 25 bp, Homo sapien
gacagggtcgagtgccctaaagtcc

SEQ ID NO: 198361 - DNA, 25 bp, Homo sapien
gtccagcagaggctcccaaggcagc

SEQ ID NO: 198362 - DNA, 25 bp, Homo sapien
tcccagctcggctaatggtggaagc

SEQ ID NO: 198363 - DNA, 25 bp, Homo sapien
gcaacccagcgctgctccgcagaca

SEQ ID NO: 198364 - DNA, 25 bp, Homo sapien
atgcgcccgggctctgagcattagc

SEQ ID NO: 198365 - DNA, 25 bp, Homo sapien
ccgggctctgagcattagcgctcca

SEQ ID NO: 198366 - DNA, 25 bp, Homo sapien
ttagcgctccagtgcagcttggaag

SEQ ID NO: 198367 - DNA, 25 bp, Homo sapien
agcttggaaggcatgctcccagctc

SEQ ID NO: 198368 - DNA, 25 bp, Homo sapien
aggcatgctcccagctcggctaatg

SEQ ID NO: 198369 - DNA, 25 bp, Homo sapien
acagtgatcaccctcggctcctcgc

SEQ ID NO: 198370 - DNA, 25 bp, Homo sapien
tacgtttccgccaaagctgtgaaca

SEQ ID NO: 198371 - DNA, 25 bp, Homo sapien
aactcctggacgaacctcttgaata

SEQ ID NO: 198372 - DNA, 25 bp, Homo sapien
cctagcaagatttcggccacatttc

SEQ ID NO: 198373 - DNA, 25 bp, Homo sapien
actccggattcagaggcggtgtata

SEQ ID NO: 198374 - DNA, 25 bp, Homo sapien
cgcgaagtccctatctatctctgtg

SEQ ID NO: 198375 - DNA, 25 bp, Homo sapien
gctccacggcttaccggattgcatg

SEQ ID NO: 198376 - DNA, 25 bp, Homo sapien
tttctaactcgaaccagccgctggg

SEQ ID NO: 198377 - DNA, 25 bp, Homo sapien
tgccgaagcaactgggtcagccttt

SEQ ID NO: 198378 - DNA, 25 bp, Homo sapien
gttggtgctcctgatggcagagaaa

SEQ ID NO: 198379 - DNA, 25 bp, Homo sapien
gatgcatagccgctgctgctcggtc

SEQ ID NO: 198380 - DNA, 25 bp, Homo sapien
ctgccagagcgcacagagatgccca

SEQ ID NO: 198381 - DNA, 25 bp, Homo sapien
acgatgggctccgtctcattctgcc

SEQ ID NO: 198382 - DNA, 25 bp, Homo sapien
tgaattattgatgcagccggcgctg

SEQ ID NO: 198383 - DNA, 25 bp, Homo sapien
cactcgtcggccctcaggtaggagg

SEQ ID NO: 198384 - DNA, 25 bp, Homo sapien
ctctcgccgtgagtcgacgaaggga

SEQ ID NO: 198385 - DNA, 25 bp, Homo sapien
ctgcccagccgcacttggatgcata

SEQ ID NO: 198386 - DNA, 25 bp, Homo sapien
acgtgtgcgccaatgaacgtgtgca

SEQ ID NO: 198387 - DNA, 25 bp, Homo sapien
gacgtgtgcgccaatgaacgtgtgc

SEQ ID NO: 198388 - DNA, 25 bp, Homo sapien
ccaatggacgtgtgcgccaatagac

SEQ ID NO: 198389 - DNA, 25 bp, Homo sapien
cgccaatagatgtgtgtgccaatgg

SEQ ID NO: 198390 - DNA, 25 bp, Homo sapien
gccaatggacgtgtgcgccaataga

SEQ ID NO: 198391 - DNA, 25 bp, Homo sapien
gcgccaatagatgtgtgtgccaatg

SEQ ID NO: 198392 - DNA, 25 bp, Homo sapien
gcaccaatagacgtgtgcaccaatg

SEQ ID NO: 198393 - DNA, 25 bp, Homo sapien
acgtgtgcgccaatagatgtgtgtg

SEQ ID NO: 198394 - DNA, 25 bp, Homo sapien
tagaagaaaaaatctccgggatgtg

SEQ ID NO: 198395 - DNA, 25 bp, Homo sapien
tgttgtcccgggttctgacaccgta

SEQ ID NO: 198396 - DNA, 25 bp, Homo sapien
cccgcactgttgtcccgggttctga

SEQ ID NO: 198397 - DNA, 25 bp, Homo sapien
tggccacctcacaactgggccttgt

SEQ ID NO: 198398 - DNA, 25 bp, Homo sapien
tcccttaacgatgatggccacctca

SEQ ID NO: 198399 - DNA, 25 bp, Homo sapien
tgtggctggtcccttaacgatgatg

SEQ ID NO: 198400 - DNA, 25 bp, Homo sapien
ttctgacaccgtaggctgagccaga

SEQ ID NO: 198401 - DNA, 25 bp, Homo sapien
ctgggatccacctacaaggagcaga

SEQ ID NO: 198402 - DNA, 25 bp, Homo sapien
acagcctcgtgctcatgcgggcgga

SEQ ID NO: 198403 - DNA, 25 bp, Homo sapien
gtgatgccagtagcctcgcccggag

SEQ ID NO: 198404 - DNA, 25 bp, Homo sapien
tcccgtgacgggcactgcgaaggct

SEQ ID NO: 198405 - DNA, 25 bp, Homo sapien
gtggtaatgtcaccgacccttcctg

SEQ ID NO: 198406 - DNA, 25 bp, Homo sapien
taatgtcaccgacccttcctgcgag

SEQ ID NO: 198407 - DNA, 25 bp, Homo sapien
agcagatgcccacagcgccaagcga

SEQ ID NO: 198408 - DNA, 25 bp, Homo sapien
gcgaccaggtgatgccagtagcctc

SEQ ID NO: 198409 - DNA, 25 bp, Homo sapien
caagcgacagcctcgtgctcatgcg

SEQ ID NO: 198410 - DNA, 25 bp, Homo sapien
gactaccacattgccgaaataaatc

SEQ ID NO: 198411 - DNA, 25 bp, Homo sapien
ggctccgacaccaaagatactaatg

SEQ ID NO: 198412 - DNA, 25 bp, Homo sapien
cggagtgagtgctccggctccgaca

SEQ ID NO: 198413 - DNA, 25 bp, Homo sapien
gccacagacccaggccggagtgagt

SEQ ID NO: 198414 - DNA, 25 bp, Homo sapien
ccacactgcgccattagctcgtaat

SEQ ID NO: 198415 - DNA, 25 bp, Homo sapien
gcggcaagattgactgcagccctcc

SEQ ID NO: 198416 - DNA, 25 bp, Homo sapien
cgacgtttattacccgccagcggca

SEQ ID NO: 198417 - DNA, 25 bp, Homo sapien
ataaatcaccgtcgctcaggagggg

SEQ ID NO: 198418 - DNA, 25 bp, Homo sapien
tgtggttggacccagactgcctccc

SEQ ID NO: 198419 - DNA, 25 bp, Homo sapien
tgtgctcgagggctcccgaggccct

SEQ ID NO: 198420 - DNA, 25 bp, Homo sapien
cccgtgcagcctgttattcataaaa

SEQ ID NO: 198421 - DNA, 25 bp, Homo sapien
gcggccatttccacctgtggttgga

SEQ ID NO: 198422 - DNA, 25 bp, Homo sapien
ccgttggccgagcagacgttttatt

SEQ ID NO: 198423 - DNA, 25 bp, Homo sapien
cgagcagacgttttatttgtggaac

SEQ ID NO: 198424 - DNA, 25 bp, Homo sapien
atttgtggaacggaattgctgtcgg

SEQ ID NO: 198425 - DNA, 25 bp, Homo sapien
cttggagagaaagtgcctttttgta

SEQ ID NO: 198426 - DNA, 25 bp, Homo sapien
tcaaacttgacactgcactcggggc

SEQ ID NO: 198427 - DNA, 25 bp, Homo sapien
cagccttcttgcgtgagccatcatc

SEQ ID NO: 198428 - DNA, 25 bp, Homo sapien
aggtcttcggcactctcaaacttga

SEQ ID NO: 198429 - DNA, 25 bp, Homo sapien
gtagggcagcccattgacgtcaagc

SEQ ID NO: 198430 - DNA, 25 bp, Homo sapien
agggcgcacttgtagagcttctgca

SEQ ID NO: 198431 - DNA, 25 bp, Homo sapien
tgcccgccagcttctgcatgtggaa

SEQ ID NO: 198432 - DNA, 25 bp, Homo sapien
aggtgccatggatcttgagctcaag

SEQ ID NO: 198433 - DNA, 25 bp, Homo sapien
gttgcacttgtgactgcccttgata

SEQ ID NO: 198434 - DNA, 25 bp, Homo sapien
ttatccgggcgacacccacacctta

SEQ ID NO: 198435 - DNA, 25 bp, Homo sapien
acgcccacaccttatccgggtgaca

SEQ ID NO: 198436 - DNA, 25 bp, Homo sapien
ggtgacacccacaccttatccaggt

SEQ ID NO: 198437 - DNA, 25 bp, Homo sapien
aggcgacacccacaccttatccagg

SEQ ID NO: 198438 - DNA, 25 bp, Homo sapien
gatccaggcgacacccacgtccaca

SEQ ID NO: 198439 - DNA, 25 bp, Homo sapien
aggcgacacccacgtccacacctga

SEQ ID NO: 198440 - DNA, 25 bp, Homo sapien
ctgatccaggcgacacccacgtcca

SEQ ID NO: 198441 - DNA, 25 bp, Homo sapien
ggcgacacccacgtccacacctgat

SEQ ID NO: 198442 - DNA, 25 bp, Homo sapien
aggccgaggtcacaaccatctccga

SEQ ID NO: 198443 - DNA, 25 bp, Homo sapien
tctccgatcatctgcgtgggtgacg

SEQ ID NO: 198444 - DNA, 25 bp, Homo sapien
tcgcccgtatgcagcttgatgtgcc

SEQ ID NO: 198445 - DNA, 25 bp, Homo sapien
tcacggctcctcttgtgcttgaaga

SEQ ID NO: 198446 - DNA, 25 bp, Homo sapien
aggtgcacttgaacggcagcttgtc

SEQ ID NO: 198447 - DNA, 25 bp, Homo sapien
tgcctcttcaagtagctcaagcgga

SEQ ID NO: 198448 - DNA, 25 bp, Homo sapien
tgcctcgcactcgtggcagtgatac

SEQ ID NO: 198449 - DNA, 25 bp, Homo sapien
gcagtgatacttcttgtcgcccgta

SEQ ID NO: 198450 - DNA, 25 bp, Homo sapien
tgggctcttatcagcctctcccagt

SEQ ID NO: 198451 - DNA, 25 bp, Homo sapien
gagttcattaccagccagggtaccc

SEQ ID NO: 198452 - DNA, 25 bp, Homo sapien
ctctgagagttcattaccagccagg

SEQ ID NO: 198453 - DNA, 25 bp, Homo sapien
ttatcagcctctcccagtcagtctg

SEQ ID NO: 198454 - DNA, 25 bp, Homo sapien
tgggctccttctgggctcttatcag

SEQ ID NO: 198455 - DNA, 25 bp, Homo sapien
ccgtcagatttctggcgctgccacg

SEQ ID NO: 198456 - DNA, 25 bp, Homo sapien
actttctttgccagtcgtgataccc

SEQ ID NO: 198457 - DNA, 25 bp, Homo sapien
ccgccacagctgttccaggccctca

SEQ ID NO: 198458 - DNA, 25 bp, Homo sapien
accaggagtcctgagggcgccagac

SEQ ID NO: 198459 - DNA, 25 bp, Homo sapien
cacccaagggcggcaccagctgtgg

SEQ ID NO: 198460 - DNA, 25 bp, Homo sapien
gctttgtgcccgaacctggccctga

SEQ ID NO: 198461 - DNA, 25 bp, Homo sapien
gtgcccgaacctggccctgagtgac

SEQ ID NO: 198462 - DNA, 25 bp, Homo sapien
aacctggccctgagtgactgcgccg

SEQ ID NO: 198463 - DNA, 25 bp, Homo sapien
ggcccagcgcgttcccaatgccgcc

SEQ ID NO: 198464 - DNA, 25 bp, Homo sapien
caatgccgccgcctcaaaggggtcc

SEQ ID NO: 198465 - DNA, 25 bp, Homo sapien
tgcgttcccaagcgtcggccgggct

SEQ ID NO: 198466 - DNA, 25 bp, Homo sapien
gggagcccgcaatagcccatcctga

SEQ ID NO: 198467 - DNA, 25 bp, Homo sapien
cgtcgcctgcacgtatgtccgtttc

SEQ ID NO: 198468 - DNA, 25 bp, Homo sapien
cgccctaggcagtctcagaggtaga

SEQ ID NO: 198469 - DNA, 25 bp, Homo sapien
taaacgcgacgcctagctggacacc

SEQ ID NO: 198470 - DNA, 25 bp, Homo sapien
taactagacctaagccttgagggcc

SEQ ID NO: 198471 - DNA, 25 bp, Homo sapien
tgtgcgtccaagagtgtccaacatc

SEQ ID NO: 198472 - DNA, 25 bp, Homo sapien
gacgagatcctggagccgctcacaa

SEQ ID NO: 198473 - DNA, 25 bp, Homo sapien
tgacctaatccgaaaggacgagatc

SEQ ID NO: 198474 - DNA, 25 bp, Homo sapien
gggccctcgctggaaatagaaagca

SEQ ID NO: 198475 - DNA, 25 bp, Homo sapien
gcagacaatgaactcctggcggagg

SEQ ID NO: 198476 - DNA, 25 bp, Homo sapien
tagacttagccgctctcatcgttcc

SEQ ID NO: 198477 - DNA, 25 bp, Homo sapien
ggcacccaaccgaggggctagaatc

SEQ ID NO: 198478 - DNA, 25 bp, Homo sapien
ctagaatcgggacaaagcagcaggc

SEQ ID NO: 198479 - DNA, 25 bp, Homo sapien
gtgtgtatctatatatctgcagctc

SEQ ID NO: 198480 - DNA, 25 bp, Homo sapien
ggagccagcacagaaagccggcctg

SEQ ID NO: 198481 - DNA, 25 bp, Homo sapien
ccgccggcgccgtgcagacaatgaa

SEQ ID NO: 198482 - DNA, 25 bp, Homo sapien
ggctgcactgcagagacacataata

SEQ ID NO: 198483 - DNA, 25 bp, Homo sapien
gccaggcttggctggaaatgtagcc

SEQ ID NO: 198484 - DNA, 25 bp, Homo sapien
ggaacacacttagggcccacgcggc

SEQ ID NO: 198485 - DNA, 25 bp, Homo sapien
cggctgtcaagctcgccaagacgca

SEQ ID NO: 198486 - DNA, 25 bp, Homo sapien
cgcatgagcctcacaaactgtaaaa

SEQ ID NO: 198487 - DNA, 25 bp, Homo sapien
ctcaactcagcctacttggagggga

SEQ ID NO: 198488 - DNA, 25 bp, Homo sapien
tcgcgctcctgtcttctttgtggtc

SEQ ID NO: 198489 - DNA, 25 bp, Homo sapien
agcgcctggtttggagattatgatg

SEQ ID NO: 198490 - DNA, 25 bp, Homo sapien
ggctgcccgcgaaccgcgtgttcat

SEQ ID NO: 198491 - DNA, 25 bp, Homo sapien
cgcaggcccagtaggggctcgcaaa

SEQ ID NO: 198492 - DNA, 25 bp, Homo sapien
tccagccgggatccgagaacccaaa

SEQ ID NO: 198493 - DNA, 25 bp, Homo sapien
gcaggccttggagatcctctccagc

SEQ ID NO: 198494 - DNA, 25 bp, Homo sapien
ttcccagggcaagcagctggagacc

SEQ ID NO: 198495 - DNA, 25 bp, Homo sapien
aacggctggctagggttgttcccag

SEQ ID NO: 198496 - DNA, 25 bp, Homo sapien
acttgttgcacgctcgggtgcagcc

SEQ ID NO: 198497 - DNA, 25 bp, Homo sapien
accgcgtgttcatctgcgtgctcgc

SEQ ID NO: 198498 - DNA, 25 bp, Homo sapien
gccaatagaaagctgtcttagttgg

SEQ ID NO: 198499 - DNA, 25 bp, Homo sapien
gccggtgcaagagacagccaataga

SEQ ID NO: 198500 - DNA, 25 bp, Homo sapien
gaccgtccaacgctaggcgccgagg

SEQ ID NO: 198501 - DNA, 25 bp, Homo sapien
agttcttggtccctccggctgaccg

SEQ ID NO: 198502 - DNA, 25 bp, Homo sapien
aatgaacgaactggctccggagggc

SEQ ID NO: 198503 - DNA, 25 bp, Homo sapien
aatccaatgagcgtagcgggtctag

SEQ ID NO: 198504 - DNA, 25 bp, Homo sapien
tgccgcccgacatgaactcgctgga

SEQ ID NO: 198505 - DNA, 25 bp, Homo sapien
gaggtctagtagaggaatccaatga

SEQ ID NO: 198506 - DNA, 25 bp, Homo sapien
gggtcggcgttactattctagtcca

SEQ ID NO: 198507 - DNA, 25 bp, Homo sapien
agcgcttcaagcgacctcagttctc

SEQ ID NO: 198508 - DNA, 25 bp, Homo sapien
gcaagagccggacgaagcgcttcaa

SEQ ID NO: 198509 - DNA, 25 bp, Homo sapien
ccagcgcacgtcaccatgggcaaga

SEQ ID NO: 198510 - DNA, 25 bp, Homo sapien
ttgccctcctctctcggtggtctgt

SEQ ID NO: 198511 - DNA, 25 bp, Homo sapien
ctgagcagcagcaacggaccttgtt

SEQ ID NO: 198512 - DNA, 25 bp, Homo sapien
gcccatgtgtgctgcagccgtcagc

SEQ ID NO: 198513 - DNA, 25 bp, Homo sapien
attgcgcgccttctgacccttttcg

SEQ ID NO: 198514 - DNA, 25 bp, Homo sapien
gtgggtcggaaatgctccgagaccc

SEQ ID NO: 198515 - DNA, 25 bp, Homo sapien
agcccgactggcttagggcacagaa

SEQ ID NO: 198516 - DNA, 25 bp, Homo sapien
ctttccgataacaagactgagactc

SEQ ID NO: 198517 - DNA, 25 bp, Homo sapien
tggcgcccgctttccgataacaaga

SEQ ID NO: 198518 - DNA, 25 bp, Homo sapien
tcctcccttaggcacggccaggaga

SEQ ID NO: 198519 - DNA, 25 bp, Homo sapien
ctttcccacggttctaggggagctg

SEQ ID NO: 198520 - DNA, 25 bp, Homo sapien
ggtcctgctgggacgcctttccttc

SEQ ID NO: 198521 - DNA, 25 bp, Homo sapien
ggccaggagacgcttcccagacgct

SEQ ID NO: 198522 - DNA, 25 bp, Homo sapien
ccagcggcgcgagctctaacgcaga

SEQ ID NO: 198523 - DNA, 25 bp, Homo sapien
cgagctctaacgcagagcagatggc

SEQ ID NO: 198524 - DNA, 25 bp, Homo sapien
ctgcagccgggcctgattaggtccc

SEQ ID NO: 198525 - DNA, 25 bp, Homo sapien
cgctggcgctttgaagtgagccgct

SEQ ID NO: 198526 - DNA, 25 bp, Homo sapien
tgggcgcgggatcctctttcctgca

SEQ ID NO: 198527 - DNA, 25 bp, Homo sapien
gggatcctctttcctgcaggcccat

SEQ ID NO: 198528 - DNA, 25 bp, Homo sapien
gggagggcgctctggcttcctccca

SEQ ID NO: 198529 - DNA, 25 bp, Homo sapien
caggcccatctgggacttcaaagcg

SEQ ID NO: 198530 - DNA, 25 bp, Homo sapien
agtcccactcccacggtgacgcccg

SEQ ID NO: 198531 - DNA, 25 bp, Homo sapien
ggtgacgcccgccaggcagtcctgt

SEQ ID NO: 198532 - DNA, 25 bp, Homo sapien
atcccagcccgccaagtgcgtcagc

SEQ ID NO: 198533 - DNA, 25 bp, Homo sapien
gcaggcggcatgagactgcctcgcc

SEQ ID NO: 198534 - DNA, 25 bp, Homo sapien
cctggcaggcggcatgagactgcct

SEQ ID NO: 198535 - DNA, 25 bp, Homo sapien
tcagccgctaccactgagcgcccgg

SEQ ID NO: 198536 - DNA, 25 bp, Homo sapien
gtgcgtcagccgctaccactgagcg

SEQ ID NO: 198537 - DNA, 25 bp, Homo sapien
cccgggctgtgccaggcgatgcacc

SEQ ID NO: 198538 - DNA, 25 bp, Homo sapien
acttctcctcaacggcgttacattc

SEQ ID NO: 198539 - DNA, 25 bp, Homo sapien
cacttctcctcaacggcgttacatt

SEQ ID NO: 198540 - DNA, 25 bp, Homo sapien
caacggcgttacattcctgcggttc

SEQ ID NO: 198541 - DNA, 25 bp, Homo sapien
cggttcccacttctcaccggtgtca

SEQ ID NO: 198542 - DNA, 25 bp, Homo sapien
cggcgttacattcctgcggttccca

SEQ ID NO: 198543 - DNA, 25 bp, Homo sapien
ctgcggttcccacttctcaccggtg

SEQ ID NO: 198544 - DNA, 25 bp, Homo sapien
tgcggttcccacttctcaccggtgt

SEQ ID NO: 198545 - DNA, 25 bp, Homo sapien
cgttacattcctgcggttcccactt

SEQ ID NO: 198546 - DNA, 25 bp, Homo sapien
gggctgccgctaacggacgatgcac

SEQ ID NO: 198547 - DNA, 25 bp, Homo sapien
ccagaccgcggtaggtgctggctct

SEQ ID NO: 198548 - DNA, 25 bp, Homo sapien
ggtaggtgctggctctgcctttcct

SEQ ID NO: 198549 - DNA, 25 bp, Homo sapien
tttcctcgccgtgttgctcccgcac

SEQ ID NO: 198550 - DNA, 25 bp, Homo sapien
gggaaacccctcgagctgtcagctg

SEQ ID NO: 198551 - DNA, 25 bp, Homo sapien
gctgcaaagcggaattcccggcgcc

SEQ ID NO: 198552 - DNA, 25 bp, Homo sapien
cccagccggcgctaagacggaagaa

SEQ ID NO: 198553 - DNA, 25 bp, Homo sapien
cgagatgcggcctcaggacagcacc

SEQ ID NO: 198554 - DNA, 25 bp, Homo sapien
ataacggggcgctttggacatttgt

SEQ ID NO: 198555 - DNA, 25 bp, Homo sapien
ggaaacttcactccaagccgggtca

SEQ ID NO: 198556 - DNA, 25 bp, Homo sapien
gggcgggtaatgaacactttctgca

SEQ ID NO: 198557 - DNA, 25 bp, Homo sapien
acctgtaaattggagccgccgagtc

SEQ ID NO: 198558 - DNA, 25 bp, Homo sapien
gccctgcccgtttagagagaacgtg

SEQ ID NO: 198559 - DNA, 25 bp, Homo sapien
gttctgtcccaatacgcctcctgga

SEQ ID NO: 198560 - DNA, 25 bp, Homo sapien
cgctgccgaagcttgcacctgagca

SEQ ID NO: 198561 - DNA, 25 bp, Homo sapien
aaccagccttgcctttgatgcgccg

SEQ ID NO: 198562 - DNA, 25 bp, Homo sapien
cgtgccgtggtccttcgcctcccac

SEQ ID NO: 198563 - DNA, 25 bp, Homo sapien
catcgaggagtggatcgggagacag

SEQ ID NO: 198564 - DNA, 25 bp, Homo sapien
acagcttcgccgtgagcgctgcctg

SEQ ID NO: 198565 - DNA, 25 bp, Homo sapien
caggtgacagcttcgccgtgagcgc

SEQ ID NO: 198566 - DNA, 25 bp, Homo sapien
agactcaggggcttcatgtcgtccc

SEQ ID NO: 198567 - DNA, 25 bp, Homo sapien
ggagccagactcaggggcttcatgt

SEQ ID NO: 198568 - DNA, 25 bp, Homo sapien
gggtaacttttggcacctggagcca

SEQ ID NO: 198569 - DNA, 25 bp, Homo sapien
tggcgggcaccataggccgaagcac

SEQ ID NO: 198570 - DNA, 25 bp, Homo sapien
cactgtcttagtcctgcgggctacc

SEQ ID NO: 198571 - DNA, 25 bp, Homo sapien
gcatgcactgtcttactcctgcggg

SEQ ID NO: 198572 - DNA, 25 bp, Homo sapien
aaccagccacacatgcactgtctta

SEQ ID NO: 198573 - DNA, 25 bp, Homo sapien
gcactgtcttagtcctgcgggctac

SEQ ID NO: 198574 - DNA, 25 bp, Homo sapien
tgcactgtcttagtcctgcgggcta

SEQ ID NO: 198575 - DNA, 25 bp, Homo sapien
gccacgcatgcactgtcttagtcct

SEQ ID NO: 198576 - DNA, 25 bp, Homo sapien
tgcactgtcttactcctgcggggta

SEQ ID NO: 198577 - DNA, 25 bp, Homo sapien
atgcactgtcttactcctgcggggt

SEQ ID NO: 198578 - DNA, 25 bp, Homo sapien
tcgcgaagtcggaatagcgccgttc

SEQ ID NO: 198579 - DNA, 25 bp, Homo sapien
cgcacagtgagctccttcagggtga

SEQ ID NO: 198580 - DNA, 25 bp, Homo sapien
ctcctgcagagtcacgaagtccttg

SEQ ID NO: 198581 - DNA, 25 bp, Homo sapien
ctcagcgaagttcccagtcaggtgc

SEQ ID NO: 198582 - DNA, 25 bp, Homo sapien
aacgtcttcagcagcgctttctgga

SEQ ID NO: 198583 - DNA, 25 bp, Homo sapien
ccaggacggccttgttgttgtcaaa

SEQ ID NO: 198584 - DNA, 25 bp, Homo sapien
ttgttgtcaaagctcccagtctgga

SEQ ID NO: 198585 - DNA, 25 bp, Homo sapien
gcttcctgggaaactccacgtcttc

SEQ ID NO: 198586 - DNA, 25 bp, Homo sapien
cgcagctcggcctacgattggctag

SEQ ID NO: 198587 - DNA, 25 bp, Homo sapien
gacagagcggaaagtcccttcggcc

SEQ ID NO: 198588 - DNA, 25 bp, Homo sapien
ctgtcacagggaggcccaatcacgg

SEQ ID NO: 198589 - DNA, 25 bp, Homo sapien
cccgccgcccgaggttagtgaatga

SEQ ID NO: 198590 - DNA, 25 bp, Homo sapien
ccctttggttccaccgagcttgaca

SEQ ID NO: 198591 - DNA, 25 bp, Homo sapien
ggcgtacgtaccgatcgattttgcg

SEQ ID NO: 198592 - DNA, 25 bp, Homo sapien
tcagccaatggtgacgcggcaccca

SEQ ID NO: 198593 - DNA, 25 bp, Homo sapien
ccattggaggaaggtctgtcacagg

SEQ ID NO: 198594 - DNA, 25 bp, Homo sapien
catttgcaagtcactgcgcggcgca

SEQ ID NO: 198595 - DNA, 25 bp, Homo sapien
tacctgcattatcgcggcttcctta

SEQ ID NO: 198596 - DNA, 25 bp, Homo sapien
ggtttcgggctgtacctgcattatc

SEQ ID NO: 198597 - DNA, 25 bp, Homo sapien
cggcttccttaagctcggatgaata

SEQ ID NO: 198598 - DNA, 25 bp, Homo sapien
ttcaaggttatccagacagcggtct

SEQ ID NO: 198599 - DNA, 25 bp, Homo sapien
gctcggatgaatatgtaaatctctc

SEQ ID NO: 198600 - DNA, 25 bp, Homo sapien
agcggtctgcgggtttcatttgcaa

SEQ ID NO: 198601 - DNA, 25 bp, Homo sapien
tctcggtggcgttcaaggttatcca

SEQ ID NO: 198602 - DNA, 25 bp, Homo sapien
tgtcaacttccataaaggccgagag

SEQ ID NO: 198603 - DNA, 25 bp, Homo sapien
cccgcagaagcgacaatgacatttg

SEQ ID NO: 198604 - DNA, 25 bp, Homo sapien
cccatcaagcgttattagagtcatc

SEQ ID NO: 198605 - DNA, 25 bp, Homo sapien
cgggtcctttgatctgggccacaaa

SEQ ID NO: 198606 - DNA, 25 bp, Homo sapien
gcccacgctggaaagttcttcctta

SEQ ID NO: 198607 - DNA, 25 bp, Homo sapien
atacaaaataaactgcggccctgcc

SEQ ID NO: 198608 - DNA, 25 bp, Homo sapien
cggtttccgtttcgcatgaatacaa

SEQ ID NO: 198609 - DNA, 25 bp, Homo sapien
ttagagtcatctgccgtctccgagg

SEQ ID NO: 198610 - DNA, 25 bp, Homo sapien
aggtcagcgcccaccttctggaacg

SEQ ID NO: 198611 - DNA, 25 bp, Homo sapien
cactcttggggaaaaaatgtcactc

SEQ ID NO: 198612 - DNA, 25 bp, Homo sapien
agcgagaaatctgtccctctaaatg

SEQ ID NO: 198613 - DNA, 25 bp, Homo sapien
gccttcggggtgattctcagcatca

SEQ ID NO: 198614 - DNA, 25 bp, Homo sapien
cggcacagagtctaacgacagggtc

SEQ ID NO: 198615 - DNA, 25 bp, Homo sapien
cgacgctttctaccttacctgggca

SEQ ID NO: 198616 - DNA, 25 bp, Homo sapien
ctaaatgttcgggtgccaagccttc

SEQ ID NO: 198617 - DNA, 25 bp, Homo sapien
ggacgtcgtctgtgcaacggaaaca

SEQ ID NO: 198618 - DNA, 25 bp, Homo sapien
gcggtcccgcaaagcttttctcctg

SEQ ID NO: 198619 - DNA, 25 bp, Homo sapien
aagtttggacttgcaggttccgcca

SEQ ID NO: 198620 - DNA, 25 bp, Homo sapien
tgcggtagcaccctcctaactctgg

SEQ ID NO: 198621 - DNA, 25 bp, Homo sapien
cacacgtgtttgttacttggtctac

SEQ ID NO: 198622 - DNA, 25 bp, Homo sapien
ggcaccgcatgcagccaggaaccta

SEQ ID NO: 198623 - DNA, 25 bp, Homo sapien
ccgcaatagcgaatggggatagccc

SEQ ID NO: 198624 - DNA, 25 bp, Homo sapien
ttggcttcttgaaagtccgggcctc

SEQ ID NO: 198625 - DNA, 25 bp, Homo sapien
tcaattacgggccattgtctcggtc

SEQ ID NO: 198626 - DNA, 25 bp, Homo sapien
agattgctccttgtgcgtcctccca

SEQ ID NO: 198627 - DNA, 25 bp, Homo sapien
tttgcaccgtctccggaacaactgg

SEQ ID NO: 198628 - DNA, 25 bp, Homo sapien
gagataaattttgcgagccagaccc

SEQ ID NO: 198629 - DNA, 25 bp, Homo sapien
gggcgcataccgaccagaaagattt

SEQ ID NO: 198630 - DNA, 25 bp, Homo sapien
gctggccacccgcaaacctggaaaa

SEQ ID NO: 198631 - DNA, 25 bp, Homo sapien
cacagttgtcgcctccatcggagaa

SEQ ID NO: 198632 - DNA, 25 bp, Homo sapien
gctttgaggccggtaccgtgaaaca

SEQ ID NO: 198633 - DNA, 25 bp, Homo sapien
gtaaacttccttaccgctggcagca

SEQ ID NO: 198634 - DNA, 25 bp, Homo sapien
cccaggacaattagggctgaagttt

SEQ ID NO: 198635 - DNA, 25 bp, Homo sapien
gccgaagctcgcctccactttttgg

SEQ ID NO: 198636 - DNA, 25 bp, Homo sapien
gcgctgcgaacttcccaactcgggg

SEQ ID NO: 198637 - DNA, 25 bp, Homo sapien
tttaagagctaccagaaagcagccc

SEQ ID NO: 198638 - DNA, 25 bp, Homo sapien
gccaggggcactgatcctccagctt

SEQ ID NO: 198639 - DNA, 25 bp, Homo sapien
ttctctacctcggacattcccagga

SEQ ID NO: 198640 - DNA, 25 bp, Homo sapien
tcacactgagcgcagcagcgagcac

SEQ ID NO: 198641 - DNA, 25 bp, Homo sapien
accggcctgggctccgagttcagct

SEQ ID NO: 198642 - DNA, 25 bp, Homo sapien
cccgagccaagagtcgcgtactgtc

SEQ ID NO: 198643 - DNA, 25 bp, Homo sapien
gccaccaagggctatctccagacgg

SEQ ID NO: 198644 - DNA, 25 bp, Homo sapien
gcccgcggcaaagttcgtctttctc

SEQ ID NO: 198645 - DNA, 25 bp, Homo sapien
gagggctgttcctacaccggtatta

SEQ ID NO: 198646 - DNA, 25 bp, Homo sapien
cttcgctagcgactgcaagtgcttg

SEQ ID NO: 198647 - DNA, 25 bp, Homo sapien
tttccgtccacagttgagcgtcttg

SEQ ID NO: 198648 - DNA, 25 bp, Homo sapien
gagcgtcttgcacttaaattcactg

SEQ ID NO: 198649 - DNA, 25 bp, Homo sapien
gcactcgctctccagcagttcaata

SEQ ID NO: 198650 - DNA, 25 bp, Homo sapien
aaggatgggctggttctctcccaag

SEQ ID NO: 198651 - DNA, 25 bp, Homo sapien
caaggcagtcgacccgcctaaggga

SEQ ID NO: 198652 - DNA, 25 bp, Homo sapien
gcgtacctggcggaaaagtgtcctc

SEQ ID NO: 198653 - DNA, 25 bp, Homo sapien
gcatcggctctgcagctgacacaca

SEQ ID NO: 198654 - DNA, 25 bp, Homo sapien
agcgactctgtagctcggttcctga

SEQ ID NO: 198655 - DNA, 25 bp, Homo sapien
ctcccgccagaaaggatggctccta

SEQ ID NO: 198656 - DNA, 25 bp, Homo sapien
tccacacggtaacgctgggcaacgt

SEQ ID NO: 198657 - DNA, 25 bp, Homo sapien
ctgacacacagtagcggggacaccc

SEQ ID NO: 198658 - DNA, 25 bp, Homo sapien
ctaagcctggagaaagagcccgttc

SEQ ID NO: 198659 - DNA, 25 bp, Homo sapien
ctccaggggatgcacgtgaatgcct

SEQ ID NO: 198660 - DNA, 25 bp, Homo sapien
tttccacaaccagttcgcggccgag

SEQ ID NO: 198661 - DNA, 25 bp, Homo sapien
agtcaaggagtcagcctgctccggg

SEQ ID NO: 198662 - DNA, 25 bp, Homo sapien
tgcggcgtcgaggatgatttccaca

SEQ ID NO: 198663 - DNA, 25 bp, Homo sapien
cgctggcgacccagagaccctggaa

SEQ ID NO: 198664 - DNA, 25 bp, Homo sapien
aagaccaacctgctgccgggccgtg

SEQ ID NO: 198665 - DNA, 25 bp, Homo sapien
cacgtgaatgcctctgcccgacggt

SEQ ID NO: 198666 - DNA, 25 bp, Homo sapien
gggtagaacctcacatccatgccga

SEQ ID NO: 198667 - DNA, 25 bp, Homo sapien
catcggaccaggagatcagggaccc

SEQ ID NO: 198668 - DNA, 25 bp, Homo sapien
cacctggaacgctcggtcctcgaag

SEQ ID NO: 198669 - DNA, 25 bp, Homo sapien
ccctgtccaggcatactcaaaagtt

SEQ ID NO: 198670 - DNA, 25 bp, Homo sapien
tccgaggtccaaagtgccctaacga

SEQ ID NO: 198671 - DNA, 25 bp, Homo sapien
tgtggaggtctccaatcccgatctc

SEQ ID NO: 198672 - DNA, 25 bp, Homo sapien
ggggctgcgatcgtgtttactaata

SEQ ID NO: 198673 - DNA, 25 bp, Homo sapien
gtcaccttgctgtagccgtagtacc

SEQ ID NO: 198674 - DNA, 25 bp, Homo sapien
ttgcctttcgaatgtcccctgcgtg

SEQ ID NO: 198675 - DNA, 25 bp, Homo sapien
tgcgtcccgtgtgtcccaccctcct

SEQ ID NO: 198676 - DNA, 25 bp, Homo sapien
ccttccttcttcatgggtgcctgtc

SEQ ID NO: 198677 - DNA, 25 bp, Homo sapien
tttcctcggccgaagcggacgccag

SEQ ID NO: 198678 - DNA, 25 bp, Homo sapien
tgcacgagtgtctcccggtagccgg

SEQ ID NO: 198679 - DNA, 25 bp, Homo sapien
tgcgtggacacacctaacccagacg

SEQ ID NO: 198680 - DNA, 25 bp, Homo sapien
caacctgcacgagtgtctcccggta

SEQ ID NO: 198681 - DNA, 25 bp, Homo sapien
ttccttcttcatgggtgcctgtccc

SEQ ID NO: 198682 - DNA, 25 bp, Homo sapien
tcctcgaagcggaaagcagccactg

SEQ ID NO: 198683 - DNA, 25 bp, Homo sapien
cctgcgctctagtgggcgcttcaca

SEQ ID NO: 198684 - DNA, 25 bp, Homo sapien
cttcacaggcgcagcgacagcgaca

SEQ ID NO: 198685 - DNA, 25 bp, Homo sapien
cgacagctcgaacctgagtcccagg

SEQ ID NO: 198686 - DNA, 25 bp, Homo sapien
ccggcagccaaggtaggattcctga

SEQ ID NO: 198687 - DNA, 25 bp, Homo sapien
caccgcttgcggtctgcagagataa

SEQ ID NO: 198688 - DNA, 25 bp, Homo sapien
agagcaccaggtcgctggcacgctc

SEQ ID NO: 198689 - DNA, 25 bp, Homo sapien
gcccacgtgggaagaagccctggct

SEQ ID NO: 198690 - DNA, 25 bp, Homo sapien
cgggcacaaatatgcaaatagcgcg

SEQ ID NO: 198691 - DNA, 25 bp, Homo sapien
cggcgcgggcacaaatatgcaaata

SEQ ID NO: 198692 - DNA, 25 bp, Homo sapien
ggacgctccctcttaggcagcccga

SEQ ID NO: 198693 - DNA, 25 bp, Homo sapien
ccatgttggagcggagcaacgaccc

SEQ ID NO: 198694 - DNA, 25 bp, Homo sapien
gccagccgcgagtgtcagtctcagt

SEQ ID NO: 198695 - DNA, 25 bp, Homo sapien
cagggctccgggagtaaccgcgcca

SEQ ID NO: 198696 - DNA, 25 bp, Homo sapien
tcagtcatggcgaagcgcgagagtc

SEQ ID NO: 198697 - DNA, 25 bp, Homo sapien
agtaaccgcgccagcgattgggtcg

SEQ ID NO: 198698 - DNA, 25 bp, Homo sapien
tccctctgcacacgggaactgtgcg

SEQ ID NO: 198699 - DNA, 25 bp, Homo sapien
cttcttgtgcgtgagtccctctgca

SEQ ID NO: 198700 - DNA, 25 bp, Homo sapien
gttccagaaacacctcagcttagcg

SEQ ID NO: 198701 - DNA, 25 bp, Homo sapien
cacctaggcagagggatacgttcca

SEQ ID NO: 198702 - DNA, 25 bp, Homo sapien
agcaccttgatgatgcgctctgtcc

SEQ ID NO: 198703 - DNA, 25 bp, Homo sapien
ataccgagctccaggaaggtcgctg

SEQ ID NO: 198704 - DNA, 25 bp, Homo sapien
ccgccgccaacaccttaggtgaata

SEQ ID NO: 198705 - DNA, 25 bp, Homo sapien
agatagcgcgcctgctaaaggctgc

SEQ ID NO: 198706 - DNA, 25 bp, Homo sapien
ggacttgcccttatttgcaccgcga

SEQ ID NO: 198707 - DNA, 25 bp, Homo sapien
caccgcgattaaccgggttgtggca

SEQ ID NO: 198708 - DNA, 25 bp, Homo sapien
cccgcccgccttgttagtagaatga

SEQ ID NO: 198709 - DNA, 25 bp, Homo sapien
ggaacgcgtcttgccctaaagtagc

SEQ ID NO: 198710 - DNA, 25 bp, Homo sapien
ctttcctgcggcttccgaatgggga

SEQ ID NO: 198711 - DNA, 25 bp, Homo sapien
ctctgcgctattccgaggctcttag

SEQ ID NO: 198712 - DNA, 25 bp, Homo sapien
gctaccgcagcatgagcgaaagcta

SEQ ID NO: 198713 - DNA, 25 bp, Homo sapien
cgtgctcaagactacgggtgcctgc

SEQ ID NO: 198714 - DNA, 25 bp, Homo sapien
cgttgggaagaacacactcggtcct

SEQ ID NO: 198715 - DNA, 25 bp, Homo sapien
ggcggccagatttacagacacctca

SEQ ID NO: 198716 - DNA, 25 bp, Homo sapien
gtgccttcaatgcagagctcctggc

SEQ ID NO: 198717 - DNA, 25 bp, Homo sapien
cccttacgtaacagcgcctgggacg

SEQ ID NO: 198718 - DNA, 25 bp, Homo sapien
gtcacaattggccagggcgtctgcc

SEQ ID NO: 198719 - DNA, 25 bp, Homo sapien
cgctaacgtctgcaagccaagcttt

SEQ ID NO: 198720 - DNA, 25 bp, Homo sapien
acggcctgtcagtcatggaagtatc

SEQ ID NO: 198721 - DNA, 25 bp, Homo sapien
tcgcgagcgcctagaaagatggaca

SEQ ID NO: 198722 - DNA, 25 bp, Homo sapien
cgaagctaaggtatgtcgggctccc

SEQ ID NO: 198723 - DNA, 25 bp, Homo sapien
gccctgcagctagctaccgttgcta

SEQ ID NO: 198724 - DNA, 25 bp, Homo sapien
caggctcccgtagcctcctgggaaa

SEQ ID NO: 198725 - DNA, 25 bp, Homo sapien
cagctgtcggacctgggaaattctc

SEQ ID NO: 198726 - DNA, 25 bp, Homo sapien
taccgttgctatagcgccgacagcg

SEQ ID NO: 198727 - DNA, 25 bp, Homo sapien
ctttagtggcagcatgaagcgcacc

SEQ ID NO: 198728 - DNA, 25 bp, Homo sapien
ggagatcttcgtgcgctgtgagcaa

SEQ ID NO: 198729 - DNA, 25 bp, Homo sapien
tcctgtgctaaatcccgtggcgctc

SEQ ID NO: 198730 - DNA, 25 bp, Homo sapien
tcccagggtgtgccgtcgccctgag

SEQ ID NO: 198731 - DNA, 25 bp, Homo sapien
ccagggtgtgccgtcgccctgagcc

SEQ ID NO: 198732 - DNA, 25 bp, Homo sapien
gccgtccatggaggcactgtcccag

SEQ ID NO: 198733 - DNA, 25 bp, Homo sapien
ccgtccatggaggcactgtcccagg

SEQ ID NO: 198734 - DNA, 25 bp, Homo sapien
cccgccgtccatggaggcactgtcc

SEQ ID NO: 198735 - DNA, 25 bp, Homo sapien
gtcccagggtgtgccgtcgccctga

SEQ ID NO: 198736 - DNA, 25 bp, Homo sapien
gtccatggaggcactgtcccagggt

SEQ ID NO: 198737 - DNA, 25 bp, Homo sapien
cgtccatggaggcactgtcccaggg

SEQ ID NO: 198738 - DNA, 25 bp, Homo sapien
cgtgagcccggctttccgctgatgc

SEQ ID NO: 198739 - DNA, 25 bp, Homo sapien
acagtcccagggtgcgccgggagcc

SEQ ID NO: 198740 - DNA, 25 bp, Homo sapien
ccgctgatgcacagtcccagggtgc

SEQ ID NO: 198741 - DNA, 25 bp, Homo sapien
ttccgctgatgcacagtcccagggt

SEQ ID NO: 198742 - DNA, 25 bp, Homo sapien
ctttccgctgatgcacagtcccagg

SEQ ID NO: 198743 - DNA, 25 bp, Homo sapien
ggctttccgctgatgcacagtccca

SEQ ID NO: 198744 - DNA, 25 bp, Homo sapien
gagcccggctttccgctgatgcaca

SEQ ID NO: 198745 - DNA, 25 bp, Homo sapien
ctgatgcacagtcccagggtgcgcc

SEQ ID NO: 198746 - DNA, 25 bp, Homo sapien
cggccagacaagttcaccagaagca

SEQ ID NO: 198747 - DNA, 25 bp, Homo sapien
cgccttcatccttaggccttaaatg

SEQ ID NO: 198748 - DNA, 25 bp, Homo sapien
gccttaaatgaatgccggccagaca

SEQ ID NO: 198749 - DNA, 25 bp, Homo sapien
ccagagccggaaacggccttcagtc

SEQ ID NO: 198750 - DNA, 25 bp, Homo sapien
cagaagcagggttactacagaaatc

SEQ ID NO: 198751 - DNA, 25 bp, Homo sapien
aatcccggggaatgacacacgtgcc

SEQ ID NO: 198752 - DNA, 25 bp, Homo sapien
gcttttgaggacacttaccgccttc

SEQ ID NO: 198753 - DNA, 25 bp, Homo sapien
gtgccgaagtccctacactaccaga

SEQ ID NO: 198754 - DNA, 25 bp, Homo sapien
gccacacgggccatggcggagagtt

SEQ ID NO: 198755 - DNA, 25 bp, Homo sapien
tccctacccagcaattaagccgagg

SEQ ID NO: 198756 - DNA, 25 bp, Homo sapien
gaaaggccaagggacaccgtctgga

SEQ ID NO: 198757 - DNA, 25 bp, Homo sapien
cccggggaatctgggataagacact

SEQ ID NO: 198758 - DNA, 25 bp, Homo sapien
ttaagccgaggctgtgacagcgacg

SEQ ID NO: 198759 - DNA, 25 bp, Homo sapien
cccagcaattaagccgaggctgtga

SEQ ID NO: 198760 - DNA, 25 bp, Homo sapien
gggttccccgagaccacgtgctcta

SEQ ID NO: 198761 - DNA, 25 bp, Homo sapien
aaggccaagggacaccgtctggacg

SEQ ID NO: 198762 - DNA, 25 bp, Homo sapien
gaggctttgcactcggcgccggcac

SEQ ID NO: 198763 - DNA, 25 bp, Homo sapien
aactggagcgttgcagtaacaactc

SEQ ID NO: 198764 - DNA, 25 bp, Homo sapien
gcgccattagcgtgagttagaactg

SEQ ID NO: 198765 - DNA, 25 bp, Homo sapien
tgggtcttggcgtgaagcgccatta

SEQ ID NO: 198766 - DNA, 25 bp, Homo sapien
tgactttctccaggagccgtgggtg

SEQ ID NO: 198767 - DNA, 25 bp, Homo sapien
ccttgcagcctgttgactttctcca

SEQ ID NO: 198768 - DNA, 25 bp, Homo sapien
cggcacccttgcagcctgttgactt

SEQ ID NO: 198769 - DNA, 25 bp, Homo sapien
aagcctgaggctttgcactcggcgc

SEQ ID NO: 198770 - DNA, 25 bp, Homo sapien
agccctttccatgagacttaaattg

SEQ ID NO: 198771 - DNA, 25 bp, Homo sapien
cgcgctcgggttacaggttaatgaa

SEQ ID NO: 198772 - DNA, 25 bp, Homo sapien
ctctccgctctgtgaagcgtagaca

SEQ ID NO: 198773 - DNA, 25 bp, Homo sapien
gcgttctctttctccgctattagca

SEQ ID NO: 198774 - DNA, 25 bp, Homo sapien
ccgcacagggtggaattcgtatttg

SEQ ID NO: 198775 - DNA, 25 bp, Homo sapien
tatttggccaggaatccggactccg

SEQ ID NO: 198776 - DNA, 25 bp, Homo sapien
ccaacttcgctcttggcgcggaaga

SEQ ID NO: 198777 - DNA, 25 bp, Homo sapien
cctgcaaagttctgataagtagcta

SEQ ID NO: 198778 - DNA, 25 bp, Homo sapien
gggccttagcaggatgcctcttcta

SEQ ID NO: 198779 - DNA, 25 bp, Homo sapien
ccaccagggtgccaagacgcacaga

SEQ ID NO: 198780 - DNA, 25 bp, Homo sapien
cagggccagagcgaaacctcagtct

SEQ ID NO: 198781 - DNA, 25 bp, Homo sapien
cttcgaaggtgtgcagtgttgagcc

SEQ ID NO: 198782 - DNA, 25 bp, Homo sapien
ccggaacgcgcgagatagtcacacg

SEQ ID NO: 198783 - DNA, 25 bp, Homo sapien
cacacgcgccactttgagggtcaaa

SEQ ID NO: 198784 - DNA, 25 bp, Homo sapien
tggccacactgtacctttactaacg

SEQ ID NO: 198785 - DNA, 25 bp, Homo sapien
tctcaactagagctgggcagtcaca

SEQ ID NO: 198786 - DNA, 25 bp, Homo sapien
ttgacatttctacggggcgcaagcc

SEQ ID NO: 198787 - DNA, 25 bp, Homo sapien
ctgccctggacgctatgaaactctc

SEQ ID NO: 198788 - DNA, 25 bp, Homo sapien
ttctcacgagggcttttgctctccg

SEQ ID NO: 198789 - DNA, 25 bp, Homo sapien
cccgtacacggacgagagcacgttg

SEQ ID NO: 198790 - DNA, 25 bp, Homo sapien
agcgggcggatgtattggtatccca

SEQ ID NO: 198791 - DNA, 25 bp, Homo sapien
tccgcgttcgcctattgatctgctc

SEQ ID NO: 198792 - DNA, 25 bp, Homo sapien
agccaggtcaggtccgaacagattg

SEQ ID NO: 198793 - DNA, 25 bp, Homo sapien
ctccgggctctgattgacatttcta

SEQ ID NO: 198794 - DNA, 25 bp, Homo sapien
tccgctcgctcctcgttaatcttgg

SEQ ID NO: 198795 - DNA, 25 bp, Homo sapien
tttgtccacaaaggccgtcgcgctc

SEQ ID NO: 198796 - DNA, 25 bp, Homo sapien
ccctgatttgagaggcctgtgatgg

SEQ ID NO: 198797 - DNA, 25 bp, Homo sapien
tggagcgccaccagaaaattagtgc

SEQ ID NO: 198798 - DNA, 25 bp, Homo sapien
ctgacaacgtcgtctattggcaata

SEQ ID NO: 198799 - DNA, 25 bp, Homo sapien
ttccaagtgacacgtcgcgggatca

SEQ ID NO: 198800 - DNA, 25 bp, Homo sapien
cgcgggatcaaacacagccacattg

SEQ ID NO: 198801 - DNA, 25 bp, Homo sapien
gtcgccttattggacgccgaggcca

SEQ ID NO: 198802 - DNA, 25 bp, Homo sapien
tccgacatttaacgcgggctgcgtc

SEQ ID NO: 198803 - DNA, 25 bp, Homo sapien
ggcagcctcagcgactcggatttta

SEQ ID NO: 198804 - DNA, 25 bp, Homo sapien
gacctgtgcaaagactctccctatg

SEQ ID NO: 198805 - DNA, 25 bp, Homo sapien
ccgagcggacgctttggctaaagac

SEQ ID NO: 198806 - DNA, 25 bp, Homo sapien
atggctccttcggacaccttcatgg

SEQ ID NO: 198807 - DNA, 25 bp, Homo sapien
ggtgctcgccaagcccaaactgtgg

SEQ ID NO: 198808 - DNA, 25 bp, Homo sapien
cggtccggggtctcatttcaatgga

SEQ ID NO: 198809 - DNA, 25 bp, Homo sapien
atcccggctacacgaactatggctc

SEQ ID NO: 198810 - DNA, 25 bp, Homo sapien
gaggccagcgcccaatcataggtga

SEQ ID NO: 198811 - DNA, 25 bp, Homo sapien
tacatctcgcccgtcaaagtcaatg

SEQ ID NO: 198812 - DNA, 25 bp, Homo sapien
gtctccatgacaatagcgcgatcga

SEQ ID NO: 198813 - DNA, 25 bp, Homo sapien
gcctcgcttagacattggccggctg

SEQ ID NO: 198814 - DNA, 25 bp, Homo sapien
gctctcggagaatgtagtctgaacc

SEQ ID NO: 198815 - DNA, 25 bp, Homo sapien
tctgaaccgctcaggcctcttggtg

SEQ ID NO: 198816 - DNA, 25 bp, Homo sapien
ctgggttagtgtgagatcgcgaaat

SEQ ID NO: 198817 - DNA, 25 bp, Homo sapien
ttcggcccacgaggggacacgacta

SEQ ID NO: 198818 - DNA, 25 bp, Homo sapien
cccttcaaacttgggcgattgtctc

SEQ ID NO: 198819 - DNA, 25 bp, Homo sapien
caggccttggactcaagagttgctc

SEQ ID NO: 198820 - DNA, 25 bp, Homo sapien
cgcgcacaaggcgtcagaatcctca

SEQ ID NO: 198821 - DNA, 25 bp, Homo sapien
tggccatgtcctatccgcagggcta

SEQ ID NO: 198822 - DNA, 25 bp, Homo sapien
cgcagggctacttgtaccagccgtc

SEQ ID NO: 198823 - DNA, 25 bp, Homo sapien
cggcgtacagcaccagcgtcatttc

SEQ ID NO: 198824 - DNA, 25 bp, Homo sapien
gccgccttctcctcgtacgtggtaa

SEQ ID NO: 198825 - DNA, 25 bp, Homo sapien
tgctcgcaaaagagagccgcgtctt

SEQ ID NO: 198826 - DNA, 25 bp, Homo sapien
tgcaaccgcgccctgaaagaccgtt

SEQ ID NO: 198827 - DNA, 25 bp, Homo sapien
aggaatgtaattgcgctcccatgac

SEQ ID NO: 198828 - DNA, 25 bp, Homo sapien
acagctagctgccaactcggacgga

SEQ ID NO: 198829 - DNA, 25 bp, Homo sapien
cagggcccacgactagaacaaagtt

SEQ ID NO: 198830 - DNA, 25 bp, Homo sapien
tccgggctgcttattcctggtgcca

SEQ ID NO: 198831 - DNA, 25 bp, Homo sapien
ttagctttgaactccggcccggaca

SEQ ID NO: 198832 - DNA, 25 bp, Homo sapien
cgtcccgcatcaggtgtacgcactt

SEQ ID NO: 198833 - DNA, 25 bp, Homo sapien
ccaggcgcaggcaattgagaaatac

SEQ ID NO: 198834 - DNA, 25 bp, Homo sapien
cccgtgctatgtttagaaaggtgtc

SEQ ID NO: 198835 - DNA, 25 bp, Homo sapien
agcatcaccgggcagtgtgcgatgc

SEQ ID NO: 198836 - DNA, 25 bp, Homo sapien
gacctttctgcactcagacacgggg

SEQ ID NO: 198837 - DNA, 25 bp, Homo sapien
ccatctgtgacctttctgcactcag

SEQ ID NO: 198838 - DNA, 25 bp, Homo sapien
gtaatcacgagtgtctctaaaaccc

SEQ ID NO: 198839 - DNA, 25 bp, Homo sapien
cccagaaggtaatcacgagtgtctc

SEQ ID NO: 198840 - DNA, 25 bp, Homo sapien
cggcggtcacccagaaggtaatcac

SEQ ID NO: 198841 - DNA, 25 bp, Homo sapien
atggcccgctggcttgtccgggaat

SEQ ID NO: 198842 - DNA, 25 bp, Homo sapien
aaaaggcagatttccgcgccgggca

SEQ ID NO: 198843 - DNA, 25 bp, Homo sapien
gcacctgtttgcagggctgcgcctc

SEQ ID NO: 198844 - DNA, 25 bp, Homo sapien
ctcggcgcggcggtgaataattcat

SEQ ID NO: 198845 - DNA, 25 bp, Homo sapien
ctttgcagtcaaacgcgctgcgttc

SEQ ID NO: 198846 - DNA, 25 bp, Homo sapien
cgccggccgctgtgatttattattt

SEQ ID NO: 198847 - DNA, 25 bp, Homo sapien
ttattatttaccaacgcgcggccgc

SEQ ID NO: 198848 - DNA, 25 bp, Homo sapien
cggagtctggcaaaacgctcttgtg

SEQ ID NO: 198849 - DNA, 25 bp, Homo sapien
cccaggctcgtaatcaaaaggcaga

SEQ ID NO: 198850 - DNA, 25 bp, Homo sapien
ggtttttgacgttcctcgccagctg

SEQ ID NO: 198851 - DNA, 25 bp, Homo sapien
cccgacggaatctgagggatcccga

SEQ ID NO: 198852 - DNA, 25 bp, Homo sapien
ctatccggcctactcgaggaccagg

SEQ ID NO: 198853 - DNA, 25 bp, Homo sapien
gagccggaatctagcccgagtcctg

SEQ ID NO: 198854 - DNA, 25 bp, Homo sapien
caaactttacttcagcgcaggggcg

SEQ ID NO: 198855 - DNA, 25 bp, Homo sapien
cccgggattaccgtgacgtcacatt

SEQ ID NO: 198856 - DNA, 25 bp, Homo sapien
acgcgcctttgggaacccgcatctt

SEQ ID NO: 198857 - DNA, 25 bp, Homo sapien
ggcctgtggcgtgaacaaactttac

SEQ ID NO: 198858 - DNA, 25 bp, Homo sapien
aagcaactgtccgacccagcgggtg

SEQ ID NO: 198859 - DNA, 25 bp, Homo sapien
tgtagtccttctttgcctcctgggg

SEQ ID NO: 198860 - DNA, 25 bp, Homo sapien
tctccgcttgaggacccgctgcgga

SEQ ID NO: 198861 - DNA, 25 bp, Homo sapien
ggaagcccgtccgattgggcctctc

SEQ ID NO: 198862 - DNA, 25 bp, Homo sapien
agccggggctctgctactgtccgct

SEQ ID NO: 198863 - DNA, 25 bp, Homo sapien
agcacccagagctgttctctggcca

SEQ ID NO: 198864 - DNA, 25 bp, Homo sapien
cagctgcagcagtagcgaggactca

SEQ ID NO: 198865 - DNA, 25 bp, Homo sapien
acgaaggcatgaccaacggcgactc

SEQ ID NO: 198866 - DNA, 25 bp, Homo sapien
tgccgtatgattcctggacagcctc

SEQ ID NO: 198867 - DNA, 25 bp, Homo sapien
agctgacttcctctcggcggagaca

SEQ ID NO: 198868 - DNA, 25 bp, Homo sapien
ttccggatcggaagaagctgacttc

SEQ ID NO: 198869 - DNA, 25 bp, Homo sapien
gcagccctaggttgaccatgcacta

SEQ ID NO: 198870 - DNA, 25 bp, Homo sapien
ccacgaagtcctgagtgccgtatga

SEQ ID NO: 198871 - DNA, 25 bp, Homo sapien
gcgacgagtcttcctgcatacccaa

SEQ ID NO: 198872 - DNA, 25 bp, Homo sapien
agtgcagtgccagtacccgtctgga

SEQ ID NO: 198873 - DNA, 25 bp, Homo sapien
tacccatgcttggagaaaccgcgca

SEQ ID NO: 198874 - DNA, 25 bp, Homo sapien
taaccgctgcgtaaccaatccgtgg

SEQ ID NO: 198875 - DNA, 25 bp, Homo sapien
taagagatttaaagacgcccgcgca

SEQ ID NO: 198876 - DNA, 25 bp, Homo sapien
cgcgtctagtggctttggctttagc

SEQ ID NO: 198877 - DNA, 25 bp, Homo sapien
cggtacaggccaaccaatgggaact

SEQ ID NO: 198878 - DNA, 25 bp, Homo sapien
gtcagcaaacacttccggtacaggc

SEQ ID NO: 198879 - DNA, 25 bp, Homo sapien
tcctccgatcgaactgaacctaatg

SEQ ID NO: 198880 - DNA, 25 bp, Homo sapien
aactgcatctgtttccgggttcgta

SEQ ID NO: 198881 - DNA, 25 bp, Homo sapien
ccaatccgtggagccaagctgacca

SEQ ID NO: 198882 - DNA, 25 bp, Homo sapien
ttaaactgcgaaaagataaacatta

SEQ ID NO: 198883 - DNA, 25 bp, Homo sapien
aacattatttccagtcggctttgcg

SEQ ID NO: 198884 - DNA, 25 bp, Homo sapien
taaacattatttccagtcggctttg

SEQ ID NO: 198885 - DNA, 25 bp, Homo sapien
agataaacattatttccagtcggct

SEQ ID NO: 198886 - DNA, 25 bp, Homo sapien
aagataaacattatttccagtcggc

SEQ ID NO: 198887 - DNA, 25 bp, Homo sapien
ctgcgaaaagataaacattatttcc

SEQ ID NO: 198888 - DNA, 25 bp, Homo sapien
actgcgaaaagataaacattatttc

SEQ ID NO: 198889 - DNA, 25 bp, Homo sapien
gataaacattatttccagtcggctt

SEQ ID NO: 198890 - DNA, 25 bp, Homo sapien
gctttcgttttgttcctgggcaaca

SEQ ID NO: 198891 - DNA, 25 bp, Homo sapien
tcgttttgttcctgggcaacagctg

SEQ ID NO: 198892 - DNA, 25 bp, Homo sapien
tttgttcctgggcaacagctgctcc

SEQ ID NO: 198893 - DNA, 25 bp, Homo sapien
gttcctgggcaacagctgctcccaa

SEQ ID NO: 198894 - DNA, 25 bp, Homo sapien
cccagggaccctccagtcgccctcg

SEQ ID NO: 198895 - DNA, 25 bp, Homo sapien
tcgctgacccgcggcttagggtccg

SEQ ID NO: 198896 - DNA, 25 bp, Homo sapien
cgcccgaacactcgcccgcgcttcc

SEQ ID NO: 198897 - DNA, 25 bp, Homo sapien
cctctttgctttcgttttgttcctg

SEQ ID NO: 198898 - DNA, 25 bp, Homo sapien
cggccacccagatggagtcggtgct

SEQ ID NO: 198899 - DNA, 25 bp, Homo sapien
ctgagcatcctgaaccgcaaggggc

SEQ ID NO: 198900 - DNA, 25 bp, Homo sapien
agcccaactgcctggtcatcgatga

SEQ ID NO: 198901 - DNA, 25 bp, Homo sapien
aggtcttccgcacacgcatcgaggc

SEQ ID NO: 198902 - DNA, 25 bp, Homo sapien
ccattgcagtgacgaccgtagcccg

SEQ ID NO: 198903 - DNA, 25 bp, Homo sapien
tgtgacggtctccacgcaaatgcgg

SEQ ID NO: 198904 - DNA, 25 bp, Homo sapien
gcagcagccgcgtcatgtgacggtc

SEQ ID NO: 198905 - DNA, 25 bp, Homo sapien
gtcatcgatgagatcgacggggccc

SEQ ID NO: 198906 - DNA, 25 bp, Homo sapien
caggctccaaccaggcggcgaggcg

SEQ ID NO: 198907 - DNA, 25 bp, Homo sapien
gcgccgtcgcccatcatcaagttcc

SEQ ID NO: 198908 - DNA, 25 bp, Homo sapien
cgctacgatggaggcgctaatggcc

SEQ ID NO: 198909 - DNA, 25 bp, Homo sapien
catcatcaagttccccggcgatgtc

SEQ ID NO: 198910 - DNA, 25 bp, Homo sapien
ccgcggagcaggctccaaccaggcg

SEQ ID NO: 198911 - DNA, 25 bp, Homo sapien
ccaggccaccgagccagcggaccct

SEQ ID NO: 198912 - DNA, 25 bp, Homo sapien
acgggtcccctgagggcgctctgtc

SEQ ID NO: 198913 - DNA, 25 bp, Homo sapien
tggaggcgctaatggcccggggcgc

SEQ ID NO: 198914 - DNA, 25 bp, Homo sapien
cgtagatcgcttcggccgggttcta

SEQ ID NO: 198915 - DNA, 25 bp, Homo sapien
gctcaactatgagccggtgcgccca

SEQ ID NO: 198916 - DNA, 25 bp, Homo sapien
ttcggctcagttttggctgcagcgc

SEQ ID NO: 198917 - DNA, 25 bp, Homo sapien
ctctagtaggtcttcggctcagttt

SEQ ID NO: 198918 - DNA, 25 bp, Homo sapien
tcgccctaggctgggactctagtag

SEQ ID NO: 198919 - DNA, 25 bp, Homo sapien
cgtctaagtaacttcagcgcctgcg

SEQ ID NO: 198920 - DNA, 25 bp, Homo sapien
cagcagcaggcgtctaagtaacttc

SEQ ID NO: 198921 - DNA, 25 bp, Homo sapien
cccttcgtgcagcagacgcagatcg

SEQ ID NO: 198922 - DNA, 25 bp, Homo sapien
gcgcgctcatcccagtgtctaaggc

SEQ ID NO: 198923 - DNA, 25 bp, Homo sapien
ttagcgctaacaggctccagacgga

SEQ ID NO: 198924 - DNA, 25 bp, Homo sapien
ctgggttaatgcaatcggcgcgtta

SEQ ID NO: 198925 - DNA, 25 bp, Homo sapien
acctggggcgcaggctacattacca

SEQ ID NO: 198926 - DNA, 25 bp, Homo sapien
ttaagtgtccgagaaggctcctgtg

SEQ ID NO: 198927 - DNA, 25 bp, Homo sapien
ggctgtcagaagtctccaactcttg

SEQ ID NO: 198928 - DNA, 25 bp, Homo sapien
cctttatccaagcagagcctcggcg

SEQ ID NO: 198929 - DNA, 25 bp, Homo sapien
tcagcctcggtgagttcaatcccag

SEQ ID NO: 198930 - DNA, 25 bp, Homo sapien
aagtcctaatatggaagtcgtgccc

SEQ ID NO: 198931 - DNA, 25 bp, Homo sapien
caggataaaggcacggagccacatc

SEQ ID NO: 198932 - DNA, 25 bp, Homo sapien
cccaagccgcggaagcagagagagt

SEQ ID NO: 198933 - DNA, 25 bp, Homo sapien
cacctcggcccagaacaaggatttc

SEQ ID NO: 198934 - DNA, 25 bp, Homo sapien
agagccggacctgttgtgtctttgc

SEQ ID NO: 198935 - DNA, 25 bp, Homo sapien
acagggcgatctcaggatgttcacc

SEQ ID NO: 198936 - DNA, 25 bp, Homo sapien
cggcctgcatttgggcgagcagtac

SEQ ID NO: 198937 - DNA, 25 bp, Homo sapien
gtctttgcctttctacgcatctgcg

SEQ ID NO: 198938 - DNA, 25 bp, Homo sapien
ctctccggtaggctcaccgagcgat

SEQ ID NO: 198939 - DNA, 25 bp, Homo sapien
ggctccagcctcgactattatttta

SEQ ID NO: 198940 - DNA, 25 bp, Homo sapien
gcgcttgttcgctctcccatttttt

SEQ ID NO: 198941 - DNA, 25 bp, Homo sapien
ttattttgggtcgtgcacaagcctc

SEQ ID NO: 198942 - DNA, 25 bp, Homo sapien
gaagagcggcgatgcacatgcacta

SEQ ID NO: 198943 - DNA, 25 bp, Homo sapien
tcaccgagcgatgcgagctctggga

SEQ ID NO: 198944 - DNA, 25 bp, Homo sapien
gctctgggagacagcgacgccgcct

SEQ ID NO: 198945 - DNA, 25 bp, Homo sapien
tcccattgacaaggaggtccgcgcc

SEQ ID NO: 198946 - DNA, 25 bp, Homo sapien
agacttggagaagcggctcccacga

SEQ ID NO: 198947 - DNA, 25 bp, Homo sapien
agtggcacacgctcggtctggacac

SEQ ID NO: 198948 - DNA, 25 bp, Homo sapien
cgaggactgaggtccagtggcacac

SEQ ID NO: 198949 - DNA, 25 bp, Homo sapien
ctcgaagtcttccacctcactgggc

SEQ ID NO: 198950 - DNA, 25 bp, Homo sapien
ctgtctctcatcagcagacttggag

SEQ ID NO: 198951 - DNA, 25 bp, Homo sapien
ttacgctgcaccagcatgcgctgtc

SEQ ID NO: 198952 - DNA, 25 bp, Homo sapien
cgactcacttgcgagcttgctggag

SEQ ID NO: 198953 - DNA, 25 bp, Homo sapien
aggagttcgtccttacgctgcacca

SEQ ID NO: 198954 - DNA, 25 bp, Homo sapien
agcgggacccagtttcctcctgaga

SEQ ID NO: 198955 - DNA, 25 bp, Homo sapien
cccggaatcgcacgtattagcatgc

SEQ ID NO: 198956 - DNA, 25 bp, Homo sapien
ggctggccctataaaaatgtttctg

SEQ ID NO: 198957 - DNA, 25 bp, Homo sapien
cgcagacgtctctacctacaggatc

SEQ ID NO: 198958 - DNA, 25 bp, Homo sapien
ctcgcccaatctcacaggatagtta

SEQ ID NO: 198959 - DNA, 25 bp, Homo sapien
gtttacggttgccacaggtcagtcc

SEQ ID NO: 198960 - DNA, 25 bp, Homo sapien
tatcgcgagatgacaggattttccc

SEQ ID NO: 198961 - DNA, 25 bp, Homo sapien
tcccgcgaaggagaagcgcgctttt

SEQ ID NO: 198962 - DNA, 25 bp, Homo sapien
acccacacgaagaggctgtctgaga

SEQ ID NO: 198963 - DNA, 25 bp, Homo sapien
cgccgtccgcaccacggcttggctg

SEQ ID NO: 198964 - DNA, 25 bp, Homo sapien
cgggcacccagcatcatccgccgtc

SEQ ID NO: 198965 - DNA, 25 bp, Homo sapien
aagaggctgtctgagagcaggtact

SEQ ID NO: 198966 - DNA, 25 bp, Homo sapien
tcgctcacccacacgaagaggctgt

SEQ ID NO: 198967 - DNA, 25 bp, Homo sapien
cggataaagggtgacgcagcggacc

SEQ ID NO: 198968 - DNA, 25 bp, Homo sapien
ccacgcgatgttcctcccgcccgcg

SEQ ID NO: 198969 - DNA, 25 bp, Homo sapien
aggccgttagctggtccggctcgcc

SEQ ID NO: 198970 - DNA, 25 bp, Homo sapien
attgggcggtaccacagacatgctg

SEQ ID NO: 198971 - DNA, 25 bp, Homo sapien
cgcgccgcacttacaggttgatggt

SEQ ID NO: 198972 - DNA, 25 bp, Homo sapien
tgcgggaagcggttatctgcaatcc

SEQ ID NO: 198973 - DNA, 25 bp, Homo sapien
ccctcaggaaggtagcgtcttgatc

SEQ ID NO: 198974 - DNA, 25 bp, Homo sapien
gacgctgttacggaagaaaccttga

SEQ ID NO: 198975 - DNA, 25 bp, Homo sapien
cgccacgcagaggtctagggatctc

SEQ ID NO: 198976 - DNA, 25 bp, Homo sapien
gatctctgaaaaagccctgggactc

SEQ ID NO: 198977 - DNA, 25 bp, Homo sapien
cgtcggagagtctataggagctttc

SEQ ID NO: 198978 - DNA, 25 bp, Homo sapien
acaagcgcagcggagctggcctcac

SEQ ID NO: 198979 - DNA, 25 bp, Homo sapien
gggctgattttgtggcgcagtttca

SEQ ID NO: 198980 - DNA, 25 bp, Homo sapien
gtggcgcagtttcagggtgaacaca

SEQ ID NO: 198981 - DNA, 25 bp, Homo sapien
agggtgaacacaggcagcagcatga

SEQ ID NO: 198982 - DNA, 25 bp, Homo sapien
ggcgcagacccgtccgctctttttg

SEQ ID NO: 198983 - DNA, 25 bp, Homo sapien
ccaggcacgggtgagtcccgtcgta

SEQ ID NO: 198984 - DNA, 25 bp, Homo sapien
gtagcgccctatggccaccattcgg

SEQ ID NO: 198985 - DNA, 25 bp, Homo sapien
ccgggcaagaagtgcagggacacta

SEQ ID NO: 198986 - DNA, 25 bp, Homo sapien
ccactttcggagatggtacgtgcgc

SEQ ID NO: 198987 - DNA, 25 bp, Homo sapien
cccgcccgaggctataaaagcatcg

SEQ ID NO: 198988 - DNA, 25 bp, Homo sapien
acattaacccttcctgtggcgtcgc

SEQ ID NO: 198989 - DNA, 25 bp, Homo sapien
tggggacccgagttcgtccacatta

SEQ ID NO: 198990 - DNA, 25 bp, Homo sapien
tgcgccttcgctcaaggacacttgg

SEQ ID NO: 198991 - DNA, 25 bp, Homo sapien
gcgcgcccttgtacctgcaaagaaa

SEQ ID NO: 198992 - DNA, 25 bp, Homo sapien
tcctcgacatggaccctgagacctg

SEQ ID NO: 198993 - DNA, 25 bp, Homo sapien
ccagttgcttggagaagcccgttca

SEQ ID NO: 198994 - DNA, 25 bp, Homo sapien
tgtgcaggccagcactaccttcgag

SEQ ID NO: 198995 - DNA, 25 bp, Homo sapien
gggtcaggagttggccgcttctcat

SEQ ID NO: 198996 - DNA, 25 bp, Homo sapien
ccgccctatgtctagttcctgtaca

SEQ ID NO: 198997 - DNA, 25 bp, Homo sapien
tctagttcctgtacagccggggcca

SEQ ID NO: 198998 - DNA, 25 bp, Homo sapien
cctcaaggaccagcgcagagggctc

SEQ ID NO: 198999 - DNA, 25 bp, Homo sapien
cctcaggacgctagccctgtgtgca

SEQ ID NO: 199000 - DNA, 25 bp, Homo sapien
cactaccttcgaggcggggactcag

SEQ ID NO: 199001 - DNA, 25 bp, Homo sapien
ctcttctcggtgtggcaggaggtct

SEQ ID NO: 199002 - DNA, 25 bp, Homo sapien
tataaacactgcttgccgcgctgca

SEQ ID NO: 199003 - DNA, 25 bp, Homo sapien
ccgaggcgcaagtgggccgccttca

SEQ ID NO: 199004 - DNA, 25 bp, Homo sapien
gctcaggttcgagtacaggacagga

SEQ ID NO: 199005 - DNA, 25 bp, Homo sapien
ttcagctcgccatggatcccaactg

SEQ ID NO: 199006 - DNA, 25 bp, Homo sapien
cgcgctaacggctcaggttcgagta

SEQ ID NO: 199007 - DNA, 25 bp, Homo sapien
tgtttcgcctggagccgcaagtgac

SEQ ID NO: 199008 - DNA, 25 bp, Homo sapien
cctggagccgcaagtgactcagcgc

SEQ ID NO: 199009 - DNA, 25 bp, Homo sapien
tcccggctctttctagctataaaca

SEQ ID NO: 199010 - DNA, 25 bp, Homo sapien
gatggccagcaaccacaaggaaatg

SEQ ID NO: 199011 - DNA, 25 bp, Homo sapien
caaccacaaggaaatggggaatatg

SEQ ID NO: 199012 - DNA, 25 bp, Homo sapien
ccaagcaagagacccgcggtgcaca

SEQ ID NO: 199013 - DNA, 25 bp, Homo sapien
gttgcacaccggctccgggaatggc

SEQ ID NO: 199014 - DNA, 25 bp, Homo sapien
ggaatatcgcgaccaccagaggctg

SEQ ID NO: 199015 - DNA, 25 bp, Homo sapien
cgggaatggcgaaataccgcagatg

SEQ ID NO: 199016 - DNA, 25 bp, Homo sapien
ctgctgctcacagtccctccacgta

SEQ ID NO: 199017 - DNA, 25 bp, Homo sapien
gacggagatggccagcaaccacaag

SEQ ID NO: 199018 - DNA, 25 bp, Homo sapien
gatgttctgaacacaactcgctcgc

SEQ ID NO: 199019 - DNA, 25 bp, Homo sapien
cacccgagcgaacgggctccaaagg

SEQ ID NO: 199020 - DNA, 25 bp, Homo sapien
gacttcgggaacaccgcgtacctgc

SEQ ID NO: 199021 - DNA, 25 bp, Homo sapien
agtcgagctgaaaaccgcggagcta

SEQ ID NO: 199022 - DNA, 25 bp, Homo sapien
cacggactctgggacaagtcgagct

SEQ ID NO: 199023 - DNA, 25 bp, Homo sapien
gcactcagcggatcccgggacggca

SEQ ID NO: 199024 - DNA, 25 bp, Homo sapien
cccgtgttgctatgtaaggaggtgc

SEQ ID NO: 199025 - DNA, 25 bp, Homo sapien
agcaggtgggctgcacacggactct

SEQ ID NO: 199026 - DNA, 25 bp, Homo sapien
gcacacgaccgatccggggactgga

SEQ ID NO: 199027 - DNA, 25 bp, Homo sapien
ctagcagtcgctccatttatcgctt

SEQ ID NO: 199028 - DNA, 25 bp, Homo sapien
acgactcgctccctaccacacgccc

SEQ ID NO: 199029 - DNA, 25 bp, Homo sapien
ctgagtagaaaagcagccgcaggct

SEQ ID NO: 199030 - DNA, 25 bp, Homo sapien
atggtgcgcccggcacttatgctgg

SEQ ID NO: 199031 - DNA, 25 bp, Homo sapien
ctcccgcgcaaacccgagccaaagg

SEQ ID NO: 199032 - DNA, 25 bp, Homo sapien
gggcctagcagtcgctccatttatc

SEQ ID NO: 199033 - DNA, 25 bp, Homo sapien
ggacctcggggacactgcgtaccac

SEQ ID NO: 199034 - DNA, 25 bp, Homo sapien
gacctcggggacaccgcataccgcc

SEQ ID NO: 199035 - DNA, 25 bp, Homo sapien
ggacaccgcataccgccgggcgcac

SEQ ID NO: 199036 - DNA, 25 bp, Homo sapien
cccttccttgagtaggaaagcagcc

SEQ ID NO: 199037 - DNA, 25 bp, Homo sapien
ttgagtaggaaagcagccgcaggtt

SEQ ID NO: 199038 - DNA, 25 bp, Homo sapien
accacgccgtccacgtgcgccttgc

SEQ ID NO: 199039 - DNA, 25 bp, Homo sapien
cttgcggtctctccatttatcgctt

SEQ ID NO: 199040 - DNA, 25 bp, Homo sapien
gcttcccactcagccgatccgggga

SEQ ID NO: 199041 - DNA, 25 bp, Homo sapien
cccagctgaaaacggcgaagcgagg

SEQ ID NO: 199042 - DNA, 25 bp, Homo sapien
ggaatgaaacaaccaccggctacca

SEQ ID NO: 199043 - DNA, 25 bp, Homo sapien
tcggccctgccacgctgacccgtgg

SEQ ID NO: 199044 - DNA, 25 bp, Homo sapien
ccaatgagcgccacaccaacctcca

SEQ ID NO: 199045 - DNA, 25 bp, Homo sapien
cgcaaaaacacgccgcagagcggaa

SEQ ID NO: 199046 - DNA, 25 bp, Homo sapien
caccgccgacttcccggaggagcga

SEQ ID NO: 199047 - DNA, 25 bp, Homo sapien
gctaccagagcaacaacggcctccg

SEQ ID NO: 199048 - DNA, 25 bp, Homo sapien
atgaaacaaccaccggctaccagag

SEQ ID NO: 199049 - DNA, 25 bp, Homo sapien
gcttcccggcgtctttccctctgcc

SEQ ID NO: 199050 - DNA, 25 bp, Homo sapien
ccgtgttcccgtgttactgtgtacg

SEQ ID NO: 199051 - DNA, 25 bp, Homo sapien
ggcgtaaactcactcccgcgttagc

SEQ ID NO: 199052 - DNA, 25 bp, Homo sapien
tggaggcgaccgaaacgccaaggct

SEQ ID NO: 199053 - DNA, 25 bp, Homo sapien
ggacaggccgagctgaaaaccgtga

SEQ ID NO: 199054 - DNA, 25 bp, Homo sapien
tgcactcagacttcgggacaggccg

SEQ ID NO: 199055 - DNA, 25 bp, Homo sapien
aatcacatcggtggcggttgctctg

SEQ ID NO: 199056 - DNA, 25 bp, Homo sapien
gcgacagcgaggagaaacgaaaatc

SEQ ID NO: 199057 - DNA, 25 bp, Homo sapien
tgcgcaaagcccagtccaggtcatc

SEQ ID NO: 199058 - DNA, 25 bp, Homo sapien
ggtagcacatggactcccacagagc

SEQ ID NO: 199059 - DNA, 25 bp, Homo sapien
agcaccctgccctgactgtaaagtc

SEQ ID NO: 199060 - DNA, 25 bp, Homo sapien
tgcgcaacagccacgttaaggagga

SEQ ID NO: 199061 - DNA, 25 bp, Homo sapien
agagccgaagctcacgtcactggtg

SEQ ID NO: 199062 - DNA, 25 bp, Homo sapien
atggagtgcaatctccgggaaattc

SEQ ID NO: 199063 - DNA, 25 bp, Homo sapien
ccgcctcggtcttatctggggacgt

SEQ ID NO: 199064 - DNA, 25 bp, Homo sapien
gaaccctgggcagcgctgacactga

SEQ ID NO: 199065 - DNA, 25 bp, Homo sapien
ccctccaaagcgagcgtgagccaaa

SEQ ID NO: 199066 - DNA, 25 bp, Homo sapien
actgcttcttcgcttctctcttgga

SEQ ID NO: 199067 - DNA, 25 bp, Homo sapien
cgcttctctcttggaaagtccagtc

SEQ ID NO: 199068 - DNA, 25 bp, Homo sapien
ggctgttggggtccaccacgccttc

SEQ ID NO: 199069 - DNA, 25 bp, Homo sapien
tgactatcaaagcagcggccggctg

SEQ ID NO: 199070 - DNA, 25 bp, Homo sapien
tctgctgcacacagcccacccagga

SEQ ID NO: 199071 - DNA, 25 bp, Homo sapien
tgagcggactccaaagggacggtcc

SEQ ID NO: 199072 - DNA, 25 bp, Homo sapien
cccgcttgagcggactccaaaggga

SEQ ID NO: 199073 - DNA, 25 bp, Homo sapien
cttggaaagtccagtctctcctcgg

SEQ ID NO: 199074 - DNA, 25 bp, Homo sapien
tgtgtagctccatcctcgtgctcgc

SEQ ID NO: 199075 - DNA, 25 bp, Homo sapien
ctatgctcccggaggtacgtggcgc

SEQ ID NO: 199076 - DNA, 25 bp, Homo sapien
cgtgctcgccttcttcattggcgga

SEQ ID NO: 199077 - DNA, 25 bp, Homo sapien
caggtggtcgcgttatcctcatccc

SEQ ID NO: 199078 - DNA, 25 bp, Homo sapien
ctcccgtgtccgtgtgtagctccat

SEQ ID NO: 199079 - DNA, 25 bp, Homo sapien
tcttcattggcggaagctgggagcc

SEQ ID NO: 199080 - DNA, 25 bp, Homo sapien
gtcatcagctttgcctctcccgtgt

SEQ ID NO: 199081 - DNA, 25 bp, Homo sapien
ctgccaccctgagagctattttcta

SEQ ID NO: 199082 - DNA, 25 bp, Homo sapien
gggcgtcccttaccagcggcacagg

SEQ ID NO: 199083 - DNA, 25 bp, Homo sapien
tcccttgagcgcagctgggcgcaca

SEQ ID NO: 199084 - DNA, 25 bp, Homo sapien
atgggccaagtgcaaggtcccttga

SEQ ID NO: 199085 - DNA, 25 bp, Homo sapien
gcggctgtttttatagtcaggagac

SEQ ID NO: 199086 - DNA, 25 bp, Homo sapien
acagccagcggctgtttttatagtc

SEQ ID NO: 199087 - DNA, 25 bp, Homo sapien
caacccgaggcgagactagagttcc

SEQ ID NO: 199088 - DNA, 25 bp, Homo sapien
ccattgcaacccgaggcgagactag

SEQ ID NO: 199089 - DNA, 25 bp, Homo sapien
ttgagcgcagctgggcgcacaccgc

SEQ ID NO: 199090 - DNA, 25 bp, Homo sapien
ccggtgcaggccttttctcggagac

SEQ ID NO: 199091 - DNA, 25 bp, Homo sapien
gccaagtgatgttccgggagtccgc

SEQ ID NO: 199092 - DNA, 25 bp, Homo sapien
ttttctcggagaccctacactcagc

SEQ ID NO: 199093 - DNA, 25 bp, Homo sapien
acggcgctcagatggacacagctcc

SEQ ID NO: 199094 - DNA, 25 bp, Homo sapien
gcgcctgttcatcggacctaccttg

SEQ ID NO: 199095 - DNA, 25 bp, Homo sapien
cctaccttgaaaaggtgacagcgga

SEQ ID NO: 199096 - DNA, 25 bp, Homo sapien
aggactagctgcgtgcgggtcctcc

SEQ ID NO: 199097 - DNA, 25 bp, Homo sapien
ggacaatgacaacggccaggcgacc

SEQ ID NO: 199098 - DNA, 25 bp, Homo sapien
cgacccgtctgctgcgcacagccca

SEQ ID NO: 199099 - DNA, 25 bp, Homo sapien
gagtagcaggtaatctcagggaact

SEQ ID NO: 199100 - DNA, 25 bp, Homo sapien
caggtaatctcagggaactgggcag

SEQ ID NO: 199101 - DNA, 25 bp, Homo sapien
ggagccgctgcgaaagggccgtccc

SEQ ID NO: 199102 - DNA, 25 bp, Homo sapien
accgacctgcgctcagggtactttg

SEQ ID NO: 199103 - DNA, 25 bp, Homo sapien
tgcgctcagggtactttgcgcccga

SEQ ID NO: 199104 - DNA, 25 bp, Homo sapien
tactttgcgcccgacccgtctgctg

SEQ ID NO: 199105 - DNA, 25 bp, Homo sapien
gatctcggggcacgcggaacgccaa

SEQ ID NO: 199106 - DNA, 25 bp, Homo sapien
cgaccacctgggaatgggaaatggc

SEQ ID NO: 199107 - DNA, 25 bp, Homo sapien
cacagctcaacccaagaccgcaggc

SEQ ID NO: 199108 - DNA, 25 bp, Homo sapien
gacccgcctgctgcgcacagctcaa

SEQ ID NO: 199109 - DNA, 25 bp, Homo sapien
ggatggtgcgcctgacccgcctgct

SEQ ID NO: 199110 - DNA, 25 bp, Homo sapien
ggcgcgtacctctggcagcatagcc

SEQ ID NO: 199111 - DNA, 25 bp, Homo sapien
ccacctgggaatgggaaatggccct

SEQ ID NO: 199112 - DNA, 25 bp, Homo sapien
gcgaagctgaggacgactgtgcggg

SEQ ID NO: 199113 - DNA, 25 bp, Homo sapien
ggaatgggaaatggccctcagggtg

SEQ ID NO: 199114 - DNA, 25 bp, Homo sapien
gattccgagtttcccggcacgccta

SEQ ID NO: 199115 - DNA, 25 bp, Homo sapien
tgggctccaccacgcttttcatctg

SEQ ID NO: 199116 - DNA, 25 bp, Homo sapien
cttttcatctgtcccgctgcgtgtt

SEQ ID NO: 199117 - DNA, 25 bp, Homo sapien
ggactataaagagagccgccggctt

SEQ ID NO: 199118 - DNA, 25 bp, Homo sapien
ccaggttctcaacgaggtggagcca

SEQ ID NO: 199119 - DNA, 25 bp, Homo sapien
ggacgccacgtactgccaggttctc

SEQ ID NO: 199120 - DNA, 25 bp, Homo sapien
atccagggacgtgatccagggactc

SEQ ID NO: 199121 - DNA, 25 bp, Homo sapien
ggaaatgcaaagctacacacagtgg

SEQ ID NO: 199122 - DNA, 25 bp, Homo sapien
atacttcccgttctcctcatggcag

SEQ ID NO: 199123 - DNA, 25 bp, Homo sapien
ggagcggccagccttggccaatcag

SEQ ID NO: 199124 - DNA, 25 bp, Homo sapien
ctgtagcacaaggtaagggtgtgtc

SEQ ID NO: 199125 - DNA, 25 bp, Homo sapien
gaccctgggcttgtccttgaaccca

SEQ ID NO: 199126 - DNA, 25 bp, Homo sapien
tgacgccggcgacacaacgccttgt

SEQ ID NO: 199127 - DNA, 25 bp, Homo sapien
gggtgcctttcattcgtccactttc

SEQ ID NO: 199128 - DNA, 25 bp, Homo sapien
tgaatgcagaacctaggcctcccga

SEQ ID NO: 199129 - DNA, 25 bp, Homo sapien
tctggtcgcgtccttgcgaccctgg

SEQ ID NO: 199130 - DNA, 25 bp, Homo sapien
ccctcgctggttgacaaagaactaa

SEQ ID NO: 199131 - DNA, 25 bp, Homo sapien
agaggctgctcgaagtccttgccgc

SEQ ID NO: 199132 - DNA, 25 bp, Homo sapien
caggtcctgacagcgagacaaactc

SEQ ID NO: 199133 - DNA, 25 bp, Homo sapien
aactcgcgcctcgtgctttgtaaaa

SEQ ID NO: 199134 - DNA, 25 bp, Homo sapien
tcttacccgggaaatggcgagaggc

SEQ ID NO: 199135 - DNA, 25 bp, Homo sapien
gcgcggagagcgctcaactaacagc

SEQ ID NO: 199136 - DNA, 25 bp, Homo sapien
cggctgcactgcgatctgggaagaa

SEQ ID NO: 199137 - DNA, 25 bp, Homo sapien
gctcaactaacagcgcacctggacg

SEQ ID NO: 199138 - DNA, 25 bp, Homo sapien
aactgtcgttgcagagattgcgggc

SEQ ID NO: 199139 - DNA, 25 bp, Homo sapien
agccacagagcgttctgtccgcaga

SEQ ID NO: 199140 - DNA, 25 bp, Homo sapien
gcccgtcacgctcctggtgaagagc

SEQ ID NO: 199141 - DNA, 25 bp, Homo sapien
ccatggagtccgagaccgaacccga

SEQ ID NO: 199142 - DNA, 25 bp, Homo sapien
atccggacgccgattgggccacgtt

SEQ ID NO: 199143 - DNA, 25 bp, Homo sapien
ggcttctataaaaggcgcccgaagc

SEQ ID NO: 199144 - DNA, 25 bp, Homo sapien
cccagagacgtgaactgtcgttgca

SEQ ID NO: 199145 - DNA, 25 bp, Homo sapien
cagcgccaccgcgacttggagctga

SEQ ID NO: 199146 - DNA, 25 bp, Homo sapien
actttcagtttcgtgcagagcgcgg

SEQ ID NO: 199147 - DNA, 25 bp, Homo sapien
tcccgtccacgaaaggggtgagcgc

SEQ ID NO: 199148 - DNA, 25 bp, Homo sapien
cacgtctcctgggactgtccttggg

SEQ ID NO: 199149 - DNA, 25 bp, Homo sapien
gctggcacctcgaatccacgtgatt

SEQ ID NO: 199150 - DNA, 25 bp, Homo sapien
atccacgtgatttctcggcagcagc

SEQ ID NO: 199151 - DNA, 25 bp, Homo sapien
cagttccatgcactggcggagcagc

SEQ ID NO: 199152 - DNA, 25 bp, Homo sapien
aggatcggggttcgaattctgcacg

SEQ ID NO: 199153 - DNA, 25 bp, Homo sapien
gcggcggcttctactttcagtttcg

SEQ ID NO: 199154 - DNA, 25 bp, Homo sapien
tccgagcccagctgctttggggacc

SEQ ID NO: 199155 - DNA, 25 bp, Homo sapien
ttgttccgatcctcagccacctgag

SEQ ID NO: 199156 - DNA, 25 bp, Homo sapien
gcagcttggcgtgagtgcccaactt

SEQ ID NO: 199157 - DNA, 25 bp, Homo sapien
cgtgagtgcccaacttcggccttgg

SEQ ID NO: 199158 - DNA, 25 bp, Homo sapien
ttggggctgggctctttgatccagc

SEQ ID NO: 199159 - DNA, 25 bp, Homo sapien
ggcgcttcggtgactcagctccgac

SEQ ID NO: 199160 - DNA, 25 bp, Homo sapien
gaagccgcgttgttccgatcctcag

SEQ ID NO: 199161 - DNA, 25 bp, Homo sapien
tctttgatccagctgcgggtccgaa

SEQ ID NO: 199162 - DNA, 25 bp, Homo sapien
ccctgaaaacgagccggagagactt

SEQ ID NO: 199163 - DNA, 25 bp, Homo sapien
cctcaggatgaggactggccagtct

SEQ ID NO: 199164 - DNA, 25 bp, Homo sapien
gtcccgctgatcacgtgacacgatt

SEQ ID NO: 199165 - DNA, 25 bp, Homo sapien
gcgtccatctttgccgttctctcgg

SEQ ID NO: 199166 - DNA, 25 bp, Homo sapien
tgattgggccattcacgcctcagga

SEQ ID NO: 199167 - DNA, 25 bp, Homo sapien
gcccgatggaaatccggtaccctga

SEQ ID NO: 199168 - DNA, 25 bp, Homo sapien
aggcttcggctactccggacaagga

SEQ ID NO: 199169 - DNA, 25 bp, Homo sapien
ctcggacctgtcacaaaggagtcgc

SEQ ID NO: 199170 - DNA, 25 bp, Homo sapien
ggcgacttgagacggagttcccaca

SEQ ID NO: 199171 - DNA, 25 bp, Homo sapien
taacgctcgcctgtgattggatgcc

SEQ ID NO: 199172 - DNA, 25 bp, Homo sapien
cgcggccttggctgagaggccttaa

SEQ ID NO: 199173 - DNA, 25 bp, Homo sapien
ggcgactgcgatggacgccttagaa

SEQ ID NO: 199174 - DNA, 25 bp, Homo sapien
gcgctgtctttgtgagtagctcctc

SEQ ID NO: 199175 - DNA, 25 bp, Homo sapien
tctcgagttgcgagtgaggaaattc

SEQ ID NO: 199176 - DNA, 25 bp, Homo sapien
cgtggcttcgattccttcatccgta

SEQ ID NO: 199177 - DNA, 25 bp, Homo sapien
tgaggaaattctggctcgtggcttc

SEQ ID NO: 199178 - DNA, 25 bp, Homo sapien
aggcgctttctacgcgctgtgcacc

SEQ ID NO: 199179 - DNA, 25 bp, Homo sapien
cgcgcctagggataaacttgtggta

SEQ ID NO: 199180 - DNA, 25 bp, Homo sapien
caggccgtggtagcttccgcgccta

SEQ ID NO: 199181 - DNA, 25 bp, Homo sapien
ctccggatccctgtgtggctccagg

SEQ ID NO: 199182 - DNA, 25 bp, Homo sapien
ttcgcgaaaaatgaacgcagcgccg

SEQ ID NO: 199183 - DNA, 25 bp, Homo sapien
tgtggccgctggtaaccaccttgga

SEQ ID NO: 199184 - DNA, 25 bp, Homo sapien
ccggcgcagcgactcttgaagagtc

SEQ ID NO: 199185 - DNA, 25 bp, Homo sapien
actctgtacacggtgcagggtgctc

SEQ ID NO: 199186 - DNA, 25 bp, Homo sapien
tccggtcactctccactggcgatga

SEQ ID NO: 199187 - DNA, 25 bp, Homo sapien
gatatggccaaacacccgggcgcga

SEQ ID NO: 199188 - DNA, 25 bp, Homo sapien
ggccgtcttctgtccctgcatttag

SEQ ID NO: 199189 - DNA, 25 bp, Homo sapien
cttccgccttgggagataatttccg

SEQ ID NO: 199190 - DNA, 25 bp, Homo sapien
agcgctcgtcgcagccatcttggct

SEQ ID NO: 199191 - DNA, 25 bp, Homo sapien
ggcagggctctcatatccggtcact

SEQ ID NO: 199192 - DNA, 25 bp, Homo sapien
cgattgcatttgacggacgcgacgc

SEQ ID NO: 199193 - DNA, 25 bp, Homo sapien
tgtgaccctcgaaagctagacgtgc

SEQ ID NO: 199194 - DNA, 25 bp, Homo sapien
cctaactcgaaatggcggcaccttc

SEQ ID NO: 199195 - DNA, 25 bp, Homo sapien
gcacggagcttttccgagtgcctcc

SEQ ID NO: 199196 - DNA, 25 bp, Homo sapien
cccgacgccaaaggctcaggatgga

SEQ ID NO: 199197 - DNA, 25 bp, Homo sapien
aaagcagtagcctggagccgactcc

SEQ ID NO: 199198 - DNA, 25 bp, Homo sapien
caggctgctgccctaactcgaaatg

SEQ ID NO: 199199 - DNA, 25 bp, Homo sapien
gcgatgcagcatctggaccgccagg

SEQ ID NO: 199200 - DNA, 25 bp, Homo sapien
caatgggtcaaggacgcgatgcagc

SEQ ID NO: 199201 - DNA, 25 bp, Homo sapien
ggagccgactccttcttcccaggaa

SEQ ID NO: 199202 - DNA, 25 bp, Homo sapien
cgtggctgcgttcccatcgaggaac

SEQ ID NO: 199203 - DNA, 25 bp, Homo sapien
gcagccggggaacggcagaaattcc

SEQ ID NO: 199204 - DNA, 25 bp, Homo sapien
tgggcgacgtgcccgcttccaaaat

SEQ ID NO: 199205 - DNA, 25 bp, Homo sapien
aggctccacggagcgacgacttccg

SEQ ID NO: 199206 - DNA, 25 bp, Homo sapien
tggtcccgtagctaccggtcgcgtc

SEQ ID NO: 199207 - DNA, 25 bp, Homo sapien
ctcaggaataaaccagccggggctt

SEQ ID NO: 199208 - DNA, 25 bp, Homo sapien
cctcacaccgacttctcaggaataa

SEQ ID NO: 199209 - DNA, 25 bp, Homo sapien
acggcagaaattcccagtcaggacc

SEQ ID NO: 199210 - DNA, 25 bp, Homo sapien
gcctcgctgactgacttccggtgtt

SEQ ID NO: 199211 - DNA, 25 bp, Homo sapien
cacggagctcactgacgagaatgtc

SEQ ID NO: 199212 - DNA, 25 bp, Homo sapien
gttcatcatcgagaacaccgacctg

SEQ ID NO: 199213 - DNA, 25 bp, Homo sapien
caccgacctggcgtaaggctaccga

SEQ ID NO: 199214 - DNA, 25 bp, Homo sapien
ctgcaccagggctttagctttggga

SEQ ID NO: 199215 - DNA, 25 bp, Homo sapien
tttcagggtggccaattcgattcgg

SEQ ID NO: 199216 - DNA, 25 bp, Homo sapien
ggtcttcatcgctgaggttcccata

SEQ ID NO: 199217 - DNA, 25 bp, Homo sapien
ggttcccataataggtaagcgactc

SEQ ID NO: 199218 - DNA, 25 bp, Homo sapien
ccggaagctctggtttcaccgcggc

SEQ ID NO: 199219 - DNA, 25 bp, Homo sapien
aggcagctggctgcatgcgagaccc

SEQ ID NO: 199220 - DNA, 25 bp, Homo sapien
tttacccgcccagtgctatcctgtg

SEQ ID NO: 199221 - DNA, 25 bp, Homo sapien
ggctcagagcctcgcaaaacaaaga

SEQ ID NO: 199222 - DNA, 25 bp, Homo sapien
tttgctgtgaaaagaaccgaaactc

SEQ ID NO: 199223 - DNA, 25 bp, Homo sapien
agcaacttgcttccctttgctgtga

SEQ ID NO: 199224 - DNA, 25 bp, Homo sapien
tgcaaacgtgcaactgcctgccgcg

SEQ ID NO: 199225 - DNA, 25 bp, Homo sapien
gcgggcgccctgatcaaacaagcaa

SEQ ID NO: 199226 - DNA, 25 bp, Homo sapien
ctgcgaccaccgtcagtctcgaaga

SEQ ID NO: 199227 - DNA, 25 bp, Homo sapien
gtctcgaagatcagccgcgccaagg

SEQ ID NO: 199228 - DNA, 25 bp, Homo sapien
caaccgttattggactgcgaccacc

SEQ ID NO: 199229 - DNA, 25 bp, Homo sapien
tcctcggacctacgggagaacacaa

SEQ ID NO: 199230 - DNA, 25 bp, Homo sapien
cgggcgcgatacaactgtgcatgat

SEQ ID NO: 199231 - DNA, 25 bp, Homo sapien
gccaattggcagtgcagtccgacca

SEQ ID NO: 199232 - DNA, 25 bp, Homo sapien
tgctccatttctcgcgccaattggc

SEQ ID NO: 199233 - DNA, 25 bp, Homo sapien
gcccacttcgagactggagcgcgaa

SEQ ID NO: 199234 - DNA, 25 bp, Homo sapien
cttggttcaggtttcctcagcgcca

SEQ ID NO: 199235 - DNA, 25 bp, Homo sapien
tcctcagcgccaactacgtactagg

SEQ ID NO: 199236 - DNA, 25 bp, Homo sapien
gctcggctttcttggttcaggtttc

SEQ ID NO: 199237 - DNA, 25 bp, Homo sapien
ctccagcctaacttcggggcgaggg

SEQ ID NO: 199238 - DNA, 25 bp, Homo sapien
ctggagcaagttcccgggccgcctt

SEQ ID NO: 199239 - DNA, 25 bp, Homo sapien
ctagaaagttctgctctgagttcgg

SEQ ID NO: 199240 - DNA, 25 bp, Homo sapien
gtcgccttagtcctcacttagtcga

SEQ ID NO: 199241 - DNA, 25 bp, Homo sapien
ggacttgcgggctccgtacgtccca

SEQ ID NO: 199242 - DNA, 25 bp, Homo sapien
tgacgcccgacatgtgcatcagctt

SEQ ID NO: 199243 - DNA, 25 bp, Homo sapien
caagatcatcatgacgcccgacatg

SEQ ID NO: 199244 - DNA, 25 bp, Homo sapien
cagcaaaggcaacaagatcatcatg

SEQ ID NO: 199245 - DNA, 25 bp, Homo sapien
agcgcgagttcctgcggcgcaccga

SEQ ID NO: 199246 - DNA, 25 bp, Homo sapien
acatcacggcctccaagcgcgagtt

SEQ ID NO: 199247 - DNA, 25 bp, Homo sapien
tgcgctaccactgccgtgaggacca

SEQ ID NO: 199248 - DNA, 25 bp, Homo sapien
cggaggagcgcatccagctgcgcta

SEQ ID NO: 199249 - DNA, 25 bp, Homo sapien
atgtgcatcagcttcgaggtgggcc

SEQ ID NO: 199250 - DNA, 25 bp, Homo sapien
tcgagaagggttacggcgcttccca

SEQ ID NO: 199251 - DNA, 25 bp, Homo sapien
tgattgcagccattcagggagcagc

SEQ ID NO: 199252 - DNA, 25 bp, Homo sapien
tgtttccttctagacctcccatggg

SEQ ID NO: 199253 - DNA, 25 bp, Homo sapien
tccggaatcaggctgtttccttcta

SEQ ID NO: 199254 - DNA, 25 bp, Homo sapien
tgcagtgctacagggttcagcgcct

SEQ ID NO: 199255 - DNA, 25 bp, Homo sapien
ttgcccacgcatccattagtcgagg

SEQ ID NO: 199256 - DNA, 25 bp, Homo sapien
gcccaacgtgtcacaaataaagctg

SEQ ID NO: 199257 - DNA, 25 bp, Homo sapien
tggcctttctccgattccctgattg

SEQ ID NO: 199258 - DNA, 25 bp, Homo sapien
ccgtactccgcaagcagagggttgg

SEQ ID NO: 199259 - DNA, 25 bp, Homo sapien
aggatcagccgtggccgagggacct

SEQ ID NO: 199260 - DNA, 25 bp, Homo sapien
tagagcccgtactccgcaagcagag

SEQ ID NO: 199261 - DNA, 25 bp, Homo sapien
aggctagagcccgtactccgcaagc

SEQ ID NO: 199262 - DNA, 25 bp, Homo sapien
tcaagcagcggccaatcaaggcagg

SEQ ID NO: 199263 - DNA, 25 bp, Homo sapien
tcggttgtcaagcagcggccaatca

SEQ ID NO: 199264 - DNA, 25 bp, Homo sapien
ctctgagccggaggttttgttgtga

SEQ ID NO: 199265 - DNA, 25 bp, Homo sapien
gagcacccgcggcagctgattggtg

SEQ ID NO: 199266 - DNA, 25 bp, Homo sapien
gagcgcagggcagcaatgacgtccc

SEQ ID NO: 199267 - DNA, 25 bp, Homo sapien
tcgcaccgtcacgatgagcagcgcg

SEQ ID NO: 199268 - DNA, 25 bp, Homo sapien
actctcacccgtggtgcggaggcct

SEQ ID NO: 199269 - DNA, 25 bp, Homo sapien
tgcagggaaggcacccaccagatca

SEQ ID NO: 199270 - DNA, 25 bp, Homo sapien
gcgacttgttgatgtgctgcgcctc

SEQ ID NO: 199271 - DNA, 25 bp, Homo sapien
cccagagccgacagcgacttgttga

SEQ ID NO: 199272 - DNA, 25 bp, Homo sapien
ccgtcacgatgagcagcgcgtgcga

SEQ ID NO: 199273 - DNA, 25 bp, Homo sapien
ctcgttcaggttggtgaactcggtc

SEQ ID NO: 199274 - DNA, 25 bp, Homo sapien
catgcgttccctgaaggctctcaca

SEQ ID NO: 199275 - DNA, 25 bp, Homo sapien
gtacatcccttaccgtgtccttgca

SEQ ID NO: 199276 - DNA, 25 bp, Homo sapien
gggtctgcgctcttctcgttcaata

SEQ ID NO: 199277 - DNA, 25 bp, Homo sapien
agcaaggtcctcgactcgggctgaa

SEQ ID NO: 199278 - DNA, 25 bp, Homo sapien
ggaaatgattaactcgggccgcggc

SEQ ID NO: 199279 - DNA, 25 bp, Homo sapien
cctggtgagccatgcgtacttttgc

SEQ ID NO: 199280 - DNA, 25 bp, Homo sapien
cgagtgcaaaacttccacgcgagta

SEQ ID NO: 199281 - DNA, 25 bp, Homo sapien
gcgggctctcataccagtacgtgtc

SEQ ID NO: 199282 - DNA, 25 bp, Homo sapien
ctattgctgcgggaccggcaaggac

SEQ ID NO: 199283 - DNA, 25 bp, Homo sapien
cggaaggatcctcacccaacgctgg

SEQ ID NO: 199284 - DNA, 25 bp, Homo sapien
agccacaggtccgtgtgatcgtccc

SEQ ID NO: 199285 - DNA, 25 bp, Homo sapien
gacgtctgtgatctccgctggtgtt

SEQ ID NO: 199286 - DNA, 25 bp, Homo sapien
gccggcatctggagacgtctgtgat

SEQ ID NO: 199287 - DNA, 25 bp, Homo sapien
tcggccatcatgtgcgaatgttttg

SEQ ID NO: 199288 - DNA, 25 bp, Homo sapien
ctcggcaccgtcctgtctgtgttgt

SEQ ID NO: 199289 - DNA, 25 bp, Homo sapien
gaatgttttgctccgtgctgacgcc

SEQ ID NO: 199290 - DNA, 25 bp, Homo sapien
ggacacacctgctggaactgcgcgc

SEQ ID NO: 199291 - DNA, 25 bp, Homo sapien
cgggacggtcagagctgcagccact

SEQ ID NO: 199292 - DNA, 25 bp, Homo sapien
gcatcttcaccgacaggatctgctc

SEQ ID NO: 199293 - DNA, 25 bp, Homo sapien
ggctcatgcagatcctcaccgagtg

SEQ ID NO: 199294 - DNA, 25 bp, Homo sapien
aagcatcttctcttgagccgtgggg

SEQ ID NO: 199295 - DNA, 25 bp, Homo sapien
gtcacgactacggaaaagcatcttc

SEQ ID NO: 199296 - DNA, 25 bp, Homo sapien
tcaccgagtgctcttcgggctcggc

SEQ ID NO: 199297 - DNA, 25 bp, Homo sapien
tgcagccactgaggtcacgactacg

SEQ ID NO: 199298 - DNA, 25 bp, Homo sapien
aattcatgtacttcaccgtgctgtc

SEQ ID NO: 199299 - DNA, 25 bp, Homo sapien
cacggacttggggatcttgtagaaa

SEQ ID NO: 199300 - DNA, 25 bp, Homo sapien
taccaggtcttgacgcggttctgca

SEQ ID NO: 199301 - DNA, 25 bp, Homo sapien
caccgggcaccaggcgacaggagtt

SEQ ID NO: 199302 - DNA, 25 bp, Homo sapien
gtgccaggtgtactcgtaccaggtc

SEQ ID NO: 199303 - DNA, 25 bp, Homo sapien
acccagcatgccttgcgagtgccag

SEQ ID NO: 199304 - DNA, 25 bp, Homo sapien
gggcgtgaccatcttacccagcatg

SEQ ID NO: 199305 - DNA, 25 bp, Homo sapien
gtccatgcagctgcggtagtaggtc

SEQ ID NO: 199306 - DNA, 25 bp, Homo sapien
gacgggcggacattctctcctagca

SEQ ID NO: 199307 - DNA, 25 bp, Homo sapien
tcattagcatgcctctggaaccgtc

SEQ ID NO: 199308 - DNA, 25 bp, Homo sapien
actccgcggacaaccaatgggctgc

SEQ ID NO: 199309 - DNA, 25 bp, Homo sapien
tctcctagcagaggccatgatcgta

SEQ ID NO: 199310 - DNA, 25 bp, Homo sapien
cattcgggctttgatgtctcctcca

SEQ ID NO: 199311 - DNA, 25 bp, Homo sapien
ctcggtagtttcactttacagcaca

SEQ ID NO: 199312 - DNA, 25 bp, Homo sapien
tgaatgaacacacctgagatgcctc

SEQ ID NO: 199313 - DNA, 25 bp, Homo sapien
ttccttgaaagactggggattcgcc

SEQ ID NO: 199314 - DNA, 25 bp, Homo sapien
ttgaagcccgacgtgacccagacct

SEQ ID NO: 199315 - DNA, 25 bp, Homo sapien
caggccagaagcttcgcaacaggta

SEQ ID NO: 199316 - DNA, 25 bp, Homo sapien
cgcaacaggtaccacgagggaaagc

SEQ ID NO: 199317 - DNA, 25 bp, Homo sapien
gcatcaaccgagtggactggccctg

SEQ ID NO: 199318 - DNA, 25 bp, Homo sapien
tcgaggactggtcccacttcgtgtc

SEQ ID NO: 199319 - DNA, 25 bp, Homo sapien
ttcaagctgccttgcctgaggaagc

SEQ ID NO: 199320 - DNA, 25 bp, Homo sapien
gggacctgttctccgtacacgtgtg

SEQ ID NO: 199321 - DNA, 25 bp, Homo sapien
gcaccgggccacttgtcaactgagg

SEQ ID NO: 199322 - DNA, 25 bp, Homo sapien
cgcgagctgcttcgctctggagaga

SEQ ID NO: 199323 - DNA, 25 bp, Homo sapien
agctgcttcgctctggagagatccg

SEQ ID NO: 199324 - DNA, 25 bp, Homo sapien
cgagctgcttcgctctggagagatc

SEQ ID NO: 199325 - DNA, 25 bp, Homo sapien
ggcgcgagctgcttcgctctggaga

SEQ ID NO: 199326 - DNA, 25 bp, Homo sapien
gggcgcgagctgcttcgctctggag

SEQ ID NO: 199327 - DNA, 25 bp, Homo sapien
agggcgcgagctgcttcgctctgga

SEQ ID NO: 199328 - DNA, 25 bp, Homo sapien
gagggcgcgagctgcttcgctctgg

SEQ ID NO: 199329 - DNA, 25 bp, Homo sapien
gagctgcttcgctctggagagatcc

SEQ ID NO: 199330 - DNA, 25 bp, Homo sapien
ttcggctccagctacaggtagggga

SEQ ID NO: 199331 - DNA, 25 bp, Homo sapien
cagctacaggtaggggaacggtcct

SEQ ID NO: 199332 - DNA, 25 bp, Homo sapien
aaccacgttctcatccgactgctgg

SEQ ID NO: 199333 - DNA, 25 bp, Homo sapien
tcatccgactgctggggacagcctc

SEQ ID NO: 199334 - DNA, 25 bp, Homo sapien
cgttcgcattgggtgaaggcgccct

SEQ ID NO: 199335 - DNA, 25 bp, Homo sapien
gccctggaacccttcaggagggatg

SEQ ID NO: 199336 - DNA, 25 bp, Homo sapien
caggaacactttccgaagcttcggc

SEQ ID NO: 199337 - DNA, 25 bp, Homo sapien
acactttccgaagcttcggctccag

SEQ ID NO: 199338 - DNA, 25 bp, Homo sapien
gcagctccgacgactccttgaaatg

SEQ ID NO: 199339 - DNA, 25 bp, Homo sapien
ctcggcagattggtcaaagcctttc

SEQ ID NO: 199340 - DNA, 25 bp, Homo sapien
gcgcttgtaggccttgttgcacaca

SEQ ID NO: 199341 - DNA, 25 bp, Homo sapien
gctgcaggtctgacgcgtacttgaa

SEQ ID NO: 199342 - DNA, 25 bp, Homo sapien
ttgttgagatgctcccgctgcttga

SEQ ID NO: 199343 - DNA, 25 bp, Homo sapien
tacacacttgaactgctgctcgcgg

SEQ ID NO: 199344 - DNA, 25 bp, Homo sapien
gcccttctcacataggccgcatttg

SEQ ID NO: 199345 - DNA, 25 bp, Homo sapien
acacggggcacttgaagagagtctc

SEQ ID NO: 199346 - DNA, 25 bp, Homo sapien
gagtcggtgggctgaatcttcacca

SEQ ID NO: 199347 - DNA, 25 bp, Homo sapien
tcgactaaccgaggaagggcgctct

SEQ ID NO: 199348 - DNA, 25 bp, Homo sapien
aggctctggtctgccacaattgatc

SEQ ID NO: 199349 - DNA, 25 bp, Homo sapien
ccctaactgctcagcttggctttta

SEQ ID NO: 199350 - DNA, 25 bp, Homo sapien
cgggactgtcgtgtctggtatgtct

SEQ ID NO: 199351 - DNA, 25 bp, Homo sapien
tatgaaatgggtacacgaaggctgg

SEQ ID NO: 199352 - DNA, 25 bp, Homo sapien
tgaatcttcaccactgtcctgccgg

SEQ ID NO: 199353 - DNA, 25 bp, Homo sapien
tgagggccctgagcgatatatgaaa

SEQ ID NO: 199354 - DNA, 25 bp, Homo sapien
tccagctcgttaagcttcgcgggga

SEQ ID NO: 199355 - DNA, 25 bp, Homo sapien
aagctgcttccggaatagaatgaaa

SEQ ID NO: 199356 - DNA, 25 bp, Homo sapien
ctcgttaagcttcgcggggaggtgt

SEQ ID NO: 199357 - DNA, 25 bp, Homo sapien
aatccagctcgttaagcttcgcggg

SEQ ID NO: 199358 - DNA, 25 bp, Homo sapien
atgaaatccagctcgttaagcttcg

SEQ ID NO: 199359 - DNA, 25 bp, Homo sapien
tagaatgaaatccagctcgttaagc

SEQ ID NO: 199360 - DNA, 25 bp, Homo sapien
tccggaatagaatgaaatccagctc

SEQ ID NO: 199361 - DNA, 25 bp, Homo sapien
ctgcttccggaatagaatgaaatcc

SEQ ID NO: 199362 - DNA, 25 bp, Homo sapien
gcacctcttcgcaaacccttgaggg

SEQ ID NO: 199363 - DNA, 25 bp, Homo sapien
tggcctcccgtctgggtgataccga

SEQ ID NO: 199364 - DNA, 25 bp, Homo sapien
acagccctgttctgggcactgagcc

SEQ ID NO: 199365 - DNA, 25 bp, Homo sapien
agcaagcggacttggcagtctgccc

SEQ ID NO: 199366 - DNA, 25 bp, Homo sapien
cgtcgcaagtttccaaggcgcgtgc

SEQ ID NO: 199367 - DNA, 25 bp, Homo sapien
ttctcctcgggcttgggaatttgcc

SEQ ID NO: 199368 - DNA, 25 bp, Homo sapien
gccagacaaaggctccggagttgcg

SEQ ID NO: 199369 - DNA, 25 bp, Homo sapien
agccgattcctcgagagcccggctg

SEQ ID NO: 199370 - DNA, 25 bp, Homo sapien
cggtggctttctggcccacgcctat

SEQ ID NO: 199371 - DNA, 25 bp, Homo sapien
cgtttgatggcaccggtggctttct

SEQ ID NO: 199372 - DNA, 25 bp, Homo sapien
ccctggtcttccaggaggtgcccta

SEQ ID NO: 199373 - DNA, 25 bp, Homo sapien
cagaaggaggccgacatcatggtac

SEQ ID NO: 199374 - DNA, 25 bp, Homo sapien
aggccgacatcatggtactctttgc

SEQ ID NO: 199375 - DNA, 25 bp, Homo sapien
catggtactctttgcctctggcttc

SEQ ID NO: 199376 - DNA, 25 bp, Homo sapien
gtgccctatgaggacatccggctgc

SEQ ID NO: 199377 - DNA, 25 bp, Homo sapien
cgacagctcgccgtttgatggcacc

SEQ ID NO: 199378 - DNA, 25 bp, Homo sapien
ggctgccaggagcacgtggagccag

SEQ ID NO: 199379 - DNA, 25 bp, Homo sapien
gccacgtgtcctgctttactgcaag

SEQ ID NO: 199380 - DNA, 25 bp, Homo sapien
cagcgcaagggtgcgccacgtgtcc

SEQ ID NO: 199381 - DNA, 25 bp, Homo sapien
cagatgcagcgcaagggtgcgccac

SEQ ID NO: 199382 - DNA, 25 bp, Homo sapien
acctacgcgctggtgcagatgcagc

SEQ ID NO: 199383 - DNA, 25 bp, Homo sapien
tgtcctgctttactgcaagcgctcg

SEQ ID NO: 199384 - DNA, 25 bp, Homo sapien
tgggcctcacctacgcgctggtgca

SEQ ID NO: 199385 - DNA, 25 bp, Homo sapien
gacaatgagcgcctgcggatggagc

SEQ ID NO: 199386 - DNA, 25 bp, Homo sapien
gcgggctgacccacggttttacaca

SEQ ID NO: 199387 - DNA, 25 bp, Homo sapien
cgctggcttttaacagacggtctta

SEQ ID NO: 199388 - DNA, 25 bp, Homo sapien
tccgctctccactgacacgttttta

SEQ ID NO: 199389 - DNA, 25 bp, Homo sapien
agccggtgtgtgaaaagcctgtttc

SEQ ID NO: 199390 - DNA, 25 bp, Homo sapien
gctctggcaagacgcaacgctttgg

SEQ ID NO: 199391 - DNA, 25 bp, Homo sapien
ggaccacgttctgccgctgaagact

SEQ ID NO: 199392 - DNA, 25 bp, Homo sapien
gaatgcacgttcaggccgcctttcc

SEQ ID NO: 199393 - DNA, 25 bp, Homo sapien
ctccaggcagtctcacgggaatgca

SEQ ID NO: 199394 - DNA, 25 bp, Homo sapien
ccgtcgtcccagagatgcctttgga

SEQ ID NO: 199395 - DNA, 25 bp, Homo sapien
tcctcctgaaaagagctcagttgtc

SEQ ID NO: 199396 - DNA, 25 bp, Homo sapien
ggccgcccgttgcttaaaatgaatc

SEQ ID NO: 199397 - DNA, 25 bp, Homo sapien
ctgcgagctcagaacggaaaccaca

SEQ ID NO: 199398 - DNA, 25 bp, Homo sapien
agtccgcgatcttcagctcctaagc

SEQ ID NO: 199399 - DNA, 25 bp, Homo sapien
ccgctctggaacgtgtttttgaaca

SEQ ID NO: 199400 - DNA, 25 bp, Homo sapien
ttgtcccagatttgcagaggcttgc

SEQ ID NO: 199401 - DNA, 25 bp, Homo sapien
ggcctccggatctgcagccactgat

SEQ ID NO: 199402 - DNA, 25 bp, Homo sapien
agggcccgtagccatccgtagatcc

SEQ ID NO: 199403 - DNA, 25 bp, Homo sapien
tcagcgtgcggccagctaaaacccg

SEQ ID NO: 199404 - DNA, 25 bp, Homo sapien
accagtgcaggctccatactcttgg

SEQ ID NO: 199405 - DNA, 25 bp, Homo sapien
cgcggatgcctgaagtctccacttg

SEQ ID NO: 199406 - DNA, 25 bp, Homo sapien
cccagttccttacatggtgtaccca

SEQ ID NO: 199407 - DNA, 25 bp, Homo sapien
cgtcccgcacgatgacgttacgtca

SEQ ID NO: 199408 - DNA, 25 bp, Homo sapien
ctttcgagaatcaagccagcgctcc

SEQ ID NO: 199409 - DNA, 25 bp, Homo sapien
cgtcagtggcgtaagagtaaacctg

SEQ ID NO: 199410 - DNA, 25 bp, Homo sapien
acatgtgcgagagcgggacctctgc

SEQ ID NO: 199411 - DNA, 25 bp, Homo sapien
gtgcgagagcgggacctctgcctcc

SEQ ID NO: 199412 - DNA, 25 bp, Homo sapien
tcctcagactgttcacctcggcgta

SEQ ID NO: 199413 - DNA, 25 bp, Homo sapien
tagtcccagtactcgcggctcctca

SEQ ID NO: 199414 - DNA, 25 bp, Homo sapien
gagcctcgtagtcccagtactcgcg

SEQ ID NO: 199415 - DNA, 25 bp, Homo sapien
cgtgagcctcgtagtcccagtactc

SEQ ID NO: 199416 - DNA, 25 bp, Homo sapien
ctcgggacgtgagcctcgtagtccc

SEQ ID NO: 199417 - DNA, 25 bp, Homo sapien
agactgttcacctcggcgtagaccc

SEQ ID NO: 199418 - DNA, 25 bp, Homo sapien
cgcgcttaggtgtgcgctcaaagcc

SEQ ID NO: 199419 - DNA, 25 bp, Homo sapien
gtcctctccgactcccatgaagggt

SEQ ID NO: 199420 - DNA, 25 bp, Homo sapien
actgatgatgagtccgagagcgtcc

SEQ ID NO: 199421 - DNA, 25 bp, Homo sapien
gccgcttcggcagagtgatgactga

SEQ ID NO: 199422 - DNA, 25 bp, Homo sapien
cgactcccatgaagggtcggagctg

SEQ ID NO: 199423 - DNA, 25 bp, Homo sapien
acacggcattggcaggggccgcttc

SEQ ID NO: 199424 - DNA, 25 bp, Homo sapien
tgtgcgctcaaagccagcaacctgg

SEQ ID NO: 199425 - DNA, 25 bp, Homo sapien
ctgcctgttatccagctgtgcgggc

SEQ ID NO: 199426 - DNA, 25 bp, Homo sapien
cttgatcgattgcttctgcctgggc

SEQ ID NO: 199427 - DNA, 25 bp, Homo sapien
ggcgctaacgacttctcggaaactc

SEQ ID NO: 199428 - DNA, 25 bp, Homo sapien
atcctgatgtcccacgagaagctgc

SEQ ID NO: 199429 - DNA, 25 bp, Homo sapien
ggccgccatgtcagaggcttatttc

SEQ ID NO: 199430 - DNA, 25 bp, Homo sapien
gtaccgcccgaattgactgctcctg

SEQ ID NO: 199431 - DNA, 25 bp, Homo sapien
tgtcccgctgctctaaatctgcaga

SEQ ID NO: 199432 - DNA, 25 bp, Homo sapien
cgagcgttccagcttcttcgtaacg

SEQ ID NO: 199433 - DNA, 25 bp, Homo sapien
ggctcctccgaatcacgcgagtgga

SEQ ID NO: 199434 - DNA, 25 bp, Homo sapien
aagccacgcgcgagggaccgcggtc

SEQ ID NO: 199435 - DNA, 25 bp, Homo sapien
tcgtccgcatctccgcggtgagtcg

SEQ ID NO: 199436 - DNA, 25 bp, Homo sapien
cctcctggagttcaccgggaccagg

SEQ ID NO: 199437 - DNA, 25 bp, Homo sapien
tcctggagttcaccgggaccaggtg

SEQ ID NO: 199438 - DNA, 25 bp, Homo sapien
tgcgcggccatgcaattggtggatt

SEQ ID NO: 199439 - DNA, 25 bp, Homo sapien
cggccatgcaattggtggatttttt

SEQ ID NO: 199440 - DNA, 25 bp, Homo sapien
tgtctcgtccgcatctccgcggtga

SEQ ID NO: 199441 - DNA, 25 bp, Homo sapien
agcgctcctggctgtgagctgctcc

SEQ ID NO: 199442 - DNA, 25 bp, Homo sapien
cccgacttgcgctgtccttctccgc

SEQ ID NO: 199443 - DNA, 25 bp, Homo sapien
tgctccacgacgtgaccatggccgg

SEQ ID NO: 199444 - DNA, 25 bp, Homo sapien
tgcaggagctgcgattccctgagga

SEQ ID NO: 199445 - DNA, 25 bp, Homo sapien
ctgcgattccctgaggagaagccgc

SEQ ID NO: 199446 - DNA, 25 bp, Homo sapien
ttggagtcgcgcctttgaggtctta

SEQ ID NO: 199447 - DNA, 25 bp, Homo sapien
cgcctttgaggtcttagggccgagc

SEQ ID NO: 199448 - DNA, 25 bp, Homo sapien
gccaagagggagaccgcgtgccttt

SEQ ID NO: 199449 - DNA, 25 bp, Homo sapien
gggagaccgcgtgcctttcctgcag

SEQ ID NO: 199450 - DNA, 25 bp, Homo sapien
ccggttccgcagacgataggtcacc

SEQ ID NO: 199451 - DNA, 25 bp, Homo sapien
gtttggcttcgatcaggctgaactg

SEQ ID NO: 199452 - DNA, 25 bp, Homo sapien
gctctgacgtcacccagagccaatg

SEQ ID NO: 199453 - DNA, 25 bp, Homo sapien
ctggacttcgtaggacaggtagccc

SEQ ID NO: 199454 - DNA, 25 bp, Homo sapien
atgcggctgacaggccgaaccacag

SEQ ID NO: 199455 - DNA, 25 bp, Homo sapien
ccctgaattattgatgcggctgaca

SEQ ID NO: 199456 - DNA, 25 bp, Homo sapien
cgcagcagggttcagcgaaggtcac

SEQ ID NO: 199457 - DNA, 25 bp, Homo sapien
acgcacggaggtgacgacgtcagca

SEQ ID NO: 199458 - DNA, 25 bp, Homo sapien
ggtcactgcgcgcacttatctcagg

SEQ ID NO: 199459 - DNA, 25 bp, Homo sapien
gaggaacgattccagcccgcggtaa

SEQ ID NO: 199460 - DNA, 25 bp, Homo sapien
agaccctcggcttccgatccagaaa

SEQ ID NO: 199461 - DNA, 25 bp, Homo sapien
accgtattttgttcttgcacccaga

SEQ ID NO: 199462 - DNA, 25 bp, Homo sapien
cgcgtgagtgcaattggagatcctg

SEQ ID NO: 199463 - DNA, 25 bp, Homo sapien
tggacgacaaaacaggcaccacgtg

SEQ ID NO: 199464 - DNA, 25 bp, Homo sapien
aggaaacgcgctcttagaccatggc

SEQ ID NO: 199465 - DNA, 25 bp, Homo sapien
cagggctgtacctggctcagaacca

SEQ ID NO: 199466 - DNA, 25 bp, Homo sapien
aggctcctgctagcaactaccaatc

SEQ ID NO: 199467 - DNA, 25 bp, Homo sapien
cggcctcctacttcgcggactttgg

SEQ ID NO: 199468 - DNA, 25 bp, Homo sapien
ggtgcccgcggatttaaaccaatca

SEQ ID NO: 199469 - DNA, 25 bp, Homo sapien
tggcttctacccaatcaccgacagg

SEQ ID NO: 199470 - DNA, 25 bp, Homo sapien
ggttaactccgcttgtttctctaca

SEQ ID NO: 199471 - DNA, 25 bp, Homo sapien
tcactccctagagctccgggaaacg

SEQ ID NO: 199472 - DNA, 25 bp, Homo sapien
tggcctctcatcttcagagcgcgaa

SEQ ID NO: 199473 - DNA, 25 bp, Homo sapien
cgatgcccactgcaaccatcaggga

SEQ ID NO: 199474 - DNA, 25 bp, Homo sapien
ggacgccaggatctggacccctgca

SEQ ID NO: 199475 - DNA, 25 bp, Homo sapien
tgagcatgcatcacatgacgcccgc

SEQ ID NO: 199476 - DNA, 25 bp, Homo sapien
aaagggtctgagcttttccgcggtg

SEQ ID NO: 199477 - DNA, 25 bp, Homo sapien
gacctcggggatctaacacttccac

SEQ ID NO: 199478 - DNA, 25 bp, Homo sapien
ggggattctttcccgagccggctgc

SEQ ID NO: 199479 - DNA, 25 bp, Homo sapien
ctgcggagacacgtgagcatgcatc

SEQ ID NO: 199480 - DNA, 25 bp, Homo sapien
acagacctcggggatctaacacttc

SEQ ID NO: 199481 - DNA, 25 bp, Homo sapien
gagacacgtgagcatgcatcacatg

SEQ ID NO: 199482 - DNA, 25 bp, Homo sapien
gcgagagtgtctgccgagaatcata

SEQ ID NO: 199483 - DNA, 25 bp, Homo sapien
cgcgtgttttgattcgatgtctgtc

SEQ ID NO: 199484 - DNA, 25 bp, Homo sapien
tctcgagccaccgtgcggagagtga

SEQ ID NO: 199485 - DNA, 25 bp, Homo sapien
tgaaggaagtctcgagccaccgtgc

SEQ ID NO: 199486 - DNA, 25 bp, Homo sapien
tccctgtgtatcacgggcagaaggc

SEQ ID NO: 199487 - DNA, 25 bp, Homo sapien
gaaaacaatccgaattccctgtgta

SEQ ID NO: 199488 - DNA, 25 bp, Homo sapien
tgtctgccgagaatcatacgggccc

SEQ ID NO: 199489 - DNA, 25 bp, Homo sapien
atgtctgtcccgatgctgggtttca

SEQ ID NO: 199490 - DNA, 25 bp, Homo sapien
cctgcgcggtgctgagatcagccca

SEQ ID NO: 199491 - DNA, 25 bp, Homo sapien
gacgctcttcagagcacgggtgtgt

SEQ ID NO: 199492 - DNA, 25 bp, Homo sapien
gcaggcagagccgagacgctcttca

SEQ ID NO: 199493 - DNA, 25 bp, Homo sapien
cggcctgccgagatcctgaaacgca

SEQ ID NO: 199494 - DNA, 25 bp, Homo sapien
caggcaaactgaaggacgcgaagcc

SEQ ID NO: 199495 - DNA, 25 bp, Homo sapien
cgaaacacacgcctcagaagaaagc

SEQ ID NO: 199496 - DNA, 25 bp, Homo sapien
tgtctagcatgttctgcccgaaaca

SEQ ID NO: 199497 - DNA, 25 bp, Homo sapien
tcagcccagcacgatgtctagcatg

SEQ ID NO: 199498 - DNA, 25 bp, Homo sapien
aacaggtgaacacgcaggagccggc

SEQ ID NO: 199499 - DNA, 25 bp, Homo sapien
ccagctctgcgtcccgacagaggtg

SEQ ID NO: 199500 - DNA, 25 bp, Homo sapien
cccgtgggacgttttcagatgagat

SEQ ID NO: 199501 - DNA, 25 bp, Homo sapien
cctggagagccgctaagtggtttct

SEQ ID NO: 199502 - DNA, 25 bp, Homo sapien
tttctgagccagcagagcgtggccc

SEQ ID NO: 199503 - DNA, 25 bp, Homo sapien
caggtgcactcccagaaggtcgtta

SEQ ID NO: 199504 - DNA, 25 bp, Homo sapien
agaatggccaggcttctggctcggc

SEQ ID NO: 199505 - DNA, 25 bp, Homo sapien
ccgttgctatgcactgcggctctct

SEQ ID NO: 199506 - DNA, 25 bp, Homo sapien
tgggcccgagccacgtcacagcgat

SEQ ID NO: 199507 - DNA, 25 bp, Homo sapien
cgcaaggtcaggagaatgccgcacg

SEQ ID NO: 199508 - DNA, 25 bp, Homo sapien
aatgccgcacgccaaggtcgcaggt

SEQ ID NO: 199509 - DNA, 25 bp, Homo sapien
gcaccctatcaagggcacggtcgtt

SEQ ID NO: 199510 - DNA, 25 bp, Homo sapien
ttccctagggattgcgttgcacgcc

SEQ ID NO: 199511 - DNA, 25 bp, Homo sapien
gggcacggacgctcaatcctcagtc

SEQ ID NO: 199512 - DNA, 25 bp, Homo sapien
gtttcccttggcttacctggctctg

SEQ ID NO: 199513 - DNA, 25 bp, Homo sapien
ctgctgaaggtaaggacagggactt

SEQ ID NO: 199514 - DNA, 25 bp, Homo sapien
tgagtcctttttcggtgctgcacag

SEQ ID NO: 199515 - DNA, 25 bp, Homo sapien
tctgaaggtgaacaagctccggctg

SEQ ID NO: 199516 - DNA, 25 bp, Homo sapien
ggacccttctgaattaccttgaaca

SEQ ID NO: 199517 - DNA, 25 bp, Homo sapien
tcgtccacgcccacaacagagaggt

SEQ ID NO: 199518 - DNA, 25 bp, Homo sapien
tttctccaaccgtaagcgagccgcg

SEQ ID NO: 199519 - DNA, 25 bp, Homo sapien
actgcagtagggcaaactcggtgcg

SEQ ID NO: 199520 - DNA, 25 bp, Homo sapien
ctcgtcaaccttcacggaagttttg

SEQ ID NO: 199521 - DNA, 25 bp, Homo sapien
tttgccctcgcgaaagctcgtcaac

SEQ ID NO: 199522 - DNA, 25 bp, Homo sapien
tgtccgcaacccaaagtgcagctgg

SEQ ID NO: 199523 - DNA, 25 bp, Homo sapien
cgcctgcctgccaaatgtaactgtg

SEQ ID NO: 199524 - DNA, 25 bp, Homo sapien
tggcgaatgtcaagcctccaggttc

SEQ ID NO: 199525 - DNA, 25 bp, Homo sapien
cggatatcgcgaaagacacagctta

SEQ ID NO: 199526 - DNA, 25 bp, Homo sapien
caggcaaaaccttgaggcgtacgta

SEQ ID NO: 199527 - DNA, 25 bp, Homo sapien
gcttgctactctctaggatctgttg

SEQ ID NO: 199528 - DNA, 25 bp, Homo sapien
aggtgcttcccattcaccgcacgga

SEQ ID NO: 199529 - DNA, 25 bp, Homo sapien
tcccttctggatagtcggaacatag

SEQ ID NO: 199530 - DNA, 25 bp, Homo sapien
gggcagaaggtacaagtcctgcttc

SEQ ID NO: 199531 - DNA, 25 bp, Homo sapien
cgctgatcactatgggcagaaggta

SEQ ID NO: 199532 - DNA, 25 bp, Homo sapien
gcacccgcagactttgatggtgagg

SEQ ID NO: 199533 - DNA, 25 bp, Homo sapien
cctctgcgttgcaggagagcagtgc

SEQ ID NO: 199534 - DNA, 25 bp, Homo sapien
aagtcctgcttctgccgactgaacc

SEQ ID NO: 199535 - DNA, 25 bp, Homo sapien
ccggcgttcagaatgtaggcctctg

SEQ ID NO: 199536 - DNA, 25 bp, Homo sapien
cgatcagggcgcctgtgctcaggcc

SEQ ID NO: 199537 - DNA, 25 bp, Homo sapien
gggatgccgccatcgctgatcacta

SEQ ID NO: 199538 - DNA, 25 bp, Homo sapien
gcccttgagggtggacgcaacctcc

SEQ ID NO: 199539 - DNA, 25 bp, Homo sapien
gaagagcccagtctccgttctctct

SEQ ID NO: 199540 - DNA, 25 bp, Homo sapien
cttgcaaactcttctggtggctctg

SEQ ID NO: 199541 - DNA, 25 bp, Homo sapien
aatccctcaacgttggcggctcctg

SEQ ID NO: 199542 - DNA, 25 bp, Homo sapien
atcgtccaagtgagggaagcaattg

SEQ ID NO: 199543 - DNA, 25 bp, Homo sapien
cgcgctagtggcaggaatgagaaac

SEQ ID NO: 199544 - DNA, 25 bp, Homo sapien
cccattcacaagtcagcggcggctg

SEQ ID NO: 199545 - DNA, 25 bp, Homo sapien
agtcccggtcccattcacaagtcag

SEQ ID NO: 199546 - DNA, 25 bp, Homo sapien
gcaggcggtgccactttgcagaagc

SEQ ID NO: 199547 - DNA, 25 bp, Homo sapien
cggctacgggagtcctgcacgcagc

SEQ ID NO: 199548 - DNA, 25 bp, Homo sapien
ccctggcggctacgggagtcctgca

SEQ ID NO: 199549 - DNA, 25 bp, Homo sapien
tgggtccccacgctcggcaggagac

SEQ ID NO: 199550 - DNA, 25 bp, Homo sapien
gcagcggatctcagctgggtcccca

SEQ ID NO: 199551 - DNA, 25 bp, Homo sapien
tgcagaagcgcaaactgaggccaga

SEQ ID NO: 199552 - DNA, 25 bp, Homo sapien
cggtgccactttgcagaagcgcaaa

SEQ ID NO: 199553 - DNA, 25 bp, Homo sapien
ttcctggagcagaaggttgcctgcc

SEQ ID NO: 199554 - DNA, 25 bp, Homo sapien
ccgactctgacgtggattacgactt

SEQ ID NO: 199555 - DNA, 25 bp, Homo sapien
tgggcaccgactcatccgactctga

SEQ ID NO: 199556 - DNA, 25 bp, Homo sapien
agggctccgagtccatagccgagtc

SEQ ID NO: 199557 - DNA, 25 bp, Homo sapien
acgctgcacatctacggctacgagg

SEQ ID NO: 199558 - DNA, 25 bp, Homo sapien
ccttccctctatgcgcaggtgcaga

SEQ ID NO: 199559 - DNA, 25 bp, Homo sapien
gctacgatgtgtcggtgctcaactc

SEQ ID NO: 199560 - DNA, 25 bp, Homo sapien
gatggacaccaccagctacgatgtg

SEQ ID NO: 199561 - DNA, 25 bp, Homo sapien
tccacgagcagctggtcacctacga

SEQ ID NO: 199562 - DNA, 25 bp, Homo sapien
tagagagagccagggacctagtccc

SEQ ID NO: 199563 - DNA, 25 bp, Homo sapien
gagggtcacagtgcaccacaccatc

SEQ ID NO: 199564 - DNA, 25 bp, Homo sapien
ggccgccggatctttggatttgtga

SEQ ID NO: 199565 - DNA, 25 bp, Homo sapien
agagaacctggtctggccctacaac

SEQ ID NO: 199566 - DNA, 25 bp, Homo sapien
tctggaccttgacagagaacctggt

SEQ ID NO: 199567 - DNA, 25 bp, Homo sapien
gccgggcatcctggcaatcaatgga

SEQ ID NO: 199568 - DNA, 25 bp, Homo sapien
ggcaatcaatggaccgcaggttctg

SEQ ID NO: 199569 - DNA, 25 bp, Homo sapien
ggcgcgctgtgtcaataaatgctca

SEQ ID NO: 199570 - DNA, 25 bp, Homo sapien
acacgtctgactggagcgtcggcct

SEQ ID NO: 199571 - DNA, 25 bp, Homo sapien
gcactttgctctttgcccgcgacag

SEQ ID NO: 199572 - DNA, 25 bp, Homo sapien
ggtccaacctgtctggctgtccttc

SEQ ID NO: 199573 - DNA, 25 bp, Homo sapien
tgtccttccctgacacctcgtttgt

SEQ ID NO: 199574 - DNA, 25 bp, Homo sapien
gtttgtctacccttctctgcacgtg

SEQ ID NO: 199575 - DNA, 25 bp, Homo sapien
ttctctgcacgtgtcagtggctccc

SEQ ID NO: 199576 - DNA, 25 bp, Homo sapien
gtgtcattccctacacacgcctgtg

SEQ ID NO: 199577 - DNA, 25 bp, Homo sapien
ctgtgtgtcctcttcacacgtctga

SEQ ID NO: 199578 - DNA, 25 bp, Homo sapien
ccgcatttggggaacccaagacagc

SEQ ID NO: 199579 - DNA, 25 bp, Homo sapien
tttgacccttcgacgagcaggtcgc

SEQ ID NO: 199580 - DNA, 25 bp, Homo sapien
agactttcccttgcgctgtcagagg

SEQ ID NO: 199581 - DNA, 25 bp, Homo sapien
agcagcttgccctcggtttcgggga

SEQ ID NO: 199582 - DNA, 25 bp, Homo sapien
aaaactagggcgcactctcggtcgg

SEQ ID NO: 199583 - DNA, 25 bp, Homo sapien
tcacggagtttggagtttgaaccca

SEQ ID NO: 199584 - DNA, 25 bp, Homo sapien
cctttgagctaggaagtttgaccct

SEQ ID NO: 199585 - DNA, 25 bp, Homo sapien
cccgacgagcatcaaccgcatttgg

SEQ ID NO: 199586 - DNA, 25 bp, Homo sapien
cgtgcctcttctcattggctcatga

SEQ ID NO: 199587 - DNA, 25 bp, Homo sapien
acagctctttcagtgtccttcggtc

SEQ ID NO: 199588 - DNA, 25 bp, Homo sapien
atcgaaagtggggttgttacagctc

SEQ ID NO: 199589 - DNA, 25 bp, Homo sapien
ccgtcagtgacgaagaagcccttgc

SEQ ID NO: 199590 - DNA, 25 bp, Homo sapien
ggctgagagctcttcaaccaatcga

SEQ ID NO: 199591 - DNA, 25 bp, Homo sapien
cgcggtctccaatcgcattgccaga

SEQ ID NO: 199592 - DNA, 25 bp, Homo sapien
cggggaacaccagaaagaacacttg

SEQ ID NO: 199593 - DNA, 25 bp, Homo sapien
cctcgctgcagctccaaagacgtgg

SEQ ID NO: 199594 - DNA, 25 bp, Homo sapien
ctgtccacagcaggcccacgacggc

SEQ ID NO: 199595 - DNA, 25 bp, Homo sapien
ctgccgaagccatgaaactcaggga

SEQ ID NO: 199596 - DNA, 25 bp, Homo sapien
cccgagtctgtggacaaatgtggtt

SEQ ID NO: 199597 - DNA, 25 bp, Homo sapien
cccagtcccacgttggcagctgtcc

SEQ ID NO: 199598 - DNA, 25 bp, Homo sapien
tcacactagggggactctggtcctc

SEQ ID NO: 199599 - DNA, 25 bp, Homo sapien
gagctcatcacaccgtcacactagg

SEQ ID NO: 199600 - DNA, 25 bp, Homo sapien
cagcgggtggagctcatcacaccgt

SEQ ID NO: 199601 - DNA, 25 bp, Homo sapien
aactcagggagagtggatgccaccc

SEQ ID NO: 199602 - DNA, 25 bp, Homo sapien
gaggcgtctctcaacagccatatgg

SEQ ID NO: 199603 - DNA, 25 bp, Homo sapien
ggacccaggtgttcctctaggccca

SEQ ID NO: 199604 - DNA, 25 bp, Homo sapien
acgactgctagtccagccgttgggc

SEQ ID NO: 199605 - DNA, 25 bp, Homo sapien
agcgtgtccgtcctgctctttaaag

SEQ ID NO: 199606 - DNA, 25 bp, Homo sapien
cagaatcggcttaaggcagctccca

SEQ ID NO: 199607 - DNA, 25 bp, Homo sapien
ctggcaccagagtgtgagcagaatc

SEQ ID NO: 199608 - DNA, 25 bp, Homo sapien
agccatatggcggacaccagaaccc

SEQ ID NO: 199609 - DNA, 25 bp, Homo sapien
gacccggtcgcatttcatctcagca

SEQ ID NO: 199610 - DNA, 25 bp, Homo sapien
cgcgatggataacgtgcagccgaaa

SEQ ID NO: 199611 - DNA, 25 bp, Homo sapien
agaacctactcaggcagccagctga

SEQ ID NO: 199612 - DNA, 25 bp, Homo sapien
tggcggttgctatcgcttcgcagaa

SEQ ID NO: 199613 - DNA, 25 bp, Homo sapien
atgtgctacgcgataactgaaagac

SEQ ID NO: 199614 - DNA, 25 bp, Homo sapien
gctctaggtccgctaatgtgctacg

SEQ ID NO: 199615 - DNA, 25 bp, Homo sapien
gtccgctaatatgtgcccagctcta

SEQ ID NO: 199616 - DNA, 25 bp, Homo sapien
caggccagaacacggcgggctaaca

SEQ ID NO: 199617 - DNA, 25 bp, Homo sapien
tgcttcagtgtgaaaggccacgtga

SEQ ID NO: 199618 - DNA, 25 bp, Homo sapien
cccgcgcagagcactactgtaactt

SEQ ID NO: 199619 - DNA, 25 bp, Homo sapien
gcagcgtagtgagttctgtacccaa

SEQ ID NO: 199620 - DNA, 25 bp, Homo sapien
atccgaggcaccttcagggaacttg

SEQ ID NO: 199621 - DNA, 25 bp, Homo sapien
aggccctagggacccaccatggatc

SEQ ID NO: 199622 - DNA, 25 bp, Homo sapien
ggatcctgaacacgccaaacctgag

SEQ ID NO: 199623 - DNA, 25 bp, Homo sapien
tgaatctctttactgcctggctggc

SEQ ID NO: 199624 - DNA, 25 bp, Homo sapien
tgtacccaaggcacagcgcaacatc

SEQ ID NO: 199625 - DNA, 25 bp, Homo sapien
tccgcctcagggatctttgaatctc

SEQ ID NO: 199626 - DNA, 25 bp, Homo sapien
tgcatcgatgcgtttgtggtcacca

SEQ ID NO: 199627 - DNA, 25 bp, Homo sapien
ggcgccctagcagatgcacgtgtct

SEQ ID NO: 199628 - DNA, 25 bp, Homo sapien
gtgtctgtcgaatcgctgcctccga

SEQ ID NO: 199629 - DNA, 25 bp, Homo sapien
tgcttcctctcgttgccttgtgtga

SEQ ID NO: 199630 - DNA, 25 bp, Homo sapien
ccttgtgtgaaagtcgcgttgtatt

SEQ ID NO: 199631 - DNA, 25 bp, Homo sapien
cgttgtattttcctgcgcttggcgc

SEQ ID NO: 199632 - DNA, 25 bp, Homo sapien
agttagctgagcacgccctctgagc

SEQ ID NO: 199633 - DNA, 25 bp, Homo sapien
agggctgctgcttttatcgagaaca

SEQ ID NO: 199634 - DNA, 25 bp, Homo sapien
tgcgcgagccagtgtcgcctgccct

SEQ ID NO: 199635 - DNA, 25 bp, Homo sapien
cagcggcccgaaccagggtgaagaa

SEQ ID NO: 199636 - DNA, 25 bp, Homo sapien
acttctctcgggcgcctggcgaagt

SEQ ID NO: 199637 - DNA, 25 bp, Homo sapien
cggctcctttcggaggaggacgtcg

SEQ ID NO: 199638 - DNA, 25 bp, Homo sapien
ggctttcctctgctctctcaaaggc

SEQ ID NO: 199639 - DNA, 25 bp, Homo sapien
atcgggaggtctccagcggcccgaa

SEQ ID NO: 199640 - DNA, 25 bp, Homo sapien
ccgcggtgacttcatcgccctcctc

SEQ ID NO: 199641 - DNA, 25 bp, Homo sapien
ccgctttcctgcgagcgggtagtgc

SEQ ID NO: 199642 - DNA, 25 bp, Homo sapien
agacgctgcctcaggttctcctttg

SEQ ID NO: 199643 - DNA, 25 bp, Homo sapien
gcctcaggttctcctttgaagaaag

SEQ ID NO: 199644 - DNA, 25 bp, Homo sapien
aagaaagtggggtcctcgacgcata

SEQ ID NO: 199645 - DNA, 25 bp, Homo sapien
tggagttgctttcccagacgctgcc

SEQ ID NO: 199646 - DNA, 25 bp, Homo sapien
atcatggaggtgctcgaggcctcgc

SEQ ID NO: 199647 - DNA, 25 bp, Homo sapien
gaggccatggagttgctttcccaga

SEQ ID NO: 199648 - DNA, 25 bp, Homo sapien
ggcacctaccacttgggcgaccttg

SEQ ID NO: 199649 - DNA, 25 bp, Homo sapien
cgcccgagatcatggaggtgctcga

SEQ ID NO: 199650 - DNA, 25 bp, Homo sapien
caggatgttcttgccggacggcagc

SEQ ID NO: 199651 - DNA, 25 bp, Homo sapien
cccaacgtgtcctctaggtctgcga

SEQ ID NO: 199652 - DNA, 25 bp, Homo sapien
ggcgctcaccgaagaccaggatgtt

SEQ ID NO: 199653 - DNA, 25 bp, Homo sapien
gacacttcgctcagaatggaggacc

SEQ ID NO: 199654 - DNA, 25 bp, Homo sapien
cgacaatggcaagagtggtcagccc

SEQ ID NO: 199655 - DNA, 25 bp, Homo sapien
cgttgggacctagcagcagcttctt

SEQ ID NO: 199656 - DNA, 25 bp, Homo sapien
aggacctgtggcgacaatggcaaga

SEQ ID NO: 199657 - DNA, 25 bp, Homo sapien
aactgcagccacaaagagggccctc

SEQ ID NO: 199658 - DNA, 25 bp, Homo sapien
tcgacccttctcacgtgggctaagg

SEQ ID NO: 199659 - DNA, 25 bp, Homo sapien
gggtttttacctcagacgagcatta

SEQ ID NO: 199660 - DNA, 25 bp, Homo sapien
tgcaaggtgtcttacgcttccgcgg

SEQ ID NO: 199661 - DNA, 25 bp, Homo sapien
cctgccacgacgcacgacagggttt

SEQ ID NO: 199662 - DNA, 25 bp, Homo sapien
taaggcaggacaacaacgcgcggga

SEQ ID NO: 199663 - DNA, 25 bp, Homo sapien
cagagtttccaagcgcggtaaggca

SEQ ID NO: 199664 - DNA, 25 bp, Homo sapien
cacaggcgccaacatacagagtttc

SEQ ID NO: 199665 - DNA, 25 bp, Homo sapien
ccaaaattaggggactgtgcacgcg

SEQ ID NO: 199666 - DNA, 25 bp, Homo sapien
gcctgccgcgcggaaaacagccgag

SEQ ID NO: 199667 - DNA, 25 bp, Homo sapien
ctcggctcggtgagcctcggctcac

SEQ ID NO: 199668 - DNA, 25 bp, Homo sapien
gaatgctggaaagcccgccggcccg

SEQ ID NO: 199669 - DNA, 25 bp, Homo sapien
agccgccttagctacccggctggcg

SEQ ID NO: 199670 - DNA, 25 bp, Homo sapien
tcgccgctaccgtctcctgcgcgct

SEQ ID NO: 199671 - DNA, 25 bp, Homo sapien
gccggtcgtacttctgctccttgag

SEQ ID NO: 199672 - DNA, 25 bp, Homo sapien
cccattcggaaaacgaggagcctgg

SEQ ID NO: 199673 - DNA, 25 bp, Homo sapien
ctcagctgccggtcgtacttctgct

SEQ ID NO: 199674 - DNA, 25 bp, Homo sapien
cccgctgggtatactcttcttcttc

SEQ ID NO: 199675 - DNA, 25 bp, Homo sapien
cctgtcagacattcccgcacttttg

SEQ ID NO: 199676 - DNA, 25 bp, Homo sapien
tgcactgtccgtccaggtgaatgtc

SEQ ID NO: 199677 - DNA, 25 bp, Homo sapien
cttcttcttcaccaggacgagaggg

SEQ ID NO: 199678 - DNA, 25 bp, Homo sapien
gggtacgctacaactcacacgctca

SEQ ID NO: 199679 - DNA, 25 bp, Homo sapien
acagacttggcgcaccgaagattcc

SEQ ID NO: 199680 - DNA, 25 bp, Homo sapien
ttggtgatcatcctagcctgcggta

SEQ ID NO: 199681 - DNA, 25 bp, Homo sapien
tccctgcccagacgtaagaaaagtg

SEQ ID NO: 199682 - DNA, 25 bp, Homo sapien
ggtgtctacaccgagcagggtgttt

SEQ ID NO: 199683 - DNA, 25 bp, Homo sapien
tgtgtctgggtgtctacaccgagca

SEQ ID NO: 199684 - DNA, 25 bp, Homo sapien
cgagctgccttctcggccggtacgt

SEQ ID NO: 199685 - DNA, 25 bp, Homo sapien
caggacgacggtaggcacagacctc

SEQ ID NO: 199686 - DNA, 25 bp, Homo sapien
ctacggccaggacgacggtaggcac

SEQ ID NO: 199687 - DNA, 25 bp, Homo sapien
atgaccggccaccacggctggggct

SEQ ID NO: 199688 - DNA, 25 bp, Homo sapien
cgctgctttaagaggctgctccgcg

SEQ ID NO: 199689 - DNA, 25 bp, Homo sapien
cgctcggggttcaactggctcgccg

SEQ ID NO: 199690 - DNA, 25 bp, Homo sapien
cgagagccagatgagaacccgctgc

SEQ ID NO: 199691 - DNA, 25 bp, Homo sapien
caagctcaagcacgcggcctcggtt

SEQ ID NO: 199692 - DNA, 25 bp, Homo sapien
cccatgtggcttcgtgctgtgagcc

SEQ ID NO: 199693 - DNA, 25 bp, Homo sapien
ttcgtgctgtgagccacaaacggcc

SEQ ID NO: 199694 - DNA, 25 bp, Homo sapien
cacaaacggccgtggatcccagagc

SEQ ID NO: 199695 - DNA, 25 bp, Homo sapien
agggcggactgccaagctcaagcac

SEQ ID NO: 199696 - DNA, 25 bp, Homo sapien
agcacgcggcctcggttcagggaca

SEQ ID NO: 199697 - DNA, 25 bp, Homo sapien
cgtggatcccagagccagactccgg

SEQ ID NO: 199698 - DNA, 25 bp, Homo sapien
gctgacgcagccgactctgcggtct

SEQ ID NO: 199699 - DNA, 25 bp, Homo sapien
actcgcggtttcctggagatccacc

SEQ ID NO: 199700 - DNA, 25 bp, Homo sapien
tcggccgcaaatgcgcgccgcttga

SEQ ID NO: 199701 - DNA, 25 bp, Homo sapien
actctgcggtctcctacagcatgcg

SEQ ID NO: 199702 - DNA, 25 bp, Homo sapien
gagatccaccgtctccctgggtagc

SEQ ID NO: 199703 - DNA, 25 bp, Homo sapien
ctgggtagctcaggccggtgctcca

SEQ ID NO: 199704 - DNA, 25 bp, Homo sapien
caaggccattgcctgctgacgcagc

SEQ ID NO: 199705 - DNA, 25 bp, Homo sapien
ggctcctaggcactcgcggtttcct

SEQ ID NO: 199706 - DNA, 25 bp, Homo sapien
gaacactttcagcacccaggcaggg

SEQ ID NO: 199707 - DNA, 25 bp, Homo sapien
cctctcatcctctttagccattggg

SEQ ID NO: 199708 - DNA, 25 bp, Homo sapien
gaccagctgggcctacgaccacggt

SEQ ID NO: 199709 - DNA, 25 bp, Homo sapien
ttagccattgggcaatacctctgtc

SEQ ID NO: 199710 - DNA, 25 bp, Homo sapien
tagctggcgatctcaggcacgtgac

SEQ ID NO: 199711 - DNA, 25 bp, Homo sapien
aatacctctgtccatcaagggcccg

SEQ ID NO: 199712 - DNA, 25 bp, Homo sapien
gcctccgcaattgagccaaccaggg

SEQ ID NO: 199713 - DNA, 25 bp, Homo sapien
aggcacgtgactgcctggtcctgtg

SEQ ID NO: 199714 - DNA, 25 bp, Homo sapien
ttgcagtcaaagaccaccgcgcagg

SEQ ID NO: 199715 - DNA, 25 bp, Homo sapien
gccatcttgcggctgttacgagcta

SEQ ID NO: 199716 - DNA, 25 bp, Homo sapien
ttacgagctacgatgcggcccaaga

SEQ ID NO: 199717 - DNA, 25 bp, Homo sapien
gaagcgcttcgcctttttgccaagg

SEQ ID NO: 199718 - DNA, 25 bp, Homo sapien
cgtatctggcgcacgacaccttcaa

SEQ ID NO: 199719 - DNA, 25 bp, Homo sapien
aacagcgcctggacattgtggtgca

SEQ ID NO: 199720 - DNA, 25 bp, Homo sapien
tgccgctgatgtctcaatgaacttg

SEQ ID NO: 199721 - DNA, 25 bp, Homo sapien
gatttggcgcgaaaggccatcttgc

SEQ ID NO: 199722 - DNA, 25 bp, Homo sapien
cacagacacgctcaggactaggatc

SEQ ID NO: 199723 - DNA, 25 bp, Homo sapien
ctcaggactaggatccggattagga

SEQ ID NO: 199724 - DNA, 25 bp, Homo sapien
atcaggaacccgagtggccgtgtaa

SEQ ID NO: 199725 - DNA, 25 bp, Homo sapien
gttcagggtcatcgcgtccgggacc

SEQ ID NO: 199726 - DNA, 25 bp, Homo sapien
tctggctccagagccgcctatttaa

SEQ ID NO: 199727 - DNA, 25 bp, Homo sapien
cacgcactcgtagtccggactcgga

SEQ ID NO: 199728 - DNA, 25 bp, Homo sapien
tccaccggcatgctgcggcggtgca

SEQ ID NO: 199729 - DNA, 25 bp, Homo sapien
taaacgctctcgtctgagtcgctgc

SEQ ID NO: 199730 - DNA, 25 bp, Homo sapien
atgctgtcgggaacctgctcgtcct

SEQ ID NO: 199731 - DNA, 25 bp, Homo sapien
agcagcggcggatatcgaagatctc

SEQ ID NO: 199732 - DNA, 25 bp, Homo sapien
cgaagatctcgcgtgcgtcgatgct

SEQ ID NO: 199733 - DNA, 25 bp, Homo sapien
accaccgctgatcctagcaggcgtg

SEQ ID NO: 199734 - DNA, 25 bp, Homo sapien
gctcggacccgggaacatgatggtc

SEQ ID NO: 199735 - DNA, 25 bp, Homo sapien
acgtagaggccagaaccaggtctca

SEQ ID NO: 199736 - DNA, 25 bp, Homo sapien
ggagctcccgtatccaggacggttg

SEQ ID NO: 199737 - DNA, 25 bp, Homo sapien
gcactaaaggcggtcggaggtaatc

SEQ ID NO: 199738 - DNA, 25 bp, Homo sapien
ggggacaccacggcaaggaaccagc

SEQ ID NO: 199739 - DNA, 25 bp, Homo sapien
tgggggacaccacggcaaggaacca

SEQ ID NO: 199740 - DNA, 25 bp, Homo sapien
ctgctgcttcttgtccggggccagg

SEQ ID NO: 199741 - DNA, 25 bp, Homo sapien
gcttctgctgcttcttgtccggggc

SEQ ID NO: 199742 - DNA, 25 bp, Homo sapien
cacagacttcgtgcgcggctgagcg

SEQ ID NO: 199743 - DNA, 25 bp, Homo sapien
gcacagacttcgtgcgcggctgagc

SEQ ID NO: 199744 - DNA, 25 bp, Homo sapien
ctgcacagacttcgtgcgcggctga

SEQ ID NO: 199745 - DNA, 25 bp, Homo sapien
ttctgctgcttcttgtccggggcca

SEQ ID NO: 199746 - DNA, 25 bp, Homo sapien
agggaccgggctcagatctgccaaa

SEQ ID NO: 199747 - DNA, 25 bp, Homo sapien
aaccagcggagtacaggggccccag

SEQ ID NO: 199748 - DNA, 25 bp, Homo sapien
agatctgccaaatgctgcggaggca

SEQ ID NO: 199749 - DNA, 25 bp, Homo sapien
gaaccgagaccagcgagccgaccat

SEQ ID NO: 199750 - DNA, 25 bp, Homo sapien
ccgggctcagatctgccaaatgctg

SEQ ID NO: 199751 - DNA, 25 bp, Homo sapien
aggcagaacctgacagtgcgggagg

SEQ ID NO: 199752 - DNA, 25 bp, Homo sapien
ctggtggagatgacagcgtggaact

SEQ ID NO: 199753 - DNA, 25 bp, Homo sapien
cgagccgaccatgcggctgcacaga

SEQ ID NO: 199754 - DNA, 25 bp, Homo sapien
tgggcaaggcactggatccacggct

SEQ ID NO: 199755 - DNA, 25 bp, Homo sapien
ggattctctggatcgcggaggacta

SEQ ID NO: 199756 - DNA, 25 bp, Homo sapien
gaggactacagaagccgcgcagccc

SEQ ID NO: 199757 - DNA, 25 bp, Homo sapien
tgcacagacttcacgcgcggccgag

SEQ ID NO: 199758 - DNA, 25 bp, Homo sapien
ctcctccagggtcactatgaggctc

SEQ ID NO: 199759 - DNA, 25 bp, Homo sapien
agggtcactatgaggctcccgcgga

SEQ ID NO: 199760 - DNA, 25 bp, Homo sapien
atttctccaactgtggggatcctga

SEQ ID NO: 199761 - DNA, 25 bp, Homo sapien
tggatccacggctggaccgacccgg

SEQ ID NO: 199762 - DNA, 25 bp, Homo sapien
aggactgtctgtacctgaacgtgta

SEQ ID NO: 199763 - DNA, 25 bp, Homo sapien
aatgtgaccctgttcggccagtcgg

SEQ ID NO: 199764 - DNA, 25 bp, Homo sapien
gcgggcgctccataccatctggatg

SEQ ID NO: 199765 - DNA, 25 bp, Homo sapien
ttctgcagcacaggctcggcatctt

SEQ ID NO: 199766 - DNA, 25 bp, Homo sapien
atcccggccttcttcgtccaggtga

SEQ ID NO: 199767 - DNA, 25 bp, Homo sapien
gccagctggcctcgatgtacgtcag

SEQ ID NO: 199768 - DNA, 25 bp, Homo sapien
ctgcttcttcgtacgagggctctga

SEQ ID NO: 199769 - DNA, 25 bp, Homo sapien
ctgcggaccctggattgaaacgatc

SEQ ID NO: 199770 - DNA, 25 bp, Homo sapien
tagcggcccactgtccgcagcatga

SEQ ID NO: 199771 - DNA, 25 bp, Homo sapien
tcaagtgaagatgagcagccacacc

SEQ ID NO: 199772 - DNA, 25 bp, Homo sapien
cgagcagtgagtctcagagtccttc

SEQ ID NO: 199773 - DNA, 25 bp, Homo sapien
cgctttggcaactcagggcccgagt

SEQ ID NO: 199774 - DNA, 25 bp, Homo sapien
ggtcctttaacaatgggcggcgcga

SEQ ID NO: 199775 - DNA, 25 bp, Homo sapien
cccgcgctggctttgtatgcggagc

SEQ ID NO: 199776 - DNA, 25 bp, Homo sapien
cgctgtatcgcgagacgagattggc

SEQ ID NO: 199777 - DNA, 25 bp, Homo sapien
ttgcccgacacatagtcgagcagtg

SEQ ID NO: 199778 - DNA, 25 bp, Homo sapien
aagcagcaattacccgcccaggcgg

SEQ ID NO: 199779 - DNA, 25 bp, Homo sapien
agctcatgcaggcatagtgcacaca

SEQ ID NO: 199780 - DNA, 25 bp, Homo sapien
aaagggccaattagcgcaggagacg

SEQ ID NO: 199781 - DNA, 25 bp, Homo sapien
cccactggtggttacggcagagcca

SEQ ID NO: 199782 - DNA, 25 bp, Homo sapien
ccgaggacacttctgagtcttgccc

SEQ ID NO: 199783 - DNA, 25 bp, Homo sapien
ggatcttggtgaaagcccgaggaca

SEQ ID NO: 199784 - DNA, 25 bp, Homo sapien
cgcgacaggcacgtaggcaggatac

SEQ ID NO: 199785 - DNA, 25 bp, Homo sapien
tcggtgcgcagaacagactggatct

SEQ ID NO: 199786 - DNA, 25 bp, Homo sapien
gaacgccaggcacgcttccagaacg

SEQ ID NO: 199787 - DNA, 25 bp, Homo sapien
ttggctcctgatttcgggccgtctt

SEQ ID NO: 199788 - DNA, 25 bp, Homo sapien
tctgcttgcccttatcggcgctgcg

SEQ ID NO: 199789 - DNA, 25 bp, Homo sapien
gggccgtcttgccttgcagattaag

SEQ ID NO: 199790 - DNA, 25 bp, Homo sapien
agttttttaggaagctgagccgcga

SEQ ID NO: 199791 - DNA, 25 bp, Homo sapien
cttgcagattaagtacacgggcttc

SEQ ID NO: 199792 - DNA, 25 bp, Homo sapien
tcggaaatcgtaagtcggctggccc

SEQ ID NO: 199793 - DNA, 25 bp, Homo sapien
tgcccgaccagagaagcaagttcga

SEQ ID NO: 199794 - DNA, 25 bp, Homo sapien
cttccgcctgatttttggggctgcg

SEQ ID NO: 199795 - DNA, 25 bp, Homo sapien
ccttcctgaaggtgaagtcacggcc

SEQ ID NO: 199796 - DNA, 25 bp, Homo sapien
caatcagcagccgtctcaggggtct

SEQ ID NO: 199797 - DNA, 25 bp, Homo sapien
tgcgccatcgtcagccaatcagcag

SEQ ID NO: 199798 - DNA, 25 bp, Homo sapien
ttgcaggcaaacatcctgggtctcg

SEQ ID NO: 199799 - DNA, 25 bp, Homo sapien
acagtttttgctccggtgcttccgc

SEQ ID NO: 199800 - DNA, 25 bp, Homo sapien
gccatcttcggggaacgactcagcg

SEQ ID NO: 199801 - DNA, 25 bp, Homo sapien
acgactcagcgcaggattgtaaata

SEQ ID NO: 199802 - DNA, 25 bp, Homo sapien
tagtcggagatctgcttgatgggac

SEQ ID NO: 199803 - DNA, 25 bp, Homo sapien
gcggccggcagcaactggtgtctcc

SEQ ID NO: 199804 - DNA, 25 bp, Homo sapien
atatgctcctggatgctgatggtcg

SEQ ID NO: 199805 - DNA, 25 bp, Homo sapien
agagctggtccacatcctcgtcgtc

SEQ ID NO: 199806 - DNA, 25 bp, Homo sapien
agtcgtccgactcgtagccgtcggc

SEQ ID NO: 199807 - DNA, 25 bp, Homo sapien
gaaacttactgcagtcgtccgactc

SEQ ID NO: 199808 - DNA, 25 bp, Homo sapien
gcgcgtgggaaacttactgcagtcg

SEQ ID NO: 199809 - DNA, 25 bp, Homo sapien
tggatgctgatggtcgccttctccc

SEQ ID NO: 199810 - DNA, 25 bp, Homo sapien
tgtttcttatggcacctcgatgggg

SEQ ID NO: 199811 - DNA, 25 bp, Homo sapien
gtgagtgtttcttacggcagctcca

SEQ ID NO: 199812 - DNA, 25 bp, Homo sapien
gggcgagtgtttcttacggcagctc

SEQ ID NO: 199813 - DNA, 25 bp, Homo sapien
gaatgtttcctacggcagctcgatg

SEQ ID NO: 199814 - DNA, 25 bp, Homo sapien
acgtgattgggcgagtgtttcttac

SEQ ID NO: 199815 - DNA, 25 bp, Homo sapien
tcttacggcagctcgatggggaaac

SEQ ID NO: 199816 - DNA, 25 bp, Homo sapien
gacgaatgtttcctacggcagctcg

SEQ ID NO: 199817 - DNA, 25 bp, Homo sapien
tcttatggcacctcgatggggaaac

SEQ ID NO: 199818 - DNA, 25 bp, Homo sapien
gattggacgaatgtttcctacggca

SEQ ID NO: 199819 - DNA, 25 bp, Homo sapien
gtggaaatcctctaacccgctgggc

SEQ ID NO: 199820 - DNA, 25 bp, Homo sapien
ttctcatgtgggaaagatgccggcc

SEQ ID NO: 199821 - DNA, 25 bp, Homo sapien
aaagcaggcgttttctcatgtggga

SEQ ID NO: 199822 - DNA, 25 bp, Homo sapien
agatgctcctttcctccaggtacca

SEQ ID NO: 199823 - DNA, 25 bp, Homo sapien
tgagccaggcatgtcgttccaaccc

SEQ ID NO: 199824 - DNA, 25 bp, Homo sapien
tattggacgaatgtttcctacggca

SEQ ID NO: 199825 - DNA, 25 bp, Homo sapien
cccgctccatggtctcgcgataaga

SEQ ID NO: 199826 - DNA, 25 bp, Homo sapien
caggtccatcccacggcaggtcctc

SEQ ID NO: 199827 - DNA, 25 bp, Homo sapien
atcccacggcaggtccatcccgcgg

SEQ ID NO: 199828 - DNA, 25 bp, Homo sapien
caggtccatcccacggcaggtccat

SEQ ID NO: 199829 - DNA, 25 bp, Homo sapien
gcaggtccatcccacggcaggtcct

SEQ ID NO: 199830 - DNA, 25 bp, Homo sapien
tcccacggcaggtccatcccgcggc

SEQ ID NO: 199831 - DNA, 25 bp, Homo sapien
gcaggtcctccccacggcaggtcca

SEQ ID NO: 199832 - DNA, 25 bp, Homo sapien
acggcaggtccatcccacggcaggt

SEQ ID NO: 199833 - DNA, 25 bp, Homo sapien
gcaggtccatcccacggcaggtcca

SEQ ID NO: 199834 - DNA, 25 bp, Homo sapien
gtgacaccacggtcttgccgaagtc

SEQ ID NO: 199835 - DNA, 25 bp, Homo sapien
tgtggctagacggagcccttcttca

SEQ ID NO: 199836 - DNA, 25 bp, Homo sapien
acctcctcgtcacggtcgttgagca

SEQ ID NO: 199837 - DNA, 25 bp, Homo sapien
cccaggctgaagaagatgttgttcc

SEQ ID NO: 199838 - DNA, 25 bp, Homo sapien
atctgcatcttggtctcctcgctgg

SEQ ID NO: 199839 - DNA, 25 bp, Homo sapien
gatggccatcacgttgccgtcaatg

SEQ ID NO: 199840 - DNA, 25 bp, Homo sapien
gacgggtctccaatgactgtggcta

SEQ ID NO: 199841 - DNA, 25 bp, Homo sapien
tgatgcccttgcactcgaccgagga

SEQ ID NO: 199842 - DNA, 25 bp, Homo sapien
gaggagtagggccaagggactcagg

SEQ ID NO: 199843 - DNA, 25 bp, Homo sapien
ggagtagggccaagggactcagggc

SEQ ID NO: 199844 - DNA, 25 bp, Homo sapien
gagtagggccaagggactcagggcg

SEQ ID NO: 199845 - DNA, 25 bp, Homo sapien
gtagggccaagggactcagggcgtc

SEQ ID NO: 199846 - DNA, 25 bp, Homo sapien
ggccaagggactcagggcgtccttc

SEQ ID NO: 199847 - DNA, 25 bp, Homo sapien
gccaagggactcagggcgtccttcc

SEQ ID NO: 199848 - DNA, 25 bp, Homo sapien
cagggcgtccttccccagctgagcc

SEQ ID NO: 199849 - DNA, 25 bp, Homo sapien
aggagtagggccaagggactcaggg

SEQ ID NO: 199850 - DNA, 25 bp, Homo sapien
ccgggccctggtggattgggagtcg

SEQ ID NO: 199851 - DNA, 25 bp, Homo sapien
agcaggtcatgctagggtggtctcc

SEQ ID NO: 199852 - DNA, 25 bp, Homo sapien
tcatgctagggtggtctccggccaa

SEQ ID NO: 199853 - DNA, 25 bp, Homo sapien
catgctagggtggtctccggccaag

SEQ ID NO: 199854 - DNA, 25 bp, Homo sapien
ggctgggcccgaacctgctcggagg

SEQ ID NO: 199855 - DNA, 25 bp, Homo sapien
gagccccaggccaaactttctgaag

SEQ ID NO: 199856 - DNA, 25 bp, Homo sapien
caagggagcgatgaaggtcaggcgc

SEQ ID NO: 199857 - DNA, 25 bp, Homo sapien
gggcagtgcgtgacctggagacccg

SEQ ID NO: 199858 - DNA, 25 bp, Homo sapien
gcaacccttgactcgatctccatta

SEQ ID NO: 199859 - DNA, 25 bp, Homo sapien
gcggcgacacagttcctacgattgt

SEQ ID NO: 199860 - DNA, 25 bp, Homo sapien
ggctcttaagtgtccctgggcaacc

SEQ ID NO: 199861 - DNA, 25 bp, Homo sapien
aagtgaggtcccaccctggcaagaa

SEQ ID NO: 199862 - DNA, 25 bp, Homo sapien
gggccctcactgacagcagccatga

SEQ ID NO: 199863 - DNA, 25 bp, Homo sapien
gccatgacagttgcttccggatata

SEQ ID NO: 199864 - DNA, 25 bp, Homo sapien
cggatatattgaatcgccgcggcca

SEQ ID NO: 199865 - DNA, 25 bp, Homo sapien
ggcagtctcatcctttgtcctttga

SEQ ID NO: 199866 - DNA, 25 bp, Homo sapien
gccctgcgtggcagttgaaagagtg

SEQ ID NO: 199867 - DNA, 25 bp, Homo sapien
aaagtttctacttccgctatcagga

SEQ ID NO: 199868 - DNA, 25 bp, Homo sapien
cttccgctatcaggagatctacttc

SEQ ID NO: 199869 - DNA, 25 bp, Homo sapien
gacgccatgctttcgatcactcact

SEQ ID NO: 199870 - DNA, 25 bp, Homo sapien
ggagatctacttccgggccctgcgt

SEQ ID NO: 199871 - DNA, 25 bp, Homo sapien
gatcactcacttccggtctcgaaaa

SEQ ID NO: 199872 - DNA, 25 bp, Homo sapien
attaccggctgtccgggtcctcagc

SEQ ID NO: 199873 - DNA, 25 bp, Homo sapien
tctgactactgcgtcccattaccgg

SEQ ID NO: 199874 - DNA, 25 bp, Homo sapien
taccggccttggtcatggtaacgcc

SEQ ID NO: 199875 - DNA, 25 bp, Homo sapien
cgcgggacgatactgaccagctcct

SEQ ID NO: 199876 - DNA, 25 bp, Homo sapien
atgtcgcttgtcagttcagcggccc

SEQ ID NO: 199877 - DNA, 25 bp, Homo sapien
ctcaggtccagttcgttgccgtcca

SEQ ID NO: 199878 - DNA, 25 bp, Homo sapien
cattcaggtcgctgaggctcaggtc

SEQ ID NO: 199879 - DNA, 25 bp, Homo sapien
tccttcaccgggacctcattcaggt

SEQ ID NO: 199880 - DNA, 25 bp, Homo sapien
gtcaccttccgcgaccactgagatg

SEQ ID NO: 199881 - DNA, 25 bp, Homo sapien
cgagctcggttcacgttcacccgtg

SEQ ID NO: 199882 - DNA, 25 bp, Homo sapien
aaaccagggctattcttcgagggtg

SEQ ID NO: 199883 - DNA, 25 bp, Homo sapien
cagggtgtccgcttcctcaggtact

SEQ ID NO: 199884 - DNA, 25 bp, Homo sapien
ctctctcggagttggcaggaagcca

SEQ ID NO: 199885 - DNA, 25 bp, Homo sapien
cttcggatccagaggaaaccagggc

SEQ ID NO: 199886 - DNA, 25 bp, Homo sapien
gatggtcgcgaggaagatctgtttc

SEQ ID NO: 199887 - DNA, 25 bp, Homo sapien
ttttgcgcttctaacatccaggccc

SEQ ID NO: 199888 - DNA, 25 bp, Homo sapien
agctggcatgcctcaaggacgcttc

SEQ ID NO: 199889 - DNA, 25 bp, Homo sapien
tgctgctggctctccctctaggaaa

SEQ ID NO: 199890 - DNA, 25 bp, Homo sapien
ggcttaactcgctcgcgcccagaga

SEQ ID NO: 199891 - DNA, 25 bp, Homo sapien
agcaccgggaagttgttgcgctgta

SEQ ID NO: 199892 - DNA, 25 bp, Homo sapien
ctgtaggttgagcagcttggtcttc

SEQ ID NO: 199893 - DNA, 25 bp, Homo sapien
ttggtcttctctgacaccttgggga

SEQ ID NO: 199894 - DNA, 25 bp, Homo sapien
ccaccttgtcgcagatgacgtgctg

SEQ ID NO: 199895 - DNA, 25 bp, Homo sapien
gcatcgaggccactgggcttaactc

SEQ ID NO: 199896 - DNA, 25 bp, Homo sapien
ctgcaggtgcaatgacacgaggttc

SEQ ID NO: 199897 - DNA, 25 bp, Homo sapien
ggtctgccgccctctttatacggtg

SEQ ID NO: 199898 - DNA, 25 bp, Homo sapien
atgaacccgcctgccgtgtttccgt

SEQ ID NO: 199899 - DNA, 25 bp, Homo sapien
cccaggtggcggtttgtcactctat

SEQ ID NO: 199900 - DNA, 25 bp, Homo sapien
tggccgtgaccgtggccgtccaaaa

SEQ ID NO: 199901 - DNA, 25 bp, Homo sapien
gcggcgctttacgtacacgtgagta

SEQ ID NO: 199902 - DNA, 25 bp, Homo sapien
aaagaaccgacaggaggccgcagtg

SEQ ID NO: 199903 - DNA, 25 bp, Homo sapien
aaaaggcaagcagcccgcctcgcgg

SEQ ID NO: 199904 - DNA, 25 bp, Homo sapien
ggcacaaggtgccaaaaggcaagca

SEQ ID NO: 199905 - DNA, 25 bp, Homo sapien
gtttgtcactctatgaacccgcctg

SEQ ID NO: 199906 - DNA, 25 bp, Homo sapien
aatgtcaaaggttggcgctggctgc

SEQ ID NO: 199907 - DNA, 25 bp, Homo sapien
tccgaccagattattagaggcctca

SEQ ID NO: 199908 - DNA, 25 bp, Homo sapien
cggcaccatgaagtctctaaagaag

SEQ ID NO: 199909 - DNA, 25 bp, Homo sapien
aacgtttcatggtgccgggcggcac

SEQ ID NO: 199910 - DNA, 25 bp, Homo sapien
tccgcccaagttgatcggtggatgc

SEQ ID NO: 199911 - DNA, 25 bp, Homo sapien
gccacgaaggggtttcagcacgtcc

SEQ ID NO: 199912 - DNA, 25 bp, Homo sapien
ccctcgacaggatgtggccttagtc

SEQ ID NO: 199913 - DNA, 25 bp, Homo sapien
gcccgatgaagaaggaggtttccaa

SEQ ID NO: 199914 - DNA, 25 bp, Homo sapien
tcaaggacttccagtacatcgaccg

SEQ ID NO: 199915 - DNA, 25 bp, Homo sapien
actacctgctcaagacgggctccga

SEQ ID NO: 199916 - DNA, 25 bp, Homo sapien
ggctctaacattgctggactacctg

SEQ ID NO: 199917 - DNA, 25 bp, Homo sapien
gcggcacgtgtacaaggctctaaca

SEQ ID NO: 199918 - DNA, 25 bp, Homo sapien
cggctcaatgacagcggcaagaact

SEQ ID NO: 199919 - DNA, 25 bp, Homo sapien
gttcgctcatgtccgagatcgctga

SEQ ID NO: 199920 - DNA, 25 bp, Homo sapien
tcaacgtgcgcgagaaggtcaagca

SEQ ID NO: 199921 - DNA, 25 bp, Homo sapien
cttcaccgaagtcatgggcatgctg

SEQ ID NO: 199922 - DNA, 25 bp, Homo sapien
gggtcactcaaagccactctcgttc

SEQ ID NO: 199923 - DNA, 25 bp, Homo sapien
gacctcccggtgtagggctctgaac

SEQ ID NO: 199924 - DNA, 25 bp, Homo sapien
ggcaggccgacgctaaaccagatgc

SEQ ID NO: 199925 - DNA, 25 bp, Homo sapien
actctcgttctgcaggtctcagcgc

SEQ ID NO: 199926 - DNA, 25 bp, Homo sapien
cgggtctcgaccacagcgtggatca

SEQ ID NO: 199927 - DNA, 25 bp, Homo sapien
tcgttctcagctctcaccaagtgga

SEQ ID NO: 199928 - DNA, 25 bp, Homo sapien
ctgaacgcccgcataataaagactg

SEQ ID NO: 199929 - DNA, 25 bp, Homo sapien
gcccgggagctagaaactgaacgcc

SEQ ID NO: 199930 - DNA, 25 bp, Homo sapien
acgctcggagaccagccacactgtc

SEQ ID NO: 199931 - DNA, 25 bp, Homo sapien
ccagtggagggtcttccggacaccg

SEQ ID NO: 199932 - DNA, 25 bp, Homo sapien
gcccagtggagggtcttccggacac

SEQ ID NO: 199933 - DNA, 25 bp, Homo sapien
ccctagggcactccctgcgcctgcc

SEQ ID NO: 199934 - DNA, 25 bp, Homo sapien
ggttgggccgcgtccttctgctgcc

SEQ ID NO: 199935 - DNA, 25 bp, Homo sapien
acactgtcccaagtcccggcgaaga

SEQ ID NO: 199936 - DNA, 25 bp, Homo sapien
gccgcagggcgacgctcggagacca

SEQ ID NO: 199937 - DNA, 25 bp, Homo sapien
ccttcctgtcctcagcggccgggcc

SEQ ID NO: 199938 - DNA, 25 bp, Homo sapien
atctgcatgccctcgagagtcccag

SEQ ID NO: 199939 - DNA, 25 bp, Homo sapien
gccttctggaaaggcatctgcatgc

SEQ ID NO: 199940 - DNA, 25 bp, Homo sapien
cacacggggacacgtgccttctgga

SEQ ID NO: 199941 - DNA, 25 bp, Homo sapien
gaatcaggcagcctcgctggtcggc

SEQ ID NO: 199942 - DNA, 25 bp, Homo sapien
gaacgggtcagaatcaggcagcctc

SEQ ID NO: 199943 - DNA, 25 bp, Homo sapien
ctctgcgggtgacaagaacgggtca

SEQ ID NO: 199944 - DNA, 25 bp, Homo sapien
cccgtttaagagcatgactgatggc

SEQ ID NO: 199945 - DNA, 25 bp, Homo sapien
tcgtcaagcccattttccctgggtg

SEQ ID NO: 199946 - DNA, 25 bp, Homo sapien
tgccgactgctagagcttaccctta

SEQ ID NO: 199947 - DNA, 25 bp, Homo sapien
agctccatggcctagtctcgtcaga

SEQ ID NO: 199948 - DNA, 25 bp, Homo sapien
tccgggctttttgaactctacactc

SEQ ID NO: 199949 - DNA, 25 bp, Homo sapien
gcgagttaaatagtcccggccattc

SEQ ID NO: 199950 - DNA, 25 bp, Homo sapien
ccacccagcaggcaaacggcgagtt

SEQ ID NO: 199951 - DNA, 25 bp, Homo sapien
gtcagaacttctagagggccaccca

SEQ ID NO: 199952 - DNA, 25 bp, Homo sapien
gcgggactgcccagaccttttagga

SEQ ID NO: 199953 - DNA, 25 bp, Homo sapien
cgctgcgatcagcttttcggcaata

SEQ ID NO: 199954 - DNA, 25 bp, Homo sapien
ctgcccaaatcaggggtcgtggaca

SEQ ID NO: 199955 - DNA, 25 bp, Homo sapien
ggtcagggtcgaagtctcagaattg

SEQ ID NO: 199956 - DNA, 25 bp, Homo sapien
tgactcgggagtatgaccaataagc

SEQ ID NO: 199957 - DNA, 25 bp, Homo sapien
cgcagccaagctcaactccagggtg

SEQ ID NO: 199958 - DNA, 25 bp, Homo sapien
tgattcttcgggctccctccaaggg

SEQ ID NO: 199959 - DNA, 25 bp, Homo sapien
agcagtctgattggctccagccttc

SEQ ID NO: 199960 - DNA, 25 bp, Homo sapien
tcggattccagctgtggttctctcc

SEQ ID NO: 199961 - DNA, 25 bp, Homo sapien
gcccaggagcgtcaatgtgaggtca

SEQ ID NO: 199962 - DNA, 25 bp, Homo sapien
cttgtcacgttgctgctggatacgc

SEQ ID NO: 199963 - DNA, 25 bp, Homo sapien
gcccatgctgggcaacgtcctgctg

SEQ ID NO: 199964 - DNA, 25 bp, Homo sapien
gcatccttgtcacgttgctgctgga

SEQ ID NO: 199965 - DNA, 25 bp, Homo sapien
atgcgcatccttgtcacgttgctgc

SEQ ID NO: 199966 - DNA, 25 bp, Homo sapien
ggcatgcgcatccttgtcacgttgc

SEQ ID NO: 199967 - DNA, 25 bp, Homo sapien
cacaggcatgcgcatccttgtcacg

SEQ ID NO: 199968 - DNA, 25 bp, Homo sapien
ctgccgggccgtggcagtcagccta

SEQ ID NO: 199969 - DNA, 25 bp, Homo sapien
gcaacgtcctgctgctctgcttctt

SEQ ID NO: 199970 - DNA, 25 bp, Homo sapien
attctggtgtccatggtctctgaca

SEQ ID NO: 199971 - DNA, 25 bp, Homo sapien
ggcaccaagatcctgggcatgctga

SEQ ID NO: 199972 - DNA, 25 bp, Homo sapien
tacctgcggagcagttggaacgtgc

SEQ ID NO: 199973 - DNA, 25 bp, Homo sapien
gtccatggtctctgacagcggcacc

SEQ ID NO: 199974 - DNA, 25 bp, Homo sapien
ctggacgggctgttggtgctcatct

SEQ ID NO: 199975 - DNA, 25 bp, Homo sapien
ttggtgctcatctccgtcatcgaca

SEQ ID NO: 199976 - DNA, 25 bp, Homo sapien
tccgtcatcgacattctggtgtcca

SEQ ID NO: 199977 - DNA, 25 bp, Homo sapien
tctgacagcggcaccaagatcctgg

SEQ ID NO: 199978 - DNA, 25 bp, Homo sapien
aagtccctcccagggaggcgctgtc

SEQ ID NO: 199979 - DNA, 25 bp, Homo sapien
gtccgaccgcgctcgccttccttgc

SEQ ID NO: 199980 - DNA, 25 bp, Homo sapien
gagctcggctccaagttctgggtaa

SEQ ID NO: 199981 - DNA, 25 bp, Homo sapien
tcccacgcggtgtcggggacctgcc

SEQ ID NO: 199982 - DNA, 25 bp, Homo sapien
ggcgcaaaggcacagtgcgtggctg

SEQ ID NO: 199983 - DNA, 25 bp, Homo sapien
tgggtgagtcggctccatcccagcc

SEQ ID NO: 199984 - DNA, 25 bp, Homo sapien
gaaggggcgtttcgcaatcagccgc

SEQ ID NO: 199985 - DNA, 25 bp, Homo sapien
cggctccaagttctgggtaaggcgc

SEQ ID NO: 199986 - DNA, 25 bp, Homo sapien
accgctctgaccaagtgagccggga

SEQ ID NO: 199987 - DNA, 25 bp, Homo sapien
gggctggcctcaagagagcacaatc

SEQ ID NO: 199988 - DNA, 25 bp, Homo sapien
taccagccgttgacctcattttggg

SEQ ID NO: 199989 - DNA, 25 bp, Homo sapien
accagtttctgcacctcccgaatgt

SEQ ID NO: 199990 - DNA, 25 bp, Homo sapien
tctgctctaggagggcgttcatctt

SEQ ID NO: 199991 - DNA, 25 bp, Homo sapien
gaccctgttcagtgtgacaacgctg

SEQ ID NO: 199992 - DNA, 25 bp, Homo sapien
ctgacccagatattttccgttccga

SEQ ID NO: 199993 - DNA, 25 bp, Homo sapien
catagtcgctgagaatcactgcctc

SEQ ID NO: 199994 - DNA, 25 bp, Homo sapien
gcaccatgatttcggccgcgcagtt

SEQ ID NO: 199995 - DNA, 25 bp, Homo sapien
gtcttgtcggctcctgtgtgtagga

SEQ ID NO: 199996 - DNA, 25 bp, Homo sapien
attggcgacggtgtcgcccgtgttt

SEQ ID NO: 199997 - DNA, 25 bp, Homo sapien
ccgcccgaaggaagcaccatgattt

SEQ ID NO: 199998 - DNA, 25 bp, Homo sapien
cagttgttggatgagttaatgggcc

SEQ ID NO: 199999 - DNA, 25 bp, Homo sapien
gtgggaccacgagagcgtaagtccc

SEQ ID NO: 200000 - DNA, 25 bp, Homo sapien
cacgagagcgtaagtcccgcgggcc

SEQ ID NO: 200001 - DNA, 25 bp, Homo sapien
gaacagccgcccgaaggaagcacca

SEQ ID NO: 200002 - DNA, 25 bp, Homo sapien
tcgcgccgtctctctggagccaaag

SEQ ID NO: 200003 - DNA, 25 bp, Homo sapien
cagcgcagtggcgaattcgatcttc

SEQ ID NO: 200004 - DNA, 25 bp, Homo sapien
tctggcttccatggcgcgtcttcaa

SEQ ID NO: 200005 - DNA, 25 bp, Homo sapien
acgaggaagcctccagatggagcgc

SEQ ID NO: 200006 - DNA, 25 bp, Homo sapien
tgcgtcacgaggaagcctccagatg

SEQ ID NO: 200007 - DNA, 25 bp, Homo sapien
cgtatgcgtcacgaggaagcctcca

SEQ ID NO: 200008 - DNA, 25 bp, Homo sapien
cgacggtcttcttggcggccaggct

SEQ ID NO: 200009 - DNA, 25 bp, Homo sapien
tcacacggctttcgccagtgcatcg

SEQ ID NO: 200010 - DNA, 25 bp, Homo sapien
ggccagtgccagtcctttgtctatg

SEQ ID NO: 200011 - DNA, 25 bp, Homo sapien
cccaacgtgaccgtgagcgagatgc

SEQ ID NO: 200012 - DNA, 25 bp, Homo sapien
cactctgcttcacgtggactgggca

SEQ ID NO: 200013 - DNA, 25 bp, Homo sapien
agcgactttgtcatcctgggccgag

SEQ ID NO: 200014 - DNA, 25 bp, Homo sapien
ttaccagcttctgtcgcagcgactt

SEQ ID NO: 200015 - DNA, 25 bp, Homo sapien
aagcctcggcagaagctcgttacca

SEQ ID NO: 200016 - DNA, 25 bp, Homo sapien
caacaactttgagagccgtgaggcc

SEQ ID NO: 200017 - DNA, 25 bp, Homo sapien
cccgatagctttgtgggcgcatcga

SEQ ID NO: 200018 - DNA, 25 bp, Homo sapien
gagggccaatgaaccgacgatcgga

SEQ ID NO: 200019 - DNA, 25 bp, Homo sapien
cagagagtggcagctgcagaaccca

SEQ ID NO: 200020 - DNA, 25 bp, Homo sapien
gcggcaagagtacccagaaagtgcc

SEQ ID NO: 200021 - DNA, 25 bp, Homo sapien
gtggaatagctaccaaatcggcctc

SEQ ID NO: 200022 - DNA, 25 bp, Homo sapien
agggcaaactgtgaccgggacttgt

SEQ ID NO: 200023 - DNA, 25 bp, Homo sapien
gggacttgtgcacccgattaattga

SEQ ID NO: 200024 - DNA, 25 bp, Homo sapien
caaggaggatcctgctcgtggaata

SEQ ID NO: 200025 - DNA, 25 bp, Homo sapien
taggccaaccgccacccagagagtg

SEQ ID NO: 200026 - DNA, 25 bp, Homo sapien
gaagtctatattctgggctacaggc

SEQ ID NO: 200027 - DNA, 25 bp, Homo sapien
cggccgcttatcagagccggctgtg

SEQ ID NO: 200028 - DNA, 25 bp, Homo sapien
gtcctgatgctcaactcgcctaatc

SEQ ID NO: 200029 - DNA, 25 bp, Homo sapien
gagcgctcgcatctaaaggtcttga

SEQ ID NO: 200030 - DNA, 25 bp, Homo sapien
tgggctacaggcacactaaaaacgg

SEQ ID NO: 200031 - DNA, 25 bp, Homo sapien
gccgagctaacaatagccctgctta

SEQ ID NO: 200032 - DNA, 25 bp, Homo sapien
gtcttgaacgcgttccaggtttcta

SEQ ID NO: 200033 - DNA, 25 bp, Homo sapien
ccgggcggctaatgctgttttactt

SEQ ID NO: 200034 - DNA, 25 bp, Homo sapien
gtcggacttgaactccacgcgcatg

SEQ ID NO: 200035 - DNA, 25 bp, Homo sapien
aggtgatgacctccggcgtctcaga

SEQ ID NO: 200036 - DNA, 25 bp, Homo sapien
actccacgcgcatgttgttgctctg

SEQ ID NO: 200037 - DNA, 25 bp, Homo sapien
gccgcagaacctgccgtgcagcttg

SEQ ID NO: 200038 - DNA, 25 bp, Homo sapien
agacggtgttgtcggacttgaactc

SEQ ID NO: 200039 - DNA, 25 bp, Homo sapien
tacctgagaagaagtgggccctgaa

SEQ ID NO: 200040 - DNA, 25 bp, Homo sapien
ctctgaacccgcatacctgagaaga

SEQ ID NO: 200041 - DNA, 25 bp, Homo sapien
tgttgctctgcgaggtgatgacctc

SEQ ID NO: 200042 - DNA, 25 bp, Homo sapien
tcttgataaccatggtggcgggagc

SEQ ID NO: 200043 - DNA, 25 bp, Homo sapien
cgcggtgactttccagaacgtctta

SEQ ID NO: 200044 - DNA, 25 bp, Homo sapien
acgtcttaaaggcaacgcactctga

SEQ ID NO: 200045 - DNA, 25 bp, Homo sapien
cgcactctgactcaaggcccaggga

SEQ ID NO: 200046 - DNA, 25 bp, Homo sapien
gagactggtctggttctgccatggc

SEQ ID NO: 200047 - DNA, 25 bp, Homo sapien
atttgctaaatgaccgcgcagtctg

SEQ ID NO: 200048 - DNA, 25 bp, Homo sapien
cagtctgtcatctgcggtgttcgcg

SEQ ID NO: 200049 - DNA, 25 bp, Homo sapien
gccggcaactcgtccgtcttgataa

SEQ ID NO: 200050 - DNA, 25 bp, Homo sapien
gctactcgtgtttgatggcttcccg

SEQ ID NO: 200051 - DNA, 25 bp, Homo sapien
tctgctgtcggcgttcaggtgcccg

SEQ ID NO: 200052 - DNA, 25 bp, Homo sapien
agggcagtaatcaagccggcccggc

SEQ ID NO: 200053 - DNA, 25 bp, Homo sapien
gtcgcgttacctcctgaccttaagc

SEQ ID NO: 200054 - DNA, 25 bp, Homo sapien
acctcctgaccttaagctggggcgg

SEQ ID NO: 200055 - DNA, 25 bp, Homo sapien
gggcgatccgcagcgattagcatct

SEQ ID NO: 200056 - DNA, 25 bp, Homo sapien
aagcaggatgttgacccggagcctc

SEQ ID NO: 200057 - DNA, 25 bp, Homo sapien
ccagaggtcgccgtgctctgctgtc

SEQ ID NO: 200058 - DNA, 25 bp, Homo sapien
tgcgcgaacaccgagtccaggttct

SEQ ID NO: 200059 - DNA, 25 bp, Homo sapien
gtatccatccacagcgggattcgcg

SEQ ID NO: 200060 - DNA, 25 bp, Homo sapien
ggaagccatggcgtcaacacccggc

SEQ ID NO: 200061 - DNA, 25 bp, Homo sapien
ctccagctccatggtggcaagcgga

SEQ ID NO: 200062 - DNA, 25 bp, Homo sapien
tagcgcccgataagccgctcgaact

SEQ ID NO: 200063 - DNA, 25 bp, Homo sapien
tgagctgctcgttgtcgtcccgcag

SEQ ID NO: 200064 - DNA, 25 bp, Homo sapien
ttctcccgctcgtactgggtgatga

SEQ ID NO: 200065 - DNA, 25 bp, Homo sapien
ctcgaactcgcggtagatggagccg

SEQ ID NO: 200066 - DNA, 25 bp, Homo sapien
agctagcgccggaagttaaactgca

SEQ ID NO: 200067 - DNA, 25 bp, Homo sapien
cgcctgtggacaagtgcagaccggt

SEQ ID NO: 200068 - DNA, 25 bp, Homo sapien
ggctgcagccggagttcaaacctaa

SEQ ID NO: 200069 - DNA, 25 bp, Homo sapien
tgcaagtgctgcgaaccacgtgggt

SEQ ID NO: 200070 - DNA, 25 bp, Homo sapien
cggtgttctgcaaaatgggctctcc

SEQ ID NO: 200071 - DNA, 25 bp, Homo sapien
ctgcagaaagttgttccctagaatg

SEQ ID NO: 200072 - DNA, 25 bp, Homo sapien
gccacctctcgggaagccaatttgc

SEQ ID NO: 200073 - DNA, 25 bp, Homo sapien
agaatgactgcctactcccaagagg

SEQ ID NO: 200074 - DNA, 25 bp, Homo sapien
ggagcgcaccttcatcgccatcaag

SEQ ID NO: 200075 - DNA, 25 bp, Homo sapien
tccgcgtctgctttccgagttcatt

SEQ ID NO: 200076 - DNA, 25 bp, Homo sapien
attccgcctcgtggccatgaagttc

SEQ ID NO: 200077 - DNA, 25 bp, Homo sapien
gcgagatcatcaagcgcttcgagca

SEQ ID NO: 200078 - DNA, 25 bp, Homo sapien
ggagattcccttgcagcttgcgccc

SEQ ID NO: 200079 - DNA, 25 bp, Homo sapien
tccgagttcatttcgctgccgcgaa

SEQ ID NO: 200080 - DNA, 25 bp, Homo sapien
aggaccatggccaacctggagcgca

SEQ ID NO: 200081 - DNA, 25 bp, Homo sapien
cttcgagcagaagggattccgcctc

SEQ ID NO: 200082 - DNA, 25 bp, Homo sapien
cccagtgtatagtcggggtttcttg

SEQ ID NO: 200083 - DNA, 25 bp, Homo sapien
gaagttccattcagccgtcccagtg

SEQ ID NO: 200084 - DNA, 25 bp, Homo sapien
cctttcaatatgttgcagctgcgaa

SEQ ID NO: 200085 - DNA, 25 bp, Homo sapien
cagctgcgaaattgtgttggaaaaa

SEQ ID NO: 200086 - DNA, 25 bp, Homo sapien
gaaaaattttccactccagtcacgc

SEQ ID NO: 200087 - DNA, 25 bp, Homo sapien
cgaatgaaactggaccggagaaccg

SEQ ID NO: 200088 - DNA, 25 bp, Homo sapien
agtcaagtggttacagccaagagga

SEQ ID NO: 200089 - DNA, 25 bp, Homo sapien
ggtttcttgcgctcctttcaatatg

SEQ ID NO: 200090 - DNA, 25 bp, Homo sapien
tccggggcagttcttctcctgcttc

SEQ ID NO: 200091 - DNA, 25 bp, Homo sapien
tgacacatgtccgatgcctcgctgc

SEQ ID NO: 200092 - DNA, 25 bp, Homo sapien
gtgtctcttctcttcgcaccagcgg

SEQ ID NO: 200093 - DNA, 25 bp, Homo sapien
gattattgcccgaaaccgccagccg

SEQ ID NO: 200094 - DNA, 25 bp, Homo sapien
gccgctgtcgagattttccgcaata

SEQ ID NO: 200095 - DNA, 25 bp, Homo sapien
ttccgcaatacaactgcaggggtcg

SEQ ID NO: 200096 - DNA, 25 bp, Homo sapien
cctacgcttcccaactcagagagga

SEQ ID NO: 200097 - DNA, 25 bp, Homo sapien
gcaggggtcgttatttcctcgccta

SEQ ID NO: 200098 - DNA, 25 bp, Homo sapien
gcttgccgatcttgctccttcagta

SEQ ID NO: 200099 - DNA, 25 bp, Homo sapien
cctgggtctgctgcacgaagactct

SEQ ID NO: 200100 - DNA, 25 bp, Homo sapien
tgggtctgctgcacgaagactctgg

SEQ ID NO: 200101 - DNA, 25 bp, Homo sapien
tctgctgcacgaagactctggtgtg

SEQ ID NO: 200102 - DNA, 25 bp, Homo sapien
gccgatcttgctccttcagtagcct

SEQ ID NO: 200103 - DNA, 25 bp, Homo sapien
ggcttgccgatcttgctccttcagt

SEQ ID NO: 200104 - DNA, 25 bp, Homo sapien
ttgccgatcttgctccttcagtagc

SEQ ID NO: 200105 - DNA, 25 bp, Homo sapien
ctgctgcacgaagactctggtgtgg

SEQ ID NO: 200106 - DNA, 25 bp, Homo sapien
gccctctggcgctaccatggcgttt

SEQ ID NO: 200107 - DNA, 25 bp, Homo sapien
agagtcaccgggatccctacgcgac

SEQ ID NO: 200108 - DNA, 25 bp, Homo sapien
gctaccatggcgtttggcaagagtc

SEQ ID NO: 200109 - DNA, 25 bp, Homo sapien
cgcgcccagctcctcacgctcggtg

SEQ ID NO: 200110 - DNA, 25 bp, Homo sapien
tacccgcctgtaccacctgcagccg

SEQ ID NO: 200111 - DNA, 25 bp, Homo sapien
cgcaggctccatacacccgccacta

SEQ ID NO: 200112 - DNA, 25 bp, Homo sapien
ggcgaaaagcccacctgggatccga

SEQ ID NO: 200113 - DNA, 25 bp, Homo sapien
tttggcaagagtcaccgggatccct

SEQ ID NO: 200114 - DNA, 25 bp, Homo sapien
tcgcttctcgccagaacgtctctta

SEQ ID NO: 200115 - DNA, 25 bp, Homo sapien
cggccacgtaagtgagggtcgtctt

SEQ ID NO: 200116 - DNA, 25 bp, Homo sapien
gcgtgtgaaagggttcgagctctta

SEQ ID NO: 200117 - DNA, 25 bp, Homo sapien
cactctggcctaagaaacggctcta

SEQ ID NO: 200118 - DNA, 25 bp, Homo sapien
cttgtcccgggatttgtcttgcacc

SEQ ID NO: 200119 - DNA, 25 bp, Homo sapien
gggttgcgcctgtgatctttattta

SEQ ID NO: 200120 - DNA, 25 bp, Homo sapien
ccgcgtgcaagcttgccatcacttg

SEQ ID NO: 200121 - DNA, 25 bp, Homo sapien
tcaaatctcgcgaggcgtgctccgt

SEQ ID NO: 200122 - DNA, 25 bp, Homo sapien
gtttccggctattcgagtcttgctc

SEQ ID NO: 200123 - DNA, 25 bp, Homo sapien
gcacccgctctgattcgctttggga

SEQ ID NO: 200124 - DNA, 25 bp, Homo sapien
ccatagacggtagtgcaggcttgcc

SEQ ID NO: 200125 - DNA, 25 bp, Homo sapien
ggcacctaccggctttgcaagggtc

SEQ ID NO: 200126 - DNA, 25 bp, Homo sapien
ttgcgtgcacgaaagctcagctcgg

SEQ ID NO: 200127 - DNA, 25 bp, Homo sapien
tcgccgtccagctctgagtagtctg

SEQ ID NO: 200128 - DNA, 25 bp, Homo sapien
ttcctggagggattagagcacctgc

SEQ ID NO: 200129 - DNA, 25 bp, Homo sapien
agtcttgctcattctccctcggcga

SEQ ID NO: 200130 - DNA, 25 bp, Homo sapien
gcagactgagtctccaagcgctccg

SEQ ID NO: 200131 - DNA, 25 bp, Homo sapien
acgcgcatcgcctttcagtagatca

SEQ ID NO: 200132 - DNA, 25 bp, Homo sapien
tgcctgcaagaagggaacgcgcatc

SEQ ID NO: 200133 - DNA, 25 bp, Homo sapien
ttcatgcttcctaaggcagttctgc

SEQ ID NO: 200134 - DNA, 25 bp, Homo sapien
gagctcaaatcgctgacacctggca

SEQ ID NO: 200135 - DNA, 25 bp, Homo sapien
aggatttgccggttctcctcacacc

SEQ ID NO: 200136 - DNA, 25 bp, Homo sapien
aggtcagactcctcctctcacgtga

SEQ ID NO: 200137 - DNA, 25 bp, Homo sapien
cgcatgcgcctaccgcctggaaagt

SEQ ID NO: 200138 - DNA, 25 bp, Homo sapien
gccgcctcggtgtgcttctgcagct

SEQ ID NO: 200139 - DNA, 25 bp, Homo sapien
gctcgaagctttggaaacgtcggga

SEQ ID NO: 200140 - DNA, 25 bp, Homo sapien
actctgcgtccctttccgtaggcga

SEQ ID NO: 200141 - DNA, 25 bp, Homo sapien
caccaaggattgtcggctttcccgg

SEQ ID NO: 200142 - DNA, 25 bp, Homo sapien
gacggcgagtcctctcggtagagaa

SEQ ID NO: 200143 - DNA, 25 bp, Homo sapien
agtcctctcggtagagaaggtgccc

SEQ ID NO: 200144 - DNA, 25 bp, Homo sapien
tggggcgccaatgccactctgcgtc

SEQ ID NO: 200145 - DNA, 25 bp, Homo sapien
gagggctcgaagctttggaaacgtc

SEQ ID NO: 200146 - DNA, 25 bp, Homo sapien
aggtgagagcatcctgcacgtcgcc

SEQ ID NO: 200147 - DNA, 25 bp, Homo sapien
cgtctgcactggaaacccgaaagtt

SEQ ID NO: 200148 - DNA, 25 bp, Homo sapien
accgccttgagagcgagtacttttg

SEQ ID NO: 200149 - DNA, 25 bp, Homo sapien
tgacgtcactcttgtcagggccgcg

SEQ ID NO: 200150 - DNA, 25 bp, Homo sapien
tcaggtccctgctggagaacccgct

SEQ ID NO: 200151 - DNA, 25 bp, Homo sapien
cgagcggcgacgctaaacacgcggc

SEQ ID NO: 200152 - DNA, 25 bp, Homo sapien
ttcaccacgaagacggtgagcgctg

SEQ ID NO: 200153 - DNA, 25 bp, Homo sapien
tgcatcgcgatggagaaaatgtccc

SEQ ID NO: 200154 - DNA, 25 bp, Homo sapien
ctctcaccgctggaatcgattcttg

SEQ ID NO: 200155 - DNA, 25 bp, Homo sapien
gtttccctgttgctagggccgttca

SEQ ID NO: 200156 - DNA, 25 bp, Homo sapien
attcttgaaccgcattgatcctctg

SEQ ID NO: 200157 - DNA, 25 bp, Homo sapien
gggatttgggaacccgcttctgaca

SEQ ID NO: 200158 - DNA, 25 bp, Homo sapien
gtgcgggatccacccaggatgaatc

SEQ ID NO: 200159 - DNA, 25 bp, Homo sapien
gcaggagctcccatccttggaggaa

SEQ ID NO: 200160 - DNA, 25 bp, Homo sapien
ttacgacaaatctctccgcagggcg

SEQ ID NO: 200161 - DNA, 25 bp, Homo sapien
ggccgttcacaaagcacccaaaatg

SEQ ID NO: 200162 - DNA, 25 bp, Homo sapien
cccagccaaaacgagggtccagtgg

SEQ ID NO: 200163 - DNA, 25 bp, Homo sapien
cagtggcaccttcagggtttccttc

SEQ ID NO: 200164 - DNA, 25 bp, Homo sapien
ccggttcaaggcaaagagcgccagt

SEQ ID NO: 200165 - DNA, 25 bp, Homo sapien
cttagccctgcaggaccactactga

SEQ ID NO: 200166 - DNA, 25 bp, Homo sapien
tgcagtagcgctgagtctcctctta

SEQ ID NO: 200167 - DNA, 25 bp, Homo sapien
gacttcccagtgtcagcgtcgatga

SEQ ID NO: 200168 - DNA, 25 bp, Homo sapien
atgcgcagtgaaagaaggactcctg

SEQ ID NO: 200169 - DNA, 25 bp, Homo sapien
ctcggtgacaccgaatgcgcagtga

SEQ ID NO: 200170 - DNA, 25 bp, Homo sapien
caaggtagcggccaacccgctggag

SEQ ID NO: 200171 - DNA, 25 bp, Homo sapien
gctgctggacaaggtagcggccaac

SEQ ID NO: 200172 - DNA, 25 bp, Homo sapien
aagcttctcggaggagcagttctgg

SEQ ID NO: 200173 - DNA, 25 bp, Homo sapien
ccgccggaagcttctcggaggagca

SEQ ID NO: 200174 - DNA, 25 bp, Homo sapien
actggcagctcctagtggagacctc

SEQ ID NO: 200175 - DNA, 25 bp, Homo sapien
ggagacctcgggcatcagcatctac

SEQ ID NO: 200176 - DNA, 25 bp, Homo sapien
tcgggcatcagcatctaccggctgc

SEQ ID NO: 200177 - DNA, 25 bp, Homo sapien
catctaccggctgctggacaaggta

SEQ ID NO: 200178 - DNA, 25 bp, Homo sapien
cctcagcgactctgcggagggtttc

SEQ ID NO: 200179 - DNA, 25 bp, Homo sapien
tgtcagcatttcagctccgcgcggc

SEQ ID NO: 200180 - DNA, 25 bp, Homo sapien
tctccgtggtgcagccaggccctag

SEQ ID NO: 200181 - DNA, 25 bp, Homo sapien
tggtcctgccgaagagggccgcctc

SEQ ID NO: 200182 - DNA, 25 bp, Homo sapien
tcgcctcgaggaacgccttggccat

SEQ ID NO: 200183 - DNA, 25 bp, Homo sapien
cgccttggccattttcacaggaaaa

SEQ ID NO: 200184 - DNA, 25 bp, Homo sapien
gaaagttactgtggtgcccagcgca

SEQ ID NO: 200185 - DNA, 25 bp, Homo sapien
cagcgcagtcagaggcctgtcagca

SEQ ID NO: 200186 - DNA, 25 bp, Homo sapien
ggcccaaatcccgatcactcatgtg

SEQ ID NO: 200187 - DNA, 25 bp, Homo sapien
cttgatgatcccaggggcctaactc

SEQ ID NO: 200188 - DNA, 25 bp, Homo sapien
gacccagtcgctatcgctctctgag

SEQ ID NO: 200189 - DNA, 25 bp, Homo sapien
gccatcatcgctggttgcgcatcca

SEQ ID NO: 200190 - DNA, 25 bp, Homo sapien
tgtgccgagtttctccatagcctga

SEQ ID NO: 200191 - DNA, 25 bp, Homo sapien
cgacattgcgcagcagacccttagc

SEQ ID NO: 200192 - DNA, 25 bp, Homo sapien
ctctctgagggcatttatacacagc

SEQ ID NO: 200193 - DNA, 25 bp, Homo sapien
catagcctgaccctcacggggttca

SEQ ID NO: 200194 - DNA, 25 bp, Homo sapien
atctgaacgagacgctgctgcgctc

SEQ ID NO: 200195 - DNA, 25 bp, Homo sapien
tggctgtggtcgcagacattctgcc

SEQ ID NO: 200196 - DNA, 25 bp, Homo sapien
cgccctggagtaatttcggatgccc

SEQ ID NO: 200197 - DNA, 25 bp, Homo sapien
gcggccaacttgtgtgcctttcttc

SEQ ID NO: 200198 - DNA, 25 bp, Homo sapien
ggtcaccctctacgccctggtggtg

SEQ ID NO: 200199 - DNA, 25 bp, Homo sapien
gggccactacgacccaggcttcatg

SEQ ID NO: 200200 - DNA, 25 bp, Homo sapien
caaagggctagagttctccgagggc

SEQ ID NO: 200201 - DNA, 25 bp, Homo sapien
cagcgcctaagcaagaagctgcgga

SEQ ID NO: 200202 - DNA, 25 bp, Homo sapien
cccggcgaatctatgctaattattt

SEQ ID NO: 200203 - DNA, 25 bp, Homo sapien
ctgcctccgtcagccgtgggacaga

SEQ ID NO: 200204 - DNA, 25 bp, Homo sapien
tggctcctcatttcaatagcctggc

SEQ ID NO: 200205 - DNA, 25 bp, Homo sapien
gcctcgatggctcctcatttcaata

SEQ ID NO: 200206 - DNA, 25 bp, Homo sapien
acgcagcctcgatggctcctcattt

SEQ ID NO: 200207 - DNA, 25 bp, Homo sapien
ttatttcaaacctgcgcctggtccc

SEQ ID NO: 200208 - DNA, 25 bp, Homo sapien
gctaattatttcaaacctgcgcctg

SEQ ID NO: 200209 - DNA, 25 bp, Homo sapien
cggagtcccggcgaatctatgctaa

SEQ ID NO: 200210 - DNA, 25 bp, Homo sapien
agccagaaggcagtctccttccctg

SEQ ID NO: 200211 - DNA, 25 bp, Homo sapien
aaggagaccctgtcactcgggagcg

SEQ ID NO: 200212 - DNA, 25 bp, Homo sapien
cgggagcgcacggaaatgcctcctc

SEQ ID NO: 200213 - DNA, 25 bp, Homo sapien
caggcccaaccggaaggagtcctcg

SEQ ID NO: 200214 - DNA, 25 bp, Homo sapien
cgcctcaccgtgtgttcgtgctcgt

SEQ ID NO: 200215 - DNA, 25 bp, Homo sapien
gtcgcagccctcagtagccagaagg

SEQ ID NO: 200216 - DNA, 25 bp, Homo sapien
gatgcatccatcttcctcggcgtcg

SEQ ID NO: 200217 - DNA, 25 bp, Homo sapien
cgcggtggatgaacctcaacccttc

SEQ ID NO: 200218 - DNA, 25 bp, Homo sapien
cgagcttctcggctttcagagcagg

SEQ ID NO: 200219 - DNA, 25 bp, Homo sapien
accaccggatgcacagaaccagaga

SEQ ID NO: 200220 - DNA, 25 bp, Homo sapien
cgaagagagttattcccagctgggc

SEQ ID NO: 200221 - DNA, 25 bp, Homo sapien
cgggcagccaaaactcggagagcgc

SEQ ID NO: 200222 - DNA, 25 bp, Homo sapien
ccacgttggcaatgtcattggatta

SEQ ID NO: 200223 - DNA, 25 bp, Homo sapien
ttggattacaatgcgaggtcttccc

SEQ ID NO: 200224 - DNA, 25 bp, Homo sapien
ggcgacagacagaccaccggatgca

SEQ ID NO: 200225 - DNA, 25 bp, Homo sapien
ttgcagacgtgaccggcgacagaca

SEQ ID NO: 200226 - DNA, 25 bp, Homo sapien
gggcgcctgccccaatcaggtaagc

SEQ ID NO: 200227 - DNA, 25 bp, Homo sapien
gtcgctctttgcacagagcagctct

SEQ ID NO: 200228 - DNA, 25 bp, Homo sapien
gcagtcaagtcgctctttgcacaga

SEQ ID NO: 200229 - DNA, 25 bp, Homo sapien
agtcgcagtcaagtcgctctttgca

SEQ ID NO: 200230 - DNA, 25 bp, Homo sapien
ggccagagtcgcagtcaagtcgctc

SEQ ID NO: 200231 - DNA, 25 bp, Homo sapien
tccgggcggccagagtcgcagtcaa

SEQ ID NO: 200232 - DNA, 25 bp, Homo sapien
tgcggcggagacacactgaccccta

SEQ ID NO: 200233 - DNA, 25 bp, Homo sapien
gtggccggtgctgtgtctccaccgc

SEQ ID NO: 200234 - DNA, 25 bp, Homo sapien
gaggcgtaaacacccagcaacgtga

SEQ ID NO: 200235 - DNA, 25 bp, Homo sapien
tcctcaccttcgggacctgggagtc

SEQ ID NO: 200236 - DNA, 25 bp, Homo sapien
gggctcgaggcgtaaacacccagca

SEQ ID NO: 200237 - DNA, 25 bp, Homo sapien
tggaggacaacttctgccagcagcc

SEQ ID NO: 200238 - DNA, 25 bp, Homo sapien
acacccagcaacgtgaccggaactg

SEQ ID NO: 200239 - DNA, 25 bp, Homo sapien
cgtgaccggaactggcgaacgagcc

SEQ ID NO: 200240 - DNA, 25 bp, Homo sapien
gaccagtgggctgggaatccgtccc

SEQ ID NO: 200241 - DNA, 25 bp, Homo sapien
cgatctgaccagtgggctgggaatc

SEQ ID NO: 200242 - DNA, 25 bp, Homo sapien
cgtgatggctggacgtcgccttctc

SEQ ID NO: 200243 - DNA, 25 bp, Homo sapien
atcggctagaggttcggctcaagtc

SEQ ID NO: 200244 - DNA, 25 bp, Homo sapien
cgaggaggatcctcgtggccttgcc

SEQ ID NO: 200245 - DNA, 25 bp, Homo sapien
gccggcggctttccagaattttcta

SEQ ID NO: 200246 - DNA, 25 bp, Homo sapien
ctacgattacgaagttttggcattc

SEQ ID NO: 200247 - DNA, 25 bp, Homo sapien
gcggctggagccttaagcgtttccc

SEQ ID NO: 200248 - DNA, 25 bp, Homo sapien
gaccggcgttgcctggcctgaacgc

SEQ ID NO: 200249 - DNA, 25 bp, Homo sapien
gtatgttgcgcccttccgtgggtca

SEQ ID NO: 200250 - DNA, 25 bp, Homo sapien
tgctgggaacatttgcggcgcaaca

SEQ ID NO: 200251 - DNA, 25 bp, Homo sapien
ccactctgcggatgaggaagctgac

SEQ ID NO: 200252 - DNA, 25 bp, Homo sapien
ctgacagaaggaggccatgcacacc

SEQ ID NO: 200253 - DNA, 25 bp, Homo sapien
cagcaccgtgttcttgtgcagctgc

SEQ ID NO: 200254 - DNA, 25 bp, Homo sapien
tggactgcccacgtctcattcaggc

SEQ ID NO: 200255 - DNA, 25 bp, Homo sapien
attcaggcacgacccgcagaagttg

SEQ ID NO: 200256 - DNA, 25 bp, Homo sapien
ctagctcgagaggagcagtccctga

SEQ ID NO: 200257 - DNA, 25 bp, Homo sapien
gggatttagagcatcctcgcgacca

SEQ ID NO: 200258 - DNA, 25 bp, Homo sapien
gccatcttgcttggtgctcaacgga

SEQ ID NO: 200259 - DNA, 25 bp, Homo sapien
gaggcagtcgttgtctctcacaagg

SEQ ID NO: 200260 - DNA, 25 bp, Homo sapien
actcggcatctgttcaagtcgacca

SEQ ID NO: 200261 - DNA, 25 bp, Homo sapien
aaccgtctcggaagctgccatcttg

SEQ ID NO: 200262 - DNA, 25 bp, Homo sapien
agcctttggcgtgtgccacctagtg

SEQ ID NO: 200263 - DNA, 25 bp, Homo sapien
acctggctactacaggctgcgtcta

SEQ ID NO: 200264 - DNA, 25 bp, Homo sapien
ccacctagtggtgaaacctggctac

SEQ ID NO: 200265 - DNA, 25 bp, Homo sapien
tggcggcgggtaatcaaattgaagc

SEQ ID NO: 200266 - DNA, 25 bp, Homo sapien
tgatgctgccgtgcggtacttgtca

SEQ ID NO: 200267 - DNA, 25 bp, Homo sapien
catttgcaggggtcctggtgggctt

SEQ ID NO: 200268 - DNA, 25 bp, Homo sapien
cgggtctcagcaagctgccgggtcc

SEQ ID NO: 200269 - DNA, 25 bp, Homo sapien
ggtctcagcaagctgccgggtccgc

SEQ ID NO: 200270 - DNA, 25 bp, Homo sapien
ccagcctgttgctgatgctgccgtg

SEQ ID NO: 200271 - DNA, 25 bp, Homo sapien
gccgtgcggtacttgtcatggagct

SEQ ID NO: 200272 - DNA, 25 bp, Homo sapien
ccgggtccagcctgttgctgatgct

SEQ ID NO: 200273 - DNA, 25 bp, Homo sapien
agaacggcccctgcgcatttgcagg

SEQ ID NO: 200274 - DNA, 25 bp, Homo sapien
gcccagtaaagagaacgccacaagt

SEQ ID NO: 200275 - DNA, 25 bp, Homo sapien
accgtcccgcgcctatcggattata

SEQ ID NO: 200276 - DNA, 25 bp, Homo sapien
cccaagatgtgcgtctgattttatc

SEQ ID NO: 200277 - DNA, 25 bp, Homo sapien
cccacgctagaagggatcatccagc

SEQ ID NO: 200278 - DNA, 25 bp, Homo sapien
gcagctcgtcaacggcatcatcacg

SEQ ID NO: 200279 - DNA, 25 bp, Homo sapien
ggcccgactgggatgaactgctcct

SEQ ID NO: 200280 - DNA, 25 bp, Homo sapien
acaagtaactcctgagcccgcgtgg

SEQ ID NO: 200281 - DNA, 25 bp, Homo sapien
ttccacgatggctgcatagtgcacc

SEQ ID NO: 200282 - DNA, 25 bp, Homo sapien
ctgagggaccgttcgaaccgaattg

SEQ ID NO: 200283 - DNA, 25 bp, Homo sapien
gtgatccaaccgtgtttcgggctga

SEQ ID NO: 200284 - DNA, 25 bp, Homo sapien
ggacatcggccggttgtgatccaac

SEQ ID NO: 200285 - DNA, 25 bp, Homo sapien
tgtgtacacagtctgagccggagct

SEQ ID NO: 200286 - DNA, 25 bp, Homo sapien
acttttcaaaggtcgtgtgtacaca

SEQ ID NO: 200287 - DNA, 25 bp, Homo sapien
tcaacttaaccggagcgtgcacacc

SEQ ID NO: 200288 - DNA, 25 bp, Homo sapien
cgccgcgcgtcttcagtatttaatg

SEQ ID NO: 200289 - DNA, 25 bp, Homo sapien
aatgtctctgtgttccacccgcctg

SEQ ID NO: 200290 - DNA, 25 bp, Homo sapien
gagctaagccgagcccacgtgtgac

SEQ ID NO: 200291 - DNA, 25 bp, Homo sapien
tccgccgctcgcagagagattcgga

SEQ ID NO: 200292 - DNA, 25 bp, Homo sapien
ccggcattggttacacgacgttcta

SEQ ID NO: 200293 - DNA, 25 bp, Homo sapien
cgcagcccatgtgatccagggaagt

SEQ ID NO: 200294 - DNA, 25 bp, Homo sapien
cctaaatttctgagcggtggctgga

SEQ ID NO: 200295 - DNA, 25 bp, Homo sapien
ttgctcccgacgtccttgacctaaa

SEQ ID NO: 200296 - DNA, 25 bp, Homo sapien
agagccagagagaacttccagcgca

SEQ ID NO: 200297 - DNA, 25 bp, Homo sapien
aggcaaatgggagccaaggcacctc

SEQ ID NO: 200298 - DNA, 25 bp, Homo sapien
tgggaagtttgcgacagggaacata

SEQ ID NO: 200299 - DNA, 25 bp, Homo sapien
aggagacgcgtttggccctgtagac

SEQ ID NO: 200300 - DNA, 25 bp, Homo sapien
ttggccctgtagaccatccacatcg

SEQ ID NO: 200301 - DNA, 25 bp, Homo sapien
gctgaagagaatcgcgccacaggct

SEQ ID NO: 200302 - DNA, 25 bp, Homo sapien
tgcgacagggaacatagaaaagagc

SEQ ID NO: 200303 - DNA, 25 bp, Homo sapien
ccgcacagaggacgcaaacagaagc

SEQ ID NO: 200304 - DNA, 25 bp, Homo sapien
ccacgagggcgtgtccacagagtcc

SEQ ID NO: 200305 - DNA, 25 bp, Homo sapien
ctctcgcttcagagtcggagggaca

SEQ ID NO: 200306 - DNA, 25 bp, Homo sapien
cccaggctgagcctaatgttgttta

SEQ ID NO: 200307 - DNA, 25 bp, Homo sapien
tgactagctgctaccggaaccggaa

SEQ ID NO: 200308 - DNA, 25 bp, Homo sapien
gctttactctctctcgccttgttga

SEQ ID NO: 200309 - DNA, 25 bp, Homo sapien
gcctacagtcctaggggagccaaca

SEQ ID NO: 200310 - DNA, 25 bp, Homo sapien
tccacgctaactaggatgctggctg

SEQ ID NO: 200311 - DNA, 25 bp, Homo sapien
atgctggctgcaactcgtgtttccc

SEQ ID NO: 200312 - DNA, 25 bp, Homo sapien
gggctacctcctccttggaactcga

SEQ ID NO: 200313 - DNA, 25 bp, Homo sapien
ccgagatttgaggtcaccagctcta

SEQ ID NO: 200314 - DNA, 25 bp, Homo sapien
ggccaaggatcggatgccactccca

SEQ ID NO: 200315 - DNA, 25 bp, Homo sapien
cttcgctacgcccttgtgatcttgg

SEQ ID NO: 200316 - DNA, 25 bp, Homo sapien
cccaagctcggcgttgcgagtccgg

SEQ ID NO: 200317 - DNA, 25 bp, Homo sapien
ttccaaacttggtcacgctcggcgg

SEQ ID NO: 200318 - DNA, 25 bp, Homo sapien
ccgcgcgcgtttccaaacttggtca

SEQ ID NO: 200319 - DNA, 25 bp, Homo sapien
tcgagaactcgagctggggtaccga

SEQ ID NO: 200320 - DNA, 25 bp, Homo sapien
gctcagagacccgtcgagaactcga

SEQ ID NO: 200321 - DNA, 25 bp, Homo sapien
gcccttgtgatcttggggccacgga

SEQ ID NO: 200322 - DNA, 25 bp, Homo sapien
cagcaatgggctgccaagagctccg

SEQ ID NO: 200323 - DNA, 25 bp, Homo sapien
tcgatgatgtcgtaatccatgttgg

SEQ ID NO: 200324 - DNA, 25 bp, Homo sapien
cgcgcagcacgcattcgatgatgtc

SEQ ID NO: 200325 - DNA, 25 bp, Homo sapien
tcgtccatggcctggttgaactcca

SEQ ID NO: 200326 - DNA, 25 bp, Homo sapien
cggaacaggctggtcattttgcgga

SEQ ID NO: 200327 - DNA, 25 bp, Homo sapien
tggggaacatggtcttgaagtcgtc

SEQ ID NO: 200328 - DNA, 25 bp, Homo sapien
tccgagtcggagctgtcctcataga

SEQ ID NO: 200329 - DNA, 25 bp, Homo sapien
ggaaaatgtttctagccggccgcaa

SEQ ID NO: 200330 - DNA, 25 bp, Homo sapien
gtctctccgcgcgtcagtaggactc

SEQ ID NO: 200331 - DNA, 25 bp, Homo sapien
cgtcagtaggactcggggaaccaga

SEQ ID NO: 200332 - DNA, 25 bp, Homo sapien
ggggaaccagactccgcccagtgct

SEQ ID NO: 200333 - DNA, 25 bp, Homo sapien
cggctctccaaagagatgggcgacg

SEQ ID NO: 200334 - DNA, 25 bp, Homo sapien
gaccctgtgcgagccgtcaggcttt

SEQ ID NO: 200335 - DNA, 25 bp, Homo sapien
ggcgccctttccctgcacttcacct

SEQ ID NO: 200336 - DNA, 25 bp, Homo sapien
acttcacctttcacgctcgcacggg

SEQ ID NO: 200337 - DNA, 25 bp, Homo sapien
gggtctctgcggctctccaaagaga

SEQ ID NO: 200338 - DNA, 25 bp, Homo sapien
gaaggctggaaaaatgccctccgtg

SEQ ID NO: 200339 - DNA, 25 bp, Homo sapien
cagtgaaggctggaaaaatgccctc

SEQ ID NO: 200340 - DNA, 25 bp, Homo sapien
aaatgcagctgtccctgcgcggctg

SEQ ID NO: 200341 - DNA, 25 bp, Homo sapien
ggcggcgagaaatgcagctgtccct

SEQ ID NO: 200342 - DNA, 25 bp, Homo sapien
aaagtgaggcgaggccggcttccta

SEQ ID NO: 200343 - DNA, 25 bp, Homo sapien
cgggaatcaaactcgcgacggcccg

SEQ ID NO: 200344 - DNA, 25 bp, Homo sapien
gaccaaaaaaggctgagccgacctg

SEQ ID NO: 200345 - DNA, 25 bp, Homo sapien
aaggctgagccgacctgtgacatcg

SEQ ID NO: 200346 - DNA, 25 bp, Homo sapien
ctcaacatggcagcgccgagcgcgg

SEQ ID NO: 200347 - DNA, 25 bp, Homo sapien
acaagcgaaagatggatgaagtggc

SEQ ID NO: 200348 - DNA, 25 bp, Homo sapien
ccggcacgcaatggcccagcagccc

SEQ ID NO: 200349 - DNA, 25 bp, Homo sapien
cagcccgcgctatccagcggcccgg

SEQ ID NO: 200350 - DNA, 25 bp, Homo sapien
aacgcggtccagttggcctccatgg

SEQ ID NO: 200351 - DNA, 25 bp, Homo sapien
gagcgcggccacttccggtaacctc

SEQ ID NO: 200352 - DNA, 25 bp, Homo sapien
cctggaacaggaacgcggtccagtt

SEQ ID NO: 200353 - DNA, 25 bp, Homo sapien
gtgaaaagagaacaagcgaaagatg

SEQ ID NO: 200354 - DNA, 25 bp, Homo sapien
cgcgggtcctcgaactcaacgaagg

SEQ ID NO: 200355 - DNA, 25 bp, Homo sapien
ccgttctctatgttaaggccttgga

SEQ ID NO: 200356 - DNA, 25 bp, Homo sapien
cggatagcgccgtatttgtagaaca

SEQ ID NO: 200357 - DNA, 25 bp, Homo sapien
tctttgaaagcaactcggcgccttc

SEQ ID NO: 200358 - DNA, 25 bp, Homo sapien
tagcctaaagcgttgtcccaccatg

SEQ ID NO: 200359 - DNA, 25 bp, Homo sapien
ccaccatgctctgcggcgataacgg

SEQ ID NO: 200360 - DNA, 25 bp, Homo sapien
tcgactcctgcatgggcgatacagt

SEQ ID NO: 200361 - DNA, 25 bp, Homo sapien
agctagtcatccaggtcgggtcttg

SEQ ID NO: 200362 - DNA, 25 bp, Homo sapien
ttcctgcagcgaggacgcccagtca

SEQ ID NO: 200363 - DNA, 25 bp, Homo sapien
cgcccagtcactccggcgctgttcc

SEQ ID NO: 200364 - DNA, 25 bp, Homo sapien
caccgccaccctctggggcgtcctt

SEQ ID NO: 200365 - DNA, 25 bp, Homo sapien
agtctctctgcgctgcgtggaggcc

SEQ ID NO: 200366 - DNA, 25 bp, Homo sapien
ctgtgctctgcctcgggccatcgct

SEQ ID NO: 200367 - DNA, 25 bp, Homo sapien
gcgactctacacgacccggccctcg

SEQ ID NO: 200368 - DNA, 25 bp, Homo sapien
tgtgtccgtcgcgtgcgactctaca

SEQ ID NO: 200369 - DNA, 25 bp, Homo sapien
actcgcctccgtgaaggtgagcggt

SEQ ID NO: 200370 - DNA, 25 bp, Homo sapien
ccctgagaaaacacaagaccaatcc

SEQ ID NO: 200371 - DNA, 25 bp, Homo sapien
gcaggaaccctgctgataattcgcc

SEQ ID NO: 200372 - DNA, 25 bp, Homo sapien
aaggcatggcttctgttttcgtcca

SEQ ID NO: 200373 - DNA, 25 bp, Homo sapien
aaactccctaagacggagcggcgtg

SEQ ID NO: 200374 - DNA, 25 bp, Homo sapien
gatgcgctcgtgtcggacaagaagc

SEQ ID NO: 200375 - DNA, 25 bp, Homo sapien
cctgccctacagtgtggatgcgctc

SEQ ID NO: 200376 - DNA, 25 bp, Homo sapien
gttttcgtccaatgagaaggggcca

SEQ ID NO: 200377 - DNA, 25 bp, Homo sapien
aagaccaatccgaagccgcgcacag

SEQ ID NO: 200378 - DNA, 25 bp, Homo sapien
caaccggaccaactacctggggctg

SEQ ID NO: 200379 - DNA, 25 bp, Homo sapien
gctccgcaaccggaccaactacctg

SEQ ID NO: 200380 - DNA, 25 bp, Homo sapien
catggtgtatggcagtgaggtctcc

SEQ ID NO: 200381 - DNA, 25 bp, Homo sapien
atggtgtatggcagtgaggtctccc

SEQ ID NO: 200382 - DNA, 25 bp, Homo sapien
tggtgtatggcagtgaggtctccct

SEQ ID NO: 200383 - DNA, 25 bp, Homo sapien
gtgtatggcagtgaggtctccctct

SEQ ID NO: 200384 - DNA, 25 bp, Homo sapien
tgtatggcagtgaggtctccctctc

SEQ ID NO: 200385 - DNA, 25 bp, Homo sapien
gtatggcagtgaggtctccctctcg

SEQ ID NO: 200386 - DNA, 25 bp, Homo sapien
caaaagcaaagaacccggatgtgcc

SEQ ID NO: 200387 - DNA, 25 bp, Homo sapien
cgaccaaaagcaaagaacccggatg

SEQ ID NO: 200388 - DNA, 25 bp, Homo sapien
aaagaacccggatgtgccccagcct

SEQ ID NO: 200389 - DNA, 25 bp, Homo sapien
cgttccaactagcagttcccacaga

SEQ ID NO: 200390 - DNA, 25 bp, Homo sapien
actagcagttcccacagagacgcgg

SEQ ID NO: 200391 - DNA, 25 bp, Homo sapien
cagttcccacagagacgcggggcac

SEQ ID NO: 200392 - DNA, 25 bp, Homo sapien
atgcggggcacggagacgtcccaca

SEQ ID NO: 200393 - DNA, 25 bp, Homo sapien
cggagatgtccccacagagacgcgg

SEQ ID NO: 200394 - DNA, 25 bp, Homo sapien
agaaacagctcatgaggctacggaa

SEQ ID NO: 200395 - DNA, 25 bp, Homo sapien
gaaacagctcatgaggctacggaaa

SEQ ID NO: 200396 - DNA, 25 bp, Homo sapien
aacagctcatgaggctacggaaaca

SEQ ID NO: 200397 - DNA, 25 bp, Homo sapien
cagctcatgaggctacggaaacagg

SEQ ID NO: 200398 - DNA, 25 bp, Homo sapien
aaatacacagaggtcctcaagaccc

SEQ ID NO: 200399 - DNA, 25 bp, Homo sapien
atacacagaggtcctcaagacccac

SEQ ID NO: 200400 - DNA, 25 bp, Homo sapien
aagaaacagctcatgaggctacgga

SEQ ID NO: 200401 - DNA, 25 bp, Homo sapien
agaagaaacagctcatgaggctacg

SEQ ID NO: 200402 - DNA, 25 bp, Homo sapien
agctcaccgaaagcgggacctcgtg

SEQ ID NO: 200403 - DNA, 25 bp, Homo sapien
taccgatcaccgcttaccatgtatg

SEQ ID NO: 200404 - DNA, 25 bp, Homo sapien
cagttggccacacagtgcaagtgca

SEQ ID NO: 200405 - DNA, 25 bp, Homo sapien
ttttcctggcaacggagacgctgga

SEQ ID NO: 200406 - DNA, 25 bp, Homo sapien
gaaagcgcgccgctctgttttcctg

SEQ ID NO: 200407 - DNA, 25 bp, Homo sapien
gtgctccagacggtctccgccatga

SEQ ID NO: 200408 - DNA, 25 bp, Homo sapien
tgcgactaccggaggcgcaagttgc

SEQ ID NO: 200409 - DNA, 25 bp, Homo sapien
ccatgtatgcgataaaagctcaccg

SEQ ID NO: 200410 - DNA, 25 bp, Homo sapien
ggggacgggatgcactacccaaaca

SEQ ID NO: 200411 - DNA, 25 bp, Homo sapien
gtgtctctggaagcggcacctttcc

SEQ ID NO: 200412 - DNA, 25 bp, Homo sapien
tacccaaacacgcagtgaaaggagg

SEQ ID NO: 200413 - DNA, 25 bp, Homo sapien
tgcgcgatggagatctgcacagacc

SEQ ID NO: 200414 - DNA, 25 bp, Homo sapien
ggaagacgcgcaacggcttccctct

SEQ ID NO: 200415 - DNA, 25 bp, Homo sapien
atcgtgctggtttcaggaggaagcc

SEQ ID NO: 200416 - DNA, 25 bp, Homo sapien
acgtggcggtcacgttctggccgcc

SEQ ID NO: 200417 - DNA, 25 bp, Homo sapien
ccgaagctcagcgaggatcgtgctg

SEQ ID NO: 200418 - DNA, 25 bp, Homo sapien
aacgggatgcagtcggcttggttct

SEQ ID NO: 200419 - DNA, 25 bp, Homo sapien
caggagcggaagaacgggatgcagt

SEQ ID NO: 200420 - DNA, 25 bp, Homo sapien
atggtgatgttgctcccggggcaag

SEQ ID NO: 200421 - DNA, 25 bp, Homo sapien
cccagctggttggacatgttgcgca

SEQ ID NO: 200422 - DNA, 25 bp, Homo sapien
ctggttgcggatggtgatgttgctc

SEQ ID NO: 200423 - DNA, 25 bp, Homo sapien
ctcctcgctgccgtacaccatgctg

SEQ ID NO: 200424 - DNA, 25 bp, Homo sapien
gttggacatgttgcgcaggttcctg

SEQ ID NO: 200425 - DNA, 25 bp, Homo sapien
tgcagtcggcttggttcttgatgcg

SEQ ID NO: 200426 - DNA, 25 bp, Homo sapien
atttgtcctgctccgggcaagtcac

SEQ ID NO: 200427 - DNA, 25 bp, Homo sapien
gcgcagccgcttgacttggacaaca

SEQ ID NO: 200428 - DNA, 25 bp, Homo sapien
agccagccgcacctgttgttgcaca

SEQ ID NO: 200429 - DNA, 25 bp, Homo sapien
cacgatctcgttggagaccgcgcga

SEQ ID NO: 200430 - DNA, 25 bp, Homo sapien
ctcctggtccggagtcagctgatca

SEQ ID NO: 200431 - DNA, 25 bp, Homo sapien
ttgcatgaacatgagtgagcgctcc

SEQ ID NO: 200432 - DNA, 25 bp, Homo sapien
gtctcgcagttgacgccagtgacga

SEQ ID NO: 200433 - DNA, 25 bp, Homo sapien
ttggacaacacattcagctgggcgg

SEQ ID NO: 200434 - DNA, 25 bp, Homo sapien
tccacctatagggtgtgtgtgcgtg

SEQ ID NO: 200435 - DNA, 25 bp, Homo sapien
gtttgcagacagacatcggcacgta

SEQ ID NO: 200436 - DNA, 25 bp, Homo sapien
tactgcgttccggaggagccatccg

SEQ ID NO: 200437 - DNA, 25 bp, Homo sapien
agccatccggcgtcacaggctgtgc

SEQ ID NO: 200438 - DNA, 25 bp, Homo sapien
gctgcacacacgtccacctataggg

SEQ ID NO: 200439 - DNA, 25 bp, Homo sapien
attccgcagccagcctggatcggga

SEQ ID NO: 200440 - DNA, 25 bp, Homo sapien
ccagggagctcaggacccgctgtac

SEQ ID NO: 200441 - DNA, 25 bp, Homo sapien
agacatcggcacgtatggacggcgc

SEQ ID NO: 200442 - DNA, 25 bp, Homo sapien
gcagcagccgatcgaagtcccgcac

SEQ ID NO: 200443 - DNA, 25 bp, Homo sapien
ggccgtaccactggcagcgcggcag

SEQ ID NO: 200444 - DNA, 25 bp, Homo sapien
tgcccaggacgggaaagctccccag

SEQ ID NO: 200445 - DNA, 25 bp, Homo sapien
cacaccaccactgagtccttggggt

SEQ ID NO: 200446 - DNA, 25 bp, Homo sapien
caccactgagtccttggggttctga

SEQ ID NO: 200447 - DNA, 25 bp, Homo sapien
acacctgcccttgcgccggcgctca

SEQ ID NO: 200448 - DNA, 25 bp, Homo sapien
ttgcgcagcgcgatctgcctctgca

SEQ ID NO: 200449 - DNA, 25 bp, Homo sapien
agcgtctcccgctggttgcgcagcg

SEQ ID NO: 200450 - DNA, 25 bp, Homo sapien
acttccggcgcttagacttcctctt

SEQ ID NO: 200451 - DNA, 25 bp, Homo sapien
aatagctcgttacccagaatgccca

SEQ ID NO: 200452 - DNA, 25 bp, Homo sapien
tgcacccgcaggaagtaaatagctc

SEQ ID NO: 200453 - DNA, 25 bp, Homo sapien
ggagatagacgaccacagcctgtgc

SEQ ID NO: 200454 - DNA, 25 bp, Homo sapien
cgatgggaagaacaacagggagata

SEQ ID NO: 200455 - DNA, 25 bp, Homo sapien
tagacttcctcttccggtgtgggcg

SEQ ID NO: 200456 - DNA, 25 bp, Homo sapien
cgcagatgccgcaggtccttcggca

SEQ ID NO: 200457 - DNA, 25 bp, Homo sapien
gtctccagggccatcttcgccgatg

SEQ ID NO: 200458 - DNA, 25 bp, Homo sapien
aatggggcctcgagttcccgccacg

SEQ ID NO: 200459 - DNA, 25 bp, Homo sapien
ctttccgacgcccatagcgtgagga

SEQ ID NO: 200460 - DNA, 25 bp, Homo sapien
cccatagcgtgaggacgtgcgaaaa

SEQ ID NO: 200461 - DNA, 25 bp, Homo sapien
gacgtgcgaaaatgcgccctccagc

SEQ ID NO: 200462 - DNA, 25 bp, Homo sapien
ccaccttgcggaagccgtagaggtt

SEQ ID NO: 200463 - DNA, 25 bp, Homo sapien
cggcctcgaagagcggctgatcgat

SEQ ID NO: 200464 - DNA, 25 bp, Homo sapien
gaccgccagtctcgggaagcacagc

SEQ ID NO: 200465 - DNA, 25 bp, Homo sapien
ggctgttcaccaggcgccacagctt

SEQ ID NO: 200466 - DNA, 25 bp, Homo sapien
ccctcccgcacgagtgcagaaggga

SEQ ID NO: 200467 - DNA, 25 bp, Homo sapien
tctccacaatggagcgggcccagct

SEQ ID NO: 200468 - DNA, 25 bp, Homo sapien
gcggtctgggccagcgcacatgtcc

SEQ ID NO: 200469 - DNA, 25 bp, Homo sapien
tcaggctcatggtcgcgggcggtct

SEQ ID NO: 200470 - DNA, 25 bp, Homo sapien
cgaagcagctaagcatggagcagga

SEQ ID NO: 200471 - DNA, 25 bp, Homo sapien
ggcacttacgaagcagctaagcatg

SEQ ID NO: 200472 - DNA, 25 bp, Homo sapien
atgggctgaaatcgagggctgaccc

SEQ ID NO: 200473 - DNA, 25 bp, Homo sapien
gggtgggcacttacgaagcagctaa

SEQ ID NO: 200474 - DNA, 25 bp, Homo sapien
gaaccaatcatatctctagcctgta

SEQ ID NO: 200475 - DNA, 25 bp, Homo sapien
ccactcattggtcgagtcgggcaaa

SEQ ID NO: 200476 - DNA, 25 bp, Homo sapien
cagcctttagccaatcggatgccta

SEQ ID NO: 200477 - DNA, 25 bp, Homo sapien
tgcctaaagacgagactatacctgg

SEQ ID NO: 200478 - DNA, 25 bp, Homo sapien
gggagacgcgaccaatgggaaatca

SEQ ID NO: 200479 - DNA, 25 bp, Homo sapien
acagcgcgtccttgcggcagccaat

SEQ ID NO: 200480 - DNA, 25 bp, Homo sapien
tcgtcgcctactggtagcgcaatta

SEQ ID NO: 200481 - DNA, 25 bp, Homo sapien
ttgcggttcccaggcttgcagtgca

SEQ ID NO: 200482 - DNA, 25 bp, Homo sapien
acgtggtcaccaagccgcaaaagcc

SEQ ID NO: 200483 - DNA, 25 bp, Homo sapien
agccaggcgtaagcgaacagcttcc

SEQ ID NO: 200484 - DNA, 25 bp, Homo sapien
cccgacacatttgatgcatacgtaa

SEQ ID NO: 200485 - DNA, 25 bp, Homo sapien
tcaccgtgctgcatgctaattaagc

SEQ ID NO: 200486 - DNA, 25 bp, Homo sapien
taagcatcattcctacgtcgttttc

SEQ ID NO: 200487 - DNA, 25 bp, Homo sapien
ttggaacgatggttgcacagccacc

SEQ ID NO: 200488 - DNA, 25 bp, Homo sapien
cagcttccagcgtcttaatcagaga

SEQ ID NO: 200489 - DNA, 25 bp, Homo sapien
tgcatacgtaattgtcaccgtgctg

SEQ ID NO: 200490 - DNA, 25 bp, Homo sapien
ccttcgtcctagagcgcaggcatca

SEQ ID NO: 200491 - DNA, 25 bp, Homo sapien
ggttggcgcccactccgtggctgct

SEQ ID NO: 200492 - DNA, 25 bp, Homo sapien
tcagagggaaaaacttgggagcagc

SEQ ID NO: 200493 - DNA, 25 bp, Homo sapien
aaaacttgggagcagcgacgcaccg

SEQ ID NO: 200494 - DNA, 25 bp, Homo sapien
gacctcgcagcaccgccgtcaccct

SEQ ID NO: 200495 - DNA, 25 bp, Homo sapien
cggggcctgtacctcagctgctagc

SEQ ID NO: 200496 - DNA, 25 bp, Homo sapien
tgtacctcagctgctagcggtgccg

SEQ ID NO: 200497 - DNA, 25 bp, Homo sapien
ccgtggctgctcagagggaaaaact

SEQ ID NO: 200498 - DNA, 25 bp, Homo sapien
aacgcactagaaccggcaatcactg

SEQ ID NO: 200499 - DNA, 25 bp, Homo sapien
cttacggatcggttcgctctagctg

SEQ ID NO: 200500 - DNA, 25 bp, Homo sapien
cgatctgactgaactcccttacgga

SEQ ID NO: 200501 - DNA, 25 bp, Homo sapien
tatgcccgcctcttatagtaacgtc

SEQ ID NO: 200502 - DNA, 25 bp, Homo sapien
tttctcccgcgaagaacgcactaga

SEQ ID NO: 200503 - DNA, 25 bp, Homo sapien
tacaccttctttggtattcgctaga

SEQ ID NO: 200504 - DNA, 25 bp, Homo sapien
ccgcttcttcgtatgacacatctca

SEQ ID NO: 200505 - DNA, 25 bp, Homo sapien
acctgcttctgtacgatctgactga

SEQ ID NO: 200506 - DNA, 25 bp, Homo sapien
cggcaggaactcgtcttcagcagct

SEQ ID NO: 200507 - DNA, 25 bp, Homo sapien
agtcgctccttcgacttcgtccaga

SEQ ID NO: 200508 - DNA, 25 bp, Homo sapien
tggcgtagatttctaacaaccagtc

SEQ ID NO: 200509 - DNA, 25 bp, Homo sapien
aaggctgatgcgaaatgttgattcc

SEQ ID NO: 200510 - DNA, 25 bp, Homo sapien
acacacgtaaagattctggcgtaga

SEQ ID NO: 200511 - DNA, 25 bp, Homo sapien
agctgccatcttgggaaggctgatg

SEQ ID NO: 200512 - DNA, 25 bp, Homo sapien
caaccagtctgaatcgggcgctgca

SEQ ID NO: 200513 - DNA, 25 bp, Homo sapien
cagaagctgtttgctggaatcgaac

SEQ ID NO: 200514 - DNA, 25 bp, Homo sapien
gccttcagcccagtctccgttagat

SEQ ID NO: 200515 - DNA, 25 bp, Homo sapien
tttggtgagtttcccgctgtctcca

SEQ ID NO: 200516 - DNA, 25 bp, Homo sapien
tccagactgctgaggaactcctaga

SEQ ID NO: 200517 - DNA, 25 bp, Homo sapien
tcctgatggcaagctgaggcacacc

SEQ ID NO: 200518 - DNA, 25 bp, Homo sapien
gttagattctgcttcctcccacgtc

SEQ ID NO: 200519 - DNA, 25 bp, Homo sapien
tgtttacagcgtgaaagagctcctc

SEQ ID NO: 200520 - DNA, 25 bp, Homo sapien
cgggaagacgttccgctttgaaatg

SEQ ID NO: 200521 - DNA, 25 bp, Homo sapien
ccctccgagcttagcaaaggtaacg

SEQ ID NO: 200522 - DNA, 25 bp, Homo sapien
cctgcagcagctctacaaatagtta

SEQ ID NO: 200523 - DNA, 25 bp, Homo sapien
tgtcctttagactccgcggactcga

SEQ ID NO: 200524 - DNA, 25 bp, Homo sapien
agggaccctgcaatgcttaattaga

SEQ ID NO: 200525 - DNA, 25 bp, Homo sapien
gggctgagctctccgtaggaataaa

SEQ ID NO: 200526 - DNA, 25 bp, Homo sapien
ggcaacctagtgctgatcgctcgtg

SEQ ID NO: 200527 - DNA, 25 bp, Homo sapien
gctgcatccctgaggagaaaactta

SEQ ID NO: 200528 - DNA, 25 bp, Homo sapien
ctggagctattcctgggcgagtttc

SEQ ID NO: 200529 - DNA, 25 bp, Homo sapien
gcccgagcccgaacctgaactggta

SEQ ID NO: 200530 - DNA, 25 bp, Homo sapien
tcccggaggcagaataaagagaaaa

SEQ ID NO: 200531 - DNA, 25 bp, Homo sapien
tgctcatcggactcctgcacaaatc

SEQ ID NO: 200532 - DNA, 25 bp, Homo sapien
gagcgagcctcggaaatgcccgcgc

SEQ ID NO: 200533 - DNA, 25 bp, Homo sapien
cagtgacagcatcggggaagtatcc

SEQ ID NO: 200534 - DNA, 25 bp, Homo sapien
cctctgttttaaaagcagtgacagc

SEQ ID NO: 200535 - DNA, 25 bp, Homo sapien
gcctgttttctctccctctgtttta

SEQ ID NO: 200536 - DNA, 25 bp, Homo sapien
cctgctgcatgccagttttctttgg

SEQ ID NO: 200537 - DNA, 25 bp, Homo sapien
gaggacgcgcgtttcctcttggtgc

SEQ ID NO: 200538 - DNA, 25 bp, Homo sapien
acaccaaccgtaaccagagcagctg

SEQ ID NO: 200539 - DNA, 25 bp, Homo sapien
aatgggcacggcatccttggtaccg

SEQ ID NO: 200540 - DNA, 25 bp, Homo sapien
aggctccgcagtctgacctcttagg

SEQ ID NO: 200541 - DNA, 25 bp, Homo sapien
ccggcccgaggtcgccagatcaaat

SEQ ID NO: 200542 - DNA, 25 bp, Homo sapien
cgcctatggaactgacggtggagtt

SEQ ID NO: 200543 - DNA, 25 bp, Homo sapien
aggtgccgcagagaattcgcaaaca

SEQ ID NO: 200544 - DNA, 25 bp, Homo sapien
agcgatcgcctagttcccgcgttgc

SEQ ID NO: 200545 - DNA, 25 bp, Homo sapien
gggcgcatacgagacttggcgactc

SEQ ID NO: 200546 - DNA, 25 bp, Homo sapien
tggccgttaggaagttgtgcataca

SEQ ID NO: 200547 - DNA, 25 bp, Homo sapien
tctcggcccgccttttagaacgtga

SEQ ID NO: 200548 - DNA, 25 bp, Homo sapien
tgtgaaccacctctcccttcttggg

SEQ ID NO: 200549 - DNA, 25 bp, Homo sapien
ggacgcttagggaccgttccattca

SEQ ID NO: 200550 - DNA, 25 bp, Homo sapien
tccctgacgagtttcccggatgtaa

SEQ ID NO: 200551 - DNA, 25 bp, Homo sapien
tacccgaggcggtttagacaccaga

SEQ ID NO: 200552 - DNA, 25 bp, Homo sapien
agtttccggcgactccaaattgtgc

SEQ ID NO: 200553 - DNA, 25 bp, Homo sapien
tcgacctccgcctccatgttgaata

SEQ ID NO: 200554 - DNA, 25 bp, Homo sapien
tacggtgtgcgaccgacaggtcttt

SEQ ID NO: 200555 - DNA, 25 bp, Homo sapien
tttcgccaccaagatcctggggatc

SEQ ID NO: 200556 - DNA, 25 bp, Homo sapien
ccgtgagcttgcgagaccttctaat

SEQ ID NO: 200557 - DNA, 25 bp, Homo sapien
accttctaatgggagcatcagcctg

SEQ ID NO: 200558 - DNA, 25 bp, Homo sapien
ccggaaggactctagagaacgctct

SEQ ID NO: 200559 - DNA, 25 bp, Homo sapien
acggctctacgcctgaattccgaga

SEQ ID NO: 200560 - DNA, 25 bp, Homo sapien
agaacgctctgcactatggctggtc

SEQ ID NO: 200561 - DNA, 25 bp, Homo sapien
tctgcgttgtgggaatcttcggcaa

SEQ ID NO: 200562 - DNA, 25 bp, Homo sapien
tggaaggatgatcgcaaggtccctt

SEQ ID NO: 200563 - DNA, 25 bp, Homo sapien
gcgccgtgcagaaccgagggtaccc

SEQ ID NO: 200564 - DNA, 25 bp, Homo sapien
gggcaccgggagcacactgctccga

SEQ ID NO: 200565 - DNA, 25 bp, Homo sapien
actgctccgagcgagctagtggctg

SEQ ID NO: 200566 - DNA, 25 bp, Homo sapien
ggatttgcatgaagctggacgagct

SEQ ID NO: 200567 - DNA, 25 bp, Homo sapien
ggtcccttcctagcagcaagacaca

SEQ ID NO: 200568 - DNA, 25 bp, Homo sapien
tttctcggcggatggaaggatgatc

SEQ ID NO: 200569 - DNA, 25 bp, Homo sapien
acgggaaagacacggtcgagaatga

SEQ ID NO: 200570 - DNA, 25 bp, Homo sapien
atgctccgttgagagacgcggcttt

SEQ ID NO: 200571 - DNA, 25 bp, Homo sapien
caagaactggattcgtggcgccaca

SEQ ID NO: 200572 - DNA, 25 bp, Homo sapien
tggcgccacaagctcattcactgtg

SEQ ID NO: 200573 - DNA, 25 bp, Homo sapien
aagtggcaattgctgctccggcccg

SEQ ID NO: 200574 - DNA, 25 bp, Homo sapien
gccggcttattgtggcgactcgcct

SEQ ID NO: 200575 - DNA, 25 bp, Homo sapien
ggagttaatcctcgacgcacgggtc

SEQ ID NO: 200576 - DNA, 25 bp, Homo sapien
tgcgtatttgtgttcggtgtcgtgc

SEQ ID NO: 200577 - DNA, 25 bp, Homo sapien
cgcggctttcggcaagaactggatt

SEQ ID NO: 200578 - DNA, 25 bp, Homo sapien
agagtcctggggacacttaggtcca

SEQ ID NO: 200579 - DNA, 25 bp, Homo sapien
ccgcgtttccctcggagagtcctgg

SEQ ID NO: 200580 - DNA, 25 bp, Homo sapien
aaatttctcggagcgcgtcgtctgc

SEQ ID NO: 200581 - DNA, 25 bp, Homo sapien
agactgtggctttaagagcgtgccg

SEQ ID NO: 200582 - DNA, 25 bp, Homo sapien
tgtttacaaacactgccgggcccgc

SEQ ID NO: 200583 - DNA, 25 bp, Homo sapien
tgcggagctggaatcgccgcttcct

SEQ ID NO: 200584 - DNA, 25 bp, Homo sapien
catgggttcggactccatggggtcc

SEQ ID NO: 200585 - DNA, 25 bp, Homo sapien
actgggcgccctcgaaatttctcgg

SEQ ID NO: 200586 - DNA, 25 bp, Homo sapien
ccttgctacaagtcgcacgcgcgga

SEQ ID NO: 200587 - DNA, 25 bp, Homo sapien
ctttccaagcccgaggcgaactttg

SEQ ID NO: 200588 - DNA, 25 bp, Homo sapien
cgttgaaaagaggtgtcgtcgcgac

SEQ ID NO: 200589 - DNA, 25 bp, Homo sapien
gcacgcgcggaagtaaacacctcta

SEQ ID NO: 200590 - DNA, 25 bp, Homo sapien
atctcctcagatcggtggacgtgct

SEQ ID NO: 200591 - DNA, 25 bp, Homo sapien
aacacctctacgtcatcagggcgcg

SEQ ID NO: 200592 - DNA, 25 bp, Homo sapien
tgcatcgccgatagaggtgcggtcc

SEQ ID NO: 200593 - DNA, 25 bp, Homo sapien
gtctatgtcccggtttcccgcagtc

SEQ ID NO: 200594 - DNA, 25 bp, Homo sapien
cccgagtcgcatgatgtggcaaaat

SEQ ID NO: 200595 - DNA, 25 bp, Homo sapien
ctcagtcgaaacaggcagcggtcgc

SEQ ID NO: 200596 - DNA, 25 bp, Homo sapien
ctaaagcgcccacggaagtgacgtc

SEQ ID NO: 200597 - DNA, 25 bp, Homo sapien
tcagtatcacgtgcacctggaagta

SEQ ID NO: 200598 - DNA, 25 bp, Homo sapien
aacgagctctccatttctggcagca

SEQ ID NO: 200599 - DNA, 25 bp, Homo sapien
aggccgtttccctgagtcacggaga

SEQ ID NO: 200600 - DNA, 25 bp, Homo sapien
gagacgccgcatttccttaaaacga

SEQ ID NO: 200601 - DNA, 25 bp, Homo sapien
aagcggcacccgtcatgcctcaagg

SEQ ID NO: 200602 - DNA, 25 bp, Homo sapien
agcgagcagtcattcttcctcttgc

SEQ ID NO: 200603 - DNA, 25 bp, Homo sapien
tgagagtccgtaaggagcagcttcc

SEQ ID NO: 200604 - DNA, 25 bp, Homo sapien
ggaggaacgtatcccttctggaggc

SEQ ID NO: 200605 - DNA, 25 bp, Homo sapien
tctgggcagcgaacacgtttctatc

SEQ ID NO: 200606 - DNA, 25 bp, Homo sapien
tgagctacctcttccggggttcctg

SEQ ID NO: 200607 - DNA, 25 bp, Homo sapien
tcctgggtgacaagttccggatcaa

SEQ ID NO: 200608 - DNA, 25 bp, Homo sapien
atcccgcgaggatcaaccgagctcg

SEQ ID NO: 200609 - DNA, 25 bp, Homo sapien
gggcccgcactaagagcctaactga

SEQ ID NO: 200610 - DNA, 25 bp, Homo sapien
gaccagcgcttctgtccggttcaaa

SEQ ID NO: 200611 - DNA, 25 bp, Homo sapien
ttcacggaaccctgtacgcatgctc

SEQ ID NO: 200612 - DNA, 25 bp, Homo sapien
atgcgcatgctcactttcaaaacga

SEQ ID NO: 200613 - DNA, 25 bp, Homo sapien
gtacgcatgctcactgtccaccgaa

SEQ ID NO: 200614 - DNA, 25 bp, Homo sapien
gcgcctggatcctgccgatagttct

SEQ ID NO: 200615 - DNA, 25 bp, Homo sapien
gcgcatgtccactgcccactgtttg

SEQ ID NO: 200616 - DNA, 25 bp, Homo sapien
acgcatgctcctacgctgaacttta

SEQ ID NO: 200617 - DNA, 25 bp, Homo sapien
cgattcctcgagctgttggacttga

SEQ ID NO: 200618 - DNA, 25 bp, Homo sapien
atctccgagggcagagttctccacc

SEQ ID NO: 200619 - DNA, 25 bp, Homo sapien
caggcctggcgctaaataataagtc

SEQ ID NO: 200620 - DNA, 25 bp, Homo sapien
agctgcgcctgagaacggccttcag

SEQ ID NO: 200621 - DNA, 25 bp, Homo sapien
ttttggcagcgagaacaagcgagct

SEQ ID NO: 200622 - DNA, 25 bp, Homo sapien
ttcagtcggggccatcaaccgcaaa

SEQ ID NO: 200623 - DNA, 25 bp, Homo sapien
ggcctaacctctcatgaccagaagc

SEQ ID NO: 200624 - DNA, 25 bp, Homo sapien
gtccgagcctcgagtgcctattctc

SEQ ID NO: 200625 - DNA, 25 bp, Homo sapien
cgagcttgacgcctgacctagttgt

SEQ ID NO: 200626 - DNA, 25 bp, Homo sapien
aagggaattggagcgtggacctctc

SEQ ID NO: 200627 - DNA, 25 bp, Homo sapien
gagggcccaggacgatttcgctccc

SEQ ID NO: 200628 - DNA, 25 bp, Homo sapien
gggtcatcctttctcctgaaactgg

SEQ ID NO: 200629 - DNA, 25 bp, Homo sapien
ctgcggaaccacagggcgacatcca

SEQ ID NO: 200630 - DNA, 25 bp, Homo sapien
tggacctctccaggcttttcattcg

SEQ ID NO: 200631 - DNA, 25 bp, Homo sapien
ttttcattcgctggttctgccggtg

SEQ ID NO: 200632 - DNA, 25 bp, Homo sapien
tttccatctcctcattggctgtcgc

SEQ ID NO: 200633 - DNA, 25 bp, Homo sapien
aagacgcacggatctcgaatacctc

SEQ ID NO: 200634 - DNA, 25 bp, Homo sapien
ggcgaccatctcttcggaagcctaa

SEQ ID NO: 200635 - DNA, 25 bp, Homo sapien
aacgccaaaggctaggagtggacga

SEQ ID NO: 200636 - DNA, 25 bp, Homo sapien
cggcgaggcgctgcctgtatgaccc

SEQ ID NO: 200637 - DNA, 25 bp, Homo sapien
ggatggcgaccatctcttcggaagc

SEQ ID NO: 200638 - DNA, 25 bp, Homo sapien
gccagaggaccagccgaacgccaaa

SEQ ID NO: 200639 - DNA, 25 bp, Homo sapien
cgttgcagccggcagcgtagttgct

SEQ ID NO: 200640 - DNA, 25 bp, Homo sapien
ctcttcggaagcctaacgatccagc

SEQ ID NO: 200641 - DNA, 25 bp, Homo sapien
gaagcctaacgatccagcacaggtc

SEQ ID NO: 200642 - DNA, 25 bp, Homo sapien
tgaggcaccgtcagcatcctcgcgt

SEQ ID NO: 200643 - DNA, 25 bp, Homo sapien
actgtcagcatcctcgcgtcctgtg

SEQ ID NO: 200644 - DNA, 25 bp, Homo sapien
gctgtgaggcactgtcagcatcctc

SEQ ID NO: 200645 - DNA, 25 bp, Homo sapien
tgtcagcatcctcgcgtcctgtgcg

SEQ ID NO: 200646 - DNA, 25 bp, Homo sapien
ctgtcagcatcctcgcgtcctgtgt

SEQ ID NO: 200647 - DNA, 25 bp, Homo sapien
tgaggcaccgtcagcatcctcggtc

SEQ ID NO: 200648 - DNA, 25 bp, Homo sapien
tgtgaggcaccgtcagcatcctcgg

SEQ ID NO: 200649 - DNA, 25 bp, Homo sapien
tgtgaggcaccgtcagcatcctcgc

SEQ ID NO: 200650 - DNA, 25 bp, Homo sapien
agcagccatcttttctacgggcggg

SEQ ID NO: 200651 - DNA, 25 bp, Homo sapien
gcgaaacccattgcctcgctcaggg

SEQ ID NO: 200652 - DNA, 25 bp, Homo sapien
tcagaggggtttccatgactacggg

SEQ ID NO: 200653 - DNA, 25 bp, Homo sapien
ctcggagatgagctgatcgaagagc

SEQ ID NO: 200654 - DNA, 25 bp, Homo sapien
cactgccctcgctgtagttctcgga

SEQ ID NO: 200655 - DNA, 25 bp, Homo sapien
cggaaggccacgaaccgacaacttg

SEQ ID NO: 200656 - DNA, 25 bp, Homo sapien
tcagggattgcttcccgcggtgcct

SEQ ID NO: 200657 - DNA, 25 bp, Homo sapien
tggggtgatcccagggaaatacttc

SEQ ID NO: 200658 - DNA, 25 bp, Homo sapien
cggttgttccgcagcattctgggga

SEQ ID NO: 200659 - DNA, 25 bp, Homo sapien
gagccaggaacacgcaccagccagg

SEQ ID NO: 200660 - DNA, 25 bp, Homo sapien
agttctcctccataggctgcgagcc

SEQ ID NO: 200661 - DNA, 25 bp, Homo sapien
agcttccgccatcgtggctcgttca

SEQ ID NO: 200662 - DNA, 25 bp, Homo sapien
tggatgcagctgatgcggttgttcc

SEQ ID NO: 200663 - DNA, 25 bp, Homo sapien
ccgtgaagctgtcgttgtggatgca

SEQ ID NO: 200664 - DNA, 25 bp, Homo sapien
atacggtggtgatctggttgtcgta

SEQ ID NO: 200665 - DNA, 25 bp, Homo sapien
tcgtggctcgttcacagttctcctc

SEQ ID NO: 200666 - DNA, 25 bp, Homo sapien
tcgtccactcctagcctttggcgtt

SEQ ID NO: 200667 - DNA, 25 bp, Homo sapien
agcaactacgctgccggctgcaacg

SEQ ID NO: 200668 - DNA, 25 bp, Homo sapien
actcctagcctttggcgttcggctg

SEQ ID NO: 200669 - DNA, 25 bp, Homo sapien
gacctgtgctggatcgttaggcttc

SEQ ID NO: 200670 - DNA, 25 bp, Homo sapien
tgctggatcgttaggcttccgaaga

SEQ ID NO: 200671 - DNA, 25 bp, Homo sapien
ggcttccgaagagatggtcgccatc

SEQ ID NO: 200672 - DNA, 25 bp, Homo sapien
gggtcatacaggcagcgcctcgccg

SEQ ID NO: 200673 - DNA, 25 bp, Homo sapien
gcctttggcgttcggctggtcctct

SEQ ID NO: 200674 - DNA, 25 bp, Homo sapien
atcagcgctcagcagcgaccggcag

SEQ ID NO: 200675 - DNA, 25 bp, Homo sapien
cgtggtacattcgatcgacggaacg

SEQ ID NO: 200676 - DNA, 25 bp, Homo sapien
cctagaaatcgagcgtggtacattc

SEQ ID NO: 200677 - DNA, 25 bp, Homo sapien
tcctgcgttgtgctaaagacctaga

SEQ ID NO: 200678 - DNA, 25 bp, Homo sapien
gggacgaccaatcgacttatcctgc

SEQ ID NO: 200679 - DNA, 25 bp, Homo sapien
ctttgggtttcttcgagcgctactc

SEQ ID NO: 200680 - DNA, 25 bp, Homo sapien
acacagaagactgcggggagcctta

SEQ ID NO: 200681 - DNA, 25 bp, Homo sapien
tttcaactgcgtactggacgacaca

SEQ ID NO: 200682 - DNA, 25 bp, Homo sapien
tctttgtccattcggttccgaggcc

SEQ ID NO: 200683 - DNA, 25 bp, Homo sapien
ctcctagggccgtaattgccgcagc

SEQ ID NO: 200684 - DNA, 25 bp, Homo sapien
tcattccgactggatcagggggccc

SEQ ID NO: 200685 - DNA, 25 bp, Homo sapien
agggccgtaattgccgcagccatcc

SEQ ID NO: 200686 - DNA, 25 bp, Homo sapien
gcagccatccctacgcgtctccagc

SEQ ID NO: 200687 - DNA, 25 bp, Homo sapien
cgtcgtctttgtccattcggttccg

SEQ ID NO: 200688 - DNA, 25 bp, Homo sapien
ttggactggggcgcccacgactgac

SEQ ID NO: 200689 - DNA, 25 bp, Homo sapien
gcgcctcattccgactggatcaggg

SEQ ID NO: 200690 - DNA, 25 bp, Homo sapien
ctcaactgtttagaccaccgcgggt

SEQ ID NO: 200691 - DNA, 25 bp, Homo sapien
accaaggtttggtcttctgctgagc

SEQ ID NO: 200692 - DNA, 25 bp, Homo sapien
ctgagcgctgctggatgaatcgcca

SEQ ID NO: 200693 - DNA, 25 bp, Homo sapien
gcagctgcttccagggtgctgtcca

SEQ ID NO: 200694 - DNA, 25 bp, Homo sapien
gattcgacccgaactccaagacgcg

SEQ ID NO: 200695 - DNA, 25 bp, Homo sapien
aagacgcgtccgcactggtccaaca

SEQ ID NO: 200696 - DNA, 25 bp, Homo sapien
ctggtccaacaaccctcatggatcg

SEQ ID NO: 200697 - DNA, 25 bp, Homo sapien
atggatcgtcgcctgcctcaactgt

SEQ ID NO: 200698 - DNA, 25 bp, Homo sapien
acatcgccacgaggagttggcaggc

SEQ ID NO: 200699 - DNA, 25 bp, Homo sapien
gcgtttcccgcgagaaagcagaacc

SEQ ID NO: 200700 - DNA, 25 bp, Homo sapien
cgagcatatgtaggggagcgtttcc

SEQ ID NO: 200701 - DNA, 25 bp, Homo sapien
gctttccggggcacagaagctgcag

SEQ ID NO: 200702 - DNA, 25 bp, Homo sapien
ggccgaaacgctgtgctcacctcga

SEQ ID NO: 200703 - DNA, 25 bp, Homo sapien
tagctgtcagacatcgccacgagga

SEQ ID NO: 200704 - DNA, 25 bp, Homo sapien
tcgcgccgctgacctagctgtcaga

SEQ ID NO: 200705 - DNA, 25 bp, Homo sapien
tgtgctcacctcgagcactgccagg

SEQ ID NO: 200706 - DNA, 25 bp, Homo sapien
ccatcggccagtgcaggtgagctcc

SEQ ID NO: 200707 - DNA, 25 bp, Homo sapien
tcgcggctccgctataaaacccagg

SEQ ID NO: 200708 - DNA, 25 bp, Homo sapien
ctataaaacccaggccggcaggatc

SEQ ID NO: 200709 - DNA, 25 bp, Homo sapien
aacccaggccggcaggatcgctgca

SEQ ID NO: 200710 - DNA, 25 bp, Homo sapien
cccggctcagaggactctttgctgt

SEQ ID NO: 200711 - DNA, 25 bp, Homo sapien
gaggactctttgctgtcccgcaaga

SEQ ID NO: 200712 - DNA, 25 bp, Homo sapien
tttgctgtcccgcaagatgcggatg

SEQ ID NO: 200713 - DNA, 25 bp, Homo sapien
gtcccgcaagatgcggatgctgctg

SEQ ID NO: 200714 - DNA, 25 bp, Homo sapien
agccggtctttccggacagggtgat

SEQ ID NO: 200715 - DNA, 25 bp, Homo sapien
taacctccagcgctgaattgggagc

SEQ ID NO: 200716 - DNA, 25 bp, Homo sapien
aacctccagcgctgaattgggagcc

SEQ ID NO: 200717 - DNA, 25 bp, Homo sapien
cctccagcgctgaattgggagcctg

SEQ ID NO: 200718 - DNA, 25 bp, Homo sapien
tccagcgctgaattgggagcctggc

SEQ ID NO: 200719 - DNA, 25 bp, Homo sapien
tctgcggagccggtctttccggaca

SEQ ID NO: 200720 - DNA, 25 bp, Homo sapien
ctgcggagccggtctttccggacag

SEQ ID NO: 200721 - DNA, 25 bp, Homo sapien
tccctaacctccagcgctgaattgg

SEQ ID NO: 200722 - DNA, 25 bp, Homo sapien
ggagacggccatcttctccgagggc

SEQ ID NO: 200723 - DNA, 25 bp, Homo sapien
tacttcttgggtcacctgagcctcg

SEQ ID NO: 200724 - DNA, 25 bp, Homo sapien
gtgttccttttcctacgcgcgcatc

SEQ ID NO: 200725 - DNA, 25 bp, Homo sapien
ggctctgtcctctccgtgtatttcc

SEQ ID NO: 200726 - DNA, 25 bp, Homo sapien
cgagatgtacttcttcgtggctctg

SEQ ID NO: 200727 - DNA, 25 bp, Homo sapien
agcctcgtggacgtctgctttacca

SEQ ID NO: 200728 - DNA, 25 bp, Homo sapien
ccaggcgtgctttgccgagatgtac

SEQ ID NO: 200729 - DNA, 25 bp, Homo sapien
cccttcttttgcgacatgacggtga

SEQ ID NO: 200730 - DNA, 25 bp, Homo sapien
gctgaggaatccgatccgtgactcc

SEQ ID NO: 200731 - DNA, 25 bp, Homo sapien
ggggacgcatctccgcacgtaacgc

SEQ ID NO: 200732 - DNA, 25 bp, Homo sapien
gcccacatgttctggcgttcggcgg

SEQ ID NO: 200733 - DNA, 25 bp, Homo sapien
aggccagacactgttcccggtaacg

SEQ ID NO: 200734 - DNA, 25 bp, Homo sapien
tccatgccggatcacgtgactcttc

SEQ ID NO: 200735 - DNA, 25 bp, Homo sapien
gatccgtgactccttggcacccatg

SEQ ID NO: 200736 - DNA, 25 bp, Homo sapien
agcgcctcctcgtagctgaggaatc

SEQ ID NO: 200737 - DNA, 25 bp, Homo sapien
ccacactaacaagtgcggcttctgc

SEQ ID NO: 200738 - DNA, 25 bp, Homo sapien
gttacagagcccgtaggcactggcg

SEQ ID NO: 200739 - DNA, 25 bp, Homo sapien
ccgcactgtcgcgaaggcaggcgaa

SEQ ID NO: 200740 - DNA, 25 bp, Homo sapien
caggcgaagaacagggccacactga

SEQ ID NO: 200741 - DNA, 25 bp, Homo sapien
gcccagaggacacgaaggaaggtcc

SEQ ID NO: 200742 - DNA, 25 bp, Homo sapien
aaaaggtggctcgagtgaggaaact

SEQ ID NO: 200743 - DNA, 25 bp, Homo sapien
ggcaacggtctctcgtcgccgggac

SEQ ID NO: 200744 - DNA, 25 bp, Homo sapien
gcgacgggacttgcccgcgtctcag

SEQ ID NO: 200745 - DNA, 25 bp, Homo sapien
agcgcctcctgtgtgaagcgggacc

SEQ ID NO: 200746 - DNA, 25 bp, Homo sapien
ggaccatactcacaggcgctcggtg

SEQ ID NO: 200747 - DNA, 25 bp, Homo sapien
ttcaaaggtggaacctccgaggcgc

SEQ ID NO: 200748 - DNA, 25 bp, Homo sapien
tgcaagccgcctacagtttcaaagg

SEQ ID NO: 200749 - DNA, 25 bp, Homo sapien
ccggcagtcatccatcaatcgaaaa

SEQ ID NO: 200750 - DNA, 25 bp, Homo sapien
agctcccaactgactgctgcgagga

SEQ ID NO: 200751 - DNA, 25 bp, Homo sapien
cacacggcgaggatgcgcacattta

SEQ ID NO: 200752 - DNA, 25 bp, Homo sapien
tattcttgggaatggcctgcagccc

SEQ ID NO: 200753 - DNA, 25 bp, Homo sapien
gccaagtcctggctgtacacacaca

SEQ ID NO: 200754 - DNA, 25 bp, Homo sapien
tcaaactggatgttctcgggcaagg

SEQ ID NO: 200755 - DNA, 25 bp, Homo sapien
tgtgcggcgtcatgacgtaagcgca

SEQ ID NO: 200756 - DNA, 25 bp, Homo sapien
caccagacgtttcgggaggcaagtc

SEQ ID NO: 200757 - DNA, 25 bp, Homo sapien
gcccacggcgcataccttgtagtaa

SEQ ID NO: 200758 - DNA, 25 bp, Homo sapien
gtctctgggatccactctagttcca

SEQ ID NO: 200759 - DNA, 25 bp, Homo sapien
aaagcgtcacaatcccggttcgaga

SEQ ID NO: 200760 - DNA, 25 bp, Homo sapien
cttaggaagagctggatgcctccca

SEQ ID NO: 200761 - DNA, 25 bp, Homo sapien
ggagcggatgtagttgtccacgaca

SEQ ID NO: 200762 - DNA, 25 bp, Homo sapien
ggccgcattaagaacgctggactga

SEQ ID NO: 200763 - DNA, 25 bp, Homo sapien
actccggattggtcgagcttagaga

SEQ ID NO: 200764 - DNA, 25 bp, Homo sapien
tcggcgtcgtcgaagataaacaata

SEQ ID NO: 200765 - DNA, 25 bp, Homo sapien
taaacaatagttggccggcgagcgc

SEQ ID NO: 200766 - DNA, 25 bp, Homo sapien
ctcaaatcgttgtggagcccgaacc

SEQ ID NO: 200767 - DNA, 25 bp, Homo sapien
ccggctaaggtttgcgctgccatcc

SEQ ID NO: 200768 - DNA, 25 bp, Homo sapien
gccgctcgggaaaggatcaacaact

SEQ ID NO: 200769 - DNA, 25 bp, Homo sapien
agcagaagggtttcacctcgtccga

SEQ ID NO: 200770 - DNA, 25 bp, Homo sapien
ggtccgcctctttcctacttgctgg

SEQ ID NO: 200771 - DNA, 25 bp, Homo sapien
tcggggagactccaaacagtgagcc

SEQ ID NO: 200772 - DNA, 25 bp, Homo sapien
cccagcggattggacacattcagaa

SEQ ID NO: 200773 - DNA, 25 bp, Homo sapien
ggcttcacccgaacttacatgctgt

SEQ ID NO: 200774 - DNA, 25 bp, Homo sapien
tgcctgcgtttgcaaccgaacctga

SEQ ID NO: 200775 - DNA, 25 bp, Homo sapien
ggctccaacctgaaacgctcacgtg

SEQ ID NO: 200776 - DNA, 25 bp, Homo sapien
ccagctgtcgcgagaattcgatgta

SEQ ID NO: 200777 - DNA, 25 bp, Homo sapien
taggctcccggaaggtaaacacatc

SEQ ID NO: 200778 - DNA, 25 bp, Homo sapien
atagctgtagggtttcctctccagg

SEQ ID NO: 200779 - DNA, 25 bp, Homo sapien
ctggcatctcaggtaaggcctgtga

SEQ ID NO: 200780 - DNA, 25 bp, Homo sapien
tgggttccttccactgtaaatctgg

SEQ ID NO: 200781 - DNA, 25 bp, Homo sapien
cttggattaggtgacctgcagctgc

SEQ ID NO: 200782 - DNA, 25 bp, Homo sapien
cacttgcacgggcagcagttctttg

SEQ ID NO: 200783 - DNA, 25 bp, Homo sapien
cctggacagttcaccatgggccctg

SEQ ID NO: 200784 - DNA, 25 bp, Homo sapien
ctccgccatgggcatgggtcaccta

SEQ ID NO: 200785 - DNA, 25 bp, Homo sapien
cttgggcgccgtgtaattctatagc

SEQ ID NO: 200786 - DNA, 25 bp, Homo sapien
gcgcgcctgtcagcggcaatttgtt

SEQ ID NO: 200787 - DNA, 25 bp, Homo sapien
caccctgcgcgggataattgggacg

SEQ ID NO: 200788 - DNA, 25 bp, Homo sapien
ccttaggtgcagaacgacgcccttc

SEQ ID NO: 200789 - DNA, 25 bp, Homo sapien
gcggaccaggtgtctcaagcgtaca

SEQ ID NO: 200790 - DNA, 25 bp, Homo sapien
acgtgcacctgacttctgcggacca

SEQ ID NO: 200791 - DNA, 25 bp, Homo sapien
gtctctcaagtcactcagtcgatcg

SEQ ID NO: 200792 - DNA, 25 bp, Homo sapien
cgctccctgcgaaagcgtttccgaa

SEQ ID NO: 200793 - DNA, 25 bp, Homo sapien
aagcgactctgtccagggagtgtcc

SEQ ID NO: 200794 - DNA, 25 bp, Homo sapien
gggaaattcagcctctctcagactc

SEQ ID NO: 200795 - DNA, 25 bp, Homo sapien
cacaagctaggcacggagatggtca

SEQ ID NO: 200796 - DNA, 25 bp, Homo sapien
tggtcatcaccaagtccgggaggta

SEQ ID NO: 200797 - DNA, 25 bp, Homo sapien
ttcgctcccacggacaaccaagttg

SEQ ID NO: 200798 - DNA, 25 bp, Homo sapien
caaccgttctgagtcccagcgcaga

SEQ ID NO: 200799 - DNA, 25 bp, Homo sapien
ccaggatgtcttatcaggctctgta

SEQ ID NO: 200800 - DNA, 25 bp, Homo sapien
ggctctgtagcccagttcccaatac

SEQ ID NO: 200801 - DNA, 25 bp, Homo sapien
ttctcgtttggcaccggagcgattt

SEQ ID NO: 200802 - DNA, 25 bp, Homo sapien
tgcccgagctggctctccgcaaagt

SEQ ID NO: 200803 - DNA, 25 bp, Homo sapien
tagcactagcctcctcaccaccggg

SEQ ID NO: 200804 - DNA, 25 bp, Homo sapien
tccaaggccgctggtggaaacagcc

SEQ ID NO: 200805 - DNA, 25 bp, Homo sapien
gtggaaacagccgggagcctagccc

SEQ ID NO: 200806 - DNA, 25 bp, Homo sapien
ccatcccgcggtgccctgtcgccca

SEQ ID NO: 200807 - DNA, 25 bp, Homo sapien
ctgtcgcccagtggctcggccaagg

SEQ ID NO: 200808 - DNA, 25 bp, Homo sapien
cgactgcgtttcagcccctatcaga

SEQ ID NO: 200809 - DNA, 25 bp, Homo sapien
ctggctctccgcaaagtaggggccc

SEQ ID NO: 200810 - DNA, 25 bp, Homo sapien
gcgagaacgaaacgacaaaaacgca

SEQ ID NO: 200811 - DNA, 25 bp, Homo sapien
gcgggctccacctcaggttttcact

SEQ ID NO: 200812 - DNA, 25 bp, Homo sapien
cacctcaggttttcacttttcgctc

SEQ ID NO: 200813 - DNA, 25 bp, Homo sapien
tccggagcgagaacgaaacgacaaa

SEQ ID NO: 200814 - DNA, 25 bp, Homo sapien
cgctagaaagcgaagtgaacggcgc

SEQ ID NO: 200815 - DNA, 25 bp, Homo sapien
cgaagtgaacggcgctgtgcgctct

SEQ ID NO: 200816 - DNA, 25 bp, Homo sapien
agctccgcgcaacgggcctgggcac

SEQ ID NO: 200817 - DNA, 25 bp, Homo sapien
ttcacttttcgctccggagcgagaa

SEQ ID NO: 200818 - DNA, 25 bp, Homo sapien
cggaagcaccgatttccagcgctga

SEQ ID NO: 200819 - DNA, 25 bp, Homo sapien
aggcccaggggacctcatttcctct

SEQ ID NO: 200820 - DNA, 25 bp, Homo sapien
tcctctcgggttaatcggaatcttc

SEQ ID NO: 200821 - DNA, 25 bp, Homo sapien
cagctgaccgcgaactcctgcgtgg

SEQ ID NO: 200822 - DNA, 25 bp, Homo sapien
acagcctctacgagccctggattta

SEQ ID NO: 200823 - DNA, 25 bp, Homo sapien
ttcctccgctctgggaaggacccaa

SEQ ID NO: 200824 - DNA, 25 bp, Homo sapien
gcgcatatctgttcctcctattgga

SEQ ID NO: 200825 - DNA, 25 bp, Homo sapien
gcgatacctgctggcggcctagcct

SEQ ID NO: 200826 - DNA, 25 bp, Homo sapien
tgcgtgctgggtgtcttcagatgaa

SEQ ID NO: 200827 - DNA, 25 bp, Homo sapien
cctgcctgaatgtgccctaaacctg

SEQ ID NO: 200828 - DNA, 25 bp, Homo sapien
tcttcagatgaagggcgacgaaatc

SEQ ID NO: 200829 - DNA, 25 bp, Homo sapien
tcctgagggcaatgagcctccgtgc

SEQ ID NO: 200830 - DNA, 25 bp, Homo sapien
cgtttcttgccgcaggacggttgct

SEQ ID NO: 200831 - DNA, 25 bp, Homo sapien
gacccggccggattactgtcatctg

SEQ ID NO: 200832 - DNA, 25 bp, Homo sapien
ctgtcatctgtggactgcctgcgct

SEQ ID NO: 200833 - DNA, 25 bp, Homo sapien
cgggccgaggagaccctgcctgaat

SEQ ID NO: 200834 - DNA, 25 bp, Homo sapien
tgtgcacggaccagcccgtctgcag

SEQ ID NO: 200835 - DNA, 25 bp, Homo sapien
tgctccaggacgtcgagccgctctg

SEQ ID NO: 200836 - DNA, 25 bp, Homo sapien
gcttctccgtctggtaggtgtgcac

SEQ ID NO: 200837 - DNA, 25 bp, Homo sapien
gccgggctgaggtgctgcttcctcc

SEQ ID NO: 200838 - DNA, 25 bp, Homo sapien
ccgagaacagtcagtggacggccca

SEQ ID NO: 200839 - DNA, 25 bp, Homo sapien
gcctcgagagggaacagcacagacg

SEQ ID NO: 200840 - DNA, 25 bp, Homo sapien
ccgtctgcagcctcgagagggaaca

SEQ ID NO: 200841 - DNA, 25 bp, Homo sapien
gcgcttgcgccaaagcccttgctgt

SEQ ID NO: 200842 - DNA, 25 bp, Homo sapien
gacacacaactttcgccctcagttt

SEQ ID NO: 200843 - DNA, 25 bp, Homo sapien
atgacgttaacgctcttccttggcg

SEQ ID NO: 200844 - DNA, 25 bp, Homo sapien
cgggcgcgatgacgttaacgctctt

SEQ ID NO: 200845 - DNA, 25 bp, Homo sapien
atggcatcttcgctgcctgcctggc

SEQ ID NO: 200846 - DNA, 25 bp, Homo sapien
acctcggcgcgatggcatcttcgct

SEQ ID NO: 200847 - DNA, 25 bp, Homo sapien
gaatcaggctgttcgcaggcgccgt

SEQ ID NO: 200848 - DNA, 25 bp, Homo sapien
gcccgcgaagaaagcgcgggaatca

SEQ ID NO: 200849 - DNA, 25 bp, Homo sapien
aagcgcgggaatcaggctgttcgca

SEQ ID NO: 200850 - DNA, 25 bp, Homo sapien
taagaagggcgccaagcaaacggaa

SEQ ID NO: 200851 - DNA, 25 bp, Homo sapien
gcggggccatctgtaccgccgcttg

SEQ ID NO: 200852 - DNA, 25 bp, Homo sapien
gatcaatcaaaacagcgcctccgga

SEQ ID NO: 200853 - DNA, 25 bp, Homo sapien
gcgcacctctactggatcaatcaaa

SEQ ID NO: 200854 - DNA, 25 bp, Homo sapien
agcaaacggaaaccgcgcacctcta

SEQ ID NO: 200855 - DNA, 25 bp, Homo sapien
gtgcgtttgctaagaagggcgccaa

SEQ ID NO: 200856 - DNA, 25 bp, Homo sapien
cagcgcctccggacaaacgggaatg

SEQ ID NO: 200857 - DNA, 25 bp, Homo sapien
ggaaaccgcgcacctctactggatc

SEQ ID NO: 200858 - DNA, 25 bp, Homo sapien
ccaggcgagccctcctggttgtcga

SEQ ID NO: 200859 - DNA, 25 bp, Homo sapien
ccaaagtgcagccttggagatcaag

SEQ ID NO: 200860 - DNA, 25 bp, Homo sapien
cagactgattgacagcggcgacgtc

SEQ ID NO: 200861 - DNA, 25 bp, Homo sapien
tctaatctaaaccatgcggggctcc

SEQ ID NO: 200862 - DNA, 25 bp, Homo sapien
acttcaggggcggtcaaagttgcag

SEQ ID NO: 200863 - DNA, 25 bp, Homo sapien
ttgcttcccgcctctctaatctaaa

SEQ ID NO: 200864 - DNA, 25 bp, Homo sapien
ctccgcatgcggcaccgcaattagg

SEQ ID NO: 200865 - DNA, 25 bp, Homo sapien
accggggctcccaaatgaacagcgc

SEQ ID NO: 200866 - DNA, 25 bp, Homo sapien
cctgagtgagcctgtaggttcgaac

SEQ ID NO: 200867 - DNA, 25 bp, Homo sapien
ggttcgaactcgagcaccaggtagg

SEQ ID NO: 200868 - DNA, 25 bp, Homo sapien
ccctgtggcgctaaagtgtgcctga

SEQ ID NO: 200869 - DNA, 25 bp, Homo sapien
gggcagagcctggatcagtcaccca

SEQ ID NO: 200870 - DNA, 25 bp, Homo sapien
tctttaggcccaaagcagagccctg

SEQ ID NO: 200871 - DNA, 25 bp, Homo sapien
ggaagtctctacctcagtgctgtct

SEQ ID NO: 200872 - DNA, 25 bp, Homo sapien
gctctcctttcctgcatggccagga

SEQ ID NO: 200873 - DNA, 25 bp, Homo sapien
gaaagcctttggttcaggaagtctc

SEQ ID NO: 200874 - DNA, 25 bp, Homo sapien
gcagttcattctaaagccatttccg

SEQ ID NO: 200875 - DNA, 25 bp, Homo sapien
aacttgcgtgttccctcagcagtga

SEQ ID NO: 200876 - DNA, 25 bp, Homo sapien
tgaatagataaaggctccagctccg

SEQ ID NO: 200877 - DNA, 25 bp, Homo sapien
gctctcgcagcgcagctagaacttg

SEQ ID NO: 200878 - DNA, 25 bp, Homo sapien
aacgtccgaggaagcttatcttagc

SEQ ID NO: 200879 - DNA, 25 bp, Homo sapien
cagttacgggtttgttgccagaatt

SEQ ID NO: 200880 - DNA, 25 bp, Homo sapien
ctcagcagtgagttcgcagttacgg

SEQ ID NO: 200881 - DNA, 25 bp, Homo sapien
gcaccctttcagagcctgtttcatg

SEQ ID NO: 200882 - DNA, 25 bp, Homo sapien
aaacaagggctcaaggtacgcggcg

SEQ ID NO: 200883 - DNA, 25 bp, Homo sapien
tcaaccacacaacccgagacgaatt

SEQ ID NO: 200884 - DNA, 25 bp, Homo sapien
cgccaaggccaggaatcaaccagtc

SEQ ID NO: 200885 - DNA, 25 bp, Homo sapien
atcaaccagtcccggtgcgaggtga

SEQ ID NO: 200886 - DNA, 25 bp, Homo sapien
ggcatccaatggaagtctccgaaaa

SEQ ID NO: 200887 - DNA, 25 bp, Homo sapien
atagcccagcgagctcgaccaatca

SEQ ID NO: 200888 - DNA, 25 bp, Homo sapien
aatcacccgccaaggccaggaatca

SEQ ID NO: 200889 - DNA, 25 bp, Homo sapien
ggggcgagaacttcggcatccaatg

SEQ ID NO: 200890 - DNA, 25 bp, Homo sapien
gactcggacaccaagaactcagacg

SEQ ID NO: 200891 - DNA, 25 bp, Homo sapien
acgtcggcgccaatgcaactgtgcg

SEQ ID NO: 200892 - DNA, 25 bp, Homo sapien
gtcggccaccgtactggtctgagag

SEQ ID NO: 200893 - DNA, 25 bp, Homo sapien
ccaaccgggttgtcgatacaaagtg

SEQ ID NO: 200894 - DNA, 25 bp, Homo sapien
aaaccctagttgtgcctcgagtcga

SEQ ID NO: 200895 - DNA, 25 bp, Homo sapien
agcggacgcttcataccttaagatc

SEQ ID NO: 200896 - DNA, 25 bp, Homo sapien
cccgggcgcaactagaaccaataag

SEQ ID NO: 200897 - DNA, 25 bp, Homo sapien
aagcgggagactttttcaacctgca

SEQ ID NO: 200898 - DNA, 25 bp, Homo sapien
cgccgcctccgaccagagagagaaa

SEQ ID NO: 200899 - DNA, 25 bp, Homo sapien
aggttacagtgacaatcttccaggc

SEQ ID NO: 200900 - DNA, 25 bp, Homo sapien
atcaagtccgagacggcagagccca

SEQ ID NO: 200901 - DNA, 25 bp, Homo sapien
gcgatgtccttaagcccagagtctc

SEQ ID NO: 200902 - DNA, 25 bp, Homo sapien
tctgcgggctcagaccattctctgg

SEQ ID NO: 200903 - DNA, 25 bp, Homo sapien
ctggctctgtcttcgtgtcgttcct

SEQ ID NO: 200904 - DNA, 25 bp, Homo sapien
cggcctaaagtttgccctcctgtgg

SEQ ID NO: 200905 - DNA, 25 bp, Homo sapien
tcccttcgctttaatggcggccaca

SEQ ID NO: 200906 - DNA, 25 bp, Homo sapien
ctccagcagctgcacgtaggccggg

SEQ ID NO: 200907 - DNA, 25 bp, Homo sapien
ctgctggacgttgcggaaggaatac

SEQ ID NO: 200908 - DNA, 25 bp, Homo sapien
accgcctcgaaggtcagcgtgggct

SEQ ID NO: 200909 - DNA, 25 bp, Homo sapien
atgggtacatccaccgcctcgaagg

SEQ ID NO: 200910 - DNA, 25 bp, Homo sapien
acgcgccaggcgcagttgcccagtt

SEQ ID NO: 200911 - DNA, 25 bp, Homo sapien
ccagaagacgcggtcccgcaggtgc

SEQ ID NO: 200912 - DNA, 25 bp, Homo sapien
tgaccaggtggatcttgagccaatc

SEQ ID NO: 200913 - DNA, 25 bp, Homo sapien
catggcatctgcgtagcctgcacca

SEQ ID NO: 200914 - DNA, 25 bp, Homo sapien
cgccgctccacaactttcttgttgg

SEQ ID NO: 200915 - DNA, 25 bp, Homo sapien
atagtctcctctttctgcttgctcc

SEQ ID NO: 200916 - DNA, 25 bp, Homo sapien
cttggctgcgtggaaccatagtctc

SEQ ID NO: 200917 - DNA, 25 bp, Homo sapien
tgagatgcttgcttctcttggctgc

SEQ ID NO: 200918 - DNA, 25 bp, Homo sapien
ggggcatttcttcagatcttaattg

SEQ ID NO: 200919 - DNA, 25 bp, Homo sapien
agtctctttgcccagcggccacagg

SEQ ID NO: 200920 - DNA, 25 bp, Homo sapien
cccatctggaccttcctgggtggct

SEQ ID NO: 200921 - DNA, 25 bp, Homo sapien
tggctggaggctaccacctccactg

SEQ ID NO: 200922 - DNA, 25 bp, Homo sapien
ctcgccgataagaggcagcagttcg

SEQ ID NO: 200923 - DNA, 25 bp, Homo sapien
tgccaggagaaacaaggtgcgctta

SEQ ID NO: 200924 - DNA, 25 bp, Homo sapien
agaacagtatccagcgggtgtgcca

SEQ ID NO: 200925 - DNA, 25 bp, Homo sapien
cctaagctgcccgtttgattttctc

SEQ ID NO: 200926 - DNA, 25 bp, Homo sapien
acccgaggcactctccaaggggaga

SEQ ID NO: 200927 - DNA, 25 bp, Homo sapien
acgagtcaagctgccctacccgagg

SEQ ID NO: 200928 - DNA, 25 bp, Homo sapien
gcgtcttccaccacaatgcctggta

SEQ ID NO: 200929 - DNA, 25 bp, Homo sapien
ttggtatcaacagccagcgtactgc

SEQ ID NO: 200930 - DNA, 25 bp, Homo sapien
cagccgtgcaaatctcgcgaggaaa

SEQ ID NO: 200931 - DNA, 25 bp, Homo sapien
gcgcctggctctgtacgcgagcccg

SEQ ID NO: 200932 - DNA, 25 bp, Homo sapien
gccgtgcaaatctcgcgaggaaaca

SEQ ID NO: 200933 - DNA, 25 bp, Homo sapien
tctcgcgaggaaacacgcggtttca

SEQ ID NO: 200934 - DNA, 25 bp, Homo sapien
acgcggtttcactagtgtgtttaca

SEQ ID NO: 200935 - DNA, 25 bp, Homo sapien
gcggtttcactagtgtgtttacacc

SEQ ID NO: 200936 - DNA, 25 bp, Homo sapien
tgcaaatctcgcgaggaaacacgcg

SEQ ID NO: 200937 - DNA, 25 bp, Homo sapien
ttcactagtgtgtttacaccgatca

SEQ ID NO: 200938 - DNA, 25 bp, Homo sapien
cggacctgaacgcacaaagtgcctc

SEQ ID NO: 200939 - DNA, 25 bp, Homo sapien
cgctgtgtgcaacagtgaggaattc

SEQ ID NO: 200940 - DNA, 25 bp, Homo sapien
tgaggaattcgctaaccagccctgg

SEQ ID NO: 200941 - DNA, 25 bp, Homo sapien
gacttccgtttcctcgccatcaaga

SEQ ID NO: 200942 - DNA, 25 bp, Homo sapien
cctcggagaagatgtgaagcgctgt

SEQ ID NO: 200943 - DNA, 25 bp, Homo sapien
catcaagaggtgtctcggcgccaaa

SEQ ID NO: 200944 - DNA, 25 bp, Homo sapien
cctcttccgtgcgattggatgactc

SEQ ID NO: 200945 - DNA, 25 bp, Homo sapien
tcgccatcttcgtcagcaaacttct

SEQ ID NO: 200946 - DNA, 25 bp, Homo sapien
gtcgtacatgcgcttcacaaagtca

SEQ ID NO: 200947 - DNA, 25 bp, Homo sapien
atcgttgttgcgagtggtctccagc

SEQ ID NO: 200948 - DNA, 25 bp, Homo sapien
tcccgcgaggtgatgtccgtctgct

SEQ ID NO: 200949 - DNA, 25 bp, Homo sapien
tcttgaagtcctcggccacggtcac

SEQ ID NO: 200950 - DNA, 25 bp, Homo sapien
caaagtcattctgcgtcttgaagtc

SEQ ID NO: 200951 - DNA, 25 bp, Homo sapien
tcccagttgccactccgcagtagga

SEQ ID NO: 200952 - DNA, 25 bp, Homo sapien
cgtgaaggatgttgttgcctcgtga

SEQ ID NO: 200953 - DNA, 25 bp, Homo sapien
ccgcagtaggatcatgtcgtacatg

SEQ ID NO: 200954 - DNA, 25 bp, Homo sapien
acagagcagcaagagaaagggcgca

SEQ ID NO: 200955 - DNA, 25 bp, Homo sapien
actgatgcgttaggacggctttcca

SEQ ID NO: 200956 - DNA, 25 bp, Homo sapien
ccagggctctctgtccgggagttcc

SEQ ID NO: 200957 - DNA, 25 bp, Homo sapien
actccagcagcctaggaggaagcgg

SEQ ID NO: 200958 - DNA, 25 bp, Homo sapien
aactcgtctccgcttttctgaaagc

SEQ ID NO: 200959 - DNA, 25 bp, Homo sapien
ttttctccagaagcgtgtgtgcgtg

SEQ ID NO: 200960 - DNA, 25 bp, Homo sapien
tgccaacttggccaacttcagggcc

SEQ ID NO: 200961 - DNA, 25 bp, Homo sapien
ttgcgggcggtcatcacagcccagc

SEQ ID NO: 200962 - DNA, 25 bp, Homo sapien
ccgcacggagaaatgaacaggtgtg

SEQ ID NO: 200963 - DNA, 25 bp, Homo sapien
cgcagaccgggcatttgtctagctg

SEQ ID NO: 200964 - DNA, 25 bp, Homo sapien
aatgaggttggatcgttggcccaga

SEQ ID NO: 200965 - DNA, 25 bp, Homo sapien
acaagtgatcgcgtggccacggcga

SEQ ID NO: 200966 - DNA, 25 bp, Homo sapien
agccagccgtcgttgtgaaaattcc

SEQ ID NO: 200967 - DNA, 25 bp, Homo sapien
aaggaagtggctcttgggctgttta

SEQ ID NO: 200968 - DNA, 25 bp, Homo sapien
ttccgcacctgcgttatggagtggt

SEQ ID NO: 200969 - DNA, 25 bp, Homo sapien
aattctgccctcagcggcctggtca

SEQ ID NO: 200970 - DNA, 25 bp, Homo sapien
atcgcgctgccctatgtgtgcaaga

SEQ ID NO: 200971 - DNA, 25 bp, Homo sapien
ctggttactgggtagaaggttcaag

SEQ ID NO: 200972 - DNA, 25 bp, Homo sapien
tagaaggttcaaggcgacgtgcacc

SEQ ID NO: 200973 - DNA, 25 bp, Homo sapien
aggcgacgtgcacccaggttagaaa

SEQ ID NO: 200974 - DNA, 25 bp, Homo sapien
aggcttcccgaactggctcaggctt

SEQ ID NO: 200975 - DNA, 25 bp, Homo sapien
agtgatccgcactgagtcctcgggc

SEQ ID NO: 200976 - DNA, 25 bp, Homo sapien
tgtgtgcaagaagaagcccaacgcc

SEQ ID NO: 200977 - DNA, 25 bp, Homo sapien
aggagaactgtggagtgatccgcac

SEQ ID NO: 200978 - DNA, 25 bp, Homo sapien
aggcctcttgttcacctgttccggg

SEQ ID NO: 200979 - DNA, 25 bp, Homo sapien
ccgacgacagccctcaaggtgagca

SEQ ID NO: 200980 - DNA, 25 bp, Homo sapien
ggtaagtcccgagaggcctgaatga

SEQ ID NO: 200981 - DNA, 25 bp, Homo sapien
cagccctgtttgcttccgtgtggga

SEQ ID NO: 200982 - DNA, 25 bp, Homo sapien
ccaggaggccgagtacaagttcttt

SEQ ID NO: 200983 - DNA, 25 bp, Homo sapien
gttctttgagcaccactccacgtgg

SEQ ID NO: 200984 - DNA, 25 bp, Homo sapien
taccacaatttcgaccggagccggc

SEQ ID NO: 200985 - DNA, 25 bp, Homo sapien
gccaggaattccagggagggtctcc

SEQ ID NO: 200986 - DNA, 25 bp, Homo sapien
accaccctagggatgttcttctgcc

SEQ ID NO: 200987 - DNA, 25 bp, Homo sapien
gcgcccgcgacacaaaggtctttta

SEQ ID NO: 200988 - DNA, 25 bp, Homo sapien
ttggcttctctagggtcgtaatctg

SEQ ID NO: 200989 - DNA, 25 bp, Homo sapien
tcttttaaagacctcgcagcgccct

SEQ ID NO: 200990 - DNA, 25 bp, Homo sapien
ctctccgggtctctgaaaatggtca

SEQ ID NO: 200991 - DNA, 25 bp, Homo sapien
aaaatggtcagttcggcttcgcagg

SEQ ID NO: 200992 - DNA, 25 bp, Homo sapien
gctgcgtgcccggaataataaattg

SEQ ID NO: 200993 - DNA, 25 bp, Homo sapien
cgtggcgactcttttcggagcacca

SEQ ID NO: 200994 - DNA, 25 bp, Homo sapien
tcccaagccagtcgtgggcgcccgc

SEQ ID NO: 200995 - DNA, 25 bp, Homo sapien
cgaccaggtgcagccgccgagagca

SEQ ID NO: 200996 - DNA, 25 bp, Homo sapien
tctttttgcttcttcactccctaca

SEQ ID NO: 200997 - DNA, 25 bp, Homo sapien
cgcccattaattgcgcggggacggc

SEQ ID NO: 200998 - DNA, 25 bp, Homo sapien
gagccgcccattaattgcgcgggga

SEQ ID NO: 200999 - DNA, 25 bp, Homo sapien
gcaggagccgcccattaattgcgcg

SEQ ID NO: 201000 - DNA, 25 bp, Homo sapien
gttacctgtgggtctgcccttcctc

SEQ ID NO: 201001 - DNA, 25 bp, Homo sapien
gccgttacctgtgggtctgcccttc

SEQ ID NO: 201002 - DNA, 25 bp, Homo sapien
tgacagggtcgttcgcctccacagc

SEQ ID NO: 201003 - DNA, 25 bp, Homo sapien
tcgcttcagtgacagggtcgttcgc

SEQ ID NO: 201004 - DNA, 25 bp, Homo sapien
gggaaggctggctccgaatatgaca

SEQ ID NO: 201005 - DNA, 25 bp, Homo sapien
ccgaatatgacaccaaggcgggctt

SEQ ID NO: 201006 - DNA, 25 bp, Homo sapien
gtcgccacttggctgtcaccgaaga

SEQ ID NO: 201007 - DNA, 25 bp, Homo sapien
gtcaccgaagatgtcatggaatttg

SEQ ID NO: 201008 - DNA, 25 bp, Homo sapien
tggaatttggtacctagagcgtctc

SEQ ID NO: 201009 - DNA, 25 bp, Homo sapien
cttgacccggaggtgcagagagccc

SEQ ID NO: 201010 - DNA, 25 bp, Homo sapien
cgggtcaagatgtagagcaccgccc

SEQ ID NO: 201011 - DNA, 25 bp, Homo sapien
agcctgcagtcctgaagacgcctca

SEQ ID NO: 201012 - DNA, 25 bp, Homo sapien
tcctgaagacgcctcagcaggggca

SEQ ID NO: 201013 - DNA, 25 bp, Homo sapien
tatctccctccgtcagcgtcttgaa

SEQ ID NO: 201014 - DNA, 25 bp, Homo sapien
ctccgtcagcgtcttgaagtccatg

SEQ ID NO: 201015 - DNA, 25 bp, Homo sapien
cagcgtcttgaagtccatggagagg

SEQ ID NO: 201016 - DNA, 25 bp, Homo sapien
cggcccgggtcaagatgtagagcac

SEQ ID NO: 201017 - DNA, 25 bp, Homo sapien
tgccagagccactctccggagcctg

SEQ ID NO: 201018 - DNA, 25 bp, Homo sapien
aggctcccgctggaagcagcgctcg

SEQ ID NO: 201019 - DNA, 25 bp, Homo sapien
ttgaactgcaggtcgctctcccagg

SEQ ID NO: 201020 - DNA, 25 bp, Homo sapien
tctcccaggcaatgccgcctcggta

SEQ ID NO: 201021 - DNA, 25 bp, Homo sapien
acgcgccggtcatggccaccaaggt

SEQ ID NO: 201022 - DNA, 25 bp, Homo sapien
cctccatgctgaggcaaacgctgca

SEQ ID NO: 201023 - DNA, 25 bp, Homo sapien
tgaggcaaacgctgcaagaaagagc

SEQ ID NO: 201024 - DNA, 25 bp, Homo sapien
cgcgttgaactgcaggtcgctctcc

SEQ ID NO: 201025 - DNA, 25 bp, Homo sapien
ccctagagactgcgcctgagatgcg

SEQ ID NO: 201026 - DNA, 25 bp, Homo sapien
ctgcagttctactcaggctggtgga

SEQ ID NO: 201027 - DNA, 25 bp, Homo sapien
tgcatttcctcgcagcctctcagtg

SEQ ID NO: 201028 - DNA, 25 bp, Homo sapien
ggactccttatttggcgtgacccga

SEQ ID NO: 201029 - DNA, 25 bp, Homo sapien
ggcagattttacagagcgcacctca

SEQ ID NO: 201030 - DNA, 25 bp, Homo sapien
ttgtgcctggcagctaacacgcccg

SEQ ID NO: 201031 - DNA, 25 bp, Homo sapien
cagctcagaactggcgacggcgttc

SEQ ID NO: 201032 - DNA, 25 bp, Homo sapien
cttcattcgcgacggctgcagttac

SEQ ID NO: 201033 - DNA, 25 bp, Homo sapien
gcgcacctcaaacgtacaagtcagt

SEQ ID NO: 201034 - DNA, 25 bp, Homo sapien
gggtctcggttctaacttcagcaga

SEQ ID NO: 201035 - DNA, 25 bp, Homo sapien
actagatgtcagacccggttcgggc

SEQ ID NO: 201036 - DNA, 25 bp, Homo sapien
gttggtccatttgcaccctaccttg

SEQ ID NO: 201037 - DNA, 25 bp, Homo sapien
ctaccttgctctagaacgcggcgca

SEQ ID NO: 201038 - DNA, 25 bp, Homo sapien
aacgcggcgcaggagcaaagatcca

SEQ ID NO: 201039 - DNA, 25 bp, Homo sapien
caaactcggggtcaccagcaagcgg

SEQ ID NO: 201040 - DNA, 25 bp, Homo sapien
caggaggccactagatgtcagaccc

SEQ ID NO: 201041 - DNA, 25 bp, Homo sapien
ggtcccgcgcttcctgattttctcg

SEQ ID NO: 201042 - DNA, 25 bp, Homo sapien
ggcacccaccgaagtagaagccttc

SEQ ID NO: 201043 - DNA, 25 bp, Homo sapien
atgagcagggctgcgatgtccccct

SEQ ID NO: 201044 - DNA, 25 bp, Homo sapien
cgctcgatggcgatgttcagcgccg

SEQ ID NO: 201045 - DNA, 25 bp, Homo sapien
ccaccgaagtagaagccttcgtgtt

SEQ ID NO: 201046 - DNA, 25 bp, Homo sapien
agaagccttcgtgttggtacttggg

SEQ ID NO: 201047 - DNA, 25 bp, Homo sapien
aagaaggcccccttggcgtgcgcgt

SEQ ID NO: 201048 - DNA, 25 bp, Homo sapien
gggcggcacccaccgaagtagaagc

SEQ ID NO: 201049 - DNA, 25 bp, Homo sapien
atggcgatgttcagcgccgtctgcc

SEQ ID NO: 201050 - DNA, 25 bp, Homo sapien
ttctaaagagaggaggccctttctc

SEQ ID NO: 201051 - DNA, 25 bp, Homo sapien
gcaggctcgggtgttccggcaaact

SEQ ID NO: 201052 - DNA, 25 bp, Homo sapien
ccagcatgcacgagttggatggatg

SEQ ID NO: 201053 - DNA, 25 bp, Homo sapien
atcaccgcggagaatgcaaggcgcc

SEQ ID NO: 201054 - DNA, 25 bp, Homo sapien
agctgggcgcacgacaccaacatca

SEQ ID NO: 201055 - DNA, 25 bp, Homo sapien
ctccagcgccgaacaggtgctgttc

SEQ ID NO: 201056 - DNA, 25 bp, Homo sapien
gcagagctacaactccagcgccgaa

SEQ ID NO: 201057 - DNA, 25 bp, Homo sapien
ccggcaacttttctgctgacgaggc

SEQ ID NO: 201058 - DNA, 25 bp, Homo sapien
cctcactgtggtggatctcatcgtg

SEQ ID NO: 201059 - DNA, 25 bp, Homo sapien
caccaatgatgaggtggtcagccac

SEQ ID NO: 201060 - DNA, 25 bp, Homo sapien
gcaccacctatgtcaacaccaatga

SEQ ID NO: 201061 - DNA, 25 bp, Homo sapien
catcatgttcgtcgtggacatcgtc

SEQ ID NO: 201062 - DNA, 25 bp, Homo sapien
cgtggggcctgcagctatacctgca

SEQ ID NO: 201063 - DNA, 25 bp, Homo sapien
agcgatcaggacgaatcacggcgtg

SEQ ID NO: 201064 - DNA, 25 bp, Homo sapien
tcctgctcagcgatcaggacgaatc

SEQ ID NO: 201065 - DNA, 25 bp, Homo sapien
cgtcgtggacatcgtcatcaacttc

SEQ ID NO: 201066 - DNA, 25 bp, Homo sapien
gctggaccgctactctgagtatggg

SEQ ID NO: 201067 - DNA, 25 bp, Homo sapien
gggcggctgtgctcttcttgctcat

SEQ ID NO: 201068 - DNA, 25 bp, Homo sapien
tacgccatcggcaatgtggagcggc

SEQ ID NO: 201069 - DNA, 25 bp, Homo sapien
gtggagcggccctacctagaacaca

SEQ ID NO: 201070 - DNA, 25 bp, Homo sapien
cctagaacacaagatcggctggctg

SEQ ID NO: 201071 - DNA, 25 bp, Homo sapien
ggtgtgcagcttggcaagcgctaca

SEQ ID NO: 201072 - DNA, 25 bp, Homo sapien
ttggcaagcgctacaacggcagcga

SEQ ID NO: 201073 - DNA, 25 bp, Homo sapien
cgcgtagcacggaagctggaccgct

SEQ ID NO: 201074 - DNA, 25 bp, Homo sapien
gctccatcgagatcctgcgcgacga

SEQ ID NO: 201075 - DNA, 25 bp, Homo sapien
acacgctggtgcacctcggcgacgt

SEQ ID NO: 201076 - DNA, 25 bp, Homo sapien
gcgcgctagccgtcaagttcaagac

SEQ ID NO: 201077 - DNA, 25 bp, Homo sapien
aggctgacatctgcctgcacctgca

SEQ ID NO: 201078 - DNA, 25 bp, Homo sapien
cagatgctgcgtgtcaaggagttca

SEQ ID NO: 201079 - DNA, 25 bp, Homo sapien
tgtccgcgatcatccagcgcctgta

SEQ ID NO: 201080 - DNA, 25 bp, Homo sapien
gtacgccagcatcttcgggaacgtg

SEQ ID NO: 201081 - DNA, 25 bp, Homo sapien
cgacgacgtggtcgtggccatccta

SEQ ID NO: 201082 - DNA, 25 bp, Homo sapien
gtcccgcgaaagtcagtaggtcttc

SEQ ID NO: 201083 - DNA, 25 bp, Homo sapien
tcagcgcaggtcacagacggtttca

SEQ ID NO: 201084 - DNA, 25 bp, Homo sapien
ctacaagtatgaagcgccctggaca

SEQ ID NO: 201085 - DNA, 25 bp, Homo sapien
ccctggacagtctacgcgatgaact

SEQ ID NO: 201086 - DNA, 25 bp, Homo sapien
gcagcttcgtggaggagtacaacaa

SEQ ID NO: 201087 - DNA, 25 bp, Homo sapien
tgagccgttatctgcctgactgaca

SEQ ID NO: 201088 - DNA, 25 bp, Homo sapien
cacggcaaacggaaggagatctaca

SEQ ID NO: 201089 - DNA, 25 bp, Homo sapien
gatttcagacgctacggccgcaata

SEQ ID NO: 201090 - DNA, 25 bp, Homo sapien
tccaaagtcaggcacatcaagggtc

SEQ ID NO: 201091 - DNA, 25 bp, Homo sapien
cgccgggcacaacaagtggtccaaa

SEQ ID NO: 201092 - DNA, 25 bp, Homo sapien
aggacgctgcactttaccgcggctg

SEQ ID NO: 201093 - DNA, 25 bp, Homo sapien
tggccgctgctgctagcagcttgaa

SEQ ID NO: 201094 - DNA, 25 bp, Homo sapien
gcccaagcctttggatctcaggtga

SEQ ID NO: 201095 - DNA, 25 bp, Homo sapien
accgtgcagccacggaacggacttt

SEQ ID NO: 201096 - DNA, 25 bp, Homo sapien
aaggaagtgtgctacgccatcaagg

SEQ ID NO: 201097 - DNA, 25 bp, Homo sapien
agggtcattagctgttgagccgccc

SEQ ID NO: 201098 - DNA, 25 bp, Homo sapien
ctgtcccgatgattggcaggcgcta

SEQ ID NO: 201099 - DNA, 25 bp, Homo sapien
gccaccatgggtaagtgtcgccacc

SEQ ID NO: 201100 - DNA, 25 bp, Homo sapien
gcggaggtgacactcacggacctta

SEQ ID NO: 201101 - DNA, 25 bp, Homo sapien
gctgcgcgaccagcggtttgttttt

SEQ ID NO: 201102 - DNA, 25 bp, Homo sapien
gctgatgattagctggccgctgaga

SEQ ID NO: 201103 - DNA, 25 bp, Homo sapien
aaaccgccttggcttcgcccattgg

SEQ ID NO: 201104 - DNA, 25 bp, Homo sapien
cctctacgtgattggctaacagcgc

SEQ ID NO: 201105 - DNA, 25 bp, Homo sapien
cgcccattggcatcctgtgagagta

SEQ ID NO: 201106 - DNA, 25 bp, Homo sapien
atcctactgggaggggacgagttca

SEQ ID NO: 201107 - DNA, 25 bp, Homo sapien
tcaagcgtttctggggcggaattct

SEQ ID NO: 201108 - DNA, 25 bp, Homo sapien
gagctgctgccgctaccagtggtcc

SEQ ID NO: 201109 - DNA, 25 bp, Homo sapien
cgccaccgccttatcgctgcaccgc

SEQ ID NO: 201110 - DNA, 25 bp, Homo sapien
cgcgctccgcatcctactgggaggg

SEQ ID NO: 201111 - DNA, 25 bp, Homo sapien
ctctgcaaccctgcgacgggctggg

SEQ ID NO: 201112 - DNA, 25 bp, Homo sapien
ccggtatgcgtggttcccggagcac

SEQ ID NO: 201113 - DNA, 25 bp, Homo sapien
cgaggctccacgtactcaagcgttt

SEQ ID NO: 201114 - DNA, 25 bp, Homo sapien
gccgtcccgcgcctgtgttcgttgt

SEQ ID NO: 201115 - DNA, 25 bp, Homo sapien
cgacggctcgttggagtctccgcac

SEQ ID NO: 201116 - DNA, 25 bp, Homo sapien
ggagtctccgcacggcttccttgat

SEQ ID NO: 201117 - DNA, 25 bp, Homo sapien
gtctccgcacggcttccttgatgag

SEQ ID NO: 201118 - DNA, 25 bp, Homo sapien
gtttcccgagagcacgagctgctgg

SEQ ID NO: 201119 - DNA, 25 bp, Homo sapien
gcttgggtccatcggcgctgctgca

SEQ ID NO: 201120 - DNA, 25 bp, Homo sapien
gcgtggggactgatttccgacctcc

SEQ ID NO: 201121 - DNA, 25 bp, Homo sapien
cccagcgtcaccgactgctgcagca

SEQ ID NO: 201122 - DNA, 25 bp, Homo sapien
tgcctgtcagcccaaagtgcgcggc

SEQ ID NO: 201123 - DNA, 25 bp, Homo sapien
agagcggttctcagttcccgttgtc

SEQ ID NO: 201124 - DNA, 25 bp, Homo sapien
accgggaggactgatagagcgctcc

SEQ ID NO: 201125 - DNA, 25 bp, Homo sapien
cctgttcctggagttagcaagcagc

SEQ ID NO: 201126 - DNA, 25 bp, Homo sapien
caggatggccgctccgacgaaggcc

SEQ ID NO: 201127 - DNA, 25 bp, Homo sapien
cgccactctgcctgaacaggacaaa

SEQ ID NO: 201128 - DNA, 25 bp, Homo sapien
aggcccaagcctattctgctctcgg

SEQ ID NO: 201129 - DNA, 25 bp, Homo sapien
tgaacaggacaaaccggcacccagc

SEQ ID NO: 201130 - DNA, 25 bp, Homo sapien
ccaactgcagtttcccgtcagagta

SEQ ID NO: 201131 - DNA, 25 bp, Homo sapien
ccgcggcctcgcttaacaaagagtc

SEQ ID NO: 201132 - DNA, 25 bp, Homo sapien
cctctaggacgcagccagaaccgta

SEQ ID NO: 201133 - DNA, 25 bp, Homo sapien
cctccgccgtccgttacgtagaatg

SEQ ID NO: 201134 - DNA, 25 bp, Homo sapien
ctccggaagctaaaggtggccatgc

SEQ ID NO: 201135 - DNA, 25 bp, Homo sapien
tctagatgggtcatgaacactgtcc

SEQ ID NO: 201136 - DNA, 25 bp, Homo sapien
cctcactgcgcatgtcgcgtttttg

SEQ ID NO: 201137 - DNA, 25 bp, Homo sapien
tggagctttaaggtcaggcgccttc

SEQ ID NO: 201138 - DNA, 25 bp, Homo sapien
ccgtcagccgtgacagcatgagtga

SEQ ID NO: 201139 - DNA, 25 bp, Homo sapien
ttgacgccctcacagttgcccgggt

SEQ ID NO: 201140 - DNA, 25 bp, Homo sapien
ctgcttgaccgcagggagaagctca

SEQ ID NO: 201141 - DNA, 25 bp, Homo sapien
acatcaggccaccagccaaggaggc

SEQ ID NO: 201142 - DNA, 25 bp, Homo sapien
atggccgacgtcaggagctgccaca

SEQ ID NO: 201143 - DNA, 25 bp, Homo sapien
tcagcccgtgactatgtgctcatgg

SEQ ID NO: 201144 - DNA, 25 bp, Homo sapien
tgaggtgctcaagtcagcccgtgac

SEQ ID NO: 201145 - DNA, 25 bp, Homo sapien
cccgggtcttcgttgatgatgccca

SEQ ID NO: 201146 - DNA, 25 bp, Homo sapien
gctggctccttcgtcagtactgaca

SEQ ID NO: 201147 - DNA, 25 bp, Homo sapien
cttgacggaccagagcaggtatggc

SEQ ID NO: 201148 - DNA, 25 bp, Homo sapien
gtctatatcatatcgcctctcggtc

SEQ ID NO: 201149 - DNA, 25 bp, Homo sapien
ctcggtcctcctaaaagtcgtatga

SEQ ID NO: 201150 - DNA, 25 bp, Homo sapien
acacctcgggcttgtagagcacttc

SEQ ID NO: 201151 - DNA, 25 bp, Homo sapien
cgaccggatctgctgtgtcagcgcc

SEQ ID NO: 201152 - DNA, 25 bp, Homo sapien
ccggaattcttctctgcctggtctt

SEQ ID NO: 201153 - DNA, 25 bp, Homo sapien
ggacgccagtcctttggctccgttc

SEQ ID NO: 201154 - DNA, 25 bp, Homo sapien
cttcacagtgaatgagccgttgcta

SEQ ID NO: 201155 - DNA, 25 bp, Homo sapien
gttgctactactctctcccggtata

SEQ ID NO: 201156 - DNA, 25 bp, Homo sapien
agtcgagttacccagaggcggctac

SEQ ID NO: 201157 - DNA, 25 bp, Homo sapien
tcctgcccgggagattccggatcca

SEQ ID NO: 201158 - DNA, 25 bp, Homo sapien
cacagacccggttcgggacagattc

SEQ ID NO: 201159 - DNA, 25 bp, Homo sapien
tccaagttcgcgagttcctcacaga

SEQ ID NO: 201160 - DNA, 25 bp, Homo sapien
ccgggacttggcgatcttaattccg

SEQ ID NO: 201161 - DNA, 25 bp, Homo sapien
cgtctcccggagttcctcatgcatt

SEQ ID NO: 201162 - DNA, 25 bp, Homo sapien
cctggcggtgtagaacaaacggtct

SEQ ID NO: 201163 - DNA, 25 bp, Homo sapien
gttttcctcatacagccgagctttg

SEQ ID NO: 201164 - DNA, 25 bp, Homo sapien
tattcagaagtggttatgcggcgcc

SEQ ID NO: 201165 - DNA, 25 bp, Homo sapien
tgcggcgccaaacacgcgctttctg

SEQ ID NO: 201166 - DNA, 25 bp, Homo sapien
tcccgtcgttgtagcttcctgctcg

SEQ ID NO: 201167 - DNA, 25 bp, Homo sapien
gccaaccctgctgagctttcgcgtg

SEQ ID NO: 201168 - DNA, 25 bp, Homo sapien
ggcgtcacgagtttctaggcagatc

SEQ ID NO: 201169 - DNA, 25 bp, Homo sapien
ctcacgtgtgttagggatcgtcctc

SEQ ID NO: 201170 - DNA, 25 bp, Homo sapien
agcgacatcatgagggcgaacagca

SEQ ID NO: 201171 - DNA, 25 bp, Homo sapien
cgaaggtctcgaagttgaacatatc

SEQ ID NO: 201172 - DNA, 25 bp, Homo sapien
ccaggcggatcacacggaacagcgt

SEQ ID NO: 201173 - DNA, 25 bp, Homo sapien
tgaacatatcatcgatgcccgactc

SEQ ID NO: 201174 - DNA, 25 bp, Homo sapien
catgccgaagatggagtagatgaac

SEQ ID NO: 201175 - DNA, 25 bp, Homo sapien
ccgactccttcttgacgtaggcaaa

SEQ ID NO: 201176 - DNA, 25 bp, Homo sapien
cgaacagcagcgtccggatgccctt

SEQ ID NO: 201177 - DNA, 25 bp, Homo sapien
ccgacgtggtgatctcgaacaggca

SEQ ID NO: 201178 - DNA, 25 bp, Homo sapien
tcatccgcaaggtttaccgaggcga

SEQ ID NO: 201179 - DNA, 25 bp, Homo sapien
ttcccggccctataagcgctgggtg

SEQ ID NO: 201180 - DNA, 25 bp, Homo sapien
tggctgggaaagaccggcaatgccc

SEQ ID NO: 201181 - DNA, 25 bp, Homo sapien
cgcgtcagacttcatcggggaaaag

SEQ ID NO: 201182 - DNA, 25 bp, Homo sapien
tccgccgtggtggaatcatccgcaa

SEQ ID NO: 201183 - DNA, 25 bp, Homo sapien
tccggagcgaaggtttcagcagcta

SEQ ID NO: 201184 - DNA, 25 bp, Homo sapien
cgagcctcagcggacgcagaactga

SEQ ID NO: 201185 - DNA, 25 bp, Homo sapien
gtgcctagaagcctccttttcgtct

SEQ ID NO: 201186 - DNA, 25 bp, Homo sapien
agccttccctgagtgtatcgcgcgc

SEQ ID NO: 201187 - DNA, 25 bp, Homo sapien
ccggcctgctgtgatgacattccaa

SEQ ID NO: 201188 - DNA, 25 bp, Homo sapien
gtgccttcgccgtgagttcgacata

SEQ ID NO: 201189 - DNA, 25 bp, Homo sapien
ggctgctaggctgggcaattttcca

SEQ ID NO: 201190 - DNA, 25 bp, Homo sapien
tcagcgctggtctgctcctttaaaa

SEQ ID NO: 201191 - DNA, 25 bp, Homo sapien
ccgcgagcgacaagaagtaacctga

SEQ ID NO: 201192 - DNA, 25 bp, Homo sapien
tgttttgccacgacaggcctcaatc

SEQ ID NO: 201193 - DNA, 25 bp, Homo sapien
ccatcagacgcgcagatttagttga

SEQ ID NO: 201194 - DNA, 25 bp, Homo sapien
taactgcggttctcgactttcaagc

SEQ ID NO: 201195 - DNA, 25 bp, Homo sapien
caccgtatggtttccgtgctcagca

SEQ ID NO: 201196 - DNA, 25 bp, Homo sapien
ccgttttcctctagtttgcgcgtga

SEQ ID NO: 201197 - DNA, 25 bp, Homo sapien
ccgctggctgcctcattgtactatg

SEQ ID NO: 201198 - DNA, 25 bp, Homo sapien
agactgctcacccaagatccgctgg

SEQ ID NO: 201199 - DNA, 25 bp, Homo sapien
tttcaagcatttcgcgtcgccggtg

SEQ ID NO: 201200 - DNA, 25 bp, Homo sapien
ggcctcagcccaatgtcacttgtta

SEQ ID NO: 201201 - DNA, 25 bp, Homo sapien
cggggcgcatacaacctctgacaga

SEQ ID NO: 201202 - DNA, 25 bp, Homo sapien
ccagggacgtagaaacacgctcaga

SEQ ID NO: 201203 - DNA, 25 bp, Homo sapien
gaacccacgtggataccctgtagcc

SEQ ID NO: 201204 - DNA, 25 bp, Homo sapien
gggtctcaacccagctacctgacgg

SEQ ID NO: 201205 - DNA, 25 bp, Homo sapien
gctgagacaccagaaggcaactttc

SEQ ID NO: 201206 - DNA, 25 bp, Homo sapien
ggcaactttcccgagcgacccatgt

SEQ ID NO: 201207 - DNA, 25 bp, Homo sapien
agcgacccatgttgactaagccgtg

SEQ ID NO: 201208 - DNA, 25 bp, Homo sapien
ccgtggcgaggaatgagcttaaatg

SEQ ID NO: 201209 - DNA, 25 bp, Homo sapien
taaatgaccggcttccagggacgta

SEQ ID NO: 201210 - DNA, 25 bp, Homo sapien
tggggctactcctttccgtcaacag

SEQ ID NO: 201211 - DNA, 25 bp, Homo sapien
tgcgacttcacatgccctcctttgg

SEQ ID NO: 201212 - DNA, 25 bp, Homo sapien
acaggcacctgcagaccttatggca

SEQ ID NO: 201213 - DNA, 25 bp, Homo sapien
tgacggctacacgagagcgcatctc

SEQ ID NO: 201214 - DNA, 25 bp, Homo sapien
gcgcatctctctccgaagttaaaga

SEQ ID NO: 201215 - DNA, 25 bp, Homo sapien
acaagccaccactaccgttaacaga

SEQ ID NO: 201216 - DNA, 25 bp, Homo sapien
cgttaacagaatccggagaggccac

SEQ ID NO: 201217 - DNA, 25 bp, Homo sapien
tggttctctgctagcttgccgttcg

SEQ ID NO: 201218 - DNA, 25 bp, Homo sapien
caccctcgccactcggagatgttta

SEQ ID NO: 201219 - DNA, 25 bp, Homo sapien
gccgcggtctcggtcactcgaataa

SEQ ID NO: 201220 - DNA, 25 bp, Homo sapien
gagccctcacgtctgtaaccaaaag

SEQ ID NO: 201221 - DNA, 25 bp, Homo sapien
gcggtccgcactactttcccgttga

SEQ ID NO: 201222 - DNA, 25 bp, Homo sapien
gacccgcgtgtctgataatcctttg

SEQ ID NO: 201223 - DNA, 25 bp, Homo sapien
cggcggagaatggtctctaaacttc

SEQ ID NO: 201224 - DNA, 25 bp, Homo sapien
agccgcttttatagtctggaccgcc

SEQ ID NO: 201225 - DNA, 25 bp, Homo sapien
tgggagccgctctatgacctaatcg

SEQ ID NO: 201226 - DNA, 25 bp, Homo sapien
ccctggcgggcaccggcagtcaggg

SEQ ID NO: 201227 - DNA, 25 bp, Homo sapien
tctcgtctcggcgaggcccagtagc

SEQ ID NO: 201228 - DNA, 25 bp, Homo sapien
tcgtctcggcgaggcccagtagccg

SEQ ID NO: 201229 - DNA, 25 bp, Homo sapien
cgtctcggcgaggcccagtagccga

SEQ ID NO: 201230 - DNA, 25 bp, Homo sapien
gcagaactctgggctcggccgcttc

SEQ ID NO: 201231 - DNA, 25 bp, Homo sapien
gggcaccggcagtcagggagggtgt

SEQ ID NO: 201232 - DNA, 25 bp, Homo sapien
gagcagaactctgggctcggccgct

SEQ ID NO: 201233 - DNA, 25 bp, Homo sapien
tcccacgcggaacgctgggagggag

SEQ ID NO: 201234 - DNA, 25 bp, Homo sapien
cggcctattctcattctcccggaaa

SEQ ID NO: 201235 - DNA, 25 bp, Homo sapien
tggctaacagctcggggctcgaaca

SEQ ID NO: 201236 - DNA, 25 bp, Homo sapien
ggccatcctgccacgtgaccaggtg

SEQ ID NO: 201237 - DNA, 25 bp, Homo sapien
ggaattcgctgctacatcggccatc

SEQ ID NO: 201238 - DNA, 25 bp, Homo sapien
agcccgtggccacactgagatgaga

SEQ ID NO: 201239 - DNA, 25 bp, Homo sapien
cagaagatggttgcacagccgaagc

SEQ ID NO: 201240 - DNA, 25 bp, Homo sapien
cacccgagtgaaagtgcagttgccc

SEQ ID NO: 201241 - DNA, 25 bp, Homo sapien
gtgcagttgcccgtaccgatatttc

SEQ ID NO: 201242 - DNA, 25 bp, Homo sapien
aaacaggaaccagccgcggtctcca

SEQ ID NO: 201243 - DNA, 25 bp, Homo sapien
cgggcaggcaccgtcccaccgtcac

SEQ ID NO: 201244 - DNA, 25 bp, Homo sapien
tgcaggagccagagtgaaggcggcg

SEQ ID NO: 201245 - DNA, 25 bp, Homo sapien
cgtcccaccgtcactaggacagaga

SEQ ID NO: 201246 - DNA, 25 bp, Homo sapien
caccgtcactaggacagagaatgtg

SEQ ID NO: 201247 - DNA, 25 bp, Homo sapien
ccaccgtcactaggacagagaatgt

SEQ ID NO: 201248 - DNA, 25 bp, Homo sapien
cccaccgtcactaggacagagaatg

SEQ ID NO: 201249 - DNA, 25 bp, Homo sapien
gtcccaccgtcactaggacagagaa

SEQ ID NO: 201250 - DNA, 25 bp, Homo sapien
gtgtccccaagagagtggcccctgg

SEQ ID NO: 201251 - DNA, 25 bp, Homo sapien
gagagcttaactaaatctgccggcg

SEQ ID NO: 201252 - DNA, 25 bp, Homo sapien
gagcttaactaaatctgccggcgcc

SEQ ID NO: 201253 - DNA, 25 bp, Homo sapien
aggaaagggtatacacttgagtcac

SEQ ID NO: 201254 - DNA, 25 bp, Homo sapien
gaaagggtatacacttgagtcacta

SEQ ID NO: 201255 - DNA, 25 bp, Homo sapien
cttccgaggtggtgccggagaggtt

SEQ ID NO: 201256 - DNA, 25 bp, Homo sapien
ctacagtgtccccaagagagtggcc

SEQ ID NO: 201257 - DNA, 25 bp, Homo sapien
agcttaactaaatctgccggcgccc

SEQ ID NO: 201258 - DNA, 25 bp, Homo sapien
gctgagcagcctacgagcctgggac

SEQ ID NO: 201259 - DNA, 25 bp, Homo sapien
gtgagctgagcagcctacgagcctg

SEQ ID NO: 201260 - DNA, 25 bp, Homo sapien
gcccggcctgcggaagcggttggag

SEQ ID NO: 201261 - DNA, 25 bp, Homo sapien
acgtgagctgagcagcctacgagcc

SEQ ID NO: 201262 - DNA, 25 bp, Homo sapien
tcacgtgagctgagcagcctacgag

SEQ ID NO: 201263 - DNA, 25 bp, Homo sapien
tgccgcgagcggaaccccggatggg

SEQ ID NO: 201264 - DNA, 25 bp, Homo sapien
agcagcctacgagcctgggacgggg

SEQ ID NO: 201265 - DNA, 25 bp, Homo sapien
ctgagcagcctacgagcctgggacg

SEQ ID NO: 201266 - DNA, 25 bp, Homo sapien
tcgcggtcctgactttccaaggctg

SEQ ID NO: 201267 - DNA, 25 bp, Homo sapien
cccgcagctgcctgcttcgatttta

SEQ ID NO: 201268 - DNA, 25 bp, Homo sapien
cagggccggctatagcggtcccgca

SEQ ID NO: 201269 - DNA, 25 bp, Homo sapien
ggacagcgacgcgtttcctgcccgg

SEQ ID NO: 201270 - DNA, 25 bp, Homo sapien
acgccaggggaagccaagcgaccga

SEQ ID NO: 201271 - DNA, 25 bp, Homo sapien
acgcagcagtggaggaggttaccct

SEQ ID NO: 201272 - DNA, 25 bp, Homo sapien
aggcaggcctgcacggcacgcagca

SEQ ID NO: 201273 - DNA, 25 bp, Homo sapien
cctgcttcgattttagcactgctgc

SEQ ID NO: 201274 - DNA, 25 bp, Homo sapien
gctccctggggcagtcacccaaagg

SEQ ID NO: 201275 - DNA, 25 bp, Homo sapien
cgctccatcgcacacgctctctggg

SEQ ID NO: 201276 - DNA, 25 bp, Homo sapien
ccctgagcgcgccagagctggagtt

SEQ ID NO: 201277 - DNA, 25 bp, Homo sapien
gcggctcgccttttcctgagtagag

SEQ ID NO: 201278 - DNA, 25 bp, Homo sapien
ccttttcctgagtagagggtcacga

SEQ ID NO: 201279 - DNA, 25 bp, Homo sapien
tggttctccagagccacagacgcgc

SEQ ID NO: 201280 - DNA, 25 bp, Homo sapien
ctggggcagtcacccaaaggacttt

SEQ ID NO: 201281 - DNA, 25 bp, Homo sapien
ccgcaggttgtcgtacagccgcggc

SEQ ID NO: 201282 - DNA, 25 bp, Homo sapien
catgtggccacatgtgtgacaggtc

SEQ ID NO: 201283 - DNA, 25 bp, Homo sapien
tccctcgggctccatccctcgttcg

SEQ ID NO: 201284 - DNA, 25 bp, Homo sapien
ccgccagtccctcgggctccatccc

SEQ ID NO: 201285 - DNA, 25 bp, Homo sapien
acatgtgtgacaggtcccgccagtc

SEQ ID NO: 201286 - DNA, 25 bp, Homo sapien
tggccacatgtgtgacaggtcccgc

SEQ ID NO: 201287 - DNA, 25 bp, Homo sapien
cgtgcatgtggccacatgtgtgaca

SEQ ID NO: 201288 - DNA, 25 bp, Homo sapien
cccacgtgcatgtggccacatgtgt

SEQ ID NO: 201289 - DNA, 25 bp, Homo sapien
gccacatgtgtgacaggtcccgcca

SEQ ID NO: 201290 - DNA, 25 bp, Homo sapien
tgctaatcccagtcggtgccgcatc

SEQ ID NO: 201291 - DNA, 25 bp, Homo sapien
acgcatgcgctctgccgtgccgaag

SEQ ID NO: 201292 - DNA, 25 bp, Homo sapien
gatgcagcgcatgcgcacacctgga

SEQ ID NO: 201293 - DNA, 25 bp, Homo sapien
gctgctactccggaatctgctaatc

SEQ ID NO: 201294 - DNA, 25 bp, Homo sapien
ggccgcctacaaactggtgctgatc

SEQ ID NO: 201295 - DNA, 25 bp, Homo sapien
cgcatggaacctggagaaccgcttc

SEQ ID NO: 201296 - DNA, 25 bp, Homo sapien
cttcagcggctggtacgacgccgac

SEQ ID NO: 201297 - DNA, 25 bp, Homo sapien
cggtccagagcgagtggaaagattt

SEQ ID NO: 201298 - DNA, 25 bp, Homo sapien
acaggcatttgtcgatctccttgga

SEQ ID NO: 201299 - DNA, 25 bp, Homo sapien
ggtcttttcccgagacaggcatttg

SEQ ID NO: 201300 - DNA, 25 bp, Homo sapien
ccagccgcttcacataggtcttttc

SEQ ID NO: 201301 - DNA, 25 bp, Homo sapien
gatccgcatctgcttcaggaaggtg

SEQ ID NO: 201302 - DNA, 25 bp, Homo sapien
agtcctgcccgtggatgatccgcat

SEQ ID NO: 201303 - DNA, 25 bp, Homo sapien
cggcacctttgatcacgttgctgta

SEQ ID NO: 201304 - DNA, 25 bp, Homo sapien
gttccttcgccagcgacacagcgga

SEQ ID NO: 201305 - DNA, 25 bp, Homo sapien
cggcgagtcacgagctcgatgtgtc

SEQ ID NO: 201306 - DNA, 25 bp, Homo sapien
cgtgaatccatccaggcgccaggag

SEQ ID NO: 201307 - DNA, 25 bp, Homo sapien
taccaaggccggcagtacaggctga

SEQ ID NO: 201308 - DNA, 25 bp, Homo sapien
aggagatgacaatccggtaccaagg

SEQ ID NO: 201309 - DNA, 25 bp, Homo sapien
ctttccaagttggaggcgcctagtg

SEQ ID NO: 201310 - DNA, 25 bp, Homo sapien
taaggctcgccctctgccacacatc

SEQ ID NO: 201311 - DNA, 25 bp, Homo sapien
tggtgcggtctaaggctcgccctct

SEQ ID NO: 201312 - DNA, 25 bp, Homo sapien
ccaggccttagtggtgcggtctaag

SEQ ID NO: 201313 - DNA, 25 bp, Homo sapien
atccggtaccaaggccggcagtaca

SEQ ID NO: 201314 - DNA, 25 bp, Homo sapien
cgatctcgaggtagcacttaggcga

SEQ ID NO: 201315 - DNA, 25 bp, Homo sapien
cccagagtcggcattaggggttcgc

SEQ ID NO: 201316 - DNA, 25 bp, Homo sapien
ctctggcgcaaaggaaagtgaactc

SEQ ID NO: 201317 - DNA, 25 bp, Homo sapien
ctcagtgcactcaggacgctgtctg

SEQ ID NO: 201318 - DNA, 25 bp, Homo sapien
catctctatggtctgggcgtcgagc

SEQ ID NO: 201319 - DNA, 25 bp, Homo sapien
atccggaggtttccgcatctctatg

SEQ ID NO: 201320 - DNA, 25 bp, Homo sapien
ggcttgtctcttcgcgatccctttc

SEQ ID NO: 201321 - DNA, 25 bp, Homo sapien
tgagcccgcatttcctctctaggaa

SEQ ID NO: 201322 - DNA, 25 bp, Homo sapien
tcagcggcgcctagtgagagtcagg

SEQ ID NO: 201323 - DNA, 25 bp, Homo sapien
agtcagcggcgcctagtgagagtca

SEQ ID NO: 201324 - DNA, 25 bp, Homo sapien
tccaagtcagcggcgcctagtgaga

SEQ ID NO: 201325 - DNA, 25 bp, Homo sapien
agctgctttccaagtcagcggcgcc

SEQ ID NO: 201326 - DNA, 25 bp, Homo sapien
ctttccaagtcagcggcgcctagtg

SEQ ID NO: 201327 - DNA, 25 bp, Homo sapien
gctttccaagtcagcggcgcctagt

SEQ ID NO: 201328 - DNA, 25 bp, Homo sapien
gctgctttccaagtcagcggcgcct

SEQ ID NO: 201329 - DNA, 25 bp, Homo sapien
agcggcgcctagtgagagtcagggg

SEQ ID NO: 201330 - DNA, 25 bp, Homo sapien
agctgcgctctgtccgtctaagacg

SEQ ID NO: 201331 - DNA, 25 bp, Homo sapien
cttcacagatgtggtgcccaggtca

SEQ ID NO: 201332 - DNA, 25 bp, Homo sapien
ggggagtcgcctgccaatctttcag

SEQ ID NO: 201333 - DNA, 25 bp, Homo sapien
atggaggcttctcgtcttcccactg

SEQ ID NO: 201334 - DNA, 25 bp, Homo sapien
cgggctctgatttccgcccaatgga

SEQ ID NO: 201335 - DNA, 25 bp, Homo sapien
ggcggtctgagcttcgctcacgaaa

SEQ ID NO: 201336 - DNA, 25 bp, Homo sapien
caagagtctctgtgtccctggcagc

SEQ ID NO: 201337 - DNA, 25 bp, Homo sapien
accttctgctcagttgccgcctggg

SEQ ID NO: 201338 - DNA, 25 bp, Homo sapien
tgacacgaaagacccatgcacctgc

SEQ ID NO: 201339 - DNA, 25 bp, Homo sapien
cgggactcctagaatcagacaattc

SEQ ID NO: 201340 - DNA, 25 bp, Homo sapien
ctgccgccctcttagaaactaaatg

SEQ ID NO: 201341 - DNA, 25 bp, Homo sapien
aaatgcctgtaatgcggctcccacc

SEQ ID NO: 201342 - DNA, 25 bp, Homo sapien
ggcacttacccaaactgctcgctgg

SEQ ID NO: 201343 - DNA, 25 bp, Homo sapien
ccttggagtggcttttgcatttcga

SEQ ID NO: 201344 - DNA, 25 bp, Homo sapien
gcttcgtcgtctgcttggtcacaaa

SEQ ID NO: 201345 - DNA, 25 bp, Homo sapien
ctccgtgcctttcccattgcgtttg

SEQ ID NO: 201346 - DNA, 25 bp, Homo sapien
ggctgctcgggacttttatgcgcta

SEQ ID NO: 201347 - DNA, 25 bp, Homo sapien
tgctcgggacttttatgcgctagcg

SEQ ID NO: 201348 - DNA, 25 bp, Homo sapien
tccacgggggtcatctccttgggca

SEQ ID NO: 201349 - DNA, 25 bp, Homo sapien
gtgggttctctacaggacgtggaaa

SEQ ID NO: 201350 - DNA, 25 bp, Homo sapien
tctctacaggacgtggaaaggaaag

SEQ ID NO: 201351 - DNA, 25 bp, Homo sapien
aggcgctgtgcaccgcaaacccatg

SEQ ID NO: 201352 - DNA, 25 bp, Homo sapien
acccatgttcgggtgtagagtggat

SEQ ID NO: 201353 - DNA, 25 bp, Homo sapien
ccgcaaacccatgttcgggtgtaga

SEQ ID NO: 201354 - DNA, 25 bp, Homo sapien
cgccgtttgcagaggcgcccgcaga

SEQ ID NO: 201355 - DNA, 25 bp, Homo sapien
ccaaatgcaactgaacgcctccaga

SEQ ID NO: 201356 - DNA, 25 bp, Homo sapien
ccagaaatggcgacgcgcggagtct

SEQ ID NO: 201357 - DNA, 25 bp, Homo sapien
ggagtctctgcctctccgcaaaagg

SEQ ID NO: 201358 - DNA, 25 bp, Homo sapien
atccataaccgcgacagcgacgcga

SEQ ID NO: 201359 - DNA, 25 bp, Homo sapien
gccactcggataagtctcctctctg

SEQ ID NO: 201360 - DNA, 25 bp, Homo sapien
tagccggcctgccaacttcaaaggg

SEQ ID NO: 201361 - DNA, 25 bp, Homo sapien
agcagcagcctagtccagaaatggc

SEQ ID NO: 201362 - DNA, 25 bp, Homo sapien
agaactgcaagcaagcagatttttt

SEQ ID NO: 201363 - DNA, 25 bp, Homo sapien
tatggccatcgcaagaactgcaagc

SEQ ID NO: 201364 - DNA, 25 bp, Homo sapien
tggtagcattatggccatcgcaaga

SEQ ID NO: 201365 - DNA, 25 bp, Homo sapien
caacagtttctggtagcattatggc

SEQ ID NO: 201366 - DNA, 25 bp, Homo sapien
cccggctctggaatgcaacagtttc

SEQ ID NO: 201367 - DNA, 25 bp, Homo sapien
tttaagttctccggcctctttgctc

SEQ ID NO: 201368 - DNA, 25 bp, Homo sapien
gcccgagttctgatttcttctttta

SEQ ID NO: 201369 - DNA, 25 bp, Homo sapien
ccgagggcattctcagcccgagttc

SEQ ID NO: 201370 - DNA, 25 bp, Homo sapien
cgcagagtcgcttatgatcacctta

SEQ ID NO: 201371 - DNA, 25 bp, Homo sapien
caaacccttgggtcagactcttgga

SEQ ID NO: 201372 - DNA, 25 bp, Homo sapien
tggaccacgtcagaccgatcaaacc

SEQ ID NO: 201373 - DNA, 25 bp, Homo sapien
accggctgatcaaactttacttaga

SEQ ID NO: 201374 - DNA, 25 bp, Homo sapien
caccggcgcaaaattccactcaaga

SEQ ID NO: 201375 - DNA, 25 bp, Homo sapien
cagtcgaagcttccgggataacccg

SEQ ID NO: 201376 - DNA, 25 bp, Homo sapien
cacagtttgaatgctgctgccctcc

SEQ ID NO: 201377 - DNA, 25 bp, Homo sapien
acagatttcctctcccagtcgcaaa

SEQ ID NO: 201378 - DNA, 25 bp, Homo sapien
cacttaccggggatgcagtatctca

SEQ ID NO: 201379 - DNA, 25 bp, Homo sapien
cgagcgcaccttccgagcaatcgtt

SEQ ID NO: 201380 - DNA, 25 bp, Homo sapien
cagttccgcagtaagacacgtgtca

SEQ ID NO: 201381 - DNA, 25 bp, Homo sapien
tatctcacaggtggcgccatgattg

SEQ ID NO: 201382 - DNA, 25 bp, Homo sapien
actctgtacgggaagcgctcactta

SEQ ID NO: 201383 - DNA, 25 bp, Homo sapien
cccagaagctgtaggccgtttagcc

SEQ ID NO: 201384 - DNA, 25 bp, Homo sapien
ctcctccaagttacacagacgttcg

SEQ ID NO: 201385 - DNA, 25 bp, Homo sapien
ttgccgctgtcccaaaaccaggatg

SEQ ID NO: 201386 - DNA, 25 bp, Homo sapien
agtccgaactcttcgcccggagtga

SEQ ID NO: 201387 - DNA, 25 bp, Homo sapien
atggctgacgttttcccgggcaacg

SEQ ID NO: 201388 - DNA, 25 bp, Homo sapien
gcaacgactccacggcgtctcagga

SEQ ID NO: 201389 - DNA, 25 bp, Homo sapien
aacgtgcacgaggtgaaggaccaca

SEQ ID NO: 201390 - DNA, 25 bp, Homo sapien
ggaccacaaattcatcgcgcgcttc

SEQ ID NO: 201391 - DNA, 25 bp, Homo sapien
ctctgccgccgcgagtaggaagcgc

SEQ ID NO: 201392 - DNA, 25 bp, Homo sapien
gggctggctcactccgataacttgg

SEQ ID NO: 201393 - DNA, 25 bp, Homo sapien
ccgacttcatctggtaggtgccggg

SEQ ID NO: 201394 - DNA, 25 bp, Homo sapien
ctggagagccctagcgatcgcgcac

SEQ ID NO: 201395 - DNA, 25 bp, Homo sapien
gaccgggagagaccacctcttccat

SEQ ID NO: 201396 - DNA, 25 bp, Homo sapien
gaagaccgggagagaccacctcttc

SEQ ID NO: 201397 - DNA, 25 bp, Homo sapien
acggtcattggcgccgagcggttcc

SEQ ID NO: 201398 - DNA, 25 bp, Homo sapien
cagccggcgagggacattggaccag

SEQ ID NO: 201399 - DNA, 25 bp, Homo sapien
cagcctagcgcggtacctcccgccc

SEQ ID NO: 201400 - DNA, 25 bp, Homo sapien
tcccgggcagcctagcgcggtacct

SEQ ID NO: 201401 - DNA, 25 bp, Homo sapien
ctagcgatcgcgcaccctggaaggg

SEQ ID NO: 201402 - DNA, 25 bp, Homo sapien
aaccggtgtctgtgctattgctatg

SEQ ID NO: 201403 - DNA, 25 bp, Homo sapien
tgtgctgcatcgaaggtacggccag

SEQ ID NO: 201404 - DNA, 25 bp, Homo sapien
ttcgcggccagctgtacatcagctc

SEQ ID NO: 201405 - DNA, 25 bp, Homo sapien
accgaaactcaagcacgcgcgcgta

SEQ ID NO: 201406 - DNA, 25 bp, Homo sapien
gcgctttctacaggctcgggctgag

SEQ ID NO: 201407 - DNA, 25 bp, Homo sapien
ctgcggagacctcagtaggaaacta

SEQ ID NO: 201408 - DNA, 25 bp, Homo sapien
ccgatctgcggaccgggaacagact

SEQ ID NO: 201409 - DNA, 25 bp, Homo sapien
gtacatcagctctggtccctctcgg

SEQ ID NO: 201410 - DNA, 25 bp, Homo sapien
cacttcggcctctggcggatttgta

SEQ ID NO: 201411 - DNA, 25 bp, Homo sapien
tggagcaccacaacactacctgcga

SEQ ID NO: 201412 - DNA, 25 bp, Homo sapien
tggtaaccgaccactgggctgtgct

SEQ ID NO: 201413 - DNA, 25 bp, Homo sapien
tgctggccatgacagccgtggtaac

SEQ ID NO: 201414 - DNA, 25 bp, Homo sapien
cttctgcatcctggcaggcatcgtg

SEQ ID NO: 201415 - DNA, 25 bp, Homo sapien
ccaaaatgctgaaggtccgcgtgac

SEQ ID NO: 201416 - DNA, 25 bp, Homo sapien
gacagcaagacctgcgggcccatca

SEQ ID NO: 201417 - DNA, 25 bp, Homo sapien
ctggcggatttgtaccaagcgcatc

SEQ ID NO: 201418 - DNA, 25 bp, Homo sapien
ccgggctgacggcattgaaaattca

SEQ ID NO: 201419 - DNA, 25 bp, Homo sapien
gggtaacgtgatccgcgaccctcta

SEQ ID NO: 201420 - DNA, 25 bp, Homo sapien
ccctaggaatgtggctccaggctcc

SEQ ID NO: 201421 - DNA, 25 bp, Homo sapien
gccatcttggatccacttgtcaacg

SEQ ID NO: 201422 - DNA, 25 bp, Homo sapien
gagctgctcgcggatttatttgtgc

SEQ ID NO: 201423 - DNA, 25 bp, Homo sapien
gtcattactttctacgccatcttgg

SEQ ID NO: 201424 - DNA, 25 bp, Homo sapien
ctgcattgaatcaacccgaggtttc

SEQ ID NO: 201425 - DNA, 25 bp, Homo sapien
gtccaccagcgtcgaagcacgattt

SEQ ID NO: 201426 - DNA, 25 bp, Homo sapien
tctcctcggcgtctttggaagatcc

SEQ ID NO: 201427 - DNA, 25 bp, Homo sapien
ggcatttcttccactgcccgtctga

SEQ ID NO: 201428 - DNA, 25 bp, Homo sapien
cagctccgcgttgttccgcgagaaa

SEQ ID NO: 201429 - DNA, 25 bp, Homo sapien
ttcgatgctctgtcaacctgcttgg

SEQ ID NO: 201430 - DNA, 25 bp, Homo sapien
tgtaggacatctcgaccctgctctg

SEQ ID NO: 201431 - DNA, 25 bp, Homo sapien
tcgcgccctcgctgcttaacaaagg

SEQ ID NO: 201432 - DNA, 25 bp, Homo sapien
tcccggcagtcttccgagcaagatg

SEQ ID NO: 201433 - DNA, 25 bp, Homo sapien
cccgtctgagggaacgctaagtagt

SEQ ID NO: 201434 - DNA, 25 bp, Homo sapien
agtccacctccatcttgacgatgcg

SEQ ID NO: 201435 - DNA, 25 bp, Homo sapien
gacctggggtctcccactcgtgcag

SEQ ID NO: 201436 - DNA, 25 bp, Homo sapien
ctcgtgcaggcccaactagggctgg

SEQ ID NO: 201437 - DNA, 25 bp, Homo sapien
cccaactagggctggacaggcattg

SEQ ID NO: 201438 - DNA, 25 bp, Homo sapien
gaggcctaagcaggctccgcgccgt

SEQ ID NO: 201439 - DNA, 25 bp, Homo sapien
accttggctagcttcgcacactcgg

SEQ ID NO: 201440 - DNA, 25 bp, Homo sapien
cacactcgggtaggcgctgatccac

SEQ ID NO: 201441 - DNA, 25 bp, Homo sapien
agcccatcgggagcccacgcaaagg

SEQ ID NO: 201442 - DNA, 25 bp, Homo sapien
caggaaatcttgtttaccgcccgcg

SEQ ID NO: 201443 - DNA, 25 bp, Homo sapien
tgactttgcaacaccgcgttccggg

SEQ ID NO: 201444 - DNA, 25 bp, Homo sapien
agccgatcgagcctttgtctggaaa

SEQ ID NO: 201445 - DNA, 25 bp, Homo sapien
cggctgcaatgtgttcctggtgaca

SEQ ID NO: 201446 - DNA, 25 bp, Homo sapien
catgctgctgaaagagtaccggatc

SEQ ID NO: 201447 - DNA, 25 bp, Homo sapien
atctgcatgccgctcaccgtagacg

SEQ ID NO: 201448 - DNA, 25 bp, Homo sapien
cagactgttggggatcactatgagc

SEQ ID NO: 201449 - DNA, 25 bp, Homo sapien
ggggatttgcggcttccacttgtca

SEQ ID NO: 201450 - DNA, 25 bp, Homo sapien
agcggcaggacagtcatcctctata

SEQ ID NO: 201451 - DNA, 25 bp, Homo sapien
acagaccagtttctagtgacagaca

SEQ ID NO: 201452 - DNA, 25 bp, Homo sapien
cgctggaggaagaattcacgttgtc

SEQ ID NO: 201453 - DNA, 25 bp, Homo sapien
gcggccgtacttaggtttgctcaaa

SEQ ID NO: 201454 - DNA, 25 bp, Homo sapien
ggcccgttcattctcgcgagagaaa

SEQ ID NO: 201455 - DNA, 25 bp, Homo sapien
caggttcctggtttggcaagcactc

SEQ ID NO: 201456 - DNA, 25 bp, Homo sapien
tatcccttcctggagcacatccggg

SEQ ID NO: 201457 - DNA, 25 bp, Homo sapien
ttcaggacccagtaagcagcacttc

SEQ ID NO: 201458 - DNA, 25 bp, Homo sapien
ttggagtcattttctggactccagc

SEQ ID NO: 201459 - DNA, 25 bp, Homo sapien
tggactccagctccatgcttcagag

SEQ ID NO: 201460 - DNA, 25 bp, Homo sapien
cagctccatgcttcagagtttccta

SEQ ID NO: 201461 - DNA, 25 bp, Homo sapien
cttcagagtttcctaagttcagggg

SEQ ID NO: 201462 - DNA, 25 bp, Homo sapien
ccctcgactaatttccctctgtcgc

SEQ ID NO: 201463 - DNA, 25 bp, Homo sapien
catcagtttccatagggggagggaa

SEQ ID NO: 201464 - DNA, 25 bp, Homo sapien
acctgcgcccggagttttgccgcgc

SEQ ID NO: 201465 - DNA, 25 bp, Homo sapien
agcagttgtcattggagtcattttc

SEQ ID NO: 201466 - DNA, 25 bp, Homo sapien
ccaagggctccttgcggaagttcct

SEQ ID NO: 201467 - DNA, 25 bp, Homo sapien
gaagttcctggagcacctctccggg

SEQ ID NO: 201468 - DNA, 25 bp, Homo sapien
tggcggtaggaacctccatccggaa

SEQ ID NO: 201469 - DNA, 25 bp, Homo sapien
ccatccggaagatcagtgagttttc

SEQ ID NO: 201470 - DNA, 25 bp, Homo sapien
tgttttaaatggaacctggcagagg

SEQ ID NO: 201471 - DNA, 25 bp, Homo sapien
gtcgttctgcctctgagctgtagga

SEQ ID NO: 201472 - DNA, 25 bp, Homo sapien
tgggtacagcgcgatcacttcctaa

SEQ ID NO: 201473 - DNA, 25 bp, Homo sapien
ccctagaatgtcgaggaagaaacgg

SEQ ID NO: 201474 - DNA, 25 bp, Homo sapien
cgatcccgttcaccgctgcttccga

SEQ ID NO: 201475 - DNA, 25 bp, Homo sapien
gcccagcacgtccacatcgtgcacg

SEQ ID NO: 201476 - DNA, 25 bp, Homo sapien
gtgcacgatcccgttcaccgctgct

SEQ ID NO: 201477 - DNA, 25 bp, Homo sapien
tgcttccgaaaaacagtttggagaa

SEQ ID NO: 201478 - DNA, 25 bp, Homo sapien
tccgaaaaacagtttggagaagagc

SEQ ID NO: 201479 - DNA, 25 bp, Homo sapien
aacagtttggagaagagcattaccc

SEQ ID NO: 201480 - DNA, 25 bp, Homo sapien
tggagaagagcattaccccgagttc

SEQ ID NO: 201481 - DNA, 25 bp, Homo sapien
cgtccacatcgtgcacgatcccgtt

SEQ ID NO: 201482 - DNA, 25 bp, Homo sapien
acgcctcgcgttcgtccagatcgga

SEQ ID NO: 201483 - DNA, 25 bp, Homo sapien
cgcgttcgtccagatcggaccggca

SEQ ID NO: 201484 - DNA, 25 bp, Homo sapien
gaacgcctcgcgttcgtccagatcg

SEQ ID NO: 201485 - DNA, 25 bp, Homo sapien
aattcgctctcgcagaacgcctcgc

SEQ ID NO: 201486 - DNA, 25 bp, Homo sapien
gccgggctcaccgaattcgctctcg

SEQ ID NO: 201487 - DNA, 25 bp, Homo sapien
ccctgggatctcgcgggcggattct

SEQ ID NO: 201488 - DNA, 25 bp, Homo sapien
caggaggtggtttttagcaaccgcg

SEQ ID NO: 201489 - DNA, 25 bp, Homo sapien
tcgtccagatcggaccggcaggcgc

SEQ ID NO: 201490 - DNA, 25 bp, Homo sapien
ggagatagaggacaagggaggcttc

SEQ ID NO: 201491 - DNA, 25 bp, Homo sapien
gcccggaggcctggaagtgaagcag

SEQ ID NO: 201492 - DNA, 25 bp, Homo sapien
gaggacaagggaggcttcgcaggca

SEQ ID NO: 201493 - DNA, 25 bp, Homo sapien
agatagaggacaagggaggcttcgc

SEQ ID NO: 201494 - DNA, 25 bp, Homo sapien
agaggagatagaggacaagggaggc

SEQ ID NO: 201495 - DNA, 25 bp, Homo sapien
tcggggaaagccgaggaagccgaga

SEQ ID NO: 201496 - DNA, 25 bp, Homo sapien
gagaagcagtgaggggaggccgtcg

SEQ ID NO: 201497 - DNA, 25 bp, Homo sapien
gatagaggacaagggaggcttcgca

SEQ ID NO: 201498 - DNA, 25 bp, Homo sapien
tgcgcgtgaccctccgagctctcct

SEQ ID NO: 201499 - DNA, 25 bp, Homo sapien
acttcccgcgcgctgcgccatgggc

SEQ ID NO: 201500 - DNA, 25 bp, Homo sapien
tgcccggtaactgcatggcatccac

SEQ ID NO: 201501 - DNA, 25 bp, Homo sapien
tctcctgcccggtaactgcatggca

SEQ ID NO: 201502 - DNA, 25 bp, Homo sapien
tctcgcgccgagaggcaagtgattt

SEQ ID NO: 201503 - DNA, 25 bp, Homo sapien
gaggcaagtgatttggcagccgccc

SEQ ID NO: 201504 - DNA, 25 bp, Homo sapien
ctgcgcttttctgcgtccctgtcgg

SEQ ID NO: 201505 - DNA, 25 bp, Homo sapien
cctgtcggccgcctggacttcccgc

SEQ ID NO: 201506 - DNA, 25 bp, Homo sapien
ctgagtcgaggtggaccctttgaac

SEQ ID NO: 201507 - DNA, 25 bp, Homo sapien
tctgcaaacggcagcggaggcctta

SEQ ID NO: 201508 - DNA, 25 bp, Homo sapien
tttagggcgccgacgctctgcaaac

SEQ ID NO: 201509 - DNA, 25 bp, Homo sapien
cgacgttcattgaccaggcggctga

SEQ ID NO: 201510 - DNA, 25 bp, Homo sapien
ggaccctttgaacgcagtcgcccta

SEQ ID NO: 201511 - DNA, 25 bp, Homo sapien
ccacacggtctttgagctgagtcga

SEQ ID NO: 201512 - DNA, 25 bp, Homo sapien
cagccaatcggaatgcggagtcacc

SEQ ID NO: 201513 - DNA, 25 bp, Homo sapien
ccgcttcgcaggtacagactcaggc

SEQ ID NO: 201514 - DNA, 25 bp, Homo sapien
tctccatctcttcgaagtcatcatc

SEQ ID NO: 201515 - DNA, 25 bp, Homo sapien
agtacttacgtcaccgccttgctga

SEQ ID NO: 201516 - DNA, 25 bp, Homo sapien
tgaagttggactcgtcgcgcagctc

SEQ ID NO: 201517 - DNA, 25 bp, Homo sapien
tcttgcacgcggtgttgagcatggt

SEQ ID NO: 201518 - DNA, 25 bp, Homo sapien
tccgaccttctcactgaccagttgg

SEQ ID NO: 201519 - DNA, 25 bp, Homo sapien
catggtcagtttagcctgcgaggct

SEQ ID NO: 201520 - DNA, 25 bp, Homo sapien
caggtagccggggttcttcacctgg

SEQ ID NO: 201521 - DNA, 25 bp, Homo sapien
actcgatggtcctggacagtactta

SEQ ID NO: 201522 - DNA, 25 bp, Homo sapien
ggcgatgacatacttctcggtcttg

SEQ ID NO: 201523 - DNA, 25 bp, Homo sapien
cggccttttattgacgcggttgaga

SEQ ID NO: 201524 - DNA, 25 bp, Homo sapien
ctcggtcttgtagtcgaacagcgac

SEQ ID NO: 201525 - DNA, 25 bp, Homo sapien
caccttcttgttcttggcgatgaca

SEQ ID NO: 201526 - DNA, 25 bp, Homo sapien
ttacacgaccaggtacgccaggatg

SEQ ID NO: 201527 - DNA, 25 bp, Homo sapien
caaaagtccgcggagaacttacacg

SEQ ID NO: 201528 - DNA, 25 bp, Homo sapien
gtgcacgcctgcgaattccaggacc

SEQ ID NO: 201529 - DNA, 25 bp, Homo sapien
cccacgtgcgctcatggggagcact

SEQ ID NO: 201530 - DNA, 25 bp, Homo sapien
ccgcaggtaaagctgttctccgggg

SEQ ID NO: 201531 - DNA, 25 bp, Homo sapien
ttggggtttgttggtccagctctgg

SEQ ID NO: 201532 - DNA, 25 bp, Homo sapien
ccaggggccactctcgtggaggcat

SEQ ID NO: 201533 - DNA, 25 bp, Homo sapien
ctcacaccgaggcccttggactaaa

SEQ ID NO: 201534 - DNA, 25 bp, Homo sapien
agcccgcaggtaaagctgttctccg

SEQ ID NO: 201535 - DNA, 25 bp, Homo sapien
ctacgggactctgcggattctctgc

SEQ ID NO: 201536 - DNA, 25 bp, Homo sapien
tgctacgggactctgcggattctct

SEQ ID NO: 201537 - DNA, 25 bp, Homo sapien
agggacagcccgcaggtaaagctgt

SEQ ID NO: 201538 - DNA, 25 bp, Homo sapien
acagggcaggagaccacggctgttt

SEQ ID NO: 201539 - DNA, 25 bp, Homo sapien
ccttaggactgtgccgctttcactc

SEQ ID NO: 201540 - DNA, 25 bp, Homo sapien
ttccttaggactgtgccgctttcac

SEQ ID NO: 201541 - DNA, 25 bp, Homo sapien
cctggtttggcttccttaggactgt

SEQ ID NO: 201542 - DNA, 25 bp, Homo sapien
tcgtcctggtttggcttccttagga

SEQ ID NO: 201543 - DNA, 25 bp, Homo sapien
aggactgtgccgctttcactcgagc

SEQ ID NO: 201544 - DNA, 25 bp, Homo sapien
tgtgccgctttcactcgagctcctg

SEQ ID NO: 201545 - DNA, 25 bp, Homo sapien
aggagaccacggctgtttcctgttt

SEQ ID NO: 201546 - DNA, 25 bp, Homo sapien
gtcctcggctccgacattaggggca

SEQ ID NO: 201547 - DNA, 25 bp, Homo sapien
gctgtccggtgccttcggtcgctcg

SEQ ID NO: 201548 - DNA, 25 bp, Homo sapien
tcactcggtctcaggctcttctgtg

SEQ ID NO: 201549 - DNA, 25 bp, Homo sapien
aggctcttctgtggcgcatctcacg

SEQ ID NO: 201550 - DNA, 25 bp, Homo sapien
tgtggcgcatctcacgtgaccgcgc

SEQ ID NO: 201551 - DNA, 25 bp, Homo sapien
caagagggcggctgaagccgatcct

SEQ ID NO: 201552 - DNA, 25 bp, Homo sapien
ccgcctaggttgaggcagcctccaa

SEQ ID NO: 201553 - DNA, 25 bp, Homo sapien
tccaagccgtggctgagctcgccca

SEQ ID NO: 201554 - DNA, 25 bp, Homo sapien
cccgcaagcgagcaggtaacgatgg

SEQ ID NO: 201555 - DNA, 25 bp, Homo sapien
aaagttttggcggagccatcgctgg

SEQ ID NO: 201556 - DNA, 25 bp, Homo sapien
gctggggagtctgccacttccctct

SEQ ID NO: 201557 - DNA, 25 bp, Homo sapien
gtgctgtcggtcacatgcgcacctg

SEQ ID NO: 201558 - DNA, 25 bp, Homo sapien
caatgagaaaatcaggcccagccct

SEQ ID NO: 201559 - DNA, 25 bp, Homo sapien
cgattgagggcgaataattcccagc

SEQ ID NO: 201560 - DNA, 25 bp, Homo sapien
gccggcttctgcctaggcagttcca

SEQ ID NO: 201561 - DNA, 25 bp, Homo sapien
gtcctgggcttaccgatggactccc

SEQ ID NO: 201562 - DNA, 25 bp, Homo sapien
tgcggctctacgtcaacctgcggcg

SEQ ID NO: 201563 - DNA, 25 bp, Homo sapien
ctctattctggaagaggcgggtcgc

SEQ ID NO: 201564 - DNA, 25 bp, Homo sapien
cctcgctaccctctattctggaaga

SEQ ID NO: 201565 - DNA, 25 bp, Homo sapien
cgcatctgtggctctcgagaaccgg

SEQ ID NO: 201566 - DNA, 25 bp, Homo sapien
gtcacgccggcgatgcctctcaaac

SEQ ID NO: 201567 - DNA, 25 bp, Homo sapien
gagcgctgcggctctacgtcaacct

SEQ ID NO: 201568 - DNA, 25 bp, Homo sapien
tcagcatccgggtttcggcctcgga

SEQ ID NO: 201569 - DNA, 25 bp, Homo sapien
gggtcgcggccgctgaactccagct

SEQ ID NO: 201570 - DNA, 25 bp, Homo sapien
agcagcagtgctaaaatcgaagcag

SEQ ID NO: 201571 - DNA, 25 bp, Homo sapien
agggtaacctcctccactgctgcgt

SEQ ID NO: 201572 - DNA, 25 bp, Homo sapien
ccgggcaggaaacgcgtcgctgtcc

SEQ ID NO: 201573 - DNA, 25 bp, Homo sapien
tgggcacagccttggaaagtcagga

SEQ ID NO: 201574 - DNA, 25 bp, Homo sapien
tgctgcgtgccgtgcaggcctgcct

SEQ ID NO: 201575 - DNA, 25 bp, Homo sapien
gccttggaaagtcaggaccgcgacg

SEQ ID NO: 201576 - DNA, 25 bp, Homo sapien
tgcgggaccgctatagccggccctg

SEQ ID NO: 201577 - DNA, 25 bp, Homo sapien
gctaaaatcgaagcaggcagctgcg

SEQ ID NO: 201578 - DNA, 25 bp, Homo sapien
tcttatcctataccggctgcagccg

SEQ ID NO: 201579 - DNA, 25 bp, Homo sapien
ccggagctttgctgcaacgctagta

SEQ ID NO: 201580 - DNA, 25 bp, Homo sapien
gccctgggcattcctaactgtcaga

SEQ ID NO: 201581 - DNA, 25 bp, Homo sapien
gggcccgactctagcgcaagttggc

SEQ ID NO: 201582 - DNA, 25 bp, Homo sapien
taagccgctcggtaacatgagaaaa

SEQ ID NO: 201583 - DNA, 25 bp, Homo sapien
cccaataaggcggaggcttggcctc

SEQ ID NO: 201584 - DNA, 25 bp, Homo sapien
cccgcgccctgaggatttagggatt

SEQ ID NO: 201585 - DNA, 25 bp, Homo sapien
gcgtcgctgcctagctcttatccta

SEQ ID NO: 201586 - DNA, 25 bp, Homo sapien
tcctggttgaaagagaagcagctga

SEQ ID NO: 201587 - DNA, 25 bp, Homo sapien
cgaggaccagagcacctgatagggc

SEQ ID NO: 201588 - DNA, 25 bp, Homo sapien
tcgtaacgcggctctccattggaca

SEQ ID NO: 201589 - DNA, 25 bp, Homo sapien
tccattggacaaaggcgcgtgacgc

SEQ ID NO: 201590 - DNA, 25 bp, Homo sapien
cccacgtggcggtgttttcattgcc

SEQ ID NO: 201591 - DNA, 25 bp, Homo sapien
tctgctggtttcagtccggcaactg

SEQ ID NO: 201592 - DNA, 25 bp, Homo sapien
cgcagcttacgtgcagtcctggttg

SEQ ID NO: 201593 - DNA, 25 bp, Homo sapien
aggcggaagccacaagctgctctca

SEQ ID NO: 201594 - DNA, 25 bp, Homo sapien
aggagtcgcccacctgtcatctgag

SEQ ID NO: 201595 - DNA, 25 bp, Homo sapien
aggcgacccaagacacccagagagg

SEQ ID NO: 201596 - DNA, 25 bp, Homo sapien
agagtgagggtccttccaagagcga

SEQ ID NO: 201597 - DNA, 25 bp, Homo sapien
ggctgttgcgcccttaaggttgcta

SEQ ID NO: 201598 - DNA, 25 bp, Homo sapien
gttgctaaggcgacggttctggcca

SEQ ID NO: 201599 - DNA, 25 bp, Homo sapien
attgacgtcagtagccgaacgctga

SEQ ID NO: 201600 - DNA, 25 bp, Homo sapien
cctagccgctatcgcagagtggagc

SEQ ID NO: 201601 - DNA, 25 bp, Homo sapien
tggaccgatccaagatggcgtcacg

SEQ ID NO: 201602 - DNA, 25 bp, Homo sapien
ggcggctgctagtgctcccgcgact

SEQ ID NO: 201603 - DNA, 25 bp, Homo sapien
gaagagggcctgcaacttggagctc

SEQ ID NO: 201604 - DNA, 25 bp, Homo sapien
tgcaacttggagctcgacccgctgt

SEQ ID NO: 201605 - DNA, 25 bp, Homo sapien
cgggaaaagttgtgcacgatcgtgc

SEQ ID NO: 201606 - DNA, 25 bp, Homo sapien
gtgtcgctcctcaacttggggacca

SEQ ID NO: 201607 - DNA, 25 bp, Homo sapien
ggcgtcgcttctccgcgccgagtga

SEQ ID NO: 201608 - DNA, 25 bp, Homo sapien
gggcgtctctcctgaggatgctgtc

SEQ ID NO: 201609 - DNA, 25 bp, Homo sapien
cggctcctccgggacgttgtacagc

SEQ ID NO: 201610 - DNA, 25 bp, Homo sapien
agtggtaaacctgccgcctcttagc

SEQ ID NO: 201611 - DNA, 25 bp, Homo sapien
ctcctggcatttggatgggcctctc

SEQ ID NO: 201612 - DNA, 25 bp, Homo sapien
tcacgtctcctcttaagcatccttg

SEQ ID NO: 201613 - DNA, 25 bp, Homo sapien
acggcctcgtgtctcagtggtaaac

SEQ ID NO: 201614 - DNA, 25 bp, Homo sapien
cacgctctttctggaggcacgggca

SEQ ID NO: 201615 - DNA, 25 bp, Homo sapien
gtctgttgactcagtgcgggtgacc

SEQ ID NO: 201616 - DNA, 25 bp, Homo sapien
caggcaaaggcagtgtcccgaagtc

SEQ ID NO: 201617 - DNA, 25 bp, Homo sapien
agcatccttgccgtctgtctcctgg

SEQ ID NO: 201618 - DNA, 25 bp, Homo sapien
ccggaggcgtttcttcaacagcagc

SEQ ID NO: 201619 - DNA, 25 bp, Homo sapien
ccaacgccaagggacagtgtcatct

SEQ ID NO: 201620 - DNA, 25 bp, Homo sapien
tcgcagtccgacgatcctgacgatc

SEQ ID NO: 201621 - DNA, 25 bp, Homo sapien
ggagccggcttttccgcacatatgg

SEQ ID NO: 201622 - DNA, 25 bp, Homo sapien
ctcgcgatgtttgcgtttgaacctc

SEQ ID NO: 201623 - DNA, 25 bp, Homo sapien
accgcgacgcgctgaacaaaccaag

SEQ ID NO: 201624 - DNA, 25 bp, Homo sapien
ggccgcgcttacctgaaccgaactg

SEQ ID NO: 201625 - DNA, 25 bp, Homo sapien
ccaaagcgctggaagctgcgagctc

SEQ ID NO: 201626 - DNA, 25 bp, Homo sapien
gcccaggatattgcagagcgcactg

SEQ ID NO: 201627 - DNA, 25 bp, Homo sapien
agcctaggcgccttgtaagtaattc

SEQ ID NO: 201628 - DNA, 25 bp, Homo sapien
tcgggagaacaaacagccaagcggc

SEQ ID NO: 201629 - DNA, 25 bp, Homo sapien
gcacttgcgcgcgtctcaatcctgg

SEQ ID NO: 201630 - DNA, 25 bp, Homo sapien
gcgccgggaccgacgaacaatcctg

SEQ ID NO: 201631 - DNA, 25 bp, Homo sapien
tgcggcaaaggtctctacccggcgc

SEQ ID NO: 201632 - DNA, 25 bp, Homo sapien
gctccagacggagtaggaagctttg

SEQ ID NO: 201633 - DNA, 25 bp, Homo sapien
gtgtcgcacggaccgcctcaaaaga

SEQ ID NO: 201634 - DNA, 25 bp, Homo sapien
tactctcgcggaagcccaaaagttg

SEQ ID NO: 201635 - DNA, 25 bp, Homo sapien
ccaaaagttggggtttgacctcatg

SEQ ID NO: 201636 - DNA, 25 bp, Homo sapien
caaaacggagcccaacacgaagctg

SEQ ID NO: 201637 - DNA, 25 bp, Homo sapien
ggggctttactctcgcggaagccca

SEQ ID NO: 201638 - DNA, 25 bp, Homo sapien
gtcacagctccgaggaccatccggg

SEQ ID NO: 201639 - DNA, 25 bp, Homo sapien
gtttgacctcatgaccttggccttc

SEQ ID NO: 201640 - DNA, 25 bp, Homo sapien
cccggagtccggagctcaggccagt

SEQ ID NO: 201641 - DNA, 25 bp, Homo sapien
gtgaagccgtagcttgcaggagcca

SEQ ID NO: 201642 - DNA, 25 bp, Homo sapien
agctcaagaggcagctgcacgccca

SEQ ID NO: 201643 - DNA, 25 bp, Homo sapien
ggaagctgctcacagaccgcacacg

SEQ ID NO: 201644 - DNA, 25 bp, Homo sapien
gcccaggagggcatcgagccatcgt

SEQ ID NO: 201645 - DNA, 25 bp, Homo sapien
cccgacacagtggggcagctcaaga

SEQ ID NO: 201646 - DNA, 25 bp, Homo sapien
tgcgcctgtccacgggcaaggacgt

SEQ ID NO: 201647 - DNA, 25 bp, Homo sapien
ttcccgctgaaggtgcgcctgtcca

SEQ ID NO: 201648 - DNA, 25 bp, Homo sapien
gcgtgcgccgtgagttcccgctgaa

SEQ ID NO: 201649 - DNA, 25 bp, Homo sapien
tccgggaagctgctcacagaccgca

SEQ ID NO: 201650 - DNA, 25 bp, Homo sapien
gggacatgcactcactcgggcaaca

SEQ ID NO: 201651 - DNA, 25 bp, Homo sapien
tgtccctccagggataggagtcttc

SEQ ID NO: 201652 - DNA, 25 bp, Homo sapien
tctccaagcccagcgaaatgtacta

SEQ ID NO: 201653 - DNA, 25 bp, Homo sapien
tgcgcacctacgacgctatctggta

SEQ ID NO: 201654 - DNA, 25 bp, Homo sapien
caagcatcgcgtgttcgcaactgtc

SEQ ID NO: 201655 - DNA, 25 bp, Homo sapien
cagttttagcggagtcgggattcca

SEQ ID NO: 201656 - DNA, 25 bp, Homo sapien
ggcacatgccggtcaacttcccaaa

SEQ ID NO: 201657 - DNA, 25 bp, Homo sapien
aagaaactcgtgtccggcgtgaaga

SEQ ID NO: 201658 - DNA, 25 bp, Homo sapien
tgacaaagttcttgggctgctcgcg

SEQ ID NO: 201659 - DNA, 25 bp, Homo sapien
cagcaccgggagtcgttttcatctc

SEQ ID NO: 201660 - DNA, 25 bp, Homo sapien
gtaagtcgagcagcaaaggcgttta

SEQ ID NO: 201661 - DNA, 25 bp, Homo sapien
ggggaccttcttgcagcttaagtaa

SEQ ID NO: 201662 - DNA, 25 bp, Homo sapien
ggcctcttaaaactgcactctctcg

SEQ ID NO: 201663 - DNA, 25 bp, Homo sapien
tccagtcgcctggaagctcaatcgg

SEQ ID NO: 201664 - DNA, 25 bp, Homo sapien
cgcgtcaacggctccagcaagaaca

SEQ ID NO: 201665 - DNA, 25 bp, Homo sapien
ggaagtgaaacttgcctccctccta

SEQ ID NO: 201666 - DNA, 25 bp, Homo sapien
ctgaccacgctgagcagcgagccgg

SEQ ID NO: 201667 - DNA, 25 bp, Homo sapien
tactacagccacgcggcaggccagg

SEQ ID NO: 201668 - DNA, 25 bp, Homo sapien
gaccaccagaactccagctcctact

SEQ ID NO: 201669 - DNA, 25 bp, Homo sapien
agtacgactacaccgaccaccagaa

SEQ ID NO: 201670 - DNA, 25 bp, Homo sapien
acccgcccatcacccgctcacagta

SEQ ID NO: 201671 - DNA, 25 bp, Homo sapien
cccagccactacagcgagcagcagc

SEQ ID NO: 201672 - DNA, 25 bp, Homo sapien
tcccagcgaacgcacatcaagacgg

SEQ ID NO: 201673 - DNA, 25 bp, Homo sapien
ggcaccggcctctactccaccttca

SEQ ID NO: 201674 - DNA, 25 bp, Homo sapien
atcaagtggccactcggcgaacggc

SEQ ID NO: 201675 - DNA, 25 bp, Homo sapien
gcggctggaagcagacgcgccgctc

SEQ ID NO: 201676 - DNA, 25 bp, Homo sapien
cgcccgcgcccggtggagccacagc

SEQ ID NO: 201677 - DNA, 25 bp, Homo sapien
gagccacagcgccatcaagtggcca

SEQ ID NO: 201678 - DNA, 25 bp, Homo sapien
acagcgccatcaagtggccactcgg

SEQ ID NO: 201679 - DNA, 25 bp, Homo sapien
caagtggccactcggcgaacggccg

SEQ ID NO: 201680 - DNA, 25 bp, Homo sapien
gcgccatcaagtggccactcggcga

SEQ ID NO: 201681 - DNA, 25 bp, Homo sapien
ccatcaagtggccactcggcgaacg

SEQ ID NO: 201682 - DNA, 25 bp, Homo sapien
gcgcctgcctaacagagggtccttg

SEQ ID NO: 201683 - DNA, 25 bp, Homo sapien
tgaccgcgtcctctggataccagcg

SEQ ID NO: 201684 - DNA, 25 bp, Homo sapien
gcgcccaggcgttaaggcaagtgca

SEQ ID NO: 201685 - DNA, 25 bp, Homo sapien
ttcaacccggaatctcgagaccttc

SEQ ID NO: 201686 - DNA, 25 bp, Homo sapien
gggaaacttacctccagcttggcga

SEQ ID NO: 201687 - DNA, 25 bp, Homo sapien
tgagcccagctgatacacaccaagt

SEQ ID NO: 201688 - DNA, 25 bp, Homo sapien
tctctgccaagctggaaagcgctga

SEQ ID NO: 201689 - DNA, 25 bp, Homo sapien
taatccacgttaaggggtccgcagc

SEQ ID NO: 201690 - DNA, 25 bp, Homo sapien
acctcgggacagaaaggacagtttg

SEQ ID NO: 201691 - DNA, 25 bp, Homo sapien
tgcccatccgagtgcctgagcttag

SEQ ID NO: 201692 - DNA, 25 bp, Homo sapien
gcacctgtgtgcatctgcgctgatg

SEQ ID NO: 201693 - DNA, 25 bp, Homo sapien
tgattctccgctcttgtgccttttg

SEQ ID NO: 201694 - DNA, 25 bp, Homo sapien
caacgggtacccttgcctgagtaag

SEQ ID NO: 201695 - DNA, 25 bp, Homo sapien
gtgtgccctttagcccgagatttca

SEQ ID NO: 201696 - DNA, 25 bp, Homo sapien
tgcgacgggtgacaacttctctccc

SEQ ID NO: 201697 - DNA, 25 bp, Homo sapien
aaccactgcataggccgtgcccaaa

SEQ ID NO: 201698 - DNA, 25 bp, Homo sapien
cgtcttcaggggctaaacatcggtt

SEQ ID NO: 201699 - DNA, 25 bp, Homo sapien
gcgcggatgtccctcttcctaaaac

SEQ ID NO: 201700 - DNA, 25 bp, Homo sapien
tcttcctaaaactgcacgcggggtg

SEQ ID NO: 201701 - DNA, 25 bp, Homo sapien
aagggaagacttcagccacagtttc

SEQ ID NO: 201702 - DNA, 25 bp, Homo sapien
gcgaccctgcggctcttttcgagac

SEQ ID NO: 201703 - DNA, 25 bp, Homo sapien
accaaggtcaggctctcgcagggaa

SEQ ID NO: 201704 - DNA, 25 bp, Homo sapien
aacggtaccgcgacctgatcgaggc

SEQ ID NO: 201705 - DNA, 25 bp, Homo sapien
ttcgggccgagatcgagcacaagaa

SEQ ID NO: 201706 - DNA, 25 bp, Homo sapien
cctggaaccgcaggaggaaatcctc

SEQ ID NO: 201707 - DNA, 25 bp, Homo sapien
ctcccagatcctcaggcgacgaatg

SEQ ID NO: 201708 - DNA, 25 bp, Homo sapien
tggcagaagcgctcgcctgttcaca

SEQ ID NO: 201709 - DNA, 25 bp, Homo sapien
cacagccaacggagggtacggtata

SEQ ID NO: 201710 - DNA, 25 bp, Homo sapien
gacctatccggcagtggtgcagacg

SEQ ID NO: 201711 - DNA, 25 bp, Homo sapien
tgcagacggcctgacgaggttcctt

SEQ ID NO: 201712 - DNA, 25 bp, Homo sapien
ccgcctgggctttcaggtcttccga

SEQ ID NO: 201713 - DNA, 25 bp, Homo sapien
ttccgcggcccacgttctaagtctg

SEQ ID NO: 201714 - DNA, 25 bp, Homo sapien
gctgcgtgtgtcgtagagcaacgcc

SEQ ID NO: 201715 - DNA, 25 bp, Homo sapien
ctgcgtgtgtcgtagagcaacgccc

SEQ ID NO: 201716 - DNA, 25 bp, Homo sapien
tgtcgtagagcaacgcccctccgga

SEQ ID NO: 201717 - DNA, 25 bp, Homo sapien
cagcacctgccgctgaaggggacgg

SEQ ID NO: 201718 - DNA, 25 bp, Homo sapien
gcccagatgagtgggagggacccaa

SEQ ID NO: 201719 - DNA, 25 bp, Homo sapien
agatgagtgggagggacccaaggcc

SEQ ID NO: 201720 - DNA, 25 bp, Homo sapien
gcgcggctaacctggctgggagcag

SEQ ID NO: 201721 - DNA, 25 bp, Homo sapien
gccagcgcggctaacctggctggga

SEQ ID NO: 201722 - DNA, 25 bp, Homo sapien
gcggcctccttctcattgagctggg

SEQ ID NO: 201723 - DNA, 25 bp, Homo sapien
ttcttgacaaacagggccgagtccc

SEQ ID NO: 201724 - DNA, 25 bp, Homo sapien
aagagggctgttcgtccaaggactc

SEQ ID NO: 201725 - DNA, 25 bp, Homo sapien
tccatgatgctgaggacgtcaccca

SEQ ID NO: 201726 - DNA, 25 bp, Homo sapien
tggactccgcatgcttcagcccgta

SEQ ID NO: 201727 - DNA, 25 bp, Homo sapien
cattggccttcttcacggggctgga

SEQ ID NO: 201728 - DNA, 25 bp, Homo sapien
ggctcgccagccttgctattgagga

SEQ ID NO: 201729 - DNA, 25 bp, Homo sapien
cccaaaggcctgctcatcgaggagg

SEQ ID NO: 201730 - DNA, 25 bp, Homo sapien
ctgcggaagaaacgcaagcagaaga

SEQ ID NO: 201731 - DNA, 25 bp, Homo sapien
gccaagagcgcgtgcgcaagacgtc

SEQ ID NO: 201732 - DNA, 25 bp, Homo sapien
cagaacctcatcgagctgcggaaga

SEQ ID NO: 201733 - DNA, 25 bp, Homo sapien
ggcgggatccagaacctcatcgagc

SEQ ID NO: 201734 - DNA, 25 bp, Homo sapien
agatcatcgatgtgggcgggatcca

SEQ ID NO: 201735 - DNA, 25 bp, Homo sapien
agcccgaggagatcgtaagggtcct

SEQ ID NO: 201736 - DNA, 25 bp, Homo sapien
cctcatcgagctgcggaagaaacgc

SEQ ID NO: 201737 - DNA, 25 bp, Homo sapien
gtgcgcaagacgtccctggacctgc

SEQ ID NO: 201738 - DNA, 25 bp, Homo sapien
cggctaccacagacagaggcggttg

SEQ ID NO: 201739 - DNA, 25 bp, Homo sapien
ggaccatttgttccttcggccattc

SEQ ID NO: 201740 - DNA, 25 bp, Homo sapien
agcgagatgtgtacacgcctctgcc

SEQ ID NO: 201741 - DNA, 25 bp, Homo sapien
cctctgcccgtacaggcggagaatt

SEQ ID NO: 201742 - DNA, 25 bp, Homo sapien
caggcggagaattcggttcttattc

SEQ ID NO: 201743 - DNA, 25 bp, Homo sapien
ttattcatggagaactccgggcgca

SEQ ID NO: 201744 - DNA, 25 bp, Homo sapien
gccaggacactaggtgcgcagctta

SEQ ID NO: 201745 - DNA, 25 bp, Homo sapien
cggcgtttgtttccctctggctctc

SEQ ID NO: 201746 - DNA, 25 bp, Homo sapien
aagacgtgggcccaccgtcaacctg

SEQ ID NO: 201747 - DNA, 25 bp, Homo sapien
cacacctgtgggcaagacgtgggcc

SEQ ID NO: 201748 - DNA, 25 bp, Homo sapien
ctgcgtccttgtaccaggtgatgga

SEQ ID NO: 201749 - DNA, 25 bp, Homo sapien
tgccggaagcgggtcaacttctcca

SEQ ID NO: 201750 - DNA, 25 bp, Homo sapien
tcctctccgcctaggaggggtgctt

SEQ ID NO: 201751 - DNA, 25 bp, Homo sapien
agcactggaacatgccggtatcatc

SEQ ID NO: 201752 - DNA, 25 bp, Homo sapien
cattgcgggcgaagcactggaacat

SEQ ID NO: 201753 - DNA, 25 bp, Homo sapien
tgccggtatcatcgggcaccaggcc

SEQ ID NO: 201754 - DNA, 25 bp, Homo sapien
cttctgtactagtccgagcccggca

SEQ ID NO: 201755 - DNA, 25 bp, Homo sapien
cgccggccgagctccggaataaatg

SEQ ID NO: 201756 - DNA, 25 bp, Homo sapien
ccattcggaagccacaagtctcgga

SEQ ID NO: 201757 - DNA, 25 bp, Homo sapien
ggggtgtcttgaaactccctggaga

SEQ ID NO: 201758 - DNA, 25 bp, Homo sapien
gcagagctagcagtgtccagatcaa

SEQ ID NO: 201759 - DNA, 25 bp, Homo sapien
tataatcctggtggggtccgatacc

SEQ ID NO: 201760 - DNA, 25 bp, Homo sapien
aacagtcagtctacgcggctccgtg

SEQ ID NO: 201761 - DNA, 25 bp, Homo sapien
tctctaactttgcaggcagcatctg

SEQ ID NO: 201762 - DNA, 25 bp, Homo sapien
cctcattaaagaggcgggcagattc

SEQ ID NO: 201763 - DNA, 25 bp, Homo sapien
cgggattgcattcgcacctgattac

SEQ ID NO: 201764 - DNA, 25 bp, Homo sapien
ccgggaaatccgagctaactgaatt

SEQ ID NO: 201765 - DNA, 25 bp, Homo sapien
ataaaagctgctgaccgggaaatcc

SEQ ID NO: 201766 - DNA, 25 bp, Homo sapien
tggctgcgccagcatttaataaaag

SEQ ID NO: 201767 - DNA, 25 bp, Homo sapien
ttcatgtccctaatggcgtggctgc

SEQ ID NO: 201768 - DNA, 25 bp, Homo sapien
tggttcccgagcttctcttcatgtc

SEQ ID NO: 201769 - DNA, 25 bp, Homo sapien
gcgcgctttctctcttctttatttc

SEQ ID NO: 201770 - DNA, 25 bp, Homo sapien
gctccgatgccagaacccaggatta

SEQ ID NO: 201771 - DNA, 25 bp, Homo sapien
cccaggattacgacaccggatcagc

SEQ ID NO: 201772 - DNA, 25 bp, Homo sapien
tacgggagccgctctttaggagaca

SEQ ID NO: 201773 - DNA, 25 bp, Homo sapien
atggataatcttcaggcgccaacgc

SEQ ID NO: 201774 - DNA, 25 bp, Homo sapien
gcgccaacgcaaaacggccgcaaga

SEQ ID NO: 201775 - DNA, 25 bp, Homo sapien
aagacgaggccatcgccctcacgtg

SEQ ID NO: 201776 - DNA, 25 bp, Homo sapien
ccggttcagacactagcgggtgcgc

SEQ ID NO: 201777 - DNA, 25 bp, Homo sapien
accacgggagttcacacgctccagt

SEQ ID NO: 201778 - DNA, 25 bp, Homo sapien
ggcgagagagcctcccaaggatctc

SEQ ID NO: 201779 - DNA, 25 bp, Homo sapien
gccaaatgtaagtggttgctccgaa

SEQ ID NO: 201780 - DNA, 25 bp, Homo sapien
ttcctgctcacagcccgacgaaagg

SEQ ID NO: 201781 - DNA, 25 bp, Homo sapien
catcgccgggagacgtgtctctttc

SEQ ID NO: 201782 - DNA, 25 bp, Homo sapien
gccgaggactgtttcccgcaggtcc

SEQ ID NO: 201783 - DNA, 25 bp, Homo sapien
ccgcgccgtgttaacgccgaggact

SEQ ID NO: 201784 - DNA, 25 bp, Homo sapien
tccgaaggttcaagaagagcggtgc

SEQ ID NO: 201785 - DNA, 25 bp, Homo sapien
tcctttgtgttgcagcctcggaaaa

SEQ ID NO: 201786 - DNA, 25 bp, Homo sapien
tcctggcctgcgttcggcatcttct

SEQ ID NO: 201787 - DNA, 25 bp, Homo sapien
tcggcatcttctcgggtcgtcatcg

SEQ ID NO: 201788 - DNA, 25 bp, Homo sapien
agcgttttcagtcggtccgcatcca

SEQ ID NO: 201789 - DNA, 25 bp, Homo sapien
ggtcccttcagccagaaccctagga

SEQ ID NO: 201790 - DNA, 25 bp, Homo sapien
gcccagcgcggtttccacgcccaat

SEQ ID NO: 201791 - DNA, 25 bp, Homo sapien
gccaagtcacgccaagcagtttgcg

SEQ ID NO: 201792 - DNA, 25 bp, Homo sapien
ggggcctctgcatatgtgcagagta

SEQ ID NO: 201793 - DNA, 25 bp, Homo sapien
tcgggtcgtcatcgccctctgcggt

SEQ ID NO: 201794 - DNA, 25 bp, Homo sapien
cccgaagttttcgaccgtctgagat

SEQ ID NO: 201795 - DNA, 25 bp, Homo sapien
tgagcgcagctgtcgttcagcttgt

SEQ ID NO: 201796 - DNA, 25 bp, Homo sapien
acaggggcattcgtctcggggtaat

SEQ ID NO: 201797 - DNA, 25 bp, Homo sapien
tgcagcccgtgaacagcaccttcag

SEQ ID NO: 201798 - DNA, 25 bp, Homo sapien
ggactacatcgctccctggtgggtc

SEQ ID NO: 201799 - DNA, 25 bp, Homo sapien
agcactcgggccgagccatgcaggc

SEQ ID NO: 201800 - DNA, 25 bp, Homo sapien
tctgagattccaagatggggcgctc

SEQ ID NO: 201801 - DNA, 25 bp, Homo sapien
cgttcagcttgtgggtagcactcgg

SEQ ID NO: 201802 - DNA, 25 bp, Homo sapien
cttccgacgtggcaggaaaggagtc

SEQ ID NO: 201803 - DNA, 25 bp, Homo sapien
ccggagccgcgaccgtggattgaac

SEQ ID NO: 201804 - DNA, 25 bp, Homo sapien
aacgccgccgtttgaggagcaccgg

SEQ ID NO: 201805 - DNA, 25 bp, Homo sapien
taaacgccgccgtttgaggagcacc

SEQ ID NO: 201806 - DNA, 25 bp, Homo sapien
ttgccaagcaaccggtaaacgccgc

SEQ ID NO: 201807 - DNA, 25 bp, Homo sapien
aaggagtcacgtgctccggggtcct

SEQ ID NO: 201808 - DNA, 25 bp, Homo sapien
tggcaggaaaggagtcacgtgctcc

SEQ ID NO: 201809 - DNA, 25 bp, Homo sapien
cgcgaccgtggattgaacgcttccc

SEQ ID NO: 201810 - DNA, 25 bp, Homo sapien
tgtgcctaggacacccacgtgcgaa

SEQ ID NO: 201811 - DNA, 25 bp, Homo sapien
cggcccggccaagagtggcagaacc

SEQ ID NO: 201812 - DNA, 25 bp, Homo sapien
ggacacccacgtgcgaaggccaaca

SEQ ID NO: 201813 - DNA, 25 bp, Homo sapien
gagagagggctcaagtgcattttcc

SEQ ID NO: 201814 - DNA, 25 bp, Homo sapien
tccacaccaggggtggctggtgccc

SEQ ID NO: 201815 - DNA, 25 bp, Homo sapien
tctgagccgctgcatcacgatgctt

SEQ ID NO: 201816 - DNA, 25 bp, Homo sapien
tgtcggccacagagagagggctcaa

SEQ ID NO: 201817 - DNA, 25 bp, Homo sapien
ctgcatcacgatgcttagaatgaaa

SEQ ID NO: 201818 - DNA, 25 bp, Homo sapien
acttttcctctgatgggctcccggc

SEQ ID NO: 201819 - DNA, 25 bp, Homo sapien
gggagcaacgccactccgcattggc

SEQ ID NO: 201820 - DNA, 25 bp, Homo sapien
agggtctaacgctcacacaggtctg

SEQ ID NO: 201821 - DNA, 25 bp, Homo sapien
ggtcatctcgtgctccgttcctcag

SEQ ID NO: 201822 - DNA, 25 bp, Homo sapien
ttacctaggcaaccgggagcaacgc

SEQ ID NO: 201823 - DNA, 25 bp, Homo sapien
gggcgaccgcactgggtacaattcc

SEQ ID NO: 201824 - DNA, 25 bp, Homo sapien
gctgcccattggctgttacctaggc

SEQ ID NO: 201825 - DNA, 25 bp, Homo sapien
aggcaaccgccctcaggtcagcgta

SEQ ID NO: 201826 - DNA, 25 bp, Homo sapien
atgggctccggctcgccacggtcaa

SEQ ID NO: 201827 - DNA, 25 bp, Homo sapien
accgggatcagttccttgagcgagc

SEQ ID NO: 201828 - DNA, 25 bp, Homo sapien
gcccgtaccgggatcagttccttga

SEQ ID NO: 201829 - DNA, 25 bp, Homo sapien
ggaactacggagcttggaggagacc

SEQ ID NO: 201830 - DNA, 25 bp, Homo sapien
gagcgccgcacaggcacgatttcca

SEQ ID NO: 201831 - DNA, 25 bp, Homo sapien
gcagctacctagagcgtcgccggct

SEQ ID NO: 201832 - DNA, 25 bp, Homo sapien
ggcctccgccttcaccgacacccgc

SEQ ID NO: 201833 - DNA, 25 bp, Homo sapien
tcagttccttgagcgagcgccgcac

SEQ ID NO: 201834 - DNA, 25 bp, Homo sapien
acagcggcagatgcgtgtgcttcaa

SEQ ID NO: 201835 - DNA, 25 bp, Homo sapien
ctgctggggcgctccctaaagggca

SEQ ID NO: 201836 - DNA, 25 bp, Homo sapien
cgcgcaggagttagcgaactgacac

SEQ ID NO: 201837 - DNA, 25 bp, Homo sapien
ttagcgaactgacacggaggcgcca

SEQ ID NO: 201838 - DNA, 25 bp, Homo sapien
ggcacacatcgtcgcgcagcggttc

SEQ ID NO: 201839 - DNA, 25 bp, Homo sapien
catcgtcgcgcagcggttcaggctc

SEQ ID NO: 201840 - DNA, 25 bp, Homo sapien
ctcgggtcggcgtccttagccgctg

SEQ ID NO: 201841 - DNA, 25 bp, Homo sapien
cggcgcccacggaaacccgaggctg

SEQ ID NO: 201842 - DNA, 25 bp, Homo sapien
tcagcctgctgtgccgcgtgcacga

SEQ ID NO: 201843 - DNA, 25 bp, Homo sapien
tggagaacaccgagatgcagtcgca

SEQ ID NO: 201844 - DNA, 25 bp, Homo sapien
agatgcagtcgcacgcgctgctccg

SEQ ID NO: 201845 - DNA, 25 bp, Homo sapien
cgcagtctctgcgacgagattatcc

SEQ ID NO: 201846 - DNA, 25 bp, Homo sapien
gcagatcatcgacggtagggcccac

SEQ ID NO: 201847 - DNA, 25 bp, Homo sapien
acgagattatccagggccagcggca

SEQ ID NO: 201848 - DNA, 25 bp, Homo sapien
agcagcgcgaggtgctcagcctgct

SEQ ID NO: 201849 - DNA, 25 bp, Homo sapien
gcacgagctcgaggtggagaacacc

SEQ ID NO: 201850 - DNA, 25 bp, Homo sapien
cgtggccagaagaaaagcctgggca

SEQ ID NO: 201851 - DNA, 25 bp, Homo sapien
cctgcactcactgagcgagggcgac

SEQ ID NO: 201852 - DNA, 25 bp, Homo sapien
ccacactacagcatgctgccagtga

SEQ ID NO: 201853 - DNA, 25 bp, Homo sapien
atgctgccagtgaggacaacctgtc

SEQ ID NO: 201854 - DNA, 25 bp, Homo sapien
ccgtcccgggcagtcggacatcatg

SEQ ID NO: 201855 - DNA, 25 bp, Homo sapien
aggaagcggaggtcccgatccttcg

SEQ ID NO: 201856 - DNA, 25 bp, Homo sapien
cgatccttcgaggtcaccgggcaag

SEQ ID NO: 201857 - DNA, 25 bp, Homo sapien
gaggacaacctgtccagcagcacgg

SEQ ID NO: 201858 - DNA, 25 bp, Homo sapien
tccagcgcgtggaacagctccagtt

SEQ ID NO: 201859 - DNA, 25 bp, Homo sapien
tgcagggcgttctcaaccaggtact

SEQ ID NO: 201860 - DNA, 25 bp, Homo sapien
accaggtactcggagttgcgccgct

SEQ ID NO: 201861 - DNA, 25 bp, Homo sapien
accagcaccgtcttctggaagctca

SEQ ID NO: 201862 - DNA, 25 bp, Homo sapien
gctgccgttgacgtcgaagaacttg

SEQ ID NO: 201863 - DNA, 25 bp, Homo sapien
tgcagcaccaggtccgagcgttgca

SEQ ID NO: 201864 - DNA, 25 bp, Homo sapien
gtgcccaccgcgtagtggtaccagc

SEQ ID NO: 201865 - DNA, 25 bp, Homo sapien
cgagaagagcacgttccaggtgacc

SEQ ID NO: 201866 - DNA, 25 bp, Homo sapien
cccacctgatgaacttgtcgaagac

SEQ ID NO: 201867 - DNA, 25 bp, Homo sapien
ccgcagaaccacatcgctggcgttg

SEQ ID NO: 201868 - DNA, 25 bp, Homo sapien
tggaatacccggacctcatcggtgc

SEQ ID NO: 201869 - DNA, 25 bp, Homo sapien
tccaggaacagctcactgtgcagtc

SEQ ID NO: 201870 - DNA, 25 bp, Homo sapien
agcagctcctgcaagcgctggagca

SEQ ID NO: 201871 - DNA, 25 bp, Homo sapien
ctggttacttagcagctccaggaac

SEQ ID NO: 201872 - DNA, 25 bp, Homo sapien
ttgtcgaagacagcggcgcagtcct

SEQ ID NO: 201873 - DNA, 25 bp, Homo sapien
cgcctcgctctggttacttagcagc

SEQ ID NO: 201874 - DNA, 25 bp, Homo sapien
cccaggctgtggtgcgcacggccaa

SEQ ID NO: 201875 - DNA, 25 bp, Homo sapien
ggttgaccgctacactgccctgtgc

SEQ ID NO: 201876 - DNA, 25 bp, Homo sapien
tgctcacggttgaccgctacactgc

SEQ ID NO: 201877 - DNA, 25 bp, Homo sapien
gatcgccatcctgctcacggttgac

SEQ ID NO: 201878 - DNA, 25 bp, Homo sapien
agtctggatcgccatcctgctcacg

SEQ ID NO: 201879 - DNA, 25 bp, Homo sapien
agtttgctgccaaccacgcctcagt

SEQ ID NO: 201880 - DNA, 25 bp, Homo sapien
gcgcacggccaacatcctggagttt

SEQ ID NO: 201881 - DNA, 25 bp, Homo sapien
cggccaacatcctggagtttgctgc

SEQ ID NO: 201882 - DNA, 25 bp, Homo sapien
tgcggtccagcttcagcagattcct

SEQ ID NO: 201883 - DNA, 25 bp, Homo sapien
tggtgggaacctgacctcctggaaa

SEQ ID NO: 201884 - DNA, 25 bp, Homo sapien
cgcgctaaacactgtacctcgggga

SEQ ID NO: 201885 - DNA, 25 bp, Homo sapien
ttgggcagaacctggaacggtcaca

SEQ ID NO: 201886 - DNA, 25 bp, Homo sapien
tggtgacgatcccacgtacgcttgg

SEQ ID NO: 201887 - DNA, 25 bp, Homo sapien
accgtgcgtgcaaaaggcgaacctc

SEQ ID NO: 201888 - DNA, 25 bp, Homo sapien
cgaactgtgcctgaagtgtgtctca

SEQ ID NO: 201889 - DNA, 25 bp, Homo sapien
ttcctgtgtaaacggagcgcacgta

SEQ ID NO: 201890 - DNA, 25 bp, Homo sapien
gtccgaaggagcttacgacatcatc

SEQ ID NO: 201891 - DNA, 25 bp, Homo sapien
ggcagtgccaactcgaccctgcggg

SEQ ID NO: 201892 - DNA, 25 bp, Homo sapien
gacggcaagaactctcaggtcttta

SEQ ID NO: 201893 - DNA, 25 bp, Homo sapien
atgtactcggcccagagccaccagg

SEQ ID NO: 201894 - DNA, 25 bp, Homo sapien
ccctgcgggctgaagacatgtactc

SEQ ID NO: 201895 - DNA, 25 bp, Homo sapien
ggccaccgccaacagccaggtgatg

SEQ ID NO: 201896 - DNA, 25 bp, Homo sapien
gcctgttcttccttccagtccgaag

SEQ ID NO: 201897 - DNA, 25 bp, Homo sapien
acagccaggtgatgggcagtgccaa

SEQ ID NO: 201898 - DNA, 25 bp, Homo sapien
ggggccgcatttatccctgtgtctc

SEQ ID NO: 201899 - DNA, 25 bp, Homo sapien
gctccgtccttaacccagcgtccta

SEQ ID NO: 201900 - DNA, 25 bp, Homo sapien
agcgtcctaacctgacccggctggg

SEQ ID NO: 201901 - DNA, 25 bp, Homo sapien
gtcctaacctgacccggctgggaga

SEQ ID NO: 201902 - DNA, 25 bp, Homo sapien
ctgcaacccgatcctcgccgcgggg

SEQ ID NO: 201903 - DNA, 25 bp, Homo sapien
ccagctgtcccagctcctgctgtag

SEQ ID NO: 201904 - DNA, 25 bp, Homo sapien
gcctcgcagccgctagggattgcgg

SEQ ID NO: 201905 - DNA, 25 bp, Homo sapien
cgcatttatccctgtgtctctcagg

SEQ ID NO: 201906 - DNA, 25 bp, Homo sapien
ttctgattggctactgttcgcgcgc

SEQ ID NO: 201907 - DNA, 25 bp, Homo sapien
atggacgagacgagcccactagtgt

SEQ ID NO: 201908 - DNA, 25 bp, Homo sapien
agttcccggaggatcctgagttcga

SEQ ID NO: 201909 - DNA, 25 bp, Homo sapien
atcgagcgctgcatctttcccgagc

SEQ ID NO: 201910 - DNA, 25 bp, Homo sapien
tttcccgagcgcatctaccagggct

SEQ ID NO: 201911 - DNA, 25 bp, Homo sapien
accagggctccagcggaagctactt

SEQ ID NO: 201912 - DNA, 25 bp, Homo sapien
agctacttcgtcaaggaccctcagg

SEQ ID NO: 201913 - DNA, 25 bp, Homo sapien
ggccgtgcctattcgtagccaagta

SEQ ID NO: 201914 - DNA, 25 bp, Homo sapien
gttcctggtgctgaaacgctcagtc

SEQ ID NO: 201915 - DNA, 25 bp, Homo sapien
ccagtgctgaaaacggatgcggccc

SEQ ID NO: 201916 - DNA, 25 bp, Homo sapien
atgcccgttcgctcgggatcaggaa

SEQ ID NO: 201917 - DNA, 25 bp, Homo sapien
tcctgggaccgcaatgccctgagaa

SEQ ID NO: 201918 - DNA, 25 bp, Homo sapien
cggagtccggtagctgaatgaaata

SEQ ID NO: 201919 - DNA, 25 bp, Homo sapien
ccagcatcctggagtcctaagaggc

SEQ ID NO: 201920 - DNA, 25 bp, Homo sapien
ggacttcgcctctgcaaacgtgtga

SEQ ID NO: 201921 - DNA, 25 bp, Homo sapien
gatcaccagccggacccaaatcttg

SEQ ID NO: 201922 - DNA, 25 bp, Homo sapien
gccgccgagaagatgccaagatgct

SEQ ID NO: 201923 - DNA, 25 bp, Homo sapien
agacacgccgactcacacgcatgca

SEQ ID NO: 201924 - DNA, 25 bp, Homo sapien
cctccgtgacaaggacggttccatg

SEQ ID NO: 201925 - DNA, 25 bp, Homo sapien
ctttgtccctcctccgtgacaagga

SEQ ID NO: 201926 - DNA, 25 bp, Homo sapien
cgagaagatgccaagatgctactgc

SEQ ID NO: 201927 - DNA, 25 bp, Homo sapien
ggacggttccatgccgtgcccacag

SEQ ID NO: 201928 - DNA, 25 bp, Homo sapien
caaggacggttccatgccgtgccca

SEQ ID NO: 201929 - DNA, 25 bp, Homo sapien
ccaagatgctactgcagggcggccc

SEQ ID NO: 201930 - DNA, 25 bp, Homo sapien
gtccagggacatgacgggcacgcca

SEQ ID NO: 201931 - DNA, 25 bp, Homo sapien
ctatattcagatgagctcgggccgg

SEQ ID NO: 201932 - DNA, 25 bp, Homo sapien
gccgggtgacttaacagatgaggaa

SEQ ID NO: 201933 - DNA, 25 bp, Homo sapien
tacgggaactcttccgcagcagacg

SEQ ID NO: 201934 - DNA, 25 bp, Homo sapien
cccaggggcaagcaagcgaccacag

SEQ ID NO: 201935 - DNA, 25 bp, Homo sapien
cgtgccctcagggaacagcaaggtc

SEQ ID NO: 201936 - DNA, 25 bp, Homo sapien
agtccgagctacgacctcacgggca

SEQ ID NO: 201937 - DNA, 25 bp, Homo sapien
atgtggctcatgtccgaagcgcacg

SEQ ID NO: 201938 - DNA, 25 bp, Homo sapien
aggcgccctgacacatcctaggcag

SEQ ID NO: 201939 - DNA, 25 bp, Homo sapien
ggggctggcaacgaaaatgagcctc

SEQ ID NO: 201940 - DNA, 25 bp, Homo sapien
cgtttttctgaaactcgagctgcga

SEQ ID NO: 201941 - DNA, 25 bp, Homo sapien
aatgagcctcgcgaggccgacaaga

SEQ ID NO: 201942 - DNA, 25 bp, Homo sapien
ccgagacggacgagcagctgcagaa

SEQ ID NO: 201943 - DNA, 25 bp, Homo sapien
gcgaaaacgtggagaaggagaccca

SEQ ID NO: 201944 - DNA, 25 bp, Homo sapien
caagttgggccagtacatccggctg

SEQ ID NO: 201945 - DNA, 25 bp, Homo sapien
cgacaagagccacccggagcaggta

SEQ ID NO: 201946 - DNA, 25 bp, Homo sapien
tggcgttctagaccactctcttcga

SEQ ID NO: 201947 - DNA, 25 bp, Homo sapien
ggacccgggtactgccaagctcaca

SEQ ID NO: 201948 - DNA, 25 bp, Homo sapien
cccgcagaaagggtgatctacctcc

SEQ ID NO: 201949 - DNA, 25 bp, Homo sapien
cctttgagtggcgttctagaccact

SEQ ID NO: 201950 - DNA, 25 bp, Homo sapien
agggtgatctacctcctccaaccag

SEQ ID NO: 201951 - DNA, 25 bp, Homo sapien
ttccgcatgcgcgtgagaacgcgcc

SEQ ID NO: 201952 - DNA, 25 bp, Homo sapien
ccacttccgccatgctgacggcagc

SEQ ID NO: 201953 - DNA, 25 bp, Homo sapien
caaggcgggcttagtcttaggccct

SEQ ID NO: 201954 - DNA, 25 bp, Homo sapien
actacgtgctgatcctggccttcta

SEQ ID NO: 201955 - DNA, 25 bp, Homo sapien
atggacatgtacaccctcaacttcg

SEQ ID NO: 201956 - DNA, 25 bp, Homo sapien
gtgaccctgcgcaacaactggaaga

SEQ ID NO: 201957 - DNA, 25 bp, Homo sapien
cgcggcgacagcctcatggacatgt

SEQ ID NO: 201958 - DNA, 25 bp, Homo sapien
ggtgtgcgtctactccttcatgtgc

SEQ ID NO: 201959 - DNA, 25 bp, Homo sapien
cgtcatgattgtgctggccctgatc

SEQ ID NO: 201960 - DNA, 25 bp, Homo sapien
cgtttcccagctttcgccgtcatga

SEQ ID NO: 201961 - DNA, 25 bp, Homo sapien
tcacaaggctggtgttcctggacta

SEQ ID NO: 201962 - DNA, 25 bp, Homo sapien
tagatcggcaagcacatcgactgcg

SEQ ID NO: 201963 - DNA, 25 bp, Homo sapien
agacgacaggccgtaagcagcgccc

SEQ ID NO: 201964 - DNA, 25 bp, Homo sapien
ccgctgaagcagctgtagatgccct

SEQ ID NO: 201965 - DNA, 25 bp, Homo sapien
cagacgtgctgtctgtgctgccagg

SEQ ID NO: 201966 - DNA, 25 bp, Homo sapien
cgggctgcctgcagcatcttgagca

SEQ ID NO: 201967 - DNA, 25 bp, Homo sapien
ctcgaggaaaggagctgtagtgaca

SEQ ID NO: 201968 - DNA, 25 bp, Homo sapien
cgcgacactcgggagacgtcggaca

SEQ ID NO: 201969 - DNA, 25 bp, Homo sapien
cccaattctcgatggtgcgagtggc

SEQ ID NO: 201970 - DNA, 25 bp, Homo sapien
gccaggttgggcaccagccacacgt

SEQ ID NO: 201971 - DNA, 25 bp, Homo sapien
cgcgcgagcagtaggccacaaacac

SEQ ID NO: 201972 - DNA, 25 bp, Homo sapien
ccggcggatgctccgcattccggga

SEQ ID NO: 201973 - DNA, 25 bp, Homo sapien
cagctctcggtgacgacgctgatga

SEQ ID NO: 201974 - DNA, 25 bp, Homo sapien
taggccacaaacacgggcgcgtcga

SEQ ID NO: 201975 - DNA, 25 bp, Homo sapien
gtactcttccagcaccttgaacagc

SEQ ID NO: 201976 - DNA, 25 bp, Homo sapien
aggcgctccagtcgtactcttccag

SEQ ID NO: 201977 - DNA, 25 bp, Homo sapien
gggttccatgctggcgccagtagct

SEQ ID NO: 201978 - DNA, 25 bp, Homo sapien
agtgtctttcctcgattttcctgtg

SEQ ID NO: 201979 - DNA, 25 bp, Homo sapien
tacagccagcggaatggtaccctcc

SEQ ID NO: 201980 - DNA, 25 bp, Homo sapien
agcagcaacagtttgggtccgcggc

SEQ ID NO: 201981 - DNA, 25 bp, Homo sapien
gtgcccagcagacctagggaaactg

SEQ ID NO: 201982 - DNA, 25 bp, Homo sapien
ctccgattctcccaggtcgcaggaa

SEQ ID NO: 201983 - DNA, 25 bp, Homo sapien
agataacgccaccatccgagggctg

SEQ ID NO: 201984 - DNA, 25 bp, Homo sapien
gccaagacctggacgggctctgaaa

SEQ ID NO: 201985 - DNA, 25 bp, Homo sapien
tggggacgaacgtcttggacgcttc

SEQ ID NO: 201986 - DNA, 25 bp, Homo sapien
cacgtgacttcgtcctagccaatca

SEQ ID NO: 201987 - DNA, 25 bp, Homo sapien
ccgccgttgggaaataaccagagtg

SEQ ID NO: 201988 - DNA, 25 bp, Homo sapien
gattgcgaatcctcccacgtgactt

SEQ ID NO: 201989 - DNA, 25 bp, Homo sapien
cgcagacgcccttgccatttgattg

SEQ ID NO: 201990 - DNA, 25 bp, Homo sapien
cagcaacctgcaagtggatctgttc

SEQ ID NO: 201991 - DNA, 25 bp, Homo sapien
cctagggttggaagagagcgaatcc

SEQ ID NO: 201992 - DNA, 25 bp, Homo sapien
catccggggtatacgcgatttaata

SEQ ID NO: 201993 - DNA, 25 bp, Homo sapien
tgttcctagctactgctccgcaggg

SEQ ID NO: 201994 - DNA, 25 bp, Homo sapien
gccgacctacgtacctggttgcttg

SEQ ID NO: 201995 - DNA, 25 bp, Homo sapien
ttcctcaaacctaatcggcggcgga

SEQ ID NO: 201996 - DNA, 25 bp, Homo sapien
gcttcgcagaacgacggggtcctaa

SEQ ID NO: 201997 - DNA, 25 bp, Homo sapien
ttcccgggagaaagcgctccctagc

SEQ ID NO: 201998 - DNA, 25 bp, Homo sapien
tcctcggccctagccaggtatgagc

SEQ ID NO: 201999 - DNA, 25 bp, Homo sapien
agttccgtgcgccaatcatcggtgg

SEQ ID NO: 202000 - DNA, 25 bp, Homo sapien
agcggagtgcgaagcttcctcaaac

SEQ ID NO: 202001 - DNA, 25 bp, Homo sapien
tcctaaggcgacatctgcagcacga

SEQ ID NO: 202002 - DNA, 25 bp, Homo sapien
cgccggttccatgggctccgtaggt

SEQ ID NO: 202003 - DNA, 25 bp, Homo sapien
caggcggcatcagaaccgccgcgga

SEQ ID NO: 202004 - DNA, 25 bp, Homo sapien
gcactcccacggctgctgttgcaga

SEQ ID NO: 202005 - DNA, 25 bp, Homo sapien
ctcacctgccggcaaggcgaagagg

SEQ ID NO: 202006 - DNA, 25 bp, Homo sapien
atggcgcagtccacgccgtggcgct

SEQ ID NO: 202007 - DNA, 25 bp, Homo sapien
gctccgtaggttccatgggctccgt

SEQ ID NO: 202008 - DNA, 25 bp, Homo sapien
gctccgtgggttccatggactctgt

SEQ ID NO: 202009 - DNA, 25 bp, Homo sapien
tcaaggtgcgagacaccctggctcc

SEQ ID NO: 202010 - DNA, 25 bp, Homo sapien
aggtcctcgtccaagcctaaatcga

SEQ ID NO: 202011 - DNA, 25 bp, Homo sapien
tgcgcccatcctcggagaccttgaa

SEQ ID NO: 202012 - DNA, 25 bp, Homo sapien
tggcgcacgaacatcacgtcgctgc

SEQ ID NO: 202013 - DNA, 25 bp, Homo sapien
cccactccttgggattggcgtaggt

SEQ ID NO: 202014 - DNA, 25 bp, Homo sapien
atttctgcggaacaccatggtgccc

SEQ ID NO: 202015 - DNA, 25 bp, Homo sapien
tgcagcccactgctcaagtaatttc

SEQ ID NO: 202016 - DNA, 25 bp, Homo sapien
taaatcgagctcatcccagggcagc

SEQ ID NO: 202017 - DNA, 25 bp, Homo sapien
ggtcgaggtcagagcacagcatcaa

SEQ ID NO: 202018 - DNA, 25 bp, Homo sapien
cgtctaactgatacacaggatctgg

SEQ ID NO: 202019 - DNA, 25 bp, Homo sapien
ccgtctaactgatacacaggatctg

SEQ ID NO: 202020 - DNA, 25 bp, Homo sapien
ggagatgcaggcaccgtctaactga

SEQ ID NO: 202021 - DNA, 25 bp, Homo sapien
gcaggcgccgtctaactgatacgtg

SEQ ID NO: 202022 - DNA, 25 bp, Homo sapien
ccgtctaactgatacgtgggctctg

SEQ ID NO: 202023 - DNA, 25 bp, Homo sapien
cgccgtctaactgatacgtgggctc

SEQ ID NO: 202024 - DNA, 25 bp, Homo sapien
caggcgccgtctaactgatacgtgg

SEQ ID NO: 202025 - DNA, 25 bp, Homo sapien
cgtctaactgatacgtgggctctgg

SEQ ID NO: 202026 - DNA, 25 bp, Homo sapien
tcctcctgggtataaagcgcctgtc

SEQ ID NO: 202027 - DNA, 25 bp, Homo sapien
caggagcacaggagcacaggattca

SEQ ID NO: 202028 - DNA, 25 bp, Homo sapien
atctgtcctcactagagcctggggc

SEQ ID NO: 202029 - DNA, 25 bp, Homo sapien
ggctccgtatttctccacctgtcag

SEQ ID NO: 202030 - DNA, 25 bp, Homo sapien
cacctgtcagtggaacgaaccgaga

SEQ ID NO: 202031 - DNA, 25 bp, Homo sapien
cgcaggctttttggacgtctcttga

SEQ ID NO: 202032 - DNA, 25 bp, Homo sapien
ggtcgcctctcaaagggtaaatatg

SEQ ID NO: 202033 - DNA, 25 bp, Homo sapien
gctccagcgggctcttccctaaatt

SEQ ID NO: 202034 - DNA, 25 bp, Homo sapien
cagtccctaaaatggctcggaagga

SEQ ID NO: 202035 - DNA, 25 bp, Homo sapien
ccgggtccacacagcagaaagcgcg

SEQ ID NO: 202036 - DNA, 25 bp, Homo sapien
gaactccctttaatctgaggccggc

SEQ ID NO: 202037 - DNA, 25 bp, Homo sapien
actgtggagaggtgaactcccttta

SEQ ID NO: 202038 - DNA, 25 bp, Homo sapien
gccggcggaactttcccagcttgcg

SEQ ID NO: 202039 - DNA, 25 bp, Homo sapien
atcggtctcacctggacggacgatc

SEQ ID NO: 202040 - DNA, 25 bp, Homo sapien
tcaacagaaaaatcgatgggccgcg

SEQ ID NO: 202041 - DNA, 25 bp, Homo sapien
gctttcatcgccaatccagccgaga

SEQ ID NO: 202042 - DNA, 25 bp, Homo sapien
cacacgtcagcctaaggtggcagca

SEQ ID NO: 202043 - DNA, 25 bp, Homo sapien
aagttcagcttggagtcggtcgacc

SEQ ID NO: 202044 - DNA, 25 bp, Homo sapien
cttccttctgcgtcggagcattgta

SEQ ID NO: 202045 - DNA, 25 bp, Homo sapien
ctggatcaccgccttccggaagttc

SEQ ID NO: 202046 - DNA, 25 bp, Homo sapien
agccaggctttgtttgcattgagtc

SEQ ID NO: 202047 - DNA, 25 bp, Homo sapien
gatggagcttccaggtacaggccgc

SEQ ID NO: 202048 - DNA, 25 bp, Homo sapien
atctcccgacgagccaagttcgcgt

SEQ ID NO: 202049 - DNA, 25 bp, Homo sapien
cgtcttggtggtgagctggatcacc

SEQ ID NO: 202050 - DNA, 25 bp, Homo sapien
tcccgcaacgccgctgtgcggttgg

SEQ ID NO: 202051 - DNA, 25 bp, Homo sapien
agatgtcgccctatcctttaacctc

SEQ ID NO: 202052 - DNA, 25 bp, Homo sapien
tgccatcggctgtcgcatcggcgtc

SEQ ID NO: 202053 - DNA, 25 bp, Homo sapien
tcgaggaaggtttccagatgtcgcc

SEQ ID NO: 202054 - DNA, 25 bp, Homo sapien
ctggagcgaacatgtccggggacag

SEQ ID NO: 202055 - DNA, 25 bp, Homo sapien
agcccgcgagccgtcacttcctgtg

SEQ ID NO: 202056 - DNA, 25 bp, Homo sapien
cagcagcgacggtgccatcggctgt

SEQ ID NO: 202057 - DNA, 25 bp, Homo sapien
ctttaacctcaacccgagatgtgca

SEQ ID NO: 202058 - DNA, 25 bp, Homo sapien
agacgaccgggcatccgtcatccag

SEQ ID NO: 202059 - DNA, 25 bp, Homo sapien
gcctgagcgctagctaggagtcttc

SEQ ID NO: 202060 - DNA, 25 bp, Homo sapien
ccgtcctggaggcagcaactgctcg

SEQ ID NO: 202061 - DNA, 25 bp, Homo sapien
gcggtcttcctattttcccagacga

SEQ ID NO: 202062 - DNA, 25 bp, Homo sapien
gcttctccattgttgggcgctatca

SEQ ID NO: 202063 - DNA, 25 bp, Homo sapien
cctggtacgaccagcaggacctgga

SEQ ID NO: 202064 - DNA, 25 bp, Homo sapien
ttgcatacatctcctgattggtcgg

SEQ ID NO: 202065 - DNA, 25 bp, Homo sapien
ccctggtattgttacggggcctgag

SEQ ID NO: 202066 - DNA, 25 bp, Homo sapien
agcgcgagtacaccgcggtgctgca

SEQ ID NO: 202067 - DNA, 25 bp, Homo sapien
agcaggccaagacctacctactggg

SEQ ID NO: 202068 - DNA, 25 bp, Homo sapien
ctactgggtccggacgaccacctgg

SEQ ID NO: 202069 - DNA, 25 bp, Homo sapien
tctccaggccacgtggtgcgcaaga

SEQ ID NO: 202070 - DNA, 25 bp, Homo sapien
cgctcaacgccatcgtggccaaaga

SEQ ID NO: 202071 - DNA, 25 bp, Homo sapien
tgcaaggatgctttccgcctacaca

SEQ ID NO: 202072 - DNA, 25 bp, Homo sapien
tgcgcaagagctgcagcgacactgc

SEQ ID NO: 202073 - DNA, 25 bp, Homo sapien
cgcaagcggggcatgtccatcctgc

SEQ ID NO: 202074 - DNA, 25 bp, Homo sapien
cggaagcagtcgcaagacctgagca

SEQ ID NO: 202075 - DNA, 25 bp, Homo sapien
cccaggcccattggccggatgtgga

SEQ ID NO: 202076 - DNA, 25 bp, Homo sapien
tcaagagcatctacagcctggacaa

SEQ ID NO: 202077 - DNA, 25 bp, Homo sapien
gccgggcgctgcacaagcagaaaga

SEQ ID NO: 202078 - DNA, 25 bp, Homo sapien
ggcactcttccggtagcagctcgct

SEQ ID NO: 202079 - DNA, 25 bp, Homo sapien
ggacctagaaactgcgcggaaccaa

SEQ ID NO: 202080 - DNA, 25 bp, Homo sapien
cggaaccaaagctcgagggcggctc

SEQ ID NO: 202081 - DNA, 25 bp, Homo sapien
agacggcactgagttcaagagcatc

SEQ ID NO: 202082 - DNA, 25 bp, Homo sapien
aaacttggcgcagcagcgcacgggc

SEQ ID NO: 202083 - DNA, 25 bp, Homo sapien
ggcgctatggcaggaaagagggaaa

SEQ ID NO: 202084 - DNA, 25 bp, Homo sapien
ccagatgtggcaaacttggcgcagc

SEQ ID NO: 202085 - DNA, 25 bp, Homo sapien
tgtggcaaacttggcgcagcagcgc

SEQ ID NO: 202086 - DNA, 25 bp, Homo sapien
gatgtggcaaacttggcgcagcagc

SEQ ID NO: 202087 - DNA, 25 bp, Homo sapien
tgccctggcccgaggacgaaggaat

SEQ ID NO: 202088 - DNA, 25 bp, Homo sapien
gccctggcccgaggacgaaggaatc

SEQ ID NO: 202089 - DNA, 25 bp, Homo sapien
gcgcccaggaagagcccagaggccc

SEQ ID NO: 202090 - DNA, 25 bp, Homo sapien
acacaagagctccatgcggtgacga

SEQ ID NO: 202091 - DNA, 25 bp, Homo sapien
cgcgctccaagcctgagaagccatg

SEQ ID NO: 202092 - DNA, 25 bp, Homo sapien
gagcgcttcgctcaacaggcggcca

SEQ ID NO: 202093 - DNA, 25 bp, Homo sapien
cctcaaactatgctgggattcgggc

SEQ ID NO: 202094 - DNA, 25 bp, Homo sapien
gacgtcagacgcctcatcccttagg

SEQ ID NO: 202095 - DNA, 25 bp, Homo sapien
atcccttaggccacgcggtcgcaat

SEQ ID NO: 202096 - DNA, 25 bp, Homo sapien
gtcgcaattcccagggaggctcaga

SEQ ID NO: 202097 - DNA, 25 bp, Homo sapien
tcagagactagtccaggtgccgctc

SEQ ID NO: 202098 - DNA, 25 bp, Homo sapien
cttcgcagatcagccaatagagatg

SEQ ID NO: 202099 - DNA, 25 bp, Homo sapien
aactctgcacccgaggagccctgaa

SEQ ID NO: 202100 - DNA, 25 bp, Homo sapien
acgctctatacgttcgaatcctgga

SEQ ID NO: 202101 - DNA, 25 bp, Homo sapien
tccctcggcaggttaacactgtctg

SEQ ID NO: 202102 - DNA, 25 bp, Homo sapien
actattgaagtctgccgcgctggga

SEQ ID NO: 202103 - DNA, 25 bp, Homo sapien
agcggcagctacacaagggacactc

SEQ ID NO: 202104 - DNA, 25 bp, Homo sapien
agccctccagggatcggatccaatg

SEQ ID NO: 202105 - DNA, 25 bp, Homo sapien
cgcagcaagtaacggaagtgggtca

SEQ ID NO: 202106 - DNA, 25 bp, Homo sapien
cctggacttatctaagcgctggctg

SEQ ID NO: 202107 - DNA, 25 bp, Homo sapien
ctgaacctggggatcctcctggagc

SEQ ID NO: 202108 - DNA, 25 bp, Homo sapien
ttcccgggcttcaagcagtgaccgc

SEQ ID NO: 202109 - DNA, 25 bp, Homo sapien
agtgaccgcagatgctgtgctcgcg

SEQ ID NO: 202110 - DNA, 25 bp, Homo sapien
aggtgtccaactcgtgggtgtgcct

SEQ ID NO: 202111 - DNA, 25 bp, Homo sapien
gcggcttgtccttctacggcctggc

SEQ ID NO: 202112 - DNA, 25 bp, Homo sapien
agtgggacgacaacgcgcagaccgt

SEQ ID NO: 202113 - DNA, 25 bp, Homo sapien
tgttccagctctaggagacccgctg

SEQ ID NO: 202114 - DNA, 25 bp, Homo sapien
aattcaggtgactaagcgcgtctgc

SEQ ID NO: 202115 - DNA, 25 bp, Homo sapien
ttcctgccgcgtgtccgggagacag

SEQ ID NO: 202116 - DNA, 25 bp, Homo sapien
ttcaggtgactaagcgcgtctgcga

SEQ ID NO: 202117 - DNA, 25 bp, Homo sapien
tcaaattcaggtgactaagcgcgtc

SEQ ID NO: 202118 - DNA, 25 bp, Homo sapien
tggatcaaattcaggtgactaagcg

SEQ ID NO: 202119 - DNA, 25 bp, Homo sapien
gggctgacgtcaggctccccatccc

SEQ ID NO: 202120 - DNA, 25 bp, Homo sapien
acgctgaggcccagatggatgcgcg

SEQ ID NO: 202121 - DNA, 25 bp, Homo sapien
tcaggtgactaagcgcgtctgcgag

SEQ ID NO: 202122 - DNA, 25 bp, Homo sapien
tagaaaagtcttcctgtcctggttc

SEQ ID NO: 202123 - DNA, 25 bp, Homo sapien
gacagcggagtggaaaccagattcc

SEQ ID NO: 202124 - DNA, 25 bp, Homo sapien
gcgctcggactcctggcccgaaatt

SEQ ID NO: 202125 - DNA, 25 bp, Homo sapien
ctcagtggcggtgaggatctagaaa

SEQ ID NO: 202126 - DNA, 25 bp, Homo sapien
ctggggtgatgacccgcaagcccaa

SEQ ID NO: 202127 - DNA, 25 bp, Homo sapien
gcggtgaggatctagaaaagtcttc

SEQ ID NO: 202128 - DNA, 25 bp, Homo sapien
cccgaaattccagggcggacacagc

SEQ ID NO: 202129 - DNA, 25 bp, Homo sapien
gatgacccgcaagcccaagggcgct

SEQ ID NO: 202130 - DNA, 25 bp, Homo sapien
gcctcgacgtcctccaacatgggtg

SEQ ID NO: 202131 - DNA, 25 bp, Homo sapien
cgctggttccagcacaggctaaaga

SEQ ID NO: 202132 - DNA, 25 bp, Homo sapien
gagcttcggcatccagaaaaccaga

SEQ ID NO: 202133 - DNA, 25 bp, Homo sapien
agtgggtttctttcttgcgttcaga

SEQ ID NO: 202134 - DNA, 25 bp, Homo sapien
accctggaggtgcttctgcctcgac

SEQ ID NO: 202135 - DNA, 25 bp, Homo sapien
acatgggtgtctcattttcggcttc

SEQ ID NO: 202136 - DNA, 25 bp, Homo sapien
caacatgggtgctgccagactctgc

SEQ ID NO: 202137 - DNA, 25 bp, Homo sapien
gattttcaaacgcaactcctacagg

SEQ ID NO: 202138 - DNA, 25 bp, Homo sapien
ggctccggaacctggcacagatctt

SEQ ID NO: 202139 - DNA, 25 bp, Homo sapien
gctgatccatggagactgcgagacc

SEQ ID NO: 202140 - DNA, 25 bp, Homo sapien
cacggcagcgctgatccatggagac

SEQ ID NO: 202141 - DNA, 25 bp, Homo sapien
tatcccactgccgaggagcgtggcc

SEQ ID NO: 202142 - DNA, 25 bp, Homo sapien
tggcacagatcttcctggaggactt

SEQ ID NO: 202143 - DNA, 25 bp, Homo sapien
tgcagtgcatgcttcgcttctccct

SEQ ID NO: 202144 - DNA, 25 bp, Homo sapien
gccacgcccgtggtgcagtgcatgc

SEQ ID NO: 202145 - DNA, 25 bp, Homo sapien
tgccctgggtatcccactgccgagg

SEQ ID NO: 202146 - DNA, 25 bp, Homo sapien
gagtccgccgggctgatttgcatag

SEQ ID NO: 202147 - DNA, 25 bp, Homo sapien
cttactccggtaggtcgttcatctc

SEQ ID NO: 202148 - DNA, 25 bp, Homo sapien
aaagcccggggcttcgtacacactg

SEQ ID NO: 202149 - DNA, 25 bp, Homo sapien
gtacacactggccactttatcctga

SEQ ID NO: 202150 - DNA, 25 bp, Homo sapien
agctctgcgcccttcacagagaagg

SEQ ID NO: 202151 - DNA, 25 bp, Homo sapien
gatttgcatagagtgtccgggccgc

SEQ ID NO: 202152 - DNA, 25 bp, Homo sapien
cgcccaggtcgtaaaccagtgccga

SEQ ID NO: 202153 - DNA, 25 bp, Homo sapien
agacaagagttctgggtcccggctt

SEQ ID NO: 202154 - DNA, 25 bp, Homo sapien
gacctgaccatgcatggggccctaa

SEQ ID NO: 202155 - DNA, 25 bp, Homo sapien
acccgccggcattggccgattcaaa

SEQ ID NO: 202156 - DNA, 25 bp, Homo sapien
gtccggccgatcgacgcctttatag

SEQ ID NO: 202157 - DNA, 25 bp, Homo sapien
tcaccgggagctattcctgctgttg

SEQ ID NO: 202158 - DNA, 25 bp, Homo sapien
ccagccgggatgcacacaggagaaa

SEQ ID NO: 202159 - DNA, 25 bp, Homo sapien
cgcgtggcccatcaatgggacaata

SEQ ID NO: 202160 - DNA, 25 bp, Homo sapien
tgcacctgtcaggtaggtccgaata

SEQ ID NO: 202161 - DNA, 25 bp, Homo sapien
cctgactccgtggaaggaatgaatg

SEQ ID NO: 202162 - DNA, 25 bp, Homo sapien
ttcacaaaagaggtaccaggtccgc

SEQ ID NO: 202163 - DNA, 25 bp, Homo sapien
gggtgcctcaaaagccgcgttcaaa

SEQ ID NO: 202164 - DNA, 25 bp, Homo sapien
agttaagccgcacaaagtctctctg

SEQ ID NO: 202165 - DNA, 25 bp, Homo sapien
aagtctctctgctcgtacctgtgcc

SEQ ID NO: 202166 - DNA, 25 bp, Homo sapien
gaaaccacatggtgttcgcggatta

SEQ ID NO: 202167 - DNA, 25 bp, Homo sapien
caccttgggcttttcgtcggccatg

SEQ ID NO: 202168 - DNA, 25 bp, Homo sapien
gcacgagtagccgaagcctcccatt

SEQ ID NO: 202169 - DNA, 25 bp, Homo sapien
ttcctacccgagaggtgaagcccga

SEQ ID NO: 202170 - DNA, 25 bp, Homo sapien
accagtgcaggttcacggtttcatg

SEQ ID NO: 202171 - DNA, 25 bp, Homo sapien
ttcagtaagacgagtgacgaggcgc

SEQ ID NO: 202172 - DNA, 25 bp, Homo sapien
aacgctccttcagcaccagtgcagg

SEQ ID NO: 202173 - DNA, 25 bp, Homo sapien
tgagtcccgataagcggaaaccgca

SEQ ID NO: 202174 - DNA, 25 bp, Homo sapien
gatgctttgcaggtgagtcccgata

SEQ ID NO: 202175 - DNA, 25 bp, Homo sapien
ttaactgcccgtcgggatgctttgc

SEQ ID NO: 202176 - DNA, 25 bp, Homo sapien
cacactgcgtggacttttaactgcc

SEQ ID NO: 202177 - DNA, 25 bp, Homo sapien
gcacactgcggcatctgtcttcgga

SEQ ID NO: 202178 - DNA, 25 bp, Homo sapien
gccacagctactgcaacctcaagga

SEQ ID NO: 202179 - DNA, 25 bp, Homo sapien
ccctgctgagactaagacgtggaca

SEQ ID NO: 202180 - DNA, 25 bp, Homo sapien
tgcacttcgcgctcttcgtgtccgt

SEQ ID NO: 202181 - DNA, 25 bp, Homo sapien
gccaccggcatcatgagcgaccaga

SEQ ID NO: 202182 - DNA, 25 bp, Homo sapien
tctacctgctttcggcgctctatgg

SEQ ID NO: 202183 - DNA, 25 bp, Homo sapien
gaggggctgacacacactcgcagac

SEQ ID NO: 202184 - DNA, 25 bp, Homo sapien
cgaggcgaaacctcgcggttcctct

SEQ ID NO: 202185 - DNA, 25 bp, Homo sapien
gctcatggtcaacgtggcgcacgat

SEQ ID NO: 202186 - DNA, 25 bp, Homo sapien
gacgttgtacgcttactgggaccta

SEQ ID NO: 202187 - DNA, 25 bp, Homo sapien
aggcttgtctgcttccctagtggtc

SEQ ID NO: 202188 - DNA, 25 bp, Homo sapien
cgatggcgagccaacagtcactgta

SEQ ID NO: 202189 - DNA, 25 bp, Homo sapien
agtcttgtctcgcagccagctctga

SEQ ID NO: 202190 - DNA, 25 bp, Homo sapien
cggcgctgttttccctgatttgctg

SEQ ID NO: 202191 - DNA, 25 bp, Homo sapien
gcctgatcctgttagcgcggtactc

SEQ ID NO: 202192 - DNA, 25 bp, Homo sapien
tgggacctaaatcccgcacgagttc

SEQ ID NO: 202193 - DNA, 25 bp, Homo sapien
tcagttgccacttttccggaggtcg

SEQ ID NO: 202194 - DNA, 25 bp, Homo sapien
cgcagatttaggaccctgaggagtc

SEQ ID NO: 202195 - DNA, 25 bp, Homo sapien
atccgaagcttctcccttagtcagg

SEQ ID NO: 202196 - DNA, 25 bp, Homo sapien
ccgaagcatgtcagcccgaagatct

SEQ ID NO: 202197 - DNA, 25 bp, Homo sapien
aaacggccgcggctactcactgagc

SEQ ID NO: 202198 - DNA, 25 bp, Homo sapien
cgcggcttcaaaactcgcgagagtc

SEQ ID NO: 202199 - DNA, 25 bp, Homo sapien
cgcgagagtctgcacgagctgagac

SEQ ID NO: 202200 - DNA, 25 bp, Homo sapien
ctgtcttgcagcttccagggtgaga

SEQ ID NO: 202201 - DNA, 25 bp, Homo sapien
cgccagactgcgacggatacaggga

SEQ ID NO: 202202 - DNA, 25 bp, Homo sapien
agcggaactcgcttggctcgtcacc

SEQ ID NO: 202203 - DNA, 25 bp, Homo sapien
gaactccaagcggtgcgactctgtc

SEQ ID NO: 202204 - DNA, 25 bp, Homo sapien
ctctctttctggctttcgccgagtc

SEQ ID NO: 202205 - DNA, 25 bp, Homo sapien
gagtggcagtaacccggccctacgc

SEQ ID NO: 202206 - DNA, 25 bp, Homo sapien
ttctggagccttcctcttactgggg

SEQ ID NO: 202207 - DNA, 25 bp, Homo sapien
cgcactcgagactcctaattcctga

SEQ ID NO: 202208 - DNA, 25 bp, Homo sapien
cctaattcctgagctccattctgga

SEQ ID NO: 202209 - DNA, 25 bp, Homo sapien
ttcgccgagtccttcggtctcaaca

SEQ ID NO: 202210 - DNA, 25 bp, Homo sapien
tgtccctggagatgcttctctggtc

SEQ ID NO: 202211 - DNA, 25 bp, Homo sapien
caccgggtaatgtagtccttcgcga

SEQ ID NO: 202212 - DNA, 25 bp, Homo sapien
accaatggttgtgcgcttgaggtct

SEQ ID NO: 202213 - DNA, 25 bp, Homo sapien
gcgcgagttcgaccgacgcgttaga

SEQ ID NO: 202214 - DNA, 25 bp, Homo sapien
ctctactgagctcggacgaaactgg

SEQ ID NO: 202215 - DNA, 25 bp, Homo sapien
tagaggttactcacacggctcggcg

SEQ ID NO: 202216 - DNA, 25 bp, Homo sapien
cgtgtgactcgaaagtcagcctgca

SEQ ID NO: 202217 - DNA, 25 bp, Homo sapien
tagctcctcgcgcagtcttaacagc

SEQ ID NO: 202218 - DNA, 25 bp, Homo sapien
tggggcccagatcgccgagctcagc

SEQ ID NO: 202219 - DNA, 25 bp, Homo sapien
gagcgctccgcggagaaccgcacgt

SEQ ID NO: 202220 - DNA, 25 bp, Homo sapien
gcagacccgagcagactccgcgagg

SEQ ID NO: 202221 - DNA, 25 bp, Homo sapien
tgttaaggcgttcgtcctcctgctc

SEQ ID NO: 202222 - DNA, 25 bp, Homo sapien
gctcattggtcggagcgaacggccc

SEQ ID NO: 202223 - DNA, 25 bp, Homo sapien
cctcctggactaagggaccgcggtg

SEQ ID NO: 202224 - DNA, 25 bp, Homo sapien
gctcctgcaggaagacgctccggcg

SEQ ID NO: 202225 - DNA, 25 bp, Homo sapien
ctctcccttgcaggctcggggcagg

SEQ ID NO: 202226 - DNA, 25 bp, Homo sapien
gaaccagctaggtgtcagggcgcat

SEQ ID NO: 202227 - DNA, 25 bp, Homo sapien
ccaggctcgggtagactgactcggt

SEQ ID NO: 202228 - DNA, 25 bp, Homo sapien
tccgtgcaaaccctcccgatgaagg

SEQ ID NO: 202229 - DNA, 25 bp, Homo sapien
cctcccgatgaaggcaggggacctc

SEQ ID NO: 202230 - DNA, 25 bp, Homo sapien
ctgcccagagccaagagccggagga

SEQ ID NO: 202231 - DNA, 25 bp, Homo sapien
ggggattgcgctccacgtcccaagc

SEQ ID NO: 202232 - DNA, 25 bp, Homo sapien
gtcgccgaagcagcaatacctcctg

SEQ ID NO: 202233 - DNA, 25 bp, Homo sapien
cactcccgctgtagagccaagagga

SEQ ID NO: 202234 - DNA, 25 bp, Homo sapien
tagccaataagaagccagaattccc

SEQ ID NO: 202235 - DNA, 25 bp, Homo sapien
ttctcaaatcctgaccaatcggtgg

SEQ ID NO: 202236 - DNA, 25 bp, Homo sapien
caatcggtggcctgaactttagctc

SEQ ID NO: 202237 - DNA, 25 bp, Homo sapien
aactttagctctctggccggcgcct

SEQ ID NO: 202238 - DNA, 25 bp, Homo sapien
ccttagagttgccagtaacggacat

SEQ ID NO: 202239 - DNA, 25 bp, Homo sapien
agttgccagtaacggacatggctgc

SEQ ID NO: 202240 - DNA, 25 bp, Homo sapien
agcacgccgcgtagccaataagaag

SEQ ID NO: 202241 - DNA, 25 bp, Homo sapien
gcggttgcagctacagcctagcacg

SEQ ID NO: 202242 - DNA, 25 bp, Homo sapien
acagtgtctgattccgtgaggttga

SEQ ID NO: 202243 - DNA, 25 bp, Homo sapien
ttccgtgaggttgaaatcgaggccg

SEQ ID NO: 202244 - DNA, 25 bp, Homo sapien
gtggcactggccactccgaaggcca

SEQ ID NO: 202245 - DNA, 25 bp, Homo sapien
actccgaaggccagcagtgcggtct

SEQ ID NO: 202246 - DNA, 25 bp, Homo sapien
agtgcggtctgcagtggctctctct

SEQ ID NO: 202247 - DNA, 25 bp, Homo sapien
tctctctcccggcacttgggcctcc

SEQ ID NO: 202248 - DNA, 25 bp, Homo sapien
gctgtttgatggtcaggttcccttc

SEQ ID NO: 202249 - DNA, 25 bp, Homo sapien
gggcctccgcttaacagtgtctgat

SEQ ID NO: 202250 - DNA, 25 bp, Homo sapien
tgctgaccacctcgacaatgcccgg

SEQ ID NO: 202251 - DNA, 25 bp, Homo sapien
ccgtcgggatgctgttctagcacct

SEQ ID NO: 202252 - DNA, 25 bp, Homo sapien
gcagggatgcccacccgcttgctga

SEQ ID NO: 202253 - DNA, 25 bp, Homo sapien
ctctcgtggatgtggcccttccagc

SEQ ID NO: 202254 - DNA, 25 bp, Homo sapien
gggatgctgttctagcacctgcggc

SEQ ID NO: 202255 - DNA, 25 bp, Homo sapien
gaagtagcctatgcggtctgtgccc

SEQ ID NO: 202256 - DNA, 25 bp, Homo sapien
ccctctggctctcgtggatgtggcc

SEQ ID NO: 202257 - DNA, 25 bp, Homo sapien
cttccagcggccgtcgggatgctgt

SEQ ID NO: 202258 - DNA, 25 bp, Homo sapien
accgctcctgacagttcccgggtgg

SEQ ID NO: 202259 - DNA, 25 bp, Homo sapien
gaggggccttctgcatctccagcaa

SEQ ID NO: 202260 - DNA, 25 bp, Homo sapien
gctctggacttagacccaagggcta

SEQ ID NO: 202261 - DNA, 25 bp, Homo sapien
agacaccgaaggaatggcgaacctc

SEQ ID NO: 202262 - DNA, 25 bp, Homo sapien
gccttcggcctgcaaagtcggaatt

SEQ ID NO: 202263 - DNA, 25 bp, Homo sapien
gtcacaagtgtgaccattcgcactg

SEQ ID NO: 202264 - DNA, 25 bp, Homo sapien
tcctcaggctttactggagagaagc

SEQ ID NO: 202265 - DNA, 25 bp, Homo sapien
caatggcaccacctagcggacggca

SEQ ID NO: 202266 - DNA, 25 bp, Homo sapien
tcctcaaggctttgtgaacggcggc

SEQ ID NO: 202267 - DNA, 25 bp, Homo sapien
aagcacgtgcttccaagggtcctca

SEQ ID NO: 202268 - DNA, 25 bp, Homo sapien
aggagattttcggacctgcgacttc

SEQ ID NO: 202269 - DNA, 25 bp, Homo sapien
actggtttatgttgctcttcgccga

SEQ ID NO: 202270 - DNA, 25 bp, Homo sapien
ggctgattgcctgggactggtttat

SEQ ID NO: 202271 - DNA, 25 bp, Homo sapien
agtgcgggcgtcgatatacctcgcc

SEQ ID NO: 202272 - DNA, 25 bp, Homo sapien
acttccgaacaaccctggcaggagg

SEQ ID NO: 202273 - DNA, 25 bp, Homo sapien
gccggccaaggacagaattaactcc

SEQ ID NO: 202274 - DNA, 25 bp, Homo sapien
ctggaacttcgagcagatctccttc

SEQ ID NO: 202275 - DNA, 25 bp, Homo sapien
atgtcaacgccgatcccgaggtgca

SEQ ID NO: 202276 - DNA, 25 bp, Homo sapien
gcagttccaggaagatgtcaacgcc

SEQ ID NO: 202277 - DNA, 25 bp, Homo sapien
aaggagaagctctccaggcgggaac

SEQ ID NO: 202278 - DNA, 25 bp, Homo sapien
gctgaaccagcgcaaggagaagctc

SEQ ID NO: 202279 - DNA, 25 bp, Homo sapien
agacagacgctgagtcctggtgcca

SEQ ID NO: 202280 - DNA, 25 bp, Homo sapien
gtaagcggcgctggaacttcgagca

SEQ ID NO: 202281 - DNA, 25 bp, Homo sapien
aacatggcttcagacagccgccaca

SEQ ID NO: 202282 - DNA, 25 bp, Homo sapien
ggcaggctcgccctttatgtaaata

SEQ ID NO: 202283 - DNA, 25 bp, Homo sapien
cgggaactatttccgcttgcgggag

SEQ ID NO: 202284 - DNA, 25 bp, Homo sapien
gttctgcgggaaacttctctgcctg

SEQ ID NO: 202285 - DNA, 25 bp, Homo sapien
tgcgcgatgactgaaacttgggctt

SEQ ID NO: 202286 - DNA, 25 bp, Homo sapien
acttgggcttgggtttgcacaataa

SEQ ID NO: 202287 - DNA, 25 bp, Homo sapien
cacaataatgttggcttaggagagc

SEQ ID NO: 202288 - DNA, 25 bp, Homo sapien
acaccatccctctcgtggggctgga

SEQ ID NO: 202289 - DNA, 25 bp, Homo sapien
tctctgcctgatctgcgcgatgact

SEQ ID NO: 202290 - DNA, 25 bp, Homo sapien
ctgtcactctgacggcagctactgc

SEQ ID NO: 202291 - DNA, 25 bp, Homo sapien
cttacggtcagtgtttcacccgccg

SEQ ID NO: 202292 - DNA, 25 bp, Homo sapien
cagcctcgtgccttacggtcagtgt

SEQ ID NO: 202293 - DNA, 25 bp, Homo sapien
agctactgccagtggcccgtgtcca

SEQ ID NO: 202294 - DNA, 25 bp, Homo sapien
gcctgctcgtcagctgtcactctga

SEQ ID NO: 202295 - DNA, 25 bp, Homo sapien
agcaactggagaacatctggtggca

SEQ ID NO: 202296 - DNA, 25 bp, Homo sapien
tcctccatagcaactggagaacatc

SEQ ID NO: 202297 - DNA, 25 bp, Homo sapien
tgtccagcgaagcccagcaaccaga

SEQ ID NO: 202298 - DNA, 25 bp, Homo sapien
gaggacgtcagtggcatcgcctcct

SEQ ID NO: 202299 - DNA, 25 bp, Homo sapien
caaatatggccaaggtgtttgagcc

SEQ ID NO: 202300 - DNA, 25 bp, Homo sapien
gggagcaccacctggcagtccttac

SEQ ID NO: 202301 - DNA, 25 bp, Homo sapien
caacctgggcgacatccaggtggtc

SEQ ID NO: 202302 - DNA, 25 bp, Homo sapien
agtggcatcgcctcctgcgtcttca

SEQ ID NO: 202303 - DNA, 25 bp, Homo sapien
tgcgtcttcaccaaatatggccaag

SEQ ID NO: 202304 - DNA, 25 bp, Homo sapien
tcggcagtcgtcgagccgaggacta

SEQ ID NO: 202305 - DNA, 25 bp, Homo sapien
tggcagtccttaccaacctgggcga

SEQ ID NO: 202306 - DNA, 25 bp, Homo sapien
gacatgggctcggaagggacaaaaa

SEQ ID NO: 202307 - DNA, 25 bp, Homo sapien
gccggccaaggacgcgagcgacaac

SEQ ID NO: 202308 - DNA, 25 bp, Homo sapien
ctccaggaccttcgaggacagctcg

SEQ ID NO: 202309 - DNA, 25 bp, Homo sapien
gactccgactcgagtccgctgggga

SEQ ID NO: 202310 - DNA, 25 bp, Homo sapien
agccaagcagcgacggcctggacag

SEQ ID NO: 202311 - DNA, 25 bp, Homo sapien
cgccggagcctacggacatgggctc

SEQ ID NO: 202312 - DNA, 25 bp, Homo sapien
ggcgccgagccagaaacaatgcagg

SEQ ID NO: 202313 - DNA, 25 bp, Homo sapien
tgtccggacagcgaaacccgcgagg

SEQ ID NO: 202314 - DNA, 25 bp, Homo sapien
cggctccttgtgtccgtctctctga

SEQ ID NO: 202315 - DNA, 25 bp, Homo sapien
aggatgtcggtggtctcaggtacca

SEQ ID NO: 202316 - DNA, 25 bp, Homo sapien
ccacggtcaggaacctgaggatgtc

SEQ ID NO: 202317 - DNA, 25 bp, Homo sapien
gcggcagtgtgactctgaacatctc

SEQ ID NO: 202318 - DNA, 25 bp, Homo sapien
gtccagccaggctttcccgacttgt

SEQ ID NO: 202319 - DNA, 25 bp, Homo sapien
acagaagcagcctcgagctctcggg

SEQ ID NO: 202320 - DNA, 25 bp, Homo sapien
tgcacatataaacagaagcagcctc

SEQ ID NO: 202321 - DNA, 25 bp, Homo sapien
tgaacatctcccgagctcaggacgg

SEQ ID NO: 202322 - DNA, 25 bp, Homo sapien
tccctcatacagctcggggtcaaag

SEQ ID NO: 202323 - DNA, 25 bp, Homo sapien
agcgtctgttcacccgagcctgaat

SEQ ID NO: 202324 - DNA, 25 bp, Homo sapien
agcccagtcggccagcgtctgttca

SEQ ID NO: 202325 - DNA, 25 bp, Homo sapien
aagtacttggcaatggcggcatggc

SEQ ID NO: 202326 - DNA, 25 bp, Homo sapien
cccgaagtacttggcaatggcggca

SEQ ID NO: 202327 - DNA, 25 bp, Homo sapien
ggttctggcagtggtcgcagccttt

SEQ ID NO: 202328 - DNA, 25 bp, Homo sapien
gatgcaggtcttgctccagctgctg

SEQ ID NO: 202329 - DNA, 25 bp, Homo sapien
agggcccgatgcaggtcttgctcca

SEQ ID NO: 202330 - DNA, 25 bp, Homo sapien
ttcagctttaggcagaacccacgca

SEQ ID NO: 202331 - DNA, 25 bp, Homo sapien
gcaatcttatatccgtcgcgcagtg

SEQ ID NO: 202332 - DNA, 25 bp, Homo sapien
ccctaagatatcagaaccggccgtg

SEQ ID NO: 202333 - DNA, 25 bp, Homo sapien
tggtccgcccaagaattaaaggctg

SEQ ID NO: 202334 - DNA, 25 bp, Homo sapien
gcaattttctctcttggctggccga

SEQ ID NO: 202335 - DNA, 25 bp, Homo sapien
ctctcgcagtttacgcggaagattc

SEQ ID NO: 202336 - DNA, 25 bp, Homo sapien
tcctgagcccaagatccgcaatttt

SEQ ID NO: 202337 - DNA, 25 bp, Homo sapien
cctgggatccgaaagaacctgcctt

SEQ ID NO: 202338 - DNA, 25 bp, Homo sapien
agcgcctccttcctacctgcgcgcc

SEQ ID NO: 202339 - DNA, 25 bp, Homo sapien
gcgaaggaatgcagccggtctgact

SEQ ID NO: 202340 - DNA, 25 bp, Homo sapien
gccctcggacagtccctgctcgccc

SEQ ID NO: 202341 - DNA, 25 bp, Homo sapien
cggtctgactcaccagcgcctcctt

SEQ ID NO: 202342 - DNA, 25 bp, Homo sapien
actccctgggcccatgcctcgcgct

SEQ ID NO: 202343 - DNA, 25 bp, Homo sapien
ccgcgcgaaggaatgcagccggtct

SEQ ID NO: 202344 - DNA, 25 bp, Homo sapien
cagcccggcgttggctagcggccca

SEQ ID NO: 202345 - DNA, 25 bp, Homo sapien
acgctgcgcaggacaggtgcccagc

SEQ ID NO: 202346 - DNA, 25 bp, Homo sapien
aggacacaggactacccgtcggtgc

SEQ ID NO: 202347 - DNA, 25 bp, Homo sapien
ccgcaacgatgaacggtgccacctg

SEQ ID NO: 202348 - DNA, 25 bp, Homo sapien
cacgacgccgtgatgcgtgtcagca

SEQ ID NO: 202349 - DNA, 25 bp, Homo sapien
cctacacccagtacaggacacagga

SEQ ID NO: 202350 - DNA, 25 bp, Homo sapien
caccgagtcagccttccactatgag

SEQ ID NO: 202351 - DNA, 25 bp, Homo sapien
cttccactatgaggctgatggcgcc

SEQ ID NO: 202352 - DNA, 25 bp, Homo sapien
cgccaacgtgctggctggcatcatg

SEQ ID NO: 202353 - DNA, 25 bp, Homo sapien
gctggcatcatgagccgcaacgatg

SEQ ID NO: 202354 - DNA, 25 bp, Homo sapien
tgcccgaactgcacggcgatgcaga

SEQ ID NO: 202355 - DNA, 25 bp, Homo sapien
gaagccgtaggcctccatgagcggc

SEQ ID NO: 202356 - DNA, 25 bp, Homo sapien
cctgcgtatccgagtggcagcgctt

SEQ ID NO: 202357 - DNA, 25 bp, Homo sapien
gcgagcacaggaagacctgcgtatc

SEQ ID NO: 202358 - DNA, 25 bp, Homo sapien
tagtagtcgtactcctcgcagcgcg

SEQ ID NO: 202359 - DNA, 25 bp, Homo sapien
ttgtggcagtgcagcatctcaggcc

SEQ ID NO: 202360 - DNA, 25 bp, Homo sapien
tgctgcttcacttcggccaggctct

SEQ ID NO: 202361 - DNA, 25 bp, Homo sapien
cgcttgtagcccaccgtgtggcaga

SEQ ID NO: 202362 - DNA, 25 bp, Homo sapien
gaggccatcgacgtgcccgcaggca

SEQ ID NO: 202363 - DNA, 25 bp, Homo sapien
cgacgtgcccgcaggcactgccacc

SEQ ID NO: 202364 - DNA, 25 bp, Homo sapien
ctttatccggcctgaggatgacgac

SEQ ID NO: 202365 - DNA, 25 bp, Homo sapien
tctttatccggcctgaggatgacga

SEQ ID NO: 202366 - DNA, 25 bp, Homo sapien
gggtgcccctctttatccggcctga

SEQ ID NO: 202367 - DNA, 25 bp, Homo sapien
ctggtggacgtacgggtgcccctct

SEQ ID NO: 202368 - DNA, 25 bp, Homo sapien
tgtgacccacctctgaccacctccg

SEQ ID NO: 202369 - DNA, 25 bp, Homo sapien
tgtgccactgcctcgcacctcccgc

SEQ ID NO: 202370 - DNA, 25 bp, Homo sapien
ctggaaaggcttcagccgcgcaagg

SEQ ID NO: 202371 - DNA, 25 bp, Homo sapien
catctggaaaggcttcagccgcgca

SEQ ID NO: 202372 - DNA, 25 bp, Homo sapien
ccctcgcagagcctacggccttccc

SEQ ID NO: 202373 - DNA, 25 bp, Homo sapien
cccggaggtgacaggctcacccgcc

SEQ ID NO: 202374 - DNA, 25 bp, Homo sapien
tcatcccgcgcctgtcggccagcag

SEQ ID NO: 202375 - DNA, 25 bp, Homo sapien
cggctggaagttcgagcccctgctg

SEQ ID NO: 202376 - DNA, 25 bp, Homo sapien
cggcccttcgttgttcccaaggctg

SEQ ID NO: 202377 - DNA, 25 bp, Homo sapien
caagggtttcacctgccgcggcctt

SEQ ID NO: 202378 - DNA, 25 bp, Homo sapien
gggactcttccgtgcaccggtgctc

SEQ ID NO: 202379 - DNA, 25 bp, Homo sapien
gcgtggcacacagggcctcacagtt

SEQ ID NO: 202380 - DNA, 25 bp, Homo sapien
ctcacagtttaaggggaacatgctc

SEQ ID NO: 202381 - DNA, 25 bp, Homo sapien
ttccaacgtggggaacagcctgtcc

SEQ ID NO: 202382 - DNA, 25 bp, Homo sapien
tcaaagcagccatgacgcgcgcctg

SEQ ID NO: 202383 - DNA, 25 bp, Homo sapien
caccaggccctggttgtagtccgtg

SEQ ID NO: 202384 - DNA, 25 bp, Homo sapien
cgcgacctggggctgtctcaaagca

SEQ ID NO: 202385 - DNA, 25 bp, Homo sapien
gaacatgctcccaggttgaaggcga

SEQ ID NO: 202386 - DNA, 25 bp, Homo sapien
cctaatgactcaggctgcgaggagc

SEQ ID NO: 202387 - DNA, 25 bp, Homo sapien
ttataggcacgcttcacgctgcgtc

SEQ ID NO: 202388 - DNA, 25 bp, Homo sapien
cgcgtcgcctccgtttttataggca

SEQ ID NO: 202389 - DNA, 25 bp, Homo sapien
gtcgacgagcgaaaaaccagcaccg

SEQ ID NO: 202390 - DNA, 25 bp, Homo sapien
gcagaacctgaagccgcgggtaaac

SEQ ID NO: 202391 - DNA, 25 bp, Homo sapien
gggacctctgaatcaccgccgggaa

SEQ ID NO: 202392 - DNA, 25 bp, Homo sapien
cgcccgacctacctgtagcgatgag

SEQ ID NO: 202393 - DNA, 25 bp, Homo sapien
gcgccaacggttggcagaacctgaa

SEQ ID NO: 202394 - DNA, 25 bp, Homo sapien
ctgaataataaaaggggagcggcga

SEQ ID NO: 202395 - DNA, 25 bp, Homo sapien
gccaccaacctctggtcgggctgtg

SEQ ID NO: 202396 - DNA, 25 bp, Homo sapien
ccagaccggttccaacctgctgggg

SEQ ID NO: 202397 - DNA, 25 bp, Homo sapien
acgcctgacgtcagcggccagcgtg

SEQ ID NO: 202398 - DNA, 25 bp, Homo sapien
gaaaccgcagcactacacgtacgta

SEQ ID NO: 202399 - DNA, 25 bp, Homo sapien
aagacaagaccatgtcgaagggccc

SEQ ID NO: 202400 - DNA, 25 bp, Homo sapien
cgcggaccgcgcagactgaataata

SEQ ID NO: 202401 - DNA, 25 bp, Homo sapien
gctaccgctcaggtgctgcaggcac

SEQ ID NO: 202402 - DNA, 25 bp, Homo sapien
tccaggatccttccgcagtgttttc

SEQ ID NO: 202403 - DNA, 25 bp, Homo sapien
actcagcagacgtttatggggcgca

SEQ ID NO: 202404 - DNA, 25 bp, Homo sapien
ggggagctttcgttcactcagcaga

SEQ ID NO: 202405 - DNA, 25 bp, Homo sapien
tcggcctgtccctatgctggaggaa

SEQ ID NO: 202406 - DNA, 25 bp, Homo sapien
gggtcccgagactcaaaacgcaatg

SEQ ID NO: 202407 - DNA, 25 bp, Homo sapien
atagtctctccaacaggggtcccga

SEQ ID NO: 202408 - DNA, 25 bp, Homo sapien
cacctctcggtgttattgacgatca

SEQ ID NO: 202409 - DNA, 25 bp, Homo sapien
cgagtgattcttgttgagcgccata

SEQ ID NO: 202410 - DNA, 25 bp, Homo sapien
ccaaagatgccaagcctgcggcaga

SEQ ID NO: 202411 - DNA, 25 bp, Homo sapien
gctgaggtcatcaaactcgcggccc

SEQ ID NO: 202412 - DNA, 25 bp, Homo sapien
tgctcggggctgaggtcatcaaact

SEQ ID NO: 202413 - DNA, 25 bp, Homo sapien
gtgatcatgaccacgcggatgcccg

SEQ ID NO: 202414 - DNA, 25 bp, Homo sapien
atgcccgcctggtagcagcgtgtga

SEQ ID NO: 202415 - DNA, 25 bp, Homo sapien
aagcctgcggcagatggccacggca

SEQ ID NO: 202416 - DNA, 25 bp, Homo sapien
ggcgggtccagcatgcctacgcagc

SEQ ID NO: 202417 - DNA, 25 bp, Homo sapien
agcagcgtgtgatgcaggcagccac

SEQ ID NO: 202418 - DNA, 25 bp, Homo sapien
cacggtcagcgtattccaggcagac

SEQ ID NO: 202419 - DNA, 25 bp, Homo sapien
ttcagcctccgcaggaggctcatct

SEQ ID NO: 202420 - DNA, 25 bp, Homo sapien
gaggctcatcttgccgtcccgtaca

SEQ ID NO: 202421 - DNA, 25 bp, Homo sapien
aaggccaaggcacggtcagcgtatt

SEQ ID NO: 202422 - DNA, 25 bp, Homo sapien
tccagcccatgaaaccagacggaga

SEQ ID NO: 202423 - DNA, 25 bp, Homo sapien
aaccagacggagaagctgcgtccat

SEQ ID NO: 202424 - DNA, 25 bp, Homo sapien
tgcgtccattccactgcaggcagca

SEQ ID NO: 202425 - DNA, 25 bp, Homo sapien
tcccgtacagcatagaaggccaagg

SEQ ID NO: 202426 - DNA, 25 bp, Homo sapien
cagcagctcggacagcgtgtggttc

SEQ ID NO: 202427 - DNA, 25 bp, Homo sapien
ttcgcgtccttgtcctgttctcacg

SEQ ID NO: 202428 - DNA, 25 bp, Homo sapien
caccgccagcagatgaccttgtcaa

SEQ ID NO: 202429 - DNA, 25 bp, Homo sapien
tcaaggctggaagggaccgcaaaga

SEQ ID NO: 202430 - DNA, 25 bp, Homo sapien
tagaggaggagattaagacccaacc

SEQ ID NO: 202431 - DNA, 25 bp, Homo sapien
ctcccggagtggctctaggcagatg

SEQ ID NO: 202432 - DNA, 25 bp, Homo sapien
tgaagggtccactgccgtccatgac

SEQ ID NO: 202433 - DNA, 25 bp, Homo sapien
ggaccgcaaagatcctcaggttaga

SEQ ID NO: 202434 - DNA, 25 bp, Homo sapien
tcctggcgcgacagatagaagtgac

SEQ ID NO: 202435 - DNA, 25 bp, Homo sapien
cccagtgtcaccgagtggtctgacg

SEQ ID NO: 202436 - DNA, 25 bp, Homo sapien
accgagtggtctgacgcgcgcacct

SEQ ID NO: 202437 - DNA, 25 bp, Homo sapien
ctgggcacattgcacctgccagagc

SEQ ID NO: 202438 - DNA, 25 bp, Homo sapien
ctgccagagctcaaagctgccgggc

SEQ ID NO: 202439 - DNA, 25 bp, Homo sapien
ctgacgacagtgcttcacctgctgg

SEQ ID NO: 202440 - DNA, 25 bp, Homo sapien
taggagacgcccagtgtcaccgagt

SEQ ID NO: 202441 - DNA, 25 bp, Homo sapien
cccgggactgacgacagtgcttcac

SEQ ID NO: 202442 - DNA, 25 bp, Homo sapien
ccgcgcaggccagatcgataaggag

SEQ ID NO: 202443 - DNA, 25 bp, Homo sapien
cgtgtgcccagctcagacgttacca

SEQ ID NO: 202444 - DNA, 25 bp, Homo sapien
ccacggcccagaggtaaagcgctca

SEQ ID NO: 202445 - DNA, 25 bp, Homo sapien
cctgcacaggatcatcgaggtcgtc

SEQ ID NO: 202446 - DNA, 25 bp, Homo sapien
cgacaatgatttctgcggcaccgac

SEQ ID NO: 202447 - DNA, 25 bp, Homo sapien
tggtgggctccatcgacaatgattt

SEQ ID NO: 202448 - DNA, 25 bp, Homo sapien
cgcctacctcaacgtggtgggcatg

SEQ ID NO: 202449 - DNA, 25 bp, Homo sapien
ttacggcgatgagacgtgctgtttg

SEQ ID NO: 202450 - DNA, 25 bp, Homo sapien
agctgagttcggctctctagggtcc

SEQ ID NO: 202451 - DNA, 25 bp, Homo sapien
acctcgcgcttgaggcgctcggcat

SEQ ID NO: 202452 - DNA, 25 bp, Homo sapien
agcgcccgctcgtggaggcgacact

SEQ ID NO: 202453 - DNA, 25 bp, Homo sapien
cctcggtccggcagaagagctccag

SEQ ID NO: 202454 - DNA, 25 bp, Homo sapien
tcggggcacgcctttccgcagcggt

SEQ ID NO: 202455 - DNA, 25 bp, Homo sapien
tggcccgctcgaaggttccgcgttc

SEQ ID NO: 202456 - DNA, 25 bp, Homo sapien
cctggagaccagaggctcgaaaacc

SEQ ID NO: 202457 - DNA, 25 bp, Homo sapien
cagatggcgcaggtcagcttctcct

SEQ ID NO: 202458 - DNA, 25 bp, Homo sapien
gtcgaagctccggtacttctccagc

SEQ ID NO: 202459 - DNA, 25 bp, Homo sapien
cagtcatatgctcgcccatggctgg

SEQ ID NO: 202460 - DNA, 25 bp, Homo sapien
aatactctcggtaggtccgccacca

SEQ ID NO: 202461 - DNA, 25 bp, Homo sapien
agcggtcgaagctccggtacttctc

SEQ ID NO: 202462 - DNA, 25 bp, Homo sapien
tgcggagcaggcctcagacgcctgt

SEQ ID NO: 202463 - DNA, 25 bp, Homo sapien
cgatgtcactgttgggcatcggccc

SEQ ID NO: 202464 - DNA, 25 bp, Homo sapien
caggttgctcaagtcgatgtcactg

SEQ ID NO: 202465 - DNA, 25 bp, Homo sapien
gcggagccgagagcagtcatatgct

SEQ ID NO: 202466 - DNA, 25 bp, Homo sapien
ctcggcgcggagcttgacacgcagg

SEQ ID NO: 202467 - DNA, 25 bp, Homo sapien
agcttgacacgcagggcggtggcgt

SEQ ID NO: 202468 - DNA, 25 bp, Homo sapien
gcggtggcgttgatcctctccttct

SEQ ID NO: 202469 - DNA, 25 bp, Homo sapien
gtggcgttgatcctctccttctcca

SEQ ID NO: 202470 - DNA, 25 bp, Homo sapien
tcgtacttctcggaggccacctgca

SEQ ID NO: 202471 - DNA, 25 bp, Homo sapien
cccacgcccatgtgcccgagcagca

SEQ ID NO: 202472 - DNA, 25 bp, Homo sapien
ccgagcagcaccttgctcatgctct

SEQ ID NO: 202473 - DNA, 25 bp, Homo sapien
tgcctgggctcagatgcgcccacgc

SEQ ID NO: 202474 - DNA, 25 bp, Homo sapien
tcctcgtggtctctgcgcatgtcta

SEQ ID NO: 202475 - DNA, 25 bp, Homo sapien
ctctcggtccttcagcagctttagc

SEQ ID NO: 202476 - DNA, 25 bp, Homo sapien
ggatgatgctattcagggacctgga

SEQ ID NO: 202477 - DNA, 25 bp, Homo sapien
gcagctgctcgtcacgctgccggat

SEQ ID NO: 202478 - DNA, 25 bp, Homo sapien
ggagaacttctccatctggtggatg

SEQ ID NO: 202479 - DNA, 25 bp, Homo sapien
cctccacgcgggaggacaactcgtg

SEQ ID NO: 202480 - DNA, 25 bp, Homo sapien
cgcatgtctaggatggacgccctga

SEQ ID NO: 202481 - DNA, 25 bp, Homo sapien
aggacaactcgtgcaggctgctgga

SEQ ID NO: 202482 - DNA, 25 bp, Homo sapien
atgcgtcacccttctgagcgcccgg

SEQ ID NO: 202483 - DNA, 25 bp, Homo sapien
tcctgcccacttctgagggctgaca

SEQ ID NO: 202484 - DNA, 25 bp, Homo sapien
gaagcttaaaagttcctcctgccca

SEQ ID NO: 202485 - DNA, 25 bp, Homo sapien
caaaggccctcttgggaactgccgg

SEQ ID NO: 202486 - DNA, 25 bp, Homo sapien
gccaggctcaaaggccctcttggga

SEQ ID NO: 202487 - DNA, 25 bp, Homo sapien
tggggacgccatgaagaactacagc

SEQ ID NO: 202488 - DNA, 25 bp, Homo sapien
cggaagcctcctgttacgcgccgtg

SEQ ID NO: 202489 - DNA, 25 bp, Homo sapien
gagcgcagcctgtaacgctctcagc

SEQ ID NO: 202490 - DNA, 25 bp, Homo sapien
ggggctccgaaggtcaagaaactgc

SEQ ID NO: 202491 - DNA, 25 bp, Homo sapien
gaccggcgacgcctagaacaggttg

SEQ ID NO: 202492 - DNA, 25 bp, Homo sapien
ccacgcgaggcggaaagaagaaatc

SEQ ID NO: 202493 - DNA, 25 bp, Homo sapien
gtctccagcttttctcgggaaagga

SEQ ID NO: 202494 - DNA, 25 bp, Homo sapien
cagcgaagtaagcaccgaccgaggt

SEQ ID NO: 202495 - DNA, 25 bp, Homo sapien
cgtccaggatgtgtgtaagcagctc

SEQ ID NO: 202496 - DNA, 25 bp, Homo sapien
tccgcatcgagggagtctccagctt

SEQ ID NO: 202497 - DNA, 25 bp, Homo sapien
cgaggtggcagtgacaatctaaatc

SEQ ID NO: 202498 - DNA, 25 bp, Homo sapien
tcagctcggttacctgggtcttctc

SEQ ID NO: 202499 - DNA, 25 bp, Homo sapien
ggccgtccttgtacagatggtactc

SEQ ID NO: 202500 - DNA, 25 bp, Homo sapien
atggagtactgcttcccgctcttgc

SEQ ID NO: 202501 - DNA, 25 bp, Homo sapien
acccggatcacttccttgtagatgg

SEQ ID NO: 202502 - DNA, 25 bp, Homo sapien
agatggtcttctcctgcgatttggc

SEQ ID NO: 202503 - DNA, 25 bp, Homo sapien
tggctttctggaggacgtcaatctg

SEQ ID NO: 202504 - DNA, 25 bp, Homo sapien
gcaggttcttgcactcccgattcag

SEQ ID NO: 202505 - DNA, 25 bp, Homo sapien
tacaagcagcgcaaactcggagatg

SEQ ID NO: 202506 - DNA, 25 bp, Homo sapien
ggctaccacgaacatctggggagcg

SEQ ID NO: 202507 - DNA, 25 bp, Homo sapien
acgtggtacccgagatggtgaactc

SEQ ID NO: 202508 - DNA, 25 bp, Homo sapien
ggcctcggctaccacgaacatctgg

SEQ ID NO: 202509 - DNA, 25 bp, Homo sapien
tgcaaaaggcaggagcccgcatcgg

SEQ ID NO: 202510 - DNA, 25 bp, Homo sapien
ttgcacagggcgcagatggtcgcca

SEQ ID NO: 202511 - DNA, 25 bp, Homo sapien
tagtccagagccgagtcgttgcaca

SEQ ID NO: 202512 - DNA, 25 bp, Homo sapien
gcggtcaccaggaggacctcggctc

SEQ ID NO: 202513 - DNA, 25 bp, Homo sapien
agatggtgaactcgtgcaaaaggca

SEQ ID NO: 202514 - DNA, 25 bp, Homo sapien
aggacccagtcgctcaccgcaggtc

SEQ ID NO: 202515 - DNA, 25 bp, Homo sapien
agcacgcaggtctgctgttccagca

SEQ ID NO: 202516 - DNA, 25 bp, Homo sapien
catgcgtgctccgaggccttcagcg

SEQ ID NO: 202517 - DNA, 25 bp, Homo sapien
cagcgcatgcgtgctccgaggcctt

SEQ ID NO: 202518 - DNA, 25 bp, Homo sapien
ggaagttgttctgcagggcagcgca

SEQ ID NO: 202519 - DNA, 25 bp, Homo sapien
ggtcttggcagaactcctggaagtt

SEQ ID NO: 202520 - DNA, 25 bp, Homo sapien
cgaggcaggtcttggcagaactcct

SEQ ID NO: 202521 - DNA, 25 bp, Homo sapien
acgcagccgtgcaccctcgtggctg

SEQ ID NO: 202522 - DNA, 25 bp, Homo sapien
ccttctgcaggatgttgtgctcggc

SEQ ID NO: 202523 - DNA, 25 bp, Homo sapien
aggatgttgtgctcggcgatctgtt

SEQ ID NO: 202524 - DNA, 25 bp, Homo sapien
ggcgtcgatctccttctgcaggatg

SEQ ID NO: 202525 - DNA, 25 bp, Homo sapien
gcccataggcgtcgatctccttctg

SEQ ID NO: 202526 - DNA, 25 bp, Homo sapien
acatcctccaggctcacctaccggc

SEQ ID NO: 202527 - DNA, 25 bp, Homo sapien
ccggctctgactggagaaacgggct

SEQ ID NO: 202528 - DNA, 25 bp, Homo sapien
agccctggaggtgcgtgtacaggct

SEQ ID NO: 202529 - DNA, 25 bp, Homo sapien
gtgctcggcgatctgttgctccagc

SEQ ID NO: 202530 - DNA, 25 bp, Homo sapien
agcggtcagccttgcaggctgaagc

SEQ ID NO: 202531 - DNA, 25 bp, Homo sapien
aaacccggccgttgcctgcaggagc

SEQ ID NO: 202532 - DNA, 25 bp, Homo sapien
ccttgcaggctgaagcgtcttgccc

SEQ ID NO: 202533 - DNA, 25 bp, Homo sapien
cccgcaggcagtgcccgattgccgc

SEQ ID NO: 202534 - DNA, 25 bp, Homo sapien
cccggatcatggccaccgaggtagg

SEQ ID NO: 202535 - DNA, 25 bp, Homo sapien
ggcgcccgcatcagcactgcggaca

SEQ ID NO: 202536 - DNA, 25 bp, Homo sapien
gccacggaagcgagcgcagagctcc

SEQ ID NO: 202537 - DNA, 25 bp, Homo sapien
cgcctgcctcagcacagcggacagc

SEQ ID NO: 202538 - DNA, 25 bp, Homo sapien
ccggaattctgagcaccaaaaggta

SEQ ID NO: 202539 - DNA, 25 bp, Homo sapien
gagagaaactgcaaccctcggcctc

SEQ ID NO: 202540 - DNA, 25 bp, Homo sapien
tctcctgccaggacttgtcgggacc

SEQ ID NO: 202541 - DNA, 25 bp, Homo sapien
agccctccagttcgacacgtaatca

SEQ ID NO: 202542 - DNA, 25 bp, Homo sapien
cgtaatcattgcgagttaggcccga

SEQ ID NO: 202543 - DNA, 25 bp, Homo sapien
ggcccgattactctaggatactctc

SEQ ID NO: 202544 - DNA, 25 bp, Homo sapien
ggatactctccaaactcaggctatc

SEQ ID NO: 202545 - DNA, 25 bp, Homo sapien
ctttgtttgccttcgatccggccga

SEQ ID NO: 202546 - DNA, 25 bp, Homo sapien
cgtttcccagtacgacgcgtttgtg

SEQ ID NO: 202547 - DNA, 25 bp, Homo sapien
agtgaccgtctgtctcctgcagcca

SEQ ID NO: 202548 - DNA, 25 bp, Homo sapien
ctttgcaaggatccactccggagtc

SEQ ID NO: 202549 - DNA, 25 bp, Homo sapien
agcgtgcctaaaggtccctagctca

SEQ ID NO: 202550 - DNA, 25 bp, Homo sapien
acctcctgtagccactgagcgcgaa

SEQ ID NO: 202551 - DNA, 25 bp, Homo sapien
gtgggatccacaaagctcgcattct

SEQ ID NO: 202552 - DNA, 25 bp, Homo sapien
gcgcgttcatctcgcttgagcttaa

SEQ ID NO: 202553 - DNA, 25 bp, Homo sapien
gtcaccagtgggtagtcacagcctc

SEQ ID NO: 202554 - DNA, 25 bp, Homo sapien
attcggatgctgcaagggacctcga

SEQ ID NO: 202555 - DNA, 25 bp, Homo sapien
ccatgttgggaatcgcaggctgaag

SEQ ID NO: 202556 - DNA, 25 bp, Homo sapien
tgcgcggagcccaagaacggaccga

SEQ ID NO: 202557 - DNA, 25 bp, Homo sapien
ccgacggccattttgagcgtggctg

SEQ ID NO: 202558 - DNA, 25 bp, Homo sapien
aagagaagtgtattcggatgctgca

SEQ ID NO: 202559 - DNA, 25 bp, Homo sapien
acgcgggttccttgcctcagcagag

SEQ ID NO: 202560 - DNA, 25 bp, Homo sapien
ttttcgatcggccttatgtcccgcg

SEQ ID NO: 202561 - DNA, 25 bp, Homo sapien
cagcagaggttttcgatcggcctta

SEQ ID NO: 202562 - DNA, 25 bp, Homo sapien
cgtgcccggaacgtgactcagcgct

SEQ ID NO: 202563 - DNA, 25 bp, Homo sapien
cagctggaacctccgagaaggccca

SEQ ID NO: 202564 - DNA, 25 bp, Homo sapien
attcctctgaaccagtccggaaggg

SEQ ID NO: 202565 - DNA, 25 bp, Homo sapien
gcaagccgcggtggcgtcagcctct

SEQ ID NO: 202566 - DNA, 25 bp, Homo sapien
tgactcagcgctttctccgtgccgg

SEQ ID NO: 202567 - DNA, 25 bp, Homo sapien
tttgttcacgaactcagcgtcagcg

SEQ ID NO: 202568 - DNA, 25 bp, Homo sapien
gaactcagcgtcagcgaggcaggaa

SEQ ID NO: 202569 - DNA, 25 bp, Homo sapien
tcgggcaggttcgttcatttgttca

SEQ ID NO: 202570 - DNA, 25 bp, Homo sapien
ggcctcccagtcaaagttgcctttg

SEQ ID NO: 202571 - DNA, 25 bp, Homo sapien
cgcttcttgaaagcgccgctcagta

SEQ ID NO: 202572 - DNA, 25 bp, Homo sapien
ggcgtcgaagatggcctcccagtca

SEQ ID NO: 202573 - DNA, 25 bp, Homo sapien
gctcagtagccgctccgcgtactgg

SEQ ID NO: 202574 - DNA, 25 bp, Homo sapien
agttgcctttgaggggttccagctc

SEQ ID NO: 202575 - DNA, 25 bp, Homo sapien
tgggcctcggtattcaccgtcagcg

SEQ ID NO: 202576 - DNA, 25 bp, Homo sapien
gcagtcgccgcttcttgaaagcgcc

SEQ ID NO: 202577 - DNA, 25 bp, Homo sapien
tggtgaggtccacgtccacgtgtga

SEQ ID NO: 202578 - DNA, 25 bp, Homo sapien
gtggaggtcctctgatccttgaaaa

SEQ ID NO: 202579 - DNA, 25 bp, Homo sapien
ggcgcctcctccgaataagtatgtg

SEQ ID NO: 202580 - DNA, 25 bp, Homo sapien
tcctcctcgcaacaaatggaagtgg

SEQ ID NO: 202581 - DNA, 25 bp, Homo sapien
cgaggctatccttttctcccgaaga

SEQ ID NO: 202582 - DNA, 25 bp, Homo sapien
acttctccgatgtcagtccctgggc

SEQ ID NO: 202583 - DNA, 25 bp, Homo sapien
gaggatcttttagtgccgaggtatg

SEQ ID NO: 202584 - DNA, 25 bp, Homo sapien
ccaccacttccgttaaggacgaatg

SEQ ID NO: 202585 - DNA, 25 bp, Homo sapien
tacggggacgccctctctaacatca

SEQ ID NO: 202586 - DNA, 25 bp, Homo sapien
cttaattcgaaggtgtctttgtcgg

SEQ ID NO: 202587 - DNA, 25 bp, Homo sapien
catgttgcggtgctttgctggaatc

SEQ ID NO: 202588 - DNA, 25 bp, Homo sapien
tgttgcggtgctttgctggaatcga

SEQ ID NO: 202589 - DNA, 25 bp, Homo sapien
tgtgcttaattcgaaggtgtctttg

SEQ ID NO: 202590 - DNA, 25 bp, Homo sapien
ttcgaaggtgtctttgtcggttaca

SEQ ID NO: 202591 - DNA, 25 bp, Homo sapien
aaggtgtctttgtcggttacagcaa

SEQ ID NO: 202592 - DNA, 25 bp, Homo sapien
cgccgctgcaaaggccaatgctgcc

SEQ ID NO: 202593 - DNA, 25 bp, Homo sapien
cgaaggtgtctttgtcggttacagc

SEQ ID NO: 202594 - DNA, 25 bp, Homo sapien
cgaagaccgtttcggagcgtccgca

SEQ ID NO: 202595 - DNA, 25 bp, Homo sapien
tcggtgaccctgctagacccggcag

SEQ ID NO: 202596 - DNA, 25 bp, Homo sapien
tcccgcgctcgaagaccgtttcgga

SEQ ID NO: 202597 - DNA, 25 bp, Homo sapien
tcggagcgtccgcaaccactgagtc

SEQ ID NO: 202598 - DNA, 25 bp, Homo sapien
tagcggtacacggaattagacggga

SEQ ID NO: 202599 - DNA, 25 bp, Homo sapien
cacggaattagacgggatgtccacc

SEQ ID NO: 202600 - DNA, 25 bp, Homo sapien
gcgcctgtttatcccggctcggatt

SEQ ID NO: 202601 - DNA, 25 bp, Homo sapien
ggccttctcgaagacctcccgcgct

SEQ ID NO: 202602 - DNA, 25 bp, Homo sapien
gtccaaactcgtccagcttgcgctg

SEQ ID NO: 202603 - DNA, 25 bp, Homo sapien
tgcccgtcttgtcggagcagatgac

SEQ ID NO: 202604 - DNA, 25 bp, Homo sapien
cgaagtggccgatgttgatgaccca

SEQ ID NO: 202605 - DNA, 25 bp, Homo sapien
cacacggccacgcagatcacagaga

SEQ ID NO: 202606 - DNA, 25 bp, Homo sapien
gagcagatgactgaggtgcagccca

SEQ ID NO: 202607 - DNA, 25 bp, Homo sapien
aggcttcgcacgatggcgttcttgc

SEQ ID NO: 202608 - DNA, 25 bp, Homo sapien
cagtgccaggcatgtagtgatgaca

SEQ ID NO: 202609 - DNA, 25 bp, Homo sapien
ttgaagtagtagacagcgccacgca

SEQ ID NO: 202610 - DNA, 25 bp, Homo sapien
gccgcgggagtcgaaccacaacatt

SEQ ID NO: 202611 - DNA, 25 bp, Homo sapien
aaccacaacattcgccgggcgggcg

SEQ ID NO: 202612 - DNA, 25 bp, Homo sapien
tcttccaggaaagagcggctcccgg

SEQ ID NO: 202613 - DNA, 25 bp, Homo sapien
cgtgtcactgccctgtttgtccgca

SEQ ID NO: 202614 - DNA, 25 bp, Homo sapien
cgcagaccgcgctgagcacgttctt

SEQ ID NO: 202615 - DNA, 25 bp, Homo sapien
ccacaggccgcaggattcgaatcga

SEQ ID NO: 202616 - DNA, 25 bp, Homo sapien
cgccgcgccgcgaatgtaaacaaag

SEQ ID NO: 202617 - DNA, 25 bp, Homo sapien
tcgaatcgaacgtccttacgggagc

SEQ ID NO: 202618 - DNA, 25 bp, Homo sapien
gagcggctgcactgccttcccattt

SEQ ID NO: 202619 - DNA, 25 bp, Homo sapien
cccagcaagttaggagcgaagccgc

SEQ ID NO: 202620 - DNA, 25 bp, Homo sapien
gtgcagatactcacgccggggtcag

SEQ ID NO: 202621 - DNA, 25 bp, Homo sapien
tttatacaactccactcgagcgcgc

SEQ ID NO: 202622 - DNA, 25 bp, Homo sapien
agcgcgcccggtcttatgtaaaggc

SEQ ID NO: 202623 - DNA, 25 bp, Homo sapien
ccgcgctgatttaggagccgggatt

SEQ ID NO: 202624 - DNA, 25 bp, Homo sapien
cccaggatagcgatctggcgtcgcc

SEQ ID NO: 202625 - DNA, 25 bp, Homo sapien
cactgcgtcgcgtaaccttcaggcg

SEQ ID NO: 202626 - DNA, 25 bp, Homo sapien
aggtccttcacttggctctccagcg

SEQ ID NO: 202627 - DNA, 25 bp, Homo sapien
tgcgtgctcaccctggcaaagctga

SEQ ID NO: 202628 - DNA, 25 bp, Homo sapien
gccgtccacacgcttgagctgcttg

SEQ ID NO: 202629 - DNA, 25 bp, Homo sapien
atgctgaacgagctccggacggact

SEQ ID NO: 202630 - DNA, 25 bp, Homo sapien
gctggaagtcgatccgggtattttg

SEQ ID NO: 202631 - DNA, 25 bp, Homo sapien
aggttcttgagcatggccacgatga

SEQ ID NO: 202632 - DNA, 25 bp, Homo sapien
ccgcgtgccctgaagattccacgta

SEQ ID NO: 202633 - DNA, 25 bp, Homo sapien
ggcgtccttcatgatactcccagtc

SEQ ID NO: 202634 - DNA, 25 bp, Homo sapien
cctccgaggaggtatacgatctagc

SEQ ID NO: 202635 - DNA, 25 bp, Homo sapien
ttccacgggagctctttcggtctca

SEQ ID NO: 202636 - DNA, 25 bp, Homo sapien
cggtatccgtcacctccaagctttg

SEQ ID NO: 202637 - DNA, 25 bp, Homo sapien
ccttactctgtgatgcgcttggcca

SEQ ID NO: 202638 - DNA, 25 bp, Homo sapien
gggagcctggcgactctctaaaagc

SEQ ID NO: 202639 - DNA, 25 bp, Homo sapien
gcgccggccggagattaatttgaaa

SEQ ID NO: 202640 - DNA, 25 bp, Homo sapien
aaagcctgttcttccgaggggcatg

SEQ ID NO: 202641 - DNA, 25 bp, Homo sapien
atgtctatggtagcacagcgcccgc

SEQ ID NO: 202642 - DNA, 25 bp, Homo sapien
cgccggctgcgaagttgagcgaaaa

SEQ ID NO: 202643 - DNA, 25 bp, Homo sapien
tcgctccgacacgagttcgcgcgga

SEQ ID NO: 202644 - DNA, 25 bp, Homo sapien
gccacttgtcgcttgggcgagagca

SEQ ID NO: 202645 - DNA, 25 bp, Homo sapien
cagcaaaccggaccgactgggtagg

SEQ ID NO: 202646 - DNA, 25 bp, Homo sapien
ctgagcttgggacgagctgcgttcc

SEQ ID NO: 202647 - DNA, 25 bp, Homo sapien
gggcgctccagtccctcagacgtgg

SEQ ID NO: 202648 - DNA, 25 bp, Homo sapien
ccttctagccagacgcctaggacga

SEQ ID NO: 202649 - DNA, 25 bp, Homo sapien
ctccgggcaggggacacggcaacct

SEQ ID NO: 202650 - DNA, 25 bp, Homo sapien
tgcacaatgcagtaccgagctcctt

SEQ ID NO: 202651 - DNA, 25 bp, Homo sapien
agtcggtccacgtctctaaatctcg

SEQ ID NO: 202652 - DNA, 25 bp, Homo sapien
acgccgcactggtgtaacgccgaac

SEQ ID NO: 202653 - DNA, 25 bp, Homo sapien
gaggccgacaccacagcataacatg

SEQ ID NO: 202654 - DNA, 25 bp, Homo sapien
atgactttgcatggagtgtaccctc

SEQ ID NO: 202655 - DNA, 25 bp, Homo sapien
cttggtctccttcacatgctgcttg

SEQ ID NO: 202656 - DNA, 25 bp, Homo sapien
cgacaccaggtcgtgagaaaacagc

SEQ ID NO: 202657 - DNA, 25 bp, Homo sapien
gccataactgctctgcgcgagtctc

SEQ ID NO: 202658 - DNA, 25 bp, Homo sapien
aagagctccacgaagaggcaggcga

SEQ ID NO: 202659 - DNA, 25 bp, Homo sapien
gccggcaaaggccagcagtgacacc

SEQ ID NO: 202660 - DNA, 25 bp, Homo sapien
gcagcggccagctctggaagagctc

SEQ ID NO: 202661 - DNA, 25 bp, Homo sapien
ccacagatgaacaggaagagcacga

SEQ ID NO: 202662 - DNA, 25 bp, Homo sapien
agatgtgggcgatgttgtcgatcca

SEQ ID NO: 202663 - DNA, 25 bp, Homo sapien
agcagcaggccactgaggaagccga

SEQ ID NO: 202664 - DNA, 25 bp, Homo sapien
cccgcttgcggtacttgtcgctggt

SEQ ID NO: 202665 - DNA, 25 bp, Homo sapien
tgacaccaggatgagtgcccgcttg

SEQ ID NO: 202666 - DNA, 25 bp, Homo sapien
atacgcttgtctacgcctgtgcacc

SEQ ID NO: 202667 - DNA, 25 bp, Homo sapien
tgtctacgcctgtgcacctgagtgt

SEQ ID NO: 202668 - DNA, 25 bp, Homo sapien
cacgaggccttcaggcggccgtagc

SEQ ID NO: 202669 - DNA, 25 bp, Homo sapien
tcaggcggccgtagcgcatgctgca

SEQ ID NO: 202670 - DNA, 25 bp, Homo sapien
ccgtagcgcatgctgcagtggtgca

SEQ ID NO: 202671 - DNA, 25 bp, Homo sapien
cccagtcgccgctgactccaaacca

SEQ ID NO: 202672 - DNA, 25 bp, Homo sapien
acaggtgggcatacgcttgtctacg

SEQ ID NO: 202673 - DNA, 25 bp, Homo sapien
cgcctgtgcacctgagtgtgtggaa

SEQ ID NO: 202674 - DNA, 25 bp, Homo sapien
tgtccgagccgagccctaggggcca

SEQ ID NO: 202675 - DNA, 25 bp, Homo sapien
cgcccggtgctcacccgggagaaag

SEQ ID NO: 202676 - DNA, 25 bp, Homo sapien
ccttaggcgtcctgtccgagccgag

SEQ ID NO: 202677 - DNA, 25 bp, Homo sapien
aggtttaaatctctgcccaatcgtc

SEQ ID NO: 202678 - DNA, 25 bp, Homo sapien
cttcctccggaggtttaaatctctg

SEQ ID NO: 202679 - DNA, 25 bp, Homo sapien
gaactgcaggcacttctgggacgca

SEQ ID NO: 202680 - DNA, 25 bp, Homo sapien
agagaagggtctgaactgcaggcac

SEQ ID NO: 202681 - DNA, 25 bp, Homo sapien
gcaggctcgggcacaacctcgggac

SEQ ID NO: 202682 - DNA, 25 bp, Homo sapien
ggcgacacctacctcaccaggatgg

SEQ ID NO: 202683 - DNA, 25 bp, Homo sapien
tgactcaaagtccaacactcccgag

SEQ ID NO: 202684 - DNA, 25 bp, Homo sapien
ccaatgccggcaaggtgaaggctgc

SEQ ID NO: 202685 - DNA, 25 bp, Homo sapien
cccgtgtgggtaagagccaatgccg

SEQ ID NO: 202686 - DNA, 25 bp, Homo sapien
gatgtggtctgctggaaaatgttta

SEQ ID NO: 202687 - DNA, 25 bp, Homo sapien
tagagccgggcccacatagcctgca

SEQ ID NO: 202688 - DNA, 25 bp, Homo sapien
cccacgtcctcgcagttggcataga

SEQ ID NO: 202689 - DNA, 25 bp, Homo sapien
acactcccgagctttcgcggcgagg

SEQ ID NO: 202690 - DNA, 25 bp, Homo sapien
gtctcgaccagggacaaactgtgtt

SEQ ID NO: 202691 - DNA, 25 bp, Homo sapien
taatctcggtttctccctcataggg

SEQ ID NO: 202692 - DNA, 25 bp, Homo sapien
cttcgttttctgacagccgtggttc

SEQ ID NO: 202693 - DNA, 25 bp, Homo sapien
acatggccactccagtcggtgttga

SEQ ID NO: 202694 - DNA, 25 bp, Homo sapien
gcgagcagtctcaggcctttagtga

SEQ ID NO: 202695 - DNA, 25 bp, Homo sapien
cggggtcttccttgacacgacacta

SEQ ID NO: 202696 - DNA, 25 bp, Homo sapien
cgtggttcttcacaggcctggtttc

SEQ ID NO: 202697 - DNA, 25 bp, Homo sapien
cctcagagacgaagtggtgacgata

SEQ ID NO: 202698 - DNA, 25 bp, Homo sapien
ctgcacctgcaggatgccagcggga

SEQ ID NO: 202699 - DNA, 25 bp, Homo sapien
tgctgggaccttacccgacggcagt

SEQ ID NO: 202700 - DNA, 25 bp, Homo sapien
aggccatgtccgtgctgggacctta

SEQ ID NO: 202701 - DNA, 25 bp, Homo sapien
gtcaccgagaagtggcgcagcacgt

SEQ ID NO: 202702 - DNA, 25 bp, Homo sapien
catccgaagaggtttccggagccct

SEQ ID NO: 202703 - DNA, 25 bp, Homo sapien
ccaggatggggtggaataacgcttc

SEQ ID NO: 202704 - DNA, 25 bp, Homo sapien
tggaataacgcttccagggtggacg

SEQ ID NO: 202705 - DNA, 25 bp, Homo sapien
ccaggagcatccgaagaggtttccg

SEQ ID NO: 202706 - DNA, 25 bp, Homo sapien
gacgtgctttttctgggtttcaaca

SEQ ID NO: 202707 - DNA, 25 bp, Homo sapien
ccctctgtacctcaagctaggattt

SEQ ID NO: 202708 - DNA, 25 bp, Homo sapien
cacagcccgggacaagacttccatt

SEQ ID NO: 202709 - DNA, 25 bp, Homo sapien
ttttcctcatgtgacgcgaggggcc

SEQ ID NO: 202710 - DNA, 25 bp, Homo sapien
ttactgggaagctcccgccttctga

SEQ ID NO: 202711 - DNA, 25 bp, Homo sapien
gctcttttgcactcactggggctcg

SEQ ID NO: 202712 - DNA, 25 bp, Homo sapien
gcttcgcttcgagcctcgcctttga

SEQ ID NO: 202713 - DNA, 25 bp, Homo sapien
atcctggcggaaaggacgtgctttt

SEQ ID NO: 202714 - DNA, 25 bp, Homo sapien
agcagccagaagaacgacccgcgcg

SEQ ID NO: 202715 - DNA, 25 bp, Homo sapien
ctgcaccgccgagaagtacagggca

SEQ ID NO: 202716 - DNA, 25 bp, Homo sapien
cgaggtcttccttggacccaggcaa

SEQ ID NO: 202717 - DNA, 25 bp, Homo sapien
gggaggacttcaccaacaaggggca

SEQ ID NO: 202718 - DNA, 25 bp, Homo sapien
gggacccagccagatttcgacaata

SEQ ID NO: 202719 - DNA, 25 bp, Homo sapien
cgcgaagttggaaaccggagacttg

SEQ ID NO: 202720 - DNA, 25 bp, Homo sapien
tctgacgttaccgagggagagttcc

SEQ ID NO: 202721 - DNA, 25 bp, Homo sapien
tgggcttatccagacacggcgagcg

SEQ ID NO: 202722 - DNA, 25 bp, Homo sapien
agatggaaggatgcgatacccaatg

SEQ ID NO: 202723 - DNA, 25 bp, Homo sapien
tacccaatggggatcaaggcctttg

SEQ ID NO: 202724 - DNA, 25 bp, Homo sapien
aaggcctttggcttcgcggcagatt

SEQ ID NO: 202725 - DNA, 25 bp, Homo sapien
ggcaggtgcttgaaccactgaaatg

SEQ ID NO: 202726 - DNA, 25 bp, Homo sapien
atgccgcagagggataccggcgcta

SEQ ID NO: 202727 - DNA, 25 bp, Homo sapien
gtgcgttggtccctacagtagataa

SEQ ID NO: 202728 - DNA, 25 bp, Homo sapien
taccggcgctatggcagtgattggt

SEQ ID NO: 202729 - DNA, 25 bp, Homo sapien
cgggcacagtagctaaaattaacgc

SEQ ID NO: 202730 - DNA, 25 bp, Homo sapien
caccagtagccaggcgagcagaagg

SEQ ID NO: 202731 - DNA, 25 bp, Homo sapien
agtttgcggggctgcggcttagcat

SEQ ID NO: 202732 - DNA, 25 bp, Homo sapien
tagcatggcgggacctgcatttcct

SEQ ID NO: 202733 - DNA, 25 bp, Homo sapien
catggcgggacctgcatttcctgcg

SEQ ID NO: 202734 - DNA, 25 bp, Homo sapien
gcgggacctgcatttcctgcgggcc

SEQ ID NO: 202735 - DNA, 25 bp, Homo sapien
ggacctgcatttcctgcgggccgcg

SEQ ID NO: 202736 - DNA, 25 bp, Homo sapien
gtgcgtacctgcctcgcctccaccg

SEQ ID NO: 202737 - DNA, 25 bp, Homo sapien
gcaccagtagccaggcgagcagaag

SEQ ID NO: 202738 - DNA, 25 bp, Homo sapien
tcgtagtagttgtgccgggtccaat

SEQ ID NO: 202739 - DNA, 25 bp, Homo sapien
ccgggctcagcgagaagctctcgta

SEQ ID NO: 202740 - DNA, 25 bp, Homo sapien
cccagcgctttcgattctcggagga

SEQ ID NO: 202741 - DNA, 25 bp, Homo sapien
cgcttcttgctcttgtggttcattc

SEQ ID NO: 202742 - DNA, 25 bp, Homo sapien
gcgcctttaaagtcgccttccagaa

SEQ ID NO: 202743 - DNA, 25 bp, Homo sapien
tggggtactccttcacatacggcgg

SEQ ID NO: 202744 - DNA, 25 bp, Homo sapien
cgggtccaatccagcgagtccttga

SEQ ID NO: 202745 - DNA, 25 bp, Homo sapien
ctctcgcggttttccattggctttg

SEQ ID NO: 202746 - DNA, 25 bp, Homo sapien
ggaggtcataccctccacatcggga

SEQ ID NO: 202747 - DNA, 25 bp, Homo sapien
atgaaaccttctgattggcccaccg

SEQ ID NO: 202748 - DNA, 25 bp, Homo sapien
catggcatccatagcgtcctcagcg

SEQ ID NO: 202749 - DNA, 25 bp, Homo sapien
tcagcgtcgcgcttgtcgtgaaagc

SEQ ID NO: 202750 - DNA, 25 bp, Homo sapien
cggccgtagctcatagctctgagtg

SEQ ID NO: 202751 - DNA, 25 bp, Homo sapien
aggccttgccgcagaacagcacgga

SEQ ID NO: 202752 - DNA, 25 bp, Homo sapien
ggctagcgcacctgagtaacaactg

SEQ ID NO: 202753 - DNA, 25 bp, Homo sapien
gtttatatcgctcctcacaaaatgg

SEQ ID NO: 202754 - DNA, 25 bp, Homo sapien
tggtcctgggcccagaaagttgccc

SEQ ID NO: 202755 - DNA, 25 bp, Homo sapien
cgaggactcgctcatcccaggattc

SEQ ID NO: 202756 - DNA, 25 bp, Homo sapien
tcccatccgggtggcaaagttagtg

SEQ ID NO: 202757 - DNA, 25 bp, Homo sapien
ctgcgaacgttcaagtcctggtggc

SEQ ID NO: 202758 - DNA, 25 bp, Homo sapien
atggtcagaagatgcctggtcaccc

SEQ ID NO: 202759 - DNA, 25 bp, Homo sapien
cccgatgggaagataatggtcagaa

SEQ ID NO: 202760 - DNA, 25 bp, Homo sapien
cggctgctcgcaccaacaagtttga

SEQ ID NO: 202761 - DNA, 25 bp, Homo sapien
tccgacgagagggtcccgagattag

SEQ ID NO: 202762 - DNA, 25 bp, Homo sapien
tcccgcggcgtcctgcgcaagatga

SEQ ID NO: 202763 - DNA, 25 bp, Homo sapien
acctgccactccatccggggtgctg

SEQ ID NO: 202764 - DNA, 25 bp, Homo sapien
agcgcatggacgcactggccaggct

SEQ ID NO: 202765 - DNA, 25 bp, Homo sapien
ctggagaacagcagtgagctgcacc

SEQ ID NO: 202766 - DNA, 25 bp, Homo sapien
gtgaagcgcatggacgcactggcca

SEQ ID NO: 202767 - DNA, 25 bp, Homo sapien
tgctggagctgatggtgaagcgcat

SEQ ID NO: 202768 - DNA, 25 bp, Homo sapien
gcgtcctgcgcaagatgagcgacct

SEQ ID NO: 202769 - DNA, 25 bp, Homo sapien
aacagcagtgagctgcaccgggccg

SEQ ID NO: 202770 - DNA, 25 bp, Homo sapien
aggccagcaacatggccgtggtgta

SEQ ID NO: 202771 - DNA, 25 bp, Homo sapien
cggcaaggccagcaacatggccgtg

SEQ ID NO: 202772 - DNA, 25 bp, Homo sapien
agcggctcatcaaaggcggcaaggc

SEQ ID NO: 202773 - DNA, 25 bp, Homo sapien
gagaagcggctcatcaaaggcggca

SEQ ID NO: 202774 - DNA, 25 bp, Homo sapien
tccttcatgggcttcgtgtccgagg

SEQ ID NO: 202775 - DNA, 25 bp, Homo sapien
cgacaactccttcatgggcttcgtg

SEQ ID NO: 202776 - DNA, 25 bp, Homo sapien
cgcgcgggaagcaccagcctgctcg

SEQ ID NO: 202777 - DNA, 25 bp, Homo sapien
caacatggccgtggtgtacggcaag

SEQ ID NO: 202778 - DNA, 25 bp, Homo sapien
cctggccaggagtgctacctgcaga

SEQ ID NO: 202779 - DNA, 25 bp, Homo sapien
ggctgtctgtgaatccgcctctgcc

SEQ ID NO: 202780 - DNA, 25 bp, Homo sapien
gccagggctgtctgtgaatccgcct

SEQ ID NO: 202781 - DNA, 25 bp, Homo sapien
ttccgcaagggccaggtggccttgt

SEQ ID NO: 202782 - DNA, 25 bp, Homo sapien
agctgcgccggctccaacaccaagt

SEQ ID NO: 202783 - DNA, 25 bp, Homo sapien
tcggagatgaaccacctgtacccgg

SEQ ID NO: 202784 - DNA, 25 bp, Homo sapien
cgagtcggagatgaaccacctgtac

SEQ ID NO: 202785 - DNA, 25 bp, Homo sapien
ccgcgacttccgcaagggccaggtg

SEQ ID NO: 202786 - DNA, 25 bp, Homo sapien
ttcaagaggaaaaagcgccggagcg

SEQ ID NO: 202787 - DNA, 25 bp, Homo sapien
tgtttaccaggcacccgttacgcta

SEQ ID NO: 202788 - DNA, 25 bp, Homo sapien
cccgttacgctaattgaaatgtgcc

SEQ ID NO: 202789 - DNA, 25 bp, Homo sapien
ttgaaatgtgccaaatagctgcccg

SEQ ID NO: 202790 - DNA, 25 bp, Homo sapien
atgtgccaaatagctgcccggggcg

SEQ ID NO: 202791 - DNA, 25 bp, Homo sapien
gtcacctgcggtgttgatgaggtat

SEQ ID NO: 202792 - DNA, 25 bp, Homo sapien
accaggcacccgttacgctaattga

SEQ ID NO: 202793 - DNA, 25 bp, Homo sapien
tgaggtattcaagaggaaaaagcgc

SEQ ID NO: 202794 - DNA, 25 bp, Homo sapien
tgcagaacaaggtaatgacgcccac

SEQ ID NO: 202795 - DNA, 25 bp, Homo sapien
ctcacgagctcggtcacttaggaca

SEQ ID NO: 202796 - DNA, 25 bp, Homo sapien
tcacaggggccgaatctcacgagct

SEQ ID NO: 202797 - DNA, 25 bp, Homo sapien
cccggctgtcacaggggccgaatct

SEQ ID NO: 202798 - DNA, 25 bp, Homo sapien
gtaatgacgcccacctagagtccca

SEQ ID NO: 202799 - DNA, 25 bp, Homo sapien
cttaggacaatgtagacgccctttc

SEQ ID NO: 202800 - DNA, 25 bp, Homo sapien
ggacaatgtagacgccctttctggg

SEQ ID NO: 202801 - DNA, 25 bp, Homo sapien
ggcacagcacccttcgcacgggagc

SEQ ID NO: 202802 - DNA, 25 bp, Homo sapien
atactaacagtcgtcttcacaggcg

SEQ ID NO: 202803 - DNA, 25 bp, Homo sapien
tgctaacagtcgtcttcacaggcga

SEQ ID NO: 202804 - DNA, 25 bp, Homo sapien
ggcgaccgcgcaccacagatactaa

SEQ ID NO: 202805 - DNA, 25 bp, Homo sapien
ttgctaacagtcgtcttcacaggcg

SEQ ID NO: 202806 - DNA, 25 bp, Homo sapien
agtcgtcttcacaggcgaccgcgca

SEQ ID NO: 202807 - DNA, 25 bp, Homo sapien
agacgtcttcacaggcgaccgcgca

SEQ ID NO: 202808 - DNA, 25 bp, Homo sapien
ggcgaccgtgcaccacacatactaa

SEQ ID NO: 202809 - DNA, 25 bp, Homo sapien
aggcgaccgcgcaccacagatacta

SEQ ID NO: 202810 - DNA, 25 bp, Homo sapien
gtgtggaaacctccggatggccgca

SEQ ID NO: 202811 - DNA, 25 bp, Homo sapien
tgtgtgtggaaacctccggatggcc

SEQ ID NO: 202812 - DNA, 25 bp, Homo sapien
cctgtgtgtggaaacctccggatgg

SEQ ID NO: 202813 - DNA, 25 bp, Homo sapien
ctaccagagaggtccacggcgggcg

SEQ ID NO: 202814 - DNA, 25 bp, Homo sapien
ctgcgggctaccagagaggtccacg

SEQ ID NO: 202815 - DNA, 25 bp, Homo sapien
tcctgcgggctaccagagaggtcca

SEQ ID NO: 202816 - DNA, 25 bp, Homo sapien
ccgcagtgtcctgcgggctaccaga

SEQ ID NO: 202817 - DNA, 25 bp, Homo sapien
ttccgcagtgtcctgcgggctacca

SEQ ID NO: 202818 - DNA, 25 bp, Homo sapien
tttccattctttcagccctgagccc

SEQ ID NO: 202819 - DNA, 25 bp, Homo sapien
gtgtaaactccacgcctgagctcca

SEQ ID NO: 202820 - DNA, 25 bp, Homo sapien
gcgcggtgtaaactccacgcctgag

SEQ ID NO: 202821 - DNA, 25 bp, Homo sapien
gagtctccgcctcgcatccgttcgg

SEQ ID NO: 202822 - DNA, 25 bp, Homo sapien
aggcctacagcagctttccattctt

SEQ ID NO: 202823 - DNA, 25 bp, Homo sapien
tggaggaaggcctacagcagctttc

SEQ ID NO: 202824 - DNA, 25 bp, Homo sapien
aggatgatctggaggaaggcctaca

SEQ ID NO: 202825 - DNA, 25 bp, Homo sapien
ctcgcatccgttcgggcgcggtgta

SEQ ID NO: 202826 - DNA, 25 bp, Homo sapien
ccctgttggcactacccggtgtcag

SEQ ID NO: 202827 - DNA, 25 bp, Homo sapien
acacgggctggtgcacactcacact

SEQ ID NO: 202828 - DNA, 25 bp, Homo sapien
gccctcgctatgagaacatcatttt

SEQ ID NO: 202829 - DNA, 25 bp, Homo sapien
gaaaattgttccaagcgcgctcctc

SEQ ID NO: 202830 - DNA, 25 bp, Homo sapien
aaggcctattgcgagcccaggcaca

SEQ ID NO: 202831 - DNA, 25 bp, Homo sapien
caaatgttgtctgcagaaggcgcca

SEQ ID NO: 202832 - DNA, 25 bp, Homo sapien
tccagcagggagagcaaatgttgtc

SEQ ID NO: 202833 - DNA, 25 bp, Homo sapien
tgtgaaccctacaagcgcagcctgc

SEQ ID NO: 202834 - DNA, 25 bp, Homo sapien
gccggaagttgctgacggagctact

SEQ ID NO: 202835 - DNA, 25 bp, Homo sapien
gagacacgtgctttggcctgttgga

SEQ ID NO: 202836 - DNA, 25 bp, Homo sapien
ccgactcgcagtccgcaggatgact

SEQ ID NO: 202837 - DNA, 25 bp, Homo sapien
cccgggacgataacagagctctgcc

SEQ ID NO: 202838 - DNA, 25 bp, Homo sapien
gacggcttctcccatcgcaagtagg

SEQ ID NO: 202839 - DNA, 25 bp, Homo sapien
tggtaagttatcacttccggccgga

SEQ ID NO: 202840 - DNA, 25 bp, Homo sapien
agtcatcgactctctagctgctatc

SEQ ID NO: 202841 - DNA, 25 bp, Homo sapien
aagtccggcttggatgacccagatc

SEQ ID NO: 202842 - DNA, 25 bp, Homo sapien
cgctttttgctgagagcggagtttc

SEQ ID NO: 202843 - DNA, 25 bp, Homo sapien
ggcccggcctttctgacaagaggta

SEQ ID NO: 202844 - DNA, 25 bp, Homo sapien
cggagcagtggaaccgagactgccc

SEQ ID NO: 202845 - DNA, 25 bp, Homo sapien
gtaacaaccacaagtgccgtcgccg

SEQ ID NO: 202846 - DNA, 25 bp, Homo sapien
acctcgggcacatccagcagtgcga

SEQ ID NO: 202847 - DNA, 25 bp, Homo sapien
caacaagtgacgcaaaactgggagg

SEQ ID NO: 202848 - DNA, 25 bp, Homo sapien
tggtgctcctgaacagtcaacaaga

SEQ ID NO: 202849 - DNA, 25 bp, Homo sapien
cctcagagcagcagccatacgggag

SEQ ID NO: 202850 - DNA, 25 bp, Homo sapien
ggtctcttcgcacaagtgtaaagtg

SEQ ID NO: 202851 - DNA, 25 bp, Homo sapien
tcccacgccgtgtgcaggatcagca

SEQ ID NO: 202852 - DNA, 25 bp, Homo sapien
ctcgccacagcaggtgctgcggaca

SEQ ID NO: 202853 - DNA, 25 bp, Homo sapien
ggaggatttcaggtgcggccaccct

SEQ ID NO: 202854 - DNA, 25 bp, Homo sapien
actacaccgaggtgatcggctcgga

SEQ ID NO: 202855 - DNA, 25 bp, Homo sapien
agtgatgtactacaccgaggtgatc

SEQ ID NO: 202856 - DNA, 25 bp, Homo sapien
cgcacaagtgtaaagtgatgtacta

SEQ ID NO: 202857 - DNA, 25 bp, Homo sapien
ccctgcaggtctcttcgcacaagtg

SEQ ID NO: 202858 - DNA, 25 bp, Homo sapien
gatcccggttgccacaggcatcgga

SEQ ID NO: 202859 - DNA, 25 bp, Homo sapien
gccacctgctggagtgtgcgcgtct

SEQ ID NO: 202860 - DNA, 25 bp, Homo sapien
tggcccggcgtgaaaggtcaccctg

SEQ ID NO: 202861 - DNA, 25 bp, Homo sapien
gcgctctcagagtggcggccacact

SEQ ID NO: 202862 - DNA, 25 bp, Homo sapien
gtcctcgggctcttggcgacagcga

SEQ ID NO: 202863 - DNA, 25 bp, Homo sapien
ctgccgttgccctctgaggaccgag

SEQ ID NO: 202864 - DNA, 25 bp, Homo sapien
ccgcagggcgatgttttagcagttc

SEQ ID NO: 202865 - DNA, 25 bp, Homo sapien
gccctttccgcagggcgatgtttta

SEQ ID NO: 202866 - DNA, 25 bp, Homo sapien
gcccgacgtgcctactcagtgcaga

SEQ ID NO: 202867 - DNA, 25 bp, Homo sapien
gcctgctcagtgcagacagggtgcc

SEQ ID NO: 202868 - DNA, 25 bp, Homo sapien
gcctactcagtgcagacagggtgcc

SEQ ID NO: 202869 - DNA, 25 bp, Homo sapien
tgcctgctcagtgcagacagggtgc

SEQ ID NO: 202870 - DNA, 25 bp, Homo sapien
gtgcctactcagtgcagacacggtg

SEQ ID NO: 202871 - DNA, 25 bp, Homo sapien
tcagtgcagacacggtgcccgacgt

SEQ ID NO: 202872 - DNA, 25 bp, Homo sapien
cgacgtgcctactcagtgcagacac

SEQ ID NO: 202873 - DNA, 25 bp, Homo sapien
cgtgcctgctcagtgcagacagggt

SEQ ID NO: 202874 - DNA, 25 bp, Homo sapien
ggcacactgcaggtcgagttcctcc

SEQ ID NO: 202875 - DNA, 25 bp, Homo sapien
caggccgcagcatcctttcttcgga

SEQ ID NO: 202876 - DNA, 25 bp, Homo sapien
cttcggtttctcctctacttagtgg

SEQ ID NO: 202877 - DNA, 25 bp, Homo sapien
ccaaacttggcgactcgggttcacg

SEQ ID NO: 202878 - DNA, 25 bp, Homo sapien
cgggttcacgttttgcgctcaggac

SEQ ID NO: 202879 - DNA, 25 bp, Homo sapien
atcgctgactttccaggtcggccgg

SEQ ID NO: 202880 - DNA, 25 bp, Homo sapien
cttgcaccctcgcaggaatcgctga

SEQ ID NO: 202881 - DNA, 25 bp, Homo sapien
acggaggcaccatgaagaagtctta

SEQ ID NO: 202882 - DNA, 25 bp, Homo sapien
gcggctagctctgcactgcaggagc

SEQ ID NO: 202883 - DNA, 25 bp, Homo sapien
ttcactctgggaaatccatcggtcc

SEQ ID NO: 202884 - DNA, 25 bp, Homo sapien
aacgcgcagctggatgggatcattt

SEQ ID NO: 202885 - DNA, 25 bp, Homo sapien
cacaggaccctgtgctcgttctgcg

SEQ ID NO: 202886 - DNA, 25 bp, Homo sapien
tgtttgccaagcgacagcgacctcc

SEQ ID NO: 202887 - DNA, 25 bp, Homo sapien
aggctgcctcggaactctccaggac

SEQ ID NO: 202888 - DNA, 25 bp, Homo sapien
catttcggacttcgaaggtgggtgc

SEQ ID NO: 202889 - DNA, 25 bp, Homo sapien
tccaggacgcacagtttcactctgg

SEQ ID NO: 202890 - DNA, 25 bp, Homo sapien
aggaccgcgtgatcgcgcacgtgac

SEQ ID NO: 202891 - DNA, 25 bp, Homo sapien
ggaggcttgacttgtgacatccacc

SEQ ID NO: 202892 - DNA, 25 bp, Homo sapien
ctcacggccaccctgggaaggaggc

SEQ ID NO: 202893 - DNA, 25 bp, Homo sapien
cgcttccgggtaggaccgcgtgatc

SEQ ID NO: 202894 - DNA, 25 bp, Homo sapien
cttcacggctgaggaactttggccc

SEQ ID NO: 202895 - DNA, 25 bp, Homo sapien
tcccgtttgcctagcacgccagttt

SEQ ID NO: 202896 - DNA, 25 bp, Homo sapien
ccctcttcacggctgaggaactttg

SEQ ID NO: 202897 - DNA, 25 bp, Homo sapien
gcacgccagtttctgtccagtttca

SEQ ID NO: 202898 - DNA, 25 bp, Homo sapien
gccatgtggactccctaagccaacg

SEQ ID NO: 202899 - DNA, 25 bp, Homo sapien
cgaggtgttgggccacaagacgcca

SEQ ID NO: 202900 - DNA, 25 bp, Homo sapien
ttgacatctcgtccaagcaggtgga

SEQ ID NO: 202901 - DNA, 25 bp, Homo sapien
gctgtccattgacatctcgtccaag

SEQ ID NO: 202902 - DNA, 25 bp, Homo sapien
ggcgcactgagctgtccattgacat

SEQ ID NO: 202903 - DNA, 25 bp, Homo sapien
tgtcccggcgcactgagctgtccat

SEQ ID NO: 202904 - DNA, 25 bp, Homo sapien
atgtggactccctaagccaacgctc

SEQ ID NO: 202905 - DNA, 25 bp, Homo sapien
cctcggaggacggagatcaccatcg

SEQ ID NO: 202906 - DNA, 25 bp, Homo sapien
ggtgagtcctgctcctttgttcttc

SEQ ID NO: 202907 - DNA, 25 bp, Homo sapien
cgcgctctgggaggctccttgttcc

SEQ ID NO: 202908 - DNA, 25 bp, Homo sapien
agccttgcaccactggctcgggggc

SEQ ID NO: 202909 - DNA, 25 bp, Homo sapien
ggagctcgatctccacgcggggacc

SEQ ID NO: 202910 - DNA, 25 bp, Homo sapien
ggctccttgttccgcgaccacaaag

SEQ ID NO: 202911 - DNA, 25 bp, Homo sapien
tgctcctttgttcttcccagccttg

SEQ ID NO: 202912 - DNA, 25 bp, Homo sapien
tctgctcggctctgagccatgtgac

SEQ ID NO: 202913 - DNA, 25 bp, Homo sapien
ctctgagccatgtgacccggtgggc

SEQ ID NO: 202914 - DNA, 25 bp, Homo sapien
tacagctgatcttcctgacgggagg

SEQ ID NO: 202915 - DNA, 25 bp, Homo sapien
ctgatcttcctgacgggaggatgga

SEQ ID NO: 202916 - DNA, 25 bp, Homo sapien
gccactgccataggggaggtgactc

SEQ ID NO: 202917 - DNA, 25 bp, Homo sapien
taccgcccgctttactcggagtctg

SEQ ID NO: 202918 - DNA, 25 bp, Homo sapien
ccgctttactcggagtctggggtgt

SEQ ID NO: 202919 - DNA, 25 bp, Homo sapien
gggagcccagcgtttatttacagct

SEQ ID NO: 202920 - DNA, 25 bp, Homo sapien
gcgtttatttacagctgatcttcct

SEQ ID NO: 202921 - DNA, 25 bp, Homo sapien
gcccagcgtttatttacagctgatc

SEQ ID NO: 202922 - DNA, 25 bp, Homo sapien
tctggaacggcagctgaggcaatgc

SEQ ID NO: 202923 - DNA, 25 bp, Homo sapien
atgcatcttctggaacggcagctga

SEQ ID NO: 202924 - DNA, 25 bp, Homo sapien
tgcgcgccagacgatgcatcttctg

SEQ ID NO: 202925 - DNA, 25 bp, Homo sapien
gctttgcgcgccagacgatgcatct

SEQ ID NO: 202926 - DNA, 25 bp, Homo sapien
ctggggaccgtgcaccgctttgcgc

SEQ ID NO: 202927 - DNA, 25 bp, Homo sapien
tctctgcctcggtgcggagcacgat

SEQ ID NO: 202928 - DNA, 25 bp, Homo sapien
gaagccacgtgcgatgctcggagct

SEQ ID NO: 202929 - DNA, 25 bp, Homo sapien
ctgcctcttcggtcctggaagcgtc

SEQ ID NO: 202930 - DNA, 25 bp, Homo sapien
ccatcgggtcctctgaagtgcggga

SEQ ID NO: 202931 - DNA, 25 bp, Homo sapien
agagccacgcggatgttcagaagaa

SEQ ID NO: 202932 - DNA, 25 bp, Homo sapien
gaagaagtctcttatcccggcagcc

SEQ ID NO: 202933 - DNA, 25 bp, Homo sapien
ccggcagccaattcgcggcattgtc

SEQ ID NO: 202934 - DNA, 25 bp, Homo sapien
caattcgcggcattgtctgaaaccc

SEQ ID NO: 202935 - DNA, 25 bp, Homo sapien
gcgtggtgccattgccgccgtcttt

SEQ ID NO: 202936 - DNA, 25 bp, Homo sapien
tttggcaaagaacccgcgccatcgg

SEQ ID NO: 202937 - DNA, 25 bp, Homo sapien
cgtctttcatcccttttggcaaaga

SEQ ID NO: 202938 - DNA, 25 bp, Homo sapien
ccctcctcagaaaatgaccgattag

SEQ ID NO: 202939 - DNA, 25 bp, Homo sapien
tgcgcaacaaggtccaccacacaga

SEQ ID NO: 202940 - DNA, 25 bp, Homo sapien
ctggcctggcatctcaaaagctgtc

SEQ ID NO: 202941 - DNA, 25 bp, Homo sapien
gggactcgaatgaaaggcgtaaata

SEQ ID NO: 202942 - DNA, 25 bp, Homo sapien
tggggatattgtcagcacttcaggc

SEQ ID NO: 202943 - DNA, 25 bp, Homo sapien
atacaccgtgtctgcctacccgagg

SEQ ID NO: 202944 - DNA, 25 bp, Homo sapien
tgagtgtcagatgagaaaacgcctg

SEQ ID NO: 202945 - DNA, 25 bp, Homo sapien
tgtctgcgtaactggcatcggaatc

SEQ ID NO: 202946 - DNA, 25 bp, Homo sapien
ccagttcgccctccggtatgcagat

SEQ ID NO: 202947 - DNA, 25 bp, Homo sapien
gcagccgcaactttgccgggaggtt

SEQ ID NO: 202948 - DNA, 25 bp, Homo sapien
cagagtgccgattggccagttcgcc

SEQ ID NO: 202949 - DNA, 25 bp, Homo sapien
tcgccctccggtatgcagatacggt

SEQ ID NO: 202950 - DNA, 25 bp, Homo sapien
cagatacggtgggagtcacgtgcta

SEQ ID NO: 202951 - DNA, 25 bp, Homo sapien
ggacgacttcctgttggaggccaac

SEQ ID NO: 202952 - DNA, 25 bp, Homo sapien
ggggttcttgtcagttagagcaaca

SEQ ID NO: 202953 - DNA, 25 bp, Homo sapien
ccgagcagtgcaagctcccaggact

SEQ ID NO: 202954 - DNA, 25 bp, Homo sapien
acacggaacaaatagtggctgcttc

SEQ ID NO: 202955 - DNA, 25 bp, Homo sapien
gtggctgcttctcgccagtccgttt

SEQ ID NO: 202956 - DNA, 25 bp, Homo sapien
tgcaggtatttcctcacccgtcagc

SEQ ID NO: 202957 - DNA, 25 bp, Homo sapien
ggcaccgtctgcaggtatttcctca

SEQ ID NO: 202958 - DNA, 25 bp, Homo sapien
ccaggcgagcctcgatgcaggcgta

SEQ ID NO: 202959 - DNA, 25 bp, Homo sapien
ccgacatgttgtagcgagaggccag

SEQ ID NO: 202960 - DNA, 25 bp, Homo sapien
tcgctgtacccagccgacatgttgt

SEQ ID NO: 202961 - DNA, 25 bp, Homo sapien
ttgtgacataacattccagcgtgtg

SEQ ID NO: 202962 - DNA, 25 bp, Homo sapien
tggccgcagtccttgcgaactgttc

SEQ ID NO: 202963 - DNA, 25 bp, Homo sapien
tgttcgcaaaacagtgcgggctgcg

SEQ ID NO: 202964 - DNA, 25 bp, Homo sapien
ttttgagtacctctgtccaggactg

SEQ ID NO: 202965 - DNA, 25 bp, Homo sapien
atcatcagcaccaggagagccgacc

SEQ ID NO: 202966 - DNA, 25 bp, Homo sapien
acgacagcagggtgataggcagccc

SEQ ID NO: 202967 - DNA, 25 bp, Homo sapien
cagtactccagcagcctgtggggcc

SEQ ID NO: 202968 - DNA, 25 bp, Homo sapien
acgcagcgacgctggccactggaac

SEQ ID NO: 202969 - DNA, 25 bp, Homo sapien
tgtccaggactgaagacgaaccttg

SEQ ID NO: 202970 - DNA, 25 bp, Homo sapien
cccactgcccagatcggaaaaagga

SEQ ID NO: 202971 - DNA, 25 bp, Homo sapien
aagcgcctcatctggtgggtgccac

SEQ ID NO: 202972 - DNA, 25 bp, Homo sapien
tgccatgatggacaagcgcctcatc

SEQ ID NO: 202973 - DNA, 25 bp, Homo sapien
gggctgccctatgccatgatggaca

SEQ ID NO: 202974 - DNA, 25 bp, Homo sapien
ttaaggctcatccaaccggggactc

SEQ ID NO: 202975 - DNA, 25 bp, Homo sapien
aaggagagtggcatcatcccacctg

SEQ ID NO: 202976 - DNA, 25 bp, Homo sapien
cccaggtgactgtcagcggtacctc

SEQ ID NO: 202977 - DNA, 25 bp, Homo sapien
agcgtgcacagaggccatagccaag

SEQ ID NO: 202978 - DNA, 25 bp, Homo sapien
tcccggaggaacaaatcacagaatc

SEQ ID NO: 202979 - DNA, 25 bp, Homo sapien
cccgcacctgtttgtgctttgcagg

SEQ ID NO: 202980 - DNA, 25 bp, Homo sapien
gagatgtgccctgcgcttggcctcc

SEQ ID NO: 202981 - DNA, 25 bp, Homo sapien
ccagaacttcgttgcggtcccgttg

SEQ ID NO: 202982 - DNA, 25 bp, Homo sapien
gtcccacctggaatgtggcctaata

SEQ ID NO: 202983 - DNA, 25 bp, Homo sapien
tggcctaatattaaggaaacgtgcg

SEQ ID NO: 202984 - DNA, 25 bp, Homo sapien
cgttggcaagggtcccacctggaat

SEQ ID NO: 202985 - DNA, 25 bp, Homo sapien
gtgcgaaacgggactgcaattcctg

SEQ ID NO: 202986 - DNA, 25 bp, Homo sapien
cgtggcctctggctactttgggtgc

SEQ ID NO: 202987 - DNA, 25 bp, Homo sapien
ctagatctgcatggggtgggaccct

SEQ ID NO: 202988 - DNA, 25 bp, Homo sapien
ctcttagcgggcgtggtctagatct

SEQ ID NO: 202989 - DNA, 25 bp, Homo sapien
gcccatgggccgcagagttgctgcc

SEQ ID NO: 202990 - DNA, 25 bp, Homo sapien
cagcaggttcaggagaagtggcacc

SEQ ID NO: 202991 - DNA, 25 bp, Homo sapien
aggacctgtcgcgactgctgccgga

SEQ ID NO: 202992 - DNA, 25 bp, Homo sapien
tcacacccgctcgtgggaagcagcg

SEQ ID NO: 202993 - DNA, 25 bp, Homo sapien
gccacttgttctcctcacagcaggt

SEQ ID NO: 202994 - DNA, 25 bp, Homo sapien
gaccctttctggtccgtgctgcggc

SEQ ID NO: 202995 - DNA, 25 bp, Homo sapien
ccgcctctagaagcgcagtcccgcg

SEQ ID NO: 202996 - DNA, 25 bp, Homo sapien
gcgagggccgcactttgccctcggt

SEQ ID NO: 202997 - DNA, 25 bp, Homo sapien
ggcaggttcctctgcgttccgcggc

SEQ ID NO: 202998 - DNA, 25 bp, Homo sapien
ctagcccacgagcgcgacaggtggc

SEQ ID NO: 202999 - DNA, 25 bp, Homo sapien
gccgcgactcccagattggggagtt

SEQ ID NO: 203000 - DNA, 25 bp, Homo sapien
cagggtgtccttcccactcggggca

SEQ ID NO: 203001 - DNA, 25 bp, Homo sapien
cacgccgcgactcccagattgggga

SEQ ID NO: 203002 - DNA, 25 bp, Homo sapien
cgaccgctttaaaccacggcgtgct

SEQ ID NO: 203003 - DNA, 25 bp, Homo sapien
ttaaaccacggcgtgctggccaatc

SEQ ID NO: 203004 - DNA, 25 bp, Homo sapien
aatccgggacgtgcgcccagggact

SEQ ID NO: 203005 - DNA, 25 bp, Homo sapien
cggggctctggccatataaacagag

SEQ ID NO: 203006 - DNA, 25 bp, Homo sapien
ccatataaacagagggacgcacgcc

SEQ ID NO: 203007 - DNA, 25 bp, Homo sapien
gacgcacgcccatgcggctgtagac

SEQ ID NO: 203008 - DNA, 25 bp, Homo sapien
tcacgaacccgagtactctccaagg

SEQ ID NO: 203009 - DNA, 25 bp, Homo sapien
gaagttcacgaacccgagtactctc

SEQ ID NO: 203010 - DNA, 25 bp, Homo sapien
gcttttcgccagtgccaggaataca

SEQ ID NO: 203011 - DNA, 25 bp, Homo sapien
ttcactgctgtgactcggagcgttc

SEQ ID NO: 203012 - DNA, 25 bp, Homo sapien
ccgtcacgtagataggcggcctcta

SEQ ID NO: 203013 - DNA, 25 bp, Homo sapien
agctgccgcttcgtcttcactgctg

SEQ ID NO: 203014 - DNA, 25 bp, Homo sapien
cgccgcctcaaagggtgcaaccttg

SEQ ID NO: 203015 - DNA, 25 bp, Homo sapien
tgcaaccttgatttcccagaggacg

SEQ ID NO: 203016 - DNA, 25 bp, Homo sapien
ctcggccatcttagctgtagataga

SEQ ID NO: 203017 - DNA, 25 bp, Homo sapien
tctttgttggggctgacaacctgca

SEQ ID NO: 203018 - DNA, 25 bp, Homo sapien
tagcgaggccactgtgactgggcct

SEQ ID NO: 203019 - DNA, 25 bp, Homo sapien
ggaccaccgcatctctacattcaag

SEQ ID NO: 203020 - DNA, 25 bp, Homo sapien
tttctcaaggaccaccgcatctcta

SEQ ID NO: 203021 - DNA, 25 bp, Homo sapien
tgcctggcagccctttctcaaggac

SEQ ID NO: 203022 - DNA, 25 bp, Homo sapien
ttgaatcgcgggacccgttggcaga

SEQ ID NO: 203023 - DNA, 25 bp, Homo sapien
gcgcgccattaaccgccagatttga

SEQ ID NO: 203024 - DNA, 25 bp, Homo sapien
cgcgttctttgaaagcagtcgaggg

SEQ ID NO: 203025 - DNA, 25 bp, Homo sapien
ctctacattcaagaactggcccttc

SEQ ID NO: 203026 - DNA, 25 bp, Homo sapien
gggtgcactgctcagcttcgcgctc

SEQ ID NO: 203027 - DNA, 25 bp, Homo sapien
gcgcatctgcgaaggtaaccggcca

SEQ ID NO: 203028 - DNA, 25 bp, Homo sapien
ccgcggtcgccagcgactactggta

SEQ ID NO: 203029 - DNA, 25 bp, Homo sapien
gccctgggtgcactgctcagcttcg

SEQ ID NO: 203030 - DNA, 25 bp, Homo sapien
tctgcgaaggtaaccggccaccgcg

SEQ ID NO: 203031 - DNA, 25 bp, Homo sapien
ctactggtacatcctggaggtggcg

SEQ ID NO: 203032 - DNA, 25 bp, Homo sapien
agcgactactggtacatcctggagg

SEQ ID NO: 203033 - DNA, 25 bp, Homo sapien
ggctctggcgcatctgcgaaggtaa

SEQ ID NO: 203034 - DNA, 25 bp, Homo sapien
ggagttgtagttcgcgctccctcgc

SEQ ID NO: 203035 - DNA, 25 bp, Homo sapien
aggttctgctcattgaaggagaaac

SEQ ID NO: 203036 - DNA, 25 bp, Homo sapien
cggagaaccagcgagcccgtgatgc

SEQ ID NO: 203037 - DNA, 25 bp, Homo sapien
cggccagaattcctagagctgggaa

SEQ ID NO: 203038 - DNA, 25 bp, Homo sapien
cggtgcggccagaattcctagagct

SEQ ID NO: 203039 - DNA, 25 bp, Homo sapien
gcgggagctgctgactcctctactc

SEQ ID NO: 203040 - DNA, 25 bp, Homo sapien
gcacgccggtcttcgccgtagtcgt

SEQ ID NO: 203041 - DNA, 25 bp, Homo sapien
cccgtgatgctgaagcagaaggttc

SEQ ID NO: 203042 - DNA, 25 bp, Homo sapien
gcgcattgatcgtggtgcggatgca

SEQ ID NO: 203043 - DNA, 25 bp, Homo sapien
cagcagctgcgaggcgaacccgcct

SEQ ID NO: 203044 - DNA, 25 bp, Homo sapien
acgtgctcccgagcggcgcaaggct

SEQ ID NO: 203045 - DNA, 25 bp, Homo sapien
ttactggaaacgtgctcccgagcgg

SEQ ID NO: 203046 - DNA, 25 bp, Homo sapien
gcgcttactggaaacgtgctcccga

SEQ ID NO: 203047 - DNA, 25 bp, Homo sapien
ttgctcgcgcttactggaaacgtgc

SEQ ID NO: 203048 - DNA, 25 bp, Homo sapien
ggctccacttgctcgcgcttactgg

SEQ ID NO: 203049 - DNA, 25 bp, Homo sapien
tcccttcccggtattctcgcggcca

SEQ ID NO: 203050 - DNA, 25 bp, Homo sapien
cctgatcccgcagggtcctgtggaa

SEQ ID NO: 203051 - DNA, 25 bp, Homo sapien
gcccggcccagaatagcctcccttc

SEQ ID NO: 203052 - DNA, 25 bp, Homo sapien
gcgccagcgcccgaaatagggctcg

SEQ ID NO: 203053 - DNA, 25 bp, Homo sapien
acagcgcagcggttgccatggccac

SEQ ID NO: 203054 - DNA, 25 bp, Homo sapien
gctgagcctcgatcaccttgtcctg

SEQ ID NO: 203055 - DNA, 25 bp, Homo sapien
ttgtcctgctcgagccaggttggca

SEQ ID NO: 203056 - DNA, 25 bp, Homo sapien
caggttggcatggactggaagaacc

SEQ ID NO: 203057 - DNA, 25 bp, Homo sapien
tcctgtggaaatgcggtgtctgcct

SEQ ID NO: 203058 - DNA, 25 bp, Homo sapien
tcccggccgaatttcctggcactgg

SEQ ID NO: 203059 - DNA, 25 bp, Homo sapien
tgagaataaacagcgctctccgccc

SEQ ID NO: 203060 - DNA, 25 bp, Homo sapien
cctggcactgggctgagaataaaca

SEQ ID NO: 203061 - DNA, 25 bp, Homo sapien
attcttcgcatagctccgccagggc

SEQ ID NO: 203062 - DNA, 25 bp, Homo sapien
gcggtgtccgggaagtgactcttcc

SEQ ID NO: 203063 - DNA, 25 bp, Homo sapien
ccgggaagtgactcttcctggcaga

SEQ ID NO: 203064 - DNA, 25 bp, Homo sapien
gaccggagtcccttactcccataga

SEQ ID NO: 203065 - DNA, 25 bp, Homo sapien
gtactcggcgcggacattcttcgca

SEQ ID NO: 203066 - DNA, 25 bp, Homo sapien
gtgctccgagcgtcagggcagctgt

SEQ ID NO: 203067 - DNA, 25 bp, Homo sapien
tgggccaccatctgggagcgtctct

SEQ ID NO: 203068 - DNA, 25 bp, Homo sapien
actgggccaccatctgggagcgtct

SEQ ID NO: 203069 - DNA, 25 bp, Homo sapien
gacgagaccaggaggaccggcactg

SEQ ID NO: 203070 - DNA, 25 bp, Homo sapien
gggccaccatctgggagcgtctctc

SEQ ID NO: 203071 - DNA, 25 bp, Homo sapien
gcagctgtggtgtgcgaggtgtttg

SEQ ID NO: 203072 - DNA, 25 bp, Homo sapien
cagccgtgctccgagcgtcagggca

SEQ ID NO: 203073 - DNA, 25 bp, Homo sapien
tgtgcgaggtgtttggacgagacca

SEQ ID NO: 203074 - DNA, 25 bp, Homo sapien
cgctaaagcgcagttgcccggcttc

SEQ ID NO: 203075 - DNA, 25 bp, Homo sapien
aggctacagatagtgtttgttcata

SEQ ID NO: 203076 - DNA, 25 bp, Homo sapien
ccagatcctgatctcctaaaggcta

SEQ ID NO: 203077 - DNA, 25 bp, Homo sapien
taagagaggaaaggttcccaggaca

SEQ ID NO: 203078 - DNA, 25 bp, Homo sapien
ccagggtcaccaagcgcttggagct

SEQ ID NO: 203079 - DNA, 25 bp, Homo sapien
actgcaggaagtcggtccttttgcc

SEQ ID NO: 203080 - DNA, 25 bp, Homo sapien
ccgggttcctcaggttctggaactg

SEQ ID NO: 203081 - DNA, 25 bp, Homo sapien
cgtgctacgagcacggcgctaaagc

SEQ ID NO: 203082 - DNA, 25 bp, Homo sapien
ctacctggtcccgaatcgaagtctc

SEQ ID NO: 203083 - DNA, 25 bp, Homo sapien
aaaagctcccgggactgagcgagac

SEQ ID NO: 203084 - DNA, 25 bp, Homo sapien
ccagccggagtattccgggaacctg

SEQ ID NO: 203085 - DNA, 25 bp, Homo sapien
gaatcgaagtctccgtccttggggc

SEQ ID NO: 203086 - DNA, 25 bp, Homo sapien
gtttagtcactactcgcagcagaga

SEQ ID NO: 203087 - DNA, 25 bp, Homo sapien
gccgtgaagtccacaaaggagcctt

SEQ ID NO: 203088 - DNA, 25 bp, Homo sapien
cggccggccttcttgtaatgtttag

SEQ ID NO: 203089 - DNA, 25 bp, Homo sapien
actcgcgcgcggaagttaggtctcc

SEQ ID NO: 203090 - DNA, 25 bp, Homo sapien
tctacaccgtgcttgttggcgagcc

SEQ ID NO: 203091 - DNA, 25 bp, Homo sapien
gaatgcaggccacctggcgccctta

SEQ ID NO: 203092 - DNA, 25 bp, Homo sapien
cgctcgcctttgtcaataaagttcg

SEQ ID NO: 203093 - DNA, 25 bp, Homo sapien
gacccgtgttctggaggcgactgct

SEQ ID NO: 203094 - DNA, 25 bp, Homo sapien
ggcgcctgacctatgtgcttcttca

SEQ ID NO: 203095 - DNA, 25 bp, Homo sapien
gctcgtgctccattatcggccgggt

SEQ ID NO: 203096 - DNA, 25 bp, Homo sapien
tcttcactggccttcttgagggagg

SEQ ID NO: 203097 - DNA, 25 bp, Homo sapien
cctccgcgacctgtgacgagtgact

SEQ ID NO: 203098 - DNA, 25 bp, Homo sapien
gaagaactcccgcacaatgctgctc

SEQ ID NO: 203099 - DNA, 25 bp, Homo sapien
ctgagcgcttcaacgagaccatcgg

SEQ ID NO: 203100 - DNA, 25 bp, Homo sapien
gttcccagagcaggtccgagtctcc

SEQ ID NO: 203101 - DNA, 25 bp, Homo sapien
tgtccgtgttcaggccggaagaact

SEQ ID NO: 203102 - DNA, 25 bp, Homo sapien
tcggcctccagcacattaaggtgta

SEQ ID NO: 203103 - DNA, 25 bp, Homo sapien
tgctgctcccactcctgcggaggtt

SEQ ID NO: 203104 - DNA, 25 bp, Homo sapien
ttcgacaacagcgtcatcttgagcg

SEQ ID NO: 203105 - DNA, 25 bp, Homo sapien
taaggtgtacctcttcgacaacagc

SEQ ID NO: 203106 - DNA, 25 bp, Homo sapien
aggggtcacgccagaaccttccacg

SEQ ID NO: 203107 - DNA, 25 bp, Homo sapien
aatgacatgggaacgaccgggcctt

SEQ ID NO: 203108 - DNA, 25 bp, Homo sapien
tcctgcaaggacacacgagccgcta

SEQ ID NO: 203109 - DNA, 25 bp, Homo sapien
gtccaggcctcgagttcctgcaagg

SEQ ID NO: 203110 - DNA, 25 bp, Homo sapien
ttcctggccatggactgcatgatgg

SEQ ID NO: 203111 - DNA, 25 bp, Homo sapien
acacatcttgtccaggggccactcg

SEQ ID NO: 203112 - DNA, 25 bp, Homo sapien
ttcttggtcacctcgacagacagac

SEQ ID NO: 203113 - DNA, 25 bp, Homo sapien
agcggtcatgtcctctcggtttttc

SEQ ID NO: 203114 - DNA, 25 bp, Homo sapien
ggacgatgccgccaaggaggtggcg

SEQ ID NO: 203115 - DNA, 25 bp, Homo sapien
gcttgatgaattgggcagccgccct

SEQ ID NO: 203116 - DNA, 25 bp, Homo sapien
ctagcggcttgatgaattgggcagc

SEQ ID NO: 203117 - DNA, 25 bp, Homo sapien
acaggctagcggcttgatgaattgg

SEQ ID NO: 203118 - DNA, 25 bp, Homo sapien
atgaattgggcagccgccctaggct

SEQ ID NO: 203119 - DNA, 25 bp, Homo sapien
ctgctggctgccacaggctagcggc

SEQ ID NO: 203120 - DNA, 25 bp, Homo sapien
ccgccctaggctcagggctgtgagc

SEQ ID NO: 203121 - DNA, 25 bp, Homo sapien
ctgccacaggctagcggcttgatga

SEQ ID NO: 203122 - DNA, 25 bp, Homo sapien
gcacgtatgaccgaagctgcttttc

SEQ ID NO: 203123 - DNA, 25 bp, Homo sapien
tccagattctccaccaaggccgtgt

SEQ ID NO: 203124 - DNA, 25 bp, Homo sapien
tgtgcttggtggtctccagattctc

SEQ ID NO: 203125 - DNA, 25 bp, Homo sapien
ttctcctcgatctcgctggctgtgt

SEQ ID NO: 203126 - DNA, 25 bp, Homo sapien
aggcagctctgaccttctcctcgat

SEQ ID NO: 203127 - DNA, 25 bp, Homo sapien
caaggccgtgtctcccagaaagttc

SEQ ID NO: 203128 - DNA, 25 bp, Homo sapien
cagggcacgtcaccgaggcagctct

SEQ ID NO: 203129 - DNA, 25 bp, Homo sapien
ttctcctttctcatggtagggaggc

SEQ ID NO: 203130 - DNA, 25 bp, Homo sapien
gcgggccgtgccaacccattttcaa

SEQ ID NO: 203131 - DNA, 25 bp, Homo sapien
cgggacagcttctcttgtgcctctg

SEQ ID NO: 203132 - DNA, 25 bp, Homo sapien
acagaggtattgactggcagcgcga

SEQ ID NO: 203133 - DNA, 25 bp, Homo sapien
gagcaagcggctctggtgtttcgca

SEQ ID NO: 203134 - DNA, 25 bp, Homo sapien
gccacgtcgcagtagacctcgtaga

SEQ ID NO: 203135 - DNA, 25 bp, Homo sapien
gcgagccggcacttacggcaatctt

SEQ ID NO: 203136 - DNA, 25 bp, Homo sapien
aatcttgtttttgatccgggacagc

SEQ ID NO: 203137 - DNA, 25 bp, Homo sapien
tagaagcggacgatgttgatgcacc

SEQ ID NO: 203138 - DNA, 25 bp, Homo sapien
gtgccggagttatcgcgtggaaccc

SEQ ID NO: 203139 - DNA, 25 bp, Homo sapien
agccacgtgccggagttatcgcgtg

SEQ ID NO: 203140 - DNA, 25 bp, Homo sapien
ttatcgcgtggaaccctcggaccca

SEQ ID NO: 203141 - DNA, 25 bp, Homo sapien
acgtgccggagttatcgcgtggaac

SEQ ID NO: 203142 - DNA, 25 bp, Homo sapien
ccacagccacgtgccggagttatcg

SEQ ID NO: 203143 - DNA, 25 bp, Homo sapien
cgcgtggaaccctcggacccacagc

SEQ ID NO: 203144 - DNA, 25 bp, Homo sapien
ggagttatcgcgtggaaccctcgga

SEQ ID NO: 203145 - DNA, 25 bp, Homo sapien
gagttatcgcgtggaaccctcggac

SEQ ID NO: 203146 - DNA, 25 bp, Homo sapien
agccaagtgccggaattatcacgtg

SEQ ID NO: 203147 - DNA, 25 bp, Homo sapien
agagttatcgcgtggaaccctcgga

SEQ ID NO: 203148 - DNA, 25 bp, Homo sapien
agtgccggaattatcacgtggaacc

SEQ ID NO: 203149 - DNA, 25 bp, Homo sapien
agccacttgctggaatgatcgcgtg

SEQ ID NO: 203150 - DNA, 25 bp, Homo sapien
tgctggaatgatcgcgtggaaccta

SEQ ID NO: 203151 - DNA, 25 bp, Homo sapien
gaatgatcgcgtggaacctaacacg

SEQ ID NO: 203152 - DNA, 25 bp, Homo sapien
cgtgccagagttatcgcgtggaacc

SEQ ID NO: 203153 - DNA, 25 bp, Homo sapien
ctcggatccacagccacttgctgga

SEQ ID NO: 203154 - DNA, 25 bp, Homo sapien
gcttagatggttttccaggggacca

SEQ ID NO: 203155 - DNA, 25 bp, Homo sapien
ccacagttaacagcggagcccatga

SEQ ID NO: 203156 - DNA, 25 bp, Homo sapien
cggagcccatgaacgcaaagaaact

SEQ ID NO: 203157 - DNA, 25 bp, Homo sapien
ctgggtagtccaggatccactgctc

SEQ ID NO: 203158 - DNA, 25 bp, Homo sapien
agggtagagcacattcggtccagca

SEQ ID NO: 203159 - DNA, 25 bp, Homo sapien
ctggcgcctgctaacgcagacattc

SEQ ID NO: 203160 - DNA, 25 bp, Homo sapien
ctcggcttctcttcgtaggtcacca

SEQ ID NO: 203161 - DNA, 25 bp, Homo sapien
gacattcctgctgaaagcttagatg

SEQ ID NO: 203162 - DNA, 25 bp, Homo sapien
gcgcactgaccgtagctgtcgtcct

SEQ ID NO: 203163 - DNA, 25 bp, Homo sapien
ctccacacccgcgtctcggcaggcg

SEQ ID NO: 203164 - DNA, 25 bp, Homo sapien
cccgttctcatttctgaacaaagac

SEQ ID NO: 203165 - DNA, 25 bp, Homo sapien
ttctgaacaaagacgtggaccgggc

SEQ ID NO: 203166 - DNA, 25 bp, Homo sapien
acaaagacgtggaccgggcacaact

SEQ ID NO: 203167 - DNA, 25 bp, Homo sapien
aactcgctgacgccgagagcggccg

SEQ ID NO: 203168 - DNA, 25 bp, Homo sapien
cacccacatccctcagcgccgccag

SEQ ID NO: 203169 - DNA, 25 bp, Homo sapien
acagcggctccgcttgccaagtccc

SEQ ID NO: 203170 - DNA, 25 bp, Homo sapien
ctcgaatttcgcaaggagtgaaaaa

SEQ ID NO: 203171 - DNA, 25 bp, Homo sapien
cggctacctttcctccacgtggaag

SEQ ID NO: 203172 - DNA, 25 bp, Homo sapien
cattcggacgagctcatagacgcgc

SEQ ID NO: 203173 - DNA, 25 bp, Homo sapien
tagacgcgctctgctgcacgaaaga

SEQ ID NO: 203174 - DNA, 25 bp, Homo sapien
ggcaaccgcaccaacaggaaccgaa

SEQ ID NO: 203175 - DNA, 25 bp, Homo sapien
cgggcgcacctcaagaagcaaaact

SEQ ID NO: 203176 - DNA, 25 bp, Homo sapien
tacgaaggacgcacaacggacctgg

SEQ ID NO: 203177 - DNA, 25 bp, Homo sapien
gcggaaaactccgttgcaccctaca

SEQ ID NO: 203178 - DNA, 25 bp, Homo sapien
ctggactcggggacaacagcatctt

SEQ ID NO: 203179 - DNA, 25 bp, Homo sapien
tttccttggagactcttccatggcc

SEQ ID NO: 203180 - DNA, 25 bp, Homo sapien
ggcatttgagatgcccatcctcttc

SEQ ID NO: 203181 - DNA, 25 bp, Homo sapien
cttggcactccttgggcatttgaga

SEQ ID NO: 203182 - DNA, 25 bp, Homo sapien
gacaacagcatcttggggcttggca

SEQ ID NO: 203183 - DNA, 25 bp, Homo sapien
gtagacgctgctctcagcctgtgca

SEQ ID NO: 203184 - DNA, 25 bp, Homo sapien
tcccaagctcagatgcagtagacgc

SEQ ID NO: 203185 - DNA, 25 bp, Homo sapien
catcacccaagggagcagactcggg

SEQ ID NO: 203186 - DNA, 25 bp, Homo sapien
gccagcctacgtgatgacgcaagtg

SEQ ID NO: 203187 - DNA, 25 bp, Homo sapien
aggcggggctagattccgctaactc

SEQ ID NO: 203188 - DNA, 25 bp, Homo sapien
gcgctgcgctaactccgaaagggtt

SEQ ID NO: 203189 - DNA, 25 bp, Homo sapien
acgtgtcaccgcgacgcttaaaggc

SEQ ID NO: 203190 - DNA, 25 bp, Homo sapien
tcctcgggaatacccgggctctgga

SEQ ID NO: 203191 - DNA, 25 bp, Homo sapien
tctccgaagttgacctgaatcctgc

SEQ ID NO: 203192 - DNA, 25 bp, Homo sapien
tgacgtctccgcagcgcactagagg

SEQ ID NO: 203193 - DNA, 25 bp, Homo sapien
tcctccgcaaccacgaggaaggtgc

SEQ ID NO: 203194 - DNA, 25 bp, Homo sapien
ccatccagaggcactcgtccgggga

SEQ ID NO: 203195 - DNA, 25 bp, Homo sapien
ctgtgacccagtccatccagaggca

SEQ ID NO: 203196 - DNA, 25 bp, Homo sapien
cgttgatgttcttctctgtgaccca

SEQ ID NO: 203197 - DNA, 25 bp, Homo sapien
ctggtgcccgttgatgttcttctct

SEQ ID NO: 203198 - DNA, 25 bp, Homo sapien
tctcttgatgcaggcgaagaacttg

SEQ ID NO: 203199 - DNA, 25 bp, Homo sapien
aggagccgtcacttctcttgatgca

SEQ ID NO: 203200 - DNA, 25 bp, Homo sapien
gcggtaccacgcacaggagccgtca

SEQ ID NO: 203201 - DNA, 25 bp, Homo sapien
aagaacttggcctggtgcccgttga

SEQ ID NO: 203202 - DNA, 25 bp, Homo sapien
cccacgtggtgctggattccacgca

SEQ ID NO: 203203 - DNA, 25 bp, Homo sapien
gagagctcggcagagacacccacgt

SEQ ID NO: 203204 - DNA, 25 bp, Homo sapien
agggctcaggaaatgccgagagctc

SEQ ID NO: 203205 - DNA, 25 bp, Homo sapien
caggacgccacagcatcagacgaga

SEQ ID NO: 203206 - DNA, 25 bp, Homo sapien
agcgccgagaacagagtctggcttc

SEQ ID NO: 203207 - DNA, 25 bp, Homo sapien
acggcccgtgtgaagcgccgagaac

SEQ ID NO: 203208 - DNA, 25 bp, Homo sapien
ttccacgcacgaggaaccgacgggc

SEQ ID NO: 203209 - DNA, 25 bp, Homo sapien
cagcatcagacgagacggcccgtgt

SEQ ID NO: 203210 - DNA, 25 bp, Homo sapien
tggggtcgccgctccttacctacat

SEQ ID NO: 203211 - DNA, 25 bp, Homo sapien
aaagaaagtcggctctgggcgtcca

SEQ ID NO: 203212 - DNA, 25 bp, Homo sapien
catctgcattgcaaaacgcctgttg

SEQ ID NO: 203213 - DNA, 25 bp, Homo sapien
caaaacgcctgttgcgggtgcaccg

SEQ ID NO: 203214 - DNA, 25 bp, Homo sapien
cgcgctgccttctacggatgtgttt

SEQ ID NO: 203215 - DNA, 25 bp, Homo sapien
ccgcagttttattgcgctcggagga

SEQ ID NO: 203216 - DNA, 25 bp, Homo sapien
agcccgcgcttttgttgtgcccggc

SEQ ID NO: 203217 - DNA, 25 bp, Homo sapien
gggcgtccacttgcaggattcgaga

SEQ ID NO: 203218 - DNA, 25 bp, Homo sapien
ctgcctgcaacctcgcgagaagtgc

SEQ ID NO: 203219 - DNA, 25 bp, Homo sapien
tcttccgcaagcgagggatggaccc

SEQ ID NO: 203220 - DNA, 25 bp, Homo sapien
cttccggatgcagaacgtgccagga

SEQ ID NO: 203221 - DNA, 25 bp, Homo sapien
tgccaggacagcagtttcgatttcc

SEQ ID NO: 203222 - DNA, 25 bp, Homo sapien
cggcaatcaagagcctcccgtgctg

SEQ ID NO: 203223 - DNA, 25 bp, Homo sapien
gttgtcataggaaccgcgctccgga

SEQ ID NO: 203224 - DNA, 25 bp, Homo sapien
cgagaagctccggagaggctagaca

SEQ ID NO: 203225 - DNA, 25 bp, Homo sapien
gaacggaatcaccaagtctcgcgag

SEQ ID NO: 203226 - DNA, 25 bp, Homo sapien
tgcagcgtgtcactccagcaggcag

SEQ ID NO: 203227 - DNA, 25 bp, Homo sapien
tcgtatttcacgcttccgatcttgg

SEQ ID NO: 203228 - DNA, 25 bp, Homo sapien
ccgatcttggtctccggcaacagga

SEQ ID NO: 203229 - DNA, 25 bp, Homo sapien
gcccgtccagcgtgaaggccatgat

SEQ ID NO: 203230 - DNA, 25 bp, Homo sapien
ccatgatgtaggaggcgactctgcc

SEQ ID NO: 203231 - DNA, 25 bp, Homo sapien
ccacaatgatctggtcgtcggtgtt

SEQ ID NO: 203232 - DNA, 25 bp, Homo sapien
acgtggctcacagcgatgtcgccga

SEQ ID NO: 203233 - DNA, 25 bp, Homo sapien
tcatggatgaggtagcctgggaacc

SEQ ID NO: 203234 - DNA, 25 bp, Homo sapien
agcagccagaggatggcagcaccca

SEQ ID NO: 203235 - DNA, 25 bp, Homo sapien
attcgataccgaatcccagccggtg

SEQ ID NO: 203236 - DNA, 25 bp, Homo sapien
gaatcccagccggtgtcctttgtgg

SEQ ID NO: 203237 - DNA, 25 bp, Homo sapien
tcattgtaccagttggcgggcgcct

SEQ ID NO: 203238 - DNA, 25 bp, Homo sapien
tggcagcacccacaaagaacgtcag

SEQ ID NO: 203239 - DNA, 25 bp, Homo sapien
cacaaagaacgtcaggatcaccttc

SEQ ID NO: 203240 - DNA, 25 bp, Homo sapien
cgataactgcgattcgataccgaat

SEQ ID NO: 203241 - DNA, 25 bp, Homo sapien
cgagcctccagttgtgtgcattgtg

SEQ ID NO: 203242 - DNA, 25 bp, Homo sapien
tgagggccgtcttccaccgcgttgc

SEQ ID NO: 203243 - DNA, 25 bp, Homo sapien
gcttggctgggctaacggccgggac

SEQ ID NO: 203244 - DNA, 25 bp, Homo sapien
acatgagggccgtcttccaccgcgt

SEQ ID NO: 203245 - DNA, 25 bp, Homo sapien
catgagggccgtcttccaccgcgtt

SEQ ID NO: 203246 - DNA, 25 bp, Homo sapien
atgagggccgtcttccaccgcgttg

SEQ ID NO: 203247 - DNA, 25 bp, Homo sapien
gagggccgtcttccaccgcgttgcg

SEQ ID NO: 203248 - DNA, 25 bp, Homo sapien
gtcttccaccgcgttgcgctggaac

SEQ ID NO: 203249 - DNA, 25 bp, Homo sapien
tcttccaccgcgttgcgctggaacg

SEQ ID NO: 203250 - DNA, 25 bp, Homo sapien
ttccgcttctggtcgcagagacctc

SEQ ID NO: 203251 - DNA, 25 bp, Homo sapien
gacggacctccagactcacggaatc

SEQ ID NO: 203252 - DNA, 25 bp, Homo sapien
ttctgcactgccgtcctccggaaga

SEQ ID NO: 203253 - DNA, 25 bp, Homo sapien
ggggcttttctgcacgtggatacta

SEQ ID NO: 203254 - DNA, 25 bp, Homo sapien
tactttcgagaaaccgcgcttccgc

SEQ ID NO: 203255 - DNA, 25 bp, Homo sapien
ctcgctgctcacatctggctgggct

SEQ ID NO: 203256 - DNA, 25 bp, Homo sapien
gcggggcacacacggttaatcctcc

SEQ ID NO: 203257 - DNA, 25 bp, Homo sapien
cgcggctgctgtttggacgaaaagc

SEQ ID NO: 203258 - DNA, 25 bp, Homo sapien
taagcaccttctacacgcgggagaa

SEQ ID NO: 203259 - DNA, 25 bp, Homo sapien
tgcgtgtctatttccagccaggacc

SEQ ID NO: 203260 - DNA, 25 bp, Homo sapien
agctcttttcactctgcgcctggga

SEQ ID NO: 203261 - DNA, 25 bp, Homo sapien
tgctagccttgtcggccctgttcag

SEQ ID NO: 203262 - DNA, 25 bp, Homo sapien
ctacagcgaagaggggatccacttc

SEQ ID NO: 203263 - DNA, 25 bp, Homo sapien
ccctactcagtgtgttcgcggcacg

SEQ ID NO: 203264 - DNA, 25 bp, Homo sapien
cgctgcgccaggagataagcacctt

SEQ ID NO: 203265 - DNA, 25 bp, Homo sapien
atcgcctcgcacagcgtgtgcctga

SEQ ID NO: 203266 - DNA, 25 bp, Homo sapien
tgcaagagccactacgccgcctttt

SEQ ID NO: 203267 - DNA, 25 bp, Homo sapien
accagacggtgatcttcgacacgga

SEQ ID NO: 203268 - DNA, 25 bp, Homo sapien
agccaaagcgatcggtgctcccaga

SEQ ID NO: 203269 - DNA, 25 bp, Homo sapien
ttcaccggcaagttctactgctacg

SEQ ID NO: 203270 - DNA, 25 bp, Homo sapien
tgagacgccctgcacacacagaaag

SEQ ID NO: 203271 - DNA, 25 bp, Homo sapien
tgggcgaccgcagcatcatgcaaag

SEQ ID NO: 203272 - DNA, 25 bp, Homo sapien
ccttcagtggctacctggtcaagca

SEQ ID NO: 203273 - DNA, 25 bp, Homo sapien
ccctggctttggcattcagtgagac

SEQ ID NO: 203274 - DNA, 25 bp, Homo sapien
cccgagacacgtgtgagaggcacaa

SEQ ID NO: 203275 - DNA, 25 bp, Homo sapien
tactcacgctccgtaagtcgggatg

SEQ ID NO: 203276 - DNA, 25 bp, Homo sapien
gtggcgcagcccgaaatgtattata

SEQ ID NO: 203277 - DNA, 25 bp, Homo sapien
gaggcacaaggggacccacctggca

SEQ ID NO: 203278 - DNA, 25 bp, Homo sapien
cggagcgctactcagtcaacacggc

SEQ ID NO: 203279 - DNA, 25 bp, Homo sapien
gccaagtagctggtctcatcccatc

SEQ ID NO: 203280 - DNA, 25 bp, Homo sapien
cccagcttttacctgcatagaattc

SEQ ID NO: 203281 - DNA, 25 bp, Homo sapien
tgcatagaattcaggcccgtagact

SEQ ID NO: 203282 - DNA, 25 bp, Homo sapien
gcgggacctacagccggcgctgtaa

SEQ ID NO: 203283 - DNA, 25 bp, Homo sapien
acatttcacacgttagcctggcggg

SEQ ID NO: 203284 - DNA, 25 bp, Homo sapien
tgatctccacgtctaaaatttttcc

SEQ ID NO: 203285 - DNA, 25 bp, Homo sapien
cggaagagcggggaatacaagcacc

SEQ ID NO: 203286 - DNA, 25 bp, Homo sapien
tacaagcacccgtgtcgctcagggg

SEQ ID NO: 203287 - DNA, 25 bp, Homo sapien
cctcgggcgcgaagctctccaggaa

SEQ ID NO: 203288 - DNA, 25 bp, Homo sapien
cccgctcgttaaaaatgatctccac

SEQ ID NO: 203289 - DNA, 25 bp, Homo sapien
tctccaggaaggaaacgcacatttc

SEQ ID NO: 203290 - DNA, 25 bp, Homo sapien
tgcttctggacaggaaaacaagccc

SEQ ID NO: 203291 - DNA, 25 bp, Homo sapien
tcaccgtcttccagctgaacgttgg

SEQ ID NO: 203292 - DNA, 25 bp, Homo sapien
agcgtctgtgcttctggacaggaaa

SEQ ID NO: 203293 - DNA, 25 bp, Homo sapien
ctgggaacagcgctagagcgtctgt

SEQ ID NO: 203294 - DNA, 25 bp, Homo sapien
ccttcctgttaagcgtcgccactcc

SEQ ID NO: 203295 - DNA, 25 bp, Homo sapien
tgaacgttggtagcacctccaccca

SEQ ID NO: 203296 - DNA, 25 bp, Homo sapien
ctccacccacagacgcggctgcaaa

SEQ ID NO: 203297 - DNA, 25 bp, Homo sapien
tccagctgaacgttggtagcacctc

SEQ ID NO: 203298 - DNA, 25 bp, Homo sapien
gggctgacaactccatttttaaaca

SEQ ID NO: 203299 - DNA, 25 bp, Homo sapien
ctcggggctgacaactccattttta

SEQ ID NO: 203300 - DNA, 25 bp, Homo sapien
tgcgcctgtcaactcggggctgaca

SEQ ID NO: 203301 - DNA, 25 bp, Homo sapien
gcactttgctgattgcgcctgtcaa

SEQ ID NO: 203302 - DNA, 25 bp, Homo sapien
tcctgccgacgctgcactttgctga

SEQ ID NO: 203303 - DNA, 25 bp, Homo sapien
agcactgtctccgtcacacgccagg

SEQ ID NO: 203304 - DNA, 25 bp, Homo sapien
tcttcttctctagaagccatgtgca

SEQ ID NO: 203305 - DNA, 25 bp, Homo sapien
cttgcacaggcggaggcacatccca

SEQ ID NO: 203306 - DNA, 25 bp, Homo sapien
aggcagcccgagttcgccatggagc

SEQ ID NO: 203307 - DNA, 25 bp, Homo sapien
agcatgctgccggagttggacagca

SEQ ID NO: 203308 - DNA, 25 bp, Homo sapien
cgagaatacggccagagagtctgtg

SEQ ID NO: 203309 - DNA, 25 bp, Homo sapien
caggagtcagtcactttggagcctc

SEQ ID NO: 203310 - DNA, 25 bp, Homo sapien
ctggcgtactccaacatcaaacgga

SEQ ID NO: 203311 - DNA, 25 bp, Homo sapien
agcgacggcacaacagctgatccca

SEQ ID NO: 203312 - DNA, 25 bp, Homo sapien
ctcccgcgccttcggaaaagttgcg

SEQ ID NO: 203313 - DNA, 25 bp, Homo sapien
ccgcttacctgttggaggtagagga

SEQ ID NO: 203314 - DNA, 25 bp, Homo sapien
cagtgccctccaagagccgggcgag

SEQ ID NO: 203315 - DNA, 25 bp, Homo sapien
ggagaagttttgtgcgcctcaccta

SEQ ID NO: 203316 - DNA, 25 bp, Homo sapien
tgccggtgcgagtccgctcgcttca

SEQ ID NO: 203317 - DNA, 25 bp, Homo sapien
ttcacagcgactcacgcccggaagg

SEQ ID NO: 203318 - DNA, 25 bp, Homo sapien
tcacctgccagctgtcttcgcagta

SEQ ID NO: 203319 - DNA, 25 bp, Homo sapien
cccgcaacgtcctacagaacggtgg

SEQ ID NO: 203320 - DNA, 25 bp, Homo sapien
cgaggccagcgcttttgttgtcggc

SEQ ID NO: 203321 - DNA, 25 bp, Homo sapien
gtcttcgcagtagcagtgccgactg

SEQ ID NO: 203322 - DNA, 25 bp, Homo sapien
ccggaagtgctacggttgcatcgtg

SEQ ID NO: 203323 - DNA, 25 bp, Homo sapien
tcatcccggaagtgctacggttgca

SEQ ID NO: 203324 - DNA, 25 bp, Homo sapien
gtcatcccggaagtgctacggttgc

SEQ ID NO: 203325 - DNA, 25 bp, Homo sapien
tcccggaagtgctacggttgcatcg

SEQ ID NO: 203326 - DNA, 25 bp, Homo sapien
gtgggctgtcatcccggaagtgcta

SEQ ID NO: 203327 - DNA, 25 bp, Homo sapien
atcccggaagtgctacggttgcatc

SEQ ID NO: 203328 - DNA, 25 bp, Homo sapien
aagtgctacggttgcatcgtgtggg

SEQ ID NO: 203329 - DNA, 25 bp, Homo sapien
gctgtcatcccggaagtgctacggt

SEQ ID NO: 203330 - DNA, 25 bp, Homo sapien
ccgagtgcctctgtctgcgtcagga

SEQ ID NO: 203331 - DNA, 25 bp, Homo sapien
ttgtcatcccggaagtgctacggtt

SEQ ID NO: 203332 - DNA, 25 bp, Homo sapien
cggcgcgtgcttctgatttcctaag

SEQ ID NO: 203333 - DNA, 25 bp, Homo sapien
tctgatttcctaagcatgccgagtg

SEQ ID NO: 203334 - DNA, 25 bp, Homo sapien
tgggcttgtcatcccggaagtgcta

SEQ ID NO: 203335 - DNA, 25 bp, Homo sapien
tctgtctgcgtcaggagagtcgtgt

SEQ ID NO: 203336 - DNA, 25 bp, Homo sapien
cctaagcatgccgagtgaatccatc

SEQ ID NO: 203337 - DNA, 25 bp, Homo sapien
ccgagtgaatccatcccgagtgcct

SEQ ID NO: 203338 - DNA, 25 bp, Homo sapien
aacgggcgcacatcaggaaatgttc

SEQ ID NO: 203339 - DNA, 25 bp, Homo sapien
ggaaatgttcgctctcccttcacca

SEQ ID NO: 203340 - DNA, 25 bp, Homo sapien
actggccgatttcctctccttcaag

SEQ ID NO: 203341 - DNA, 25 bp, Homo sapien
tcaccaccaaggagactggccgatt

SEQ ID NO: 203342 - DNA, 25 bp, Homo sapien
cgccaacttggggaggatgcccatc

SEQ ID NO: 203343 - DNA, 25 bp, Homo sapien
aggtgccgtccatcaataccgccaa

SEQ ID NO: 203344 - DNA, 25 bp, Homo sapien
ccacagaggaaggatgcccagtaca

SEQ ID NO: 203345 - DNA, 25 bp, Homo sapien
acatctgcctgctggaggaacgtgc

SEQ ID NO: 203346 - DNA, 25 bp, Homo sapien
ccaatgcaatttcctccggctgagg

SEQ ID NO: 203347 - DNA, 25 bp, Homo sapien
cgtccaaagcttggcaacgcgatta

SEQ ID NO: 203348 - DNA, 25 bp, Homo sapien
atcggctgccgagaatgatgcaacc

SEQ ID NO: 203349 - DNA, 25 bp, Homo sapien
gagttcccgaacacaggtcttcctg

SEQ ID NO: 203350 - DNA, 25 bp, Homo sapien
acggttgattggtagagcgtgctcc

SEQ ID NO: 203351 - DNA, 25 bp, Homo sapien
agaggccacctttcgaccttcgagg

SEQ ID NO: 203352 - DNA, 25 bp, Homo sapien
gctcctatcgcagaggctgttattc

SEQ ID NO: 203353 - DNA, 25 bp, Homo sapien
ggcagccaaatacccagcgtctgtg

SEQ ID NO: 203354 - DNA, 25 bp, Homo sapien
ccacccggatacgtgttaccatcgg

SEQ ID NO: 203355 - DNA, 25 bp, Homo sapien
cggatacgtgttaccatcgggtacg

SEQ ID NO: 203356 - DNA, 25 bp, Homo sapien
gcacacccggatacatgttaccatc

SEQ ID NO: 203357 - DNA, 25 bp, Homo sapien
aggggacgcacacccggatacgtgt

SEQ ID NO: 203358 - DNA, 25 bp, Homo sapien
atacgtgttaccatcggctacggcc

SEQ ID NO: 203359 - DNA, 25 bp, Homo sapien
ccaggggacgcacacccggatacgt

SEQ ID NO: 203360 - DNA, 25 bp, Homo sapien
cccggatacgtgttaccatcggcta

SEQ ID NO: 203361 - DNA, 25 bp, Homo sapien
gatacgtgttaccatcgggtacggc

SEQ ID NO: 203362 - DNA, 25 bp, Homo sapien
tgatcatcacatccgaccacggcat

SEQ ID NO: 203363 - DNA, 25 bp, Homo sapien
cgtcacctaccaaggggtggctgtg

SEQ ID NO: 203364 - DNA, 25 bp, Homo sapien
ggcatcgcacacaactacaaaaatg

SEQ ID NO: 203365 - DNA, 25 bp, Homo sapien
acggagtggagagcgaacatcgaca

SEQ ID NO: 203366 - DNA, 25 bp, Homo sapien
cgacacagtgatggcgtggttcaca

SEQ ID NO: 203367 - DNA, 25 bp, Homo sapien
aggacctggatctggtcacactcta

SEQ ID NO: 203368 - DNA, 25 bp, Homo sapien
acggcatgacgaccgtggacaaacg

SEQ ID NO: 203369 - DNA, 25 bp, Homo sapien
tcacactctacttcggggagccgga

SEQ ID NO: 203370 - DNA, 25 bp, Homo sapien
ccggcacaaagcacccatgggaata

SEQ ID NO: 203371 - DNA, 25 bp, Homo sapien
atgctctgctggtcgcggacggacc

SEQ ID NO: 203372 - DNA, 25 bp, Homo sapien
cttggctgttatggtgctggtaata

SEQ ID NO: 203373 - DNA, 25 bp, Homo sapien
ttgctcttccaggaagccgccggga

SEQ ID NO: 203374 - DNA, 25 bp, Homo sapien
ggtaataagcctcgcagcccaggtc

SEQ ID NO: 203375 - DNA, 25 bp, Homo sapien
aataaaggccaagccgcgacagtca

SEQ ID NO: 203376 - DNA, 25 bp, Homo sapien
ttatggtgctggtaataagcctcgc

SEQ ID NO: 203377 - DNA, 25 bp, Homo sapien
ggctgtctcgctgcgatgctctgct

SEQ ID NO: 203378 - DNA, 25 bp, Homo sapien
ctgcacatgtgcgacgggcatccac

SEQ ID NO: 203379 - DNA, 25 bp, Homo sapien
ggctgcaggagcatctgttgccatg

SEQ ID NO: 203380 - DNA, 25 bp, Homo sapien
acgcccgccttctgaggtgcgcagg

SEQ ID NO: 203381 - DNA, 25 bp, Homo sapien
accaccgcagtccaagaagccgaga

SEQ ID NO: 203382 - DNA, 25 bp, Homo sapien
aacaagcgatgggaacaggccctcg

SEQ ID NO: 203383 - DNA, 25 bp, Homo sapien
cccgcgaaggaacggtcagcgcagt

SEQ ID NO: 203384 - DNA, 25 bp, Homo sapien
gagcgcctgagtaccgcatcccagg

SEQ ID NO: 203385 - DNA, 25 bp, Homo sapien
gcttctttgggacgagcagcctccc

SEQ ID NO: 203386 - DNA, 25 bp, Homo sapien
agccagttcaagaagccgggggaag

SEQ ID NO: 203387 - DNA, 25 bp, Homo sapien
cagcccccgacccgttttgctctcg

SEQ ID NO: 203388 - DNA, 25 bp, Homo sapien
tgctctcgtccaaaacagagcgact

SEQ ID NO: 203389 - DNA, 25 bp, Homo sapien
gctctcgtccaaaacagagcgactc

SEQ ID NO: 203390 - DNA, 25 bp, Homo sapien
ctctcgtccaaaacagagcgactcc

SEQ ID NO: 203391 - DNA, 25 bp, Homo sapien
tctcgtccaaaacagagcgactccc

SEQ ID NO: 203392 - DNA, 25 bp, Homo sapien
cccccgctgccgaggaaaagccagt

SEQ ID NO: 203393 - DNA, 25 bp, Homo sapien
ttgctctcgtccaaaacagagcgac

SEQ ID NO: 203394 - DNA, 25 bp, Homo sapien
cagaacaatggctttttgcccggaa

SEQ ID NO: 203395 - DNA, 25 bp, Homo sapien
tgcccggaaaacggagttgggagca

SEQ ID NO: 203396 - DNA, 25 bp, Homo sapien
tcccttcgggccagaacaatggctt

SEQ ID NO: 203397 - DNA, 25 bp, Homo sapien
cccttcgggccagaacaatggcttt

SEQ ID NO: 203398 - DNA, 25 bp, Homo sapien
cttcgggccagaacaatggcttttt

SEQ ID NO: 203399 - DNA, 25 bp, Homo sapien
tcgggccagaacaatggctttttgc

SEQ ID NO: 203400 - DNA, 25 bp, Homo sapien
ccagaacaatggctttttgcccgga

SEQ ID NO: 203401 - DNA, 25 bp, Homo sapien
aatcacgcgggactcggtgggcgcc

SEQ ID NO: 203402 - DNA, 25 bp, Homo sapien
cacattgttctggatctcgggctgg

SEQ ID NO: 203403 - DNA, 25 bp, Homo sapien
aagctggagtacctggtcaagtggc

SEQ ID NO: 203404 - DNA, 25 bp, Homo sapien
gcccgcgcgccacattgttctggat

SEQ ID NO: 203405 - DNA, 25 bp, Homo sapien
ttgctattgatggatgtagagtttc

SEQ ID NO: 203406 - DNA, 25 bp, Homo sapien
cctgagcttgctattgatggatgta

SEQ ID NO: 203407 - DNA, 25 bp, Homo sapien
cccgctgtaacctgagcttgctatt

SEQ ID NO: 203408 - DNA, 25 bp, Homo sapien
ctttgtttacacgcccgcgggtgca

SEQ ID NO: 203409 - DNA, 25 bp, Homo sapien
gcggctggtcctccaagtgagtccc

SEQ ID NO: 203410 - DNA, 25 bp, Homo sapien
cgcagcctcatcgagcacgtatttg

SEQ ID NO: 203411 - DNA, 25 bp, Homo sapien
tcaacctgaggcattactgaagccc

SEQ ID NO: 203412 - DNA, 25 bp, Homo sapien
gagagtagcagctcggactccgacc

SEQ ID NO: 203413 - DNA, 25 bp, Homo sapien
ccacactgccagagatgagcgcagg

SEQ ID NO: 203414 - DNA, 25 bp, Homo sapien
tcagtgtccgttcagaccagccagg

SEQ ID NO: 203415 - DNA, 25 bp, Homo sapien
gtatttgtcaccgacgtcactgcca

SEQ ID NO: 203416 - DNA, 25 bp, Homo sapien
tcatcaccgtcacagtgaaggagtc

SEQ ID NO: 203417 - DNA, 25 bp, Homo sapien
ccagcactggacagaacccgtcagt

SEQ ID NO: 203418 - DNA, 25 bp, Homo sapien
tgggcaacgtgctcaactacctgga

SEQ ID NO: 203419 - DNA, 25 bp, Homo sapien
cccagagagcttttggtctcaggcc

SEQ ID NO: 203420 - DNA, 25 bp, Homo sapien
tatctccaggccctacgtgaggtcc

SEQ ID NO: 203421 - DNA, 25 bp, Homo sapien
ggaccctctgctcaggcacaactgg

SEQ ID NO: 203422 - DNA, 25 bp, Homo sapien
gcacaactgggcaagggatgcctcc

SEQ ID NO: 203423 - DNA, 25 bp, Homo sapien
gtgcaccacgggtacaatccagctc

SEQ ID NO: 203424 - DNA, 25 bp, Homo sapien
tctgtccgtccatggcccgtcagtt

SEQ ID NO: 203425 - DNA, 25 bp, Homo sapien
cccggctgcgcagctactgcaaagg

SEQ ID NO: 203426 - DNA, 25 bp, Homo sapien
gttgcctagcaatacccgcgaattc

SEQ ID NO: 203427 - DNA, 25 bp, Homo sapien
caataggcgcgaggctctgcattta

SEQ ID NO: 203428 - DNA, 25 bp, Homo sapien
gctccgagcttgcagttgcctagca

SEQ ID NO: 203429 - DNA, 25 bp, Homo sapien
cactgctgtgaagtctgcggccaga

SEQ ID NO: 203430 - DNA, 25 bp, Homo sapien
cgggccactgactcctcagcaaggg

SEQ ID NO: 203431 - DNA, 25 bp, Homo sapien
tgagcctgaatcgtggcttcctggc

SEQ ID NO: 203432 - DNA, 25 bp, Homo sapien
ggcggctccaggttcactaatcaca

SEQ ID NO: 203433 - DNA, 25 bp, Homo sapien
cccgaagaagtgcagccagtaggtg

SEQ ID NO: 203434 - DNA, 25 bp, Homo sapien
tatgcaaacatctggggctgtcccg

SEQ ID NO: 203435 - DNA, 25 bp, Homo sapien
tgccgttcccttgcgagattgttaa

SEQ ID NO: 203436 - DNA, 25 bp, Homo sapien
ttgttaacgccaagagccacagtcc

SEQ ID NO: 203437 - DNA, 25 bp, Homo sapien
ccgggtcattcgagaaggcacaagc

SEQ ID NO: 203438 - DNA, 25 bp, Homo sapien
ctctcgcagaacctcggggaacaga

SEQ ID NO: 203439 - DNA, 25 bp, Homo sapien
cccgcccttctgtaggaaatcaaat

SEQ ID NO: 203440 - DNA, 25 bp, Homo sapien
cgtcgggacctcaagtcagttccaa

SEQ ID NO: 203441 - DNA, 25 bp, Homo sapien
tcagttccaaagtgggagtctctca

SEQ ID NO: 203442 - DNA, 25 bp, Homo sapien
ctactttccgtatgcgccgcttcag

SEQ ID NO: 203443 - DNA, 25 bp, Homo sapien
aatgtgcatgtgtctcaggctcctg

SEQ ID NO: 203444 - DNA, 25 bp, Homo sapien
cgggtcccgctaacaaatcaatgtg

SEQ ID NO: 203445 - DNA, 25 bp, Homo sapien
gcgttgctacgtgaccagcgttcca

SEQ ID NO: 203446 - DNA, 25 bp, Homo sapien
cgcacgctgattggacgagctccga

SEQ ID NO: 203447 - DNA, 25 bp, Homo sapien
ccacgtgttgctaacgacgttgcta

SEQ ID NO: 203448 - DNA, 25 bp, Homo sapien
tgaaagctccatgttgactcgccgc

SEQ ID NO: 203449 - DNA, 25 bp, Homo sapien
agaccataatactctcccgctgacg

SEQ ID NO: 203450 - DNA, 25 bp, Homo sapien
cccatatggctgcaatttgagtgtc

SEQ ID NO: 203451 - DNA, 25 bp, Homo sapien
agccctagcgcgtcctctagcttga

SEQ ID NO: 203452 - DNA, 25 bp, Homo sapien
cttcccgacaaagggtctgcgacct

SEQ ID NO: 203453 - DNA, 25 bp, Homo sapien
aattgtcggcgattctcttaacagc

SEQ ID NO: 203454 - DNA, 25 bp, Homo sapien
ttaatcccattgctcggcggtccgc

SEQ ID NO: 203455 - DNA, 25 bp, Homo sapien
ctggtggcatggtcttaggaaccca

SEQ ID NO: 203456 - DNA, 25 bp, Homo sapien
gtttgcagtcattccagccgggtca

SEQ ID NO: 203457 - DNA, 25 bp, Homo sapien
tctttgtttacggaaatgcgggcgc

SEQ ID NO: 203458 - DNA, 25 bp, Homo sapien
gggcgtccacctgtgtgtccttccc

SEQ ID NO: 203459 - DNA, 25 bp, Homo sapien
ggggcgtccacctgtgtgtccttcc

SEQ ID NO: 203460 - DNA, 25 bp, Homo sapien
agaaagcatggcgtgcacggggcgc

SEQ ID NO: 203461 - DNA, 25 bp, Homo sapien
tgtggggcgtccacctgtgtgtcct

SEQ ID NO: 203462 - DNA, 25 bp, Homo sapien
aaagcatggcgtgcacggggcgcct

SEQ ID NO: 203463 - DNA, 25 bp, Homo sapien
cttccccatgggaggcagaaagcat

SEQ ID NO: 203464 - DNA, 25 bp, Homo sapien
ttccccatgggaggcagaaagcatg

SEQ ID NO: 203465 - DNA, 25 bp, Homo sapien
aggcagaaagcatggcgtgcacggg

SEQ ID NO: 203466 - DNA, 25 bp, Homo sapien
ggcaattcacctggtcgctgcaaga

SEQ ID NO: 203467 - DNA, 25 bp, Homo sapien
agcccggctccggaaaccagtctga

SEQ ID NO: 203468 - DNA, 25 bp, Homo sapien
tccaaggcgtcaagggcaattcacc

SEQ ID NO: 203469 - DNA, 25 bp, Homo sapien
cgactgctcgaggtcccagaacagc

SEQ ID NO: 203470 - DNA, 25 bp, Homo sapien
ccaccgagctgagcccggaatcgaa

SEQ ID NO: 203471 - DNA, 25 bp, Homo sapien
ccacattgcgaaacggacggtcgga

SEQ ID NO: 203472 - DNA, 25 bp, Homo sapien
gccctgcgatgaatggctctgccca

SEQ ID NO: 203473 - DNA, 25 bp, Homo sapien
ccagcttccatggtgcggtgagcca

SEQ ID NO: 203474 - DNA, 25 bp, Homo sapien
cctgcccttatatggcgatgtgcgc

SEQ ID NO: 203475 - DNA, 25 bp, Homo sapien
cgagcggccgcaccatataagggca

SEQ ID NO: 203476 - DNA, 25 bp, Homo sapien
ccaaattagcatctcccagggtgtc

SEQ ID NO: 203477 - DNA, 25 bp, Homo sapien
ggcaaccggctctcacgagtggaaa

SEQ ID NO: 203478 - DNA, 25 bp, Homo sapien
gcctcgttgtcattcttctcccgtg

SEQ ID NO: 203479 - DNA, 25 bp, Homo sapien
gcctgtatttaggttcctgccctta

SEQ ID NO: 203480 - DNA, 25 bp, Homo sapien
tccgaggctagggaagtgctaaatc

SEQ ID NO: 203481 - DNA, 25 bp, Homo sapien
agtagccgctgcagcatcaggttca

SEQ ID NO: 203482 - DNA, 25 bp, Homo sapien
ttctaaatgggtgggagcgacacac

SEQ ID NO: 203483 - DNA, 25 bp, Homo sapien
gcgccgctttggcagccattttctg

SEQ ID NO: 203484 - DNA, 25 bp, Homo sapien
agcacgcacacagctttgttatttg

SEQ ID NO: 203485 - DNA, 25 bp, Homo sapien
cgctcggcacctgctgagctacggt

SEQ ID NO: 203486 - DNA, 25 bp, Homo sapien
aggccgggtgtccagttcaccctga

SEQ ID NO: 203487 - DNA, 25 bp, Homo sapien
tctcagcagtctcagtcctggagct

SEQ ID NO: 203488 - DNA, 25 bp, Homo sapien
gtcctctgtgcgcacttttcgttta

SEQ ID NO: 203489 - DNA, 25 bp, Homo sapien
ggtacgaacccacgcggctgtgcca

SEQ ID NO: 203490 - DNA, 25 bp, Homo sapien
actcgctcagcgactctgcaggttc

SEQ ID NO: 203491 - DNA, 25 bp, Homo sapien
agagagctcgtgtagccttttaaca

SEQ ID NO: 203492 - DNA, 25 bp, Homo sapien
tggtcgggccttttgagctcaaaca

SEQ ID NO: 203493 - DNA, 25 bp, Homo sapien
gcacttgacaagttagcacggttaa

SEQ ID NO: 203494 - DNA, 25 bp, Homo sapien
atactagaactctgaggccgggcgc

SEQ ID NO: 203495 - DNA, 25 bp, Homo sapien
ggctacaccgtcacgtactccttga

SEQ ID NO: 203496 - DNA, 25 bp, Homo sapien
cggtgacgtcggtgataattatatt

SEQ ID NO: 203497 - DNA, 25 bp, Homo sapien
cccaaagaagggcttgaactcgctc

SEQ ID NO: 203498 - DNA, 25 bp, Homo sapien
gtgtgcctgcgcgtctatctccatc

SEQ ID NO: 203499 - DNA, 25 bp, Homo sapien
acaaaaatatgcctccgtgtgtgtg

SEQ ID NO: 203500 - DNA, 25 bp, Homo sapien
actcagcaacacaaaaatatgcctc

SEQ ID NO: 203501 - DNA, 25 bp, Homo sapien
cgggcgagcaaaccccaaatactca

SEQ ID NO: 203502 - DNA, 25 bp, Homo sapien
agcccgctgtcacgggcgagcaaac

SEQ ID NO: 203503 - DNA, 25 bp, Homo sapien
taatccgatagccaacagccaagcg

SEQ ID NO: 203504 - DNA, 25 bp, Homo sapien
tgcaaagcagccgaaatgcaaagtc

SEQ ID NO: 203505 - DNA, 25 bp, Homo sapien
agccgaaatgcaaagtcgcagtccc

SEQ ID NO: 203506 - DNA, 25 bp, Homo sapien
agtccggtcgcagtgcaacttcatc

SEQ ID NO: 203507 - DNA, 25 bp, Homo sapien
catattgtctgcatggggcccaggc

SEQ ID NO: 203508 - DNA, 25 bp, Homo sapien
cgctgcaatgagagatggcctgaaa

SEQ ID NO: 203509 - DNA, 25 bp, Homo sapien
cagaaggccgtttcctgaagtggtc

SEQ ID NO: 203510 - DNA, 25 bp, Homo sapien
gccctcctgaatcctggtagaaatg

SEQ ID NO: 203511 - DNA, 25 bp, Homo sapien
ctttggacacttccggagccgagtc

SEQ ID NO: 203512 - DNA, 25 bp, Homo sapien
gtagccagaaacaacccgctccagg

SEQ ID NO: 203513 - DNA, 25 bp, Homo sapien
tacgggaagataacccaggtgtgcc

SEQ ID NO: 203514 - DNA, 25 bp, Homo sapien
gccgcggctgcacaagaactcatgc

SEQ ID NO: 203515 - DNA, 25 bp, Homo sapien
gcagaaagggctccaaatccgatcc

SEQ ID NO: 203516 - DNA, 25 bp, Homo sapien
tggcgcccaagaacctcggcagaaa

SEQ ID NO: 203517 - DNA, 25 bp, Homo sapien
gctcccagttgcaccgaattgcgtc

SEQ ID NO: 203518 - DNA, 25 bp, Homo sapien
gaactcatgcaaatcccggacgtca

SEQ ID NO: 203519 - DNA, 25 bp, Homo sapien
ggctcgcgctcgctcagacaactga

SEQ ID NO: 203520 - DNA, 25 bp, Homo sapien
ttctcgatgctctccaccgcgaaga

SEQ ID NO: 203521 - DNA, 25 bp, Homo sapien
tcgcggcacgttctcagtgttcacg

SEQ ID NO: 203522 - DNA, 25 bp, Homo sapien
tcggtgcagcggatcttttctgttg

SEQ ID NO: 203523 - DNA, 25 bp, Homo sapien
agcaattgacttcccttccgtggtt

SEQ ID NO: 203524 - DNA, 25 bp, Homo sapien
ggagccgcaggagaaactagcccta

SEQ ID NO: 203525 - DNA, 25 bp, Homo sapien
ctgggattcccagagccttctgctg

SEQ ID NO: 203526 - DNA, 25 bp, Homo sapien
ggccgctggcctgcttatttgatac

SEQ ID NO: 203527 - DNA, 25 bp, Homo sapien
ttccagacgccacctcggtttgggc

SEQ ID NO: 203528 - DNA, 25 bp, Homo sapien
ctactaagtgttcggtctgggaaga

SEQ ID NO: 203529 - DNA, 25 bp, Homo sapien
tgctatctagctcagccacaggctc

SEQ ID NO: 203530 - DNA, 25 bp, Homo sapien
cgtccttgaggacgggtctgcgcat

SEQ ID NO: 203531 - DNA, 25 bp, Homo sapien
tctgtggcctgccaccagagcagcg

SEQ ID NO: 203532 - DNA, 25 bp, Homo sapien
cccgcctgagcctgtttatcattta

SEQ ID NO: 203533 - DNA, 25 bp, Homo sapien
gtggataccatgctctggcagctga

SEQ ID NO: 203534 - DNA, 25 bp, Homo sapien
ctgcgcatgtgcttctcgcggggct

SEQ ID NO: 203535 - DNA, 25 bp, Homo sapien
ccgtcagctgctcggtgagatgtga

SEQ ID NO: 203536 - DNA, 25 bp, Homo sapien
tgcccgtccacgctttggttacagg

SEQ ID NO: 203537 - DNA, 25 bp, Homo sapien
tacaggcagtgaagccgctgatgtc

SEQ ID NO: 203538 - DNA, 25 bp, Homo sapien
tcagcactggtcacggccactttta

SEQ ID NO: 203539 - DNA, 25 bp, Homo sapien
tatttgctgagcatccaggaggccc

SEQ ID NO: 203540 - DNA, 25 bp, Homo sapien
gcgacgttccttcattcaggcaata

SEQ ID NO: 203541 - DNA, 25 bp, Homo sapien
gccgagatcgcttatcagcccatca

SEQ ID NO: 203542 - DNA, 25 bp, Homo sapien
gtctgtattcgtgcgacgttccttc

SEQ ID NO: 203543 - DNA, 25 bp, Homo sapien
ctgtgttctctcgtgtgtctgtatt

SEQ ID NO: 203544 - DNA, 25 bp, Homo sapien
acggccacttttatggtctgtgttc

SEQ ID NO: 203545 - DNA, 25 bp, Homo sapien
ttatcatccagcaaacaccgcgagg

SEQ ID NO: 203546 - DNA, 25 bp, Homo sapien
ggcgccttcatcaggaccgcacgaa

SEQ ID NO: 203547 - DNA, 25 bp, Homo sapien
ttctgcgtctcggaaaacgcggcgc

SEQ ID NO: 203548 - DNA, 25 bp, Homo sapien
gcgaggtccctttgtgcccaaatgc

SEQ ID NO: 203549 - DNA, 25 bp, Homo sapien
gattattttgaggacgcgaggtccc

SEQ ID NO: 203550 - DNA, 25 bp, Homo sapien
ggaattagcggcgaggattattttg

SEQ ID NO: 203551 - DNA, 25 bp, Homo sapien
ggcctcttcctgctggaatgggaat

SEQ ID NO: 203552 - DNA, 25 bp, Homo sapien
cagaaccgcacgcagcggctcggag

SEQ ID NO: 203553 - DNA, 25 bp, Homo sapien
cgcccgctggggtgaaatcaaaaga

SEQ ID NO: 203554 - DNA, 25 bp, Homo sapien
ggcatggagccgctgtcccacatgc

SEQ ID NO: 203555 - DNA, 25 bp, Homo sapien
cggtgcactccaccgcgggcatgga

SEQ ID NO: 203556 - DNA, 25 bp, Homo sapien
tagggacagctctccgagccgggat

SEQ ID NO: 203557 - DNA, 25 bp, Homo sapien
cctgcggcgtctttgggcccttctt

SEQ ID NO: 203558 - DNA, 25 bp, Homo sapien
ttacacagatcgtgcaggctgcagg

SEQ ID NO: 203559 - DNA, 25 bp, Homo sapien
agccgaagccgtcctgcggcgtctt

SEQ ID NO: 203560 - DNA, 25 bp, Homo sapien
gcccgacctatctgcggaagccgaa

SEQ ID NO: 203561 - DNA, 25 bp, Homo sapien
acccgcacagcttacacagatcgtg

SEQ ID NO: 203562 - DNA, 25 bp, Homo sapien
gatccgccagagcactaaggactcc

SEQ ID NO: 203563 - DNA, 25 bp, Homo sapien
ggcggcatgttcttcctcgccactg

SEQ ID NO: 203564 - DNA, 25 bp, Homo sapien
tgagcctgggctacgcgctcatgct

SEQ ID NO: 203565 - DNA, 25 bp, Homo sapien
tcatgctctgccctttcgtcgtggt

SEQ ID NO: 203566 - DNA, 25 bp, Homo sapien
aaatcctcgcagatctcagacctga

SEQ ID NO: 203567 - DNA, 25 bp, Homo sapien
acctcattggctttgtgagtagccc

SEQ ID NO: 203568 - DNA, 25 bp, Homo sapien
gcctgttccgcagtacgtggtcatc

SEQ ID NO: 203569 - DNA, 25 bp, Homo sapien
ggccaagcgcgtgagcctttctcct

SEQ ID NO: 203570 - DNA, 25 bp, Homo sapien
tgacgtcgaccacacaaaccagacg

SEQ ID NO: 203571 - DNA, 25 bp, Homo sapien
cactgggaagtccatgtttagtctc

SEQ ID NO: 203572 - DNA, 25 bp, Homo sapien
gcctgccagcaacgcgctgtgtgca

SEQ ID NO: 203573 - DNA, 25 bp, Homo sapien
aggtcctgacggctgcatcctgtgt

SEQ ID NO: 203574 - DNA, 25 bp, Homo sapien
agacacgccacctttgatgcacacg

SEQ ID NO: 203575 - DNA, 25 bp, Homo sapien
atgcacacgcgcttccggaggcaca

SEQ ID NO: 203576 - DNA, 25 bp, Homo sapien
cacacaaaccagacggaacggtgtc

SEQ ID NO: 203577 - DNA, 25 bp, Homo sapien
gtttagtctcctgacgtcgaccaca

SEQ ID NO: 203578 - DNA, 25 bp, Homo sapien
ggcgcatttttcattgctggctgca

SEQ ID NO: 203579 - DNA, 25 bp, Homo sapien
ccagagtctcgggaaaaggcgcatt

SEQ ID NO: 203580 - DNA, 25 bp, Homo sapien
cataaatcaccagcgccagagtctc

SEQ ID NO: 203581 - DNA, 25 bp, Homo sapien
ggcgagcaccgttcccacataaatc

SEQ ID NO: 203582 - DNA, 25 bp, Homo sapien
ttaccgcgataaagcgctgggcttc

SEQ ID NO: 203583 - DNA, 25 bp, Homo sapien
cgaaatctccgtgttaatggaccta

SEQ ID NO: 203584 - DNA, 25 bp, Homo sapien
gcggtctatttacaacgccgaaatc

SEQ ID NO: 203585 - DNA, 25 bp, Homo sapien
ggcgactccagaccgcgaacgagaa

SEQ ID NO: 203586 - DNA, 25 bp, Homo sapien
acgcgctgagttcacgggtaacatc

SEQ ID NO: 203587 - DNA, 25 bp, Homo sapien
taccggcactcggtggcttcagact

SEQ ID NO: 203588 - DNA, 25 bp, Homo sapien
ggcggcaaatctgccactgggaaaa

SEQ ID NO: 203589 - DNA, 25 bp, Homo sapien
tccatgccgtgcttcccttcgttaa

SEQ ID NO: 203590 - DNA, 25 bp, Homo sapien
ccttcgttaatgcagatcgtccacc

SEQ ID NO: 203591 - DNA, 25 bp, Homo sapien
tgagccaggagggaaacctagaccc

SEQ ID NO: 203592 - DNA, 25 bp, Homo sapien
tgggaatgaagcctctcagaccgtc

SEQ ID NO: 203593 - DNA, 25 bp, Homo sapien
ggcgagccgatgaccgcatgcaaag

SEQ ID NO: 203594 - DNA, 25 bp, Homo sapien
cacccagaggcatcgtgtggcgcac

SEQ ID NO: 203595 - DNA, 25 bp, Homo sapien
ccagaacgctctgtgctcctcggga

SEQ ID NO: 203596 - DNA, 25 bp, Homo sapien
tgtggcgcacacactgcaggaagcc

SEQ ID NO: 203597 - DNA, 25 bp, Homo sapien
agcctgtgtggagccgagcacccag

SEQ ID NO: 203598 - DNA, 25 bp, Homo sapien
ctcctcgggagtcatggagagcctg

SEQ ID NO: 203599 - DNA, 25 bp, Homo sapien
gatctgtccggaccacgtctttgtc

SEQ ID NO: 203600 - DNA, 25 bp, Homo sapien
acgtctttgtccacagtgaactgca

SEQ ID NO: 203601 - DNA, 25 bp, Homo sapien
tgaactgcacattacgccagaacgc

SEQ ID NO: 203602 - DNA, 25 bp, Homo sapien
catgcatgtcttatcgggggcgacc

SEQ ID NO: 203603 - DNA, 25 bp, Homo sapien
cgacctgctggacgggaggaaaact

SEQ ID NO: 203604 - DNA, 25 bp, Homo sapien
aaaactgggcaaaggtcaggatctc

SEQ ID NO: 203605 - DNA, 25 bp, Homo sapien
gcggatggagaactgcatgcatgtc

SEQ ID NO: 203606 - DNA, 25 bp, Homo sapien
ctcttgtacatgctctcctcggggt

SEQ ID NO: 203607 - DNA, 25 bp, Homo sapien
caaaggtcaggatctcagccgcgcg

SEQ ID NO: 203608 - DNA, 25 bp, Homo sapien
ctggcccagctcattcaggtggttg

SEQ ID NO: 203609 - DNA, 25 bp, Homo sapien
cggagacgccgagcctcttgtacat

SEQ ID NO: 203610 - DNA, 25 bp, Homo sapien
tcaggttgattaccagcacggttta

SEQ ID NO: 203611 - DNA, 25 bp, Homo sapien
cggattctgccatcccaggcctaga

SEQ ID NO: 203612 - DNA, 25 bp, Homo sapien
gcatgcaccgagacagcctggcttt

SEQ ID NO: 203613 - DNA, 25 bp, Homo sapien
ctggcttttccagccagagggactg

SEQ ID NO: 203614 - DNA, 25 bp, Homo sapien
agggtctccgctccggcgattaact

SEQ ID NO: 203615 - DNA, 25 bp, Homo sapien
tctgcaacatcacggctaattaggg

SEQ ID NO: 203616 - DNA, 25 bp, Homo sapien
cgggcaggcacatccttcaggttga

SEQ ID NO: 203617 - DNA, 25 bp, Homo sapien
ggcgattaactctgccgatctgcaa

SEQ ID NO: 203618 - DNA, 25 bp, Homo sapien
actcctccaagggcgcgccagggaa

SEQ ID NO: 203619 - DNA, 25 bp, Homo sapien
agcagacccacatccgtccctgcag

SEQ ID NO: 203620 - DNA, 25 bp, Homo sapien
ctgaacctgccacgggcacgaagca

SEQ ID NO: 203621 - DNA, 25 bp, Homo sapien
cataacgctgaacctgccacgggca

SEQ ID NO: 203622 - DNA, 25 bp, Homo sapien
tgctcactgcacataacgctgaacc

SEQ ID NO: 203623 - DNA, 25 bp, Homo sapien
tctcagcaagaacgtgctcactgca

SEQ ID NO: 203624 - DNA, 25 bp, Homo sapien
cggctcttctgtaatctcagcaaga

SEQ ID NO: 203625 - DNA, 25 bp, Homo sapien
tccctcggctcttctgtaatctcag

SEQ ID NO: 203626 - DNA, 25 bp, Homo sapien
tctgcgtctcctagaaggggaaacc

SEQ ID NO: 203627 - DNA, 25 bp, Homo sapien
tggccgttggaaaggtgaacacacg

SEQ ID NO: 203628 - DNA, 25 bp, Homo sapien
atgtcctgcgtacaagcctgtcccg

SEQ ID NO: 203629 - DNA, 25 bp, Homo sapien
tggaccctacaaagacgcctctctg

SEQ ID NO: 203630 - DNA, 25 bp, Homo sapien
acaatgcgtcctttcacccggggtg

SEQ ID NO: 203631 - DNA, 25 bp, Homo sapien
tttcaaccgctgtcaggaaactgtg

SEQ ID NO: 203632 - DNA, 25 bp, Homo sapien
aactgtgtggacgaggaatccctgc

SEQ ID NO: 203633 - DNA, 25 bp, Homo sapien
ggtatccttgcacccgatgtcactt

SEQ ID NO: 203634 - DNA, 25 bp, Homo sapien
tgggccaccaccaggatgtcctcat

SEQ ID NO: 203635 - DNA, 25 bp, Homo sapien
ctgagtctgagtcaaaggagctgtc

SEQ ID NO: 203636 - DNA, 25 bp, Homo sapien
cgagcatgcggtctggaacactctg

SEQ ID NO: 203637 - DNA, 25 bp, Homo sapien
tgaccgtcgacaagatcccggaggg

SEQ ID NO: 203638 - DNA, 25 bp, Homo sapien
tgacatcctgcggactgaccgtcga

SEQ ID NO: 203639 - DNA, 25 bp, Homo sapien
tgacagttccaaagagccatcctcc

SEQ ID NO: 203640 - DNA, 25 bp, Homo sapien
cgccctcggctgacagttccaaaga

SEQ ID NO: 203641 - DNA, 25 bp, Homo sapien
aaaggagctgtctctgctcacgccc

SEQ ID NO: 203642 - DNA, 25 bp, Homo sapien
ctccaggacgaggttggaggaccaa

SEQ ID NO: 203643 - DNA, 25 bp, Homo sapien
tggctttccgcgacaaagcgcagct

SEQ ID NO: 203644 - DNA, 25 bp, Homo sapien
cggcttttggctttccgcgacaaag

SEQ ID NO: 203645 - DNA, 25 bp, Homo sapien
agcagaagcggcttttggctttccg

SEQ ID NO: 203646 - DNA, 25 bp, Homo sapien
ctcgccggccggctaagcagaagcg

SEQ ID NO: 203647 - DNA, 25 bp, Homo sapien
cagaaggtaaggacgcagccctcgg

SEQ ID NO: 203648 - DNA, 25 bp, Homo sapien
accaagcgcagaaggtaaggacgca

SEQ ID NO: 203649 - DNA, 25 bp, Homo sapien
cgatcctgtcagaagagcgggagga

SEQ ID NO: 203650 - DNA, 25 bp, Homo sapien
tctgcgtgcgtggagatggcacaaa

SEQ ID NO: 203651 - DNA, 25 bp, Homo sapien
cagcgtcgcctagcaacgggaaatg

SEQ ID NO: 203652 - DNA, 25 bp, Homo sapien
tacagtctaagggacgacacgtcga

SEQ ID NO: 203653 - DNA, 25 bp, Homo sapien
gcatggtcgtgctctaatcattaca

SEQ ID NO: 203654 - DNA, 25 bp, Homo sapien
cgccgctgtcgctttacagaaattg

SEQ ID NO: 203655 - DNA, 25 bp, Homo sapien
ggcgtccatgcaaggagtctccgta

SEQ ID NO: 203656 - DNA, 25 bp, Homo sapien
ttcggactaggaagggaagatacgc

SEQ ID NO: 203657 - DNA, 25 bp, Homo sapien
gccctctgcagggagatttctccta

SEQ ID NO: 203658 - DNA, 25 bp, Homo sapien
ggcatttccgccgtagctctgagcg

SEQ ID NO: 203659 - DNA, 25 bp, Homo sapien
tctaagggcccatctcggaaacaaa

SEQ ID NO: 203660 - DNA, 25 bp, Homo sapien
ccgagtcccgtgattagacgcttca

SEQ ID NO: 203661 - DNA, 25 bp, Homo sapien
gcttcagggcatatttcatctcgga

SEQ ID NO: 203662 - DNA, 25 bp, Homo sapien
accctcgtgttcaatggtgacaaca

SEQ ID NO: 203663 - DNA, 25 bp, Homo sapien
cgcgactgtgcttcaataggccata

SEQ ID NO: 203664 - DNA, 25 bp, Homo sapien
cccagagttaaaagagcggcatttc

SEQ ID NO: 203665 - DNA, 25 bp, Homo sapien
taggtgtagcacttcgatccgactc

SEQ ID NO: 203666 - DNA, 25 bp, Homo sapien
ccgaagcagtaagcaggccgtcacc

SEQ ID NO: 203667 - DNA, 25 bp, Homo sapien
tgaggttcttgtcccggccaaaatc

SEQ ID NO: 203668 - DNA, 25 bp, Homo sapien
gccacgcatccgtcaggtgaatctg

SEQ ID NO: 203669 - DNA, 25 bp, Homo sapien
ccaaggtttccaattgcggctgaca

SEQ ID NO: 203670 - DNA, 25 bp, Homo sapien
cgagtttggtatccgcctagagaga

SEQ ID NO: 203671 - DNA, 25 bp, Homo sapien
agctcccggtcttgtttacttgttg

SEQ ID NO: 203672 - DNA, 25 bp, Homo sapien
gccgtcaccgactgcgaggaaatca

SEQ ID NO: 203673 - DNA, 25 bp, Homo sapien
gcggccgcagctcgcattaacgtaa

SEQ ID NO: 203674 - DNA, 25 bp, Homo sapien
aaaaggggctcagctttgcctcctg

SEQ ID NO: 203675 - DNA, 25 bp, Homo sapien
ccagaccgtggagcttcaaaaaggg

SEQ ID NO: 203676 - DNA, 25 bp, Homo sapien
cagactgagatggagaacttggccc

SEQ ID NO: 203677 - DNA, 25 bp, Homo sapien
cttggccctgcatctcttctacatg

SEQ ID NO: 203678 - DNA, 25 bp, Homo sapien
cgaccaggacatgcgtgacgacatc

SEQ ID NO: 203679 - DNA, 25 bp, Homo sapien
catccgcgtgatgacacaagtggta

SEQ ID NO: 203680 - DNA, 25 bp, Homo sapien
ggtattctgcaaactcgacacatgt

SEQ ID NO: 203681 - DNA, 25 bp, Homo sapien
tgtttaatgatcaccagaccgtgga

SEQ ID NO: 203682 - DNA, 25 bp, Homo sapien
gagatcgacgccatcagcgtggaga

SEQ ID NO: 203683 - DNA, 25 bp, Homo sapien
gtccaccggatctctgggacagagg

SEQ ID NO: 203684 - DNA, 25 bp, Homo sapien
tctctctgggtccaccggatctctg

SEQ ID NO: 203685 - DNA, 25 bp, Homo sapien
atgaagcaccgcgacgaggcgcaca

SEQ ID NO: 203686 - DNA, 25 bp, Homo sapien
cagcagcctggtgggcatgaagcac

SEQ ID NO: 203687 - DNA, 25 bp, Homo sapien
atcatgcagcaatgggccagcagcc

SEQ ID NO: 203688 - DNA, 25 bp, Homo sapien
catcagcgtggagaagaggcgcatc

SEQ ID NO: 203689 - DNA, 25 bp, Homo sapien
tgggacagagggtgcaccttgatcc

SEQ ID NO: 203690 - DNA, 25 bp, Homo sapien
gcctttggccgcctttccgatgatg

SEQ ID NO: 203691 - DNA, 25 bp, Homo sapien
tcccagaagcgggtttgaacgtgcc

SEQ ID NO: 203692 - DNA, 25 bp, Homo sapien
tccgatgatgccctcgggacgcgtt

SEQ ID NO: 203693 - DNA, 25 bp, Homo sapien
aggacagtgacctcggtgacgcgaa

SEQ ID NO: 203694 - DNA, 25 bp, Homo sapien
ctcgtccgcccgttgttcagcgagg

SEQ ID NO: 203695 - DNA, 25 bp, Homo sapien
cgggtgagacacctgacgtctgccc

SEQ ID NO: 203696 - DNA, 25 bp, Homo sapien
gcggcctctcagttgggaaagctga

SEQ ID NO: 203697 - DNA, 25 bp, Homo sapien
ctgccggcggtaacatcccagaagc

SEQ ID NO: 203698 - DNA, 25 bp, Homo sapien
atgtttgtttctcacacggcgggga

SEQ ID NO: 203699 - DNA, 25 bp, Homo sapien
ggcgacgcgcatttctcacacggca

SEQ ID NO: 203700 - DNA, 25 bp, Homo sapien
cgctacgaggtgcccttggagaccc

SEQ ID NO: 203701 - DNA, 25 bp, Homo sapien
acgcgcatttctcacacggcaggga

SEQ ID NO: 203702 - DNA, 25 bp, Homo sapien
gggccacacgcgtttgtttctcaca

SEQ ID NO: 203703 - DNA, 25 bp, Homo sapien
cgcgtttgtttctcacacgatgggc

SEQ ID NO: 203704 - DNA, 25 bp, Homo sapien
gcagggcgacacatgtttgtttctc

SEQ ID NO: 203705 - DNA, 25 bp, Homo sapien
ttgtttctcacacgatgggcagggc

SEQ ID NO: 203706 - DNA, 25 bp, Homo sapien
ggggtgttcctgctaaacagcaatg

SEQ ID NO: 203707 - DNA, 25 bp, Homo sapien
accctttctacctggcgctggagga

SEQ ID NO: 203708 - DNA, 25 bp, Homo sapien
cggtgcgaacctctacgggtctcac

SEQ ID NO: 203709 - DNA, 25 bp, Homo sapien
tgctgaagcgccgtctcctgcatgt

SEQ ID NO: 203710 - DNA, 25 bp, Homo sapien
caatgccatgggtaagctgcccgcc

SEQ ID NO: 203711 - DNA, 25 bp, Homo sapien
atcaccctgtggaaccgggaccttg

SEQ ID NO: 203712 - DNA, 25 bp, Homo sapien
cgcagtatatcacaggcctcgccga

SEQ ID NO: 203713 - DNA, 25 bp, Homo sapien
ttgcggaccagttccttcagctgtc

SEQ ID NO: 203714 - DNA, 25 bp, Homo sapien
tacatgatgatcgtggtgtgtgccc

SEQ ID NO: 203715 - DNA, 25 bp, Homo sapien
agtggaacgacctggactacatgga

SEQ ID NO: 203716 - DNA, 25 bp, Homo sapien
tctctgtgcagcgtcatcctcgtgc

SEQ ID NO: 203717 - DNA, 25 bp, Homo sapien
actacatggactcccggagggactt

SEQ ID NO: 203718 - DNA, 25 bp, Homo sapien
acttcccggccatggtgcaggagct

SEQ ID NO: 203719 - DNA, 25 bp, Homo sapien
caaggatggcttccgggacttcccg

SEQ ID NO: 203720 - DNA, 25 bp, Homo sapien
cccacactgtgggtctttgggaagg

SEQ ID NO: 203721 - DNA, 25 bp, Homo sapien
ggagggacttcacgttcaacaagga

SEQ ID NO: 203722 - DNA, 25 bp, Homo sapien
ggtctcgaattccactttagtcatg

SEQ ID NO: 203723 - DNA, 25 bp, Homo sapien
agtaaggtgtttctgctctcgcgcc

SEQ ID NO: 203724 - DNA, 25 bp, Homo sapien
ctcttcgtcacgtgaaagggaactg

SEQ ID NO: 203725 - DNA, 25 bp, Homo sapien
ctgccgagaacagacgccttaagta

SEQ ID NO: 203726 - DNA, 25 bp, Homo sapien
ccgtggtcgccatgattcagagtcc

SEQ ID NO: 203727 - DNA, 25 bp, Homo sapien
cgccatatgcagttcccgcgggatc

SEQ ID NO: 203728 - DNA, 25 bp, Homo sapien
agtcatgtcttcctctttgagcagc

SEQ ID NO: 203729 - DNA, 25 bp, Homo sapien
cgcccgctcaccgtaagcgtagatg

SEQ ID NO: 203730 - DNA, 25 bp, Homo sapien
agagccaccgccacaggatcgtacg

SEQ ID NO: 203731 - DNA, 25 bp, Homo sapien
acggcactggacgaggagacactgt

SEQ ID NO: 203732 - DNA, 25 bp, Homo sapien
gagatgatggagagccaccgccaca

SEQ ID NO: 203733 - DNA, 25 bp, Homo sapien
accaacagcgccatgcgggccggtg

SEQ ID NO: 203734 - DNA, 25 bp, Homo sapien
gccacaggatcgtacgctgcatctg

SEQ ID NO: 203735 - DNA, 25 bp, Homo sapien
ccaaggtgctgtgccagctggacga

SEQ ID NO: 203736 - DNA, 25 bp, Homo sapien
cacaggatcgtacgctgcatctgcc

SEQ ID NO: 203737 - DNA, 25 bp, Homo sapien
ctcacggcactggacgaggagacac

SEQ ID NO: 203738 - DNA, 25 bp, Homo sapien
agcgcacacttccatgaggtgctga

SEQ ID NO: 203739 - DNA, 25 bp, Homo sapien
cacagccgcatgaagcgtgaggtta

SEQ ID NO: 203740 - DNA, 25 bp, Homo sapien
gaggttagcgcacacttccatgagg

SEQ ID NO: 203741 - DNA, 25 bp, Homo sapien
aaggacgagatgctcagcctctcgc

SEQ ID NO: 203742 - DNA, 25 bp, Homo sapien
agcctctcgctgcactatagcaatg

SEQ ID NO: 203743 - DNA, 25 bp, Homo sapien
tcgctgcactatagcaatgcgctgc

SEQ ID NO: 203744 - DNA, 25 bp, Homo sapien
atagcaatgcgctgcaggagaagga

SEQ ID NO: 203745 - DNA, 25 bp, Homo sapien
agcgtgaggttagcgcacacttcca

SEQ ID NO: 203746 - DNA, 25 bp, Homo sapien
tgtggtgagtgttcccggctgaccc

SEQ ID NO: 203747 - DNA, 25 bp, Homo sapien
tggcccacaggcgtactccgcgagg

SEQ ID NO: 203748 - DNA, 25 bp, Homo sapien
acagtgctcagagggagatttccca

SEQ ID NO: 203749 - DNA, 25 bp, Homo sapien
tggagaaggactccctccgcaggca

SEQ ID NO: 203750 - DNA, 25 bp, Homo sapien
ccctccgcaggcaggtgttcgagct

SEQ ID NO: 203751 - DNA, 25 bp, Homo sapien
accaggtctgcgagctgcgcacaca

SEQ ID NO: 203752 - DNA, 25 bp, Homo sapien
gtgttcgagctgacggaccaggtct

SEQ ID NO: 203753 - DNA, 25 bp, Homo sapien
tactccgcgagggacagtgctcaga

SEQ ID NO: 203754 - DNA, 25 bp, Homo sapien
cgaggcctccgggacaataggtcaa

SEQ ID NO: 203755 - DNA, 25 bp, Homo sapien
ccagcccacccaggcgtggagcgga

SEQ ID NO: 203756 - DNA, 25 bp, Homo sapien
cctccgggacaataggtcaaccctg

SEQ ID NO: 203757 - DNA, 25 bp, Homo sapien
cgggacaataggtcaaccctgcggg

SEQ ID NO: 203758 - DNA, 25 bp, Homo sapien
cgtggagtcatggttcccggagtct

SEQ ID NO: 203759 - DNA, 25 bp, Homo sapien
ggggcaggacgttgtctccagccca

SEQ ID NO: 203760 - DNA, 25 bp, Homo sapien
tcggggttgcagataccgcccagga

SEQ ID NO: 203761 - DNA, 25 bp, Homo sapien
gcgtcggggttgcagataccgccca

SEQ ID NO: 203762 - DNA, 25 bp, Homo sapien
aagccagccacggacggccagtcgc

SEQ ID NO: 203763 - DNA, 25 bp, Homo sapien
ggagctgcggagctcggatcttctc

SEQ ID NO: 203764 - DNA, 25 bp, Homo sapien
tggccgacctgcagcgggacaacca

SEQ ID NO: 203765 - DNA, 25 bp, Homo sapien
agctcgagcgcctgacgcgccaggt

SEQ ID NO: 203766 - DNA, 25 bp, Homo sapien
ttcaccggccgctcggactaggtga

SEQ ID NO: 203767 - DNA, 25 bp, Homo sapien
agagtcccgagcgaacgcgtcagcc

SEQ ID NO: 203768 - DNA, 25 bp, Homo sapien
gtgggagctgtaggtgtccccatta

SEQ ID NO: 203769 - DNA, 25 bp, Homo sapien
gcgtcagcccgggtgtgctctctac

SEQ ID NO: 203770 - DNA, 25 bp, Homo sapien
gcccgcaggatcctgagccaggtca

SEQ ID NO: 203771 - DNA, 25 bp, Homo sapien
gcccgggcacccagattgtgatggt

SEQ ID NO: 203772 - DNA, 25 bp, Homo sapien
gaccagatggccttgcgcccgggca

SEQ ID NO: 203773 - DNA, 25 bp, Homo sapien
gcgggaacctcacgggcatcttcat

SEQ ID NO: 203774 - DNA, 25 bp, Homo sapien
agcagatcagcgtcatcggcgggaa

SEQ ID NO: 203775 - DNA, 25 bp, Homo sapien
ggatgcattgctggagcagatcagc

SEQ ID NO: 203776 - DNA, 25 bp, Homo sapien
ccaggtcaccatgctggcgttccag

SEQ ID NO: 203777 - DNA, 25 bp, Homo sapien
cccagattgtgatggtgagccgtgc

SEQ ID NO: 203778 - DNA, 25 bp, Homo sapien
atgacggaggtccttgtaccagccc

SEQ ID NO: 203779 - DNA, 25 bp, Homo sapien
cagctggtcccgaagcatctccaga

SEQ ID NO: 203780 - DNA, 25 bp, Homo sapien
ctggggtacgggatcgagaaccaat

SEQ ID NO: 203781 - DNA, 25 bp, Homo sapien
aggtggatggtcttcgagccaaaga

SEQ ID NO: 203782 - DNA, 25 bp, Homo sapien
catcttgaagttgaggttgtgcacg

SEQ ID NO: 203783 - DNA, 25 bp, Homo sapien
cagcgcgcccggtagtagtaatgac

SEQ ID NO: 203784 - DNA, 25 bp, Homo sapien
cttctccaatccaatcagcagcggg

SEQ ID NO: 203785 - DNA, 25 bp, Homo sapien
atctccagaagctgagcaaagcgcg

SEQ ID NO: 203786 - DNA, 25 bp, Homo sapien
cctggaggacggagccattctcctc

SEQ ID NO: 203787 - DNA, 25 bp, Homo sapien
ctcctccgtgtacgcaaagtcaaac

SEQ ID NO: 203788 - DNA, 25 bp, Homo sapien
agcagcttaattctagtgatgttcc

SEQ ID NO: 203789 - DNA, 25 bp, Homo sapien
caggaatttccggacgagcagctta

SEQ ID NO: 203790 - DNA, 25 bp, Homo sapien
ctcataccggtcatcctgagtctgc

SEQ ID NO: 203791 - DNA, 25 bp, Homo sapien
cgccggaagactccgggctgtgctc

SEQ ID NO: 203792 - DNA, 25 bp, Homo sapien
ggggcccatgcatcccgccggaaga

SEQ ID NO: 203793 - DNA, 25 bp, Homo sapien
tgcttcttcccgatgatgcctgggc

SEQ ID NO: 203794 - DNA, 25 bp, Homo sapien
tcccattctgatgctgccagcaaag

SEQ ID NO: 203795 - DNA, 25 bp, Homo sapien
gcacaccagcttggctgagcagcag

SEQ ID NO: 203796 - DNA, 25 bp, Homo sapien
agcagcggcaggctccgcaccttgt

SEQ ID NO: 203797 - DNA, 25 bp, Homo sapien
gcaccttgtcgaaggagttgaagtg

SEQ ID NO: 203798 - DNA, 25 bp, Homo sapien
aaggagttgaagtggtgcacgtcct

SEQ ID NO: 203799 - DNA, 25 bp, Homo sapien
tgcacgtcctggtgcagcccgtaca

SEQ ID NO: 203800 - DNA, 25 bp, Homo sapien
ggtgcagcccgtacatcccattctg

SEQ ID NO: 203801 - DNA, 25 bp, Homo sapien
acctgtgcgcacaccagcttggctg

SEQ ID NO: 203802 - DNA, 25 bp, Homo sapien
ctggaagatgctgcgcacctgaatt

SEQ ID NO: 203803 - DNA, 25 bp, Homo sapien
cccaagctgcatcgccgagtgggtg

SEQ ID NO: 203804 - DNA, 25 bp, Homo sapien
cacctgaattaaccgggcgcctctg

SEQ ID NO: 203805 - DNA, 25 bp, Homo sapien
gggcgcctctgatgtcctcccagaa

SEQ ID NO: 203806 - DNA, 25 bp, Homo sapien
gtcctcccagaagcaactagaactc

SEQ ID NO: 203807 - DNA, 25 bp, Homo sapien
agcgccgcagtccaccgtagcgggt

SEQ ID NO: 203808 - DNA, 25 bp, Homo sapien
cgccttggtgcgcagttggaaaacc

SEQ ID NO: 203809 - DNA, 25 bp, Homo sapien
tgcgcagttggaaaacctcggagcc

SEQ ID NO: 203810 - DNA, 25 bp, Homo sapien
gaattccgcacacgcctgcgcgggg

SEQ ID NO: 203811 - DNA, 25 bp, Homo sapien
tcccgcgtctgtacccggcgcgcag

SEQ ID NO: 203812 - DNA, 25 bp, Homo sapien
cttcctgccggctccaagtttcggt

SEQ ID NO: 203813 - DNA, 25 bp, Homo sapien
tcttcctgccggctccaagtttcgg

SEQ ID NO: 203814 - DNA, 25 bp, Homo sapien
agcgggcctggagagtctcccgggg

SEQ ID NO: 203815 - DNA, 25 bp, Homo sapien
ggggaattccgcacacgcctgcgcg

SEQ ID NO: 203816 - DNA, 25 bp, Homo sapien
ggtgtagtggaaggggacagccgga

SEQ ID NO: 203817 - DNA, 25 bp, Homo sapien
gagcgggctaggatacagtgggccc

SEQ ID NO: 203818 - DNA, 25 bp, Homo sapien
ttccgcctgattgtcattgaagaga

SEQ ID NO: 203819 - DNA, 25 bp, Homo sapien
accggctggagaagcactatctgga

SEQ ID NO: 203820 - DNA, 25 bp, Homo sapien
atcaacacggtgctggagaaatggc

SEQ ID NO: 203821 - DNA, 25 bp, Homo sapien
tgacgtcttcatcggctaccactcg

SEQ ID NO: 203822 - DNA, 25 bp, Homo sapien
gggccttgacggaggaacttcacca

SEQ ID NO: 203823 - DNA, 25 bp, Homo sapien
tctgaggaggccaaatcgatcctgc

SEQ ID NO: 203824 - DNA, 25 bp, Homo sapien
tcgatcctgctgaactgcgctacgc

SEQ ID NO: 203825 - DNA, 25 bp, Homo sapien
cccaccgcgtcaaatgtcgggttca

SEQ ID NO: 203826 - DNA, 25 bp, Homo sapien
cgccctgtgctgtttgctgcattga

SEQ ID NO: 203827 - DNA, 25 bp, Homo sapien
ccgtgggcatgctcagagaccagaa

SEQ ID NO: 203828 - DNA, 25 bp, Homo sapien
aacgagagctgcacgcgcaatatgc

SEQ ID NO: 203829 - DNA, 25 bp, Homo sapien
ccaggctgctgagaagctgtgtgca

SEQ ID NO: 203830 - DNA, 25 bp, Homo sapien
accctcatcgcatacgggcggtttg

SEQ ID NO: 203831 - DNA, 25 bp, Homo sapien
ggcgtctcttctttgtccgtgagga

SEQ ID NO: 203832 - DNA, 25 bp, Homo sapien
ctcttgaatgaggatgacgcgtgcc

SEQ ID NO: 203833 - DNA, 25 bp, Homo sapien
cggtttggcttttgcccactgtgtc

SEQ ID NO: 203834 - DNA, 25 bp, Homo sapien
gggcgttgacgtgtccttcgtgaaa

SEQ ID NO: 203835 - DNA, 25 bp, Homo sapien
cggagggatctcaggaattgtagtc

SEQ ID NO: 203836 - DNA, 25 bp, Homo sapien
cccgaccaagtttgacgcttctgtc

SEQ ID NO: 203837 - DNA, 25 bp, Homo sapien
ggtatgtcccttgctttcccttgaa

SEQ ID NO: 203838 - DNA, 25 bp, Homo sapien
tttccaagcgcagaagtgccgtgcc

SEQ ID NO: 203839 - DNA, 25 bp, Homo sapien
cctggcctcagctatccgctgaaaa

SEQ ID NO: 203840 - DNA, 25 bp, Homo sapien
ggaccctccgagctcatagtcttca

SEQ ID NO: 203841 - DNA, 25 bp, Homo sapien
tcactgtggaaacggtaatgctgtc

SEQ ID NO: 203842 - DNA, 25 bp, Homo sapien
ttacggttgagagcagacagtttcg

SEQ ID NO: 203843 - DNA, 25 bp, Homo sapien
agcgctggaagagacacgaagaatc

SEQ ID NO: 203844 - DNA, 25 bp, Homo sapien
tgagatcccacggagccggtttacg

SEQ ID NO: 203845 - DNA, 25 bp, Homo sapien
cgaaggccgcataagacgttactta

SEQ ID NO: 203846 - DNA, 25 bp, Homo sapien
cggaaccttggggatcgctctccca

SEQ ID NO: 203847 - DNA, 25 bp, Homo sapien
tggttcctagggagcgccactcctt

SEQ ID NO: 203848 - DNA, 25 bp, Homo sapien
ggcccttacagtcgctgcaacctgg

SEQ ID NO: 203849 - DNA, 25 bp, Homo sapien
cacaatgaggcttggggcccttaca

SEQ ID NO: 203850 - DNA, 25 bp, Homo sapien
tcctaaggaggcgagctggccccct

SEQ ID NO: 203851 - DNA, 25 bp, Homo sapien
ggctcggctactggggtcctaagga

SEQ ID NO: 203852 - DNA, 25 bp, Homo sapien
acaaacgcaagtcgcgaggggagca

SEQ ID NO: 203853 - DNA, 25 bp, Homo sapien
ggctgcccgatccttgggagtctgc

SEQ ID NO: 203854 - DNA, 25 bp, Homo sapien
ccgatccttgggagtctgcggcttt

SEQ ID NO: 203855 - DNA, 25 bp, Homo sapien
agtctgcggctttcagacgctcctg

SEQ ID NO: 203856 - DNA, 25 bp, Homo sapien
cagccctgccggagcaaaacaaacg

SEQ ID NO: 203857 - DNA, 25 bp, Homo sapien
tgccggagcaaaacaaacgcaagtc

SEQ ID NO: 203858 - DNA, 25 bp, Homo sapien
tgcagtcctggctctacccacgcgc

SEQ ID NO: 203859 - DNA, 25 bp, Homo sapien
gtgacagtgaccattccccggaatc

SEQ ID NO: 203860 - DNA, 25 bp, Homo sapien
cccggaatctccgtggctctgatct

SEQ ID NO: 203861 - DNA, 25 bp, Homo sapien
ccagagccgtcgtcccgagcagtga

SEQ ID NO: 203862 - DNA, 25 bp, Homo sapien
cctgggacggatggaagcgcttccc

SEQ ID NO: 203863 - DNA, 25 bp, Homo sapien
ctgcacagatgtagggtgacagtga

SEQ ID NO: 203864 - DNA, 25 bp, Homo sapien
gaaacgccgcgctgtggactcgctc

SEQ ID NO: 203865 - DNA, 25 bp, Homo sapien
caaaggtgcgcgctgcacagatgta

SEQ ID NO: 203866 - DNA, 25 bp, Homo sapien
tacggatgcccactcacagacaggc

SEQ ID NO: 203867 - DNA, 25 bp, Homo sapien
ggccggcaagtacggatgcccactc

SEQ ID NO: 203868 - DNA, 25 bp, Homo sapien
aagcattgtttgagaagtgggagca

SEQ ID NO: 203869 - DNA, 25 bp, Homo sapien
cccggaaagcattgtttgagaagtg

SEQ ID NO: 203870 - DNA, 25 bp, Homo sapien
cgcaggcccggaaagcattgtttga

SEQ ID NO: 203871 - DNA, 25 bp, Homo sapien
cataactcaggtccatcggcagggg

SEQ ID NO: 203872 - DNA, 25 bp, Homo sapien
tttcctcagcccaccgctggtgaca

SEQ ID NO: 203873 - DNA, 25 bp, Homo sapien
cagccataactcaggtccatcggca

SEQ ID NO: 203874 - DNA, 25 bp, Homo sapien
ggcttggccgtagcttttcctcagg

SEQ ID NO: 203875 - DNA, 25 bp, Homo sapien
tgacgacagggacaccgttctcgcc

SEQ ID NO: 203876 - DNA, 25 bp, Homo sapien
cgcgaagcctaactctcgcgagacg

SEQ ID NO: 203877 - DNA, 25 bp, Homo sapien
aggccactagctggaaactccctga

SEQ ID NO: 203878 - DNA, 25 bp, Homo sapien
ccagaccgcacctatcagacggagg

SEQ ID NO: 203879 - DNA, 25 bp, Homo sapien
tcccagcacccagcgtttaacaggg

SEQ ID NO: 203880 - DNA, 25 bp, Homo sapien
ccggcgcccagaaacgcgtggagct

SEQ ID NO: 203881 - DNA, 25 bp, Homo sapien
aaggcccaatcggagccttctgaca

SEQ ID NO: 203882 - DNA, 25 bp, Homo sapien
ctcggcacacaacacagaaccgggg

SEQ ID NO: 203883 - DNA, 25 bp, Homo sapien
ccctctgcgggagtgatgcattgca

SEQ ID NO: 203884 - DNA, 25 bp, Homo sapien
cagtccatgcaggtgcgggaacaca

SEQ ID NO: 203885 - DNA, 25 bp, Homo sapien
caaacggagaagatccctgcagatc

SEQ ID NO: 203886 - DNA, 25 bp, Homo sapien
tccaaggatgccacaacccgacggg

SEQ ID NO: 203887 - DNA, 25 bp, Homo sapien
ggcgctgaggaagcacgattatcta

SEQ ID NO: 203888 - DNA, 25 bp, Homo sapien
gaacacatgtcggacccagggagca

SEQ ID NO: 203889 - DNA, 25 bp, Homo sapien
gttgaacaacaacgcgcagcacggc

SEQ ID NO: 203890 - DNA, 25 bp, Homo sapien
gacggcctcggttcattcctgggga

SEQ ID NO: 203891 - DNA, 25 bp, Homo sapien
ctccgtagatctcgatgtgggattc

SEQ ID NO: 203892 - DNA, 25 bp, Homo sapien
acaggcctcgaaggtccacttggtg

SEQ ID NO: 203893 - DNA, 25 bp, Homo sapien
ctcagttgatctggcgacaggcctc

SEQ ID NO: 203894 - DNA, 25 bp, Homo sapien
ctggcctgccgtgctcagttgatct

SEQ ID NO: 203895 - DNA, 25 bp, Homo sapien
aaaacagatcatcgccgcacaagca

SEQ ID NO: 203896 - DNA, 25 bp, Homo sapien
agagaagagacgcacaaaacagatc

SEQ ID NO: 203897 - DNA, 25 bp, Homo sapien
ttcagcccaggcgatgacattgccg

SEQ ID NO: 203898 - DNA, 25 bp, Homo sapien
gcggtcaaagcctcggaaatccctc

SEQ ID NO: 203899 - DNA, 25 bp, Homo sapien
caccgcgtccgggagatagaattcg

SEQ ID NO: 203900 - DNA, 25 bp, Homo sapien
atagaattcggttcggccctcctgg

SEQ ID NO: 203901 - DNA, 25 bp, Homo sapien
cccggggctatcagagcggtcaaag

SEQ ID NO: 203902 - DNA, 25 bp, Homo sapien
tgatcgagcctttcctgtccgcggc

SEQ ID NO: 203903 - DNA, 25 bp, Homo sapien
ttctcggaggcagacctagctgatc

SEQ ID NO: 203904 - DNA, 25 bp, Homo sapien
cccgcgtttcttagatgtccgtgtg

SEQ ID NO: 203905 - DNA, 25 bp, Homo sapien
gacccaggtcgtcaacacccgagtg

SEQ ID NO: 203906 - DNA, 25 bp, Homo sapien
cagctcagacgagtgcgggacccgc

SEQ ID NO: 203907 - DNA, 25 bp, Homo sapien
gtggttccgtgtcgcccgtttctca

SEQ ID NO: 203908 - DNA, 25 bp, Homo sapien
gcccgtttctcaggactcgttctca

SEQ ID NO: 203909 - DNA, 25 bp, Homo sapien
tggctctggttgcagcagctcagac

SEQ ID NO: 203910 - DNA, 25 bp, Homo sapien
cccagtgggcgaaccggcaccaaga

SEQ ID NO: 203911 - DNA, 25 bp, Homo sapien
agagcggcctgcctgtcttcggaac

SEQ ID NO: 203912 - DNA, 25 bp, Homo sapien
cctgtcttcggaactgctgaggcgg

SEQ ID NO: 203913 - DNA, 25 bp, Homo sapien
tcgttctcaggcaggagagagcctc

SEQ ID NO: 203914 - DNA, 25 bp, Homo sapien
ctgcacctctgaccacgtcacgccc

SEQ ID NO: 203915 - DNA, 25 bp, Homo sapien
tgaccacatcatgctccgagaacgt

SEQ ID NO: 203916 - DNA, 25 bp, Homo sapien
atcatgctccgagaacgtggacgct

SEQ ID NO: 203917 - DNA, 25 bp, Homo sapien
catcatgctccgagaacgtggacgc

SEQ ID NO: 203918 - DNA, 25 bp, Homo sapien
gtggacgctgcacctctgaccacat

SEQ ID NO: 203919 - DNA, 25 bp, Homo sapien
ctgaccacatcatgctccgagaacg

SEQ ID NO: 203920 - DNA, 25 bp, Homo sapien
tgctccgagaacgtggacgctgcac

SEQ ID NO: 203921 - DNA, 25 bp, Homo sapien
acatcatgctccgagaacgtggacg

SEQ ID NO: 203922 - DNA, 25 bp, Homo sapien
acacctccgaccacatcgtgctccg

SEQ ID NO: 203923 - DNA, 25 bp, Homo sapien
ctgctccgagaacgtgaactctgca

SEQ ID NO: 203924 - DNA, 25 bp, Homo sapien
actctgcacctctgaccacgtcacg

SEQ ID NO: 203925 - DNA, 25 bp, Homo sapien
ggcgctacacctccgaccacatcgt

SEQ ID NO: 203926 - DNA, 25 bp, Homo sapien
accacttcctgctccgagaacgtga

SEQ ID NO: 203927 - DNA, 25 bp, Homo sapien
tcctgctccgagaacgtgaactctg

SEQ ID NO: 203928 - DNA, 25 bp, Homo sapien
agaacgtgggcgctacacctccgac

SEQ ID NO: 203929 - DNA, 25 bp, Homo sapien
ctgcgagaacgtgggcgctacacct

SEQ ID NO: 203930 - DNA, 25 bp, Homo sapien
cccacagcggtgctttctgcgggtg

SEQ ID NO: 203931 - DNA, 25 bp, Homo sapien
gtgctttctgcgggtgatccccacc

SEQ ID NO: 203932 - DNA, 25 bp, Homo sapien
agcggtgctttctgcgggtgatccc

SEQ ID NO: 203933 - DNA, 25 bp, Homo sapien
acagcggtgctttctgcgggtgatc

SEQ ID NO: 203934 - DNA, 25 bp, Homo sapien
cacagcggtgctttctgcgggtgat

SEQ ID NO: 203935 - DNA, 25 bp, Homo sapien
tgctttctgcgggtgatccccaccg

SEQ ID NO: 203936 - DNA, 25 bp, Homo sapien
cagcggtgctttctgcgggtgatcc

SEQ ID NO: 203937 - DNA, 25 bp, Homo sapien
ccacagcggtgctttctgcgggtga

SEQ ID NO: 203938 - DNA, 25 bp, Homo sapien
actgaggagcaacctgcccagggtc

SEQ ID NO: 203939 - DNA, 25 bp, Homo sapien
gcgataaggtctaggcgccgcccgc

SEQ ID NO: 203940 - DNA, 25 bp, Homo sapien
cctggaagtcctcacaggccctggt

SEQ ID NO: 203941 - DNA, 25 bp, Homo sapien
acaggccctggtggcctactgagga

SEQ ID NO: 203942 - DNA, 25 bp, Homo sapien
ggtcctcaagagacaaccgcttagg

SEQ ID NO: 203943 - DNA, 25 bp, Homo sapien
tgcccagggtcctcaagagacaacc

SEQ ID NO: 203944 - DNA, 25 bp, Homo sapien
ggcctactgaggagcaacctgccca

SEQ ID NO: 203945 - DNA, 25 bp, Homo sapien
ctggtggcctactgaggagcaacct

SEQ ID NO: 203946 - DNA, 25 bp, Homo sapien
aggcctccttagctcatccggattg

SEQ ID NO: 203947 - DNA, 25 bp, Homo sapien
gtggaagcaaaacccgagagatcgc

SEQ ID NO: 203948 - DNA, 25 bp, Homo sapien
cgaggcactagacgctgatttagaa

SEQ ID NO: 203949 - DNA, 25 bp, Homo sapien
tgctgagatgagtaacgaggcacta

SEQ ID NO: 203950 - DNA, 25 bp, Homo sapien
ctgccagtcactgctgagatgagta

SEQ ID NO: 203951 - DNA, 25 bp, Homo sapien
gtaattcattaacgtctgccagtca

SEQ ID NO: 203952 - DNA, 25 bp, Homo sapien
tggctggtaaaggtgaaaatcagta

SEQ ID NO: 203953 - DNA, 25 bp, Homo sapien
tgaaattgcagacgtgcagccaagg

SEQ ID NO: 203954 - DNA, 25 bp, Homo sapien
gcagagcatcctcccgactggcgag

SEQ ID NO: 203955 - DNA, 25 bp, Homo sapien
atcctcccgactggcgaggtggctt

SEQ ID NO: 203956 - DNA, 25 bp, Homo sapien
tgcagagcatcctcccgactggcga

SEQ ID NO: 203957 - DNA, 25 bp, Homo sapien
cccgtcaatcagggctggacagtcc

SEQ ID NO: 203958 - DNA, 25 bp, Homo sapien
ctggacagtccgtcacgtgcagagc

SEQ ID NO: 203959 - DNA, 25 bp, Homo sapien
agtccgtcacgtgcagagcatcctc

SEQ ID NO: 203960 - DNA, 25 bp, Homo sapien
acgtgcagagcatcctcccgactgg

SEQ ID NO: 203961 - DNA, 25 bp, Homo sapien
agcatcctcccgactggcgaggtgg

SEQ ID NO: 203962 - DNA, 25 bp, Homo sapien
tgaccggtgcacagcccttactgcg

SEQ ID NO: 203963 - DNA, 25 bp, Homo sapien
cgcaccggcggcttatcttcagagt

SEQ ID NO: 203964 - DNA, 25 bp, Homo sapien
gtgagttactgcacgccaggttctc

SEQ ID NO: 203965 - DNA, 25 bp, Homo sapien
cgaccacctaaggaggtgtctgcga

SEQ ID NO: 203966 - DNA, 25 bp, Homo sapien
gctgaaaagtagaaggcgaccacct

SEQ ID NO: 203967 - DNA, 25 bp, Homo sapien
tgcctccctagtgaggaagacagtg

SEQ ID NO: 203968 - DNA, 25 bp, Homo sapien
cagataggatccgtgagtgcctccc

SEQ ID NO: 203969 - DNA, 25 bp, Homo sapien
gccgactctcggacatgagaggagt

SEQ ID NO: 203970 - DNA, 25 bp, Homo sapien
ctgggacgccccagctaaaagcttg

SEQ ID NO: 203971 - DNA, 25 bp, Homo sapien
cggtcgcagagcttcggcgtggcca

SEQ ID NO: 203972 - DNA, 25 bp, Homo sapien
tcaagcagatcctgctcgagtggtg

SEQ ID NO: 203973 - DNA, 25 bp, Homo sapien
agatcctgctcgagtggtgccgcag

SEQ ID NO: 203974 - DNA, 25 bp, Homo sapien
tgctcgagtggtgccgcagcaagac

SEQ ID NO: 203975 - DNA, 25 bp, Homo sapien
agacgctgggctaccaggtgagccc

SEQ ID NO: 203976 - DNA, 25 bp, Homo sapien
caggctgaagcggtcgcagagcttc

SEQ ID NO: 203977 - DNA, 25 bp, Homo sapien
ccagctaaaagcttgaccaagcgtc

SEQ ID NO: 203978 - DNA, 25 bp, Homo sapien
gccagtatggggcagccacatccca

SEQ ID NO: 203979 - DNA, 25 bp, Homo sapien
ctctccatctagaggccgcgtggcg

SEQ ID NO: 203980 - DNA, 25 bp, Homo sapien
gtggggcagccacatcccacctctc

SEQ ID NO: 203981 - DNA, 25 bp, Homo sapien
cctctccatctagaggccgcgtggc

SEQ ID NO: 203982 - DNA, 25 bp, Homo sapien
catcccacctctccatctagaggcc

SEQ ID NO: 203983 - DNA, 25 bp, Homo sapien
gtatggggcagccacatcccacctc

SEQ ID NO: 203984 - DNA, 25 bp, Homo sapien
tctccatctagaggccgcgtggcga

SEQ ID NO: 203985 - DNA, 25 bp, Homo sapien
ctccatctagaggccgcgtggcgag

SEQ ID NO: 203986 - DNA, 25 bp, Homo sapien
cacattcactggaacccggggcaca

SEQ ID NO: 203987 - DNA, 25 bp, Homo sapien
tcggctgactttttaagtcgggcca

SEQ ID NO: 203988 - DNA, 25 bp, Homo sapien
gtccacatgtgtccacattcactgg

SEQ ID NO: 203989 - DNA, 25 bp, Homo sapien
cggattcctacgtggtgaatgttct

SEQ ID NO: 203990 - DNA, 25 bp, Homo sapien
gcgttcgcctgtccacatgtgtcca

SEQ ID NO: 203991 - DNA, 25 bp, Homo sapien
tgggcgcacggaggcaccctgtcct

SEQ ID NO: 203992 - DNA, 25 bp, Homo sapien
ctgccgagagcgctcctggacttgg

SEQ ID NO: 203993 - DNA, 25 bp, Homo sapien
tggtgaatgttctcggctgactttt

SEQ ID NO: 203994 - DNA, 25 bp, Homo sapien
ggatgccgagccctgcgtttccagc

SEQ ID NO: 203995 - DNA, 25 bp, Homo sapien
ccgttcccttgctgcggcacaggtg

SEQ ID NO: 203996 - DNA, 25 bp, Homo sapien
caggccttgtctgtcggcatcttcc

SEQ ID NO: 203997 - DNA, 25 bp, Homo sapien
ccctacgtgctgaagctgctccaga

SEQ ID NO: 203998 - DNA, 25 bp, Homo sapien
tgggccaagatcctcgcagtggaca

SEQ ID NO: 203999 - DNA, 25 bp, Homo sapien
tcgcagtggacagcgtgagtatccc

SEQ ID NO: 204000 - DNA, 25 bp, Homo sapien
cagagtgatgtgaacctgccggccc

SEQ ID NO: 204001 - DNA, 25 bp, Homo sapien
tctcttctggggtaaagtgggacgc

SEQ ID NO: 204002 - DNA, 25 bp, Homo sapien
tgctgggtcttcacaccgagcccgt

SEQ ID NO: 204003 - DNA, 25 bp, Homo sapien
tcacctgctgggtcttcacaccgag

SEQ ID NO: 204004 - DNA, 25 bp, Homo sapien
tgtgtgtgtcacctgccaggtcttc

SEQ ID NO: 204005 - DNA, 25 bp, Homo sapien
atgtgtgtgtcacctgctgggtctt

SEQ ID NO: 204006 - DNA, 25 bp, Homo sapien
gctgggtcttcacaccgagcccgtg

SEQ ID NO: 204007 - DNA, 25 bp, Homo sapien
tgtgtgtgtcacctgccgggtcttc

SEQ ID NO: 204008 - DNA, 25 bp, Homo sapien
tgtgtgtcgcctgccgggtcttcac

SEQ ID NO: 204009 - DNA, 25 bp, Homo sapien
ccaggatgtgtgtgtcacctgctgg

SEQ ID NO: 204010 - DNA, 25 bp, Homo sapien
atctggcagaacttcgactcggcga

SEQ ID NO: 204011 - DNA, 25 bp, Homo sapien
cccattcccgaggtgagtcaggcgg

SEQ ID NO: 204012 - DNA, 25 bp, Homo sapien
gcctcggcaggatctggcagaactt

SEQ ID NO: 204013 - DNA, 25 bp, Homo sapien
ccttgctgcgccagtgggtggccat

SEQ ID NO: 204014 - DNA, 25 bp, Homo sapien
ggccatctgcctcggcaggatctgg

SEQ ID NO: 204015 - DNA, 25 bp, Homo sapien
gctcatgagaagctctacagcctcc

SEQ ID NO: 204016 - DNA, 25 bp, Homo sapien
gggacagcgctcatgagaagctcta

SEQ ID NO: 204017 - DNA, 25 bp, Homo sapien
cagaacttcgactcggcgaggtggt

SEQ ID NO: 204018 - DNA, 25 bp, Homo sapien
gaggcccccgtacgcagcaggatgt

SEQ ID NO: 204019 - DNA, 25 bp, Homo sapien
acgcagcaggatgtgcggcctccga

SEQ ID NO: 204020 - DNA, 25 bp, Homo sapien
cgtacgcagcaggatgtgcggcctc

SEQ ID NO: 204021 - DNA, 25 bp, Homo sapien
gtacgcagcaggatgtgcggcctcc

SEQ ID NO: 204022 - DNA, 25 bp, Homo sapien
cccgtacgcagcaggatgtgcggcc

SEQ ID NO: 204023 - DNA, 25 bp, Homo sapien
tacgcagcaggatgtgcggcctccg

SEQ ID NO: 204024 - DNA, 25 bp, Homo sapien
ccgtacgcagcaggatgtgcggcct

SEQ ID NO: 204025 - DNA, 25 bp, Homo sapien
cgcagcaggatgtgcggcctccgag

SEQ ID NO: 204026 - DNA, 25 bp, Homo sapien
ggcaatttctcggaggcctggcacg

SEQ ID NO: 204027 - DNA, 25 bp, Homo sapien
ggctgtggcccaaatgaagtcaaga

SEQ ID NO: 204028 - DNA, 25 bp, Homo sapien
ccaaggctgtctttgaggtcggtct

SEQ ID NO: 204029 - DNA, 25 bp, Homo sapien
aggaaaacagcgtggtcggcctctc

SEQ ID NO: 204030 - DNA, 25 bp, Homo sapien
tttccaagctgaaaacgcgaggggc

SEQ ID NO: 204031 - DNA, 25 bp, Homo sapien
tcacgtgaattacgcgcggtgactc

SEQ ID NO: 204032 - DNA, 25 bp, Homo sapien
tgggcaccagcgctcgtcacaataa

SEQ ID NO: 204033 - DNA, 25 bp, Homo sapien
aaagccacggttttcccatcgcagg

SEQ ID NO: 204034 - DNA, 25 bp, Homo sapien
gaatggcggttccagcacaagaccc

SEQ ID NO: 204035 - DNA, 25 bp, Homo sapien
cgacaggctgttctttctcccttca

SEQ ID NO: 204036 - DNA, 25 bp, Homo sapien
ttctttctcccttcaaccttgggca

SEQ ID NO: 204037 - DNA, 25 bp, Homo sapien
acccactcctgtcgccgttgcggga

SEQ ID NO: 204038 - DNA, 25 bp, Homo sapien
cagccggtgtcttatgccgctcgga

SEQ ID NO: 204039 - DNA, 25 bp, Homo sapien
atgccgctcggaggcaatgtccacc

SEQ ID NO: 204040 - DNA, 25 bp, Homo sapien
gctaccctaagtactccggggcgca

SEQ ID NO: 204041 - DNA, 25 bp, Homo sapien
aagaccctgcccacagagggtctct

SEQ ID NO: 204042 - DNA, 25 bp, Homo sapien
ccgctcctcagttcgtttctcagaa

SEQ ID NO: 204043 - DNA, 25 bp, Homo sapien
agtcaggctttctgtgtcgacagca

SEQ ID NO: 204044 - DNA, 25 bp, Homo sapien
ttccctgggatgactgacttccttg

SEQ ID NO: 204045 - DNA, 25 bp, Homo sapien
atggcgctgaattggtggatttccc

SEQ ID NO: 204046 - DNA, 25 bp, Homo sapien
ctcagaactgtcttggccgctctta

SEQ ID NO: 204047 - DNA, 25 bp, Homo sapien
ggggctccattcttagcagcaccca

SEQ ID NO: 204048 - DNA, 25 bp, Homo sapien
cctggccatcagtccttagggtctg

SEQ ID NO: 204049 - DNA, 25 bp, Homo sapien
ttagccctttgctctgctgtataca

SEQ ID NO: 204050 - DNA, 25 bp, Homo sapien
gttcctacagtctggaccgatttta

SEQ ID NO: 204051 - DNA, 25 bp, Homo sapien
ccacggttgagcagaaggtgcatct

SEQ ID NO: 204052 - DNA, 25 bp, Homo sapien
agccatcgccgatgtccttgtgttg

SEQ ID NO: 204053 - DNA, 25 bp, Homo sapien
tccttgtgttgcacggagcagttcc

SEQ ID NO: 204054 - DNA, 25 bp, Homo sapien
accgattttacatttccgagacttg

SEQ ID NO: 204055 - DNA, 25 bp, Homo sapien
acggctatcgcagagctgtgcaatc

SEQ ID NO: 204056 - DNA, 25 bp, Homo sapien
ccgagacttgcttgtggatctacac

SEQ ID NO: 204057 - DNA, 25 bp, Homo sapien
aaggcttcggttctgtcccagtaca

SEQ ID NO: 204058 - DNA, 25 bp, Homo sapien
tctccagcgggcgttctttccctct

SEQ ID NO: 204059 - DNA, 25 bp, Homo sapien
tctgcttcgtgtggcggcctccgcg

SEQ ID NO: 204060 - DNA, 25 bp, Homo sapien
gagcacgtcccgtctgaccttcaca

SEQ ID NO: 204061 - DNA, 25 bp, Homo sapien
aggccaccgtgaacgcccggccgca

SEQ ID NO: 204062 - DNA, 25 bp, Homo sapien
ccgcagcgcgtcctggacacctcct

SEQ ID NO: 204063 - DNA, 25 bp, Homo sapien
acaagggcgtgcacatccaccaggc

SEQ ID NO: 204064 - DNA, 25 bp, Homo sapien
ccctgtcttggcttcgtctcctccc

SEQ ID NO: 204065 - DNA, 25 bp, Homo sapien
acgccagcctctgcttcgtgtggcg

SEQ ID NO: 204066 - DNA, 25 bp, Homo sapien
cttctggtaccagcaacgtttctga

SEQ ID NO: 204067 - DNA, 25 bp, Homo sapien
tctgtgaaagactgcggttcatctc

SEQ ID NO: 204068 - DNA, 25 bp, Homo sapien
atctcgcattaacgcagacggtggc

SEQ ID NO: 204069 - DNA, 25 bp, Homo sapien
ttgtagccctctgtgcatctgaaga

SEQ ID NO: 204070 - DNA, 25 bp, Homo sapien
catctgaagagctggcggcagacca

SEQ ID NO: 204071 - DNA, 25 bp, Homo sapien
ggcagaccaggtttaaagcatcgca

SEQ ID NO: 204072 - DNA, 25 bp, Homo sapien
gctctgctgatcaccgaaaacactg

SEQ ID NO: 204073 - DNA, 25 bp, Homo sapien
aagcatcgcatgttgcaatccggtg

SEQ ID NO: 204074 - DNA, 25 bp, Homo sapien
cggggcttgtgtgtttcaggaatct

SEQ ID NO: 204075 - DNA, 25 bp, Homo sapien
ctgagctctgttcccgggaccgaga

SEQ ID NO: 204076 - DNA, 25 bp, Homo sapien
agacaccggccctgtcgcggctgtg

SEQ ID NO: 204077 - DNA, 25 bp, Homo sapien
gaccaccgttctgacggggcttgtg

SEQ ID NO: 204078 - DNA, 25 bp, Homo sapien
gtttcaggaatctggccaactgtga

SEQ ID NO: 204079 - DNA, 25 bp, Homo sapien
ggccaactgtgagcgcctcatcgaa

SEQ ID NO: 204080 - DNA, 25 bp, Homo sapien
cctcatcgaagtggaggacatgatg

SEQ ID NO: 204081 - DNA, 25 bp, Homo sapien
tcttcacctacgtccagtcgctgta

SEQ ID NO: 204082 - DNA, 25 bp, Homo sapien
gaagtgaaggccgacacccggatcc

SEQ ID NO: 204083 - DNA, 25 bp, Homo sapien
aagcccgtctttgtccctgtagctg

SEQ ID NO: 204084 - DNA, 25 bp, Homo sapien
cctgagcctctgagagtgtcgagtc

SEQ ID NO: 204085 - DNA, 25 bp, Homo sapien
caggaccaagtagcatcaaccgatg

SEQ ID NO: 204086 - DNA, 25 bp, Homo sapien
caaccgatgtcgaaagcccgtcttt

SEQ ID NO: 204087 - DNA, 25 bp, Homo sapien
tccctgtagctgtcagacgtgaccg

SEQ ID NO: 204088 - DNA, 25 bp, Homo sapien
agtcggttgtgctgacaagtgcgca

SEQ ID NO: 204089 - DNA, 25 bp, Homo sapien
aagtgcgcagccctctcaacgcggt

SEQ ID NO: 204090 - DNA, 25 bp, Homo sapien
ccgcgtcatgacgtaccgggagcac

SEQ ID NO: 204091 - DNA, 25 bp, Homo sapien
gcagctcccggtgagagccccgaag

SEQ ID NO: 204092 - DNA, 25 bp, Homo sapien
acagccgcgtcatgacgtaccggga

SEQ ID NO: 204093 - DNA, 25 bp, Homo sapien
cgtcatgacgtaccgggagcacaca

SEQ ID NO: 204094 - DNA, 25 bp, Homo sapien
ggcctccctgcagaagcgtcccgac

SEQ ID NO: 204095 - DNA, 25 bp, Homo sapien
tgaggagcgccgatatttagcagcc

SEQ ID NO: 204096 - DNA, 25 bp, Homo sapien
ctgcggacccgctggcacaggcaga

SEQ ID NO: 204097 - DNA, 25 bp, Homo sapien
ctacagccgcgtcatgacgtaccgg

SEQ ID NO: 204098 - DNA, 25 bp, Homo sapien
gagccagcctgtccccgtggtctag

SEQ ID NO: 204099 - DNA, 25 bp, Homo sapien
cgcggtctcggcatctgcgcccatc

SEQ ID NO: 204100 - DNA, 25 bp, Homo sapien
ctgtccccgcggtctcggcatctgc

SEQ ID NO: 204101 - DNA, 25 bp, Homo sapien
cctgtccccgcggtctcggcatctg

SEQ ID NO: 204102 - DNA, 25 bp, Homo sapien
ccgtggtctagccggcctgtccccg

SEQ ID NO: 204103 - DNA, 25 bp, Homo sapien
tccccgtggtctagccggcctgtcc

SEQ ID NO: 204104 - DNA, 25 bp, Homo sapien
tgtccccgtggtctagccggcctgt

SEQ ID NO: 204105 - DNA, 25 bp, Homo sapien
ccgcggtctcggcatctgcgcccat

SEQ ID NO: 204106 - DNA, 25 bp, Homo sapien
ttccatcctcaaagaagagggcagt

SEQ ID NO: 204107 - DNA, 25 bp, Homo sapien
cagtgatgccgggaccctttctctc

SEQ ID NO: 204108 - DNA, 25 bp, Homo sapien
cccacagtggctccgtcaatcagtt

SEQ ID NO: 204109 - DNA, 25 bp, Homo sapien
gtcaatcagttcaccgccatctaca

SEQ ID NO: 204110 - DNA, 25 bp, Homo sapien
cgccatctacaacagcagcggagag

SEQ ID NO: 204111 - DNA, 25 bp, Homo sapien
agcggagagctcatcaacaacatca

SEQ ID NO: 204112 - DNA, 25 bp, Homo sapien
tactacgacggcttcatgggccagc

SEQ ID NO: 204113 - DNA, 25 bp, Homo sapien
tcaacaacatcaagtactacgacgg

SEQ ID NO: 204114 - DNA, 25 bp, Homo sapien
cagtgtgaacgttggctgctgcctt

SEQ ID NO: 204115 - DNA, 25 bp, Homo sapien
gttgacggtggcttcccactgagca

SEQ ID NO: 204116 - DNA, 25 bp, Homo sapien
gccgtgggaagcaacgactactaca

SEQ ID NO: 204117 - DNA, 25 bp, Homo sapien
acggccgcctgctgtacatagtgaa

SEQ ID NO: 204118 - DNA, 25 bp, Homo sapien
ctgctgccttagctgctgatgacgg

SEQ ID NO: 204119 - DNA, 25 bp, Homo sapien
tgctactcgcttttgtctgtcttcg

SEQ ID NO: 204120 - DNA, 25 bp, Homo sapien
tctgtcttcgctgtcgtgtctggaa

SEQ ID NO: 204121 - DNA, 25 bp, Homo sapien
tactcggtggagaagcgtgtcagat

SEQ ID NO: 204122 - DNA, 25 bp, Homo sapien
tcaggaaccggatctgtgcagcctc

SEQ ID NO: 204123 - DNA, 25 bp, Homo sapien
gcagccacgcgggaatcaatggttc

SEQ ID NO: 204124 - DNA, 25 bp, Homo sapien
atggttcaggaaccggatctgtgca

SEQ ID NO: 204125 - DNA, 25 bp, Homo sapien
ggaaccggatctgtgcagcctcgcc

SEQ ID NO: 204126 - DNA, 25 bp, Homo sapien
gcccgcagcgtctcggacttcagga

SEQ ID NO: 204127 - DNA, 25 bp, Homo sapien
gcgtctcggacttcaggactctata

SEQ ID NO: 204128 - DNA, 25 bp, Homo sapien
tcggacttcaggactctatactagt

SEQ ID NO: 204129 - DNA, 25 bp, Homo sapien
cgcgggaatcaatggttcaggaacc

SEQ ID NO: 204130 - DNA, 25 bp, Homo sapien
acgaaatggtaatgtgaagctaaga

SEQ ID NO: 204131 - DNA, 25 bp, Homo sapien
acgtgggctgtcttcacaggtctga

SEQ ID NO: 204132 - DNA, 25 bp, Homo sapien
tcacgacgttaaccggctcgagaga

SEQ ID NO: 204133 - DNA, 25 bp, Homo sapien
cgccggcctagaggctcattatcta

SEQ ID NO: 204134 - DNA, 25 bp, Homo sapien
acgcgaattgagacggactttgaca

SEQ ID NO: 204135 - DNA, 25 bp, Homo sapien
gactttgacaaaacacgaaatggta

SEQ ID NO: 204136 - DNA, 25 bp, Homo sapien
acaggtctgatgtgaaaattcaatc

SEQ ID NO: 204137 - DNA, 25 bp, Homo sapien
cagtaaacaacacgcgcagactccg

SEQ ID NO: 204138 - DNA, 25 bp, Homo sapien
cgccggcttcccctgtcctgcagcg

SEQ ID NO: 204139 - DNA, 25 bp, Homo sapien
cctcctccgggctgaggtcctccca

SEQ ID NO: 204140 - DNA, 25 bp, Homo sapien
tcccttaggggtctgcgggtctctc

SEQ ID NO: 204141 - DNA, 25 bp, Homo sapien
ctcccttaggggtctgcgggtctct

SEQ ID NO: 204142 - DNA, 25 bp, Homo sapien
cccggggcggcctgccgaggtctgg

SEQ ID NO: 204143 - DNA, 25 bp, Homo sapien
cgcgcaggagcctgcacagggtagg

SEQ ID NO: 204144 - DNA, 25 bp, Homo sapien
ggacaggctgctgggacgtcagccc

SEQ ID NO: 204145 - DNA, 25 bp, Homo sapien
cctgcacagggtaggggcccgcgag

SEQ ID NO: 204146 - DNA, 25 bp, Homo sapien
cacttctccgtaccggtccaaggag

SEQ ID NO: 204147 - DNA, 25 bp, Homo sapien
actgcgggattcgacgccggcgttc

SEQ ID NO: 204148 - DNA, 25 bp, Homo sapien
tcgcgggccctaacatccaggtatc

SEQ ID NO: 204149 - DNA, 25 bp, Homo sapien
aggtatccgtgccacttctccgtac

SEQ ID NO: 204150 - DNA, 25 bp, Homo sapien
gtcacggagcaggacaaggccatcc

SEQ ID NO: 204151 - DNA, 25 bp, Homo sapien
ccatgggtaacctgttcggccgcaa

SEQ ID NO: 204152 - DNA, 25 bp, Homo sapien
ggccgcaagaagcagagccgcgtca

SEQ ID NO: 204153 - DNA, 25 bp, Homo sapien
cttccgcagcgcctgggtacgggac

SEQ ID NO: 204154 - DNA, 25 bp, Homo sapien
ctggcctgctctcagtccggattaa

SEQ ID NO: 204155 - DNA, 25 bp, Homo sapien
ccacgcaggcgcattgcaggaggac

SEQ ID NO: 204156 - DNA, 25 bp, Homo sapien
aggcgcattgcaggaggactccaga

SEQ ID NO: 204157 - DNA, 25 bp, Homo sapien
tgagcctgaacgcactcaggcgcca

SEQ ID NO: 204158 - DNA, 25 bp, Homo sapien
gctctcagtccggattaactctcga

SEQ ID NO: 204159 - DNA, 25 bp, Homo sapien
ggattaactctcgaccgagcccagc

SEQ ID NO: 204160 - DNA, 25 bp, Homo sapien
aggcccaacgcctctggtgctgttc

SEQ ID NO: 204161 - DNA, 25 bp, Homo sapien
tggagaccttgagcctgaacgcact

SEQ ID NO: 204162 - DNA, 25 bp, Homo sapien
gctgagctgtcctttcccgcagcgg

SEQ ID NO: 204163 - DNA, 25 bp, Homo sapien
acatctggctgcttttcgctggctg

SEQ ID NO: 204164 - DNA, 25 bp, Homo sapien
ctgtgagagcggagtttcctctctc

SEQ ID NO: 204165 - DNA, 25 bp, Homo sapien
ggcgttctcgttgtttcagcggcgc

SEQ ID NO: 204166 - DNA, 25 bp, Homo sapien
ccaacctcgggtaaagacgcttctg

SEQ ID NO: 204167 - DNA, 25 bp, Homo sapien
tgagcacccggtgcgcggcaacgat

SEQ ID NO: 204168 - DNA, 25 bp, Homo sapien
cggcaacgatgatcccgcaagggaa

SEQ ID NO: 204169 - DNA, 25 bp, Homo sapien
cgcccttgctgttcgtcgatgcaca

SEQ ID NO: 204170 - DNA, 25 bp, Homo sapien
cgctggaggtttgaaatggctttta

SEQ ID NO: 204171 - DNA, 25 bp, Homo sapien
ccctgagacagacatccggatttgg

SEQ ID NO: 204172 - DNA, 25 bp, Homo sapien
ggcatgttgctttgacgttccctga

SEQ ID NO: 204173 - DNA, 25 bp, Homo sapien
tgtgtcaccaactgcccaccatagg

SEQ ID NO: 204174 - DNA, 25 bp, Homo sapien
cgaccgcagtttccaggcaccagag

SEQ ID NO: 204175 - DNA, 25 bp, Homo sapien
ggctttggatttggtcccgagaaca

SEQ ID NO: 204176 - DNA, 25 bp, Homo sapien
tgactgcgccggattcttgtttaga

SEQ ID NO: 204177 - DNA, 25 bp, Homo sapien
cgggagccgttcgaatgtgttaagc

SEQ ID NO: 204178 - DNA, 25 bp, Homo sapien
tcatcggccgcggtgtgtctcctca

SEQ ID NO: 204179 - DNA, 25 bp, Homo sapien
tgcgttctgagtcggtcaccgaata

SEQ ID NO: 204180 - DNA, 25 bp, Homo sapien
ccacccgggaagcaggctgcgttct

SEQ ID NO: 204181 - DNA, 25 bp, Homo sapien
aggcaccgagactgctgagccactg

SEQ ID NO: 204182 - DNA, 25 bp, Homo sapien
ggataaccgtcttctcagggaaggc

SEQ ID NO: 204183 - DNA, 25 bp, Homo sapien
catgtacagcatggataaccgtctt

SEQ ID NO: 204184 - DNA, 25 bp, Homo sapien
gccgagctggtcacttccatgtaca

SEQ ID NO: 204185 - DNA, 25 bp, Homo sapien
tgtctcctcaggtgccgagctggtc

SEQ ID NO: 204186 - DNA, 25 bp, Homo sapien
taatctatcatcttatgtaaccgcg

SEQ ID NO: 204187 - DNA, 25 bp, Homo sapien
tggatgggtggacggataatctatc

SEQ ID NO: 204188 - DNA, 25 bp, Homo sapien
tttcgtctccgtcctgctgccgtta

SEQ ID NO: 204189 - DNA, 25 bp, Homo sapien
ctcgctcagaggagatgcaccggct

SEQ ID NO: 204190 - DNA, 25 bp, Homo sapien
tgcaccggctcacggaaaatgtcta

SEQ ID NO: 204191 - DNA, 25 bp, Homo sapien
gaaaatgtctataaggtgagcgccc

SEQ ID NO: 204192 - DNA, 25 bp, Homo sapien
gcgagcctcgggcacttcattctca

SEQ ID NO: 204193 - DNA, 25 bp, Homo sapien
gggcacttcattctcaacaggcttt

SEQ ID NO: 204194 - DNA, 25 bp, Homo sapien
taccaccggagggtccagtataggc

SEQ ID NO: 204195 - DNA, 25 bp, Homo sapien
ttccctcgggagatgttggctctgt

SEQ ID NO: 204196 - DNA, 25 bp, Homo sapien
ctttgcggctgggtcgatgctgcat

SEQ ID NO: 204197 - DNA, 25 bp, Homo sapien
tgggctagcacgcaaaggcgccctc

SEQ ID NO: 204198 - DNA, 25 bp, Homo sapien
agcacctgccctggaacttggccgg

SEQ ID NO: 204199 - DNA, 25 bp, Homo sapien
tataggcaggactgaggtgtacccg

SEQ ID NO: 204200 - DNA, 25 bp, Homo sapien
cacccttgctgcgtcctggaaggaa

SEQ ID NO: 204201 - DNA, 25 bp, Homo sapien
tatcccacttctgcggaagcgctgg

SEQ ID NO: 204202 - DNA, 25 bp, Homo sapien
cctgagcctctgtttgagggactca

SEQ ID NO: 204203 - DNA, 25 bp, Homo sapien
tgagggactcacgtccagctcccgg

SEQ ID NO: 204204 - DNA, 25 bp, Homo sapien
ctgctgtggctcacattctgccatc

SEQ ID NO: 204205 - DNA, 25 bp, Homo sapien
ttctgccatccgagctctgtccagg

SEQ ID NO: 204206 - DNA, 25 bp, Homo sapien
cgagaattggagcagttcccacgcc

SEQ ID NO: 204207 - DNA, 25 bp, Homo sapien
aggcagccgagaattggagcagttc

SEQ ID NO: 204208 - DNA, 25 bp, Homo sapien
cgagctctgtccaggaggcagccga

SEQ ID NO: 204209 - DNA, 25 bp, Homo sapien
ttcccacgccaagtagggccttgtg

SEQ ID NO: 204210 - DNA, 25 bp, Homo sapien
cgagggcgagaaattgtcctatttg

SEQ ID NO: 204211 - DNA, 25 bp, Homo sapien
gctgaggggacgcaattttctgacg

SEQ ID NO: 204212 - DNA, 25 bp, Homo sapien
gagactcgtgcagcgagcccaagga

SEQ ID NO: 204213 - DNA, 25 bp, Homo sapien
tccacacggtcctgcgagactcgtg

SEQ ID NO: 204214 - DNA, 25 bp, Homo sapien
ccagggctatgtccacacggtcctg

SEQ ID NO: 204215 - DNA, 25 bp, Homo sapien
gcgagcccaaggaacatgaagagga

SEQ ID NO: 204216 - DNA, 25 bp, Homo sapien
ttgtcctatttgaactcactagccg

SEQ ID NO: 204217 - DNA, 25 bp, Homo sapien
ttgaactcactagccgcagcagacg

SEQ ID NO: 204218 - DNA, 25 bp, Homo sapien
tgccatctccgagctgggtgctgtg

SEQ ID NO: 204219 - DNA, 25 bp, Homo sapien
ctgtgggtgcaggtgccatctccga

SEQ ID NO: 204220 - DNA, 25 bp, Homo sapien
tgcaggtgccatctccgagctgggt

SEQ ID NO: 204221 - DNA, 25 bp, Homo sapien
tgggtgcaggttccacctcggagct

SEQ ID NO: 204222 - DNA, 25 bp, Homo sapien
tgccatctcggagctggatgctgtg

SEQ ID NO: 204223 - DNA, 25 bp, Homo sapien
tgcaggtgccatctcggagctggat

SEQ ID NO: 204224 - DNA, 25 bp, Homo sapien
ctgtgggtgcaggttccacctcgga

SEQ ID NO: 204225 - DNA, 25 bp, Homo sapien
gtgccatctccgagctgggtgctgt

SEQ ID NO: 204226 - DNA, 25 bp, Homo sapien
aggcctgtgccgaccccagcaagat

SEQ ID NO: 204227 - DNA, 25 bp, Homo sapien
ggcctccaagtccaacctggtcatt

SEQ ID NO: 204228 - DNA, 25 bp, Homo sapien
ccagcaagatcccggagcgcgcggt

SEQ ID NO: 204229 - DNA, 25 bp, Homo sapien
tgtggcaacaggcctgtgccgaccc

SEQ ID NO: 204230 - DNA, 25 bp, Homo sapien
agaagctgccgctgtggcaacaggc

SEQ ID NO: 204231 - DNA, 25 bp, Homo sapien
cagaagctgccgctgtggcaacagg

SEQ ID NO: 204232 - DNA, 25 bp, Homo sapien
gcctccaagtccaacctggtcattt

SEQ ID NO: 204233 - DNA, 25 bp, Homo sapien
cgccctgtcggcctccaagtccaac

SEQ ID NO: 204234 - DNA, 25 bp, Homo sapien
ctgggcttgcacacggtgctggccc

SEQ ID NO: 204235 - DNA, 25 bp, Homo sapien
cctccaggcccgcaagtgaggcagg

SEQ ID NO: 204236 - DNA, 25 bp, Homo sapien
agataacctgggcttgcacacggtg

SEQ ID NO: 204237 - DNA, 25 bp, Homo sapien
gcctgctagataacctgggcttgca

SEQ ID NO: 204238 - DNA, 25 bp, Homo sapien
gcactcagtcgcctgctagataacc

SEQ ID NO: 204239 - DNA, 25 bp, Homo sapien
ccaggtattttctcggcactcagtc

SEQ ID NO: 204240 - DNA, 25 bp, Homo sapien
ttgtgcccacctctgccaggtattt

SEQ ID NO: 204241 - DNA, 25 bp, Homo sapien
ttcccggcgtgcgtctttgccgtgg

SEQ ID NO: 204242 - DNA, 25 bp, Homo sapien
gtccatactcgtcagcggaggccca

SEQ ID NO: 204243 - DNA, 25 bp, Homo sapien
cacccaactggtcgaaatgcatttg

SEQ ID NO: 204244 - DNA, 25 bp, Homo sapien
cagaaaacaggtgctgtccgcccgg

SEQ ID NO: 204245 - DNA, 25 bp, Homo sapien
cgaagaaacagctgacgcgagaaga

SEQ ID NO: 204246 - DNA, 25 bp, Homo sapien
ggcccaccttctgaagacacgaaga

SEQ ID NO: 204247 - DNA, 25 bp, Homo sapien
acgctggacccgattccagaagggc

SEQ ID NO: 204248 - DNA, 25 bp, Homo sapien
tctgggtctggagtcacccaactgg

SEQ ID NO: 204249 - DNA, 25 bp, Homo sapien
aatgcatttgtgacggctccgtttc

SEQ ID NO: 204250 - DNA, 25 bp, Homo sapien
ggattcttctcgttgaggccactga

SEQ ID NO: 204251 - DNA, 25 bp, Homo sapien
gctgttgccttctgatctcagcgga

SEQ ID NO: 204252 - DNA, 25 bp, Homo sapien
tgtcatagccactgtccagcgctcg

SEQ ID NO: 204253 - DNA, 25 bp, Homo sapien
agccagcttgatggcagacacctcg

SEQ ID NO: 204254 - DNA, 25 bp, Homo sapien
gaagacctcatagccaccatcactg

SEQ ID NO: 204255 - DNA, 25 bp, Homo sapien
gggactcatagttctcggtgtcata

SEQ ID NO: 204256 - DNA, 25 bp, Homo sapien
gcgcctccttgagcacaaactcagg

SEQ ID NO: 204257 - DNA, 25 bp, Homo sapien
gccgcacttcttctctgggcctgag

SEQ ID NO: 204258 - DNA, 25 bp, Homo sapien
ccgagggattccccgaattctgctc

SEQ ID NO: 204259 - DNA, 25 bp, Homo sapien
ggcagagcccactcatgcctgccca

SEQ ID NO: 204260 - DNA, 25 bp, Homo sapien
acgaaggggccagcgctggcagagc

SEQ ID NO: 204261 - DNA, 25 bp, Homo sapien
tgaggcccgggacgaaggggccagc

SEQ ID NO: 204262 - DNA, 25 bp, Homo sapien
gcacggagcacactggcccattctc

SEQ ID NO: 204263 - DNA, 25 bp, Homo sapien
aaaggctcctttgttgggggctgct

SEQ ID NO: 204264 - DNA, 25 bp, Homo sapien
cgcaccaaaggctcctttgttgggg

SEQ ID NO: 204265 - DNA, 25 bp, Homo sapien
gggcgcaccaaaggctcctttgttg

SEQ ID NO: 204266 - DNA, 25 bp, Homo sapien
cgtggcgcgatgacgcaaacacacc

SEQ ID NO: 204267 - DNA, 25 bp, Homo sapien
gagaaatacgtgcatcccgtccgga

SEQ ID NO: 204268 - DNA, 25 bp, Homo sapien
tcccgtccggactgatacctggatc

SEQ ID NO: 204269 - DNA, 25 bp, Homo sapien
tgcagccgcaataggcacatgagcc

SEQ ID NO: 204270 - DNA, 25 bp, Homo sapien
agagggcccactcagaacggctgcc

SEQ ID NO: 204271 - DNA, 25 bp, Homo sapien
tccgaggcggtcctgtgatgttaaa

SEQ ID NO: 204272 - DNA, 25 bp, Homo sapien
cggaacgatttccatttagcggacg

SEQ ID NO: 204273 - DNA, 25 bp, Homo sapien
ccgttcgaggttgcagcaaaccaga

SEQ ID NO: 204274 - DNA, 25 bp, Homo sapien
cgtgcgtgtcatgcgtgtaaggaca

SEQ ID NO: 204275 - DNA, 25 bp, Homo sapien
atcccaggcgaggtttccaggatgt

SEQ ID NO: 204276 - DNA, 25 bp, Homo sapien
gtaaggacaccctgcacaccgggta

SEQ ID NO: 204277 - DNA, 25 bp, Homo sapien
cgctgtgttctcatacccgaacggc

SEQ ID NO: 204278 - DNA, 25 bp, Homo sapien
tacccgaacggcaggaacacaggca

SEQ ID NO: 204279 - DNA, 25 bp, Homo sapien
gggctcacgaggcactcaacaggcc

SEQ ID NO: 204280 - DNA, 25 bp, Homo sapien
gtagggccgtgaacagatgtcatcc

SEQ ID NO: 204281 - DNA, 25 bp, Homo sapien
cagatgtcatcccaggcgaggtttc

SEQ ID NO: 204282 - DNA, 25 bp, Homo sapien
acgcgctagttcaggctccagcagc

SEQ ID NO: 204283 - DNA, 25 bp, Homo sapien
gccggccacgggtatttctagacaa

SEQ ID NO: 204284 - DNA, 25 bp, Homo sapien
cggccacgggtatttctagacaaga

SEQ ID NO: 204285 - DNA, 25 bp, Homo sapien
cacgggtatttctagacaagacttg

SEQ ID NO: 204286 - DNA, 25 bp, Homo sapien
cagtctgacgcgctagttcaggctc

SEQ ID NO: 204287 - DNA, 25 bp, Homo sapien
agcagcagccaagcatctcgccaga

SEQ ID NO: 204288 - DNA, 25 bp, Homo sapien
ccagggtccgagcagggtccgtcct

SEQ ID NO: 204289 - DNA, 25 bp, Homo sapien
ggaaaaataaaacagtctgacgcgc

SEQ ID NO: 204290 - DNA, 25 bp, Homo sapien
cgtggtcactaggaagccacacgcc

SEQ ID NO: 204291 - DNA, 25 bp, Homo sapien
agtgaccggccaggtagcagtcctg

SEQ ID NO: 204292 - DNA, 25 bp, Homo sapien
ctgccgcgcgggtaaatccaatgcg

SEQ ID NO: 204293 - DNA, 25 bp, Homo sapien
cccggaggtcagagcgcacttgtgt

SEQ ID NO: 204294 - DNA, 25 bp, Homo sapien
gaggaaattccacgtgggcctcaca

SEQ ID NO: 204295 - DNA, 25 bp, Homo sapien
gcacttgtgtgtgccgtggtcacta

SEQ ID NO: 204296 - DNA, 25 bp, Homo sapien
ttcgaggaaattccacgtgggcctc

SEQ ID NO: 204297 - DNA, 25 bp, Homo sapien
tcagagcgcacttgtgtgtgccgtg

SEQ ID NO: 204298 - DNA, 25 bp, Homo sapien
tgtacgtctagctcctcagggcttc

SEQ ID NO: 204299 - DNA, 25 bp, Homo sapien
gttggccggctacagaatttgttta

SEQ ID NO: 204300 - DNA, 25 bp, Homo sapien
cctcggtccagatctccggattgtc

SEQ ID NO: 204301 - DNA, 25 bp, Homo sapien
tggagcgccatagcacagtcgattt

SEQ ID NO: 204302 - DNA, 25 bp, Homo sapien
cttgagaaattccaggccctaccga

SEQ ID NO: 204303 - DNA, 25 bp, Homo sapien
tggccgcgcttggttcttccaaagc

SEQ ID NO: 204304 - DNA, 25 bp, Homo sapien
cacagccgttgcaccagggtactgc

SEQ ID NO: 204305 - DNA, 25 bp, Homo sapien
tcttccaaagcgagaagggcttctc

SEQ ID NO: 204306 - DNA, 25 bp, Homo sapien
tttccatgcaaaccgggagccgtgg

SEQ ID NO: 204307 - DNA, 25 bp, Homo sapien
ggctccgctggtgcagtccgaaaac

SEQ ID NO: 204308 - DNA, 25 bp, Homo sapien
cgaagtgcgagctgaaggcgaagct

SEQ ID NO: 204309 - DNA, 25 bp, Homo sapien
gttaatttccatgcaaaccgggagc

SEQ ID NO: 204310 - DNA, 25 bp, Homo sapien
cccacaggcggaggccggtttgtgc

SEQ ID NO: 204311 - DNA, 25 bp, Homo sapien
gttgaagaaggacgacgacatggcc

SEQ ID NO: 204312 - DNA, 25 bp, Homo sapien
ccgagccgccgcatcacccagcggc

SEQ ID NO: 204313 - DNA, 25 bp, Homo sapien
cggcgacagacgaggcgctccgccc

SEQ ID NO: 204314 - DNA, 25 bp, Homo sapien
gccggtgaatgaccagctcaatctc

SEQ ID NO: 204315 - DNA, 25 bp, Homo sapien
cttgtcccgtaagcgcttgatgctg

SEQ ID NO: 204316 - DNA, 25 bp, Homo sapien
agctcggcctcgtacttgtcccgta

SEQ ID NO: 204317 - DNA, 25 bp, Homo sapien
tgcagacgcagattctcgccctcgg

SEQ ID NO: 204318 - DNA, 25 bp, Homo sapien
agaaagctgctcgttcacctgggtg

SEQ ID NO: 204319 - DNA, 25 bp, Homo sapien
tgctgcgctcgctagaaagctgctc

SEQ ID NO: 204320 - DNA, 25 bp, Homo sapien
gaactcctggcggatcacctgggcc

SEQ ID NO: 204321 - DNA, 25 bp, Homo sapien
tcagctcctgttcccggttcagcag

SEQ ID NO: 204322 - DNA, 25 bp, Homo sapien
acatgccctaactgaggtcggaccc

SEQ ID NO: 204323 - DNA, 25 bp, Homo sapien
cacagctgctccacgcggttttacg

SEQ ID NO: 204324 - DNA, 25 bp, Homo sapien
cacgcggttttacgtgcactgacca

SEQ ID NO: 204325 - DNA, 25 bp, Homo sapien
tacgtgcactgaccacgtgccctga

SEQ ID NO: 204326 - DNA, 25 bp, Homo sapien
tgccctgaccaaggtagaaccctgt

SEQ ID NO: 204327 - DNA, 25 bp, Homo sapien
ccaggtgcactgactacatgcccta

SEQ ID NO: 204328 - DNA, 25 bp, Homo sapien
gggagcccggttcacagctgctcca

SEQ ID NO: 204329 - DNA, 25 bp, Homo sapien
gaaccctgtgtgaactgaccgcgtg

SEQ ID NO: 204330 - DNA, 25 bp, Homo sapien
gaccgctcggagaagcggacgctaa

SEQ ID NO: 204331 - DNA, 25 bp, Homo sapien
ctaagcgaggatcagaccgctcgga

SEQ ID NO: 204332 - DNA, 25 bp, Homo sapien
ggacgctaagcgaggatcagaccgc

SEQ ID NO: 204333 - DNA, 25 bp, Homo sapien
aagcggacgctaagcgaggatcaga

SEQ ID NO: 204334 - DNA, 25 bp, Homo sapien
ccgctcggagaagcggacgctaagc

SEQ ID NO: 204335 - DNA, 25 bp, Homo sapien
agcgaggatcagaccgctcggagaa

SEQ ID NO: 204336 - DNA, 25 bp, Homo sapien
cggacgctaagcgaggatcagaccg

SEQ ID NO: 204337 - DNA, 25 bp, Homo sapien
agaagcggacgctaagcgaggatca

SEQ ID NO: 204338 - DNA, 25 bp, Homo sapien
ctgtccttcgggaagttcaagcgtg

SEQ ID NO: 204339 - DNA, 25 bp, Homo sapien
ccatcacttcatcactggaccaggg

SEQ ID NO: 204340 - DNA, 25 bp, Homo sapien
ggatgcggaaccagtcgcgcccaaa

SEQ ID NO: 204341 - DNA, 25 bp, Homo sapien
gcggcagctagcaaccagcctggca

SEQ ID NO: 204342 - DNA, 25 bp, Homo sapien
cgcgactacagagagcggccgattg

SEQ ID NO: 204343 - DNA, 25 bp, Homo sapien
tcgttactcagtacgactgcgaggg

SEQ ID NO: 204344 - DNA, 25 bp, Homo sapien
gtgggcgccttgctaacctccctga

SEQ ID NO: 204345 - DNA, 25 bp, Homo sapien
cccggtgacaatgaagcggccggac

SEQ ID NO: 204346 - DNA, 25 bp, Homo sapien
ctcacccggtgtagaaagctcaggc

SEQ ID NO: 204347 - DNA, 25 bp, Homo sapien
ttcaaggtttgagcgcctgccgcgt

SEQ ID NO: 204348 - DNA, 25 bp, Homo sapien
ttgacaccggaagaggacggaccta

SEQ ID NO: 204349 - DNA, 25 bp, Homo sapien
agcgccgacctatcaagctgtttga

SEQ ID NO: 204350 - DNA, 25 bp, Homo sapien
caaagcctggccaattaagaagttc

SEQ ID NO: 204351 - DNA, 25 bp, Homo sapien
gcctaggccaatccgaagtcccaga

SEQ ID NO: 204352 - DNA, 25 bp, Homo sapien
ttcgtaaacaattggagcctaggcc

SEQ ID NO: 204353 - DNA, 25 bp, Homo sapien
ggccctgaggttggcttcgtaaaca

SEQ ID NO: 204354 - DNA, 25 bp, Homo sapien
cggggacactgtctgatgtacgttc

SEQ ID NO: 204355 - DNA, 25 bp, Homo sapien
gctcgacggcccacagagctctgcc

SEQ ID NO: 204356 - DNA, 25 bp, Homo sapien
tgtctgatgtacgttccggaggtcc

SEQ ID NO: 204357 - DNA, 25 bp, Homo sapien
cccaggtgcacacggggacactgtc

SEQ ID NO: 204358 - DNA, 25 bp, Homo sapien
ctggcagtaaccacagctggccgga

SEQ ID NO: 204359 - DNA, 25 bp, Homo sapien
ttgtaggatgcccagggagcccaaa

SEQ ID NO: 204360 - DNA, 25 bp, Homo sapien
ccgcaatgtgcctcggggcttgtag

SEQ ID NO: 204361 - DNA, 25 bp, Homo sapien
cggcatctccggacgccaggtgctg

SEQ ID NO: 204362 - DNA, 25 bp, Homo sapien
gtccctagggacagccatccggggc

SEQ ID NO: 204363 - DNA, 25 bp, Homo sapien
acgcgcaggtcctcgaggataatga

SEQ ID NO: 204364 - DNA, 25 bp, Homo sapien
gcaattgaaccgctcacccacgtgt

SEQ ID NO: 204365 - DNA, 25 bp, Homo sapien
ccaatcggtttcaaggggttgcagc

SEQ ID NO: 204366 - DNA, 25 bp, Homo sapien
tgccgaaggccaatcgaaagactta

SEQ ID NO: 204367 - DNA, 25 bp, Homo sapien
ccgccactgagaaagcaaacaaagg

SEQ ID NO: 204368 - DNA, 25 bp, Homo sapien
ggcgcgcactgaagcaagcatcacg

SEQ ID NO: 204369 - DNA, 25 bp, Homo sapien
ggccagactactgggctctcccgtg

SEQ ID NO: 204370 - DNA, 25 bp, Homo sapien
actggcaggcgaaggacatgccgaa

SEQ ID NO: 204371 - DNA, 25 bp, Homo sapien
gacgcaggcgggactcagcatcccg

SEQ ID NO: 204372 - DNA, 25 bp, Homo sapien
cttgagagaggagagcacgatctgc

SEQ ID NO: 204373 - DNA, 25 bp, Homo sapien
gcccactgaagaggccgtgcttgag

SEQ ID NO: 204374 - DNA, 25 bp, Homo sapien
actgcccactgaagaggccgtgctt

SEQ ID NO: 204375 - DNA, 25 bp, Homo sapien
agcggacgtagctgacccgccgcag

SEQ ID NO: 204376 - DNA, 25 bp, Homo sapien
ggaagacgccctcccagcggacgta

SEQ ID NO: 204377 - DNA, 25 bp, Homo sapien
ggatgcagcggaagacgccctccca

SEQ ID NO: 204378 - DNA, 25 bp, Homo sapien
agcgggagcacgatgcacagcgaca

SEQ ID NO: 204379 - DNA, 25 bp, Homo sapien
ggaggccatcatgttccgctgcagg

SEQ ID NO: 204380 - DNA, 25 bp, Homo sapien
gctgccgactcaccacgaacatgaa

SEQ ID NO: 204381 - DNA, 25 bp, Homo sapien
cgggctctctgcactgacagggagt

SEQ ID NO: 204382 - DNA, 25 bp, Homo sapien
gctctcacagccactgtgccgtgtg

SEQ ID NO: 204383 - DNA, 25 bp, Homo sapien
agccgacggcatccaggtgaatgac

SEQ ID NO: 204384 - DNA, 25 bp, Homo sapien
cgacacggcgaacagcaggaacatg

SEQ ID NO: 204385 - DNA, 25 bp, Homo sapien
gaacatgcggaaggtgccgcccacc

SEQ ID NO: 204386 - DNA, 25 bp, Homo sapien
ctctgaccgcccaggatgcgacttg

SEQ ID NO: 204387 - DNA, 25 bp, Homo sapien
gcccaggatgcgacttggacacatc

SEQ ID NO: 204388 - DNA, 25 bp, Homo sapien
ttggacacatccgaaagggcctagc

SEQ ID NO: 204389 - DNA, 25 bp, Homo sapien
acacatccgaaagggcctagcggga

SEQ ID NO: 204390 - DNA, 25 bp, Homo sapien
cacttggggagcgaagaccttccct

SEQ ID NO: 204391 - DNA, 25 bp, Homo sapien
ccttgcctctcaggcggcagaaaga

SEQ ID NO: 204392 - DNA, 25 bp, Homo sapien
agccgagcgtgagccagtgcaccag

SEQ ID NO: 204393 - DNA, 25 bp, Homo sapien
ctcccaccaccgtgatgcccgaatc

SEQ ID NO: 204394 - DNA, 25 bp, Homo sapien
cgatgaggagcatgcgttcccgacg

SEQ ID NO: 204395 - DNA, 25 bp, Homo sapien
cgcacccagagatgcggtgcatgtg

SEQ ID NO: 204396 - DNA, 25 bp, Homo sapien
ggctccaaggcgcacccagagatgc

SEQ ID NO: 204397 - DNA, 25 bp, Homo sapien
gctgactcagcagggtccctcccag

SEQ ID NO: 204398 - DNA, 25 bp, Homo sapien
agcagatgagaaacggcgctgactc

SEQ ID NO: 204399 - DNA, 25 bp, Homo sapien
gccctgaccgcgggattctctgcag

SEQ ID NO: 204400 - DNA, 25 bp, Homo sapien
cggccgaatgcggaaggagccgcca

SEQ ID NO: 204401 - DNA, 25 bp, Homo sapien
ggagccgccattctctccgccctga

SEQ ID NO: 204402 - DNA, 25 bp, Homo sapien
ctttaaccaggacgacccagccaga

SEQ ID NO: 204403 - DNA, 25 bp, Homo sapien
cagagccagctagggacacctcagc

SEQ ID NO: 204404 - DNA, 25 bp, Homo sapien
tgtgaatctccgagcccagacccgg

SEQ ID NO: 204405 - DNA, 25 bp, Homo sapien
aggccacggtcacaggtcccaacgt

SEQ ID NO: 204406 - DNA, 25 bp, Homo sapien
ggcccaccggactcacctgtttgaa

SEQ ID NO: 204407 - DNA, 25 bp, Homo sapien
acggattctctacgggaactgcgcc

SEQ ID NO: 204408 - DNA, 25 bp, Homo sapien
gtgcgcttctcatccacggattctc

SEQ ID NO: 204409 - DNA, 25 bp, Homo sapien
ccctacgatgctgttcacgatgttc

SEQ ID NO: 204410 - DNA, 25 bp, Homo sapien
agctgcccacaaccggcaggacagg

SEQ ID NO: 204411 - DNA, 25 bp, Homo sapien
ccacaaccggcaggacaggtcggtg

SEQ ID NO: 204412 - DNA, 25 bp, Homo sapien
ggaatgcaggaatgctgcgtgccca

SEQ ID NO: 204413 - DNA, 25 bp, Homo sapien
atgcaggaatgctgcgtgcccaggc

SEQ ID NO: 204414 - DNA, 25 bp, Homo sapien
tgcgcccgcccaaggggctctccag

SEQ ID NO: 204415 - DNA, 25 bp, Homo sapien
cccaaggggctctccagctgcgcag

SEQ ID NO: 204416 - DNA, 25 bp, Homo sapien
cggaagctgcccacaaccggcagga

SEQ ID NO: 204417 - DNA, 25 bp, Homo sapien
atgtgggcaacgcagctgggagtcc

SEQ ID NO: 204418 - DNA, 25 bp, Homo sapien
ccgtacaaacggatcctggagtcca

SEQ ID NO: 204419 - DNA, 25 bp, Homo sapien
ccggcgcaggccaatggaatcacgc

SEQ ID NO: 204420 - DNA, 25 bp, Homo sapien
acgctgtgttctgtgactccgtaca

SEQ ID NO: 204421 - DNA, 25 bp, Homo sapien
ctcggacgagcgataacgctgtgtt

SEQ ID NO: 204422 - DNA, 25 bp, Homo sapien
agccctactgtgcacgtttccgcga

SEQ ID NO: 204423 - DNA, 25 bp, Homo sapien
tcgcccagctagagccggcaggatc

SEQ ID NO: 204424 - DNA, 25 bp, Homo sapien
ccttctgcgtccgagttcccaggtt

SEQ ID NO: 204425 - DNA, 25 bp, Homo sapien
tcctggagtccagggaaagcgtccc

SEQ ID NO: 204426 - DNA, 25 bp, Homo sapien
cgtgcgctgagaatgtcgacgtttc

SEQ ID NO: 204427 - DNA, 25 bp, Homo sapien
acgtttcaaacgagccagcagagcg

SEQ ID NO: 204428 - DNA, 25 bp, Homo sapien
tttcgagggcgcttcctctaccctg

SEQ ID NO: 204429 - DNA, 25 bp, Homo sapien
caaagtagcgccgaagaccctgccg

SEQ ID NO: 204430 - DNA, 25 bp, Homo sapien
cagaagtgacagcagaatgggccgc

SEQ ID NO: 204431 - DNA, 25 bp, Homo sapien
cgccgttgctggagaataggtcaga

SEQ ID NO: 204432 - DNA, 25 bp, Homo sapien
aatccgtcttcaacaaacctcgcga

SEQ ID NO: 204433 - DNA, 25 bp, Homo sapien
attatccgtatttcccacactgggg

SEQ ID NO: 204434 - DNA, 25 bp, Homo sapien
cgctaggcccacgacaggacttcta

SEQ ID NO: 204435 - DNA, 25 bp, Homo sapien
gccatgggtaccaaacccgactcta

SEQ ID NO: 204436 - DNA, 25 bp, Homo sapien
actctaggcggtcattcactttgtc

SEQ ID NO: 204437 - DNA, 25 bp, Homo sapien
ttcgctcaaccggaggcagcagctc

SEQ ID NO: 204438 - DNA, 25 bp, Homo sapien
cggaaaagatccatccaagcgggta

SEQ ID NO: 204439 - DNA, 25 bp, Homo sapien
aggggtccctgcaaatgcccttggg

SEQ ID NO: 204440 - DNA, 25 bp, Homo sapien
aaatgagatccctggctttggtgca

SEQ ID NO: 204441 - DNA, 25 bp, Homo sapien
ggaccataaatctgcggcgcctttt

SEQ ID NO: 204442 - DNA, 25 bp, Homo sapien
gccagcaaagcaggcggcgctttta

SEQ ID NO: 204443 - DNA, 25 bp, Homo sapien
gctctggaatctgggagaagcctcc

SEQ ID NO: 204444 - DNA, 25 bp, Homo sapien
ggtttcgctccgctctcgtcaattt

SEQ ID NO: 204445 - DNA, 25 bp, Homo sapien
caattttctgtttaatgtcaccggg

SEQ ID NO: 204446 - DNA, 25 bp, Homo sapien
cgtcacccgggccataaatttgcgg

SEQ ID NO: 204447 - DNA, 25 bp, Homo sapien
agcgcacaaactcagggacgccctt

SEQ ID NO: 204448 - DNA, 25 bp, Homo sapien
ctcaggagactttttgcttggaaaa

SEQ ID NO: 204449 - DNA, 25 bp, Homo sapien
taaatttgcggtgatggcgcctccg

SEQ ID NO: 204450 - DNA, 25 bp, Homo sapien
tgaaattaaagcctttccgcgcctc

SEQ ID NO: 204451 - DNA, 25 bp, Homo sapien
acgaggcgctttctgcggaaacaaa

SEQ ID NO: 204452 - DNA, 25 bp, Homo sapien
tgaagccctagaggtcaccaggcgg

SEQ ID NO: 204453 - DNA, 25 bp, Homo sapien
ccctcttcccggtggctttgatatg

SEQ ID NO: 204454 - DNA, 25 bp, Homo sapien
cccgagaggatcagtccttggcaga

SEQ ID NO: 204455 - DNA, 25 bp, Homo sapien
gagtgcctctggtatcccgctaaag

SEQ ID NO: 204456 - DNA, 25 bp, Homo sapien
tgcagggatgcatttgccttaacga

SEQ ID NO: 204457 - DNA, 25 bp, Homo sapien
tggtgtaagacgagcaaatcctgtt

SEQ ID NO: 204458 - DNA, 25 bp, Homo sapien
ccagattcctttgatccgcgggctc

SEQ ID NO: 204459 - DNA, 25 bp, Homo sapien
gtccacttacccgagccaggagaga

SEQ ID NO: 204460 - DNA, 25 bp, Homo sapien
ttctcaagcgccatttctccggagc

SEQ ID NO: 204461 - DNA, 25 bp, Homo sapien
cgcgcccagggacctaattcaatcg

SEQ ID NO: 204462 - DNA, 25 bp, Homo sapien
tagccgcgcgctaatcggatctccg

SEQ ID NO: 204463 - DNA, 25 bp, Homo sapien
gcgcgcttcggggatttacgcttcc

SEQ ID NO: 204464 - DNA, 25 bp, Homo sapien
cccgactcaggcaggcgggaaatcc

SEQ ID NO: 204465 - DNA, 25 bp, Homo sapien
cagacgtcgcttccgaaggcgccgg

SEQ ID NO: 204466 - DNA, 25 bp, Homo sapien
gcgcaggcaggcgacagtaatccac

SEQ ID NO: 204467 - DNA, 25 bp, Homo sapien
gcagctcgcgctttctcaactttga

SEQ ID NO: 204468 - DNA, 25 bp, Homo sapien
cagtaatccacctcctgtttgctta

SEQ ID NO: 204469 - DNA, 25 bp, Homo sapien
aaaagctctctccaatccggtcaga

SEQ ID NO: 204470 - DNA, 25 bp, Homo sapien
ttccgaaatgccctcgtcagcgatt

SEQ ID NO: 204471 - DNA, 25 bp, Homo sapien
cctaggttcagttccttccgaaatg

SEQ ID NO: 204472 - DNA, 25 bp, Homo sapien
agggagccctgtgctcctaggttca

SEQ ID NO: 204473 - DNA, 25 bp, Homo sapien
tttgcttaaaaagtcgagcaggctg

SEQ ID NO: 204474 - DNA, 25 bp, Homo sapien
cgagcccaaaggagctacgggaatc

SEQ ID NO: 204475 - DNA, 25 bp, Homo sapien
cgtgctgccaccacgtctgattatc

SEQ ID NO: 204476 - DNA, 25 bp, Homo sapien
taggaatatccaggtcacgtgagta

SEQ ID NO: 204477 - DNA, 25 bp, Homo sapien
ccgccgcgctttctgtaggaatatc

SEQ ID NO: 204478 - DNA, 25 bp, Homo sapien
tgattatcccggtacggagccgccg

SEQ ID NO: 204479 - DNA, 25 bp, Homo sapien
cccgccgaagccctgtttggaatgt

SEQ ID NO: 204480 - DNA, 25 bp, Homo sapien
ttagacatcaaagttgccgcgagcc

SEQ ID NO: 204481 - DNA, 25 bp, Homo sapien
gtcccgctccataagtgacagagtt

SEQ ID NO: 204482 - DNA, 25 bp, Homo sapien
tatgggataatataccgtttcgctc

SEQ ID NO: 204483 - DNA, 25 bp, Homo sapien
gtttcgctcacgcaggcctatttgt

SEQ ID NO: 204484 - DNA, 25 bp, Homo sapien
aggcctatttgtcagtgggctgccc

SEQ ID NO: 204485 - DNA, 25 bp, Homo sapien
ccctgtttgttgtaatctataatat

SEQ ID NO: 204486 - DNA, 25 bp, Homo sapien
tataatattactgcctcccgtggcc

SEQ ID NO: 204487 - DNA, 25 bp, Homo sapien
gctgcagctgtccacacgattaggt

SEQ ID NO: 204488 - DNA, 25 bp, Homo sapien
tgtccacacgattaggttcccgatc

SEQ ID NO: 204489 - DNA, 25 bp, Homo sapien
cgcccgctgacgtttttatgggata

SEQ ID NO: 204490 - DNA, 25 bp, Homo sapien
ggtactgtgatcctagaattgtcca

SEQ ID NO: 204491 - DNA, 25 bp, Homo sapien
ggcgccatccttcagaatgcaggtt

SEQ ID NO: 204492 - DNA, 25 bp, Homo sapien
gactacgcgctctggaagacattga

SEQ ID NO: 204493 - DNA, 25 bp, Homo sapien
ctacagcctggcgaacgagagacta

SEQ ID NO: 204494 - DNA, 25 bp, Homo sapien
acaagcgtcgcgtttctgaggagaa

SEQ ID NO: 204495 - DNA, 25 bp, Homo sapien
cgagagccacttccggaacaagcgt

SEQ ID NO: 204496 - DNA, 25 bp, Homo sapien
cctgggaatcgtagtgctcgctaca

SEQ ID NO: 204497 - DNA, 25 bp, Homo sapien
tgtagttcatcaagcggaccgagga

SEQ ID NO: 204498 - DNA, 25 bp, Homo sapien
tcttccagggccaccagatgctgcg

SEQ ID NO: 204499 - DNA, 25 bp, Homo sapien
gggttcgtcacagcctcaccacgtg

SEQ ID NO: 204500 - DNA, 25 bp, Homo sapien
atcgctgccacgctgcgctgagaag

SEQ ID NO: 204501 - DNA, 25 bp, Homo sapien
ctggatcccggtgtggtctccgtct

SEQ ID NO: 204502 - DNA, 25 bp, Homo sapien
gccattacccgccacggtgtactat

SEQ ID NO: 204503 - DNA, 25 bp, Homo sapien
cggtgtactatcctcgccagcagct

SEQ ID NO: 204504 - DNA, 25 bp, Homo sapien
gcagccgtgcactctgcacgtttgc

SEQ ID NO: 204505 - DNA, 25 bp, Homo sapien
ggttcccattggagctctgcccttc

SEQ ID NO: 204506 - DNA, 25 bp, Homo sapien
ggggtgtctgacatcgttctccacg

SEQ ID NO: 204507 - DNA, 25 bp, Homo sapien
acgcgctgctgatcatcggtggatt

SEQ ID NO: 204508 - DNA, 25 bp, Homo sapien
gcacagcatcaacgcgctgctgatc

SEQ ID NO: 204509 - DNA, 25 bp, Homo sapien
acacagatgcgcacgcacagcatca

SEQ ID NO: 204510 - DNA, 25 bp, Homo sapien
tacttggaagagatcgccacacaga

SEQ ID NO: 204511 - DNA, 25 bp, Homo sapien
catcggtggattcgaggtacgttac

SEQ ID NO: 204512 - DNA, 25 bp, Homo sapien
gctattttcagcgttctcccgggga

SEQ ID NO: 204513 - DNA, 25 bp, Homo sapien
cgttctccacgtggctattttcagc

SEQ ID NO: 204514 - DNA, 25 bp, Homo sapien
cggcggctcacttaactcaaaacaa

SEQ ID NO: 204515 - DNA, 25 bp, Homo sapien
gtctcggcggctcacttaactcaaa

SEQ ID NO: 204516 - DNA, 25 bp, Homo sapien
cagaaaaggaggatgctgtctcggc

SEQ ID NO: 204517 - DNA, 25 bp, Homo sapien
cccatttcacagtttccagaaaagg

SEQ ID NO: 204518 - DNA, 25 bp, Homo sapien
ccgccatctcaacgaggcgtttttt

SEQ ID NO: 204519 - DNA, 25 bp, Homo sapien
ggagctgccgccatctcaacgaggc

SEQ ID NO: 204520 - DNA, 25 bp, Homo sapien
ggaagggcctcgctgcttctctgga

SEQ ID NO: 204521 - DNA, 25 bp, Homo sapien
tcaaaacaaatgctcgctctgccgg

SEQ ID NO: 204522 - DNA, 25 bp, Homo sapien
aaagaatggggagggtcagcagtcc

SEQ ID NO: 204523 - DNA, 25 bp, Homo sapien
cccggcccactgtgctccgctccaa

SEQ ID NO: 204524 - DNA, 25 bp, Homo sapien
actttaaatgtctgccctgccagca

SEQ ID NO: 204525 - DNA, 25 bp, Homo sapien
ccaggtgagagtagccgcctggccc

SEQ ID NO: 204526 - DNA, 25 bp, Homo sapien
cgacatcatcacatccgaaccaggt

SEQ ID NO: 204527 - DNA, 25 bp, Homo sapien
ccgaaccaggtgagagtagccgcct

SEQ ID NO: 204528 - DNA, 25 bp, Homo sapien
accaagctgccaccttgctgccatc

SEQ ID NO: 204529 - DNA, 25 bp, Homo sapien
ccgtgcactttaaatgtctgccctg

SEQ ID NO: 204530 - DNA, 25 bp, Homo sapien
aatgttctcgaacagtgcatttccc

SEQ ID NO: 204531 - DNA, 25 bp, Homo sapien
gccgctgctttctggatgcataaag

SEQ ID NO: 204532 - DNA, 25 bp, Homo sapien
cctgcggtccagtgctcccgggaaa

SEQ ID NO: 204533 - DNA, 25 bp, Homo sapien
caccaccgcgatgaagagaatgttc

SEQ ID NO: 204534 - DNA, 25 bp, Homo sapien
tggtcaccctgtgctggatgaggct

SEQ ID NO: 204535 - DNA, 25 bp, Homo sapien
acgaagctgacagtcttcagggctc

SEQ ID NO: 204536 - DNA, 25 bp, Homo sapien
gcgccgtggttgttgatagcacgaa

SEQ ID NO: 204537 - DNA, 25 bp, Homo sapien
ggatgcataaagctcaccaccgcga

SEQ ID NO: 204538 - DNA, 25 bp, Homo sapien
gctacaaattgcctctcccggcagg

SEQ ID NO: 204539 - DNA, 25 bp, Homo sapien
tgcacacctggctgtggcatcgtcc

SEQ ID NO: 204540 - DNA, 25 bp, Homo sapien
gtgttgcgtgcaggcctctttatct

SEQ ID NO: 204541 - DNA, 25 bp, Homo sapien
tctgcactgtataaagtcgttggtc

SEQ ID NO: 204542 - DNA, 25 bp, Homo sapien
gccggcgcgatgttattatccatta

SEQ ID NO: 204543 - DNA, 25 bp, Homo sapien
tccgagctcctccaaacacgattgg

SEQ ID NO: 204544 - DNA, 25 bp, Homo sapien
ctcccgggcctggtataattgtcct

SEQ ID NO: 204545 - DNA, 25 bp, Homo sapien
cccggcaggcccatttgcataaatc

SEQ ID NO: 204546 - DNA, 25 bp, Homo sapien
agttcgacgacaacagcagcttctc

SEQ ID NO: 204547 - DNA, 25 bp, Homo sapien
tgtgccatccacaaggaggacctgc

SEQ ID NO: 204548 - DNA, 25 bp, Homo sapien
agcgcgctcgtgtgccatccacaag

SEQ ID NO: 204549 - DNA, 25 bp, Homo sapien
gagccgcctgctggaaagcttcgcc

SEQ ID NO: 204550 - DNA, 25 bp, Homo sapien
gaaagcttcgccgtggaggaagact

SEQ ID NO: 204551 - DNA, 25 bp, Homo sapien
ggaagactttgagttcgacgacaac

SEQ ID NO: 204552 - DNA, 25 bp, Homo sapien
cccaaggaggatagcctgctgtacg

SEQ ID NO: 204553 - DNA, 25 bp, Homo sapien
atccacaaggaggacctgcgggacg

SEQ ID NO: 204554 - DNA, 25 bp, Homo sapien
ggggtgctgcagaacctcttccagc

SEQ ID NO: 204555 - DNA, 25 bp, Homo sapien
acccatatttggcaacggcttccgc

SEQ ID NO: 204556 - DNA, 25 bp, Homo sapien
caagacctgcaaggcgttgctcatg

SEQ ID NO: 204557 - DNA, 25 bp, Homo sapien
tgccacagctccttctcggacgagg

SEQ ID NO: 204558 - DNA, 25 bp, Homo sapien
tacagctcagacgacgaggacccgg

SEQ ID NO: 204559 - DNA, 25 bp, Homo sapien
aagaggccctgagcttctccaaagc

SEQ ID NO: 204560 - DNA, 25 bp, Homo sapien
tggaaaaccggccaaagatctcagc

SEQ ID NO: 204561 - DNA, 25 bp, Homo sapien
cccacaagctgctgcgggctaagaa

SEQ ID NO: 204562 - DNA, 25 bp, Homo sapien
caggacctctactacctggcgggca

SEQ ID NO: 204563 - DNA, 25 bp, Homo sapien
agggcaagacccaggctttcttacg

SEQ ID NO: 204564 - DNA, 25 bp, Homo sapien
tggcgtgcccatcctatgctgagcc

SEQ ID NO: 204565 - DNA, 25 bp, Homo sapien
aagagcgctccaggtgtcggaatcc

SEQ ID NO: 204566 - DNA, 25 bp, Homo sapien
agaacgacgtgcagaccatctccca

SEQ ID NO: 204567 - DNA, 25 bp, Homo sapien
tgtaccagtcctgccacgaggatga

SEQ ID NO: 204568 - DNA, 25 bp, Homo sapien
atccggtgacccttacagagcatgg

SEQ ID NO: 204569 - DNA, 25 bp, Homo sapien
tcccaagggcgcatctgagcaaata

SEQ ID NO: 204570 - DNA, 25 bp, Homo sapien
cctcacccgattggccgccgcacag

SEQ ID NO: 204571 - DNA, 25 bp, Homo sapien
cacctccgggttcgcgcgactgtga

SEQ ID NO: 204572 - DNA, 25 bp, Homo sapien
aaggccttcgctcctggtccctgag

SEQ ID NO: 204573 - DNA, 25 bp, Homo sapien
cagcgcctccgagccgggaaccgca

SEQ ID NO: 204574 - DNA, 25 bp, Homo sapien
ggaaccgcacagcacccggcgatgg

SEQ ID NO: 204575 - DNA, 25 bp, Homo sapien
gcgtagcgcgcgatcgaaccacgcg

SEQ ID NO: 204576 - DNA, 25 bp, Homo sapien
gcccgctgcggtcctctaacagccc

SEQ ID NO: 204577 - DNA, 25 bp, Homo sapien
cccagcgcctgaagcgcgggtcctt

SEQ ID NO: 204578 - DNA, 25 bp, Homo sapien
gcgcagcccgccacggaaagacagg

SEQ ID NO: 204579 - DNA, 25 bp, Homo sapien
ccacgggaccgtttctgcattttca

SEQ ID NO: 204580 - DNA, 25 bp, Homo sapien
tcgcgctctcggctcttgcttggat

SEQ ID NO: 204581 - DNA, 25 bp, Homo sapien
cgctgtgagaaacgaacgtccgtga

SEQ ID NO: 204582 - DNA, 25 bp, Homo sapien
tggcgtgaaccagcagatcaacctc

SEQ ID NO: 204583 - DNA, 25 bp, Homo sapien
gccggttcgcaatcctggcgtgaac

SEQ ID NO: 204584 - DNA, 25 bp, Homo sapien
tgcgacctgaactcggctctgcggc

SEQ ID NO: 204585 - DNA, 25 bp, Homo sapien
ccaacctggagagctgcagcacagc

SEQ ID NO: 204586 - DNA, 25 bp, Homo sapien
ggccaggaatcttggaagaaaccga

SEQ ID NO: 204587 - DNA, 25 bp, Homo sapien
gtctcaatggctttcgccggggacc

SEQ ID NO: 204588 - DNA, 25 bp, Homo sapien
gacgtccagctggtgtctcaatggc

SEQ ID NO: 204589 - DNA, 25 bp, Homo sapien
ctgagtcaggtacaccagcaggagc

SEQ ID NO: 204590 - DNA, 25 bp, Homo sapien
catgacagcctctcggtggacccag

SEQ ID NO: 204591 - DNA, 25 bp, Homo sapien
aggtggtcggcacccattcccaggc

SEQ ID NO: 204592 - DNA, 25 bp, Homo sapien
cgaggagccgattcggttcggttca

SEQ ID NO: 204593 - DNA, 25 bp, Homo sapien
cccttcccgtgacaggggaatctgg

SEQ ID NO: 204594 - DNA, 25 bp, Homo sapien
tttgtccgcgactggagagagttca

SEQ ID NO: 204595 - DNA, 25 bp, Homo sapien
cgtcgacgttctaggaagatgtcta

SEQ ID NO: 204596 - DNA, 25 bp, Homo sapien
taggactctattccgccctcgaggc

SEQ ID NO: 204597 - DNA, 25 bp, Homo sapien
cggcagagccattgcgggtaaacct

SEQ ID NO: 204598 - DNA, 25 bp, Homo sapien
tcggctgcatctgggacattcgaca

SEQ ID NO: 204599 - DNA, 25 bp, Homo sapien
agccctggaaggactgtgatttgtc

SEQ ID NO: 204600 - DNA, 25 bp, Homo sapien
ggatcctttctaaccgcccggagca

SEQ ID NO: 204601 - DNA, 25 bp, Homo sapien
cctcgctttctggttcaggacgcca

SEQ ID NO: 204602 - DNA, 25 bp, Homo sapien
gccgggatcacggactcgctggcct

SEQ ID NO: 204603 - DNA, 25 bp, Homo sapien
aaggcctcaggtagccgcggcctcg

SEQ ID NO: 204604 - DNA, 25 bp, Homo sapien
gggcagcctactgacccgaccctga

SEQ ID NO: 204605 - DNA, 25 bp, Homo sapien
ctgcacaaaggcctcaggtagccgc

SEQ ID NO: 204606 - DNA, 25 bp, Homo sapien
gacagcccttcgcgggctctaaagg

SEQ ID NO: 204607 - DNA, 25 bp, Homo sapien
ggaaaagggtctcgcacgtgcgccc

SEQ ID NO: 204608 - DNA, 25 bp, Homo sapien
ctgaagttggggctccgtcctgcct

SEQ ID NO: 204609 - DNA, 25 bp, Homo sapien
gagccgcgcatccattggccgagag

SEQ ID NO: 204610 - DNA, 25 bp, Homo sapien
agcctcacgcatcctgccggggtgg

SEQ ID NO: 204611 - DNA, 25 bp, Homo sapien
ctcacgggccacggatgggagccca

SEQ ID NO: 204612 - DNA, 25 bp, Homo sapien
gaggatgagcctctgaccagggccg

SEQ ID NO: 204613 - DNA, 25 bp, Homo sapien
cacagtcacagccagtggcccgcag

SEQ ID NO: 204614 - DNA, 25 bp, Homo sapien
tggcccgcagttctgaggcccctgg

SEQ ID NO: 204615 - DNA, 25 bp, Homo sapien
ctggcaccgctgaggcgtccctgga

SEQ ID NO: 204616 - DNA, 25 bp, Homo sapien
tgaggcgtccctggagcttcctcac

SEQ ID NO: 204617 - DNA, 25 bp, Homo sapien
ccagctcgcagcctgacgtcggcct

SEQ ID NO: 204618 - DNA, 25 bp, Homo sapien
gtcctggatatgctctgggaagcca

SEQ ID NO: 204619 - DNA, 25 bp, Homo sapien
gtctctggtctcctccgaagcttct

SEQ ID NO: 204620 - DNA, 25 bp, Homo sapien
cctccgaagcttctttgtctaggaa

SEQ ID NO: 204621 - DNA, 25 bp, Homo sapien
tggcgcggccatatttggcgacttc

SEQ ID NO: 204622 - DNA, 25 bp, Homo sapien
cttatttagtcaaggaggccgccga

SEQ ID NO: 204623 - DNA, 25 bp, Homo sapien
ctggaccgcgcgctgtgatttttct

SEQ ID NO: 204624 - DNA, 25 bp, Homo sapien
tttttctgtttagcagcggggcctc

SEQ ID NO: 204625 - DNA, 25 bp, Homo sapien
acccttctggaaccagtgccggaga

SEQ ID NO: 204626 - DNA, 25 bp, Homo sapien
ccggaaccgctcattgccaatggtg

SEQ ID NO: 204627 - DNA, 25 bp, Homo sapien
ggccgagcctcacctgagtcatctt

SEQ ID NO: 204628 - DNA, 25 bp, Homo sapien
gcctggaacagcgaaagaaacactt

SEQ ID NO: 204629 - DNA, 25 bp, Homo sapien
tgacaatgccagtggtgcgcccaga

SEQ ID NO: 204630 - DNA, 25 bp, Homo sapien
cccgtctccagagtccatgacaatg

SEQ ID NO: 204631 - DNA, 25 bp, Homo sapien
cagctcgtagctcttctccagagaa

SEQ ID NO: 204632 - DNA, 25 bp, Homo sapien
agtcatcttctctctgttggccttg

SEQ ID NO: 204633 - DNA, 25 bp, Homo sapien
cctgctcgaagtccagggcgacgta

SEQ ID NO: 204634 - DNA, 25 bp, Homo sapien
tctggtcacctgtagacattatagg

SEQ ID NO: 204635 - DNA, 25 bp, Homo sapien
cctgggacgtcccttgcaatctttc

SEQ ID NO: 204636 - DNA, 25 bp, Homo sapien
aggcctttgtttcattctggtcacc

SEQ ID NO: 204637 - DNA, 25 bp, Homo sapien
atgggagccctgacttttttgaagg

SEQ ID NO: 204638 - DNA, 25 bp, Homo sapien
gggataccctcttctgtttacgatg

SEQ ID NO: 204639 - DNA, 25 bp, Homo sapien
cgtgggtttagccacaggcttgtcc

SEQ ID NO: 204640 - DNA, 25 bp, Homo sapien
tctccgttcgtttgaagaccgaggc

SEQ ID NO: 204641 - DNA, 25 bp, Homo sapien
gatctttccgaaagccgggcaccca

SEQ ID NO: 204642 - DNA, 25 bp, Homo sapien
gggctgcacgccctaacttggtgcg

SEQ ID NO: 204643 - DNA, 25 bp, Homo sapien
cctcagtcagggctgacgcggaaaa

SEQ ID NO: 204644 - DNA, 25 bp, Homo sapien
cttgagctggtctgcattcgggcaa

SEQ ID NO: 204645 - DNA, 25 bp, Homo sapien
tcagggtacccgagtcttagccacg

SEQ ID NO: 204646 - DNA, 25 bp, Homo sapien
caagcccggactctgtcagggtacc

SEQ ID NO: 204647 - DNA, 25 bp, Homo sapien
gggctgcctcttgtctgcggagaat

SEQ ID NO: 204648 - DNA, 25 bp, Homo sapien
tctccaggtgtctccactcgaggga

SEQ ID NO: 204649 - DNA, 25 bp, Homo sapien
ctctgcagagcgactaggtcagggc

SEQ ID NO: 204650 - DNA, 25 bp, Homo sapien
gctgggcccacgctatgaggaaaag

SEQ ID NO: 204651 - DNA, 25 bp, Homo sapien
tcatcttccggagccgacggtactg

SEQ ID NO: 204652 - DNA, 25 bp, Homo sapien
ttcggcttcaaggtcaatgcctcgg

SEQ ID NO: 204653 - DNA, 25 bp, Homo sapien
atccagtttggcctcgtcaacgaca

SEQ ID NO: 204654 - DNA, 25 bp, Homo sapien
tgcaccaggtgctgaagatccagtt

SEQ ID NO: 204655 - DNA, 25 bp, Homo sapien
gccagcctgaagatgccgacgaacg

SEQ ID NO: 204656 - DNA, 25 bp, Homo sapien
tgcaatccgggagtggctgaaatcc

SEQ ID NO: 204657 - DNA, 25 bp, Homo sapien
cggtactgcctcaagtcctgtgaca

SEQ ID NO: 204658 - DNA, 25 bp, Homo sapien
ccgccaggcaaggacgaagagttca

SEQ ID NO: 204659 - DNA, 25 bp, Homo sapien
gtcgcgcattaaaaccgtgtctctc

SEQ ID NO: 204660 - DNA, 25 bp, Homo sapien
gaagagttcaccctcaagctcatca

SEQ ID NO: 204661 - DNA, 25 bp, Homo sapien
acctgagcttcagcgacggcgccta

SEQ ID NO: 204662 - DNA, 25 bp, Homo sapien
aacgcgccgaggacttcgtcttcga

SEQ ID NO: 204663 - DNA, 25 bp, Homo sapien
ttcgtcttcgagttccgtgagcgcg

SEQ ID NO: 204664 - DNA, 25 bp, Homo sapien
tctacgacgtcttccacctgagctt

SEQ ID NO: 204665 - DNA, 25 bp, Homo sapien
ccagaccagcctgtcgcgcattaaa

SEQ ID NO: 204666 - DNA, 25 bp, Homo sapien
gaggtactgcacacggagatcagga

SEQ ID NO: 204667 - DNA, 25 bp, Homo sapien
tggatctggcggaggtactgcacac

SEQ ID NO: 204668 - DNA, 25 bp, Homo sapien
atgcgctgtgaggactctgcggacc

SEQ ID NO: 204669 - DNA, 25 bp, Homo sapien
cctggcgatgggcgctcctggctac

SEQ ID NO: 204670 - DNA, 25 bp, Homo sapien
catgggagcgaagcccatgcgctgt

SEQ ID NO: 204671 - DNA, 25 bp, Homo sapien
aaccgggtgctcacctcgtggttgg

SEQ ID NO: 204672 - DNA, 25 bp, Homo sapien
aagcccatgcgctgtgaggactctg

SEQ ID NO: 204673 - DNA, 25 bp, Homo sapien
ccaggcccatgggagcgaagcccat

SEQ ID NO: 204674 - DNA, 25 bp, Homo sapien
ggcgcacagcgcgtacagcaacctg

SEQ ID NO: 204675 - DNA, 25 bp, Homo sapien
acgcctcgattctctgggctctcgg

SEQ ID NO: 204676 - DNA, 25 bp, Homo sapien
ggcttttgcgtaaacgcctcgattc

SEQ ID NO: 204677 - DNA, 25 bp, Homo sapien
agcgctcagctactcgggcttttgc

SEQ ID NO: 204678 - DNA, 25 bp, Homo sapien
tcctggccgagcagaggttgctctt

SEQ ID NO: 204679 - DNA, 25 bp, Homo sapien
gtacacgtagacgagctcgctcccg

SEQ ID NO: 204680 - DNA, 25 bp, Homo sapien
gccctcctggtcgtacacgtagacg

SEQ ID NO: 204681 - DNA, 25 bp, Homo sapien
gggcccgcggtcttcattttcacgc

SEQ ID NO: 204682 - DNA, 25 bp, Homo sapien
aggggcccagccactacagagaaag

SEQ ID NO: 204683 - DNA, 25 bp, Homo sapien
agggcggtttctcttcgccacagtc

SEQ ID NO: 204684 - DNA, 25 bp, Homo sapien
tcttcgccacagtccattctccctg

SEQ ID NO: 204685 - DNA, 25 bp, Homo sapien
aggagggcggtttctcttcgccaca

SEQ ID NO: 204686 - DNA, 25 bp, Homo sapien
tgcttagaaaggctcggcctttccc

SEQ ID NO: 204687 - DNA, 25 bp, Homo sapien
gggcccagccactacagagaaagcc

SEQ ID NO: 204688 - DNA, 25 bp, Homo sapien
gaaagccctggcgagagaagagaaa

SEQ ID NO: 204689 - DNA, 25 bp, Homo sapien
cctgcttagaaaggctcggcctttc

SEQ ID NO: 204690 - DNA, 25 bp, Homo sapien
agaactgacgattccatgcgccttg

SEQ ID NO: 204691 - DNA, 25 bp, Homo sapien
gcccggctaaaaagcgcggcctgcg

SEQ ID NO: 204692 - DNA, 25 bp, Homo sapien
cgcagctcagagagtggtgtacctg

SEQ ID NO: 204693 - DNA, 25 bp, Homo sapien
ctctgtcaacgaccagtgcggcttc

SEQ ID NO: 204694 - DNA, 25 bp, Homo sapien
ggtactttaactaactgcagctccc

SEQ ID NO: 204695 - DNA, 25 bp, Homo sapien
ccatgcgccttgcaggtactttaac

SEQ ID NO: 204696 - DNA, 25 bp, Homo sapien
agaccgccacgcacagggatacagg

SEQ ID NO: 204697 - DNA, 25 bp, Homo sapien
tctgtgcctggtcccagaagagcgg

SEQ ID NO: 204698 - DNA, 25 bp, Homo sapien
caacccgcctctgacttttagaagg

SEQ ID NO: 204699 - DNA, 25 bp, Homo sapien
tcgcagagtaaacccaacaagtgtt

SEQ ID NO: 204700 - DNA, 25 bp, Homo sapien
cccgtgcgctcctcaaattctgaga

SEQ ID NO: 204701 - DNA, 25 bp, Homo sapien
gtcaaactgctgacgggcgccgtta

SEQ ID NO: 204702 - DNA, 25 bp, Homo sapien
cactgattggccgacatgtgcgatc

SEQ ID NO: 204703 - DNA, 25 bp, Homo sapien
cagccggtagtattagcgaagtcgc

SEQ ID NO: 204704 - DNA, 25 bp, Homo sapien
gcggcgacaggccttcaacgtcaaa

SEQ ID NO: 204705 - DNA, 25 bp, Homo sapien
tcttgatactttgaccgcggccatt

SEQ ID NO: 204706 - DNA, 25 bp, Homo sapien
tgctcaaccgcactctatgggatcg

SEQ ID NO: 204707 - DNA, 25 bp, Homo sapien
atccagctggtgaacgcgaccattg

SEQ ID NO: 204708 - DNA, 25 bp, Homo sapien
tggaatgtgacgctcttctcgctgc

SEQ ID NO: 204709 - DNA, 25 bp, Homo sapien
ctcccacaggggagcttacttgctc

SEQ ID NO: 204710 - DNA, 25 bp, Homo sapien
tggggctaccacttcgaagacaccg

SEQ ID NO: 204711 - DNA, 25 bp, Homo sapien
gctccgaaatggacccagatgctta

SEQ ID NO: 204712 - DNA, 25 bp, Homo sapien
gccatctactgcctctcggtgtctg

SEQ ID NO: 204713 - DNA, 25 bp, Homo sapien
tcctgcctggagatagtactgtgtg

SEQ ID NO: 204714 - DNA, 25 bp, Homo sapien
tgcttcctctcccaaggctaagcgg

SEQ ID NO: 204715 - DNA, 25 bp, Homo sapien
caggcgctcggcagatactgagaaa

SEQ ID NO: 204716 - DNA, 25 bp, Homo sapien
agacccgtcctggtacttgccgagc

SEQ ID NO: 204717 - DNA, 25 bp, Homo sapien
cgctccgccaggatcggttgaatga

SEQ ID NO: 204718 - DNA, 25 bp, Homo sapien
gcgagcgagtccttggttttgcctt

SEQ ID NO: 204719 - DNA, 25 bp, Homo sapien
tcccagtgtcccgtctttgtggttc

SEQ ID NO: 204720 - DNA, 25 bp, Homo sapien
cctcctgggctttcggagtgccttt

SEQ ID NO: 204721 - DNA, 25 bp, Homo sapien
gccaatcccggaccttcaggaagtc

SEQ ID NO: 204722 - DNA, 25 bp, Homo sapien
cccgagcagctaaagggtgagtccc

SEQ ID NO: 204723 - DNA, 25 bp, Homo sapien
ctcacctgtgcgaagcggtcaagga

SEQ ID NO: 204724 - DNA, 25 bp, Homo sapien
cgcgtccaattagcgcgcagcgtta

SEQ ID NO: 204725 - DNA, 25 bp, Homo sapien
cggaaggatatcctgcagccgtttc

SEQ ID NO: 204726 - DNA, 25 bp, Homo sapien
accggccactctcattggatagttc

SEQ ID NO: 204727 - DNA, 25 bp, Homo sapien
ttagggctcattgttccaagggcgc

SEQ ID NO: 204728 - DNA, 25 bp, Homo sapien
ggctggccttaagtcacgacctgac

SEQ ID NO: 204729 - DNA, 25 bp, Homo sapien
cggacttctcattggttcttagggc

SEQ ID NO: 204730 - DNA, 25 bp, Homo sapien
agagacagatggtcaggggcacaga

SEQ ID NO: 204731 - DNA, 25 bp, Homo sapien
cctgcctgttggaggctgacgggaa

SEQ ID NO: 204732 - DNA, 25 bp, Homo sapien
aatttggaggcatttctggagcggc

SEQ ID NO: 204733 - DNA, 25 bp, Homo sapien
ctctgaatttggaggcatttctgga

SEQ ID NO: 204734 - DNA, 25 bp, Homo sapien
gtctggagcccgctctgaatttgga

SEQ ID NO: 204735 - DNA, 25 bp, Homo sapien
cgagagggccgtagacgcgaggcca

SEQ ID NO: 204736 - DNA, 25 bp, Homo sapien
ctgcacgtcacaccgggacggcgtc

SEQ ID NO: 204737 - DNA, 25 bp, Homo sapien
cgcacgccgtcctgcacgtcacacc

SEQ ID NO: 204738 - DNA, 25 bp, Homo sapien
atgactcggccgtgctctcactctt

SEQ ID NO: 204739 - DNA, 25 bp, Homo sapien
ctgaaggcgctgcagaacgccgtca

SEQ ID NO: 204740 - DNA, 25 bp, Homo sapien
agaacgccgtcaccaccttcgtgaa

SEQ ID NO: 204741 - DNA, 25 bp, Homo sapien
ttcgtgaaccgcatgaagagtaacc

SEQ ID NO: 204742 - DNA, 25 bp, Homo sapien
gggccgcagcatcaccaatgactcg

SEQ ID NO: 204743 - DNA, 25 bp, Homo sapien
actcttccagtccatcaacggcatg

SEQ ID NO: 204744 - DNA, 25 bp, Homo sapien
ctcaaccagctggacgagcgcaggc

SEQ ID NO: 204745 - DNA, 25 bp, Homo sapien
aagagtaaccacatgcggggccgca

SEQ ID NO: 204746 - DNA, 25 bp, Homo sapien
agctgccgccacagacgacgctttt

SEQ ID NO: 204747 - DNA, 25 bp, Homo sapien
acccgtgagcgctgaagaaagaaca

SEQ ID NO: 204748 - DNA, 25 bp, Homo sapien
ctcgcatcgcgtacggacagaaacc

SEQ ID NO: 204749 - DNA, 25 bp, Homo sapien
aacgcgcctcctgagtgttgaaagc

SEQ ID NO: 204750 - DNA, 25 bp, Homo sapien
tttagctaggaaagaggatgtcgcc

SEQ ID NO: 204751 - DNA, 25 bp, Homo sapien
gaggctctgcctgttctgatctgaa

SEQ ID NO: 204752 - DNA, 25 bp, Homo sapien
tcacatccaggcctcttaggggagc

SEQ ID NO: 204753 - DNA, 25 bp, Homo sapien
cgaggtacggctagagcgtcatttc

SEQ ID NO: 204754 - DNA, 25 bp, Homo sapien
gccgcacagacctactgtggcggga

SEQ ID NO: 204755 - DNA, 25 bp, Homo sapien
cggcaccgtggttctggagtagcct

SEQ ID NO: 204756 - DNA, 25 bp, Homo sapien
ctccagctcggaggacttgtgttca

SEQ ID NO: 204757 - DNA, 25 bp, Homo sapien
gggagaattgcctgcgccacgcagc

SEQ ID NO: 204758 - DNA, 25 bp, Homo sapien
cgccaccggtgaatgtgcctctggt

SEQ ID NO: 204759 - DNA, 25 bp, Homo sapien
ctggtggctgctgagaaaaatacac

SEQ ID NO: 204760 - DNA, 25 bp, Homo sapien
tacactgtgcagctcagtgtgtgga

SEQ ID NO: 204761 - DNA, 25 bp, Homo sapien
cccagtggagccgtttgggagaatt

SEQ ID NO: 204762 - DNA, 25 bp, Homo sapien
cgccgagacgcctgcaaaggcagca

SEQ ID NO: 204763 - DNA, 25 bp, Homo sapien
ggcttcccagttctcggcaggtggc

SEQ ID NO: 204764 - DNA, 25 bp, Homo sapien
agccggcttcccagttctcggcagg

SEQ ID NO: 204765 - DNA, 25 bp, Homo sapien
cgagacgcctgcaaaggcagcagcc

SEQ ID NO: 204766 - DNA, 25 bp, Homo sapien
cctgctgcacgcacccgctggacct

SEQ ID NO: 204767 - DNA, 25 bp, Homo sapien
gctctcctgggccatggcagccgag

SEQ ID NO: 204768 - DNA, 25 bp, Homo sapien
cgccgggcccgcctcaatcgcaggg

SEQ ID NO: 204769 - DNA, 25 bp, Homo sapien
cccgacgcccggatggccgatcccg

SEQ ID NO: 204770 - DNA, 25 bp, Homo sapien
cggttcgccatctacgagactgtgc

SEQ ID NO: 204771 - DNA, 25 bp, Homo sapien
tccacgagaaggtgttgctgggctc

SEQ ID NO: 204772 - DNA, 25 bp, Homo sapien
catctacgagactgtgcgggaccgt

SEQ ID NO: 204773 - DNA, 25 bp, Homo sapien
acgccgtgtgtcagcacggctcatc

SEQ ID NO: 204774 - DNA, 25 bp, Homo sapien
gggtttgtgtcaccgcaggtttagc

SEQ ID NO: 204775 - DNA, 25 bp, Homo sapien
tcagcacggctcatctctggggttt

SEQ ID NO: 204776 - DNA, 25 bp, Homo sapien
gggacgcccgcagacttggtcaacg

SEQ ID NO: 204777 - DNA, 25 bp, Homo sapien
catctctggggtttgtgtcaccgca

SEQ ID NO: 204778 - DNA, 25 bp, Homo sapien
cacctgggagtcacgtttattgaaa

SEQ ID NO: 204779 - DNA, 25 bp, Homo sapien
tccgagaatcggaggcatcctcagg

SEQ ID NO: 204780 - DNA, 25 bp, Homo sapien
tggacagaaaaagaatgcggacggc

SEQ ID NO: 204781 - DNA, 25 bp, Homo sapien
cacagggaccacgtgtgtagaccca

SEQ ID NO: 204782 - DNA, 25 bp, Homo sapien
taatcaggacaccaccacagggacc

SEQ ID NO: 204783 - DNA, 25 bp, Homo sapien
cggccagagcccagtaatcaggaca

SEQ ID NO: 204784 - DNA, 25 bp, Homo sapien
gtggcggaagctccggacctccctg

SEQ ID NO: 204785 - DNA, 25 bp, Homo sapien
tgtcacagtaaaaaattcacctggg

SEQ ID NO: 204786 - DNA, 25 bp, Homo sapien
tgaaccgagaggtgccgaaggaacc

SEQ ID NO: 204787 - DNA, 25 bp, Homo sapien
gagcctcggtacgacgcctttccga

SEQ ID NO: 204788 - DNA, 25 bp, Homo sapien
tggaattcccgtgcaggtttgtctc

SEQ ID NO: 204789 - DNA, 25 bp, Homo sapien
gttcctagaggacagagctggccca

SEQ ID NO: 204790 - DNA, 25 bp, Homo sapien
ctaccggagctactctgtcccagga

SEQ ID NO: 204791 - DNA, 25 bp, Homo sapien
agcgctctaggggattggccaccct

SEQ ID NO: 204792 - DNA, 25 bp, Homo sapien
tcagtcattggctccctgcggtttc

SEQ ID NO: 204793 - DNA, 25 bp, Homo sapien
ctccgtgagtcttctgtcagtcatt

SEQ ID NO: 204794 - DNA, 25 bp, Homo sapien
ctggtgctggcgacgtgttgacaca

SEQ ID NO: 204795 - DNA, 25 bp, Homo sapien
agagccgtctctggctccagcagct

SEQ ID NO: 204796 - DNA, 25 bp, Homo sapien
ctggtctggcttgagagccgtctct

SEQ ID NO: 204797 - DNA, 25 bp, Homo sapien
ctggccggatactccacagcctgga

SEQ ID NO: 204798 - DNA, 25 bp, Homo sapien
tggcgacgtgttgacacaggtcctc

SEQ ID NO: 204799 - DNA, 25 bp, Homo sapien
tgtggggccaaggacatgtgggcaa

SEQ ID NO: 204800 - DNA, 25 bp, Homo sapien
cccagactgccgagctggtgtgagc

SEQ ID NO: 204801 - DNA, 25 bp, Homo sapien
ttgacacaggtcctcgcggcatgct

SEQ ID NO: 204802 - DNA, 25 bp, Homo sapien
ctgcctgttgcgacggagtatgtaa

SEQ ID NO: 204803 - DNA, 25 bp, Homo sapien
ggcgaagaatccatcgggacacatc

SEQ ID NO: 204804 - DNA, 25 bp, Homo sapien
ttggctctatggtcccacgcatctc

SEQ ID NO: 204805 - DNA, 25 bp, Homo sapien
tcacttcgatgaccgccgtgtagcc

SEQ ID NO: 204806 - DNA, 25 bp, Homo sapien
agccaagtgctgtgtatatgacctg

SEQ ID NO: 204807 - DNA, 25 bp, Homo sapien
cgcgaagcgagaaagccactaggta

SEQ ID NO: 204808 - DNA, 25 bp, Homo sapien
gcgcagtgcagcctgatcccattca

SEQ ID NO: 204809 - DNA, 25 bp, Homo sapien
ctgggactctaccacgtgcgtattg

SEQ ID NO: 204810 - DNA, 25 bp, Homo sapien
gctcctccgattcgggcttgtactt

SEQ ID NO: 204811 - DNA, 25 bp, Homo sapien
ggccaaagaactcgaggatgcgctg

SEQ ID NO: 204812 - DNA, 25 bp, Homo sapien
ggacgcgcctgcaccttgattttgc

SEQ ID NO: 204813 - DNA, 25 bp, Homo sapien
tctgtgatcctctctgccgtcagct

SEQ ID NO: 204814 - DNA, 25 bp, Homo sapien
gaactctgtgatcctctctgccgtc

SEQ ID NO: 204815 - DNA, 25 bp, Homo sapien
gcggtggcagaactctgtgatcctc

SEQ ID NO: 204816 - DNA, 25 bp, Homo sapien
gcaccttgattttgccctccaggaa

SEQ ID NO: 204817 - DNA, 25 bp, Homo sapien
agaactcgaggatgcgctggttgtc

SEQ ID NO: 204818 - DNA, 25 bp, Homo sapien
ttctgccttggcttctaattggtgg

SEQ ID NO: 204819 - DNA, 25 bp, Homo sapien
tggctcccgacaagaactttttctg

SEQ ID NO: 204820 - DNA, 25 bp, Homo sapien
cacgcgagacactcaccgaggcatg

SEQ ID NO: 204821 - DNA, 25 bp, Homo sapien
ccggattcggaaacgctcctgagtg

SEQ ID NO: 204822 - DNA, 25 bp, Homo sapien
ttgccgctctcggattggacactca

SEQ ID NO: 204823 - DNA, 25 bp, Homo sapien
acttcgaggctcgtctttgccgctc

SEQ ID NO: 204824 - DNA, 25 bp, Homo sapien
cggcctcgcctttataaatcctggg

SEQ ID NO: 204825 - DNA, 25 bp, Homo sapien
tgttgcattctgactggaccgcgta

SEQ ID NO: 204826 - DNA, 25 bp, Homo sapien
taaatgacgaacgtcgtcggccgcc

SEQ ID NO: 204827 - DNA, 25 bp, Homo sapien
ggatccctcccgcactaaatgacga

SEQ ID NO: 204828 - DNA, 25 bp, Homo sapien
ttcggccgcgcggttcaggatccct

SEQ ID NO: 204829 - DNA, 25 bp, Homo sapien
ggggtcacgagacttccgctcactc

SEQ ID NO: 204830 - DNA, 25 bp, Homo sapien
ctgcctgtcacttccggggtcacga

SEQ ID NO: 204831 - DNA, 25 bp, Homo sapien
tgagacagaattcgtgcgcagcgcg

SEQ ID NO: 204832 - DNA, 25 bp, Homo sapien
tcagtggtcacctctgtaagccagg

SEQ ID NO: 204833 - DNA, 25 bp, Homo sapien
agacttccgctcactcgggcgggga

SEQ ID NO: 204834 - DNA, 25 bp, Homo sapien
ctgtgacgtgacaagctgaatgttc

SEQ ID NO: 204835 - DNA, 25 bp, Homo sapien
cgctagcaaggaagacgaaaccgtt

SEQ ID NO: 204836 - DNA, 25 bp, Homo sapien
ccggaaggaccctaagagcgacgca

SEQ ID NO: 204837 - DNA, 25 bp, Homo sapien
aggcctccgctgtgcgtcaatctgt

SEQ ID NO: 204838 - DNA, 25 bp, Homo sapien
cggcctgcggcaaagaatacgagaa

SEQ ID NO: 204839 - DNA, 25 bp, Homo sapien
tcatgccacctctgtttacgctagc

SEQ ID NO: 204840 - DNA, 25 bp, Homo sapien
agcgccacggtttctagtcatgcca

SEQ ID NO: 204841 - DNA, 25 bp, Homo sapien
cggaagtcacctctgtgcaggcctc

SEQ ID NO: 204842 - DNA, 25 bp, Homo sapien
tcagtttaatgatgtcgtccagaga

SEQ ID NO: 204843 - DNA, 25 bp, Homo sapien
tcaccctgctgtagggcgccggtcg

SEQ ID NO: 204844 - DNA, 25 bp, Homo sapien
cctcgattcactcgcgcggcggcct

SEQ ID NO: 204845 - DNA, 25 bp, Homo sapien
tcgctggctccggttcagtttaatg

SEQ ID NO: 204846 - DNA, 25 bp, Homo sapien
ggctccggttcagtttaatgatgtc

SEQ ID NO: 204847 - DNA, 25 bp, Homo sapien
gtcgtccagagacatgtccattttg

SEQ ID NO: 204848 - DNA, 25 bp, Homo sapien
tcagcacgccggcacgtcacttccg

SEQ ID NO: 204849 - DNA, 25 bp, Homo sapien
agagacatgtccattttgtcggcca

SEQ ID NO: 204850 - DNA, 25 bp, Homo sapien
gcgggacctaccagtgcaaggcgaa

SEQ ID NO: 204851 - DNA, 25 bp, Homo sapien
gggcacagctcctactcggtgggcc

SEQ ID NO: 204852 - DNA, 25 bp, Homo sapien
cccgcagttaatggcaaacgaataa

SEQ ID NO: 204853 - DNA, 25 bp, Homo sapien
cccaagcctgggtatgagaaggcag

SEQ ID NO: 204854 - DNA, 25 bp, Homo sapien
tgcaaggcgaacgtcttcctgtccc

SEQ ID NO: 204855 - DNA, 25 bp, Homo sapien
gctgtgtgcgtccaggacgtcgccc

SEQ ID NO: 204856 - DNA, 25 bp, Homo sapien
gcctggcctcgcgtggtacaagcca

SEQ ID NO: 204857 - DNA, 25 bp, Homo sapien
ccaaacctgcagaggtgcgagcggc

SEQ ID NO: 204858 - DNA, 25 bp, Homo sapien
aacgcacagccaatggcgtgtgccg

SEQ ID NO: 204859 - DNA, 25 bp, Homo sapien
cgcacagccaatggcgtgtgccgcg

SEQ ID NO: 204860 - DNA, 25 bp, Homo sapien
caaacgcacagccaatggcgtgtgc

SEQ ID NO: 204861 - DNA, 25 bp, Homo sapien
tccaaacgcacagccaatggcgtgt

SEQ ID NO: 204862 - DNA, 25 bp, Homo sapien
ctccaaacgcacagccaatggcgtg

SEQ ID NO: 204863 - DNA, 25 bp, Homo sapien
tggcgtgagcccctgacagagtccc

SEQ ID NO: 204864 - DNA, 25 bp, Homo sapien
cccaccgcacctccgcgcacggcca

SEQ ID NO: 204865 - DNA, 25 bp, Homo sapien
acggccaatggcgtgagcccctgac

SEQ ID NO: 204866 - DNA, 25 bp, Homo sapien
gcaccacaccctcacggcgcgcctg

SEQ ID NO: 204867 - DNA, 25 bp, Homo sapien
tggcacaataatctacagttgtccc

SEQ ID NO: 204868 - DNA, 25 bp, Homo sapien
tttttggcacaataatctacagttg

SEQ ID NO: 204869 - DNA, 25 bp, Homo sapien
tcagcggccgtcacgcgggcctcac

SEQ ID NO: 204870 - DNA, 25 bp, Homo sapien
gcctccgccagaggtagacggggtc

SEQ ID NO: 204871 - DNA, 25 bp, Homo sapien
acaggcaggtcgcacccgatgccca

SEQ ID NO: 204872 - DNA, 25 bp, Homo sapien
acccgatgcccacctacagggacgc

SEQ ID NO: 204873 - DNA, 25 bp, Homo sapien
tacagggacgctcgcccggaggcca

SEQ ID NO: 204874 - DNA, 25 bp, Homo sapien
ctctgagcgaaaacgagcgcggata

SEQ ID NO: 204875 - DNA, 25 bp, Homo sapien
tcttctggagtcgtttcctcagctc

SEQ ID NO: 204876 - DNA, 25 bp, Homo sapien
cgccggagcccaaattccaagtgga

SEQ ID NO: 204877 - DNA, 25 bp, Homo sapien
cgcagctgttgacgcgcttcttagc

SEQ ID NO: 204878 - DNA, 25 bp, Homo sapien
cgctgcatactgatgacagggaaca

SEQ ID NO: 204879 - DNA, 25 bp, Homo sapien
cggcggaaagagcaatcgctgcata

SEQ ID NO: 204880 - DNA, 25 bp, Homo sapien
ttcaaggccctcaacggcggaaaga

SEQ ID NO: 204881 - DNA, 25 bp, Homo sapien
ttgggcggcaccttctatctttgag

SEQ ID NO: 204882 - DNA, 25 bp, Homo sapien
ctgccaagacgccagggtggtcacc

SEQ ID NO: 204883 - DNA, 25 bp, Homo sapien
gggtcgtcgcacacctgccaagacg

SEQ ID NO: 204884 - DNA, 25 bp, Homo sapien
caagtatttggcgttccggacggcg

SEQ ID NO: 204885 - DNA, 25 bp, Homo sapien
tcaggatgcgcgacacctgcgggca

SEQ ID NO: 204886 - DNA, 25 bp, Homo sapien
cgcctgtgtagacgaccaagtattt

SEQ ID NO: 204887 - DNA, 25 bp, Homo sapien
attcccgcgcctgtgtagacgacca

SEQ ID NO: 204888 - DNA, 25 bp, Homo sapien
ttccgcttccgcctcacacggcagg

SEQ ID NO: 204889 - DNA, 25 bp, Homo sapien
agctccgttaccaggtccgcgctct

SEQ ID NO: 204890 - DNA, 25 bp, Homo sapien
cagcttcatgctggcgttctctgag

SEQ ID NO: 204891 - DNA, 25 bp, Homo sapien
tggcgttctctgaggccagcttctc

SEQ ID NO: 204892 - DNA, 25 bp, Homo sapien
gacgcgcgtccctacgatcgggcat

SEQ ID NO: 204893 - DNA, 25 bp, Homo sapien
gatcgggcatccgtcttggacttta

SEQ ID NO: 204894 - DNA, 25 bp, Homo sapien
gcatccgtcttggactttactattg

SEQ ID NO: 204895 - DNA, 25 bp, Homo sapien
ttactattgtgatgacgctggtggc

SEQ ID NO: 204896 - DNA, 25 bp, Homo sapien
cttcagctggacgatctcctccttg

SEQ ID NO: 204897 - DNA, 25 bp, Homo sapien
tgcagcgcctcgtacttggagcgca

SEQ ID NO: 204898 - DNA, 25 bp, Homo sapien
ggacactggtgacgctcgatggctc

SEQ ID NO: 204899 - DNA, 25 bp, Homo sapien
aaggacactggtgacgctcgatggc

SEQ ID NO: 204900 - DNA, 25 bp, Homo sapien
acgctcgatggctcggaaggacagt

SEQ ID NO: 204901 - DNA, 25 bp, Homo sapien
aggacactggtgacgctcgatggct

SEQ ID NO: 204902 - DNA, 25 bp, Homo sapien
actggtgacgctcgatggctcggaa

SEQ ID NO: 204903 - DNA, 25 bp, Homo sapien
gacgctcgatggctcggaaggacac

SEQ ID NO: 204904 - DNA, 25 bp, Homo sapien
acactggtgacgctcgatggctcgg

SEQ ID NO: 204905 - DNA, 25 bp, Homo sapien
acgctcgatggctcggaaggacact

SEQ ID NO: 204906 - DNA, 25 bp, Homo sapien
cgcacagcagaagagccgccagcta

SEQ ID NO: 204907 - DNA, 25 bp, Homo sapien
gccttcgccactagggaggccttca

SEQ ID NO: 204908 - DNA, 25 bp, Homo sapien
tctcaaatcgtctcgcccgcagatt

SEQ ID NO: 204909 - DNA, 25 bp, Homo sapien
cgccagtctgaaacccgaaggggat

SEQ ID NO: 204910 - DNA, 25 bp, Homo sapien
atgaggcggttccacgccagtctga

SEQ ID NO: 204911 - DNA, 25 bp, Homo sapien
ggaacaatttcttcagggcagaatc

SEQ ID NO: 204912 - DNA, 25 bp, Homo sapien
cgccagctaaaccttcggaacaatt

SEQ ID NO: 204913 - DNA, 25 bp, Homo sapien
gccggcaccttggaggatgtctaca

SEQ ID NO: 204914 - DNA, 25 bp, Homo sapien
gccgctccacagacgtcacatgatg

SEQ ID NO: 204915 - DNA, 25 bp, Homo sapien
tccattcatgaagcggcgacgcggc

SEQ ID NO: 204916 - DNA, 25 bp, Homo sapien
tgggctccattcatgaagcggcgac

SEQ ID NO: 204917 - DNA, 25 bp, Homo sapien
tcacgtgggctccattcatgaagcg

SEQ ID NO: 204918 - DNA, 25 bp, Homo sapien
gtttggtcacgtgggctccattcat

SEQ ID NO: 204919 - DNA, 25 bp, Homo sapien
cgtcacatgatgtttggtcacgtgg

SEQ ID NO: 204920 - DNA, 25 bp, Homo sapien
gctccacagacgtcacatgatgttt

SEQ ID NO: 204921 - DNA, 25 bp, Homo sapien
cacagacgtcacatgatgtttggtc

SEQ ID NO: 204922 - DNA, 25 bp, Homo sapien
ctgagccccgtgacggcatcaatca

SEQ ID NO: 204923 - DNA, 25 bp, Homo sapien
gttggtcatgcagcggatgaccctg

SEQ ID NO: 204924 - DNA, 25 bp, Homo sapien
acgactggagtgttggtcatgcagc

SEQ ID NO: 204925 - DNA, 25 bp, Homo sapien
ccacgactggagtgttggtcatgca

SEQ ID NO: 204926 - DNA, 25 bp, Homo sapien
tcccgcaccacgactggagtgttgg

SEQ ID NO: 204927 - DNA, 25 bp, Homo sapien
gggcgtgcgtgcctgtggcatacac

SEQ ID NO: 204928 - DNA, 25 bp, Homo sapien
tgctccatgagcctcccgtcctcca

SEQ ID NO: 204929 - DNA, 25 bp, Homo sapien
tggaagagaaaccagcgtgtccgtc

SEQ ID NO: 204930 - DNA, 25 bp, Homo sapien
ttgtcttgggccacccggacacgga

SEQ ID NO: 204931 - DNA, 25 bp, Homo sapien
accggcaggatcgagagcaagttag

SEQ ID NO: 204932 - DNA, 25 bp, Homo sapien
gccctccacgcagggctttgtcttg

SEQ ID NO: 204933 - DNA, 25 bp, Homo sapien
acccagctaccgtgcgcgggtcgta

SEQ ID NO: 204934 - DNA, 25 bp, Homo sapien
tggaggttccgcagaagaaatgact

SEQ ID NO: 204935 - DNA, 25 bp, Homo sapien
ctgtccggcccgttaactgcttcgg

SEQ ID NO: 204936 - DNA, 25 bp, Homo sapien
gacacggacgcgtccagctggcgtc

SEQ ID NO: 204937 - DNA, 25 bp, Homo sapien
tggtcccagctggtctaactttcca

SEQ ID NO: 204938 - DNA, 25 bp, Homo sapien
gccacgaaggcctggacgatcttga

SEQ ID NO: 204939 - DNA, 25 bp, Homo sapien
cccgtagcggctgtcatggaccagc

SEQ ID NO: 204940 - DNA, 25 bp, Homo sapien
agccgtggagccgtgtgaactcaca

SEQ ID NO: 204941 - DNA, 25 bp, Homo sapien
ccaggcggaagtccctggcagcaca

SEQ ID NO: 204942 - DNA, 25 bp, Homo sapien
ccatgcagaaggtgccctggacgcc

SEQ ID NO: 204943 - DNA, 25 bp, Homo sapien
acctccacagcgtaggccaggaaga

SEQ ID NO: 204944 - DNA, 25 bp, Homo sapien
acgcaccactgggtggccacgtagc

SEQ ID NO: 204945 - DNA, 25 bp, Homo sapien
gacaccgtggccatatagctgctca

SEQ ID NO: 204946 - DNA, 25 bp, Homo sapien
tgcaccacgaacacagggcctgcgg

SEQ ID NO: 204947 - DNA, 25 bp, Homo sapien
tgtgcctcgtcaaacagccactgca

SEQ ID NO: 204948 - DNA, 25 bp, Homo sapien
accgtcagctgtgcctcgtcaaaca

SEQ ID NO: 204949 - DNA, 25 bp, Homo sapien
cggccgaggttctggatgtacagcc

SEQ ID NO: 204950 - DNA, 25 bp, Homo sapien
tgcacgttgtccaccgtcagctgtg

SEQ ID NO: 204951 - DNA, 25 bp, Homo sapien
ctcacggcacgtccttgagtgtgtg

SEQ ID NO: 204952 - DNA, 25 bp, Homo sapien
ccgtcaggtgcacgttgtccaccgt

SEQ ID NO: 204953 - DNA, 25 bp, Homo sapien
tccttgagtgtgtggcgcagctcgc

SEQ ID NO: 204954 - DNA, 25 bp, Homo sapien
cagggtcgggtagaccttgtagcca

SEQ ID NO: 204955 - DNA, 25 bp, Homo sapien
tgccgcccactcacagcgcagggtc

SEQ ID NO: 204956 - DNA, 25 bp, Homo sapien
caaagctgcagcacgaggacgggcc

SEQ ID NO: 204957 - DNA, 25 bp, Homo sapien
ccttgtagccaaagaagcagttcca

SEQ ID NO: 204958 - DNA, 25 bp, Homo sapien
gccaaagaagcagttccactcctcg

SEQ ID NO: 204959 - DNA, 25 bp, Homo sapien
ccgttccagtacctggagccacagc

SEQ ID NO: 204960 - DNA, 25 bp, Homo sapien
ccacaggttaggctgccgtgggtct

SEQ ID NO: 204961 - DNA, 25 bp, Homo sapien
ccacagccacaggttaggctgccgt

SEQ ID NO: 204962 - DNA, 25 bp, Homo sapien
atccattgccatgcagtcacctgtc

SEQ ID NO: 204963 - DNA, 25 bp, Homo sapien
tcgcacacgtccgttgccacatggt

SEQ ID NO: 204964 - DNA, 25 bp, Homo sapien
ggtgggccgcgccatacacgtccat

SEQ ID NO: 204965 - DNA, 25 bp, Homo sapien
gccagccagctgtgctacacatgtc

SEQ ID NO: 204966 - DNA, 25 bp, Homo sapien
atcacaactgagtcggccggccaca

SEQ ID NO: 204967 - DNA, 25 bp, Homo sapien
acgtccattgccacgtgatcacacg

SEQ ID NO: 204968 - DNA, 25 bp, Homo sapien
tggcacatcacagctgaaccagccg

SEQ ID NO: 204969 - DNA, 25 bp, Homo sapien
agctgagctggccagccgcatcgca

SEQ ID NO: 204970 - DNA, 25 bp, Homo sapien
gcgtctggtagacacggatgccata

SEQ ID NO: 204971 - DNA, 25 bp, Homo sapien
cacatgggcatctggtagacacgga

SEQ ID NO: 204972 - DNA, 25 bp, Homo sapien
gcgtctggtagacacggatgccaca

SEQ ID NO: 204973 - DNA, 25 bp, Homo sapien
tgccacatgggcgtctggtagacac

SEQ ID NO: 204974 - DNA, 25 bp, Homo sapien
tggtagacacggatgccacatacgg

SEQ ID NO: 204975 - DNA, 25 bp, Homo sapien
tgccatatgggcgtctggtagacac

SEQ ID NO: 204976 - DNA, 25 bp, Homo sapien
cgtctggtagacacggatgccatat

SEQ ID NO: 204977 - DNA, 25 bp, Homo sapien
gtctggtagacacggatgccacata

SEQ ID NO: 204978 - DNA, 25 bp, Homo sapien
gccgtgaagtccagcgggaagctct

SEQ ID NO: 204979 - DNA, 25 bp, Homo sapien
catgttaccctccacggccgtgaag

SEQ ID NO: 204980 - DNA, 25 bp, Homo sapien
ttgcgccatgaagctgtccatgtta

SEQ ID NO: 204981 - DNA, 25 bp, Homo sapien
gccaggctcttgacttgcgccatga

SEQ ID NO: 204982 - DNA, 25 bp, Homo sapien
ggtacagggactgcgccaggctctt

SEQ ID NO: 204983 - DNA, 25 bp, Homo sapien
tcgttgcaggtcaccgaggtgttga

SEQ ID NO: 204984 - DNA, 25 bp, Homo sapien
cgggaagctctccacgggctgtccg

SEQ ID NO: 204985 - DNA, 25 bp, Homo sapien
tgcaggcgcaggtcctcgttgagct

SEQ ID NO: 204986 - DNA, 25 bp, Homo sapien
ggccatgtggacgtcctccttgcca

SEQ ID NO: 204987 - DNA, 25 bp, Homo sapien
aggagcttagggagaaagtcccagc

SEQ ID NO: 204988 - DNA, 25 bp, Homo sapien
cttagggagaaagtcccagcgccgc

SEQ ID NO: 204989 - DNA, 25 bp, Homo sapien
ccgcagacagccgagttacctgggc

SEQ ID NO: 204990 - DNA, 25 bp, Homo sapien
gccgagttacctgggctcttgtgaa

SEQ ID NO: 204991 - DNA, 25 bp, Homo sapien
agttacctgggctcttgtgaaacag

SEQ ID NO: 204992 - DNA, 25 bp, Homo sapien
tgtgaaacagagagaccaaacgctg

SEQ ID NO: 204993 - DNA, 25 bp, Homo sapien
ccaaacgctgggagctgttgccccg

SEQ ID NO: 204994 - DNA, 25 bp, Homo sapien
acgaccgcgctttccgggtctggcg

SEQ ID NO: 204995 - DNA, 25 bp, Homo sapien
ttgccgataaagttgtttgacgccg

SEQ ID NO: 204996 - DNA, 25 bp, Homo sapien
cgccacacggtgaaggtgacgccga

SEQ ID NO: 204997 - DNA, 25 bp, Homo sapien
cggcggccaatgagcggcctcctga

SEQ ID NO: 204998 - DNA, 25 bp, Homo sapien
cacggtgaaggtgacgccgagcacc

SEQ ID NO: 204999 - DNA, 25 bp, Homo sapien
agcaccgtgctgcttcaggtgcggc

SEQ ID NO: 205000 - DNA, 25 bp, Homo sapien
gaggcagaggacgaccgcgctttcc

SEQ ID NO: 205001 - DNA, 25 bp, Homo sapien
gcgagcccatccaagccgcgcttcc

SEQ ID NO: 205002 - DNA, 25 bp, Homo sapien
gggcctgctcccgtctgacagtagt

SEQ ID NO: 205003 - DNA, 25 bp, Homo sapien
tgcttcctgagacgagagtggcaga

SEQ ID NO: 205004 - DNA, 25 bp, Homo sapien
cagtgacggagcctaagagcaaagc

SEQ ID NO: 205005 - DNA, 25 bp, Homo sapien
acggaactcagacaacagtgacgga

SEQ ID NO: 205006 - DNA, 25 bp, Homo sapien
gagcacggaattctccctcccaaaa

SEQ ID NO: 205007 - DNA, 25 bp, Homo sapien
cgggttaagcacgagcacggaattc

SEQ ID NO: 205008 - DNA, 25 bp, Homo sapien
gtctgacagtagtgccgcgctgcat

SEQ ID NO: 205009 - DNA, 25 bp, Homo sapien
aaacagcgcggggaacagaagtcag

SEQ ID NO: 205010 - DNA, 25 bp, Homo sapien
gtgacagagcgctttacgacagttg

SEQ ID NO: 205011 - DNA, 25 bp, Homo sapien
atcggggttcataggacgtgcacaa

SEQ ID NO: 205012 - DNA, 25 bp, Homo sapien
tcggagtagcttcgctcccagaagg

SEQ ID NO: 205013 - DNA, 25 bp, Homo sapien
gaaggcctcaaagcgcgaccaaaga

SEQ ID NO: 205014 - DNA, 25 bp, Homo sapien
acgacagttgctttgaggcagtacc

SEQ ID NO: 205015 - DNA, 25 bp, Homo sapien
cagactgggaaagccgagaagtttc

SEQ ID NO: 205016 - DNA, 25 bp, Homo sapien
taccttactagctgctcggggagcc

SEQ ID NO: 205017 - DNA, 25 bp, Homo sapien
agccgagaagtttccactggggtga

SEQ ID NO: 205018 - DNA, 25 bp, Homo sapien
tcggctttgaaggaggacatcaggc

SEQ ID NO: 205019 - DNA, 25 bp, Homo sapien
gtaccctgactctcaggctcctgag

SEQ ID NO: 205020 - DNA, 25 bp, Homo sapien
gcacctcctcttagtgggcggctta

SEQ ID NO: 205021 - DNA, 25 bp, Homo sapien
ttagtgggcggcttaagatgaaagc

SEQ ID NO: 205022 - DNA, 25 bp, Homo sapien
agatgaaagcccagacgtcggtacc

SEQ ID NO: 205023 - DNA, 25 bp, Homo sapien
gacgtcggtaccctgactctcaggc

SEQ ID NO: 205024 - DNA, 25 bp, Homo sapien
ccctccatgcttcggtgacatcagg

SEQ ID NO: 205025 - DNA, 25 bp, Homo sapien
tgacatcaggcgtcggctttgaagg

SEQ ID NO: 205026 - DNA, 25 bp, Homo sapien
tcattttcaaaaccgagtgtggcgt

SEQ ID NO: 205027 - DNA, 25 bp, Homo sapien
tggcgtggcgcaagcaaagcccgcc

SEQ ID NO: 205028 - DNA, 25 bp, Homo sapien
ttgctcggtgttttgatcattttca

SEQ ID NO: 205029 - DNA, 25 bp, Homo sapien
atttgctttgctcggtgttttgatc

SEQ ID NO: 205030 - DNA, 25 bp, Homo sapien
taataaatatttgctttgctcggtg

SEQ ID NO: 205031 - DNA, 25 bp, Homo sapien
gtcacaaaagtggtttcatttaata

SEQ ID NO: 205032 - DNA, 25 bp, Homo sapien
ccaagagtcacaaaagtggtttcat

SEQ ID NO: 205033 - DNA, 25 bp, Homo sapien
tggcgcaagcaaagcccgccgtggc

SEQ ID NO: 205034 - DNA, 25 bp, Homo sapien
atggcgtgctgagggcctttgatct

SEQ ID NO: 205035 - DNA, 25 bp, Homo sapien
ctgagggcctttgatctgggacttg

SEQ ID NO: 205036 - DNA, 25 bp, Homo sapien
cctgcatggcgtgctgagggccttt

SEQ ID NO: 205037 - DNA, 25 bp, Homo sapien
gcccagagtagtgcccgcccgtgct

SEQ ID NO: 205038 - DNA, 25 bp, Homo sapien
ggctcgcagcccagagtagtgcccg

SEQ ID NO: 205039 - DNA, 25 bp, Homo sapien
catggggctcgcagcccagagtagt

SEQ ID NO: 205040 - DNA, 25 bp, Homo sapien
ccagggcgggtcttgtctgcagagc

SEQ ID NO: 205041 - DNA, 25 bp, Homo sapien
gcagctgattgatggagggcgtcct

SEQ ID NO: 205042 - DNA, 25 bp, Homo sapien
gagcctccaggggaaactccacact

SEQ ID NO: 205043 - DNA, 25 bp, Homo sapien
tttgtgcatgcctgtccacgccggt

SEQ ID NO: 205044 - DNA, 25 bp, Homo sapien
cacgtcccaggcctttgatggcgtc

SEQ ID NO: 205045 - DNA, 25 bp, Homo sapien
caggcctttgatggcgtccacgtgc

SEQ ID NO: 205046 - DNA, 25 bp, Homo sapien
tttgatggcgtccacgtgctccgcc

SEQ ID NO: 205047 - DNA, 25 bp, Homo sapien
tttggcccgtgtctggcgtagtgat

SEQ ID NO: 205048 - DNA, 25 bp, Homo sapien
gtgattcattgaagctcagagcctc

SEQ ID NO: 205049 - DNA, 25 bp, Homo sapien
cgtgtctggcgtagtgattcattga

SEQ ID NO: 205050 - DNA, 25 bp, Homo sapien
gacgcttggcccagctcaagagtga

SEQ ID NO: 205051 - DNA, 25 bp, Homo sapien
tgccccatcgggtgcttgtgctgcc

SEQ ID NO: 205052 - DNA, 25 bp, Homo sapien
cccagcccgtgacacccgccgtcag

SEQ ID NO: 205053 - DNA, 25 bp, Homo sapien
cctgatgagttctttgagctgacgg

SEQ ID NO: 205054 - DNA, 25 bp, Homo sapien
tgagttctttgagctgacggtggac

SEQ ID NO: 205055 - DNA, 25 bp, Homo sapien
tgagaagacgcttggcccagctcaa

SEQ ID NO: 205056 - DNA, 25 bp, Homo sapien
ggcatcttcgcgccagggtttgccc

SEQ ID NO: 205057 - DNA, 25 bp, Homo sapien
ttggcccagctcaagagtgagcggt

SEQ ID NO: 205058 - DNA, 25 bp, Homo sapien
catacgggtaattggccaccaccgc

SEQ ID NO: 205059 - DNA, 25 bp, Homo sapien
ttggctgaaagaacaaagttgaagg

SEQ ID NO: 205060 - DNA, 25 bp, Homo sapien
tcaaaggacttgtcatacgggtaat

SEQ ID NO: 205061 - DNA, 25 bp, Homo sapien
tgaagggccaactggggctaccaaa

SEQ ID NO: 205062 - DNA, 25 bp, Homo sapien
gttgaaggagtgcatccaccggatc

SEQ ID NO: 205063 - DNA, 25 bp, Homo sapien
tccgtggagattggctgaaagaaca

SEQ ID NO: 205064 - DNA, 25 bp, Homo sapien
ccctccgtggagattggctgaaaga

SEQ ID NO: 205065 - DNA, 25 bp, Homo sapien
aggagtgcatccaccggatcaccgc

SEQ ID NO: 205066 - DNA, 25 bp, Homo sapien
atggagtctgagaacgggcccaacc

SEQ ID NO: 205067 - DNA, 25 bp, Homo sapien
aggcgcgccagttcctttgttctca

SEQ ID NO: 205068 - DNA, 25 bp, Homo sapien
agccaatgaacctggagcgcgctgc

SEQ ID NO: 205069 - DNA, 25 bp, Homo sapien
aatgaacttggaacgcgccctcccg

SEQ ID NO: 205070 - DNA, 25 bp, Homo sapien
ctagccaatgagtccgaagcgcctg

SEQ ID NO: 205071 - DNA, 25 bp, Homo sapien
ctggccctcacagtgtcacgcgtga

SEQ ID NO: 205072 - DNA, 25 bp, Homo sapien
gcgcgccttgttcttcctggatact

SEQ ID NO: 205073 - DNA, 25 bp, Homo sapien
tttgttctcattggcccgcaccaag

SEQ ID NO: 205074 - DNA, 25 bp, Homo sapien
cggagctggtcctgagtgactgcat

SEQ ID NO: 205075 - DNA, 25 bp, Homo sapien
agagggcagttcctctgtatgacgg

SEQ ID NO: 205076 - DNA, 25 bp, Homo sapien
ttctgtgccgtagttaaagcgagca

SEQ ID NO: 205077 - DNA, 25 bp, Homo sapien
gtggatccctctgctccttagctgc

SEQ ID NO: 205078 - DNA, 25 bp, Homo sapien
taacattcgcggtcttacctggttc

SEQ ID NO: 205079 - DNA, 25 bp, Homo sapien
attgcctcggcagcccgaggtcgct

SEQ ID NO: 205080 - DNA, 25 bp, Homo sapien
tgactgcatgctcagcgaggaaggt

SEQ ID NO: 205081 - DNA, 25 bp, Homo sapien
caggctctccaatttctgtgccgta

SEQ ID NO: 205082 - DNA, 25 bp, Homo sapien
gccttttgcgatgtcaccgtgaacg

SEQ ID NO: 205083 - DNA, 25 bp, Homo sapien
tgcactttgtgatacattctggccc

SEQ ID NO: 205084 - DNA, 25 bp, Homo sapien
gggtttggaaatacagcgcgtttgc

SEQ ID NO: 205085 - DNA, 25 bp, Homo sapien
acgccacgtgggagcacaccgggaa

SEQ ID NO: 205086 - DNA, 25 bp, Homo sapien
gtcgtctgttccacgcggcggttgc

SEQ ID NO: 205087 - DNA, 25 bp, Homo sapien
gcctctttgagacccgggtcgtctg

SEQ ID NO: 205088 - DNA, 25 bp, Homo sapien
acccgggcgcagtaggagtgcatca

SEQ ID NO: 205089 - DNA, 25 bp, Homo sapien
cagcgcgtttgcactttgtgataca

SEQ ID NO: 205090 - DNA, 25 bp, Homo sapien
ggaacttgaagctctggccacgatg

SEQ ID NO: 205091 - DNA, 25 bp, Homo sapien
ccgcgaggaacagctccatgtcggc

SEQ ID NO: 205092 - DNA, 25 bp, Homo sapien
ggctgtcaagatccgcctgagtccg

SEQ ID NO: 205093 - DNA, 25 bp, Homo sapien
acctacctcgcggacaaggctgtca

SEQ ID NO: 205094 - DNA, 25 bp, Homo sapien
agccatttcggcctctttctgagcc

SEQ ID NO: 205095 - DNA, 25 bp, Homo sapien
tggtgacctttcagccggacaagta

SEQ ID NO: 205096 - DNA, 25 bp, Homo sapien
ccaggtccacgcacacgggttctat

SEQ ID NO: 205097 - DNA, 25 bp, Homo sapien
cggcgttgttcaccagcaggtccac

SEQ ID NO: 205098 - DNA, 25 bp, Homo sapien
ggggagaaacaatctatgaggcttc

SEQ ID NO: 205099 - DNA, 25 bp, Homo sapien
ccgtcggtgaagataaacgtctggg

SEQ ID NO: 205100 - DNA, 25 bp, Homo sapien
caatctatgaggcttctggggcgct

SEQ ID NO: 205101 - DNA, 25 bp, Homo sapien
tcttccgggtggtcttgacggcgat

SEQ ID NO: 205102 - DNA, 25 bp, Homo sapien
gcgatgaagacgtcgtcaggccgca

SEQ ID NO: 205103 - DNA, 25 bp, Homo sapien
ccgctgccggttcaggtgtttaact

SEQ ID NO: 205104 - DNA, 25 bp, Homo sapien
taacttgcaggtaacgagccgaggc

SEQ ID NO: 205105 - DNA, 25 bp, Homo sapien
ctggagctcgagctcagggtcgtcc

SEQ ID NO: 205106 - DNA, 25 bp, Homo sapien
ggcgttgcaaactggtcaggcgtca

SEQ ID NO: 205107 - DNA, 25 bp, Homo sapien
acagacgagaatcccgcggaggtga

SEQ ID NO: 205108 - DNA, 25 bp, Homo sapien
ccggtctgctctcttggctcgggaa

SEQ ID NO: 205109 - DNA, 25 bp, Homo sapien
cagactcagtcgcacgctcagattt

SEQ ID NO: 205110 - DNA, 25 bp, Homo sapien
gcacgctcagatttcgggatttcta

SEQ ID NO: 205111 - DNA, 25 bp, Homo sapien
gcaaactggtcaggcgtcatccgcg

SEQ ID NO: 205112 - DNA, 25 bp, Homo sapien
ggatcgcgtaacttcctcattcccg

SEQ ID NO: 205113 - DNA, 25 bp, Homo sapien
cccggctgggatcgcgtaacttcct

SEQ ID NO: 205114 - DNA, 25 bp, Homo sapien
gggactactgcaccagcgccaaaca

SEQ ID NO: 205115 - DNA, 25 bp, Homo sapien
gcgccaaacacgtcatcaacatgtg

SEQ ID NO: 205116 - DNA, 25 bp, Homo sapien
tgcctcaatgtcatcaaggtcggcc

SEQ ID NO: 205117 - DNA, 25 bp, Homo sapien
aacgccctcaagtgctattcccggg

SEQ ID NO: 205118 - DNA, 25 bp, Homo sapien
gtggggacctcagcaacgccctcaa

SEQ ID NO: 205119 - DNA, 25 bp, Homo sapien
acgacctgggcgaccactacctgga

SEQ ID NO: 205120 - DNA, 25 bp, Homo sapien
catcaaagagagcatccggcgcggc

SEQ ID NO: 205121 - DNA, 25 bp, Homo sapien
tctcagggagctgcagaacgcaccc

SEQ ID NO: 205122 - DNA, 25 bp, Homo sapien
agaggctgaggtcaccaccgtaccc

SEQ ID NO: 205123 - DNA, 25 bp, Homo sapien
aaggccgctccagtaccaccgttgg

SEQ ID NO: 205124 - DNA, 25 bp, Homo sapien
gggactcaccgacagctcgctggaa

SEQ ID NO: 205125 - DNA, 25 bp, Homo sapien
gggaagaaaccttgacgccagcgtc

SEQ ID NO: 205126 - DNA, 25 bp, Homo sapien
agccctgcagctttggcatcgtctc

SEQ ID NO: 205127 - DNA, 25 bp, Homo sapien
ccaacgaggggcttaagactcaact

SEQ ID NO: 205128 - DNA, 25 bp, Homo sapien
aactcagaggcagcggtcacccttc

SEQ ID NO: 205129 - DNA, 25 bp, Homo sapien
gcagcgtttgctgtgtgaagtgaca

SEQ ID NO: 205130 - DNA, 25 bp, Homo sapien
ggatactttcccgtcgcatacctgc

SEQ ID NO: 205131 - DNA, 25 bp, Homo sapien
tctccaagtcggcagctctggtgtc

SEQ ID NO: 205132 - DNA, 25 bp, Homo sapien
gggacatgcctaacacctacatcta

SEQ ID NO: 205133 - DNA, 25 bp, Homo sapien
caggacccttcaatcccgttgcatg

SEQ ID NO: 205134 - DNA, 25 bp, Homo sapien
ggcgcgcagtagcatcacgttgcca

SEQ ID NO: 205135 - DNA, 25 bp, Homo sapien
cacgttgccatggtacttggccttg

SEQ ID NO: 205136 - DNA, 25 bp, Homo sapien
tcagcggcacgcagcttgtagtaga

SEQ ID NO: 205137 - DNA, 25 bp, Homo sapien
ctcttgatgatcaggtccacggcgg

SEQ ID NO: 205138 - DNA, 25 bp, Homo sapien
gttgagctcacgctccagcgtctgg

SEQ ID NO: 205139 - DNA, 25 bp, Homo sapien
acgctcatgagcgagtccaggccca

SEQ ID NO: 205140 - DNA, 25 bp, Homo sapien
tcgcgcacggacagcaccaggttga

SEQ ID NO: 205141 - DNA, 25 bp, Homo sapien
cgctggcctcatccgcctttgagga

SEQ ID NO: 205142 - DNA, 25 bp, Homo sapien
cgggacacggtccagacaacaagga

SEQ ID NO: 205143 - DNA, 25 bp, Homo sapien
acccgtgacgaagggcggtatgcct

SEQ ID NO: 205144 - DNA, 25 bp, Homo sapien
ggaacgctcagaatggcacccgtga

SEQ ID NO: 205145 - DNA, 25 bp, Homo sapien
tgtccaggttgacagcagccaagtc

SEQ ID NO: 205146 - DNA, 25 bp, Homo sapien
aggacagccacatcgccttcagctt

SEQ ID NO: 205147 - DNA, 25 bp, Homo sapien
ggacagccacatcgccttcagcttt

SEQ ID NO: 205148 - DNA, 25 bp, Homo sapien
agccacatcgccttcagctttctcg

SEQ ID NO: 205149 - DNA, 25 bp, Homo sapien
gccctgcgcgcagtcttcgccttgt

SEQ ID NO: 205150 - DNA, 25 bp, Homo sapien
tgcgcgcagtcttcgccttgtccgc

SEQ ID NO: 205151 - DNA, 25 bp, Homo sapien
gttcggacgacagctgcacggccgc

SEQ ID NO: 205152 - DNA, 25 bp, Homo sapien
ttcggacgacagctgcacggccgcg

SEQ ID NO: 205153 - DNA, 25 bp, Homo sapien
ccctgaacttttgcctgcaccgggg

SEQ ID NO: 205154 - DNA, 25 bp, Homo sapien
cccatggaacaccgtgcacttgagg

SEQ ID NO: 205155 - DNA, 25 bp, Homo sapien
cacctgcacgacgactttgccaatg

SEQ ID NO: 205156 - DNA, 25 bp, Homo sapien
cctgcacgacgactttgccaatgtg

SEQ ID NO: 205157 - DNA, 25 bp, Homo sapien
cacgacgactttgccaatgtgcttc

SEQ ID NO: 205158 - DNA, 25 bp, Homo sapien
cgactttgccaatgtgcttcccttg

SEQ ID NO: 205159 - DNA, 25 bp, Homo sapien
tttgccaatgtgcttcccttgggcc

SEQ ID NO: 205160 - DNA, 25 bp, Homo sapien
tcccttgggccatgtagcggaaggc

SEQ ID NO: 205161 - DNA, 25 bp, Homo sapien
tgggccccatggaacaccgtgcact

SEQ ID NO: 205162 - DNA, 25 bp, Homo sapien
ctcaccgagcgggtggttctgagaa

SEQ ID NO: 205163 - DNA, 25 bp, Homo sapien
ttcttcaggaagatagccatgcctg

SEQ ID NO: 205164 - DNA, 25 bp, Homo sapien
gttgaagaacgcatccagtaggacc

SEQ ID NO: 205165 - DNA, 25 bp, Homo sapien
ccgtgcacttgaggggccgtaccac

SEQ ID NO: 205166 - DNA, 25 bp, Homo sapien
ggtcgaatttgccaatttccaggaa

SEQ ID NO: 205167 - DNA, 25 bp, Homo sapien
tggaatgtcacgttcttcaggaaga

SEQ ID NO: 205168 - DNA, 25 bp, Homo sapien
tggttctgagaaaggtcgaatttgc

SEQ ID NO: 205169 - DNA, 25 bp, Homo sapien
agtcagcactgctctcgttgaagaa

SEQ ID NO: 205170 - DNA, 25 bp, Homo sapien
ccgtgctgtagacgacaggcaccga

SEQ ID NO: 205171 - DNA, 25 bp, Homo sapien
taggccgtgctgtagacgacaggca

SEQ ID NO: 205172 - DNA, 25 bp, Homo sapien
tagtaggccgtgctgtagacgacag

SEQ ID NO: 205173 - DNA, 25 bp, Homo sapien
cgtagtaggccgtgctgtagacgac

SEQ ID NO: 205174 - DNA, 25 bp, Homo sapien
accagcgcgtagtaggccgtgctgt

SEQ ID NO: 205175 - DNA, 25 bp, Homo sapien
caccaccagcgcgtagtaggccgtg

SEQ ID NO: 205176 - DNA, 25 bp, Homo sapien
tgctgtagacgacaggcaccgaggc

SEQ ID NO: 205177 - DNA, 25 bp, Homo sapien
gtagacgacaggcaccgaggccgcc

SEQ ID NO: 205178 - DNA, 25 bp, Homo sapien
cccgagtggatgagcagcgtctccc

SEQ ID NO: 205179 - DNA, 25 bp, Homo sapien
cgtgtgccacagcacatgctgctcg

SEQ ID NO: 205180 - DNA, 25 bp, Homo sapien
cacagcacatgctgctcgaaggatg

SEQ ID NO: 205181 - DNA, 25 bp, Homo sapien
catgctgctcgaaggatgtgtcccg

SEQ ID NO: 205182 - DNA, 25 bp, Homo sapien
aacctggcctggaggtacgcccgct

SEQ ID NO: 205183 - DNA, 25 bp, Homo sapien
ggcctggaggtacgcccgcttctca

SEQ ID NO: 205184 - DNA, 25 bp, Homo sapien
ccttacccacggtggtgaagacgcg

SEQ ID NO: 205185 - DNA, 25 bp, Homo sapien
gcccgcttctcagccgaccctggtg

SEQ ID NO: 205186 - DNA, 25 bp, Homo sapien
caccgatgttgtagatggcggctga

SEQ ID NO: 205187 - DNA, 25 bp, Homo sapien
ccctgctcaccgatgttgtagatgg

SEQ ID NO: 205188 - DNA, 25 bp, Homo sapien
cctcagcacagagcgggcgtctgtg

SEQ ID NO: 205189 - DNA, 25 bp, Homo sapien
gcacaggcctcagcacagagcgggc

SEQ ID NO: 205190 - DNA, 25 bp, Homo sapien
cgaccgtcgagggtgtggtccacca

SEQ ID NO: 205191 - DNA, 25 bp, Homo sapien
actatgctcaggtagccagtggcgg

SEQ ID NO: 205192 - DNA, 25 bp, Homo sapien
gggccagcgtcttccacactatgct

SEQ ID NO: 205193 - DNA, 25 bp, Homo sapien
gcgtcttccacactatgctcaggta

SEQ ID NO: 205194 - DNA, 25 bp, Homo sapien
cccgaagccaaaggagttgatgccc

SEQ ID NO: 205195 - DNA, 25 bp, Homo sapien
tcaggatgatgtgcacgttggagcc

SEQ ID NO: 205196 - DNA, 25 bp, Homo sapien
tgttgggcctcaggatgatgtgcac

SEQ ID NO: 205197 - DNA, 25 bp, Homo sapien
tcagcatgctcaggaaagccaggtc

SEQ ID NO: 205198 - DNA, 25 bp, Homo sapien
acagccgcgatgtcgttcagcatgc

SEQ ID NO: 205199 - DNA, 25 bp, Homo sapien
cccagcacagcgtagccacggaagg

SEQ ID NO: 205200 - DNA, 25 bp, Homo sapien
agcgggcacctgctgcacctctggg

SEQ ID NO: 205201 - DNA, 25 bp, Homo sapien
ttgatgcccacgttgccgccacgga

SEQ ID NO: 205202 - DNA, 25 bp, Homo sapien
gccagggacttcttggtcagcagga

SEQ ID NO: 205203 - DNA, 25 bp, Homo sapien
gcgttcaggatggtggcgtacaccc

SEQ ID NO: 205204 - DNA, 25 bp, Homo sapien
ccatctgtattggtgccggcgttca

SEQ ID NO: 205205 - DNA, 25 bp, Homo sapien
cggccgactggtacaacgagcggat

SEQ ID NO: 205206 - DNA, 25 bp, Homo sapien
ctggtacaacgagcggatgagctgc

SEQ ID NO: 205207 - DNA, 25 bp, Homo sapien
tcacgcctgcggagggctcggctca

SEQ ID NO: 205208 - DNA, 25 bp, Homo sapien
accttgctccttgaagccatctgta

SEQ ID NO: 205209 - DNA, 25 bp, Homo sapien
atggtggcgtacacccgccgggcca

SEQ ID NO: 205210 - DNA, 25 bp, Homo sapien
gccgatgaggttgtcccagaactcc

SEQ ID NO: 205211 - DNA, 25 bp, Homo sapien
gtcatcgtccgtgaccatgtccaca

SEQ ID NO: 205212 - DNA, 25 bp, Homo sapien
acaccgccgatgaggttgtcccaga

SEQ ID NO: 205213 - DNA, 25 bp, Homo sapien
actcctgcaagttctccgactctgg

SEQ ID NO: 205214 - DNA, 25 bp, Homo sapien
aagttctccgactctggcagcttcc

SEQ ID NO: 205215 - DNA, 25 bp, Homo sapien
agcttcccggacatgccggcaatca

SEQ ID NO: 205216 - DNA, 25 bp, Homo sapien
gtgaccatgtccacaccgccgatga

SEQ ID NO: 205217 - DNA, 25 bp, Homo sapien
cttccagcgacggtcatcgtccgtg

SEQ ID NO: 205218 - DNA, 25 bp, Homo sapien
cgcagcctggacgacatcgacctgt

SEQ ID NO: 205219 - DNA, 25 bp, Homo sapien
gccgccgcccacttctttcacgcca

SEQ ID NO: 205220 - DNA, 25 bp, Homo sapien
ttctttcacgccaggctcgcgcggt

SEQ ID NO: 205221 - DNA, 25 bp, Homo sapien
ctcgcgtcacgctcgcgcttccacc

SEQ ID NO: 205222 - DNA, 25 bp, Homo sapien
tccggggagatagcgcctgtcagtc

SEQ ID NO: 205223 - DNA, 25 bp, Homo sapien
cgacatcgacctgtccgccctgcgg

SEQ ID NO: 205224 - DNA, 25 bp, Homo sapien
gctgcacgcctcacgtgctcccggg

SEQ ID NO: 205225 - DNA, 25 bp, Homo sapien
caccctcccagtgcgcggtcgctcc

SEQ ID NO: 205226 - DNA, 25 bp, Homo sapien
caggggtgttcgcaccggcccaatg

SEQ ID NO: 205227 - DNA, 25 bp, Homo sapien
agcagcaaccaatcgggcgccaggg

SEQ ID NO: 205228 - DNA, 25 bp, Homo sapien
aatgcttgggccacactggggacta

SEQ ID NO: 205229 - DNA, 25 bp, Homo sapien
gccacgccacatgggctgacagctt

SEQ ID NO: 205230 - DNA, 25 bp, Homo sapien
gacgctatttaaaccgcggccatcc

SEQ ID NO: 205231 - DNA, 25 bp, Homo sapien
cggcgccgacgctatttaaaccgcg

SEQ ID NO: 205232 - DNA, 25 bp, Homo sapien
gcacgaacaccgagacccggacagg

SEQ ID NO: 205233 - DNA, 25 bp, Homo sapien
ggcgcctccgaaggggcacgaacac

SEQ ID NO: 205234 - DNA, 25 bp, Homo sapien
accgtcctgtcggttgcagagcact

SEQ ID NO: 205235 - DNA, 25 bp, Homo sapien
ttgcagagcactgcgtccgtgtgat

SEQ ID NO: 205236 - DNA, 25 bp, Homo sapien
cagtcaccgtcctgtcggttgcaga

SEQ ID NO: 205237 - DNA, 25 bp, Homo sapien
gtcgcagagcactgcgtccgtgtga

SEQ ID NO: 205238 - DNA, 25 bp, Homo sapien
cggtcgcagagcattgtgttcgtgt

SEQ ID NO: 205239 - DNA, 25 bp, Homo sapien
cattgtgttcgtgtggaggacacgc

SEQ ID NO: 205240 - DNA, 25 bp, Homo sapien
cacgcgaggactcttggaagtgctt

SEQ ID NO: 205241 - DNA, 25 bp, Homo sapien
cctcctgccggtcgcagagcattgt

SEQ ID NO: 205242 - DNA, 25 bp, Homo sapien
gtgctccattctaagtcagcctgcg

SEQ ID NO: 205243 - DNA, 25 bp, Homo sapien
gcaacgtccgcgcagcaaagcagga

SEQ ID NO: 205244 - DNA, 25 bp, Homo sapien
atgaggatgcggctgacacttgtct

SEQ ID NO: 205245 - DNA, 25 bp, Homo sapien
tgacacttgtctggcccgtgaggct

SEQ ID NO: 205246 - DNA, 25 bp, Homo sapien
gagcagggccgtctaaagtgcacca

SEQ ID NO: 205247 - DNA, 25 bp, Homo sapien
taaagtgcaccaatgcccacgcgtc

SEQ ID NO: 205248 - DNA, 25 bp, Homo sapien
tgcattctaagtcagtgtgcgcccg

SEQ ID NO: 205249 - DNA, 25 bp, Homo sapien
cacctgggctccattctaagtcagc

SEQ ID NO: 205250 - DNA, 25 bp, Homo sapien
ggtgagcttcctgaaactccctctc

SEQ ID NO: 205251 - DNA, 25 bp, Homo sapien
catgggacaaaattctcctagccgc

SEQ ID NO: 205252 - DNA, 25 bp, Homo sapien
cggggagcgcatgggacaaaattct

SEQ ID NO: 205253 - DNA, 25 bp, Homo sapien
gcgcctcaccgatcagtgacgcatc

SEQ ID NO: 205254 - DNA, 25 bp, Homo sapien
ccgcaggctcgcgaggaaagccgac

SEQ ID NO: 205255 - DNA, 25 bp, Homo sapien
cgctcccgggtggaaggcactaact

SEQ ID NO: 205256 - DNA, 25 bp, Homo sapien
ctgctcggtgagcttcctgaaactc

SEQ ID NO: 205257 - DNA, 25 bp, Homo sapien
ctaactgagaagaagcccagccgca

SEQ ID NO: 205258 - DNA, 25 bp, Homo sapien
cgttgccacagcgaccgggtcagtc

SEQ ID NO: 205259 - DNA, 25 bp, Homo sapien
caccaaagcgctgcgtccgacagga

SEQ ID NO: 205260 - DNA, 25 bp, Homo sapien
gctgctggggttttctacaggaaga

SEQ ID NO: 205261 - DNA, 25 bp, Homo sapien
cggtcccgaagggttgacttgagct

SEQ ID NO: 205262 - DNA, 25 bp, Homo sapien
gacttgagcttttgccctgagatga

SEQ ID NO: 205263 - DNA, 25 bp, Homo sapien
cgccacgaagtcctgcctaagggtc

SEQ ID NO: 205264 - DNA, 25 bp, Homo sapien
cgcggtcgctcagaccctgattagg

SEQ ID NO: 205265 - DNA, 25 bp, Homo sapien
cgaccaccgccgcagatcgaaggag

SEQ ID NO: 205266 - DNA, 25 bp, Homo sapien
tcccacgttcgtggagaggagcgtc

SEQ ID NO: 205267 - DNA, 25 bp, Homo sapien
tccgctcccacgttcgtggagacga

SEQ ID NO: 205268 - DNA, 25 bp, Homo sapien
actccgctcccacgttcgtggagag

SEQ ID NO: 205269 - DNA, 25 bp, Homo sapien
ccgctcccacgttcgtggagaggag

SEQ ID NO: 205270 - DNA, 25 bp, Homo sapien
aactccgctcccacgttcgtggaga

SEQ ID NO: 205271 - DNA, 25 bp, Homo sapien
ctcccacgttcgtggagaggagcgt

SEQ ID NO: 205272 - DNA, 25 bp, Homo sapien
ccgctcccacgttcgtggagacgag

SEQ ID NO: 205273 - DNA, 25 bp, Homo sapien
cccaactccgctcccacgttcgtgg

SEQ ID NO: 205274 - DNA, 25 bp, Homo sapien
accagagggctctatggatcccagc

SEQ ID NO: 205275 - DNA, 25 bp, Homo sapien
tccaggccacccagaaagccatgtg

SEQ ID NO: 205276 - DNA, 25 bp, Homo sapien
ctcaaggcaggcttggtaacgaccc

SEQ ID NO: 205277 - DNA, 25 bp, Homo sapien
ctgaaggagggtctattccgccagc

SEQ ID NO: 205278 - DNA, 25 bp, Homo sapien
ggagtccaaggtcccagcttcactg

SEQ ID NO: 205279 - DNA, 25 bp, Homo sapien
aaagggtccctctcctggtgatggc

SEQ ID NO: 205280 - DNA, 25 bp, Homo sapien
cgtgggaaaaccaggcgcagccttt

SEQ ID NO: 205281 - DNA, 25 bp, Homo sapien
tgcagtgacccttatgccaggctcg

SEQ ID NO: 205282 - DNA, 25 bp, Homo sapien
tcacgtgtcatcatggcctgcgctc

SEQ ID NO: 205283 - DNA, 25 bp, Homo sapien
tccaggctgtgagctcagtcggctg

SEQ ID NO: 205284 - DNA, 25 bp, Homo sapien
acgtgtcatcatggcctgcgctcgg

SEQ ID NO: 205285 - DNA, 25 bp, Homo sapien
gctcacgtgtcatcatggcctgcgc

SEQ ID NO: 205286 - DNA, 25 bp, Homo sapien
gcgctcacgtgtcatcatggcctgc

SEQ ID NO: 205287 - DNA, 25 bp, Homo sapien
ggcgctcacgtgtcatcatggcctg

SEQ ID NO: 205288 - DNA, 25 bp, Homo sapien
cggcgctcacgtgtcatcatggcct

SEQ ID NO: 205289 - DNA, 25 bp, Homo sapien
ctccaggctgtgagctcagtcggct

SEQ ID NO: 205290 - DNA, 25 bp, Homo sapien
tttgccggagcatcatccaggtcta

SEQ ID NO: 205291 - DNA, 25 bp, Homo sapien
gtctctttgcgtcgctgggcatggt

SEQ ID NO: 205292 - DNA, 25 bp, Homo sapien
tggctgcgtccttttgccggagcat

SEQ ID NO: 205293 - DNA, 25 bp, Homo sapien
tgtgtgcgtgaaccgctttggctgc

SEQ ID NO: 205294 - DNA, 25 bp, Homo sapien
ctcaccactggggtcatcacgggtg

SEQ ID NO: 205295 - DNA, 25 bp, Homo sapien
caggtccgctctgcagtgtgtgcgt

SEQ ID NO: 205296 - DNA, 25 bp, Homo sapien
atccaggtctacctcaccactgggg

SEQ ID NO: 205297 - DNA, 25 bp, Homo sapien
gtgaaccgctttggctgccggcccg

SEQ ID NO: 205298 - DNA, 25 bp, Homo sapien
gcgcctgctagacctgagcgtcttc

SEQ ID NO: 205299 - DNA, 25 bp, Homo sapien
gttcgtggtgagctacgccaaggac

SEQ ID NO: 205300 - DNA, 25 bp, Homo sapien
cttcattgacatcttcgcgcggccg

SEQ ID NO: 205301 - DNA, 25 bp, Homo sapien
gaaggtgcggccctactccgtctac

SEQ ID NO: 205302 - DNA, 25 bp, Homo sapien
gtctacctcttcagcttctccatgt

SEQ ID NO: 205303 - DNA, 25 bp, Homo sapien
ttctttggcatctcctacggcatgg

SEQ ID NO: 205304 - DNA, 25 bp, Homo sapien
acccacaagttctccagtgccattg

SEQ ID NO: 205305 - DNA, 25 bp, Homo sapien
ccatgttcttcaacggcctcgcgga

SEQ ID NO: 205306 - DNA, 25 bp, Homo sapien
acgttctgggcactacatcgggacc

SEQ ID NO: 205307 - DNA, 25 bp, Homo sapien
agtgcacagctgacacgacgtccta

SEQ ID NO: 205308 - DNA, 25 bp, Homo sapien
ctagatactgggcaaggactgtcac

SEQ ID NO: 205309 - DNA, 25 bp, Homo sapien
agctgcctcgcacaaacgttctggg

SEQ ID NO: 205310 - DNA, 25 bp, Homo sapien
tcgggaccacagatatttacaaagc

SEQ ID NO: 205311 - DNA, 25 bp, Homo sapien
ttacaaagcaagcttgcgccacttc

SEQ ID NO: 205312 - DNA, 25 bp, Homo sapien
aggactgtcacaagcactccgaaga

SEQ ID NO: 205313 - DNA, 25 bp, Homo sapien
tacaaacgcacagctcggagactgg

SEQ ID NO: 205314 - DNA, 25 bp, Homo sapien
tcagcagaacgagtgacaggaagac

SEQ ID NO: 205315 - DNA, 25 bp, Homo sapien
ctgcggctggaggagttaatacaga

SEQ ID NO: 205316 - DNA, 25 bp, Homo sapien
ggcacagacccgacagaagcgcaag

SEQ ID NO: 205317 - DNA, 25 bp, Homo sapien
tgtgaaaactgcagcgggtctccca

SEQ ID NO: 205318 - DNA, 25 bp, Homo sapien
tacagacgaagctgcgtggacaaga

SEQ ID NO: 205319 - DNA, 25 bp, Homo sapien
ccctctcagggaagacatgaaaagc

SEQ ID NO: 205320 - DNA, 25 bp, Homo sapien
ctgggacacgtgctcagcagaacga

SEQ ID NO: 205321 - DNA, 25 bp, Homo sapien
ttcctgtcaacacatttccagagtg

SEQ ID NO: 205322 - DNA, 25 bp, Homo sapien
tcctagtccagggagcatggctatg

SEQ ID NO: 205323 - DNA, 25 bp, Homo sapien
gcaacagcagctaggcctcggaatc

SEQ ID NO: 205324 - DNA, 25 bp, Homo sapien
ccagcgtccgaataaagcccagggc

SEQ ID NO: 205325 - DNA, 25 bp, Homo sapien
acagccagagcttttcccggggtct

SEQ ID NO: 205326 - DNA, 25 bp, Homo sapien
agcggcacgctcagagaagtctctg

SEQ ID NO: 205327 - DNA, 25 bp, Homo sapien
agtctctgggattttctgggcaatg

SEQ ID NO: 205328 - DNA, 25 bp, Homo sapien
atggagaccgtgcatttctggccgc

SEQ ID NO: 205329 - DNA, 25 bp, Homo sapien
tgagcttcggcaccaccttgttaga

SEQ ID NO: 205330 - DNA, 25 bp, Homo sapien
cgagaggtatcttgtcggcctgtga

SEQ ID NO: 205331 - DNA, 25 bp, Homo sapien
tcttgactcggacggggtagcccga

SEQ ID NO: 205332 - DNA, 25 bp, Homo sapien
ccgggagctctgcacctacctgtga

SEQ ID NO: 205333 - DNA, 25 bp, Homo sapien
gtggacatgcgagaggtatcttgtc

SEQ ID NO: 205334 - DNA, 25 bp, Homo sapien
gcggtgcagccgcatactcactttc

SEQ ID NO: 205335 - DNA, 25 bp, Homo sapien
ggtgcagccgcatactcactttccg

SEQ ID NO: 205336 - DNA, 25 bp, Homo sapien
gctctctctccatgccggagacggg

SEQ ID NO: 205337 - DNA, 25 bp, Homo sapien
tctgcacctacctgtgaggtggaca

SEQ ID NO: 205338 - DNA, 25 bp, Homo sapien
gccgggtgactctaatgccgcagga

SEQ ID NO: 205339 - DNA, 25 bp, Homo sapien
gactgatctgccctgccgagtgcac

SEQ ID NO: 205340 - DNA, 25 bp, Homo sapien
gtcgctctgattcctcccgaggcag

SEQ ID NO: 205341 - DNA, 25 bp, Homo sapien
ctggcctagcctgctctgagggccg

SEQ ID NO: 205342 - DNA, 25 bp, Homo sapien
aaaacgctggcctagcctgctctga

SEQ ID NO: 205343 - DNA, 25 bp, Homo sapien
catttacggaaaacgctggcctagc

SEQ ID NO: 205344 - DNA, 25 bp, Homo sapien
tcatgctgccatttacggaaaacgc

SEQ ID NO: 205345 - DNA, 25 bp, Homo sapien
cccggcagagggactgatctgccct

SEQ ID NO: 205346 - DNA, 25 bp, Homo sapien
ttccctaagttctcccagggcgctg

SEQ ID NO: 205347 - DNA, 25 bp, Homo sapien
acaggtactcggtccgctctttaag

SEQ ID NO: 205348 - DNA, 25 bp, Homo sapien
ttccggtaaccgctgcgagaaggcc

SEQ ID NO: 205349 - DNA, 25 bp, Homo sapien
ctcgcgagaatgaatgcgtcacttc

SEQ ID NO: 205350 - DNA, 25 bp, Homo sapien
cacagttgttccaaggccggttccg

SEQ ID NO: 205351 - DNA, 25 bp, Homo sapien
agcggcctcaggttccacagttgtt

SEQ ID NO: 205352 - DNA, 25 bp, Homo sapien
gcctcacccgatgctggtacagaca

SEQ ID NO: 205353 - DNA, 25 bp, Homo sapien
tggtacagacagacgttcccgaagc

SEQ ID NO: 205354 - DNA, 25 bp, Homo sapien
tccagaagccagtcagctgagccgc

SEQ ID NO: 205355 - DNA, 25 bp, Homo sapien
gcctcgagaagccagtcagctgagc

SEQ ID NO: 205356 - DNA, 25 bp, Homo sapien
gagcctcgtgaagccagtgagctga

SEQ ID NO: 205357 - DNA, 25 bp, Homo sapien
cctcgagaagccagtgcagtgcgct

SEQ ID NO: 205358 - DNA, 25 bp, Homo sapien
gagcctcgagaagccagtcagctga

SEQ ID NO: 205359 - DNA, 25 bp, Homo sapien
gggcctcgagaagccagtcagctga

SEQ ID NO: 205360 - DNA, 25 bp, Homo sapien
cctcgagaagccagtcagctgagcc

SEQ ID NO: 205361 - DNA, 25 bp, Homo sapien
tcgagaagccagtcagctgagccgc

SEQ ID NO: 205362 - DNA, 25 bp, Homo sapien
gactcggatcttccgggcctaaatc

SEQ ID NO: 205363 - DNA, 25 bp, Homo sapien
ttcagctgcctaaaggagccgccgc

SEQ ID NO: 205364 - DNA, 25 bp, Homo sapien
tccttccgcgatcgcgcttggtctt

SEQ ID NO: 205365 - DNA, 25 bp, Homo sapien
cggggcctcaccgagatagatgtct

SEQ ID NO: 205366 - DNA, 25 bp, Homo sapien
cgaaggagccgctgccgatcttccg

SEQ ID NO: 205367 - DNA, 25 bp, Homo sapien
cggccgcttcctgggtctgaactct

SEQ ID NO: 205368 - DNA, 25 bp, Homo sapien
ccagcgcctcaatacggggcggatg

SEQ ID NO: 205369 - DNA, 25 bp, Homo sapien
gaagccaggtgagttcctcgcgaca

SEQ ID NO: 205370 - DNA, 25 bp, Homo sapien
ttaggagactcattcgcagccgacg

SEQ ID NO: 205371 - DNA, 25 bp, Homo sapien
agctgttgtcacgtgctctccgatg

SEQ ID NO: 205372 - DNA, 25 bp, Homo sapien
tcccgggcgtcctttaggagactca

SEQ ID NO: 205373 - DNA, 25 bp, Homo sapien
gatcgccggctccaccataaataga

SEQ ID NO: 205374 - DNA, 25 bp, Homo sapien
acgggtggtctctaattggcctagc

SEQ ID NO: 205375 - DNA, 25 bp, Homo sapien
gctctaattggcctagctgttgtca

SEQ ID NO: 205376 - DNA, 25 bp, Homo sapien
tccgatggcccaatcactaaggctg

SEQ ID NO: 205377 - DNA, 25 bp, Homo sapien
actaaggctggacgatgctgcactg

SEQ ID NO: 205378 - DNA, 25 bp, Homo sapien
catctggcaaggtcggaatgatttt

SEQ ID NO: 205379 - DNA, 25 bp, Homo sapien
tcggaatgattttgcgatgagcacc

SEQ ID NO: 205380 - DNA, 25 bp, Homo sapien
tggcgttctgctcaggggtttttgt

SEQ ID NO: 205381 - DNA, 25 bp, Homo sapien
ctgctcaggggtttttgtttaatga

SEQ ID NO: 205382 - DNA, 25 bp, Homo sapien
ttgcgatgagcaccgcctggattct

SEQ ID NO: 205383 - DNA, 25 bp, Homo sapien
ctggattctgcggtgaaagcgactg

SEQ ID NO: 205384 - DNA, 25 bp, Homo sapien
aaagcgactgtgtgcgcgctcacgg

SEQ ID NO: 205385 - DNA, 25 bp, Homo sapien
taatgaagaacgtcaaacatctggc

SEQ ID NO: 205386 - DNA, 25 bp, Homo sapien
gcagagatgtgtgcccgtgactcac

SEQ ID NO: 205387 - DNA, 25 bp, Homo sapien
tgcagagaagggtgcacgtgactca

SEQ ID NO: 205388 - DNA, 25 bp, Homo sapien
cactcgtgtgcagacaggtgtgtgt

SEQ ID NO: 205389 - DNA, 25 bp, Homo sapien
cacgcgtgtgtacagagataggagc

SEQ ID NO: 205390 - DNA, 25 bp, Homo sapien
gtgtgcatgaccacgcgtgtgtaca

SEQ ID NO: 205391 - DNA, 25 bp, Homo sapien
acatgtatgcagagacgggtgtgca

SEQ ID NO: 205392 - DNA, 25 bp, Homo sapien
tgtgcgtgactccacacgtgtttgc

SEQ ID NO: 205393 - DNA, 25 bp, Homo sapien
gcgcatggctccacgcatgtgcaga

SEQ ID NO: 205394 - DNA, 25 bp, Homo sapien
caaaagcatgaacagatctgggtcc

SEQ ID NO: 205395 - DNA, 25 bp, Homo sapien
atctgggtccaaagaggctcggcag

SEQ ID NO: 205396 - DNA, 25 bp, Homo sapien
ccgccgcagtgacgaagacaaaagc

SEQ ID NO: 205397 - DNA, 25 bp, Homo sapien
ttcagatattcgagtcatggaactt

SEQ ID NO: 205398 - DNA, 25 bp, Homo sapien
tgcatttggagctacttggaggttt

SEQ ID NO: 205399 - DNA, 25 bp, Homo sapien
gtcttcatctcgaggacgccttagg

SEQ ID NO: 205400 - DNA, 25 bp, Homo sapien
acccagcacgcggacggaaccttat

SEQ ID NO: 205401 - DNA, 25 bp, Homo sapien
gcccacagaacagggtctgacccag

SEQ ID NO: 205402 - DNA, 25 bp, Homo sapien
acgcgctcctctgggatgcagcttc

SEQ ID NO: 205403 - DNA, 25 bp, Homo sapien
gagctgggtttacgggaagcctcca

SEQ ID NO: 205404 - DNA, 25 bp, Homo sapien
cgcgttcacaacaagcgtgacggtg

SEQ ID NO: 205405 - DNA, 25 bp, Homo sapien
agtgcaccaagaggccctaacaccg

SEQ ID NO: 205406 - DNA, 25 bp, Homo sapien
cgcacccgcggttcacgctaaagga

SEQ ID NO: 205407 - DNA, 25 bp, Homo sapien
tgtcccttcaagagtcgagcctggc

SEQ ID NO: 205408 - DNA, 25 bp, Homo sapien
ccgccgggagcatttttccaggaga

SEQ ID NO: 205409 - DNA, 25 bp, Homo sapien
aggccctttcataaaagcgcgcaga

SEQ ID NO: 205410 - DNA, 25 bp, Homo sapien
ctacgaaggccgtttctgtgacccg

SEQ ID NO: 205411 - DNA, 25 bp, Homo sapien
tctgtccgcctttctgtccggcttt

SEQ ID NO: 205412 - DNA, 25 bp, Homo sapien
tccggctttccatccggggtgccag

SEQ ID NO: 205413 - DNA, 25 bp, Homo sapien
gttctgctaacacgaatgaagtctc

SEQ ID NO: 205414 - DNA, 25 bp, Homo sapien
tgtgacatcaaacagctacgaaggc

SEQ ID NO: 205415 - DNA, 25 bp, Homo sapien
gacctgctgctactcctggtcgtgg

SEQ ID NO: 205416 - DNA, 25 bp, Homo sapien
cacacgccgagtctccgggacgaag

SEQ ID NO: 205417 - DNA, 25 bp, Homo sapien
atgaagtctcgttggtgtgacatca

SEQ ID NO: 205418 - DNA, 25 bp, Homo sapien
gagcgctctcgcgatagacacagca

SEQ ID NO: 205419 - DNA, 25 bp, Homo sapien
tcgcgagatcgagtgagtacggctc

SEQ ID NO: 205420 - DNA, 25 bp, Homo sapien
aaggcgctgttttcaccgaattaga

SEQ ID NO: 205421 - DNA, 25 bp, Homo sapien
gttcactgcaacagacccagagatg

SEQ ID NO: 205422 - DNA, 25 bp, Homo sapien
agcccatcggggaactcgcaatacg

SEQ ID NO: 205423 - DNA, 25 bp, Homo sapien
ctgcatgcagtccataagggtcctg

SEQ ID NO: 205424 - DNA, 25 bp, Homo sapien
gggttgtgcaacgaccctgcatgca

SEQ ID NO: 205425 - DNA, 25 bp, Homo sapien
cgagcttagcaatgcgctgggaaac

SEQ ID NO: 205426 - DNA, 25 bp, Homo sapien
ctgcgtgggcttctaagagcatctg

SEQ ID NO: 205427 - DNA, 25 bp, Homo sapien
gagcatctgtgggagacccgcaaca

SEQ ID NO: 205428 - DNA, 25 bp, Homo sapien
ttggtggacacggagaatcccaggc

SEQ ID NO: 205429 - DNA, 25 bp, Homo sapien
tccgtgccctgcaaacacgggcgtg

SEQ ID NO: 205430 - DNA, 25 bp, Homo sapien
agacgcagacgcgagacccgcctgg

SEQ ID NO: 205431 - DNA, 25 bp, Homo sapien
cggcttctcccgtgccgtggaactt

SEQ ID NO: 205432 - DNA, 25 bp, Homo sapien
tctcccgtgccgtggaactttcggc

SEQ ID NO: 205433 - DNA, 25 bp, Homo sapien
ctggagcaatcctagcggcccggcg

SEQ ID NO: 205434 - DNA, 25 bp, Homo sapien
aattgggaatgcgaatccgcgctcc

SEQ ID NO: 205435 - DNA, 25 bp, Homo sapien
tccgaacgagcgtcgccaagagaaa

SEQ ID NO: 205436 - DNA, 25 bp, Homo sapien
atgggaaagactcccgcccgtgtcg

SEQ ID NO: 205437 - DNA, 25 bp, Homo sapien
ggagagaggcttccattcacggtca

SEQ ID NO: 205438 - DNA, 25 bp, Homo sapien
attcacggtcactcacaggcgcagc

SEQ ID NO: 205439 - DNA, 25 bp, Homo sapien
ggttgcgactgccacctaaaattgg

SEQ ID NO: 205440 - DNA, 25 bp, Homo sapien
tgcgaccgcgcaacaatcagacgtc

SEQ ID NO: 205441 - DNA, 25 bp, Homo sapien
ctgtgccatctgtccgaatagtatg

SEQ ID NO: 205442 - DNA, 25 bp, Homo sapien
tgaccgtcatgagcagcgagcgcta

SEQ ID NO: 205443 - DNA, 25 bp, Homo sapien
gtggcctccatgtacgtctacgtgg

SEQ ID NO: 205444 - DNA, 25 bp, Homo sapien
tggccgacctgctgtacctgctcag

SEQ ID NO: 205445 - DNA, 25 bp, Homo sapien
agcatcttcacgctgaccgtcatga

SEQ ID NO: 205446 - DNA, 25 bp, Homo sapien
gcttcctgcccttctggctgtggca

SEQ ID NO: 205447 - DNA, 25 bp, Homo sapien
acggcgcgcatcgtcaactacctga

SEQ ID NO: 205448 - DNA, 25 bp, Homo sapien
tctacacgctgctcaccaggaacta

SEQ ID NO: 205449 - DNA, 25 bp, Homo sapien
tggccacctacgtcaccaaggagtg

SEQ ID NO: 205450 - DNA, 25 bp, Homo sapien
ggagactctgtccacgcaggtagca

SEQ ID NO: 205451 - DNA, 25 bp, Homo sapien
acttcaccgtcgtggcctctgcttt

SEQ ID NO: 205452 - DNA, 25 bp, Homo sapien
ccttcgttcgtgagaactcgggaca

SEQ ID NO: 205453 - DNA, 25 bp, Homo sapien
ctcgggacatgtacacggagctttc

SEQ ID NO: 205454 - DNA, 25 bp, Homo sapien
acggagctttccacacaactcaaga

SEQ ID NO: 205455 - DNA, 25 bp, Homo sapien
ctcaagaaacccagccttggggctc

SEQ ID NO: 205456 - DNA, 25 bp, Homo sapien
ctgacatacggcgacctcgtgtttc

SEQ ID NO: 205457 - DNA, 25 bp, Homo sapien
ttgctttcgcaatgcacggctgtgc

SEQ ID NO: 205458 - DNA, 25 bp, Homo sapien
cctcgatgccatggtcggggttgca

SEQ ID NO: 205459 - DNA, 25 bp, Homo sapien
ctgaagttaccttggcccggctgct

SEQ ID NO: 205460 - DNA, 25 bp, Homo sapien
gggaacgctgggtcctcgatgccat

SEQ ID NO: 205461 - DNA, 25 bp, Homo sapien
cagtggaccttctccacgcggtgta

SEQ ID NO: 205462 - DNA, 25 bp, Homo sapien
cttctccacgcggtgtaggttctcg

SEQ ID NO: 205463 - DNA, 25 bp, Homo sapien
tccacgcggtgtaggttctcggacc

SEQ ID NO: 205464 - DNA, 25 bp, Homo sapien
cccggctgctggctacgggaacgct

SEQ ID NO: 205465 - DNA, 25 bp, Homo sapien
cacgggccctcctgaagttaccttg

SEQ ID NO: 205466 - DNA, 25 bp, Homo sapien
ctcagcaatggtgagctggaccttc

SEQ ID NO: 205467 - DNA, 25 bp, Homo sapien
tccacgtgcgcatgccagtactcgt

SEQ ID NO: 205468 - DNA, 25 bp, Homo sapien
ggatgcgctgatgccaaaagcctca

SEQ ID NO: 205469 - DNA, 25 bp, Homo sapien
ccctgcagaggacacaatagccgtc

SEQ ID NO: 205470 - DNA, 25 bp, Homo sapien
aggaaccagccttcgtacggctccg

SEQ ID NO: 205471 - DNA, 25 bp, Homo sapien
ctcccaagcacaccgggaacagata

SEQ ID NO: 205472 - DNA, 25 bp, Homo sapien
aacagataccggctccgcctgggaa

SEQ ID NO: 205473 - DNA, 25 bp, Homo sapien
tccgcgcttccgtgctgtttatgcg

SEQ ID NO: 205474 - DNA, 25 bp, Homo sapien
aggacacactcttcccaacgagggg

SEQ ID NO: 205475 - DNA, 25 bp, Homo sapien
cgtccagctaggaagttgcaggatg

SEQ ID NO: 205476 - DNA, 25 bp, Homo sapien
atgcgttgcagcgtgtctgtcccac

SEQ ID NO: 205477 - DNA, 25 bp, Homo sapien
gctctcctgtgtccagcatgcgcag

SEQ ID NO: 205478 - DNA, 25 bp, Homo sapien
ggcaggccgtgacatgccatgaata

SEQ ID NO: 205479 - DNA, 25 bp, Homo sapien
tgccatgaatagatggccacgcaca

SEQ ID NO: 205480 - DNA, 25 bp, Homo sapien
ggccacgcacatctaaggacacact

SEQ ID NO: 205481 - DNA, 25 bp, Homo sapien
ccgcacgggtttcagtcaggcgcag

SEQ ID NO: 205482 - DNA, 25 bp, Homo sapien
cgaacctgcggtgactgtcgtagtc

SEQ ID NO: 205483 - DNA, 25 bp, Homo sapien
cccaagctgctccagagcaggagtg

SEQ ID NO: 205484 - DNA, 25 bp, Homo sapien
cggtccttagccacggcctctgcca

SEQ ID NO: 205485 - DNA, 25 bp, Homo sapien
agtgcggtgagcacaaagccagccc

SEQ ID NO: 205486 - DNA, 25 bp, Homo sapien
tgactgtcgtagtcctcagagcagg

SEQ ID NO: 205487 - DNA, 25 bp, Homo sapien
caggagtgcggtgagcacaaagcca

SEQ ID NO: 205488 - DNA, 25 bp, Homo sapien
agggcacctcgatgaatctccctgc

SEQ ID NO: 205489 - DNA, 25 bp, Homo sapien
atctccctgccacgacctcgccacg

SEQ ID NO: 205490 - DNA, 25 bp, Homo sapien
gtggctgtcccgcagcggcgatgcg

SEQ ID NO: 205491 - DNA, 25 bp, Homo sapien
ccgagcgacgcctcccagcgtggct

SEQ ID NO: 205492 - DNA, 25 bp, Homo sapien
ccaggcccgagcaatcggcggccga

SEQ ID NO: 205493 - DNA, 25 bp, Homo sapien
tacctgaagagggacggccgggctc

SEQ ID NO: 205494 - DNA, 25 bp, Homo sapien
acgcgagtgcgacgcgctcggccat

SEQ ID NO: 205495 - DNA, 25 bp, Homo sapien
aacgccgtaacagggagcgcgaggc

SEQ ID NO: 205496 - DNA, 25 bp, Homo sapien
ccgcgccagtacctgaagagggacg

SEQ ID NO: 205497 - DNA, 25 bp, Homo sapien
cgccagtacctgaagagggacggcc

SEQ ID NO: 205498 - DNA, 25 bp, Homo sapien
tgcaggtctattacctcggagaggg

SEQ ID NO: 205499 - DNA, 25 bp, Homo sapien
acgacatgctccgagacctgcctga

SEQ ID NO: 205500 - DNA, 25 bp, Homo sapien
tgtgcctgtcacacatgcgggcggt

SEQ ID NO: 205501 - DNA, 25 bp, Homo sapien
ccggtggctacagcaagagcagaac

SEQ ID NO: 205502 - DNA, 25 bp, Homo sapien
ctgctccttccttgcaggtctatta

SEQ ID NO: 205503 - DNA, 25 bp, Homo sapien
gtgtgcacggctgccaaggcaaccc

SEQ ID NO: 205504 - DNA, 25 bp, Homo sapien
tctccgtcagggcacggcgtgaacc

SEQ ID NO: 205505 - DNA, 25 bp, Homo sapien
gcacggggaagttgtgcctgtcaca

SEQ ID NO: 205506 - DNA, 25 bp, Homo sapien
cctgcagttgcttctacgcggtatg

SEQ ID NO: 205507 - DNA, 25 bp, Homo sapien
gcttctacgcggtatgtctggtctg

SEQ ID NO: 205508 - DNA, 25 bp, Homo sapien
tctcatggacccaggtacgaccact

SEQ ID NO: 205509 - DNA, 25 bp, Homo sapien
ggacccaggtacgaccactactctg

SEQ ID NO: 205510 - DNA, 25 bp, Homo sapien
ggtacgaccactactctgtgctgtg

SEQ ID NO: 205511 - DNA, 25 bp, Homo sapien
tgctgcccgcaggagtcccgtccct

SEQ ID NO: 205512 - DNA, 25 bp, Homo sapien
ggccgcctgcctgcagttgcttcta

SEQ ID NO: 205513 - DNA, 25 bp, Homo sapien
cgcggtatgtctggtctggccaccc

SEQ ID NO: 205514 - DNA, 25 bp, Homo sapien
ggcaatgtctggatcaccggccgtg

SEQ ID NO: 205515 - DNA, 25 bp, Homo sapien
tcgcagtcagatgtgcgctcacagc

SEQ ID NO: 205516 - DNA, 25 bp, Homo sapien
aggattgtcccttctctggatcggc

SEQ ID NO: 205517 - DNA, 25 bp, Homo sapien
caccagggcccattctcagtctaga

SEQ ID NO: 205518 - DNA, 25 bp, Homo sapien
ctcatagctgaaggcacccaccggg

SEQ ID NO: 205519 - DNA, 25 bp, Homo sapien
gtttggccaaatcctctagtcgctc

SEQ ID NO: 205520 - DNA, 25 bp, Homo sapien
tgccgcctcaccacctttgatttta

SEQ ID NO: 205521 - DNA, 25 bp, Homo sapien
gcccagacaccgaactttgcaaatg

SEQ ID NO: 205522 - DNA, 25 bp, Homo sapien
aggccgtacaagaagtggtccattc

SEQ ID NO: 205523 - DNA, 25 bp, Homo sapien
gtgggcctgcttcatctcatccgag

SEQ ID NO: 205524 - DNA, 25 bp, Homo sapien
cgccacggctgctcattggatgatc

SEQ ID NO: 205525 - DNA, 25 bp, Homo sapien
gctcttcccagtgccgaggtatctg

SEQ ID NO: 205526 - DNA, 25 bp, Homo sapien
agcaaggactggcttctgcgtgagc

SEQ ID NO: 205527 - DNA, 25 bp, Homo sapien
ctgttagagtcagcacgagggcttc

SEQ ID NO: 205528 - DNA, 25 bp, Homo sapien
aaagagctgctctctgtgggcctgc

SEQ ID NO: 205529 - DNA, 25 bp, Homo sapien
atccacaggcacgatggagccgctg

SEQ ID NO: 205530 - DNA, 25 bp, Homo sapien
acgggctcaggcacaccgggaatgt

SEQ ID NO: 205531 - DNA, 25 bp, Homo sapien
accgggaatgtgccacgggtcctgt

SEQ ID NO: 205532 - DNA, 25 bp, Homo sapien
acaccgggaatgtgccacgggtcct

SEQ ID NO: 205533 - DNA, 25 bp, Homo sapien
cacgggctcaggcacaccgggaatg

SEQ ID NO: 205534 - DNA, 25 bp, Homo sapien
tgcacgggctcaggcacaccgggaa

SEQ ID NO: 205535 - DNA, 25 bp, Homo sapien
cacaccgggaatgtgccacgggtcc

SEQ ID NO: 205536 - DNA, 25 bp, Homo sapien
gcacgggctcaggcacaccgggaat

SEQ ID NO: 205537 - DNA, 25 bp, Homo sapien
cggtgcacgggctcaggcacaccgg

SEQ ID NO: 205538 - DNA, 25 bp, Homo sapien
gggtcacatgcacagcccgctggtt

SEQ ID NO: 205539 - DNA, 25 bp, Homo sapien
ccacacttggttggcagcaaaagca

SEQ ID NO: 205540 - DNA, 25 bp, Homo sapien
atttgctgtttcctgcctgaggctg

SEQ ID NO: 205541 - DNA, 25 bp, Homo sapien
tcgaaagcgacagccacacttggtt

SEQ ID NO: 205542 - DNA, 25 bp, Homo sapien
acatcatggagcaggaccaccactg

SEQ ID NO: 205543 - DNA, 25 bp, Homo sapien
acgctcacatcacggacatcatgga

SEQ ID NO: 205544 - DNA, 25 bp, Homo sapien
ccaccatgtagcctttcccgaagta

SEQ ID NO: 205545 - DNA, 25 bp, Homo sapien
tcgcaagccggagcaccaccatgta

SEQ ID NO: 205546 - DNA, 25 bp, Homo sapien
gcgccgcagcagagagacgcgaacc

SEQ ID NO: 205547 - DNA, 25 bp, Homo sapien
cgggtggttcctgctaaagaagcca

SEQ ID NO: 205548 - DNA, 25 bp, Homo sapien
gcggacacaagcacacgcgcgctgg

SEQ ID NO: 205549 - DNA, 25 bp, Homo sapien
gctagtcgcaccgagcgctcgtttc

SEQ ID NO: 205550 - DNA, 25 bp, Homo sapien
agcgctcgtttctttgtccggatcg

SEQ ID NO: 205551 - DNA, 25 bp, Homo sapien
ggccaacctgcagcggaacaggcgc

SEQ ID NO: 205552 - DNA, 25 bp, Homo sapien
agccgcctaccgagagcacagcggt

SEQ ID NO: 205553 - DNA, 25 bp, Homo sapien
cctgctaaagaagccagttttcttg

SEQ ID NO: 205554 - DNA, 25 bp, Homo sapien
tggcgggaatgatcagaagcgtttc

SEQ ID NO: 205555 - DNA, 25 bp, Homo sapien
tgccgcgcaccacagtccgagtaaa

SEQ ID NO: 205556 - DNA, 25 bp, Homo sapien
agccgcgagtaaggcgagtgtccaa

SEQ ID NO: 205557 - DNA, 25 bp, Homo sapien
gtccaacgccgagctggctgacaga

SEQ ID NO: 205558 - DNA, 25 bp, Homo sapien
cccgacactgtcattggcctaggca

SEQ ID NO: 205559 - DNA, 25 bp, Homo sapien
ccgcgctccagatgaagtgtgagca

SEQ ID NO: 205560 - DNA, 25 bp, Homo sapien
ctcgctcgcttcagggctcttcaag

SEQ ID NO: 205561 - DNA, 25 bp, Homo sapien
gcggttctccctgaacttgtccatc

SEQ ID NO: 205562 - DNA, 25 bp, Homo sapien
agcccacgatggcagcaacaggtga

SEQ ID NO: 205563 - DNA, 25 bp, Homo sapien
cgctgggtattcgaatgtggtcgcc

SEQ ID NO: 205564 - DNA, 25 bp, Homo sapien
gcgcctctccttaggaaacccagtg

SEQ ID NO: 205565 - DNA, 25 bp, Homo sapien
tcacgtgggtggtttgtcaactgct

SEQ ID NO: 205566 - DNA, 25 bp, Homo sapien
ccgactacgaagctgcggcatcgca

SEQ ID NO: 205567 - DNA, 25 bp, Homo sapien
cggaagcgtttgctcgtgcagatcc

SEQ ID NO: 205568 - DNA, 25 bp, Homo sapien
gaggtcggcaccagcatctttccca

SEQ ID NO: 205569 - DNA, 25 bp, Homo sapien
gcctgaaacgaacgcggtgccctaa

SEQ ID NO: 205570 - DNA, 25 bp, Homo sapien
agcttggtgcgacgtgtcttgccat

SEQ ID NO: 205571 - DNA, 25 bp, Homo sapien
ctgcttgggcaagaacggggtattc

SEQ ID NO: 205572 - DNA, 25 bp, Homo sapien
ttgccattggcctgcttcggtagcc

SEQ ID NO: 205573 - DNA, 25 bp, Homo sapien
gccgcgagttcgagtatctgatgaa

SEQ ID NO: 205574 - DNA, 25 bp, Homo sapien
tctgatgaagaagcgctcggtgacc

SEQ ID NO: 205575 - DNA, 25 bp, Homo sapien
agcgctcggtgaccatcggccgcaa

SEQ ID NO: 205576 - DNA, 25 bp, Homo sapien
cattggccggcgtaaccgtccgtca

SEQ ID NO: 205577 - DNA, 25 bp, Homo sapien
agcatgggccactcgagcttcatct

SEQ ID NO: 205578 - DNA, 25 bp, Homo sapien
gtccacaccagcgtgtgtgctcggg

SEQ ID NO: 205579 - DNA, 25 bp, Homo sapien
acacgtccacaccagcgtgtgtgct

SEQ ID NO: 205580 - DNA, 25 bp, Homo sapien
gcggcgggttcgtccacaccagcgt

SEQ ID NO: 205581 - DNA, 25 bp, Homo sapien
ccacaccagcgtgtgtgctcgggtg

SEQ ID NO: 205582 - DNA, 25 bp, Homo sapien
cgggttcgtccacaccagcgtgtgt

SEQ ID NO: 205583 - DNA, 25 bp, Homo sapien
gggttcgtccacaccagcgtgtgtg

SEQ ID NO: 205584 - DNA, 25 bp, Homo sapien
ttcgtccacaccagcgtgtgtgctc

SEQ ID NO: 205585 - DNA, 25 bp, Homo sapien
gttcgtccacaccagcgtgtgtgct

SEQ ID NO: 205586 - DNA, 25 bp, Homo sapien
ctgtcccacacaggctgagtctgtc

SEQ ID NO: 205587 - DNA, 25 bp, Homo sapien
cagttcacaggcgtaggcgtgcaga

SEQ ID NO: 205588 - DNA, 25 bp, Homo sapien
caggctgagtctgtctacccgagtg

SEQ ID NO: 205589 - DNA, 25 bp, Homo sapien
gtctacccgagtgtcccgctcagtt

SEQ ID NO: 205590 - DNA, 25 bp, Homo sapien
taagtcttaaatgcccacggacctg

SEQ ID NO: 205591 - DNA, 25 bp, Homo sapien
tcttaaatgcccacggacctgctcg

SEQ ID NO: 205592 - DNA, 25 bp, Homo sapien
gtgtcccgctcagttcacaggcgta

SEQ ID NO: 205593 - DNA, 25 bp, Homo sapien
accgtcagtgcacgggagctgctta

SEQ ID NO: 205594 - DNA, 25 bp, Homo sapien
ggaagcccggtttgcccagagcgcc

SEQ ID NO: 205595 - DNA, 25 bp, Homo sapien
gtcatccaggaagcccggtttgccc

SEQ ID NO: 205596 - DNA, 25 bp, Homo sapien
agcccaaactcgctgtcatccagga

SEQ ID NO: 205597 - DNA, 25 bp, Homo sapien
cctggcgctgcacagcccaaactcg

SEQ ID NO: 205598 - DNA, 25 bp, Homo sapien
ccctgagagcctgtcgagggaaggt

SEQ ID NO: 205599 - DNA, 25 bp, Homo sapien
tctgctcactctagtggcgcccaga

SEQ ID NO: 205600 - DNA, 25 bp, Homo sapien
cgcgggagtgctgtctgctcactct

SEQ ID NO: 205601 - DNA, 25 bp, Homo sapien
cccaacagcgtgagccagacgcgga

SEQ ID NO: 205602 - DNA, 25 bp, Homo sapien
tctgacattgacaagtggagacacc

SEQ ID NO: 205603 - DNA, 25 bp, Homo sapien
agccgccgcgtgtcttttcccttgg

SEQ ID NO: 205604 - DNA, 25 bp, Homo sapien
gtgtcttttcccttggcctcgcgcg

SEQ ID NO: 205605 - DNA, 25 bp, Homo sapien
agagaggctgcttttctgtgcgctt

SEQ ID NO: 205606 - DNA, 25 bp, Homo sapien
ggctgcttttctgtgcgctttgctc

SEQ ID NO: 205607 - DNA, 25 bp, Homo sapien
ctttgctctcagagtccgtccgagg

SEQ ID NO: 205608 - DNA, 25 bp, Homo sapien
tccgaggccggtgcacagaaaaccg

SEQ ID NO: 205609 - DNA, 25 bp, Homo sapien
aaaccgcacggatgttctgacattg

SEQ ID NO: 205610 - DNA, 25 bp, Homo sapien
cactgccaacagtcgcgacgtctgg

SEQ ID NO: 205611 - DNA, 25 bp, Homo sapien
tctatgacacagcaaagggcgattc

SEQ ID NO: 205612 - DNA, 25 bp, Homo sapien
ccgaaattgaagctacgccaggctg

SEQ ID NO: 205613 - DNA, 25 bp, Homo sapien
agtccagcctcaggtctatgacaca

SEQ ID NO: 205614 - DNA, 25 bp, Homo sapien
gggctcatcactccgggtcgccagt

SEQ ID NO: 205615 - DNA, 25 bp, Homo sapien
catccattccgggtacctcgggcgg

SEQ ID NO: 205616 - DNA, 25 bp, Homo sapien
gtcaccctgacaggacaaacactcg

SEQ ID NO: 205617 - DNA, 25 bp, Homo sapien
caggctgttgtgaattgatccactg

SEQ ID NO: 205618 - DNA, 25 bp, Homo sapien
gaggcaccctaccaatcagaccagg

SEQ ID NO: 205619 - DNA, 25 bp, Homo sapien
gaatttgggatcctcacctcgggcc

SEQ ID NO: 205620 - DNA, 25 bp, Homo sapien
aggaccctgcaaccaatgggaattc

SEQ ID NO: 205621 - DNA, 25 bp, Homo sapien
gcgtgtcctaaatccaatcgaaata

SEQ ID NO: 205622 - DNA, 25 bp, Homo sapien
ggcgtgtcagcagcccttttaggga

SEQ ID NO: 205623 - DNA, 25 bp, Homo sapien
ggcgctatctttcaggtagccaatc

SEQ ID NO: 205624 - DNA, 25 bp, Homo sapien
ccggctaatgggaaacaaggactgc

SEQ ID NO: 205625 - DNA, 25 bp, Homo sapien
ggcgccttaaatagattcttcacta

SEQ ID NO: 205626 - DNA, 25 bp, Homo sapien
cgtgtcgacacaggtcacgtgggcc

SEQ ID NO: 205627 - DNA, 25 bp, Homo sapien
tctcacggaacacagagcaagcctg

SEQ ID NO: 205628 - DNA, 25 bp, Homo sapien
gagcaagcctgtctacgagttcagc

SEQ ID NO: 205629 - DNA, 25 bp, Homo sapien
gcctgtctacgagttcagccggtga

SEQ ID NO: 205630 - DNA, 25 bp, Homo sapien
acgcgctaagccgtgactccctgta

SEQ ID NO: 205631 - DNA, 25 bp, Homo sapien
taacacacccgtgtcgacacaggtc

SEQ ID NO: 205632 - DNA, 25 bp, Homo sapien
gtgactccctgtaacacacccgtgt

SEQ ID NO: 205633 - DNA, 25 bp, Homo sapien
tgctcagagctctcacggaacacag

SEQ ID NO: 205634 - DNA, 25 bp, Homo sapien
ctatctggccatgaggagctgacca

SEQ ID NO: 205635 - DNA, 25 bp, Homo sapien
ggctctcacggctgacccgatgtca

SEQ ID NO: 205636 - DNA, 25 bp, Homo sapien
agccagcgtccctgcaggggactgc

SEQ ID NO: 205637 - DNA, 25 bp, Homo sapien
cccgtttgctgcttgagtctcttcg

SEQ ID NO: 205638 - DNA, 25 bp, Homo sapien
ccagtgttgactcccgctcttcgtg

SEQ ID NO: 205639 - DNA, 25 bp, Homo sapien
catccgctccgctagggaagacctg

SEQ ID NO: 205640 - DNA, 25 bp, Homo sapien
aggtcggtctctgaccagccagcgt

SEQ ID NO: 205641 - DNA, 25 bp, Homo sapien
gagtctcttcggagcccagtgttga

SEQ ID NO: 205642 - DNA, 25 bp, Homo sapien
gttggcaacacacgcatccgcatcg

SEQ ID NO: 205643 - DNA, 25 bp, Homo sapien
cgatatcaactctgtggtgccaaaa

SEQ ID NO: 205644 - DNA, 25 bp, Homo sapien
ctagcgaccgggagagcttttcttt

SEQ ID NO: 205645 - DNA, 25 bp, Homo sapien
caggacccttagagggcgagagttc

SEQ ID NO: 205646 - DNA, 25 bp, Homo sapien
agcgccacaacggtgaccagccgga

SEQ ID NO: 205647 - DNA, 25 bp, Homo sapien
cggcgagtcctttgcacatgttggc

SEQ ID NO: 205648 - DNA, 25 bp, Homo sapien
cctcgtgtcatttcagccgcggcga

SEQ ID NO: 205649 - DNA, 25 bp, Homo sapien
atcgtcattgccctgagcgtggaca

SEQ ID NO: 205650 - DNA, 25 bp, Homo sapien
ggccttgtttcccatacactgcgct

SEQ ID NO: 205651 - DNA, 25 bp, Homo sapien
acgttcctggtgaacgggcctgtga

SEQ ID NO: 205652 - DNA, 25 bp, Homo sapien
tccgcatcagttctgaggctgttca

SEQ ID NO: 205653 - DNA, 25 bp, Homo sapien
tttaaaaagcacatgcctggggagg

SEQ ID NO: 205654 - DNA, 25 bp, Homo sapien
ccttgccgctctacagtgattttta

SEQ ID NO: 205655 - DNA, 25 bp, Homo sapien
tgaaaagcagctgcgctcccgagtc

SEQ ID NO: 205656 - DNA, 25 bp, Homo sapien
ccatcagttccacttgaaaagcagc

SEQ ID NO: 205657 - DNA, 25 bp, Homo sapien
ggcctcacatgaggcacgtccgtgc

SEQ ID NO: 205658 - DNA, 25 bp, Homo sapien
aaggaggtcaccttccctgggcgct

SEQ ID NO: 205659 - DNA, 25 bp, Homo sapien
ggcgctttaaatcatccagtgctta

SEQ ID NO: 205660 - DNA, 25 bp, Homo sapien
cacctggattccgacatgggaaaag

SEQ ID NO: 205661 - DNA, 25 bp, Homo sapien
tcagccacgggctacctactaaaga

SEQ ID NO: 205662 - DNA, 25 bp, Homo sapien
cctcctcaccgtggtcctggttgaa

SEQ ID NO: 205663 - DNA, 25 bp, Homo sapien
cgtcaatcacgctgtggggaaaatc

SEQ ID NO: 205664 - DNA, 25 bp, Homo sapien
atcccgataaccgtggagcccgcag

SEQ ID NO: 205665 - DNA, 25 bp, Homo sapien
cggctccagtaaacccaagcgaagt

SEQ ID NO: 205666 - DNA, 25 bp, Homo sapien
acctccttcagagaagccctggtgc

SEQ ID NO: 205667 - DNA, 25 bp, Homo sapien
gacaaccggaccaccacctccttca

SEQ ID NO: 205668 - DNA, 25 bp, Homo sapien
ctactctggatgacgggggcccaga

SEQ ID NO: 205669 - DNA, 25 bp, Homo sapien
acagcgctatgtccgttctggggtc

SEQ ID NO: 205670 - DNA, 25 bp, Homo sapien
agccacagcgctatgtccgttctgg

SEQ ID NO: 205671 - DNA, 25 bp, Homo sapien
tctgatcccaaaagccgattcccag

SEQ ID NO: 205672 - DNA, 25 bp, Homo sapien
ggccacaggttctgatcccaaaagc

SEQ ID NO: 205673 - DNA, 25 bp, Homo sapien
ggttctgatcccaaaagccgattcc

SEQ ID NO: 205674 - DNA, 25 bp, Homo sapien
ccagacggaaatggggtccaggcca

SEQ ID NO: 205675 - DNA, 25 bp, Homo sapien
agaccgagaggaagacaaacgccca

SEQ ID NO: 205676 - DNA, 25 bp, Homo sapien
tgccctgcaactacagaccgagagg

SEQ ID NO: 205677 - DNA, 25 bp, Homo sapien
tccaagatccaagaactctgccctg

SEQ ID NO: 205678 - DNA, 25 bp, Homo sapien
caagttgccgacagggtccaagatc

SEQ ID NO: 205679 - DNA, 25 bp, Homo sapien
acatagtctgtggagtcaagttgcc

SEQ ID NO: 205680 - DNA, 25 bp, Homo sapien
gaagacacttccctgggtaaccagc

SEQ ID NO: 205681 - DNA, 25 bp, Homo sapien
tgttgcagaacagaagacacttccc

SEQ ID NO: 205682 - DNA, 25 bp, Homo sapien
ctcctgaaaggtcgctgtcaccaca

SEQ ID NO: 205683 - DNA, 25 bp, Homo sapien
gccgaacgcgcacttgcggactcga

SEQ ID NO: 205684 - DNA, 25 bp, Homo sapien
cccgctgcgcgcagactgcggagaa

SEQ ID NO: 205685 - DNA, 25 bp, Homo sapien
gtgcaacagggacgccgcagcacga

SEQ ID NO: 205686 - DNA, 25 bp, Homo sapien
gagcagaaagtcgtaggcccggacc

SEQ ID NO: 205687 - DNA, 25 bp, Homo sapien
cgccattggtggaccgcagttgcta

SEQ ID NO: 205688 - DNA, 25 bp, Homo sapien
gttgtccgtccatcttactctcgtc

SEQ ID NO: 205689 - DNA, 25 bp, Homo sapien
cgcgctttcactggcttggttgtcc

SEQ ID NO: 205690 - DNA, 25 bp, Homo sapien
tgggcgtcgcatgtctatacagaga

SEQ ID NO: 205691 - DNA, 25 bp, Homo sapien
cacgcagtgactgctccagacgggc

SEQ ID NO: 205692 - DNA, 25 bp, Homo sapien
catgtctatacagagactgctccag

SEQ ID NO: 205693 - DNA, 25 bp, Homo sapien
cgtcgcatgtctatacagagactgc

SEQ ID NO: 205694 - DNA, 25 bp, Homo sapien
gtgcccacgcagagactgctccgga

SEQ ID NO: 205695 - DNA, 25 bp, Homo sapien
acgcagagactgctccggactggcc

SEQ ID NO: 205696 - DNA, 25 bp, Homo sapien
cgcagtgactgctccagacgggccg

SEQ ID NO: 205697 - DNA, 25 bp, Homo sapien
tgtgggcgtcgcatgtctatacaga

SEQ ID NO: 205698 - DNA, 25 bp, Homo sapien
tgctgcaggacgatgtgagtttccc

SEQ ID NO: 205699 - DNA, 25 bp, Homo sapien
gagggttcaccactgtttcctgaga

SEQ ID NO: 205700 - DNA, 25 bp, Homo sapien
tccgcggaggacttggtcatctttt

SEQ ID NO: 205701 - DNA, 25 bp, Homo sapien
gccggagtttacagaagcctcatta

SEQ ID NO: 205702 - DNA, 25 bp, Homo sapien
gcaccaaattcccttcggccaatga

SEQ ID NO: 205703 - DNA, 25 bp, Homo sapien
cggcaggacgaggtggcaccaaatt

SEQ ID NO: 205704 - DNA, 25 bp, Homo sapien
ttccagagagaaagctcccgacgcg

SEQ ID NO: 205705 - DNA, 25 bp, Homo sapien
atctttttcgagttgtgctgccttc

SEQ ID NO: 205706 - DNA, 25 bp, Homo sapien
gtgcatcagccagggccggagctac

SEQ ID NO: 205707 - DNA, 25 bp, Homo sapien
cggagctacgacacggatcaaggac

SEQ ID NO: 205708 - DNA, 25 bp, Homo sapien
gacgagtgttcgtgaaagtgaaccc

SEQ ID NO: 205709 - DNA, 25 bp, Homo sapien
gagcctcggtcagtacgttgtgaaa

SEQ ID NO: 205710 - DNA, 25 bp, Homo sapien
aagtgactctggaggtgtccatccc

SEQ ID NO: 205711 - DNA, 25 bp, Homo sapien
tctagccggggaagctgcttaagtc

SEQ ID NO: 205712 - DNA, 25 bp, Homo sapien
tcctgttctccgtgaactttctctc

SEQ ID NO: 205713 - DNA, 25 bp, Homo sapien
ggactcatgtttgcccgctcggccg

SEQ ID NO: 205714 - DNA, 25 bp, Homo sapien
tgacagcggcgtctaacgtcactgc

SEQ ID NO: 205715 - DNA, 25 bp, Homo sapien
catagagggatgttctggagaagcc

SEQ ID NO: 205716 - DNA, 25 bp, Homo sapien
gcagtcctggctaggcagcctgcca

SEQ ID NO: 205717 - DNA, 25 bp, Homo sapien
cgccggatcggacgcttggcactct

SEQ ID NO: 205718 - DNA, 25 bp, Homo sapien
tcccaggagaacctccgaggtggga

SEQ ID NO: 205719 - DNA, 25 bp, Homo sapien
ggctcggctatgtgcagtgaagctg

SEQ ID NO: 205720 - DNA, 25 bp, Homo sapien
gtcccgcccgcatagagggatgttc

SEQ ID NO: 205721 - DNA, 25 bp, Homo sapien
cgtctaacgtcactgcgcacggggc

SEQ ID NO: 205722 - DNA, 25 bp, Homo sapien
actgggtaggtccatcccgacagca

SEQ ID NO: 205723 - DNA, 25 bp, Homo sapien
agcacagcatcaggtgcccgggacc

SEQ ID NO: 205724 - DNA, 25 bp, Homo sapien
ccactgggtaggtccatcccgacag

SEQ ID NO: 205725 - DNA, 25 bp, Homo sapien
taggtccatcccgacagcacctgtg

SEQ ID NO: 205726 - DNA, 25 bp, Homo sapien
gtccatcccgacagcacctgtgccg

SEQ ID NO: 205727 - DNA, 25 bp, Homo sapien
aggtccatcccgacagcacctgtgc

SEQ ID NO: 205728 - DNA, 25 bp, Homo sapien
catcgttccactcagcacagcatca

SEQ ID NO: 205729 - DNA, 25 bp, Homo sapien
cgggtaggtccatcccgacagcacc

SEQ ID NO: 205730 - DNA, 25 bp, Homo sapien
tgacatcgttccactcagcacagca

SEQ ID NO: 205731 - DNA, 25 bp, Homo sapien
tcgttctgtgtcagcacatcaggtg

SEQ ID NO: 205732 - DNA, 25 bp, Homo sapien
ccgatggcacgtgtgctgctcgact

SEQ ID NO: 205733 - DNA, 25 bp, Homo sapien
tgggtccatcccgacagcacctgtg

SEQ ID NO: 205734 - DNA, 25 bp, Homo sapien
gccgcttggctcaaggccctgacat

SEQ ID NO: 205735 - DNA, 25 bp, Homo sapien
aaagcggcgccatcccgatggcacg

SEQ ID NO: 205736 - DNA, 25 bp, Homo sapien
ggacccgggacatcatcgttctgtg

SEQ ID NO: 205737 - DNA, 25 bp, Homo sapien
acctccctgccagacggtgcgtgtg

SEQ ID NO: 205738 - DNA, 25 bp, Homo sapien
ggccgagcctacgacacggacgcag

SEQ ID NO: 205739 - DNA, 25 bp, Homo sapien
aagtcaaccgcaggacgcaggtgct

SEQ ID NO: 205740 - DNA, 25 bp, Homo sapien
gcaggcccagtgttcgtcaaagtca

SEQ ID NO: 205741 - DNA, 25 bp, Homo sapien
cgtcagcctctctctccgatcggca

SEQ ID NO: 205742 - DNA, 25 bp, Homo sapien
ggcttccgagcgagcagagtcccgc

SEQ ID NO: 205743 - DNA, 25 bp, Homo sapien
cgcaggaagcgcgaagccggacgaa

SEQ ID NO: 205744 - DNA, 25 bp, Homo sapien
tccgatcggcacctggcgtcccagt

SEQ ID NO: 205745 - DNA, 25 bp, Homo sapien
gtgttcgtcaaagtcaaccgcagga

SEQ ID NO: 205746 - DNA, 25 bp, Homo sapien
tcccggatctgttttgtggcctaga

SEQ ID NO: 205747 - DNA, 25 bp, Homo sapien
tttccaagaacgaggtgatgagacc

SEQ ID NO: 205748 - DNA, 25 bp, Homo sapien
gctcccagaggccagcgataactgc

SEQ ID NO: 205749 - DNA, 25 bp, Homo sapien
ctctcgtaggtgaagatcccggatc

SEQ ID NO: 205750 - DNA, 25 bp, Homo sapien
ttacgacccggcttccttctatggc

SEQ ID NO: 205751 - DNA, 25 bp, Homo sapien
ccttctatggccattccgagtttga

SEQ ID NO: 205752 - DNA, 25 bp, Homo sapien
ccgagtttgaactggcaatcgcctt

SEQ ID NO: 205753 - DNA, 25 bp, Homo sapien
taactgcagccgttgctctcgtagg

SEQ ID NO: 205754 - DNA, 25 bp, Homo sapien
tcttccagagcctttgggacccgtg

SEQ ID NO: 205755 - DNA, 25 bp, Homo sapien
cgcgctgagtgcactttaccgggcg

SEQ ID NO: 205756 - DNA, 25 bp, Homo sapien
aggacgagacactggcctttggcgc

SEQ ID NO: 205757 - DNA, 25 bp, Homo sapien
atggccctgagcgacgaaccggccg

SEQ ID NO: 205758 - DNA, 25 bp, Homo sapien
cccaggctgccgagatggccctgag

SEQ ID NO: 205759 - DNA, 25 bp, Homo sapien
ctagcggagtgggatctgcgaacac

SEQ ID NO: 205760 - DNA, 25 bp, Homo sapien
ctggctttcgcgctctagcggagtg

SEQ ID NO: 205761 - DNA, 25 bp, Homo sapien
tcccgcgcgcggtattttggcggcc

SEQ ID NO: 205762 - DNA, 25 bp, Homo sapien
cacgtagctgtctcgtgggcgtcgc

SEQ ID NO: 205763 - DNA, 25 bp, Homo sapien
ttgggcgtcatagcctggcagctcc

SEQ ID NO: 205764 - DNA, 25 bp, Homo sapien
atggagccggctctcgcgcaggcca

SEQ ID NO: 205765 - DNA, 25 bp, Homo sapien
ctcgcgcaggccaactagatggatg

SEQ ID NO: 205766 - DNA, 25 bp, Homo sapien
gccaactagatggatgtgctggaac

SEQ ID NO: 205767 - DNA, 25 bp, Homo sapien
ttccacgtctcaccttgcctggggt

SEQ ID NO: 205768 - DNA, 25 bp, Homo sapien
ttgcctggggtctccacgtagctgt

SEQ ID NO: 205769 - DNA, 25 bp, Homo sapien
ggggtctccacgtagctgtctcgtg

SEQ ID NO: 205770 - DNA, 25 bp, Homo sapien
gcgtcgtcttcctgtctgtggtatc

SEQ ID NO: 205771 - DNA, 25 bp, Homo sapien
gtccatggcgttgtcttcctgtctg

SEQ ID NO: 205772 - DNA, 25 bp, Homo sapien
tcagtgttgtcttcctgtccatggc

SEQ ID NO: 205773 - DNA, 25 bp, Homo sapien
ggcgtcctcatgtcctcagtgttgt

SEQ ID NO: 205774 - DNA, 25 bp, Homo sapien
ggcattgtcttcctatccgcggcgt

SEQ ID NO: 205775 - DNA, 25 bp, Homo sapien
agcatcgtcttcctatccgcggcat

SEQ ID NO: 205776 - DNA, 25 bp, Homo sapien
atgatgagtgccacctcgccacggc

SEQ ID NO: 205777 - DNA, 25 bp, Homo sapien
tgtggtatcatcttcctgcccgcgg

SEQ ID NO: 205778 - DNA, 25 bp, Homo sapien
cgaccgtgaccatcagggcgcctgt

SEQ ID NO: 205779 - DNA, 25 bp, Homo sapien
ccgcatctgtgctgggcggctctga

SEQ ID NO: 205780 - DNA, 25 bp, Homo sapien
ttgcttctcagagccctccctggtt

SEQ ID NO: 205781 - DNA, 25 bp, Homo sapien
ttctcagagccctccctggttgcgt

SEQ ID NO: 205782 - DNA, 25 bp, Homo sapien
cagagccctccctggttgcgtggta

SEQ ID NO: 205783 - DNA, 25 bp, Homo sapien
ctccctggttgcgtggtaggcgccc

SEQ ID NO: 205784 - DNA, 25 bp, Homo sapien
tcccttgacctttgcttctcagagc

SEQ ID NO: 205785 - DNA, 25 bp, Homo sapien
cagggcgcctgtggcaccgttgcca

SEQ ID NO: 205786 - DNA, 25 bp, Homo sapien
gaggcggagcttcggtctcctccgt

SEQ ID NO: 205787 - DNA, 25 bp, Homo sapien
ctcctgtgcgattcagcagctacaa

SEQ ID NO: 205788 - DNA, 25 bp, Homo sapien
gcagctacaaatacccaacagcttt

SEQ ID NO: 205789 - DNA, 25 bp, Homo sapien
tacgtgttggcgtgaagatggttcc

SEQ ID NO: 205790 - DNA, 25 bp, Homo sapien
tatgtgtgttgctttacgtgttggc

SEQ ID NO: 205791 - DNA, 25 bp, Homo sapien
ccctccaacttatgtgtgttgcttt

SEQ ID NO: 205792 - DNA, 25 bp, Homo sapien
ccaacagctttggagtggcagcgcg

SEQ ID NO: 205793 - DNA, 25 bp, Homo sapien
ttcccgaggcggagcttcggtctcc

SEQ ID NO: 205794 - DNA, 25 bp, Homo sapien
cggccgcgaacagtgctccagaact

SEQ ID NO: 205795 - DNA, 25 bp, Homo sapien
actcagagagttttccagacgggtg

SEQ ID NO: 205796 - DNA, 25 bp, Homo sapien
gacccgggccttcaagagctattta

SEQ ID NO: 205797 - DNA, 25 bp, Homo sapien
cccaagcttgtctgattctgtctgc

SEQ ID NO: 205798 - DNA, 25 bp, Homo sapien
tccagcctcttgctcctgtgaatca

SEQ ID NO: 205799 - DNA, 25 bp, Homo sapien
tcagtctgccctaccctggaatggg

SEQ ID NO: 205800 - DNA, 25 bp, Homo sapien
ggaaaatgcggacatgccactcagt

SEQ ID NO: 205801 - DNA, 25 bp, Homo sapien
atgaggcgctttagccgtctccacg

SEQ ID NO: 205802 - DNA, 25 bp, Homo sapien
tgcgtcaccaggctgtccgtggcag

SEQ ID NO: 205803 - DNA, 25 bp, Homo sapien
ttcgtctgaacccatctccgcggtg

SEQ ID NO: 205804 - DNA, 25 bp, Homo sapien
cgtctcgactcgtggatggtgagta

SEQ ID NO: 205805 - DNA, 25 bp, Homo sapien
tgctgccatctcgactcgtggatgg

SEQ ID NO: 205806 - DNA, 25 bp, Homo sapien
catctcgactcgtggatggtgagta

SEQ ID NO: 205807 - DNA, 25 bp, Homo sapien
tgagtagctgaagcacggtcagctg

SEQ ID NO: 205808 - DNA, 25 bp, Homo sapien
tctgaacccatctccgcggtgtggc

SEQ ID NO: 205809 - DNA, 25 bp, Homo sapien
ctgaagcacggtcagctgcgtcacc

SEQ ID NO: 205810 - DNA, 25 bp, Homo sapien
tggtttctaaagaggcacctcccgc

SEQ ID NO: 205811 - DNA, 25 bp, Homo sapien
tgatcactgtcgacgccgcgtgcac

SEQ ID NO: 205812 - DNA, 25 bp, Homo sapien
tcatctggcggctgggagctgtaat

SEQ ID NO: 205813 - DNA, 25 bp, Homo sapien
ggtctggcgagagcctccgtcatct

SEQ ID NO: 205814 - DNA, 25 bp, Homo sapien
tctatcagaagccagctctgcgtgc

SEQ ID NO: 205815 - DNA, 25 bp, Homo sapien
gctttctttcccgatcacttctatc

SEQ ID NO: 205816 - DNA, 25 bp, Homo sapien
ggagctgtaataaagagcagtcttg

SEQ ID NO: 205817 - DNA, 25 bp, Homo sapien
ccgcgtgcacttcgtggtttctaaa

SEQ ID NO: 205818 - DNA, 25 bp, Homo sapien
tccctgttcttcaggcgtctgcaac

SEQ ID NO: 205819 - DNA, 25 bp, Homo sapien
ggttgcggcgtctgctcgcccttct

SEQ ID NO: 205820 - DNA, 25 bp, Homo sapien
ttaacaagagtagcccgggtcgctc

SEQ ID NO: 205821 - DNA, 25 bp, Homo sapien
gaaagcttgtccctctccgccgagc

SEQ ID NO: 205822 - DNA, 25 bp, Homo sapien
tctaggctcaagagtcgggatcatg

SEQ ID NO: 205823 - DNA, 25 bp, Homo sapien
cgggatcatgtgctgtttgttccgc

SEQ ID NO: 205824 - DNA, 25 bp, Homo sapien
aagcagctgcgcggcgaattctaga

SEQ ID NO: 205825 - DNA, 25 bp, Homo sapien
ccgacgtttccctgttcttcaggcg

SEQ ID NO: 205826 - DNA, 25 bp, Homo sapien
gctggaccgcgtgcggaccctcggt

SEQ ID NO: 205827 - DNA, 25 bp, Homo sapien
gatcgctggaccgcgtgcggaccct

SEQ ID NO: 205828 - DNA, 25 bp, Homo sapien
tgcggaccctcggtgcgcatccagg

SEQ ID NO: 205829 - DNA, 25 bp, Homo sapien
cggaccctcgctgcgcatccagggc

SEQ ID NO: 205830 - DNA, 25 bp, Homo sapien
cctcggtgcgcatccagggcgggat

SEQ ID NO: 205831 - DNA, 25 bp, Homo sapien
cctcgctgcgcatccagggcgggat

SEQ ID NO: 205832 - DNA, 25 bp, Homo sapien
accctcggtgcgcatccagggcggg

SEQ ID NO: 205833 - DNA, 25 bp, Homo sapien
cgggatcgctggaccgcgtgcggac

SEQ ID NO: 205834 - DNA, 25 bp, Homo sapien
agcatgtccatttgtcccgagcgga

SEQ ID NO: 205835 - DNA, 25 bp, Homo sapien
tccatttgtcccgagcggagggtct

SEQ ID NO: 205836 - DNA, 25 bp, Homo sapien
ccgggctgtgtaagaagcatgtcca

SEQ ID NO: 205837 - DNA, 25 bp, Homo sapien
cgtgtccgggctgtgtaagaagcat

SEQ ID NO: 205838 - DNA, 25 bp, Homo sapien
gtcttgtttcatcgcccgtgtccgg

SEQ ID NO: 205839 - DNA, 25 bp, Homo sapien
cccttgtcttgtttcatcgcccgtg

SEQ ID NO: 205840 - DNA, 25 bp, Homo sapien
ccagcgcccttgtcttgtttcatcg

SEQ ID NO: 205841 - DNA, 25 bp, Homo sapien
ggcactgggacacggccattgcacc

SEQ ID NO: 205842 - DNA, 25 bp, Homo sapien
ggcccattcgtcgaggtacatcgga

SEQ ID NO: 205843 - DNA, 25 bp, Homo sapien
gctgaagccctttgtgactgcaatc

SEQ ID NO: 205844 - DNA, 25 bp, Homo sapien
tgaagcctcacgtgttgcccgtgtg

SEQ ID NO: 205845 - DNA, 25 bp, Homo sapien
ttctcttgtccttgcccagttgtcg

SEQ ID NO: 205846 - DNA, 25 bp, Homo sapien
ccagttgtcgccgtgatcctgaagg

SEQ ID NO: 205847 - DNA, 25 bp, Homo sapien
tgtcgcttgcgtgcctcactcatct

SEQ ID NO: 205848 - DNA, 25 bp, Homo sapien
ctgcaatctcgaggtaggcccattc

SEQ ID NO: 205849 - DNA, 25 bp, Homo sapien
aaggcgctgacctacgacgagaagc

SEQ ID NO: 205850 - DNA, 25 bp, Homo sapien
taagcagctcgttgtgaggcacacg

SEQ ID NO: 205851 - DNA, 25 bp, Homo sapien
ggcacacgctggtaagcagctcgtt

SEQ ID NO: 205852 - DNA, 25 bp, Homo sapien
caagcagctcgttgtgaggcacacg

SEQ ID NO: 205853 - DNA, 25 bp, Homo sapien
gcccgcttggctttgatctcgtggg

SEQ ID NO: 205854 - DNA, 25 bp, Homo sapien
actgtggctcctgggttccctcacg

SEQ ID NO: 205855 - DNA, 25 bp, Homo sapien
acgcacccgggtgtaagcgccactg

SEQ ID NO: 205856 - DNA, 25 bp, Homo sapien
cctgtgtccgacaagcagctcgttg

SEQ ID NO: 205857 - DNA, 25 bp, Homo sapien
ttcgtcttttggacgtcctgggtgc

SEQ ID NO: 205858 - DNA, 25 bp, Homo sapien
tcagcatgtgtcctcagcgcatgtc

SEQ ID NO: 205859 - DNA, 25 bp, Homo sapien
ctagtgtcctcagcgtgtccgcagt

SEQ ID NO: 205860 - DNA, 25 bp, Homo sapien
atgtgtcctccgctagtgtcctcag

SEQ ID NO: 205861 - DNA, 25 bp, Homo sapien
ggttctttgctcagcgtagtgcgcc

SEQ ID NO: 205862 - DNA, 25 bp, Homo sapien
tggaaccagagggaacacactcctg

SEQ ID NO: 205863 - DNA, 25 bp, Homo sapien
agcgcatgtcctcagcgcacgtgtc

SEQ ID NO: 205864 - DNA, 25 bp, Homo sapien
cagtgcgtgtgtcctccgctcacgt

SEQ ID NO: 205865 - DNA, 25 bp, Homo sapien
ggggaaggtcgtatccatggaacca

SEQ ID NO: 205866 - DNA, 25 bp, Homo sapien
tcgattctcgcctgcgcagaagttg

SEQ ID NO: 205867 - DNA, 25 bp, Homo sapien
gtctcttgcagtcttcccgaggctg

SEQ ID NO: 205868 - DNA, 25 bp, Homo sapien
ccgaggctgctgtccatgacactga

SEQ ID NO: 205869 - DNA, 25 bp, Homo sapien
gggccatctgcatcaccacgggtgc

SEQ ID NO: 205870 - DNA, 25 bp, Homo sapien
cacatgaggcatgggtcgattctcg

SEQ ID NO: 205871 - DNA, 25 bp, Homo sapien
cgtcctgttgcccttggtgtctcag

SEQ ID NO: 205872 - DNA, 25 bp, Homo sapien
tgatgaccctgagggatgccagtgt

SEQ ID NO: 205873 - DNA, 25 bp, Homo sapien
ctgagtccagatcttcacatgaggc

SEQ ID NO: 205874 - DNA, 25 bp, Homo sapien
tgcccgagtacagctccggactctt

SEQ ID NO: 205875 - DNA, 25 bp, Homo sapien
ctacgtgcccgagtacagctccgga

SEQ ID NO: 205876 - DNA, 25 bp, Homo sapien
gtggagcctcctcgtcgacccacca

SEQ ID NO: 205877 - DNA, 25 bp, Homo sapien
agcatgaccgccctgggtggagcct

SEQ ID NO: 205878 - DNA, 25 bp, Homo sapien
tcccactcccgtggcagcatgaccg

SEQ ID NO: 205879 - DNA, 25 bp, Homo sapien
ccctgcccgacagcatgaagctgga

SEQ ID NO: 205880 - DNA, 25 bp, Homo sapien
gacgagaaagagtgcctcaagtacc

SEQ ID NO: 205881 - DNA, 25 bp, Homo sapien
agcccgcacctcttcaccttcccgc

SEQ ID NO: 205882 - DNA, 25 bp, Homo sapien
cggagggtcaccaagtacttctgta

SEQ ID NO: 205883 - DNA, 25 bp, Homo sapien
gagaccgtgtccagctgcaactgca

SEQ ID NO: 205884 - DNA, 25 bp, Homo sapien
ttaatccggggcctctcactcctag

SEQ ID NO: 205885 - DNA, 25 bp, Homo sapien
tgaagggcaccatgaaacgcacgtg

SEQ ID NO: 205886 - DNA, 25 bp, Homo sapien
ctgcaccacgcagacctgttggctg

SEQ ID NO: 205887 - DNA, 25 bp, Homo sapien
gaagtaccacgcagcactcaaggtg

SEQ ID NO: 205888 - DNA, 25 bp, Homo sapien
ccggactactgcctggagaacaaaa

SEQ ID NO: 205889 - DNA, 25 bp, Homo sapien
aacaaaacgctagggctgctgggca

SEQ ID NO: 205890 - DNA, 25 bp, Homo sapien
gttgaatgcgttccgagtccccagg

SEQ ID NO: 205891 - DNA, 25 bp, Homo sapien
ccgagtccctgtagctggcggcgat

SEQ ID NO: 205892 - DNA, 25 bp, Homo sapien
cgttccgagtccctgtagctggcgg

SEQ ID NO: 205893 - DNA, 25 bp, Homo sapien
ggcgacagagttgaaggcgtttgga

SEQ ID NO: 205894 - DNA, 25 bp, Homo sapien
caacgacggagttgaaggtgttccg

SEQ ID NO: 205895 - DNA, 25 bp, Homo sapien
atccctttggccaacgacggagttg

SEQ ID NO: 205896 - DNA, 25 bp, Homo sapien
cgatggagttgaatgcgttccgagt

SEQ ID NO: 205897 - DNA, 25 bp, Homo sapien
cctttggccaacgacggagttgaag

SEQ ID NO: 205898 - DNA, 25 bp, Homo sapien
tggtttacctcctgctctcggtttg

SEQ ID NO: 205899 - DNA, 25 bp, Homo sapien
actctcttgcaggtccgatgtggcc

SEQ ID NO: 205900 - DNA, 25 bp, Homo sapien
agatcattggcagcccggccttgtc

SEQ ID NO: 205901 - DNA, 25 bp, Homo sapien
tgttcctgacgctcctgcactttga

SEQ ID NO: 205902 - DNA, 25 bp, Homo sapien
tttgcagctgtgagcgcatcatgtg

SEQ ID NO: 205903 - DNA, 25 bp, Homo sapien
ggaccgcctgtgctcagtttaccgc

SEQ ID NO: 205904 - DNA, 25 bp, Homo sapien
cctccgtgaactggagtgcaccttc

SEQ ID NO: 205905 - DNA, 25 bp, Homo sapien
ggccagtgagaagattgaccgtttc

SEQ ID NO: 205906 - DNA, 25 bp, Homo sapien
tttcgtcacgtgctctcccgcatgt

SEQ ID NO: 205907 - DNA, 25 bp, Homo sapien
cccgcatgtcctaagtgagggctca

SEQ ID NO: 205908 - DNA, 25 bp, Homo sapien
gcgaaacccaaggtgagtggccgca

SEQ ID NO: 205909 - DNA, 25 bp, Homo sapien
ttcagtgggaaacgtgagcgaaacc

SEQ ID NO: 205910 - DNA, 25 bp, Homo sapien
ggattatcaaatcccgcttcagtgg

SEQ ID NO: 205911 - DNA, 25 bp, Homo sapien
gcactcgggaattgcggggattatc

SEQ ID NO: 205912 - DNA, 25 bp, Homo sapien
cgtaacaggacgtgaggtgccctct

SEQ ID NO: 205913 - DNA, 25 bp, Homo sapien
gttgccgagagccttgtgtctgctt

SEQ ID NO: 205914 - DNA, 25 bp, Homo sapien
aggtttccgacagacgcacgcatgc

SEQ ID NO: 205915 - DNA, 25 bp, Homo sapien
tgcgcacaacgctctgttctcgaga

SEQ ID NO: 205916 - DNA, 25 bp, Homo sapien
actccgacagatgtacgcatgcgca

SEQ ID NO: 205917 - DNA, 25 bp, Homo sapien
gctgcgtacctagcactccgacaga

SEQ ID NO: 205918 - DNA, 25 bp, Homo sapien
gctgtgccggtatcgccaacagatg

SEQ ID NO: 205919 - DNA, 25 bp, Homo sapien
gtctccgcagacagaagcacgcatg

SEQ ID NO: 205920 - DNA, 25 bp, Homo sapien
gcacacttctatgcgcggaggtctc

SEQ ID NO: 205921 - DNA, 25 bp, Homo sapien
gctgtgtgccaaggtcgccaaaaga

SEQ ID NO: 205922 - DNA, 25 bp, Homo sapien
gcagatcgcggagcggaagttcatc

SEQ ID NO: 205923 - DNA, 25 bp, Homo sapien
gtgagacctcattccgtcgcggctg

SEQ ID NO: 205924 - DNA, 25 bp, Homo sapien
gcgaagcggattctcgagttcttga

SEQ ID NO: 205925 - DNA, 25 bp, Homo sapien
ttcttgagcctagagcaatgcttgg

SEQ ID NO: 205926 - DNA, 25 bp, Homo sapien
ctcaggtcgtcaatgattccggggc

SEQ ID NO: 205927 - DNA, 25 bp, Homo sapien
ctagggctagaaccggcgaaaagca

SEQ ID NO: 205928 - DNA, 25 bp, Homo sapien
catcgacgggtgcactttgctgttc

SEQ ID NO: 205929 - DNA, 25 bp, Homo sapien
cgtcgccagtgacaccgggacaaca

SEQ ID NO: 205930 - DNA, 25 bp, Homo sapien
gccatgttttcttttctcgttacga

SEQ ID NO: 205931 - DNA, 25 bp, Homo sapien
aggaactcggcccagccatgttttc

SEQ ID NO: 205932 - DNA, 25 bp, Homo sapien
cagatgccgctctcggcaaacagga

SEQ ID NO: 205933 - DNA, 25 bp, Homo sapien
tctcgttacgactataatcagctgc

SEQ ID NO: 205934 - DNA, 25 bp, Homo sapien
tctcccatgagagcacagatgccgc

SEQ ID NO: 205935 - DNA, 25 bp, Homo sapien
cataaaggggcagttcgatcgattt

SEQ ID NO: 205936 - DNA, 25 bp, Homo sapien
cgatcgattttgataggtgtccacc

SEQ ID NO: 205937 - DNA, 25 bp, Homo sapien
atagcctcagcccatggtcacttga

SEQ ID NO: 205938 - DNA, 25 bp, Homo sapien
cacctgaggttctccggtgggcact

SEQ ID NO: 205939 - DNA, 25 bp, Homo sapien
gcgggacctccgcacacctgaggtt

SEQ ID NO: 205940 - DNA, 25 bp, Homo sapien
gactgcggccatggaagcttgacgc

SEQ ID NO: 205941 - DNA, 25 bp, Homo sapien
tgaggtctcctttccctgactgcgg

SEQ ID NO: 205942 - DNA, 25 bp, Homo sapien
tgtgacgtcttttctgccctcagcc

SEQ ID NO: 205943 - DNA, 25 bp, Homo sapien
ctggagaacgtgctcctgtgacgtc

SEQ ID NO: 205944 - DNA, 25 bp, Homo sapien
gtgggcactcgagagactcacggct

SEQ ID NO: 205945 - DNA, 25 bp, Homo sapien
gaaccgtcctcctgcgattccggaa

SEQ ID NO: 205946 - DNA, 25 bp, Homo sapien
ctgcccggatctaaggaaggaattc

SEQ ID NO: 205947 - DNA, 25 bp, Homo sapien
gcggcgaccacaacagacgtgagca

SEQ ID NO: 205948 - DNA, 25 bp, Homo sapien
gctcgtagaagaacagcaggtcctc

SEQ ID NO: 205949 - DNA, 25 bp, Homo sapien
cgcccttcctgaggtgctcgtagaa

SEQ ID NO: 205950 - DNA, 25 bp, Homo sapien
gtggtcattttacctctgggaacta

SEQ ID NO: 205951 - DNA, 25 bp, Homo sapien
tggccgctcctcacagtgacacggg

SEQ ID NO: 205952 - DNA, 25 bp, Homo sapien
cggcggcctgctttccaacttaacg

SEQ ID NO: 205953 - DNA, 25 bp, Homo sapien
cactcatgagactcccgtcgggtta

SEQ ID NO: 205954 - DNA, 25 bp, Homo sapien
tggacacctgcaggtgcacacccac

SEQ ID NO: 205955 - DNA, 25 bp, Homo sapien
ttaataagggacactgaagaaagga

SEQ ID NO: 205956 - DNA, 25 bp, Homo sapien
tctaaccaacatagaattggagttt

SEQ ID NO: 205957 - DNA, 25 bp, Homo sapien
caatagacatagctagtatttaaaa

SEQ ID NO: 205958 - DNA, 25 bp, Homo sapien
taaaacggacgcctacaggtgcgtc

SEQ ID NO: 205959 - DNA, 25 bp, Homo sapien
agaacggggacatggatgcctgaac

SEQ ID NO: 205960 - DNA, 25 bp, Homo sapien
ggatgcctgaacgtgcactcccaca

SEQ ID NO: 205961 - DNA, 25 bp, Homo sapien
tgaacgtgcactcccacagggagga

SEQ ID NO: 205962 - DNA, 25 bp, Homo sapien
gtctgcaaaacagctcaatccattc

SEQ ID NO: 205963 - DNA, 25 bp, Homo sapien
ccattctttagtgacaacgatccag

SEQ ID NO: 205964 - DNA, 25 bp, Homo sapien
cataaggacgcgcacagacaccgtg

SEQ ID NO: 205965 - DNA, 25 bp, Homo sapien
ggggctcagtcagcacagagcacta

SEQ ID NO: 205966 - DNA, 25 bp, Homo sapien
gagcactaggggctgcacctgaact

SEQ ID NO: 205967 - DNA, 25 bp, Homo sapien
cggcgagtcctccaagcatgggcaa

SEQ ID NO: 205968 - DNA, 25 bp, Homo sapien
tcacgggacgtttctatcggacaga

SEQ ID NO: 205969 - DNA, 25 bp, Homo sapien
cagaattacgcatctgtctgcaaaa

SEQ ID NO: 205970 - DNA, 25 bp, Homo sapien
ccagggtcagcaatgacagaccttc

SEQ ID NO: 205971 - DNA, 25 bp, Homo sapien
gcagggacagtagagccggatccaa

SEQ ID NO: 205972 - DNA, 25 bp, Homo sapien
tctgccgagaaaggagcagtgctcc

SEQ ID NO: 205973 - DNA, 25 bp, Homo sapien
agggcaccgtcggaaacacgctccg

SEQ ID NO: 205974 - DNA, 25 bp, Homo sapien
ccagcgcaatctctgctaccaggga

SEQ ID NO: 205975 - DNA, 25 bp, Homo sapien
gcgaaccaacctgtgcggaagaccc

SEQ ID NO: 205976 - DNA, 25 bp, Homo sapien
gcgccgagcccgagacactgacaga

SEQ ID NO: 205977 - DNA, 25 bp, Homo sapien
cggatccaattcaagggtagacgta

SEQ ID NO: 205978 - DNA, 25 bp, Homo sapien
tccgcagtccgcgtgtgggattcct

SEQ ID NO: 205979 - DNA, 25 bp, Homo sapien
cgtgtgggattcctgagctcgccct

SEQ ID NO: 205980 - DNA, 25 bp, Homo sapien
gtgtgggattcctgagctcgccctc

SEQ ID NO: 205981 - DNA, 25 bp, Homo sapien
ccctccgcatgtgggattcctgagc

SEQ ID NO: 205982 - DNA, 25 bp, Homo sapien
ccgcgtgtgggattcctgagcccac

SEQ ID NO: 205983 - DNA, 25 bp, Homo sapien
tgtgggattcctgagctcgccctcc

SEQ ID NO: 205984 - DNA, 25 bp, Homo sapien
tccgcgtgtgggattcctgagccca

SEQ ID NO: 205985 - DNA, 25 bp, Homo sapien
gccctccgcatgtgggattcctgag

SEQ ID NO: 205986 - DNA, 25 bp, Homo sapien
aagtctcccagctcgtttgaacaca

SEQ ID NO: 205987 - DNA, 25 bp, Homo sapien
ccataagtctcccagctcgtttgaa

SEQ ID NO: 205988 - DNA, 25 bp, Homo sapien
agtatcccagctcgtttgaacacac

SEQ ID NO: 205989 - DNA, 25 bp, Homo sapien
aagtatcccagctcgtttgaacaca

SEQ ID NO: 205990 - DNA, 25 bp, Homo sapien
atccataagtctcccagctcgtttg

SEQ ID NO: 205991 - DNA, 25 bp, Homo sapien
cgtatccataagtctcccagctcgt

SEQ ID NO: 205992 - DNA, 25 bp, Homo sapien
agctcgtttgaacacacgccacgaa

SEQ ID NO: 205993 - DNA, 25 bp, Homo sapien
gtatccataagtctcccagctcgtt

SEQ ID NO: 205994 - DNA, 25 bp, Homo sapien
ccgtgaacaccgtgcgcctgtatca

SEQ ID NO: 205995 - DNA, 25 bp, Homo sapien
gtgctccacaaacacggtgcgcctg

SEQ ID NO: 205996 - DNA, 25 bp, Homo sapien
gcgcctgtatcaggtaccacacgtg

SEQ ID NO: 205997 - DNA, 25 bp, Homo sapien
cgcctgtatcaggtaccacacgtgc

SEQ ID NO: 205998 - DNA, 25 bp, Homo sapien
ctgtatcaggtaccacacgtgctcc

SEQ ID NO: 205999 - DNA, 25 bp, Homo sapien
tccgtgaacaccgtgcgcctgtatc

SEQ ID NO: 206000 - DNA, 25 bp, Homo sapien
cctgtatcaggtaccacacgtgctc

SEQ ID NO: 206001 - DNA, 25 bp, Homo sapien
ccgcgaacatggtgtggctgtatca

SEQ ID NO: 206002 - DNA, 25 bp, Homo sapien
gcggagagtccacacacggacaccg

SEQ ID NO: 206003 - DNA, 25 bp, Homo sapien
ggacaccgcggagagtccacacaca

SEQ ID NO: 206004 - DNA, 25 bp, Homo sapien
gtccacacacggacaccgcggagag

SEQ ID NO: 206005 - DNA, 25 bp, Homo sapien
ggacaccgcggagagtccacacacg

SEQ ID NO: 206006 - DNA, 25 bp, Homo sapien
ggacaccgcggagtccacacacgga

SEQ ID NO: 206007 - DNA, 25 bp, Homo sapien
actgtgaagtccacacacacacgga

SEQ ID NO: 206008 - DNA, 25 bp, Homo sapien
ggagtccacacacggacaccgcgga

SEQ ID NO: 206009 - DNA, 25 bp, Homo sapien
agtccacacacggacaccgcggaga

SEQ ID NO: 206010 - DNA, 25 bp, Homo sapien
tgtaaactcagcgacggccgccaga

SEQ ID NO: 206011 - DNA, 25 bp, Homo sapien
gaagggtgtaaactcagcgacggcc

SEQ ID NO: 206012 - DNA, 25 bp, Homo sapien
taaactcagcgacggccgccagagc

SEQ ID NO: 206013 - DNA, 25 bp, Homo sapien
gcggggaagggtgtaaactcagcga

SEQ ID NO: 206014 - DNA, 25 bp, Homo sapien
aaactcagcgacggccgccagagca

SEQ ID NO: 206015 - DNA, 25 bp, Homo sapien
ggtgtaaactcagcgacggccgcca

SEQ ID NO: 206016 - DNA, 25 bp, Homo sapien
agggtgtaaactcagcgacggccgc

SEQ ID NO: 206017 - DNA, 25 bp, Homo sapien
ccagagcacccacgggtccctcgca

SEQ ID NO: 206018 - DNA, 25 bp, Homo sapien
ggggacgattctggcgatcacatga

SEQ ID NO: 206019 - DNA, 25 bp, Homo sapien
ccagcccggtatccgagaggtaaga

SEQ ID NO: 206020 - DNA, 25 bp, Homo sapien
gtactcttcacaggcaggtgtcttc

SEQ ID NO: 206021 - DNA, 25 bp, Homo sapien
ctctcctgcagtaccgcggacaaga

SEQ ID NO: 206022 - DNA, 25 bp, Homo sapien
catgtccttgtctcctagtcctggg

SEQ ID NO: 206023 - DNA, 25 bp, Homo sapien
cggacagcggaagcccatttcagga

SEQ ID NO: 206024 - DNA, 25 bp, Homo sapien
gcgctgagccagcacgatgcacata

SEQ ID NO: 206025 - DNA, 25 bp, Homo sapien
aggtgtcttctggtggacccaactc

SEQ ID NO: 206026 - DNA, 25 bp, Homo sapien
tcttctagacacactgctgggcgcc

SEQ ID NO: 206027 - DNA, 25 bp, Homo sapien
cccctgttctagacacactgctggg

SEQ ID NO: 206028 - DNA, 25 bp, Homo sapien
cctgttctagacacactgctgggcg

SEQ ID NO: 206029 - DNA, 25 bp, Homo sapien
ctcttctagacacactgctgggcgc

SEQ ID NO: 206030 - DNA, 25 bp, Homo sapien
ctgttctagacacactgctgggcgc

SEQ ID NO: 206031 - DNA, 25 bp, Homo sapien
gttctagacacactgctgggcgccc

SEQ ID NO: 206032 - DNA, 25 bp, Homo sapien
ccctgttctagacacactgctgggc

SEQ ID NO: 206033 - DNA, 25 bp, Homo sapien
tgttctagacacactgctgggcgcc

SEQ ID NO: 206034 - DNA, 25 bp, Homo sapien
tggcacctaccacgtgggcctgcat

SEQ ID NO: 206035 - DNA, 25 bp, Homo sapien
gggcgcgcgtcacaatctctggtcc

SEQ ID NO: 206036 - DNA, 25 bp, Homo sapien
caatctccgattggtgcagagcggc

SEQ ID NO: 206037 - DNA, 25 bp, Homo sapien
ctccgagcccggaagcttcaaaatc

SEQ ID NO: 206038 - DNA, 25 bp, Homo sapien
acgtgggcctgcatggcctggctct

SEQ ID NO: 206039 - DNA, 25 bp, Homo sapien
agccggagctgcagatctcggccgc

SEQ ID NO: 206040 - DNA, 25 bp, Homo sapien
ttcaaaatcagaacgaggaaggtcg

SEQ ID NO: 206041 - DNA, 25 bp, Homo sapien
gaggccaggcaatctccgattggtg

SEQ ID NO: 206042 - DNA, 25 bp, Homo sapien
ggtggggagacagaggttccctgca

SEQ ID NO: 206043 - DNA, 25 bp, Homo sapien
acagtgttagactcggtgctgggtg

SEQ ID NO: 206044 - DNA, 25 bp, Homo sapien
tccgcacggacggtgttagactcgg

SEQ ID NO: 206045 - DNA, 25 bp, Homo sapien
gacggtgttagactcggtgctgggt

SEQ ID NO: 206046 - DNA, 25 bp, Homo sapien
caggtccgcacggacggtgttagac

SEQ ID NO: 206047 - DNA, 25 bp, Homo sapien
aggtccgcacggacggtgttagact

SEQ ID NO: 206048 - DNA, 25 bp, Homo sapien
gtccgcacggacggtgttagactcg

SEQ ID NO: 206049 - DNA, 25 bp, Homo sapien
cacggacggtgttagactcggtgct

SEQ ID NO: 206050 - DNA, 25 bp, Homo sapien
ttgacgtggatcaccgaaggagctg

SEQ ID NO: 206051 - DNA, 25 bp, Homo sapien
gcccgccaagttgccagggaggcaa

SEQ ID NO: 206052 - DNA, 25 bp, Homo sapien
tcggtgccgcggcttcacacggtca

SEQ ID NO: 206053 - DNA, 25 bp, Homo sapien
ttcacacggtcagtgcacagacatg

SEQ ID NO: 206054 - DNA, 25 bp, Homo sapien
tgcacagacatgaacgctggactga

SEQ ID NO: 206055 - DNA, 25 bp, Homo sapien
ccgtgactggatggaatccgcaagc

SEQ ID NO: 206056 - DNA, 25 bp, Homo sapien
cacattgcactgctgactgaggggt

SEQ ID NO: 206057 - DNA, 25 bp, Homo sapien
gctgatgcaggcgagacacctggcc

SEQ ID NO: 206058 - DNA, 25 bp, Homo sapien
cacatgcgcaaaggcctgtcacggc

SEQ ID NO: 206059 - DNA, 25 bp, Homo sapien
gcccagcggcatcacgttccgggat

SEQ ID NO: 206060 - DNA, 25 bp, Homo sapien
tccagccgctccgaaggcttcaagt

SEQ ID NO: 206061 - DNA, 25 bp, Homo sapien
ccttggtcatgtgggaggctagaac

SEQ ID NO: 206062 - DNA, 25 bp, Homo sapien
cgttcttctggggtcctaggatagg

SEQ ID NO: 206063 - DNA, 25 bp, Homo sapien
gcatattatacttcttggcggcggc

SEQ ID NO: 206064 - DNA, 25 bp, Homo sapien
ttccgggatgccctttgcagccact

SEQ ID NO: 206065 - DNA, 25 bp, Homo sapien
aggttcgtagtcttccacacgcata

SEQ ID NO: 206066 - DNA, 25 bp, Homo sapien
tccagatcgcagacaccgtgccgtg

SEQ ID NO: 206067 - DNA, 25 bp, Homo sapien
tcctggtcccgaacgtctcgggtca

SEQ ID NO: 206068 - DNA, 25 bp, Homo sapien
tcccgaacgtctcgggtcactgtgg

SEQ ID NO: 206069 - DNA, 25 bp, Homo sapien
gtcactgtggggtaacgaggctctc

SEQ ID NO: 206070 - DNA, 25 bp, Homo sapien
ggtaacgaggctctcggaccctcgc

SEQ ID NO: 206071 - DNA, 25 bp, Homo sapien
ggaccctcgccatctgtcatcgtca

SEQ ID NO: 206072 - DNA, 25 bp, Homo sapien
tgaagagctccagatcgcagacacc

SEQ ID NO: 206073 - DNA, 25 bp, Homo sapien
ggctggccttccctgaagagctcca

SEQ ID NO: 206074 - DNA, 25 bp, Homo sapien
agacgtccacctctgtgtacaaatc

SEQ ID NO: 206075 - DNA, 25 bp, Homo sapien
caacgtttgtgagtttcaggccttc

SEQ ID NO: 206076 - DNA, 25 bp, Homo sapien
ccttcggtagttggcatatgggaca

SEQ ID NO: 206077 - DNA, 25 bp, Homo sapien
ccgtgagcgtcctccagaacgagtg

SEQ ID NO: 206078 - DNA, 25 bp, Homo sapien
ctgagcacatctgaccggccgtggt

SEQ ID NO: 206079 - DNA, 25 bp, Homo sapien
atccaccgtgtactgtagatggccc

SEQ ID NO: 206080 - DNA, 25 bp, Homo sapien
ctgcacactggccttcaacgtttgt

SEQ ID NO: 206081 - DNA, 25 bp, Homo sapien
gccggaccttagcacgtcatcactg

SEQ ID NO: 206082 - DNA, 25 bp, Homo sapien
tcgccaacttcagaggctcggcggc

SEQ ID NO: 206083 - DNA, 25 bp, Homo sapien
tcggactcgccaacttcagaggctc

SEQ ID NO: 206084 - DNA, 25 bp, Homo sapien
ccggctccgcgcgtgtccgagcctc

SEQ ID NO: 206085 - DNA, 25 bp, Homo sapien
cggactcggactcgccaacttcaga

SEQ ID NO: 206086 - DNA, 25 bp, Homo sapien
ggcgcgcagtactccagcgaccggt

SEQ ID NO: 206087 - DNA, 25 bp, Homo sapien
cggttctagaacaaaagagcccgcg

SEQ ID NO: 206088 - DNA, 25 bp, Homo sapien
cgcagtactccagcgaccggtgcag

SEQ ID NO: 206089 - DNA, 25 bp, Homo sapien
ggcgcgcgacgtgaccacccggact

SEQ ID NO: 206090 - DNA, 25 bp, Homo sapien
ctgaccgtgtgcatcaggtccttca

SEQ ID NO: 206091 - DNA, 25 bp, Homo sapien
gaactgagactgctggtaccagacg

SEQ ID NO: 206092 - DNA, 25 bp, Homo sapien
gtacccaacaggtgctctcatcgtt

SEQ ID NO: 206093 - DNA, 25 bp, Homo sapien
gcacgagctgtctggtgagtgtcct

SEQ ID NO: 206094 - DNA, 25 bp, Homo sapien
tgccgtggagtggatgtacccaaca

SEQ ID NO: 206095 - DNA, 25 bp, Homo sapien
gggtatcgtcctcactgactctctg

SEQ ID NO: 206096 - DNA, 25 bp, Homo sapien
cagtacgagctggttaggaggcaca

SEQ ID NO: 206097 - DNA, 25 bp, Homo sapien
gccatcatttggagcgggtatcgtc

SEQ ID NO: 206098 - DNA, 25 bp, Homo sapien
cgccggcttccgttcgcggactttg

SEQ ID NO: 206099 - DNA, 25 bp, Homo sapien
gaaccggttcctggacttgagcgga

SEQ ID NO: 206100 - DNA, 25 bp, Homo sapien
cgggcaaaagccaagccgccaggtg

SEQ ID NO: 206101 - DNA, 25 bp, Homo sapien
cacgtgacgcgacgcaacgcaggta

SEQ ID NO: 206102 - DNA, 25 bp, Homo sapien
tacccaagggtctcgagaaaagaga

SEQ ID NO: 206103 - DNA, 25 bp, Homo sapien
tgtcgtccaggccaggtacaactcc

SEQ ID NO: 206104 - DNA, 25 bp, Homo sapien
aaaaacgcggagctcgcgtctccca

SEQ ID NO: 206105 - DNA, 25 bp, Homo sapien
ccgcctgcacgactggactggagcg

SEQ ID NO: 206106 - DNA, 25 bp, Homo sapien
tccacgcagggatcctgagccaatg

SEQ ID NO: 206107 - DNA, 25 bp, Homo sapien
aagacgcctgtggtgtggaagaacc

SEQ ID NO: 206108 - DNA, 25 bp, Homo sapien
tctcctgggtggcaagaagacgcct

SEQ ID NO: 206109 - DNA, 25 bp, Homo sapien
gtcgcagttgcgtttctcgcactcc

SEQ ID NO: 206110 - DNA, 25 bp, Homo sapien
cgaggtcgcagttgcgtttctcgca

SEQ ID NO: 206111 - DNA, 25 bp, Homo sapien
cagggatcctgagccaatggcggaa

SEQ ID NO: 206112 - DNA, 25 bp, Homo sapien
gggacgtgccgtccctgctgcagtc

SEQ ID NO: 206113 - DNA, 25 bp, Homo sapien
atcctgagccaatggcggaagcgga

SEQ ID NO: 206114 - DNA, 25 bp, Homo sapien
tcgtgcctcacagatggcctcatgc

SEQ ID NO: 206115 - DNA, 25 bp, Homo sapien
ctccttcactctcctgcactcgtgc

SEQ ID NO: 206116 - DNA, 25 bp, Homo sapien
tcctgcactcgtgcctcacagatgg

SEQ ID NO: 206117 - DNA, 25 bp, Homo sapien
ctcgtgcctcacagatggcctcatg

SEQ ID NO: 206118 - DNA, 25 bp, Homo sapien
gtgcctcacagatggcctcatgcgc

SEQ ID NO: 206119 - DNA, 25 bp, Homo sapien
tgcctcacagatggcctcatgcgcg

SEQ ID NO: 206120 - DNA, 25 bp, Homo sapien
cctcacagatggcctcatgcgcgga

SEQ ID NO: 206121 - DNA, 25 bp, Homo sapien
tgcactcgtgcctcacagatggcct

SEQ ID NO: 206122 - DNA, 25 bp, Homo sapien
agctccaaatgcgtggccgctgtgg

SEQ ID NO: 206123 - DNA, 25 bp, Homo sapien
tcattgagaggacttcccgcctgcg

SEQ ID NO: 206124 - DNA, 25 bp, Homo sapien
gcagcgctcgagacgctcattgaga

SEQ ID NO: 206125 - DNA, 25 bp, Homo sapien
ccgctgtgggagctcgtctccaggc

SEQ ID NO: 206126 - DNA, 25 bp, Homo sapien
ctcaaagctgtagggctggacggca

SEQ ID NO: 206127 - DNA, 25 bp, Homo sapien
ctttggccactgaggcggtcctcga

SEQ ID NO: 206128 - DNA, 25 bp, Homo sapien
cgccgaaagggcctcaaagctgtag

SEQ ID NO: 206129 - DNA, 25 bp, Homo sapien
tccaactagcagtcaggaggggccg

SEQ ID NO: 206130 - DNA, 25 bp, Homo sapien
aaaggccagtgcctgtccgggaaga

SEQ ID NO: 206131 - DNA, 25 bp, Homo sapien
gcgggcgacaagttacagttgctgc

SEQ ID NO: 206132 - DNA, 25 bp, Homo sapien
ttaggcccgcaccatcgagtcgaac

SEQ ID NO: 206133 - DNA, 25 bp, Homo sapien
cgagtcgaaccgagtcctcatgttt

SEQ ID NO: 206134 - DNA, 25 bp, Homo sapien
tgttttcctagacaagccgctgggg

SEQ ID NO: 206135 - DNA, 25 bp, Homo sapien
acctggagtcactgagccgacgaaa

SEQ ID NO: 206136 - DNA, 25 bp, Homo sapien
cagttgctgccttacgatggccgtg

SEQ ID NO: 206137 - DNA, 25 bp, Homo sapien
ggggaaacacttctggcccatgtga

SEQ ID NO: 206138 - DNA, 25 bp, Homo sapien
atgggccccatccttgtcgtcgtcg

SEQ ID NO: 206139 - DNA, 25 bp, Homo sapien
tgcccgcgcctaagctcccacccgg

SEQ ID NO: 206140 - DNA, 25 bp, Homo sapien
ccacctctcaggtccggtagggcga

SEQ ID NO: 206141 - DNA, 25 bp, Homo sapien
gcgcggagagcgcactgagctctta

SEQ ID NO: 206142 - DNA, 25 bp, Homo sapien
cgcactgagctcttagaggtctgtg

SEQ ID NO: 206143 - DNA, 25 bp, Homo sapien
ccggctcgtcttctggcagcttggt

SEQ ID NO: 206144 - DNA, 25 bp, Homo sapien
tggacctgggctggatccttaggct

SEQ ID NO: 206145 - DNA, 25 bp, Homo sapien
tccttaggctccgaagagatgggcc

SEQ ID NO: 206146 - DNA, 25 bp, Homo sapien
gcgtcctcagctggtcctagacatg

SEQ ID NO: 206147 - DNA, 25 bp, Homo sapien
gccgagaccaagaagccgaccgaga

SEQ ID NO: 206148 - DNA, 25 bp, Homo sapien
ccgagagcaagaaggcccagtcatg

SEQ ID NO: 206149 - DNA, 25 bp, Homo sapien
cccataggcatatgagctctgctcc

SEQ ID NO: 206150 - DNA, 25 bp, Homo sapien
cgctatcactgggtcgcggctccta

SEQ ID NO: 206151 - DNA, 25 bp, Homo sapien
ggccgtctcccaccggatcaggtgt

SEQ ID NO: 206152 - DNA, 25 bp, Homo sapien
tcaggtgtctcctctgcgcagactc

SEQ ID NO: 206153 - DNA, 25 bp, Homo sapien
cgcgctggctggttaccaaggttac

SEQ ID NO: 206154 - DNA, 25 bp, Homo sapien
cttagcggtttctctctgggcggcg

SEQ ID NO: 206155 - DNA, 25 bp, Homo sapien
tgcgcactgcttatttcccgctgtc

SEQ ID NO: 206156 - DNA, 25 bp, Homo sapien
gcctcctccgccagctgagcccgcg

SEQ ID NO: 206157 - DNA, 25 bp, Homo sapien
cggcttcccagcctgacggtgaggc

SEQ ID NO: 206158 - DNA, 25 bp, Homo sapien
cactgcttatttcccgctgtcagga

SEQ ID NO: 206159 - DNA, 25 bp, Homo sapien
gcggatccagccttagcggtttctc

SEQ ID NO: 206160 - DNA, 25 bp, Homo sapien
ccctcgggccaacgtcacgtgccgc

SEQ ID NO: 206161 - DNA, 25 bp, Homo sapien
cagccttagcggtttctctctgggc

SEQ ID NO: 206162 - DNA, 25 bp, Homo sapien
gagctgtcttctccgtcccacagga

SEQ ID NO: 206163 - DNA, 25 bp, Homo sapien
atcggcctggcattacctggtactg

SEQ ID NO: 206164 - DNA, 25 bp, Homo sapien
taggaagccaggtctgccacagctc

SEQ ID NO: 206165 - DNA, 25 bp, Homo sapien
gctggcctcacgcatttcgcttgga

SEQ ID NO: 206166 - DNA, 25 bp, Homo sapien
tcgcttggatgcctaaatctgtctc

SEQ ID NO: 206167 - DNA, 25 bp, Homo sapien
gcgccgctccctgtacaaactggtg

SEQ ID NO: 206168 - DNA, 25 bp, Homo sapien
ctcgccgccttggaaagaggctttc

SEQ ID NO: 206169 - DNA, 25 bp, Homo sapien
cccggtgagggtcacttccaagatc

SEQ ID NO: 206170 - DNA, 25 bp, Homo sapien
gcggaaacgactgcgaacacgtgca

SEQ ID NO: 206171 - DNA, 25 bp, Homo sapien
gagctttcttgctgcgctgccgagt

SEQ ID NO: 206172 - DNA, 25 bp, Homo sapien
cgggaagcctcgaatccggattccg

SEQ ID NO: 206173 - DNA, 25 bp, Homo sapien
ggcgctctgacgacctaaggccagc

SEQ ID NO: 206174 - DNA, 25 bp, Homo sapien
cagaggcagcatcgcggaaacgact

SEQ ID NO: 206175 - DNA, 25 bp, Homo sapien
caccgtcggtgtgcagcgagccgca

SEQ ID NO: 206176 - DNA, 25 bp, Homo sapien
cgctaaacctcaccgtcggtgtgca

SEQ ID NO: 206177 - DNA, 25 bp, Homo sapien
tccggattccggagctttcttgctg

SEQ ID NO: 206178 - DNA, 25 bp, Homo sapien
aggactccagcgactgcgcacgacg

SEQ ID NO: 206179 - DNA, 25 bp, Homo sapien
agatggaggccatcggcagaaaccc

SEQ ID NO: 206180 - DNA, 25 bp, Homo sapien
acgacggcgattgtcgctgcacctg

SEQ ID NO: 206181 - DNA, 25 bp, Homo sapien
agaggacagcgtggctctccaggac

SEQ ID NO: 206182 - DNA, 25 bp, Homo sapien
gcggactgatgctgttgtctgcaga

SEQ ID NO: 206183 - DNA, 25 bp, Homo sapien
atgcattggggcacagcggactgat

SEQ ID NO: 206184 - DNA, 25 bp, Homo sapien
ggcaagctcagaccacgggtggact

SEQ ID NO: 206185 - DNA, 25 bp, Homo sapien
ctcagttcagctttcggcgcagatg

SEQ ID NO: 206186 - DNA, 25 bp, Homo sapien
gtgctcatgaagaggctgtgagcca

SEQ ID NO: 206187 - DNA, 25 bp, Homo sapien
cgggatgatgcgattggcattgaca

SEQ ID NO: 206188 - DNA, 25 bp, Homo sapien
tgaagctcggcggtgctcatgaaga

SEQ ID NO: 206189 - DNA, 25 bp, Homo sapien
cataggtgccatctggctgaagctc

SEQ ID NO: 206190 - DNA, 25 bp, Homo sapien
ggcattgacatctgtttcgggagaa

SEQ ID NO: 206191 - DNA, 25 bp, Homo sapien
agaaagcgaggaatggagccgaccc

SEQ ID NO: 206192 - DNA, 25 bp, Homo sapien
tccgtggtggcataggtgccatctg

SEQ ID NO: 206193 - DNA, 25 bp, Homo sapien
ctccacgtctcctcgggatgatgcg

SEQ ID NO: 206194 - DNA, 25 bp, Homo sapien
gacgaagtgcaaggaagagcccgcc

SEQ ID NO: 206195 - DNA, 25 bp, Homo sapien
actcaccgatgaggaccgcgttgtc

SEQ ID NO: 206196 - DNA, 25 bp, Homo sapien
accgcgttgtccaggtttcggagct

SEQ ID NO: 206197 - DNA, 25 bp, Homo sapien
cccgcgcttggaagatgggcagact

SEQ ID NO: 206198 - DNA, 25 bp, Homo sapien
ctccacagcttcagggtagggactg

SEQ ID NO: 206199 - DNA, 25 bp, Homo sapien
agagcctggccggaatctcttggcc

SEQ ID NO: 206200 - DNA, 25 bp, Homo sapien
ctcctccggcatgtcgggagggcac

SEQ ID NO: 206201 - DNA, 25 bp, Homo sapien
cctctcaggtgcagacaacaggagc

SEQ ID NO: 206202 - DNA, 25 bp, Homo sapien
aggacaccggcttgctcttcaggca

SEQ ID NO: 206203 - DNA, 25 bp, Homo sapien
acctagggcgagatgaaccgaggac

SEQ ID NO: 206204 - DNA, 25 bp, Homo sapien
ctggaagctccagatgggcgttgga

SEQ ID NO: 206205 - DNA, 25 bp, Homo sapien
gggatccgggcgcaccctggaagct

SEQ ID NO: 206206 - DNA, 25 bp, Homo sapien
gcttgctcttcaggcagctctggcc

SEQ ID NO: 206207 - DNA, 25 bp, Homo sapien
accggcttgctcttcaggcagctct

SEQ ID NO: 206208 - DNA, 25 bp, Homo sapien
gacaccggcttgctcttcaggcagc

SEQ ID NO: 206209 - DNA, 25 bp, Homo sapien
gcgagatgaaccgaggaccgtccat

SEQ ID NO: 206210 - DNA, 25 bp, Homo sapien
gtcaccctcatggtcgctccggtaa

SEQ ID NO: 206211 - DNA, 25 bp, Homo sapien
ttgaggtgtccacaaccagccaatc

SEQ ID NO: 206212 - DNA, 25 bp, Homo sapien
agccaatcaggaacgcgagagtatc

SEQ ID NO: 206213 - DNA, 25 bp, Homo sapien
agcctgtgtgtgcttcaaatcgtca

SEQ ID NO: 206214 - DNA, 25 bp, Homo sapien
gccgcaagctctggtacgccatctt

SEQ ID NO: 206215 - DNA, 25 bp, Homo sapien
tccgacctgaagatcccagcatgca

SEQ ID NO: 206216 - DNA, 25 bp, Homo sapien
cgcggggtcttagacagctcaactc

SEQ ID NO: 206217 - DNA, 25 bp, Homo sapien
cgaggcgcgtatcagtcggaatttt

SEQ ID NO: 206218 - DNA, 25 bp, Homo sapien
tacggctgtatttctagcgacccgg

SEQ ID NO: 206219 - DNA, 25 bp, Homo sapien
ggcttgtcaaacaggccttcggact

SEQ ID NO: 206220 - DNA, 25 bp, Homo sapien
gagatagcagccctcgtccagtgga

SEQ ID NO: 206221 - DNA, 25 bp, Homo sapien
tggccactcaggcaagctgtaaatg

SEQ ID NO: 206222 - DNA, 25 bp, Homo sapien
gggtgcagcgctgttctaaaacaca

SEQ ID NO: 206223 - DNA, 25 bp, Homo sapien
ttgccggcagctactttgtactttc

SEQ ID NO: 206224 - DNA, 25 bp, Homo sapien
ggggtccaggggcattctaattata

SEQ ID NO: 206225 - DNA, 25 bp, Homo sapien
ctgggtctggctcatcccttaaaga

SEQ ID NO: 206226 - DNA, 25 bp, Homo sapien
ccctccggagtcctgagagcccgtc

SEQ ID NO: 206227 - DNA, 25 bp, Homo sapien
gatcgcggggtgagtcctgtctctc

SEQ ID NO: 206228 - DNA, 25 bp, Homo sapien
tgtctctcggcgctccagccggacc

SEQ ID NO: 206229 - DNA, 25 bp, Homo sapien
aacaagtttgtgcagacgcggttgg

SEQ ID NO: 206230 - DNA, 25 bp, Homo sapien
tggggtgcgcacagcttccctccta

SEQ ID NO: 206231 - DNA, 25 bp, Homo sapien
agcttccctcctaggcggcgacgtt

SEQ ID NO: 206232 - DNA, 25 bp, Homo sapien
cgggcaaacaagtttgtgcagacgc

SEQ ID NO: 206233 - DNA, 25 bp, Homo sapien
cgtcatggtgcgtgtgttagagccc

SEQ ID NO: 206234 - DNA, 25 bp, Homo sapien
gacttgatcaatggctacatccgga

SEQ ID NO: 206235 - DNA, 25 bp, Homo sapien
caagccctgcgtgaccacaactgga

SEQ ID NO: 206236 - DNA, 25 bp, Homo sapien
tacatccggacggtggaccaagccc

SEQ ID NO: 206237 - DNA, 25 bp, Homo sapien
gcctggtgcccacgttacgggagat

SEQ ID NO: 206238 - DNA, 25 bp, Homo sapien
cgcacgtcctggactggctcaagta

SEQ ID NO: 206239 - DNA, 25 bp, Homo sapien
ggctgctctgcgtggagaacaacaa

SEQ ID NO: 206240 - DNA, 25 bp, Homo sapien
tatgtgcccagatgataggcctggc

SEQ ID NO: 206241 - DNA, 25 bp, Homo sapien
gtggccttcctcaacgtgtctgtga

SEQ ID NO: 206242 - DNA, 25 bp, Homo sapien
tctgggtaccacaagaagtcggatc

SEQ ID NO: 206243 - DNA, 25 bp, Homo sapien
acgcaggatacaaagcccggagcca

SEQ ID NO: 206244 - DNA, 25 bp, Homo sapien
cgggccaatccaagcgcagcatttg

SEQ ID NO: 206245 - DNA, 25 bp, Homo sapien
ggacggaaccaatcagctgtgagga

SEQ ID NO: 206246 - DNA, 25 bp, Homo sapien
ggagccgcgcagagtttcaaatcgg

SEQ ID NO: 206247 - DNA, 25 bp, Homo sapien
ggcgcgatctggactcaaaacaatt

SEQ ID NO: 206248 - DNA, 25 bp, Homo sapien
gttctgttcacaggggagggcatca

SEQ ID NO: 206249 - DNA, 25 bp, Homo sapien
catcaggttcggacacgcacggcct

SEQ ID NO: 206250 - DNA, 25 bp, Homo sapien
atcatgcgcgagttgttcttctttg

SEQ ID NO: 206251 - DNA, 25 bp, Homo sapien
tgcccttgcgcaggatcatgcgcga

SEQ ID NO: 206252 - DNA, 25 bp, Homo sapien
ttgcgcttccgcaggaactctggct

SEQ ID NO: 206253 - DNA, 25 bp, Homo sapien
ggctgctgcactgacatggttctgc

SEQ ID NO: 206254 - DNA, 25 bp, Homo sapien
tctttgtccgactcgggctggctct

SEQ ID NO: 206255 - DNA, 25 bp, Homo sapien
ctggtcggacactgctggacagaca

SEQ ID NO: 206256 - DNA, 25 bp, Homo sapien
agttgttcttctttgggcgtgagcg

SEQ ID NO: 206257 - DNA, 25 bp, Homo sapien
cctcagggcaccgactcgaacttgg

SEQ ID NO: 206258 - DNA, 25 bp, Homo sapien
tgaggctttgcgtcccagggtcgat

SEQ ID NO: 206259 - DNA, 25 bp, Homo sapien
cgccgcagacctggccctttccggc

SEQ ID NO: 206260 - DNA, 25 bp, Homo sapien
ccttcggtggcgaagcccgggtctg

SEQ ID NO: 206261 - DNA, 25 bp, Homo sapien
gaaggaatctgggtctctggactga

SEQ ID NO: 206262 - DNA, 25 bp, Homo sapien
ccgagaaggaatctgggtctctgga

SEQ ID NO: 206263 - DNA, 25 bp, Homo sapien
cttcccgagaaggaatctgggtctc

SEQ ID NO: 206264 - DNA, 25 bp, Homo sapien
cagctgaggctttgcgtcccagggt

SEQ ID NO: 206265 - DNA, 25 bp, Homo sapien
tcccgagaaggaatctgggtctctg

SEQ ID NO: 206266 - DNA, 25 bp, Homo sapien
gcccgagacactgcgggccagagac

SEQ ID NO: 206267 - DNA, 25 bp, Homo sapien
gacgcggagacagcccgagacactg

SEQ ID NO: 206268 - DNA, 25 bp, Homo sapien
agaggggcgcacagactattagaca

SEQ ID NO: 206269 - DNA, 25 bp, Homo sapien
gcacagactattagacagcgctgga

SEQ ID NO: 206270 - DNA, 25 bp, Homo sapien
agactattagacagcgctggagaga

SEQ ID NO: 206271 - DNA, 25 bp, Homo sapien
agagacgctcctagggccagaacgc

SEQ ID NO: 206272 - DNA, 25 bp, Homo sapien
ctcctagggccagaacgccgaggtg

SEQ ID NO: 206273 - DNA, 25 bp, Homo sapien
ctcagagacgcggagacagcccgag

SEQ ID NO: 206274 - DNA, 25 bp, Homo sapien
cacgtcgtcgatgaagtgcctctcg

SEQ ID NO: 206275 - DNA, 25 bp, Homo sapien
cgcgcttggaggtatctctaggtta

SEQ ID NO: 206276 - DNA, 25 bp, Homo sapien
tctaggttagactcctctggggctg

SEQ ID NO: 206277 - DNA, 25 bp, Homo sapien
tgggtcagcattcatcagagaggtc

SEQ ID NO: 206278 - DNA, 25 bp, Homo sapien
agcgtcttgcggcagttgtaatcca

SEQ ID NO: 206279 - DNA, 25 bp, Homo sapien
acctcggccttgtagttgcgccacg

SEQ ID NO: 206280 - DNA, 25 bp, Homo sapien
ccattggggacacaggtgaccgtct

SEQ ID NO: 206281 - DNA, 25 bp, Homo sapien
gcctctcggagtcgtacttgaccaa

SEQ ID NO: 206282 - DNA, 25 bp, Homo sapien
acgtcgtgccaatggcccgctatga

SEQ ID NO: 206283 - DNA, 25 bp, Homo sapien
ggatgtcttagcacctcgctcccta

SEQ ID NO: 206284 - DNA, 25 bp, Homo sapien
caacaaaggctttccgagtcagatc

SEQ ID NO: 206285 - DNA, 25 bp, Homo sapien
gtccatgactctatgcggcttccca

SEQ ID NO: 206286 - DNA, 25 bp, Homo sapien
cggtaagttttgcagccagtgtcca

SEQ ID NO: 206287 - DNA, 25 bp, Homo sapien
tcgtcagaggctcccgtagtcttta

SEQ ID NO: 206288 - DNA, 25 bp, Homo sapien
gacgtgcactcctccagtagcggct

SEQ ID NO: 206289 - DNA, 25 bp, Homo sapien
gagtctcccggctcatagctccagg

SEQ ID NO: 206290 - DNA, 25 bp, Homo sapien
tctctggagtccttctgcctctgtc

SEQ ID NO: 206291 - DNA, 25 bp, Homo sapien
tagttgtaaagtcacgctccggcgc

SEQ ID NO: 206292 - DNA, 25 bp, Homo sapien
gcgcggcaccagcagtctatgacaa

SEQ ID NO: 206293 - DNA, 25 bp, Homo sapien
gttaacctcttgtctcttcggctga

SEQ ID NO: 206294 - DNA, 25 bp, Homo sapien
tctattagtaatggagacctcgccg

SEQ ID NO: 206295 - DNA, 25 bp, Homo sapien
gctgccttcccaattcccagtggaa

SEQ ID NO: 206296 - DNA, 25 bp, Homo sapien
ctccacagggagaaagttaacctct

SEQ ID NO: 206297 - DNA, 25 bp, Homo sapien
gtcatcaggaccagaggcagtcata

SEQ ID NO: 206298 - DNA, 25 bp, Homo sapien
gggaccacccgctacacagagacgt

SEQ ID NO: 206299 - DNA, 25 bp, Homo sapien
ctctcttctgcctgcggtgaccatt

SEQ ID NO: 206300 - DNA, 25 bp, Homo sapien
cggctatggcagtaccgtagttttc

SEQ ID NO: 206301 - DNA, 25 bp, Homo sapien
ccacgtcatcgtgttgtggcgctcc

SEQ ID NO: 206302 - DNA, 25 bp, Homo sapien
aggaccatggtgcttccacgtcatc

SEQ ID NO: 206303 - DNA, 25 bp, Homo sapien
ggagtccagtgttttagccttcgaa

SEQ ID NO: 206304 - DNA, 25 bp, Homo sapien
ccgcgctggctccaaaatagcgagg

SEQ ID NO: 206305 - DNA, 25 bp, Homo sapien
cagcagcggccataacaaacgaaga

SEQ ID NO: 206306 - DNA, 25 bp, Homo sapien
caggcaaagacagcgaatcgccacc

SEQ ID NO: 206307 - DNA, 25 bp, Homo sapien
cggtcccggggcaccgaggaatatg

SEQ ID NO: 206308 - DNA, 25 bp, Homo sapien
ctgcctaacagaggaaaagcccgga

SEQ ID NO: 206309 - DNA, 25 bp, Homo sapien
tcgccacctgcctaacagaggaaaa

SEQ ID NO: 206310 - DNA, 25 bp, Homo sapien
gaatcgccacctgcctaacagagga

SEQ ID NO: 206311 - DNA, 25 bp, Homo sapien
ggcagcggccataacaggcaaagac

SEQ ID NO: 206312 - DNA, 25 bp, Homo sapien
agcgaatcgccacctgcctaacaga

SEQ ID NO: 206313 - DNA, 25 bp, Homo sapien
caggcccgcttagcccgcgctggct

SEQ ID NO: 206314 - DNA, 25 bp, Homo sapien
tccaagcccttctgaagccggaatg

SEQ ID NO: 206315 - DNA, 25 bp, Homo sapien
tcgcacagcgggaattgccaccagc

SEQ ID NO: 206316 - DNA, 25 bp, Homo sapien
cctccctatggtgggcagttggtga

SEQ ID NO: 206317 - DNA, 25 bp, Homo sapien
ccgctactcgatctccttggaatta

SEQ ID NO: 206318 - DNA, 25 bp, Homo sapien
tgttctcgggaccaaatccaaagcc

SEQ ID NO: 206319 - DNA, 25 bp, Homo sapien
gcgcttggcacagtcagtgaccaca

SEQ ID NO: 206320 - DNA, 25 bp, Homo sapien
ctgcttaacacattcgaacggctcc

SEQ ID NO: 206321 - DNA, 25 bp, Homo sapien
gccggaatgatttctccctaattca

SEQ ID NO: 206322 - DNA, 25 bp, Homo sapien
ctccggtgtctctccgagaggtgtc

SEQ ID NO: 206323 - DNA, 25 bp, Homo sapien
ctgcctggagatgcaactgaccttg

SEQ ID NO: 206324 - DNA, 25 bp, Homo sapien
catcagaatgacgagtggcagcagc

SEQ ID NO: 206325 - DNA, 25 bp, Homo sapien
tgacgaacaagatcacgaaggactt

SEQ ID NO: 206326 - DNA, 25 bp, Homo sapien
cgaaggacttgaacttggagacata

SEQ ID NO: 206327 - DNA, 25 bp, Homo sapien
ctttggactccaacgcttcgggcca

SEQ ID NO: 206328 - DNA, 25 bp, Homo sapien
agggtcccggatgaaactctctgca

SEQ ID NO: 206329 - DNA, 25 bp, Homo sapien
cctctgggtctctcaggtctatctc

SEQ ID NO: 206330 - DNA, 25 bp, Homo sapien
tttagcttgggccagagcaaggcgc

SEQ ID NO: 206331 - DNA, 25 bp, Homo sapien
tccctgcagcccgagcggggttcag

SEQ ID NO: 206332 - DNA, 25 bp, Homo sapien
cggccggagcttggcatttagcttg

SEQ ID NO: 206333 - DNA, 25 bp, Homo sapien
caggcaactgcaggtttggggctct

SEQ ID NO: 206334 - DNA, 25 bp, Homo sapien
tgggatccactgaccaggcaactgc

SEQ ID NO: 206335 - DNA, 25 bp, Homo sapien
gccctctgcacatgggatccactga

SEQ ID NO: 206336 - DNA, 25 bp, Homo sapien
gccgaatgtcttccctgtgcgcaga

SEQ ID NO: 206337 - DNA, 25 bp, Homo sapien
gcagcgaactgaaccgttttgagcc

SEQ ID NO: 206338 - DNA, 25 bp, Homo sapien
agccaggattctctgaaggttcacc

SEQ ID NO: 206339 - DNA, 25 bp, Homo sapien
ggattctctgaaggttcaccgaccc

SEQ ID NO: 206340 - DNA, 25 bp, Homo sapien
cccaaaacctgagctgtgtactgtc

SEQ ID NO: 206341 - DNA, 25 bp, Homo sapien
aacctgagctgtgtactgtcgcgca

SEQ ID NO: 206342 - DNA, 25 bp, Homo sapien
aggcagagtttgagatcgacgtccc

SEQ ID NO: 206343 - DNA, 25 bp, Homo sapien
ctcctgatggtgaagctgcgcaaac

SEQ ID NO: 206344 - DNA, 25 bp, Homo sapien
aaacacaacgtgctgttgagtctcg

SEQ ID NO: 206345 - DNA, 25 bp, Homo sapien
gctgcgcaaacacaacgtgctgttg

SEQ ID NO: 206346 - DNA, 25 bp, Homo sapien
ggtcagacgtgaagctcctccaaga

SEQ ID NO: 206347 - DNA, 25 bp, Homo sapien
agtcgggtccctcctactaagtctg

SEQ ID NO: 206348 - DNA, 25 bp, Homo sapien
gctctgtcctcgaaacggcctcagt

SEQ ID NO: 206349 - DNA, 25 bp, Homo sapien
gagctcagttaatgggacccacgtg

SEQ ID NO: 206350 - DNA, 25 bp, Homo sapien
cagtgacccagagccaatgtaagta

SEQ ID NO: 206351 - DNA, 25 bp, Homo sapien
tcgtacaaccgcgtgcagctttggc

SEQ ID NO: 206352 - DNA, 25 bp, Homo sapien
acttgggagcgcctaaaacttgcga

SEQ ID NO: 206353 - DNA, 25 bp, Homo sapien
tctgagacccaaagagcaggttgtg

SEQ ID NO: 206354 - DNA, 25 bp, Homo sapien
gactcccttctttatggcgtcgctc

SEQ ID NO: 206355 - DNA, 25 bp, Homo sapien
gccgtctcccgcgaaagtcctgaga

SEQ ID NO: 206356 - DNA, 25 bp, Homo sapien
ccctgcgagggcatcctgggctttc

SEQ ID NO: 206357 - DNA, 25 bp, Homo sapien
cgtcgctcctgtgctgtgggccgaa

SEQ ID NO: 206358 - DNA, 25 bp, Homo sapien
tgcggcatcgtcctcagcgcctggg

SEQ ID NO: 206359 - DNA, 25 bp, Homo sapien
tcagcgcctggggagtgatcatgtt

SEQ ID NO: 206360 - DNA, 25 bp, Homo sapien
tgatcatgttggtgaggggactccc

SEQ ID NO: 206361 - DNA, 25 bp, Homo sapien
tcccgcgaaagtcctgagaggagcc

SEQ ID NO: 206362 - DNA, 25 bp, Homo sapien
ctgcctggaaagtcccgatgtctga

SEQ ID NO: 206363 - DNA, 25 bp, Homo sapien
aggaatacatggtgcgctagggccc

SEQ ID NO: 206364 - DNA, 25 bp, Homo sapien
gacgtcagcgtccacaaaggttcga

SEQ ID NO: 206365 - DNA, 25 bp, Homo sapien
aatctgctctcttcagccctgtgtc

SEQ ID NO: 206366 - DNA, 25 bp, Homo sapien
ccttcgctgtgtcccgtatctcaat

SEQ ID NO: 206367 - DNA, 25 bp, Homo sapien
tcccgggcgagagactgaatccctt

SEQ ID NO: 206368 - DNA, 25 bp, Homo sapien
ctatttaaagactccctgcaccgtg

SEQ ID NO: 206369 - DNA, 25 bp, Homo sapien
ggcgcttggactcggtcacagacac

SEQ ID NO: 206370 - DNA, 25 bp, Homo sapien
gcagagaatggcttccggcttccgc

SEQ ID NO: 206371 - DNA, 25 bp, Homo sapien
ccgcacaccgagacccgcctgagca

SEQ ID NO: 206372 - DNA, 25 bp, Homo sapien
agcagagaatggcttccggcttccg

SEQ ID NO: 206373 - DNA, 25 bp, Homo sapien
caggggtgaatggcttccggcttcc

SEQ ID NO: 206374 - DNA, 25 bp, Homo sapien
cggcttccgcacaccgagacccgcc

SEQ ID NO: 206375 - DNA, 25 bp, Homo sapien
cgcacaccgagacccgcctgagcag

SEQ ID NO: 206376 - DNA, 25 bp, Homo sapien
ggcttccgcacaccgagacccgccg

SEQ ID NO: 206377 - DNA, 25 bp, Homo sapien
ttccggcttccgcacaccgagaccc

SEQ ID NO: 206378 - DNA, 25 bp, Homo sapien
caccggccttctggcctggcgagaa

SEQ ID NO: 206379 - DNA, 25 bp, Homo sapien
atcctcgagctggacgcgaacccta

SEQ ID NO: 206380 - DNA, 25 bp, Homo sapien
acagggcggtcaaggaatcctcgag

SEQ ID NO: 206381 - DNA, 25 bp, Homo sapien
cgaaactgctgcacagggcggtcaa

SEQ ID NO: 206382 - DNA, 25 bp, Homo sapien
ggtggccttgcgaaactgctgcaca

SEQ ID NO: 206383 - DNA, 25 bp, Homo sapien
aagggctgttctgccctgcgggcac

SEQ ID NO: 206384 - DNA, 25 bp, Homo sapien
ttccctacctaagaggtgctgcgga

SEQ ID NO: 206385 - DNA, 25 bp, Homo sapien
ttctggcctggcgagaaactgcagg

SEQ ID NO: 206386 - DNA, 25 bp, Homo sapien
ggttgccgtatgcactttgtcctgc

SEQ ID NO: 206387 - DNA, 25 bp, Homo sapien
tccgacgactcagactcccgtattg

SEQ ID NO: 206388 - DNA, 25 bp, Homo sapien
ccgtcctcgtgtccacttgcagtga

SEQ ID NO: 206389 - DNA, 25 bp, Homo sapien
cagcgagcctgagtcccagaaattg

SEQ ID NO: 206390 - DNA, 25 bp, Homo sapien
taggagtcgcagaattccgtagttc

SEQ ID NO: 206391 - DNA, 25 bp, Homo sapien
cggtgtggaaccttcaactggctcc

SEQ ID NO: 206392 - DNA, 25 bp, Homo sapien
ggctctagttgcacctcggaaggaa

SEQ ID NO: 206393 - DNA, 25 bp, Homo sapien
tttgtcctgcagcaaaggttggctc

SEQ ID NO: 206394 - DNA, 25 bp, Homo sapien
catctacacggaaactggcgcgctc

SEQ ID NO: 206395 - DNA, 25 bp, Homo sapien
tacgcatgcgcccattcactgctgg

SEQ ID NO: 206396 - DNA, 25 bp, Homo sapien
ggtgctctcagcgttcttccagtcg

SEQ ID NO: 206397 - DNA, 25 bp, Homo sapien
taccgcttagatggcgcgcaggaca

SEQ ID NO: 206398 - DNA, 25 bp, Homo sapien
ggcagcagccctgttaccgcttaga

SEQ ID NO: 206399 - DNA, 25 bp, Homo sapien
ccggcttgaactagctcagctccga

SEQ ID NO: 206400 - DNA, 25 bp, Homo sapien
gcctccataggaatcgcggtgcagc

SEQ ID NO: 206401 - DNA, 25 bp, Homo sapien
ggccaggtcttcagtcctatatcgc

SEQ ID NO: 206402 - DNA, 25 bp, Homo sapien
agcccgtaggacagcccgtttatcg

SEQ ID NO: 206403 - DNA, 25 bp, Homo sapien
tcggtcaaagtgctcggcaaggtca

SEQ ID NO: 206404 - DNA, 25 bp, Homo sapien
tttctcaggttgtcgggtaatcagg

SEQ ID NO: 206405 - DNA, 25 bp, Homo sapien
ttctagagccggttgccctttctca

SEQ ID NO: 206406 - DNA, 25 bp, Homo sapien
tgtttgcctccctcgaactaatggt

SEQ ID NO: 206407 - DNA, 25 bp, Homo sapien
agggcccaaccaaagcctgcgaatg

SEQ ID NO: 206408 - DNA, 25 bp, Homo sapien
tctgtgagagaagcctccacgcctg

SEQ ID NO: 206409 - DNA, 25 bp, Homo sapien
ctggcgaaagccgagaagacgaagc

SEQ ID NO: 206410 - DNA, 25 bp, Homo sapien
ccggcctccagttcctggggacaga

SEQ ID NO: 206411 - DNA, 25 bp, Homo sapien
tggagcgccgccatctgacagctca

SEQ ID NO: 206412 - DNA, 25 bp, Homo sapien
cttcccggagcgagagaaccagtag

SEQ ID NO: 206413 - DNA, 25 bp, Homo sapien
tcctccagccggcagtagttgtcgg

SEQ ID NO: 206414 - DNA, 25 bp, Homo sapien
gcctatgtggtgctggacaaatttc

SEQ ID NO: 206415 - DNA, 25 bp, Homo sapien
cccatccaggtgttcacagggccta

SEQ ID NO: 206416 - DNA, 25 bp, Homo sapien
gcactcacttgaagcccgtctcgta

SEQ ID NO: 206417 - DNA, 25 bp, Homo sapien
ggctccgcaggtcagacacgaactg

SEQ ID NO: 206418 - DNA, 25 bp, Homo sapien
ctggggccgaccaaactcctgagcg

SEQ ID NO: 206419 - DNA, 25 bp, Homo sapien
atcgcctggtctctagactcccagg

SEQ ID NO: 206420 - DNA, 25 bp, Homo sapien
tcctgagcgcagaagggatccgcta

SEQ ID NO: 206421 - DNA, 25 bp, Homo sapien
ctcaccctacgcagtgcaaaggacg

SEQ ID NO: 206422 - DNA, 25 bp, Homo sapien
cgcagtgcaaaggacgtcaggaact

SEQ ID NO: 206423 - DNA, 25 bp, Homo sapien
tggtgaaagacatccgggtcctatc

SEQ ID NO: 206424 - DNA, 25 bp, Homo sapien
tgggcgcagcgcatcctgaataacc

SEQ ID NO: 206425 - DNA, 25 bp, Homo sapien
ggtccctgacgtcaatcgcctggtc

SEQ ID NO: 206426 - DNA, 25 bp, Homo sapien
gaaggttgctgcctccctcgataga

SEQ ID NO: 206427 - DNA, 25 bp, Homo sapien
gctcctggggctctggcaaatagcc

SEQ ID NO: 206428 - DNA, 25 bp, Homo sapien
agcttcagtcgtcgccggttaccat

SEQ ID NO: 206429 - DNA, 25 bp, Homo sapien
ttaaccgcttcgctcctggggctct

SEQ ID NO: 206430 - DNA, 25 bp, Homo sapien
tccctcgatagagtaagccagaccc

SEQ ID NO: 206431 - DNA, 25 bp, Homo sapien
gcatctcggctttgcccaataagga

SEQ ID NO: 206432 - DNA, 25 bp, Homo sapien
gccctcatttcggtcaggtaaccca

SEQ ID NO: 206433 - DNA, 25 bp, Homo sapien
gccaatgaatgaggccgtcggccac

SEQ ID NO: 206434 - DNA, 25 bp, Homo sapien
gcttggagatccctctaagtcagcg

SEQ ID NO: 206435 - DNA, 25 bp, Homo sapien
cgtcggaggactagactctaggtcg

SEQ ID NO: 206436 - DNA, 25 bp, Homo sapien
gctcaggtaagtcaccgcagccttg

SEQ ID NO: 206437 - DNA, 25 bp, Homo sapien
tcggcagggatctccctcttggtgc

SEQ ID NO: 206438 - DNA, 25 bp, Homo sapien
ttggtgccaggtacctgcctactgc

SEQ ID NO: 206439 - DNA, 25 bp, Homo sapien
gcctactgctcagtcgccgaaagta

SEQ ID NO: 206440 - DNA, 25 bp, Homo sapien
tctaagtcagcggaacgcagggccg

SEQ ID NO: 206441 - DNA, 25 bp, Homo sapien
gccagggtgccctagggcgaaacta

SEQ ID NO: 206442 - DNA, 25 bp, Homo sapien
gtctcttcctcatccaggtggtaaa

SEQ ID NO: 206443 - DNA, 25 bp, Homo sapien
ttcaggaaacggaccatcggctccc

SEQ ID NO: 206444 - DNA, 25 bp, Homo sapien
cggtcctatctaggccttgcgctca

SEQ ID NO: 206445 - DNA, 25 bp, Homo sapien
cttgaaaaagtacttggcgcccgcg

SEQ ID NO: 206446 - DNA, 25 bp, Homo sapien
tcttcaccaggtagggagtctcttc

SEQ ID NO: 206447 - DNA, 25 bp, Homo sapien
catgtcacgtgacttaaaggcagcc

SEQ ID NO: 206448 - DNA, 25 bp, Homo sapien
taagctggcctgtgccttcaggaaa

SEQ ID NO: 206449 - DNA, 25 bp, Homo sapien
tgcaggacgctcttgaaatcgccga

SEQ ID NO: 206450 - DNA, 25 bp, Homo sapien
tcagcgctctgcaccggtcgagagc

SEQ ID NO: 206451 - DNA, 25 bp, Homo sapien
agtttgccaattgattcctcgcccg

SEQ ID NO: 206452 - DNA, 25 bp, Homo sapien
ggggctcgacctccaagtttgccaa

SEQ ID NO: 206453 - DNA, 25 bp, Homo sapien
gcggcaactactcggagctccggta

SEQ ID NO: 206454 - DNA, 25 bp, Homo sapien
accgggcattctccggcggcaacta

SEQ ID NO: 206455 - DNA, 25 bp, Homo sapien
acaggtccgtctgccgtagacaata

SEQ ID NO: 206456 - DNA, 25 bp, Homo sapien
cacccagttactaggctatggaccc

SEQ ID NO: 206457 - DNA, 25 bp, Homo sapien
agagctcaccttcgggactgggctc

SEQ ID NO: 206458 - DNA, 25 bp, Homo sapien
ggcgcttctcgaacggatgctcttc

SEQ ID NO: 206459 - DNA, 25 bp, Homo sapien
tcagcggagcgatccacgaatttgc

SEQ ID NO: 206460 - DNA, 25 bp, Homo sapien
tcaatttgtgggctacgcaggcgac

SEQ ID NO: 206461 - DNA, 25 bp, Homo sapien
gacggttggcttttgctcatcgaaa

SEQ ID NO: 206462 - DNA, 25 bp, Homo sapien
acgaaccgtgttgctacgctgaagg

SEQ ID NO: 206463 - DNA, 25 bp, Homo sapien
ggtttctccagctctacgccctttg

SEQ ID NO: 206464 - DNA, 25 bp, Homo sapien
acactgcgggacttgagttaaatca

SEQ ID NO: 206465 - DNA, 25 bp, Homo sapien
gaaggcggccgttgacaccaaaaca

SEQ ID NO: 206466 - DNA, 25 bp, Homo sapien
cggggctgcactgaacgcaaggctg

SEQ ID NO: 206467 - DNA, 25 bp, Homo sapien
aacgcaaggctgtgttgaacgcatc

SEQ ID NO: 206468 - DNA, 25 bp, Homo sapien
ttgaacgcatcggacctgacaccct

SEQ ID NO: 206469 - DNA, 25 bp, Homo sapien
acaccctcagacacccgggacaata

SEQ ID NO: 206470 - DNA, 25 bp, Homo sapien
tgaacgcatcggacctgacaccctc

SEQ ID NO: 206471 - DNA, 25 bp, Homo sapien
gacaccctcagacacccgggacaat

SEQ ID NO: 206472 - DNA, 25 bp, Homo sapien
cgcaaggctgtgttgaacgcatcgg

SEQ ID NO: 206473 - DNA, 25 bp, Homo sapien
ggggctgcactgaacgcaaggctgt

SEQ ID NO: 206474 - DNA, 25 bp, Homo sapien
ggccgaggctctgcactaacaagac

SEQ ID NO: 206475 - DNA, 25 bp, Homo sapien
cggcggaggctccacactaacaaga

SEQ ID NO: 206476 - DNA, 25 bp, Homo sapien
ggtcggccgaggctctacactaaca

SEQ ID NO: 206477 - DNA, 25 bp, Homo sapien
gccgaggctctgcactaacaagacg

SEQ ID NO: 206478 - DNA, 25 bp, Homo sapien
acaagacggatccagggttcaaagc

SEQ ID NO: 206479 - DNA, 25 bp, Homo sapien
caagacggatccagggttcaaagct

SEQ ID NO: 206480 - DNA, 25 bp, Homo sapien
gccgaggctctgcagtaacaagagg

SEQ ID NO: 206481 - DNA, 25 bp, Homo sapien
cggccgaggctctacactaacaaga

SEQ ID NO: 206482 - DNA, 25 bp, Homo sapien
cagtgcccactcgatagaaattccc

SEQ ID NO: 206483 - DNA, 25 bp, Homo sapien
cggcgttcctgtcacgtcaggtgtc

SEQ ID NO: 206484 - DNA, 25 bp, Homo sapien
ccgggctctgcgcagaagcttttcg

SEQ ID NO: 206485 - DNA, 25 bp, Homo sapien
acattcgtaggacgggacagtgccc

SEQ ID NO: 206486 - DNA, 25 bp, Homo sapien
ggcgatgtcgccaaggacattcgta

SEQ ID NO: 206487 - DNA, 25 bp, Homo sapien
gcctcagcgcgtccttaggatgggc

SEQ ID NO: 206488 - DNA, 25 bp, Homo sapien
ggaacgcttacctgctcgatggcca

SEQ ID NO: 206489 - DNA, 25 bp, Homo sapien
gacgcccggatgaaagtcagccctg

SEQ ID NO: 206490 - DNA, 25 bp, Homo sapien
tcgttgtccgtacgactgtgcgcca

SEQ ID NO: 206491 - DNA, 25 bp, Homo sapien
caggcgccattttaccgtccaaagg

SEQ ID NO: 206492 - DNA, 25 bp, Homo sapien
ctacttccggtggtgacgtgtattc

SEQ ID NO: 206493 - DNA, 25 bp, Homo sapien
acgtgtattcgcttcaccgggacta

SEQ ID NO: 206494 - DNA, 25 bp, Homo sapien
accgggactaagttcctcctgcgcg

SEQ ID NO: 206495 - DNA, 25 bp, Homo sapien
gcactccaagcgaggctgcagtatt

SEQ ID NO: 206496 - DNA, 25 bp, Homo sapien
agagtgacgtcacttggcccgcgct

SEQ ID NO: 206497 - DNA, 25 bp, Homo sapien
ctgggtttcccactctgacaggcgc

SEQ ID NO: 206498 - DNA, 25 bp, Homo sapien
gggccaggtgaatgcaaatcttgtc

SEQ ID NO: 206499 - DNA, 25 bp, Homo sapien
atttccgccctcagaaaacactggg

SEQ ID NO: 206500 - DNA, 25 bp, Homo sapien
gagcgccggcaagtcccaaagtatc

SEQ ID NO: 206501 - DNA, 25 bp, Homo sapien
cgagtcgtacattttgcagctcatc

SEQ ID NO: 206502 - DNA, 25 bp, Homo sapien
ccaaagtatcctgggctgtaggtcc

SEQ ID NO: 206503 - DNA, 25 bp, Homo sapien
cctgggccgtgatgatgttgtcacc

SEQ ID NO: 206504 - DNA, 25 bp, Homo sapien
gttgtcacccgcataggagctcatc

SEQ ID NO: 206505 - DNA, 25 bp, Homo sapien
actgcaggcccgaattggccatttc

SEQ ID NO: 206506 - DNA, 25 bp, Homo sapien
cgcggactctttaaggcgtcatctc

SEQ ID NO: 206507 - DNA, 25 bp, Homo sapien
cccgggacctgacatttggaggctc

SEQ ID NO: 206508 - DNA, 25 bp, Homo sapien
tcccaacgtgggagctaaaaatagc

SEQ ID NO: 206509 - DNA, 25 bp, Homo sapien
ctcaaaacttcccagtcggaggctg

SEQ ID NO: 206510 - DNA, 25 bp, Homo sapien
agactccaggatcggttctttcatc

SEQ ID NO: 206511 - DNA, 25 bp, Homo sapien
cgtcgggcttccaacagataggctc

SEQ ID NO: 206512 - DNA, 25 bp, Homo sapien
ggctccgaagtaggattcatcatga

SEQ ID NO: 206513 - DNA, 25 bp, Homo sapien
gtccagacccgcagagtttaagatg

SEQ ID NO: 206514 - DNA, 25 bp, Homo sapien
ccactcctctcctgaacttggggaa

SEQ ID NO: 206515 - DNA, 25 bp, Homo sapien
taagggaatagtgagaacctgctcc

SEQ ID NO: 206516 - DNA, 25 bp, Homo sapien
agaacctgctccaacagccaatgtg

SEQ ID NO: 206517 - DNA, 25 bp, Homo sapien
cagccaatgtgcatttcccaacttg

SEQ ID NO: 206518 - DNA, 25 bp, Homo sapien
ggggccgttgcccagagtcttcagc

SEQ ID NO: 206519 - DNA, 25 bp, Homo sapien
ttggggaactggctcccatattcca

SEQ ID NO: 206520 - DNA, 25 bp, Homo sapien
ggggacccatggtctctatcctaac

SEQ ID NO: 206521 - DNA, 25 bp, Homo sapien
atgaatcggcgggacttacgtcggt

SEQ ID NO: 206522 - DNA, 25 bp, Homo sapien
gttttccggatcctgccgggctcca

SEQ ID NO: 206523 - DNA, 25 bp, Homo sapien
ggcagtgagtagcaccgctcgcctc

SEQ ID NO: 206524 - DNA, 25 bp, Homo sapien
cctcggttctggcagtgagtagcac

SEQ ID NO: 206525 - DNA, 25 bp, Homo sapien
ggaatctgcagcctcggttctggca

SEQ ID NO: 206526 - DNA, 25 bp, Homo sapien
cagccgcccagtaagtacacctggg

SEQ ID NO: 206527 - DNA, 25 bp, Homo sapien
cccgtatgctgccaggtgcagacgc

SEQ ID NO: 206528 - DNA, 25 bp, Homo sapien
gagccgaggccaatggcagcccgct

SEQ ID NO: 206529 - DNA, 25 bp, Homo sapien
tcgagaccgaccttgcccgtatgct

SEQ ID NO: 206530 - DNA, 25 bp, Homo sapien
ggtgcgcgttgtatttttagccagg

SEQ ID NO: 206531 - DNA, 25 bp, Homo sapien
tgcgcttcccaagggctggcgtcct

SEQ ID NO: 206532 - DNA, 25 bp, Homo sapien
agcagccgcagtcgcctctcccggt

SEQ ID NO: 206533 - DNA, 25 bp, Homo sapien
ggattccgcttcctcgctgaccctc

SEQ ID NO: 206534 - DNA, 25 bp, Homo sapien
tgaccctccacttgctatctatcgc

SEQ ID NO: 206535 - DNA, 25 bp, Homo sapien
tgaagattcggatttccggggcatc

SEQ ID NO: 206536 - DNA, 25 bp, Homo sapien
ttcagagttgaagattcggatttcc

SEQ ID NO: 206537 - DNA, 25 bp, Homo sapien
cttgctatctatcgcccgccgcacc

SEQ ID NO: 206538 - DNA, 25 bp, Homo sapien
agatagcacgcttgcgcggctgtca

SEQ ID NO: 206539 - DNA, 25 bp, Homo sapien
gcctgcgtactaagacccgtgtgca

SEQ ID NO: 206540 - DNA, 25 bp, Homo sapien
tgcgttctagacgagacaagtgatc

SEQ ID NO: 206541 - DNA, 25 bp, Homo sapien
cgtggtcttttcaacgcctggcgta

SEQ ID NO: 206542 - DNA, 25 bp, Homo sapien
ttaggattccgaacacgcatgcgtt

SEQ ID NO: 206543 - DNA, 25 bp, Homo sapien
atgcgttctgagacccaggcgtttc

SEQ ID NO: 206544 - DNA, 25 bp, Homo sapien
agggctccttattgcgcaggcgcaa

SEQ ID NO: 206545 - DNA, 25 bp, Homo sapien
cgcctgcgcgttgcagattagttga

SEQ ID NO: 206546 - DNA, 25 bp, Homo sapien
ccatcataatgtgccggtgcagcgc

SEQ ID NO: 206547 - DNA, 25 bp, Homo sapien
agctctctttaatttcgcgggccca

SEQ ID NO: 206548 - DNA, 25 bp, Homo sapien
ggctgtctctgactgccagacctca

SEQ ID NO: 206549 - DNA, 25 bp, Homo sapien
ggcggccgacctcacaggtgaaaga

SEQ ID NO: 206550 - DNA, 25 bp, Homo sapien
tgcgctcccgctccatcataatgtg

SEQ ID NO: 206551 - DNA, 25 bp, Homo sapien
ggccttggcatcctcagctctcttt

SEQ ID NO: 206552 - DNA, 25 bp, Homo sapien
cagccttgaggtacaggagccattc

SEQ ID NO: 206553 - DNA, 25 bp, Homo sapien
agcgccctggccatggcgttggaaa

SEQ ID NO: 206554 - DNA, 25 bp, Homo sapien
aaaagggtaggcctccactgctctg

SEQ ID NO: 206555 - DNA, 25 bp, Homo sapien
attgcgcatgacgagcacctggctg

SEQ ID NO: 206556 - DNA, 25 bp, Homo sapien
cggggcttgccgtgacagctaccac

SEQ ID NO: 206557 - DNA, 25 bp, Homo sapien
gccgtgacagctaccactcctattg

SEQ ID NO: 206558 - DNA, 25 bp, Homo sapien
actcctattggtcaacgcgaacagc

SEQ ID NO: 206559 - DNA, 25 bp, Homo sapien
gcgaacagcgacgtcctctgcgata

SEQ ID NO: 206560 - DNA, 25 bp, Homo sapien
ctctgcgataggctgtaggtgaaaa

SEQ ID NO: 206561 - DNA, 25 bp, Homo sapien
cgcagcgccacattgcgcatgacga

SEQ ID NO: 206562 - DNA, 25 bp, Homo sapien
agaagtggagagtcccgtcctcccg

SEQ ID NO: 206563 - DNA, 25 bp, Homo sapien
ccgcggtgtttgtgatgcccgctgc

SEQ ID NO: 206564 - DNA, 25 bp, Homo sapien
agtcatcccattgacaaagaagtgg

SEQ ID NO: 206565 - DNA, 25 bp, Homo sapien
agcagggccctgagtcatcccattg

SEQ ID NO: 206566 - DNA, 25 bp, Homo sapien
cgcctggccatagagatcgacgaca

SEQ ID NO: 206567 - DNA, 25 bp, Homo sapien
gtcgtccacaatggtggcctgggcc

SEQ ID NO: 206568 - DNA, 25 bp, Homo sapien
tcacccacgtcgtccacaatggtgg

SEQ ID NO: 206569 - DNA, 25 bp, Homo sapien
atcgacgacagcatagacgcccggg

SEQ ID NO: 206570 - DNA, 25 bp, Homo sapien
tccaaagcagcgtgagccgagtctg

SEQ ID NO: 206571 - DNA, 25 bp, Homo sapien
cgggagcctcgctttacggcatagc

SEQ ID NO: 206572 - DNA, 25 bp, Homo sapien
ggtgctggagcccaaacactttctg

SEQ ID NO: 206573 - DNA, 25 bp, Homo sapien
ggccaggtatgctttacggcactgc

SEQ ID NO: 206574 - DNA, 25 bp, Homo sapien
acaccagcccgtggttaaactcctg

SEQ ID NO: 206575 - DNA, 25 bp, Homo sapien
cgcaagggttctcggctcaacacca

SEQ ID NO: 206576 - DNA, 25 bp, Homo sapien
ggtgacaccttgaagcactcgcttt

SEQ ID NO: 206577 - DNA, 25 bp, Homo sapien
tggggacgaccacgatgagaacaga

SEQ ID NO: 206578 - DNA, 25 bp, Homo sapien
gcgcgtccgctgacggaacagaagc

SEQ ID NO: 206579 - DNA, 25 bp, Homo sapien
cccgcgctaggctggtttcctcggt

SEQ ID NO: 206580 - DNA, 25 bp, Homo sapien
agccgcaccgactgcgtgatgatca

SEQ ID NO: 206581 - DNA, 25 bp, Homo sapien
ctgcggtcctcggaccggactgagc

SEQ ID NO: 206582 - DNA, 25 bp, Homo sapien
aatggccgatgagcctccggagccc

SEQ ID NO: 206583 - DNA, 25 bp, Homo sapien
tgcgtgatgatcagcaccaggtacc

SEQ ID NO: 206584 - DNA, 25 bp, Homo sapien
tccgctgacggaacagaagccggga

SEQ ID NO: 206585 - DNA, 25 bp, Homo sapien
tgatcagcaccaggtaccggcgccg

SEQ ID NO: 206586 - DNA, 25 bp, Homo sapien
acgctgacatcgtcaccctgtaaga

SEQ ID NO: 206587 - DNA, 25 bp, Homo sapien
gtcaccctgtaagaatgcctgaagg

SEQ ID NO: 206588 - DNA, 25 bp, Homo sapien
gccatggaaacagccaacgctgaca

SEQ ID NO: 206589 - DNA, 25 bp, Homo sapien
ctgttcctgaaacggggagctgatc

SEQ ID NO: 206590 - DNA, 25 bp, Homo sapien
aggctcgcctgcctgttcctgaaac

SEQ ID NO: 206591 - DNA, 25 bp, Homo sapien
cgaacgtgaaccaagcggacagtgc

SEQ ID NO: 206592 - DNA, 25 bp, Homo sapien
gctgacgccgaaacagaagcctgtg

SEQ ID NO: 206593 - DNA, 25 bp, Homo sapien
ccaggctcgagaaaggctgcgcgaa

SEQ ID NO: 206594 - DNA, 25 bp, Homo sapien
ggctgtttccatcagagccctcgga

SEQ ID NO: 206595 - DNA, 25 bp, Homo sapien
ccgccgacttgcagacgtgagatcg

SEQ ID NO: 206596 - DNA, 25 bp, Homo sapien
cgagctccagtccagcaaggtgcga

SEQ ID NO: 206597 - DNA, 25 bp, Homo sapien
ggttcacttcttgggcgccaccttc

SEQ ID NO: 206598 - DNA, 25 bp, Homo sapien
gtgcttcgctcttcccttctggttc

SEQ ID NO: 206599 - DNA, 25 bp, Homo sapien
tctgccattaaagcctccgtgcttc

SEQ ID NO: 206600 - DNA, 25 bp, Homo sapien
cagtcatgacctccacacgctgtga

SEQ ID NO: 206601 - DNA, 25 bp, Homo sapien
aagctgagccgtcgcagtcatgacc

SEQ ID NO: 206602 - DNA, 25 bp, Homo sapien
gtcaccttgtcccactagggaactc

SEQ ID NO: 206603 - DNA, 25 bp, Homo sapien
cttccgccttgaccaggtgagggtc

SEQ ID NO: 206604 - DNA, 25 bp, Homo sapien
ggaggttccgcagtcgccgcttccg

SEQ ID NO: 206605 - DNA, 25 bp, Homo sapien
cagcctgggaggttccgcagtcgcc

SEQ ID NO: 206606 - DNA, 25 bp, Homo sapien
tcctcggatttagcccaggcagcct

SEQ ID NO: 206607 - DNA, 25 bp, Homo sapien
cgccctccgcgggatttactcctgt

SEQ ID NO: 206608 - DNA, 25 bp, Homo sapien
tgtcccactagggaactcggggtgc

SEQ ID NO: 206609 - DNA, 25 bp, Homo sapien
tgttcgcgcccggttctgagtccac

SEQ ID NO: 206610 - DNA, 25 bp, Homo sapien
ggcttggaccagaagggttatcctc

SEQ ID NO: 206611 - DNA, 25 bp, Homo sapien
tgggcctccaaggagcacgtgtccc

SEQ ID NO: 206612 - DNA, 25 bp, Homo sapien
cctcctaggcaaagaggacttttgt

SEQ ID NO: 206613 - DNA, 25 bp, Homo sapien
acttttgtgaaagatgggtgcactc

SEQ ID NO: 206614 - DNA, 25 bp, Homo sapien
ttccctcctgcaggtgatggagctg

SEQ ID NO: 206615 - DNA, 25 bp, Homo sapien
agccttctcgtctgcctcggacgtg

SEQ ID NO: 206616 - DNA, 25 bp, Homo sapien
tacgcgcaacctactgctggcgtcg

SEQ ID NO: 206617 - DNA, 25 bp, Homo sapien
gcgcaccatcaaggtggctgacttc

SEQ ID NO: 206618 - DNA, 25 bp, Homo sapien
gcaaactcggagatagccagacaga

SEQ ID NO: 206619 - DNA, 25 bp, Homo sapien
cagccagtccgagcacattccggga

SEQ ID NO: 206620 - DNA, 25 bp, Homo sapien
ttgttctcccatcctgcggaggagg

SEQ ID NO: 206621 - DNA, 25 bp, Homo sapien
ggtgcctagcactcggcagctcaca

SEQ ID NO: 206622 - DNA, 25 bp, Homo sapien
tgactcggggagaaacccaagtgtc

SEQ ID NO: 206623 - DNA, 25 bp, Homo sapien
cattccgggaggatgtgttcaaacc

SEQ ID NO: 206624 - DNA, 25 bp, Homo sapien
ttagaaagggactcaaggcctcatc

SEQ ID NO: 206625 - DNA, 25 bp, Homo sapien
cttagttctggaagcggaggcaaac

SEQ ID NO: 206626 - DNA, 25 bp, Homo sapien
agatcccggtcttctctcaaagttc

SEQ ID NO: 206627 - DNA, 25 bp, Homo sapien
ggctcctcctgttcagcttcaaatc

SEQ ID NO: 206628 - DNA, 25 bp, Homo sapien
ttgcgtcaaggattggcccactttc

SEQ ID NO: 206629 - DNA, 25 bp, Homo sapien
gcctttgtaaaaccgctgcagagtg

SEQ ID NO: 206630 - DNA, 25 bp, Homo sapien
attgcgctcttcacccgcctttgta

SEQ ID NO: 206631 - DNA, 25 bp, Homo sapien
cgggccgtgttcatttcagcattgc

SEQ ID NO: 206632 - DNA, 25 bp, Homo sapien
atcccgaccgcccatgcaaataagg

SEQ ID NO: 206633 - DNA, 25 bp, Homo sapien
ataaggttcacaggcgcccaatccg

SEQ ID NO: 206634 - DNA, 25 bp, Homo sapien
tgtggttcaccgacaacttggaggc

SEQ ID NO: 206635 - DNA, 25 bp, Homo sapien
cccgtcgtgcagttcttgggcgtgc

SEQ ID NO: 206636 - DNA, 25 bp, Homo sapien
tgcagaaccagagcgaggactgcct

SEQ ID NO: 206637 - DNA, 25 bp, Homo sapien
tgcctgtacctcaacctctacgtgc

SEQ ID NO: 206638 - DNA, 25 bp, Homo sapien
tcatgctgcctgtgtggttcaccga

SEQ ID NO: 206639 - DNA, 25 bp, Homo sapien
agctcaacaacgagatcctgggccc

SEQ ID NO: 206640 - DNA, 25 bp, Homo sapien
agcgcttcccggtggtgaacacggc

SEQ ID NO: 206641 - DNA, 25 bp, Homo sapien
gccacctacgtgcagaaccagagcg

SEQ ID NO: 206642 - DNA, 25 bp, Homo sapien
ccggcatatttgctgcttggctagc

SEQ ID NO: 206643 - DNA, 25 bp, Homo sapien
aggtcacctccttcatcacggattc

SEQ ID NO: 206644 - DNA, 25 bp, Homo sapien
ccaatttcggcgatttcggcggtga

SEQ ID NO: 206645 - DNA, 25 bp, Homo sapien
tgcatccggaatcgcatgtacatga

SEQ ID NO: 206646 - DNA, 25 bp, Homo sapien
catgaaaaatgtgtccgcgtgcggc

SEQ ID NO: 206647 - DNA, 25 bp, Homo sapien
aaattctgtgccgagcctgatgcgc

SEQ ID NO: 206648 - DNA, 25 bp, Homo sapien
gtaacctttgcagatggcgccgcta

SEQ ID NO: 206649 - DNA, 25 bp, Homo sapien
ggcgccgctattgctgagaaatgga

SEQ ID NO: 206650 - DNA, 25 bp, Homo sapien
gggactcacgggactactccacgga

SEQ ID NO: 206651 - DNA, 25 bp, Homo sapien
accgcgccaacaaggtggccttctg

SEQ ID NO: 206652 - DNA, 25 bp, Homo sapien
gcgtgcgtgacaactaccgcgccaa

SEQ ID NO: 206653 - DNA, 25 bp, Homo sapien
cctctactacaagcgggaccggcgg

SEQ ID NO: 206654 - DNA, 25 bp, Homo sapien
tactccacggagctgagcgtcaccg

SEQ ID NO: 206655 - DNA, 25 bp, Homo sapien
ttcctcaacatcctggcctttgctg

SEQ ID NO: 206656 - DNA, 25 bp, Homo sapien
tttgctgccctctactacaagcggg

SEQ ID NO: 206657 - DNA, 25 bp, Homo sapien
cggtgcaggcggcttagcccacctg

SEQ ID NO: 206658 - DNA, 25 bp, Homo sapien
cgggacgttgcctcactattttctg

SEQ ID NO: 206659 - DNA, 25 bp, Homo sapien
tggcctctgagtcggcttccttcta

SEQ ID NO: 206660 - DNA, 25 bp, Homo sapien
gaccttggctctaccgcacctttga

SEQ ID NO: 206661 - DNA, 25 bp, Homo sapien
tcttcgacctgatcccagtggtgtc

SEQ ID NO: 206662 - DNA, 25 bp, Homo sapien
gcccacattatgttccgcccaggtg

SEQ ID NO: 206663 - DNA, 25 bp, Homo sapien
ctattttctgaacggccgacagctc

SEQ ID NO: 206664 - DNA, 25 bp, Homo sapien
gggcccattaaagacgctgttccta

SEQ ID NO: 206665 - DNA, 25 bp, Homo sapien
agtcgcctcagcatgacgtcgtcga

SEQ ID NO: 206666 - DNA, 25 bp, Homo sapien
gaaagcctcgtagttcctgctcgtc

SEQ ID NO: 206667 - DNA, 25 bp, Homo sapien
cggagtctccttattttcgaggtca

SEQ ID NO: 206668 - DNA, 25 bp, Homo sapien
ggtgtccttgcagctacctcgccag

SEQ ID NO: 206669 - DNA, 25 bp, Homo sapien
ctgtgacctgcgcttcaagaacgga

SEQ ID NO: 206670 - DNA, 25 bp, Homo sapien
catcctgctgtccaaggtgcgactg

SEQ ID NO: 206671 - DNA, 25 bp, Homo sapien
cagacacagttcacggctagagatg

SEQ ID NO: 206672 - DNA, 25 bp, Homo sapien
gccggttctcgcgattctttcaatc

SEQ ID NO: 206673 - DNA, 25 bp, Homo sapien
actctgaagaatagggcccggctga

SEQ ID NO: 206674 - DNA, 25 bp, Homo sapien
ctagacgctttttgacggctggtcc

SEQ ID NO: 206675 - DNA, 25 bp, Homo sapien
gctgctggtctacggcttgtacaaa

SEQ ID NO: 206676 - DNA, 25 bp, Homo sapien
tcccgtgagcgatcaggagaagctg

SEQ ID NO: 206677 - DNA, 25 bp, Homo sapien
cctcaagcagctgaagggtcccgtg

SEQ ID NO: 206678 - DNA, 25 bp, Homo sapien
cccatgtgccaagtggagttcgagc

SEQ ID NO: 206679 - DNA, 25 bp, Homo sapien
agaaaatgcgccgtgtgagcccaaa

SEQ ID NO: 206680 - DNA, 25 bp, Homo sapien
agacagcagcgttccggatcctaga

SEQ ID NO: 206681 - DNA, 25 bp, Homo sapien
ccgagcttgcaatctgtgcttgaca

SEQ ID NO: 206682 - DNA, 25 bp, Homo sapien
tcagcgttggtctcatcctggcgca

SEQ ID NO: 206683 - DNA, 25 bp, Homo sapien
tggcgcaactcatcagcctggtgag

SEQ ID NO: 206684 - DNA, 25 bp, Homo sapien
tggctatgatagctccgtgcggcca

SEQ ID NO: 206685 - DNA, 25 bp, Homo sapien
gagaaacttttctctggctatgata

SEQ ID NO: 206686 - DNA, 25 bp, Homo sapien
accagggctgcacttattctctcct

SEQ ID NO: 206687 - DNA, 25 bp, Homo sapien
tctgagcgaagtcactgagcgagcc

SEQ ID NO: 206688 - DNA, 25 bp, Homo sapien
tgtcctccagcaacaggtgcacatt

SEQ ID NO: 206689 - DNA, 25 bp, Homo sapien
ttgctcgaggcaggatcaagtcccg

SEQ ID NO: 206690 - DNA, 25 bp, Homo sapien
ttctgcctccaacgtggtggccggc

SEQ ID NO: 206691 - DNA, 25 bp, Homo sapien
gcggtcttgcacaccttggcgcagt

SEQ ID NO: 206692 - DNA, 25 bp, Homo sapien
tcttgcacaccttggcgcagtgggg

SEQ ID NO: 206693 - DNA, 25 bp, Homo sapien
gggccgctcagcagcatgcctctgc

SEQ ID NO: 206694 - DNA, 25 bp, Homo sapien
ctcagggcagctgcggtcttgcaca

SEQ ID NO: 206695 - DNA, 25 bp, Homo sapien
agcttctgcctccaacgtggtggcc

SEQ ID NO: 206696 - DNA, 25 bp, Homo sapien
cttccgcagctttctcagggtggtg

SEQ ID NO: 206697 - DNA, 25 bp, Homo sapien
ggtgcttccgcagctttctcagggt

SEQ ID NO: 206698 - DNA, 25 bp, Homo sapien
ttcatgcttcgtgcggtactccgcc

SEQ ID NO: 206699 - DNA, 25 bp, Homo sapien
aggccgcgcacacatacagcacgtg

SEQ ID NO: 206700 - DNA, 25 bp, Homo sapien
acagggtcacgtaggaacgctcgca

SEQ ID NO: 206701 - DNA, 25 bp, Homo sapien
ttgctgtgtctcttcagactggaca

SEQ ID NO: 206702 - DNA, 25 bp, Homo sapien
caggggtacttcctccgccacgagt

SEQ ID NO: 206703 - DNA, 25 bp, Homo sapien
gtactccgccagagcaaacactttc

SEQ ID NO: 206704 - DNA, 25 bp, Homo sapien
cgtgtgccacacttcatgcttcgtg

SEQ ID NO: 206705 - DNA, 25 bp, Homo sapien
ctttctcacaatagcggcaggggta

SEQ ID NO: 206706 - DNA, 25 bp, Homo sapien
ccttcaaagagggagtgagcacctc

SEQ ID NO: 206707 - DNA, 25 bp, Homo sapien
gtcaaccccaaaggagagcggtctg

SEQ ID NO: 206708 - DNA, 25 bp, Homo sapien
tctctgcctggctcctacgccatca

SEQ ID NO: 206709 - DNA, 25 bp, Homo sapien
agcttgcagcgcttgcccgggctca

SEQ ID NO: 206710 - DNA, 25 bp, Homo sapien
ggctgcagaattaacccttcaaaga

SEQ ID NO: 206711 - DNA, 25 bp, Homo sapien
aggcgatcgcgtcccacggccgccc

SEQ ID NO: 206712 - DNA, 25 bp, Homo sapien
tcgctcggacgccataccagggccc

SEQ ID NO: 206713 - DNA, 25 bp, Homo sapien
ggggccattaggctgcagaattaac

SEQ ID NO: 206714 - DNA, 25 bp, Homo sapien
ccgattcgcagagcagaccattttc

SEQ ID NO: 206715 - DNA, 25 bp, Homo sapien
gcgctttctcgctgcttatgggtga

SEQ ID NO: 206716 - DNA, 25 bp, Homo sapien
ggctgcggaaacttggcgctttctc

SEQ ID NO: 206717 - DNA, 25 bp, Homo sapien
cctgagtccggatgaactggtaagc

SEQ ID NO: 206718 - DNA, 25 bp, Homo sapien
tgcgcaccatcaagagagtccagtt

SEQ ID NO: 206719 - DNA, 25 bp, Homo sapien
cgccctgacgaggtctgagcaccta

SEQ ID NO: 206720 - DNA, 25 bp, Homo sapien
tttgctgaagatgaaaccgttgtcc

SEQ ID NO: 206721 - DNA, 25 bp, Homo sapien
actgccgtaacctctgccgttcagg

SEQ ID NO: 206722 - DNA, 25 bp, Homo sapien
cgggcatcgctgtccgcccaggtga

SEQ ID NO: 206723 - DNA, 25 bp, Homo sapien
aggaggtgcccgcacacgcatagcc

SEQ ID NO: 206724 - DNA, 25 bp, Homo sapien
acgcaacggacctcgccctggtggt

SEQ ID NO: 206725 - DNA, 25 bp, Homo sapien
cgggtgggcgcccactccgttcgct

SEQ ID NO: 206726 - DNA, 25 bp, Homo sapien
actccgttcgctgcgcgcacagcgc

SEQ ID NO: 206727 - DNA, 25 bp, Homo sapien
gcgagaggctcggagtttgatcaca

SEQ ID NO: 206728 - DNA, 25 bp, Homo sapien
tcctgctggccgtggtcagtttggg

SEQ ID NO: 206729 - DNA, 25 bp, Homo sapien
agaggctcggagtttgatcacacac

SEQ ID NO: 206730 - DNA, 25 bp, Homo sapien
atgtaggcacctggcacacacgtcg

SEQ ID NO: 206731 - DNA, 25 bp, Homo sapien
ttcgttgtccttcttcatccggagc

SEQ ID NO: 206732 - DNA, 25 bp, Homo sapien
tctgctcatcaagaggtgcgaggtg

SEQ ID NO: 206733 - DNA, 25 bp, Homo sapien
acacgtcgtctttgacctgctttta

SEQ ID NO: 206734 - DNA, 25 bp, Homo sapien
tccgtgtgtcttccagcgtgattag

SEQ ID NO: 206735 - DNA, 25 bp, Homo sapien
ctgaggtctgatctcgcagcagatg

SEQ ID NO: 206736 - DNA, 25 bp, Homo sapien
agctgcctttgaggacgcacctgcc

SEQ ID NO: 206737 - DNA, 25 bp, Homo sapien
cccgtgtgtcgtgaacaacgctgtc

SEQ ID NO: 206738 - DNA, 25 bp, Homo sapien
cgggaaagttagtgtgaaacatgtt

SEQ ID NO: 206739 - DNA, 25 bp, Homo sapien
gagataaccattagcgcagccgccg

SEQ ID NO: 206740 - DNA, 25 bp, Homo sapien
accattagcgcagccgccgataaag

SEQ ID NO: 206741 - DNA, 25 bp, Homo sapien
aggctccgcggccattacgggaaag

SEQ ID NO: 206742 - DNA, 25 bp, Homo sapien
ggcacggctgcgagataaccattag

SEQ ID NO: 206743 - DNA, 25 bp, Homo sapien
gcccgacacgccgacgtccaccagg

SEQ ID NO: 206744 - DNA, 25 bp, Homo sapien
gcccgagagagccacgagacccgcc

SEQ ID NO: 206745 - DNA, 25 bp, Homo sapien
cggccattacgggaaagttagtgtg

SEQ ID NO: 206746 - DNA, 25 bp, Homo sapien
tcttcgccgggtgtgacgtactaat

SEQ ID NO: 206747 - DNA, 25 bp, Homo sapien
acgtactaatcgtgcgccaccgctg

SEQ ID NO: 206748 - DNA, 25 bp, Homo sapien
ggcccagaagcgttggaatcctgaa

SEQ ID NO: 206749 - DNA, 25 bp, Homo sapien
cctgaattgagacggctgcgcctaa

SEQ ID NO: 206750 - DNA, 25 bp, Homo sapien
cagaggcccgcataggggcttctta

SEQ ID NO: 206751 - DNA, 25 bp, Homo sapien
agccatccaagctcgtgggaccgga

SEQ ID NO: 206752 - DNA, 25 bp, Homo sapien
cttctttctgatcaagccctgctta

SEQ ID NO: 206753 - DNA, 25 bp, Homo sapien
tgttggtgttgcctcactcctctga

SEQ ID NO: 206754 - DNA, 25 bp, Homo sapien
ttcttgacggccaggactgagccta

SEQ ID NO: 206755 - DNA, 25 bp, Homo sapien
ccgttcagtgtgctggttttcttga

SEQ ID NO: 206756 - DNA, 25 bp, Homo sapien
tccagtcacttcgtcgcggctaaaa

SEQ ID NO: 206757 - DNA, 25 bp, Homo sapien
ccggagcattctgacggtaccactc

SEQ ID NO: 206758 - DNA, 25 bp, Homo sapien
ctgcgagccaggattcccggtaaga

SEQ ID NO: 206759 - DNA, 25 bp, Homo sapien
ggcactccgccctagtttctaagga

SEQ ID NO: 206760 - DNA, 25 bp, Homo sapien
tcgcttctaagtgttgtgcaatctc

SEQ ID NO: 206761 - DNA, 25 bp, Homo sapien
ttctaaggatcatgtctgcgagcca

SEQ ID NO: 206762 - DNA, 25 bp, Homo sapien
tgctcgtgccgattcttttacctga

SEQ ID NO: 206763 - DNA, 25 bp, Homo sapien
cgtgggcccttagtccaagccttga

SEQ ID NO: 206764 - DNA, 25 bp, Homo sapien
gcccttccctctagagacgctgaga

SEQ ID NO: 206765 - DNA, 25 bp, Homo sapien
aggcgtgcagcttcggcaagcttta

SEQ ID NO: 206766 - DNA, 25 bp, Homo sapien
cgtggtccctgactgagacttattt

SEQ ID NO: 206767 - DNA, 25 bp, Homo sapien
cgcgcacgcgcaacgaaagtcaatg

SEQ ID NO: 206768 - DNA, 25 bp, Homo sapien
gctagctttgcaatatggcggccga

SEQ ID NO: 206769 - DNA, 25 bp, Homo sapien
caggggtgtaaatctggcttccaaa

SEQ ID NO: 206770 - DNA, 25 bp, Homo sapien
ggagatctcggagttgtgcatcttg

SEQ ID NO: 206771 - DNA, 25 bp, Homo sapien
ggggtctgtacccaaagcctctgct

SEQ ID NO: 206772 - DNA, 25 bp, Homo sapien
tgagcggagctccacaccatgaacg

SEQ ID NO: 206773 - DNA, 25 bp, Homo sapien
caaagcctctgctcggttgggtggt

SEQ ID NO: 206774 - DNA, 25 bp, Homo sapien
ttccctgtccgcagcgggaaggtcc

SEQ ID NO: 206775 - DNA, 25 bp, Homo sapien
ggagctccacaccatgaacgcgttc

SEQ ID NO: 206776 - DNA, 25 bp, Homo sapien
actcacccatagctgccaggcaggt

SEQ ID NO: 206777 - DNA, 25 bp, Homo sapien
ctctgcttgggtgggctcccgtcct

SEQ ID NO: 206778 - DNA, 25 bp, Homo sapien
tgagcctgtcgaatgttctcgtttc

SEQ ID NO: 206779 - DNA, 25 bp, Homo sapien
cacaccgcggggactaatcgtgtta

SEQ ID NO: 206780 - DNA, 25 bp, Homo sapien
gacaccctccggcttaggttcacga

SEQ ID NO: 206781 - DNA, 25 bp, Homo sapien
cgtcccgatagaaacgcgccgtctg

SEQ ID NO: 206782 - DNA, 25 bp, Homo sapien
gctctgcgagcagccatgattcccg

SEQ ID NO: 206783 - DNA, 25 bp, Homo sapien
gcccagtgaaagtggtgtttccttc

SEQ ID NO: 206784 - DNA, 25 bp, Homo sapien
aacaaccgctcgaggagtccgcatc

SEQ ID NO: 206785 - DNA, 25 bp, Homo sapien
ctgggcttcgctacgataaagctta

SEQ ID NO: 206786 - DNA, 25 bp, Homo sapien
cgcgccgtctcaccttgtagaaggc

SEQ ID NO: 206787 - DNA, 25 bp, Homo sapien
tgtctttcttggtgcgcacgctcca

SEQ ID NO: 206788 - DNA, 25 bp, Homo sapien
atgcgcctgaacgactgcttggtca

SEQ ID NO: 206789 - DNA, 25 bp, Homo sapien
ctagcgcttgcgcagaacaagatta

SEQ ID NO: 206790 - DNA, 25 bp, Homo sapien
cctcctggtcgcttgctagcgcttg

SEQ ID NO: 206791 - DNA, 25 bp, Homo sapien
atcggggcttccacattccctttca

SEQ ID NO: 206792 - DNA, 25 bp, Homo sapien
cgcgcaggcgtcaaggttagagccc

SEQ ID NO: 206793 - DNA, 25 bp, Homo sapien
gtcgccgcaaggaaaaaggtgcttg

SEQ ID NO: 206794 - DNA, 25 bp, Homo sapien
agtcttcacccgaatcagcctcagg

SEQ ID NO: 206795 - DNA, 25 bp, Homo sapien
atcagcttggagaacaggcacggcc

SEQ ID NO: 206796 - DNA, 25 bp, Homo sapien
ttcgaattcggctagctcctaaggc

SEQ ID NO: 206797 - DNA, 25 bp, Homo sapien
ctcctaaggcgtgggtacggaagct

SEQ ID NO: 206798 - DNA, 25 bp, Homo sapien
tcagcctcaggatatctccacagtc

SEQ ID NO: 206799 - DNA, 25 bp, Homo sapien
tggatcctgaagagcctgagagagc

SEQ ID NO: 206800 - DNA, 25 bp, Homo sapien
aagggcctacggacttggatcctga

SEQ ID NO: 206801 - DNA, 25 bp, Homo sapien
gcacaactgtcagccaatcagcttg

SEQ ID NO: 206802 - DNA, 25 bp, Homo sapien
cgcgccaccaagatggtcatccaga

SEQ ID NO: 206803 - DNA, 25 bp, Homo sapien
acagcttctttgcatcttggatttc

SEQ ID NO: 206804 - DNA, 25 bp, Homo sapien
gagaaagtaggtcacagccgccttc

SEQ ID NO: 206805 - DNA, 25 bp, Homo sapien
ggcctaggatcggtgcatcttccgc

SEQ ID NO: 206806 - DNA, 25 bp, Homo sapien
aacccgaggacgcaccagtttatgg

SEQ ID NO: 206807 - DNA, 25 bp, Homo sapien
gggccgaatcgccagtctaatctcc

SEQ ID NO: 206808 - DNA, 25 bp, Homo sapien
ctgcgttctgctcggtttttgtagc

SEQ ID NO: 206809 - DNA, 25 bp, Homo sapien
agcgagccttgagcttcgttccaca

SEQ ID NO: 206810 - DNA, 25 bp, Homo sapien
caaccgcgagctaagagatggggca

SEQ ID NO: 206811 - DNA, 25 bp, Homo sapien
tacggcacaaagtggccggtacgcg

SEQ ID NO: 206812 - DNA, 25 bp, Homo sapien
tgcggaatgaaacaaccgcgagcta

SEQ ID NO: 206813 - DNA, 25 bp, Homo sapien
cagcgggagaaatgaattcgagttc

SEQ ID NO: 206814 - DNA, 25 bp, Homo sapien
ttcgagttccgcctcctaccaggaa

SEQ ID NO: 206815 - DNA, 25 bp, Homo sapien
ctcctaccaggaagaaccggctcgg

SEQ ID NO: 206816 - DNA, 25 bp, Homo sapien
acggaggaccacacggacgcctgcg

SEQ ID NO: 206817 - DNA, 25 bp, Homo sapien
tgcatgggaagaaactgcggaatga

SEQ ID NO: 206818 - DNA, 25 bp, Homo sapien
cgccaagatagaagcgttcagacta

SEQ ID NO: 206819 - DNA, 25 bp, Homo sapien
gaaggtggaccgaaatcccgcgaca

SEQ ID NO: 206820 - DNA, 25 bp, Homo sapien
tgctttaagaattaccgcgggactc

SEQ ID NO: 206821 - DNA, 25 bp, Homo sapien
tgggtcgcccgcgaaatctgatccg

SEQ ID NO: 206822 - DNA, 25 bp, Homo sapien
gcagccacgaggagccctagggctt

SEQ ID NO: 206823 - DNA, 25 bp, Homo sapien
atcccgcgacagcaagaggcccgta

SEQ ID NO: 206824 - DNA, 25 bp, Homo sapien
cggtgctaaggaacacagtgctttc

SEQ ID NO: 206825 - DNA, 25 bp, Homo sapien
ctttcaaaagaattggcgtccgctg

SEQ ID NO: 206826 - DNA, 25 bp, Homo sapien
agaagatctggagccggtgcctcag

SEQ ID NO: 206827 - DNA, 25 bp, Homo sapien
attactcggatacgctccggctggc

SEQ ID NO: 206828 - DNA, 25 bp, Homo sapien
ctgcgtctggcggagacaattactc

SEQ ID NO: 206829 - DNA, 25 bp, Homo sapien
aatccgggattttccgagccgcctg

SEQ ID NO: 206830 - DNA, 25 bp, Homo sapien
cgcctgtaagtatttttcgtcattg

SEQ ID NO: 206831 - DNA, 25 bp, Homo sapien
atctgtaaatgaaaccgcccggctt

SEQ ID NO: 206832 - DNA, 25 bp, Homo sapien
tgccggcagacgcagaaaagccgtc

SEQ ID NO: 206833 - DNA, 25 bp, Homo sapien
tcgtcattgctctgatgccggcaga

SEQ ID NO: 206834 - DNA, 25 bp, Homo sapien
caggaagcaggtccgcgtgggcgct

SEQ ID NO: 206835 - DNA, 25 bp, Homo sapien
gggcatcagctaccggggtggtccg

SEQ ID NO: 206836 - DNA, 25 bp, Homo sapien
cacttaggcgggctcacagatcccg

SEQ ID NO: 206837 - DNA, 25 bp, Homo sapien
gctccagctccggtttttccctcca

SEQ ID NO: 206838 - DNA, 25 bp, Homo sapien
tcctgggctcgggactggtttcctc

SEQ ID NO: 206839 - DNA, 25 bp, Homo sapien
ctggtttcctcccttagcccgctgc

SEQ ID NO: 206840 - DNA, 25 bp, Homo sapien
agcccgctgccctcaatcccagcga

SEQ ID NO: 206841 - DNA, 25 bp, Homo sapien
cttaggcgggctcacagatcccggg

SEQ ID NO: 206842 - DNA, 25 bp, Homo sapien
gcaacttcttagagtggcccatcgg

SEQ ID NO: 206843 - DNA, 25 bp, Homo sapien
cgattgggttctccctgccttttca

SEQ ID NO: 206844 - DNA, 25 bp, Homo sapien
ccttttcaatgtcctgcggggcggt

SEQ ID NO: 206845 - DNA, 25 bp, Homo sapien
ttccagctgggtcctgacaccaggc

SEQ ID NO: 206846 - DNA, 25 bp, Homo sapien
cttcggctcgccagatgtggctact

SEQ ID NO: 206847 - DNA, 25 bp, Homo sapien
atgtggctactttcctttagtcccg

SEQ ID NO: 206848 - DNA, 25 bp, Homo sapien
tagtcccggagccttcaagccctgg

SEQ ID NO: 206849 - DNA, 25 bp, Homo sapien
cctggaaatcctggaacgccttcta

SEQ ID NO: 206850 - DNA, 25 bp, Homo sapien
ctacgtggcccagtattccggaaag

SEQ ID NO: 206851 - DNA, 25 bp, Homo sapien
ccgtgaacggaacaagaaatggcca

SEQ ID NO: 206852 - DNA, 25 bp, Homo sapien
ctgttcaatagcgagctggccctgg

SEQ ID NO: 206853 - DNA, 25 bp, Homo sapien
ttccctaggctatcaagcggactta

SEQ ID NO: 206854 - DNA, 25 bp, Homo sapien
ctttcctctgggatgagtgaccgga

SEQ ID NO: 206855 - DNA, 25 bp, Homo sapien
ttctccatgtccagcattcgggcgc

SEQ ID NO: 206856 - DNA, 25 bp, Homo sapien
gcgtgcttctgctggacaccttcca

SEQ ID NO: 206857 - DNA, 25 bp, Homo sapien
gcggtggatctctacatgctgttca

SEQ ID NO: 206858 - DNA, 25 bp, Homo sapien
aaatctgggagatcgcacgagactg

SEQ ID NO: 206859 - DNA, 25 bp, Homo sapien
cgggctgtttcgtcgcctcacaaaa

SEQ ID NO: 206860 - DNA, 25 bp, Homo sapien
ctgcagacggaaaccatggagacca

SEQ ID NO: 206861 - DNA, 25 bp, Homo sapien
aatgagtggaagactggccggttcc

SEQ ID NO: 206862 - DNA, 25 bp, Homo sapien
tcgatgccctccagcaaatctggga

SEQ ID NO: 206863 - DNA, 25 bp, Homo sapien
ctgccctgtaggagctcgatgccct

SEQ ID NO: 206864 - DNA, 25 bp, Homo sapien
ggtgccacttcatgcaacgcgcctt

SEQ ID NO: 206865 - DNA, 25 bp, Homo sapien
ccggttcctgatcctgcagacggaa

SEQ ID NO: 206866 - DNA, 25 bp, Homo sapien
agcgcatcgcgatgcccgagcaggt

SEQ ID NO: 206867 - DNA, 25 bp, Homo sapien
ctcatcaacggcgagcgcatcgcga

SEQ ID NO: 206868 - DNA, 25 bp, Homo sapien
aacaaggtgttgaccctcatcaacg

SEQ ID NO: 206869 - DNA, 25 bp, Homo sapien
ccgtcatggacgataacaaggtgtt

SEQ ID NO: 206870 - DNA, 25 bp, Homo sapien
tggatcgagaacatgaactccgtca

SEQ ID NO: 206871 - DNA, 25 bp, Homo sapien
cccgtggacacactgtggatcgaga

SEQ ID NO: 206872 - DNA, 25 bp, Homo sapien
tctactcagatgagaaacccgacga

SEQ ID NO: 206873 - DNA, 25 bp, Homo sapien
acccgacgagaagtggatcctgttc

SEQ ID NO: 206874 - DNA, 25 bp, Homo sapien
tgccgcgtgatcacctcgccctgcg

SEQ ID NO: 206875 - DNA, 25 bp, Homo sapien
cctgcgggtccagcatgatgagcgt

SEQ ID NO: 206876 - DNA, 25 bp, Homo sapien
agtcctcgtcgttcagcacctccac

SEQ ID NO: 206877 - DNA, 25 bp, Homo sapien
ccagcatgatgagcgtggggatgcc

SEQ ID NO: 206878 - DNA, 25 bp, Homo sapien
gaactcccggcagtcctcgtcgttc

SEQ ID NO: 206879 - DNA, 25 bp, Homo sapien
agtcggagagctccagcacgggctt

SEQ ID NO: 206880 - DNA, 25 bp, Homo sapien
cctcgttaagctgcgcggcgttgga

SEQ ID NO: 206881 - DNA, 25 bp, Homo sapien
ggccctcgttaagctgcgcggcgtt

SEQ ID NO: 206882 - DNA, 25 bp, Homo sapien
cttaccttagaagggcgcgtgatcc

SEQ ID NO: 206883 - DNA, 25 bp, Homo sapien
actgcaccctgaggcccgcaccctg

SEQ ID NO: 206884 - DNA, 25 bp, Homo sapien
agggatcagggctgaaccccgtaca

SEQ ID NO: 206885 - DNA, 25 bp, Homo sapien
aggcgtggccctgaacgaatgggca

SEQ ID NO: 206886 - DNA, 25 bp, Homo sapien
aagggcgcgtgatccaaatgagtag

SEQ ID NO: 206887 - DNA, 25 bp, Homo sapien
aagtctccgggcaggacttcagtgg

SEQ ID NO: 206888 - DNA, 25 bp, Homo sapien
gtggcttaagtctccgggcaggact

SEQ ID NO: 206889 - DNA, 25 bp, Homo sapien
caaatgagtagggatttgtcaggca

SEQ ID NO: 206890 - DNA, 25 bp, Homo sapien
cgggctctggcttaagttgctttcc

SEQ ID NO: 206891 - DNA, 25 bp, Homo sapien
gtcgcgaccataatgcccagcctgg

SEQ ID NO: 206892 - DNA, 25 bp, Homo sapien
tcgtggagtctgtgtaaagccgcct

SEQ ID NO: 206893 - DNA, 25 bp, Homo sapien
ccagagtaactggagggcgagactt

SEQ ID NO: 206894 - DNA, 25 bp, Homo sapien
tcccaagagaaagcgagcgggtacc

SEQ ID NO: 206895 - DNA, 25 bp, Homo sapien
cccaggtgattcttctgggccatca

SEQ ID NO: 206896 - DNA, 25 bp, Homo sapien
tgctgcagcttatgttgtgacactg

SEQ ID NO: 206897 - DNA, 25 bp, Homo sapien
cgtagattcgcttcctgtttgctgc

SEQ ID NO: 206898 - DNA, 25 bp, Homo sapien
gcctctcgctgctctttgtactcta

SEQ ID NO: 206899 - DNA, 25 bp, Homo sapien
ggacggcactcactgacttagggaa

SEQ ID NO: 206900 - DNA, 25 bp, Homo sapien
tcatcatcgccgaaggggaagctgc

SEQ ID NO: 206901 - DNA, 25 bp, Homo sapien
gggaagctgcctttcctggtaactg

SEQ ID NO: 206902 - DNA, 25 bp, Homo sapien
cctccacgtctggttcttgggtctc

SEQ ID NO: 206903 - DNA, 25 bp, Homo sapien
tcacggagggccatacttgaccaca

SEQ ID NO: 206904 - DNA, 25 bp, Homo sapien
gggtccaagcgcttccatgcaaaca

SEQ ID NO: 206905 - DNA, 25 bp, Homo sapien
tgaccacagttcagcgccgtacctg

SEQ ID NO: 206906 - DNA, 25 bp, Homo sapien
atattcctgtgtaccgcttcgtgca

SEQ ID NO: 206907 - DNA, 25 bp, Homo sapien
tcctggtggccaatcctggatgatc

SEQ ID NO: 206908 - DNA, 25 bp, Homo sapien
ctactgggagaccatcagcgctttc

SEQ ID NO: 206909 - DNA, 25 bp, Homo sapien
tctgctccgtcaacatcaacattgg

SEQ ID NO: 206910 - DNA, 25 bp, Homo sapien
cagctgtacatgaaggtgcccggca

SEQ ID NO: 206911 - DNA, 25 bp, Homo sapien
tgggccacaccatcctgggcatgaa

SEQ ID NO: 206912 - DNA, 25 bp, Homo sapien
gcgggtaacatccacgggcaacatg

SEQ ID NO: 206913 - DNA, 25 bp, Homo sapien
cccggagacctcgtgtggattaatg

SEQ ID NO: 206914 - DNA, 25 bp, Homo sapien
aaaactccctgacacagaaacgccg

SEQ ID NO: 206915 - DNA, 25 bp, Homo sapien
gcagcccacagttggcgctacacga

SEQ ID NO: 206916 - DNA, 25 bp, Homo sapien
ccctcccatgtggcctaggacggga

SEQ ID NO: 206917 - DNA, 25 bp, Homo sapien
ctgatgggaagcgacagctccgccc

SEQ ID NO: 206918 - DNA, 25 bp, Homo sapien
gtgtcgggaacaatcctgcgcctga

SEQ ID NO: 206919 - DNA, 25 bp, Homo sapien
gcctgcaaaactccctgacacagaa

SEQ ID NO: 206920 - DNA, 25 bp, Homo sapien
tcgtatgggtcacggcgcctgcaaa

SEQ ID NO: 206921 - DNA, 25 bp, Homo sapien
atcctgcgcctgatgggaagcgaca

SEQ ID NO: 206922 - DNA, 25 bp, Homo sapien
ttacttccaatgctagctgtgaccc

SEQ ID NO: 206923 - DNA, 25 bp, Homo sapien
cagtaccgcactgaggagctggctc

SEQ ID NO: 206924 - DNA, 25 bp, Homo sapien
agccgggttctcatggtgctcaaac

SEQ ID NO: 206925 - DNA, 25 bp, Homo sapien
tacatagacgttacggcagccgagg

SEQ ID NO: 206926 - DNA, 25 bp, Homo sapien
cacgcggctcgtgtatgtacataga

SEQ ID NO: 206927 - DNA, 25 bp, Homo sapien
cgactttggcctttttagcaacaga

SEQ ID NO: 206928 - DNA, 25 bp, Homo sapien
gagattctttctatgggctttaccc

SEQ ID NO: 206929 - DNA, 25 bp, Homo sapien
cctacgacgccttcacgctggtgag

SEQ ID NO: 206930 - DNA, 25 bp, Homo sapien
cgtgcacagtatcgcctggtcggct

SEQ ID NO: 206931 - DNA, 25 bp, Homo sapien
tttcacggccctactggtcaccgga

SEQ ID NO: 206932 - DNA, 25 bp, Homo sapien
tggtcaccggattcctgctcctcgt

SEQ ID NO: 206933 - DNA, 25 bp, Homo sapien
gctcgtgcttgctctggccagctac

SEQ ID NO: 206934 - DNA, 25 bp, Homo sapien
tagccgattgcctcgtgccctacag

SEQ ID NO: 206935 - DNA, 25 bp, Homo sapien
cagccgagccctttatcggcgtcgg

SEQ ID NO: 206936 - DNA, 25 bp, Homo sapien
tcggcttgggcctgacgcctcttct

SEQ ID NO: 206937 - DNA, 25 bp, Homo sapien
gggtctatgggccacaacttcaacc

SEQ ID NO: 206938 - DNA, 25 bp, Homo sapien
tcgcgagacctttacctctggtttc

SEQ ID NO: 206939 - DNA, 25 bp, Homo sapien
actacgccggatgtcttaagatatc

SEQ ID NO: 206940 - DNA, 25 bp, Homo sapien
agcggcgcaactcaattacttgatc

SEQ ID NO: 206941 - DNA, 25 bp, Homo sapien
acttctctagcgctgtggctcactg

SEQ ID NO: 206942 - DNA, 25 bp, Homo sapien
caacggcacagatctcgcgagcttc

SEQ ID NO: 206943 - DNA, 25 bp, Homo sapien
cttctcgtagcagcatggtcggtcc

SEQ ID NO: 206944 - DNA, 25 bp, Homo sapien
ccacgcgggactcatactacgtttc

SEQ ID NO: 206945 - DNA, 25 bp, Homo sapien
agtcccagaaccagagcccgtgcta

SEQ ID NO: 206946 - DNA, 25 bp, Homo sapien
ttaggtgcccgccaactgaggggca

SEQ ID NO: 206947 - DNA, 25 bp, Homo sapien
gagggaccgccgagaccctggcggc

SEQ ID NO: 206948 - DNA, 25 bp, Homo sapien
gctcaggacttggacaggcagagtg

SEQ ID NO: 206949 - DNA, 25 bp, Homo sapien
agagtggggacggtgtccatcggac

SEQ ID NO: 206950 - DNA, 25 bp, Homo sapien
ggagacttaggtgcccgccaactga

SEQ ID NO: 206951 - DNA, 25 bp, Homo sapien
gtaggcaggaaacggccaaggcgaa

SEQ ID NO: 206952 - DNA, 25 bp, Homo sapien
cgacgacgagggagtactcgggcgc

SEQ ID NO: 206953 - DNA, 25 bp, Homo sapien
gcggagacttaggtgcccgccaact

SEQ ID NO: 206954 - DNA, 25 bp, Homo sapien
taacgcggccagctccgtgaacaga

SEQ ID NO: 206955 - DNA, 25 bp, Homo sapien
agaacgagcacactctcctggggcc

SEQ ID NO: 206956 - DNA, 25 bp, Homo sapien
gggtaccctcaccaagagctgcatc

SEQ ID NO: 206957 - DNA, 25 bp, Homo sapien
gcagatgttgcagtccagctcgccc

SEQ ID NO: 206958 - DNA, 25 bp, Homo sapien
ccacaagtccgagtcaagagccatc

SEQ ID NO: 206959 - DNA, 25 bp, Homo sapien
cgtcagcgtcgctgctttccttggc

SEQ ID NO: 206960 - DNA, 25 bp, Homo sapien
gaacctcggtattcctcggcgctct

SEQ ID NO: 206961 - DNA, 25 bp, Homo sapien
ccttcggagcgtcacgccttgatcg

SEQ ID NO: 206962 - DNA, 25 bp, Homo sapien
agccgacggcgagtagctcatgccc

SEQ ID NO: 206963 - DNA, 25 bp, Homo sapien
cagcgacaccgggttgggtccctgc

SEQ ID NO: 206964 - DNA, 25 bp, Homo sapien
gtatcactactcgaagccgggactc

SEQ ID NO: 206965 - DNA, 25 bp, Homo sapien
tggctttgttcatgcgtatcactac

SEQ ID NO: 206966 - DNA, 25 bp, Homo sapien
cccactgcaaaaggatatggctttg

SEQ ID NO: 206967 - DNA, 25 bp, Homo sapien
gcgggcgtgctactttctctctcga

SEQ ID NO: 206968 - DNA, 25 bp, Homo sapien
caagaagggcctagaaagacgcagc

SEQ ID NO: 206969 - DNA, 25 bp, Homo sapien
ctcatgcccgggatttgcaagaagg

SEQ ID NO: 206970 - DNA, 25 bp, Homo sapien
ctcctaagacgaggtgtgccgggac

SEQ ID NO: 206971 - DNA, 25 bp, Homo sapien
gcttctgaggagcactcaggggctt

SEQ ID NO: 206972 - DNA, 25 bp, Homo sapien
ccacctggcttctgaggagcactca

SEQ ID NO: 206973 - DNA, 25 bp, Homo sapien
gcggcctttttcctgactgtggctg

SEQ ID NO: 206974 - DNA, 25 bp, Homo sapien
ctccaagcggcctttttcctgactg

SEQ ID NO: 206975 - DNA, 25 bp, Homo sapien
cctgaaggcaaagctgcccatttcc

SEQ ID NO: 206976 - DNA, 25 bp, Homo sapien
agcctcttttgagtccgtgcctgcg

SEQ ID NO: 206977 - DNA, 25 bp, Homo sapien
aggaacggctcctcctaagacgagg

SEQ ID NO: 206978 - DNA, 25 bp, Homo sapien
aaggtctcggaggataaggacccag

SEQ ID NO: 206979 - DNA, 25 bp, Homo sapien
agagagatgccacttcagcgcgaac

SEQ ID NO: 206980 - DNA, 25 bp, Homo sapien
gggtccacacagacggtcctcactg

SEQ ID NO: 206981 - DNA, 25 bp, Homo sapien
ggtcctcactgctccggctgcgaag

SEQ ID NO: 206982 - DNA, 25 bp, Homo sapien
ctgcgaaggttctgctcggtacacg

SEQ ID NO: 206983 - DNA, 25 bp, Homo sapien
ctcggtacacgcgatagacacctgc

SEQ ID NO: 206984 - DNA, 25 bp, Homo sapien
atagacacctgcatgctggctggcc

SEQ ID NO: 206985 - DNA, 25 bp, Homo sapien
acttcagcgcgaaccgctgcgggac

SEQ ID NO: 206986 - DNA, 25 bp, Homo sapien
aggctgccaacggttttgagcgtag

SEQ ID NO: 206987 - DNA, 25 bp, Homo sapien
ggactcaccggaactgctccgagtg

SEQ ID NO: 206988 - DNA, 25 bp, Homo sapien
acagaagtgatgtgagtgtctgcga

SEQ ID NO: 206989 - DNA, 25 bp, Homo sapien
caggcgctcgggatacagaagtgat

SEQ ID NO: 206990 - DNA, 25 bp, Homo sapien
tcagccaatctgtggccaccggagc

SEQ ID NO: 206991 - DNA, 25 bp, Homo sapien
agtgctgcttgtcagactccgcctc

SEQ ID NO: 206992 - DNA, 25 bp, Homo sapien
tgggcattaactccgctccagtgct

SEQ ID NO: 206993 - DNA, 25 bp, Homo sapien
tccgagtgcccgtcaagagttactt

SEQ ID NO: 206994 - DNA, 25 bp, Homo sapien
ccgcaccctggccttcacagagcag

SEQ ID NO: 206995 - DNA, 25 bp, Homo sapien
gcgcctcgcttcctccatcactaaa

SEQ ID NO: 206996 - DNA, 25 bp, Homo sapien
gaccactctgcggtctacccgctgc

SEQ ID NO: 206997 - DNA, 25 bp, Homo sapien
tgcagaagcgggtgcggaagcggga

SEQ ID NO: 206998 - DNA, 25 bp, Homo sapien
catcactaaaccaccgggggactga

SEQ ID NO: 206999 - DNA, 25 bp, Homo sapien
gcttcctccatcactaaaccaccgg

SEQ ID NO: 207000 - DNA, 25 bp, Homo sapien
cgcctcgcgccttatccttggggct

SEQ ID NO: 207001 - DNA, 25 bp, Homo sapien
ctcgcgccttatccttggggctccc

SEQ ID NO: 207002 - DNA, 25 bp, Homo sapien
cggctcctgcgattagcgctccaga

SEQ ID NO: 207003 - DNA, 25 bp, Homo sapien
gcgacggcactcagaattgcgctga

SEQ ID NO: 207004 - DNA, 25 bp, Homo sapien
gcagcggcgaatggcacattacaga

SEQ ID NO: 207005 - DNA, 25 bp, Homo sapien
tccatgagcaatcagcgagcagcgg

SEQ ID NO: 207006 - DNA, 25 bp, Homo sapien
cccatctgccaaagccgagatttta

SEQ ID NO: 207007 - DNA, 25 bp, Homo sapien
cggggaagtgaccagcactagatta

SEQ ID NO: 207008 - DNA, 25 bp, Homo sapien
cgtcctgcctggagtctagaaggga

SEQ ID NO: 207009 - DNA, 25 bp, Homo sapien
cgctccagatgtttggctgcgctag

SEQ ID NO: 207010 - DNA, 25 bp, Homo sapien
ccagggtcacaggtaggctcccttg

SEQ ID NO: 207011 - DNA, 25 bp, Homo sapien
agttagtcttcccagcctccggagg

SEQ ID NO: 207012 - DNA, 25 bp, Homo sapien
gcggtagcagcagaatcatcccatg

SEQ ID NO: 207013 - DNA, 25 bp, Homo sapien
tcatcccatgggttactcgggcttg

SEQ ID NO: 207014 - DNA, 25 bp, Homo sapien
agcctgctccgtctgtgttcgcaga

SEQ ID NO: 207015 - DNA, 25 bp, Homo sapien
ctgtcgcctccgtgacttccatgga

SEQ ID NO: 207016 - DNA, 25 bp, Homo sapien
gcctctgtccgcagcagtgatcatg

SEQ ID NO: 207017 - DNA, 25 bp, Homo sapien
gtgttcgcagaagccggcaatgacc

SEQ ID NO: 207018 - DNA, 25 bp, Homo sapien
ccctcgtgctggttcgatccaaaca

SEQ ID NO: 207019 - DNA, 25 bp, Homo sapien
cacatccgggatgcgcaggtccctg

SEQ ID NO: 207020 - DNA, 25 bp, Homo sapien
attcgtgctgctagacacggacgcg

SEQ ID NO: 207021 - DNA, 25 bp, Homo sapien
cgggagaccggctttttgccacata

SEQ ID NO: 207022 - DNA, 25 bp, Homo sapien
caggtccctggcttctgcggggacc

SEQ ID NO: 207023 - DNA, 25 bp, Homo sapien
ggtacccggatgcacttcccgcgtg

SEQ ID NO: 207024 - DNA, 25 bp, Homo sapien
caaacaacatctgcggtggaggtga

SEQ ID NO: 207025 - DNA, 25 bp, Homo sapien
tttttgccacatacatgctggatcc

SEQ ID NO: 207026 - DNA, 25 bp, Homo sapien
aaccgcctgacctgcaaccggggtg

SEQ ID NO: 207027 - DNA, 25 bp, Homo sapien
tgcaggtccagcaaccacggcatca

SEQ ID NO: 207028 - DNA, 25 bp, Homo sapien
cgccgaggacactttctggctagtg

SEQ ID NO: 207029 - DNA, 25 bp, Homo sapien
aacttgagcactgtggggattctcc

SEQ ID NO: 207030 - DNA, 25 bp, Homo sapien
gtcaacaccgcctcgcgcatggagt

SEQ ID NO: 207031 - DNA, 25 bp, Homo sapien
gcctgtttggggacacggtcaacac

SEQ ID NO: 207032 - DNA, 25 bp, Homo sapien
agcatctccacaggtccatgcgtgg

SEQ ID NO: 207033 - DNA, 25 bp, Homo sapien
ttctcttgagaagtgaggcccggcc

SEQ ID NO: 207034 - DNA, 25 bp, Homo sapien
tggtacccaaagaaggtgtcctctg

SEQ ID NO: 207035 - DNA, 25 bp, Homo sapien
gagcccggtgcgacattttccaaga

SEQ ID NO: 207036 - DNA, 25 bp, Homo sapien
cacctggatggcgatgggcatcatc

SEQ ID NO: 207037 - DNA, 25 bp, Homo sapien
tgacgccgttgaggtactggtaccc

SEQ ID NO: 207038 - DNA, 25 bp, Homo sapien
tggcaagtaggcacccacacgggaa

SEQ ID NO: 207039 - DNA, 25 bp, Homo sapien
ggatgccctccatgatgcggtagtc

SEQ ID NO: 207040 - DNA, 25 bp, Homo sapien
ttgccctcgggtccaaagtgcagca

SEQ ID NO: 207041 - DNA, 25 bp, Homo sapien
gcattcgcgcacacagaggctcagc

SEQ ID NO: 207042 - DNA, 25 bp, Homo sapien
ccaggcccgtgctcatgaggtagat

SEQ ID NO: 207043 - DNA, 25 bp, Homo sapien
tgaggtagatgaggccttgcctccc

SEQ ID NO: 207044 - DNA, 25 bp, Homo sapien
atgaggccttgcctcccgatggacg

SEQ ID NO: 207045 - DNA, 25 bp, Homo sapien
agatcttcaggccgtcgtctcggta

SEQ ID NO: 207046 - DNA, 25 bp, Homo sapien
tcccgatggacgtgacctgaggaca

SEQ ID NO: 207047 - DNA, 25 bp, Homo sapien
tcaatggccgcccagatcttcaggc

SEQ ID NO: 207048 - DNA, 25 bp, Homo sapien
gcaggctgtccggaaggcagaaatt

SEQ ID NO: 207049 - DNA, 25 bp, Homo sapien
cgcacctcgcacctctcaatggccg

SEQ ID NO: 207050 - DNA, 25 bp, Homo sapien
gttgttttcgtgcaccaggaactca

SEQ ID NO: 207051 - DNA, 25 bp, Homo sapien
cccattcggagtcagtgggcaggaa

SEQ ID NO: 207052 - DNA, 25 bp, Homo sapien
gccagcagccagtcccattcggagt

SEQ ID NO: 207053 - DNA, 25 bp, Homo sapien
aggaactcagagttgcgcacccacg

SEQ ID NO: 207054 - DNA, 25 bp, Homo sapien
gctgagctgcgtccgaaaggaacga

SEQ ID NO: 207055 - DNA, 25 bp, Homo sapien
cagcaaatgcgtgcacagaaagtgc

SEQ ID NO: 207056 - DNA, 25 bp, Homo sapien
tggcgaaggcctcgcacagcaaatg

SEQ ID NO: 207057 - DNA, 25 bp, Homo sapien
agttgcgcacccacgtcttggccag

SEQ ID NO: 207058 - DNA, 25 bp, Homo sapien
tggtacagtccctgcgtcgcagcct

SEQ ID NO: 207059 - DNA, 25 bp, Homo sapien
agcctctactatggtacagtccctg

SEQ ID NO: 207060 - DNA, 25 bp, Homo sapien
cgcactgttccagcctctactatgg

SEQ ID NO: 207061 - DNA, 25 bp, Homo sapien
tcagagaagcccatagcccgcagcg

SEQ ID NO: 207062 - DNA, 25 bp, Homo sapien
ctagggactggggaggaacctctca

SEQ ID NO: 207063 - DNA, 25 bp, Homo sapien
ccaggtgtccgggatctgggccact

SEQ ID NO: 207064 - DNA, 25 bp, Homo sapien
cgcgtggcattctttccgctccagg

SEQ ID NO: 207065 - DNA, 25 bp, Homo sapien
agcgccggcaaacagggtctgaatg

SEQ ID NO: 207066 - DNA, 25 bp, Homo sapien
cgtgcacgttacgagtctgtgactg

SEQ ID NO: 207067 - DNA, 25 bp, Homo sapien
ggcgtgcacgttacgagtctgtgac

SEQ ID NO: 207068 - DNA, 25 bp, Homo sapien
gcgtgcacgttacgagtccgtgtga

SEQ ID NO: 207069 - DNA, 25 bp, Homo sapien
tggcgtgcacgttacgagtccgtgt

SEQ ID NO: 207070 - DNA, 25 bp, Homo sapien
tggcgtgtacgttacgagtctgtga

SEQ ID NO: 207071 - DNA, 25 bp, Homo sapien
agtggcgtgtacgttacgagtctgt

SEQ ID NO: 207072 - DNA, 25 bp, Homo sapien
tgagtggcgtgtacgttaagagtcc

SEQ ID NO: 207073 - DNA, 25 bp, Homo sapien
tggcgtgcacgttacgagtctgtga

SEQ ID NO: 207074 - DNA, 25 bp, Homo sapien
gtttagtaaaaactgccgagcgcac

SEQ ID NO: 207075 - DNA, 25 bp, Homo sapien
ccgagcgcacagtgccgtgtgcatg

SEQ ID NO: 207076 - DNA, 25 bp, Homo sapien
tgccgtgtgcatgtgacgagtccgt

SEQ ID NO: 207077 - DNA, 25 bp, Homo sapien
gggcaccttacgagccagtgcgagc

SEQ ID NO: 207078 - DNA, 25 bp, Homo sapien
ggcaccttacgagtcagtgtgagtg

SEQ ID NO: 207079 - DNA, 25 bp, Homo sapien
tacgttaagagtccctgtgagtgcc

SEQ ID NO: 207080 - DNA, 25 bp, Homo sapien
gtgtgcacgttacgagtgcatgtga

SEQ ID NO: 207081 - DNA, 25 bp, Homo sapien
cggcaaatttttgcgccacactgtt

SEQ ID NO: 207082 - DNA, 25 bp, Homo sapien
ttcccactctagtacccgtaagcta

SEQ ID NO: 207083 - DNA, 25 bp, Homo sapien
cctccctgttttttcgacccatgtg

SEQ ID NO: 207084 - DNA, 25 bp, Homo sapien
attttcggttgctctccctccctgt

SEQ ID NO: 207085 - DNA, 25 bp, Homo sapien
gttttttcgacccatgtgcgccctc

SEQ ID NO: 207086 - DNA, 25 bp, Homo sapien
tctctcacctggctaacatgctttg

SEQ ID NO: 207087 - DNA, 25 bp, Homo sapien
ggctaacatgctttgcgcccgctac

SEQ ID NO: 207088 - DNA, 25 bp, Homo sapien
cgtaagctacaagacgccgccgttc

SEQ ID NO: 207089 - DNA, 25 bp, Homo sapien
cgctcgctcagccattttcggttgc

SEQ ID NO: 207090 - DNA, 25 bp, Homo sapien
cgaaactgtccaatcctaggggttg

SEQ ID NO: 207091 - DNA, 25 bp, Homo sapien
gtagcccacggcgaactccaatatc

SEQ ID NO: 207092 - DNA, 25 bp, Homo sapien
tggcccaccctgagacgaaactgtc

SEQ ID NO: 207093 - DNA, 25 bp, Homo sapien
ggaaccaatgcccaacgcgtgagga

SEQ ID NO: 207094 - DNA, 25 bp, Homo sapien
tttgaaaccgcaacccagggaatga

SEQ ID NO: 207095 - DNA, 25 bp, Homo sapien
agggttgccaaccaagcttgtgtcc

SEQ ID NO: 207096 - DNA, 25 bp, Homo sapien
ggtgttattaacctcgcctcggagc

SEQ ID NO: 207097 - DNA, 25 bp, Homo sapien
gctttctccagcttcgggttccgga

SEQ ID NO: 207098 - DNA, 25 bp, Homo sapien
ccggcgccgtctgtcggcagccgcc

SEQ ID NO: 207099 - DNA, 25 bp, Homo sapien
gtcaagaagagattcggcttccggg

SEQ ID NO: 207100 - DNA, 25 bp, Homo sapien
cgcgtcagccgcaaagaggcccaga

SEQ ID NO: 207101 - DNA, 25 bp, Homo sapien
ctaggccgcagggtccacaggcggc

SEQ ID NO: 207102 - DNA, 25 bp, Homo sapien
ctgggtcaagaagagattcggcttc

SEQ ID NO: 207103 - DNA, 25 bp, Homo sapien
agagagacaacgtgcgcccgaggct

SEQ ID NO: 207104 - DNA, 25 bp, Homo sapien
aagaggcccagacagatggacgcag

SEQ ID NO: 207105 - DNA, 25 bp, Homo sapien
caaagaggcccagacagatggacgc

SEQ ID NO: 207106 - DNA, 25 bp, Homo sapien
tgggctcgggctgaatttttctcac

SEQ ID NO: 207107 - DNA, 25 bp, Homo sapien
tttttctcacctgcacgcgaggctg

SEQ ID NO: 207108 - DNA, 25 bp, Homo sapien
ccctggccatatggggcggctttat

SEQ ID NO: 207109 - DNA, 25 bp, Homo sapien
ctttatggcccggtggccggatccg

SEQ ID NO: 207110 - DNA, 25 bp, Homo sapien
atccggacgagaggaaggatgactt

SEQ ID NO: 207111 - DNA, 25 bp, Homo sapien
gaaggatgacttggcgctccaccca

SEQ ID NO: 207112 - DNA, 25 bp, Homo sapien
tggcctacaccgttgcctgtccggg

SEQ ID NO: 207113 - DNA, 25 bp, Homo sapien
cacggcaaccattcgggaccacttc

SEQ ID NO: 207114 - DNA, 25 bp, Homo sapien
ttcccggccgctttgatcccgcacg

SEQ ID NO: 207115 - DNA, 25 bp, Homo sapien
agctcgctgacacttccaggttcct

SEQ ID NO: 207116 - DNA, 25 bp, Homo sapien
tgggaagctcgctgacacttccagg

SEQ ID NO: 207117 - DNA, 25 bp, Homo sapien
gtatctcgtcgtctctccgagtctc

SEQ ID NO: 207118 - DNA, 25 bp, Homo sapien
gccacctgcggcgaccacttgtgag

SEQ ID NO: 207119 - DNA, 25 bp, Homo sapien
tctctccgcgtcttggcgtctgcat

SEQ ID NO: 207120 - DNA, 25 bp, Homo sapien
tctcgggtctctggtatctcgtcgt

SEQ ID NO: 207121 - DNA, 25 bp, Homo sapien
gcatctctgattccgcgtctctccg

SEQ ID NO: 207122 - DNA, 25 bp, Homo sapien
ggaacggcccactctcacactggtg

SEQ ID NO: 207123 - DNA, 25 bp, Homo sapien
cagagatgcctacctggtcgcagga

SEQ ID NO: 207124 - DNA, 25 bp, Homo sapien
gcagactcccggtgcaagatttcga

SEQ ID NO: 207125 - DNA, 25 bp, Homo sapien
tctagtccgaagtgggctgacatca

SEQ ID NO: 207126 - DNA, 25 bp, Homo sapien
actactgagcattttctgagcgcca

SEQ ID NO: 207127 - DNA, 25 bp, Homo sapien
tgccatcgtcaaggacccgaggatc

SEQ ID NO: 207128 - DNA, 25 bp, Homo sapien
acggcctattaggatcccagggttg

SEQ ID NO: 207129 - DNA, 25 bp, Homo sapien
ggggtcacgcatcccttacatatcc

SEQ ID NO: 207130 - DNA, 25 bp, Homo sapien
gggattttccttgacgacactctta

SEQ ID NO: 207131 - DNA, 25 bp, Homo sapien
ttaaccacggctgctaaatctgcgc

SEQ ID NO: 207132 - DNA, 25 bp, Homo sapien
cgcggcaacttgtttacccagaagc

SEQ ID NO: 207133 - DNA, 25 bp, Homo sapien
ggtgacgtaaatgccagtcccgctc

SEQ ID NO: 207134 - DNA, 25 bp, Homo sapien
ccgacctgccaagattggtgacgta

SEQ ID NO: 207135 - DNA, 25 bp, Homo sapien
cgacacttctgaggttcttattggc

SEQ ID NO: 207136 - DNA, 25 bp, Homo sapien
attggaagcctgaccggaagccacg

SEQ ID NO: 207137 - DNA, 25 bp, Homo sapien
aggcgcactttgtacagagacccgg

SEQ ID NO: 207138 - DNA, 25 bp, Homo sapien
cgcgtcacccgcatccgggcactgc

SEQ ID NO: 207139 - DNA, 25 bp, Homo sapien
ctgcccgggacggaaagatggcggc

SEQ ID NO: 207140 - DNA, 25 bp, Homo sapien
aacgcaggagagaccccgggcactc

SEQ ID NO: 207141 - DNA, 25 bp, Homo sapien
caggaggacactgggtccgctcctt

SEQ ID NO: 207142 - DNA, 25 bp, Homo sapien
tgcgatccgggtcgacccgaaaaga

SEQ ID NO: 207143 - DNA, 25 bp, Homo sapien
tcacagatgcgatccgggtcgaccc

SEQ ID NO: 207144 - DNA, 25 bp, Homo sapien
cgacctcacagatgcgatccgggtc

SEQ ID NO: 207145 - DNA, 25 bp, Homo sapien
cctcacagatgcgatccgggtcgac

SEQ ID NO: 207146 - DNA, 25 bp, Homo sapien
atgacgaccaccagatgcgccagga

SEQ ID NO: 207147 - DNA, 25 bp, Homo sapien
gccgacaaatctagacgaacgcctc

SEQ ID NO: 207148 - DNA, 25 bp, Homo sapien
tcgcgagcagtacattctccggctg

SEQ ID NO: 207149 - DNA, 25 bp, Homo sapien
gcgcttctaacctaacggctgggta

SEQ ID NO: 207150 - DNA, 25 bp, Homo sapien
ggggacaccaatgcttctgctgttg

SEQ ID NO: 207151 - DNA, 25 bp, Homo sapien
agctacgctgcccagttgtggatca

SEQ ID NO: 207152 - DNA, 25 bp, Homo sapien
ttgtggatcacttgagaccgctgcc

SEQ ID NO: 207153 - DNA, 25 bp, Homo sapien
tacccgggaccagaataaggtgatg

SEQ ID NO: 207154 - DNA, 25 bp, Homo sapien
atcacgcatggaagaagtcggtctc

SEQ ID NO: 207155 - DNA, 25 bp, Homo sapien
gccgagcggattccttccaaatgtg

SEQ ID NO: 207156 - DNA, 25 bp, Homo sapien
acgagttctctttccagtgccgagc

SEQ ID NO: 207157 - DNA, 25 bp, Homo sapien
gtcggtctctgatctacgagttctc

SEQ ID NO: 207158 - DNA, 25 bp, Homo sapien
taccgtaattctgggcggataacgc

SEQ ID NO: 207159 - DNA, 25 bp, Homo sapien
atttttgcgatggatccgggtaccg

SEQ ID NO: 207160 - DNA, 25 bp, Homo sapien
cagcccaaccatcgcgcggggattt

SEQ ID NO: 207161 - DNA, 25 bp, Homo sapien
gagcagttctagacctctcagcaga

SEQ ID NO: 207162 - DNA, 25 bp, Homo sapien
gcgccgctcagacggatcttgagtt

SEQ ID NO: 207163 - DNA, 25 bp, Homo sapien
gccgcaacggaggaattggttcgcc

SEQ ID NO: 207164 - DNA, 25 bp, Homo sapien
gtctggatgcaacccacgctcagcg

SEQ ID NO: 207165 - DNA, 25 bp, Homo sapien
cttgagttgcaggttgttggcgaca

SEQ ID NO: 207166 - DNA, 25 bp, Homo sapien
gactagggcctgatgttccgctaca

SEQ ID NO: 207167 - DNA, 25 bp, Homo sapien
ttccgctacagccagaaggtccgtc

SEQ ID NO: 207168 - DNA, 25 bp, Homo sapien
acgacgccgcagcttgacgtcttcg

SEQ ID NO: 207169 - DNA, 25 bp, Homo sapien
ccgagacgactccatactgcaggtg

SEQ ID NO: 207170 - DNA, 25 bp, Homo sapien
caccggtgggattcgtcagcctcat

SEQ ID NO: 207171 - DNA, 25 bp, Homo sapien
tcatagaggccgcaggggaaaaaca

SEQ ID NO: 207172 - DNA, 25 bp, Homo sapien
ggtgggattcgtcagcctcatagag

SEQ ID NO: 207173 - DNA, 25 bp, Homo sapien
aacaccggtgggattcgtcagcctc

SEQ ID NO: 207174 - DNA, 25 bp, Homo sapien
tgggattcgtcagcctcatagaggc

SEQ ID NO: 207175 - DNA, 25 bp, Homo sapien
ctcatagaggccgcaggggaaaaac

SEQ ID NO: 207176 - DNA, 25 bp, Homo sapien
aaacaccggtgggattcgtcagcct

SEQ ID NO: 207177 - DNA, 25 bp, Homo sapien
accggtgggattcgtcagcctcata

SEQ ID NO: 207178 - DNA, 25 bp, Homo sapien
atcgagccggaagcgctagcccgag

SEQ ID NO: 207179 - DNA, 25 bp, Homo sapien
cgcgccctggccaaggacttttcaa

SEQ ID NO: 207180 - DNA, 25 bp, Homo sapien
aaacaactgaatctgccacgccgcg

SEQ ID NO: 207181 - DNA, 25 bp, Homo sapien
ggccgcccgcaaacaactgaatctg

SEQ ID NO: 207182 - DNA, 25 bp, Homo sapien
aggccagctcacctggggtccaagg

SEQ ID NO: 207183 - DNA, 25 bp, Homo sapien
gccaaggacttttcaaatctcccgc

SEQ ID NO: 207184 - DNA, 25 bp, Homo sapien
aagggagcaggtcagcacactagcc

SEQ ID NO: 207185 - DNA, 25 bp, Homo sapien
ggaccctctgatctacctgatcatc

SEQ ID NO: 207186 - DNA, 25 bp, Homo sapien
gcggcgaccaggctcgcttcccact

SEQ ID NO: 207187 - DNA, 25 bp, Homo sapien
agccgagcatcaggctccgcgccgg

SEQ ID NO: 207188 - DNA, 25 bp, Homo sapien
tagcggcgctcggagtgcggaggac

SEQ ID NO: 207189 - DNA, 25 bp, Homo sapien
ggctcgcctgcgcagccgagcatca

SEQ ID NO: 207190 - DNA, 25 bp, Homo sapien
aggctcgcttcccacttgggctgcg

SEQ ID NO: 207191 - DNA, 25 bp, Homo sapien
gcccatccggctctcctcacccctg

SEQ ID NO: 207192 - DNA, 25 bp, Homo sapien
gggcggcatggtccctctgcgccca

SEQ ID NO: 207193 - DNA, 25 bp, Homo sapien
gctcgcttcccacttgggctgcggg

SEQ ID NO: 207194 - DNA, 25 bp, Homo sapien
gttttcctggatccgcacgggtcca

SEQ ID NO: 207195 - DNA, 25 bp, Homo sapien
ggttgcctactgttcccggatcgca

SEQ ID NO: 207196 - DNA, 25 bp, Homo sapien
gcgctagcggtgaaggtcactcaca

SEQ ID NO: 207197 - DNA, 25 bp, Homo sapien
ccagcatcgttgagggttttcgtga

SEQ ID NO: 207198 - DNA, 25 bp, Homo sapien
ttacctcgatcgctgttttcctgga

SEQ ID NO: 207199 - DNA, 25 bp, Homo sapien
ggcagccattacttttacctcgatc

SEQ ID NO: 207200 - DNA, 25 bp, Homo sapien
gtcactcacaattgcgcgctgggca

SEQ ID NO: 207201 - DNA, 25 bp, Homo sapien
tttcctgaggaaacttccgctccga

SEQ ID NO: 207202 - DNA, 25 bp, Homo sapien
gacgttgccgcgaaccgccttagag

SEQ ID NO: 207203 - DNA, 25 bp, Homo sapien
ccgccttagaggtcgtgccaggctt

SEQ ID NO: 207204 - DNA, 25 bp, Homo sapien
gcttgctgtagtgctgggtccacta

SEQ ID NO: 207205 - DNA, 25 bp, Homo sapien
ctgggtccactatgcatggcggaac

SEQ ID NO: 207206 - DNA, 25 bp, Homo sapien
tccactatgcatggcggaacggtcc

SEQ ID NO: 207207 - DNA, 25 bp, Homo sapien
caggccgagtattttggagcactgg

SEQ ID NO: 207208 - DNA, 25 bp, Homo sapien
ctcctcccaggaaatagcgtcaagg

SEQ ID NO: 207209 - DNA, 25 bp, Homo sapien
ccgccttgcacgactgccttgaaca

SEQ ID NO: 207210 - DNA, 25 bp, Homo sapien
tgacgtcaccggtgagcgggtttcc

SEQ ID NO: 207211 - DNA, 25 bp, Homo sapien
ccagagagacaaggcagaggaaata

SEQ ID NO: 207212 - DNA, 25 bp, Homo sapien
gagacgtaatagcagcactcacgga

SEQ ID NO: 207213 - DNA, 25 bp, Homo sapien
cgccgcgtgaatgagggaataaaca

SEQ ID NO: 207214 - DNA, 25 bp, Homo sapien
ggaataaacattcgcagaaccagta

SEQ ID NO: 207215 - DNA, 25 bp, Homo sapien
cgcagaaccagtaagaggtaggagc

SEQ ID NO: 207216 - DNA, 25 bp, Homo sapien
ggtaggagcggaccgactcacaacc

SEQ ID NO: 207217 - DNA, 25 bp, Homo sapien
tcgcttcctagagactccgcgaggc

SEQ ID NO: 207218 - DNA, 25 bp, Homo sapien
cccgcgtatttgctttagtggaggc

SEQ ID NO: 207219 - DNA, 25 bp, Homo sapien
cggcgcacgcggatgacgtaacaaa

SEQ ID NO: 207220 - DNA, 25 bp, Homo sapien
cgcgagtgcatcttccacgtgagta

SEQ ID NO: 207221 - DNA, 25 bp, Homo sapien
tgagtatagttaccgcgtgcggacc

SEQ ID NO: 207222 - DNA, 25 bp, Homo sapien
tcctccaggtgcagcgtttcgtcat

SEQ ID NO: 207223 - DNA, 25 bp, Homo sapien
tgtgtctacttggtgcccgcgtatt

SEQ ID NO: 207224 - DNA, 25 bp, Homo sapien
gcgtccattcgtcctatcttgcgtg

SEQ ID NO: 207225 - DNA, 25 bp, Homo sapien
cgtttcgtcatctagcccaagcttg

SEQ ID NO: 207226 - DNA, 25 bp, Homo sapien
ccagagcctgatagtggaacttctc

SEQ ID NO: 207227 - DNA, 25 bp, Homo sapien
tcccggacaatcaagaagttttctg

SEQ ID NO: 207228 - DNA, 25 bp, Homo sapien
tcagacccatggagcccacgagaga

SEQ ID NO: 207229 - DNA, 25 bp, Homo sapien
cgtgacccaatgtggacttctttta

SEQ ID NO: 207230 - DNA, 25 bp, Homo sapien
caaatcttaaaggatccgggagcta

SEQ ID NO: 207231 - DNA, 25 bp, Homo sapien
gcgcagggcggagccaaatcttaaa

SEQ ID NO: 207232 - DNA, 25 bp, Homo sapien
gcactcctaagagcgcggcttccgg

SEQ ID NO: 207233 - DNA, 25 bp, Homo sapien
aagttttctgccatcccgtgacgga

SEQ ID NO: 207234 - DNA, 25 bp, Homo sapien
agagacctgggttcccgatcgaaca

SEQ ID NO: 207235 - DNA, 25 bp, Homo sapien
gggtcacataagttcaggtccacgc

SEQ ID NO: 207236 - DNA, 25 bp, Homo sapien
ggagccttcaagagccacaaccgag

SEQ ID NO: 207237 - DNA, 25 bp, Homo sapien
accggagctcgcagtagcttcaacc

SEQ ID NO: 207238 - DNA, 25 bp, Homo sapien
aggactctggccaggaatgagcgtc

SEQ ID NO: 207239 - DNA, 25 bp, Homo sapien
ttggaattaactgtccaggctccgc

SEQ ID NO: 207240 - DNA, 25 bp, Homo sapien
ccggtgatttcctcgagccagcaac

SEQ ID NO: 207241 - DNA, 25 bp, Homo sapien
atccgagaaagaagtcaggactctg

SEQ ID NO: 207242 - DNA, 25 bp, Homo sapien
agcacgtcttctggctggactctgg

SEQ ID NO: 207243 - DNA, 25 bp, Homo sapien
agtttttcaagctggtgcctgcacg

SEQ ID NO: 207244 - DNA, 25 bp, Homo sapien
ccacgcccgatggagtttttcaagc

SEQ ID NO: 207245 - DNA, 25 bp, Homo sapien
gcttgatccgactaggtttggcttc

SEQ ID NO: 207246 - DNA, 25 bp, Homo sapien
gcctgcgttcagctgcttgatccga

SEQ ID NO: 207247 - DNA, 25 bp, Homo sapien
actggctcccgctgttcagaacact

SEQ ID NO: 207248 - DNA, 25 bp, Homo sapien
agagcgctggagctcctcgaagtcc

SEQ ID NO: 207249 - DNA, 25 bp, Homo sapien
aggtcgcaacggcagtcaccaggtc

SEQ ID NO: 207250 - DNA, 25 bp, Homo sapien
agaggcaccgcggacaccgtgcagc

SEQ ID NO: 207251 - DNA, 25 bp, Homo sapien
gcctggatccatgcccgtccacccg

SEQ ID NO: 207252 - DNA, 25 bp, Homo sapien
gagaaagggacacaccagacgcggc

SEQ ID NO: 207253 - DNA, 25 bp, Homo sapien
gggacacaccagacgcggcgtctga

SEQ ID NO: 207254 - DNA, 25 bp, Homo sapien
aagagctgcagactgaggaaggtca

SEQ ID NO: 207255 - DNA, 25 bp, Homo sapien
gagaaaagagctgcagactgaggaa

SEQ ID NO: 207256 - DNA, 25 bp, Homo sapien
cagctcagggctgaacggctgaggc

SEQ ID NO: 207257 - DNA, 25 bp, Homo sapien
cgccggaagccggtcagcgccagcc

SEQ ID NO: 207258 - DNA, 25 bp, Homo sapien
agggcccgccagagattcagttctg

SEQ ID NO: 207259 - DNA, 25 bp, Homo sapien
ctggtccagaccacgcttcgaagga

SEQ ID NO: 207260 - DNA, 25 bp, Homo sapien
gatggctgctgattacacccgcttg

SEQ ID NO: 207261 - DNA, 25 bp, Homo sapien
tcccgcttcggtgatggccgcaaaa

SEQ ID NO: 207262 - DNA, 25 bp, Homo sapien
cgctgcttccggttctgtaagttta

SEQ ID NO: 207263 - DNA, 25 bp, Homo sapien
aggtcctagtgtctcccttccgaga

SEQ ID NO: 207264 - DNA, 25 bp, Homo sapien
ccagcgtgccggtactttaacgagc

SEQ ID NO: 207265 - DNA, 25 bp, Homo sapien
taaatgctcggcctgtttgcgtcca

SEQ ID NO: 207266 - DNA, 25 bp, Homo sapien
agcatctcacgccggcgagcaggtc

SEQ ID NO: 207267 - DNA, 25 bp, Homo sapien
catctcacgccggcgagcaggtccc

SEQ ID NO: 207268 - DNA, 25 bp, Homo sapien
gagcatctcacgccggcgagcaggt

SEQ ID NO: 207269 - DNA, 25 bp, Homo sapien
gcatctcacacgggcgagcaggtcc

SEQ ID NO: 207270 - DNA, 25 bp, Homo sapien
catctcacacgggcgagcaggtccc

SEQ ID NO: 207271 - DNA, 25 bp, Homo sapien
ccctgaccacggcgcatctcacacg

SEQ ID NO: 207272 - DNA, 25 bp, Homo sapien
cgcatctcacacgggcgagcaggtc

SEQ ID NO: 207273 - DNA, 25 bp, Homo sapien
agcaggtcccccctgaccacggcgc

SEQ ID NO: 207274 - DNA, 25 bp, Homo sapien
tccttttcgcagtggactcagatta

SEQ ID NO: 207275 - DNA, 25 bp, Homo sapien
ccgcgccctgaagttcaacttggaa

SEQ ID NO: 207276 - DNA, 25 bp, Homo sapien
ggattgcgccgtctccctgcatcat

SEQ ID NO: 207277 - DNA, 25 bp, Homo sapien
gccgccgcagtgatttattcgcttc

SEQ ID NO: 207278 - DNA, 25 bp, Homo sapien
acccggcggaatcaggtgctgaacc

SEQ ID NO: 207279 - DNA, 25 bp, Homo sapien
cccggaacgagagaacagatttctc

SEQ ID NO: 207280 - DNA, 25 bp, Homo sapien
ccaccggcgagaggcaattttcttc

SEQ ID NO: 207281 - DNA, 25 bp, Homo sapien
acaccactctttccaggggcagatg

SEQ ID NO: 207282 - DNA, 25 bp, Homo sapien
cccgcgatcggcagcagaaggcgcg

SEQ ID NO: 207283 - DNA, 25 bp, Homo sapien
tccagcctctctgtcgagcggaagc

SEQ ID NO: 207284 - DNA, 25 bp, Homo sapien
tgcccctcggagcttggtggcacca

SEQ ID NO: 207285 - DNA, 25 bp, Homo sapien
tgaggtgcggctcacgcctgcttcc

SEQ ID NO: 207286 - DNA, 25 bp, Homo sapien
acggccaccacagcgatgagcgtga

SEQ ID NO: 207287 - DNA, 25 bp, Homo sapien
gcgcgcatggagtcagctccagcct

SEQ ID NO: 207288 - DNA, 25 bp, Homo sapien
acagcgatgagcgtgatgagcagca

SEQ ID NO: 207289 - DNA, 25 bp, Homo sapien
gccaccacagcgatgagcgtgatga

SEQ ID NO: 207290 - DNA, 25 bp, Homo sapien
tcacagaatggcctcggacacccag

SEQ ID NO: 207291 - DNA, 25 bp, Homo sapien
tttgacacattggaggtgagcctgc

SEQ ID NO: 207292 - DNA, 25 bp, Homo sapien
ggggcaactgttccaaccgctctaa

SEQ ID NO: 207293 - DNA, 25 bp, Homo sapien
ccttcatttgcgagggtggcttgga

SEQ ID NO: 207294 - DNA, 25 bp, Homo sapien
agcggggttgcattttgatctctca

SEQ ID NO: 207295 - DNA, 25 bp, Homo sapien
cggcggcgaacatgcgcttttgaca

SEQ ID NO: 207296 - DNA, 25 bp, Homo sapien
gctcggattggcattctcctgactc

SEQ ID NO: 207297 - DNA, 25 bp, Homo sapien
ttcggcaaagtgtcaccaacgggct

SEQ ID NO: 207298 - DNA, 25 bp, Homo sapien
tttacgccgagatgcgttggcacgc

SEQ ID NO: 207299 - DNA, 25 bp, Homo sapien
cctgttacccttgtgagcacgcgtg

SEQ ID NO: 207300 - DNA, 25 bp, Homo sapien
gtggcatcatccagttcccgctgga

SEQ ID NO: 207301 - DNA, 25 bp, Homo sapien
tggcacgcgtcgcttcttcttctgc

SEQ ID NO: 207302 - DNA, 25 bp, Homo sapien
taagctgcttcatccgagcgttggc

SEQ ID NO: 207303 - DNA, 25 bp, Homo sapien
agcgttggccttctccatcttgggg

SEQ ID NO: 207304 - DNA, 25 bp, Homo sapien
ctgcttcctccagctggcgtttaag

SEQ ID NO: 207305 - DNA, 25 bp, Homo sapien
tgaatccagtgtcggcctctctgta

SEQ ID NO: 207306 - DNA, 25 bp, Homo sapien
ctctcttcctgggaggcagacactg

SEQ ID NO: 207307 - DNA, 25 bp, Homo sapien
caatctcatgggctggctcttacgc

SEQ ID NO: 207308 - DNA, 25 bp, Homo sapien
cacccacctggaatgacgctcattg

SEQ ID NO: 207309 - DNA, 25 bp, Homo sapien
tagcaacccgaacgaagctaccttc

SEQ ID NO: 207310 - DNA, 25 bp, Homo sapien
cgcccatctccaagggaagacgtta

SEQ ID NO: 207311 - DNA, 25 bp, Homo sapien
agacccactggttggtttgcgcgcc

SEQ ID NO: 207312 - DNA, 25 bp, Homo sapien
ccgcgggtttcacaaggacttcatt

SEQ ID NO: 207313 - DNA, 25 bp, Homo sapien
cttacgcccgtcataggctccggga

SEQ ID NO: 207314 - DNA, 25 bp, Homo sapien
tgtcaaaacacggtaacggaaatga

SEQ ID NO: 207315 - DNA, 25 bp, Homo sapien
actctggccgggaccttgagctcgc

SEQ ID NO: 207316 - DNA, 25 bp, Homo sapien
aactcatctggctggaggtcggacg

SEQ ID NO: 207317 - DNA, 25 bp, Homo sapien
gcgtgcattaactcatctggctgga

SEQ ID NO: 207318 - DNA, 25 bp, Homo sapien
ccgtcaggctgcgtgcattaactca

SEQ ID NO: 207319 - DNA, 25 bp, Homo sapien
ttaaaatgttgactccgtggtggcc

SEQ ID NO: 207320 - DNA, 25 bp, Homo sapien
gaaatgaccctatttaaaatgttga

SEQ ID NO: 207321 - DNA, 25 bp, Homo sapien
acaccgcccgttccgcttctctctg

SEQ ID NO: 207322 - DNA, 25 bp, Homo sapien
ccccgcacaccaggtggaagagctt

SEQ ID NO: 207323 - DNA, 25 bp, Homo sapien
tgcgctctgagctaggcctcgggcc

SEQ ID NO: 207324 - DNA, 25 bp, Homo sapien
cccagcgccctgctgatgtcccacc

SEQ ID NO: 207325 - DNA, 25 bp, Homo sapien
ccaccgggggttggcactcatggct

SEQ ID NO: 207326 - DNA, 25 bp, Homo sapien
cgcggtcaccaggtcaacggccgcc

SEQ ID NO: 207327 - DNA, 25 bp, Homo sapien
cagcgcacctgcgagccgcacctgc

SEQ ID NO: 207328 - DNA, 25 bp, Homo sapien
ccctgctgatgtcccaccgggggtt

SEQ ID NO: 207329 - DNA, 25 bp, Homo sapien
acctgcccggacgtgcgcaggtgcg

SEQ ID NO: 207330 - DNA, 25 bp, Homo sapien
accagctggctggtgctcttgaaga

SEQ ID NO: 207331 - DNA, 25 bp, Homo sapien
tatagatcctgatgaacttctgccc

SEQ ID NO: 207332 - DNA, 25 bp, Homo sapien
acggctcttaccgaaggttgctgta

SEQ ID NO: 207333 - DNA, 25 bp, Homo sapien
ggaagccttgggatcctcatctcca

SEQ ID NO: 207334 - DNA, 25 bp, Homo sapien
ccacaacacgtagcgtggaagcctt

SEQ ID NO: 207335 - DNA, 25 bp, Homo sapien
tcggagccaaagaccacaacacgta

SEQ ID NO: 207336 - DNA, 25 bp, Homo sapien
caccttccctgaaatccgatcggag

SEQ ID NO: 207337 - DNA, 25 bp, Homo sapien
tgtccatgccatcagagaggcctga

SEQ ID NO: 207338 - DNA, 25 bp, Homo sapien
gcacttccatgactcccaggttctg

SEQ ID NO: 207339 - DNA, 25 bp, Homo sapien
ttctgacggcacaagagccctgatg

SEQ ID NO: 207340 - DNA, 25 bp, Homo sapien
ctgatgcccacgctcacggacagtt

SEQ ID NO: 207341 - DNA, 25 bp, Homo sapien
tgaccctacgacacagggcgtcctg

SEQ ID NO: 207342 - DNA, 25 bp, Homo sapien
cccagcagaggttacccggataacg

SEQ ID NO: 207343 - DNA, 25 bp, Homo sapien
atctggagcgcaggtttgcagaccc

SEQ ID NO: 207344 - DNA, 25 bp, Homo sapien
actccctgcgattcgggtgaccgtc

SEQ ID NO: 207345 - DNA, 25 bp, Homo sapien
agaagcagaccctggccggtccatg

SEQ ID NO: 207346 - DNA, 25 bp, Homo sapien
ccgcaggggacaaagagattgatta

SEQ ID NO: 207347 - DNA, 25 bp, Homo sapien
ccggcgcctgattcagtgcttagta

SEQ ID NO: 207348 - DNA, 25 bp, Homo sapien
ctcgagtgccttcgacgggaaagtc

SEQ ID NO: 207349 - DNA, 25 bp, Homo sapien
tctggccatttccatacagctccgg

SEQ ID NO: 207350 - DNA, 25 bp, Homo sapien
ggggctgtcactcccagaataaatc

SEQ ID NO: 207351 - DNA, 25 bp, Homo sapien
atgccattcgccgagcgctcaaagg

SEQ ID NO: 207352 - DNA, 25 bp, Homo sapien
ctggggctcccaaattgtgaatgga

SEQ ID NO: 207353 - DNA, 25 bp, Homo sapien
acagggtcgacctgcacagactttt

SEQ ID NO: 207354 - DNA, 25 bp, Homo sapien
acgcgcctgctagcagcgagcgaga

SEQ ID NO: 207355 - DNA, 25 bp, Homo sapien
gactttgtcaatgcggccttcggca

SEQ ID NO: 207356 - DNA, 25 bp, Homo sapien
cgctgcatcccggactttgtcaatg

SEQ ID NO: 207357 - DNA, 25 bp, Homo sapien
aaggacgtgcgcgtgtccagcacct

SEQ ID NO: 207358 - DNA, 25 bp, Homo sapien
agcccgatccctgctcggacgagaa

SEQ ID NO: 207359 - DNA, 25 bp, Homo sapien
agctggacgcagcatgatgcgcgca

SEQ ID NO: 207360 - DNA, 25 bp, Homo sapien
cctgcgcccgaaacttggggtgcga

SEQ ID NO: 207361 - DNA, 25 bp, Homo sapien
ctccagaggtaaagtcccgaacgcg

SEQ ID NO: 207362 - DNA, 25 bp, Homo sapien
ctgtgctcagtacccggcgggcgac

SEQ ID NO: 207363 - DNA, 25 bp, Homo sapien
atccctgtgctcagtacccggcggg

SEQ ID NO: 207364 - DNA, 25 bp, Homo sapien
ctctcctctttcatccctgtgctca

SEQ ID NO: 207365 - DNA, 25 bp, Homo sapien
aagagcggcagagacccgtccgcgc

SEQ ID NO: 207366 - DNA, 25 bp, Homo sapien
aggtaagagcggcagagacccgtcc

SEQ ID NO: 207367 - DNA, 25 bp, Homo sapien
ctagcatggaagagcgcgcgggtcc

SEQ ID NO: 207368 - DNA, 25 bp, Homo sapien
ggctcctcggggtgccggagcctct

SEQ ID NO: 207369 - DNA, 25 bp, Homo sapien
gtggctgcgcccagatctccgggcg

SEQ ID NO: 207370 - DNA, 25 bp, Homo sapien
tgacaaagcactagtaacccacgta

SEQ ID NO: 207371 - DNA, 25 bp, Homo sapien
tcatgatcatgcaccggcagcgtcc

SEQ ID NO: 207372 - DNA, 25 bp, Homo sapien
cactcttaggcttgtcatgatcatg

SEQ ID NO: 207373 - DNA, 25 bp, Homo sapien
tatcagcagcacaaccgggaaagcc

SEQ ID NO: 207374 - DNA, 25 bp, Homo sapien
cagtagtggctgaaaaaccgtcaca

SEQ ID NO: 207375 - DNA, 25 bp, Homo sapien
caggaatcatcctcagggccttcga

SEQ ID NO: 207376 - DNA, 25 bp, Homo sapien
ccgcatgaggagagacgatacacgc

SEQ ID NO: 207377 - DNA, 25 bp, Homo sapien
gggccttcgaggtcacaagcgtgac

SEQ ID NO: 207378 - DNA, 25 bp, Homo sapien
gcggcagcagccgtgtactcgccgt

SEQ ID NO: 207379 - DNA, 25 bp, Homo sapien
gctctgacatttcccggggccgcag

SEQ ID NO: 207380 - DNA, 25 bp, Homo sapien
ccagagacaaacgaacggatgggcc

SEQ ID NO: 207381 - DNA, 25 bp, Homo sapien
agagacaaacgaacggatgggccgt

SEQ ID NO: 207382 - DNA, 25 bp, Homo sapien
aacggatgggccgtggcggagtctc

SEQ ID NO: 207383 - DNA, 25 bp, Homo sapien
cttgctggtcttggccggccgtgcg

SEQ ID NO: 207384 - DNA, 25 bp, Homo sapien
ggcagcagccgtgtactcgccgtct

SEQ ID NO: 207385 - DNA, 25 bp, Homo sapien
ggctctgacatttcccggggccgca

SEQ ID NO: 207386 - DNA, 25 bp, Homo sapien
actaccgcgacatgggcaagcccat

SEQ ID NO: 207387 - DNA, 25 bp, Homo sapien
tcaacatggagctctacaagctttc

SEQ ID NO: 207388 - DNA, 25 bp, Homo sapien
ctctacaagctttcggggcgcaaga

SEQ ID NO: 207389 - DNA, 25 bp, Homo sapien
caagagcggaggtgtctgcctcaac

SEQ ID NO: 207390 - DNA, 25 bp, Homo sapien
agcggaggtgtctgcctcaactgtc

SEQ ID NO: 207391 - DNA, 25 bp, Homo sapien
gcaaggagggctactaccgcgacat

SEQ ID NO: 207392 - DNA, 25 bp, Homo sapien
gagacccggggaacatcagtcctcc

SEQ ID NO: 207393 - DNA, 25 bp, Homo sapien
gtgtctgcctcaactgtcgccacaa

SEQ ID NO: 207394 - DNA, 25 bp, Homo sapien
atcatctccgtgtataagcagggca

SEQ ID NO: 207395 - DNA, 25 bp, Homo sapien
tgcgcaagttccagcagcgtgagaa

SEQ ID NO: 207396 - DNA, 25 bp, Homo sapien
tgtgaattctcaagcccgtagtgtg

SEQ ID NO: 207397 - DNA, 25 bp, Homo sapien
ggccctggagaaatgacgagacgta

SEQ ID NO: 207398 - DNA, 25 bp, Homo sapien
cacggggctccttccagagcagaga

SEQ ID NO: 207399 - DNA, 25 bp, Homo sapien
ggccgataaaagcagcctggtgatc

SEQ ID NO: 207400 - DNA, 25 bp, Homo sapien
ccagagcggcatcgtggccgataaa

SEQ ID NO: 207401 - DNA, 25 bp, Homo sapien
catcgcctgcaagtgtcccaaaatc

SEQ ID NO: 207402 - DNA, 25 bp, Homo sapien
ccaccagcggcaatgcgaagtgatt

SEQ ID NO: 207403 - DNA, 25 bp, Homo sapien
cgaagtgattgcctgctctccggaa

SEQ ID NO: 207404 - DNA, 25 bp, Homo sapien
ttagcagctgactacggcggcccgc

SEQ ID NO: 207405 - DNA, 25 bp, Homo sapien
tgctcttagcagctgactacggcgg

SEQ ID NO: 207406 - DNA, 25 bp, Homo sapien
gctcggactcttcctgctcttagca

SEQ ID NO: 207407 - DNA, 25 bp, Homo sapien
gggtccggtgccatcctgcagactc

SEQ ID NO: 207408 - DNA, 25 bp, Homo sapien
gattgcctgctctccggaagcccgg

SEQ ID NO: 207409 - DNA, 25 bp, Homo sapien
cccgcagttcgtcccgtgcgcgacc

SEQ ID NO: 207410 - DNA, 25 bp, Homo sapien
caccaggagccttagagaagctgta

SEQ ID NO: 207411 - DNA, 25 bp, Homo sapien
cagggcttgaagaaccacggcaaca

SEQ ID NO: 207412 - DNA, 25 bp, Homo sapien
cgcgcgctctggactcgcgaataca

SEQ ID NO: 207413 - DNA, 25 bp, Homo sapien
ctttccgcggagttcaaggtaggca

SEQ ID NO: 207414 - DNA, 25 bp, Homo sapien
ccactgcttgaaggctgctcgagga

SEQ ID NO: 207415 - DNA, 25 bp, Homo sapien
taggcgctttcagaatgttcatttc

SEQ ID NO: 207416 - DNA, 25 bp, Homo sapien
tggggaatccgaccacgaagactcc

SEQ ID NO: 207417 - DNA, 25 bp, Homo sapien
gccttgcccttttcttcctgcagta

SEQ ID NO: 207418 - DNA, 25 bp, Homo sapien
cacctctactgggtgcacgccgtag

SEQ ID NO: 207419 - DNA, 25 bp, Homo sapien
ggtttcctgccctgataatttcgga

SEQ ID NO: 207420 - DNA, 25 bp, Homo sapien
cgtctataggatggacctggtttcc

SEQ ID NO: 207421 - DNA, 25 bp, Homo sapien
gcttccttctgcgtcttcgtctata

SEQ ID NO: 207422 - DNA, 25 bp, Homo sapien
agcgggagacactccactctctgcg

SEQ ID NO: 207423 - DNA, 25 bp, Homo sapien
cgccgtaggtcagcttcctgaaaaa

SEQ ID NO: 207424 - DNA, 25 bp, Homo sapien
tggggttggccataaacacctcttg

SEQ ID NO: 207425 - DNA, 25 bp, Homo sapien
ctggtcagagccctgcacatgcaca

SEQ ID NO: 207426 - DNA, 25 bp, Homo sapien
ccacgtcgtagagggagaaggccca

SEQ ID NO: 207427 - DNA, 25 bp, Homo sapien
aggggagactgaccatgacgatctc

SEQ ID NO: 207428 - DNA, 25 bp, Homo sapien
actccttgaagtccagggtgccgtc

SEQ ID NO: 207429 - DNA, 25 bp, Homo sapien
tgcagggcgatgacgtactccttga

SEQ ID NO: 207430 - DNA, 25 bp, Homo sapien
gaaggcccactccagcttctggttg

SEQ ID NO: 207431 - DNA, 25 bp, Homo sapien
ctgatggtcccgttaccgtccacgt

SEQ ID NO: 207432 - DNA, 25 bp, Homo sapien
agctgcggaacacatgctgggcgta

SEQ ID NO: 207433 - DNA, 25 bp, Homo sapien
gacgatctccagcacttcattcttg

SEQ ID NO: 207434 - DNA, 25 bp, Homo sapien
acaggtacgcgagcgcaccgaggac

SEQ ID NO: 207435 - DNA, 25 bp, Homo sapien
agcaactgcacgtagctcgccggga

SEQ ID NO: 207436 - DNA, 25 bp, Homo sapien
tagctcgccgggaaccagccacgga

SEQ ID NO: 207437 - DNA, 25 bp, Homo sapien
tggcgcgcggaaatgcgcagctccc

SEQ ID NO: 207438 - DNA, 25 bp, Homo sapien
ggacctgcagcagcgtgatcagctc

SEQ ID NO: 207439 - DNA, 25 bp, Homo sapien
agcagagactcgttggcttcgcaga

SEQ ID NO: 207440 - DNA, 25 bp, Homo sapien
agctcgcggatcctagctctgggct

SEQ ID NO: 207441 - DNA, 25 bp, Homo sapien
acaagttctcgcttcctcagagcag

SEQ ID NO: 207442 - DNA, 25 bp, Homo sapien
tctatctgcgtggaggtgacgcctc

SEQ ID NO: 207443 - DNA, 25 bp, Homo sapien
tccagctcctcaattcgagcctgtg

SEQ ID NO: 207444 - DNA, 25 bp, Homo sapien
atagtcgctgcgctgtttctctgtc

SEQ ID NO: 207445 - DNA, 25 bp, Homo sapien
agctcccgggcatagtcgctgcgct

SEQ ID NO: 207446 - DNA, 25 bp, Homo sapien
ggccaccatggcttcgtgctgcagt

SEQ ID NO: 207447 - DNA, 25 bp, Homo sapien
gcctgtggagggcagccgttcaccc

SEQ ID NO: 207448 - DNA, 25 bp, Homo sapien
cgctgtttctctgtcttcgcgcggg

SEQ ID NO: 207449 - DNA, 25 bp, Homo sapien
ttgttgagctctatctgcgtggagg

SEQ ID NO: 207450 - DNA, 25 bp, Homo sapien
gacctcatccggctagtttaaaatg

SEQ ID NO: 207451 - DNA, 25 bp, Homo sapien
ttagtctcgctgagcctgttccgga

SEQ ID NO: 207452 - DNA, 25 bp, Homo sapien
aggatgcgggttttacttagtctcg

SEQ ID NO: 207453 - DNA, 25 bp, Homo sapien
atgacaatgacagaggcgcgtgacc

SEQ ID NO: 207454 - DNA, 25 bp, Homo sapien
ctcatctcttcggtagccacgtttg

SEQ ID NO: 207455 - DNA, 25 bp, Homo sapien
agcagagctgcagagtcttccgccc

SEQ ID NO: 207456 - DNA, 25 bp, Homo sapien
aggaaaccgcacttcgaggcggctc

SEQ ID NO: 207457 - DNA, 25 bp, Homo sapien
gtgaccgaacgtgcctgccggacgt

SEQ ID NO: 207458 - DNA, 25 bp, Homo sapien
ccgcgaggcaagaagcgccaaagtt

SEQ ID NO: 207459 - DNA, 25 bp, Homo sapien
ggtactaggaccagcatcgccatga

SEQ ID NO: 207460 - DNA, 25 bp, Homo sapien
gcgatttccggtagcgttccgcttc

SEQ ID NO: 207461 - DNA, 25 bp, Homo sapien
cgcgacgagcaccagaagggttcca

SEQ ID NO: 207462 - DNA, 25 bp, Homo sapien
ctccggaagtcggaaggagtcgctc

SEQ ID NO: 207463 - DNA, 25 bp, Homo sapien
tggcgctgttacatagcccgtagtc

SEQ ID NO: 207464 - DNA, 25 bp, Homo sapien
agcccgtagtcagaggcctttcagc

SEQ ID NO: 207465 - DNA, 25 bp, Homo sapien
ggccgcataactcgtccgggtacta

SEQ ID NO: 207466 - DNA, 25 bp, Homo sapien
ttactaagctccatcgctgcgggac

SEQ ID NO: 207467 - DNA, 25 bp, Homo sapien
gagcctttaccaagctccgtcgctg

SEQ ID NO: 207468 - DNA, 25 bp, Homo sapien
tactaagctccatcgctgcgggacc

SEQ ID NO: 207469 - DNA, 25 bp, Homo sapien
tttactaagctccatcgctgcggga

SEQ ID NO: 207470 - DNA, 25 bp, Homo sapien
agcctttactaagctccgtcgctgc

SEQ ID NO: 207471 - DNA, 25 bp, Homo sapien
ctttactaaggtccatcactgcggg

SEQ ID NO: 207472 - DNA, 25 bp, Homo sapien
ggacctctcggagcctttactaagc

SEQ ID NO: 207473 - DNA, 25 bp, Homo sapien
ctttactaagctccatcgctgcggg

SEQ ID NO: 207474 - DNA, 25 bp, Homo sapien
tagagacccagcagcgagatgccgc

SEQ ID NO: 207475 - DNA, 25 bp, Homo sapien
aggctgcagccgaagtagagaccca

SEQ ID NO: 207476 - DNA, 25 bp, Homo sapien
acacgaagacgatctccaggcgccg

SEQ ID NO: 207477 - DNA, 25 bp, Homo sapien
gcactcgaaccaaagaggggtcctg

SEQ ID NO: 207478 - DNA, 25 bp, Homo sapien
tgcttctccttgtagggcagcgcca

SEQ ID NO: 207479 - DNA, 25 bp, Homo sapien
gctggtcctggtccgaggacacgaa

SEQ ID NO: 207480 - DNA, 25 bp, Homo sapien
agccacggcatgtcccgcacgaagt

SEQ ID NO: 207481 - DNA, 25 bp, Homo sapien
ctggtccgaggacacgaagacgatc

SEQ ID NO: 207482 - DNA, 25 bp, Homo sapien
gaacacatccgcgtctcttagacgg

SEQ ID NO: 207483 - DNA, 25 bp, Homo sapien
aagcagaaagcccaagtcccgtcct

SEQ ID NO: 207484 - DNA, 25 bp, Homo sapien
tgggactcgcttccatgaacacatc

SEQ ID NO: 207485 - DNA, 25 bp, Homo sapien
cgctagtcagttacacggcccgcta

SEQ ID NO: 207486 - DNA, 25 bp, Homo sapien
aagaaggcggccatgagtccgttgc

SEQ ID NO: 207487 - DNA, 25 bp, Homo sapien
tggtggacggaagtcgaatttgaac

SEQ ID NO: 207488 - DNA, 25 bp, Homo sapien
agccagggccgcttcttctgaggtc

SEQ ID NO: 207489 - DNA, 25 bp, Homo sapien
ctgggaagttccacgcgcggaacca

SEQ ID NO: 207490 - DNA, 25 bp, Homo sapien
gccgcgagctgaacggcaccgcccg

SEQ ID NO: 207491 - DNA, 25 bp, Homo sapien
ctctgcagtcgcagccgggcatggt

SEQ ID NO: 207492 - DNA, 25 bp, Homo sapien
catggtgagtgagtgaggtccagcc

SEQ ID NO: 207493 - DNA, 25 bp, Homo sapien
cccgtcttgggagcgggctctacgc

SEQ ID NO: 207494 - DNA, 25 bp, Homo sapien
cgagtctctctcctcgagggctgcg

SEQ ID NO: 207495 - DNA, 25 bp, Homo sapien
agccgcgcttcgggtcctgcctgag

SEQ ID NO: 207496 - DNA, 25 bp, Homo sapien
cccgccatggcgctgcggcgcctcc

SEQ ID NO: 207497 - DNA, 25 bp, Homo sapien
tgctgcccagcgtccacggagcccg

SEQ ID NO: 207498 - DNA, 25 bp, Homo sapien
cgacaaggaggctgacgagtattac

SEQ ID NO: 207499 - DNA, 25 bp, Homo sapien
agtcgctgtccagggccatctcgca

SEQ ID NO: 207500 - DNA, 25 bp, Homo sapien
tgagttcagcatgccctacgaccgc

SEQ ID NO: 207501 - DNA, 25 bp, Homo sapien
gggcctgccagatgagttcagcatg

SEQ ID NO: 207502 - DNA, 25 bp, Homo sapien
ccatgtcccaggacagggtcctgtc

SEQ ID NO: 207503 - DNA, 25 bp, Homo sapien
tccagatgtcccaacagaagccgtt

SEQ ID NO: 207504 - DNA, 25 bp, Homo sapien
ccatctcgcacacggacgtctttgt

SEQ ID NO: 207505 - DNA, 25 bp, Homo sapien
tattacatgagacggcggcacctgc

SEQ ID NO: 207506 - DNA, 25 bp, Homo sapien
gagtctcggctggtgtcctagcaac

SEQ ID NO: 207507 - DNA, 25 bp, Homo sapien
ctcctaccttattagcctggaaggg

SEQ ID NO: 207508 - DNA, 25 bp, Homo sapien
ccgtcgctagggaaaccgatgcagc

SEQ ID NO: 207509 - DNA, 25 bp, Homo sapien
accgacgactgcgactcctggggac

SEQ ID NO: 207510 - DNA, 25 bp, Homo sapien
ctcctggggacctacgtggccatga

SEQ ID NO: 207511 - DNA, 25 bp, Homo sapien
ctggctggcgctaaggcgctttttt

SEQ ID NO: 207512 - DNA, 25 bp, Homo sapien
ctggagcacctagccgcgctgttct

SEQ ID NO: 207513 - DNA, 25 bp, Homo sapien
gtgtcctagcaacagcgacgcgacc

SEQ ID NO: 207514 - DNA, 25 bp, Homo sapien
agcgaggttcccgagccaacgccat

SEQ ID NO: 207515 - DNA, 25 bp, Homo sapien
ggcggagctgataccgaagctccta

SEQ ID NO: 207516 - DNA, 25 bp, Homo sapien
agcccgttttcggtcccagtgcaga

SEQ ID NO: 207517 - DNA, 25 bp, Homo sapien
gcgcgctcccagacgcatgggcaag

SEQ ID NO: 207518 - DNA, 25 bp, Homo sapien
acgcagatagcgcaaggcctgaccc

SEQ ID NO: 207519 - DNA, 25 bp, Homo sapien
gaagctcctattggccgtcggggac

SEQ ID NO: 207520 - DNA, 25 bp, Homo sapien
ctctctctggcgttgcagcccagga

SEQ ID NO: 207521 - DNA, 25 bp, Homo sapien
ctccaccgacatggcagcgaggttc

SEQ ID NO: 207522 - DNA, 25 bp, Homo sapien
ggcacagctggagccggaccaccga

SEQ ID NO: 207523 - DNA, 25 bp, Homo sapien
tccctgacgccgctcaggtaggcgg

SEQ ID NO: 207524 - DNA, 25 bp, Homo sapien
ccgtcagcagcatgcagggtaagga

SEQ ID NO: 207525 - DNA, 25 bp, Homo sapien
agaggccgagcttgctgcattgcag

SEQ ID NO: 207526 - DNA, 25 bp, Homo sapien
tgcagctcagcatctggcccgggct

SEQ ID NO: 207527 - DNA, 25 bp, Homo sapien
tgcttcacaggtcgcgcacccagag

SEQ ID NO: 207528 - DNA, 25 bp, Homo sapien
agccctggtccaagacagctgtctg

SEQ ID NO: 207529 - DNA, 25 bp, Homo sapien
ggaccaccgagctgacctcgggcta

SEQ ID NO: 207530 - DNA, 25 bp, Homo sapien
tttcctccgggcatccgctctttag

SEQ ID NO: 207531 - DNA, 25 bp, Homo sapien
tcccgccggctaagagttaattagc

SEQ ID NO: 207532 - DNA, 25 bp, Homo sapien
aggggtccagcttatttccaaattg

SEQ ID NO: 207533 - DNA, 25 bp, Homo sapien
gcaatcgccggcagcctatgacatc

SEQ ID NO: 207534 - DNA, 25 bp, Homo sapien
tcataaaggcgtggtggcgattctc

SEQ ID NO: 207535 - DNA, 25 bp, Homo sapien
atcagatggcaaagttgggaccttc

SEQ ID NO: 207536 - DNA, 25 bp, Homo sapien
cgcctgtcagtagtaaagggtatca

SEQ ID NO: 207537 - DNA, 25 bp, Homo sapien
ggtccgtcggaagcttttcttctca

SEQ ID NO: 207538 - DNA, 25 bp, Homo sapien
ggccacggacctgtatttccaggca

SEQ ID NO: 207539 - DNA, 25 bp, Homo sapien
gtctcccaggccacggacctgtatt

SEQ ID NO: 207540 - DNA, 25 bp, Homo sapien
gtatttcccggcaacctctgcgtgg

SEQ ID NO: 207541 - DNA, 25 bp, Homo sapien
ccgggccacggacctgtatttccag

SEQ ID NO: 207542 - DNA, 25 bp, Homo sapien
ggccacggacctgtatttccctgca

SEQ ID NO: 207543 - DNA, 25 bp, Homo sapien
ggccacggacctgtatttcccggca

SEQ ID NO: 207544 - DNA, 25 bp, Homo sapien
gggccacggacctgtatttccctgc

SEQ ID NO: 207545 - DNA, 25 bp, Homo sapien
tgtatttcccggcaacctctgcgtg

SEQ ID NO: 207546 - DNA, 25 bp, Homo sapien
cgcagtcggtctccggagatctctt

SEQ ID NO: 207547 - DNA, 25 bp, Homo sapien
ttgctctgattgtgctggaggcagc

SEQ ID NO: 207548 - DNA, 25 bp, Homo sapien
ctctggccgcctgtcttcctggaaa

SEQ ID NO: 207549 - DNA, 25 bp, Homo sapien
agcgcaaagtgtgacgcatccttta

SEQ ID NO: 207550 - DNA, 25 bp, Homo sapien
gctccggttgccaagcgcaaagtgt

SEQ ID NO: 207551 - DNA, 25 bp, Homo sapien
aagcagttcaatcgcatgcgccagc

SEQ ID NO: 207552 - DNA, 25 bp, Homo sapien
cggggccacgatgaagaagcagttc

SEQ ID NO: 207553 - DNA, 25 bp, Homo sapien
agccatgtaaccctgcggcgggctc

SEQ ID NO: 207554 - DNA, 25 bp, Homo sapien
attcatatttggcttctgcgtcgcg

SEQ ID NO: 207555 - DNA, 25 bp, Homo sapien
gaggcctcttggatttcgtcgtttc

SEQ ID NO: 207556 - DNA, 25 bp, Homo sapien
caaactgggtggctcgaagaggctc

SEQ ID NO: 207557 - DNA, 25 bp, Homo sapien
tgtgagggtcatggacacaaactgg

SEQ ID NO: 207558 - DNA, 25 bp, Homo sapien
tctttgtgtccctcgccagcatggg

SEQ ID NO: 207559 - DNA, 25 bp, Homo sapien
tcccaacgcggacctgcttgaatgt

SEQ ID NO: 207560 - DNA, 25 bp, Homo sapien
gggtgctaaagctgcgctgctcttc

SEQ ID NO: 207561 - DNA, 25 bp, Homo sapien
tcctgtcatctgttacgcgtgggta

SEQ ID NO: 207562 - DNA, 25 bp, Homo sapien
gtcaattgacagtggccatagagta

SEQ ID NO: 207563 - DNA, 25 bp, Homo sapien
gcgaggctgctcatccaatagaaag

SEQ ID NO: 207564 - DNA, 25 bp, Homo sapien
ccaaaactgagaaagccgccggtca

SEQ ID NO: 207565 - DNA, 25 bp, Homo sapien
accacctgcaggtacacggtgtttg

SEQ ID NO: 207566 - DNA, 25 bp, Homo sapien
gctcgttgactgaccggttgaactc

SEQ ID NO: 207567 - DNA, 25 bp, Homo sapien
cggaagctgtttttctcctggggcg

SEQ ID NO: 207568 - DNA, 25 bp, Homo sapien
ctgttccggtttgccggccgcaatt

SEQ ID NO: 207569 - DNA, 25 bp, Homo sapien
taccgctcgggacttgtcaattgac

SEQ ID NO: 207570 - DNA, 25 bp, Homo sapien
cgcgcaacgcttcctgggaaatgta

SEQ ID NO: 207571 - DNA, 25 bp, Homo sapien
gggatcccaagtccagccaagagtg

SEQ ID NO: 207572 - DNA, 25 bp, Homo sapien
ggatttaacgcctcaccgcccgatg

SEQ ID NO: 207573 - DNA, 25 bp, Homo sapien
gggcgctttctggtgaatctgaatc

SEQ ID NO: 207574 - DNA, 25 bp, Homo sapien
atctgccgttgcatcacagtggcta

SEQ ID NO: 207575 - DNA, 25 bp, Homo sapien
cgcaacgtgacgcttgtcgaatctg

SEQ ID NO: 207576 - DNA, 25 bp, Homo sapien
ggggaaagctgtccaagcccaattc

SEQ ID NO: 207577 - DNA, 25 bp, Homo sapien
ctcctgcagtacctggtgggtgaca

SEQ ID NO: 207578 - DNA, 25 bp, Homo sapien
gctcgccgctcacgaagagcatctg

SEQ ID NO: 207579 - DNA, 25 bp, Homo sapien
acagcgtctgcgtgtagtccgagat

SEQ ID NO: 207580 - DNA, 25 bp, Homo sapien
tgaacgtcaagctctcgaaggtggg

SEQ ID NO: 207581 - DNA, 25 bp, Homo sapien
tgaggcccgctgtcctgtttttgaa

SEQ ID NO: 207582 - DNA, 25 bp, Homo sapien
atggcgctccacgacgtgtcgatga

SEQ ID NO: 207583 - DNA, 25 bp, Homo sapien
tagatgccgatctggatggcgctcc

SEQ ID NO: 207584 - DNA, 25 bp, Homo sapien
gcctcccgcgtgacgaagtaactgg

SEQ ID NO: 207585 - DNA, 25 bp, Homo sapien
gtgtccttggacatggccgagatgc

SEQ ID NO: 207586 - DNA, 25 bp, Homo sapien
cgggttgctccaaactgctcttgga

SEQ ID NO: 207587 - DNA, 25 bp, Homo sapien
ctcggccaggcagtagaagacgtaa

SEQ ID NO: 207588 - DNA, 25 bp, Homo sapien
gcgggtccgtgcttaagaaaccatc

SEQ ID NO: 207589 - DNA, 25 bp, Homo sapien
tagactcgcccaagtcctgagcttg

SEQ ID NO: 207590 - DNA, 25 bp, Homo sapien
gcgatcctgcatcactggctcggtc

SEQ ID NO: 207591 - DNA, 25 bp, Homo sapien
tggcgagcgacagtgacttccagcc

SEQ ID NO: 207592 - DNA, 25 bp, Homo sapien
ttctctcagccaaggagcgaggtcc

SEQ ID NO: 207593 - DNA, 25 bp, Homo sapien
tccgcccgagttcaggttctctcag

SEQ ID NO: 207594 - DNA, 25 bp, Homo sapien
ctttttcttcaggacagcggaggca

SEQ ID NO: 207595 - DNA, 25 bp, Homo sapien
ctcacgcctcctgacaggtactgta

SEQ ID NO: 207596 - DNA, 25 bp, Homo sapien
acaggtactgtacccgccttgggca

SEQ ID NO: 207597 - DNA, 25 bp, Homo sapien
cagactcgtaaattatggccgcatc

SEQ ID NO: 207598 - DNA, 25 bp, Homo sapien
gttcccggaagtccttcaggcctca

SEQ ID NO: 207599 - DNA, 25 bp, Homo sapien
tctcttattaccacgtgcgaggccg

SEQ ID NO: 207600 - DNA, 25 bp, Homo sapien
ctggctgcaaccttggggagccctt

SEQ ID NO: 207601 - DNA, 25 bp, Homo sapien
cacaccgtgctttgcggttcccgga

SEQ ID NO: 207602 - DNA, 25 bp, Homo sapien
gcttccgcttctacgtggacgcaga

SEQ ID NO: 207603 - DNA, 25 bp, Homo sapien
tgctgctcatgctcacctgcaagcg

SEQ ID NO: 207604 - DNA, 25 bp, Homo sapien
aggagctcgcggagactgttcttct

SEQ ID NO: 207605 - DNA, 25 bp, Homo sapien
tcaatgcgtacatctcctacctcgg

SEQ ID NO: 207606 - DNA, 25 bp, Homo sapien
gctggacatcaccacatggaccttc

SEQ ID NO: 207607 - DNA, 25 bp, Homo sapien
gctactgcatgatgtcggtcaccca

SEQ ID NO: 207608 - DNA, 25 bp, Homo sapien
gtgaagactactcccggggcggcta

SEQ ID NO: 207609 - DNA, 25 bp, Homo sapien
agactgttcttctgcagcctgtggc

SEQ ID NO: 207610 - DNA, 25 bp, Homo sapien
aggagctcggacgaccgcagcctca

SEQ ID NO: 207611 - DNA, 25 bp, Homo sapien
ctctgctccgctcccggctgtcccg

SEQ ID NO: 207612 - DNA, 25 bp, Homo sapien
gtccgctggggagacaactggccgc

SEQ ID NO: 207613 - DNA, 25 bp, Homo sapien
tccaggccgagataaagttcccttc

SEQ ID NO: 207614 - DNA, 25 bp, Homo sapien
cagcgggagtccaggccgagataaa

SEQ ID NO: 207615 - DNA, 25 bp, Homo sapien
ccttctacgggaagaggggatcgcg

SEQ ID NO: 207616 - DNA, 25 bp, Homo sapien
ccaacaaaggtacagcgggagtcca

SEQ ID NO: 207617 - DNA, 25 bp, Homo sapien
ggagcgagctcgcagctgctaaccc

SEQ ID NO: 207618 - DNA, 25 bp, Homo sapien
gctgcagtcagagcaatttccgacg

SEQ ID NO: 207619 - DNA, 25 bp, Homo sapien
ggagctcagctctgcgctgcagtca

SEQ ID NO: 207620 - DNA, 25 bp, Homo sapien
tccggcccgagacttagctgtggga

SEQ ID NO: 207621 - DNA, 25 bp, Homo sapien
cctgtggttctcaatagttggaatt

SEQ ID NO: 207622 - DNA, 25 bp, Homo sapien
caaagcgtcagttcgccgcccaggt

SEQ ID NO: 207623 - DNA, 25 bp, Homo sapien
ggcaaaagggccaaagcgtcagttc

SEQ ID NO: 207624 - DNA, 25 bp, Homo sapien
acggcacagcctacgactctctaga

SEQ ID NO: 207625 - DNA, 25 bp, Homo sapien
ccgcgcgtgggaatttcacggcaca

SEQ ID NO: 207626 - DNA, 25 bp, Homo sapien
gccagcccgtgtggacgctggaaca

SEQ ID NO: 207627 - DNA, 25 bp, Homo sapien
gacgctggaacaccgtgtgcagagg

SEQ ID NO: 207628 - DNA, 25 bp, Homo sapien
gggcttcctggtccgcctccgtgct

SEQ ID NO: 207629 - DNA, 25 bp, Homo sapien
agttgagatgagatcacggaagccc

SEQ ID NO: 207630 - DNA, 25 bp, Homo sapien
tctgtgtggagttgagatgagatca

SEQ ID NO: 207631 - DNA, 25 bp, Homo sapien
caaagtctgtgtggagttgagatga

SEQ ID NO: 207632 - DNA, 25 bp, Homo sapien
cgggactcaacaaagtctgtgtgga

SEQ ID NO: 207633 - DNA, 25 bp, Homo sapien
cccgggactcaacaaagtctgtgtg

SEQ ID NO: 207634 - DNA, 25 bp, Homo sapien
cctgtatttcggctgtggctgtttc

SEQ ID NO: 207635 - DNA, 25 bp, Homo sapien
gtggctgtttcgctccctctggtct

SEQ ID NO: 207636 - DNA, 25 bp, Homo sapien
ccagcctctggagtgtgcttccctg

SEQ ID NO: 207637 - DNA, 25 bp, Homo sapien
gttaatcattacttcgccagcgaca

SEQ ID NO: 207638 - DNA, 25 bp, Homo sapien
tgccggctcgcaactctgggaaact

SEQ ID NO: 207639 - DNA, 25 bp, Homo sapien
cggatggatccgagacggtagattt

SEQ ID NO: 207640 - DNA, 25 bp, Homo sapien
ggccggctgctaagagagttaatca

SEQ ID NO: 207641 - DNA, 25 bp, Homo sapien
ctgggaaactcagcgcgggtcctcc

SEQ ID NO: 207642 - DNA, 25 bp, Homo sapien
gccgtcgccgacagtgaagtaagta

SEQ ID NO: 207643 - DNA, 25 bp, Homo sapien
ccgctgctcaggcacattttcaaac

SEQ ID NO: 207644 - DNA, 25 bp, Homo sapien
caaaccaggggtgctaacgtcaatc

SEQ ID NO: 207645 - DNA, 25 bp, Homo sapien
ctggctttctgcgtttgcttccgac

SEQ ID NO: 207646 - DNA, 25 bp, Homo sapien
ctagcggttgctgtttcttggaaga

SEQ ID NO: 207647 - DNA, 25 bp, Homo sapien
ctgggttgcaggcatcgaaaacttc

SEQ ID NO: 207648 - DNA, 25 bp, Homo sapien
tgctggcagctgtgctatctgaatc

SEQ ID NO: 207649 - DNA, 25 bp, Homo sapien
ggggacacttgggaacatttactca

SEQ ID NO: 207650 - DNA, 25 bp, Homo sapien
gcagcttctgcttcccagatgggga

SEQ ID NO: 207651 - DNA, 25 bp, Homo sapien
ggcagggttacagcttcggaccacc

SEQ ID NO: 207652 - DNA, 25 bp, Homo sapien
actacggcagattgcgcagcgcatc

SEQ ID NO: 207653 - DNA, 25 bp, Homo sapien
ggtctccgccctcaaggaacttcta

SEQ ID NO: 207654 - DNA, 25 bp, Homo sapien
cgaggccgcagagtctgttaacttt

SEQ ID NO: 207655 - DNA, 25 bp, Homo sapien
gcaaagaatattcggggcccattga

SEQ ID NO: 207656 - DNA, 25 bp, Homo sapien
cggcttccggaaattctgttctcga

SEQ ID NO: 207657 - DNA, 25 bp, Homo sapien
agcgagccaccctctaaccatgggg

SEQ ID NO: 207658 - DNA, 25 bp, Homo sapien
gcctcacctgttgggctgagcctgg

SEQ ID NO: 207659 - DNA, 25 bp, Homo sapien
gccacgtgtccgctcctttcgggag

SEQ ID NO: 207660 - DNA, 25 bp, Homo sapien
cgtccggcctcacctgttgggctga

SEQ ID NO: 207661 - DNA, 25 bp, Homo sapien
gtagtcctccgtggccacgtgacca

SEQ ID NO: 207662 - DNA, 25 bp, Homo sapien
ctggccgggtagtcctccgtggcca

SEQ ID NO: 207663 - DNA, 25 bp, Homo sapien
tcgggcatcaatcgacgcggccctg

SEQ ID NO: 207664 - DNA, 25 bp, Homo sapien
gttggcttggacatcccgttctgga

SEQ ID NO: 207665 - DNA, 25 bp, Homo sapien
tgtccgctcctttcgggagctaggg

SEQ ID NO: 207666 - DNA, 25 bp, Homo sapien
agggccatctcggactacacgcaga

SEQ ID NO: 207667 - DNA, 25 bp, Homo sapien
cccaccttcgagagcttgacgttca

SEQ ID NO: 207668 - DNA, 25 bp, Homo sapien
ttcaaaaacaggacagcgggcctca

SEQ ID NO: 207669 - DNA, 25 bp, Homo sapien
ggagcgccatccagatcggcatcta

SEQ ID NO: 207670 - DNA, 25 bp, Homo sapien
tctacgccaagcacctggagcactg

SEQ ID NO: 207671 - DNA, 25 bp, Homo sapien
catccgccagatgctcttcgtgagc

SEQ ID NO: 207672 - DNA, 25 bp, Homo sapien
cgcatctcggccatgtccaaggaca

SEQ ID NO: 207673 - DNA, 25 bp, Homo sapien
cagttacttcgtcacgcgggaggcc

SEQ ID NO: 207674 - DNA, 25 bp, Homo sapien
tgccagggtacctgcgccatgacgt

SEQ ID NO: 207675 - DNA, 25 bp, Homo sapien
gccagggtacctgcgccatgacgtc

SEQ ID NO: 207676 - DNA, 25 bp, Homo sapien
atgacgtcatgggaccgtcaccctc

SEQ ID NO: 207677 - DNA, 25 bp, Homo sapien
ggtgccagggtacctgcgccatgac

SEQ ID NO: 207678 - DNA, 25 bp, Homo sapien
cagggtacctgcgccatgacgtcat

SEQ ID NO: 207679 - DNA, 25 bp, Homo sapien
ccatgacgtcatgggaccgtcaccc

SEQ ID NO: 207680 - DNA, 25 bp, Homo sapien
gtgccagggtacctgcgccatgacg

SEQ ID NO: 207681 - DNA, 25 bp, Homo sapien
gggtacctgcgccatgacgtcatgg

SEQ ID NO: 207682 - DNA, 25 bp, Homo sapien
taggtgcccagatttccgtctgaga

SEQ ID NO: 207683 - DNA, 25 bp, Homo sapien
ctccgcattccgtttgtctccaagt

SEQ ID NO: 207684 - DNA, 25 bp, Homo sapien
gcccgcctgcaacggaacatctttt

SEQ ID NO: 207685 - DNA, 25 bp, Homo sapien
gcattctggcggcaagttctgctca

SEQ ID NO: 207686 - DNA, 25 bp, Homo sapien
actcagcaacaggaggagcattctg

SEQ ID NO: 207687 - DNA, 25 bp, Homo sapien
gcgacgtggaggacgatgatactca

SEQ ID NO: 207688 - DNA, 25 bp, Homo sapien
gccaggcactcacgctgacgatcgt

SEQ ID NO: 207689 - DNA, 25 bp, Homo sapien
tctgccagcgtagaggaacggtcct

SEQ ID NO: 207690 - DNA, 25 bp, Homo sapien
acaacgccctgtttgcgtcgctgca

SEQ ID NO: 207691 - DNA, 25 bp, Homo sapien
tggaagaagtccctctcctctcggg

SEQ ID NO: 207692 - DNA, 25 bp, Homo sapien
ccaaatgtagctcagcggatgccca

SEQ ID NO: 207693 - DNA, 25 bp, Homo sapien
ttgaccgagaaactggctcctcagc

SEQ ID NO: 207694 - DNA, 25 bp, Homo sapien
gcggcgacttttactcgaaaccaga

SEQ ID NO: 207695 - DNA, 25 bp, Homo sapien
tgcgcctcaagaaaaagtcggtccc

SEQ ID NO: 207696 - DNA, 25 bp, Homo sapien
ggagacagtcacttggccttaaatg

SEQ ID NO: 207697 - DNA, 25 bp, Homo sapien
ttactgtctgcacctacgaagcatg

SEQ ID NO: 207698 - DNA, 25 bp, Homo sapien
caggctagagtcagcgagaccactc

SEQ ID NO: 207699 - DNA, 25 bp, Homo sapien
cgctcacgcttagtaaccgaggctc

SEQ ID NO: 207700 - DNA, 25 bp, Homo sapien
tcccgcgatcctgaggcgagaagtt

SEQ ID NO: 207701 - DNA, 25 bp, Homo sapien
atcctttggggtagtcctagaggca

SEQ ID NO: 207702 - DNA, 25 bp, Homo sapien
gagaccactcacctgtcggcggatg

SEQ ID NO: 207703 - DNA, 25 bp, Homo sapien
tctgtgacgatagcagcgcctgagg

SEQ ID NO: 207704 - DNA, 25 bp, Homo sapien
cccgcctttcctatctgtgacgata

SEQ ID NO: 207705 - DNA, 25 bp, Homo sapien
cggttactatggacgcgctcacgct

SEQ ID NO: 207706 - DNA, 25 bp, Homo sapien
ctctggcggtgtcgccgattcctac

SEQ ID NO: 207707 - DNA, 25 bp, Homo sapien
gtgtcaggaagctaagaggcccgca

SEQ ID NO: 207708 - DNA, 25 bp, Homo sapien
ccacagccgcaagaagtacttgctc

SEQ ID NO: 207709 - DNA, 25 bp, Homo sapien
agaagtacttgctctgcgccgcacg

SEQ ID NO: 207710 - DNA, 25 bp, Homo sapien
tcctcctcgagttcgagtagcgggc

SEQ ID NO: 207711 - DNA, 25 bp, Homo sapien
gtcccacggaacctgcagagccagt

SEQ ID NO: 207712 - DNA, 25 bp, Homo sapien
acgtcagcgcagcagcgtacgggtc

SEQ ID NO: 207713 - DNA, 25 bp, Homo sapien
ctcgcgctggttaacaatgggcgtc

SEQ ID NO: 207714 - DNA, 25 bp, Homo sapien
ccgattctcccagccgcaccacggg

SEQ ID NO: 207715 - DNA, 25 bp, Homo sapien
gccgcaccacgggtgctcccacctg

SEQ ID NO: 207716 - DNA, 25 bp, Homo sapien
tcccagccgcaccacgggtgctccc

SEQ ID NO: 207717 - DNA, 25 bp, Homo sapien
tcgatcgtccgattctcccagccgc

SEQ ID NO: 207718 - DNA, 25 bp, Homo sapien
gatcgtccgattctcccagccgcac

SEQ ID NO: 207719 - DNA, 25 bp, Homo sapien
tcgtccgattctcccagccgcacca

SEQ ID NO: 207720 - DNA, 25 bp, Homo sapien
ttctcccagccgcaccacgggtgct

SEQ ID NO: 207721 - DNA, 25 bp, Homo sapien
gtccgattctcccagccgcaccacg

SEQ ID NO: 207722 - DNA, 25 bp, Homo sapien
gatgctgcctcatactctcgcgaga

SEQ ID NO: 207723 - DNA, 25 bp, Homo sapien
tcgagggcagaccatgagccctgtc

SEQ ID NO: 207724 - DNA, 25 bp, Homo sapien
tgaggattagacacaggagatgctg

SEQ ID NO: 207725 - DNA, 25 bp, Homo sapien
cgagacggacggagctcttcgatcg

SEQ ID NO: 207726 - DNA, 25 bp, Homo sapien
agaaccggagtctggcgatgccaag

SEQ ID NO: 207727 - DNA, 25 bp, Homo sapien
tccgagctggccaaagaagttcgtc

SEQ ID NO: 207728 - DNA, 25 bp, Homo sapien
tcccacctgcggagaaccggagtct

SEQ ID NO: 207729 - DNA, 25 bp, Homo sapien
tgcgcgtttgttaaaggggcctcga

SEQ ID NO: 207730 - DNA, 25 bp, Homo sapien
tacacccagacagagcaggcgcggc

SEQ ID NO: 207731 - DNA, 25 bp, Homo sapien
tggactaggtctacaccggcacttc

SEQ ID NO: 207732 - DNA, 25 bp, Homo sapien
gcccagaaacgcatttgagagccct

SEQ ID NO: 207733 - DNA, 25 bp, Homo sapien
aggcgcggcccagccagaaaaccag

SEQ ID NO: 207734 - DNA, 25 bp, Homo sapien
gccagaaaaccaggccggcagtagc

SEQ ID NO: 207735 - DNA, 25 bp, Homo sapien
agccgccttcccaagctactggagg

SEQ ID NO: 207736 - DNA, 25 bp, Homo sapien
gaggagaggcaaccacgcttctgcc

SEQ ID NO: 207737 - DNA, 25 bp, Homo sapien
cggcacttcacttttgcacaacatg

SEQ ID NO: 207738 - DNA, 25 bp, Homo sapien
tgcggaacagacctccagcatatgg

SEQ ID NO: 207739 - DNA, 25 bp, Homo sapien
tccacgttggagttcatggctgcgg

SEQ ID NO: 207740 - DNA, 25 bp, Homo sapien
acctccagcatatggggtcccttca

SEQ ID NO: 207741 - DNA, 25 bp, Homo sapien
agcatatggggtcccttcagggccc

SEQ ID NO: 207742 - DNA, 25 bp, Homo sapien
tatggggtcccttcagggccctcga

SEQ ID NO: 207743 - DNA, 25 bp, Homo sapien
cttcagggccctcgatggtgacctg

SEQ ID NO: 207744 - DNA, 25 bp, Homo sapien
tcagggccctcgatggtgacctgga

SEQ ID NO: 207745 - DNA, 25 bp, Homo sapien
gcgcacagcgtacaccaacctgcct

SEQ ID NO: 207746 - DNA, 25 bp, Homo sapien
ccaggagtcagtggcaggcgcggcc

SEQ ID NO: 207747 - DNA, 25 bp, Homo sapien
agcgggcggccaggagtcagtggca

SEQ ID NO: 207748 - DNA, 25 bp, Homo sapien
tcggaggcttgggtttggaagacac

SEQ ID NO: 207749 - DNA, 25 bp, Homo sapien
ggatcatggcctcgcagaagcccgc

SEQ ID NO: 207750 - DNA, 25 bp, Homo sapien
acggatcatggcctcgcagaagccc

SEQ ID NO: 207751 - DNA, 25 bp, Homo sapien
gttgggcacggatcatggcctcgca

SEQ ID NO: 207752 - DNA, 25 bp, Homo sapien
ggcacggatcatggcctcgcagaag

SEQ ID NO: 207753 - DNA, 25 bp, Homo sapien
gggcacggatcatggcctcgcagaa

SEQ ID NO: 207754 - DNA, 25 bp, Homo sapien
gtgctgtggagacgcagaggatcca

SEQ ID NO: 207755 - DNA, 25 bp, Homo sapien
tgcggagaaggatcgacgagctttc

SEQ ID NO: 207756 - DNA, 25 bp, Homo sapien
aggatcgacgagctttccggagaaa

SEQ ID NO: 207757 - DNA, 25 bp, Homo sapien
ttccggagaaagatccgcgagcttt

SEQ ID NO: 207758 - DNA, 25 bp, Homo sapien
ccggagaaagatccgcgagctttcc

SEQ ID NO: 207759 - DNA, 25 bp, Homo sapien
aaagatccgcgagctttccggagcc

SEQ ID NO: 207760 - DNA, 25 bp, Homo sapien
tccgcgagctttccggagccggagc

SEQ ID NO: 207761 - DNA, 25 bp, Homo sapien
gcggcgctctacttctgcggagaag

SEQ ID NO: 207762 - DNA, 25 bp, Homo sapien
atgtgaactggctacatgctctccc

SEQ ID NO: 207763 - DNA, 25 bp, Homo sapien
tgagatctatggacacccgctcttc

SEQ ID NO: 207764 - DNA, 25 bp, Homo sapien
acaaggatgagatctatggacaccc

SEQ ID NO: 207765 - DNA, 25 bp, Homo sapien
acagcgacggcctgaagagggacaa

SEQ ID NO: 207766 - DNA, 25 bp, Homo sapien
ccaggcttggacagcgacggcctga

SEQ ID NO: 207767 - DNA, 25 bp, Homo sapien
gtacgatgagctgccgcactaccca

SEQ ID NO: 207768 - DNA, 25 bp, Homo sapien
cgcagccctggctggcttcccagag

SEQ ID NO: 207769 - DNA, 25 bp, Homo sapien
tcttggccctggtctttgagaaatg

SEQ ID NO: 207770 - DNA, 25 bp, Homo sapien
tcagcctgggcttctgcactgactt

SEQ ID NO: 207771 - DNA, 25 bp, Homo sapien
gcactgacttctacggctgcctctt

SEQ ID NO: 207772 - DNA, 25 bp, Homo sapien
ggtgctcacgcagagctccatcttc

SEQ ID NO: 207773 - DNA, 25 bp, Homo sapien
gagctccgaaatgggtcgtcttctc

SEQ ID NO: 207774 - DNA, 25 bp, Homo sapien
gggcacccaagacatcccagatgcg

SEQ ID NO: 207775 - DNA, 25 bp, Homo sapien
tgcgcgtcgctctaaggagatctgc

SEQ ID NO: 207776 - DNA, 25 bp, Homo sapien
gcaatttgttagttatccgccgcca

SEQ ID NO: 207777 - DNA, 25 bp, Homo sapien
ggcagtcgacagatacctggccatc

SEQ ID NO: 207778 - DNA, 25 bp, Homo sapien
tctgaagtgtcctgtgagcgcctct

SEQ ID NO: 207779 - DNA, 25 bp, Homo sapien
taactgattaggtgccaggatgggc

SEQ ID NO: 207780 - DNA, 25 bp, Homo sapien
gcaccgacgccaggactgggagacc

SEQ ID NO: 207781 - DNA, 25 bp, Homo sapien
gagacccgaggcagcacctacttcg

SEQ ID NO: 207782 - DNA, 25 bp, Homo sapien
tacttcgtcaccacgctgatcttca

SEQ ID NO: 207783 - DNA, 25 bp, Homo sapien
ctgatcttcacaccgaagacgccgg

SEQ ID NO: 207784 - DNA, 25 bp, Homo sapien
aagacgccggtctgctttttggacg

SEQ ID NO: 207785 - DNA, 25 bp, Homo sapien
cgcgtgcttctgaagtgtcctgtga

SEQ ID NO: 207786 - DNA, 25 bp, Homo sapien
ccgaggcagagatcatccagctgct

SEQ ID NO: 207787 - DNA, 25 bp, Homo sapien
tccagctgctgaagcgagccaaggt

SEQ ID NO: 207788 - DNA, 25 bp, Homo sapien
ctgcaactgcgctgtaccgtaaata

SEQ ID NO: 207789 - DNA, 25 bp, Homo sapien
atttgctgaatcgatttgactttta

SEQ ID NO: 207790 - DNA, 25 bp, Homo sapien
cgaacaagaggtttagagaaccaca

SEQ ID NO: 207791 - DNA, 25 bp, Homo sapien
gcctacctgtggaggatcctgaccc

SEQ ID NO: 207792 - DNA, 25 bp, Homo sapien
agggatgtcctgctcagtcgtcagg

SEQ ID NO: 207793 - DNA, 25 bp, Homo sapien
agcatgttccggctcctgagctgga

SEQ ID NO: 207794 - DNA, 25 bp, Homo sapien
ggaattcgcaccaagccctcactga

SEQ ID NO: 207795 - DNA, 25 bp, Homo sapien
cctactcaccgggagctggctaagc

SEQ ID NO: 207796 - DNA, 25 bp, Homo sapien
ctccttccggagagttgggagacca

SEQ ID NO: 207797 - DNA, 25 bp, Homo sapien
ttgggagaccaactccctccgctgg

SEQ ID NO: 207798 - DNA, 25 bp, Homo sapien
ggtgcatttcgacctgcccaagata

SEQ ID NO: 207799 - DNA, 25 bp, Homo sapien
cccaagatactttctagggctctgg

SEQ ID NO: 207800 - DNA, 25 bp, Homo sapien
gggctctggctggaattcgcaccaa

SEQ ID NO: 207801 - DNA, 25 bp, Homo sapien
ccctcactgaaatgctgggcgaggc

SEQ ID NO: 207802 - DNA, 25 bp, Homo sapien
ctcacaaggtgtctagcaggagctt

SEQ ID NO: 207803 - DNA, 25 bp, Homo sapien
agccgtgggatttatgttcttttca

SEQ ID NO: 207804 - DNA, 25 bp, Homo sapien
ctcggaggtaagcttctgccgcttc

SEQ ID NO: 207805 - DNA, 25 bp, Homo sapien
ctccgtaacgtggaaggctcagagc

SEQ ID NO: 207806 - DNA, 25 bp, Homo sapien
gactctttgtgtcccaagacggctg

SEQ ID NO: 207807 - DNA, 25 bp, Homo sapien
gcacgatgcttatggccgggaaaga

SEQ ID NO: 207808 - DNA, 25 bp, Homo sapien
tgcgcgccagcaagagacaacgtcc

SEQ ID NO: 207809 - DNA, 25 bp, Homo sapien
agagctcctcgatcgccgcatggct

SEQ ID NO: 207810 - DNA, 25 bp, Homo sapien
ccggcgctgcaaggaagtttccaga

SEQ ID NO: 207811 - DNA, 25 bp, Homo sapien
ggagcctttcttacggctatgagga

SEQ ID NO: 207812 - DNA, 25 bp, Homo sapien
gttgcataaatttgcgctccgccag

SEQ ID NO: 207813 - DNA, 25 bp, Homo sapien
tgataagtgacgcaacactcgttgc

SEQ ID NO: 207814 - DNA, 25 bp, Homo sapien
ccgatcggcgattctgtcgagttta

SEQ ID NO: 207815 - DNA, 25 bp, Homo sapien
ggcaggatcctggtatccgctaaca

SEQ ID NO: 207816 - DNA, 25 bp, Homo sapien
cgcacgcgcgctcagttacttagca

SEQ ID NO: 207817 - DNA, 25 bp, Homo sapien
tgaaaagcctaaactgcctctcggg

SEQ ID NO: 207818 - DNA, 25 bp, Homo sapien
tgcagcttttagagagacacacacc

SEQ ID NO: 207819 - DNA, 25 bp, Homo sapien
agcgtttatcttatcggcgagtttc

SEQ ID NO: 207820 - DNA, 25 bp, Homo sapien
tcagtgtagttttaatcccgggctc

SEQ ID NO: 207821 - DNA, 25 bp, Homo sapien
ctgctggacacttttccgtggaatg

SEQ ID NO: 207822 - DNA, 25 bp, Homo sapien
tccagcgctggcgaatcacagagtg

SEQ ID NO: 207823 - DNA, 25 bp, Homo sapien
gtctgacaagtcatccatctcccgg

SEQ ID NO: 207824 - DNA, 25 bp, Homo sapien
gaggccctctgtcgttacctgaata

SEQ ID NO: 207825 - DNA, 25 bp, Homo sapien
agttagaactgagagcccggcttca

SEQ ID NO: 207826 - DNA, 25 bp, Homo sapien
ttttttgagatgtgagagggaattg

SEQ ID NO: 207827 - DNA, 25 bp, Homo sapien
aggaagaaacgtgatcacgccgctg

SEQ ID NO: 207828 - DNA, 25 bp, Homo sapien
cggaaaggaagaaacgtgatcacgc

SEQ ID NO: 207829 - DNA, 25 bp, Homo sapien
tccggaaaggaagaaacgtgatcac

SEQ ID NO: 207830 - DNA, 25 bp, Homo sapien
ttccggaaaggaagaaacgtgatca

SEQ ID NO: 207831 - DNA, 25 bp, Homo sapien
gtgcttcacggtcaccaccaggtgt

SEQ ID NO: 207832 - DNA, 25 bp, Homo sapien
gcgcgattttttgagatgtgagagg

SEQ ID NO: 207833 - DNA, 25 bp, Homo sapien
tgcttcacggtcaccaccaggtgtc

SEQ ID NO: 207834 - DNA, 25 bp, Homo sapien
gaaatgctgtggtcccgccgtccgc

SEQ ID NO: 207835 - DNA, 25 bp, Homo sapien
tcgcggtgggagtcttagcagaacc

SEQ ID NO: 207836 - DNA, 25 bp, Homo sapien
atgcgcctgaagctcggtagcgaga

SEQ ID NO: 207837 - DNA, 25 bp, Homo sapien
gcccaggattctgggtagttagttg

SEQ ID NO: 207838 - DNA, 25 bp, Homo sapien
gctggagtccaaaggaaggtccttc

SEQ ID NO: 207839 - DNA, 25 bp, Homo sapien
gacacccttacagtccagctctgtg

SEQ ID NO: 207840 - DNA, 25 bp, Homo sapien
cagaaccgcggtggagcctactacc

SEQ ID NO: 207841 - DNA, 25 bp, Homo sapien
gcctgcatcctccagttcctttgga

SEQ ID NO: 207842 - DNA, 25 bp, Homo sapien
ttcgactgtcctgatgatacttgta

SEQ ID NO: 207843 - DNA, 25 bp, Homo sapien
cagaagcgataactgacgacgtcta

SEQ ID NO: 207844 - DNA, 25 bp, Homo sapien
tggctgaggctcatggatcactctt

SEQ ID NO: 207845 - DNA, 25 bp, Homo sapien
gatcactcttttgtggtagggccac

SEQ ID NO: 207846 - DNA, 25 bp, Homo sapien
gtagggccacatctgccagagcctg

SEQ ID NO: 207847 - DNA, 25 bp, Homo sapien
cgtcggtaagattgtaacagtatta

SEQ ID NO: 207848 - DNA, 25 bp, Homo sapien
ttactggaagacttattcgactgtc

SEQ ID NO: 207849 - DNA, 25 bp, Homo sapien
gtctaatgtctatctgaccgcagtc

SEQ ID NO: 207850 - DNA, 25 bp, Homo sapien
ccgaggcacctgctgccagacaggg

SEQ ID NO: 207851 - DNA, 25 bp, Homo sapien
gctcctccctcttggctacccgggc

SEQ ID NO: 207852 - DNA, 25 bp, Homo sapien
acattcagcggaagcgccgaggcac

SEQ ID NO: 207853 - DNA, 25 bp, Homo sapien
agcgacgcccagaagtccggccgtt

SEQ ID NO: 207854 - DNA, 25 bp, Homo sapien
ttggtctgccgggtgcccatgccgc

SEQ ID NO: 207855 - DNA, 25 bp, Homo sapien
cctgcctgcgtcctctcggcagtcg

SEQ ID NO: 207856 - DNA, 25 bp, Homo sapien
gaccatgccgactcgccggtggtag

SEQ ID NO: 207857 - DNA, 25 bp, Homo sapien
ccaggctgcccttggtctgccgggt

SEQ ID NO: 207858 - DNA, 25 bp, Homo sapien
ggctgtggaccacatttcccaagaa

SEQ ID NO: 207859 - DNA, 25 bp, Homo sapien
tggtattggtcccttgggtgtccca

SEQ ID NO: 207860 - DNA, 25 bp, Homo sapien
gtgggaagatcttacaaactgcatg

SEQ ID NO: 207861 - DNA, 25 bp, Homo sapien
ccacttaaattcgtagtcagcctta

SEQ ID NO: 207862 - DNA, 25 bp, Homo sapien
tcccatcttatggaaggtggtattg

SEQ ID NO: 207863 - DNA, 25 bp, Homo sapien
ggtagctcttgcacctaggccgtta

SEQ ID NO: 207864 - DNA, 25 bp, Homo sapien
tggagctgtccgctctgaaacctga

SEQ ID NO: 207865 - DNA, 25 bp, Homo sapien
gtctcagccaaactgcgggccattt

SEQ ID NO: 207866 - DNA, 25 bp, Homo sapien
acccatcgctctgacttgcttgtca

SEQ ID NO: 207867 - DNA, 25 bp, Homo sapien
ctgcgaggttccgaagggaacttca

SEQ ID NO: 207868 - DNA, 25 bp, Homo sapien
gctgtcactgatcgcgcggacactc

SEQ ID NO: 207869 - DNA, 25 bp, Homo sapien
gctgcgcccggacatcaatacctgt

SEQ ID NO: 207870 - DNA, 25 bp, Homo sapien
atcaatacctgtcgctgggacccgg

SEQ ID NO: 207871 - DNA, 25 bp, Homo sapien
acaggcaacaatggcgacgctggca

SEQ ID NO: 207872 - DNA, 25 bp, Homo sapien
agagccaatcggagcccaagctgcc

SEQ ID NO: 207873 - DNA, 25 bp, Homo sapien
acgcaggtctggtagacgtcttgga

SEQ ID NO: 207874 - DNA, 25 bp, Homo sapien
gaagcagacaaaatccaaacctggg

SEQ ID NO: 207875 - DNA, 25 bp, Homo sapien
aggaaggggattagcagctctgaac

SEQ ID NO: 207876 - DNA, 25 bp, Homo sapien
gcatggctgaccttgaggagaagca

SEQ ID NO: 207877 - DNA, 25 bp, Homo sapien
tgccctggcacccactttgctttta

SEQ ID NO: 207878 - DNA, 25 bp, Homo sapien
aggcaggctagcctcttagcacccg

SEQ ID NO: 207879 - DNA, 25 bp, Homo sapien
ttgtccaaggcaggctagcctctta

SEQ ID NO: 207880 - DNA, 25 bp, Homo sapien
ctgaacgacgcttttgtccaaggca

SEQ ID NO: 207881 - DNA, 25 bp, Homo sapien
ttagcagctctgaacgacgcttttg

SEQ ID NO: 207882 - DNA, 25 bp, Homo sapien
tgcagctgcagacgcccatcctggg

SEQ ID NO: 207883 - DNA, 25 bp, Homo sapien
catcctgggagtggacaccagcttc

SEQ ID NO: 207884 - DNA, 25 bp, Homo sapien
cacgggatcaccgtgcacagtgagt

SEQ ID NO: 207885 - DNA, 25 bp, Homo sapien
tgagtgctgtacaaagtgcctgtgc

SEQ ID NO: 207886 - DNA, 25 bp, Homo sapien
agggcgcccgactaagccttttctg

SEQ ID NO: 207887 - DNA, 25 bp, Homo sapien
taagccttttctgccctgcgtgagg

SEQ ID NO: 207888 - DNA, 25 bp, Homo sapien
atgcgtgttccgtctgcagctgcag

SEQ ID NO: 207889 - DNA, 25 bp, Homo sapien
acacggcttcggcttcggacgatcc

SEQ ID NO: 207890 - DNA, 25 bp, Homo sapien
cagacaaggcagtccgcaggcggaa

SEQ ID NO: 207891 - DNA, 25 bp, Homo sapien
acctcgcgccaggacaccgggagtt

SEQ ID NO: 207892 - DNA, 25 bp, Homo sapien
gcgctctgcctcactgcagacaagg

SEQ ID NO: 207893 - DNA, 25 bp, Homo sapien
cggggtcctcaaggaacgcagcgct

SEQ ID NO: 207894 - DNA, 25 bp, Homo sapien
ccaggttgtcacgaagccgcgaccg

SEQ ID NO: 207895 - DNA, 25 bp, Homo sapien
gcacaggctgtttcctcacggagga

SEQ ID NO: 207896 - DNA, 25 bp, Homo sapien
cgaaaaatgtccctggagaagccgg

SEQ ID NO: 207897 - DNA, 25 bp, Homo sapien
gctccctgcgagagggaactggcca

SEQ ID NO: 207898 - DNA, 25 bp, Homo sapien
ctccacgaagccgtagccatttttg

SEQ ID NO: 207899 - DNA, 25 bp, Homo sapien
tcctcgctgttcagctcgtaaaggg

SEQ ID NO: 207900 - DNA, 25 bp, Homo sapien
cgctgttcagctcgtaaagggcgtc

SEQ ID NO: 207901 - DNA, 25 bp, Homo sapien
tccacgaagccgtagccatttttga

SEQ ID NO: 207902 - DNA, 25 bp, Homo sapien
cacgaagccgtagccatttttgagg

SEQ ID NO: 207903 - DNA, 25 bp, Homo sapien
cgaagccgtagccatttttgaggtc

SEQ ID NO: 207904 - DNA, 25 bp, Homo sapien
ctcgctgttcagctcgtaaagggcg

SEQ ID NO: 207905 - DNA, 25 bp, Homo sapien
gctcctcgctgttcagctcgtaaag

SEQ ID NO: 207906 - DNA, 25 bp, Homo sapien
ggaggcggccatagccactgaaaaa

SEQ ID NO: 207907 - DNA, 25 bp, Homo sapien
atagccactgaaaaagcgctggatg

SEQ ID NO: 207908 - DNA, 25 bp, Homo sapien
aggtctacttcgaggaggcggccat

SEQ ID NO: 207909 - DNA, 25 bp, Homo sapien
ccatttttgaggtctacttcgagga

SEQ ID NO: 207910 - DNA, 25 bp, Homo sapien
agtcctcgaactccacgaagccgta

SEQ ID NO: 207911 - DNA, 25 bp, Homo sapien
gtcgcgggagtcctcgaactccacg

SEQ ID NO: 207912 - DNA, 25 bp, Homo sapien
ggcgtgctctacgatcacgcgctcg

SEQ ID NO: 207913 - DNA, 25 bp, Homo sapien
gtcctatgtagacgcgcggcatgtc

SEQ ID NO: 207914 - DNA, 25 bp, Homo sapien
gaaggggcttcagtctctcccagca

SEQ ID NO: 207915 - DNA, 25 bp, Homo sapien
tcccagcaacgcgatcagaggtctt

SEQ ID NO: 207916 - DNA, 25 bp, Homo sapien
tcgctctgggtgcaggatttctaga

SEQ ID NO: 207917 - DNA, 25 bp, Homo sapien
ttggattgctcagtacctgcggcta

SEQ ID NO: 207918 - DNA, 25 bp, Homo sapien
gccgctagaagtctctgcgcttgga

SEQ ID NO: 207919 - DNA, 25 bp, Homo sapien
cccagggtttcaccgagcttgctct

SEQ ID NO: 207920 - DNA, 25 bp, Homo sapien
tttctccgaaactcgcgtgaggcta

SEQ ID NO: 207921 - DNA, 25 bp, Homo sapien
ccgtgcccttctcttggccgaaaga

SEQ ID NO: 207922 - DNA, 25 bp, Homo sapien
cccaatcgcctctcaggagtgggcg

SEQ ID NO: 207923 - DNA, 25 bp, Homo sapien
gcgcccgggacaacgagtacctggc

SEQ ID NO: 207924 - DNA, 25 bp, Homo sapien
tacctggcggccgaactgaggacaa

SEQ ID NO: 207925 - DNA, 25 bp, Homo sapien
ctgaggacaactgagggaactcgca

SEQ ID NO: 207926 - DNA, 25 bp, Homo sapien
ttggacccggactaggaggccgcat

SEQ ID NO: 207927 - DNA, 25 bp, Homo sapien
gccctacctgtgagggaggccagct

SEQ ID NO: 207928 - DNA, 25 bp, Homo sapien
gctggagactgaacccacactcggg

SEQ ID NO: 207929 - DNA, 25 bp, Homo sapien
cgggaacgcttccagcaatggcggc

SEQ ID NO: 207930 - DNA, 25 bp, Homo sapien
cagaggcttttggacaccgcctgcc

SEQ ID NO: 207931 - DNA, 25 bp, Homo sapien
cggtgggaaaaccggcaggaggctg

SEQ ID NO: 207932 - DNA, 25 bp, Homo sapien
agccagtggcgggagccaccggtgg

SEQ ID NO: 207933 - DNA, 25 bp, Homo sapien
agaggcttttggacaccgcctgcca

SEQ ID NO: 207934 - DNA, 25 bp, Homo sapien
tcagaggcttttggacaccgcctgc

SEQ ID NO: 207935 - DNA, 25 bp, Homo sapien
cccggtcggtcagcgactcgcgccc

SEQ ID NO: 207936 - DNA, 25 bp, Homo sapien
gcctcccggtcggtcagcgactcgc

SEQ ID NO: 207937 - DNA, 25 bp, Homo sapien
gaggcttttggacaccgcctgccat

SEQ ID NO: 207938 - DNA, 25 bp, Homo sapien
aggcgctccggtcccatttgcagcg

SEQ ID NO: 207939 - DNA, 25 bp, Homo sapien
tttgttagcgagagcgcgccaaccc

SEQ ID NO: 207940 - DNA, 25 bp, Homo sapien
cccagaggttcctttgttagcgaga

SEQ ID NO: 207941 - DNA, 25 bp, Homo sapien
ccgactgccattggcccagaggttc

SEQ ID NO: 207942 - DNA, 25 bp, Homo sapien
gcacaacttaccttgcgctcggcgg

SEQ ID NO: 207943 - DNA, 25 bp, Homo sapien
caaacctgaacgtcccatgccggcg

SEQ ID NO: 207944 - DNA, 25 bp, Homo sapien
aggcagcctgaggtcggctccgcct

SEQ ID NO: 207945 - DNA, 25 bp, Homo sapien
tcggcgccagtccaccaaacctgaa

SEQ ID NO: 207946 - DNA, 25 bp, Homo sapien
gctgagttccgtcccatccagcagg

SEQ ID NO: 207947 - DNA, 25 bp, Homo sapien
ctccaagacctttgactgggctgag

SEQ ID NO: 207948 - DNA, 25 bp, Homo sapien
caagacctttgactgggctgagttc

SEQ ID NO: 207949 - DNA, 25 bp, Homo sapien
agacctttgactgggctgagttccg

SEQ ID NO: 207950 - DNA, 25 bp, Homo sapien
ctttgactgggctgagttccgtccc

SEQ ID NO: 207951 - DNA, 25 bp, Homo sapien
tgactgggctgagttccgtcccatc

SEQ ID NO: 207952 - DNA, 25 bp, Homo sapien
gggctgagttccgtcccatccagca

SEQ ID NO: 207953 - DNA, 25 bp, Homo sapien
actgggctgagttccgtcccatcca

SEQ ID NO: 207954 - DNA, 25 bp, Homo sapien
cggccgctgagctagccatcaagga

SEQ ID NO: 207955 - DNA, 25 bp, Homo sapien
cttcaggcacggctcagcaatgcgg

SEQ ID NO: 207956 - DNA, 25 bp, Homo sapien
ctggccaagctcaagggcgacctga

SEQ ID NO: 207957 - DNA, 25 bp, Homo sapien
ctagcgagcagaagctcaagagtgc

SEQ ID NO: 207958 - DNA, 25 bp, Homo sapien
gcctggagacacagcaggcgctgca

SEQ ID NO: 207959 - DNA, 25 bp, Homo sapien
ttgccgacctcagccagcaactggg

SEQ ID NO: 207960 - DNA, 25 bp, Homo sapien
atccggcaccacgaggctgagatcc

SEQ ID NO: 207961 - DNA, 25 bp, Homo sapien
ctgagatccggagccttcaggcacg

SEQ ID NO: 207962 - DNA, 25 bp, Homo sapien
gccatgtagtcgcagtcggtgacga

SEQ ID NO: 207963 - DNA, 25 bp, Homo sapien
cacgcagccggctagaccttctgtg

SEQ ID NO: 207964 - DNA, 25 bp, Homo sapien
tgcttccagcatgccgggacagttc

SEQ ID NO: 207965 - DNA, 25 bp, Homo sapien
gggctctgctttctccgcgttacac

SEQ ID NO: 207966 - DNA, 25 bp, Homo sapien
taagtgtccacctttgcgcctagga

SEQ ID NO: 207967 - DNA, 25 bp, Homo sapien
agcagaccgatttgcgagccgttga

SEQ ID NO: 207968 - DNA, 25 bp, Homo sapien
aggggaatctgctccgcctctaacc

SEQ ID NO: 207969 - DNA, 25 bp, Homo sapien
ggctgcagcagtcacgaaaactccg

SEQ ID NO: 207970 - DNA, 25 bp, Homo sapien
gacacactgtggcagacgtccctcc

SEQ ID NO: 207971 - DNA, 25 bp, Homo sapien
tgcgtccacgacacggacacactgt

SEQ ID NO: 207972 - DNA, 25 bp, Homo sapien
cctccgtccaccacagcgctgaccc

SEQ ID NO: 207973 - DNA, 25 bp, Homo sapien
ggcagacgtccctccgtccaccaca

SEQ ID NO: 207974 - DNA, 25 bp, Homo sapien
cggacacactgtggcagacgtccct

SEQ ID NO: 207975 - DNA, 25 bp, Homo sapien
cacgacacggacacactgtggcaga

SEQ ID NO: 207976 - DNA, 25 bp, Homo sapien
gtccctccgtccaccacagcgctga

SEQ ID NO: 207977 - DNA, 25 bp, Homo sapien
tccacgacacggacacactgtggca

SEQ ID NO: 207978 - DNA, 25 bp, Homo sapien
acacgttaggggatggaatcgctcg

SEQ ID NO: 207979 - DNA, 25 bp, Homo sapien
gtgtccacgacacggacacactgtg

SEQ ID NO: 207980 - DNA, 25 bp, Homo sapien
tgtggcacacagcacacgttagggg

SEQ ID NO: 207981 - DNA, 25 bp, Homo sapien
ggcacacagcacacgttaggggatg

SEQ ID NO: 207982 - DNA, 25 bp, Homo sapien
cacacagcacacgttaggggatgga

SEQ ID NO: 207983 - DNA, 25 bp, Homo sapien
acagcacacgttaggggatggaatc

SEQ ID NO: 207984 - DNA, 25 bp, Homo sapien
cacacgttaggggatggaatcgctc

SEQ ID NO: 207985 - DNA, 25 bp, Homo sapien
cagcacacgttaggggatggaatcg

SEQ ID NO: 207986 - DNA, 25 bp, Homo sapien
acctgcccaggccagagaccgctct

SEQ ID NO: 207987 - DNA, 25 bp, Homo sapien
ctgcccaggccagagaccgctctcc

SEQ ID NO: 207988 - DNA, 25 bp, Homo sapien
cagagaccgctctccgcgctagaag

SEQ ID NO: 207989 - DNA, 25 bp, Homo sapien
agagaccgctctccgcgctagaagc

SEQ ID NO: 207990 - DNA, 25 bp, Homo sapien
tccgcgctagaagccacagcaaccc

SEQ ID NO: 207991 - DNA, 25 bp, Homo sapien
gcgctagaagccacagcaaccccgg

SEQ ID NO: 207992 - DNA, 25 bp, Homo sapien
gccacgggccctagcacacccgtca

SEQ ID NO: 207993 - DNA, 25 bp, Homo sapien
ccacgggccctagcacacccgtcac

SEQ ID NO: 207994 - DNA, 25 bp, Homo sapien
tgaacccacgcctcccatcagcccg

SEQ ID NO: 207995 - DNA, 25 bp, Homo sapien
ggttccacctcccaccacgtgccaa

SEQ ID NO: 207996 - DNA, 25 bp, Homo sapien
tccttccagccaggcgctcggccac

SEQ ID NO: 207997 - DNA, 25 bp, Homo sapien
ctcaacaggtgaccacgcctccctc

SEQ ID NO: 207998 - DNA, 25 bp, Homo sapien
tgtcacgcaccaagctgaacccacg

SEQ ID NO: 207999 - DNA, 25 bp, Homo sapien
acaactgtcacgcaccaagctgaac

SEQ ID NO: 208000 - DNA, 25 bp, Homo sapien
accacgcctccctccacgcgccagg

SEQ ID NO: 208001 - DNA, 25 bp, Homo sapien
ggccacgtgcaaggtcacgccctca

SEQ ID NO: 208002 - DNA, 25 bp, Homo sapien
ccaaggtatcctcggtcggagcacc

SEQ ID NO: 208003 - DNA, 25 bp, Homo sapien
ttctccatctggaccaaggtatcct

SEQ ID NO: 208004 - DNA, 25 bp, Homo sapien
tcaccagcgagcttctccatctgga

SEQ ID NO: 208005 - DNA, 25 bp, Homo sapien
caggagagcagacagctggtaccgc

SEQ ID NO: 208006 - DNA, 25 bp, Homo sapien
tccctcagcgattcctgccaggaga

SEQ ID NO: 208007 - DNA, 25 bp, Homo sapien
tgggctgattcagagccgcgtttcc

SEQ ID NO: 208008 - DNA, 25 bp, Homo sapien
cccgaaggctcgttctgggctgatt

SEQ ID NO: 208009 - DNA, 25 bp, Homo sapien
tcggagcaccttccaggagcttctc

SEQ ID NO: 208010 - DNA, 25 bp, Homo sapien
gggaccacatcaagcttcaggccga

SEQ ID NO: 208011 - DNA, 25 bp, Homo sapien
cgctgcctatgaccgccactagtta

SEQ ID NO: 208012 - DNA, 25 bp, Homo sapien
ccaggggaggtcttttctgtgcttt

SEQ ID NO: 208013 - DNA, 25 bp, Homo sapien
acgcaactattctccggggcaactg

SEQ ID NO: 208014 - DNA, 25 bp, Homo sapien
gacaggcttgttagtgcagcactga

SEQ ID NO: 208015 - DNA, 25 bp, Homo sapien
ttactaagtgagtacgccacctggc

SEQ ID NO: 208016 - DNA, 25 bp, Homo sapien
caacgaggcttggagattcagcaac

SEQ ID NO: 208017 - DNA, 25 bp, Homo sapien
ggagcgagttctccggcaacccgta

SEQ ID NO: 208018 - DNA, 25 bp, Homo sapien
gcccaggaacacagtccgagtccta

SEQ ID NO: 208019 - DNA, 25 bp, Homo sapien
cgcgggagtatgctgaaacttaaaa

SEQ ID NO: 208020 - DNA, 25 bp, Homo sapien
ttgcagaactcggaaccgctgtgcg

SEQ ID NO: 208021 - DNA, 25 bp, Homo sapien
tctcaagcccgggttcaggctctca

SEQ ID NO: 208022 - DNA, 25 bp, Homo sapien
aggcttcctgtccacataaaagaga

SEQ ID NO: 208023 - DNA, 25 bp, Homo sapien
aaccatttcattaagcgcgggagta

SEQ ID NO: 208024 - DNA, 25 bp, Homo sapien
agttccgaatggttcagaccgcacc

SEQ ID NO: 208025 - DNA, 25 bp, Homo sapien
ctacaactccgaggtctgactggga

SEQ ID NO: 208026 - DNA, 25 bp, Homo sapien
cgcagcattctgtaggaccaaaata

SEQ ID NO: 208027 - DNA, 25 bp, Homo sapien
aaacagcctgaattcgccgtagccg

SEQ ID NO: 208028 - DNA, 25 bp, Homo sapien
gcccacccgttactgtttccatgga

SEQ ID NO: 208029 - DNA, 25 bp, Homo sapien
ctggttcaagcaccgcgagactata

SEQ ID NO: 208030 - DNA, 25 bp, Homo sapien
tgctccagggcagacgccatgtttt

SEQ ID NO: 208031 - DNA, 25 bp, Homo sapien
cctagggcgttaccttgagctgaga

SEQ ID NO: 208032 - DNA, 25 bp, Homo sapien
gcgctcgatcctgccctgatctaaa

SEQ ID NO: 208033 - DNA, 25 bp, Homo sapien
gtctcaggactaaaagggctgttcc

SEQ ID NO: 208034 - DNA, 25 bp, Homo sapien
cgagggcggattcctcaggaagttc

SEQ ID NO: 208035 - DNA, 25 bp, Homo sapien
gccctctgatagaatagggtctggg

SEQ ID NO: 208036 - DNA, 25 bp, Homo sapien
accagcccttcatcgcgctggagga

SEQ ID NO: 208037 - DNA, 25 bp, Homo sapien
acagcgcaccgggaagatgcggccc

SEQ ID NO: 208038 - DNA, 25 bp, Homo sapien
cgcgtgttcctttagggaccgcgcg

SEQ ID NO: 208039 - DNA, 25 bp, Homo sapien
agacgcaaatcgacagcgcgggagc

SEQ ID NO: 208040 - DNA, 25 bp, Homo sapien
ccagggtccacggagaagacgcaaa

SEQ ID NO: 208041 - DNA, 25 bp, Homo sapien
ctcggggtggccctctgatagaata

SEQ ID NO: 208042 - DNA, 25 bp, Homo sapien
cttacgtctgcggatcttccgggcc

SEQ ID NO: 208043 - DNA, 25 bp, Homo sapien
ggccttacgtctgcggatcttccgg

SEQ ID NO: 208044 - DNA, 25 bp, Homo sapien
tacgtctgcggatcttccgggccgg

SEQ ID NO: 208045 - DNA, 25 bp, Homo sapien
gggccttacgtctgcggatcttccg

SEQ ID NO: 208046 - DNA, 25 bp, Homo sapien
gccttacgtctgcggatcttccggg

SEQ ID NO: 208047 - DNA, 25 bp, Homo sapien
ccttacgtctgcggatcttccgggc

SEQ ID NO: 208048 - DNA, 25 bp, Homo sapien
ttacgtctgcggatcttccgggccg

SEQ ID NO: 208049 - DNA, 25 bp, Homo sapien
cgggccttacgtctgcggatcttcc

SEQ ID NO: 208050 - DNA, 25 bp, Homo sapien
cctgcagggactccgtggacttgtt

SEQ ID NO: 208051 - DNA, 25 bp, Homo sapien
aagaccatgccattccggctgggcg

SEQ ID NO: 208052 - DNA, 25 bp, Homo sapien
gtggggcttcaagaccatgccattc

SEQ ID NO: 208053 - DNA, 25 bp, Homo sapien
ccgctgccagtccttgtggaagtgg

SEQ ID NO: 208054 - DNA, 25 bp, Homo sapien
gccaccttcttgtgaatgccggcca

SEQ ID NO: 208055 - DNA, 25 bp, Homo sapien
aaatgccgatggtccgggccacctt

SEQ ID NO: 208056 - DNA, 25 bp, Homo sapien
cgtggacttgttccgcctcctcgga

SEQ ID NO: 208057 - DNA, 25 bp, Homo sapien
cctcggatccacagaaatgccgatg

SEQ ID NO: 208058 - DNA, 25 bp, Homo sapien
ggaggatgtattgccgccaacgtcc

SEQ ID NO: 208059 - DNA, 25 bp, Homo sapien
gacgtgtagagtgcgcgacgctttt

SEQ ID NO: 208060 - DNA, 25 bp, Homo sapien
tagagtgcgcgacgcttttggcgac

SEQ ID NO: 208061 - DNA, 25 bp, Homo sapien
agtgcgcgacgcttttggcgacccg

SEQ ID NO: 208062 - DNA, 25 bp, Homo sapien
tgcgcgacgcttttggcgacccgac

SEQ ID NO: 208063 - DNA, 25 bp, Homo sapien
cgcgacgcttttggcgacccgacct

SEQ ID NO: 208064 - DNA, 25 bp, Homo sapien
cggaggatgtattgccgccaacgtc

SEQ ID NO: 208065 - DNA, 25 bp, Homo sapien
tttcccgccgactgcccagtgcgca

SEQ ID NO: 208066 - DNA, 25 bp, Homo sapien
atagcagttcttggccgggatactc

SEQ ID NO: 208067 - DNA, 25 bp, Homo sapien
tcatcgcggccagtttcattgggca

SEQ ID NO: 208068 - DNA, 25 bp, Homo sapien
gtagaagtcgcggtcacccttgttg

SEQ ID NO: 208069 - DNA, 25 bp, Homo sapien
gtcgcggttgtccagactgaacacc

SEQ ID NO: 208070 - DNA, 25 bp, Homo sapien
ctagcctctctaagcgcgaagcgca

SEQ ID NO: 208071 - DNA, 25 bp, Homo sapien
gtcttgcccaccttggacgagccga

SEQ ID NO: 208072 - DNA, 25 bp, Homo sapien
gctcgggcacatcttcttgatcatc

SEQ ID NO: 208073 - DNA, 25 bp, Homo sapien
acctcgccgcggatggagtagaact

SEQ ID NO: 208074 - DNA, 25 bp, Homo sapien
tcataatattgacacaggcagggca

SEQ ID NO: 208075 - DNA, 25 bp, Homo sapien
gcgttccggcccattggagtcggcc

SEQ ID NO: 208076 - DNA, 25 bp, Homo sapien
acccacaggaagtccagtcataata

SEQ ID NO: 208077 - DNA, 25 bp, Homo sapien
cacaggaagtccagtcataatattg

SEQ ID NO: 208078 - DNA, 25 bp, Homo sapien
cctcaggaccggatctgggccggat

SEQ ID NO: 208079 - DNA, 25 bp, Homo sapien
tgccagcaaggctggcgttccggcc

SEQ ID NO: 208080 - DNA, 25 bp, Homo sapien
gcccattggagtcggccgtgctgca

SEQ ID NO: 208081 - DNA, 25 bp, Homo sapien
aggaccggatctgggccggatccac

SEQ ID NO: 208082 - DNA, 25 bp, Homo sapien
cgcgacgagcactgcctagagcttc

SEQ ID NO: 208083 - DNA, 25 bp, Homo sapien
aatctgaggtttacacgcgcgcgca

SEQ ID NO: 208084 - DNA, 25 bp, Homo sapien
ccggtgcggtcagtacctgtctaaa

SEQ ID NO: 208085 - DNA, 25 bp, Homo sapien
ccgtcaccgcgaagtgcctctttat

SEQ ID NO: 208086 - DNA, 25 bp, Homo sapien
caagtcccagtgtgtttcgccgcag

SEQ ID NO: 208087 - DNA, 25 bp, Homo sapien
tccgctgcagctacgtagcagtatc

SEQ ID NO: 208088 - DNA, 25 bp, Homo sapien
cgcgggtcgtagctataagcagctt

SEQ ID NO: 208089 - DNA, 25 bp, Homo sapien
gcacccgagcctgtaactgacctgg

SEQ ID NO: 208090 - DNA, 25 bp, Homo sapien
tcccggagtggaaagcagggtccac

SEQ ID NO: 208091 - DNA, 25 bp, Homo sapien
cagggtccacctgccgagaagaaac

SEQ ID NO: 208092 - DNA, 25 bp, Homo sapien
cagggcggcaagacatagacccaga

SEQ ID NO: 208093 - DNA, 25 bp, Homo sapien
catagacccagaggcaggcgtctcc

SEQ ID NO: 208094 - DNA, 25 bp, Homo sapien
cccagcgttcgccatcaagttcaag

SEQ ID NO: 208095 - DNA, 25 bp, Homo sapien
cgtgcgctgtttgcactcccggagt

SEQ ID NO: 208096 - DNA, 25 bp, Homo sapien
ttcaagccacttagagggacgcgca

SEQ ID NO: 208097 - DNA, 25 bp, Homo sapien
ggcaccttgtttcggagcagcttgt

SEQ ID NO: 208098 - DNA, 25 bp, Homo sapien
tgagctttgtgagtgcgtccgaggt

SEQ ID NO: 208099 - DNA, 25 bp, Homo sapien
cccgcgacctggggagctctgtagc

SEQ ID NO: 208100 - DNA, 25 bp, Homo sapien
tctgcggtgtccctacccgggcagc

SEQ ID NO: 208101 - DNA, 25 bp, Homo sapien
tggccatcgcttgggagtcagggcc

SEQ ID NO: 208102 - DNA, 25 bp, Homo sapien
gcaagggatctgcttgcgccgaggc

SEQ ID NO: 208103 - DNA, 25 bp, Homo sapien
cgagtgtggcaagggatctgcttgc

SEQ ID NO: 208104 - DNA, 25 bp, Homo sapien
ccgcggggtccttgctttgtgtggt

SEQ ID NO: 208105 - DNA, 25 bp, Homo sapien
gctcgggctctctgcggtgtcccta

SEQ ID NO: 208106 - DNA, 25 bp, Homo sapien
cgtgggcgcagcagcaattttatcc

SEQ ID NO: 208107 - DNA, 25 bp, Homo sapien
cccgaagtctgcaatgaaacgcgaa

SEQ ID NO: 208108 - DNA, 25 bp, Homo sapien
gcagcggctgaaattggtgcgcctt

SEQ ID NO: 208109 - DNA, 25 bp, Homo sapien
gacttcacgcgcctccagtgtcttg

SEQ ID NO: 208110 - DNA, 25 bp, Homo sapien
taggagctggttcatgggacttcac

SEQ ID NO: 208111 - DNA, 25 bp, Homo sapien
ctgcgtttacttctgggcccgaaga

SEQ ID NO: 208112 - DNA, 25 bp, Homo sapien
cgcaagtttcctcgctctgcgttta

SEQ ID NO: 208113 - DNA, 25 bp, Homo sapien
gaccgcagacgcttgccgcaagttt

SEQ ID NO: 208114 - DNA, 25 bp, Homo sapien
gcgagagggcaaatgcccgcgcttc

SEQ ID NO: 208115 - DNA, 25 bp, Homo sapien
ttggggataatgaaagagagtctgt

SEQ ID NO: 208116 - DNA, 25 bp, Homo sapien
ctcctccgcggtggcgtcccacagg

SEQ ID NO: 208117 - DNA, 25 bp, Homo sapien
cgttctcccactccctggatgtttg

SEQ ID NO: 208118 - DNA, 25 bp, Homo sapien
gggctctgcttaccgagcccggcaa

SEQ ID NO: 208119 - DNA, 25 bp, Homo sapien
cgggacgggctctgcttaccgagcc

SEQ ID NO: 208120 - DNA, 25 bp, Homo sapien
gctcgcctccgaggccatttccttt

SEQ ID NO: 208121 - DNA, 25 bp, Homo sapien
agtcccagcgttgcggccggcgctt

SEQ ID NO: 208122 - DNA, 25 bp, Homo sapien
aacgcgcgggtttaattgcacctgc

SEQ ID NO: 208123 - DNA, 25 bp, Homo sapien
cgcggcgcgttcgtttcattaattt

SEQ ID NO: 208124 - DNA, 25 bp, Homo sapien
tcattaatttatcgccctgcctcgg

SEQ ID NO: 208125 - DNA, 25 bp, Homo sapien
ggcgcgttcgtttcattaatttatc

SEQ ID NO: 208126 - DNA, 25 bp, Homo sapien
ttaaagcttaatggctgcgaacgcg

SEQ ID NO: 208127 - DNA, 25 bp, Homo sapien
gcgtcttctcgttcttatgctaatg

SEQ ID NO: 208128 - DNA, 25 bp, Homo sapien
ggtggccgccatcaaagcgtcttct

SEQ ID NO: 208129 - DNA, 25 bp, Homo sapien
gcgaacgcgcgggtttaattgcacc

SEQ ID NO: 208130 - DNA, 25 bp, Homo sapien
acccgcaggctcgtaagtcactgga

SEQ ID NO: 208131 - DNA, 25 bp, Homo sapien
ccgtgacattcactcgtaggacaga

SEQ ID NO: 208132 - DNA, 25 bp, Homo sapien
tctttgacatacacacgcctgcgcg

SEQ ID NO: 208133 - DNA, 25 bp, Homo sapien
ggggccgtctctaattacctcctga

SEQ ID NO: 208134 - DNA, 25 bp, Homo sapien
aataatggctactgagggcgctcgc

SEQ ID NO: 208135 - DNA, 25 bp, Homo sapien
tcgtgcgagcgctcacatttgtttc

SEQ ID NO: 208136 - DNA, 25 bp, Homo sapien
tgtttctcccaaggatctcatctgg

SEQ ID NO: 208137 - DNA, 25 bp, Homo sapien
gcgccacatcattcagtcaaactga

SEQ ID NO: 208138 - DNA, 25 bp, Homo sapien
tcgcctcgttcggtgccagaggact

SEQ ID NO: 208139 - DNA, 25 bp, Homo sapien
agctgcttcactcggctgacttcga

SEQ ID NO: 208140 - DNA, 25 bp, Homo sapien
gagtgtgcaaggaacagctgcttca

SEQ ID NO: 208141 - DNA, 25 bp, Homo sapien
catctttggtcaagtggagtgtgca

SEQ ID NO: 208142 - DNA, 25 bp, Homo sapien
gcagcacgggccttagattttgctc

SEQ ID NO: 208143 - DNA, 25 bp, Homo sapien
gggcgcacctctccgtcaggtttct

SEQ ID NO: 208144 - DNA, 25 bp, Homo sapien
ttacgagcgttaataggtttgagcc

SEQ ID NO: 208145 - DNA, 25 bp, Homo sapien
gagggaagcgctccattattcatta

SEQ ID NO: 208146 - DNA, 25 bp, Homo sapien
aagcccgagtccgtgtccacctgtt

SEQ ID NO: 208147 - DNA, 25 bp, Homo sapien
ttctgtgacctctcctgacgacatg

SEQ ID NO: 208148 - DNA, 25 bp, Homo sapien
tgtccaccaaatctgacgactcctt

SEQ ID NO: 208149 - DNA, 25 bp, Homo sapien
ttccagagcctacacggcagtctgc

SEQ ID NO: 208150 - DNA, 25 bp, Homo sapien
ggcagtctgccgctcgacagcttct

SEQ ID NO: 208151 - DNA, 25 bp, Homo sapien
gcttctccaagttcgtggcgggtga

SEQ ID NO: 208152 - DNA, 25 bp, Homo sapien
tctactgcaaccaggcccgtggcag

SEQ ID NO: 208153 - DNA, 25 bp, Homo sapien
cctgccagggtcaacagcaactcga

SEQ ID NO: 208154 - DNA, 25 bp, Homo sapien
acctcttcaccctgtaaggggcgtg

SEQ ID NO: 208155 - DNA, 25 bp, Homo sapien
ttcctcttgcaagcggctgaggtca

SEQ ID NO: 208156 - DNA, 25 bp, Homo sapien
aagtacatttcctcttgcaagcggc

SEQ ID NO: 208157 - DNA, 25 bp, Homo sapien
cctgaaatccgcctcaagtacattt

SEQ ID NO: 208158 - DNA, 25 bp, Homo sapien
tggatcccgcagagcctgaaatccg

SEQ ID NO: 208159 - DNA, 25 bp, Homo sapien
ttctcacccttcgtgcgggtggaga

SEQ ID NO: 208160 - DNA, 25 bp, Homo sapien
ttcaccctgtaaggggcgtgccaag

SEQ ID NO: 208161 - DNA, 25 bp, Homo sapien
cgtgccaagcgacgacgacagcagc

SEQ ID NO: 208162 - DNA, 25 bp, Homo sapien
acacattccacgtgggtgctgccgc

SEQ ID NO: 208163 - DNA, 25 bp, Homo sapien
cagaggctgccgtagtaatccaccc

SEQ ID NO: 208164 - DNA, 25 bp, Homo sapien
cgctggtccagagccgatccttgat

SEQ ID NO: 208165 - DNA, 25 bp, Homo sapien
tctcaagacgacgtggcacacattc

SEQ ID NO: 208166 - DNA, 25 bp, Homo sapien
tttgccagatctctcgtgcggttcg

SEQ ID NO: 208167 - DNA, 25 bp, Homo sapien
ggtagacctgggctatgctcagtta

SEQ ID NO: 208168 - DNA, 25 bp, Homo sapien
gggacactttccctctggaatctca

SEQ ID NO: 208169 - DNA, 25 bp, Homo sapien
gagcctttggaacaaaccgtgcgga

SEQ ID NO: 208170 - DNA, 25 bp, Homo sapien
gcgatcgccaagcttctcgagtgtg

SEQ ID NO: 208171 - DNA, 25 bp, Homo sapien
gatcggccaccagaggtcagcacca

SEQ ID NO: 208172 - DNA, 25 bp, Homo sapien
ccgccggtcttagggtcaagatcgc

SEQ ID NO: 208173 - DNA, 25 bp, Homo sapien
aactgtggaggccagagtctcttgc

SEQ ID NO: 208174 - DNA, 25 bp, Homo sapien
tcggccttcaaagcttcgacgcagg

SEQ ID NO: 208175 - DNA, 25 bp, Homo sapien
ccaggcgcatgagcatctgctgaca

SEQ ID NO: 208176 - DNA, 25 bp, Homo sapien
cgcctgcgcacacgaggatgtgtca

SEQ ID NO: 208177 - DNA, 25 bp, Homo sapien
acacggggtctagctggaagtgaca

SEQ ID NO: 208178 - DNA, 25 bp, Homo sapien
ctgccgcctcgctagggcccggccc

SEQ ID NO: 208179 - DNA, 25 bp, Homo sapien
tctgccggggttactggcggtcact

SEQ ID NO: 208180 - DNA, 25 bp, Homo sapien
gccgacttcacctgtcaaggcgcgg

SEQ ID NO: 208181 - DNA, 25 bp, Homo sapien
cttcacctgtcaaggcgcggcggat

SEQ ID NO: 208182 - DNA, 25 bp, Homo sapien
caaggcgcggcggatttttgaagcc

SEQ ID NO: 208183 - DNA, 25 bp, Homo sapien
cggcggatttttgaagccgttgagc

SEQ ID NO: 208184 - DNA, 25 bp, Homo sapien
ttttgaagccgttgagcgctgcggc

SEQ ID NO: 208185 - DNA, 25 bp, Homo sapien
tactggcggtcactggccctcagct

SEQ ID NO: 208186 - DNA, 25 bp, Homo sapien
acggtcaagaagctcggcgcccagc

SEQ ID NO: 208187 - DNA, 25 bp, Homo sapien
cacgtccggggccacggtcaagaag

SEQ ID NO: 208188 - DNA, 25 bp, Homo sapien
cgtccggggccacggtcaagaagct

SEQ ID NO: 208189 - DNA, 25 bp, Homo sapien
ggtcaagaagctcggcgcccagctg

SEQ ID NO: 208190 - DNA, 25 bp, Homo sapien
cctggatcacgtccggggccacggt

SEQ ID NO: 208191 - DNA, 25 bp, Homo sapien
ggccacggtcaagaagctcggcgcc

SEQ ID NO: 208192 - DNA, 25 bp, Homo sapien
tccggggccacggtcaagaagctcg

SEQ ID NO: 208193 - DNA, 25 bp, Homo sapien
cggtcaagaagctcggcgcccagct

SEQ ID NO: 208194 - DNA, 25 bp, Homo sapien
ccacacgaggtaccagacgggagtg

SEQ ID NO: 208195 - DNA, 25 bp, Homo sapien
gttaccgtctcccttcatttcatgg

SEQ ID NO: 208196 - DNA, 25 bp, Homo sapien
tgcgcctggatcacctcttgggcca

SEQ ID NO: 208197 - DNA, 25 bp, Homo sapien
gtcaagaagctcagcacgcccaacg

SEQ ID NO: 208198 - DNA, 25 bp, Homo sapien
aaaccagaccacttgcggcacagca

SEQ ID NO: 208199 - DNA, 25 bp, Homo sapien
tggatcacgtctgcggccactgtca

SEQ ID NO: 208200 - DNA, 25 bp, Homo sapien
cggcacagcacgaggccacacgagg

SEQ ID NO: 208201 - DNA, 25 bp, Homo sapien
gctcaacctcagtacgggtcagtta

SEQ ID NO: 208202 - DNA, 25 bp, Homo sapien
gtgattcatgaagtaagacccgccc

SEQ ID NO: 208203 - DNA, 25 bp, Homo sapien
ttcctattgcgccaccaccgaaatg

SEQ ID NO: 208204 - DNA, 25 bp, Homo sapien
ctgccatctgagacccggtagtacc

SEQ ID NO: 208205 - DNA, 25 bp, Homo sapien
cgccgacatgacaaggcgctgcatg

SEQ ID NO: 208206 - DNA, 25 bp, Homo sapien
ctcacgccggagtcacttccgaaga

SEQ ID NO: 208207 - DNA, 25 bp, Homo sapien
ccgggctccggtttgcttcagcaaa

SEQ ID NO: 208208 - DNA, 25 bp, Homo sapien
cgtgccagccaatcaagacgtgatt

SEQ ID NO: 208209 - DNA, 25 bp, Homo sapien
acttccgaagagagaaccgccatga

SEQ ID NO: 208210 - DNA, 25 bp, Homo sapien
gggaatgaccgtgagtaacctcgca

SEQ ID NO: 208211 - DNA, 25 bp, Homo sapien
atgcgcatgcgcaagagctccgacg

SEQ ID NO: 208212 - DNA, 25 bp, Homo sapien
taacctcgcaattacgtcacggctg

SEQ ID NO: 208213 - DNA, 25 bp, Homo sapien
agcttcagccgtggccatcacaggg

SEQ ID NO: 208214 - DNA, 25 bp, Homo sapien
tcgggacaccgagctcagagacacc

SEQ ID NO: 208215 - DNA, 25 bp, Homo sapien
gacgcaccttcgatgtcggtcagca

SEQ ID NO: 208216 - DNA, 25 bp, Homo sapien
ctccaaagccgcctcgctgaagggt

SEQ ID NO: 208217 - DNA, 25 bp, Homo sapien
gagcgccctccagtcattcatttta

SEQ ID NO: 208218 - DNA, 25 bp, Homo sapien
gcaccggaagggctaacacgggaca

SEQ ID NO: 208219 - DNA, 25 bp, Homo sapien
aggacgcttgtcctgtccagccatg

SEQ ID NO: 208220 - DNA, 25 bp, Homo sapien
tgacgcggcgtcagcgcgtaactcc

SEQ ID NO: 208221 - DNA, 25 bp, Homo sapien
cgcccagagcggaggattccttcca

SEQ ID NO: 208222 - DNA, 25 bp, Homo sapien
caactgggagataggaattcgcatc

SEQ ID NO: 208223 - DNA, 25 bp, Homo sapien
cagcttctgtgggtttcgagccttt

SEQ ID NO: 208224 - DNA, 25 bp, Homo sapien
cctcggcgttgccaactgggagata

SEQ ID NO: 208225 - DNA, 25 bp, Homo sapien
tttcgagccttttcgggcaggcgtc

SEQ ID NO: 208226 - DNA, 25 bp, Homo sapien
gatagcaccggcacccggcgaaggc

SEQ ID NO: 208227 - DNA, 25 bp, Homo sapien
ggtcgttacacctctgtcagcaaag

SEQ ID NO: 208228 - DNA, 25 bp, Homo sapien
ccactctctggaacgccgagcttag

SEQ ID NO: 208229 - DNA, 25 bp, Homo sapien
catcttgggtggacaacacgcagcg

SEQ ID NO: 208230 - DNA, 25 bp, Homo sapien
tgaggtggcacaagcgcccggcaaa

SEQ ID NO: 208231 - DNA, 25 bp, Homo sapien
aggccagacgaccaggatgcccagc

SEQ ID NO: 208232 - DNA, 25 bp, Homo sapien
gcaccgacgcccagtgaaggccaga

SEQ ID NO: 208233 - DNA, 25 bp, Homo sapien
ctaggtcaccggagtccctgtcagc

SEQ ID NO: 208234 - DNA, 25 bp, Homo sapien
gccagaatttccgagctcgccttgg

SEQ ID NO: 208235 - DNA, 25 bp, Homo sapien
tggagatctctatcagcaccctgga

SEQ ID NO: 208236 - DNA, 25 bp, Homo sapien
caccacgagaagctcctggagatct

SEQ ID NO: 208237 - DNA, 25 bp, Homo sapien
gccgggacctggagaatcaccacca

SEQ ID NO: 208238 - DNA, 25 bp, Homo sapien
ggcctttgcttaactcggggctgca

SEQ ID NO: 208239 - DNA, 25 bp, Homo sapien
tctcccgccgtctgagagcatcagg

SEQ ID NO: 208240 - DNA, 25 bp, Homo sapien
gccttgggcccttaaagtctgtctc

SEQ ID NO: 208241 - DNA, 25 bp, Homo sapien
gaggacctgcctaacgacctgcgcg

SEQ ID NO: 208242 - DNA, 25 bp, Homo sapien
gatgcgagacgcgaaacctggagca

SEQ ID NO: 208243 - DNA, 25 bp, Homo sapien
actcgtacgacgtagaggtggtgct

SEQ ID NO: 208244 - DNA, 25 bp, Homo sapien
gcaggaaacacagagcgatgggatc

SEQ ID NO: 208245 - DNA, 25 bp, Homo sapien
tcgggctgtacggaaacctctcaac

SEQ ID NO: 208246 - DNA, 25 bp, Homo sapien
ccgcgcctcggcgaggagactacaa

SEQ ID NO: 208247 - DNA, 25 bp, Homo sapien
cgcgatgccggtccgcaccgagtgt

SEQ ID NO: 208248 - DNA, 25 bp, Homo sapien
cccaaagccgcacggtcgggctgta

SEQ ID NO: 208249 - DNA, 25 bp, Homo sapien
ccaccagaagagcaaggggaactcg

SEQ ID NO: 208250 - DNA, 25 bp, Homo sapien
ggcggaaccgatagtgtctggcact

SEQ ID NO: 208251 - DNA, 25 bp, Homo sapien
gctcgcccggactctgaatcctgga

SEQ ID NO: 208252 - DNA, 25 bp, Homo sapien
caggcgcccacgagaacgctgttct

SEQ ID NO: 208253 - DNA, 25 bp, Homo sapien
ctctgctgctaccatggggatctta

SEQ ID NO: 208254 - DNA, 25 bp, Homo sapien
tcgctcggacacagaagaacaaggg

SEQ ID NO: 208255 - DNA, 25 bp, Homo sapien
ggggaacaactccagcagtaatgct

SEQ ID NO: 208256 - DNA, 25 bp, Homo sapien
cgcggagaagttgccagacaagtgc

SEQ ID NO: 208257 - DNA, 25 bp, Homo sapien
gctctttccagaggtccgcagcctg

SEQ ID NO: 208258 - DNA, 25 bp, Homo sapien
aggcggcctacaaacgcttcggcta

SEQ ID NO: 208259 - DNA, 25 bp, Homo sapien
tgtaccctactttgatccctacgga

SEQ ID NO: 208260 - DNA, 25 bp, Homo sapien
tggctactacctggatccctatgcg

SEQ ID NO: 208261 - DNA, 25 bp, Homo sapien
gcgaggcgcacccttatggctacta

SEQ ID NO: 208262 - DNA, 25 bp, Homo sapien
acccgtatgcccacgccatggatga

SEQ ID NO: 208263 - DNA, 25 bp, Homo sapien
gacgctgtcggagaagaagcccatc

SEQ ID NO: 208264 - DNA, 25 bp, Homo sapien
tcgcttgcgcggttcctcaagaaga

SEQ ID NO: 208265 - DNA, 25 bp, Homo sapien
cggggtactcgtctccttacagcta

SEQ ID NO: 208266 - DNA, 25 bp, Homo sapien
cacggcgacactgttggcaatatga

SEQ ID NO: 208267 - DNA, 25 bp, Homo sapien
cgggacaactataaggcgggcagcc

SEQ ID NO: 208268 - DNA, 25 bp, Homo sapien
agcgcagcgactatgaggagcagca

SEQ ID NO: 208269 - DNA, 25 bp, Homo sapien
cggacctgcgtgagaagctcaagtc

SEQ ID NO: 208270 - DNA, 25 bp, Homo sapien
ccaagcgcaagtatcaggaggactc

SEQ ID NO: 208271 - DNA, 25 bp, Homo sapien
agctcaagtccatgacgtcccggga

SEQ ID NO: 208272 - DNA, 25 bp, Homo sapien
tgacgtcgtgcggagagctttaaag

SEQ ID NO: 208273 - DNA, 25 bp, Homo sapien
caggttgctatttgagagcgttccc

SEQ ID NO: 208274 - DNA, 25 bp, Homo sapien
tccaagcccgggaacgtgcgccaat

SEQ ID NO: 208275 - DNA, 25 bp, Homo sapien
agccccggctcatggactacaagtc

SEQ ID NO: 208276 - DNA, 25 bp, Homo sapien
cggcgcatgctaggcgggcgtccct

SEQ ID NO: 208277 - DNA, 25 bp, Homo sapien
ggggcccagttcaccattgtctggc

SEQ ID NO: 208278 - DNA, 25 bp, Homo sapien
gcccagttcaccattgtctggccaa

SEQ ID NO: 208279 - DNA, 25 bp, Homo sapien
agttcaccattgtctggccaacagg

SEQ ID NO: 208280 - DNA, 25 bp, Homo sapien
ttcaccattgtctggccaacagggg

SEQ ID NO: 208281 - DNA, 25 bp, Homo sapien
tcaccattgtctggccaacaggggc

SEQ ID NO: 208282 - DNA, 25 bp, Homo sapien
aagcgcagtgaggtcagccttcatc

SEQ ID NO: 208283 - DNA, 25 bp, Homo sapien
ctccgcattgcgtgtgtagtccacc

SEQ ID NO: 208284 - DNA, 25 bp, Homo sapien
ccagggaggccatcaactaaccatg

SEQ ID NO: 208285 - DNA, 25 bp, Homo sapien
gcacagctcctgacccagcttgagg

SEQ ID NO: 208286 - DNA, 25 bp, Homo sapien
gtccagaatgtacacgcagcgcgtg

SEQ ID NO: 208287 - DNA, 25 bp, Homo sapien
tcgcgtttcaccttcccggagagac

SEQ ID NO: 208288 - DNA, 25 bp, Homo sapien
tgccgtctaggtcttcgttccactc

SEQ ID NO: 208289 - DNA, 25 bp, Homo sapien
tcatctggtctttcttctcggcgtc

SEQ ID NO: 208290 - DNA, 25 bp, Homo sapien
ccggtcctgcatgacggctctagag

SEQ ID NO: 208291 - DNA, 25 bp, Homo sapien
cggatccgagcgcaaaggtgagcaa

SEQ ID NO: 208292 - DNA, 25 bp, Homo sapien
tgtcctcgagctgcagcagtagaga

SEQ ID NO: 208293 - DNA, 25 bp, Homo sapien
ttagacctgacgaagggagaggacc

SEQ ID NO: 208294 - DNA, 25 bp, Homo sapien
cgggatcgaaggagagcttgtcctc

SEQ ID NO: 208295 - DNA, 25 bp, Homo sapien
attctaccctccaagctgggccagg

SEQ ID NO: 208296 - DNA, 25 bp, Homo sapien
agccgcgcgtcgctgtctctatggc

SEQ ID NO: 208297 - DNA, 25 bp, Homo sapien
tccaagctgggccaggcctttctca

SEQ ID NO: 208298 - DNA, 25 bp, Homo sapien
gggacgagggacctgatacttctca

SEQ ID NO: 208299 - DNA, 25 bp, Homo sapien
gtgccgggctctgagctcacctccc

SEQ ID NO: 208300 - DNA, 25 bp, Homo sapien
atacttctcagcctgggtgaggggc

SEQ ID NO: 208301 - DNA, 25 bp, Homo sapien
ctgatacttctcagcctgggtgagg

SEQ ID NO: 208302 - DNA, 25 bp, Homo sapien
acctgatacttctcagcctgggtga

SEQ ID NO: 208303 - DNA, 25 bp, Homo sapien
gggacctgatacttctcagcctggg

SEQ ID NO: 208304 - DNA, 25 bp, Homo sapien
acgagggacctgatacttctcagcc

SEQ ID NO: 208305 - DNA, 25 bp, Homo sapien
tcccccttgggcgttgtcactgcag

SEQ ID NO: 208306 - DNA, 25 bp, Homo sapien
tgaggtccacgccacgcacgaacgg

SEQ ID NO: 208307 - DNA, 25 bp, Homo sapien
ccgtaacggccgctggtcgaggcac

SEQ ID NO: 208308 - DNA, 25 bp, Homo sapien
tggagttggaggcttccacgatctc

SEQ ID NO: 208309 - DNA, 25 bp, Homo sapien
ctgttcgaagactgcggaggcacca

SEQ ID NO: 208310 - DNA, 25 bp, Homo sapien
cattccgcggggaagtgtaggcttt

SEQ ID NO: 208311 - DNA, 25 bp, Homo sapien
ctcaccttgaagtcgttgccgctga

SEQ ID NO: 208312 - DNA, 25 bp, Homo sapien
ggcctcggaggtccattcctggcca

SEQ ID NO: 208313 - DNA, 25 bp, Homo sapien
aggctttaggcctcttagggcctca

SEQ ID NO: 208314 - DNA, 25 bp, Homo sapien
cccgagtcaccgatgaggagattga

SEQ ID NO: 208315 - DNA, 25 bp, Homo sapien
accgcgcagtattttggcacctgtg

SEQ ID NO: 208316 - DNA, 25 bp, Homo sapien
ttccagggtccttcacgttccattc

SEQ ID NO: 208317 - DNA, 25 bp, Homo sapien
ccaagggcagcgttcgaatcctagc

SEQ ID NO: 208318 - DNA, 25 bp, Homo sapien
tcttggtttatcctgcgaacggggc

SEQ ID NO: 208319 - DNA, 25 bp, Homo sapien
ccgctgcgcaaacttgggttatttt

SEQ ID NO: 208320 - DNA, 25 bp, Homo sapien
cgggacctgcccttcattggctgaa

SEQ ID NO: 208321 - DNA, 25 bp, Homo sapien
acgtcacctgttcgcggtctcggaa

SEQ ID NO: 208322 - DNA, 25 bp, Homo sapien
cctggacgaccatgacgctgggact

SEQ ID NO: 208323 - DNA, 25 bp, Homo sapien
cagcacgaacgcctggagctcactg

SEQ ID NO: 208324 - DNA, 25 bp, Homo sapien
acctctggctgcaggacctgtatcc

SEQ ID NO: 208325 - DNA, 25 bp, Homo sapien
gcttctgtcaactggccggccattg

SEQ ID NO: 208326 - DNA, 25 bp, Homo sapien
gcgtcctgctggagctactccgcaa

SEQ ID NO: 208327 - DNA, 25 bp, Homo sapien
cgcaggacgcagcttgagttctgcc

SEQ ID NO: 208328 - DNA, 25 bp, Homo sapien
tgcaggcctactttcggagcaagtt

SEQ ID NO: 208329 - DNA, 25 bp, Homo sapien
gacctgtatccagtggaggctgcta

SEQ ID NO: 208330 - DNA, 25 bp, Homo sapien
gccttggcgttcatgaggcctcaga

SEQ ID NO: 208331 - DNA, 25 bp, Homo sapien
tgcaggtgatttcgcagcaggtttc

SEQ ID NO: 208332 - DNA, 25 bp, Homo sapien
tagcgggcgacaggaaagatcatcc

SEQ ID NO: 208333 - DNA, 25 bp, Homo sapien
tttttcggccacacagaggactttc

SEQ ID NO: 208334 - DNA, 25 bp, Homo sapien
gcctcagcaccgaatccagtatctt

SEQ ID NO: 208335 - DNA, 25 bp, Homo sapien
ctggcctttggagcttcagtcactg

SEQ ID NO: 208336 - DNA, 25 bp, Homo sapien
gtagcctcgcgttaagccttgttca

SEQ ID NO: 208337 - DNA, 25 bp, Homo sapien
gctcggaagtctacgaggacgcttc

SEQ ID NO: 208338 - DNA, 25 bp, Homo sapien
tcaggaaggtgcactctgcgcgcca

SEQ ID NO: 208339 - DNA, 25 bp, Homo sapien
attcttgccaaaggccacgggccgc

SEQ ID NO: 208340 - DNA, 25 bp, Homo sapien
tcataccgaatgtgcctggaactgg

SEQ ID NO: 208341 - DNA, 25 bp, Homo sapien
cctcccgtcattgcggctgcagagg

SEQ ID NO: 208342 - DNA, 25 bp, Homo sapien
ctggaccgctcgagctcaggaaggt

SEQ ID NO: 208343 - DNA, 25 bp, Homo sapien
cgcccaatcagagagcgcagccaag

SEQ ID NO: 208344 - DNA, 25 bp, Homo sapien
aacgcacccgcgctattggctgcgg

SEQ ID NO: 208345 - DNA, 25 bp, Homo sapien
ccgaacttggcgctggaccgctcga

SEQ ID NO: 208346 - DNA, 25 bp, Homo sapien
ccagcacttcaagcagcacgagctg

SEQ ID NO: 208347 - DNA, 25 bp, Homo sapien
aggactggagcgacctcatggccga

SEQ ID NO: 208348 - DNA, 25 bp, Homo sapien
cagcaggactggagcgacctcatgg

SEQ ID NO: 208349 - DNA, 25 bp, Homo sapien
gactggagcgacctcatggccgacc

SEQ ID NO: 208350 - DNA, 25 bp, Homo sapien
acctcatggccgaccctgcgggcgt

SEQ ID NO: 208351 - DNA, 25 bp, Homo sapien
agcgcatggtggagctgcggcaccc

SEQ ID NO: 208352 - DNA, 25 bp, Homo sapien
agcacttcaagcagcacgagctgct

SEQ ID NO: 208353 - DNA, 25 bp, Homo sapien
tggagcgacctcatggccgaccctg

SEQ ID NO: 208354 - DNA, 25 bp, Homo sapien
acaccagccgtgtgcagcctatcaa

SEQ ID NO: 208355 - DNA, 25 bp, Homo sapien
ccatcatccgcaatgtaaaaggccc

SEQ ID NO: 208356 - DNA, 25 bp, Homo sapien
tccatcatccgcaatgtaaaaggcc

SEQ ID NO: 208357 - DNA, 25 bp, Homo sapien
tgcagcctatcaagctggccagggt

SEQ ID NO: 208358 - DNA, 25 bp, Homo sapien
tgtgcagcctatcaagctggccagg

SEQ ID NO: 208359 - DNA, 25 bp, Homo sapien
ccgtgtgcagcctatcaagctggcc

SEQ ID NO: 208360 - DNA, 25 bp, Homo sapien
cagccgtgtgcagcctatcaagctg

SEQ ID NO: 208361 - DNA, 25 bp, Homo sapien
accagccgtgtgcagcctatcaagc

SEQ ID NO: 208362 - DNA, 25 bp, Homo sapien
ttcctatccctcttgtccacgccag

SEQ ID NO: 208363 - DNA, 25 bp, Homo sapien
cgtgcttgctctcgctgccgacgct

SEQ ID NO: 208364 - DNA, 25 bp, Homo sapien
cgccctcaccgtgcttgctctcgct

SEQ ID NO: 208365 - DNA, 25 bp, Homo sapien
gtctaaggcgccctcaccgtgcttg

SEQ ID NO: 208366 - DNA, 25 bp, Homo sapien
gtggagctcgccaagatcttccagg

SEQ ID NO: 208367 - DNA, 25 bp, Homo sapien
ctctgtggagctcgccaagatcttc

SEQ ID NO: 208368 - DNA, 25 bp, Homo sapien
ggcagctctgtggagctcgccaaga

SEQ ID NO: 208369 - DNA, 25 bp, Homo sapien
tcttgtccacgccagtgtctccagg

SEQ ID NO: 208370 - DNA, 25 bp, Homo sapien
tgcgaggccatgatccgtgcccaac

SEQ ID NO: 208371 - DNA, 25 bp, Homo sapien
cttctgcgaggccatgatccgtgcc

SEQ ID NO: 208372 - DNA, 25 bp, Homo sapien
gcgggcttctgcgaggccatgatcc

SEQ ID NO: 208373 - DNA, 25 bp, Homo sapien
gtgtcttccaaacccaagcctccga

SEQ ID NO: 208374 - DNA, 25 bp, Homo sapien
cgcctgccactgactcctggccgcc

SEQ ID NO: 208375 - DNA, 25 bp, Homo sapien
accggccgcgcctgccactgactcc

SEQ ID NO: 208376 - DNA, 25 bp, Homo sapien
tcctacccggcatcccaccggccgc

SEQ ID NO: 208377 - DNA, 25 bp, Homo sapien
aggccatgatccgtgcccaacgcca

SEQ ID NO: 208378 - DNA, 25 bp, Homo sapien
cgcgccgtcatagctacagcttgga

SEQ ID NO: 208379 - DNA, 25 bp, Homo sapien
tttgcttccgaggtcaaggcgagta

SEQ ID NO: 208380 - DNA, 25 bp, Homo sapien
tagcgacccagtccgttgtggagaa

SEQ ID NO: 208381 - DNA, 25 bp, Homo sapien
tgcagctgctgcacatagcgaccca

SEQ ID NO: 208382 - DNA, 25 bp, Homo sapien
cggtattcggccactactctgggca

SEQ ID NO: 208383 - DNA, 25 bp, Homo sapien
ctcgaccgacttgcagtggatgctc

SEQ ID NO: 208384 - DNA, 25 bp, Homo sapien
tgcggatcacgtccaagcccgactg

SEQ ID NO: 208385 - DNA, 25 bp, Homo sapien
gcttctgcaccagcgtcgagatctc

SEQ ID NO: 208386 - DNA, 25 bp, Homo sapien
ccatgatgggcgacaggcggccact

SEQ ID NO: 208387 - DNA, 25 bp, Homo sapien
tccagctcatcactgctgcgtgacg

SEQ ID NO: 208388 - DNA, 25 bp, Homo sapien
aacggaagtccgtccacgcatccag

SEQ ID NO: 208389 - DNA, 25 bp, Homo sapien
ttggtgcgtgaacggaagtccgtcc

SEQ ID NO: 208390 - DNA, 25 bp, Homo sapien
ggccactgactgtgctggcgttaga

SEQ ID NO: 208391 - DNA, 25 bp, Homo sapien
caactctgtgcttgccatgatgggc

SEQ ID NO: 208392 - DNA, 25 bp, Homo sapien
tggacttcatccaactctgtgcttg

SEQ ID NO: 208393 - DNA, 25 bp, Homo sapien
ctggcgttagaattggtgcgtgaac

SEQ ID NO: 208394 - DNA, 25 bp, Homo sapien
ccgcctactgctgcatgtgcgcgga

SEQ ID NO: 208395 - DNA, 25 bp, Homo sapien
gccacccatcgccacgctgtgcctg

SEQ ID NO: 208396 - DNA, 25 bp, Homo sapien
tgtgcgcggagcacacaataccgtg

SEQ ID NO: 208397 - DNA, 25 bp, Homo sapien
cgccgtccggaccatcgccacccat

SEQ ID NO: 208398 - DNA, 25 bp, Homo sapien
ctggcctcagggctactacgtctgc

SEQ ID NO: 208399 - DNA, 25 bp, Homo sapien
tctccagaaacaaagaaactcccaa

SEQ ID NO: 208400 - DNA, 25 bp, Homo sapien
ggctactacgtctgcgggcacagct

SEQ ID NO: 208401 - DNA, 25 bp, Homo sapien
tacgtctgcgggcacagctcgtcgc

SEQ ID NO: 208402 - DNA, 25 bp, Homo sapien
cacgtacaggatcgcggacggctct

SEQ ID NO: 208403 - DNA, 25 bp, Homo sapien
atcatggagtcggcggccgtctccc

SEQ ID NO: 208404 - DNA, 25 bp, Homo sapien
ctcctcctcggggatcatggagtcg

SEQ ID NO: 208405 - DNA, 25 bp, Homo sapien
cgagtcctcaaggagcagcccggag

SEQ ID NO: 208406 - DNA, 25 bp, Homo sapien
cttggcagggctcgcttggagctcc

SEQ ID NO: 208407 - DNA, 25 bp, Homo sapien
ctttgcaggggccacgtacaggatc

SEQ ID NO: 208408 - DNA, 25 bp, Homo sapien
gagctccggcctttgcaggggccac

SEQ ID NO: 208409 - DNA, 25 bp, Homo sapien
cgtggacgccgcgaaggctccggct

SEQ ID NO: 208410 - DNA, 25 bp, Homo sapien
gccaagaaaaagacggacaagaagc

SEQ ID NO: 208411 - DNA, 25 bp, Homo sapien
agcatgctggcgagcgcgataagaa

SEQ ID NO: 208412 - DNA, 25 bp, Homo sapien
cactcaacgaggaggcgggccgcct

SEQ ID NO: 208413 - DNA, 25 bp, Homo sapien
ccatggccaagaagcatgctggcga

SEQ ID NO: 208414 - DNA, 25 bp, Homo sapien
ccgagtctgcactcaacgaggaggc

SEQ ID NO: 208415 - DNA, 25 bp, Homo sapien
tgagggtcccatggccaagaagcat

SEQ ID NO: 208416 - DNA, 25 bp, Homo sapien
cgtctgctcacagagatccacgggg

SEQ ID NO: 208417 - DNA, 25 bp, Homo sapien
aaaagacggacaagaagcgggcgct

SEQ ID NO: 208418 - DNA, 25 bp, Homo sapien
caggtgggagcacccatggtgaggt

SEQ ID NO: 208419 - DNA, 25 bp, Homo sapien
gaggttgggagaatcggccgatcga

SEQ ID NO: 208420 - DNA, 25 bp, Homo sapien
gtgaggttgggagaatcggccgatc

SEQ ID NO: 208421 - DNA, 25 bp, Homo sapien
catggtgaggttgggagaatcggcc

SEQ ID NO: 208422 - DNA, 25 bp, Homo sapien
cacccatggtgaggttgggagaatc

SEQ ID NO: 208423 - DNA, 25 bp, Homo sapien
ccatggtgaggttgggagaatcggc

SEQ ID NO: 208424 - DNA, 25 bp, Homo sapien
acccatggtgaggttgggagaatcg

SEQ ID NO: 208425 - DNA, 25 bp, Homo sapien
cccatggtgaggttgggagaatcgg

SEQ ID NO: 208426 - DNA, 25 bp, Homo sapien
tttggacaaattctgccgcgctcgg

SEQ ID NO: 208427 - DNA, 25 bp, Homo sapien
cagcatctcctgtgtctaatcctca

SEQ ID NO: 208428 - DNA, 25 bp, Homo sapien
ctggggcatcaggagtttggacaaa

SEQ ID NO: 208429 - DNA, 25 bp, Homo sapien
gactcggcacagaacgacccgggga

SEQ ID NO: 208430 - DNA, 25 bp, Homo sapien
gacgaacttctttggccagctcgga

SEQ ID NO: 208431 - DNA, 25 bp, Homo sapien
caattcccagaagcgccttggcatc

SEQ ID NO: 208432 - DNA, 25 bp, Homo sapien
cttggcatcgccagactccggttct

SEQ ID NO: 208433 - DNA, 25 bp, Homo sapien
ctcgcgagagtatgaggcagcatct

SEQ ID NO: 208434 - DNA, 25 bp, Homo sapien
tgcggcgcagagcaagtacttcttg

SEQ ID NO: 208435 - DNA, 25 bp, Homo sapien
taggaatcggcgacaccgccagagc

SEQ ID NO: 208436 - DNA, 25 bp, Homo sapien
tcttagcttcctgacacccaggggt

SEQ ID NO: 208437 - DNA, 25 bp, Homo sapien
gtctctctttcctcaacccttattg

SEQ ID NO: 208438 - DNA, 25 bp, Homo sapien
caagtacttcttgcggctgtgggga

SEQ ID NO: 208439 - DNA, 25 bp, Homo sapien
gcccgctactcgaactcgaggagga

SEQ ID NO: 208440 - DNA, 25 bp, Homo sapien
gacccgtacgctgctgcgctgacgt

SEQ ID NO: 208441 - DNA, 25 bp, Homo sapien
cgcccattgttaaccagcgcgagtg

SEQ ID NO: 208442 - DNA, 25 bp, Homo sapien
agtcgccattttgctcctagagagg

SEQ ID NO: 208443 - DNA, 25 bp, Homo sapien
agtcaccgcggacgccaatcttgtg

SEQ ID NO: 208444 - DNA, 25 bp, Homo sapien
cccatcgtgccagcccgactccacc

SEQ ID NO: 208445 - DNA, 25 bp, Homo sapien
ccagctaggtgcctccgctgtccgg

SEQ ID NO: 208446 - DNA, 25 bp, Homo sapien
gcccaccggcctcgcagtcaccgcg

SEQ ID NO: 208447 - DNA, 25 bp, Homo sapien
accgcggacgccaatcttgtgcatg

SEQ ID NO: 208448 - DNA, 25 bp, Homo sapien
gccaatcttgtgcatggagtcgcca

SEQ ID NO: 208449 - DNA, 25 bp, Homo sapien
cttgtgcatggagtcgccattttgc

SEQ ID NO: 208450 - DNA, 25 bp, Homo sapien
ctcggtggccctgccatcggtcatg

SEQ ID NO: 208451 - DNA, 25 bp, Homo sapien
ggattccgaagggactcggatgctc

SEQ ID NO: 208452 - DNA, 25 bp, Homo sapien
gacagtttggagtatgggattccga

SEQ ID NO: 208453 - DNA, 25 bp, Homo sapien
taggtgcttcgactgagacagtttg

SEQ ID NO: 208454 - DNA, 25 bp, Homo sapien
ccgtcctggcctttaggtgcttcga

SEQ ID NO: 208455 - DNA, 25 bp, Homo sapien
tttagaatccgatgaggcccactgg

SEQ ID NO: 208456 - DNA, 25 bp, Homo sapien
gggcttgagccctccgtttagaatc

SEQ ID NO: 208457 - DNA, 25 bp, Homo sapien
gcattttgggccagtcttgggctgc

SEQ ID NO: 208458 - DNA, 25 bp, Homo sapien
tgttctcccgcttgagcacctcgta

SEQ ID NO: 208459 - DNA, 25 bp, Homo sapien
gctgctcctcgctgtagaagaactc

SEQ ID NO: 208460 - DNA, 25 bp, Homo sapien
cgccagttcacatggttgtcgtcca

SEQ ID NO: 208461 - DNA, 25 bp, Homo sapien
tgtcgtccagacactgcacctgaga

SEQ ID NO: 208462 - DNA, 25 bp, Homo sapien
tgcctctacgtgcagggaacccata

SEQ ID NO: 208463 - DNA, 25 bp, Homo sapien
tatcccagatttccggagctgcctg

SEQ ID NO: 208464 - DNA, 25 bp, Homo sapien
cgggtcgtacacctcgatggtctcc

SEQ ID NO: 208465 - DNA, 25 bp, Homo sapien
tccaggatgcgcttgagctccagct

SEQ ID NO: 208466 - DNA, 25 bp, Homo sapien
gcgggcctcaggcattagagcccag

SEQ ID NO: 208467 - DNA, 25 bp, Homo sapien
tcactatggacatctggaggcggct

SEQ ID NO: 208468 - DNA, 25 bp, Homo sapien
gcggcgctcatgtcgtcgctgacct

SEQ ID NO: 208469 - DNA, 25 bp, Homo sapien
ggctgatgatcgcagtgatgctggc

SEQ ID NO: 208470 - DNA, 25 bp, Homo sapien
caaggccggacagggtcacacatcc

SEQ ID NO: 208471 - DNA, 25 bp, Homo sapien
ttcccggggctgtctcaaggccgga

SEQ ID NO: 208472 - DNA, 25 bp, Homo sapien
gcaccctcttcactatggacatctg

SEQ ID NO: 208473 - DNA, 25 bp, Homo sapien
ctcaggcattagagcccaggcggga

SEQ ID NO: 208474 - DNA, 25 bp, Homo sapien
gccgccaagttgtttgcacgaaaac

SEQ ID NO: 208475 - DNA, 25 bp, Homo sapien
ccatcgtatctttccggcagcttcg

SEQ ID NO: 208476 - DNA, 25 bp, Homo sapien
ctgcctggcacaagtccatcgtatc

SEQ ID NO: 208477 - DNA, 25 bp, Homo sapien
ttctcgtattcttcgtaccgccctg

SEQ ID NO: 208478 - DNA, 25 bp, Homo sapien
gccctgaacggaggcttcaatcttt

SEQ ID NO: 208479 - DNA, 25 bp, Homo sapien
ggtgcgaccaggagaccagcaaccc

SEQ ID NO: 208480 - DNA, 25 bp, Homo sapien
caaacgatgcttcttggtgcgacca

SEQ ID NO: 208481 - DNA, 25 bp, Homo sapien
cttcggtcctgggaagccgccaagt

SEQ ID NO: 208482 - DNA, 25 bp, Homo sapien
gcctcctgtttcagcggtgacggct

SEQ ID NO: 208483 - DNA, 25 bp, Homo sapien
tttaattttagtcttggcgcgaggc

SEQ ID NO: 208484 - DNA, 25 bp, Homo sapien
tgtgtggcacctcctattgtctctt

SEQ ID NO: 208485 - DNA, 25 bp, Homo sapien
tggcacctcctattgtctctttttg

SEQ ID NO: 208486 - DNA, 25 bp, Homo sapien
ttgtctctttttgcgttttctccca

SEQ ID NO: 208487 - DNA, 25 bp, Homo sapien
tttgcgttttctcccattctcgctc

SEQ ID NO: 208488 - DNA, 25 bp, Homo sapien
tcgctccctcttttgtcgccgtttc

SEQ ID NO: 208489 - DNA, 25 bp, Homo sapien
aaggttttcgcctcctgtttcagcg

SEQ ID NO: 208490 - DNA, 25 bp, Homo sapien
ggagaaaacgcaaaaagagacaata

SEQ ID NO: 208491 - DNA, 25 bp, Homo sapien
gcctcgcgccaagactaaaattaaa

SEQ ID NO: 208492 - DNA, 25 bp, Homo sapien
agccgtcaccgctgaaacaggaggc

SEQ ID NO: 208493 - DNA, 25 bp, Homo sapien
cgctgaaacaggaggcgaaaacctt

SEQ ID NO: 208494 - DNA, 25 bp, Homo sapien
cggcgacaaaagagggagcgagaat

SEQ ID NO: 208495 - DNA, 25 bp, Homo sapien
gagcgagaatgggagaaaacgcaaa

SEQ ID NO: 208496 - DNA, 25 bp, Homo sapien
ccgcctcgcgccaagactaaaatta

SEQ ID NO: 208497 - DNA, 25 bp, Homo sapien
aagagacaataggaggtgccacaca

SEQ ID NO: 208498 - DNA, 25 bp, Homo sapien
gggaaccaaagtttcactgcagacg

SEQ ID NO: 208499 - DNA, 25 bp, Homo sapien
aagccacgattttggccgcgtgcga

SEQ ID NO: 208500 - DNA, 25 bp, Homo sapien
gaattgtggccgtgggcacctcgac

SEQ ID NO: 208501 - DNA, 25 bp, Homo sapien
gtttcactgcagacgggcaggcaga

SEQ ID NO: 208502 - DNA, 25 bp, Homo sapien
tatcgtgctgttagcggacgcgatg

SEQ ID NO: 208503 - DNA, 25 bp, Homo sapien
tagcggacgcgatgctgctttccaa

SEQ ID NO: 208504 - DNA, 25 bp, Homo sapien
ctgggtccagcaggaaacaagggcc

SEQ ID NO: 208505 - DNA, 25 bp, Homo sapien
ggcggggatctctgatcagatttca

SEQ ID NO: 208506 - DNA, 25 bp, Homo sapien
gcgctcgctccgaacacacaggaaa

SEQ ID NO: 208507 - DNA, 25 bp, Homo sapien
ggcgcgccaggtgactcctggcaca

SEQ ID NO: 208508 - DNA, 25 bp, Homo sapien
ctggtcggggttcccagctcgcact

SEQ ID NO: 208509 - DNA, 25 bp, Homo sapien
agctcgcactcctccaggagaaaca

SEQ ID NO: 208510 - DNA, 25 bp, Homo sapien
gagaaacacatcttcgtcctccaga

SEQ ID NO: 208511 - DNA, 25 bp, Homo sapien
gtcctccagaaccttgtccagcaag

SEQ ID NO: 208512 - DNA, 25 bp, Homo sapien
gaaccttgtccagcaagcctatcgc

SEQ ID NO: 208513 - DNA, 25 bp, Homo sapien
aacacacaggaaacgcgcgtcgcga

SEQ ID NO: 208514 - DNA, 25 bp, Homo sapien
agagagagactgacccacccacgca

SEQ ID NO: 208515 - DNA, 25 bp, Homo sapien
accgaggcagaaatgacgggattgc

SEQ ID NO: 208516 - DNA, 25 bp, Homo sapien
gacacagaacgcaagagagagactg

SEQ ID NO: 208517 - DNA, 25 bp, Homo sapien
tggaactacaggtcgccttccggtc

SEQ ID NO: 208518 - DNA, 25 bp, Homo sapien
gcttctggaactacaggtcgccttc

SEQ ID NO: 208519 - DNA, 25 bp, Homo sapien
ttgcggcggcttctggaactacagg

SEQ ID NO: 208520 - DNA, 25 bp, Homo sapien
tttcttagccgcatctcaaggcagc

SEQ ID NO: 208521 - DNA, 25 bp, Homo sapien
cagaaatgacgggattgccgcagac

SEQ ID NO: 208522 - DNA, 25 bp, Homo sapien
ggagcccatccagtcccgatggact

SEQ ID NO: 208523 - DNA, 25 bp, Homo sapien
aacagtgagtgtctcagggtcccga

SEQ ID NO: 208524 - DNA, 25 bp, Homo sapien
aactgtgcaggagagactgtgaccc

SEQ ID NO: 208525 - DNA, 25 bp, Homo sapien
gagtcttggtttcttcctccgtgaa

SEQ ID NO: 208526 - DNA, 25 bp, Homo sapien
atggactgactcctccgtcagcgga

SEQ ID NO: 208527 - DNA, 25 bp, Homo sapien
gcccgcagagacagcgcgccagaga

SEQ ID NO: 208528 - DNA, 25 bp, Homo sapien
aaggagcctgtggatccctcccaga

SEQ ID NO: 208529 - DNA, 25 bp, Homo sapien
cctccgtgaaatggggcttgagcag

SEQ ID NO: 208530 - DNA, 25 bp, Homo sapien
gtattaatttgccagggtttgtgtg

SEQ ID NO: 208531 - DNA, 25 bp, Homo sapien
agtgcgcgcgttcgggtattaattt

SEQ ID NO: 208532 - DNA, 25 bp, Homo sapien
cgctcccgcctctcgagcgctgccg

SEQ ID NO: 208533 - DNA, 25 bp, Homo sapien
cgcgcgttcgggtattaatttgcca

SEQ ID NO: 208534 - DNA, 25 bp, Homo sapien
tggcctgaaggggattagagtgcgc

SEQ ID NO: 208535 - DNA, 25 bp, Homo sapien
gccggagcgtgagtttctgcttgac

SEQ ID NO: 208536 - DNA, 25 bp, Homo sapien
tcaaactgagccagacgcggcggtg

SEQ ID NO: 208537 - DNA, 25 bp, Homo sapien
tgtgtgggtgtcaaactgagccaga

SEQ ID NO: 208538 - DNA, 25 bp, Homo sapien
tgttcacctaacgactcgctccctc

SEQ ID NO: 208539 - DNA, 25 bp, Homo sapien
gagacactcactgttcacctaacga

SEQ ID NO: 208540 - DNA, 25 bp, Homo sapien
acggaggagtcagtccatcgggact

SEQ ID NO: 208541 - DNA, 25 bp, Homo sapien
agtccatcgggactggatgggctcc

SEQ ID NO: 208542 - DNA, 25 bp, Homo sapien
gcgtatcccacgcacagaccgcgca

SEQ ID NO: 208543 - DNA, 25 bp, Homo sapien
gggaccctgagacactcactgttca

SEQ ID NO: 208544 - DNA, 25 bp, Homo sapien
ctccgctgacggaggagtcagtcca

SEQ ID NO: 208545 - DNA, 25 bp, Homo sapien
actcgggaccctgagacactcactg

SEQ ID NO: 208546 - DNA, 25 bp, Homo sapien
cagtctctctcttgcgttctgtgtc

SEQ ID NO: 208547 - DNA, 25 bp, Homo sapien
ctgccttgagatgcggctaagaaac

SEQ ID NO: 208548 - DNA, 25 bp, Homo sapien
gaaggcgacctgtagttccagaagc

SEQ ID NO: 208549 - DNA, 25 bp, Homo sapien
ccacaggccgtccttagcacagccc

SEQ ID NO: 208550 - DNA, 25 bp, Homo sapien
tgggtcagtctctctcttgcgttct

SEQ ID NO: 208551 - DNA, 25 bp, Homo sapien
aatcccgtcatttctgcctcggtct

SEQ ID NO: 208552 - DNA, 25 bp, Homo sapien
gtctgcggcaatcccgtcatttctg

SEQ ID NO: 208553 - DNA, 25 bp, Homo sapien
gaccggaaggcgacctgtagttcca

SEQ ID NO: 208554 - DNA, 25 bp, Homo sapien
acggggccatctgtcagtgacatca

SEQ ID NO: 208555 - DNA, 25 bp, Homo sapien
gttgatatttatcgacggggccatc

SEQ ID NO: 208556 - DNA, 25 bp, Homo sapien
ccaactctagagactgtgatgctga

SEQ ID NO: 208557 - DNA, 25 bp, Homo sapien
ctctgtcgctcagtgaggccttttg

SEQ ID NO: 208558 - DNA, 25 bp, Homo sapien
tcagctacgtctcaggcttctcagg

SEQ ID NO: 208559 - DNA, 25 bp, Homo sapien
aggccttttgcccacagttcggaag

SEQ ID NO: 208560 - DNA, 25 bp, Homo sapien
ctcagattctgacgcgtgaccagca

SEQ ID NO: 208561 - DNA, 25 bp, Homo sapien
cgaagtaacgtcctctccctgcaga

SEQ ID NO: 208562 - DNA, 25 bp, Homo sapien
ctagtcgggagaatgaacggtctgt

SEQ ID NO: 208563 - DNA, 25 bp, Homo sapien
tctgtgtgagagtgtcaccgaattc

SEQ ID NO: 208564 - DNA, 25 bp, Homo sapien
caccgaattcaacgggaagccagca

SEQ ID NO: 208565 - DNA, 25 bp, Homo sapien
cagctctccggttttctccaggtta

SEQ ID NO: 208566 - DNA, 25 bp, Homo sapien
ttcacaggtgggtcccgcaatctta

SEQ ID NO: 208567 - DNA, 25 bp, Homo sapien
tcccatggtatcgttttctggtctc

SEQ ID NO: 208568 - DNA, 25 bp, Homo sapien
tctcagttcttctccttcacaggtg

SEQ ID NO: 208569 - DNA, 25 bp, Homo sapien
gcgtcgaccttctttttgcgtccta

SEQ ID NO: 208570 - DNA, 25 bp, Homo sapien
tgagaatcctccaccagagctgcca

SEQ ID NO: 208571 - DNA, 25 bp, Homo sapien
ggctctgctgttgctacccgatgaa

SEQ ID NO: 208572 - DNA, 25 bp, Homo sapien
catggtgggcgactcatcgatgtac

SEQ ID NO: 208573 - DNA, 25 bp, Homo sapien
tcgatgtacggcatggtctctgagc

SEQ ID NO: 208574 - DNA, 25 bp, Homo sapien
ctcgtccgtcccgtagctgaagtct

SEQ ID NO: 208575 - DNA, 25 bp, Homo sapien
tctgagacaaggaacaagaaaggcc

SEQ ID NO: 208576 - DNA, 25 bp, Homo sapien
caagaaaggccactgagaatcctcc

SEQ ID NO: 208577 - DNA, 25 bp, Homo sapien
acccgatgaagagcatgtcagccgc

SEQ ID NO: 208578 - DNA, 25 bp, Homo sapien
cagctttccgctgcaaggatctccc

SEQ ID NO: 208579 - DNA, 25 bp, Homo sapien
gtccttatctctgtccgggatcccg

SEQ ID NO: 208580 - DNA, 25 bp, Homo sapien
ggggtccttatctctgtccgggatc

SEQ ID NO: 208581 - DNA, 25 bp, Homo sapien
ctggagccccgttcatcttggaaca

SEQ ID NO: 208582 - DNA, 25 bp, Homo sapien
ttactcctacctcggatcctggagc

SEQ ID NO: 208583 - DNA, 25 bp, Homo sapien
tcaccgagcatctccttttatgtcc

SEQ ID NO: 208584 - DNA, 25 bp, Homo sapien
ttacccgtccctatcaccgagcatc

SEQ ID NO: 208585 - DNA, 25 bp, Homo sapien
atcccgcccgtctcacctttcctgg

SEQ ID NO: 208586 - DNA, 25 bp, Homo sapien
accaggagcactattcccggccggg

SEQ ID NO: 208587 - DNA, 25 bp, Homo sapien
ccacgcgagccggaaacaaccagga

SEQ ID NO: 208588 - DNA, 25 bp, Homo sapien
gccggaaacaaccaggagcactatt

SEQ ID NO: 208589 - DNA, 25 bp, Homo sapien
ctctgtaccacagctcccaaggtcc

SEQ ID NO: 208590 - DNA, 25 bp, Homo sapien
gctggcaaccatgccgacccaaaag

SEQ ID NO: 208591 - DNA, 25 bp, Homo sapien
ctctccgtctctgaggtgggcacca

SEQ ID NO: 208592 - DNA, 25 bp, Homo sapien
gccgccgacacacccacgcgagccg

SEQ ID NO: 208593 - DNA, 25 bp, Homo sapien
gagggtcgctggcaaccatgccgac

SEQ ID NO: 208594 - DNA, 25 bp, Homo sapien
gtgacctcggtactagctcaacatc

SEQ ID NO: 208595 - DNA, 25 bp, Homo sapien
cctgcccgttgaccatgagtagaaa

SEQ ID NO: 208596 - DNA, 25 bp, Homo sapien
ttgccctagaaacagacggcgtagc

SEQ ID NO: 208597 - DNA, 25 bp, Homo sapien
caggacacgtttcttggcagcgaca

SEQ ID NO: 208598 - DNA, 25 bp, Homo sapien
gacctgtcgggtaaagccagcccta

SEQ ID NO: 208599 - DNA, 25 bp, Homo sapien
acgtgaccacagctgtcggggctaa

SEQ ID NO: 208600 - DNA, 25 bp, Homo sapien
ctcctgccagtgatccaagcaagtg

SEQ ID NO: 208601 - DNA, 25 bp, Homo sapien
acgccctcagcaagccgagtgttta

SEQ ID NO: 208602 - DNA, 25 bp, Homo sapien
tcgggagccagtagccaaggtaaca

SEQ ID NO: 208603 - DNA, 25 bp, Homo sapien
aatggcggacacaattccctgggcg

SEQ ID NO: 208604 - DNA, 25 bp, Homo sapien
cgcttctgcccttgtcggtttagga

SEQ ID NO: 208605 - DNA, 25 bp, Homo sapien
ctggggtagctagtctgccacgaac

SEQ ID NO: 208606 - DNA, 25 bp, Homo sapien
gagcctcgggacctctgaaagcctt

SEQ ID NO: 208607 - DNA, 25 bp, Homo sapien
gctgcggcctttgaacaagtaagtg

SEQ ID NO: 208608 - DNA, 25 bp, Homo sapien
caggggcgttgccttccattcactt

SEQ ID NO: 208609 - DNA, 25 bp, Homo sapien
ctccgcagcagtagctcagcgattg

SEQ ID NO: 208610 - DNA, 25 bp, Homo sapien
atgctccagcgcgtctgtgttcccg

SEQ ID NO: 208611 - DNA, 25 bp, Homo sapien
caacgtcgccgcttcacaggaggca

SEQ ID NO: 208612 - DNA, 25 bp, Homo sapien
gccgcttcacaggaggcagggcacc

SEQ ID NO: 208613 - DNA, 25 bp, Homo sapien
agcggcgaccgcgaacgcctctgac

SEQ ID NO: 208614 - DNA, 25 bp, Homo sapien
ctcctcctgggcatctccttaatcc

SEQ ID NO: 208615 - DNA, 25 bp, Homo sapien
gcagttcaggctgggatgctccagc

SEQ ID NO: 208616 - DNA, 25 bp, Homo sapien
tctgtgttcccgcaccggagaaacc

SEQ ID NO: 208617 - DNA, 25 bp, Homo sapien
accggagaaaccacactcgctagcg

SEQ ID NO: 208618 - DNA, 25 bp, Homo sapien
cactccttgcgggagtcggagtctc

SEQ ID NO: 208619 - DNA, 25 bp, Homo sapien
ggtgagactacttgaccctgaggaa

SEQ ID NO: 208620 - DNA, 25 bp, Homo sapien
gctgtcaatgcgtgaaagatggtta

SEQ ID NO: 208621 - DNA, 25 bp, Homo sapien
agcacggcgtgtaagaagttgtctg

SEQ ID NO: 208622 - DNA, 25 bp, Homo sapien
aaccctgtccatggagctaaaaata

SEQ ID NO: 208623 - DNA, 25 bp, Homo sapien
agaggggctcagtctgttcttgtga

SEQ ID NO: 208624 - DNA, 25 bp, Homo sapien
aatgcatgagtgtaaacgctccctc

SEQ ID NO: 208625 - DNA, 25 bp, Homo sapien
tggaatattgtctgccgtgaggctg

SEQ ID NO: 208626 - DNA, 25 bp, Homo sapien
gtctttgcaagacccgcaggcgtcc

SEQ ID NO: 208627 - DNA, 25 bp, Homo sapien
ggagcgcgttccgttagtttacaga

SEQ ID NO: 208628 - DNA, 25 bp, Homo sapien
gtccttccacgccaggtcattcaga

SEQ ID NO: 208629 - DNA, 25 bp, Homo sapien
caggagttccttggtctttgcaaga

SEQ ID NO: 208630 - DNA, 25 bp, Homo sapien
cgcgcgagtcacatggaagctcctg

SEQ ID NO: 208631 - DNA, 25 bp, Homo sapien
ttccgagaagagctgcgggcgctct

SEQ ID NO: 208632 - DNA, 25 bp, Homo sapien
ggacctggtgatttctgcctccgcg

SEQ ID NO: 208633 - DNA, 25 bp, Homo sapien
tttgccttccaagtgcaggagttcc

SEQ ID NO: 208634 - DNA, 25 bp, Homo sapien
cctccgcagtttcttgcgcagttga

SEQ ID NO: 208635 - DNA, 25 bp, Homo sapien
tgcgcagttgatgatctttataatc

SEQ ID NO: 208636 - DNA, 25 bp, Homo sapien
tataatcagcctcgtcagctccatc

SEQ ID NO: 208637 - DNA, 25 bp, Homo sapien
tcgtcagctccatcttctgtggaca

SEQ ID NO: 208638 - DNA, 25 bp, Homo sapien
tcttctgtggacatctgggcaaggt

SEQ ID NO: 208639 - DNA, 25 bp, Homo sapien
cgtcacggtgggtgcctgatttcgc

SEQ ID NO: 208640 - DNA, 25 bp, Homo sapien
tgtgaacgcgccttgctttccgcgc

SEQ ID NO: 208641 - DNA, 25 bp, Homo sapien
aaggtcgagccggacgctgtcacgc

SEQ ID NO: 208642 - DNA, 25 bp, Homo sapien
tctcagcaggatggccaacaccttc

SEQ ID NO: 208643 - DNA, 25 bp, Homo sapien
gaagctctgagtaacggacgtgcga

SEQ ID NO: 208644 - DNA, 25 bp, Homo sapien
cccaggccaataggggtgaggcttt

SEQ ID NO: 208645 - DNA, 25 bp, Homo sapien
gtccatctggccatgtttgaagagc

SEQ ID NO: 208646 - DNA, 25 bp, Homo sapien
taggcctccaactacgtccatctgg

SEQ ID NO: 208647 - DNA, 25 bp, Homo sapien
cctcagggactagctctccagggaa

SEQ ID NO: 208648 - DNA, 25 bp, Homo sapien
tgcaagaaggaaatgaccgctgtcc

SEQ ID NO: 208649 - DNA, 25 bp, Homo sapien
tgcaggagcgcgagaaggatatcct

SEQ ID NO: 208650 - DNA, 25 bp, Homo sapien
gacattcctaaatcccgcgcgggga

SEQ ID NO: 208651 - DNA, 25 bp, Homo sapien
gctgggtgttgaggaagagcgccca

SEQ ID NO: 208652 - DNA, 25 bp, Homo sapien
atcacgcccacgtgcttcttgttgg

SEQ ID NO: 208653 - DNA, 25 bp, Homo sapien
gcccacgtgcttcttgttggggctg

SEQ ID NO: 208654 - DNA, 25 bp, Homo sapien
ggctgccgaagctctgcaaaacagc

SEQ ID NO: 208655 - DNA, 25 bp, Homo sapien
cccgcgtcagccgtttccactgccc

SEQ ID NO: 208656 - DNA, 25 bp, Homo sapien
tccactgcccgggacattcctaaat

SEQ ID NO: 208657 - DNA, 25 bp, Homo sapien
cacctggacacgtccgggtcctgcc

SEQ ID NO: 208658 - DNA, 25 bp, Homo sapien
gctggcatgaaacaccgggcttttt

SEQ ID NO: 208659 - DNA, 25 bp, Homo sapien
accgcaggtcctaactcagagcagc

SEQ ID NO: 208660 - DNA, 25 bp, Homo sapien
gttggcaccgcagcactcgactggc

SEQ ID NO: 208661 - DNA, 25 bp, Homo sapien
cgccagggcgcgcaaacaggaagcc

SEQ ID NO: 208662 - DNA, 25 bp, Homo sapien
cggagaccggctggcatgaaacacc

SEQ ID NO: 208663 - DNA, 25 bp, Homo sapien
aaagcgaggcttcgcccacgcacgt

SEQ ID NO: 208664 - DNA, 25 bp, Homo sapien
ctttttgaggtcaaagcgaggcttc

SEQ ID NO: 208665 - DNA, 25 bp, Homo sapien
gtcctgtgtgccacgtgacagcctc

SEQ ID NO: 208666 - DNA, 25 bp, Homo sapien
tgccattctctgttgaagaagtggg

SEQ ID NO: 208667 - DNA, 25 bp, Homo sapien
ccgccacctgtacgagtgctgcaga

SEQ ID NO: 208668 - DNA, 25 bp, Homo sapien
ggccacgctccacaaagggaacttc

SEQ ID NO: 208669 - DNA, 25 bp, Homo sapien
cattcaggttaatggaggtgttgcc

SEQ ID NO: 208670 - DNA, 25 bp, Homo sapien
ggcaacgtcactccatcgagccttg

SEQ ID NO: 208671 - DNA, 25 bp, Homo sapien
acgtggcgcatctgagaacctattc

SEQ ID NO: 208672 - DNA, 25 bp, Homo sapien
aatctcccaaggtgggacgcccgtg

SEQ ID NO: 208673 - DNA, 25 bp, Homo sapien
ggaacttcagcgatacggaaatctc

SEQ ID NO: 208674 - DNA, 25 bp, Homo sapien
gaactgcagcggacgggtcctgccc

SEQ ID NO: 208675 - DNA, 25 bp, Homo sapien
cccgacactggcagaaggcggccgc

SEQ ID NO: 208676 - DNA, 25 bp, Homo sapien
ctgaacctctctgggtcgcactctc

SEQ ID NO: 208677 - DNA, 25 bp, Homo sapien
gcccagcctgagcaccttgtgcagg

SEQ ID NO: 208678 - DNA, 25 bp, Homo sapien
gggcgcgcttcacggcctcgctgat

SEQ ID NO: 208679 - DNA, 25 bp, Homo sapien
atccggaactgcagcggacgggtcc

SEQ ID NO: 208680 - DNA, 25 bp, Homo sapien
accttgtgcaggtctgcggccagcg

SEQ ID NO: 208681 - DNA, 25 bp, Homo sapien
tcgctgatcttgctcatggcgcctg

SEQ ID NO: 208682 - DNA, 25 bp, Homo sapien
catgccgagagaccggagcggaaac

SEQ ID NO: 208683 - DNA, 25 bp, Homo sapien
tgccagaggcttgggcctcacaaca

SEQ ID NO: 208684 - DNA, 25 bp, Homo sapien
aaaacaaacggcgagacgggctgcg

SEQ ID NO: 208685 - DNA, 25 bp, Homo sapien
acgggctgcgcgcacaatagcatac

SEQ ID NO: 208686 - DNA, 25 bp, Homo sapien
gcacaatagcatacccgggcggcta

SEQ ID NO: 208687 - DNA, 25 bp, Homo sapien
gatccctcttgctgtactcgaagtc

SEQ ID NO: 208688 - DNA, 25 bp, Homo sapien
cgggcggactctcatgccgagagac

SEQ ID NO: 208689 - DNA, 25 bp, Homo sapien
agtgcggcgcaggtatcagcaccgc

SEQ ID NO: 208690 - DNA, 25 bp, Homo sapien
gcgctctggaaaaccagagttcacg

SEQ ID NO: 208691 - DNA, 25 bp, Homo sapien
aatcgtttctgcacaccgactcaga

SEQ ID NO: 208692 - DNA, 25 bp, Homo sapien
gggccctcttcgcagagaatcgttt

SEQ ID NO: 208693 - DNA, 25 bp, Homo sapien
ggtcccttgactgcgagaagctggt

SEQ ID NO: 208694 - DNA, 25 bp, Homo sapien
tgacaggcgggattctgcacctttt

SEQ ID NO: 208695 - DNA, 25 bp, Homo sapien
cttaggatccctagagggacggtga

SEQ ID NO: 208696 - DNA, 25 bp, Homo sapien
tctcggggtttactcgcttaggatc

SEQ ID NO: 208697 - DNA, 25 bp, Homo sapien
agagttcacgctgccaaactgccag

SEQ ID NO: 208698 - DNA, 25 bp, Homo sapien
tcctgctcctccgtttgagttttgc

SEQ ID NO: 208699 - DNA, 25 bp, Homo sapien
actcctctgacctcgcgcaagaagg

SEQ ID NO: 208700 - DNA, 25 bp, Homo sapien
tgaaccagcgcgacaatactcctct

SEQ ID NO: 208701 - DNA, 25 bp, Homo sapien
ctcagctacctttccgccggaagaa

SEQ ID NO: 208702 - DNA, 25 bp, Homo sapien
tgcactagcgcgaaaagggaccctt

SEQ ID NO: 208703 - DNA, 25 bp, Homo sapien
ttgagttttgctcacaggcgctggc

SEQ ID NO: 208704 - DNA, 25 bp, Homo sapien
gtacccttcaaattgtgcccttcta

SEQ ID NO: 208705 - DNA, 25 bp, Homo sapien
cagctgttttgtggcgtctgtcgcc

SEQ ID NO: 208706 - DNA, 25 bp, Homo sapien
agaagcggcaattgcaggacgactt

SEQ ID NO: 208707 - DNA, 25 bp, Homo sapien
ggcaattgcaggacgacttcgcaca

SEQ ID NO: 208708 - DNA, 25 bp, Homo sapien
gggcacagcgggcccaacagctgct

SEQ ID NO: 208709 - DNA, 25 bp, Homo sapien
cactggcagcgagagcgtgaggccc

SEQ ID NO: 208710 - DNA, 25 bp, Homo sapien
gcctgcaggcatacgaggagcggca

SEQ ID NO: 208711 - DNA, 25 bp, Homo sapien
ctgcgccaccttggagcgggagcag

SEQ ID NO: 208712 - DNA, 25 bp, Homo sapien
agctgctgcaggagcgcgaacagct

SEQ ID NO: 208713 - DNA, 25 bp, Homo sapien
aggacgacttcgcacagctgctgca

SEQ ID NO: 208714 - DNA, 25 bp, Homo sapien
ccagggatccgagatgccctcggga

SEQ ID NO: 208715 - DNA, 25 bp, Homo sapien
aatggacgcggtctggccgcttcct

SEQ ID NO: 208716 - DNA, 25 bp, Homo sapien
cctcgggagccaatctgtgttcttg

SEQ ID NO: 208717 - DNA, 25 bp, Homo sapien
atctgtgttcttggcggaccacacc

SEQ ID NO: 208718 - DNA, 25 bp, Homo sapien
attggctgaagccaaggacccgggc

SEQ ID NO: 208719 - DNA, 25 bp, Homo sapien
aaaaccttggatcgtgcatcccacc

SEQ ID NO: 208720 - DNA, 25 bp, Homo sapien
caccaaagggagattggctgaagcc

SEQ ID NO: 208721 - DNA, 25 bp, Homo sapien
gctgtctgtagccaataaaaccttg

SEQ ID NO: 208722 - DNA, 25 bp, Homo sapien
agagccaggtggctcccgacagctg

SEQ ID NO: 208723 - DNA, 25 bp, Homo sapien
gggtccctctcctgagcatcagtga

SEQ ID NO: 208724 - DNA, 25 bp, Homo sapien
gcaccctccctgttgtgccttgggg

SEQ ID NO: 208725 - DNA, 25 bp, Homo sapien
cggtgagtactagccgcgccgccag

SEQ ID NO: 208726 - DNA, 25 bp, Homo sapien
ctgcctttctgggaaggcgtgctgc

SEQ ID NO: 208727 - DNA, 25 bp, Homo sapien
gcggtccgggtactacatctcccag

SEQ ID NO: 208728 - DNA, 25 bp, Homo sapien
cagccctcgccgcagtgggacaggt

SEQ ID NO: 208729 - DNA, 25 bp, Homo sapien
cctcagccgcgtggtctgaagggat

SEQ ID NO: 208730 - DNA, 25 bp, Homo sapien
ccgcgactgttcctaacccagaata

SEQ ID NO: 208731 - DNA, 25 bp, Homo sapien
tgcgccgcttgggattgtgaaatta

SEQ ID NO: 208732 - DNA, 25 bp, Homo sapien
aaacgctgctcgtcctgaacgcgca

SEQ ID NO: 208733 - DNA, 25 bp, Homo sapien
aacccagaatagtccgtgcttgttc

SEQ ID NO: 208734 - DNA, 25 bp, Homo sapien
gcctcaccgcagtggggtttttcca

SEQ ID NO: 208735 - DNA, 25 bp, Homo sapien
gtttttccagcctaccttgtgcagc

SEQ ID NO: 208736 - DNA, 25 bp, Homo sapien
gcgcccggtcctttctttgactgga

SEQ ID NO: 208737 - DNA, 25 bp, Homo sapien
gtcggccaagcatgggcaaccactc

SEQ ID NO: 208738 - DNA, 25 bp, Homo sapien
caagcacggtgagggcgccttagac

SEQ ID NO: 208739 - DNA, 25 bp, Homo sapien
tggccgaggcagtagctcgctactg

SEQ ID NO: 208740 - DNA, 25 bp, Homo sapien
aaaccgcgggctatcctgctgggag

SEQ ID NO: 208741 - DNA, 25 bp, Homo sapien
ctcctttcgcagattggaaaccgcg

SEQ ID NO: 208742 - DNA, 25 bp, Homo sapien
gcggtcctcctttcgcagattggaa

SEQ ID NO: 208743 - DNA, 25 bp, Homo sapien
cagtgatcgcttggcttggcatttc

SEQ ID NO: 208744 - DNA, 25 bp, Homo sapien
ctggaagatcttggcgagctccaca

SEQ ID NO: 208745 - DNA, 25 bp, Homo sapien
tcttggcgagctccacagagctgcc

SEQ ID NO: 208746 - DNA, 25 bp, Homo sapien
ctagcgtgcaaggcgccgcggctca

SEQ ID NO: 208747 - DNA, 25 bp, Homo sapien
ggctgaggaaataccggacacggtc

SEQ ID NO: 208748 - DNA, 25 bp, Homo sapien
gctgaggaaataccggacacggtca

SEQ ID NO: 208749 - DNA, 25 bp, Homo sapien
ccagctctagcctttaaattcccgg

SEQ ID NO: 208750 - DNA, 25 bp, Homo sapien
taccggacacggtcacccgttgcca

SEQ ID NO: 208751 - DNA, 25 bp, Homo sapien
acccgttgccagctctagcctttaa

SEQ ID NO: 208752 - DNA, 25 bp, Homo sapien
cgttgccagctctagcctttaaatt

SEQ ID NO: 208753 - DNA, 25 bp, Homo sapien
gccagctctagcctttaaattcccg

SEQ ID NO: 208754 - DNA, 25 bp, Homo sapien
tcccggaaccgatgagcaacttcgc

SEQ ID NO: 208755 - DNA, 25 bp, Homo sapien
tggcgatccgcaaaccaggtgccgt

SEQ ID NO: 208756 - DNA, 25 bp, Homo sapien
ggaccgcaggaatcctctctgggga

SEQ ID NO: 208757 - DNA, 25 bp, Homo sapien
tgcctgggtcccgatcccgatcttg

SEQ ID NO: 208758 - DNA, 25 bp, Homo sapien
tactgctgtagagggtgtcgatcca

SEQ ID NO: 208759 - DNA, 25 bp, Homo sapien
cggctcggtcagatccgaaacccga

SEQ ID NO: 208760 - DNA, 25 bp, Homo sapien
ccctcatcgcgcaacaaaggaggga

SEQ ID NO: 208761 - DNA, 25 bp, Homo sapien
gagcccacaggggtgacatcacctc

SEQ ID NO: 208762 - DNA, 25 bp, Homo sapien
atgcctagctagcaataactttaga

SEQ ID NO: 208763 - DNA, 25 bp, Homo sapien
tcaagaacacaatatctggaccctt

SEQ ID NO: 208764 - DNA, 25 bp, Homo sapien
ctttcctgaacataaaatgcctagc

SEQ ID NO: 208765 - DNA, 25 bp, Homo sapien
tcagtgtctttctaactgggaaatt

SEQ ID NO: 208766 - DNA, 25 bp, Homo sapien
acaatcagtgtctttctaactggga

SEQ ID NO: 208767 - DNA, 25 bp, Homo sapien
tttgaatccacaatcagtgtctttc

SEQ ID NO: 208768 - DNA, 25 bp, Homo sapien
ggacccttgatttgaatccacaatc

SEQ ID NO: 208769 - DNA, 25 bp, Homo sapien
cacaatatctggacccttgatttga

SEQ ID NO: 208770 - DNA, 25 bp, Homo sapien
tggaaagcctgcaggaaactcgaga

SEQ ID NO: 208771 - DNA, 25 bp, Homo sapien
gcctgcaggaaactcgagacaaaga

SEQ ID NO: 208772 - DNA, 25 bp, Homo sapien
agcctgcaggaaactcgagacaaag

SEQ ID NO: 208773 - DNA, 25 bp, Homo sapien
aagcctgcaggaaactcgagacaaa

SEQ ID NO: 208774 - DNA, 25 bp, Homo sapien
aaagcctgcaggaaactcgagacaa

SEQ ID NO: 208775 - DNA, 25 bp, Homo sapien
gaaagcctgcaggaaactcgagaca

SEQ ID NO: 208776 - DNA, 25 bp, Homo sapien
ggaaagcctgcaggaaactcgagac

SEQ ID NO: 208777 - DNA, 25 bp, Homo sapien
cctgcaggaaactcgagacaaagac

SEQ ID NO: 208778 - DNA, 25 bp, Homo sapien
ggacagagacatttaaaggcctgaa

SEQ ID NO: 208779 - DNA, 25 bp, Homo sapien
gatcttcgaacccactgaaaaagca

SEQ ID NO: 208780 - DNA, 25 bp, Homo sapien
tcttcgaacccactgaaaaagcaca

SEQ ID NO: 208781 - DNA, 25 bp, Homo sapien
aagacagaggcaaacgcaacgctgg

SEQ ID NO: 208782 - DNA, 25 bp, Homo sapien
gacagaggcaaacgcaacgctggga

SEQ ID NO: 208783 - DNA, 25 bp, Homo sapien
agaggcaaacgcaacgctgggaaga

SEQ ID NO: 208784 - DNA, 25 bp, Homo sapien
ctgatcttcgaacccactgaaaaag

SEQ ID NO: 208785 - DNA, 25 bp, Homo sapien
ctctgatcttcgaacccactgaaaa

SEQ ID NO: 208786 - DNA, 25 bp, Homo sapien
gaagcctgttcccaggagctgcagc

SEQ ID NO: 208787 - DNA, 25 bp, Homo sapien
cctggcagagagtgatgaggccaaa

SEQ ID NO: 208788 - DNA, 25 bp, Homo sapien
cccgtgctacgctgcgggtcagtga

SEQ ID NO: 208789 - DNA, 25 bp, Homo sapien
ggagctgcagcgacaccgccaggaa

SEQ ID NO: 208790 - DNA, 25 bp, Homo sapien
agaaagctgggcagttggatgctga

SEQ ID NO: 208791 - DNA, 25 bp, Homo sapien
ccaccgctgacccattcctcctggc

SEQ ID NO: 208792 - DNA, 25 bp, Homo sapien
agcgacaccgccaggaagctgagca

SEQ ID NO: 208793 - DNA, 25 bp, Homo sapien
tcctcctggcagagagtgatgaggc

SEQ ID NO: 208794 - DNA, 25 bp, Homo sapien
cgcacctttgacgtcactgaacctg

SEQ ID NO: 208795 - DNA, 25 bp, Homo sapien
ttgacgtcactgaacctgtgccttc

SEQ ID NO: 208796 - DNA, 25 bp, Homo sapien
gcacctttgacgtcactgaacctgt

SEQ ID NO: 208797 - DNA, 25 bp, Homo sapien
tgcgcacctttgacgtcactgaacc

SEQ ID NO: 208798 - DNA, 25 bp, Homo sapien
cctgcgcacctttgacgtcactgaa

SEQ ID NO: 208799 - DNA, 25 bp, Homo sapien
gcctgcgcacctttgacgtcactga

SEQ ID NO: 208800 - DNA, 25 bp, Homo sapien
taaggccaagccacgcgggtaaggc

SEQ ID NO: 208801 - DNA, 25 bp, Homo sapien
acctttgacgtcactgaacctgtgc

SEQ ID NO: 208802 - DNA, 25 bp, Homo sapien
gcttgaacaggccagggagccacga

SEQ ID NO: 208803 - DNA, 25 bp, Homo sapien
ctgagcccagagaaacgacctggaa

SEQ ID NO: 208804 - DNA, 25 bp, Homo sapien
tggaaaggaagcttctcacagaatg

SEQ ID NO: 208805 - DNA, 25 bp, Homo sapien
cttctcacagaatgcggcgcggaca

SEQ ID NO: 208806 - DNA, 25 bp, Homo sapien
ccgagcaggggatctggaaagcact

SEQ ID NO: 208807 - DNA, 25 bp, Homo sapien
aagtgtccctaccaggcgagtggcc

SEQ ID NO: 208808 - DNA, 25 bp, Homo sapien
cgcgcagaggcctcctcaatgcagg

SEQ ID NO: 208809 - DNA, 25 bp, Homo sapien
cccgcgctgtgacatcattgatgac

SEQ ID NO: 208810 - DNA, 25 bp, Homo sapien
cagctcccgtccaaggtcgctcctg

SEQ ID NO: 208811 - DNA, 25 bp, Homo sapien
cggcgggtgaccgctgcagaccaac

SEQ ID NO: 208812 - DNA, 25 bp, Homo sapien
gtccaaggtcgctcctggcggcggg

SEQ ID NO: 208813 - DNA, 25 bp, Homo sapien
cccgtccaaggtcgctcctggcggc

SEQ ID NO: 208814 - DNA, 25 bp, Homo sapien
ctcccgtccaaggtcgctcctggcg

SEQ ID NO: 208815 - DNA, 25 bp, Homo sapien
gctcccgtccaaggtcgctcctggc

SEQ ID NO: 208816 - DNA, 25 bp, Homo sapien
agctcccgtccaaggtcgctcctgg

SEQ ID NO: 208817 - DNA, 25 bp, Homo sapien
ggcgggtgaccgctgcagaccaacg

SEQ ID NO: 208818 - DNA, 25 bp, Homo sapien
gaccgcccaccgaagtcccaggctc

SEQ ID NO: 208819 - DNA, 25 bp, Homo sapien
ggaaggataggaagatgaggagata

SEQ ID NO: 208820 - DNA, 25 bp, Homo sapien
ccgcaaggacctcgcgcaggaacgc

SEQ ID NO: 208821 - DNA, 25 bp, Homo sapien
agaaccaggagagttccccgcaagg

SEQ ID NO: 208822 - DNA, 25 bp, Homo sapien
tgcacccgcatccagccccgaaccc

SEQ ID NO: 208823 - DNA, 25 bp, Homo sapien
ttctttctctgcacccgcatccagc

SEQ ID NO: 208824 - DNA, 25 bp, Homo sapien
gcccagaactcgacagccccccatc

SEQ ID NO: 208825 - DNA, 25 bp, Homo sapien
agaccaacgcccagaactcgacagc

SEQ ID NO: 208826 - DNA, 25 bp, Homo sapien
tcataggctctcagtatagtccgtc

SEQ ID NO: 208827 - DNA, 25 bp, Homo sapien
acaaagatggggctgcgcgatcgcc

SEQ ID NO: 208828 - DNA, 25 bp, Homo sapien
ggccgcggacggagattacgtcacc

SEQ ID NO: 208829 - DNA, 25 bp, Homo sapien
cggcaccttcggctattgtcatagg

SEQ ID NO: 208830 - DNA, 25 bp, Homo sapien
agtccgtctggtacagagccgcctc

SEQ ID NO: 208831 - DNA, 25 bp, Homo sapien
ggcgcgagacgtcagtcctagcact

SEQ ID NO: 208832 - DNA, 25 bp, Homo sapien
tcctagcactgaaccggtttgcgcc

SEQ ID NO: 208833 - DNA, 25 bp, Homo sapien
gacgttccctgtctcttccagagga

SEQ ID NO: 208834 - DNA, 25 bp, Homo sapien
ttcccacatttctgcgcgacgtagg

SEQ ID NO: 208835 - DNA, 25 bp, Homo sapien
ccctccggaagatgaaggcactgta

SEQ ID NO: 208836 - DNA, 25 bp, Homo sapien
tgcgggtggaccctatcagatctcg

SEQ ID NO: 208837 - DNA, 25 bp, Homo sapien
ccatcgggtcctgtgtacaccttga

SEQ ID NO: 208838 - DNA, 25 bp, Homo sapien
gcgcagcctcaatgctgggattgga

SEQ ID NO: 208839 - DNA, 25 bp, Homo sapien
attgactatggtctctccggctacc

SEQ ID NO: 208840 - DNA, 25 bp, Homo sapien
agggctcctggcttcaacctgttta

SEQ ID NO: 208841 - DNA, 25 bp, Homo sapien
tgagtccagtttccgctgctgggaa

SEQ ID NO: 208842 - DNA, 25 bp, Homo sapien
aacgtctcgcgccaaggcggcatcg

SEQ ID NO: 208843 - DNA, 25 bp, Homo sapien
actggaacccagtatgcccggcgag

SEQ ID NO: 208844 - DNA, 25 bp, Homo sapien
tggagacactctgcttgccaacgtc

SEQ ID NO: 208845 - DNA, 25 bp, Homo sapien
ccgtcctggttcgagcatttctgaa

SEQ ID NO: 208846 - DNA, 25 bp, Homo sapien
tccttgagtttcgagagccagtagc

SEQ ID NO: 208847 - DNA, 25 bp, Homo sapien
tacaactcccagagcactgcgcgga

SEQ ID NO: 208848 - DNA, 25 bp, Homo sapien
gggcaacaagcccttggatctcacc

SEQ ID NO: 208849 - DNA, 25 bp, Homo sapien
ggatcccggatcctccggaactgga

SEQ ID NO: 208850 - DNA, 25 bp, Homo sapien
ttggcctgctcactctgtgtccctg

SEQ ID NO: 208851 - DNA, 25 bp, Homo sapien
aacttcgacgacctgggttggcctg

SEQ ID NO: 208852 - DNA, 25 bp, Homo sapien
actcgcggctgaaaagctgaaggca

SEQ ID NO: 208853 - DNA, 25 bp, Homo sapien
agcaccggtttaacagcctcggcca

SEQ ID NO: 208854 - DNA, 25 bp, Homo sapien
tgcagccacctttggtctgtaggaa

SEQ ID NO: 208855 - DNA, 25 bp, Homo sapien
cccgcacagatctaaggcttggctt

SEQ ID NO: 208856 - DNA, 25 bp, Homo sapien
acgtgggcctttccagttccctgca

SEQ ID NO: 208857 - DNA, 25 bp, Homo sapien
gcttctctgctccttcggtcttgtg

SEQ ID NO: 208858 - DNA, 25 bp, Homo sapien
caggtcctggtcacgtgatgaggct

SEQ ID NO: 208859 - DNA, 25 bp, Homo sapien
cctccaggcgcggttaatccagtcg

SEQ ID NO: 208860 - DNA, 25 bp, Homo sapien
aagtgctttcctgtccggacctcgg

SEQ ID NO: 208861 - DNA, 25 bp, Homo sapien
taaatccatggctcaaagtgctttc

SEQ ID NO: 208862 - DNA, 25 bp, Homo sapien
gctccagctcctcatctggatttta

SEQ ID NO: 208863 - DNA, 25 bp, Homo sapien
cgggaggagaaaccagctccagctc

SEQ ID NO: 208864 - DNA, 25 bp, Homo sapien
tcgtgtccgtgactcgcgcaggaag

SEQ ID NO: 208865 - DNA, 25 bp, Homo sapien
cgagtgttcggcctcggtttctgag

SEQ ID NO: 208866 - DNA, 25 bp, Homo sapien
tggagcccgcagtcctctagattag

SEQ ID NO: 208867 - DNA, 25 bp, Homo sapien
tctcgggttttttccagacgacgca

SEQ ID NO: 208868 - DNA, 25 bp, Homo sapien
ttttccagacgacgcacccaggaga

SEQ ID NO: 208869 - DNA, 25 bp, Homo sapien
gtcgcggactcgtccttgctgcagt

SEQ ID NO: 208870 - DNA, 25 bp, Homo sapien
agattagtctccaccgccgtccagg

SEQ ID NO: 208871 - DNA, 25 bp, Homo sapien
cgtccaggacccacttgcagcatgg

SEQ ID NO: 208872 - DNA, 25 bp, Homo sapien
aacgaaaggaccaatcgggcacgca

SEQ ID NO: 208873 - DNA, 25 bp, Homo sapien
agccgtgccacctttagggatctcg

SEQ ID NO: 208874 - DNA, 25 bp, Homo sapien
ggcttcaaccgcgtgtcctggagcc

SEQ ID NO: 208875 - DNA, 25 bp, Homo sapien
gcctagagatttaccgtgcgcgccc

SEQ ID NO: 208876 - DNA, 25 bp, Homo sapien
tagagctcggcttcaaccgcgtgtc

SEQ ID NO: 208877 - DNA, 25 bp, Homo sapien
agacccaacgcctagagatttaccg

SEQ ID NO: 208878 - DNA, 25 bp, Homo sapien
gatgccgcagcccttcacagagagc

SEQ ID NO: 208879 - DNA, 25 bp, Homo sapien
acgcgtcagcccagttctcggcctc

SEQ ID NO: 208880 - DNA, 25 bp, Homo sapien
cccaggctctgtctcctgtagccgc

SEQ ID NO: 208881 - DNA, 25 bp, Homo sapien
gacagcagcagacccaacgcctaga

SEQ ID NO: 208882 - DNA, 25 bp, Homo sapien
gcagatgtccatgcggtccgacggc

SEQ ID NO: 208883 - DNA, 25 bp, Homo sapien
catcgggctccgtctgcatggctgt

SEQ ID NO: 208884 - DNA, 25 bp, Homo sapien
gtgggccgcacgctgcaccaggtct

SEQ ID NO: 208885 - DNA, 25 bp, Homo sapien
tccctgaggatgactgtgggccgca

SEQ ID NO: 208886 - DNA, 25 bp, Homo sapien
actcagagagcgcagagtcaaggcg

SEQ ID NO: 208887 - DNA, 25 bp, Homo sapien
gcaaagccgtcttgggagactcaga

SEQ ID NO: 208888 - DNA, 25 bp, Homo sapien
gccagcagcaaagccgtcttgggag

SEQ ID NO: 208889 - DNA, 25 bp, Homo sapien
tcctgcccgaggcagatgtccatgc

SEQ ID NO: 208890 - DNA, 25 bp, Homo sapien
tgctcctggctaaccttcgtcctgg

SEQ ID NO: 208891 - DNA, 25 bp, Homo sapien
tggagtcgtgtctctttctcacctc

SEQ ID NO: 208892 - DNA, 25 bp, Homo sapien
tccatgccagcaagtcagccaagtc

SEQ ID NO: 208893 - DNA, 25 bp, Homo sapien
ccggctaccaccacaaggaactttg

SEQ ID NO: 208894 - DNA, 25 bp, Homo sapien
agccaagtccagaggctcccttttg

SEQ ID NO: 208895 - DNA, 25 bp, Homo sapien
ttccctcccttggtgagacatcgga

SEQ ID NO: 208896 - DNA, 25 bp, Homo sapien
agggcgatccgctttgcagagaaga

SEQ ID NO: 208897 - DNA, 25 bp, Homo sapien
cccggagctagcacgaggttgtgca

SEQ ID NO: 208898 - DNA, 25 bp, Homo sapien
ccgctggaccagatcgacatcgatg

SEQ ID NO: 208899 - DNA, 25 bp, Homo sapien
accacctgtgtggacatccgctggc

SEQ ID NO: 208900 - DNA, 25 bp, Homo sapien
ggcggtacatgctgctcatcttctc

SEQ ID NO: 208901 - DNA, 25 bp, Homo sapien
cctggctgctgttcggcatcatctt

SEQ ID NO: 208902 - DNA, 25 bp, Homo sapien
atcatcttctgggtcatcgcggtgg

SEQ ID NO: 208903 - DNA, 25 bp, Homo sapien
tgctgttcagccacaacgccgtggt

SEQ ID NO: 208904 - DNA, 25 bp, Homo sapien
gcgcagctcatcaagccgcgggtca

SEQ ID NO: 208905 - DNA, 25 bp, Homo sapien
ctggctgacatgttcaccacctgtg

SEQ ID NO: 208906 - DNA, 25 bp, Homo sapien
atcccaggggctgacctctggacgg

SEQ ID NO: 208907 - DNA, 25 bp, Homo sapien
ccgcaagcctgatcccaggggctga

SEQ ID NO: 208908 - DNA, 25 bp, Homo sapien
aacaccgcaagcctgatcccagggg

SEQ ID NO: 208909 - DNA, 25 bp, Homo sapien
cacatgcggccacgtagggacctgg

SEQ ID NO: 208910 - DNA, 25 bp, Homo sapien
ctcacatgcggccacgtagggacct

SEQ ID NO: 208911 - DNA, 25 bp, Homo sapien
gaatgcgctcacatgcggccacgta

SEQ ID NO: 208912 - DNA, 25 bp, Homo sapien
tcctggaatgcgctcacatgcggcc

SEQ ID NO: 208913 - DNA, 25 bp, Homo sapien
aggggctgacctctggacggtctca

SEQ ID NO: 208914 - DNA, 25 bp, Homo sapien
tacttttccagtgccacgggatttc

SEQ ID NO: 208915 - DNA, 25 bp, Homo sapien
ctctcgtttccttattcctggaatg

SEQ ID NO: 208916 - DNA, 25 bp, Homo sapien
tagaaatgcctactcctctcgtttc

SEQ ID NO: 208917 - DNA, 25 bp, Homo sapien
tctggacggtctcagggactgacta

SEQ ID NO: 208918 - DNA, 25 bp, Homo sapien
atctgcatcgtaaaagccagcgtta

SEQ ID NO: 208919 - DNA, 25 bp, Homo sapien
cgccgcttatccgtttatctgcatc

SEQ ID NO: 208920 - DNA, 25 bp, Homo sapien
gtgccttagacggtagaaatgccta

SEQ ID NO: 208921 - DNA, 25 bp, Homo sapien
acgggatttcatgcaaagtgcctta

SEQ ID NO: 208922 - DNA, 25 bp, Homo sapien
gctcccgcgagcttcttcctaaatt

SEQ ID NO: 208923 - DNA, 25 bp, Homo sapien
agagagggtcgttccgcactcgccc

SEQ ID NO: 208924 - DNA, 25 bp, Homo sapien
ccacgcgaaatttcctgccgggcgg

SEQ ID NO: 208925 - DNA, 25 bp, Homo sapien
cttcctaaattccagccacgcgaaa

SEQ ID NO: 208926 - DNA, 25 bp, Homo sapien
tccgtttagcaggaggttttgagct

SEQ ID NO: 208927 - DNA, 25 bp, Homo sapien
gcgcgccttaacagttgtccgttta

SEQ ID NO: 208928 - DNA, 25 bp, Homo sapien
cctgccagactgaggaacgccgagc

SEQ ID NO: 208929 - DNA, 25 bp, Homo sapien
gaaacagaaccggatgcgcgcctta

SEQ ID NO: 208930 - DNA, 25 bp, Homo sapien
caaaactttctaatccgcgaggagc

SEQ ID NO: 208931 - DNA, 25 bp, Homo sapien
gggtcaattagtacacgcgggaatc

SEQ ID NO: 208932 - DNA, 25 bp, Homo sapien
gtcagcgttgtaggcgcgctcttga

SEQ ID NO: 208933 - DNA, 25 bp, Homo sapien
ccggctgttccaggaggactgcgaa

SEQ ID NO: 208934 - DNA, 25 bp, Homo sapien
cgcccgccggagatgcggatccgat

SEQ ID NO: 208935 - DNA, 25 bp, Homo sapien
gtcactcggagcagaacggtagtta

SEQ ID NO: 208936 - DNA, 25 bp, Homo sapien
ggctgtctgtcctcgcaggtagcag

SEQ ID NO: 208937 - DNA, 25 bp, Homo sapien
cgccagagcccagcaaaactttcta

SEQ ID NO: 208938 - DNA, 25 bp, Homo sapien
tatatagcaagctctaccagcgggg

SEQ ID NO: 208939 - DNA, 25 bp, Homo sapien
ggcggtcacctttatatatagcaag

SEQ ID NO: 208940 - DNA, 25 bp, Homo sapien
gacacctggcggtcacctttatata

SEQ ID NO: 208941 - DNA, 25 bp, Homo sapien
cggcagctcacggttccactcacgc

SEQ ID NO: 208942 - DNA, 25 bp, Homo sapien
ttgtctagcgacacctggcggtcac

SEQ ID NO: 208943 - DNA, 25 bp, Homo sapien
cacgctggttgtctagcgacacctg

SEQ ID NO: 208944 - DNA, 25 bp, Homo sapien
ctggctttcacgctggttgtctagc

SEQ ID NO: 208945 - DNA, 25 bp, Homo sapien
atccggatccgtccggctggctttc

SEQ ID NO: 208946 - DNA, 25 bp, Homo sapien
tggatggcagaaaggagtctctact

SEQ ID NO: 208947 - DNA, 25 bp, Homo sapien
cgtcatcagaatggaaaagcgatcc

SEQ ID NO: 208948 - DNA, 25 bp, Homo sapien
aagcgatccagatggtcccgcaggc

SEQ ID NO: 208949 - DNA, 25 bp, Homo sapien
actgtgttcttgcagccgagaggcc

SEQ ID NO: 208950 - DNA, 25 bp, Homo sapien
agccgagaggcccacacaggacaag

SEQ ID NO: 208951 - DNA, 25 bp, Homo sapien
gtgatcacacgtgcggccaagcttc

SEQ ID NO: 208952 - DNA, 25 bp, Homo sapien
cgaagtacaggacgtcatcagaatg

SEQ ID NO: 208953 - DNA, 25 bp, Homo sapien
acaaggaggcctgacccaggctgtt

SEQ ID NO: 208954 - DNA, 25 bp, Homo sapien
ctgcgaccacctgctgagccggtga

SEQ ID NO: 208955 - DNA, 25 bp, Homo sapien
gctcacttctgggacagtggccaac

SEQ ID NO: 208956 - DNA, 25 bp, Homo sapien
tgcctcatttaacggggcgccaggg

SEQ ID NO: 208957 - DNA, 25 bp, Homo sapien
tggacgaatccctgctacacagcgg

SEQ ID NO: 208958 - DNA, 25 bp, Homo sapien
gctccagcgctcttccggggaggct

SEQ ID NO: 208959 - DNA, 25 bp, Homo sapien
cggggagcttcgctccagcgctctt

SEQ ID NO: 208960 - DNA, 25 bp, Homo sapien
gaggctggctcacttctgggacagt

SEQ ID NO: 208961 - DNA, 25 bp, Homo sapien
ctggtacctgccgtgcctcatttaa

SEQ ID NO: 208962 - DNA, 25 bp, Homo sapien
cgctgtctctctccggcgagctgtg

SEQ ID NO: 208963 - DNA, 25 bp, Homo sapien
gagaccagagggaaagtcaagtgtc

SEQ ID NO: 208964 - DNA, 25 bp, Homo sapien
cagccagtggctgaggatgaacttc

SEQ ID NO: 208965 - DNA, 25 bp, Homo sapien
gatgaacttctcgttgaaatccacc

SEQ ID NO: 208966 - DNA, 25 bp, Homo sapien
gaaatccaccatctcgaagtcgtgg

SEQ ID NO: 208967 - DNA, 25 bp, Homo sapien
atctcgaagtcgtggtcgccgccgt

SEQ ID NO: 208968 - DNA, 25 bp, Homo sapien
gaggctttgagctgctcctccgcca

SEQ ID NO: 208969 - DNA, 25 bp, Homo sapien
tccaggttgagtctgcggcgctcca

SEQ ID NO: 208970 - DNA, 25 bp, Homo sapien
ggacgtgattcgcagcatcctcgta

SEQ ID NO: 208971 - DNA, 25 bp, Homo sapien
acattaaccaacagcgattccgtcg

SEQ ID NO: 208972 - DNA, 25 bp, Homo sapien
gcacgcgccgacagaaactaacaga

SEQ ID NO: 208973 - DNA, 25 bp, Homo sapien
tggcccacagccgtaaagacctgcg

SEQ ID NO: 208974 - DNA, 25 bp, Homo sapien
gagcattcaggcacgactggctttg

SEQ ID NO: 208975 - DNA, 25 bp, Homo sapien
ccttgcacaaatttgcgctctgcca

SEQ ID NO: 208976 - DNA, 25 bp, Homo sapien
aggtgacgcgacacccggcctttct

SEQ ID NO: 208977 - DNA, 25 bp, Homo sapien
cgcacggagacggtgtctatgtaag

SEQ ID NO: 208978 - DNA, 25 bp, Homo sapien
agcctgagtcgctgcctaggtggcc

SEQ ID NO: 208979 - DNA, 25 bp, Homo sapien
ggtcgaagcccactgcgaaaccctg

SEQ ID NO: 208980 - DNA, 25 bp, Homo sapien
agagagccggagctcaggtctccta

SEQ ID NO: 208981 - DNA, 25 bp, Homo sapien
cttccttagcaggtatcgcgttgcg

SEQ ID NO: 208982 - DNA, 25 bp, Homo sapien
agcagccgttgttgcttccttagca

SEQ ID NO: 208983 - DNA, 25 bp, Homo sapien
tcccatgggcgatgaggctcggatt

SEQ ID NO: 208984 - DNA, 25 bp, Homo sapien
actgcgaaaccctgcgccatggcgg

SEQ ID NO: 208985 - DNA, 25 bp, Homo sapien
tctcctaggcccagtgggtcgaagc

SEQ ID NO: 208986 - DNA, 25 bp, Homo sapien
gggaattgtgcgtcaccatcaccac

SEQ ID NO: 208987 - DNA, 25 bp, Homo sapien
cgcgatttttaagatgtgagagagg

SEQ ID NO: 208988 - DNA, 25 bp, Homo sapien
tctcgccggaaatatccctctttcg

SEQ ID NO: 208989 - DNA, 25 bp, Homo sapien
ctcgccggaaatatccctctttcgg

SEQ ID NO: 208990 - DNA, 25 bp, Homo sapien
aaatatccctctttcgggaagcgct

SEQ ID NO: 208991 - DNA, 25 bp, Homo sapien
aatatccctctttcgggaagcgctc

SEQ ID NO: 208992 - DNA, 25 bp, Homo sapien
atatccctctttcgggaagcgctcc

SEQ ID NO: 208993 - DNA, 25 bp, Homo sapien
gcgcgatttttaagatgtgagagag

SEQ ID NO: 208994 - DNA, 25 bp, Homo sapien
gtagagactcctttgcgccgtcccg

SEQ ID NO: 208995 - DNA, 25 bp, Homo sapien
aggcggggctggctgttggaggaat

SEQ ID NO: 208996 - DNA, 25 bp, Homo sapien
tgttggaggaatgtgcgaggatctc

SEQ ID NO: 208997 - DNA, 25 bp, Homo sapien
ccgggctggctcaacgcccccaccg

SEQ ID NO: 208998 - DNA, 25 bp, Homo sapien
aggaatgtgcgaggatctccgtggc

SEQ ID NO: 208999 - DNA, 25 bp, Homo sapien
agagactcctttgcgccgtcccgcc

SEQ ID NO: 209000 - DNA, 25 bp, Homo sapien
aggatctccgtggccggtgtctgaa

SEQ ID NO: 209001 - DNA, 25 bp, Homo sapien
agtagagactcctttgcgccgtccc

SEQ ID NO: 209002 - DNA, 25 bp, Homo sapien
tcaatagtgcgcctccaacgctgac

SEQ ID NO: 209003 - DNA, 25 bp, Homo sapien
acggacgggcccatgttattcttcg

SEQ ID NO: 209004 - DNA, 25 bp, Homo sapien
gcccatgttattcttcgcagtcctc

SEQ ID NO: 209005 - DNA, 25 bp, Homo sapien
cgcagtcctcctgtaatggccgggc

SEQ ID NO: 209006 - DNA, 25 bp, Homo sapien
aaggcccgtcgattcctgcgtgtac

SEQ ID NO: 209007 - DNA, 25 bp, Homo sapien
tccgagctcaatagtgcgcctccaa

SEQ ID NO: 209008 - DNA, 25 bp, Homo sapien
gccgcggatcggatcggcatagcca

SEQ ID NO: 209009 - DNA, 25 bp, Homo sapien
ctgcgtgtactagtcgacccgctca

SEQ ID NO: 209010 - DNA, 25 bp, Homo sapien
tccccgggatcaggcttgcagtgtt

SEQ ID NO: 209011 - DNA, 25 bp, Homo sapien
ccctgcgtggccgaacggcatgtga

SEQ ID NO: 209012 - DNA, 25 bp, Homo sapien
tggccgaacggcatgtgagcacatt

SEQ ID NO: 209013 - DNA, 25 bp, Homo sapien
ggccgaacggcatgtgagcacattc

SEQ ID NO: 209014 - DNA, 25 bp, Homo sapien
ccgaacggcatgtgagcacattcca

SEQ ID NO: 209015 - DNA, 25 bp, Homo sapien
acggcatgtgagcacattccaggaa

SEQ ID NO: 209016 - DNA, 25 bp, Homo sapien
cagcgcacagggaggtcgctgagtc

SEQ ID NO: 209017 - DNA, 25 bp, Homo sapien
cgtccagagttcagtccccgggatc

SEQ ID NO: 209018 - DNA, 25 bp, Homo sapien
ggcactttgcatgaaatcccgtggc

SEQ ID NO: 209019 - DNA, 25 bp, Homo sapien
tagtcagtccctgagaccgtccaga

SEQ ID NO: 209020 - DNA, 25 bp, Homo sapien
caagtaggagggctccgtgcacacc

SEQ ID NO: 209021 - DNA, 25 bp, Homo sapien
tgcagataaacggataagcggcgta

SEQ ID NO: 209022 - DNA, 25 bp, Homo sapien
atcccgtggcactggaaaagtagtt

SEQ ID NO: 209023 - DNA, 25 bp, Homo sapien
atttctaccgtctaaggcactttgc

SEQ ID NO: 209024 - DNA, 25 bp, Homo sapien
aacgagaggagtaggcatttctacc

SEQ ID NO: 209025 - DNA, 25 bp, Homo sapien
cgctggcttttacgatgcagataaa

SEQ ID NO: 209026 - DNA, 25 bp, Homo sapien
ggaaaggctgcaggaatctcgaggc

SEQ ID NO: 209027 - DNA, 25 bp, Homo sapien
tggaaaggctgcaggaatctcgagg

SEQ ID NO: 209028 - DNA, 25 bp, Homo sapien
ggctgcaggaatctcgaggcaaaga

SEQ ID NO: 209029 - DNA, 25 bp, Homo sapien
aggctgcaggaatctcgaggcaaag

SEQ ID NO: 209030 - DNA, 25 bp, Homo sapien
aaggctgcaggaatctcgaggcaaa

SEQ ID NO: 209031 - DNA, 25 bp, Homo sapien
aaaggctgcaggaatctcgaggcaa

SEQ ID NO: 209032 - DNA, 25 bp, Homo sapien
gaaaggctgcaggaatctcgaggca

SEQ ID NO: 209033 - DNA, 25 bp, Homo sapien
gctgcaggaatctcgaggcaaagac

SEQ ID NO: 209034 - DNA, 25 bp, Homo sapien
ggcgcccaagactgcttcacgaatg

SEQ ID NO: 209035 - DNA, 25 bp, Homo sapien
agactgcttcacgaatgcgaatgcg

SEQ ID NO: 209036 - DNA, 25 bp, Homo sapien
ccgaggaggccttattgtcgagaca

SEQ ID NO: 209037 - DNA, 25 bp, Homo sapien
tcctctgcttaggtaggctgacagc

SEQ ID NO: 209038 - DNA, 25 bp, Homo sapien
tgcctgcaccattttcctctgctta

SEQ ID NO: 209039 - DNA, 25 bp, Homo sapien
gttgtcgcgggcagcattttcccga

SEQ ID NO: 209040 - DNA, 25 bp, Homo sapien
tcgagacatttagggtcccgcagtg

SEQ ID NO: 209041 - DNA, 25 bp, Homo sapien
attttcccgagaccaggtgcgctct

SEQ ID NO: 209042 - DNA, 25 bp, Homo sapien
tgcgcctttttgtccctgctgccgc

SEQ ID NO: 209043 - DNA, 25 bp, Homo sapien
acgctgcgcctttttcccgccctgg

SEQ ID NO: 209044 - DNA, 25 bp, Homo sapien
gcagctttctcccaccgtggctttt

SEQ ID NO: 209045 - DNA, 25 bp, Homo sapien
agctttctcctactgcgcctttttg

SEQ ID NO: 209046 - DNA, 25 bp, Homo sapien
gccacagattttggccgccgcggct

SEQ ID NO: 209047 - DNA, 25 bp, Homo sapien
cacggcttttgcctacgcggcttct

SEQ ID NO: 209048 - DNA, 25 bp, Homo sapien
ggcttttgcctacgcggcttcttgc

SEQ ID NO: 209049 - DNA, 25 bp, Homo sapien
ctttttgtggttttctgcgtgcgcc

SEQ ID NO: 209050 - DNA, 25 bp, Homo sapien
tcagagatctgagccaaccttggcc

SEQ ID NO: 209051 - DNA, 25 bp, Homo sapien
tctgagccaaccttggccgacatgc

SEQ ID NO: 209052 - DNA, 25 bp, Homo sapien
agcagcggccctacagacgggagtc

SEQ ID NO: 209053 - DNA, 25 bp, Homo sapien
agcggccctacagacgggagtcaga

SEQ ID NO: 209054 - DNA, 25 bp, Homo sapien
ccctacagacgggagtcagagatct

SEQ ID NO: 209055 - DNA, 25 bp, Homo sapien
cagacgggagtcagagatctgagcc

SEQ ID NO: 209056 - DNA, 25 bp, Homo sapien
gagtcagagatctgagccaaccttg

SEQ ID NO: 209057 - DNA, 25 bp, Homo sapien
aaccttggccgacatgcagcatcca

SEQ ID NO: 209058 - DNA, 25 bp, Homo sapien
gcaccgacgtggatgcagcacctac

SEQ ID NO: 209059 - DNA, 25 bp, Homo sapien
ctccagtgtctcgtttgcagtcggc

SEQ ID NO: 209060 - DNA, 25 bp, Homo sapien
cgtattcccggaatcagacggtgcc

SEQ ID NO: 209061 - DNA, 25 bp, Homo sapien
tctgttgttgggtccgcatcgtatt

SEQ ID NO: 209062 - DNA, 25 bp, Homo sapien
gagctttcccgaggcagttagcaga

SEQ ID NO: 209063 - DNA, 25 bp, Homo sapien
ctccgtactttggtctgaggccttc

SEQ ID NO: 209064 - DNA, 25 bp, Homo sapien
tctattgtctgtggttgactccgta

SEQ ID NO: 209065 - DNA, 25 bp, Homo sapien
taggggaactgtcttcctccgcagg

SEQ ID NO: 209066 - DNA, 25 bp, Homo sapien
tcacggagcagtttagtccaaatcc

SEQ ID NO: 209067 - DNA, 25 bp, Homo sapien
cgtgacgaagatcacggagcagttt

SEQ ID NO: 209068 - DNA, 25 bp, Homo sapien
ttctgtcggcccctgtaagcttctc

SEQ ID NO: 209069 - DNA, 25 bp, Homo sapien
ccgcgtgggtgtctacgaggatccc

SEQ ID NO: 209070 - DNA, 25 bp, Homo sapien
ccaaggatgactgagccaagcggct

SEQ ID NO: 209071 - DNA, 25 bp, Homo sapien
cggagcagtttagtccaaatccggg

SEQ ID NO: 209072 - DNA, 25 bp, Homo sapien
gggaaaaacacccaaggatgactga

SEQ ID NO: 209073 - DNA, 25 bp, Homo sapien
caagcggctctagctggaggcgccc

SEQ ID NO: 209074 - DNA, 25 bp, Homo sapien
gcgagagctactgccgcagccggca

SEQ ID NO: 209075 - DNA, 25 bp, Homo sapien
ccgagcgttacctggtcccgggcag

SEQ ID NO: 209076 - DNA, 25 bp, Homo sapien
cagggacagccgagcgttacctggt

SEQ ID NO: 209077 - DNA, 25 bp, Homo sapien
tcccttaggcgccagggacagccga

SEQ ID NO: 209078 - DNA, 25 bp, Homo sapien
attctattccggcacctcccttagg

SEQ ID NO: 209079 - DNA, 25 bp, Homo sapien
tcccattggctggtagggccgccag

SEQ ID NO: 209080 - DNA, 25 bp, Homo sapien
tgtggcgccgccagccttgtcaaac

SEQ ID NO: 209081 - DNA, 25 bp, Homo sapien
tagggccgccagtcattctattccg

SEQ ID NO: 209082 - DNA, 25 bp, Homo sapien
actcatcttcggtggaggagaaagg

SEQ ID NO: 209083 - DNA, 25 bp, Homo sapien
cacgagctgctgtgccattggaagc

SEQ ID NO: 209084 - DNA, 25 bp, Homo sapien
aaaggggcctttgtgagcgcccagc

SEQ ID NO: 209085 - DNA, 25 bp, Homo sapien
cggcgttcacgctgtgaaccagcga

SEQ ID NO: 209086 - DNA, 25 bp, Homo sapien
ccgcctgggctatgactcatcttcg

SEQ ID NO: 209087 - DNA, 25 bp, Homo sapien
ctgtggcctgccaagccaaggagaa

SEQ ID NO: 209088 - DNA, 25 bp, Homo sapien
cggcctgacccagttttccctgtgg

SEQ ID NO: 209089 - DNA, 25 bp, Homo sapien
tgaaccagcgaactaggccaccggc

SEQ ID NO: 209090 - DNA, 25 bp, Homo sapien
ccctaccaaaggtgcggagttcctg

SEQ ID NO: 209091 - DNA, 25 bp, Homo sapien
ctaggctcgtggagaggacgcccct

SEQ ID NO: 209092 - DNA, 25 bp, Homo sapien
gcgcctgccctaccaaaggtgcgga

SEQ ID NO: 209093 - DNA, 25 bp, Homo sapien
caaaggtgcggagttcctgcgcctc

SEQ ID NO: 209094 - DNA, 25 bp, Homo sapien
cgggcctgacacaacagacggctgg

SEQ ID NO: 209095 - DNA, 25 bp, Homo sapien
ctgacacaacagacggctgggccct

SEQ ID NO: 209096 - DNA, 25 bp, Homo sapien
tgaccgcgggcctgacacaacagac

SEQ ID NO: 209097 - DNA, 25 bp, Homo sapien
ctggcccacgatccgctcccggagg

SEQ ID NO: 209098 - DNA, 25 bp, Homo sapien
cttcaggccgggcaccctgggcttg

SEQ ID NO: 209099 - DNA, 25 bp, Homo sapien
agggagtgatgactcatttcctttc

SEQ ID NO: 209100 - DNA, 25 bp, Homo sapien
cacggtcccagggagtgatgactca

SEQ ID NO: 209101 - DNA, 25 bp, Homo sapien
tgtggccgcgtctccacactcgctc

SEQ ID NO: 209102 - DNA, 25 bp, Homo sapien
ccattgtcctgggttcctgtggccg

SEQ ID NO: 209103 - DNA, 25 bp, Homo sapien
tacttcccgccattgtcctgggttc

SEQ ID NO: 209104 - DNA, 25 bp, Homo sapien
gcgcggctgcagtcaggcccacatt

SEQ ID NO: 209105 - DNA, 25 bp, Homo sapien
atttcctttcctccgctgacatcat

SEQ ID NO: 209106 - DNA, 25 bp, Homo sapien
gagctggcgcggagcagctccaccc

SEQ ID NO: 209107 - DNA, 25 bp, Homo sapien
cccatttccagtttgcggggccgca

SEQ ID NO: 209108 - DNA, 25 bp, Homo sapien
aggcatggatagagcagcgctgcgc

SEQ ID NO: 209109 - DNA, 25 bp, Homo sapien
ccgatgccgaggcatggatagagca

SEQ ID NO: 209110 - DNA, 25 bp, Homo sapien
gtggaagcggcagactcagcggccg

SEQ ID NO: 209111 - DNA, 25 bp, Homo sapien
ctttcgctttgctgccgcggctggg

SEQ ID NO: 209112 - DNA, 25 bp, Homo sapien
gggtcgccgcggctttcgctttgct

SEQ ID NO: 209113 - DNA, 25 bp, Homo sapien
ggggccgcaggactcgttgtcccac

SEQ ID NO: 209114 - DNA, 25 bp, Homo sapien
agaccagcgtgtacctgcaggagtg

SEQ ID NO: 209115 - DNA, 25 bp, Homo sapien
acgaggtggacgacttgccgagctc

SEQ ID NO: 209116 - DNA, 25 bp, Homo sapien
tgtacctgcaggagtgggacatccc

SEQ ID NO: 209117 - DNA, 25 bp, Homo sapien
ccttcgagcaggtagagctgggcga

SEQ ID NO: 209118 - DNA, 25 bp, Homo sapien
agccagaccagcgtgtacctgcagg

SEQ ID NO: 209119 - DNA, 25 bp, Homo sapien
cccatctctcgcaaggccagccaga

SEQ ID NO: 209120 - DNA, 25 bp, Homo sapien
catggcgaggtggccattcgcctgc

SEQ ID NO: 209121 - DNA, 25 bp, Homo sapien
ggacgacttgccgagctctcgccgg

SEQ ID NO: 209122 - DNA, 25 bp, Homo sapien
cgcgctttatcgctcggagcctgca

SEQ ID NO: 209123 - DNA, 25 bp, Homo sapien
cttcggccggaggatcctgcagagc

SEQ ID NO: 209124 - DNA, 25 bp, Homo sapien
ccctccgatttctcccagagagaga

SEQ ID NO: 209125 - DNA, 25 bp, Homo sapien
tcaggaatcccacagagcgcacatc

SEQ ID NO: 209126 - DNA, 25 bp, Homo sapien
tgcgacctctcaagcgttctaaaag

SEQ ID NO: 209127 - DNA, 25 bp, Homo sapien
cgcctgggctcctgaattgcgacct

SEQ ID NO: 209128 - DNA, 25 bp, Homo sapien
tagacgcctctcatagtgcatgggg

SEQ ID NO: 209129 - DNA, 25 bp, Homo sapien
cgcagcgcaactgaacccgcataga

SEQ ID NO: 209130 - DNA, 25 bp, Homo sapien
cctagctcgcgctgcaggcctttcc

SEQ ID NO: 209131 - DNA, 25 bp, Homo sapien
caatagatccgaggacacccgaggc

SEQ ID NO: 209132 - DNA, 25 bp, Homo sapien
tcttcaatagatccgaggacacccg

SEQ ID NO: 209133 - DNA, 25 bp, Homo sapien
ccctaggtcttcaatagatccgagg

SEQ ID NO: 209134 - DNA, 25 bp, Homo sapien
gaagagcgcagaccgcaagggaaaa

SEQ ID NO: 209135 - DNA, 25 bp, Homo sapien
gaggcctccacatccctagcccgcc

SEQ ID NO: 209136 - DNA, 25 bp, Homo sapien
gcgcggctcaccagcctccagggga

SEQ ID NO: 209137 - DNA, 25 bp, Homo sapien
gctctccggtggaagagcgcagacc

SEQ ID NO: 209138 - DNA, 25 bp, Homo sapien
tggccgaacagtgcgcctgtctgaa

SEQ ID NO: 209139 - DNA, 25 bp, Homo sapien
aggagtcagcccgcttccgaccgta

SEQ ID NO: 209140 - DNA, 25 bp, Homo sapien
agacggagcagccttgagccctgcg

SEQ ID NO: 209141 - DNA, 25 bp, Homo sapien
tctatccggctttgctaggggaggt

SEQ ID NO: 209142 - DNA, 25 bp, Homo sapien
ggctccgctctatccggctttgcta

SEQ ID NO: 209143 - DNA, 25 bp, Homo sapien
gtgcgcctgtctgaagctcctggcc

SEQ ID NO: 209144 - DNA, 25 bp, Homo sapien
acaccttgttgccactggccgaaca

SEQ ID NO: 209145 - DNA, 25 bp, Homo sapien
gtgtccgacgctggctccgctctat

SEQ ID NO: 209146 - DNA, 25 bp, Homo sapien
atttcgcctccggacagcggcgtct

SEQ ID NO: 209147 - DNA, 25 bp, Homo sapien
gcttttggccctgctcgtctacctg

SEQ ID NO: 209148 - DNA, 25 bp, Homo sapien
gcgaagacgccttcctggggtagct

SEQ ID NO: 209149 - DNA, 25 bp, Homo sapien
gtggctagatctgaccgcgcccttc

SEQ ID NO: 209150 - DNA, 25 bp, Homo sapien
ctcaggtatgggaaactaggccgcc

SEQ ID NO: 209151 - DNA, 25 bp, Homo sapien
gtcacataacatcctgcctccgaga

SEQ ID NO: 209152 - DNA, 25 bp, Homo sapien
tttacatgttcactcccgaccctgg

SEQ ID NO: 209153 - DNA, 25 bp, Homo sapien
cctctcatggccacggtgcttttgg

SEQ ID NO: 209154 - DNA, 25 bp, Homo sapien
gtgccgaccgtacaggctgtcctac

SEQ ID NO: 209155 - DNA, 25 bp, Homo sapien
tctttgtgctgagaacacgtctttg

SEQ ID NO: 209156 - DNA, 25 bp, Homo sapien
gaacacgtctttgcagcggtcatga

SEQ ID NO: 209157 - DNA, 25 bp, Homo sapien
tagatttctttgtgctgagaacacg

SEQ ID NO: 209158 - DNA, 25 bp, Homo sapien
ccttagttcggtgccgaccgtacag

SEQ ID NO: 209159 - DNA, 25 bp, Homo sapien
cacgtctttgcagcggtcatgaggc

SEQ ID NO: 209160 - DNA, 25 bp, Homo sapien
ggtgttcgtggcgtttgcaattttc

SEQ ID NO: 209161 - DNA, 25 bp, Homo sapien
tcgtggcgtttgcaattttcttgtg

SEQ ID NO: 209162 - DNA, 25 bp, Homo sapien
tcacgcgtgacgtcccgcgtgatgg

SEQ ID NO: 209163 - DNA, 25 bp, Homo sapien
ctggtcggcgtcacgcgtgacgtcc

SEQ ID NO: 209164 - DNA, 25 bp, Homo sapien
cttcagagagcgatggaaagcgtaa

SEQ ID NO: 209165 - DNA, 25 bp, Homo sapien
tgagagcttcagagagcgatggaaa

SEQ ID NO: 209166 - DNA, 25 bp, Homo sapien
cgcctcgaatgacacccaccgccct

SEQ ID NO: 209167 - DNA, 25 bp, Homo sapien
ccaccgccctcaggttctgccaatc

SEQ ID NO: 209168 - DNA, 25 bp, Homo sapien
ggaaagcgtaagtgctcgctctccc

SEQ ID NO: 209169 - DNA, 25 bp, Homo sapien
cgatggaaagcgtaagtgctcgctc

SEQ ID NO: 209170 - DNA, 25 bp, Homo sapien
tcataaatctccttcacacagaggc

SEQ ID NO: 209171 - DNA, 25 bp, Homo sapien
gcttgttaattacaggtcgcggggc

SEQ ID NO: 209172 - DNA, 25 bp, Homo sapien
accgcggcttgttaattacaggtcg

SEQ ID NO: 209173 - DNA, 25 bp, Homo sapien
tggggaccgcggcttgttaattaca

SEQ ID NO: 209174 - DNA, 25 bp, Homo sapien
cccggtcttagctcataaatctcct

SEQ ID NO: 209175 - DNA, 25 bp, Homo sapien
gttaattacaggtcgcggggcctga

SEQ ID NO: 209176 - DNA, 25 bp, Homo sapien
acacagaggcccataaatcaggggc

SEQ ID NO: 209177 - DNA, 25 bp, Homo sapien
cggataacaaggaccgtgaagaatc

SEQ ID NO: 209178 - DNA, 25 bp, Homo sapien
cccaggggaatggtgcacacctgga

SEQ ID NO: 209179 - DNA, 25 bp, Homo sapien
atgcccggtgatgcacgcagaaagc

SEQ ID NO: 209180 - DNA, 25 bp, Homo sapien
cctctaaggtgtacgcacgaggacg

SEQ ID NO: 209181 - DNA, 25 bp, Homo sapien
gcacgcagaaagcatcgaggtaaaa

SEQ ID NO: 209182 - DNA, 25 bp, Homo sapien
cgatccctgacggtagcttgcgggt

SEQ ID NO: 209183 - DNA, 25 bp, Homo sapien
gcatcgaggtaaaaatgaacgggga

SEQ ID NO: 209184 - DNA, 25 bp, Homo sapien
tgaacggggagacacctctaaggtg

SEQ ID NO: 209185 - DNA, 25 bp, Homo sapien
tcagccgagggacgtggctatttct

SEQ ID NO: 209186 - DNA, 25 bp, Homo sapien
cggtagaacagttagcggccatcgg

SEQ ID NO: 209187 - DNA, 25 bp, Homo sapien
acgacgaccggtagaacagttagcg

SEQ ID NO: 209188 - DNA, 25 bp, Homo sapien
tggcctagaaggagaacggagttcc

SEQ ID NO: 209189 - DNA, 25 bp, Homo sapien
attggctgagaccacctagtcctga

SEQ ID NO: 209190 - DNA, 25 bp, Homo sapien
ggttaggcctcggagccgcgcaaac

SEQ ID NO: 209191 - DNA, 25 bp, Homo sapien
acccaacggaggacctgagggtgca

SEQ ID NO: 209192 - DNA, 25 bp, Homo sapien
gaacaccacccaacggaggacctga

SEQ ID NO: 209193 - DNA, 25 bp, Homo sapien
acacctagggccctgctgtgactgc

SEQ ID NO: 209194 - DNA, 25 bp, Homo sapien
tggagatgaacatcagtatttgctg

SEQ ID NO: 209195 - DNA, 25 bp, Homo sapien
tgaacgtgtaaacgaatccttgacc

SEQ ID NO: 209196 - DNA, 25 bp, Homo sapien
tgctgaacgtgtaaacgaatccttg

SEQ ID NO: 209197 - DNA, 25 bp, Homo sapien
atttgctgaacgtgtaaacgaatcc

SEQ ID NO: 209198 - DNA, 25 bp, Homo sapien
tgaacatcagtatttgctgaacgtg

SEQ ID NO: 209199 - DNA, 25 bp, Homo sapien
ccagcgtggagatgaacatcagtat

SEQ ID NO: 209200 - DNA, 25 bp, Homo sapien
agcgtggagatgaacatcagtattt

SEQ ID NO: 209201 - DNA, 25 bp, Homo sapien
cagtatttgctgaacgtgtaaacga

SEQ ID NO: 209202 - DNA, 25 bp, Homo sapien
gcttctttgttcaccgcggccagct

SEQ ID NO: 209203 - DNA, 25 bp, Homo sapien
tctgcttctttgttcaccgcggcca

SEQ ID NO: 209204 - DNA, 25 bp, Homo sapien
tgcctcctacgtccctcgagtcctc

SEQ ID NO: 209205 - DNA, 25 bp, Homo sapien
tgtccattttactgcctcctacgtc

SEQ ID NO: 209206 - DNA, 25 bp, Homo sapien
cagccggtgaggattcctgtccatt

SEQ ID NO: 209207 - DNA, 25 bp, Homo sapien
tcatgctccacagccggtgaggatt

SEQ ID NO: 209208 - DNA, 25 bp, Homo sapien
tgacggccgcactgcaccggggtac

SEQ ID NO: 209209 - DNA, 25 bp, Homo sapien
acgaatccttgaccttccctcatgc

SEQ ID NO: 209210 - DNA, 25 bp, Homo sapien
gttccagttgcctctctcgggtcct

SEQ ID NO: 209211 - DNA, 25 bp, Homo sapien
gctcgcgcactctgggttccagttg

SEQ ID NO: 209212 - DNA, 25 bp, Homo sapien
gcgagctctacccagtcgaggtgag

SEQ ID NO: 209213 - DNA, 25 bp, Homo sapien
cctgttcatggacctgcaggcggtg

SEQ ID NO: 209214 - DNA, 25 bp, Homo sapien
gtccaggcccaaccgacagactatg

SEQ ID NO: 209215 - DNA, 25 bp, Homo sapien
aagcggtctgcctagccctcgcggg

SEQ ID NO: 209216 - DNA, 25 bp, Homo sapien
cagccaatggaagcggtctgcctag

SEQ ID NO: 209217 - DNA, 25 bp, Homo sapien
atcaccctgttcatggacctgcagg

SEQ ID NO: 209218 - DNA, 25 bp, Homo sapien
cggtactgcctttcctcaggacgcg

SEQ ID NO: 209219 - DNA, 25 bp, Homo sapien
tctcccagatgcatgcgaggcactg

SEQ ID NO: 209220 - DNA, 25 bp, Homo sapien
gcgagccgactctttactatgtaaa

SEQ ID NO: 209221 - DNA, 25 bp, Homo sapien
tcctcgtaagatcgtggcaagcatc

SEQ ID NO: 209222 - DNA, 25 bp, Homo sapien
cagagcctgtttacctatgacgtca

SEQ ID NO: 209223 - DNA, 25 bp, Homo sapien
tcctgactccggaagcacttacagc

SEQ ID NO: 209224 - DNA, 25 bp, Homo sapien
tttcccggatagagcgctatgcatg

SEQ ID NO: 209225 - DNA, 25 bp, Homo sapien
ccgaacttatccgagccgcagtttc

SEQ ID NO: 209226 - DNA, 25 bp, Homo sapien
acctgaccggagagccggctagata

SEQ ID NO: 209227 - DNA, 25 bp, Homo sapien
gcacaagggcggtgatagctccagt

SEQ ID NO: 209228 - DNA, 25 bp, Homo sapien
acgcttggtttctttccgtctcatc

SEQ ID NO: 209229 - DNA, 25 bp, Homo sapien
atatggcgtcctctttgcttgcggg

SEQ ID NO: 209230 - DNA, 25 bp, Homo sapien
tcgacgctggcgagaaggctccagc

SEQ ID NO: 209231 - DNA, 25 bp, Homo sapien
tccctcaccgggacgagaggtgcct

SEQ ID NO: 209232 - DNA, 25 bp, Homo sapien
gcactggctaggaacacgctctctg

SEQ ID NO: 209233 - DNA, 25 bp, Homo sapien
cttccggtgcgcttagcgttacttc

SEQ ID NO: 209234 - DNA, 25 bp, Homo sapien
ccgaggtcttccaactggtggagga

SEQ ID NO: 209235 - DNA, 25 bp, Homo sapien
cagcaggccttgtccgcgctgaagc

SEQ ID NO: 209236 - DNA, 25 bp, Homo sapien
agctgtgtcgcttcttcgccatgtc

SEQ ID NO: 209237 - DNA, 25 bp, Homo sapien
ttctctccgcctacaagctgtgtcg

SEQ ID NO: 209238 - DNA, 25 bp, Homo sapien
ttctgaccggcacccttgcctggta

SEQ ID NO: 209239 - DNA, 25 bp, Homo sapien
gtgcccaggccacgctttgttccag

SEQ ID NO: 209240 - DNA, 25 bp, Homo sapien
tagcccagggtctgtgcgacgccat

SEQ ID NO: 209241 - DNA, 25 bp, Homo sapien
tgtgcgacgccatccgcctcgatgg

SEQ ID NO: 209242 - DNA, 25 bp, Homo sapien
tgaacctggcgaaggaacgcgaacc

SEQ ID NO: 209243 - DNA, 25 bp, Homo sapien
tcgtgccgttgctcgactctaaccg

SEQ ID NO: 209244 - DNA, 25 bp, Homo sapien
cagtagcggtgttggcgactaacaa

SEQ ID NO: 209245 - DNA, 25 bp, Homo sapien
gacgagctgctttcgctgcacgcct

SEQ ID NO: 209246 - DNA, 25 bp, Homo sapien
acgcatggtagagaagcgcgcagcc

SEQ ID NO: 209247 - DNA, 25 bp, Homo sapien
cacatgttcaagcattcggaggaga

SEQ ID NO: 209248 - DNA, 25 bp, Homo sapien
tctaaccgcttggaggcgcagtgca

SEQ ID NO: 209249 - DNA, 25 bp, Homo sapien
gtcaggcatcttggagcacatgttc

SEQ ID NO: 209250 - DNA, 25 bp, Homo sapien
cctgggcatgaaatcgggcatcacc

SEQ ID NO: 209251 - DNA, 25 bp, Homo sapien
tgcagcagatcggtttctccaagta

SEQ ID NO: 209252 - DNA, 25 bp, Homo sapien
tccagagcctgaaacgcctggtttc

SEQ ID NO: 209253 - DNA, 25 bp, Homo sapien
agcctgtacgcagccaccgttaggg

SEQ ID NO: 209254 - DNA, 25 bp, Homo sapien
ccttgcatcttgtgctcgaggtcca

SEQ ID NO: 209255 - DNA, 25 bp, Homo sapien
caactattctacgtgcgaccgcagc

SEQ ID NO: 209256 - DNA, 25 bp, Homo sapien
tacacctacggcctggtcagctgcg

SEQ ID NO: 209257 - DNA, 25 bp, Homo sapien
gttagggtcactcggctctgatcta

SEQ ID NO: 209258 - DNA, 25 bp, Homo sapien
attctcgctcaccttccgggtcgga

SEQ ID NO: 209259 - DNA, 25 bp, Homo sapien
cttcctgcccaaaaatccgcgaggt

SEQ ID NO: 209260 - DNA, 25 bp, Homo sapien
tccgcgaggttttcgaggaatcacg

SEQ ID NO: 209261 - DNA, 25 bp, Homo sapien
atcgaaacccacgaattccctagcg

SEQ ID NO: 209262 - DNA, 25 bp, Homo sapien
tcctgcgccgttaaatccaccaagt

SEQ ID NO: 209263 - DNA, 25 bp, Homo sapien
cggagcctggaagctacgtctcaga

SEQ ID NO: 209264 - DNA, 25 bp, Homo sapien
cccgagcaacggctttagtacctca

SEQ ID NO: 209265 - DNA, 25 bp, Homo sapien
ctgacctcgatcctgcgccgttaaa

SEQ ID NO: 209266 - DNA, 25 bp, Homo sapien
gctgacatctgccacggacgcaaag

SEQ ID NO: 209267 - DNA, 25 bp, Homo sapien
ggcacaaaggatgcgacccagcacg

SEQ ID NO: 209268 - DNA, 25 bp, Homo sapien
cccagcacgaagtagccgacgtgga

SEQ ID NO: 209269 - DNA, 25 bp, Homo sapien
tgcagctgcaccacaaaaacggaca

SEQ ID NO: 209270 - DNA, 25 bp, Homo sapien
ccgaagtcgccgaggagggcacaaa

SEQ ID NO: 209271 - DNA, 25 bp, Homo sapien
gccagaaggccaccgaagtcgccga

SEQ ID NO: 209272 - DNA, 25 bp, Homo sapien
cgcaaagctagcagccagaaggcca

SEQ ID NO: 209273 - DNA, 25 bp, Homo sapien
tgccacggacgcaaagctagcagcc

SEQ ID NO: 209274 - DNA, 25 bp, Homo sapien
ggttgaaacgccagggtctcgcctg

SEQ ID NO: 209275 - DNA, 25 bp, Homo sapien
tccacaccgggcgtgtgggttgaaa

SEQ ID NO: 209276 - DNA, 25 bp, Homo sapien
gccgctcgctttgaagtcggccgcg

SEQ ID NO: 209277 - DNA, 25 bp, Homo sapien
taataggcacctacgcggccgccgg

SEQ ID NO: 209278 - DNA, 25 bp, Homo sapien
ccggcgctaataggcacctacgcgg

SEQ ID NO: 209279 - DNA, 25 bp, Homo sapien
gagccggaacttttgaagcccaggc

SEQ ID NO: 209280 - DNA, 25 bp, Homo sapien
gaggaagagccggaacttttgaagc

SEQ ID NO: 209281 - DNA, 25 bp, Homo sapien
gagcggctcccggactttctctccc

SEQ ID NO: 209282 - DNA, 25 bp, Homo sapien
cacctgtaaagtgtgcgtagacacc

SEQ ID NO: 209283 - DNA, 25 bp, Homo sapien
ccgcgggatgacctcacctgtaaag

SEQ ID NO: 209284 - DNA, 25 bp, Homo sapien
gtgacctgaggccaccggactctcg

SEQ ID NO: 209285 - DNA, 25 bp, Homo sapien
gcgagcgactcgctgcctgggacca

SEQ ID NO: 209286 - DNA, 25 bp, Homo sapien
ggccctgcaggaccaaggcaaagtt

SEQ ID NO: 209287 - DNA, 25 bp, Homo sapien
cgctgaagcggtgccacagatactg

SEQ ID NO: 209288 - DNA, 25 bp, Homo sapien
ccctttggcgggtgccattgtagcc

SEQ ID NO: 209289 - DNA, 25 bp, Homo sapien
caaggcaaagttggccaggaagacc

SEQ ID NO: 209290 - DNA, 25 bp, Homo sapien
gggtgctcaccaccggtgatccgct

SEQ ID NO: 209291 - DNA, 25 bp, Homo sapien
cctccggcccgatcggctgcttcct

SEQ ID NO: 209292 - DNA, 25 bp, Homo sapien
caccttcatggccttgcggggccga

SEQ ID NO: 209293 - DNA, 25 bp, Homo sapien
gctccgactcggacccagattcgga

SEQ ID NO: 209294 - DNA, 25 bp, Homo sapien
cttcaccttcatggccttgcggggc

SEQ ID NO: 209295 - DNA, 25 bp, Homo sapien
cagattcggattccgcaggcggctg

SEQ ID NO: 209296 - DNA, 25 bp, Homo sapien
accctcccgaaatgcgacgggcgcg

SEQ ID NO: 209297 - DNA, 25 bp, Homo sapien
cgactcggacccagattcggattcc

SEQ ID NO: 209298 - DNA, 25 bp, Homo sapien
ggccaatcgcgagcgctactccaga

SEQ ID NO: 209299 - DNA, 25 bp, Homo sapien
tcgtgagcctcacccaatcggaatc

SEQ ID NO: 209300 - DNA, 25 bp, Homo sapien
caccgcacctaggtgtgtagccgca

SEQ ID NO: 209301 - DNA, 25 bp, Homo sapien
cgtggtcttccaccagagcggtagc

SEQ ID NO: 209302 - DNA, 25 bp, Homo sapien
gcctgaagggaatctcgtctgaaga

SEQ ID NO: 209303 - DNA, 25 bp, Homo sapien
ggcccgcgttcattgggatctccgt

SEQ ID NO: 209304 - DNA, 25 bp, Homo sapien
gcacgatggccaccgcagcgaagaa

SEQ ID NO: 209305 - DNA, 25 bp, Homo sapien
ttcgctggggatctgaaaggaagtc

SEQ ID NO: 209306 - DNA, 25 bp, Homo sapien
gcgttttccgctgacggagccctca

SEQ ID NO: 209307 - DNA, 25 bp, Homo sapien
cacccgccgtctgtgtttgaacctg

SEQ ID NO: 209308 - DNA, 25 bp, Homo sapien
ctcagaccaagtcgaggacgccatg

SEQ ID NO: 209309 - DNA, 25 bp, Homo sapien
ggcaggcctatcacgtctcagacca

SEQ ID NO: 209310 - DNA, 25 bp, Homo sapien
agagatctcccgcttaccgtctggg

SEQ ID NO: 209311 - DNA, 25 bp, Homo sapien
gggctcgacccaactttccaggaca

SEQ ID NO: 209312 - DNA, 25 bp, Homo sapien
agagtacgctcgcaccctagtcgcg

SEQ ID NO: 209313 - DNA, 25 bp, Homo sapien
gcggacctcctcacatccatggtgt

SEQ ID NO: 209314 - DNA, 25 bp, Homo sapien
gaacagaggcatttaggtccgggtc

SEQ ID NO: 209315 - DNA, 25 bp, Homo sapien
ccggcctagaaagagggcgctaagc

SEQ ID NO: 209316 - DNA, 25 bp, Homo sapien
tgtcctacgacgctgcagggccgac

SEQ ID NO: 209317 - DNA, 25 bp, Homo sapien
gtggacctggctgactcatttcggt

SEQ ID NO: 209318 - DNA, 25 bp, Homo sapien
gggcgctaagcgcaactagcagcaa

SEQ ID NO: 209319 - DNA, 25 bp, Homo sapien
ctagcagcaagaccaacagcgcgga

SEQ ID NO: 209320 - DNA, 25 bp, Homo sapien
ctcaccggcctagaaagagggcgct

SEQ ID NO: 209321 - DNA, 25 bp, Homo sapien
cgcggagaagaacagaggcatttag

SEQ ID NO: 209322 - DNA, 25 bp, Homo sapien
tgcggtgggtccgtactatcttttc

SEQ ID NO: 209323 - DNA, 25 bp, Homo sapien
cgacgactccattttcctcggtggg

SEQ ID NO: 209324 - DNA, 25 bp, Homo sapien
tcggttacctttcgcacccacgaga

SEQ ID NO: 209325 - DNA, 25 bp, Homo sapien
acgatactctcgctctgttccaggg

SEQ ID NO: 209326 - DNA, 25 bp, Homo sapien
cggctgagcctggttacttacgata

SEQ ID NO: 209327 - DNA, 25 bp, Homo sapien
gcccgagtctgatctttatggttta

SEQ ID NO: 209328 - DNA, 25 bp, Homo sapien
ggcgcgtattgagtagcttcaccac

SEQ ID NO: 209329 - DNA, 25 bp, Homo sapien
ggcgggcttcagacaggtaaagttc

SEQ ID NO: 209330 - DNA, 25 bp, Homo sapien
cgcccaggtcttcgtctctacagga

SEQ ID NO: 209331 - DNA, 25 bp, Homo sapien
tccgatagccgagcgttccagctct

SEQ ID NO: 209332 - DNA, 25 bp, Homo sapien
ggctcggtcttttccttagtccatc

SEQ ID NO: 209333 - DNA, 25 bp, Homo sapien
caattgtgagcgtcgtcctgaccca

SEQ ID NO: 209334 - DNA, 25 bp, Homo sapien
actcttgcgtgaagtccaaccctga

SEQ ID NO: 209335 - DNA, 25 bp, Homo sapien
ggtggaaccctcagtctccttggtc

SEQ ID NO: 209336 - DNA, 25 bp, Homo sapien
gccgcggaggtaattgtgatgccac

SEQ ID NO: 209337 - DNA, 25 bp, Homo sapien
gtctcagcgtcagccgcgttcttca

SEQ ID NO: 209338 - DNA, 25 bp, Homo sapien
gaatgttcatcctgcctgcggcctt

SEQ ID NO: 209339 - DNA, 25 bp, Homo sapien
tcttttgacgcttcaccgggcacca

SEQ ID NO: 209340 - DNA, 25 bp, Homo sapien
ctccgcacgggtgccagaatgttca

SEQ ID NO: 209341 - DNA, 25 bp, Homo sapien
gggccacggagatgaaacaatcacc

SEQ ID NO: 209342 - DNA, 25 bp, Homo sapien
gccggatagttcctacgattacgcg

SEQ ID NO: 209343 - DNA, 25 bp, Homo sapien
cgaggagactcttcggccgccaatt

SEQ ID NO: 209344 - DNA, 25 bp, Homo sapien
gggctccgccaacgctgtaacacga

SEQ ID NO: 209345 - DNA, 25 bp, Homo sapien
gaggctgccctaccattacagagcg

SEQ ID NO: 209346 - DNA, 25 bp, Homo sapien
agcgtcagtgttctctgctgcgtcg

SEQ ID NO: 209347 - DNA, 25 bp, Homo sapien
tccagcaatgggattgcgagcgtca

SEQ ID NO: 209348 - DNA, 25 bp, Homo sapien
ctgaggctctcaggtgagtccagca

SEQ ID NO: 209349 - DNA, 25 bp, Homo sapien
aagattaatagttgcccggctccgg

SEQ ID NO: 209350 - DNA, 25 bp, Homo sapien
ccacttctacctttagggcggactg

SEQ ID NO: 209351 - DNA, 25 bp, Homo sapien
gcggtgatgaagaggcccattaacc

SEQ ID NO: 209352 - DNA, 25 bp, Homo sapien
cagcttcattaagggcctccgccag

SEQ ID NO: 209353 - DNA, 25 bp, Homo sapien
cgcctcccaaccaggacattagaaa

SEQ ID NO: 209354 - DNA, 25 bp, Homo sapien
agagggcgccgctctgcaaattacc

SEQ ID NO: 209355 - DNA, 25 bp, Homo sapien
cgaacgaattgggaacacggctgct

SEQ ID NO: 209356 - DNA, 25 bp, Homo sapien
tcagctctaagtacaaagcatcgcg

SEQ ID NO: 209357 - DNA, 25 bp, Homo sapien
catcgcgagtctttagtgctctttg

SEQ ID NO: 209358 - DNA, 25 bp, Homo sapien
tgctctttggcgctataagcccgtg

SEQ ID NO: 209359 - DNA, 25 bp, Homo sapien
tgcgtttcggacacgctgcagtata

SEQ ID NO: 209360 - DNA, 25 bp, Homo sapien
acgagcattggagacccttttcaca

SEQ ID NO: 209361 - DNA, 25 bp, Homo sapien
tgccgcgccgcagagcgaacgaatt

SEQ ID NO: 209362 - DNA, 25 bp, Homo sapien
tagcttgcagcagttgcggctccta

SEQ ID NO: 209363 - DNA, 25 bp, Homo sapien
acacagttggcgaagccctctaggc

SEQ ID NO: 209364 - DNA, 25 bp, Homo sapien
cggacttcgggtaactaggagctgt

SEQ ID NO: 209365 - DNA, 25 bp, Homo sapien
gccctctactttctgcgcagagctg

SEQ ID NO: 209366 - DNA, 25 bp, Homo sapien
ggaactgctgagtaacccatcgcca

SEQ ID NO: 209367 - DNA, 25 bp, Homo sapien
ctgggcaagcaagacctccgatttg

SEQ ID NO: 209368 - DNA, 25 bp, Homo sapien
gacctccgatttgccgggacagctg

SEQ ID NO: 209369 - DNA, 25 bp, Homo sapien
tctgttctgggaaccgggatccctc

SEQ ID NO: 209370 - DNA, 25 bp, Homo sapien
cgtggtgccataaagcccagctgga

SEQ ID NO: 209371 - DNA, 25 bp, Homo sapien
cgggatgggccatccgcgctcctga

SEQ ID NO: 209372 - DNA, 25 bp, Homo sapien
tgcggacacctggagtgccacggcc

SEQ ID NO: 209373 - DNA, 25 bp, Homo sapien
tacaacgaggccttcaacgcgctgc

SEQ ID NO: 209374 - DNA, 25 bp, Homo sapien
tggcagctggactataaaacccggg

SEQ ID NO: 209375 - DNA, 25 bp, Homo sapien
ggcctgtctcgggagtgtccagccc

SEQ ID NO: 209376 - DNA, 25 bp, Homo sapien
tacctggaggccgataataaagcag

SEQ ID NO: 209377 - DNA, 25 bp, Homo sapien
gagcgcaagcgcatcctagactaca

SEQ ID NO: 209378 - DNA, 25 bp, Homo sapien
cctgaaatagcgtcactcgtgggca

SEQ ID NO: 209379 - DNA, 25 bp, Homo sapien
ttgccctattcttggacactgcgtg

SEQ ID NO: 209380 - DNA, 25 bp, Homo sapien
tgcaggcccacaaatacggacgcgt

SEQ ID NO: 209381 - DNA, 25 bp, Homo sapien
accgtgtcatgtcctcttcaggtga

SEQ ID NO: 209382 - DNA, 25 bp, Homo sapien
tgcgtgccaaggagaacccgctttc

SEQ ID NO: 209383 - DNA, 25 bp, Homo sapien
gcgcgccctattttcttgccctatt

SEQ ID NO: 209384 - DNA, 25 bp, Homo sapien
tcgggaacgcgacatccttttagtc

SEQ ID NO: 209385 - DNA, 25 bp, Homo sapien
tcaacttgcacgacttgggatttcc

SEQ ID NO: 209386 - DNA, 25 bp, Homo sapien
ttgcctctggagaagaaaacctttg

SEQ ID NO: 209387 - DNA, 25 bp, Homo sapien
atgcgcgagcctgtgcaggtttcca

SEQ ID NO: 209388 - DNA, 25 bp, Homo sapien
cctggagaagcccaagcgacggctg

SEQ ID NO: 209389 - DNA, 25 bp, Homo sapien
catgcctggcttcgactacaagttc

SEQ ID NO: 209390 - DNA, 25 bp, Homo sapien
cgagactggcggtcaccagacccaa

SEQ ID NO: 209391 - DNA, 25 bp, Homo sapien
agaagcggagccacgatctctgtcc

SEQ ID NO: 209392 - DNA, 25 bp, Homo sapien
accgtttctgcgatacctgcctgca

SEQ ID NO: 209393 - DNA, 25 bp, Homo sapien
ttcggctgcctagcacctggaagct

SEQ ID NO: 209394 - DNA, 25 bp, Homo sapien
ggggtcgcgttagaaaaagcacaca

SEQ ID NO: 209395 - DNA, 25 bp, Homo sapien
ctcctgtctgcacagccaatggcga

SEQ ID NO: 209396 - DNA, 25 bp, Homo sapien
gccaggctcacggagcgcaggactc

SEQ ID NO: 209397 - DNA, 25 bp, Homo sapien
aaaggtgaggttcgctccgcagcgc

SEQ ID NO: 209398 - DNA, 25 bp, Homo sapien
gcccgactcggctcctctttgttag

SEQ ID NO: 209399 - DNA, 25 bp, Homo sapien
ccttgcgccctggaaaggtgaggtt

SEQ ID NO: 209400 - DNA, 25 bp, Homo sapien
ggagccagcagagcgactcgccaaa

SEQ ID NO: 209401 - DNA, 25 bp, Homo sapien
gcgactcgccaaacagccaactggg

SEQ ID NO: 209402 - DNA, 25 bp, Homo sapien
tgtatccttccgctaagttaccctc

SEQ ID NO: 209403 - DNA, 25 bp, Homo sapien
gccgccaccacttctccactgcccg

SEQ ID NO: 209404 - DNA, 25 bp, Homo sapien
gcccttccgtctcccacagtcagag

SEQ ID NO: 209405 - DNA, 25 bp, Homo sapien
cacaaagtcatgtatccttccgcta

SEQ ID NO: 209406 - DNA, 25 bp, Homo sapien
agtcatgtatccttccgctaagtta

SEQ ID NO: 209407 - DNA, 25 bp, Homo sapien
caccactactcacggtcggtgactg

SEQ ID NO: 209408 - DNA, 25 bp, Homo sapien
actactcacggtcggtgactgggcc

SEQ ID NO: 209409 - DNA, 25 bp, Homo sapien
ggccctcatggctgctcctttgccg

SEQ ID NO: 209410 - DNA, 25 bp, Homo sapien
tctgttcaatcgtaggagcgctcct

SEQ ID NO: 209411 - DNA, 25 bp, Homo sapien
cgacagttcggtgactccttgcgtc

SEQ ID NO: 209412 - DNA, 25 bp, Homo sapien
tcggattctctcagcccgacagttc

SEQ ID NO: 209413 - DNA, 25 bp, Homo sapien
ttctcgcagtaatggccagggctct

SEQ ID NO: 209414 - DNA, 25 bp, Homo sapien
ctcttaggcttccaacggaggtgcg

SEQ ID NO: 209415 - DNA, 25 bp, Homo sapien
ggagcgggtgatccctttttcctca

SEQ ID NO: 209416 - DNA, 25 bp, Homo sapien
ggctaggcttgttcaatcggtgtta

SEQ ID NO: 209417 - DNA, 25 bp, Homo sapien
gctggttcgtcagccgctctgttca

SEQ ID NO: 209418 - DNA, 25 bp, Homo sapien
gcttcggcggtcaacgcgctttatt

SEQ ID NO: 209419 - DNA, 25 bp, Homo sapien
acgcgctttattccgaggggcttca

SEQ ID NO: 209420 - DNA, 25 bp, Homo sapien
ctgtgccgagaaacgacctctgttt

SEQ ID NO: 209421 - DNA, 25 bp, Homo sapien
tggaatccagccaaacctctgcgtt

SEQ ID NO: 209422 - DNA, 25 bp, Homo sapien
cctgcttggaattaacgggtctgac

SEQ ID NO: 209423 - DNA, 25 bp, Homo sapien
ctgaaaccaccagcgcctcgttggg

SEQ ID NO: 209424 - DNA, 25 bp, Homo sapien
cgaggggcttcagatacagatgacc

SEQ ID NO: 209425 - DNA, 25 bp, Homo sapien
cacgagatctctcttggaaggggcc

SEQ ID NO: 209426 - DNA, 25 bp, Homo sapien
acaagcacgtaagcgcccagcagca

SEQ ID NO: 209427 - DNA, 25 bp, Homo sapien
cgcaccgccctggatcgccgccagg

SEQ ID NO: 209428 - DNA, 25 bp, Homo sapien
tgtagtagacaagcacgtaagcgcc

SEQ ID NO: 209429 - DNA, 25 bp, Homo sapien
ggccttcaccaggttgtagtagaca

SEQ ID NO: 209430 - DNA, 25 bp, Homo sapien
ttccgatgccgctgttggcgcctgc

SEQ ID NO: 209431 - DNA, 25 bp, Homo sapien
cgtcatctttccgatgccgctgttg

SEQ ID NO: 209432 - DNA, 25 bp, Homo sapien
gtgtcccggcgggttctcggctcac

SEQ ID NO: 209433 - DNA, 25 bp, Homo sapien
gcggctgccgatccgccctgcacag

SEQ ID NO: 209434 - DNA, 25 bp, Homo sapien
atccactcgagaaggcggcgttctg

SEQ ID NO: 209435 - DNA, 25 bp, Homo sapien
cggcgttctgctgggtgaacacaca

SEQ ID NO: 209436 - DNA, 25 bp, Homo sapien
cacacactcgagaaggcggcgttct

SEQ ID NO: 209437 - DNA, 25 bp, Homo sapien
acccactcgagaaggcagcgttctg

SEQ ID NO: 209438 - DNA, 25 bp, Homo sapien
cgacattccgctgggcgaacacaca

SEQ ID NO: 209439 - DNA, 25 bp, Homo sapien
tccactcgagaaggcgacgttccgc

SEQ ID NO: 209440 - DNA, 25 bp, Homo sapien
cccactcgagaaggcagcgttctgc

SEQ ID NO: 209441 - DNA, 25 bp, Homo sapien
acacactcgagaaggcggcgttctg

SEQ ID NO: 209442 - DNA, 25 bp, Homo sapien
ataatgggccgcctcctgtgaggag

SEQ ID NO: 209443 - DNA, 25 bp, Homo sapien
caaccttatgggctgtggaaccgcg

SEQ ID NO: 209444 - DNA, 25 bp, Homo sapien
ctggccaaggctccgtttcaggttc

SEQ ID NO: 209445 - DNA, 25 bp, Homo sapien
cgcttcagactttggttgcaggatc

SEQ ID NO: 209446 - DNA, 25 bp, Homo sapien
agctggctgggaatccgacccgcct

SEQ ID NO: 209447 - DNA, 25 bp, Homo sapien
tgctctttaacgacgccggataatg

SEQ ID NO: 209448 - DNA, 25 bp, Homo sapien
acttgttctcggcttaatttccatc

SEQ ID NO: 209449 - DNA, 25 bp, Homo sapien
caccgcgttctctgcgtagccggag

SEQ ID NO: 209450 - DNA, 25 bp, Homo sapien
gtacacgatcgtcttggtctccatt

SEQ ID NO: 209451 - DNA, 25 bp, Homo sapien
ccctgatgtgtccaagtcgtacacg

SEQ ID NO: 209452 - DNA, 25 bp, Homo sapien
agtggtcgcagcacaggagatctcc

SEQ ID NO: 209453 - DNA, 25 bp, Homo sapien
tcaggcttccgactgcgcttttctg

SEQ ID NO: 209454 - DNA, 25 bp, Homo sapien
cagcttcttccaaatggggaggatc

SEQ ID NO: 209455 - DNA, 25 bp, Homo sapien
gcgggtaggtgaaactgctgcaaac

SEQ ID NO: 209456 - DNA, 25 bp, Homo sapien
tgctgcaaacgtcctcggaggctga

SEQ ID NO: 209457 - DNA, 25 bp, Homo sapien
tctaggcgcttcgagtttaggactg

SEQ ID NO: 209458 - DNA, 25 bp, Homo sapien
tttgagagcgtcagtgctgcatgcc

SEQ ID NO: 209459 - DNA, 25 bp, Homo sapien
cggggattcatgctccttttcaggg

SEQ ID NO: 209460 - DNA, 25 bp, Homo sapien
tcccagtttgcaacgccaaagggtc

SEQ ID NO: 209461 - DNA, 25 bp, Homo sapien
catcctgggagcaagaatcgcgata

SEQ ID NO: 209462 - DNA, 25 bp, Homo sapien
ctgtagttccatgtgcgtgcgatgc

SEQ ID NO: 209463 - DNA, 25 bp, Homo sapien
gtgcgatgcactctatggtaggata

SEQ ID NO: 209464 - DNA, 25 bp, Homo sapien
ggaagagtcatttgccggccaggaa

SEQ ID NO: 209465 - DNA, 25 bp, Homo sapien
cttggtattgccgtcagagatgggc

SEQ ID NO: 209466 - DNA, 25 bp, Homo sapien
taatgagccattcaggatgcctccc

SEQ ID NO: 209467 - DNA, 25 bp, Homo sapien
cccgcattagctcttaagctgtgca

SEQ ID NO: 209468 - DNA, 25 bp, Homo sapien
catcggcactaatgagccattcagg

SEQ ID NO: 209469 - DNA, 25 bp, Homo sapien
aaaaaggctttcatcggcactaatg

SEQ ID NO: 209470 - DNA, 25 bp, Homo sapien
ctgtttaaagtatttagacgaaatg

SEQ ID NO: 209471 - DNA, 25 bp, Homo sapien
aaatagacatcggagggagccctgt

SEQ ID NO: 209472 - DNA, 25 bp, Homo sapien
cccggtggattctctcccgctcccg

SEQ ID NO: 209473 - DNA, 25 bp, Homo sapien
ctcttaagctgtgcaaatagacatc

SEQ ID NO: 209474 - DNA, 25 bp, Homo sapien
ccgcagcacgttgacagcaggatta

SEQ ID NO: 209475 - DNA, 25 bp, Homo sapien
tgacagcaggattacccttcggagc

SEQ ID NO: 209476 - DNA, 25 bp, Homo sapien
ggggactcagaatccgcagcacgtt

SEQ ID NO: 209477 - DNA, 25 bp, Homo sapien
gcatgttgacagcaggattaccctt

SEQ ID NO: 209478 - DNA, 25 bp, Homo sapien
cgcagcacgttgacagcaggattac

SEQ ID NO: 209479 - DNA, 25 bp, Homo sapien
ttacccttcggagccgtgcgcgctg

SEQ ID NO: 209480 - DNA, 25 bp, Homo sapien
cacgttgacagcaggattacccttc

SEQ ID NO: 209481 - DNA, 25 bp, Homo sapien
catgttgacagcaggattacccttc

SEQ ID NO: 209482 - DNA, 25 bp, Homo sapien
tgcctgcagtaatgaatggacaaac

SEQ ID NO: 209483 - DNA, 25 bp, Homo sapien
aaccttgcaaaggaggtcatctgcc

SEQ ID NO: 209484 - DNA, 25 bp, Homo sapien
ggtcaagaaatagcccagacattcc

SEQ ID NO: 209485 - DNA, 25 bp, Homo sapien
tcgcttggcctctctactttttata

SEQ ID NO: 209486 - DNA, 25 bp, Homo sapien
tccactccagggtcatctcgcttgg

SEQ ID NO: 209487 - DNA, 25 bp, Homo sapien
tctaaagagatcagtgctaccctcc

SEQ ID NO: 209488 - DNA, 25 bp, Homo sapien
ctattcctggcgctctctaaagaga

SEQ ID NO: 209489 - DNA, 25 bp, Homo sapien
tccgccctgcttccatggtcatttg

SEQ ID NO: 209490 - DNA, 25 bp, Homo sapien
gcgcctgacagaatcagcaccacgg

SEQ ID NO: 209491 - DNA, 25 bp, Homo sapien
taagaacactagaggccctggaacc

SEQ ID NO: 209492 - DNA, 25 bp, Homo sapien
ccggcggcaaagtcgagcgaagttt

SEQ ID NO: 209493 - DNA, 25 bp, Homo sapien
agcaccctgagatgcctagagtgtg

SEQ ID NO: 209494 - DNA, 25 bp, Homo sapien
cccattagatctggggagatgatta

SEQ ID NO: 209495 - DNA, 25 bp, Homo sapien
gtcccttaccgtgagccaggagcgc

SEQ ID NO: 209496 - DNA, 25 bp, Homo sapien
aggagcggcttaccgtaaagtctca

SEQ ID NO: 209497 - DNA, 25 bp, Homo sapien
taaagtctcatgcaaaggcgcagag

SEQ ID NO: 209498 - DNA, 25 bp, Homo sapien
cgaggtgagcttcctcggctgctca

SEQ ID NO: 209499 - DNA, 25 bp, Homo sapien
tgcccatttgcgatcggcacctgga

SEQ ID NO: 209500 - DNA, 25 bp, Homo sapien
taggccgggctgatttccctggaac

SEQ ID NO: 209501 - DNA, 25 bp, Homo sapien
cctgtaatgagctcccagggcccga

SEQ ID NO: 209502 - DNA, 25 bp, Homo sapien
gcagccgcgtggcagcaaagaacac

SEQ ID NO: 209503 - DNA, 25 bp, Homo sapien
tctaattgaaatgccctccgcgctg

SEQ ID NO: 209504 - DNA, 25 bp, Homo sapien
tggcagcaaagaacacggggacttt

SEQ ID NO: 209505 - DNA, 25 bp, Homo sapien
ccgcgtgcttccctgtaatgagctc

SEQ ID NO: 209506 - DNA, 25 bp, Homo sapien
agagccagccctgtcttcgccagag

SEQ ID NO: 209507 - DNA, 25 bp, Homo sapien
ccgttctctttcttctcgacttgga

SEQ ID NO: 209508 - DNA, 25 bp, Homo sapien
acttggacttcttgctcttccgaga

SEQ ID NO: 209509 - DNA, 25 bp, Homo sapien
gcctcttgtgctctgaggaagcttc

SEQ ID NO: 209510 - DNA, 25 bp, Homo sapien
ctccgggcactttggatgctcttcc

SEQ ID NO: 209511 - DNA, 25 bp, Homo sapien
tgctccgctggaatggaacaggctt

SEQ ID NO: 209512 - DNA, 25 bp, Homo sapien
aagacctcgttgacggcagcctcca

SEQ ID NO: 209513 - DNA, 25 bp, Homo sapien
gaggctcatccactgccgaggcaga

SEQ ID NO: 209514 - DNA, 25 bp, Homo sapien
tcacccttgaggtcatcgctggagc

SEQ ID NO: 209515 - DNA, 25 bp, Homo sapien
gcgcaggtcgactgggaacttttta

SEQ ID NO: 209516 - DNA, 25 bp, Homo sapien
gctgcaccagctgtccctctagagt

SEQ ID NO: 209517 - DNA, 25 bp, Homo sapien
atcatctgtgagttctgcttggcca

SEQ ID NO: 209518 - DNA, 25 bp, Homo sapien
gctgtacttaggtggcccgagtcca

SEQ ID NO: 209519 - DNA, 25 bp, Homo sapien
cccggttactatcggagtcaatgtc

SEQ ID NO: 209520 - DNA, 25 bp, Homo sapien
agtcaatgtcagtcaggtgcaggtc

SEQ ID NO: 209521 - DNA, 25 bp, Homo sapien
tcgaggtttctgaggcgctctcatc

SEQ ID NO: 209522 - DNA, 25 bp, Homo sapien
gactgcacgcttctcacgtgacatt

SEQ ID NO: 209523 - DNA, 25 bp, Homo sapien
gcttctcacgtgacattagccagcc

SEQ ID NO: 209524 - DNA, 25 bp, Homo sapien
cctcgccaagggttgtagcagcggc

SEQ ID NO: 209525 - DNA, 25 bp, Homo sapien
gggtgactccctgccaggtcacacg

SEQ ID NO: 209526 - DNA, 25 bp, Homo sapien
tgccaggtcacacggagcttatctg

SEQ ID NO: 209527 - DNA, 25 bp, Homo sapien
acggagcttatctggctccaggtgt

SEQ ID NO: 209528 - DNA, 25 bp, Homo sapien
ggaaggcagcaatcccgcgggccat

SEQ ID NO: 209529 - DNA, 25 bp, Homo sapien
tgtgctccctcacgccgactgcacg

SEQ ID NO: 209530 - DNA, 25 bp, Homo sapien
gcacgcattcatgctggggtactca

SEQ ID NO: 209531 - DNA, 25 bp, Homo sapien
ctgagatacgcacgcattcatgctg

SEQ ID NO: 209532 - DNA, 25 bp, Homo sapien
gctctcacacactgagatacgcacg

SEQ ID NO: 209533 - DNA, 25 bp, Homo sapien
tgacgctctcacacactgagatacg

SEQ ID NO: 209534 - DNA, 25 bp, Homo sapien
ggtactgacgctctcacacactgag

SEQ ID NO: 209535 - DNA, 25 bp, Homo sapien
atacgcacgcattcatgctggggta

SEQ ID NO: 209536 - DNA, 25 bp, Homo sapien
cacacactgagatacgcacgcattc

SEQ ID NO: 209537 - DNA, 25 bp, Homo sapien
tcacacactgagatacgcacgcatt

SEQ ID NO: 209538 - DNA, 25 bp, Homo sapien
cgagccgaaagggagctccctgctg

SEQ ID NO: 209539 - DNA, 25 bp, Homo sapien
ctgtggggataaacgcccggcctgc

SEQ ID NO: 209540 - DNA, 25 bp, Homo sapien
cggcaggcagcagaagcggagacgc

SEQ ID NO: 209541 - DNA, 25 bp, Homo sapien
gcggagacgcggcatccagcagcct

SEQ ID NO: 209542 - DNA, 25 bp, Homo sapien
gagacgcggcatccagcagcctcgg

SEQ ID NO: 209543 - DNA, 25 bp, Homo sapien
caggccgagccgaaagggagctccc

SEQ ID NO: 209544 - DNA, 25 bp, Homo sapien
ggcgtcgagctccacggcgccgcca

SEQ ID NO: 209545 - DNA, 25 bp, Homo sapien
cgctcgctccatcgtggggcctgga

SEQ ID NO: 209546 - DNA, 25 bp, Homo sapien
gggtgaggggcacttcctcaactca

SEQ ID NO: 209547 - DNA, 25 bp, Homo sapien
acccgtgagatgaggggtcccaaca

SEQ ID NO: 209548 - DNA, 25 bp, Homo sapien
cgtttagtggtggaaatgacccgtg

SEQ ID NO: 209549 - DNA, 25 bp, Homo sapien
atcggcttccaacatggcggacagg

SEQ ID NO: 209550 - DNA, 25 bp, Homo sapien
aggcaccgcctctacccgaaatgaa

SEQ ID NO: 209551 - DNA, 25 bp, Homo sapien
tcctgtggcagagaaactcgtgacc

SEQ ID NO: 209552 - DNA, 25 bp, Homo sapien
tcgcgacaccatccgagtcgggatt

SEQ ID NO: 209553 - DNA, 25 bp, Homo sapien
ccgcctgcaaaagggtctcgcgaca

SEQ ID NO: 209554 - DNA, 25 bp, Homo sapien
cgcgtctcgccagcgcactggttaa

SEQ ID NO: 209555 - DNA, 25 bp, Homo sapien
tcctcgccggcaagcaggctcgtgt

SEQ ID NO: 209556 - DNA, 25 bp, Homo sapien
agcactatggctctctcttctgtcg

SEQ ID NO: 209557 - DNA, 25 bp, Homo sapien
gccgggccttcaacgtcagcactat

SEQ ID NO: 209558 - DNA, 25 bp, Homo sapien
tccaacaatcaggagccacgctgtg

SEQ ID NO: 209559 - DNA, 25 bp, Homo sapien
cgcagtctgtgaacagcactttcta

SEQ ID NO: 209560 - DNA, 25 bp, Homo sapien
cactggttaaccgagcgattctgcg

SEQ ID NO: 209561 - DNA, 25 bp, Homo sapien
ttctgcgagattggcagccgcactc

SEQ ID NO: 209562 - DNA, 25 bp, Homo sapien
tccgcgaactcagtgaggccatgct

SEQ ID NO: 209563 - DNA, 25 bp, Homo sapien
cgcgcatgtagtcgtgtctcgcgca

SEQ ID NO: 209564 - DNA, 25 bp, Homo sapien
catcttaactgagcccaagcgctga

SEQ ID NO: 209565 - DNA, 25 bp, Homo sapien
tcttccctttgtgagcgcctcctta

SEQ ID NO: 209566 - DNA, 25 bp, Homo sapien
gcactaggcactcgcgaacatctga

SEQ ID NO: 209567 - DNA, 25 bp, Homo sapien
aactctgcccgtagcaagccttgcg

SEQ ID NO: 209568 - DNA, 25 bp, Homo sapien
cgtggcattagaagctccgcgaact

SEQ ID NO: 209569 - DNA, 25 bp, Homo sapien
gcctgtcaggcggaaaatctcgcga

SEQ ID NO: 209570 - DNA, 25 bp, Homo sapien
tcgcggcgaccaatctctttctaga

SEQ ID NO: 209571 - DNA, 25 bp, Homo sapien
ctttgggataggcatctcgaccctc

SEQ ID NO: 209572 - DNA, 25 bp, Homo sapien
cgactgtcatcagggtcttccgcca

SEQ ID NO: 209573 - DNA, 25 bp, Homo sapien
ctcggggctccacatcaaggaaatc

SEQ ID NO: 209574 - DNA, 25 bp, Homo sapien
ggatgcccgtccgacctacaaggaa

SEQ ID NO: 209575 - DNA, 25 bp, Homo sapien
aacgcctcgtaaaccggggtgcatg

SEQ ID NO: 209576 - DNA, 25 bp, Homo sapien
ctcgctgtttccaagctttgggata

SEQ ID NO: 209577 - DNA, 25 bp, Homo sapien
cccggccctttgtacagcaattgca

SEQ ID NO: 209578 - DNA, 25 bp, Homo sapien
ggccagcttcgcctggtacaccaga

SEQ ID NO: 209579 - DNA, 25 bp, Homo sapien
aggtcctcctttgtgagactccacg

SEQ ID NO: 209580 - DNA, 25 bp, Homo sapien
cccgcgagttgtttgcagttaagga

SEQ ID NO: 209581 - DNA, 25 bp, Homo sapien
ttccagggcatagagcctcccatcg

SEQ ID NO: 209582 - DNA, 25 bp, Homo sapien
acgcggacaactgctcagctctatg

SEQ ID NO: 209583 - DNA, 25 bp, Homo sapien
tctcgatcatccatagcggcagcgg

SEQ ID NO: 209584 - DNA, 25 bp, Homo sapien
aagctcccatgagggtggctcgttc

SEQ ID NO: 209585 - DNA, 25 bp, Homo sapien
gctcgcagacgatgccgccattttg

SEQ ID NO: 209586 - DNA, 25 bp, Homo sapien
gagtgacggcctgggacctgccact

SEQ ID NO: 209587 - DNA, 25 bp, Homo sapien
acacagtggctggtgaggagttccc

SEQ ID NO: 209588 - DNA, 25 bp, Homo sapien
ttccgacgcggggagagcatctact

SEQ ID NO: 209589 - DNA, 25 bp, Homo sapien
acgctctgcacacggctgcacagaa

SEQ ID NO: 209590 - DNA, 25 bp, Homo sapien
cggcccacagctgtgctgaagcgga

SEQ ID NO: 209591 - DNA, 25 bp, Homo sapien
gacctgccactgtggcgtgcggctc

SEQ ID NO: 209592 - DNA, 25 bp, Homo sapien
gctgcacagaaacttccgacgcggg

SEQ ID NO: 209593 - DNA, 25 bp, Homo sapien
gcccacagcggacagccaggacaca

SEQ ID NO: 209594 - DNA, 25 bp, Homo sapien
ggcaggcgtaccgaccacgcgagca

SEQ ID NO: 209595 - DNA, 25 bp, Homo sapien
ggggtggcactgagatgacataaaa

SEQ ID NO: 209596 - DNA, 25 bp, Homo sapien
agatgacataaaaccacactcgccc

SEQ ID NO: 209597 - DNA, 25 bp, Homo sapien
cgcttccgtcggatacagagatgga

SEQ ID NO: 209598 - DNA, 25 bp, Homo sapien
gcctccctcagaccgaggagcggga

SEQ ID NO: 209599 - DNA, 25 bp, Homo sapien
gggaacgtccttcctcgctagtcca

SEQ ID NO: 209600 - DNA, 25 bp, Homo sapien
cacgcgagcagcaggtgcaagacgc

SEQ ID NO: 209601 - DNA, 25 bp, Homo sapien
ctttcgggacatcctcagcggcgac

SEQ ID NO: 209602 - DNA, 25 bp, Homo sapien
cgcgtctcgagcacgtggcagctga

SEQ ID NO: 209603 - DNA, 25 bp, Homo sapien
cccagctatggaatttcatttatta

SEQ ID NO: 209604 - DNA, 25 bp, Homo sapien
attaaatgtcgaggaggctgctggc

SEQ ID NO: 209605 - DNA, 25 bp, Homo sapien
agccctgccgcttggctgtctttgt

SEQ ID NO: 209606 - DNA, 25 bp, Homo sapien
gtctttgtttctccgctgtgtgggc

SEQ ID NO: 209607 - DNA, 25 bp, Homo sapien
aagcgacctgggttcagtgtctacc

SEQ ID NO: 209608 - DNA, 25 bp, Homo sapien
ccaggcgctcagtccacgagcggtg

SEQ ID NO: 209609 - DNA, 25 bp, Homo sapien
gttcagtgtctaccgccgcctggca

SEQ ID NO: 209610 - DNA, 25 bp, Homo sapien
tcacctagatgagagtagaggcctc

SEQ ID NO: 209611 - DNA, 25 bp, Homo sapien
cgggaccacacgtgtttcggactca

SEQ ID NO: 209612 - DNA, 25 bp, Homo sapien
tctcccacgagatccggggacagtg

SEQ ID NO: 209613 - DNA, 25 bp, Homo sapien
ccgcggcttttgtgcttgttgaccg

SEQ ID NO: 209614 - DNA, 25 bp, Homo sapien
tgcactacctcgtgtggcacaaccg

SEQ ID NO: 209615 - DNA, 25 bp, Homo sapien
ccgagggcaagtatccgctgcacta

SEQ ID NO: 209616 - DNA, 25 bp, Homo sapien
tgagctgacaagctctacccggggc

SEQ ID NO: 209617 - DNA, 25 bp, Homo sapien
cccagtttcacgaggcggactacaa

SEQ ID NO: 209618 - DNA, 25 bp, Homo sapien
gcccaactgattgctaactgccata

SEQ ID NO: 209619 - DNA, 25 bp, Homo sapien
gccgacgccagggactgtaaaatca

SEQ ID NO: 209620 - DNA, 25 bp, Homo sapien
gcctagccgttcagccaacactttg

SEQ ID NO: 209621 - DNA, 25 bp, Homo sapien
ggtcccatgcggctacataaaattg

SEQ ID NO: 209622 - DNA, 25 bp, Homo sapien
atccaagttcgtgggctctctcaga

SEQ ID NO: 209623 - DNA, 25 bp, Homo sapien
tttcggactcgaatcacggctgctg

SEQ ID NO: 209624 - DNA, 25 bp, Homo sapien
gccacccattctctttgggcaagga

SEQ ID NO: 209625 - DNA, 25 bp, Homo sapien
ttccggacactaggtgagcactctg

SEQ ID NO: 209626 - DNA, 25 bp, Homo sapien
ttccggagctacgacgagcagctgc

SEQ ID NO: 209627 - DNA, 25 bp, Homo sapien
cagtgagtatgaccaggtgcgtctc

SEQ ID NO: 209628 - DNA, 25 bp, Homo sapien
caggtcaccatctgggaggcgctaa

SEQ ID NO: 209629 - DNA, 25 bp, Homo sapien
ccatgtcctacgagggtcgccgaca

SEQ ID NO: 209630 - DNA, 25 bp, Homo sapien
taagccaggacacagccggagaacc

SEQ ID NO: 209631 - DNA, 25 bp, Homo sapien
accctcctggtatcgggatggcttc

SEQ ID NO: 209632 - DNA, 25 bp, Homo sapien
cccaggcattgacggggagaacttg

SEQ ID NO: 209633 - DNA, 25 bp, Homo sapien
gatccaggcttcaccgcggagttca

SEQ ID NO: 209634 - DNA, 25 bp, Homo sapien
tgccactggctcctcgaagttgttc

SEQ ID NO: 209635 - DNA, 25 bp, Homo sapien
gcgcgccgcatgcagtcacagcaaa

SEQ ID NO: 209636 - DNA, 25 bp, Homo sapien
ggtgtgttcaccatcatcttataga

SEQ ID NO: 209637 - DNA, 25 bp, Homo sapien
cggctctttgctgctgaacgtgttc

SEQ ID NO: 209638 - DNA, 25 bp, Homo sapien
gcggctcgtcggtaatctcaaagta

SEQ ID NO: 209639 - DNA, 25 bp, Homo sapien
tctcaaagtaccgaatgctgctgtc

SEQ ID NO: 209640 - DNA, 25 bp, Homo sapien
tgtcgccctgcaaaatcagtcggtt

SEQ ID NO: 209641 - DNA, 25 bp, Homo sapien
gcagcagccttcagtcctgtccagg

SEQ ID NO: 209642 - DNA, 25 bp, Homo sapien
ctcccaatttagctgtcccgatcgg

SEQ ID NO: 209643 - DNA, 25 bp, Homo sapien
ttcgcagacctagagcaggacgctt

SEQ ID NO: 209644 - DNA, 25 bp, Homo sapien
ctgccgctgccatcaacctaagagg

SEQ ID NO: 209645 - DNA, 25 bp, Homo sapien
ctgacactgcgttcttgcgagacga

SEQ ID NO: 209646 - DNA, 25 bp, Homo sapien
gctggctgctgtccggccaaatata

SEQ ID NO: 209647 - DNA, 25 bp, Homo sapien
cacgctgcgaatcctctgcggaagg

SEQ ID NO: 209648 - DNA, 25 bp, Homo sapien
acctctccgggtgtctgtagtatct

SEQ ID NO: 209649 - DNA, 25 bp, Homo sapien
cggcctcggagaaccatcgaaaata

SEQ ID NO: 209650 - DNA, 25 bp, Homo sapien
ctcgccctcgcttgattgtttgctc

SEQ ID NO: 209651 - DNA, 25 bp, Homo sapien
gcgcgtcacagcctttagggcatcc

SEQ ID NO: 209652 - DNA, 25 bp, Homo sapien
gggccggctcaaagtgcacaactcc

SEQ ID NO: 209653 - DNA, 25 bp, Homo sapien
taaggaatcatgtcggggccaccga

SEQ ID NO: 209654 - DNA, 25 bp, Homo sapien
tcacagctggttgatggcgttctgc

SEQ ID NO: 209655 - DNA, 25 bp, Homo sapien
gcggctgctgaaagagcaaactttc

SEQ ID NO: 209656 - DNA, 25 bp, Homo sapien
cggagacctccaggcaagcaggatg

SEQ ID NO: 209657 - DNA, 25 bp, Homo sapien
agcaaactttctgagcgttcgcgga

SEQ ID NO: 209658 - DNA, 25 bp, Homo sapien
ccgcctggtcgtaacccttgagttg

SEQ ID NO: 209659 - DNA, 25 bp, Homo sapien
gtaacccttgagttgccggaagctg

SEQ ID NO: 209660 - DNA, 25 bp, Homo sapien
gctggaccgtgaccaaagccatcta

SEQ ID NO: 209661 - DNA, 25 bp, Homo sapien
caaagccatctaggcgctgctgggt

SEQ ID NO: 209662 - DNA, 25 bp, Homo sapien
tccgggcagggcattcttgtcctga

SEQ ID NO: 209663 - DNA, 25 bp, Homo sapien
agactgtcgccgactgacgctccga

SEQ ID NO: 209664 - DNA, 25 bp, Homo sapien
ggggcacaatgagcgctcccagtgc

SEQ ID NO: 209665 - DNA, 25 bp, Homo sapien
ctgggtttcctccttcgtgctggaa

SEQ ID NO: 209666 - DNA, 25 bp, Homo sapien
ccgaggagttttaaatgcgctggaa

SEQ ID NO: 209667 - DNA, 25 bp, Homo sapien
gacaagcaggatccgggccacccaa

SEQ ID NO: 209668 - DNA, 25 bp, Homo sapien
cgactgtatctttggccgaggagtt

SEQ ID NO: 209669 - DNA, 25 bp, Homo sapien
gggatgagaaactacggcgactgta

SEQ ID NO: 209670 - DNA, 25 bp, Homo sapien
attccgggcaggcagtgagtgatcc

SEQ ID NO: 209671 - DNA, 25 bp, Homo sapien
ccacgttcagcggacacgggagcaa

SEQ ID NO: 209672 - DNA, 25 bp, Homo sapien
acgacatcggcgtcagcgtcacgga

SEQ ID NO: 209673 - DNA, 25 bp, Homo sapien
ccgcgcgagagtttacgtgacgaca

SEQ ID NO: 209674 - DNA, 25 bp, Homo sapien
tgcctccgcgcctaaacgctggggt

SEQ ID NO: 209675 - DNA, 25 bp, Homo sapien
acagagcggtgcttctcgtctgggc

SEQ ID NO: 209676 - DNA, 25 bp, Homo sapien
accggctccggtttcagcttcacag

SEQ ID NO: 209677 - DNA, 25 bp, Homo sapien
tactccgctcctccgagtcgaagtt

SEQ ID NO: 209678 - DNA, 25 bp, Homo sapien
tctgagacgctgagcacatagtccc

SEQ ID NO: 209679 - DNA, 25 bp, Homo sapien
gagacgcgcgagttctctgagacgc

SEQ ID NO: 209680 - DNA, 25 bp, Homo sapien
tctcgaggaccagccagccaggctg

SEQ ID NO: 209681 - DNA, 25 bp, Homo sapien
agcttcacagcagcgcccgaaatgg

SEQ ID NO: 209682 - DNA, 25 bp, Homo sapien
agctctggctcttgctgagcgtgga

SEQ ID NO: 209683 - DNA, 25 bp, Homo sapien
gggccctcacatggtctgatctcta

SEQ ID NO: 209684 - DNA, 25 bp, Homo sapien
ctgatctctagatagccgccgccaa

SEQ ID NO: 209685 - DNA, 25 bp, Homo sapien
ccgccgccaaagagctcttgaagaa

SEQ ID NO: 209686 - DNA, 25 bp, Homo sapien
gcgtcactttgaggcgaataaactt

SEQ ID NO: 209687 - DNA, 25 bp, Homo sapien
ggccgagcgaggaatcctgactttc

SEQ ID NO: 209688 - DNA, 25 bp, Homo sapien
tcctgctctttaactttgcgggagg

SEQ ID NO: 209689 - DNA, 25 bp, Homo sapien
cgtgccgctttctcttgacctcgga

SEQ ID NO: 209690 - DNA, 25 bp, Homo sapien
cgcgtcccgaatctaacttcgtaag

SEQ ID NO: 209691 - DNA, 25 bp, Homo sapien
gtggcccgcttcagacagatgtcca

SEQ ID NO: 209692 - DNA, 25 bp, Homo sapien
gtggtcccgacattctgggcaagta

SEQ ID NO: 209693 - DNA, 25 bp, Homo sapien
ggggtcggaattcagtttctgtatc

SEQ ID NO: 209694 - DNA, 25 bp, Homo sapien
cgaattcagtcctgttgggagacca

SEQ ID NO: 209695 - DNA, 25 bp, Homo sapien
acttcgtaagcgcatcctggggtgc

SEQ ID NO: 209696 - DNA, 25 bp, Homo sapien
cgctgcagcggggaaacccataagc

SEQ ID NO: 209697 - DNA, 25 bp, Homo sapien
tctgtatcagagcagctaccttctc

SEQ ID NO: 209698 - DNA, 25 bp, Homo sapien
gcctctttagcatcggccgctcggt

SEQ ID NO: 209699 - DNA, 25 bp, Homo sapien
ccgctactaccacgaagaggagttg

SEQ ID NO: 209700 - DNA, 25 bp, Homo sapien
gcggaggcgactaccacaactacga

SEQ ID NO: 209701 - DNA, 25 bp, Homo sapien
acatgcatggcgacgagaccgtgtc

SEQ ID NO: 209702 - DNA, 25 bp, Homo sapien
tcctgttgctcatgtgcctgctgct

SEQ ID NO: 209703 - DNA, 25 bp, Homo sapien
aggtgttgatctacttggcccgcga

SEQ ID NO: 209704 - DNA, 25 bp, Homo sapien
gcccagagggaatcggctgctttaa

SEQ ID NO: 209705 - DNA, 25 bp, Homo sapien
ccttggcgaaggaagagagtgacca

SEQ ID NO: 209706 - DNA, 25 bp, Homo sapien
ccgactttgtaggtgttcaggagca

SEQ ID NO: 209707 - DNA, 25 bp, Homo sapien
gcagcggacccgctttaataatgtc

SEQ ID NO: 209708 - DNA, 25 bp, Homo sapien
tgccgaggattattcaccgcaaata

SEQ ID NO: 209709 - DNA, 25 bp, Homo sapien
gagccgctgccagaactcccggttt

SEQ ID NO: 209710 - DNA, 25 bp, Homo sapien
tgtcctaggttgctcacacccgaga

SEQ ID NO: 209711 - DNA, 25 bp, Homo sapien
gaggctcagtcgcaccctacatttc

SEQ ID NO: 209712 - DNA, 25 bp, Homo sapien
agttcgcttgaaatccctggaatgc

SEQ ID NO: 209713 - DNA, 25 bp, Homo sapien
ggaatgcgctttcttctggctccta

SEQ ID NO: 209714 - DNA, 25 bp, Homo sapien
acgcaccatggtgactttccggcct

SEQ ID NO: 209715 - DNA, 25 bp, Homo sapien
cagcacaggaaagaaccagactccc

SEQ ID NO: 209716 - DNA, 25 bp, Homo sapien
atcttgggagaagcagcacaggaaa

SEQ ID NO: 209717 - DNA, 25 bp, Homo sapien
aaggcctccgggtgcgtcctacgag

SEQ ID NO: 209718 - DNA, 25 bp, Homo sapien
cctggctctcaaggcggaaacacgc

SEQ ID NO: 209719 - DNA, 25 bp, Homo sapien
catggtgactttccggcctgcatcg

SEQ ID NO: 209720 - DNA, 25 bp, Homo sapien
ggcggaaacacgcaccatggtgact

SEQ ID NO: 209721 - DNA, 25 bp, Homo sapien
acgttggacgacaaagatggcggca

SEQ ID NO: 209722 - DNA, 25 bp, Homo sapien
gctcctggaggacttttggctcgca

SEQ ID NO: 209723 - DNA, 25 bp, Homo sapien
gctcttctgagctgtggtcgtcatg

SEQ ID NO: 209724 - DNA, 25 bp, Homo sapien
ccacggggcccaaggcacagagaga

SEQ ID NO: 209725 - DNA, 25 bp, Homo sapien
atgtgagcgcatcccacggggccca

SEQ ID NO: 209726 - DNA, 25 bp, Homo sapien
attctcccaacgtctcgggcctggt

SEQ ID NO: 209727 - DNA, 25 bp, Homo sapien
cttttggctcgcaagcgcttctcca

SEQ ID NO: 209728 - DNA, 25 bp, Homo sapien
gcgaagcttccttcaggtgctcctg

SEQ ID NO: 209729 - DNA, 25 bp, Homo sapien
ctgccttgaggccagcatcagggaa

SEQ ID NO: 209730 - DNA, 25 bp, Homo sapien
agtagccgagcccagagtcctgctc

SEQ ID NO: 209731 - DNA, 25 bp, Homo sapien
ttgtgctgcccggaccaaggaagga

SEQ ID NO: 209732 - DNA, 25 bp, Homo sapien
tcaggacgacgacgctcgccacatc

SEQ ID NO: 209733 - DNA, 25 bp, Homo sapien
gccagtcagactgcgcccgacaggt

SEQ ID NO: 209734 - DNA, 25 bp, Homo sapien
aggatacacccgttcgcatcgcagc

SEQ ID NO: 209735 - DNA, 25 bp, Homo sapien
ttcgggctgaaaagtcttggtcaag

SEQ ID NO: 209736 - DNA, 25 bp, Homo sapien
cgcatcgcagcggatttcgggctga

SEQ ID NO: 209737 - DNA, 25 bp, Homo sapien
gctactgggcctagcctagaggaga

SEQ ID NO: 209738 - DNA, 25 bp, Homo sapien
ctgcgaagccgaaggtctgaggtgc

SEQ ID NO: 209739 - DNA, 25 bp, Homo sapien
tcaggcgcggggctcatgggaatcc

SEQ ID NO: 209740 - DNA, 25 bp, Homo sapien
aggcgcggggctcatgggaatccca

SEQ ID NO: 209741 - DNA, 25 bp, Homo sapien
ggctgcgaagccgaaggtctgaggt

SEQ ID NO: 209742 - DNA, 25 bp, Homo sapien
gcgaagccgaaggtctgaggtgcgc

SEQ ID NO: 209743 - DNA, 25 bp, Homo sapien
ccagcctctccgcaccctttgtctc

SEQ ID NO: 209744 - DNA, 25 bp, Homo sapien
cagcctctccgcaccctttgtctcc

SEQ ID NO: 209745 - DNA, 25 bp, Homo sapien
cgcggggctcatgggaatcccaagg

SEQ ID NO: 209746 - DNA, 25 bp, Homo sapien
gcgcggacgccttggttcccggagc

SEQ ID NO: 209747 - DNA, 25 bp, Homo sapien
ccgtgggacggaatacacagagcgt

SEQ ID NO: 209748 - DNA, 25 bp, Homo sapien
cccgtgggacggaatacacagagcg

SEQ ID NO: 209749 - DNA, 25 bp, Homo sapien
tcccgtgggacggaatacacagagc

SEQ ID NO: 209750 - DNA, 25 bp, Homo sapien
ggtcccgtgggacggaatacacaga

SEQ ID NO: 209751 - DNA, 25 bp, Homo sapien
acggaatacacagagcgtggggtgt

SEQ ID NO: 209752 - DNA, 25 bp, Homo sapien
gaggtcccgtgggacggaatacaca

SEQ ID NO: 209753 - DNA, 25 bp, Homo sapien
cgcgtggcaccgtgggcgtggaggt

SEQ ID NO: 209754 - DNA, 25 bp, Homo sapien
ggccgcctttggatccgtgtaatcc

SEQ ID NO: 209755 - DNA, 25 bp, Homo sapien
ctggacaggtgagtgtctgcgggcc

SEQ ID NO: 209756 - DNA, 25 bp, Homo sapien
ttcgccgagccgcaggagagacacg

SEQ ID NO: 209757 - DNA, 25 bp, Homo sapien
tggatccgtgtaatccgcctctttt

SEQ ID NO: 209758 - DNA, 25 bp, Homo sapien
cgccgagccgcaggagagacacgct

SEQ ID NO: 209759 - DNA, 25 bp, Homo sapien
ccgcctttggatccgtgtaatccgc

SEQ ID NO: 209760 - DNA, 25 bp, Homo sapien
ctcctggggcgctcaagcgggttgc

SEQ ID NO: 209761 - DNA, 25 bp, Homo sapien
cctttggatccgtgtaatccgcctc

SEQ ID NO: 209762 - DNA, 25 bp, Homo sapien
agaagcgcctccgcgtgactgacgg

SEQ ID NO: 209763 - DNA, 25 bp, Homo sapien
cgcgatggcgcctcagaagcacggc

SEQ ID NO: 209764 - DNA, 25 bp, Homo sapien
cgagcggttggtattgcaggcgctt

SEQ ID NO: 209765 - DNA, 25 bp, Homo sapien
caagccgcgcctccgcgagaagcgc

SEQ ID NO: 209766 - DNA, 25 bp, Homo sapien
gaattcagttcaaagaggcggccgg

SEQ ID NO: 209767 - DNA, 25 bp, Homo sapien
tcccgcgaattcagttcaaagaggc

SEQ ID NO: 209768 - DNA, 25 bp, Homo sapien
attttcccgcgaattcagttcaaag

SEQ ID NO: 209769 - DNA, 25 bp, Homo sapien
caggaaccgcgatggcgcctcagaa

SEQ ID NO: 209770 - DNA, 25 bp, Homo sapien
ccacgacgaccttgattgacgggcg

SEQ ID NO: 209771 - DNA, 25 bp, Homo sapien
ctcgcgcaggcggaagcaccgccca

SEQ ID NO: 209772 - DNA, 25 bp, Homo sapien
aacctagcgcgggttcccgactgca

SEQ ID NO: 209773 - DNA, 25 bp, Homo sapien
gcctccacgttctcgcgggcctcct

SEQ ID NO: 209774 - DNA, 25 bp, Homo sapien
cgccggtagctctgcgctgcctcca

SEQ ID NO: 209775 - DNA, 25 bp, Homo sapien
gtgggtgtggccctccgacctgcct

SEQ ID NO: 209776 - DNA, 25 bp, Homo sapien
cgcctcttccgtgctgcggcacagc

SEQ ID NO: 209777 - DNA, 25 bp, Homo sapien
cgaccttgattgacgggcgcacggc

SEQ ID NO: 209778 - DNA, 25 bp, Homo sapien
cgtatttgcggcgataggcaaagcc

SEQ ID NO: 209779 - DNA, 25 bp, Homo sapien
gcctaccgggctgtttggcatcatt

SEQ ID NO: 209780 - DNA, 25 bp, Homo sapien
cacctcgtcaaagcggcctggggta

SEQ ID NO: 209781 - DNA, 25 bp, Homo sapien
tggcggatcagcacctcgtcaaagc

SEQ ID NO: 209782 - DNA, 25 bp, Homo sapien
aggtacttcacctggtggcggatca

SEQ ID NO: 209783 - DNA, 25 bp, Homo sapien
tgcgcacgcgcaggttttccaacag

SEQ ID NO: 209784 - DNA, 25 bp, Homo sapien
tgcggcgataggcaaagccggctct

SEQ ID NO: 209785 - DNA, 25 bp, Homo sapien
ggctgtttggcatcattgggtttga

SEQ ID NO: 209786 - DNA, 25 bp, Homo sapien
cgctttctcattgcctctttccgtg

SEQ ID NO: 209787 - DNA, 25 bp, Homo sapien
ctttccgtgttcgattcggctgatc

SEQ ID NO: 209788 - DNA, 25 bp, Homo sapien
cagggatctcattgcccgcgctttc

SEQ ID NO: 209789 - DNA, 25 bp, Homo sapien
ttcgagggcaccctgcatacactgg

SEQ ID NO: 209790 - DNA, 25 bp, Homo sapien
ttccctccgaagctctgtggtccga

SEQ ID NO: 209791 - DNA, 25 bp, Homo sapien
ggacggcgcgaaaacccaattgaca

SEQ ID NO: 209792 - DNA, 25 bp, Homo sapien
agggagtcattttggccctctcggc

SEQ ID NO: 209793 - DNA, 25 bp, Homo sapien
ggctcagcagaatcccagcagcttg

SEQ ID NO: 209794 - DNA, 25 bp, Homo sapien
ctaccgactcctgagagccgctggg

SEQ ID NO: 209795 - DNA, 25 bp, Homo sapien
ggccgaatctccaggaaggcgattc

SEQ ID NO: 209796 - DNA, 25 bp, Homo sapien
gttcctgcgtgctgcgcccaaaagc

SEQ ID NO: 209797 - DNA, 25 bp, Homo sapien
ctgcactcggcggaaaggttgttgt

SEQ ID NO: 209798 - DNA, 25 bp, Homo sapien
aggttgttgtccaagcggcgttccg

SEQ ID NO: 209799 - DNA, 25 bp, Homo sapien
cactgcaccggggaaacgttcttgc

SEQ ID NO: 209800 - DNA, 25 bp, Homo sapien
agccgctgggccgaatctccaggaa

SEQ ID NO: 209801 - DNA, 25 bp, Homo sapien
tgtcccgctgagcagtgggtcgtcc

SEQ ID NO: 209802 - DNA, 25 bp, Homo sapien
tgcacgaagaccatgcatatggatg

SEQ ID NO: 209803 - DNA, 25 bp, Homo sapien
ctctagcttcccgactttcgtgggg

SEQ ID NO: 209804 - DNA, 25 bp, Homo sapien
ggcagctgctctttgtgcacgaaga

SEQ ID NO: 209805 - DNA, 25 bp, Homo sapien
cctaattcaattagctgggccgccg

SEQ ID NO: 209806 - DNA, 25 bp, Homo sapien
gggcctggccgacctaattcaatta

SEQ ID NO: 209807 - DNA, 25 bp, Homo sapien
cccagggacaatgggattatttccg

SEQ ID NO: 209808 - DNA, 25 bp, Homo sapien
atcacagtgccgcagtccagttggg

SEQ ID NO: 209809 - DNA, 25 bp, Homo sapien
cgccgcagtcccattaatcacagtg

SEQ ID NO: 209810 - DNA, 25 bp, Homo sapien
agatgcgcatcttcccacgtgcttg

SEQ ID NO: 209811 - DNA, 25 bp, Homo sapien
ccggtgggctaaccagaaggtgcca

SEQ ID NO: 209812 - DNA, 25 bp, Homo sapien
cggttccttctgagtcccttcactt

SEQ ID NO: 209813 - DNA, 25 bp, Homo sapien
tcccagccagggctaaacgtcgggc

SEQ ID NO: 209814 - DNA, 25 bp, Homo sapien
gggctctcgatgtctgcgcacccag

SEQ ID NO: 209815 - DNA, 25 bp, Homo sapien
cgcttagttcgccttaggtgggaga

SEQ ID NO: 209816 - DNA, 25 bp, Homo sapien
cacgtgcttggacccggacacgaga

SEQ ID NO: 209817 - DNA, 25 bp, Homo sapien
tcgcgagcgcaacaagaagcggctg

SEQ ID NO: 209818 - DNA, 25 bp, Homo sapien
ctgaccctttcccatgtggctcgaa

SEQ ID NO: 209819 - DNA, 25 bp, Homo sapien
ccgcacgcgagatacaggcgggctc

SEQ ID NO: 209820 - DNA, 25 bp, Homo sapien
aggacctggccgacaagtaccgccg

SEQ ID NO: 209821 - DNA, 25 bp, Homo sapien
gctgcatcatctgccaggggctgct

SEQ ID NO: 209822 - DNA, 25 bp, Homo sapien
agaacacgctactgcaggacctggc

SEQ ID NO: 209823 - DNA, 25 bp, Homo sapien
cgaggacgacctcggctgcatcatc

SEQ ID NO: 209824 - DNA, 25 bp, Homo sapien
gccgcacctgcggaagaacacgcta

SEQ ID NO: 209825 - DNA, 25 bp, Homo sapien
tcagtctaaaagtcgagttccgctc

SEQ ID NO: 209826 - DNA, 25 bp, Homo sapien
gtgcagcccagaccaaggaaagaga

SEQ ID NO: 209827 - DNA, 25 bp, Homo sapien
tcaggacgactacgctcggcacgtc

SEQ ID NO: 209828 - DNA, 25 bp, Homo sapien
gttgcagcgccaaaagctcgggcct

SEQ ID NO: 209829 - DNA, 25 bp, Homo sapien
gaggttacatcggttcgcatcgcag

SEQ ID NO: 209830 - DNA, 25 bp, Homo sapien
gctgactgcgcgcaactttaaggag

SEQ ID NO: 209831 - DNA, 25 bp, Homo sapien
ctgcgcgcaactttaaggagtgttt

SEQ ID NO: 209832 - DNA, 25 bp, Homo sapien
aggagtgtttactccttaaagatgg

SEQ ID NO: 209833 - DNA, 25 bp, Homo sapien
tgcccgcgtgcaaaatccttactct

SEQ ID NO: 209834 - DNA, 25 bp, Homo sapien
cccagaggagttagatgacgtcacc

SEQ ID NO: 209835 - DNA, 25 bp, Homo sapien
cgtggaaaggatcccacttccggtg

SEQ ID NO: 209836 - DNA, 25 bp, Homo sapien
aggaggactcgctttttcattaatg

SEQ ID NO: 209837 - DNA, 25 bp, Homo sapien
agggacgctcgccagacggcccaga

SEQ ID NO: 209838 - DNA, 25 bp, Homo sapien
agcccagcgccagtctaggtgagcc

SEQ ID NO: 209839 - DNA, 25 bp, Homo sapien
ggtcagctctggcactcgccagctg

SEQ ID NO: 209840 - DNA, 25 bp, Homo sapien
gagcaatccaaacccggaggccggc

SEQ ID NO: 209841 - DNA, 25 bp, Homo sapien
ttcattaatgaaaccggccggcgcg

SEQ ID NO: 209842 - DNA, 25 bp, Homo sapien
gcaatggcttccaaactcctgcgcg

SEQ ID NO: 209843 - DNA, 25 bp, Homo sapien
ccggcgagtcccagtgagagcggag

SEQ ID NO: 209844 - DNA, 25 bp, Homo sapien
aatggcttccaaactcctgcgcgcg

SEQ ID NO: 209845 - DNA, 25 bp, Homo sapien
tcctgcgcgcggtcatcctcgggcc

SEQ ID NO: 209846 - DNA, 25 bp, Homo sapien
gaaggcaatggcttccaaactcctg

SEQ ID NO: 209847 - DNA, 25 bp, Homo sapien
tcctcgcgaaggcaatggcttccaa

SEQ ID NO: 209848 - DNA, 25 bp, Homo sapien
cgcgaaggcaatggcttccaaactc

SEQ ID NO: 209849 - DNA, 25 bp, Homo sapien
aggcaatggcttccaaactcctgcg

SEQ ID NO: 209850 - DNA, 25 bp, Homo sapien
cacggatagcggaaaggggcgcgac

SEQ ID NO: 209851 - DNA, 25 bp, Homo sapien
cccgcggaatcctccggcagggcag

SEQ ID NO: 209852 - DNA, 25 bp, Homo sapien
ccgttggcagctcgctgcgcctgcc

SEQ ID NO: 209853 - DNA, 25 bp, Homo sapien
ggacgcgggctccttttgtctgcag

SEQ ID NO: 209854 - DNA, 25 bp, Homo sapien
gcgggctccttttgtctgcagcgtc

SEQ ID NO: 209855 - DNA, 25 bp, Homo sapien
gccgctgctgacacggatcggccgc

SEQ ID NO: 209856 - DNA, 25 bp, Homo sapien
ccaggacatcctgagcgctcgggag

SEQ ID NO: 209857 - DNA, 25 bp, Homo sapien
catcctgagcgctcgggagacgcca

SEQ ID NO: 209858 - DNA, 25 bp, Homo sapien
ggtcgtgttacctgagccatctcgt

SEQ ID NO: 209859 - DNA, 25 bp, Homo sapien
gagccatctcgttcggccgcgagta

SEQ ID NO: 209860 - DNA, 25 bp, Homo sapien
cgcagcttgatacaaagagcccttc

SEQ ID NO: 209861 - DNA, 25 bp, Homo sapien
ctcgtgatgtcaccgcagcttgata

SEQ ID NO: 209862 - DNA, 25 bp, Homo sapien
agactacagcgcctacctggcaggg

SEQ ID NO: 209863 - DNA, 25 bp, Homo sapien
cgcagaacgggcaagagactacagc

SEQ ID NO: 209864 - DNA, 25 bp, Homo sapien
ccggaatctcacagtgcggtgacaa

SEQ ID NO: 209865 - DNA, 25 bp, Homo sapien
ccaggaagtgcttttagtggactag

SEQ ID NO: 209866 - DNA, 25 bp, Homo sapien
cccgaggaaggtcgtgcttcgtgca

SEQ ID NO: 209867 - DNA, 25 bp, Homo sapien
agctgaacccgaggaaggtcgtgct

SEQ ID NO: 209868 - DNA, 25 bp, Homo sapien
gctgaacccgaggaaggtcgtgctt

SEQ ID NO: 209869 - DNA, 25 bp, Homo sapien
ctgaacccgaggaaggtcgtgcttc

SEQ ID NO: 209870 - DNA, 25 bp, Homo sapien
tgaacccgaggaaggtcgtgcttcg

SEQ ID NO: 209871 - DNA, 25 bp, Homo sapien
acccgaggaaggtcgtgcttcgtgc

SEQ ID NO: 209872 - DNA, 25 bp, Homo sapien
gacggaaatgacccggccagggtca

SEQ ID NO: 209873 - DNA, 25 bp, Homo sapien
aacccgaggaaggtcgtgcttcgtg

SEQ ID NO: 209874 - DNA, 25 bp, Homo sapien
tctttccgactcaggcacggctctg

SEQ ID NO: 209875 - DNA, 25 bp, Homo sapien
ctcaggcacggctctgtgccgtagc

SEQ ID NO: 209876 - DNA, 25 bp, Homo sapien
ggctctgtgccgtagctttcgaccc

SEQ ID NO: 209877 - DNA, 25 bp, Homo sapien
ccgctgcccgctctaggcgtgggct

SEQ ID NO: 209878 - DNA, 25 bp, Homo sapien
gccgggcttctcaagacgccggttc

SEQ ID NO: 209879 - DNA, 25 bp, Homo sapien
tcaagacgccggttcgggtcccgca

SEQ ID NO: 209880 - DNA, 25 bp, Homo sapien
cgccgaggcttctttccgactcagg

SEQ ID NO: 209881 - DNA, 25 bp, Homo sapien
aggcttctttccgactcaggcacgg

SEQ ID NO: 209882 - DNA, 25 bp, Homo sapien
gcctgctccaggttcagcgggctca

SEQ ID NO: 209883 - DNA, 25 bp, Homo sapien
ctccacgtcctagggcagtcattca

SEQ ID NO: 209884 - DNA, 25 bp, Homo sapien
agtcattcaaccgaaggcgtgggcc

SEQ ID NO: 209885 - DNA, 25 bp, Homo sapien
cagtgtggaccgagccctcaccttg

SEQ ID NO: 209886 - DNA, 25 bp, Homo sapien
cgacctgttgatcttcccgacgagc

SEQ ID NO: 209887 - DNA, 25 bp, Homo sapien
ttcccgacgagccaggtaaaagtgc

SEQ ID NO: 209888 - DNA, 25 bp, Homo sapien
ccaggtaaaagtgcggctgtacaca

SEQ ID NO: 209889 - DNA, 25 bp, Homo sapien
gtacacagccttggcgagggcgtct

SEQ ID NO: 209890 - DNA, 25 bp, Homo sapien
cactgcttcgccaatggggacacta

SEQ ID NO: 209891 - DNA, 25 bp, Homo sapien
ggtcccgcccgatttgcgagtgtta

SEQ ID NO: 209892 - DNA, 25 bp, Homo sapien
ttcgccaatggggacactaaggtcc

SEQ ID NO: 209893 - DNA, 25 bp, Homo sapien
cccgcccgatttgcgagtgttatgg

SEQ ID NO: 209894 - DNA, 25 bp, Homo sapien
gtcttcactgcttcgccaatgggga

SEQ ID NO: 209895 - DNA, 25 bp, Homo sapien
agtcgtcttcactgcttcgccaatg

SEQ ID NO: 209896 - DNA, 25 bp, Homo sapien
cggagtcgtcttcactgcttcgcca

SEQ ID NO: 209897 - DNA, 25 bp, Homo sapien
acactaaggtccaggtggcccgcgg

SEQ ID NO: 209898 - DNA, 25 bp, Homo sapien
cgggtcacgcagagcccattagctt

SEQ ID NO: 209899 - DNA, 25 bp, Homo sapien
agaatacggccttggctgcttggtc

SEQ ID NO: 209900 - DNA, 25 bp, Homo sapien
gcgaagctctcttgcaccgggcttt

SEQ ID NO: 209901 - DNA, 25 bp, Homo sapien
ttttcgcctggtgattgatgtccca

SEQ ID NO: 209902 - DNA, 25 bp, Homo sapien
tcccagagtcaacagcgagcgagca

SEQ ID NO: 209903 - DNA, 25 bp, Homo sapien
tttctgcgcacttcgcttccaagtc

SEQ ID NO: 209904 - DNA, 25 bp, Homo sapien
ccagcatggagcacctgggtccgca

SEQ ID NO: 209905 - DNA, 25 bp, Homo sapien
gaccggctcctacaacgtgaacatg

SEQ ID NO: 209906 - DNA, 25 bp, Homo sapien
cgccgagcgtcgtgtaacccttgga

SEQ ID NO: 209907 - DNA, 25 bp, Homo sapien
ttcctgatgtgtcaccagcacgtgg

SEQ ID NO: 209908 - DNA, 25 bp, Homo sapien
ggcgaagtttctcggcgcataactc

SEQ ID NO: 209909 - DNA, 25 bp, Homo sapien
cccgaactccgaggatgggagctga

SEQ ID NO: 209910 - DNA, 25 bp, Homo sapien
gggtgtcggatcaactggcctacaa

SEQ ID NO: 209911 - DNA, 25 bp, Homo sapien
tggcctacaaagtcccagttctcgg

SEQ ID NO: 209912 - DNA, 25 bp, Homo sapien
ggcttcgtcgggctcgctctcctag

SEQ ID NO: 209913 - DNA, 25 bp, Homo sapien
gcgcgcagccttcctgatgtgtcac

SEQ ID NO: 209914 - DNA, 25 bp, Homo sapien
aggatccgccgcagaagcgccaatc

SEQ ID NO: 209915 - DNA, 25 bp, Homo sapien
tcccagcgcgaaatctgaaacaatc

SEQ ID NO: 209916 - DNA, 25 bp, Homo sapien
acaatctcggagacggattttggaa

SEQ ID NO: 209917 - DNA, 25 bp, Homo sapien
gattttggaaactcctctcggtgca

SEQ ID NO: 209918 - DNA, 25 bp, Homo sapien
tctcggtgcatatcctaaggctgca

SEQ ID NO: 209919 - DNA, 25 bp, Homo sapien
aggctgcacgactagctgcgtgtga

SEQ ID NO: 209920 - DNA, 25 bp, Homo sapien
cggggtgtgctccagcttcaaaacc

SEQ ID NO: 209921 - DNA, 25 bp, Homo sapien
ctggccgttttcagctcgagcgcga

SEQ ID NO: 209922 - DNA, 25 bp, Homo sapien
gcgggtagcttctcaacagcgaaca

SEQ ID NO: 209923 - DNA, 25 bp, Homo sapien
tgggattgcagcgagaacccgccct

SEQ ID NO: 209924 - DNA, 25 bp, Homo sapien
tccctgtggccgattgtgggattgc

SEQ ID NO: 209925 - DNA, 25 bp, Homo sapien
gcgtccggacgtaacgtgctcccta

SEQ ID NO: 209926 - DNA, 25 bp, Homo sapien
ctgccatgaggtccgaggtctacaa

SEQ ID NO: 209927 - DNA, 25 bp, Homo sapien
gcgttcctgaattatctctgccatg

SEQ ID NO: 209928 - DNA, 25 bp, Homo sapien
gagccgatcttctatgcgttcctga

SEQ ID NO: 209929 - DNA, 25 bp, Homo sapien
gggaaggcccttcggcttctacagc

SEQ ID NO: 209930 - DNA, 25 bp, Homo sapien
aggtttcccagctcgcgcgttaccg

SEQ ID NO: 209931 - DNA, 25 bp, Homo sapien
caggtcgcagccggcctctggcttt

SEQ ID NO: 209932 - DNA, 25 bp, Homo sapien
ttcgcccgccgcatgcaccctgggc

SEQ ID NO: 209933 - DNA, 25 bp, Homo sapien
ccagaccctttgtcagagagcgagg

SEQ ID NO: 209934 - DNA, 25 bp, Homo sapien
ctctcacctcgcttggccgagcggc

SEQ ID NO: 209935 - DNA, 25 bp, Homo sapien
ttgtcctgtccccaagcaaggagtc

SEQ ID NO: 209936 - DNA, 25 bp, Homo sapien
gcaccaaggcttcaggtttcccagc

SEQ ID NO: 209937 - DNA, 25 bp, Homo sapien
gagaggacgaccgccaccggtgcaa

SEQ ID NO: 209938 - DNA, 25 bp, Homo sapien
gaattcagttcaaagaggcggccgg

SEQ ID NO: 209939 - DNA, 25 bp, Homo sapien
agaagcgcctccgcgtgactgacgg

SEQ ID NO: 209940 - DNA, 25 bp, Homo sapien
caggaaccgcgatggcgcctcagaa

SEQ ID NO: 209941 - DNA, 25 bp, Homo sapien
cgcgatggcgcctcagaagcacggc

SEQ ID NO: 209942 - DNA, 25 bp, Homo sapien
ggtggcagttactcggcctcctcct

SEQ ID NO: 209943 - DNA, 25 bp, Homo sapien
cgaaaatggagcacgtccaggctga

SEQ ID NO: 209944 - DNA, 25 bp, Homo sapien
ttcccgcgaattcagttcaaagagg

SEQ ID NO: 209945 - DNA, 25 bp, Homo sapien
atggagcacgtccaggctgaccacg

SEQ ID NO: 209946 - DNA, 25 bp, Homo sapien
ttagacgcggggcttgtcaggagct

SEQ ID NO: 209947 - DNA, 25 bp, Homo sapien
ccgtgctgcgccaagtccaggcgcc

SEQ ID NO: 209948 - DNA, 25 bp, Homo sapien
acaaggtggcggttgaaggcgatct

SEQ ID NO: 209949 - DNA, 25 bp, Homo sapien
ttgaaggcgatcttgagtggggccc

SEQ ID NO: 209950 - DNA, 25 bp, Homo sapien
ccctcgccgatacgcggtagtagcc

SEQ ID NO: 209951 - DNA, 25 bp, Homo sapien
ccgatacgcggtagtagccggggca

SEQ ID NO: 209952 - DNA, 25 bp, Homo sapien
aggagacccggcaggctttgggctc

SEQ ID NO: 209953 - DNA, 25 bp, Homo sapien
ctcgccgatacgcggtagtagccgg

SEQ ID NO: 209954 - DNA, 25 bp, Homo sapien
gcctgacagcgggagcgctgttccg

SEQ ID NO: 209955 - DNA, 25 bp, Homo sapien
ttcactcttctcttttggctggccg

SEQ ID NO: 209956 - DNA, 25 bp, Homo sapien
ttctccgcgttcctaggccttccag

SEQ ID NO: 209957 - DNA, 25 bp, Homo sapien
agctccgctcgcctttctccgcgtt

SEQ ID NO: 209958 - DNA, 25 bp, Homo sapien
ctcttctcttttggctggccgccgg

SEQ ID NO: 209959 - DNA, 25 bp, Homo sapien
ggagaacgtgagtccgcaccctctg

SEQ ID NO: 209960 - DNA, 25 bp, Homo sapien
agcgcgttcgcgttccgaaagcgcg

SEQ ID NO: 209961 - DNA, 25 bp, Homo sapien
tcgcgttccgaaagcgcgtgtccct

SEQ ID NO: 209962 - DNA, 25 bp, Homo sapien
gcgacactgattgaaattcaagccg

SEQ ID NO: 209963 - DNA, 25 bp, Homo sapien
cactgattgaaattcaagccggccc

SEQ ID NO: 209964 - DNA, 25 bp, Homo sapien
cacgccgggcaacttggaggtttca

SEQ ID NO: 209965 - DNA, 25 bp, Homo sapien
ggacacggcgttttcccgcagaggc

SEQ ID NO: 209966 - DNA, 25 bp, Homo sapien
cctcacgcccgcgacctgcgagctc

SEQ ID NO: 209967 - DNA, 25 bp, Homo sapien
ctggccatgcaagccggcctggcga

SEQ ID NO: 209968 - DNA, 25 bp, Homo sapien
ctccgctcccggattagctcccgcc

SEQ ID NO: 209969 - DNA, 25 bp, Homo sapien
ctcgggtctccatccctccggtcct

SEQ ID NO: 209970 - DNA, 25 bp, Homo sapien
tcggtatcagggctcgtccggctcc

SEQ ID NO: 209971 - DNA, 25 bp, Homo sapien
cctgcttccgcgatagctgtaaaga

SEQ ID NO: 209972 - DNA, 25 bp, Homo sapien
tcccgtgcagccgtcggtatcaggg

SEQ ID NO: 209973 - DNA, 25 bp, Homo sapien
catccatcgactcctgcaaagaggg

SEQ ID NO: 209974 - DNA, 25 bp, Homo sapien
agttccttttcatctccatccatcg

SEQ ID NO: 209975 - DNA, 25 bp, Homo sapien
ctggacggcggctcgagtctccgct

SEQ ID NO: 209976 - DNA, 25 bp, Homo sapien
taaagacagtagtggctgctggacg

SEQ ID NO: 209977 - DNA, 25 bp, Homo sapien
ttccgcgatagctgtaaagacagta

SEQ ID NO: 209978 - DNA, 25 bp, Homo sapien
ttttcctcgtcagcacggagctcgc

SEQ ID NO: 209979 - DNA, 25 bp, Homo sapien
ggctccgcctgagtcaggttttcca

SEQ ID NO: 209980 - DNA, 25 bp, Homo sapien
aagatcttggttttcctcgtcagca

SEQ ID NO: 209981 - DNA, 25 bp, Homo sapien
gtccgagcctcgaacccaggaagat

SEQ ID NO: 209982 - DNA, 25 bp, Homo sapien
aaccaatgtccaaatacggccggcg

SEQ ID NO: 209983 - DNA, 25 bp, Homo sapien
aagcggctgccaaatccggccgcgg

SEQ ID NO: 209984 - DNA, 25 bp, Homo sapien
tgggactacactccgcggcgggcct

SEQ ID NO: 209985 - DNA, 25 bp, Homo sapien
ttttccaggagggacgccgttggca

SEQ ID NO: 209986 - DNA, 25 bp, Homo sapien
cctggggagctttttgtttgcgcaa

SEQ ID NO: 209987 - DNA, 25 bp, Homo sapien
caaacaggcgggttagtgcactcca

SEQ ID NO: 209988 - DNA, 25 bp, Homo sapien
tcagggctttctggttggcacactc

SEQ ID NO: 209989 - DNA, 25 bp, Homo sapien
gtctcaggcagctctcggttcattg

SEQ ID NO: 209990 - DNA, 25 bp, Homo sapien
agagccctggctctgttttaccgga

SEQ ID NO: 209991 - DNA, 25 bp, Homo sapien
ttccgctcgcggtttctgatccttt

SEQ ID NO: 209992 - DNA, 25 bp, Homo sapien
tcgtggggcgcacatactttttccg

SEQ ID NO: 209993 - DNA, 25 bp, Homo sapien
tggatgcagaacagcccgcaccttg

SEQ ID NO: 209994 - DNA, 25 bp, Homo sapien
cggaggtctgcgtcatgtgaccctc

SEQ ID NO: 209995 - DNA, 25 bp, Homo sapien
cattttgtgtctgcttcctgtggga

SEQ ID NO: 209996 - DNA, 25 bp, Homo sapien
ccggtagaacacagttatgggtcgc

SEQ ID NO: 209997 - DNA, 25 bp, Homo sapien
gtgctggtatcctttgtcggtttga

SEQ ID NO: 209998 - DNA, 25 bp, Homo sapien
cgtggagcgtttgtatttaggcgtc

SEQ ID NO: 209999 - DNA, 25 bp, Homo sapien
ctctgaaacggacaagatggctgcc

SEQ ID NO: 210000 - DNA, 25 bp, Homo sapien
ggcctcgtttctcctgcttcttttc

SEQ ID NO: 210001 - DNA, 25 bp, Homo sapien
cctcctaccgcagtgcttgacggga

SEQ ID NO: 210002 - DNA, 25 bp, Homo sapien
ggtcacttatcgtcccgaatgaatg

SEQ ID NO: 210003 - DNA, 25 bp, Homo sapien
gccttggcgaaaccagctctggaca

SEQ ID NO: 210004 - DNA, 25 bp, Homo sapien
tctttgccacatagcgagcacttta

SEQ ID NO: 210005 - DNA, 25 bp, Homo sapien
ggagttccagagagcccagtctcta

SEQ ID NO: 210006 - DNA, 25 bp, Homo sapien
gtctcactcttgtgggagggcttga

SEQ ID NO: 210007 - DNA, 25 bp, Homo sapien
cggactggtcctagagtctctactt

SEQ ID NO: 210008 - DNA, 25 bp, Homo sapien
tctgatgctgctgactcactgtgtg

SEQ ID NO: 210009 - DNA, 25 bp, Homo sapien
gtctctacttgaaaggccttggcga

SEQ ID NO: 210010 - DNA, 25 bp, Homo sapien
cgtagaggtgcctcccgctcgttgc

SEQ ID NO: 210011 - DNA, 25 bp, Homo sapien
gctcggtgagcggttttatccctcc

SEQ ID NO: 210012 - DNA, 25 bp, Homo sapien
ttgttttccaggcagatccaagggg

SEQ ID NO: 210013 - DNA, 25 bp, Homo sapien
gcctggcgctaagaaccatcttgtt

SEQ ID NO: 210014 - DNA, 25 bp, Homo sapien
gagctgccgcctgccgggtaagcct

SEQ ID NO: 210015 - DNA, 25 bp, Homo sapien
gctgaggacaccaacggccgcgact

SEQ ID NO: 210016 - DNA, 25 bp, Homo sapien
cgcggctcgagctgaggacaccaac

SEQ ID NO: 210017 - DNA, 25 bp, Homo sapien
ctaccggaaggccacgctgtttgag

SEQ ID NO: 210018 - DNA, 25 bp, Homo sapien
ccatgagcacgtgaggcactttcta

SEQ ID NO: 210019 - DNA, 25 bp, Homo sapien
tggagtcgccttcaccaggccatga

SEQ ID NO: 210020 - DNA, 25 bp, Homo sapien
atgcgctgagcttctgcccagcctg

SEQ ID NO: 210021 - DNA, 25 bp, Homo sapien
ttggtcccgctttgaacgctctgct

SEQ ID NO: 210022 - DNA, 25 bp, Homo sapien
aacgccaagctgtcgtgtccacacg

SEQ ID NO: 210023 - DNA, 25 bp, Homo sapien
tgctcttagtgctgggcagtgaacg

SEQ ID NO: 210024 - DNA, 25 bp, Homo sapien
ctctgctggacttacggagctgctc

SEQ ID NO: 210025 - DNA, 25 bp, Homo sapien
ctttctaagcactggttgcccggga

SEQ ID NO: 210026 - DNA, 25 bp, Homo sapien
tcctagctctgctatgcgcggtaca

SEQ ID NO: 210027 - DNA, 25 bp, Homo sapien
gcaatgccatcgagctgcagaactc

SEQ ID NO: 210028 - DNA, 25 bp, Homo sapien
aactcggcggccgacaggttctctg

SEQ ID NO: 210029 - DNA, 25 bp, Homo sapien
ggacgtcgagtctcacctccttttc

SEQ ID NO: 210030 - DNA, 25 bp, Homo sapien
agcaagttcctgtgcggcgcttcag

SEQ ID NO: 210031 - DNA, 25 bp, Homo sapien
caaagggaatctgcacccgccgggt

SEQ ID NO: 210032 - DNA, 25 bp, Homo sapien
agcgcccgcggctgaaacgaagccg

SEQ ID NO: 210033 - DNA, 25 bp, Homo sapien
ccaagagggcactggacgtcgagtc

SEQ ID NO: 210034 - DNA, 25 bp, Homo sapien
ggataacgcgtccagcgccgtccgt

SEQ ID NO: 210035 - DNA, 25 bp, Homo sapien
tcctcagtcgggcctccggggtcga

SEQ ID NO: 210036 - DNA, 25 bp, Homo sapien
tcgcgaccgctcctcagtcgggcct

SEQ ID NO: 210037 - DNA, 25 bp, Homo sapien
ggcgtctcgcatacctaatgtaaat

SEQ ID NO: 210038 - DNA, 25 bp, Homo sapien
cagcgccgtccgtccgttcgtcttc

SEQ ID NO: 210039 - DNA, 25 bp, Homo sapien
gccggcgtctcgcatacctaatgta

SEQ ID NO: 210040 - DNA, 25 bp, Homo sapien
gagggataacgcgtccagcgccgtc

SEQ ID NO: 210041 - DNA, 25 bp, Homo sapien
tcagccggcgtctcgcatacctaat

SEQ ID NO: 210042 - DNA, 25 bp, Homo sapien
cacctgagcctgaggttggccatga

SEQ ID NO: 210043 - DNA, 25 bp, Homo sapien
ttggccatgaactcgggcatggaga

SEQ ID NO: 210044 - DNA, 25 bp, Homo sapien
tcgggcatggagacggtgtccatca

SEQ ID NO: 210045 - DNA, 25 bp, Homo sapien
acggtgtccatcagcacgaagtctg

SEQ ID NO: 210046 - DNA, 25 bp, Homo sapien
tctgccttgccgaattccaggctct

SEQ ID NO: 210047 - DNA, 25 bp, Homo sapien
gaagcgcggcccttgagctcgacac

SEQ ID NO: 210048 - DNA, 25 bp, Homo sapien
acgaagtctgccttgccgaattcca

SEQ ID NO: 210049 - DNA, 25 bp, Homo sapien
atccctggagcttgggcgctcccga

SEQ ID NO: 210050 - DNA, 25 bp, Homo sapien
gtctgccgcccggacgggccaccgc

SEQ ID NO: 210051 - DNA, 25 bp, Homo sapien
ccgcagctttgttcttgccgcgggg

SEQ ID NO: 210052 - DNA, 25 bp, Homo sapien
ccctgcggtacccatccgcgctcgc

SEQ ID NO: 210053 - DNA, 25 bp, Homo sapien
gcgcgaggctggattcctagggccg

SEQ ID NO: 210054 - DNA, 25 bp, Homo sapien
cccggactttgccatcggcggggca

SEQ ID NO: 210055 - DNA, 25 bp, Homo sapien
actttgccatcggcggggcagtcgc

SEQ ID NO: 210056 - DNA, 25 bp, Homo sapien
gtgccgcagctttgttcttgccgcg

SEQ ID NO: 210057 - DNA, 25 bp, Homo sapien
cgggtgccgcagctttgttcttgcc

SEQ ID NO: 210058 - DNA, 25 bp, Homo sapien
aagtcctgcgcctaagtcctgccag

SEQ ID NO: 210059 - DNA, 25 bp, Homo sapien
ttccttgttactgctccctgggctg

SEQ ID NO: 210060 - DNA, 25 bp, Homo sapien
actcggccaccatgcctgatctgga

SEQ ID NO: 210061 - DNA, 25 bp, Homo sapien
agcttttacgctggtcctgggagaa

SEQ ID NO: 210062 - DNA, 25 bp, Homo sapien
cggcactacttctggaggggtccca

SEQ ID NO: 210063 - DNA, 25 bp, Homo sapien
aagcgtgcgcccgaaaggagctccg

SEQ ID NO: 210064 - DNA, 25 bp, Homo sapien
agcccgtgcagtttagcgcggctca

SEQ ID NO: 210065 - DNA, 25 bp, Homo sapien
agccgccatgggagtccgcagcagc

SEQ ID NO: 210066 - DNA, 25 bp, Homo sapien
tgaaaccgcgtgtttcctcgcgaga

SEQ ID NO: 210067 - DNA, 25 bp, Homo sapien
cgcgtgtttcctcgcgagatttgca

SEQ ID NO: 210068 - DNA, 25 bp, Homo sapien
accgcgtgtttcctcgcgagatttg

SEQ ID NO: 210069 - DNA, 25 bp, Homo sapien
aaaccgcgtgtttcctcgcgagatt

SEQ ID NO: 210070 - DNA, 25 bp, Homo sapien
tgtaaacacactagtgaaaccgcgt

SEQ ID NO: 210071 - DNA, 25 bp, Homo sapien
tcggtgtaaacacactagtgaaacc

SEQ ID NO: 210072 - DNA, 25 bp, Homo sapien
cccgggctcgcgtacagagccaggc

SEQ ID NO: 210073 - DNA, 25 bp, Homo sapien
tgatcggtgtaaacacactagtgaa

SEQ ID NO: 210074 - DNA, 25 bp, Homo sapien
agcgaaccgcatcctcctgcagttg

SEQ ID NO: 210075 - DNA, 25 bp, Homo sapien
cagtttatctcctgggaacgcacca

SEQ ID NO: 210076 - DNA, 25 bp, Homo sapien
cgagcagcgctcgttcagtttatct

SEQ ID NO: 210077 - DNA, 25 bp, Homo sapien
taacggcttgttcccggtgcagacg

SEQ ID NO: 210078 - DNA, 25 bp, Homo sapien
gctgaccctctgtgcgtgcacaact

SEQ ID NO: 210079 - DNA, 25 bp, Homo sapien
gccgtggtctgacgactcgaccaaa

SEQ ID NO: 210080 - DNA, 25 bp, Homo sapien
aaatcactagcgtcacgtcggtggc

SEQ ID NO: 210081 - DNA, 25 bp, Homo sapien
aacgcaccaggagttgggcacacgc

SEQ ID NO: 210082 - DNA, 25 bp, Homo sapien
tttctcacttgcttgcgggcagagg

SEQ ID NO: 210083 - DNA, 25 bp, Homo sapien
ggccggacgctcatttctcacttgc

SEQ ID NO: 210084 - DNA, 25 bp, Homo sapien
aaggctcgtcactgcaacaacccgg

SEQ ID NO: 210085 - DNA, 25 bp, Homo sapien
cacagactcgccctggtggggttag

SEQ ID NO: 210086 - DNA, 25 bp, Homo sapien
caacacaacggcgtacacagactcg

SEQ ID NO: 210087 - DNA, 25 bp, Homo sapien
cctactgagagccaggccgtgggcc

SEQ ID NO: 210088 - DNA, 25 bp, Homo sapien
cgtgggccacgcttccgatccggtg

SEQ ID NO: 210089 - DNA, 25 bp, Homo sapien
atccttgcggggaaggctcgtcact

SEQ ID NO: 210090 - DNA, 25 bp, Homo sapien
cccatgatgttttggactccgaatg

SEQ ID NO: 210091 - DNA, 25 bp, Homo sapien
aggcgaggaccggtatctggagact

SEQ ID NO: 210092 - DNA, 25 bp, Homo sapien
tggactccgaatgccgtttctcgcc

SEQ ID NO: 210093 - DNA, 25 bp, Homo sapien
cggccacgctgatgcactgcggtcg

SEQ ID NO: 210094 - DNA, 25 bp, Homo sapien
tgggcagaattccaaatgccagcgg

SEQ ID NO: 210095 - DNA, 25 bp, Homo sapien
aattccaaatgccagcggccgctgc

SEQ ID NO: 210096 - DNA, 25 bp, Homo sapien
ggcgcagcggcacagccttcagagc

SEQ ID NO: 210097 - DNA, 25 bp, Homo sapien
ccttttcccatgatgttttggactc

SEQ ID NO: 210098 - DNA, 25 bp, Homo sapien
acctgggatttttatgctgggctgc

SEQ ID NO: 210099 - DNA, 25 bp, Homo sapien
gcattcatttgcacctgacctggga

SEQ ID NO: 210100 - DNA, 25 bp, Homo sapien
tcgccagtttcagcaccgcacggaa

SEQ ID NO: 210101 - DNA, 25 bp, Homo sapien
ctgggccctgatccagactggagaa

SEQ ID NO: 210102 - DNA, 25 bp, Homo sapien
cggcgctatccatgtgcggttacta

SEQ ID NO: 210103 - DNA, 25 bp, Homo sapien
tctgcatcttacagcgtttatggtc

SEQ ID NO: 210104 - DNA, 25 bp, Homo sapien
tctctgccgagacagcgagacctta

SEQ ID NO: 210105 - DNA, 25 bp, Homo sapien
tcatcaagctggagtcgacgtcctg

SEQ ID NO: 210106 - DNA, 25 bp, Homo sapien
gctccacgctgaggggtgagcctca

SEQ ID NO: 210107 - DNA, 25 bp, Homo sapien
gctctccgcattggtggagcgccct

SEQ ID NO: 210108 - DNA, 25 bp, Homo sapien
gggtgtttcgatgctccacgctgag

SEQ ID NO: 210109 - DNA, 25 bp, Homo sapien
ttttcttaaccagcaaggcgtggcg

SEQ ID NO: 210110 - DNA, 25 bp, Homo sapien
ggatacattttcttaaccagcaagg

SEQ ID NO: 210111 - DNA, 25 bp, Homo sapien
aaccagccgacctgggatacatttt

SEQ ID NO: 210112 - DNA, 25 bp, Homo sapien
tcctaacgtgaaaccagccgacctg

SEQ ID NO: 210113 - DNA, 25 bp, Homo sapien
ggccttccgcaagctggagacgctc

SEQ ID NO: 210114 - DNA, 25 bp, Homo sapien
atgcccgggaagtcaagagctcctg

SEQ ID NO: 210115 - DNA, 25 bp, Homo sapien
tgtccgcctgcatgccttccgggat

SEQ ID NO: 210116 - DNA, 25 bp, Homo sapien
agcccttcgtggtgttccagaccaa

SEQ ID NO: 210117 - DNA, 25 bp, Homo sapien
aaggagctgccggtcctcaacgtct

SEQ ID NO: 210118 - DNA, 25 bp, Homo sapien
ccgagcgcctgacggtgaactggaa

SEQ ID NO: 210119 - DNA, 25 bp, Homo sapien
aaggtgcgggccttcatcgtccgct

SEQ ID NO: 210120 - DNA, 25 bp, Homo sapien
tggtccaggtgctgttctacgtagc

SEQ ID NO: 210121 - DNA, 25 bp, Homo sapien
gtgctgccagtcagctaccgcctgt

SEQ ID NO: 210122 - DNA, 25 bp, Homo sapien
ctccaagcgcaagcgggtcaagttc

SEQ ID NO: 210123 - DNA, 25 bp, Homo sapien
acgcaagagtgtgctcgccacgacc

SEQ ID NO: 210124 - DNA, 25 bp, Homo sapien
cagacctggagatcggcatgtacgc

SEQ ID NO: 210125 - DNA, 25 bp, Homo sapien
catggaccactctcaccactgggtg

SEQ ID NO: 210126 - DNA, 25 bp, Homo sapien
cgtcagaggagctggcctatgactc

SEQ ID NO: 210127 - DNA, 25 bp, Homo sapien
ccggacctgcacaattacatgcgca

SEQ ID NO: 210128 - DNA, 25 bp, Homo sapien
tctgggcggctgaattgattttgta

SEQ ID NO: 210129 - DNA, 25 bp, Homo sapien
tgcatcgtttttgtgctgcgctacc

SEQ ID NO: 210130 - DNA, 25 bp, Homo sapien
agttcagcgcctcattccgtcaaga

SEQ ID NO: 210131 - DNA, 25 bp, Homo sapien
cgcccttacaggaagtgacgttatc

SEQ ID NO: 210132 - DNA, 25 bp, Homo sapien
acgttatcatgcctcgcccgacgga

SEQ ID NO: 210133 - DNA, 25 bp, Homo sapien
tctgagcaccagtcggaaacggata

SEQ ID NO: 210134 - DNA, 25 bp, Homo sapien
tccattcgcgaagtacaaccgtttg

SEQ ID NO: 210135 - DNA, 25 bp, Homo sapien
cagctgagttgtgccctgtgtaaca

SEQ ID NO: 210136 - DNA, 25 bp, Homo sapien
ggcagactcacgtcctgggaaagca

SEQ ID NO: 210137 - DNA, 25 bp, Homo sapien
ccttggagttgacggcctttatcgc

SEQ ID NO: 210138 - DNA, 25 bp, Homo sapien
gagcaagttccgaggcctacggtga

SEQ ID NO: 210139 - DNA, 25 bp, Homo sapien
cccgcggcctgtaatgagcaagttc

SEQ ID NO: 210140 - DNA, 25 bp, Homo sapien
ctaggacccggatttaaagagacag

SEQ ID NO: 210141 - DNA, 25 bp, Homo sapien
gcagaatgcaactacgacccacgtg

SEQ ID NO: 210142 - DNA, 25 bp, Homo sapien
ggccgcgattgcaggttgaaaacta

SEQ ID NO: 210143 - DNA, 25 bp, Homo sapien
gactcagggagccttgatcacttcc

SEQ ID NO: 210144 - DNA, 25 bp, Homo sapien
gacgggtttcctcaaagctgcattg

SEQ ID NO: 210145 - DNA, 25 bp, Homo sapien
ggccaggcctcagcgatttccttct

SEQ ID NO: 210146 - DNA, 25 bp, Homo sapien
ctcccggccggcacctaggagagga

SEQ ID NO: 210147 - DNA, 25 bp, Homo sapien
ccctctcgggatcgcgcctccgctc

SEQ ID NO: 210148 - DNA, 25 bp, Homo sapien
cgcgcccgagccaccatagagaaga

SEQ ID NO: 210149 - DNA, 25 bp, Homo sapien
cccgagccaccatagagaagagcga

SEQ ID NO: 210150 - DNA, 25 bp, Homo sapien
ccaccatagagaagagcgaggcgcc

SEQ ID NO: 210151 - DNA, 25 bp, Homo sapien
accatagagaagagcgaggcgcccg

SEQ ID NO: 210152 - DNA, 25 bp, Homo sapien
gtcgcgacatcctcacgggcggccc

SEQ ID NO: 210153 - DNA, 25 bp, Homo sapien
atcccggccgcggacgcctcaggca

SEQ ID NO: 210154 - DNA, 25 bp, Homo sapien
ttctgtgcgccagcttccgttccaa

SEQ ID NO: 210155 - DNA, 25 bp, Homo sapien
cggtcacctgtcttgatcctgtggc

SEQ ID NO: 210156 - DNA, 25 bp, Homo sapien
acggaacggatctccgctggagaca

SEQ ID NO: 210157 - DNA, 25 bp, Homo sapien
ccgaccttctaaagagccttctgtg

SEQ ID NO: 210158 - DNA, 25 bp, Homo sapien
ccttcctagagaggacacaggcgcg

SEQ ID NO: 210159 - DNA, 25 bp, Homo sapien
agggcacagtccgaccctgagcacg

SEQ ID NO: 210160 - DNA, 25 bp, Homo sapien
agctggatcatctcctcggtaaggc

SEQ ID NO: 210161 - DNA, 25 bp, Homo sapien
ctgtggctcctgagaagctggatca

SEQ ID NO: 210162 - DNA, 25 bp, Homo sapien
tagtgagcaggttctggcggcagcg

SEQ ID NO: 210163 - DNA, 25 bp, Homo sapien
caggccgcgcaaaatccagaaatag

SEQ ID NO: 210164 - DNA, 25 bp, Homo sapien
cgccaggccgcgcaaaatccagaaa

SEQ ID NO: 210165 - DNA, 25 bp, Homo sapien
aggtctcccgcattcaccggctgtg

SEQ ID NO: 210166 - DNA, 25 bp, Homo sapien
ctgtgtggagcgtagtgagcaggtt

SEQ ID NO: 210167 - DNA, 25 bp, Homo sapien
tgctcaggttgggccctgacgagct

SEQ ID NO: 210168 - DNA, 25 bp, Homo sapien
cgcaggcccgcggagtgctcaggtt

SEQ ID NO: 210169 - DNA, 25 bp, Homo sapien
cattcaccggctgtggcacccagcg

SEQ ID NO: 210170 - DNA, 25 bp, Homo sapien
cctccagcacctcagaagtcgtctc

SEQ ID NO: 210171 - DNA, 25 bp, Homo sapien
tcctcttttggactcaagatcaatg

SEQ ID NO: 210172 - DNA, 25 bp, Homo sapien
ctcggggtgcgatttctctcctctt

SEQ ID NO: 210173 - DNA, 25 bp, Homo sapien
aaatccagaaatagcctccagcacc

SEQ ID NO: 210174 - DNA, 25 bp, Homo sapien
gcgccttcttctcggggtgcgattt

SEQ ID NO: 210175 - DNA, 25 bp, Homo sapien
cgagctcgcgccttcttctcggggt

SEQ ID NO: 210176 - DNA, 25 bp, Homo sapien
caggactggagccaccgagctcgcg

SEQ ID NO: 210177 - DNA, 25 bp, Homo sapien
caagatcaatgcttcccggccggcg

SEQ ID NO: 210178 - DNA, 25 bp, Homo sapien
gaactgcactagcaaccgctgcaca

SEQ ID NO: 210179 - DNA, 25 bp, Homo sapien
agacagagcgccgtctccgtggtcg

SEQ ID NO: 210180 - DNA, 25 bp, Homo sapien
agtagcgcgttgcacacgagctgca

SEQ ID NO: 210181 - DNA, 25 bp, Homo sapien
ccacatcgccctctgctgttgggga

SEQ ID NO: 210182 - DNA, 25 bp, Homo sapien
gaccatgaaccgcagaccctcggta

SEQ ID NO: 210183 - DNA, 25 bp, Homo sapien
gcagaccctcggtaatatgattccc

SEQ ID NO: 210184 - DNA, 25 bp, Homo sapien
ggccagccacttacctgggccagta

SEQ ID NO: 210185 - DNA, 25 bp, Homo sapien
cctcatcctggaactgcactagcaa

SEQ ID NO: 210186 - DNA, 25 bp, Homo sapien
aatgaggggaatccgcgcgcggagg

SEQ ID NO: 210187 - DNA, 25 bp, Homo sapien
gagcttcgcggccgcagtgtccgcc

SEQ ID NO: 210188 - DNA, 25 bp, Homo sapien
ccctccacgtcacgcggttggaatg

SEQ ID NO: 210189 - DNA, 25 bp, Homo sapien
cacgcggttggaatgaggggaatcc

SEQ ID NO: 210190 - DNA, 25 bp, Homo sapien
ccgcattcccgggatgcccgctggc

SEQ ID NO: 210191 - DNA, 25 bp, Homo sapien
cctcctcactggacggaagcgcgag

SEQ ID NO: 210192 - DNA, 25 bp, Homo sapien
ctcctcactggacggaagcgcgagc

SEQ ID NO: 210193 - DNA, 25 bp, Homo sapien
tccacgtcacgcggttggaatgagg

SEQ ID NO: 210194 - DNA, 25 bp, Homo sapien
tttcctccgctgacaaatatgctta

SEQ ID NO: 210195 - DNA, 25 bp, Homo sapien
ctgttcactcgccattactgaggga

SEQ ID NO: 210196 - DNA, 25 bp, Homo sapien
tgcttaaattcagcgggtcgccacg

SEQ ID NO: 210197 - DNA, 25 bp, Homo sapien
gtcgccacgtctgatctgaggtcgc

SEQ ID NO: 210198 - DNA, 25 bp, Homo sapien
gcctcgatcagaaggacttgggccc

SEQ ID NO: 210199 - DNA, 25 bp, Homo sapien
tactgagggaatcctggttagtttc

SEQ ID NO: 210200 - DNA, 25 bp, Homo sapien
tgggtcttccgtacgccacatttcc

SEQ ID NO: 210201 - DNA, 25 bp, Homo sapien
tggttagtttcttttcctccgctga

SEQ ID NO: 210202 - DNA, 25 bp, Homo sapien
cccgctggggagatttagtttgttg

SEQ ID NO: 210203 - DNA, 25 bp, Homo sapien
cttccagcagctgacggagtaattc

SEQ ID NO: 210204 - DNA, 25 bp, Homo sapien
ccttccctgggtgaaataagaactg

SEQ ID NO: 210205 - DNA, 25 bp, Homo sapien
taacgatgcgattgggctgtacctc

SEQ ID NO: 210206 - DNA, 25 bp, Homo sapien
gaggtgtcacggaactcagctgata

SEQ ID NO: 210207 - DNA, 25 bp, Homo sapien
ctcctattgggctgtggtgaagaca

SEQ ID NO: 210208 - DNA, 25 bp, Homo sapien
tttcctgtcagtaaaacgctgtttc

SEQ ID NO: 210209 - DNA, 25 bp, Homo sapien
tcagctgatataagcccgggatccc

SEQ ID NO: 210210 - DNA, 25 bp, Homo sapien
cgggtctgctaagcccgcgaactct

SEQ ID NO: 210211 - DNA, 25 bp, Homo sapien
ggcgcccaggtcgagtccttatata

SEQ ID NO: 210212 - DNA, 25 bp, Homo sapien
atcccacgcaggagatgcaagagcc

SEQ ID NO: 210213 - DNA, 25 bp, Homo sapien
atatactagcgggttggcgccatcc

SEQ ID NO: 210214 - DNA, 25 bp, Homo sapien
tgaagcacgggtagaaacgcaactc

SEQ ID NO: 210215 - DNA, 25 bp, Homo sapien
tggcactcgagttacagcccgacgc

SEQ ID NO: 210216 - DNA, 25 bp, Homo sapien
tgggctagaccctgaagcacgggta

SEQ ID NO: 210217 - DNA, 25 bp, Homo sapien
ggggcaaggaccctctctgacctct

SEQ ID NO: 210218 - DNA, 25 bp, Homo sapien
gtcggaggcccacttctcactgatg

SEQ ID NO: 210219 - DNA, 25 bp, Homo sapien
cccgagccagagtgggatttaacgg

SEQ ID NO: 210220 - DNA, 25 bp, Homo sapien
ccggtaaccgtcacgctgctagtga

SEQ ID NO: 210221 - DNA, 25 bp, Homo sapien
aaaaacctgccagcgttctgctttt

SEQ ID NO: 210222 - DNA, 25 bp, Homo sapien
gcagtctttagcacccgccaggatt

SEQ ID NO: 210223 - DNA, 25 bp, Homo sapien
cgccaggattctgtccgagtgtttg

SEQ ID NO: 210224 - DNA, 25 bp, Homo sapien
tgtaatcctcctgtctttggccaac

SEQ ID NO: 210225 - DNA, 25 bp, Homo sapien
tccgagtgtttggattttgtaatcc

SEQ ID NO: 210226 - DNA, 25 bp, Homo sapien
tcccgctgctccttgtagtttggcg

SEQ ID NO: 210227 - DNA, 25 bp, Homo sapien
acggggtcgcgcctctttctgcgac

SEQ ID NO: 210228 - DNA, 25 bp, Homo sapien
gcgcgacggggtcgcgcctctttct

SEQ ID NO: 210229 - DNA, 25 bp, Homo sapien
ctgctccttgtagtttggcgtctga

SEQ ID NO: 210230 - DNA, 25 bp, Homo sapien
cactagcgtcgtccgcctctgttcc

SEQ ID NO: 210231 - DNA, 25 bp, Homo sapien
cagcccgcccgcactagcgtcgtcc

SEQ ID NO: 210232 - DNA, 25 bp, Homo sapien
cggctgcacgcaggcctcagctcct

SEQ ID NO: 210233 - DNA, 25 bp, Homo sapien
tccttgtagtttggcgtctgagacc

SEQ ID NO: 210234 - DNA, 25 bp, Homo sapien
gcgatcaagtcctcatagcctttta

SEQ ID NO: 210235 - DNA, 25 bp, Homo sapien
tgcagccggaacaggaacacagata

SEQ ID NO: 210236 - DNA, 25 bp, Homo sapien
gccttttagggaatttgctcagcaa

SEQ ID NO: 210237 - DNA, 25 bp, Homo sapien
ggggttgctctcctagcttgctccc

SEQ ID NO: 210238 - DNA, 25 bp, Homo sapien
catccgagtcaacgccagtccaggg

SEQ ID NO: 210239 - DNA, 25 bp, Homo sapien
cgtgggtacaaacgggagctccgca

SEQ ID NO: 210240 - DNA, 25 bp, Homo sapien
gtcaagctccaggacactccgcgtt

SEQ ID NO: 210241 - DNA, 25 bp, Homo sapien
caggacgcacttggctctgcctgtt

SEQ ID NO: 210242 - DNA, 25 bp, Homo sapien
ctctgtgctcagtcaacgccttgga

SEQ ID NO: 210243 - DNA, 25 bp, Homo sapien
cgcgcatcggccaagttctcactga

SEQ ID NO: 210244 - DNA, 25 bp, Homo sapien
acacgagcagtgtgacggttaccgg

SEQ ID NO: 210245 - DNA, 25 bp, Homo sapien
cctggctggttttcttgtaacacga

SEQ ID NO: 210246 - DNA, 25 bp, Homo sapien
aaccctggcaggtgttaaaggctgc

SEQ ID NO: 210247 - DNA, 25 bp, Homo sapien
aagttctcactgacgcggactggcc

SEQ ID NO: 210248 - DNA, 25 bp, Homo sapien
ggagaggaggactacgaaacccata

SEQ ID NO: 210249 - DNA, 25 bp, Homo sapien
catacactcggacagaaccctggca

SEQ ID NO: 210250 - DNA, 25 bp, Homo sapien
gaggatgcctccaggtagttcttgg

SEQ ID NO: 210251 - DNA, 25 bp, Homo sapien
ctccaggtagttcttggcgaacgcc

SEQ ID NO: 210252 - DNA, 25 bp, Homo sapien
agttcttggcgaacgccgcagctcc

SEQ ID NO: 210253 - DNA, 25 bp, Homo sapien
ccgcagctccggtgacgcgaggaga

SEQ ID NO: 210254 - DNA, 25 bp, Homo sapien
cgagaggtgagcgaactgtattgct

SEQ ID NO: 210255 - DNA, 25 bp, Homo sapien
tctccgccacaacccgctcaagtag

SEQ ID NO: 210256 - DNA, 25 bp, Homo sapien
aacccgctcaagtagggggactctg

SEQ ID NO: 210257 - DNA, 25 bp, Homo sapien
cgcaggtggcctgccttggcagcac

SEQ ID NO: 210258 - DNA, 25 bp, Homo sapien
tgcccgggtcgtgcactttcagtag

SEQ ID NO: 210259 - DNA, 25 bp, Homo sapien
tctcctgcccttgggctaggcctcc

SEQ ID NO: 210260 - DNA, 25 bp, Homo sapien
gggacacgcaggactcccgcctctc

SEQ ID NO: 210261 - DNA, 25 bp, Homo sapien
cctctccgcccggaattcgttgaga

SEQ ID NO: 210262 - DNA, 25 bp, Homo sapien
gcccggaattcgttgagacggaatc

SEQ ID NO: 210263 - DNA, 25 bp, Homo sapien
tgagacggaatctcagcggatcccg

SEQ ID NO: 210264 - DNA, 25 bp, Homo sapien
ggaatctcagcggatcccgcgtccg

SEQ ID NO: 210265 - DNA, 25 bp, Homo sapien
cgcaaactccgtcccaagtggggcg

SEQ ID NO: 210266 - DNA, 25 bp, Homo sapien
aaacggtgtgtctgcgaatccaacg

SEQ ID NO: 210267 - DNA, 25 bp, Homo sapien
acgggcggaagttttgtcatctaca

SEQ ID NO: 210268 - DNA, 25 bp, Homo sapien
accgcacgcgctgttatcgactctg

SEQ ID NO: 210269 - DNA, 25 bp, Homo sapien
gtctgcgcactcttcaccaagtagg

SEQ ID NO: 210270 - DNA, 25 bp, Homo sapien
aacgcccacgtgaatagctctgagg

SEQ ID NO: 210271 - DNA, 25 bp, Homo sapien
cagcctgcggttttgacagacattg

SEQ ID NO: 210272 - DNA, 25 bp, Homo sapien
tcgactctgcgcctttggaaacggt

SEQ ID NO: 210273 - DNA, 25 bp, Homo sapien
agcgcgggcccttaagcaactgaaa

SEQ ID NO: 210274 - DNA, 25 bp, Homo sapien
aaagcgactggtctctcaggataga

SEQ ID NO: 210275 - DNA, 25 bp, Homo sapien
ctaggctgtaagacctgagccgggc

SEQ ID NO: 210276 - DNA, 25 bp, Homo sapien
ttgctcagaacttggaaagcgactg

SEQ ID NO: 210277 - DNA, 25 bp, Homo sapien
ctcaggatagagaccgcgacgcaaa

SEQ ID NO: 210278 - DNA, 25 bp, Homo sapien
tgacggaaaagatgcgtccgccatc

SEQ ID NO: 210279 - DNA, 25 bp, Homo sapien
agatgcgtccgccatcccttttgct

SEQ ID NO: 210280 - DNA, 25 bp, Homo sapien
cgcgacgcaaagaagtgacggaaaa

SEQ ID NO: 210281 - DNA, 25 bp, Homo sapien
agccgcgctaggctgtaagacctga

SEQ ID NO: 210282 - DNA, 25 bp, Homo sapien
ttaggcggcttctccggaacccaga

SEQ ID NO: 210283 - DNA, 25 bp, Homo sapien
cgcaggaatcagctgtttccttgtc

SEQ ID NO: 210284 - DNA, 25 bp, Homo sapien
gtttccttgtcagtccctcccagga

SEQ ID NO: 210285 - DNA, 25 bp, Homo sapien
cccaggagacggctcccactcccta

SEQ ID NO: 210286 - DNA, 25 bp, Homo sapien
tccctacacgcagcgaggcacacgg

SEQ ID NO: 210287 - DNA, 25 bp, Homo sapien
ggcacacggtggggctcagtcaccc

SEQ ID NO: 210288 - DNA, 25 bp, Homo sapien
tcccggacccctggatgaatgaatg

SEQ ID NO: 210289 - DNA, 25 bp, Homo sapien
ggcttctccggaacccagaggcgga

SEQ ID NO: 210290 - DNA, 25 bp, Homo sapien
caggcgaggcgcaaacaacccacga

SEQ ID NO: 210291 - DNA, 25 bp, Homo sapien
gaatgcggtccggaaaccagaacta

SEQ ID NO: 210292 - DNA, 25 bp, Homo sapien
gctctagttccgaatgcggtccgga

SEQ ID NO: 210293 - DNA, 25 bp, Homo sapien
tgaaaccaccaggacctctgggatg

SEQ ID NO: 210294 - DNA, 25 bp, Homo sapien
acagaagccgcacccggaaatgaaa

SEQ ID NO: 210295 - DNA, 25 bp, Homo sapien
ggtctccgctttatgacagaagccg

SEQ ID NO: 210296 - DNA, 25 bp, Homo sapien
gacgccacgtttgaagggaggtctc

SEQ ID NO: 210297 - DNA, 25 bp, Homo sapien
ctagagaactctatgacccacctga

SEQ ID NO: 210298 - DNA, 25 bp, Homo sapien
gtcgccctcgagcaccagcttcacg

SEQ ID NO: 210299 - DNA, 25 bp, Homo sapien
gccatatgctgcttcgtgatccatg

SEQ ID NO: 210300 - DNA, 25 bp, Homo sapien
gccattgtggaaccaggagaagaaa

SEQ ID NO: 210301 - DNA, 25 bp, Homo sapien
tggaaccaggagaagaaagctgtct

SEQ ID NO: 210302 - DNA, 25 bp, Homo sapien
tcgtgcgcctttcggagaggagcct

SEQ ID NO: 210303 - DNA, 25 bp, Homo sapien
cagctgcccggtgtagaagcccacg

SEQ ID NO: 210304 - DNA, 25 bp, Homo sapien
aaagctgtctcgtgcgcctttcgga

SEQ ID NO: 210305 - DNA, 25 bp, Homo sapien
gcttcgtgatccatgtcactctgca

SEQ ID NO: 210306 - DNA, 25 bp, Homo sapien
agggacccagcggaatgccagcccg

SEQ ID NO: 210307 - DNA, 25 bp, Homo sapien
cgcccaagcgaatatgtcaggctca

SEQ ID NO: 210308 - DNA, 25 bp, Homo sapien
agggccgcccaagcgaatatgtcag

SEQ ID NO: 210309 - DNA, 25 bp, Homo sapien
agaattcgtccagggccgcccaagc

SEQ ID NO: 210310 - DNA, 25 bp, Homo sapien
taaagaattcgtccagggccgccca

SEQ ID NO: 210311 - DNA, 25 bp, Homo sapien
ccagggattaaagaattcgtccagg

SEQ ID NO: 210312 - DNA, 25 bp, Homo sapien
ccctcctccttccagcgcgagcagg

SEQ ID NO: 210313 - DNA, 25 bp, Homo sapien
agcgaatatgtcaggctcagggacc

SEQ ID NO: 210314 - DNA, 25 bp, Homo sapien
acgtgcacgacctccagatcctcga

SEQ ID NO: 210315 - DNA, 25 bp, Homo sapien
cttgtacaacgagttcagcgaggtc

SEQ ID NO: 210316 - DNA, 25 bp, Homo sapien
gcaagagtgccatcgtgcgccagtt

SEQ ID NO: 210317 - DNA, 25 bp, Homo sapien
atggtctccacctaccgggtggccg

SEQ ID NO: 210318 - DNA, 25 bp, Homo sapien
gcgggaggcatggtctccacctacc

SEQ ID NO: 210319 - DNA, 25 bp, Homo sapien
tgcgccagttcttgtacaacgagtt

SEQ ID NO: 210320 - DNA, 25 bp, Homo sapien
ctgtcgtcatgaacggccacgtgca

SEQ ID NO: 210321 - DNA, 25 bp, Homo sapien
ctttacctgcctgctgtcgtcatga

SEQ ID NO: 210322 - DNA, 25 bp, Homo sapien
tgtcgcacctggtacgcaagacctg

SEQ ID NO: 210323 - DNA, 25 bp, Homo sapien
gctacgtggaatgctcggccaagta

SEQ ID NO: 210324 - DNA, 25 bp, Homo sapien
aagtacaactggcacatcctgctgc

SEQ ID NO: 210325 - DNA, 25 bp, Homo sapien
cttcagcgagctgctcaagagcgtc

SEQ ID NO: 210326 - DNA, 25 bp, Homo sapien
ttgcaagcacgtgcacgctgccctg

SEQ ID NO: 210327 - DNA, 25 bp, Homo sapien
cagtgctgtatttagtgcagtgccc

SEQ ID NO: 210328 - DNA, 25 bp, Homo sapien
tcagagacgcccatcatcatcgtgg

SEQ ID NO: 210329 - DNA, 25 bp, Homo sapien
cccacagggtgatcggaacctcaga

SEQ ID NO: 210330 - DNA, 25 bp, Homo sapien
gcccactgttggtgcttggttccca

SEQ ID NO: 210331 - DNA, 25 bp, Homo sapien
tgcagagcccagcataacctagagc

SEQ ID NO: 210332 - DNA, 25 bp, Homo sapien
gctgcgagctcctcttctgcaagaa

SEQ ID NO: 210333 - DNA, 25 bp, Homo sapien
tgcaggagtctgcacagccacccag

SEQ ID NO: 210334 - DNA, 25 bp, Homo sapien
cccagcctatgtggcgcactgcgtt

SEQ ID NO: 210335 - DNA, 25 bp, Homo sapien
ctgcgttctggatcacccggatctg

SEQ ID NO: 210336 - DNA, 25 bp, Homo sapien
accttctctcttggagcgcggagcc

SEQ ID NO: 210337 - DNA, 25 bp, Homo sapien
ccatccgtcaagaaggcccactgtt

SEQ ID NO: 210338 - DNA, 25 bp, Homo sapien
tagcgggcacccttgaagaggatga

SEQ ID NO: 210339 - DNA, 25 bp, Homo sapien
ttgcctgcagtttggcctggtcgag

SEQ ID NO: 210340 - DNA, 25 bp, Homo sapien
tcgaggcgccagtagcggtcatctc

SEQ ID NO: 210341 - DNA, 25 bp, Homo sapien
cagtagcggtcatctcggaagaaga

SEQ ID NO: 210342 - DNA, 25 bp, Homo sapien
ctcggaagaagatgatggagccatc

SEQ ID NO: 210343 - DNA, 25 bp, Homo sapien
atgatggagccatcgggcctcggca

SEQ ID NO: 210344 - DNA, 25 bp, Homo sapien
gtagtagggctccacttgcagtccc

SEQ ID NO: 210345 - DNA, 25 bp, Homo sapien
gccagcacgtagtagcgggcaccct

SEQ ID NO: 210346 - DNA, 25 bp, Homo sapien
gccacgggaaccactcgcggctgaa

SEQ ID NO: 210347 - DNA, 25 bp, Homo sapien
gctgaaatccagatgtgcttctctg

SEQ ID NO: 210348 - DNA, 25 bp, Homo sapien
tgcttctctgggcaacgtccatcac

SEQ ID NO: 210349 - DNA, 25 bp, Homo sapien
accaccaggcacagatggcgcacgg

SEQ ID NO: 210350 - DNA, 25 bp, Homo sapien
ccacacccggggcagatggacgtac

SEQ ID NO: 210351 - DNA, 25 bp, Homo sapien
gcagatggacgtaccggcccatcga

SEQ ID NO: 210352 - DNA, 25 bp, Homo sapien
aggccctcatcaacgtcagctttcc

SEQ ID NO: 210353 - DNA, 25 bp, Homo sapien
cagatgcgaggccacgggaaccact

SEQ ID NO: 210354 - DNA, 25 bp, Homo sapien
gttcgcttgtggacgatcccttcct

SEQ ID NO: 210355 - DNA, 25 bp, Homo sapien
agcttcagggccacatgtctcaggc

SEQ ID NO: 210356 - DNA, 25 bp, Homo sapien
gggctagatgccgagatgtaattca

SEQ ID NO: 210357 - DNA, 25 bp, Homo sapien
gggctcccggagtctcatttctaga

SEQ ID NO: 210358 - DNA, 25 bp, Homo sapien
ttgagcctcgatgatgtctgccgtg

SEQ ID NO: 210359 - DNA, 25 bp, Homo sapien
cagcagctggagaattcggccaaac

SEQ ID NO: 210360 - DNA, 25 bp, Homo sapien
aacctgactctttctccaggggcga

SEQ ID NO: 210361 - DNA, 25 bp, Homo sapien
ccatctgtttggctctgacgagtcc

SEQ ID NO: 210362 - DNA, 25 bp, Homo sapien
tcttggtcgaagtgcgcttcgccgc

SEQ ID NO: 210363 - DNA, 25 bp, Homo sapien
tgcgccagcaccacgaacaggttgc

SEQ ID NO: 210364 - DNA, 25 bp, Homo sapien
cgtcgcggcccagcctcttgtagta

SEQ ID NO: 210365 - DNA, 25 bp, Homo sapien
cctcttgtagtagggcgccatgagc

SEQ ID NO: 210366 - DNA, 25 bp, Homo sapien
aggccaagcgtgtgaccgatctcgt

SEQ ID NO: 210367 - DNA, 25 bp, Homo sapien
ccagcacgtcgtcccagctgagcag

SEQ ID NO: 210368 - DNA, 25 bp, Homo sapien
tgtgaccgatctcgtgcgccagcac

SEQ ID NO: 210369 - DNA, 25 bp, Homo sapien
gctcatcttggtcgaagtgcgcttc

SEQ ID NO: 210370 - DNA, 25 bp, Homo sapien
ccggggtttcgccagtgccctagct

SEQ ID NO: 210371 - DNA, 25 bp, Homo sapien
cagcccatcagtgcggatccgcgtg

SEQ ID NO: 210372 - DNA, 25 bp, Homo sapien
tgacaggtctcaagcacacgcaccg

SEQ ID NO: 210373 - DNA, 25 bp, Homo sapien
tgactgccgagttctgacaggtctc

SEQ ID NO: 210374 - DNA, 25 bp, Homo sapien
taacgcagattgtctgctcacaggg

SEQ ID NO: 210375 - DNA, 25 bp, Homo sapien
ctctttatgttcaagtgcgaagggg

SEQ ID NO: 210376 - DNA, 25 bp, Homo sapien
ctgcccggctctttatgttcaagtg

SEQ ID NO: 210377 - DNA, 25 bp, Homo sapien
tgcctgtgtggttccagcctggcac

SEQ ID NO: 210378 - DNA, 25 bp, Homo sapien
tcctgccgcagctttgtggtaccac

SEQ ID NO: 210379 - DNA, 25 bp, Homo sapien
cgcctggctttcgtattcgttgttc

SEQ ID NO: 210380 - DNA, 25 bp, Homo sapien
ccgccacattctcagggtcagattc

SEQ ID NO: 210381 - DNA, 25 bp, Homo sapien
agcatccttgtttgctactcggcga

SEQ ID NO: 210382 - DNA, 25 bp, Homo sapien
agccgccagctaggacgtaccattc

SEQ ID NO: 210383 - DNA, 25 bp, Homo sapien
tcgtgatcgtggcattggtactttc

SEQ ID NO: 210384 - DNA, 25 bp, Homo sapien
ggcggctagtaccagtgcagaaaca

SEQ ID NO: 210385 - DNA, 25 bp, Homo sapien
gtgacttcttcagcgagcagcggca

SEQ ID NO: 210386 - DNA, 25 bp, Homo sapien
ctgttctgagtcttgggcggtccca

SEQ ID NO: 210387 - DNA, 25 bp, Homo sapien
cacaccgtccttctgttctgagtct

SEQ ID NO: 210388 - DNA, 25 bp, Homo sapien
gttctgagtcttgggcggtcccagc

SEQ ID NO: 210389 - DNA, 25 bp, Homo sapien
cttctgttctgagtcttgggcggtc

SEQ ID NO: 210390 - DNA, 25 bp, Homo sapien
tccttctgttctgagtcttgggcgg

SEQ ID NO: 210391 - DNA, 25 bp, Homo sapien
cgtccttctgttctgagtcttgggc

SEQ ID NO: 210392 - DNA, 25 bp, Homo sapien
caccgtccttctgttctgagtcttg

SEQ ID NO: 210393 - DNA, 25 bp, Homo sapien
accgtccttctgttctgagtcttgg

SEQ ID NO: 210394 - DNA, 25 bp, Homo sapien
ttttttaaaaagaggcgcatgcgag

SEQ ID NO: 210395 - DNA, 25 bp, Homo sapien
gcaaggcacgcccgcgcttttttaa

SEQ ID NO: 210396 - DNA, 25 bp, Homo sapien
cgcaaaaggtaccaactccgccatc

SEQ ID NO: 210397 - DNA, 25 bp, Homo sapien
ctctcgatgggaaccgcaaaaggta

SEQ ID NO: 210398 - DNA, 25 bp, Homo sapien
tttgtcactctcgatgggaaccgca

SEQ ID NO: 210399 - DNA, 25 bp, Homo sapien
agcaaggttttgtcactctcgatgg

SEQ ID NO: 210400 - DNA, 25 bp, Homo sapien
gagctcagctcccacactagcaagg

SEQ ID NO: 210401 - DNA, 25 bp, Homo sapien
gctcccacactagcaaggttttgtc

SEQ ID NO: 210402 - DNA, 25 bp, Homo sapien
gccggagtttgctcgtgtcttctga

SEQ ID NO: 210403 - DNA, 25 bp, Homo sapien
ccagtgaaaaccgtaggtcgccatc

SEQ ID NO: 210404 - DNA, 25 bp, Homo sapien
ggtcgccatcacctaactacgcgtg

SEQ ID NO: 210405 - DNA, 25 bp, Homo sapien
actacgcgtgcaataaagtcttctg

SEQ ID NO: 210406 - DNA, 25 bp, Homo sapien
tgcttacagcccgagaacccttttc

SEQ ID NO: 210407 - DNA, 25 bp, Homo sapien
ttgaccgttgccctttctcgccgga

SEQ ID NO: 210408 - DNA, 25 bp, Homo sapien
atgtctcacctatcgccttcctggg

SEQ ID NO: 210409 - DNA, 25 bp, Homo sapien
tgggctcaaggatccacgaaaagcc

SEQ ID NO: 210410 - DNA, 25 bp, Homo sapien
gccggcgggcgctctggcacctttt

SEQ ID NO: 210411 - DNA, 25 bp, Homo sapien
ccttgcagccggcagcctagtcgct

SEQ ID NO: 210412 - DNA, 25 bp, Homo sapien
agctccatgagctctccgcgccctg

SEQ ID NO: 210413 - DNA, 25 bp, Homo sapien
ggatccaacacaggtccagccctgt

SEQ ID NO: 210414 - DNA, 25 bp, Homo sapien
cttcggagcctgaggatccaacaca

SEQ ID NO: 210415 - DNA, 25 bp, Homo sapien
gacgaggatggggaccatatcttcg

SEQ ID NO: 210416 - DNA, 25 bp, Homo sapien
cgcgccagctgtcctggagcagaaa

SEQ ID NO: 210417 - DNA, 25 bp, Homo sapien
tggggaccatatcttcggagcctga

SEQ ID NO: 210418 - DNA, 25 bp, Homo sapien
ccgccgcagtgccaaataacagacg

SEQ ID NO: 210419 - DNA, 25 bp, Homo sapien
cgcagtgttctgatctttgcccgca

SEQ ID NO: 210420 - DNA, 25 bp, Homo sapien
ctttgcgagccgagaaagttctgat

SEQ ID NO: 210421 - DNA, 25 bp, Homo sapien
cgaggaccggaactttgcgagccga

SEQ ID NO: 210422 - DNA, 25 bp, Homo sapien
aacctttcccatgccgcggagggtg

SEQ ID NO: 210423 - DNA, 25 bp, Homo sapien
cagagggcgctcctacctaaccttt

SEQ ID NO: 210424 - DNA, 25 bp, Homo sapien
agccagttagaggaatttcgctgcc

SEQ ID NO: 210425 - DNA, 25 bp, Homo sapien
tttgcccgcagtgtaccggggattg

SEQ ID NO: 210426 - DNA, 25 bp, Homo sapien
acaggcctggatgccgacgaccctt

SEQ ID NO: 210427 - DNA, 25 bp, Homo sapien
agtgcccacagggtaggtgtcttcc

SEQ ID NO: 210428 - DNA, 25 bp, Homo sapien
aaaacagacgcggtcagcatctcca

SEQ ID NO: 210429 - DNA, 25 bp, Homo sapien
agcatctccagtgagcccacgcagg

SEQ ID NO: 210430 - DNA, 25 bp, Homo sapien
ttgctcgggtttggctgaaaggaaa

SEQ ID NO: 210431 - DNA, 25 bp, Homo sapien
cccaccaggacagggtgtggaagaa

SEQ ID NO: 210432 - DNA, 25 bp, Homo sapien
tccactgcaggaatctccaggaacc

SEQ ID NO: 210433 - DNA, 25 bp, Homo sapien
agctgaccaaatgggccgcgggaac

SEQ ID NO: 210434 - DNA, 25 bp, Homo sapien
cgggctcatctaggaccagtccaca

SEQ ID NO: 210435 - DNA, 25 bp, Homo sapien
ggcgctctccctacagggacaaatg

SEQ ID NO: 210436 - DNA, 25 bp, Homo sapien
agggccggcatttctgacctagaga

SEQ ID NO: 210437 - DNA, 25 bp, Homo sapien
gtggcggcgtctagacataacgtcc

SEQ ID NO: 210438 - DNA, 25 bp, Homo sapien
ctgggctctactcttttggcgcaga

SEQ ID NO: 210439 - DNA, 25 bp, Homo sapien
cagcgcagctcgtttactatgggtc

SEQ ID NO: 210440 - DNA, 25 bp, Homo sapien
tcccgccttttttccgcagcgagga

SEQ ID NO: 210441 - DNA, 25 bp, Homo sapien
cggcctttggagacgatggcaattt

SEQ ID NO: 210442 - DNA, 25 bp, Homo sapien
cgacgtcggggatatccaaagtgcc

SEQ ID NO: 210443 - DNA, 25 bp, Homo sapien
agattctgaagagatcggaacacga

SEQ ID NO: 210444 - DNA, 25 bp, Homo sapien
gatcggaacacgaaatttctttgca

SEQ ID NO: 210445 - DNA, 25 bp, Homo sapien
ttcaatccacaaacttttcccgagc

SEQ ID NO: 210446 - DNA, 25 bp, Homo sapien
ttcccgagcacctttatatacaaca

SEQ ID NO: 210447 - DNA, 25 bp, Homo sapien
tatacaacacactgcaggagacact

SEQ ID NO: 210448 - DNA, 25 bp, Homo sapien
gaaataaagacccagcctcagtggg

SEQ ID NO: 210449 - DNA, 25 bp, Homo sapien
cagtggcgacgtgagatcccagcaa

SEQ ID NO: 210450 - DNA, 25 bp, Homo sapien
cccaggctcactcgtgggggtcagc

SEQ ID NO: 210451 - DNA, 25 bp, Homo sapien
gcggggaacggtctgcagacccagg

SEQ ID NO: 210452 - DNA, 25 bp, Homo sapien
ggggaacggtctgcagacccaggct

SEQ ID NO: 210453 - DNA, 25 bp, Homo sapien
tgcagacccaggctcactcgtgggg

SEQ ID NO: 210454 - DNA, 25 bp, Homo sapien
gagggcggggaacagtctgcagacc

SEQ ID NO: 210455 - DNA, 25 bp, Homo sapien
tgcagacccaggctcactcgtggcg

SEQ ID NO: 210456 - DNA, 25 bp, Homo sapien
agggcggggaacagtctgcagaccc

SEQ ID NO: 210457 - DNA, 25 bp, Homo sapien
cagacccaggctcactcgtgggggt

SEQ ID NO: 210458 - DNA, 25 bp, Homo sapien
tgcatatcagagcatggacttggtc

SEQ ID NO: 210459 - DNA, 25 bp, Homo sapien
agctctgaaaacctcgacaacgacg

SEQ ID NO: 210460 - DNA, 25 bp, Homo sapien
acttggtcttcccagcgctaccaga

SEQ ID NO: 210461 - DNA, 25 bp, Homo sapien
ctggcgatgtccgaagtgcatatca

SEQ ID NO: 210462 - DNA, 25 bp, Homo sapien
acatgctctggaagtgtggttcaac

SEQ ID NO: 210463 - DNA, 25 bp, Homo sapien
tcaactttcaccaggctactgcggg

SEQ ID NO: 210464 - DNA, 25 bp, Homo sapien
gacaacgacgcctctctcttcagtg

SEQ ID NO: 210465 - DNA, 25 bp, Homo sapien
tcccgtaggaacactcgtgggcatc

SEQ ID NO: 210466 - DNA, 25 bp, Homo sapien
aacctgggacgcagctaatagatgc

SEQ ID NO: 210467 - DNA, 25 bp, Homo sapien
ctgtggcctctgttgttacagctgc

SEQ ID NO: 210468 - DNA, 25 bp, Homo sapien
tctgcgtgatctgcttggagaagcc

SEQ ID NO: 210469 - DNA, 25 bp, Homo sapien
cgctcaaatgtagcaccgtcgtctg

SEQ ID NO: 210470 - DNA, 25 bp, Homo sapien
gcgcatcgagtgtatcgacgctcta

SEQ ID NO: 210471 - DNA, 25 bp, Homo sapien
ggcggcgcagtaaacagtctccttc

SEQ ID NO: 210472 - DNA, 25 bp, Homo sapien
cttttgcctacctgctgagcgctga

SEQ ID NO: 210473 - DNA, 25 bp, Homo sapien
cgctctaagtacgagggctggaaca

SEQ ID NO: 210474 - DNA, 25 bp, Homo sapien
cggcggacaccattaccctgatagg

SEQ ID NO: 210475 - DNA, 25 bp, Homo sapien
aaagcggcagcttcccacgttctgg

SEQ ID NO: 210476 - DNA, 25 bp, Homo sapien
actacggtgagatgttttgcgaccc

SEQ ID NO: 210477 - DNA, 25 bp, Homo sapien
ggtggagacgcctacttcttcctca

SEQ ID NO: 210478 - DNA, 25 bp, Homo sapien
ggcttgctggcttcaactacggtga

SEQ ID NO: 210479 - DNA, 25 bp, Homo sapien
cgccggcaccatttggagtacgtga

SEQ ID NO: 210480 - DNA, 25 bp, Homo sapien
ccttccgcgtctgaagggcttcaga

SEQ ID NO: 210481 - DNA, 25 bp, Homo sapien
cagatataggttcgggttgacactc

SEQ ID NO: 210482 - DNA, 25 bp, Homo sapien
acgggcttgactcgctgaaagaatt

SEQ ID NO: 210483 - DNA, 25 bp, Homo sapien
cctcgtcagccagtaacagggagca

SEQ ID NO: 210484 - DNA, 25 bp, Homo sapien
gcgcaaatttctccagcggggtccc

SEQ ID NO: 210485 - DNA, 25 bp, Homo sapien
actgcccgtagaggaaacgacattc

SEQ ID NO: 210486 - DNA, 25 bp, Homo sapien
tagcgaggcgaccacgaaaacggtg

SEQ ID NO: 210487 - DNA, 25 bp, Homo sapien
ctcctttggaccctgactggaggcc

SEQ ID NO: 210488 - DNA, 25 bp, Homo sapien
tcgacttctcgcaacctatccaggt

SEQ ID NO: 210489 - DNA, 25 bp, Homo sapien
tcctaccagtcctagttcgggtcta

SEQ ID NO: 210490 - DNA, 25 bp, Homo sapien
gcctgcggcgttgtaaccatggagc

SEQ ID NO: 210491 - DNA, 25 bp, Homo sapien
tggagccgccggctcagtgtttcca

SEQ ID NO: 210492 - DNA, 25 bp, Homo sapien
cctgcggcgttgtaacgatggagcc

SEQ ID NO: 210493 - DNA, 25 bp, Homo sapien
ccttgtttgcctgcggcgttgtaac

SEQ ID NO: 210494 - DNA, 25 bp, Homo sapien
cctgcggcgttgtaaccatggagcc

SEQ ID NO: 210495 - DNA, 25 bp, Homo sapien
gagccgccggctcagtgtttccacg

SEQ ID NO: 210496 - DNA, 25 bp, Homo sapien
cccttgtttgcctgcggcgttgtaa

SEQ ID NO: 210497 - DNA, 25 bp, Homo sapien
ggagccgccggctcagtgtttccac

SEQ ID NO: 210498 - DNA, 25 bp, Homo sapien
ccctttgctctagtcggggcggcct

SEQ ID NO: 210499 - DNA, 25 bp, Homo sapien
cgggacgcttcagtatgcgcccttg

SEQ ID NO: 210500 - DNA, 25 bp, Homo sapien
gcgcccgcactgtgggcaacatcga

SEQ ID NO: 210501 - DNA, 25 bp, Homo sapien
tctcggatcccttaaggcaggcttc

SEQ ID NO: 210502 - DNA, 25 bp, Homo sapien
cttaagtctcatctttgaaggagcc

SEQ ID NO: 210503 - DNA, 25 bp, Homo sapien
tttgaaggagccgtttgccctgaca

SEQ ID NO: 210504 - DNA, 25 bp, Homo sapien
cctgctcgagttaccgaatctccga

SEQ ID NO: 210505 - DNA, 25 bp, Homo sapien
ctccgactggatacggcggatcgcc

SEQ ID NO: 210506 - DNA, 25 bp, Homo sapien
cttcctcggagtggataaggtcatc

SEQ ID NO: 210507 - DNA, 25 bp, Homo sapien
tcgccgctcctctagccttgaggga

SEQ ID NO: 210508 - DNA, 25 bp, Homo sapien
ctcgtcctcgatgggatccaggatc

SEQ ID NO: 210509 - DNA, 25 bp, Homo sapien
ctaagccgcttgctgctggatgacc

SEQ ID NO: 210510 - DNA, 25 bp, Homo sapien
gtcatttctcccatgcagcgcggca

SEQ ID NO: 210511 - DNA, 25 bp, Homo sapien
tgcgccatggcattgctctcgaccg

SEQ ID NO: 210512 - DNA, 25 bp, Homo sapien
tgtttgttcctgtccgagagagctc

SEQ ID NO: 210513 - DNA, 25 bp, Homo sapien
ctcggtagtccagttgtgggtaatc

SEQ ID NO: 210514 - DNA, 25 bp, Homo sapien
ggcgcgagctctcatcaccacaatg

SEQ ID NO: 210515 - DNA, 25 bp, Homo sapien
aggcggtgacgatctgcagaagtct

SEQ ID NO: 210516 - DNA, 25 bp, Homo sapien
gcaagatcttttggagccttcggtc

SEQ ID NO: 210517 - DNA, 25 bp, Homo sapien
gtgcccgaagatgagagtgccgctt

SEQ ID NO: 210518 - DNA, 25 bp, Homo sapien
ttttattggacgcacagtgaccgtg

SEQ ID NO: 210519 - DNA, 25 bp, Homo sapien
ctcggagacatgtctggtggcgatc

SEQ ID NO: 210520 - DNA, 25 bp, Homo sapien
ggctcctcggcagtgtttgttttta

SEQ ID NO: 210521 - DNA, 25 bp, Homo sapien
ttctttcctacccttcccatgagtg

SEQ ID NO: 210522 - DNA, 25 bp, Homo sapien
cggtcgcggaggcagtgatttaggt

SEQ ID NO: 210523 - DNA, 25 bp, Homo sapien
gagcaaccttgagcgcggtcgcgga

SEQ ID NO: 210524 - DNA, 25 bp, Homo sapien
ctcgggagcaaccttgagcgcggtc

SEQ ID NO: 210525 - DNA, 25 bp, Homo sapien
acatttcaccgtcgggaggtgagcc

SEQ ID NO: 210526 - DNA, 25 bp, Homo sapien
ccggcaccggagcgtgaaggtaaat

SEQ ID NO: 210527 - DNA, 25 bp, Homo sapien
gaaggtaaatggccacatttcaccg

SEQ ID NO: 210528 - DNA, 25 bp, Homo sapien
ccggctcgggagcaaccttgagcgc

SEQ ID NO: 210529 - DNA, 25 bp, Homo sapien
tttaggtgccggcaccggagcgtga

SEQ ID NO: 210530 - DNA, 25 bp, Homo sapien
ctttttctcagtgcctggagaccgc

SEQ ID NO: 210531 - DNA, 25 bp, Homo sapien
gctgcccgctttttctcagtgcctg

SEQ ID NO: 210532 - DNA, 25 bp, Homo sapien
acggtcagcggccttttcgcaggcg

SEQ ID NO: 210533 - DNA, 25 bp, Homo sapien
gcgtctctgcgagtatctgtctccc

SEQ ID NO: 210534 - DNA, 25 bp, Homo sapien
gtccgctgctcctcatagaggcgtc

SEQ ID NO: 210535 - DNA, 25 bp, Homo sapien
gggagagtgtgttcgcgactttctc

SEQ ID NO: 210536 - DNA, 25 bp, Homo sapien
ttcgcgactttctcgcacagcggct

SEQ ID NO: 210537 - DNA, 25 bp, Homo sapien
tgccaagctggaccggtccggccag

SEQ ID NO: 210538 - DNA, 25 bp, Homo sapien
gtctgcccttgatggagccactggt

SEQ ID NO: 210539 - DNA, 25 bp, Homo sapien
gccactggtggggttacttgctggc

SEQ ID NO: 210540 - DNA, 25 bp, Homo sapien
acgccgggcgcgctgtgcacagtct

SEQ ID NO: 210541 - DNA, 25 bp, Homo sapien
gctgtgcacagtctccggaggccgc

SEQ ID NO: 210542 - DNA, 25 bp, Homo sapien
ctgtggacgcgaggccagctcgtag

SEQ ID NO: 210543 - DNA, 25 bp, Homo sapien
tctccgagtcctgtctgcccttgat

SEQ ID NO: 210544 - DNA, 25 bp, Homo sapien
gtcctgtctgcccttgatggagcca

SEQ ID NO: 210545 - DNA, 25 bp, Homo sapien
tacttgctggcggtcggccactttc

SEQ ID NO: 210546 - DNA, 25 bp, Homo sapien
cattcctgctactgcgggagcgcct

SEQ ID NO: 210547 - DNA, 25 bp, Homo sapien
ggtgacggcctcgttatgtctttaa

SEQ ID NO: 210548 - DNA, 25 bp, Homo sapien
agcctagccactgtcctgcctggga

SEQ ID NO: 210549 - DNA, 25 bp, Homo sapien
gggcctgtcatcagcgcacgcgcaa

SEQ ID NO: 210550 - DNA, 25 bp, Homo sapien
ggactctcccacgagcgcaaagctg

SEQ ID NO: 210551 - DNA, 25 bp, Homo sapien
agctgtcgcggactgtttttcttcc

SEQ ID NO: 210552 - DNA, 25 bp, Homo sapien
cgagagcgcctctgaaccaaaggca

SEQ ID NO: 210553 - DNA, 25 bp, Homo sapien
tctccagaaagcaaccgggacacct

SEQ ID NO: 210554 - DNA, 25 bp, Homo sapien
aatgttcatctggacggggacagga

SEQ ID NO: 210555 - DNA, 25 bp, Homo sapien
tcccactgctgggtaaatgttcatc

SEQ ID NO: 210556 - DNA, 25 bp, Homo sapien
agcgaactgctttgcctttggccac

SEQ ID NO: 210557 - DNA, 25 bp, Homo sapien
gattgtccgatacgccttggccagg

SEQ ID NO: 210558 - DNA, 25 bp, Homo sapien
gaattagcccggagattgtccgata

SEQ ID NO: 210559 - DNA, 25 bp, Homo sapien
gaggccggccctgacacgaattagc

SEQ ID NO: 210560 - DNA, 25 bp, Homo sapien
cttcaattttatcagcggccgggga

SEQ ID NO: 210561 - DNA, 25 bp, Homo sapien
gctccagagcatccaacttcatttc

SEQ ID NO: 210562 - DNA, 25 bp, Homo sapien
gcacgcactcgcctgtcccaaagcc

SEQ ID NO: 210563 - DNA, 25 bp, Homo sapien
tttatttatttgttggattcctgcc

SEQ ID NO: 210564 - DNA, 25 bp, Homo sapien
atttgttggattcctgcccagagcc

SEQ ID NO: 210565 - DNA, 25 bp, Homo sapien
ggattcctgcccagagccgcttttc

SEQ ID NO: 210566 - DNA, 25 bp, Homo sapien
cgggcacgcacccaaatacacattg

SEQ ID NO: 210567 - DNA, 25 bp, Homo sapien
agccgcttttccacgggcgcagagt

SEQ ID NO: 210568 - DNA, 25 bp, Homo sapien
ggcgcagagtctcccaccaaacacg

SEQ ID NO: 210569 - DNA, 25 bp, Homo sapien
acacattgttgtcacgccgtcttag

SEQ ID NO: 210570 - DNA, 25 bp, Homo sapien
ggtaacctcctagagccggctacgc

SEQ ID NO: 210571 - DNA, 25 bp, Homo sapien
attactgcggcctcaccgagtctgg

SEQ ID NO: 210572 - DNA, 25 bp, Homo sapien
tccgagcgaccttatccacgcagtt

SEQ ID NO: 210573 - DNA, 25 bp, Homo sapien
agttccctgcgtggcattactgcgg

SEQ ID NO: 210574 - DNA, 25 bp, Homo sapien
gagaccttggcgctcagatccgagc

SEQ ID NO: 210575 - DNA, 25 bp, Homo sapien
tccctcctccgggatgggtgtagca

SEQ ID NO: 210576 - DNA, 25 bp, Homo sapien
actccgcatggggtaacctcctaga

SEQ ID NO: 210577 - DNA, 25 bp, Homo sapien
gtgtagcagggtgtgtactccgcat

SEQ ID NO: 210578 - DNA, 25 bp, Homo sapien
gggacacgcgggatctttatttata

SEQ ID NO: 210579 - DNA, 25 bp, Homo sapien
ttccttgggcctcgaaccatttgca

SEQ ID NO: 210580 - DNA, 25 bp, Homo sapien
gctcacactggtaattaatgcgata

SEQ ID NO: 210581 - DNA, 25 bp, Homo sapien
actaactttacccagcgcaggccgg

SEQ ID NO: 210582 - DNA, 25 bp, Homo sapien
tttatcgggagcagatttacgtttc

SEQ ID NO: 210583 - DNA, 25 bp, Homo sapien
cgctgaacacggaacgaaaaggctt

SEQ ID NO: 210584 - DNA, 25 bp, Homo sapien
cccaggcattgcgaccacgcatgtg

SEQ ID NO: 210585 - DNA, 25 bp, Homo sapien
cgtgcgctggctgcatatttctatg

SEQ ID NO: 210586 - DNA, 25 bp, Homo sapien
ctgcggagttcgtggttgtacagaa

SEQ ID NO: 210587 - DNA, 25 bp, Homo sapien
ttaccagagcgagtactacgggccc

SEQ ID NO: 210588 - DNA, 25 bp, Homo sapien
agtggacctacccttcgtgccgtca

SEQ ID NO: 210589 - DNA, 25 bp, Homo sapien
agcggtttaccgacatcctggcgca

SEQ ID NO: 210590 - DNA, 25 bp, Homo sapien
ggcgagctacggaaaccacctgtcc

SEQ ID NO: 210591 - DNA, 25 bp, Homo sapien
gcactggctgtcgacgtgcagaact

SEQ ID NO: 210592 - DNA, 25 bp, Homo sapien
ctggacccggatccgtagacagacc

SEQ ID NO: 210593 - DNA, 25 bp, Homo sapien
cttctcgtcgctgtcggtcaacggt

SEQ ID NO: 210594 - DNA, 25 bp, Homo sapien
tccatctgcacagcgggattccctg

SEQ ID NO: 210595 - DNA, 25 bp, Homo sapien
ttccacggagcgcaagccagattct

SEQ ID NO: 210596 - DNA, 25 bp, Homo sapien
gggtccaaaggccaattccacaata

SEQ ID NO: 210597 - DNA, 25 bp, Homo sapien
tgctcgggccaaatgagccttccta

SEQ ID NO: 210598 - DNA, 25 bp, Homo sapien
tttcagcttccgtctggtctgcgca

SEQ ID NO: 210599 - DNA, 25 bp, Homo sapien
tccgcggcttcggtttccatgacat

SEQ ID NO: 210600 - DNA, 25 bp, Homo sapien
gtgccagaagcctaccgagtaccgg

SEQ ID NO: 210601 - DNA, 25 bp, Homo sapien
gagggacgcccactatcactgcctt

SEQ ID NO: 210602 - DNA, 25 bp, Homo sapien
gacctggacaaactgctgcactgta

SEQ ID NO: 210603 - DNA, 25 bp, Homo sapien
gctgcccggttttcctcaaggactg

SEQ ID NO: 210604 - DNA, 25 bp, Homo sapien
tccaccctacggatgtgaaatatcg

SEQ ID NO: 210605 - DNA, 25 bp, Homo sapien
agcaacctccttgatgaaacctggg

SEQ ID NO: 210606 - DNA, 25 bp, Homo sapien
agtgcccggagctttttcctgcttc

SEQ ID NO: 210607 - DNA, 25 bp, Homo sapien
gcaaagctccgtgctcgctggtatt

SEQ ID NO: 210608 - DNA, 25 bp, Homo sapien
ggactgctgtctttcccggagccaa

SEQ ID NO: 210609 - DNA, 25 bp, Homo sapien
ctccgagccttttgcgtagagtgtc

SEQ ID NO: 210610 - DNA, 25 bp, Homo sapien
tgcggcaccatacctaggcggagct

SEQ ID NO: 210611 - DNA, 25 bp, Homo sapien
tgggcacacgatgtggattcgattc

SEQ ID NO: 210612 - DNA, 25 bp, Homo sapien
ttcgattcttctaacaacgtggttg

SEQ ID NO: 210613 - DNA, 25 bp, Homo sapien
ccctcgtcgcgggattcagaatcct

SEQ ID NO: 210614 - DNA, 25 bp, Homo sapien
cagaatcctggcgaaaacccgaaca

SEQ ID NO: 210615 - DNA, 25 bp, Homo sapien
tggcaacgctcagcagtcaaatttg

SEQ ID NO: 210616 - DNA, 25 bp, Homo sapien
gcctggaaatgtcagggcctgttct

SEQ ID NO: 210617 - DNA, 25 bp, Homo sapien
tgttctccttcccatcagtgctgtg

SEQ ID NO: 210618 - DNA, 25 bp, Homo sapien
cgcacccgcgattcgagcagcttaa

SEQ ID NO: 210619 - DNA, 25 bp, Homo sapien
ccctggcgctgcaactggaacagtt

SEQ ID NO: 210620 - DNA, 25 bp, Homo sapien
cttcatgctagcaacgcccgcagtg

SEQ ID NO: 210621 - DNA, 25 bp, Homo sapien
gggccacggctacgctatgctttat

SEQ ID NO: 210622 - DNA, 25 bp, Homo sapien
gtgcccggcctcagactactataaa

SEQ ID NO: 210623 - DNA, 25 bp, Homo sapien
tacacgtgcgtatccctgacatagg

SEQ ID NO: 210624 - DNA, 25 bp, Homo sapien
tggaacagttgttgaacccgcgacc

SEQ ID NO: 210625 - DNA, 25 bp, Homo sapien
tctcagcgacagaagcggtcacgtg

SEQ ID NO: 210626 - DNA, 25 bp, Homo sapien
gaacccagaattaaggcgggctaga

SEQ ID NO: 210627 - DNA, 25 bp, Homo sapien
cacctcacctcagggtggcaacgtg

SEQ ID NO: 210628 - DNA, 25 bp, Homo sapien
gagctccatgaggtgactacgtccg

SEQ ID NO: 210629 - DNA, 25 bp, Homo sapien
gcccgagggctcagcggcagccaat

SEQ ID NO: 210630 - DNA, 25 bp, Homo sapien
gtccgagcgcggatctgccattcgg

SEQ ID NO: 210631 - DNA, 25 bp, Homo sapien
tgccacagccgggtacggggccaac

SEQ ID NO: 210632 - DNA, 25 bp, Homo sapien
gcatgcgcctcgcatcagggacaga

SEQ ID NO: 210633 - DNA, 25 bp, Homo sapien
cccgatctggatagtgtggagccca

SEQ ID NO: 210634 - DNA, 25 bp, Homo sapien
gggcaaagtgattactggtcggatc

SEQ ID NO: 210635 - DNA, 25 bp, Homo sapien
cgccacacgggcaaagtgattactg

SEQ ID NO: 210636 - DNA, 25 bp, Homo sapien
gccacgcgccacacgggcaaagtga

SEQ ID NO: 210637 - DNA, 25 bp, Homo sapien
tggtcggatcaaaagtcaggcaagc

SEQ ID NO: 210638 - DNA, 25 bp, Homo sapien
tcaaaagtcaggcaagcggctcagc

SEQ ID NO: 210639 - DNA, 25 bp, Homo sapien
agcgcgagcccctctagcgggacta

SEQ ID NO: 210640 - DNA, 25 bp, Homo sapien
gcctcgccatttcccgctcagccct

SEQ ID NO: 210641 - DNA, 25 bp, Homo sapien
tcaccgcactccggaggggaccaaa

SEQ ID NO: 210642 - DNA, 25 bp, Homo sapien
tccagcaagcgtcagccaggaactg

SEQ ID NO: 210643 - DNA, 25 bp, Homo sapien
ggttgcatgttcacctccgggtctc

SEQ ID NO: 210644 - DNA, 25 bp, Homo sapien
tgcccgtacctgttccagcaagcgt

SEQ ID NO: 210645 - DNA, 25 bp, Homo sapien
gctactgattttcccttcgctcttg

SEQ ID NO: 210646 - DNA, 25 bp, Homo sapien
atcggatttgctttctcgcctttaa

SEQ ID NO: 210647 - DNA, 25 bp, Homo sapien
agcccggctcatacgcagacgctga

SEQ ID NO: 210648 - DNA, 25 bp, Homo sapien
cctctggaaactttgtgccggcgcc

SEQ ID NO: 210649 - DNA, 25 bp, Homo sapien
ggcggcttcacacctgtatcggatt

SEQ ID NO: 210650 - DNA, 25 bp, Homo sapien
cagctctttgggaagtcgacagtta

SEQ ID NO: 210651 - DNA, 25 bp, Homo sapien
gcttctggaggcaactgatagacta

SEQ ID NO: 210652 - DNA, 25 bp, Homo sapien
gccacgctgtgtatcgcgtacctga

SEQ ID NO: 210653 - DNA, 25 bp, Homo sapien
tgtcatcaggcccaacgtaggcttc

SEQ ID NO: 210654 - DNA, 25 bp, Homo sapien
accttatggcatagttcccgacgtc

SEQ ID NO: 210655 - DNA, 25 bp, Homo sapien
aggagtcccgacacctgatgcctta

SEQ ID NO: 210656 - DNA, 25 bp, Homo sapien
tttagtgccactgaagcctgcgtca

SEQ ID NO: 210657 - DNA, 25 bp, Homo sapien
tcccgacgtctatgagaaggagtcc

SEQ ID NO: 210658 - DNA, 25 bp, Homo sapien
agcagcaccatgtcgcttcgcggct

SEQ ID NO: 210659 - DNA, 25 bp, Homo sapien
aaccagagcgtcacacgccgcggtg

SEQ ID NO: 210660 - DNA, 25 bp, Homo sapien
caccatgtcgcttcgcggctcggtg

SEQ ID NO: 210661 - DNA, 25 bp, Homo sapien
tcactactccttgagcagcaccatg

SEQ ID NO: 210662 - DNA, 25 bp, Homo sapien
cctcaggcaccctccgtccctgctg

SEQ ID NO: 210663 - DNA, 25 bp, Homo sapien
cctctcctcgggtccacttgggcct

SEQ ID NO: 210664 - DNA, 25 bp, Homo sapien
ccacagcactcccagcgctcggcgt

SEQ ID NO: 210665 - DNA, 25 bp, Homo sapien
tgcctgtgcgtcttcgtcgtgctct

SEQ ID NO: 210666 - DNA, 25 bp, Homo sapien
ggtcctccgtttgaaaaccatgatc

SEQ ID NO: 210667 - DNA, 25 bp, Homo sapien
tcccgcagcccagttccaaggaaaa

SEQ ID NO: 210668 - DNA, 25 bp, Homo sapien
gggctggagaaaactgccataactg

SEQ ID NO: 210669 - DNA, 25 bp, Homo sapien
tgtcagctgaacacagccacttccg

SEQ ID NO: 210670 - DNA, 25 bp, Homo sapien
agccacttccgggtcaaacaccagg

SEQ ID NO: 210671 - DNA, 25 bp, Homo sapien
gattcaattctagctctcgggctgg

SEQ ID NO: 210672 - DNA, 25 bp, Homo sapien
attcattgtctggtaggccctctgc

SEQ ID NO: 210673 - DNA, 25 bp, Homo sapien
cccagtggcaaagcgccgttggtcc

SEQ ID NO: 210674 - DNA, 25 bp, Homo sapien
gtggacgtccatctttacccagaaa

SEQ ID NO: 210675 - DNA, 25 bp, Homo sapien
ctttacccagaaagcgccacagttc

SEQ ID NO: 210676 - DNA, 25 bp, Homo sapien
acctggaatcgagctgcgtctgccg

SEQ ID NO: 210677 - DNA, 25 bp, Homo sapien
gggctcctgctccttctcagttact

SEQ ID NO: 210678 - DNA, 25 bp, Homo sapien
aagcgtctcgtgtcgaatttggccc

SEQ ID NO: 210679 - DNA, 25 bp, Homo sapien
tcccttgggcacaatacctggaatc

SEQ ID NO: 210680 - DNA, 25 bp, Homo sapien
ccggcgaaagagatcgtggacgtcc

SEQ ID NO: 210681 - DNA, 25 bp, Homo sapien
tgcgtctgccgagaagcgtctcgtg

SEQ ID NO: 210682 - DNA, 25 bp, Homo sapien
acttatcggagctgcgtctgacacc

SEQ ID NO: 210683 - DNA, 25 bp, Homo sapien
gcagcccacaggataccaagcctta

SEQ ID NO: 210684 - DNA, 25 bp, Homo sapien
ttgggcgaacacaccactgctgttt

SEQ ID NO: 210685 - DNA, 25 bp, Homo sapien
cgcgcaggtagcagacttcttcaga

SEQ ID NO: 210686 - DNA, 25 bp, Homo sapien
ctgctgtttgcagtatcccgagaca

SEQ ID NO: 210687 - DNA, 25 bp, Homo sapien
cccgaacttgggatttgaggctctc

SEQ ID NO: 210688 - DNA, 25 bp, Homo sapien
gcttttgcccagagctgctgacttc

SEQ ID NO: 210689 - DNA, 25 bp, Homo sapien
cctgcgcaatgggacctagagataa

SEQ ID NO: 210690 - DNA, 25 bp, Homo sapien
ccagctgtcaaagtctagggcggtc

SEQ ID NO: 210691 - DNA, 25 bp, Homo sapien
cgctcggctccttagataattagta

SEQ ID NO: 210692 - DNA, 25 bp, Homo sapien
cacgcgatgggctctgtcctaaagc

SEQ ID NO: 210693 - DNA, 25 bp, Homo sapien
aaatcgcggcgcttcagtgtccgaa

SEQ ID NO: 210694 - DNA, 25 bp, Homo sapien
ggccctcggagcacaaattcaaatg

SEQ ID NO: 210695 - DNA, 25 bp, Homo sapien
cgcctcgcggaactctcttgcagga

SEQ ID NO: 210696 - DNA, 25 bp, Homo sapien
ttatgttacgtctcagctgcggcca

SEQ ID NO: 210697 - DNA, 25 bp, Homo sapien
acaccaccgcgcttcgtttctttgg

SEQ ID NO: 210698 - DNA, 25 bp, Homo sapien
agagtagagaccctggatgcgtccc

SEQ ID NO: 210699 - DNA, 25 bp, Homo sapien
tagagaccctggatgcgtcccggcc

SEQ ID NO: 210700 - DNA, 25 bp, Homo sapien
aagcgaagagtagagaccctggatg

SEQ ID NO: 210701 - DNA, 25 bp, Homo sapien
gacactacgcttcggggttcaggtg

SEQ ID NO: 210702 - DNA, 25 bp, Homo sapien
aagacactacgcttcggggttcagg

SEQ ID NO: 210703 - DNA, 25 bp, Homo sapien
agagagaagacactacgcttcgggg

SEQ ID NO: 210704 - DNA, 25 bp, Homo sapien
ttctcagttccgctttagtccagag

SEQ ID NO: 210705 - DNA, 25 bp, Homo sapien
actgaccacttaggaaggggcgccg

SEQ ID NO: 210706 - DNA, 25 bp, Homo sapien
ttcccttcaggtggcagacagaacg

SEQ ID NO: 210707 - DNA, 25 bp, Homo sapien
acgtgtccgcggcattggccctcgg

SEQ ID NO: 210708 - DNA, 25 bp, Homo sapien
acagaacgagggtgacagtgaaaac

SEQ ID NO: 210709 - DNA, 25 bp, Homo sapien
gcggcggtcctcaaattcccttcag

SEQ ID NO: 210710 - DNA, 25 bp, Homo sapien
caaaagcagctgtgtgtatgtacgg

SEQ ID NO: 210711 - DNA, 25 bp, Homo sapien
gtccacctccacaaaagcagctgtg

SEQ ID NO: 210712 - DNA, 25 bp, Homo sapien
ggccacagcctttcgtccacctcca

SEQ ID NO: 210713 - DNA, 25 bp, Homo sapien
cagtgaaaacgtgtccgcggcattg

SEQ ID NO: 210714 - DNA, 25 bp, Homo sapien
ccacacaggtgtgctcgccggggag

SEQ ID NO: 210715 - DNA, 25 bp, Homo sapien
ctccagcttgccctcgaaggtgaag

SEQ ID NO: 210716 - DNA, 25 bp, Homo sapien
ggcagccgctcgaagggcctcttct

SEQ ID NO: 210717 - DNA, 25 bp, Homo sapien
gagacatcggcaggcagccgctcga

SEQ ID NO: 210718 - DNA, 25 bp, Homo sapien
agcaagtcgggcttgaggcaaaggc

SEQ ID NO: 210719 - DNA, 25 bp, Homo sapien
aggtgaagtccagcaagtcgggctt

SEQ ID NO: 210720 - DNA, 25 bp, Homo sapien
cagcttgccctcgaaggtgaagtcc

SEQ ID NO: 210721 - DNA, 25 bp, Homo sapien
ccacatccaccgagcgcgggcgacc

SEQ ID NO: 210722 - DNA, 25 bp, Homo sapien
gctagtcggagagctcagccttctc

SEQ ID NO: 210723 - DNA, 25 bp, Homo sapien
ttcggcccgagctgtttgtaaatta

SEQ ID NO: 210724 - DNA, 25 bp, Homo sapien
cgaacctcgggcgactgaaaagcca

SEQ ID NO: 210725 - DNA, 25 bp, Homo sapien
tttgcggagctgagatcaagagccc

SEQ ID NO: 210726 - DNA, 25 bp, Homo sapien
tggggccaccaacggcctgatgatg

SEQ ID NO: 210727 - DNA, 25 bp, Homo sapien
cggctgtaagttgggaagctcatta

SEQ ID NO: 210728 - DNA, 25 bp, Homo sapien
tgtctgtccaatgcaggcggctgta

SEQ ID NO: 210729 - DNA, 25 bp, Homo sapien
ggcaatcttgctcactttcctccgg

SEQ ID NO: 210730 - DNA, 25 bp, Homo sapien
cagggccgcttcattgggattcatg

SEQ ID NO: 210731 - DNA, 25 bp, Homo sapien
cgcgcgcggggacctaatccatcaa

SEQ ID NO: 210732 - DNA, 25 bp, Homo sapien
aaaaccatatggtcgccagcgccgg

SEQ ID NO: 210733 - DNA, 25 bp, Homo sapien
tcatggtccgcgctccgaattacag

SEQ ID NO: 210734 - DNA, 25 bp, Homo sapien
tccatcctaagagagggcaattttt

SEQ ID NO: 210735 - DNA, 25 bp, Homo sapien
tctctgcttttggagtgtctttctg

SEQ ID NO: 210736 - DNA, 25 bp, Homo sapien
cgcccgagaccagatgcgcatttct

SEQ ID NO: 210737 - DNA, 25 bp, Homo sapien
attttgcggagaaagagagcccagc

SEQ ID NO: 210738 - DNA, 25 bp, Homo sapien
ccgcttgagcttagcgcgccgattc

SEQ ID NO: 210739 - DNA, 25 bp, Homo sapien
ctgccgctgcccaaagatggtcata

SEQ ID NO: 210740 - DNA, 25 bp, Homo sapien
cggcagcccgagagctttgaaaaca

SEQ ID NO: 210741 - DNA, 25 bp, Homo sapien
cgccgattctggaaccaggtgatga

SEQ ID NO: 210742 - DNA, 25 bp, Homo sapien
gcggactctacgtcggccttcatct

SEQ ID NO: 210743 - DNA, 25 bp, Homo sapien
gcccagtttcttggcggactctacg

SEQ ID NO: 210744 - DNA, 25 bp, Homo sapien
ccagcctgggtttattgcttcgaga

SEQ ID NO: 210745 - DNA, 25 bp, Homo sapien
actttcgccgcttcttaggggtctg

SEQ ID NO: 210746 - DNA, 25 bp, Homo sapien
cctggaaaattccactcctgtgcta

SEQ ID NO: 210747 - DNA, 25 bp, Homo sapien
cacatttcggcggagggcgcgctcc

SEQ ID NO: 210748 - DNA, 25 bp, Homo sapien
tgtgctagctccaccctatgcggct

SEQ ID NO: 210749 - DNA, 25 bp, Homo sapien
gaaaattccactcctgtgctagctc

SEQ ID NO: 210750 - DNA, 25 bp, Homo sapien
gctagctccaccctatgcggctttt

SEQ ID NO: 210751 - DNA, 25 bp, Homo sapien
tacccgacgctcttcactctcagct

SEQ ID NO: 210752 - DNA, 25 bp, Homo sapien
gcagctcgcgttcaagcgctctctc

SEQ ID NO: 210753 - DNA, 25 bp, Homo sapien
tatgcggcttttctcctacccgacg

SEQ ID NO: 210754 - DNA, 25 bp, Homo sapien
tcagtcgcctctttcgcaccaagag

SEQ ID NO: 210755 - DNA, 25 bp, Homo sapien
tgcccttcccgctgcaggacttggt

SEQ ID NO: 210756 - DNA, 25 bp, Homo sapien
aacagctgctcggaagaggagctca

SEQ ID NO: 210757 - DNA, 25 bp, Homo sapien
ccgagagcctggagactaacagctg

SEQ ID NO: 210758 - DNA, 25 bp, Homo sapien
cgggaccctcggaactgctgtgtcc

SEQ ID NO: 210759 - DNA, 25 bp, Homo sapien
agccgcctccttggctatggagagg

SEQ ID NO: 210760 - DNA, 25 bp, Homo sapien
cgcagctgatggtgttccgcaacgt

SEQ ID NO: 210761 - DNA, 25 bp, Homo sapien
ttctcggaagggctccttcaaaatc

SEQ ID NO: 210762 - DNA, 25 bp, Homo sapien
cgctacttgcgcttggcggtcgccg

SEQ ID NO: 210763 - DNA, 25 bp, Homo sapien
gagcgctgacaccagccgctacttg

SEQ ID NO: 210764 - DNA, 25 bp, Homo sapien
cagctgcccggacagggcgcatgga

SEQ ID NO: 210765 - DNA, 25 bp, Homo sapien
aggacggcatagcagggcccagcat

SEQ ID NO: 210766 - DNA, 25 bp, Homo sapien
cagccgctacttgcgcttggcggtc

SEQ ID NO: 210767 - DNA, 25 bp, Homo sapien
ttggggcattggagctccgggcgga

SEQ ID NO: 210768 - DNA, 25 bp, Homo sapien
tgacaccagccgctacttgcgcttg

SEQ ID NO: 210769 - DNA, 25 bp, Homo sapien
tgcgggcgttgtgacccggcgaggt

SEQ ID NO: 210770 - DNA, 25 bp, Homo sapien
ggctctgacgtccagctctcaggca

SEQ ID NO: 210771 - DNA, 25 bp, Homo sapien
tgcctcagcccggttgcaggtctgt

SEQ ID NO: 210772 - DNA, 25 bp, Homo sapien
ccacccgatgaatggagtcgccttc

SEQ ID NO: 210773 - DNA, 25 bp, Homo sapien
gctgccaagccagggtcgctgcgac

SEQ ID NO: 210774 - DNA, 25 bp, Homo sapien
gcgggacgtcctccactaaggcgtc

SEQ ID NO: 210775 - DNA, 25 bp, Homo sapien
ctggatcctggggaagttctagaca

SEQ ID NO: 210776 - DNA, 25 bp, Homo sapien
ggaagttctagacacaggcccagga

SEQ ID NO: 210777 - DNA, 25 bp, Homo sapien
ctctcttcgccaggctgggctctga

SEQ ID NO: 210778 - DNA, 25 bp, Homo sapien
cgggcgccttcagccgggaggcgca

SEQ ID NO: 210779 - DNA, 25 bp, Homo sapien
tctgccgggcgcctagcagcggccc

SEQ ID NO: 210780 - DNA, 25 bp, Homo sapien
caggaggcgcggagccaatccagcc

SEQ ID NO: 210781 - DNA, 25 bp, Homo sapien
aggcgtcagccctgcgagactcgcg

SEQ ID NO: 210782 - DNA, 25 bp, Homo sapien
gggactgtgtagtgccctggcgtgt

SEQ ID NO: 210783 - DNA, 25 bp, Homo sapien
ctgccgtctgcgtgtgagggtgcga

SEQ ID NO: 210784 - DNA, 25 bp, Homo sapien
agagtgcgtgtctgggtccagggct

SEQ ID NO: 210785 - DNA, 25 bp, Homo sapien
gaggcgcggagccaatccagccgtc

SEQ ID NO: 210786 - DNA, 25 bp, Homo sapien
ccgccgtgatgatgccgggagcctg

SEQ ID NO: 210787 - DNA, 25 bp, Homo sapien
ccagccagccgagagagagtcgggt

SEQ ID NO: 210788 - DNA, 25 bp, Homo sapien
cctggccagggcaacacagtggtca

SEQ ID NO: 210789 - DNA, 25 bp, Homo sapien
ctggccagggcaacacagtggtcag

SEQ ID NO: 210790 - DNA, 25 bp, Homo sapien
tggccagggcaacacagtggtcagt

SEQ ID NO: 210791 - DNA, 25 bp, Homo sapien
ccagggcaacacagtggtcagtggg

SEQ ID NO: 210792 - DNA, 25 bp, Homo sapien
caacacagtggtcagtgggggggtt

SEQ ID NO: 210793 - DNA, 25 bp, Homo sapien
tgccgccgccgtgatgatgccggga

SEQ ID NO: 210794 - DNA, 25 bp, Homo sapien
gaggcacgtgttccggctgaccacc

SEQ ID NO: 210795 - DNA, 25 bp, Homo sapien
gcctgcgccagtggaagcgggtgta

SEQ ID NO: 210796 - DNA, 25 bp, Homo sapien
cgctcgctctcgctgagcaaggagc

SEQ ID NO: 210797 - DNA, 25 bp, Homo sapien
agaccaagaggaggcacgtgttccg

SEQ ID NO: 210798 - DNA, 25 bp, Homo sapien
ggctgaccaccgctgacttctgtga

SEQ ID NO: 210799 - DNA, 25 bp, Homo sapien
accaccgctgacttctgtgaatatc

SEQ ID NO: 210800 - DNA, 25 bp, Homo sapien
gctgaggaccgggatgacatgctgg

SEQ ID NO: 210801 - DNA, 25 bp, Homo sapien
ctacagcgagaccaagaggaggcac

SEQ ID NO: 210802 - DNA, 25 bp, Homo sapien
gggcgcacagtgacaacaaggactc

SEQ ID NO: 210803 - DNA, 25 bp, Homo sapien
caaggactccggactcagcagcctg

SEQ ID NO: 210804 - DNA, 25 bp, Homo sapien
cctgtctcccacacagggttcgtgg

SEQ ID NO: 210805 - DNA, 25 bp, Homo sapien
ccgggagatgctggcgatctccttc

SEQ ID NO: 210806 - DNA, 25 bp, Homo sapien
gcagcagcaccgacgacgactcgga

SEQ ID NO: 210807 - DNA, 25 bp, Homo sapien
acgcgctccattgtgtcgggctact

SEQ ID NO: 210808 - DNA, 25 bp, Homo sapien
agagcccgctgactgacctcaactt

SEQ ID NO: 210809 - DNA, 25 bp, Homo sapien
tcagcagcctggagtccaccaaggc

SEQ ID NO: 210810 - DNA, 25 bp, Homo sapien
cgcgcaccgactcctggttctgtag

SEQ ID NO: 210811 - DNA, 25 bp, Homo sapien
ctgggtaataagctcctcgtcgttg

SEQ ID NO: 210812 - DNA, 25 bp, Homo sapien
gttcctcttccaccagggtgcgctg

SEQ ID NO: 210813 - DNA, 25 bp, Homo sapien
actcctggttctgtagctgcgggac

SEQ ID NO: 210814 - DNA, 25 bp, Homo sapien
cgggtagaggactgcccaatccagg

SEQ ID NO: 210815 - DNA, 25 bp, Homo sapien
tctgcagaagaagcggctgcttggc

SEQ ID NO: 210816 - DNA, 25 bp, Homo sapien
gcctcacttgagctgctgggtaata

SEQ ID NO: 210817 - DNA, 25 bp, Homo sapien
ctcgtcgttgagatagcgcagccgt

SEQ ID NO: 210818 - DNA, 25 bp, Homo sapien
cacaggcaggagaccgcagttccga

SEQ ID NO: 210819 - DNA, 25 bp, Homo sapien
aggcccacgaggtcccatatgccag

SEQ ID NO: 210820 - DNA, 25 bp, Homo sapien
acaggaaggcccacgaggtcccata

SEQ ID NO: 210821 - DNA, 25 bp, Homo sapien
gccgttgattttgaggaagagtttg

SEQ ID NO: 210822 - DNA, 25 bp, Homo sapien
tcctggttggacgagccgttgattt

SEQ ID NO: 210823 - DNA, 25 bp, Homo sapien
ttccgaggcggcagccactacacga

SEQ ID NO: 210824 - DNA, 25 bp, Homo sapien
gtcagtcactgaagcacaggcagga

SEQ ID NO: 210825 - DNA, 25 bp, Homo sapien
gccactacacgaaggcctcctggtt

SEQ ID NO: 210826 - DNA, 25 bp, Homo sapien
tgtggaaaacccagcatctgcagtg

SEQ ID NO: 210827 - DNA, 25 bp, Homo sapien
cagctaagccgctcaggtgtcccga

SEQ ID NO: 210828 - DNA, 25 bp, Homo sapien
ctgggaagtgctacctcagctaagc

SEQ ID NO: 210829 - DNA, 25 bp, Homo sapien
ttacccaggtcgagttcagagagcc

SEQ ID NO: 210830 - DNA, 25 bp, Homo sapien
tgaataattcagcagtcgcgcgggg

SEQ ID NO: 210831 - DNA, 25 bp, Homo sapien
gcctgagtcaggcttctcataataa

SEQ ID NO: 210832 - DNA, 25 bp, Homo sapien
cccgcccggctaaatggacacagga

SEQ ID NO: 210833 - DNA, 25 bp, Homo sapien
ggcgtggttccaagcacagtgaaga

SEQ ID NO: 210834 - DNA, 25 bp, Homo sapien
cgcgcaagtcactggcgctgttctg

SEQ ID NO: 210835 - DNA, 25 bp, Homo sapien
cctcgcaggtgaagctgcatctgca

SEQ ID NO: 210836 - DNA, 25 bp, Homo sapien
gacttgcggcaagggacttctacca

SEQ ID NO: 210837 - DNA, 25 bp, Homo sapien
cttctaccagtaggtgggcgttggt

SEQ ID NO: 210838 - DNA, 25 bp, Homo sapien
gtacctggagcttgcgcaactgctg

SEQ ID NO: 210839 - DNA, 25 bp, Homo sapien
aactgctggagctggccgcgcaagt

SEQ ID NO: 210840 - DNA, 25 bp, Homo sapien
tgttctgcaggcctcgcaggtgaag

SEQ ID NO: 210841 - DNA, 25 bp, Homo sapien
gctgcatctgcagccggctaacggc

SEQ ID NO: 210842 - DNA, 25 bp, Homo sapien
cccggcgtacgataggcgcgaacgc

SEQ ID NO: 210843 - DNA, 25 bp, Homo sapien
ggtcagcatagaggccctcgccttt

SEQ ID NO: 210844 - DNA, 25 bp, Homo sapien
tcctccagatcggactgcagcgcgg

SEQ ID NO: 210845 - DNA, 25 bp, Homo sapien
tcggccagcttctgcggtgacgaag

SEQ ID NO: 210846 - DNA, 25 bp, Homo sapien
gcgatgcgtacaccatctctctctg

SEQ ID NO: 210847 - DNA, 25 bp, Homo sapien
ctccaggactctcggcaaagacgga

SEQ ID NO: 210848 - DNA, 25 bp, Homo sapien
ctctctgcgcagaagacagcccgga

SEQ ID NO: 210849 - DNA, 25 bp, Homo sapien
gccgccttgtacagggagtcctcca

SEQ ID NO: 210850 - DNA, 25 bp, Homo sapien
cgtagaagacgttgcgagcctcgtc

SEQ ID NO: 210851 - DNA, 25 bp, Homo sapien
gagtgcagatgcacccaggcacctc

SEQ ID NO: 210852 - DNA, 25 bp, Homo sapien
cggacgtcctccagctcgtagaaga

SEQ ID NO: 210853 - DNA, 25 bp, Homo sapien
cgtctttgatgaggatggcggtatt

SEQ ID NO: 210854 - DNA, 25 bp, Homo sapien
cccatggtgagcttctgcgggaaca

SEQ ID NO: 210855 - DNA, 25 bp, Homo sapien
aacatgtgcgcgatgagtgcgtgca

SEQ ID NO: 210856 - DNA, 25 bp, Homo sapien
ggcgacttaagcatgcccatggtga

SEQ ID NO: 210857 - DNA, 25 bp, Homo sapien
tgctgacctcgtgcgtgatgtgcac

SEQ ID NO: 210858 - DNA, 25 bp, Homo sapien
ccgggaaggtcatgactttccgacg

SEQ ID NO: 210859 - DNA, 25 bp, Homo sapien
ctttgctgcaatgcgagagccgccg

SEQ ID NO: 210860 - DNA, 25 bp, Homo sapien
ggaacctgcaatggcctggacgtcc

SEQ ID NO: 210861 - DNA, 25 bp, Homo sapien
atcgggaacctgcaatggcctggac

SEQ ID NO: 210862 - DNA, 25 bp, Homo sapien
cgtttctcagggatcgggaacctgc

SEQ ID NO: 210863 - DNA, 25 bp, Homo sapien
ggcccacgccgaaggcacctaatgc

SEQ ID NO: 210864 - DNA, 25 bp, Homo sapien
aggtcatgactttccgacgctgggg

SEQ ID NO: 210865 - DNA, 25 bp, Homo sapien
cggtaaccgcgactccacctggcgc

SEQ ID NO: 210866 - DNA, 25 bp, Homo sapien
actctgggccgcgatcaccgtgtgc

SEQ ID NO: 210867 - DNA, 25 bp, Homo sapien
tgctccgctccggatctgcgagagg

SEQ ID NO: 210868 - DNA, 25 bp, Homo sapien
ttgcggtcggcgtccgccttctgga

SEQ ID NO: 210869 - DNA, 25 bp, Homo sapien
aggcatcacgcttgcggtcggcgtc

SEQ ID NO: 210870 - DNA, 25 bp, Homo sapien
ggtccatgaaggcatcacgcttgcg

SEQ ID NO: 210871 - DNA, 25 bp, Homo sapien
gtacttgctcttcaggtggtccatg

SEQ ID NO: 210872 - DNA, 25 bp, Homo sapien
atcctgtcctgctggcctcgcaggg

SEQ ID NO: 210873 - DNA, 25 bp, Homo sapien
cgtgctgtgggtacttgctcttcag

SEQ ID NO: 210874 - DNA, 25 bp, Homo sapien
gttggctccgcagacttctccagcg

SEQ ID NO: 210875 - DNA, 25 bp, Homo sapien
cgcgcctagggatggaaaggctctc

SEQ ID NO: 210876 - DNA, 25 bp, Homo sapien
cccaagtagtcttcgcgccacgata

SEQ ID NO: 210877 - DNA, 25 bp, Homo sapien
tcgcgccacgatagagacaaataca

SEQ ID NO: 210878 - DNA, 25 bp, Homo sapien
acaaatacattgaccgaggaccggc

SEQ ID NO: 210879 - DNA, 25 bp, Homo sapien
ccttcagccaaggtgaccgcggaaa

SEQ ID NO: 210880 - DNA, 25 bp, Homo sapien
taggacgctccagcgacggtccctg

SEQ ID NO: 210881 - DNA, 25 bp, Homo sapien
ccttcgttggcctacctgttggctc

SEQ ID NO: 210882 - DNA, 25 bp, Homo sapien
cacgcaggcacagcggagagaattc

SEQ ID NO: 210883 - DNA, 25 bp, Homo sapien
cgaagctggtcgtagattcccgagg

SEQ ID NO: 210884 - DNA, 25 bp, Homo sapien
gtgcttcaggccatccggggcccag

SEQ ID NO: 210885 - DNA, 25 bp, Homo sapien
cagggcacagggtctccatggagca

SEQ ID NO: 210886 - DNA, 25 bp, Homo sapien
ggagaccctctcgagtcgcccgaag

SEQ ID NO: 210887 - DNA, 25 bp, Homo sapien
tcgagtcgcccgaagcgcagaggca

SEQ ID NO: 210888 - DNA, 25 bp, Homo sapien
tgggccacgctgaggctcgagaccc

SEQ ID NO: 210889 - DNA, 25 bp, Homo sapien
tgcacaggagcgaacgccgaagtgc

SEQ ID NO: 210890 - DNA, 25 bp, Homo sapien
ggcagccctccgagattccctgtgt

SEQ ID NO: 210891 - DNA, 25 bp, Homo sapien
cggggattcatctcccttccggatg

SEQ ID NO: 210892 - DNA, 25 bp, Homo sapien
cagggtgacctgagacaaaggcttc

SEQ ID NO: 210893 - DNA, 25 bp, Homo sapien
cacgttttagtgagccctgtccggc

SEQ ID NO: 210894 - DNA, 25 bp, Homo sapien
cgccctgtgtagatgtagcctcttc

SEQ ID NO: 210895 - DNA, 25 bp, Homo sapien
ggagtaaatccctgacgccaaagac

SEQ ID NO: 210896 - DNA, 25 bp, Homo sapien
ccaggcccttgatgttccggttgaa

SEQ ID NO: 210897 - DNA, 25 bp, Homo sapien
ccgggattccggtcatcgcaataat

SEQ ID NO: 210898 - DNA, 25 bp, Homo sapien
cggcagagagcgcacagacgctcag

SEQ ID NO: 210899 - DNA, 25 bp, Homo sapien
tgtccgcactcagcggcagagagcg

SEQ ID NO: 210900 - DNA, 25 bp, Homo sapien
tggcctccgccctcgcagaacgccg

SEQ ID NO: 210901 - DNA, 25 bp, Homo sapien
gcttgctcccagaagcgcggcctag

SEQ ID NO: 210902 - DNA, 25 bp, Homo sapien
tgacccgtcccgaggtgacgcgacg

SEQ ID NO: 210903 - DNA, 25 bp, Homo sapien
accacgcagggtgcatcagtccgtg

SEQ ID NO: 210904 - DNA, 25 bp, Homo sapien
cacagacgctcagcacacccgggcc

SEQ ID NO: 210905 - DNA, 25 bp, Homo sapien
ttctgtccgcactcagcggcagaga

SEQ ID NO: 210906 - DNA, 25 bp, Homo sapien
ggcgtccgagcgattttcattcact

SEQ ID NO: 210907 - DNA, 25 bp, Homo sapien
ggccacactggactaggaaacgagg

SEQ ID NO: 210908 - DNA, 25 bp, Homo sapien
tcctccagacaagagtaggtcccgc

SEQ ID NO: 210909 - DNA, 25 bp, Homo sapien
acgtgacctcattccttcaggatgc

SEQ ID NO: 210910 - DNA, 25 bp, Homo sapien
ccggaggatggattctcttatgtta

SEQ ID NO: 210911 - DNA, 25 bp, Homo sapien
ctccgggtctgggacacaataatcc

SEQ ID NO: 210912 - DNA, 25 bp, Homo sapien
ttatgttaccttccgcagttagccc

SEQ ID NO: 210913 - DNA, 25 bp, Homo sapien
ccatccctaactggggcgcctggaa

SEQ ID NO: 210914 - DNA, 25 bp, Homo sapien
gcctaaactcaggtggccagacaga

SEQ ID NO: 210915 - DNA, 25 bp, Homo sapien
acggaggcctctgcgcctaaactca

SEQ ID NO: 210916 - DNA, 25 bp, Homo sapien
taaggagatccacggaggcctctgc

SEQ ID NO: 210917 - DNA, 25 bp, Homo sapien
ctccagcccggggtaaggagatcca

SEQ ID NO: 210918 - DNA, 25 bp, Homo sapien
ttggccctgactgtctgcaggatga

SEQ ID NO: 210919 - DNA, 25 bp, Homo sapien
tcgaagtaccgcgagttggccctga

SEQ ID NO: 210920 - DNA, 25 bp, Homo sapien
agccggctgagagccgataaagccg

SEQ ID NO: 210921 - DNA, 25 bp, Homo sapien
ggtggggaactagcaccctcgtcca

SEQ ID NO: 210922 - DNA, 25 bp, Homo sapien
tttgagccgttcctcagcagcacgg

SEQ ID NO: 210923 - DNA, 25 bp, Homo sapien
cctggagtctccattcggaaccagc

SEQ ID NO: 210924 - DNA, 25 bp, Homo sapien
ctctggtgctttgagccgttcctca

SEQ ID NO: 210925 - DNA, 25 bp, Homo sapien
tgagccgttcctcagcagcacggca

SEQ ID NO: 210926 - DNA, 25 bp, Homo sapien
gagccgcaaagctcacgagtgtgcg

SEQ ID NO: 210927 - DNA, 25 bp, Homo sapien
gctcacgagtgtgcggaaagtgacc

SEQ ID NO: 210928 - DNA, 25 bp, Homo sapien
cgatggctctggtgctttgagccgt

SEQ ID NO: 210929 - DNA, 25 bp, Homo sapien
gcaaggcctggagtctccattcgga

SEQ ID NO: 210930 - DNA, 25 bp, Homo sapien
tcgactaccggcgtagtagtgagcc

SEQ ID NO: 210931 - DNA, 25 bp, Homo sapien
caatgggagcgagcctggacggcgc

SEQ ID NO: 210932 - DNA, 25 bp, Homo sapien
cgagtcaatgggagcgagcctggac

SEQ ID NO: 210933 - DNA, 25 bp, Homo sapien
gcgtagtagtgagccgagtcaatgg

SEQ ID NO: 210934 - DNA, 25 bp, Homo sapien
cggcgtagtagtgagccgagtcaat

SEQ ID NO: 210935 - DNA, 25 bp, Homo sapien
ccggcgtagtagtgagccgagtcaa

SEQ ID NO: 210936 - DNA, 25 bp, Homo sapien
taccggcgtagtagtgagccgagtc

SEQ ID NO: 210937 - DNA, 25 bp, Homo sapien
gactaccggcgtagtagtgagccga

SEQ ID NO: 210938 - DNA, 25 bp, Homo sapien
cattggaacggcgagaggtcgactc

SEQ ID NO: 210939 - DNA, 25 bp, Homo sapien
agacgccgtaagagatgccgccatc

SEQ ID NO: 210940 - DNA, 25 bp, Homo sapien
cctgagattgaggatacgtgaagtc

SEQ ID NO: 210941 - DNA, 25 bp, Homo sapien
gccatcgggcgaaataagtggaacc

SEQ ID NO: 210942 - DNA, 25 bp, Homo sapien
tcctcaggttctacctcaaacgtgg

SEQ ID NO: 210943 - DNA, 25 bp, Homo sapien
ccctttttagggtgacctgagattg

SEQ ID NO: 210944 - DNA, 25 bp, Homo sapien
ggtcgactctggctatcctcaggtt

SEQ ID NO: 210945 - DNA, 25 bp, Homo sapien
cctcaaacgtggagaggcgcggaac

SEQ ID NO: 210946 - DNA, 25 bp, Homo sapien
ccgctctgtctgtcctagtctatta

SEQ ID NO: 210947 - DNA, 25 bp, Homo sapien
aattgctctggcgatcgagggatcc

SEQ ID NO: 210948 - DNA, 25 bp, Homo sapien
tctttcccatgggtgaccggctgta

SEQ ID NO: 210949 - DNA, 25 bp, Homo sapien
gacccggtttactggaattgctctg

SEQ ID NO: 210950 - DNA, 25 bp, Homo sapien
ggtgaccacggacttccagaagatc

SEQ ID NO: 210951 - DNA, 25 bp, Homo sapien
tattatgtcctataacggaggggcc

SEQ ID NO: 210952 - DNA, 25 bp, Homo sapien
gggatcctagtacaccgcaatcatg

SEQ ID NO: 210953 - DNA, 25 bp, Homo sapien
gaagaactgtgtggccatcgctgca

SEQ ID NO: 210954 - DNA, 25 bp, Homo sapien
cgatgccaccgctccggaagggaag

SEQ ID NO: 210955 - DNA, 25 bp, Homo sapien
acagagacaccaggcctcgcgtggc

SEQ ID NO: 210956 - DNA, 25 bp, Homo sapien
gagctggttaccgtgtggttcaccc

SEQ ID NO: 210957 - DNA, 25 bp, Homo sapien
ggcccggaatagcttcactttctgg

SEQ ID NO: 210958 - DNA, 25 bp, Homo sapien
cactttctggcacacgaaatgcttc

SEQ ID NO: 210959 - DNA, 25 bp, Homo sapien
gccagggtttggctctttcccgcaa

SEQ ID NO: 210960 - DNA, 25 bp, Homo sapien
ttcccgcaacccgaatgccaagatg

SEQ ID NO: 210961 - DNA, 25 bp, Homo sapien
gaagagaaagtccagcctagaaagc

SEQ ID NO: 210962 - DNA, 25 bp, Homo sapien
ccaggagccgtcaactgccagtttc

SEQ ID NO: 210963 - DNA, 25 bp, Homo sapien
cagattttgcaaaggtccgggctcc

SEQ ID NO: 210964 - DNA, 25 bp, Homo sapien
cgttggcgttacttgcagattttgc

SEQ ID NO: 210965 - DNA, 25 bp, Homo sapien
tgccagtttcaccaccgctctagag

SEQ ID NO: 210966 - DNA, 25 bp, Homo sapien
cccatgacggtggagacgattcctc

SEQ ID NO: 210967 - DNA, 25 bp, Homo sapien
cctcactacgcggatctggaagatt

SEQ ID NO: 210968 - DNA, 25 bp, Homo sapien
gtcgaggtctcattttggctgcttc

SEQ ID NO: 210969 - DNA, 25 bp, Homo sapien
cgcggaacgatgacgtacagggctc

SEQ ID NO: 210970 - DNA, 25 bp, Homo sapien
agcctttctccagtcgcaggcgaca

SEQ ID NO: 210971 - DNA, 25 bp, Homo sapien
aaaggggcggaaccacgtgactctg

SEQ ID NO: 210972 - DNA, 25 bp, Homo sapien
cgtggtagtcctgctgcgcgttgta

SEQ ID NO: 210973 - DNA, 25 bp, Homo sapien
ttgtagggcggaatcgccgaccaca

SEQ ID NO: 210974 - DNA, 25 bp, Homo sapien
acagcttgggcctagagcgcccata

SEQ ID NO: 210975 - DNA, 25 bp, Homo sapien
cagtcgcaggcgacactcgctcagg

SEQ ID NO: 210976 - DNA, 25 bp, Homo sapien
ccgtccaagataaagcctttctcca

SEQ ID NO: 210977 - DNA, 25 bp, Homo sapien
tagagcgcccataagcgcgggcagc

SEQ ID NO: 210978 - DNA, 25 bp, Homo sapien
tcacgtcgggatcctgccatctcaa

SEQ ID NO: 210979 - DNA, 25 bp, Homo sapien
cgatagccctattcgcggagcgatc

SEQ ID NO: 210980 - DNA, 25 bp, Homo sapien
gacactgggatatgaactttaacgc

SEQ ID NO: 210981 - DNA, 25 bp, Homo sapien
ctgggcgctgccttattacgtaata

SEQ ID NO: 210982 - DNA, 25 bp, Homo sapien
gcgatctcgcggtatccagactaca

SEQ ID NO: 210983 - DNA, 25 bp, Homo sapien
tgccacccgattctcacggaaagta

SEQ ID NO: 210984 - DNA, 25 bp, Homo sapien
agctcgctcggattttacttatgcc

SEQ ID NO: 210985 - DNA, 25 bp, Homo sapien
cacgacagatggtggaggatcctcc

SEQ ID NO: 210986 - DNA, 25 bp, Homo sapien
cgcagtgctccgaatccagggagga

SEQ ID NO: 210987 - DNA, 25 bp, Homo sapien
ccgggagacgcgtctttgcaatccc

SEQ ID NO: 210988 - DNA, 25 bp, Homo sapien
tgaactgtctggataaggtgagccc

SEQ ID NO: 210989 - DNA, 25 bp, Homo sapien
ggcaagatcgtgtatcccacggaga

SEQ ID NO: 210990 - DNA, 25 bp, Homo sapien
cagttccagcgttcaggaggatcca

SEQ ID NO: 210991 - DNA, 25 bp, Homo sapien
ccgaatgcggtgaatcagttccagc

SEQ ID NO: 210992 - DNA, 25 bp, Homo sapien
tccgcagattcatgccgggtagaaa

SEQ ID NO: 210993 - DNA, 25 bp, Homo sapien
ggggacacatcccagtctgaaaacc

SEQ ID NO: 210994 - DNA, 25 bp, Homo sapien
gcatcgcatccgtcctgggcgtgac

SEQ ID NO: 210995 - DNA, 25 bp, Homo sapien
tgtatgactacagcgccgccgacga

SEQ ID NO: 210996 - DNA, 25 bp, Homo sapien
tctccttccaggacggggacaccat

SEQ ID NO: 210997 - DNA, 25 bp, Homo sapien
tcaacgtgcagcagatcgacgacgg

SEQ ID NO: 210998 - DNA, 25 bp, Homo sapien
gccaactacgtggaggccatctgaa

SEQ ID NO: 210999 - DNA, 25 bp, Homo sapien
tggaggccatctgaacccgcagcgc

SEQ ID NO: 211000 - DNA, 25 bp, Homo sapien
gtcttcagcacattccacggcatcg

SEQ ID NO: 211001 - DNA, 25 bp, Homo sapien
cggtaccgcgcggtgtatgactaca

SEQ ID NO: 211002 - DNA, 25 bp, Homo sapien
ccagagctcgcctcgcatggtgggt

SEQ ID NO: 211003 - DNA, 25 bp, Homo sapien
gcctcgcatggtgggtgcccggacc

SEQ ID NO: 211004 - DNA, 25 bp, Homo sapien
ccggcctgcttgctgccccggtcct

SEQ ID NO: 211005 - DNA, 25 bp, Homo sapien
agctcgcctcgcatggtgggtgccc

SEQ ID NO: 211006 - DNA, 25 bp, Homo sapien
catgcccacacctgactgcccgtcc

SEQ ID NO: 211007 - DNA, 25 bp, Homo sapien
ctgcccatgcccacacctgactgcc

SEQ ID NO: 211008 - DNA, 25 bp, Homo sapien
cctcgcggacatcgccaggccgtcc

SEQ ID NO: 211009 - DNA, 25 bp, Homo sapien
ccacacctgactgcccgtccctccc

SEQ ID NO: 211010 - DNA, 25 bp, Homo sapien
cgtactattgatccgcttctgagca

SEQ ID NO: 211011 - DNA, 25 bp, Homo sapien
tagcccattagatctcgtactattg

SEQ ID NO: 211012 - DNA, 25 bp, Homo sapien
cgtctggcagctccaggaaaggatc

SEQ ID NO: 211013 - DNA, 25 bp, Homo sapien
agaaggacccttcgcgcaggatgtc

SEQ ID NO: 211014 - DNA, 25 bp, Homo sapien
gaagtctcgccctcacgaaggacga

SEQ ID NO: 211015 - DNA, 25 bp, Homo sapien
cacccgcttggcagttagcccatta

SEQ ID NO: 211016 - DNA, 25 bp, Homo sapien
caggatgtcccggagactcgtccac

SEQ ID NO: 211017 - DNA, 25 bp, Homo sapien
ggtgacctagcctttgggcgcttcc

SEQ ID NO: 211018 - DNA, 25 bp, Homo sapien
ctagaagcatcagccgccccgcgct

SEQ ID NO: 211019 - DNA, 25 bp, Homo sapien
gagaacccctagaagcatcagccgc

SEQ ID NO: 211020 - DNA, 25 bp, Homo sapien
agccgctcccaaggcaaggggtgca

SEQ ID NO: 211021 - DNA, 25 bp, Homo sapien
taacggagcgctcccctagagctct

SEQ ID NO: 211022 - DNA, 25 bp, Homo sapien
tgccctcagccctaacggagcgctc

SEQ ID NO: 211023 - DNA, 25 bp, Homo sapien
tcgggctgagagaacccctagaagc

SEQ ID NO: 211024 - DNA, 25 bp, Homo sapien
cagccgctcccaaggcaaggggtgc

SEQ ID NO: 211025 - DNA, 25 bp, Homo sapien
cgcgctcctcactgagctcctggct

SEQ ID NO: 211026 - DNA, 25 bp, Homo sapien
ccgtgtttgtgctccagccgatgaa

SEQ ID NO: 211027 - DNA, 25 bp, Homo sapien
gatccacaccgtggggagtgctctg

SEQ ID NO: 211028 - DNA, 25 bp, Homo sapien
actgagcgtgccgtccagatgtccc

SEQ ID NO: 211029 - DNA, 25 bp, Homo sapien
ctgaacaaacactgagcgtgccgtc

SEQ ID NO: 211030 - DNA, 25 bp, Homo sapien
acgcgaggcactgaacaaacactga

SEQ ID NO: 211031 - DNA, 25 bp, Homo sapien
tccagccgatgaagcgagtgcaaag

SEQ ID NO: 211032 - DNA, 25 bp, Homo sapien
agccgccggccgtgtttgtgctcca

SEQ ID NO: 211033 - DNA, 25 bp, Homo sapien
caaagggctgtacaaacgcgaggca

SEQ ID NO: 211034 - DNA, 25 bp, Homo sapien
tgctcattaacttggcgatcagctg

SEQ ID NO: 211035 - DNA, 25 bp, Homo sapien
ctccgggacggtggaaaagacagct

SEQ ID NO: 211036 - DNA, 25 bp, Homo sapien
ggcttgccaagagacggtgtttaga

SEQ ID NO: 211037 - DNA, 25 bp, Homo sapien
gtcacaatcgcaggaaactcgcagc

SEQ ID NO: 211038 - DNA, 25 bp, Homo sapien
ggagcgcccatatacgaccctcgga

SEQ ID NO: 211039 - DNA, 25 bp, Homo sapien
ccctggttcccgaagatgctcatta

SEQ ID NO: 211040 - DNA, 25 bp, Homo sapien
gcgatcagctgtcccatggcacttc

SEQ ID NO: 211041 - DNA, 25 bp, Homo sapien
cgtgcgtccgaccacagatcagagg

SEQ ID NO: 211042 - DNA, 25 bp, Homo sapien
tcagcgaatgtagacgcctcgtccc

SEQ ID NO: 211043 - DNA, 25 bp, Homo sapien
tgtcggtcagctcttcctcatagtc

SEQ ID NO: 211044 - DNA, 25 bp, Homo sapien
tcagctcttcctcatagtcttcttc

SEQ ID NO: 211045 - DNA, 25 bp, Homo sapien
ccctgcctctcagcgaatgtagacg

SEQ ID NO: 211046 - DNA, 25 bp, Homo sapien
ttccggttgtcggtcagctcttcct

SEQ ID NO: 211047 - DNA, 25 bp, Homo sapien
gcagtagcgggccttattccggccc

SEQ ID NO: 211048 - DNA, 25 bp, Homo sapien
agccctccagctcattcttgttgcg

SEQ ID NO: 211049 - DNA, 25 bp, Homo sapien
tcgtcctcccaggatccctgtcggg

SEQ ID NO: 211050 - DNA, 25 bp, Homo sapien
cacgctcagcccactgaagctggtg

SEQ ID NO: 211051 - DNA, 25 bp, Homo sapien
tccctcagcgcatgggagaggccgt

SEQ ID NO: 211052 - DNA, 25 bp, Homo sapien
ttctggaccatggagaggagcctcc

SEQ ID NO: 211053 - DNA, 25 bp, Homo sapien
ggtcgaagacctccatggggatctc

SEQ ID NO: 211054 - DNA, 25 bp, Homo sapien
gcccatcaatcacaacctgcaagga

SEQ ID NO: 211055 - DNA, 25 bp, Homo sapien
cccaagcggcaggaaccttgacgcg

SEQ ID NO: 211056 - DNA, 25 bp, Homo sapien
gcccactgaagctggtgcccaagcg

SEQ ID NO: 211057 - DNA, 25 bp, Homo sapien
ggctcgctttctagcctctttcaac

SEQ ID NO: 211058 - DNA, 25 bp, Homo sapien
gagctggtctccatcaggcgctgac

SEQ ID NO: 211059 - DNA, 25 bp, Homo sapien
ggagatgaaatggaggccgccctaa

SEQ ID NO: 211060 - DNA, 25 bp, Homo sapien
agcgtcgcagcaactgagaccagga

SEQ ID NO: 211061 - DNA, 25 bp, Homo sapien
tcgacccacgcgagcagagcaaacg

SEQ ID NO: 211062 - DNA, 25 bp, Homo sapien
cctttcttgcttggcacacccggag

SEQ ID NO: 211063 - DNA, 25 bp, Homo sapien
agcggagccgatctctgctttcacg

SEQ ID NO: 211064 - DNA, 25 bp, Homo sapien
agaccaagccgtgggccctttcttg

SEQ ID NO: 211065 - DNA, 25 bp, Homo sapien
gggcccgagcgagctctttcctttc

SEQ ID NO: 211066 - DNA, 25 bp, Homo sapien
gggcgctcatcaggaaaggcagccc

SEQ ID NO: 211067 - DNA, 25 bp, Homo sapien
cctgcgcgactcaggtgcacatgga

SEQ ID NO: 211068 - DNA, 25 bp, Homo sapien
cgcctataaatagcacaggacgtgc

SEQ ID NO: 211069 - DNA, 25 bp, Homo sapien
gcgactgagtcatcccggggaccca

SEQ ID NO: 211070 - DNA, 25 bp, Homo sapien
cgccagcgtttctgtctccggcttg

SEQ ID NO: 211071 - DNA, 25 bp, Homo sapien
ctgacctcggatgggtactgagccc

SEQ ID NO: 211072 - DNA, 25 bp, Homo sapien
ggcaagatcggcctcgacggccctg

SEQ ID NO: 211073 - DNA, 25 bp, Homo sapien
ctccatgctgggctccgatgacagg

SEQ ID NO: 211074 - DNA, 25 bp, Homo sapien
agccaaggagctgtccgtgtccagc

SEQ ID NO: 211075 - DNA, 25 bp, Homo sapien
tgagacgcggagataaacacccgga

SEQ ID NO: 211076 - DNA, 25 bp, Homo sapien
tctgaagccgttctccagaggctgc

SEQ ID NO: 211077 - DNA, 25 bp, Homo sapien
ttctcgctcatctcggtcatggttc

SEQ ID NO: 211078 - DNA, 25 bp, Homo sapien
gcgtcatccggttcgttctccttct

SEQ ID NO: 211079 - DNA, 25 bp, Homo sapien
ccatctctccaacgaagaccagtgg

SEQ ID NO: 211080 - DNA, 25 bp, Homo sapien
attcagagacacgagcgaggataga

SEQ ID NO: 211081 - DNA, 25 bp, Homo sapien
cacgcaggttgtagagacaaattca

SEQ ID NO: 211082 - DNA, 25 bp, Homo sapien
gccggacgcttgtctccctgtgcat

SEQ ID NO: 211083 - DNA, 25 bp, Homo sapien
cccagtgcattacattacggggtgc

SEQ ID NO: 211084 - DNA, 25 bp, Homo sapien
cttctggatgtgtctagattggggc

SEQ ID NO: 211085 - DNA, 25 bp, Homo sapien
acaagagacctctcggctccggcta

SEQ ID NO: 211086 - DNA, 25 bp, Homo sapien
actgtcgccttgaacccaaagtgca

SEQ ID NO: 211087 - DNA, 25 bp, Homo sapien
caggatcctgtaaggcacccgcatc

SEQ ID NO: 211088 - DNA, 25 bp, Homo sapien
gcaacgccgctgctcattggacaga

SEQ ID NO: 211089 - DNA, 25 bp, Homo sapien
aacgactgctcgtcgctagctcggc

SEQ ID NO: 211090 - DNA, 25 bp, Homo sapien
aatattggtcaatgcgtcggcctcg

SEQ ID NO: 211091 - DNA, 25 bp, Homo sapien
agcagtccctactcttcccgggaag

SEQ ID NO: 211092 - DNA, 25 bp, Homo sapien
tcccgggaaggatcaatctgaagtc

SEQ ID NO: 211093 - DNA, 25 bp, Homo sapien
gggcatcgaaatctcgcgaatattg

SEQ ID NO: 211094 - DNA, 25 bp, Homo sapien
cgcgagatttctttcagcgcagtct

SEQ ID NO: 211095 - DNA, 25 bp, Homo sapien
tcttccctttgatctgagctgtctc

SEQ ID NO: 211096 - DNA, 25 bp, Homo sapien
ctcgcgccgctggatattaaacctg

SEQ ID NO: 211097 - DNA, 25 bp, Homo sapien
attcgcgagataaaccgtggtcctg

SEQ ID NO: 211098 - DNA, 25 bp, Homo sapien
tctatcgcctgctctgtcgcctgct

SEQ ID NO: 211099 - DNA, 25 bp, Homo sapien
cgtcctccgcagctgagccccgctc

SEQ ID NO: 211100 - DNA, 25 bp, Homo sapien
cccaggctctatcgcctgctctgtc

SEQ ID NO: 211101 - DNA, 25 bp, Homo sapien
ctctctggttcctggcctccgtcct

SEQ ID NO: 211102 - DNA, 25 bp, Homo sapien
cgcctgctctgtcgcctgctccatc

SEQ ID NO: 211103 - DNA, 25 bp, Homo sapien
gctggctcccgatctggctcccgtt

SEQ ID NO: 211104 - DNA, 25 bp, Homo sapien
cccgatctggctcccgttcccactc

SEQ ID NO: 211105 - DNA, 25 bp, Homo sapien
cgcccggtgtgctcagcttgctcgg

SEQ ID NO: 211106 - DNA, 25 bp, Homo sapien
cctgatctcgcgttgtttgataagc

SEQ ID NO: 211107 - DNA, 25 bp, Homo sapien
aagctttgctcaaacggggagctcc

SEQ ID NO: 211108 - DNA, 25 bp, Homo sapien
cgagactcaggtgaaacgcgtttct

SEQ ID NO: 211109 - DNA, 25 bp, Homo sapien
cgcgtttctagtttgggacctgatc

SEQ ID NO: 211110 - DNA, 25 bp, Homo sapien
cgaaacatcgcgagaggctactgga

SEQ ID NO: 211111 - DNA, 25 bp, Homo sapien
ggctactggactctcgcgacgattt

SEQ ID NO: 211112 - DNA, 25 bp, Homo sapien
tgccgtttcggtttaatctagtgtg

SEQ ID NO: 211113 - DNA, 25 bp, Homo sapien
tctcgcgacgatttctgggattgcc

SEQ ID NO: 211114 - DNA, 25 bp, Homo sapien
ccctcagcaaagattttgcgccttc

SEQ ID NO: 211115 - DNA, 25 bp, Homo sapien
tatcctgattgattcctcctgctcc

SEQ ID NO: 211116 - DNA, 25 bp, Homo sapien
ggctgcggcttcattatcctgattg

SEQ ID NO: 211117 - DNA, 25 bp, Homo sapien
tcctccgaaccgtctggcggacttg

SEQ ID NO: 211118 - DNA, 25 bp, Homo sapien
tgcgtcctgctttagcgcgcggcct

SEQ ID NO: 211119 - DNA, 25 bp, Homo sapien
cccggttgccaaggcgcggttgcca

SEQ ID NO: 211120 - DNA, 25 bp, Homo sapien
gaggccactgcagctttaagatttc

SEQ ID NO: 211121 - DNA, 25 bp, Homo sapien
ggtcggtgctcttccaaggttccag

SEQ ID NO: 211122 - DNA, 25 bp, Homo sapien
gatcagcgcccagacctacggaacg

SEQ ID NO: 211123 - DNA, 25 bp, Homo sapien
cgcacggtggttccactctcgaatc

SEQ ID NO: 211124 - DNA, 25 bp, Homo sapien
agagctggtttcttcaaccacaaga

SEQ ID NO: 211125 - DNA, 25 bp, Homo sapien
gttcaaaccggtggcgcgagccagc

SEQ ID NO: 211126 - DNA, 25 bp, Homo sapien
gggctggaaacaggcgtcgaccaat

SEQ ID NO: 211127 - DNA, 25 bp, Homo sapien
ttccggccggactcggagacaaaca

SEQ ID NO: 211128 - DNA, 25 bp, Homo sapien
agcccgcatctgttcgtcatctctt

SEQ ID NO: 211129 - DNA, 25 bp, Homo sapien
gctttgcagccttcaacccgagtca

SEQ ID NO: 211130 - DNA, 25 bp, Homo sapien
gatcccgcggttgacgccctcctct

SEQ ID NO: 211131 - DNA, 25 bp, Homo sapien
ctcccaatagcaaaaccgggtgatg

SEQ ID NO: 211132 - DNA, 25 bp, Homo sapien
ggaattttagatgtgctctccgccc

SEQ ID NO: 211133 - DNA, 25 bp, Homo sapien
tctcggaattttagatgtgctctcc

SEQ ID NO: 211134 - DNA, 25 bp, Homo sapien
ctgggtgaacagatgtctcggaatt

SEQ ID NO: 211135 - DNA, 25 bp, Homo sapien
tctcctccctgggtgaacagatgtc

SEQ ID NO: 211136 - DNA, 25 bp, Homo sapien
ggcgcaatcagttgcagagcggatg

SEQ ID NO: 211137 - DNA, 25 bp, Homo sapien
aaccgggtgatggatccgggagcac

SEQ ID NO: 211138 - DNA, 25 bp, Homo sapien
ggctcctgcctaggctaccctggat

SEQ ID NO: 211139 - DNA, 25 bp, Homo sapien
tcttggagtagcagggcaccacctt

SEQ ID NO: 211140 - DNA, 25 bp, Homo sapien
atagttcttggctaggcgcagcgtc

SEQ ID NO: 211141 - DNA, 25 bp, Homo sapien
tccgagagcgcccagatatagttct

SEQ ID NO: 211142 - DNA, 25 bp, Homo sapien
gtctgcacgtaggacactaggtctg

SEQ ID NO: 211143 - DNA, 25 bp, Homo sapien
ttgagctgcagacagccggccacca

SEQ ID NO: 211144 - DNA, 25 bp, Homo sapien
cttggtcatcttgcgcttcttgggc

SEQ ID NO: 211145 - DNA, 25 bp, Homo sapien
ctgcgacagacccttgcacagagtc

SEQ ID NO: 211146 - DNA, 25 bp, Homo sapien
gagcgagtgtggcatctctaccagg

SEQ ID NO: 211147 - DNA, 25 bp, Homo sapien
tatcacatgagagacggtgattggc

SEQ ID NO: 211148 - DNA, 25 bp, Homo sapien
cgtcacgggcagcagctatcacatg

SEQ ID NO: 211149 - DNA, 25 bp, Homo sapien
gccatatgggcttggcacgtcacgg

SEQ ID NO: 211150 - DNA, 25 bp, Homo sapien
tctatgccaggccatatgggcttgg

SEQ ID NO: 211151 - DNA, 25 bp, Homo sapien
cggggtaccagcctctatgccaggc

SEQ ID NO: 211152 - DNA, 25 bp, Homo sapien
ggcatctctaccaggcggggtacca

SEQ ID NO: 211153 - DNA, 25 bp, Homo sapien
tcttcagagcgccatgcgaaccgcg

SEQ ID NO: 211154 - DNA, 25 bp, Homo sapien
gcccggctccgttcgctacaagaaa

SEQ ID NO: 211155 - DNA, 25 bp, Homo sapien
tgcataacaatcaggcgcgcgcttg

SEQ ID NO: 211156 - DNA, 25 bp, Homo sapien
ttcgctacaagaaacacaatgcata

SEQ ID NO: 211157 - DNA, 25 bp, Homo sapien
tccgttcgctacaagaaacacaatg

SEQ ID NO: 211158 - DNA, 25 bp, Homo sapien
ggctccgttcgctacaagaaacaca

SEQ ID NO: 211159 - DNA, 25 bp, Homo sapien
gcagggaaacagcttgtgccagccc

SEQ ID NO: 211160 - DNA, 25 bp, Homo sapien
accgccgcgtggcagggaaacagct

SEQ ID NO: 211161 - DNA, 25 bp, Homo sapien
cgcgcttggagccatgccacgcggc

SEQ ID NO: 211162 - DNA, 25 bp, Homo sapien
gctggagactcgtgcaacttttccc

SEQ ID NO: 211163 - DNA, 25 bp, Homo sapien
ccgcgtgtgaagttagctggagact

SEQ ID NO: 211164 - DNA, 25 bp, Homo sapien
cgcggggcttcttcgccctcccaag

SEQ ID NO: 211165 - DNA, 25 bp, Homo sapien
cccaaggaccgcaagaagatccagt

SEQ ID NO: 211166 - DNA, 25 bp, Homo sapien
gcgggcacggtatttttatccgtgc

SEQ ID NO: 211167 - DNA, 25 bp, Homo sapien
gcaagaagatccagttctcggtgcc

SEQ ID NO: 211168 - DNA, 25 bp, Homo sapien
atttttatccgtgcgcgaacagccc

SEQ ID NO: 211169 - DNA, 25 bp, Homo sapien
gcacagacctggctcagcgagcgcg

SEQ ID NO: 211170 - DNA, 25 bp, Homo sapien
tttgagtccgcttctgcgcagggcc

SEQ ID NO: 211171 - DNA, 25 bp, Homo sapien
gcaggcgaacgcaagtcccgcttcg

SEQ ID NO: 211172 - DNA, 25 bp, Homo sapien
gccggaagatcttcttccgctctga

SEQ ID NO: 211173 - DNA, 25 bp, Homo sapien
cgctctgaggcgctactgaggccgc

SEQ ID NO: 211174 - DNA, 25 bp, Homo sapien
tgtccgtgctgggttccgtccgacc

SEQ ID NO: 211175 - DNA, 25 bp, Homo sapien
cggcctttgagtccgcttctgcgca

SEQ ID NO: 211176 - DNA, 25 bp, Homo sapien
ttggggtctccagcaatgactcttg

SEQ ID NO: 211177 - DNA, 25 bp, Homo sapien
tctccagcaatgactcttggcgacc

SEQ ID NO: 211178 - DNA, 25 bp, Homo sapien
taagtgcattagcacagctcacctc

SEQ ID NO: 211179 - DNA, 25 bp, Homo sapien
ccagataagcggctgggaacccgcg

SEQ ID NO: 211180 - DNA, 25 bp, Homo sapien
tctgcagcccggacactaagggaga

SEQ ID NO: 211181 - DNA, 25 bp, Homo sapien
ctgttccgcccgctaagtgcattag

SEQ ID NO: 211182 - DNA, 25 bp, Homo sapien
tatcgcgcctgccatcggacgggca

SEQ ID NO: 211183 - DNA, 25 bp, Homo sapien
aggccggaacggactgtcctttctg

SEQ ID NO: 211184 - DNA, 25 bp, Homo sapien
cccggtggcatagcaacggacgaga

SEQ ID NO: 211185 - DNA, 25 bp, Homo sapien
agtctccacctcgaatcaggaaaga

SEQ ID NO: 211186 - DNA, 25 bp, Homo sapien
aactgtcccgcggtgtgtgagaaac

SEQ ID NO: 211187 - DNA, 25 bp, Homo sapien
tgccccttggcgtgtgagaaactgc

SEQ ID NO: 211188 - DNA, 25 bp, Homo sapien
ccccgcggtgtgtgagaaactgtcc

SEQ ID NO: 211189 - DNA, 25 bp, Homo sapien
tgtgagaaactgtcccgcggtgtgt

SEQ ID NO: 211190 - DNA, 25 bp, Homo sapien
gtcccgcggtgtgtgagaaactgcc

SEQ ID NO: 211191 - DNA, 25 bp, Homo sapien
tgtgtgagaaactgtcccgcggtgt

SEQ ID NO: 211192 - DNA, 25 bp, Homo sapien
cgcggtgtgtgagaaactgtcccgc

SEQ ID NO: 211193 - DNA, 25 bp, Homo sapien
tcccgcggtgtgtgagaaactgccc

SEQ ID NO: 211194 - DNA, 25 bp, Homo sapien
cggttcacggcgtagcctcagtttt

SEQ ID NO: 211195 - DNA, 25 bp, Homo sapien
ctaaatctggcttgtgggcaaccgc

SEQ ID NO: 211196 - DNA, 25 bp, Homo sapien
ccgtttctcatccttagaggctgta

SEQ ID NO: 211197 - DNA, 25 bp, Homo sapien
agccgatttcctctgcgtaatggca

SEQ ID NO: 211198 - DNA, 25 bp, Homo sapien
gcaaccgcaacgctgccgcagtgaa

SEQ ID NO: 211199 - DNA, 25 bp, Homo sapien
ccgccatcttgtggatgagaggcca

SEQ ID NO: 211200 - DNA, 25 bp, Homo sapien
ctctctggagaaacgccgtgaggcc

SEQ ID NO: 211201 - DNA, 25 bp, Homo sapien
cagcctgcgcctgagaggtaagaga

SEQ ID NO: 211202 - DNA, 25 bp, Homo sapien
cagttctgctcttcgcactgcagta

SEQ ID NO: 211203 - DNA, 25 bp, Homo sapien
ctgcagtacgcagtcgcggtacacc

SEQ ID NO: 211204 - DNA, 25 bp, Homo sapien
tccgctgaagtccacacagtttaaa

SEQ ID NO: 211205 - DNA, 25 bp, Homo sapien
ctttattctactctccgctgaagtc

SEQ ID NO: 211206 - DNA, 25 bp, Homo sapien
ggaagttcctgtgttctttattcta

SEQ ID NO: 211207 - DNA, 25 bp, Homo sapien
gctgtgtccatatatcgaggcgata

SEQ ID NO: 211208 - DNA, 25 bp, Homo sapien
ttcccggatttttgtgggcgcctgc

SEQ ID NO: 211209 - DNA, 25 bp, Homo sapien
cttaggagtatgaagcttccacttc

SEQ ID NO: 211210 - DNA, 25 bp, Homo sapien
tcccgcaaagggtgtattgcgtaga

SEQ ID NO: 211211 - DNA, 25 bp, Homo sapien
tcaaagaagttctctgaaattgttc

SEQ ID NO: 211212 - DNA, 25 bp, Homo sapien
gagactggcgctttccaggctccga

SEQ ID NO: 211213 - DNA, 25 bp, Homo sapien
gagatggcccatccaagagactggc

SEQ ID NO: 211214 - DNA, 25 bp, Homo sapien
cagttacacggcagcggctcgagat

SEQ ID NO: 211215 - DNA, 25 bp, Homo sapien
ccgaagttgtggacagtcgagacgc

SEQ ID NO: 211216 - DNA, 25 bp, Homo sapien
agccgcagtgagcaccatggagctg

SEQ ID NO: 211217 - DNA, 25 bp, Homo sapien
gacgagctctcctatcccgaagttg

SEQ ID NO: 211218 - DNA, 25 bp, Homo sapien
cgcagatgcggatcctgaaagagac

SEQ ID NO: 211219 - DNA, 25 bp, Homo sapien
agaagatccggaagtacacgatgcg

SEQ ID NO: 211220 - DNA, 25 bp, Homo sapien
ccggaagtacacgatgcggagactg

SEQ ID NO: 211221 - DNA, 25 bp, Homo sapien
tacacgatgcggagactgctgcagg

SEQ ID NO: 211222 - DNA, 25 bp, Homo sapien
cgatgcggagactgctgcaggaaac

SEQ ID NO: 211223 - DNA, 25 bp, Homo sapien
gagccgctgacacctagcggagcga

SEQ ID NO: 211224 - DNA, 25 bp, Homo sapien
agcgatgcccaaccaggcgcagatg

SEQ ID NO: 211225 - DNA, 25 bp, Homo sapien
tgacacctagcggagcgatgcccaa

SEQ ID NO: 211226 - DNA, 25 bp, Homo sapien
accttccgcgaaggagaccgatggc

SEQ ID NO: 211227 - DNA, 25 bp, Homo sapien
acagagcggacagggccttcggatc

SEQ ID NO: 211228 - DNA, 25 bp, Homo sapien
gtgcaaacttggtaccttccgcgaa

SEQ ID NO: 211229 - DNA, 25 bp, Homo sapien
ttcggcgactctgtggtgcaaactt

SEQ ID NO: 211230 - DNA, 25 bp, Homo sapien
tctgggcctgtggactcttcggctt

SEQ ID NO: 211231 - DNA, 25 bp, Homo sapien
ggcttctgcttcctctgggcctgtg

SEQ ID NO: 211232 - DNA, 25 bp, Homo sapien
atggcttccacgtgctcagccactg

SEQ ID NO: 211233 - DNA, 25 bp, Homo sapien
ccagcatgtagatcgtggtcacagg

SEQ ID NO: 211234 - DNA, 25 bp, Homo sapien
cgttttgacctcgtagggcagctcc

SEQ ID NO: 211235 - DNA, 25 bp, Homo sapien
tcgatgcccggatactgctccttca

SEQ ID NO: 211236 - DNA, 25 bp, Homo sapien
cagctccaggtaggtcgcctcgaag

SEQ ID NO: 211237 - DNA, 25 bp, Homo sapien
gcctcgaagccgcagggttcactgg

SEQ ID NO: 211238 - DNA, 25 bp, Homo sapien
ccctgcttccgggtgtgacgcgaac

SEQ ID NO: 211239 - DNA, 25 bp, Homo sapien
gccactgctacgttttgacctcgta

SEQ ID NO: 211240 - DNA, 25 bp, Homo sapien
ggtctccgccactgctacgttttga

SEQ ID NO: 211241 - DNA, 25 bp, Homo sapien
cgaggcgcgactcgatctcgatgcc

SEQ ID NO: 211242 - DNA, 25 bp, Homo sapien
aggcctttcactcctggggtgtcac

SEQ ID NO: 211243 - DNA, 25 bp, Homo sapien
ggggtgtcacgcgacccacgctttc

SEQ ID NO: 211244 - DNA, 25 bp, Homo sapien
cccgatgaggggaggcctttcactc

SEQ ID NO: 211245 - DNA, 25 bp, Homo sapien
atcctgctcgggctgtgataggaca

SEQ ID NO: 211246 - DNA, 25 bp, Homo sapien
cccgggcagtttcacttctggatcc

SEQ ID NO: 211247 - DNA, 25 bp, Homo sapien
gggctcctgtctctcgaggttccca

SEQ ID NO: 211248 - DNA, 25 bp, Homo sapien
ttagtccgggcctcgctgcgagtct

SEQ ID NO: 211249 - DNA, 25 bp, Homo sapien
acgcgccatcggtttcgtggcttgc

SEQ ID NO: 211250 - DNA, 25 bp, Homo sapien
agtgccgcgggttccgcgcctccag

SEQ ID NO: 211251 - DNA, 25 bp, Homo sapien
cgcagactgaaaagggcaggagccg

SEQ ID NO: 211252 - DNA, 25 bp, Homo sapien
tgctcctgccgtcgcctggactcag

SEQ ID NO: 211253 - DNA, 25 bp, Homo sapien
gcgtcggcgcagactgaaaagggca

SEQ ID NO: 211254 - DNA, 25 bp, Homo sapien
cgacctgccggtgcgcggggttaca

SEQ ID NO: 211255 - DNA, 25 bp, Homo sapien
gctggcggcggctttaaaggacgct

SEQ ID NO: 211256 - DNA, 25 bp, Homo sapien
tgtggctactcggcctctccacgtg

SEQ ID NO: 211257 - DNA, 25 bp, Homo sapien
cggctttaaaggacgctggccgcgg

SEQ ID NO: 211258 - DNA, 25 bp, Homo sapien
ggtgttctctccttgatcccttcgg

SEQ ID NO: 211259 - DNA, 25 bp, Homo sapien
cgagaatcgaagcacgcacgcgttc

SEQ ID NO: 211260 - DNA, 25 bp, Homo sapien
agaggatctggcgatcgcctgcagc

SEQ ID NO: 211261 - DNA, 25 bp, Homo sapien
gcgaaaagttcgcatgcctgctgcc

SEQ ID NO: 211262 - DNA, 25 bp, Homo sapien
tccttgggacctcgcggtgttctct

SEQ ID NO: 211263 - DNA, 25 bp, Homo sapien
gaacgcgacaccgtggcttcttttc

SEQ ID NO: 211264 - DNA, 25 bp, Homo sapien
agcgatgatgcgaacgtgcgtccta

SEQ ID NO: 211265 - DNA, 25 bp, Homo sapien
gagggagtctgtccctcgacgcctc

SEQ ID NO: 211266 - DNA, 25 bp, Homo sapien
tgtaccgtgacgtgatggtcagatc

SEQ ID NO: 211267 - DNA, 25 bp, Homo sapien
agttgtagtttcttccgctggctcc

SEQ ID NO: 211268 - DNA, 25 bp, Homo sapien
ggcctcttggttccttccgggctca

SEQ ID NO: 211269 - DNA, 25 bp, Homo sapien
ctggaggcagccaaacgtttatccc

SEQ ID NO: 211270 - DNA, 25 bp, Homo sapien
agcctgggtcttcgcactcggaacc

SEQ ID NO: 211271 - DNA, 25 bp, Homo sapien
gttttctgagtgagacctcgggtgc

SEQ ID NO: 211272 - DNA, 25 bp, Homo sapien
cctcactgttgttggggttttctga

SEQ ID NO: 211273 - DNA, 25 bp, Homo sapien
aggcgaacccgcactaagcacagga

SEQ ID NO: 211274 - DNA, 25 bp, Homo sapien
ccacgctggttgaggcgctcttaaa

SEQ ID NO: 211275 - DNA, 25 bp, Homo sapien
ttgagcgaacttgggcgcaaaaccc

SEQ ID NO: 211276 - DNA, 25 bp, Homo sapien
ataggctgtacccactccacgctgg

SEQ ID NO: 211277 - DNA, 25 bp, Homo sapien
ggcagccgttgagcacaagcccagc

SEQ ID NO: 211278 - DNA, 25 bp, Homo sapien
cctttgtaacccagattggagcctg

SEQ ID NO: 211279 - DNA, 25 bp, Homo sapien
gacgcccacagaaatgcactcgaga

SEQ ID NO: 211280 - DNA, 25 bp, Homo sapien
gcgagagctggacacagtcaccttg

SEQ ID NO: 211281 - DNA, 25 bp, Homo sapien
gcacctcggctgtggatttatttcc

SEQ ID NO: 211282 - DNA, 25 bp, Homo sapien
cttctcggcggaggaacaaagccct

SEQ ID NO: 211283 - DNA, 25 bp, Homo sapien
gccaggacgtgcagctgtgcacaca

SEQ ID NO: 211284 - DNA, 25 bp, Homo sapien
acagaagatggatggcctggagccc

SEQ ID NO: 211285 - DNA, 25 bp, Homo sapien
ttatcagcgaacgaggccgatgaca

SEQ ID NO: 211286 - DNA, 25 bp, Homo sapien
gtgatgacaaatgcccgttatcagc

SEQ ID NO: 211287 - DNA, 25 bp, Homo sapien
attggcgcagaggaaagtgatgaca

SEQ ID NO: 211288 - DNA, 25 bp, Homo sapien
tgtcagccgcgctgatgacattggc

SEQ ID NO: 211289 - DNA, 25 bp, Homo sapien
ggcgcctatatccttgtacggtgca

SEQ ID NO: 211290 - DNA, 25 bp, Homo sapien
acgacgtcactgtcgaccgggcttc

SEQ ID NO: 211291 - DNA, 25 bp, Homo sapien
gagggagctcgaaaggccgctcaca

SEQ ID NO: 211292 - DNA, 25 bp, Homo sapien
tacagagactcagggactcgaggga

SEQ ID NO: 211293 - DNA, 25 bp, Homo sapien
catccaggagctgaggcactacaga

SEQ ID NO: 211294 - DNA, 25 bp, Homo sapien
tctcctttaagggaggacatccagg

SEQ ID NO: 211295 - DNA, 25 bp, Homo sapien
ggcccgcattgttcttctcctttaa

SEQ ID NO: 211296 - DNA, 25 bp, Homo sapien
gactcgtctagtcggcccgcattgt

SEQ ID NO: 211297 - DNA, 25 bp, Homo sapien
accgggcttctccatcatattccga

SEQ ID NO: 211298 - DNA, 25 bp, Homo sapien
ggccagtctgctgcgcattcccggg

SEQ ID NO: 211299 - DNA, 25 bp, Homo sapien
agcttgcaactgacgccctggggaa

SEQ ID NO: 211300 - DNA, 25 bp, Homo sapien
acgagcccgggagcttgcaactgac

SEQ ID NO: 211301 - DNA, 25 bp, Homo sapien
cagtgaccctgtcacgagcccggga

SEQ ID NO: 211302 - DNA, 25 bp, Homo sapien
ttgattatgcaaagccgcggggctc

SEQ ID NO: 211303 - DNA, 25 bp, Homo sapien
caaatgccttgcgattgattatgca

SEQ ID NO: 211304 - DNA, 25 bp, Homo sapien
ggggcattaatatgcaaatgccttg

SEQ ID NO: 211305 - DNA, 25 bp, Homo sapien
ggcccgagtggcctttgcaaagctg

SEQ ID NO: 211306 - DNA, 25 bp, Homo sapien
gtgcagagttcgattctgtacaagg

SEQ ID NO: 211307 - DNA, 25 bp, Homo sapien
cagcttctcggaatgcatgttgttc

SEQ ID NO: 211308 - DNA, 25 bp, Homo sapien
cagcttggtgaagcgggaagtctcc

SEQ ID NO: 211309 - DNA, 25 bp, Homo sapien
cggaattctccatgcccgagcggtc

SEQ ID NO: 211310 - DNA, 25 bp, Homo sapien
gctgctccaccgaagcggaattctc

SEQ ID NO: 211311 - DNA, 25 bp, Homo sapien
cacccggaaggacagcagcttctcg

SEQ ID NO: 211312 - DNA, 25 bp, Homo sapien
aagggccggttcttcagcaccagag

SEQ ID NO: 211313 - DNA, 25 bp, Homo sapien
tgcatgttgttcagggtccgcaggt

SEQ ID NO: 211314 - DNA, 25 bp, Homo sapien
tgaatgaaaacaaacgcagcacgtg

SEQ ID NO: 211315 - DNA, 25 bp, Homo sapien
tgggcccggctctagagccatgtga

SEQ ID NO: 211316 - DNA, 25 bp, Homo sapien
gcaacgaccaatggggtggcagcca

SEQ ID NO: 211317 - DNA, 25 bp, Homo sapien
tcattatgtaacgaggccgggaggc

SEQ ID NO: 211318 - DNA, 25 bp, Homo sapien
cccgaacgatagcagggccaggaca

SEQ ID NO: 211319 - DNA, 25 bp, Homo sapien
ttcccgtcaatcgagagcagtcgcc

SEQ ID NO: 211320 - DNA, 25 bp, Homo sapien
gtgagtcagcccagcttcacccaga

SEQ ID NO: 211321 - DNA, 25 bp, Homo sapien
gctctggactcctcaagtgtcgctc

SEQ ID NO: 211322 - DNA, 25 bp, Homo sapien
accagcccggcttgcacacgcaggc

SEQ ID NO: 211323 - DNA, 25 bp, Homo sapien
ttcgcagtggcacacgccggtcgcg

SEQ ID NO: 211324 - DNA, 25 bp, Homo sapien
cacgtggacgaccaccagccgggtt

SEQ ID NO: 211325 - DNA, 25 bp, Homo sapien
gccgcgcgcagacccttaccctgcg

SEQ ID NO: 211326 - DNA, 25 bp, Homo sapien
agccgtggcagttgcagcggaagct

SEQ ID NO: 211327 - DNA, 25 bp, Homo sapien
cgcactgctgctggcattcgggacc

SEQ ID NO: 211328 - DNA, 25 bp, Homo sapien
acacactcgcactgctgctggcatt

SEQ ID NO: 211329 - DNA, 25 bp, Homo sapien
accaccagccgggttcgcagtggca

SEQ ID NO: 211330 - DNA, 25 bp, Homo sapien
cgcgcctgcgcaacgacaagactgt

SEQ ID NO: 211331 - DNA, 25 bp, Homo sapien
gagacgtgtgccctgctacgttccc

SEQ ID NO: 211332 - DNA, 25 bp, Homo sapien
gagctcccggtgcaaaagtcccaga

SEQ ID NO: 211333 - DNA, 25 bp, Homo sapien
acgttccctcggcagtaatatttca

SEQ ID NO: 211334 - DNA, 25 bp, Homo sapien
aacagccggcacgttgagctcttgc

SEQ ID NO: 211335 - DNA, 25 bp, Homo sapien
caagactgtcgggatttgtagtcca

SEQ ID NO: 211336 - DNA, 25 bp, Homo sapien
tccaccgacaaagtgggcggactgc

SEQ ID NO: 211337 - DNA, 25 bp, Homo sapien
agcaggtaccatgtgatcccaggga

SEQ ID NO: 211338 - DNA, 25 bp, Homo sapien
tatgaccatgagatccgcggtgttc

SEQ ID NO: 211339 - DNA, 25 bp, Homo sapien
ccggcggcaatcctgagcagcgact

SEQ ID NO: 211340 - DNA, 25 bp, Homo sapien
ccggcaccgtaagctcaaggagccg

SEQ ID NO: 211341 - DNA, 25 bp, Homo sapien
cctgagcagcgactggactacgagc

SEQ ID NO: 211342 - DNA, 25 bp, Homo sapien
ccctttcacaatagcgcggcccgcc

SEQ ID NO: 211343 - DNA, 25 bp, Homo sapien
tggcggctacgagcggctccgtttt

SEQ ID NO: 211344 - DNA, 25 bp, Homo sapien
gctgctgaggcgagcccgccaaact

SEQ ID NO: 211345 - DNA, 25 bp, Homo sapien
gctgctccggaccactatgaccatg

SEQ ID NO: 211346 - DNA, 25 bp, Homo sapien
cggctactggccactggactctggc

SEQ ID NO: 211347 - DNA, 25 bp, Homo sapien
tccagctctgagcatcgtgtcttcg

SEQ ID NO: 211348 - DNA, 25 bp, Homo sapien
ggcatgaagccgctggagaaatttc

SEQ ID NO: 211349 - DNA, 25 bp, Homo sapien
tttctgaagaagcagacgtcgcagc

SEQ ID NO: 211350 - DNA, 25 bp, Homo sapien
ggcgtcagagcgtgtctcgcctgct

SEQ ID NO: 211351 - DNA, 25 bp, Homo sapien
cgagcatcttctgaaccgggttctg

SEQ ID NO: 211352 - DNA, 25 bp, Homo sapien
ccggtgggctcgaacacccagagca

SEQ ID NO: 211353 - DNA, 25 bp, Homo sapien
gttgctgagagcgagcactcctttc

SEQ ID NO: 211354 - DNA, 25 bp, Homo sapien
gggagacggccaacttggagctgct

SEQ ID NO: 211355 - DNA, 25 bp, Homo sapien
agttcatcaagatcgcggccctgtg

SEQ ID NO: 211356 - DNA, 25 bp, Homo sapien
tcgtggactacgtgttccacgggga

SEQ ID NO: 211357 - DNA, 25 bp, Homo sapien
cagctgctcaagaagttcatcaaga

SEQ ID NO: 211358 - DNA, 25 bp, Homo sapien
tgcagctggagttcgtggactacgt

SEQ ID NO: 211359 - DNA, 25 bp, Homo sapien
ctggagttcgtggactacgtgttcc

SEQ ID NO: 211360 - DNA, 25 bp, Homo sapien
tcacgcactgggtggccaccgaagt

SEQ ID NO: 211361 - DNA, 25 bp, Homo sapien
ccaccgaagtgctgctctgcgaggc

SEQ ID NO: 211362 - DNA, 25 bp, Homo sapien
aggggcgcatgcgtctcgcatctct

SEQ ID NO: 211363 - DNA, 25 bp, Homo sapien
gcctccattttgttcgcggacgctg

SEQ ID NO: 211364 - DNA, 25 bp, Homo sapien
acggtgggagcagatccatttccgg

SEQ ID NO: 211365 - DNA, 25 bp, Homo sapien
gcagatccatttccgggttggcaaa

SEQ ID NO: 211366 - DNA, 25 bp, Homo sapien
gcagaggattcgctcccagagcagc

SEQ ID NO: 211367 - DNA, 25 bp, Homo sapien
ctgggtcagtcgctgaaatgacctg

SEQ ID NO: 211368 - DNA, 25 bp, Homo sapien
ctgaaatgacctgcggacctgagtg

SEQ ID NO: 211369 - DNA, 25 bp, Homo sapien
gcttccgcctttacgtgggccggca

SEQ ID NO: 211370 - DNA, 25 bp, Homo sapien
gtccaaggtcgacgggcctggccca

SEQ ID NO: 211371 - DNA, 25 bp, Homo sapien
gcctggcccagccataaatcacggc

SEQ ID NO: 211372 - DNA, 25 bp, Homo sapien
gggcctggcccagccataaatcacg

SEQ ID NO: 211373 - DNA, 25 bp, Homo sapien
acgggcctggcccagccataaatca

SEQ ID NO: 211374 - DNA, 25 bp, Homo sapien
gtcgacgggcctggcccagccataa

SEQ ID NO: 211375 - DNA, 25 bp, Homo sapien
ggtcgacgggcctggcccagccata

SEQ ID NO: 211376 - DNA, 25 bp, Homo sapien
aggtcgacgggcctggcccagccat

SEQ ID NO: 211377 - DNA, 25 bp, Homo sapien
ggcctggcccagccataaatcacgg

SEQ ID NO: 211378 - DNA, 25 bp, Homo sapien
gctacaggcggagcgatggtccctg

SEQ ID NO: 211379 - DNA, 25 bp, Homo sapien
tgggcccgctttcgtgtccacgcat

SEQ ID NO: 211380 - DNA, 25 bp, Homo sapien
ctcagcaagtctcggaagagcttcc

SEQ ID NO: 211381 - DNA, 25 bp, Homo sapien
gacggcctcagcaagtctcggaaga

SEQ ID NO: 211382 - DNA, 25 bp, Homo sapien
cgtgtccacgcatcccggccctcct

SEQ ID NO: 211383 - DNA, 25 bp, Homo sapien
tgggatgcagtccagagctcagccc

SEQ ID NO: 211384 - DNA, 25 bp, Homo sapien
ccataaatcacggcggctggaggtg

SEQ ID NO: 211385 - DNA, 25 bp, Homo sapien
gcagacggcctcagcaagtctcgga

SEQ ID NO: 211386 - DNA, 25 bp, Homo sapien
taagacttggggctctctcattggc

SEQ ID NO: 211387 - DNA, 25 bp, Homo sapien
ccaatcagaatcgaggccgggcttt

SEQ ID NO: 211388 - DNA, 25 bp, Homo sapien
gaacgctgtggccattcggatttgg

SEQ ID NO: 211389 - DNA, 25 bp, Homo sapien
tggcctcacagcgactctaagactt

SEQ ID NO: 211390 - DNA, 25 bp, Homo sapien
tggctgtaactcttccactggattg

SEQ ID NO: 211391 - DNA, 25 bp, Homo sapien
gtgcccaaggcgaaaggctctgtga

SEQ ID NO: 211392 - DNA, 25 bp, Homo sapien
ggctctgtgactacagccaatcaga

SEQ ID NO: 211393 - DNA, 25 bp, Homo sapien
aagagtgcgactgcgcggcagcaaa

SEQ ID NO: 211394 - DNA, 25 bp, Homo sapien
cgcaccggcggacggaaatccagac

SEQ ID NO: 211395 - DNA, 25 bp, Homo sapien
ctgagcgcatgtttgcggatgaatc

SEQ ID NO: 211396 - DNA, 25 bp, Homo sapien
gcccagcactgctggggcagtttcc

SEQ ID NO: 211397 - DNA, 25 bp, Homo sapien
actgctggggcagtttcccgtgcgc

SEQ ID NO: 211398 - DNA, 25 bp, Homo sapien
tttgcggatgaatctggacaggaca

SEQ ID NO: 211399 - DNA, 25 bp, Homo sapien
tggcgtccacatctgggagccattg

SEQ ID NO: 211400 - DNA, 25 bp, Homo sapien
cattggcgcattcctgccggctgag

SEQ ID NO: 211401 - DNA, 25 bp, Homo sapien
catctgggagccattggcgcattcc

SEQ ID NO: 211402 - DNA, 25 bp, Homo sapien
cgttcttgctctgaatcttcggttc

SEQ ID NO: 211403 - DNA, 25 bp, Homo sapien
ttcccgaggtctattaaggagaggc

SEQ ID NO: 211404 - DNA, 25 bp, Homo sapien
ggtaaagtttcagcctccgcacgtg

SEQ ID NO: 211405 - DNA, 25 bp, Homo sapien
tccagtcttcaactaggagtggctc

SEQ ID NO: 211406 - DNA, 25 bp, Homo sapien
cggattcccacggtccagtcttcaa

SEQ ID NO: 211407 - DNA, 25 bp, Homo sapien
cgcgctcgagctgttgcagaaccgc

SEQ ID NO: 211408 - DNA, 25 bp, Homo sapien
caccgagcgctattttcattctttc

SEQ ID NO: 211409 - DNA, 25 bp, Homo sapien
cgtgactcgctatggccgctgccat

SEQ ID NO: 211410 - DNA, 25 bp, Homo sapien
ggagccgctgtactctgcctcggac

SEQ ID NO: 211411 - DNA, 25 bp, Homo sapien
atcctcgccacggagaatccctgga

SEQ ID NO: 211412 - DNA, 25 bp, Homo sapien
gcgtaccaccagagaccgagcgagt

SEQ ID NO: 211413 - DNA, 25 bp, Homo sapien
tgtgtactcctcatctggagccttt

SEQ ID NO: 211414 - DNA, 25 bp, Homo sapien
cggcgtccctctgtactctgtgtac

SEQ ID NO: 211415 - DNA, 25 bp, Homo sapien
ttcagcgagagttcagccgcattgc

SEQ ID NO: 211416 - DNA, 25 bp, Homo sapien
tcggacgccacgagactctagacgg

SEQ ID NO: 211417 - DNA, 25 bp, Homo sapien
cagccgcattgcattaggcaaatga

SEQ ID NO: 211418 - DNA, 25 bp, Homo sapien
tgaagcacgtggatgcccgtagttg

SEQ ID NO: 211419 - DNA, 25 bp, Homo sapien
ccgctcccagacgtccaagaatgtg

SEQ ID NO: 211420 - DNA, 25 bp, Homo sapien
ccaagaatgtgaagcacgtggatgc

SEQ ID NO: 211421 - DNA, 25 bp, Homo sapien
aggggccttcttccgctgccgcggt

SEQ ID NO: 211422 - DNA, 25 bp, Homo sapien
ctgccgcggtacacccagagctacc

SEQ ID NO: 211423 - DNA, 25 bp, Homo sapien
cggctgatttcctgctgatctcctc

SEQ ID NO: 211424 - DNA, 25 bp, Homo sapien
ccttgtgcgagcctgcgaacggctc

SEQ ID NO: 211425 - DNA, 25 bp, Homo sapien
tcccagacgtccaagaatgtgaagc

SEQ ID NO: 211426 - DNA, 25 bp, Homo sapien
ccaccgtcagacctcactccctctc

SEQ ID NO: 211427 - DNA, 25 bp, Homo sapien
tctccaccgtcagacctcactccct

SEQ ID NO: 211428 - DNA, 25 bp, Homo sapien
tctccaccgtcagacctcgcaccct

SEQ ID NO: 211429 - DNA, 25 bp, Homo sapien
tccaccgtcagacctcactccctct

SEQ ID NO: 211430 - DNA, 25 bp, Homo sapien
ccaccgtcagacctcgcaccctctc

SEQ ID NO: 211431 - DNA, 25 bp, Homo sapien
tccaccgtcagacctcgcaccctct

SEQ ID NO: 211432 - DNA, 25 bp, Homo sapien
tctctccaccgtcagacctcactcc

SEQ ID NO: 211433 - DNA, 25 bp, Homo sapien
tctctccaccgtcagacctcacacc

SEQ ID NO: 211434 - DNA, 25 bp, Homo sapien
aaacggcgcgccagatcctgcagct

SEQ ID NO: 211435 - DNA, 25 bp, Homo sapien
cctgctgtgcagcatgcaaaccttg

SEQ ID NO: 211436 - DNA, 25 bp, Homo sapien
caaaccttgcttgagtgcccaccga

SEQ ID NO: 211437 - DNA, 25 bp, Homo sapien
tgggtccttgccctcatacggcact

SEQ ID NO: 211438 - DNA, 25 bp, Homo sapien
cgctcgctctttagcctgcggagtc

SEQ ID NO: 211439 - DNA, 25 bp, Homo sapien
ttgtgccgcagctcagcgttcacca

SEQ ID NO: 211440 - DNA, 25 bp, Homo sapien
tcctgcaactgggagcggagcaaag

SEQ ID NO: 211441 - DNA, 25 bp, Homo sapien
gtgacctccttgagctgccgcagca

SEQ ID NO: 211442 - DNA, 25 bp, Homo sapien
cccaccgcgaaatagaagagcacga

SEQ ID NO: 211443 - DNA, 25 bp, Homo sapien
cagcatgaccaccagccagaggcgg

SEQ ID NO: 211444 - DNA, 25 bp, Homo sapien
ccaggatgcggaagatcagcatgac

SEQ ID NO: 211445 - DNA, 25 bp, Homo sapien
gcgtgttgcacacgaactcctcttg

SEQ ID NO: 211446 - DNA, 25 bp, Homo sapien
gccggctcacgaagcagtcgaccgt

SEQ ID NO: 211447 - DNA, 25 bp, Homo sapien
gcgcctcttcgtgtgcacggttgca

SEQ ID NO: 211448 - DNA, 25 bp, Homo sapien
ccctagatggccagatctcggcggc

SEQ ID NO: 211449 - DNA, 25 bp, Homo sapien
catggagtagacgacgaacagcacc

SEQ ID NO: 211450 - DNA, 25 bp, Homo sapien
gccgtacctgcaatggtgacacttc

SEQ ID NO: 211451 - DNA, 25 bp, Homo sapien
cttctccacagacgcgcgtcggtta

SEQ ID NO: 211452 - DNA, 25 bp, Homo sapien
gggccgctgtaacatggatccacta

SEQ ID NO: 211453 - DNA, 25 bp, Homo sapien
gggcaacaacgcacgacaccctgga

SEQ ID NO: 211454 - DNA, 25 bp, Homo sapien
gccgggtcatacttcactactagca

SEQ ID NO: 211455 - DNA, 25 bp, Homo sapien
cccggaaccgggaatggagaatatg

SEQ ID NO: 211456 - DNA, 25 bp, Homo sapien
aatatgggctcccaagccggtcgcc

SEQ ID NO: 211457 - DNA, 25 bp, Homo sapien
cgtctccgtccagaagaaccaatcg

SEQ ID NO: 211458 - DNA, 25 bp, Homo sapien
tgggcgcctgctacagcttccaaac

SEQ ID NO: 211459 - DNA, 25 bp, Homo sapien
gctctgtccaggaagaccggatccg

SEQ ID NO: 211460 - DNA, 25 bp, Homo sapien
cggttcagaggcactctgggcgcct

SEQ ID NO: 211461 - DNA, 25 bp, Homo sapien
tccggggctccggttcagaggcact

SEQ ID NO: 211462 - DNA, 25 bp, Homo sapien
cgagactcctccgaggtcgggaaag

SEQ ID NO: 211463 - DNA, 25 bp, Homo sapien
tccctttctcggtgggagactgagg

SEQ ID NO: 211464 - DNA, 25 bp, Homo sapien
caggaagaccggatccgcagagccg

SEQ ID NO: 211465 - DNA, 25 bp, Homo sapien
tgtccaggaagaccggatccgcaga

SEQ ID NO: 211466 - DNA, 25 bp, Homo sapien
tcaagtgggagcttttggtgtaaac

SEQ ID NO: 211467 - DNA, 25 bp, Homo sapien
ctggtgtgctttcaagtgggagctt

SEQ ID NO: 211468 - DNA, 25 bp, Homo sapien
cttttggtgtaaactttcctgcagc

SEQ ID NO: 211469 - DNA, 25 bp, Homo sapien
ttcctgcagccgttaaagtggcacc

SEQ ID NO: 211470 - DNA, 25 bp, Homo sapien
tgcagccgttaaagtggcaccggtg

SEQ ID NO: 211471 - DNA, 25 bp, Homo sapien
gttaaagtggcaccggtgcaccctc

SEQ ID NO: 211472 - DNA, 25 bp, Homo sapien
ggaggcatcgccatttcccttgtca

SEQ ID NO: 211473 - DNA, 25 bp, Homo sapien
tgtgcgtccgctggtgtgctttcaa

SEQ ID NO: 211474 - DNA, 25 bp, Homo sapien
cacactgatgcacgggcaaggcgtg

SEQ ID NO: 211475 - DNA, 25 bp, Homo sapien
gctgttgcgccacttgcgccctggg

SEQ ID NO: 211476 - DNA, 25 bp, Homo sapien
tgcgccctgggcttggggatgccct

SEQ ID NO: 211477 - DNA, 25 bp, Homo sapien
tggggatgccctgcggggtgtacac

SEQ ID NO: 211478 - DNA, 25 bp, Homo sapien
cctgcacacactgatgcacgggcaa

SEQ ID NO: 211479 - DNA, 25 bp, Homo sapien
gcacacactgatgcacgggcaaggc

SEQ ID NO: 211480 - DNA, 25 bp, Homo sapien
gggcgacgaagccatccactgcccg

SEQ ID NO: 211481 - DNA, 25 bp, Homo sapien
gctgcggctgttgcgccacttgcgc

SEQ ID NO: 211482 - DNA, 25 bp, Homo sapien
tccaagcgcttttagggtgtaatcg

SEQ ID NO: 211483 - DNA, 25 bp, Homo sapien
atcgtcccaggtttctaagccaagg

SEQ ID NO: 211484 - DNA, 25 bp, Homo sapien
acttggaaacactcacccgcgggca

SEQ ID NO: 211485 - DNA, 25 bp, Homo sapien
tccggtcttgctttcctttaggctg

SEQ ID NO: 211486 - DNA, 25 bp, Homo sapien
cctcgcaacagcttgtgtgtccttg

SEQ ID NO: 211487 - DNA, 25 bp, Homo sapien
cacgagttctgcagtttttccaagc

SEQ ID NO: 211488 - DNA, 25 bp, Homo sapien
attttgatactttcccagccgggcg

SEQ ID NO: 211489 - DNA, 25 bp, Homo sapien
tgcttagcacactcagggatttttt

SEQ ID NO: 211490 - DNA, 25 bp, Homo sapien
gtactcagctcgcatattgttcagc

SEQ ID NO: 211491 - DNA, 25 bp, Homo sapien
tctcgataagctcattccgggctga

SEQ ID NO: 211492 - DNA, 25 bp, Homo sapien
gataagctcattccgggctgaggtg

SEQ ID NO: 211493 - DNA, 25 bp, Homo sapien
gcgccagcgtcgtcagagatctgct

SEQ ID NO: 211494 - DNA, 25 bp, Homo sapien
tcgcatattgttcagcagaaccgtg

SEQ ID NO: 211495 - DNA, 25 bp, Homo sapien
gtcgtcagagatctgctgctgcagc

SEQ ID NO: 211496 - DNA, 25 bp, Homo sapien
cgcccgggcgcacccaagcgtggtt

SEQ ID NO: 211497 - DNA, 25 bp, Homo sapien
ttcagcagaaccgtgaggtctaccc

SEQ ID NO: 211498 - DNA, 25 bp, Homo sapien
gcgaaagtggctgcgcctgagtcgt

SEQ ID NO: 211499 - DNA, 25 bp, Homo sapien
gcctcatctcggtgagctggctccg

SEQ ID NO: 211500 - DNA, 25 bp, Homo sapien
cgtgggagatctgttgctgcagcga

SEQ ID NO: 211501 - DNA, 25 bp, Homo sapien
ggggcccacctcaccttctcattga

SEQ ID NO: 211502 - DNA, 25 bp, Homo sapien
gtactccgctcgcatgttgttcaac

SEQ ID NO: 211503 - DNA, 25 bp, Homo sapien
ctccgctcgcatgttgttcaacaaa

SEQ ID NO: 211504 - DNA, 25 bp, Homo sapien
tgttgttcaacaaaaccgcgaggtc

SEQ ID NO: 211505 - DNA, 25 bp, Homo sapien
tgttcaacaaaaccgcgaggtctac

SEQ ID NO: 211506 - DNA, 25 bp, Homo sapien
cggcggtaggtctcaatctccagct

SEQ ID NO: 211507 - DNA, 25 bp, Homo sapien
gcgtccttccgattctgctcagcga

SEQ ID NO: 211508 - DNA, 25 bp, Homo sapien
cgcaggcctttctgtgaatgtatca

SEQ ID NO: 211509 - DNA, 25 bp, Homo sapien
ctcggtgttggtgctaatctcctta

SEQ ID NO: 211510 - DNA, 25 bp, Homo sapien
gtgacctcgctcttgctggactgaa

SEQ ID NO: 211511 - DNA, 25 bp, Homo sapien
gatggtttcatactgcgcccgcata

SEQ ID NO: 211512 - DNA, 25 bp, Homo sapien
ctacgtctgtttgcgcacgagccta

SEQ ID NO: 211513 - DNA, 25 bp, Homo sapien
agctgtgcctccaggttgctgatga

SEQ ID NO: 211514 - DNA, 25 bp, Homo sapien
gtcgttgaggttctgcatggttagc

SEQ ID NO: 211515 - DNA, 25 bp, Homo sapien
gtcgtgtagtagtggctgtagtcgc

SEQ ID NO: 211516 - DNA, 25 bp, Homo sapien
tcccgcaggtcctggatggtcgtgt

SEQ ID NO: 211517 - DNA, 25 bp, Homo sapien
caggtgcactgcacttcccgcggcc

SEQ ID NO: 211518 - DNA, 25 bp, Homo sapien
ttcccacgtcctaacgggctcctgc

SEQ ID NO: 211519 - DNA, 25 bp, Homo sapien
cacctgtggaccttcccacgtccta

SEQ ID NO: 211520 - DNA, 25 bp, Homo sapien
ctgcatggttagcttctcgttgccc

SEQ ID NO: 211521 - DNA, 25 bp, Homo sapien
gatcttcacctctagctcgccgttg

SEQ ID NO: 211522 - DNA, 25 bp, Homo sapien
agccaacctcggctctggacagggc

SEQ ID NO: 211523 - DNA, 25 bp, Homo sapien
ccaggacctcgccaactcggcttca

SEQ ID NO: 211524 - DNA, 25 bp, Homo sapien
ttgtcctcagactgaacatctccct

SEQ ID NO: 211525 - DNA, 25 bp, Homo sapien
tgtccgctttggagccaacctcggc

SEQ ID NO: 211526 - DNA, 25 bp, Homo sapien
tcctttgtccctaggcggggtgcag

SEQ ID NO: 211527 - DNA, 25 bp, Homo sapien
ctaggcggggtgcagcttcctttgt

SEQ ID NO: 211528 - DNA, 25 bp, Homo sapien
cagcttcctttgtcctcagactgaa

SEQ ID NO: 211529 - DNA, 25 bp, Homo sapien
cggtgatgtccgctttggagccaac

SEQ ID NO: 211530 - DNA, 25 bp, Homo sapien
gagcggcgggatagaaaaattcact

SEQ ID NO: 211531 - DNA, 25 bp, Homo sapien
cgggcccacaagaagcgcagcagaa

SEQ ID NO: 211532 - DNA, 25 bp, Homo sapien
ccgggaagtgcgcaacccgagttca

SEQ ID NO: 211533 - DNA, 25 bp, Homo sapien
cccgagttcagcagttgatccagtc

SEQ ID NO: 211534 - DNA, 25 bp, Homo sapien
cgccgaggtgctcagatggattagt

SEQ ID NO: 211535 - DNA, 25 bp, Homo sapien
cggccctcgataaggaaacactccg

SEQ ID NO: 211536 - DNA, 25 bp, Homo sapien
ttagagttgcacactgcgccgagga

SEQ ID NO: 211537 - DNA, 25 bp, Homo sapien
acagacctcagcgtgtgatgggctc

SEQ ID NO: 211538 - DNA, 25 bp, Homo sapien
agggtaaagtccgtgtgcacacctg

SEQ ID NO: 211539 - DNA, 25 bp, Homo sapien
gatgtgcgtccaggcgtgccttgca

SEQ ID NO: 211540 - DNA, 25 bp, Homo sapien
tctccctcctgtcaactcctgagga

SEQ ID NO: 211541 - DNA, 25 bp, Homo sapien
ttcccacgcggggtgtgacaccaac

SEQ ID NO: 211542 - DNA, 25 bp, Homo sapien
gtgtgacaccaacgggggacataat

SEQ ID NO: 211543 - DNA, 25 bp, Homo sapien
cgaacgagggtaaagtccgtgtgca

SEQ ID NO: 211544 - DNA, 25 bp, Homo sapien
tgcacacctgtgcatggccacatgc

SEQ ID NO: 211545 - DNA, 25 bp, Homo sapien
gccacatgcggatgtgcgtccaggc

SEQ ID NO: 211546 - DNA, 25 bp, Homo sapien
acctaaagggagaaggcgcgatctg

SEQ ID NO: 211547 - DNA, 25 bp, Homo sapien
agacctaaagggagaaggcgcgatc

SEQ ID NO: 211548 - DNA, 25 bp, Homo sapien
catcgcagccagaccggcttgccca

SEQ ID NO: 211549 - DNA, 25 bp, Homo sapien
ttgcccactgcgcagcaaggcggag

SEQ ID NO: 211550 - DNA, 25 bp, Homo sapien
tgcccactgcgcagcaaggcggagc

SEQ ID NO: 211551 - DNA, 25 bp, Homo sapien
cccgcacagctaagcccgggcgtgg

SEQ ID NO: 211552 - DNA, 25 bp, Homo sapien
gggcgtggtgctcgcggcgccctct

SEQ ID NO: 211553 - DNA, 25 bp, Homo sapien
gaccagacctaaagggagaaggcgc

SEQ ID NO: 211554 - DNA, 25 bp, Homo sapien
ggccgctcccatttcggatcccaga

SEQ ID NO: 211555 - DNA, 25 bp, Homo sapien
catccccgtttcagtgcggccgctc

SEQ ID NO: 211556 - DNA, 25 bp, Homo sapien
ccaaggacgccccacggagcactcc

SEQ ID NO: 211557 - DNA, 25 bp, Homo sapien
gctggcggcttccaggaagcgcgcc

SEQ ID NO: 211558 - DNA, 25 bp, Homo sapien
ctctgctggcggcttccaggaagcg

SEQ ID NO: 211559 - DNA, 25 bp, Homo sapien
ccgctcccatttcggatcccagagg

SEQ ID NO: 211560 - DNA, 25 bp, Homo sapien
gagatcggagagaagcccggccgcg

SEQ ID NO: 211561 - DNA, 25 bp, Homo sapien
tctgctggcggcttccaggaagcgc

SEQ ID NO: 211562 - DNA, 25 bp, Homo sapien
cggcgtctcagtggcgcatttacta

SEQ ID NO: 211563 - DNA, 25 bp, Homo sapien
tccaccgaggaaaaggaatcgtatc

SEQ ID NO: 211564 - DNA, 25 bp, Homo sapien
aggctccgagacagatcaagctttc

SEQ ID NO: 211565 - DNA, 25 bp, Homo sapien
tcctagagtcaagaggacgccctcc

SEQ ID NO: 211566 - DNA, 25 bp, Homo sapien
cagaggcgcggctatataactaaac

SEQ ID NO: 211567 - DNA, 25 bp, Homo sapien
tcgtatcgtatgtccgctatccaga

SEQ ID NO: 211568 - DNA, 25 bp, Homo sapien
cgtcaccattgcgtcacgtccgtta

SEQ ID NO: 211569 - DNA, 25 bp, Homo sapien
caaaccaattggaagcggcgccgcc

SEQ ID NO: 211570 - DNA, 25 bp, Homo sapien
cgggacctttataacctgcgccagc

SEQ ID NO: 211571 - DNA, 25 bp, Homo sapien
tcgggatcctactctctgtccagtg

SEQ ID NO: 211572 - DNA, 25 bp, Homo sapien
cttccgagaggaactgggatccaga

SEQ ID NO: 211573 - DNA, 25 bp, Homo sapien
ttgtcgggcatagaccggacatccc

SEQ ID NO: 211574 - DNA, 25 bp, Homo sapien
ctcccgaataaaggcggcgcgctca

SEQ ID NO: 211575 - DNA, 25 bp, Homo sapien
ggcgaccagacagacaccgcagtga

SEQ ID NO: 211576 - DNA, 25 bp, Homo sapien
tccggagaatggttctgcccaaagc

SEQ ID NO: 211577 - DNA, 25 bp, Homo sapien
agcaactagtggcaagcgggactca

SEQ ID NO: 211578 - DNA, 25 bp, Homo sapien
cctcgttgcgggagtgcagcaactc

SEQ ID NO: 211579 - DNA, 25 bp, Homo sapien
gcagcaactccatgagtggggccga

SEQ ID NO: 211580 - DNA, 25 bp, Homo sapien
cggacacgcgcttccggtagtctgg

SEQ ID NO: 211581 - DNA, 25 bp, Homo sapien
tagtctgggttcttgtcctcggaga

SEQ ID NO: 211582 - DNA, 25 bp, Homo sapien
gccaggttaaacgtcggccagcctc

SEQ ID NO: 211583 - DNA, 25 bp, Homo sapien
taaacgtcggccagcctccatcgtg

SEQ ID NO: 211584 - DNA, 25 bp, Homo sapien
ctcaccagtgccctcgttgcgggag

SEQ ID NO: 211585 - DNA, 25 bp, Homo sapien
acgcgctggatgttctccaccgacg

SEQ ID NO: 211586 - DNA, 25 bp, Homo sapien
gcctctgtttatccgcttgccattg

SEQ ID NO: 211587 - DNA, 25 bp, Homo sapien
ccgcaggtagtatcgacgaggctct

SEQ ID NO: 211588 - DNA, 25 bp, Homo sapien
ctatctcgcctgactgtcccgtgga

SEQ ID NO: 211589 - DNA, 25 bp, Homo sapien
tggccaaggcagcaactcagtaacc

SEQ ID NO: 211590 - DNA, 25 bp, Homo sapien
tcagatctctggttcgcggagctcc

SEQ ID NO: 211591 - DNA, 25 bp, Homo sapien
cgcagtcgaagcagagcaaagtctc

SEQ ID NO: 211592 - DNA, 25 bp, Homo sapien
aaacggtaaattcctgactgcagcg

SEQ ID NO: 211593 - DNA, 25 bp, Homo sapien
ccaaagagaccagcggcagcaagtt

SEQ ID NO: 211594 - DNA, 25 bp, Homo sapien
acagcgcgtagtgcaggtactggta

SEQ ID NO: 211595 - DNA, 25 bp, Homo sapien
agtgtcgttaagtcctctccgtcgg

SEQ ID NO: 211596 - DNA, 25 bp, Homo sapien
ttttcccagagggtccgatagtgtc

SEQ ID NO: 211597 - DNA, 25 bp, Homo sapien
ctctggaagtcacgcagcagctgcc

SEQ ID NO: 211598 - DNA, 25 bp, Homo sapien
gggctcccaccttgaacagcgcgta

SEQ ID NO: 211599 - DNA, 25 bp, Homo sapien
taacgctccttcgaccgatctgtgg

SEQ ID NO: 211600 - DNA, 25 bp, Homo sapien
gtgccttgggtgaagataacgctcc

SEQ ID NO: 211601 - DNA, 25 bp, Homo sapien
cggaagctgtacttctcgtactgcg

SEQ ID NO: 211602 - DNA, 25 bp, Homo sapien
aggcccaatgggcaggaagcctctc

SEQ ID NO: 211603 - DNA, 25 bp, Homo sapien
cagaggtacctgtaaccggtctccg

SEQ ID NO: 211604 - DNA, 25 bp, Homo sapien
ccaggctgccgcatcaggaccgtgg

SEQ ID NO: 211605 - DNA, 25 bp, Homo sapien
cgcatcaggaccgtggccttcatca

SEQ ID NO: 211606 - DNA, 25 bp, Homo sapien
cgtggccttcatcagggtgctcacc

SEQ ID NO: 211607 - DNA, 25 bp, Homo sapien
tcagggtgctcacctgtcccgagac

SEQ ID NO: 211608 - DNA, 25 bp, Homo sapien
tctgccatcccgttcgaggcctggt

SEQ ID NO: 211609 - DNA, 25 bp, Homo sapien
tcccgagacccgagagaaccactga

SEQ ID NO: 211610 - DNA, 25 bp, Homo sapien
tgccgccaggacagctctgagcagt

SEQ ID NO: 211611 - DNA, 25 bp, Homo sapien
gcgctcagcgagtgtgaaaccaatg

SEQ ID NO: 211612 - DNA, 25 bp, Homo sapien
cgcccggtgtacatgtactcgatta

SEQ ID NO: 211613 - DNA, 25 bp, Homo sapien
cccgccgaagcacagggtaatgtcg

SEQ ID NO: 211614 - DNA, 25 bp, Homo sapien
tgcactcgaaatcctcggcttctgg

SEQ ID NO: 211615 - DNA, 25 bp, Homo sapien
aacgatgcggctgttggtacgacac

SEQ ID NO: 211616 - DNA, 25 bp, Homo sapien
gtccgtcagtaacagtcgcccagtc

SEQ ID NO: 211617 - DNA, 25 bp, Homo sapien
actcgattacggcttccactgtgtc

SEQ ID NO: 211618 - DNA, 25 bp, Homo sapien
gcgattggccacacgcgttccctag

SEQ ID NO: 211619 - DNA, 25 bp, Homo sapien
gtgctcacctctgccgaagtccgtg

SEQ ID NO: 211620 - DNA, 25 bp, Homo sapien
tcaaaacttccgagcagggcgcgtg

SEQ ID NO: 211621 - DNA, 25 bp, Homo sapien
tgggcgtggagctcaattttgtacc

SEQ ID NO: 211622 - DNA, 25 bp, Homo sapien
ggaggcgcgcatagctcattctctc

SEQ ID NO: 211623 - DNA, 25 bp, Homo sapien
tccttgctgcgagattccagtcctc

SEQ ID NO: 211624 - DNA, 25 bp, Homo sapien
ggactcgacgatacctccagtgcga

SEQ ID NO: 211625 - DNA, 25 bp, Homo sapien
ccggccagacttggcgtcagctcaa

SEQ ID NO: 211626 - DNA, 25 bp, Homo sapien
tcctgaagcgctggagttgcagacc

SEQ ID NO: 211627 - DNA, 25 bp, Homo sapien
agaggttccaccactgccagcggtc

SEQ ID NO: 211628 - DNA, 25 bp, Homo sapien
cctttgggatcagcaggaacttttc

SEQ ID NO: 211629 - DNA, 25 bp, Homo sapien
tggccaccgattgcgtcttgctcca

SEQ ID NO: 211630 - DNA, 25 bp, Homo sapien
gatgttcgccaataggggtcctccc

SEQ ID NO: 211631 - DNA, 25 bp, Homo sapien
gggtctccagtctaacctcaactga

SEQ ID NO: 211632 - DNA, 25 bp, Homo sapien
cagaggctagcgcagcccactcgta

SEQ ID NO: 211633 - DNA, 25 bp, Homo sapien
tttcacctgctgagcgtcatcacca

SEQ ID NO: 211634 - DNA, 25 bp, Homo sapien
gccgcgcagagcttcagcaacgtga

SEQ ID NO: 211635 - DNA, 25 bp, Homo sapien
acgccggcaggttgtacccagaatc

SEQ ID NO: 211636 - DNA, 25 bp, Homo sapien
ccggaagtcgctgtacatctcatgg

SEQ ID NO: 211637 - DNA, 25 bp, Homo sapien
cggagcttccacaaaccagatagag

SEQ ID NO: 211638 - DNA, 25 bp, Homo sapien
ccagatagaggttctccagcttttc

SEQ ID NO: 211639 - DNA, 25 bp, Homo sapien
ttccctcttatatggccgaaggcga

SEQ ID NO: 211640 - DNA, 25 bp, Homo sapien
aggcgagaccttgcgaagcaccttt

SEQ ID NO: 211641 - DNA, 25 bp, Homo sapien
agcgtctctaaatccggtcaccatg

SEQ ID NO: 211642 - DNA, 25 bp, Homo sapien
tagaagaaagctggagtgcccgacc

SEQ ID NO: 211643 - DNA, 25 bp, Homo sapien
ctactggccaagctagtcacccggg

SEQ ID NO: 211644 - DNA, 25 bp, Homo sapien
agaccacttaccagcagagccaatg

SEQ ID NO: 211645 - DNA, 25 bp, Homo sapien
tggccagaatagcttccgagtcagc

SEQ ID NO: 211646 - DNA, 25 bp, Homo sapien
gtgaccctctggaacggttgccatg

SEQ ID NO: 211647 - DNA, 25 bp, Homo sapien
tgcggacagcccagaagactgcgct

SEQ ID NO: 211648 - DNA, 25 bp, Homo sapien
tactcgccgtgtacgcagctggcgc

SEQ ID NO: 211649 - DNA, 25 bp, Homo sapien
cctccgggaatggaggagtctcgca

SEQ ID NO: 211650 - DNA, 25 bp, Homo sapien
ctcctcatcatggtgagaggccggg

SEQ ID NO: 211651 - DNA, 25 bp, Homo sapien
aggaagcgtcttgcaaacgaggacc

SEQ ID NO: 211652 - DNA, 25 bp, Homo sapien
agcgtcttgcaaacgaggacccggg

SEQ ID NO: 211653 - DNA, 25 bp, Homo sapien
ccgggcccagtctcatcacgcggaa

SEQ ID NO: 211654 - DNA, 25 bp, Homo sapien
aactcgggaccgcagaagctgctgc

SEQ ID NO: 211655 - DNA, 25 bp, Homo sapien
gttttggttcgcagcgcctgcgcgc

SEQ ID NO: 211656 - DNA, 25 bp, Homo sapien
cggtggtgtttctcaggagggaact

SEQ ID NO: 211657 - DNA, 25 bp, Homo sapien
ttccagttttcttggtactcagggc

SEQ ID NO: 211658 - DNA, 25 bp, Homo sapien
ttacctttccgaagtggcaggaatg

SEQ ID NO: 211659 - DNA, 25 bp, Homo sapien
ggaaggcacccacaaccagtctagg

SEQ ID NO: 211660 - DNA, 25 bp, Homo sapien
aagggaaagaaggtccagcactgcc

SEQ ID NO: 211661 - DNA, 25 bp, Homo sapien
cttaggagagcttcagacaagcttc

SEQ ID NO: 211662 - DNA, 25 bp, Homo sapien
ccagcacgtttacctttccgaagtg

SEQ ID NO: 211663 - DNA, 25 bp, Homo sapien
gcatgcctccagcacgtttaccttt

SEQ ID NO: 211664 - DNA, 25 bp, Homo sapien
ccacaaccagtctagggactagggg

SEQ ID NO: 211665 - DNA, 25 bp, Homo sapien
tcctccacgaccagaagcggaaagg

SEQ ID NO: 211666 - DNA, 25 bp, Homo sapien
ggtgtcggctgacgcttacaagatc

SEQ ID NO: 211667 - DNA, 25 bp, Homo sapien
gacaagtaccgtgatggcaccaaga

SEQ ID NO: 211668 - DNA, 25 bp, Homo sapien
cttctccgaggagtacaagcggctc

SEQ ID NO: 211669 - DNA, 25 bp, Homo sapien
tacaagcggctcgatgaggacctgg

SEQ ID NO: 211670 - DNA, 25 bp, Homo sapien
gcaagtccacgctggcacgggtcat

SEQ ID NO: 211671 - DNA, 25 bp, Homo sapien
gccgccgggacatcagaattcttgt

SEQ ID NO: 211672 - DNA, 25 bp, Homo sapien
cagaattcttgtgcttgatgacacc

SEQ ID NO: 211673 - DNA, 25 bp, Homo sapien
ttgatgacaccaaccacgaacggga

SEQ ID NO: 211674 - DNA, 25 bp, Homo sapien
ctcggcctctcctataaggacgatc

SEQ ID NO: 211675 - DNA, 25 bp, Homo sapien
cgtctaccagagagaggctccgctt

SEQ ID NO: 211676 - DNA, 25 bp, Homo sapien
agagcacttccggttggagcataga

SEQ ID NO: 211677 - DNA, 25 bp, Homo sapien
ctcttcgcctcttggtcgtcgagca

SEQ ID NO: 211678 - DNA, 25 bp, Homo sapien
aacgagtttccctgagccacggagc

SEQ ID NO: 211679 - DNA, 25 bp, Homo sapien
ggtccatccggccttgatctcagat

SEQ ID NO: 211680 - DNA, 25 bp, Homo sapien
ggacgatcgtcctctcagctggaga

SEQ ID NO: 211681 - DNA, 25 bp, Homo sapien
agacctctgaaattgccctcggaga

SEQ ID NO: 211682 - DNA, 25 bp, Homo sapien
aggccaggtcctggccgtcattctc

SEQ ID NO: 211683 - DNA, 25 bp, Homo sapien
gctcgtccggcgctaggatcggcct

SEQ ID NO: 211684 - DNA, 25 bp, Homo sapien
ccgcgtccagggagtctagaacctt

SEQ ID NO: 211685 - DNA, 25 bp, Homo sapien
gtctagaaccttgggctcccgcgca

SEQ ID NO: 211686 - DNA, 25 bp, Homo sapien
attcgtcttgcctgacggaagctgg

SEQ ID NO: 211687 - DNA, 25 bp, Homo sapien
gcctggaggagcctacaccgactct

SEQ ID NO: 211688 - DNA, 25 bp, Homo sapien
gaggagcctacaccgactctggagg

SEQ ID NO: 211689 - DNA, 25 bp, Homo sapien
tctccgctgccggaattcgtcttgc

SEQ ID NO: 211690 - DNA, 25 bp, Homo sapien
cgtcagggtccatggatgccagttc

SEQ ID NO: 211691 - DNA, 25 bp, Homo sapien
aggccgaatactacgcgcttaaaca

SEQ ID NO: 211692 - DNA, 25 bp, Homo sapien
ttaaacagcgcgaagtcgcccagcg

SEQ ID NO: 211693 - DNA, 25 bp, Homo sapien
tcgaagatcgctgcgaaggcggcca

SEQ ID NO: 211694 - DNA, 25 bp, Homo sapien
aggagtcctgtaggcccttccgcat

SEQ ID NO: 211695 - DNA, 25 bp, Homo sapien
ggcccttccgcatggagtccaggaa

SEQ ID NO: 211696 - DNA, 25 bp, Homo sapien
accgcagcctcggagtaaccgagca

SEQ ID NO: 211697 - DNA, 25 bp, Homo sapien
catccactgcgatcttcaccatgtg

SEQ ID NO: 211698 - DNA, 25 bp, Homo sapien
agagcgctccggacaaacccggctg

SEQ ID NO: 211699 - DNA, 25 bp, Homo sapien
tcccggtcaccaggcaagaagggtc

SEQ ID NO: 211700 - DNA, 25 bp, Homo sapien
gttctttcccggtcaccaggcaaga

SEQ ID NO: 211701 - DNA, 25 bp, Homo sapien
actcggaggctctcctggctgaaga

SEQ ID NO: 211702 - DNA, 25 bp, Homo sapien
gccctgcagaaccacctaagtgctg

SEQ ID NO: 211703 - DNA, 25 bp, Homo sapien
cacctaagtgctgagcacgcggcgg

SEQ ID NO: 211704 - DNA, 25 bp, Homo sapien
aggcaagaagggtctccgccgctgc

SEQ ID NO: 211705 - DNA, 25 bp, Homo sapien
gcctacctggagagcgctccggaca

SEQ ID NO: 211706 - DNA, 25 bp, Homo sapien
cgtcgccgtcttacctgcggggcag

SEQ ID NO: 211707 - DNA, 25 bp, Homo sapien
cgctcagagccgagatagggatatc

SEQ ID NO: 211708 - DNA, 25 bp, Homo sapien
tcagagccgagatagggatatcctc

SEQ ID NO: 211709 - DNA, 25 bp, Homo sapien
ccgagatagggatatcctcactgtc

SEQ ID NO: 211710 - DNA, 25 bp, Homo sapien
atatcctcactgtcccttggggtcc

SEQ ID NO: 211711 - DNA, 25 bp, Homo sapien
ccccaattttgaggcgagaggaccg

SEQ ID NO: 211712 - DNA, 25 bp, Homo sapien
tgccctcgaggtcctcggcgtggac

SEQ ID NO: 211713 - DNA, 25 bp, Homo sapien
ggaagaggctgcctcgttctcccgc

SEQ ID NO: 211714 - DNA, 25 bp, Homo sapien
tgtcatggatgagcagcgcgtcatt

SEQ ID NO: 211715 - DNA, 25 bp, Homo sapien
gatctgggttttagtgacgtgctcc

SEQ ID NO: 211716 - DNA, 25 bp, Homo sapien
tgacgtgctccctgtgatagaaatc

SEQ ID NO: 211717 - DNA, 25 bp, Homo sapien
agccaaggcatccacggcgcggacg

SEQ ID NO: 211718 - DNA, 25 bp, Homo sapien
tcattgtagcgcctcaggtgaagcg

SEQ ID NO: 211719 - DNA, 25 bp, Homo sapien
gaagcgcatacacccgttgctcctg

SEQ ID NO: 211720 - DNA, 25 bp, Homo sapien
gttgctcctgaagcccagccaaagc

SEQ ID NO: 211721 - DNA, 25 bp, Homo sapien
tgtgatagaaatcctgcagcgcagc

SEQ ID NO: 211722 - DNA, 25 bp, Homo sapien
ggtccgtgtagttctcagcctgaca

SEQ ID NO: 211723 - DNA, 25 bp, Homo sapien
gcggaattgcacgaagccacgccca

SEQ ID NO: 211724 - DNA, 25 bp, Homo sapien
gcgctacgtcaaacgagagtcctaa

SEQ ID NO: 211725 - DNA, 25 bp, Homo sapien
tttgcaatgcatgctggtccgtgta

SEQ ID NO: 211726 - DNA, 25 bp, Homo sapien
cgcgctctgtgagttggcattttta

SEQ ID NO: 211727 - DNA, 25 bp, Homo sapien
tttaaactgagctcggaatccagcc

SEQ ID NO: 211728 - DNA, 25 bp, Homo sapien
tctgattggcaaggaggccaccctt

SEQ ID NO: 211729 - DNA, 25 bp, Homo sapien
aaagccacggcgtctgcgtttgcaa

SEQ ID NO: 211730 - DNA, 25 bp, Homo sapien
agcagatcgcagctggtgaagcgcc

SEQ ID NO: 211731 - DNA, 25 bp, Homo sapien
cgcagctggtgaagcgccgcagcca

SEQ ID NO: 211732 - DNA, 25 bp, Homo sapien
gacgcttacaggtcggtgccgagcc

SEQ ID NO: 211733 - DNA, 25 bp, Homo sapien
cttacaggtcggtgccgagccgcgt

SEQ ID NO: 211734 - DNA, 25 bp, Homo sapien
ctatccggcgccagagcagatcgca

SEQ ID NO: 211735 - DNA, 25 bp, Homo sapien
tccggcgccagagcagatcgcagct

SEQ ID NO: 211736 - DNA, 25 bp, Homo sapien
cagagcagatcgcagctggtgaagc

SEQ ID NO: 211737 - DNA, 25 bp, Homo sapien
cgccagagcagatcgcagctggtga

SEQ ID NO: 211738 - DNA, 25 bp, Homo sapien
acatggaactcgatgatgccgcggc

SEQ ID NO: 211739 - DNA, 25 bp, Homo sapien
catcccgggccgcattggccgaaag

SEQ ID NO: 211740 - DNA, 25 bp, Homo sapien
acgaggcgggcgatatactccttag

SEQ ID NO: 211741 - DNA, 25 bp, Homo sapien
atactccttaggcatgcgcggcagc

SEQ ID NO: 211742 - DNA, 25 bp, Homo sapien
cagctggtgggaaaagacattctgc

SEQ ID NO: 211743 - DNA, 25 bp, Homo sapien
ccttgggcgtcagtgagttgccgat

SEQ ID NO: 211744 - DNA, 25 bp, Homo sapien
gccgcattggccgaaagcaggctcg

SEQ ID NO: 211745 - DNA, 25 bp, Homo sapien
cagtgagttgccgatgacatggaac

SEQ ID NO: 211746 - DNA, 25 bp, Homo sapien
tcggatgcagagagtcggtaacacc

SEQ ID NO: 211747 - DNA, 25 bp, Homo sapien
cgcgccctttgacagcagttagttg

SEQ ID NO: 211748 - DNA, 25 bp, Homo sapien
ggatccagttccttcacagctgcgg

SEQ ID NO: 211749 - DNA, 25 bp, Homo sapien
cggctcaggaggacaatgaccatgc

SEQ ID NO: 211750 - DNA, 25 bp, Homo sapien
ccatgccagagacggtttccaaatg

SEQ ID NO: 211751 - DNA, 25 bp, Homo sapien
ggtcagttaccgcatgtcacagaag

SEQ ID NO: 211752 - DNA, 25 bp, Homo sapien
aggtgcaccggaaaatgctcccgtc

SEQ ID NO: 211753 - DNA, 25 bp, Homo sapien
accggacagcagcaactggacgtca

SEQ ID NO: 211754 - DNA, 25 bp, Homo sapien
acttgtagttcgcagcgctgggagg

SEQ ID NO: 211755 - DNA, 25 bp, Homo sapien
caggctccggcctccacttccgcct

SEQ ID NO: 211756 - DNA, 25 bp, Homo sapien
ctttcagccgctccggatccggatc

SEQ ID NO: 211757 - DNA, 25 bp, Homo sapien
cctcaatactcccaggtgattgaca

SEQ ID NO: 211758 - DNA, 25 bp, Homo sapien
cccaggtgattgacagtgcggagac

SEQ ID NO: 211759 - DNA, 25 bp, Homo sapien
gcggagaccaatgggaggcactctt

SEQ ID NO: 211760 - DNA, 25 bp, Homo sapien
gcactcttggccgacctacccagcg

SEQ ID NO: 211761 - DNA, 25 bp, Homo sapien
ctacccagcggcgccggtaggaacg

SEQ ID NO: 211762 - DNA, 25 bp, Homo sapien
cctgttcctgcaccgcggctttggg

SEQ ID NO: 211763 - DNA, 25 bp, Homo sapien
tccttgtggctccacctcgcgggtt

SEQ ID NO: 211764 - DNA, 25 bp, Homo sapien
tctgccgcacaaagagcctcttctg

SEQ ID NO: 211765 - DNA, 25 bp, Homo sapien
ggctttgggagttcctagacccgca

SEQ ID NO: 211766 - DNA, 25 bp, Homo sapien
atgtccaggagatccgagacggccc

SEQ ID NO: 211767 - DNA, 25 bp, Homo sapien
ccacgcgtgtctctcggggagagaa

SEQ ID NO: 211768 - DNA, 25 bp, Homo sapien
gcttgaataacagacccgccctctt

SEQ ID NO: 211769 - DNA, 25 bp, Homo sapien
ctcgggtctcaccatgtccaggaga

SEQ ID NO: 211770 - DNA, 25 bp, Homo sapien
gtcttttgacgacagcagtcgggca

SEQ ID NO: 211771 - DNA, 25 bp, Homo sapien
caaaagctaaggctggtgcccgaca

SEQ ID NO: 211772 - DNA, 25 bp, Homo sapien
gaggcggcaagagcaagtcttttga

SEQ ID NO: 211773 - DNA, 25 bp, Homo sapien
cagggcccgaagaacgactcagatc

SEQ ID NO: 211774 - DNA, 25 bp, Homo sapien
tggagactcgtctttattgcctttt

SEQ ID NO: 211775 - DNA, 25 bp, Homo sapien
cagagaccagtcacacgaatggaga

SEQ ID NO: 211776 - DNA, 25 bp, Homo sapien
ggacgcgaccgcacaggaacagaga

SEQ ID NO: 211777 - DNA, 25 bp, Homo sapien
agctgtcctccgcaagacgctttgc

SEQ ID NO: 211778 - DNA, 25 bp, Homo sapien
atgggcacggcaggaattcacattc

SEQ ID NO: 211779 - DNA, 25 bp, Homo sapien
cgatcaataattatcctgggtttgc

SEQ ID NO: 211780 - DNA, 25 bp, Homo sapien
gcgcactgtcgtggtcgttttggtt

SEQ ID NO: 211781 - DNA, 25 bp, Homo sapien
ggtcgaccaccactagcagggctag

SEQ ID NO: 211782 - DNA, 25 bp, Homo sapien
tgctttgtttgggttgggtcgacca

SEQ ID NO: 211783 - DNA, 25 bp, Homo sapien
gcacatgctgctttgtttgggttgg

SEQ ID NO: 211784 - DNA, 25 bp, Homo sapien
gacgccgcaccgcaagcacatgctg

SEQ ID NO: 211785 - DNA, 25 bp, Homo sapien
ggaattcacattcgcccaggccgaa

SEQ ID NO: 211786 - DNA, 25 bp, Homo sapien
ttcctgtagtaacagccgccgctgc

SEQ ID NO: 211787 - DNA, 25 bp, Homo sapien
cgcgcgctgtgtatggtctatcgca

SEQ ID NO: 211788 - DNA, 25 bp, Homo sapien
cccggggaggcactagtgcacagat

SEQ ID NO: 211789 - DNA, 25 bp, Homo sapien
aaagccctagccgtcgagtgggagc

SEQ ID NO: 211790 - DNA, 25 bp, Homo sapien
ccgagaggggacactctactgccgc

SEQ ID NO: 211791 - DNA, 25 bp, Homo sapien
tggtctatcgcaggcagctgacctt

SEQ ID NO: 211792 - DNA, 25 bp, Homo sapien
gaacggccgccgctgttgcgcactt

SEQ ID NO: 211793 - DNA, 25 bp, Homo sapien
tgacctttgaggaggaaatcgctgc

SEQ ID NO: 211794 - DNA, 25 bp, Homo sapien
ttccctgcattatcaccgctggctg

SEQ ID NO: 211795 - DNA, 25 bp, Homo sapien
ggcccggcgccaagatgcttctcaa

SEQ ID NO: 211796 - DNA, 25 bp, Homo sapien
ctgcgctgttttcagctggctgccg

SEQ ID NO: 211797 - DNA, 25 bp, Homo sapien
ggcaggttccttctgagctcagagc

SEQ ID NO: 211798 - DNA, 25 bp, Homo sapien
ggggctaatctgatccatctctgcg

SEQ ID NO: 211799 - DNA, 25 bp, Homo sapien
atccatctctgcgagggaaggtgct

SEQ ID NO: 211800 - DNA, 25 bp, Homo sapien
ggaaggtgctcgctcgtagctccca

SEQ ID NO: 211801 - DNA, 25 bp, Homo sapien
agatgcttctcaaccctcggggcca

SEQ ID NO: 211802 - DNA, 25 bp, Homo sapien
cgcccactgaccaatgaggagagca

SEQ ID NO: 211803 - DNA, 25 bp, Homo sapien
tcacctgtttctccggcagaggccg

SEQ ID NO: 211804 - DNA, 25 bp, Homo sapien
cgcagctccggaaaccgctgaatta

SEQ ID NO: 211805 - DNA, 25 bp, Homo sapien
ccgaggcacgccgtcatgcataatt

SEQ ID NO: 211806 - DNA, 25 bp, Homo sapien
ttcatgaaaggccagctcgttcggc

SEQ ID NO: 211807 - DNA, 25 bp, Homo sapien
ctgttccgacagttcggtgctcctc

SEQ ID NO: 211808 - DNA, 25 bp, Homo sapien
cggagccaagaggagactgatacgc

SEQ ID NO: 211809 - DNA, 25 bp, Homo sapien
cgctcctgtcatcccgaagagtctt

SEQ ID NO: 211810 - DNA, 25 bp, Homo sapien
caccatctcggtggccttgagcact

SEQ ID NO: 211811 - DNA, 25 bp, Homo sapien
tgatgctcagtttggccggcagctt

SEQ ID NO: 211812 - DNA, 25 bp, Homo sapien
gctctgcgcgggactcctcaataac

SEQ ID NO: 211813 - DNA, 25 bp, Homo sapien
ggtacgcaccttggtcttctccatc

SEQ ID NO: 211814 - DNA, 25 bp, Homo sapien
cgtgcccagcttgttcatgcgcttc

SEQ ID NO: 211815 - DNA, 25 bp, Homo sapien
tgtcccgcgacgtcttcagtttctc

SEQ ID NO: 211816 - DNA, 25 bp, Homo sapien
tggcaccttgtagaccgcggtcttg

SEQ ID NO: 211817 - DNA, 25 bp, Homo sapien
ggcagcttcacttcatcctaaggga

SEQ ID NO: 211818 - DNA, 25 bp, Homo sapien
tgcagcgaatggctgcgcacccggc

SEQ ID NO: 211819 - DNA, 25 bp, Homo sapien
ccgctaaccatgcagcgaatggctg

SEQ ID NO: 211820 - DNA, 25 bp, Homo sapien
gagcggccgctaaccatgcagcgaa

SEQ ID NO: 211821 - DNA, 25 bp, Homo sapien
ggtctccgagccacctactgtgtgt

SEQ ID NO: 211822 - DNA, 25 bp, Homo sapien
ccgccggctacgcagtggtctccga

SEQ ID NO: 211823 - DNA, 25 bp, Homo sapien
ccgaccgcctggagcgcccgagtct

SEQ ID NO: 211824 - DNA, 25 bp, Homo sapien
cgcaccgaatcgctgtgcgccgctg

SEQ ID NO: 211825 - DNA, 25 bp, Homo sapien
gtcccgtggaacgtcgtgctcgccg

SEQ ID NO: 211826 - DNA, 25 bp, Homo sapien
gccctgcttgccctagtcttttacg

SEQ ID NO: 211827 - DNA, 25 bp, Homo sapien
ctcgcttcatgcaggaggttgccgc

SEQ ID NO: 211828 - DNA, 25 bp, Homo sapien
tgccgcccagaattatcgcaacctg

SEQ ID NO: 211829 - DNA, 25 bp, Homo sapien
tatggttgctccttcctgccagtgg

SEQ ID NO: 211830 - DNA, 25 bp, Homo sapien
cagttctccctacatgacgtggtca

SEQ ID NO: 211831 - DNA, 25 bp, Homo sapien
attctcttccgcgtgctgagggcta

SEQ ID NO: 211832 - DNA, 25 bp, Homo sapien
tggggccctgtctttgtatcacatc

SEQ ID NO: 211833 - DNA, 25 bp, Homo sapien
ggcgccatgcataccacacttacgg

SEQ ID NO: 211834 - DNA, 25 bp, Homo sapien
ttgcacttgggctaaaatctctgtg

SEQ ID NO: 211835 - DNA, 25 bp, Homo sapien
ccactttggaaatgggcggagcgcc

SEQ ID NO: 211836 - DNA, 25 bp, Homo sapien
cctcgggagacacagctccactttg

SEQ ID NO: 211837 - DNA, 25 bp, Homo sapien
tgatattaaaccactacggccctcg

SEQ ID NO: 211838 - DNA, 25 bp, Homo sapien
gatccctttccacccgtagatgata

SEQ ID NO: 211839 - DNA, 25 bp, Homo sapien
atctctgtggtcgtccaaccctgtc

SEQ ID NO: 211840 - DNA, 25 bp, Homo sapien
ctctggtgccgcaaatcgcacactg

SEQ ID NO: 211841 - DNA, 25 bp, Homo sapien
tggtgactaaacagaccgcgggagc

SEQ ID NO: 211842 - DNA, 25 bp, Homo sapien
ccgctaattcggttctgctacaagt

SEQ ID NO: 211843 - DNA, 25 bp, Homo sapien
gctcacctggtagatcatgacttta

SEQ ID NO: 211844 - DNA, 25 bp, Homo sapien
ctcgttgacctccagcttcttgatc

SEQ ID NO: 211845 - DNA, 25 bp, Homo sapien
cgcacggtcttcacgttgacgctga

SEQ ID NO: 211846 - DNA, 25 bp, Homo sapien
cgctcctccagctgtgcttgagtca

SEQ ID NO: 211847 - DNA, 25 bp, Homo sapien
acgccgttcacctggtccgacttga

SEQ ID NO: 211848 - DNA, 25 bp, Homo sapien
cgacaatatagagcgtggggtcctc

SEQ ID NO: 211849 - DNA, 25 bp, Homo sapien
tgagccctgaatcacccgctatatc

SEQ ID NO: 211850 - DNA, 25 bp, Homo sapien
ccaactgcaatgaggtcattgcggg

SEQ ID NO: 211851 - DNA, 25 bp, Homo sapien
tcagcacgctgggtctcgcctgcga

SEQ ID NO: 211852 - DNA, 25 bp, Homo sapien
cccattggccaactgcaatgaggtc

SEQ ID NO: 211853 - DNA, 25 bp, Homo sapien
ttggccaactgcaatgaggtcattg

SEQ ID NO: 211854 - DNA, 25 bp, Homo sapien
cggggctttacggacgcaagcacgt

SEQ ID NO: 211855 - DNA, 25 bp, Homo sapien
cacgtcgaagcgctgctcctggagc

SEQ ID NO: 211856 - DNA, 25 bp, Homo sapien
cggtggtttctgtggcggttgctgt

SEQ ID NO: 211857 - DNA, 25 bp, Homo sapien
gtttagcgcaacagggagcggccct

SEQ ID NO: 211858 - DNA, 25 bp, Homo sapien
gagccgctgccacccaaatcgggag

SEQ ID NO: 211859 - DNA, 25 bp, Homo sapien
cgttttacccgaaggcgctctgtga

SEQ ID NO: 211860 - DNA, 25 bp, Homo sapien
ggacccgcaggactgagaccatgga

SEQ ID NO: 211861 - DNA, 25 bp, Homo sapien
tagccttcgggtccacgtggccgga

SEQ ID NO: 211862 - DNA, 25 bp, Homo sapien
gcgcgacttctgtggctgccacgtg

SEQ ID NO: 211863 - DNA, 25 bp, Homo sapien
ctgagcccgggcttagccttcgggt

SEQ ID NO: 211864 - DNA, 25 bp, Homo sapien
gagtatcctggtacccggaagccgc

SEQ ID NO: 211865 - DNA, 25 bp, Homo sapien
aagccgggcttggacacctacagcc

SEQ ID NO: 211866 - DNA, 25 bp, Homo sapien
ggaccttccgcctcttgcactaata

SEQ ID NO: 211867 - DNA, 25 bp, Homo sapien
gtgacggctgtggatggctaattaa

SEQ ID NO: 211868 - DNA, 25 bp, Homo sapien
agacagatcacgttagcccgttata

SEQ ID NO: 211869 - DNA, 25 bp, Homo sapien
tccaccacagcaaggagatctaccg

SEQ ID NO: 211870 - DNA, 25 bp, Homo sapien
gaccaggtgatggaccgcacgaaca

SEQ ID NO: 211871 - DNA, 25 bp, Homo sapien
tgcgctacttcacaaccaggcgctt

SEQ ID NO: 211872 - DNA, 25 bp, Homo sapien
atgggagaccctgagctcagcgatc

SEQ ID NO: 211873 - DNA, 25 bp, Homo sapien
accagctgctgatgcgcctggacga

SEQ ID NO: 211874 - DNA, 25 bp, Homo sapien
gggctgcctttcaatgacgtttatt

SEQ ID NO: 211875 - DNA, 25 bp, Homo sapien
tccagattctttgtgtgcggagctg

SEQ ID NO: 211876 - DNA, 25 bp, Homo sapien
ctctgcccggctcacattagctgtg

SEQ ID NO: 211877 - DNA, 25 bp, Homo sapien
cccttgtagcctcagatggatttgg

SEQ ID NO: 211878 - DNA, 25 bp, Homo sapien
gcaggaacccgcgtttcaaatgttc

SEQ ID NO: 211879 - DNA, 25 bp, Homo sapien
gtgctggaccgcacggacatccaca

SEQ ID NO: 211880 - DNA, 25 bp, Homo sapien
tcgcccacagcaagcaagtctttcg

SEQ ID NO: 211881 - DNA, 25 bp, Homo sapien
caagttcgcgctcgaaggcttatgc

SEQ ID NO: 211882 - DNA, 25 bp, Homo sapien
cggctcctgtcggtcagcactgaaa

SEQ ID NO: 211883 - DNA, 25 bp, Homo sapien
gtgcgttacgccaccagctgttaca

SEQ ID NO: 211884 - DNA, 25 bp, Homo sapien
gcccacccgccagaagtcgtgttga

SEQ ID NO: 211885 - DNA, 25 bp, Homo sapien
ggccacgtttgaggttcttgatttc

SEQ ID NO: 211886 - DNA, 25 bp, Homo sapien
actctatgttcacctgcagccgggc

SEQ ID NO: 211887 - DNA, 25 bp, Homo sapien
aacccggtcaaacagcagctagtgc

SEQ ID NO: 211888 - DNA, 25 bp, Homo sapien
ttcgattccttgaagaccctggtgc

SEQ ID NO: 211889 - DNA, 25 bp, Homo sapien
tcccaggatttcgactcagttcagc

SEQ ID NO: 211890 - DNA, 25 bp, Homo sapien
ggggactccatcttacaaaacgcgc

SEQ ID NO: 211891 - DNA, 25 bp, Homo sapien
cattccactgcctaacccggggagg

SEQ ID NO: 211892 - DNA, 25 bp, Homo sapien
agtaaagtctttgggctgcgcatgc

SEQ ID NO: 211893 - DNA, 25 bp, Homo sapien
ggttcctgacacaccggccagcagt

SEQ ID NO: 211894 - DNA, 25 bp, Homo sapien
ctgacaagccaattgaggggactcc

SEQ ID NO: 211895 - DNA, 25 bp, Homo sapien
cggctggaaccgtggagtaaagtct

SEQ ID NO: 211896 - DNA, 25 bp, Homo sapien
cgtgcacacactatctgcggcggtg

SEQ ID NO: 211897 - DNA, 25 bp, Homo sapien
gggatcatacacaggggaggcactc

SEQ ID NO: 211898 - DNA, 25 bp, Homo sapien
ttcccgctgtaggttcccgaacaca

SEQ ID NO: 211899 - DNA, 25 bp, Homo sapien
gcgtgcccacggctaagaaacttcc

SEQ ID NO: 211900 - DNA, 25 bp, Homo sapien
gacctcaagccatgggcctctgcga

SEQ ID NO: 211901 - DNA, 25 bp, Homo sapien
tttcaggtcggaacttgcgcattcg

SEQ ID NO: 211902 - DNA, 25 bp, Homo sapien
agaaacttcctctttctgctcccgg

SEQ ID NO: 211903 - DNA, 25 bp, Homo sapien
ctcagaaagccggacgttgtagttg

SEQ ID NO: 211904 - DNA, 25 bp, Homo sapien
gggagaaggtcctcaccgccttgcc

SEQ ID NO: 211905 - DNA, 25 bp, Homo sapien
cccggactccatagttcatttcagg

SEQ ID NO: 211906 - DNA, 25 bp, Homo sapien
cgttaagcacttcggccactgtctg

SEQ ID NO: 211907 - DNA, 25 bp, Homo sapien
cgctcctactgtgcgctgaagggca

SEQ ID NO: 211908 - DNA, 25 bp, Homo sapien
gaggaataaaccttgcccagctgtg

SEQ ID NO: 211909 - DNA, 25 bp, Homo sapien
ccggcgagaaatgcaaggagcgatc

SEQ ID NO: 211910 - DNA, 25 bp, Homo sapien
tcccaggagagaggactcagccagt

SEQ ID NO: 211911 - DNA, 25 bp, Homo sapien
ctgccaagcacgtgccgaggacttt

SEQ ID NO: 211912 - DNA, 25 bp, Homo sapien
tcgccgagactacgttaagcacttc

SEQ ID NO: 211913 - DNA, 25 bp, Homo sapien
ggactcactgccgaccgttcaaatg

SEQ ID NO: 211914 - DNA, 25 bp, Homo sapien
tctgcatgaacgaaggccagtgctt

SEQ ID NO: 211915 - DNA, 25 bp, Homo sapien
tttccgagggtccagttctctcacc

SEQ ID NO: 211916 - DNA, 25 bp, Homo sapien
aggcaccacagagcgctcctagctg

SEQ ID NO: 211917 - DNA, 25 bp, Homo sapien
gccgcgcacgcgcaatctgcatgaa

SEQ ID NO: 211918 - DNA, 25 bp, Homo sapien
ttctctcaccagaaagccgcgttca

SEQ ID NO: 211919 - DNA, 25 bp, Homo sapien
gccagtgcttaaagacgtgccattc

SEQ ID NO: 211920 - DNA, 25 bp, Homo sapien
cgtgccattcattgccagaactcga

SEQ ID NO: 211921 - DNA, 25 bp, Homo sapien
gccgtggcccgacaagtcacaataa

SEQ ID NO: 211922 - DNA, 25 bp, Homo sapien
aagagcgtcttcttcgtgggccagc

SEQ ID NO: 211923 - DNA, 25 bp, Homo sapien
ggagcgacgacaacgccctgaagca

SEQ ID NO: 211924 - DNA, 25 bp, Homo sapien
cccgcagcacgtggtgagctgtgac

SEQ ID NO: 211925 - DNA, 25 bp, Homo sapien
gcctctggccgctgtacaactacgg

SEQ ID NO: 211926 - DNA, 25 bp, Homo sapien
cagcaaggatcgtaccgtgcgcctc

SEQ ID NO: 211927 - DNA, 25 bp, Homo sapien
aggacttcttcctgagcggcagcaa

SEQ ID NO: 211928 - DNA, 25 bp, Homo sapien
gtgagccagcaggatgcccactttc

SEQ ID NO: 211929 - DNA, 25 bp, Homo sapien
aaactggctggcgtactggcagtac

SEQ ID NO: 211930 - DNA, 25 bp, Homo sapien
gaagaaaacaaaatctctcgtctga

SEQ ID NO: 211931 - DNA, 25 bp, Homo sapien
cgagccagagacttctcaagaagcc

SEQ ID NO: 211932 - DNA, 25 bp, Homo sapien
tctcgtctgagcatgactcttggcg

SEQ ID NO: 211933 - DNA, 25 bp, Homo sapien
gtcttcccagcgaagacttggaacg

SEQ ID NO: 211934 - DNA, 25 bp, Homo sapien
gaaaggtcttcccagcgaagacttg

SEQ ID NO: 211935 - DNA, 25 bp, Homo sapien
tttcgccagcgcgtctgcagcggtt

SEQ ID NO: 211936 - DNA, 25 bp, Homo sapien
agagacttctcaagaagcccagagg

SEQ ID NO: 211937 - DNA, 25 bp, Homo sapien
actcttggcggtggtgctttcgcca

SEQ ID NO: 211938 - DNA, 25 bp, Homo sapien
gcatccgcgtcaagaggcgaagaga

SEQ ID NO: 211939 - DNA, 25 bp, Homo sapien
aaccagagtgagcaagcgagcgccg

SEQ ID NO: 211940 - DNA, 25 bp, Homo sapien
agtgcggcaaccagagtgagcaagc

SEQ ID NO: 211941 - DNA, 25 bp, Homo sapien
cgggagatcatcaccctgcagctgg

SEQ ID NO: 211942 - DNA, 25 bp, Homo sapien
cctgtgcggaattccagctgcgact

SEQ ID NO: 211943 - DNA, 25 bp, Homo sapien
cgggcattcgtctcagccgtgactc

SEQ ID NO: 211944 - DNA, 25 bp, Homo sapien
aattccagctgcgactgctgaggga

SEQ ID NO: 211945 - DNA, 25 bp, Homo sapien
cgcgcccacgtctgaagagcgatgc

SEQ ID NO: 211946 - DNA, 25 bp, Homo sapien
gcctcgcggaatctgagcaggtcta

SEQ ID NO: 211947 - DNA, 25 bp, Homo sapien
aaggggtctcttagtcctgtcacca

SEQ ID NO: 211948 - DNA, 25 bp, Homo sapien
tcaaacctggtgagcacgtcggcca

SEQ ID NO: 211949 - DNA, 25 bp, Homo sapien
gctggggctggacatttacttctca

SEQ ID NO: 211950 - DNA, 25 bp, Homo sapien
tgtccgcttagagactgacctcagc

SEQ ID NO: 211951 - DNA, 25 bp, Homo sapien
ggcaggtccgtctgtaaaccagcga

SEQ ID NO: 211952 - DNA, 25 bp, Homo sapien
agcaggtctaggttccagtcaagcc

SEQ ID NO: 211953 - DNA, 25 bp, Homo sapien
ccactcagaggtcttgccaggattc

SEQ ID NO: 211954 - DNA, 25 bp, Homo sapien
agagtgaagcctcgacggcagcaga

SEQ ID NO: 211955 - DNA, 25 bp, Homo sapien
cacatcccgagtagggctgctgctc

SEQ ID NO: 211956 - DNA, 25 bp, Homo sapien
gggtccgcagctcaaaggtttcctc

SEQ ID NO: 211957 - DNA, 25 bp, Homo sapien
gtgattgagacgaggctccgaaccc

SEQ ID NO: 211958 - DNA, 25 bp, Homo sapien
tctggcctccgcacttgcgaactgg

SEQ ID NO: 211959 - DNA, 25 bp, Homo sapien
ccggttacagcgagagtgattgaga

SEQ ID NO: 211960 - DNA, 25 bp, Homo sapien
ctagttcgccaagcgcgcagcgtgt

SEQ ID NO: 211961 - DNA, 25 bp, Homo sapien
tagtcccggtgcagaagagtgaagc

SEQ ID NO: 211962 - DNA, 25 bp, Homo sapien
gccacacgatgacggagaccaagtg

SEQ ID NO: 211963 - DNA, 25 bp, Homo sapien
cccagaagcgcgtagcaggctacca

SEQ ID NO: 211964 - DNA, 25 bp, Homo sapien
aggctaccatgacgcccagcggcag

SEQ ID NO: 211965 - DNA, 25 bp, Homo sapien
gcgcagccagtagatcggcagtatc

SEQ ID NO: 211966 - DNA, 25 bp, Homo sapien
catccttgcgtttgctggcagggca

SEQ ID NO: 211967 - DNA, 25 bp, Homo sapien
gcaggtggcacttcccagactccag

SEQ ID NO: 211968 - DNA, 25 bp, Homo sapien
ggtcaccagcagtgcgacatccttg

SEQ ID NO: 211969 - DNA, 25 bp, Homo sapien
tagagaacgggattgaggccacagc

SEQ ID NO: 211970 - DNA, 25 bp, Homo sapien
gcccgctggctctcatcttttcctg

SEQ ID NO: 211971 - DNA, 25 bp, Homo sapien
cgctccgcattgcagctctgaggct

SEQ ID NO: 211972 - DNA, 25 bp, Homo sapien
tgctcgccgcggtctcaggagccga

SEQ ID NO: 211973 - DNA, 25 bp, Homo sapien
ggctcttctgcatcctgctcgccgc

SEQ ID NO: 211974 - DNA, 25 bp, Homo sapien
ctgcatgatgcatctccggctcttc

SEQ ID NO: 211975 - DNA, 25 bp, Homo sapien
gccgggaccgtcagccctgcatgat

SEQ ID NO: 211976 - DNA, 25 bp, Homo sapien
gagccctagccggagccgttcacag

SEQ ID NO: 211977 - DNA, 25 bp, Homo sapien
cattgcagctctgaggctgccgcgc

SEQ ID NO: 211978 - DNA, 25 bp, Homo sapien
ctataggcataagcgggtggtcacc

SEQ ID NO: 211979 - DNA, 25 bp, Homo sapien
tccgcggaacatcagctgccaactg

SEQ ID NO: 211980 - DNA, 25 bp, Homo sapien
ccctggctccagatagacttaatga

SEQ ID NO: 211981 - DNA, 25 bp, Homo sapien
ggactgggtcacacgttacatgcta

SEQ ID NO: 211982 - DNA, 25 bp, Homo sapien
acaccgttctaccagcgagggcaca

SEQ ID NO: 211983 - DNA, 25 bp, Homo sapien
acaactcggtactctgggcgccaag

SEQ ID NO: 211984 - DNA, 25 bp, Homo sapien
ccagcgctgactaacagtcggtttc

SEQ ID NO: 211985 - DNA, 25 bp, Homo sapien
gtttccctaccctagacggctgcga

SEQ ID NO: 211986 - DNA, 25 bp, Homo sapien
tactctatttcgacggcgacgatgc

SEQ ID NO: 211987 - DNA, 25 bp, Homo sapien
gtggtgcgccatgacctgcacttcc

SEQ ID NO: 211988 - DNA, 25 bp, Homo sapien
gaaggacggtcttctgctgcacgcc

SEQ ID NO: 211989 - DNA, 25 bp, Homo sapien
tggcctggaacccacgcggcaagat

SEQ ID NO: 211990 - DNA, 25 bp, Homo sapien
tatggctgcccatacagtaagtgtg

SEQ ID NO: 211991 - DNA, 25 bp, Homo sapien
gcgcagaggccgacatactctattt

SEQ ID NO: 211992 - DNA, 25 bp, Homo sapien
gacgtgttcgccttcagcttcaaga

SEQ ID NO: 211993 - DNA, 25 bp, Homo sapien
cacctacggtcctttgcgcagaggc

SEQ ID NO: 211994 - DNA, 25 bp, Homo sapien
ccgcccattaaaggagacgcacagt

SEQ ID NO: 211995 - DNA, 25 bp, Homo sapien
gacgggtcatttacacgtccacctc

SEQ ID NO: 211996 - DNA, 25 bp, Homo sapien
ttctctcagaacacctgggacgctc

SEQ ID NO: 211997 - DNA, 25 bp, Homo sapien
tcctgcgggaacagcgaagcagccc

SEQ ID NO: 211998 - DNA, 25 bp, Homo sapien
aaactgtccatagtgaccggggccg

SEQ ID NO: 211999 - DNA, 25 bp, Homo sapien
ggccatgctgtaagagccttcttca

SEQ ID NO: 212000 - DNA, 25 bp, Homo sapien
ggctctcctgactcaaaaacgctaa

SEQ ID NO: 212001 - DNA, 25 bp, Homo sapien
gccgtcacgtgtaaccttgggcgga

SEQ ID NO: 212002 - DNA, 25 bp, Homo sapien
tatcggcataacttccgcggctgca

SEQ ID NO: 212003 - DNA, 25 bp, Homo sapien
tcggcataacttccgcggctgcata

SEQ ID NO: 212004 - DNA, 25 bp, Homo sapien
tggcctatcggcataacttccgcgg

SEQ ID NO: 212005 - DNA, 25 bp, Homo sapien
gaacctggcctatcggcataacttc

SEQ ID NO: 212006 - DNA, 25 bp, Homo sapien
gaagaacctggcctatcggcataac

SEQ ID NO: 212007 - DNA, 25 bp, Homo sapien
atgttcatcggaggtctggtgggcg

SEQ ID NO: 212008 - DNA, 25 bp, Homo sapien
ctcctgtgcccaagaggcctcattc

SEQ ID NO: 212009 - DNA, 25 bp, Homo sapien
aacttccgcggctgcatagaaaacg

SEQ ID NO: 212010 - DNA, 25 bp, Homo sapien
gtctcatttcgcttccgcacctggg

SEQ ID NO: 212011 - DNA, 25 bp, Homo sapien
caggtcaacgtgtccatcgcgcaga

SEQ ID NO: 212012 - DNA, 25 bp, Homo sapien
cggaggccctcacaacttcgttcaa

SEQ ID NO: 212013 - DNA, 25 bp, Homo sapien
ggtaccgcaccctatcaacttcgga

SEQ ID NO: 212014 - DNA, 25 bp, Homo sapien
ctcacgggtgttgatgcgtcttcac

SEQ ID NO: 212015 - DNA, 25 bp, Homo sapien
gaccggtgtgaaaactgaattccca

SEQ ID NO: 212016 - DNA, 25 bp, Homo sapien
ggtcacgtcatggttggagatctca

SEQ ID NO: 212017 - DNA, 25 bp, Homo sapien
agaagcttcagttcgctgctggtga

SEQ ID NO: 212018 - DNA, 25 bp, Homo sapien
tgtccggcgtgcagcatcagtccac

SEQ ID NO: 212019 - DNA, 25 bp, Homo sapien
cctcttcgtgggcagcgtgaggaac

SEQ ID NO: 212020 - DNA, 25 bp, Homo sapien
atctccgagcagagcctggtggtgt

SEQ ID NO: 212021 - DNA, 25 bp, Homo sapien
gtgcagcatcagtccaccctggagc

SEQ ID NO: 212022 - DNA, 25 bp, Homo sapien
atgtccctgtcctccttcagcgtga

SEQ ID NO: 212023 - DNA, 25 bp, Homo sapien
cttcttcatcttcgaggacaccaca

SEQ ID NO: 212024 - DNA, 25 bp, Homo sapien
accagcattgccatgtcccgcatgt

SEQ ID NO: 212025 - DNA, 25 bp, Homo sapien
atcttcgaggacaccacaggccttc

SEQ ID NO: 212026 - DNA, 25 bp, Homo sapien
agacgctgtcctcgcctgggtctct

SEQ ID NO: 212027 - DNA, 25 bp, Homo sapien
ccgcgcggacgcactactgtcattt

SEQ ID NO: 212028 - DNA, 25 bp, Homo sapien
attgacttacccgtgccgcgcggac

SEQ ID NO: 212029 - DNA, 25 bp, Homo sapien
cgcgtgcgcattgacttacccgtgc

SEQ ID NO: 212030 - DNA, 25 bp, Homo sapien
cgggtcccgctgctaggacgcatgc

SEQ ID NO: 212031 - DNA, 25 bp, Homo sapien
ggcccaggcttgtttactcactcac

SEQ ID NO: 212032 - DNA, 25 bp, Homo sapien
cagtgtgtccctcggattccttcca

SEQ ID NO: 212033 - DNA, 25 bp, Homo sapien
actactgtcatttgccgccaaaacc

SEQ ID NO: 212034 - DNA, 25 bp, Homo sapien
gcgactcgaattcggggagcgatcc

SEQ ID NO: 212035 - DNA, 25 bp, Homo sapien
cagcctcgcggggtgagctacgaga

SEQ ID NO: 212036 - DNA, 25 bp, Homo sapien
ggctggggatataggcgcccccaca

SEQ ID NO: 212037 - DNA, 25 bp, Homo sapien
ccgctcctcgcctccttgctgcacg

SEQ ID NO: 212038 - DNA, 25 bp, Homo sapien
ccgcgtctccctaggacccgagtcg

SEQ ID NO: 212039 - DNA, 25 bp, Homo sapien
ggttaggaccgacgtacctagcagc

SEQ ID NO: 212040 - DNA, 25 bp, Homo sapien
gaccgacgtacctagcagcactggc

SEQ ID NO: 212041 - DNA, 25 bp, Homo sapien
ctgggagagcagcttgccgacccct

SEQ ID NO: 212042 - DNA, 25 bp, Homo sapien
tcccactcagttctggcctcagagt

SEQ ID NO: 212043 - DNA, 25 bp, Homo sapien
catgtcccagactgaggccgacctg

SEQ ID NO: 212044 - DNA, 25 bp, Homo sapien
tcagccgccgtagctcagtcgactt

SEQ ID NO: 212045 - DNA, 25 bp, Homo sapien
gtccctgaagctgtggccctagagc

SEQ ID NO: 212046 - DNA, 25 bp, Homo sapien
ccgatggccgatacctcaagtttga

SEQ ID NO: 212047 - DNA, 25 bp, Homo sapien
tggctccttcaagacggtgtatcga

SEQ ID NO: 212048 - DNA, 25 bp, Homo sapien
ctcactcttagtgcgggaggatgct

SEQ ID NO: 212049 - DNA, 25 bp, Homo sapien
catcgagattggacgtggctccttc

SEQ ID NO: 212050 - DNA, 25 bp, Homo sapien
ctctgtcaaaatcggggacctgggc

SEQ ID NO: 212051 - DNA, 25 bp, Homo sapien
aagcgcgcctcctttgccaagagtg

SEQ ID NO: 212052 - DNA, 25 bp, Homo sapien
ttcagcgctggagccgccaaatcct

SEQ ID NO: 212053 - DNA, 25 bp, Homo sapien
tgcggggacttcatttcctacactc

SEQ ID NO: 212054 - DNA, 25 bp, Homo sapien
ccgggatctcaagtgcgacaatgtc

SEQ ID NO: 212055 - DNA, 25 bp, Homo sapien
gacaatgtctttatcacgggaccta

SEQ ID NO: 212056 - DNA, 25 bp, Homo sapien
cacgggacctactggctctgtcaaa

SEQ ID NO: 212057 - DNA, 25 bp, Homo sapien
cctttgccaagagtgtcatcggtgc

SEQ ID NO: 212058 - DNA, 25 bp, Homo sapien
gagtacccgtactccgagtgccaga

SEQ ID NO: 212059 - DNA, 25 bp, Homo sapien
cgagtgccagaatgccgcgcaaatc

SEQ ID NO: 212060 - DNA, 25 bp, Homo sapien
agatggccacctctgagtacccgta

SEQ ID NO: 212061 - DNA, 25 bp, Homo sapien
catgtgcatgctggagatggccacc

SEQ ID NO: 212062 - DNA, 25 bp, Homo sapien
acgtgtacgcgttcggcatgtgcat

SEQ ID NO: 212063 - DNA, 25 bp, Homo sapien
cccgagatgtacgaggaaaagtacg

SEQ ID NO: 212064 - DNA, 25 bp, Homo sapien
cgcgcaaatctaccgcaaggtcact

SEQ ID NO: 212065 - DNA, 25 bp, Homo sapien
ggaaaggcaattccagggccacttc

SEQ ID NO: 212066 - DNA, 25 bp, Homo sapien
ccatcgagttcctgttccagctggg

SEQ ID NO: 212067 - DNA, 25 bp, Homo sapien
caagctctggctgcgcatggaggac

SEQ ID NO: 212068 - DNA, 25 bp, Homo sapien
gcccacgggacaaccaggccatcga

SEQ ID NO: 212069 - DNA, 25 bp, Homo sapien
ggccatcgagttcctgttccagctg

SEQ ID NO: 212070 - DNA, 25 bp, Homo sapien
acgacggcgagaagccgggcctcaa

SEQ ID NO: 212071 - DNA, 25 bp, Homo sapien
cgggcctcaagctctggctgcgcat

SEQ ID NO: 212072 - DNA, 25 bp, Homo sapien
tcacccacgcgtcaccctcaggttc

SEQ ID NO: 212073 - DNA, 25 bp, Homo sapien
aggttcaccatccaggacctcctgg

SEQ ID NO: 212074 - DNA, 25 bp, Homo sapien
ttagaatccagagggtcaccagctc

SEQ ID NO: 212075 - DNA, 25 bp, Homo sapien
atgcctaggccggtcacgatgttcc

SEQ ID NO: 212076 - DNA, 25 bp, Homo sapien
tccgcctgccgcatggaatgcagtt

SEQ ID NO: 212077 - DNA, 25 bp, Homo sapien
ggggcctctccacgcttagaatcca

SEQ ID NO: 212078 - DNA, 25 bp, Homo sapien
cggacggatacaaatagccaacacc

SEQ ID NO: 212079 - DNA, 25 bp, Homo sapien
ggcctcgctgggaacagtagccctt

SEQ ID NO: 212080 - DNA, 25 bp, Homo sapien
aagcggacgtgctttctgattggct

SEQ ID NO: 212081 - DNA, 25 bp, Homo sapien
cagcttctcccgagtcgggtcgata

SEQ ID NO: 212082 - DNA, 25 bp, Homo sapien
gcgggcttctaagttcaggctctca

SEQ ID NO: 212083 - DNA, 25 bp, Homo sapien
ggaaggcacccatcagcgtcctgag

SEQ ID NO: 212084 - DNA, 25 bp, Homo sapien
ttacagcaagctcctcacgcgagtc

SEQ ID NO: 212085 - DNA, 25 bp, Homo sapien
gttgctccagagctccgtatttaca

SEQ ID NO: 212086 - DNA, 25 bp, Homo sapien
acgcaaagatctcgaaagtgttcca

SEQ ID NO: 212087 - DNA, 25 bp, Homo sapien
tttttaattccgcacggtgagtggc

SEQ ID NO: 212088 - DNA, 25 bp, Homo sapien
cgtggcaaccagagagccgttttta

SEQ ID NO: 212089 - DNA, 25 bp, Homo sapien
gtgttccaaaaagaggcaggtcctg

SEQ ID NO: 212090 - DNA, 25 bp, Homo sapien
aacgtcgcttgactctccttctgca

SEQ ID NO: 212091 - DNA, 25 bp, Homo sapien
tcctcccgaggacagaacgtgttag

SEQ ID NO: 212092 - DNA, 25 bp, Homo sapien
gccaagggtcctgtcctcgttctct

SEQ ID NO: 212093 - DNA, 25 bp, Homo sapien
ctcgctttaggagggccacatttca

SEQ ID NO: 212094 - DNA, 25 bp, Homo sapien
cgtgcaaggagattcgcccaacatc

SEQ ID NO: 212095 - DNA, 25 bp, Homo sapien
tgctgccctcccgataatcttaggt

SEQ ID NO: 212096 - DNA, 25 bp, Homo sapien
gcttcctgtttatccgcactgcgct

SEQ ID NO: 212097 - DNA, 25 bp, Homo sapien
gctttccggccttttagagtctcca

SEQ ID NO: 212098 - DNA, 25 bp, Homo sapien
acgtgacgctacgacggcagcagga

SEQ ID NO: 212099 - DNA, 25 bp, Homo sapien
gaactaccatcgctctgtcttcagc

SEQ ID NO: 212100 - DNA, 25 bp, Homo sapien
ccaagtccggtctaccgcggaggca

SEQ ID NO: 212101 - DNA, 25 bp, Homo sapien
tgtcttcagcgacttcccggtagcc

SEQ ID NO: 212102 - DNA, 25 bp, Homo sapien
agctcctggtccacaggctcacagg

SEQ ID NO: 212103 - DNA, 25 bp, Homo sapien
acttccgccgagaccggacgtgacg

SEQ ID NO: 212104 - DNA, 25 bp, Homo sapien
agcgaggcctccagaactaccatcg

SEQ ID NO: 212105 - DNA, 25 bp, Homo sapien
ccgagaccggacgtgacgctacgac

SEQ ID NO: 212106 - DNA, 25 bp, Homo sapien
tggcctcgttgctgaaggtggatca

SEQ ID NO: 212107 - DNA, 25 bp, Homo sapien
gtctccctggggataccagctctga

SEQ ID NO: 212108 - DNA, 25 bp, Homo sapien
ccgaggtcagccgagatttctcagg

SEQ ID NO: 212109 - DNA, 25 bp, Homo sapien
cgagcgagcagtgagtaagccagca

SEQ ID NO: 212110 - DNA, 25 bp, Homo sapien
cagcctcgcaggagtctcggcgatt

SEQ ID NO: 212111 - DNA, 25 bp, Homo sapien
gaggctcagttctcagcgcaccatt

SEQ ID NO: 212112 - DNA, 25 bp, Homo sapien
cggcgcttgtctttttcgctctagc

SEQ ID NO: 212113 - DNA, 25 bp, Homo sapien
tggctttctgtaccgcgtctgatga

SEQ ID NO: 212114 - DNA, 25 bp, Homo sapien
agagcgacgtgggacaaacgtcatc

SEQ ID NO: 212115 - DNA, 25 bp, Homo sapien
agtctcaagtgcctcgccgtgacgc

SEQ ID NO: 212116 - DNA, 25 bp, Homo sapien
gtgacgccgtacctctcgggcataa

SEQ ID NO: 212117 - DNA, 25 bp, Homo sapien
ctctcgggcataactgtcacgctga

SEQ ID NO: 212118 - DNA, 25 bp, Homo sapien
ttgccggcccggcagtctcaagtgc

SEQ ID NO: 212119 - DNA, 25 bp, Homo sapien
cgccatacctgcaggcgtgtgagga

SEQ ID NO: 212120 - DNA, 25 bp, Homo sapien
aaacgtcatcaagggcgcttgtctg

SEQ ID NO: 212121 - DNA, 25 bp, Homo sapien
gtcacgctgacaccagaacgccata

SEQ ID NO: 212122 - DNA, 25 bp, Homo sapien
cgggtcactactgcgactctattta

SEQ ID NO: 212123 - DNA, 25 bp, Homo sapien
tgcgcgcaacttctcgggccaataa

SEQ ID NO: 212124 - DNA, 25 bp, Homo sapien
tctgggataccaacccgtgcactcg

SEQ ID NO: 212125 - DNA, 25 bp, Homo sapien
aacagctttaacctcctctgggata

SEQ ID NO: 212126 - DNA, 25 bp, Homo sapien
gagaacgcctcgagaaccgctcaga

SEQ ID NO: 212127 - DNA, 25 bp, Homo sapien
actctatttagcagcggaggtctca

SEQ ID NO: 212128 - DNA, 25 bp, Homo sapien
cgttgctggacgaatcgggtcacta

SEQ ID NO: 212129 - DNA, 25 bp, Homo sapien
gcggaggtctcaaggaacagcttta

SEQ ID NO: 212130 - DNA, 25 bp, Homo sapien
ccttctgcgggagctcgaagacttc

SEQ ID NO: 212131 - DNA, 25 bp, Homo sapien
gcaaccgcgtttttagaagaggcga

SEQ ID NO: 212132 - DNA, 25 bp, Homo sapien
ttcgcgcaggtgcagttccgcctgc

SEQ ID NO: 212133 - DNA, 25 bp, Homo sapien
gagctcgaagacttcgccttccgcg

SEQ ID NO: 212134 - DNA, 25 bp, Homo sapien
tgccctcacgtcctaggttacgaag

SEQ ID NO: 212135 - DNA, 25 bp, Homo sapien
ctgttgggccaaaggcgaaagacga

SEQ ID NO: 212136 - DNA, 25 bp, Homo sapien
tccagacccggatgatggtgcatgc

SEQ ID NO: 212137 - DNA, 25 bp, Homo sapien
tgtcctcgcacttcgcgcaggtgca

SEQ ID NO: 212138 - DNA, 25 bp, Homo sapien
gtctctggcggctacgtatccgatc

SEQ ID NO: 212139 - DNA, 25 bp, Homo sapien
gccgggtgcattccttccctaggtc

SEQ ID NO: 212140 - DNA, 25 bp, Homo sapien
tgaatctttcaatccgctgccatcc

SEQ ID NO: 212141 - DNA, 25 bp, Homo sapien
ttgctgccggtaagtagaagcttgg

SEQ ID NO: 212142 - DNA, 25 bp, Homo sapien
gaggtcactcctcaccggggtgaaa

SEQ ID NO: 212143 - DNA, 25 bp, Homo sapien
cacacaatcagcgtggcaaagcctg

SEQ ID NO: 212144 - DNA, 25 bp, Homo sapien
ctgcgtttccctcatgagcttcttc

SEQ ID NO: 212145 - DNA, 25 bp, Homo sapien
acgtatccgatcctgtcctgcgagc

SEQ ID NO: 212146 - DNA, 25 bp, Homo sapien
ggactcccgacgagagcgcacagct

SEQ ID NO: 212147 - DNA, 25 bp, Homo sapien
ctccatgcccggagtgacaggcaga

SEQ ID NO: 212148 - DNA, 25 bp, Homo sapien
cacagctggatggagagtgcacagc

SEQ ID NO: 212149 - DNA, 25 bp, Homo sapien
ggctacctctctctcgtcggacatg

SEQ ID NO: 212150 - DNA, 25 bp, Homo sapien
ccaaagccggtgagcactaggcagc

SEQ ID NO: 212151 - DNA, 25 bp, Homo sapien
ttgtcgtagcctccaaagccggtga

SEQ ID NO: 212152 - DNA, 25 bp, Homo sapien
ctagccatgaggtctgcgaagttga

SEQ ID NO: 212153 - DNA, 25 bp, Homo sapien
tgcagcttcaccttgtcgtagcctc

SEQ ID NO: 212154 - DNA, 25 bp, Homo sapien
ccctgccaggacataggcggacgcg

SEQ ID NO: 212155 - DNA, 25 bp, Homo sapien
atgtaaccggagacccggctgcccg

SEQ ID NO: 212156 - DNA, 25 bp, Homo sapien
ccatggggacggaaagctatgatgt

SEQ ID NO: 212157 - DNA, 25 bp, Homo sapien
ctatgatgtcaccaccgtccgggtg

SEQ ID NO: 212158 - DNA, 25 bp, Homo sapien
gtgctggggttcaccctcccatttc

SEQ ID NO: 212159 - DNA, 25 bp, Homo sapien
gcggttaagtcaatgtaaccggaga

SEQ ID NO: 212160 - DNA, 25 bp, Homo sapien
atgatgtcaccaccgtccgggtggg

SEQ ID NO: 212161 - DNA, 25 bp, Homo sapien
ggagacccggctgcccgttgccatg

SEQ ID NO: 212162 - DNA, 25 bp, Homo sapien
atagatggggtttgggagaaccaga

SEQ ID NO: 212163 - DNA, 25 bp, Homo sapien
gagaaccagagcatccgggagggag

SEQ ID NO: 212164 - DNA, 25 bp, Homo sapien
gagcagggtgagatagatggggttt

SEQ ID NO: 212165 - DNA, 25 bp, Homo sapien
tgggaggaattagggagcagggtga

SEQ ID NO: 212166 - DNA, 25 bp, Homo sapien
ctcgggtaaccagggacaagagaca

SEQ ID NO: 212167 - DNA, 25 bp, Homo sapien
tactcgggtaaccagggacaagaga

SEQ ID NO: 212168 - DNA, 25 bp, Homo sapien
ccctggcgacggatgggaatgggta

SEQ ID NO: 212169 - DNA, 25 bp, Homo sapien
aatgtcggaggtcctgggcaatgga

SEQ ID NO: 212170 - DNA, 25 bp, Homo sapien
atgtctgcgcactcgtagttccacc

SEQ ID NO: 212171 - DNA, 25 bp, Homo sapien
ggaaatgcgctctggcccatgtctg

SEQ ID NO: 212172 - DNA, 25 bp, Homo sapien
atttttcgggttcagcttgcttttg

SEQ ID NO: 212173 - DNA, 25 bp, Homo sapien
gccaccagtcaatggggtggtcgtt

SEQ ID NO: 212174 - DNA, 25 bp, Homo sapien
agagccaatcttcttggcgaaaacg

SEQ ID NO: 212175 - DNA, 25 bp, Homo sapien
tcttcttggcgaaaacgcggagaaa

SEQ ID NO: 212176 - DNA, 25 bp, Homo sapien
agctggcagcggacggtctttgcat

SEQ ID NO: 212177 - DNA, 25 bp, Homo sapien
cggacggtctttgcattgccgcctc

SEQ ID NO: 212178 - DNA, 25 bp, Homo sapien
gccctcgatccctcgttggagggga

SEQ ID NO: 212179 - DNA, 25 bp, Homo sapien
agccagggatccgactcagtgctcg

SEQ ID NO: 212180 - DNA, 25 bp, Homo sapien
ctatcagcgggccaaggcctggcct

SEQ ID NO: 212181 - DNA, 25 bp, Homo sapien
atggccatcttcgaggtctatcagc

SEQ ID NO: 212182 - DNA, 25 bp, Homo sapien
cccgagccaaggacactgaggtaag

SEQ ID NO: 212183 - DNA, 25 bp, Homo sapien
gtcccatccgatgccggagaccagg

SEQ ID NO: 212184 - DNA, 25 bp, Homo sapien
attcatcgtccacgctgtctgcggg

SEQ ID NO: 212185 - DNA, 25 bp, Homo sapien
gacacacggtggacaattcaaattc

SEQ ID NO: 212186 - DNA, 25 bp, Homo sapien
gtaaggaagcagctgcggttaccta

SEQ ID NO: 212187 - DNA, 25 bp, Homo sapien
tgttgttcgggttcaggttgcttct

SEQ ID NO: 212188 - DNA, 25 bp, Homo sapien
cctcagcctcaatgtttgttattgt

SEQ ID NO: 212189 - DNA, 25 bp, Homo sapien
gggaaatccgctctggcccacatct

SEQ ID NO: 212190 - DNA, 25 bp, Homo sapien
catcttggcgaacactcggagaaac

SEQ ID NO: 212191 - DNA, 25 bp, Homo sapien
tccaccaatcaatggcgtggtcgtt

SEQ ID NO: 212192 - DNA, 25 bp, Homo sapien
cactcggagaaacaggggactagtt

SEQ ID NO: 212193 - DNA, 25 bp, Homo sapien
acggtccttgcattggcctccggca

SEQ ID NO: 212194 - DNA, 25 bp, Homo sapien
gcaaattagaaatggcgcttcagcc

SEQ ID NO: 212195 - DNA, 25 bp, Homo sapien
gaaagggcgagacatgcaaattaga

SEQ ID NO: 212196 - DNA, 25 bp, Homo sapien
cggggactcagatcgccgtagccac

SEQ ID NO: 212197 - DNA, 25 bp, Homo sapien
ccgctgcgagcagagctggaccgca

SEQ ID NO: 212198 - DNA, 25 bp, Homo sapien
gctagtgacgcccacgcgcatttcc

SEQ ID NO: 212199 - DNA, 25 bp, Homo sapien
tctttacagtgatgacctgatggct

SEQ ID NO: 212200 - DNA, 25 bp, Homo sapien
gacgctccagtctttacagtgatga

SEQ ID NO: 212201 - DNA, 25 bp, Homo sapien
cgcgggacgctccagtctttacagt

SEQ ID NO: 212202 - DNA, 25 bp, Homo sapien
cccagtgatccgacgtaaaggtgca

SEQ ID NO: 212203 - DNA, 25 bp, Homo sapien
agcgcacacggccaatttaaaagca

SEQ ID NO: 212204 - DNA, 25 bp, Homo sapien
ttaactcaatgatcgtcacgccgca

SEQ ID NO: 212205 - DNA, 25 bp, Homo sapien
cgcgagtactaagagaccgtgaaac

SEQ ID NO: 212206 - DNA, 25 bp, Homo sapien
acaacggtcccaactgatgcaaatg

SEQ ID NO: 212207 - DNA, 25 bp, Homo sapien
atggcccaatgcaaacacgttgaca

SEQ ID NO: 212208 - DNA, 25 bp, Homo sapien
cgttgacaatctcccgttagcgaca

SEQ ID NO: 212209 - DNA, 25 bp, Homo sapien
ggtacgcgcgatgagcttaaatacg

SEQ ID NO: 212210 - DNA, 25 bp, Homo sapien
ttcaggccgtgagtgtaaacgtacg

SEQ ID NO: 212211 - DNA, 25 bp, Homo sapien
tgcagggtttactcacgtatttacc

SEQ ID NO: 212212 - DNA, 25 bp, Homo sapien
cggaaaggcaccattcaggccgtga

SEQ ID NO: 212213 - DNA, 25 bp, Homo sapien
atcactccgttctgcccggaaaggc

SEQ ID NO: 212214 - DNA, 25 bp, Homo sapien
agccttcctgggtatcactccgttc

SEQ ID NO: 212215 - DNA, 25 bp, Homo sapien
cgggatttagtaccgaccaagcaca

SEQ ID NO: 212216 - DNA, 25 bp, Homo sapien
ggagtggtagaaacgcccctgctga

SEQ ID NO: 212217 - DNA, 25 bp, Homo sapien
tagtaccgaccaagcacacagcagt

SEQ ID NO: 212218 - DNA, 25 bp, Homo sapien
ctcgctcccacaggttcgagggctg

SEQ ID NO: 212219 - DNA, 25 bp, Homo sapien
ctcgaccggcgagttttcgttgagg

SEQ ID NO: 212220 - DNA, 25 bp, Homo sapien
ggccctggtaatctccgctcagtga

SEQ ID NO: 212221 - DNA, 25 bp, Homo sapien
atctccgctcagtgagtggcgctgc

SEQ ID NO: 212222 - DNA, 25 bp, Homo sapien
caccagttccgacgccctggggtgg

SEQ ID NO: 212223 - DNA, 25 bp, Homo sapien
cggtagcccagtgagcgcgaccact

SEQ ID NO: 212224 - DNA, 25 bp, Homo sapien
tgagcgcgaccactacttccctgtg

SEQ ID NO: 212225 - DNA, 25 bp, Homo sapien
agcgcgaccactacttccctgtgaa

SEQ ID NO: 212226 - DNA, 25 bp, Homo sapien
cgtcacgaggtgtctgcggaaggaa

SEQ ID NO: 212227 - DNA, 25 bp, Homo sapien
ccattactgtgaagagcggagcttc

SEQ ID NO: 212228 - DNA, 25 bp, Homo sapien
ttactgtgaagagcggagcttcagc

SEQ ID NO: 212229 - DNA, 25 bp, Homo sapien
agagcggagcttcagcggtctggct

SEQ ID NO: 212230 - DNA, 25 bp, Homo sapien
gccgcagagagaagtccgactgcga

SEQ ID NO: 212231 - DNA, 25 bp, Homo sapien
agagagaagtccgactgcgactgcg

SEQ ID NO: 212232 - DNA, 25 bp, Homo sapien
gactgcgactgcgagatcgcgccct

SEQ ID NO: 212233 - DNA, 25 bp, Homo sapien
ttgaggaaagccattactgtgaaga

SEQ ID NO: 212234 - DNA, 25 bp, Homo sapien
ttgtgacgtcacacgcgggttttta

SEQ ID NO: 212235 - DNA, 25 bp, Homo sapien
tcaatctccggtctcagcgtctgca

SEQ ID NO: 212236 - DNA, 25 bp, Homo sapien
attgtcccgcgccttgtgacgtcac

SEQ ID NO: 212237 - DNA, 25 bp, Homo sapien
aaggccgaaccctaggcaggctctg

SEQ ID NO: 212238 - DNA, 25 bp, Homo sapien
cgcggctcacgagaggtaaacggac

SEQ ID NO: 212239 - DNA, 25 bp, Homo sapien
taaacggaccctgcagaccgtgctg

SEQ ID NO: 212240 - DNA, 25 bp, Homo sapien
ctgcagaccgtgctgaggcggtccc

SEQ ID NO: 212241 - DNA, 25 bp, Homo sapien
gtgggagccggactcaatctccggt

SEQ ID NO: 212242 - DNA, 25 bp, Homo sapien
gggatcgcgtggcatcaccttccaa

SEQ ID NO: 212243 - DNA, 25 bp, Homo sapien
tcaccttccaagtgtgggacgtcgg

SEQ ID NO: 212244 - DNA, 25 bp, Homo sapien
tgcgaccactgtggcgctcttatac

SEQ ID NO: 212245 - DNA, 25 bp, Homo sapien
ccgccggacagacggtctagtgttt

SEQ ID NO: 212246 - DNA, 25 bp, Homo sapien
agccaaggtggagttgcaccgaatc

SEQ ID NO: 212247 - DNA, 25 bp, Homo sapien
ttgcaccgaatcagccgggcctcgg

SEQ ID NO: 212248 - DNA, 25 bp, Homo sapien
aatcagccgggcctcggacaaccag

SEQ ID NO: 212249 - DNA, 25 bp, Homo sapien
ggcgctcttatacccgccggacaga

SEQ ID NO: 212250 - DNA, 25 bp, Homo sapien
gctgagtgaacgtttccaggcctga

SEQ ID NO: 212251 - DNA, 25 bp, Homo sapien
cgcgctgacccggaagtgaaagctg

SEQ ID NO: 212252 - DNA, 25 bp, Homo sapien
gcaggctgttttgcggttgcctccc

SEQ ID NO: 212253 - DNA, 25 bp, Homo sapien
atcctgttgggacttgattcgttcc

SEQ ID NO: 212254 - DNA, 25 bp, Homo sapien
agcacttcctgtttgatctctatga

SEQ ID NO: 212255 - DNA, 25 bp, Homo sapien
cactctagttgtcccttccttaagc

SEQ ID NO: 212256 - DNA, 25 bp, Homo sapien
gatcggcgtgcagagtaacccactc

SEQ ID NO: 212257 - DNA, 25 bp, Homo sapien
ttctcgcctgtagagggcgcagatc

SEQ ID NO: 212258 - DNA, 25 bp, Homo sapien
cccttatgctccagccttgccagca

SEQ ID NO: 212259 - DNA, 25 bp, Homo sapien
tccacacacatgcaggggtagggca

SEQ ID NO: 212260 - DNA, 25 bp, Homo sapien
gccctccacacacatgcaggggtag

SEQ ID NO: 212261 - DNA, 25 bp, Homo sapien
agccttgccagcacccgccctcgcc

SEQ ID NO: 212262 - DNA, 25 bp, Homo sapien
cacgcccacacacgctggcttcagc

SEQ ID NO: 212263 - DNA, 25 bp, Homo sapien
cggtgacacacacccgctcccaact

SEQ ID NO: 212264 - DNA, 25 bp, Homo sapien
cccacagttttgcgggagcggtgac

SEQ ID NO: 212265 - DNA, 25 bp, Homo sapien
gccacgctggtcacgcccacacaca

SEQ ID NO: 212266 - DNA, 25 bp, Homo sapien
aggcggggaatcacagacactctcc

SEQ ID NO: 212267 - DNA, 25 bp, Homo sapien
tgtagggcacttgctggtccaagta

SEQ ID NO: 212268 - DNA, 25 bp, Homo sapien
tggtccaagtatccggctttcatcc

SEQ ID NO: 212269 - DNA, 25 bp, Homo sapien
cgggctcggttacataagaacgtgt

SEQ ID NO: 212270 - DNA, 25 bp, Homo sapien
accgacttgtttttcgggcgcagca

SEQ ID NO: 212271 - DNA, 25 bp, Homo sapien
gtgcatttccttcgctcggcctcag

SEQ ID NO: 212272 - DNA, 25 bp, Homo sapien
ctcacgctgctgaaggtgtagggca

SEQ ID NO: 212273 - DNA, 25 bp, Homo sapien
ggcgaaacttctccgactcactggg

SEQ ID NO: 212274 - DNA, 25 bp, Homo sapien
cgcacggtaaagtgatttgggcgcc

SEQ ID NO: 212275 - DNA, 25 bp, Homo sapien
gtaaagtgatttgggcgcctggccc

SEQ ID NO: 212276 - DNA, 25 bp, Homo sapien
tgccaccgttccgggaactcgagaa

SEQ ID NO: 212277 - DNA, 25 bp, Homo sapien
gaaggcaggtccagacccctccgga

SEQ ID NO: 212278 - DNA, 25 bp, Homo sapien
gtcacgagcggatgacgggcttccc

SEQ ID NO: 212279 - DNA, 25 bp, Homo sapien
gatgacgggcttcccggagcacagc

SEQ ID NO: 212280 - DNA, 25 bp, Homo sapien
actgccttgggctgggcgactctct

SEQ ID NO: 212281 - DNA, 25 bp, Homo sapien
gcgactctctagcaggaggcgcacg

SEQ ID NO: 212282 - DNA, 25 bp, Homo sapien
gagctgtgcctgctctctgcaacag

SEQ ID NO: 212283 - DNA, 25 bp, Homo sapien
tctctgcaacaggaaggggcccagc

SEQ ID NO: 212284 - DNA, 25 bp, Homo sapien
ctggcgctgtgcaaacaggacaatt

SEQ ID NO: 212285 - DNA, 25 bp, Homo sapien
tgatcggcgtttgccaccgagctgt

SEQ ID NO: 212286 - DNA, 25 bp, Homo sapien
cgggctatttcagcctggcgctgtg

SEQ ID NO: 212287 - DNA, 25 bp, Homo sapien
caggacaatttactgcggccaaaag

SEQ ID NO: 212288 - DNA, 25 bp, Homo sapien
ccctgagctcatttcctggggcgcg

SEQ ID NO: 212289 - DNA, 25 bp, Homo sapien
acagacaaatatccgccacgccagg

SEQ ID NO: 212290 - DNA, 25 bp, Homo sapien
cgctcggctgggaaatcgcacgtct

SEQ ID NO: 212291 - DNA, 25 bp, Homo sapien
tgggaaatcgcacgtctctccgcgg

SEQ ID NO: 212292 - DNA, 25 bp, Homo sapien
aaatcgcacgtctctccgcggtgac

SEQ ID NO: 212293 - DNA, 25 bp, Homo sapien
aaccgcccggccgtctcaatgcgat

SEQ ID NO: 212294 - DNA, 25 bp, Homo sapien
cggctgggaaatcgcacgtctctcc

SEQ ID NO: 212295 - DNA, 25 bp, Homo sapien
ctcaatgcgatcacaggagggacac

SEQ ID NO: 212296 - DNA, 25 bp, Homo sapien
cgtctcaatgcgatcacaggaggga

SEQ ID NO: 212297 - DNA, 25 bp, Homo sapien
acacggagatcgaggagggccacag

SEQ ID NO: 212298 - DNA, 25 bp, Homo sapien
gcctcggtcccgaagtccttgagct

SEQ ID NO: 212299 - DNA, 25 bp, Homo sapien
tgaagtgcagctcgcggcagctgta

SEQ ID NO: 212300 - DNA, 25 bp, Homo sapien
gcccatcggtcacgtagcgggtgaa

SEQ ID NO: 212301 - DNA, 25 bp, Homo sapien
agcacaccagctcggtgaccggctt

SEQ ID NO: 212302 - DNA, 25 bp, Homo sapien
gaagtcgggcccactaggtcgccac

SEQ ID NO: 212303 - DNA, 25 bp, Homo sapien
gcttgcacttgcacgaggccaccag

SEQ ID NO: 212304 - DNA, 25 bp, Homo sapien
ccttgagctccgactggttgtggaa

SEQ ID NO: 212305 - DNA, 25 bp, Homo sapien
ggcagctgtactcggacacgtctgt

SEQ ID NO: 212306 - DNA, 25 bp, Homo sapien
gcctgtcagtcaaagcggctctctc

SEQ ID NO: 212307 - DNA, 25 bp, Homo sapien
gctctccgggaaaacgcctgtcagt

SEQ ID NO: 212308 - DNA, 25 bp, Homo sapien
tctctcgtgagagcgtctgactgct

SEQ ID NO: 212309 - DNA, 25 bp, Homo sapien
ccatctccgtctgctggagaattga

SEQ ID NO: 212310 - DNA, 25 bp, Homo sapien
aaggtgttagcaggttcaccgggca

SEQ ID NO: 212311 - DNA, 25 bp, Homo sapien
gttcaccgggcagcaacgctcagac

SEQ ID NO: 212312 - DNA, 25 bp, Homo sapien
acgctcagaccgatgtgcaggccac

SEQ ID NO: 212313 - DNA, 25 bp, Homo sapien
cgctgcctgagtgtcgatttgcagt

SEQ ID NO: 212314 - DNA, 25 bp, Homo sapien
ttaggttccctgatccgggactgcc

SEQ ID NO: 212315 - DNA, 25 bp, Homo sapien
cggactcgctcatttggggtgttta

SEQ ID NO: 212316 - DNA, 25 bp, Homo sapien
gaaccaggcagctgtcacatgacgc

SEQ ID NO: 212317 - DNA, 25 bp, Homo sapien
ggtgacctcactgcagaaccaggca

SEQ ID NO: 212318 - DNA, 25 bp, Homo sapien
cgaaggcagacattccgcggtgacc

SEQ ID NO: 212319 - DNA, 25 bp, Homo sapien
ccgagggtcacctgttaagtgaaca

SEQ ID NO: 212320 - DNA, 25 bp, Homo sapien
ccgggaaaattccatgcccgaattg

SEQ ID NO: 212321 - DNA, 25 bp, Homo sapien
cccgaattgtgacgtcggcccgttg

SEQ ID NO: 212322 - DNA, 25 bp, Homo sapien
ctttcatgattacagggaccgccgg

SEQ ID NO: 212323 - DNA, 25 bp, Homo sapien
acacctaggggtcgcttcagtcttt

SEQ ID NO: 212324 - DNA, 25 bp, Homo sapien
tctttgtaaactggcaagcgcggta

SEQ ID NO: 212325 - DNA, 25 bp, Homo sapien
agcgcggtaacttccttccctgaat

SEQ ID NO: 212326 - DNA, 25 bp, Homo sapien
cctgaattaaatgcagggcccaata

SEQ ID NO: 212327 - DNA, 25 bp, Homo sapien
tgcagggcccaataaacatttcgtg

SEQ ID NO: 212328 - DNA, 25 bp, Homo sapien
catttcgtggcggaggtacacctag

SEQ ID NO: 212329 - DNA, 25 bp, Homo sapien
ccaggccgtttgtgtatctttgtaa

SEQ ID NO: 212330 - DNA, 25 bp, Homo sapien
ccactaagaggcgtaagagcggccc

SEQ ID NO: 212331 - DNA, 25 bp, Homo sapien
ccgctagccggcgtcgtacccgctc

SEQ ID NO: 212332 - DNA, 25 bp, Homo sapien
ccctccgcgtctggcaccgccgcac

SEQ ID NO: 212333 - DNA, 25 bp, Homo sapien
gcctcctacctcgtcgcgccgggat

SEQ ID NO: 212334 - DNA, 25 bp, Homo sapien
acagccagacttcccttccgcccgc

SEQ ID NO: 212335 - DNA, 25 bp, Homo sapien
cgctcgctctccgaaggaacctgtg

SEQ ID NO: 212336 - DNA, 25 bp, Homo sapien
cccggtgccactaagaggcgtaaga

SEQ ID NO: 212337 - DNA, 25 bp, Homo sapien
ccgaaggaacctgtgggagaacaag

SEQ ID NO: 212338 - DNA, 25 bp, Homo sapien
tgctgattggctaaagccctgactg

SEQ ID NO: 212339 - DNA, 25 bp, Homo sapien
ttggctaaagccctgactggcgctg

SEQ ID NO: 212340 - DNA, 25 bp, Homo sapien
gccttgctgattggctaaagccctg

SEQ ID NO: 212341 - DNA, 25 bp, Homo sapien
gaccgccttgctgattggctaaagc

SEQ ID NO: 212342 - DNA, 25 bp, Homo sapien
ccgtgaccgccttgctgattggcta

SEQ ID NO: 212343 - DNA, 25 bp, Homo sapien
ccctctgaggaaccagccaatggga

SEQ ID NO: 212344 - DNA, 25 bp, Homo sapien
ggagcgtcctacacgccgccgtcta

SEQ ID NO: 212345 - DNA, 25 bp, Homo sapien
ctaaagccctgactggcgctgcgcg

SEQ ID NO: 212346 - DNA, 25 bp, Homo sapien
gtctggaggaatggaatccaccctc

SEQ ID NO: 212347 - DNA, 25 bp, Homo sapien
ctggtcgtaggagccgtccaggtct

SEQ ID NO: 212348 - DNA, 25 bp, Homo sapien
tccaggtctcgggaatcggacaaac

SEQ ID NO: 212349 - DNA, 25 bp, Homo sapien
tcgggaatcggacaaactctccttg

SEQ ID NO: 212350 - DNA, 25 bp, Homo sapien
ggacaaactctccttgcggccctgg

SEQ ID NO: 212351 - DNA, 25 bp, Homo sapien
ccctggcggcctactgtgctgtcgg

SEQ ID NO: 212352 - DNA, 25 bp, Homo sapien
aggtctacccggaggtcctggagca

SEQ ID NO: 212353 - DNA, 25 bp, Homo sapien
actcacccgtgagctggtcgtagga

SEQ ID NO: 212354 - DNA, 25 bp, Homo sapien
ggaagcgctaacagcacggttctta

SEQ ID NO: 212355 - DNA, 25 bp, Homo sapien
taaccctagctcttcgcttctggca

SEQ ID NO: 212356 - DNA, 25 bp, Homo sapien
gttcttacgtaatgccgggcttcta

SEQ ID NO: 212357 - DNA, 25 bp, Homo sapien
cctaagtgccgtgtcaggacgaaaa

SEQ ID NO: 212358 - DNA, 25 bp, Homo sapien
ggcgctcagcgtttattgcttgtca

SEQ ID NO: 212359 - DNA, 25 bp, Homo sapien
cttgtcaatcgctagcccggctctt

SEQ ID NO: 212360 - DNA, 25 bp, Homo sapien
cccggctcttaaagcggcaaggcct

SEQ ID NO: 212361 - DNA, 25 bp, Homo sapien
ccctcccagggaagattgtggtgtt

SEQ ID NO: 212362 - DNA, 25 bp, Homo sapien
ccctcggcgaggagctgcaagtgcc

SEQ ID NO: 212363 - DNA, 25 bp, Homo sapien
tcgtgtcgctgctgatgcagcccga

SEQ ID NO: 212364 - DNA, 25 bp, Homo sapien
ccatagcgggcctcgtgtcgctgct

SEQ ID NO: 212365 - DNA, 25 bp, Homo sapien
gctgcgcattcgctctggccatagc

SEQ ID NO: 212366 - DNA, 25 bp, Homo sapien
acacctgcaagctccggtccgggtg

SEQ ID NO: 212367 - DNA, 25 bp, Homo sapien
gcgcggaacacctgcaagctccggt

SEQ ID NO: 212368 - DNA, 25 bp, Homo sapien
tagacacgaccctcggtctgagcgc

SEQ ID NO: 212369 - DNA, 25 bp, Homo sapien
cccagaaatagacacgaccctcggt

SEQ ID NO: 212370 - DNA, 25 bp, Homo sapien
cgtagtagcggttcagctcctccgg

SEQ ID NO: 212371 - DNA, 25 bp, Homo sapien
tcgggagtgcgtatgcaaatgacgt

SEQ ID NO: 212372 - DNA, 25 bp, Homo sapien
ggagacgtcgttaagtgatgttgcc

SEQ ID NO: 212373 - DNA, 25 bp, Homo sapien
tgtccgggccgtctcttttcccata

SEQ ID NO: 212374 - DNA, 25 bp, Homo sapien
ttgggacgtgggtcattccaagcct

SEQ ID NO: 212375 - DNA, 25 bp, Homo sapien
gcagggccagaagcactgtggtcaa

SEQ ID NO: 212376 - DNA, 25 bp, Homo sapien
cctgcgcacgaacaccatctgggaa

SEQ ID NO: 212377 - DNA, 25 bp, Homo sapien
ctctcggatgcaggatgtgtggtaa

SEQ ID NO: 212378 - DNA, 25 bp, Homo sapien
gagcggctgctgtttgcgcagctaa

SEQ ID NO: 212379 - DNA, 25 bp, Homo sapien
ggtgcacgtccactctcctgtaggc

SEQ ID NO: 212380 - DNA, 25 bp, Homo sapien
cctgtaggctcgtgcccttgacata

SEQ ID NO: 212381 - DNA, 25 bp, Homo sapien
tctgcttgatgacgtcgctgtcgca

SEQ ID NO: 212382 - DNA, 25 bp, Homo sapien
cagctaagtggcgtctgtgtaccca

SEQ ID NO: 212383 - DNA, 25 bp, Homo sapien
atcgggccatcgctgataagaaacc

SEQ ID NO: 212384 - DNA, 25 bp, Homo sapien
tcttaggcgcacattggctcgcggt

SEQ ID NO: 212385 - DNA, 25 bp, Homo sapien
gcccttgacatatccggggctgtca

SEQ ID NO: 212386 - DNA, 25 bp, Homo sapien
ctagcacctcgggaggatcccttca

SEQ ID NO: 212387 - DNA, 25 bp, Homo sapien
ccgggactacccgagactttgcatc

SEQ ID NO: 212388 - DNA, 25 bp, Homo sapien
cggtaagcatgagcaagagggtatc

SEQ ID NO: 212389 - DNA, 25 bp, Homo sapien
tctcgggatccgagacagagccctg

SEQ ID NO: 212390 - DNA, 25 bp, Homo sapien
cccacgagctgcgttttcccggaag

SEQ ID NO: 212391 - DNA, 25 bp, Homo sapien
ccattaacgtgtcccgcccgaggat

SEQ ID NO: 212392 - DNA, 25 bp, Homo sapien
aacctcgcgttttgatccagggtgc

SEQ ID NO: 212393 - DNA, 25 bp, Homo sapien
acccgagactttgcatcgcgtggcc

SEQ ID NO: 212394 - DNA, 25 bp, Homo sapien
ctccaccgtcagacctcgcaccctc

SEQ ID NO: 212395 - DNA, 25 bp, Homo sapien
tctctccaccgtcagacctcgcacc

SEQ ID NO: 212396 - DNA, 25 bp, Homo sapien
tccaccgtcagacctcgcaccctct

SEQ ID NO: 212397 - DNA, 25 bp, Homo sapien
tctccaccgtcagacctcgcaccct

SEQ ID NO: 212398 - DNA, 25 bp, Homo sapien
ccaccgtcagacctcgcaccctctc

SEQ ID NO: 212399 - DNA, 25 bp, Homo sapien
tctccaccgtcagacctcactccct

SEQ ID NO: 212400 - DNA, 25 bp, Homo sapien
tctctccaccgtcagacctcacacc

SEQ ID NO: 212401 - DNA, 25 bp, Homo sapien
tctctccaccgtcagacctcactcc

SEQ ID NO: 212402 - DNA, 25 bp, Homo sapien
gaaccgcgtttggtgtttgaagcca

SEQ ID NO: 212403 - DNA, 25 bp, Homo sapien
gaaaacagttgcacgcggcttgatg

SEQ ID NO: 212404 - DNA, 25 bp, Homo sapien
atctgctcagcgtttaggtttccca

SEQ ID NO: 212405 - DNA, 25 bp, Homo sapien
aattccctaattccggaggcgctgg

SEQ ID NO: 212406 - DNA, 25 bp, Homo sapien
tgtttgaagccagccaccttgtccg

SEQ ID NO: 212407 - DNA, 25 bp, Homo sapien
tccctggggttcgactcagaatgca

SEQ ID NO: 212408 - DNA, 25 bp, Homo sapien
tgcagcaactccattctccctgggg

SEQ ID NO: 212409 - DNA, 25 bp, Homo sapien
gctgtgccaggttttcaagacgatc

SEQ ID NO: 212410 - DNA, 25 bp, Homo sapien
agcagtcataaggtgcggccctttc

SEQ ID NO: 212411 - DNA, 25 bp, Homo sapien
ctggccttcttgcagcgcatggaca

SEQ ID NO: 212412 - DNA, 25 bp, Homo sapien
ttcctcaataacacaggcggcctgc

SEQ ID NO: 212413 - DNA, 25 bp, Homo sapien
gtcctgagtaacgtgaacctgcccg

SEQ ID NO: 212414 - DNA, 25 bp, Homo sapien
cgcagactcactagcaagccgggtg

SEQ ID NO: 212415 - DNA, 25 bp, Homo sapien
cgccgctgctgtgccattttttggc

SEQ ID NO: 212416 - DNA, 25 bp, Homo sapien
gcggcctgcgcgacagcagtcataa

SEQ ID NO: 212417 - DNA, 25 bp, Homo sapien
ctggtagacgcgcttcgacacaacg

SEQ ID NO: 212418 - DNA, 25 bp, Homo sapien
tgaaactagcgcacagcacggctgc

SEQ ID NO: 212419 - DNA, 25 bp, Homo sapien
ccgtagtggacgtagcccccgatgt

SEQ ID NO: 212420 - DNA, 25 bp, Homo sapien
gcggcgtaggtgctaatggccaatt

SEQ ID NO: 212421 - DNA, 25 bp, Homo sapien
ctaatggccaattggagtgcggccc

SEQ ID NO: 212422 - DNA, 25 bp, Homo sapien
agcgccgcttcacgccaaaggacat

SEQ ID NO: 212423 - DNA, 25 bp, Homo sapien
tcacgccaaaggacatgaaactagc

SEQ ID NO: 212424 - DNA, 25 bp, Homo sapien
cccatgtcgaaatacaggtaaggca

SEQ ID NO: 212425 - DNA, 25 bp, Homo sapien
taaggcactgggatgtcgggcttcc

SEQ ID NO: 212426 - DNA, 25 bp, Homo sapien
cggctgcgtttacctgttgccagta

SEQ ID NO: 212427 - DNA, 25 bp, Homo sapien
tgttgccagtactcctccagagacg

SEQ ID NO: 212428 - DNA, 25 bp, Homo sapien
cgcgcggagcccacacaatatttgc

SEQ ID NO: 212429 - DNA, 25 bp, Homo sapien
acaccggactgactgcaaacgtaac

SEQ ID NO: 212430 - DNA, 25 bp, Homo sapien
ctggcgtgaccgagactctccatca

SEQ ID NO: 212431 - DNA, 25 bp, Homo sapien
ggcccgcaccattggctcaattcga

SEQ ID NO: 212432 - DNA, 25 bp, Homo sapien
ctcgttctgattggaaagtggcctc

SEQ ID NO: 212433 - DNA, 25 bp, Homo sapien
cgcaggctatttttagcagggtata

SEQ ID NO: 212434 - DNA, 25 bp, Homo sapien
agcgtgtgagcagcaccgaacccaa

SEQ ID NO: 212435 - DNA, 25 bp, Homo sapien
ccgaacccaactgcatgatcagctg

SEQ ID NO: 212436 - DNA, 25 bp, Homo sapien
gaacctatcttcgacgccatcttgg

SEQ ID NO: 212437 - DNA, 25 bp, Homo sapien
catcttgggaaagggcagtccgctg

SEQ ID NO: 212438 - DNA, 25 bp, Homo sapien
atgggacacgcagcttccgggtcaa

SEQ ID NO: 212439 - DNA, 25 bp, Homo sapien
cagcttccgggtcaagcgctttttc

SEQ ID NO: 212440 - DNA, 25 bp, Homo sapien
ccctgccgcgtttagcggctgcgta

SEQ ID NO: 212441 - DNA, 25 bp, Homo sapien
tcagccctctcagcgtacagcatga

SEQ ID NO: 212442 - DNA, 25 bp, Homo sapien
cacgcagggaaggatacttaaagcc

SEQ ID NO: 212443 - DNA, 25 bp, Homo sapien
cacggagcgtgcttgcgtcacacgc

SEQ ID NO: 212444 - DNA, 25 bp, Homo sapien
aacgctgaagtactcgcccggagga

SEQ ID NO: 212445 - DNA, 25 bp, Homo sapien
acacctggctcccaacgctgaagta

SEQ ID NO: 212446 - DNA, 25 bp, Homo sapien
ttggtagtcaaaggctaccacctcg

SEQ ID NO: 212447 - DNA, 25 bp, Homo sapien
aggatacttaaagccagcattttgg

SEQ ID NO: 212448 - DNA, 25 bp, Homo sapien
tcgggcttcacgcagggaaggatac

SEQ ID NO: 212449 - DNA, 25 bp, Homo sapien
agccagcattttggattggtagtca

SEQ ID NO: 212450 - DNA, 25 bp, Homo sapien
ggcgctacagaaccagctagcctgg

SEQ ID NO: 212451 - DNA, 25 bp, Homo sapien
ggcatcgtgatagccgaggcgctac

SEQ ID NO: 212452 - DNA, 25 bp, Homo sapien
gacgctgcttcgttgcctggactct

SEQ ID NO: 212453 - DNA, 25 bp, Homo sapien
ctgcgctgcccagtagggaggaaaa

SEQ ID NO: 212454 - DNA, 25 bp, Homo sapien
cgtgcctgcaacagtggccacgtgg

SEQ ID NO: 212455 - DNA, 25 bp, Homo sapien
cgccttcgcatcagcggagcaggga

SEQ ID NO: 212456 - DNA, 25 bp, Homo sapien
ggctctggatcacctttctgggcga

SEQ ID NO: 212457 - DNA, 25 bp, Homo sapien
tctgggcgatcccaagatcctcttt

SEQ ID NO: 212458 - DNA, 25 bp, Homo sapien
tcggacaagtctcgaactcgccagc

SEQ ID NO: 212459 - DNA, 25 bp, Homo sapien
ccaacaacaacattcggagacgtca

SEQ ID NO: 212460 - DNA, 25 bp, Homo sapien
ggccagcgacgccatcgtgacagct

SEQ ID NO: 212461 - DNA, 25 bp, Homo sapien
catcgtgacagctccttaaagggcc

SEQ ID NO: 212462 - DNA, 25 bp, Homo sapien
gcccagcacagggttcggccgagac

SEQ ID NO: 212463 - DNA, 25 bp, Homo sapien
tggggctcaacctttggattgtaaa

SEQ ID NO: 212464 - DNA, 25 bp, Homo sapien
tgcaatcgtcgcttgcctaagctgc

SEQ ID NO: 212465 - DNA, 25 bp, Homo sapien
tcaaaacgtggatggtgcaatcgtc

SEQ ID NO: 212466 - DNA, 25 bp, Homo sapien
tgtgtcggcgggaaagaaatatgcc

SEQ ID NO: 212467 - DNA, 25 bp, Homo sapien
ttcgaatgcggcctaaggcgcctgc

SEQ ID NO: 212468 - DNA, 25 bp, Homo sapien
cagtctcctggcgactttccctata

SEQ ID NO: 212469 - DNA, 25 bp, Homo sapien
ttccctatatcgcagagactcatcc

SEQ ID NO: 212470 - DNA, 25 bp, Homo sapien
ggagtccgagacttccacctgggtc

SEQ ID NO: 212471 - DNA, 25 bp, Homo sapien
acccgccgtcgctatggtaatgccg

SEQ ID NO: 212472 - DNA, 25 bp, Homo sapien
ctccggaactgctcatggggttcca

SEQ ID NO: 212473 - DNA, 25 bp, Homo sapien
cctttaagaccagagcggaagacta

SEQ ID NO: 212474 - DNA, 25 bp, Homo sapien
acacgcccatggactgtgcgctgca

SEQ ID NO: 212475 - DNA, 25 bp, Homo sapien
caactgggagcctgaagtccttttc

SEQ ID NO: 212476 - DNA, 25 bp, Homo sapien
cacaacgcttgtgccaacggctgcg

SEQ ID NO: 212477 - DNA, 25 bp, Homo sapien
actgcgctgaacacggcgtgcgctg

SEQ ID NO: 212478 - DNA, 25 bp, Homo sapien
ctctgtacctggagcatggcgccga

SEQ ID NO: 212479 - DNA, 25 bp, Homo sapien
gcctggagcaacatgtggctctgta

SEQ ID NO: 212480 - DNA, 25 bp, Homo sapien
tgaacctggcagcaggcgagagcca

SEQ ID NO: 212481 - DNA, 25 bp, Homo sapien
ttttcgccgcactgctggactacgg

SEQ ID NO: 212482 - DNA, 25 bp, Homo sapien
tcgcgcaccgctgtactccagcctg

SEQ ID NO: 212483 - DNA, 25 bp, Homo sapien
caagatcgcgcaccgctgtactcca

SEQ ID NO: 212484 - DNA, 25 bp, Homo sapien
aagatcgcgcaccgctgtactccag

SEQ ID NO: 212485 - DNA, 25 bp, Homo sapien
atcgcgcaccgctgtactccagcct

SEQ ID NO: 212486 - DNA, 25 bp, Homo sapien
gccaagatcgcgcaccgctgtactc

SEQ ID NO: 212487 - DNA, 25 bp, Homo sapien
gagggccgcaatcccgccaacaatg

SEQ ID NO: 212488 - DNA, 25 bp, Homo sapien
tccgctgagaaacctgtccctttta

SEQ ID NO: 212489 - DNA, 25 bp, Homo sapien
cgcagcttcgcgtcatcagtgcaag

SEQ ID NO: 212490 - DNA, 25 bp, Homo sapien
gcgggacttcctgtccctggtataa

SEQ ID NO: 212491 - DNA, 25 bp, Homo sapien
cggaagagaccggaccctgaacaga

SEQ ID NO: 212492 - DNA, 25 bp, Homo sapien
cgtcctggcgaggtcaaaacattta

SEQ ID NO: 212493 - DNA, 25 bp, Homo sapien
actggccgggacaactggtcttatc

SEQ ID NO: 212494 - DNA, 25 bp, Homo sapien
ccaacgccgagggaataggaccatc

SEQ ID NO: 212495 - DNA, 25 bp, Homo sapien
gggcgccctgaggatcagtcactta

SEQ ID NO: 212496 - DNA, 25 bp, Homo sapien
ttagccattgctccggagactcccg

SEQ ID NO: 212497 - DNA, 25 bp, Homo sapien
gagactcccgggaataggccaggaa

SEQ ID NO: 212498 - DNA, 25 bp, Homo sapien
acccggggcagtcagaatgtggaaa

SEQ ID NO: 212499 - DNA, 25 bp, Homo sapien
tgaatcatgatctgtgcgggcaagg

SEQ ID NO: 212500 - DNA, 25 bp, Homo sapien
tgccacgaaacggagcaccagggtg

SEQ ID NO: 212501 - DNA, 25 bp, Homo sapien
tgcgtgctctcatgtgtcccgtgaa

SEQ ID NO: 212502 - DNA, 25 bp, Homo sapien
atgtgtcccgtgaatcagtgcgccc

SEQ ID NO: 212503 - DNA, 25 bp, Homo sapien
ggtggggactgacgaatgagccggg

SEQ ID NO: 212504 - DNA, 25 bp, Homo sapien
acggtgggtacgagtttcaggagct

SEQ ID NO: 212505 - DNA, 25 bp, Homo sapien
ggactgacgaatgagccgggggcac

SEQ ID NO: 212506 - DNA, 25 bp, Homo sapien
gactgacgaatgagccgggggcact

SEQ ID NO: 212507 - DNA, 25 bp, Homo sapien
gtggggactgacgaatgagccgggg

SEQ ID NO: 212508 - DNA, 25 bp, Homo sapien
gggtggggactgacgaatgagccgg

SEQ ID NO: 212509 - DNA, 25 bp, Homo sapien
ggagctgccggcctagagtggggtg

SEQ ID NO: 212510 - DNA, 25 bp, Homo sapien
gggactgacgaatgagccgggggca

SEQ ID NO: 212511 - DNA, 25 bp, Homo sapien
ctgcggcactgctgctgcatcatac

SEQ ID NO: 212512 - DNA, 25 bp, Homo sapien
ccgggagggtgtctctattgtcccg

SEQ ID NO: 212513 - DNA, 25 bp, Homo sapien
agtccgggagggtgtctctattgtc

SEQ ID NO: 212514 - DNA, 25 bp, Homo sapien
cccagagagtgggacgcgtcccagc

SEQ ID NO: 212515 - DNA, 25 bp, Homo sapien
tgctgcatcataccgactgggggga

SEQ ID NO: 212516 - DNA, 25 bp, Homo sapien
tgctgctgcatcataccgactgggg

SEQ ID NO: 212517 - DNA, 25 bp, Homo sapien
actgctgctgcatcataccgactgg

SEQ ID NO: 212518 - DNA, 25 bp, Homo sapien
cggcactgctgctgcatcataccga

SEQ ID NO: 212519 - DNA, 25 bp, Homo sapien
caatgggttagtccacgcccgcttc

SEQ ID NO: 212520 - DNA, 25 bp, Homo sapien
tcaaaggtcagcacctcggaagcca

SEQ ID NO: 212521 - DNA, 25 bp, Homo sapien
ggcatacgcagcttcagcagccgtc

SEQ ID NO: 212522 - DNA, 25 bp, Homo sapien
aaggcctagtatggcaggacccgca

SEQ ID NO: 212523 - DNA, 25 bp, Homo sapien
cgctggaagagcgaagccgtttctc

SEQ ID NO: 212524 - DNA, 25 bp, Homo sapien
tgagaccggctcagaccacgattcc

SEQ ID NO: 212525 - DNA, 25 bp, Homo sapien
ttcccagcaagcatcgcaaagacta

SEQ ID NO: 212526 - DNA, 25 bp, Homo sapien
ctcccgaaaggcatcgcgagaaata

SEQ ID NO: 212527 - DNA, 25 bp, Homo sapien
tgcggaccaacaagcggccgagatg

SEQ ID NO: 212528 - DNA, 25 bp, Homo sapien
gaggccaagcgcgagcgcgctccaa

SEQ ID NO: 212529 - DNA, 25 bp, Homo sapien
cgcagctcggcagcatttgctccag

SEQ ID NO: 212530 - DNA, 25 bp, Homo sapien
ctcggcccgggaggaccaataagat

SEQ ID NO: 212531 - DNA, 25 bp, Homo sapien
aggcgtgcagccacttctgtgaaga

SEQ ID NO: 212532 - DNA, 25 bp, Homo sapien
acttctgtgaagaggccagacttga

SEQ ID NO: 212533 - DNA, 25 bp, Homo sapien
cactccaggcttgcggaccaacaag

SEQ ID NO: 212534 - DNA, 25 bp, Homo sapien
ccagacttgaagtggggcgcagtta

SEQ ID NO: 212535 - DNA, 25 bp, Homo sapien
tccgagaagatgaacatggccgaca

SEQ ID NO: 212536 - DNA, 25 bp, Homo sapien
gacaggtcgttccacattcgggcca

SEQ ID NO: 212537 - DNA, 25 bp, Homo sapien
aggcagcctgaccttcttcttctca

SEQ ID NO: 212538 - DNA, 25 bp, Homo sapien
tctgcggcgctcagctgacagcttc

SEQ ID NO: 212539 - DNA, 25 bp, Homo sapien
aagcatgggctggtgcagatgtctc

SEQ ID NO: 212540 - DNA, 25 bp, Homo sapien
ctctcgggccttgtacttggcctgc

SEQ ID NO: 212541 - DNA, 25 bp, Homo sapien
acgctctgttgccagatctcctcag

SEQ ID NO: 212542 - DNA, 25 bp, Homo sapien
ggtagtcgccgataacgctctgttg

SEQ ID NO: 212543 - DNA, 25 bp, Homo sapien
cggttcaatccagcccggcatggtt

SEQ ID NO: 212544 - DNA, 25 bp, Homo sapien
ttctcccagctcagactagggcttc

SEQ ID NO: 212545 - DNA, 25 bp, Homo sapien
tcgcggcgtccagcttcggtgccta

SEQ ID NO: 212546 - DNA, 25 bp, Homo sapien
ctgtgggagccggttcaatccagcc

SEQ ID NO: 212547 - DNA, 25 bp, Homo sapien
ggcatggttctccaggcctgcccgg

SEQ ID NO: 212548 - DNA, 25 bp, Homo sapien
cgggctcacttaccgagcgtgtgga

SEQ ID NO: 212549 - DNA, 25 bp, Homo sapien
gggccgaacagtcgagccgcagctc

SEQ ID NO: 212550 - DNA, 25 bp, Homo sapien
tgccgaacggcacatacgaaactta

SEQ ID NO: 212551 - DNA, 25 bp, Homo sapien
cttgttttgctctggcatcgccgcc

SEQ ID NO: 212552 - DNA, 25 bp, Homo sapien
gctgtggagcgtaagaacctgatca

SEQ ID NO: 212553 - DNA, 25 bp, Homo sapien
gcaccctctgcggattggtcctcgg

SEQ ID NO: 212554 - DNA, 25 bp, Homo sapien
ccagccgtgatccagcgacgggttt

SEQ ID NO: 212555 - DNA, 25 bp, Homo sapien
gcacatctggatggaagcgagcttt

SEQ ID NO: 212556 - DNA, 25 bp, Homo sapien
agcgagctttgtccagaccaccatg

SEQ ID NO: 212557 - DNA, 25 bp, Homo sapien
ctggggctgtcctccaagaaagcgt

SEQ ID NO: 212558 - DNA, 25 bp, Homo sapien
aaagcgtcctctcgcaacgtggctg

SEQ ID NO: 212559 - DNA, 25 bp, Homo sapien
agaagttccgcatcgtctacgcgca

SEQ ID NO: 212560 - DNA, 25 bp, Homo sapien
ttcacgcagaggtgagcggctccat

SEQ ID NO: 212561 - DNA, 25 bp, Homo sapien
caagctacgactacctgacggacga

SEQ ID NO: 212562 - DNA, 25 bp, Homo sapien
gtcaccgatgaggacagctggtaca

SEQ ID NO: 212563 - DNA, 25 bp, Homo sapien
agctggtacagcaagtggcacaaga

SEQ ID NO: 212564 - DNA, 25 bp, Homo sapien
ccgtggtcatcgattacacgcccta

SEQ ID NO: 212565 - DNA, 25 bp, Homo sapien
tggcacaagatggagcagaagttcc

SEQ ID NO: 212566 - DNA, 25 bp, Homo sapien
acgccctacctaaagttcacgcaga

SEQ ID NO: 212567 - DNA, 25 bp, Homo sapien
taggaacgtaggaccaggacgtctc

SEQ ID NO: 212568 - DNA, 25 bp, Homo sapien
taggagccagggtccttccctcgtc

SEQ ID NO: 212569 - DNA, 25 bp, Homo sapien
cctacctggctctaggctggtgctc

SEQ ID NO: 212570 - DNA, 25 bp, Homo sapien
aacagatccggtgaccaagaagggc

SEQ ID NO: 212571 - DNA, 25 bp, Homo sapien
tcgagggtgacgtgtaaacagatcc

SEQ ID NO: 212572 - DNA, 25 bp, Homo sapien
cccaaaatcagagtacctgtgctgc

SEQ ID NO: 212573 - DNA, 25 bp, Homo sapien
acctcctacgtgcaggcgcggattt

SEQ ID NO: 212574 - DNA, 25 bp, Homo sapien
aggccgacgccgaaagcagccaagg

SEQ ID NO: 212575 - DNA, 25 bp, Homo sapien
atcgacgttttggtgttggttgctc

SEQ ID NO: 212576 - DNA, 25 bp, Homo sapien
gcctgcaactgcaaaacgctttgta

SEQ ID NO: 212577 - DNA, 25 bp, Homo sapien
gacttgaaaacttcgcggcgacttc

SEQ ID NO: 212578 - DNA, 25 bp, Homo sapien
ccactgggttagctgagctgcagcc

SEQ ID NO: 212579 - DNA, 25 bp, Homo sapien
tcaggttacaggacaggcctgcaac

SEQ ID NO: 212580 - DNA, 25 bp, Homo sapien
agatcccaccttcgcgtgaccttgg

SEQ ID NO: 212581 - DNA, 25 bp, Homo sapien
gggcaaatcacaacctcgcctaagg

SEQ ID NO: 212582 - DNA, 25 bp, Homo sapien
aaggcccggaatgactctgcgcgga

SEQ ID NO: 212583 - DNA, 25 bp, Homo sapien
tggtccaccgactgcgacagcagga

SEQ ID NO: 212584 - DNA, 25 bp, Homo sapien
acgttgcggtagacgttgtccttga

SEQ ID NO: 212585 - DNA, 25 bp, Homo sapien
gcacagggatggtgactgagccact

SEQ ID NO: 212586 - DNA, 25 bp, Homo sapien
tggactcgttgaatagcacagggat

SEQ ID NO: 212587 - DNA, 25 bp, Homo sapien
agcagcttcttctcggtcagggcct

SEQ ID NO: 212588 - DNA, 25 bp, Homo sapien
gcccgcctgcaggtcgatgtaagag

SEQ ID NO: 212589 - DNA, 25 bp, Homo sapien
acatctacgcccgagtccaggctgg

SEQ ID NO: 212590 - DNA, 25 bp, Homo sapien
tcagcgagttgtcctccggagagca

SEQ ID NO: 212591 - DNA, 25 bp, Homo sapien
tcttcggtagacaatggctcaggca

SEQ ID NO: 212592 - DNA, 25 bp, Homo sapien
actcaattcacgaacgccgcgaaga

SEQ ID NO: 212593 - DNA, 25 bp, Homo sapien
ccagggaacagaataccactcaatt

SEQ ID NO: 212594 - DNA, 25 bp, Homo sapien
ccacccgaatccagggaacagaata

SEQ ID NO: 212595 - DNA, 25 bp, Homo sapien
ctaggccgggccctagcggtccatg

SEQ ID NO: 212596 - DNA, 25 bp, Homo sapien
tcggtagacaatggctcaggcagca

SEQ ID NO: 212597 - DNA, 25 bp, Homo sapien
agcgcgattgtctccgaccggagcc

SEQ ID NO: 212598 - DNA, 25 bp, Homo sapien
ggggaccctcgcactacccattgtg

SEQ ID NO: 212599 - DNA, 25 bp, Homo sapien
ttctcgtgcagcaaaagacggtcca

SEQ ID NO: 212600 - DNA, 25 bp, Homo sapien
ccagactccacagcttgttgccgtg

SEQ ID NO: 212601 - DNA, 25 bp, Homo sapien
gttcgagtagatccacagggtgacc

SEQ ID NO: 212602 - DNA, 25 bp, Homo sapien
aacgccttgtggtggacccactgca

SEQ ID NO: 212603 - DNA, 25 bp, Homo sapien
ggttgaccaggtccacgaagatgtc

SEQ ID NO: 212604 - DNA, 25 bp, Homo sapien
cgctgagcccacacttgtagaggta

SEQ ID NO: 212605 - DNA, 25 bp, Homo sapien
actcgatgtggttgtcctgcaggta

SEQ ID NO: 212606 - DNA, 25 bp, Homo sapien
acccactgcagctggttctcgtgca

SEQ ID NO: 212607 - DNA, 25 bp, Homo sapien
tgctctcggacctgagcgccttcgg

SEQ ID NO: 212608 - DNA, 25 bp, Homo sapien
ctcatccacgggagacggaagtctt

SEQ ID NO: 212609 - DNA, 25 bp, Homo sapien
agcagccgctttcagccactgtgtg

SEQ ID NO: 212610 - DNA, 25 bp, Homo sapien
gccactgtgtgtgcgtccggactct

SEQ ID NO: 212611 - DNA, 25 bp, Homo sapien
actcagcggtccgagtccgtggcag

SEQ ID NO: 212612 - DNA, 25 bp, Homo sapien
agacggaagtcttggccctgctccg

SEQ ID NO: 212613 - DNA, 25 bp, Homo sapien
cgccatgaagcgctcggggactctg

SEQ ID NO: 212614 - DNA, 25 bp, Homo sapien
cgagaatcgggcctcgccctgctgg

SEQ ID NO: 212615 - DNA, 25 bp, Homo sapien
ttttgctccctactcgcctgagtga

SEQ ID NO: 212616 - DNA, 25 bp, Homo sapien
cggatgggcacgtacctaagaaata

SEQ ID NO: 212617 - DNA, 25 bp, Homo sapien
tttctaggacgttccagtgctgcca

SEQ ID NO: 212618 - DNA, 25 bp, Homo sapien
caggtcgtagctggcgcttactaaa

SEQ ID NO: 212619 - DNA, 25 bp, Homo sapien
ttttccacgtaaatgcggctcaggg

SEQ ID NO: 212620 - DNA, 25 bp, Homo sapien
ctgggcggtaactcgagaaaatatc

SEQ ID NO: 212621 - DNA, 25 bp, Homo sapien
aaagcagctacctacgggcgtcttc

SEQ ID NO: 212622 - DNA, 25 bp, Homo sapien
ttcgggtctcatcacctggaaggca

SEQ ID NO: 212623 - DNA, 25 bp, Homo sapien
tcggcgacgcccgtgtttacctgaa

SEQ ID NO: 212624 - DNA, 25 bp, Homo sapien
ctggttcgcaagtcggagcaaaact

SEQ ID NO: 212625 - DNA, 25 bp, Homo sapien
atccgatgccaaacaggcggaagcc

SEQ ID NO: 212626 - DNA, 25 bp, Homo sapien
agccgggaggcctcttgagaaagca

SEQ ID NO: 212627 - DNA, 25 bp, Homo sapien
aggttctgggctagaccagcgcctt

SEQ ID NO: 212628 - DNA, 25 bp, Homo sapien
tgaaagtctcggtcttcgttgaagc

SEQ ID NO: 212629 - DNA, 25 bp, Homo sapien
tcaggacgacgctctccggttcgct

SEQ ID NO: 212630 - DNA, 25 bp, Homo sapien
tcaggcccggttccgaaatccgatg

SEQ ID NO: 212631 - DNA, 25 bp, Homo sapien
atcatttttctgtcgggctgctaca

SEQ ID NO: 212632 - DNA, 25 bp, Homo sapien
tacttggtagacatgcagcgcttcc

SEQ ID NO: 212633 - DNA, 25 bp, Homo sapien
cttctcacaggaggagacgcgtttc

SEQ ID NO: 212634 - DNA, 25 bp, Homo sapien
cgcggcccgatggttccatgttctt

SEQ ID NO: 212635 - DNA, 25 bp, Homo sapien
acccagagcggcctatcatttttct

SEQ ID NO: 212636 - DNA, 25 bp, Homo sapien
cttctccgaggacggttaccgcacg

SEQ ID NO: 212637 - DNA, 25 bp, Homo sapien
ggtgccatcctatctcagctacaag

SEQ ID NO: 212638 - DNA, 25 bp, Homo sapien
ctacaagtttctgggcgagcgtgat

SEQ ID NO: 212639 - DNA, 25 bp, Homo sapien
gtgctgcagcccaaagtcgcgttcc

SEQ ID NO: 212640 - DNA, 25 bp, Homo sapien
aatcgctgttggaacctcggcgccg

SEQ ID NO: 212641 - DNA, 25 bp, Homo sapien
atatttcctattcccgtgtgctgca

SEQ ID NO: 212642 - DNA, 25 bp, Homo sapien
cctcgtgaccactttctgatatttc

SEQ ID NO: 212643 - DNA, 25 bp, Homo sapien
ccgaacagccgaggtagaacaggtg

SEQ ID NO: 212644 - DNA, 25 bp, Homo sapien
cccacattcgtgtcctctgagaggg

SEQ ID NO: 212645 - DNA, 25 bp, Homo sapien
catttactttgagcgggaaaagctc

SEQ ID NO: 212646 - DNA, 25 bp, Homo sapien
cggccagacttgcaagaggcgacga

SEQ ID NO: 212647 - DNA, 25 bp, Homo sapien
agcgcgtcttcgcatacgtgcggtc

SEQ ID NO: 212648 - DNA, 25 bp, Homo sapien
aagcccaggcccgtaagtgcaaaga

SEQ ID NO: 212649 - DNA, 25 bp, Homo sapien
atcgccttcgccaggggctatcgcg

SEQ ID NO: 212650 - DNA, 25 bp, Homo sapien
ctagggcgcctaccgcagtgcctga

SEQ ID NO: 212651 - DNA, 25 bp, Homo sapien
aggtccaccgcgcatgcctgaagag

SEQ ID NO: 212652 - DNA, 25 bp, Homo sapien
taagtgcaaagagcgcagccgtgtc

SEQ ID NO: 212653 - DNA, 25 bp, Homo sapien
gccggcttgagagttttgtgctttc

SEQ ID NO: 212654 - DNA, 25 bp, Homo sapien
tgctttctagatgaagcgcgtcttc

SEQ ID NO: 212655 - DNA, 25 bp, Homo sapien
cgcgaatgtaatacggaggcctctg

SEQ ID NO: 212656 - DNA, 25 bp, Homo sapien
gctcatggagctcgcgaatgtaata

SEQ ID NO: 212657 - DNA, 25 bp, Homo sapien
tgtagctgccctgagataaccagga

SEQ ID NO: 212658 - DNA, 25 bp, Homo sapien
cgcggccgaaaacgccaagagattg

SEQ ID NO: 212659 - DNA, 25 bp, Homo sapien
ggagccggcatttgatgagcgaacc

SEQ ID NO: 212660 - DNA, 25 bp, Homo sapien
ccaaggacaccgtagggcggatctc

SEQ ID NO: 212661 - DNA, 25 bp, Homo sapien
tggagccggcaggaaatttaaactg

SEQ ID NO: 212662 - DNA, 25 bp, Homo sapien
atctcgcagctacggcgttctttta

SEQ ID NO: 212663 - DNA, 25 bp, Homo sapien
gccaccttttcctgcagtgctcggg

SEQ ID NO: 212664 - DNA, 25 bp, Homo sapien
gacccgtagcgaaggtgcaagaaat

SEQ ID NO: 212665 - DNA, 25 bp, Homo sapien
aagaaatcccagaggcgtagagccc

SEQ ID NO: 212666 - DNA, 25 bp, Homo sapien
tagagcccggcgttcgccaagagcc

SEQ ID NO: 212667 - DNA, 25 bp, Homo sapien
agcttccacagcctggggtcaagcg

SEQ ID NO: 212668 - DNA, 25 bp, Homo sapien
agcctctctggggtaccacgacaga

SEQ ID NO: 212669 - DNA, 25 bp, Homo sapien
ccctacaaatctacgagtcctcgga

SEQ ID NO: 212670 - DNA, 25 bp, Homo sapien
ccgcacctgccgaggagacttcgag

SEQ ID NO: 212671 - DNA, 25 bp, Homo sapien
ggcatccatcctgcctgactcgagg

SEQ ID NO: 212672 - DNA, 25 bp, Homo sapien
agcatcgacgagtacaaccagtttc

SEQ ID NO: 212673 - DNA, 25 bp, Homo sapien
caggtggcaactgctgcaagaaatg

SEQ ID NO: 212674 - DNA, 25 bp, Homo sapien
aagaaatgcaccctgactcacgacg

SEQ ID NO: 212675 - DNA, 25 bp, Homo sapien
tgctgtcgccgctgcaaggtaagca

SEQ ID NO: 212676 - DNA, 25 bp, Homo sapien
gcttgatgcgaagacagcgccaatg

SEQ ID NO: 212677 - DNA, 25 bp, Homo sapien
aagttctcgcgctgtagcatcgacg

SEQ ID NO: 212678 - DNA, 25 bp, Homo sapien
ggagcgattggaggccttcatataa

SEQ ID NO: 212679 - DNA, 25 bp, Homo sapien
cctcgcccgctcaggccacgtcctt

SEQ ID NO: 212680 - DNA, 25 bp, Homo sapien
acgtccttctcgactgccctgctgc

SEQ ID NO: 212681 - DNA, 25 bp, Homo sapien
gaggaaggtacgacccgacccagca

SEQ ID NO: 212682 - DNA, 25 bp, Homo sapien
cggccacgtcatccctcccgctgtc

SEQ ID NO: 212683 - DNA, 25 bp, Homo sapien
gtccttgtctcctccatctcattcg

SEQ ID NO: 212684 - DNA, 25 bp, Homo sapien
tcgtcaccccgcgttctgttgatgg

SEQ ID NO: 212685 - DNA, 25 bp, Homo sapien
agagcctcgctcagggaagaaggtc

SEQ ID NO: 212686 - DNA, 25 bp, Homo sapien
ctcagggaagaaggtcccagctgcc

SEQ ID NO: 212687 - DNA, 25 bp, Homo sapien
agcgccaactttccgcggtcgagtc

SEQ ID NO: 212688 - DNA, 25 bp, Homo sapien
gggaagcgacgcgagcgccaacttt

SEQ ID NO: 212689 - DNA, 25 bp, Homo sapien
gagtcctcgccgctctctcggatag

SEQ ID NO: 212690 - DNA, 25 bp, Homo sapien
ctctctcggatagtccgggacgcgg

SEQ ID NO: 212691 - DNA, 25 bp, Homo sapien
agtcacccgcgtggagtctggaccc

SEQ ID NO: 212692 - DNA, 25 bp, Homo sapien
cgcagacttcgctccggacagttca

SEQ ID NO: 212693 - DNA, 25 bp, Homo sapien
cggacagttcattcttccaagctga

SEQ ID NO: 212694 - DNA, 25 bp, Homo sapien
agacaaagagcagcccgcgaagagc

SEQ ID NO: 212695 - DNA, 25 bp, Homo sapien
gggcagtgtggtgtatctctctcca

SEQ ID NO: 212696 - DNA, 25 bp, Homo sapien
gtttctgggctgctgcgcatttaca

SEQ ID NO: 212697 - DNA, 25 bp, Homo sapien
ctgcgcatttacacagttggggaaa

SEQ ID NO: 212698 - DNA, 25 bp, Homo sapien
gggaaaacgctacccgccagcctga

SEQ ID NO: 212699 - DNA, 25 bp, Homo sapien
gcagggccgggctttattaatatgc

SEQ ID NO: 212700 - DNA, 25 bp, Homo sapien
tatgctaattgtcctgctagtggga

SEQ ID NO: 212701 - DNA, 25 bp, Homo sapien
agagccgtgtcaaagtgacccggga

SEQ ID NO: 212702 - DNA, 25 bp, Homo sapien
cggcatgcatgtgacgcagctttta

SEQ ID NO: 212703 - DNA, 25 bp, Homo sapien
gtcatccgtctccaacttctgagga

SEQ ID NO: 212704 - DNA, 25 bp, Homo sapien
aactctgtcccagttgcctggcaac

SEQ ID NO: 212705 - DNA, 25 bp, Homo sapien
accgaggtgttacaactctgtccca

SEQ ID NO: 212706 - DNA, 25 bp, Homo sapien
cggccctcaccgaggtgttacaact

SEQ ID NO: 212707 - DNA, 25 bp, Homo sapien
tgcagagggaaaccaatgtcatccg

SEQ ID NO: 212708 - DNA, 25 bp, Homo sapien
agacccggagcagccagcagattaa

SEQ ID NO: 212709 - DNA, 25 bp, Homo sapien
gggaaaccaatgtcatccgtctcca

SEQ ID NO: 212710 - DNA, 25 bp, Homo sapien
ggagcagccagcagattaaaaaccc

SEQ ID NO: 212711 - DNA, 25 bp, Homo sapien
atcacgtggtcaggctgttagcgca

SEQ ID NO: 212712 - DNA, 25 bp, Homo sapien
acgaatctgatcaggcgcctcggga

SEQ ID NO: 212713 - DNA, 25 bp, Homo sapien
ccaagacgtgggctgctccaaagag

SEQ ID NO: 212714 - DNA, 25 bp, Homo sapien
cccaagacgagtagcccaagacgtg

SEQ ID NO: 212715 - DNA, 25 bp, Homo sapien
cctgaggaccagttccgaggtatgc

SEQ ID NO: 212716 - DNA, 25 bp, Homo sapien
gaggacaaccctctgcctgaggacc

SEQ ID NO: 212717 - DNA, 25 bp, Homo sapien
tgctcagctaagagttcccaggccg

SEQ ID NO: 212718 - DNA, 25 bp, Homo sapien
ttgctaggcaaccacagctgcgggc

SEQ ID NO: 212719 - DNA, 25 bp, Homo sapien
ctctccagggactcgttctgtggga

SEQ ID NO: 212720 - DNA, 25 bp, Homo sapien
caactggcgccggtagtcgttggct

SEQ ID NO: 212721 - DNA, 25 bp, Homo sapien
caggtcaaggactgcaactggcgcc

SEQ ID NO: 212722 - DNA, 25 bp, Homo sapien
accgtgccgcgcagagactccaggt

SEQ ID NO: 212723 - DNA, 25 bp, Homo sapien
tcctgctcgcgcatctgcctctcca

SEQ ID NO: 212724 - DNA, 25 bp, Homo sapien
cgcgccagcgcctcctgataactgg

SEQ ID NO: 212725 - DNA, 25 bp, Homo sapien
gcagagactccaggtcgcaggtcaa

SEQ ID NO: 212726 - DNA, 25 bp, Homo sapien
gccggtagtcgttggcttcgtgctt

SEQ ID NO: 212727 - DNA, 25 bp, Homo sapien
gcaccttgacgtccagcacaaaaga

SEQ ID NO: 212728 - DNA, 25 bp, Homo sapien
caaagtgttgcgagagccgttcaca

SEQ ID NO: 212729 - DNA, 25 bp, Homo sapien
aggcccagtctaggtccagcataga

SEQ ID NO: 212730 - DNA, 25 bp, Homo sapien
cgcccagtttaaaggggtccatgca

SEQ ID NO: 212731 - DNA, 25 bp, Homo sapien
cgtatcgctgattggctgtttccta

SEQ ID NO: 212732 - DNA, 25 bp, Homo sapien
gccgttcacagtgggcttgctcact

SEQ ID NO: 212733 - DNA, 25 bp, Homo sapien
gccggaccgtgcttcctattggtca

SEQ ID NO: 212734 - DNA, 25 bp, Homo sapien
acccggcgccttgcgttcaaattag

SEQ ID NO: 212735 - DNA, 25 bp, Homo sapien
ttgtacaaatatatagcgcgggctg

SEQ ID NO: 212736 - DNA, 25 bp, Homo sapien
tctcagagcgcaggaagcaaacccg

SEQ ID NO: 212737 - DNA, 25 bp, Homo sapien
gtgggcagtaaacagtcctattgta

SEQ ID NO: 212738 - DNA, 25 bp, Homo sapien
gcgtccaggtgcaggatcacgctgt

SEQ ID NO: 212739 - DNA, 25 bp, Homo sapien
tgaagccagagaacgtgctgtattt

SEQ ID NO: 212740 - DNA, 25 bp, Homo sapien
gtatttgttgctgttgccgccgtgt

SEQ ID NO: 212741 - DNA, 25 bp, Homo sapien
gctttgcctccatccagcttgatga

SEQ ID NO: 212742 - DNA, 25 bp, Homo sapien
cgcgtcctgggcaatagcactggcc

SEQ ID NO: 212743 - DNA, 25 bp, Homo sapien
taggcgcccgcgctcaaggacggtc

SEQ ID NO: 212744 - DNA, 25 bp, Homo sapien
accagcacggggatgagcaccacca

SEQ ID NO: 212745 - DNA, 25 bp, Homo sapien
aatgttgcacgtaaacttgccgctg

SEQ ID NO: 212746 - DNA, 25 bp, Homo sapien
cgcgtcgtagttgttgcctaggttg

SEQ ID NO: 212747 - DNA, 25 bp, Homo sapien
cagcatctcatagtggccttccggg

SEQ ID NO: 212748 - DNA, 25 bp, Homo sapien
gcggccgctagcagcgtctttcggc

SEQ ID NO: 212749 - DNA, 25 bp, Homo sapien
tgccgggaatgttgcacgtaaactt

SEQ ID NO: 212750 - DNA, 25 bp, Homo sapien
gtcgtcaaacttgagtacctcgtaa

SEQ ID NO: 212751 - DNA, 25 bp, Homo sapien
ggggcatccaagaggcgcgctcgca

SEQ ID NO: 212752 - DNA, 25 bp, Homo sapien
gcctcccgctccgaaaaagctcctg

SEQ ID NO: 212753 - DNA, 25 bp, Homo sapien
ttctccctagtacgctcgctcgggg

SEQ ID NO: 212754 - DNA, 25 bp, Homo sapien
gtcagcctgggatttgcacggaccc

SEQ ID NO: 212755 - DNA, 25 bp, Homo sapien
cggtcgtcagcctgggatttgcacg

SEQ ID NO: 212756 - DNA, 25 bp, Homo sapien
ccaagagcgacagggctggtgaccc

SEQ ID NO: 212757 - DNA, 25 bp, Homo sapien
cccaccaagagcgacagggctggtg

SEQ ID NO: 212758 - DNA, 25 bp, Homo sapien
gctcggctgtcaggcaatccggtcc

SEQ ID NO: 212759 - DNA, 25 bp, Homo sapien
ttgcagcaactaaatatttggtttc

SEQ ID NO: 212760 - DNA, 25 bp, Homo sapien
gcctgtgtactaggctagaaaaccc

SEQ ID NO: 212761 - DNA, 25 bp, Homo sapien
acctccaccgcggagtgtgagcctg

SEQ ID NO: 212762 - DNA, 25 bp, Homo sapien
agccgcggctttagctcagctcagc

SEQ ID NO: 212763 - DNA, 25 bp, Homo sapien
cttcaattaaaagcgaaaagcgagg

SEQ ID NO: 212764 - DNA, 25 bp, Homo sapien
atatttggtttctgcctttgcccgc

SEQ ID NO: 212765 - DNA, 25 bp, Homo sapien
acactggccgggtaattgatctgga

SEQ ID NO: 212766 - DNA, 25 bp, Homo sapien
tctggaggtgccaatttgcagcaac

SEQ ID NO: 212767 - DNA, 25 bp, Homo sapien
tgtgcgtcttcaccctcgctggtgt

SEQ ID NO: 212768 - DNA, 25 bp, Homo sapien
ccttttgagttagcgctcagggtca

SEQ ID NO: 212769 - DNA, 25 bp, Homo sapien
ggcgaacaacgcaccttttgagtta

SEQ ID NO: 212770 - DNA, 25 bp, Homo sapien
ctcagaggacgtgggcgaacaacgc

SEQ ID NO: 212771 - DNA, 25 bp, Homo sapien
ctccgggtgctaaggcccaaagtga

SEQ ID NO: 212772 - DNA, 25 bp, Homo sapien
cttattgctccgctccgggtgctaa

SEQ ID NO: 212773 - DNA, 25 bp, Homo sapien
accctcgctggtgtcttattgctcc

SEQ ID NO: 212774 - DNA, 25 bp, Homo sapien
gcccagaaggcgtgtgcgtcttcac

SEQ ID NO: 212775 - DNA, 25 bp, Homo sapien
gaacgtctccttcatcatctccttg

SEQ ID NO: 212776 - DNA, 25 bp, Homo sapien
tcatctccttgcgaatctcggggtg

SEQ ID NO: 212777 - DNA, 25 bp, Homo sapien
tgccgccggtcaggctggttaaaga

SEQ ID NO: 212778 - DNA, 25 bp, Homo sapien
gccgttctccagcaagacctcagtg

SEQ ID NO: 212779 - DNA, 25 bp, Homo sapien
gcaagacctcagtgccgaagacctc

SEQ ID NO: 212780 - DNA, 25 bp, Homo sapien
tgccgaagacctctacgatgcgccg

SEQ ID NO: 212781 - DNA, 25 bp, Homo sapien
ccaggaccttgcgatttatgtcgcc

SEQ ID NO: 212782 - DNA, 25 bp, Homo sapien
gaggaagtacttgaacgtctccttc

SEQ ID NO: 212783 - DNA, 25 bp, Homo sapien
gcagttcccttttcggagccacgtg

SEQ ID NO: 212784 - DNA, 25 bp, Homo sapien
cttgcagtgtcattcgggagttgta

SEQ ID NO: 212785 - DNA, 25 bp, Homo sapien
gacctccatgtaaggatgcccagtg

SEQ ID NO: 212786 - DNA, 25 bp, Homo sapien
tctagtatcggccttggagcctggc

SEQ ID NO: 212787 - DNA, 25 bp, Homo sapien
tgtcggaaacataacccgcggctgg

SEQ ID NO: 212788 - DNA, 25 bp, Homo sapien
gcagcgtctctacggccattcctgg

SEQ ID NO: 212789 - DNA, 25 bp, Homo sapien
ccttcttccagggtgcaagtgggtc

SEQ ID NO: 212790 - DNA, 25 bp, Homo sapien
tttcccgggagaacttgtctgcctc

SEQ ID NO: 212791 - DNA, 25 bp, Homo sapien
ctaggccgcgaaattgggtcgcccg

SEQ ID NO: 212792 - DNA, 25 bp, Homo sapien
ccggctggctctcaccggcccgcgt

SEQ ID NO: 212793 - DNA, 25 bp, Homo sapien
ccgcgtggcgcgctacgtacccagc

SEQ ID NO: 212794 - DNA, 25 bp, Homo sapien
aggcctccgcctctagcccaatctc

SEQ ID NO: 212795 - DNA, 25 bp, Homo sapien
tctagcccaatctccgcagcgctta

SEQ ID NO: 212796 - DNA, 25 bp, Homo sapien
atctccgcagcgcttacaggccggc

SEQ ID NO: 212797 - DNA, 25 bp, Homo sapien
cgcagcgcttacaggccggctcagc

SEQ ID NO: 212798 - DNA, 25 bp, Homo sapien
ccactaggccgcgaaattgggtcgc

SEQ ID NO: 212799 - DNA, 25 bp, Homo sapien
ctgggatccgttccctctcgcggga

SEQ ID NO: 212800 - DNA, 25 bp, Homo sapien
actttacagacgtgaacgctgaggc

SEQ ID NO: 212801 - DNA, 25 bp, Homo sapien
ctcctcgcaggccttctggggaaag

SEQ ID NO: 212802 - DNA, 25 bp, Homo sapien
tctgcgagggccctaaaaacgctgg

SEQ ID NO: 212803 - DNA, 25 bp, Homo sapien
gcactttcccggcagccgaagacga

SEQ ID NO: 212804 - DNA, 25 bp, Homo sapien
ccggcctcattaccgagggagagct

SEQ ID NO: 212805 - DNA, 25 bp, Homo sapien
gctgtcgcattgatccggagctgca

SEQ ID NO: 212806 - DNA, 25 bp, Homo sapien
cccgcgctgagagatcggggttacc

SEQ ID NO: 212807 - DNA, 25 bp, Homo sapien
gtttcctgggaaagagtcgctccta

SEQ ID NO: 212808 - DNA, 25 bp, Homo sapien
taacggtccttaacggcagccaata

SEQ ID NO: 212809 - DNA, 25 bp, Homo sapien
cactggcaagggcaggctgaaatca

SEQ ID NO: 212810 - DNA, 25 bp, Homo sapien
tttcctcaaagcgtggccgaatgcc

SEQ ID NO: 212811 - DNA, 25 bp, Homo sapien
agccgtccctcgtgattcctgggta

SEQ ID NO: 212812 - DNA, 25 bp, Homo sapien
acggccatgagcactgcagcgattg

SEQ ID NO: 212813 - DNA, 25 bp, Homo sapien
tggcagctcgcttcgccagaaaaac

SEQ ID NO: 212814 - DNA, 25 bp, Homo sapien
cgaatgcctaggcttccgggtatca

SEQ ID NO: 212815 - DNA, 25 bp, Homo sapien
tgccacgtgcgcgagcggatcttgc

SEQ ID NO: 212816 - DNA, 25 bp, Homo sapien
ggagcttggtcagaccgcgcaccca

SEQ ID NO: 212817 - DNA, 25 bp, Homo sapien
aggtccaggttcttgcggcggccct

SEQ ID NO: 212818 - DNA, 25 bp, Homo sapien
cctcgatgtgctgcacgaagactga

SEQ ID NO: 212819 - DNA, 25 bp, Homo sapien
atgtgctgcacgaagactgagagga

SEQ ID NO: 212820 - DNA, 25 bp, Homo sapien
ctcacagatgtgctgcgatggcgca

SEQ ID NO: 212821 - DNA, 25 bp, Homo sapien
gtacagccgctccttgtgccacgtg

SEQ ID NO: 212822 - DNA, 25 bp, Homo sapien
tggaaccacacgctcaggccgtcct

SEQ ID NO: 212823 - DNA, 25 bp, Homo sapien
cgagcctctgatcttggccgcaagg

SEQ ID NO: 212824 - DNA, 25 bp, Homo sapien
ttcgaggcttggacaggccggcacc

SEQ ID NO: 212825 - DNA, 25 bp, Homo sapien
cccagcaactggttctgggttcgag

SEQ ID NO: 212826 - DNA, 25 bp, Homo sapien
gcagtgacgtcataggattaacctc

SEQ ID NO: 212827 - DNA, 25 bp, Homo sapien
gccctgactcgaggctgacgcagga

SEQ ID NO: 212828 - DNA, 25 bp, Homo sapien
gcaccggggacgagggccatcctct

SEQ ID NO: 212829 - DNA, 25 bp, Homo sapien
ttggccgcaagggtgactagagccc

SEQ ID NO: 212830 - DNA, 25 bp, Homo sapien
ccacagtctcggagctgacggacct

SEQ ID NO: 212831 - DNA, 25 bp, Homo sapien
gtcttggctcaagcctcggtccggc

SEQ ID NO: 212832 - DNA, 25 bp, Homo sapien
cgtccgtgggccgtcttggctcaag

SEQ ID NO: 212833 - DNA, 25 bp, Homo sapien
gtccggcctgtattcagtggcgaaa

SEQ ID NO: 212834 - DNA, 25 bp, Homo sapien
tattcagtggcgaaactggccgctc

SEQ ID NO: 212835 - DNA, 25 bp, Homo sapien
aaactggccgctctgagggccgcct

SEQ ID NO: 212836 - DNA, 25 bp, Homo sapien
gtgccagcgcctccaagtccactgg

SEQ ID NO: 212837 - DNA, 25 bp, Homo sapien
cagcacaagccctgtcgtccgtggg

SEQ ID NO: 212838 - DNA, 25 bp, Homo sapien
ctcagctgcctcagttcccggtgcc

SEQ ID NO: 212839 - DNA, 25 bp, Homo sapien
aggcagcgtcatcggtagttttaac

SEQ ID NO: 212840 - DNA, 25 bp, Homo sapien
ggcgtcactgcaggaattacaaact

SEQ ID NO: 212841 - DNA, 25 bp, Homo sapien
ggcgcttaaccctttactgacttga

SEQ ID NO: 212842 - DNA, 25 bp, Homo sapien
tggccgagccattcttgtcagaata

SEQ ID NO: 212843 - DNA, 25 bp, Homo sapien
attacgtactgttcctgccgctgca

SEQ ID NO: 212844 - DNA, 25 bp, Homo sapien
ctgggtttcacgcactggacttacc

SEQ ID NO: 212845 - DNA, 25 bp, Homo sapien
ggcggggcgaaaaagcttctatata

SEQ ID NO: 212846 - DNA, 25 bp, Homo sapien
ttcgaggactctactagccatggcc

SEQ ID NO: 212847 - DNA, 25 bp, Homo sapien
gggtccagttgtgcctcctcacagc

SEQ ID NO: 212848 - DNA, 25 bp, Homo sapien
tgttgacgttacaggcccttggatc

SEQ ID NO: 212849 - DNA, 25 bp, Homo sapien
ccaccttagccggatctattttctg

SEQ ID NO: 212850 - DNA, 25 bp, Homo sapien
gctcggccgaggagactccaacctt

SEQ ID NO: 212851 - DNA, 25 bp, Homo sapien
agggaagccgtttcaccagcctctc

SEQ ID NO: 212852 - DNA, 25 bp, Homo sapien
tctccagtcgaagtgggagtccctc

SEQ ID NO: 212853 - DNA, 25 bp, Homo sapien
agctgactgccacgccgacttgtgg

SEQ ID NO: 212854 - DNA, 25 bp, Homo sapien
cccttggatcgcttttcaggccaga

SEQ ID NO: 212855 - DNA, 25 bp, Homo sapien
cttcgtcaggagaaccagatgtgga

SEQ ID NO: 212856 - DNA, 25 bp, Homo sapien
cggtgagttccagcggaaggacttc

SEQ ID NO: 212857 - DNA, 25 bp, Homo sapien
cttctctgagacttacgaacgcttc

SEQ ID NO: 212858 - DNA, 25 bp, Homo sapien
cttacgaacgcttccacaccgagag

SEQ ID NO: 212859 - DNA, 25 bp, Homo sapien
agctggtgcgagactacctggagct

SEQ ID NO: 212860 - DNA, 25 bp, Homo sapien
gccagcagtcctgccgccaggtgga

SEQ ID NO: 212861 - DNA, 25 bp, Homo sapien
ggaccgaaaaccagcggcttcgtca

SEQ ID NO: 212862 - DNA, 25 bp, Homo sapien
tgccgaggtccagaggctccggacc

SEQ ID NO: 212863 - DNA, 25 bp, Homo sapien
cagaagttcgaaaatcgccgagggg

SEQ ID NO: 212864 - DNA, 25 bp, Homo sapien
ccggaaagctggatttccgaggctg

SEQ ID NO: 212865 - DNA, 25 bp, Homo sapien
ggtctccgagccgtgctcgcagtcg

SEQ ID NO: 212866 - DNA, 25 bp, Homo sapien
gctcgcagtcgctgagatcctcggt

SEQ ID NO: 212867 - DNA, 25 bp, Homo sapien
ctgagatcctcggtgcggagaagat

SEQ ID NO: 212868 - DNA, 25 bp, Homo sapien
cagacccggccaatccctcgcccga

SEQ ID NO: 212869 - DNA, 25 bp, Homo sapien
gggagcgacagcagaagttcgaaaa

SEQ ID NO: 212870 - DNA, 25 bp, Homo sapien
tggaggagaggttcaaccgcgccct

SEQ ID NO: 212871 - DNA, 25 bp, Homo sapien
tccagtgtctgcaaggcctttacgc

SEQ ID NO: 212872 - DNA, 25 bp, Homo sapien
tcaggccctgacgtgcttaggtttc

SEQ ID NO: 212873 - DNA, 25 bp, Homo sapien
ctcagaggtggccaataagttcgcc

SEQ ID NO: 212874 - DNA, 25 bp, Homo sapien
ggcttcctgcgcgataaccaactct

SEQ ID NO: 212875 - DNA, 25 bp, Homo sapien
tggagcccaccctttccgttatgcg

SEQ ID NO: 212876 - DNA, 25 bp, Homo sapien
ccgctgctctgagaaaaggtacctc

SEQ ID NO: 212877 - DNA, 25 bp, Homo sapien
ttcgagcccgcttgtccactcatta

SEQ ID NO: 212878 - DNA, 25 bp, Homo sapien
ggtcgcttaccttcctccatgtctg

SEQ ID NO: 212879 - DNA, 25 bp, Homo sapien
gggcccacccaagtcaaggagctga

SEQ ID NO: 212880 - DNA, 25 bp, Homo sapien
cggggctcaccatgtgctggtgcta

SEQ ID NO: 212881 - DNA, 25 bp, Homo sapien
ggggatgctgtctccatcgagatcc

SEQ ID NO: 212882 - DNA, 25 bp, Homo sapien
ttcagcgaatcgaccgccatggggc

SEQ ID NO: 212883 - DNA, 25 bp, Homo sapien
agctgaggcttctaggcttgacatc

SEQ ID NO: 212884 - DNA, 25 bp, Homo sapien
tccatggccaagattgcagaactgg

SEQ ID NO: 212885 - DNA, 25 bp, Homo sapien
cttcgggacgcggagaacgaatcca

SEQ ID NO: 212886 - DNA, 25 bp, Homo sapien
tgctacagctgacagagcggcttcg

SEQ ID NO: 212887 - DNA, 25 bp, Homo sapien
ggacgcacctacttcgtgcagtttg

SEQ ID NO: 212888 - DNA, 25 bp, Homo sapien
ttccgctcagcaaacgctttacttg

SEQ ID NO: 212889 - DNA, 25 bp, Homo sapien
tgacgccataagtgacctcgcctta

SEQ ID NO: 212890 - DNA, 25 bp, Homo sapien
tttcgccctacccagtacttagtga

SEQ ID NO: 212891 - DNA, 25 bp, Homo sapien
agggctgcttcttcactagagttgg

SEQ ID NO: 212892 - DNA, 25 bp, Homo sapien
tagcaggcctctgcaaaccagcggg

SEQ ID NO: 212893 - DNA, 25 bp, Homo sapien
tcctagttggagaggtcgctgatgc

SEQ ID NO: 212894 - DNA, 25 bp, Homo sapien
gcccgctgcttcttgaagtagtagc

SEQ ID NO: 212895 - DNA, 25 bp, Homo sapien
cccggggtccagattcaaatccctg

SEQ ID NO: 212896 - DNA, 25 bp, Homo sapien
gaggctgcaagtgcaaaactttatc

SEQ ID NO: 212897 - DNA, 25 bp, Homo sapien
cagcaaagcaaaggtcccaggaggc

SEQ ID NO: 212898 - DNA, 25 bp, Homo sapien
gcctggccactcgatccatggagaa

SEQ ID NO: 212899 - DNA, 25 bp, Homo sapien
gtgtctcacaactggccgctgacgg

SEQ ID NO: 212900 - DNA, 25 bp, Homo sapien
tcacctttgcgaagcatgttggcca

SEQ ID NO: 212901 - DNA, 25 bp, Homo sapien
gctgcagctaatccgagcgcgtcga

SEQ ID NO: 212902 - DNA, 25 bp, Homo sapien
ccggagcgcattcaacttcaacttg

SEQ ID NO: 212903 - DNA, 25 bp, Homo sapien
gcgggtcgacctgcctttcaggtgc

SEQ ID NO: 212904 - DNA, 25 bp, Homo sapien
ggacaggacttgcacccgctctgca

SEQ ID NO: 212905 - DNA, 25 bp, Homo sapien
gcatgcgtgtccgtgagagcacatg

SEQ ID NO: 212906 - DNA, 25 bp, Homo sapien
ccatgcagaccgaggctctgtcctg

SEQ ID NO: 212907 - DNA, 25 bp, Homo sapien
ctggaaatattagaggcgccggtgc

SEQ ID NO: 212908 - DNA, 25 bp, Homo sapien
tgatgtcgccgcctctgtgacgtcc

SEQ ID NO: 212909 - DNA, 25 bp, Homo sapien
cgcctccagtgtgctctttggctga

SEQ ID NO: 212910 - DNA, 25 bp, Homo sapien
taagcctggctgtgctggacaggac

SEQ ID NO: 212911 - DNA, 25 bp, Homo sapien
ccagggcgcactcctgcaggagaca

SEQ ID NO: 212912 - DNA, 25 bp, Homo sapien
agctgcgttctcgaggttacgggaa

SEQ ID NO: 212913 - DNA, 25 bp, Homo sapien
tctggcagtcttaccagctgcgttc

SEQ ID NO: 212914 - DNA, 25 bp, Homo sapien
tgggcactatttccggacgatgttt

SEQ ID NO: 212915 - DNA, 25 bp, Homo sapien
taacgaggcctggtttccagaaatg

SEQ ID NO: 212916 - DNA, 25 bp, Homo sapien
cccgctccctagcaacgattggtta

SEQ ID NO: 212917 - DNA, 25 bp, Homo sapien
gccaaccaatgagacggtcgtcccg

SEQ ID NO: 212918 - DNA, 25 bp, Homo sapien
cctgccactgacttcggttaccttg

SEQ ID NO: 212919 - DNA, 25 bp, Homo sapien
ctcgcgggatgaggctgcggctcgc

SEQ ID NO: 212920 - DNA, 25 bp, Homo sapien
gggtccctgctgagtcacgcgcagc

SEQ ID NO: 212921 - DNA, 25 bp, Homo sapien
ctcagcccggaggtgccctcgcctg

SEQ ID NO: 212922 - DNA, 25 bp, Homo sapien
cgccgattggcgaggccgcattcct

SEQ ID NO: 212923 - DNA, 25 bp, Homo sapien
ttggcgaggccgcattcctgcgcgc

SEQ ID NO: 212924 - DNA, 25 bp, Homo sapien
gtccgggtgactcacggtgcaggca

SEQ ID NO: 212925 - DNA, 25 bp, Homo sapien
tgcaggcagctcaggaacgcccgct

SEQ ID NO: 212926 - DNA, 25 bp, Homo sapien
tcaggaacgcccgctcgcgggatga

SEQ ID NO: 212927 - DNA, 25 bp, Homo sapien
ctccggtgataacgtggacgtcctc

SEQ ID NO: 212928 - DNA, 25 bp, Homo sapien
cgctctgcaccgacatgcggttctg

SEQ ID NO: 212929 - DNA, 25 bp, Homo sapien
aggtgctcactgatggccgcaatga

SEQ ID NO: 212930 - DNA, 25 bp, Homo sapien
cgtcatccaggtcaaggcgctcatc

SEQ ID NO: 212931 - DNA, 25 bp, Homo sapien
gtggtccaccttatagcgtagcttc

SEQ ID NO: 212932 - DNA, 25 bp, Homo sapien
tggccaggtttccactgatgcggta

SEQ ID NO: 212933 - DNA, 25 bp, Homo sapien
ggctacgggtccctgctatgactcc

SEQ ID NO: 212934 - DNA, 25 bp, Homo sapien
gctggaagagcatccgcagagtgtc

SEQ ID NO: 212935 - DNA, 25 bp, Homo sapien
ggcagcctcaaagggcgactcccag

SEQ ID NO: 212936 - DNA, 25 bp, Homo sapien
gtgtgcgtctcccacaccgggctgg

SEQ ID NO: 212937 - DNA, 25 bp, Homo sapien
ggctgcctctctatgttcgcgtaca

SEQ ID NO: 212938 - DNA, 25 bp, Homo sapien
ctcccaggtggtaactcccgtgtct

SEQ ID NO: 212939 - DNA, 25 bp, Homo sapien
gcgggttgtagaagaacaccctgcg

SEQ ID NO: 212940 - DNA, 25 bp, Homo sapien
cccgtcagcgggttgtagaagaaca

SEQ ID NO: 212941 - DNA, 25 bp, Homo sapien
tctatgttcgcgtacacgggctccg

SEQ ID NO: 212942 - DNA, 25 bp, Homo sapien
tcccgtgtctgggttgtagtagtag

SEQ ID NO: 212943 - DNA, 25 bp, Homo sapien
cccttagtccgagggccttgctgta

SEQ ID NO: 212944 - DNA, 25 bp, Homo sapien
cgcccgcagagaatcagcagagggt

SEQ ID NO: 212945 - DNA, 25 bp, Homo sapien
atcagcagagggtctcgtagcactg

SEQ ID NO: 212946 - DNA, 25 bp, Homo sapien
gagggtctcgtagcactgcctccct

SEQ ID NO: 212947 - DNA, 25 bp, Homo sapien
tcagagttggaatgtgggctctgta

SEQ ID NO: 212948 - DNA, 25 bp, Homo sapien
cacgagtggctcctggagaatgcac

SEQ ID NO: 212949 - DNA, 25 bp, Homo sapien
ctctccggagtggtggtcataagcc

SEQ ID NO: 212950 - DNA, 25 bp, Homo sapien
ccagctgcatcaccgcagacgtgag

SEQ ID NO: 212951 - DNA, 25 bp, Homo sapien
ctgcatttaagcaagaccgctggtg

SEQ ID NO: 212952 - DNA, 25 bp, Homo sapien
aagccgggcagtctcagggtaacca

SEQ ID NO: 212953 - DNA, 25 bp, Homo sapien
cctaactcaccaagcggagcgagga

SEQ ID NO: 212954 - DNA, 25 bp, Homo sapien
agcctccgagccgacgatgcggtct

SEQ ID NO: 212955 - DNA, 25 bp, Homo sapien
ggtctctcggccactgacaacagga

SEQ ID NO: 212956 - DNA, 25 bp, Homo sapien
tgacgccatcacgttggctcggcgc

SEQ ID NO: 212957 - DNA, 25 bp, Homo sapien
tgtcagggagaacgcatccgttacc

SEQ ID NO: 212958 - DNA, 25 bp, Homo sapien
gggtcacgagtgaagctgcatttaa

SEQ ID NO: 212959 - DNA, 25 bp, Homo sapien
cccgcaatctgttgataactcggtc

SEQ ID NO: 212960 - DNA, 25 bp, Homo sapien
cggagctcgagccacatccaggcag

SEQ ID NO: 212961 - DNA, 25 bp, Homo sapien
gcccgagatggttgagtttggctcc

SEQ ID NO: 212962 - DNA, 25 bp, Homo sapien
agtggggcgcagattgatttttaaa

SEQ ID NO: 212963 - DNA, 25 bp, Homo sapien
atggagaaggagacgcatctgccgc

SEQ ID NO: 212964 - DNA, 25 bp, Homo sapien
tgaccgccgctgtcttcacagatgg

SEQ ID NO: 212965 - DNA, 25 bp, Homo sapien
ccgcgaggaaagcagctccgagtaa

SEQ ID NO: 212966 - DNA, 25 bp, Homo sapien
tccgagtaactttcggctccgctgg

SEQ ID NO: 212967 - DNA, 25 bp, Homo sapien
gcgggcccttgagtatgaccaatca

SEQ ID NO: 212968 - DNA, 25 bp, Homo sapien
tatgaccaatcagaatgcggactgc

SEQ ID NO: 212969 - DNA, 25 bp, Homo sapien
tcagaatgcggactgcgtcccaggg

SEQ ID NO: 212970 - DNA, 25 bp, Homo sapien
ccgcgttatatatcgcagtggctgc

SEQ ID NO: 212971 - DNA, 25 bp, Homo sapien
ggcagctttgcaagtccgcgttata

SEQ ID NO: 212972 - DNA, 25 bp, Homo sapien
gcagaggcgtatcttggtcgagatt

SEQ ID NO: 212973 - DNA, 25 bp, Homo sapien
atcttggtcgagattggatagcggc

SEQ ID NO: 212974 - DNA, 25 bp, Homo sapien
cgcaggaaagaggtcgcgccagccc

SEQ ID NO: 212975 - DNA, 25 bp, Homo sapien
agtgtatgagcaccagctatcctgc

SEQ ID NO: 212976 - DNA, 25 bp, Homo sapien
ccagctatcctgctgttccagcgcg

SEQ ID NO: 212977 - DNA, 25 bp, Homo sapien
agcaccagctatcctgctgttccag

SEQ ID NO: 212978 - DNA, 25 bp, Homo sapien
atgagcaccagctatcctgctgttc

SEQ ID NO: 212979 - DNA, 25 bp, Homo sapien
tgtatgagcaccagctatcctgctg

SEQ ID NO: 212980 - DNA, 25 bp, Homo sapien
aggaagtgtatgagcaccagctatc

SEQ ID NO: 212981 - DNA, 25 bp, Homo sapien
tcaggaagtgtatgagcaccagcta

SEQ ID NO: 212982 - DNA, 25 bp, Homo sapien
aaagagaatagagagccatgcagtc

SEQ ID NO: 212983 - DNA, 25 bp, Homo sapien
tcttggagaaatggacgtcgggttc

SEQ ID NO: 212984 - DNA, 25 bp, Homo sapien
ctttttgcccagagaattattattc

SEQ ID NO: 212985 - DNA, 25 bp, Homo sapien
tgaggatgatcgagacacccgatcc

SEQ ID NO: 212986 - DNA, 25 bp, Homo sapien
gagtcactctcgtcactgtagtctc

SEQ ID NO: 212987 - DNA, 25 bp, Homo sapien
gagaattattattcagtgtgtcctg

SEQ ID NO: 212988 - DNA, 25 bp, Homo sapien
ggcctcctcatattcctctccgatg

SEQ ID NO: 212989 - DNA, 25 bp, Homo sapien
tgatgatgcaggagaacagcccgaa

SEQ ID NO: 212990 - DNA, 25 bp, Homo sapien
actcatagggcgaggagacggaggc

SEQ ID NO: 212991 - DNA, 25 bp, Homo sapien
cctccctaacaatgggaatggggca

SEQ ID NO: 212992 - DNA, 25 bp, Homo sapien
ccctaacaatgggaatggggcagaa

SEQ ID NO: 212993 - DNA, 25 bp, Homo sapien
agcgcccactcgtaggcctgggacg

SEQ ID NO: 212994 - DNA, 25 bp, Homo sapien
tgccctccctaacaatgggaatggg

SEQ ID NO: 212995 - DNA, 25 bp, Homo sapien
ctgccctccctaacaatgggaatgg

SEQ ID NO: 212996 - DNA, 25 bp, Homo sapien
tctgccctccctaacaatgggaatg

SEQ ID NO: 212997 - DNA, 25 bp, Homo sapien
cggggcgcccctcctgaagcgagcc

SEQ ID NO: 212998 - DNA, 25 bp, Homo sapien
cctaacaatgggaatggggcagaag

SEQ ID NO: 212999 - DNA, 25 bp, Homo sapien
gttcgcacataggagagcaccggtc

SEQ ID NO: 213000 - DNA, 25 bp, Homo sapien
aactacagccttgtcttggcgggta

SEQ ID NO: 213001 - DNA, 25 bp, Homo sapien
ggggtaccagtcttttgcagcttta

SEQ ID NO: 213002 - DNA, 25 bp, Homo sapien
tagatcccgctgttagtcgccttgg

SEQ ID NO: 213003 - DNA, 25 bp, Homo sapien
ttttagtaccacatgcgcaggcagg

SEQ ID NO: 213004 - DNA, 25 bp, Homo sapien
cttccagcgctgtctttttagtacc

SEQ ID NO: 213005 - DNA, 25 bp, Homo sapien
gcacgaccgagagcagcccttaatc

SEQ ID NO: 213006 - DNA, 25 bp, Homo sapien
gcaactgcatagtcggggacctcta

SEQ ID NO: 213007 - DNA, 25 bp, Homo sapien
ggaggctgatcctttaccgcggccc

SEQ ID NO: 213008 - DNA, 25 bp, Homo sapien
aatcgctctaggctctcgggcagac

SEQ ID NO: 213009 - DNA, 25 bp, Homo sapien
atgtccgtaggacccgggcattcag

SEQ ID NO: 213010 - DNA, 25 bp, Homo sapien
cattcaggacggtagccgagcgagc

SEQ ID NO: 213011 - DNA, 25 bp, Homo sapien
tccgtctcgtcaaggtaacagcccg

SEQ ID NO: 213012 - DNA, 25 bp, Homo sapien
ggcagcctaactctctggacctttg

SEQ ID NO: 213013 - DNA, 25 bp, Homo sapien
ggctccgcgccaagaatcgctctag

SEQ ID NO: 213014 - DNA, 25 bp, Homo sapien
cggtccctctgggatgtccgtagga

SEQ ID NO: 213015 - DNA, 25 bp, Homo sapien
aggttacgtgatctgcgctcccagc

SEQ ID NO: 213016 - DNA, 25 bp, Homo sapien
cctcatttccgagcccattgttgga

SEQ ID NO: 213017 - DNA, 25 bp, Homo sapien
cacgtctttacggtgccatgccaaa

SEQ ID NO: 213018 - DNA, 25 bp, Homo sapien
ggtgccatcttttttcggcgtgtca

SEQ ID NO: 213019 - DNA, 25 bp, Homo sapien
gcggatttctttctcagcgctcgga

SEQ ID NO: 213020 - DNA, 25 bp, Homo sapien
cacgctcgcaaaggcagggttcacc

SEQ ID NO: 213021 - DNA, 25 bp, Homo sapien
tgcctgagaacagtgcgcggatccc

SEQ ID NO: 213022 - DNA, 25 bp, Homo sapien
cgcgctgtcactttagttgcccttc

SEQ ID NO: 213023 - DNA, 25 bp, Homo sapien
cgcggtgtaggagaccagcccgact

SEQ ID NO: 213024 - DNA, 25 bp, Homo sapien
cacggccgtcggatttagactggaa

SEQ ID NO: 213025 - DNA, 25 bp, Homo sapien
gcagcgcagcctgagacacccgccg

SEQ ID NO: 213026 - DNA, 25 bp, Homo sapien
cgctccacggccgtcggatttagac

SEQ ID NO: 213027 - DNA, 25 bp, Homo sapien
cggatttagactggaagctcggtcc

SEQ ID NO: 213028 - DNA, 25 bp, Homo sapien
agactggaagctcggtccaggtccc

SEQ ID NO: 213029 - DNA, 25 bp, Homo sapien
ccagggggcgattccgctgagtcac

SEQ ID NO: 213030 - DNA, 25 bp, Homo sapien
ccagcttgatgcgcccgcggtgtag

SEQ ID NO: 213031 - DNA, 25 bp, Homo sapien
gaaagagccagaagctcccgtcccg

SEQ ID NO: 213032 - DNA, 25 bp, Homo sapien
cagcaccgtcccgtttgcccagcgc

SEQ ID NO: 213033 - DNA, 25 bp, Homo sapien
tcccgtcccgctgaccgcgagcctt

SEQ ID NO: 213034 - DNA, 25 bp, Homo sapien
gagattagcgcccacgtccagcctg

SEQ ID NO: 213035 - DNA, 25 bp, Homo sapien
gccaatgagattagcgcccacgtcc

SEQ ID NO: 213036 - DNA, 25 bp, Homo sapien
ccctggccaatgagattagcgccca

SEQ ID NO: 213037 - DNA, 25 bp, Homo sapien
aggcgcctgaaaggcccctggccaa

SEQ ID NO: 213038 - DNA, 25 bp, Homo sapien
accgcgagccttcctcagcaccgtc

SEQ ID NO: 213039 - DNA, 25 bp, Homo sapien
ccgaggtgagtctaacctgaggcac

SEQ ID NO: 213040 - DNA, 25 bp, Homo sapien
gccgtggccgatgtttttgtacctc

SEQ ID NO: 213041 - DNA, 25 bp, Homo sapien
ctgaggcactgacgccgtcacatgc

SEQ ID NO: 213042 - DNA, 25 bp, Homo sapien
gaggaactgtttgcactgtgtagta

SEQ ID NO: 213043 - DNA, 25 bp, Homo sapien
gcctccgtatactgcagcacggctg

SEQ ID NO: 213044 - DNA, 25 bp, Homo sapien
ccaaggctaaccctgcagaaagctc

SEQ ID NO: 213045 - DNA, 25 bp, Homo sapien
gctccctgaccagtgaagcggcttc

SEQ ID NO: 213046 - DNA, 25 bp, Homo sapien
tcggcaccacactattccaaggcta

SEQ ID NO: 213047 - DNA, 25 bp, Homo sapien
attcccattgttagggagggcagag

SEQ ID NO: 213048 - DNA, 25 bp, Homo sapien
gaggcgagagcccgagatcgcacct

SEQ ID NO: 213049 - DNA, 25 bp, Homo sapien
ccaggcctacgagtgggcgctgggc

SEQ ID NO: 213050 - DNA, 25 bp, Homo sapien
cgtcccaggcctacgagtgggcgct

SEQ ID NO: 213051 - DNA, 25 bp, Homo sapien
cattcccattgttagggagggcaga

SEQ ID NO: 213052 - DNA, 25 bp, Homo sapien
cccattcccattgttagggagggca

SEQ ID NO: 213053 - DNA, 25 bp, Homo sapien
agaggcgagagcccgagatcgcacc

SEQ ID NO: 213054 - DNA, 25 bp, Homo sapien
ccattcccattgttagggagggcag

SEQ ID NO: 213055 - DNA, 25 bp, Homo sapien
tgccgtacgagtagccggggtacac

SEQ ID NO: 213056 - DNA, 25 bp, Homo sapien
cccacgttgaccgagttgaaggcga

SEQ ID NO: 213057 - DNA, 25 bp, Homo sapien
ggtacacctcctcgtagggcggcac

SEQ ID NO: 213058 - DNA, 25 bp, Homo sapien
gcgccgcgaagctgcctttgcatag

SEQ ID NO: 213059 - DNA, 25 bp, Homo sapien
ggccctgcggtcaataaacgagatg

SEQ ID NO: 213060 - DNA, 25 bp, Homo sapien
aggtcgcctctagctcctgtagctg

SEQ ID NO: 213061 - DNA, 25 bp, Homo sapien
cgccgctgcttctttttcagcgaac

SEQ ID NO: 213062 - DNA, 25 bp, Homo sapien
tttcagcgaaccgtcctctggggag

SEQ ID NO: 213063 - DNA, 25 bp, Homo sapien
gcccaagcggcccaccacgctcaac

SEQ ID NO: 213064 - DNA, 25 bp, Homo sapien
cggcccaccacgctcaacctctttc

SEQ ID NO: 213065 - DNA, 25 bp, Homo sapien
cggttgcaggccgagatgctgcaga

SEQ ID NO: 213066 - DNA, 25 bp, Homo sapien
gccgagatgctgcagatggacctga

SEQ ID NO: 213067 - DNA, 25 bp, Homo sapien
cagatggacctgatcgacgcgacgg

SEQ ID NO: 213068 - DNA, 25 bp, Homo sapien
tgatcgacgcgacgggggacactcc

SEQ ID NO: 213069 - DNA, 25 bp, Homo sapien
cagcggggacacgtaccggcccaag

SEQ ID NO: 213070 - DNA, 25 bp, Homo sapien
gcagcggggacacgtaccggcccaa

SEQ ID NO: 213071 - DNA, 25 bp, Homo sapien
aggtttgtgcctcgacacgaagacg

SEQ ID NO: 213072 - DNA, 25 bp, Homo sapien
ccaccggaccatattcaggtttgtg

SEQ ID NO: 213073 - DNA, 25 bp, Homo sapien
accggaccatattcaggtttgtgcc

SEQ ID NO: 213074 - DNA, 25 bp, Homo sapien
cggaccatattcaggtttgtgcctc

SEQ ID NO: 213075 - DNA, 25 bp, Homo sapien
tcaggtttgtgcctcgacacgaaga

SEQ ID NO: 213076 - DNA, 25 bp, Homo sapien
gaccatattcaggtttgtgcctcga

SEQ ID NO: 213077 - DNA, 25 bp, Homo sapien
ccatattcaggtttgtgcctcgaca

SEQ ID NO: 213078 - DNA, 25 bp, Homo sapien
tattcaggtttgtgcctcgacacga

SEQ ID NO: 213079 - DNA, 25 bp, Homo sapien
aggatagctggtgctcatacacttc

SEQ ID NO: 213080 - DNA, 25 bp, Homo sapien
ctggaacagcaggatagctggtgct

SEQ ID NO: 213081 - DNA, 25 bp, Homo sapien
acgcgctggaacagcaggatagctg

SEQ ID NO: 213082 - DNA, 25 bp, Homo sapien
aacagcaggatagctggtgctcata

SEQ ID NO: 213083 - DNA, 25 bp, Homo sapien
gcaggatagctggtgctcatacact

SEQ ID NO: 213084 - DNA, 25 bp, Homo sapien
atagctggtgctcatacacttcctg

SEQ ID NO: 213085 - DNA, 25 bp, Homo sapien
tagctggtgctcatacacttcctga

SEQ ID NO: 213086 - DNA, 25 bp, Homo sapien
cagcaggatagctggtgctcataca

SEQ ID NO: 213087 - DNA, 25 bp, Homo sapien
cggttttgttccaatggtctgctca

SEQ ID NO: 213088 - DNA, 25 bp, Homo sapien
atggtctgctcagcgagtgattccc

SEQ ID NO: 213089 - DNA, 25 bp, Homo sapien
gcagcgcgcaaacgcacacgagttt

SEQ ID NO: 213090 - DNA, 25 bp, Homo sapien
cgcacacgagtttaaagtttaggct

SEQ ID NO: 213091 - DNA, 25 bp, Homo sapien
gtgatgctatcctcgcccgcagatc

SEQ ID NO: 213092 - DNA, 25 bp, Homo sapien
gacagacattctcggggacaacttt

SEQ ID NO: 213093 - DNA, 25 bp, Homo sapien
ggacaactttgcgaggccatgtgct

SEQ ID NO: 213094 - DNA, 25 bp, Homo sapien
ccctcattagcatgaacggggacgc

SEQ ID NO: 213095 - DNA, 25 bp, Homo sapien
cgccagatcagacttcggtgagaca

SEQ ID NO: 213096 - DNA, 25 bp, Homo sapien
accgcgacgggaaacgcacaggagc

SEQ ID NO: 213097 - DNA, 25 bp, Homo sapien
ctccttgccgggcataatggccgcg

SEQ ID NO: 213098 - DNA, 25 bp, Homo sapien
tgcattgtgcttccgctcggggaaa

SEQ ID NO: 213099 - DNA, 25 bp, Homo sapien
tcatgggaacgccttggcgctccga

SEQ ID NO: 213100 - DNA, 25 bp, Homo sapien
ccgccttttgccgttgtcatgggaa

SEQ ID NO: 213101 - DNA, 25 bp, Homo sapien
accaaagtctgcgacctcaggtgca

SEQ ID NO: 213102 - DNA, 25 bp, Homo sapien
ggagcgagaccctaaccaaagtctg

SEQ ID NO: 213103 - DNA, 25 bp, Homo sapien
ttccgagtcccggagaatcctgcac

SEQ ID NO: 213104 - DNA, 25 bp, Homo sapien
tttggaagcagcgatgaacgggata

SEQ ID NO: 213105 - DNA, 25 bp, Homo sapien
ccggagaatcctgcacgcgagatcc

SEQ ID NO: 213106 - DNA, 25 bp, Homo sapien
caagcgcgaaatcggtgagcccggc

SEQ ID NO: 213107 - DNA, 25 bp, Homo sapien
agaggcgttctgcaagcgcgaaatc

SEQ ID NO: 213108 - DNA, 25 bp, Homo sapien
tcggcctcagtcagccgcgcaggga

SEQ ID NO: 213109 - DNA, 25 bp, Homo sapien
ctcagcttcagattcggcctcagtc

SEQ ID NO: 213110 - DNA, 25 bp, Homo sapien
ttcgctgttgctaaaaaccaacgcc

SEQ ID NO: 213111 - DNA, 25 bp, Homo sapien
ccgcggcctttaggatttcagctca

SEQ ID NO: 213112 - DNA, 25 bp, Homo sapien
tcctggagcttttgcaccaatgagc

SEQ ID NO: 213113 - DNA, 25 bp, Homo sapien
cctgttgccactcaaggtaccgcta

SEQ ID NO: 213114 - DNA, 25 bp, Homo sapien
tgaagcctccttcggttcctcgctg

SEQ ID NO: 213115 - DNA, 25 bp, Homo sapien
ccctgcgtggaacctatgaagcctc

SEQ ID NO: 213116 - DNA, 25 bp, Homo sapien
cagggcctttttggcacgctcagtc

SEQ ID NO: 213117 - DNA, 25 bp, Homo sapien
ctctaaggtaagatggctccgacta

SEQ ID NO: 213118 - DNA, 25 bp, Homo sapien
ccgatgccatgtgcgaccaatcaga

SEQ ID NO: 213119 - DNA, 25 bp, Homo sapien
cggcggactgacacgcacgttggaa

SEQ ID NO: 213120 - DNA, 25 bp, Homo sapien
cacccccttgcgagggcttattagg

SEQ ID NO: 213121 - DNA, 25 bp, Homo sapien
tcacggcggttgcacgcctgcgcga

SEQ ID NO: 213122 - DNA, 25 bp, Homo sapien
tggaaacggagtcacccaccacagc

SEQ ID NO: 213123 - DNA, 25 bp, Homo sapien
tcgttacacgcgtctgctgcgcctc

SEQ ID NO: 213124 - DNA, 25 bp, Homo sapien
gtggcaggggattagccctcctcaa

SEQ ID NO: 213125 - DNA, 25 bp, Homo sapien
ggggattagccctcctcaacaactc

SEQ ID NO: 213126 - DNA, 25 bp, Homo sapien
cgcacgttggaaacggagtcaccca

SEQ ID NO: 213127 - DNA, 25 bp, Homo sapien
cttcgttccggatcctctgagtctc

SEQ ID NO: 213128 - DNA, 25 bp, Homo sapien
ctctggccaatcagaagcgctcttc

SEQ ID NO: 213129 - DNA, 25 bp, Homo sapien
ggattccaaggtccagcaatagctc

SEQ ID NO: 213130 - DNA, 25 bp, Homo sapien
cagggcgctttctggtaatggtttc

SEQ ID NO: 213131 - DNA, 25 bp, Homo sapien
tgttcccaaggcaccggagttcagc

SEQ ID NO: 213132 - DNA, 25 bp, Homo sapien
tcctggtttcaagtctccggcttcg

SEQ ID NO: 213133 - DNA, 25 bp, Homo sapien
gccggcgcccattcactttatggca

SEQ ID NO: 213134 - DNA, 25 bp, Homo sapien
caggtctcgttttagggattccaag

SEQ ID NO: 213135 - DNA, 25 bp, Homo sapien
tgtgcttgttcatggccgagcgcgc

SEQ ID NO: 213136 - DNA, 25 bp, Homo sapien
cgttgttgtgcttgttcatggccga

SEQ ID NO: 213137 - DNA, 25 bp, Homo sapien
actaacacgccgaagtcagcgtcct

SEQ ID NO: 213138 - DNA, 25 bp, Homo sapien
cccttatgatgcgagtcacagccgc

SEQ ID NO: 213139 - DNA, 25 bp, Homo sapien
atgcgagtcacagccgcaaatggtg

SEQ ID NO: 213140 - DNA, 25 bp, Homo sapien
atggcgtgaacgaaggccgactcgc

SEQ ID NO: 213141 - DNA, 25 bp, Homo sapien
tccctggacactaacacgccgaagt

SEQ ID NO: 213142 - DNA, 25 bp, Homo sapien
cagccgcaaatggtggaggtgccct

SEQ ID NO: 213143 - DNA, 25 bp, Homo sapien
tcgggcgcttttcaggccgcccagg

SEQ ID NO: 213144 - DNA, 25 bp, Homo sapien
tgggccgctcaatccgcctttgttc

SEQ ID NO: 213145 - DNA, 25 bp, Homo sapien
ggtgtcacaccgcattacccgcata

SEQ ID NO: 213146 - DNA, 25 bp, Homo sapien
attacccgcataatgcggccgccgg

SEQ ID NO: 213147 - DNA, 25 bp, Homo sapien
cagcaaattcccaaactctcgggca

SEQ ID NO: 213148 - DNA, 25 bp, Homo sapien
acctgggttcaaggtccgggctctg

SEQ ID NO: 213149 - DNA, 25 bp, Homo sapien
caaagcgcggggcagagattaaccc

SEQ ID NO: 213150 - DNA, 25 bp, Homo sapien
ggcgtcttccgggatgctctcctcg

SEQ ID NO: 213151 - DNA, 25 bp, Homo sapien
ttcgggcttgtcagaagcgcacctc

SEQ ID NO: 213152 - DNA, 25 bp, Homo sapien
cgcggcctaaggtaagagatgagtc

SEQ ID NO: 213153 - DNA, 25 bp, Homo sapien
cggagccgagtgtcatttgagtctt

SEQ ID NO: 213154 - DNA, 25 bp, Homo sapien
tcagatcggtatcgggacctcctgc

SEQ ID NO: 213155 - DNA, 25 bp, Homo sapien
gccagtcgcatttcctgctctcgga

SEQ ID NO: 213156 - DNA, 25 bp, Homo sapien
ctcggagtcgggtcactttctcctc

SEQ ID NO: 213157 - DNA, 25 bp, Homo sapien
aagtttgcccgcgaccatgaagagg

SEQ ID NO: 213158 - DNA, 25 bp, Homo sapien
ccacttgagattggaaatgactttc

SEQ ID NO: 213159 - DNA, 25 bp, Homo sapien
gcgccctgagttcggtctccagctt

SEQ ID NO: 213160 - DNA, 25 bp, Homo sapien
gccctgttcagtgtccgagtctctg

SEQ ID NO: 213161 - DNA, 25 bp, Homo sapien
aacccacttcgcagtcggagttcgc

SEQ ID NO: 213162 - DNA, 25 bp, Homo sapien
gccgaggtctcgaactcagacccta

SEQ ID NO: 213163 - DNA, 25 bp, Homo sapien
tgcgctacagctgggccaatttttc

SEQ ID NO: 213164 - DNA, 25 bp, Homo sapien
atcccggagaggcagaatctcctcc

SEQ ID NO: 213165 - DNA, 25 bp, Homo sapien
tctacctcggagaagccattgcgct

SEQ ID NO: 213166 - DNA, 25 bp, Homo sapien
tcaggcgtcagtcccgctctctgat

SEQ ID NO: 213167 - DNA, 25 bp, Homo sapien
tccgatctcgcaaccactgctagta

SEQ ID NO: 213168 - DNA, 25 bp, Homo sapien
ccctgttccagcaaacgcacaagtg

SEQ ID NO: 213169 - DNA, 25 bp, Homo sapien
tagccttcagcgaacatgtacaccg

SEQ ID NO: 213170 - DNA, 25 bp, Homo sapien
tcctaacgcctgactgaatcctgag

SEQ ID NO: 213171 - DNA, 25 bp, Homo sapien
tatcccgcgattgtccttcctaacg

SEQ ID NO: 213172 - DNA, 25 bp, Homo sapien
agccgagcctgtgactacacttatc

SEQ ID NO: 213173 - DNA, 25 bp, Homo sapien
cggctcgccttcaactttgctctga

SEQ ID NO: 213174 - DNA, 25 bp, Homo sapien
aggacctctcgttagtatcccgcga

SEQ ID NO: 213175 - DNA, 25 bp, Homo sapien
ccgagcagctgagcctgaagcagca

SEQ ID NO: 213176 - DNA, 25 bp, Homo sapien
tggagagcctctacccgctggccaa

SEQ ID NO: 213177 - DNA, 25 bp, Homo sapien
tcagccacatgaagatgcacgccgt

SEQ ID NO: 213178 - DNA, 25 bp, Homo sapien
gcggcaagttcgcacagcaacgcaa

SEQ ID NO: 213179 - DNA, 25 bp, Homo sapien
acatgcgcatccactcgggcgagaa

SEQ ID NO: 213180 - DNA, 25 bp, Homo sapien
tacccatgcaccatctgcgggaaga

SEQ ID NO: 213181 - DNA, 25 bp, Homo sapien
cgtcgtgcgacaagagctacaagga

SEQ ID NO: 213182 - DNA, 25 bp, Homo sapien
tcactgcttcgtgccttagctcggg

SEQ ID NO: 213183 - DNA, 25 bp, Homo sapien
gcacgtgggatcttgactcgccgcc

SEQ ID NO: 213184 - DNA, 25 bp, Homo sapien
gccgtgacgtcaaagatgtcccaga

SEQ ID NO: 213185 - DNA, 25 bp, Homo sapien
cagtctagagccaaggtgccggcgc

SEQ ID NO: 213186 - DNA, 25 bp, Homo sapien
cccgggcagtaagcagtctagagcc

SEQ ID NO: 213187 - DNA, 25 bp, Homo sapien
ccgtgactggagactgttactgagg

SEQ ID NO: 213188 - DNA, 25 bp, Homo sapien
acaatcgaaagccacggttgccctg

SEQ ID NO: 213189 - DNA, 25 bp, Homo sapien
ctgttacctccagttcccacagtaa

SEQ ID NO: 213190 - DNA, 25 bp, Homo sapien
gaccatggctgtagactgttacctc

SEQ ID NO: 213191 - DNA, 25 bp, Homo sapien
ggctgtgtgcctagaaatacgtaca

SEQ ID NO: 213192 - DNA, 25 bp, Homo sapien
gttgctaagctctccaaggcctcgg

SEQ ID NO: 213193 - DNA, 25 bp, Homo sapien
cgcacctcaccggttgccatggtaa

SEQ ID NO: 213194 - DNA, 25 bp, Homo sapien
ggccacttccggagtagtactgcga

SEQ ID NO: 213195 - DNA, 25 bp, Homo sapien
cttctggaaacatgagcgcctgtta

SEQ ID NO: 213196 - DNA, 25 bp, Homo sapien
ttatgccgcgcacaccgaatccatg

SEQ ID NO: 213197 - DNA, 25 bp, Homo sapien
acttttccgaactggggctgtgtgc

SEQ ID NO: 213198 - DNA, 25 bp, Homo sapien
tccaagtggacagtgccgtacagta

SEQ ID NO: 213199 - DNA, 25 bp, Homo sapien
cggcgctcctgcaccagaaagttga

SEQ ID NO: 213200 - DNA, 25 bp, Homo sapien
tccttcttgcagcagcgctggcgag

SEQ ID NO: 213201 - DNA, 25 bp, Homo sapien
ccgaagaccacggtaagcgacagca

SEQ ID NO: 213202 - DNA, 25 bp, Homo sapien
gttcaggaaggtcgcgttcatcgcc

SEQ ID NO: 213203 - DNA, 25 bp, Homo sapien
ccagaaagttgatcatgctctcgga

SEQ ID NO: 213204 - DNA, 25 bp, Homo sapien
cgagcgaccgcagtcccaaattgca

SEQ ID NO: 213205 - DNA, 25 bp, Homo sapien
aggccaacaagctcagcgactctga

SEQ ID NO: 213206 - DNA, 25 bp, Homo sapien
tccaagccgctgtggttcaggaagg

SEQ ID NO: 213207 - DNA, 25 bp, Homo sapien
tcatccttgcccactcgtgctccca

SEQ ID NO: 213208 - DNA, 25 bp, Homo sapien
atgctccacacacgcgtctcctctc

SEQ ID NO: 213209 - DNA, 25 bp, Homo sapien
tcggcctggcgaccctaactccgct

SEQ ID NO: 213210 - DNA, 25 bp, Homo sapien
ccattggctgactgatggtgtccgt

SEQ ID NO: 213211 - DNA, 25 bp, Homo sapien
ccaggggcaccagagccaacggctg

SEQ ID NO: 213212 - DNA, 25 bp, Homo sapien
cagcctcggaccttcctgcgcggct

SEQ ID NO: 213213 - DNA, 25 bp, Homo sapien
ttcctgcgcggctcaaccaagccta

SEQ ID NO: 213214 - DNA, 25 bp, Homo sapien
tggctgactgatggtgtccgtcaga

SEQ ID NO: 213215 - DNA, 25 bp, Homo sapien
attttcgccgaagccgctcacgcta

SEQ ID NO: 213216 - DNA, 25 bp, Homo sapien
tgggcaaggcctccgaactgactaa

SEQ ID NO: 213217 - DNA, 25 bp, Homo sapien
agcaccgtcatcctcgaggctcagg

SEQ ID NO: 213218 - DNA, 25 bp, Homo sapien
ggcccactttctgcagtgcctcagg

SEQ ID NO: 213219 - DNA, 25 bp, Homo sapien
ttgtcgaagattaccggaagctacc

SEQ ID NO: 213220 - DNA, 25 bp, Homo sapien
cggaagctaccgagtctgacccaaa

SEQ ID NO: 213221 - DNA, 25 bp, Homo sapien
tgacccaaagcgtaggtttctcttc

SEQ ID NO: 213222 - DNA, 25 bp, Homo sapien
cccagggttgggctacgccaaatct

SEQ ID NO: 213223 - DNA, 25 bp, Homo sapien
acgccgaagccatcagccaggctga

SEQ ID NO: 213224 - DNA, 25 bp, Homo sapien
ccaaggacgactggcccaggagcca

SEQ ID NO: 213225 - DNA, 25 bp, Homo sapien
tctgcgctgggaatgcgcgtgtcct

SEQ ID NO: 213226 - DNA, 25 bp, Homo sapien
ccctctcaggcgcagggtctagaga

SEQ ID NO: 213227 - DNA, 25 bp, Homo sapien
gaggagcaatagtttcccaccgctc

SEQ ID NO: 213228 - DNA, 25 bp, Homo sapien
accaggatgcgctgacgacccggct

SEQ ID NO: 213229 - DNA, 25 bp, Homo sapien
gcgagagaggagcaatagtttccca

SEQ ID NO: 213230 - DNA, 25 bp, Homo sapien
gatgccgctgtagcttcctgggtga

SEQ ID NO: 213231 - DNA, 25 bp, Homo sapien
ccgccattttggatccgctgacagg

SEQ ID NO: 213232 - DNA, 25 bp, Homo sapien
gacaggtcagcgaagtctcttccta

SEQ ID NO: 213233 - DNA, 25 bp, Homo sapien
gtcggaatgctacttttcacggtgc

SEQ ID NO: 213234 - DNA, 25 bp, Homo sapien
ttcacggtgcaaagctatgattggc

SEQ ID NO: 213235 - DNA, 25 bp, Homo sapien
tgaggctagttaccacgtcagtgag

SEQ ID NO: 213236 - DNA, 25 bp, Homo sapien
acgactcatcctggcggactgtgca

SEQ ID NO: 213237 - DNA, 25 bp, Homo sapien
cttcggcctcaatttccaggaaaca

SEQ ID NO: 213238 - DNA, 25 bp, Homo sapien
ctcttcctagagttccggtgtcgtg

SEQ ID NO: 213239 - DNA, 25 bp, Homo sapien
tcacaggcccttacgaggtggggca

SEQ ID NO: 213240 - DNA, 25 bp, Homo sapien
aggcggtattgagttcagccgctcc

SEQ ID NO: 213241 - DNA, 25 bp, Homo sapien
acggaccgaaggtaagattgaagtg

SEQ ID NO: 213242 - DNA, 25 bp, Homo sapien
gtaagattgaagtggggtcagacca

SEQ ID NO: 213243 - DNA, 25 bp, Homo sapien
caccggctcgacagccgatagggtc

SEQ ID NO: 213244 - DNA, 25 bp, Homo sapien
gcagtgccttccagtcagcgcggag

SEQ ID NO: 213245 - DNA, 25 bp, Homo sapien
cgcaccggagaatgaacagcgatta

SEQ ID NO: 213246 - DNA, 25 bp, Homo sapien
cgggacagcgcaccggagaatgaac

SEQ ID NO: 213247 - DNA, 25 bp, Homo sapien
tcatccctctcaccccggtggatgc

SEQ ID NO: 213248 - DNA, 25 bp, Homo sapien
agctttgctgggctccgtgtagacc

SEQ ID NO: 213249 - DNA, 25 bp, Homo sapien
ctctcaccccggtggatgcgtggct

SEQ ID NO: 213250 - DNA, 25 bp, Homo sapien
ttcatccctctcaccccggtggatg

SEQ ID NO: 213251 - DNA, 25 bp, Homo sapien
cttcatccctctcaccccggtggat

SEQ ID NO: 213252 - DNA, 25 bp, Homo sapien
tgtagacctagacctttacctgcta

SEQ ID NO: 213253 - DNA, 25 bp, Homo sapien
ctttgctgggctccgtgtagaccta

SEQ ID NO: 213254 - DNA, 25 bp, Homo sapien
gctttgctgggctccgtgtagacct

SEQ ID NO: 213255 - DNA, 25 bp, Homo sapien
agggtggaaccaactgttgtcacgc

SEQ ID NO: 213256 - DNA, 25 bp, Homo sapien
gaaccaactgttgtcacgcgccagc

SEQ ID NO: 213257 - DNA, 25 bp, Homo sapien
tagggtggaaccaactgttgtcacg

SEQ ID NO: 213258 - DNA, 25 bp, Homo sapien
tggaaccaactgttgtcacgcgcca

SEQ ID NO: 213259 - DNA, 25 bp, Homo sapien
accaactgttgtcacgcgccagcga

SEQ ID NO: 213260 - DNA, 25 bp, Homo sapien
gtggaaccaactgttgtcacgcgcc

SEQ ID NO: 213261 - DNA, 25 bp, Homo sapien
caactgttgtcacgcgccagcgaga

SEQ ID NO: 213262 - DNA, 25 bp, Homo sapien
aaccaactgttgtcacgcgccagcg

SEQ ID NO: 213263 - DNA, 25 bp, Homo sapien
cgccagcgagagagcgcttgaacgc

SEQ ID NO: 213264 - DNA, 25 bp, Homo sapien
ggagcgcgccctccgccgaaatgtg

SEQ ID NO: 213265 - DNA, 25 bp, Homo sapien
gcacaggagtggaattttccaggga

SEQ ID NO: 213266 - DNA, 25 bp, Homo sapien
agctagcacaggagtggaattttcc

SEQ ID NO: 213267 - DNA, 25 bp, Homo sapien
agccgcatagggtggagctagcaca

SEQ ID NO: 213268 - DNA, 25 bp, Homo sapien
agaaaagccgcatagggtggagcta

SEQ ID NO: 213269 - DNA, 25 bp, Homo sapien
agctgagagtgaagagcgtcgggta

SEQ ID NO: 213270 - DNA, 25 bp, Homo sapien
agagagcgcttgaacgcgagctgcg

SEQ ID NO: 213271 - DNA, 25 bp, Homo sapien
tcgagcggctgcctgccgatgtctc

SEQ ID NO: 213272 - DNA, 25 bp, Homo sapien
cagcctttgcctcaagcccgacttg

SEQ ID NO: 213273 - DNA, 25 bp, Homo sapien
ttctcgtcttcagccgctcctctcg

SEQ ID NO: 213274 - DNA, 25 bp, Homo sapien
ggcctcgccgcgatgccggagaaga

SEQ ID NO: 213275 - DNA, 25 bp, Homo sapien
agcccgacttgctggacttcacctt

SEQ ID NO: 213276 - DNA, 25 bp, Homo sapien
ggacttcaccttcgagggcaagctg

SEQ ID NO: 213277 - DNA, 25 bp, Homo sapien
cttcaccttcgagggcaagctggag

SEQ ID NO: 213278 - DNA, 25 bp, Homo sapien
agaagaggcccttcgagcggctgcc

SEQ ID NO: 213279 - DNA, 25 bp, Homo sapien
agccggtctgagctcaaggccttta

SEQ ID NO: 213280 - DNA, 25 bp, Homo sapien
tcaccattctcgagaagaccgtgtc

SEQ ID NO: 213281 - DNA, 25 bp, Homo sapien
tccgccatggagctgatcaccattc

SEQ ID NO: 213282 - DNA, 25 bp, Homo sapien
agccggaccgactacccagacagag

SEQ ID NO: 213283 - DNA, 25 bp, Homo sapien
ccgccagcagcccatttggagggag

SEQ ID NO: 213284 - DNA, 25 bp, Homo sapien
gagaggtccggtccgaatatccctc

SEQ ID NO: 213285 - DNA, 25 bp, Homo sapien
gggccttgaaaccagcaggcgaatg

SEQ ID NO: 213286 - DNA, 25 bp, Homo sapien
caggacaacggccaatcgtcgtgga

SEQ ID NO: 213287 - DNA, 25 bp, Homo sapien
ttactcagacccagtcactcgcgtt

SEQ ID NO: 213288 - DNA, 25 bp, Homo sapien
aggggcgacaatttctgtcggccga

SEQ ID NO: 213289 - DNA, 25 bp, Homo sapien
gggtgcacataacgctccagcgcgc

SEQ ID NO: 213290 - DNA, 25 bp, Homo sapien
tctccggggtgcacataacgctcca

SEQ ID NO: 213291 - DNA, 25 bp, Homo sapien
tccctggcacttagatgggcctgtg

SEQ ID NO: 213292 - DNA, 25 bp, Homo sapien
agtcactcgcgtttccctggcactt

SEQ ID NO: 213293 - DNA, 25 bp, Homo sapien
ggccggccctacaaacgcgcgcaca

SEQ ID NO: 213294 - DNA, 25 bp, Homo sapien
gacaatttctgtcggccgagcgaaa

SEQ ID NO: 213295 - DNA, 25 bp, Homo sapien
gctgctgctacagccgtagcggctc

SEQ ID NO: 213296 - DNA, 25 bp, Homo sapien
gctggggcaaaaggaacagtcacct

SEQ ID NO: 213297 - DNA, 25 bp, Homo sapien
ggaacagtcaccttcgcggcgagaa

SEQ ID NO: 213298 - DNA, 25 bp, Homo sapien
actaacccgcgagagaggtagggca

SEQ ID NO: 213299 - DNA, 25 bp, Homo sapien
tccgcgtctcccgatgcctgggaat

SEQ ID NO: 213300 - DNA, 25 bp, Homo sapien
ctttccgaacgacggtggccgcgct

SEQ ID NO: 213301 - DNA, 25 bp, Homo sapien
gaaaccaccacagacgggcggcgcg

SEQ ID NO: 213302 - DNA, 25 bp, Homo sapien
ggccagagtagccaggatcccgcgc

SEQ ID NO: 213303 - DNA, 25 bp, Homo sapien
atggagtccatgttcgaggacgaca

SEQ ID NO: 213304 - DNA, 25 bp, Homo sapien
tgtggctggacagtcccggagaccc

SEQ ID NO: 213305 - DNA, 25 bp, Homo sapien
tcactgcttacggagacatcaagga

SEQ ID NO: 213306 - DNA, 25 bp, Homo sapien
ttacggagacatcaaggaacggctg

SEQ ID NO: 213307 - DNA, 25 bp, Homo sapien
cctggagagggagaacgccaccctc

SEQ ID NO: 213308 - DNA, 25 bp, Homo sapien
actttgccctcatcactgcttacgg

SEQ ID NO: 213309 - DNA, 25 bp, Homo sapien
cgacatcagcatcctgacgcaggag

SEQ ID NO: 213310 - DNA, 25 bp, Homo sapien
tgttcgaggacgacatcagcatcct

SEQ ID NO: 213311 - DNA, 25 bp, Homo sapien
cctggccgtccatcaacgtgagtgg

SEQ ID NO: 213312 - DNA, 25 bp, Homo sapien
gaggtgggcaccatccgctgcgcct

SEQ ID NO: 213313 - DNA, 25 bp, Homo sapien
catccggctgcgcttcgagaagcag

SEQ ID NO: 213314 - DNA, 25 bp, Homo sapien
cagccaccacgtgaaggccggcttc

SEQ ID NO: 213315 - DNA, 25 bp, Homo sapien
gccgcagctactctgagctggcgga

SEQ ID NO: 213316 - DNA, 25 bp, Homo sapien
cgggcctacggcagcgagctctacg

SEQ ID NO: 213317 - DNA, 25 bp, Homo sapien
gtccatcaacgtgagtggggcgccc

SEQ ID NO: 213318 - DNA, 25 bp, Homo sapien
cagcgagctctacggccctggcagg

SEQ ID NO: 213319 - DNA, 25 bp, Homo sapien
agaacgtctcgtctgtttttctggc

SEQ ID NO: 213320 - DNA, 25 bp, Homo sapien
gcgactctagtgacagcggcccgct

SEQ ID NO: 213321 - DNA, 25 bp, Homo sapien
gggtcgcgctcaacaaccacctgtt

SEQ ID NO: 213322 - DNA, 25 bp, Homo sapien
cacctgttgtggtccaagtttaatc

SEQ ID NO: 213323 - DNA, 25 bp, Homo sapien
tcagcaccagacagagatgatcatc

SEQ ID NO: 213324 - DNA, 25 bp, Homo sapien
tgatcatcaccaagcagggacggtg

SEQ ID NO: 213325 - DNA, 25 bp, Homo sapien
ccgcgccggaacaagaacgtctcgt

SEQ ID NO: 213326 - DNA, 25 bp, Homo sapien
ttgcggagacatgctgacgggcacc

SEQ ID NO: 213327 - DNA, 25 bp, Homo sapien
ccactccgaggaggagacacttttc

SEQ ID NO: 213328 - DNA, 25 bp, Homo sapien
acgcacggaaacgtcatgggaattc

SEQ ID NO: 213329 - DNA, 25 bp, Homo sapien
gctgtgatggagacacactcttgta

SEQ ID NO: 213330 - DNA, 25 bp, Homo sapien
atgctcgcttgcacactcatgttga

SEQ ID NO: 213331 - DNA, 25 bp, Homo sapien
cccacactgagaagctcgggattca

SEQ ID NO: 213332 - DNA, 25 bp, Homo sapien
gctcacccgtgtccgtacatcaaga

SEQ ID NO: 213333 - DNA, 25 bp, Homo sapien
acacctgtacctgtgctggcgcaca

SEQ ID NO: 213334 - DNA, 25 bp, Homo sapien
tcggatccacgtcgacaccgttgta

SEQ ID NO: 213335 - DNA, 25 bp, Homo sapien
gcacactctgggaccgacccgggtg

SEQ ID NO: 213336 - DNA, 25 bp, Homo sapien
ctcaccaacagtgacgaggggcgcg

SEQ ID NO: 213337 - DNA, 25 bp, Homo sapien
cagagccggaggaccagagacgccc

SEQ ID NO: 213338 - DNA, 25 bp, Homo sapien
cgctgcctttctcggcttcctgggg

SEQ ID NO: 213339 - DNA, 25 bp, Homo sapien
cagcagagtctattcgtggtccgtc

SEQ ID NO: 213340 - DNA, 25 bp, Homo sapien
tctattcgtggtccgtccgcacaca

SEQ ID NO: 213341 - DNA, 25 bp, Homo sapien
ggtccgtccgcacacagcggggttc

SEQ ID NO: 213342 - DNA, 25 bp, Homo sapien
cggggttccgctcaccaacagtgac

SEQ ID NO: 213343 - DNA, 25 bp, Homo sapien
acctgtgtccatcccagagcgtgcg

SEQ ID NO: 213344 - DNA, 25 bp, Homo sapien
gctgctcctgcgaagctggtgtcca

SEQ ID NO: 213345 - DNA, 25 bp, Homo sapien
gtctctccagttccggcgtcttctg

SEQ ID NO: 213346 - DNA, 25 bp, Homo sapien
gcgcgtctttgttccgtccaggcat

SEQ ID NO: 213347 - DNA, 25 bp, Homo sapien
gtgcactcaaagaccgccagctctg

SEQ ID NO: 213348 - DNA, 25 bp, Homo sapien
tgcgccttccctgtgcactcaaaga

SEQ ID NO: 213349 - DNA, 25 bp, Homo sapien
ccctctggacgctgccgaggaaata

SEQ ID NO: 213350 - DNA, 25 bp, Homo sapien
ttccgtccaggcatcttcaacgcgt

SEQ ID NO: 213351 - DNA, 25 bp, Homo sapien
gttgagctgcacaggcattgacacc

SEQ ID NO: 213352 - DNA, 25 bp, Homo sapien
gaatgttccacaggctcacgtcagc

SEQ ID NO: 213353 - DNA, 25 bp, Homo sapien
ttgcgcagaatgttccacaggctca

SEQ ID NO: 213354 - DNA, 25 bp, Homo sapien
cttggacaggtctttgccgatgttg

SEQ ID NO: 213355 - DNA, 25 bp, Homo sapien
ctcgttgagctgcacaggcattgac

SEQ ID NO: 213356 - DNA, 25 bp, Homo sapien
gaggctgctgtactccagctcctcg

SEQ ID NO: 213357 - DNA, 25 bp, Homo sapien
tggtccaggaggctgctgtactcca

SEQ ID NO: 213358 - DNA, 25 bp, Homo sapien
gccgatgttgttgcgcagaatgttc

SEQ ID NO: 213359 - DNA, 25 bp, Homo sapien
caagacacgccgtgaggacctgggc

SEQ ID NO: 213360 - DNA, 25 bp, Homo sapien
caccggaagaatggacggaagccga

SEQ ID NO: 213361 - DNA, 25 bp, Homo sapien
gtacccgccggctgtagccgtaaga

SEQ ID NO: 213362 - DNA, 25 bp, Homo sapien
ctgtagccgtaagacgcatgcgcta

SEQ ID NO: 213363 - DNA, 25 bp, Homo sapien
acgcatgcgctaggccgggccaacg

SEQ ID NO: 213364 - DNA, 25 bp, Homo sapien
cactcggcgtccagtctcttagcaa

SEQ ID NO: 213365 - DNA, 25 bp, Homo sapien
gtccagtctcttagcaacgactccg

SEQ ID NO: 213366 - DNA, 25 bp, Homo sapien
cgcagccatctccaccggaagaatg

SEQ ID NO: 213367 - DNA, 25 bp, Homo sapien
tcggcgcacacaccatggacgggtg

SEQ ID NO: 213368 - DNA, 25 bp, Homo sapien
cgcaaggaagacaccgccgtggctc

SEQ ID NO: 213369 - DNA, 25 bp, Homo sapien
cccacacgtgtaaaagacgcgcaag

SEQ ID NO: 213370 - DNA, 25 bp, Homo sapien
gaggcgggcctctccataaccctgg

SEQ ID NO: 213371 - DNA, 25 bp, Homo sapien
gagtcagggctcgacgacgccatct

SEQ ID NO: 213372 - DNA, 25 bp, Homo sapien
cggagacaaagcagtcgcaggaaca

SEQ ID NO: 213373 - DNA, 25 bp, Homo sapien
actctcaggtgacctggaaggcctt

SEQ ID NO: 213374 - DNA, 25 bp, Homo sapien
ccgagttcttggcaaagatcacagc

SEQ ID NO: 213375 - DNA, 25 bp, Homo sapien
gagtcggcctgaaccacgattcata

SEQ ID NO: 213376 - DNA, 25 bp, Homo sapien
ttcataatggtgtgacatgtccggc

SEQ ID NO: 213377 - DNA, 25 bp, Homo sapien
cgccctcgtgggttttcatgtgctt

SEQ ID NO: 213378 - DNA, 25 bp, Homo sapien
tgcagactgcacaggggaacttctt

SEQ ID NO: 213379 - DNA, 25 bp, Homo sapien
acgtcttggcgtaggctttcccgca

SEQ ID NO: 213380 - DNA, 25 bp, Homo sapien
gggcggctacttccaaggccttagc

SEQ ID NO: 213381 - DNA, 25 bp, Homo sapien
cacaaagctggtggtctccgacgta

SEQ ID NO: 213382 - DNA, 25 bp, Homo sapien
gactgtcgctttccaggtcctcgca

SEQ ID NO: 213383 - DNA, 25 bp, Homo sapien
gaaagataactagggcgtgcgccgc

SEQ ID NO: 213384 - DNA, 25 bp, Homo sapien
cggagtgcgttttttcgagacaatc

SEQ ID NO: 213385 - DNA, 25 bp, Homo sapien
ctgcggccgcctttaacccttgagg

SEQ ID NO: 213386 - DNA, 25 bp, Homo sapien
agcgagcgaacaaggccagctccgc

SEQ ID NO: 213387 - DNA, 25 bp, Homo sapien
acggtcgctcataggccctgtgcgc

SEQ ID NO: 213388 - DNA, 25 bp, Homo sapien
gtgcgctactgacggtcgctcatag

SEQ ID NO: 213389 - DNA, 25 bp, Homo sapien
cacggctggctggtgcgctactgac

SEQ ID NO: 213390 - DNA, 25 bp, Homo sapien
ttcgagacaatctccgtagcgctca

SEQ ID NO: 213391 - DNA, 25 bp, Homo sapien
cgactctcgcaggtgtagcaggcca

SEQ ID NO: 213392 - DNA, 25 bp, Homo sapien
acgaggctaagctcaacgggaaaca

SEQ ID NO: 213393 - DNA, 25 bp, Homo sapien
aggaagccatcggagccacactgca

SEQ ID NO: 213394 - DNA, 25 bp, Homo sapien
gccacgccttcagctggatttcaga

SEQ ID NO: 213395 - DNA, 25 bp, Homo sapien
gggaatgaacttgagccacgccttc

SEQ ID NO: 213396 - DNA, 25 bp, Homo sapien
caaggagccgttgcagggaatgaac

SEQ ID NO: 213397 - DNA, 25 bp, Homo sapien
tacgtccgtccttcgatttacacaa

SEQ ID NO: 213398 - DNA, 25 bp, Homo sapien
cgatttacacaaggtccaaggagcc

SEQ ID NO: 213399 - DNA, 25 bp, Homo sapien
ttgggaatcgcgtggaagacacttc

SEQ ID NO: 213400 - DNA, 25 bp, Homo sapien
ggccagcgctcacaatgcggcttcg

SEQ ID NO: 213401 - DNA, 25 bp, Homo sapien
tgtcacctagattcgggcacgttgc

SEQ ID NO: 213402 - DNA, 25 bp, Homo sapien
gggcacgttgctcttccgtttgcaa

SEQ ID NO: 213403 - DNA, 25 bp, Homo sapien
tccctcgattccctagcgaggcttg

SEQ ID NO: 213404 - DNA, 25 bp, Homo sapien
ttgcccggttccgtaccagctcaag

SEQ ID NO: 213405 - DNA, 25 bp, Homo sapien
acttgacaactgcacggcgacggcc

SEQ ID NO: 213406 - DNA, 25 bp, Homo sapien
ggcatgttctttatcactctgagca

SEQ ID NO: 213407 - DNA, 25 bp, Homo sapien
tggggatgtatccaaaccagaaata

SEQ ID NO: 213408 - DNA, 25 bp, Homo sapien
ggaacaagtcccaacaggtgcaacc

SEQ ID NO: 213409 - DNA, 25 bp, Homo sapien
ccctgtccagatgttgcacaatgca

SEQ ID NO: 213410 - DNA, 25 bp, Homo sapien
ccagaaatatcctttcaggtctctc

SEQ ID NO: 213411 - DNA, 25 bp, Homo sapien
gtaattagcagggaggctctcgcca

SEQ ID NO: 213412 - DNA, 25 bp, Homo sapien
aggcaattatttggctccagtggga

SEQ ID NO: 213413 - DNA, 25 bp, Homo sapien
gttgcacaatgcaggcgcgtgccca

SEQ ID NO: 213414 - DNA, 25 bp, Homo sapien
agcccaatcccagatcggttctcgg

SEQ ID NO: 213415 - DNA, 25 bp, Homo sapien
cctgcgttcatgcttccagccattg

SEQ ID NO: 213416 - DNA, 25 bp, Homo sapien
ggcggagcccttgaagttactcaga

SEQ ID NO: 213417 - DNA, 25 bp, Homo sapien
tccagccattgtcggagtgtcagcc

SEQ ID NO: 213418 - DNA, 25 bp, Homo sapien
gtgcttccagccatttgggactcca

SEQ ID NO: 213419 - DNA, 25 bp, Homo sapien
cgccagccaatcaggatgtccagag

SEQ ID NO: 213420 - DNA, 25 bp, Homo sapien
aaattccgtcgtctatgccgccagc

SEQ ID NO: 213421 - DNA, 25 bp, Homo sapien
gcggcaatgccagccgattgtaaaa

SEQ ID NO: 213422 - DNA, 25 bp, Homo sapien
tcctaaaacggagtcggtgctgccc

SEQ ID NO: 213423 - DNA, 25 bp, Homo sapien
tgtagatgcccaccagcgattcagg

SEQ ID NO: 213424 - DNA, 25 bp, Homo sapien
attggttaatagtgctgtcggtccc

SEQ ID NO: 213425 - DNA, 25 bp, Homo sapien
caagcgcttattggtgaaggctgcc

SEQ ID NO: 213426 - DNA, 25 bp, Homo sapien
cgaactatgcctgggtcggctctga

SEQ ID NO: 213427 - DNA, 25 bp, Homo sapien
aggccttcctgcactcttaactgta

SEQ ID NO: 213428 - DNA, 25 bp, Homo sapien
aaccagatgggcactgctcggcatc

SEQ ID NO: 213429 - DNA, 25 bp, Homo sapien
cgacagcccggttactgatatatcc

SEQ ID NO: 213430 - DNA, 25 bp, Homo sapien
tgaggaggcagccaacagcccttgt

SEQ ID NO: 213431 - DNA, 25 bp, Homo sapien
cctgagtggagcgtaaaccctgatt

SEQ ID NO: 213432 - DNA, 25 bp, Homo sapien
atctgcgtggagaagacccagtgcc

SEQ ID NO: 213433 - DNA, 25 bp, Homo sapien
aaccctgattggctgtacggaaggc

SEQ ID NO: 213434 - DNA, 25 bp, Homo sapien
cgaaggatgcccgtttgtgtctaaa

SEQ ID NO: 213435 - DNA, 25 bp, Homo sapien
tttgtgtctaaacggaggctcggcc

SEQ ID NO: 213436 - DNA, 25 bp, Homo sapien
ggctcggccacaacgccactggatt

SEQ ID NO: 213437 - DNA, 25 bp, Homo sapien
gtgtttcccgccaggaccatcagca

SEQ ID NO: 213438 - DNA, 25 bp, Homo sapien
agaaggtatttgcaacggcctccca

SEQ ID NO: 213439 - DNA, 25 bp, Homo sapien
ccagcagccctgtgcaaagcagatg

SEQ ID NO: 213440 - DNA, 25 bp, Homo sapien
tgcaaagcagatgttccgccgcaga

SEQ ID NO: 213441 - DNA, 25 bp, Homo sapien
caaagcagatgttccgccgcagacg

SEQ ID NO: 213442 - DNA, 25 bp, Homo sapien
aaagcagatgttccgccgcagacgc

SEQ ID NO: 213443 - DNA, 25 bp, Homo sapien
tgctgtcgccgagcacgctgtctcg

SEQ ID NO: 213444 - DNA, 25 bp, Homo sapien
cgctcagtgattacctccatctccg

SEQ ID NO: 213445 - DNA, 25 bp, Homo sapien
atctccgcagtgttcgccatacggc

SEQ ID NO: 213446 - DNA, 25 bp, Homo sapien
tgtctcgcccgctcagtgattacct

SEQ ID NO: 213447 - DNA, 25 bp, Homo sapien
ggagagcatcgcgtaattcacagga

SEQ ID NO: 213448 - DNA, 25 bp, Homo sapien
tgcagaagtagtcaagcccgttata

SEQ ID NO: 213449 - DNA, 25 bp, Homo sapien
acgggttacgtactcagcgcttaca

SEQ ID NO: 213450 - DNA, 25 bp, Homo sapien
gtctcctttcttgtcgccatactag

SEQ ID NO: 213451 - DNA, 25 bp, Homo sapien
ccgcgttgctaagaagcgcatttgc

SEQ ID NO: 213452 - DNA, 25 bp, Homo sapien
tcccgtccctgctacattggaatag

SEQ ID NO: 213453 - DNA, 25 bp, Homo sapien
agccagtttgtgtgaagggcccagc

SEQ ID NO: 213454 - DNA, 25 bp, Homo sapien
gatgcgcgagaaagccacttgtccc

SEQ ID NO: 213455 - DNA, 25 bp, Homo sapien
tcggagtgtatcacagaacctgggc

SEQ ID NO: 213456 - DNA, 25 bp, Homo sapien
cgcgagttctgagttggctgctccc

SEQ ID NO: 213457 - DNA, 25 bp, Homo sapien
ccagtcaggggtgacacaaagttcc

SEQ ID NO: 213458 - DNA, 25 bp, Homo sapien
tcggcgctgggacgaacttttcctc

SEQ ID NO: 213459 - DNA, 25 bp, Homo sapien
gacggactcaggacaggcctcctct

SEQ ID NO: 213460 - DNA, 25 bp, Homo sapien
ctgggacggacaggccactccttac

SEQ ID NO: 213461 - DNA, 25 bp, Homo sapien
ggtagactccagaagcatgcccatc

SEQ ID NO: 213462 - DNA, 25 bp, Homo sapien
ttcttccagctgatccctggccggg

SEQ ID NO: 213463 - DNA, 25 bp, Homo sapien
gcctcagcattctcgggtctcacta

SEQ ID NO: 213464 - DNA, 25 bp, Homo sapien
tggcggcgatacaccttcctattcc

SEQ ID NO: 213465 - DNA, 25 bp, Homo sapien
gggcacattcctttcccagaaggga

SEQ ID NO: 213466 - DNA, 25 bp, Homo sapien
taagcagtgggtatcgggcacattc

SEQ ID NO: 213467 - DNA, 25 bp, Homo sapien
ctcggctcgttgattggagaaactg

SEQ ID NO: 213468 - DNA, 25 bp, Homo sapien
cgccctcctcattggtgggtccata

SEQ ID NO: 213469 - DNA, 25 bp, Homo sapien
ctggaagcgcccaacctggatactt

SEQ ID NO: 213470 - DNA, 25 bp, Homo sapien
ctaggtactcattgggccgggaatt

SEQ ID NO: 213471 - DNA, 25 bp, Homo sapien
ccagagcctgtaccaggaggtgttt

SEQ ID NO: 213472 - DNA, 25 bp, Homo sapien
tgcgagatgagaacggacgacccta

SEQ ID NO: 213473 - DNA, 25 bp, Homo sapien
agctggacaccatcctgaatctgga

SEQ ID NO: 213474 - DNA, 25 bp, Homo sapien
aggacctgcagcgtgacaaagcccg

SEQ ID NO: 213475 - DNA, 25 bp, Homo sapien
gagaaagtggagttcctgcgctccc

SEQ ID NO: 213476 - DNA, 25 bp, Homo sapien
tgcgctccctgcgacagatgaagca

SEQ ID NO: 213477 - DNA, 25 bp, Homo sapien
cagatgaagcagaaggtccagagcc

SEQ ID NO: 213478 - DNA, 25 bp, Homo sapien
cgcccagtcagtatgcgctccagta

SEQ ID NO: 213479 - DNA, 25 bp, Homo sapien
tgtccaagactacaaggcccgaagc

SEQ ID NO: 213480 - DNA, 25 bp, Homo sapien
ccgaacaaaagagcctcgcagtctg

SEQ ID NO: 213481 - DNA, 25 bp, Homo sapien
gacgttactcctccgtagtcctgca

SEQ ID NO: 213482 - DNA, 25 bp, Homo sapien
aagccaggttcctctggcagtccca

SEQ ID NO: 213483 - DNA, 25 bp, Homo sapien
ccggcgtcttccgaatacagttaca

SEQ ID NO: 213484 - DNA, 25 bp, Homo sapien
caaacctcgggttgtgcggtcgtat

SEQ ID NO: 213485 - DNA, 25 bp, Homo sapien
agccgcccagccaagcaacattgtt

SEQ ID NO: 213486 - DNA, 25 bp, Homo sapien
gcactcagtctctggctcaggattc

SEQ ID NO: 213487 - DNA, 25 bp, Homo sapien
tcacccggaaggagaagccgtgatc

SEQ ID NO: 213488 - DNA, 25 bp, Homo sapien
ggcaccggcgactcacccggaagga

SEQ ID NO: 213489 - DNA, 25 bp, Homo sapien
attggggcgtctcccgtcgtgcacc

SEQ ID NO: 213490 - DNA, 25 bp, Homo sapien
aagcgggaatcccactcagagcccg

SEQ ID NO: 213491 - DNA, 25 bp, Homo sapien
ccgcgctattcggaagcgggaatcc

SEQ ID NO: 213492 - DNA, 25 bp, Homo sapien
ttggatatccattcgccgtccctca

SEQ ID NO: 213493 - DNA, 25 bp, Homo sapien
ccggattggatatccattcgccgtc

SEQ ID NO: 213494 - DNA, 25 bp, Homo sapien
gaagccgtgatctggctatatggtg

SEQ ID NO: 213495 - DNA, 25 bp, Homo sapien
tctggacaaggtcgtgcaatacctg

SEQ ID NO: 213496 - DNA, 25 bp, Homo sapien
cgttcccaaaaactgcaggtgaccg

SEQ ID NO: 213497 - DNA, 25 bp, Homo sapien
acggcgctcatcgagaaagttctgg

SEQ ID NO: 213498 - DNA, 25 bp, Homo sapien
cgtatgggtacgcacggcgctcatc

SEQ ID NO: 213499 - DNA, 25 bp, Homo sapien
cgcacggcgctcatcgagaaagttc

SEQ ID NO: 213500 - DNA, 25 bp, Homo sapien
tcgtgcaatacctggcggaaaactg

SEQ ID NO: 213501 - DNA, 25 bp, Homo sapien
tggcggaaaactgcaggtgaccgcc

SEQ ID NO: 213502 - DNA, 25 bp, Homo sapien
agaaagttctggacaaggtcgtgca

SEQ ID NO: 213503 - DNA, 25 bp, Homo sapien
gatgctgcagcgaggtatggactcc

SEQ ID NO: 213504 - DNA, 25 bp, Homo sapien
tagctcgagagtacaacgcgcgcct

SEQ ID NO: 213505 - DNA, 25 bp, Homo sapien
agcgcccgagccctactcgactacg

SEQ ID NO: 213506 - DNA, 25 bp, Homo sapien
tactcgactacggcgtcaccgcgga

SEQ ID NO: 213507 - DNA, 25 bp, Homo sapien
cgcaggacgagaacggagacacgta

SEQ ID NO: 213508 - DNA, 25 bp, Homo sapien
cgagaacggagacacgtaggcaaca

SEQ ID NO: 213509 - DNA, 25 bp, Homo sapien
acacgtaggcaacagagggcctggc

SEQ ID NO: 213510 - DNA, 25 bp, Homo sapien
tgtggcccgtagctcgagagtacaa

SEQ ID NO: 213511 - DNA, 25 bp, Homo sapien
gtgccggaagcaccgcaccgtgcga

SEQ ID NO: 213512 - DNA, 25 bp, Homo sapien
aagccgtaaagaaagcctggccgtg

SEQ ID NO: 213513 - DNA, 25 bp, Homo sapien
ctgcgccagggcgttaccttccagg

SEQ ID NO: 213514 - DNA, 25 bp, Homo sapien
cagggcgttaccttccaggagccaa

SEQ ID NO: 213515 - DNA, 25 bp, Homo sapien
taccttccaggagccaacggatctc

SEQ ID NO: 213516 - DNA, 25 bp, Homo sapien
gagccaacggatctcctcagggagg

SEQ ID NO: 213517 - DNA, 25 bp, Homo sapien
gaggcacctgtacctcagccgcggt

SEQ ID NO: 213518 - DNA, 25 bp, Homo sapien
ccgcaccgtgcgaggccaaaggtgc

SEQ ID NO: 213519 - DNA, 25 bp, Homo sapien
ggacgactccggagctgtcaccaca

SEQ ID NO: 213520 - DNA, 25 bp, Homo sapien
ttcagcacttcgtaaatcacccatc

SEQ ID NO: 213521 - DNA, 25 bp, Homo sapien
gacagcttcgaagatgcttttcagc

SEQ ID NO: 213522 - DNA, 25 bp, Homo sapien
aggcggattcagtgtttatttaggc

SEQ ID NO: 213523 - DNA, 25 bp, Homo sapien
actgtaactataattaggcggattc

SEQ ID NO: 213524 - DNA, 25 bp, Homo sapien
tcgggtgttgtgtttccactgtaac

SEQ ID NO: 213525 - DNA, 25 bp, Homo sapien
tccaggaaagctgtcaggagacgct

SEQ ID NO: 213526 - DNA, 25 bp, Homo sapien
tcacctcggaagagggcacacccgg

SEQ ID NO: 213527 - DNA, 25 bp, Homo sapien
ccagagagcgatcgaggtttgttgc

SEQ ID NO: 213528 - DNA, 25 bp, Homo sapien
atcgaggtttgttgcccgccgcgga

SEQ ID NO: 213529 - DNA, 25 bp, Homo sapien
tccgccgaccaaaggtttgccagtg

SEQ ID NO: 213530 - DNA, 25 bp, Homo sapien
cgcgctgtcggcttgtttggaaagc

SEQ ID NO: 213531 - DNA, 25 bp, Homo sapien
cttgtttggaaagcccagaggcgct

SEQ ID NO: 213532 - DNA, 25 bp, Homo sapien
gcccagaggcgcttcgaggtaaaaa

SEQ ID NO: 213533 - DNA, 25 bp, Homo sapien
gagacccagggctttcaccttgagc

SEQ ID NO: 213534 - DNA, 25 bp, Homo sapien
ttcctgccgtccagtgcccggagac

SEQ ID NO: 213535 - DNA, 25 bp, Homo sapien
tattatagtccatgcgtcaaggccg

SEQ ID NO: 213536 - DNA, 25 bp, Homo sapien
caacctttcggcagtatgtcacagc

SEQ ID NO: 213537 - DNA, 25 bp, Homo sapien
gctgtcaaccgcctgagccgagctt

SEQ ID NO: 213538 - DNA, 25 bp, Homo sapien
cggccctcgcttgcatagctgtcaa

SEQ ID NO: 213539 - DNA, 25 bp, Homo sapien
cgggatagccggagttctgctgaaa

SEQ ID NO: 213540 - DNA, 25 bp, Homo sapien
aatagcctccgtctccttctgattg

SEQ ID NO: 213541 - DNA, 25 bp, Homo sapien
aagctcgcggtctgctcgttcccat

SEQ ID NO: 213542 - DNA, 25 bp, Homo sapien
ggggctcgaatccatggcctgaccc

SEQ ID NO: 213543 - DNA, 25 bp, Homo sapien
tggcggccacagcttcttccctcgc

SEQ ID NO: 213544 - DNA, 25 bp, Homo sapien
gagcatcgtctttgcttccctgtct

SEQ ID NO: 213545 - DNA, 25 bp, Homo sapien
tgagcatcgtctttgcttccctgtc

SEQ ID NO: 213546 - DNA, 25 bp, Homo sapien
ttgagcatcgtctttgcttccctgt

SEQ ID NO: 213547 - DNA, 25 bp, Homo sapien
agcatcgtctttgcttccctgtctc

SEQ ID NO: 213548 - DNA, 25 bp, Homo sapien
ggccccagcgccattttgagcatcg

SEQ ID NO: 213549 - DNA, 25 bp, Homo sapien
tgtcatggcggccacagcttcttcc

SEQ ID NO: 213550 - DNA, 25 bp, Homo sapien
tttgagcatcgtctttgcttccctg

SEQ ID NO: 213551 - DNA, 25 bp, Homo sapien
agccgctcgctttactgcttttggg

SEQ ID NO: 213552 - DNA, 25 bp, Homo sapien
gtgtactcagcccaacctcagttcg

SEQ ID NO: 213553 - DNA, 25 bp, Homo sapien
cttctccagttccagcagctgcgtg

SEQ ID NO: 213554 - DNA, 25 bp, Homo sapien
gccggcacaggtacttattaaagtg

SEQ ID NO: 213555 - DNA, 25 bp, Homo sapien
cctgcctttcggtgaggtccagcaa

SEQ ID NO: 213556 - DNA, 25 bp, Homo sapien
tgcgccctctaagcgaacggctaaa

SEQ ID NO: 213557 - DNA, 25 bp, Homo sapien
gctgtcgagagaaccctgtaggcta

SEQ ID NO: 213558 - DNA, 25 bp, Homo sapien
cgggtcagggcaaagcattcagagc

SEQ ID NO: 213559 - DNA, 25 bp, Homo sapien
acgtgcggctcatactcgggcgccg

SEQ ID NO: 213560 - DNA, 25 bp, Homo sapien
cgtaggcattctggtgggctttacc

SEQ ID NO: 213561 - DNA, 25 bp, Homo sapien
atctgccgctcgctgaggttcagca

SEQ ID NO: 213562 - DNA, 25 bp, Homo sapien
attctggtgggctttaccgaaggcg

SEQ ID NO: 213563 - DNA, 25 bp, Homo sapien
caggttggccatctctacacggcga

SEQ ID NO: 213564 - DNA, 25 bp, Homo sapien
ggccatctctacacggcgaggccgg

SEQ ID NO: 213565 - DNA, 25 bp, Homo sapien
gacgacgaggccaatcccttggcct

SEQ ID NO: 213566 - DNA, 25 bp, Homo sapien
tcatggagtgtaaggcgttcatgaa

SEQ ID NO: 213567 - DNA, 25 bp, Homo sapien
ctccgaagagagcagccgcggcgtt

SEQ ID NO: 213568 - DNA, 25 bp, Homo sapien
cgaggaatagcctccgaagagagca

SEQ ID NO: 213569 - DNA, 25 bp, Homo sapien
ctgccagggtacgaggaatagcctc

SEQ ID NO: 213570 - DNA, 25 bp, Homo sapien
agccgaagccattgctgccagggta

SEQ ID NO: 213571 - DNA, 25 bp, Homo sapien
ccagggactgcagcgagcaagctga

SEQ ID NO: 213572 - DNA, 25 bp, Homo sapien
cggcctcatgcagctgccgttgagc

SEQ ID NO: 213573 - DNA, 25 bp, Homo sapien
ctccttgctcttggcatgtggggca

SEQ ID NO: 213574 - DNA, 25 bp, Homo sapien
tgcagctgccgttgagctccttgct

SEQ ID NO: 213575 - DNA, 25 bp, Homo sapien
cccaaggaggcgaagaagagcaagc

SEQ ID NO: 213576 - DNA, 25 bp, Homo sapien
ctccgcttcgggactttgctcagca

SEQ ID NO: 213577 - DNA, 25 bp, Homo sapien
aggcgccttagaaactccgcttcgg

SEQ ID NO: 213578 - DNA, 25 bp, Homo sapien
agcgatcaggacaccaaaacggtta

SEQ ID NO: 213579 - DNA, 25 bp, Homo sapien
gccagagacgcgataggaaagaatg

SEQ ID NO: 213580 - DNA, 25 bp, Homo sapien
cagccacctacgatggcccaaggag

SEQ ID NO: 213581 - DNA, 25 bp, Homo sapien
cggcgactggcgacaagctaccagc

SEQ ID NO: 213582 - DNA, 25 bp, Homo sapien
ttgggagctggaggtaaccgaatta

SEQ ID NO: 213583 - DNA, 25 bp, Homo sapien
tcaatgtcaccagcgaaatgggttc

SEQ ID NO: 213584 - DNA, 25 bp, Homo sapien
ggcacaccggcgactcttcaatgtc

SEQ ID NO: 213585 - DNA, 25 bp, Homo sapien
accgagctgaactcgggctttgaga

SEQ ID NO: 213586 - DNA, 25 bp, Homo sapien
ggctcgtctggcaccgagctgaact

SEQ ID NO: 213587 - DNA, 25 bp, Homo sapien
acgccagtttcctgagaagctccca

SEQ ID NO: 213588 - DNA, 25 bp, Homo sapien
gcggcagacgccagtttcctgagaa

SEQ ID NO: 213589 - DNA, 25 bp, Homo sapien
tacctgtgcggtcttccgctagggc

SEQ ID NO: 213590 - DNA, 25 bp, Homo sapien
aaatgggttccatatgtccgacccg

SEQ ID NO: 213591 - DNA, 25 bp, Homo sapien
gcctttttcttcttgcggctctgca

SEQ ID NO: 213592 - DNA, 25 bp, Homo sapien
ctctcacggacgcacggagtgcgcg

SEQ ID NO: 213593 - DNA, 25 bp, Homo sapien
ttgacgccgatcatgctggcccggc

SEQ ID NO: 213594 - DNA, 25 bp, Homo sapien
tgtggatgctgttgacgccgatcat

SEQ ID NO: 213595 - DNA, 25 bp, Homo sapien
gcccgtagcgcacggagcacagcga

SEQ ID NO: 213596 - DNA, 25 bp, Homo sapien
ccgcatgaaatggaggcgcccgatc

SEQ ID NO: 213597 - DNA, 25 bp, Homo sapien
agcgctgcggccagccgtagcacag

SEQ ID NO: 213598 - DNA, 25 bp, Homo sapien
ctgaccaccaggtcggtgtagagca

SEQ ID NO: 213599 - DNA, 25 bp, Homo sapien
gctggtgcaccatagcgttatccca

SEQ ID NO: 213600 - DNA, 25 bp, Homo sapien
cccaccgcagggctggcacactgcc

SEQ ID NO: 213601 - DNA, 25 bp, Homo sapien
tgcaccatagcgttatcccacctga

SEQ ID NO: 213602 - DNA, 25 bp, Homo sapien
tagcgttatcccacctgaccggccc

SEQ ID NO: 213603 - DNA, 25 bp, Homo sapien
acactgccgccacctgtccacggtg

SEQ ID NO: 213604 - DNA, 25 bp, Homo sapien
gtccacggtgcggacccacctgtcg

SEQ ID NO: 213605 - DNA, 25 bp, Homo sapien
tgtcccgggccttctacggctgtga

SEQ ID NO: 213606 - DNA, 25 bp, Homo sapien
cacctgtcggcgctggtgcaccata

SEQ ID NO: 213607 - DNA, 25 bp, Homo sapien
tccggctgagcctgccgcaccaccc

SEQ ID NO: 213608 - DNA, 25 bp, Homo sapien
agcgcgtgggcgatctccaccctcc

SEQ ID NO: 213609 - DNA, 25 bp, Homo sapien
tgggcaacttgtggtcttttttcca

SEQ ID NO: 213610 - DNA, 25 bp, Homo sapien
cttggtgttgggcaacttgtggtct

SEQ ID NO: 213611 - DNA, 25 bp, Homo sapien
cggatcttggtgttgggcaacttgt

SEQ ID NO: 213612 - DNA, 25 bp, Homo sapien
agcggatcttggtgttgggcaactt

SEQ ID NO: 213613 - DNA, 25 bp, Homo sapien
gcctgccgcaccacccgagcggatc

SEQ ID NO: 213614 - DNA, 25 bp, Homo sapien
acctgctggcgcgtgtaggcggtcc

SEQ ID NO: 213615 - DNA, 25 bp, Homo sapien
cgccggcgtagtacccgggcgagtg

SEQ ID NO: 213616 - DNA, 25 bp, Homo sapien
ggccgcgtagcgctgcacggtgcac

SEQ ID NO: 213617 - DNA, 25 bp, Homo sapien
ggtagacgacgggctctttgcacgc

SEQ ID NO: 213618 - DNA, 25 bp, Homo sapien
cacgtgaactttgcgcatccagggg

SEQ ID NO: 213619 - DNA, 25 bp, Homo sapien
ctcacgtgaactttgcgcatccagg

SEQ ID NO: 213620 - DNA, 25 bp, Homo sapien
cccgtgctcacgtgaactttgcgca

SEQ ID NO: 213621 - DNA, 25 bp, Homo sapien
ctcacccgtgctcacgtgaactttg

SEQ ID NO: 213622 - DNA, 25 bp, Homo sapien
cgagtggtcgctgggtaggtaatcg

SEQ ID NO: 213623 - DNA, 25 bp, Homo sapien
gagctctctcctgtccactattgtg

SEQ ID NO: 213624 - DNA, 25 bp, Homo sapien
ctgctgctctacacttcacaaggga

SEQ ID NO: 213625 - DNA, 25 bp, Homo sapien
tggcgcccaagagcagagatttttc

SEQ ID NO: 213626 - DNA, 25 bp, Homo sapien
catcaccttttgttggcggggagaa

SEQ ID NO: 213627 - DNA, 25 bp, Homo sapien
cctcagaagccggaacgtgactttt

SEQ ID NO: 213628 - DNA, 25 bp, Homo sapien
tctttgttaaacagctaggcgcgtc

SEQ ID NO: 213629 - DNA, 25 bp, Homo sapien
cgcgtcacgaggctctcaaacattt

SEQ ID NO: 213630 - DNA, 25 bp, Homo sapien
gtgcccagtccgctaggaatcatca

SEQ ID NO: 213631 - DNA, 25 bp, Homo sapien
cgaaatatcgtaacacaaggcgagg

SEQ ID NO: 213632 - DNA, 25 bp, Homo sapien
gtctggtagcgggtatacgcggtcc

SEQ ID NO: 213633 - DNA, 25 bp, Homo sapien
agccaggctcatacttttcaatttg

SEQ ID NO: 213634 - DNA, 25 bp, Homo sapien
gctgtagccaggctcatacttttca

SEQ ID NO: 213635 - DNA, 25 bp, Homo sapien
tcagggctggaaggcgctgccagct

SEQ ID NO: 213636 - DNA, 25 bp, Homo sapien
caggcttgtgggaaccggtccccag

SEQ ID NO: 213637 - DNA, 25 bp, Homo sapien
taacacaaggcgaggcaggcttgtg

SEQ ID NO: 213638 - DNA, 25 bp, Homo sapien
tatcgtaacacaaggcgaggcaggc

SEQ ID NO: 213639 - DNA, 25 bp, Homo sapien
cgctggcctcgtctatttcggtgaa

SEQ ID NO: 213640 - DNA, 25 bp, Homo sapien
ttctcgctgatgacctcaagaggta

SEQ ID NO: 213641 - DNA, 25 bp, Homo sapien
cttcgttttgctatgtatgcggcca

SEQ ID NO: 213642 - DNA, 25 bp, Homo sapien
cgtggtcgttataaccctgtgcttc

SEQ ID NO: 213643 - DNA, 25 bp, Homo sapien
ttagcaactgatagtccgggccatt

SEQ ID NO: 213644 - DNA, 25 bp, Homo sapien
agagagctgccactgccataattta

SEQ ID NO: 213645 - DNA, 25 bp, Homo sapien
gggatccctgtaagagccgctcaga

SEQ ID NO: 213646 - DNA, 25 bp, Homo sapien
gctgaggtccatcccattgtaattg

SEQ ID NO: 213647 - DNA, 25 bp, Homo sapien
cccaaaggaggaacctgttacgcag

SEQ ID NO: 213648 - DNA, 25 bp, Homo sapien
cagcgtctggtaacgtgtgtatgtc

SEQ ID NO: 213649 - DNA, 25 bp, Homo sapien
atcttgatctgcctctccgtcaggc

SEQ ID NO: 213650 - DNA, 25 bp, Homo sapien
agacgcgctgagcagtttgctctcc

SEQ ID NO: 213651 - DNA, 25 bp, Homo sapien
ctcctcggcactgagctgagacgcg

SEQ ID NO: 213652 - DNA, 25 bp, Homo sapien
ctcgagtagtgaggcctcagagcac

SEQ ID NO: 213653 - DNA, 25 bp, Homo sapien
ttcactcggcctgtttttcttcctc

SEQ ID NO: 213654 - DNA, 25 bp, Homo sapien
cctgttacgcagagtggagatgctg

SEQ ID NO: 213655 - DNA, 25 bp, Homo sapien
ttctgtctcgccgaacacgctcttg

SEQ ID NO: 213656 - DNA, 25 bp, Homo sapien
cgacgggaagtctcactcactgttg

SEQ ID NO: 213657 - DNA, 25 bp, Homo sapien
ccggagtggagcacttctgctcttc

SEQ ID NO: 213658 - DNA, 25 bp, Homo sapien
aggccgactctttctcgcggtagaa

SEQ ID NO: 213659 - DNA, 25 bp, Homo sapien
gcgggtccgcatagcccgacgaata

SEQ ID NO: 213660 - DNA, 25 bp, Homo sapien
gctccgccgggtttatgatttgttg

SEQ ID NO: 213661 - DNA, 25 bp, Homo sapien
ttgtgttttatagtccgagcgccgc

SEQ ID NO: 213662 - DNA, 25 bp, Homo sapien
cactgttgcacgaattcatccgctg

SEQ ID NO: 213663 - DNA, 25 bp, Homo sapien
atcttgatctgtctttccgtgaggc

SEQ ID NO: 213664 - DNA, 25 bp, Homo sapien
tgtctttccgtgaggcagagcgtgt

SEQ ID NO: 213665 - DNA, 25 bp, Homo sapien
aatcttgatctgtctttccgtgagg

SEQ ID NO: 213666 - DNA, 25 bp, Homo sapien
tcttgatctgtctttccgtgaggca

SEQ ID NO: 213667 - DNA, 25 bp, Homo sapien
ttgatctgtctttccgtgaggcaga

SEQ ID NO: 213668 - DNA, 25 bp, Homo sapien
tgatctgtctttccgtgaggcagag

SEQ ID NO: 213669 - DNA, 25 bp, Homo sapien
ggcagagcgtgtgcgcgatctcgat

SEQ ID NO: 213670 - DNA, 25 bp, Homo sapien
caaatcttgatctgtctttccgtga

SEQ ID NO: 213671 - DNA, 25 bp, Homo sapien
ccgaacttgaggctggatatttaga

SEQ ID NO: 213672 - DNA, 25 bp, Homo sapien
cggcgttacctgagcttcgcatcca

SEQ ID NO: 213673 - DNA, 25 bp, Homo sapien
atgggaaagccgagccctgtggatt

SEQ ID NO: 213674 - DNA, 25 bp, Homo sapien
gtcggttttacgagattccttgata

SEQ ID NO: 213675 - DNA, 25 bp, Homo sapien
cgcgcagtgcatgttgaaggaactc

SEQ ID NO: 213676 - DNA, 25 bp, Homo sapien
tccggaagttactctcggccgccaa

SEQ ID NO: 213677 - DNA, 25 bp, Homo sapien
aaggaactcggctcgagcccatagc

SEQ ID NO: 213678 - DNA, 25 bp, Homo sapien
agaggttctgctcaaagggcgcgca

SEQ ID NO: 213679 - DNA, 25 bp, Homo sapien
atccgtgttgagcagcatgagcgca

SEQ ID NO: 213680 - DNA, 25 bp, Homo sapien
tgctcgcgttttccagagccgggtc

SEQ ID NO: 213681 - DNA, 25 bp, Homo sapien
acgcatgtgcgcatgttccgggaga

SEQ ID NO: 213682 - DNA, 25 bp, Homo sapien
agctccctagggaagtcgccgccat

SEQ ID NO: 213683 - DNA, 25 bp, Homo sapien
cgccatcattgaggccctccaggtt

SEQ ID NO: 213684 - DNA, 25 bp, Homo sapien
tcccaggtcctgcatgtctggccag

SEQ ID NO: 213685 - DNA, 25 bp, Homo sapien
ggtcatgcgcttcccgatgttctaa

SEQ ID NO: 213686 - DNA, 25 bp, Homo sapien
gaaggtctttttggctgtccacgcg

SEQ ID NO: 213687 - DNA, 25 bp, Homo sapien
atactaccactagcggggactggcg

SEQ ID NO: 213688 - DNA, 25 bp, Homo sapien
gtcccagctgaagcctacttcttgt

SEQ ID NO: 213689 - DNA, 25 bp, Homo sapien
tcctcctgctcgcatttgctgctgg

SEQ ID NO: 213690 - DNA, 25 bp, Homo sapien
ttgctgctggggaacttgtctttgt

SEQ ID NO: 213691 - DNA, 25 bp, Homo sapien
cagggcgtgcgatacctcgattcgc

SEQ ID NO: 213692 - DNA, 25 bp, Homo sapien
cgattcgccgcttacgagtcagata

SEQ ID NO: 213693 - DNA, 25 bp, Homo sapien
acgagcctgggagaccattataata

SEQ ID NO: 213694 - DNA, 25 bp, Homo sapien
ccattataataagggcaggggacct

SEQ ID NO: 213695 - DNA, 25 bp, Homo sapien
gccgcccagtcaaatcggagttttc

SEQ ID NO: 213696 - DNA, 25 bp, Homo sapien
gctccggttacctcagggctgtgac

SEQ ID NO: 213697 - DNA, 25 bp, Homo sapien
aagcgtgacgtgtttcaggctcggc

SEQ ID NO: 213698 - DNA, 25 bp, Homo sapien
cgcagatagctacagacattcgggc

SEQ ID NO: 213699 - DNA, 25 bp, Homo sapien
acattcgggcggaatctgggctccc

SEQ ID NO: 213700 - DNA, 25 bp, Homo sapien
gctgcaccaacacgcgcgaacggga

SEQ ID NO: 213701 - DNA, 25 bp, Homo sapien
ccctcagcaagtcaggctccggtta

SEQ ID NO: 213702 - DNA, 25 bp, Homo sapien
tccagggaaaccgaagctcaggccg

SEQ ID NO: 213703 - DNA, 25 bp, Homo sapien
aggtctggatcctgcgcaccgaata

SEQ ID NO: 213704 - DNA, 25 bp, Homo sapien
gggcgaagccgcagtcataataatt

SEQ ID NO: 213705 - DNA, 25 bp, Homo sapien
gcccgtggtagaactcctggatttg

SEQ ID NO: 213706 - DNA, 25 bp, Homo sapien
ttttattgaattttgaggcggcggc

SEQ ID NO: 213707 - DNA, 25 bp, Homo sapien
ctgcgtactgcaccaggtctggatc

SEQ ID NO: 213708 - DNA, 25 bp, Homo sapien
cggcaagcttgcagtctgcgtactg

SEQ ID NO: 213709 - DNA, 25 bp, Homo sapien
gcagcgggtcgtagccgtagaaatt

SEQ ID NO: 213710 - DNA, 25 bp, Homo sapien
accgaataggctctggcgttgcagc

SEQ ID NO: 213711 - DNA, 25 bp, Homo sapien
cgcgcattctttgggagcgcgcaaa

SEQ ID NO: 213712 - DNA, 25 bp, Homo sapien
gctccagagcttgcgcccgtgcgaa

SEQ ID NO: 213713 - DNA, 25 bp, Homo sapien
tggactcatacaaaggctccagagc

SEQ ID NO: 213714 - DNA, 25 bp, Homo sapien
cagccctggactcatacaaaggctc

SEQ ID NO: 213715 - DNA, 25 bp, Homo sapien
gagcgcgcaaagcatccagagacca

SEQ ID NO: 213716 - DNA, 25 bp, Homo sapien
gcccatgggaaaacgcgcattcttt

SEQ ID NO: 213717 - DNA, 25 bp, Homo sapien
gccttcgcgcccatgggaaaacgcg

SEQ ID NO: 213718 - DNA, 25 bp, Homo sapien
gagaccacatccgagccttcccgca

SEQ ID NO: 213719 - DNA, 25 bp, Homo sapien
tttccgacgcctgattctggagggg

SEQ ID NO: 213720 - DNA, 25 bp, Homo sapien
caaagtgttctttcccggcttctct

SEQ ID NO: 213721 - DNA, 25 bp, Homo sapien
tgcgacaacaaagtgttctttcccg

SEQ ID NO: 213722 - DNA, 25 bp, Homo sapien
gcaggaggctcctcgtttccgacgc

SEQ ID NO: 213723 - DNA, 25 bp, Homo sapien
tctgaagcatttgcgacaacaaagt

SEQ ID NO: 213724 - DNA, 25 bp, Homo sapien
cccagttgcaatttctgaagcattt

SEQ ID NO: 213725 - DNA, 25 bp, Homo sapien
cccagctgcggctctctcagctccg

SEQ ID NO: 213726 - DNA, 25 bp, Homo sapien
tcctcgtttccgacgcctgattctg

SEQ ID NO: 213727 - DNA, 25 bp, Homo sapien
ctgcctgatgcggagctccgctttc

SEQ ID NO: 213728 - DNA, 25 bp, Homo sapien
gatcagttcgtcctttcgttggagg

SEQ ID NO: 213729 - DNA, 25 bp, Homo sapien
tcacttgcagtctcccttcattcgg

SEQ ID NO: 213730 - DNA, 25 bp, Homo sapien
cttcattcgggccatgcttcgttcc

SEQ ID NO: 213731 - DNA, 25 bp, Homo sapien
gggccatgcttcgttcccaactcta

SEQ ID NO: 213732 - DNA, 25 bp, Homo sapien
tcccgccgtctcttggatcagttcg

SEQ ID NO: 213733 - DNA, 25 bp, Homo sapien
tgatgcggagctccgctttctcctg

SEQ ID NO: 213734 - DNA, 25 bp, Homo sapien
cccaaggcctggatgagaagcgcag

SEQ ID NO: 213735 - DNA, 25 bp, Homo sapien
gctggggctagagccgccaagcccg

SEQ ID NO: 213736 - DNA, 25 bp, Homo sapien
agatctgcatccaggcccatgaagc

SEQ ID NO: 213737 - DNA, 25 bp, Homo sapien
atccaggcccatgaagcaggaggcc

SEQ ID NO: 213738 - DNA, 25 bp, Homo sapien
cgggtctcctttggcgctggggcta

SEQ ID NO: 213739 - DNA, 25 bp, Homo sapien
ttctctgcgtgggtcgagaagccga

SEQ ID NO: 213740 - DNA, 25 bp, Homo sapien
ggtcgagaagccgacgggattcgga

SEQ ID NO: 213741 - DNA, 25 bp, Homo sapien
gattcggaggaacgcgcagagcgtt

SEQ ID NO: 213742 - DNA, 25 bp, Homo sapien
ccaggcccatgaagcaggaggccaa

SEQ ID NO: 213743 - DNA, 25 bp, Homo sapien
tctttgattagacagcacggcctcc

SEQ ID NO: 213744 - DNA, 25 bp, Homo sapien
tgcccgccgaagtttccaaactgta

SEQ ID NO: 213745 - DNA, 25 bp, Homo sapien
tccaaactgtactcgggcgtgccct

SEQ ID NO: 213746 - DNA, 25 bp, Homo sapien
cgcgtactggccagaaggaaacttg

SEQ ID NO: 213747 - DNA, 25 bp, Homo sapien
ggcgcgtcctcactctcgtgactta

SEQ ID NO: 213748 - DNA, 25 bp, Homo sapien
tagctgctaagcgtcccagaaatgg

SEQ ID NO: 213749 - DNA, 25 bp, Homo sapien
gcagtttcccttcacattgtccgca

SEQ ID NO: 213750 - DNA, 25 bp, Homo sapien
ttctcagacattatccgggcgcttg

SEQ ID NO: 213751 - DNA, 25 bp, Homo sapien
gcacccatcgcaaaaacgcagctgt

SEQ ID NO: 213752 - DNA, 25 bp, Homo sapien
gaagccgccgcctacacggaaaatc

SEQ ID NO: 213753 - DNA, 25 bp, Homo sapien
cgcacactttgtccgcgtggagaga

SEQ ID NO: 213754 - DNA, 25 bp, Homo sapien
tttacgagcggcagaagcacccgcc

SEQ ID NO: 213755 - DNA, 25 bp, Homo sapien
ctgtcctgaaaagaaagacgtccgg

SEQ ID NO: 213756 - DNA, 25 bp, Homo sapien
tcaccgtgttgatgaacttcaaacg

SEQ ID NO: 213757 - DNA, 25 bp, Homo sapien
ccacgtgtccggcagggaagtccga

SEQ ID NO: 213758 - DNA, 25 bp, Homo sapien
gcgcagaccctatgatcggctcggc

SEQ ID NO: 213759 - DNA, 25 bp, Homo sapien
aagattctctcgcagctctgcgtcc

SEQ ID NO: 213760 - DNA, 25 bp, Homo sapien
gtgaggccgagacagagaccaacct

SEQ ID NO: 213761 - DNA, 25 bp, Homo sapien
acagagaccaacctctaggcggcgc

SEQ ID NO: 213762 - DNA, 25 bp, Homo sapien
ccctggcgttgagtccgcgctgaac

SEQ ID NO: 213763 - DNA, 25 bp, Homo sapien
gttgagtccgcgctgaacaagattc

SEQ ID NO: 213764 - DNA, 25 bp, Homo sapien
tgaacaagattctctcgcagctctg

SEQ ID NO: 213765 - DNA, 25 bp, Homo sapien
ctggggaagcagctctgtggtctcc

SEQ ID NO: 213766 - DNA, 25 bp, Homo sapien
agtccgcgctgaacaagattctctc

SEQ ID NO: 213767 - DNA, 25 bp, Homo sapien
aactactctctttgggagggccagg

SEQ ID NO: 213768 - DNA, 25 bp, Homo sapien
gccgctggagttactatggcaacta

SEQ ID NO: 213769 - DNA, 25 bp, Homo sapien
ctgcctgagttaggtgtcgtcacgc

SEQ ID NO: 213770 - DNA, 25 bp, Homo sapien
tttgagtctcggacccaggagatcc

SEQ ID NO: 213771 - DNA, 25 bp, Homo sapien
gatctagggaacaccgtcttgaacc

SEQ ID NO: 213772 - DNA, 25 bp, Homo sapien
gccgcgccaagcacacggtatgggt

SEQ ID NO: 213773 - DNA, 25 bp, Homo sapien
ggaggctgccacatgacctgttaca

SEQ ID NO: 213774 - DNA, 25 bp, Homo sapien
ttgagccacacgtaaggcccggctg

SEQ ID NO: 213775 - DNA, 25 bp, Homo sapien
tcagcagcgtgcacggagatcttca

SEQ ID NO: 213776 - DNA, 25 bp, Homo sapien
ttggtccattccacgcagtcccagg

SEQ ID NO: 213777 - DNA, 25 bp, Homo sapien
ctcggtctatctgcgcgccaagatc

SEQ ID NO: 213778 - DNA, 25 bp, Homo sapien
ggtcagcgtttagagccactccctg

SEQ ID NO: 213779 - DNA, 25 bp, Homo sapien
ggtggctggacatagcctccctatc

SEQ ID NO: 213780 - DNA, 25 bp, Homo sapien
ctcctctggactgctgggactctaa

SEQ ID NO: 213781 - DNA, 25 bp, Homo sapien
cccgggacacaggtgcagatctcca

SEQ ID NO: 213782 - DNA, 25 bp, Homo sapien
gttgtgaatctacaggcccttgacg

SEQ ID NO: 213783 - DNA, 25 bp, Homo sapien
ccacgggcggttggtcctgaaagct

SEQ ID NO: 213784 - DNA, 25 bp, Homo sapien
gagatcaaggttaagccggtggccc

SEQ ID NO: 213785 - DNA, 25 bp, Homo sapien
agaggggcctttcacgccgcagtcc

SEQ ID NO: 213786 - DNA, 25 bp, Homo sapien
cgtcttcgtagactgcaggagtcca

SEQ ID NO: 213787 - DNA, 25 bp, Homo sapien
tgaggcctctcgaggcagtgtctgt

SEQ ID NO: 213788 - DNA, 25 bp, Homo sapien
cgaaggggctcacgctcctgcgttc

SEQ ID NO: 213789 - DNA, 25 bp, Homo sapien
ggataggcgagagcgcttcctgcct

SEQ ID NO: 213790 - DNA, 25 bp, Homo sapien
gaagctgcctcggtctggagatcaa

SEQ ID NO: 213791 - DNA, 25 bp, Homo sapien
tcccgccgacaagaaagggctttgc

SEQ ID NO: 213792 - DNA, 25 bp, Homo sapien
cgaggaggcaccgacacacacaaca

SEQ ID NO: 213793 - DNA, 25 bp, Homo sapien
ccaggtccctcgcagcatgttaatg

SEQ ID NO: 213794 - DNA, 25 bp, Homo sapien
cgtctctatgctcatcgcgccgaga

SEQ ID NO: 213795 - DNA, 25 bp, Homo sapien
gcacggggagaaaaatcaatgtctc

SEQ ID NO: 213796 - DNA, 25 bp, Homo sapien
tgccattccaggaagcgggccgcct

SEQ ID NO: 213797 - DNA, 25 bp, Homo sapien
tctctgttgttgctgcgcttgccat

SEQ ID NO: 213798 - DNA, 25 bp, Homo sapien
ggccgcctccagtagcgtctctatg

SEQ ID NO: 213799 - DNA, 25 bp, Homo sapien
taggctcctgtctgctcgatgagcg

SEQ ID NO: 213800 - DNA, 25 bp, Homo sapien
tcgatgagcgtccactcgccagttc

SEQ ID NO: 213801 - DNA, 25 bp, Homo sapien
cctcaagtctcaaacacggtgcggg

SEQ ID NO: 213802 - DNA, 25 bp, Homo sapien
cagggaaaaccctcagctctggtca

SEQ ID NO: 213803 - DNA, 25 bp, Homo sapien
ctctggtcaaaagccaagtgagcga

SEQ ID NO: 213804 - DNA, 25 bp, Homo sapien
aaggaggcgatgcaacgtcaccctg

SEQ ID NO: 213805 - DNA, 25 bp, Homo sapien
gcacccaggtctcgaggttccagga

SEQ ID NO: 213806 - DNA, 25 bp, Homo sapien
tttggccgcaggtgaacagacagcg

SEQ ID NO: 213807 - DNA, 25 bp, Homo sapien
gatggcctcaagaatccggctttta

SEQ ID NO: 213808 - DNA, 25 bp, Homo sapien
cccaaatacggaggccaggagcttt

SEQ ID NO: 213809 - DNA, 25 bp, Homo sapien
tgtcgatcccgaccaaaacattggc

SEQ ID NO: 213810 - DNA, 25 bp, Homo sapien
atcggccttagctagtattcgtttg

SEQ ID NO: 213811 - DNA, 25 bp, Homo sapien
ggcctcgttacgaccgactcgaaca

SEQ ID NO: 213812 - DNA, 25 bp, Homo sapien
tatttcctccgccaccgagtaggga

SEQ ID NO: 213813 - DNA, 25 bp, Homo sapien
cctgttcaccttcgactggatgtta

SEQ ID NO: 213814 - DNA, 25 bp, Homo sapien
aggagcttttcgttgtctcgcccga

SEQ ID NO: 213815 - DNA, 25 bp, Homo sapien
gagggtgagaatggtataaatttca

SEQ ID NO: 213816 - DNA, 25 bp, Homo sapien
atttctattagacaggacgggttgg

SEQ ID NO: 213817 - DNA, 25 bp, Homo sapien
cctcttccctggagagcgactgttc

SEQ ID NO: 213818 - DNA, 25 bp, Homo sapien
gcctccgggctttattgcaagttta

SEQ ID NO: 213819 - DNA, 25 bp, Homo sapien
cggtaacgagttcatctatttaatt

SEQ ID NO: 213820 - DNA, 25 bp, Homo sapien
catctatttaattcgcggttgcagc

SEQ ID NO: 213821 - DNA, 25 bp, Homo sapien
gcggttgcagctcggggatttctat

SEQ ID NO: 213822 - DNA, 25 bp, Homo sapien
gcaagtttacggtaacgagttcatc

SEQ ID NO: 213823 - DNA, 25 bp, Homo sapien
cgtagcttgctgagagattcgctgc

SEQ ID NO: 213824 - DNA, 25 bp, Homo sapien
gcgtagacgcgaccctgtgatccca

SEQ ID NO: 213825 - DNA, 25 bp, Homo sapien
tttcgtagcttgctgagagattcgc

SEQ ID NO: 213826 - DNA, 25 bp, Homo sapien
gatcccatttcgtagcttgctgaga

SEQ ID NO: 213827 - DNA, 25 bp, Homo sapien
tgtgatcccatttcgtagcttgctg

SEQ ID NO: 213828 - DNA, 25 bp, Homo sapien
ccctgtgatcccatttcgtagcttg

SEQ ID NO: 213829 - DNA, 25 bp, Homo sapien
cgcgaccctgtgatcccatttcgta

SEQ ID NO: 213830 - DNA, 25 bp, Homo sapien
agacgcgaccctgtgatcccatttc

SEQ ID NO: 213831 - DNA, 25 bp, Homo sapien
tagaaattatttcgggcctggagcc

SEQ ID NO: 213832 - DNA, 25 bp, Homo sapien
gctagccagccggagtaaaacccga

SEQ ID NO: 213833 - DNA, 25 bp, Homo sapien
acccgaaagatggagcctcaggttc

SEQ ID NO: 213834 - DNA, 25 bp, Homo sapien
agcttccggaggtagtttctacgca

SEQ ID NO: 213835 - DNA, 25 bp, Homo sapien
attgcgccactactcccttattcgg

SEQ ID NO: 213836 - DNA, 25 bp, Homo sapien
gaggcctaataaaatccacttgctt

SEQ ID NO: 213837 - DNA, 25 bp, Homo sapien
cccttattcggcttctggaggccta

SEQ ID NO: 213838 - DNA, 25 bp, Homo sapien
ctatttggagtagggatcgcctgca

SEQ ID NO: 213839 - DNA, 25 bp, Homo sapien
cccgcaggttctcctggagtggtga

SEQ ID NO: 213840 - DNA, 25 bp, Homo sapien
gaccgccttcttcttccattcgaga

SEQ ID NO: 213841 - DNA, 25 bp, Homo sapien
agatggctcgtaccgaacctccttg

SEQ ID NO: 213842 - DNA, 25 bp, Homo sapien
ggggctggaccaatacatctgccga

SEQ ID NO: 213843 - DNA, 25 bp, Homo sapien
atacatctgccgatgccctggccga

SEQ ID NO: 213844 - DNA, 25 bp, Homo sapien
ccctggccgaatggcaggcgacatc

SEQ ID NO: 213845 - DNA, 25 bp, Homo sapien
ccaggccgctggaagcctgtagctc

SEQ ID NO: 213846 - DNA, 25 bp, Homo sapien
agctccgcggacgatgaaagcctgc

SEQ ID NO: 213847 - DNA, 25 bp, Homo sapien
aaatgtcctcgaggtagtggcggcc

SEQ ID NO: 213848 - DNA, 25 bp, Homo sapien
ccataaacacttggctgcggcggcc

SEQ ID NO: 213849 - DNA, 25 bp, Homo sapien
ggttctgcgggttgtccagacttca

SEQ ID NO: 213850 - DNA, 25 bp, Homo sapien
gtccagacttcaggcctgtgcgctc

SEQ ID NO: 213851 - DNA, 25 bp, Homo sapien
cctgtgcgctcaatcgtggagaatg

SEQ ID NO: 213852 - DNA, 25 bp, Homo sapien
cccagcctaaggtgcaggaaggacc

SEQ ID NO: 213853 - DNA, 25 bp, Homo sapien
gaccagcacgaacccgctggctttg

SEQ ID NO: 213854 - DNA, 25 bp, Homo sapien
cgaccgcgggccataaacacttggc

SEQ ID NO: 213855 - DNA, 25 bp, Homo sapien
tcttgcggccgcgacgaaaggcgca

SEQ ID NO: 213856 - DNA, 25 bp, Homo sapien
ccttgctgtacggaatgcgtttctt

SEQ ID NO: 213857 - DNA, 25 bp, Homo sapien
ttctgaaaccagatggtaatctggc

SEQ ID NO: 213858 - DNA, 25 bp, Homo sapien
agatggtaatctggcgctccgagag

SEQ ID NO: 213859 - DNA, 25 bp, Homo sapien
gctgccgagatcttgcgcctcttgt

SEQ ID NO: 213860 - DNA, 25 bp, Homo sapien
tgcgcctcttgtccttggtgatgaa

SEQ ID NO: 213861 - DNA, 25 bp, Homo sapien
gtccttggtgatgaacttgttagcc

SEQ ID NO: 213862 - DNA, 25 bp, Homo sapien
atgaacttgttagccgcatactccc

SEQ ID NO: 213863 - DNA, 25 bp, Homo sapien
gcaaactggaggaccgcaatgcatt

SEQ ID NO: 213864 - DNA, 25 bp, Homo sapien
ttgcctcacgcggttgcggcaacca

SEQ ID NO: 213865 - DNA, 25 bp, Homo sapien
cgcgtcccacggcagcgtttttgtt

SEQ ID NO: 213866 - DNA, 25 bp, Homo sapien
tcccgtagcgtgctgggatttgcaa

SEQ ID NO: 213867 - DNA, 25 bp, Homo sapien
caggcttgtgggtaggaaccgttat

SEQ ID NO: 213868 - DNA, 25 bp, Homo sapien
ttggatgaaaaagatgcccggcgct

SEQ ID NO: 213869 - DNA, 25 bp, Homo sapien
atcgcggagttaagtgcgattatcc

SEQ ID NO: 213870 - DNA, 25 bp, Homo sapien
gcccggcgcttccagcttaaaatcg

SEQ ID NO: 213871 - DNA, 25 bp, Homo sapien
tgaccttcactgtgttcgccggcgg

SEQ ID NO: 213872 - DNA, 25 bp, Homo sapien
ccggcggcatcaatcgcaccaagta

SEQ ID NO: 213873 - DNA, 25 bp, Homo sapien
cgtgagcgtcgtcttgtttactaaa

SEQ ID NO: 213874 - DNA, 25 bp, Homo sapien
tttgctcagctatttcccgggaaga

SEQ ID NO: 213875 - DNA, 25 bp, Homo sapien
gtctcggcttcacgccatgcaagtc

SEQ ID NO: 213876 - DNA, 25 bp, Homo sapien
gcaagtccacatgctccacgtttga

SEQ ID NO: 213877 - DNA, 25 bp, Homo sapien
gccggcacacgctcctgaatttctg

SEQ ID NO: 213878 - DNA, 25 bp, Homo sapien
aatttctgcttccacgcggccctga

SEQ ID NO: 213879 - DNA, 25 bp, Homo sapien
aaagaactcaggtcaggggtgcata

SEQ ID NO: 213880 - DNA, 25 bp, Homo sapien
cggtgagacggcactcgattaaata

SEQ ID NO: 213881 - DNA, 25 bp, Homo sapien
ctctacaggccaaggaggcgggttt

SEQ ID NO: 213882 - DNA, 25 bp, Homo sapien
gagaaaatcttactgcgcacgcgca

SEQ ID NO: 213883 - DNA, 25 bp, Homo sapien
tagacagccgatggagccaccgatg

SEQ ID NO: 213884 - DNA, 25 bp, Homo sapien
ggcaaatactcggtagcgactcaga

SEQ ID NO: 213885 - DNA, 25 bp, Homo sapien
cgccgtgtcacgaatggctgtcaga

SEQ ID NO: 213886 - DNA, 25 bp, Homo sapien
ggatccacgcaccaaagggcaaata

SEQ ID NO: 213887 - DNA, 25 bp, Homo sapien
tcccggatagaaggcaaactcagtg

SEQ ID NO: 213888 - DNA, 25 bp, Homo sapien
gtttcagcgagctccgggacactcg

SEQ ID NO: 213889 - DNA, 25 bp, Homo sapien
ggggcatagttgacagcaggcatca

SEQ ID NO: 213890 - DNA, 25 bp, Homo sapien
tcccagcaagccttcgatatccttg

SEQ ID NO: 213891 - DNA, 25 bp, Homo sapien
ggctccatccaaggtggcataattg

SEQ ID NO: 213892 - DNA, 25 bp, Homo sapien
taaatcgctcccagctcgcaagtcg

SEQ ID NO: 213893 - DNA, 25 bp, Homo sapien
gcaagtcgcctgcattcgctcagca

SEQ ID NO: 213894 - DNA, 25 bp, Homo sapien
tcagcacggccgtcttgacgcaaga

SEQ ID NO: 213895 - DNA, 25 bp, Homo sapien
ccaggctagggacccgccaacgagg

SEQ ID NO: 213896 - DNA, 25 bp, Homo sapien
cacccgtcgcactagtgggcatttg

SEQ ID NO: 213897 - DNA, 25 bp, Homo sapien
tgggcatttgctaaactacgtttta

SEQ ID NO: 213898 - DNA, 25 bp, Homo sapien
ttttttgtaaagtgagcgcccgctg

SEQ ID NO: 213899 - DNA, 25 bp, Homo sapien
actggagcaaactctgtggcggcga

SEQ ID NO: 213900 - DNA, 25 bp, Homo sapien
gagcaaactctgtggcggcgacgat

SEQ ID NO: 213901 - DNA, 25 bp, Homo sapien
tctggctgaactgcttggggtcgcc

SEQ ID NO: 213902 - DNA, 25 bp, Homo sapien
ggacttggcacctcggtgtcagctc

SEQ ID NO: 213903 - DNA, 25 bp, Homo sapien
tttgagtaatgcacgcgaggcagtc

SEQ ID NO: 213904 - DNA, 25 bp, Homo sapien
ggaggcattgccctccaggagtatc

SEQ ID NO: 213905 - DNA, 25 bp, Homo sapien
aggagtatctattcccatcggggta

SEQ ID NO: 213906 - DNA, 25 bp, Homo sapien
ccatcggggtatggtgaatgccatc

SEQ ID NO: 213907 - DNA, 25 bp, Homo sapien
gaatgccatctaggcccatgctcca

SEQ ID NO: 213908 - DNA, 25 bp, Homo sapien
gtcgccgccgaaacaggatctccta

SEQ ID NO: 213909 - DNA, 25 bp, Homo sapien
ccagggcgaaaaggtccgaagatct

SEQ ID NO: 213910 - DNA, 25 bp, Homo sapien
ggatctcctaaagcgggctccaccg

SEQ ID NO: 213911 - DNA, 25 bp, Homo sapien
tgattggacacatccctctcgcgcg

SEQ ID NO: 213912 - DNA, 25 bp, Homo sapien
gcgacctgtggctgatcttgaagaa

SEQ ID NO: 213913 - DNA, 25 bp, Homo sapien
agccatctagcctcgtgattggaca

SEQ ID NO: 213914 - DNA, 25 bp, Homo sapien
cgccgccatcttgtgaagccatcta

SEQ ID NO: 213915 - DNA, 25 bp, Homo sapien
tcctagaaacgcagatgatacgctc

SEQ ID NO: 213916 - DNA, 25 bp, Homo sapien
agccgcatagcgaagctcctagaaa

SEQ ID NO: 213917 - DNA, 25 bp, Homo sapien
gggcctgtacaaccctagaatctta

SEQ ID NO: 213918 - DNA, 25 bp, Homo sapien
tttgctgctcctaacagaaggcgcg

SEQ ID NO: 213919 - DNA, 25 bp, Homo sapien
gctctggagaagcaccgcatctttc

SEQ ID NO: 213920 - DNA, 25 bp, Homo sapien
agaggctactctcgtgctctggaga

SEQ ID NO: 213921 - DNA, 25 bp, Homo sapien
ggggctccgcattaccagtcttggt

SEQ ID NO: 213922 - DNA, 25 bp, Homo sapien
aggcgccatcgccagcattttgccg

SEQ ID NO: 213923 - DNA, 25 bp, Homo sapien
ccctggtgtgaaaaggcgccatcgc

SEQ ID NO: 213924 - DNA, 25 bp, Homo sapien
gcagccctttcaatcgcaccgaatt

SEQ ID NO: 213925 - DNA, 25 bp, Homo sapien
gtcttggtcgcaaaagcagcccttt

SEQ ID NO: 213926 - DNA, 25 bp, Homo sapien
agaagcaccgcatctttctccggac

SEQ ID NO: 213927 - DNA, 25 bp, Homo sapien
ctctggagcgaagccctttggccct

SEQ ID NO: 213928 - DNA, 25 bp, Homo sapien
tctggaaccgaattcacctctgagg

SEQ ID NO: 213929 - DNA, 25 bp, Homo sapien
gccctgccctgagcatttctactga

SEQ ID NO: 213930 - DNA, 25 bp, Homo sapien
agcgtcggggaagcacttttctcgt

SEQ ID NO: 213931 - DNA, 25 bp, Homo sapien
ttccgccaaggagctcggggctcaa

SEQ ID NO: 213932 - DNA, 25 bp, Homo sapien
tctgggcgtcctaatctccaatttc

SEQ ID NO: 213933 - DNA, 25 bp, Homo sapien
ggcaaattcgctaggaagaaccttc

SEQ ID NO: 213934 - DNA, 25 bp, Homo sapien
agccgcttgggcaaaaccagcagaa

SEQ ID NO: 213935 - DNA, 25 bp, Homo sapien
ctcgaaggatgaaggagtaacgctc

SEQ ID NO: 213936 - DNA, 25 bp, Homo sapien
ctcatatttgcatacggggccttct

SEQ ID NO: 213937 - DNA, 25 bp, Homo sapien
acggggccttctaggccttcgattg

SEQ ID NO: 213938 - DNA, 25 bp, Homo sapien
gaatccaattaaccgcccaggcgct

SEQ ID NO: 213939 - DNA, 25 bp, Homo sapien
ggcgcggccagaacgtctggctcca

SEQ ID NO: 213940 - DNA, 25 bp, Homo sapien
ctggctccagaggtccagctgcgcg

SEQ ID NO: 213941 - DNA, 25 bp, Homo sapien
ggggcgctcttacccgcaattccta

SEQ ID NO: 213942 - DNA, 25 bp, Homo sapien
ctgggctgctagtccagcttgcaac

SEQ ID NO: 213943 - DNA, 25 bp, Homo sapien
gtggttccgtaatccctcgcctgga

SEQ ID NO: 213944 - DNA, 25 bp, Homo sapien
aggctcctcgggaagaagtgacacc

SEQ ID NO: 213945 - DNA, 25 bp, Homo sapien
tggtgttctgaaggccctggagccc

SEQ ID NO: 213946 - DNA, 25 bp, Homo sapien
ggcaagtttcggttctcaccgcagt

SEQ ID NO: 213947 - DNA, 25 bp, Homo sapien
acttgcagtcctgagaaggggccac

SEQ ID NO: 213948 - DNA, 25 bp, Homo sapien
cctcggggtgcccacattcagactt

SEQ ID NO: 213949 - DNA, 25 bp, Homo sapien
acgggctctcccttgggtgcttagc

SEQ ID NO: 213950 - DNA, 25 bp, Homo sapien
atgtcatcgccgttggcttcgaggc

SEQ ID NO: 213951 - DNA, 25 bp, Homo sapien
gcctttttcttcagcgtacaccttg

SEQ ID NO: 213952 - DNA, 25 bp, Homo sapien
cggcctagaatatctcgcgggatct

SEQ ID NO: 213953 - DNA, 25 bp, Homo sapien
tcgagcgtttcagggatcggccaat

SEQ ID NO: 213954 - DNA, 25 bp, Homo sapien
atcttgtgcgcgaggttatggaacc

SEQ ID NO: 213955 - DNA, 25 bp, Homo sapien
cgccaactctatggtcgagcgtttc

SEQ ID NO: 213956 - DNA, 25 bp, Homo sapien
cgtacaccttggtcgccatcttgtg

SEQ ID NO: 213957 - DNA, 25 bp, Homo sapien
ggccaatcgtaatccagatctcgta

SEQ ID NO: 213958 - DNA, 25 bp, Homo sapien
tcggggccaaagtcatgtgtctgac

SEQ ID NO: 213959 - DNA, 25 bp, Homo sapien
cagctccgggcgtcgggatccaact

SEQ ID NO: 213960 - DNA, 25 bp, Homo sapien
tctactccggatcaagcggtgagcc

SEQ ID NO: 213961 - DNA, 25 bp, Homo sapien
ggccgcgctgcttagccactgggac

SEQ ID NO: 213962 - DNA, 25 bp, Homo sapien
gctgccgagtagtcccggaagcgaa

SEQ ID NO: 213963 - DNA, 25 bp, Homo sapien
ccagaaccatcacggcctgctagtt

SEQ ID NO: 213964 - DNA, 25 bp, Homo sapien
ctcccgtcctggaggaccgtaggtg

SEQ ID NO: 213965 - DNA, 25 bp, Homo sapien
gaccctttagcgcttcagtaacgcc

SEQ ID NO: 213966 - DNA, 25 bp, Homo sapien
accgtaggtggacgctcttgcagag

SEQ ID NO: 213967 - DNA, 25 bp, Homo sapien
ttgcccacaacagggcggagctcct

SEQ ID NO: 213968 - DNA, 25 bp, Homo sapien
gggacacccgtaagcgtccagaata

SEQ ID NO: 213969 - DNA, 25 bp, Homo sapien
aattctctaacgtcccagggctatg

SEQ ID NO: 213970 - DNA, 25 bp, Homo sapien
cggagctcctgctctaattctctaa

SEQ ID NO: 213971 - DNA, 25 bp, Homo sapien
aggggaaatcacctgctccgtcggg

SEQ ID NO: 213972 - DNA, 25 bp, Homo sapien
cttgatacaggccacggcgagaatc

SEQ ID NO: 213973 - DNA, 25 bp, Homo sapien
cctgagcaaactggatgtgccttga

SEQ ID NO: 213974 - DNA, 25 bp, Homo sapien
gtccagaatagtgggcccgaaggca

SEQ ID NO: 213975 - DNA, 25 bp, Homo sapien
gcgcgtcatctgcacgcgccggaag

SEQ ID NO: 213976 - DNA, 25 bp, Homo sapien
gattcgcaaagcctcgcggcgagga

SEQ ID NO: 213977 - DNA, 25 bp, Homo sapien
tagtggccaagattcgcaaagcctc

SEQ ID NO: 213978 - DNA, 25 bp, Homo sapien
cccgcctttagctagtggccaagat

SEQ ID NO: 213979 - DNA, 25 bp, Homo sapien
gcggcgaggaaagcacgagtattca

SEQ ID NO: 213980 - DNA, 25 bp, Homo sapien
cgaggctgagtgtctccagttccta

SEQ ID NO: 213981 - DNA, 25 bp, Homo sapien
agccgcatttcctgccgcgaggctg

SEQ ID NO: 213982 - DNA, 25 bp, Homo sapien
cggaagccacgagccgcatttcctg

SEQ ID NO: 213983 - DNA, 25 bp, Homo sapien
tcgattttatttagaggcggcgcca

SEQ ID NO: 213984 - DNA, 25 bp, Homo sapien
cccgcctgtcagtcgctagcagtta

SEQ ID NO: 213985 - DNA, 25 bp, Homo sapien
ctcccgtggggatctcaaaacatta

SEQ ID NO: 213986 - DNA, 25 bp, Homo sapien
aacattatttcctgcggcttcctcg

SEQ ID NO: 213987 - DNA, 25 bp, Homo sapien
agtcttcggcttctctttgtctgtc

SEQ ID NO: 213988 - DNA, 25 bp, Homo sapien
catgtgagatctgggctggaccatc

SEQ ID NO: 213989 - DNA, 25 bp, Homo sapien
tccctaggggccaggttcttgcaaa

SEQ ID NO: 213990 - DNA, 25 bp, Homo sapien
ccctcaggcgggagattatcgggtt

SEQ ID NO: 213991 - DNA, 25 bp, Homo sapien
gctgcgccgtctcagttctcaattg

SEQ ID NO: 213992 - DNA, 25 bp, Homo sapien
tcagctgcgccgtctcagttctcaa

SEQ ID NO: 213993 - DNA, 25 bp, Homo sapien
tcagcttcccgggttaggtgagagg

SEQ ID NO: 213994 - DNA, 25 bp, Homo sapien
tttggcggtagaacattcgagaccg

SEQ ID NO: 213995 - DNA, 25 bp, Homo sapien
ggctttggcggtagaacattcgaga

SEQ ID NO: 213996 - DNA, 25 bp, Homo sapien
agagacaaagggcaaagtcctgggc

SEQ ID NO: 213997 - DNA, 25 bp, Homo sapien
ttcgaccggccggtggctctgcaga

SEQ ID NO: 213998 - DNA, 25 bp, Homo sapien
gtctcagttctcaattgcccgttca

SEQ ID NO: 213999 - DNA, 25 bp, Homo sapien
tccttctcatggtgcggtgggaagc

SEQ ID NO: 214000 - DNA, 25 bp, Homo sapien
cagatgtttgcccatcgtcatcagg

SEQ ID NO: 214001 - DNA, 25 bp, Homo sapien
ttatggacacgcagacgcttgcggg

SEQ ID NO: 214002 - DNA, 25 bp, Homo sapien
gccacttatggacacgcagacgctt

SEQ ID NO: 214003 - DNA, 25 bp, Homo sapien
agcggccgccacttatggacacgca

SEQ ID NO: 214004 - DNA, 25 bp, Homo sapien
cctgagggctactgcgcagcggccg

SEQ ID NO: 214005 - DNA, 25 bp, Homo sapien
cccatcgtcatcagggggcactaag

SEQ ID NO: 214006 - DNA, 25 bp, Homo sapien
gatgtttgcccatcgtcatcagggg

SEQ ID NO: 214007 - DNA, 25 bp, Homo sapien
cttggggaaaaggatcggccctgct

SEQ ID NO: 214008 - DNA, 25 bp, Homo sapien
ctccctcttcctggcgggtctgggg

SEQ ID NO: 214009 - DNA, 25 bp, Homo sapien
ctcctgtgacagacggagctggagc

SEQ ID NO: 214010 - DNA, 25 bp, Homo sapien
agagaaaccgcgagcgccgagcttg

SEQ ID NO: 214011 - DNA, 25 bp, Homo sapien
gagcgccgagcttggactcgagccc

SEQ ID NO: 214012 - DNA, 25 bp, Homo sapien
ggtgacttagcaagaaaagtattct

SEQ ID NO: 214013 - DNA, 25 bp, Homo sapien
ctctctgatcttggggaaaaggatc

SEQ ID NO: 214014 - DNA, 25 bp, Homo sapien
tggggaccaggtagctctctgatct

SEQ ID NO: 214015 - DNA, 25 bp, Homo sapien
ggcactgtgtaccattttactaact

SEQ ID NO: 214016 - DNA, 25 bp, Homo sapien
tcacggtgaccgcatttcccagctg

SEQ ID NO: 214017 - DNA, 25 bp, Homo sapien
tctcggcctggtaatttgacacggc

SEQ ID NO: 214018 - DNA, 25 bp, Homo sapien
tggtaatttgacacggccagccggt

SEQ ID NO: 214019 - DNA, 25 bp, Homo sapien
acggccagccggtcactgtttaagg

SEQ ID NO: 214020 - DNA, 25 bp, Homo sapien
ctgtttaaggcactgtgtaccattt

SEQ ID NO: 214021 - DNA, 25 bp, Homo sapien
ctaacttaatcctcacggtgaccgc

SEQ ID NO: 214022 - DNA, 25 bp, Homo sapien
tttactaacttaatcctcacggtga

SEQ ID NO: 214023 - DNA, 25 bp, Homo sapien
gagcgctggcttttccgtgggaaaa

SEQ ID NO: 214024 - DNA, 25 bp, Homo sapien
gtcggttttcaaatccaggcgccca

SEQ ID NO: 214025 - DNA, 25 bp, Homo sapien
cacggggacacagcatagcgaggaa

SEQ ID NO: 214026 - DNA, 25 bp, Homo sapien
acctgccctactcgccgagaatttg

SEQ ID NO: 214027 - DNA, 25 bp, Homo sapien
ggctccgtgacatccggcagtctga

SEQ ID NO: 214028 - DNA, 25 bp, Homo sapien
agagcagagcgagaggtgaaacttc

SEQ ID NO: 214029 - DNA, 25 bp, Homo sapien
gcgcgtgcggaacgaactctgcacc

SEQ ID NO: 214030 - DNA, 25 bp, Homo sapien
tgcttggaactcagaggcgctgacc

SEQ ID NO: 214031 - DNA, 25 bp, Homo sapien
cgcgatacgttactgctgcctgagc

SEQ ID NO: 214032 - DNA, 25 bp, Homo sapien
gggcgcaatttcaaagtctccgtta

SEQ ID NO: 214033 - DNA, 25 bp, Homo sapien
cggtgggacctcacgagactttttg

SEQ ID NO: 214034 - DNA, 25 bp, Homo sapien
attcctgttttggagaccgcttccg

SEQ ID NO: 214035 - DNA, 25 bp, Homo sapien
tgggtagcctcactgacctggccta

SEQ ID NO: 214036 - DNA, 25 bp, Homo sapien
agatgttttcatttcagggccgttc

SEQ ID NO: 214037 - DNA, 25 bp, Homo sapien
gaacgcgacttcaccctggagggca

SEQ ID NO: 214038 - DNA, 25 bp, Homo sapien
agggtgccgtcatgcttcttattgg

SEQ ID NO: 214039 - DNA, 25 bp, Homo sapien
acggcagactctccgccgcctcctc

SEQ ID NO: 214040 - DNA, 25 bp, Homo sapien
ttcctcctaatacccactccctgcc

SEQ ID NO: 214041 - DNA, 25 bp, Homo sapien
ccctgctggccagaagccttcctcc

SEQ ID NO: 214042 - DNA, 25 bp, Homo sapien
gagccagtgcacctgccggtggtgc

SEQ ID NO: 214043 - DNA, 25 bp, Homo sapien
tcgccgcgacgccaactagcctagc

SEQ ID NO: 214044 - DNA, 25 bp, Homo sapien
ccggtggtgcccgacggcagactct

SEQ ID NO: 214045 - DNA, 25 bp, Homo sapien
cctccgccaccttggggtgaggcct

SEQ ID NO: 214046 - DNA, 25 bp, Homo sapien
tcctctgcgttttccctggcctcgg

SEQ ID NO: 214047 - DNA, 25 bp, Homo sapien
gaatcacctcgaagcaggcgccctg

SEQ ID NO: 214048 - DNA, 25 bp, Homo sapien
atggcttcgtagatggcgctcaggt

SEQ ID NO: 214049 - DNA, 25 bp, Homo sapien
cgtccacgatagtctcgtcgaagtc

SEQ ID NO: 214050 - DNA, 25 bp, Homo sapien
aggcgccctgttttgccacaaactg

SEQ ID NO: 214051 - DNA, 25 bp, Homo sapien
tctccacgccaaaggtgttggcatc

SEQ ID NO: 214052 - DNA, 25 bp, Homo sapien
cccacgtagaagaggcgctcgaagt

SEQ ID NO: 214053 - DNA, 25 bp, Homo sapien
gaggcgcacatctgcagccgtttcc

SEQ ID NO: 214054 - DNA, 25 bp, Homo sapien
ggcggccagactcagcacgacttca

SEQ ID NO: 214055 - DNA, 25 bp, Homo sapien
cccaggcggctgctgttcttactgg

SEQ ID NO: 214056 - DNA, 25 bp, Homo sapien
gacagactttctacttaaccgcctc

SEQ ID NO: 214057 - DNA, 25 bp, Homo sapien
ccgtagaagcggtggtattcccgtg

SEQ ID NO: 214058 - DNA, 25 bp, Homo sapien
cggcggccagctgtacacatacatg

SEQ ID NO: 214059 - DNA, 25 bp, Homo sapien
gcggcggcacacacaggaaagagcc

SEQ ID NO: 214060 - DNA, 25 bp, Homo sapien
aggaaagagccaagcgcgtgcacgc

SEQ ID NO: 214061 - DNA, 25 bp, Homo sapien
cccggcgcacgaagtccggtagctg

SEQ ID NO: 214062 - DNA, 25 bp, Homo sapien
cccagcgcagctcggtttgcaggct

SEQ ID NO: 214063 - DNA, 25 bp, Homo sapien
gctccggctcacgagtccctccagt

SEQ ID NO: 214064 - DNA, 25 bp, Homo sapien
cagcagaggtctgtcccggctgagt

SEQ ID NO: 214065 - DNA, 25 bp, Homo sapien
actgaggatgatgtgcgtctgagcc

SEQ ID NO: 214066 - DNA, 25 bp, Homo sapien
aggatgatgtgcgtctgagccgtcc

SEQ ID NO: 214067 - DNA, 25 bp, Homo sapien
agcgactgtccaatcgcagcggtgc

SEQ ID NO: 214068 - DNA, 25 bp, Homo sapien
cggtgccggcgcacatcaaaggggc

SEQ ID NO: 214069 - DNA, 25 bp, Homo sapien
cgcgcgtgaaggagcgccttcaaac

SEQ ID NO: 214070 - DNA, 25 bp, Homo sapien
aacgtcacaagcgactgtccaatcg

SEQ ID NO: 214071 - DNA, 25 bp, Homo sapien
cgaccgcggagcgtggcacgttcag

SEQ ID NO: 214072 - DNA, 25 bp, Homo sapien
caggaaggacgagtcgccccacggc

SEQ ID NO: 214073 - DNA, 25 bp, Homo sapien
cacgttcaggaaggacgagtcgccc

SEQ ID NO: 214074 - DNA, 25 bp, Homo sapien
ggccacgcctcgttaggcgccacgt

SEQ ID NO: 214075 - DNA, 25 bp, Homo sapien
cctgcccgccgctcgctgtaggagg

SEQ ID NO: 214076 - DNA, 25 bp, Homo sapien
gagggagccttctgcgtcggctccc

SEQ ID NO: 214077 - DNA, 25 bp, Homo sapien
gtcggctcccgacactcgctcactg

SEQ ID NO: 214078 - DNA, 25 bp, Homo sapien
tcccgacactcgctcactggggcgc

SEQ ID NO: 214079 - DNA, 25 bp, Homo sapien
cgagcggacccgctgcaaaactgca

SEQ ID NO: 214080 - DNA, 25 bp, Homo sapien
cccaggtaaagacgagagctgcgca

SEQ ID NO: 214081 - DNA, 25 bp, Homo sapien
attgtgagcgctccgccgcccagat

SEQ ID NO: 214082 - DNA, 25 bp, Homo sapien
tctgtctcctgccacattgtgagcg

SEQ ID NO: 214083 - DNA, 25 bp, Homo sapien
gctcgagtcacaaccgccggctggg

SEQ ID NO: 214084 - DNA, 25 bp, Homo sapien
agctgcctcggcgaagggttacgcc

SEQ ID NO: 214085 - DNA, 25 bp, Homo sapien
gacccgctgcaaaactgcagccaag

SEQ ID NO: 214086 - DNA, 25 bp, Homo sapien
tgcaaacctcctctcggcccgctaa

SEQ ID NO: 214087 - DNA, 25 bp, Homo sapien
cgtgaggcttttagacccaggatcc

SEQ ID NO: 214088 - DNA, 25 bp, Homo sapien
aggatccgttccaagggaccgctgc

SEQ ID NO: 214089 - DNA, 25 bp, Homo sapien
gccgtccagagagaagcagcactcc

SEQ ID NO: 214090 - DNA, 25 bp, Homo sapien
agcgactgattcatggcagggagcc

SEQ ID NO: 214091 - DNA, 25 bp, Homo sapien
cttgtctgagctaattggctgggcc

SEQ ID NO: 214092 - DNA, 25 bp, Homo sapien
catgattcatcgctgggctcttgtc

SEQ ID NO: 214093 - DNA, 25 bp, Homo sapien
agtcggccctaatggctcatgattc

SEQ ID NO: 214094 - DNA, 25 bp, Homo sapien
catcacggctgacagactggggatc

SEQ ID NO: 214095 - DNA, 25 bp, Homo sapien
ctcccagtcccggaattggggctgc

SEQ ID NO: 214096 - DNA, 25 bp, Homo sapien
catgaaccgaatgccctggaaggtc

SEQ ID NO: 214097 - DNA, 25 bp, Homo sapien
ggcctgctttatggccatgaaccga

SEQ ID NO: 214098 - DNA, 25 bp, Homo sapien
tccgacgagattgtcagatgtggcc

SEQ ID NO: 214099 - DNA, 25 bp, Homo sapien
cgcgcgtgttctcacggcttgaagc

SEQ ID NO: 214100 - DNA, 25 bp, Homo sapien
acggaggaggcgtcttcactctccc

SEQ ID NO: 214101 - DNA, 25 bp, Homo sapien
agagagcagaggcttggacatttcc

SEQ ID NO: 214102 - DNA, 25 bp, Homo sapien
cctcggattctgtagcgcggtatcc

SEQ ID NO: 214103 - DNA, 25 bp, Homo sapien
agcagcagccatcatgtcgaccata

SEQ ID NO: 214104 - DNA, 25 bp, Homo sapien
gggctcctcggctctatccctgttt

SEQ ID NO: 214105 - DNA, 25 bp, Homo sapien
tgcgttcggcagctcaggttaaaac

SEQ ID NO: 214106 - DNA, 25 bp, Homo sapien
tctatccctgcacgctcggagaagg

SEQ ID NO: 214107 - DNA, 25 bp, Homo sapien
acgtgtctccaatggggcctctgca

SEQ ID NO: 214108 - DNA, 25 bp, Homo sapien
gaacggtcaacactcacagccaggg

SEQ ID NO: 214109 - DNA, 25 bp, Homo sapien
tgagaaatcccgtctgcgcgtcacc

SEQ ID NO: 214110 - DNA, 25 bp, Homo sapien
gcacctgtaactcccgggatccgta

SEQ ID NO: 214111 - DNA, 25 bp, Homo sapien
cctgcaccgtgtgcgaggacaccga

SEQ ID NO: 214112 - DNA, 25 bp, Homo sapien
gtattccgacgaggccaaccacgtg

SEQ ID NO: 214113 - DNA, 25 bp, Homo sapien
gccaggacaagcagaacaccgtgtg

SEQ ID NO: 214114 - DNA, 25 bp, Homo sapien
gcctcgtgttctcctgccaggacaa

SEQ ID NO: 214115 - DNA, 25 bp, Homo sapien
tgcgcctacggctactaccaggatg

SEQ ID NO: 214116 - DNA, 25 bp, Homo sapien
gctcaggcgtgacgttctccgacgt

SEQ ID NO: 214117 - DNA, 25 bp, Homo sapien
actaaatctggtgtccgctgcgctc

SEQ ID NO: 214118 - DNA, 25 bp, Homo sapien
tcccgggtgcccaaaagagcagacg

SEQ ID NO: 214119 - DNA, 25 bp, Homo sapien
atccagcgagccgacctcgtggaga

SEQ ID NO: 214120 - DNA, 25 bp, Homo sapien
catagactcctttacccatgaggcc

SEQ ID NO: 214121 - DNA, 25 bp, Homo sapien
tgcttgcaagctgggccacccagga

SEQ ID NO: 214122 - DNA, 25 bp, Homo sapien
ggctaccagcccgagcacatagact

SEQ ID NO: 214123 - DNA, 25 bp, Homo sapien
ccgacctcgtggagagtctgtgcag

SEQ ID NO: 214124 - DNA, 25 bp, Homo sapien
tgtgcagtgagtccactgccacatc

SEQ ID NO: 214125 - DNA, 25 bp, Homo sapien
cagcccgagcacatagactccttta

SEQ ID NO: 214126 - DNA, 25 bp, Homo sapien
cgttcgcgccctgcttgcaagctgg

SEQ ID NO: 214127 - DNA, 25 bp, Homo sapien
aaccggacactcgagtcctgtggac

SEQ ID NO: 214128 - DNA, 25 bp, Homo sapien
ccgctctgccatgcgccgagcctgc

SEQ ID NO: 214129 - DNA, 25 bp, Homo sapien
gggctacagggacccgctctgccat

SEQ ID NO: 214130 - DNA, 25 bp, Homo sapien
gggccctgagaaccggacactcgag

SEQ ID NO: 214131 - DNA, 25 bp, Homo sapien
ggcctgggctacagggacccgctct

SEQ ID NO: 214132 - DNA, 25 bp, Homo sapien
cactctggagtgaatagggctgcgc

SEQ ID NO: 214133 - DNA, 25 bp, Homo sapien
tgagaaccggacactcgagtcctgt

SEQ ID NO: 214134 - DNA, 25 bp, Homo sapien
acacgtggacgaggaggtaccggat

SEQ ID NO: 214135 - DNA, 25 bp, Homo sapien
caccctgggccgcttgagtgtaaag

SEQ ID NO: 214136 - DNA, 25 bp, Homo sapien
ttcacaaataaagaacccgaggctc

SEQ ID NO: 214137 - DNA, 25 bp, Homo sapien
gacccgctccagtcgagactatttc

SEQ ID NO: 214138 - DNA, 25 bp, Homo sapien
tcgccgtacgcgttatatagatctg

SEQ ID NO: 214139 - DNA, 25 bp, Homo sapien
atggctgccacttggcgctctgacc

SEQ ID NO: 214140 - DNA, 25 bp, Homo sapien
gatgcgatctcctagcacgacagcg

SEQ ID NO: 214141 - DNA, 25 bp, Homo sapien
tccatcgggagtccagagaggcaca

SEQ ID NO: 214142 - DNA, 25 bp, Homo sapien
cccgaggctcagtttcgtattccaa

SEQ ID NO: 214143 - DNA, 25 bp, Homo sapien
cgccagccgtgggattaggcttcgc

SEQ ID NO: 214144 - DNA, 25 bp, Homo sapien
ttttggtcgctaagggcaagcgccc

SEQ ID NO: 214145 - DNA, 25 bp, Homo sapien
ggcaagcgcccgtgacaaacatggc

SEQ ID NO: 214146 - DNA, 25 bp, Homo sapien
caggcgcattggctcgcacctggct

SEQ ID NO: 214147 - DNA, 25 bp, Homo sapien
aggcttcgccggctacgattgcggt

SEQ ID NO: 214148 - DNA, 25 bp, Homo sapien
tacgattgcggtgagacgctggcca

SEQ ID NO: 214149 - DNA, 25 bp, Homo sapien
tggggccgatctggcacaaacgaca

SEQ ID NO: 214150 - DNA, 25 bp, Homo sapien
aagccctagaagtgcgcgcaggcgc

SEQ ID NO: 214151 - DNA, 25 bp, Homo sapien
ttaagttgtctttattaagcgccgc

SEQ ID NO: 214152 - DNA, 25 bp, Homo sapien
ttgtctttattaagcgccgctgtgc

SEQ ID NO: 214153 - DNA, 25 bp, Homo sapien
tggaccgcagcgacttgggtccagc

SEQ ID NO: 214154 - DNA, 25 bp, Homo sapien
agcgacttgggtccagccgacaggt

SEQ ID NO: 214155 - DNA, 25 bp, Homo sapien
gccacacccgcttggtctcttcatc

SEQ ID NO: 214156 - DNA, 25 bp, Homo sapien
agcggaaagggtctgcgccccagca

SEQ ID NO: 214157 - DNA, 25 bp, Homo sapien
ccgctgtgcgccagaaaccgggagc

SEQ ID NO: 214158 - DNA, 25 bp, Homo sapien
taagcgccgctgtgcgccagaaacc

SEQ ID NO: 214159 - DNA, 25 bp, Homo sapien
agtgcaggctagacacccagaagga

SEQ ID NO: 214160 - DNA, 25 bp, Homo sapien
ctcagcacaggttttggctcttaga

SEQ ID NO: 214161 - DNA, 25 bp, Homo sapien
ggacttccctcagcacaggttttgg

SEQ ID NO: 214162 - DNA, 25 bp, Homo sapien
ggctagacacccagaaggacttccc

SEQ ID NO: 214163 - DNA, 25 bp, Homo sapien
ggagcagacatcataacaaaaggag

SEQ ID NO: 214164 - DNA, 25 bp, Homo sapien
gagggaaggagcagacatcataaca

SEQ ID NO: 214165 - DNA, 25 bp, Homo sapien
ccagaaggacttccctcagcacagg

SEQ ID NO: 214166 - DNA, 25 bp, Homo sapien
tcataacaaaaggagtgcaggctag

SEQ ID NO: 214167 - DNA, 25 bp, Homo sapien
agcctctatctggtgagtggtccga

SEQ ID NO: 214168 - DNA, 25 bp, Homo sapien
agctggtgacctgcaggcttttccc

SEQ ID NO: 214169 - DNA, 25 bp, Homo sapien
tcccagagcctcaggaccgctgaag

SEQ ID NO: 214170 - DNA, 25 bp, Homo sapien
tgcgaccagcgctcggaaaaaggcc

SEQ ID NO: 214171 - DNA, 25 bp, Homo sapien
agcttgcgagccctgaaactttctc

SEQ ID NO: 214172 - DNA, 25 bp, Homo sapien
tgttcctggtgcagggtagcctcta

SEQ ID NO: 214173 - DNA, 25 bp, Homo sapien
ggaagatgcaactgactcgctgctg

SEQ ID NO: 214174 - DNA, 25 bp, Homo sapien
cggagactggacagatagggttaat

SEQ ID NO: 214175 - DNA, 25 bp, Homo sapien
gactcgtgctccaccggctctttat

SEQ ID NO: 214176 - DNA, 25 bp, Homo sapien
gcgggaccgccgatacacaaataca

SEQ ID NO: 214177 - DNA, 25 bp, Homo sapien
tgcgcttgcctcatactgtccgcaa

SEQ ID NO: 214178 - DNA, 25 bp, Homo sapien
tctggcattcgcaggccacgtaatc

SEQ ID NO: 214179 - DNA, 25 bp, Homo sapien
ggcgcgtttgtgtcttctgaatgct

SEQ ID NO: 214180 - DNA, 25 bp, Homo sapien
gcaggcgacagctcagtatttggca

SEQ ID NO: 214181 - DNA, 25 bp, Homo sapien
ccgcctatctttcctagtgcgcatg

SEQ ID NO: 214182 - DNA, 25 bp, Homo sapien
tgcgaggaccaaatagaggcgtaac

SEQ ID NO: 214183 - DNA, 25 bp, Homo sapien
gcccggctcacctgcacggccaccc

SEQ ID NO: 214184 - DNA, 25 bp, Homo sapien
cctccgccctcatagactctgaacg

SEQ ID NO: 214185 - DNA, 25 bp, Homo sapien
tttcacggctcctcgctcttgctcc

SEQ ID NO: 214186 - DNA, 25 bp, Homo sapien
gacacctctgcccacttttcggtta

SEQ ID NO: 214187 - DNA, 25 bp, Homo sapien
agctggaaggggatcgtggccctga

SEQ ID NO: 214188 - DNA, 25 bp, Homo sapien
cccgcacactccgtcccagcggtgc

SEQ ID NO: 214189 - DNA, 25 bp, Homo sapien
cccaccgactcctgctcccagcgcc

SEQ ID NO: 214190 - DNA, 25 bp, Homo sapien
acgcgccactcctcctcacgcctcg

SEQ ID NO: 214191 - DNA, 25 bp, Homo sapien
ctgcgcagaacgctccagacgctga

SEQ ID NO: 214192 - DNA, 25 bp, Homo sapien
gcgggtttctaaggacagtcgattg

SEQ ID NO: 214193 - DNA, 25 bp, Homo sapien
gcctcacagtgcttgggtcccaact

SEQ ID NO: 214194 - DNA, 25 bp, Homo sapien
cgtccgcaggattgggactgataca

SEQ ID NO: 214195 - DNA, 25 bp, Homo sapien
gcctcggcctatgcttgcaactatt

SEQ ID NO: 214196 - DNA, 25 bp, Homo sapien
gcctggatcggaggcgttcttatta

SEQ ID NO: 214197 - DNA, 25 bp, Homo sapien
ggtcgctgaaacgtctggaagcata

SEQ ID NO: 214198 - DNA, 25 bp, Homo sapien
gatccctcctctcctgattggtcga

SEQ ID NO: 214199 - DNA, 25 bp, Homo sapien
cggagctttccttggtcttctcatg

SEQ ID NO: 214200 - DNA, 25 bp, Homo sapien
cgcagcgacaggtcgtactccatca

SEQ ID NO: 214201 - DNA, 25 bp, Homo sapien
cctgcgtcttgtagatggtgtaacc

SEQ ID NO: 214202 - DNA, 25 bp, Homo sapien
ctcgcgactcacgtattcctggatg

SEQ ID NO: 214203 - DNA, 25 bp, Homo sapien
gtgtaaccctccttctcgtgctgca

SEQ ID NO: 214204 - DNA, 25 bp, Homo sapien
gccgaccggaactcagctttgctct

SEQ ID NO: 214205 - DNA, 25 bp, Homo sapien
gccaccgaggggaacagcaagtcca

SEQ ID NO: 214206 - DNA, 25 bp, Homo sapien
ggcacttgaggtactcggagctttc

SEQ ID NO: 214207 - DNA, 25 bp, Homo sapien
cgcaggttgacgatctgggttcctt

SEQ ID NO: 214208 - DNA, 25 bp, Homo sapien
catcttgactgaggagcgcgaaccc

SEQ ID NO: 214209 - DNA, 25 bp, Homo sapien
tgggattcgaacctagacctatctg

SEQ ID NO: 214210 - DNA, 25 bp, Homo sapien
gaggtctgcttcagtctttcccgcg

SEQ ID NO: 214211 - DNA, 25 bp, Homo sapien
tcctccagccaaagtcggtgcgtga

SEQ ID NO: 214212 - DNA, 25 bp, Homo sapien
aacgctgcggtttggctaagattgc

SEQ ID NO: 214213 - DNA, 25 bp, Homo sapien
aaaccgcggctatttgcagcgtcgc

SEQ ID NO: 214214 - DNA, 25 bp, Homo sapien
gctcgcgggctctttcatcttgact

SEQ ID NO: 214215 - DNA, 25 bp, Homo sapien
tatacctgacaggtcctcacccggg

SEQ ID NO: 214216 - DNA, 25 bp, Homo sapien
ggcggccctatacctgacaggtcct

SEQ ID NO: 214217 - DNA, 25 bp, Homo sapien
caggcggccctatacctgacaggtc

SEQ ID NO: 214218 - DNA, 25 bp, Homo sapien
ttgtctccgattctacggcctcctc

SEQ ID NO: 214219 - DNA, 25 bp, Homo sapien
gacttgtctccgattctacggcctc

SEQ ID NO: 214220 - DNA, 25 bp, Homo sapien
cgggacttgtctccgattctacggc

SEQ ID NO: 214221 - DNA, 25 bp, Homo sapien
cccggaatgctgccgaggacccagc

SEQ ID NO: 214222 - DNA, 25 bp, Homo sapien
acccagcccggtaggacagggcagc

SEQ ID NO: 214223 - DNA, 25 bp, Homo sapien
gcctactctagtcccgccagttttg

SEQ ID NO: 214224 - DNA, 25 bp, Homo sapien
ggagcatcctccgaaaaccattagg

SEQ ID NO: 214225 - DNA, 25 bp, Homo sapien
cctgttttggctctgccgcctgatt

SEQ ID NO: 214226 - DNA, 25 bp, Homo sapien
ccgcctgatttctaccgcaggcaga

SEQ ID NO: 214227 - DNA, 25 bp, Homo sapien
gaactcttataactaggcttctgcc

SEQ ID NO: 214228 - DNA, 25 bp, Homo sapien
tgtccttgaatccaaggcgggcgca

SEQ ID NO: 214229 - DNA, 25 bp, Homo sapien
cgcaggcagatatcttccgagaccc

SEQ ID NO: 214230 - DNA, 25 bp, Homo sapien
tgagctgacctctaatccgcaggga

SEQ ID NO: 214231 - DNA, 25 bp, Homo sapien
acgcatgcgcagtctagccgccggt

SEQ ID NO: 214232 - DNA, 25 bp, Homo sapien
tgaacgcgcctgacaggccgggcca

SEQ ID NO: 214233 - DNA, 25 bp, Homo sapien
gccagtgacaaagagccggcggctc

SEQ ID NO: 214234 - DNA, 25 bp, Homo sapien
agcgatcctttcgaggaggagagcc

SEQ ID NO: 214235 - DNA, 25 bp, Homo sapien
cttatagataggaaagacgcaactc

SEQ ID NO: 214236 - DNA, 25 bp, Homo sapien
acgcaactcacgttgtcgatcacga

SEQ ID NO: 214237 - DNA, 25 bp, Homo sapien
ggcgatcacatcgtaggactccatg

SEQ ID NO: 214238 - DNA, 25 bp, Homo sapien
tccatggcagaggaatctctccttc

SEQ ID NO: 214239 - DNA, 25 bp, Homo sapien
ctgccagattaaccctttcttggcc

SEQ ID NO: 214240 - DNA, 25 bp, Homo sapien
agaggagtctagacacgcctggcta

SEQ ID NO: 214241 - DNA, 25 bp, Homo sapien
ggcgctgccagattaaccctttctt

SEQ ID NO: 214242 - DNA, 25 bp, Homo sapien
atgaaaggcgctgccagattaaccc

SEQ ID NO: 214243 - DNA, 25 bp, Homo sapien
gctgctgatgaaaggcgctgccaga

SEQ ID NO: 214244 - DNA, 25 bp, Homo sapien
cccgccaagctgctgatgaaaggcg

SEQ ID NO: 214245 - DNA, 25 bp, Homo sapien
gcagggctgccctgtggtcacgtcc

SEQ ID NO: 214246 - DNA, 25 bp, Homo sapien
ctagacacgcctggctaacgagggg

SEQ ID NO: 214247 - DNA, 25 bp, Homo sapien
cctgcggaaattacaggggcgctcg

SEQ ID NO: 214248 - DNA, 25 bp, Homo sapien
ccgctggttggaggcgtttaaattg

SEQ ID NO: 214249 - DNA, 25 bp, Homo sapien
gaaggcactcagctttcctggagga

SEQ ID NO: 214250 - DNA, 25 bp, Homo sapien
gcgtttaaattgaaagcagctttgg

SEQ ID NO: 214251 - DNA, 25 bp, Homo sapien
ccacgacccgggcaaggcagtctgg

SEQ ID NO: 214252 - DNA, 25 bp, Homo sapien
ttctccacctgggtctgcctcttgg

SEQ ID NO: 214253 - DNA, 25 bp, Homo sapien
tcttggctcgctgactgcaagcctg

SEQ ID NO: 214254 - DNA, 25 bp, Homo sapien
tgccgcgtttgagccggtcagctcc

SEQ ID NO: 214255 - DNA, 25 bp, Homo sapien
ccggcttgcgccagcactaaatgct

SEQ ID NO: 214256 - DNA, 25 bp, Homo sapien
agagacctcctctgctagggcgtgc

SEQ ID NO: 214257 - DNA, 25 bp, Homo sapien
ggaatctctgttccgctggcacatc

SEQ ID NO: 214258 - DNA, 25 bp, Homo sapien
cgccgccaaaccgaattaatcagtt

SEQ ID NO: 214259 - DNA, 25 bp, Homo sapien
cgcaggtctcttcagactgcccatt

SEQ ID NO: 214260 - DNA, 25 bp, Homo sapien
gctcagtaaccagtcggctgcccgg

SEQ ID NO: 214261 - DNA, 25 bp, Homo sapien
gtgtgtgcataaaacatcccagcta

SEQ ID NO: 214262 - DNA, 25 bp, Homo sapien
agatctgattctttccttcccgccg

SEQ ID NO: 214263 - DNA, 25 bp, Homo sapien
cccgaaatcgggagactgcaaatgc

SEQ ID NO: 214264 - DNA, 25 bp, Homo sapien
agctccctgtctcttgggcatccag

SEQ ID NO: 214265 - DNA, 25 bp, Homo sapien
tttctgccattataaccgaggttcc

SEQ ID NO: 214266 - DNA, 25 bp, Homo sapien
gcggtagccaatccgggacgtctaa

SEQ ID NO: 214267 - DNA, 25 bp, Homo sapien
ccggcgtctatttaccaacaaactg

SEQ ID NO: 214268 - DNA, 25 bp, Homo sapien
cgcgttctccgctgaaagaggctca

SEQ ID NO: 214269 - DNA, 25 bp, Homo sapien
gagacactttctccgggatcttaag

SEQ ID NO: 214270 - DNA, 25 bp, Homo sapien
tttaccacttctctacagcgggctg

SEQ ID NO: 214271 - DNA, 25 bp, Homo sapien
tcggcgctttcttcctagggtcaca

SEQ ID NO: 214272 - DNA, 25 bp, Homo sapien
tcacttttcctgcagggtgcgcctg

SEQ ID NO: 214273 - DNA, 25 bp, Homo sapien
caaacccggggtcactatcagcgct

SEQ ID NO: 214274 - DNA, 25 bp, Homo sapien
tcagcgctgcgagactggtattcaa

SEQ ID NO: 214275 - DNA, 25 bp, Homo sapien
gtattcaaggtcctctcagccgggc

SEQ ID NO: 214276 - DNA, 25 bp, Homo sapien
gcggacaccgtctcaagcctctgag

SEQ ID NO: 214277 - DNA, 25 bp, Homo sapien
tgagcctctgcctgcaatgtccttc

SEQ ID NO: 214278 - DNA, 25 bp, Homo sapien
cctgggagcagaactgcgtcttgta

SEQ ID NO: 214279 - DNA, 25 bp, Homo sapien
gacttgatcgaggatcgcctgctga

SEQ ID NO: 214280 - DNA, 25 bp, Homo sapien
ccgtgcctgcaagcccattgagatt

SEQ ID NO: 214281 - DNA, 25 bp, Homo sapien
ggctccgtaggtatattccgacttg

SEQ ID NO: 214282 - DNA, 25 bp, Homo sapien
tttggcttccagtccatgccttttc

SEQ ID NO: 214283 - DNA, 25 bp, Homo sapien
tctgagggtcatctaggccaacttc

SEQ ID NO: 214284 - DNA, 25 bp, Homo sapien
cgcctgctgaaatgcccacgaaatc

SEQ ID NO: 214285 - DNA, 25 bp, Homo sapien
atctcgccgtcggttgtttctctcg

SEQ ID NO: 214286 - DNA, 25 bp, Homo sapien
ccaaatgcttgcacacccggggctg

SEQ ID NO: 214287 - DNA, 25 bp, Homo sapien
cctcgtggttccttcgagctctgca

SEQ ID NO: 214288 - DNA, 25 bp, Homo sapien
gtgccctctgttctgctgccaagag

SEQ ID NO: 214289 - DNA, 25 bp, Homo sapien
caaagtcagactcgcgcagcaggct

SEQ ID NO: 214290 - DNA, 25 bp, Homo sapien
aggggagcgctatctgtctgtctat

SEQ ID NO: 214291 - DNA, 25 bp, Homo sapien
accctgcctggcagagcagtgtaca

SEQ ID NO: 214292 - DNA, 25 bp, Homo sapien
ttggcagaaacagagggcacggtcc

SEQ ID NO: 214293 - DNA, 25 bp, Homo sapien
agtgcccgcttggtctgggccactc

SEQ ID NO: 214294 - DNA, 25 bp, Homo sapien
cttccggcagtccaaagggctttga

SEQ ID NO: 214295 - DNA, 25 bp, Homo sapien
acgtcttgaagatgtgcttggccga

SEQ ID NO: 214296 - DNA, 25 bp, Homo sapien
tccgcttcttggagaccagctcgtc

SEQ ID NO: 214297 - DNA, 25 bp, Homo sapien
tccctgcgaggcaggttggatccga

SEQ ID NO: 214298 - DNA, 25 bp, Homo sapien
ggatccgagtcatgagggccctcag

SEQ ID NO: 214299 - DNA, 25 bp, Homo sapien
cgggtggcacctgtaagtacgtctt

SEQ ID NO: 214300 - DNA, 25 bp, Homo sapien
gatgagttctccaatgccgattttc

SEQ ID NO: 214301 - DNA, 25 bp, Homo sapien
cttgcccaggtagcgcatgttgatg

SEQ ID NO: 214302 - DNA, 25 bp, Homo sapien
cccgggcagcactcacaaagacgtg

SEQ ID NO: 214303 - DNA, 25 bp, Homo sapien
atccgagagcgcagctgtgaaactg

SEQ ID NO: 214304 - DNA, 25 bp, Homo sapien
tcggttcccagatgcgccaatgcca

SEQ ID NO: 214305 - DNA, 25 bp, Homo sapien
cagcagcgctacctgtaagtgaagc

SEQ ID NO: 214306 - DNA, 25 bp, Homo sapien
ggtcgccctccatcggcagacagag

SEQ ID NO: 214307 - DNA, 25 bp, Homo sapien
gggcacgaaaccgatcagcgctacg

SEQ ID NO: 214308 - DNA, 25 bp, Homo sapien
ccaggcgacgctttctcggagaagc

SEQ ID NO: 214309 - DNA, 25 bp, Homo sapien
aggcaggaagatagacccacggatc

SEQ ID NO: 214310 - DNA, 25 bp, Homo sapien
gtcgtctccgccttcaacctggata

SEQ ID NO: 214311 - DNA, 25 bp, Homo sapien
cccggagttgtttgtgagtggccat

SEQ ID NO: 214312 - DNA, 25 bp, Homo sapien
catagagcacttcagcaagttctcc

SEQ ID NO: 214313 - DNA, 25 bp, Homo sapien
aggggcgcccaagtacatagagcac

SEQ ID NO: 214314 - DNA, 25 bp, Homo sapien
gctgctgaagaatgcgtccctggca

SEQ ID NO: 214315 - DNA, 25 bp, Homo sapien
agcagtttctggacttcggtacgga

SEQ ID NO: 214316 - DNA, 25 bp, Homo sapien
aggcgccatgacgagccgattggct

SEQ ID NO: 214317 - DNA, 25 bp, Homo sapien
aaggctattggttcgcccggagttg

SEQ ID NO: 214318 - DNA, 25 bp, Homo sapien
cgcgcggggaccacaaccaaagtcg

SEQ ID NO: 214319 - DNA, 25 bp, Homo sapien
gaggcaccctctggcagactcggcg

SEQ ID NO: 214320 - DNA, 25 bp, Homo sapien
cgctccaggttaccgctatcgtcaa

SEQ ID NO: 214321 - DNA, 25 bp, Homo sapien
atctacggagagtgccgccgccttt

SEQ ID NO: 214322 - DNA, 25 bp, Homo sapien
gggactgcacgccatctacggagag

SEQ ID NO: 214323 - DNA, 25 bp, Homo sapien
gggagtctcacccaccgagtccgcc

SEQ ID NO: 214324 - DNA, 25 bp, Homo sapien
aggcgcggagctagacctcgctgca

SEQ ID NO: 214325 - DNA, 25 bp, Homo sapien
ccgctatcgtcaagtactggtatgc

SEQ ID NO: 214326 - DNA, 25 bp, Homo sapien
caagtactggtatgctctgggccgc

SEQ ID NO: 214327 - DNA, 25 bp, Homo sapien
tctccaaccagaacatccagtactt

SEQ ID NO: 214328 - DNA, 25 bp, Homo sapien
cgcatgctcatcaaccagcacagtg

SEQ ID NO: 214329 - DNA, 25 bp, Homo sapien
tacaaggacacctacggcgatgacc

SEQ ID NO: 214330 - DNA, 25 bp, Homo sapien
caaggcgtgcttgagtacaaggaca

SEQ ID NO: 214331 - DNA, 25 bp, Homo sapien
cccaccatggcacaaggcgtgcttg

SEQ ID NO: 214332 - DNA, 25 bp, Homo sapien
gcacaacgacgtggtgcccaccatg

SEQ ID NO: 214333 - DNA, 25 bp, Homo sapien
atccggaaccggcacaacgacgtgg

SEQ ID NO: 214334 - DNA, 25 bp, Homo sapien
caaccagcacagtgggtgccggcca

SEQ ID NO: 214335 - DNA, 25 bp, Homo sapien
cccgggagcgaccagcaggaggtgc

SEQ ID NO: 214336 - DNA, 25 bp, Homo sapien
gagtgcaaaggcgagcgcagccggt

SEQ ID NO: 214337 - DNA, 25 bp, Homo sapien
cgcaaccccggaggatccaggcaga

SEQ ID NO: 214338 - DNA, 25 bp, Homo sapien
acgcagcgttgtgcaggggccggta

SEQ ID NO: 214339 - DNA, 25 bp, Homo sapien
cctcgtgcgacgcagcgttgtgcag

SEQ ID NO: 214340 - DNA, 25 bp, Homo sapien
aggccctcgtgcgacgcagcgttgt

SEQ ID NO: 214341 - DNA, 25 bp, Homo sapien
tctcaccttcgctgtgcggctctgc

SEQ ID NO: 214342 - DNA, 25 bp, Homo sapien
gggctcccgcagccatcggtcacct

SEQ ID NO: 214343 - DNA, 25 bp, Homo sapien
ctccggcatcggtcatcttcagcgt

SEQ ID NO: 214344 - DNA, 25 bp, Homo sapien
agttgcagctacttctctgcccgcg

SEQ ID NO: 214345 - DNA, 25 bp, Homo sapien
tcggtcatcttcagcgtctggcgcc

SEQ ID NO: 214346 - DNA, 25 bp, Homo sapien
cagctacttctctgcccgcgggaga

SEQ ID NO: 214347 - DNA, 25 bp, Homo sapien
gaaaggcccttgtcgcttagccctg

SEQ ID NO: 214348 - DNA, 25 bp, Homo sapien
tagggccataaatcctatctccgcc

SEQ ID NO: 214349 - DNA, 25 bp, Homo sapien
ggggattagggccataaatcctatc

SEQ ID NO: 214350 - DNA, 25 bp, Homo sapien
cctcaggcccatggtgctcgaggcg

SEQ ID NO: 214351 - DNA, 25 bp, Homo sapien
tggctccgtcttcatcatggtgggg

SEQ ID NO: 214352 - DNA, 25 bp, Homo sapien
gggaccgcttgctgaccagcttcga

SEQ ID NO: 214353 - DNA, 25 bp, Homo sapien
gccttctcgaagacggcgctgagct

SEQ ID NO: 214354 - DNA, 25 bp, Homo sapien
tgctgccgttgaagcgcaccacgac

SEQ ID NO: 214355 - DNA, 25 bp, Homo sapien
gttcgaacagcttccgcgtctcctg

SEQ ID NO: 214356 - DNA, 25 bp, Homo sapien
cgtcgtgcccatctgcaggaacata

SEQ ID NO: 214357 - DNA, 25 bp, Homo sapien
cagcttcgagttgacctggggaacc

SEQ ID NO: 214358 - DNA, 25 bp, Homo sapien
cggtggacgttggagccatatttct

SEQ ID NO: 214359 - DNA, 25 bp, Homo sapien
ccctgtagattagagcgttttctgg

SEQ ID NO: 214360 - DNA, 25 bp, Homo sapien
cctctcgtggcggactggccaggtc

SEQ ID NO: 214361 - DNA, 25 bp, Homo sapien
ctggccaggtcgcagtctttgttgt

SEQ ID NO: 214362 - DNA, 25 bp, Homo sapien
agcgaacgcgccctctcgtggcgga

SEQ ID NO: 214363 - DNA, 25 bp, Homo sapien
caacatcgcgcaggcgcaagaccgg

SEQ ID NO: 214364 - DNA, 25 bp, Homo sapien
agctcgtggccttgggttccctcct

SEQ ID NO: 214365 - DNA, 25 bp, Homo sapien
tagattagagcgttttctgggtcgg

SEQ ID NO: 214366 - DNA, 25 bp, Homo sapien
cagtctttgttgttgcgctggaggc

SEQ ID NO: 214367 - DNA, 25 bp, Homo sapien
cacggccttcctgattgcttctaca

SEQ ID NO: 214368 - DNA, 25 bp, Homo sapien
ccgcagagagggcaatctttcctta

SEQ ID NO: 214369 - DNA, 25 bp, Homo sapien
cgagtccgcgccaaagtttctcatc

SEQ ID NO: 214370 - DNA, 25 bp, Homo sapien
gtccgcaaatagtccagaagttagc

SEQ ID NO: 214371 - DNA, 25 bp, Homo sapien
cctccaggtcacttttagccaaaga

SEQ ID NO: 214372 - DNA, 25 bp, Homo sapien
gccagggaggctgtaactctttcca

SEQ ID NO: 214373 - DNA, 25 bp, Homo sapien
gcttctacatcttgggcttcaaatg

SEQ ID NO: 214374 - DNA, 25 bp, Homo sapien
caaagctttagtccgcggtggcttc

SEQ ID NO: 214375 - DNA, 25 bp, Homo sapien
ctccgcggggtctttccaggaatct

SEQ ID NO: 214376 - DNA, 25 bp, Homo sapien
acagattggcgacacagcaggaggc

SEQ ID NO: 214377 - DNA, 25 bp, Homo sapien
gcgcccaaggacatgacgttgagcc

SEQ ID NO: 214378 - DNA, 25 bp, Homo sapien
ccgcagggggctcagaatcaggccc

SEQ ID NO: 214379 - DNA, 25 bp, Homo sapien
cggggtctttccaggaatctggatg

SEQ ID NO: 214380 - DNA, 25 bp, Homo sapien
caggaatctggatgggcctgctcgc

SEQ ID NO: 214381 - DNA, 25 bp, Homo sapien
acatgacgttgagcctctcagggtc

SEQ ID NO: 214382 - DNA, 25 bp, Homo sapien
ggggtcaagacagattggcgacaca

SEQ ID NO: 214383 - DNA, 25 bp, Homo sapien
gcctccaggtttttaagcagacgcc

SEQ ID NO: 214384 - DNA, 25 bp, Homo sapien
cgcgtgggactgaactcgcccacga

SEQ ID NO: 214385 - DNA, 25 bp, Homo sapien
ctctcccaaggcggcgtctctggga

SEQ ID NO: 214386 - DNA, 25 bp, Homo sapien
agcagacgcctgtggctctcacacg

SEQ ID NO: 214387 - DNA, 25 bp, Homo sapien
agcgcagaaggcacgcgctcaagcc

SEQ ID NO: 214388 - DNA, 25 bp, Homo sapien
aggtttttaagcagacgcctgtggc

SEQ ID NO: 214389 - DNA, 25 bp, Homo sapien
tgcggcctccaggtttttaagcaga

SEQ ID NO: 214390 - DNA, 25 bp, Homo sapien
taagcagacgcctgtggctctcaca

SEQ ID NO: 214391 - DNA, 25 bp, Homo sapien
cccatgtagcccaggaatcggcttg

SEQ ID NO: 214392 - DNA, 25 bp, Homo sapien
gaaatcctcccttaatgaagtcaca

SEQ ID NO: 214393 - DNA, 25 bp, Homo sapien
tgtgtggtgggacttgaaatcctcc

SEQ ID NO: 214394 - DNA, 25 bp, Homo sapien
aagcttgactaacggcctctagggg

SEQ ID NO: 214395 - DNA, 25 bp, Homo sapien
ccgcacgggtaccaagcttgactaa

SEQ ID NO: 214396 - DNA, 25 bp, Homo sapien
ggagtgttcgctcccgcattttcga

SEQ ID NO: 214397 - DNA, 25 bp, Homo sapien
cctgggcactgagtcaaagcttgag

SEQ ID NO: 214398 - DNA, 25 bp, Homo sapien
ccctcgggtaacgtttgaagagctg

SEQ ID NO: 214399 - DNA, 25 bp, Homo sapien
atatatacgactggggcgcgatgaa

SEQ ID NO: 214400 - DNA, 25 bp, Homo sapien
ctctctcaatgtcggtgactggaat

SEQ ID NO: 214401 - DNA, 25 bp, Homo sapien
ctgatatatacgactggggcgcgat

SEQ ID NO: 214402 - DNA, 25 bp, Homo sapien
cgcgatgaaatacactcgatggctg

SEQ ID NO: 214403 - DNA, 25 bp, Homo sapien
gaaatacactcgatggctgctactc

SEQ ID NO: 214404 - DNA, 25 bp, Homo sapien
tcgatggctgctactcacatatggg

SEQ ID NO: 214405 - DNA, 25 bp, Homo sapien
tgtcggtgactggaatggctgatat

SEQ ID NO: 214406 - DNA, 25 bp, Homo sapien
aatggctgatatatacgactggggc

SEQ ID NO: 214407 - DNA, 25 bp, Homo sapien
gcgggactccacgtctcctaggaac

SEQ ID NO: 214408 - DNA, 25 bp, Homo sapien
ctaggaaccgctgcgcgctcactga

SEQ ID NO: 214409 - DNA, 25 bp, Homo sapien
ctcactgattggctgatcgctgctc

SEQ ID NO: 214410 - DNA, 25 bp, Homo sapien
gatcgctgctcagccgccattttca

SEQ ID NO: 214411 - DNA, 25 bp, Homo sapien
tgcagtccgctgacaggcgctttct

SEQ ID NO: 214412 - DNA, 25 bp, Homo sapien
ctcagaagcagcctcgaccgcggag

SEQ ID NO: 214413 - DNA, 25 bp, Homo sapien
aagcagcctcgaccgcggaggcgaa

SEQ ID NO: 214414 - DNA, 25 bp, Homo sapien
gctgacaggcgctttctgcctggca

SEQ ID NO: 214415 - DNA, 25 bp, Homo sapien
tctcagcagctcacggtgtggaaac

SEQ ID NO: 214416 - DNA, 25 bp, Homo sapien
ggaaactgcgacactcacgcgggtg

SEQ ID NO: 214417 - DNA, 25 bp, Homo sapien
aaactgcgacactcacgcgggtgcc

SEQ ID NO: 214418 - DNA, 25 bp, Homo sapien
ctcagcagctcacggtgtggaaact

SEQ ID NO: 214419 - DNA, 25 bp, Homo sapien
acacgggtgccatctcagcagctca

SEQ ID NO: 214420 - DNA, 25 bp, Homo sapien
tgtggaaactgcgacactcacacgg

SEQ ID NO: 214421 - DNA, 25 bp, Homo sapien
tggaaactgcgacactcacgcgggt

SEQ ID NO: 214422 - DNA, 25 bp, Homo sapien
tgtggaaactgcgacactcacgcgg

SEQ ID NO: 214423 - DNA, 25 bp, Homo sapien
catccgtgtcagagtgctgtgtgcc

SEQ ID NO: 214424 - DNA, 25 bp, Homo sapien
cgggcatccatgtcagagtgctgtg

SEQ ID NO: 214425 - DNA, 25 bp, Homo sapien
catctgtgtcagagtgctgtgtgcc

SEQ ID NO: 214426 - DNA, 25 bp, Homo sapien
atccgtgtcagagtgctgtgtgccg

SEQ ID NO: 214427 - DNA, 25 bp, Homo sapien
ctgcgggcatccatgtcagagtgct

SEQ ID NO: 214428 - DNA, 25 bp, Homo sapien
gtgcgggcatccatgtcagagtgct

SEQ ID NO: 214429 - DNA, 25 bp, Homo sapien
catccatgtcagagtgctgtgtgcc

SEQ ID NO: 214430 - DNA, 25 bp, Homo sapien
tgcgggcatccatgtcagagtgctg

SEQ ID NO: 214431 - DNA, 25 bp, Homo sapien
aaagagactttttccactgtggccg

SEQ ID NO: 214432 - DNA, 25 bp, Homo sapien
tgtggccgagaacgagggatttaaa

SEQ ID NO: 214433 - DNA, 25 bp, Homo sapien
ggcacccgggatacttcactgaaaa

SEQ ID NO: 214434 - DNA, 25 bp, Homo sapien
aacctagtgaggacctgacaccgtg

SEQ ID NO: 214435 - DNA, 25 bp, Homo sapien
tctcaggcttggacggaacctagtg

SEQ ID NO: 214436 - DNA, 25 bp, Homo sapien
caccgcgtctggcaaagggaaggcc

SEQ ID NO: 214437 - DNA, 25 bp, Homo sapien
cacagggtcgagtgaggaacccttc

SEQ ID NO: 214438 - DNA, 25 bp, Homo sapien
cccgtctatgagcagctgtcgtgtc

SEQ ID NO: 214439 - DNA, 25 bp, Homo sapien
cacgcgtagttaggtgatggcgacc

SEQ ID NO: 214440 - DNA, 25 bp, Homo sapien
ggcagaagactttattgcacgcgta

SEQ ID NO: 214441 - DNA, 25 bp, Homo sapien
gttctcgggctgtaagcagcaggca

SEQ ID NO: 214442 - DNA, 25 bp, Homo sapien
cgtcggcttttcgtggatccttgag

SEQ ID NO: 214443 - DNA, 25 bp, Homo sapien
cgagaaagggcaacggtcaaagatt

SEQ ID NO: 214444 - DNA, 25 bp, Homo sapien
cacgagcaaactccggcgagaaagg

SEQ ID NO: 214445 - DNA, 25 bp, Homo sapien
cccaggaaggcgataggtgagacat

SEQ ID NO: 214446 - DNA, 25 bp, Homo sapien
tgatggcgacctacggttttcactg

SEQ ID NO: 214447 - DNA, 25 bp, Homo sapien
cccgagcaagggtcgtcggcatcca

SEQ ID NO: 214448 - DNA, 25 bp, Homo sapien
tggagatgctgaccgcgtctgtttt

SEQ ID NO: 214449 - DNA, 25 bp, Homo sapien
tttcctttcagccaaacccgagcaa

SEQ ID NO: 214450 - DNA, 25 bp, Homo sapien
ggtcgtcggcatccaggcctgtgcc

SEQ ID NO: 214451 - DNA, 25 bp, Homo sapien
gcttcacgtggcgggaagaccctct

SEQ ID NO: 214452 - DNA, 25 bp, Homo sapien
ttcccgcggcccatttggtcagctt

SEQ ID NO: 214453 - DNA, 25 bp, Homo sapien
gaccgcgtctgttttcctttcagcc

SEQ ID NO: 214454 - DNA, 25 bp, Homo sapien
cctgcgtgggctcactggagatgct

SEQ ID NO: 214455 - DNA, 25 bp, Homo sapien
tgatcaatccttgttttcctcggca

SEQ ID NO: 214456 - DNA, 25 bp, Homo sapien
gaaatcgggacttggcattttctcc

SEQ ID NO: 214457 - DNA, 25 bp, Homo sapien
tcctaatttgttggaggccgccagc

SEQ ID NO: 214458 - DNA, 25 bp, Homo sapien
ttagcagttgagaaaaattcctttc

SEQ ID NO: 214459 - DNA, 25 bp, Homo sapien
tccgtttctatttgtgaagggagga

SEQ ID NO: 214460 - DNA, 25 bp, Homo sapien
ggccggggactggaatttcatctga

SEQ ID NO: 214461 - DNA, 25 bp, Homo sapien
gccgagcctcctgttcattagcagt

SEQ ID NO: 214462 - DNA, 25 bp, Homo sapien
gcctttctgccgacttcttccaatt

SEQ ID NO: 214463 - DNA, 25 bp, Homo sapien
gctgggcctttacttcgccgcccgc

SEQ ID NO: 214464 - DNA, 25 bp, Homo sapien
agggcccagcaaggattctccccag

SEQ ID NO: 214465 - DNA, 25 bp, Homo sapien
tggagttcctctgccaggcaggagg

SEQ ID NO: 214466 - DNA, 25 bp, Homo sapien
tggcaccagacacccggcagaggga

SEQ ID NO: 214467 - DNA, 25 bp, Homo sapien
cggcgagggcccagcaaggattctc

SEQ ID NO: 214468 - DNA, 25 bp, Homo sapien
ggcgagggcccagcaaggattctcc

SEQ ID NO: 214469 - DNA, 25 bp, Homo sapien
gcgagggcccagcaaggattctccc

SEQ ID NO: 214470 - DNA, 25 bp, Homo sapien
ctgggcctttacttcgccgcccgcg

SEQ ID NO: 214471 - DNA, 25 bp, Homo sapien
ttccttgagtaaactgagacacgcc

SEQ ID NO: 214472 - DNA, 25 bp, Homo sapien
catgctgcataatcggcttccttga

SEQ ID NO: 214473 - DNA, 25 bp, Homo sapien
gatcgtggtgcgttcatgctgcata

SEQ ID NO: 214474 - DNA, 25 bp, Homo sapien
agttccagtttgtgctgactcagga

SEQ ID NO: 214475 - DNA, 25 bp, Homo sapien
tgagcctttggcctggcagcacgac

SEQ ID NO: 214476 - DNA, 25 bp, Homo sapien
tcctgcacttgctgtagctgcgaga

SEQ ID NO: 214477 - DNA, 25 bp, Homo sapien
gccgtctggcagcagtgacgccatc

SEQ ID NO: 214478 - DNA, 25 bp, Homo sapien
gagacacgccgatgaccaagagttg

SEQ ID NO: 214479 - DNA, 25 bp, Homo sapien
ccgtgaaggtgacttctgctttgta

SEQ ID NO: 214480 - DNA, 25 bp, Homo sapien
cgtgactcacagagggcgaagtgct

SEQ ID NO: 214481 - DNA, 25 bp, Homo sapien
ctccagaggcttctagcaggcgagg

SEQ ID NO: 214482 - DNA, 25 bp, Homo sapien
ctcagaatcagaacagggaggtctc

SEQ ID NO: 214483 - DNA, 25 bp, Homo sapien
gtccaccctgcattctccgtgaagg

SEQ ID NO: 214484 - DNA, 25 bp, Homo sapien
gcagcctttatgagcctggctcctg

SEQ ID NO: 214485 - DNA, 25 bp, Homo sapien
ctccagggtgctccttacgagctca

SEQ ID NO: 214486 - DNA, 25 bp, Homo sapien
acgaggtgcaatgtgtccgtgagca

SEQ ID NO: 214487 - DNA, 25 bp, Homo sapien
cgtcgtggtcgaggttgtgttttct

SEQ ID NO: 214488 - DNA, 25 bp, Homo sapien
ttgtgttttctgtctcccgtgctgc

SEQ ID NO: 214489 - DNA, 25 bp, Homo sapien
gcacgtgccgccaactcacatttga

SEQ ID NO: 214490 - DNA, 25 bp, Homo sapien
aagtggcgttggtcacaaaggtgcc

SEQ ID NO: 214491 - DNA, 25 bp, Homo sapien
acaaaggtgccttgacgtggacacc

SEQ ID NO: 214492 - DNA, 25 bp, Homo sapien
ccctgacttggctttgctgagtgtg

SEQ ID NO: 214493 - DNA, 25 bp, Homo sapien
gtgccgtccctgcagtgacaccgag

SEQ ID NO: 214494 - DNA, 25 bp, Homo sapien
gacaccgaggtgctcctagccgtct

SEQ ID NO: 214495 - DNA, 25 bp, Homo sapien
gttcgaggctccatccagcaagtta

SEQ ID NO: 214496 - DNA, 25 bp, Homo sapien
agaagccggagtctgtctttcgcca

SEQ ID NO: 214497 - DNA, 25 bp, Homo sapien
acgttaggagtcacggcatctggcc

SEQ ID NO: 214498 - DNA, 25 bp, Homo sapien
aacgccttggtgtgccgtctgatac

SEQ ID NO: 214499 - DNA, 25 bp, Homo sapien
taccgaagctgtggacgttctcgcc

SEQ ID NO: 214500 - DNA, 25 bp, Homo sapien
tcactggccacatgcacttcgggga

SEQ ID NO: 214501 - DNA, 25 bp, Homo sapien
ggcatggcgacttcctcttcactgg

SEQ ID NO: 214502 - DNA, 25 bp, Homo sapien
tccacctgcgcgtgagcagactcta

SEQ ID NO: 214503 - DNA, 25 bp, Homo sapien
gcggccactaacagcaggaggtcgt

SEQ ID NO: 214504 - DNA, 25 bp, Homo sapien
cggccactaacagcaggaggtcgtg

SEQ ID NO: 214505 - DNA, 25 bp, Homo sapien
gcagtgcggctatggcaggggttct

SEQ ID NO: 214506 - DNA, 25 bp, Homo sapien
tgaggaatccggagtcaacactggg

SEQ ID NO: 214507 - DNA, 25 bp, Homo sapien
gagtcaacactgggccactgtgtgc

SEQ ID NO: 214508 - DNA, 25 bp, Homo sapien
cagccgggcgggccgtgatttataa

SEQ ID NO: 214509 - DNA, 25 bp, Homo sapien
ggagcagagtgggtcgggctccgga

SEQ ID NO: 214510 - DNA, 25 bp, Homo sapien
gaacgtgaggaatccggagtcaaca

SEQ ID NO: 214511 - DNA, 25 bp, Homo sapien
gcagaccaaggctcacttctgtcca

SEQ ID NO: 214512 - DNA, 25 bp, Homo sapien
ccaggcagaccaaggctcacttctg

SEQ ID NO: 214513 - DNA, 25 bp, Homo sapien
gggtcgctactggtcactcgggccc

SEQ ID NO: 214514 - DNA, 25 bp, Homo sapien
gagctggggtcgctactggtcactc

SEQ ID NO: 214515 - DNA, 25 bp, Homo sapien
cccattcttgatgagagggagctgg

SEQ ID NO: 214516 - DNA, 25 bp, Homo sapien
acgcacccggcctcgcctgaaaagc

SEQ ID NO: 214517 - DNA, 25 bp, Homo sapien
ccacgtacagcaaagcggccgtgtc

SEQ ID NO: 214518 - DNA, 25 bp, Homo sapien
tatgggtggcctgtctatgcctcag

SEQ ID NO: 214519 - DNA, 25 bp, Homo sapien
gtccgtgtgccgtctgcctgcacag

SEQ ID NO: 214520 - DNA, 25 bp, Homo sapien
aaaggatcacgcgaccatgggtacg

SEQ ID NO: 214521 - DNA, 25 bp, Homo sapien
accatgggtacgttggccacctgaa

SEQ ID NO: 214522 - DNA, 25 bp, Homo sapien
ccacctgaaggttgagtcccgcagc

SEQ ID NO: 214523 - DNA, 25 bp, Homo sapien
ccaggaggagcttcttagcggaact

SEQ ID NO: 214524 - DNA, 25 bp, Homo sapien
acgccctggctcatcccgggtgaag

SEQ ID NO: 214525 - DNA, 25 bp, Homo sapien
tctgaactgatgacagtggacgggt

SEQ ID NO: 214526 - DNA, 25 bp, Homo sapien
tgaagaggctgctgagtctgaactg

SEQ ID NO: 214527 - DNA, 25 bp, Homo sapien
gcacgatccttcctcgctgcatgat

SEQ ID NO: 214528 - DNA, 25 bp, Homo sapien
gatccttcctcgctgcatgatcctt

SEQ ID NO: 214529 - DNA, 25 bp, Homo sapien
gcacgatccttcctcgctgcacgat

SEQ ID NO: 214530 - DNA, 25 bp, Homo sapien
tgcatgatgattccttgctgcacga

SEQ ID NO: 214531 - DNA, 25 bp, Homo sapien
tgcacgatccttcctcgctgcatga

SEQ ID NO: 214532 - DNA, 25 bp, Homo sapien
tgcacgatccttcctcgctgcacga

SEQ ID NO: 214533 - DNA, 25 bp, Homo sapien
cacgatccttcctcgctgcacgatc

SEQ ID NO: 214534 - DNA, 25 bp, Homo sapien
gcatgatgattccttgctgcacgat

SEQ ID NO: 214535 - DNA, 25 bp, Homo sapien
caggatcagtcctcactgcacgatc

SEQ ID NO: 214536 - DNA, 25 bp, Homo sapien
ttcctcactgcatgatgattccttg

SEQ ID NO: 214537 - DNA, 25 bp, Homo sapien
acgatcagtcctcgctgcaggatca

SEQ ID NO: 214538 - DNA, 25 bp, Homo sapien
gatcattcctggttgcacgatcctt

SEQ ID NO: 214539 - DNA, 25 bp, Homo sapien
atgatcactgcaccatcattcctcg

SEQ ID NO: 214540 - DNA, 25 bp, Homo sapien
gcacgatcactgcagatgatcactg

SEQ ID NO: 214541 - DNA, 25 bp, Homo sapien
cgctcgatgaggtctgcacgatcac

SEQ ID NO: 214542 - DNA, 25 bp, Homo sapien
ctcgctgcacgatcattcctggttg

SEQ ID NO: 214543 - DNA, 25 bp, Homo sapien
cccggagagcccagatcgtagatta

SEQ ID NO: 214544 - DNA, 25 bp, Homo sapien
ccggagagtccagatcgtagattat

SEQ ID NO: 214545 - DNA, 25 bp, Homo sapien
ccggagagcccagatcgtagattat

SEQ ID NO: 214546 - DNA, 25 bp, Homo sapien
agagcccagatcgtagattattttg

SEQ ID NO: 214547 - DNA, 25 bp, Homo sapien
cccggagagtccagatcgtagatta

SEQ ID NO: 214548 - DNA, 25 bp, Homo sapien
cgtagattattttggacctgctgtc

SEQ ID NO: 214549 - DNA, 25 bp, Homo sapien
cgtagattattttggacccgctgtc

SEQ ID NO: 214550 - DNA, 25 bp, Homo sapien
ggagagcccagatcgtagattattt

SEQ ID NO: 214551 - DNA, 25 bp, Homo sapien
ggccagtttcctagagacgtcgtcg

SEQ ID NO: 214552 - DNA, 25 bp, Homo sapien
tcagagactggcttgacgcctccca

SEQ ID NO: 214553 - DNA, 25 bp, Homo sapien
cagtgccctcgcaggagtactcaca

SEQ ID NO: 214554 - DNA, 25 bp, Homo sapien
actgttactgttcttccgtggccaa

SEQ ID NO: 214555 - DNA, 25 bp, Homo sapien
gccaccaggatttctacagggtgta

SEQ ID NO: 214556 - DNA, 25 bp, Homo sapien
gcggccgcaagattctcgtctgttc

SEQ ID NO: 214557 - DNA, 25 bp, Homo sapien
aaagcgcaagcactcaacggccttc

SEQ ID NO: 214558 - DNA, 25 bp, Homo sapien
tcgtctgttctgtggacaactgtta

SEQ ID NO: 214559 - DNA, 25 bp, Homo sapien
tcagcaaggcggtgacgtaagtact

SEQ ID NO: 214560 - DNA, 25 bp, Homo sapien
tgtccaggaccatcgagtacccgca

SEQ ID NO: 214561 - DNA, 25 bp, Homo sapien
agcctcgcaggctaaactgaccatg

SEQ ID NO: 214562 - DNA, 25 bp, Homo sapien
aactgaccatgctcaacaccgcgtg

SEQ ID NO: 214563 - DNA, 25 bp, Homo sapien
acaccgcgtgcaagatccggggcca

SEQ ID NO: 214564 - DNA, 25 bp, Homo sapien
ggggaccaagctggatgatgacttc

SEQ ID NO: 214565 - DNA, 25 bp, Homo sapien
gagctgcgcgacgagtccaacttca

SEQ ID NO: 214566 - DNA, 25 bp, Homo sapien
ccaactggtcagtgagaaggtcgga

SEQ ID NO: 214567 - DNA, 25 bp, Homo sapien
agccgccagggacatgtctaacctc

SEQ ID NO: 214568 - DNA, 25 bp, Homo sapien
agggtacaccagttcgcatcgcagg

SEQ ID NO: 214569 - DNA, 25 bp, Homo sapien
aacgggcctgtcgaagtgcgcctga

SEQ ID NO: 214570 - DNA, 25 bp, Homo sapien
tgtccgctactaggcctcgcctaga

SEQ ID NO: 214571 - DNA, 25 bp, Homo sapien
agctgaccagccctgtccgctacta

SEQ ID NO: 214572 - DNA, 25 bp, Homo sapien
ctctcccttgagtggaccggacact

SEQ ID NO: 214573 - DNA, 25 bp, Homo sapien
aactctcccttgagtggaccggaca

SEQ ID NO: 214574 - DNA, 25 bp, Homo sapien
gcctgtcgaagtgcgcctgacaggt

SEQ ID NO: 214575 - DNA, 25 bp, Homo sapien
ggtgactccgcattccgattggctg

SEQ ID NO: 214576 - DNA, 25 bp, Homo sapien
ctcgactcagctcaaagaccgtgtg

SEQ ID NO: 214577 - DNA, 25 bp, Homo sapien
cgactgcgttcaaagggtccacctc

SEQ ID NO: 214578 - DNA, 25 bp, Homo sapien
cgccgcctgagtctgtacctgcgaa

SEQ ID NO: 214579 - DNA, 25 bp, Homo sapien
gccgttcgtgtttccatagggttga

SEQ ID NO: 214580 - DNA, 25 bp, Homo sapien
ctcagccgcctggtcaatgaacgtc

SEQ ID NO: 214581 - DNA, 25 bp, Homo sapien
taaggcctccgctgccgtttgcaga

SEQ ID NO: 214582 - DNA, 25 bp, Homo sapien
tcgagcctaagctgtgtgcccattg

SEQ ID NO: 214583 - DNA, 25 bp, Homo sapien
gtggatgccatgcagttaccgggca

SEQ ID NO: 214584 - DNA, 25 bp, Homo sapien
tgccatgcagttaccgggcaggaga

SEQ ID NO: 214585 - DNA, 25 bp, Homo sapien
ctcggagggtcacgcgcaggccctc

SEQ ID NO: 214586 - DNA, 25 bp, Homo sapien
ccgctccgggcccatggcgcagcgc

SEQ ID NO: 214587 - DNA, 25 bp, Homo sapien
gccgacagggacgcagaaaagcgca

SEQ ID NO: 214588 - DNA, 25 bp, Homo sapien
ggggcggctgccaaatcacttgcct

SEQ ID NO: 214589 - DNA, 25 bp, Homo sapien
aatcacttgcctctcggcgcgagac

SEQ ID NO: 214590 - DNA, 25 bp, Homo sapien
ggctgccaaatcacttgcctctcgg

SEQ ID NO: 214591 - DNA, 25 bp, Homo sapien
ctttgggtcatcaacctctcagcga

SEQ ID NO: 214592 - DNA, 25 bp, Homo sapien
ggtgccgcgacagacgcacgttgca

SEQ ID NO: 214593 - DNA, 25 bp, Homo sapien
ccagccttcctatcgtgcttgggga

SEQ ID NO: 214594 - DNA, 25 bp, Homo sapien
ccaccagggcagaaagtttgggcca

SEQ ID NO: 214595 - DNA, 25 bp, Homo sapien
gaagaccaccttcccgagcgtgcga

SEQ ID NO: 214596 - DNA, 25 bp, Homo sapien
agcaccaaaatgaccactggcctcg

SEQ ID NO: 214597 - DNA, 25 bp, Homo sapien
tggggacccgacaggttcccaatgc

SEQ ID NO: 214598 - DNA, 25 bp, Homo sapien
ctacgtgataccagggatcccaggg

SEQ ID NO: 214599 - DNA, 25 bp, Homo sapien
tccagcggccctgggaccgtgtcag

SEQ ID NO: 214600 - DNA, 25 bp, Homo sapien
tcttgaatgagcctcgggagccctc

SEQ ID NO: 214601 - DNA, 25 bp, Homo sapien
ctgggcttttctggctcttgaatga

SEQ ID NO: 214602 - DNA, 25 bp, Homo sapien
gccctgggcttttctggctcttgaa

SEQ ID NO: 214603 - DNA, 25 bp, Homo sapien
taattacctcttcgcaggccctggg

SEQ ID NO: 214604 - DNA, 25 bp, Homo sapien
ggcctccttgctgtaattacctctt

SEQ ID NO: 214605 - DNA, 25 bp, Homo sapien
gaatggtacccaggaggcctccttg

SEQ ID NO: 214606 - DNA, 25 bp, Homo sapien
agaaggcccactctggaatggtacc

SEQ ID NO: 214607 - DNA, 25 bp, Homo sapien
tgtacatccagaacctcggccgcga

SEQ ID NO: 214608 - DNA, 25 bp, Homo sapien
gcgagctgcgccacacactcaagga

SEQ ID NO: 214609 - DNA, 25 bp, Homo sapien
ccgcaggccctgtgttcgtggtgca

SEQ ID NO: 214610 - DNA, 25 bp, Homo sapien
tgcagtggctgtttgacgaggcaca

SEQ ID NO: 214611 - DNA, 25 bp, Homo sapien
acgaggcacagctgacggtggacaa

SEQ ID NO: 214612 - DNA, 25 bp, Homo sapien
ctgacggtggacaacgtgcacctga

SEQ ID NO: 214613 - DNA, 25 bp, Homo sapien
acaacgtgcacctgacggggcagcc

SEQ ID NO: 214614 - DNA, 25 bp, Homo sapien
ccacacactcaaggacgtgccgtga

SEQ ID NO: 214615 - DNA, 25 bp, Homo sapien
gcggtcgtcctctgcctccgggaag

SEQ ID NO: 214616 - DNA, 25 bp, Homo sapien
gccgggacatctgccaccgcgcaac

SEQ ID NO: 214617 - DNA, 25 bp, Homo sapien
cagacccggaaagcgcggtcgtcct

SEQ ID NO: 214618 - DNA, 25 bp, Homo sapien
cggcgtcaaacaactttatcggcaa

SEQ ID NO: 214619 - DNA, 25 bp, Homo sapien
gtgctcggcgtcaccttcaccgtgt

SEQ ID NO: 214620 - DNA, 25 bp, Homo sapien
cggccgcacctgaagcagcacggtg

SEQ ID NO: 214621 - DNA, 25 bp, Homo sapien
cgaacaccgggacgccgaccgcaat

SEQ ID NO: 214622 - DNA, 25 bp, Homo sapien
caggaggccgctcattggccgccga

SEQ ID NO: 214623 - DNA, 25 bp, Homo sapien
tgcccgggaagtctaagcctgctag

SEQ ID NO: 214624 - DNA, 25 bp, Homo sapien
gcctgctagcgaaagctgctctccg

SEQ ID NO: 214625 - DNA, 25 bp, Homo sapien
atcagtccacaacccagatagcagg

SEQ ID NO: 214626 - DNA, 25 bp, Homo sapien
atagcaggctgagcgacgtcccatt

SEQ ID NO: 214627 - DNA, 25 bp, Homo sapien
tccctccttggctttaagcgcagtg

SEQ ID NO: 214628 - DNA, 25 bp, Homo sapien
tctcacccgggccagttttcaaggc

SEQ ID NO: 214629 - DNA, 25 bp, Homo sapien
tgctgagattgctgtcctgactgcc

SEQ ID NO: 214630 - DNA, 25 bp, Homo sapien
gctgtaactggtggcatttgtcccg

SEQ ID NO: 214631 - DNA, 25 bp, Homo sapien
tgtttcacaagagcccaggtaactc

SEQ ID NO: 214632 - DNA, 25 bp, Homo sapien
agcgtttggtctctctgtttcacaa

SEQ ID NO: 214633 - DNA, 25 bp, Homo sapien
agcccaggtaactcggctgtctgcg

SEQ ID NO: 214634 - DNA, 25 bp, Homo sapien
gcggcgctgggactttctccctaag

SEQ ID NO: 214635 - DNA, 25 bp, Homo sapien
gctgggactttctccctaagctcct

SEQ ID NO: 214636 - DNA, 25 bp, Homo sapien
tggcaaggaggacgtccacatggcc

SEQ ID NO: 214637 - DNA, 25 bp, Homo sapien
cggggcaacagctcccagcgtttgg

SEQ ID NO: 214638 - DNA, 25 bp, Homo sapien
tcccagcgtttggtctctctgtttc

SEQ ID NO: 214639 - DNA, 25 bp, Homo sapien
tcccgcaggtctccgagggagccag

SEQ ID NO: 214640 - DNA, 25 bp, Homo sapien
ggccctcggctggaagccctgtgtc

SEQ ID NO: 214641 - DNA, 25 bp, Homo sapien
cccgcgatctccttaagtcgtagct

SEQ ID NO: 214642 - DNA, 25 bp, Homo sapien
cgcgatctccttaagtcgtagctgc

SEQ ID NO: 214643 - DNA, 25 bp, Homo sapien
gatctccttaagtcgtagctgcttc

SEQ ID NO: 214644 - DNA, 25 bp, Homo sapien
tctccttaagtcgtagctgcttctc

SEQ ID NO: 214645 - DNA, 25 bp, Homo sapien
aggagcgccccggaactgagcgact

SEQ ID NO: 214646 - DNA, 25 bp, Homo sapien
cttaagtcgtagctgcttctctgac

SEQ ID NO: 214647 - DNA, 25 bp, Homo sapien
acctcggtgacctgcaacgacggca

SEQ ID NO: 214648 - DNA, 25 bp, Homo sapien
gtggagggtaacatggacagcttca

SEQ ID NO: 214649 - DNA, 25 bp, Homo sapien
cttcatggcgcaagtcaagagcctg

SEQ ID NO: 214650 - DNA, 25 bp, Homo sapien
agagcttcccgctggacttcacggc

SEQ ID NO: 214651 - DNA, 25 bp, Homo sapien
acgcgctcaacaggccgaggacagc

SEQ ID NO: 214652 - DNA, 25 bp, Homo sapien
agctcaacgaggacctgcgcctgca

SEQ ID NO: 214653 - DNA, 25 bp, Homo sapien
tggggattttccacggaccacagcc

SEQ ID NO: 214654 - DNA, 25 bp, Homo sapien
aagcgcgctccttcagtgcggacgc

SEQ ID NO: 214655 - DNA, 25 bp, Homo sapien
ggcccgtcctcgtgctgcagctttg

SEQ ID NO: 214656 - DNA, 25 bp, Homo sapien
tggctgtggctccaggtactggaac

SEQ ID NO: 214657 - DNA, 25 bp, Homo sapien
acggcagcctaacctgtggctgtgg

SEQ ID NO: 214658 - DNA, 25 bp, Homo sapien
agacccacggcagcctaacctgtgg

SEQ ID NO: 214659 - DNA, 25 bp, Homo sapien
cgaggagtggaactgcttctttggc

SEQ ID NO: 214660 - DNA, 25 bp, Homo sapien
tggaactgcttctttggctacaagg

SEQ ID NO: 214661 - DNA, 25 bp, Homo sapien
cttctttggctacaaggtctacccg

SEQ ID NO: 214662 - DNA, 25 bp, Homo sapien
tggctacaaggtctacccgaccctg

SEQ ID NO: 214663 - DNA, 25 bp, Homo sapien
cggcgttttccagctcgagtgctca

SEQ ID NO: 214664 - DNA, 25 bp, Homo sapien
tctcacaggctctaggggcatgata

SEQ ID NO: 214665 - DNA, 25 bp, Homo sapien
tcttacggtggtgtccttagtcgtc

SEQ ID NO: 214666 - DNA, 25 bp, Homo sapien
tgtaaggctcagaagcgtccctccg

SEQ ID NO: 214667 - DNA, 25 bp, Homo sapien
caaagtcccgaagccgtgaggtgta

SEQ ID NO: 214668 - DNA, 25 bp, Homo sapien
tcctgggctccgtccatgaacaggc

SEQ ID NO: 214669 - DNA, 25 bp, Homo sapien
ttcccttcgcagctgtgaatcctgg

SEQ ID NO: 214670 - DNA, 25 bp, Homo sapien
tcgctgcttgttggagatgcccagc

SEQ ID NO: 214671 - DNA, 25 bp, Homo sapien
accgggcttatgctccgactctgaa

SEQ ID NO: 214672 - DNA, 25 bp, Homo sapien
cgcggcccacactggcgactttgac

SEQ ID NO: 214673 - DNA, 25 bp, Homo sapien
gcgcggggtctcaccagcgctgtct

SEQ ID NO: 214674 - DNA, 25 bp, Homo sapien
ggtcctgcaccgtcgggcaggtcca

SEQ ID NO: 214675 - DNA, 25 bp, Homo sapien
ggctcggacaccacccggtcctgca

SEQ ID NO: 214676 - DNA, 25 bp, Homo sapien
gcgctcctcagtcccgtcagacacc

SEQ ID NO: 214677 - DNA, 25 bp, Homo sapien
gtccgggctggtgcgctcctcagtc

SEQ ID NO: 214678 - DNA, 25 bp, Homo sapien
atgctccgactctgaaccgactgac

SEQ ID NO: 214679 - DNA, 25 bp, Homo sapien
aggagtcgctggcacgcacctgaag

SEQ ID NO: 214680 - DNA, 25 bp, Homo sapien
ttcctctggtaagctggaaacaacc

SEQ ID NO: 214681 - DNA, 25 bp, Homo sapien
cgcacctgaaggtggctaaggtcag

SEQ ID NO: 214682 - DNA, 25 bp, Homo sapien
accacagcaagtgcccgggaaacgc

SEQ ID NO: 214683 - DNA, 25 bp, Homo sapien
tgtgaccacacttcatgccagactg

SEQ ID NO: 214684 - DNA, 25 bp, Homo sapien
gagacgtcatgtctgtgtgaccaca

SEQ ID NO: 214685 - DNA, 25 bp, Homo sapien
ggcaggcgctcacacaaacacaggg

SEQ ID NO: 214686 - DNA, 25 bp, Homo sapien
taaggtcagacgtacctcctgcctc

SEQ ID NO: 214687 - DNA, 25 bp, Homo sapien
cgcagtctttcgttgctgtgggaag

SEQ ID NO: 214688 - DNA, 25 bp, Homo sapien
ggcgactcaccatcgtcagtgcgca

SEQ ID NO: 214689 - DNA, 25 bp, Homo sapien
cgcaaccgttcgctaactgaaatga

SEQ ID NO: 214690 - DNA, 25 bp, Homo sapien
acgccagagtctcaagcgcggttcg

SEQ ID NO: 214691 - DNA, 25 bp, Homo sapien
cgtaatcgcgctcaccaagcaggtg

SEQ ID NO: 214692 - DNA, 25 bp, Homo sapien
gtcgcgttgcatcttgggaattgta

SEQ ID NO: 214693 - DNA, 25 bp, Homo sapien
gctatgagtaggtcttcttcgcgga

SEQ ID NO: 214694 - DNA, 25 bp, Homo sapien
gaccacctgtggtactgacgtaatc

SEQ ID NO: 214695 - DNA, 25 bp, Homo sapien
agctggcgtctcgagacctggagac

SEQ ID NO: 214696 - DNA, 25 bp, Homo sapien
gatgcaccacacagactacaagttc

SEQ ID NO: 214697 - DNA, 25 bp, Homo sapien
atcgttcagctgctcgtggccaagc

SEQ ID NO: 214698 - DNA, 25 bp, Homo sapien
tgggcgtccacgaagtggtcttcgc

SEQ ID NO: 214699 - DNA, 25 bp, Homo sapien
agtggtcttcgccttcgtgacggac

SEQ ID NO: 214700 - DNA, 25 bp, Homo sapien
cttcgtgacggacgagcacgcccag

SEQ ID NO: 214701 - DNA, 25 bp, Homo sapien
ggggactccaagctccacgtggatg

SEQ ID NO: 214702 - DNA, 25 bp, Homo sapien
ctgcgggcacggcagatgcaccaca

SEQ ID NO: 214703 - DNA, 25 bp, Homo sapien
agtcctcgtgccacacagagaggtc

SEQ ID NO: 214704 - DNA, 25 bp, Homo sapien
tcgtgccacacagagaggtccggcc

SEQ ID NO: 214705 - DNA, 25 bp, Homo sapien
gagaggtccggcctacgccagtcct

SEQ ID NO: 214706 - DNA, 25 bp, Homo sapien
gccacacagagaggtccggcctacg

SEQ ID NO: 214707 - DNA, 25 bp, Homo sapien
acacagagaggtccggcctacgcca

SEQ ID NO: 214708 - DNA, 25 bp, Homo sapien
gtgccacacagagaggtccggccta

SEQ ID NO: 214709 - DNA, 25 bp, Homo sapien
gccagtcctcgtgccacacagagag

SEQ ID NO: 214710 - DNA, 25 bp, Homo sapien
tacgccagtcctcgtgccacacaga

SEQ ID NO: 214711 - DNA, 25 bp, Homo sapien
tgagacccacctggtcatcgcgggg

SEQ ID NO: 214712 - DNA, 25 bp, Homo sapien
cctggcgcatgagacagggcacaca

SEQ ID NO: 214713 - DNA, 25 bp, Homo sapien
cgttgtacacgactctggagacggg

SEQ ID NO: 214714 - DNA, 25 bp, Homo sapien
gcacccaccttcgtaaatgaagcgg

SEQ ID NO: 214715 - DNA, 25 bp, Homo sapien
tcttgccgttgtacacgactctgga

SEQ ID NO: 214716 - DNA, 25 bp, Homo sapien
ctgctggtcctcttgccgttgtaca

SEQ ID NO: 214717 - DNA, 25 bp, Homo sapien
aatgaagcggacgttctcctcgtgg

SEQ ID NO: 214718 - DNA, 25 bp, Homo sapien
ggggcgtctgatcctagcgctccac

SEQ ID NO: 214719 - DNA, 25 bp, Homo sapien
cctgtagaccattgactggcccata

SEQ ID NO: 214720 - DNA, 25 bp, Homo sapien
cctttcgtcggagcagcagtatctg

SEQ ID NO: 214721 - DNA, 25 bp, Homo sapien
ccaaaggccctcctagagtgatctg

SEQ ID NO: 214722 - DNA, 25 bp, Homo sapien
gtctcagaaatcacaggcatggtca

SEQ ID NO: 214723 - DNA, 25 bp, Homo sapien
tagcctgcttctcagcggaacagtc

SEQ ID NO: 214724 - DNA, 25 bp, Homo sapien
gcctcagcggtaaagtcgtccacta

SEQ ID NO: 214725 - DNA, 25 bp, Homo sapien
cgaggatcaccttgccctgtccagg

SEQ ID NO: 214726 - DNA, 25 bp, Homo sapien
tccactacgagcatatgagtgtctc

SEQ ID NO: 214727 - DNA, 25 bp, Homo sapien
gggcccatagctgcctaccatgtag

SEQ ID NO: 214728 - DNA, 25 bp, Homo sapien
gcagggcctccttgtactttcgcag

SEQ ID NO: 214729 - DNA, 25 bp, Homo sapien
cttgaagctctccaggtcgcctgtt

SEQ ID NO: 214730 - DNA, 25 bp, Homo sapien
gcagcctgtagcttacccggaaaga

SEQ ID NO: 214731 - DNA, 25 bp, Homo sapien
ggttaacctgcaggacccgaagcga

SEQ ID NO: 214732 - DNA, 25 bp, Homo sapien
cggacactatctctcggttaacctg

SEQ ID NO: 214733 - DNA, 25 bp, Homo sapien
tggatgtacttcatgccggacacta

SEQ ID NO: 214734 - DNA, 25 bp, Homo sapien
acgcctttcctgtacgtatgctgga

SEQ ID NO: 214735 - DNA, 25 bp, Homo sapien
catgaaagaagctccggaccgctcg

SEQ ID NO: 214736 - DNA, 25 bp, Homo sapien
ccgcgcgaggatagccgtaggcgcc

SEQ ID NO: 214737 - DNA, 25 bp, Homo sapien
atagccgtaggcgccgggatcctag

SEQ ID NO: 214738 - DNA, 25 bp, Homo sapien
gcctcggcggccatgaaagaagctc

SEQ ID NO: 214739 - DNA, 25 bp, Homo sapien
ctcggcggccatgaaagaagctccg

SEQ ID NO: 214740 - DNA, 25 bp, Homo sapien
cggcggccatgaaagaagctccgga

SEQ ID NO: 214741 - DNA, 25 bp, Homo sapien
gccatgaaagaagctccggaccgct

SEQ ID NO: 214742 - DNA, 25 bp, Homo sapien
gcggccatgaaagaagctccggacc

SEQ ID NO: 214743 - DNA, 25 bp, Homo sapien
ttatccgtgaaaatcgcagtggagc

SEQ ID NO: 214744 - DNA, 25 bp, Homo sapien
cccgagctgtgtctcgagacctttg

SEQ ID NO: 214745 - DNA, 25 bp, Homo sapien
aagcctgtagagcagcgcggatgac

SEQ ID NO: 214746 - DNA, 25 bp, Homo sapien
acctcctggttggaaagcctgtaga

SEQ ID NO: 214747 - DNA, 25 bp, Homo sapien
accgacctcctggttggaaagcctg

SEQ ID NO: 214748 - DNA, 25 bp, Homo sapien
gggatgctgataccgacctcctggt

SEQ ID NO: 214749 - DNA, 25 bp, Homo sapien
tgtgtctcgagacctttgtcctccc

SEQ ID NO: 214750 - DNA, 25 bp, Homo sapien
aaaatcgcagtggagcgaacaaggg

SEQ ID NO: 214751 - DNA, 25 bp, Homo sapien
tgtcccccgtggaaagacagggctg

SEQ ID NO: 214752 - DNA, 25 bp, Homo sapien
tccgactgcgactcttgcttcgggg

SEQ ID NO: 214753 - DNA, 25 bp, Homo sapien
gactgcgactcttgcttcggggcct

SEQ ID NO: 214754 - DNA, 25 bp, Homo sapien
actgcgactcttgcttcggggccta

SEQ ID NO: 214755 - DNA, 25 bp, Homo sapien
cgactcttgcttcggggcctagtca

SEQ ID NO: 214756 - DNA, 25 bp, Homo sapien
ttgcttcggggcctagtcacctagt

SEQ ID NO: 214757 - DNA, 25 bp, Homo sapien
gcttcggggcctagtcacctagtcc

SEQ ID NO: 214758 - DNA, 25 bp, Homo sapien
cggtccgactgcgactcttgcttcg

SEQ ID NO: 214759 - DNA, 25 bp, Homo sapien
ttcctgaccctcacggctactccgg

SEQ ID NO: 214760 - DNA, 25 bp, Homo sapien
cgcgactgtggtcgtttttatacct

SEQ ID NO: 214761 - DNA, 25 bp, Homo sapien
ggccgcgactgtggtcgtttttata

SEQ ID NO: 214762 - DNA, 25 bp, Homo sapien
cggaacaaacaaagagctgggaagg

SEQ ID NO: 214763 - DNA, 25 bp, Homo sapien
aacgtccggaacaaacaaagagctg

SEQ ID NO: 214764 - DNA, 25 bp, Homo sapien
gccgcacaacttcagttcccttaga

SEQ ID NO: 214765 - DNA, 25 bp, Homo sapien
ctcttcccggcctgagaggatccgg

SEQ ID NO: 214766 - DNA, 25 bp, Homo sapien
cggcctgagaggatccggccgaaac

SEQ ID NO: 214767 - DNA, 25 bp, Homo sapien
agccatcaggtcatcactgtaaaga

SEQ ID NO: 214768 - DNA, 25 bp, Homo sapien
tcccaagcgaaggcggagccgacga

SEQ ID NO: 214769 - DNA, 25 bp, Homo sapien
tcatcactgtaaagactggagcgtc

SEQ ID NO: 214770 - DNA, 25 bp, Homo sapien
cgtcactagcggtctgtggaaggga

SEQ ID NO: 214771 - DNA, 25 bp, Homo sapien
tgcggtccagctctgctcgcagcgg

SEQ ID NO: 214772 - DNA, 25 bp, Homo sapien
tctaatttgcatgtctcgccctttc

SEQ ID NO: 214773 - DNA, 25 bp, Homo sapien
ggctgaagcgccatttctaatttgc

SEQ ID NO: 214774 - DNA, 25 bp, Homo sapien
aaagactggagcgtcccgcggcctg

SEQ ID NO: 214775 - DNA, 25 bp, Homo sapien
cgagtgacctcacgctgatgactca

SEQ ID NO: 214776 - DNA, 25 bp, Homo sapien
gtgcgcggcagacccgaaaccagcg

SEQ ID NO: 214777 - DNA, 25 bp, Homo sapien
cggccaccggatgaatcagcagctg

SEQ ID NO: 214778 - DNA, 25 bp, Homo sapien
atgactcagcaagtctccctccggg

SEQ ID NO: 214779 - DNA, 25 bp, Homo sapien
tcagcttgagcaccgagtgacctca

SEQ ID NO: 214780 - DNA, 25 bp, Homo sapien
cctccggtatcagcttgagcaccga

SEQ ID NO: 214781 - DNA, 25 bp, Homo sapien
cgctcggcgctcacttaaacaggca

SEQ ID NO: 214782 - DNA, 25 bp, Homo sapien
ctggcacgcgactgacggaacccga

SEQ ID NO: 214783 - DNA, 25 bp, Homo sapien
tcaggactccgcttgggtgtcaccc

SEQ ID NO: 214784 - DNA, 25 bp, Homo sapien
cgcttgggtgtcacccgtgcaggaa

SEQ ID NO: 214785 - DNA, 25 bp, Homo sapien
caggaagcctcccttagtcaagggc

SEQ ID NO: 214786 - DNA, 25 bp, Homo sapien
tgctcgggacgtggattcctttccc

SEQ ID NO: 214787 - DNA, 25 bp, Homo sapien
tgcctctctgctcgggacgtggatt

SEQ ID NO: 214788 - DNA, 25 bp, Homo sapien
ttctgacgcaggtcgtcaggactcc

SEQ ID NO: 214789 - DNA, 25 bp, Homo sapien
tggcaccagacacccggcagaggga

SEQ ID NO: 214790 - DNA, 25 bp, Homo sapien
gcgagggcccagcaaggattctccc

SEQ ID NO: 214791 - DNA, 25 bp, Homo sapien
cgccgcactgcccacttggaagatg

SEQ ID NO: 214792 - DNA, 25 bp, Homo sapien
gagtcacgcgcctttcagttggaaa

SEQ ID NO: 214793 - DNA, 25 bp, Homo sapien
gagatcaaaccgctacgcaagatgg

SEQ ID NO: 214794 - DNA, 25 bp, Homo sapien
ctgtggcgcttgtgaacccaaagta

SEQ ID NO: 214795 - DNA, 25 bp, Homo sapien
cgggtgtacgggcagaacatcaata

SEQ ID NO: 214796 - DNA, 25 bp, Homo sapien
ttaccttgccattggtccgcggagc

SEQ ID NO: 214797 - DNA, 25 bp, Homo sapien
caataacgagacgtggtcccgcatc

SEQ ID NO: 214798 - DNA, 25 bp, Homo sapien
agctggagcagccaccctatgattg

SEQ ID NO: 214799 - DNA, 25 bp, Homo sapien
tggcagccgggttcatcaaagaggt

SEQ ID NO: 214800 - DNA, 25 bp, Homo sapien
ccaaccctgtgcttgtgatagagaa

SEQ ID NO: 214801 - DNA, 25 bp, Homo sapien
tcggggtaccaccaaatcaggatga

SEQ ID NO: 214802 - DNA, 25 bp, Homo sapien
gaccagctcgcgacttctttcatca

SEQ ID NO: 214803 - DNA, 25 bp, Homo sapien
acgcccttcggcatgtactgctatg

SEQ ID NO: 214804 - DNA, 25 bp, Homo sapien
tctcaaggcgaaaggcgtcaagctc

SEQ ID NO: 214805 - DNA, 25 bp, Homo sapien
ctgctcttgggttcatcgtctccga

SEQ ID NO: 214806 - DNA, 25 bp, Homo sapien
gcgcgaggagatccaccagctaatg

SEQ ID NO: 214807 - DNA, 25 bp, Homo sapien
tctccgaggaaatttcacgcagagg

SEQ ID NO: 214808 - DNA, 25 bp, Homo sapien
tgaggcgacccttcttgatgacaaa

SEQ ID NO: 214809 - DNA, 25 bp, Homo sapien
tccctgatgcgtacgaatccctctt

SEQ ID NO: 214810 - DNA, 25 bp, Homo sapien
tggctgcttactctgaactccgacg

SEQ ID NO: 214811 - DNA, 25 bp, Homo sapien
ctccgacgttttcaggatccacttt

SEQ ID NO: 214812 - DNA, 25 bp, Homo sapien
ggatccacttttcgaagactcacaa

SEQ ID NO: 214813 - DNA, 25 bp, Homo sapien
gactcacaaagcacgaaagatattc

SEQ ID NO: 214814 - DNA, 25 bp, Homo sapien
cttgatgacaaactcgctacgatgc

SEQ ID NO: 214815 - DNA, 25 bp, Homo sapien
ggttgcagttcgagccaaggccttt

SEQ ID NO: 214816 - DNA, 25 bp, Homo sapien
caaggcctttgcaggatgggatcga

SEQ ID NO: 214817 - DNA, 25 bp, Homo sapien
atattgggcctcatcggcttcggtc

SEQ ID NO: 214818 - DNA, 25 bp, Homo sapien
cattcgtggggagatattgggcctc

SEQ ID NO: 214819 - DNA, 25 bp, Homo sapien
cctcagtaaaggctcgcattcgtgg

SEQ ID NO: 214820 - DNA, 25 bp, Homo sapien
gggaacaggtcgctgtaccaggcac

SEQ ID NO: 214821 - DNA, 25 bp, Homo sapien
aaattgctgtgtgcagcatcccgtc

SEQ ID NO: 214822 - DNA, 25 bp, Homo sapien
ctgctggcgagctcgaaattgctgt

SEQ ID NO: 214823 - DNA, 25 bp, Homo sapien
tccctctgccgggtgtctggtgcca

SEQ ID NO: 214824 - DNA, 25 bp, Homo sapien
acccaagcggagtcctgacgacctg

SEQ ID NO: 214825 - DNA, 25 bp, Homo sapien
ctgacgacctgcgtcagaagtagcc

SEQ ID NO: 214826 - DNA, 25 bp, Homo sapien
gaaaggaatccacgtcccgagcaga

SEQ ID NO: 214827 - DNA, 25 bp, Homo sapien
acgtcccgagcagagaggcagcgtt

SEQ ID NO: 214828 - DNA, 25 bp, Homo sapien
ggagaatccttgctgggccctcgcc

SEQ ID NO: 214829 - DNA, 25 bp, Homo sapien
cacagaagccgcaggagacgcaggc

SEQ ID NO: 214830 - DNA, 25 bp, Homo sapien
gggtgacacccaagcggagtcctga

SEQ ID NO: 214831 - DNA, 25 bp, Homo sapien
cgaccatcagcatccaggagcatat

SEQ ID NO: 214832 - DNA, 25 bp, Homo sapien
ggagacaccagttgctgccggccgc

SEQ ID NO: 214833 - DNA, 25 bp, Homo sapien
gagtcggacgactgcagtaagtttc

SEQ ID NO: 214834 - DNA, 25 bp, Homo sapien
acgccgacggctacgagtcggacga

SEQ ID NO: 214835 - DNA, 25 bp, Homo sapien
ctgcagtaagtttcccacgcgccga

SEQ ID NO: 214836 - DNA, 25 bp, Homo sapien
gtcccatcaagcagatctccgacta

SEQ ID NO: 214837 - DNA, 25 bp, Homo sapien
gggagaaggcgaccatcagcatcca

SEQ ID NO: 214838 - DNA, 25 bp, Homo sapien
acgacgaggatgtggaccagctctt

SEQ ID NO: 214839 - DNA, 25 bp, Homo sapien
tcctgacctctagtggcgagcgcgg

SEQ ID NO: 214840 - DNA, 25 bp, Homo sapien
tcacctcctgacctctagtggcgag

SEQ ID NO: 214841 - DNA, 25 bp, Homo sapien
cgtgcatgccgagcccgttgttcct

SEQ ID NO: 214842 - DNA, 25 bp, Homo sapien
gccgagcccgttgttccttcgcaaa

SEQ ID NO: 214843 - DNA, 25 bp, Homo sapien
gaacctcccgatgcatggactctgg

SEQ ID NO: 214844 - DNA, 25 bp, Homo sapien
tgcatggactctggctgtcgtcgac

SEQ ID NO: 214845 - DNA, 25 bp, Homo sapien
tgtcgtcgacgcagactctcgtgca

SEQ ID NO: 214846 - DNA, 25 bp, Homo sapien
cgcagactctcgtgcactgcttaac

SEQ ID NO: 214847 - DNA, 25 bp, Homo sapien
ctgaccctgccattcagcggggctg

SEQ ID NO: 214848 - DNA, 25 bp, Homo sapien
tcactagtaaggcagtcgggcccct

SEQ ID NO: 214849 - DNA, 25 bp, Homo sapien
ggtccagagagagcctcctaggccc

SEQ ID NO: 214850 - DNA, 25 bp, Homo sapien
ccacctggcattcagcgcgctcccg

SEQ ID NO: 214851 - DNA, 25 bp, Homo sapien
aaggtccagagagagcctcctaggc

SEQ ID NO: 214852 - DNA, 25 bp, Homo sapien
cagaaggtccagagagagcctccta

SEQ ID NO: 214853 - DNA, 25 bp, Homo sapien
ccagaaggtccagagagagcctcct

SEQ ID NO: 214854 - DNA, 25 bp, Homo sapien
ggcgatgctccccgggtaggacaaa

SEQ ID NO: 214855 - DNA, 25 bp, Homo sapien
caccctgtcggtattcggcatgcag

SEQ ID NO: 214856 - DNA, 25 bp, Homo sapien
cgcgctacagcctgagaggtgacgc

SEQ ID NO: 214857 - DNA, 25 bp, Homo sapien
ctaacctcaatcctgcgagggaggg

SEQ ID NO: 214858 - DNA, 25 bp, Homo sapien
cagtacctggggcagatccaacaca

SEQ ID NO: 214859 - DNA, 25 bp, Homo sapien
actggcgcgggcaacacacacagca

SEQ ID NO: 214860 - DNA, 25 bp, Homo sapien
cgcttcgcagcgttttcaaaaactg

SEQ ID NO: 214861 - DNA, 25 bp, Homo sapien
tcgggagttcgagtataagttctta

SEQ ID NO: 214862 - DNA, 25 bp, Homo sapien
ctcgccttacagacgccgaaacgga

SEQ ID NO: 214863 - DNA, 25 bp, Homo sapien
gggatcacgcccatcggactagcca

SEQ ID NO: 214864 - DNA, 25 bp, Homo sapien
ctacgacttcaaggcaggcttctga

SEQ ID NO: 214865 - DNA, 25 bp, Homo sapien
acagttcttggcagcctcttctgga

SEQ ID NO: 214866 - DNA, 25 bp, Homo sapien
cgcaggtcgactggaacagttcttg

SEQ ID NO: 214867 - DNA, 25 bp, Homo sapien
cgcaagacttgcagaactcgggccc

SEQ ID NO: 214868 - DNA, 25 bp, Homo sapien
cgctgctcttgctgctctctgtgag

SEQ ID NO: 214869 - DNA, 25 bp, Homo sapien
gagaaccctgcgctcagctgtgcta

SEQ ID NO: 214870 - DNA, 25 bp, Homo sapien
tagccaaggaggagccttcgcactc

SEQ ID NO: 214871 - DNA, 25 bp, Homo sapien
cggcttgcaattcgctgtgaccttt

SEQ ID NO: 214872 - DNA, 25 bp, Homo sapien
gtcccgcgggtctggagatcttcaa

SEQ ID NO: 214873 - DNA, 25 bp, Homo sapien
acctttccaggaagtgttgcacacg

SEQ ID NO: 214874 - DNA, 25 bp, Homo sapien
ccggatgttttttgtggcggcttgc

SEQ ID NO: 214875 - DNA, 25 bp, Homo sapien
ctgaccaggagctgtccggatgttt

SEQ ID NO: 214876 - DNA, 25 bp, Homo sapien
ataggccgccactgaacggctcagc

SEQ ID NO: 214877 - DNA, 25 bp, Homo sapien
atctcgccctctccgatttcaggag

SEQ ID NO: 214878 - DNA, 25 bp, Homo sapien
cgtgtggcaaacgagctggccgttt

SEQ ID NO: 214879 - DNA, 25 bp, Homo sapien
tcttggttcagtgacgccgctggaa

SEQ ID NO: 214880 - DNA, 25 bp, Homo sapien
aaccatgtttgtggctcgcagcatc

SEQ ID NO: 214881 - DNA, 25 bp, Homo sapien
gcggcggaccacaaggatctcatcc

SEQ ID NO: 214882 - DNA, 25 bp, Homo sapien
gatctcatccacgatgtctctttcg

SEQ ID NO: 214883 - DNA, 25 bp, Homo sapien
gtctctttcgacttccacgggcggc

SEQ ID NO: 214884 - DNA, 25 bp, Homo sapien
tccagcgatcagagcgttaaggtgc

SEQ ID NO: 214885 - DNA, 25 bp, Homo sapien
gttcacccgacgacctgcagtggga

SEQ ID NO: 214886 - DNA, 25 bp, Homo sapien
ggatggcaacctgctccagcgatca

SEQ ID NO: 214887 - DNA, 25 bp, Homo sapien
catgtcttcccgctgtccaatcaaa

SEQ ID NO: 214888 - DNA, 25 bp, Homo sapien
ctccgcctggttgggattaattgca

SEQ ID NO: 214889 - DNA, 25 bp, Homo sapien
cgcatgcacctttggcctacgtttc

SEQ ID NO: 214890 - DNA, 25 bp, Homo sapien
gcacactgccctccgaagtcgggga

SEQ ID NO: 214891 - DNA, 25 bp, Homo sapien
ctgggacacctcttcagtccgtgga

SEQ ID NO: 214892 - DNA, 25 bp, Homo sapien
cctggtgccgcgaacagacgtaaac

SEQ ID NO: 214893 - DNA, 25 bp, Homo sapien
ttcaaatccaggaacgcgctgtccc

SEQ ID NO: 214894 - DNA, 25 bp, Homo sapien
attgcacgcctctgtgtcatcgggc

SEQ ID NO: 214895 - DNA, 25 bp, Homo sapien
cagggaaacctagtcagccgtgctc

SEQ ID NO: 214896 - DNA, 25 bp, Homo sapien
tccgcactttcggtgccagaaaatg

SEQ ID NO: 214897 - DNA, 25 bp, Homo sapien
cgccggcctaggagaaatccggatc

SEQ ID NO: 214898 - DNA, 25 bp, Homo sapien
acctcaggaggaaacgtctggcttg

SEQ ID NO: 214899 - DNA, 25 bp, Homo sapien
ctcgtcttgcttttcaggggttgga

SEQ ID NO: 214900 - DNA, 25 bp, Homo sapien
agcgagcccacttccgatgcacaga

SEQ ID NO: 214901 - DNA, 25 bp, Homo sapien
tgtgaataccagatcgccgggcctg

SEQ ID NO: 214902 - DNA, 25 bp, Homo sapien
aatccggatcgagacaactgctgtg

SEQ ID NO: 214903 - DNA, 25 bp, Homo sapien
ttgggaactggacgtccgcgagcct

SEQ ID NO: 214904 - DNA, 25 bp, Homo sapien
agactgaattctgcaccgcccggag

SEQ ID NO: 214905 - DNA, 25 bp, Homo sapien
ccgttttctgtttcctggtgccctg

SEQ ID NO: 214906 - DNA, 25 bp, Homo sapien
gacgctttgggaactggacgtccgc

SEQ ID NO: 214907 - DNA, 25 bp, Homo sapien
cttctggcccaagttcaccgctgcg

SEQ ID NO: 214908 - DNA, 25 bp, Homo sapien
tgaggtcctcagctcttaaagaacc

SEQ ID NO: 214909 - DNA, 25 bp, Homo sapien
attagcaggcgagtgcgttggccct

SEQ ID NO: 214910 - DNA, 25 bp, Homo sapien
tcccgcggttgcaagactgaattct

SEQ ID NO: 214911 - DNA, 25 bp, Homo sapien
tgtggaaactgagtcccgtgcggct

SEQ ID NO: 214912 - DNA, 25 bp, Homo sapien
tgtgcgtggaaactgagtcccgtgt

SEQ ID NO: 214913 - DNA, 25 bp, Homo sapien
ccctgtgcgtggaaactgagtcccg

SEQ ID NO: 214914 - DNA, 25 bp, Homo sapien
tggaaactgagtcccgtgcggctct

SEQ ID NO: 214915 - DNA, 25 bp, Homo sapien
cctgtgcgtggaaactgagtcccgt

SEQ ID NO: 214916 - DNA, 25 bp, Homo sapien
gctctgtgcgtggaaactgagtccc

SEQ ID NO: 214917 - DNA, 25 bp, Homo sapien
gtggaaactgagtcccgtgtggctc

SEQ ID NO: 214918 - DNA, 25 bp, Homo sapien
ctctgtgcgtggaaactgagtcccg

SEQ ID NO: 214919 - DNA, 25 bp, Homo sapien
tgcaggtgcgaccctgcaggatgct

SEQ ID NO: 214920 - DNA, 25 bp, Homo sapien
atggaagtgacctgagcctcgcccg

SEQ ID NO: 214921 - DNA, 25 bp, Homo sapien
aggtgccacacccaggtaccgcccg

SEQ ID NO: 214922 - DNA, 25 bp, Homo sapien
cccagcagagcgatggacttggaca

SEQ ID NO: 214923 - DNA, 25 bp, Homo sapien
agcgatggacttggacaggctaaga

SEQ ID NO: 214924 - DNA, 25 bp, Homo sapien
ttggacaggctaagatggaagtgac

SEQ ID NO: 214925 - DNA, 25 bp, Homo sapien
gccggcccagcagagcgatggactt

SEQ ID NO: 214926 - DNA, 25 bp, Homo sapien
ctaagatggaagtgacctgagcctc

SEQ ID NO: 214927 - DNA, 25 bp, Homo sapien
cgccgtggacactggagaatcctcc

SEQ ID NO: 214928 - DNA, 25 bp, Homo sapien
cctgccgtggacactggagaatcct

SEQ ID NO: 214929 - DNA, 25 bp, Homo sapien
ttcccaccgtggacactggagaatc

SEQ ID NO: 214930 - DNA, 25 bp, Homo sapien
tcctgccgtggacactggagaatcc

SEQ ID NO: 214931 - DNA, 25 bp, Homo sapien
atcccgccgtggacactggagaatc

SEQ ID NO: 214932 - DNA, 25 bp, Homo sapien
ccgtggacaccggagaatccttctc

SEQ ID NO: 214933 - DNA, 25 bp, Homo sapien
cccgccgtggacactggagaatcct

SEQ ID NO: 214934 - DNA, 25 bp, Homo sapien
cccgctgtggatactggagaatcct

SEQ ID NO: 214935 - DNA, 25 bp, Homo sapien
gtatacgtttgccactgattccagg

SEQ ID NO: 214936 - DNA, 25 bp, Homo sapien
ccacactctgggctgaaaagggtac

SEQ ID NO: 214937 - DNA, 25 bp, Homo sapien
tatcttaggaaagggccgtgttgga

SEQ ID NO: 214938 - DNA, 25 bp, Homo sapien
cgagcagctggaccgccgtatacgt

SEQ ID NO: 214939 - DNA, 25 bp, Homo sapien
ccgcagatggacctggcggcgttcc

SEQ ID NO: 214940 - DNA, 25 bp, Homo sapien
tacgttttcaggaaccgctcagccc

SEQ ID NO: 214941 - DNA, 25 bp, Homo sapien
ggggacagtcactacgttttcagga

SEQ ID NO: 214942 - DNA, 25 bp, Homo sapien
tcggaggctcagtgatggcccagcc

SEQ ID NO: 214943 - DNA, 25 bp, Homo sapien
cggcgcttcggaaacctgaaccaga

SEQ ID NO: 214944 - DNA, 25 bp, Homo sapien
tgtgcttcactacccaacgcgtggg

SEQ ID NO: 214945 - DNA, 25 bp, Homo sapien
cctgacatgggctcacttcgcatta

SEQ ID NO: 214946 - DNA, 25 bp, Homo sapien
gtgactctcgcacctccggaagtga

SEQ ID NO: 214947 - DNA, 25 bp, Homo sapien
gcccgctcagtgaagcttctgcatg

SEQ ID NO: 214948 - DNA, 25 bp, Homo sapien
gtcgtacactgccacagcccgaaga

SEQ ID NO: 214949 - DNA, 25 bp, Homo sapien
ggtctattgccttgtgtcctcagtc

SEQ ID NO: 214950 - DNA, 25 bp, Homo sapien
agaagtcccttctcgcctctgtgcg

SEQ ID NO: 214951 - DNA, 25 bp, Homo sapien
gtaccatggcgtccgcgcttaccat

SEQ ID NO: 214952 - DNA, 25 bp, Homo sapien
tcccttctcagcctagacggagctg

SEQ ID NO: 214953 - DNA, 25 bp, Homo sapien
ctctgctcggatggaagactcgtga

SEQ ID NO: 214954 - DNA, 25 bp, Homo sapien
gaagactcgtgaagggacctgcccg

SEQ ID NO: 214955 - DNA, 25 bp, Homo sapien
agtgcattcgctcagcggcagattc

SEQ ID NO: 214956 - DNA, 25 bp, Homo sapien
cagtggctcagctcccaagccgagg

SEQ ID NO: 214957 - DNA, 25 bp, Homo sapien
ctggttgtcgccagcgtacccagga

SEQ ID NO: 214958 - DNA, 25 bp, Homo sapien
aggcgcgcctcccactttacagaag

SEQ ID NO: 214959 - DNA, 25 bp, Homo sapien
tccgcggaagaatggtacaagtcca

SEQ ID NO: 214960 - DNA, 25 bp, Homo sapien
tcctttcttctgtagctcgcgttga

SEQ ID NO: 214961 - DNA, 25 bp, Homo sapien
ggcgcgcaccaacgagtacaagatc

SEQ ID NO: 214962 - DNA, 25 bp, Homo sapien
accgcttcgccgtgttcatcgagaa

SEQ ID NO: 214963 - DNA, 25 bp, Homo sapien
gtgactgtggctaaaccagacctga

SEQ ID NO: 214964 - DNA, 25 bp, Homo sapien
cctgacctcggctctgagggagatc

SEQ ID NO: 214965 - DNA, 25 bp, Homo sapien
ctaagaacctgcagtccgcggaaga

SEQ ID NO: 214966 - DNA, 25 bp, Homo sapien
agtatgagtccctggccgctaagaa

SEQ ID NO: 214967 - DNA, 25 bp, Homo sapien
tgaggccggtttctgcggcctcagc

SEQ ID NO: 214968 - DNA, 25 bp, Homo sapien
ctggtgcagccttggttctggtgga

SEQ ID NO: 214969 - DNA, 25 bp, Homo sapien
tgcagccttggttctggtggagcgc

SEQ ID NO: 214970 - DNA, 25 bp, Homo sapien
tgtcgggacgggaatgcttcccgct

SEQ ID NO: 214971 - DNA, 25 bp, Homo sapien
tcgggacgggaatgcttcccgctga

SEQ ID NO: 214972 - DNA, 25 bp, Homo sapien
ccgctgaggccggtttctgcggcct

SEQ ID NO: 214973 - DNA, 25 bp, Homo sapien
cccggcaggcgatgcggaggcagcc

SEQ ID NO: 214974 - DNA, 25 bp, Homo sapien
gacgggaatgcttcccgctgaggcc

SEQ ID NO: 214975 - DNA, 25 bp, Homo sapien
gccacaactttctatctccttgaga

SEQ ID NO: 214976 - DNA, 25 bp, Homo sapien
gcttccgctgcatgtggaagtgagc

SEQ ID NO: 214977 - DNA, 25 bp, Homo sapien
ctatctccttgagatcctgagaata

SEQ ID NO: 214978 - DNA, 25 bp, Homo sapien
cccgcgaggaggagcaccggtaaat

SEQ ID NO: 214979 - DNA, 25 bp, Homo sapien
gcaaccatccaaccattcaagagtg

SEQ ID NO: 214980 - DNA, 25 bp, Homo sapien
taaatgcaaaatcgcgcttccgctg

SEQ ID NO: 214981 - DNA, 25 bp, Homo sapien
gcaccggtaaatagccacaactttc

SEQ ID NO: 214982 - DNA, 25 bp, Homo sapien
gctgacgcggttctctggccgctgt

SEQ ID NO: 214983 - DNA, 25 bp, Homo sapien
catacacatgttcctcctggcgcgg

SEQ ID NO: 214984 - DNA, 25 bp, Homo sapien
tcaggggccatcatcgccggcatct

SEQ ID NO: 214985 - DNA, 25 bp, Homo sapien
gctgcggcattgtcttcatcctgta

SEQ ID NO: 214986 - DNA, 25 bp, Homo sapien
accacatcatgacggcgaggcgctc

SEQ ID NO: 214987 - DNA, 25 bp, Homo sapien
gcgcggactcacgtcaagcggatcg

SEQ ID NO: 214988 - DNA, 25 bp, Homo sapien
gttcctcctggtgtctctgtacata

SEQ ID NO: 214989 - DNA, 25 bp, Homo sapien
gttcttcgctatgctgttcctcctg

SEQ ID NO: 214990 - DNA, 25 bp, Homo sapien
cagaatccacctacgtcatcctgtg

SEQ ID NO: 214991 - DNA, 25 bp, Homo sapien
tctgtgtgcgatcagctggagtcca

SEQ ID NO: 214992 - DNA, 25 bp, Homo sapien
tgagacacagtcacccgcccgatgg

SEQ ID NO: 214993 - DNA, 25 bp, Homo sapien
ggagatgcatccaaaagacaaccga

SEQ ID NO: 214994 - DNA, 25 bp, Homo sapien
cggaacactgggacactctcatatt

SEQ ID NO: 214995 - DNA, 25 bp, Homo sapien
aaagggacttctccatgcggcgctc

SEQ ID NO: 214996 - DNA, 25 bp, Homo sapien
gcatcgccgcaggacgcataacaga

SEQ ID NO: 214997 - DNA, 25 bp, Homo sapien
gcctcgctgagacgcggattttaaa

SEQ ID NO: 214998 - DNA, 25 bp, Homo sapien
cgggcaaccgcacaagcaagaatgc

SEQ ID NO: 214999 - DNA, 25 bp, Homo sapien
cgttgggcgccagtgcttgcaggac

SEQ ID NO: 215000 - DNA, 25 bp, Homo sapien
tcgctgtcctccgagatgtcctcgt

SEQ ID NO: 215001 - DNA, 25 bp, Homo sapien
gtgtcgctgtcctccgagatgtcct

SEQ ID NO: 215002 - DNA, 25 bp, Homo sapien
gctgcacctcctcggcagaggcttt

SEQ ID NO: 215003 - DNA, 25 bp, Homo sapien
gcataacaaacagcagggcgtctgg

SEQ ID NO: 215004 - DNA, 25 bp, Homo sapien
tctgcgagccggcataacaaacagc

SEQ ID NO: 215005 - DNA, 25 bp, Homo sapien
ccggcataacaaacagcagggcgtc

SEQ ID NO: 215006 - DNA, 25 bp, Homo sapien
cgtctgggcatctgacgggtgttct

SEQ ID NO: 215007 - DNA, 25 bp, Homo sapien
tcgcggattttggattagataatag

SEQ ID NO: 215008 - DNA, 25 bp, Homo sapien
agcgcacagcgtttccgcaggaatc

SEQ ID NO: 215009 - DNA, 25 bp, Homo sapien
ggattagataatagatttgggatcg

SEQ ID NO: 215010 - DNA, 25 bp, Homo sapien
tggattagataatagatttgggatc

SEQ ID NO: 215011 - DNA, 25 bp, Homo sapien
cggattttggattagataatagatt

SEQ ID NO: 215012 - DNA, 25 bp, Homo sapien
gcggattttggattagataatagat

SEQ ID NO: 215013 - DNA, 25 bp, Homo sapien
cgcggattttggattagataataga

SEQ ID NO: 215014 - DNA, 25 bp, Homo sapien
atcgcggattttggattagataata

SEQ ID NO: 215015 - DNA, 25 bp, Homo sapien
tctaagcagttacgtgaaaatggat

SEQ ID NO: 215016 - DNA, 25 bp, Homo sapien
atgtctgctctaagcagttacgtga

SEQ ID NO: 215017 - DNA, 25 bp, Homo sapien
gagatatgtctgctctaagcagtta

SEQ ID NO: 215018 - DNA, 25 bp, Homo sapien
aaaagagatatgtctgctctaagca

SEQ ID NO: 215019 - DNA, 25 bp, Homo sapien
agattaaaaagagatatgtctgctc

SEQ ID NO: 215020 - DNA, 25 bp, Homo sapien
agaaacagaggaactcgagcatcca

SEQ ID NO: 215021 - DNA, 25 bp, Homo sapien
agagaaacagaggaactcgagcatc

SEQ ID NO: 215022 - DNA, 25 bp, Homo sapien
tgctctaagcagttacgtgaaaatg

SEQ ID NO: 215023 - DNA, 25 bp, Homo sapien
ccgccggcatatttattacaattta

SEQ ID NO: 215024 - DNA, 25 bp, Homo sapien
gccggcatatttattacaatttatt

SEQ ID NO: 215025 - DNA, 25 bp, Homo sapien
ctgaacaatcaagtttcaggcaaat

SEQ ID NO: 215026 - DNA, 25 bp, Homo sapien
atggataaatacaaaagcaagcaca

SEQ ID NO: 215027 - DNA, 25 bp, Homo sapien
gcacaagagtattcagtagagaatt

SEQ ID NO: 215028 - DNA, 25 bp, Homo sapien
tgagcctgaacaatcaagtttcagg

SEQ ID NO: 215029 - DNA, 25 bp, Homo sapien
accatccgccggcatatttattaca

SEQ ID NO: 215030 - DNA, 25 bp, Homo sapien
agcaagcacaagagtattcagtaga

SEQ ID NO: 215031 - DNA, 25 bp, Homo sapien
tccaggctgctggtctcggcacagt

SEQ ID NO: 215032 - DNA, 25 bp, Homo sapien
cagacaggcgggagccaaccttcac

SEQ ID NO: 215033 - DNA, 25 bp, Homo sapien
ccagacaggcgggagccaaccttca

SEQ ID NO: 215034 - DNA, 25 bp, Homo sapien
accacgtccaggtggtccgcgccca

SEQ ID NO: 215035 - DNA, 25 bp, Homo sapien
tctcggcacagttgtgcagggccgt

SEQ ID NO: 215036 - DNA, 25 bp, Homo sapien
tgctggtctcggcacagttgtgcag

SEQ ID NO: 215037 - DNA, 25 bp, Homo sapien
cggcacagttgtgcagggccgtgtt

SEQ ID NO: 215038 - DNA, 25 bp, Homo sapien
aggctgctggtctcggcacagttgt

SEQ ID NO: 215039 - DNA, 25 bp, Homo sapien
ggctcactctacttaccagaaaaat

SEQ ID NO: 215040 - DNA, 25 bp, Homo sapien
gctcactctacttaccagaaaaata

SEQ ID NO: 215041 - DNA, 25 bp, Homo sapien
tggctcactctacttaccagaaaaa

SEQ ID NO: 215042 - DNA, 25 bp, Homo sapien
catggctcactctacttaccagaaa

SEQ ID NO: 215043 - DNA, 25 bp, Homo sapien
gacatggctcactctacttaccaga

SEQ ID NO: 215044 - DNA, 25 bp, Homo sapien
aagacatggctcactctacttacca

SEQ ID NO: 215045 - DNA, 25 bp, Homo sapien
ctggacaggtggtcacgccccagga

SEQ ID NO: 215046 - DNA, 25 bp, Homo sapien
cggggcctggacaggtggtcacgcc

SEQ ID NO: 215047 - DNA, 25 bp, Homo sapien
agctacgtccctgacgccgcttggg

SEQ ID NO: 215048 - DNA, 25 bp, Homo sapien
aaatgtggtttagcggccctcacct

SEQ ID NO: 215049 - DNA, 25 bp, Homo sapien
gggaaatgtggtttagcggccctca

SEQ ID NO: 215050 - DNA, 25 bp, Homo sapien
gcgcgggggctctaaatacctcctc

SEQ ID NO: 215051 - DNA, 25 bp, Homo sapien
gacgagggccagctacgtccctgac

SEQ ID NO: 215052 - DNA, 25 bp, Homo sapien
cccggcagacgagggccagctacgt

SEQ ID NO: 215053 - DNA, 25 bp, Homo sapien
cacacgcctaggcagccggggcaga

SEQ ID NO: 215054 - DNA, 25 bp, Homo sapien
ctccatggtcgggagagacaccagg

SEQ ID NO: 215055 - DNA, 25 bp, Homo sapien
gccgcgctctcatgagtcgctgcta

SEQ ID NO: 215056 - DNA, 25 bp, Homo sapien
ataggcgaccggtccgtgtcacttc

SEQ ID NO: 215057 - DNA, 25 bp, Homo sapien
ccgctttgctgtggtcaggataggc

SEQ ID NO: 215058 - DNA, 25 bp, Homo sapien
tcgctgctaccgcagctcgaggtgg

SEQ ID NO: 215059 - DNA, 25 bp, Homo sapien
aggtgcttccctgcccggagagcag

SEQ ID NO: 215060 - DNA, 25 bp, Homo sapien
ccctggaacctcaggtcggacttgg

SEQ ID NO: 215061 - DNA, 25 bp, Homo sapien
tgctaccggcgtcggccgatacaca

SEQ ID NO: 215062 - DNA, 25 bp, Homo sapien
gctctcatgagtcgctgctaccgca

SEQ ID NO: 215063 - DNA, 25 bp, Homo sapien
agcacagcaggaccgccgtcccacc

SEQ ID NO: 215064 - DNA, 25 bp, Homo sapien
cattggaggactcctcggctacgtc

SEQ ID NO: 215065 - DNA, 25 bp, Homo sapien
attggaggactcctcggctacgtcc

SEQ ID NO: 215066 - DNA, 25 bp, Homo sapien
tggaggactcctcggctacgtcctg

SEQ ID NO: 215067 - DNA, 25 bp, Homo sapien
aggactcctcggctacgtcctggac

SEQ ID NO: 215068 - DNA, 25 bp, Homo sapien
ggactcctcggctacgtcctggact

SEQ ID NO: 215069 - DNA, 25 bp, Homo sapien
acggcgctctctggactacccctgc

SEQ ID NO: 215070 - DNA, 25 bp, Homo sapien
ctacccctgcgccaccgcgtcctgc

SEQ ID NO: 215071 - DNA, 25 bp, Homo sapien
tccaggaggaacaacggcgtcaagc

SEQ ID NO: 215072 - DNA, 25 bp, Homo sapien
ggaggaaagtctttggcctgatgga

SEQ ID NO: 215073 - DNA, 25 bp, Homo sapien
ttggaggaaagtctttggcctgatg

SEQ ID NO: 215074 - DNA, 25 bp, Homo sapien
gtttggaggaaagtctttggcctga

SEQ ID NO: 215075 - DNA, 25 bp, Homo sapien
agtttggaggaaagtctttggcctg

SEQ ID NO: 215076 - DNA, 25 bp, Homo sapien
ggcctgagatcaccccaagctctgg

SEQ ID NO: 215077 - DNA, 25 bp, Homo sapien
ccaggaggaacaacggcgtcaagct

SEQ ID NO: 215078 - DNA, 25 bp, Homo sapien
gatcaccccaagctctgggtgcctt

SEQ ID NO: 215079 - DNA, 25 bp, Homo sapien
gcctcatcctggcaactatacatgg

SEQ ID NO: 215080 - DNA, 25 bp, Homo sapien
tatacatggcccagaggtcgcgagc

SEQ ID NO: 215081 - DNA, 25 bp, Homo sapien
gggaatcgacgctcagcgcggccct

SEQ ID NO: 215082 - DNA, 25 bp, Homo sapien
gctatgtcaagcaggccgtgttgca

SEQ ID NO: 215083 - DNA, 25 bp, Homo sapien
agctgcgcgtgagctgctgctgtaa

SEQ ID NO: 215084 - DNA, 25 bp, Homo sapien
ctgctgctgtaacgctctaacgtta

SEQ ID NO: 215085 - DNA, 25 bp, Homo sapien
gctcagaatttctcccgacagaggc

SEQ ID NO: 215086 - DNA, 25 bp, Homo sapien
acgttagagcagctaacggctctgc

SEQ ID NO: 215087 - DNA, 25 bp, Homo sapien
gtgcgcctacgtccgagcaaggacg

SEQ ID NO: 215088 - DNA, 25 bp, Homo sapien
ggcacggccccactggtctcggcac

SEQ ID NO: 215089 - DNA, 25 bp, Homo sapien
cctacgtccgagcaaggacgtcacg

SEQ ID NO: 215090 - DNA, 25 bp, Homo sapien
agcgggtgcgcctacgtccgagcaa

SEQ ID NO: 215091 - DNA, 25 bp, Homo sapien
gcctacgtccgagcaaggacgtcac

SEQ ID NO: 215092 - DNA, 25 bp, Homo sapien
cgcctacgtccgagcaaggacgtca

SEQ ID NO: 215093 - DNA, 25 bp, Homo sapien
ggtgcgcctacgtccgagcaaggac

SEQ ID NO: 215094 - DNA, 25 bp, Homo sapien
gcgcctacgtccgagcaaggacgtc

SEQ ID NO: 215095 - DNA, 25 bp, Homo sapien
atccgcgggagcaaaatagtggaaa

SEQ ID NO: 215096 - DNA, 25 bp, Homo sapien
gcatccgcgggagcaaaatagtgga

SEQ ID NO: 215097 - DNA, 25 bp, Homo sapien
ttgcatccgcgggagcaaaatagtg

SEQ ID NO: 215098 - DNA, 25 bp, Homo sapien
aaaaagttgcatccgcgggagcaaa

SEQ ID NO: 215099 - DNA, 25 bp, Homo sapien
gcaaaaagttgcatccgcgggagca

SEQ ID NO: 215100 - DNA, 25 bp, Homo sapien
agcaaaaagttgcatccgcgggagc

SEQ ID NO: 215101 - DNA, 25 bp, Homo sapien
cggcagcaaaaagttgcatccgcgg

SEQ ID NO: 215102 - DNA, 25 bp, Homo sapien
ggcggcagcaaaaagttgcatccgc

SEQ ID NO: 215103 - DNA, 25 bp, Homo sapien
ctgcgcttcgcccagcacggcgtgc

SEQ ID NO: 215104 - DNA, 25 bp, Homo sapien
gagcatcgccgagtacatcgccctt

SEQ ID NO: 215105 - DNA, 25 bp, Homo sapien
gcaggcttgcgaccactgggccctg

SEQ ID NO: 215106 - DNA, 25 bp, Homo sapien
accactgggccctgtacagctgcgg

SEQ ID NO: 215107 - DNA, 25 bp, Homo sapien
ccctgtacagctgcggcgacgaggc

SEQ ID NO: 215108 - DNA, 25 bp, Homo sapien
tacagctgcggcgacgaggctttgc

SEQ ID NO: 215109 - DNA, 25 bp, Homo sapien
aactgaggtcccactgcctgactta

SEQ ID NO: 215110 - DNA, 25 bp, Homo sapien
aggaaaccgccctggctgcgcttcg

SEQ ID NO: 215111 - DNA, 25 bp, Homo sapien
agctgccggcaaggttctcgccttg

SEQ ID NO: 215112 - DNA, 25 bp, Homo sapien
ccattttgtcccgtcgctgctgggg

SEQ ID NO: 215113 - DNA, 25 bp, Homo sapien
agctggtccacgcaggacagcctca

SEQ ID NO: 215114 - DNA, 25 bp, Homo sapien
cgctccgctcagaggcgctgtagac

SEQ ID NO: 215115 - DNA, 25 bp, Homo sapien
gtcgatgcccgatggagacttagca

SEQ ID NO: 215116 - DNA, 25 bp, Homo sapien
tcctgttcaaacaaacggagaccgc

SEQ ID NO: 215117 - DNA, 25 bp, Homo sapien
agggactaatatgtccgccttcctg

SEQ ID NO: 215118 - DNA, 25 bp, Homo sapien
tggagactccctccgggcaacaagg

SEQ ID NO: 215119 - DNA, 25 bp, Homo sapien
tagagcctgagggaccgccaacgct

SEQ ID NO: 215120 - DNA, 25 bp, Homo sapien
gttgctctctttcctattccgtttc

SEQ ID NO: 215121 - DNA, 25 bp, Homo sapien
tgcaatcacgcttgacggcgcgagg

SEQ ID NO: 215122 - DNA, 25 bp, Homo sapien
cctccatgtggcgaaaatgcaatca

SEQ ID NO: 215123 - DNA, 25 bp, Homo sapien
agagttgtcgtgaaatgctcctccc

SEQ ID NO: 215124 - DNA, 25 bp, Homo sapien
ccgtaaatggcctactagagttgtc

SEQ ID NO: 215125 - DNA, 25 bp, Homo sapien
ttcgctcctcctactgccgtaaatg

SEQ ID NO: 215126 - DNA, 25 bp, Homo sapien
cgctcggttttgaaagttgctctct

SEQ ID NO: 215127 - DNA, 25 bp, Homo sapien
cttttccggagggatgggaagctca

SEQ ID NO: 215128 - DNA, 25 bp, Homo sapien
accgggctctactcgctgcctttgt

SEQ ID NO: 215129 - DNA, 25 bp, Homo sapien
cagtgccaacctgggagccgtgcct

SEQ ID NO: 215130 - DNA, 25 bp, Homo sapien
agcgccgcagcggacttttccggag

SEQ ID NO: 215131 - DNA, 25 bp, Homo sapien
gggcagcacctgaggaatccgcctc

SEQ ID NO: 215132 - DNA, 25 bp, Homo sapien
taggggagaaatgcgcgcccaccac

SEQ ID NO: 215133 - DNA, 25 bp, Homo sapien
aggaccgcgcatcgagggctccaca

SEQ ID NO: 215134 - DNA, 25 bp, Homo sapien
agctcgcctgtgaccggcaggagct

SEQ ID NO: 215135 - DNA, 25 bp, Homo sapien
gacgggatcttcacggacagctaca

SEQ ID NO: 215136 - DNA, 25 bp, Homo sapien
cttccagggaggttttgctataatt

SEQ ID NO: 215137 - DNA, 25 bp, Homo sapien
gcctacagcctgtcgacttatatta

SEQ ID NO: 215138 - DNA, 25 bp, Homo sapien
ccagactggcatatgtagggctctc

SEQ ID NO: 215139 - DNA, 25 bp, Homo sapien
ccgctaccggaaacaaatggctgtc

SEQ ID NO: 215140 - DNA, 25 bp, Homo sapien
gggctctccggttactttctctgta

SEQ ID NO: 215141 - DNA, 25 bp, Homo sapien
agccagggagtttgatccgttttga

SEQ ID NO: 215142 - DNA, 25 bp, Homo sapien
tttagcgcaaacacacgaagggtcg

SEQ ID NO: 215143 - DNA, 25 bp, Homo sapien
gccctgctggtctatgggataatca

SEQ ID NO: 215144 - DNA, 25 bp, Homo sapien
gaccggctcactcgactgctgattc

SEQ ID NO: 215145 - DNA, 25 bp, Homo sapien
atcgcgtcaggggagttagctttcc

SEQ ID NO: 215146 - DNA, 25 bp, Homo sapien
tagctttccttcagccgggtctggc

SEQ ID NO: 215147 - DNA, 25 bp, Homo sapien
ggcgccgggtagatgcatatatata

SEQ ID NO: 215148 - DNA, 25 bp, Homo sapien
cggctgtcgccaagtgctgttcaac

SEQ ID NO: 215149 - DNA, 25 bp, Homo sapien
cctgcgcagaatgaccatgtgtagc

SEQ ID NO: 215150 - DNA, 25 bp, Homo sapien
ggttctgcgcgtctacaaacttttg

SEQ ID NO: 215151 - DNA, 25 bp, Homo sapien
ggggcaccgccatcgataacagatc

SEQ ID NO: 215152 - DNA, 25 bp, Homo sapien
gttctccgtgacctacatctgctcg

SEQ ID NO: 215153 - DNA, 25 bp, Homo sapien
tggctgcacgccaagtctctccagg

SEQ ID NO: 215154 - DNA, 25 bp, Homo sapien
agatcctcgcctgcccaaaatagaa

SEQ ID NO: 215155 - DNA, 25 bp, Homo sapien
agctattttcaagttcccgtgtgcc

SEQ ID NO: 215156 - DNA, 25 bp, Homo sapien
cggtccttttccgtagacaggtgtg

SEQ ID NO: 215157 - DNA, 25 bp, Homo sapien
gcgaactattcgtttagtggcctta

SEQ ID NO: 215158 - DNA, 25 bp, Homo sapien
ttctcagcggaggacttttatcacc

SEQ ID NO: 215159 - DNA, 25 bp, Homo sapien
gacacgcgagcacgttagctgccta

SEQ ID NO: 215160 - DNA, 25 bp, Homo sapien
cggctcagctgacgtgcccagaaga

SEQ ID NO: 215161 - DNA, 25 bp, Homo sapien
ttacctgtgaccgtcttgggtgcgc

SEQ ID NO: 215162 - DNA, 25 bp, Homo sapien
cctcgctcgtcagatgggagttacc

SEQ ID NO: 215163 - DNA, 25 bp, Homo sapien
cacatccgggtatcaggagacactc

SEQ ID NO: 215164 - DNA, 25 bp, Homo sapien
aaaggcgagctagtgtccatcctca

SEQ ID NO: 215165 - DNA, 25 bp, Homo sapien
ggacgctcgcgtaccttccttttgc

SEQ ID NO: 215166 - DNA, 25 bp, Homo sapien
tgcctacctcaagcgacggcgtctt

SEQ ID NO: 215167 - DNA, 25 bp, Homo sapien
aaagccgcgtgtgcgcggcctgcta

SEQ ID NO: 215168 - DNA, 25 bp, Homo sapien
ggcgtttccgccatgcgcctgcagt

SEQ ID NO: 215169 - DNA, 25 bp, Homo sapien
ggagtaggcgcttccggccattcat

SEQ ID NO: 215170 - DNA, 25 bp, Homo sapien
cggccattcatactgcagtcggtca

SEQ ID NO: 215171 - DNA, 25 bp, Homo sapien
tcggtcagtgttcggttgaaggatt

SEQ ID NO: 215172 - DNA, 25 bp, Homo sapien
ctctcccatttgcaggaggcgggaa

SEQ ID NO: 215173 - DNA, 25 bp, Homo sapien
gcttccgcctgggtcgctcgcggat

SEQ ID NO: 215174 - DNA, 25 bp, Homo sapien
gattctgtgtgctgtcggacccaga

SEQ ID NO: 215175 - DNA, 25 bp, Homo sapien
gagctcccgggacaacatccgcagg

SEQ ID NO: 215176 - DNA, 25 bp, Homo sapien
agtgaccttgaacgattccgctctg

SEQ ID NO: 215177 - DNA, 25 bp, Homo sapien
tccagaagcgcggttccaagaccgg

SEQ ID NO: 215178 - DNA, 25 bp, Homo sapien
agcccaggataagggataagcccac

SEQ ID NO: 215179 - DNA, 25 bp, Homo sapien
ctcaggtagtagaaggcataagcga

SEQ ID NO: 215180 - DNA, 25 bp, Homo sapien
gctcaccttggcaatgctgctcagg

SEQ ID NO: 215181 - DNA, 25 bp, Homo sapien
cagcgcagaagtcagccgggttcag

SEQ ID NO: 215182 - DNA, 25 bp, Homo sapien
ttctcccagctaggtcgcagtgggc

SEQ ID NO: 215183 - DNA, 25 bp, Homo sapien
gggcttacgacctccgcatcctgga

SEQ ID NO: 215184 - DNA, 25 bp, Homo sapien
tggaagccttcccactctattattg

SEQ ID NO: 215185 - DNA, 25 bp, Homo sapien
ctcctagacactctgagaaggtgcc

SEQ ID NO: 215186 - DNA, 25 bp, Homo sapien
tacccggatgtggagtcgctctcgc

SEQ ID NO: 215187 - DNA, 25 bp, Homo sapien
aaaggccggcagttaagcttgctcc

SEQ ID NO: 215188 - DNA, 25 bp, Homo sapien
cgatgagtaactcccggaataaccg

SEQ ID NO: 215189 - DNA, 25 bp, Homo sapien
gggacaacggcacagctgccaacta

SEQ ID NO: 215190 - DNA, 25 bp, Homo sapien
agacgcttagggatcagttttctcc

SEQ ID NO: 215191 - DNA, 25 bp, Homo sapien
aggctggataaatgggaatcgtctc

SEQ ID NO: 215192 - DNA, 25 bp, Homo sapien
gaagtgaagacacgcccgagctagg

SEQ ID NO: 215193 - DNA, 25 bp, Homo sapien
tgcgtaggaccctaggcatttccta

SEQ ID NO: 215194 - DNA, 25 bp, Homo sapien
gagaatttacttgcgtaggacccta

SEQ ID NO: 215195 - DNA, 25 bp, Homo sapien
tcctacgggaaaagaagtgaagaca

SEQ ID NO: 215196 - DNA, 25 bp, Homo sapien
gaatcgtctctctccagtcgcagca

SEQ ID NO: 215197 - DNA, 25 bp, Homo sapien
ggcgtcttaggccagaacatgagga

SEQ ID NO: 215198 - DNA, 25 bp, Homo sapien
tccagtcgcagcaaagagaatttac

SEQ ID NO: 215199 - DNA, 25 bp, Homo sapien
gacagccctccatacggcagcggag

SEQ ID NO: 215200 - DNA, 25 bp, Homo sapien
gcaacctgtcgagctgggaggactt

SEQ ID NO: 215201 - DNA, 25 bp, Homo sapien
ggacttgctgctgttcactgacctc

SEQ ID NO: 215202 - DNA, 25 bp, Homo sapien
gccggaggagatgtaccagaccctc

SEQ ID NO: 215203 - DNA, 25 bp, Homo sapien
gcggccgctgaacgggacgtaccac

SEQ ID NO: 215204 - DNA, 25 bp, Homo sapien
cactcgggccctgttttcaggactt

SEQ ID NO: 215205 - DNA, 25 bp, Homo sapien
tcaggactttctcgtccgggtgcgc

SEQ ID NO: 215206 - DNA, 25 bp, Homo sapien
ccagcaagctgctgtggtccagccg

SEQ ID NO: 215207 - DNA, 25 bp, Homo sapien
tcgggatttgagagccgcaagcttc

SEQ ID NO: 215208 - DNA, 25 bp, Homo sapien
cgccggcgcggaatttctttatcgg

SEQ ID NO: 215209 - DNA, 25 bp, Homo sapien
cggtcattgggtggcctagataaca

SEQ ID NO: 215210 - DNA, 25 bp, Homo sapien
gcggcgcagcgagtacattaagtca

SEQ ID NO: 215211 - DNA, 25 bp, Homo sapien
cattaagtcacgtaaacagcgcgga

SEQ ID NO: 215212 - DNA, 25 bp, Homo sapien
aatgccaccgcggtgacctttcgtg

SEQ ID NO: 215213 - DNA, 25 bp, Homo sapien
cgccaccacctgacgtttctaaaga

SEQ ID NO: 215214 - DNA, 25 bp, Homo sapien
gccgttttaggatacccagctccca

SEQ ID NO: 215215 - DNA, 25 bp, Homo sapien
tttccgtacatgacgacccgagtta

SEQ ID NO: 215216 - DNA, 25 bp, Homo sapien
acgctttctaggagaccgaccttca

SEQ ID NO: 215217 - DNA, 25 bp, Homo sapien
ttgtcctaaagtctccctcggcagc

SEQ ID NO: 215218 - DNA, 25 bp, Homo sapien
cacgtctgtcggaagaaatcctttc

SEQ ID NO: 215219 - DNA, 25 bp, Homo sapien
ccgctagggaccgtatcagtttgta

SEQ ID NO: 215220 - DNA, 25 bp, Homo sapien
cacgactgatgtggaagcccttttc

SEQ ID NO: 215221 - DNA, 25 bp, Homo sapien
acctgagccgtagcatcccgagata

SEQ ID NO: 215222 - DNA, 25 bp, Homo sapien
ggtcggtctcacacaacttcagggc

SEQ ID NO: 215223 - DNA, 25 bp, Homo sapien
gctccatccagacgccgctgtggcg

SEQ ID NO: 215224 - DNA, 25 bp, Homo sapien
ctgctggaggacctgtccgagagcc

SEQ ID NO: 215225 - DNA, 25 bp, Homo sapien
agtgcgtgaactgcggctccatcca

SEQ ID NO: 215226 - DNA, 25 bp, Homo sapien
actacctgtgcaacgcctgcgggct

SEQ ID NO: 215227 - DNA, 25 bp, Homo sapien
cctgcgggctctacagcaagatgaa

SEQ ID NO: 215228 - DNA, 25 bp, Homo sapien
tacagcaagatgaacggcctcagcc

SEQ ID NO: 215229 - DNA, 25 bp, Homo sapien
tccgagagccgcgagtgcgtgaact

SEQ ID NO: 215230 - DNA, 25 bp, Homo sapien
cagacctgctggaggacctgtccga

SEQ ID NO: 215231 - DNA, 25 bp, Homo sapien
actccactcgtgtctgcttttgtgc

SEQ ID NO: 215232 - DNA, 25 bp, Homo sapien
ctgcgctgacagaacgtgattctcg

SEQ ID NO: 215233 - DNA, 25 bp, Homo sapien
tgcttttgtgcagcggtccagacag

SEQ ID NO: 215234 - DNA, 25 bp, Homo sapien
gggctctacataggcgtcagtctcg

SEQ ID NO: 215235 - DNA, 25 bp, Homo sapien
tattcgggtcaagatgggctctaca

SEQ ID NO: 215236 - DNA, 25 bp, Homo sapien
cccgagaacagcgagctcaagtatt

SEQ ID NO: 215237 - DNA, 25 bp, Homo sapien
ggagagagcaccaatcccgagaaca

SEQ ID NO: 215238 - DNA, 25 bp, Homo sapien
ccagacagtggcgactgcgctgaca

SEQ ID NO: 215239 - DNA, 25 bp, Homo sapien
aaaagcccgtgtgcctctgcatagc

SEQ ID NO: 215240 - DNA, 25 bp, Homo sapien
gtcggtgcttgctgcctgcggctct

SEQ ID NO: 215241 - DNA, 25 bp, Homo sapien
tgtgcctctgcatagcgtcgctaca

SEQ ID NO: 215242 - DNA, 25 bp, Homo sapien
gaagaaaagcccgtgtgcctctgca

SEQ ID NO: 215243 - DNA, 25 bp, Homo sapien
tggccgagctctgggaagaaaagcc

SEQ ID NO: 215244 - DNA, 25 bp, Homo sapien
aagcctctgctccaccgcggcgaga

SEQ ID NO: 215245 - DNA, 25 bp, Homo sapien
tgcctgcggctctcagaagcctctg

SEQ ID NO: 215246 - DNA, 25 bp, Homo sapien
atagcgtcgctacagcgctgactcg

SEQ ID NO: 215247 - DNA, 25 bp, Homo sapien
cggctgcctagacacgaaagggtgc

SEQ ID NO: 215248 - DNA, 25 bp, Homo sapien
cttacctggaactggcaaaacgtgg

SEQ ID NO: 215249 - DNA, 25 bp, Homo sapien
ataaacatcgttagcctccgggccg

SEQ ID NO: 215250 - DNA, 25 bp, Homo sapien
gctccaggcattggaaacgtttccc

SEQ ID NO: 215251 - DNA, 25 bp, Homo sapien
gggccgacacgtggtgcatttttaa

SEQ ID NO: 215252 - DNA, 25 bp, Homo sapien
gcttcgcagcgcacctcatttgtaa

SEQ ID NO: 215253 - DNA, 25 bp, Homo sapien
tccctcggtgtggtatgtctgtata

SEQ ID NO: 215254 - DNA, 25 bp, Homo sapien
tgactcttaatctcccggggcggga

SEQ ID NO: 215255 - DNA, 25 bp, Homo sapien
taactcttcccgtgacaggccctgg

SEQ ID NO: 215256 - DNA, 25 bp, Homo sapien
ctcttcagtgacagccgggacagtt

SEQ ID NO: 215257 - DNA, 25 bp, Homo sapien
gcggcgaacacttagtggctaattc

SEQ ID NO: 215258 - DNA, 25 bp, Homo sapien
cattaacttatctgcagccgcgctg

SEQ ID NO: 215259 - DNA, 25 bp, Homo sapien
tcgtctctgagaacgcgtgcacttt

SEQ ID NO: 215260 - DNA, 25 bp, Homo sapien
ctgcgggtcgtggtaatttacatcc

SEQ ID NO: 215261 - DNA, 25 bp, Homo sapien
cccggctttcatttcgctgtaatta

SEQ ID NO: 215262 - DNA, 25 bp, Homo sapien
gacgcttgtcctctccctgacaggg

SEQ ID NO: 215263 - DNA, 25 bp, Homo sapien
ctaactttaggggtcgtgccagtct

SEQ ID NO: 215264 - DNA, 25 bp, Homo sapien
gagttgagcgttcagggcactcctc

SEQ ID NO: 215265 - DNA, 25 bp, Homo sapien
tcttcgtagagacggccacactggc

SEQ ID NO: 215266 - DNA, 25 bp, Homo sapien
tcgcatggaagttactgcgcgcgtc

SEQ ID NO: 215267 - DNA, 25 bp, Homo sapien
gcgcgtcgtgcgtaatgacgtcagc

SEQ ID NO: 215268 - DNA, 25 bp, Homo sapien
cagcgccggcggagaatttcaaatt

SEQ ID NO: 215269 - DNA, 25 bp, Homo sapien
atttcaaattcgaacggctttggcg

SEQ ID NO: 215270 - DNA, 25 bp, Homo sapien
cgccatgttgctgtacggaaaaacg

SEQ ID NO: 215271 - DNA, 25 bp, Homo sapien
gcgctacctcagtactacttctggg

SEQ ID NO: 215272 - DNA, 25 bp, Homo sapien
ggcggtgagtaaaagcaatctcttt

SEQ ID NO: 215273 - DNA, 25 bp, Homo sapien
ggctttcgcgaatcccgaggcaatc

SEQ ID NO: 215274 - DNA, 25 bp, Homo sapien
gcctcagaaagtgctcgcttccctt

SEQ ID NO: 215275 - DNA, 25 bp, Homo sapien
aagcgagcagccgtcctttcacagc

SEQ ID NO: 215276 - DNA, 25 bp, Homo sapien
ttcccaccgaggatttggcactctg

SEQ ID NO: 215277 - DNA, 25 bp, Homo sapien
cgctcctcagctagggcacgaagtg

SEQ ID NO: 215278 - DNA, 25 bp, Homo sapien
gtcgccagactcttcgggtagctcc

SEQ ID NO: 215279 - DNA, 25 bp, Homo sapien
ggggacgcctcaactcgttcactca

SEQ ID NO: 215280 - DNA, 25 bp, Homo sapien
gttcactcagggaatcctgcccatc

SEQ ID NO: 215281 - DNA, 25 bp, Homo sapien
atgcctttatcagcgtgcaggtgcc

SEQ ID NO: 215282 - DNA, 25 bp, Homo sapien
ttggaggaggacgatgcctttatca

SEQ ID NO: 215283 - DNA, 25 bp, Homo sapien
gcccaactgcagctgctcgacgggt

SEQ ID NO: 215284 - DNA, 25 bp, Homo sapien
cccttgattcctggcggccatgcga

SEQ ID NO: 215285 - DNA, 25 bp, Homo sapien
aggactcggttcagcttgctcgccg

SEQ ID NO: 215286 - DNA, 25 bp, Homo sapien
tctccaggccgacttcgcagaacta

SEQ ID NO: 215287 - DNA, 25 bp, Homo sapien
ggggatccacggtgcctgcccaaat

SEQ ID NO: 215288 - DNA, 25 bp, Homo sapien
gtgaggccgaccagagacctcctca

SEQ ID NO: 215289 - DNA, 25 bp, Homo sapien
caggtacaaaaggtgaggccgacca

SEQ ID NO: 215290 - DNA, 25 bp, Homo sapien
gccaggtagcaggtacaaaaggtga

SEQ ID NO: 215291 - DNA, 25 bp, Homo sapien
ttcgtgaggtaagaagccaggtagc

SEQ ID NO: 215292 - DNA, 25 bp, Homo sapien
ccctcaccttgttcgtgaggtaaga

SEQ ID NO: 215293 - DNA, 25 bp, Homo sapien
tcaaacctcccacgtgcaatcgctg

SEQ ID NO: 215294 - DNA, 25 bp, Homo sapien
ggaagattctccgactcaaacctcc

SEQ ID NO: 215295 - DNA, 25 bp, Homo sapien
tgccacctctctgctctgttcttgt

SEQ ID NO: 215296 - DNA, 25 bp, Homo sapien
agccagctgatgcttgcttctccga

SEQ ID NO: 215297 - DNA, 25 bp, Homo sapien
ggcatcagcagccagtcgcccgtgt

SEQ ID NO: 215298 - DNA, 25 bp, Homo sapien
tgtctctgccttcattcccgaatgg

SEQ ID NO: 215299 - DNA, 25 bp, Homo sapien
acccagcaaggtaagtggcagacga

SEQ ID NO: 215300 - DNA, 25 bp, Homo sapien
tggagtactagccttggtcacacgg

SEQ ID NO: 215301 - DNA, 25 bp, Homo sapien
tcacacgggctggatctctcggaaa

SEQ ID NO: 215302 - DNA, 25 bp, Homo sapien
cggccaattgcaagcgactgtccta

SEQ ID NO: 215303 - DNA, 25 bp, Homo sapien
aggactactatctggagctgtgcga

SEQ ID NO: 215304 - DNA, 25 bp, Homo sapien
aggcgaaccctgtcaactgcgtctt

SEQ ID NO: 215305 - DNA, 25 bp, Homo sapien
aactgcgtcttcttcgatgaggcca

SEQ ID NO: 215306 - DNA, 25 bp, Homo sapien
agtgtctcaattgttggcgcgcccg

SEQ ID NO: 215307 - DNA, 25 bp, Homo sapien
gcgcgcccgtcttatctaggcttct

SEQ ID NO: 215308 - DNA, 25 bp, Homo sapien
gacgtcgagattttcattttccttg

SEQ ID NO: 215309 - DNA, 25 bp, Homo sapien
tgtacttcaggcgtatcagcggcgc

SEQ ID NO: 215310 - DNA, 25 bp, Homo sapien
atgcgcgaaccggtgttagaacttg

SEQ ID NO: 215311 - DNA, 25 bp, Homo sapien
atttcggctccgacaattacgctga

SEQ ID NO: 215312 - DNA, 25 bp, Homo sapien
ggacttatggagtctggctcggccc

SEQ ID NO: 215313 - DNA, 25 bp, Homo sapien
cctgaccgtgtgacgatccgcgagt

SEQ ID NO: 215314 - DNA, 25 bp, Homo sapien
cagtcacctgaaaggaatctggacc

SEQ ID NO: 215315 - DNA, 25 bp, Homo sapien
ggccgcggagtctctgtttatttcg

SEQ ID NO: 215316 - DNA, 25 bp, Homo sapien
cggtttctggccgtgatgctttccc

SEQ ID NO: 215317 - DNA, 25 bp, Homo sapien
tctgtggagttgtgccaacggtttc

SEQ ID NO: 215318 - DNA, 25 bp, Homo sapien
ggcactttctagcagagcccggggc

SEQ ID NO: 215319 - DNA, 25 bp, Homo sapien
tgtagcccacggacgcagacggcac

SEQ ID NO: 215320 - DNA, 25 bp, Homo sapien
tttctccacacaggcgcgccgggag

SEQ ID NO: 215321 - DNA, 25 bp, Homo sapien
aggcttcgctctttggccgcgcgac

SEQ ID NO: 215322 - DNA, 25 bp, Homo sapien
tggcccatctgggacgcgatccaca

SEQ ID NO: 215323 - DNA, 25 bp, Homo sapien
gaaggcactccctgaccgcagatca

SEQ ID NO: 215324 - DNA, 25 bp, Homo sapien
caccaggggtctgaaagcgaaaact

SEQ ID NO: 215325 - DNA, 25 bp, Homo sapien
gaccgcagatcacactctgcagctg

SEQ ID NO: 215326 - DNA, 25 bp, Homo sapien
cacagaacgtctttaacaccagggg

SEQ ID NO: 215327 - DNA, 25 bp, Homo sapien
tttgaatttcctgggcccgcctcta

SEQ ID NO: 215328 - DNA, 25 bp, Homo sapien
tgggcccgcctctagggccacatgc

SEQ ID NO: 215329 - DNA, 25 bp, Homo sapien
ctctgcgggcttgttttgaatttcc

SEQ ID NO: 215330 - DNA, 25 bp, Homo sapien
cacctctgcgggcttgttttgaatt

SEQ ID NO: 215331 - DNA, 25 bp, Homo sapien
gcctgcacctctgcgggcttgtttt

SEQ ID NO: 215332 - DNA, 25 bp, Homo sapien
tggcaggcctgcacctctgcgggct

SEQ ID NO: 215333 - DNA, 25 bp, Homo sapien
gccgcgaaggggagcaagccggtaa

SEQ ID NO: 215334 - DNA, 25 bp, Homo sapien
ccctttctctagtgcgcgggctgcg

SEQ ID NO: 215335 - DNA, 25 bp, Homo sapien
cacggtcgtctcaggttcagcctca

SEQ ID NO: 215336 - DNA, 25 bp, Homo sapien
tccgcatgaccgacagactctactg

SEQ ID NO: 215337 - DNA, 25 bp, Homo sapien
tgaccgacagactctactggccgtg

SEQ ID NO: 215338 - DNA, 25 bp, Homo sapien
tctactggccgtgctgcagttccta

SEQ ID NO: 215339 - DNA, 25 bp, Homo sapien
gctgcagttcctacggcagagcaaa

SEQ ID NO: 215340 - DNA, 25 bp, Homo sapien
ttcctacggcagagcaaactccgcg

SEQ ID NO: 215341 - DNA, 25 bp, Homo sapien
cgctgaggtgaccagcgcgcttctc

SEQ ID NO: 215342 - DNA, 25 bp, Homo sapien
caaactccgcgaggccgaagaggcg

SEQ ID NO: 215343 - DNA, 25 bp, Homo sapien
ccttgaaggacatcctgcacatgtc

SEQ ID NO: 215344 - DNA, 25 bp, Homo sapien
agtcccggtcgctcaccttgaagga

SEQ ID NO: 215345 - DNA, 25 bp, Homo sapien
gcaggcaaaccgcaaacccacaggg

SEQ ID NO: 215346 - DNA, 25 bp, Homo sapien
gggcaggcaggcaaaccgcaaaccc

SEQ ID NO: 215347 - DNA, 25 bp, Homo sapien
gccatgagtgcgaagcctctcaggc

SEQ ID NO: 215348 - DNA, 25 bp, Homo sapien
tccacagccatgagtgcgaagcctc

SEQ ID NO: 215349 - DNA, 25 bp, Homo sapien
tcagccgatccacagccatgagtgc

SEQ ID NO: 215350 - DNA, 25 bp, Homo sapien
gggcacagactcagccgatccacag

SEQ ID NO: 215351 - DNA, 25 bp, Homo sapien
caggcttgagtcctcgagggttcag

SEQ ID NO: 215352 - DNA, 25 bp, Homo sapien
ggctgagcgctgtcagttcctgatc

SEQ ID NO: 215353 - DNA, 25 bp, Homo sapien
tcagttcctgatccggctggtgccc

SEQ ID NO: 215354 - DNA, 25 bp, Homo sapien
cggcgaggatttgggccaccgccac

SEQ ID NO: 215355 - DNA, 25 bp, Homo sapien
ccagcccgagctctactgcaagttg

SEQ ID NO: 215356 - DNA, 25 bp, Homo sapien
cgagggcccacgacccaggagcgat

SEQ ID NO: 215357 - DNA, 25 bp, Homo sapien
agcgatctcgtggaagcaccgcacc

SEQ ID NO: 215358 - DNA, 25 bp, Homo sapien
cgctctaagagatgcaggcgcctcg

SEQ ID NO: 215359 - DNA, 25 bp, Homo sapien
tcggtcaccgattccggtcctcagg

SEQ ID NO: 215360 - DNA, 25 bp, Homo sapien
aaacaatacaggtgacccacgcgtc

SEQ ID NO: 215361 - DNA, 25 bp, Homo sapien
agtcggaccagcttttcaaacaata

SEQ ID NO: 215362 - DNA, 25 bp, Homo sapien
aacggcttcagggagtcggaccagc

SEQ ID NO: 215363 - DNA, 25 bp, Homo sapien
atgctgctcaacaacggcttcaggg

SEQ ID NO: 215364 - DNA, 25 bp, Homo sapien
ctggccggcatcaacatgctgctca

SEQ ID NO: 215365 - DNA, 25 bp, Homo sapien
tctcgcgtgcgtgtgtccgagcagt

SEQ ID NO: 215366 - DNA, 25 bp, Homo sapien
aggtctcctccctggcaagatcagc

SEQ ID NO: 215367 - DNA, 25 bp, Homo sapien
gctcactgagggcaataaacctgtc

SEQ ID NO: 215368 - DNA, 25 bp, Homo sapien
gcggcacctacaagctcagtcggga

SEQ ID NO: 215369 - DNA, 25 bp, Homo sapien
cggggccctttccacagagagaaca

SEQ ID NO: 215370 - DNA, 25 bp, Homo sapien
gagaacacagctcttcgggagattc

SEQ ID NO: 215371 - DNA, 25 bp, Homo sapien
tccttccaacttcgcgagggccgag

SEQ ID NO: 215372 - DNA, 25 bp, Homo sapien
caggagcgcgtttgaatcggttccc

SEQ ID NO: 215373 - DNA, 25 bp, Homo sapien
ggtgtacttgtttgatcggcgcgaa

SEQ ID NO: 215374 - DNA, 25 bp, Homo sapien
gcaggcgtcgctgtcttttctcctt

SEQ ID NO: 215375 - DNA, 25 bp, Homo sapien
aatctggagaaaaggcgcaccctgc

SEQ ID NO: 215376 - DNA, 25 bp, Homo sapien
ttacccttgtggtagtgggcgcatg

SEQ ID NO: 215377 - DNA, 25 bp, Homo sapien
ggcatcgtatttctcgcttaaggcg

SEQ ID NO: 215378 - DNA, 25 bp, Homo sapien
cgctggcatcctgaaaggcatcgta

SEQ ID NO: 215379 - DNA, 25 bp, Homo sapien
accattatgtctcagggagtctctc

SEQ ID NO: 215380 - DNA, 25 bp, Homo sapien
tcatggcctttgtcgctttcggctc

SEQ ID NO: 215381 - DNA, 25 bp, Homo sapien
tgcctgcggggctataaaaacgctc

SEQ ID NO: 215382 - DNA, 25 bp, Homo sapien
tgcggttacctatggctccgaagtc

SEQ ID NO: 215383 - DNA, 25 bp, Homo sapien
ttcttggatctactcacatccctgg

SEQ ID NO: 215384 - DNA, 25 bp, Homo sapien
cgaggtcctagagctgctgtgcgct

SEQ ID NO: 215385 - DNA, 25 bp, Homo sapien
ctccttgggctctacgtgagtgccg

SEQ ID NO: 215386 - DNA, 25 bp, Homo sapien
ggtctccctaagtcacctttgcgca

SEQ ID NO: 215387 - DNA, 25 bp, Homo sapien
tcgcaagctccagcgcgaatgcgct

SEQ ID NO: 215388 - DNA, 25 bp, Homo sapien
acatccctggatcaagtctggccgc

SEQ ID NO: 215389 - DNA, 25 bp, Homo sapien
gcacacacacgtccaactattcttg

SEQ ID NO: 215390 - DNA, 25 bp, Homo sapien
acctacctgggccagatccgaggac

SEQ ID NO: 215391 - DNA, 25 bp, Homo sapien
aagtaccgagaaggcacgcagctga

SEQ ID NO: 215392 - DNA, 25 bp, Homo sapien
tggacagccgcgagaaactgaccta

SEQ ID NO: 215393 - DNA, 25 bp, Homo sapien
cacgtcgaggaagtggtcgtcacca

SEQ ID NO: 215394 - DNA, 25 bp, Homo sapien
ggttccaggttttgccagctactag

SEQ ID NO: 215395 - DNA, 25 bp, Homo sapien
tactagggacgcgtaaagccttcgc

SEQ ID NO: 215396 - DNA, 25 bp, Homo sapien
tggcaggccttacccggagactaca

SEQ ID NO: 215397 - DNA, 25 bp, Homo sapien
cccgagtgggaagtgcaacaaacgc

SEQ ID NO: 215398 - DNA, 25 bp, Homo sapien
aacgcctaacttcctgcagcgctgg

SEQ ID NO: 215399 - DNA, 25 bp, Homo sapien
ctaaagtctcctggccattccgatg

SEQ ID NO: 215400 - DNA, 25 bp, Homo sapien
ccaaggccgcaatgggcaagcaaaa

SEQ ID NO: 215401 - DNA, 25 bp, Homo sapien
agggcctctggctgcaactcgcgag

SEQ ID NO: 215402 - DNA, 25 bp, Homo sapien
caactcgcgagggtcggctttccct

SEQ ID NO: 215403 - DNA, 25 bp, Homo sapien
gtctccgccctacgggagacagtga

SEQ ID NO: 215404 - DNA, 25 bp, Homo sapien
ggtgctgtctctccaggctcggctc

SEQ ID NO: 215405 - DNA, 25 bp, Homo sapien
cggacggtgtcctcgtcaaccatta

SEQ ID NO: 215406 - DNA, 25 bp, Homo sapien
cgcggtggtaaatgactccctaaag

SEQ ID NO: 215407 - DNA, 25 bp, Homo sapien
cccacctccgagatgacttttttct

SEQ ID NO: 215408 - DNA, 25 bp, Homo sapien
atctcggtttcgcttgcttgcggcg

SEQ ID NO: 215409 - DNA, 25 bp, Homo sapien
ctccttacctttgagggatctcggt

SEQ ID NO: 215410 - DNA, 25 bp, Homo sapien
agcaccgcacggttttgcatattta

SEQ ID NO: 215411 - DNA, 25 bp, Homo sapien
gcggtcaacttctgggaatggccaa

SEQ ID NO: 215412 - DNA, 25 bp, Homo sapien
accgcgaaacgcaaaggactccagg

SEQ ID NO: 215413 - DNA, 25 bp, Homo sapien
atcagatcgataacttcagggaccc

SEQ ID NO: 215414 - DNA, 25 bp, Homo sapien
ttcctccagcccagatgtagatctc

SEQ ID NO: 215415 - DNA, 25 bp, Homo sapien
gcgcggtttcaccttctgaatcgca

SEQ ID NO: 215416 - DNA, 25 bp, Homo sapien
ggccgcgaaagccacagacatgttg

SEQ ID NO: 215417 - DNA, 25 bp, Homo sapien
atgtctcgcttctgcgcactctggg

SEQ ID NO: 215418 - DNA, 25 bp, Homo sapien
tagccctggccgaactttcttgacc

SEQ ID NO: 215419 - DNA, 25 bp, Homo sapien
ccctggccctttgcgctaatggtag

SEQ ID NO: 215420 - DNA, 25 bp, Homo sapien
ctccgcttcagcgattcaggaaatg

SEQ ID NO: 215421 - DNA, 25 bp, Homo sapien
agccagcagtccgtgttcccaaaca

SEQ ID NO: 215422 - DNA, 25 bp, Homo sapien
cagagcgtgccctagacctagttca

SEQ ID NO: 215423 - DNA, 25 bp, Homo sapien
attgcactggactgtgggtatcctg

SEQ ID NO: 215424 - DNA, 25 bp, Homo sapien
cgtccaatattacgtcactgggtga

SEQ ID NO: 215425 - DNA, 25 bp, Homo sapien
ggcctcatttttctccactggcgaa

SEQ ID NO: 215426 - DNA, 25 bp, Homo sapien
ctggcgaatgcaatctaagggtctt

SEQ ID NO: 215427 - DNA, 25 bp, Homo sapien
gaactcgagttgctcctcggccaga

SEQ ID NO: 215428 - DNA, 25 bp, Homo sapien
cgcagctggtgtccttcaacgaatg

SEQ ID NO: 215429 - DNA, 25 bp, Homo sapien
cgacgattggctatggctccaaatc

SEQ ID NO: 215430 - DNA, 25 bp, Homo sapien
cagaagccctagtcctcgtccaata

SEQ ID NO: 215431 - DNA, 25 bp, Homo sapien
gtcctgtgcgatggcgtctcgatat

SEQ ID NO: 215432 - DNA, 25 bp, Homo sapien
cgatggcgtctcgatatgacagggc

SEQ ID NO: 215433 - DNA, 25 bp, Homo sapien
cgaggacatccgcaggcagccaaag

SEQ ID NO: 215434 - DNA, 25 bp, Homo sapien
acttccgtgaagcagccgaagcgcg

SEQ ID NO: 215435 - DNA, 25 bp, Homo sapien
cttccgggcggtagcacgctgtgtt

SEQ ID NO: 215436 - DNA, 25 bp, Homo sapien
cggtggcaagcccttgtagtcctgt

SEQ ID NO: 215437 - DNA, 25 bp, Homo sapien
gcagccaaaggagcaaggacttccg

SEQ ID NO: 215438 - DNA, 25 bp, Homo sapien
aagcccttgtagtcctgtgcgatgg

SEQ ID NO: 215439 - DNA, 25 bp, Homo sapien
cgaggtctccgcgtggctatataaa

SEQ ID NO: 215440 - DNA, 25 bp, Homo sapien
ggcgccgtgactaaggctcctgtca

SEQ ID NO: 215441 - DNA, 25 bp, Homo sapien
ctgtggaacccgaaccgcaccggag

SEQ ID NO: 215442 - DNA, 25 bp, Homo sapien
cccagcgatgctgtggaacccgaac

SEQ ID NO: 215443 - DNA, 25 bp, Homo sapien
gaccttccgggagccgcaagtccag

SEQ ID NO: 215444 - DNA, 25 bp, Homo sapien
ctcgaggtgtgagcgacgaccttcc

SEQ ID NO: 215445 - DNA, 25 bp, Homo sapien
gctatataaacatggctggcgtggc

SEQ ID NO: 215446 - DNA, 25 bp, Homo sapien
ctaaggctcctgtcagcgtctgcgt

SEQ ID NO: 215447 - DNA, 25 bp, Homo sapien
cctactgggcgagctgctttgaatt

SEQ ID NO: 215448 - DNA, 25 bp, Homo sapien
tgacgatgtctttttctgcagcgaa

SEQ ID NO: 215449 - DNA, 25 bp, Homo sapien
accgcgccaggtgtgaaacaagtta

SEQ ID NO: 215450 - DNA, 25 bp, Homo sapien
gcctccggctccttagggaaacaca

SEQ ID NO: 215451 - DNA, 25 bp, Homo sapien
tggccggctttgttcacaatgcact

SEQ ID NO: 215452 - DNA, 25 bp, Homo sapien
ctaagttagttgcacactgggaccc

SEQ ID NO: 215453 - DNA, 25 bp, Homo sapien
acacggctaattccagagggctggc

SEQ ID NO: 215454 - DNA, 25 bp, Homo sapien
tcgggtgcgtcctcgaatttacctc

SEQ ID NO: 215455 - DNA, 25 bp, Homo sapien
tgatggcttgcttctgcaccaccgg

SEQ ID NO: 215456 - DNA, 25 bp, Homo sapien
cgccttggagagcatctgcatccga

SEQ ID NO: 215457 - DNA, 25 bp, Homo sapien
tccgagtgcctagcaagttcttgcc

SEQ ID NO: 215458 - DNA, 25 bp, Homo sapien
ggctttgttctcgtaccaggtcaca

SEQ ID NO: 215459 - DNA, 25 bp, Homo sapien
ggcagaactcggtgcccgtctcata

SEQ ID NO: 215460 - DNA, 25 bp, Homo sapien
gaacttgcgaccgtcctcgtccatg

SEQ ID NO: 215461 - DNA, 25 bp, Homo sapien
cgtctcatacatgcggggcaagttc

SEQ ID NO: 215462 - DNA, 25 bp, Homo sapien
ctccgaggggcggatacaaagtctt

SEQ ID NO: 215463 - DNA, 25 bp, Homo sapien
gccatattgccgtctctctgccagt

SEQ ID NO: 215464 - DNA, 25 bp, Homo sapien
tgtcattaaagacctggggcgctcc

SEQ ID NO: 215465 - DNA, 25 bp, Homo sapien
gacggtctcgtttctctaagtaatg

SEQ ID NO: 215466 - DNA, 25 bp, Homo sapien
tcccaacttaccctctggcggagaa

SEQ ID NO: 215467 - DNA, 25 bp, Homo sapien
acggaggctgaccagaccttcttcc

SEQ ID NO: 215468 - DNA, 25 bp, Homo sapien
aggagccgcgctccaattgtcattc

SEQ ID NO: 215469 - DNA, 25 bp, Homo sapien
gtttaatgaccttcagctaccggga

SEQ ID NO: 215470 - DNA, 25 bp, Homo sapien
cgctgagagcttttgtgtttaatga

SEQ ID NO: 215471 - DNA, 25 bp, Homo sapien
atgaaacgtttgcatccaaaagggg

SEQ ID NO: 215472 - DNA, 25 bp, Homo sapien
ccacaatggcgtctttcacggggcg

SEQ ID NO: 215473 - DNA, 25 bp, Homo sapien
ggctcctgacttggcgctgaccgca

SEQ ID NO: 215474 - DNA, 25 bp, Homo sapien
cccgcagagatgtgcgcttggctct

SEQ ID NO: 215475 - DNA, 25 bp, Homo sapien
tgctgtgccctttatccggggagga

SEQ ID NO: 215476 - DNA, 25 bp, Homo sapien
gcctcccaaggagacttctaatccg

SEQ ID NO: 215477 - DNA, 25 bp, Homo sapien
ggcgggagaggaagcacacttcaca

SEQ ID NO: 215478 - DNA, 25 bp, Homo sapien
tctaatccggagcatgtgctgtgcc

SEQ ID NO: 215479 - DNA, 25 bp, Homo sapien
tcgtgaacaagaatgtgagctgctc

SEQ ID NO: 215480 - DNA, 25 bp, Homo sapien
ccagcgccaggaacaagtaagtgcg

SEQ ID NO: 215481 - DNA, 25 bp, Homo sapien
tggcctcattgttctccgggtttac

SEQ ID NO: 215482 - DNA, 25 bp, Homo sapien
gcagacccgggcgatccgaaaacga

SEQ ID NO: 215483 - DNA, 25 bp, Homo sapien
gaaaacgactcccaggaattccatg

SEQ ID NO: 215484 - DNA, 25 bp, Homo sapien
accctccggcgtctgctcggtgaag

SEQ ID NO: 215485 - DNA, 25 bp, Homo sapien
ccctgggaccatgggtgcttttctt

SEQ ID NO: 215486 - DNA, 25 bp, Homo sapien
aactggtgcgcctacatcgtgaaca

SEQ ID NO: 215487 - DNA, 25 bp, Homo sapien
gggagcgcggcacggggacgtgtaa

SEQ ID NO: 215488 - DNA, 25 bp, Homo sapien
ctgcccaagggacacgcgcaccgcc

SEQ ID NO: 215489 - DNA, 25 bp, Homo sapien
agggacacgcgcaccgcccagatct

SEQ ID NO: 215490 - DNA, 25 bp, Homo sapien
accgcccagatctgggagcgcggca

SEQ ID NO: 215491 - DNA, 25 bp, Homo sapien
cagcggccattcccggcccgtggca

SEQ ID NO: 215492 - DNA, 25 bp, Homo sapien
caggaacgagcaggctgccagcggg

SEQ ID NO: 215493 - DNA, 25 bp, Homo sapien
aggtgcacacgcagaagcggccccg

SEQ ID NO: 215494 - DNA, 25 bp, Homo sapien
aggagtccgggagctgagcctgccc

SEQ ID NO: 215495 - DNA, 25 bp, Homo sapien
tctccagcggcgaagcacctggaaa

SEQ ID NO: 215496 - DNA, 25 bp, Homo sapien
ctctgcctttgtggctctctggtcc

SEQ ID NO: 215497 - DNA, 25 bp, Homo sapien
gacagctcggagtcgggcgctcacc

SEQ ID NO: 215498 - DNA, 25 bp, Homo sapien
ctctgactttctggcctcgcctccg

SEQ ID NO: 215499 - DNA, 25 bp, Homo sapien
ctccggggcaaactcccgcgcactc

SEQ ID NO: 215500 - DNA, 25 bp, Homo sapien
tccagctctgcctttgtggctctct

SEQ ID NO: 215501 - DNA, 25 bp, Homo sapien
agcgcagcttcggaggaaacttccc

SEQ ID NO: 215502 - DNA, 25 bp, Homo sapien
gcgcttgcaggtgctgctgttccag

SEQ ID NO: 215503 - DNA, 25 bp, Homo sapien
cggagaaacggctccaggcagtttc

SEQ ID NO: 215504 - DNA, 25 bp, Homo sapien
ccgccaatggagagcgagctgatga

SEQ ID NO: 215505 - DNA, 25 bp, Homo sapien
ggccagattttctttccaggtggga

SEQ ID NO: 215506 - DNA, 25 bp, Homo sapien
ccaggtgggacgaacacagaatatt

SEQ ID NO: 215507 - DNA, 25 bp, Homo sapien
taggacagtagagcccttgagcacc

SEQ ID NO: 215508 - DNA, 25 bp, Homo sapien
gtggaggcaagtcccgtaactaaga

SEQ ID NO: 215509 - DNA, 25 bp, Homo sapien
cgcgacccatccctgcagaaataaa

SEQ ID NO: 215510 - DNA, 25 bp, Homo sapien
ctgatgacaaatagcgggccgcgga

SEQ ID NO: 215511 - DNA, 25 bp, Homo sapien
tcacttctgaaaccggattggaccc

SEQ ID NO: 215512 - DNA, 25 bp, Homo sapien
ccgcttgggtgagcttctgaatacc

SEQ ID NO: 215513 - DNA, 25 bp, Homo sapien
gcccgggagcaacttcacttctgaa

SEQ ID NO: 215514 - DNA, 25 bp, Homo sapien
ttaagtgtatttggcctctctcagg

SEQ ID NO: 215515 - DNA, 25 bp, Homo sapien
ttaccacgagggtcagcagcagatg

SEQ ID NO: 215516 - DNA, 25 bp, Homo sapien
ctatccggcgagatctggcttacca

SEQ ID NO: 215517 - DNA, 25 bp, Homo sapien
agagtcgacccgcaaacacacgttt

SEQ ID NO: 215518 - DNA, 25 bp, Homo sapien
ctttgagctctcagggatcctctcc

SEQ ID NO: 215519 - DNA, 25 bp, Homo sapien
ggggatcccaactctcaggtcgcga

SEQ ID NO: 215520 - DNA, 25 bp, Homo sapien
tccttgagtgcgctgattacatcta

SEQ ID NO: 215521 - DNA, 25 bp, Homo sapien
aggtcgcgatcctcttcctatctgc

SEQ ID NO: 215522 - DNA, 25 bp, Homo sapien
tagttttcctctgcaccctaggcga

SEQ ID NO: 215523 - DNA, 25 bp, Homo sapien
ctgcctctcatccaaggggcttttc

SEQ ID NO: 215524 - DNA, 25 bp, Homo sapien
ttacctgcgcaaggtgtttctcacc

SEQ ID NO: 215525 - DNA, 25 bp, Homo sapien
tgtccgctccgccaggcgagattaa

SEQ ID NO: 215526 - DNA, 25 bp, Homo sapien
tacccaggggccacgattttggctg

SEQ ID NO: 215527 - DNA, 25 bp, Homo sapien
gacaccttggtgttggcctccttaa

SEQ ID NO: 215528 - DNA, 25 bp, Homo sapien
ggtgttggcctccttaacggccagc

SEQ ID NO: 215529 - DNA, 25 bp, Homo sapien
cctatggatactcaccttctgcatc

SEQ ID NO: 215530 - DNA, 25 bp, Homo sapien
gccgctagtggtcttcctatggata

SEQ ID NO: 215531 - DNA, 25 bp, Homo sapien
ccagagccaaagctgcagcccatgg

SEQ ID NO: 215532 - DNA, 25 bp, Homo sapien
aaagctgcagcccatggcgtagctg

SEQ ID NO: 215533 - DNA, 25 bp, Homo sapien
ggctgagctcagatcacctgcatag

SEQ ID NO: 215534 - DNA, 25 bp, Homo sapien
cacgctgctccgcatttgcgatggc

SEQ ID NO: 215535 - DNA, 25 bp, Homo sapien
ccgagaggaagttgagatgcctgtt

SEQ ID NO: 215536 - DNA, 25 bp, Homo sapien
aggaagttgagatgcctgttctgca

SEQ ID NO: 215537 - DNA, 25 bp, Homo sapien
ccgcttttcttctgcacgggggcct

SEQ ID NO: 215538 - DNA, 25 bp, Homo sapien
tggcggcttcagactaatctaactc

SEQ ID NO: 215539 - DNA, 25 bp, Homo sapien
gactaatctaactccagaaaagaga

SEQ ID NO: 215540 - DNA, 25 bp, Homo sapien
agaagaaaacagtgggatggagtct

SEQ ID NO: 215541 - DNA, 25 bp, Homo sapien
gagtggaaaaacagcctcccggcgc

SEQ ID NO: 215542 - DNA, 25 bp, Homo sapien
cgccagtgagtggaaaaacagcctc

SEQ ID NO: 215543 - DNA, 25 bp, Homo sapien
tgcgacctatcgaagttgtgttttc

SEQ ID NO: 215544 - DNA, 25 bp, Homo sapien
ccaggagagtaagttgcgacctatc

SEQ ID NO: 215545 - DNA, 25 bp, Homo sapien
cctggggcttcggaaaatcctcttg

SEQ ID NO: 215546 - DNA, 25 bp, Homo sapien
cttctcctggtaagtgccgcaagcg

SEQ ID NO: 215547 - DNA, 25 bp, Homo sapien
ctcccgccattctccagagagtagg

SEQ ID NO: 215548 - DNA, 25 bp, Homo sapien
ctgctccgtggagcttttgtccttg

SEQ ID NO: 215549 - DNA, 25 bp, Homo sapien
tccgggcccaaagcacaatcacaaa

SEQ ID NO: 215550 - DNA, 25 bp, Homo sapien
gcggtcgcagctttcctgaggacac

SEQ ID NO: 215551 - DNA, 25 bp, Homo sapien
tcggagccgcgtctggttggagaaa

SEQ ID NO: 215552 - DNA, 25 bp, Homo sapien
caagggcggcagcggcattaccgcc

SEQ ID NO: 215553 - DNA, 25 bp, Homo sapien
accaggcgaagagcaaccgggcgac

SEQ ID NO: 215554 - DNA, 25 bp, Homo sapien
agaggggcagctaactgcagcacgc

SEQ ID NO: 215555 - DNA, 25 bp, Homo sapien
ggcgggaacgtctcgagacccctgc

SEQ ID NO: 215556 - DNA, 25 bp, Homo sapien
ccgcggacaccaggcgaagagcaac

SEQ ID NO: 215557 - DNA, 25 bp, Homo sapien
gccagcgacgaacgcgctccgactc

SEQ ID NO: 215558 - DNA, 25 bp, Homo sapien
gggcagctaactgcagcacgcccgg

SEQ ID NO: 215559 - DNA, 25 bp, Homo sapien
ctggattgtgggataagattgccct

SEQ ID NO: 215560 - DNA, 25 bp, Homo sapien
agcggatctggacccgagcctaata

SEQ ID NO: 215561 - DNA, 25 bp, Homo sapien
gagcctaataaaggctgcgtaaata

SEQ ID NO: 215562 - DNA, 25 bp, Homo sapien
ggctgcgtaaataaaggtgtagtta

SEQ ID NO: 215563 - DNA, 25 bp, Homo sapien
gctgccctaatggctcctgctcagt

SEQ ID NO: 215564 - DNA, 25 bp, Homo sapien
cggcccaaattcttcctcgcagagg

SEQ ID NO: 215565 - DNA, 25 bp, Homo sapien
ccaaattcttcctcgcagaggggag

SEQ ID NO: 215566 - DNA, 25 bp, Homo sapien
agcgcttgtcttgtcccggctgcgt

SEQ ID NO: 215567 - DNA, 25 bp, Homo sapien
gcttcggtttctggggcacaatcca

SEQ ID NO: 215568 - DNA, 25 bp, Homo sapien
cccacgcagtttggcctttttgacg

SEQ ID NO: 215569 - DNA, 25 bp, Homo sapien
tgcacaactgtaggccgggttctca

SEQ ID NO: 215570 - DNA, 25 bp, Homo sapien
cgcgtccctcacgtgactgtgttaa

SEQ ID NO: 215571 - DNA, 25 bp, Homo sapien
ccgccatgttgaggccgaaccctga

SEQ ID NO: 215572 - DNA, 25 bp, Homo sapien
ggagacgccgacagtcaccacttag

SEQ ID NO: 215573 - DNA, 25 bp, Homo sapien
gggattagctcctgcactgattgta

SEQ ID NO: 215574 - DNA, 25 bp, Homo sapien
ccgaacgcactggagcctagaaaca

SEQ ID NO: 215575 - DNA, 25 bp, Homo sapien
cggaagacagcctcttaggaaattg

SEQ ID NO: 215576 - DNA, 25 bp, Homo sapien
ccacgtgtaagttccaggggagctc

SEQ ID NO: 215577 - DNA, 25 bp, Homo sapien
gaggtgttacaccagcctgtccgga

SEQ ID NO: 215578 - DNA, 25 bp, Homo sapien
cgctgaacacggtagaacgggctgc

SEQ ID NO: 215579 - DNA, 25 bp, Homo sapien
cctaggcggcttgccgaagatctca

SEQ ID NO: 215580 - DNA, 25 bp, Homo sapien
agttgcccgtcacgtccttcgactg

SEQ ID NO: 215581 - DNA, 25 bp, Homo sapien
tgctgagcaccgacagcggcaaatc

SEQ ID NO: 215582 - DNA, 25 bp, Homo sapien
aggcactgagtgcttcgcagctgtc

SEQ ID NO: 215583 - DNA, 25 bp, Homo sapien
cgcgtgctgtgaaatcgggaattgt

SEQ ID NO: 215584 - DNA, 25 bp, Homo sapien
tcctaatcccgtgtgtttctttctc

SEQ ID NO: 215585 - DNA, 25 bp, Homo sapien
cgggaattgttgatgccggagccaa

SEQ ID NO: 215586 - DNA, 25 bp, Homo sapien
agtcacttgcgacgcacccgcggtt

SEQ ID NO: 215587 - DNA, 25 bp, Homo sapien
tcaggtccctttcagtcacttgcga

SEQ ID NO: 215588 - DNA, 25 bp, Homo sapien
ttggaagtcccttccgctggcgacg

SEQ ID NO: 215589 - DNA, 25 bp, Homo sapien
acgccaggagcttcctccgttggaa

SEQ ID NO: 215590 - DNA, 25 bp, Homo sapien
agtcagggctgaggtttcctaatcc

SEQ ID NO: 215591 - DNA, 25 bp, Homo sapien
cggcctgtcagcacgtgtgagtaga

SEQ ID NO: 215592 - DNA, 25 bp, Homo sapien
ggccgggtctctacgaacacgtgaa

SEQ ID NO: 215593 - DNA, 25 bp, Homo sapien
aggaaaagcagctccgtccacaacg

SEQ ID NO: 215594 - DNA, 25 bp, Homo sapien
acaacgccgcttcggggctcctagg

SEQ ID NO: 215595 - DNA, 25 bp, Homo sapien
gcagtagcgtctctgcgttcggccc

SEQ ID NO: 215596 - DNA, 25 bp, Homo sapien
cgcgcgctgtatcctgatgcgatcc

SEQ ID NO: 215597 - DNA, 25 bp, Homo sapien
ccctccgggttcatgtagggagtcg

SEQ ID NO: 215598 - DNA, 25 bp, Homo sapien
gccacgtcctacaccgaagatgatt

SEQ ID NO: 215599 - DNA, 25 bp, Homo sapien
cgggtctgagaaacgccatagcagc

SEQ ID NO: 215600 - DNA, 25 bp, Homo sapien
ttcacatccttgaggctgcagccca

SEQ ID NO: 215601 - DNA, 25 bp, Homo sapien
tcacgcccggagaagactcagagca

SEQ ID NO: 215602 - DNA, 25 bp, Homo sapien
agcgctcccagcactgactaatcaa

SEQ ID NO: 215603 - DNA, 25 bp, Homo sapien
ctaatcaacaaggtgcgagcaacgc

SEQ ID NO: 215604 - DNA, 25 bp, Homo sapien
ggcgcgctccgcaagctttagctct

SEQ ID NO: 215605 - DNA, 25 bp, Homo sapien
gtatcgctccctgagtcgtggtgtc

SEQ ID NO: 215606 - DNA, 25 bp, Homo sapien
cctggcaatgcggtggctaaataca

SEQ ID NO: 215607 - DNA, 25 bp, Homo sapien
cgacggcgaaggttccaggtcaact

SEQ ID NO: 215608 - DNA, 25 bp, Homo sapien
aggcgggagctgtccttatcaattc

SEQ ID NO: 215609 - DNA, 25 bp, Homo sapien
gctgactcggtgcacctggctttaa

SEQ ID NO: 215610 - DNA, 25 bp, Homo sapien
ctcagctcggctgttggcagcaaca

SEQ ID NO: 215611 - DNA, 25 bp, Homo sapien
aggtcaacttgtgcccgaagctttg

SEQ ID NO: 215612 - DNA, 25 bp, Homo sapien
tgcttttcgcagttggcccagtttg

SEQ ID NO: 215613 - DNA, 25 bp, Homo sapien
ggggtgtgcgaatcttagctctcca

SEQ ID NO: 215614 - DNA, 25 bp, Homo sapien
tcttctcccgggaaagtgcagcgga

SEQ ID NO: 215615 - DNA, 25 bp, Homo sapien
tttcggcgcccgatcagcgctccag

SEQ ID NO: 215616 - DNA, 25 bp, Homo sapien
ggggcctcctggctcgagcccttag

SEQ ID NO: 215617 - DNA, 25 bp, Homo sapien
gtcggttatcccgtgtccaggcaac

SEQ ID NO: 215618 - DNA, 25 bp, Homo sapien
caagtcggttatcccgtgtccaggc

SEQ ID NO: 215619 - DNA, 25 bp, Homo sapien
cccaagtcggttatcccgtgtccag

SEQ ID NO: 215620 - DNA, 25 bp, Homo sapien
ctctgctgcggtcgaggccccaagt

SEQ ID NO: 215621 - DNA, 25 bp, Homo sapien
ccgactcaccggctccgcgcgtttc

SEQ ID NO: 215622 - DNA, 25 bp, Homo sapien
agcgcccgcgccgaggcacaagcgc

SEQ ID NO: 215623 - DNA, 25 bp, Homo sapien
catggtgccttgatccgtgatgcca

SEQ ID NO: 215624 - DNA, 25 bp, Homo sapien
ccagctcgtgagcagcctgttcatg

SEQ ID NO: 215625 - DNA, 25 bp, Homo sapien
acccagctccaggtcatggttcatg

SEQ ID NO: 215626 - DNA, 25 bp, Homo sapien
atggcctcgaagaactgctggatgc

SEQ ID NO: 215627 - DNA, 25 bp, Homo sapien
ctccgtgcacgtctcgtcgaagagc

SEQ ID NO: 215628 - DNA, 25 bp, Homo sapien
cgctcgatgtcgatatagtgggacc

SEQ ID NO: 215629 - DNA, 25 bp, Homo sapien
tgggaccagtacttgctcttgagga

SEQ ID NO: 215630 - DNA, 25 bp, Homo sapien
aggcggtttgcatttgtgccagctc

SEQ ID NO: 215631 - DNA, 25 bp, Homo sapien
tgagatctgcgtccgcttcacccga

SEQ ID NO: 215632 - DNA, 25 bp, Homo sapien
cacggtcacgccgagtttgagcacg

SEQ ID NO: 215633 - DNA, 25 bp, Homo sapien
ggcctgaccctgatccgtggatgcc

SEQ ID NO: 215634 - DNA, 25 bp, Homo sapien
tccgcttcacccgagcatgagcttg

SEQ ID NO: 215635 - DNA, 25 bp, Homo sapien
ctcagacatcacagttgccgcggca

SEQ ID NO: 215636 - DNA, 25 bp, Homo sapien
tggcggtgtccatagcaacgctgga

SEQ ID NO: 215637 - DNA, 25 bp, Homo sapien
ttgccctggcggtgtccatagcaac

SEQ ID NO: 215638 - DNA, 25 bp, Homo sapien
cgagcatgagcttgggtctctcgga

SEQ ID NO: 215639 - DNA, 25 bp, Homo sapien
gcccttcgatttgacccagaattta

SEQ ID NO: 215640 - DNA, 25 bp, Homo sapien
agcggtcggtctctttaatattttg

SEQ ID NO: 215641 - DNA, 25 bp, Homo sapien
ggtgcgctgccgctttaaaataaag

SEQ ID NO: 215642 - DNA, 25 bp, Homo sapien
tcttgacaggcacgtagagcacttg

SEQ ID NO: 215643 - DNA, 25 bp, Homo sapien
aaatttggcgttgtccgtggagctc

SEQ ID NO: 215644 - DNA, 25 bp, Homo sapien
tccggttgggcaccagcaatcaatg

SEQ ID NO: 215645 - DNA, 25 bp, Homo sapien
tcaccgtcttggtcttgcctgagtc

SEQ ID NO: 215646 - DNA, 25 bp, Homo sapien
gcaacggctgtctcggacgtttttc

SEQ ID NO: 215647 - DNA, 25 bp, Homo sapien
cttgcaaaatggtcagtggctcctg

SEQ ID NO: 215648 - DNA, 25 bp, Homo sapien
ctgccaggaaaacggcccgaccagt

SEQ ID NO: 215649 - DNA, 25 bp, Homo sapien
ctcgtcgtcgtctcccagactaaat

SEQ ID NO: 215650 - DNA, 25 bp, Homo sapien
tcgtctcccagactaaatcccggaa

SEQ ID NO: 215651 - DNA, 25 bp, Homo sapien
aaagcgggatgtttgcgcccaccgc

SEQ ID NO: 215652 - DNA, 25 bp, Homo sapien
caccgcgctgtagctggtcctgaca

SEQ ID NO: 215653 - DNA, 25 bp, Homo sapien
gctggtcctgacacttgcaaaatgg

SEQ ID NO: 215654 - DNA, 25 bp, Homo sapien
attctactctcacccgaggcccgcg

SEQ ID NO: 215655 - DNA, 25 bp, Homo sapien
gtcctttcgtgttgcagtgcactgc

SEQ ID NO: 215656 - DNA, 25 bp, Homo sapien
ggacatccgcgttgggttcctttgc

SEQ ID NO: 215657 - DNA, 25 bp, Homo sapien
gcccgtccattccaaggtgtgtgca

SEQ ID NO: 215658 - DNA, 25 bp, Homo sapien
gcacggcgttttcttctttgacagc

SEQ ID NO: 215659 - DNA, 25 bp, Homo sapien
ccgcgcaccgagcaaagtcaagagt

SEQ ID NO: 215660 - DNA, 25 bp, Homo sapien
agtcagtgactgaagcgcccgtcca

SEQ ID NO: 215661 - DNA, 25 bp, Homo sapien
ctccattagggatgatactcacgtc

SEQ ID NO: 215662 - DNA, 25 bp, Homo sapien
tcttggtcatcctctcgggctgagc

SEQ ID NO: 215663 - DNA, 25 bp, Homo sapien
cgggttgttattctgcgcccaagca

SEQ ID NO: 215664 - DNA, 25 bp, Homo sapien
tcctttggcctgagacagcgtcttc

SEQ ID NO: 215665 - DNA, 25 bp, Homo sapien
gagggctactcagcgacttcgcact

SEQ ID NO: 215666 - DNA, 25 bp, Homo sapien
cagactgcgagtcacgtgcgacaga

SEQ ID NO: 215667 - DNA, 25 bp, Homo sapien
cccaagcatctcttctgcagggagc

SEQ ID NO: 215668 - DNA, 25 bp, Homo sapien
ccggagcaggtgagtcaagtgcatt

SEQ ID NO: 215669 - DNA, 25 bp, Homo sapien
caagaagttgtgcaagggtcggcta

SEQ ID NO: 215670 - DNA, 25 bp, Homo sapien
caagtgcatttaaagcggtaccgcc

SEQ ID NO: 215671 - DNA, 25 bp, Homo sapien
agcgttcctacaggtaatggggctg

SEQ ID NO: 215672 - DNA, 25 bp, Homo sapien
catccaggataataacgggaccatc

SEQ ID NO: 215673 - DNA, 25 bp, Homo sapien
cccaaatggcgagaacaacaacgac

SEQ ID NO: 215674 - DNA, 25 bp, Homo sapien
ccttctcgggagtgcgccaatgcct

SEQ ID NO: 215675 - DNA, 25 bp, Homo sapien
gccacgtgaccagggtgctgctgcc

SEQ ID NO: 215676 - DNA, 25 bp, Homo sapien
acgccgcgaccctgtgcgaattgag

SEQ ID NO: 215677 - DNA, 25 bp, Homo sapien
gggaccatcattcctttccggaagc

SEQ ID NO: 215678 - DNA, 25 bp, Homo sapien
atggcaacaggctggccacgtgacc

SEQ ID NO: 215679 - DNA, 25 bp, Homo sapien
gggtcttcacggctccttatgatgg

SEQ ID NO: 215680 - DNA, 25 bp, Homo sapien
agagacgcctacgtggaagcagtgc

SEQ ID NO: 215681 - DNA, 25 bp, Homo sapien
ggaagcagtgctgtcggtctccaac

SEQ ID NO: 215682 - DNA, 25 bp, Homo sapien
tggcccagctgcataccgctgggta

SEQ ID NO: 215683 - DNA, 25 bp, Homo sapien
ccgctgggtacaggagagagttcct

SEQ ID NO: 215684 - DNA, 25 bp, Homo sapien
agagagttcctggaataccaccgcc

SEQ ID NO: 215685 - DNA, 25 bp, Homo sapien
cctcatcgtgcacctgaaggcggga

SEQ ID NO: 215686 - DNA, 25 bp, Homo sapien
ttatgatgggcgctacctgatcacg

SEQ ID NO: 215687 - DNA, 25 bp, Homo sapien
ccggacagtggaggagctccgctcc

SEQ ID NO: 215688 - DNA, 25 bp, Homo sapien
agatgcgggaccctccaggtgccgc

SEQ ID NO: 215689 - DNA, 25 bp, Homo sapien
ccctggccttggagattccgccggg

SEQ ID NO: 215690 - DNA, 25 bp, Homo sapien
tggaaactgtagagcccgcggctct

SEQ ID NO: 215691 - DNA, 25 bp, Homo sapien
cgcggctctgattggctacctcaga

SEQ ID NO: 215692 - DNA, 25 bp, Homo sapien
attggctacctcagagcaaggggcg

SEQ ID NO: 215693 - DNA, 25 bp, Homo sapien
acttccggtctttgtggcttgcagc

SEQ ID NO: 215694 - DNA, 25 bp, Homo sapien
gcggaacactgcgtacgcgcacttc

SEQ ID NO: 215695 - DNA, 25 bp, Homo sapien
ccgcgtgctggatgctgacacagca

SEQ ID NO: 215696 - DNA, 25 bp, Homo sapien
catcgcagagtacaagcggttgacg

SEQ ID NO: 215697 - DNA, 25 bp, Homo sapien
ttcccgcgtaggaagcgacaggagc

SEQ ID NO: 215698 - DNA, 25 bp, Homo sapien
cgaagacgacagtcctaggagctgc

SEQ ID NO: 215699 - DNA, 25 bp, Homo sapien
cggacgtgctgactgcgaagacgac

SEQ ID NO: 215700 - DNA, 25 bp, Homo sapien
cgcgggctggtataccatcgagaaa

SEQ ID NO: 215701 - DNA, 25 bp, Homo sapien
tttttcctcgttatgtcgcgggctg

SEQ ID NO: 215702 - DNA, 25 bp, Homo sapien
ttcagggcacgctcggaattggccc

SEQ ID NO: 215703 - DNA, 25 bp, Homo sapien
cacagcggtccggtgaccaagtcga

SEQ ID NO: 215704 - DNA, 25 bp, Homo sapien
tcgagtccttggagagtgaaggccc

SEQ ID NO: 215705 - DNA, 25 bp, Homo sapien
ctgtgcatggtttctcgagtccttg

SEQ ID NO: 215706 - DNA, 25 bp, Homo sapien
cctaacgagcaggaaactgtgcatg

SEQ ID NO: 215707 - DNA, 25 bp, Homo sapien
tccgggtgatcttgcctaacgagca

SEQ ID NO: 215708 - DNA, 25 bp, Homo sapien
tagcagaggagttccgggtgatctt

SEQ ID NO: 215709 - DNA, 25 bp, Homo sapien
gagacgattggttcacggcctagtg

SEQ ID NO: 215710 - DNA, 25 bp, Homo sapien
accaagtcgaggtaagggtgatgtc

SEQ ID NO: 215711 - DNA, 25 bp, Homo sapien
gccacccagacgacaggcgcgatga

SEQ ID NO: 215712 - DNA, 25 bp, Homo sapien
aagcatttgccgtcgagtagcgtga

SEQ ID NO: 215713 - DNA, 25 bp, Homo sapien
atcgtagatctcagggcagggcacc

SEQ ID NO: 215714 - DNA, 25 bp, Homo sapien
gccaacagccagtcgccatcgtaga

SEQ ID NO: 215715 - DNA, 25 bp, Homo sapien
tgggccatggagcagaacatgtagc

SEQ ID NO: 215716 - DNA, 25 bp, Homo sapien
gcttccactcttcggccagcatgga

SEQ ID NO: 215717 - DNA, 25 bp, Homo sapien
catgtagcgcaacacagcggggtcc

SEQ ID NO: 215718 - DNA, 25 bp, Homo sapien
ggaggtaacgcacggccacctctcg

SEQ ID NO: 215719 - DNA, 25 bp, Homo sapien
ctgcggccggtgagactacaaatcc

SEQ ID NO: 215720 - DNA, 25 bp, Homo sapien
ggcagacgcagaaacgccgttcaca

SEQ ID NO: 215721 - DNA, 25 bp, Homo sapien
gctcaggaaccgcagcagcttcgct

SEQ ID NO: 215722 - DNA, 25 bp, Homo sapien
cctgctaagaggtccgcagacccta

SEQ ID NO: 215723 - DNA, 25 bp, Homo sapien
atgccgaagacccaagcaggcctgc

SEQ ID NO: 215724 - DNA, 25 bp, Homo sapien
cgccagggcctcgaaatagaacaaa

SEQ ID NO: 215725 - DNA, 25 bp, Homo sapien
aatgaccgcattgaggctgcgcttg

SEQ ID NO: 215726 - DNA, 25 bp, Homo sapien
gagagctctctgcaaatgccgaaga

SEQ ID NO: 215727 - DNA, 25 bp, Homo sapien
cgacaccgcacgacaaccagaaaga

SEQ ID NO: 215728 - DNA, 25 bp, Homo sapien
gggaactgccagctgcgcaacaact

SEQ ID NO: 215729 - DNA, 25 bp, Homo sapien
taagggtgctgcacttgcgcgcgaa

SEQ ID NO: 215730 - DNA, 25 bp, Homo sapien
ggagggctggcttccgaccatctcc

SEQ ID NO: 215731 - DNA, 25 bp, Homo sapien
ctcggctctaccctgctgtggtggg

SEQ ID NO: 215732 - DNA, 25 bp, Homo sapien
caaccagaaagaacgtccctggagg

SEQ ID NO: 215733 - DNA, 25 bp, Homo sapien
tgcgcaacaacttccggttctggtg

SEQ ID NO: 215734 - DNA, 25 bp, Homo sapien
ggcttcgatcaaagcctgggacgca

SEQ ID NO: 215735 - DNA, 25 bp, Homo sapien
tccgctgttacttccgtcttgatgc

SEQ ID NO: 215736 - DNA, 25 bp, Homo sapien
tgcgtacctgcgcaaagctggaagc

SEQ ID NO: 215737 - DNA, 25 bp, Homo sapien
ttgatgcttgaaaacccggcctgga

SEQ ID NO: 215738 - DNA, 25 bp, Homo sapien
cacaattggaatttgcgccgccatc

SEQ ID NO: 215739 - DNA, 25 bp, Homo sapien
ggcctcttcttgctgttccggacta

SEQ ID NO: 215740 - DNA, 25 bp, Homo sapien
cttttttcttcttactggcgccata

SEQ ID NO: 215741 - DNA, 25 bp, Homo sapien
tctctcggtgcaatctaaaaggcgg

SEQ ID NO: 215742 - DNA, 25 bp, Homo sapien
tggactccaagctgtagctggcttc

SEQ ID NO: 215743 - DNA, 25 bp, Homo sapien
agcgagtttccgtcctagtttgaca

SEQ ID NO: 215744 - DNA, 25 bp, Homo sapien
cagctttggcgagcagcgagtttcc

SEQ ID NO: 215745 - DNA, 25 bp, Homo sapien
gtgccgttggacacgcggcgtctct

SEQ ID NO: 215746 - DNA, 25 bp, Homo sapien
cgcctagcgaggtgagtgtatcgcc

SEQ ID NO: 215747 - DNA, 25 bp, Homo sapien
gttgtctttaacttgctgcggcagc

SEQ ID NO: 215748 - DNA, 25 bp, Homo sapien
cgatccgctgtgagggctcctccat

SEQ ID NO: 215749 - DNA, 25 bp, Homo sapien
cctagtttgacattgagttagaacc

SEQ ID NO: 215750 - DNA, 25 bp, Homo sapien
tcgacgcgcaacagcccgagttgtc

SEQ ID NO: 215751 - DNA, 25 bp, Homo sapien
aggccagttcctccgaacgctaatc

SEQ ID NO: 215752 - DNA, 25 bp, Homo sapien
aggcccatcgcctggatcctgagcg

SEQ ID NO: 215753 - DNA, 25 bp, Homo sapien
tgcccgctgactgcttgagtcctaa

SEQ ID NO: 215754 - DNA, 25 bp, Homo sapien
agccaacttattccgtgcgcctcga

SEQ ID NO: 215755 - DNA, 25 bp, Homo sapien
tcagcggagagttccagccaactta

SEQ ID NO: 215756 - DNA, 25 bp, Homo sapien
ggttgctgggcgtatagatattcta

SEQ ID NO: 215757 - DNA, 25 bp, Homo sapien
gatattctatttcgcggggcctttg

SEQ ID NO: 215758 - DNA, 25 bp, Homo sapien
gcgtacgctcatctggatcccactg

SEQ ID NO: 215759 - DNA, 25 bp, Homo sapien
ggcgccctattttctcacctggttc

SEQ ID NO: 215760 - DNA, 25 bp, Homo sapien
ggcgatgagacagaagcactacctt

SEQ ID NO: 215761 - DNA, 25 bp, Homo sapien
gtgggagcctcacctttggactcta

SEQ ID NO: 215762 - DNA, 25 bp, Homo sapien
ggtgttcctttgctcctcacaagtc

SEQ ID NO: 215763 - DNA, 25 bp, Homo sapien
ttacagctgggcctacacttcgtcg

SEQ ID NO: 215764 - DNA, 25 bp, Homo sapien
tcgcacggtaagaagaacgcctgtc

SEQ ID NO: 215765 - DNA, 25 bp, Homo sapien
cctacggtgcctgtttccggaagca

SEQ ID NO: 215766 - DNA, 25 bp, Homo sapien
tctgactcgaaactccgctgggtgc

SEQ ID NO: 215767 - DNA, 25 bp, Homo sapien
agcggttgactcacctttccgcagc

SEQ ID NO: 215768 - DNA, 25 bp, Homo sapien
ctcccacacggtgacgatgggacgc

SEQ ID NO: 215769 - DNA, 25 bp, Homo sapien
tgtttacggtggtgaatgagccaca

SEQ ID NO: 215770 - DNA, 25 bp, Homo sapien
cgagttgctcaactccgacagcttc

SEQ ID NO: 215771 - DNA, 25 bp, Homo sapien
tcagagaaggctgacatccctccga

SEQ ID NO: 215772 - DNA, 25 bp, Homo sapien
ggccgcaaaccagcaagatggcgtc

SEQ ID NO: 215773 - DNA, 25 bp, Homo sapien
caaaccagcaagatggcgtccggcc

SEQ ID NO: 215774 - DNA, 25 bp, Homo sapien
gcggccgacataagcggttgactca

SEQ ID NO: 215775 - DNA, 25 bp, Homo sapien
ctggactgcgacggctaggacccgc

SEQ ID NO: 215776 - DNA, 25 bp, Homo sapien
ggcggggaagaaacaccagcaactc

SEQ ID NO: 215777 - DNA, 25 bp, Homo sapien
aagaaacaccagcaactcggcggcc

SEQ ID NO: 215778 - DNA, 25 bp, Homo sapien
ccgcctcgccgcagatcacgtgccc

SEQ ID NO: 215779 - DNA, 25 bp, Homo sapien
tgcgcgggttcagagtcctcagcag

SEQ ID NO: 215780 - DNA, 25 bp, Homo sapien
cgggttcagagtcctcagcagccac

SEQ ID NO: 215781 - DNA, 25 bp, Homo sapien
cggcccgcgcccacttacccacagg

SEQ ID NO: 215782 - DNA, 25 bp, Homo sapien
cacttacccacaggggctccgctcc

SEQ ID NO: 215783 - DNA, 25 bp, Homo sapien
cgtctcttgtttgtgcggctgacca

SEQ ID NO: 215784 - DNA, 25 bp, Homo sapien
ggcccactggtgtcttcgagaaatc

SEQ ID NO: 215785 - DNA, 25 bp, Homo sapien
tcgcgaagctggaagacaatcacta

SEQ ID NO: 215786 - DNA, 25 bp, Homo sapien
atccgcttttccgtgtgttcgccga

SEQ ID NO: 215787 - DNA, 25 bp, Homo sapien
cggccctagcgcattgtaagcagtt

SEQ ID NO: 215788 - DNA, 25 bp, Homo sapien
gccacggtccaagagcagagctagc

SEQ ID NO: 215789 - DNA, 25 bp, Homo sapien
gacttctcacgtgttttgctgccca

SEQ ID NO: 215790 - DNA, 25 bp, Homo sapien
cgggtcggatttcgctcttgagaca

SEQ ID NO: 215791 - DNA, 25 bp, Homo sapien
cacacctaggctgcggattccgaga

SEQ ID NO: 215792 - DNA, 25 bp, Homo sapien
gttgtttaaagactggcacccgctc

SEQ ID NO: 215793 - DNA, 25 bp, Homo sapien
ggaaacatcttcgtgggacccatcg

SEQ ID NO: 215794 - DNA, 25 bp, Homo sapien
tctccgcgagacatagctaaacttg

SEQ ID NO: 215795 - DNA, 25 bp, Homo sapien
ctaccctttggtcagccgcattcta

SEQ ID NO: 215796 - DNA, 25 bp, Homo sapien
tcccggttccgaaagtgtgcagcca

SEQ ID NO: 215797 - DNA, 25 bp, Homo sapien
gacgtggacggatcttttgctccta

SEQ ID NO: 215798 - DNA, 25 bp, Homo sapien
cgggcgcattttgaatcgaaactcc

SEQ ID NO: 215799 - DNA, 25 bp, Homo sapien
ccaggtccacgtagttgctccagta

SEQ ID NO: 215800 - DNA, 25 bp, Homo sapien
tacacgtcggtgtgttgtgacagcc

SEQ ID NO: 215801 - DNA, 25 bp, Homo sapien
ctggagtaccacgtgcttaggaggc

SEQ ID NO: 215802 - DNA, 25 bp, Homo sapien
tcactccgcatgctggcaaagaagt

SEQ ID NO: 215803 - DNA, 25 bp, Homo sapien
ctcgtcgaagagcttctgctccagg

SEQ ID NO: 215804 - DNA, 25 bp, Homo sapien
tgctccagtatctgcgctgcaggaa

SEQ ID NO: 215805 - DNA, 25 bp, Homo sapien
cgcggcatttcacctgcgaacactg

SEQ ID NO: 215806 - DNA, 25 bp, Homo sapien
gaagtcccgcgcatgctcacagcag

SEQ ID NO: 215807 - DNA, 25 bp, Homo sapien
gggaccatcgctcgagggcaaatcc

SEQ ID NO: 215808 - DNA, 25 bp, Homo sapien
tgccctgccggggtattccaaatct

SEQ ID NO: 215809 - DNA, 25 bp, Homo sapien
ggaagaagtcagaaggccgcctgtc

SEQ ID NO: 215810 - DNA, 25 bp, Homo sapien
gcgcgagccgtctcctttgcacttt

SEQ ID NO: 215811 - DNA, 25 bp, Homo sapien
atgcatcatggccacgctggcttgc

SEQ ID NO: 215812 - DNA, 25 bp, Homo sapien
ttcttggacgacacggaccctttca

SEQ ID NO: 215813 - DNA, 25 bp, Homo sapien
aggcgccgcacaaggtacgacccgg

SEQ ID NO: 215814 - DNA, 25 bp, Homo sapien
cgctgttcacgttccgcgaggacct

SEQ ID NO: 215815 - DNA, 25 bp, Homo sapien
ttagctactttccatccacctcagt

SEQ ID NO: 215816 - DNA, 25 bp, Homo sapien
aagtagcaacggcttacctccgcgc

SEQ ID NO: 215817 - DNA, 25 bp, Homo sapien
ctgtgggcttcagaaggccctgctc

SEQ ID NO: 215818 - DNA, 25 bp, Homo sapien
gtctgaagtcactccagcaagtccc

SEQ ID NO: 215819 - DNA, 25 bp, Homo sapien
ggcctggaggtctgaagtcactcca

SEQ ID NO: 215820 - DNA, 25 bp, Homo sapien
ttgtccttctaagggtgggcctgga

SEQ ID NO: 215821 - DNA, 25 bp, Homo sapien
cccttcattgtccttctaagggtgg

SEQ ID NO: 215822 - DNA, 25 bp, Homo sapien
acagcctttcccatcttagctactt

SEQ ID NO: 215823 - DNA, 25 bp, Homo sapien
cacgagaacatgaaggctgtgctga

SEQ ID NO: 215824 - DNA, 25 bp, Homo sapien
aaggctgtgctgaaaacctcgtccc

SEQ ID NO: 215825 - DNA, 25 bp, Homo sapien
cacacgcagccgagcaagccgaggt

SEQ ID NO: 215826 - DNA, 25 bp, Homo sapien
aagccgaggtaactcctggctgcgc

SEQ ID NO: 215827 - DNA, 25 bp, Homo sapien
ggctcgtcttgtcttctcaggttgg

SEQ ID NO: 215828 - DNA, 25 bp, Homo sapien
tccggtctccatcgcaggctgcggt

SEQ ID NO: 215829 - DNA, 25 bp, Homo sapien
ttgtcttctcaggttggccgctctg

SEQ ID NO: 215830 - DNA, 25 bp, Homo sapien
acgcggctgagcacgagaacatgaa

SEQ ID NO: 215831 - DNA, 25 bp, Homo sapien
tcctcacctaggatgcgcgtgatgc

SEQ ID NO: 215832 - DNA, 25 bp, Homo sapien
gcttctccaggtgcggcttgctgca

SEQ ID NO: 215833 - DNA, 25 bp, Homo sapien
cagcgccgaggccaatttcatggca

SEQ ID NO: 215834 - DNA, 25 bp, Homo sapien
atttcatggcatgccgggaacggta

SEQ ID NO: 215835 - DNA, 25 bp, Homo sapien
aacggtagttctcggcgcctgaaag

SEQ ID NO: 215836 - DNA, 25 bp, Homo sapien
gttggtctgacagcagcagctccgt

SEQ ID NO: 215837 - DNA, 25 bp, Homo sapien
cccgagtggcggttgtttcaagatg

SEQ ID NO: 215838 - DNA, 25 bp, Homo sapien
ggactgtatcctttgcccgcctgac

SEQ ID NO: 215839 - DNA, 25 bp, Homo sapien
aaggcgagtgaagcggaaggtgagt

SEQ ID NO: 215840 - DNA, 25 bp, Homo sapien
agcgagaggcgaggatgacggcggc

SEQ ID NO: 215841 - DNA, 25 bp, Homo sapien
cgaccgacggcgtggcctccaccgg

SEQ ID NO: 215842 - DNA, 25 bp, Homo sapien
cctccaccggcgtcggcagccaggc

SEQ ID NO: 215843 - DNA, 25 bp, Homo sapien
tgtggggcgagttcggcctggccct

SEQ ID NO: 215844 - DNA, 25 bp, Homo sapien
gcctggcccttggggacaacggcat

SEQ ID NO: 215845 - DNA, 25 bp, Homo sapien
ggacaacggcatccgactgcactcg

SEQ ID NO: 215846 - DNA, 25 bp, Homo sapien
ggggacaacggcatccgactgcact

SEQ ID NO: 215847 - DNA, 25 bp, Homo sapien
caaggcaccagtgagggtccggccc

SEQ ID NO: 215848 - DNA, 25 bp, Homo sapien
cgcagcgggtccaaggcaccagtga

SEQ ID NO: 215849 - DNA, 25 bp, Homo sapien
ttacctgtgcgagtcctggtctccc

SEQ ID NO: 215850 - DNA, 25 bp, Homo sapien
ctcagtacgggcgattggcgtcttt

SEQ ID NO: 215851 - DNA, 25 bp, Homo sapien
gctcacgaagcctggcgagacacga

SEQ ID NO: 215852 - DNA, 25 bp, Homo sapien
ggacactgtcctccctgacaggagg

SEQ ID NO: 215853 - DNA, 25 bp, Homo sapien
gaggcgccgccgagaaacttctcca

SEQ ID NO: 215854 - DNA, 25 bp, Homo sapien
tggaggagtttattggacactgtcc

SEQ ID NO: 215855 - DNA, 25 bp, Homo sapien
gagtacttcacaaaggcgcaccctg

SEQ ID NO: 215856 - DNA, 25 bp, Homo sapien
agcactcaccggcatggtctggctg

SEQ ID NO: 215857 - DNA, 25 bp, Homo sapien
ggcccggaataagggtcatgctttc

SEQ ID NO: 215858 - DNA, 25 bp, Homo sapien
gcattttccacctgggtaacctcag

SEQ ID NO: 215859 - DNA, 25 bp, Homo sapien
tcggcgaacttgaccaccagactgg

SEQ ID NO: 215860 - DNA, 25 bp, Homo sapien
atctgctgcattcgccgcatcgtgc

SEQ ID NO: 215861 - DNA, 25 bp, Homo sapien
ggggttgaacatgcccatctggcca

SEQ ID NO: 215862 - DNA, 25 bp, Homo sapien
tgcactcctcgatgttcccaaaggc

SEQ ID NO: 215863 - DNA, 25 bp, Homo sapien
gaaagtctatcgagctcctgaggtc

SEQ ID NO: 215864 - DNA, 25 bp, Homo sapien
gagctcctgaggtctcgtcaaggca

SEQ ID NO: 215865 - DNA, 25 bp, Homo sapien
tctcgtcaaggcaggcgctggccct

SEQ ID NO: 215866 - DNA, 25 bp, Homo sapien
gtctctccaggccattaaacactaa

SEQ ID NO: 215867 - DNA, 25 bp, Homo sapien
caggccattaaacactaattaggtt

SEQ ID NO: 215868 - DNA, 25 bp, Homo sapien
gggtgccctttgaaatgccagtgct

SEQ ID NO: 215869 - DNA, 25 bp, Homo sapien
aggtttagaaagtctatcgagctcc

SEQ ID NO: 215870 - DNA, 25 bp, Homo sapien
gcggcgtctctccaggccattaaac

SEQ ID NO: 215871 - DNA, 25 bp, Homo sapien
aactgaactggagaccaccatcccg

SEQ ID NO: 215872 - DNA, 25 bp, Homo sapien
actgaactggagaccaccatcccgt

SEQ ID NO: 215873 - DNA, 25 bp, Homo sapien
ttcaactgaactggagaccaccatc

SEQ ID NO: 215874 - DNA, 25 bp, Homo sapien
tttcaactgaactggagaccaccat

SEQ ID NO: 215875 - DNA, 25 bp, Homo sapien
atttcaactgaactggagaccacca

SEQ ID NO: 215876 - DNA, 25 bp, Homo sapien
aatttcaactgaactggagaccacc

SEQ ID NO: 215877 - DNA, 25 bp, Homo sapien
gaaatttcaactgaactggagacca

SEQ ID NO: 215878 - DNA, 25 bp, Homo sapien
tcaactgaactggagaccaccatcc

SEQ ID NO: 215879 - DNA, 25 bp, Homo sapien
ctcctctgggatgaacacgctgacg

SEQ ID NO: 215880 - DNA, 25 bp, Homo sapien
agggccttctcgttcttcaaccacg

SEQ ID NO: 215881 - DNA, 25 bp, Homo sapien
ggtcctcccagcctcgaacttgagg

SEQ ID NO: 215882 - DNA, 25 bp, Homo sapien
tcacgccgttgatggtgaagtacgc

SEQ ID NO: 215883 - DNA, 25 bp, Homo sapien
cagcccgtatttgcccgagtcagcg

SEQ ID NO: 215884 - DNA, 25 bp, Homo sapien
ttgttcttcacaaccagcccgtatt

SEQ ID NO: 215885 - DNA, 25 bp, Homo sapien
ggtctccgagccatacttgttcttc

SEQ ID NO: 215886 - DNA, 25 bp, Homo sapien
aacacgctgacggtgaagtcgctgg

SEQ ID NO: 215887 - DNA, 25 bp, Homo sapien
tgtcaccataacaaccggagcgagg

SEQ ID NO: 215888 - DNA, 25 bp, Homo sapien
gggtgccaccatactcgcctgatgt

SEQ ID NO: 215889 - DNA, 25 bp, Homo sapien
agacgctcattcaccggcgcagctg

SEQ ID NO: 215890 - DNA, 25 bp, Homo sapien
gccaaggaccgcgaagtccagagaa

SEQ ID NO: 215891 - DNA, 25 bp, Homo sapien
agcgccgaacctcctggggccggat

SEQ ID NO: 215892 - DNA, 25 bp, Homo sapien
gccggatgccatgggtaacaacttc

SEQ ID NO: 215893 - DNA, 25 bp, Homo sapien
tttccgtgctgggaataaggccagc

SEQ ID NO: 215894 - DNA, 25 bp, Homo sapien
cgcgcgcgtgtcactaagacgctca

SEQ ID NO: 215895 - DNA, 25 bp, Homo sapien
gacaactggcgcgttcctctgggcg

SEQ ID NO: 215896 - DNA, 25 bp, Homo sapien
ggcctccatagcaaccgagctgtga

SEQ ID NO: 215897 - DNA, 25 bp, Homo sapien
gtgcagccgccgtgaccttagacct

SEQ ID NO: 215898 - DNA, 25 bp, Homo sapien
tgaccttagacctggccggcgtcca

SEQ ID NO: 215899 - DNA, 25 bp, Homo sapien
cgtccacgggcataccatgcgggca

SEQ ID NO: 215900 - DNA, 25 bp, Homo sapien
ataccatgcgggcaccaggcaggcc

SEQ ID NO: 215901 - DNA, 25 bp, Homo sapien
ccgtgagctgcccttggtccagcag

SEQ ID NO: 215902 - DNA, 25 bp, Homo sapien
cgagctgtgaccatggccagagaga

SEQ ID NO: 215903 - DNA, 25 bp, Homo sapien
accgcggtgatctcacttgcggcgc

SEQ ID NO: 215904 - DNA, 25 bp, Homo sapien
tggctccttaaataaaccgcggtga

SEQ ID NO: 215905 - DNA, 25 bp, Homo sapien
actcgatgggcggactcgatcgcgc

SEQ ID NO: 215906 - DNA, 25 bp, Homo sapien
aggctgcccgcgcaggaacttcacg

SEQ ID NO: 215907 - DNA, 25 bp, Homo sapien
ccgggcagagtcttctgctcgtgca

SEQ ID NO: 215908 - DNA, 25 bp, Homo sapien
gtcttctgctcgtgcagcgcgctct

SEQ ID NO: 215909 - DNA, 25 bp, Homo sapien
cgaggcgcgatagtttatcaaagac

SEQ ID NO: 215910 - DNA, 25 bp, Homo sapien
tttatcaaagacgagggctggctcc

SEQ ID NO: 215911 - DNA, 25 bp, Homo sapien
caattaccgagccattaagggcggg

SEQ ID NO: 215912 - DNA, 25 bp, Homo sapien
ccggagcgggaagatccacaccgcg

SEQ ID NO: 215913 - DNA, 25 bp, Homo sapien
atccacaccgcggagcagccgtagg

SEQ ID NO: 215914 - DNA, 25 bp, Homo sapien
gcagccgtaggaaatattgatatta

SEQ ID NO: 215915 - DNA, 25 bp, Homo sapien
aatattgatattagccgacctctgg

SEQ ID NO: 215916 - DNA, 25 bp, Homo sapien
tccgcccgcggtgaaaataagacgc

SEQ ID NO: 215917 - DNA, 25 bp, Homo sapien
ggggccaatcaattaccgagccatt

SEQ ID NO: 215918 - DNA, 25 bp, Homo sapien
gtgaaaataagacgcggggccaatc

SEQ ID NO: 215919 - DNA, 25 bp, Homo sapien
tgggcgcttttttcttccatctggc

SEQ ID NO: 215920 - DNA, 25 bp, Homo sapien
ggggctttatccaccaagctatgct

SEQ ID NO: 215921 - DNA, 25 bp, Homo sapien
gagcgcgcattcatcagtgtcgaga

SEQ ID NO: 215922 - DNA, 25 bp, Homo sapien
tagacaagagctctctcgcgcgcgc

SEQ ID NO: 215923 - DNA, 25 bp, Homo sapien
atttagactagaaaagcgagccggc

SEQ ID NO: 215924 - DNA, 25 bp, Homo sapien
ctatgctctattagggcgccaggcg

SEQ ID NO: 215925 - DNA, 25 bp, Homo sapien
gttcaagttcccagccagaccaggg

SEQ ID NO: 215926 - DNA, 25 bp, Homo sapien
caggctggaccggttcaagttccca

SEQ ID NO: 215927 - DNA, 25 bp, Homo sapien
agcttcagaatcctgctgccatcta

SEQ ID NO: 215928 - DNA, 25 bp, Homo sapien
aatagaccagaaagggctgcccagg

SEQ ID NO: 215929 - DNA, 25 bp, Homo sapien
atgaagcgtcttcccgcgtacagcc

SEQ ID NO: 215930 - DNA, 25 bp, Homo sapien
ccctggcaatctgttcaggaaaata

SEQ ID NO: 215931 - DNA, 25 bp, Homo sapien
ccggcttgctcttctgtctgagctg

SEQ ID NO: 215932 - DNA, 25 bp, Homo sapien
gcctggctgtttagccgccgtatcc

SEQ ID NO: 215933 - DNA, 25 bp, Homo sapien
tctagggatgagatgaagcgtcttc

SEQ ID NO: 215934 - DNA, 25 bp, Homo sapien
cgtacagccgccctgatggatcgct

SEQ ID NO: 215935 - DNA, 25 bp, Homo sapien
tcagcggaccgaactgcacagctca

SEQ ID NO: 215936 - DNA, 25 bp, Homo sapien
cctttcactaggagtccgggattcg

SEQ ID NO: 215937 - DNA, 25 bp, Homo sapien
aacgctccaacccatcctttgaaga

SEQ ID NO: 215938 - DNA, 25 bp, Homo sapien
ctaaaattagcagggctcgccgcgc

SEQ ID NO: 215939 - DNA, 25 bp, Homo sapien
tgtgattactccaggactcctcggg

SEQ ID NO: 215940 - DNA, 25 bp, Homo sapien
tctctctccataaatcggtggcgcg

SEQ ID NO: 215941 - DNA, 25 bp, Homo sapien
gctcgccgtttgacagatgctcatc

SEQ ID NO: 215942 - DNA, 25 bp, Homo sapien
ctcatcgccatggagttgccgcagc

SEQ ID NO: 215943 - DNA, 25 bp, Homo sapien
gaagccgggccaaacgcagtctttg

SEQ ID NO: 215944 - DNA, 25 bp, Homo sapien
gggctcctgaatgaagctgttatgc

SEQ ID NO: 215945 - DNA, 25 bp, Homo sapien
cgaggcttcgattctgagaagattc

SEQ ID NO: 215946 - DNA, 25 bp, Homo sapien
cgcccaagagccagtgggaaatgcc

SEQ ID NO: 215947 - DNA, 25 bp, Homo sapien
cgcagtctttgcatgagtgtggccc

SEQ ID NO: 215948 - DNA, 25 bp, Homo sapien
aaatgccggcggtggcagttcacac

SEQ ID NO: 215949 - DNA, 25 bp, Homo sapien
atgtcggattgatttcggggccttt

SEQ ID NO: 215950 - DNA, 25 bp, Homo sapien
ggagagtcgcctgcatcgtccaacc

SEQ ID NO: 215951 - DNA, 25 bp, Homo sapien
cagaatccggccagacgacggggct

SEQ ID NO: 215952 - DNA, 25 bp, Homo sapien
ccgggcaggcagaatccggccagac

SEQ ID NO: 215953 - DNA, 25 bp, Homo sapien
ttcagtacggctggatcctccgcag

SEQ ID NO: 215954 - DNA, 25 bp, Homo sapien
accacgcggcgcttcagtacggctg

SEQ ID NO: 215955 - DNA, 25 bp, Homo sapien
aagcttgtctgagcttcaccgcagc

SEQ ID NO: 215956 - DNA, 25 bp, Homo sapien
gggagacaccttcagaagaagcttg

SEQ ID NO: 215957 - DNA, 25 bp, Homo sapien
agccatcaggagctcttgggaaagc

SEQ ID NO: 215958 - DNA, 25 bp, Homo sapien
tgggaaagcaaagcagggagacacc

SEQ ID NO: 215959 - DNA, 25 bp, Homo sapien
cttgctcacgggcatgtcgggaaac

SEQ ID NO: 215960 - DNA, 25 bp, Homo sapien
cccaagccctagcattctcaggaaa

SEQ ID NO: 215961 - DNA, 25 bp, Homo sapien
tatgactcaagtgccgcagtgcttg

SEQ ID NO: 215962 - DNA, 25 bp, Homo sapien
tgcaaagccgaaggggcagcctcag

SEQ ID NO: 215963 - DNA, 25 bp, Homo sapien
ccttacccgtctggcgggtcttatg

SEQ ID NO: 215964 - DNA, 25 bp, Homo sapien
ctctgcaaagcagggtttctgggcc

SEQ ID NO: 215965 - DNA, 25 bp, Homo sapien
tgggccgtgatcgagtcttgctcac

SEQ ID NO: 215966 - DNA, 25 bp, Homo sapien
ctgctggaagctgggttccttccga

SEQ ID NO: 215967 - DNA, 25 bp, Homo sapien
gtcaacatctcggtgctgcccagtc

SEQ ID NO: 215968 - DNA, 25 bp, Homo sapien
accacctgggagcttgacacaaatg

SEQ ID NO: 215969 - DNA, 25 bp, Homo sapien
taggcattgccgtgactctcgtaga

SEQ ID NO: 215970 - DNA, 25 bp, Homo sapien
tgtgtgctaccagcccggaaagaca

SEQ ID NO: 215971 - DNA, 25 bp, Homo sapien
tgccagaccctgatatacaaagatg

SEQ ID NO: 215972 - DNA, 25 bp, Homo sapien
ccctgctctgcgacaataatggcca

SEQ ID NO: 215973 - DNA, 25 bp, Homo sapien
ttcgcccaaggccacatctgtattg

SEQ ID NO: 215974 - DNA, 25 bp, Homo sapien
ggcgacgtccatgaccgctacgaga

SEQ ID NO: 215975 - DNA, 25 bp, Homo sapien
tctccacggtaaggccccgcggatg

SEQ ID NO: 215976 - DNA, 25 bp, Homo sapien
acccggagcactctccacggtaagg

SEQ ID NO: 215977 - DNA, 25 bp, Homo sapien
ggggacagatcacccggagcactct

SEQ ID NO: 215978 - DNA, 25 bp, Homo sapien
ctgcactgcccgtcgccggagatgg

SEQ ID NO: 215979 - DNA, 25 bp, Homo sapien
agaggtggctgcactgcccgtcgcc

SEQ ID NO: 215980 - DNA, 25 bp, Homo sapien
cagcagaggtggctgcactgcccgt

SEQ ID NO: 215981 - DNA, 25 bp, Homo sapien
ggggcgactcggtgaccagccggcc

SEQ ID NO: 215982 - DNA, 25 bp, Homo sapien
gccctgccatgccggtctccgcccg

SEQ ID NO: 215983 - DNA, 25 bp, Homo sapien
cccgattcaagagggtttgcgcaaa

SEQ ID NO: 215984 - DNA, 25 bp, Homo sapien
tcgatttccctacaaggacttgggc

SEQ ID NO: 215985 - DNA, 25 bp, Homo sapien
gccacaggacggacgcaaccatctg

SEQ ID NO: 215986 - DNA, 25 bp, Homo sapien
ggacccagaggaccattatatattg

SEQ ID NO: 215987 - DNA, 25 bp, Homo sapien
gcttccttccggcttgctaagcaga

SEQ ID NO: 215988 - DNA, 25 bp, Homo sapien
tgctcggattctcgtagctgtgccg

SEQ ID NO: 215989 - DNA, 25 bp, Homo sapien
aactctggaaatgtggcttcgctca

SEQ ID NO: 215990 - DNA, 25 bp, Homo sapien
acttcgctcctgtgcccaaacttgg

SEQ ID NO: 215991 - DNA, 25 bp, Homo sapien
actgcgcgcaaggaagaaaccctga

SEQ ID NO: 215992 - DNA, 25 bp, Homo sapien
ctggcctccggactgtcacatgatc

SEQ ID NO: 215993 - DNA, 25 bp, Homo sapien
ggccgcaacgtaggacaaaccactc

SEQ ID NO: 215994 - DNA, 25 bp, Homo sapien
accactccaggacgcatttgcactg

SEQ ID NO: 215995 - DNA, 25 bp, Homo sapien
tctgcggaacctcactcagtgcgga

SEQ ID NO: 215996 - DNA, 25 bp, Homo sapien
cacccgcgtcggcttgaagaaatcc

SEQ ID NO: 215997 - DNA, 25 bp, Homo sapien
ggttagcctaaatccgcactgcgcg

SEQ ID NO: 215998 - DNA, 25 bp, Homo sapien
tgcgcttcaagcaacctgcccggtt

SEQ ID NO: 215999 - DNA, 25 bp, Homo sapien
gcagtgaggtttcacgcgagcgcct

SEQ ID NO: 216000 - DNA, 25 bp, Homo sapien
gcgcatgcgcagtgaggtttcacgc

SEQ ID NO: 216001 - DNA, 25 bp, Homo sapien
ggaaccgcccgacgctggagaagac

SEQ ID NO: 216002 - DNA, 25 bp, Homo sapien
ggctgccgcttcatcccagcgaaaa

SEQ ID NO: 216003 - DNA, 25 bp, Homo sapien
agccgaagcgttagcccggaacgag

SEQ ID NO: 216004 - DNA, 25 bp, Homo sapien
gaaccgcagcgaagccgaagcgtta

SEQ ID NO: 216005 - DNA, 25 bp, Homo sapien
tgaaactgcacagtagaaccgcagc

SEQ ID NO: 216006 - DNA, 25 bp, Homo sapien
ctgaggagccgaatgaaactgcaca

SEQ ID NO: 216007 - DNA, 25 bp, Homo sapien
gcgtcgggccacgatcaatatatca

SEQ ID NO: 216008 - DNA, 25 bp, Homo sapien
ggctctctgcgtcctcaggagcacg

SEQ ID NO: 216009 - DNA, 25 bp, Homo sapien
caaaagtttcccttgaacagtgagc

SEQ ID NO: 216010 - DNA, 25 bp, Homo sapien
tcccttgaacagtgagcgcgtcatc

SEQ ID NO: 216011 - DNA, 25 bp, Homo sapien
cagtgagcgcgtcatcgcagcgcga

SEQ ID NO: 216012 - DNA, 25 bp, Homo sapien
gcagactcaacttctgcgttccaca

SEQ ID NO: 216013 - DNA, 25 bp, Homo sapien
tgcgttccacactcgcgcagggaag

SEQ ID NO: 216014 - DNA, 25 bp, Homo sapien
ggtcctaaaccactcccgattgcga

SEQ ID NO: 216015 - DNA, 25 bp, Homo sapien
atggccgagccgcaaagaaggtcaa

SEQ ID NO: 216016 - DNA, 25 bp, Homo sapien
cgcaggtgacgagcaaaagggcacc

SEQ ID NO: 216017 - DNA, 25 bp, Homo sapien
agaaggtcaagacagccggcccacc

SEQ ID NO: 216018 - DNA, 25 bp, Homo sapien
ctgactgggacaaaatggccgagcc

SEQ ID NO: 216019 - DNA, 25 bp, Homo sapien
caggcggtacttctgcagccgcagc

SEQ ID NO: 216020 - DNA, 25 bp, Homo sapien
ctttgcagttactccgcaggcggta

SEQ ID NO: 216021 - DNA, 25 bp, Homo sapien
aacgcgcacggacagcatctttgca

SEQ ID NO: 216022 - DNA, 25 bp, Homo sapien
aaaagggcacctgtgtcgcctgctc

SEQ ID NO: 216023 - DNA, 25 bp, Homo sapien
cttctggtgatcgagggacaattgc

SEQ ID NO: 216024 - DNA, 25 bp, Homo sapien
ggcggcttccacatctgaactgctt

SEQ ID NO: 216025 - DNA, 25 bp, Homo sapien
cccgtgcttagactctcctgaaggc

SEQ ID NO: 216026 - DNA, 25 bp, Homo sapien
gtgcgcgccacgtctacttttctct

SEQ ID NO: 216027 - DNA, 25 bp, Homo sapien
ttcctagtaaagtggcgggagccgc

SEQ ID NO: 216028 - DNA, 25 bp, Homo sapien
gcgcatctcccgctaggagttccta

SEQ ID NO: 216029 - DNA, 25 bp, Homo sapien
agagccttcgaccagccttgcacag

SEQ ID NO: 216030 - DNA, 25 bp, Homo sapien
gctcaacggccaggagtctcaggta

SEQ ID NO: 216031 - DNA, 25 bp, Homo sapien
gcgctgtcctttgctgaaggcattg

SEQ ID NO: 216032 - DNA, 25 bp, Homo sapien
aggcattgtccttggcttgcattga

SEQ ID NO: 216033 - DNA, 25 bp, Homo sapien
ggcttgcattgagtggctttcccac

SEQ ID NO: 216034 - DNA, 25 bp, Homo sapien
acatttcgggaaggtgacggtctca

SEQ ID NO: 216035 - DNA, 25 bp, Homo sapien
agcgcgggttccatcgcgccagatg

SEQ ID NO: 216036 - DNA, 25 bp, Homo sapien
gccagatggcgctgtctggcttttc

SEQ ID NO: 216037 - DNA, 25 bp, Homo sapien
acggcctctggtgacattttcttgg

SEQ ID NO: 216038 - DNA, 25 bp, Homo sapien
gaagcgacttcacggccctggagtt

SEQ ID NO: 216039 - DNA, 25 bp, Homo sapien
agggagcctttccatgggccatctg

SEQ ID NO: 216040 - DNA, 25 bp, Homo sapien
ggctatctcgtgcttccagtgtttg

SEQ ID NO: 216041 - DNA, 25 bp, Homo sapien
ggaacgcacctccacatgtctgagt

SEQ ID NO: 216042 - DNA, 25 bp, Homo sapien
ggacctcagggtcgtgtgcactaag

SEQ ID NO: 216043 - DNA, 25 bp, Homo sapien
tgcccgcagtcaggctctacacgtg

SEQ ID NO: 216044 - DNA, 25 bp, Homo sapien
cgtgcccgtctctctgcactaagga

SEQ ID NO: 216045 - DNA, 25 bp, Homo sapien
cgcgtcctgcgttaacaaggcgttt

SEQ ID NO: 216046 - DNA, 25 bp, Homo sapien
tgttcgcattccagcttcccttgtg

SEQ ID NO: 216047 - DNA, 25 bp, Homo sapien
tcctcctccggcgtgaggtccacct

SEQ ID NO: 216048 - DNA, 25 bp, Homo sapien
accaggtgccgcagccacacggtgt

SEQ ID NO: 216049 - DNA, 25 bp, Homo sapien
cacacggtgtccacgaaccagctgg

SEQ ID NO: 216050 - DNA, 25 bp, Homo sapien
gtcggccgcctcaagctgttcaaag

SEQ ID NO: 216051 - DNA, 25 bp, Homo sapien
gtccacgaaccagctgggcccaaag

SEQ ID NO: 216052 - DNA, 25 bp, Homo sapien
tgcccgagccggagcttatagacct

SEQ ID NO: 216053 - DNA, 25 bp, Homo sapien
agcttatagacctcgcccacgtcgg

SEQ ID NO: 216054 - DNA, 25 bp, Homo sapien
cgcctcaagctgttcaaagggcagg

SEQ ID NO: 216055 - DNA, 25 bp, Homo sapien
gcatcattctgtcggctgccttctc

SEQ ID NO: 216056 - DNA, 25 bp, Homo sapien
ttgtagtactcgtgttccagctccc

SEQ ID NO: 216057 - DNA, 25 bp, Homo sapien
tcgtcgtcctccgaggcgtagttca

SEQ ID NO: 216058 - DNA, 25 bp, Homo sapien
aggcgtagttcagcagctccgcttc

SEQ ID NO: 216059 - DNA, 25 bp, Homo sapien
gctccgcttcgtacagggccaggaa

SEQ ID NO: 216060 - DNA, 25 bp, Homo sapien
ggccaggaagtcgatgtccttcttc

SEQ ID NO: 216061 - DNA, 25 bp, Homo sapien
tttcttctggggcatcattctgtcg

SEQ ID NO: 216062 - DNA, 25 bp, Homo sapien
cgcacctctggccttgtagtactcg

SEQ ID NO: 216063 - DNA, 25 bp, Homo sapien
cgcagccgctttggatgctcttcgg

SEQ ID NO: 216064 - DNA, 25 bp, Homo sapien
tctcccgcgcagatagcgagctggt

SEQ ID NO: 216065 - DNA, 25 bp, Homo sapien
ctctcggtgagcctatgcgacctca

SEQ ID NO: 216066 - DNA, 25 bp, Homo sapien
ggcgagctgcacctcagccacaatg

SEQ ID NO: 216067 - DNA, 25 bp, Homo sapien
tgcacgggaccatcacgcagatccg

SEQ ID NO: 216068 - DNA, 25 bp, Homo sapien
cgcagatccgcatcctcggtgagtg

SEQ ID NO: 216069 - DNA, 25 bp, Homo sapien
tggccgagaccatcttcgtcaaggt

SEQ ID NO: 216070 - DNA, 25 bp, Homo sapien
gcgccattagccatccgggattgta

SEQ ID NO: 216071 - DNA, 25 bp, Homo sapien
tagcgcgacacgttgaccaggtact

SEQ ID NO: 216072 - DNA, 25 bp, Homo sapien
gacgcggcttgacgttgtcatagta

SEQ ID NO: 216073 - DNA, 25 bp, Homo sapien
tcacagagctccagcgccgcagtga

SEQ ID NO: 216074 - DNA, 25 bp, Homo sapien
agtagtagacagcttgcggcgattc

SEQ ID NO: 216075 - DNA, 25 bp, Homo sapien
gcgattcgaagtcgtccagcacgta

SEQ ID NO: 216076 - DNA, 25 bp, Homo sapien
agcacgtacttgacgcggatggaca

SEQ ID NO: 216077 - DNA, 25 bp, Homo sapien
gacgcgttctcgtacacctgcagca

SEQ ID NO: 216078 - DNA, 25 bp, Homo sapien
cccagaagccaaagaggtgcacctc

SEQ ID NO: 216079 - DNA, 25 bp, Homo sapien
gcaggacctgtcagactggctgaga

SEQ ID NO: 216080 - DNA, 25 bp, Homo sapien
cgtcgggtgagtcgcgctcgactct

SEQ ID NO: 216081 - DNA, 25 bp, Homo sapien
cttcgctgtcgtttgtggtctcgcg

SEQ ID NO: 216082 - DNA, 25 bp, Homo sapien
gcctaacgctcttcgctgtcgtttg

SEQ ID NO: 216083 - DNA, 25 bp, Homo sapien
cccttcaggcaggaagtgtcggcgc

SEQ ID NO: 216084 - DNA, 25 bp, Homo sapien
gcaggccgcgatatcgcagcggatc

SEQ ID NO: 216085 - DNA, 25 bp, Homo sapien
ggtcaaattccagcggcctgcccag

SEQ ID NO: 216086 - DNA, 25 bp, Homo sapien
atcgcggcccactcgggtcaaattc

SEQ ID NO: 216087 - DNA, 25 bp, Homo sapien
caatggactttcttacctcttaatg

SEQ ID NO: 216088 - DNA, 25 bp, Homo sapien
caatggggagcaagacccgggctcc

SEQ ID NO: 216089 - DNA, 25 bp, Homo sapien
cttcgaggggcaaagtttctggttg

SEQ ID NO: 216090 - DNA, 25 bp, Homo sapien
gcaaggtcaccaaggcaaaggcgca

SEQ ID NO: 216091 - DNA, 25 bp, Homo sapien
atacaggatctgttgcagcaaggtc

SEQ ID NO: 216092 - DNA, 25 bp, Homo sapien
cccgcagcaagggatcgcgaaggtt

SEQ ID NO: 216093 - DNA, 25 bp, Homo sapien
ggcctccggttctgccgatagggac

SEQ ID NO: 216094 - DNA, 25 bp, Homo sapien
acctcttaatgtagttcctgccata

SEQ ID NO: 216095 - DNA, 25 bp, Homo sapien
atgcgaatgtcgtgcctctcagaaa

SEQ ID NO: 216096 - DNA, 25 bp, Homo sapien
cggcgcccaactcctacaaggaaga

SEQ ID NO: 216097 - DNA, 25 bp, Homo sapien
actcggcagccgttcgtcaaagacc

SEQ ID NO: 216098 - DNA, 25 bp, Homo sapien
actgggaccttgtctcatccttgga

SEQ ID NO: 216099 - DNA, 25 bp, Homo sapien
tccttggaaccactcgtaaatctta

SEQ ID NO: 216100 - DNA, 25 bp, Homo sapien
ctacatccggaaagattcgtgcttc

SEQ ID NO: 216101 - DNA, 25 bp, Homo sapien
tgtcatcctaacaccgcagaggctc

SEQ ID NO: 216102 - DNA, 25 bp, Homo sapien
taaatcttaggtcaggcagccggca

SEQ ID NO: 216103 - DNA, 25 bp, Homo sapien
cgcaactgaggcgttatccgcgggc

SEQ ID NO: 216104 - DNA, 25 bp, Homo sapien
gccctcactgcgaaccgggatgtcg

SEQ ID NO: 216105 - DNA, 25 bp, Homo sapien
actgcctagagctgggtcgcaactg

SEQ ID NO: 216106 - DNA, 25 bp, Homo sapien
cgtgacaggagcattcgggaagatt

SEQ ID NO: 216107 - DNA, 25 bp, Homo sapien
agattcttacggtgcccttcacgcg

SEQ ID NO: 216108 - DNA, 25 bp, Homo sapien
tgcctatggacggagaaagccgccg

SEQ ID NO: 216109 - DNA, 25 bp, Homo sapien
gtgtgcggaccactggcagcactca

SEQ ID NO: 216110 - DNA, 25 bp, Homo sapien
cccggtgaaggtgcaagatcaaacg

SEQ ID NO: 216111 - DNA, 25 bp, Homo sapien
aataaatgagacacaggcgggtttg

SEQ ID NO: 216112 - DNA, 25 bp, Homo sapien
ttgctgcgggacgattccgagtctc

SEQ ID NO: 216113 - DNA, 25 bp, Homo sapien
ggaagcggtaaggaacgcatatata

SEQ ID NO: 216114 - DNA, 25 bp, Homo sapien
tccgagtctccggttgctatggcga

SEQ ID NO: 216115 - DNA, 25 bp, Homo sapien
gctatggcgacagagtccgctacta

SEQ ID NO: 216116 - DNA, 25 bp, Homo sapien
tccgctactagagaagcgcaaacgc

SEQ ID NO: 216117 - DNA, 25 bp, Homo sapien
gcagccgtgatggagggaaaaataa

SEQ ID NO: 216118 - DNA, 25 bp, Homo sapien
taaaacatgattataccaagaaccc

SEQ ID NO: 216119 - DNA, 25 bp, Homo sapien
aggcccgatagcggccggaatcagc

SEQ ID NO: 216120 - DNA, 25 bp, Homo sapien
cccggcggtcgcagctctgtctttg

SEQ ID NO: 216121 - DNA, 25 bp, Homo sapien
agaggcccgatagcggccggaatca

SEQ ID NO: 216122 - DNA, 25 bp, Homo sapien
tcccggcggtcgcagctctgtcttt

SEQ ID NO: 216123 - DNA, 25 bp, Homo sapien
tgtcccggcggtcgcagctctgtct

SEQ ID NO: 216124 - DNA, 25 bp, Homo sapien
ccggcggtcgcagctctgtctttgg

SEQ ID NO: 216125 - DNA, 25 bp, Homo sapien
gcccgatagcggccggaatcagctg

SEQ ID NO: 216126 - DNA, 25 bp, Homo sapien
cggtcgcagctctgtctttggggct

SEQ ID NO: 216127 - DNA, 25 bp, Homo sapien
accgggccgctaagtctctggcaaa

SEQ ID NO: 216128 - DNA, 25 bp, Homo sapien
caaagtcgcccacgtgctggtgctt

SEQ ID NO: 216129 - DNA, 25 bp, Homo sapien
aggcgcttcaccgtctttctgattc

SEQ ID NO: 216130 - DNA, 25 bp, Homo sapien
ggcggagagtttctgcaaatatttc

SEQ ID NO: 216131 - DNA, 25 bp, Homo sapien
tagctttttcggctccgtcttagtg

SEQ ID NO: 216132 - DNA, 25 bp, Homo sapien
cgacctcgggatgtggagtcacagc

SEQ ID NO: 216133 - DNA, 25 bp, Homo sapien
gtcttagtggccagacgcacctgca

SEQ ID NO: 216134 - DNA, 25 bp, Homo sapien
tgtttcggtccacgagcaccagctt

SEQ ID NO: 216135 - DNA, 25 bp, Homo sapien
gcagtgctaaaggaggagttccgtc

SEQ ID NO: 216136 - DNA, 25 bp, Homo sapien
acaaacaccgactggggcctgaccg

SEQ ID NO: 216137 - DNA, 25 bp, Homo sapien
tggcggggacacaaacaccgactgg

SEQ ID NO: 216138 - DNA, 25 bp, Homo sapien
gtgactcattcctccgcagggcgca

SEQ ID NO: 216139 - DNA, 25 bp, Homo sapien
cgtgagtgactcattcctccgcagg

SEQ ID NO: 216140 - DNA, 25 bp, Homo sapien
catcagtggccgtgagtgactcatt

SEQ ID NO: 216141 - DNA, 25 bp, Homo sapien
tgctaaaggaggagttccgtcggac

SEQ ID NO: 216142 - DNA, 25 bp, Homo sapien
tcggacgcctcggaggccatcagtg

SEQ ID NO: 216143 - DNA, 25 bp, Homo sapien
tccgtacgccgtcctcaggaaaggc

SEQ ID NO: 216144 - DNA, 25 bp, Homo sapien
gcacagagcaagagcgcacggcccg

SEQ ID NO: 216145 - DNA, 25 bp, Homo sapien
tcttcagtcctacagcggcttctca

SEQ ID NO: 216146 - DNA, 25 bp, Homo sapien
gcgccgtgttgtcctctgtctgcac

SEQ ID NO: 216147 - DNA, 25 bp, Homo sapien
tgcaccgccgctgacggaaagctag

SEQ ID NO: 216148 - DNA, 25 bp, Homo sapien
aaagctaggcccttctggagacccg

SEQ ID NO: 216149 - DNA, 25 bp, Homo sapien
gcttcgaggaatgactgacacacta

SEQ ID NO: 216150 - DNA, 25 bp, Homo sapien
ttcccgaaccctgtcacaaaatctg

SEQ ID NO: 216151 - DNA, 25 bp, Homo sapien
gtacagggtaaaggccatggccgtc

SEQ ID NO: 216152 - DNA, 25 bp, Homo sapien
cgccttcctacggaagccgatgggg

SEQ ID NO: 216153 - DNA, 25 bp, Homo sapien
ccctcgctgaagactgcaagtcctg

SEQ ID NO: 216154 - DNA, 25 bp, Homo sapien
caagtcctgccgcttgtctagaccg

SEQ ID NO: 216155 - DNA, 25 bp, Homo sapien
cgctcctcgtgcagcactgcgatgg

SEQ ID NO: 216156 - DNA, 25 bp, Homo sapien
tgcctgcagcagtgagtacagggta

SEQ ID NO: 216157 - DNA, 25 bp, Homo sapien
gaagtccaagcgatttctctcccgc

SEQ ID NO: 216158 - DNA, 25 bp, Homo sapien
actgcgatggcgttgacgcagagca

SEQ ID NO: 216159 - DNA, 25 bp, Homo sapien
cagtcgttgttggtagaacgcccta

SEQ ID NO: 216160 - DNA, 25 bp, Homo sapien
ttaatcactcgggaagcggacggga

SEQ ID NO: 216161 - DNA, 25 bp, Homo sapien
tgaaactcggatcaactggcagtcg

SEQ ID NO: 216162 - DNA, 25 bp, Homo sapien
tctgtgtttcgaggatggttctagc

SEQ ID NO: 216163 - DNA, 25 bp, Homo sapien
ggcggctctgattcctttccatggc

SEQ ID NO: 216164 - DNA, 25 bp, Homo sapien
tgctccttttccacggcttttctgg

SEQ ID NO: 216165 - DNA, 25 bp, Homo sapien
cccgaaaggtcagagtgtgaagtcc

SEQ ID NO: 216166 - DNA, 25 bp, Homo sapien
ggctttcccagcgagagtgaaatta

SEQ ID NO: 216167 - DNA, 25 bp, Homo sapien
tcgagttagttatcccttggccgtc

SEQ ID NO: 216168 - DNA, 25 bp, Homo sapien
gccgaagccgctttcgaagttagca

SEQ ID NO: 216169 - DNA, 25 bp, Homo sapien
ccgggcgcagcagctgattcatctg

SEQ ID NO: 216170 - DNA, 25 bp, Homo sapien
gccgttttaggtgtgtgttctcttc

SEQ ID NO: 216171 - DNA, 25 bp, Homo sapien
tgtcccgagcagtcagcaaaccaca

SEQ ID NO: 216172 - DNA, 25 bp, Homo sapien
actctggcctccacgcattctaggg

SEQ ID NO: 216173 - DNA, 25 bp, Homo sapien
gcgctgtctctgctaggcttattta

SEQ ID NO: 216174 - DNA, 25 bp, Homo sapien
ttcaaacgaaatagcgaggcggccc

SEQ ID NO: 216175 - DNA, 25 bp, Homo sapien
cccttgaatcagaggcggctgtctc

SEQ ID NO: 216176 - DNA, 25 bp, Homo sapien
cctgtttagcaataacggctggagc

SEQ ID NO: 216177 - DNA, 25 bp, Homo sapien
cgcggagtcacttggtggacttttc

SEQ ID NO: 216178 - DNA, 25 bp, Homo sapien
cggctggagcacgtcctacaagtta

SEQ ID NO: 216179 - DNA, 25 bp, Homo sapien
cctgggatcagagcgtcctgtttag

SEQ ID NO: 216180 - DNA, 25 bp, Homo sapien
tctcactctgacagcgccgaggtgc

SEQ ID NO: 216181 - DNA, 25 bp, Homo sapien
tcggggcagctgtcaaaaacgagac

SEQ ID NO: 216182 - DNA, 25 bp, Homo sapien
cgtctgaaacggcagcggctgtttt

SEQ ID NO: 216183 - DNA, 25 bp, Homo sapien
cggatagaaggcgtccttgcggccc

SEQ ID NO: 216184 - DNA, 25 bp, Homo sapien
gccagaacatgcagaagggcggata

SEQ ID NO: 216185 - DNA, 25 bp, Homo sapien
ccgcatcctctttcttatggcacaa

SEQ ID NO: 216186 - DNA, 25 bp, Homo sapien
gctcagccaggtccaggaaggcctg

SEQ ID NO: 216187 - DNA, 25 bp, Homo sapien
tttcttatggcacaagctgaaggcg

SEQ ID NO: 216188 - DNA, 25 bp, Homo sapien
actacggcggcctcctgcaaggagt

SEQ ID NO: 216189 - DNA, 25 bp, Homo sapien
cggcctcctgcaaggagtcgtcgtc

SEQ ID NO: 216190 - DNA, 25 bp, Homo sapien
ggctttcgcctagcgcgcagcctag

SEQ ID NO: 216191 - DNA, 25 bp, Homo sapien
tgcccagcaagctgtgtgccggatt

SEQ ID NO: 216192 - DNA, 25 bp, Homo sapien
ccgctggggatctcaaataggtgcc

SEQ ID NO: 216193 - DNA, 25 bp, Homo sapien
ccgcagaaagtgtgggtacgcagaa

SEQ ID NO: 216194 - DNA, 25 bp, Homo sapien
ctggcccgagcgaatggcgctcaaa

SEQ ID NO: 216195 - DNA, 25 bp, Homo sapien
cgaagcatccaagcgggtcctcgta

SEQ ID NO: 216196 - DNA, 25 bp, Homo sapien
cgtctgtctctgaactcgtgtcgga

SEQ ID NO: 216197 - DNA, 25 bp, Homo sapien
ttccggcaatacctggtaacctctg

SEQ ID NO: 216198 - DNA, 25 bp, Homo sapien
taacctctgggtgtctttaggcgtg

SEQ ID NO: 216199 - DNA, 25 bp, Homo sapien
agacctctctgacgccgcctgttgg

SEQ ID NO: 216200 - DNA, 25 bp, Homo sapien
tctgacgccgcctgttggtcaggca

SEQ ID NO: 216201 - DNA, 25 bp, Homo sapien
ggcttagcttgctcagatccgcacc

SEQ ID NO: 216202 - DNA, 25 bp, Homo sapien
cctgcttctcggcttagcttgctca

SEQ ID NO: 216203 - DNA, 25 bp, Homo sapien
ttagggtgagggtcggtctctcctc

SEQ ID NO: 216204 - DNA, 25 bp, Homo sapien
ctcctgggcaagtttgtaagtttag

SEQ ID NO: 216205 - DNA, 25 bp, Homo sapien
cctactctcctcctgggcaagtttg

SEQ ID NO: 216206 - DNA, 25 bp, Homo sapien
gcggaggacgaagccacttacctgt

SEQ ID NO: 216207 - DNA, 25 bp, Homo sapien
tagtagatcgcatagcccagccgga

SEQ ID NO: 216208 - DNA, 25 bp, Homo sapien
cgctctggggaatcttctttcgctg

SEQ ID NO: 216209 - DNA, 25 bp, Homo sapien
ctcctccataattcgcggcggatca

SEQ ID NO: 216210 - DNA, 25 bp, Homo sapien
gtgtgttgctccctgttgctttcta

SEQ ID NO: 216211 - DNA, 25 bp, Homo sapien
ggtcctggaccgaagatttagccca

SEQ ID NO: 216212 - DNA, 25 bp, Homo sapien
ttgctacggcttcatcccggagctc

SEQ ID NO: 216213 - DNA, 25 bp, Homo sapien
tgcgtaagcggcaactcctccagga

SEQ ID NO: 216214 - DNA, 25 bp, Homo sapien
tcctctccacgtagggtagtagatc

SEQ ID NO: 216215 - DNA, 25 bp, Homo sapien
ggctggcaacaagcagctcctaata

SEQ ID NO: 216216 - DNA, 25 bp, Homo sapien
cctacggatccaggatggctccttc

SEQ ID NO: 216217 - DNA, 25 bp, Homo sapien
cgaagcagttaagcggctggcaaca

SEQ ID NO: 216218 - DNA, 25 bp, Homo sapien
ccgcgcccggcagcgaagcagttaa

SEQ ID NO: 216219 - DNA, 25 bp, Homo sapien
cctaacagagaacggcgctcggagc

SEQ ID NO: 216220 - DNA, 25 bp, Homo sapien
gctcctaataaacactcggctaatt

SEQ ID NO: 216221 - DNA, 25 bp, Homo sapien
actgcgaagggcagccgcgcgaaac

SEQ ID NO: 216222 - DNA, 25 bp, Homo sapien
ctggtgtccgcgatgccgcactgac

SEQ ID NO: 216223 - DNA, 25 bp, Homo sapien
cctcgaatcggaagggagacgtcgc

SEQ ID NO: 216224 - DNA, 25 bp, Homo sapien
ctgctggctggcgagctgcttctcc

SEQ ID NO: 216225 - DNA, 25 bp, Homo sapien
acgcccgcggtttcgcttgagttgg

SEQ ID NO: 216226 - DNA, 25 bp, Homo sapien
ccaatcagcacgagggaagctcggg

SEQ ID NO: 216227 - DNA, 25 bp, Homo sapien
tgttccttcctcttccgatgggatg

SEQ ID NO: 216228 - DNA, 25 bp, Homo sapien
cgcagccaatcagcacgagggaagc

SEQ ID NO: 216229 - DNA, 25 bp, Homo sapien
cttcctcttccgatgggatggaggg

SEQ ID NO: 216230 - DNA, 25 bp, Homo sapien
attggaggcggaactgaaaacactc

SEQ ID NO: 216231 - DNA, 25 bp, Homo sapien
ctcggactcaggcttagccgcagtc

SEQ ID NO: 216232 - DNA, 25 bp, Homo sapien
ttgttccctgcgctgcgcactgcga

SEQ ID NO: 216233 - DNA, 25 bp, Homo sapien
caggcttagccgcagtctgtgagcc

SEQ ID NO: 216234 - DNA, 25 bp, Homo sapien
ggccagcccagcctacttgtctcgc

SEQ ID NO: 216235 - DNA, 25 bp, Homo sapien
ctacttgtctcgctgcgcccggctg

SEQ ID NO: 216236 - DNA, 25 bp, Homo sapien
ggtgcttcccagaatcccggtgccc

SEQ ID NO: 216237 - DNA, 25 bp, Homo sapien
cagctgggctcggactcaggcttag

SEQ ID NO: 216238 - DNA, 25 bp, Homo sapien
ctgcctccgctccaggggtcggcgc

SEQ ID NO: 216239 - DNA, 25 bp, Homo sapien
atcgcgcgtagttctcccggaaacg

SEQ ID NO: 216240 - DNA, 25 bp, Homo sapien
gcacccggacacatcgcgcatagtt

SEQ ID NO: 216241 - DNA, 25 bp, Homo sapien
tcacccggacacatcgcgcatagtt

SEQ ID NO: 216242 - DNA, 25 bp, Homo sapien
atcgcgcatagttctcccggaaacc

SEQ ID NO: 216243 - DNA, 25 bp, Homo sapien
atcgcgcatagttctcccggaaacg

SEQ ID NO: 216244 - DNA, 25 bp, Homo sapien
atcgcgtatagttctcccggaaacg

SEQ ID NO: 216245 - DNA, 25 bp, Homo sapien
gcacccagacacatcgcgcatagtt

SEQ ID NO: 216246 - DNA, 25 bp, Homo sapien
acatcgcgcgtagttctcccggaaa

SEQ ID NO: 216247 - DNA, 25 bp, Homo sapien
acgttctcggccagcgcgaaggcca

SEQ ID NO: 216248 - DNA, 25 bp, Homo sapien
gcgcgcccgaacagcttcatctgtg

SEQ ID NO: 216249 - DNA, 25 bp, Homo sapien
cgcgtgaagctcttgtagcagaact

SEQ ID NO: 216250 - DNA, 25 bp, Homo sapien
ccatgcggcagctctggcgcttgat

SEQ ID NO: 216251 - DNA, 25 bp, Homo sapien
agctcttgcaggctcagggcgccct

SEQ ID NO: 216252 - DNA, 25 bp, Homo sapien
gaactgccgctccagctcttgcagg

SEQ ID NO: 216253 - DNA, 25 bp, Homo sapien
gcttcatctgtgtctcctcgaactg

SEQ ID NO: 216254 - DNA, 25 bp, Homo sapien
ttgtagcagaactcgcactggtagg

SEQ ID NO: 216255 - DNA, 25 bp, Homo sapien
ggggaagctctctccatcgtccttc

SEQ ID NO: 216256 - DNA, 25 bp, Homo sapien
agagactatagctcgactcgcctgc

SEQ ID NO: 216257 - DNA, 25 bp, Homo sapien
gcgcctagctggacttctgccaatc

SEQ ID NO: 216258 - DNA, 25 bp, Homo sapien
gctcctttaatttctgcccgtatcg

SEQ ID NO: 216259 - DNA, 25 bp, Homo sapien
tgactctcaggaggaccaagcattc

SEQ ID NO: 216260 - DNA, 25 bp, Homo sapien
gagtgcccttacgttccttcggctg

SEQ ID NO: 216261 - DNA, 25 bp, Homo sapien
ccgtctccggagctgagagactata

SEQ ID NO: 216262 - DNA, 25 bp, Homo sapien
ggggtcagtccttttgcgccaccca

SEQ ID NO: 216263 - DNA, 25 bp, Homo sapien
gttaccgcctgagaggccggcgcct

SEQ ID NO: 216264 - DNA, 25 bp, Homo sapien
tcacgaaaaattcccgagcgtggtg

SEQ ID NO: 216265 - DNA, 25 bp, Homo sapien
agttgcccggcctgttcagactggt

SEQ ID NO: 216266 - DNA, 25 bp, Homo sapien
gttcagactggttcgcccacctttc

SEQ ID NO: 216267 - DNA, 25 bp, Homo sapien
gcctgacctctgagaaagcagaatc

SEQ ID NO: 216268 - DNA, 25 bp, Homo sapien
tccgggacatgaagcaaccacagcc

SEQ ID NO: 216269 - DNA, 25 bp, Homo sapien
ctccaggcagggcttcgtgccagac

SEQ ID NO: 216270 - DNA, 25 bp, Homo sapien
ctgagaaagcagaatccgggacatg

SEQ ID NO: 216271 - DNA, 25 bp, Homo sapien
tacaccgcgacagtggaagtcaccg

SEQ ID NO: 216272 - DNA, 25 bp, Homo sapien
catcaggcgcttgcgggcctcctgg

SEQ ID NO: 216273 - DNA, 25 bp, Homo sapien
acagtggaagtcaccgagctcggga

SEQ ID NO: 216274 - DNA, 25 bp, Homo sapien
cgcgacagtggaagtcaccgagctc

SEQ ID NO: 216275 - DNA, 25 bp, Homo sapien
caactacaccgcgacagtggaagtc

SEQ ID NO: 216276 - DNA, 25 bp, Homo sapien
ctccagcgagcgctcccggatcagc

SEQ ID NO: 216277 - DNA, 25 bp, Homo sapien
ctggcgctgcgagctctccagcgag

SEQ ID NO: 216278 - DNA, 25 bp, Homo sapien
tcctgcgaggtggacaactacaccg

SEQ ID NO: 216279 - DNA, 25 bp, Homo sapien
ctgcctcctccaggatttaaaggga

SEQ ID NO: 216280 - DNA, 25 bp, Homo sapien
cgcgccgctgtcagagtctcgtggc

SEQ ID NO: 216281 - DNA, 25 bp, Homo sapien
ccgctaatttctattttgacagtaa

SEQ ID NO: 216282 - DNA, 25 bp, Homo sapien
cgcccggctccgctaatttctattt

SEQ ID NO: 216283 - DNA, 25 bp, Homo sapien
aactgcctcggctgccgaggtgctg

SEQ ID NO: 216284 - DNA, 25 bp, Homo sapien
cccgcaatcgctttccggcgcagcc

SEQ ID NO: 216285 - DNA, 25 bp, Homo sapien
gggacgcagtcctggcgtcctcctt

SEQ ID NO: 216286 - DNA, 25 bp, Homo sapien
gccgccgtttctccggtctcctgac

SEQ ID NO: 216287 - DNA, 25 bp, Homo sapien
cggcacggacgttctcatccttaaa

SEQ ID NO: 216288 - DNA, 25 bp, Homo sapien
cttggcagctaaggcgacatcccga

SEQ ID NO: 216289 - DNA, 25 bp, Homo sapien
ctgtcttggcagctaaggcgacatc

SEQ ID NO: 216290 - DNA, 25 bp, Homo sapien
actgggctgtcttggcagctaaggc

SEQ ID NO: 216291 - DNA, 25 bp, Homo sapien
ctagactgggctgtcttggcagcta

SEQ ID NO: 216292 - DNA, 25 bp, Homo sapien
ttttggcgtcgctagactgggctgt

SEQ ID NO: 216293 - DNA, 25 bp, Homo sapien
ggcacggacgttctcatccttaaag

SEQ ID NO: 216294 - DNA, 25 bp, Homo sapien
catccttaaagcctttcggactcta

SEQ ID NO: 216295 - DNA, 25 bp, Homo sapien
gctctgaaaagccacctctgggtgg

SEQ ID NO: 216296 - DNA, 25 bp, Homo sapien
tcccaacggttgtggttctgttggc

SEQ ID NO: 216297 - DNA, 25 bp, Homo sapien
ggggttcacttgacaggctctgaaa

SEQ ID NO: 216298 - DNA, 25 bp, Homo sapien
ctcgggttcatcaggacgacgagca

SEQ ID NO: 216299 - DNA, 25 bp, Homo sapien
cgcctgagccgagtgtttctctatt

SEQ ID NO: 216300 - DNA, 25 bp, Homo sapien
cgcccggctgtttgtgtgtacacac

SEQ ID NO: 216301 - DNA, 25 bp, Homo sapien
attcctgtcgctgcggtgcaatcgg

SEQ ID NO: 216302 - DNA, 25 bp, Homo sapien
caaatcggtggacccgttgcggtct

SEQ ID NO: 216303 - DNA, 25 bp, Homo sapien
atcgtgcgcacaatctaccagaagg

SEQ ID NO: 216304 - DNA, 25 bp, Homo sapien
accgctgccaagctctgcgacaaga

SEQ ID NO: 216305 - DNA, 25 bp, Homo sapien
ctctgcgacaagatggcgctcttta

SEQ ID NO: 216306 - DNA, 25 bp, Homo sapien
cgctctttatggtggaggggaccaa

SEQ ID NO: 216307 - DNA, 25 bp, Homo sapien
tgctcctcaacatgctgcaggtaac

SEQ ID NO: 216308 - DNA, 25 bp, Homo sapien
gcaggtaactggacgccggccacca

SEQ ID NO: 216309 - DNA, 25 bp, Homo sapien
ctctgcgttcggtgagttattccta

SEQ ID NO: 216310 - DNA, 25 bp, Homo sapien
agaaggctgtgtccgaccgcagctt

SEQ ID NO: 216311 - DNA, 25 bp, Homo sapien
tgtgactcctcggagaccttggcag

SEQ ID NO: 216312 - DNA, 25 bp, Homo sapien
ccaactggcagcaggcgacgtgtag

SEQ ID NO: 216313 - DNA, 25 bp, Homo sapien
tgtcagccgcagtcgccaactggca

SEQ ID NO: 216314 - DNA, 25 bp, Homo sapien
caccgcttgggtcagaaaggacctc

SEQ ID NO: 216315 - DNA, 25 bp, Homo sapien
attgttcccgcatgctgtcagccgc

SEQ ID NO: 216316 - DNA, 25 bp, Homo sapien
gagacgggctcgcattgttcccgca

SEQ ID NO: 216317 - DNA, 25 bp, Homo sapien
aggacctcggaaggctgaaaaagtg

SEQ ID NO: 216318 - DNA, 25 bp, Homo sapien
tgtagcagatgtccgggaggacaaa

SEQ ID NO: 216319 - DNA, 25 bp, Homo sapien
ccttgtgtaccaacagcgtcctgga

SEQ ID NO: 216320 - DNA, 25 bp, Homo sapien
tccagtgtggcggacttgatgaaga

SEQ ID NO: 216321 - DNA, 25 bp, Homo sapien
taccggctgttgaagatgacctcta

SEQ ID NO: 216322 - DNA, 25 bp, Homo sapien
gcccttcacaaagctgatctgcacg

SEQ ID NO: 216323 - DNA, 25 bp, Homo sapien
cggctgctgcataaactcgtggtca

SEQ ID NO: 216324 - DNA, 25 bp, Homo sapien
gctgcaggctgtacgccttctcgta

SEQ ID NO: 216325 - DNA, 25 bp, Homo sapien
cacgggcagctgctgatgaactggc

SEQ ID NO: 216326 - DNA, 25 bp, Homo sapien
cttctcgtagtcgaaagccttgatg

SEQ ID NO: 216327 - DNA, 25 bp, Homo sapien
tggtgccgtttccatccgtgtcaac

SEQ ID NO: 216328 - DNA, 25 bp, Homo sapien
aggagtcagctcaccggccatgcct

SEQ ID NO: 216329 - DNA, 25 bp, Homo sapien
ccagctcctgggcattgatggtgcc

SEQ ID NO: 216330 - DNA, 25 bp, Homo sapien
agatgagtttccttagctgggcctc

SEQ ID NO: 216331 - DNA, 25 bp, Homo sapien
cccggagagtcccagcacaaaagca

SEQ ID NO: 216332 - DNA, 25 bp, Homo sapien
ggggaggcagtttcccatccaccga

SEQ ID NO: 216333 - DNA, 25 bp, Homo sapien
gagcatcctcgcgaactcctcgtag

SEQ ID NO: 216334 - DNA, 25 bp, Homo sapien
ctgctctcagagctcgtggtccaga

SEQ ID NO: 216335 - DNA, 25 bp, Homo sapien
cgtgaatatgacctcagcggcggcc

SEQ ID NO: 216336 - DNA, 25 bp, Homo sapien
gctccggtttctaggactgcctgga

SEQ ID NO: 216337 - DNA, 25 bp, Homo sapien
gagagcgctgtctcggtttaaaaga

SEQ ID NO: 216338 - DNA, 25 bp, Homo sapien
cgccctagcgcttcattcattggtt

SEQ ID NO: 216339 - DNA, 25 bp, Homo sapien
tgtttcgcaaacaacagatcgggtt

SEQ ID NO: 216340 - DNA, 25 bp, Homo sapien
gccgtctagacaccctgtcgcttta

SEQ ID NO: 216341 - DNA, 25 bp, Homo sapien
gtgtcttgtgcacagctctggaatg

SEQ ID NO: 216342 - DNA, 25 bp, Homo sapien
actgcctggagaagtgtgtcttgtg

SEQ ID NO: 216343 - DNA, 25 bp, Homo sapien
ccactggtgttcgacgtgattctcc

SEQ ID NO: 216344 - DNA, 25 bp, Homo sapien
ggcgggcctggaccaaatccaactc

SEQ ID NO: 216345 - DNA, 25 bp, Homo sapien
ccaaaactccaaaggtgcgcggcca

SEQ ID NO: 216346 - DNA, 25 bp, Homo sapien
gagacagatacccagttcggccttc

SEQ ID NO: 216347 - DNA, 25 bp, Homo sapien
tgcctgtttgttcctctgcaccctg

SEQ ID NO: 216348 - DNA, 25 bp, Homo sapien
gtaggggacacccaacttctcctgc

SEQ ID NO: 216349 - DNA, 25 bp, Homo sapien
aaaggagtttcagggtctcagccga

SEQ ID NO: 216350 - DNA, 25 bp, Homo sapien
ggagccgcgcacttcacagttcaca

SEQ ID NO: 216351 - DNA, 25 bp, Homo sapien
agcgcagatcgtttggtcctgaaca

SEQ ID NO: 216352 - DNA, 25 bp, Homo sapien
tctggcaaaataagaaggctctcgc

SEQ ID NO: 216353 - DNA, 25 bp, Homo sapien
cccgcatgagacgtctggcaaaata

SEQ ID NO: 216354 - DNA, 25 bp, Homo sapien
ttccgcgcacacgaagactcagggg

SEQ ID NO: 216355 - DNA, 25 bp, Homo sapien
ttagtaaccggatctcctcgaattc

SEQ ID NO: 216356 - DNA, 25 bp, Homo sapien
cagcctcggcttcctacatggaagg

SEQ ID NO: 216357 - DNA, 25 bp, Homo sapien
tgcctgctaaggagcgaacatgacc

SEQ ID NO: 216358 - DNA, 25 bp, Homo sapien
tgacctccgcacaccatgaagaagt

SEQ ID NO: 216359 - DNA, 25 bp, Homo sapien
aacacgattcctggggagattggag

SEQ ID NO: 216360 - DNA, 25 bp, Homo sapien
tgacagcaatcttgcccgtctgcgc

SEQ ID NO: 216361 - DNA, 25 bp, Homo sapien
gcggctgcagacctgtaaaccttaa

SEQ ID NO: 216362 - DNA, 25 bp, Homo sapien
gagccacccgcagttgcgctcgagg

SEQ ID NO: 216363 - DNA, 25 bp, Homo sapien
gagaccgtcggggtcacctctccag

SEQ ID NO: 216364 - DNA, 25 bp, Homo sapien
ccgtgcagtcagacgtgcagtgtgc

SEQ ID NO: 216365 - DNA, 25 bp, Homo sapien
gacctccagggcagctatcgctgct

SEQ ID NO: 216366 - DNA, 25 bp, Homo sapien
ctgcgcctctgactcacgtggtgac

SEQ ID NO: 216367 - DNA, 25 bp, Homo sapien
taccgcaaagccacgtggcgaaatc

SEQ ID NO: 216368 - DNA, 25 bp, Homo sapien
tctccggaagcaccgacttggcctt

SEQ ID NO: 216369 - DNA, 25 bp, Homo sapien
tcccaacagcggactcggacagagg

SEQ ID NO: 216370 - DNA, 25 bp, Homo sapien
tcggacagaggtccgtccgctgtca

SEQ ID NO: 216371 - DNA, 25 bp, Homo sapien
ggctcaggcctccatgtttccacgt

SEQ ID NO: 216372 - DNA, 25 bp, Homo sapien
ttccacgtctcagcgggtacagatc

SEQ ID NO: 216373 - DNA, 25 bp, Homo sapien
gtcctttgggtgttattcgtgcctc

SEQ ID NO: 216374 - DNA, 25 bp, Homo sapien
ctagtacctcctgggctaccgcaaa

SEQ ID NO: 216375 - DNA, 25 bp, Homo sapien
cagccgagccaatgggcgccttcaa

SEQ ID NO: 216376 - DNA, 25 bp, Homo sapien
cgccggtggtggacaaagaatacag

SEQ ID NO: 216377 - DNA, 25 bp, Homo sapien
gcctgcggagcagctacaaagccca

SEQ ID NO: 216378 - DNA, 25 bp, Homo sapien
ccgcggaaacgcagctgacaatgtc

SEQ ID NO: 216379 - DNA, 25 bp, Homo sapien
cagcacgcagcagtgttgcccaagg

SEQ ID NO: 216380 - DNA, 25 bp, Homo sapien
gcttcgctgcgggaagaaagcctga

SEQ ID NO: 216381 - DNA, 25 bp, Homo sapien
tctcggtaaaggatgatgcctgtgc

SEQ ID NO: 216382 - DNA, 25 bp, Homo sapien
gcgcgtcccagatgcccaactaaaa

SEQ ID NO: 216383 - DNA, 25 bp, Homo sapien
gacctcagggacacgcactcgtcgt

SEQ ID NO: 216384 - DNA, 25 bp, Homo sapien
gtcctgggagcagcctttctcaatg

SEQ ID NO: 216385 - DNA, 25 bp, Homo sapien
ctcacctgcgggcagacacaggcgt

SEQ ID NO: 216386 - DNA, 25 bp, Homo sapien
tcaatggcccgcacatagctgtggc

SEQ ID NO: 216387 - DNA, 25 bp, Homo sapien
tgcgactccagctcgctgaacacgg

SEQ ID NO: 216388 - DNA, 25 bp, Homo sapien
tgaacacggactcgcacacggactc

SEQ ID NO: 216389 - DNA, 25 bp, Homo sapien
acggactcgaactgcccgttcactt

SEQ ID NO: 216390 - DNA, 25 bp, Homo sapien
ccgtgctgctctggatggtcctaac

SEQ ID NO: 216391 - DNA, 25 bp, Homo sapien
acttctcgcgagattcgtagccgaa

SEQ ID NO: 216392 - DNA, 25 bp, Homo sapien
ggagaactcatgagaacttgacttc

SEQ ID NO: 216393 - DNA, 25 bp, Homo sapien
agcggtggattttgggagaactcat

SEQ ID NO: 216394 - DNA, 25 bp, Homo sapien
gaaacactcacctcaggctgcttag

SEQ ID NO: 216395 - DNA, 25 bp, Homo sapien
tttagtagccctaggagttctcctc

SEQ ID NO: 216396 - DNA, 25 bp, Homo sapien
tctgcggacctcagaggccgactga

SEQ ID NO: 216397 - DNA, 25 bp, Homo sapien
ttcgtagccgaagaaacgagatctg

SEQ ID NO: 216398 - DNA, 25 bp, Homo sapien
ccgcctccagcgaggatttagtagc

SEQ ID NO: 216399 - DNA, 25 bp, Homo sapien
ctgcagggttaagggtatcgtctta

SEQ ID NO: 216400 - DNA, 25 bp, Homo sapien
tcgtcttaaagagccggatcctccc

SEQ ID NO: 216401 - DNA, 25 bp, Homo sapien
aggtcggaacaggatctgctggctc

SEQ ID NO: 216402 - DNA, 25 bp, Homo sapien
gctcggtttcctcgcacaggtctct

SEQ ID NO: 216403 - DNA, 25 bp, Homo sapien
ggtttcctcgcacaggtctctccag

SEQ ID NO: 216404 - DNA, 25 bp, Homo sapien
gcaggacctgttccgggcgactgca

SEQ ID NO: 216405 - DNA, 25 bp, Homo sapien
ctgttccgggcgactgcagggttaa

SEQ ID NO: 216406 - DNA, 25 bp, Homo sapien
atggcgggacgcagcctctcagcct

SEQ ID NO: 216407 - DNA, 25 bp, Homo sapien
cagatctcgttctggggcaagccgt

SEQ ID NO: 216408 - DNA, 25 bp, Homo sapien
aggatgctctccttctccagggatc

SEQ ID NO: 216409 - DNA, 25 bp, Homo sapien
ctctataggagcgtgacagcagcga

SEQ ID NO: 216410 - DNA, 25 bp, Homo sapien
gggtcagatgactcccatactttta

SEQ ID NO: 216411 - DNA, 25 bp, Homo sapien
cccagagacgggaataaattatgca

SEQ ID NO: 216412 - DNA, 25 bp, Homo sapien
ttccggcgtcagcaaggtgtgacca

SEQ ID NO: 216413 - DNA, 25 bp, Homo sapien
tttcagggaaatgtccgcctccgcc

SEQ ID NO: 216414 - DNA, 25 bp, Homo sapien
cccagcggacgcagagtttcaggga

SEQ ID NO: 216415 - DNA, 25 bp, Homo sapien
ggtcccagcgtaagatggtcctacc

SEQ ID NO: 216416 - DNA, 25 bp, Homo sapien
tgggtttttatcacgtccgctccaa

SEQ ID NO: 216417 - DNA, 25 bp, Homo sapien
tatatgatcaggtcccattgcgggc

SEQ ID NO: 216418 - DNA, 25 bp, Homo sapien
gagcccgcagtattttccttatatg

SEQ ID NO: 216419 - DNA, 25 bp, Homo sapien
ccgagagaatttggtttgacacctc

SEQ ID NO: 216420 - DNA, 25 bp, Homo sapien
ccggagcctgagaggattatgaaaa

SEQ ID NO: 216421 - DNA, 25 bp, Homo sapien
tcggatagaccacaacgcgccttga

SEQ ID NO: 216422 - DNA, 25 bp, Homo sapien
acgcgccttgagagcggactctttc

SEQ ID NO: 216423 - DNA, 25 bp, Homo sapien
gggtctccggagataacggcgcacc

SEQ ID NO: 216424 - DNA, 25 bp, Homo sapien
attcacaatgctcttccctggggtc

SEQ ID NO: 216425 - DNA, 25 bp, Homo sapien
tgaccttgaaggcatcctgaaactc

SEQ ID NO: 216426 - DNA, 25 bp, Homo sapien
ccgagcccaggcaacgaaagtgagg

SEQ ID NO: 216427 - DNA, 25 bp, Homo sapien
agaggccgcgtcaaaacatccatcc

SEQ ID NO: 216428 - DNA, 25 bp, Homo sapien
gctggcctggagtttctcgatcttc

SEQ ID NO: 216429 - DNA, 25 bp, Homo sapien
tccagggttccctgttgtgggtatg

SEQ ID NO: 216430 - DNA, 25 bp, Homo sapien
cgcagtcactgaagccctctttgta

SEQ ID NO: 216431 - DNA, 25 bp, Homo sapien
tcattgatctaacgctgaggccagg

SEQ ID NO: 216432 - DNA, 25 bp, Homo sapien
gaacagaagccctctcattgatcta

SEQ ID NO: 216433 - DNA, 25 bp, Homo sapien
agccctctcattgatctaacgctga

SEQ ID NO: 216434 - DNA, 25 bp, Homo sapien
ttgatctaacgctgaggccaggcca

SEQ ID NO: 216435 - DNA, 25 bp, Homo sapien
atctaacgctgaggccaggccagtt

SEQ ID NO: 216436 - DNA, 25 bp, Homo sapien
taacgctgaggccaggccagttccg

SEQ ID NO: 216437 - DNA, 25 bp, Homo sapien
tgaggccaggccagttccgcattcc

SEQ ID NO: 216438 - DNA, 25 bp, Homo sapien
agaagccctctcattgatctaacgc

SEQ ID NO: 216439 - DNA, 25 bp, Homo sapien
actcggggagcccacaaggcgacgt

SEQ ID NO: 216440 - DNA, 25 bp, Homo sapien
agcccacaaggcgacgttctccgag

SEQ ID NO: 216441 - DNA, 25 bp, Homo sapien
ctgcagctccagagccactcgggga

SEQ ID NO: 216442 - DNA, 25 bp, Homo sapien
ggagcattttcccacggcaggtggt

SEQ ID NO: 216443 - DNA, 25 bp, Homo sapien
aatgaaccgtgggagcattttccca

SEQ ID NO: 216444 - DNA, 25 bp, Homo sapien
cgcaagtgtggaaaatgaaccgtgg

SEQ ID NO: 216445 - DNA, 25 bp, Homo sapien
cgttccagaacaggacgcaagtgtg

SEQ ID NO: 216446 - DNA, 25 bp, Homo sapien
tctgcgaggcgaacagaagccctct

SEQ ID NO: 216447 - DNA, 25 bp, Homo sapien
tctgctcggtttaggaatggcttgg

SEQ ID NO: 216448 - DNA, 25 bp, Homo sapien
ccctgaccttgggagtgccgcggat

SEQ ID NO: 216449 - DNA, 25 bp, Homo sapien
tttgccctgaccttgggagtgccgc

SEQ ID NO: 216450 - DNA, 25 bp, Homo sapien
agcgttcgcatcagcatccttcttt

SEQ ID NO: 216451 - DNA, 25 bp, Homo sapien
cggatgcctgcgtccgaagcagagc

SEQ ID NO: 216452 - DNA, 25 bp, Homo sapien
gacaggaggtcagcccagcgttcgc

SEQ ID NO: 216453 - DNA, 25 bp, Homo sapien
cgactctgctcggtttaggaatggc

SEQ ID NO: 216454 - DNA, 25 bp, Homo sapien
ggtcagcccagcgttcgcatcagca

SEQ ID NO: 216455 - DNA, 25 bp, Homo sapien
gggacttcctcttccagctgagaag

SEQ ID NO: 216456 - DNA, 25 bp, Homo sapien
tcttccagctgagaagctgagcctg

SEQ ID NO: 216457 - DNA, 25 bp, Homo sapien
ccgcagacgcctgcactcgggactt

SEQ ID NO: 216458 - DNA, 25 bp, Homo sapien
gtctggttgccatggtgcgcctcgc

SEQ ID NO: 216459 - DNA, 25 bp, Homo sapien
cttccgcgacgcagaagtctggttg

SEQ ID NO: 216460 - DNA, 25 bp, Homo sapien
accgctggctgtacattttcgagtc

SEQ ID NO: 216461 - DNA, 25 bp, Homo sapien
ctgtacggtgccaaaccgctggctg

SEQ ID NO: 216462 - DNA, 25 bp, Homo sapien
agaagctgagcctgcgcagtcctca

SEQ ID NO: 216463 - DNA, 25 bp, Homo sapien
gcctgttttaccactatttgaagag

SEQ ID NO: 216464 - DNA, 25 bp, Homo sapien
cacatcctccgggaaggcggcaatg

SEQ ID NO: 216465 - DNA, 25 bp, Homo sapien
caaagggcctcgtcggaatttctga

SEQ ID NO: 216466 - DNA, 25 bp, Homo sapien
gcggcaatgaaaacgccttgggccc

SEQ ID NO: 216467 - DNA, 25 bp, Homo sapien
agtacggcttgggaaaatcggcgca

SEQ ID NO: 216468 - DNA, 25 bp, Homo sapien
gattcccaaggttgtgcagcccaaa

SEQ ID NO: 216469 - DNA, 25 bp, Homo sapien
ggccgcactcgaacgtcctaggtcg

SEQ ID NO: 216470 - DNA, 25 bp, Homo sapien
ggcggttctttgatcttcgagtcca

SEQ ID NO: 216471 - DNA, 25 bp, Homo sapien
tcgctgcccatctagctggcgcatg

SEQ ID NO: 216472 - DNA, 25 bp, Homo sapien
ggtttgtcatggctgtgcgcacatt

SEQ ID NO: 216473 - DNA, 25 bp, Homo sapien
accgaacgcggcaaggaagctgctt

SEQ ID NO: 216474 - DNA, 25 bp, Homo sapien
ggtgtcaccacactgaaggcgcgct

SEQ ID NO: 216475 - DNA, 25 bp, Homo sapien
accgcagcaatgtggagacagcttc

SEQ ID NO: 216476 - DNA, 25 bp, Homo sapien
gtgccacaccgcaggtaaactgagg

SEQ ID NO: 216477 - DNA, 25 bp, Homo sapien
cggggacagtccctctgataaaggc

SEQ ID NO: 216478 - DNA, 25 bp, Homo sapien
caggcactgaacatgtcgacgggga

SEQ ID NO: 216479 - DNA, 25 bp, Homo sapien
cggcgacctaattgcggattcttca

SEQ ID NO: 216480 - DNA, 25 bp, Homo sapien
tccgtacgttcctaggcgacatatg

SEQ ID NO: 216481 - DNA, 25 bp, Homo sapien
cgtctccgctgcaaaccagtaggtg

SEQ ID NO: 216482 - DNA, 25 bp, Homo sapien
cgccatcttgcttatcgtatccgta

SEQ ID NO: 216483 - DNA, 25 bp, Homo sapien
cgtatccgtatggtggccgaatcca

SEQ ID NO: 216484 - DNA, 25 bp, Homo sapien
ccgcgctctaatgtggctttcccga

SEQ ID NO: 216485 - DNA, 25 bp, Homo sapien
cgccaccttgtcagtagagtccgta

SEQ ID NO: 216486 - DNA, 25 bp, Homo sapien
cgccatcttggtggttgattccgta

SEQ ID NO: 216487 - DNA, 25 bp, Homo sapien
cttcaccgtcacagggaaagctgga

SEQ ID NO: 216488 - DNA, 25 bp, Homo sapien
ccgagtccgcaccattccgggaagc

SEQ ID NO: 216489 - DNA, 25 bp, Homo sapien
ccgtcacagggaaagctggatcggc

SEQ ID NO: 216490 - DNA, 25 bp, Homo sapien
tgccctggagggactagaccctttg

SEQ ID NO: 216491 - DNA, 25 bp, Homo sapien
agggactagaccctttgtctccacg

SEQ ID NO: 216492 - DNA, 25 bp, Homo sapien
cctttgtctccacgtcgggcgttgg

SEQ ID NO: 216493 - DNA, 25 bp, Homo sapien
cgcgcacctggagcactaagggcct

SEQ ID NO: 216494 - DNA, 25 bp, Homo sapien
cacctggagcactaagggcctggtc

SEQ ID NO: 216495 - DNA, 25 bp, Homo sapien
cgatgctccgtcccactccttcctg

SEQ ID NO: 216496 - DNA, 25 bp, Homo sapien
aggctgaggactgcgcaggaccgcc

SEQ ID NO: 216497 - DNA, 25 bp, Homo sapien
gtgtttccccggagacgcgctcggc

SEQ ID NO: 216498 - DNA, 25 bp, Homo sapien
agtgcgtctgtgtttccccggagac

SEQ ID NO: 216499 - DNA, 25 bp, Homo sapien
agctgagagtgcgtctgtgtttccc

SEQ ID NO: 216500 - DNA, 25 bp, Homo sapien
cggcgtaggtccaggggagctgaga

SEQ ID NO: 216501 - DNA, 25 bp, Homo sapien
acgacggcgtaggtccaggggagct

SEQ ID NO: 216502 - DNA, 25 bp, Homo sapien
ctgcgcccccgtggaaggacggtgg

SEQ ID NO: 216503 - DNA, 25 bp, Homo sapien
tctcactgcggaaaaactcgaccct

SEQ ID NO: 216504 - DNA, 25 bp, Homo sapien
ccatgcggtgtcctcacggaaggca

SEQ ID NO: 216505 - DNA, 25 bp, Homo sapien
gcgagacaaggagcgcccccaagtg

SEQ ID NO: 216506 - DNA, 25 bp, Homo sapien
cgccttcacgtctagggcggcaggt

SEQ ID NO: 216507 - DNA, 25 bp, Homo sapien
caccgtcgcgggaaaagccaagttg

SEQ ID NO: 216508 - DNA, 25 bp, Homo sapien
aggcgatctcactgcggaaaaactc

SEQ ID NO: 216509 - DNA, 25 bp, Homo sapien
accaccaaggcgatctcactgcgga

SEQ ID NO: 216510 - DNA, 25 bp, Homo sapien
ggaggagcccaccaccaaggcgatc

SEQ ID NO: 216511 - DNA, 25 bp, Homo sapien
cttcggaagcatggatgtgcgcctg

SEQ ID NO: 216512 - DNA, 25 bp, Homo sapien
agacccagcggcgagtagccttttg

SEQ ID NO: 216513 - DNA, 25 bp, Homo sapien
gacgcaaaccgggaacagcggctga

SEQ ID NO: 216514 - DNA, 25 bp, Homo sapien
gcgggcggtttgaattttgcttaca

SEQ ID NO: 216515 - DNA, 25 bp, Homo sapien
catcctgggcttccaacggagactg

SEQ ID NO: 216516 - DNA, 25 bp, Homo sapien
tgcggtatccgcagctggagaccca

SEQ ID NO: 216517 - DNA, 25 bp, Homo sapien
gagtagccttttgctcccggacgga

SEQ ID NO: 216518 - DNA, 25 bp, Homo sapien
accctgcctttggaagcgcccgagg

SEQ ID NO: 216519 - DNA, 25 bp, Homo sapien
tcggatcgcagtcccgattatcctc

SEQ ID NO: 216520 - DNA, 25 bp, Homo sapien
gtgctgtcctggacccgtttgggat

SEQ ID NO: 216521 - DNA, 25 bp, Homo sapien
cgctgggctcctcgcgttgtgttta

SEQ ID NO: 216522 - DNA, 25 bp, Homo sapien
agttcagattcggatcgcagtcccg

SEQ ID NO: 216523 - DNA, 25 bp, Homo sapien
ctcgttgaagggttaatacagcgtc

SEQ ID NO: 216524 - DNA, 25 bp, Homo sapien
gacagaggcgcctacactggcggta

SEQ ID NO: 216525 - DNA, 25 bp, Homo sapien
agccactgccaaactagcgagtttc

SEQ ID NO: 216526 - DNA, 25 bp, Homo sapien
gggcagttcacactgcgagttcaga

SEQ ID NO: 216527 - DNA, 25 bp, Homo sapien
aaggtcgctgtgaagaagattgccc

SEQ ID NO: 216528 - DNA, 25 bp, Homo sapien
agtacatggagaccgacctggcacg

SEQ ID NO: 216529 - DNA, 25 bp, Homo sapien
caagttcagcgtggcgtacatcgtc

SEQ ID NO: 216530 - DNA, 25 bp, Homo sapien
cctgcagggtgagctgttcaagttc

SEQ ID NO: 216531 - DNA, 25 bp, Homo sapien
ggcgcctggaccacgacaacatcgt

SEQ ID NO: 216532 - DNA, 25 bp, Homo sapien
agatcaagatcattcggcgcctgga

SEQ ID NO: 216533 - DNA, 25 bp, Homo sapien
gcagcatgaagcacgcgctccgaga

SEQ ID NO: 216534 - DNA, 25 bp, Homo sapien
aagattgccctgagcgatgcccgca

SEQ ID NO: 216535 - DNA, 25 bp, Homo sapien
gctccgagttctcctgcttcttata

SEQ ID NO: 216536 - DNA, 25 bp, Homo sapien
tgcttcttatagttggacaccacca

SEQ ID NO: 216537 - DNA, 25 bp, Homo sapien
gacaccaccacgtactgttccagga

SEQ ID NO: 216538 - DNA, 25 bp, Homo sapien
actgttccaggatcatgggctcggc

SEQ ID NO: 216539 - DNA, 25 bp, Homo sapien
ctcgcagctcacagggcgccaagga

SEQ ID NO: 216540 - DNA, 25 bp, Homo sapien
accgctctcgttcttctcgatgaca

SEQ ID NO: 216541 - DNA, 25 bp, Homo sapien
caaggacaggccatatagcaaggcc

SEQ ID NO: 216542 - DNA, 25 bp, Homo sapien
aaagcacgcggtgagccagcggcca

SEQ ID NO: 216543 - DNA, 25 bp, Homo sapien
tagagcagtcgcactcgtccatgga

SEQ ID NO: 216544 - DNA, 25 bp, Homo sapien
gcgacctcaatggtgcgtgcatccc

SEQ ID NO: 216545 - DNA, 25 bp, Homo sapien
ccggacaataaactgggcgacctca

SEQ ID NO: 216546 - DNA, 25 bp, Homo sapien
aagcccgaggacctgccggacaata

SEQ ID NO: 216547 - DNA, 25 bp, Homo sapien
agttcgacctggacgtgttcatctc

SEQ ID NO: 216548 - DNA, 25 bp, Homo sapien
tcctggacctgtcgcactggaagca

SEQ ID NO: 216549 - DNA, 25 bp, Homo sapien
gggtcgccgtcctacctggacaagc

SEQ ID NO: 216550 - DNA, 25 bp, Homo sapien
cgtgcagaccgaggccttctccaaa

SEQ ID NO: 216551 - DNA, 25 bp, Homo sapien
cggcagctaagcctccagacggagc

SEQ ID NO: 216552 - DNA, 25 bp, Homo sapien
gatttccaggttcctccgccggctg

SEQ ID NO: 216553 - DNA, 25 bp, Homo sapien
ccggcttccttcatggagcggcgga

SEQ ID NO: 216554 - DNA, 25 bp, Homo sapien
tcagaaccgtaacctccaggagctg

SEQ ID NO: 216555 - DNA, 25 bp, Homo sapien
cgcgccagtgtgagcctgagctgac

SEQ ID NO: 216556 - DNA, 25 bp, Homo sapien
cgcgagacctctggtaaggcccggc

SEQ ID NO: 216557 - DNA, 25 bp, Homo sapien
tgtaccacctgtcgcggcgcgagac

SEQ ID NO: 216558 - DNA, 25 bp, Homo sapien
tacatcgcggcgacccaggttccag

SEQ ID NO: 216559 - DNA, 25 bp, Homo sapien
gactcgccggctcgatcaggcacgg

SEQ ID NO: 216560 - DNA, 25 bp, Homo sapien
caccgagcgcggacctccctcgcat

SEQ ID NO: 216561 - DNA, 25 bp, Homo sapien
cgctggggacctaagcctggggagc

SEQ ID NO: 216562 - DNA, 25 bp, Homo sapien
cgggcgcgcttcctcgggactcgcc

SEQ ID NO: 216563 - DNA, 25 bp, Homo sapien
gtgagtgcggtagggcataccagag

SEQ ID NO: 216564 - DNA, 25 bp, Homo sapien
cgggcgcattgtagccccgcggaca

SEQ ID NO: 216565 - DNA, 25 bp, Homo sapien
ggacctccctcgcatcctagagcgg

SEQ ID NO: 216566 - DNA, 25 bp, Homo sapien
cgaggacgcgcctcgttcaccgccc

SEQ ID NO: 216567 - DNA, 25 bp, Homo sapien
gttctcagtagtttcacggtcgccc

SEQ ID NO: 216568 - DNA, 25 bp, Homo sapien
ttttgcaacgagatgccaatttccc

SEQ ID NO: 216569 - DNA, 25 bp, Homo sapien
aggcccaggtccagattcagagccg

SEQ ID NO: 216570 - DNA, 25 bp, Homo sapien
caaaccctgaaattacccggatgtg

SEQ ID NO: 216571 - DNA, 25 bp, Homo sapien
cgcatgctcagtggcttctcgacaa

SEQ ID NO: 216572 - DNA, 25 bp, Homo sapien
ttggcagcaacaacacggccctggt

SEQ ID NO: 216573 - DNA, 25 bp, Homo sapien
gctcctctttgttgttctcagtagt

SEQ ID NO: 216574 - DNA, 25 bp, Homo sapien
cgcttgcagctcgtgggagaatcaa

SEQ ID NO: 216575 - DNA, 25 bp, Homo sapien
ggttttcgcaaggtgacccatcttc

SEQ ID NO: 216576 - DNA, 25 bp, Homo sapien
cgtgggacagcatcgccgccatcat

SEQ ID NO: 216577 - DNA, 25 bp, Homo sapien
acgccagcctggtgttccacgaata

SEQ ID NO: 216578 - DNA, 25 bp, Homo sapien
gtgttccacgaatacagcccaagta

SEQ ID NO: 216579 - DNA, 25 bp, Homo sapien
agtaacgtgaacaccaccggactgg

SEQ ID NO: 216580 - DNA, 25 bp, Homo sapien
tgggtcgcccgagaaacttcacact

SEQ ID NO: 216581 - DNA, 25 bp, Homo sapien
tcacactttttaccaggcaagacgg

SEQ ID NO: 216582 - DNA, 25 bp, Homo sapien
gttgacgctctttctccggagcagg

SEQ ID NO: 216583 - DNA, 25 bp, Homo sapien
cggagagggactgtgattgttcact

SEQ ID NO: 216584 - DNA, 25 bp, Homo sapien
agggactgtgattgttcactttaca

SEQ ID NO: 216585 - DNA, 25 bp, Homo sapien
ctgtgattgttcactttacacgtca

SEQ ID NO: 216586 - DNA, 25 bp, Homo sapien
tgttcactttacacgtcactctttg

SEQ ID NO: 216587 - DNA, 25 bp, Homo sapien
tacacgtcactctttgtgacgtccc

SEQ ID NO: 216588 - DNA, 25 bp, Homo sapien
aaaaaggaggcggacgaaggcgctg

SEQ ID NO: 216589 - DNA, 25 bp, Homo sapien
agaggctgaaactaagggccaagcg

SEQ ID NO: 216590 - DNA, 25 bp, Homo sapien
cagcagaggctgaaactaagggcca

SEQ ID NO: 216591 - DNA, 25 bp, Homo sapien
aagagcttctggaccgagtgcacca

SEQ ID NO: 216592 - DNA, 25 bp, Homo sapien
ccttgctcttgctgcgtttgccata

SEQ ID NO: 216593 - DNA, 25 bp, Homo sapien
tactgcagggtgtgatagccatcgc

SEQ ID NO: 216594 - DNA, 25 bp, Homo sapien
gggcacactcgtccttcagctcttg

SEQ ID NO: 216595 - DNA, 25 bp, Homo sapien
ggcccacgcactcagcctggaagga

SEQ ID NO: 216596 - DNA, 25 bp, Homo sapien
gcggctgcctgatagccctttcatg

SEQ ID NO: 216597 - DNA, 25 bp, Homo sapien
tgcacatgtcaccatccaggttgtc

SEQ ID NO: 216598 - DNA, 25 bp, Homo sapien
ggaccaggcgctcttcttcagcagc

SEQ ID NO: 216599 - DNA, 25 bp, Homo sapien
tcagacagtcaagcgccaaggcagc

SEQ ID NO: 216600 - DNA, 25 bp, Homo sapien
gaatctgcgcttgcactcgggctca

SEQ ID NO: 216601 - DNA, 25 bp, Homo sapien
cggctttctcttctctgctaagtgc

SEQ ID NO: 216602 - DNA, 25 bp, Homo sapien
gctaagtgctgcatggccaagggtt

SEQ ID NO: 216603 - DNA, 25 bp, Homo sapien
ccaagggttgcgaacgcgagcagaa

SEQ ID NO: 216604 - DNA, 25 bp, Homo sapien
cgagcagaaaatgcgcctctcactg

SEQ ID NO: 216605 - DNA, 25 bp, Homo sapien
tctcactgtcgcgagggattcagac

SEQ ID NO: 216606 - DNA, 25 bp, Homo sapien
cgctgtcctgtgatgagcgcgtacc

SEQ ID NO: 216607 - DNA, 25 bp, Homo sapien
tccaagcgctatgggcggccatctt

SEQ ID NO: 216608 - DNA, 25 bp, Homo sapien
gccaccgcctcttaggtcctccaag

SEQ ID NO: 216609 - DNA, 25 bp, Homo sapien
gtcctccaagcgctatgggcggcca

SEQ ID NO: 216610 - DNA, 25 bp, Homo sapien
ctatgggcggccatcttgtctccgc

SEQ ID NO: 216611 - DNA, 25 bp, Homo sapien
tctatggcggagtcgccgccagcgc

SEQ ID NO: 216612 - DNA, 25 bp, Homo sapien
gcgctgcgcttcttccgtaaccgag

SEQ ID NO: 216613 - DNA, 25 bp, Homo sapien
ggacgcgcgcaagcatcatagagcg

SEQ ID NO: 216614 - DNA, 25 bp, Homo sapien
aagcatcatagagcgggcgcgcaca

SEQ ID NO: 216615 - DNA, 25 bp, Homo sapien
cgtgggcctccacgattccttggca

SEQ ID NO: 216616 - DNA, 25 bp, Homo sapien
gagggtttatctgcgccgtcctttc

SEQ ID NO: 216617 - DNA, 25 bp, Homo sapien
attccttggcatgcgtgtcactctg

SEQ ID NO: 216618 - DNA, 25 bp, Homo sapien
cacagagcgactggagactgtagtc

SEQ ID NO: 216619 - DNA, 25 bp, Homo sapien
cagcggcctccttgggtgtaaatga

SEQ ID NO: 216620 - DNA, 25 bp, Homo sapien
tacctctagaggaatggcttcaccc

SEQ ID NO: 216621 - DNA, 25 bp, Homo sapien
tgtcactctgggcaacaggctggtc

SEQ ID NO: 216622 - DNA, 25 bp, Homo sapien
gtggggcgcgtccacactacaaata

SEQ ID NO: 216623 - DNA, 25 bp, Homo sapien
aggtgtccgccgaaatgcaggactc

SEQ ID NO: 216624 - DNA, 25 bp, Homo sapien
atgcaggactccttcggagcacaga

SEQ ID NO: 216625 - DNA, 25 bp, Homo sapien
ctccttcggagcacagagaatccca

SEQ ID NO: 216626 - DNA, 25 bp, Homo sapien
ggagcacagagaatcccacacgatc

SEQ ID NO: 216627 - DNA, 25 bp, Homo sapien
ccacacgatcctccctggaacgggg

SEQ ID NO: 216628 - DNA, 25 bp, Homo sapien
tgtgattacagaggcgctgggacac

SEQ ID NO: 216629 - DNA, 25 bp, Homo sapien
acagggataatgaggtgtccgccga

SEQ ID NO: 216630 - DNA, 25 bp, Homo sapien
ttacagaggcgctgggacacagccg

SEQ ID NO: 216631 - DNA, 25 bp, Homo sapien
cccgcgcaaactggccgagaatagc

SEQ ID NO: 216632 - DNA, 25 bp, Homo sapien
cgccctggctgctgaataaatggtt

SEQ ID NO: 216633 - DNA, 25 bp, Homo sapien
ttgtcccatcctgtgacagccgaga

SEQ ID NO: 216634 - DNA, 25 bp, Homo sapien
gtgtcttttcgagggttgtcccatc

SEQ ID NO: 216635 - DNA, 25 bp, Homo sapien
cgttgggtaacaggcctgagctttc

SEQ ID NO: 216636 - DNA, 25 bp, Homo sapien
aggggtcgcgacctaacgctcaaca

SEQ ID NO: 216637 - DNA, 25 bp, Homo sapien
gcagcgacttggatgcagcccacat

SEQ ID NO: 216638 - DNA, 25 bp, Homo sapien
cgcctgattgggactggaaaaattg

SEQ ID NO: 216639 - DNA, 25 bp, Homo sapien
tctccttgctgacggtggagcccgg

SEQ ID NO: 216640 - DNA, 25 bp, Homo sapien
tctcccggcaaggaaacttcgcagg

SEQ ID NO: 216641 - DNA, 25 bp, Homo sapien
gcacatccgcgttgggacttgcaga

SEQ ID NO: 216642 - DNA, 25 bp, Homo sapien
tgggacttgcagacacgccttcttc

SEQ ID NO: 216643 - DNA, 25 bp, Homo sapien
tgccactcgcagtcctgacgggcag

SEQ ID NO: 216644 - DNA, 25 bp, Homo sapien
ccacaggttggaggagataagtagc

SEQ ID NO: 216645 - DNA, 25 bp, Homo sapien
tgaaatctgacacctgctctcccgg

SEQ ID NO: 216646 - DNA, 25 bp, Homo sapien
ggaaggaaacctctctgaaatctga

SEQ ID NO: 216647 - DNA, 25 bp, Homo sapien
cgaaggtggccagactcgcctacct

SEQ ID NO: 216648 - DNA, 25 bp, Homo sapien
acgcgtacgcccagcgctggagagc

SEQ ID NO: 216649 - DNA, 25 bp, Homo sapien
agtcgcggcaggacgcgtacgccca

SEQ ID NO: 216650 - DNA, 25 bp, Homo sapien
cgccaccgcccgcaggcttggctcc

SEQ ID NO: 216651 - DNA, 25 bp, Homo sapien
ctcccctgggcgatcggaccttggg

SEQ ID NO: 216652 - DNA, 25 bp, Homo sapien
agactcgcctaccttgtggggcgcc

SEQ ID NO: 216653 - DNA, 25 bp, Homo sapien
gccagactcgcctaccttgtggggc

SEQ ID NO: 216654 - DNA, 25 bp, Homo sapien
ccctcgctagggtgctgtacaggcg

SEQ ID NO: 216655 - DNA, 25 bp, Homo sapien
gcaggcgaccatagagtggtaaaca

SEQ ID NO: 216656 - DNA, 25 bp, Homo sapien
cggctgctcctccagacaatgactg

SEQ ID NO: 216657 - DNA, 25 bp, Homo sapien
gagtggtaaacagagcgcctagaga

SEQ ID NO: 216658 - DNA, 25 bp, Homo sapien
atggcggtgctggtcgaccacgcct

SEQ ID NO: 216659 - DNA, 25 bp, Homo sapien
ttcccgaggccgaggtcgttcgcag

SEQ ID NO: 216660 - DNA, 25 bp, Homo sapien
catttccctgcgctcttattcgtgt

SEQ ID NO: 216661 - DNA, 25 bp, Homo sapien
cttattcgtgttgccgcttcttggc

SEQ ID NO: 216662 - DNA, 25 bp, Homo sapien
gggaactgcgggcttataaagagaa

SEQ ID NO: 216663 - DNA, 25 bp, Homo sapien
cacctcgttgaagaagcctcccatg

SEQ ID NO: 216664 - DNA, 25 bp, Homo sapien
ccaggtactgggcttttgtcacggt

SEQ ID NO: 216665 - DNA, 25 bp, Homo sapien
tgcgtggggcagttcaaattcctga

SEQ ID NO: 216666 - DNA, 25 bp, Homo sapien
gctcagatttcgtttcccgcggtca

SEQ ID NO: 216667 - DNA, 25 bp, Homo sapien
cgccaccgaagtcgctgggaaattc

SEQ ID NO: 216668 - DNA, 25 bp, Homo sapien
cggatgttctaatcctgcgggcaaa

SEQ ID NO: 216669 - DNA, 25 bp, Homo sapien
tcccttcattcactcaggcgaggtg

SEQ ID NO: 216670 - DNA, 25 bp, Homo sapien
tctgctgcactgagacattttaatg

SEQ ID NO: 216671 - DNA, 25 bp, Homo sapien
ggtgaacttgaccacggcgagtctg

SEQ ID NO: 216672 - DNA, 25 bp, Homo sapien
cgaggcctaattccggcagctcctg

SEQ ID NO: 216673 - DNA, 25 bp, Homo sapien
cgccactggctttgaaactgaagga

SEQ ID NO: 216674 - DNA, 25 bp, Homo sapien
cgtcatttccgcgtcgtccggtttg

SEQ ID NO: 216675 - DNA, 25 bp, Homo sapien
tccggtttggccttcagcgcccaat

SEQ ID NO: 216676 - DNA, 25 bp, Homo sapien
gcccaatcccaaaacgcgaagcgta

SEQ ID NO: 216677 - DNA, 25 bp, Homo sapien
gaagcgtagtcccaccctcgactga

SEQ ID NO: 216678 - DNA, 25 bp, Homo sapien
cctcgactgagtagcctcgcgctaa

SEQ ID NO: 216679 - DNA, 25 bp, Homo sapien
ccggcggtctgataggctacatcgc

SEQ ID NO: 216680 - DNA, 25 bp, Homo sapien
cccacggattatcccagcaggatct

SEQ ID NO: 216681 - DNA, 25 bp, Homo sapien
gcaccggcaccttgcagtatcactg

SEQ ID NO: 216682 - DNA, 25 bp, Homo sapien
tcagctgatttactgcagtggcggc

SEQ ID NO: 216683 - DNA, 25 bp, Homo sapien
gttgcagcgaaagtcacggcagttg

SEQ ID NO: 216684 - DNA, 25 bp, Homo sapien
ctcatttttgcgacagttgcagcga

SEQ ID NO: 216685 - DNA, 25 bp, Homo sapien
ccggcttaggccttgcaagtaggga

SEQ ID NO: 216686 - DNA, 25 bp, Homo sapien
tctccatcgtaacgcggctggctct

SEQ ID NO: 216687 - DNA, 25 bp, Homo sapien
ttgtgtctctgtttctttggctttc

SEQ ID NO: 216688 - DNA, 25 bp, Homo sapien
gggagttggtccttttccacaatgc

SEQ ID NO: 216689 - DNA, 25 bp, Homo sapien
gccaaaatgtcacccaaaaagctag

SEQ ID NO: 216690 - DNA, 25 bp, Homo sapien
aagctagtgcaacaacttgctttgc

SEQ ID NO: 216691 - DNA, 25 bp, Homo sapien
ttgctttgcaaacgacccaggagcc

SEQ ID NO: 216692 - DNA, 25 bp, Homo sapien
caggagcctgccgagaaagccctgc

SEQ ID NO: 216693 - DNA, 25 bp, Homo sapien
gtgcgaatttgaccggtggacatga

SEQ ID NO: 216694 - DNA, 25 bp, Homo sapien
tccgggaccctgtcgcaattagaaa

SEQ ID NO: 216695 - DNA, 25 bp, Homo sapien
atgtgcgttgctgagcgtggcctga

SEQ ID NO: 216696 - DNA, 25 bp, Homo sapien
tgagcgtggcctgagcccggtcagc

SEQ ID NO: 216697 - DNA, 25 bp, Homo sapien
gccgcccgcaaactcaggggaggta

SEQ ID NO: 216698 - DNA, 25 bp, Homo sapien
ccgcccgcaaactcaggggaggtag

SEQ ID NO: 216699 - DNA, 25 bp, Homo sapien
ccacttccagcgcttctgggagtgc

SEQ ID NO: 216700 - DNA, 25 bp, Homo sapien
tccagcgcttctgggagtgcatgtg

SEQ ID NO: 216701 - DNA, 25 bp, Homo sapien
cttctgggagtgcatgtgcgttgct

SEQ ID NO: 216702 - DNA, 25 bp, Homo sapien
tagggggtgcgctttccctggcctc

SEQ ID NO: 216703 - DNA, 25 bp, Homo sapien
cagctttccgggatttctgcaattc

SEQ ID NO: 216704 - DNA, 25 bp, Homo sapien
ctctgtgttagtgccctcgggaatt

SEQ ID NO: 216705 - DNA, 25 bp, Homo sapien
ctggggcgttctctctcaacccttt

SEQ ID NO: 216706 - DNA, 25 bp, Homo sapien
cacgcgggtttattctcaggaagcc

SEQ ID NO: 216707 - DNA, 25 bp, Homo sapien
gcctatcaaaggacacgcgggttta

SEQ ID NO: 216708 - DNA, 25 bp, Homo sapien
agccgctgtccaaatcgatgtgatt

SEQ ID NO: 216709 - DNA, 25 bp, Homo sapien
gggccagataactgcgcggtccttc

SEQ ID NO: 216710 - DNA, 25 bp, Homo sapien
tctccgagactctttgggccagata

SEQ ID NO: 216711 - DNA, 25 bp, Homo sapien
ggcgaggcaggttctcctcacttcc

SEQ ID NO: 216712 - DNA, 25 bp, Homo sapien
actgggaaactgacgctccgggatg

SEQ ID NO: 216713 - DNA, 25 bp, Homo sapien
accggagaagtcttagcactgcgca

SEQ ID NO: 216714 - DNA, 25 bp, Homo sapien
gagggttctaggaccaagggtctca

SEQ ID NO: 216715 - DNA, 25 bp, Homo sapien
ggctcccttacctgatttcctcttg

SEQ ID NO: 216716 - DNA, 25 bp, Homo sapien
cctcttggaactgccatagtccctg

SEQ ID NO: 216717 - DNA, 25 bp, Homo sapien
cacccactagggacagcgaggtagc

SEQ ID NO: 216718 - DNA, 25 bp, Homo sapien
gtgccgctgctcatgtgatgcccac

SEQ ID NO: 216719 - DNA, 25 bp, Homo sapien
tttagacatcaatcctggccggctc

SEQ ID NO: 216720 - DNA, 25 bp, Homo sapien
agcgcctagaaaccgcattgattta

SEQ ID NO: 216721 - DNA, 25 bp, Homo sapien
ataattaaatcagaggccgccgggc

SEQ ID NO: 216722 - DNA, 25 bp, Homo sapien
tcgcgaatgtcgtggaactccatcc

SEQ ID NO: 216723 - DNA, 25 bp, Homo sapien
ccctcggccctggaatcaatagtgg

SEQ ID NO: 216724 - DNA, 25 bp, Homo sapien
ggccgctgacttttcacgacaattg

SEQ ID NO: 216725 - DNA, 25 bp, Homo sapien
tcctcacgcagacttcgcgaatgtc

SEQ ID NO: 216726 - DNA, 25 bp, Homo sapien
gacgaggggtcgctcctctcaaatc

SEQ ID NO: 216727 - DNA, 25 bp, Homo sapien
cgagccgtcagccaaacctgaaaag

SEQ ID NO: 216728 - DNA, 25 bp, Homo sapien
cgctcacccaaacagaagacgtcgg

SEQ ID NO: 216729 - DNA, 25 bp, Homo sapien
agcggcagagcccttctggacagct

SEQ ID NO: 216730 - DNA, 25 bp, Homo sapien
ctgcggcctcggagtggttgcgctt

SEQ ID NO: 216731 - DNA, 25 bp, Homo sapien
tggtagcttcccgtggaaggcccgc

SEQ ID NO: 216732 - DNA, 25 bp, Homo sapien
ccactggtagcttcccgtggaaggc

SEQ ID NO: 216733 - DNA, 25 bp, Homo sapien
acagccactggtagcttcccgtgga

SEQ ID NO: 216734 - DNA, 25 bp, Homo sapien
cccaaacagaagacgtcggcgccgg

SEQ ID NO: 216735 - DNA, 25 bp, Homo sapien
ctcctggcggtttagttagggatca

SEQ ID NO: 216736 - DNA, 25 bp, Homo sapien
tgcctgctagctgcttggatgaata

SEQ ID NO: 216737 - DNA, 25 bp, Homo sapien
tccactgtgtggttatgtcactttc

SEQ ID NO: 216738 - DNA, 25 bp, Homo sapien
tgctggcaacaataacgtaaacgtg

SEQ ID NO: 216739 - DNA, 25 bp, Homo sapien
tgatccggcgcgtttccagtaagcc

SEQ ID NO: 216740 - DNA, 25 bp, Homo sapien
aggctgaacgcaacccgtgccagta

SEQ ID NO: 216741 - DNA, 25 bp, Homo sapien
cgtgtggacccagatttcattgatc

SEQ ID NO: 216742 - DNA, 25 bp, Homo sapien
tgcagtctgtgcttcgtcaagtccc

SEQ ID NO: 216743 - DNA, 25 bp, Homo sapien
gccgggccacgacaaaatgctcagc

SEQ ID NO: 216744 - DNA, 25 bp, Homo sapien
aaatctggcagggagaccttccgca

SEQ ID NO: 216745 - DNA, 25 bp, Homo sapien
cggccatgatgtcgcacctgaacgg

SEQ ID NO: 216746 - DNA, 25 bp, Homo sapien
catggtcaccagcatggcctcgatc

SEQ ID NO: 216747 - DNA, 25 bp, Homo sapien
gcagagtctgcccaactacggtccg

SEQ ID NO: 216748 - DNA, 25 bp, Homo sapien
ggcatgggcatgagcaacacctaca

SEQ ID NO: 216749 - DNA, 25 bp, Homo sapien
tgcaccacgccatgagcatgtcctg

SEQ ID NO: 216750 - DNA, 25 bp, Homo sapien
ccacgtcgggccagctggaagaaat

SEQ ID NO: 216751 - DNA, 25 bp, Homo sapien
aacacgtgccttctgcccatatagg

SEQ ID NO: 216752 - DNA, 25 bp, Homo sapien
ccggtcgcgcaaagaacacagcttt

SEQ ID NO: 216753 - DNA, 25 bp, Homo sapien
ggtggattcctattcccagtcggta

SEQ ID NO: 216754 - DNA, 25 bp, Homo sapien
cccgcagtgttgatctaagaaggta

SEQ ID NO: 216755 - DNA, 25 bp, Homo sapien
cggcggactccggatactttgagtg

SEQ ID NO: 216756 - DNA, 25 bp, Homo sapien
cgatgatttgcatagcgcgggtctt

SEQ ID NO: 216757 - DNA, 25 bp, Homo sapien
cagccagtagagagcgataataata

SEQ ID NO: 216758 - DNA, 25 bp, Homo sapien
taaaggcaggatgacagctattctc

SEQ ID NO: 216759 - DNA, 25 bp, Homo sapien
aacgcattgcctgggcagcctcggc

SEQ ID NO: 216760 - DNA, 25 bp, Homo sapien
ggcgccgctccctgcgtgaaaatgg

SEQ ID NO: 216761 - DNA, 25 bp, Homo sapien
ttgcgccgagtgaacgcattgcctg

SEQ ID NO: 216762 - DNA, 25 bp, Homo sapien
gcagccatgtttgcgccgagtgaac

SEQ ID NO: 216763 - DNA, 25 bp, Homo sapien
acttacgcggatcgcggagcaggac

SEQ ID NO: 216764 - DNA, 25 bp, Homo sapien
gcgacagacccacttacgcggatcg

SEQ ID NO: 216765 - DNA, 25 bp, Homo sapien
gccttctcagggatcctggccctgg

SEQ ID NO: 216766 - DNA, 25 bp, Homo sapien
cgctccctgcgtgaaaatgggcccg

SEQ ID NO: 216767 - DNA, 25 bp, Homo sapien
gtgcgggtcctcttgcaaaccagac

SEQ ID NO: 216768 - DNA, 25 bp, Homo sapien
cgcccactctggtaggcactaagga

SEQ ID NO: 216769 - DNA, 25 bp, Homo sapien
ggaacaccgcgccatacactgagtc

SEQ ID NO: 216770 - DNA, 25 bp, Homo sapien
gacgccgtcttatgactccaacgtg

SEQ ID NO: 216771 - DNA, 25 bp, Homo sapien
cgattccggcgttgcatcagagagc

SEQ ID NO: 216772 - DNA, 25 bp, Homo sapien
cgccgcggttccattggttacgaga

SEQ ID NO: 216773 - DNA, 25 bp, Homo sapien
agaccctggcacagtgtcacttttg

SEQ ID NO: 216774 - DNA, 25 bp, Homo sapien
cagaggcaacttccggatccagaga

SEQ ID NO: 216775 - DNA, 25 bp, Homo sapien
ctctgttcttttaatgtggcgtccc

SEQ ID NO: 216776 - DNA, 25 bp, Homo sapien
ttcctacttggtcctgttcgtggcg

SEQ ID NO: 216777 - DNA, 25 bp, Homo sapien
acttccgcgtttctggcgcgtggtc

SEQ ID NO: 216778 - DNA, 25 bp, Homo sapien
cgcaggatgagcgtctctgttcttt

SEQ ID NO: 216779 - DNA, 25 bp, Homo sapien
cttcgccctaccaggcgcaggatga

SEQ ID NO: 216780 - DNA, 25 bp, Homo sapien
cagctttgcgctgaaggtcgcttta

SEQ ID NO: 216781 - DNA, 25 bp, Homo sapien
ggaatccggggctcgccctagtcgc

SEQ ID NO: 216782 - DNA, 25 bp, Homo sapien
cgcgtggtcttgcatttcctacttg

SEQ ID NO: 216783 - DNA, 25 bp, Homo sapien
ggtgccatccgccacgatggcatca

SEQ ID NO: 216784 - DNA, 25 bp, Homo sapien
ctgctcctccgccttcaaccgcttg

SEQ ID NO: 216785 - DNA, 25 bp, Homo sapien
atccgccacgatggcatcaagcggc

SEQ ID NO: 216786 - DNA, 25 bp, Homo sapien
acgatggcatcaagcggcgagcgct

SEQ ID NO: 216787 - DNA, 25 bp, Homo sapien
gcatcaagcggcgagcgcttcttgc

SEQ ID NO: 216788 - DNA, 25 bp, Homo sapien
cgagcgcttcttgcggatgctgcgc

SEQ ID NO: 216789 - DNA, 25 bp, Homo sapien
cttcttgcggatgctgcgcccggag

SEQ ID NO: 216790 - DNA, 25 bp, Homo sapien
atgaggtccgcgtagccccgctggt

SEQ ID NO: 216791 - DNA, 25 bp, Homo sapien
cgctaccgatcgaagaacccaaaca

SEQ ID NO: 216792 - DNA, 25 bp, Homo sapien
caaatcccacctgtgcgggctcggg

SEQ ID NO: 216793 - DNA, 25 bp, Homo sapien
gtcagatacgtttggcccgcaagtc

SEQ ID NO: 216794 - DNA, 25 bp, Homo sapien
ttggcccgcaagtccttttcggaca

SEQ ID NO: 216795 - DNA, 25 bp, Homo sapien
ccttttcggacacgttggcatctgc

SEQ ID NO: 216796 - DNA, 25 bp, Homo sapien
acgttggcatctgctcccaaagagc

SEQ ID NO: 216797 - DNA, 25 bp, Homo sapien
ccggacatgtgtgtcgctaccgatc

SEQ ID NO: 216798 - DNA, 25 bp, Homo sapien
atcccggatctccaaagtgcggcgg

SEQ ID NO: 216799 - DNA, 25 bp, Homo sapien
agtcccagttcttaaggctcctgag

SEQ ID NO: 216800 - DNA, 25 bp, Homo sapien
ctccactctcttgcccgtgtaggtg

SEQ ID NO: 216801 - DNA, 25 bp, Homo sapien
gagattcccacgcaagtagcccgaa

SEQ ID NO: 216802 - DNA, 25 bp, Homo sapien
gacccgggtcactttgccaattctg

SEQ ID NO: 216803 - DNA, 25 bp, Homo sapien
ctccggtcggagtttcaggtctaat

SEQ ID NO: 216804 - DNA, 25 bp, Homo sapien
cttcgccaactagtagccacggaga

SEQ ID NO: 216805 - DNA, 25 bp, Homo sapien
gccggtcaaccgcagacaaatctga

SEQ ID NO: 216806 - DNA, 25 bp, Homo sapien
tacctggagcgaacaccatgatttc

SEQ ID NO: 216807 - DNA, 25 bp, Homo sapien
tcattgtttgtaaataaagcggcgc

SEQ ID NO: 216808 - DNA, 25 bp, Homo sapien
ttccgaagacgaggtgagtggcacc

SEQ ID NO: 216809 - DNA, 25 bp, Homo sapien
gggagttcctatcccgcgccggcag

SEQ ID NO: 216810 - DNA, 25 bp, Homo sapien
ctccgcaagccgagctcattgtttg

SEQ ID NO: 216811 - DNA, 25 bp, Homo sapien
tttgtaaataaagcggcgcgacgcc

SEQ ID NO: 216812 - DNA, 25 bp, Homo sapien
aaagcggcgcgacgcccttggagct

SEQ ID NO: 216813 - DNA, 25 bp, Homo sapien
agccggtctatggactttccgaaga

SEQ ID NO: 216814 - DNA, 25 bp, Homo sapien
gatccaggggagcttgggtccttcc

SEQ ID NO: 216815 - DNA, 25 bp, Homo sapien
cttccttctccagggcgagctctga

SEQ ID NO: 216816 - DNA, 25 bp, Homo sapien
gggcgcttagcttcgcgacctcaca

SEQ ID NO: 216817 - DNA, 25 bp, Homo sapien
cctgcgaagaaactccacggctgct

SEQ ID NO: 216818 - DNA, 25 bp, Homo sapien
cctggagatcacagccctgcgaaga

SEQ ID NO: 216819 - DNA, 25 bp, Homo sapien
gcggacagatgacttcaccgttgta

SEQ ID NO: 216820 - DNA, 25 bp, Homo sapien
ccaccatccatcaaaggcggacaga

SEQ ID NO: 216821 - DNA, 25 bp, Homo sapien
ctctgaaagcatctcgggctgtgtg

SEQ ID NO: 216822 - DNA, 25 bp, Homo sapien
gggctgtactcacgtagtgcttgga

SEQ ID NO: 216823 - DNA, 25 bp, Homo sapien
cgattcgagagaggcaggcatccgc

SEQ ID NO: 216824 - DNA, 25 bp, Homo sapien
ggcagcagcttccaacccagacagg

SEQ ID NO: 216825 - DNA, 25 bp, Homo sapien
agcagcttccaacccagacaggctt

SEQ ID NO: 216826 - DNA, 25 bp, Homo sapien
ttccaacccagacaggcttaagccg

SEQ ID NO: 216827 - DNA, 25 bp, Homo sapien
ccagacaggcttaagccgcgcgagg

SEQ ID NO: 216828 - DNA, 25 bp, Homo sapien
ggagaccaggatttctcctcgccgc

SEQ ID NO: 216829 - DNA, 25 bp, Homo sapien
agctggcggagaccaggatttctcc

SEQ ID NO: 216830 - DNA, 25 bp, Homo sapien
cccactccaggctgttggttacctg

SEQ ID NO: 216831 - DNA, 25 bp, Homo sapien
aggtatcctcgcattcggctggaga

SEQ ID NO: 216832 - DNA, 25 bp, Homo sapien
gcgcttaagcggagctcgtccatgt

SEQ ID NO: 216833 - DNA, 25 bp, Homo sapien
gtccatgttcatcccgcagctcttg

SEQ ID NO: 216834 - DNA, 25 bp, Homo sapien
cctcaactttggcttcacgggcaca

SEQ ID NO: 216835 - DNA, 25 bp, Homo sapien
ggccaggggtgcacatttaagatca

SEQ ID NO: 216836 - DNA, 25 bp, Homo sapien
tcccgaggagaaaagcgccaaaagc

SEQ ID NO: 216837 - DNA, 25 bp, Homo sapien
aaagccctgtttccacgggagctga

SEQ ID NO: 216838 - DNA, 25 bp, Homo sapien
ttttgtcttccagttgcagcagccc

SEQ ID NO: 216839 - DNA, 25 bp, Homo sapien
ctcggcaaacctgtctaattggggc

SEQ ID NO: 216840 - DNA, 25 bp, Homo sapien
gcagccgcacgcacgcagtaggcag

SEQ ID NO: 216841 - DNA, 25 bp, Homo sapien
agctgccggggcgtaattcctccac

SEQ ID NO: 216842 - DNA, 25 bp, Homo sapien
ctctctggcgtgagtacgcaggcct

SEQ ID NO: 216843 - DNA, 25 bp, Homo sapien
agccggcgactgagaaccgcttgcc

SEQ ID NO: 216844 - DNA, 25 bp, Homo sapien
tgtcgccgggcacatgaaagtccct

SEQ ID NO: 216845 - DNA, 25 bp, Homo sapien
ggcacatgaaagtccctgagtcagg

SEQ ID NO: 216846 - DNA, 25 bp, Homo sapien
tgccgcgctgccagatttgttcttc

SEQ ID NO: 216847 - DNA, 25 bp, Homo sapien
cagagggcagcacaggcttgcgttc

SEQ ID NO: 216848 - DNA, 25 bp, Homo sapien
cacggagcagtggtgcgctctcacc

SEQ ID NO: 216849 - DNA, 25 bp, Homo sapien
cttgggagctgggtgcaccccttag

SEQ ID NO: 216850 - DNA, 25 bp, Homo sapien
ttcgccttctgagctcggggccggc

SEQ ID NO: 216851 - DNA, 25 bp, Homo sapien
gcttgcgttcgtcccggtctgagcg

SEQ ID NO: 216852 - DNA, 25 bp, Homo sapien
cagcacaggcttgcgttcgtcccgg

SEQ ID NO: 216853 - DNA, 25 bp, Homo sapien
gctcccacgcacatccaggtcctcc

SEQ ID NO: 216854 - DNA, 25 bp, Homo sapien
tgcaccccttagaggagcccggctt

SEQ ID NO: 216855 - DNA, 25 bp, Homo sapien
gcgctcccttttgttcgctcgccgc

SEQ ID NO: 216856 - DNA, 25 bp, Homo sapien
aaaggactgggtgagagcccgcaat

SEQ ID NO: 216857 - DNA, 25 bp, Homo sapien
tgagagcccgcaatgtcgttggaaa

SEQ ID NO: 216858 - DNA, 25 bp, Homo sapien
atgtcgttggaaaaaagcagccctc

SEQ ID NO: 216859 - DNA, 25 bp, Homo sapien
caaaggtcatccgagctgcggccca

SEQ ID NO: 216860 - DNA, 25 bp, Homo sapien
ggaacgcagatgacacgcccgtaac

SEQ ID NO: 216861 - DNA, 25 bp, Homo sapien
gcgccgcgctgaacaaaggtcatcc

SEQ ID NO: 216862 - DNA, 25 bp, Homo sapien
tgacacgcccgtaacatggaagccg

SEQ ID NO: 216863 - DNA, 25 bp, Homo sapien
atacacggctaggtgatttgcgagc

SEQ ID NO: 216864 - DNA, 25 bp, Homo sapien
cccaagactggcgagactacgattc

SEQ ID NO: 216865 - DNA, 25 bp, Homo sapien
tcgctgctcgatgttccctccgaag

SEQ ID NO: 216866 - DNA, 25 bp, Homo sapien
cgcctgaccagagtcgggaaattca

SEQ ID NO: 216867 - DNA, 25 bp, Homo sapien
cgctgcagtcatccaatagccaaga

SEQ ID NO: 216868 - DNA, 25 bp, Homo sapien
agcgtagaggcaccacctttcctcg

SEQ ID NO: 216869 - DNA, 25 bp, Homo sapien
gcttggatatcttcggggacctgaa

SEQ ID NO: 216870 - DNA, 25 bp, Homo sapien
cgggaaattcagctcctcttgagta

SEQ ID NO: 216871 - DNA, 25 bp, Homo sapien
gggaccgtgctgaccaagatgtacc

SEQ ID NO: 216872 - DNA, 25 bp, Homo sapien
gtccgggtcaccagtctctgctctt

SEQ ID NO: 216873 - DNA, 25 bp, Homo sapien
ccgcccgggcttccatataaagtag

SEQ ID NO: 216874 - DNA, 25 bp, Homo sapien
cccggttagctatagggagacgtca

SEQ ID NO: 216875 - DNA, 25 bp, Homo sapien
cactaaattgtgttggatggaaggc

SEQ ID NO: 216876 - DNA, 25 bp, Homo sapien
ggggcaatgtacactcagccttttc

SEQ ID NO: 216877 - DNA, 25 bp, Homo sapien
cagagcgctctggtccgcgatagaa

SEQ ID NO: 216878 - DNA, 25 bp, Homo sapien
tcgaggaccggaggaattaatccga

SEQ ID NO: 216879 - DNA, 25 bp, Homo sapien
atccactagggatacacagcctgga

SEQ ID NO: 216880 - DNA, 25 bp, Homo sapien
tcttaacgtcgagcctctggagccc

SEQ ID NO: 216881 - DNA, 25 bp, Homo sapien
cgccatcctacagctgttctcttaa

SEQ ID NO: 216882 - DNA, 25 bp, Homo sapien
gcggtcctacgggaacctcaggaca

SEQ ID NO: 216883 - DNA, 25 bp, Homo sapien
gtgttcggaactaggaaatccacta

SEQ ID NO: 216884 - DNA, 25 bp, Homo sapien
gacagaaccgtgttcggaactagga

SEQ ID NO: 216885 - DNA, 25 bp, Homo sapien
acagctgttctcttaacgtcgagcc

SEQ ID NO: 216886 - DNA, 25 bp, Homo sapien
tcctacgggaacctcaggacactga

SEQ ID NO: 216887 - DNA, 25 bp, Homo sapien
caacctggttcgcaagagcagaaga

SEQ ID NO: 216888 - DNA, 25 bp, Homo sapien
gcgcggtccaattcgcggcgtcctt

SEQ ID NO: 216889 - DNA, 25 bp, Homo sapien
tctcggcgcggtccaattcgcggcg

SEQ ID NO: 216890 - DNA, 25 bp, Homo sapien
gcccaacctggttcgcaagagcaga

SEQ ID NO: 216891 - DNA, 25 bp, Homo sapien
cctggttcgcaagagcagaagagga

SEQ ID NO: 216892 - DNA, 25 bp, Homo sapien
gagcagaagaggatcccggtctaca

SEQ ID NO: 216893 - DNA, 25 bp, Homo sapien
ggatcccggtctacagacccgcttg

SEQ ID NO: 216894 - DNA, 25 bp, Homo sapien
cgcttgctttcctcctagggcgggt

SEQ ID NO: 216895 - DNA, 25 bp, Homo sapien
gtaaccggcatcttgtcctgtgctg

SEQ ID NO: 216896 - DNA, 25 bp, Homo sapien
taaccggcatcttgtcctgtgctgg

SEQ ID NO: 216897 - DNA, 25 bp, Homo sapien
aaccggcatcttgtcctgtgctggg

SEQ ID NO: 216898 - DNA, 25 bp, Homo sapien
gtacaaatggccagacgggaaacgc

SEQ ID NO: 216899 - DNA, 25 bp, Homo sapien
tacaaatggccagacgggaaacgcg

SEQ ID NO: 216900 - DNA, 25 bp, Homo sapien
caaatggccagacgggaaacgcgcc

SEQ ID NO: 216901 - DNA, 25 bp, Homo sapien
caggtgtcccggagcgtctccctgt

SEQ ID NO: 216902 - DNA, 25 bp, Homo sapien
aggtgtcccggagcgtctccctgtc

SEQ ID NO: 216903 - DNA, 25 bp, Homo sapien
cttcggaacggctaaacatcaactt

SEQ ID NO: 216904 - DNA, 25 bp, Homo sapien
gactgtcgctctgccctaaactttc

SEQ ID NO: 216905 - DNA, 25 bp, Homo sapien
gcagccctgcacgtgttggggcata

SEQ ID NO: 216906 - DNA, 25 bp, Homo sapien
gtacaggcgtagcagaaaccgcttg

SEQ ID NO: 216907 - DNA, 25 bp, Homo sapien
tctgggaagatacgtctgtacaggc

SEQ ID NO: 216908 - DNA, 25 bp, Homo sapien
taagaggcgttcctcacgtcaggac

SEQ ID NO: 216909 - DNA, 25 bp, Homo sapien
aggacgcctgcgttccttacggctc

SEQ ID NO: 216910 - DNA, 25 bp, Homo sapien
catagtggatgggtctgactgtcgc

SEQ ID NO: 216911 - DNA, 25 bp, Homo sapien
tttgcctttagccactagcggagcc

SEQ ID NO: 216912 - DNA, 25 bp, Homo sapien
ctttgaccctcgctgggaagcttga

SEQ ID NO: 216913 - DNA, 25 bp, Homo sapien
gcggagcagttcgtagtcgcctaca

SEQ ID NO: 216914 - DNA, 25 bp, Homo sapien
catgactttcttcgaggctagattc

SEQ ID NO: 216915 - DNA, 25 bp, Homo sapien
gcaggcgttctcttacatgactttc

SEQ ID NO: 216916 - DNA, 25 bp, Homo sapien
tcccgactttttgatgcaggcgttc

SEQ ID NO: 216917 - DNA, 25 bp, Homo sapien
gctgtcatgatgtaggacctcctga

SEQ ID NO: 216918 - DNA, 25 bp, Homo sapien
ctgctgtgcgagaaagcctacctgc

SEQ ID NO: 216919 - DNA, 25 bp, Homo sapien
tctccaagcctcctgggaatggcca

SEQ ID NO: 216920 - DNA, 25 bp, Homo sapien
cccaagtcctgagcgtgcttaaaca

SEQ ID NO: 216921 - DNA, 25 bp, Homo sapien
tggatgtgctccttggctttcagac

SEQ ID NO: 216922 - DNA, 25 bp, Homo sapien
cgcgtggccctgaactatgcttggc

SEQ ID NO: 216923 - DNA, 25 bp, Homo sapien
gagcgcgctagcatctgagccttag

SEQ ID NO: 216924 - DNA, 25 bp, Homo sapien
ggggacgattctctgctgcagcgaa

SEQ ID NO: 216925 - DNA, 25 bp, Homo sapien
gccaagtttaggagcttcagcctgt

SEQ ID NO: 216926 - DNA, 25 bp, Homo sapien
gcagcgaagtgtccctagaattttc

SEQ ID NO: 216927 - DNA, 25 bp, Homo sapien
ctgggccggcactaggaatattccc

SEQ ID NO: 216928 - DNA, 25 bp, Homo sapien
tgcgcactcaccttcgtactcgggg

SEQ ID NO: 216929 - DNA, 25 bp, Homo sapien
tggcctcgatgctgtgaagtcgcga

SEQ ID NO: 216930 - DNA, 25 bp, Homo sapien
gctgccgccttagtcccagaagtcg

SEQ ID NO: 216931 - DNA, 25 bp, Homo sapien
ttccacctcttgatccgttttaagc

SEQ ID NO: 216932 - DNA, 25 bp, Homo sapien
tttgtctccctctacttcgggctta

SEQ ID NO: 216933 - DNA, 25 bp, Homo sapien
gggcttaccctctcacttcagacta

SEQ ID NO: 216934 - DNA, 25 bp, Homo sapien
caagcgagaagctcccgtcggccat

SEQ ID NO: 216935 - DNA, 25 bp, Homo sapien
tgtacccagagcctcgtcagtgcgg

SEQ ID NO: 216936 - DNA, 25 bp, Homo sapien
atgggccatcgaagggtccctgtac

SEQ ID NO: 216937 - DNA, 25 bp, Homo sapien
ctctttttcgccacatgggccatcg

SEQ ID NO: 216938 - DNA, 25 bp, Homo sapien
cagacgttagcctgggaaacgtgtc

SEQ ID NO: 216939 - DNA, 25 bp, Homo sapien
catagcctgggcagacgttagcctg

SEQ ID NO: 216940 - DNA, 25 bp, Homo sapien
cttgctccagccaggatctggcttg

SEQ ID NO: 216941 - DNA, 25 bp, Homo sapien
agggtaacgtgcgacaagtgacagc

SEQ ID NO: 216942 - DNA, 25 bp, Homo sapien
agcggctgttctgcatagcctgggc

SEQ ID NO: 216943 - DNA, 25 bp, Homo sapien
cccttgaagctgtatttgtactcga

SEQ ID NO: 216944 - DNA, 25 bp, Homo sapien
gccatcttggattctggaacgcgga

SEQ ID NO: 216945 - DNA, 25 bp, Homo sapien
aaggcgcagaacagcggccgaactc

SEQ ID NO: 216946 - DNA, 25 bp, Homo sapien
ccctccacagcgcatatggtgtgca

SEQ ID NO: 216947 - DNA, 25 bp, Homo sapien
tttgtactcgaaacggcgatgtggc

SEQ ID NO: 216948 - DNA, 25 bp, Homo sapien
ctggaacgggaacctcagcacacca

SEQ ID NO: 216949 - DNA, 25 bp, Homo sapien
acgaagcgaccgagtgacagcagca

SEQ ID NO: 216950 - DNA, 25 bp, Homo sapien
ccaacagggcgctcgctgattggca

SEQ ID NO: 216951 - DNA, 25 bp, Homo sapien
tgaagacttcagacacgggtattta

SEQ ID NO: 216952 - DNA, 25 bp, Homo sapien
tgtcgcccaggacagctgagcactc

SEQ ID NO: 216953 - DNA, 25 bp, Homo sapien
gccctgaggttcaagttgtctcgtc

SEQ ID NO: 216954 - DNA, 25 bp, Homo sapien
tcgtcgcgattttgctctctgagca

SEQ ID NO: 216955 - DNA, 25 bp, Homo sapien
gggtcacgacgaagcgaaccagctc

SEQ ID NO: 216956 - DNA, 25 bp, Homo sapien
acctgtagcatgtggtgagctcgcc

SEQ ID NO: 216957 - DNA, 25 bp, Homo sapien
gggtatccctgacgcgacccacgga

SEQ ID NO: 216958 - DNA, 25 bp, Homo sapien
tgtaggtccacgtgtgtcccaacgc

SEQ ID NO: 216959 - DNA, 25 bp, Homo sapien
tgcaggactgttcgtgttcagctcg

SEQ ID NO: 216960 - DNA, 25 bp, Homo sapien
taggggcgcctccagaaagttcttc

SEQ ID NO: 216961 - DNA, 25 bp, Homo sapien
ctcaccgtgtgtagttggcatctcc

SEQ ID NO: 216962 - DNA, 25 bp, Homo sapien
ggcgtctagtttccctacgtcacca

SEQ ID NO: 216963 - DNA, 25 bp, Homo sapien
tctcactggacaaaagcgtggtctc

SEQ ID NO: 216964 - DNA, 25 bp, Homo sapien
tacgtcaccagggaagttctcactg

SEQ ID NO: 216965 - DNA, 25 bp, Homo sapien
cgtccagcgtttgcagatggtcaaa

SEQ ID NO: 216966 - DNA, 25 bp, Homo sapien
caagccggatttgcgattgggatgc

SEQ ID NO: 216967 - DNA, 25 bp, Homo sapien
cacaaaagcctctcccgttgcaggg

SEQ ID NO: 216968 - DNA, 25 bp, Homo sapien
tttagaactcatgcaccaaagatga

SEQ ID NO: 216969 - DNA, 25 bp, Homo sapien
ggtttagttgctctagacatgtcta

SEQ ID NO: 216970 - DNA, 25 bp, Homo sapien
tcacggtgctaaggtttagttgctc

SEQ ID NO: 216971 - DNA, 25 bp, Homo sapien
aaagatgaaaattccgtgctccggg

SEQ ID NO: 216972 - DNA, 25 bp, Homo sapien
gcctcttctgctcatgtgtcaagtg

SEQ ID NO: 216973 - DNA, 25 bp, Homo sapien
tgacacaattaagcatagactatta

SEQ ID NO: 216974 - DNA, 25 bp, Homo sapien
catgtgtcaagtggtcacggtgcta

SEQ ID NO: 216975 - DNA, 25 bp, Homo sapien
tcctggcaaccgcacggagactttg

SEQ ID NO: 216976 - DNA, 25 bp, Homo sapien
agaatgtggtgggtactcgagtccc

SEQ ID NO: 216977 - DNA, 25 bp, Homo sapien
gagttcgacttcctcggacttagtg

SEQ ID NO: 216978 - DNA, 25 bp, Homo sapien
taggaccgaaggtctccggagagtc

SEQ ID NO: 216979 - DNA, 25 bp, Homo sapien
ccgccctggagcagttaggaccgaa

SEQ ID NO: 216980 - DNA, 25 bp, Homo sapien
gagactttgcgaaacatccgaaggc

SEQ ID NO: 216981 - DNA, 25 bp, Homo sapien
ttctcactggacaggccgaacgcgg

SEQ ID NO: 216982 - DNA, 25 bp, Homo sapien
aggcagctacgtgagcagaacgccc

SEQ ID NO: 216983 - DNA, 25 bp, Homo sapien
cggactcggaacagagcttcgactt

SEQ ID NO: 216984 - DNA, 25 bp, Homo sapien
caaatccagacgttctccgcgggtg

SEQ ID NO: 216985 - DNA, 25 bp, Homo sapien
ccaagctctacgaggccgacatgga

SEQ ID NO: 216986 - DNA, 25 bp, Homo sapien
tcgactccctccagacgtatatgtt

SEQ ID NO: 216987 - DNA, 25 bp, Homo sapien
cggcaccggaaacaaccatacatca

SEQ ID NO: 216988 - DNA, 25 bp, Homo sapien
atgctgcccgagatcgagagcctct

SEQ ID NO: 216989 - DNA, 25 bp, Homo sapien
acagctacgtgctggccaagctcta

SEQ ID NO: 216990 - DNA, 25 bp, Homo sapien
tgcctcagacgtgcgcagtgaacag

SEQ ID NO: 216991 - DNA, 25 bp, Homo sapien
gagtcctgaccgctcggacccgtcg

SEQ ID NO: 216992 - DNA, 25 bp, Homo sapien
gcagccagtctgagggacgtagcgc

SEQ ID NO: 216993 - DNA, 25 bp, Homo sapien
gtgctccgctcacgcgaaccctcgg

SEQ ID NO: 216994 - DNA, 25 bp, Homo sapien
gaacaaatgcgtccatcacaccagc

SEQ ID NO: 216995 - DNA, 25 bp, Homo sapien
cgtcagggaccgaagaacaaatgcg

SEQ ID NO: 216996 - DNA, 25 bp, Homo sapien
gagggctcggcttctcgactgcccg

SEQ ID NO: 216997 - DNA, 25 bp, Homo sapien
ggagactcgccgtgacacgggccta

SEQ ID NO: 216998 - DNA, 25 bp, Homo sapien
tctctctcccagagtggccgccgcc

SEQ ID NO: 216999 - DNA, 25 bp, Homo sapien
acgagtccagctggctttgtcctgc

SEQ ID NO: 217000 - DNA, 25 bp, Homo sapien
tttttgtgtcactgagactccggca

SEQ ID NO: 217001 - DNA, 25 bp, Homo sapien
tcggcaccgagcgagagctttttgt

SEQ ID NO: 217002 - DNA, 25 bp, Homo sapien
cccagttacagcaggcggcagctgc

SEQ ID NO: 217003 - DNA, 25 bp, Homo sapien
tctcaggagacacgcaactcccggg

SEQ ID NO: 217004 - DNA, 25 bp, Homo sapien
cgggcacgaggaaagctccctcgga

SEQ ID NO: 217005 - DNA, 25 bp, Homo sapien
ccctggggcaacttctagggctgga

SEQ ID NO: 217006 - DNA, 25 bp, Homo sapien
cacagcgctctctaatcccgggagg

SEQ ID NO: 217007 - DNA, 25 bp, Homo sapien
gcgctaagccgcgttacagtgcagg

SEQ ID NO: 217008 - DNA, 25 bp, Homo sapien
cgggcgcgctaagccgcgttacagt

SEQ ID NO: 217009 - DNA, 25 bp, Homo sapien
gagccgggcttcccgcaaagccaaa

SEQ ID NO: 217010 - DNA, 25 bp, Homo sapien
gccaaaaacttacataagcagctgc

SEQ ID NO: 217011 - DNA, 25 bp, Homo sapien
aagccgcgttacagtgcagggagcc

SEQ ID NO: 217012 - DNA, 25 bp, Homo sapien
ctaagccgcgttacagtgcagggag

SEQ ID NO: 217013 - DNA, 25 bp, Homo sapien
tcccgcaaagccaaaaacttacata

SEQ ID NO: 217014 - DNA, 25 bp, Homo sapien
aaacttacataagcagctgcagccg

SEQ ID NO: 217015 - DNA, 25 bp, Homo sapien
cccaagaagccctcaaggcgtatcg

SEQ ID NO: 217016 - DNA, 25 bp, Homo sapien
agcgcagacccaagaagccctcaag

SEQ ID NO: 217017 - DNA, 25 bp, Homo sapien
gcggctgcacgacttccttgttgca

SEQ ID NO: 217018 - DNA, 25 bp, Homo sapien
aagcttgcaacttcggagtcgggag

SEQ ID NO: 217019 - DNA, 25 bp, Homo sapien
tgcaagcttgcaacttcggagtcgg

SEQ ID NO: 217020 - DNA, 25 bp, Homo sapien
cgacttccttgttgcaagcttgcaa

SEQ ID NO: 217021 - DNA, 25 bp, Homo sapien
gacaatggcggctgcacgacttcct

SEQ ID NO: 217022 - DNA, 25 bp, Homo sapien
gcacgacttccttgttgcaagcttg

SEQ ID NO: 217023 - DNA, 25 bp, Homo sapien
cccggcccgattatcaattgatgcg

SEQ ID NO: 217024 - DNA, 25 bp, Homo sapien
ggagggtattcctaagccaccacta

SEQ ID NO: 217025 - DNA, 25 bp, Homo sapien
gccgctgctgctatcgcgataattc

SEQ ID NO: 217026 - DNA, 25 bp, Homo sapien
ggagcgtactccttgtctctaagtc

SEQ ID NO: 217027 - DNA, 25 bp, Homo sapien
tgctcagctgttgcgcgatcaatac

SEQ ID NO: 217028 - DNA, 25 bp, Homo sapien
gatcaatacttgctgaccgccctgg

SEQ ID NO: 217029 - DNA, 25 bp, Homo sapien
cctggagctgcataccgagctgtta

SEQ ID NO: 217030 - DNA, 25 bp, Homo sapien
agcggggccttcaatctttgctatc

SEQ ID NO: 217031 - DNA, 25 bp, Homo sapien
tcccaccgcaaaccaggggagcttg

SEQ ID NO: 217032 - DNA, 25 bp, Homo sapien
ttccacccggaaagagacatgattc

SEQ ID NO: 217033 - DNA, 25 bp, Homo sapien
tgggcacctcacttgcggcagataa

SEQ ID NO: 217034 - DNA, 25 bp, Homo sapien
cggcagataaccgttcccgatacga

SEQ ID NO: 217035 - DNA, 25 bp, Homo sapien
ttagccgcaggctttgatgctgtca

SEQ ID NO: 217036 - DNA, 25 bp, Homo sapien
cgatacgatttctcccgggtggcct

SEQ ID NO: 217037 - DNA, 25 bp, Homo sapien
cggtcctctcggaacaggtttctca

SEQ ID NO: 217038 - DNA, 25 bp, Homo sapien
tctcagtacagttagcaagcgaatg

SEQ ID NO: 217039 - DNA, 25 bp, Homo sapien
atcatcgtggtctacgtcagccaga

SEQ ID NO: 217040 - DNA, 25 bp, Homo sapien
tgtgactggaaacagtaactccacg

SEQ ID NO: 217041 - DNA, 25 bp, Homo sapien
tccacgttcatctccagcgggcagg

SEQ ID NO: 217042 - DNA, 25 bp, Homo sapien
aacttcaagggcgacatcatcgtgg

SEQ ID NO: 217043 - DNA, 25 bp, Homo sapien
tacgtcagccagacctcgcaggagg

SEQ ID NO: 217044 - DNA, 25 bp, Homo sapien
cgccgagactccttcgcggggaacg

SEQ ID NO: 217045 - DNA, 25 bp, Homo sapien
cacccagggatcgatcggtacagtc

SEQ ID NO: 217046 - DNA, 25 bp, Homo sapien
cagcgggcaggtgatgaacttcaag

SEQ ID NO: 217047 - DNA, 25 bp, Homo sapien
aaggaggacaccctcgctcgcttgc

SEQ ID NO: 217048 - DNA, 25 bp, Homo sapien
tggactcggtgctcaaaagcctgcg

SEQ ID NO: 217049 - DNA, 25 bp, Homo sapien
actacctgcgcgactcggaggccaa

SEQ ID NO: 217050 - DNA, 25 bp, Homo sapien
agctgcgcttccttggctcgtgcct

SEQ ID NO: 217051 - DNA, 25 bp, Homo sapien
tgtgcaacccgctggagctgcgctt

SEQ ID NO: 217052 - DNA, 25 bp, Homo sapien
tcggcgcagcgcctggagttcatgt

SEQ ID NO: 217053 - DNA, 25 bp, Homo sapien
ctcatcgtctacctggcgctgctgg

SEQ ID NO: 217054 - DNA, 25 bp, Homo sapien
cagcccgggaagacgacgccagcga

SEQ ID NO: 217055 - DNA, 25 bp, Homo sapien
gctcggaggtcacgcaacgcccgga

SEQ ID NO: 217056 - DNA, 25 bp, Homo sapien
ccggagctagcgcacggcgatatag

SEQ ID NO: 217057 - DNA, 25 bp, Homo sapien
tagcgccggagacttccaggcggac

SEQ ID NO: 217058 - DNA, 25 bp, Homo sapien
gacttccaggcggactcgagaacca

SEQ ID NO: 217059 - DNA, 25 bp, Homo sapien
cggactcgagaaccacgtggatgct

SEQ ID NO: 217060 - DNA, 25 bp, Homo sapien
cgagaaccacgtggatgctgcgctg

SEQ ID NO: 217061 - DNA, 25 bp, Homo sapien
gaggtcacgcaacgcccggagctag

SEQ ID NO: 217062 - DNA, 25 bp, Homo sapien
ctagcgcacggcgatatagggtccg

SEQ ID NO: 217063 - DNA, 25 bp, Homo sapien
ggcacggaggcatacccaaccttga

SEQ ID NO: 217064 - DNA, 25 bp, Homo sapien
agccggccacactcaggacgatggt

SEQ ID NO: 217065 - DNA, 25 bp, Homo sapien
gaaacgtgagctgttgtcaggccca

SEQ ID NO: 217066 - DNA, 25 bp, Homo sapien
aaagaggcgcccagaggatatcacc

SEQ ID NO: 217067 - DNA, 25 bp, Homo sapien
cccaaccttgagtgcgtccagcata

SEQ ID NO: 217068 - DNA, 25 bp, Homo sapien
gcggagactcctctttgcgtttcca

SEQ ID NO: 217069 - DNA, 25 bp, Homo sapien
gcgcgggtcagcaattcgaagtccg

SEQ ID NO: 217070 - DNA, 25 bp, Homo sapien
cgcgttcagatcctcgaagtggctc

SEQ ID NO: 217071 - DNA, 25 bp, Homo sapien
ctgaagcaccggcagacgctgcagc

SEQ ID NO: 217072 - DNA, 25 bp, Homo sapien
ccaactccctcctgctgaggagagg

SEQ ID NO: 217073 - DNA, 25 bp, Homo sapien
ggaagacgctgcttctgaagcaccg

SEQ ID NO: 217074 - DNA, 25 bp, Homo sapien
gactgggtgaggcaccagctccagc

SEQ ID NO: 217075 - DNA, 25 bp, Homo sapien
gtgcacgtcttcgaccgccacatgg

SEQ ID NO: 217076 - DNA, 25 bp, Homo sapien
gtgctctgcacactggacaccacgg

SEQ ID NO: 217077 - DNA, 25 bp, Homo sapien
cactggacaccacggccggcgaggt

SEQ ID NO: 217078 - DNA, 25 bp, Homo sapien
ctgaagaggaatctgtccgcggccg

SEQ ID NO: 217079 - DNA, 25 bp, Homo sapien
cctggcgaccgggtcccgggatgcg

SEQ ID NO: 217080 - DNA, 25 bp, Homo sapien
gcagctggctggacatctcggcgaa

SEQ ID NO: 217081 - DNA, 25 bp, Homo sapien
ctggctggacatctcggcgaagtcg

SEQ ID NO: 217082 - DNA, 25 bp, Homo sapien
acatctcggcgaagtcgcggcggta

SEQ ID NO: 217083 - DNA, 25 bp, Homo sapien
cggcgggagaagtcgtcgccggcct

SEQ ID NO: 217084 - DNA, 25 bp, Homo sapien
gagggtcaggtggaccacaggtggc

SEQ ID NO: 217085 - DNA, 25 bp, Homo sapien
tctgcagcggcgaggtcctggcgac

SEQ ID NO: 217086 - DNA, 25 bp, Homo sapien
tgaagggcgtcaggtgcagctggct

SEQ ID NO: 217087 - DNA, 25 bp, Homo sapien
cgcgcaccggttaattctgccaatc

SEQ ID NO: 217088 - DNA, 25 bp, Homo sapien
cgcgcttttttgctctcgctgggaa

SEQ ID NO: 217089 - DNA, 25 bp, Homo sapien
cacaggatcgatttacggccgcagg

SEQ ID NO: 217090 - DNA, 25 bp, Homo sapien
atctggccaattgcgcatcttttcc

SEQ ID NO: 217091 - DNA, 25 bp, Homo sapien
cgcgcgtcaggcaatctggccaatt

SEQ ID NO: 217092 - DNA, 25 bp, Homo sapien
tctgccaatcatgcgtctgggcctc

SEQ ID NO: 217093 - DNA, 25 bp, Homo sapien
ttggtttaacattccgaagctcagc

SEQ ID NO: 217094 - DNA, 25 bp, Homo sapien
accgctctgagtcgctgagtgaagc

SEQ ID NO: 217095 - DNA, 25 bp, Homo sapien
agggtgcgccatgaaaacaagggct

SEQ ID NO: 217096 - DNA, 25 bp, Homo sapien
aaagaaagagccctcctctgagcca

SEQ ID NO: 217097 - DNA, 25 bp, Homo sapien
ggtgcctgtcctcttacttcattct

SEQ ID NO: 217098 - DNA, 25 bp, Homo sapien
gcgtaacgtcacacggttcattcaa

SEQ ID NO: 217099 - DNA, 25 bp, Homo sapien
cgagcgctagaagcccgcgctgtgt

SEQ ID NO: 217100 - DNA, 25 bp, Homo sapien
aggatgactgctacgaagttctccc

SEQ ID NO: 217101 - DNA, 25 bp, Homo sapien
gaccggtttcctgtgcgtaacgtca

SEQ ID NO: 217102 - DNA, 25 bp, Homo sapien
attctctgcacagcccgaccggttt

SEQ ID NO: 217103 - DNA, 25 bp, Homo sapien
cccatttggccatgccttcctgggg

SEQ ID NO: 217104 - DNA, 25 bp, Homo sapien
acgctctgaaatcccgggctccatt

SEQ ID NO: 217105 - DNA, 25 bp, Homo sapien
gggagcccagcgactacgctctgaa

SEQ ID NO: 217106 - DNA, 25 bp, Homo sapien
aagactcgctcttcgggagctcgaa

SEQ ID NO: 217107 - DNA, 25 bp, Homo sapien
tccggacagcgccagatgcgagcgc

SEQ ID NO: 217108 - DNA, 25 bp, Homo sapien
ggagacaccatgtacagcagcagca

SEQ ID NO: 217109 - DNA, 25 bp, Homo sapien
gctgatgagcggagacaccatgtac

SEQ ID NO: 217110 - DNA, 25 bp, Homo sapien
cccgggctccattccatattttttg

SEQ ID NO: 217111 - DNA, 25 bp, Homo sapien
gcgacgtcttcgatttgtagtgtaa

SEQ ID NO: 217112 - DNA, 25 bp, Homo sapien
tcctcctgcacgagcacagaatgtc

SEQ ID NO: 217113 - DNA, 25 bp, Homo sapien
acagaatgtctagccggccgtgaac

SEQ ID NO: 217114 - DNA, 25 bp, Homo sapien
accgggtctctaagtgggcgagcaa

SEQ ID NO: 217115 - DNA, 25 bp, Homo sapien
ttgccgacgctttcgttggagacta

SEQ ID NO: 217116 - DNA, 25 bp, Homo sapien
gccagggaacttaagcacgagcgct

SEQ ID NO: 217117 - DNA, 25 bp, Homo sapien
ttgccgccggcacattgagtttgtg

SEQ ID NO: 217118 - DNA, 25 bp, Homo sapien
tggacggtgcacaataaacacttgc

SEQ ID NO: 217119 - DNA, 25 bp, Homo sapien
tcctcgtctcggtggtgaataattc

SEQ ID NO: 217120 - DNA, 25 bp, Homo sapien
acgccactcggcatcttccaaatga

SEQ ID NO: 217121 - DNA, 25 bp, Homo sapien
tccacatgctttgttgcctcgtagc

SEQ ID NO: 217122 - DNA, 25 bp, Homo sapien
cggggacgtcttttactttgagatg

SEQ ID NO: 217123 - DNA, 25 bp, Homo sapien
tagcctggaagccaatcgagccctg

SEQ ID NO: 217124 - DNA, 25 bp, Homo sapien
ccgggcacttccgatttcgtcatca

SEQ ID NO: 217125 - DNA, 25 bp, Homo sapien
ggagagccaacagcagcaacgtcga

SEQ ID NO: 217126 - DNA, 25 bp, Homo sapien
cgcgcacggggtaacagccctcaaa

SEQ ID NO: 217127 - DNA, 25 bp, Homo sapien
cttgaaagagcttccgagtgaaacc

SEQ ID NO: 217128 - DNA, 25 bp, Homo sapien
tgcaagcggcgcagaatccttgaaa

SEQ ID NO: 217129 - DNA, 25 bp, Homo sapien
tgaggtgtcccttgacccttctctc

SEQ ID NO: 217130 - DNA, 25 bp, Homo sapien
tctccttagggtgtatgaggtgtcc

SEQ ID NO: 217131 - DNA, 25 bp, Homo sapien
cgggaactaatagatggtctcctta

SEQ ID NO: 217132 - DNA, 25 bp, Homo sapien
cacctcctggtgactaattctagtg

SEQ ID NO: 217133 - DNA, 25 bp, Homo sapien
tgagcgcgtcgcctctaacactggt

SEQ ID NO: 217134 - DNA, 25 bp, Homo sapien
tctctccacggagctacgggtagca

SEQ ID NO: 217135 - DNA, 25 bp, Homo sapien
aaggccagagcaggaatcagagcga

SEQ ID NO: 217136 - DNA, 25 bp, Homo sapien
ctgcgctgtgatttgctgccggatg

SEQ ID NO: 217137 - DNA, 25 bp, Homo sapien
atttgctgcgctgtgatttgctgcc

SEQ ID NO: 217138 - DNA, 25 bp, Homo sapien
cttgcgatttgctgcgctgtgattt

SEQ ID NO: 217139 - DNA, 25 bp, Homo sapien
tgtttctaggcttgcgatttgctgc

SEQ ID NO: 217140 - DNA, 25 bp, Homo sapien
agagcaggaatcagagcgaggcaaa

SEQ ID NO: 217141 - DNA, 25 bp, Homo sapien
caggttcccgcggaggccacctctt

SEQ ID NO: 217142 - DNA, 25 bp, Homo sapien
gcgtctgtttctaggcttgcgattt

SEQ ID NO: 217143 - DNA, 25 bp, Homo sapien
cgcctgcggtcgtgccctttgagaa

SEQ ID NO: 217144 - DNA, 25 bp, Homo sapien
gtgcggtcacctgctcttcccgcgg

SEQ ID NO: 217145 - DNA, 25 bp, Homo sapien
tctgtgggtgtctgcaggcccgaat

SEQ ID NO: 217146 - DNA, 25 bp, Homo sapien
gccgggataataaggtctgtgggtg

SEQ ID NO: 217147 - DNA, 25 bp, Homo sapien
ctttgagaaggaaggcagaaggccc

SEQ ID NO: 217148 - DNA, 25 bp, Homo sapien
agcctctcccaggaggtagggactc

SEQ ID NO: 217149 - DNA, 25 bp, Homo sapien
agtcctgcgttcttggccgtctgac

SEQ ID NO: 217150 - DNA, 25 bp, Homo sapien
tctcccaggaggtagggactcaccc

SEQ ID NO: 217151 - DNA, 25 bp, Homo sapien
tgcgcctttggaagcaggactaatc

SEQ ID NO: 217152 - DNA, 25 bp, Homo sapien
ttctttcggatgcacacgcccgggt

SEQ ID NO: 217153 - DNA, 25 bp, Homo sapien
gcagccgagcgcacgttctttcgga

SEQ ID NO: 217154 - DNA, 25 bp, Homo sapien
agcggctccgtcttcgcgttctttt

SEQ ID NO: 217155 - DNA, 25 bp, Homo sapien
atgtccgtgtggagtttcccttggc

SEQ ID NO: 217156 - DNA, 25 bp, Homo sapien
cccggaaagccggtgttgacagaca

SEQ ID NO: 217157 - DNA, 25 bp, Homo sapien
ctctgcaaggcaggacaggcttgtg

SEQ ID NO: 217158 - DNA, 25 bp, Homo sapien
cgccgaagtctcagtggctccctgg

SEQ ID NO: 217159 - DNA, 25 bp, Homo sapien
tgcattttttcactggcgtcctccg

SEQ ID NO: 217160 - DNA, 25 bp, Homo sapien
cggtgtcgaaagacgcctctccgtg

SEQ ID NO: 217161 - DNA, 25 bp, Homo sapien
ggctggaagaacctaagcaagtttc

SEQ ID NO: 217162 - DNA, 25 bp, Homo sapien
ccctctgtaggaaacattcaggcta

SEQ ID NO: 217163 - DNA, 25 bp, Homo sapien
taaccgcgaatcgtgaccaggcgcc

SEQ ID NO: 217164 - DNA, 25 bp, Homo sapien
caagtccgcttacctcaggcagatc

SEQ ID NO: 217165 - DNA, 25 bp, Homo sapien
aaccacggaccgcaggacagagacc

SEQ ID NO: 217166 - DNA, 25 bp, Homo sapien
agcaagtttcagtcttggacaagtc

SEQ ID NO: 217167 - DNA, 25 bp, Homo sapien
cacgctgccatgctagcccgggaga

SEQ ID NO: 217168 - DNA, 25 bp, Homo sapien
taagaatcctttgcgctctcggtgc

SEQ ID NO: 217169 - DNA, 25 bp, Homo sapien
gcgcctgcgcagtcatgtcttaaga

SEQ ID NO: 217170 - DNA, 25 bp, Homo sapien
cggaagagaagcaccgcgctaacta

SEQ ID NO: 217171 - DNA, 25 bp, Homo sapien
gataaagacactggggtccgccgcc

SEQ ID NO: 217172 - DNA, 25 bp, Homo sapien
tactagggaaaacggtgctggttca

SEQ ID NO: 217173 - DNA, 25 bp, Homo sapien
aagctgactgtgcaaaagagggata

SEQ ID NO: 217174 - DNA, 25 bp, Homo sapien
acgtccagcattggtccggcacagc

SEQ ID NO: 217175 - DNA, 25 bp, Homo sapien
ggcccgctcccttctgagccgagca

SEQ ID NO: 217176 - DNA, 25 bp, Homo sapien
gcgcccattggctctgcgctttggc

SEQ ID NO: 217177 - DNA, 25 bp, Homo sapien
tgtgtacacccgtatcccggagacc

SEQ ID NO: 217178 - DNA, 25 bp, Homo sapien
acgccgctgctgtgtacacccgtat

SEQ ID NO: 217179 - DNA, 25 bp, Homo sapien
cagtgttttcctcaggcgggagcag

SEQ ID NO: 217180 - DNA, 25 bp, Homo sapien
cagattggtggaaggtctgccgctc

SEQ ID NO: 217181 - DNA, 25 bp, Homo sapien
tgaacaccgcacctcacggacaagg

SEQ ID NO: 217182 - DNA, 25 bp, Homo sapien
tgcgccatgggcagtgttttcctca

SEQ ID NO: 217183 - DNA, 25 bp, Homo sapien
ctttaacgacatagtcaagcagggc

SEQ ID NO: 217184 - DNA, 25 bp, Homo sapien
gaggcgccgtgtccttaggaatctc

SEQ ID NO: 217185 - DNA, 25 bp, Homo sapien
tggccatggcctccaactttaacga

SEQ ID NO: 217186 - DNA, 25 bp, Homo sapien
caagcagggctacgtgaaaatccgc

SEQ ID NO: 217187 - DNA, 25 bp, Homo sapien
tgaaaatccgcagcaggaagcttgg

SEQ ID NO: 217188 - DNA, 25 bp, Homo sapien
atggcccgcttgttgcttggccagg

SEQ ID NO: 217189 - DNA, 25 bp, Homo sapien
atcctcgagtgcaccgggctgtctt

SEQ ID NO: 217190 - DNA, 25 bp, Homo sapien
tagacgaaaggggttgtcagttcca

SEQ ID NO: 217191 - DNA, 25 bp, Homo sapien
aaagctgcggttctccaggagtctg

SEQ ID NO: 217192 - DNA, 25 bp, Homo sapien
ccacgggaaaagctgcggttctcca

SEQ ID NO: 217193 - DNA, 25 bp, Homo sapien
ggcatataaggacgaacccacggga

SEQ ID NO: 217194 - DNA, 25 bp, Homo sapien
agcgcctcattcttttccaggcata

SEQ ID NO: 217195 - DNA, 25 bp, Homo sapien
cttgggtagaagaaagcgcctcatt

SEQ ID NO: 217196 - DNA, 25 bp, Homo sapien
tcaagggcttttcttgggtagaaga

SEQ ID NO: 217197 - DNA, 25 bp, Homo sapien
agagtcagatcctcggccaggtttc

SEQ ID NO: 217198 - DNA, 25 bp, Homo sapien
caggagtctggttgttcctcgcagc

SEQ ID NO: 217199 - DNA, 25 bp, Homo sapien
tctcatcgtggcctacttgaaccga

SEQ ID NO: 217200 - DNA, 25 bp, Homo sapien
acttgaaccgagtgtccgatctccc

SEQ ID NO: 217201 - DNA, 25 bp, Homo sapien
tacccgctgggtatccagccttagc

SEQ ID NO: 217202 - DNA, 25 bp, Homo sapien
tgggtatccagccttagcgcgcacc

SEQ ID NO: 217203 - DNA, 25 bp, Homo sapien
gtcgctcgggtgctcttcagcctgg

SEQ ID NO: 217204 - DNA, 25 bp, Homo sapien
taaggactgtttgtgccgacccttc

SEQ ID NO: 217205 - DNA, 25 bp, Homo sapien
aagtgacggcatctgcttctgggtc

SEQ ID NO: 217206 - DNA, 25 bp, Homo sapien
tgggctccaaccttatctcatcgtg

SEQ ID NO: 217207 - DNA, 25 bp, Homo sapien
atccgaaaaagcaagcccctgcggc

SEQ ID NO: 217208 - DNA, 25 bp, Homo sapien
aggggaagaagtccggcgagattag

SEQ ID NO: 217209 - DNA, 25 bp, Homo sapien
tccggcgagattagaggggaaatcc

SEQ ID NO: 217210 - DNA, 25 bp, Homo sapien
gaaatccgaaaaagcaagcccctgc

SEQ ID NO: 217211 - DNA, 25 bp, Homo sapien
ccgaaaaagcaagcccctgcggcag

SEQ ID NO: 217212 - DNA, 25 bp, Homo sapien
ccaggaaacactcgccaggaactgg

SEQ ID NO: 217213 - DNA, 25 bp, Homo sapien
ggaaacactcgccaggaactggctg

SEQ ID NO: 217214 - DNA, 25 bp, Homo sapien
gcgagattagaggggaaatccgaaa

SEQ ID NO: 217215 - DNA, 25 bp, Homo sapien
tcccgactgcaaagagactacgtta

SEQ ID NO: 217216 - DNA, 25 bp, Homo sapien
gtgacacgaccattctcagcaagtg

SEQ ID NO: 217217 - DNA, 25 bp, Homo sapien
cgctcaccaggagtaggagtcatta

SEQ ID NO: 217218 - DNA, 25 bp, Homo sapien
atctcggccagctgatgacctgtca

SEQ ID NO: 217219 - DNA, 25 bp, Homo sapien
actgcgtccagccacaattaatgta

SEQ ID NO: 217220 - DNA, 25 bp, Homo sapien
ggagaattaaactgccgcgccactg

SEQ ID NO: 217221 - DNA, 25 bp, Homo sapien
taccgagtttcctgatgagccctgc

SEQ ID NO: 217222 - DNA, 25 bp, Homo sapien
tgcgcacttcctggacagcagtctc

SEQ ID NO: 217223 - DNA, 25 bp, Homo sapien
aggaaaaaccaggacagggactctg

SEQ ID NO: 217224 - DNA, 25 bp, Homo sapien
acggctggttttcgcctcggagtgc

SEQ ID NO: 217225 - DNA, 25 bp, Homo sapien
ctgcagcgacgggtctgggtcagcg

SEQ ID NO: 217226 - DNA, 25 bp, Homo sapien
ggccgcggacggctcttctcgaccc

SEQ ID NO: 217227 - DNA, 25 bp, Homo sapien
cgccgcctttgttgcccgcagctcg

SEQ ID NO: 217228 - DNA, 25 bp, Homo sapien
tccctcctcggacctccgcgggctc

SEQ ID NO: 217229 - DNA, 25 bp, Homo sapien
acacggctggttttcgcctcggagt

SEQ ID NO: 217230 - DNA, 25 bp, Homo sapien
cgggacacggctggttttcgcctcg

SEQ ID NO: 217231 - DNA, 25 bp, Homo sapien
actataattgccacgtcggtctgcg

SEQ ID NO: 217232 - DNA, 25 bp, Homo sapien
catcggggactataattgccacgtc

SEQ ID NO: 217233 - DNA, 25 bp, Homo sapien
tgccatcggggactataattgccac

SEQ ID NO: 217234 - DNA, 25 bp, Homo sapien
tataattgccacgtcggtctgcgtg

SEQ ID NO: 217235 - DNA, 25 bp, Homo sapien
taattgccacgtcggtctgcgtgtt

SEQ ID NO: 217236 - DNA, 25 bp, Homo sapien
gcatttgttgccatcggggactata

SEQ ID NO: 217237 - DNA, 25 bp, Homo sapien
gttgccatcggggactataattgcc

SEQ ID NO: 217238 - DNA, 25 bp, Homo sapien
tgtgctggtcggcttcatccccacg

SEQ ID NO: 217239 - DNA, 25 bp, Homo sapien
atccacgcagaaggcgcttgcatgc

SEQ ID NO: 217240 - DNA, 25 bp, Homo sapien
ctccttggggcgaataagattacta

SEQ ID NO: 217241 - DNA, 25 bp, Homo sapien
ttctgcgaacttacgcgcccgtctg

SEQ ID NO: 217242 - DNA, 25 bp, Homo sapien
gattctctctttctcagcggggcgg

SEQ ID NO: 217243 - DNA, 25 bp, Homo sapien
tctggtttccagaccacggggattc

SEQ ID NO: 217244 - DNA, 25 bp, Homo sapien
tctggaccagggagagtcttcgtta

SEQ ID NO: 217245 - DNA, 25 bp, Homo sapien
cctctcttaggcgaaggaccgattc

SEQ ID NO: 217246 - DNA, 25 bp, Homo sapien
tcccaggcttgggttattctccagc

SEQ ID NO: 217247 - DNA, 25 bp, Homo sapien
gcagagttaccaaatgggctcctta

SEQ ID NO: 217248 - DNA, 25 bp, Homo sapien
aaagtttcgcggttgagcactgggc

SEQ ID NO: 217249 - DNA, 25 bp, Homo sapien
ttccatccgcgtaaaggaactgggc

SEQ ID NO: 217250 - DNA, 25 bp, Homo sapien
taaaggttagaccttgcgggctctc

SEQ ID NO: 217251 - DNA, 25 bp, Homo sapien
ggccttcgtgtgaaaatcccttgtg

SEQ ID NO: 217252 - DNA, 25 bp, Homo sapien
ctccttagtcatggcttggggctcc

SEQ ID NO: 217253 - DNA, 25 bp, Homo sapien
atcttccgctgaggcattgaaggca

SEQ ID NO: 217254 - DNA, 25 bp, Homo sapien
atgcagccgcaaatcccgagccgga

SEQ ID NO: 217255 - DNA, 25 bp, Homo sapien
cgcatgcgcgcgtgagcaaaagtaa

SEQ ID NO: 217256 - DNA, 25 bp, Homo sapien
cacgttgcagggtagaaaggatttc

SEQ ID NO: 217257 - DNA, 25 bp, Homo sapien
ggccttgcgccaagctggacgaata

SEQ ID NO: 217258 - DNA, 25 bp, Homo sapien
aacggtatgcccacccttgcgcaga

SEQ ID NO: 217259 - DNA, 25 bp, Homo sapien
acagagcgggcttctagaaacttcc

SEQ ID NO: 217260 - DNA, 25 bp, Homo sapien
ggggtatttcccactgtgcacagtc

SEQ ID NO: 217261 - DNA, 25 bp, Homo sapien
tgcaagtcccgcctgaaccacgtag

SEQ ID NO: 217262 - DNA, 25 bp, Homo sapien
gatttcctccggtcgttcttccata

SEQ ID NO: 217263 - DNA, 25 bp, Homo sapien
cccggcggcatgttcgaggctgctc

SEQ ID NO: 217264 - DNA, 25 bp, Homo sapien
tctagtcctgaaggccaagggaatc

SEQ ID NO: 217265 - DNA, 25 bp, Homo sapien
ctgagaggacgcgtctagtcctgaa

SEQ ID NO: 217266 - DNA, 25 bp, Homo sapien
ttctgcccgtttgctgagaggacgc

SEQ ID NO: 217267 - DNA, 25 bp, Homo sapien
cggagggctcgatccgcatctacag

SEQ ID NO: 217268 - DNA, 25 bp, Homo sapien
gtctcgacacctctctgggccgtaa

SEQ ID NO: 217269 - DNA, 25 bp, Homo sapien
ctgcgccacgatgtccggggagtca

SEQ ID NO: 217270 - DNA, 25 bp, Homo sapien
ctgggccgtaatcgccttcgcttct

SEQ ID NO: 217271 - DNA, 25 bp, Homo sapien
aagggcctccgacggttggccatca

SEQ ID NO: 217272 - DNA, 25 bp, Homo sapien
tttggtcaaatcgtacaccttgtgg

SEQ ID NO: 217273 - DNA, 25 bp, Homo sapien
acaccttgtggtgcaggatcagcca

SEQ ID NO: 217274 - DNA, 25 bp, Homo sapien
tgctgtggttgtgcttctgaatctc

SEQ ID NO: 217275 - DNA, 25 bp, Homo sapien
tggccatcatccttgtcactcaaaa

SEQ ID NO: 217276 - DNA, 25 bp, Homo sapien
ctcctctagggtgtagtacttcacg

SEQ ID NO: 217277 - DNA, 25 bp, Homo sapien
gagagcgcccaggtgtacactagca

SEQ ID NO: 217278 - DNA, 25 bp, Homo sapien
cccgcccagtatgcgggtgttaatt

SEQ ID NO: 217279 - DNA, 25 bp, Homo sapien
ggacgtgttgcgctgacccagcttt

SEQ ID NO: 217280 - DNA, 25 bp, Homo sapien
tactgttctcacagaagccaggccg

SEQ ID NO: 217281 - DNA, 25 bp, Homo sapien
agacccatgagtcccaatttttcgg

SEQ ID NO: 217282 - DNA, 25 bp, Homo sapien
acactccgatgaaggcagggcacgc

SEQ ID NO: 217283 - DNA, 25 bp, Homo sapien
cgcgggaaatactgggattggctcc

SEQ ID NO: 217284 - DNA, 25 bp, Homo sapien
ttgacctacattgcgtgccaggagc

SEQ ID NO: 217285 - DNA, 25 bp, Homo sapien
tgccttggcgggaaaagttgaccta

SEQ ID NO: 217286 - DNA, 25 bp, Homo sapien
cagggcttcactgggtcatccgtga

SEQ ID NO: 217287 - DNA, 25 bp, Homo sapien
gagttccgcactcgcgtagctgctc

SEQ ID NO: 217288 - DNA, 25 bp, Homo sapien
gcagctcagggtggaatcacagaac

SEQ ID NO: 217289 - DNA, 25 bp, Homo sapien
acccgagagacagaggcgtggcacc

SEQ ID NO: 217290 - DNA, 25 bp, Homo sapien
tggacactcggatcagacccgcaaa

SEQ ID NO: 217291 - DNA, 25 bp, Homo sapien
cgcaaactttcttccggagctcggg

SEQ ID NO: 217292 - DNA, 25 bp, Homo sapien
gacaaagggcgaattctggcgaaaa

SEQ ID NO: 217293 - DNA, 25 bp, Homo sapien
ctccacgcaggtgtcgggaacccat

SEQ ID NO: 217294 - DNA, 25 bp, Homo sapien
agccctccgcatgggctcggtgaga

SEQ ID NO: 217295 - DNA, 25 bp, Homo sapien
aggtgggtcttcctgatggaccttc

SEQ ID NO: 217296 - DNA, 25 bp, Homo sapien
cagcggcgagagtcacgcctcattc

SEQ ID NO: 217297 - DNA, 25 bp, Homo sapien
tccgccgggactgaaacgcaacgga

SEQ ID NO: 217298 - DNA, 25 bp, Homo sapien
gcaaccgggaagcacagcacaagcc

SEQ ID NO: 217299 - DNA, 25 bp, Homo sapien
gaggtgacgtcaccttccgcacctg

SEQ ID NO: 217300 - DNA, 25 bp, Homo sapien
ctgctggtaacagggccttgcctag

SEQ ID NO: 217301 - DNA, 25 bp, Homo sapien
ttggactccattgccgcactgcagg

SEQ ID NO: 217302 - DNA, 25 bp, Homo sapien
ggccttgcctagtgggccttccttc

SEQ ID NO: 217303 - DNA, 25 bp, Homo sapien
ctccgagaggcggaaaagttacctg

SEQ ID NO: 217304 - DNA, 25 bp, Homo sapien
ggccaccgcagtacttcaggacagt

SEQ ID NO: 217305 - DNA, 25 bp, Homo sapien
aggaaagccaacctcgtcctgcctg

SEQ ID NO: 217306 - DNA, 25 bp, Homo sapien
ccgtgcgaggaaagccaacctcgtc

SEQ ID NO: 217307 - DNA, 25 bp, Homo sapien
cacgcccagagaccgtgcgaggaaa

SEQ ID NO: 217308 - DNA, 25 bp, Homo sapien
ctgttgcaggagacaccgaggctcc

SEQ ID NO: 217309 - DNA, 25 bp, Homo sapien
aagttacctgggatcagcagggagc

SEQ ID NO: 217310 - DNA, 25 bp, Homo sapien
tcaggacagttacatgggcacagcc

SEQ ID NO: 217311 - DNA, 25 bp, Homo sapien
gcttccggcaagagctgatgtgtta

SEQ ID NO: 217312 - DNA, 25 bp, Homo sapien
gcccgacgcgctcatcgaatttaga

SEQ ID NO: 217313 - DNA, 25 bp, Homo sapien
ggcctgccggccactcggataaaaa

SEQ ID NO: 217314 - DNA, 25 bp, Homo sapien
ctgcatccactacggagtcgccttg

SEQ ID NO: 217315 - DNA, 25 bp, Homo sapien
gcaagctttagcgtctggtttccag

SEQ ID NO: 217316 - DNA, 25 bp, Homo sapien
gagcgattccgtcgccaaacaggta

SEQ ID NO: 217317 - DNA, 25 bp, Homo sapien
ccttcgacggagaaacaggatgtcc

SEQ ID NO: 217318 - DNA, 25 bp, Homo sapien
agtcgccttggaagccaccggaagt

SEQ ID NO: 217319 - DNA, 25 bp, Homo sapien
gccggggctgagttatttggctact

SEQ ID NO: 217320 - DNA, 25 bp, Homo sapien
ttatcaggaagacgcgccacttcca

SEQ ID NO: 217321 - DNA, 25 bp, Homo sapien
ggcctatctgtcatcccgcattatc

SEQ ID NO: 217322 - DNA, 25 bp, Homo sapien
tcacaactgaggatgctgcacattg

SEQ ID NO: 217323 - DNA, 25 bp, Homo sapien
tgttttcacacagcgtaactgcgga

SEQ ID NO: 217324 - DNA, 25 bp, Homo sapien
gcggcactcgagcactgtctaatta

SEQ ID NO: 217325 - DNA, 25 bp, Homo sapien
gcagcttctaatgacgcggcactcg

SEQ ID NO: 217326 - DNA, 25 bp, Homo sapien
tgcgaaagtccgcacggcctatctg

SEQ ID NO: 217327 - DNA, 25 bp, Homo sapien
cagccaggcgcccatccggcagccg

SEQ ID NO: 217328 - DNA, 25 bp, Homo sapien
tccgcagaacgccaggcatgccagg

SEQ ID NO: 217329 - DNA, 25 bp, Homo sapien
ctggaccaacgtccctgctgggcca

SEQ ID NO: 217330 - DNA, 25 bp, Homo sapien
acctctcggccgtcagcagtgcagc

SEQ ID NO: 217331 - DNA, 25 bp, Homo sapien
cgacacctgcctgcccgactcctgg

SEQ ID NO: 217332 - DNA, 25 bp, Homo sapien
ggcagcacctctcggccgtcagcag

SEQ ID NO: 217333 - DNA, 25 bp, Homo sapien
gaacgccaggcatgccagggcggcc

SEQ ID NO: 217334 - DNA, 25 bp, Homo sapien
cgcagaacgccaggcatgccagggc

SEQ ID NO: 217335 - DNA, 25 bp, Homo sapien
tgggtggacaagttctctccgagtc

SEQ ID NO: 217336 - DNA, 25 bp, Homo sapien
agccagcggctgcttgagtttgcca

SEQ ID NO: 217337 - DNA, 25 bp, Homo sapien
ttgagattcctcaggcctgcgaccg

SEQ ID NO: 217338 - DNA, 25 bp, Homo sapien
gcctgagtccttacctctgcgtgag

SEQ ID NO: 217339 - DNA, 25 bp, Homo sapien
ccgccaccacggagaggggattcat

SEQ ID NO: 217340 - DNA, 25 bp, Homo sapien
atcgtggttattcgcaagggcaagc

SEQ ID NO: 217341 - DNA, 25 bp, Homo sapien
ttctaaattgtctgcgtcgtcggtg

SEQ ID NO: 217342 - DNA, 25 bp, Homo sapien
tgccaggggcctttgcttgaaaaac

SEQ ID NO: 217343 - DNA, 25 bp, Homo sapien
ggccgctgctcctttaatctttttg

SEQ ID NO: 217344 - DNA, 25 bp, Homo sapien
tacgacatgtccacgatggcccggg

SEQ ID NO: 217345 - DNA, 25 bp, Homo sapien
ttcccgggatctcgcaaactcaggc

SEQ ID NO: 217346 - DNA, 25 bp, Homo sapien
taaacgtcgcagtttgcgtccaggc

SEQ ID NO: 217347 - DNA, 25 bp, Homo sapien
tcggatattcacaccagcaacagtc

SEQ ID NO: 217348 - DNA, 25 bp, Homo sapien
gacgttcggtggcatcggatattca

SEQ ID NO: 217349 - DNA, 25 bp, Homo sapien
tcccgctccaccctaaagattatgt

SEQ ID NO: 217350 - DNA, 25 bp, Homo sapien
ttttggtttgaatctgctcggcgca

SEQ ID NO: 217351 - DNA, 25 bp, Homo sapien
gagcagccgacgttttgagaaagcc

SEQ ID NO: 217352 - DNA, 25 bp, Homo sapien
gctgcgtgaactcaggacgctcctg

SEQ ID NO: 217353 - DNA, 25 bp, Homo sapien
cgagaagcagctgcgtgaactcagg

SEQ ID NO: 217354 - DNA, 25 bp, Homo sapien
ggcccagctctgcaagtgtttaaca

SEQ ID NO: 217355 - DNA, 25 bp, Homo sapien
ccgtgcatgaaggagccgtgtgtaa

SEQ ID NO: 217356 - DNA, 25 bp, Homo sapien
tggccgagtctcagccgccgtgcat

SEQ ID NO: 217357 - DNA, 25 bp, Homo sapien
gacgctcctgagcagccgacgtttt

SEQ ID NO: 217358 - DNA, 25 bp, Homo sapien
agctcccactcacatgggcagtggc

SEQ ID NO: 217359 - DNA, 25 bp, Homo sapien
agatctcacacagaacctcctcggg

SEQ ID NO: 217360 - DNA, 25 bp, Homo sapien
ccaggcgctgcgctgacacaaagtg

SEQ ID NO: 217361 - DNA, 25 bp, Homo sapien
ggaactttgccgacaccaccctgag

SEQ ID NO: 217362 - DNA, 25 bp, Homo sapien
cctggcaggaaacacggcccgtgaa

SEQ ID NO: 217363 - DNA, 25 bp, Homo sapien
tcttcccgcagggtgagatctcaca

SEQ ID NO: 217364 - DNA, 25 bp, Homo sapien
catcaggggtgtgattggaccaacc

SEQ ID NO: 217365 - DNA, 25 bp, Homo sapien
cccgtctctcaccatcaggggtgtg

SEQ ID NO: 217366 - DNA, 25 bp, Homo sapien
tgaactccttggcagcggaactttg

SEQ ID NO: 217367 - DNA, 25 bp, Homo sapien
cgactctcggctcgcggaagaaggc

SEQ ID NO: 217368 - DNA, 25 bp, Homo sapien
cttcctcttagactaagtgcgggga

SEQ ID NO: 217369 - DNA, 25 bp, Homo sapien
aaaaggacagcctgcatcggcctcg

SEQ ID NO: 217370 - DNA, 25 bp, Homo sapien
caatgagaaagctgcgacccgcgca

SEQ ID NO: 217371 - DNA, 25 bp, Homo sapien
cggggtgacactgtttgatctgtga

SEQ ID NO: 217372 - DNA, 25 bp, Homo sapien
cgctggccacagtcgtctggaggct

SEQ ID NO: 217373 - DNA, 25 bp, Homo sapien
gaaagttcgcggtgcttctctgcgc

SEQ ID NO: 217374 - DNA, 25 bp, Homo sapien
catcggcctcgctggcgcacaatga

SEQ ID NO: 217375 - DNA, 25 bp, Homo sapien
agcatgctggacaagccggtgtacc

SEQ ID NO: 217376 - DNA, 25 bp, Homo sapien
cacgccctccacagtttcagagaag

SEQ ID NO: 217377 - DNA, 25 bp, Homo sapien
agcgcactcatggacatctccgaca

SEQ ID NO: 217378 - DNA, 25 bp, Homo sapien
agtccaagaacaagccgctggtgtc

SEQ ID NO: 217379 - DNA, 25 bp, Homo sapien
agcgaccagcccattgacttaacca

SEQ ID NO: 217380 - DNA, 25 bp, Homo sapien
gagctgtcaccggtccacaagagga

SEQ ID NO: 217381 - DNA, 25 bp, Homo sapien
ccgatgccatcgaccgctactatta

SEQ ID NO: 217382 - DNA, 25 bp, Homo sapien
ccgctggcgatgctgtacaagatca

SEQ ID NO: 217383 - DNA, 25 bp, Homo sapien
tcagcgccagcgtttgatgtgcggc

SEQ ID NO: 217384 - DNA, 25 bp, Homo sapien
aagtcggacagcacccgccttgtgc

SEQ ID NO: 217385 - DNA, 25 bp, Homo sapien
cgctgcgactgttgaaagtcggaca

SEQ ID NO: 217386 - DNA, 25 bp, Homo sapien
gaggccgcttcgcacctcccagtgt

SEQ ID NO: 217387 - DNA, 25 bp, Homo sapien
ctcccagtgtgtccgggttgagcgc

SEQ ID NO: 217388 - DNA, 25 bp, Homo sapien
acgcagagttcacggcgaagacgga

SEQ ID NO: 217389 - DNA, 25 bp, Homo sapien
cccgacttggttattgatcggccca

SEQ ID NO: 217390 - DNA, 25 bp, Homo sapien
acttggttattgatcggcccaagcg

SEQ ID NO: 217391 - DNA, 25 bp, Homo sapien
ccatgcatgcacgtaggaaattaga

SEQ ID NO: 217392 - DNA, 25 bp, Homo sapien
tattactcgaagctcaccagccgtg

SEQ ID NO: 217393 - DNA, 25 bp, Homo sapien
tgcggttggaaacgttcagattcta

SEQ ID NO: 217394 - DNA, 25 bp, Homo sapien
aggccgcgaagctttgccaaatgtg

SEQ ID NO: 217395 - DNA, 25 bp, Homo sapien
gggctaagtcactgcgaaccctcgc

SEQ ID NO: 217396 - DNA, 25 bp, Homo sapien
ggggtcccactccatttcggcagga

SEQ ID NO: 217397 - DNA, 25 bp, Homo sapien
gcacgttaccatggcgacgcgtttc

SEQ ID NO: 217398 - DNA, 25 bp, Homo sapien
ggacggtccctttgcaaatctggcc

SEQ ID NO: 217399 - DNA, 25 bp, Homo sapien
aagtctgtgccgtgaccagagcctc

SEQ ID NO: 217400 - DNA, 25 bp, Homo sapien
ctgacctcgggctgcaaagacgatc

SEQ ID NO: 217401 - DNA, 25 bp, Homo sapien
tcctgctcacccgtgttgtggtcgg

SEQ ID NO: 217402 - DNA, 25 bp, Homo sapien
acgcggtgtcctttgctcagcacct

SEQ ID NO: 217403 - DNA, 25 bp, Homo sapien
ggcagaggcacccagaaaaccgtca

SEQ ID NO: 217404 - DNA, 25 bp, Homo sapien
gtcaccacctgatcccgcagagaat

SEQ ID NO: 217405 - DNA, 25 bp, Homo sapien
ccggcctgtgtgtattcagcaatcc

SEQ ID NO: 217406 - DNA, 25 bp, Homo sapien
gagccggctggctctttgcgaaagc

SEQ ID NO: 217407 - DNA, 25 bp, Homo sapien
cgcgcgctggcaaaagcacagagtc

SEQ ID NO: 217408 - DNA, 25 bp, Homo sapien
aacagcctcattcgcctcgggaacg

SEQ ID NO: 217409 - DNA, 25 bp, Homo sapien
cccgcaccctttggccagatgattt

SEQ ID NO: 217410 - DNA, 25 bp, Homo sapien
ttaatcctgggattccgcgttggtc

SEQ ID NO: 217411 - DNA, 25 bp, Homo sapien
gagccactgtccacttgaaagcagg

SEQ ID NO: 217412 - DNA, 25 bp, Homo sapien
cacagagtctcggaataggctaaac

SEQ ID NO: 217413 - DNA, 25 bp, Homo sapien
gcgcactagctctggggttcgcaga

SEQ ID NO: 217414 - DNA, 25 bp, Homo sapien
ggaggatcgcactcgctcatcctta

SEQ ID NO: 217415 - DNA, 25 bp, Homo sapien
ccgtctccttattgctggggtcatc

SEQ ID NO: 217416 - DNA, 25 bp, Homo sapien
tgtgcatccacaggacctcggggta

SEQ ID NO: 217417 - DNA, 25 bp, Homo sapien
caggcaccggtttggagctagcctc

SEQ ID NO: 217418 - DNA, 25 bp, Homo sapien
tcctggccgtgacaaggtttggtct

SEQ ID NO: 217419 - DNA, 25 bp, Homo sapien
tttggtctgtcgatacccgtcaggg

SEQ ID NO: 217420 - DNA, 25 bp, Homo sapien
ggcttttgtgaccactcccagggga

SEQ ID NO: 217421 - DNA, 25 bp, Homo sapien
gggtgaacgactaaagccgcctgca

SEQ ID NO: 217422 - DNA, 25 bp, Homo sapien
ttcttaggcatgctagcggcttttg

SEQ ID NO: 217423 - DNA, 25 bp, Homo sapien
tgagctgatgccctccgtgttccca

SEQ ID NO: 217424 - DNA, 25 bp, Homo sapien
ggccgctgcgcttctatcagcttga

SEQ ID NO: 217425 - DNA, 25 bp, Homo sapien
aactagaagcgagctccatcgggcc

SEQ ID NO: 217426 - DNA, 25 bp, Homo sapien
cgtgatttctcctctctgaactaga

SEQ ID NO: 217427 - DNA, 25 bp, Homo sapien
acaggtctgactctcacgtgatttc

SEQ ID NO: 217428 - DNA, 25 bp, Homo sapien
cagatcagcgatgacttgacaggtc

SEQ ID NO: 217429 - DNA, 25 bp, Homo sapien
ctccgctccttaaacgaacttcaga

SEQ ID NO: 217430 - DNA, 25 bp, Homo sapien
gtgttcccacactggcagctgccgt

SEQ ID NO: 217431 - DNA, 25 bp, Homo sapien
ttacgctcgaactggctcttgcaga

SEQ ID NO: 217432 - DNA, 25 bp, Homo sapien
ggcgttcaagctgtccaggtttgta

SEQ ID NO: 217433 - DNA, 25 bp, Homo sapien
tgtaaacaggttcccgcacttggcg

SEQ ID NO: 217434 - DNA, 25 bp, Homo sapien
tcactcttgggcctgttcttgctgc

SEQ ID NO: 217435 - DNA, 25 bp, Homo sapien
tgcttcttcatgtgcgccttcagga

SEQ ID NO: 217436 - DNA, 25 bp, Homo sapien
ctctcgatgtggctcagcagcgact

SEQ ID NO: 217437 - DNA, 25 bp, Homo sapien
gctccaggtccttcttacgctcgaa

SEQ ID NO: 217438 - DNA, 25 bp, Homo sapien
tccttgaacctacggccgcagatgt

SEQ ID NO: 217439 - DNA, 25 bp, Homo sapien
tcaccgtcgtgtgtgcgtgcctcac

SEQ ID NO: 217440 - DNA, 25 bp, Homo sapien
gcctcaccgtcgtgcgtgtgcgtgc

SEQ ID NO: 217441 - DNA, 25 bp, Homo sapien
gcgtgcctcaccgtcgtgcgtgtgc

SEQ ID NO: 217442 - DNA, 25 bp, Homo sapien
gtgtgcatgcctgtaggcaatgcca

SEQ ID NO: 217443 - DNA, 25 bp, Homo sapien
taggcaatgccaggcctcaccgtcg

SEQ ID NO: 217444 - DNA, 25 bp, Homo sapien
gtgcctcaccgtcgtgcgtgtgcgt

SEQ ID NO: 217445 - DNA, 25 bp, Homo sapien
tgcctcaccgtcgtgcgtgtgcgtg

SEQ ID NO: 217446 - DNA, 25 bp, Homo sapien
ctcaccgtcgtgtgtgcgtgcctca

SEQ ID NO: 217447 - DNA, 25 bp, Homo sapien
ggcaggtacttccaaagctttgagg

SEQ ID NO: 217448 - DNA, 25 bp, Homo sapien
gacctggagccgactgacttcacaa

SEQ ID NO: 217449 - DNA, 25 bp, Homo sapien
tcagccgcactgctgggcaggtact

SEQ ID NO: 217450 - DNA, 25 bp, Homo sapien
gcgaatcccgatctccaggagcctg

SEQ ID NO: 217451 - DNA, 25 bp, Homo sapien
cctagtgctttccagcggatttccc

SEQ ID NO: 217452 - DNA, 25 bp, Homo sapien
agccgcttggccctagtgctttcca

SEQ ID NO: 217453 - DNA, 25 bp, Homo sapien
cgactgacttcacaaaggcctcctg

SEQ ID NO: 217454 - DNA, 25 bp, Homo sapien
aagctttgaggattggctgatgctc

SEQ ID NO: 217455 - DNA, 25 bp, Homo sapien
accgcggagacactgtgaggtcaca

SEQ ID NO: 217456 - DNA, 25 bp, Homo sapien
agggctccgtcctttgttacgcagg

SEQ ID NO: 217457 - DNA, 25 bp, Homo sapien
ccacgggcacatctgggcttttcca

SEQ ID NO: 217458 - DNA, 25 bp, Homo sapien
tttccaggcagtccacagagccatc

SEQ ID NO: 217459 - DNA, 25 bp, Homo sapien
tgaggtcacacacgcagaacacaaa

SEQ ID NO: 217460 - DNA, 25 bp, Homo sapien
cgcaggaccggttcaggtgtgaaca

SEQ ID NO: 217461 - DNA, 25 bp, Homo sapien
ggtgtgaacacttatgtaatcgtcc

SEQ ID NO: 217462 - DNA, 25 bp, Homo sapien
ttatgtaatcgtcctcggggccacg

SEQ ID NO: 217463 - DNA, 25 bp, Homo sapien
gcgagtgggttccatcatcacctga

SEQ ID NO: 217464 - DNA, 25 bp, Homo sapien
cgagcgcttcaccttctagaatttg

SEQ ID NO: 217465 - DNA, 25 bp, Homo sapien
atgctgcccttcacttttctacgga

SEQ ID NO: 217466 - DNA, 25 bp, Homo sapien
gacgctaccttgtaaccgagttaga

SEQ ID NO: 217467 - DNA, 25 bp, Homo sapien
ttcacatcagtttcagcaatccgcg

SEQ ID NO: 217468 - DNA, 25 bp, Homo sapien
tcctgagaaagtcggtgccacagta

SEQ ID NO: 217469 - DNA, 25 bp, Homo sapien
ggttccgacctgaatctgaaagtgc

SEQ ID NO: 217470 - DNA, 25 bp, Homo sapien
tgtgcccgtgaatacgcccattgtg

SEQ ID NO: 217471 - DNA, 25 bp, Homo sapien
cagcctggaaatggtctgccctgta

SEQ ID NO: 217472 - DNA, 25 bp, Homo sapien
cagaggtcccgctggaaagacttca

SEQ ID NO: 217473 - DNA, 25 bp, Homo sapien
cctgaatcaagggtcacagaggtcc

SEQ ID NO: 217474 - DNA, 25 bp, Homo sapien
gtgcgtgtcactcaacttcctggta

SEQ ID NO: 217475 - DNA, 25 bp, Homo sapien
gtcccaggtgcgtgtgcattacaca

SEQ ID NO: 217476 - DNA, 25 bp, Homo sapien
catctggactgaaatggggacaccc

SEQ ID NO: 217477 - DNA, 25 bp, Homo sapien
ctcgtcaaggtctaaggctgctgca

SEQ ID NO: 217478 - DNA, 25 bp, Homo sapien
ctgccacccggccatttaaaaatga

SEQ ID NO: 217479 - DNA, 25 bp, Homo sapien
tgctagagaacgagaaccgcagtgc

SEQ ID NO: 217480 - DNA, 25 bp, Homo sapien
agggctgtacactcgcatccctctg

SEQ ID NO: 217481 - DNA, 25 bp, Homo sapien
cggctgcaccatctgatgctagaga

SEQ ID NO: 217482 - DNA, 25 bp, Homo sapien
caccatctgatgctagagaacgaga

SEQ ID NO: 217483 - DNA, 25 bp, Homo sapien
aaccgcagtgcgtgcccgacacaaa

SEQ ID NO: 217484 - DNA, 25 bp, Homo sapien
caggggagacgacatggaagaaatc

SEQ ID NO: 217485 - DNA, 25 bp, Homo sapien
cgtgcccgacacaaagggaaggaca

SEQ ID NO: 217486 - DNA, 25 bp, Homo sapien
atctgggggagccaaaagccgccat

SEQ ID NO: 217487 - DNA, 25 bp, Homo sapien
gcgctgtctctcgtttttccaattc

SEQ ID NO: 217488 - DNA, 25 bp, Homo sapien
ttccaattcccttcacatctttttc

SEQ ID NO: 217489 - DNA, 25 bp, Homo sapien
tcacatctttttcttgttccctttc

SEQ ID NO: 217490 - DNA, 25 bp, Homo sapien
aaggcgagagccaacccaggatctt

SEQ ID NO: 217491 - DNA, 25 bp, Homo sapien
aacccaggatcttggaggcccgtga

SEQ ID NO: 217492 - DNA, 25 bp, Homo sapien
agcgccggcaatcagcctagacctg

SEQ ID NO: 217493 - DNA, 25 bp, Homo sapien
ggtcacgtctgcacccttaatcgcg

SEQ ID NO: 217494 - DNA, 25 bp, Homo sapien
cgccacaggcgctgtctctcgtttt

SEQ ID NO: 217495 - DNA, 25 bp, Homo sapien
cccacgggagcgtgcggctcatatt

SEQ ID NO: 217496 - DNA, 25 bp, Homo sapien
ggagtgcggccaacaaaagaccatc

SEQ ID NO: 217497 - DNA, 25 bp, Homo sapien
cgcagcttcttcggccgcgggacag

SEQ ID NO: 217498 - DNA, 25 bp, Homo sapien
attaggaaggtgtccagtgcgtcgt

SEQ ID NO: 217499 - DNA, 25 bp, Homo sapien
ttattaggaaggtgtccagtgcgtc

SEQ ID NO: 217500 - DNA, 25 bp, Homo sapien
gccaacaaaagaccatccgcgagcg

SEQ ID NO: 217501 - DNA, 25 bp, Homo sapien
gagcgtgcggctcatattattagga

SEQ ID NO: 217502 - DNA, 25 bp, Homo sapien
cggctcatattattaggaaggtgtc

SEQ ID NO: 217503 - DNA, 25 bp, Homo sapien
cccttgcaagggcagcagcgcgaag

SEQ ID NO: 217504 - DNA, 25 bp, Homo sapien
ggtcatgctcaggtcgagctcgccc

SEQ ID NO: 217505 - DNA, 25 bp, Homo sapien
ccgcgactgcacgtagctgaggaag

SEQ ID NO: 217506 - DNA, 25 bp, Homo sapien
tccacgaaggagctggccgtgctct

SEQ ID NO: 217507 - DNA, 25 bp, Homo sapien
agacgctgtacacggcctcggccag

SEQ ID NO: 217508 - DNA, 25 bp, Homo sapien
agcgctcgcggtagacgctgtacac

SEQ ID NO: 217509 - DNA, 25 bp, Homo sapien
cacgtagctgaggaagccgttgagc

SEQ ID NO: 217510 - DNA, 25 bp, Homo sapien
aaggcgctcagcgaggagtccacga

SEQ ID NO: 217511 - DNA, 25 bp, Homo sapien
tgtgatccgggaacttgaaccctga

SEQ ID NO: 217512 - DNA, 25 bp, Homo sapien
tccagtgttatctggggcgcgctgt

SEQ ID NO: 217513 - DNA, 25 bp, Homo sapien
gcacacagtgtgctccagtgttatc

SEQ ID NO: 217514 - DNA, 25 bp, Homo sapien
aatgatacgggcgagtcgccgcccg

SEQ ID NO: 217515 - DNA, 25 bp, Homo sapien
cacagtaggcgccagcgttgtccgg

SEQ ID NO: 217516 - DNA, 25 bp, Homo sapien
tgaacttgagggaaagtggccgccc

SEQ ID NO: 217517 - DNA, 25 bp, Homo sapien
cggcccgcgctgaacttgagggaaa

SEQ ID NO: 217518 - DNA, 25 bp, Homo sapien
ctgcagacgctgtgggtagtgcata

SEQ ID NO: 217519 - DNA, 25 bp, Homo sapien
gcatgtgtgtccctactgcgccaag

SEQ ID NO: 217520 - DNA, 25 bp, Homo sapien
tcaagacgcacaccggcatcaaggc

SEQ ID NO: 217521 - DNA, 25 bp, Homo sapien
gccttcgccgtgaagagcacgctga

SEQ ID NO: 217522 - DNA, 25 bp, Homo sapien
ttcaagtgcccgcagtgcttccgcg

SEQ ID NO: 217523 - DNA, 25 bp, Homo sapien
cgctgacagcgcacatcaagacgca

SEQ ID NO: 217524 - DNA, 25 bp, Homo sapien
tactgcgccaaggagttccgcaagc

SEQ ID NO: 217525 - DNA, 25 bp, Homo sapien
gtgcgctggcatgtgtgtccctact

SEQ ID NO: 217526 - DNA, 25 bp, Homo sapien
ggagttccgcaagcccagcgacctg

SEQ ID NO: 217527 - DNA, 25 bp, Homo sapien
tgcaggacgagcccaagcacgccaa

SEQ ID NO: 217528 - DNA, 25 bp, Homo sapien
gaaacctagcgacctggtgaggtga

SEQ ID NO: 217529 - DNA, 25 bp, Homo sapien
agcacgccaactgctgcacatactg

SEQ ID NO: 217530 - DNA, 25 bp, Homo sapien
catcagtgagctgagggacaagcag

SEQ ID NO: 217531 - DNA, 25 bp, Homo sapien
accgcatcagtgagctgagggacaa

SEQ ID NO: 217532 - DNA, 25 bp, Homo sapien
cgcggcagaaaaggaccgcatcagt

SEQ ID NO: 217533 - DNA, 25 bp, Homo sapien
aggagagcgccacggtgtcagagaa

SEQ ID NO: 217534 - DNA, 25 bp, Homo sapien
cttcaagaaacctagcgacctggtg

SEQ ID NO: 217535 - DNA, 25 bp, Homo sapien
gcgccagagcgcagctgtttctgga

SEQ ID NO: 217536 - DNA, 25 bp, Homo sapien
gagcgcagctgtttctggagcctgc

SEQ ID NO: 217537 - DNA, 25 bp, Homo sapien
ggagctgcgcaaaccacctggagac

SEQ ID NO: 217538 - DNA, 25 bp, Homo sapien
gcaaaccacctggagaccatgtctg

SEQ ID NO: 217539 - DNA, 25 bp, Homo sapien
accatgtctggggatgcgaccagga

SEQ ID NO: 217540 - DNA, 25 bp, Homo sapien
ctggggaaaggtgagtgctctccat

SEQ ID NO: 217541 - DNA, 25 bp, Homo sapien
aaaatgttggcttcggcggagctgc

SEQ ID NO: 217542 - DNA, 25 bp, Homo sapien
ccgcgtgacagaaaatgttggcttc

SEQ ID NO: 217543 - DNA, 25 bp, Homo sapien
tgaatgagccggttatcttctcagg

SEQ ID NO: 217544 - DNA, 25 bp, Homo sapien
tcttctgggaggaagtgaatgagcc

SEQ ID NO: 217545 - DNA, 25 bp, Homo sapien
tactcgctaccacgcgtcttctggg

SEQ ID NO: 217546 - DNA, 25 bp, Homo sapien
ggtgcacgcctgtgcctactcgcta

SEQ ID NO: 217547 - DNA, 25 bp, Homo sapien
agtaattcgggagcaggtgcacgcc

SEQ ID NO: 217548 - DNA, 25 bp, Homo sapien
gcccgtgtgtctcggtgagtaattc

SEQ ID NO: 217549 - DNA, 25 bp, Homo sapien
atcttctcagggagggttagtgctg

SEQ ID NO: 217550 - DNA, 25 bp, Homo sapien
acgcccggtcacagccagtgtctat

SEQ ID NO: 217551 - DNA, 25 bp, Homo sapien
cgtggacgcacttggaacacggccg

SEQ ID NO: 217552 - DNA, 25 bp, Homo sapien
cccgcgtgcagaatcctgagcaaca

SEQ ID NO: 217553 - DNA, 25 bp, Homo sapien
cgtgcagaatcctgagcaacagaaa

SEQ ID NO: 217554 - DNA, 25 bp, Homo sapien
tgagcaacagaaacagcactttaag

SEQ ID NO: 217555 - DNA, 25 bp, Homo sapien
cagcactttaagaaacgaaatcgtg

SEQ ID NO: 217556 - DNA, 25 bp, Homo sapien
agaaacgaaatcgtggacgcacttg

SEQ ID NO: 217557 - DNA, 25 bp, Homo sapien
atcgtggacgcacttggaacacggc

SEQ ID NO: 217558 - DNA, 25 bp, Homo sapien
cgaaatcgtggacgcacttggaaca

SEQ ID NO: 217559 - DNA, 25 bp, Homo sapien
ggaggaacacgcgaccttcgcactc

SEQ ID NO: 217560 - DNA, 25 bp, Homo sapien
aggccacacctacggggctcctaag

SEQ ID NO: 217561 - DNA, 25 bp, Homo sapien
ggccaacattgatgatgaccttacc

SEQ ID NO: 217562 - DNA, 25 bp, Homo sapien
tctggcttctgcaaagcagtcgcgc

SEQ ID NO: 217563 - DNA, 25 bp, Homo sapien
ctccggggacttccacagcctatgt

SEQ ID NO: 217564 - DNA, 25 bp, Homo sapien
agcctatgtccacgcggcgcctgga

SEQ ID NO: 217565 - DNA, 25 bp, Homo sapien
tgcacaggcagaatcatctggcttc

SEQ ID NO: 217566 - DNA, 25 bp, Homo sapien
cgagcccaggcaaggaacggccttg

SEQ ID NO: 217567 - DNA, 25 bp, Homo sapien
ggcgtttccgaaatgacctggcaca

SEQ ID NO: 217568 - DNA, 25 bp, Homo sapien
atgcacagaattcagccgggccgca

SEQ ID NO: 217569 - DNA, 25 bp, Homo sapien
tggccacacaggcagggaataactg

SEQ ID NO: 217570 - DNA, 25 bp, Homo sapien
cttccaggaaggagcgtcgtcatgg

SEQ ID NO: 217571 - DNA, 25 bp, Homo sapien
ctgcagaagggcactgaatgcgctc

SEQ ID NO: 217572 - DNA, 25 bp, Homo sapien
agactggtgactagaagcagctccc

SEQ ID NO: 217573 - DNA, 25 bp, Homo sapien
ccagcgctgagcagactggtgacta

SEQ ID NO: 217574 - DNA, 25 bp, Homo sapien
accgcgctctccagatgcaaacgga

SEQ ID NO: 217575 - DNA, 25 bp, Homo sapien
cacacctgcgggaggtcggacatgt

SEQ ID NO: 217576 - DNA, 25 bp, Homo sapien
ccgaacatgaggagaacgccactga

SEQ ID NO: 217577 - DNA, 25 bp, Homo sapien
cgcgcgcggcaaaaagaaacagctc

SEQ ID NO: 217578 - DNA, 25 bp, Homo sapien
tcatttcggagctgaggacaaggcg

SEQ ID NO: 217579 - DNA, 25 bp, Homo sapien
agaagacgcgtttggtttcacccag

SEQ ID NO: 217580 - DNA, 25 bp, Homo sapien
caaagctgtgggatgcgcgctgcac

SEQ ID NO: 217581 - DNA, 25 bp, Homo sapien
tcatcacgatggcaaaccgaacatg

SEQ ID NO: 217582 - DNA, 25 bp, Homo sapien
cggacatgtcctgattgcgtgttca

SEQ ID NO: 217583 - DNA, 25 bp, Homo sapien
tctaaaatctggtcagccctcgcgg

SEQ ID NO: 217584 - DNA, 25 bp, Homo sapien
ccttgtctcgggtgaggtatgctaa

SEQ ID NO: 217585 - DNA, 25 bp, Homo sapien
atgctaaagggttcgctctcgcttg

SEQ ID NO: 217586 - DNA, 25 bp, Homo sapien
gcttggtgcgagcattcttctgtga

SEQ ID NO: 217587 - DNA, 25 bp, Homo sapien
cttctgtgaatccattacgggtctc

SEQ ID NO: 217588 - DNA, 25 bp, Homo sapien
tacgggtctcaaagtcctaatgcag

SEQ ID NO: 217589 - DNA, 25 bp, Homo sapien
gtaggcttctcccaacgctggcaaa

SEQ ID NO: 217590 - DNA, 25 bp, Homo sapien
cgaagcatgaatcccgccttgtctc

SEQ ID NO: 217591 - DNA, 25 bp, Homo sapien
ggctggtctcggcttcaagcgccca

SEQ ID NO: 217592 - DNA, 25 bp, Homo sapien
ctcagagggagactgcgcttcgccc

SEQ ID NO: 217593 - DNA, 25 bp, Homo sapien
ggcagcctgcttcgccttccggggt

SEQ ID NO: 217594 - DNA, 25 bp, Homo sapien
cctggacacctgtcagggtcgggcc

SEQ ID NO: 217595 - DNA, 25 bp, Homo sapien
agcggtttcagcgaccctgggaccg

SEQ ID NO: 217596 - DNA, 25 bp, Homo sapien
acccgcccagagtggccgcttttga

SEQ ID NO: 217597 - DNA, 25 bp, Homo sapien
gccaggtaaacacaggccgatcccg

SEQ ID NO: 217598 - DNA, 25 bp, Homo sapien
ggcttcctgcgagccaggtaaacac

SEQ ID NO: 217599 - DNA, 25 bp, Homo sapien
actggcggctgttgctaagagaccg

SEQ ID NO: 217600 - DNA, 25 bp, Homo sapien
gctcgggcgacacaaaggaaccatg

SEQ ID NO: 217601 - DNA, 25 bp, Homo sapien
cgggagccatttccaagagtttcca

SEQ ID NO: 217602 - DNA, 25 bp, Homo sapien
gtttccaagaagtgtcaggtcctcc

SEQ ID NO: 217603 - DNA, 25 bp, Homo sapien
ccggagccatgacacagggaaattg

SEQ ID NO: 217604 - DNA, 25 bp, Homo sapien
ttctttcctccaactacctgtctga

SEQ ID NO: 217605 - DNA, 25 bp, Homo sapien
gagaaactttttcagcccgagccga

SEQ ID NO: 217606 - DNA, 25 bp, Homo sapien
gtgcctcggtcttttgttgcctcta

SEQ ID NO: 217607 - DNA, 25 bp, Homo sapien
ctctctcagaaggtcccggcgcaaa

SEQ ID NO: 217608 - DNA, 25 bp, Homo sapien
tctgcttctgctatgccaaggtgca

SEQ ID NO: 217609 - DNA, 25 bp, Homo sapien
gtgtgcaccttcgtcttcggctacc

SEQ ID NO: 217610 - DNA, 25 bp, Homo sapien
caagaaggcctacgtggtgtgcacc

SEQ ID NO: 217611 - DNA, 25 bp, Homo sapien
caccgtgtccatgctggtgagcatc

SEQ ID NO: 217612 - DNA, 25 bp, Homo sapien
ctgggcgccttcatctgcaagttca

SEQ ID NO: 217613 - DNA, 25 bp, Homo sapien
gggcaacagcctagtgatcaccgtg

SEQ ID NO: 217614 - DNA, 25 bp, Homo sapien
gcatcggcgtggagaacttcgtcac

SEQ ID NO: 217615 - DNA, 25 bp, Homo sapien
ccacccgccgcagagcagatgagct

SEQ ID NO: 217616 - DNA, 25 bp, Homo sapien
ggtcagctttgctcctcagggctgc

SEQ ID NO: 217617 - DNA, 25 bp, Homo sapien
atggagctgattccacctgaggctg

SEQ ID NO: 217618 - DNA, 25 bp, Homo sapien
tctggcgggagcgtgccactcacgt

SEQ ID NO: 217619 - DNA, 25 bp, Homo sapien
ccgctgccgcagttttgtttacaga

SEQ ID NO: 217620 - DNA, 25 bp, Homo sapien
ttgtttacagaaatcgcttcacacg

SEQ ID NO: 217621 - DNA, 25 bp, Homo sapien
gcccatctcactcactcggtgctga

SEQ ID NO: 217622 - DNA, 25 bp, Homo sapien
ccgcatggagctgattccacctgag

SEQ ID NO: 217623 - DNA, 25 bp, Homo sapien
ccgagcttggtcttgccgcagatgc

SEQ ID NO: 217624 - DNA, 25 bp, Homo sapien
gacacagcatgtcttccccgagctt

SEQ ID NO: 217625 - DNA, 25 bp, Homo sapien
ccgtgcaggagacacagcatgtctt

SEQ ID NO: 217626 - DNA, 25 bp, Homo sapien
tgcaggagacacagcatgtcttccc

SEQ ID NO: 217627 - DNA, 25 bp, Homo sapien
gccatgctgttcctgccgtgcagga

SEQ ID NO: 217628 - DNA, 25 bp, Homo sapien
cagggaggcgccatgctgttcctgc

SEQ ID NO: 217629 - DNA, 25 bp, Homo sapien
tgcagctcaatgtgtccccatcggc

SEQ ID NO: 217630 - DNA, 25 bp, Homo sapien
ttcctgccgtgcaggagacacagca

SEQ ID NO: 217631 - DNA, 25 bp, Homo sapien
cggaccaccttgatctggccgtagc

SEQ ID NO: 217632 - DNA, 25 bp, Homo sapien
aggaactcccgggtacgggctgcat

SEQ ID NO: 217633 - DNA, 25 bp, Homo sapien
acctccatgtcggtgtcccggttgc

SEQ ID NO: 217634 - DNA, 25 bp, Homo sapien
tgctgtccacgccaatgaagtcctc

SEQ ID NO: 217635 - DNA, 25 bp, Homo sapien
cctgccagttctcgtacatgctgtc

SEQ ID NO: 217636 - DNA, 25 bp, Homo sapien
tggcacagcagtggcctgtccacct

SEQ ID NO: 217637 - DNA, 25 bp, Homo sapien
gggcttccagcaagtcatccacgaa

SEQ ID NO: 217638 - DNA, 25 bp, Homo sapien
aagggcacgaaaaggtggcacagca

SEQ ID NO: 217639 - DNA, 25 bp, Homo sapien
gctctaaaggctctgtctgtctgtc

SEQ ID NO: 217640 - DNA, 25 bp, Homo sapien
ctgtctgtctgactgtgggcggcct

SEQ ID NO: 217641 - DNA, 25 bp, Homo sapien
tgtctgtctgactgtgggcggcctg

SEQ ID NO: 217642 - DNA, 25 bp, Homo sapien
ctgtctgtctgactgtggggcggcc

SEQ ID NO: 217643 - DNA, 25 bp, Homo sapien
cggcgctctaaaggctctgtctgtc

SEQ ID NO: 217644 - DNA, 25 bp, Homo sapien
gcgctctaaaggctctgtctgtctg

SEQ ID NO: 217645 - DNA, 25 bp, Homo sapien
ccggcgctctaaaggctctgtctgt

SEQ ID NO: 217646 - DNA, 25 bp, Homo sapien
tgtctgtctgactgtggggcggcct

SEQ ID NO: 217647 - DNA, 25 bp, Homo sapien
gggctaaacccgcagacactgagcg

SEQ ID NO: 217648 - DNA, 25 bp, Homo sapien
ccgcagacactgagcggggacgcca

SEQ ID NO: 217649 - DNA, 25 bp, Homo sapien
tgctccgtgtcctggactctgagca

SEQ ID NO: 217650 - DNA, 25 bp, Homo sapien
actctgagcaaagccgcgggcctta

SEQ ID NO: 217651 - DNA, 25 bp, Homo sapien
cccagtgccgacacctgctaagaga

SEQ ID NO: 217652 - DNA, 25 bp, Homo sapien
cacctgctaagagacggtgcattgc

SEQ ID NO: 217653 - DNA, 25 bp, Homo sapien
agacggtgcattgcgggctaaaccc

SEQ ID NO: 217654 - DNA, 25 bp, Homo sapien
actgagcggggacgccacttccgac

SEQ ID NO: 217655 - DNA, 25 bp, Homo sapien
ccataatatgcgtggggtcgccatg

SEQ ID NO: 217656 - DNA, 25 bp, Homo sapien
cttctataatatgcgtggggtcgcc

SEQ ID NO: 217657 - DNA, 25 bp, Homo sapien
cctcccgtgttgcttccataatatg

SEQ ID NO: 217658 - DNA, 25 bp, Homo sapien
cttccataatatgcgtggggtcgcc

SEQ ID NO: 217659 - DNA, 25 bp, Homo sapien
gggtcgccatgaacttcctcccgta

SEQ ID NO: 217660 - DNA, 25 bp, Homo sapien
tatgcgtggagtcgccatgaacttc

SEQ ID NO: 217661 - DNA, 25 bp, Homo sapien
gggtcgccatgaacttcctcccgtg

SEQ ID NO: 217662 - DNA, 25 bp, Homo sapien
ctcccgtgttgcttccataatatgc

SEQ ID NO: 217663 - DNA, 25 bp, Homo sapien
tgcggggtgagcacggttaacaaac

SEQ ID NO: 217664 - DNA, 25 bp, Homo sapien
cctccgacagcttgcggggtgagca

SEQ ID NO: 217665 - DNA, 25 bp, Homo sapien
gttaacaaaccctacagctggcgga

SEQ ID NO: 217666 - DNA, 25 bp, Homo sapien
tggcaccgtaaacaagccgcgtctt

SEQ ID NO: 217667 - DNA, 25 bp, Homo sapien
acataattgcacacgaatggcgggg

SEQ ID NO: 217668 - DNA, 25 bp, Homo sapien
ctggcggatctgtgcagacataatt

SEQ ID NO: 217669 - DNA, 25 bp, Homo sapien
aaccctacagctggcggatctgtgc

SEQ ID NO: 217670 - DNA, 25 bp, Homo sapien
caagcgaagggaaaagtggcaccgt

SEQ ID NO: 217671 - DNA, 25 bp, Homo sapien
tttctcaggtccaaagagcggaccc

SEQ ID NO: 217672 - DNA, 25 bp, Homo sapien
tcaaaagaccgacccggcggcctga

SEQ ID NO: 217673 - DNA, 25 bp, Homo sapien
ccggcaacatcagcgacagtggagc

SEQ ID NO: 217674 - DNA, 25 bp, Homo sapien
tgggcactttcctgacggaggactc

SEQ ID NO: 217675 - DNA, 25 bp, Homo sapien
caattgggcagcgatttctcaggtc

SEQ ID NO: 217676 - DNA, 25 bp, Homo sapien
ggccgcctcacctgacacaattggg

SEQ ID NO: 217677 - DNA, 25 bp, Homo sapien
cagtggagcccggtctcaaaagacc

SEQ ID NO: 217678 - DNA, 25 bp, Homo sapien
ctcctgggagctccggcaacatcag

SEQ ID NO: 217679 - DNA, 25 bp, Homo sapien
cctgggctctgctccagtggaaaca

SEQ ID NO: 217680 - DNA, 25 bp, Homo sapien
ttcttacgtgacactggcaggcggc

SEQ ID NO: 217681 - DNA, 25 bp, Homo sapien
tccagtggaaacacaacctgccttc

SEQ ID NO: 217682 - DNA, 25 bp, Homo sapien
ccgcgcatccgtgaagctgtgtgtt

SEQ ID NO: 217683 - DNA, 25 bp, Homo sapien
tctgtgttactacaggggccggctg

SEQ ID NO: 217684 - DNA, 25 bp, Homo sapien
ggctgtggaaatcccacgctccaga

SEQ ID NO: 217685 - DNA, 25 bp, Homo sapien
acgcctacctctgctgggtctgaca

SEQ ID NO: 217686 - DNA, 25 bp, Homo sapien
tctgacagacagaactggtgcagcg

SEQ ID NO: 217687 - DNA, 25 bp, Homo sapien
tgcagacacagcgagactacgtaca

SEQ ID NO: 217688 - DNA, 25 bp, Homo sapien
tacatggcgagaccacagacacggc

SEQ ID NO: 217689 - DNA, 25 bp, Homo sapien
tgcacaccgcaaaaccatggacgtc

SEQ ID NO: 217690 - DNA, 25 bp, Homo sapien
tggacgtcacaagaccacgcacacg

SEQ ID NO: 217691 - DNA, 25 bp, Homo sapien
acgcacacggtgagacaaggcaaga

SEQ ID NO: 217692 - DNA, 25 bp, Homo sapien
tggcgagaccacatgcaaggcaaga

SEQ ID NO: 217693 - DNA, 25 bp, Homo sapien
cagacacggcgagacaacagacata

SEQ ID NO: 217694 - DNA, 25 bp, Homo sapien
cacggacatggcaagactgcagaca

SEQ ID NO: 217695 - DNA, 25 bp, Homo sapien
gtgtcacgggaatggagatgcctta

SEQ ID NO: 217696 - DNA, 25 bp, Homo sapien
gttccctgcagaacggacggcagtc

SEQ ID NO: 217697 - DNA, 25 bp, Homo sapien
ttgttcgcgtgctgagtgcactctg

SEQ ID NO: 217698 - DNA, 25 bp, Homo sapien
atgccttaaggctccggcttggacg

SEQ ID NO: 217699 - DNA, 25 bp, Homo sapien
cagagacaccaaagatccagcaagc

SEQ ID NO: 217700 - DNA, 25 bp, Homo sapien
ggctgtgctgtgctttccagagaca

SEQ ID NO: 217701 - DNA, 25 bp, Homo sapien
atgaagacggcacgcctgctgcgca

SEQ ID NO: 217702 - DNA, 25 bp, Homo sapien
ggcgcacaccctccgggatgaagac

SEQ ID NO: 217703 - DNA, 25 bp, Homo sapien
ggctgcgcacgcaggctgttcccaa

SEQ ID NO: 217704 - DNA, 25 bp, Homo sapien
agccaaagacgaggccaagcaaaag

SEQ ID NO: 217705 - DNA, 25 bp, Homo sapien
ctgggaaagtcgaagccaaagacga

SEQ ID NO: 217706 - DNA, 25 bp, Homo sapien
tccctcctgggaaagtcgaagccaa

SEQ ID NO: 217707 - DNA, 25 bp, Homo sapien
catcacatggctgtccctcctggga

SEQ ID NO: 217708 - DNA, 25 bp, Homo sapien
gactcaaaacacgaccatcacatgg

SEQ ID NO: 217709 - DNA, 25 bp, Homo sapien
gggcgtcgagactcaaaacacgacc

SEQ ID NO: 217710 - DNA, 25 bp, Homo sapien
gggaggcaggcactcagctccctcg

SEQ ID NO: 217711 - DNA, 25 bp, Homo sapien
ggtccatcgcttaccctgcagcagt

SEQ ID NO: 217712 - DNA, 25 bp, Homo sapien
aagccacgatctgactccggacctg

SEQ ID NO: 217713 - DNA, 25 bp, Homo sapien
tgccggcctttgcagccttcagagt

SEQ ID NO: 217714 - DNA, 25 bp, Homo sapien
caggttcttcctccgcacttgtggg

SEQ ID NO: 217715 - DNA, 25 bp, Homo sapien
cttcggtccacactttcagagaaca

SEQ ID NO: 217716 - DNA, 25 bp, Homo sapien
tccacgcgcctgtctgaggaagatc

SEQ ID NO: 217717 - DNA, 25 bp, Homo sapien
tccggcaagcctgagctgaaacgca

SEQ ID NO: 217718 - DNA, 25 bp, Homo sapien
cgtccacacagtgcgcaggtcaaca

SEQ ID NO: 217719 - DNA, 25 bp, Homo sapien
gtgctgacgctgacacagaaaagtt

SEQ ID NO: 217720 - DNA, 25 bp, Homo sapien
ccctgcgaggtgctgacgctgacac

SEQ ID NO: 217721 - DNA, 25 bp, Homo sapien
cgcgttttggatgaacacaggcgtg

SEQ ID NO: 217722 - DNA, 25 bp, Homo sapien
tgctgccgcgttttggatgaacaca

SEQ ID NO: 217723 - DNA, 25 bp, Homo sapien
atctgtcaaggctgctgccgcgttt

SEQ ID NO: 217724 - DNA, 25 bp, Homo sapien
ttcccatctgtcaaggctgctgccg

SEQ ID NO: 217725 - DNA, 25 bp, Homo sapien
ccgcaggtggcttcccatctgtcaa

SEQ ID NO: 217726 - DNA, 25 bp, Homo sapien
ggtggcttcccatctgtcaaggctg

SEQ ID NO: 217727 - DNA, 25 bp, Homo sapien
cgctgagcacagagcgtggagccct

SEQ ID NO: 217728 - DNA, 25 bp, Homo sapien
gaacgggaagctgtctgctcagccg

SEQ ID NO: 217729 - DNA, 25 bp, Homo sapien
agctggaacgggaagctgtctgctc

SEQ ID NO: 217730 - DNA, 25 bp, Homo sapien
cctccagcgtgcagctggaacggga

SEQ ID NO: 217731 - DNA, 25 bp, Homo sapien
ggccgcagcaacagggcggcgtgga

SEQ ID NO: 217732 - DNA, 25 bp, Homo sapien
agcagccggcctgtcggtcctcggc

SEQ ID NO: 217733 - DNA, 25 bp, Homo sapien
ggtggcggcgaaggcacccagcgct

SEQ ID NO: 217734 - DNA, 25 bp, Homo sapien
tgccatcctggggttgtgcatggtg

SEQ ID NO: 217735 - DNA, 25 bp, Homo sapien
cgctgtatggaagccctttgctgcc

SEQ ID NO: 217736 - DNA, 25 bp, Homo sapien
ggcgaagccaaacactggagaggaa

SEQ ID NO: 217737 - DNA, 25 bp, Homo sapien
acactggagaggaaaagttgagctc

SEQ ID NO: 217738 - DNA, 25 bp, Homo sapien
gagaggaaaagttgagctcgtctcc

SEQ ID NO: 217739 - DNA, 25 bp, Homo sapien
agccgggcaggttctagaacaaaca

SEQ ID NO: 217740 - DNA, 25 bp, Homo sapien
actcgcgctgtatggaagccctttg

SEQ ID NO: 217741 - DNA, 25 bp, Homo sapien
ccgtggcatctgtgagcgtggcaga

SEQ ID NO: 217742 - DNA, 25 bp, Homo sapien
ggttctagaacaaacactcgcgctg

SEQ ID NO: 217743 - DNA, 25 bp, Homo sapien
gatccttagcgctggcctgctgtac

SEQ ID NO: 217744 - DNA, 25 bp, Homo sapien
cgtctcgatccttagcgctggcctg

SEQ ID NO: 217745 - DNA, 25 bp, Homo sapien
tctcgatccttagcgctggcctgct

SEQ ID NO: 217746 - DNA, 25 bp, Homo sapien
atggccgtctcgatccttagcgctg

SEQ ID NO: 217747 - DNA, 25 bp, Homo sapien
gcatggccgtctcgatccttagcgc

SEQ ID NO: 217748 - DNA, 25 bp, Homo sapien
catggccgtctcgatccttagcgct

SEQ ID NO: 217749 - DNA, 25 bp, Homo sapien
agggcatggccgtctcgatccttag

SEQ ID NO: 217750 - DNA, 25 bp, Homo sapien
cgatccttagcgctggcctgctgta

SEQ ID NO: 217751 - DNA, 25 bp, Homo sapien
tggacctgaggatgccaggccgaca

SEQ ID NO: 217752 - DNA, 25 bp, Homo sapien
ctgaggatgccaggccgacagagca

SEQ ID NO: 217753 - DNA, 25 bp, Homo sapien
gaggatggacctgaggatgccagcc

SEQ ID NO: 217754 - DNA, 25 bp, Homo sapien
ggatgccagcccgacagagcacggt

SEQ ID NO: 217755 - DNA, 25 bp, Homo sapien
cagagcacggtgtcgaccagcagga

SEQ ID NO: 217756 - DNA, 25 bp, Homo sapien
caggaggatggacctgaggatgcca

SEQ ID NO: 217757 - DNA, 25 bp, Homo sapien
atgccagcccgacagagcacggtgt

SEQ ID NO: 217758 - DNA, 25 bp, Homo sapien
acagagcacggtgtcgaccagcagg

SEQ ID NO: 217759 - DNA, 25 bp, Homo sapien
tgccagcccgacagagcacggtgtc

SEQ ID NO: 217760 - DNA, 25 bp, Homo sapien
acagagcacggtgtcgaccagcagg

SEQ ID NO: 217761 - DNA, 25 bp, Homo sapien
gcccgacagagcacggtgtcgacca

SEQ ID NO: 217762 - DNA, 25 bp, Homo sapien
ccagcccgacagagcacggtgtcga

SEQ ID NO: 217763 - DNA, 25 bp, Homo sapien
gatgccagcccgacagagcacggtg

SEQ ID NO: 217764 - DNA, 25 bp, Homo sapien
ggatgccagcccgacagagcacggt

SEQ ID NO: 217765 - DNA, 25 bp, Homo sapien
tggacctgaggatgccaggccgaca

SEQ ID NO: 217766 - DNA, 25 bp, Homo sapien
atgccagcccgacagagcacggtgt

SEQ ID NO: 217767 - DNA, 25 bp, Homo sapien
tttgtcacatctccggtttcctttc

SEQ ID NO: 217768 - DNA, 25 bp, Homo sapien
tctttgcttcagcttccatgcgacc

SEQ ID NO: 217769 - DNA, 25 bp, Homo sapien
gccctctagcgccagcgttttgtca

SEQ ID NO: 217770 - DNA, 25 bp, Homo sapien
tccacacgctgagagtcagctgagc

SEQ ID NO: 217771 - DNA, 25 bp, Homo sapien
tctcctctgcagaaatcgctcgagc

SEQ ID NO: 217772 - DNA, 25 bp, Homo sapien
ggtttcctttctttgcttcagcttc

SEQ ID NO: 217773 - DNA, 25 bp, Homo sapien
tgtgccgcggccctgtcaaagcggc

SEQ ID NO: 217774 - DNA, 25 bp, Homo sapien
ctgagcttgaacaaagagacctttc

SEQ ID NO: 217775 - DNA, 25 bp, Homo sapien
ccaggcaggaggcacatactcaggt

SEQ ID NO: 217776 - DNA, 25 bp, Homo sapien
taccaggctgtagagaagtgagctg

SEQ ID NO: 217777 - DNA, 25 bp, Homo sapien
acatactcaggtgagctgtggcatg

SEQ ID NO: 217778 - DNA, 25 bp, Homo sapien
ggttgagttctgtctcccaaaaaga

SEQ ID NO: 217779 - DNA, 25 bp, Homo sapien
atggctccactgacatttcctattc

SEQ ID NO: 217780 - DNA, 25 bp, Homo sapien
gcaagtggcattttccacaaatggc

SEQ ID NO: 217781 - DNA, 25 bp, Homo sapien
cacccttctgctgtggctctctgtt

SEQ ID NO: 217782 - DNA, 25 bp, Homo sapien
ttgctgtatgttttgggttgagttc

SEQ ID NO: 217783 - DNA, 25 bp, Homo sapien
ggtgctgtgcggtcagtcccgccca

SEQ ID NO: 217784 - DNA, 25 bp, Homo sapien
accgagcgtaactcgcgcgtcctga

SEQ ID NO: 217785 - DNA, 25 bp, Homo sapien
ccaaagcaagcactgtggaaggagc

SEQ ID NO: 217786 - DNA, 25 bp, Homo sapien
tccgtgacccatagacgtggccttt

SEQ ID NO: 217787 - DNA, 25 bp, Homo sapien
cccttgggatgttatttccaaagca

SEQ ID NO: 217788 - DNA, 25 bp, Homo sapien
agacgtggcctttgcagccgtttcc

SEQ ID NO: 217789 - DNA, 25 bp, Homo sapien
gaccggcgaactcatagcggggccc

SEQ ID NO: 217790 - DNA, 25 bp, Homo sapien
aggtgctccgggatgaccggcccac

SEQ ID NO: 217791 - DNA, 25 bp, Homo sapien
cccgaggctgggcagaactcgcaga

SEQ ID NO: 217792 - DNA, 25 bp, Homo sapien
aactcgcagaggaagacaagggcag

SEQ ID NO: 217793 - DNA, 25 bp, Homo sapien
cgggcacacgacacttgtcggctga

SEQ ID NO: 217794 - DNA, 25 bp, Homo sapien
cccagaggaaacaaaagccaaatgc

SEQ ID NO: 217795 - DNA, 25 bp, Homo sapien
gcccgtccaaagtaggcgacaagtg

SEQ ID NO: 217796 - DNA, 25 bp, Homo sapien
ggcgacaagtgaggcagcgcctctc

SEQ ID NO: 217797 - DNA, 25 bp, Homo sapien
gctctcaccaatcccgcaggtaagt

SEQ ID NO: 217798 - DNA, 25 bp, Homo sapien
ttgcgacctcgcgaaaacgctctca

SEQ ID NO: 217799 - DNA, 25 bp, Homo sapien
tttctgcggcgcgttttacaagtgg

SEQ ID NO: 217800 - DNA, 25 bp, Homo sapien
gcgctctgctcagatgtgagaagta

SEQ ID NO: 217801 - DNA, 25 bp, Homo sapien
taacgggtcacctggccactaggaa

SEQ ID NO: 217802 - DNA, 25 bp, Homo sapien
acaaaaatgtggtcccgctctgggc

SEQ ID NO: 217803 - DNA, 25 bp, Homo sapien
tgccctgggacttacgattggcttg

SEQ ID NO: 217804 - DNA, 25 bp, Homo sapien
cagagttactcatttcctggatgtc

SEQ ID NO: 217805 - DNA, 25 bp, Homo sapien
ttctttcttcggtagcgctctgctc

SEQ ID NO: 217806 - DNA, 25 bp, Homo sapien
taaaagtcgtcctaagccgcggagc

SEQ ID NO: 217807 - DNA, 25 bp, Homo sapien
cggcaatgattgaagaggccgcgtc

SEQ ID NO: 217808 - DNA, 25 bp, Homo sapien
cgcatttgttctcagggcagcgagg

SEQ ID NO: 217809 - DNA, 25 bp, Homo sapien
ccggcatgcagagcggctttcctac

SEQ ID NO: 217810 - DNA, 25 bp, Homo sapien
cgtctgtctccgtgcatggcagccg

SEQ ID NO: 217811 - DNA, 25 bp, Homo sapien
tcctggcgaccagcgctgctaatga

SEQ ID NO: 217812 - DNA, 25 bp, Homo sapien
accagcgctgctaatgaacgggagg

SEQ ID NO: 217813 - DNA, 25 bp, Homo sapien
gccgtccattgtccctcgcatttgt

SEQ ID NO: 217814 - DNA, 25 bp, Homo sapien
cggcaacgccgcagttcacattcga

SEQ ID NO: 217815 - DNA, 25 bp, Homo sapien
ttcgggtccttccagacctgttgtg

SEQ ID NO: 217816 - DNA, 25 bp, Homo sapien
gaatttcccaccgatcgccgagcgg

SEQ ID NO: 217817 - DNA, 25 bp, Homo sapien
tcagttcagctggatcttcccggtg

SEQ ID NO: 217818 - DNA, 25 bp, Homo sapien
tgtgcctgttgcaggtcggaaacgc

SEQ ID NO: 217819 - DNA, 25 bp, Homo sapien
tcggaaacgcaacccgtctggaagc

SEQ ID NO: 217820 - DNA, 25 bp, Homo sapien
ttcaaggtcgtgattcccaggcaca

SEQ ID NO: 217821 - DNA, 25 bp, Homo sapien
acacgctccgttacacgccgggtgg

SEQ ID NO: 217822 - DNA, 25 bp, Homo sapien
ccaccggcctggctttgctgaaaca

SEQ ID NO: 217823 - DNA, 25 bp, Homo sapien
tcaggcagccttcaacatccaggga

SEQ ID NO: 217824 - DNA, 25 bp, Homo sapien
acctgccggagacagctcagtgacc

SEQ ID NO: 217825 - DNA, 25 bp, Homo sapien
agtgaccgcccagggaaccgctctt

SEQ ID NO: 217826 - DNA, 25 bp, Homo sapien
ggaaccgctcttccgacacacggga

SEQ ID NO: 217827 - DNA, 25 bp, Homo sapien
cctttgcgcattcacaggagcactc

SEQ ID NO: 217828 - DNA, 25 bp, Homo sapien
tggccgtgaaacgtggctttcgtca

SEQ ID NO: 217829 - DNA, 25 bp, Homo sapien
gctttcgtcaccgaggcttcagcgc

SEQ ID NO: 217830 - DNA, 25 bp, Homo sapien
caaggctctggcctgtcgtcttctc

SEQ ID NO: 217831 - DNA, 25 bp, Homo sapien
gaaccttctggtcttgcctcgcttc

SEQ ID NO: 217832 - DNA, 25 bp, Homo sapien
gcacttttctttcccggcctggcag

SEQ ID NO: 217833 - DNA, 25 bp, Homo sapien
agcgctgccaggttgcactccagca

SEQ ID NO: 217834 - DNA, 25 bp, Homo sapien
ctggggccatcattgccacctcgta

SEQ ID NO: 217835 - DNA, 25 bp, Homo sapien
tccttccacagcgttcccaggggag

SEQ ID NO: 217836 - DNA, 25 bp, Homo sapien
gtggagactccctcggagacctctg

SEQ ID NO: 217837 - DNA, 25 bp, Homo sapien
agacctctgcgcacatggagacccg

SEQ ID NO: 217838 - DNA, 25 bp, Homo sapien
gcagagacatctataccagtgggaa

SEQ ID NO: 217839 - DNA, 25 bp, Homo sapien
gctggactccacgtggctgttttaa

SEQ ID NO: 217840 - DNA, 25 bp, Homo sapien
tctctgcagatctgtgaagtgccca

SEQ ID NO: 217841 - DNA, 25 bp, Homo sapien
tcgggaggcctatccgaggtattgc

SEQ ID NO: 217842 - DNA, 25 bp, Homo sapien
gctgcgcttggaatcacactctctg

SEQ ID NO: 217843 - DNA, 25 bp, Homo sapien
ttctccacaaacgtgggctggactc

SEQ ID NO: 217844 - DNA, 25 bp, Homo sapien
gttcccgtggctggatgtttctcac

SEQ ID NO: 217845 - DNA, 25 bp, Homo sapien
ctcttttcattcagacgcggcttcg

SEQ ID NO: 217846 - DNA, 25 bp, Homo sapien
aggatccgatccagttcaaagcgca

SEQ ID NO: 217847 - DNA, 25 bp, Homo sapien
ttctgcctctggaaagccattcagc

SEQ ID NO: 217848 - DNA, 25 bp, Homo sapien
ggcttcacacaacacataccgagca

SEQ ID NO: 217849 - DNA, 25 bp, Homo sapien
ctggctcctccagtgatgatcagta

SEQ ID NO: 217850 - DNA, 25 bp, Homo sapien
ccattcagcaggcaaggtggattca

SEQ ID NO: 217851 - DNA, 25 bp, Homo sapien
agcggagacagcttctgcctctgga

SEQ ID NO: 217852 - DNA, 25 bp, Homo sapien
ctaccaagtaggcaacccggtgcta

SEQ ID NO: 217853 - DNA, 25 bp, Homo sapien
atgatcagtacccaggagtgcctcg

SEQ ID NO: 217854 - DNA, 25 bp, Homo sapien
cccacacaggaagggcatgctggct

SEQ ID NO: 217855 - DNA, 25 bp, Homo sapien
tcacggcctcatgagcccataaagg

SEQ ID NO: 217856 - DNA, 25 bp, Homo sapien
agcccataaagggaagcggacacga

SEQ ID NO: 217857 - DNA, 25 bp, Homo sapien
acggcctcatgagcccataaaggga

SEQ ID NO: 217858 - DNA, 25 bp, Homo sapien
gctcacggcctcatgagcccataaa

SEQ ID NO: 217859 - DNA, 25 bp, Homo sapien
tgagcccataaagggaagcggacac

SEQ ID NO: 217860 - DNA, 25 bp, Homo sapien
gcccataaagggaagcggacacgaa

SEQ ID NO: 217861 - DNA, 25 bp, Homo sapien
aagcgcgtcatcaccgaggctctca

SEQ ID NO: 217862 - DNA, 25 bp, Homo sapien
gaagcgcgtcatcaccgaggctctc

SEQ ID NO: 217863 - DNA, 25 bp, Homo sapien
atcatcggcggacagaaggcgtgac

SEQ ID NO: 217864 - DNA, 25 bp, Homo sapien
cggaagcacgtcatcaccgaggctc

SEQ ID NO: 217865 - DNA, 25 bp, Homo sapien
gctcccaggaccttatgagcccata

SEQ ID NO: 217866 - DNA, 25 bp, Homo sapien
gctcccaggacgtccgcaagcatgt

SEQ ID NO: 217867 - DNA, 25 bp, Homo sapien
cgtgtgactgaccacggaccgagga

SEQ ID NO: 217868 - DNA, 25 bp, Homo sapien
ccacgtgtggtttcccgtgtgactg

SEQ ID NO: 217869 - DNA, 25 bp, Homo sapien
gtgctcacggcctcatgagcccata

SEQ ID NO: 217870 - DNA, 25 bp, Homo sapien
gcaagcatgtttccaacaagccctg

SEQ ID NO: 217871 - DNA, 25 bp, Homo sapien
cagcaccaccgcgttggtcattgta

SEQ ID NO: 217872 - DNA, 25 bp, Homo sapien
gaaataattctcacaggctgcactc

SEQ ID NO: 217873 - DNA, 25 bp, Homo sapien
gttggagctgctggcctctctgttt

SEQ ID NO: 217874 - DNA, 25 bp, Homo sapien
gagcttccgggctcttttctttgaa

SEQ ID NO: 217875 - DNA, 25 bp, Homo sapien
tcaacacattgttcacatggcagcg

SEQ ID NO: 217876 - DNA, 25 bp, Homo sapien
tcgtcggcaatttttggatgcactg

SEQ ID NO: 217877 - DNA, 25 bp, Homo sapien
tcatgctactacactgaattcatta

SEQ ID NO: 217878 - DNA, 25 bp, Homo sapien
tcacatggcagcgttccacgggcac

SEQ ID NO: 217879 - DNA, 25 bp, Homo sapien
gctcctggcctaacgcagcagtttc

SEQ ID NO: 217880 - DNA, 25 bp, Homo sapien
ttccgagacacgcaggagccttttc

SEQ ID NO: 217881 - DNA, 25 bp, Homo sapien
gtggcccgtggtttcacgtagaaca

SEQ ID NO: 217882 - DNA, 25 bp, Homo sapien
aagcgcctcctggacagtgaccatc

SEQ ID NO: 217883 - DNA, 25 bp, Homo sapien
caggcagcctgcagattcgttgtta

SEQ ID NO: 217884 - DNA, 25 bp, Homo sapien
tgttaaactacactcacgccgggtc

SEQ ID NO: 217885 - DNA, 25 bp, Homo sapien
ccgagaaagtcatgtcacgtccgtc

SEQ ID NO: 217886 - DNA, 25 bp, Homo sapien
gtgtgcttaagccaacctgttcatt

SEQ ID NO: 217887 - DNA, 25 bp, Homo sapien
gagggtgacagccgcggccgaacct

SEQ ID NO: 217888 - DNA, 25 bp, Homo sapien
agacctggctagagggagggtgaca

SEQ ID NO: 217889 - DNA, 25 bp, Homo sapien
aacctgcagacctggctagagggag

SEQ ID NO: 217890 - DNA, 25 bp, Homo sapien
aaacctgcagacctggctagaggga

SEQ ID NO: 217891 - DNA, 25 bp, Homo sapien
acaaacctgcagacctggctagagg

SEQ ID NO: 217892 - DNA, 25 bp, Homo sapien
gacaaacctgcagacctggctagag

SEQ ID NO: 217893 - DNA, 25 bp, Homo sapien
gagggtgacagccgcggacaaacct

SEQ ID NO: 217894 - DNA, 25 bp, Homo sapien
ggacaaacctgcagacctggctaga

SEQ ID NO: 217895 - DNA, 25 bp, Homo sapien
tcaccctctggacaagagaacgggc

SEQ ID NO: 217896 - DNA, 25 bp, Homo sapien
atcacccaggaacgcggggacgcct

SEQ ID NO: 217897 - DNA, 25 bp, Homo sapien
gccgatggttccagaggaagccgtc

SEQ ID NO: 217898 - DNA, 25 bp, Homo sapien
cctactcttgtcgacgtgggtcctg

SEQ ID NO: 217899 - DNA, 25 bp, Homo sapien
tcctcgggtttggaatcaccctctg

SEQ ID NO: 217900 - DNA, 25 bp, Homo sapien
gaaagcaccgaaggggcaattatta

SEQ ID NO: 217901 - DNA, 25 bp, Homo sapien
cctggatccggcttgattttcatat

SEQ ID NO: 217902 - DNA, 25 bp, Homo sapien
cgccgagatcacttgggacgcgaca

SEQ ID NO: 217903 - DNA, 25 bp, Homo sapien
attcttcctcgctgaggggtgcttc

SEQ ID NO: 217904 - DNA, 25 bp, Homo sapien
aggggtgcttccagcgaggcggcct

SEQ ID NO: 217905 - DNA, 25 bp, Homo sapien
gcccggtattcttcctcgctgaggg

SEQ ID NO: 217906 - DNA, 25 bp, Homo sapien
ccggtattcttcctcgctgaggggt

SEQ ID NO: 217907 - DNA, 25 bp, Homo sapien
ggtattcttcctcgctgaggggtgc

SEQ ID NO: 217908 - DNA, 25 bp, Homo sapien
tcttcctcgctgaggggtgcttcca

SEQ ID NO: 217909 - DNA, 25 bp, Homo sapien
cttcctcgctgaggggtgcttccag

SEQ ID NO: 217910 - DNA, 25 bp, Homo sapien
cctcgctgaggggtgcttccagcga

SEQ ID NO: 217911 - DNA, 25 bp, Homo sapien
cgcagccagccacccgctcagcagg

SEQ ID NO: 217912 - DNA, 25 bp, Homo sapien
tgcgccttgtgcctgagcgcacgac

SEQ ID NO: 217913 - DNA, 25 bp, Homo sapien
gctcagcaggtacccggagccgctc

SEQ ID NO: 217914 - DNA, 25 bp, Homo sapien
gtgctgaccgcctaccactcgtacg

SEQ ID NO: 217915 - DNA, 25 bp, Homo sapien
cgccgagacatgcgcggctgacgat

SEQ ID NO: 217916 - DNA, 25 bp, Homo sapien
tgctggtcccggtctttgttctggg

SEQ ID NO: 217917 - DNA, 25 bp, Homo sapien
gtccatgctggtcccggtctttgtt

SEQ ID NO: 217918 - DNA, 25 bp, Homo sapien
cagctgcgccttgtgcctgagcgca

SEQ ID NO: 217919 - DNA, 25 bp, Homo sapien
ctcatgttatcctcgaaggggcgtc

SEQ ID NO: 217920 - DNA, 25 bp, Homo sapien
gggcgtcacgctggcctcatgttat

SEQ ID NO: 217921 - DNA, 25 bp, Homo sapien
catgttatcctcgaaggggcgtcac

SEQ ID NO: 217922 - DNA, 25 bp, Homo sapien
acgccggcctgatgttatcctcgaa

SEQ ID NO: 217923 - DNA, 25 bp, Homo sapien
tgttatcctcgaaggggcgtcacgc

SEQ ID NO: 217924 - DNA, 25 bp, Homo sapien
gtcacgccggcctgatgttatcctc

SEQ ID NO: 217925 - DNA, 25 bp, Homo sapien
cctcatgtcgtcctcgaaggggcgt

SEQ ID NO: 217926 - DNA, 25 bp, Homo sapien
atgttatcctcgaaggggcgtcacg

SEQ ID NO: 217927 - DNA, 25 bp, Homo sapien
tttatcaccacacggcgcgagcagg

SEQ ID NO: 217928 - DNA, 25 bp, Homo sapien
ggaaagccgagctcccttaagagca

SEQ ID NO: 217929 - DNA, 25 bp, Homo sapien
agccacgtcttggaattgtttcctg

SEQ ID NO: 217930 - DNA, 25 bp, Homo sapien
tcggtttgctcctgatagccacgtc

SEQ ID NO: 217931 - DNA, 25 bp, Homo sapien
ggtaaccacctgcatccgttttgtg

SEQ ID NO: 217932 - DNA, 25 bp, Homo sapien
atttgaccagcgatgctcacaggcg

SEQ ID NO: 217933 - DNA, 25 bp, Homo sapien
atccgccttggaagcaccatcgctg

SEQ ID NO: 217934 - DNA, 25 bp, Homo sapien
aggcgacctcgcagcttcgcatcag

SEQ ID NO: 217935 - DNA, 25 bp, Homo sapien
aagccacgcggtcgcacacctggta

SEQ ID NO: 217936 - DNA, 25 bp, Homo sapien
ttcctggaattggaagcagccggtg

SEQ ID NO: 217937 - DNA, 25 bp, Homo sapien
gaagatgctggagacgccctgagac

SEQ ID NO: 217938 - DNA, 25 bp, Homo sapien
ccctgagacggcggctgagacaccg

SEQ ID NO: 217939 - DNA, 25 bp, Homo sapien
ggctgagacaccgagctgaggccga

SEQ ID NO: 217940 - DNA, 25 bp, Homo sapien
cccacagggttagcaaagacgcaag

SEQ ID NO: 217941 - DNA, 25 bp, Homo sapien
ggcgtgaagccacgcggtcgcacac

SEQ ID NO: 217942 - DNA, 25 bp, Homo sapien
caaagacgcaagagggcgtgaagcc

SEQ ID NO: 217943 - DNA, 25 bp, Homo sapien
tgcaatctagtgatggcgcccacgc

SEQ ID NO: 217944 - DNA, 25 bp, Homo sapien
catccggggatctcggctttggaac

SEQ ID NO: 217945 - DNA, 25 bp, Homo sapien
cacccgcatgtttactcctggacgt

SEQ ID NO: 217946 - DNA, 25 bp, Homo sapien
tgagactgttttcttaaggatcatc

SEQ ID NO: 217947 - DNA, 25 bp, Homo sapien
cggcacccacgactctgagactgtt

SEQ ID NO: 217948 - DNA, 25 bp, Homo sapien
tctgaaaagcgagcgttccacgttg

SEQ ID NO: 217949 - DNA, 25 bp, Homo sapien
caggcgatgctgaagtcttcctcag

SEQ ID NO: 217950 - DNA, 25 bp, Homo sapien
tgagagtggaacgtccatcgcccgt

SEQ ID NO: 217951 - DNA, 25 bp, Homo sapien
cacgtggcgcagatcaaaagctccg

SEQ ID NO: 217952 - DNA, 25 bp, Homo sapien
cactcccagattccgaggccaggtc

SEQ ID NO: 217953 - DNA, 25 bp, Homo sapien
tgcctgggaccaacccgctccctct

SEQ ID NO: 217954 - DNA, 25 bp, Homo sapien
agatccagctgtccctagccgagtc

SEQ ID NO: 217955 - DNA, 25 bp, Homo sapien
gtgttccgttctcccacgtggcgca

SEQ ID NO: 217956 - DNA, 25 bp, Homo sapien
tcccacgtggcgcagatcaaaagct

SEQ ID NO: 217957 - DNA, 25 bp, Homo sapien
gccgccttctctgggagccatcggt

SEQ ID NO: 217958 - DNA, 25 bp, Homo sapien
acatcctgacatggccgacctgcag

SEQ ID NO: 217959 - DNA, 25 bp, Homo sapien
aggcagccgcgccttaaggccagag

SEQ ID NO: 217960 - DNA, 25 bp, Homo sapien
acgcggcatttctcacgccaggagc

SEQ ID NO: 217961 - DNA, 25 bp, Homo sapien
cttaaggccagagtcgaagcctgtg

SEQ ID NO: 217962 - DNA, 25 bp, Homo sapien
atatgcggtgggaacagcccgcgcc

SEQ ID NO: 217963 - DNA, 25 bp, Homo sapien
cgcggcctcgctaatgaggaaactt

SEQ ID NO: 217964 - DNA, 25 bp, Homo sapien
tgaaatcagctgtggggtttcgccc

SEQ ID NO: 217965 - DNA, 25 bp, Homo sapien
cgagagacgcggttctgaaatcagc

SEQ ID NO: 217966 - DNA, 25 bp, Homo sapien
gacacagggaacgttcgaggagaca

SEQ ID NO: 217967 - DNA, 25 bp, Homo sapien
gggcgaagtaaacttggctcctctc

SEQ ID NO: 217968 - DNA, 25 bp, Homo sapien
ctagcagcatgtctcggcgcaagca

SEQ ID NO: 217969 - DNA, 25 bp, Homo sapien
gagcgtcctcttcgaaacatccaag

SEQ ID NO: 217970 - DNA, 25 bp, Homo sapien
tcatttcgctggtaggagcgtcctc

SEQ ID NO: 217971 - DNA, 25 bp, Homo sapien
gacctcggctttgcagtcatttcgc

SEQ ID NO: 217972 - DNA, 25 bp, Homo sapien
tctcccgtctttttggatccgccga

SEQ ID NO: 217973 - DNA, 25 bp, Homo sapien
caggcgccgcgaaagttaagagact

SEQ ID NO: 217974 - DNA, 25 bp, Homo sapien
tgacgcagcctgtgatccctcgcga

SEQ ID NO: 217975 - DNA, 25 bp, Homo sapien
gacctaaagacatcgtgccggtttg

SEQ ID NO: 217976 - DNA, 25 bp, Homo sapien
ggggcattcgtacaagtttccgctg

SEQ ID NO: 217977 - DNA, 25 bp, Homo sapien
ggctctgccggatcttccaacgaaa

SEQ ID NO: 217978 - DNA, 25 bp, Homo sapien
gcccggttcacttgcgtccacgaaa

SEQ ID NO: 217979 - DNA, 25 bp, Homo sapien
tgggaacctgtgtctgcttcttctc

SEQ ID NO: 217980 - DNA, 25 bp, Homo sapien
cacttgccttcgttggagggactta

SEQ ID NO: 217981 - DNA, 25 bp, Homo sapien
ggccctccagcgatcgttttgcgtt

SEQ ID NO: 217982 - DNA, 25 bp, Homo sapien
ccgcgcgacacttctgcaatctgaa

SEQ ID NO: 217983 - DNA, 25 bp, Homo sapien
gggccgatccagaagtgcgcagccc

SEQ ID NO: 217984 - DNA, 25 bp, Homo sapien
aggccatctgtgctgacggttcaca

SEQ ID NO: 217985 - DNA, 25 bp, Homo sapien
tgctgacggttcacaccagacagga

SEQ ID NO: 217986 - DNA, 25 bp, Homo sapien
ggaccacttgcaaggacaaaaataa

SEQ ID NO: 217987 - DNA, 25 bp, Homo sapien
tggagttggaactttcggtcgcgct

SEQ ID NO: 217988 - DNA, 25 bp, Homo sapien
tggaactttcggtcgcgctcgctgc

SEQ ID NO: 217989 - DNA, 25 bp, Homo sapien
tcctgtatttaagaagccgccggcg

SEQ ID NO: 217990 - DNA, 25 bp, Homo sapien
ggttcacaccagacaggaccacttg

SEQ ID NO: 217991 - DNA, 25 bp, Homo sapien
gggaaccgcttctccaccaaaggca

SEQ ID NO: 217992 - DNA, 25 bp, Homo sapien
ggctgctagactcgatgcaaacgtc

SEQ ID NO: 217993 - DNA, 25 bp, Homo sapien
cgtcggaaacctcgaagctgcagca

SEQ ID NO: 217994 - DNA, 25 bp, Homo sapien
cggacccgaaccagtgcgtcatctg

SEQ ID NO: 217995 - DNA, 25 bp, Homo sapien
cagagcgcgctgaagatgcactacc

SEQ ID NO: 217996 - DNA, 25 bp, Homo sapien
ttcaagtgcaagatctgcggccgcg

SEQ ID NO: 217997 - DNA, 25 bp, Homo sapien
agggcaacctcaagacgcacttcgg

SEQ ID NO: 217998 - DNA, 25 bp, Homo sapien
caaatgccgcttctgcgccaaggtc

SEQ ID NO: 217999 - DNA, 25 bp, Homo sapien
tcccatcgcgggagcgaagagcagc

SEQ ID NO: 218000 - DNA, 25 bp, Homo sapien
gtggtgctggtcagtctcagctcct

SEQ ID NO: 218001 - DNA, 25 bp, Homo sapien
agcgtgcagcaaccgccatggatgc

SEQ ID NO: 218002 - DNA, 25 bp, Homo sapien
gagcccgctccagggatagcgctcg

SEQ ID NO: 218003 - DNA, 25 bp, Homo sapien
caacttttcccatcgcgggagcgaa

SEQ ID NO: 218004 - DNA, 25 bp, Homo sapien
tcccagaacgaaggtggcggcacga

SEQ ID NO: 218005 - DNA, 25 bp, Homo sapien
actccatccaagttgcgccgcggtg

SEQ ID NO: 218006 - DNA, 25 bp, Homo sapien
ctgagaacaggggacgcactacgag

SEQ ID NO: 218007 - DNA, 25 bp, Homo sapien
ggccttgcttcttcacgagcgctca

SEQ ID NO: 218008 - DNA, 25 bp, Homo sapien
cggtcacactcggatcttggaataa

SEQ ID NO: 218009 - DNA, 25 bp, Homo sapien
tttcggccacagtcagcacccgatg

SEQ ID NO: 218010 - DNA, 25 bp, Homo sapien
tcacgcatgtgtctccgcacgaagc

SEQ ID NO: 218011 - DNA, 25 bp, Homo sapien
gcctccctgggatgtcattttagca

SEQ ID NO: 218012 - DNA, 25 bp, Homo sapien
gtccgcttttgacagtcccttctta

SEQ ID NO: 218013 - DNA, 25 bp, Homo sapien
cgagttccgatccagtggcgagcta

SEQ ID NO: 218014 - DNA, 25 bp, Homo sapien
gcacgatggctcctcgccaactgta

SEQ ID NO: 218015 - DNA, 25 bp, Homo sapien
tctgcagggacttcttgtaatcacc

SEQ ID NO: 218016 - DNA, 25 bp, Homo sapien
acggacccacgagaaagccagtgtg

SEQ ID NO: 218017 - DNA, 25 bp, Homo sapien
agggacttcttgtaatcaccaagca

SEQ ID NO: 218018 - DNA, 25 bp, Homo sapien
gagtcctgcccgtggctccacccag

SEQ ID NO: 218019 - DNA, 25 bp, Homo sapien
gacccacgagaaagccagtgtggct

SEQ ID NO: 218020 - DNA, 25 bp, Homo sapien
cttcttgtaatcaccaagcagcgcg

SEQ ID NO: 218021 - DNA, 25 bp, Homo sapien
tggccacggctatgagcccacggac

SEQ ID NO: 218022 - DNA, 25 bp, Homo sapien
ccacggacccacgagaaagccagtg

SEQ ID NO: 218023 - DNA, 25 bp, Homo sapien
ccggaggctttaaagctttgtcttg

SEQ ID NO: 218024 - DNA, 25 bp, Homo sapien
ttaaagctttgtcttgcatccgcgg

SEQ ID NO: 218025 - DNA, 25 bp, Homo sapien
aagctttgtcttgcatccgcgggcc

SEQ ID NO: 218026 - DNA, 25 bp, Homo sapien
tttgtcttgcatccgcgggccacgc

SEQ ID NO: 218027 - DNA, 25 bp, Homo sapien
ctgcctttgctttgcctccctgtgt

SEQ ID NO: 218028 - DNA, 25 bp, Homo sapien
cgggtgccatcgtccggcctcaccc

SEQ ID NO: 218029 - DNA, 25 bp, Homo sapien
ctgggtcctgcacgtgggcactgcg

SEQ ID NO: 218030 - DNA, 25 bp, Homo sapien
ccacctccgcccttgcagcgcagag

SEQ ID NO: 218031 - DNA, 25 bp, Homo sapien
gtcccagctttagccactcgtgacg

SEQ ID NO: 218032 - DNA, 25 bp, Homo sapien
actcgtgacgtcattgcccggactc

SEQ ID NO: 218033 - DNA, 25 bp, Homo sapien
tcatcgtgcgccgacgccaaacgag

SEQ ID NO: 218034 - DNA, 25 bp, Homo sapien
ttacgtcatcggacctcgccgcttg

SEQ ID NO: 218035 - DNA, 25 bp, Homo sapien
cagatcccgctttacccggtgcgta

SEQ ID NO: 218036 - DNA, 25 bp, Homo sapien
gccgaccggcacagcaggtaaccga

SEQ ID NO: 218037 - DNA, 25 bp, Homo sapien
agcgcaggctctggaccgctaagga

SEQ ID NO: 218038 - DNA, 25 bp, Homo sapien
cgcacagacaccagcggttccaagg

SEQ ID NO: 218039 - DNA, 25 bp, Homo sapien
tgcacagtgactgaaggtgcaagct

SEQ ID NO: 218040 - DNA, 25 bp, Homo sapien
tgcagagtgactgaaggtgcgggct

SEQ ID NO: 218041 - DNA, 25 bp, Homo sapien
agctggcggtgtgcacagtgactga

SEQ ID NO: 218042 - DNA, 25 bp, Homo sapien
cacagtgactgaaggtgcaagctgc

SEQ ID NO: 218043 - DNA, 25 bp, Homo sapien
cagtgactgaaggtgcaagctgcat

SEQ ID NO: 218044 - DNA, 25 bp, Homo sapien
tgactgaaggtgcaagctgcatgtc

SEQ ID NO: 218045 - DNA, 25 bp, Homo sapien
actgaaggtgcaagctgcatgtcgg

SEQ ID NO: 218046 - DNA, 25 bp, Homo sapien
gtgactgaaggtgcgggctgcatgt

SEQ ID NO: 218047 - DNA, 25 bp, Homo sapien
tcagcgtctgagtgactgttgggtc

SEQ ID NO: 218048 - DNA, 25 bp, Homo sapien
gccactgtcttcagcgtctgagtga

SEQ ID NO: 218049 - DNA, 25 bp, Homo sapien
gtctgagtgactcttgggtcccgca

SEQ ID NO: 218050 - DNA, 25 bp, Homo sapien
gcggccactgtcttcagcgtctgag

SEQ ID NO: 218051 - DNA, 25 bp, Homo sapien
tcagcgtctgagtgactcttgggtc

SEQ ID NO: 218052 - DNA, 25 bp, Homo sapien
cggccactgtcttcagcgtctgagt

SEQ ID NO: 218053 - DNA, 25 bp, Homo sapien
ccactgtcttcagcgtctgagtgac

SEQ ID NO: 218054 - DNA, 25 bp, Homo sapien
agcgtctgagtgactgttgggtccc

SEQ ID NO: 218055 - DNA, 25 bp, Homo sapien
tgctctctctggttagcgtgctctc

SEQ ID NO: 218056 - DNA, 25 bp, Homo sapien
ctccgtggttagtgtgctctctcca

SEQ ID NO: 218057 - DNA, 25 bp, Homo sapien
ggttagcgtgctctctctggttagc

SEQ ID NO: 218058 - DNA, 25 bp, Homo sapien
gctctctctggttagcgtgctctcc

SEQ ID NO: 218059 - DNA, 25 bp, Homo sapien
ggttagtgtgctctctccatggtta

SEQ ID NO: 218060 - DNA, 25 bp, Homo sapien
ttagcgtgctctccgtggttagtgt

SEQ ID NO: 218061 - DNA, 25 bp, Homo sapien
tgctctctccatggttagcgtgctc

SEQ ID NO: 218062 - DNA, 25 bp, Homo sapien
ctctctgtggttagcgtgctctccg

SEQ ID NO: 218063 - DNA, 25 bp, Homo sapien
tatgtgagactcaacggcagcgagg

SEQ ID NO: 218064 - DNA, 25 bp, Homo sapien
tggcgcatcacaggcctcgtccttg

SEQ ID NO: 218065 - DNA, 25 bp, Homo sapien
gcctgcggggaacagccatttatgt

SEQ ID NO: 218066 - DNA, 25 bp, Homo sapien
agaatagccaggtgttagcctgcgg

SEQ ID NO: 218067 - DNA, 25 bp, Homo sapien
cggagaccacccagagagaatagcc

SEQ ID NO: 218068 - DNA, 25 bp, Homo sapien
tggcccgaagagacccactcgcaga

SEQ ID NO: 218069 - DNA, 25 bp, Homo sapien
tcctgacaccgctggcccgaagaga

SEQ ID NO: 218070 - DNA, 25 bp, Homo sapien
ggagatgctccgtgtcatggtcaca

SEQ ID NO: 218071 - DNA, 25 bp, Homo sapien
ttgtgcgtggatggaaggacatctc

SEQ ID NO: 218072 - DNA, 25 bp, Homo sapien
acagctcccgcgtgatggaaggaca

SEQ ID NO: 218073 - DNA, 25 bp, Homo sapien
ctcccgcgtgatggaaggacatctc

SEQ ID NO: 218074 - DNA, 25 bp, Homo sapien
ccgcgtgatggaaggacatctctgt

SEQ ID NO: 218075 - DNA, 25 bp, Homo sapien
catctctgtggacggggacagccca

SEQ ID NO: 218076 - DNA, 25 bp, Homo sapien
acagtccatgcgtggatggaggaca

SEQ ID NO: 218077 - DNA, 25 bp, Homo sapien
tggaggacaactccgtggacgggga

SEQ ID NO: 218078 - DNA, 25 bp, Homo sapien
ccatgcgtggatggaggacaactcc

SEQ ID NO: 218079 - DNA, 25 bp, Homo sapien
gcagcacagccactcgggagcagtt

SEQ ID NO: 218080 - DNA, 25 bp, Homo sapien
ccatgcagtggtgaacctgtacgta

SEQ ID NO: 218081 - DNA, 25 bp, Homo sapien
tcagacctgcgggaggtgaacacag

SEQ ID NO: 218082 - DNA, 25 bp, Homo sapien
cctgcaccacggatgaaggcgctga

SEQ ID NO: 218083 - DNA, 25 bp, Homo sapien
ccatatcagaaagtgcctgctctta

SEQ ID NO: 218084 - DNA, 25 bp, Homo sapien
taagttgtggatcatggtaaaaccc

SEQ ID NO: 218085 - DNA, 25 bp, Homo sapien
tgccttggaattgttttttgaatcg

SEQ ID NO: 218086 - DNA, 25 bp, Homo sapien
gtgtgcacttgtcctcgtctcagtg

SEQ ID NO: 218087 - DNA, 25 bp, Homo sapien
tctgctactcgcaacgctgcctggt

SEQ ID NO: 218088 - DNA, 25 bp, Homo sapien
gggatcttcatcttgccgcggagtt

SEQ ID NO: 218089 - DNA, 25 bp, Homo sapien
catccggaagccagggatcttcatc

SEQ ID NO: 218090 - DNA, 25 bp, Homo sapien
ggtcgcacccaggaaccatctttgt

SEQ ID NO: 218091 - DNA, 25 bp, Homo sapien
gttgaggtcgaactgcaagcgccac

SEQ ID NO: 218092 - DNA, 25 bp, Homo sapien
ctaactttagcgaagtcgggccgcg

SEQ ID NO: 218093 - DNA, 25 bp, Homo sapien
gacgccctgacacggaggacccaga

SEQ ID NO: 218094 - DNA, 25 bp, Homo sapien
tggagctcaggaccctaactttagc

SEQ ID NO: 218095 - DNA, 25 bp, Homo sapien
catcagcgcctgttgaatggaattc

SEQ ID NO: 218096 - DNA, 25 bp, Homo sapien
gtattttccacgcaggcggcagcct

SEQ ID NO: 218097 - DNA, 25 bp, Homo sapien
ccgccaggagtttcacctgttcatt

SEQ ID NO: 218098 - DNA, 25 bp, Homo sapien
ttcttccgcgtcgtttcccatcagg

SEQ ID NO: 218099 - DNA, 25 bp, Homo sapien
ttccgaaggcgtttcaccaaccagc

SEQ ID NO: 218100 - DNA, 25 bp, Homo sapien
tggaattcctctgccgtcatctgtc

SEQ ID NO: 218101 - DNA, 25 bp, Homo sapien
ctgcgctcccacaaggtgtcgctgg

SEQ ID NO: 218102 - DNA, 25 bp, Homo sapien
cgtcacctgaaatgctggcggagct

SEQ ID NO: 218103 - DNA, 25 bp, Homo sapien
gccgcgagccggttgtttatgtaaa

SEQ ID NO: 218104 - DNA, 25 bp, Homo sapien
cgagtttaaccagcgcgacgagggc

SEQ ID NO: 218105 - DNA, 25 bp, Homo sapien
gaggaccaggagttcgacttcgagt

SEQ ID NO: 218106 - DNA, 25 bp, Homo sapien
gccctgggcgcagccttaggtacct

SEQ ID NO: 218107 - DNA, 25 bp, Homo sapien
ctgaaatcggggttcctagcgttgg

SEQ ID NO: 218108 - DNA, 25 bp, Homo sapien
ttcccggcaccgtcgggctgaaatc

SEQ ID NO: 218109 - DNA, 25 bp, Homo sapien
ggcgcgccacgaacccagcgggaat

SEQ ID NO: 218110 - DNA, 25 bp, Homo sapien
gacttcgagttcctcttcgagttta

SEQ ID NO: 218111 - DNA, 25 bp, Homo sapien
ggtgctcacacatgacgccaggaag

SEQ ID NO: 218112 - DNA, 25 bp, Homo sapien
tggcgtctcatagccctggtgctca

SEQ ID NO: 218113 - DNA, 25 bp, Homo sapien
atgaacacccaagtgcgctccagga

SEQ ID NO: 218114 - DNA, 25 bp, Homo sapien
gctccaggagaagggatttggcacc

SEQ ID NO: 218115 - DNA, 25 bp, Homo sapien
cggtaagcttctaggggtgtctttg

SEQ ID NO: 218116 - DNA, 25 bp, Homo sapien
gcatctgccaggatggcgtctcata

SEQ ID NO: 218117 - DNA, 25 bp, Homo sapien
agcggctataaacaaacctacgagg

SEQ ID NO: 218118 - DNA, 25 bp, Homo sapien
gtggtcccggcaacggcattaaaca

SEQ ID NO: 218119 - DNA, 25 bp, Homo sapien
agcgcgccttctgccaataggtgtc

SEQ ID NO: 218120 - DNA, 25 bp, Homo sapien
cgccaagtttcgagctgcttcttta

SEQ ID NO: 218121 - DNA, 25 bp, Homo sapien
atggcacagtgtgggtccctgaaac

SEQ ID NO: 218122 - DNA, 25 bp, Homo sapien
tcctgcaagtggctttgaaaatacc

SEQ ID NO: 218123 - DNA, 25 bp, Homo sapien
cccttgcagaggtgtgagcatacga

SEQ ID NO: 218124 - DNA, 25 bp, Homo sapien
atgtacttcataagggcagacgtcc

SEQ ID NO: 218125 - DNA, 25 bp, Homo sapien
accctgataactgcggggcttgctt

SEQ ID NO: 218126 - DNA, 25 bp, Homo sapien
agttccagccagagaagatgtttca

SEQ ID NO: 218127 - DNA, 25 bp, Homo sapien
tggcctgttgtccagcgggtctgat

SEQ ID NO: 218128 - DNA, 25 bp, Homo sapien
agccgcaggcctgcgctcgacaaaa

SEQ ID NO: 218129 - DNA, 25 bp, Homo sapien
cagcgggtctgatgcagccggctca

SEQ ID NO: 218130 - DNA, 25 bp, Homo sapien
tgcctgtgtggcctgttgtccagcg

SEQ ID NO: 218131 - DNA, 25 bp, Homo sapien
cctggcacggtcacccaggcgtgtg

SEQ ID NO: 218132 - DNA, 25 bp, Homo sapien
gggtcttccgcagcgctccatgcgg

SEQ ID NO: 218133 - DNA, 25 bp, Homo sapien
caccgttggactgcgtccctgtgct

SEQ ID NO: 218134 - DNA, 25 bp, Homo sapien
ttccttctgtccaccgttggactgc

SEQ ID NO: 218135 - DNA, 25 bp, Homo sapien
gctgggcacagccttatatgactga

SEQ ID NO: 218136 - DNA, 25 bp, Homo sapien
cctgcgctcgctggttgacagcaca

SEQ ID NO: 218137 - DNA, 25 bp, Homo sapien
tcaccttagcctcgggctggactta

SEQ ID NO: 218138 - DNA, 25 bp, Homo sapien
tcctggggcatctctaggtgacacc

SEQ ID NO: 218139 - DNA, 25 bp, Homo sapien
atgccaactggcttcactggaaaca

SEQ ID NO: 218140 - DNA, 25 bp, Homo sapien
gccttccactcggagagagcggcca

SEQ ID NO: 218141 - DNA, 25 bp, Homo sapien
ggacttactgcttccaaaagcgctg

SEQ ID NO: 218142 - DNA, 25 bp, Homo sapien
ccaccctgcgtgaatacaattattt

SEQ ID NO: 218143 - DNA, 25 bp, Homo sapien
ccgacgactcgtggttgggcaacac

SEQ ID NO: 218144 - DNA, 25 bp, Homo sapien
cccttgcaacaagaggaagtacagc

SEQ ID NO: 218145 - DNA, 25 bp, Homo sapien
agacgtcgccatggcagtctccctg

SEQ ID NO: 218146 - DNA, 25 bp, Homo sapien
gtcctcccggagctgcaactcagag

SEQ ID NO: 218147 - DNA, 25 bp, Homo sapien
aggtggaagacgtcctccctagctc

SEQ ID NO: 218148 - DNA, 25 bp, Homo sapien
ttgggcctgtaccacaacaataacc

SEQ ID NO: 218149 - DNA, 25 bp, Homo sapien
agataacctcgtgcttgggcctgta

SEQ ID NO: 218150 - DNA, 25 bp, Homo sapien
cctggagagtcctcgcatcgagata

SEQ ID NO: 218151 - DNA, 25 bp, Homo sapien
cccagagacgccggctgtggcatca

SEQ ID NO: 218152 - DNA, 25 bp, Homo sapien
gccacgctttggaacagcacggcct

SEQ ID NO: 218153 - DNA, 25 bp, Homo sapien
aattgccttccctgcctcgggtgca

SEQ ID NO: 218154 - DNA, 25 bp, Homo sapien
cagtccgccacgctttggaacagca

SEQ ID NO: 218155 - DNA, 25 bp, Homo sapien
atgggaccgcagctcaacagtgccc

SEQ ID NO: 218156 - DNA, 25 bp, Homo sapien
gtgcagatgggaccgcagctcaaca

SEQ ID NO: 218157 - DNA, 25 bp, Homo sapien
tgcagtaattgccttccctgcctcg

SEQ ID NO: 218158 - DNA, 25 bp, Homo sapien
tccctgcctcgggtgcagatgggac

SEQ ID NO: 218159 - DNA, 25 bp, Homo sapien
tcttcctcggggaattgcacgtgcc

SEQ ID NO: 218160 - DNA, 25 bp, Homo sapien
gtctgcgcgtttcccatctgaagtc

SEQ ID NO: 218161 - DNA, 25 bp, Homo sapien
ctcgtgttcgctcagtctctgcaaa

SEQ ID NO: 218162 - DNA, 25 bp, Homo sapien
ctgcaaacacccatttcaaagaggg

SEQ ID NO: 218163 - DNA, 25 bp, Homo sapien
gtcagggcttccacgtgggaattcc

SEQ ID NO: 218164 - DNA, 25 bp, Homo sapien
ggaattccgggagacgccatccgcc

SEQ ID NO: 218165 - DNA, 25 bp, Homo sapien
acacgcgcagtttcttcctcgggga

SEQ ID NO: 218166 - DNA, 25 bp, Homo sapien
agggctcacacacgcgcagtttctt

SEQ ID NO: 218167 - DNA, 25 bp, Homo sapien
gacgcctttccaggtgacttcgctg

SEQ ID NO: 218168 - DNA, 25 bp, Homo sapien
tttccaggcgacgtcgctgcagaga

SEQ ID NO: 218169 - DNA, 25 bp, Homo sapien
tttccaggcgacgttgctgcagaga

SEQ ID NO: 218170 - DNA, 25 bp, Homo sapien
cgcctttccaggtgacttcgctgca

SEQ ID NO: 218171 - DNA, 25 bp, Homo sapien
tttccaggtgacgtcgctgcagaga

SEQ ID NO: 218172 - DNA, 25 bp, Homo sapien
cgtttccaggcgacgtcgctgcaga

SEQ ID NO: 218173 - DNA, 25 bp, Homo sapien
acgcgtttccaggtgacgtcgctgc

SEQ ID NO: 218174 - DNA, 25 bp, Homo sapien
cgtttccaggtgacgtcgctgcaga

SEQ ID NO: 218175 - DNA, 25 bp, Homo sapien
tgtcgcgagctttcggctgaaaaaa

SEQ ID NO: 218176 - DNA, 25 bp, Homo sapien
aggacctgagccacgagccacactg

SEQ ID NO: 218177 - DNA, 25 bp, Homo sapien
cgcttccaccgcagcgtgaggacag

SEQ ID NO: 218178 - DNA, 25 bp, Homo sapien
atgccacgtcccatgccgcttccac

SEQ ID NO: 218179 - DNA, 25 bp, Homo sapien
ctcctcccgtggaaaggactgtgtg

SEQ ID NO: 218180 - DNA, 25 bp, Homo sapien
gacggcatctctgtcgcgagctttc

SEQ ID NO: 218181 - DNA, 25 bp, Homo sapien
gagacacaggttcaggggcatgaac

SEQ ID NO: 218182 - DNA, 25 bp, Homo sapien
ggcatgaacggctcctcccgtggaa

SEQ ID NO: 218183 - DNA, 25 bp, Homo sapien
caccgagcccactacgagacggagg

SEQ ID NO: 218184 - DNA, 25 bp, Homo sapien
ccatcgtgcaggtaggcactgcggc

SEQ ID NO: 218185 - DNA, 25 bp, Homo sapien
cgtgcactcgccgatgaagtgtcca

SEQ ID NO: 218186 - DNA, 25 bp, Homo sapien
aggtctgtgtggtgctgaacgcctc

SEQ ID NO: 218187 - DNA, 25 bp, Homo sapien
ggtgctgaacgcctcctctgctctg

SEQ ID NO: 218188 - DNA, 25 bp, Homo sapien
cactcaggcccgtatgagcttcgga

SEQ ID NO: 218189 - DNA, 25 bp, Homo sapien
ctcgccgatgaagtgtccacccaag

SEQ ID NO: 218190 - DNA, 25 bp, Homo sapien
tatgagcttcggattgaggtgcagc

SEQ ID NO: 218191 - DNA, 25 bp, Homo sapien
tggaagctcctcgtaaccgcagacg

SEQ ID NO: 218192 - DNA, 25 bp, Homo sapien
tgtccgctgcatctcaaaaagcttg

SEQ ID NO: 218193 - DNA, 25 bp, Homo sapien
tcttcgttgtgaatcgtctgtccgc

SEQ ID NO: 218194 - DNA, 25 bp, Homo sapien
cgcgggagtttcctgcatttgagaa

SEQ ID NO: 218195 - DNA, 25 bp, Homo sapien
cgcttttcagaaacgaggctcatcg

SEQ ID NO: 218196 - DNA, 25 bp, Homo sapien
tttagtacatcctttgacgcggccc

SEQ ID NO: 218197 - DNA, 25 bp, Homo sapien
tgccgtcgggttattttagtacatc

SEQ ID NO: 218198 - DNA, 25 bp, Homo sapien
ttaaagcccgctgtctcctgcagtg

SEQ ID NO: 218199 - DNA, 25 bp, Homo sapien
ccgaactgaagtcactggctgagca

SEQ ID NO: 218200 - DNA, 25 bp, Homo sapien
atctcccgctgaaacccagaacttt

SEQ ID NO: 218201 - DNA, 25 bp, Homo sapien
acccagaactttcggttcagcaggg

SEQ ID NO: 218202 - DNA, 25 bp, Homo sapien
aactttcggttcagcagggctggga

SEQ ID NO: 218203 - DNA, 25 bp, Homo sapien
attccctccaagttgggccgcggtg

SEQ ID NO: 218204 - DNA, 25 bp, Homo sapien
actgaagtcactggctgagcaggca

SEQ ID NO: 218205 - DNA, 25 bp, Homo sapien
gggtctccctgcctagtccgcgcac

SEQ ID NO: 218206 - DNA, 25 bp, Homo sapien
tcccagaccgaaggtggcagcgcgt

SEQ ID NO: 218207 - DNA, 25 bp, Homo sapien
tctggggttgccactcaacatcctt

SEQ ID NO: 218208 - DNA, 25 bp, Homo sapien
acgtgccattcacgggcgccatgtc

SEQ ID NO: 218209 - DNA, 25 bp, Homo sapien
cttctctggagtggggatacaatgt

SEQ ID NO: 218210 - DNA, 25 bp, Homo sapien
gggcttccggtttgaatgatctttc

SEQ ID NO: 218211 - DNA, 25 bp, Homo sapien
ccatgtctccaagaagaggggctcc

SEQ ID NO: 218212 - DNA, 25 bp, Homo sapien
ctcttccggagagacgtggagaccc

SEQ ID NO: 218213 - DNA, 25 bp, Homo sapien
atgatctttctccaaagtcggcgga

SEQ ID NO: 218214 - DNA, 25 bp, Homo sapien
ctctgctgccttcgtgcaggtgaca

SEQ ID NO: 218215 - DNA, 25 bp, Homo sapien
ggcacatggacgcttcccttgaatc

SEQ ID NO: 218216 - DNA, 25 bp, Homo sapien
tcacacggattctgcagacagcttc

SEQ ID NO: 218217 - DNA, 25 bp, Homo sapien
agacagcttccttcaccaggcatgg

SEQ ID NO: 218218 - DNA, 25 bp, Homo sapien
agggcctctcgtgcaggaaactgca

SEQ ID NO: 218219 - DNA, 25 bp, Homo sapien
acacgtcgtcctgttcctgtcatgg

SEQ ID NO: 218220 - DNA, 25 bp, Homo sapien
gcccgtgcattcaccggtctgagaa

SEQ ID NO: 218221 - DNA, 25 bp, Homo sapien
tgctatgtaacctccgccgttcagg

SEQ ID NO: 218222 - DNA, 25 bp, Homo sapien
ccgttcaggcctcagcatgcagcaa

SEQ ID NO: 218223 - DNA, 25 bp, Homo sapien
cctggactctgcacgtggtcatcgt

SEQ ID NO: 218224 - DNA, 25 bp, Homo sapien
gccgtctgtggtcaaagattttaaa

SEQ ID NO: 218225 - DNA, 25 bp, Homo sapien
ggcgtcgcattttcctgtggctgga

SEQ ID NO: 218226 - DNA, 25 bp, Homo sapien
ctgcccactgacatctgagaatccg

SEQ ID NO: 218227 - DNA, 25 bp, Homo sapien
gctctgagttcagccaccggtgaga

SEQ ID NO: 218228 - DNA, 25 bp, Homo sapien
tgagttcagccgtcgcttcactgtg

SEQ ID NO: 218229 - DNA, 25 bp, Homo sapien
ccttcgatgtctcagctgggacctg

SEQ ID NO: 218230 - DNA, 25 bp, Homo sapien
tccaaacgtgatcagaggggtcgac

SEQ ID NO: 218231 - DNA, 25 bp, Homo sapien
gaacagcatgcgagccgtgtaagcc

SEQ ID NO: 218232 - DNA, 25 bp, Homo sapien
gttttctctgcgttccggtgactcc

SEQ ID NO: 218233 - DNA, 25 bp, Homo sapien
tctaccaggtgcaccgcatcacagg

SEQ ID NO: 218234 - DNA, 25 bp, Homo sapien
tgctgcagcttttcattgggacggc

SEQ ID NO: 218235 - DNA, 25 bp, Homo sapien
ctacttggagaatgagccgctgatg

SEQ ID NO: 218236 - DNA, 25 bp, Homo sapien
aaagtcctggagatcccactcctgc

SEQ ID NO: 218237 - DNA, 25 bp, Homo sapien
aggtgttttctgttctctcgccagc

SEQ ID NO: 218238 - DNA, 25 bp, Homo sapien
cgccagctgcatggctacttggaga

SEQ ID NO: 218239 - DNA, 25 bp, Homo sapien
tcaagttactctgagaaaccacacg

SEQ ID NO: 218240 - DNA, 25 bp, Homo sapien
ccacacgcagaagaggctgatcgga

SEQ ID NO: 218241 - DNA, 25 bp, Homo sapien
gctgggcgtgcacctcacctggtct

SEQ ID NO: 218242 - DNA, 25 bp, Homo sapien
tcacctggtctccttggaactgctg

SEQ ID NO: 218243 - DNA, 25 bp, Homo sapien
cttggaactgctgcggcagccgcca

SEQ ID NO: 218244 - DNA, 25 bp, Homo sapien
gccgccagtaaaacggctctgcacg

SEQ ID NO: 218245 - DNA, 25 bp, Homo sapien
aacggctctgcacggatgtgctgcc

SEQ ID NO: 218246 - DNA, 25 bp, Homo sapien
tgatcggagcccagcgttacctaaa

SEQ ID NO: 218247 - DNA, 25 bp, Homo sapien
ggaaaccgtcccgtcacatgcgctt

SEQ ID NO: 218248 - DNA, 25 bp, Homo sapien
cgacattgaacttcggaaaggagag

SEQ ID NO: 218249 - DNA, 25 bp, Homo sapien
cgtccacgcgcccacaggggaggaa

SEQ ID NO: 218250 - DNA, 25 bp, Homo sapien
ctgtaagtggacgtccacgcgccca

SEQ ID NO: 218251 - DNA, 25 bp, Homo sapien
catcgaatgctgtaagtggacgtcc

SEQ ID NO: 218252 - DNA, 25 bp, Homo sapien
aagaacacacgggtacggctggtgt

SEQ ID NO: 218253 - DNA, 25 bp, Homo sapien
acggacatcgggaggaagaacacac

SEQ ID NO: 218254 - DNA, 25 bp, Homo sapien
cttcggaaaggagagacggacatcg

SEQ ID NO: 218255 - DNA, 25 bp, Homo sapien
gcgtctgttctggtgccgtttttta

SEQ ID NO: 218256 - DNA, 25 bp, Homo sapien
catcagcgaagcctgttttggtgtc

SEQ ID NO: 218257 - DNA, 25 bp, Homo sapien
cttttcttaagtcacgcgtctgttc

SEQ ID NO: 218258 - DNA, 25 bp, Homo sapien
cagttctcgatgctggagctgaaca

SEQ ID NO: 218259 - DNA, 25 bp, Homo sapien
tggatgcatcaaacatgagccagtt

SEQ ID NO: 218260 - DNA, 25 bp, Homo sapien
aacgcccgcgtgaaacgtgagctcg

SEQ ID NO: 218261 - DNA, 25 bp, Homo sapien
gctgctgagggacacactaacgttc

SEQ ID NO: 218262 - DNA, 25 bp, Homo sapien
tgaagactcccactccgtttgccag

SEQ ID NO: 218263 - DNA, 25 bp, Homo sapien
caaaggccctttcaggaccggctgc

SEQ ID NO: 218264 - DNA, 25 bp, Homo sapien
tttgtggaaacagtggctcagcatc

SEQ ID NO: 218265 - DNA, 25 bp, Homo sapien
ggaagcctcccgatgactcagactg

SEQ ID NO: 218266 - DNA, 25 bp, Homo sapien
gactcagactgcagggaattcccta

SEQ ID NO: 218267 - DNA, 25 bp, Homo sapien
gaatatttttactcctgcactcggg

SEQ ID NO: 218268 - DNA, 25 bp, Homo sapien
tgcactcgggcagtttcctactaag

SEQ ID NO: 218269 - DNA, 25 bp, Homo sapien
cggagctctgataaggctgaacaca

SEQ ID NO: 218270 - DNA, 25 bp, Homo sapien
ttcctactaaggactcggagctctg

SEQ ID NO: 218271 - DNA, 25 bp, Homo sapien
gtcattaaacgcgacatcctggccc

SEQ ID NO: 218272 - DNA, 25 bp, Homo sapien
gcctcggctgcaaaaatggcgtccc

SEQ ID NO: 218273 - DNA, 25 bp, Homo sapien
tgttggcctcggctgcaaaaatggc

SEQ ID NO: 218274 - DNA, 25 bp, Homo sapien
gctgtgttggcctcggctgcaaaaa

SEQ ID NO: 218275 - DNA, 25 bp, Homo sapien
cttctcgggacataaagagaggagc

SEQ ID NO: 218276 - DNA, 25 bp, Homo sapien
cctcttgcttctcgggacataaaga

SEQ ID NO: 218277 - DNA, 25 bp, Homo sapien
ggagtccctcttgcttctcgggaca

SEQ ID NO: 218278 - DNA, 25 bp, Homo sapien
cctcggggtgtcattaaacgcgaca

SEQ ID NO: 218279 - DNA, 25 bp, Homo sapien
tcccaagcacaagagcctgggcgtg

SEQ ID NO: 218280 - DNA, 25 bp, Homo sapien
tggctcctggactcgcgattggcca

SEQ ID NO: 218281 - DNA, 25 bp, Homo sapien
ccctgtgatggtgtcccaagcacaa

SEQ ID NO: 218282 - DNA, 25 bp, Homo sapien
attggccacagcctgttagcgggcg

SEQ ID NO: 218283 - DNA, 25 bp, Homo sapien
acttctgctgtcaccgggccgtttc

SEQ ID NO: 218284 - DNA, 25 bp, Homo sapien
accgcgtgcatacagccggtgcctg

SEQ ID NO: 218285 - DNA, 25 bp, Homo sapien
ggctgggtcacacttctgctgtcac

SEQ ID NO: 218286 - DNA, 25 bp, Homo sapien
ccggtgcctgaggataatgaccgtc

SEQ ID NO: 218287 - DNA, 25 bp, Homo sapien
tctacgggccacgtcagttatttgg

SEQ ID NO: 218288 - DNA, 25 bp, Homo sapien
tctgtaagccgcgtcggttatttga

SEQ ID NO: 218289 - DNA, 25 bp, Homo sapien
aagccgcgtcggttatttgaggtct

SEQ ID NO: 218290 - DNA, 25 bp, Homo sapien
ttatttgaggtctgtaagccgcgtc

SEQ ID NO: 218291 - DNA, 25 bp, Homo sapien
cgcgtcagttatttggggtctataa

SEQ ID NO: 218292 - DNA, 25 bp, Homo sapien
taagctgtgtcggttatttgaggtc

SEQ ID NO: 218293 - DNA, 25 bp, Homo sapien
gtctacgggccacgtcagttatttg

SEQ ID NO: 218294 - DNA, 25 bp, Homo sapien
ccgcgtcagttatttggggtctata

SEQ ID NO: 218295 - DNA, 25 bp, Homo sapien
cgctccgcggatccaggttgaaatt

SEQ ID NO: 218296 - DNA, 25 bp, Homo sapien
tcctggaatccgaccgtgagcattt

SEQ ID NO: 218297 - DNA, 25 bp, Homo sapien
ctcccgctgtgcaaaggaacgcagg

SEQ ID NO: 218298 - DNA, 25 bp, Homo sapien
tttcccagcttttcccacgattgga

SEQ ID NO: 218299 - DNA, 25 bp, Homo sapien
cacgattggagccaagagaggtccc

SEQ ID NO: 218300 - DNA, 25 bp, Homo sapien
cggggatctcagttgggcaattgta

SEQ ID NO: 218301 - DNA, 25 bp, Homo sapien
gctcaggacactgacttcaagatga

SEQ ID NO: 218302 - DNA, 25 bp, Homo sapien
gtttgccaattaccagcgccacctg

SEQ ID NO: 218303 - DNA, 25 bp, Homo sapien
gtcccgttagtgagaccgagccatc

SEQ ID NO: 218304 - DNA, 25 bp, Homo sapien
cagcgtggcgtgttgcacatttaac

SEQ ID NO: 218305 - DNA, 25 bp, Homo sapien
agcgcgtggggtgctttttctaaag

SEQ ID NO: 218306 - DNA, 25 bp, Homo sapien
taaccgtaagccgtgaacatgagcg

SEQ ID NO: 218307 - DNA, 25 bp, Homo sapien
cgccaacggtaacgccatctttcta

SEQ ID NO: 218308 - DNA, 25 bp, Homo sapien
gcgaagccagtaccagcgtttcacc

SEQ ID NO: 218309 - DNA, 25 bp, Homo sapien
cccgccatttcggaatcagaggata

SEQ ID NO: 218310 - DNA, 25 bp, Homo sapien
tctggtggttgagatcccgccattt

SEQ ID NO: 218311 - DNA, 25 bp, Homo sapien
ttttgagtcagaaggtcgcagtggt

SEQ ID NO: 218312 - DNA, 25 bp, Homo sapien
tcgtctcagtgccaaaggcatcctc

SEQ ID NO: 218313 - DNA, 25 bp, Homo sapien
tgccaaaggcatcctccgatgactc

SEQ ID NO: 218314 - DNA, 25 bp, Homo sapien
tcctccgatgactcggccgaagatg

SEQ ID NO: 218315 - DNA, 25 bp, Homo sapien
actcggccgaagatgagctcagtcc

SEQ ID NO: 218316 - DNA, 25 bp, Homo sapien
ccgaagatgagctcagtccgcagcc

SEQ ID NO: 218317 - DNA, 25 bp, Homo sapien
tcacgtctccttttgagtcagaagg

SEQ ID NO: 218318 - DNA, 25 bp, Homo sapien
ggggcctcacgtctccttttgagtc

SEQ ID NO: 218319 - DNA, 25 bp, Homo sapien
gctcaccgtcgacgttgtaaacctg

SEQ ID NO: 218320 - DNA, 25 bp, Homo sapien
acgttgcgagggaagcgttttcaca

SEQ ID NO: 218321 - DNA, 25 bp, Homo sapien
acgctcgctgtcaacgtaaacctga

SEQ ID NO: 218322 - DNA, 25 bp, Homo sapien
acgctcgctgtcgacgtaaacctga

SEQ ID NO: 218323 - DNA, 25 bp, Homo sapien
acgctcactgttgacgtaaacctga

SEQ ID NO: 218324 - DNA, 25 bp, Homo sapien
cgcgctcactgtcgacgttgtaaac

SEQ ID NO: 218325 - DNA, 25 bp, Homo sapien
acgctgtcgacataaacctgaggga

SEQ ID NO: 218326 - DNA, 25 bp, Homo sapien
ctcactgtcgacgttgtaaacctga

SEQ ID NO: 218327 - DNA, 25 bp, Homo sapien
agccgtgttcttgacgttctccagc

SEQ ID NO: 218328 - DNA, 25 bp, Homo sapien
tgttcttgacgttctccagccagca

SEQ ID NO: 218329 - DNA, 25 bp, Homo sapien
ggcaagcagcccgtgcgtcccgatg

SEQ ID NO: 218330 - DNA, 25 bp, Homo sapien
tgtctgagccgtgttcttgacgttc

SEQ ID NO: 218331 - DNA, 25 bp, Homo sapien
aagaatccaagtggctggagagatg

SEQ ID NO: 218332 - DNA, 25 bp, Homo sapien
cggctctcgggcatagccggccttg

SEQ ID NO: 218333 - DNA, 25 bp, Homo sapien
tcgccaccaccatcctaggtcagga

SEQ ID NO: 218334 - DNA, 25 bp, Homo sapien
tgggtcgcgtgtcccagagccctgt

SEQ ID NO: 218335 - DNA, 25 bp, Homo sapien
tcactccggcgtgacctggttcctg

SEQ ID NO: 218336 - DNA, 25 bp, Homo sapien
gtgtcattccggcatgacctggttc

SEQ ID NO: 218337 - DNA, 25 bp, Homo sapien
cgtgacctggtcctggggtgtcact

SEQ ID NO: 218338 - DNA, 25 bp, Homo sapien
tgtcactccggcgtgacctggtcct

SEQ ID NO: 218339 - DNA, 25 bp, Homo sapien
tgacctggttcctggggtgtcattc

SEQ ID NO: 218340 - DNA, 25 bp, Homo sapien
tccagcgtgacctggttcctggggt

SEQ ID NO: 218341 - DNA, 25 bp, Homo sapien
tgtcactccggcgtgacctggttcc

SEQ ID NO: 218342 - DNA, 25 bp, Homo sapien
ctggggtgtcactccggcgtgacct

SEQ ID NO: 218343 - DNA, 25 bp, Homo sapien
gcgaagtcccgcaaaagccagaggc

SEQ ID NO: 218344 - DNA, 25 bp, Homo sapien
cgcagccggacaatgagggcgactc

SEQ ID NO: 218345 - DNA, 25 bp, Homo sapien
cactgctcgcgtagatggcgctcct

SEQ ID NO: 218346 - DNA, 25 bp, Homo sapien
taaagcctaagcctgcaaagagcgg

SEQ ID NO: 218347 - DNA, 25 bp, Homo sapien
gtggccgagacacccactccgaggt

SEQ ID NO: 218348 - DNA, 25 bp, Homo sapien
cactccgaggtggatcaggatgcgc

SEQ ID NO: 218349 - DNA, 25 bp, Homo sapien
gcgactcgggagagctctttctcca

SEQ ID NO: 218350 - DNA, 25 bp, Homo sapien
gcggcgacacacagcagcaagacca

SEQ ID NO: 218351 - DNA, 25 bp, Homo sapien
ctgtaacggtcaagcgagagcctga

SEQ ID NO: 218352 - DNA, 25 bp, Homo sapien
ccgtgcggctctgtaaacacatcta

SEQ ID NO: 218353 - DNA, 25 bp, Homo sapien
ttagccgaggtgacgagcacgttac

SEQ ID NO: 218354 - DNA, 25 bp, Homo sapien
gcctgagtcccgtgaatggtttgta

SEQ ID NO: 218355 - DNA, 25 bp, Homo sapien
ggggtctaaggctcacattggtgtc

SEQ ID NO: 218356 - DNA, 25 bp, Homo sapien
gggtgcgtcctcctgatataaagtg

SEQ ID NO: 218357 - DNA, 25 bp, Homo sapien
cctgaagagttggaccagttgtacc

SEQ ID NO: 218358 - DNA, 25 bp, Homo sapien
acatctaaatgcagtggcggccttg

SEQ ID NO: 218359 - DNA, 25 bp, Homo sapien
gtgtgccgccatccaacgtcgttac

SEQ ID NO: 218360 - DNA, 25 bp, Homo sapien
cgagaaaactcgctgccacctggtc

SEQ ID NO: 218361 - DNA, 25 bp, Homo sapien
gctcccttcgtggaaagtcttacta

SEQ ID NO: 218362 - DNA, 25 bp, Homo sapien
cccggctgaggatgattgaaagagc

SEQ ID NO: 218363 - DNA, 25 bp, Homo sapien
gcggactcagccgtgcaaatcattc

SEQ ID NO: 218364 - DNA, 25 bp, Homo sapien
ggctcagacgtcgactcacgcgttt

SEQ ID NO: 218365 - DNA, 25 bp, Homo sapien
caaatcattcatcggggtcagtgcc

SEQ ID NO: 218366 - DNA, 25 bp, Homo sapien
cacgcgtttcagttcctctcgagaa

SEQ ID NO: 218367 - DNA, 25 bp, Homo sapien
ctaaggcgttcatgggtgtgtcact

SEQ ID NO: 218368 - DNA, 25 bp, Homo sapien
gcgtgtgtgcgatgcctttgtcatc

SEQ ID NO: 218369 - DNA, 25 bp, Homo sapien
tgtcatcttgtgtaggcaagccgtg

SEQ ID NO: 218370 - DNA, 25 bp, Homo sapien
gtaggcaggccgtgaacagtactaa

SEQ ID NO: 218371 - DNA, 25 bp, Homo sapien
agctgtgaaccgtagtaaggtgtcc

SEQ ID NO: 218372 - DNA, 25 bp, Homo sapien
taaggtgtccgcaagtgtcactgta

SEQ ID NO: 218373 - DNA, 25 bp, Homo sapien
cgggcaagccgtgaacagtagtaag

SEQ ID NO: 218374 - DNA, 25 bp, Homo sapien
ttcgcgagtcattgtaacgtaggca

SEQ ID NO: 218375 - DNA, 25 bp, Homo sapien
cccgcggtgtctgtcagggtgccct

SEQ ID NO: 218376 - DNA, 25 bp, Homo sapien
caattacaggaacctaatggccttc

SEQ ID NO: 218377 - DNA, 25 bp, Homo sapien
agagtccaccaacggcaattacagg

SEQ ID NO: 218378 - DNA, 25 bp, Homo sapien
cccgctgattcgatttagagctaac

SEQ ID NO: 218379 - DNA, 25 bp, Homo sapien
tggaagtgtcgtgttcccagccagg

SEQ ID NO: 218380 - DNA, 25 bp, Homo sapien
catcgttcgccggtcttgtcgctgc

SEQ ID NO: 218381 - DNA, 25 bp, Homo sapien
gggcatcctgctccggggcatcgtt

SEQ ID NO: 218382 - DNA, 25 bp, Homo sapien
gatttagagctaacgagagtccacc

SEQ ID NO: 218383 - DNA, 25 bp, Homo sapien
cgcggaagcagcaaatccggccttg

SEQ ID NO: 218384 - DNA, 25 bp, Homo sapien
accgggcagaaaaagctcagagctt

SEQ ID NO: 218385 - DNA, 25 bp, Homo sapien
tcactgagttctctcgggccacgca

SEQ ID NO: 218386 - DNA, 25 bp, Homo sapien
aaatccggccttgcgctggctgcag

SEQ ID NO: 218387 - DNA, 25 bp, Homo sapien
cgtgtcctcagccaaaccgggcaga

SEQ ID NO: 218388 - DNA, 25 bp, Homo sapien
gctgcagtgctcagtctccggcgag

SEQ ID NO: 218389 - DNA, 25 bp, Homo sapien
agatgctcacccgtggcgtgtcctc

SEQ ID NO: 218390 - DNA, 25 bp, Homo sapien
cctaatggccttcttcactgagttc

SEQ ID NO: 218391 - DNA, 25 bp, Homo sapien
ccacctggctcatgtgcctataaga

SEQ ID NO: 218392 - DNA, 25 bp, Homo sapien
ccgtttgaacagtggagcctgcaca

SEQ ID NO: 218393 - DNA, 25 bp, Homo sapien
aggaccaggcttgaggatctttccc

SEQ ID NO: 218394 - DNA, 25 bp, Homo sapien
ccgggtcagcacacggctttctcaa

SEQ ID NO: 218395 - DNA, 25 bp, Homo sapien
gaacgctcggctctcaataaaaagg

SEQ ID NO: 218396 - DNA, 25 bp, Homo sapien
gggagttgtatctgccatgttttta

SEQ ID NO: 218397 - DNA, 25 bp, Homo sapien
gctgacggccaccaagtccactgga

SEQ ID NO: 218398 - DNA, 25 bp, Homo sapien
aacggtatcactttcgaacgctcgg

SEQ ID NO: 218399 - DNA, 25 bp, Homo sapien
cctccggagggactcggtgtgtctc

SEQ ID NO: 218400 - DNA, 25 bp, Homo sapien
catcaggcgacagccttctcgaagc

SEQ ID NO: 218401 - DNA, 25 bp, Homo sapien
gcgttgctgcctctgcagatgcctc

SEQ ID NO: 218402 - DNA, 25 bp, Homo sapien
tgacgtgtcccggtggctctcacag

SEQ ID NO: 218403 - DNA, 25 bp, Homo sapien
actcggtgtgtctcggtgttgattt

SEQ ID NO: 218404 - DNA, 25 bp, Homo sapien
ctcggtgttgatttcagaacagggg

SEQ ID NO: 218405 - DNA, 25 bp, Homo sapien
ttcagaacaggggagatgctgacgt

SEQ ID NO: 218406 - DNA, 25 bp, Homo sapien
cgagtggcagctccgacatcctgct

SEQ ID NO: 218407 - DNA, 25 bp, Homo sapien
gacagctctcttgaggtcggccctc

SEQ ID NO: 218408 - DNA, 25 bp, Homo sapien
cggcctgtcccacgaacacgatgga

SEQ ID NO: 218409 - DNA, 25 bp, Homo sapien
agggttgtccatcccgctctctgtc

SEQ ID NO: 218410 - DNA, 25 bp, Homo sapien
ctctgtcagctgctgccatggggca

SEQ ID NO: 218411 - DNA, 25 bp, Homo sapien
agcgtctgagaccttgtggaacaca

SEQ ID NO: 218412 - DNA, 25 bp, Homo sapien
tgtggaacacacttgacccggcgct

SEQ ID NO: 218413 - DNA, 25 bp, Homo sapien
tccttaggcctcgacagctctcttg

SEQ ID NO: 218414 - DNA, 25 bp, Homo sapien
cgaacacgatggagacctcagacgc

SEQ ID NO: 218415 - DNA, 25 bp, Homo sapien
acaagtcaggtcctgcgtgccagtc

SEQ ID NO: 218416 - DNA, 25 bp, Homo sapien
gccgtgcgcactctgggacaagtca

SEQ ID NO: 218417 - DNA, 25 bp, Homo sapien
ctttctctctgcgttgtgccgaggc

SEQ ID NO: 218418 - DNA, 25 bp, Homo sapien
gcccgagtgtcacggaaagtgcctc

SEQ ID NO: 218419 - DNA, 25 bp, Homo sapien
ggccctgtcgttatcctccttagtg

SEQ ID NO: 218420 - DNA, 25 bp, Homo sapien
aaagtgcctctggtgaggagctgcc

SEQ ID NO: 218421 - DNA, 25 bp, Homo sapien
ctgcgtgccagtccgggagcagcct

SEQ ID NO: 218422 - DNA, 25 bp, Homo sapien
cttagtgtttgtgaagagtcacacg

SEQ ID NO: 218423 - DNA, 25 bp, Homo sapien
gctcccgcagaaggaacggcctgta

SEQ ID NO: 218424 - DNA, 25 bp, Homo sapien
cgtctgtgaaatgaacctcgtgttg

SEQ ID NO: 218425 - DNA, 25 bp, Homo sapien
ggcgtgtacttggatcgtctgtgaa

SEQ ID NO: 218426 - DNA, 25 bp, Homo sapien
aagatgccgctttgttctcagagtg

SEQ ID NO: 218427 - DNA, 25 bp, Homo sapien
cgtagtctgcgagtggttcatgata

SEQ ID NO: 218428 - DNA, 25 bp, Homo sapien
gtgcagcctttctcaggggactgtc

SEQ ID NO: 218429 - DNA, 25 bp, Homo sapien
gcacccggcactgtaggagtcacgt

SEQ ID NO: 218430 - DNA, 25 bp, Homo sapien
aatcgcgtctcttgtgtctcactca

SEQ ID NO: 218431 - DNA, 25 bp, Homo sapien
tgggtttccgccaggacctaaatgc

SEQ ID NO: 218432 - DNA, 25 bp, Homo sapien
cgtcggtgctgagacgaaatcgcgc

SEQ ID NO: 218433 - DNA, 25 bp, Homo sapien
tagagaaaagagtcttggtgaggac

SEQ ID NO: 218434 - DNA, 25 bp, Homo sapien
acgcgttcattttacttcacatata

SEQ ID NO: 218435 - DNA, 25 bp, Homo sapien
agatgacacgcgttcattttacttc

SEQ ID NO: 218436 - DNA, 25 bp, Homo sapien
gttgccgcgacagtgcccacagagc

SEQ ID NO: 218437 - DNA, 25 bp, Homo sapien
tccgccaggacctaaatgcagtgtc

SEQ ID NO: 218438 - DNA, 25 bp, Homo sapien
atgcagtgtctgagttgccgcgaca

SEQ ID NO: 218439 - DNA, 25 bp, Homo sapien
gccgctggagttcggacttctgcaa

SEQ ID NO: 218440 - DNA, 25 bp, Homo sapien
gacttgggacttgcctggcgacttt

SEQ ID NO: 218441 - DNA, 25 bp, Homo sapien
tttggccggacttttgctaactgcg

SEQ ID NO: 218442 - DNA, 25 bp, Homo sapien
tagcgctctgctgtttacccgtctc

SEQ ID NO: 218443 - DNA, 25 bp, Homo sapien
gacttctgcaactgttggcactttg

SEQ ID NO: 218444 - DNA, 25 bp, Homo sapien
cggcgagctcagcaaccggaaccga

SEQ ID NO: 218445 - DNA, 25 bp, Homo sapien
caccgccagtcagtcggggagcaag

SEQ ID NO: 218446 - DNA, 25 bp, Homo sapien
acagctccctggtggtagagcccta

SEQ ID NO: 218447 - DNA, 25 bp, Homo sapien
aaggcgtccctcactggccagttct

SEQ ID NO: 218448 - DNA, 25 bp, Homo sapien
agcacgatgtctacctggcattcaa

SEQ ID NO: 218449 - DNA, 25 bp, Homo sapien
tggcattcaaggtaagtcatcaagc

SEQ ID NO: 218450 - DNA, 25 bp, Homo sapien
gccagttctgacattggtcccgggg

SEQ ID NO: 218451 - DNA, 25 bp, Homo sapien
ctcaacgcaacaaaaaggtgatttc

SEQ ID NO: 218452 - DNA, 25 bp, Homo sapien
tttgctgccggcagccatcagcatc

SEQ ID NO: 218453 - DNA, 25 bp, Homo sapien
ggggctttatttcgactcaggcaca

SEQ ID NO: 218454 - DNA, 25 bp, Homo sapien
ggcaggaccacgagacgtccgctga

SEQ ID NO: 218455 - DNA, 25 bp, Homo sapien
ggaaggcaggcgacaaagcctcaca

SEQ ID NO: 218456 - DNA, 25 bp, Homo sapien
ggcaggtgacaaagcctcatagacc

SEQ ID NO: 218457 - DNA, 25 bp, Homo sapien
caggaaggcaggtgacaaagcctca

SEQ ID NO: 218458 - DNA, 25 bp, Homo sapien
ggaaggcaggtgacaaagcctcata

SEQ ID NO: 218459 - DNA, 25 bp, Homo sapien
gcaggaaggcaggtgacaaagcctc

SEQ ID NO: 218460 - DNA, 25 bp, Homo sapien
ggaaggcaggtgacaaagcctcaca

SEQ ID NO: 218461 - DNA, 25 bp, Homo sapien
ggcaggcgacaaagcctcacagacc

SEQ ID NO: 218462 - DNA, 25 bp, Homo sapien
gggaaggcaggtgacaaagcctcac

SEQ ID NO: 218463 - DNA, 25 bp, Homo sapien
cttgacttggccgtcaggcgtcgcg

SEQ ID NO: 218464 - DNA, 25 bp, Homo sapien
gctctgggatgggagtcgttttacc

SEQ ID NO: 218465 - DNA, 25 bp, Homo sapien
tgggatgggagtcgttttacccatg

SEQ ID NO: 218466 - DNA, 25 bp, Homo sapien
cctgcagatcctgaggctccgggag

SEQ ID NO: 218467 - DNA, 25 bp, Homo sapien
gaggccatgcccgtgactcaatggg

SEQ ID NO: 218468 - DNA, 25 bp, Homo sapien
gcccgtgactcaatggggaagaaca

SEQ ID NO: 218469 - DNA, 25 bp, Homo sapien
ctttggggacttgacttggccgtca

SEQ ID NO: 218470 - DNA, 25 bp, Homo sapien
ggactgccggcgtctgaagccctct

SEQ ID NO: 218471 - DNA, 25 bp, Homo sapien
caccaccaccgcagttgccacgacc

SEQ ID NO: 218472 - DNA, 25 bp, Homo sapien
cagacgcccggatgcggaggaccca

SEQ ID NO: 218473 - DNA, 25 bp, Homo sapien
gccaacttttgccatcccgggagcc

SEQ ID NO: 218474 - DNA, 25 bp, Homo sapien
atcccgggagccatagcggcagaga

SEQ ID NO: 218475 - DNA, 25 bp, Homo sapien
tggagtctcagctacctggcgcgac

SEQ ID NO: 218476 - DNA, 25 bp, Homo sapien
ggctgcggacagacccgatgcgcca

SEQ ID NO: 218477 - DNA, 25 bp, Homo sapien
cccatggaatcgctggcgcctccgc

SEQ ID NO: 218478 - DNA, 25 bp, Homo sapien
ctctgctttggcagctgtcggggct

SEQ ID NO: 218479 - DNA, 25 bp, Homo sapien
tgctggaacttcaaacctcggtgtg

SEQ ID NO: 218480 - DNA, 25 bp, Homo sapien
tttggcgatgttggtgctggaactt

SEQ ID NO: 218481 - DNA, 25 bp, Homo sapien
gttctgccttaagctgacgttttgg

SEQ ID NO: 218482 - DNA, 25 bp, Homo sapien
gttggcctctttgccgttctgcctt

SEQ ID NO: 218483 - DNA, 25 bp, Homo sapien
gccaccgcggattgttggcctcttt

SEQ ID NO: 218484 - DNA, 25 bp, Homo sapien
ggctgattgtggcacgcgtgccttc

SEQ ID NO: 218485 - DNA, 25 bp, Homo sapien
gcaccctgaggacgcgctggctgat

SEQ ID NO: 218486 - DNA, 25 bp, Homo sapien
gcctgaggctaaatgctgcaaaaca

SEQ ID NO: 218487 - DNA, 25 bp, Homo sapien
cccgacgcatgtgtggggctctgga

SEQ ID NO: 218488 - DNA, 25 bp, Homo sapien
atcatggccgcgttgcagacgaccc

SEQ ID NO: 218489 - DNA, 25 bp, Homo sapien
gactggttatcatggccgcgttgca

SEQ ID NO: 218490 - DNA, 25 bp, Homo sapien
ttcatggactggttatcatggccgc

SEQ ID NO: 218491 - DNA, 25 bp, Homo sapien
gtccagcagcaaacgtgcacctcat

SEQ ID NO: 218492 - DNA, 25 bp, Homo sapien
gggacgccttcatggactggttatc

SEQ ID NO: 218493 - DNA, 25 bp, Homo sapien
acactgagccgcgtctgcagcgaag

SEQ ID NO: 218494 - DNA, 25 bp, Homo sapien
acgccttcatggactggttatcatg

SEQ ID NO: 218495 - DNA, 25 bp, Homo sapien
ggaaaagacctttcctgtctgctct

SEQ ID NO: 218496 - DNA, 25 bp, Homo sapien
ttcctgtctgctctgccgtggccga

SEQ ID NO: 218497 - DNA, 25 bp, Homo sapien
cctgtctgctctgccgtggccgatg

SEQ ID NO: 218498 - DNA, 25 bp, Homo sapien
gggtgtagcgatttgcagtgcgttt

SEQ ID NO: 218499 - DNA, 25 bp, Homo sapien
gaaaagacctttcctgtctgctctg

SEQ ID NO: 218500 - DNA, 25 bp, Homo sapien
tttcctgtctgctctgccgtggccg

SEQ ID NO: 218501 - DNA, 25 bp, Homo sapien
ggtgtagcgatttgcagtgcgtttt

SEQ ID NO: 218502 - DNA, 25 bp, Homo sapien
cgggaaaagacctttcctgtctgct

SEQ ID NO: 218503 - DNA, 25 bp, Homo sapien
tgagaagacacaatacgaggcctgc

SEQ ID NO: 218504 - DNA, 25 bp, Homo sapien
aatacgaggcctgccgtccgaacgc

SEQ ID NO: 218505 - DNA, 25 bp, Homo sapien
ctgccgtccgaacgcggaccctgca

SEQ ID NO: 218506 - DNA, 25 bp, Homo sapien
gccgtgaacacaaggctgagtttgc

SEQ ID NO: 218507 - DNA, 25 bp, Homo sapien
cacaaggctgagtttgcgcctctga

SEQ ID NO: 218508 - DNA, 25 bp, Homo sapien
tgcgcctctgatttgcgccacgtga

SEQ ID NO: 218509 - DNA, 25 bp, Homo sapien
ttgctttgagtctgcgtgcacggtg

SEQ ID NO: 218510 - DNA, 25 bp, Homo sapien
catggggcggtgagaagacacaata

SEQ ID NO: 218511 - DNA, 25 bp, Homo sapien
ccagcgctggaaactgcgtctcctg

SEQ ID NO: 218512 - DNA, 25 bp, Homo sapien
atttcccaggagagtcgcacgtctg

SEQ ID NO: 218513 - DNA, 25 bp, Homo sapien
tgtggcctgtcgagaacacagtgtc

SEQ ID NO: 218514 - DNA, 25 bp, Homo sapien
tccagctgcgttacttggagaagca

SEQ ID NO: 218515 - DNA, 25 bp, Homo sapien
tggtctcccaggcacgcatggccat

SEQ ID NO: 218516 - DNA, 25 bp, Homo sapien
atgtgcacacagctccgtggccagc

SEQ ID NO: 218517 - DNA, 25 bp, Homo sapien
ccacgacgtggccatgtgcacacag

SEQ ID NO: 218518 - DNA, 25 bp, Homo sapien
cgctcactgtgtggcctgtcgagaa

SEQ ID NO: 218519 - DNA, 25 bp, Homo sapien
gcgcggacaagcagcttcccagagg

SEQ ID NO: 218520 - DNA, 25 bp, Homo sapien
tggccgcgcctggaatcggcctcaa

SEQ ID NO: 218521 - DNA, 25 bp, Homo sapien
aggaatccgccgtcatctggtcccg

SEQ ID NO: 218522 - DNA, 25 bp, Homo sapien
actcacggacctgaggccctgggag

SEQ ID NO: 218523 - DNA, 25 bp, Homo sapien
cggctgcctgtgactcacggacctg

SEQ ID NO: 218524 - DNA, 25 bp, Homo sapien
tttgactttccctgaacaccggctg

SEQ ID NO: 218525 - DNA, 25 bp, Homo sapien
caggctctgagcgtttgtttcatgg

SEQ ID NO: 218526 - DNA, 25 bp, Homo sapien
aggcccttcgcgatttggccgcttc

SEQ ID NO: 218527 - DNA, 25 bp, Homo sapien
gccgctgtccgagcgttcagtctaa

SEQ ID NO: 218528 - DNA, 25 bp, Homo sapien
ttaaggactctgatggacagacggc

SEQ ID NO: 218529 - DNA, 25 bp, Homo sapien
cagcctgtgtttaaggactctgatg

SEQ ID NO: 218530 - DNA, 25 bp, Homo sapien
cgagagcagcctgtgtttaaggact

SEQ ID NO: 218531 - DNA, 25 bp, Homo sapien
acagacggcggagtggacgtcccac

SEQ ID NO: 218532 - DNA, 25 bp, Homo sapien
cgttcagtctaaccgatctcgcttc

SEQ ID NO: 218533 - DNA, 25 bp, Homo sapien
gtggacgtcccaccctcacgaggga

SEQ ID NO: 218534 - DNA, 25 bp, Homo sapien
ctccagaatctgcaccgagagcagc

SEQ ID NO: 218535 - DNA, 25 bp, Homo sapien
ggccttgcccagcacgcattctaga

SEQ ID NO: 218536 - DNA, 25 bp, Homo sapien
catccgggcggtgcgaagtcagcac

SEQ ID NO: 218537 - DNA, 25 bp, Homo sapien
agtcagcaccgtgccgagcagttga

SEQ ID NO: 218538 - DNA, 25 bp, Homo sapien
gcagttgagagcagacggtgttttc

SEQ ID NO: 218539 - DNA, 25 bp, Homo sapien
cacgcattctagaaggaagcggccc

SEQ ID NO: 218540 - DNA, 25 bp, Homo sapien
agcgcggccaaagttggaagccctg

SEQ ID NO: 218541 - DNA, 25 bp, Homo sapien
tttcattgttccctcgcttcgctgg

SEQ ID NO: 218542 - DNA, 25 bp, Homo sapien
agagcagacggtgttttcttttcat

SEQ ID NO: 218543 - DNA, 25 bp, Homo sapien
cctgtgctccgcgacagggatggag

SEQ ID NO: 218544 - DNA, 25 bp, Homo sapien
atgagaatgaagagacagcggccga

SEQ ID NO: 218545 - DNA, 25 bp, Homo sapien
agacagcggccgagacagtggctcc

SEQ ID NO: 218546 - DNA, 25 bp, Homo sapien
tggagctactcaatcaaatccaaat

SEQ ID NO: 218547 - DNA, 25 bp, Homo sapien
gtggctcctgatcactccccgggaa

SEQ ID NO: 218548 - DNA, 25 bp, Homo sapien
gacagggatggagctactcaatcaa

SEQ ID NO: 218549 - DNA, 25 bp, Homo sapien
gagacagtggctcctgatcactccc

SEQ ID NO: 218550 - DNA, 25 bp, Homo sapien
agggatggagctactcaatcaaatc

SEQ ID NO: 218551 - DNA, 25 bp, Homo sapien
ttgtcccacgcagaagaacgaggcc

SEQ ID NO: 218552 - DNA, 25 bp, Homo sapien
ctggctctgagcaagccgagccttc

SEQ ID NO: 218553 - DNA, 25 bp, Homo sapien
ccacgtagagcagctcggagccgtc

SEQ ID NO: 218554 - DNA, 25 bp, Homo sapien
gggaataaactgtgcggcccacgta

SEQ ID NO: 218555 - DNA, 25 bp, Homo sapien
ccgcgggttcgaatctgctgtgaaa

SEQ ID NO: 218556 - DNA, 25 bp, Homo sapien
tgctcccgcaggaatttgtcccacg

SEQ ID NO: 218557 - DNA, 25 bp, Homo sapien
atcagctccgactttgcgcgctcga

SEQ ID NO: 218558 - DNA, 25 bp, Homo sapien
gctgtgaaatgtcaccggcgcgctc

SEQ ID NO: 218559 - DNA, 25 bp, Homo sapien
cgaagaggggccaacttcctccaag

SEQ ID NO: 218560 - DNA, 25 bp, Homo sapien
cccacgtcaggggagcgcagaccag

SEQ ID NO: 218561 - DNA, 25 bp, Homo sapien
accttactcgcggtggctttctgga

SEQ ID NO: 218562 - DNA, 25 bp, Homo sapien
gagtgccctcaccttactcgcggtg

SEQ ID NO: 218563 - DNA, 25 bp, Homo sapien
gcgtccaggaaccagactcgggccg

SEQ ID NO: 218564 - DNA, 25 bp, Homo sapien
ttccgcgggcatacgcgtccaggaa

SEQ ID NO: 218565 - DNA, 25 bp, Homo sapien
ttcccgcgggccaggaactgtgacg

SEQ ID NO: 218566 - DNA, 25 bp, Homo sapien
gcagaccagctgatcacccgcggaa

SEQ ID NO: 218567 - DNA, 25 bp, Homo sapien
ccggtgattagaaagcggcacgttc

SEQ ID NO: 218568 - DNA, 25 bp, Homo sapien
cagcacacgagccatctacgttttc

SEQ ID NO: 218569 - DNA, 25 bp, Homo sapien
tcagggctcgtgaccctctgttccg

SEQ ID NO: 218570 - DNA, 25 bp, Homo sapien
aaagcggcacgttctatcctcggcc

SEQ ID NO: 218571 - DNA, 25 bp, Homo sapien
ctcacgggccacagaatcacagatg

SEQ ID NO: 218572 - DNA, 25 bp, Homo sapien
cccacgcttctgaccggtgattaga

SEQ ID NO: 218573 - DNA, 25 bp, Homo sapien
agaatcacagatgcggtcctcacct

SEQ ID NO: 218574 - DNA, 25 bp, Homo sapien
gagcggccttctcctagacagcaca

SEQ ID NO: 218575 - DNA, 25 bp, Homo sapien
aggaacgcagttcttcacggccggc

SEQ ID NO: 218576 - DNA, 25 bp, Homo sapien
cgcgccaagaccgtcactgggactg

SEQ ID NO: 218577 - DNA, 25 bp, Homo sapien
atacgtagttccgagcgcgccaaga

SEQ ID NO: 218578 - DNA, 25 bp, Homo sapien
tgcgttgaacgctgggactcgtagt

SEQ ID NO: 218579 - DNA, 25 bp, Homo sapien
gtcccgcgacgttgcgactcacagt

SEQ ID NO: 218580 - DNA, 25 bp, Homo sapien
cgctcgtatttacacgcgcacgtac

SEQ ID NO: 218581 - DNA, 25 bp, Homo sapien
cggtaccgagaggaactacagcgtc

SEQ ID NO: 218582 - DNA, 25 bp, Homo sapien
gtgcatgccggaactcgtagtctcg

SEQ ID NO: 218583 - DNA, 25 bp, Homo sapien
agctcctagggacactgagtgccgg

SEQ ID NO: 218584 - DNA, 25 bp, Homo sapien
tgccgggcagcctcgtgtccgcggg

SEQ ID NO: 218585 - DNA, 25 bp, Homo sapien
acacctagggtcaggcgctgagtgc

SEQ ID NO: 218586 - DNA, 25 bp, Homo sapien
agggacactgagtgccgggcagcct

SEQ ID NO: 218587 - DNA, 25 bp, Homo sapien
ctcctagggacactgagtgccgggc

SEQ ID NO: 218588 - DNA, 25 bp, Homo sapien
tgggtggtctcatgttcgcagggtg

SEQ ID NO: 218589 - DNA, 25 bp, Homo sapien
tctcatgttcgcagggtggggcggt

SEQ ID NO: 218590 - DNA, 25 bp, Homo sapien
tcctagggacactgagtgccgggca

SEQ ID NO: 218591 - DNA, 25 bp, Homo sapien
gcaaacgtgtatcctctgtcccatg

SEQ ID NO: 218592 - DNA, 25 bp, Homo sapien
ggctgtacgcacacaccatcgcagg

SEQ ID NO: 218593 - DNA, 25 bp, Homo sapien
gagctgcacgtcttcaccttcggca

SEQ ID NO: 218594 - DNA, 25 bp, Homo sapien
tcctggagaagatcgccaagctgta

SEQ ID NO: 218595 - DNA, 25 bp, Homo sapien
tcaggccttttctcccgactgttgc

SEQ ID NO: 218596 - DNA, 25 bp, Homo sapien
tcagaacgcttgtctggggcacacg

SEQ ID NO: 218597 - DNA, 25 bp, Homo sapien
aaacgcatcctctgtcccacgtgga

SEQ ID NO: 218598 - DNA, 25 bp, Homo sapien
cacacgtgtgttctcaggatgcctg

SEQ ID NO: 218599 - DNA, 25 bp, Homo sapien
cgtggacgaagcaacgtctgtccca

SEQ ID NO: 218600 - DNA, 25 bp, Homo sapien
agcgaccgtctgttccacgtggacg

SEQ ID NO: 218601 - DNA, 25 bp, Homo sapien
ggacaaagtgggacagcgaccgtct

SEQ ID NO: 218602 - DNA, 25 bp, Homo sapien
ccttcatggacaaagcgaggggaca

SEQ ID NO: 218603 - DNA, 25 bp, Homo sapien
ggtgaccgtctgtccttcatggaca

SEQ ID NO: 218604 - DNA, 25 bp, Homo sapien
tgactgtcccatgtggatgcagtga

SEQ ID NO: 218605 - DNA, 25 bp, Homo sapien
gaccgtctgtcccacatggatgtag

SEQ ID NO: 218606 - DNA, 25 bp, Homo sapien
cgccacaggatggtgaccgtctgtc

SEQ ID NO: 218607 - DNA, 25 bp, Homo sapien
cctgtagaaggtagagactttcacc

SEQ ID NO: 218608 - DNA, 25 bp, Homo sapien
tcatccggggcttacagtcacggtg

SEQ ID NO: 218609 - DNA, 25 bp, Homo sapien
gtgccaggtcatccggggcttacag

SEQ ID NO: 218610 - DNA, 25 bp, Homo sapien
tcctccagaccgtggcttgggaaac

SEQ ID NO: 218611 - DNA, 25 bp, Homo sapien
ggagttgctgacttcctccagaccg

SEQ ID NO: 218612 - DNA, 25 bp, Homo sapien
ctttcaccagatgggtggggtcagc

SEQ ID NO: 218613 - DNA, 25 bp, Homo sapien
tgaaactaggggcattcctgtagaa

SEQ ID NO: 218614 - DNA, 25 bp, Homo sapien
tcagcgtggagttgctgacttcctc

SEQ ID NO: 218615 - DNA, 25 bp, Homo sapien
cagtgggctacacccgacaaacttc

SEQ ID NO: 218616 - DNA, 25 bp, Homo sapien
gggcactgacctggactttgactta

SEQ ID NO: 218617 - DNA, 25 bp, Homo sapien
tttgacttatccagcgacagcgaga

SEQ ID NO: 218618 - DNA, 25 bp, Homo sapien
ccgagtcacagaacagcgagctgtc

SEQ ID NO: 218619 - DNA, 25 bp, Homo sapien
agatcctggtccgtgtacacactga

SEQ ID NO: 218620 - DNA, 25 bp, Homo sapien
tccgcaagatcgtgccggagctcaa

SEQ ID NO: 218621 - DNA, 25 bp, Homo sapien
gctggcagacgtggccataattttc

SEQ ID NO: 218622 - DNA, 25 bp, Homo sapien
ggagcattaccacgccacggcgctg

SEQ ID NO: 218623 - DNA, 25 bp, Homo sapien
ctctcggctgatttcacggcccttg

SEQ ID NO: 218624 - DNA, 25 bp, Homo sapien
gctccctctggaaacgcgctctagt

SEQ ID NO: 218625 - DNA, 25 bp, Homo sapien
gatttcacggcccttgaggtcatgg

SEQ ID NO: 218626 - DNA, 25 bp, Homo sapien
gtgttttgtcttttacgattctgga

SEQ ID NO: 218627 - DNA, 25 bp, Homo sapien
tctggaaacgcgctctagttcctcc

SEQ ID NO: 218628 - DNA, 25 bp, Homo sapien
gcggcaaagcccagccggctttcgg

SEQ ID NO: 218629 - DNA, 25 bp, Homo sapien
acgattctggagagcagcgtgtgcc

SEQ ID NO: 218630 - DNA, 25 bp, Homo sapien
cccggttttctgtttcatagattgt

SEQ ID NO: 218631 - DNA, 25 bp, Homo sapien
ttgcctacggagaattttaagacta

SEQ ID NO: 218632 - DNA, 25 bp, Homo sapien
aggcctgcaagtccaccgtgggtaa

SEQ ID NO: 218633 - DNA, 25 bp, Homo sapien
gacaccttctgcgaggcctgcaagt

SEQ ID NO: 218634 - DNA, 25 bp, Homo sapien
gaccagcctgatggagcgcttcacc

SEQ ID NO: 218635 - DNA, 25 bp, Homo sapien
aggtcatcattatcggctcccgcgg

SEQ ID NO: 218636 - DNA, 25 bp, Homo sapien
ccggccgacttcaagttgcaggtca

SEQ ID NO: 218637 - DNA, 25 bp, Homo sapien
cttgtgttaactataaatgcgggtc

SEQ ID NO: 218638 - DNA, 25 bp, Homo sapien
tctcatcgagcctgggagtctttcg

SEQ ID NO: 218639 - DNA, 25 bp, Homo sapien
aagcgcgtgttcacagagggccgcc

SEQ ID NO: 218640 - DNA, 25 bp, Homo sapien
gcagcgttcacggtgttcacgggat

SEQ ID NO: 218641 - DNA, 25 bp, Homo sapien
atgggaagcgcagcgttcgtggggt

SEQ ID NO: 218642 - DNA, 25 bp, Homo sapien
tgggaagcctggcattcacggtgtt

SEQ ID NO: 218643 - DNA, 25 bp, Homo sapien
aagcctggcattcacggtgttcgtg

SEQ ID NO: 218644 - DNA, 25 bp, Homo sapien
agcctggcattcacggtgttcgtgg

SEQ ID NO: 218645 - DNA, 25 bp, Homo sapien
gtttgcggcgttcgtgggatgggaa

SEQ ID NO: 218646 - DNA, 25 bp, Homo sapien
aagcgtggcgttcacgggatggaaa

SEQ ID NO: 218647 - DNA, 25 bp, Homo sapien
caccgctgcggcttcacggacttag

SEQ ID NO: 218648 - DNA, 25 bp, Homo sapien
ctacgcgctgcgaggtaatcttgcg

SEQ ID NO: 218649 - DNA, 25 bp, Homo sapien
ctcgctcatttagggcgggagacat

SEQ ID NO: 218650 - DNA, 25 bp, Homo sapien
gctgcacagtcagaagaggacgttg

SEQ ID NO: 218651 - DNA, 25 bp, Homo sapien
tcacggacttagagcttgagggcgc

SEQ ID NO: 218652 - DNA, 25 bp, Homo sapien
ttttaaaacacagagcaagcgccag

SEQ ID NO: 218653 - DNA, 25 bp, Homo sapien
cagcccgtaacggtcgccagtgtga

SEQ ID NO: 218654 - DNA, 25 bp, Homo sapien
gggaaacacaaagccggctacgcgc

SEQ ID NO: 218655 - DNA, 25 bp, Homo sapien
tgtggatcctcacgctgcggcctca

SEQ ID NO: 218656 - DNA, 25 bp, Homo sapien
ctcagcagaggacaggtgtgcgttt

SEQ ID NO: 218657 - DNA, 25 bp, Homo sapien
tgcgtttggtgtgtttgtgcacaaa

SEQ ID NO: 218658 - DNA, 25 bp, Homo sapien
tttgtgcacaaacacccgcctgtct

SEQ ID NO: 218659 - DNA, 25 bp, Homo sapien
gctcacaaagagactcacacccatg

SEQ ID NO: 218660 - DNA, 25 bp, Homo sapien
ccctgcaggttcctgtgtgatcatg

SEQ ID NO: 218661 - DNA, 25 bp, Homo sapien
gcctctgcagctgcgttacctcgtt

SEQ ID NO: 218662 - DNA, 25 bp, Homo sapien
tcctgtgtgatcatggaactgcggg

SEQ ID NO: 218663 - DNA, 25 bp, Homo sapien
ccatgctggacataaagtgctcttc

SEQ ID NO: 218664 - DNA, 25 bp, Homo sapien
acttgagttcacctcccggcactgg

SEQ ID NO: 218665 - DNA, 25 bp, Homo sapien
ccactccgacgtgatccatgctgga

SEQ ID NO: 218666 - DNA, 25 bp, Homo sapien
gatccctcctgggaaacagcctgcg

SEQ ID NO: 218667 - DNA, 25 bp, Homo sapien
tcctctgtggccgtttctcgtacct

SEQ ID NO: 218668 - DNA, 25 bp, Homo sapien
gaagcggcttcacaccgagtctctg

SEQ ID NO: 218669 - DNA, 25 bp, Homo sapien
tgtgatttctgatcgaagcggcttc

SEQ ID NO: 218670 - DNA, 25 bp, Homo sapien
ccgccacatcgaggcactgacggta

SEQ ID NO: 218671 - DNA, 25 bp, Homo sapien
ggagaagcctgttgcggaggaacgg

SEQ ID NO: 218672 - DNA, 25 bp, Homo sapien
agcgacgacagcgacagcgagaaga

SEQ ID NO: 218673 - DNA, 25 bp, Homo sapien
gtggacgacatccttggagaaggca

SEQ ID NO: 218674 - DNA, 25 bp, Homo sapien
ggctgtttgtcaggtggacgacatc

SEQ ID NO: 218675 - DNA, 25 bp, Homo sapien
actcttggctgtttgtcaggtggac

SEQ ID NO: 218676 - DNA, 25 bp, Homo sapien
gtcgctgactcttggctgtttgtca

SEQ ID NO: 218677 - DNA, 25 bp, Homo sapien
ggaaggaggtctgtcgctgactctt

SEQ ID NO: 218678 - DNA, 25 bp, Homo sapien
tctgtcgctgactcttggctgtttg

SEQ ID NO: 218679 - DNA, 25 bp, Homo sapien
tgctttgcgcttccttcgccatgaa

SEQ ID NO: 218680 - DNA, 25 bp, Homo sapien
ttggccgcaacagcgcactctaaac

SEQ ID NO: 218681 - DNA, 25 bp, Homo sapien
tgttttcgggcgtttggccgcaaca

SEQ ID NO: 218682 - DNA, 25 bp, Homo sapien
tccttcgccatgaatgaggcctgtt

SEQ ID NO: 218683 - DNA, 25 bp, Homo sapien
agcaccgtggtttgctttgcgcttc

SEQ ID NO: 218684 - DNA, 25 bp, Homo sapien
aagagctgagcaccgtggtttgctt

SEQ ID NO: 218685 - DNA, 25 bp, Homo sapien
agccagcgtcctgcatgtcgagggt

SEQ ID NO: 218686 - DNA, 25 bp, Homo sapien
cgccatgaatgaggcctgttttcgg

SEQ ID NO: 218687 - DNA, 25 bp, Homo sapien
gtgggactctcatacccacggccgg

SEQ ID NO: 218688 - DNA, 25 bp, Homo sapien
ggtgggactctcatacccacggccg

SEQ ID NO: 218689 - DNA, 25 bp, Homo sapien
gacgggtgggactctcatacccacg

SEQ ID NO: 218690 - DNA, 25 bp, Homo sapien
gggacgggtgggactctcataccca

SEQ ID NO: 218691 - DNA, 25 bp, Homo sapien
cgggtgggactctcatacccacggc

SEQ ID NO: 218692 - DNA, 25 bp, Homo sapien
tgggactctcatacccacggccggg

SEQ ID NO: 218693 - DNA, 25 bp, Homo sapien
gggactctcatacccacggccggga

SEQ ID NO: 218694 - DNA, 25 bp, Homo sapien
gggtgggactctcatacccacggcc

SEQ ID NO: 218695 - DNA, 25 bp, Homo sapien
gcagcactggtcttcccttttgttc

SEQ ID NO: 218696 - DNA, 25 bp, Homo sapien
gacgtcatctggtgggttccttcca

SEQ ID NO: 218697 - DNA, 25 bp, Homo sapien
ccacgcttgtgtgaggcttcacctg

SEQ ID NO: 218698 - DNA, 25 bp, Homo sapien
tcacgccacgttccactccagggtg

SEQ ID NO: 218699 - DNA, 25 bp, Homo sapien
ggtgcactggggaaattatccgcca

SEQ ID NO: 218700 - DNA, 25 bp, Homo sapien
gaaattatccgccatgcgcagcgcc

SEQ ID NO: 218701 - DNA, 25 bp, Homo sapien
gttttttagtgacgtggcggcctca

SEQ ID NO: 218702 - DNA, 25 bp, Homo sapien
cctcacggtgagcagcactggtctt

SEQ ID NO: 218703 - DNA, 25 bp, Homo sapien
tgtggtcgagtgaacagagcatgca

SEQ ID NO: 218704 - DNA, 25 bp, Homo sapien
gcatgcagcattcaggaccagcgtg

SEQ ID NO: 218705 - DNA, 25 bp, Homo sapien
agcattcaggaccagcgtggccctg

SEQ ID NO: 218706 - DNA, 25 bp, Homo sapien
gtggccctgggtgttcgcctgttct

SEQ ID NO: 218707 - DNA, 25 bp, Homo sapien
tcgcctgttctgaccgtgtggtcga

SEQ ID NO: 218708 - DNA, 25 bp, Homo sapien
ctgaccgtgtggtcgagtgaacaga

SEQ ID NO: 218709 - DNA, 25 bp, Homo sapien
gccggaccgcatgcagcattcagga

SEQ ID NO: 218710 - DNA, 25 bp, Homo sapien
gccgtgctgcacaccttctccgtca

SEQ ID NO: 218711 - DNA, 25 bp, Homo sapien
gggcacagggcctgggtcctgtcct

SEQ ID NO: 218712 - DNA, 25 bp, Homo sapien
gtcctgctgcgtccatgtgggcgac

SEQ ID NO: 218713 - DNA, 25 bp, Homo sapien
gctgttgtttcaggcgtctggggac

SEQ ID NO: 218714 - DNA, 25 bp, Homo sapien
cccaggtcatcaggcaggcgatgcg

SEQ ID NO: 218715 - DNA, 25 bp, Homo sapien
catcaggcaggcgatgcgtccatga

SEQ ID NO: 218716 - DNA, 25 bp, Homo sapien
gatgcgtccatgagggaggtaagga

SEQ ID NO: 218717 - DNA, 25 bp, Homo sapien
cctgctgcgtccgtgagggaggtga

SEQ ID NO: 218718 - DNA, 25 bp, Homo sapien
cctgctgcgtccatgtgggcgacgt

SEQ ID NO: 218719 - DNA, 25 bp, Homo sapien
gtggtggctgtcctccgtttcccac

SEQ ID NO: 218720 - DNA, 25 bp, Homo sapien
cacttggcagcagcgtgccgcctga

SEQ ID NO: 218721 - DNA, 25 bp, Homo sapien
gcgcggcaggtcttcctgctttcca

SEQ ID NO: 218722 - DNA, 25 bp, Homo sapien
tgtccctggtgccagcacagaactg

SEQ ID NO: 218723 - DNA, 25 bp, Homo sapien
ctgaactccgcccttgagtcgtgcg

SEQ ID NO: 218724 - DNA, 25 bp, Homo sapien
tacagcgaatgactcgggcttcaga

SEQ ID NO: 218725 - DNA, 25 bp, Homo sapien
ggaaagctcagacccataacccagc

SEQ ID NO: 218726 - DNA, 25 bp, Homo sapien
actgggccttgtccagtatcactgg

SEQ ID NO: 218727 - DNA, 25 bp, Homo sapien
tgggctccaggccaagctcgcagag

SEQ ID NO: 218728 - DNA, 25 bp, Homo sapien
ggattttctgaaacctcagttcctc

SEQ ID NO: 218729 - DNA, 25 bp, Homo sapien
cctgtaagtgcccagccacgagggc

SEQ ID NO: 218730 - DNA, 25 bp, Homo sapien
gggctgagagattcgaactcctttg

SEQ ID NO: 218731 - DNA, 25 bp, Homo sapien
agagattcgaactcctttgctgccg

SEQ ID NO: 218732 - DNA, 25 bp, Homo sapien
ctttgctgccgcgaagaagggcctg

SEQ ID NO: 218733 - DNA, 25 bp, Homo sapien
ctgccgcgaagaagggcctgttccc

SEQ ID NO: 218734 - DNA, 25 bp, Homo sapien
cgatgcgcgggattttctgaaacct

SEQ ID NO: 218735 - DNA, 25 bp, Homo sapien
agcgtatccagcaccgtcctcagaa

SEQ ID NO: 218736 - DNA, 25 bp, Homo sapien
ccgggatgtttaatgtgtccgaaca

SEQ ID NO: 218737 - DNA, 25 bp, Homo sapien
aaggtcccgattgcaacgtgtcaga

SEQ ID NO: 218738 - DNA, 25 bp, Homo sapien
tgcagacgctgtaaggccaaaacga

SEQ ID NO: 218739 - DNA, 25 bp, Homo sapien
tcttctcgcctgttttcccggagtg

SEQ ID NO: 218740 - DNA, 25 bp, Homo sapien
gtgcagccgaatcgcttcgcaatta

SEQ ID NO: 218741 - DNA, 25 bp, Homo sapien
cccagattcacgtggatagtagtgc

SEQ ID NO: 218742 - DNA, 25 bp, Homo sapien
ggcaaacgccttcctggtcgatttc

SEQ ID NO: 218743 - DNA, 25 bp, Homo sapien
tttgcggcttggctgacttctgagt

SEQ ID NO: 218744 - DNA, 25 bp, Homo sapien
gatgctacagaaacgcgtgttccct

SEQ ID NO: 218745 - DNA, 25 bp, Homo sapien
tgcagatgctacagaaacgcgtgtt

SEQ ID NO: 218746 - DNA, 25 bp, Homo sapien
cggcatccgctgtatgcagatgcta

SEQ ID NO: 218747 - DNA, 25 bp, Homo sapien
ttcctgacggcatccgctgtatgca

SEQ ID NO: 218748 - DNA, 25 bp, Homo sapien
cgcagttcctgacggcatccgctgt

SEQ ID NO: 218749 - DNA, 25 bp, Homo sapien
acttctgagtcagcggctggggcat

SEQ ID NO: 218750 - DNA, 25 bp, Homo sapien
cttgtgctccgcaaggacgagcagg

SEQ ID NO: 218751 - DNA, 25 bp, Homo sapien
gggcttctcccacagacagcgtggc

SEQ ID NO: 218752 - DNA, 25 bp, Homo sapien
aatccatttcttcggaacactcggg

SEQ ID NO: 218753 - DNA, 25 bp, Homo sapien
cccgcttagaaacaatatggccagt

SEQ ID NO: 218754 - DNA, 25 bp, Homo sapien
aacatgcggctcacatccggacggc

SEQ ID NO: 218755 - DNA, 25 bp, Homo sapien
ctgcttccacccaggagattcgcga

SEQ ID NO: 218756 - DNA, 25 bp, Homo sapien
aggacccattccttctccacggtgg

SEQ ID NO: 218757 - DNA, 25 bp, Homo sapien
ggtctgccctgtgcgaatgacctcc

SEQ ID NO: 218758 - DNA, 25 bp, Homo sapien
ttccttcgcctttgctcctcatggg

SEQ ID NO: 218759 - DNA, 25 bp, Homo sapien
gtccttggtattccagaggccatga

SEQ ID NO: 218760 - DNA, 25 bp, Homo sapien
gaggaagcctcccatcgtaagcgcg

SEQ ID NO: 218761 - DNA, 25 bp, Homo sapien
ccggagctgtcctgcaagaatgaac

SEQ ID NO: 218762 - DNA, 25 bp, Homo sapien
gccgtagactggtgtggtcagacca

SEQ ID NO: 218763 - DNA, 25 bp, Homo sapien
gaggccatgaccagactctagtctc

SEQ ID NO: 218764 - DNA, 25 bp, Homo sapien
cagggacctcgtcttgtccttggta

SEQ ID NO: 218765 - DNA, 25 bp, Homo sapien
gaaagcagcccatccacggaccagg

SEQ ID NO: 218766 - DNA, 25 bp, Homo sapien
ttcctaaattgctcagaggtgcctc

SEQ ID NO: 218767 - DNA, 25 bp, Homo sapien
aaacgcgggcgagacatcagggacc

SEQ ID NO: 218768 - DNA, 25 bp, Homo sapien
gcgagacatcagggaccgggaaaca

SEQ ID NO: 218769 - DNA, 25 bp, Homo sapien
gtctgctgtcaaagccggttggcgc

SEQ ID NO: 218770 - DNA, 25 bp, Homo sapien
tcaaagccggttggcgctgagaaga

SEQ ID NO: 218771 - DNA, 25 bp, Homo sapien
ccgcacggacacagacgacactata

SEQ ID NO: 218772 - DNA, 25 bp, Homo sapien
ggaaacagaaggacgcgcgtttcga

SEQ ID NO: 218773 - DNA, 25 bp, Homo sapien
gcagctgcccagtgggccacaagcc

SEQ ID NO: 218774 - DNA, 25 bp, Homo sapien
gacgacactataaacgcgggcgaga

SEQ ID NO: 218775 - DNA, 25 bp, Homo sapien
tcgcggagtctggaccgcaggtaaa

SEQ ID NO: 218776 - DNA, 25 bp, Homo sapien
tccggcaggtgaactgggcccgctc

SEQ ID NO: 218777 - DNA, 25 bp, Homo sapien
tcactggggacgagaagggtccctc

SEQ ID NO: 218778 - DNA, 25 bp, Homo sapien
agcccgggtccggactgtggtcact

SEQ ID NO: 218779 - DNA, 25 bp, Homo sapien
tcccgcagccgcgaattctgcaaac

SEQ ID NO: 218780 - DNA, 25 bp, Homo sapien
gtctattcgcgctggtcctgcggga

SEQ ID NO: 218781 - DNA, 25 bp, Homo sapien
ctcctgtctgatggttccgcgcgca

SEQ ID NO: 218782 - DNA, 25 bp, Homo sapien
gaccgcaggtaaagttgagcgcgcc

SEQ ID NO: 218783 - DNA, 25 bp, Homo sapien
gctgtgccgacaggcatgagctctg

SEQ ID NO: 218784 - DNA, 25 bp, Homo sapien
acacgcagggcatccagggacggcc

SEQ ID NO: 218785 - DNA, 25 bp, Homo sapien
agggcatccagggacggccacctgt

SEQ ID NO: 218786 - DNA, 25 bp, Homo sapien
tccagggacggccacctgtgtctga

SEQ ID NO: 218787 - DNA, 25 bp, Homo sapien
agggacggccacctgtgtctgagta

SEQ ID NO: 218788 - DNA, 25 bp, Homo sapien
ctgtgtctgagtactgcgcgcctgt

SEQ ID NO: 218789 - DNA, 25 bp, Homo sapien
gtgtctgagtactgcgcgcctgtcc

SEQ ID NO: 218790 - DNA, 25 bp, Homo sapien
aacggagggctgtttgtcgtgggag

SEQ ID NO: 218791 - DNA, 25 bp, Homo sapien
tttaaaatcatggaaagagctgccc

SEQ ID NO: 218792 - DNA, 25 bp, Homo sapien
tacagacagctaaagggatcctttc

SEQ ID NO: 218793 - DNA, 25 bp, Homo sapien
ttagaagaccaggtggacgcggctc

SEQ ID NO: 218794 - DNA, 25 bp, Homo sapien
ccctggagcagtgaaggtcggctct

SEQ ID NO: 218795 - DNA, 25 bp, Homo sapien
ggccgctgcagcatcggccctagtg

SEQ ID NO: 218796 - DNA, 25 bp, Homo sapien
ggtctggctgtaacttcttcaccca

SEQ ID NO: 218797 - DNA, 25 bp, Homo sapien
ctaagcagacacttggctggctccc

SEQ ID NO: 218798 - DNA, 25 bp, Homo sapien
tcacccacagctaagcagacacttg

SEQ ID NO: 218799 - DNA, 25 bp, Homo sapien
cactgaccacactccacgttatggg

SEQ ID NO: 218800 - DNA, 25 bp, Homo sapien
cactccacgttatgggcccagagtc

SEQ ID NO: 218801 - DNA, 25 bp, Homo sapien
agctgccggggacacactgaccaca

SEQ ID NO: 218802 - DNA, 25 bp, Homo sapien
tcgctgaccacactccacgttatgg

SEQ ID NO: 218803 - DNA, 25 bp, Homo sapien
actgaccacactccacgttatgggc

SEQ ID NO: 218804 - DNA, 25 bp, Homo sapien
cgctgaccacactccacgttatggg

SEQ ID NO: 218805 - DNA, 25 bp, Homo sapien
gctgaccacactccacgttatgggc

SEQ ID NO: 218806 - DNA, 25 bp, Homo sapien
actccacgttatgggcccagagtcc

SEQ ID NO: 218807 - DNA, 25 bp, Homo sapien
tagttcggcgcgttacgtcattacg

SEQ ID NO: 218808 - DNA, 25 bp, Homo sapien
cggcgcgttacgtcattacatccag

SEQ ID NO: 218809 - DNA, 25 bp, Homo sapien
cagctcctcacggaaggttagttcg

SEQ ID NO: 218810 - DNA, 25 bp, Homo sapien
gcgcgttacgtcattacatccagtg

SEQ ID NO: 218811 - DNA, 25 bp, Homo sapien
tcggcgcgttacgtcattacgttca

SEQ ID NO: 218812 - DNA, 25 bp, Homo sapien
gagcagctcctcacggaaggttaga

SEQ ID NO: 218813 - DNA, 25 bp, Homo sapien
ttcggcgcgttacgtcattacgttc

SEQ ID NO: 218814 - DNA, 25 bp, Homo sapien
agcagctcctcacggaaggttagtt

SEQ ID NO: 218815 - DNA, 25 bp, Homo sapien
cgctgacacactgtgggcgacagga

SEQ ID NO: 218816 - DNA, 25 bp, Homo sapien
gtgaaaactgagtgagcagctcctc

SEQ ID NO: 218817 - DNA, 25 bp, Homo sapien
acgaagcttcacaactgagcgagca

SEQ ID NO: 218818 - DNA, 25 bp, Homo sapien
ctgctcccttctgaggcaggcagag

SEQ ID NO: 218819 - DNA, 25 bp, Homo sapien
aacccgggtagtcgagctgaaactg

SEQ ID NO: 218820 - DNA, 25 bp, Homo sapien
ggctgcagcttaagaggaagctctc

SEQ ID NO: 218821 - DNA, 25 bp, Homo sapien
ctttctttgaaacgctgtgtccagg

SEQ ID NO: 218822 - DNA, 25 bp, Homo sapien
gctgaaactgtgatctgaggcgcga

SEQ ID NO: 218823 - DNA, 25 bp, Homo sapien
ttccctgcatacagagccttcgtca

SEQ ID NO: 218824 - DNA, 25 bp, Homo sapien
cagagccttcgtcaggagggttccc

SEQ ID NO: 218825 - DNA, 25 bp, Homo sapien
tgccctgcgtacagagccttcgtca

SEQ ID NO: 218826 - DNA, 25 bp, Homo sapien
tacagagccttcgtcaggagcgtgc

SEQ ID NO: 218827 - DNA, 25 bp, Homo sapien
agagccttcgtcaggagcgtgccct

SEQ ID NO: 218828 - DNA, 25 bp, Homo sapien
gacagagccttcgtcaggagggttc

SEQ ID NO: 218829 - DNA, 25 bp, Homo sapien
acagagccttcgtcaggagggttcc

SEQ ID NO: 218830 - DNA, 25 bp, Homo sapien
agagccttcgtcaggagggttccct

SEQ ID NO: 218831 - DNA, 25 bp, Homo sapien
ggtaaacaaaccacgcgcgggctgc

SEQ ID NO: 218832 - DNA, 25 bp, Homo sapien
ttccgacgacctttgcgaatcttgc

SEQ ID NO: 218833 - DNA, 25 bp, Homo sapien
catggagcgggtgaagatgatcaac

SEQ ID NO: 218834 - DNA, 25 bp, Homo sapien
gatgatcaacgtgcagcgtctgctg

SEQ ID NO: 218835 - DNA, 25 bp, Homo sapien
ccctgaaacggcgtgtgcactacga

SEQ ID NO: 218836 - DNA, 25 bp, Homo sapien
tgctcgcggggagaggtaaacaaac

SEQ ID NO: 218837 - DNA, 25 bp, Homo sapien
agcccgagcgctactaatctttttc

SEQ ID NO: 218838 - DNA, 25 bp, Homo sapien
tgtgcactacgattcccggcagccg

SEQ ID NO: 218839 - DNA, 25 bp, Homo sapien
gcaagcacttccgttgaagcgttaa

SEQ ID NO: 218840 - DNA, 25 bp, Homo sapien
ggttttagcacgcagcaagcacttc

SEQ ID NO: 218841 - DNA, 25 bp, Homo sapien
ttcccgagagttcgccgggagcaca

SEQ ID NO: 218842 - DNA, 25 bp, Homo sapien
cacctcacagagagggaaactccga

SEQ ID NO: 218843 - DNA, 25 bp, Homo sapien
gtcacccagtgacagacagctcaga

SEQ ID NO: 218844 - DNA, 25 bp, Homo sapien
gcgtccgttccagctcagataagca

SEQ ID NO: 218845 - DNA, 25 bp, Homo sapien
cgccttcatccgatctggtgtttcc

SEQ ID NO: 218846 - DNA, 25 bp, Homo sapien
cggcctgaggtttggttttagcacg

SEQ ID NO: 218847 - DNA, 25 bp, Homo sapien
cccggctgttcccttggtgataact

SEQ ID NO: 218848 - DNA, 25 bp, Homo sapien
ccgccctgaaacatctggctctttg

SEQ ID NO: 218849 - DNA, 25 bp, Homo sapien
ggctctttggagtttgcgtcgattt

SEQ ID NO: 218850 - DNA, 25 bp, Homo sapien
ccgttccttttgcaggagccgggca

SEQ ID NO: 218851 - DNA, 25 bp, Homo sapien
acgtgagccgcgacgagttcttctt

SEQ ID NO: 218852 - DNA, 25 bp, Homo sapien
aagctcttcgcctgcgtgtccgtgt

SEQ ID NO: 218853 - DNA, 25 bp, Homo sapien
tctgcctgagcaccatgccggacat

SEQ ID NO: 218854 - DNA, 25 bp, Homo sapien
gcgtcgatttgtgaaagctccgttc

SEQ ID NO: 218855 - DNA, 25 bp, Homo sapien
cgtctgcgtcccgttggcctggacg

SEQ ID NO: 218856 - DNA, 25 bp, Homo sapien
ggctgacgtcttgcggcagcaagtc

SEQ ID NO: 218857 - DNA, 25 bp, Homo sapien
acgtcttgcggcagcaagtcgagtg

SEQ ID NO: 218858 - DNA, 25 bp, Homo sapien
tcgagtgggcggtgcaggaccagcc

SEQ ID NO: 218859 - DNA, 25 bp, Homo sapien
ctatgacgccttggcagagcctctg

SEQ ID NO: 218860 - DNA, 25 bp, Homo sapien
tcccgttggcctggacgtctgcggt

SEQ ID NO: 218861 - DNA, 25 bp, Homo sapien
ctgcgtcccgttggcctggacgtct

SEQ ID NO: 218862 - DNA, 25 bp, Homo sapien
cccgcgtctgggaggctcccacacc

SEQ ID NO: 218863 - DNA, 25 bp, Homo sapien
gatgccacgtggcagtgtgcggagg

SEQ ID NO: 218864 - DNA, 25 bp, Homo sapien
gagggcgcctgatgcccacgtggca

SEQ ID NO: 218865 - DNA, 25 bp, Homo sapien
agggcgcctgatgccacgtggcagt

SEQ ID NO: 218866 - DNA, 25 bp, Homo sapien
gcctgatgccacgtggcagtgtgcg

SEQ ID NO: 218867 - DNA, 25 bp, Homo sapien
cgcctgatgccacgtggcagtgtgc

SEQ ID NO: 218868 - DNA, 25 bp, Homo sapien
ggagggcgcctgatgcccacgtggc

SEQ ID NO: 218869 - DNA, 25 bp, Homo sapien
ctgatgccacgtggcagtgtgcgga

SEQ ID NO: 218870 - DNA, 25 bp, Homo sapien
gcccacgtggcagtgtgcggagggc

SEQ ID NO: 218871 - DNA, 25 bp, Homo sapien
aagccacgctgcgatcccgtctatg

SEQ ID NO: 218872 - DNA, 25 bp, Homo sapien
tgtgtcacgtacagagcgagtgttc

SEQ ID NO: 218873 - DNA, 25 bp, Homo sapien
tgcccgggacagcacgaatgggctc

SEQ ID NO: 218874 - DNA, 25 bp, Homo sapien
ggtgccagatcaatcccggtgcatc

SEQ ID NO: 218875 - DNA, 25 bp, Homo sapien
gctttattcagcacggcctagcccg

SEQ ID NO: 218876 - DNA, 25 bp, Homo sapien
agcgagtgttcagccggctttattc

SEQ ID NO: 218877 - DNA, 25 bp, Homo sapien
ccgtctatgggatacctgggaaagc

SEQ ID NO: 218878 - DNA, 25 bp, Homo sapien
tcctgcgtctttgcgctgcgttttc

SEQ ID NO: 218879 - DNA, 25 bp, Homo sapien
gtcatctccatgaccaccgtgggct

SEQ ID NO: 218880 - DNA, 25 bp, Homo sapien
ccaagtgccgcagcctgttcgtgct

SEQ ID NO: 218881 - DNA, 25 bp, Homo sapien
tgcgcgcgccactcaacatcattga

SEQ ID NO: 218882 - DNA, 25 bp, Homo sapien
catcattgacatcctggcgctcctg

SEQ ID NO: 218883 - DNA, 25 bp, Homo sapien
tcctgccgttctacgtgtcgctgct

SEQ ID NO: 218884 - DNA, 25 bp, Homo sapien
gccagctattggtgggccgtcatct

SEQ ID NO: 218885 - DNA, 25 bp, Homo sapien
aggaggacagcacgcactcggccac

SEQ ID NO: 218886 - DNA, 25 bp, Homo sapien
acagccaccgaggacagctcgcagg

SEQ ID NO: 218887 - DNA, 25 bp, Homo sapien
gtgcacagactctccggggcgctca

SEQ ID NO: 218888 - DNA, 25 bp, Homo sapien
tgacgaggatgcacagggtctcagc

SEQ ID NO: 218889 - DNA, 25 bp, Homo sapien
gcgctcattaccgtaactacaacca

SEQ ID NO: 218890 - DNA, 25 bp, Homo sapien
gggcctcagtgcacagactctccgg

SEQ ID NO: 218891 - DNA, 25 bp, Homo sapien
agcgcagaccggatgaactgggcct

SEQ ID NO: 218892 - DNA, 25 bp, Homo sapien
gtcactcttaaaagcgcagaccgga

SEQ ID NO: 218893 - DNA, 25 bp, Homo sapien
cccgatggtcactcttaaaagcgca

SEQ ID NO: 218894 - DNA, 25 bp, Homo sapien
cccgttcctgacgaggatgcacagg

SEQ ID NO: 218895 - DNA, 25 bp, Homo sapien
gtggtgctcccgtacccgtggtgct

SEQ ID NO: 218896 - DNA, 25 bp, Homo sapien
ctctcatagccgcagtgctcccgta

SEQ ID NO: 218897 - DNA, 25 bp, Homo sapien
cgtaccctcccatacccacggtgct

SEQ ID NO: 218898 - DNA, 25 bp, Homo sapien
cagtgctcccgtaccctcccatacc

SEQ ID NO: 218899 - DNA, 25 bp, Homo sapien
gtaccctcccatacccacggtgctc

SEQ ID NO: 218900 - DNA, 25 bp, Homo sapien
ggtgctcccgtacccgcggcgctct

SEQ ID NO: 218901 - DNA, 25 bp, Homo sapien
ggtgctctcatagccgcagtgctcc

SEQ ID NO: 218902 - DNA, 25 bp, Homo sapien
gcagtgctcccgtaccctcccatac

SEQ ID NO: 218903 - DNA, 25 bp, Homo sapien
cgctcccgtacccacggtgctctca

SEQ ID NO: 218904 - DNA, 25 bp, Homo sapien
tctcatacccgcagtgctcccgtac

SEQ ID NO: 218905 - DNA, 25 bp, Homo sapien
gcggcgctctcgtacccgcagtgct

SEQ ID NO: 218906 - DNA, 25 bp, Homo sapien
gctcttgtacctgcggcactcccgt

SEQ ID NO: 218907 - DNA, 25 bp, Homo sapien
gtacccgtggtgctctcatagccgc

SEQ ID NO: 218908 - DNA, 25 bp, Homo sapien
gtggtgctctcatagccgcagtgct

SEQ ID NO: 218909 - DNA, 25 bp, Homo sapien
ctcccgtacccatggcgctcccata

SEQ ID NO: 218910 - DNA, 25 bp, Homo sapien
agtgctcccgtacccgtggtgctcc

SEQ ID NO: 218911 - DNA, 25 bp, Homo sapien
atccaggaccttgactgagcccgtg

SEQ ID NO: 218912 - DNA, 25 bp, Homo sapien
tacaatgcagtttccatccaggacc

SEQ ID NO: 218913 - DNA, 25 bp, Homo sapien
tgactgagcccgtgggcatcatgct

SEQ ID NO: 218914 - DNA, 25 bp, Homo sapien
catcatgctgctcgcgttgtgccct

SEQ ID NO: 218915 - DNA, 25 bp, Homo sapien
gttgtgccctacctctggcggtcac

SEQ ID NO: 218916 - DNA, 25 bp, Homo sapien
ccaggcatggtctgtggttccgaac

SEQ ID NO: 218917 - DNA, 25 bp, Homo sapien
tgtgagggactagagttttctgccc

SEQ ID NO: 218918 - DNA, 25 bp, Homo sapien
ccgccacagcgagcagatctgtttt

SEQ ID NO: 218919 - DNA, 25 bp, Homo sapien
gacccggctcggagtttgcagcgcc

SEQ ID NO: 218920 - DNA, 25 bp, Homo sapien
tctgtcctgacccaggagacccggg

SEQ ID NO: 218921 - DNA, 25 bp, Homo sapien
gacgagtctcgtccagctctgtcct

SEQ ID NO: 218922 - DNA, 25 bp, Homo sapien
cgtgtcctgaatgcgggccacccgg

SEQ ID NO: 218923 - DNA, 25 bp, Homo sapien
cctctcacgcgtgtcctgaatgcgg

SEQ ID NO: 218924 - DNA, 25 bp, Homo sapien
ccatccaagcggagggcgtcgtcct

SEQ ID NO: 218925 - DNA, 25 bp, Homo sapien
gcgtctcggcgtcagtccgctcagg

SEQ ID NO: 218926 - DNA, 25 bp, Homo sapien
caggggactgaaggccgcgaccaac

SEQ ID NO: 218927 - DNA, 25 bp, Homo sapien
tctgaaaaggaagaactcggtcggc

SEQ ID NO: 218928 - DNA, 25 bp, Homo sapien
ctcgatcattcggacgtggaaatcc

SEQ ID NO: 218929 - DNA, 25 bp, Homo sapien
cgacagcaaggcgacccggtctgaa

SEQ ID NO: 218930 - DNA, 25 bp, Homo sapien
aggtcgctcgactcacgtgactccg

SEQ ID NO: 218931 - DNA, 25 bp, Homo sapien
gtagcagtagcaggaaaatcaccgc

SEQ ID NO: 218932 - DNA, 25 bp, Homo sapien
ggcctccgcttcacctcgggaggga

SEQ ID NO: 218933 - DNA, 25 bp, Homo sapien
gaaatacaaactctcgcgcgaggtc

SEQ ID NO: 218934 - DNA, 25 bp, Homo sapien
ctccaacaggcaggctccacaggga

SEQ ID NO: 218935 - DNA, 25 bp, Homo sapien
cggccagcggtccacatggacgtgc

SEQ ID NO: 218936 - DNA, 25 bp, Homo sapien
atgcactgcccgtgcggagcgtttt

SEQ ID NO: 218937 - DNA, 25 bp, Homo sapien
gcccacgggccctcttgagtaaggc

SEQ ID NO: 218938 - DNA, 25 bp, Homo sapien
gccctcttgagtaaggcggctccgc

SEQ ID NO: 218939 - DNA, 25 bp, Homo sapien
cgctcggtgacattgcgtccctgca

SEQ ID NO: 218940 - DNA, 25 bp, Homo sapien
ggagcttagctgtcgccacctcgcg

SEQ ID NO: 218941 - DNA, 25 bp, Homo sapien
gaatcgcggagcttagctgtcgcca

SEQ ID NO: 218942 - DNA, 25 bp, Homo sapien
caggggtgaccgaggcccatgcact

SEQ ID NO: 218943 - DNA, 25 bp, Homo sapien
tgaatgagactcgtcgcaccgaagc

SEQ ID NO: 218944 - DNA, 25 bp, Homo sapien
ccgaggcagattgtaaacctttttg

SEQ ID NO: 218945 - DNA, 25 bp, Homo sapien
cagttttagttttgtcccgaggcag

SEQ ID NO: 218946 - DNA, 25 bp, Homo sapien
tgcagggagattcctttgggcttct

SEQ ID NO: 218947 - DNA, 25 bp, Homo sapien
agtcgtgactctgcagaatagtttc

SEQ ID NO: 218948 - DNA, 25 bp, Homo sapien
cgtcatcgccagtggccggtttgaa

SEQ ID NO: 218949 - DNA, 25 bp, Homo sapien
atggggaagcctctcaaagtcgtga

SEQ ID NO: 218950 - DNA, 25 bp, Homo sapien
tttgcgtgttgctgcgtcatcgcca

SEQ ID NO: 218951 - DNA, 25 bp, Homo sapien
tcgcccgccagacccttcctcaagg

SEQ ID NO: 218952 - DNA, 25 bp, Homo sapien
ttcctcaaggacctgcacgcccggc

SEQ ID NO: 218953 - DNA, 25 bp, Homo sapien
gcgctcgcccaacctcgcgggcaaa

SEQ ID NO: 218954 - DNA, 25 bp, Homo sapien
tgccgctgccaagggccgcaaagcc

SEQ ID NO: 218955 - DNA, 25 bp, Homo sapien
agcagcgacgccgaatccggcacgg

SEQ ID NO: 218956 - DNA, 25 bp, Homo sapien
acagcagctccgacctctctgactg

SEQ ID NO: 218957 - DNA, 25 bp, Homo sapien
cagcctgggcgagcagtctcggctc

SEQ ID NO: 218958 - DNA, 25 bp, Homo sapien
tcgcgcatcagccacacggacagca

SEQ ID NO: 218959 - DNA, 25 bp, Homo sapien
aggacctcgtccatcttcatgcacg

SEQ ID NO: 218960 - DNA, 25 bp, Homo sapien
ggaatcgcctgaacgacggagccgc

SEQ ID NO: 218961 - DNA, 25 bp, Homo sapien
gcgctaccttctcggcgatgctgta

SEQ ID NO: 218962 - DNA, 25 bp, Homo sapien
tcttcatgcacgtaggatcccagtc

SEQ ID NO: 218963 - DNA, 25 bp, Homo sapien
gcacacgcaaactccgctgggactg

SEQ ID NO: 218964 - DNA, 25 bp, Homo sapien
gttggttccgtcatagcagctgtcg

SEQ ID NO: 218965 - DNA, 25 bp, Homo sapien
ggacgtccagaaaggcccggaatgc

SEQ ID NO: 218966 - DNA, 25 bp, Homo sapien
cctcctccgagaggatggcctggtc

SEQ ID NO: 218967 - DNA, 25 bp, Homo sapien
gactttctctaggtgcccggggaga

SEQ ID NO: 218968 - DNA, 25 bp, Homo sapien
acgtgttcctagctacgcagcgcca

SEQ ID NO: 218969 - DNA, 25 bp, Homo sapien
cgcctacgtcagttcccagtattta

SEQ ID NO: 218970 - DNA, 25 bp, Homo sapien
acttctggggaggacgcccaatctg

SEQ ID NO: 218971 - DNA, 25 bp, Homo sapien
gcccagtggcggaaacagacggacc

SEQ ID NO: 218972 - DNA, 25 bp, Homo sapien
tctccaggcttcgatgccttcgttg

SEQ ID NO: 218973 - DNA, 25 bp, Homo sapien
ttcgttgctttgtgcggcgcacccg

SEQ ID NO: 218974 - DNA, 25 bp, Homo sapien
actgcggtcgcgctcacttctcttt

SEQ ID NO: 218975 - DNA, 25 bp, Homo sapien
gtgtccgctcatccgcgttcttgcg

SEQ ID NO: 218976 - DNA, 25 bp, Homo sapien
tttgcctcgaaaaccaagtaatgcg

SEQ ID NO: 218977 - DNA, 25 bp, Homo sapien
actggctcaagaaatttgcctcgaa

SEQ ID NO: 218978 - DNA, 25 bp, Homo sapien
ttccgtagccgcgatgctgcgctat

SEQ ID NO: 218979 - DNA, 25 bp, Homo sapien
gctgtctcctgcaagaactggctca

SEQ ID NO: 218980 - DNA, 25 bp, Homo sapien
ctgcgagcggggacttcactgctct

SEQ ID NO: 218981 - DNA, 25 bp, Homo sapien
gctgcgctatttccaggctgcgagc

SEQ ID NO: 218982 - DNA, 25 bp, Homo sapien
gttcttgcgcccatgcggcctagct

SEQ ID NO: 218983 - DNA, 25 bp, Homo sapien
gagctcccggatgccaagagcccgt

SEQ ID NO: 218984 - DNA, 25 bp, Homo sapien
agaattcagccaagggcgagctccc

SEQ ID NO: 218985 - DNA, 25 bp, Homo sapien
gacaaggccttcttccagggcgctg

SEQ ID NO: 218986 - DNA, 25 bp, Homo sapien
ccgttaaagatgaggagacaaggcc

SEQ ID NO: 218987 - DNA, 25 bp, Homo sapien
acgtacacggcaccctcggctgttg

SEQ ID NO: 218988 - DNA, 25 bp, Homo sapien
agagcagctcacatcacgtacacgg

SEQ ID NO: 218989 - DNA, 25 bp, Homo sapien
tggacgaccaccgtggctgcagctc

SEQ ID NO: 218990 - DNA, 25 bp, Homo sapien
cccttccacgcggtgtggcagacga

SEQ ID NO: 218991 - DNA, 25 bp, Homo sapien
cgttcgtgtcatttgtgaagcccga

SEQ ID NO: 218992 - DNA, 25 bp, Homo sapien
cgtgcgttttaaagcgtgctggaaa

SEQ ID NO: 218993 - DNA, 25 bp, Homo sapien
ctgtgtgcgtgcgttttaaagcgtg

SEQ ID NO: 218994 - DNA, 25 bp, Homo sapien
cccgacaggaagagtggagccctgc

SEQ ID NO: 218995 - DNA, 25 bp, Homo sapien
tttgtgaagcccgacaggaagagtg

SEQ ID NO: 218996 - DNA, 25 bp, Homo sapien
gtgtcatttgtgaagcccgacagga

SEQ ID NO: 218997 - DNA, 25 bp, Homo sapien
ccgaacgcatctctgcctccctagg

SEQ ID NO: 218998 - DNA, 25 bp, Homo sapien
agcgtgctggaaacgtctacaatgg

SEQ ID NO: 218999 - DNA, 25 bp, Homo sapien
ggggaccaggtccacatcgatgatg

SEQ ID NO: 219000 - DNA, 25 bp, Homo sapien
ggccgtcatacacctggcactgctg

SEQ ID NO: 219001 - DNA, 25 bp, Homo sapien
gtaccatgcgcgagatgaagatgcc

SEQ ID NO: 219002 - DNA, 25 bp, Homo sapien
aggacctcgtcattcacagccagca

SEQ ID NO: 219003 - DNA, 25 bp, Homo sapien
ctgttggcgatcatcatgtccgtga

SEQ ID NO: 219004 - DNA, 25 bp, Homo sapien
tgacgacgtcgttgtcctcatcgct

SEQ ID NO: 219005 - DNA, 25 bp, Homo sapien
tccagtgtgccctcgatgacgacgt

SEQ ID NO: 219006 - DNA, 25 bp, Homo sapien
actgctgttccatctgcgtgacgcc

SEQ ID NO: 219007 - DNA, 25 bp, Homo sapien
ctgagacttgtgaaaacttcggttc

SEQ ID NO: 219008 - DNA, 25 bp, Homo sapien
cgcctggtgcctagatgtttggtac

SEQ ID NO: 219009 - DNA, 25 bp, Homo sapien
cggcaagtctcctcctggcaggtaa

SEQ ID NO: 219010 - DNA, 25 bp, Homo sapien
cctggcaggtaacaagcctcctttg

SEQ ID NO: 219011 - DNA, 25 bp, Homo sapien
cgcctctcactcgtggaacaaaaga

SEQ ID NO: 219012 - DNA, 25 bp, Homo sapien
cggcgcccgaactggaaagttgtcg

SEQ ID NO: 219013 - DNA, 25 bp, Homo sapien
tgcaatcgtagaatcgcaaggtctg

SEQ ID NO: 219014 - DNA, 25 bp, Homo sapien
gggcttaccttgctcttgacttcca

SEQ ID NO: 219015 - DNA, 25 bp, Homo sapien
tacttcctcaaaggtgagcgctcgg

SEQ ID NO: 219016 - DNA, 25 bp, Homo sapien
gctcaacgtcaacctcaactcggtg

SEQ ID NO: 219017 - DNA, 25 bp, Homo sapien
ggcatgaaggtcacgtcgctcgacg

SEQ ID NO: 219018 - DNA, 25 bp, Homo sapien
gagtccctcagcgaagcgcggaaga

SEQ ID NO: 219019 - DNA, 25 bp, Homo sapien
tcattcacataaaacgctgcgcggc

SEQ ID NO: 219020 - DNA, 25 bp, Homo sapien
gtcacggacggcactcattcacata

SEQ ID NO: 219021 - DNA, 25 bp, Homo sapien
ggaaacacccatatttggccttata

SEQ ID NO: 219022 - DNA, 25 bp, Homo sapien
agtctgcaccctgtggcttgttgtg

SEQ ID NO: 219023 - DNA, 25 bp, Homo sapien
tgctgtccaacatccagcgctgcga

SEQ ID NO: 219024 - DNA, 25 bp, Homo sapien
cggaggaaatgtttgagaagacgtc

SEQ ID NO: 219025 - DNA, 25 bp, Homo sapien
ggactctgagtacctagtgacccta

SEQ ID NO: 219026 - DNA, 25 bp, Homo sapien
tgaccctaaaacacgaggcccagcg

SEQ ID NO: 219027 - DNA, 25 bp, Homo sapien
agcggacggtggagcgcctcatcac

SEQ ID NO: 219028 - DNA, 25 bp, Homo sapien
agcttcctccatgatgcggggctgc

SEQ ID NO: 219029 - DNA, 25 bp, Homo sapien
ctcagcggcaaggtgctcaaactgc

SEQ ID NO: 219030 - DNA, 25 bp, Homo sapien
agcacgagaaccacgcgctgctgtc

SEQ ID NO: 219031 - DNA, 25 bp, Homo sapien
agggtctccgaggactgctgtccta

SEQ ID NO: 219032 - DNA, 25 bp, Homo sapien
tggattcacgcatcgccatcgcatg

SEQ ID NO: 219033 - DNA, 25 bp, Homo sapien
tgcttgcggttgagttctggattca

SEQ ID NO: 219034 - DNA, 25 bp, Homo sapien
tttccttcacgggtagcgtgcttgc

SEQ ID NO: 219035 - DNA, 25 bp, Homo sapien
ccacaagtaaggaaggaagagcctc

SEQ ID NO: 219036 - DNA, 25 bp, Homo sapien
gctttggctgctcgacccacaagta

SEQ ID NO: 219037 - DNA, 25 bp, Homo sapien
ctgtcctagcctcgcctgggtgcat

SEQ ID NO: 219038 - DNA, 25 bp, Homo sapien
gccgccctggactgtggctttggct

SEQ ID NO: 219039 - DNA, 25 bp, Homo sapien
agccctcttagggaggccgctgcag

SEQ ID NO: 219040 - DNA, 25 bp, Homo sapien
cttcgttacccaggagcccaaggtg

SEQ ID NO: 219041 - DNA, 25 bp, Homo sapien
agcccaaggtgcagctccgggacgc

SEQ ID NO: 219042 - DNA, 25 bp, Homo sapien
gctccgggacgcttcttttcaaggc

SEQ ID NO: 219043 - DNA, 25 bp, Homo sapien
ccgcccactgggtaaggaggctcaa

SEQ ID NO: 219044 - DNA, 25 bp, Homo sapien
tcttgctctccgtgtctcccttagt

SEQ ID NO: 219045 - DNA, 25 bp, Homo sapien
ggacactgcggccttagccctctta

SEQ ID NO: 219046 - DNA, 25 bp, Homo sapien
ctcccttagttttgggcgcaggaga

SEQ ID NO: 219047 - DNA, 25 bp, Homo sapien
cctcctttgtcggatagtgtctgcg

SEQ ID NO: 219048 - DNA, 25 bp, Homo sapien
cggtcgccacaaatgctactgcaga

SEQ ID NO: 219049 - DNA, 25 bp, Homo sapien
gagatgttttcaagcccggctccgg

SEQ ID NO: 219050 - DNA, 25 bp, Homo sapien
cagcggcgacgaagacaacgacagc

SEQ ID NO: 219051 - DNA, 25 bp, Homo sapien
gacggctacgccgaagcactcgttc

SEQ ID NO: 219052 - DNA, 25 bp, Homo sapien
cgagccgtagctcgcctgacagtga

SEQ ID NO: 219053 - DNA, 25 bp, Homo sapien
ctgacagtgacaggccgttagtgcc

SEQ ID NO: 219054 - DNA, 25 bp, Homo sapien
tcatcgccgccatttccagaagctt

SEQ ID NO: 219055 - DNA, 25 bp, Homo sapien
ggagcctggcaagttttatcgaatt

SEQ ID NO: 219056 - DNA, 25 bp, Homo sapien
cgactcccgatgcagagctccgatg

SEQ ID NO: 219057 - DNA, 25 bp, Homo sapien
tctgacggcaaacgacaaggggttc

SEQ ID NO: 219058 - DNA, 25 bp, Homo sapien
gtagacctaggaaacgcgcatttta

SEQ ID NO: 219059 - DNA, 25 bp, Homo sapien
gaagttcgaaagctctacccttgga

SEQ ID NO: 219060 - DNA, 25 bp, Homo sapien
tcgcatcgctagaacccggccatgg

SEQ ID NO: 219061 - DNA, 25 bp, Homo sapien
gatgcagagctcagcgccagccact

SEQ ID NO: 219062 - DNA, 25 bp, Homo sapien
cttggagatccttattcagtaggtc

SEQ ID NO: 219063 - DNA, 25 bp, Homo sapien
tggcaccgctctacagaggctcggc

SEQ ID NO: 219064 - DNA, 25 bp, Homo sapien
ctgccctggtcgctgtcagtgccat

SEQ ID NO: 219065 - DNA, 25 bp, Homo sapien
gacgccgggagccagcagcatctct

SEQ ID NO: 219066 - DNA, 25 bp, Homo sapien
ccttaacgagaaacttgggcgtgat

SEQ ID NO: 219067 - DNA, 25 bp, Homo sapien
agtgccatctcccttaacgagaaac

SEQ ID NO: 219068 - DNA, 25 bp, Homo sapien
tgcgccgctttggtccagaccatct

SEQ ID NO: 219069 - DNA, 25 bp, Homo sapien
cagcagcatctctgcgccgctttgg

SEQ ID NO: 219070 - DNA, 25 bp, Homo sapien
tggtccagaccatctctgggccggc

SEQ ID NO: 219071 - DNA, 25 bp, Homo sapien
tctcaacttcgggagctgaggcgca

SEQ ID NO: 219072 - DNA, 25 bp, Homo sapien
ctcctgggtgttgtagtttgcttcc

SEQ ID NO: 219073 - DNA, 25 bp, Homo sapien
gtcccgttccgtcccaatcattgta

SEQ ID NO: 219074 - DNA, 25 bp, Homo sapien
gttggaacgactaaagcacgctggc

SEQ ID NO: 219075 - DNA, 25 bp, Homo sapien
ctcaaggccgttgcaggagatgccc

SEQ ID NO: 219076 - DNA, 25 bp, Homo sapien
cgacagaggtttattcccgcctatc

SEQ ID NO: 219077 - DNA, 25 bp, Homo sapien
ttcgccagcaccacaccggggtaag

SEQ ID NO: 219078 - DNA, 25 bp, Homo sapien
ggaaagccctttccatcctcaaggc

SEQ ID NO: 219079 - DNA, 25 bp, Homo sapien
tgcttgtcgacgttcccaggagtcc

SEQ ID NO: 219080 - DNA, 25 bp, Homo sapien
ctgagcgcgggtttcctaccgagct

SEQ ID NO: 219081 - DNA, 25 bp, Homo sapien
tagtagtgccgtgcttgtcgacgtt

SEQ ID NO: 219082 - DNA, 25 bp, Homo sapien
gcctcggtgtagtagtgccgtgctt

SEQ ID NO: 219083 - DNA, 25 bp, Homo sapien
tgcgtcccgagtttgggaatggccc

SEQ ID NO: 219084 - DNA, 25 bp, Homo sapien
gacgtaaactgtgtgcttcagggtg

SEQ ID NO: 219085 - DNA, 25 bp, Homo sapien
tcgcgcccaaaaggacagcagaccg

SEQ ID NO: 219086 - DNA, 25 bp, Homo sapien
tcctaccgagctagaggccagcctg

SEQ ID NO: 219087 - DNA, 25 bp, Homo sapien
tttattgggtcaccggcctcgccca

SEQ ID NO: 219088 - DNA, 25 bp, Homo sapien
ctgccagccgcagccatctcggcgg

SEQ ID NO: 219089 - DNA, 25 bp, Homo sapien
ccgctttattgggtcaccggcctcg

SEQ ID NO: 219090 - DNA, 25 bp, Homo sapien
gggccacgtacccgccatcttgtgg

SEQ ID NO: 219091 - DNA, 25 bp, Homo sapien
agagaagaaaggcccggtcagcgcc

SEQ ID NO: 219092 - DNA, 25 bp, Homo sapien
tttcctcacggacgcgagattttcc

SEQ ID NO: 219093 - DNA, 25 bp, Homo sapien
gcgccgtttcctcacggacgcgaga

SEQ ID NO: 219094 - DNA, 25 bp, Homo sapien
cgggccactcacatccgtctgcgtc

SEQ ID NO: 219095 - DNA, 25 bp, Homo sapien
ggagacatcttctcggctgcgcgtg

SEQ ID NO: 219096 - DNA, 25 bp, Homo sapien
tgccgatgacgtcaagccaggagca

SEQ ID NO: 219097 - DNA, 25 bp, Homo sapien
cccggctagagtggcctgtgaacac

SEQ ID NO: 219098 - DNA, 25 bp, Homo sapien
ggagtttccctagcgactcagttcg

SEQ ID NO: 219099 - DNA, 25 bp, Homo sapien
tgggcgcctgagtcagccaaacagc

SEQ ID NO: 219100 - DNA, 25 bp, Homo sapien
ccttggtctgtaagctctgcgttcc

SEQ ID NO: 219101 - DNA, 25 bp, Homo sapien
ccgcgcacatgcgtttctgtggttt

SEQ ID NO: 219102 - DNA, 25 bp, Homo sapien
ccaaacagcctactcggggttcttg

SEQ ID NO: 219103 - DNA, 25 bp, Homo sapien
ggggctttggatgcaacaataatta

SEQ ID NO: 219104 - DNA, 25 bp, Homo sapien
tgcagcgattgtgaaatgggcgccc

SEQ ID NO: 219105 - DNA, 25 bp, Homo sapien
ggccacattcccaactgcagcgatt

SEQ ID NO: 219106 - DNA, 25 bp, Homo sapien
ccgtgggaactgacccggccacatt

SEQ ID NO: 219107 - DNA, 25 bp, Homo sapien
ggtgactaaaatcccagtgatgctg

SEQ ID NO: 219108 - DNA, 25 bp, Homo sapien
ttagtattttgacgatgcgattccg

SEQ ID NO: 219109 - DNA, 25 bp, Homo sapien
gctgattatttggatttcctgggca

SEQ ID NO: 219110 - DNA, 25 bp, Homo sapien
caagtaggaggtcccaccctgagta

SEQ ID NO: 219111 - DNA, 25 bp, Homo sapien
ggggcaattgatttactcacgtaaa

SEQ ID NO: 219112 - DNA, 25 bp, Homo sapien
ccggcggcccagaaatagcagcggc

SEQ ID NO: 219113 - DNA, 25 bp, Homo sapien
ggctgcgagcacatgatggcgatac

SEQ ID NO: 219114 - DNA, 25 bp, Homo sapien
atggcgatacgggagctcaaagtgt

SEQ ID NO: 219115 - DNA, 25 bp, Homo sapien
agggctttctcctccgcttttgata

SEQ ID NO: 219116 - DNA, 25 bp, Homo sapien
cgcttttgatagtttccttccggca

SEQ ID NO: 219117 - DNA, 25 bp, Homo sapien
agccaagtcgctgagtgctcttttg

SEQ ID NO: 219118 - DNA, 25 bp, Homo sapien
ttccggcagaaagtttaagttgctc

SEQ ID NO: 219119 - DNA, 25 bp, Homo sapien
cacgtaggcacgcagaggccgtcac

SEQ ID NO: 219120 - DNA, 25 bp, Homo sapien
ggtggcccaccgaaccggtgacaca

SEQ ID NO: 219121 - DNA, 25 bp, Homo sapien
accggtgacacagcggcaggcgtta

SEQ ID NO: 219122 - DNA, 25 bp, Homo sapien
tggcctcgtcctagagctcggccga

SEQ ID NO: 219123 - DNA, 25 bp, Homo sapien
ccatggcgaagcacgagcagatcct

SEQ ID NO: 219124 - DNA, 25 bp, Homo sapien
tcaaattcaaaggtaggcagaacgg

SEQ ID NO: 219125 - DNA, 25 bp, Homo sapien
gacaagcgctagaagctcccggccg

SEQ ID NO: 219126 - DNA, 25 bp, Homo sapien
ttcccttgacagctgggctgcgctc

SEQ ID NO: 219127 - DNA, 25 bp, Homo sapien
ccgcgcctgtccagggaagcctgaa

SEQ ID NO: 219128 - DNA, 25 bp, Homo sapien
ggacgctcagcgagtgtctgtccca

SEQ ID NO: 219129 - DNA, 25 bp, Homo sapien
cctgagctcagtgaaagattgcaga

SEQ ID NO: 219130 - DNA, 25 bp, Homo sapien
gctgtgtccagacgcccttcagagc

SEQ ID NO: 219131 - DNA, 25 bp, Homo sapien
ttcagagcaaaggagccacaggcgg

SEQ ID NO: 219132 - DNA, 25 bp, Homo sapien
cccagtgtctctcgggaagcgtgac

SEQ ID NO: 219133 - DNA, 25 bp, Homo sapien
gacctcgacttcatgcccgggagaa

SEQ ID NO: 219134 - DNA, 25 bp, Homo sapien
ctcgggaagcgtgacctcgacttca

SEQ ID NO: 219135 - DNA, 25 bp, Homo sapien
aggcagatttcgagcagccccggct

SEQ ID NO: 219136 - DNA, 25 bp, Homo sapien
ccgcactcgcgcaagggcggggtct

SEQ ID NO: 219137 - DNA, 25 bp, Homo sapien
atttactgcggggtgaagcgctgtc

SEQ ID NO: 219138 - DNA, 25 bp, Homo sapien
ggggcacacctgccgccctagcgcc

SEQ ID NO: 219139 - DNA, 25 bp, Homo sapien
cccttgtccaggcagatttcgagca

SEQ ID NO: 219140 - DNA, 25 bp, Homo sapien
cttgtccaggcagatttcgagcagc

SEQ ID NO: 219141 - DNA, 25 bp, Homo sapien
ggtgaagcgctgtctggggcacacc

SEQ ID NO: 219142 - DNA, 25 bp, Homo sapien
tgtccaggcagatttcgagcagccc

SEQ ID NO: 219143 - DNA, 25 bp, Homo sapien
acgcccaccagagccaccgcacttc

SEQ ID NO: 219144 - DNA, 25 bp, Homo sapien
aggcggcttctgctggtactcgccc

SEQ ID NO: 219145 - DNA, 25 bp, Homo sapien
gagccaccgcacttccggttgctgt

SEQ ID NO: 219146 - DNA, 25 bp, Homo sapien
gcccaccagagccaccgcacttccg

SEQ ID NO: 219147 - DNA, 25 bp, Homo sapien
ttctgctggtactcgcccaccacgc

SEQ ID NO: 219148 - DNA, 25 bp, Homo sapien
ggcggcttctgctggtactcgccca

SEQ ID NO: 219149 - DNA, 25 bp, Homo sapien
agagccaccgcacttccggttgctg

SEQ ID NO: 219150 - DNA, 25 bp, Homo sapien
tctgctggtactcgcccaccacgcc

SEQ ID NO: 219151 - DNA, 25 bp, Homo sapien
cgcggcttctgctggtactcagcca

SEQ ID NO: 219152 - DNA, 25 bp, Homo sapien
ctgtccacgcggcttctgctggtac

SEQ ID NO: 219153 - DNA, 25 bp, Homo sapien
agagtccagagccacggcacttccg

SEQ ID NO: 219154 - DNA, 25 bp, Homo sapien
tttggctacgacagcccagagtcca

SEQ ID NO: 219155 - DNA, 25 bp, Homo sapien
tgtttggctacgacagcccagagtc

SEQ ID NO: 219156 - DNA, 25 bp, Homo sapien
gcgtgtttggctacgacagcccaga

SEQ ID NO: 219157 - DNA, 25 bp, Homo sapien
aggcgtgtttggctacgacagccca

SEQ ID NO: 219158 - DNA, 25 bp, Homo sapien
ccacgcggcttctgctggtactcag

SEQ ID NO: 219159 - DNA, 25 bp, Homo sapien
agcaggccgctttgcttggatccca

SEQ ID NO: 219160 - DNA, 25 bp, Homo sapien
gctttgcttggatcccacgccaggc

SEQ ID NO: 219161 - DNA, 25 bp, Homo sapien
gcggaagggtgacccgcgcattctc

SEQ ID NO: 219162 - DNA, 25 bp, Homo sapien
gtgacccgcgcattctctttccttg

SEQ ID NO: 219163 - DNA, 25 bp, Homo sapien
cgcgcattctctttccttgcgggcg

SEQ ID NO: 219164 - DNA, 25 bp, Homo sapien
ctcagcaggccgctttgcttggatc

SEQ ID NO: 219165 - DNA, 25 bp, Homo sapien
cgctttgcttggatcccacgccagg

SEQ ID NO: 219166 - DNA, 25 bp, Homo sapien
aggccgctttgcttggatcccacgc

SEQ ID NO: 219167 - DNA, 25 bp, Homo sapien
cctgccgtctcagccctgggagagg

SEQ ID NO: 219168 - DNA, 25 bp, Homo sapien
gggctctgcccactttccgaggctt

SEQ ID NO: 219169 - DNA, 25 bp, Homo sapien
tctggatcgcggcacggcctacact

SEQ ID NO: 219170 - DNA, 25 bp, Homo sapien
cttcacggtgagttcccgagggcca

SEQ ID NO: 219171 - DNA, 25 bp, Homo sapien
tcctgctcagatacctgttcccggc

SEQ ID NO: 219172 - DNA, 25 bp, Homo sapien
actggaaatgtcctggccgcgccgc

SEQ ID NO: 219173 - DNA, 25 bp, Homo sapien
agttgcccgggcaccaaatcggagc

SEQ ID NO: 219174 - DNA, 25 bp, Homo sapien
tctgcccactttccgaggcttggga

SEQ ID NO: 219175 - DNA, 25 bp, Homo sapien
gcacggaagccgactaccagctgca

SEQ ID NO: 219176 - DNA, 25 bp, Homo sapien
acgtggcctatgacctctggcgaga

SEQ ID NO: 219177 - DNA, 25 bp, Homo sapien
gccaggcctcctggatcatccgagg

SEQ ID NO: 219178 - DNA, 25 bp, Homo sapien
ccagctgcacaacgtccaggtgatc

SEQ ID NO: 219179 - DNA, 25 bp, Homo sapien
tctgccacacagaggcggtggccga

SEQ ID NO: 219180 - DNA, 25 bp, Homo sapien
ctcggccagcaggtgaaccgcacat

SEQ ID NO: 219181 - DNA, 25 bp, Homo sapien
acgtccaggtgatctgccacacaga

SEQ ID NO: 219182 - DNA, 25 bp, Homo sapien
aggtgaaccgcacatgcccgggctt

SEQ ID NO: 219183 - DNA, 25 bp, Homo sapien
cgcgcctgcgctagatgccctaggt

SEQ ID NO: 219184 - DNA, 25 bp, Homo sapien
aaatagtgagtgagaaccttccggg

SEQ ID NO: 219185 - DNA, 25 bp, Homo sapien
ggggctggaacacctcgccaaagca

SEQ ID NO: 219186 - DNA, 25 bp, Homo sapien
agatggcggctcagaagataaacga

SEQ ID NO: 219187 - DNA, 25 bp, Homo sapien
tctctccacgtcagagacctgactg

SEQ ID NO: 219188 - DNA, 25 bp, Homo sapien
cccacgcctatttgggcggattctt

SEQ ID NO: 219189 - DNA, 25 bp, Homo sapien
tgcgcctgcgcaatgtctctttgcg

SEQ ID NO: 219190 - DNA, 25 bp, Homo sapien
tagacgccgggtccgtctctcactg

SEQ ID NO: 219191 - DNA, 25 bp, Homo sapien
gtggctcctcaagccagcgtgggct

SEQ ID NO: 219192 - DNA, 25 bp, Homo sapien
ggtgatttatttcattggctcgcta

SEQ ID NO: 219193 - DNA, 25 bp, Homo sapien
tgccagccacgtccttgatactttg

SEQ ID NO: 219194 - DNA, 25 bp, Homo sapien
tcactgaattctgctgccagccacg

SEQ ID NO: 219195 - DNA, 25 bp, Homo sapien
cccagcttctgctttcactgaattc

SEQ ID NO: 219196 - DNA, 25 bp, Homo sapien
aggcttgtgtttctcgtgtgctccg

SEQ ID NO: 219197 - DNA, 25 bp, Homo sapien
tctgaacatggcttcgtgtgtgaca

SEQ ID NO: 219198 - DNA, 25 bp, Homo sapien
tggctcgctattacttggcagcggc

SEQ ID NO: 219199 - DNA, 25 bp, Homo sapien
ccagctgccagacgggcgggaacaa

SEQ ID NO: 219200 - DNA, 25 bp, Homo sapien
taacccggagatgtcccagcgagtg

SEQ ID NO: 219201 - DNA, 25 bp, Homo sapien
ggcttagacgggattcgacgtaaca

SEQ ID NO: 219202 - DNA, 25 bp, Homo sapien
tcgacgtaacagaagatgacgcttg

SEQ ID NO: 219203 - DNA, 25 bp, Homo sapien
aagatgacgcttgagtgacagattc

SEQ ID NO: 219204 - DNA, 25 bp, Homo sapien
ccataggagagggtgttcccagctg

SEQ ID NO: 219205 - DNA, 25 bp, Homo sapien
tgacagattcgtcagcgcccagagg

SEQ ID NO: 219206 - DNA, 25 bp, Homo sapien
gcggaaatcacgtaacccggagatg

SEQ ID NO: 219207 - DNA, 25 bp, Homo sapien
taaagcaggtaaggccttcgcgtcc

SEQ ID NO: 219208 - DNA, 25 bp, Homo sapien
agaattggggcactcctttgcagcc

SEQ ID NO: 219209 - DNA, 25 bp, Homo sapien
tgactcctcctacgccctgtgaagg

SEQ ID NO: 219210 - DNA, 25 bp, Homo sapien
tggaggactggttttgcctaaaaga

SEQ ID NO: 219211 - DNA, 25 bp, Homo sapien
tccgagtgaagcttttgactaagtc

SEQ ID NO: 219212 - DNA, 25 bp, Homo sapien
cggaccaaccctacggtcatagatt

SEQ ID NO: 219213 - DNA, 25 bp, Homo sapien
ttaaacagcgcggaatcacgtggcc

SEQ ID NO: 219214 - DNA, 25 bp, Homo sapien
caggggcccggaatcatgtacataa

SEQ ID NO: 219215 - DNA, 25 bp, Homo sapien
tgtgtaaacaccacgcgggcccatt

SEQ ID NO: 219216 - DNA, 25 bp, Homo sapien
aggggaatacttgcgcgcttcaaaa

SEQ ID NO: 219217 - DNA, 25 bp, Homo sapien
gggcaactattttccagtcggtgaa

SEQ ID NO: 219218 - DNA, 25 bp, Homo sapien
acacttccataaaccggcctgcaga

SEQ ID NO: 219219 - DNA, 25 bp, Homo sapien
gaactcctcgggcacctaatcattg

SEQ ID NO: 219220 - DNA, 25 bp, Homo sapien
gggcccattcctgaacgactctttg

SEQ ID NO: 219221 - DNA, 25 bp, Homo sapien
atggcatttcgcacccacgcagggc

SEQ ID NO: 219222 - DNA, 25 bp, Homo sapien
ctccgctgcggttacttatctcata

SEQ ID NO: 219223 - DNA, 25 bp, Homo sapien
tctgctacaccagccgccacgctgt

SEQ ID NO: 219224 - DNA, 25 bp, Homo sapien
gtgcgtctgtccttccgccagctct

SEQ ID NO: 219225 - DNA, 25 bp, Homo sapien
tcgggagcatgagaatggaagcgtc

SEQ ID NO: 219226 - DNA, 25 bp, Homo sapien
ctctgctctgctacaccagccgcca

SEQ ID NO: 219227 - DNA, 25 bp, Homo sapien
agcctgtgttcgggagcatgagaat

SEQ ID NO: 219228 - DNA, 25 bp, Homo sapien
ccgccacgctgtgcgtctgtccttc

SEQ ID NO: 219229 - DNA, 25 bp, Homo sapien
ggcgcgctacgtgcgggacgccgac

SEQ ID NO: 219230 - DNA, 25 bp, Homo sapien
cgctgctctgctctgctacaccagc

SEQ ID NO: 219231 - DNA, 25 bp, Homo sapien
atggagaccagagcgcatatcgggt

SEQ ID NO: 219232 - DNA, 25 bp, Homo sapien
acgcaaggcccatgcccgtctatgg

SEQ ID NO: 219233 - DNA, 25 bp, Homo sapien
gccggcccatttagtgtgaatcctg

SEQ ID NO: 219234 - DNA, 25 bp, Homo sapien
tccctcactcgaaggaacggcgcga

SEQ ID NO: 219235 - DNA, 25 bp, Homo sapien
ctcaagagaaaaaccagcgccgtcc

SEQ ID NO: 219236 - DNA, 25 bp, Homo sapien
gcgcgcttctccaccttcaatgaaa

SEQ ID NO: 219237 - DNA, 25 bp, Homo sapien
tgaaactttcgaagccctcactcgg

SEQ ID NO: 219238 - DNA, 25 bp, Homo sapien
cttcttcaggggtagctgatgccgg

SEQ ID NO: 219239 - DNA, 25 bp, Homo sapien
gcctgggcggcagtatttacggtaa

SEQ ID NO: 219240 - DNA, 25 bp, Homo sapien
ctctgggcgttagcaagtgatctcc

SEQ ID NO: 219241 - DNA, 25 bp, Homo sapien
tttacggtaacgaaagccagctgta

SEQ ID NO: 219242 - DNA, 25 bp, Homo sapien
caagtgatctccagccaaggcggcc

SEQ ID NO: 219243 - DNA, 25 bp, Homo sapien
ggctcagacggcattatttacggta

SEQ ID NO: 219244 - DNA, 25 bp, Homo sapien
atcgaccgcatgctgcgcgaccaga

SEQ ID NO: 219245 - DNA, 25 bp, Homo sapien
gcccacatgggtctgtgctacagtc

SEQ ID NO: 219246 - DNA, 25 bp, Homo sapien
aaaatgcaaaatgaccctctggggc

SEQ ID NO: 219247 - DNA, 25 bp, Homo sapien
cagaccatctctttcagcagcagga

SEQ ID NO: 219248 - DNA, 25 bp, Homo sapien
aacgcctgctctgaatcggaaaaca

SEQ ID NO: 219249 - DNA, 25 bp, Homo sapien
cgcgcgtcttccttacagccattta

SEQ ID NO: 219250 - DNA, 25 bp, Homo sapien
aaggcattttactccgcgcgtcttc

SEQ ID NO: 219251 - DNA, 25 bp, Homo sapien
gaatatgcatgatcctccgcgagtc

SEQ ID NO: 219252 - DNA, 25 bp, Homo sapien
ggatcctcctccctgctagaatatg

SEQ ID NO: 219253 - DNA, 25 bp, Homo sapien
cacgtccgacggctgaggaatagca

SEQ ID NO: 219254 - DNA, 25 bp, Homo sapien
ccgtctccgttcattgtgctgtatt

SEQ ID NO: 219255 - DNA, 25 bp, Homo sapien
ggcatctgataggagcctcagtttc

SEQ ID NO: 219256 - DNA, 25 bp, Homo sapien
gtaggcctccgtttcacgggtgcta

SEQ ID NO: 219257 - DNA, 25 bp, Homo sapien
gtttcacgggtgctaagtaagtcga

SEQ ID NO: 219258 - DNA, 25 bp, Homo sapien
gtcgaaaagcaagggcatctgatag

SEQ ID NO: 219259 - DNA, 25 bp, Homo sapien
gcttagcgcgcctggctttccacag

SEQ ID NO: 219260 - DNA, 25 bp, Homo sapien
ccggcttcgggcctactcaagatgg

SEQ ID NO: 219261 - DNA, 25 bp, Homo sapien
cctactcaagatggggtttctcggg

SEQ ID NO: 219262 - DNA, 25 bp, Homo sapien
cgggtgctaagtaagtcgaaaagca

SEQ ID NO: 219263 - DNA, 25 bp, Homo sapien
gggcctcgacctcaacatggagctg

SEQ ID NO: 219264 - DNA, 25 bp, Homo sapien
tcaacctgaagttcgcggccaaaga

SEQ ID NO: 219265 - DNA, 25 bp, Homo sapien
gagccgtccgactatgtctaacatg

SEQ ID NO: 219266 - DNA, 25 bp, Homo sapien
gccgaaaatgccatccgccagaaga

SEQ ID NO: 219267 - DNA, 25 bp, Homo sapien
gagcggacttaccttaccttctctg

SEQ ID NO: 219268 - DNA, 25 bp, Homo sapien
attcgagcaccagtttgagactctg

SEQ ID NO: 219269 - DNA, 25 bp, Homo sapien
tgcgccgctcacagtagaaacagga

SEQ ID NO: 219270 - DNA, 25 bp, Homo sapien
tctggacgtccagacgcagcaaatg

SEQ ID NO: 219271 - DNA, 25 bp, Homo sapien
gccgtggacacagagaacatccgca

SEQ ID NO: 219272 - DNA, 25 bp, Homo sapien
ctcttgcagaggatcagcacggcca

SEQ ID NO: 219273 - DNA, 25 bp, Homo sapien
tgcacacgctctctcttgcagagga

SEQ ID NO: 219274 - DNA, 25 bp, Homo sapien
tgagctcttgtgaggatgctgccgc

SEQ ID NO: 219275 - DNA, 25 bp, Homo sapien
tccagcggatgcacctcaagcagta

SEQ ID NO: 219276 - DNA, 25 bp, Homo sapien
acatccgcagggtgttcaacgactg

SEQ ID NO: 219277 - DNA, 25 bp, Homo sapien
cggccaccggtgacggcaaacatta

SEQ ID NO: 219278 - DNA, 25 bp, Homo sapien
gactgccgcgacatcatccagcgga

SEQ ID NO: 219279 - DNA, 25 bp, Homo sapien
tccgtgcgcaactcggagtaaaggc

SEQ ID NO: 219280 - DNA, 25 bp, Homo sapien
gtgcgggagccctttcaccagggca

SEQ ID NO: 219281 - DNA, 25 bp, Homo sapien
aacttcctgtttccgcggtagcgcg

SEQ ID NO: 219282 - DNA, 25 bp, Homo sapien
agcgcgcgggcctgtcactgaagcc

SEQ ID NO: 219283 - DNA, 25 bp, Homo sapien
cccagagcggacaaccgcagctggg

SEQ ID NO: 219284 - DNA, 25 bp, Homo sapien
tctgagtgtcgcgttacagagtccc

SEQ ID NO: 219285 - DNA, 25 bp, Homo sapien
cgagctgtcgttagggcccaggaaa

SEQ ID NO: 219286 - DNA, 25 bp, Homo sapien
ctcggcagtctgagtgtcgcgttac

SEQ ID NO: 219287 - DNA, 25 bp, Homo sapien
tgagctcacacaaagacccttccag

SEQ ID NO: 219288 - DNA, 25 bp, Homo sapien
gccggaaaccttgcgtctcagattc

SEQ ID NO: 219289 - DNA, 25 bp, Homo sapien
ggccaagagccggaaaccttgcgtc

SEQ ID NO: 219290 - DNA, 25 bp, Homo sapien
ccctgatgccagctgcgggcctgga

SEQ ID NO: 219291 - DNA, 25 bp, Homo sapien
gtcctgagctcacacaaagaccctt

SEQ ID NO: 219292 - DNA, 25 bp, Homo sapien
tgctttgggccaggatcggcctcga

SEQ ID NO: 219293 - DNA, 25 bp, Homo sapien
aaagacccttccagcctcaccgagg

SEQ ID NO: 219294 - DNA, 25 bp, Homo sapien
gagccttcctcactagcggccaaga

SEQ ID NO: 219295 - DNA, 25 bp, Homo sapien
acgttgtcggcgaactctcttttca

SEQ ID NO: 219296 - DNA, 25 bp, Homo sapien
tccacggagatttggccaataaata

SEQ ID NO: 219297 - DNA, 25 bp, Homo sapien
catggttttgtctttgcgctcgtgg

SEQ ID NO: 219298 - DNA, 25 bp, Homo sapien
cttccggggacacctgaaatcagca

SEQ ID NO: 219299 - DNA, 25 bp, Homo sapien
ctggaactgacaatttggagagccc

SEQ ID NO: 219300 - DNA, 25 bp, Homo sapien
tgagacctgggttacaatacaagtc

SEQ ID NO: 219301 - DNA, 25 bp, Homo sapien
tacaagtctgacctcggggcgagtc

SEQ ID NO: 219302 - DNA, 25 bp, Homo sapien
ccacagctgtgaaccggtgagtgca

SEQ ID NO: 219303 - DNA, 25 bp, Homo sapien
tccgcgcgcttgacccagaacagta

SEQ ID NO: 219304 - DNA, 25 bp, Homo sapien
agcggaaagcaggacgcacggctcc

SEQ ID NO: 219305 - DNA, 25 bp, Homo sapien
caggctcggcactgatttgtgttca

SEQ ID NO: 219306 - DNA, 25 bp, Homo sapien
agagggaccaggctcggcactgatt

SEQ ID NO: 219307 - DNA, 25 bp, Homo sapien
cacgggcccggctcaacttgaggga

SEQ ID NO: 219308 - DNA, 25 bp, Homo sapien
aacagtacggagttctgcacgagcc

SEQ ID NO: 219309 - DNA, 25 bp, Homo sapien
gcttgacccagaacagtacggagtt

SEQ ID NO: 219310 - DNA, 25 bp, Homo sapien
gatttgtgttcagggctagcccaga

SEQ ID NO: 219311 - DNA, 25 bp, Homo sapien
ctgctccgccgaaggtcattcgcgg

SEQ ID NO: 219312 - DNA, 25 bp, Homo sapien
cctccctctgttaggggtcgtcgcg

SEQ ID NO: 219313 - DNA, 25 bp, Homo sapien
cagttgaccactccgcttctgctct

SEQ ID NO: 219314 - DNA, 25 bp, Homo sapien
taatgtctcccagttgaccactccg

SEQ ID NO: 219315 - DNA, 25 bp, Homo sapien
gccgcgtttaatgtctcccagttga

SEQ ID NO: 219316 - DNA, 25 bp, Homo sapien
ccttgccgcgtttaatgtctcccag

SEQ ID NO: 219317 - DNA, 25 bp, Homo sapien
ccgaaggtcattcgcggccgccgag

SEQ ID NO: 219318 - DNA, 25 bp, Homo sapien
ggtcgtcgcgcttctccgatttctc

SEQ ID NO: 219319 - DNA, 25 bp, Homo sapien
tgtcacctgggtcacatctccaagg

SEQ ID NO: 219320 - DNA, 25 bp, Homo sapien
atgccgttattccatgcgttgtgcc

SEQ ID NO: 219321 - DNA, 25 bp, Homo sapien
tgccagcgcggcctttagatgcttt

SEQ ID NO: 219322 - DNA, 25 bp, Homo sapien
ttcttcaaatcatgagggcactcgg

SEQ ID NO: 219323 - DNA, 25 bp, Homo sapien
tgagctttctcctcactctcaggga

SEQ ID NO: 219324 - DNA, 25 bp, Homo sapien
ccaccacttggggttgtctctgcaa

SEQ ID NO: 219325 - DNA, 25 bp, Homo sapien
gcgacagcacaacgggaacagactc

SEQ ID NO: 219326 - DNA, 25 bp, Homo sapien
gcggaggctttctttgccaagggca

SEQ ID NO: 219327 - DNA, 25 bp, Homo sapien
ggcaccgatgtgcagcaggtactca

SEQ ID NO: 219328 - DNA, 25 bp, Homo sapien
ttctccaaaatgacccagaggctgg

SEQ ID NO: 219329 - DNA, 25 bp, Homo sapien
ccatcggatctcagacaggaaggtc

SEQ ID NO: 219330 - DNA, 25 bp, Homo sapien
agcgtgatgttcttctcccatcgga

SEQ ID NO: 219331 - DNA, 25 bp, Homo sapien
cggctgcagcgctatagtcctggaa

SEQ ID NO: 219332 - DNA, 25 bp, Homo sapien
ggccattgcgtcacctggggccata

SEQ ID NO: 219333 - DNA, 25 bp, Homo sapien
aactcctgggcccatgttcatggca

SEQ ID NO: 219334 - DNA, 25 bp, Homo sapien
gtggggcatcccaagtcagcttctc

SEQ ID NO: 219335 - DNA, 25 bp, Homo sapien
gccattctgcagctcggatatctta

SEQ ID NO: 219336 - DNA, 25 bp, Homo sapien
ctaataagattgtttcggaggtcca

SEQ ID NO: 219337 - DNA, 25 bp, Homo sapien
gagttaacccagaaaatgagccatt

SEQ ID NO: 219338 - DNA, 25 bp, Homo sapien
ttactcagaatcagggtgaccgtgc

SEQ ID NO: 219339 - DNA, 25 bp, Homo sapien
cgacgtgctcctttgtcctctgcgg

SEQ ID NO: 219340 - DNA, 25 bp, Homo sapien
ccagatggtagaaggaagaagacgc

SEQ ID NO: 219341 - DNA, 25 bp, Homo sapien
cgcatgatagggaggagaataaaaa

SEQ ID NO: 219342 - DNA, 25 bp, Homo sapien
tcggaggtccaatctttcaaggaga

SEQ ID NO: 219343 - DNA, 25 bp, Homo sapien
ccctggtgcctaagggttctggccg

SEQ ID NO: 219344 - DNA, 25 bp, Homo sapien
tgcacatgcgcgctggtgcctaacg

SEQ ID NO: 219345 - DNA, 25 bp, Homo sapien
ttctccgcggatggcctcgtgggcc

SEQ ID NO: 219346 - DNA, 25 bp, Homo sapien
ggctcagggctgtttctccgcggat

SEQ ID NO: 219347 - DNA, 25 bp, Homo sapien
catgtgccctggtgcctaagggttc

SEQ ID NO: 219348 - DNA, 25 bp, Homo sapien
gcaggctgaggtgcgcatgtgccct

SEQ ID NO: 219349 - DNA, 25 bp, Homo sapien
tcgcgagagtgcgcagctcccgcga

SEQ ID NO: 219350 - DNA, 25 bp, Homo sapien
agggctgtttctccgcggatggcct

SEQ ID NO: 219351 - DNA, 25 bp, Homo sapien
gtgcgcttccaatcgccttgcgttc

SEQ ID NO: 219352 - DNA, 25 bp, Homo sapien
ccgggactatgcaggagccctcatc

SEQ ID NO: 219353 - DNA, 25 bp, Homo sapien
cgggcgtctgcaaaccaggtgacag

SEQ ID NO: 219354 - DNA, 25 bp, Homo sapien
gctgcatgcatctctggccgctgct

SEQ ID NO: 219355 - DNA, 25 bp, Homo sapien
cccgagcaaagcttccgcgatgcga

SEQ ID NO: 219356 - DNA, 25 bp, Homo sapien
accctcttgcagctgggcacaggta

SEQ ID NO: 219357 - DNA, 25 bp, Homo sapien
ctggaaatcacaacgggagctgggc

SEQ ID NO: 219358 - DNA, 25 bp, Homo sapien
gtggagagctcgtgccaaaacgtcc

SEQ ID NO: 219359 - DNA, 25 bp, Homo sapien
gaagccgccagcaggtgtctcgctc

SEQ ID NO: 219360 - DNA, 25 bp, Homo sapien
agaccagaacgctggagcaggaagc

SEQ ID NO: 219361 - DNA, 25 bp, Homo sapien
ggctgcgcaaccacctccctggatc

SEQ ID NO: 219362 - DNA, 25 bp, Homo sapien
ccacctgtaggcctttctgggcaaa

SEQ ID NO: 219363 - DNA, 25 bp, Homo sapien
ctgtaggcctttctgggcaaaacca

SEQ ID NO: 219364 - DNA, 25 bp, Homo sapien
ggcaaaaccagtttagactgagacc

SEQ ID NO: 219365 - DNA, 25 bp, Homo sapien
tttagactgagaccagaacgctgga

SEQ ID NO: 219366 - DNA, 25 bp, Homo sapien
gggtgtagatgccaccgccggccac

SEQ ID NO: 219367 - DNA, 25 bp, Homo sapien
tgatggtgcagaggcgtactccctc

SEQ ID NO: 219368 - DNA, 25 bp, Homo sapien
ctttctttggatgcaggtggccgca

SEQ ID NO: 219369 - DNA, 25 bp, Homo sapien
agctcagcccgaatgagcggtgtca

SEQ ID NO: 219370 - DNA, 25 bp, Homo sapien
tgtcaggctatgcaccgtgctcccg

SEQ ID NO: 219371 - DNA, 25 bp, Homo sapien
cagaggcgtactccctctcggggtc

SEQ ID NO: 219372 - DNA, 25 bp, Homo sapien
attccggcgtcctcggaacagccgg

SEQ ID NO: 219373 - DNA, 25 bp, Homo sapien
agcggtgtcaggctatgcaccgtgc

SEQ ID NO: 219374 - DNA, 25 bp, Homo sapien
cgtcgaggctttctttggatgcagg

SEQ ID NO: 219375 - DNA, 25 bp, Homo sapien
cttgccctgcccaagttttgggaag

SEQ ID NO: 219376 - DNA, 25 bp, Homo sapien
ccaagttttgggaagtgatcagcga

SEQ ID NO: 219377 - DNA, 25 bp, Homo sapien
gctcaggcgcgcctggaattcggcc

SEQ ID NO: 219378 - DNA, 25 bp, Homo sapien
accagatcggcaccaaggtgggcct

SEQ ID NO: 219379 - DNA, 25 bp, Homo sapien
gtccgcagagccagttcctagcgca

SEQ ID NO: 219380 - DNA, 25 bp, Homo sapien
cgcagttgccgctgtcgtccgcaga

SEQ ID NO: 219381 - DNA, 25 bp, Homo sapien
gcagagaccctgaaaagctccaccg

SEQ ID NO: 219382 - DNA, 25 bp, Homo sapien
tcaacgtctactacaatgagtcatc

SEQ ID NO: 219383 - DNA, 25 bp, Homo sapien
cacctgctcgtctgaatgacacgga

SEQ ID NO: 219384 - DNA, 25 bp, Homo sapien
gctgaccttaggaccgagcaccagg

SEQ ID NO: 219385 - DNA, 25 bp, Homo sapien
acggaacgctcccactgcaggcaaa

SEQ ID NO: 219386 - DNA, 25 bp, Homo sapien
tcctcctgcgcctggttgattcagc

SEQ ID NO: 219387 - DNA, 25 bp, Homo sapien
ctacgaggagtttgtccgtgtgctg

SEQ ID NO: 219388 - DNA, 25 bp, Homo sapien
ttccgcgtgttcgacaaggacggca

SEQ ID NO: 219389 - DNA, 25 bp, Homo sapien
gacggcaacggcaccgtggacttcc

SEQ ID NO: 219390 - DNA, 25 bp, Homo sapien
ctcgggagaagcagagctgacctta

SEQ ID NO: 219391 - DNA, 25 bp, Homo sapien
aatgccacactgtcggtgcaccagc

SEQ ID NO: 219392 - DNA, 25 bp, Homo sapien
acgggactctctttgttgcaggcca

SEQ ID NO: 219393 - DNA, 25 bp, Homo sapien
ggagccctacaatgccacactgtcg

SEQ ID NO: 219394 - DNA, 25 bp, Homo sapien
cagcaagatccgtgaggagttcccg

SEQ ID NO: 219395 - DNA, 25 bp, Homo sapien
agtggggtcaccacctcgctgcgct

SEQ ID NO: 219396 - DNA, 25 bp, Homo sapien
gagtgcgagcactgcgactgcctgc

SEQ ID NO: 219397 - DNA, 25 bp, Homo sapien
tctctttgttgcaggccagacgggt

SEQ ID NO: 219398 - DNA, 25 bp, Homo sapien
ccatgagtggggtcaccacctcgct

SEQ ID NO: 219399 - DNA, 25 bp, Homo sapien
ttacagacgccttcgttccgtgctc

SEQ ID NO: 219400 - DNA, 25 bp, Homo sapien
gtgctcgtgctgctgactcaaaatt

SEQ ID NO: 219401 - DNA, 25 bp, Homo sapien
tccttgcgactacatcgtgctcgtg

SEQ ID NO: 219402 - DNA, 25 bp, Homo sapien
gaggagcccaagctctcaacgcggc

SEQ ID NO: 219403 - DNA, 25 bp, Homo sapien
gcccaggtaggactcaccgtccgga

SEQ ID NO: 219404 - DNA, 25 bp, Homo sapien
gctctactgaagctgcgcgttttca

SEQ ID NO: 219405 - DNA, 25 bp, Homo sapien
ggtgaagcgcgaaaacccggctcta

SEQ ID NO: 219406 - DNA, 25 bp, Homo sapien
acatgaccttcgaggcttcaaccgc

SEQ ID NO: 219407 - DNA, 25 bp, Homo sapien
gggaagatctcgttcaaaaacctga

SEQ ID NO: 219408 - DNA, 25 bp, Homo sapien
gacttcctggccgtgatgacgcaga

SEQ ID NO: 219409 - DNA, 25 bp, Homo sapien
tcaactcgtggaaaccggttaatga

SEQ ID NO: 219410 - DNA, 25 bp, Homo sapien
tcgcctaagcaagatcccgcagatg

SEQ ID NO: 219411 - DNA, 25 bp, Homo sapien
aaaacctgaagcgtgtggccaacga

SEQ ID NO: 219412 - DNA, 25 bp, Homo sapien
gcatttgacctcttcgacgtggacg

SEQ ID NO: 219413 - DNA, 25 bp, Homo sapien
tcaggctctttgatgacgatgagac

SEQ ID NO: 219414 - DNA, 25 bp, Homo sapien
cctaagcccgagctcactgaggatc

SEQ ID NO: 219415 - DNA, 25 bp, Homo sapien
ggcatctgcagcaagcgcgcatcgc

SEQ ID NO: 219416 - DNA, 25 bp, Homo sapien
agaccgcaacttcggcgtcccggag

SEQ ID NO: 219417 - DNA, 25 bp, Homo sapien
caggaaaggccggacctcacagcgg

SEQ ID NO: 219418 - DNA, 25 bp, Homo sapien
atctggagctcggagcacgtgtttg

SEQ ID NO: 219419 - DNA, 25 bp, Homo sapien
ccggcggcaatgaagatctggagct

SEQ ID NO: 219420 - DNA, 25 bp, Homo sapien
gagctatttttagccgctgcagcca

SEQ ID NO: 219421 - DNA, 25 bp, Homo sapien
gccgcgcccgcagagctatttttag

SEQ ID NO: 219422 - DNA, 25 bp, Homo sapien
agccagcctagccaccagacggggt

SEQ ID NO: 219423 - DNA, 25 bp, Homo sapien
gatttgtcggaccagcctttcatta

SEQ ID NO: 219424 - DNA, 25 bp, Homo sapien
ccagcctttcattaaagtgaagaga

SEQ ID NO: 219425 - DNA, 25 bp, Homo sapien
agtgaagagactagcgcgttgccca

SEQ ID NO: 219426 - DNA, 25 bp, Homo sapien
cacccgtgggacacggtcatccagg

SEQ ID NO: 219427 - DNA, 25 bp, Homo sapien
ctcgcgggactcctcagatttgtcg

SEQ ID NO: 219428 - DNA, 25 bp, Homo sapien
acacggtcatccaggcggccatgcg

SEQ ID NO: 219429 - DNA, 25 bp, Homo sapien
gaacccgatgaacccgagcgtgctg

SEQ ID NO: 219430 - DNA, 25 bp, Homo sapien
catgcgcaagtacccgaacccgatg

SEQ ID NO: 219431 - DNA, 25 bp, Homo sapien
ggctcctccacaaacgctggcgggt

SEQ ID NO: 219432 - DNA, 25 bp, Homo sapien
aagcacgtctggctgcgagggcaca

SEQ ID NO: 219433 - DNA, 25 bp, Homo sapien
gacggaaaagcacgtctggctgcga

SEQ ID NO: 219434 - DNA, 25 bp, Homo sapien
actgatcgcgggtcgcaggtgaccc

SEQ ID NO: 219435 - DNA, 25 bp, Homo sapien
cctcatgagcgtgcaacagggagca

SEQ ID NO: 219436 - DNA, 25 bp, Homo sapien
acttaggctcctccacaaacgctgg

SEQ ID NO: 219437 - DNA, 25 bp, Homo sapien
tcggtcctgcagatcaccaagcagc

SEQ ID NO: 219438 - DNA, 25 bp, Homo sapien
cagatcaccaagcagctctcctggg

SEQ ID NO: 219439 - DNA, 25 bp, Homo sapien
cgtttgggaaaactgcgcagggctc

SEQ ID NO: 219440 - DNA, 25 bp, Homo sapien
tgcagacatgcagctctctccgtgg

SEQ ID NO: 219441 - DNA, 25 bp, Homo sapien
cgcaggcagctcgtttgggaaaact

SEQ ID NO: 219442 - DNA, 25 bp, Homo sapien
ggcctcagtggccaagcagtgtttg

SEQ ID NO: 219443 - DNA, 25 bp, Homo sapien
gggcggcctactgctcccatcgaag

SEQ ID NO: 219444 - DNA, 25 bp, Homo sapien
cgcagggtccgggactttcgccagc

SEQ ID NO: 219445 - DNA, 25 bp, Homo sapien
cagtgcgacccaacggcagccagag

SEQ ID NO: 219446 - DNA, 25 bp, Homo sapien
tctctccgtggaatgtgcatgtgca

SEQ ID NO: 219447 - DNA, 25 bp, Homo sapien
tcgtctgttatgcaggcagtgaacg

SEQ ID NO: 219448 - DNA, 25 bp, Homo sapien
catctaggctgagttctgggtttcc

SEQ ID NO: 219449 - DNA, 25 bp, Homo sapien
gccagagctgctcccgtaaatgctc

SEQ ID NO: 219450 - DNA, 25 bp, Homo sapien
gttctgctctgcgtactcgtccctg

SEQ ID NO: 219451 - DNA, 25 bp, Homo sapien
cgtccctggcgttgccactctgtga

SEQ ID NO: 219452 - DNA, 25 bp, Homo sapien
cactctgtgaccttgcctgcgtgtc

SEQ ID NO: 219453 - DNA, 25 bp, Homo sapien
gcacatggtcactccgccaggcttg

SEQ ID NO: 219454 - DNA, 25 bp, Homo sapien
gggctgtttggacatggcaccttcc

SEQ ID NO: 219455 - DNA, 25 bp, Homo sapien
cgagatggccgcacggtctctagcc

SEQ ID NO: 219456 - DNA, 25 bp, Homo sapien
ctctcagagtcgcaggcggtgacgc

SEQ ID NO: 219457 - DNA, 25 bp, Homo sapien
atgcacgctctggaggtgaggacca

SEQ ID NO: 219458 - DNA, 25 bp, Homo sapien
tcagctccggagcatcgtcgtcgcg

SEQ ID NO: 219459 - DNA, 25 bp, Homo sapien
gttgtacagccgcaggatctcctcc

SEQ ID NO: 219460 - DNA, 25 bp, Homo sapien
cctgctcctcgttgatgggctggtt

SEQ ID NO: 219461 - DNA, 25 bp, Homo sapien
cagccgcgggtgttccaagaactac

SEQ ID NO: 219462 - DNA, 25 bp, Homo sapien
gcccggtcgcaagggacacacagct

SEQ ID NO: 219463 - DNA, 25 bp, Homo sapien
ttgccggcttcaccctcctaatggt

SEQ ID NO: 219464 - DNA, 25 bp, Homo sapien
gcttcattctcacggccgtcctaaa

SEQ ID NO: 219465 - DNA, 25 bp, Homo sapien
ctttctcggagacgaggacgctctc

SEQ ID NO: 219466 - DNA, 25 bp, Homo sapien
gcgttaggagcgactggagcacaaa

SEQ ID NO: 219467 - DNA, 25 bp, Homo sapien
ccttgcttgccagggtctccgaaag

SEQ ID NO: 219468 - DNA, 25 bp, Homo sapien
tttccgccctctgaaccggcagtta

SEQ ID NO: 219469 - DNA, 25 bp, Homo sapien
tgctagcacctgctcggctcgtttt

SEQ ID NO: 219470 - DNA, 25 bp, Homo sapien
actgcgaccatgttcgttccctgcg

SEQ ID NO: 219471 - DNA, 25 bp, Homo sapien
tcagtttatggctccctcggctttc

SEQ ID NO: 219472 - DNA, 25 bp, Homo sapien
ctggcattgcttttacccggtgggc

SEQ ID NO: 219473 - DNA, 25 bp, Homo sapien
ggagcttccgtgatcgtcagccaaa

SEQ ID NO: 219474 - DNA, 25 bp, Homo sapien
ctgaagatgcttccgtccgcggata

SEQ ID NO: 219475 - DNA, 25 bp, Homo sapien
tccgctttctgctgagctctccgaa

SEQ ID NO: 219476 - DNA, 25 bp, Homo sapien
ctttgcgtttctccgcgcacttgga

SEQ ID NO: 219477 - DNA, 25 bp, Homo sapien
aggctcctggttttgatgtctggca

SEQ ID NO: 219478 - DNA, 25 bp, Homo sapien
agaggtcgcagcacttgtcagttta

SEQ ID NO: 219479 - DNA, 25 bp, Homo sapien
ttcctgagacttctccaaagcgggg

SEQ ID NO: 219480 - DNA, 25 bp, Homo sapien
cccagggaatacttaggggactgca

SEQ ID NO: 219481 - DNA, 25 bp, Homo sapien
aaatcactgctcagcgttagccgcg

SEQ ID NO: 219482 - DNA, 25 bp, Homo sapien
agaactttccagatcgccctgcgca

SEQ ID NO: 219483 - DNA, 25 bp, Homo sapien
gggctctcggagcttcccataaaac

SEQ ID NO: 219484 - DNA, 25 bp, Homo sapien
gtatcttcttcctcgccgtttcctg

SEQ ID NO: 219485 - DNA, 25 bp, Homo sapien
accattcctgatcggaggctgcgaa

SEQ ID NO: 219486 - DNA, 25 bp, Homo sapien
cggtgctgcttccaacgtatcttct

SEQ ID NO: 219487 - DNA, 25 bp, Homo sapien
ccagagaaagagctgtccgcgagca

SEQ ID NO: 219488 - DNA, 25 bp, Homo sapien
tccgcgagcaagaaccaagcacagc

SEQ ID NO: 219489 - DNA, 25 bp, Homo sapien
tccagaactaactgcgcttgcgcta

SEQ ID NO: 219490 - DNA, 25 bp, Homo sapien
gcttgcgctaaccatgagctgctca

SEQ ID NO: 219491 - DNA, 25 bp, Homo sapien
gccagcgacgctgagtatccaactc

SEQ ID NO: 219492 - DNA, 25 bp, Homo sapien
tgggtccgcgactcaccaagtacag

SEQ ID NO: 219493 - DNA, 25 bp, Homo sapien
ttcgaactcccgctcgatggtggtg

SEQ ID NO: 219494 - DNA, 25 bp, Homo sapien
gctgctcagctcaagtatgcttttt

SEQ ID NO: 219495 - DNA, 25 bp, Homo sapien
cgcggcaccactcttaaccgatgtt

SEQ ID NO: 219496 - DNA, 25 bp, Homo sapien
cccaggaaggcaattatttgatttt

SEQ ID NO: 219497 - DNA, 25 bp, Homo sapien
accgatgttgatttcccctttcaca

SEQ ID NO: 219498 - DNA, 25 bp, Homo sapien
cactcttaaccgatgttgatttccc

SEQ ID NO: 219499 - DNA, 25 bp, Homo sapien
ccactcttaaccgatgttgatttcc

SEQ ID NO: 219500 - DNA, 25 bp, Homo sapien
gcaccactcttaaccgatgttgatt

SEQ ID NO: 219501 - DNA, 25 bp, Homo sapien
cggcaccactcttaaccgatgttga

SEQ ID NO: 219502 - DNA, 25 bp, Homo sapien
gcggcaccactcttaaccgatgttg

SEQ ID NO: 219503 - DNA, 25 bp, Homo sapien
atcagcgttcggatgactgcaggcc

SEQ ID NO: 219504 - DNA, 25 bp, Homo sapien
tgcgctgtcaggacgcgcagttccc

SEQ ID NO: 219505 - DNA, 25 bp, Homo sapien
gctgaagggacaccgttttacaaca

SEQ ID NO: 219506 - DNA, 25 bp, Homo sapien
cctgaagagaccgtggctccgtctt

SEQ ID NO: 219507 - DNA, 25 bp, Homo sapien
actgcaggccgtgatttcggaaatg

SEQ ID NO: 219508 - DNA, 25 bp, Homo sapien
tgaaatcgaggccaccatcccgtgc

SEQ ID NO: 219509 - DNA, 25 bp, Homo sapien
caggaaccagcgcagatccggaggc

SEQ ID NO: 219510 - DNA, 25 bp, Homo sapien
cgcgtagaccgtgacagggaagtaa

SEQ ID NO: 219511 - DNA, 25 bp, Homo sapien
tcgttccgactctgacagtcccgtg

SEQ ID NO: 219512 - DNA, 25 bp, Homo sapien
actgtggctgtcgttccgactccga

SEQ ID NO: 219513 - DNA, 25 bp, Homo sapien
ctggtttgactgtggctgtcgttcc

SEQ ID NO: 219514 - DNA, 25 bp, Homo sapien
ggctgtcgttcctactccgacggtc

SEQ ID NO: 219515 - DNA, 25 bp, Homo sapien
actgtggctgtcgttccgactctga

SEQ ID NO: 219516 - DNA, 25 bp, Homo sapien
actgtggctgtcgttcctactccga

SEQ ID NO: 219517 - DNA, 25 bp, Homo sapien
gactgtggctgtcgttcctactccg

SEQ ID NO: 219518 - DNA, 25 bp, Homo sapien
tgtcgttccgactctgacggtcccg

SEQ ID NO: 219519 - DNA, 25 bp, Homo sapien
gcgggaaacttgtccttgcggttga

SEQ ID NO: 219520 - DNA, 25 bp, Homo sapien
cttgccgccgaacagcgtgagcgac

SEQ ID NO: 219521 - DNA, 25 bp, Homo sapien
acaccttgtagaactgcacgggcga

SEQ ID NO: 219522 - DNA, 25 bp, Homo sapien
tgagaacttgactcgggagaacttc

SEQ ID NO: 219523 - DNA, 25 bp, Homo sapien
gtgtcgatacggcacttctcgctca

SEQ ID NO: 219524 - DNA, 25 bp, Homo sapien
acaggctctcggtggacgtcagcac

SEQ ID NO: 219525 - DNA, 25 bp, Homo sapien
gctccgacatgtcccgggccaggaa

SEQ ID NO: 219526 - DNA, 25 bp, Homo sapien
gtccgccgtggccaccacgatgttg

SEQ ID NO: 219527 - DNA, 25 bp, Homo sapien
gactgtcctccggaaacaactgaga

SEQ ID NO: 219528 - DNA, 25 bp, Homo sapien
actccgactcggagagtgagtgagc

SEQ ID NO: 219529 - DNA, 25 bp, Homo sapien
gtggcggactactccgactcggaga

SEQ ID NO: 219530 - DNA, 25 bp, Homo sapien
ccgagatcatcagccgctcctggtt

SEQ ID NO: 219531 - DNA, 25 bp, Homo sapien
ggatccgcctccagcagcaaggtca

SEQ ID NO: 219532 - DNA, 25 bp, Homo sapien
tcagcggcgtcctgaagaagctggc

SEQ ID NO: 219533 - DNA, 25 bp, Homo sapien
cctgaagaagctggcacagagccgc

SEQ ID NO: 219534 - DNA, 25 bp, Homo sapien
atcaccgtcggggacctgggcatcg

SEQ ID NO: 219535 - DNA, 25 bp, Homo sapien
tagctccctctgagttgcgctgggc

SEQ ID NO: 219536 - DNA, 25 bp, Homo sapien
accatgaccctggaggcgatccgct

SEQ ID NO: 219537 - DNA, 25 bp, Homo sapien
cgcatgtgcgtgtctctttttccgg

SEQ ID NO: 219538 - DNA, 25 bp, Homo sapien
ttcggccacgtggaatccgcgtcct

SEQ ID NO: 219539 - DNA, 25 bp, Homo sapien
gcagatcctagaccagctgctgctg

SEQ ID NO: 219540 - DNA, 25 bp, Homo sapien
gccatccgcgccatgaaggtgcagc

SEQ ID NO: 219541 - DNA, 25 bp, Homo sapien
tcgtgcgcgacaagctgagcttcct

SEQ ID NO: 219542 - DNA, 25 bp, Homo sapien
cccgcgacctggctgatgttgcagc

SEQ ID NO: 219543 - DNA, 25 bp, Homo sapien
ccaggtcgtgttatcgctcccaaga

SEQ ID NO: 219544 - DNA, 25 bp, Homo sapien
tgtgccttccggctacgactgctca

SEQ ID NO: 219545 - DNA, 25 bp, Homo sapien
cagcggcagcctctgaaaagaatcg

SEQ ID NO: 219546 - DNA, 25 bp, Homo sapien
cgcgtcgtgcagcagcaaaagctca

SEQ ID NO: 219547 - DNA, 25 bp, Homo sapien
cgtgctagggacgagagatgaaatc

SEQ ID NO: 219548 - DNA, 25 bp, Homo sapien
tatcccgtgagttcttgcgtttttc

SEQ ID NO: 219549 - DNA, 25 bp, Homo sapien
caggcgcacaaacccgcaaagagta

SEQ ID NO: 219550 - DNA, 25 bp, Homo sapien
ccgctgtatcccatggttccctgtg

SEQ ID NO: 219551 - DNA, 25 bp, Homo sapien
gctggactgaaatcctgtgaggaag

SEQ ID NO: 219552 - DNA, 25 bp, Homo sapien
tcctgtgaggaagattcgcgccctc

SEQ ID NO: 219553 - DNA, 25 bp, Homo sapien
gggtccggctgccttcttgtagccc

SEQ ID NO: 219554 - DNA, 25 bp, Homo sapien
tcgcggtcctgtcaggtccgggcct

SEQ ID NO: 219555 - DNA, 25 bp, Homo sapien
cggctcacacgctcgggaagactgc

SEQ ID NO: 219556 - DNA, 25 bp, Homo sapien
tcagtaccagtaggcgcggctcaca

SEQ ID NO: 219557 - DNA, 25 bp, Homo sapien
agtcccaggagccacatgcgcatgc

SEQ ID NO: 219558 - DNA, 25 bp, Homo sapien
gcgagaagggccagagactctccga

SEQ ID NO: 219559 - DNA, 25 bp, Homo sapien
cggaagcgaccctcagtaaacaaag

SEQ ID NO: 219560 - DNA, 25 bp, Homo sapien
agcagcttcattgttgtgaagagtc

SEQ ID NO: 219561 - DNA, 25 bp, Homo sapien
tggcatcgcagtcatcgagtgagca

SEQ ID NO: 219562 - DNA, 25 bp, Homo sapien
ctgtgcgctctggttgggtaaacaa

SEQ ID NO: 219563 - DNA, 25 bp, Homo sapien
gtaaacaaagccgtgtgtgggcgca

SEQ ID NO: 219564 - DNA, 25 bp, Homo sapien
tagccgagagctgggccttcgagca

SEQ ID NO: 219565 - DNA, 25 bp, Homo sapien
acctcagcgccaagcgggtagccga

SEQ ID NO: 219566 - DNA, 25 bp, Homo sapien
aaactccgcataaggcctgggccgc

SEQ ID NO: 219567 - DNA, 25 bp, Homo sapien
tggagagcccgagcgcctctaccat

SEQ ID NO: 219568 - DNA, 25 bp, Homo sapien
attcggcacgcccaccaggtggagc

SEQ ID NO: 219569 - DNA, 25 bp, Homo sapien
ggaaacatccgcgagccagggagtc

SEQ ID NO: 219570 - DNA, 25 bp, Homo sapien
ctctaccatgtctccatcagctttg

SEQ ID NO: 219571 - DNA, 25 bp, Homo sapien
agatcacgtccgtgagctgcggctg

SEQ ID NO: 219572 - DNA, 25 bp, Homo sapien
gacaaccgcgacctcttctactgtg

SEQ ID NO: 219573 - DNA, 25 bp, Homo sapien
catcagctttgatcgctgcaagatc

SEQ ID NO: 219574 - DNA, 25 bp, Homo sapien
ttctactgtgcccacgtggtggccc

SEQ ID NO: 219575 - DNA, 25 bp, Homo sapien
catgacggacaagtgccggcagctc

SEQ ID NO: 219576 - DNA, 25 bp, Homo sapien
agatgctgcgaatgcgggactccaa

SEQ ID NO: 219577 - DNA, 25 bp, Homo sapien
ctgcgctccatgttcagcaaggtgc

SEQ ID NO: 219578 - DNA, 25 bp, Homo sapien
agcagctactgtccaatggcggcta

SEQ ID NO: 219579 - DNA, 25 bp, Homo sapien
ccaactgctggcacctggacgagga

SEQ ID NO: 219580 - DNA, 25 bp, Homo sapien
gcgcaggaatcgaggacgccaactg

SEQ ID NO: 219581 - DNA, 25 bp, Homo sapien
ttctcatgaccgagcagttcctgca

SEQ ID NO: 219582 - DNA, 25 bp, Homo sapien
gggcgcgcatgctgattctcatgac

SEQ ID NO: 219583 - DNA, 25 bp, Homo sapien
cccgcggcactatggggatttcatc

SEQ ID NO: 219584 - DNA, 25 bp, Homo sapien
atttcatcgaattcctgggcaaggc

SEQ ID NO: 219585 - DNA, 25 bp, Homo sapien
cgactgcagctggacacatcgcgga

SEQ ID NO: 219586 - DNA, 25 bp, Homo sapien
ccctgaccctgtgcgagaagaacca

SEQ ID NO: 219587 - DNA, 25 bp, Homo sapien
actgtggcccgctatatggagcacc

SEQ ID NO: 219588 - DNA, 25 bp, Homo sapien
gtcaacgacgtgctttgggcctgct

SEQ ID NO: 219589 - DNA, 25 bp, Homo sapien
tgcgcgatgaaggaccctcagaact

SEQ ID NO: 219590 - DNA, 25 bp, Homo sapien
ctgtccgatattctgcgccgctgga

SEQ ID NO: 219591 - DNA, 25 bp, Homo sapien
tgcatggggattggcttttcgcacc

SEQ ID NO: 219592 - DNA, 25 bp, Homo sapien
gtctgggatcttgcgccactgaaga

SEQ ID NO: 219593 - DNA, 25 bp, Homo sapien
tgaagaggctcccagtcgtcaaata

SEQ ID NO: 219594 - DNA, 25 bp, Homo sapien
gcgagaaagcccgtggttgtctaaa

SEQ ID NO: 219595 - DNA, 25 bp, Homo sapien
tggttgtctaaacgtccctggctcc

SEQ ID NO: 219596 - DNA, 25 bp, Homo sapien
ggccttcctgccttttggatgaatg

SEQ ID NO: 219597 - DNA, 25 bp, Homo sapien
aatggagatgctgtgtctgggtcac

SEQ ID NO: 219598 - DNA, 25 bp, Homo sapien
ccgcgcgtattccagcaggtatgtg

SEQ ID NO: 219599 - DNA, 25 bp, Homo sapien
tcgccaccgtcagacgcactgtccc

SEQ ID NO: 219600 - DNA, 25 bp, Homo sapien
cggcgccctcgccttctcgcaacgc

SEQ ID NO: 219601 - DNA, 25 bp, Homo sapien
tcgccttctcgcaacgctcttgggg

SEQ ID NO: 219602 - DNA, 25 bp, Homo sapien
cgccttctcgcaacgctcttgggga

SEQ ID NO: 219603 - DNA, 25 bp, Homo sapien
agccaggcgcggaaaagttgccggc

SEQ ID NO: 219604 - DNA, 25 bp, Homo sapien
ggcgcggaaaagttgccggcgccgc

SEQ ID NO: 219605 - DNA, 25 bp, Homo sapien
ccgccgtcgccaccgtcagacgcac

SEQ ID NO: 219606 - DNA, 25 bp, Homo sapien
accgcattcccatgcgtcccctggg

SEQ ID NO: 219607 - DNA, 25 bp, Homo sapien
cgggagctgcgttttggagacccac

SEQ ID NO: 219608 - DNA, 25 bp, Homo sapien
tggggcgctcggaaatcgaatgcca

SEQ ID NO: 219609 - DNA, 25 bp, Homo sapien
tcgaatgccagaagagagtacggcc

SEQ ID NO: 219610 - DNA, 25 bp, Homo sapien
ccctccattgttgttggggcttgga

SEQ ID NO: 219611 - DNA, 25 bp, Homo sapien
atgcaatttcccgtgcaggcgcctc

SEQ ID NO: 219612 - DNA, 25 bp, Homo sapien
atctctgcgtctcgcctttccggag

SEQ ID NO: 219613 - DNA, 25 bp, Homo sapien
gggcacgtcaccgagacagacaggc

SEQ ID NO: 219614 - DNA, 25 bp, Homo sapien
cccggagccgccgaaatgcaatttc

SEQ ID NO: 219615 - DNA, 25 bp, Homo sapien
cgcctggcatccagacgggctgttt

SEQ ID NO: 219616 - DNA, 25 bp, Homo sapien
cgaggctttctaagcgcctggcatc

SEQ ID NO: 219617 - DNA, 25 bp, Homo sapien
tcctcgaggctttctaagcgcctgg

SEQ ID NO: 219618 - DNA, 25 bp, Homo sapien
cacagggaacagagggggcacctcc

SEQ ID NO: 219619 - DNA, 25 bp, Homo sapien
actgacagggaacacctgtggccga

SEQ ID NO: 219620 - DNA, 25 bp, Homo sapien
gggctgactgacagggaacacctgt

SEQ ID NO: 219621 - DNA, 25 bp, Homo sapien
aggaagagcccgcagacaggcaagc

SEQ ID NO: 219622 - DNA, 25 bp, Homo sapien
catccagacgggctgtttcgcttcg

SEQ ID NO: 219623 - DNA, 25 bp, Homo sapien
ctctttgaggactggcttaggggtt

SEQ ID NO: 219624 - DNA, 25 bp, Homo sapien
caggtcaaaagcgacggggctctaa

SEQ ID NO: 219625 - DNA, 25 bp, Homo sapien
tgggagtctatatgggcgggtttta

SEQ ID NO: 219626 - DNA, 25 bp, Homo sapien
agctgggctctttgaggactggctt

SEQ ID NO: 219627 - DNA, 25 bp, Homo sapien
cgtctatagagcaggcttttgtgga

SEQ ID NO: 219628 - DNA, 25 bp, Homo sapien
tcccggggcgtctatagagcaggct

SEQ ID NO: 219629 - DNA, 25 bp, Homo sapien
gaaagggctctagaaggtgccggga

SEQ ID NO: 219630 - DNA, 25 bp, Homo sapien
ttctggggaacaggtcaaaagcgac

SEQ ID NO: 219631 - DNA, 25 bp, Homo sapien
agttcagatgctgtgtgaccgcgca

SEQ ID NO: 219632 - DNA, 25 bp, Homo sapien
catccctggtcgtcactgcttggct

SEQ ID NO: 219633 - DNA, 25 bp, Homo sapien
ctggtcgtcactgcttggcttgcgg

SEQ ID NO: 219634 - DNA, 25 bp, Homo sapien
gtggtcgccgaactctgtgcgatca

SEQ ID NO: 219635 - DNA, 25 bp, Homo sapien
cgccgaactctgtgcgatcactgga

SEQ ID NO: 219636 - DNA, 25 bp, Homo sapien
actctgtgcgatcactggaggaagg

SEQ ID NO: 219637 - DNA, 25 bp, Homo sapien
ccctccggaagtgcccgagttcaga

SEQ ID NO: 219638 - DNA, 25 bp, Homo sapien
tgcccgagttcagatgctgtgtgac

SEQ ID NO: 219639 - DNA, 25 bp, Homo sapien
gcccatttttcttgcctagcgagtg

SEQ ID NO: 219640 - DNA, 25 bp, Homo sapien
cccgtctctgattgggcagcttctc

SEQ ID NO: 219641 - DNA, 25 bp, Homo sapien
ccctgctggaggcttactctgtagc

SEQ ID NO: 219642 - DNA, 25 bp, Homo sapien
ggagttgtcactctaccctgctgga

SEQ ID NO: 219643 - DNA, 25 bp, Homo sapien
ggcggccaggctattaacacccttc

SEQ ID NO: 219644 - DNA, 25 bp, Homo sapien
tgtggtcacccacggtacctctttg

SEQ ID NO: 219645 - DNA, 25 bp, Homo sapien
ctttgggcttacttacagatgcatc

SEQ ID NO: 219646 - DNA, 25 bp, Homo sapien
tggccgccttagcttcaacagtaac

SEQ ID NO: 219647 - DNA, 25 bp, Homo sapien
tgcccacttactggccagggctaca

SEQ ID NO: 219648 - DNA, 25 bp, Homo sapien
accacccgaaactcggcaggcaaga

SEQ ID NO: 219649 - DNA, 25 bp, Homo sapien
acccaaggatcagaagcgcagcctg

SEQ ID NO: 219650 - DNA, 25 bp, Homo sapien
cgaacgcctgtgctctttctgcaaa

SEQ ID NO: 219651 - DNA, 25 bp, Homo sapien
tttctgcaaacacaacggcgagtcc

SEQ ID NO: 219652 - DNA, 25 bp, Homo sapien
atctaccagtcccacgtgctgaagg

SEQ ID NO: 219653 - DNA, 25 bp, Homo sapien
tcccacgtgctgaaggacgaggctg

SEQ ID NO: 219654 - DNA, 25 bp, Homo sapien
agctggtccggcctgacaaggcgaa

SEQ ID NO: 219655 - DNA, 25 bp, Homo sapien
gcaacttggggagcgttgagtcatc

SEQ ID NO: 219656 - DNA, 25 bp, Homo sapien
gccacgagagggcaccacagtcgca

SEQ ID NO: 219657 - DNA, 25 bp, Homo sapien
tcacggggtcgctgtctccggagca

SEQ ID NO: 219658 - DNA, 25 bp, Homo sapien
ccagagacgtcacggggtcgctgtc

SEQ ID NO: 219659 - DNA, 25 bp, Homo sapien
ctgtgctttgtctcgggctctgggt

SEQ ID NO: 219660 - DNA, 25 bp, Homo sapien
aactcctgtgctttgtctcgggctc

SEQ ID NO: 219661 - DNA, 25 bp, Homo sapien
gcagaatcggaactcctgtgctttg

SEQ ID NO: 219662 - DNA, 25 bp, Homo sapien
agggcaccacagtcgcagaatcgga

SEQ ID NO: 219663 - DNA, 25 bp, Homo sapien
tgacactacgccgaccaccgagaag

SEQ ID NO: 219664 - DNA, 25 bp, Homo sapien
gccgaccaccgagaagtgaggactc

SEQ ID NO: 219665 - DNA, 25 bp, Homo sapien
tgaggactccacaggccgagagccc

SEQ ID NO: 219666 - DNA, 25 bp, Homo sapien
ccgagagcccacgtgaagccggagc

SEQ ID NO: 219667 - DNA, 25 bp, Homo sapien
cggtgactgacagacgctctgaacc

SEQ ID NO: 219668 - DNA, 25 bp, Homo sapien
ccacgcactacctgccgggagttgt

SEQ ID NO: 219669 - DNA, 25 bp, Homo sapien
ggtccgggcatccagccttgaagat

SEQ ID NO: 219670 - DNA, 25 bp, Homo sapien
ccagccttgaagatgcacaagagga

SEQ ID NO: 219671 - DNA, 25 bp, Homo sapien
tccgcagctggttgcgttgcagctg

SEQ ID NO: 219672 - DNA, 25 bp, Homo sapien
ttgccatagaggtgcagcgtgtgca

SEQ ID NO: 219673 - DNA, 25 bp, Homo sapien
gcagcaacaaatagcgcagaccacg

SEQ ID NO: 219674 - DNA, 25 bp, Homo sapien
cgcggtccagcccattgccatagag

SEQ ID NO: 219675 - DNA, 25 bp, Homo sapien
agccgggttagctgattccctgcca

SEQ ID NO: 219676 - DNA, 25 bp, Homo sapien
ctgagctcccgcagttggtccaggc

SEQ ID NO: 219677 - DNA, 25 bp, Homo sapien
gccaggcggttataggccaggttaa

SEQ ID NO: 219678 - DNA, 25 bp, Homo sapien
gccaggttaagctccgtcaggcccg

SEQ ID NO: 219679 - DNA, 25 bp, Homo sapien
tcaaagttatctgggcagggcgaac

SEQ ID NO: 219680 - DNA, 25 bp, Homo sapien
gattctcgagccttggtggaccaca

SEQ ID NO: 219681 - DNA, 25 bp, Homo sapien
accgcctgtggtctccatggaaacc

SEQ ID NO: 219682 - DNA, 25 bp, Homo sapien
cgcccaagtatgctcgtcaggcctt

SEQ ID NO: 219683 - DNA, 25 bp, Homo sapien
ctccgagtggtacgtccttaaggcg

SEQ ID NO: 219684 - DNA, 25 bp, Homo sapien
gggctgttactgtcgctaccaatca

SEQ ID NO: 219685 - DNA, 25 bp, Homo sapien
ccgctgtcccgaaaaaggaccaatg

SEQ ID NO: 219686 - DNA, 25 bp, Homo sapien
aatggcgcccagctcgaaatcggag

SEQ ID NO: 219687 - DNA, 25 bp, Homo sapien
cgtgacatctacgtcagcaccgtgg

SEQ ID NO: 219688 - DNA, 25 bp, Homo sapien
tcggccaacgggatgctcatgaaca

SEQ ID NO: 219689 - DNA, 25 bp, Homo sapien
tcttcggcttcaagtgagaccaggc

SEQ ID NO: 219690 - DNA, 25 bp, Homo sapien
acgcctccaaggtcatcgtcttcgg

SEQ ID NO: 219691 - DNA, 25 bp, Homo sapien
gcgacctgtacctgaccgtatgcga

SEQ ID NO: 219692 - DNA, 25 bp, Homo sapien
tcggctattccaggacgaggagatc

SEQ ID NO: 219693 - DNA, 25 bp, Homo sapien
tcacaggtccggcaggttcggctat

SEQ ID NO: 219694 - DNA, 25 bp, Homo sapien
gagtgacgagaaccaccgtgacatc

SEQ ID NO: 219695 - DNA, 25 bp, Homo sapien
cgcggtgctcgatcaggtagtacat

SEQ ID NO: 219696 - DNA, 25 bp, Homo sapien
cgtcttttgtgtcagagtttgcagc

SEQ ID NO: 219697 - DNA, 25 bp, Homo sapien
ctggagcagtgaccacgaagccaca

SEQ ID NO: 219698 - DNA, 25 bp, Homo sapien
gccacagaagctttgagggaccctg

SEQ ID NO: 219699 - DNA, 25 bp, Homo sapien
ccagccgccagtgagatgtcctgcg

SEQ ID NO: 219700 - DNA, 25 bp, Homo sapien
tgggaacacgcctcgcctacctttg

SEQ ID NO: 219701 - DNA, 25 bp, Homo sapien
agtgactcaggctggatcccgcaca

SEQ ID NO: 219702 - DNA, 25 bp, Homo sapien
ctcctcgtctggaacacagggacca

SEQ ID NO: 219703 - DNA, 25 bp, Homo sapien
tctctggatcctgaccctctggtcg

SEQ ID NO: 219704 - DNA, 25 bp, Homo sapien
aagaccactttctgctgcggcagga

SEQ ID NO: 219705 - DNA, 25 bp, Homo sapien
ccgtgccgaacactagcacctgggg

SEQ ID NO: 219706 - DNA, 25 bp, Homo sapien
agcacctgggggattctctggatcc

SEQ ID NO: 219707 - DNA, 25 bp, Homo sapien
cgtggcggccgtgccgaacactagc

SEQ ID NO: 219708 - DNA, 25 bp, Homo sapien
gatcctgaccctctggtcggggctg

SEQ ID NO: 219709 - DNA, 25 bp, Homo sapien
tggctcgaagaccactttctgctgc

SEQ ID NO: 219710 - DNA, 25 bp, Homo sapien
agccgggacagtggctcgaagacca

SEQ ID NO: 219711 - DNA, 25 bp, Homo sapien
ccgcctccggggctatttgcatacg

SEQ ID NO: 219712 - DNA, 25 bp, Homo sapien
ctcccaaagacttctgggagggcgg

SEQ ID NO: 219713 - DNA, 25 bp, Homo sapien
gtaacaaccagtcgcctgaggcgtg

SEQ ID NO: 219714 - DNA, 25 bp, Homo sapien
ttcctcggtaacaaccagtcgcctg

SEQ ID NO: 219715 - DNA, 25 bp, Homo sapien
tgcgatcttccctagcgcctcgggt

SEQ ID NO: 219716 - DNA, 25 bp, Homo sapien
gtccgcggtgcgatcttccctagcg

SEQ ID NO: 219717 - DNA, 25 bp, Homo sapien
tggtcggcccgtgcgccaagctcag

SEQ ID NO: 219718 - DNA, 25 bp, Homo sapien
ccctcgggtccgtggacacggtcag

SEQ ID NO: 219719 - DNA, 25 bp, Homo sapien
tcctggttcgactaaagggacgtca

SEQ ID NO: 219720 - DNA, 25 bp, Homo sapien
ggacttcccggcgatctgatttatc

SEQ ID NO: 219721 - DNA, 25 bp, Homo sapien
tgcacgcttttcaacaccctctgga

SEQ ID NO: 219722 - DNA, 25 bp, Homo sapien
taccaaaggtttgccgcgctctctg

SEQ ID NO: 219723 - DNA, 25 bp, Homo sapien
tccgctcttgcgtacactttacatg

SEQ ID NO: 219724 - DNA, 25 bp, Homo sapien
tttctggcttcttgcgctgacgtca

SEQ ID NO: 219725 - DNA, 25 bp, Homo sapien
ccggactcgggattcgatgacgtca

SEQ ID NO: 219726 - DNA, 25 bp, Homo sapien
gccaggccttgcagctaaactatta

SEQ ID NO: 219727 - DNA, 25 bp, Homo sapien
ttgctttcgctcaggctcaagattc

SEQ ID NO: 219728 - DNA, 25 bp, Homo sapien
gtgctcgtcatcatcgccgtgttca

SEQ ID NO: 219729 - DNA, 25 bp, Homo sapien
gctactggtacttcggcaaggcttg

SEQ ID NO: 219730 - DNA, 25 bp, Homo sapien
gctgctcaccgtgttcggcaacgtg

SEQ ID NO: 219731 - DNA, 25 bp, Homo sapien
ccttactccctgcaggtgacgctga

SEQ ID NO: 219732 - DNA, 25 bp, Homo sapien
caggccaccgatgatttttgttctc

SEQ ID NO: 219733 - DNA, 25 bp, Homo sapien
agtcggtaatcgcttcggggatgta

SEQ ID NO: 219734 - DNA, 25 bp, Homo sapien
ccgcgttcatgttccgccaggagca

SEQ ID NO: 219735 - DNA, 25 bp, Homo sapien
ccacgcgtatgcagagcgaacggta

SEQ ID NO: 219736 - DNA, 25 bp, Homo sapien
aacggtagaggtgcaggcgccactc

SEQ ID NO: 219737 - DNA, 25 bp, Homo sapien
ggatgcgcggtacgcggtaccaccc

SEQ ID NO: 219738 - DNA, 25 bp, Homo sapien
tacccagagctcgaagaggagcagc

SEQ ID NO: 219739 - DNA, 25 bp, Homo sapien
cgctgctgcctctgttgtgggtgct

SEQ ID NO: 219740 - DNA, 25 bp, Homo sapien
ttgtgggtgcttttccagcggacgc

SEQ ID NO: 219741 - DNA, 25 bp, Homo sapien
ccaggataagccacgcgtatgcaga

SEQ ID NO: 219742 - DNA, 25 bp, Homo sapien
agtgctccaggataagccacgcgta

SEQ ID NO: 219743 - DNA, 25 bp, Homo sapien
ccttgagacgctccacgcggagttt

SEQ ID NO: 219744 - DNA, 25 bp, Homo sapien
aaccttgagacgctccacgcggagt

SEQ ID NO: 219745 - DNA, 25 bp, Homo sapien
ttctcctgcgcacagaggacccgga

SEQ ID NO: 219746 - DNA, 25 bp, Homo sapien
accttgagacgctccacgcggagtt

SEQ ID NO: 219747 - DNA, 25 bp, Homo sapien
cgctccacgcggagtttctcctcct

SEQ ID NO: 219748 - DNA, 25 bp, Homo sapien
tctcctgcgcacagaggacccggag

SEQ ID NO: 219749 - DNA, 25 bp, Homo sapien
tggcccagcgcgggtctgcacccag

SEQ ID NO: 219750 - DNA, 25 bp, Homo sapien
cttgagacgctccacgcggagtttc

SEQ ID NO: 219751 - DNA, 25 bp, Homo sapien
ccatgacattgtgagagccagagag

SEQ ID NO: 219752 - DNA, 25 bp, Homo sapien
aggccaagaagcctgcattagtggc

SEQ ID NO: 219753 - DNA, 25 bp, Homo sapien
gcctgcattagtggccaagtcctcc

SEQ ID NO: 219754 - DNA, 25 bp, Homo sapien
ctgtgtgcgctctatcgagctggac

SEQ ID NO: 219755 - DNA, 25 bp, Homo sapien
tctatcgagctggacgggctggtct

SEQ ID NO: 219756 - DNA, 25 bp, Homo sapien
gatgaacaggcctgtggcaggtgcc

SEQ ID NO: 219757 - DNA, 25 bp, Homo sapien
cgtgatcctccatgacattgtgaga

SEQ ID NO: 219758 - DNA, 25 bp, Homo sapien
ccagcgtgatcctccatgacattgt

SEQ ID NO: 219759 - DNA, 25 bp, Homo sapien
actgggcgcgctagttgatgaaact

SEQ ID NO: 219760 - DNA, 25 bp, Homo sapien
tcttccaagaagtcccgtgccctga

SEQ ID NO: 219761 - DNA, 25 bp, Homo sapien
agcggttcatggagacgcccatcga

SEQ ID NO: 219762 - DNA, 25 bp, Homo sapien
cgagccatcagtcgagcaggacgca

SEQ ID NO: 219763 - DNA, 25 bp, Homo sapien
tcctggagcaagagagcgaagtcct

SEQ ID NO: 219764 - DNA, 25 bp, Homo sapien
tgaggcttccgaactgcttccaacc

SEQ ID NO: 219765 - DNA, 25 bp, Homo sapien
tgacggggacatggctctgaaaaag

SEQ ID NO: 219766 - DNA, 25 bp, Homo sapien
tgtcctcgctctgggaatcaaaacc

SEQ ID NO: 219767 - DNA, 25 bp, Homo sapien
ttacccgtgtgcctctagcgcttgt

SEQ ID NO: 219768 - DNA, 25 bp, Homo sapien
tcagaactcagtctgggacgcatcc

SEQ ID NO: 219769 - DNA, 25 bp, Homo sapien
ggagggccactctggtcagaactca

SEQ ID NO: 219770 - DNA, 25 bp, Homo sapien
atcctccctggagggccactctggt

SEQ ID NO: 219771 - DNA, 25 bp, Homo sapien
cttggtggggaaaagtgcatcctcc

SEQ ID NO: 219772 - DNA, 25 bp, Homo sapien
cgtgtgcctctagcgcttgtcggtc

SEQ ID NO: 219773 - DNA, 25 bp, Homo sapien
cccgcagaaaggtctcggagaacgg

SEQ ID NO: 219774 - DNA, 25 bp, Homo sapien
ccctccggtgccaggacgcttggtg

SEQ ID NO: 219775 - DNA, 25 bp, Homo sapien
gttcacaccctctcgtttccaggct

SEQ ID NO: 219776 - DNA, 25 bp, Homo sapien
ggcgcgcttaccgagttcacaccct

SEQ ID NO: 219777 - DNA, 25 bp, Homo sapien
tcacaccctctcgtttccaggcttc

SEQ ID NO: 219778 - DNA, 25 bp, Homo sapien
agttcacaccctctcgtttccaggc

SEQ ID NO: 219779 - DNA, 25 bp, Homo sapien
gagttcacaccctctcgtttccagg

SEQ ID NO: 219780 - DNA, 25 bp, Homo sapien
gcgcttaccgagttcacaccctctc

SEQ ID NO: 219781 - DNA, 25 bp, Homo sapien
cgcgcttaccgagttcacaccctct

SEQ ID NO: 219782 - DNA, 25 bp, Homo sapien
gcgcgcttaccgagttcacaccctc

SEQ ID NO: 219783 - DNA, 25 bp, Homo sapien
cgcaaaatgtggcgcgcttaccgag

SEQ ID NO: 219784 - DNA, 25 bp, Homo sapien
ccgggcgcaaaatgtggcgcgctta

SEQ ID NO: 219785 - DNA, 25 bp, Homo sapien
gcacggccagacacggcctggccca

SEQ ID NO: 219786 - DNA, 25 bp, Homo sapien
aatgcgcccttaccgccctgctctg

SEQ ID NO: 219787 - DNA, 25 bp, Homo sapien
gaatgcgggaatgcgcccttaccgc

SEQ ID NO: 219788 - DNA, 25 bp, Homo sapien
gccggaatgcgggaatgcgccctta

SEQ ID NO: 219789 - DNA, 25 bp, Homo sapien
cggaatgcgggaatgcgcccttacc

SEQ ID NO: 219790 - DNA, 25 bp, Homo sapien
ggcgcaaaatgtggcgcgcttaccg

SEQ ID NO: 219791 - DNA, 25 bp, Homo sapien
ccctattctggagtttggaactgtc

SEQ ID NO: 219792 - DNA, 25 bp, Homo sapien
ctcgggcccttaggaaactgatcga

SEQ ID NO: 219793 - DNA, 25 bp, Homo sapien
actgatcgagggcactttcctgggg

SEQ ID NO: 219794 - DNA, 25 bp, Homo sapien
gcgcgtcgggaaaagtagtcttcta

SEQ ID NO: 219795 - DNA, 25 bp, Homo sapien
gtgggcgtagccttaagtctcttcc

SEQ ID NO: 219796 - DNA, 25 bp, Homo sapien
tcctccagtggacgttgaatttccc

SEQ ID NO: 219797 - DNA, 25 bp, Homo sapien
tggcgaattccaggcttctttcaaa

SEQ ID NO: 219798 - DNA, 25 bp, Homo sapien
cctttttgcttcatgtgcgcctatg

SEQ ID NO: 219799 - DNA, 25 bp, Homo sapien
cacgcgctccaggaacctggcggtg

SEQ ID NO: 219800 - DNA, 25 bp, Homo sapien
cggcatcttcaggatccggctcaga

SEQ ID NO: 219801 - DNA, 25 bp, Homo sapien
tccggctcagatgggttcccaggcc

SEQ ID NO: 219802 - DNA, 25 bp, Homo sapien
ctcgaaccactgctctgtagccatg

SEQ ID NO: 219803 - DNA, 25 bp, Homo sapien
cactgctctgtagccatggtagggc

SEQ ID NO: 219804 - DNA, 25 bp, Homo sapien
ggcgggaacctgagctctttaagct

SEQ ID NO: 219805 - DNA, 25 bp, Homo sapien
ttgaatttcaacacgcgggaggggc

SEQ ID NO: 219806 - DNA, 25 bp, Homo sapien
ggccgttcgcctcttttgaatttca

SEQ ID NO: 219807 - DNA, 25 bp, Homo sapien
tcccgcgccactataggctctcagc

SEQ ID NO: 219808 - DNA, 25 bp, Homo sapien
cgtcattcataaggcctggcgctgg

SEQ ID NO: 219809 - DNA, 25 bp, Homo sapien
cgccggcgtcattcataaggcctgg

SEQ ID NO: 219810 - DNA, 25 bp, Homo sapien
cagaacgctcagtgtcaatccgggg

SEQ ID NO: 219811 - DNA, 25 bp, Homo sapien
ttcccagccgcactcaggaggatgc

SEQ ID NO: 219812 - DNA, 25 bp, Homo sapien
cagacgcgtccgattggccgagacg

SEQ ID NO: 219813 - DNA, 25 bp, Homo sapien
cgggaacctcagcccaagatctctg

SEQ ID NO: 219814 - DNA, 25 bp, Homo sapien
cccagcagaacgctcagtgtcaatc

SEQ ID NO: 219815 - DNA, 25 bp, Homo sapien
attactgaccttcatctgccgcttc

SEQ ID NO: 219816 - DNA, 25 bp, Homo sapien
aggtcagcacctgcagacgggacca

SEQ ID NO: 219817 - DNA, 25 bp, Homo sapien
ggtgccgattactgaccttcatctg

SEQ ID NO: 219818 - DNA, 25 bp, Homo sapien
caggaaatccaggtgccgattactg

SEQ ID NO: 219819 - DNA, 25 bp, Homo sapien
ctgtgctgctccaggtaggcggaca

SEQ ID NO: 219820 - DNA, 25 bp, Homo sapien
gccatcagctgtgctgctccaggta

SEQ ID NO: 219821 - DNA, 25 bp, Homo sapien
ggggccgccatcagctgtgctgctc

SEQ ID NO: 219822 - DNA, 25 bp, Homo sapien
aggtagaggtgcctcggacctgcac

SEQ ID NO: 219823 - DNA, 25 bp, Homo sapien
ctgcagtggcgcaccctgatgacgc

SEQ ID NO: 219824 - DNA, 25 bp, Homo sapien
cgagcccgaccgatttctcagggag

SEQ ID NO: 219825 - DNA, 25 bp, Homo sapien
cagggaataggggacacgactgccc

SEQ ID NO: 219826 - DNA, 25 bp, Homo sapien
accctgatgacgcaaccggcgcgtg

SEQ ID NO: 219827 - DNA, 25 bp, Homo sapien
cgcaaccggcgcgtggcattgacgc

SEQ ID NO: 219828 - DNA, 25 bp, Homo sapien
atccgagggtgtaatgtgtgtactc

SEQ ID NO: 219829 - DNA, 25 bp, Homo sapien
tgtaatgtgtgtactcgagtgtgcg

SEQ ID NO: 219830 - DNA, 25 bp, Homo sapien
tttctcagggagaagaccggagctc

SEQ ID NO: 219831 - DNA, 25 bp, Homo sapien
tagcgtgtccgctggaaaccaatcc

SEQ ID NO: 219832 - DNA, 25 bp, Homo sapien
ccagcgtctccgacttggatgtcaa

SEQ ID NO: 219833 - DNA, 25 bp, Homo sapien
tccttctggccaatcctgagggttc

SEQ ID NO: 219834 - DNA, 25 bp, Homo sapien
tcgcctcgcttttccgggagatgca

SEQ ID NO: 219835 - DNA, 25 bp, Homo sapien
cgtctgtcaacaggtgagcgtttcc

SEQ ID NO: 219836 - DNA, 25 bp, Homo sapien
ctccgagaactgaagtgcgcaccta

SEQ ID NO: 219837 - DNA, 25 bp, Homo sapien
ggcgaaactatctccaagcttctta

SEQ ID NO: 219838 - DNA, 25 bp, Homo sapien
agcttttctgagtggctcctgaccc

SEQ ID NO: 219839 - DNA, 25 bp, Homo sapien
gatcatcttctcaaaggccgccgca

SEQ ID NO: 219840 - DNA, 25 bp, Homo sapien
gtgcagctctccgactcgtccagat

SEQ ID NO: 219841 - DNA, 25 bp, Homo sapien
gatcgctctggtacagcaccgactg

SEQ ID NO: 219842 - DNA, 25 bp, Homo sapien
cctccagggccttatagagaagttc

SEQ ID NO: 219843 - DNA, 25 bp, Homo sapien
agaagttcaatctcggcccggtcag

SEQ ID NO: 219844 - DNA, 25 bp, Homo sapien
caccagctctgagatgatcatcttc

SEQ ID NO: 219845 - DNA, 25 bp, Homo sapien
gccgcacctggtagtagccctgcag

SEQ ID NO: 219846 - DNA, 25 bp, Homo sapien
ccgcaggttgttgtgcaccagctct

SEQ ID NO: 219847 - DNA, 25 bp, Homo sapien
gttgaaggcatagtccacgcggttg

SEQ ID NO: 219848 - DNA, 25 bp, Homo sapien
acgtgccctcaaagcgcagtgtgta

SEQ ID NO: 219849 - DNA, 25 bp, Homo sapien
tggcgtagatgacccacagcccgtt

SEQ ID NO: 219850 - DNA, 25 bp, Homo sapien
atgcgcgtccgtaggtcatacttga

SEQ ID NO: 219851 - DNA, 25 bp, Homo sapien
ccttgttgtagaagacggcaccatc

SEQ ID NO: 219852 - DNA, 25 bp, Homo sapien
aaagcctgtgccatccacgcggttg

SEQ ID NO: 219853 - DNA, 25 bp, Homo sapien
tcccacgaggcatactcagtcagtg

SEQ ID NO: 219854 - DNA, 25 bp, Homo sapien
ggctgtagcgcaccacgaaatagtt

SEQ ID NO: 219855 - DNA, 25 bp, Homo sapien
cggattacacggatccaaaggcggc

SEQ ID NO: 219856 - DNA, 25 bp, Homo sapien
tggccgccgcaacccgcttgagcgc

SEQ ID NO: 219857 - DNA, 25 bp, Homo sapien
gattacacggatccaaaggcggccc

SEQ ID NO: 219858 - DNA, 25 bp, Homo sapien
aggcggattacacggatccaaaggc

SEQ ID NO: 219859 - DNA, 25 bp, Homo sapien
aaaagaggcggattacacggatcca

SEQ ID NO: 219860 - DNA, 25 bp, Homo sapien
cgtgtctctcctgcggctcggcgaa

SEQ ID NO: 219861 - DNA, 25 bp, Homo sapien
ggcccgcagacactcacctgtccag

SEQ ID NO: 219862 - DNA, 25 bp, Homo sapien
caccgcagcgccgacagctcccgcg

SEQ ID NO: 219863 - DNA, 25 bp, Homo sapien
gctcaggaggcaaagagtgcggagg

SEQ ID NO: 219864 - DNA, 25 bp, Homo sapien
ctccccatgagccccgctcctgaga

SEQ ID NO: 219865 - DNA, 25 bp, Homo sapien
ggctccccatgagccccgctcctga

SEQ ID NO: 219866 - DNA, 25 bp, Homo sapien
tgggctccccatgagccccgctcct

SEQ ID NO: 219867 - DNA, 25 bp, Homo sapien
cttgggctccccatgagccccgctc

SEQ ID NO: 219868 - DNA, 25 bp, Homo sapien
actttgcgccttgggctccccatga

SEQ ID NO: 219869 - DNA, 25 bp, Homo sapien
cccactttgcgccttgggctcccca

SEQ ID NO: 219870 - DNA, 25 bp, Homo sapien
ctcccactttgcgccttgggctccc

SEQ ID NO: 219871 - DNA, 25 bp, Homo sapien
cacgcccacggtgccacgcgcctcg

SEQ ID NO: 219872 - DNA, 25 bp, Homo sapien
acgctctgtgtattccgtcccacgg

SEQ ID NO: 219873 - DNA, 25 bp, Homo sapien
gctctgtgtattccgtcccacggga

SEQ ID NO: 219874 - DNA, 25 bp, Homo sapien
tctgtgtattccgtcccacgggacc

SEQ ID NO: 219875 - DNA, 25 bp, Homo sapien
tgtgtattccgtcccacgggacctc

SEQ ID NO: 219876 - DNA, 25 bp, Homo sapien
gacctccacgcccacggtgccacgc

SEQ ID NO: 219877 - DNA, 25 bp, Homo sapien
gctccgggaaccaaggcgtccgcgc

SEQ ID NO: 219878 - DNA, 25 bp, Homo sapien
ccacgggacctccacgcccacggtg

SEQ ID NO: 219879 - DNA, 25 bp, Homo sapien
ggccatggaaacaatgcatctttta

SEQ ID NO: 219880 - DNA, 25 bp, Homo sapien
atggagtcatcgctccgggctccca

SEQ ID NO: 219881 - DNA, 25 bp, Homo sapien
cgcgtgcaggccatggaaacaatgc

SEQ ID NO: 219882 - DNA, 25 bp, Homo sapien
aatgcatcttttatgaagcgatccc

SEQ ID NO: 219883 - DNA, 25 bp, Homo sapien
gaaaccttgcattaatgcggcattg

SEQ ID NO: 219884 - DNA, 25 bp, Homo sapien
tgcggcattgatttccctcgtaata

SEQ ID NO: 219885 - DNA, 25 bp, Homo sapien
gcctggaaaccttgcattaatgcgg

SEQ ID NO: 219886 - DNA, 25 bp, Homo sapien
cctcgtaatagagggggctctcccg

SEQ ID NO: 219887 - DNA, 25 bp, Homo sapien
gctcggctctttgccgaggtgatta

SEQ ID NO: 219888 - DNA, 25 bp, Homo sapien
gctggcctccgttcccacctttgaa

SEQ ID NO: 219889 - DNA, 25 bp, Homo sapien
ttaacccgagttgccagcgcttttc

SEQ ID NO: 219890 - DNA, 25 bp, Homo sapien
cccacctttgaagtgagctctggtt

SEQ ID NO: 219891 - DNA, 25 bp, Homo sapien
ggcgcacggctttaacccgagttgc

SEQ ID NO: 219892 - DNA, 25 bp, Homo sapien
taggatgcgtcctccgagggcgcac

SEQ ID NO: 219893 - DNA, 25 bp, Homo sapien
ccgaggtgattaggatgcgtcctcc

SEQ ID NO: 219894 - DNA, 25 bp, Homo sapien
ctttgaagtgagctctggttggatg

SEQ ID NO: 219895 - DNA, 25 bp, Homo sapien
cggtcgatagcagactcccaggctc

SEQ ID NO: 219896 - DNA, 25 bp, Homo sapien
gcgggcagatctaaaagcttcccta

SEQ ID NO: 219897 - DNA, 25 bp, Homo sapien
ccaggcggtcgatagcagactccca

SEQ ID NO: 219898 - DNA, 25 bp, Homo sapien
ccgcccaggcggtcgatagcagact

SEQ ID NO: 219899 - DNA, 25 bp, Homo sapien
ggcagatctaaaagcttccctaccg

SEQ ID NO: 219900 - DNA, 25 bp, Homo sapien
cgagcgggcagatctaaaagcttcc

SEQ ID NO: 219901 - DNA, 25 bp, Homo sapien
ggacgagcgggcagatctaaaagct

SEQ ID NO: 219902 - DNA, 25 bp, Homo sapien
agatctaaaagcttccctaccgccg

SEQ ID NO: 219903 - DNA, 25 bp, Homo sapien
agtgcccgctcgcttctgagcgttg

SEQ ID NO: 219904 - DNA, 25 bp, Homo sapien
cccagatagtgagtgcagcgagatg

SEQ ID NO: 219905 - DNA, 25 bp, Homo sapien
aggcagtgccacacacaatgtccgg

SEQ ID NO: 219906 - DNA, 25 bp, Homo sapien
ctttcttgtggtgcgcgtgttccaa

SEQ ID NO: 219907 - DNA, 25 bp, Homo sapien
aggcctggagctctactttcttgtg

SEQ ID NO: 219908 - DNA, 25 bp, Homo sapien
cgccttctgctggatgagcctcgaa

SEQ ID NO: 219909 - DNA, 25 bp, Homo sapien
gggctgctgcactactgtttcctgg

SEQ ID NO: 219910 - DNA, 25 bp, Homo sapien
cggctgccatctacagcaagggcta

SEQ ID NO: 219911 - DNA, 25 bp, Homo sapien
ggagccgccatgtttagtactgata

SEQ ID NO: 219912 - DNA, 25 bp, Homo sapien
ggtcaatctaaaagtaggcgcgccc

SEQ ID NO: 219913 - DNA, 25 bp, Homo sapien
cgcctcgcgtttattggtcaatcta

SEQ ID NO: 219914 - DNA, 25 bp, Homo sapien
tgggccgctgccttttcattcaaga

SEQ ID NO: 219915 - DNA, 25 bp, Homo sapien
ccttttcgaagagtggcgtctgcgc

SEQ ID NO: 219916 - DNA, 25 bp, Homo sapien
ctccgcgcgctgctaagagacactt

SEQ ID NO: 219917 - DNA, 25 bp, Homo sapien
gctcagacacgagttgctgcgcttc

SEQ ID NO: 219918 - DNA, 25 bp, Homo sapien
ctattcggacgaactgacagactcc

SEQ ID NO: 219919 - DNA, 25 bp, Homo sapien
cggagaaccgagattgcgacgaaca

SEQ ID NO: 219920 - DNA, 25 bp, Homo sapien
cgtccgacttcgaaggttacgagca

SEQ ID NO: 219921 - DNA, 25 bp, Homo sapien
gccgcccgagtaagtgtgtctatga

SEQ ID NO: 219922 - DNA, 25 bp, Homo sapien
ctgttactgtcacttccggaggttc

SEQ ID NO: 219923 - DNA, 25 bp, Homo sapien
ctccctccggaagcaagctgctgtg

SEQ ID NO: 219924 - DNA, 25 bp, Homo sapien
ggatccggagccgattcccagaaca

SEQ ID NO: 219925 - DNA, 25 bp, Homo sapien
tttccctgacctaggctttggcctg

SEQ ID NO: 219926 - DNA, 25 bp, Homo sapien
gaggcactaattggggcgcttttcc

SEQ ID NO: 219927 - DNA, 25 bp, Homo sapien
agaagaaccgaagcagccgctcctc

SEQ ID NO: 219928 - DNA, 25 bp, Homo sapien
ggaacgggcagtgagcgccgtgcag

SEQ ID NO: 219929 - DNA, 25 bp, Homo sapien
gcagcgtggggtgtccgcccacctg

SEQ ID NO: 219930 - DNA, 25 bp, Homo sapien
ccttacctgttgtctagcattgctg

SEQ ID NO: 219931 - DNA, 25 bp, Homo sapien
acctgttgtctagcattgctgtgta

SEQ ID NO: 219932 - DNA, 25 bp, Homo sapien
gtctagcattgctgtgtacacggcc

SEQ ID NO: 219933 - DNA, 25 bp, Homo sapien
ctagcattgctgtgtacacggcctg

SEQ ID NO: 219934 - DNA, 25 bp, Homo sapien
agagcggcccggtggtcagggaact

SEQ ID NO: 219935 - DNA, 25 bp, Homo sapien
tttctgggacgactgaaaccacgca

SEQ ID NO: 219936 - DNA, 25 bp, Homo sapien
cgcttgggcacgagtctgcatttat

SEQ ID NO: 219937 - DNA, 25 bp, Homo sapien
tagaaattccgcagaggcctccact

SEQ ID NO: 219938 - DNA, 25 bp, Homo sapien
tccgacggcggccacgaacaaagct

SEQ ID NO: 219939 - DNA, 25 bp, Homo sapien
tatggagcgccatctgcatgcagca

SEQ ID NO: 219940 - DNA, 25 bp, Homo sapien
cctcgcctggtttccgaaggagtga

SEQ ID NO: 219941 - DNA, 25 bp, Homo sapien
cccaaagggcgccaatgtgcaggca

SEQ ID NO: 219942 - DNA, 25 bp, Homo sapien
ccacgcagagccacgggtaaccaag

SEQ ID NO: 219943 - DNA, 25 bp, Homo sapien
aggcgcacctgcgtctggagtcccg

SEQ ID NO: 219944 - DNA, 25 bp, Homo sapien
ccgctctcggcttgaacgcgtggaa

SEQ ID NO: 219945 - DNA, 25 bp, Homo sapien
tgaacgcgtggaaccgttctcctcg

SEQ ID NO: 219946 - DNA, 25 bp, Homo sapien
aggacatggccagcgacgccgtgca

SEQ ID NO: 219947 - DNA, 25 bp, Homo sapien
acgccgtgcaggtaggcgcacctgc

SEQ ID NO: 219948 - DNA, 25 bp, Homo sapien
ctcaaactcggcctctcctggagaa

SEQ ID NO: 219949 - DNA, 25 bp, Homo sapien
cggaggctctacttcgggtgtctgt

SEQ ID NO: 219950 - DNA, 25 bp, Homo sapien
tctcctggagaactagaaggggcgc

SEQ ID NO: 219951 - DNA, 25 bp, Homo sapien
cctggagttctcctagctccactga

SEQ ID NO: 219952 - DNA, 25 bp, Homo sapien
cccagggagatgcatgccatgaccc

SEQ ID NO: 219953 - DNA, 25 bp, Homo sapien
gagccaggttaacccatctccacgg

SEQ ID NO: 219954 - DNA, 25 bp, Homo sapien
acccatggtctccagagccaggtta

SEQ ID NO: 219955 - DNA, 25 bp, Homo sapien
agggattccactgctcactggctca

SEQ ID NO: 219956 - DNA, 25 bp, Homo sapien
agctggtccctgctagagcagctgg

SEQ ID NO: 219957 - DNA, 25 bp, Homo sapien
tgcatgtggtctgcacctggagttc

SEQ ID NO: 219958 - DNA, 25 bp, Homo sapien
gatgcgggactccagggattccact

SEQ ID NO: 219959 - DNA, 25 bp, Homo sapien
gcagatgcacgacaccaccatgata

SEQ ID NO: 219960 - DNA, 25 bp, Homo sapien
cctgggctcgcagaatggcttttta

SEQ ID NO: 219961 - DNA, 25 bp, Homo sapien
cctggcgcagtaggatgtacaccca

SEQ ID NO: 219962 - DNA, 25 bp, Homo sapien
aggagtctcaggtgtcccggaaaga

SEQ ID NO: 219963 - DNA, 25 bp, Homo sapien
ccagcattgggctccagcagatgca

SEQ ID NO: 219964 - DNA, 25 bp, Homo sapien
atgataccgacaagctggcccacca

SEQ ID NO: 219965 - DNA, 25 bp, Homo sapien
tgaagcgcggcgacttataacggtg

SEQ ID NO: 219966 - DNA, 25 bp, Homo sapien
tgggcctctggttgtgcttagaagt

SEQ ID NO: 219967 - DNA, 25 bp, Homo sapien
tcgcccacgctgatgaggtggatgt

SEQ ID NO: 219968 - DNA, 25 bp, Homo sapien
aatggcctcgatcatgtcgcccacg

SEQ ID NO: 219969 - DNA, 25 bp, Homo sapien
aggctctgcccgttaatggcctcga

SEQ ID NO: 219970 - DNA, 25 bp, Homo sapien
ctcggggcagctccttgagcagccg

SEQ ID NO: 219971 - DNA, 25 bp, Homo sapien
gcttcagcgtgaaggtacggcctcg

SEQ ID NO: 219972 - DNA, 25 bp, Homo sapien
atgtggtcgatcacgctgccctcct

SEQ ID NO: 219973 - DNA, 25 bp, Homo sapien
gaggctccgtgagcttcagcgtgaa

SEQ ID NO: 219974 - DNA, 25 bp, Homo sapien
tcaccgaaggccttgcgaggctccg

SEQ ID NO: 219975 - DNA, 25 bp, Homo sapien
tcgccgcgaagcagtggaccgttcc

SEQ ID NO: 219976 - DNA, 25 bp, Homo sapien
ggagcagacacatccttctcgcaga

SEQ ID NO: 219977 - DNA, 25 bp, Homo sapien
atcagcggctgcctctcggtgctcg

SEQ ID NO: 219978 - DNA, 25 bp, Homo sapien
caatccgcgtcttccgcttcgggtg

SEQ ID NO: 219979 - DNA, 25 bp, Homo sapien
gtggacccgacggaaacattccaga

SEQ ID NO: 219980 - DNA, 25 bp, Homo sapien
cgtgctgtcggctgagtgtcagtct

SEQ ID NO: 219981 - DNA, 25 bp, Homo sapien
ggattcgaacttccgacgtccagga

SEQ ID NO: 219982 - DNA, 25 bp, Homo sapien
agtcaggtgacctaggccaggtttc

SEQ ID NO: 219983 - DNA, 25 bp, Homo sapien
tgagcacgtcgtaggcctcagcgat

SEQ ID NO: 219984 - DNA, 25 bp, Homo sapien
ggacgagccaatcgcgaccttcttt

SEQ ID NO: 219985 - DNA, 25 bp, Homo sapien
cctttcgggacgagccaatcgcgac

SEQ ID NO: 219986 - DNA, 25 bp, Homo sapien
ctttcagcgacacgcgacatccggg

SEQ ID NO: 219987 - DNA, 25 bp, Homo sapien
tggtagtagtctttacccatgaccc

SEQ ID NO: 219988 - DNA, 25 bp, Homo sapien
ttccctgtctgtcaaaaggcggggc

SEQ ID NO: 219989 - DNA, 25 bp, Homo sapien
agacatgctagaagcttctggccga

SEQ ID NO: 219990 - DNA, 25 bp, Homo sapien
ggactctatatacccgtccggcgga

SEQ ID NO: 219991 - DNA, 25 bp, Homo sapien
gtggccactgctgacccattctttt

SEQ ID NO: 219992 - DNA, 25 bp, Homo sapien
cccgggccactcgtaaattccaatg

SEQ ID NO: 219993 - DNA, 25 bp, Homo sapien
cgcatgtgcgcaggaagtatttata

SEQ ID NO: 219994 - DNA, 25 bp, Homo sapien
gcagactttgtcatgggagccacga

SEQ ID NO: 219995 - DNA, 25 bp, Homo sapien
aatccgagggagtcttgcacaaatc

SEQ ID NO: 219996 - DNA, 25 bp, Homo sapien
aggggctttgctatcagtattcttg

SEQ ID NO: 219997 - DNA, 25 bp, Homo sapien
ggatgctgccttgcctgtcactcaa

SEQ ID NO: 219998 - DNA, 25 bp, Homo sapien
tctggcctaaccgtcgcttaccttg

SEQ ID NO: 219999 - DNA, 25 bp, Homo sapien
atgacgcagtgtctcccaggtgagc

SEQ ID NO: 220000 - DNA, 25 bp, Homo sapien
tgccgctgggcttccgccgtataca

SEQ ID NO: 220001 - DNA, 25 bp, Homo sapien
cctccgctggaattgggttcccatc

SEQ ID NO: 220002 - DNA, 25 bp, Homo sapien
tccctgactcagaaagcaggggcgg

SEQ ID NO: 220003 - DNA, 25 bp, Homo sapien
ggacagccacatacacgggttgcga

SEQ ID NO: 220004 - DNA, 25 bp, Homo sapien
acatacacgggttgcgaggctgccc

SEQ ID NO: 220005 - DNA, 25 bp, Homo sapien
ggtttcgccatcatgacgcagtgtc

SEQ ID NO: 220006 - DNA, 25 bp, Homo sapien
gtcctggatcggtttcgccatcatg

SEQ ID NO: 220007 - DNA, 25 bp, Homo sapien
cctctccttcaagggagtgggccgc

SEQ ID NO: 220008 - DNA, 25 bp, Homo sapien
atggactcctccaagcggacttgtg

SEQ ID NO: 220009 - DNA, 25 bp, Homo sapien
agcggacttgtgtatttctagggaa

SEQ ID NO: 220010 - DNA, 25 bp, Homo sapien
tgtgtgcagccggaatggactcctc

SEQ ID NO: 220011 - DNA, 25 bp, Homo sapien
attttggcgccttgggatgtatggc

SEQ ID NO: 220012 - DNA, 25 bp, Homo sapien
gccagcttccgtgtaggcccgtcgt

SEQ ID NO: 220013 - DNA, 25 bp, Homo sapien
cccggattcttggtttgtgtgcagc

SEQ ID NO: 220014 - DNA, 25 bp, Homo sapien
atttctagggaattttggcgccttg

SEQ ID NO: 220015 - DNA, 25 bp, Homo sapien
cggagatcatagagatgaaggactc

SEQ ID NO: 220016 - DNA, 25 bp, Homo sapien
gcagtcgctgcagatccctgcagca

SEQ ID NO: 220017 - DNA, 25 bp, Homo sapien
tgcagcagccgagggtcacctagct

SEQ ID NO: 220018 - DNA, 25 bp, Homo sapien
gagggtcacctagctcctacccgga

SEQ ID NO: 220019 - DNA, 25 bp, Homo sapien
catttaggcagctgcggagatcata

SEQ ID NO: 220020 - DNA, 25 bp, Homo sapien
aggactccagaggatcgctccggtc

SEQ ID NO: 220021 - DNA, 25 bp, Homo sapien
gctccttgcgttcggggaagccgta

SEQ ID NO: 220022 - DNA, 25 bp, Homo sapien
gcttccgggtcatttaggcagctgc

SEQ ID NO: 220023 - DNA, 25 bp, Homo sapien
ggatttacccaaaggagagcaagga

SEQ ID NO: 220024 - DNA, 25 bp, Homo sapien
ggccggggtgacacacggctgaccc

SEQ ID NO: 220025 - DNA, 25 bp, Homo sapien
agcgcatggccacgtgggtgaaccc

SEQ ID NO: 220026 - DNA, 25 bp, Homo sapien
acgcgcgggctcctgcttgccaggt

SEQ ID NO: 220027 - DNA, 25 bp, Homo sapien
cgggctcctgcttgccaggttttaa

SEQ ID NO: 220028 - DNA, 25 bp, Homo sapien
tgcttgccaggttttaacccacaag

SEQ ID NO: 220029 - DNA, 25 bp, Homo sapien
gggcgcggacaagcccagagggcga

SEQ ID NO: 220030 - DNA, 25 bp, Homo sapien
ctcctgcttgccaggttttaaccca

SEQ ID NO: 220031 - DNA, 25 bp, Homo sapien
cccggtctctcgctctcaggtaccc

SEQ ID NO: 220032 - DNA, 25 bp, Homo sapien
ggactggagggcctagaacagctcc

SEQ ID NO: 220033 - DNA, 25 bp, Homo sapien
acagctccgcctgtgtgaggggttt

SEQ ID NO: 220034 - DNA, 25 bp, Homo sapien
tgaggggtttcctccctgcgatcag

SEQ ID NO: 220035 - DNA, 25 bp, Homo sapien
tttcctccctgcgatcagccggtgg

SEQ ID NO: 220036 - DNA, 25 bp, Homo sapien
gcgtgaggcccacacagtcagggcc

SEQ ID NO: 220037 - DNA, 25 bp, Homo sapien
acagtcagggcctcgcatctgggcg

SEQ ID NO: 220038 - DNA, 25 bp, Homo sapien
gcctagaacagctccgcctgtgtga

SEQ ID NO: 220039 - DNA, 25 bp, Homo sapien
gtgagtggcctctccggcatccagc

SEQ ID NO: 220040 - DNA, 25 bp, Homo sapien
ctcggtgctggaaacgtgcctgtgt

SEQ ID NO: 220041 - DNA, 25 bp, Homo sapien
ggacccgccagggactgtgcagcac

SEQ ID NO: 220042 - DNA, 25 bp, Homo sapien
gggcaagcaggagctcagagacaaa

SEQ ID NO: 220043 - DNA, 25 bp, Homo sapien
tggcaacggctctaaggggcaagca

SEQ ID NO: 220044 - DNA, 25 bp, Homo sapien
cgaccaggagaaaagcggtggcaac

SEQ ID NO: 220045 - DNA, 25 bp, Homo sapien
aggaaactcaccagaacgaccagga

SEQ ID NO: 220046 - DNA, 25 bp, Homo sapien
ctaaggggataggaaactcaccaga

SEQ ID NO: 220047 - DNA, 25 bp, Homo sapien
cggtgaccatgtggcagcccaagga

SEQ ID NO: 220048 - DNA, 25 bp, Homo sapien
accaagcagggaccatgcgcgtgtt

SEQ ID NO: 220049 - DNA, 25 bp, Homo sapien
agcgcagccaggacacacgcgttgg

SEQ ID NO: 220050 - DNA, 25 bp, Homo sapien
gcgaggaccgcgcacattctgaccg

SEQ ID NO: 220051 - DNA, 25 bp, Homo sapien
acattctgaccgatcgctgcgggca

SEQ ID NO: 220052 - DNA, 25 bp, Homo sapien
tcacgctgtggaagggcaagatgaa

SEQ ID NO: 220053 - DNA, 25 bp, Homo sapien
cgcgcgcagcaccagattaacgggc

SEQ ID NO: 220054 - DNA, 25 bp, Homo sapien
cgccctgcagaccaccgaggtggtg

SEQ ID NO: 220055 - DNA, 25 bp, Homo sapien
ggctgggtttcaatgcgcttgcaca

SEQ ID NO: 220056 - DNA, 25 bp, Homo sapien
accagggtcctctgtcgaaagttca

SEQ ID NO: 220057 - DNA, 25 bp, Homo sapien
ggttcgcatgtaccagagacacgtg

SEQ ID NO: 220058 - DNA, 25 bp, Homo sapien
ccacggtctcatcaaggtacggttc

SEQ ID NO: 220059 - DNA, 25 bp, Homo sapien
agctgcagataagcgaccgtgtgtg

SEQ ID NO: 220060 - DNA, 25 bp, Homo sapien
tggcgctaaacgaagccaagcggtt

SEQ ID NO: 220061 - DNA, 25 bp, Homo sapien
ctatcctccggtgtacgaaatataa

SEQ ID NO: 220062 - DNA, 25 bp, Homo sapien
cgaaagttcacctggagaccgcaga

SEQ ID NO: 220063 - DNA, 25 bp, Homo sapien
tgcagactggggtgcctccagccag

SEQ ID NO: 220064 - DNA, 25 bp, Homo sapien
cgcggaccgttatgtgctgctggcc

SEQ ID NO: 220065 - DNA, 25 bp, Homo sapien
cgatcgtcacgtcccatcgaagctg

SEQ ID NO: 220066 - DNA, 25 bp, Homo sapien
tcccatcgaagctggagcggatccg

SEQ ID NO: 220067 - DNA, 25 bp, Homo sapien
gtttgggccaagcattcccggaatg

SEQ ID NO: 220068 - DNA, 25 bp, Homo sapien
attcccggaatgtgcttcctgctgg

SEQ ID NO: 220069 - DNA, 25 bp, Homo sapien
tggccgagccgctactcaggaaaac

SEQ ID NO: 220070 - DNA, 25 bp, Homo sapien
ggcctcgcccacgacaggaaatggg

SEQ ID NO: 220071 - DNA, 25 bp, Homo sapien
gccagcgagttaccacgggaccagt

SEQ ID NO: 220072 - DNA, 25 bp, Homo sapien
atctccagatgtcgcgccttacttg

SEQ ID NO: 220073 - DNA, 25 bp, Homo sapien
gtgaccaaggagagccagacctgtt

SEQ ID NO: 220074 - DNA, 25 bp, Homo sapien
tcaacgtgtgcctctgagccagatg

SEQ ID NO: 220075 - DNA, 25 bp, Homo sapien
agctctccaagcaaatcaacgtgtg

SEQ ID NO: 220076 - DNA, 25 bp, Homo sapien
ttcgacgccctcatcctggatctgg

SEQ ID NO: 220077 - DNA, 25 bp, Homo sapien
agacgacttcgatgcgcccttcaac

SEQ ID NO: 220078 - DNA, 25 bp, Homo sapien
caccggtgacttcgaagacgacttc

SEQ ID NO: 220079 - DNA, 25 bp, Homo sapien
gacccttgccgccagtttctgtgcg

SEQ ID NO: 220080 - DNA, 25 bp, Homo sapien
tcgcatcaggatgtggttctcccac

SEQ ID NO: 220081 - DNA, 25 bp, Homo sapien
ggaacctctccggaagaaatcgcgc

SEQ ID NO: 220082 - DNA, 25 bp, Homo sapien
agaccacgccctttgtgcgcctagg

SEQ ID NO: 220083 - DNA, 25 bp, Homo sapien
gcgacgacagcaccacacagttatc

SEQ ID NO: 220084 - DNA, 25 bp, Homo sapien
cccatgttacgtcaccaagaggcac

SEQ ID NO: 220085 - DNA, 25 bp, Homo sapien
gtgaagccatgcctctccgtgacaa

SEQ ID NO: 220086 - DNA, 25 bp, Homo sapien
gggtcgaggtcacatcgcatcagga

SEQ ID NO: 220087 - DNA, 25 bp, Homo sapien
ccggactccggacgcaagtagatga

SEQ ID NO: 220088 - DNA, 25 bp, Homo sapien
actcttggcgcagctgagcttcagc

SEQ ID NO: 220089 - DNA, 25 bp, Homo sapien
caccaggacgctcaggaaaaagatg

SEQ ID NO: 220090 - DNA, 25 bp, Homo sapien
gaaggacatcagcaccaccaggacg

SEQ ID NO: 220091 - DNA, 25 bp, Homo sapien
gaaatcctcacgatggcagccacga

SEQ ID NO: 220092 - DNA, 25 bp, Homo sapien
ggccggctgccaaggaaatcctcac

SEQ ID NO: 220093 - DNA, 25 bp, Homo sapien
tggaggcgcagtcaaaatgtactac

SEQ ID NO: 220094 - DNA, 25 bp, Homo sapien
tgtcacagaagaagtgctccacgtg

SEQ ID NO: 220095 - DNA, 25 bp, Homo sapien
acacggcgtagtgagtaccgggcac

SEQ ID NO: 220096 - DNA, 25 bp, Homo sapien
attacgggacagaggacgaggacac

SEQ ID NO: 220097 - DNA, 25 bp, Homo sapien
caggggctccctgcagttgcagaga

SEQ ID NO: 220098 - DNA, 25 bp, Homo sapien
ttgcagagaagtccgcagccaacgg

SEQ ID NO: 220099 - DNA, 25 bp, Homo sapien
gcccacccgtgaaaggacctggtca

SEQ ID NO: 220100 - DNA, 25 bp, Homo sapien
cggcaggttttacctcgtcagcgga

SEQ ID NO: 220101 - DNA, 25 bp, Homo sapien
tttatcatctgtggggtcacggctg

SEQ ID NO: 220102 - DNA, 25 bp, Homo sapien
cggctgccacgaacatcaggaatta

SEQ ID NO: 220103 - DNA, 25 bp, Homo sapien
cgctcgtcaccaagtctttagaata

SEQ ID NO: 220104 - DNA, 25 bp, Homo sapien
tcctcatcaattgcacagccgtcga

SEQ ID NO: 220105 - DNA, 25 bp, Homo sapien
tgcacagccgtcgacttcttcctta

SEQ ID NO: 220106 - DNA, 25 bp, Homo sapien
agccgtcgacttcttccttacattc

SEQ ID NO: 220107 - DNA, 25 bp, Homo sapien
gctgtcgctcgtcaccaagtcttta

SEQ ID NO: 220108 - DNA, 25 bp, Homo sapien
cgtcaccaagtctttagaatagctt

SEQ ID NO: 220109 - DNA, 25 bp, Homo sapien
agaatagctttagcgtcgtgaaccc

SEQ ID NO: 220110 - DNA, 25 bp, Homo sapien
tccttacattcccacagctccctgg

SEQ ID NO: 220111 - DNA, 25 bp, Homo sapien
gtccttgtgcagtgagaagccctca

SEQ ID NO: 220112 - DNA, 25 bp, Homo sapien
aaccagagggtgctgtgctcgcgct

SEQ ID NO: 220113 - DNA, 25 bp, Homo sapien
ggccaccatgacacccaggacgaga

SEQ ID NO: 220114 - DNA, 25 bp, Homo sapien
acacccaggacgagaatgaccagca

SEQ ID NO: 220115 - DNA, 25 bp, Homo sapien
atgaccagcagcaagacagcgcccg

SEQ ID NO: 220116 - DNA, 25 bp, Homo sapien
cgctgacaacgctcccaggtagtca

SEQ ID NO: 220117 - DNA, 25 bp, Homo sapien
ccttgtgaccagaggccacgtcctt

SEQ ID NO: 220118 - DNA, 25 bp, Homo sapien
gtacgggaagtccaggcgctccacc

SEQ ID NO: 220119 - DNA, 25 bp, Homo sapien
taagggaagaccatggcctggccgt

SEQ ID NO: 220120 - DNA, 25 bp, Homo sapien
tcggcgcagtacttctcgtacaccg

SEQ ID NO: 220121 - DNA, 25 bp, Homo sapien
gccggcacctcgctggcacaatcca

SEQ ID NO: 220122 - DNA, 25 bp, Homo sapien
tcggcaaagtggtcggcgcagtact

SEQ ID NO: 220123 - DNA, 25 bp, Homo sapien
actgtgagcaccagcacgccgcggg

SEQ ID NO: 220124 - DNA, 25 bp, Homo sapien
gaacgcagtagctcctctggcggca

SEQ ID NO: 220125 - DNA, 25 bp, Homo sapien
agaaagtcggcgctggaacgcagta

SEQ ID NO: 220126 - DNA, 25 bp, Homo sapien
cgctgagccgctgcagaaagtcggc

SEQ ID NO: 220127 - DNA, 25 bp, Homo sapien
gcgaggggtcgaaaactcaaccaca

SEQ ID NO: 220128 - DNA, 25 bp, Homo sapien
cggggttctccagcgcgaccatggc

SEQ ID NO: 220129 - DNA, 25 bp, Homo sapien
cagccatcagggaacgaacggggaa

SEQ ID NO: 220130 - DNA, 25 bp, Homo sapien
cagaaatctagctccgggaaggagg

SEQ ID NO: 220131 - DNA, 25 bp, Homo sapien
gctgcggactgagccaggaatccag

SEQ ID NO: 220132 - DNA, 25 bp, Homo sapien
ggactgagccaggaatccagcccag

SEQ ID NO: 220133 - DNA, 25 bp, Homo sapien
ctaaggcctgagcatcgacgaggga

SEQ ID NO: 220134 - DNA, 25 bp, Homo sapien
gccggccacgatccctacacccaga

SEQ ID NO: 220135 - DNA, 25 bp, Homo sapien
cggcaggagggtcccgacaaccctg

SEQ ID NO: 220136 - DNA, 25 bp, Homo sapien
gcgtctgctggcatgggacgcccac

SEQ ID NO: 220137 - DNA, 25 bp, Homo sapien
tcacttgcaagtgcgctcgcggcca

SEQ ID NO: 220138 - DNA, 25 bp, Homo sapien
ccaccggcgtggcagtcgaagttgt

SEQ ID NO: 220139 - DNA, 25 bp, Homo sapien
tggatgggctcacttgcaagtgcgc

SEQ ID NO: 220140 - DNA, 25 bp, Homo sapien
ccacgctcagcgagcagtcgccgcc

SEQ ID NO: 220141 - DNA, 25 bp, Homo sapien
cgcgccacccgctcgcaacgcggac

SEQ ID NO: 220142 - DNA, 25 bp, Homo sapien
gccagcactgcagcgcctcgcattg

SEQ ID NO: 220143 - DNA, 25 bp, Homo sapien
aggtcctgttcgcagtggaagcctc

SEQ ID NO: 220144 - DNA, 25 bp, Homo sapien
cactcatccacatcgcgggcgcatc

SEQ ID NO: 220145 - DNA, 25 bp, Homo sapien
ccgttcaggcatgggtctgcggaca

SEQ ID NO: 220146 - DNA, 25 bp, Homo sapien
acgagccaccgttcaggcatgggtc

SEQ ID NO: 220147 - DNA, 25 bp, Homo sapien
cgtcttggcacgagccaccgttcag

SEQ ID NO: 220148 - DNA, 25 bp, Homo sapien
aggggttgctcaggcactcatccac

SEQ ID NO: 220149 - DNA, 25 bp, Homo sapien
ttcgcagtggaagcctccgtagcct

SEQ ID NO: 220150 - DNA, 25 bp, Homo sapien
cagtggaagcctccgtagcctggcg

SEQ ID NO: 220151 - DNA, 25 bp, Homo sapien
agagcactcgtccacatcctggtca

SEQ ID NO: 220152 - DNA, 25 bp, Homo sapien
gcccattcacagacgatggagctcc

SEQ ID NO: 220153 - DNA, 25 bp, Homo sapien
tttcccagcccattcacagacgatg

SEQ ID NO: 220154 - DNA, 25 bp, Homo sapien
cacgaccgcactggcacaggaagga

SEQ ID NO: 220155 - DNA, 25 bp, Homo sapien
gaggtccagtgtagccacgaccgca

SEQ ID NO: 220156 - DNA, 25 bp, Homo sapien
cggtctcacagcgaggtccagtgta

SEQ ID NO: 220157 - DNA, 25 bp, Homo sapien
ttgacatcggtctcacagcgaggtc

SEQ ID NO: 220158 - DNA, 25 bp, Homo sapien
cgacagacactcgttgacatcggtc

SEQ ID NO: 220159 - DNA, 25 bp, Homo sapien
gcggctgactcagtccttagcgtca

SEQ ID NO: 220160 - DNA, 25 bp, Homo sapien
actgaactcaacaagcggctgactc

SEQ ID NO: 220161 - DNA, 25 bp, Homo sapien
cgaggtctatggaaacgtctgctgc

SEQ ID NO: 220162 - DNA, 25 bp, Homo sapien
gggagtggttcccacagcccaactc

SEQ ID NO: 220163 - DNA, 25 bp, Homo sapien
agcccaactcggaggactgagcccg

SEQ ID NO: 220164 - DNA, 25 bp, Homo sapien
ccggtgattcacctgtcgaagggcg

SEQ ID NO: 220165 - DNA, 25 bp, Homo sapien
ggctcattcacctgtcggcagtatt

SEQ ID NO: 220166 - DNA, 25 bp, Homo sapien
gtcccagacgcctgagactgaactc

SEQ ID NO: 220167 - DNA, 25 bp, Homo sapien
gctctaatcgctcaagggtccctgt

SEQ ID NO: 220168 - DNA, 25 bp, Homo sapien
ggacgagtcccgaactctgtacgca

SEQ ID NO: 220169 - DNA, 25 bp, Homo sapien
tccgagttcagagctcccagaactt

SEQ ID NO: 220170 - DNA, 25 bp, Homo sapien
gggaagttttctccgagttcagagc

SEQ ID NO: 220171 - DNA, 25 bp, Homo sapien
ctcggaatccggctccgggtcttgc

SEQ ID NO: 220172 - DNA, 25 bp, Homo sapien
ctccaggactggcatgaagcccggg

SEQ ID NO: 220173 - DNA, 25 bp, Homo sapien
tgggtcccttcatcttcagctctaa

SEQ ID NO: 220174 - DNA, 25 bp, Homo sapien
ccattctgaatctctgggtcctcca

SEQ ID NO: 220175 - DNA, 25 bp, Homo sapien
tagcaaccgtcagcggatctccgtc

SEQ ID NO: 220176 - DNA, 25 bp, Homo sapien
agaaggcgcctttccgtcgccctag

SEQ ID NO: 220177 - DNA, 25 bp, Homo sapien
cgatcatgcgaggaatcccagccca

SEQ ID NO: 220178 - DNA, 25 bp, Homo sapien
gccctaaaagatgcacgcgccaagc

SEQ ID NO: 220179 - DNA, 25 bp, Homo sapien
gcgggtctacgacgagacacgattt

SEQ ID NO: 220180 - DNA, 25 bp, Homo sapien
cgagacacgattttctattggctta

SEQ ID NO: 220181 - DNA, 25 bp, Homo sapien
tattggcttactcgccaggactctg

SEQ ID NO: 220182 - DNA, 25 bp, Homo sapien
aggactctgcccaatcgacgcgatc

SEQ ID NO: 220183 - DNA, 25 bp, Homo sapien
aggaaaccgtgctcacccagcgagg

SEQ ID NO: 220184 - DNA, 25 bp, Homo sapien
cgtgagcgctatgcagccgtagacc

SEQ ID NO: 220185 - DNA, 25 bp, Homo sapien
ccttgaggttcaggaaaccgtgctc

SEQ ID NO: 220186 - DNA, 25 bp, Homo sapien
cccgtgcgatcaccttgaggttcag

SEQ ID NO: 220187 - DNA, 25 bp, Homo sapien
acagcctgaagcctggggaaccctc

SEQ ID NO: 220188 - DNA, 25 bp, Homo sapien
ccagccgagacatagtgcagacgca

SEQ ID NO: 220189 - DNA, 25 bp, Homo sapien
cgttacctcgtccagccgagacata

SEQ ID NO: 220190 - DNA, 25 bp, Homo sapien
accaggctccacatgaaggcgcgca

SEQ ID NO: 220191 - DNA, 25 bp, Homo sapien
ggctaggggacacctcgtactattc

SEQ ID NO: 220192 - DNA, 25 bp, Homo sapien
tcgtgatctggcacagcggctaaca

SEQ ID NO: 220193 - DNA, 25 bp, Homo sapien
acggcctgcgctgaaactttgggaa

SEQ ID NO: 220194 - DNA, 25 bp, Homo sapien
ccgcagcgccgagacttttagtttc

SEQ ID NO: 220195 - DNA, 25 bp, Homo sapien
caactttgtagagcgaggggccaac

SEQ ID NO: 220196 - DNA, 25 bp, Homo sapien
atctgcgctctttgggtcacttgga

SEQ ID NO: 220197 - DNA, 25 bp, Homo sapien
gtctccgagttgatgtgaaggccca

SEQ ID NO: 220198 - DNA, 25 bp, Homo sapien
catgctaatgtaggcgtggagtccc

SEQ ID NO: 220199 - DNA, 25 bp, Homo sapien
ccgggagccaatctgcaggtgttga

SEQ ID NO: 220200 - DNA, 25 bp, Homo sapien
atgttcaagcgacaggtcctggccc

SEQ ID NO: 220201 - DNA, 25 bp, Homo sapien
ggcggccactgatgttcaagcgaca

SEQ ID NO: 220202 - DNA, 25 bp, Homo sapien
ccctgtacgtctgtgattggacggc

SEQ ID NO: 220203 - DNA, 25 bp, Homo sapien
agctgtggttccaacggcgggtcca

SEQ ID NO: 220204 - DNA, 25 bp, Homo sapien
gcactgacttcacccagctgtggtt

SEQ ID NO: 220205 - DNA, 25 bp, Homo sapien
tccaaagacctagcagcactgactt

SEQ ID NO: 220206 - DNA, 25 bp, Homo sapien
ccttcggtctggctccaaagaccta

SEQ ID NO: 220207 - DNA, 25 bp, Homo sapien
cgaacgtcacgttcttggggacaga

SEQ ID NO: 220208 - DNA, 25 bp, Homo sapien
gtccagccggcacttgctcgtaaca

SEQ ID NO: 220209 - DNA, 25 bp, Homo sapien
gcgggcaggacatcacgaacgtcac

SEQ ID NO: 220210 - DNA, 25 bp, Homo sapien
actgtgtagacatttggcggagaga

SEQ ID NO: 220211 - DNA, 25 bp, Homo sapien
cgatgtcctgtgtatactgtgtaga

SEQ ID NO: 220212 - DNA, 25 bp, Homo sapien
cggcagcaacgatgtcctgtgtata

SEQ ID NO: 220213 - DNA, 25 bp, Homo sapien
cagaaaaccagtcacggcggcagca

SEQ ID NO: 220214 - DNA, 25 bp, Homo sapien
ttgctcgtaacaaggcgtgtgctga

SEQ ID NO: 220215 - DNA, 25 bp, Homo sapien
agggccttctcacgctcctctttct

SEQ ID NO: 220216 - DNA, 25 bp, Homo sapien
cgccgacgtgcctcctcatgggccc

SEQ ID NO: 220217 - DNA, 25 bp, Homo sapien
cagcgcatcctcgtcctctcggctc

SEQ ID NO: 220218 - DNA, 25 bp, Homo sapien
cagagggtcccagtcagcctgggga

SEQ ID NO: 220219 - DNA, 25 bp, Homo sapien
cacccgcccacctcatgcgctcctg

SEQ ID NO: 220220 - DNA, 25 bp, Homo sapien
tctcagcgtgctcggcctgagcctt

SEQ ID NO: 220221 - DNA, 25 bp, Homo sapien
cgcggcggaactgctcgaagctgtc

SEQ ID NO: 220222 - DNA, 25 bp, Homo sapien
tccttctcagcgtgctcggcctgag

SEQ ID NO: 220223 - DNA, 25 bp, Homo sapien
acggacgtgaccttcctcctgtgct

SEQ ID NO: 220224 - DNA, 25 bp, Homo sapien
ggacacttcccgtgtatgtgcctga

SEQ ID NO: 220225 - DNA, 25 bp, Homo sapien
cctgtctcagactcggggtatcagc

SEQ ID NO: 220226 - DNA, 25 bp, Homo sapien
cgcgaggcaacgcataggagaacca

SEQ ID NO: 220227 - DNA, 25 bp, Homo sapien
acggagggagatgcactcagaagct

SEQ ID NO: 220228 - DNA, 25 bp, Homo sapien
gttcgtcaactacatccagcaggtg

SEQ ID NO: 220229 - DNA, 25 bp, Homo sapien
ctgggcgacttcatgtgcaagttcg

SEQ ID NO: 220230 - DNA, 25 bp, Homo sapien
atgtgcctgagtgttcgcacacgta

SEQ ID NO: 220231 - DNA, 25 bp, Homo sapien
aagcgggccaagctcgcctccaggg

SEQ ID NO: 220232 - DNA, 25 bp, Homo sapien
caatgcaggttacgcggaccgcgcc

SEQ ID NO: 220233 - DNA, 25 bp, Homo sapien
cggcgagcacggaccgagcaaaaca

SEQ ID NO: 220234 - DNA, 25 bp, Homo sapien
gagcaaaacaaagcgcccagcaagg

SEQ ID NO: 220235 - DNA, 25 bp, Homo sapien
cggcccaggcaaaacgacctgggtg

SEQ ID NO: 220236 - DNA, 25 bp, Homo sapien
accaaaggcaggacagccgcgagcg

SEQ ID NO: 220237 - DNA, 25 bp, Homo sapien
gcaaaacgacctgggtgccagaagg

SEQ ID NO: 220238 - DNA, 25 bp, Homo sapien
cccattacgcaatgcaggttacgcg

SEQ ID NO: 220239 - DNA, 25 bp, Homo sapien
gtgcgctgctcagaagcctctcaaa

SEQ ID NO: 220240 - DNA, 25 bp, Homo sapien
ccgtgctatggacaggactgctgcg

SEQ ID NO: 220241 - DNA, 25 bp, Homo sapien
cctttgctttagcattgtgccgcta

SEQ ID NO: 220242 - DNA, 25 bp, Homo sapien
gcgcgcaacagacatgtcacctttg

SEQ ID NO: 220243 - DNA, 25 bp, Homo sapien
tcatcccgggtaggtagcaggacct

SEQ ID NO: 220244 - DNA, 25 bp, Homo sapien
cactgcctgaaactatgactgctgt

SEQ ID NO: 220245 - DNA, 25 bp, Homo sapien
cgagactgtcccacgaagatggcga

SEQ ID NO: 220246 - DNA, 25 bp, Homo sapien
tgtttaatagcaaagtcatcccggg

SEQ ID NO: 220247 - DNA, 25 bp, Homo sapien
tcataggactcgaacggctggaagc

SEQ ID NO: 220248 - DNA, 25 bp, Homo sapien
ttgcgagggcttacccgatcccgat

SEQ ID NO: 220249 - DNA, 25 bp, Homo sapien
tgggtctcggcattcactgtactgc

SEQ ID NO: 220250 - DNA, 25 bp, Homo sapien
ccgcatgaagccatcaagggagccc

SEQ ID NO: 220251 - DNA, 25 bp, Homo sapien
cccacgtagttcagctcgttccagg

SEQ ID NO: 220252 - DNA, 25 bp, Homo sapien
ggtcgaactcatagtcgtagctgta

SEQ ID NO: 220253 - DNA, 25 bp, Homo sapien
atccgtagggcatggtgctgtcata

SEQ ID NO: 220254 - DNA, 25 bp, Homo sapien
tgcatgcccatcacgccgtagtcgg

SEQ ID NO: 220255 - DNA, 25 bp, Homo sapien
tttcgggctgctacgatccagctcc

SEQ ID NO: 220256 - DNA, 25 bp, Homo sapien
cccgcgcggcacagtaacagagaaa

SEQ ID NO: 220257 - DNA, 25 bp, Homo sapien
ccattttgtggcgtcttcggaagag

SEQ ID NO: 220258 - DNA, 25 bp, Homo sapien
tagccctggtccatgtcttcgacgc

SEQ ID NO: 220259 - DNA, 25 bp, Homo sapien
ggcgaccacagcacgcatgcgttca

SEQ ID NO: 220260 - DNA, 25 bp, Homo sapien
tccgccatcgactactggaagacca

SEQ ID NO: 220261 - DNA, 25 bp, Homo sapien
ccattggctggtcttcacgagggcc

SEQ ID NO: 220262 - DNA, 25 bp, Homo sapien
gtttggtttccagcttcggccacgc

SEQ ID NO: 220263 - DNA, 25 bp, Homo sapien
tgaccggtacaggtcgcgctcactc

SEQ ID NO: 220264 - DNA, 25 bp, Homo sapien
atgccctggaacatgccgtactcgg

SEQ ID NO: 220265 - DNA, 25 bp, Homo sapien
cagggtcaagctcgctgtagtcata

SEQ ID NO: 220266 - DNA, 25 bp, Homo sapien
ataggccatttccatctcagggtca

SEQ ID NO: 220267 - DNA, 25 bp, Homo sapien
ggtaggcatcgtattggccctcata

SEQ ID NO: 220268 - DNA, 25 bp, Homo sapien
cgttgccacgcatgcggaactggtc

SEQ ID NO: 220269 - DNA, 25 bp, Homo sapien
tggggtcttcccacatgcgcccata

SEQ ID NO: 220270 - DNA, 25 bp, Homo sapien
gccgagaggcaccagacatgcactg

SEQ ID NO: 220271 - DNA, 25 bp, Homo sapien
cattggctcataccggcctcggctt

SEQ ID NO: 220272 - DNA, 25 bp, Homo sapien
ctcggcttcacgtctattggaagga

SEQ ID NO: 220273 - DNA, 25 bp, Homo sapien
cgccattttgtgaccgcagggaagg

SEQ ID NO: 220274 - DNA, 25 bp, Homo sapien
cctgctcgcaaggaccaaggcctga

SEQ ID NO: 220275 - DNA, 25 bp, Homo sapien
tgctgctctgaacatccgacgctgc

SEQ ID NO: 220276 - DNA, 25 bp, Homo sapien
aggcccacctgtgtagctcatggtg

SEQ ID NO: 220277 - DNA, 25 bp, Homo sapien
tggcgggcaacacaacatccgacga

SEQ ID NO: 220278 - DNA, 25 bp, Homo sapien
ccgacgctgcgatagctgctgctaa

SEQ ID NO: 220279 - DNA, 25 bp, Homo sapien
cgctgttcgcgtgttctgcaattcc

SEQ ID NO: 220280 - DNA, 25 bp, Homo sapien
gcacggggatccacatactcgtctg

SEQ ID NO: 220281 - DNA, 25 bp, Homo sapien
ggaactgcgccgatttggacttttg

SEQ ID NO: 220282 - DNA, 25 bp, Homo sapien
tgcgccgtttggaaaccacaggaca

SEQ ID NO: 220283 - DNA, 25 bp, Homo sapien
gaacgtttcgtctctcccagcgaga

SEQ ID NO: 220284 - DNA, 25 bp, Homo sapien
tcgacgccgttacccagcaggagaa

SEQ ID NO: 220285 - DNA, 25 bp, Homo sapien
tcgtctgtgtatcctgagttccgcc

SEQ ID NO: 220286 - DNA, 25 bp, Homo sapien
caggacttgtcagtacccgagtttc

SEQ ID NO: 220287 - DNA, 25 bp, Homo sapien
tcacgccgaactgccgcaggtgtgc

SEQ ID NO: 220288 - DNA, 25 bp, Homo sapien
cggtgtttgatccactcgctcagtg

SEQ ID NO: 220289 - DNA, 25 bp, Homo sapien
cttctggggccggtgtttgatccac

SEQ ID NO: 220290 - DNA, 25 bp, Homo sapien
atgtagctgcggtaggcgcccacct

SEQ ID NO: 220291 - DNA, 25 bp, Homo sapien
ccggcactgcggaacttcttggtga

SEQ ID NO: 220292 - DNA, 25 bp, Homo sapien
ccctccggcactgcggccgaccacg

SEQ ID NO: 220293 - DNA, 25 bp, Homo sapien
cagaggccgctcaccaccgtcggct

SEQ ID NO: 220294 - DNA, 25 bp, Homo sapien
ccatggccggcactgcggaacttct

SEQ ID NO: 220295 - DNA, 25 bp, Homo sapien
aggggctggccatacccgcggcctt

SEQ ID NO: 220296 - DNA, 25 bp, Homo sapien
gcgtccggatcgctgacgcccaggt

SEQ ID NO: 220297 - DNA, 25 bp, Homo sapien
gagcacgtctatgggggatcccttg

SEQ ID NO: 220298 - DNA, 25 bp, Homo sapien
gatgagcccgtggagcacgtctatg

SEQ ID NO: 220299 - DNA, 25 bp, Homo sapien
tccctcctgatgagcccgtggagca

SEQ ID NO: 220300 - DNA, 25 bp, Homo sapien
gaggcggatctggacgccgtccctc

SEQ ID NO: 220301 - DNA, 25 bp, Homo sapien
cgcggccttcagcttggccttcttg

SEQ ID NO: 220302 - DNA, 25 bp, Homo sapien
gatcccttggcgtccggatcgctga

SEQ ID NO: 220303 - DNA, 25 bp, Homo sapien
cctaggatgggaatcttccggcctc

SEQ ID NO: 220304 - DNA, 25 bp, Homo sapien
tccgcttttgtcactcggcactggg

SEQ ID NO: 220305 - DNA, 25 bp, Homo sapien
ctgaagtgagtttccgcaccggacg

SEQ ID NO: 220306 - DNA, 25 bp, Homo sapien
acatctgtcagacggggcaaaggtc

SEQ ID NO: 220307 - DNA, 25 bp, Homo sapien
tgggcccacacaactaaagggcctg

SEQ ID NO: 220308 - DNA, 25 bp, Homo sapien
cgccgagtgccacgagcgaaaccgt

SEQ ID NO: 220309 - DNA, 25 bp, Homo sapien
agcgaaaccgttcgtctgggccctg

SEQ ID NO: 220310 - DNA, 25 bp, Homo sapien
cccggacatctctatccctaggatg

SEQ ID NO: 220311 - DNA, 25 bp, Homo sapien
ctgtgtggctacctccgaggctgac

SEQ ID NO: 220312 - DNA, 25 bp, Homo sapien
cactgtccaggtctgtgtggctacc

SEQ ID NO: 220313 - DNA, 25 bp, Homo sapien
tccgagttcactgtccaggtctgtg

SEQ ID NO: 220314 - DNA, 25 bp, Homo sapien
gaagcctccgagttcactgtccagg

SEQ ID NO: 220315 - DNA, 25 bp, Homo sapien
tccacagaagcctccgagttcactg

SEQ ID NO: 220316 - DNA, 25 bp, Homo sapien
cacacaggtagggcccggtccggat

SEQ ID NO: 220317 - DNA, 25 bp, Homo sapien
gatgcatgggaacacggccggctcc

SEQ ID NO: 220318 - DNA, 25 bp, Homo sapien
ctacctccgaggctgacgtgggtag

SEQ ID NO: 220319 - DNA, 25 bp, Homo sapien
cgcgcacacagctccctgcagagca

SEQ ID NO: 220320 - DNA, 25 bp, Homo sapien
tcccgcgcacacagctccctgcaga

SEQ ID NO: 220321 - DNA, 25 bp, Homo sapien
tgggcctctgcgcttagccccctgg

SEQ ID NO: 220322 - DNA, 25 bp, Homo sapien
gagcccgccagagaccctccacaag

SEQ ID NO: 220323 - DNA, 25 bp, Homo sapien
caacactcaggaccggggacccgag

SEQ ID NO: 220324 - DNA, 25 bp, Homo sapien
cagctccctgcagagcacgcgtccc

SEQ ID NO: 220325 - DNA, 25 bp, Homo sapien
ccgagcccgccagagaccctccaca

SEQ ID NO: 220326 - DNA, 25 bp, Homo sapien
gcgcttagccccctggggtcgcttc

SEQ ID NO: 220327 - DNA, 25 bp, Homo sapien
caggacgccggaccgggacactctg

SEQ ID NO: 220328 - DNA, 25 bp, Homo sapien
tgggcctgaccttaccttgttcaca

SEQ ID NO: 220329 - DNA, 25 bp, Homo sapien
ggcccaactctctgagcggcgaacg

SEQ ID NO: 220330 - DNA, 25 bp, Homo sapien
tgcccagtgcctggtttcggtcttg

SEQ ID NO: 220331 - DNA, 25 bp, Homo sapien
gtccatttggcgctgccagggtacc

SEQ ID NO: 220332 - DNA, 25 bp, Homo sapien
ggacactctgcgtgcgctgcaccgg

SEQ ID NO: 220333 - DNA, 25 bp, Homo sapien
taccgacggcttccgaggcagcgag

SEQ ID NO: 220334 - DNA, 25 bp, Homo sapien
tggtcccatgctcagggagcctttg

SEQ ID NO: 220335 - DNA, 25 bp, Homo sapien
ccgctccacgttgtcctgcagatgg

SEQ ID NO: 220336 - DNA, 25 bp, Homo sapien
ggaactccgccagctccttgtagcg

SEQ ID NO: 220337 - DNA, 25 bp, Homo sapien
caccgcaagtgaagcgtggagcctc

SEQ ID NO: 220338 - DNA, 25 bp, Homo sapien
cgtggagcctcaaacctgttgcgtc

SEQ ID NO: 220339 - DNA, 25 bp, Homo sapien
ttctagcttttctgggctctccggg

SEQ ID NO: 220340 - DNA, 25 bp, Homo sapien
aaagacttcgcgattgcctggcagg

SEQ ID NO: 220341 - DNA, 25 bp, Homo sapien
ttggagccgttgcaacgatgcaggc

SEQ ID NO: 220342 - DNA, 25 bp, Homo sapien
cgcatagtggaaggtgaggaactcc

SEQ ID NO: 220343 - DNA, 25 bp, Homo sapien
gcaccgcacaactcgggagcgtgtc

SEQ ID NO: 220344 - DNA, 25 bp, Homo sapien
ccgtgtagtgcaggctgcgaagact

SEQ ID NO: 220345 - DNA, 25 bp, Homo sapien
ggctgcgaagactcaccgcggtgaa

SEQ ID NO: 220346 - DNA, 25 bp, Homo sapien
actcaccgcggtgaagtgcggccag

SEQ ID NO: 220347 - DNA, 25 bp, Homo sapien
gcgccgcggtgtagttgcccactat

SEQ ID NO: 220348 - DNA, 25 bp, Homo sapien
gagaagcaagcaccatgcggcgtga

SEQ ID NO: 220349 - DNA, 25 bp, Homo sapien
cgattctgttggtgtgccaagggcc

SEQ ID NO: 220350 - DNA, 25 bp, Homo sapien
gttgcccactatggccacgccgaag

SEQ ID NO: 220351 - DNA, 25 bp, Homo sapien
acaagaatcccagcggcagctgcag

SEQ ID NO: 220352 - DNA, 25 bp, Homo sapien
ctcctacctgtagccgatgtctccc

SEQ ID NO: 220353 - DNA, 25 bp, Homo sapien
ccagccttgcgtgtcctggtggtag

SEQ ID NO: 220354 - DNA, 25 bp, Homo sapien
ctgcatggagcgcatgttggctgcg

SEQ ID NO: 220355 - DNA, 25 bp, Homo sapien
ctgcgcagcgcgtgaagtccgtgca

SEQ ID NO: 220356 - DNA, 25 bp, Homo sapien
caggcacgtaggtgtgatgcacgta

SEQ ID NO: 220357 - DNA, 25 bp, Homo sapien
ggtgtgatgcacgtacaagaatccc

SEQ ID NO: 220358 - DNA, 25 bp, Homo sapien
cacgtacaagaatcccagcggcagc

SEQ ID NO: 220359 - DNA, 25 bp, Homo sapien
acggggctgcatgcccggggcactc

SEQ ID NO: 220360 - DNA, 25 bp, Homo sapien
tcagatcccaggtagtggcgccggt

SEQ ID NO: 220361 - DNA, 25 bp, Homo sapien
agtggcgccggtggatccggatcga

SEQ ID NO: 220362 - DNA, 25 bp, Homo sapien
gcgtggtgagggctgtaacctgagc

SEQ ID NO: 220363 - DNA, 25 bp, Homo sapien
ggatccggatcgagggcaggaggct

SEQ ID NO: 220364 - DNA, 25 bp, Homo sapien
aggaggctgagacccgcgggtgagt

SEQ ID NO: 220365 - DNA, 25 bp, Homo sapien
cggtcagatcccaggtagtggcgcc

SEQ ID NO: 220366 - DNA, 25 bp, Homo sapien
acggcgcggtcagatcccaggtagt

SEQ ID NO: 220367 - DNA, 25 bp, Homo sapien
ccacgtgtagtcagacggcttcttc

SEQ ID NO: 220368 - DNA, 25 bp, Homo sapien
gtcaacattcttgaccttggccgcg

SEQ ID NO: 220369 - DNA, 25 bp, Homo sapien
tgccgccaaactcgataagcatctc

SEQ ID NO: 220370 - DNA, 25 bp, Homo sapien
cccgggcgtagatgttgccgccaaa

SEQ ID NO: 220371 - DNA, 25 bp, Homo sapien
gtggggtgtctcactttcgtagtac

SEQ ID NO: 220372 - DNA, 25 bp, Homo sapien
tttcgtagtactcgaagcacttggc

SEQ ID NO: 220373 - DNA, 25 bp, Homo sapien
aagcatctcgatgaggtcaacattc

SEQ ID NO: 220374 - DNA, 25 bp, Homo sapien
gctgctgctccacgtgtagtcagac

SEQ ID NO: 220375 - DNA, 25 bp, Homo sapien
taacactgctacgtttccgcctgag

SEQ ID NO: 220376 - DNA, 25 bp, Homo sapien
acagagcttcgccatggccgagttg

SEQ ID NO: 220377 - DNA, 25 bp, Homo sapien
tgtggcactaacactgctacgtttc

SEQ ID NO: 220378 - DNA, 25 bp, Homo sapien
ctacgtttccgcctgagcgtggacc

SEQ ID NO: 220379 - DNA, 25 bp, Homo sapien
cctgagcgtggaccgaacgcgcaag

SEQ ID NO: 220380 - DNA, 25 bp, Homo sapien
ggaagccggagctcatactgcgcac

SEQ ID NO: 220381 - DNA, 25 bp, Homo sapien
atactgcgcacggagaacgggctct

SEQ ID NO: 220382 - DNA, 25 bp, Homo sapien
ttgcgcgtggttgtggcactaacac

SEQ ID NO: 220383 - DNA, 25 bp, Homo sapien
cttccgcgtcctgccggaccacgcg

SEQ ID NO: 220384 - DNA, 25 bp, Homo sapien
gaagctggagctgatcgtgcgcgcg

SEQ ID NO: 220385 - DNA, 25 bp, Homo sapien
gggtcctgggcacagtcagagtccc

SEQ ID NO: 220386 - DNA, 25 bp, Homo sapien
cccgggaactgcatcggccagacgt

SEQ ID NO: 220387 - DNA, 25 bp, Homo sapien
cgggaactgcatcggccagacgttc

SEQ ID NO: 220388 - DNA, 25 bp, Homo sapien
atcggccagacgttcgccatggctg

SEQ ID NO: 220389 - DNA, 25 bp, Homo sapien
atggactttggctacgggtggagcc

SEQ ID NO: 220390 - DNA, 25 bp, Homo sapien
agacgttcgccatggctgagatgaa

SEQ ID NO: 220391 - DNA, 25 bp, Homo sapien
gctcaggtctgaacattcttgctag

SEQ ID NO: 220392 - DNA, 25 bp, Homo sapien
acgcttggtgttggcgacagagcct

SEQ ID NO: 220393 - DNA, 25 bp, Homo sapien
gaacaccgtcgtgtaccatcctcgg

SEQ ID NO: 220394 - DNA, 25 bp, Homo sapien
atgtctgcacgcatctccaggtgtg

SEQ ID NO: 220395 - DNA, 25 bp, Homo sapien
ctccaggtgtgcatggtgccaggac

SEQ ID NO: 220396 - DNA, 25 bp, Homo sapien
aggtgcgtgtccacctccgcgtgca

SEQ ID NO: 220397 - DNA, 25 bp, Homo sapien
cctctgtgagggctcaggtctgaac

SEQ ID NO: 220398 - DNA, 25 bp, Homo sapien
aacattcttgctagtgcgcgcgcgt

SEQ ID NO: 220399 - DNA, 25 bp, Homo sapien
cctgtgccagtcagatgttcttctc

SEQ ID NO: 220400 - DNA, 25 bp, Homo sapien
tgttcttctccttcagcttcggctt

SEQ ID NO: 220401 - DNA, 25 bp, Homo sapien
ttcctgctcaccgtcatgggctacg

SEQ ID NO: 220402 - DNA, 25 bp, Homo sapien
tcatgggctacgaccgctacgtggc

SEQ ID NO: 220403 - DNA, 25 bp, Homo sapien
ccctgcgctacaacgtgctcatgag

SEQ ID NO: 220404 - DNA, 25 bp, Homo sapien
agatcctctacaccgtggccatcat

SEQ ID NO: 220405 - DNA, 25 bp, Homo sapien
gccttcctggcctgtgccagtcaga

SEQ ID NO: 220406 - DNA, 25 bp, Homo sapien
tgcgctacaacgtgctcatgagccc

SEQ ID NO: 220407 - DNA, 25 bp, Homo sapien
actgcgcccaggatccgcatttggg

SEQ ID NO: 220408 - DNA, 25 bp, Homo sapien
gcagccaaagtcctccttcagcgcg

SEQ ID NO: 220409 - DNA, 25 bp, Homo sapien
cttcagcgcgcatgatcagctccgg

SEQ ID NO: 220410 - DNA, 25 bp, Homo sapien
tcatcttcgccatggcgaacgcctg

SEQ ID NO: 220411 - DNA, 25 bp, Homo sapien
gaacgcctgcccgatgcagttcctg

SEQ ID NO: 220412 - DNA, 25 bp, Homo sapien
tgtgactgcgcccaggatccgcatt

SEQ ID NO: 220413 - DNA, 25 bp, Homo sapien
ttcaggggctccactcgcagccaaa

SEQ ID NO: 220414 - DNA, 25 bp, Homo sapien
cctgcccgatgcagttcctgcgggt

SEQ ID NO: 220415 - DNA, 25 bp, Homo sapien
tttgcatccgagagcgactcgtccc

SEQ ID NO: 220416 - DNA, 25 bp, Homo sapien
gaagagacttggtcccggatctggc

SEQ ID NO: 220417 - DNA, 25 bp, Homo sapien
atcaccggccaggtatttgcatccg

SEQ ID NO: 220418 - DNA, 25 bp, Homo sapien
gggcgcctcttaccaatcgggcgga

SEQ ID NO: 220419 - DNA, 25 bp, Homo sapien
gcagtgcgtcctggaagccaaagaa

SEQ ID NO: 220420 - DNA, 25 bp, Homo sapien
cactggatcaatcgctcaggggcga

SEQ ID NO: 220421 - DNA, 25 bp, Homo sapien
gcccagcgtaggtgctccgtaagaa

SEQ ID NO: 220422 - DNA, 25 bp, Homo sapien
tgaaaatttccgtccactctgcccg

SEQ ID NO: 220423 - DNA, 25 bp, Homo sapien
tctgactggcacaggccaggaaggc

SEQ ID NO: 220424 - DNA, 25 bp, Homo sapien
ctcatgagcacgttgtagcgcaggg

SEQ ID NO: 220425 - DNA, 25 bp, Homo sapien
ccagcatgcgcgggatgatggccac

SEQ ID NO: 220426 - DNA, 25 bp, Homo sapien
ccacgtagcggtcgtagcccatgac

SEQ ID NO: 220427 - DNA, 25 bp, Homo sapien
cgtagcccatgacggtgagcaggaa

SEQ ID NO: 220428 - DNA, 25 bp, Homo sapien
gggctcatgagcacgttgtagcgca

SEQ ID NO: 220429 - DNA, 25 bp, Homo sapien
aggagaagaacatctgactggcaca

SEQ ID NO: 220430 - DNA, 25 bp, Homo sapien
atgatggccacggtgtagaggatct

SEQ ID NO: 220431 - DNA, 25 bp, Homo sapien
agcagaggaaatattgcctaattca

SEQ ID NO: 220432 - DNA, 25 bp, Homo sapien
ctcctgattgcttgaccttggactc

SEQ ID NO: 220433 - DNA, 25 bp, Homo sapien
cgaggtgggcgctctcgatcagcca

SEQ ID NO: 220434 - DNA, 25 bp, Homo sapien
gcataatgctgtaggccgttgcatc

SEQ ID NO: 220435 - DNA, 25 bp, Homo sapien
ggccgttgcatctactaaacattta

SEQ ID NO: 220436 - DNA, 25 bp, Homo sapien
ggaattataccaattttcttccatg

SEQ ID NO: 220437 - DNA, 25 bp, Homo sapien
gtcttttgaaagacagaagcagagg

SEQ ID NO: 220438 - DNA, 25 bp, Homo sapien
tgaggccagcattatacctaatggc

SEQ ID NO: 220439 - DNA, 25 bp, Homo sapien
agaacagaagcggtagggtcagcaa

SEQ ID NO: 220440 - DNA, 25 bp, Homo sapien
tagggtcagcaagagcaggaaaaga

SEQ ID NO: 220441 - DNA, 25 bp, Homo sapien
ccagtagacacaacccagccgagga

SEQ ID NO: 220442 - DNA, 25 bp, Homo sapien
agggtcagcaagagcaggaaaagaa

SEQ ID NO: 220443 - DNA, 25 bp, Homo sapien
agccgcgggcccagtagacacaacc

SEQ ID NO: 220444 - DNA, 25 bp, Homo sapien
aacagaagcggtagggtcagcaaga

SEQ ID NO: 220445 - DNA, 25 bp, Homo sapien
cagtagacacaacccagccgaggag

SEQ ID NO: 220446 - DNA, 25 bp, Homo sapien
gtagacacaacccagccgaggagca

SEQ ID NO: 220447 - DNA, 25 bp, Homo sapien
taagaaagccgctgaggacaagtgc

SEQ ID NO: 220448 - DNA, 25 bp, Homo sapien
ccgctgaggacaagtgcaagcaggt

SEQ ID NO: 220449 - DNA, 25 bp, Homo sapien
aggacaagtgcaagcaggtgaggtg

SEQ ID NO: 220450 - DNA, 25 bp, Homo sapien
ggagtcctctctgtgcggaaggccg

SEQ ID NO: 220451 - DNA, 25 bp, Homo sapien
agaaagccgctgaggacaagtgcaa

SEQ ID NO: 220452 - DNA, 25 bp, Homo sapien
gcggataagaaagccgctgaggaca

SEQ ID NO: 220453 - DNA, 25 bp, Homo sapien
aagccgctgaggacaagtgcaagca

SEQ ID NO: 220454 - DNA, 25 bp, Homo sapien
aaagccgctgaggacaagtgcaagc

SEQ ID NO: 220455 - DNA, 25 bp, Homo sapien
caatgtgctggtgatcgtggccatc

SEQ ID NO: 220456 - DNA, 25 bp, Homo sapien
tcatcatgggcgtcttcacgctctg

SEQ ID NO: 220457 - DNA, 25 bp, Homo sapien
ccctgtgcatcatggccttcgtgta

SEQ ID NO: 220458 - DNA, 25 bp, Homo sapien
ccaagtgctgcgacttcgtcaccaa

SEQ ID NO: 220459 - DNA, 25 bp, Homo sapien
agaccctgtgtgtcattgccctgga

SEQ ID NO: 220460 - DNA, 25 bp, Homo sapien
gtacggctccttcttctgcgagctg

SEQ ID NO: 220461 - DNA, 25 bp, Homo sapien
cgagccgctgtctcagcagtggaca

SEQ ID NO: 220462 - DNA, 25 bp, Homo sapien
gacggccagcatcgagaccctgtgt

SEQ ID NO: 220463 - DNA, 25 bp, Homo sapien
atgaggatgaaaacgtggagcttcc

SEQ ID NO: 220464 - DNA, 25 bp, Homo sapien
gggtcgcactttctcgcctctttcg

SEQ ID NO: 220465 - DNA, 25 bp, Homo sapien
tcccagcgctttctccaaataagtc

SEQ ID NO: 220466 - DNA, 25 bp, Homo sapien
gcgctttctccaaataagtcccgaa

SEQ ID NO: 220467 - DNA, 25 bp, Homo sapien
gcgtatcgtgcaggctccgactccg

SEQ ID NO: 220468 - DNA, 25 bp, Homo sapien
tggagcttccattgtctagggtttg

SEQ ID NO: 220469 - DNA, 25 bp, Homo sapien
ttgtctagggtttgaccggccgaca

SEQ ID NO: 220470 - DNA, 25 bp, Homo sapien
aaaggggcactttccagcagctgtg

SEQ ID NO: 220471 - DNA, 25 bp, Homo sapien
aggctgagagcgctaccttgctttc

SEQ ID NO: 220472 - DNA, 25 bp, Homo sapien
tcagcccgctcgttagggcgtgtta

SEQ ID NO: 220473 - DNA, 25 bp, Homo sapien
atctccaccataggtaacgggaccg

SEQ ID NO: 220474 - DNA, 25 bp, Homo sapien
gaggacgccttcaactccactttta

SEQ ID NO: 220475 - DNA, 25 bp, Homo sapien
tggcgaagacctacgattacctgtt

SEQ ID NO: 220476 - DNA, 25 bp, Homo sapien
tgctggtcaatcagagcccgtgctc

SEQ ID NO: 220477 - DNA, 25 bp, Homo sapien
cgcgactcttcactgctggtcaatc

SEQ ID NO: 220478 - DNA, 25 bp, Homo sapien
tctgctgtcgcctaacggaactccg

SEQ ID NO: 220479 - DNA, 25 bp, Homo sapien
gagcggtcagaggagaccttaatta

SEQ ID NO: 220480 - DNA, 25 bp, Homo sapien
ccaggcggccttcgagaaaatgcag

SEQ ID NO: 220481 - DNA, 25 bp, Homo sapien
ctcctggaagcaatgggaacgagca

SEQ ID NO: 220482 - DNA, 25 bp, Homo sapien
gacaaagacaaagcgaaactcctgg

SEQ ID NO: 220483 - DNA, 25 bp, Homo sapien
cgcctcctcatgtctttttccagga

SEQ ID NO: 220484 - DNA, 25 bp, Homo sapien
agggcccgcgggattccgtcttcat

SEQ ID NO: 220485 - DNA, 25 bp, Homo sapien
agtgagagaagagtcgccctctgcc

SEQ ID NO: 220486 - DNA, 25 bp, Homo sapien
cttaattacggggagaggatgctgt

SEQ ID NO: 220487 - DNA, 25 bp, Homo sapien
tggcgggagcaagaaacatggttac

SEQ ID NO: 220488 - DNA, 25 bp, Homo sapien
gccctgttgctacgtaacgcggtgg

SEQ ID NO: 220489 - DNA, 25 bp, Homo sapien
cgggccttacttccgggatgcttct

SEQ ID NO: 220490 - DNA, 25 bp, Homo sapien
tacatacgacgtaatgcgcctgcgc

SEQ ID NO: 220491 - DNA, 25 bp, Homo sapien
tctacgtgctggacctgaagggcaa

SEQ ID NO: 220492 - DNA, 25 bp, Homo sapien
catcctgtttctgggtaaccgggcg

SEQ ID NO: 220493 - DNA, 25 bp, Homo sapien
ccgcgttgccaggtaactgactgca

SEQ ID NO: 220494 - DNA, 25 bp, Homo sapien
caccctgttgctaggtaaccggctt

SEQ ID NO: 220495 - DNA, 25 bp, Homo sapien
tgttgttctcagcaatcgcagggcc

SEQ ID NO: 220496 - DNA, 25 bp, Homo sapien
agagaggaagctccgtaatgttctg

SEQ ID NO: 220497 - DNA, 25 bp, Homo sapien
tcagcaatcgcagggcctcgtgtta

SEQ ID NO: 220498 - DNA, 25 bp, Homo sapien
gcctcgtgttagcaggaagcacagc

SEQ ID NO: 220499 - DNA, 25 bp, Homo sapien
ataactccggtatataaagacagcg

SEQ ID NO: 220500 - DNA, 25 bp, Homo sapien
cacagccaagtagggtttcctgcgt

SEQ ID NO: 220501 - DNA, 25 bp, Homo sapien
caagtagggtttcctgcgtgttgga

SEQ ID NO: 220502 - DNA, 25 bp, Homo sapien
ttctgggaggcgatggttaaaaata

SEQ ID NO: 220503 - DNA, 25 bp, Homo sapien
gcaggtggtgcacgcttaggactcc

SEQ ID NO: 220504 - DNA, 25 bp, Homo sapien
ggcacacaggaacactccctaagga

SEQ ID NO: 220505 - DNA, 25 bp, Homo sapien
cctggtgtctgagctgctgcgaccc

SEQ ID NO: 220506 - DNA, 25 bp, Homo sapien
agccttcggtctcttcgacgacgcg

SEQ ID NO: 220507 - DNA, 25 bp, Homo sapien
ggcaagacctacaccaagagttcgc

SEQ ID NO: 220508 - DNA, 25 bp, Homo sapien
ccaagagttcgcatctgaaggcgca

SEQ ID NO: 220509 - DNA, 25 bp, Homo sapien
tgcgacccgagctggatgcgccgct

SEQ ID NO: 220510 - DNA, 25 bp, Homo sapien
cagcgcgcgccagaaaatgaattta

SEQ ID NO: 220511 - DNA, 25 bp, Homo sapien
cggctctcgtacacagagctctgga

SEQ ID NO: 220512 - DNA, 25 bp, Homo sapien
cggcaacaggagagcgtccgtcaca

SEQ ID NO: 220513 - DNA, 25 bp, Homo sapien
gcacccaaatgtgtctgtggtggcc

SEQ ID NO: 220514 - DNA, 25 bp, Homo sapien
tctcccggcacccaaatgtgtctgt

SEQ ID NO: 220515 - DNA, 25 bp, Homo sapien
ttcccgagtgaccttcgcctgctgt

SEQ ID NO: 220516 - DNA, 25 bp, Homo sapien
agctgggctggttcccgagtgacct

SEQ ID NO: 220517 - DNA, 25 bp, Homo sapien
tgctccctttccgacctgcccgcag

SEQ ID NO: 220518 - DNA, 25 bp, Homo sapien
ggtccacattctaacccgtgcgccg

SEQ ID NO: 220519 - DNA, 25 bp, Homo sapien
aaactacaggccgtgatggagacgc

SEQ ID NO: 220520 - DNA, 25 bp, Homo sapien
acagagagcccgagagtgcccggat

SEQ ID NO: 220521 - DNA, 25 bp, Homo sapien
cccgacgaggacagagagcccgaga

SEQ ID NO: 220522 - DNA, 25 bp, Homo sapien
tacaggccgtgatggagacgctgtt

SEQ ID NO: 220523 - DNA, 25 bp, Homo sapien
ggccatgaaactacaggccgtgatg

SEQ ID NO: 220524 - DNA, 25 bp, Homo sapien
gccgcagggccatgaaactacaggc

SEQ ID NO: 220525 - DNA, 25 bp, Homo sapien
gggccgcagggccatgaaactacag

SEQ ID NO: 220526 - DNA, 25 bp, Homo sapien
atggagacgctgttgcagcggcagc

SEQ ID NO: 220527 - DNA, 25 bp, Homo sapien
tgctgagcgcgatggccagttccag

SEQ ID NO: 220528 - DNA, 25 bp, Homo sapien
tgtatatatagacatctgcactgcc

SEQ ID NO: 220529 - DNA, 25 bp, Homo sapien
cccgtgccctgtcccgcctacacac

SEQ ID NO: 220530 - DNA, 25 bp, Homo sapien
ctacacacggccctcgcctaggcgg

SEQ ID NO: 220531 - DNA, 25 bp, Homo sapien
cgcctaggcggcaggcatgtcagcc

SEQ ID NO: 220532 - DNA, 25 bp, Homo sapien
aggcatgtcagccttgctgagcgcg

SEQ ID NO: 220533 - DNA, 25 bp, Homo sapien
ccttggagtacggtggcgacggtgt

SEQ ID NO: 220534 - DNA, 25 bp, Homo sapien
gcggcaggcatgtcagccttgctga

SEQ ID NO: 220535 - DNA, 25 bp, Homo sapien
acttgaggagggtcgatgcctttac

SEQ ID NO: 220536 - DNA, 25 bp, Homo sapien
cgcgaattggtctttgcttaacttc

SEQ ID NO: 220537 - DNA, 25 bp, Homo sapien
gcctttactgaccttctgctgaatg

SEQ ID NO: 220538 - DNA, 25 bp, Homo sapien
cccgtttgcctcgtatcggccaggg

SEQ ID NO: 220539 - DNA, 25 bp, Homo sapien
gagaaacgtggggatgctaattaca

SEQ ID NO: 220540 - DNA, 25 bp, Homo sapien
gctaattacacatcacaggcgccga

SEQ ID NO: 220541 - DNA, 25 bp, Homo sapien
agtcaccgatcccttgcttttcaaa

SEQ ID NO: 220542 - DNA, 25 bp, Homo sapien
cgacagcgacgaaaacaacggcagg

SEQ ID NO: 220543 - DNA, 25 bp, Homo sapien
ctgcatcctttgattcacgtacggc

SEQ ID NO: 220544 - DNA, 25 bp, Homo sapien
cgtgggaaaccgcagccagtgataa

SEQ ID NO: 220545 - DNA, 25 bp, Homo sapien
gccagtgataagctgggaagccaca

SEQ ID NO: 220546 - DNA, 25 bp, Homo sapien
gaacgaagcggctggaagctccaaa

SEQ ID NO: 220547 - DNA, 25 bp, Homo sapien
ggcaccgttcaaagctctgctcaga

SEQ ID NO: 220548 - DNA, 25 bp, Homo sapien
gctccgaaaagagggtgaagctcct

SEQ ID NO: 220549 - DNA, 25 bp, Homo sapien
gagacaggcgatccctcggaaaatc

SEQ ID NO: 220550 - DNA, 25 bp, Homo sapien
ctgggacaaataaatgacagggctc

SEQ ID NO: 220551 - DNA, 25 bp, Homo sapien
agacgtacgatctgcgcccggtgca

SEQ ID NO: 220552 - DNA, 25 bp, Homo sapien
tggttctctgttagggatgccgtcc

SEQ ID NO: 220553 - DNA, 25 bp, Homo sapien
agcccatgccgaggcctggttctct

SEQ ID NO: 220554 - DNA, 25 bp, Homo sapien
ctgtccgagtcgaccatgctgtgtc

SEQ ID NO: 220555 - DNA, 25 bp, Homo sapien
ttccaacgttgttcggactctcatg

SEQ ID NO: 220556 - DNA, 25 bp, Homo sapien
aggcatctgcgtcttccgtgctctc

SEQ ID NO: 220557 - DNA, 25 bp, Homo sapien
tagacagggccacgcatgtgcagtc

SEQ ID NO: 220558 - DNA, 25 bp, Homo sapien
ggatcagtctgagatcgcactgctg

SEQ ID NO: 220559 - DNA, 25 bp, Homo sapien
tcgcagcatgcatatggcccagagc

SEQ ID NO: 220560 - DNA, 25 bp, Homo sapien
ttcctcttggaaatagacggtagcc

SEQ ID NO: 220561 - DNA, 25 bp, Homo sapien
actcccgtcacaactcgcgattatg

SEQ ID NO: 220562 - DNA, 25 bp, Homo sapien
ctcgcgattatgacctgagggtccc

SEQ ID NO: 220563 - DNA, 25 bp, Homo sapien
gatgtagtctcttctgctctggctc

SEQ ID NO: 220564 - DNA, 25 bp, Homo sapien
gcaaccgctccttcaggcgtgaatg

SEQ ID NO: 220565 - DNA, 25 bp, Homo sapien
ctggggtctattggagcatggtcct

SEQ ID NO: 220566 - DNA, 25 bp, Homo sapien
acctccgtctagaaattcctcttgg

SEQ ID NO: 220567 - DNA, 25 bp, Homo sapien
taggggtcatccagagccacgccca

SEQ ID NO: 220568 - DNA, 25 bp, Homo sapien
cggtagttctcataggggtcatcca

SEQ ID NO: 220569 - DNA, 25 bp, Homo sapien
agctcttgttcctgcggtagttctc

SEQ ID NO: 220570 - DNA, 25 bp, Homo sapien
aggagtagctcttgttcctgcggta

SEQ ID NO: 220571 - DNA, 25 bp, Homo sapien
cacgcctttatactggtcccactta

SEQ ID NO: 220572 - DNA, 25 bp, Homo sapien
tggggtcctggatcccttgctcctt

SEQ ID NO: 220573 - DNA, 25 bp, Homo sapien
cccgcccttgatggggtcctggatc

SEQ ID NO: 220574 - DNA, 25 bp, Homo sapien
cggcatgggcgcctacttacactcg

SEQ ID NO: 220575 - DNA, 25 bp, Homo sapien
agcatcacagcgctggctcagacca

SEQ ID NO: 220576 - DNA, 25 bp, Homo sapien
gctcagaccatggaggcgctgccct

SEQ ID NO: 220577 - DNA, 25 bp, Homo sapien
cccgtacactcaccggcagggaagt

SEQ ID NO: 220578 - DNA, 25 bp, Homo sapien
aggggccctcgaactggctgttcca

SEQ ID NO: 220579 - DNA, 25 bp, Homo sapien
atgccctcatggctgttgttccagg

SEQ ID NO: 220580 - DNA, 25 bp, Homo sapien
cctgcgtggtctaggccctagtgct

SEQ ID NO: 220581 - DNA, 25 bp, Homo sapien
agcatcacagcgctcggcagcatca

SEQ ID NO: 220582 - DNA, 25 bp, Homo sapien
acgttgaggcgcctcctacgctgac

SEQ ID NO: 220583 - DNA, 25 bp, Homo sapien
cgggcgatcttctgctgcttgtctt

SEQ ID NO: 220584 - DNA, 25 bp, Homo sapien
ttcctccacggccaagaagctggtg

SEQ ID NO: 220585 - DNA, 25 bp, Homo sapien
tgcttgtcttcctccacggccaaga

SEQ ID NO: 220586 - DNA, 25 bp, Homo sapien
cccaacccggtcagggcgatggctg

SEQ ID NO: 220587 - DNA, 25 bp, Homo sapien
gccctctgccttctcgggaatcggg

SEQ ID NO: 220588 - DNA, 25 bp, Homo sapien
tgagggagagactttccgcgcgtca

SEQ ID NO: 220589 - DNA, 25 bp, Homo sapien
agtagatgggcaccacgaccttctg

SEQ ID NO: 220590 - DNA, 25 bp, Homo sapien
aagctggtgcagtagatgggcacca

SEQ ID NO: 220591 - DNA, 25 bp, Homo sapien
aggccaagccaagctaccgaccgga

SEQ ID NO: 220592 - DNA, 25 bp, Homo sapien
caaccgagccaatgacgagtgagca

SEQ ID NO: 220593 - DNA, 25 bp, Homo sapien
tgaacatccagttcttcccggcctg

SEQ ID NO: 220594 - DNA, 25 bp, Homo sapien
cggggacttggcattgctgaacatc

SEQ ID NO: 220595 - DNA, 25 bp, Homo sapien
tggccggccatcagctcacagtgcg

SEQ ID NO: 220596 - DNA, 25 bp, Homo sapien
ccatcagccgtgatgcggttccgga

SEQ ID NO: 220597 - DNA, 25 bp, Homo sapien
gtggtgcagcacgtcattgatcagg

SEQ ID NO: 220598 - DNA, 25 bp, Homo sapien
atcaggtagatgaggtgcagccgca

SEQ ID NO: 220599 - DNA, 25 bp, Homo sapien
tgggcgagcttgtcgatgacatttc

SEQ ID NO: 220600 - DNA, 25 bp, Homo sapien
tcctgacactttcgcagagtgggtc

SEQ ID NO: 220601 - DNA, 25 bp, Homo sapien
gcacgcgcagaagtttcctgacact

SEQ ID NO: 220602 - DNA, 25 bp, Homo sapien
tgacatttcgaagctcctggtctgg

SEQ ID NO: 220603 - DNA, 25 bp, Homo sapien
tcttctcaaactcgggcccattgcg

SEQ ID NO: 220604 - DNA, 25 bp, Homo sapien
agtaactgtagaattcgcctccgaa

SEQ ID NO: 220605 - DNA, 25 bp, Homo sapien
ccagcgccagcttgcacttgtagta

SEQ ID NO: 220606 - DNA, 25 bp, Homo sapien
cacttacggccgtcgctgggaaact

SEQ ID NO: 220607 - DNA, 25 bp, Homo sapien
gggcaaccgctaactagattcctga

SEQ ID NO: 220608 - DNA, 25 bp, Homo sapien
aacctaccggtgtgtgcataggaca

SEQ ID NO: 220609 - DNA, 25 bp, Homo sapien
gctcttgggctaaactcgctctgca

SEQ ID NO: 220610 - DNA, 25 bp, Homo sapien
tcagggcctcgaccagggatacaag

SEQ ID NO: 220611 - DNA, 25 bp, Homo sapien
tccaagctgtgccacctgagacgtg

SEQ ID NO: 220612 - DNA, 25 bp, Homo sapien
cagtccactgtagatgcgcttccgg

SEQ ID NO: 220613 - DNA, 25 bp, Homo sapien
aggatcaccttgttgaccacgttgc

SEQ ID NO: 220614 - DNA, 25 bp, Homo sapien
cgggcaccttccagatgctgacgtg

SEQ ID NO: 220615 - DNA, 25 bp, Homo sapien
accacggcgactggacttacgagga

SEQ ID NO: 220616 - DNA, 25 bp, Homo sapien
cctgaccacggcgactggacttacg

SEQ ID NO: 220617 - DNA, 25 bp, Homo sapien
agctgcagccgcctgaccacggcga

SEQ ID NO: 220618 - DNA, 25 bp, Homo sapien
cgactggacttacgaggagcagttt

SEQ ID NO: 220619 - DNA, 25 bp, Homo sapien
tggacttacgaggagcagtttaagc

SEQ ID NO: 220620 - DNA, 25 bp, Homo sapien
tacgaggagcagtttaagcaggtga

SEQ ID NO: 220621 - DNA, 25 bp, Homo sapien
gcccacgttgcacggggtgtgtgct

SEQ ID NO: 220622 - DNA, 25 bp, Homo sapien
cctttgaaggcccacgttgcacggg

SEQ ID NO: 220623 - DNA, 25 bp, Homo sapien
ccacgttgtgattctgcgcgcagaa

SEQ ID NO: 220624 - DNA, 25 bp, Homo sapien
tgagcagctgccgagttttttgtga

SEQ ID NO: 220625 - DNA, 25 bp, Homo sapien
cgagggaaccagacgtccacgttgt

SEQ ID NO: 220626 - DNA, 25 bp, Homo sapien
agtactctgggtagtccgcgccgca

SEQ ID NO: 220627 - DNA, 25 bp, Homo sapien
cgcctcgagaaccaaactccagtga

SEQ ID NO: 220628 - DNA, 25 bp, Homo sapien
cagccggtccctgatctgctgcgga

SEQ ID NO: 220629 - DNA, 25 bp, Homo sapien
cgcgcgcgcaaagagtccttgaacc

SEQ ID NO: 220630 - DNA, 25 bp, Homo sapien
acgccggagccgctgtcattgcctg

SEQ ID NO: 220631 - DNA, 25 bp, Homo sapien
gccacgccctaacaaggctgctgga

SEQ ID NO: 220632 - DNA, 25 bp, Homo sapien
tcaggggccaacttttccatagcgg

SEQ ID NO: 220633 - DNA, 25 bp, Homo sapien
tagcggggtccaaccagccaagagt

SEQ ID NO: 220634 - DNA, 25 bp, Homo sapien
ccctgcggagctgacacatcaacaa

SEQ ID NO: 220635 - DNA, 25 bp, Homo sapien
gggctccctggaggaaccaatcagc

SEQ ID NO: 220636 - DNA, 25 bp, Homo sapien
gcagcacaccttgaggtcctgggta

SEQ ID NO: 220637 - DNA, 25 bp, Homo sapien
tggtcgggttcttcctttcaagctc

SEQ ID NO: 220638 - DNA, 25 bp, Homo sapien
aatgggctcgaattcagacgctctc

SEQ ID NO: 220639 - DNA, 25 bp, Homo sapien
cgaggtcctaacctatctccacggg

SEQ ID NO: 220640 - DNA, 25 bp, Homo sapien
tgggcagcaattcctactcactttc

SEQ ID NO: 220641 - DNA, 25 bp, Homo sapien
ttgggcttctggacaaaaggaatcc

SEQ ID NO: 220642 - DNA, 25 bp, Homo sapien
ggaatcctttgactcctgagctgca

SEQ ID NO: 220643 - DNA, 25 bp, Homo sapien
ccaactgggctctaaaatgagatcc

SEQ ID NO: 220644 - DNA, 25 bp, Homo sapien
accctatggggcagaaaagtcttga

SEQ ID NO: 220645 - DNA, 25 bp, Homo sapien
cgaagatcggggtcctaattgagcc

SEQ ID NO: 220646 - DNA, 25 bp, Homo sapien
ggttcctgatcgaacggaccctatg

SEQ ID NO: 220647 - DNA, 25 bp, Homo sapien
tggccatcgcctatgacaacatcgt

SEQ ID NO: 220648 - DNA, 25 bp, Homo sapien
cgaggcccggaaagcaatcaactgc

SEQ ID NO: 220649 - DNA, 25 bp, Homo sapien
tccaggcaggacgtgatatgcattc

SEQ ID NO: 220650 - DNA, 25 bp, Homo sapien
tcgatgggccaagatacacctttta

SEQ ID NO: 220651 - DNA, 25 bp, Homo sapien
accttttacactcagctgcccgaga

SEQ ID NO: 220652 - DNA, 25 bp, Homo sapien
cagcgtggccattctgacggactac

SEQ ID NO: 220653 - DNA, 25 bp, Homo sapien
agctcctatttacgggcctcgtgtc

SEQ ID NO: 220654 - DNA, 25 bp, Homo sapien
tcgtcctggtgctggacatcacctc

SEQ ID NO: 220655 - DNA, 25 bp, Homo sapien
gcgctgctagggagaccagctacca

SEQ ID NO: 220656 - DNA, 25 bp, Homo sapien
accacctcgtgagcgatgacgtctg

SEQ ID NO: 220657 - DNA, 25 bp, Homo sapien
tgagcgatgacgtctgcctgaaggt

SEQ ID NO: 220658 - DNA, 25 bp, Homo sapien
ctctacctgaacgagaagaagcggg

SEQ ID NO: 220659 - DNA, 25 bp, Homo sapien
agctaccagtggaaggctgagcgct

SEQ ID NO: 220660 - DNA, 25 bp, Homo sapien
gctgcatggccgacgagaactgctt

SEQ ID NO: 220661 - DNA, 25 bp, Homo sapien
cgagaactgcttcaaggtgagagga

SEQ ID NO: 220662 - DNA, 25 bp, Homo sapien
gcctgaaggtggtggagctctacct

SEQ ID NO: 220663 - DNA, 25 bp, Homo sapien
caccagcactttgaggagtggcaca

SEQ ID NO: 220664 - DNA, 25 bp, Homo sapien
atggtaccctgcaagacgctgtgtg

SEQ ID NO: 220665 - DNA, 25 bp, Homo sapien
cttgaacgacgtgagaggcatctcc

SEQ ID NO: 220666 - DNA, 25 bp, Homo sapien
cacagccgctggctggaggacaatg

SEQ ID NO: 220667 - DNA, 25 bp, Homo sapien
tcgtgaactccgaggactacatgta

SEQ ID NO: 220668 - DNA, 25 bp, Homo sapien
gcgacgtggactgccgcttcaagct

SEQ ID NO: 220669 - DNA, 25 bp, Homo sapien
ttcaagctcagcactcacaagatgg

SEQ ID NO: 220670 - DNA, 25 bp, Homo sapien
tacatgtaccgtcgcgggaccctct

SEQ ID NO: 220671 - DNA, 25 bp, Homo sapien
cctggcccttggactctgcatggct

SEQ ID NO: 220672 - DNA, 25 bp, Homo sapien
gcgtggatcccttcatctactacta

SEQ ID NO: 220673 - DNA, 25 bp, Homo sapien
tgagcaccctcaacagctgcgtgga

SEQ ID NO: 220674 - DNA, 25 bp, Homo sapien
aacctctatggtgcctacgtgccca

SEQ ID NO: 220675 - DNA, 25 bp, Homo sapien
tctgcatggctgcttggctcatggc

SEQ ID NO: 220676 - DNA, 25 bp, Homo sapien
cggccgcactctatggtcacatgta

SEQ ID NO: 220677 - DNA, 25 bp, Homo sapien
tctactactacgtgtcggccgagtt

SEQ ID NO: 220678 - DNA, 25 bp, Homo sapien
tccgatcgcgtgctctgccatgacg

SEQ ID NO: 220679 - DNA, 25 bp, Homo sapien
gcgttctcctgactttacgttggcc

SEQ ID NO: 220680 - DNA, 25 bp, Homo sapien
cgcgacagttaatgggaggtcctga

SEQ ID NO: 220681 - DNA, 25 bp, Homo sapien
agttaatgggaggtcctgagccctg

SEQ ID NO: 220682 - DNA, 25 bp, Homo sapien
ctgagccctggccttatggaatttc

SEQ ID NO: 220683 - DNA, 25 bp, Homo sapien
ggccttatggaatttcacgcaggta

SEQ ID NO: 220684 - DNA, 25 bp, Homo sapien
cacgcaggtatttgcctaatactta

SEQ ID NO: 220685 - DNA, 25 bp, Homo sapien
tctatgctgcgttctcctgacttta

SEQ ID NO: 220686 - DNA, 25 bp, Homo sapien
tctgggccgccctgcaacaacagcc

SEQ ID NO: 220687 - DNA, 25 bp, Homo sapien
gagtcttgtggctttgagcagcttc

SEQ ID NO: 220688 - DNA, 25 bp, Homo sapien
cttctctgaagaggacgtggcttaa

SEQ ID NO: 220689 - DNA, 25 bp, Homo sapien
actcgagctcgaagcctgcctttgg

SEQ ID NO: 220690 - DNA, 25 bp, Homo sapien
gtgggacctgatctgtcggacagta

SEQ ID NO: 220691 - DNA, 25 bp, Homo sapien
gtctcgcccaccatcggcggtagtg

SEQ ID NO: 220692 - DNA, 25 bp, Homo sapien
tcggaccatttgtggagacgcagga

SEQ ID NO: 220693 - DNA, 25 bp, Homo sapien
tacaaatccagacctgcggaagccc

SEQ ID NO: 220694 - DNA, 25 bp, Homo sapien
cagccctatggcgtctacaaatcca

SEQ ID NO: 220695 - DNA, 25 bp, Homo sapien
ggccgacgtggcctactacaccatg

SEQ ID NO: 220696 - DNA, 25 bp, Homo sapien
ggcggactttgatgacctgtgtaac

SEQ ID NO: 220697 - DNA, 25 bp, Homo sapien
tggaaccatcaagtacgtgcatatg

SEQ ID NO: 220698 - DNA, 25 bp, Homo sapien
ggagcgcaacgcagatggaaccatc

SEQ ID NO: 220699 - DNA, 25 bp, Homo sapien
cggctggacggcaccaaatgttatg

SEQ ID NO: 220700 - DNA, 25 bp, Homo sapien
gcaccacctcggacgtcatcaagga

SEQ ID NO: 220701 - DNA, 25 bp, Homo sapien
ccatgctcaggaagcgcgtgaacca

SEQ ID NO: 220702 - DNA, 25 bp, Homo sapien
gcgtgaaccagtgcatcgtgatctc

SEQ ID NO: 220703 - DNA, 25 bp, Homo sapien
tgctccgggctgctatccgggccat

SEQ ID NO: 220704 - DNA, 25 bp, Homo sapien
ctatccgggccatggcagtgcttcg

SEQ ID NO: 220705 - DNA, 25 bp, Homo sapien
tgcgggagctcatcggcatggaccc

SEQ ID NO: 220706 - DNA, 25 bp, Homo sapien
gcagtgacagctcctacgtgcggga

SEQ ID NO: 220707 - DNA, 25 bp, Homo sapien
gccagacatcgtggccctgctgcgg

SEQ ID NO: 220708 - DNA, 25 bp, Homo sapien
catggactacatgcggccagacatc

SEQ ID NO: 220709 - DNA, 25 bp, Homo sapien
cttccgggagaagaacatggactac

SEQ ID NO: 220710 - DNA, 25 bp, Homo sapien
ggggcgtgaacccacaaaagcgtca

SEQ ID NO: 220711 - DNA, 25 bp, Homo sapien
tactgtaacgaacatcttcggggcg

SEQ ID NO: 220712 - DNA, 25 bp, Homo sapien
cgctgccttcgaggagctgtttatc

SEQ ID NO: 220713 - DNA, 25 bp, Homo sapien
agctgtttatcttgggtgcgttcgc

SEQ ID NO: 220714 - DNA, 25 bp, Homo sapien
cgttcgcgtcgtaattgggatgttc

SEQ ID NO: 220715 - DNA, 25 bp, Homo sapien
aattgggatgttccgagccacctgg

SEQ ID NO: 220716 - DNA, 25 bp, Homo sapien
ccacctggttcttttcagctgtatg

SEQ ID NO: 220717 - DNA, 25 bp, Homo sapien
ggtcatttccctgttgtaagcaata

SEQ ID NO: 220718 - DNA, 25 bp, Homo sapien
tcttttcagctgtatggacgttccc

SEQ ID NO: 220719 - DNA, 25 bp, Homo sapien
atcccaggcggcagggctcccagca

SEQ ID NO: 220720 - DNA, 25 bp, Homo sapien
ggtcctcttgcctctttccaggtca

SEQ ID NO: 220721 - DNA, 25 bp, Homo sapien
acaggttcggatccgcggtcctctt

SEQ ID NO: 220722 - DNA, 25 bp, Homo sapien
cctctttccaggtcagggttcccag

SEQ ID NO: 220723 - DNA, 25 bp, Homo sapien
atcggcagtcgccatcaccgccaga

SEQ ID NO: 220724 - DNA, 25 bp, Homo sapien
acattgagttgcacgtggacgcgga

SEQ ID NO: 220725 - DNA, 25 bp, Homo sapien
ggaacacgtgggcacattgagttgc

SEQ ID NO: 220726 - DNA, 25 bp, Homo sapien
agaccgcagagacaggttcggatcc

SEQ ID NO: 220727 - DNA, 25 bp, Homo sapien
cctgcagatgaagcgggccgccgtc

SEQ ID NO: 220728 - DNA, 25 bp, Homo sapien
gaggacgcaggctgccgtgtacctc

SEQ ID NO: 220729 - DNA, 25 bp, Homo sapien
gccgtgtacctccaggcctcatgga

SEQ ID NO: 220730 - DNA, 25 bp, Homo sapien
ctctaccggcaccagaaacagagca

SEQ ID NO: 220731 - DNA, 25 bp, Homo sapien
acagagcatcatccgcctgcagagc

SEQ ID NO: 220732 - DNA, 25 bp, Homo sapien
acctgcagcgcaagaggtgagcaga

SEQ ID NO: 220733 - DNA, 25 bp, Homo sapien
tggtgctggagcgtcggcacttcct

SEQ ID NO: 220734 - DNA, 25 bp, Homo sapien
tggtgcggaaaatcctgctgctgca

SEQ ID NO: 220735 - DNA, 25 bp, Homo sapien
gcgacttcctccgagccgtcggtga

SEQ ID NO: 220736 - DNA, 25 bp, Homo sapien
tgcgtagacagcctgaccagcgaca

SEQ ID NO: 220737 - DNA, 25 bp, Homo sapien
tggagaagctcctggaacacgtgga

SEQ ID NO: 220738 - DNA, 25 bp, Homo sapien
acggcctgtacaccgagggcctcta

SEQ ID NO: 220739 - DNA, 25 bp, Homo sapien
tctaccgcaagtcgggtgctgccaa

SEQ ID NO: 220740 - DNA, 25 bp, Homo sapien
cgcagcagtcaagctggagaacttc

SEQ ID NO: 220741 - DNA, 25 bp, Homo sapien
tgaccttcgcacagtacggcgactt

SEQ ID NO: 220742 - DNA, 25 bp, Homo sapien
atccacgccatcacaggggtgctga

SEQ ID NO: 220743 - DNA, 25 bp, Homo sapien
ctcggaaggtcagtattaaggtagc

SEQ ID NO: 220744 - DNA, 25 bp, Homo sapien
gcccggaccagatacattccgtgta

SEQ ID NO: 220745 - DNA, 25 bp, Homo sapien
ttcgtaacggtcagagtgaagaccc

SEQ ID NO: 220746 - DNA, 25 bp, Homo sapien
gccgtcgtccttcgtaacggtcaga

SEQ ID NO: 220747 - DNA, 25 bp, Homo sapien
cctgccatctgtctctcaaaagggc

SEQ ID NO: 220748 - DNA, 25 bp, Homo sapien
gtagcgtctgcttttctccttcccg

SEQ ID NO: 220749 - DNA, 25 bp, Homo sapien
aacctggactcggagacgtcggcca

SEQ ID NO: 220750 - DNA, 25 bp, Homo sapien
gaagctgcagtaaccctgccatctg

SEQ ID NO: 220751 - DNA, 25 bp, Homo sapien
ttcctagggttggaagccacctggc

SEQ ID NO: 220752 - DNA, 25 bp, Homo sapien
acttccgccctctcttaacatggag

SEQ ID NO: 220753 - DNA, 25 bp, Homo sapien
cctctcttaacatggagccggcgga

SEQ ID NO: 220754 - DNA, 25 bp, Homo sapien
cggcgtcgaggctggagctaaacct

SEQ ID NO: 220755 - DNA, 25 bp, Homo sapien
agctaaacctggtgcggctgctatc

SEQ ID NO: 220756 - DNA, 25 bp, Homo sapien
ggatctcgcactgccgcgtagagcc

SEQ ID NO: 220757 - DNA, 25 bp, Homo sapien
cgcccggaaggccacttgaaggcac

SEQ ID NO: 220758 - DNA, 25 bp, Homo sapien
tatcccgctgcgaggcgatggcagc

SEQ ID NO: 220759 - DNA, 25 bp, Homo sapien
accatgtttcgaaggtgtgtggcca

SEQ ID NO: 220760 - DNA, 25 bp, Homo sapien
gaccacgattcctgtggcagctgca

SEQ ID NO: 220761 - DNA, 25 bp, Homo sapien
ccaatcgcgtgcgtctatgcaaata

SEQ ID NO: 220762 - DNA, 25 bp, Homo sapien
caaatagcggtcgttctggggaact

SEQ ID NO: 220763 - DNA, 25 bp, Homo sapien
gtcgggtccatcctgcagtaaatgc

SEQ ID NO: 220764 - DNA, 25 bp, Homo sapien
cgcggcgacgtcagagttcatttac

SEQ ID NO: 220765 - DNA, 25 bp, Homo sapien
ggaagtgcctctccgacagcagatc

SEQ ID NO: 220766 - DNA, 25 bp, Homo sapien
gccgggcctctaggcaaaagattta

SEQ ID NO: 220767 - DNA, 25 bp, Homo sapien
gcgatcagttcggacaccggctgcc

SEQ ID NO: 220768 - DNA, 25 bp, Homo sapien
ttgaggcagccatactcggccgagt

SEQ ID NO: 220769 - DNA, 25 bp, Homo sapien
atactcggccgagtcgacctgcagg

SEQ ID NO: 220770 - DNA, 25 bp, Homo sapien
aaggcgcgcacctggtccatgaaag

SEQ ID NO: 220771 - DNA, 25 bp, Homo sapien
gtccatgaaagccacggcgcgctcg

SEQ ID NO: 220772 - DNA, 25 bp, Homo sapien
cgccgcgttcagcacgaagagctcg

SEQ ID NO: 220773 - DNA, 25 bp, Homo sapien
ccactccacggtgctgaagagcagc

SEQ ID NO: 220774 - DNA, 25 bp, Homo sapien
cgccagctcgcacacgttgtcgatg

SEQ ID NO: 220775 - DNA, 25 bp, Homo sapien
gccctcgcaggtgaagacaccgtaa

SEQ ID NO: 220776 - DNA, 25 bp, Homo sapien
cacggtccaagttccacgttcgatt

SEQ ID NO: 220777 - DNA, 25 bp, Homo sapien
ttgcagcaacttcctgcggccggtc

SEQ ID NO: 220778 - DNA, 25 bp, Homo sapien
ggaacctgcaacgatgtagcgccga

SEQ ID NO: 220779 - DNA, 25 bp, Homo sapien
gtagcgccgactgtatacacaatcc

SEQ ID NO: 220780 - DNA, 25 bp, Homo sapien
tgcggcggatgcttcgcttgaaaaa

SEQ ID NO: 220781 - DNA, 25 bp, Homo sapien
agacaccgtaatgcttgccgctcga

SEQ ID NO: 220782 - DNA, 25 bp, Homo sapien
ctcaccggcaggtgtagctgaggtt

SEQ ID NO: 220783 - DNA, 25 bp, Homo sapien
ctcttccagaaagtcgccgcgtctg

SEQ ID NO: 220784 - DNA, 25 bp, Homo sapien
caccctttctctgctcgggttaaca

SEQ ID NO: 220785 - DNA, 25 bp, Homo sapien
caccctagattgtgtttgcttcctc

SEQ ID NO: 220786 - DNA, 25 bp, Homo sapien
cccacagttcctggcaaagcaatga

SEQ ID NO: 220787 - DNA, 25 bp, Homo sapien
ttgggtcgctcgatcaccctcgagg

SEQ ID NO: 220788 - DNA, 25 bp, Homo sapien
tccacctctggccttggacgttggg

SEQ ID NO: 220789 - DNA, 25 bp, Homo sapien
ttgagcctcgccaagatgtctctcc

SEQ ID NO: 220790 - DNA, 25 bp, Homo sapien
ttaacacctggtgcccggaatctcc

SEQ ID NO: 220791 - DNA, 25 bp, Homo sapien
cggcgcggaccctaatttggtgcta

SEQ ID NO: 220792 - DNA, 25 bp, Homo sapien
aggccgagaacgaaggctccaggtc

SEQ ID NO: 220793 - DNA, 25 bp, Homo sapien
cctggcctgaggtcatagcatctag

SEQ ID NO: 220794 - DNA, 25 bp, Homo sapien
caccagggtcagacggcagaggttt

SEQ ID NO: 220795 - DNA, 25 bp, Homo sapien
cgctcggtaagatagagcctgggtc

SEQ ID NO: 220796 - DNA, 25 bp, Homo sapien
ggtccactctgaccgcggtgtttgc

SEQ ID NO: 220797 - DNA, 25 bp, Homo sapien
cccagatctgtcgaggcactgacgc

SEQ ID NO: 220798 - DNA, 25 bp, Homo sapien
ctgcgctaggaccaaagtggggatc

SEQ ID NO: 220799 - DNA, 25 bp, Homo sapien
tcccagagcaggaattcgtggagca

SEQ ID NO: 220800 - DNA, 25 bp, Homo sapien
gggtcccaggatcaagcacggctga

SEQ ID NO: 220801 - DNA, 25 bp, Homo sapien
tcaagcacggctgacacggaagaca

SEQ ID NO: 220802 - DNA, 25 bp, Homo sapien
gggagagcttctgtacaaggtcatc

SEQ ID NO: 220803 - DNA, 25 bp, Homo sapien
caaggtcatcttccgtgagggtccc

SEQ ID NO: 220804 - DNA, 25 bp, Homo sapien
cggcccagcggctacttcttgtctt

SEQ ID NO: 220805 - DNA, 25 bp, Homo sapien
gaattcgtggagcagcgtgttgacc

SEQ ID NO: 220806 - DNA, 25 bp, Homo sapien
tgcggctgtgctcaccaagcgatgc

SEQ ID NO: 220807 - DNA, 25 bp, Homo sapien
tacttttttatttgcagacctgggc

SEQ ID NO: 220808 - DNA, 25 bp, Homo sapien
aaacgcgaggggctctatgcacctc

SEQ ID NO: 220809 - DNA, 25 bp, Homo sapien
gttcgcattgtctgcgcgcacctga

SEQ ID NO: 220810 - DNA, 25 bp, Homo sapien
cgatgaccgattcacgctcccggta

SEQ ID NO: 220811 - DNA, 25 bp, Homo sapien
ctcccaggagagacaaacaggtgtc

SEQ ID NO: 220812 - DNA, 25 bp, Homo sapien
tatgcacctccctggcggtagttcc

SEQ ID NO: 220813 - DNA, 25 bp, Homo sapien
gacctgggccgatgccgctttaaaa

SEQ ID NO: 220814 - DNA, 25 bp, Homo sapien
tgacccgcgtagaagtgaagtactt

SEQ ID NO: 220815 - DNA, 25 bp, Homo sapien
cgcggtggggcctattaaccattag

SEQ ID NO: 220816 - DNA, 25 bp, Homo sapien
cctcgtgctggaccctgaagcatga

SEQ ID NO: 220817 - DNA, 25 bp, Homo sapien
tgtgcccgtgacagacgaccttcct

SEQ ID NO: 220818 - DNA, 25 bp, Homo sapien
agtgtgtgtccaaaagcgtgcctgc

SEQ ID NO: 220819 - DNA, 25 bp, Homo sapien
tgccctgacgtcctttgtgaatgtc

SEQ ID NO: 220820 - DNA, 25 bp, Homo sapien
gccgagtgacgtggcaaacttccca

SEQ ID NO: 220821 - DNA, 25 bp, Homo sapien
ttctaataacacacgcggcagcccg

SEQ ID NO: 220822 - DNA, 25 bp, Homo sapien
cagcaccacggtgttcgtttaggtc

SEQ ID NO: 220823 - DNA, 25 bp, Homo sapien
cttatcgtgcatgccgtggacaagc

SEQ ID NO: 220824 - DNA, 25 bp, Homo sapien
tctacctcggccatgcgctggtctt

SEQ ID NO: 220825 - DNA, 25 bp, Homo sapien
caccctggggatttgtagctgtggc

SEQ ID NO: 220826 - DNA, 25 bp, Homo sapien
tcgggaagaaagcacgcccaccaag

SEQ ID NO: 220827 - DNA, 25 bp, Homo sapien
agtactggccgctcatcatggcccg

SEQ ID NO: 220828 - DNA, 25 bp, Homo sapien
cccggagtacgaaggatgacacgtt

SEQ ID NO: 220829 - DNA, 25 bp, Homo sapien
tgacacgttgaaagcgttgccctcc

SEQ ID NO: 220830 - DNA, 25 bp, Homo sapien
gttgccctcctttaacagctgcttc

SEQ ID NO: 220831 - DNA, 25 bp, Homo sapien
gggcgggtcctgcatgcttcacccg

SEQ ID NO: 220832 - DNA, 25 bp, Homo sapien
cgggcttgacctctacaaaggtgta

SEQ ID NO: 220833 - DNA, 25 bp, Homo sapien
caaaggtgtagccatcgctggactc

SEQ ID NO: 220834 - DNA, 25 bp, Homo sapien
atcgctggactcgacgctctccagt

SEQ ID NO: 220835 - DNA, 25 bp, Homo sapien
caggcaacagaagataccgtcggtc

SEQ ID NO: 220836 - DNA, 25 bp, Homo sapien
ccagagccattctgcccgtgtagga

SEQ ID NO: 220837 - DNA, 25 bp, Homo sapien
ccgcccattgcggtacacggtgatc

SEQ ID NO: 220838 - DNA, 25 bp, Homo sapien
ggcgtgcccagcaggcaacagaaga

SEQ ID NO: 220839 - DNA, 25 bp, Homo sapien
gccttccaggtgttcgtcatccctg

SEQ ID NO: 220840 - DNA, 25 bp, Homo sapien
agcccaatgagaggcggcaattccg

SEQ ID NO: 220841 - DNA, 25 bp, Homo sapien
ctaaggtaacgcacgcccgagactg

SEQ ID NO: 220842 - DNA, 25 bp, Homo sapien
ctaatcccggattgtggagggcaac

SEQ ID NO: 220843 - DNA, 25 bp, Homo sapien
tggtggacaccactcctccgaagtg

SEQ ID NO: 220844 - DNA, 25 bp, Homo sapien
gggcttcgatctctccttttggggc

SEQ ID NO: 220845 - DNA, 25 bp, Homo sapien
cctggcctagttaggagcccaatga

SEQ ID NO: 220846 - DNA, 25 bp, Homo sapien
tcggcctatcgcagctgcggactga

SEQ ID NO: 220847 - DNA, 25 bp, Homo sapien
gtgcaggtcatccttcgccgaatgc

SEQ ID NO: 220848 - DNA, 25 bp, Homo sapien
gccgaatgctcaagggccgcaagtc

SEQ ID NO: 220849 - DNA, 25 bp, Homo sapien
ccggctacctgttggtgtgtatgca

SEQ ID NO: 220850 - DNA, 25 bp, Homo sapien
ggcctcttttttgcacgttaggaga

SEQ ID NO: 220851 - DNA, 25 bp, Homo sapien
cataatcctttgttccagggctgga

SEQ ID NO: 220852 - DNA, 25 bp, Homo sapien
ctgaccgcgggagataatgccttgt

SEQ ID NO: 220853 - DNA, 25 bp, Homo sapien
ttgcgcattttgcagccaggctctg

SEQ ID NO: 220854 - DNA, 25 bp, Homo sapien
acccactgcggatatggctgtcttg

SEQ ID NO: 220855 - DNA, 25 bp, Homo sapien
ctggatctcttcagttcaggagaat

SEQ ID NO: 220856 - DNA, 25 bp, Homo sapien
cttggcaccgcgatatgcagggctt

SEQ ID NO: 220857 - DNA, 25 bp, Homo sapien
caccgcgatatgcagggctttgtcg

SEQ ID NO: 220858 - DNA, 25 bp, Homo sapien
tatgcagggctttgtcgccaaagga

SEQ ID NO: 220859 - DNA, 25 bp, Homo sapien
tcgccaaaggaagtgcgacatcgcc

SEQ ID NO: 220860 - DNA, 25 bp, Homo sapien
gcgacatcgccgattgtcccggttc

SEQ ID NO: 220861 - DNA, 25 bp, Homo sapien
tcgttctcagcacgccggacctgga

SEQ ID NO: 220862 - DNA, 25 bp, Homo sapien
tggtctggcctcgttctcagcacgc

SEQ ID NO: 220863 - DNA, 25 bp, Homo sapien
tcagattatcccatgtggacccagg

SEQ ID NO: 220864 - DNA, 25 bp, Homo sapien
ttctccaccatagtggggctccctt

SEQ ID NO: 220865 - DNA, 25 bp, Homo sapien
cgctcagcgaagctgaccttcttca

SEQ ID NO: 220866 - DNA, 25 bp, Homo sapien
gccgtctctgcctacgggtcgaatc

SEQ ID NO: 220867 - DNA, 25 bp, Homo sapien
ctccggcgggtcaatccaagacgac

SEQ ID NO: 220868 - DNA, 25 bp, Homo sapien
ggccttcaccctcggacggtgtgtc

SEQ ID NO: 220869 - DNA, 25 bp, Homo sapien
gcatcccaacatcaatggccctgtt

SEQ ID NO: 220870 - DNA, 25 bp, Homo sapien
cccagaggcttcctgtatctggcta

SEQ ID NO: 220871 - DNA, 25 bp, Homo sapien
gcctctcatacgtggcggtgacaaa

SEQ ID NO: 220872 - DNA, 25 bp, Homo sapien
ttgcacgatgagctcgggaatgccc

SEQ ID NO: 220873 - DNA, 25 bp, Homo sapien
cggatgtggttcagcagccatagca

SEQ ID NO: 220874 - DNA, 25 bp, Homo sapien
aggtcatcagcacgtcgcagttctc

SEQ ID NO: 220875 - DNA, 25 bp, Homo sapien
cagttctctgtaggcaccgtcttca

SEQ ID NO: 220876 - DNA, 25 bp, Homo sapien
tccacgccttgtgggacaccaggta

SEQ ID NO: 220877 - DNA, 25 bp, Homo sapien
aactcggccttcactgctttgcgca

SEQ ID NO: 220878 - DNA, 25 bp, Homo sapien
cggctggatagcatggttggcactt

SEQ ID NO: 220879 - DNA, 25 bp, Homo sapien
gttctcagctgagttcgcccgccta

SEQ ID NO: 220880 - DNA, 25 bp, Homo sapien
cgtctccgcccgtgttgttttctgg

SEQ ID NO: 220881 - DNA, 25 bp, Homo sapien
gtccagacaccacgccaggttacgt

SEQ ID NO: 220882 - DNA, 25 bp, Homo sapien
tcgcccgcctagttctttggttcgc

SEQ ID NO: 220883 - DNA, 25 bp, Homo sapien
cacgtcactctagggttctcagctg

SEQ ID NO: 220884 - DNA, 25 bp, Homo sapien
cggcccgatgcacgtcactctaggg

SEQ ID NO: 220885 - DNA, 25 bp, Homo sapien
caggttacgtttgaccctgatcctc

SEQ ID NO: 220886 - DNA, 25 bp, Homo sapien
ctagttctttggttcgcgtctccgc

SEQ ID NO: 220887 - DNA, 25 bp, Homo sapien
gggaacaacatttcgctacacctac

SEQ ID NO: 220888 - DNA, 25 bp, Homo sapien
cctacctccataccgcctcccgctc

SEQ ID NO: 220889 - DNA, 25 bp, Homo sapien
cacctacctccataccgcctcccgc

SEQ ID NO: 220890 - DNA, 25 bp, Homo sapien
acaacatttcgctacacctacctcc

SEQ ID NO: 220891 - DNA, 25 bp, Homo sapien
cggggaacaacatttcgctacacct

SEQ ID NO: 220892 - DNA, 25 bp, Homo sapien
ggaacaacatttcgctacacctacc

SEQ ID NO: 220893 - DNA, 25 bp, Homo sapien
ggggaacaacatttcgctacaccta

SEQ ID NO: 220894 - DNA, 25 bp, Homo sapien
gaacaacatttcgctacacctacct

SEQ ID NO: 220895 - DNA, 25 bp, Homo sapien
cgggtcgcaggttgtaaatccatgt

SEQ ID NO: 220896 - DNA, 25 bp, Homo sapien
ctgcccagacttgaagccacacagg

SEQ ID NO: 220897 - DNA, 25 bp, Homo sapien
cactttactagtcaagccgcggagt

SEQ ID NO: 220898 - DNA, 25 bp, Homo sapien
tggtcgagaatagttgagcacttta

SEQ ID NO: 220899 - DNA, 25 bp, Homo sapien
tcctaagatacccaatggtggtcga

SEQ ID NO: 220900 - DNA, 25 bp, Homo sapien
ggtgggcaggacgtatcctaagata

SEQ ID NO: 220901 - DNA, 25 bp, Homo sapien
agcgagtatcttcagacggtgggca

SEQ ID NO: 220902 - DNA, 25 bp, Homo sapien
cagccaatggaagcgagtatcttca

SEQ ID NO: 220903 - DNA, 25 bp, Homo sapien
gtgtggccacatacagcagggagct

SEQ ID NO: 220904 - DNA, 25 bp, Homo sapien
tcacactccgaggatgaggttgcgg

SEQ ID NO: 220905 - DNA, 25 bp, Homo sapien
ccacgtagagtggtggttttgctca

SEQ ID NO: 220906 - DNA, 25 bp, Homo sapien
caccctgacgggcagtgccttgcgg

SEQ ID NO: 220907 - DNA, 25 bp, Homo sapien
ttgctcactgagtcacactccgagg

SEQ ID NO: 220908 - DNA, 25 bp, Homo sapien
ggagtaccaggatgtgcctgacctg

SEQ ID NO: 220909 - DNA, 25 bp, Homo sapien
cttcctgcgggccaaagtcttcgtg

SEQ ID NO: 220910 - DNA, 25 bp, Homo sapien
atggcattcccttccgtggtggccc

SEQ ID NO: 220911 - DNA, 25 bp, Homo sapien
agcctcccaggtgcgctgattcgcc

SEQ ID NO: 220912 - DNA, 25 bp, Homo sapien
tcttcgcgctaagctctggccaagg

SEQ ID NO: 220913 - DNA, 25 bp, Homo sapien
tccagattgtgcacgcgccggagca

SEQ ID NO: 220914 - DNA, 25 bp, Homo sapien
cctccggttccagattgtgcacgcg

SEQ ID NO: 220915 - DNA, 25 bp, Homo sapien
ccgctgcggcatcgcagtgatccgg

SEQ ID NO: 220916 - DNA, 25 bp, Homo sapien
catcgcagtgatccggaccagcggc

SEQ ID NO: 220917 - DNA, 25 bp, Homo sapien
gatcatcgagccctcggtctacttg

SEQ ID NO: 220918 - DNA, 25 bp, Homo sapien
gagccctcggtctacttgacactga

SEQ ID NO: 220919 - DNA, 25 bp, Homo sapien
gcggggctctcagcatctgcatccg

SEQ ID NO: 220920 - DNA, 25 bp, Homo sapien
tgctgacgggaattgaaaggacctc

SEQ ID NO: 220921 - DNA, 25 bp, Homo sapien
ctggagagtgttattaatatccgcc

SEQ ID NO: 220922 - DNA, 25 bp, Homo sapien
gggccgcgcttcattgtcatttctg

SEQ ID NO: 220923 - DNA, 25 bp, Homo sapien
cccggaatctcgtgatctggaaatc

SEQ ID NO: 220924 - DNA, 25 bp, Homo sapien
ggcgatcgcacgaagggcccgtcac

SEQ ID NO: 220925 - DNA, 25 bp, Homo sapien
tcacagatgagaagaccgaggtgcc

SEQ ID NO: 220926 - DNA, 25 bp, Homo sapien
aaaggacctcgtggcttaggcaggc

SEQ ID NO: 220927 - DNA, 25 bp, Homo sapien
ggcgctgtgagcatatccctgcatc

SEQ ID NO: 220928 - DNA, 25 bp, Homo sapien
ccgcgtctgtgtgacattaatatgt

SEQ ID NO: 220929 - DNA, 25 bp, Homo sapien
acgtcgttgctgcatctcggtgtga

SEQ ID NO: 220930 - DNA, 25 bp, Homo sapien
tcggtgtgacgtcatgccaagttcc

SEQ ID NO: 220931 - DNA, 25 bp, Homo sapien
gcatctgcacgacgccatcgctata

SEQ ID NO: 220932 - DNA, 25 bp, Homo sapien
tcgctatatctcttcgtgacgtcta

SEQ ID NO: 220933 - DNA, 25 bp, Homo sapien
cacggtgatatgtgacgtcagcgcc

SEQ ID NO: 220934 - DNA, 25 bp, Homo sapien
acgtgacgccatcaccacggtgata

SEQ ID NO: 220935 - DNA, 25 bp, Homo sapien
aagaagtagcgcaggtaataccagc

SEQ ID NO: 220936 - DNA, 25 bp, Homo sapien
ctgcaggttggactctgtgctcacg

SEQ ID NO: 220937 - DNA, 25 bp, Homo sapien
ctgtgctcacgtgcacgttgccata

SEQ ID NO: 220938 - DNA, 25 bp, Homo sapien
catagaccatgaagagcacgagccc

SEQ ID NO: 220939 - DNA, 25 bp, Homo sapien
gtagcgcaggtaataccagcagccc

SEQ ID NO: 220940 - DNA, 25 bp, Homo sapien
agcgtaggaccctccgtgctccatg

SEQ ID NO: 220941 - DNA, 25 bp, Homo sapien
cccatttgctcgatcccgccgtccg

SEQ ID NO: 220942 - DNA, 25 bp, Homo sapien
cgtgcacgttgccatagaccatgaa

SEQ ID NO: 220943 - DNA, 25 bp, Homo sapien
tgatagtctgcatgccgtttgcacg

SEQ ID NO: 220944 - DNA, 25 bp, Homo sapien
ccacgcacgccggaatccaagttga

SEQ ID NO: 220945 - DNA, 25 bp, Homo sapien
tcaggctggagactcccgcgcccac

SEQ ID NO: 220946 - DNA, 25 bp, Homo sapien
tccagccgccgcgtagactccgtgg

SEQ ID NO: 220947 - DNA, 25 bp, Homo sapien
cgccggaatccaagttgatagtctg

SEQ ID NO: 220948 - DNA, 25 bp, Homo sapien
tccaagttgatagtctgcatgccgt

SEQ ID NO: 220949 - DNA, 25 bp, Homo sapien
tcactcacaggcgttcgcgcagcgc

SEQ ID NO: 220950 - DNA, 25 bp, Homo sapien
gccgcacaggcttcgccctcggcct

SEQ ID NO: 220951 - DNA, 25 bp, Homo sapien
tggtccagctgcctggctagggcct

SEQ ID NO: 220952 - DNA, 25 bp, Homo sapien
ttaattggcaccttggggcgccagg

SEQ ID NO: 220953 - DNA, 25 bp, Homo sapien
cccagacggccacgaatatttaatt

SEQ ID NO: 220954 - DNA, 25 bp, Homo sapien
tgctgccgcagccaggaacacggcc

SEQ ID NO: 220955 - DNA, 25 bp, Homo sapien
cggccagattccaggctaccagggc

SEQ ID NO: 220956 - DNA, 25 bp, Homo sapien
aggcggccagattccaggctaccag

SEQ ID NO: 220957 - DNA, 25 bp, Homo sapien
tgccggatactttccgcctggtcca

SEQ ID NO: 220958 - DNA, 25 bp, Homo sapien
atatttaattggcaccttggggcgc

SEQ ID NO: 220959 - DNA, 25 bp, Homo sapien
tccagatcgtggtggacaagagccc

SEQ ID NO: 220960 - DNA, 25 bp, Homo sapien
cttcgcgcagaaatctggctacttc

SEQ ID NO: 220961 - DNA, 25 bp, Homo sapien
agcctagaggtaagaggtgcccacc

SEQ ID NO: 220962 - DNA, 25 bp, Homo sapien
catggattccagtaagggctgcttc

SEQ ID NO: 220963 - DNA, 25 bp, Homo sapien
gccttagttctctgggcagcctaga

SEQ ID NO: 220964 - DNA, 25 bp, Homo sapien
acccgccagctttggcaagagcttc

SEQ ID NO: 220965 - DNA, 25 bp, Homo sapien
gcgtatactgcgcttccgggcaatc

SEQ ID NO: 220966 - DNA, 25 bp, Homo sapien
cggtagatctcctgcaccgtcgagg

SEQ ID NO: 220967 - DNA, 25 bp, Homo sapien
cccactagggactggatcgcgggaa

SEQ ID NO: 220968 - DNA, 25 bp, Homo sapien
ccacagctcgctaagttcagaaaag

SEQ ID NO: 220969 - DNA, 25 bp, Homo sapien
aggcggtgaggccagtcctcctacc

SEQ ID NO: 220970 - DNA, 25 bp, Homo sapien
cagggtcattgcagccagcacccgg

SEQ ID NO: 220971 - DNA, 25 bp, Homo sapien
ccggccgccgtaagaacgggccatg

SEQ ID NO: 220972 - DNA, 25 bp, Homo sapien
gacgccgaatctccgcgaaaacttg

SEQ ID NO: 220973 - DNA, 25 bp, Homo sapien
atctccgcgaaaacttgggacaaag

SEQ ID NO: 220974 - DNA, 25 bp, Homo sapien
gctaagttcagaaaagggcaccacc

SEQ ID NO: 220975 - DNA, 25 bp, Homo sapien
tccactgagaactggcgcccgaggt

SEQ ID NO: 220976 - DNA, 25 bp, Homo sapien
gcactcggtgaggctccgtggctcc

SEQ ID NO: 220977 - DNA, 25 bp, Homo sapien
gccggcaggcgctccactgagaact

SEQ ID NO: 220978 - DNA, 25 bp, Homo sapien
cttgagcaccacgaccgccggcagg

SEQ ID NO: 220979 - DNA, 25 bp, Homo sapien
gcgccgtcgcgagtgagcacgtccc

SEQ ID NO: 220980 - DNA, 25 bp, Homo sapien
ctcctgccagttggcgaagcaggcg

SEQ ID NO: 220981 - DNA, 25 bp, Homo sapien
cgcctcctgccagttggcgaagcag

SEQ ID NO: 220982 - DNA, 25 bp, Homo sapien
cagctggaagttgcggtccagcacc

SEQ ID NO: 220983 - DNA, 25 bp, Homo sapien
gggtagagatcctgcacgccaacta

SEQ ID NO: 220984 - DNA, 25 bp, Homo sapien
tgcctctctatggtcgtggcttctg

SEQ ID NO: 220985 - DNA, 25 bp, Homo sapien
ggccgttctagcacccatgtctctt

SEQ ID NO: 220986 - DNA, 25 bp, Homo sapien
tgtcatggagacagcggacgaccct

SEQ ID NO: 220987 - DNA, 25 bp, Homo sapien
gcaaggcttggttgtcatggagaca

SEQ ID NO: 220988 - DNA, 25 bp, Homo sapien
ggctgcaggacacgtgtgtttccta

SEQ ID NO: 220989 - DNA, 25 bp, Homo sapien
cgccaactagggctcgggtcctgat

SEQ ID NO: 220990 - DNA, 25 bp, Homo sapien
ggtcctgatatcttgcgagccacgc

SEQ ID NO: 220991 - DNA, 25 bp, Homo sapien
agaaggcctgccgtttggcaccgac

SEQ ID NO: 220992 - DNA, 25 bp, Homo sapien
ctccgtgctgcagaacgagcactca

SEQ ID NO: 220993 - DNA, 25 bp, Homo sapien
cgagcactcattccaggcacagctg

SEQ ID NO: 220994 - DNA, 25 bp, Homo sapien
ttcacgctgttcctgttcacggcca

SEQ ID NO: 220995 - DNA, 25 bp, Homo sapien
agatgaccaacctgcaggccgcgca

SEQ ID NO: 220996 - DNA, 25 bp, Homo sapien
tggacatggtcttcagctgcctgta

SEQ ID NO: 220997 - DNA, 25 bp, Homo sapien
gccaagatgcactgcgagccactga

SEQ ID NO: 220998 - DNA, 25 bp, Homo sapien
cgggctgcccaagggtaaattgcta

SEQ ID NO: 220999 - DNA, 25 bp, Homo sapien
tctctcctgcaacaggtgagaagcc

SEQ ID NO: 221000 - DNA, 25 bp, Homo sapien
ccgagtcctggcaagacgagtccta

SEQ ID NO: 221001 - DNA, 25 bp, Homo sapien
caggcatctttcctgtgcggcggga

SEQ ID NO: 221002 - DNA, 25 bp, Homo sapien
aaggactcaacagcccgaccctttg

SEQ ID NO: 221003 - DNA, 25 bp, Homo sapien
cgatgacccgaacggcaggacgttt

SEQ ID NO: 221004 - DNA, 25 bp, Homo sapien
tgcgcactgagctaagccctcgggt

SEQ ID NO: 221005 - DNA, 25 bp, Homo sapien
gctgacagtcggctcttgagtcggt

SEQ ID NO: 221006 - DNA, 25 bp, Homo sapien
cagtgggctctgcttatcccgagtc

SEQ ID NO: 221007 - DNA, 25 bp, Homo sapien
cggagtctgactcggagcgcgttcc

SEQ ID NO: 221008 - DNA, 25 bp, Homo sapien
tctcgctggcgctgttgtggctgct

SEQ ID NO: 221009 - DNA, 25 bp, Homo sapien
ggctggcgcttcctgcgcatcgtct

SEQ ID NO: 221010 - DNA, 25 bp, Homo sapien
ttcctgcgcatcgtctgcaagaccg

SEQ ID NO: 221011 - DNA, 25 bp, Homo sapien
catcgtctgcaagaccgcgaggcga

SEQ ID NO: 221012 - DNA, 25 bp, Homo sapien
ccgcgaggcgagacctcttgtgagt

SEQ ID NO: 221013 - DNA, 25 bp, Homo sapien
agacctcttgtgagtgttgccggga

SEQ ID NO: 221014 - DNA, 25 bp, Homo sapien
cttgtgagtgttgccgggatccgtc

SEQ ID NO: 221015 - DNA, 25 bp, Homo sapien
cgcgcatctttcaggcggtagtgca

SEQ ID NO: 221016 - DNA, 25 bp, Homo sapien
agtgctggacctttgcgcagctgga

SEQ ID NO: 221017 - DNA, 25 bp, Homo sapien
gctggacgcctactccaatgcggta

SEQ ID NO: 221018 - DNA, 25 bp, Homo sapien
tactccaatgcggtagccaacctct

SEQ ID NO: 221019 - DNA, 25 bp, Homo sapien
ggcgctaaggccctgatctttggag

SEQ ID NO: 221020 - DNA, 25 bp, Homo sapien
cggcggtgaccatgacccatgtgtt

SEQ ID NO: 221021 - DNA, 25 bp, Homo sapien
tgacccatgtgttggggaccacagc

SEQ ID NO: 221022 - DNA, 25 bp, Homo sapien
cagcggtctctctgtgctgatccgc

SEQ ID NO: 221023 - DNA, 25 bp, Homo sapien
acggatggatgaggccgtccccaga

SEQ ID NO: 221024 - DNA, 25 bp, Homo sapien
ggatgaggccgtccccagagtgaac

SEQ ID NO: 221025 - DNA, 25 bp, Homo sapien
gccgtccccagagtgaacggatgga

SEQ ID NO: 221026 - DNA, 25 bp, Homo sapien
gtccccagagtgaacggatggatga

SEQ ID NO: 221027 - DNA, 25 bp, Homo sapien
tggatgaggccgtccccagagtgaa

SEQ ID NO: 221028 - DNA, 25 bp, Homo sapien
gaacggatggatgaggccgtcccca

SEQ ID NO: 221029 - DNA, 25 bp, Homo sapien
cgtccccagagtgaacggatggatg

SEQ ID NO: 221030 - DNA, 25 bp, Homo sapien
aggccgtccccagagtgaacggatg

SEQ ID NO: 221031 - DNA, 25 bp, Homo sapien
ttgccaacatggacggcaaggtgca

SEQ ID NO: 221032 - DNA, 25 bp, Homo sapien
tacatcggggagatctgccgctacc

SEQ ID NO: 221033 - DNA, 25 bp, Homo sapien
gggatacataaaacagcctggactg

SEQ ID NO: 221034 - DNA, 25 bp, Homo sapien
cgtcctgccatctgggaggagttca

SEQ ID NO: 221035 - DNA, 25 bp, Homo sapien
gcgtacgccaaatcggggagttcta

SEQ ID NO: 221036 - DNA, 25 bp, Homo sapien
cgccaccgagtgcaactgcagcatt

SEQ ID NO: 221037 - DNA, 25 bp, Homo sapien
tctcggagttcagggaagaccactg

SEQ ID NO: 221038 - DNA, 25 bp, Homo sapien
cccaggtggttcagtacatcgggga

SEQ ID NO: 221039 - DNA, 25 bp, Homo sapien
ggagaacgtctccaccaccgaggtg

SEQ ID NO: 221040 - DNA, 25 bp, Homo sapien
ctgcgccgcttcgatggctatgtca

SEQ ID NO: 221041 - DNA, 25 bp, Homo sapien
ggctatgtcagcgagagcgccacca

SEQ ID NO: 221042 - DNA, 25 bp, Homo sapien
gagagcgccaccagcaagaagatcg

SEQ ID NO: 221043 - DNA, 25 bp, Homo sapien
cacagcgtcttcagcaagggcgaca

SEQ ID NO: 221044 - DNA, 25 bp, Homo sapien
tacctctcaggtgcgcagcctgcta

SEQ ID NO: 221045 - DNA, 25 bp, Homo sapien
ggctacatgtacttccgggaccgta

SEQ ID NO: 221046 - DNA, 25 bp, Homo sapien
ctctgccaggtgacgtgctagtgat

SEQ ID NO: 221047 - DNA, 25 bp, Homo sapien
cgtctcgatgctagcccgcgagcta

SEQ ID NO: 221048 - DNA, 25 bp, Homo sapien
gtactcgaaaccaagcggcagggcc

SEQ ID NO: 221049 - DNA, 25 bp, Homo sapien
gtgcccttcgatcacgccgagagca

SEQ ID NO: 221050 - DNA, 25 bp, Homo sapien
tcatgccgagatggtcacgcccact

SEQ ID NO: 221051 - DNA, 25 bp, Homo sapien
atggtctacttgcagtccgtcttcc

SEQ ID NO: 221052 - DNA, 25 bp, Homo sapien
ccgagtggcccatgtcaaacgatgc

SEQ ID NO: 221053 - DNA, 25 bp, Homo sapien
ggggccactgggtatcatgccaaga

SEQ ID NO: 221054 - DNA, 25 bp, Homo sapien
ggtgcttcacttgcctcactgcgca

SEQ ID NO: 221055 - DNA, 25 bp, Homo sapien
ggctctcctttcaaaaagccacgtc

SEQ ID NO: 221056 - DNA, 25 bp, Homo sapien
cccacaccgggaaactgtgctggtt

SEQ ID NO: 221057 - DNA, 25 bp, Homo sapien
aactgtgctggttcttggacgaggc

SEQ ID NO: 221058 - DNA, 25 bp, Homo sapien
cctgaccgtgcccttcgagaagcat

SEQ ID NO: 221059 - DNA, 25 bp, Homo sapien
gcccttcgagaagcattccactttg

SEQ ID NO: 221060 - DNA, 25 bp, Homo sapien
gcattccactttgtagctggccaga

SEQ ID NO: 221061 - DNA, 25 bp, Homo sapien
cctgctggccgccactctccgggct

SEQ ID NO: 221062 - DNA, 25 bp, Homo sapien
cactttgtagctggccagagggacg

SEQ ID NO: 221063 - DNA, 25 bp, Homo sapien
accggtctgggcagcttctagacgc

SEQ ID NO: 221064 - DNA, 25 bp, Homo sapien
accgaggtatgcacggcgtccggat

SEQ ID NO: 221065 - DNA, 25 bp, Homo sapien
ttccagcccgaaaaggacgagctgc

SEQ ID NO: 221066 - DNA, 25 bp, Homo sapien
cgtgacctaagcgaagaatgggctt

SEQ ID NO: 221067 - DNA, 25 bp, Homo sapien
cttgcgtcgctggagaagacgatcc

SEQ ID NO: 221068 - DNA, 25 bp, Homo sapien
ttacaatgggtagaagagggcgctc

SEQ ID NO: 221069 - DNA, 25 bp, Homo sapien
gcctagagtctgtccggaggaaacc

SEQ ID NO: 221070 - DNA, 25 bp, Homo sapien
ccaagcataggatgtgcaagggaac

SEQ ID NO: 221071 - DNA, 25 bp, Homo sapien
cacggcgctatggtgagtcgagccc

SEQ ID NO: 221072 - DNA, 25 bp, Homo sapien
tgttggcgcgaaacgcggcccacgc

SEQ ID NO: 221073 - DNA, 25 bp, Homo sapien
cgcgcgtgctcatcgcgctgttggc

SEQ ID NO: 221074 - DNA, 25 bp, Homo sapien
acgacttaaaggagacgcgtggcgc

SEQ ID NO: 221075 - DNA, 25 bp, Homo sapien
cggccagagtcctcccgcagaaaaa

SEQ ID NO: 221076 - DNA, 25 bp, Homo sapien
tatgtgcctttaagatcggtgcggg

SEQ ID NO: 221077 - DNA, 25 bp, Homo sapien
ctccgagcgctatgtgcctttaaga

SEQ ID NO: 221078 - DNA, 25 bp, Homo sapien
catcgggacggttctacgcatgccc

SEQ ID NO: 221079 - DNA, 25 bp, Homo sapien
tggtagacggcaagtgattcagatg

SEQ ID NO: 221080 - DNA, 25 bp, Homo sapien
caagacaccggacaagatgggcttc

SEQ ID NO: 221081 - DNA, 25 bp, Homo sapien
caccggacaagatgggcttcgacga

SEQ ID NO: 221082 - DNA, 25 bp, Homo sapien
ctgcaggcacaggagatcgagtgcc

SEQ ID NO: 221083 - DNA, 25 bp, Homo sapien
tggacggcaagtgagtccgaggcct

SEQ ID NO: 221084 - DNA, 25 bp, Homo sapien
gtgtagacctcgctggtagacggca

SEQ ID NO: 221085 - DNA, 25 bp, Homo sapien
acctcgctggtagacggcaagtgat

SEQ ID NO: 221086 - DNA, 25 bp, Homo sapien
tcccaccaagacaccggacaagatg

SEQ ID NO: 221087 - DNA, 25 bp, Homo sapien
gcggtgccattccaacttctgcaac

SEQ ID NO: 221088 - DNA, 25 bp, Homo sapien
cccagacttcacaatacggagcttc

SEQ ID NO: 221089 - DNA, 25 bp, Homo sapien
ccgcccggctttcgattgatcattc

SEQ ID NO: 221090 - DNA, 25 bp, Homo sapien
atacggagcttctcacaccgagaac

SEQ ID NO: 221091 - DNA, 25 bp, Homo sapien
accgagaacatgtccgcccggcttt

SEQ ID NO: 221092 - DNA, 25 bp, Homo sapien
cctccgacgagcaggactgaagaag

SEQ ID NO: 221093 - DNA, 25 bp, Homo sapien
ctgcaaccatgcacagtgatcgata

SEQ ID NO: 221094 - DNA, 25 bp, Homo sapien
attacctttttccttcaccatggca

SEQ ID NO: 221095 - DNA, 25 bp, Homo sapien
ctggtggaggccgactattcctact

SEQ ID NO: 221096 - DNA, 25 bp, Homo sapien
ggacgagttcctgcccgtcatgttc

SEQ ID NO: 221097 - DNA, 25 bp, Homo sapien
aaggctgtgcctcgcgtgaggaacc

SEQ ID NO: 221098 - DNA, 25 bp, Homo sapien
tattcctactggaccctggcctacg

SEQ ID NO: 221099 - DNA, 25 bp, Homo sapien
tggcctacgtgatctccctgcaagg

SEQ ID NO: 221100 - DNA, 25 bp, Homo sapien
gcaaggcgcccgcaaactgctggct

SEQ ID NO: 221101 - DNA, 25 bp, Homo sapien
tgctgagccgctctccaagatgctg

SEQ ID NO: 221102 - DNA, 25 bp, Homo sapien
tctccaagatgctgcctgtggacga

SEQ ID NO: 221103 - DNA, 25 bp, Homo sapien
gacttgagcttcacgaactccttgg

SEQ ID NO: 221104 - DNA, 25 bp, Homo sapien
cccaccgaaaaatgaccgcatagtt

SEQ ID NO: 221105 - DNA, 25 bp, Homo sapien
acttgacctacaaccctgtgcttgg

SEQ ID NO: 221106 - DNA, 25 bp, Homo sapien
ggcggaacgtgagacaggccacacc

SEQ ID NO: 221107 - DNA, 25 bp, Homo sapien
agctcatagcactcgggacccgcgt

SEQ ID NO: 221108 - DNA, 25 bp, Homo sapien
tgacgcacacctgcagctcatagca

SEQ ID NO: 221109 - DNA, 25 bp, Homo sapien
gcgaagcagtagtccttgacgcaca

SEQ ID NO: 221110 - DNA, 25 bp, Homo sapien
gaccgcatagttttacatccagctc

SEQ ID NO: 221111 - DNA, 25 bp, Homo sapien
aaggattgcaggtccgggctcttct

SEQ ID NO: 221112 - DNA, 25 bp, Homo sapien
ggcatagcgcaaggattgcaggtcc

SEQ ID NO: 221113 - DNA, 25 bp, Homo sapien
atgcggtctgggtacccttaccctg

SEQ ID NO: 221114 - DNA, 25 bp, Homo sapien
ttaccctgggccgattgcgtctgta

SEQ ID NO: 221115 - DNA, 25 bp, Homo sapien
aggaaggtcttcttgaggcccacgc

SEQ ID NO: 221116 - DNA, 25 bp, Homo sapien
gtcttgattagcaggtcggtggcct

SEQ ID NO: 221117 - DNA, 25 bp, Homo sapien
tctccaggaaggtcttcttgaggcc

SEQ ID NO: 221118 - DNA, 25 bp, Homo sapien
tgcgtctgtacaaaggtcttgatta

SEQ ID NO: 221119 - DNA, 25 bp, Homo sapien
cgcggaccaggagtcgcaccgcctc

SEQ ID NO: 221120 - DNA, 25 bp, Homo sapien
ctcgagggcacacgacccaggtcag

SEQ ID NO: 221121 - DNA, 25 bp, Homo sapien
ggcacacgacccaggtcagctgcaa

SEQ ID NO: 221122 - DNA, 25 bp, Homo sapien
ggtcagctgcaacccccgggcggaa

SEQ ID NO: 221123 - DNA, 25 bp, Homo sapien
cgcacgctctggcaccagcctcctg

SEQ ID NO: 221124 - DNA, 25 bp, Homo sapien
ctgcctcttgctgctcgagggcaca

SEQ ID NO: 221125 - DNA, 25 bp, Homo sapien
cctcttgctgctcgagggcacacga

SEQ ID NO: 221126 - DNA, 25 bp, Homo sapien
ccagggccttcgcacgggcctgccc

SEQ ID NO: 221127 - DNA, 25 bp, Homo sapien
ccctcaccggtgatgctgatcttgg

SEQ ID NO: 221128 - DNA, 25 bp, Homo sapien
gcggtccttgagcaccatgatgatg

SEQ ID NO: 221129 - DNA, 25 bp, Homo sapien
ctcccggatcttcatgcggtccttg

SEQ ID NO: 221130 - DNA, 25 bp, Homo sapien
tctcctggatgagctcgaagatctc

SEQ ID NO: 221131 - DNA, 25 bp, Homo sapien
ttggtcaccgcgaagatctcctgga

SEQ ID NO: 221132 - DNA, 25 bp, Homo sapien
tgaccgccttcatctgctgcgtgtg

SEQ ID NO: 221133 - DNA, 25 bp, Homo sapien
ctgatcttggcggaccacttggacg

SEQ ID NO: 221134 - DNA, 25 bp, Homo sapien
catgatgatgttctgtgtccggtcc

SEQ ID NO: 221135 - DNA, 25 bp, Homo sapien
ggtggccgtccacacttcgaagttg

SEQ ID NO: 221136 - DNA, 25 bp, Homo sapien
acgccaacccgtggccctgcgctca

SEQ ID NO: 221137 - DNA, 25 bp, Homo sapien
tcacgctgcaggcagtcggcgttga

SEQ ID NO: 221138 - DNA, 25 bp, Homo sapien
gtcctggcacttctcgtggcacttg

SEQ ID NO: 221139 - DNA, 25 bp, Homo sapien
acttctcgtggcacttgacaccgca

SEQ ID NO: 221140 - DNA, 25 bp, Homo sapien
gtggcacttgacaccgcactcggtg

SEQ ID NO: 221141 - DNA, 25 bp, Homo sapien
ctcgcactcgtagcagtaggtgggc

SEQ ID NO: 221142 - DNA, 25 bp, Homo sapien
acttcgaagttgtgtggcgtcgtgc

SEQ ID NO: 221143 - DNA, 25 bp, Homo sapien
gtccctgagtcaccgtcttcgtcgt

SEQ ID NO: 221144 - DNA, 25 bp, Homo sapien
tgcggcctcaaaggtctttggggcc

SEQ ID NO: 221145 - DNA, 25 bp, Homo sapien
ccagaagcgctgactgatgaatgta

SEQ ID NO: 221146 - DNA, 25 bp, Homo sapien
cgtcatgcggcctcaaaggtctttg

SEQ ID NO: 221147 - DNA, 25 bp, Homo sapien
actgatgaatgtagtggccgtaccc

SEQ ID NO: 221148 - DNA, 25 bp, Homo sapien
ccggtcagtaaatggtccctgagtc

SEQ ID NO: 221149 - DNA, 25 bp, Homo sapien
tgaagacaccgcgtcatgcggcctc

SEQ ID NO: 221150 - DNA, 25 bp, Homo sapien
agcgggcttcgggtcacacgcatga

SEQ ID NO: 221151 - DNA, 25 bp, Homo sapien
acacgcacgcttcctgtcgcccgag

SEQ ID NO: 221152 - DNA, 25 bp, Homo sapien
cagcaggagttcagcacacgcacgc

SEQ ID NO: 221153 - DNA, 25 bp, Homo sapien
ccaggcagcaggagttcagcacacg

SEQ ID NO: 221154 - DNA, 25 bp, Homo sapien
cagggtttgtgaatgaatcggccga

SEQ ID NO: 221155 - DNA, 25 bp, Homo sapien
atttgcactcggaagctgccgcggc

SEQ ID NO: 221156 - DNA, 25 bp, Homo sapien
gccggatttgcactcggaagctgcc

SEQ ID NO: 221157 - DNA, 25 bp, Homo sapien
ccggccggatttgcactcggaagct

SEQ ID NO: 221158 - DNA, 25 bp, Homo sapien
cagcccggccggatttgcactcgga

SEQ ID NO: 221159 - DNA, 25 bp, Homo sapien
gccgccaccggccatcttggttcag

SEQ ID NO: 221160 - DNA, 25 bp, Homo sapien
acagcgcctgacgtggcgctgatgc

SEQ ID NO: 221161 - DNA, 25 bp, Homo sapien
ccagtctagatcgtttccgggtaga

SEQ ID NO: 221162 - DNA, 25 bp, Homo sapien
ggcccagctgcgtcgacaagggcta

SEQ ID NO: 221163 - DNA, 25 bp, Homo sapien
tcctacctccaacgcaaagcagaga

SEQ ID NO: 221164 - DNA, 25 bp, Homo sapien
ccaacgcaaagcagagacatgtctc

SEQ ID NO: 221165 - DNA, 25 bp, Homo sapien
gacatgtctccgagctcgcaggtgg

SEQ ID NO: 221166 - DNA, 25 bp, Homo sapien
cacacctcctcgttgcagggggaca

SEQ ID NO: 221167 - DNA, 25 bp, Homo sapien
ctacgtcctggaggagctcgaaaga

SEQ ID NO: 221168 - DNA, 25 bp, Homo sapien
ggctcccaagcggacacccaggagt

SEQ ID NO: 221169 - DNA, 25 bp, Homo sapien
ctcacctacgtcctggaggagctcg

SEQ ID NO: 221170 - DNA, 25 bp, Homo sapien
tccgagctcactgctcctcgtggtg

SEQ ID NO: 221171 - DNA, 25 bp, Homo sapien
gggtcttcagcccttccggtgcggc

SEQ ID NO: 221172 - DNA, 25 bp, Homo sapien
caaagggcctgtaagtggtcgacaa

SEQ ID NO: 221173 - DNA, 25 bp, Homo sapien
tctccacgacctcaaagggcctgta

SEQ ID NO: 221174 - DNA, 25 bp, Homo sapien
caagcggacacccaggagtcggcca

SEQ ID NO: 221175 - DNA, 25 bp, Homo sapien
gtgatgcccttgacaggagagcgaa

SEQ ID NO: 221176 - DNA, 25 bp, Homo sapien
gctcgcccacatccggggatcaagg

SEQ ID NO: 221177 - DNA, 25 bp, Homo sapien
gggatccgctgccaaagtttcaggc

SEQ ID NO: 221178 - DNA, 25 bp, Homo sapien
ggtgctccgaatggctctccagctc

SEQ ID NO: 221179 - DNA, 25 bp, Homo sapien
gagagcgaagaccacggtcgcctga

SEQ ID NO: 221180 - DNA, 25 bp, Homo sapien
ggcgccgactttggcccttaggctc

SEQ ID NO: 221181 - DNA, 25 bp, Homo sapien
gtcggccaggctctcggaaagccta

SEQ ID NO: 221182 - DNA, 25 bp, Homo sapien
tcacctctggcggacatggtgcagg

SEQ ID NO: 221183 - DNA, 25 bp, Homo sapien
ctggacatgtatgtgctgcacccgc

SEQ ID NO: 221184 - DNA, 25 bp, Homo sapien
acccaccgtgctcttcgagaagatg

SEQ ID NO: 221185 - DNA, 25 bp, Homo sapien
agcacttgaggttcctgcgagagcc

SEQ ID NO: 221186 - DNA, 25 bp, Homo sapien
cccgcaaggagccagcacgggctga

SEQ ID NO: 221187 - DNA, 25 bp, Homo sapien
tctgtgcccaacctcaagaagacga

SEQ ID NO: 221188 - DNA, 25 bp, Homo sapien
tcaagaagacgaatgcccaggcggc

SEQ ID NO: 221189 - DNA, 25 bp, Homo sapien
gcttcccgccggtggcaaatggacc

SEQ ID NO: 221190 - DNA, 25 bp, Homo sapien
cccagcctccgatgtggagaagcca

SEQ ID NO: 221191 - DNA, 25 bp, Homo sapien
gggctccggtgtcagcgaccaagcc

SEQ ID NO: 221192 - DNA, 25 bp, Homo sapien
cgtctcctggcctagaaccgagcgt

SEQ ID NO: 221193 - DNA, 25 bp, Homo sapien
gcaggcgaaaatggggaccgctccc

SEQ ID NO: 221194 - DNA, 25 bp, Homo sapien
tccgcaggcgaaaatggggaccgct

SEQ ID NO: 221195 - DNA, 25 bp, Homo sapien
ctcccacgcgcaccgtgccctgcag

SEQ ID NO: 221196 - DNA, 25 bp, Homo sapien
agctgggcgcctaaatggcccaatg

SEQ ID NO: 221197 - DNA, 25 bp, Homo sapien
cggtgtcagcgaccaagccgcaggt

SEQ ID NO: 221198 - DNA, 25 bp, Homo sapien
cctggcctagaaccgagcgtgcacg

SEQ ID NO: 221199 - DNA, 25 bp, Homo sapien
acacggaagttacaggatctcatca

SEQ ID NO: 221200 - DNA, 25 bp, Homo sapien
ttaattccacaacgtcaagcccagg

SEQ ID NO: 221201 - DNA, 25 bp, Homo sapien
atgtccgcctccgagaattccgtta

SEQ ID NO: 221202 - DNA, 25 bp, Homo sapien
tggggctttataacctgcggatgtc

SEQ ID NO: 221203 - DNA, 25 bp, Homo sapien
caagcccagggtcttacggacctga

SEQ ID NO: 221204 - DNA, 25 bp, Homo sapien
cgctacggcgaggaacagctcaaga

SEQ ID NO: 221205 - DNA, 25 bp, Homo sapien
atcaaggacgttctccgctacggcg

SEQ ID NO: 221206 - DNA, 25 bp, Homo sapien
tgccacctggaactgacacggaagt

SEQ ID NO: 221207 - DNA, 25 bp, Homo sapien
ccctcccagattgggcgggatcaga

SEQ ID NO: 221208 - DNA, 25 bp, Homo sapien
gcttgttcatctccagccacgggga

SEQ ID NO: 221209 - DNA, 25 bp, Homo sapien
gctcattccctagcagcgggccaga

SEQ ID NO: 221210 - DNA, 25 bp, Homo sapien
gctctggctcaggtaaaaactcttt

SEQ ID NO: 221211 - DNA, 25 bp, Homo sapien
aaaactctttcttcggctcgcgagc

SEQ ID NO: 221212 - DNA, 25 bp, Homo sapien
gttgccctcacccatccgtaattgt

SEQ ID NO: 221213 - DNA, 25 bp, Homo sapien
cgcataccctgcagatgtgggaaca

SEQ ID NO: 221214 - DNA, 25 bp, Homo sapien
acccgcaaggcgctgcttgttcatc

SEQ ID NO: 221215 - DNA, 25 bp, Homo sapien
ctggcgctgctcaatggcgagtatc

SEQ ID NO: 221216 - DNA, 25 bp, Homo sapien
ctcgctcatgatgacgcacgtccgg

SEQ ID NO: 221217 - DNA, 25 bp, Homo sapien
gccgcgtgcacccttagtcggaatt

SEQ ID NO: 221218 - DNA, 25 bp, Homo sapien
atacgtgcgacctgttaggccgctc

SEQ ID NO: 221219 - DNA, 25 bp, Homo sapien
gctgcatcgtgtgggaacttcactc

SEQ ID NO: 221220 - DNA, 25 bp, Homo sapien
cagtcgtccgcgtctcgctcatgat

SEQ ID NO: 221221 - DNA, 25 bp, Homo sapien
tcaggtaagcgggaaatcccacttc

SEQ ID NO: 221222 - DNA, 25 bp, Homo sapien
gcgcagctgggcaagaattacatca

SEQ ID NO: 221223 - DNA, 25 bp, Homo sapien
agcacgttcagaacttcctcctgta

SEQ ID NO: 221224 - DNA, 25 bp, Homo sapien
cgcagccgcagcacgttcagaactt

SEQ ID NO: 221225 - DNA, 25 bp, Homo sapien
cgtgccatgccaacacctctatggt

SEQ ID NO: 221226 - DNA, 25 bp, Homo sapien
gtacggggtttgcagctgcgcctcc

SEQ ID NO: 221227 - DNA, 25 bp, Homo sapien
gaacttcctcctgtacagacactgc

SEQ ID NO: 221228 - DNA, 25 bp, Homo sapien
ctaagtgcgcgcagccggtcttcct

SEQ ID NO: 221229 - DNA, 25 bp, Homo sapien
ctagcaactatgtgcgccgcgagct

SEQ ID NO: 221230 - DNA, 25 bp, Homo sapien
ctccaacccgcacgaggcccgcaag

SEQ ID NO: 221231 - DNA, 25 bp, Homo sapien
gcacaacttctcacgcatctctggg

SEQ ID NO: 221232 - DNA, 25 bp, Homo sapien
gtacgaagtggtggccgcacaactt

SEQ ID NO: 221233 - DNA, 25 bp, Homo sapien
aggcctcctggcttcggtggaccag

SEQ ID NO: 221234 - DNA, 25 bp, Homo sapien
acgtgtgcatctgcgcctacgtgca

SEQ ID NO: 221235 - DNA, 25 bp, Homo sapien
tgagccctgggcacatgcatgcaaa

SEQ ID NO: 221236 - DNA, 25 bp, Homo sapien
tgcggacccacgatctgtgcacgca

SEQ ID NO: 221237 - DNA, 25 bp, Homo sapien
gcgttcacacacactccagtgcgga

SEQ ID NO: 221238 - DNA, 25 bp, Homo sapien
ggggcccaacgcgaacaccagggca

SEQ ID NO: 221239 - DNA, 25 bp, Homo sapien
cttagctaggccgaagtcagcgatc

SEQ ID NO: 221240 - DNA, 25 bp, Homo sapien
gaagttctgatcctgagccctaagc

SEQ ID NO: 221241 - DNA, 25 bp, Homo sapien
gagccatcctccactgaagttctga

SEQ ID NO: 221242 - DNA, 25 bp, Homo sapien
gcgtgcagagaggatcccaggataa

SEQ ID NO: 221243 - DNA, 25 bp, Homo sapien
cgatcttgacgtgtgcctcgctctc

SEQ ID NO: 221244 - DNA, 25 bp, Homo sapien
ttgtcaagcggcagcagcttagcta

SEQ ID NO: 221245 - DNA, 25 bp, Homo sapien
cgcggaccacgtagtagtctttgtc

SEQ ID NO: 221246 - DNA, 25 bp, Homo sapien
tcgctctccacgaggatgtttcggg

SEQ ID NO: 221247 - DNA, 25 bp, Homo sapien
ccatgatgtacttggccatgagcga

SEQ ID NO: 221248 - DNA, 25 bp, Homo sapien
gcctcttagtcttgcctcgttccag

SEQ ID NO: 221249 - DNA, 25 bp, Homo sapien
tcggagcctcactctgcctcttagt

SEQ ID NO: 221250 - DNA, 25 bp, Homo sapien
ggggcctgcttgatgctaatgtcta

SEQ ID NO: 221251 - DNA, 25 bp, Homo sapien
aatctggttgtctgtcctggtaaca

SEQ ID NO: 221252 - DNA, 25 bp, Homo sapien
ggggaatcctgcacccactaaaatc

SEQ ID NO: 221253 - DNA, 25 bp, Homo sapien
agcgtcagagcccagtgaaacccga

SEQ ID NO: 221254 - DNA, 25 bp, Homo sapien
cctcctgcgagggacaagcgtcaga

SEQ ID NO: 221255 - DNA, 25 bp, Homo sapien
gcatgcgcaatgactcctccaggtc

SEQ ID NO: 221256 - DNA, 25 bp, Homo sapien
tcccggccttagtcaaagccgaagc

SEQ ID NO: 221257 - DNA, 25 bp, Homo sapien
tgcgagtctcggctcacgtctgcct

SEQ ID NO: 221258 - DNA, 25 bp, Homo sapien
tcgcagctttcctccgaggcctgga

SEQ ID NO: 221259 - DNA, 25 bp, Homo sapien
cctggaaggcgagctagcctttgcc

SEQ ID NO: 221260 - DNA, 25 bp, Homo sapien
tgcggcatcgccagctcttacctag

SEQ ID NO: 221261 - DNA, 25 bp, Homo sapien
agctcttacctagcgggcagggacc

SEQ ID NO: 221262 - DNA, 25 bp, Homo sapien
ctccaggtccgcaaggcaggcatct

SEQ ID NO: 221263 - DNA, 25 bp, Homo sapien
gagctctccaggtcgtcccgggaga

SEQ ID NO: 221264 - DNA, 25 bp, Homo sapien
tgcagtcccgggacaggatgttctc

SEQ ID NO: 221265 - DNA, 25 bp, Homo sapien
ggatgttctccaagttcacctccat

SEQ ID NO: 221266 - DNA, 25 bp, Homo sapien
aacgccgctcggtggtcgcctcatt

SEQ ID NO: 221267 - DNA, 25 bp, Homo sapien
gtcgcctcattcctctgatggggcc

SEQ ID NO: 221268 - DNA, 25 bp, Homo sapien
aaaaagtggtcagcgttgagcaaga

SEQ ID NO: 221269 - DNA, 25 bp, Homo sapien
aacgagcaagcaccgcttgggcttg

SEQ ID NO: 221270 - DNA, 25 bp, Homo sapien
gttgagcaagacaaaagaaacgagc

SEQ ID NO: 221271 - DNA, 25 bp, Homo sapien
cgtcgagccgccaagtttctgtttt

SEQ ID NO: 221272 - DNA, 25 bp, Homo sapien
ttcctttctgcaacgtggacgtggc

SEQ ID NO: 221273 - DNA, 25 bp, Homo sapien
taagtcgcgcagcatagaggcccta

SEQ ID NO: 221274 - DNA, 25 bp, Homo sapien
tgttgcacccaacatggcggccatc

SEQ ID NO: 221275 - DNA, 25 bp, Homo sapien
gctgcgcgacagaggacacttcctt

SEQ ID NO: 221276 - DNA, 25 bp, Homo sapien
agccaatgaagacgcgggtcgcttt

SEQ ID NO: 221277 - DNA, 25 bp, Homo sapien
gcttgcctcgttgccttctgggaaa

SEQ ID NO: 221278 - DNA, 25 bp, Homo sapien
gtagcaggtggatccatagccaatg

SEQ ID NO: 221279 - DNA, 25 bp, Homo sapien
acggacatcgacagcccatagattc

SEQ ID NO: 221280 - DNA, 25 bp, Homo sapien
tggcacctcggtgctttaacggaag

SEQ ID NO: 221281 - DNA, 25 bp, Homo sapien
ctgggccagcttctgaactcggtcc

SEQ ID NO: 221282 - DNA, 25 bp, Homo sapien
cgctatggcctcaagttcctctgga

SEQ ID NO: 221283 - DNA, 25 bp, Homo sapien
tctgccagcttcatgtcggccgtgc

SEQ ID NO: 221284 - DNA, 25 bp, Homo sapien
ctcatgctcctggtgtccactggca

SEQ ID NO: 221285 - DNA, 25 bp, Homo sapien
gactacggggtctttgccctcatgc

SEQ ID NO: 221286 - DNA, 25 bp, Homo sapien
catagattcctaacccagggagccc

SEQ ID NO: 221287 - DNA, 25 bp, Homo sapien
agagcgtcagccttcactagcccgg

SEQ ID NO: 221288 - DNA, 25 bp, Homo sapien
gcgtgcacacgcatggaccagtcct

SEQ ID NO: 221289 - DNA, 25 bp, Homo sapien
cctagagagcagaccagggacccga

SEQ ID NO: 221290 - DNA, 25 bp, Homo sapien
gtaaggactgtccaggtgacctcga

SEQ ID NO: 221291 - DNA, 25 bp, Homo sapien
tcgagtccctccttgcagtacctgg

SEQ ID NO: 221292 - DNA, 25 bp, Homo sapien
cagtacctggagatgcgcttcagcc

SEQ ID NO: 221293 - DNA, 25 bp, Homo sapien
cagtacattgtagccacggtgagtg

SEQ ID NO: 221294 - DNA, 25 bp, Homo sapien
cggctctgcgggactttgcagtaca

SEQ ID NO: 221295 - DNA, 25 bp, Homo sapien
gggcgatgcccatttccagactaga

SEQ ID NO: 221296 - DNA, 25 bp, Homo sapien
tagacgattgaagcccgacgcgaca

SEQ ID NO: 221297 - DNA, 25 bp, Homo sapien
tttcatccgggcatcggccatcttg

SEQ ID NO: 221298 - DNA, 25 bp, Homo sapien
ccatcttggtaaaggcaatgttcta

SEQ ID NO: 221299 - DNA, 25 bp, Homo sapien
caaagaagtggctgactaccctggc

SEQ ID NO: 221300 - DNA, 25 bp, Homo sapien
aggagcacttctggcgtccagtctg

SEQ ID NO: 221301 - DNA, 25 bp, Homo sapien
gtccagtctgaaccgcacctagttg

SEQ ID NO: 221302 - DNA, 25 bp, Homo sapien
gcgacagcatgttcgaggccacctg

SEQ ID NO: 221303 - DNA, 25 bp, Homo sapien
cgttgccttagcaaccgggcgcgcg

SEQ ID NO: 221304 - DNA, 25 bp, Homo sapien
cagaagaggggatgccgcgcccagc

SEQ ID NO: 221305 - DNA, 25 bp, Homo sapien
tgagggccggggaatcctcacccgc

SEQ ID NO: 221306 - DNA, 25 bp, Homo sapien
gtgcgcactggcagcagggaatccc

SEQ ID NO: 221307 - DNA, 25 bp, Homo sapien
aggggagttccgtgcgcgcccagcc

SEQ ID NO: 221308 - DNA, 25 bp, Homo sapien
ggccgccggtcgctcactgcgcctg

SEQ ID NO: 221309 - DNA, 25 bp, Homo sapien
gtgctcgccatttgcgccggggctt

SEQ ID NO: 221310 - DNA, 25 bp, Homo sapien
tttcccgtcgcgcgccagcagaaga

SEQ ID NO: 221311 - DNA, 25 bp, Homo sapien
accacggtccatgagcggagcccag

SEQ ID NO: 221312 - DNA, 25 bp, Homo sapien
cccgctcagcgtgctgcaggccgac

SEQ ID NO: 221313 - DNA, 25 bp, Homo sapien
attccggcgcccaggcacgtctggt

SEQ ID NO: 221314 - DNA, 25 bp, Homo sapien
cacgtctggtctcaccacgcgctcc

SEQ ID NO: 221315 - DNA, 25 bp, Homo sapien
catcacggacctgcactgcggcttt

SEQ ID NO: 221316 - DNA, 25 bp, Homo sapien
acctcctcactggaccagacggtga

SEQ ID NO: 221317 - DNA, 25 bp, Homo sapien
gaccagacggtgaaggtacgccgcc

SEQ ID NO: 221318 - DNA, 25 bp, Homo sapien
ctcactggaccagacggtgaaggta

SEQ ID NO: 221319 - DNA, 25 bp, Homo sapien
accctcggggattttctcagcgctc

SEQ ID NO: 221320 - DNA, 25 bp, Homo sapien
ggaagacgcctttgtctcccgcctg

SEQ ID NO: 221321 - DNA, 25 bp, Homo sapien
ccacagcccggcatgtggggtgtac

SEQ ID NO: 221322 - DNA, 25 bp, Homo sapien
ctcctggccttgaacaacagcctga

SEQ ID NO: 221323 - DNA, 25 bp, Homo sapien
acagcctgaagtcgagtccgggcta

SEQ ID NO: 221324 - DNA, 25 bp, Homo sapien
agcacgcaccctcggggattttctc

SEQ ID NO: 221325 - DNA, 25 bp, Homo sapien
gaccctcgcggaagacgcctttgtc

SEQ ID NO: 221326 - DNA, 25 bp, Homo sapien
gaaagcgcaaaggtgcagcacgcac

SEQ ID NO: 221327 - DNA, 25 bp, Homo sapien
tcagggtgctcctcttggttcaaga

SEQ ID NO: 221328 - DNA, 25 bp, Homo sapien
cgggacagggacgtgacctgtcaca

SEQ ID NO: 221329 - DNA, 25 bp, Homo sapien
tgacctgtcacacgggtgaggactg

SEQ ID NO: 221330 - DNA, 25 bp, Homo sapien
gtcacacgggtgaggactgaagtct

SEQ ID NO: 221331 - DNA, 25 bp, Homo sapien
aggactgaagtctgtggctgcgtca

SEQ ID NO: 221332 - DNA, 25 bp, Homo sapien
ttttcgggctccactgggcgattgt

SEQ ID NO: 221333 - DNA, 25 bp, Homo sapien
tccactgggcgattgtggggtccac

SEQ ID NO: 221334 - DNA, 25 bp, Homo sapien
ctcctcttggttcaagaagagaagg

SEQ ID NO: 221335 - DNA, 25 bp, Homo sapien
gaggagggggacatcccttcttcaa

SEQ ID NO: 221336 - DNA, 25 bp, Homo sapien
gccgcgacggactgcctccctcggc

SEQ ID NO: 221337 - DNA, 25 bp, Homo sapien
tcacacgcccttgcccggccgtgca

SEQ ID NO: 221338 - DNA, 25 bp, Homo sapien
gccgtgcacttgtcttcgcgctcgg

SEQ ID NO: 221339 - DNA, 25 bp, Homo sapien
cccttctctttggtgggcggattgg

SEQ ID NO: 221340 - DNA, 25 bp, Homo sapien
ttggtcaaagcttgcccgactccgg

SEQ ID NO: 221341 - DNA, 25 bp, Homo sapien
ccgggaattcaaaggggagctgcgg

SEQ ID NO: 221342 - DNA, 25 bp, Homo sapien
gcttgcccgactccgggaattcaaa

SEQ ID NO: 221343 - DNA, 25 bp, Homo sapien
cgaggagggaggcacgtctcggagg

SEQ ID NO: 221344 - DNA, 25 bp, Homo sapien
aatgtgggatctttaaatatgggcg

SEQ ID NO: 221345 - DNA, 25 bp, Homo sapien
gatctttaaatatgggcggggcttg

SEQ ID NO: 221346 - DNA, 25 bp, Homo sapien
ccaagagggagggtctccgtgcggt

SEQ ID NO: 221347 - DNA, 25 bp, Homo sapien
tgcggggtcgtcgaaggcggtgcca

SEQ ID NO: 221348 - DNA, 25 bp, Homo sapien
tgccaacccgggctcggccaatcgg

SEQ ID NO: 221349 - DNA, 25 bp, Homo sapien
ggtgcgggaggatccaggatctgca

SEQ ID NO: 221350 - DNA, 25 bp, Homo sapien
cggggaatgtgggatctttaaatat

SEQ ID NO: 221351 - DNA, 25 bp, Homo sapien
cacagaatacgtccggtgcaaaacg

SEQ ID NO: 221352 - DNA, 25 bp, Homo sapien
gtgcgtcccgtgcacagaatacgtc

SEQ ID NO: 221353 - DNA, 25 bp, Homo sapien
tgcttgcatctgcaaaccgtgcgtc

SEQ ID NO: 221354 - DNA, 25 bp, Homo sapien
aggccatcggatacgcggccggcct

SEQ ID NO: 221355 - DNA, 25 bp, Homo sapien
acatgagagcccgtctgggatgcgc

SEQ ID NO: 221356 - DNA, 25 bp, Homo sapien
aaggcaccagacatgagagcccgtc

SEQ ID NO: 221357 - DNA, 25 bp, Homo sapien
gtttagctcttaccgtgggctcgcg

SEQ ID NO: 221358 - DNA, 25 bp, Homo sapien
cgcctctgcaggatgctcggacact

SEQ ID NO: 221359 - DNA, 25 bp, Homo sapien
catcgtcgtcatggtgacggagacc

SEQ ID NO: 221360 - DNA, 25 bp, Homo sapien
tgcacccaggtagtcatgaacagcc

SEQ ID NO: 221361 - DNA, 25 bp, Homo sapien
cagccacagctacaatggcagcgtg

SEQ ID NO: 221362 - DNA, 25 bp, Homo sapien
tagtggccaagagtgagccagcccg

SEQ ID NO: 221363 - DNA, 25 bp, Homo sapien
gctcttcgagaagcggaagcgcctc

SEQ ID NO: 221364 - DNA, 25 bp, Homo sapien
gcctcagcgactatgccctcatttt

SEQ ID NO: 221365 - DNA, 25 bp, Homo sapien
tttcggcatgtttggcatcgtcgtc

SEQ ID NO: 221366 - DNA, 25 bp, Homo sapien
cctcattttcggcatgtttggcatc

SEQ ID NO: 221367 - DNA, 25 bp, Homo sapien
agcatctcctcctggatcatcgcag

SEQ ID NO: 221368 - DNA, 25 bp, Homo sapien
gcgcttcgtcatgaagacactcatg

SEQ ID NO: 221369 - DNA, 25 bp, Homo sapien
gccgggtgatgctactgcacagcaa

SEQ ID NO: 221370 - DNA, 25 bp, Homo sapien
gtgttcctcatctcgctagagctgg

SEQ ID NO: 221371 - DNA, 25 bp, Homo sapien
agctggcagtgtgcgccattcaccc

SEQ ID NO: 221372 - DNA, 25 bp, Homo sapien
gccctccacagctgttcatggtgga

SEQ ID NO: 221373 - DNA, 25 bp, Homo sapien
gcgtgtctgacacccatggctggtt

SEQ ID NO: 221374 - DNA, 25 bp, Homo sapien
aaaatcttcacggacgcctcgagcc

SEQ ID NO: 221375 - DNA, 25 bp, Homo sapien
cctggaaagccgcttggatgcgctg

SEQ ID NO: 221376 - DNA, 25 bp, Homo sapien
cgtggtatcgtcctttcctctctca

SEQ ID NO: 221377 - DNA, 25 bp, Homo sapien
cgcagacccagaccgtcatgtacga

SEQ ID NO: 221378 - DNA, 25 bp, Homo sapien
agaccgtcatgtacgaccttgtatc

SEQ ID NO: 221379 - DNA, 25 bp, Homo sapien
tgcacgctcagcacgaggagctgga

SEQ ID NO: 221380 - DNA, 25 bp, Homo sapien
tgcgctgggtgcctctctacaggcc

SEQ ID NO: 221381 - DNA, 25 bp, Homo sapien
ccctaaatcttggccatcgtgtggc

SEQ ID NO: 221382 - DNA, 25 bp, Homo sapien
accttgtatcggagctgcacgctca

SEQ ID NO: 221383 - DNA, 25 bp, Homo sapien
tgctccgaggtgagacactcgtcgc

SEQ ID NO: 221384 - DNA, 25 bp, Homo sapien
agctactcgaggtggattttgtttg

SEQ ID NO: 221385 - DNA, 25 bp, Homo sapien
agaccatagggctgagatctgcggc

SEQ ID NO: 221386 - DNA, 25 bp, Homo sapien
ttctgattcaacagcgccgacccta

SEQ ID NO: 221387 - DNA, 25 bp, Homo sapien
ccgaggatggcaaagtcaacagtgc

SEQ ID NO: 221388 - DNA, 25 bp, Homo sapien
gcgtcaacgccgtatccagcgacta

SEQ ID NO: 221389 - DNA, 25 bp, Homo sapien
ggccggaagcctctcaacttagaac

SEQ ID NO: 221390 - DNA, 25 bp, Homo sapien
ttctctccgcgtgtccaaaccgtgt

SEQ ID NO: 221391 - DNA, 25 bp, Homo sapien
attgggaagggaacatcatttcgta

SEQ ID NO: 221392 - DNA, 25 bp, Homo sapien
atcatttcgtaggtaccgctcctgg

SEQ ID NO: 221393 - DNA, 25 bp, Homo sapien
tcccgcagacgacgcagaggcaact

SEQ ID NO: 221394 - DNA, 25 bp, Homo sapien
ggcaactcccgctggagaaactcca

SEQ ID NO: 221395 - DNA, 25 bp, Homo sapien
actccatgcgacttttctttgggga

SEQ ID NO: 221396 - DNA, 25 bp, Homo sapien
gaagcccagagagaggtcacgccgt

SEQ ID NO: 221397 - DNA, 25 bp, Homo sapien
cctgcattcagctctgtggcgggac

SEQ ID NO: 221398 - DNA, 25 bp, Homo sapien
cattacgctgccacgagagggcgcc

SEQ ID NO: 221399 - DNA, 25 bp, Homo sapien
cgattttgcgttctgaggctgcagc

SEQ ID NO: 221400 - DNA, 25 bp, Homo sapien
cctacctgcagataccggggagacc

SEQ ID NO: 221401 - DNA, 25 bp, Homo sapien
caggggcgtttgttattttgctcca

SEQ ID NO: 221402 - DNA, 25 bp, Homo sapien
cccggacgcgatgctattcgacaag

SEQ ID NO: 221403 - DNA, 25 bp, Homo sapien
aaagcgttctcggtgcagttggacg

SEQ ID NO: 221404 - DNA, 25 bp, Homo sapien
cgagcacggcttacacgcagagcta

SEQ ID NO: 221405 - DNA, 25 bp, Homo sapien
tattcgacaaggtgaaagcgttctc

SEQ ID NO: 221406 - DNA, 25 bp, Homo sapien
tgctccaacaccagttgtgtgcctc

SEQ ID NO: 221407 - DNA, 25 bp, Homo sapien
cacgacgagaccgtgcgcctctggg

SEQ ID NO: 221408 - DNA, 25 bp, Homo sapien
gcagagcaagcagtgcatccggacg

SEQ ID NO: 221409 - DNA, 25 bp, Homo sapien
agagggagaggagcttccacccaga

SEQ ID NO: 221410 - DNA, 25 bp, Homo sapien
ggagcttccacccagagcaggacgc

SEQ ID NO: 221411 - DNA, 25 bp, Homo sapien
gccgggaaggtcttcaaagggcaca

SEQ ID NO: 221412 - DNA, 25 bp, Homo sapien
tgacttgcctgtcagtgtccactga

SEQ ID NO: 221413 - DNA, 25 bp, Homo sapien
acggcagcgtgctgctctcaggctc

SEQ ID NO: 221414 - DNA, 25 bp, Homo sapien
catccggacggtggccctcaaaggt

SEQ ID NO: 221415 - DNA, 25 bp, Homo sapien
ctgcactgccgcgttctacacgtgg

SEQ ID NO: 221416 - DNA, 25 bp, Homo sapien
tgccgcgttctacacgtggactacg

SEQ ID NO: 221417 - DNA, 25 bp, Homo sapien
cgagatcgacaacggctccacacgt

SEQ ID NO: 221418 - DNA, 25 bp, Homo sapien
tggtgcagacacagacgttcatggc

SEQ ID NO: 221419 - DNA, 25 bp, Homo sapien
acagacgttcatggcccgaggcgcc

SEQ ID NO: 221420 - DNA, 25 bp, Homo sapien
ttcatggcccgaggcgcccgaaagc

SEQ ID NO: 221421 - DNA, 25 bp, Homo sapien
cagccgtggtgcagacacagacgtt

SEQ ID NO: 221422 - DNA, 25 bp, Homo sapien
cccagtgggtccttccatcctgcac

SEQ ID NO: 221423 - DNA, 25 bp, Homo sapien
ggggagcaggcggttcccgctggca

SEQ ID NO: 221424 - DNA, 25 bp, Homo sapien
tgatcgcggcacagcccgtggaggc

SEQ ID NO: 221425 - DNA, 25 bp, Homo sapien
tctgcgtgatcgcggcacagcccgt

SEQ ID NO: 221426 - DNA, 25 bp, Homo sapien
ggctctgcgtgatcgcggcacagcc

SEQ ID NO: 221427 - DNA, 25 bp, Homo sapien
gtccccatcccaatcttccggtgcc

SEQ ID NO: 221428 - DNA, 25 bp, Homo sapien
cccgaccactgggaccaggcaggtc

SEQ ID NO: 221429 - DNA, 25 bp, Homo sapien
ggttcccgctggcagggtcagccca

SEQ ID NO: 221430 - DNA, 25 bp, Homo sapien
aggcgcgtcgcgcatggggccgggc

SEQ ID NO: 221431 - DNA, 25 bp, Homo sapien
gctgcagatcagagacacccggtct

SEQ ID NO: 221432 - DNA, 25 bp, Homo sapien
agttagatgccaacccgcccgcagc

SEQ ID NO: 221433 - DNA, 25 bp, Homo sapien
aacctggagccgcaccggtagctgc

SEQ ID NO: 221434 - DNA, 25 bp, Homo sapien
tagctgcgggactgcgaactcagca

SEQ ID NO: 221435 - DNA, 25 bp, Homo sapien
actgcgaactcagcaggtgatggga

SEQ ID NO: 221436 - DNA, 25 bp, Homo sapien
ggctgagctgcagatcagagacacc

SEQ ID NO: 221437 - DNA, 25 bp, Homo sapien
agatcagagacacccggtctctggc

SEQ ID NO: 221438 - DNA, 25 bp, Homo sapien
aactcagcaggtgatgggaagccag

SEQ ID NO: 221439 - DNA, 25 bp, Homo sapien
tgggctacaaaagtatggccgcttc

SEQ ID NO: 221440 - DNA, 25 bp, Homo sapien
cacattaggctttttgcgacgctcg

SEQ ID NO: 221441 - DNA, 25 bp, Homo sapien
caggcgcactcttgttgcatcatca

SEQ ID NO: 221442 - DNA, 25 bp, Homo sapien
ggtgtcttcgccgtctttgaaaaca

SEQ ID NO: 221443 - DNA, 25 bp, Homo sapien
tccaaggccgctttggctaccaagc

SEQ ID NO: 221444 - DNA, 25 bp, Homo sapien
gtgttcgccgtgcacaagcccaaag

SEQ ID NO: 221445 - DNA, 25 bp, Homo sapien
ccttgaaactgcaggaacggtcgca

SEQ ID NO: 221446 - DNA, 25 bp, Homo sapien
aaagggcccacttcagccgagctgc

SEQ ID NO: 221447 - DNA, 25 bp, Homo sapien
tccggattcggccacacgaaggggc

SEQ ID NO: 221448 - DNA, 25 bp, Homo sapien
gtcccgcagggacaagctgcacatc

SEQ ID NO: 221449 - DNA, 25 bp, Homo sapien
atcccggcgctgaccctcgagtgag

SEQ ID NO: 221450 - DNA, 25 bp, Homo sapien
ggaggacaggatgacaactaccctc

SEQ ID NO: 221451 - DNA, 25 bp, Homo sapien
cacgtctctgttcgtgtcgcccaga

SEQ ID NO: 221452 - DNA, 25 bp, Homo sapien
agccgccatccggagatccggattc

SEQ ID NO: 221453 - DNA, 25 bp, Homo sapien
tctgcctcggcatgaagtcccgcag

SEQ ID NO: 221454 - DNA, 25 bp, Homo sapien
ctcacgtcctgagctgaacccagaa

SEQ ID NO: 221455 - DNA, 25 bp, Homo sapien
cctggactggggtgtctgtccgcca

SEQ ID NO: 221456 - DNA, 25 bp, Homo sapien
caaacaggagttgccagaagtgtgt

SEQ ID NO: 221457 - DNA, 25 bp, Homo sapien
accacggcgagcgtctgtctgtggc

SEQ ID NO: 221458 - DNA, 25 bp, Homo sapien
ggccagccgagcaaacaggagttgc

SEQ ID NO: 221459 - DNA, 25 bp, Homo sapien
ctgctgcagcgctccaagaggtagg

SEQ ID NO: 221460 - DNA, 25 bp, Homo sapien
ctcgcctgggcggagttccagtcgc

SEQ ID NO: 221461 - DNA, 25 bp, Homo sapien
catcggagccgcctggcaaaaggcg

SEQ ID NO: 221462 - DNA, 25 bp, Homo sapien
cgcctggcaaaaggcgcgctgctgc

SEQ ID NO: 221463 - DNA, 25 bp, Homo sapien
ctgatggcgtcttgggcttcatcca

SEQ ID NO: 221464 - DNA, 25 bp, Homo sapien
cttggccaagtctggcgagaacctc

SEQ ID NO: 221465 - DNA, 25 bp, Homo sapien
tggcccgagactgcttggccaagtc

SEQ ID NO: 221466 - DNA, 25 bp, Homo sapien
tggcgtcttgggcttcatccaccac

SEQ ID NO: 221467 - DNA, 25 bp, Homo sapien
ccaggccacagcacagatggagggc

SEQ ID NO: 221468 - DNA, 25 bp, Homo sapien
agtctggcgagaacctcgtcacctc

SEQ ID NO: 221469 - DNA, 25 bp, Homo sapien
cagcacagatggagggccgtctgca

SEQ ID NO: 221470 - DNA, 25 bp, Homo sapien
ccacagcacagatggagggccgtct

SEQ ID NO: 221471 - DNA, 25 bp, Homo sapien
gtctacactgtgcaccacgtcgtct

SEQ ID NO: 221472 - DNA, 25 bp, Homo sapien
caccacgtcgtctgggtgagtgccg

SEQ ID NO: 221473 - DNA, 25 bp, Homo sapien
gatagcgacgtctacactgtgcacc

SEQ ID NO: 221474 - DNA, 25 bp, Homo sapien
tctacatgggtgatagcgacgtcta

SEQ ID NO: 221475 - DNA, 25 bp, Homo sapien
gcgatccgcgtctacatgggtgata

SEQ ID NO: 221476 - DNA, 25 bp, Homo sapien
aagtacggcttcagcctgcgggcga

SEQ ID NO: 221477 - DNA, 25 bp, Homo sapien
ctctggcaagaagtacggcttcagc

SEQ ID NO: 221478 - DNA, 25 bp, Homo sapien
ccatcgttatccacagctctggcaa

SEQ ID NO: 221479 - DNA, 25 bp, Homo sapien
ccgtgcaggaggttagcttcgatga

SEQ ID NO: 221480 - DNA, 25 bp, Homo sapien
ccggggccagtcagctgacaagctg

SEQ ID NO: 221481 - DNA, 25 bp, Homo sapien
aggttagcttcgatgagccgcagga

SEQ ID NO: 221482 - DNA, 25 bp, Homo sapien
gcgaggaagccgtgccagtagctct

SEQ ID NO: 221483 - DNA, 25 bp, Homo sapien
cctcagtgccacagatcgccgtgga

SEQ ID NO: 221484 - DNA, 25 bp, Homo sapien
ggctgcacctgtccgagcgccgaga

SEQ ID NO: 221485 - DNA, 25 bp, Homo sapien
cgccgagactccttcaagaagcagg

SEQ ID NO: 221486 - DNA, 25 bp, Homo sapien
ccttcaagaagcaggaggccgtgca

SEQ ID NO: 221487 - DNA, 25 bp, Homo sapien
ttgcactcggctacctctggaaacg

SEQ ID NO: 221488 - DNA, 25 bp, Homo sapien
tctagtccaccagtcccgcgggatt

SEQ ID NO: 221489 - DNA, 25 bp, Homo sapien
tgtttgctgagcttgagaacgcctc

SEQ ID NO: 221490 - DNA, 25 bp, Homo sapien
attcccataagctggcggtcgcctc

SEQ ID NO: 221491 - DNA, 25 bp, Homo sapien
attgggcactgagcacattcggtta

SEQ ID NO: 221492 - DNA, 25 bp, Homo sapien
gggatcagcctcagttgtgccagtg

SEQ ID NO: 221493 - DNA, 25 bp, Homo sapien
ccgtagagagtgttcggccatttcc

SEQ ID NO: 221494 - DNA, 25 bp, Homo sapien
cctgcctggaatggggcttcgaata

SEQ ID NO: 221495 - DNA, 25 bp, Homo sapien
gggccctgagggcttccagtaccgc

SEQ ID NO: 221496 - DNA, 25 bp, Homo sapien
agggcttccagtaccgcgctctgta

SEQ ID NO: 221497 - DNA, 25 bp, Homo sapien
ctgagggcttccagtaccgcgctct

SEQ ID NO: 221498 - DNA, 25 bp, Homo sapien
ggcctcaacgagcgcacacggcagc

SEQ ID NO: 221499 - DNA, 25 bp, Homo sapien
cccggcgacgtgctggtagtgagcc

SEQ ID NO: 221500 - DNA, 25 bp, Homo sapien
ctctgtacccgttccgccgggagcg

SEQ ID NO: 221501 - DNA, 25 bp, Homo sapien
agtaccgcgctctgtacccgttccg

SEQ ID NO: 221502 - DNA, 25 bp, Homo sapien
gggcttccagtaccgcgctctgtac

SEQ ID NO: 221503 - DNA, 25 bp, Homo sapien
gtcgtggctgaggagaaatcccaca

SEQ ID NO: 221504 - DNA, 25 bp, Homo sapien
cgaacccacgtcagctcccgcagaa

SEQ ID NO: 221505 - DNA, 25 bp, Homo sapien
gtgctcttccctcgcacagtgaccc

SEQ ID NO: 221506 - DNA, 25 bp, Homo sapien
ggtacaggcacaaccgtgctcttcc

SEQ ID NO: 221507 - DNA, 25 bp, Homo sapien
aggagaaatcccacagatgtcactg

SEQ ID NO: 221508 - DNA, 25 bp, Homo sapien
agaacctagatcattcgctgccacc

SEQ ID NO: 221509 - DNA, 25 bp, Homo sapien
ctccgggcctgctctcgcagtgttg

SEQ ID NO: 221510 - DNA, 25 bp, Homo sapien
acagaacagccttggtcgtggctga

SEQ ID NO: 221511 - DNA, 25 bp, Homo sapien
ggcctggactctcctcagttctgtg

SEQ ID NO: 221512 - DNA, 25 bp, Homo sapien
cctgcgcaagatcaatcgggacctg

SEQ ID NO: 221513 - DNA, 25 bp, Homo sapien
cagttctgtgtcgtgttcgggtttt

SEQ ID NO: 221514 - DNA, 25 bp, Homo sapien
aatcgggacctgttcgacttctcca

SEQ ID NO: 221515 - DNA, 25 bp, Homo sapien
aggccgtcctgtgcagcaccatgga

SEQ ID NO: 221516 - DNA, 25 bp, Homo sapien
aggtcacgtggctccctgtgttaca

SEQ ID NO: 221517 - DNA, 25 bp, Homo sapien
ttcccttctgtctgtgggcgtcacg

SEQ ID NO: 221518 - DNA, 25 bp, Homo sapien
gacgaggtgcgcaacctgcgcaaga

SEQ ID NO: 221519 - DNA, 25 bp, Homo sapien
cccagtacacatgagttggacgtgt

SEQ ID NO: 221520 - DNA, 25 bp, Homo sapien
tggtccctgagcgacgtggatcagt

SEQ ID NO: 221521 - DNA, 25 bp, Homo sapien
cgaatctcactaccgcccggagctg

SEQ ID NO: 221522 - DNA, 25 bp, Homo sapien
tgcccgcaccgcgtacaggtgaagg

SEQ ID NO: 221523 - DNA, 25 bp, Homo sapien
cctgcacccgcagactggtccctga

SEQ ID NO: 221524 - DNA, 25 bp, Homo sapien
gtacacatgagttggacgtgtgccc

SEQ ID NO: 221525 - DNA, 25 bp, Homo sapien
tggatcagtgggacacggcagccct

SEQ ID NO: 221526 - DNA, 25 bp, Homo sapien
cctggctgacggcattaagagcttc

SEQ ID NO: 221527 - DNA, 25 bp, Homo sapien
ccggctcgaggcaccggagacagaa

SEQ ID NO: 221528 - DNA, 25 bp, Homo sapien
aacagctggctgctgtgctatggct

SEQ ID NO: 221529 - DNA, 25 bp, Homo sapien
ggccggaattcccttcaacagcatc

SEQ ID NO: 221530 - DNA, 25 bp, Homo sapien
gagaggttttctgcggccggaattc

SEQ ID NO: 221531 - DNA, 25 bp, Homo sapien
gttgggatctgtccctcctgaccgg

SEQ ID NO: 221532 - DNA, 25 bp, Homo sapien
acggcggttgggatctgtccctcct

SEQ ID NO: 221533 - DNA, 25 bp, Homo sapien
aggcaccggagacagaatggctgcc

SEQ ID NO: 221534 - DNA, 25 bp, Homo sapien
tgctatggcttcctctacctggcgc

SEQ ID NO: 221535 - DNA, 25 bp, Homo sapien
ccaggcctcggacaacagagagatc

SEQ ID NO: 221536 - DNA, 25 bp, Homo sapien
gatcgacaagcgcatgaacagcctc

SEQ ID NO: 221537 - DNA, 25 bp, Homo sapien
gaacagcctcaagccggacctcatg

SEQ ID NO: 221538 - DNA, 25 bp, Homo sapien
ccggacctcatgcagctgcgcaaga

SEQ ID NO: 221539 - DNA, 25 bp, Homo sapien
tgcgcaagatccgagaccagtacct

SEQ ID NO: 221540 - DNA, 25 bp, Homo sapien
acctcgtgtaagtggcggctccata

SEQ ID NO: 221541 - DNA, 25 bp, Homo sapien
gctcaagtcccgcattgccgagatc

SEQ ID NO: 221542 - DNA, 25 bp, Homo sapien
ccgagatccatgagagccgcacgaa

SEQ ID NO: 221543 - DNA, 25 bp, Homo sapien
ctctcattgaatgcctgccgcgtgc

SEQ ID NO: 221544 - DNA, 25 bp, Homo sapien
ccagccagtacgcactcatggagga

SEQ ID NO: 221545 - DNA, 25 bp, Homo sapien
cgcaccacgaggaacgcacttggta

SEQ ID NO: 221546 - DNA, 25 bp, Homo sapien
caagcgggatggcaccttcctcatc

SEQ ID NO: 221547 - DNA, 25 bp, Homo sapien
gcgacaccaagcactgcgtcatcta

SEQ ID NO: 221548 - DNA, 25 bp, Homo sapien
ccctacaacctgtacgggtcgctga

SEQ ID NO: 221549 - DNA, 25 bp, Homo sapien
agcacgcctcgctggtgcagcacaa

SEQ ID NO: 221550 - DNA, 25 bp, Homo sapien
tgggcaagatcaaccgcacgcaggc

SEQ ID NO: 221551 - DNA, 25 bp, Homo sapien
cgccgcctggttaaaggcgcttatt

SEQ ID NO: 221552 - DNA, 25 bp, Homo sapien
aggcgcttatttcccaggcagccgc

SEQ ID NO: 221553 - DNA, 25 bp, Homo sapien
tgaccctgtcgccacttctgctgtt

SEQ ID NO: 221554 - DNA, 25 bp, Homo sapien
ccctctgcaagcgttagacttcttt

SEQ ID NO: 221555 - DNA, 25 bp, Homo sapien
gtttcgctttcgcatcccgcatctg

SEQ ID NO: 221556 - DNA, 25 bp, Homo sapien
tgggccaccagttaactacaaggta

SEQ ID NO: 221557 - DNA, 25 bp, Homo sapien
aaaccctgttcagttcccggcgctg

SEQ ID NO: 221558 - DNA, 25 bp, Homo sapien
agacttctttgggaatgggccacca

SEQ ID NO: 221559 - DNA, 25 bp, Homo sapien
cgacggtttcccataggctggcaca

SEQ ID NO: 221560 - DNA, 25 bp, Homo sapien
cgggacgacggtcactgatttgcca

SEQ ID NO: 221561 - DNA, 25 bp, Homo sapien
accaatcggcatgcgggacgtaacg

SEQ ID NO: 221562 - DNA, 25 bp, Homo sapien
ctcgaccttgggatagaacgcctgc

SEQ ID NO: 221563 - DNA, 25 bp, Homo sapien
aacgcctgccttttattggtcaata

SEQ ID NO: 221564 - DNA, 25 bp, Homo sapien
ggtcaatactcttcgggccgggcaa

SEQ ID NO: 221565 - DNA, 25 bp, Homo sapien
cggacctgcggactgaagatcctta

SEQ ID NO: 221566 - DNA, 25 bp, Homo sapien
tgctcgtcactaacacgctgggctg

SEQ ID NO: 221567 - DNA, 25 bp, Homo sapien
tgcgatagatggtcttgaccttgaa

SEQ ID NO: 221568 - DNA, 25 bp, Homo sapien
aaggcaggcgtgaacgagtcgtcag

SEQ ID NO: 221569 - DNA, 25 bp, Homo sapien
cgttgcgatagatggtcttgacctt

SEQ ID NO: 221570 - DNA, 25 bp, Homo sapien
gtcttgaccttgaagtcgatgccca

SEQ ID NO: 221571 - DNA, 25 bp, Homo sapien
ccttgaagtcgatgcccacggtgct

SEQ ID NO: 221572 - DNA, 25 bp, Homo sapien
agtcgatgcccacggtgctgacgaa

SEQ ID NO: 221573 - DNA, 25 bp, Homo sapien
atgcccacggtgctgacgaaggcag

SEQ ID NO: 221574 - DNA, 25 bp, Homo sapien
ttgaccttgaagtcgatgcccacgg

SEQ ID NO: 221575 - DNA, 25 bp, Homo sapien
atgccatctggggataccgggtgta

SEQ ID NO: 221576 - DNA, 25 bp, Homo sapien
aacgagtcgtcagcatagcggaaga

SEQ ID NO: 221577 - DNA, 25 bp, Homo sapien
ccttctgcccatagcgcgagtctgt

SEQ ID NO: 221578 - DNA, 25 bp, Homo sapien
ttctgatccgaggactccttctgcc

SEQ ID NO: 221579 - DNA, 25 bp, Homo sapien
aacatgtagtcgaagttctgatccg

SEQ ID NO: 221580 - DNA, 25 bp, Homo sapien
ttgccgatgatgagaatcttgaaca

SEQ ID NO: 221581 - DNA, 25 bp, Homo sapien
tgcccacgctgctgttgccgatgat

SEQ ID NO: 221582 - DNA, 25 bp, Homo sapien
aagaggaaggacgtcttgcccacgc

SEQ ID NO: 221583 - DNA, 25 bp, Homo sapien
accgactcgcctatagaaatgtgca

SEQ ID NO: 221584 - DNA, 25 bp, Homo sapien
gcgcgtagagatgtggcccattgac

SEQ ID NO: 221585 - DNA, 25 bp, Homo sapien
gcggagcctcacatgtagataagtc

SEQ ID NO: 221586 - DNA, 25 bp, Homo sapien
agtcctccgtgacgtcctgcaaagg

SEQ ID NO: 221587 - DNA, 25 bp, Homo sapien
ggcgtcacacgagcatatccaggta

SEQ ID NO: 221588 - DNA, 25 bp, Homo sapien
gcgcgtgcaacgctcacacacttag

SEQ ID NO: 221589 - DNA, 25 bp, Homo sapien
gcccattgacgcacgcagagccaga

SEQ ID NO: 221590 - DNA, 25 bp, Homo sapien
tcctgagcagattgacgtgcaaatg

SEQ ID NO: 221591 - DNA, 25 bp, Homo sapien
gggtgccgctggctaacattgggcg

SEQ ID NO: 221592 - DNA, 25 bp, Homo sapien
ggggatcgaaccctaggcttgagca

SEQ ID NO: 221593 - DNA, 25 bp, Homo sapien
gatcgaaccctaggcttgagcatgg

SEQ ID NO: 221594 - DNA, 25 bp, Homo sapien
aaccctaggcttgagcatggtgctg

SEQ ID NO: 221595 - DNA, 25 bp, Homo sapien
tgcccagtccgctcggaggcccgac

SEQ ID NO: 221596 - DNA, 25 bp, Homo sapien
ggcccgaccagcaggacgagctctt

SEQ ID NO: 221597 - DNA, 25 bp, Homo sapien
agtgggaccatcagggctggaggat

SEQ ID NO: 221598 - DNA, 25 bp, Homo sapien
ctcttcccggcgaggtgcggtaagt

SEQ ID NO: 221599 - DNA, 25 bp, Homo sapien
acaggtgggtcaactcccggttcag

SEQ ID NO: 221600 - DNA, 25 bp, Homo sapien
actcccggttcaggatccgcttgaa

SEQ ID NO: 221601 - DNA, 25 bp, Homo sapien
ttcaggatccgcttgaactggggcg

SEQ ID NO: 221602 - DNA, 25 bp, Homo sapien
gtctgcagcgtctccaactgatcca

SEQ ID NO: 221603 - DNA, 25 bp, Homo sapien
aactgatccaggcaccagtccagct

SEQ ID NO: 221604 - DNA, 25 bp, Homo sapien
tccagctcgtctagcgtctccaatg

SEQ ID NO: 221605 - DNA, 25 bp, Homo sapien
gggagatgtactcggacacctggtt

SEQ ID NO: 221606 - DNA, 25 bp, Homo sapien
tactcggacacctggttcccggagc

SEQ ID NO: 221607 - DNA, 25 bp, Homo sapien
cgcgtctgtggacaaatagggaaac

SEQ ID NO: 221608 - DNA, 25 bp, Homo sapien
cgtggacacccagagttcattgtga

SEQ ID NO: 221609 - DNA, 25 bp, Homo sapien
aggtcacagtcgtttctggaaaggc

SEQ ID NO: 221610 - DNA, 25 bp, Homo sapien
cttaccaagtgggtgccaattcggc

SEQ ID NO: 221611 - DNA, 25 bp, Homo sapien
cagcctttgggtgccagacttacca

SEQ ID NO: 221612 - DNA, 25 bp, Homo sapien
caattcaggtcttcctccgtggaca

SEQ ID NO: 221613 - DNA, 25 bp, Homo sapien
gccttcaaaagggaatgtgcttcgc

SEQ ID NO: 221614 - DNA, 25 bp, Homo sapien
ggaaccaccaggaaccacggtcata

SEQ ID NO: 221615 - DNA, 25 bp, Homo sapien
tcttgtctccagaaaggggtcgtcc

SEQ ID NO: 221616 - DNA, 25 bp, Homo sapien
ggtcggactcgacgttcttgtctcc

SEQ ID NO: 221617 - DNA, 25 bp, Homo sapien
ctgcacgctgggtccttggacacaa

SEQ ID NO: 221618 - DNA, 25 bp, Homo sapien
accctgcgtcgtaattgccggtctg

SEQ ID NO: 221619 - DNA, 25 bp, Homo sapien
cagtggtgacgtcatcgttcagacc

SEQ ID NO: 221620 - DNA, 25 bp, Homo sapien
cacagattctcagagggacggcgcc

SEQ ID NO: 221621 - DNA, 25 bp, Homo sapien
tccagccgctgcaagagcccaaggt

SEQ ID NO: 221622 - DNA, 25 bp, Homo sapien
gaacatccaggtcacttcgcagctg

SEQ ID NO: 221623 - DNA, 25 bp, Homo sapien
cgccgacctgtacttcttgcaaatg

SEQ ID NO: 221624 - DNA, 25 bp, Homo sapien
caaatgtcgtcgaggttgcaggcct

SEQ ID NO: 221625 - DNA, 25 bp, Homo sapien
cgcctccgctctgtgcaggcgatgt

SEQ ID NO: 221626 - DNA, 25 bp, Homo sapien
gcttggccgggaccttgtcaaagaa

SEQ ID NO: 221627 - DNA, 25 bp, Homo sapien
ttgtcaaagaactgccggagggcct

SEQ ID NO: 221628 - DNA, 25 bp, Homo sapien
agcattccgtagctgtgcttggccg

SEQ ID NO: 221629 - DNA, 25 bp, Homo sapien
tgcacggggtgatgtacgccgacct

SEQ ID NO: 221630 - DNA, 25 bp, Homo sapien
ttgcagacatcgttggacacgctgg

SEQ ID NO: 221631 - DNA, 25 bp, Homo sapien
tccggatccgaatagaagcgctgtt

SEQ ID NO: 221632 - DNA, 25 bp, Homo sapien
gagagcgactcaacctgctgcaagc

SEQ ID NO: 221633 - DNA, 25 bp, Homo sapien
gacccacaagccatgatgacaccag

SEQ ID NO: 221634 - DNA, 25 bp, Homo sapien
agaaatagctttttccttccaggcg

SEQ ID NO: 221635 - DNA, 25 bp, Homo sapien
tctttcagtcccaaccgcacgtggg

SEQ ID NO: 221636 - DNA, 25 bp, Homo sapien
agcccgcggacttgtccggatccga

SEQ ID NO: 221637 - DNA, 25 bp, Homo sapien
tccatgcgccagagaaaggggtctg

SEQ ID NO: 221638 - DNA, 25 bp, Homo sapien
gccagcctcaaccaagcagcagaga

SEQ ID NO: 221639 - DNA, 25 bp, Homo sapien
gcgcggttccacgattggccaccaa

SEQ ID NO: 221640 - DNA, 25 bp, Homo sapien
tgtagccgcgccaggcagactggat

SEQ ID NO: 221641 - DNA, 25 bp, Homo sapien
agaggtgtgccaggttccgccgcac

SEQ ID NO: 221642 - DNA, 25 bp, Homo sapien
ccgcgccaagtagcttggatgacca

SEQ ID NO: 221643 - DNA, 25 bp, Homo sapien
acgcccgcctggatagtgatcactg

SEQ ID NO: 221644 - DNA, 25 bp, Homo sapien
atcactgcgaggatgcggatctcct

SEQ ID NO: 221645 - DNA, 25 bp, Homo sapien
accaccgccttgttgcgccaggtgt

SEQ ID NO: 221646 - DNA, 25 bp, Homo sapien
tgcagcctgcatggacaccattggc

SEQ ID NO: 221647 - DNA, 25 bp, Homo sapien
accagcccgttggactggatgatga

SEQ ID NO: 221648 - DNA, 25 bp, Homo sapien
aggactttctgcttgagctgcgcca

SEQ ID NO: 221649 - DNA, 25 bp, Homo sapien
gccagctccgtgttctgactcttga

SEQ ID NO: 221650 - DNA, 25 bp, Homo sapien
ttgatgcgctcctgcgtgtccatgt

SEQ ID NO: 221651 - DNA, 25 bp, Homo sapien
ctcaggttcgcgtagacaggcgctt

SEQ ID NO: 221652 - DNA, 25 bp, Homo sapien
cgccaccttggggtagaggaactgt

SEQ ID NO: 221653 - DNA, 25 bp, Homo sapien
tccagcttgtcgagtcctgggcacc

SEQ ID NO: 221654 - DNA, 25 bp, Homo sapien
cgccgagctggttctgcttgtgtaa

SEQ ID NO: 221655 - DNA, 25 bp, Homo sapien
ggtcggccctgcaagcaatttactg

SEQ ID NO: 221656 - DNA, 25 bp, Homo sapien
cgggccggtactagcagccagacac

SEQ ID NO: 221657 - DNA, 25 bp, Homo sapien
ggaagtcgcagtaaacacagggttg

SEQ ID NO: 221658 - DNA, 25 bp, Homo sapien
tccgtaagtttcctggtcttcgatg

SEQ ID NO: 221659 - DNA, 25 bp, Homo sapien
cggcggcagtggaagagttaacttc

SEQ ID NO: 221660 - DNA, 25 bp, Homo sapien
ccgggagacggcatctccgcgtaca

SEQ ID NO: 221661 - DNA, 25 bp, Homo sapien
tcagcgccaacgtcagggcgaagtg

SEQ ID NO: 221662 - DNA, 25 bp, Homo sapien
gggcttgttttccattgcgcaaata

SEQ ID NO: 221663 - DNA, 25 bp, Homo sapien
tcgatgatctcgtcggggatgcgca

SEQ ID NO: 221664 - DNA, 25 bp, Homo sapien
tgccgcggatgtagcactcgggcat

SEQ ID NO: 221665 - DNA, 25 bp, Homo sapien
tgcgcaggtacttgatggtgctgcc

SEQ ID NO: 221666 - DNA, 25 bp, Homo sapien
gaacttgtccccgtcctgcggagaa

SEQ ID NO: 221667 - DNA, 25 bp, Homo sapien
accatgtcgatgatctcgtcgggga

SEQ ID NO: 221668 - DNA, 25 bp, Homo sapien
ccttgaccatgtcgatgatctcgtc

SEQ ID NO: 221669 - DNA, 25 bp, Homo sapien
acctcctccttgaccatgtcgatga

SEQ ID NO: 221670 - DNA, 25 bp, Homo sapien
tacttgatggtgctgccgcggatgt

SEQ ID NO: 221671 - DNA, 25 bp, Homo sapien
tgaaaccttcgtcggtctcctgggc

SEQ ID NO: 221672 - DNA, 25 bp, Homo sapien
acgtgatagagccacctgcagtctc

SEQ ID NO: 221673 - DNA, 25 bp, Homo sapien
actcgaggctcggaccttacgttcg

SEQ ID NO: 221674 - DNA, 25 bp, Homo sapien
cagggatcccaacgactgctgttcc

SEQ ID NO: 221675 - DNA, 25 bp, Homo sapien
gccgcgcgccactaagctgaaagaa

SEQ ID NO: 221676 - DNA, 25 bp, Homo sapien
gcggtcaaccaatccacgcggagta

SEQ ID NO: 221677 - DNA, 25 bp, Homo sapien
aaatgcgtgcgcaggtgaaaccttc

SEQ ID NO: 221678 - DNA, 25 bp, Homo sapien
agtgccgcggcttgtaatgcaaaag

SEQ ID NO: 221679 - DNA, 25 bp, Homo sapien
agatttggaaggtgtcatcacccgc

SEQ ID NO: 221680 - DNA, 25 bp, Homo sapien
agctgtcgcgccagtcgcaacagaa

SEQ ID NO: 221681 - DNA, 25 bp, Homo sapien
gcgccagtcgcaacagaagcaggtc

SEQ ID NO: 221682 - DNA, 25 bp, Homo sapien
ccagtcgcaacagaagcaggtccga

SEQ ID NO: 221683 - DNA, 25 bp, Homo sapien
aggcacagcccgatcccgccatgga

SEQ ID NO: 221684 - DNA, 25 bp, Homo sapien
ggtagtgacgggtacgctggctgat

SEQ ID NO: 221685 - DNA, 25 bp, Homo sapien
ctctcagatttggaaggtgtcatca

SEQ ID NO: 221686 - DNA, 25 bp, Homo sapien
ggcaggtgctggaagtcctctcaga

SEQ ID NO: 221687 - DNA, 25 bp, Homo sapien
cgggaccctcagagttgcactccga

SEQ ID NO: 221688 - DNA, 25 bp, Homo sapien
ctgggaagattcgaacaccgacctc

SEQ ID NO: 221689 - DNA, 25 bp, Homo sapien
gcgagccgcgcaagtttcccgggac

SEQ ID NO: 221690 - DNA, 25 bp, Homo sapien
cctcagagttgcactccgaagactc

SEQ ID NO: 221691 - DNA, 25 bp, Homo sapien
attccgagagttgcggaaacgctac

SEQ ID NO: 221692 - DNA, 25 bp, Homo sapien
cggaaacgctacgaggacctgctaa

SEQ ID NO: 221693 - DNA, 25 bp, Homo sapien
ccgaagactccagattccgagagtt

SEQ ID NO: 221694 - DNA, 25 bp, Homo sapien
tgctaaccaggctgcgggccaacca

SEQ ID NO: 221695 - DNA, 25 bp, Homo sapien
cggcgtcagctcagccttgcaagac

SEQ ID NO: 221696 - DNA, 25 bp, Homo sapien
agctacaatcccatggtgctcattc

SEQ ID NO: 221697 - DNA, 25 bp, Homo sapien
tcaagacgagcctgcaccgcctgaa

SEQ ID NO: 221698 - DNA, 25 bp, Homo sapien
gcggcaaacatgcacgcgcagatca

SEQ ID NO: 221699 - DNA, 25 bp, Homo sapien
caagtgaccatgtgcatcggcgcgt

SEQ ID NO: 221700 - DNA, 25 bp, Homo sapien
tggcagaatcttcgtccgcacggcc

SEQ ID NO: 221701 - DNA, 25 bp, Homo sapien
agtcggaccaactgctggcagaatc

SEQ ID NO: 221702 - DNA, 25 bp, Homo sapien
gctcattcaaaagaccgacaccggg

SEQ ID NO: 221703 - DNA, 25 bp, Homo sapien
ctgggtactataggagctttgtgtc

SEQ ID NO: 221704 - DNA, 25 bp, Homo sapien
ctttatggggctatccgcagtcgtt

SEQ ID NO: 221705 - DNA, 25 bp, Homo sapien
agcagtcacccagcacctagtattg

SEQ ID NO: 221706 - DNA, 25 bp, Homo sapien
agttgttccaggacggccactgtga

SEQ ID NO: 221707 - DNA, 25 bp, Homo sapien
cacacgcgggcttgcctaggaaaaa

SEQ ID NO: 221708 - DNA, 25 bp, Homo sapien
cccaatgtcactgcctgaggcttta

SEQ ID NO: 221709 - DNA, 25 bp, Homo sapien
gagttaactccgtgggctctgtcca

SEQ ID NO: 221710 - DNA, 25 bp, Homo sapien
cagtcgccgagacagcgataattta

SEQ ID NO: 221711 - DNA, 25 bp, Homo sapien
ccgagacgctgaacgcaagcaaata

SEQ ID NO: 221712 - DNA, 25 bp, Homo sapien
ctcggatgctcgttagggatgttag

SEQ ID NO: 221713 - DNA, 25 bp, Homo sapien
gccaggacgatttccgagcagagcc

SEQ ID NO: 221714 - DNA, 25 bp, Homo sapien
gatgcggtaatcttcgagagctcga

SEQ ID NO: 221715 - DNA, 25 bp, Homo sapien
cgggctcactttatctgcgctagga

SEQ ID NO: 221716 - DNA, 25 bp, Homo sapien
ccctaaagttgggagacgccagcaa

SEQ ID NO: 221717 - DNA, 25 bp, Homo sapien
acggtactttccgagcgtcgcgagc

SEQ ID NO: 221718 - DNA, 25 bp, Homo sapien
ggcgtgttccgaggccagatttctt

SEQ ID NO: 221719 - DNA, 25 bp, Homo sapien
cctttcccgaggctcggcccgagct

SEQ ID NO: 221720 - DNA, 25 bp, Homo sapien
gcggctgccgcacaacctgagcttg

SEQ ID NO: 221721 - DNA, 25 bp, Homo sapien
caactttgcgatggagtttgtgcgg

SEQ ID NO: 221722 - DNA, 25 bp, Homo sapien
gcgagcgacgccgacaactttgcga

SEQ ID NO: 221723 - DNA, 25 bp, Homo sapien
gccggcctcaaacaaccactgggag

SEQ ID NO: 221724 - DNA, 25 bp, Homo sapien
ccgtggcgagcgacgccgacaactt

SEQ ID NO: 221725 - DNA, 25 bp, Homo sapien
cgccgacaactttgcgatggagttt

SEQ ID NO: 221726 - DNA, 25 bp, Homo sapien
acaaccactgggaggcactgtttcc

SEQ ID NO: 221727 - DNA, 25 bp, Homo sapien
agagtcggcgtgaacgcgcttccca

SEQ ID NO: 221728 - DNA, 25 bp, Homo sapien
cgcagcggttaccatggcagcgccg

SEQ ID NO: 221729 - DNA, 25 bp, Homo sapien
cgcagagcgtagaccgcagggccca

SEQ ID NO: 221730 - DNA, 25 bp, Homo sapien
gcctccgttgctctcgctctaactg

SEQ ID NO: 221731 - DNA, 25 bp, Homo sapien
gccggctcctcttcagggatgattg

SEQ ID NO: 221732 - DNA, 25 bp, Homo sapien
ctcctcttcagggatgattgacgta

SEQ ID NO: 221733 - DNA, 25 bp, Homo sapien
gccgcccgggattaactgctcaggg

SEQ ID NO: 221734 - DNA, 25 bp, Homo sapien
actgctcagggcctagagttgggaa

SEQ ID NO: 221735 - DNA, 25 bp, Homo sapien
cgtccgggctctcgacgaagaactg

SEQ ID NO: 221736 - DNA, 25 bp, Homo sapien
cggcgcgtataggttcacctcgctc

SEQ ID NO: 221737 - DNA, 25 bp, Homo sapien
aaacgcagtcgattggccagcaccg

SEQ ID NO: 221738 - DNA, 25 bp, Homo sapien
ccggtactcgtattgcgcctcgatg

SEQ ID NO: 221739 - DNA, 25 bp, Homo sapien
actcaccggcgcagagtcgactcag

SEQ ID NO: 221740 - DNA, 25 bp, Homo sapien
ggttcgaggcccgacaacccagagc

SEQ ID NO: 221741 - DNA, 25 bp, Homo sapien
tgggccaggacaaacgcagtcgatt

SEQ ID NO: 221742 - DNA, 25 bp, Homo sapien
agacaggccgcgcagtgaatcccgg

SEQ ID NO: 221743 - DNA, 25 bp, Homo sapien
gcacccgttcccgagcgaaagcgta

SEQ ID NO: 221744 - DNA, 25 bp, Homo sapien
tgctcccgcccacgttgccttccgg

SEQ ID NO: 221745 - DNA, 25 bp, Homo sapien
tcccgctcctatttcaccgtcccga

SEQ ID NO: 221746 - DNA, 25 bp, Homo sapien
tccgtgtctgtaggctcgggcgaca

SEQ ID NO: 221747 - DNA, 25 bp, Homo sapien
acgtctgagccggtgcccgtgtctg

SEQ ID NO: 221748 - DNA, 25 bp, Homo sapien
ggcatggcgccagcacgtctgagcc

SEQ ID NO: 221749 - DNA, 25 bp, Homo sapien
caaaccagaggatgcactgaccgcc

SEQ ID NO: 221750 - DNA, 25 bp, Homo sapien
ggggatccagcgaccaaaccagagg

SEQ ID NO: 221751 - DNA, 25 bp, Homo sapien
gggtccatgtcagtgcagaagctca

SEQ ID NO: 221752 - DNA, 25 bp, Homo sapien
gggttgctctgcaccatgtcgtcca

SEQ ID NO: 221753 - DNA, 25 bp, Homo sapien
ggcacatacttgatgaccacctgga

SEQ ID NO: 221754 - DNA, 25 bp, Homo sapien
tgctgtcacccacgtacggcacata

SEQ ID NO: 221755 - DNA, 25 bp, Homo sapien
gaggtatactcatccagcgcgcgct

SEQ ID NO: 221756 - DNA, 25 bp, Homo sapien
tggacacctccttagagcggaactg

SEQ ID NO: 221757 - DNA, 25 bp, Homo sapien
gtcagcagcgctaggtccagcatga

SEQ ID NO: 221758 - DNA, 25 bp, Homo sapien
agcaccagtgtgttggttccgccca

SEQ ID NO: 221759 - DNA, 25 bp, Homo sapien
tctggcgctgctccgaagaggagat

SEQ ID NO: 221760 - DNA, 25 bp, Homo sapien
ggggctctacctcatactcctcgga

SEQ ID NO: 221761 - DNA, 25 bp, Homo sapien
tgaaccgccgcgtgatgcgctcaat

SEQ ID NO: 221762 - DNA, 25 bp, Homo sapien
ccgccgcgtgatgcgctcaatgcgg

SEQ ID NO: 221763 - DNA, 25 bp, Homo sapien
cggtactcgctgtactcggcattga

SEQ ID NO: 221764 - DNA, 25 bp, Homo sapien
gctgtactcggcattgaagtcgttc

SEQ ID NO: 221765 - DNA, 25 bp, Homo sapien
gtcgttcttgtagctctggcgctgc

SEQ ID NO: 221766 - DNA, 25 bp, Homo sapien
tcggcattgaagtcgttcttgtagc

SEQ ID NO: 221767 - DNA, 25 bp, Homo sapien
cactcggtcacggaagggcctctgg

SEQ ID NO: 221768 - DNA, 25 bp, Homo sapien
tccgcctgcgtcaggccgtccttct

SEQ ID NO: 221769 - DNA, 25 bp, Homo sapien
actcacggcactggcaccactcttc

SEQ ID NO: 221770 - DNA, 25 bp, Homo sapien
actcttcctgatggcactcgccaag

SEQ ID NO: 221771 - DNA, 25 bp, Homo sapien
cctgatggcactcgccaagttgatg

SEQ ID NO: 221772 - DNA, 25 bp, Homo sapien
actcgccaagttgatgggggttgcc

SEQ ID NO: 221773 - DNA, 25 bp, Homo sapien
cagctcagccttgcggtagggccgt

SEQ ID NO: 221774 - DNA, 25 bp, Homo sapien
ctcagccttgcggtagggccgtagt

SEQ ID NO: 221775 - DNA, 25 bp, Homo sapien
cggcaggcagcgcactacattattc

SEQ ID NO: 221776 - DNA, 25 bp, Homo sapien
aggtgcgcaaactggaccctgccca

SEQ ID NO: 221777 - DNA, 25 bp, Homo sapien
cgcctgtattgcctcctagtgctga

SEQ ID NO: 221778 - DNA, 25 bp, Homo sapien
cgctgacgcgctgcattattcatga

SEQ ID NO: 221779 - DNA, 25 bp, Homo sapien
gtggccacttccgtgaacgaactcc

SEQ ID NO: 221780 - DNA, 25 bp, Homo sapien
agccgctgacgtgatgcattattta

SEQ ID NO: 221781 - DNA, 25 bp, Homo sapien
gatctctacagtcttccgtctttgg

SEQ ID NO: 221782 - DNA, 25 bp, Homo sapien
ttcacgtggaacaccgacaccttgc

SEQ ID NO: 221783 - DNA, 25 bp, Homo sapien
gtctcgccgtaaacactccagtgtc

SEQ ID NO: 221784 - DNA, 25 bp, Homo sapien
tcatgcagacgtccgtcccgggcgt

SEQ ID NO: 221785 - DNA, 25 bp, Homo sapien
acccgttggctcatgcagacgtccg

SEQ ID NO: 221786 - DNA, 25 bp, Homo sapien
tgccgcacccgttggctcatgcaga

SEQ ID NO: 221787 - DNA, 25 bp, Homo sapien
ctcgggaaccaggttcggccgcttg

SEQ ID NO: 221788 - DNA, 25 bp, Homo sapien
gccctgcacgcctccatcgggaccc

SEQ ID NO: 221789 - DNA, 25 bp, Homo sapien
gcctgtctgacgccaccagtctggg

SEQ ID NO: 221790 - DNA, 25 bp, Homo sapien
gggccctcagtcaagccgcgaccca

SEQ ID NO: 221791 - DNA, 25 bp, Homo sapien
caagcctgggcttctggaaatacgc

SEQ ID NO: 221792 - DNA, 25 bp, Homo sapien
tgctcaatggatacgcaggcggcgc

SEQ ID NO: 221793 - DNA, 25 bp, Homo sapien
catctggtcattcctgctgcgcaca

SEQ ID NO: 221794 - DNA, 25 bp, Homo sapien
gcgccactggccacatctggtcatt

SEQ ID NO: 221795 - DNA, 25 bp, Homo sapien
ttaacgcacgcaagcggctccaggg

SEQ ID NO: 221796 - DNA, 25 bp, Homo sapien
cgccctttcctgtcgtgacttaacg

SEQ ID NO: 221797 - DNA, 25 bp, Homo sapien
ttgtgatgcacccacgagctgaagc

SEQ ID NO: 221798 - DNA, 25 bp, Homo sapien
tacgcaggcgcgagatgaattgttt

SEQ ID NO: 221799 - DNA, 25 bp, Homo sapien
ggcctagaggcagcggacgcaaaca

SEQ ID NO: 221800 - DNA, 25 bp, Homo sapien
cgtgtagcgttaactctgccagtca

SEQ ID NO: 221801 - DNA, 25 bp, Homo sapien
tccgagttaatgagagaggggtatt

SEQ ID NO: 221802 - DNA, 25 bp, Homo sapien
tgagctggctcatgcgggccagtct

SEQ ID NO: 221803 - DNA, 25 bp, Homo sapien
gcttcgttcgccagcatccaagatg

SEQ ID NO: 221804 - DNA, 25 bp, Homo sapien
cgttcagctattcgctgagggcccg

SEQ ID NO: 221805 - DNA, 25 bp, Homo sapien
accgccagcggttgtcagtggccta

SEQ ID NO: 221806 - DNA, 25 bp, Homo sapien
gtgcaatcgtctcaagtgactcggc

SEQ ID NO: 221807 - DNA, 25 bp, Homo sapien
tttcttccttctggctggccggccg

SEQ ID NO: 221808 - DNA, 25 bp, Homo sapien
cgcgctaccggagcacagtgcacgg

SEQ ID NO: 221809 - DNA, 25 bp, Homo sapien
tgactacgacttcgcgcgctaccgg

SEQ ID NO: 221810 - DNA, 25 bp, Homo sapien
tgcgcagcggccctgactacgactt

SEQ ID NO: 221811 - DNA, 25 bp, Homo sapien
cgggagtcaggaagcgtccttccta

SEQ ID NO: 221812 - DNA, 25 bp, Homo sapien
cgacgactcactcttcgtggcttct

SEQ ID NO: 221813 - DNA, 25 bp, Homo sapien
ggagcctacggtccctgcagtgcct

SEQ ID NO: 221814 - DNA, 25 bp, Homo sapien
tgcgcagtcatgatcaccgagaccg

SEQ ID NO: 221815 - DNA, 25 bp, Homo sapien
tgaaacgggcttttccgtcagccaa

SEQ ID NO: 221816 - DNA, 25 bp, Homo sapien
cgaggctgctgcgttcacactaata

SEQ ID NO: 221817 - DNA, 25 bp, Homo sapien
catctgtatgctctgggtctatctc

SEQ ID NO: 221818 - DNA, 25 bp, Homo sapien
cgtttgcaaatgtcccgagcacgtc

SEQ ID NO: 221819 - DNA, 25 bp, Homo sapien
ctcctgtgcgtaggtcgactgtctt

SEQ ID NO: 221820 - DNA, 25 bp, Homo sapien
tcgactgtcttctccgtgcctgagc

SEQ ID NO: 221821 - DNA, 25 bp, Homo sapien
cccagaggagcaggtagctgttcaa

SEQ ID NO: 221822 - DNA, 25 bp, Homo sapien
agctcagggataccagcctttagcc

SEQ ID NO: 221823 - DNA, 25 bp, Homo sapien
ctcgccactggtcgtagaggcggaa

SEQ ID NO: 221824 - DNA, 25 bp, Homo sapien
ttgagccagcccaggaactgcttga

SEQ ID NO: 221825 - DNA, 25 bp, Homo sapien
gttggagcagtacgcgtgcttcttg

SEQ ID NO: 221826 - DNA, 25 bp, Homo sapien
atccaggctcgccactggtcgtaga

SEQ ID NO: 221827 - DNA, 25 bp, Homo sapien
tgtgcgacttctgcatccaggctcg

SEQ ID NO: 221828 - DNA, 25 bp, Homo sapien
gggtcttgtgcgacttctgcatcca

SEQ ID NO: 221829 - DNA, 25 bp, Homo sapien
ccttcctacctggttgcgggtcttg

SEQ ID NO: 221830 - DNA, 25 bp, Homo sapien
cgtgcttcttgagccagcccaggaa

SEQ ID NO: 221831 - DNA, 25 bp, Homo sapien
tgaagcaccggtacccgcggcggtc

SEQ ID NO: 221832 - DNA, 25 bp, Homo sapien
aggtgcagccgaagcgagccctcct

SEQ ID NO: 221833 - DNA, 25 bp, Homo sapien
catgacattgtgcaactggtggccc

SEQ ID NO: 221834 - DNA, 25 bp, Homo sapien
ctggaggccgccatccatgacattg

SEQ ID NO: 221835 - DNA, 25 bp, Homo sapien
tcgggtgctggaggccgtacctccc

SEQ ID NO: 221836 - DNA, 25 bp, Homo sapien
agctggtcctggacctaagccggcg

SEQ ID NO: 221837 - DNA, 25 bp, Homo sapien
cgcacgcctgggaagacgtcggcct

SEQ ID NO: 221838 - DNA, 25 bp, Homo sapien
tggctgttggggacaccactgccgc

SEQ ID NO: 221839 - DNA, 25 bp, Homo sapien
ctcacgtcataaataaagccgggga

SEQ ID NO: 221840 - DNA, 25 bp, Homo sapien
gcctcacgtcataaataaagccggg

SEQ ID NO: 221841 - DNA, 25 bp, Homo sapien
atcggcctcacgtcataaataaagc

SEQ ID NO: 221842 - DNA, 25 bp, Homo sapien
ggacatcggcctcacgtcataaata

SEQ ID NO: 221843 - DNA, 25 bp, Homo sapien
cggataaggacatcggcctcacgtc

SEQ ID NO: 221844 - DNA, 25 bp, Homo sapien
cggcggataaggacatcggcctcac

SEQ ID NO: 221845 - DNA, 25 bp, Homo sapien
cctgtgcaagaatcgcaggtgccgg

SEQ ID NO: 221846 - DNA, 25 bp, Homo sapien
taaagccggggacccgctgacaggc

SEQ ID NO: 221847 - DNA, 25 bp, Homo sapien
cggagcaagtctgagcagccgaatt

SEQ ID NO: 221848 - DNA, 25 bp, Homo sapien
caggggcccagagtccaccgaagca

SEQ ID NO: 221849 - DNA, 25 bp, Homo sapien
cagccgaattgacaaggcgctaatg

SEQ ID NO: 221850 - DNA, 25 bp, Homo sapien
actctctggacagtggactgcggcg

SEQ ID NO: 221851 - DNA, 25 bp, Homo sapien
gcggaagcaggactctctggacagt

SEQ ID NO: 221852 - DNA, 25 bp, Homo sapien
gcagagggtctcaggccgcgatccc

SEQ ID NO: 221853 - DNA, 25 bp, Homo sapien
agtccaccgaagcagacgcgtgcgc

SEQ ID NO: 221854 - DNA, 25 bp, Homo sapien
acaaggcgctaatgcgccgctggcc

SEQ ID NO: 221855 - DNA, 25 bp, Homo sapien
tggcctgccgctgattcacgcccag

SEQ ID NO: 221856 - DNA, 25 bp, Homo sapien
ggcgccgagtcaactttccctctta

SEQ ID NO: 221857 - DNA, 25 bp, Homo sapien
gccgagtcaactttccctcttaagc

SEQ ID NO: 221858 - DNA, 25 bp, Homo sapien
ccgaaggaatgtcggcggatttcct

SEQ ID NO: 221859 - DNA, 25 bp, Homo sapien
gaatgtcggcggatttcctgaaacc

SEQ ID NO: 221860 - DNA, 25 bp, Homo sapien
gggtcaagtcctctttccgctcacc

SEQ ID NO: 221861 - DNA, 25 bp, Homo sapien
ctgctgtggcttcccggacgcctgg

SEQ ID NO: 221862 - DNA, 25 bp, Homo sapien
cccgccttgacctcggctgctgtgg

SEQ ID NO: 221863 - DNA, 25 bp, Homo sapien
gcgcgcaagttgtctcctttctaac

SEQ ID NO: 221864 - DNA, 25 bp, Homo sapien
cctgggtgtcaaaagagaagatgcc

SEQ ID NO: 221865 - DNA, 25 bp, Homo sapien
ccactcccttatctggcggagagga

SEQ ID NO: 221866 - DNA, 25 bp, Homo sapien
aagtcagaagtgtcgctatttgccc

SEQ ID NO: 221867 - DNA, 25 bp, Homo sapien
catctttgcagaggatccgggttta

SEQ ID NO: 221868 - DNA, 25 bp, Homo sapien
ttgctcctgagcatacctctgtgtc

SEQ ID NO: 221869 - DNA, 25 bp, Homo sapien
ctcgctgatccttgtagcctggaca

SEQ ID NO: 221870 - DNA, 25 bp, Homo sapien
cccgttttcccatgagaattagaca

SEQ ID NO: 221871 - DNA, 25 bp, Homo sapien
cgcctccagtctgttagcatttaga

SEQ ID NO: 221872 - DNA, 25 bp, Homo sapien
agttgctgaactttcgcattggtca

SEQ ID NO: 221873 - DNA, 25 bp, Homo sapien
ggtgatgttttcctcgccaaggctg

SEQ ID NO: 221874 - DNA, 25 bp, Homo sapien
cttgcacagatgacgggtgatgttt

SEQ ID NO: 221875 - DNA, 25 bp, Homo sapien
actccacgtgagtcacttgcacaga

SEQ ID NO: 221876 - DNA, 25 bp, Homo sapien
ggtcaggagcgcacaaatgtttata

SEQ ID NO: 221877 - DNA, 25 bp, Homo sapien
gttctccttggtgaagtccgtcctg

SEQ ID NO: 221878 - DNA, 25 bp, Homo sapien
gtggagccgtctgtctcgtcacaga

SEQ ID NO: 221879 - DNA, 25 bp, Homo sapien
cgtctggagactcggaccggctcag

SEQ ID NO: 221880 - DNA, 25 bp, Homo sapien
cactcagaggccagattcgggcaga

SEQ ID NO: 221881 - DNA, 25 bp, Homo sapien
actcacgtgcgggtgaccgtcactc

SEQ ID NO: 221882 - DNA, 25 bp, Homo sapien
tccgatgactcacgtgcgggtgacc

SEQ ID NO: 221883 - DNA, 25 bp, Homo sapien
cgcattggctccgatgactcacgtg

SEQ ID NO: 221884 - DNA, 25 bp, Homo sapien
accgtcactcgagtggccgtctgga

SEQ ID NO: 221885 - DNA, 25 bp, Homo sapien
aatggcctcttgagacggccctggc

SEQ ID NO: 221886 - DNA, 25 bp, Homo sapien
ctgctgacgcattggctccgatgac

SEQ ID NO: 221887 - DNA, 25 bp, Homo sapien
cgctcggtcagcagcaaggtctacc

SEQ ID NO: 221888 - DNA, 25 bp, Homo sapien
agctgtgccgagatcgacctgttcc

SEQ ID NO: 221889 - DNA, 25 bp, Homo sapien
gaaagccgcatccagttccagctga

SEQ ID NO: 221890 - DNA, 25 bp, Homo sapien
tctcagtggaggacaagaaggccct

SEQ ID NO: 221891 - DNA, 25 bp, Homo sapien
gccgcctctacatctcgggtggcta

SEQ ID NO: 221892 - DNA, 25 bp, Homo sapien
tggccgtgctggacaattttgtgta

SEQ ID NO: 221893 - DNA, 25 bp, Homo sapien
ttccggcagcacgagatgcagtctc

SEQ ID NO: 221894 - DNA, 25 bp, Homo sapien
ggaggccttcaactaccaggtgctg

SEQ ID NO: 221895 - DNA, 25 bp, Homo sapien
cttcgaggaggtcatgaaggacctg

SEQ ID NO: 221896 - DNA, 25 bp, Homo sapien
tgcacaatcagaagcaggcggagga

SEQ ID NO: 221897 - DNA, 25 bp, Homo sapien
agatcgcgctgcacaatcagaagca

SEQ ID NO: 221898 - DNA, 25 bp, Homo sapien
tccgcggaaattcagcgagaagatc

SEQ ID NO: 221899 - DNA, 25 bp, Homo sapien
gagaagatggcgacttcgaacaatc

SEQ ID NO: 221900 - DNA, 25 bp, Homo sapien
cgttgaaatttccactcgcgctcca

SEQ ID NO: 221901 - DNA, 25 bp, Homo sapien
cggatcactgcgtcggcgttgaaat

SEQ ID NO: 221902 - DNA, 25 bp, Homo sapien
tgcgtcggcgttgaaatttccactc

SEQ ID NO: 221903 - DNA, 25 bp, Homo sapien
cccgtgtgtccttacaggtcgacca

SEQ ID NO: 221904 - DNA, 25 bp, Homo sapien
tcaacgtcagcagactcgtcggtgc

SEQ ID NO: 221905 - DNA, 25 bp, Homo sapien
ctatccggttgggaggtctcaccag

SEQ ID NO: 221906 - DNA, 25 bp, Homo sapien
tccctaacgtgcacctccgagaaga

SEQ ID NO: 221907 - DNA, 25 bp, Homo sapien
cacctgctcggtggaagggctctcc

SEQ ID NO: 221908 - DNA, 25 bp, Homo sapien
gctctccggagactggcactcagta

SEQ ID NO: 221909 - DNA, 25 bp, Homo sapien
tcagtatctgagtatgaggagcctc

SEQ ID NO: 221910 - DNA, 25 bp, Homo sapien
gtgactcagtaacccacagcgtgct

SEQ ID NO: 221911 - DNA, 25 bp, Homo sapien
ggccagcgcctttccgacggcgaag

SEQ ID NO: 221912 - DNA, 25 bp, Homo sapien
actcgcaggctgcaaataggaagcg

SEQ ID NO: 221913 - DNA, 25 bp, Homo sapien
cccacgcggtgctgtgggacctgac

SEQ ID NO: 221914 - DNA, 25 bp, Homo sapien
tgtgggacctgacacgctatccctc

SEQ ID NO: 221915 - DNA, 25 bp, Homo sapien
gcagacgcagctagggtacagcctt

SEQ ID NO: 221916 - DNA, 25 bp, Homo sapien
cgtgcatgtcatcggccacagcctg

SEQ ID NO: 221917 - DNA, 25 bp, Homo sapien
cagccttgaggacgtgcatgtcatc

SEQ ID NO: 221918 - DNA, 25 bp, Homo sapien
tggccgctggtcagcactgttgccc

SEQ ID NO: 221919 - DNA, 25 bp, Homo sapien
gctccctgctgcgttacaccattga

SEQ ID NO: 221920 - DNA, 25 bp, Homo sapien
gcttccatcgctgcggggatccctt

SEQ ID NO: 221921 - DNA, 25 bp, Homo sapien
acaccattgagtcctttcgcatctg

SEQ ID NO: 221922 - DNA, 25 bp, Homo sapien
agcgtctctttctcaagtgactgaa

SEQ ID NO: 221923 - DNA, 25 bp, Homo sapien
gggctctctgtctgcttcagcgtct

SEQ ID NO: 221924 - DNA, 25 bp, Homo sapien
acgcgagctgtccacctttctgggc

SEQ ID NO: 221925 - DNA, 25 bp, Homo sapien
tgtccgcaaagacacgcgagctgtc

SEQ ID NO: 221926 - DNA, 25 bp, Homo sapien
tttcgcatctgtgcgcatcccgctt

SEQ ID NO: 221927 - DNA, 25 bp, Homo sapien
ggtgctcagaatcccagaggcctgc

SEQ ID NO: 221928 - DNA, 25 bp, Homo sapien
ctctgccgtgtctgggatctgactt

SEQ ID NO: 221929 - DNA, 25 bp, Homo sapien
atctgacttccctgaggttaggtcc

SEQ ID NO: 221930 - DNA, 25 bp, Homo sapien
ggttaggtccggcacctgtcagaaa

SEQ ID NO: 221931 - DNA, 25 bp, Homo sapien
ggcacctgtcagaaaccaggcctga

SEQ ID NO: 221932 - DNA, 25 bp, Homo sapien
aaccaggcctgacattttcaagatg

SEQ ID NO: 221933 - DNA, 25 bp, Homo sapien
tttcaagatgggcacaggcccgctc

SEQ ID NO: 221934 - DNA, 25 bp, Homo sapien
ccaggcccgtccatgtgggcagcgt

SEQ ID NO: 221935 - DNA, 25 bp, Homo sapien
cggcactttaaggtgtggagccttc

SEQ ID NO: 221936 - DNA, 25 bp, Homo sapien
acccatttgtgtttgcccgtgatcc

SEQ ID NO: 221937 - DNA, 25 bp, Homo sapien
cgcaagtgctgctacggctactgca

SEQ ID NO: 221938 - DNA, 25 bp, Homo sapien
tactgcattgacctgctggagcggc

SEQ ID NO: 221939 - DNA, 25 bp, Homo sapien
tggcggtcaccagcttcagtatcaa

SEQ ID NO: 221940 - DNA, 25 bp, Homo sapien
ggcctcacccatcggtgcctttatg

SEQ ID NO: 221941 - DNA, 25 bp, Homo sapien
taggttcctggccaacacgtccttc

SEQ ID NO: 221942 - DNA, 25 bp, Homo sapien
cccgctcacaggtggtggacttcac

SEQ ID NO: 221943 - DNA, 25 bp, Homo sapien
tttcttggcagaggcccacacagcg

SEQ ID NO: 221944 - DNA, 25 bp, Homo sapien
atctggcctccagcatttcggcagc

SEQ ID NO: 221945 - DNA, 25 bp, Homo sapien
tttcggcagccgctacacctgttgg

SEQ ID NO: 221946 - DNA, 25 bp, Homo sapien
cgctacacctgttggccggctgtgc

SEQ ID NO: 221947 - DNA, 25 bp, Homo sapien
tcactaatccgcaagcccagcaatt

SEQ ID NO: 221948 - DNA, 25 bp, Homo sapien
cgcaagcccagcaattctcagaagg

SEQ ID NO: 221949 - DNA, 25 bp, Homo sapien
cacttgtctgcaaacgtttcttggc

SEQ ID NO: 221950 - DNA, 25 bp, Homo sapien
cagcaattctcagaaggaggcccgg

SEQ ID NO: 221951 - DNA, 25 bp, Homo sapien
agaacgtgagctccctcaggaagga

SEQ ID NO: 221952 - DNA, 25 bp, Homo sapien
agcaggcacccagtctaaacaagca

SEQ ID NO: 221953 - DNA, 25 bp, Homo sapien
acacacaacatacgtggaagctgga

SEQ ID NO: 221954 - DNA, 25 bp, Homo sapien
gcccggtaatgcctgacatgtgttg

SEQ ID NO: 221955 - DNA, 25 bp, Homo sapien
ttgtttgtgaacctgccgcccaagc

SEQ ID NO: 221956 - DNA, 25 bp, Homo sapien
caagcagctcgcctggcaggggctt

SEQ ID NO: 221957 - DNA, 25 bp, Homo sapien
cgccttttaaatcaagccgagctgc

SEQ ID NO: 221958 - DNA, 25 bp, Homo sapien
ggctttgctttctggacgcctttta

SEQ ID NO: 221959 - DNA, 25 bp, Homo sapien
ggcatctttgcccacctacagagcg

SEQ ID NO: 221960 - DNA, 25 bp, Homo sapien
gacccgggccttgcgagtcagagct

SEQ ID NO: 221961 - DNA, 25 bp, Homo sapien
cccgtcccatctgcgggctatggag

SEQ ID NO: 221962 - DNA, 25 bp, Homo sapien
tctttgcccacctacagagcggagg

SEQ ID NO: 221963 - DNA, 25 bp, Homo sapien
tgcccacctacagagcggaggccga

SEQ ID NO: 221964 - DNA, 25 bp, Homo sapien
catggaccgtgcacgcgggtttgcc

SEQ ID NO: 221965 - DNA, 25 bp, Homo sapien
ctggctttgcgtggaggccaggatc

SEQ ID NO: 221966 - DNA, 25 bp, Homo sapien
ccttgcgagtcagagctgcacgtgc

SEQ ID NO: 221967 - DNA, 25 bp, Homo sapien
gacggctgtcttttatatttctgag

SEQ ID NO: 221968 - DNA, 25 bp, Homo sapien
gtggccacctttgccgggaagtgac

SEQ ID NO: 221969 - DNA, 25 bp, Homo sapien
tcaccgcaggcaggcccatcggtgg

SEQ ID NO: 221970 - DNA, 25 bp, Homo sapien
tttctgagcacacacagagccctgg

SEQ ID NO: 221971 - DNA, 25 bp, Homo sapien
aataaacactattttgacggctgtc

SEQ ID NO: 221972 - DNA, 25 bp, Homo sapien
gggccgtggcgcattttccgactgt

SEQ ID NO: 221973 - DNA, 25 bp, Homo sapien
cgaggacaccttccggatggaccgc

SEQ ID NO: 221974 - DNA, 25 bp, Homo sapien
aggcgcaaagtggacagagcatgca

SEQ ID NO: 221975 - DNA, 25 bp, Homo sapien
agcgttctccggacacacgtcgatc

SEQ ID NO: 221976 - DNA, 25 bp, Homo sapien
cgtcgatcttgtctaccaccttgtc

SEQ ID NO: 221977 - DNA, 25 bp, Homo sapien
cttgtctgcatcaaagtcgtcctgg

SEQ ID NO: 221978 - DNA, 25 bp, Homo sapien
gcaccaggcggcagttgtcccgact

SEQ ID NO: 221979 - DNA, 25 bp, Homo sapien
ccgactgtcagggactccgtcattg

SEQ ID NO: 221980 - DNA, 25 bp, Homo sapien
actccgtcattgtcgtcgtcgtcgt

SEQ ID NO: 221981 - DNA, 25 bp, Homo sapien
ggtgagcgtgacttcagcgttctcc

SEQ ID NO: 221982 - DNA, 25 bp, Homo sapien
tccgggtccagcacgactgtctgga

SEQ ID NO: 221983 - DNA, 25 bp, Homo sapien
tccgtgttgcgctggtctgggttcc

SEQ ID NO: 221984 - DNA, 25 bp, Homo sapien
ctcacggtcgccgtcgatgtcgtcg

SEQ ID NO: 221985 - DNA, 25 bp, Homo sapien
cgtcgatgtcgtcgtcgcacgcatc

SEQ ID NO: 221986 - DNA, 25 bp, Homo sapien
ccgtcctggtctgtgtccttttggt

SEQ ID NO: 221987 - DNA, 25 bp, Homo sapien
tgtccttttggtcgtcgttcttctg

SEQ ID NO: 221988 - DNA, 25 bp, Homo sapien
ttctgggaccggcagttgtcgcacg

SEQ ID NO: 221989 - DNA, 25 bp, Homo sapien
cacttgtcctcgtccgtgttgcgct

SEQ ID NO: 221990 - DNA, 25 bp, Homo sapien
gaccggcagttgtcgcacgcatcgc

SEQ ID NO: 221991 - DNA, 25 bp, Homo sapien
cgcacctcgtagtgtctcggatgtg

SEQ ID NO: 221992 - DNA, 25 bp, Homo sapien
gtgcgtactgactgctgcatccctg

SEQ ID NO: 221993 - DNA, 25 bp, Homo sapien
gctcttcggggcgaacactcccagt

SEQ ID NO: 221994 - DNA, 25 bp, Homo sapien
gcacgactttgccttgatgacggca

SEQ ID NO: 221995 - DNA, 25 bp, Homo sapien
gctctgagatggaagcaattgtcgc

SEQ ID NO: 221996 - DNA, 25 bp, Homo sapien
gctagcgcacctcgttgacgtcggt

SEQ ID NO: 221997 - DNA, 25 bp, Homo sapien
ctcggatgtggaaagttcaagggcc

SEQ ID NO: 221998 - DNA, 25 bp, Homo sapien
ttcaagggccatatgccagtgcttg

SEQ ID NO: 221999 - DNA, 25 bp, Homo sapien
gctcacccggtggagcacaaaggcc

SEQ ID NO: 222000 - DNA, 25 bp, Homo sapien
tggcgctatccggtgcccacttggc

SEQ ID NO: 222001 - DNA, 25 bp, Homo sapien
ggcatctgcgcagtaaacatctggc

SEQ ID NO: 222002 - DNA, 25 bp, Homo sapien
cctttgtgcgctcacccggtggagc

SEQ ID NO: 222003 - DNA, 25 bp, Homo sapien
aggatatgcggagggctctaagtca

SEQ ID NO: 222004 - DNA, 25 bp, Homo sapien
ctctaagtcaaagcgggcgtttttg

SEQ ID NO: 222005 - DNA, 25 bp, Homo sapien
gcgtttttgcgggtgtagacactgc

SEQ ID NO: 222006 - DNA, 25 bp, Homo sapien
ccggtgtaaagtcgggcatctgcgc

SEQ ID NO: 222007 - DNA, 25 bp, Homo sapien
agggtattcggctagcgctcaatta

SEQ ID NO: 222008 - DNA, 25 bp, Homo sapien
acacagggctccgagttcgagttca

SEQ ID NO: 222009 - DNA, 25 bp, Homo sapien
ggcgttccgagaccacctatgtagg

SEQ ID NO: 222010 - DNA, 25 bp, Homo sapien
cagtctctccagttgggcgttccga

SEQ ID NO: 222011 - DNA, 25 bp, Homo sapien
ccgtcgcagcgaccacaggtgcaga

SEQ ID NO: 222012 - DNA, 25 bp, Homo sapien
ccaattagcagttggggcgggacca

SEQ ID NO: 222013 - DNA, 25 bp, Homo sapien
gcagactctcactttcctggacacg

SEQ ID NO: 222014 - DNA, 25 bp, Homo sapien
gcactgttacctctcggtccggctg

SEQ ID NO: 222015 - DNA, 25 bp, Homo sapien
tcctcacaggatgcagagcgcattg

SEQ ID NO: 222016 - DNA, 25 bp, Homo sapien
tgtgctgcaaagaccactgagcctg

SEQ ID NO: 222017 - DNA, 25 bp, Homo sapien
cggccgcttgtattgaaggtttatg

SEQ ID NO: 222018 - DNA, 25 bp, Homo sapien
cgtaatcatcaagtgccagctgccc

SEQ ID NO: 222019 - DNA, 25 bp, Homo sapien
ccacgaggtggaggacgtaatcatc

SEQ ID NO: 222020 - DNA, 25 bp, Homo sapien
tggctacatctaccacaagctgttg

SEQ ID NO: 222021 - DNA, 25 bp, Homo sapien
tgagacctcggtgtctggctacatc

SEQ ID NO: 222022 - DNA, 25 bp, Homo sapien
aacgtttgccgtggatgagacctcg

SEQ ID NO: 222023 - DNA, 25 bp, Homo sapien
tgcccgagcaggctccttgcaaaga

SEQ ID NO: 222024 - DNA, 25 bp, Homo sapien
caggctccttgcaaagacagcagcg

SEQ ID NO: 222025 - DNA, 25 bp, Homo sapien
aacttcgcatttctgtgcccgagca

SEQ ID NO: 222026 - DNA, 25 bp, Homo sapien
gaaaggggactacgtcttagcagga

SEQ ID NO: 222027 - DNA, 25 bp, Homo sapien
tctctttgattgaaaggggactacg

SEQ ID NO: 222028 - DNA, 25 bp, Homo sapien
ctcagagtagccctttcctctgttc

SEQ ID NO: 222029 - DNA, 25 bp, Homo sapien
gaagaccctcatctcagagtagccc

SEQ ID NO: 222030 - DNA, 25 bp, Homo sapien
ggagggcgcgtctgtccacgcctac

SEQ ID NO: 222031 - DNA, 25 bp, Homo sapien
cccgaggcactcacgaagatgacca

SEQ ID NO: 222032 - DNA, 25 bp, Homo sapien
gcgtcatactggtccgcgagccaca

SEQ ID NO: 222033 - DNA, 25 bp, Homo sapien
tgaagaactccgacatgatggcctc

SEQ ID NO: 222034 - DNA, 25 bp, Homo sapien
tgtgagtaccgcagcagcatggaca

SEQ ID NO: 222035 - DNA, 25 bp, Homo sapien
tccacatgctcacaaagcggtagtg

SEQ ID NO: 222036 - DNA, 25 bp, Homo sapien
aggcccttcacgctggacatgagga

SEQ ID NO: 222037 - DNA, 25 bp, Homo sapien
ggatgtcatcgtagcccaggaactc

SEQ ID NO: 222038 - DNA, 25 bp, Homo sapien
actcaccgatgaagacgaagatctg

SEQ ID NO: 222039 - DNA, 25 bp, Homo sapien
tcgctcctggactacgaggtctcca

SEQ ID NO: 222040 - DNA, 25 bp, Homo sapien
tcatcgacctgctccacgacaagtg

SEQ ID NO: 222041 - DNA, 25 bp, Homo sapien
gctacaagtcctccggcttcatcga

SEQ ID NO: 222042 - DNA, 25 bp, Homo sapien
atcgacgccgactgcaaactgctga

SEQ ID NO: 222043 - DNA, 25 bp, Homo sapien
tcaacgccttcatcatggacaagtc

SEQ ID NO: 222044 - DNA, 25 bp, Homo sapien
cgccgaggcgtacatcaagaagagc

SEQ ID NO: 222045 - DNA, 25 bp, Homo sapien
gccctgagccttgtctgaagtgacc

SEQ ID NO: 222046 - DNA, 25 bp, Homo sapien
actgctgaccgtgggaaagcccttc

SEQ ID NO: 222047 - DNA, 25 bp, Homo sapien
agcgccgcatcgaagtcgcgcgtga

SEQ ID NO: 222048 - DNA, 25 bp, Homo sapien
cctcactagcgggtacaagcctcgg

SEQ ID NO: 222049 - DNA, 25 bp, Homo sapien
acggttcactgcagacctaccaaga

SEQ ID NO: 222050 - DNA, 25 bp, Homo sapien
tccatcctcaggacggttcactgca

SEQ ID NO: 222051 - DNA, 25 bp, Homo sapien
tgccactgatgttggcgcctgcacc

SEQ ID NO: 222052 - DNA, 25 bp, Homo sapien
ccgagtgggactggaccacggccct

SEQ ID NO: 222053 - DNA, 25 bp, Homo sapien
tagaatggaatgagcgctcctccgc

SEQ ID NO: 222054 - DNA, 25 bp, Homo sapien
tgagccgctgtcaacagacagttta

SEQ ID NO: 222055 - DNA, 25 bp, Homo sapien
ggttccacagccgacaggtcgaaga

SEQ ID NO: 222056 - DNA, 25 bp, Homo sapien
agacgactgtccactcagggcaatg

SEQ ID NO: 222057 - DNA, 25 bp, Homo sapien
aggtaggaacaggaactcggctcgc

SEQ ID NO: 222058 - DNA, 25 bp, Homo sapien
cggtggccgaagttgctagtagcct

SEQ ID NO: 222059 - DNA, 25 bp, Homo sapien
atgagttccaaggaaggcgccctgc

SEQ ID NO: 222060 - DNA, 25 bp, Homo sapien
ccgaagtgggagacatgagccagaa

SEQ ID NO: 222061 - DNA, 25 bp, Homo sapien
ctgcaggaaggcattagtgtcaaga

SEQ ID NO: 222062 - DNA, 25 bp, Homo sapien
tcagcatcaagcagaaggactggtc

SEQ ID NO: 222063 - DNA, 25 bp, Homo sapien
ttcccagcagagaaacccaggcgcg

SEQ ID NO: 222064 - DNA, 25 bp, Homo sapien
ccacgcagcactgtctgaagggggc

SEQ ID NO: 222065 - DNA, 25 bp, Homo sapien
cactagctgcgcgtagctcggcatg

SEQ ID NO: 222066 - DNA, 25 bp, Homo sapien
gcggcccgagagaccttatcctggg

SEQ ID NO: 222067 - DNA, 25 bp, Homo sapien
ttatcctggggctccaacgtcctgg

SEQ ID NO: 222068 - DNA, 25 bp, Homo sapien
agccgcgctgcactagctgcgcgta

SEQ ID NO: 222069 - DNA, 25 bp, Homo sapien
actgacccgaaagaggcgcgcagtg

SEQ ID NO: 222070 - DNA, 25 bp, Homo sapien
cggccacactgacccgaaagaggcg

SEQ ID NO: 222071 - DNA, 25 bp, Homo sapien
caagccaatgggatccggggaaaca

SEQ ID NO: 222072 - DNA, 25 bp, Homo sapien
tttttagacgcagaacgcggctcgc

SEQ ID NO: 222073 - DNA, 25 bp, Homo sapien
gcgcctcgtttatgcactgctggta

SEQ ID NO: 222074 - DNA, 25 bp, Homo sapien
actgctggtagctgccgatgtagaa

SEQ ID NO: 222075 - DNA, 25 bp, Homo sapien
tcatcgtggctcgtggaacaatgtc

SEQ ID NO: 222076 - DNA, 25 bp, Homo sapien
tgtagtgtgtttctgcaagccaatg

SEQ ID NO: 222077 - DNA, 25 bp, Homo sapien
gaccacgcaggaggcagatccaata

SEQ ID NO: 222078 - DNA, 25 bp, Homo sapien
gaggcgccatttcgctgtcttctca

SEQ ID NO: 222079 - DNA, 25 bp, Homo sapien
acaggctgacgtccagcagctgcgc

SEQ ID NO: 222080 - DNA, 25 bp, Homo sapien
cagctggtgctccaactccgcattg

SEQ ID NO: 222081 - DNA, 25 bp, Homo sapien
agctcaaacaggctgacgtccagca

SEQ ID NO: 222082 - DNA, 25 bp, Homo sapien
acgcagctcactcagctcaaacagg

SEQ ID NO: 222083 - DNA, 25 bp, Homo sapien
ggaatcgttcatagaaaaccagccc

SEQ ID NO: 222084 - DNA, 25 bp, Homo sapien
ggccggaatcgttcatagaaaacca

SEQ ID NO: 222085 - DNA, 25 bp, Homo sapien
catcccaggccggaatcgttcatag

SEQ ID NO: 222086 - DNA, 25 bp, Homo sapien
gctggtgctccaactccgcattgcg

SEQ ID NO: 222087 - DNA, 25 bp, Homo sapien
cccacggagctgcagagacacgagg

SEQ ID NO: 222088 - DNA, 25 bp, Homo sapien
gaggcgcggtctccacagttgcccg

SEQ ID NO: 222089 - DNA, 25 bp, Homo sapien
gggcgcctgccagcttgttgttgct

SEQ ID NO: 222090 - DNA, 25 bp, Homo sapien
gtctccacagttgcccgggccaggt

SEQ ID NO: 222091 - DNA, 25 bp, Homo sapien
gccagcttgttgttgctgtcctgca

SEQ ID NO: 222092 - DNA, 25 bp, Homo sapien
tgctgtcctgcagtgcgaaaaactc

SEQ ID NO: 222093 - DNA, 25 bp, Homo sapien
gtgcgaaaaactcggcctcccactg

SEQ ID NO: 222094 - DNA, 25 bp, Homo sapien
tcccactgtacctcgcccacggagc

SEQ ID NO: 222095 - DNA, 25 bp, Homo sapien
ctgtctctgggtccagaacttcggg

SEQ ID NO: 222096 - DNA, 25 bp, Homo sapien
ctccgcgttgtcctagactcctaaa

SEQ ID NO: 222097 - DNA, 25 bp, Homo sapien
ggctctgaccctggaacttccgaga

SEQ ID NO: 222098 - DNA, 25 bp, Homo sapien
ccaatctggccggtggatgaggccc

SEQ ID NO: 222099 - DNA, 25 bp, Homo sapien
ccaactagtcatgcgcctcggatgc

SEQ ID NO: 222100 - DNA, 25 bp, Homo sapien
gcagcgtttggggaaagttactcac

SEQ ID NO: 222101 - DNA, 25 bp, Homo sapien
ctcctgctgcgacttgcagcgtttg

SEQ ID NO: 222102 - DNA, 25 bp, Homo sapien
tcagaccctgaatccagaacttcgg

SEQ ID NO: 222103 - DNA, 25 bp, Homo sapien
tgcccgtgcgggtctctgtccgcgt

SEQ ID NO: 222104 - DNA, 25 bp, Homo sapien
actcctgcctcgctgagtcacgaaa

SEQ ID NO: 222105 - DNA, 25 bp, Homo sapien
gcccgccagaactggatgcagcgcg

SEQ ID NO: 222106 - DNA, 25 bp, Homo sapien
gcgcagaacatgtgacccgcgggcc

SEQ ID NO: 222107 - DNA, 25 bp, Homo sapien
acccgaggcagggaccaaccaggcg

SEQ ID NO: 222108 - DNA, 25 bp, Homo sapien
tcacgaaaattacccgctggggcca

SEQ ID NO: 222109 - DNA, 25 bp, Homo sapien
ctgcctcgctgagtcacgaaaatta

SEQ ID NO: 222110 - DNA, 25 bp, Homo sapien
gagcgttgggccaagcgcgcctcct

SEQ ID NO: 222111 - DNA, 25 bp, Homo sapien
tcgtccttggttatcgtgagcgtcc

SEQ ID NO: 222112 - DNA, 25 bp, Homo sapien
ctccgagttcgggaggaatgaatga

SEQ ID NO: 222113 - DNA, 25 bp, Homo sapien
gaacgactgaaccaatgagcctttg

SEQ ID NO: 222114 - DNA, 25 bp, Homo sapien
tgcaaatgaaccaacggtctccgca

SEQ ID NO: 222115 - DNA, 25 bp, Homo sapien
gcaagcgcgctgtccgcttcttctg

SEQ ID NO: 222116 - DNA, 25 bp, Homo sapien
ggacgctctggaggcaaaacatttc

SEQ ID NO: 222117 - DNA, 25 bp, Homo sapien
aggtggcctcgttggctttaccttg

SEQ ID NO: 222118 - DNA, 25 bp, Homo sapien
aaagacgcctccgtcgcgcacgagg

SEQ ID NO: 222119 - DNA, 25 bp, Homo sapien
cagttctgcctgttttctgccaaga

SEQ ID NO: 222120 - DNA, 25 bp, Homo sapien
aggcacgggtcctgtcatggatccc

SEQ ID NO: 222121 - DNA, 25 bp, Homo sapien
gggctgcccatctgcttcatactcg

SEQ ID NO: 222122 - DNA, 25 bp, Homo sapien
caccggtagcgccagtttcttcgta

SEQ ID NO: 222123 - DNA, 25 bp, Homo sapien
ccagtcttcggctttgcggccaatc

SEQ ID NO: 222124 - DNA, 25 bp, Homo sapien
ggtcggactgcaccttgaacgctcc

SEQ ID NO: 222125 - DNA, 25 bp, Homo sapien
ctctacacgagagcctcaggggacc

SEQ ID NO: 222126 - DNA, 25 bp, Homo sapien
actgtcgcttccagcgctgactggc

SEQ ID NO: 222127 - DNA, 25 bp, Homo sapien
gtgcgcatgagtgcgaacacacgtg

SEQ ID NO: 222128 - DNA, 25 bp, Homo sapien
gtgtgtatgtgcacgcaggttgctc

SEQ ID NO: 222129 - DNA, 25 bp, Homo sapien
acgcaggttgctcctaggggtgcaa

SEQ ID NO: 222130 - DNA, 25 bp, Homo sapien
cccttcgagcgcatgatcttcggcg

SEQ ID NO: 222131 - DNA, 25 bp, Homo sapien
tcgagcgcatgatcttcggcgcctg

SEQ ID NO: 222132 - DNA, 25 bp, Homo sapien
gcagtcggcctcgtacccgctggat

SEQ ID NO: 222133 - DNA, 25 bp, Homo sapien
cctcgtacccgctggatgtggtgcg

SEQ ID NO: 222134 - DNA, 25 bp, Homo sapien
gcacgctgcgcaccatcgtgcggga

SEQ ID NO: 222135 - DNA, 25 bp, Homo sapien
tcacgggcttcgatgcggccagcct

SEQ ID NO: 222136 - DNA, 25 bp, Homo sapien
cataccctctgctggatttcacggg

SEQ ID NO: 222137 - DNA, 25 bp, Homo sapien
accagcaaccagaggcgcccagagt

SEQ ID NO: 222138 - DNA, 25 bp, Homo sapien
ggcgcccagagtcgaaggcagaatc

SEQ ID NO: 222139 - DNA, 25 bp, Homo sapien
tcgaaggcagaatcggacagcctgt

SEQ ID NO: 222140 - DNA, 25 bp, Homo sapien
cagaatcggacagcctgtgcggaga

SEQ ID NO: 222141 - DNA, 25 bp, Homo sapien
ggggcgtccataccctctgctggat

SEQ ID NO: 222142 - DNA, 25 bp, Homo sapien
tgctggatttcacgggcttcgatgc

SEQ ID NO: 222143 - DNA, 25 bp, Homo sapien
aggatgccctcacgcggccacttgt

SEQ ID NO: 222144 - DNA, 25 bp, Homo sapien
ggccgccgctgtcacagaactgtag

SEQ ID NO: 222145 - DNA, 25 bp, Homo sapien
cacagaactgtaggaagacgggcgc

SEQ ID NO: 222146 - DNA, 25 bp, Homo sapien
agccgacacccaagggcctacgtga

SEQ ID NO: 222147 - DNA, 25 bp, Homo sapien
ttgtgccgcacttccacacgcagga

SEQ ID NO: 222148 - DNA, 25 bp, Homo sapien
tgtcacgcacatgctccaggcagtt

SEQ ID NO: 222149 - DNA, 25 bp, Homo sapien
ccaggacgaagagcacaaacagggc

SEQ ID NO: 222150 - DNA, 25 bp, Homo sapien
cgcggctcgagttgtgccgcacttc

SEQ ID NO: 222151 - DNA, 25 bp, Homo sapien
ctccgggcactctgcggaaactcga

SEQ ID NO: 222152 - DNA, 25 bp, Homo sapien
tgtagttcagatacgctggttcgga

SEQ ID NO: 222153 - DNA, 25 bp, Homo sapien
tcagtgtgtcttgagccggcaaatc

SEQ ID NO: 222154 - DNA, 25 bp, Homo sapien
gcatcccgtccgaccaatcagtgtg

SEQ ID NO: 222155 - DNA, 25 bp, Homo sapien
tgcatgccggaaattgtagttcaga

SEQ ID NO: 222156 - DNA, 25 bp, Homo sapien
tgcggaaactcgaccaattagagcc

SEQ ID NO: 222157 - DNA, 25 bp, Homo sapien
tcgctcaccatgacgcgtgcgagaa

SEQ ID NO: 222158 - DNA, 25 bp, Homo sapien
gcccgactctggtctgacgagcatc

SEQ ID NO: 222159 - DNA, 25 bp, Homo sapien
agaggctctgccagggaccgggcga

SEQ ID NO: 222160 - DNA, 25 bp, Homo sapien
gcgctcagacttgatgctgactggg

SEQ ID NO: 222161 - DNA, 25 bp, Homo sapien
gagcaagggataggggaaggtctta

SEQ ID NO: 222162 - DNA, 25 bp, Homo sapien
ggtgatctcctaccggggccagccg

SEQ ID NO: 222163 - DNA, 25 bp, Homo sapien
tgccaccgggtgatctcctaccggg

SEQ ID NO: 222164 - DNA, 25 bp, Homo sapien
tggtgccaccgggtgatctcctacc

SEQ ID NO: 222165 - DNA, 25 bp, Homo sapien
ctcgccgtacctggcgagcgctctg

SEQ ID NO: 222166 - DNA, 25 bp, Homo sapien
gagaggcgctcagacttgatgctga

SEQ ID NO: 222167 - DNA, 25 bp, Homo sapien
gctggatcagactggccaggctttc

SEQ ID NO: 222168 - DNA, 25 bp, Homo sapien
ggaaagactgcaagacggggctctc

SEQ ID NO: 222169 - DNA, 25 bp, Homo sapien
cctcgcgctcgctagaatggaaaga

SEQ ID NO: 222170 - DNA, 25 bp, Homo sapien
aagcccttctcgcaggcaacgctga

SEQ ID NO: 222171 - DNA, 25 bp, Homo sapien
tcctgagtgaaatagactccgatcc

SEQ ID NO: 222172 - DNA, 25 bp, Homo sapien
tcggcccaacttgcctggattgatt

SEQ ID NO: 222173 - DNA, 25 bp, Homo sapien
tgggcgcccttgaccttactgccga

SEQ ID NO: 222174 - DNA, 25 bp, Homo sapien
gcgggacgggcttatttgcatacag

SEQ ID NO: 222175 - DNA, 25 bp, Homo sapien
cgctcctcagtctttgcggacaaga

SEQ ID NO: 222176 - DNA, 25 bp, Homo sapien
tgttccggtgtcagagggcccgccc

SEQ ID NO: 222177 - DNA, 25 bp, Homo sapien
gcacggctcctgttccggtgtcaga

SEQ ID NO: 222178 - DNA, 25 bp, Homo sapien
tgctgaaaccggacgccgcacggct

SEQ ID NO: 222179 - DNA, 25 bp, Homo sapien
ctaagccttccctgctgaaaccgga

SEQ ID NO: 222180 - DNA, 25 bp, Homo sapien
tgcatctccggctcctccatagcga

SEQ ID NO: 222181 - DNA, 25 bp, Homo sapien
gcaggcccgcaccacctttcttccc

SEQ ID NO: 222182 - DNA, 25 bp, Homo sapien
cagtctttgcggacaagaaaggggc

SEQ ID NO: 222183 - DNA, 25 bp, Homo sapien
cccattccctccgagtcggtgagga

SEQ ID NO: 222184 - DNA, 25 bp, Homo sapien
gaaattctcagagccctttaggccc

SEQ ID NO: 222185 - DNA, 25 bp, Homo sapien
cgtagtgaaattctcagagcccttt

SEQ ID NO: 222186 - DNA, 25 bp, Homo sapien
ggcgcaggcgtagtgaaattctcag

SEQ ID NO: 222187 - DNA, 25 bp, Homo sapien
ccaattggctccctctggaaaaatc

SEQ ID NO: 222188 - DNA, 25 bp, Homo sapien
acccgaagccggagccaattggctc

SEQ ID NO: 222189 - DNA, 25 bp, Homo sapien
catctacccgaagccggagccaatt

SEQ ID NO: 222190 - DNA, 25 bp, Homo sapien
gcaggcgcaactgccctcccaggac

SEQ ID NO: 222191 - DNA, 25 bp, Homo sapien
gcacatcctgcaaaattctagaccc

SEQ ID NO: 222192 - DNA, 25 bp, Homo sapien
tctactctggccgagccgaccaaag

SEQ ID NO: 222193 - DNA, 25 bp, Homo sapien
gagccgaccaaagcacatcctgcaa

SEQ ID NO: 222194 - DNA, 25 bp, Homo sapien
ggaggcggccgtgcgcacaacatcc

SEQ ID NO: 222195 - DNA, 25 bp, Homo sapien
agctggtgaactgcgcccaggtcca

SEQ ID NO: 222196 - DNA, 25 bp, Homo sapien
actgcgcccaggtccataggcgggc

SEQ ID NO: 222197 - DNA, 25 bp, Homo sapien
cgggcccacgcttgagtgttccaaa

SEQ ID NO: 222198 - DNA, 25 bp, Homo sapien
cttgagtgttccaaacgggagaaga

SEQ ID NO: 222199 - DNA, 25 bp, Homo sapien
atttaccttggttcccttgaagctg

SEQ ID NO: 222200 - DNA, 25 bp, Homo sapien
ggctttttgtgcgaggctgtttctc

SEQ ID NO: 222201 - DNA, 25 bp, Homo sapien
gcgaggctgtttctctgcgaatagc

SEQ ID NO: 222202 - DNA, 25 bp, Homo sapien
tgcgaatagctcttggagccaaatc

SEQ ID NO: 222203 - DNA, 25 bp, Homo sapien
ttggagccaaatcttgggacccgga

SEQ ID NO: 222204 - DNA, 25 bp, Homo sapien
cgtgttgtaattcaggcgccgaccg

SEQ ID NO: 222205 - DNA, 25 bp, Homo sapien
ggcccgggttcgatgattgaattta

SEQ ID NO: 222206 - DNA, 25 bp, Homo sapien
cttcatgctcgcttcttaaagggcc

SEQ ID NO: 222207 - DNA, 25 bp, Homo sapien
ggccgtgttgcgggagaagacttcg

SEQ ID NO: 222208 - DNA, 25 bp, Homo sapien
catgcgcagagagccctcgcggccc

SEQ ID NO: 222209 - DNA, 25 bp, Homo sapien
cctttataagcactgaggcggcgct

SEQ ID NO: 222210 - DNA, 25 bp, Homo sapien
tttataagcactgaggcggcgctgg

SEQ ID NO: 222211 - DNA, 25 bp, Homo sapien
agcgcagcgtcctttgtgcccggcg

SEQ ID NO: 222212 - DNA, 25 bp, Homo sapien
cccgggatgcgtccgagctaggagc

SEQ ID NO: 222213 - DNA, 25 bp, Homo sapien
gatgcgtccgagctaggagccaggt

SEQ ID NO: 222214 - DNA, 25 bp, Homo sapien
ccctttataagcactgaggcggcgc

SEQ ID NO: 222215 - DNA, 25 bp, Homo sapien
ggcgaaggccacgtccctgaaagcc

SEQ ID NO: 222216 - DNA, 25 bp, Homo sapien
ccagggctttcactttggcgaaggc

SEQ ID NO: 222217 - DNA, 25 bp, Homo sapien
tactgcttccgaggtgcgtgcgtcc

SEQ ID NO: 222218 - DNA, 25 bp, Homo sapien
ttcgacgcctactgcttccgaggtg

SEQ ID NO: 222219 - DNA, 25 bp, Homo sapien
ggcagcgtgcgctacccgatccaga

SEQ ID NO: 222220 - DNA, 25 bp, Homo sapien
tgcacctggcctggcatgagggcct

SEQ ID NO: 222221 - DNA, 25 bp, Homo sapien
caggcgaggtcttctacgtgggccc

SEQ ID NO: 222222 - DNA, 25 bp, Homo sapien
ctcccgcaggcgaggtcttctacgt

SEQ ID NO: 222223 - DNA, 25 bp, Homo sapien
aggggtctcctgtttctgatcgcta

SEQ ID NO: 222224 - DNA, 25 bp, Homo sapien
tcacggggtattgcactgagccgtc

SEQ ID NO: 222225 - DNA, 25 bp, Homo sapien
cagcggtctagcagctgcagcttcc

SEQ ID NO: 222226 - DNA, 25 bp, Homo sapien
gttcctcggcgttatggcgataccc

SEQ ID NO: 222227 - DNA, 25 bp, Homo sapien
gcctccgcgaaggtcagcttgtatc

SEQ ID NO: 222228 - DNA, 25 bp, Homo sapien
gaccctgcttcggtgggattcagga

SEQ ID NO: 222229 - DNA, 25 bp, Homo sapien
cggcttcaggaagaacacgcgccct

SEQ ID NO: 222230 - DNA, 25 bp, Homo sapien
gcgatacccgtagttgcgcaggccc

SEQ ID NO: 222231 - DNA, 25 bp, Homo sapien
tctgaggacaaccaagcagggttca

SEQ ID NO: 222232 - DNA, 25 bp, Homo sapien
ctgcttttcgcggagaagaccactt

SEQ ID NO: 222233 - DNA, 25 bp, Homo sapien
aggcgctgtctgtaccactaccgag

SEQ ID NO: 222234 - DNA, 25 bp, Homo sapien
cctcatagtggtagcggcagggcaa

SEQ ID NO: 222235 - DNA, 25 bp, Homo sapien
gggtccaccacctttgtccacttga

SEQ ID NO: 222236 - DNA, 25 bp, Homo sapien
cctagtgccacgaagacgtcggtga

SEQ ID NO: 222237 - DNA, 25 bp, Homo sapien
gcccgtagtcttgcagcgtgacgtt

SEQ ID NO: 222238 - DNA, 25 bp, Homo sapien
agaccacttttagcggccctgactc

SEQ ID NO: 222239 - DNA, 25 bp, Homo sapien
gggattttacgtgatcgaagacatc

SEQ ID NO: 222240 - DNA, 25 bp, Homo sapien
gcggtcaccttgagcagcacgaaga

SEQ ID NO: 222241 - DNA, 25 bp, Homo sapien
gccgcgaataggtgacagccatctt

SEQ ID NO: 222242 - DNA, 25 bp, Homo sapien
gccatcttgaagaacagcgcgtgga

SEQ ID NO: 222243 - DNA, 25 bp, Homo sapien
taacgacccgcaagtgtccgagggc

SEQ ID NO: 222244 - DNA, 25 bp, Homo sapien
cgctgctgacgctagcgagtcgcca

SEQ ID NO: 222245 - DNA, 25 bp, Homo sapien
atccaccgcggctatgaggccagta

SEQ ID NO: 222246 - DNA, 25 bp, Homo sapien
tctgggccacctcttttgcatattg

SEQ ID NO: 222247 - DNA, 25 bp, Homo sapien
agacgtggttgagcgcgtaggacac

SEQ ID NO: 222248 - DNA, 25 bp, Homo sapien
tcaccatcgacaccctcgtctccaa

SEQ ID NO: 222249 - DNA, 25 bp, Homo sapien
gacagcgccgcgatcttgccggcca

SEQ ID NO: 222250 - DNA, 25 bp, Homo sapien
acgcactgcgagagcgccgagacgt

SEQ ID NO: 222251 - DNA, 25 bp, Homo sapien
cgcacgcactgcgagagcgccgaga

SEQ ID NO: 222252 - DNA, 25 bp, Homo sapien
tcgcagaagccaggtccgcggaccg

SEQ ID NO: 222253 - DNA, 25 bp, Homo sapien
cgcagggctcgcagaagccaggtcc

SEQ ID NO: 222254 - DNA, 25 bp, Homo sapien
gccgtgaccgccctgcgtgttccca

SEQ ID NO: 222255 - DNA, 25 bp, Homo sapien
tcctcgtcaggggactggaagacac

SEQ ID NO: 222256 - DNA, 25 bp, Homo sapien
gtgggagtagctcttcacagggccc

SEQ ID NO: 222257 - DNA, 25 bp, Homo sapien
tagctcttcacagggcccggcaggc

SEQ ID NO: 222258 - DNA, 25 bp, Homo sapien
agcagggacctcttcccagcgctgg

SEQ ID NO: 222259 - DNA, 25 bp, Homo sapien
gcgtctggtatagaaggaaggatat

SEQ ID NO: 222260 - DNA, 25 bp, Homo sapien
tatagaaggaaggatatgcgcactc

SEQ ID NO: 222261 - DNA, 25 bp, Homo sapien
aggatatgcgcactcgggatctgca

SEQ ID NO: 222262 - DNA, 25 bp, Homo sapien
cactcgggatctgcagggcacctct

SEQ ID NO: 222263 - DNA, 25 bp, Homo sapien
gggctccttgcaagatctgggctga

SEQ ID NO: 222264 - DNA, 25 bp, Homo sapien
gctgttacctgcaacatcccggttg

SEQ ID NO: 222265 - DNA, 25 bp, Homo sapien
ccctgttatagtgtgcatcgcctga

SEQ ID NO: 222266 - DNA, 25 bp, Homo sapien
cgccctattactgcgtgaacgactg

SEQ ID NO: 222267 - DNA, 25 bp, Homo sapien
agcctcagcctatcagcgatgccta

SEQ ID NO: 222268 - DNA, 25 bp, Homo sapien
cgatgcctaagtcccagtcacgata

SEQ ID NO: 222269 - DNA, 25 bp, Homo sapien
agctgggctccgttctctatcacca

SEQ ID NO: 222270 - DNA, 25 bp, Homo sapien
ggcttcgctgagcacttccgcactt

SEQ ID NO: 222271 - DNA, 25 bp, Homo sapien
gctgtctgtcatgaagctggccaca

SEQ ID NO: 222272 - DNA, 25 bp, Homo sapien
ggagccggccacgaattgactcgtc

SEQ ID NO: 222273 - DNA, 25 bp, Homo sapien
actcactggtcgtcatgcgctgtct

SEQ ID NO: 222274 - DNA, 25 bp, Homo sapien
acctcattggcttgtggcgccttca

SEQ ID NO: 222275 - DNA, 25 bp, Homo sapien
cttcactcggagagacgcgcctcaa

SEQ ID NO: 222276 - DNA, 25 bp, Homo sapien
gacgccacaagacctgaccggactg

SEQ ID NO: 222277 - DNA, 25 bp, Homo sapien
ggcgccgagcaacttcggtgagtaa

SEQ ID NO: 222278 - DNA, 25 bp, Homo sapien
gatgcctgtcagtcattccgtcccg

SEQ ID NO: 222279 - DNA, 25 bp, Homo sapien
cctaggcctggaagccacgcgagat

SEQ ID NO: 222280 - DNA, 25 bp, Homo sapien
ttaccgcaggaagaacctaggcctg

SEQ ID NO: 222281 - DNA, 25 bp, Homo sapien
agcagcgagcgcaaataccatccta

SEQ ID NO: 222282 - DNA, 25 bp, Homo sapien
cccggacctaatgccgcagggagaa

SEQ ID NO: 222283 - DNA, 25 bp, Homo sapien
cgctccggcaaaacgcgcttgatga

SEQ ID NO: 222284 - DNA, 25 bp, Homo sapien
cccagccggaattcggagctaaggc

SEQ ID NO: 222285 - DNA, 25 bp, Homo sapien
cttagcaacccggaggagctcacta

SEQ ID NO: 222286 - DNA, 25 bp, Homo sapien
gatcacgttgcgttgcctagcgaca

SEQ ID NO: 222287 - DNA, 25 bp, Homo sapien
gagcgagcgagttctactccttgta

SEQ ID NO: 222288 - DNA, 25 bp, Homo sapien
cttgtattctgggagcgtcttcttg

SEQ ID NO: 222289 - DNA, 25 bp, Homo sapien
cctgcatgagcgtggaaaagtgaga

SEQ ID NO: 222290 - DNA, 25 bp, Homo sapien
gcgcgctgacctggtgcgcatgtcc

SEQ ID NO: 222291 - DNA, 25 bp, Homo sapien
gggcggcgtcgcctttaagagctcc

SEQ ID NO: 222292 - DNA, 25 bp, Homo sapien
aaccagcgcgcccaacgaggtgtcg

SEQ ID NO: 222293 - DNA, 25 bp, Homo sapien
gtgagttggccacgacccttcggcc

SEQ ID NO: 222294 - DNA, 25 bp, Homo sapien
tcttcttgcgctgccctggaaagtt

SEQ ID NO: 222295 - DNA, 25 bp, Homo sapien
cagcaggaacaggagattgagcagc

SEQ ID NO: 222296 - DNA, 25 bp, Homo sapien
cgggagccctacatgtgtgcacagt

SEQ ID NO: 222297 - DNA, 25 bp, Homo sapien
tgtgcacagtgcaagacggacttca

SEQ ID NO: 222298 - DNA, 25 bp, Homo sapien
gcggcgccatcatgtgtgagaactg

SEQ ID NO: 222299 - DNA, 25 bp, Homo sapien
gtgagaactgcatgacaaccaacca

SEQ ID NO: 222300 - DNA, 25 bp, Homo sapien
accaaccagaagaaggcgctcaagg

SEQ ID NO: 222301 - DNA, 25 bp, Homo sapien
aggccgcctttgtgaaggcgctgca

SEQ ID NO: 222302 - DNA, 25 bp, Homo sapien
tggagcacaccagccggctgaaggc

SEQ ID NO: 222303 - DNA, 25 bp, Homo sapien
ggctgtgctacaggtcagaaccgca

SEQ ID NO: 222304 - DNA, 25 bp, Homo sapien
cgtaagttggcgttccgctcaggag

SEQ ID NO: 222305 - DNA, 25 bp, Homo sapien
agtaacggggctgtgctacaggtca

SEQ ID NO: 222306 - DNA, 25 bp, Homo sapien
tgctacaggtcagaaccgcactggg

SEQ ID NO: 222307 - DNA, 25 bp, Homo sapien
tacaggtcagaaccgcactgggcgc

SEQ ID NO: 222308 - DNA, 25 bp, Homo sapien
cgtgaccacgtcagtcgccgactgt

SEQ ID NO: 222309 - DNA, 25 bp, Homo sapien
tgaccacgtcagtcgccgactgtca

SEQ ID NO: 222310 - DNA, 25 bp, Homo sapien
taagttggcgttccgctcaggagag

SEQ ID NO: 222311 - DNA, 25 bp, Homo sapien
gctcagcagcacgttttcgcacttg

SEQ ID NO: 222312 - DNA, 25 bp, Homo sapien
gcggccgcttccatcacgatgtaca

SEQ ID NO: 222313 - DNA, 25 bp, Homo sapien
agtttcccgttgcacacctcgatga

SEQ ID NO: 222314 - DNA, 25 bp, Homo sapien
atgtggccaccttcaccttggagta

SEQ ID NO: 222315 - DNA, 25 bp, Homo sapien
agtagctgccctctccaattgtgcg

SEQ ID NO: 222316 - DNA, 25 bp, Homo sapien
tgcggcccagcttataaccgagttc

SEQ ID NO: 222317 - DNA, 25 bp, Homo sapien
gtcagtttccgatgagaggccacta

SEQ ID NO: 222318 - DNA, 25 bp, Homo sapien
agcctccctgctttgtgactcataa

SEQ ID NO: 222319 - DNA, 25 bp, Homo sapien
tcacctcggccatgagcagcgcagc

SEQ ID NO: 222320 - DNA, 25 bp, Homo sapien
cgaaagggtgaagtccgtctgagtc

SEQ ID NO: 222321 - DNA, 25 bp, Homo sapien
gtccgtctgagtccaccgaccaatg

SEQ ID NO: 222322 - DNA, 25 bp, Homo sapien
tctgagtccaccgaccaatggtgac

SEQ ID NO: 222323 - DNA, 25 bp, Homo sapien
accgaccaatggtgacgcgcagcgc

SEQ ID NO: 222324 - DNA, 25 bp, Homo sapien
aatggtgacgcgcagcgccttcgcg

SEQ ID NO: 222325 - DNA, 25 bp, Homo sapien
tccctccacggatgcgcttaaaagg

SEQ ID NO: 222326 - DNA, 25 bp, Homo sapien
gcgcttcctgattggcgggcatgca

SEQ ID NO: 222327 - DNA, 25 bp, Homo sapien
gattcatcagcagcgctggtcgctc

SEQ ID NO: 222328 - DNA, 25 bp, Homo sapien
gggaatccgagaccctcctggcatc

SEQ ID NO: 222329 - DNA, 25 bp, Homo sapien
cctcctggcatcttgctggagacac

SEQ ID NO: 222330 - DNA, 25 bp, Homo sapien
cttgctggagacactaagctgcgtt

SEQ ID NO: 222331 - DNA, 25 bp, Homo sapien
actaagctgcgttgctggggaaact

SEQ ID NO: 222332 - DNA, 25 bp, Homo sapien
tgcgttgctggggaaactgcctccg

SEQ ID NO: 222333 - DNA, 25 bp, Homo sapien
catgaatgattcatcagcagcgctg

SEQ ID NO: 222334 - DNA, 25 bp, Homo sapien
tggccaagacgggcctgggaatccc

SEQ ID NO: 222335 - DNA, 25 bp, Homo sapien
cagagagcccgcaggagtgccacgt

SEQ ID NO: 222336 - DNA, 25 bp, Homo sapien
cctcagtttcccgtggcatcaaagg

SEQ ID NO: 222337 - DNA, 25 bp, Homo sapien
ctccaggccttataaggacatttgc

SEQ ID NO: 222338 - DNA, 25 bp, Homo sapien
cttataaggacatttgcgctccggg

SEQ ID NO: 222339 - DNA, 25 bp, Homo sapien
tgagctccacgcagttcaacaaggg

SEQ ID NO: 222340 - DNA, 25 bp, Homo sapien
tcgcacgctccgaccggtgcaggag

SEQ ID NO: 222341 - DNA, 25 bp, Homo sapien
gcggacgggcccttgttctccctga

SEQ ID NO: 222342 - DNA, 25 bp, Homo sapien
ccttgttctccctgacgcctggtgg

SEQ ID NO: 222343 - DNA, 25 bp, Homo sapien
gttccgtgtcccacgctttggagca

SEQ ID NO: 222344 - DNA, 25 bp, Homo sapien
agctcaaggctgcagacgctactcg

SEQ ID NO: 222345 - DNA, 25 bp, Homo sapien
cgcacggtgaaactgagggcatccc

SEQ ID NO: 222346 - DNA, 25 bp, Homo sapien
ttcaacccgcgcgtcgcacggtgaa

SEQ ID NO: 222347 - DNA, 25 bp, Homo sapien
gcccgccaggcctcgattcaacccg

SEQ ID NO: 222348 - DNA, 25 bp, Homo sapien
cagcgcatcttctgccaccagaggg

SEQ ID NO: 222349 - DNA, 25 bp, Homo sapien
cccacgctttggagcagtagaacca

SEQ ID NO: 222350 - DNA, 25 bp, Homo sapien
gcagtagaaccaacgcgcggccagc

SEQ ID NO: 222351 - DNA, 25 bp, Homo sapien
cctcaggcagcttgggatgcagctt

SEQ ID NO: 222352 - DNA, 25 bp, Homo sapien
cctaaagcgggtccgagcagcttga

SEQ ID NO: 222353 - DNA, 25 bp, Homo sapien
gcgagacaggacttccagccaccta

SEQ ID NO: 222354 - DNA, 25 bp, Homo sapien
tcccagactgtttggggtggcctaa

SEQ ID NO: 222355 - DNA, 25 bp, Homo sapien
cttcccgctggcctagaaaacttca

SEQ ID NO: 222356 - DNA, 25 bp, Homo sapien
tcacacggtccctgggtgatccaag

SEQ ID NO: 222357 - DNA, 25 bp, Homo sapien
gtgggcacactcgaagagggacttc

SEQ ID NO: 222358 - DNA, 25 bp, Homo sapien
cgcagggaccctcgccaataaacag

SEQ ID NO: 222359 - DNA, 25 bp, Homo sapien
ggctgccatccgcttctactacggg

SEQ ID NO: 222360 - DNA, 25 bp, Homo sapien
gcgacttcgagagcctggctgccat

SEQ ID NO: 222361 - DNA, 25 bp, Homo sapien
ggacgtcctggttcaacgtggacca

SEQ ID NO: 222362 - DNA, 25 bp, Homo sapien
gctgagacagcaagtaaggcctttg

SEQ ID NO: 222363 - DNA, 25 bp, Homo sapien
tgcacctgtttcaggccgctggctc

SEQ ID NO: 222364 - DNA, 25 bp, Homo sapien
tcaagatctaagtgagaggccggtc

SEQ ID NO: 222365 - DNA, 25 bp, Homo sapien
ttctggtgcctcaaccgcgagcaac

SEQ ID NO: 222366 - DNA, 25 bp, Homo sapien
gccggtcagacagaggcaagagctc

SEQ ID NO: 222367 - DNA, 25 bp, Homo sapien
cgaggttttgcttccggttgctagc

SEQ ID NO: 222368 - DNA, 25 bp, Homo sapien
gcctgctgctactcgagacttcatg

SEQ ID NO: 222369 - DNA, 25 bp, Homo sapien
tttgcaccggctgggaaatcatttc

SEQ ID NO: 222370 - DNA, 25 bp, Homo sapien
gcagggagatcctaaccgtgtcatc

SEQ ID NO: 222371 - DNA, 25 bp, Homo sapien
ttctgtcctgcgctacaacctgtgg

SEQ ID NO: 222372 - DNA, 25 bp, Homo sapien
aaagtcggcatgttctcgcaggctg

SEQ ID NO: 222373 - DNA, 25 bp, Homo sapien
gggagacgcctcacttcagttttca

SEQ ID NO: 222374 - DNA, 25 bp, Homo sapien
tcggcgccttctagatgactcaacc

SEQ ID NO: 222375 - DNA, 25 bp, Homo sapien
aggcgcagaagtgcgtgcggcctcg

SEQ ID NO: 222376 - DNA, 25 bp, Homo sapien
ggagggcggccacctgatctccgtc

SEQ ID NO: 222377 - DNA, 25 bp, Homo sapien
tgatctccgtccctgccttccgcag

SEQ ID NO: 222378 - DNA, 25 bp, Homo sapien
tccgtccctgccttccgcagaagcc

SEQ ID NO: 222379 - DNA, 25 bp, Homo sapien
ccgcagaagcctcgtggggcgcgtg

SEQ ID NO: 222380 - DNA, 25 bp, Homo sapien
agctgtgggccaggccgtcgcttgc

SEQ ID NO: 222381 - DNA, 25 bp, Homo sapien
gcgtcctctggaggcgcagaagtgc

SEQ ID NO: 222382 - DNA, 25 bp, Homo sapien
cgctggggatgcgtgtcccgggcgt

SEQ ID NO: 222383 - DNA, 25 bp, Homo sapien
aggtgcgcgcctacgccaacgacaa

SEQ ID NO: 222384 - DNA, 25 bp, Homo sapien
ccagctctacggacttcgggatgcc

SEQ ID NO: 222385 - DNA, 25 bp, Homo sapien
cgggcctgcttcctcaaggtgaaga

SEQ ID NO: 222386 - DNA, 25 bp, Homo sapien
gccacttccgcttcgccagggtgga

SEQ ID NO: 222387 - DNA, 25 bp, Homo sapien
atatggtccgctcccacaacgcagg

SEQ ID NO: 222388 - DNA, 25 bp, Homo sapien
tcacgctggtcaatctggagcccgc

SEQ ID NO: 222389 - DNA, 25 bp, Homo sapien
gcctgttcaatctggacgtgcctga

SEQ ID NO: 222390 - DNA, 25 bp, Homo sapien
gacgatcccgccttcaagcgtaacg

SEQ ID NO: 222391 - DNA, 25 bp, Homo sapien
gtgccgtcgagcctggagcactacc

SEQ ID NO: 222392 - DNA, 25 bp, Homo sapien
ccgtgtattgcaccgcctacagaca

SEQ ID NO: 222393 - DNA, 25 bp, Homo sapien
tcgagcctggagcactaccactggc

SEQ ID NO: 222394 - DNA, 25 bp, Homo sapien
atctgctgcaggacgtcgctcgtgt

SEQ ID NO: 222395 - DNA, 25 bp, Homo sapien
gtgatggccatgatctgctgcagga

SEQ ID NO: 222396 - DNA, 25 bp, Homo sapien
tggcctgtgcctcgtccaggctctg

SEQ ID NO: 222397 - DNA, 25 bp, Homo sapien
ataaggcctatccagcccgttccgt

SEQ ID NO: 222398 - DNA, 25 bp, Homo sapien
gctatcgccagccaacccgtgtatt

SEQ ID NO: 222399 - DNA, 25 bp, Homo sapien
cacaatgagcatgaccacgcggcca

SEQ ID NO: 222400 - DNA, 25 bp, Homo sapien
tgtgcagctgcacggccatcacact

SEQ ID NO: 222401 - DNA, 25 bp, Homo sapien
accgacgcagtgaggcttgtgtcca

SEQ ID NO: 222402 - DNA, 25 bp, Homo sapien
ccctcaagtgaaagtcgggctgtgc

SEQ ID NO: 222403 - DNA, 25 bp, Homo sapien
tcgccgccgcacgtagaagaaaatg

SEQ ID NO: 222404 - DNA, 25 bp, Homo sapien
cgggtgtacacagccaccatgagca

SEQ ID NO: 222405 - DNA, 25 bp, Homo sapien
gccagattgccgagcaggtagtaga

SEQ ID NO: 222406 - DNA, 25 bp, Homo sapien
tcgacagagcccagacggccaaata

SEQ ID NO: 222407 - DNA, 25 bp, Homo sapien
gtctccgggacaaagacagcggttg

SEQ ID NO: 222408 - DNA, 25 bp, Homo sapien
atgcgcccgcagtttcgagcctgcg

SEQ ID NO: 222409 - DNA, 25 bp, Homo sapien
ggctgagtcactcggcgacccgaaa

SEQ ID NO: 222410 - DNA, 25 bp, Homo sapien
ttcgtgtccaatcggccgccgagtt

SEQ ID NO: 222411 - DNA, 25 bp, Homo sapien
agttacaagccactccctgatccga

SEQ ID NO: 222412 - DNA, 25 bp, Homo sapien
tcggctttgccagctcgcagtatca

SEQ ID NO: 222413 - DNA, 25 bp, Homo sapien
gcgcacgctagggttttgcaatccc

SEQ ID NO: 222414 - DNA, 25 bp, Homo sapien
ccagctgatcatcgggcgcacgcta

SEQ ID NO: 222415 - DNA, 25 bp, Homo sapien
acgctcggccattctcgaaagcctg

SEQ ID NO: 222416 - DNA, 25 bp, Homo sapien
ggccattctcgaaagcctggcacag

SEQ ID NO: 222417 - DNA, 25 bp, Homo sapien
tcgagacgtcatgaggcgagttccc

SEQ ID NO: 222418 - DNA, 25 bp, Homo sapien
cttgaggacactcgagacgtcatga

SEQ ID NO: 222419 - DNA, 25 bp, Homo sapien
ctgaagaaatcgcttgaggacactc

SEQ ID NO: 222420 - DNA, 25 bp, Homo sapien
cctgagcaccaacctcctgaagaaa

SEQ ID NO: 222421 - DNA, 25 bp, Homo sapien
agtgtcctgagcaccaacctcctga

SEQ ID NO: 222422 - DNA, 25 bp, Homo sapien
cagccgctccacacggacccgggac

SEQ ID NO: 222423 - DNA, 25 bp, Homo sapien
ttgcacatactgcagctgggcgcgc

SEQ ID NO: 222424 - DNA, 25 bp, Homo sapien
gcccgaagagactcagcgtcacctg

SEQ ID NO: 222425 - DNA, 25 bp, Homo sapien
gtcatccaggggacaggacctcatg

SEQ ID NO: 222426 - DNA, 25 bp, Homo sapien
actggctgtcgagggaaatggccta

SEQ ID NO: 222427 - DNA, 25 bp, Homo sapien
aaatggcctagtcctggtgtctcca

SEQ ID NO: 222428 - DNA, 25 bp, Homo sapien
agcttgcgcacgtgcgacacgattc

SEQ ID NO: 222429 - DNA, 25 bp, Homo sapien
gcaggtcctcgctgcgttgcacata

SEQ ID NO: 222430 - DNA, 25 bp, Homo sapien
cgacacgattcgctgcttggcgatc

SEQ ID NO: 222431 - DNA, 25 bp, Homo sapien
gcaaccctcagtctgtccgtttgga

SEQ ID NO: 222432 - DNA, 25 bp, Homo sapien
cagctggttcagatttagccgggga

SEQ ID NO: 222433 - DNA, 25 bp, Homo sapien
gatccacagtgtctgcggccttgca

SEQ ID NO: 222434 - DNA, 25 bp, Homo sapien
cacggaggcagctcggatccacagt

SEQ ID NO: 222435 - DNA, 25 bp, Homo sapien
ccgtggctcagttgactcccggctg

SEQ ID NO: 222436 - DNA, 25 bp, Homo sapien
ccgctttaccggctgcttgaaacag

SEQ ID NO: 222437 - DNA, 25 bp, Homo sapien
tcacggaagggtcgcctcccaatta

SEQ ID NO: 222438 - DNA, 25 bp, Homo sapien
tcgcctcccaattagaaaccagctt

SEQ ID NO: 222439 - DNA, 25 bp, Homo sapien
gggacaagtgtgtgccctcaatgta

SEQ ID NO: 222440 - DNA, 25 bp, Homo sapien
tgggccataggttccctctcagatc

SEQ ID NO: 222441 - DNA, 25 bp, Homo sapien
tcctaagacttcatctgggccatag

SEQ ID NO: 222442 - DNA, 25 bp, Homo sapien
ccctgacctgggcatcctaagactt

SEQ ID NO: 222443 - DNA, 25 bp, Homo sapien
tacctgagccgcttgaaactgggtc

SEQ ID NO: 222444 - DNA, 25 bp, Homo sapien
tgatagtgcccttctctacctgagc

SEQ ID NO: 222445 - DNA, 25 bp, Homo sapien
cccgtagcccggaagccttgatagt

SEQ ID NO: 222446 - DNA, 25 bp, Homo sapien
gggtcctgaacccatccgggcacag

SEQ ID NO: 222447 - DNA, 25 bp, Homo sapien
cgatgtagcagaggtcggtggagcc

SEQ ID NO: 222448 - DNA, 25 bp, Homo sapien
tcatacgaggcaagcacggacattc

SEQ ID NO: 222449 - DNA, 25 bp, Homo sapien
gcttctcatacgaggcaagcacgga

SEQ ID NO: 222450 - DNA, 25 bp, Homo sapien
ggagcccagcttctcatacgaggca

SEQ ID NO: 222451 - DNA, 25 bp, Homo sapien
cttcacggccgcgatgtagcagagg

SEQ ID NO: 222452 - DNA, 25 bp, Homo sapien
ctcaccatggagtgcagagtttcgg

SEQ ID NO: 222453 - DNA, 25 bp, Homo sapien
agatctcggtgtggatgtggtggta

SEQ ID NO: 222454 - DNA, 25 bp, Homo sapien
gcccagcttctcatacgaggcaagc

SEQ ID NO: 222455 - DNA, 25 bp, Homo sapien
gcgttatcctcggtccagagctttc

SEQ ID NO: 222456 - DNA, 25 bp, Homo sapien
tgcctaccttgctccttcagactgg

SEQ ID NO: 222457 - DNA, 25 bp, Homo sapien
cttcgtccgagctgttcattttggc

SEQ ID NO: 222458 - DNA, 25 bp, Homo sapien
ttgcggctccactacccggaagttg

SEQ ID NO: 222459 - DNA, 25 bp, Homo sapien
tcagggacgcgagttcagagaaaac

SEQ ID NO: 222460 - DNA, 25 bp, Homo sapien
cgcagcgtgtgtgggaactccactt

SEQ ID NO: 222461 - DNA, 25 bp, Homo sapien
ggggtcgctcccaaagaaccacaga

SEQ ID NO: 222462 - DNA, 25 bp, Homo sapien
tcttccctagttttcccgcagtaga

SEQ ID NO: 222463 - DNA, 25 bp, Homo sapien
cgcaatgcgcgtgcacagaccaatg

SEQ ID NO: 222464 - DNA, 25 bp, Homo sapien
cgcagcttcggggatctgcacccaa

SEQ ID NO: 222465 - DNA, 25 bp, Homo sapien
accagctcgtcaccgttcgctatga

SEQ ID NO: 222466 - DNA, 25 bp, Homo sapien
gccatggcagcctggactaggaaga

SEQ ID NO: 222467 - DNA, 25 bp, Homo sapien
cagggactacttcgggtgccgccat

SEQ ID NO: 222468 - DNA, 25 bp, Homo sapien
tggaagacctaacggtgcctgcctc

SEQ ID NO: 222469 - DNA, 25 bp, Homo sapien
ccatgacaggctgtggccggaagaa

SEQ ID NO: 222470 - DNA, 25 bp, Homo sapien
gtcgggctcgcgtgtacacacttac

SEQ ID NO: 222471 - DNA, 25 bp, Homo sapien
ccatgccgggagctaaaatttctta

SEQ ID NO: 222472 - DNA, 25 bp, Homo sapien
ggagcagttcgcagcactagaggaa

SEQ ID NO: 222473 - DNA, 25 bp, Homo sapien
cctgtaccaggatcgggagcagttc

SEQ ID NO: 222474 - DNA, 25 bp, Homo sapien
tggccacaaggctacgggacctaca

SEQ ID NO: 222475 - DNA, 25 bp, Homo sapien
agatgtagtctcatggcaactccca

SEQ ID NO: 222476 - DNA, 25 bp, Homo sapien
tcactggaagaagcggcagaacggc

SEQ ID NO: 222477 - DNA, 25 bp, Homo sapien
atttcttaaccaatgccggccagcg

SEQ ID NO: 222478 - DNA, 25 bp, Homo sapien
atcagggactgtgcgcatcactgga

SEQ ID NO: 222479 - DNA, 25 bp, Homo sapien
aactgaatatcgagaggaggtcgcg

SEQ ID NO: 222480 - DNA, 25 bp, Homo sapien
gctccggaatgaacccttctgtata

SEQ ID NO: 222481 - DNA, 25 bp, Homo sapien
cccttctgtatatgatcaaatgatc

SEQ ID NO: 222482 - DNA, 25 bp, Homo sapien
tcaaatgatcttccaaaaggttgcc

SEQ ID NO: 222483 - DNA, 25 bp, Homo sapien
cttccaaaaggttgccatgagtaca

SEQ ID NO: 222484 - DNA, 25 bp, Homo sapien
ggttgccatgagtacaaaatagaga

SEQ ID NO: 222485 - DNA, 25 bp, Homo sapien
tcatctcttcaaaaaatgatgttga

SEQ ID NO: 222486 - DNA, 25 bp, Homo sapien
aacagaatagagagctccggaatga

SEQ ID NO: 222487 - DNA, 25 bp, Homo sapien
ctcggaacccaccaggcatgatgca

SEQ ID NO: 222488 - DNA, 25 bp, Homo sapien
accgtcctgtgccatcttccgagag

SEQ ID NO: 222489 - DNA, 25 bp, Homo sapien
acggactagatagctctcgcccgcg

SEQ ID NO: 222490 - DNA, 25 bp, Homo sapien
tcttagtggaccagcagacagtgtg

SEQ ID NO: 222491 - DNA, 25 bp, Homo sapien
gttatactccagacggacgggctca

SEQ ID NO: 222492 - DNA, 25 bp, Homo sapien
acacttggcgcgtagtgtggacccg

SEQ ID NO: 222493 - DNA, 25 bp, Homo sapien
ggcctccagcttgagatgtttaaga

SEQ ID NO: 222494 - DNA, 25 bp, Homo sapien
ccgtttgaggctctggccgatttct

SEQ ID NO: 222495 - DNA, 25 bp, Homo sapien
gtccttctcctactttctgggctca

SEQ ID NO: 222496 - DNA, 25 bp, Homo sapien
caacgagcgcctgcgtgggactcca

SEQ ID NO: 222497 - DNA, 25 bp, Homo sapien
ggccttctgcaacgagcgcctgcgt

SEQ ID NO: 222498 - DNA, 25 bp, Homo sapien
acaacgcggggccttctgcaacgag

SEQ ID NO: 222499 - DNA, 25 bp, Homo sapien
tgaccgggcgctcaccacgggtgtt

SEQ ID NO: 222500 - DNA, 25 bp, Homo sapien
agggccctctcactgtagctttaag

SEQ ID NO: 222501 - DNA, 25 bp, Homo sapien
tctgggctcactcggctccctgtga

SEQ ID NO: 222502 - DNA, 25 bp, Homo sapien
gctgcaaacggactgcgctccaggt

SEQ ID NO: 222503 - DNA, 25 bp, Homo sapien
tccagccacggtttagccgagaaca

SEQ ID NO: 222504 - DNA, 25 bp, Homo sapien
gcctcggctctaacccttggtcatg

SEQ ID NO: 222505 - DNA, 25 bp, Homo sapien
ctctaacccttggtcatggctcagc

SEQ ID NO: 222506 - DNA, 25 bp, Homo sapien
atggctcagcttggtgcgcagaaac

SEQ ID NO: 222507 - DNA, 25 bp, Homo sapien
ggtgcgcagaaacccgacgtcaatc

SEQ ID NO: 222508 - DNA, 25 bp, Homo sapien
acccgacgtcaatcagagcattttg

SEQ ID NO: 222509 - DNA, 25 bp, Homo sapien
atcagagcattttgcgcagctgggc

SEQ ID NO: 222510 - DNA, 25 bp, Homo sapien
agctgggcgagctttcctcggcatg

SEQ ID NO: 222511 - DNA, 25 bp, Homo sapien
cccgcttctgtggagcctaccagtt

SEQ ID NO: 222512 - DNA, 25 bp, Homo sapien
accagttggatttcgcagcgggcga

SEQ ID NO: 222513 - DNA, 25 bp, Homo sapien
cccagaggagcagagacgccccatg

SEQ ID NO: 222514 - DNA, 25 bp, Homo sapien
ctgtggagcctaccagttggatttc

SEQ ID NO: 222515 - DNA, 25 bp, Homo sapien
ccagagctgtactgcgcaaccgaca

SEQ ID NO: 222516 - DNA, 25 bp, Homo sapien
tggtgccagagctgtactgcgcaac

SEQ ID NO: 222517 - DNA, 25 bp, Homo sapien
tgacctattgcgtgtccccccagta

SEQ ID NO: 222518 - DNA, 25 bp, Homo sapien
gagcctaccagttggatttcgcagc

SEQ ID NO: 222519 - DNA, 25 bp, Homo sapien
aactggcgccctccggaagtgaagg

SEQ ID NO: 222520 - DNA, 25 bp, Homo sapien
gggtcacgactggaactggcgccct

SEQ ID NO: 222521 - DNA, 25 bp, Homo sapien
cagctgggtcacgactggaactggc

SEQ ID NO: 222522 - DNA, 25 bp, Homo sapien
tctgcgcactaagctgagccgcgac

SEQ ID NO: 222523 - DNA, 25 bp, Homo sapien
gatttctgcgcactaagctgagccg

SEQ ID NO: 222524 - DNA, 25 bp, Homo sapien
cctcggatttctgcgcactaagctg

SEQ ID NO: 222525 - DNA, 25 bp, Homo sapien
gttgacctcggatttctgcgcacta

SEQ ID NO: 222526 - DNA, 25 bp, Homo sapien
ctcggccagctgtgggaaatgctct

SEQ ID NO: 222527 - DNA, 25 bp, Homo sapien
tgagtacacggcagggtctcagcct

SEQ ID NO: 222528 - DNA, 25 bp, Homo sapien
gagtacacggcagggtctcagcctc

SEQ ID NO: 222529 - DNA, 25 bp, Homo sapien
gtctgtgagtacactgcagggtctc

SEQ ID NO: 222530 - DNA, 25 bp, Homo sapien
gtgagtacacggcagggtctcagcc

SEQ ID NO: 222531 - DNA, 25 bp, Homo sapien
gtacactgcagggtctcagcctcgg

SEQ ID NO: 222532 - DNA, 25 bp, Homo sapien
gtacacggcagggtctcagcctcgg

SEQ ID NO: 222533 - DNA, 25 bp, Homo sapien
gtacacatcagggtctcagcctcgg

SEQ ID NO: 222534 - DNA, 25 bp, Homo sapien
tcggccgtgtgtcctcgagtacaca

SEQ ID NO: 222535 - DNA, 25 bp, Homo sapien
gtgggacacattgtctggtgtagac

SEQ ID NO: 222536 - DNA, 25 bp, Homo sapien
acattgtctggtgtagaccgggagc

SEQ ID NO: 222537 - DNA, 25 bp, Homo sapien
acggtgtctggtgtagacggtaagc

SEQ ID NO: 222538 - DNA, 25 bp, Homo sapien
tgggacacggtgtctggtgtagacc

SEQ ID NO: 222539 - DNA, 25 bp, Homo sapien
tgggacacattgtctggtgtagacc

SEQ ID NO: 222540 - DNA, 25 bp, Homo sapien
acacggtgtctggtgtagaccggga

SEQ ID NO: 222541 - DNA, 25 bp, Homo sapien
acacggtgtctggtgtagacggtaa

SEQ ID NO: 222542 - DNA, 25 bp, Homo sapien
gacacattgtctggtgtagaccggg

SEQ ID NO: 222543 - DNA, 25 bp, Homo sapien
gctccactgccttgggtcacagctg

SEQ ID NO: 222544 - DNA, 25 bp, Homo sapien
ctgccgctaaaaccgtcaaagcagg

SEQ ID NO: 222545 - DNA, 25 bp, Homo sapien
taacttaccactttcctggtgaggc

SEQ ID NO: 222546 - DNA, 25 bp, Homo sapien
ccggcctccgtcgacggaagctgtg

SEQ ID NO: 222547 - DNA, 25 bp, Homo sapien
gtcaaagcaggcctaacttaccact

SEQ ID NO: 222548 - DNA, 25 bp, Homo sapien
agtccctatttctgcccgtgctggc

SEQ ID NO: 222549 - DNA, 25 bp, Homo sapien
tcacagctggcgtcttaagggccgg

SEQ ID NO: 222550 - DNA, 25 bp, Homo sapien
ccaggaaggtattttcagtccctat

SEQ ID NO: 222551 - DNA, 25 bp, Homo sapien
cttcgaggataaggacgagcagttg

SEQ ID NO: 222552 - DNA, 25 bp, Homo sapien
aggaggagcgcctgattaatctctc

SEQ ID NO: 222553 - DNA, 25 bp, Homo sapien
ttcttaacgtgtaagcaagttgccc

SEQ ID NO: 222554 - DNA, 25 bp, Homo sapien
cgatgtgacttcttttcttaacgtg

SEQ ID NO: 222555 - DNA, 25 bp, Homo sapien
ttagacctatcaactattcgatgtg

SEQ ID NO: 222556 - DNA, 25 bp, Homo sapien
tgcctgcactttgcccacaaagggc

SEQ ID NO: 222557 - DNA, 25 bp, Homo sapien
caccaaggttatgtgagtctcctgc

SEQ ID NO: 222558 - DNA, 25 bp, Homo sapien
ctgattaatctctctgagctgaccc

SEQ ID NO: 222559 - DNA, 25 bp, Homo sapien
ggactcggagccgtccctgccagtg

SEQ ID NO: 222560 - DNA, 25 bp, Homo sapien
ttcctgcgatctggggttgggattt

SEQ ID NO: 222561 - DNA, 25 bp, Homo sapien
gatttcggctcaggccgtgcgcggt

SEQ ID NO: 222562 - DNA, 25 bp, Homo sapien
agccgtccctgccagtggctttcgt

SEQ ID NO: 222563 - DNA, 25 bp, Homo sapien
gtccctgccagtggctttcgtgggc

SEQ ID NO: 222564 - DNA, 25 bp, Homo sapien
ttggagcccaggccaacgagccgcg

SEQ ID NO: 222565 - DNA, 25 bp, Homo sapien
cccaggccaacgagccgcgcgggac

SEQ ID NO: 222566 - DNA, 25 bp, Homo sapien
atctggggttgggatttcggctcag

SEQ ID NO: 222567 - DNA, 25 bp, Homo sapien
cagtagtgggcaagacgagactcca

SEQ ID NO: 222568 - DNA, 25 bp, Homo sapien
tcactggggatagtcctgaggtctt

SEQ ID NO: 222569 - DNA, 25 bp, Homo sapien
ctgaagtttgcagcccgcgtgagag

SEQ ID NO: 222570 - DNA, 25 bp, Homo sapien
acatctgtaacttcagcgacgctga

SEQ ID NO: 222571 - DNA, 25 bp, Homo sapien
tgccgagtcccgcacatctgtaact

SEQ ID NO: 222572 - DNA, 25 bp, Homo sapien
ctgtcctcgcctgttaacttacagc

SEQ ID NO: 222573 - DNA, 25 bp, Homo sapien
gcaggctaaacttcagtgctggagg

SEQ ID NO: 222574 - DNA, 25 bp, Homo sapien
tctccacagcaacgggcgtgtgcgg

SEQ ID NO: 222575 - DNA, 25 bp, Homo sapien
gaaagctgagcaggcaattgctgcc

SEQ ID NO: 222576 - DNA, 25 bp, Homo sapien
ggccaccgcgcaactgtgcgactga

SEQ ID NO: 222577 - DNA, 25 bp, Homo sapien
aactgtgcgactgaccagaggaggc

SEQ ID NO: 222578 - DNA, 25 bp, Homo sapien
cgtaaccagggcctactacagcgca

SEQ ID NO: 222579 - DNA, 25 bp, Homo sapien
ccagggcctactacagcgcagaata

SEQ ID NO: 222580 - DNA, 25 bp, Homo sapien
gccatcctccaagtccattggtcga

SEQ ID NO: 222581 - DNA, 25 bp, Homo sapien
tgaggcgtcacaaggaaagctgagc

SEQ ID NO: 222582 - DNA, 25 bp, Homo sapien
ccattggtcgatgagaaagatgaca

SEQ ID NO: 222583 - DNA, 25 bp, Homo sapien
gctgctcttggcctctcgcctcgcc

SEQ ID NO: 222584 - DNA, 25 bp, Homo sapien
tcaggcgcacgcccgtggccatgga

SEQ ID NO: 222585 - DNA, 25 bp, Homo sapien
cggtccagcgcattcagccaaggct

SEQ ID NO: 222586 - DNA, 25 bp, Homo sapien
tccagcgcattcagccaaggctacg

SEQ ID NO: 222587 - DNA, 25 bp, Homo sapien
ccacagccacgtctagccagagagg

SEQ ID NO: 222588 - DNA, 25 bp, Homo sapien
acagccacgtctagccagagagggg

SEQ ID NO: 222589 - DNA, 25 bp, Homo sapien
acatcctgaggggaccggctgctct

SEQ ID NO: 222590 - DNA, 25 bp, Homo sapien
gtgggtctgggacaccagtccaccc

SEQ ID NO: 222591 - DNA, 25 bp, Homo sapien
ctagattcgccaaagtcagaggctg

SEQ ID NO: 222592 - DNA, 25 bp, Homo sapien
ggctcggattcggagccagctctgc

SEQ ID NO: 222593 - DNA, 25 bp, Homo sapien
cccaggtcctggctagattcgccaa

SEQ ID NO: 222594 - DNA, 25 bp, Homo sapien
atgtgagggtgccagctaagcccag

SEQ ID NO: 222595 - DNA, 25 bp, Homo sapien
tcaatgtcacccgagatgaggagga

SEQ ID NO: 222596 - DNA, 25 bp, Homo sapien
cacccgagatgaggaggatcttcta

SEQ ID NO: 222597 - DNA, 25 bp, Homo sapien
cttgcaaagacgctctggtccccga

SEQ ID NO: 222598 - DNA, 25 bp, Homo sapien
cggattcggagccagctctgccgtg

SEQ ID NO: 222599 - DNA, 25 bp, Homo sapien
ttcctggacgagtcctctcggcctg

SEQ ID NO: 222600 - DNA, 25 bp, Homo sapien
agcatttcctggacgagtcctctcg

SEQ ID NO: 222601 - DNA, 25 bp, Homo sapien
aaccagagcatttcctggacgagtc

SEQ ID NO: 222602 - DNA, 25 bp, Homo sapien
agttgcaaccctgcgtcgaggccca

SEQ ID NO: 222603 - DNA, 25 bp, Homo sapien
ccttagttgcaaccctgcgtcgagg

SEQ ID NO: 222604 - DNA, 25 bp, Homo sapien
aggaacgccttagttgcaaccctgc

SEQ ID NO: 222605 - DNA, 25 bp, Homo sapien
ctgcgcctctgaccggcgctggttc

SEQ ID NO: 222606 - DNA, 25 bp, Homo sapien
gcccaggaacgccttagttgcaacc

SEQ ID NO: 222607 - DNA, 25 bp, Homo sapien
cacggcagggatggcttcgaatccg

SEQ ID NO: 222608 - DNA, 25 bp, Homo sapien
gccgccgcacggagcctgaacccaa

SEQ ID NO: 222609 - DNA, 25 bp, Homo sapien
gcagggatggcttcgaatccgagcc

SEQ ID NO: 222610 - DNA, 25 bp, Homo sapien
cccacggcagggatggcttcgaatc

SEQ ID NO: 222611 - DNA, 25 bp, Homo sapien
cccacgacggccaccggcagggaca

SEQ ID NO: 222612 - DNA, 25 bp, Homo sapien
gaccggacgcgtggtctggggcctg

SEQ ID NO: 222613 - DNA, 25 bp, Homo sapien
cgaatctggaccggacgcgtggtct

SEQ ID NO: 222614 - DNA, 25 bp, Homo sapien
cagggatggcttcgaatccgagccc

SEQ ID NO: 222615 - DNA, 25 bp, Homo sapien
ttgaccagatgtcggcctcgaaccg

SEQ ID NO: 222616 - DNA, 25 bp, Homo sapien
ctgcctctctggttaccgcctcctt

SEQ ID NO: 222617 - DNA, 25 bp, Homo sapien
aatgaaggtcagtggactcagactc

SEQ ID NO: 222618 - DNA, 25 bp, Homo sapien
tcagtggactcagactcaggccgca

SEQ ID NO: 222619 - DNA, 25 bp, Homo sapien
ggactcagactcaggccgcaagcgt

SEQ ID NO: 222620 - DNA, 25 bp, Homo sapien
actcaggccgcaagcgtcacacttg

SEQ ID NO: 222621 - DNA, 25 bp, Homo sapien
ccacgttgaccagatgtcggcctcg

SEQ ID NO: 222622 - DNA, 25 bp, Homo sapien
aagcgtcacacttggcctcttcccg

SEQ ID NO: 222623 - DNA, 25 bp, Homo sapien
ctgcccaggggccttcattaaccga

SEQ ID NO: 222624 - DNA, 25 bp, Homo sapien
accggctggcttctcagtcgggcca

SEQ ID NO: 222625 - DNA, 25 bp, Homo sapien
gtctggagcgccacacttggctgta

SEQ ID NO: 222626 - DNA, 25 bp, Homo sapien
cggaacagtctcaggtctggagcgc

SEQ ID NO: 222627 - DNA, 25 bp, Homo sapien
taaggctccagctgggcggaacagt

SEQ ID NO: 222628 - DNA, 25 bp, Homo sapien
cggacgaggtgcatcctgttccacc

SEQ ID NO: 222629 - DNA, 25 bp, Homo sapien
tcattaaccgaaggggacgtgccac

SEQ ID NO: 222630 - DNA, 25 bp, Homo sapien
ccttccctgtagcaggggcggacga

SEQ ID NO: 222631 - DNA, 25 bp, Homo sapien
agactactgctagaggaggcccgac

SEQ ID NO: 222632 - DNA, 25 bp, Homo sapien
gggagtgtctttcctatcaatcaca

SEQ ID NO: 222633 - DNA, 25 bp, Homo sapien
acaagacgctatctggactccgaga

SEQ ID NO: 222634 - DNA, 25 bp, Homo sapien
aatccagacgtttcctgcgtgcagg

SEQ ID NO: 222635 - DNA, 25 bp, Homo sapien
tcgttttccaaaccgagcaattgtg

SEQ ID NO: 222636 - DNA, 25 bp, Homo sapien
gcaattgtgcccgaagctacgcgcc

SEQ ID NO: 222637 - DNA, 25 bp, Homo sapien
agccgctttgctctttcctggagga

SEQ ID NO: 222638 - DNA, 25 bp, Homo sapien
tctgaatttcctttgattagcggcg

SEQ ID NO: 222639 - DNA, 25 bp, Homo sapien
cggggacagagggaactcctgcaat

SEQ ID NO: 222640 - DNA, 25 bp, Homo sapien
tcctgcaattcggagctgcggtatt

SEQ ID NO: 222641 - DNA, 25 bp, Homo sapien
ctgcggtattgcagccggttataca

SEQ ID NO: 222642 - DNA, 25 bp, Homo sapien
caccctacggtgatgcagcaagagc

SEQ ID NO: 222643 - DNA, 25 bp, Homo sapien
gcgaggcccttctgtgatcccgtct

SEQ ID NO: 222644 - DNA, 25 bp, Homo sapien
aggtcgcccaatagcagcgtgcaga

SEQ ID NO: 222645 - DNA, 25 bp, Homo sapien
agctcagcgcacttggcttaagggg

SEQ ID NO: 222646 - DNA, 25 bp, Homo sapien
gaagaaggcccgagactcgagaatg

SEQ ID NO: 222647 - DNA, 25 bp, Homo sapien
tctggcatctaagtcgccaaccttc

SEQ ID NO: 222648 - DNA, 25 bp, Homo sapien
gctcgcggcctgaagctgtttttct

SEQ ID NO: 222649 - DNA, 25 bp, Homo sapien
ccatctgctgatcgatgtgggcggt

SEQ ID NO: 222650 - DNA, 25 bp, Homo sapien
aggagcaagggctcaagcgcaggga

SEQ ID NO: 222651 - DNA, 25 bp, Homo sapien
aggcccagcggatccaccctacagg

SEQ ID NO: 222652 - DNA, 25 bp, Homo sapien
ccggactgagaagccagcaggtaga

SEQ ID NO: 222653 - DNA, 25 bp, Homo sapien
caggtagaggcccagcggatccacc

SEQ ID NO: 222654 - DNA, 25 bp, Homo sapien
accctacaggccaagggtggcgctc

SEQ ID NO: 222655 - DNA, 25 bp, Homo sapien
cagagctctggtcccattgagacag

SEQ ID NO: 222656 - DNA, 25 bp, Homo sapien
caagacagatcgagatggcaagggc

SEQ ID NO: 222657 - DNA, 25 bp, Homo sapien
agcgcgaacgtcaacaagacagatc

SEQ ID NO: 222658 - DNA, 25 bp, Homo sapien
ggagcccgacaaccagcgcgaacgt

SEQ ID NO: 222659 - DNA, 25 bp, Homo sapien
aggtggcctcagtggagcccgacaa

SEQ ID NO: 222660 - DNA, 25 bp, Homo sapien
gctccggaggacaagagaacttaga

SEQ ID NO: 222661 - DNA, 25 bp, Homo sapien
ttcagctgaaggctgcgggccttcc

SEQ ID NO: 222662 - DNA, 25 bp, Homo sapien
ggtcccattgagacagttcagctga

SEQ ID NO: 222663 - DNA, 25 bp, Homo sapien
tcactcccttggactcttcacggtg

SEQ ID NO: 222664 - DNA, 25 bp, Homo sapien
ctcccttggactcttcacggtgtct

SEQ ID NO: 222665 - DNA, 25 bp, Homo sapien
tcctgagcgtccctcacatggaagc

SEQ ID NO: 222666 - DNA, 25 bp, Homo sapien
tgagcgtccctcacatggaagccga

SEQ ID NO: 222667 - DNA, 25 bp, Homo sapien
tccgcaggcagggaggtctcgccca

SEQ ID NO: 222668 - DNA, 25 bp, Homo sapien
gtctcgcccaggaaatgctctgttg

SEQ ID NO: 222669 - DNA, 25 bp, Homo sapien
tcgcccaggaaatgctctgttggcc

SEQ ID NO: 222670 - DNA, 25 bp, Homo sapien
cccgctgctgcggttcgtgctgtgc

SEQ ID NO: 222671 - DNA, 25 bp, Homo sapien
atttgcagctagttccggggcttcc

SEQ ID NO: 222672 - DNA, 25 bp, Homo sapien
tgtggattgcaccttccttgtttta

SEQ ID NO: 222673 - DNA, 25 bp, Homo sapien
gagcttctcccgctcgaacaatttg

SEQ ID NO: 222674 - DNA, 25 bp, Homo sapien
ccggcccgcatcctagtgttgcttt

SEQ ID NO: 222675 - DNA, 25 bp, Homo sapien
ctgcgaccctagtgtttgctaagga

SEQ ID NO: 222676 - DNA, 25 bp, Homo sapien
gatgtgacccattccctggccaagg

SEQ ID NO: 222677 - DNA, 25 bp, Homo sapien
ccgttggctaagtgcgtgttttaca

SEQ ID NO: 222678 - DNA, 25 bp, Homo sapien
gtgccgtcgttagtccaggaagaag

SEQ ID NO: 222679 - DNA, 25 bp, Homo sapien
caggtagtgggatcggccgccgcgt

SEQ ID NO: 222680 - DNA, 25 bp, Homo sapien
gctgacgagggtcgccaggtgccca

SEQ ID NO: 222681 - DNA, 25 bp, Homo sapien
aacgcgccgcttcccatggagggcg

SEQ ID NO: 222682 - DNA, 25 bp, Homo sapien
aaacgcgccgcttcccatggagggc

SEQ ID NO: 222683 - DNA, 25 bp, Homo sapien
ggggtgacatcctcgatgtgccctc

SEQ ID NO: 222684 - DNA, 25 bp, Homo sapien
cccgccaggtagtgggatcggccgc

SEQ ID NO: 222685 - DNA, 25 bp, Homo sapien
catggagggcgtcggcgacaggaag

SEQ ID NO: 222686 - DNA, 25 bp, Homo sapien
gcgccgcttcccatggagggcgtcg

SEQ ID NO: 222687 - DNA, 25 bp, Homo sapien
gggactacaatcttcgcatgaaatg

SEQ ID NO: 222688 - DNA, 25 bp, Homo sapien
tagcatcttagctgcttccggccgc

SEQ ID NO: 222689 - DNA, 25 bp, Homo sapien
gcatgctgggagcagtagcatctta

SEQ ID NO: 222690 - DNA, 25 bp, Homo sapien
taggcggttccagccgttagtcaca

SEQ ID NO: 222691 - DNA, 25 bp, Homo sapien
cttgttagttgtacgcctgcaggac

SEQ ID NO: 222692 - DNA, 25 bp, Homo sapien
atctgcacccagcttgttagttgta

SEQ ID NO: 222693 - DNA, 25 bp, Homo sapien
cggccaagctatcttctcgctagca

SEQ ID NO: 222694 - DNA, 25 bp, Homo sapien
tgaggcccgtgaacagccaagctcc

SEQ ID NO: 222695 - DNA, 25 bp, Homo sapien
ccgcatctggttgctgaggaacgcc

SEQ ID NO: 222696 - DNA, 25 bp, Homo sapien
tgaggaacgcctgacgccgccttgt

SEQ ID NO: 222697 - DNA, 25 bp, Homo sapien
cctgacgccgccttgtggatgaagc

SEQ ID NO: 222698 - DNA, 25 bp, Homo sapien
ccttgtggatgaagccgcagagcag

SEQ ID NO: 222699 - DNA, 25 bp, Homo sapien
gccttgctgttcaccagtccctggg

SEQ ID NO: 222700 - DNA, 25 bp, Homo sapien
cccatgcccggtatccggtggatgc

SEQ ID NO: 222701 - DNA, 25 bp, Homo sapien
atgcgagtgctagtccagctgcagc

SEQ ID NO: 222702 - DNA, 25 bp, Homo sapien
ccttggctgcgactgtgtgcctgca

SEQ ID NO: 222703 - DNA, 25 bp, Homo sapien
gctgtgcccgcacagtgaggcccta

SEQ ID NO: 222704 - DNA, 25 bp, Homo sapien
ggtcgcaggtcccagtactcatgcc

SEQ ID NO: 222705 - DNA, 25 bp, Homo sapien
caactggtgccaggttcggtttcct

SEQ ID NO: 222706 - DNA, 25 bp, Homo sapien
cacccagagcgcgaggtcgcaggtc

SEQ ID NO: 222707 - DNA, 25 bp, Homo sapien
gcctggtgggtgcttcctcacctgc

SEQ ID NO: 222708 - DNA, 25 bp, Homo sapien
ccgtccctaccgtgcctggtgggtg

SEQ ID NO: 222709 - DNA, 25 bp, Homo sapien
gggcgctcacaactggtgccaggtt

SEQ ID NO: 222710 - DNA, 25 bp, Homo sapien
gtactcatgccggaggccctgacgt

SEQ ID NO: 222711 - DNA, 25 bp, Homo sapien
cagggttccagctgcctttatcttc

SEQ ID NO: 222712 - DNA, 25 bp, Homo sapien
gaccgctgctctcgctcaagttctg

SEQ ID NO: 222713 - DNA, 25 bp, Homo sapien
aggcacttcaaattcccgcggacgg

SEQ ID NO: 222714 - DNA, 25 bp, Homo sapien
caggcctcactagggagcggctcct

SEQ ID NO: 222715 - DNA, 25 bp, Homo sapien
gcccaactctctgcagtctcgggga

SEQ ID NO: 222716 - DNA, 25 bp, Homo sapien
gcagttccttgaagcccacccaggt

SEQ ID NO: 222717 - DNA, 25 bp, Homo sapien
tctccgcggagatggagctggaaaa

SEQ ID NO: 222718 - DNA, 25 bp, Homo sapien
ttatcttcgggagagcgaatggctc

SEQ ID NO: 222719 - DNA, 25 bp, Homo sapien
tcgggcggagagttcttgcaaattc

SEQ ID NO: 222720 - DNA, 25 bp, Homo sapien
ccagctagcgaaccagccattgtta

SEQ ID NO: 222721 - DNA, 25 bp, Homo sapien
aatgcccacggcaggaactcgaagg

SEQ ID NO: 222722 - DNA, 25 bp, Homo sapien
gagtccttgccctggtccttcttct

SEQ ID NO: 222723 - DNA, 25 bp, Homo sapien
gggtttcactggcttccgcgctacc

SEQ ID NO: 222724 - DNA, 25 bp, Homo sapien
tccttcttctgcttggtgcgccggt

SEQ ID NO: 222725 - DNA, 25 bp, Homo sapien
ccagcgtcaaaggaagcgagctccc

SEQ ID NO: 222726 - DNA, 25 bp, Homo sapien
ggcgccgcttacacagaacaaagta

SEQ ID NO: 222727 - DNA, 25 bp, Homo sapien
agagctccgaggctgcctccgggca

SEQ ID NO: 222728 - DNA, 25 bp, Homo sapien
cccagtactggtgggcgccgaacag

SEQ ID NO: 222729 - DNA, 25 bp, Homo sapien
agagacccttgctccgagagcccgg

SEQ ID NO: 222730 - DNA, 25 bp, Homo sapien
gggcagtcacgtccaacgtacctga

SEQ ID NO: 222731 - DNA, 25 bp, Homo sapien
cagatggggcgcttccggaaccctc

SEQ ID NO: 222732 - DNA, 25 bp, Homo sapien
agcagcctcttctctggcacgcaga

SEQ ID NO: 222733 - DNA, 25 bp, Homo sapien
ctcggcctagatgcggctgctgaga

SEQ ID NO: 222734 - DNA, 25 bp, Homo sapien
ctgcggctggtcagttcaccaggtg

SEQ ID NO: 222735 - DNA, 25 bp, Homo sapien
ctgcactgatgcctgagagccaaag

SEQ ID NO: 222736 - DNA, 25 bp, Homo sapien
ggaggcaaatcttcccgccttgaga

SEQ ID NO: 222737 - DNA, 25 bp, Homo sapien
cccgttgcctctcacagctgggaga

SEQ ID NO: 222738 - DNA, 25 bp, Homo sapien
ccgcactgctggttctggtgctcaa

SEQ ID NO: 222739 - DNA, 25 bp, Homo sapien
gcctggatctactccgtgacactga

SEQ ID NO: 222740 - DNA, 25 bp, Homo sapien
ccaggctgcgaactttgcaccttta

SEQ ID NO: 222741 - DNA, 25 bp, Homo sapien
tctgttgggaaccttcctgcggtcc

SEQ ID NO: 222742 - DNA, 25 bp, Homo sapien
tgagatcccgggacacgaaccagtc

SEQ ID NO: 222743 - DNA, 25 bp, Homo sapien
tttcagcccggaactgaccaggatg

SEQ ID NO: 222744 - DNA, 25 bp, Homo sapien
cgtttcagcccggaactgaccagga

SEQ ID NO: 222745 - DNA, 25 bp, Homo sapien
cgtttcagccctgaactgaccagga

SEQ ID NO: 222746 - DNA, 25 bp, Homo sapien
cagccctgaactgaccaggatgacc

SEQ ID NO: 222747 - DNA, 25 bp, Homo sapien
ttcagccctgaactgacgaggatgc

SEQ ID NO: 222748 - DNA, 25 bp, Homo sapien
tttcagccctgaactgaccaggatg

SEQ ID NO: 222749 - DNA, 25 bp, Homo sapien
agccctgaactgaccaggatgaccc

SEQ ID NO: 222750 - DNA, 25 bp, Homo sapien
tttcagccctgaactgacgaggatg

SEQ ID NO: 222751 - DNA, 25 bp, Homo sapien
gccggtcacagggacgaccttccaa

SEQ ID NO: 222752 - DNA, 25 bp, Homo sapien
ccgccggaaaggaaattctgcagtc

SEQ ID NO: 222753 - DNA, 25 bp, Homo sapien
taccgacaacatggcgacagccgct

SEQ ID NO: 222754 - DNA, 25 bp, Homo sapien
cctgagcgggatgctaccgacaaca

SEQ ID NO: 222755 - DNA, 25 bp, Homo sapien
aagggccgcttcaggtccaacacag

SEQ ID NO: 222756 - DNA, 25 bp, Homo sapien
ggctcaccattgaggcccacggagg

SEQ ID NO: 222757 - DNA, 25 bp, Homo sapien
ctacagagctcgtgaactcggccga

SEQ ID NO: 222758 - DNA, 25 bp, Homo sapien
ggtcccggtgccacctcgtcagtgt

SEQ ID NO: 222759 - DNA, 25 bp, Homo sapien
gggcaatgacatctcacaccggctt

SEQ ID NO: 222760 - DNA, 25 bp, Homo sapien
tgcccttctgaagcgccagctacgg

SEQ ID NO: 222761 - DNA, 25 bp, Homo sapien
ccagctacgggaagacaagcagtgt

SEQ ID NO: 222762 - DNA, 25 bp, Homo sapien
tccacgcagagttggaagccctatg

SEQ ID NO: 222763 - DNA, 25 bp, Homo sapien
aagccctatgccactgggtagacgc

SEQ ID NO: 222764 - DNA, 25 bp, Homo sapien
tgctctcttgcagaccgtacgcgtc

SEQ ID NO: 222765 - DNA, 25 bp, Homo sapien
tgcatactccttcctagttaggtcg

SEQ ID NO: 222766 - DNA, 25 bp, Homo sapien
ccggatcgtgatggtgggcaaacca

SEQ ID NO: 222767 - DNA, 25 bp, Homo sapien
cggggctgtactccaaccagaaaga

SEQ ID NO: 222768 - DNA, 25 bp, Homo sapien
cggcatctcgctttgcaccgggcaa

SEQ ID NO: 222769 - DNA, 25 bp, Homo sapien
cccgcatttgccttcggggaccaga

SEQ ID NO: 222770 - DNA, 25 bp, Homo sapien
tacgcgctgcgtccgaaccacatgt

SEQ ID NO: 222771 - DNA, 25 bp, Homo sapien
ccctatgactatgactacgcgctgc

SEQ ID NO: 222772 - DNA, 25 bp, Homo sapien
taggagagacccaaggcgagcctta

SEQ ID NO: 222773 - DNA, 25 bp, Homo sapien
cgaaacgcactagctggggactccc

SEQ ID NO: 222774 - DNA, 25 bp, Homo sapien
cagctggttgcccaaactggggtaa

SEQ ID NO: 222775 - DNA, 25 bp, Homo sapien
tccagttcttcacggctcccagtga

SEQ ID NO: 222776 - DNA, 25 bp, Homo sapien
acactctagtgtgctcgcgtgcaca

SEQ ID NO: 222777 - DNA, 25 bp, Homo sapien
ttctctgtggccgaaaacaggccca

SEQ ID NO: 222778 - DNA, 25 bp, Homo sapien
ccagaggccaccagaaaaccgagta

SEQ ID NO: 222779 - DNA, 25 bp, Homo sapien
gcatcttcaaagtcagcagtggtta

SEQ ID NO: 222780 - DNA, 25 bp, Homo sapien
ttcagtggtggtacctcaaggagcc

SEQ ID NO: 222781 - DNA, 25 bp, Homo sapien
cgacatcgaaatgccctgcgcgttc

SEQ ID NO: 222782 - DNA, 25 bp, Homo sapien
ggagccacctcgtattcgctggaga

SEQ ID NO: 222783 - DNA, 25 bp, Homo sapien
agcggtccgagaatgaagagtaagc

SEQ ID NO: 222784 - DNA, 25 bp, Homo sapien
tacgacgttctcagtagccgaatcc

SEQ ID NO: 222785 - DNA, 25 bp, Homo sapien
agccgaatccctttccaggcgcatg

SEQ ID NO: 222786 - DNA, 25 bp, Homo sapien
gcgagcgccggtgatgtcacgcata

SEQ ID NO: 222787 - DNA, 25 bp, Homo sapien
ggtgatgtcacgcatagcgccatct

SEQ ID NO: 222788 - DNA, 25 bp, Homo sapien
atagcgccatctccgagctccgaga

SEQ ID NO: 222789 - DNA, 25 bp, Homo sapien
cagtgcgtcatcagagagcgccgga

SEQ ID NO: 222790 - DNA, 25 bp, Homo sapien
ctccgagagtctgcgacagcagctg

SEQ ID NO: 222791 - DNA, 25 bp, Homo sapien
ccgcgaggaccagctgcagcgcaag

SEQ ID NO: 222792 - DNA, 25 bp, Homo sapien
caaggcggtggtcctggagtacttc

SEQ ID NO: 222793 - DNA, 25 bp, Homo sapien
tgaagcgcagcacgccccgcatgag

SEQ ID NO: 222794 - DNA, 25 bp, Homo sapien
ttcgtgagggccttcctgaagcgca

SEQ ID NO: 222795 - DNA, 25 bp, Homo sapien
ccgaggccttcgtgagggccttcct

SEQ ID NO: 222796 - DNA, 25 bp, Homo sapien
ccttcaggagcacagcgggccgagg

SEQ ID NO: 222797 - DNA, 25 bp, Homo sapien
ttgtccgcctgcagccttcaggagc

SEQ ID NO: 222798 - DNA, 25 bp, Homo sapien
gcggtggtcctggagtacttcaccc

SEQ ID NO: 222799 - DNA, 25 bp, Homo sapien
tgtttccgggatcctggcctcgtgt

SEQ ID NO: 222800 - DNA, 25 bp, Homo sapien
aagtcccgcaggtctcgcagtcgcg

SEQ ID NO: 222801 - DNA, 25 bp, Homo sapien
gcatgaggcgagtctcccatcacca

SEQ ID NO: 222802 - DNA, 25 bp, Homo sapien
agtgccgctgactccagcccaagaa

SEQ ID NO: 222803 - DNA, 25 bp, Homo sapien
ccgctgactccagcccaagaagagg

SEQ ID NO: 222804 - DNA, 25 bp, Homo sapien
gtcagagcgtccgaggcggaatccc

SEQ ID NO: 222805 - DNA, 25 bp, Homo sapien
ggtctcagcgcacccggtcgctggt

SEQ ID NO: 222806 - DNA, 25 bp, Homo sapien
aaacgcgcagatgtaagctggtgga

SEQ ID NO: 222807 - DNA, 25 bp, Homo sapien
caagaagtcctttgtggtgtcggcc

SEQ ID NO: 222808 - DNA, 25 bp, Homo sapien
gcgccaggaatggattagccacatc

SEQ ID NO: 222809 - DNA, 25 bp, Homo sapien
acaaggccacggacatctgcatgcg

SEQ ID NO: 222810 - DNA, 25 bp, Homo sapien
cgctggatgatcaagacggccaaga

SEQ ID NO: 222811 - DNA, 25 bp, Homo sapien
ctgcaggccaagaaccgctggatga

SEQ ID NO: 222812 - DNA, 25 bp, Homo sapien
tcacactggagctgttgccggagac

SEQ ID NO: 222813 - DNA, 25 bp, Homo sapien
tcgtgctcaacaagcgcaagtaccg

SEQ ID NO: 222814 - DNA, 25 bp, Homo sapien
cgacatcctggtgtatggcagcatc

SEQ ID NO: 222815 - DNA, 25 bp, Homo sapien
acgcgcacgcatgatcacatccggg

SEQ ID NO: 222816 - DNA, 25 bp, Homo sapien
tcggcgatcagacgcggctgcagcc

SEQ ID NO: 222817 - DNA, 25 bp, Homo sapien
tggctccgagctgcgcccggcctta

SEQ ID NO: 222818 - DNA, 25 bp, Homo sapien
ggtggcgtaaggagacgaggcgccc

SEQ ID NO: 222819 - DNA, 25 bp, Homo sapien
acgaggcgcccggagaagagtcctg

SEQ ID NO: 222820 - DNA, 25 bp, Homo sapien
gaagagtcctgggaaccgcaaggcc

SEQ ID NO: 222821 - DNA, 25 bp, Homo sapien
agagtcctgggaaccgcaaggccgc

SEQ ID NO: 222822 - DNA, 25 bp, Homo sapien
cgctcggcgatcagacgcggctgca

SEQ ID NO: 222823 - DNA, 25 bp, Mus musculus
aacgcatgcggatggttcccgggac

SEQ ID NO: 222824 - DNA, 25 bp, Mus musculus
gaaagtatgaaggacctgcctttcc

SEQ ID NO: 222825 - DNA, 25 bp, Mus musculus
agcgaaagtatgaaggacctgcctt

SEQ ID NO: 222826 - DNA, 25 bp, Mus musculus
cgagcgaaagtatgaaggacctgcc

SEQ ID NO: 222827 - DNA, 25 bp, Mus musculus
gacgagcgaaagtatgaaggacctg

SEQ ID NO: 222828 - DNA, 25 bp, Mus musculus
caggacgagcgaaagtatgaaggac

SEQ ID NO: 222829 - DNA, 25 bp, Mus musculus
taaggacaggacgagcgaaagtatg

SEQ ID NO: 222830 - DNA, 25 bp, Mus musculus
taaacgcatgcggatggttcccggg

SEQ ID NO: 222831 - DNA, 25 bp, Mus musculus
caggtaaacgcatgcggatggttcc

SEQ ID NO: 222832 - DNA, 25 bp, Mus musculus
tgctcccgctacctggagggtcctt

SEQ ID NO: 222833 - DNA, 25 bp, Mus musculus
ggagcctgggctggatatgggcaga

SEQ ID NO: 222834 - DNA, 25 bp, Mus musculus
ggcagtctcccctcgctgcgctggt

SEQ ID NO: 222835 - DNA, 25 bp, Mus musculus
tttaaggacaggacgagcgaaagta

SEQ ID NO: 222836 - DNA, 25 bp, Mus musculus
cttttaaggacaggacgagcgaaag

SEQ ID NO: 222837 - DNA, 25 bp, Mus musculus
ccctgcacgtaggctgtggaaacct

SEQ ID NO: 222838 - DNA, 25 bp, Mus musculus
tctggagccgggctgttgcgttttc

SEQ ID NO: 222839 - DNA, 25 bp, Mus musculus
ctgttgcgttttctgcgtctagttg

SEQ ID NO: 222840 - DNA, 25 bp, Mus musculus
tttctgcgtctagttgggcagctca

SEQ ID NO: 222841 - DNA, 25 bp, Mus musculus
tctagttgggcagctcaaggtgagc

SEQ ID NO: 222842 - DNA, 25 bp, Mus musculus
accggggactcgtgcacgctccatg

SEQ ID NO: 222843 - DNA, 25 bp, Mus musculus
cgctccatgcccagcgcggccacaa

SEQ ID NO: 222844 - DNA, 25 bp, Mus musculus
ggccacaacccaggccatggcgatg

SEQ ID NO: 222845 - DNA, 25 bp, Mus musculus
cagcggaaggcaggagccgaaaccc

SEQ ID NO: 222846 - DNA, 25 bp, Mus musculus
tcctctatcaccgtgacttccggaa

SEQ ID NO: 222847 - DNA, 25 bp, Mus musculus
tcaccgtgacttccggaactgttgg

SEQ ID NO: 222848 - DNA, 25 bp, Mus musculus
cggaactgttggtttcagtaaatcg

SEQ ID NO: 222849 - DNA, 25 bp, Mus musculus
tggtttcagtaaatcggtttcagcg

SEQ ID NO: 222850 - DNA, 25 bp, Mus musculus
caacccaggccatggcgatgctgcg

SEQ ID NO: 222851 - DNA, 25 bp, Mus musculus
tggggatctcctacattagcgtcta

SEQ ID NO: 222852 - DNA, 25 bp, Mus musculus
agctagtttgttcccggtcgtcttg

SEQ ID NO: 222853 - DNA, 25 bp, Mus musculus
ccgagtctgaggatacgtttctagc

SEQ ID NO: 222854 - DNA, 25 bp, Mus musculus
ggagccagcctcattctcaagcgca

SEQ ID NO: 222855 - DNA, 25 bp, Mus musculus
ttagcgtctacgaccaccaaggtga

SEQ ID NO: 222856 - DNA, 25 bp, Mus musculus
tcagacatcgccagcctcgtggtgt

SEQ ID NO: 222857 - DNA, 25 bp, Mus musculus
aggagcccagcttctcagacatcgc

SEQ ID NO: 222858 - DNA, 25 bp, Mus musculus
cggacgtccggtccctgcagaagct

SEQ ID NO: 222859 - DNA, 25 bp, Mus musculus
cgtcggcaggaaccggcgtcatcac

SEQ ID NO: 222860 - DNA, 25 bp, Mus musculus
cgcttcggcacctggaactggatct

SEQ ID NO: 222861 - DNA, 25 bp, Mus musculus
ccacaggagtatgacggggctgtac

SEQ ID NO: 222862 - DNA, 25 bp, Mus musculus
cagaactctccatgtactaacgggg

SEQ ID NO: 222863 - DNA, 25 bp, Mus musculus
caagcgcacgctctctttagcagtg

SEQ ID NO: 222864 - DNA, 25 bp, Mus musculus
gtgaccgaggcacttccgagtctga

SEQ ID NO: 222865 - DNA, 25 bp, Mus musculus
acgtcacgcaggcttaggaccgcga

SEQ ID NO: 222866 - DNA, 25 bp, Mus musculus
gagaatacgtcgctcccgcacctgt

SEQ ID NO: 222867 - DNA, 25 bp, Mus musculus
gcacctgtctccttcacgaaatgct

SEQ ID NO: 222868 - DNA, 25 bp, Mus musculus
cttcacgaaatgctcccggtaggtc

SEQ ID NO: 222869 - DNA, 25 bp, Mus musculus
gaaatgctcccggtaggtccgccac

SEQ ID NO: 222870 - DNA, 25 bp, Mus musculus
taccgctcgaagctccggtacttct

SEQ ID NO: 222871 - DNA, 25 bp, Mus musculus
ttaggaccgcgaccggagctacaga

SEQ ID NO: 222872 - DNA, 25 bp, Mus musculus
ctacagaggcccaagagctccacga

SEQ ID NO: 222873 - DNA, 25 bp, Mus musculus
cggcatctcccaattccgaaaaacg

SEQ ID NO: 222874 - DNA, 25 bp, Mus musculus
caggtcgccaaagacgcccgtagga

SEQ ID NO: 222875 - DNA, 25 bp, Mus musculus
caaagacgcccgtaggacccagaca

SEQ ID NO: 222876 - DNA, 25 bp, Mus musculus
ccgtaggacccagacagaggtggcc

SEQ ID NO: 222877 - DNA, 25 bp, Mus musculus
cgggcacagacagggacgtcacgca

SEQ ID NO: 222878 - DNA, 25 bp, Mus musculus
tcgatgtcctcgttgggcatgggcc

SEQ ID NO: 222879 - DNA, 25 bp, Mus musculus
gcagcgccagcgatatgtccggcca

SEQ ID NO: 222880 - DNA, 25 bp, Mus musculus
agcttcggagcctacagcctggcgg

SEQ ID NO: 222881 - DNA, 25 bp, Mus musculus
cgctgatgatgcagagcttcggagc

SEQ ID NO: 222882 - DNA, 25 bp, Mus musculus
acctgcgcgagcagacggcgctgat

SEQ ID NO: 222883 - DNA, 25 bp, Mus musculus
cagcaggagcacctgcgcgagcaga

SEQ ID NO: 222884 - DNA, 25 bp, Mus musculus
catcagcaaccgttttccgtactac

SEQ ID NO: 222885 - DNA, 25 bp, Mus musculus
gcgagttcatcagcaaccgttttcc

SEQ ID NO: 222886 - DNA, 25 bp, Mus musculus
ccctgagcggcatctgcgagttcat

SEQ ID NO: 222887 - DNA, 25 bp, Mus musculus
ctgcagagcccgcagaagaagctga

SEQ ID NO: 222888 - DNA, 25 bp, Mus musculus
aagggccaccggtgagcgctcatca

SEQ ID NO: 222889 - DNA, 25 bp, Mus musculus
ggatgaccctctccggcagcggcag

SEQ ID NO: 222890 - DNA, 25 bp, Mus musculus
atatgtccggccagacggtgctgac

SEQ ID NO: 222891 - DNA, 25 bp, Mus musculus
agaacagcctggtgaagccacccta

SEQ ID NO: 222892 - DNA, 25 bp, Mus musculus
gagcgctcatcacggccagtctcaa

SEQ ID NO: 222893 - DNA, 25 bp, Mus musculus
cctcacaggaatccgtgggctaagc

SEQ ID NO: 222894 - DNA, 25 bp, Mus musculus
cccggcgtgtggctgtcctgcagaa

SEQ ID NO: 222895 - DNA, 25 bp, Mus musculus
cttgttgggaggtctcgcccatccc

SEQ ID NO: 222896 - DNA, 25 bp, Mus musculus
ctgcgggcgccaattctggagagca

SEQ ID NO: 222897 - DNA, 25 bp, Mus musculus
cgctggttctctgcgggcgccaatt

SEQ ID NO: 222898 - DNA, 25 bp, Mus musculus
caggcgcattcgctggttctctgcg

SEQ ID NO: 222899 - DNA, 25 bp, Mus musculus
acgtggcagtctagctctcccagtc

SEQ ID NO: 222900 - DNA, 25 bp, Mus musculus
gcaacgtggcagtctagctctccca

SEQ ID NO: 222901 - DNA, 25 bp, Mus musculus
ttctcgaattccagggcttgcaccc

SEQ ID NO: 222902 - DNA, 25 bp, Mus musculus
agccgccaggcttctcgaattccag

SEQ ID NO: 222903 - DNA, 25 bp, Mus musculus
aggagcaaggggctttccacctgcc

SEQ ID NO: 222904 - DNA, 25 bp, Mus musculus
agccgctcaagctttggccgtggtc

SEQ ID NO: 222905 - DNA, 25 bp, Mus musculus
tccgtgggctaagcagccgctcaag

SEQ ID NO: 222906 - DNA, 25 bp, Mus musculus
ctgtcctgcagaagtgacgcggcct

SEQ ID NO: 222907 - DNA, 25 bp, Mus musculus
cgtttggaaggtgctctgcctctta

SEQ ID NO: 222908 - DNA, 25 bp, Mus musculus
ctgcctcttatttccggtggcggcg

SEQ ID NO: 222909 - DNA, 25 bp, Mus musculus
cacaaatctctggtcggagcgtttg

SEQ ID NO: 222910 - DNA, 25 bp, Mus musculus
tctcggtcaatggtccacaaatctc

SEQ ID NO: 222911 - DNA, 25 bp, Mus musculus
gccatggctgttctctctcggtcaa

SEQ ID NO: 222912 - DNA, 25 bp, Mus musculus
gcctcgcaacagataagctacaatg

SEQ ID NO: 222913 - DNA, 25 bp, Mus musculus
ctattgtggacatgccagcctcgca

SEQ ID NO: 222914 - DNA, 25 bp, Mus musculus
tcaaggaaatggtgcagggagtcta

SEQ ID NO: 222915 - DNA, 25 bp, Mus musculus
tccgcgcgagaaagagcctgaacgt

SEQ ID NO: 222916 - DNA, 25 bp, Mus musculus
ccgtatgcagctcgccggaaacagt

SEQ ID NO: 222917 - DNA, 25 bp, Mus musculus
agtaagcgctggatgaggtgtcacc

SEQ ID NO: 222918 - DNA, 25 bp, Mus musculus
ggaagcataaaaagcccgcgtagta

SEQ ID NO: 222919 - DNA, 25 bp, Mus musculus
gggactccgttgctggacagaacca

SEQ ID NO: 222920 - DNA, 25 bp, Mus musculus
gcacgaccctcctcactattgtgga

SEQ ID NO: 222921 - DNA, 25 bp, Mus musculus
tcatcgtacgcatcgctgcagccaa

SEQ ID NO: 222922 - DNA, 25 bp, Mus musculus
ccaccatggtgaagatcgtgacagt

SEQ ID NO: 222923 - DNA, 25 bp, Mus musculus
cgctgtgctattctggtctgggatt

SEQ ID NO: 222924 - DNA, 25 bp, Mus musculus
tcgtgacagtgaagacgcaggcata

SEQ ID NO: 222925 - DNA, 25 bp, Mus musculus
acgcaggcatatccggatcagaagc

SEQ ID NO: 222926 - DNA, 25 bp, Mus musculus
attgcggaagcgagtgaaggttttc

SEQ ID NO: 222927 - DNA, 25 bp, Mus musculus
gttttccagagcaacgccaactatg

SEQ ID NO: 222928 - DNA, 25 bp, Mus musculus
gccaactatgcggagaatttcatcc

SEQ ID NO: 222929 - DNA, 25 bp, Mus musculus
cagagcatcgtctctaccgtggagc

SEQ ID NO: 222930 - DNA, 25 bp, Mus musculus
cccacgtttcgcaatggctatgccg

SEQ ID NO: 222931 - DNA, 25 bp, Mus musculus
atgaccgaggccatccagctcatcg

SEQ ID NO: 222932 - DNA, 25 bp, Mus musculus
gcacgctcccttgaccttggcagta

SEQ ID NO: 222933 - DNA, 25 bp, Mus musculus
ctgggccatcgtttccagggcaaga

SEQ ID NO: 222934 - DNA, 25 bp, Mus musculus
gggacggccgcttctacatgaccga

SEQ ID NO: 222935 - DNA, 25 bp, Mus musculus
cacgcggggctgatgcccaaggtaa

SEQ ID NO: 222936 - DNA, 25 bp, Mus musculus
tgatgcccaaggtaagcagcgcccg

SEQ ID NO: 222937 - DNA, 25 bp, Mus musculus
accgccacgagaggaggaatgcacc

SEQ ID NO: 222938 - DNA, 25 bp, Mus musculus
cgaacccgtggatgttctgcgcgcc

SEQ ID NO: 222939 - DNA, 25 bp, Mus musculus
tgcctgcggcaggacgaagtgaccc

SEQ ID NO: 222940 - DNA, 25 bp, Mus musculus
gagggacaaagagttttgcaaaggc

SEQ ID NO: 222941 - DNA, 25 bp, Mus musculus
ctaggactgaacagccggctgagtc

SEQ ID NO: 222942 - DNA, 25 bp, Mus musculus
tcgcaagagcgacacagagagccta

SEQ ID NO: 222943 - DNA, 25 bp, Mus musculus
cggagacacacggttcgcaagagcg

SEQ ID NO: 222944 - DNA, 25 bp, Mus musculus
cttctgcagtcggagccggagacac

SEQ ID NO: 222945 - DNA, 25 bp, Mus musculus
gcactgggcacgctcttctgcagtc

SEQ ID NO: 222946 - DNA, 25 bp, Mus musculus
agctccaggcactgggcacgctctt

SEQ ID NO: 222947 - DNA, 25 bp, Mus musculus
cacagagagcctaggactgaacagc

SEQ ID NO: 222948 - DNA, 25 bp, Mus musculus
gtcccggagctggtcattcgaccgc

SEQ ID NO: 222949 - DNA, 25 bp, Mus musculus
ctgccttgtggcatgctggatcttg

SEQ ID NO: 222950 - DNA, 25 bp, Mus musculus
tccttcgcagatttgttttcactcg

SEQ ID NO: 222951 - DNA, 25 bp, Mus musculus
cagtttgcactctcttccttcgcag

SEQ ID NO: 222952 - DNA, 25 bp, Mus musculus
ggattctctgctctatccgcgcttc

SEQ ID NO: 222953 - DNA, 25 bp, Mus musculus
ctttcttgttggctggggattctct

SEQ ID NO: 222954 - DNA, 25 bp, Mus musculus
tttgccgctgccctcttctgcagag

SEQ ID NO: 222955 - DNA, 25 bp, Mus musculus
tgtcccgtgtactcatttgccgctg

SEQ ID NO: 222956 - DNA, 25 bp, Mus musculus
cagtgctctctgtcccgtgtactca

SEQ ID NO: 222957 - DNA, 25 bp, Mus musculus
tctccatcctggacgaggcgcaagt

SEQ ID NO: 222958 - DNA, 25 bp, Mus musculus
aagttttccagctacagccgccgcg

SEQ ID NO: 222959 - DNA, 25 bp, Mus musculus
tgttttcactcgtcactcctgcaaa

SEQ ID NO: 222960 - DNA, 25 bp, Mus musculus
cctttggctgctctgccttgtggca

SEQ ID NO: 222961 - DNA, 25 bp, Mus musculus
ggacctctcggttcctgcagacttc

SEQ ID NO: 222962 - DNA, 25 bp, Mus musculus
tctcttctctcacttcggtctttta

SEQ ID NO: 222963 - DNA, 25 bp, Mus musculus
tgtactttgtgttccctccagccca

SEQ ID NO: 222964 - DNA, 25 bp, Mus musculus
ccctccagcccaaggcggtgttgaa

SEQ ID NO: 222965 - DNA, 25 bp, Mus musculus
gctgccacgtctggtctgtactttg

SEQ ID NO: 222966 - DNA, 25 bp, Mus musculus
ctgcagccagcgagagcagcgtgtt

SEQ ID NO: 222967 - DNA, 25 bp, Mus musculus
cgaagcctttctgcagccagcgaga

SEQ ID NO: 222968 - DNA, 25 bp, Mus musculus
gagccctttgcctcgacgaagcctt

SEQ ID NO: 222969 - DNA, 25 bp, Mus musculus
agaaggaggtatgcgcaccgagccc

SEQ ID NO: 222970 - DNA, 25 bp, Mus musculus
cgcaaaaccggaggagaccgtaatg

SEQ ID NO: 222971 - DNA, 25 bp, Mus musculus
cagctcccaggtatgggcaccgggc

SEQ ID NO: 222972 - DNA, 25 bp, Mus musculus
agcaaccggcggaaaatcctagtga

SEQ ID NO: 222973 - DNA, 25 bp, Mus musculus
gatccggaccctctgctgggacggc

SEQ ID NO: 222974 - DNA, 25 bp, Mus musculus
ccgcgtcctagattccgcaggtgtc

SEQ ID NO: 222975 - DNA, 25 bp, Mus musculus
gttcgagtcccaccatgttaccgcg

SEQ ID NO: 222976 - DNA, 25 bp, Mus musculus
gagaccgtaatggtcccggcgccta

SEQ ID NO: 222977 - DNA, 25 bp, Mus musculus
aggcaactcagcctgccgtgcaggg

SEQ ID NO: 222978 - DNA, 25 bp, Mus musculus
cactggtcccagtttcgatgaatcg

SEQ ID NO: 222979 - DNA, 25 bp, Mus musculus
cggcggcctgcgctctaaaaacgca

SEQ ID NO: 222980 - DNA, 25 bp, Mus musculus
tcgatgaatcgggtcccttcgggta

SEQ ID NO: 222981 - DNA, 25 bp, Mus musculus
cgggtaggacctatagtcgtctctc

SEQ ID NO: 222982 - DNA, 25 bp, Mus musculus
tccatcatgctacattccggcaagc

SEQ ID NO: 222983 - DNA, 25 bp, Mus musculus
ttccggcaagctgcggttcggagtt

SEQ ID NO: 222984 - DNA, 25 bp, Mus musculus
ccgcaagagctgaccaggggtgaac

SEQ ID NO: 222985 - DNA, 25 bp, Mus musculus
gccgcggggccataaacaggatgtc

SEQ ID NO: 222986 - DNA, 25 bp, Mus musculus
ccgcggctaaggagaggcaccgaaa

SEQ ID NO: 222987 - DNA, 25 bp, Mus musculus
ggtcaggagtctggcaggcaactca

SEQ ID NO: 222988 - DNA, 25 bp, Mus musculus
gtccggcgtggacacccgcggctaa

SEQ ID NO: 222989 - DNA, 25 bp, Mus musculus
ttggggagccacagacactggtccc

SEQ ID NO: 222990 - DNA, 25 bp, Mus musculus
ccataaacaggatgtcggcggagcg

SEQ ID NO: 222991 - DNA, 25 bp, Mus musculus
tcgatcttccgcctgcaagagccag

SEQ ID NO: 222992 - DNA, 25 bp, Mus musculus
gccagcgtcgatcgaggctacttca

SEQ ID NO: 222993 - DNA, 25 bp, Mus musculus
tcctctgctcgctttcccggagatg

SEQ ID NO: 222994 - DNA, 25 bp, Mus musculus
tttctgtggactgaattcgatcttc

SEQ ID NO: 222995 - DNA, 25 bp, Mus musculus
ccgggcttacgttgaattttctgtg

SEQ ID NO: 222996 - DNA, 25 bp, Mus musculus
tttagtgagatgacaccgggcttac

SEQ ID NO: 222997 - DNA, 25 bp, Mus musculus
cggctgtagctgtcgtttagtgaga

SEQ ID NO: 222998 - DNA, 25 bp, Mus musculus
cctagaatgggaccaagagacggct

SEQ ID NO: 222999 - DNA, 25 bp, Mus musculus
actgaccagaatagccctagaatgg

SEQ ID NO: 223000 - DNA, 25 bp, Mus musculus
gtggacccgcgaactgaccagaata

SEQ ID NO: 223001 - DNA, 25 bp, Mus musculus
gagaagtcacgctccagcctccgag

SEQ ID NO: 223002 - DNA, 25 bp, Mus musculus
ctgccgctgagaagtcacgctccag

SEQ ID NO: 223003 - DNA, 25 bp, Mus musculus
agcggcctgcgcgttgactccactt

SEQ ID NO: 223004 - DNA, 25 bp, Mus musculus
tcgaggctacttcaggtctccgccg

SEQ ID NO: 223005 - DNA, 25 bp, Mus musculus
tggtctccattttcttccggccgtg

SEQ ID NO: 223006 - DNA, 25 bp, Mus musculus
cgtgtgtcctgtggaatcgtcttca

SEQ ID NO: 223007 - DNA, 25 bp, Mus musculus
agaaggaaactctgatcgttggctc

SEQ ID NO: 223008 - DNA, 25 bp, Mus musculus
gggcggtcctggttaatctgaaagc

SEQ ID NO: 223009 - DNA, 25 bp, Mus musculus
tctttgccatgtccacgttggtagc

SEQ ID NO: 223010 - DNA, 25 bp, Mus musculus
aaaatctcggagcagcgcctaggta

SEQ ID NO: 223011 - DNA, 25 bp, Mus musculus
tcctgggatcttgacagcgaaaatc

SEQ ID NO: 223012 - DNA, 25 bp, Mus musculus
agcacttctcaggatgccgggcatg

SEQ ID NO: 223013 - DNA, 25 bp, Mus musculus
gagcgtcccttctccgtttgtgtgg

SEQ ID NO: 223014 - DNA, 25 bp, Mus musculus
atcgtcttcacttaacggttcctga

SEQ ID NO: 223015 - DNA, 25 bp, Mus musculus
cgcatgagcagagagacggtgcatc

SEQ ID NO: 223016 - DNA, 25 bp, Mus musculus
taagtcgaatcgcagtctccggagg

SEQ ID NO: 223017 - DNA, 25 bp, Mus musculus
actgcccggtgcgaagcacttctca

SEQ ID NO: 223018 - DNA, 25 bp, Mus musculus
acctaggatgttggcctggcgctaa

SEQ ID NO: 223019 - DNA, 25 bp, Mus musculus
caggcattgtgcctctcaatgttcc

SEQ ID NO: 223020 - DNA, 25 bp, Mus musculus
tcctttcagaaacaaggccacggaa

SEQ ID NO: 223021 - DNA, 25 bp, Mus musculus
gggttccgactccactcagtgcgct

SEQ ID NO: 223022 - DNA, 25 bp, Mus musculus
gcctctggcctcaaatagacggtgg

SEQ ID NO: 223023 - DNA, 25 bp, Mus musculus
tggaggattctaggaactgtagtcc

SEQ ID NO: 223024 - DNA, 25 bp, Mus musculus
actgtagtccgtcgcccgttcacta

SEQ ID NO: 223025 - DNA, 25 bp, Mus musculus
cactagcgggccgaaccacaggact

SEQ ID NO: 223026 - DNA, 25 bp, Mus musculus
ccacaggacttgaccggaaggacta

SEQ ID NO: 223027 - DNA, 25 bp, Mus musculus
aaggcgtctgttggatgctccgcga

SEQ ID NO: 223028 - DNA, 25 bp, Mus musculus
cgcgagttgctaggagctgtctcaa

SEQ ID NO: 223029 - DNA, 25 bp, Mus musculus
agctgtctcaacgtcactcccgtga

SEQ ID NO: 223030 - DNA, 25 bp, Mus musculus
cactcccgtgaagcgcggggaaagc

SEQ ID NO: 223031 - DNA, 25 bp, Mus musculus
ggccctgttaagagctgtcctttca

SEQ ID NO: 223032 - DNA, 25 bp, Mus musculus
ctgaatccagacacagccgagcttc

SEQ ID NO: 223033 - DNA, 25 bp, Mus musculus
tgtcagcgagcctgcaccgggcgct

SEQ ID NO: 223034 - DNA, 25 bp, Mus musculus
aacccgcgggcgtatgtcagcgagc

SEQ ID NO: 223035 - DNA, 25 bp, Mus musculus
cgctgaagccgctgggaagctagat

SEQ ID NO: 223036 - DNA, 25 bp, Mus musculus
gccgctgggaagctagatgtaaaga

SEQ ID NO: 223037 - DNA, 25 bp, Mus musculus
ctagatgtaaagagttagcgcggtg

SEQ ID NO: 223038 - DNA, 25 bp, Mus musculus
agagttagcgcggtggccgcctccc

SEQ ID NO: 223039 - DNA, 25 bp, Mus musculus
ttgcacaatccctgccgtgcaatcg

SEQ ID NO: 223040 - DNA, 25 bp, Mus musculus
cagcctgaaatggttcccaggtttc

SEQ ID NO: 223041 - DNA, 25 bp, Mus musculus
cccaggtttccaagcctagcaaaga

SEQ ID NO: 223042 - DNA, 25 bp, Mus musculus
agcctagcaaagaaccgcggcgtcc

SEQ ID NO: 223043 - DNA, 25 bp, Mus musculus
tcaggcgcactccaagccgtatttc

SEQ ID NO: 223044 - DNA, 25 bp, Mus musculus
ccaagccgtatttcttcgggtgact

SEQ ID NO: 223045 - DNA, 25 bp, Mus musculus
gtatttcttcgggtgactgggccgc

SEQ ID NO: 223046 - DNA, 25 bp, Mus musculus
tgactcgcacccagcctgaaatggt

SEQ ID NO: 223047 - DNA, 25 bp, Mus musculus
tgtaaacaacatcccggctctattt

SEQ ID NO: 223048 - DNA, 25 bp, Mus musculus
cttccgggtctcatgaccgggaagg

SEQ ID NO: 223049 - DNA, 25 bp, Mus musculus
gctttgccatgtgatagattgggga

SEQ ID NO: 223050 - DNA, 25 bp, Mus musculus
ctgtttttattctagctttgccatg

SEQ ID NO: 223051 - DNA, 25 bp, Mus musculus
cgtgaccgtcgccatttttctgttt

SEQ ID NO: 223052 - DNA, 25 bp, Mus musculus
aaggctcgccacaacgtgaccgtcg

SEQ ID NO: 223053 - DNA, 25 bp, Mus musculus
tatctaatgacgcagcaaggctcgc

SEQ ID NO: 223054 - DNA, 25 bp, Mus musculus
catcccgctatttgcatgaggatta

SEQ ID NO: 223055 - DNA, 25 bp, Mus musculus
ccctttctttgttcatcccgctatt

SEQ ID NO: 223056 - DNA, 25 bp, Mus musculus
ctaggctcccgtgtccaggcttcgg

SEQ ID NO: 223057 - DNA, 25 bp, Mus musculus
cggctctatttccagcggccgcggg

SEQ ID NO: 223058 - DNA, 25 bp, Mus musculus
acgagacacaactccaggcgaagga

SEQ ID NO: 223059 - DNA, 25 bp, Mus musculus
cgccggatccgtcatgtaaacaaca

SEQ ID NO: 223060 - DNA, 25 bp, Mus musculus
gggaaaagcgagtgcgccacagctc

SEQ ID NO: 223061 - DNA, 25 bp, Mus musculus
ggggaccctaactggcctctcgtgc

SEQ ID NO: 223062 - DNA, 25 bp, Mus musculus
cgcgctcctttccaccgaggtgtgt

SEQ ID NO: 223063 - DNA, 25 bp, Mus musculus
ctttccaccgaggtgtgtgtctccc

SEQ ID NO: 223064 - DNA, 25 bp, Mus musculus
tccagttgcaggcagcggccactgt

SEQ ID NO: 223065 - DNA, 25 bp, Mus musculus
aagcgacagtcaccgagaagcgccc

SEQ ID NO: 223066 - DNA, 25 bp, Mus musculus
agaagcgcccggagagctgctccca

SEQ ID NO: 223067 - DNA, 25 bp, Mus musculus
cttcccggagttgcgcgcctggact

SEQ ID NO: 223068 - DNA, 25 bp, Mus musculus
gactcgggtgggtctgactgacctc

SEQ ID NO: 223069 - DNA, 25 bp, Mus musculus
ggcggggcagtctttaaagcctctc

SEQ ID NO: 223070 - DNA, 25 bp, Mus musculus
ggcagtctttaaagcctctcctttc

SEQ ID NO: 223071 - DNA, 25 bp, Mus musculus
tcggcagcgcctcggactgcactgg

SEQ ID NO: 223072 - DNA, 25 bp, Mus musculus
ccctgcacggcaggccgagggaaac

SEQ ID NO: 223073 - DNA, 25 bp, Mus musculus
atccgggctaagtctggccgcgctc

SEQ ID NO: 223074 - DNA, 25 bp, Mus musculus
aggccgagggaaacgcgagcctctc

SEQ ID NO: 223075 - DNA, 25 bp, Mus musculus
tggccaggcacaggcaaacgcacgg

SEQ ID NO: 223076 - DNA, 25 bp, Mus musculus
ggctactgcggaccgcgcacagatt

SEQ ID NO: 223077 - DNA, 25 bp, Mus musculus
gggctgtatcgcctcgccacaagct

SEQ ID NO: 223078 - DNA, 25 bp, Mus musculus
gcgcacacctgttcgtgcccggggt

SEQ ID NO: 223079 - DNA, 25 bp, Mus musculus
gggcgcgtatccgtgaccgcgcaca

SEQ ID NO: 223080 - DNA, 25 bp, Mus musculus
cggaccgcgcacagatttctctgca

SEQ ID NO: 223081 - DNA, 25 bp, Mus musculus
caaacgcacggcgacagcgttggcg

SEQ ID NO: 223082 - DNA, 25 bp, Mus musculus
accgaggccggaggcactaagagcc

SEQ ID NO: 223083 - DNA, 25 bp, Mus musculus
gggagcagcggttactgagacactc

SEQ ID NO: 223084 - DNA, 25 bp, Mus musculus
tcctcagaagccaagacctaggtcc

SEQ ID NO: 223085 - DNA, 25 bp, Mus musculus
cggtcggccggcttggttctgcctt

SEQ ID NO: 223086 - DNA, 25 bp, Mus musculus
ggaaaatcctgggagacacgcgaca

SEQ ID NO: 223087 - DNA, 25 bp, Mus musculus
gggagacacgcgacagaatcttacg

SEQ ID NO: 223088 - DNA, 25 bp, Mus musculus
ttctctgcagcaaagggcgcgtatc

SEQ ID NO: 223089 - DNA, 25 bp, Mus musculus
acgtggttcagggtcgcacttcttt

SEQ ID NO: 223090 - DNA, 25 bp, Mus musculus
tgccgaggggccgacatctccgcag

SEQ ID NO: 223091 - DNA, 25 bp, Mus musculus
gtgcttctccgcagctgctcagttt

SEQ ID NO: 223092 - DNA, 25 bp, Mus musculus
ggggccgacatctccgcagcctgga

SEQ ID NO: 223093 - DNA, 25 bp, Mus musculus
tctctagatcctggtgcctgccgag

SEQ ID NO: 223094 - DNA, 25 bp, Mus musculus
ttgattctctagatcctggtgcctg

SEQ ID NO: 223095 - DNA, 25 bp, Mus musculus
gcatccttgattctctagatcctgg

SEQ ID NO: 223096 - DNA, 25 bp, Mus musculus
tcagggtcgcacttctttctgcatc

SEQ ID NO: 223097 - DNA, 25 bp, Mus musculus
tccgcagctgctcagtttgctcgcg

SEQ ID NO: 223098 - DNA, 25 bp, Mus musculus
cccagcacacacgtggttcagggtc

SEQ ID NO: 223099 - DNA, 25 bp, Mus musculus
cctgggaaatttctgccgcagcggg

SEQ ID NO: 223100 - DNA, 25 bp, Mus musculus
ggggccctgggaaatttctgccgca

SEQ ID NO: 223101 - DNA, 25 bp, Mus musculus
gtcgcacttctttctgcatccttga

SEQ ID NO: 223102 - DNA, 25 bp, Mus musculus
ggagctcaggccgtgcttctccgca

SEQ ID NO: 223103 - DNA, 25 bp, Mus musculus
tctttgcagctggtggacagtcacg

SEQ ID NO: 223104 - DNA, 25 bp, Mus musculus
accacggacagctcaggtagcggcc

SEQ ID NO: 223105 - DNA, 25 bp, Mus musculus
tggttatgaatctttgcagctggtg

SEQ ID NO: 223106 - DNA, 25 bp, Mus musculus
agaccagcagcgatggttatgaatc

SEQ ID NO: 223107 - DNA, 25 bp, Mus musculus
gggagctaccggaaaaagaccagca

SEQ ID NO: 223108 - DNA, 25 bp, Mus musculus
ggcttgcccatgagcctcctcggga

SEQ ID NO: 223109 - DNA, 25 bp, Mus musculus
ttttcatccctctcttagtctgtcc

SEQ ID NO: 223110 - DNA, 25 bp, Mus musculus
tcctcttcgcgtcatgtcgggcact

SEQ ID NO: 223111 - DNA, 25 bp, Mus musculus
ctcgggcgctgtccagcctacgggt

SEQ ID NO: 223112 - DNA, 25 bp, Mus musculus
ggctacacctacacttcctcgggcg

SEQ ID NO: 223113 - DNA, 25 bp, Mus musculus
gagctgcccggcttttgcccggcta

SEQ ID NO: 223114 - DNA, 25 bp, Mus musculus
ctcctttactctcttctgtttattc

SEQ ID NO: 223115 - DNA, 25 bp, Mus musculus
cgtcatgtcgggcacttgattatta

SEQ ID NO: 223116 - DNA, 25 bp, Mus musculus
tggctcagtccttcggcccggtgca

SEQ ID NO: 223117 - DNA, 25 bp, Mus musculus
cttttggagaaagccggaagcagcg

SEQ ID NO: 223118 - DNA, 25 bp, Mus musculus
tgcggagcctataaacgctcgcgcc

SEQ ID NO: 223119 - DNA, 25 bp, Mus musculus
cagaggtgttttgcggagcctataa

SEQ ID NO: 223120 - DNA, 25 bp, Mus musculus
cctcccgaatgcgcggcagaggtgt

SEQ ID NO: 223121 - DNA, 25 bp, Mus musculus
tgcgagttcctgcagaccgcggcct

SEQ ID NO: 223122 - DNA, 25 bp, Mus musculus
ctggctccaggctgcatggcgagca

SEQ ID NO: 223123 - DNA, 25 bp, Mus musculus
ctcctggctccaggctgcatggcga

SEQ ID NO: 223124 - DNA, 25 bp, Mus musculus
ttaaaggtacactgcgaccctcgcc

SEQ ID NO: 223125 - DNA, 25 bp, Mus musculus
ctccagagacatggcgggcgttaaa

SEQ ID NO: 223126 - DNA, 25 bp, Mus musculus
gttgggtaggaagtcaataccgtca

SEQ ID NO: 223127 - DNA, 25 bp, Mus musculus
cgcccacgcccgtcagttcccaggc

SEQ ID NO: 223128 - DNA, 25 bp, Mus musculus
acatggcgggcgttaaaggtacact

SEQ ID NO: 223129 - DNA, 25 bp, Mus musculus
gcgggcgttaaaggtacactgcgac

SEQ ID NO: 223130 - DNA, 25 bp, Mus musculus
cccagctccagagacatggcgggcg

SEQ ID NO: 223131 - DNA, 25 bp, Mus musculus
gcagtcacctgagtggccagtgccc

SEQ ID NO: 223132 - DNA, 25 bp, Mus musculus
ccgcgcagtcacctgagtggccagt

SEQ ID NO: 223133 - DNA, 25 bp, Mus musculus
cgcgcacgagtggtcggcaccttct

SEQ ID NO: 223134 - DNA, 25 bp, Mus musculus
cggcaccttctgagccagcagcata

SEQ ID NO: 223135 - DNA, 25 bp, Mus musculus
ttctgagccagcagcatagagccca

SEQ ID NO: 223136 - DNA, 25 bp, Mus musculus
atagagcccaggcatccctgcttta

SEQ ID NO: 223137 - DNA, 25 bp, Mus musculus
agagcccaggcatccctgctttacg

SEQ ID NO: 223138 - DNA, 25 bp, Mus musculus
cgggacacaggtgggacactctttt

SEQ ID NO: 223139 - DNA, 25 bp, Mus musculus
caggtgggacactcttttagtcctc

SEQ ID NO: 223140 - DNA, 25 bp, Mus musculus
ctcttttagtcctcaatccctggcg

SEQ ID NO: 223141 - DNA, 25 bp, Mus musculus
tggcgcgaggccacccaaggcaacg

SEQ ID NO: 223142 - DNA, 25 bp, Mus musculus
cgaggccacccaaggcaacgcagga

SEQ ID NO: 223143 - DNA, 25 bp, Mus musculus
cacccaaggcaacgcaggacgcagg

SEQ ID NO: 223144 - DNA, 25 bp, Mus musculus
tgctttacgccactccgggacacag

SEQ ID NO: 223145 - DNA, 25 bp, Mus musculus
gcacgcagggctgcgcgtaatcctc

SEQ ID NO: 223146 - DNA, 25 bp, Mus musculus
accaggcttcgggttctcgcctcga

SEQ ID NO: 223147 - DNA, 25 bp, Mus musculus
ccgcggtatcctgagaccaggcttc

SEQ ID NO: 223148 - DNA, 25 bp, Mus musculus
cccgcttaggtagccgcggtatcct

SEQ ID NO: 223149 - DNA, 25 bp, Mus musculus
acccatgcttctcagcgcgggttgg

SEQ ID NO: 223150 - DNA, 25 bp, Mus musculus
ggtaggagaggcacccatgcttctc

SEQ ID NO: 223151 - DNA, 25 bp, Mus musculus
ctcagggatcggtctgtagcggtcc

SEQ ID NO: 223152 - DNA, 25 bp, Mus musculus
atccctgattctgtgcggtgctgga

SEQ ID NO: 223153 - DNA, 25 bp, Mus musculus
ggcatccagtcagggcgaccagatc

SEQ ID NO: 223154 - DNA, 25 bp, Mus musculus
gcgagttgaggttccacccgggatc

SEQ ID NO: 223155 - DNA, 25 bp, Mus musculus
tgcgcgtaatcctccagccgcggtg

SEQ ID NO: 223156 - DNA, 25 bp, Mus musculus
tcggatctccgaggttcgcccacgg

SEQ ID NO: 223157 - DNA, 25 bp, Mus musculus
cgcagcttgaggttgaggatgcctc

SEQ ID NO: 223158 - DNA, 25 bp, Mus musculus
cctgctggcagtaagggatcttctg

SEQ ID NO: 223159 - DNA, 25 bp, Mus musculus
gcctgaggcggccaacgcttagact

SEQ ID NO: 223160 - DNA, 25 bp, Mus musculus
gaggaggcgactcgcgcacgcctga

SEQ ID NO: 223161 - DNA, 25 bp, Mus musculus
tgaggcggccaacgcttagactctt

SEQ ID NO: 223162 - DNA, 25 bp, Mus musculus
ggcggccaacgcttagactcttgcc

SEQ ID NO: 223163 - DNA, 25 bp, Mus musculus
ggccaacgcttagactcttgccttc

SEQ ID NO: 223164 - DNA, 25 bp, Mus musculus
acgcttagactcttgccttcaatcc

SEQ ID NO: 223165 - DNA, 25 bp, Mus musculus
cagaaatgagctggagcatcgcctg

SEQ ID NO: 223166 - DNA, 25 bp, Mus musculus
aatgagctggagcatcgcctgtttg

SEQ ID NO: 223167 - DNA, 25 bp, Mus musculus
gagctggagcatcgcctgtttgatt

SEQ ID NO: 223168 - DNA, 25 bp, Mus musculus
ggagcatcgcctgtttgattccaga

SEQ ID NO: 223169 - DNA, 25 bp, Mus musculus
gcatcgcctgtttgattccagagcc

SEQ ID NO: 223170 - DNA, 25 bp, Mus musculus
cgcctgtttgattccagagcccgaa

SEQ ID NO: 223171 - DNA, 25 bp, Mus musculus
ctgtttgattccagagcccgaatcg

SEQ ID NO: 223172 - DNA, 25 bp, Mus musculus
cccacctggggcaggcgtctgccca

SEQ ID NO: 223173 - DNA, 25 bp, Mus musculus
tcaggcgccgaccaggccctatgag

SEQ ID NO: 223174 - DNA, 25 bp, Mus musculus
cgctccttgcgcagatcgggattca

SEQ ID NO: 223175 - DNA, 25 bp, Mus musculus
tgacaggcaccaaagcgatgacaac

SEQ ID NO: 223176 - DNA, 25 bp, Mus musculus
gtgttctccggactaccatccaaga

SEQ ID NO: 223177 - DNA, 25 bp, Mus musculus
ttaactctggattgaaggtggcggc

SEQ ID NO: 223178 - DNA, 25 bp, Mus musculus
caccgatttctcgacggcgccgggt

SEQ ID NO: 223179 - DNA, 25 bp, Mus musculus
cgggattcatgacggagaccagtgc

SEQ ID NO: 223180 - DNA, 25 bp, Mus musculus
cgcgcaaccgattggccagggcctt

SEQ ID NO: 223181 - DNA, 25 bp, Mus musculus
ttcacgtgatctttccgggaggaaa

SEQ ID NO: 223182 - DNA, 25 bp, Mus musculus
gacctcacgtctccaggttcacgtg

SEQ ID NO: 223183 - DNA, 25 bp, Mus musculus
gctcctcgccaaggaaagcaaggta

SEQ ID NO: 223184 - DNA, 25 bp, Mus musculus
ccctatgagcggagcgagacagccc

SEQ ID NO: 223185 - DNA, 25 bp, Mus musculus
tgacaacctgtctccgcagctcagg

SEQ ID NO: 223186 - DNA, 25 bp, Mus musculus
catccaagatgtgcgtgattaactc

SEQ ID NO: 223187 - DNA, 25 bp, Mus musculus
ggccctttccttcgggcagcctgca

SEQ ID NO: 223188 - DNA, 25 bp, Mus musculus
cgcctgcccggcgtttccgtggcga

SEQ ID NO: 223189 - DNA, 25 bp, Mus musculus
ttctaccgggagctgagagcgcgca

SEQ ID NO: 223190 - DNA, 25 bp, Mus musculus
ccgccacttctaccgggagctgaga

SEQ ID NO: 223191 - DNA, 25 bp, Mus musculus
atgggagcccaacgagcgcggctcc

SEQ ID NO: 223192 - DNA, 25 bp, Mus musculus
gacccaggatgggagcccaacgagc

SEQ ID NO: 223193 - DNA, 25 bp, Mus musculus
aacatcttgcctttcccgccgcccg

SEQ ID NO: 223194 - DNA, 25 bp, Mus musculus
gattgcgcctcaacatcttgccttt

SEQ ID NO: 223195 - DNA, 25 bp, Mus musculus
cggcggttaccgctcatccagattg

SEQ ID NO: 223196 - DNA, 25 bp, Mus musculus
acggactgcagagcgccacggggac

SEQ ID NO: 223197 - DNA, 25 bp, Mus musculus
gcctcatccgggtggacggactgca

SEQ ID NO: 223198 - DNA, 25 bp, Mus musculus
cactcgcctcatccgggtggacgga

SEQ ID NO: 223199 - DNA, 25 bp, Mus musculus
cctcccgggctctgtaccgcggcag

SEQ ID NO: 223200 - DNA, 25 bp, Mus musculus
gctcatccagattgcgcctcaacat

SEQ ID NO: 223201 - DNA, 25 bp, Mus musculus
ataggcttgcaaggaccacgaggag

SEQ ID NO: 223202 - DNA, 25 bp, Mus musculus
agctgaagggattggccgaggcagc

SEQ ID NO: 223203 - DNA, 25 bp, Mus musculus
gtccagagctgaagggattggccga

SEQ ID NO: 223204 - DNA, 25 bp, Mus musculus
catgtgacgcggtccagagctgaag

SEQ ID NO: 223205 - DNA, 25 bp, Mus musculus
aggctggctaccatgtgacgcggtc

SEQ ID NO: 223206 - DNA, 25 bp, Mus musculus
atgcaggctggctaccatgtgacgc

SEQ ID NO: 223207 - DNA, 25 bp, Mus musculus
ggggtattgtgtcaggagatgcagg

SEQ ID NO: 223208 - DNA, 25 bp, Mus musculus
gacgggaaatgggttccgtgcgctc

SEQ ID NO: 223209 - DNA, 25 bp, Mus musculus
gtagcgagcaatggggacgggaaat

SEQ ID NO: 223210 - DNA, 25 bp, Mus musculus
ggaagtgcgtcaccaggtggggaag

SEQ ID NO: 223211 - DNA, 25 bp, Mus musculus
cgcaataggcttgcaaggaccacga

SEQ ID NO: 223212 - DNA, 25 bp, Mus musculus
agccgcaataggcttgcaaggacca

SEQ ID NO: 223213 - DNA, 25 bp, Mus musculus
cccagagccgcaataggcttgcaag

SEQ ID NO: 223214 - DNA, 25 bp, Mus musculus
aggggctgtgtgtttggagaggagc

SEQ ID NO: 223215 - DNA, 25 bp, Mus musculus
cgctcagcagctcaggaatgtttgc

SEQ ID NO: 223216 - DNA, 25 bp, Mus musculus
aaactccggtctagcacggcagcgg

SEQ ID NO: 223217 - DNA, 25 bp, Mus musculus
acggcagcgggagtttttacacaga

SEQ ID NO: 223218 - DNA, 25 bp, Mus musculus
tttacacagaccgaatcaagccaga

SEQ ID NO: 223219 - DNA, 25 bp, Mus musculus
atcaagccagaggatccggcgctgc

SEQ ID NO: 223220 - DNA, 25 bp, Mus musculus
gctggctgtctctccgggatctaga

SEQ ID NO: 223221 - DNA, 25 bp, Mus musculus
ccgggatctagaggaacgggccaca

SEQ ID NO: 223222 - DNA, 25 bp, Mus musculus
ccacacggatctagtgcggaactta

SEQ ID NO: 223223 - DNA, 25 bp, Mus musculus
tgactttttagaccagggctcggcg

SEQ ID NO: 223224 - DNA, 25 bp, Mus musculus
cgaccgcggagcctggctcaagaag

SEQ ID NO: 223225 - DNA, 25 bp, Mus musculus
agcggcggctgtaagtgcagcctcc

SEQ ID NO: 223226 - DNA, 25 bp, Mus musculus
agtgcagcctccacagaccatctta

SEQ ID NO: 223227 - DNA, 25 bp, Mus musculus
aggggcgctcgcagtctccttttcc

SEQ ID NO: 223228 - DNA, 25 bp, Mus musculus
tgctcgtcggagagctatgcatggt

SEQ ID NO: 223229 - DNA, 25 bp, Mus musculus
acccgccgcggcgatgtgacccggt

SEQ ID NO: 223230 - DNA, 25 bp, Mus musculus
gcgcacatccgggttctggccgcga

SEQ ID NO: 223231 - DNA, 25 bp, Mus musculus
caacatggcggaggtaagaacgagc

SEQ ID NO: 223232 - DNA, 25 bp, Mus musculus
gccgctgcccacctgttgtccggcc

SEQ ID NO: 223233 - DNA, 25 bp, Mus musculus
gctcggctgggcttcccgaaactaa

SEQ ID NO: 223234 - DNA, 25 bp, Mus musculus
ctcggctgggcttcccgaaactaag

SEQ ID NO: 223235 - DNA, 25 bp, Mus musculus
aggcgccgtcggacttgaggcagtt

SEQ ID NO: 223236 - DNA, 25 bp, Mus musculus
ggaagccgcccagggcgcaacttcg

SEQ ID NO: 223237 - DNA, 25 bp, Mus musculus
ctctctgcctgctcccgcgaacttt

SEQ ID NO: 223238 - DNA, 25 bp, Mus musculus
tgctcccgcgaactttcttccctcg

SEQ ID NO: 223239 - DNA, 25 bp, Mus musculus
ttcttccctcgcgagcccagaagtc

SEQ ID NO: 223240 - DNA, 25 bp, Mus musculus
gcccagaagtcgctgctcccgccag

SEQ ID NO: 223241 - DNA, 25 bp, Mus musculus
cgactgctgacctgccgtctaggca

SEQ ID NO: 223242 - DNA, 25 bp, Mus musculus
gcccaggcgcacatccgggttctgg

SEQ ID NO: 223243 - DNA, 25 bp, Mus musculus
ggaaggagctcacgccgtagaaacc

SEQ ID NO: 223244 - DNA, 25 bp, Mus musculus
ctggcgagcacagagttgcgcctgc

SEQ ID NO: 223245 - DNA, 25 bp, Mus musculus
actttgccctggcatggtgcctcgc

SEQ ID NO: 223246 - DNA, 25 bp, Mus musculus
gctgacgtctgtggacttccgccat

SEQ ID NO: 223247 - DNA, 25 bp, Mus musculus
taaccggagcatgctgacgtctgtg

SEQ ID NO: 223248 - DNA, 25 bp, Mus musculus
gggcttctcctttaaccggagcatg

SEQ ID NO: 223249 - DNA, 25 bp, Mus musculus
catctctgtgtgtggaggatttcgc

SEQ ID NO: 223250 - DNA, 25 bp, Mus musculus
cagctcctcctcatctctgtgtgtg

SEQ ID NO: 223251 - DNA, 25 bp, Mus musculus
gccagcagcttcaggaacaccgtta

SEQ ID NO: 223252 - DNA, 25 bp, Mus musculus
acgctcttgttgaccaccacgatga

SEQ ID NO: 223253 - DNA, 25 bp, Mus musculus
acctgtagttggtgagcacgctctt

SEQ ID NO: 223254 - DNA, 25 bp, Mus musculus
cagcccggccacctgtagttggtga

SEQ ID NO: 223255 - DNA, 25 bp, Mus musculus
ctgggcaccggcctcgttgtgcctt

SEQ ID NO: 223256 - DNA, 25 bp, Mus musculus
tcaggaacaccgttagcgtttcggc

SEQ ID NO: 223257 - DNA, 25 bp, Mus musculus
gcgagacggcgccacagtccgtaca

SEQ ID NO: 223258 - DNA, 25 bp, Mus musculus
tccttgtgcagagcgacacatgctc

SEQ ID NO: 223259 - DNA, 25 bp, Mus musculus
ttcctccaggcgttgccggtctggc

SEQ ID NO: 223260 - DNA, 25 bp, Mus musculus
ctaagcggcgcttcctccaggcgtt

SEQ ID NO: 223261 - DNA, 25 bp, Mus musculus
gtggcttcctcctaagcggcgcttc

SEQ ID NO: 223262 - DNA, 25 bp, Mus musculus
tgcctcccgcctcgggtggtggctt

SEQ ID NO: 223263 - DNA, 25 bp, Mus musculus
agctttctggaagtttgcctcccgc

SEQ ID NO: 223264 - DNA, 25 bp, Mus musculus
tgacggctcggcgttcttccagagc

SEQ ID NO: 223265 - DNA, 25 bp, Mus musculus
tgtggcttcagtgcgcgctcacggt

SEQ ID NO: 223266 - DNA, 25 bp, Mus musculus
ttggattccgctcgggctgtggctt

SEQ ID NO: 223267 - DNA, 25 bp, Mus musculus
cggagccggctgttggattccgctc

SEQ ID NO: 223268 - DNA, 25 bp, Mus musculus
tggctctcacaagggcggagcaaaa

SEQ ID NO: 223269 - DNA, 25 bp, Mus musculus
ccagctcgcagcattagcgcagtcg

SEQ ID NO: 223270 - DNA, 25 bp, Mus musculus
aacggacttggctctcacaagggcg

SEQ ID NO: 223271 - DNA, 25 bp, Mus musculus
atggcttcagtcgtccagccgtcgg

SEQ ID NO: 223272 - DNA, 25 bp, Mus musculus
cggtcgccctgttctgcagccagag

SEQ ID NO: 223273 - DNA, 25 bp, Mus musculus
ctgcagccagaggatgatgtgtcga

SEQ ID NO: 223274 - DNA, 25 bp, Mus musculus
cgccagggcaaggatggcttcagtc

SEQ ID NO: 223275 - DNA, 25 bp, Mus musculus
tccagccgtcgggtgggcgcctcat

SEQ ID NO: 223276 - DNA, 25 bp, Mus musculus
tcgcgttcccgcagccacgagggag

SEQ ID NO: 223277 - DNA, 25 bp, Mus musculus
gaaagaaaagtctgaagcccaaagc

SEQ ID NO: 223278 - DNA, 25 bp, Mus musculus
aagcccaaagccaagcggtggtggc

SEQ ID NO: 223279 - DNA, 25 bp, Mus musculus
ggctgtccgcagctcttggacttgg

SEQ ID NO: 223280 - DNA, 25 bp, Mus musculus
cttggacttggtggcgcgtttcgcc

SEQ ID NO: 223281 - DNA, 25 bp, Mus musculus
gtttcgccgcgctgaacggccaggc

SEQ ID NO: 223282 - DNA, 25 bp, Mus musculus
cggccgcagtgtgcgcaaagttttg

SEQ ID NO: 223283 - DNA, 25 bp, Mus musculus
gaacaaaagcagagtccggtcgccc

SEQ ID NO: 223284 - DNA, 25 bp, Mus musculus
actgcgggccgagagtcgcgttccc

SEQ ID NO: 223285 - DNA, 25 bp, Mus musculus
acttgtgagcatagaggcttggcta

SEQ ID NO: 223286 - DNA, 25 bp, Mus musculus
ctgcgcccgtctacttgtgagcata

SEQ ID NO: 223287 - DNA, 25 bp, Mus musculus
cttggctaaaagcaggcgctggaga

SEQ ID NO: 223288 - DNA, 25 bp, Mus musculus
cgctggagaatcagcagagtcctag

SEQ ID NO: 223289 - DNA, 25 bp, Mus musculus
aagctcttcgctccgatcggtctct

SEQ ID NO: 223290 - DNA, 25 bp, Mus musculus
cgatcggtctctactcccgggatgg

SEQ ID NO: 223291 - DNA, 25 bp, Mus musculus
gactccgctgagctgtcgctcggaa

SEQ ID NO: 223292 - DNA, 25 bp, Mus musculus
gttccggcggcgaacagagcgccct

SEQ ID NO: 223293 - DNA, 25 bp, Mus musculus
tcgcttcccggggaggatggaccca

SEQ ID NO: 223294 - DNA, 25 bp, Mus musculus
aggatggacccagctcggcgctcac

SEQ ID NO: 223295 - DNA, 25 bp, Mus musculus
ctgcggcagccaaggaggatgctcc

SEQ ID NO: 223296 - DNA, 25 bp, Mus musculus
ctttcggggcgcttctctagggagt

SEQ ID NO: 223297 - DNA, 25 bp, Mus musculus
agctgtcgctcggaacgcgttccgg

SEQ ID NO: 223298 - DNA, 25 bp, Mus musculus
cccttctgccaaggggctcggggca

SEQ ID NO: 223299 - DNA, 25 bp, Mus musculus
tcggactgggccaatcgcccaattc

SEQ ID NO: 223300 - DNA, 25 bp, Mus musculus
ctgcttctcagccatgttcggcgca

SEQ ID NO: 223301 - DNA, 25 bp, Mus musculus
gtgcttctgcttctcagccatgttc

SEQ ID NO: 223302 - DNA, 25 bp, Mus musculus
actttgccgaaggtgccgacgccca

SEQ ID NO: 223303 - DNA, 25 bp, Mus musculus
tgcactcactcttcactttgccgaa

SEQ ID NO: 223304 - DNA, 25 bp, Mus musculus
cgcccgcgagcgctccacctgccac

SEQ ID NO: 223305 - DNA, 25 bp, Mus musculus
ggcatagagaaaagacagggcgctc

SEQ ID NO: 223306 - DNA, 25 bp, Mus musculus
ctgcagacaagcgagctgaggcata

SEQ ID NO: 223307 - DNA, 25 bp, Mus musculus
ggccaatcgcccaattctgcagaca

SEQ ID NO: 223308 - DNA, 25 bp, Mus musculus
gggcccttcggactgggccaatcgc

SEQ ID NO: 223309 - DNA, 25 bp, Mus musculus
ctcagccatgttcggcgcacgggct

SEQ ID NO: 223310 - DNA, 25 bp, Mus musculus
atagagaaaagacagggcgctcgga

SEQ ID NO: 223311 - DNA, 25 bp, Mus musculus
cccaattctgcagacaagcgagctg

SEQ ID NO: 223312 - DNA, 25 bp, Mus musculus
cgagctgaggcatagagaaaagaca

SEQ ID NO: 223313 - DNA, 25 bp, Mus musculus
cagagccgaggcgtcccgagaaaag

SEQ ID NO: 223314 - DNA, 25 bp, Mus musculus
gccatgcctcgggaccagagggcaa

SEQ ID NO: 223315 - DNA, 25 bp, Mus musculus
accgtgagccatgcctcgggaccag

SEQ ID NO: 223316 - DNA, 25 bp, Mus musculus
tagaccgtgagccatgcctcgggac

SEQ ID NO: 223317 - DNA, 25 bp, Mus musculus
gggtgtagaccgtgagccatgcctc

SEQ ID NO: 223318 - DNA, 25 bp, Mus musculus
cgaccgagatggaaggagaatctga

SEQ ID NO: 223319 - DNA, 25 bp, Mus musculus
cgcgaccgagatggaaggagaatct

SEQ ID NO: 223320 - DNA, 25 bp, Mus musculus
gaatctgagcgcgaccgagatggaa

SEQ ID NO: 223321 - DNA, 25 bp, Mus musculus
ggatgaatctgagcgcgaccgagat

SEQ ID NO: 223322 - DNA, 25 bp, Mus musculus
aagggatgaatctgagcgcgaccga

SEQ ID NO: 223323 - DNA, 25 bp, Mus musculus
gcggtgaagatggaagggatgaatc

SEQ ID NO: 223324 - DNA, 25 bp, Mus musculus
aagcccagggcggtgaagatggaag

SEQ ID NO: 223325 - DNA, 25 bp, Mus musculus
gaccagagggcaaggcgctggagag

SEQ ID NO: 223326 - DNA, 25 bp, Mus musculus
cgaggcgtcccgagaaaagcccagg

SEQ ID NO: 223327 - DNA, 25 bp, Mus musculus
gaccgacgtcgctcgccaatcagaa

SEQ ID NO: 223328 - DNA, 25 bp, Mus musculus
agcacatggttccaagagcgcgctg

SEQ ID NO: 223329 - DNA, 25 bp, Mus musculus
ccagcctgtcatcgtctgttgaggc

SEQ ID NO: 223330 - DNA, 25 bp, Mus musculus
tgaacgctgaatctcgtgacgccca

SEQ ID NO: 223331 - DNA, 25 bp, Mus musculus
gccgcaaagccgtactgaacgctga

SEQ ID NO: 223332 - DNA, 25 bp, Mus musculus
ctgcgtgcgcttacggagacaaagc

SEQ ID NO: 223333 - DNA, 25 bp, Mus musculus
cggccaaacaagatccggtcacgtg

SEQ ID NO: 223334 - DNA, 25 bp, Mus musculus
gtactgttcctttaaatggccgaga

SEQ ID NO: 223335 - DNA, 25 bp, Mus musculus
cccggcgacaagacaagatggctcc

SEQ ID NO: 223336 - DNA, 25 bp, Mus musculus
gcttcttcgagttaggggcctgact

SEQ ID NO: 223337 - DNA, 25 bp, Mus musculus
cgcccgagttctgcgtacgagaaga

SEQ ID NO: 223338 - DNA, 25 bp, Mus musculus
ctgcggtggttgagttccaattcca

SEQ ID NO: 223339 - DNA, 25 bp, Mus musculus
gccagagcaggagaaagagccgcca

SEQ ID NO: 223340 - DNA, 25 bp, Mus musculus
ccctcgtcggatcgcaaaagcatag

SEQ ID NO: 223341 - DNA, 25 bp, Mus musculus
ccagcgccatgcaaagctacaagta

SEQ ID NO: 223342 - DNA, 25 bp, Mus musculus
tccggggcagcacagttctgcaaaa

SEQ ID NO: 223343 - DNA, 25 bp, Mus musculus
ctgcaaaagttcctgctcgggattt

SEQ ID NO: 223344 - DNA, 25 bp, Mus musculus
tacccgcgtctgcagttggaactac

SEQ ID NO: 223345 - DNA, 25 bp, Mus musculus
ggcgatcgtccctgagagtaagaac

SEQ ID NO: 223346 - DNA, 25 bp, Mus musculus
tgctcatctgcctggacctcttctg

SEQ ID NO: 223347 - DNA, 25 bp, Mus musculus
cctcttcatgggtgagcgcagtccc

SEQ ID NO: 223348 - DNA, 25 bp, Mus musculus
acctccttaggggtgatctccagct

SEQ ID NO: 223349 - DNA, 25 bp, Mus musculus
atggaggaaacctgtggctctctgc

SEQ ID NO: 223350 - DNA, 25 bp, Mus musculus
ggctctctgctctgtatccgagtca

SEQ ID NO: 223351 - DNA, 25 bp, Mus musculus
tccgagtcagatgcgagtgagaccc

SEQ ID NO: 223352 - DNA, 25 bp, Mus musculus
ctcgtcccggctgcatgtaaacatc

SEQ ID NO: 223353 - DNA, 25 bp, Mus musculus
tccgcgctgctccattcattaagta

SEQ ID NO: 223354 - DNA, 25 bp, Mus musculus
cggcgctcaacaacaacccgaggaa

SEQ ID NO: 223355 - DNA, 25 bp, Mus musculus
ctgctccgggttccggaagtcgagc

SEQ ID NO: 223356 - DNA, 25 bp, Mus musculus
ggcaccgccacgttcgcgcacgcgc

SEQ ID NO: 223357 - DNA, 25 bp, Mus musculus
acgacgctcaagacccgcgaggggt

SEQ ID NO: 223358 - DNA, 25 bp, Mus musculus
acgacgacgctcaagacccgcgagg

SEQ ID NO: 223359 - DNA, 25 bp, Mus musculus
acaggcgtcacgacgacgctcaaga

SEQ ID NO: 223360 - DNA, 25 bp, Mus musculus
tgaaactccacaggcgtcacgacga

SEQ ID NO: 223361 - DNA, 25 bp, Mus musculus
tagccgttgagagacattttttaaa

SEQ ID NO: 223362 - DNA, 25 bp, Mus musculus
cgcgtagccgttgagagacattttt

SEQ ID NO: 223363 - DNA, 25 bp, Mus musculus
cgtcgcgtagccgttgagagacatt

SEQ ID NO: 223364 - DNA, 25 bp, Mus musculus
cgcgtctcagggtcgtcgcgtagcc

SEQ ID NO: 223365 - DNA, 25 bp, Mus musculus
ttccgtgcaggctaccgcgtctcag

SEQ ID NO: 223366 - DNA, 25 bp, Mus musculus
tggctaaggccctggggtccccaca

SEQ ID NO: 223367 - DNA, 25 bp, Mus musculus
tcctgctccgggttccggaagtcga

SEQ ID NO: 223368 - DNA, 25 bp, Mus musculus
tggggtccccacaggccaccgagga

SEQ ID NO: 223369 - DNA, 25 bp, Mus musculus
cacagttctcttgatgcgggcccag

SEQ ID NO: 223370 - DNA, 25 bp, Mus musculus
ccctgcctctgagtgacagcagcgt

SEQ ID NO: 223371 - DNA, 25 bp, Mus musculus
tgacagcagcgtggacagctgccca

SEQ ID NO: 223372 - DNA, 25 bp, Mus musculus
agttgggccgccctcgctgggcaat

SEQ ID NO: 223373 - DNA, 25 bp, Mus musculus
ttcggggtcacagttctcttgatgc

SEQ ID NO: 223374 - DNA, 25 bp, Mus musculus
tttcgactgttttggcttctccggc

SEQ ID NO: 223375 - DNA, 25 bp, Mus musculus
ccagggctggaaacgcgctttccca

SEQ ID NO: 223376 - DNA, 25 bp, Mus musculus
tggaaacgcgctttcccagcgtctc

SEQ ID NO: 223377 - DNA, 25 bp, Mus musculus
cccgtggagactgtagatctggcct

SEQ ID NO: 223378 - DNA, 25 bp, Mus musculus
gactgtagatctggcctggggaaca

SEQ ID NO: 223379 - DNA, 25 bp, Mus musculus
ctgagcatccggaggctcctccagg

SEQ ID NO: 223380 - DNA, 25 bp, Mus musculus
ctcctccaggggatctgggctccga

SEQ ID NO: 223381 - DNA, 25 bp, Mus musculus
ttctccggcccagagagaatggcca

SEQ ID NO: 223382 - DNA, 25 bp, Mus musculus
ctgggcaatgctgaggtgtgtttcc

SEQ ID NO: 223383 - DNA, 25 bp, Mus musculus
cgcctggccaagaacgacatcaacg

SEQ ID NO: 223384 - DNA, 25 bp, Mus musculus
agtcacctgcgatgggacacgagtg

SEQ ID NO: 223385 - DNA, 25 bp, Mus musculus
gacacgagtgtcgtcagggcaccga

SEQ ID NO: 223386 - DNA, 25 bp, Mus musculus
ctcccgtcccagagggaacctgttg

SEQ ID NO: 223387 - DNA, 25 bp, Mus musculus
aggactctcgtgctctctctgcgct

SEQ ID NO: 223388 - DNA, 25 bp, Mus musculus
ggcctctcacctcagacacgttcgg

SEQ ID NO: 223389 - DNA, 25 bp, Mus musculus
acatgaccacgctgctgtgcatggg

SEQ ID NO: 223390 - DNA, 25 bp, Mus musculus
aagaacgacatcaacgaggccgtgg

SEQ ID NO: 223391 - DNA, 25 bp, Mus musculus
gtggcgctgctcaccaacgagcggc

SEQ ID NO: 223392 - DNA, 25 bp, Mus musculus
ccggcctcgactacggtggctacga

SEQ ID NO: 223393 - DNA, 25 bp, Mus musculus
tacggtggctacgagcccatggata

SEQ ID NO: 223394 - DNA, 25 bp, Mus musculus
acgagcccatggatagcggcggccc

SEQ ID NO: 223395 - DNA, 25 bp, Mus musculus
gtgagtggggttgccctgacctcac

SEQ ID NO: 223396 - DNA, 25 bp, Mus musculus
aatcggaggaggagcagcacatgac

SEQ ID NO: 223397 - DNA, 25 bp, Mus musculus
aaggatcaggtttcggcctcgccct

SEQ ID NO: 223398 - DNA, 25 bp, Mus musculus
ctctggggagccaaggactggctca

SEQ ID NO: 223399 - DNA, 25 bp, Mus musculus
atggacgcctgggactcggggcact

SEQ ID NO: 223400 - DNA, 25 bp, Mus musculus
ggcctcgggaaggacatggacgcct

SEQ ID NO: 223401 - DNA, 25 bp, Mus musculus
gctcagtcctctagcctcagaaaga

SEQ ID NO: 223402 - DNA, 25 bp, Mus musculus
gtcctctagcctcagaaagagagag

SEQ ID NO: 223403 - DNA, 25 bp, Mus musculus
agagagaacgggagcccaccggcag

SEQ ID NO: 223404 - DNA, 25 bp, Mus musculus
gcagcctgcgcgtccacgtgaaggt

SEQ ID NO: 223405 - DNA, 25 bp, Mus musculus
cgcgtccacgtgaaggtggaagcct

SEQ ID NO: 223406 - DNA, 25 bp, Mus musculus
cccatcggaagatcctctctgatta

SEQ ID NO: 223407 - DNA, 25 bp, Mus musculus
tcggaagatcctctctgattaaaca

SEQ ID NO: 223408 - DNA, 25 bp, Mus musculus
tctctgattaaacattaacgggccc

SEQ ID NO: 223409 - DNA, 25 bp, Mus musculus
tactaaaggatcaggtttcggcctc

SEQ ID NO: 223410 - DNA, 25 bp, Mus musculus
ggactggctcagtcctctagcctca

SEQ ID NO: 223411 - DNA, 25 bp, Mus musculus
gaaggggttggagttcgttctcatc

SEQ ID NO: 223412 - DNA, 25 bp, Mus musculus
catccagaaacaggtgagcggcgcg

SEQ ID NO: 223413 - DNA, 25 bp, Mus musculus
cagcgcgtgcgggacatccagaaac

SEQ ID NO: 223414 - DNA, 25 bp, Mus musculus
gtgttcaagctgagcagtgcgccgc

SEQ ID NO: 223415 - DNA, 25 bp, Mus musculus
atctactactacgtgcgcgcctggg

SEQ ID NO: 223416 - DNA, 25 bp, Mus musculus
tgccgctctcgctcatcttcgatat

SEQ ID NO: 223417 - DNA, 25 bp, Mus musculus
gtgtgcctcttcttgctgccgctct

SEQ ID NO: 223418 - DNA, 25 bp, Mus musculus
gttcgttctcatccaccagcgctgg

SEQ ID NO: 223419 - DNA, 25 bp, Mus musculus
ttggcgacccaagccaatcgcgagg

SEQ ID NO: 223420 - DNA, 25 bp, Mus musculus
gctcaccattggtcgccgcctgggt

SEQ ID NO: 223421 - DNA, 25 bp, Mus musculus
agccaatgaacgcagcggctccctg

SEQ ID NO: 223422 - DNA, 25 bp, Mus musculus
ctcgcacgccgactagaagagggtg

SEQ ID NO: 223423 - DNA, 25 bp, Mus musculus
gctgcctccagagcgagagccctaa

SEQ ID NO: 223424 - DNA, 25 bp, Mus musculus
atccaccagcgctgggtgttcgtgt

SEQ ID NO: 223425 - DNA, 25 bp, Mus musculus
gaggacctggacacccttctcgatg

SEQ ID NO: 223426 - DNA, 25 bp, Mus musculus
tgggtaccacccacttgcaagaggt

SEQ ID NO: 223427 - DNA, 25 bp, Mus musculus
agggatatgcgcatggcttcgacgt

SEQ ID NO: 223428 - DNA, 25 bp, Mus musculus
acccttctcgatgaactggactatc

SEQ ID NO: 223429 - DNA, 25 bp, Mus musculus
aactggactatctgcccggccactt

SEQ ID NO: 223430 - DNA, 25 bp, Mus musculus
cacttccacctggagatgcagctca

SEQ ID NO: 223431 - DNA, 25 bp, Mus musculus
acctgaagctccagcgagagggtct

SEQ ID NO: 223432 - DNA, 25 bp, Mus musculus
cgtgcgtcacctcttgggaaccttt

SEQ ID NO: 223433 - DNA, 25 bp, Mus musculus
gtgatgcccgcgagcatttcctgga

SEQ ID NO: 223434 - DNA, 25 bp, Mus musculus
atttcctggaagtggcccgcaaaga

SEQ ID NO: 223435 - DNA, 25 bp, Mus musculus
aacctcaacgcctgggccaatctgg

SEQ ID NO: 223436 - DNA, 25 bp, Mus musculus
gaaacacctacagggcgagcccttg

SEQ ID NO: 223437 - DNA, 25 bp, Mus musculus
ccaatctggcacacgtctacgggca

SEQ ID NO: 223438 - DNA, 25 bp, Mus musculus
gcgggcatcgccctctacgacaaag

SEQ ID NO: 223439 - DNA, 25 bp, Mus musculus
cgaactgcaactgctgcgcggcaaa

SEQ ID NO: 223440 - DNA, 25 bp, Mus musculus
aggtgacacgctgcccgaactgcaa

SEQ ID NO: 223441 - DNA, 25 bp, Mus musculus
ctgctgcgcggcaaatgcctacgtg

SEQ ID NO: 223442 - DNA, 25 bp, Mus musculus
aatgcctacgtgtccagggtgagga

SEQ ID NO: 223443 - DNA, 25 bp, Mus musculus
gatgccaacgctgcggcctgcttca

SEQ ID NO: 223444 - DNA, 25 bp, Mus musculus
cctgcttcaagcgtgccgtagagct

SEQ ID NO: 223445 - DNA, 25 bp, Mus musculus
acgacgagggatccagccataccga

SEQ ID NO: 223446 - DNA, 25 bp, Mus musculus
ccataccgagggcttcggctgcctg

SEQ ID NO: 223447 - DNA, 25 bp, Mus musculus
ctgcctgctcgaggcattgctggcc

SEQ ID NO: 223448 - DNA, 25 bp, Mus musculus
cattgctggcccagtggagccaggc

SEQ ID NO: 223449 - DNA, 25 bp, Mus musculus
tggacgtctggctgcgccatgccca

SEQ ID NO: 223450 - DNA, 25 bp, Mus musculus
ctgcgccatgcccagggcaagtatc

SEQ ID NO: 223451 - DNA, 25 bp, Mus musculus
gcaagtatccggcagcacgcctgcg

SEQ ID NO: 223452 - DNA, 25 bp, Mus musculus
agttggagctaggtgacacgctgcc

SEQ ID NO: 223453 - DNA, 25 bp, Mus musculus
aggcgcactggctttgcgtgactga

SEQ ID NO: 223454 - DNA, 25 bp, Mus musculus
caggctattggatagtcgtgtgctc

SEQ ID NO: 223455 - DNA, 25 bp, Mus musculus
ctctcagtcgccacaggctattgga

SEQ ID NO: 223456 - DNA, 25 bp, Mus musculus
gctgtctcgcgtgcatcctctcagt

SEQ ID NO: 223457 - DNA, 25 bp, Mus musculus
cacgatctggtgtctgctgtctcgc

SEQ ID NO: 223458 - DNA, 25 bp, Mus musculus
tgggcacgcgcacccacgatctggt

SEQ ID NO: 223459 - DNA, 25 bp, Mus musculus
atctagggacagtttctgggcacgc

SEQ ID NO: 223460 - DNA, 25 bp, Mus musculus
gcccagcgaatctagggacagtttc

SEQ ID NO: 223461 - DNA, 25 bp, Mus musculus
ttgcgtgactgaagagcgcccgact

SEQ ID NO: 223462 - DNA, 25 bp, Mus musculus
ctttccgattggtgagaaacacagg

SEQ ID NO: 223463 - DNA, 25 bp, Mus musculus
cctcccgtgagtgcggctttccgat

SEQ ID NO: 223464 - DNA, 25 bp, Mus musculus
tctccagagcgtgggaccggagcat

SEQ ID NO: 223465 - DNA, 25 bp, Mus musculus
ttgctttccggaaaacctctccagc

SEQ ID NO: 223466 - DNA, 25 bp, Mus musculus
gcgcccgactcaggtattgagttgc

SEQ ID NO: 223467 - DNA, 25 bp, Mus musculus
gcggacggtttctaccagtgaccaa

SEQ ID NO: 223468 - DNA, 25 bp, Mus musculus
cttatacgcaaaacctcgaggcgga

SEQ ID NO: 223469 - DNA, 25 bp, Mus musculus
tgaccaagcctcgaggaccaagctc

SEQ ID NO: 223470 - DNA, 25 bp, Mus musculus
aagccgccgcggtaaggctggctct

SEQ ID NO: 223471 - DNA, 25 bp, Mus musculus
aacttttccaggaacgcgtccatgg

SEQ ID NO: 223472 - DNA, 25 bp, Mus musculus
cgcgtccatggaagcgtcctctgta

SEQ ID NO: 223473 - DNA, 25 bp, Mus musculus
agcgtcctctgtaggctcaggctca

SEQ ID NO: 223474 - DNA, 25 bp, Mus musculus
tctccatggcagctcgcaacttcgg

SEQ ID NO: 223475 - DNA, 25 bp, Mus musculus
caacttcggcgcttcagtcccggga

SEQ ID NO: 223476 - DNA, 25 bp, Mus musculus
tcagtcccgggaccaagaaacgcgc

SEQ ID NO: 223477 - DNA, 25 bp, Mus musculus
gatgcccttccttttgcagtccggg

SEQ ID NO: 223478 - DNA, 25 bp, Mus musculus
tgcgcgaggctatgcctctcgggtt

SEQ ID NO: 223479 - DNA, 25 bp, Mus musculus
gctcagaactctccatggcagctcg

SEQ ID NO: 223480 - DNA, 25 bp, Mus musculus
cgtggtcttaaacgcagtcaactta

SEQ ID NO: 223481 - DNA, 25 bp, Mus musculus
gagcaccgcgatgcccaggccgcgc

SEQ ID NO: 223482 - DNA, 25 bp, Mus musculus
cgcgacacttttctttggagtccga

SEQ ID NO: 223483 - DNA, 25 bp, Mus musculus
ccacgcgacacttttctttggagtc

SEQ ID NO: 223484 - DNA, 25 bp, Mus musculus
cgcgactgccgctcatcaaagtgct

SEQ ID NO: 223485 - DNA, 25 bp, Mus musculus
agggccgcgactgccgctcatcaaa

SEQ ID NO: 223486 - DNA, 25 bp, Mus musculus
gaaaagggccgcgactgccgctcat

SEQ ID NO: 223487 - DNA, 25 bp, Mus musculus
cgcggtccgctgtggtcgctgaccg

SEQ ID NO: 223488 - DNA, 25 bp, Mus musculus
gtagagcggagcaccgcgatgccca

SEQ ID NO: 223489 - DNA, 25 bp, Mus musculus
accacagtatgtgcgtgggtgagtt

SEQ ID NO: 223490 - DNA, 25 bp, Mus musculus
ttgaaccacagtatgtgcgtgggtg

SEQ ID NO: 223491 - DNA, 25 bp, Mus musculus
aagtttgaaccacagtatgtgcgtg

SEQ ID NO: 223492 - DNA, 25 bp, Mus musculus
gacacttttctttggagtccgaata

SEQ ID NO: 223493 - DNA, 25 bp, Mus musculus
cccgctgagtgaaaagggccgcgac

SEQ ID NO: 223494 - DNA, 25 bp, Mus musculus
taaaatacggtaacagaatatgacg

SEQ ID NO: 223495 - DNA, 25 bp, Mus musculus
ccggaagccacagtcgctctgcaga

SEQ ID NO: 223496 - DNA, 25 bp, Mus musculus
aggcgcccgtcgcagctccctcctg

SEQ ID NO: 223497 - DNA, 25 bp, Mus musculus
ccgccgctcagctaggcggtgccgc

SEQ ID NO: 223498 - DNA, 25 bp, Mus musculus
taaatcaaacgctcctgcagcagcc

SEQ ID NO: 223499 - DNA, 25 bp, Mus musculus
gcttaataaatcaaacgctcctgca

SEQ ID NO: 223500 - DNA, 25 bp, Mus musculus
tgctagaacattagcttaataaatc

SEQ ID NO: 223501 - DNA, 25 bp, Mus musculus
cgggatggagaaaatgtgctagaac

SEQ ID NO: 223502 - DNA, 25 bp, Mus musculus
tggaaacagctcattacgggatgga

SEQ ID NO: 223503 - DNA, 25 bp, Mus musculus
ggaagccacagtcgctctgcagaca

SEQ ID NO: 223504 - DNA, 25 bp, Mus musculus
gagcggccggaagccacagtcgctc

SEQ ID NO: 223505 - DNA, 25 bp, Mus musculus
tccctcctgccttggcggagctagg

SEQ ID NO: 223506 - DNA, 25 bp, Mus musculus
ggagaaaatgtgctagaacattagc

SEQ ID NO: 223507 - DNA, 25 bp, Mus musculus
ccctggtggaaacagctcattacgg

SEQ ID NO: 223508 - DNA, 25 bp, Mus musculus
gctcattacgggatggagaaaatgt

SEQ ID NO: 223509 - DNA, 25 bp, Mus musculus
caaatgccctcgtcgcccggttgag

SEQ ID NO: 223510 - DNA, 25 bp, Mus musculus
gcacaaggcacttcgcgggaaaagg

SEQ ID NO: 223511 - DNA, 25 bp, Mus musculus
ggggatgattcctactgcaaatgcc

SEQ ID NO: 223512 - DNA, 25 bp, Mus musculus
gactgacaggcatccatcccgcgaa

SEQ ID NO: 223513 - DNA, 25 bp, Mus musculus
agaacctgtcaactgcttccctgtc

SEQ ID NO: 223514 - DNA, 25 bp, Mus musculus
aggctaggaggcttgttctacccaa

SEQ ID NO: 223515 - DNA, 25 bp, Mus musculus
agacattgggtccaggctctacgca

SEQ ID NO: 223516 - DNA, 25 bp, Mus musculus
cccattcgagttccggccaacgatt

SEQ ID NO: 223517 - DNA, 25 bp, Mus musculus
aaccatctcgaagtaagggccgcca

SEQ ID NO: 223518 - DNA, 25 bp, Mus musculus
cccggagtccgatgaagtcatgata

SEQ ID NO: 223519 - DNA, 25 bp, Mus musculus
cacggacacagtttggatactatgg

SEQ ID NO: 223520 - DNA, 25 bp, Mus musculus
tggttacgcgatccgacccaaacag

SEQ ID NO: 223521 - DNA, 25 bp, Mus musculus
ggccgccagaggaggaaattccttc

SEQ ID NO: 223522 - DNA, 25 bp, Mus musculus
cgcacctactcgtctgtggctcaga

SEQ ID NO: 223523 - DNA, 25 bp, Mus musculus
gttcggttgagctccaagtagacca

SEQ ID NO: 223524 - DNA, 25 bp, Mus musculus
caggctcgggaaaagtaagcctctc

SEQ ID NO: 223525 - DNA, 25 bp, Mus musculus
aagtaagcctctcgcgagtggggcc

SEQ ID NO: 223526 - DNA, 25 bp, Mus musculus
aaggcaaaggctcggcggtgccctc

SEQ ID NO: 223527 - DNA, 25 bp, Mus musculus
ttgccaaaggcaaaggctcggcggt

SEQ ID NO: 223528 - DNA, 25 bp, Mus musculus
ccatgtttgccaaaggcaaaggctc

SEQ ID NO: 223529 - DNA, 25 bp, Mus musculus
agctccaagtagaccagcggcggcg

SEQ ID NO: 223530 - DNA, 25 bp, Mus musculus
cgtggagagcccattgttgggcgcc

SEQ ID NO: 223531 - DNA, 25 bp, Mus musculus
gccacgttcggttgagctccaagta

SEQ ID NO: 223532 - DNA, 25 bp, Mus musculus
ggcagccacgttcggttgagctcca

SEQ ID NO: 223533 - DNA, 25 bp, Mus musculus
tgctgacaggcgtccctctcggcct

SEQ ID NO: 223534 - DNA, 25 bp, Mus musculus
ggtgctccagtccacgcccgagccc

SEQ ID NO: 223535 - DNA, 25 bp, Mus musculus
tcttctctgcaagccatgtttgcca

SEQ ID NO: 223536 - DNA, 25 bp, Mus musculus
cgggaaaagtaagcctctcgcgagt

SEQ ID NO: 223537 - DNA, 25 bp, Mus musculus
cagtgtaagtgccaacgggcgagct

SEQ ID NO: 223538 - DNA, 25 bp, Mus musculus
ctcgggctggtactgttaattacta

SEQ ID NO: 223539 - DNA, 25 bp, Mus musculus
ctccagccctgtgcagtgtaagtgc

SEQ ID NO: 223540 - DNA, 25 bp, Mus musculus
gcggatggtgggactctccagccct

SEQ ID NO: 223541 - DNA, 25 bp, Mus musculus
ttatttgcagctgggagcccgcggc

SEQ ID NO: 223542 - DNA, 25 bp, Mus musculus
cggacattctggcaccgcgagggaa

SEQ ID NO: 223543 - DNA, 25 bp, Mus musculus
atccgcaagactaggcgggcggtct

SEQ ID NO: 223544 - DNA, 25 bp, Mus musculus
tcgccttcctcgagagcgagcgagg

SEQ ID NO: 223545 - DNA, 25 bp, Mus musculus
gcagataaatgcagtcgccttcctc

SEQ ID NO: 223546 - DNA, 25 bp, Mus musculus
ccggacgccctgcagataaatgcag

SEQ ID NO: 223547 - DNA, 25 bp, Mus musculus
gacctcccgcatgacacagatgtct

SEQ ID NO: 223548 - DNA, 25 bp, Mus musculus
cgggtctgcccattgttaacatata

SEQ ID NO: 223549 - DNA, 25 bp, Mus musculus
acgccgcctgtgacagtggcaatcc

SEQ ID NO: 223550 - DNA, 25 bp, Mus musculus
attactatgccgatgaccgatgacc

SEQ ID NO: 223551 - DNA, 25 bp, Mus musculus
gtgcttcttgccctcgtaggtaatg

SEQ ID NO: 223552 - DNA, 25 bp, Mus musculus
cgacgcctcatgagttctggaactg

SEQ ID NO: 223553 - DNA, 25 bp, Mus musculus
taaaatgccttagcgggtccgacgc

SEQ ID NO: 223554 - DNA, 25 bp, Mus musculus
gcccggtctcctcgctgtaaaatta

SEQ ID NO: 223555 - DNA, 25 bp, Mus musculus
ttgacccttaggcatttagaacgtg

SEQ ID NO: 223556 - DNA, 25 bp, Mus musculus
agggacctcagatctgtactttgca

SEQ ID NO: 223557 - DNA, 25 bp, Mus musculus
gtgccacacgtgaagaaacttgctg

SEQ ID NO: 223558 - DNA, 25 bp, Mus musculus
caggcagttcccatccttattggtg

SEQ ID NO: 223559 - DNA, 25 bp, Mus musculus
ggggatctcgtacaccctgtccagg

SEQ ID NO: 223560 - DNA, 25 bp, Mus musculus
ccagccacgggacgaagtgcttctt

SEQ ID NO: 223561 - DNA, 25 bp, Mus musculus
ggcgccgaacgcgagttacttttgc

SEQ ID NO: 223562 - DNA, 25 bp, Mus musculus
tgctgctaagttttccgattcccgg

SEQ ID NO: 223563 - DNA, 25 bp, Mus musculus
caatgacgggtttttgcgaatgaca

SEQ ID NO: 223564 - DNA, 25 bp, Mus musculus
gggtacctctttctatgccagcttg

SEQ ID NO: 223565 - DNA, 25 bp, Mus musculus
cacaaatgtgcggaatcggcgagcc

SEQ ID NO: 223566 - DNA, 25 bp, Mus musculus
tcctgacctaactagcagcgcgggg

SEQ ID NO: 223567 - DNA, 25 bp, Mus musculus
cttgctcctgcggaaattgccggaa

SEQ ID NO: 223568 - DNA, 25 bp, Mus musculus
cggtgcagctgcagttttccttgct

SEQ ID NO: 223569 - DNA, 25 bp, Mus musculus
gccctagtggtgaagctgtgcttca

SEQ ID NO: 223570 - DNA, 25 bp, Mus musculus
gcctttgactcggtcctgggagaca

SEQ ID NO: 223571 - DNA, 25 bp, Mus musculus
actgcagcggccgaagcctttgact

SEQ ID NO: 223572 - DNA, 25 bp, Mus musculus
caacaattcgagctgctgtgacaga

SEQ ID NO: 223573 - DNA, 25 bp, Mus musculus
cacgagaggttttccgtcccagaga

SEQ ID NO: 223574 - DNA, 25 bp, Mus musculus
ttcccagaacgcactgcgaggcgtg

SEQ ID NO: 223575 - DNA, 25 bp, Mus musculus
tggtgacccgcaggaactacacttc

SEQ ID NO: 223576 - DNA, 25 bp, Mus musculus
gggccgcgcgttgtaactatttgta

SEQ ID NO: 223577 - DNA, 25 bp, Mus musculus
ccgctgctgctgttgactatggcgc

SEQ ID NO: 223578 - DNA, 25 bp, Mus musculus
cggacgcaggcgtgcacaaaatagt

SEQ ID NO: 223579 - DNA, 25 bp, Mus musculus
ctaggccacaaagcccgtgagggtg

SEQ ID NO: 223580 - DNA, 25 bp, Mus musculus
gtcctttcgcggagctacccaaggc

SEQ ID NO: 223581 - DNA, 25 bp, Mus musculus
ctgggaactcctctgaggctgaggc

SEQ ID NO: 223582 - DNA, 25 bp, Mus musculus
gcgcgcgcctgggaactcctctgag

SEQ ID NO: 223583 - DNA, 25 bp, Mus musculus
acgcgcaagtgaggtggcgcttcta

SEQ ID NO: 223584 - DNA, 25 bp, Mus musculus
ggtagtcctgaggaaagacgcgcaa

SEQ ID NO: 223585 - DNA, 25 bp, Mus musculus
caatgcaatgtaaaggtagtcctga

SEQ ID NO: 223586 - DNA, 25 bp, Mus musculus
cccgaggcaatgcaatgtaaaggta

SEQ ID NO: 223587 - DNA, 25 bp, Mus musculus
agcccgtgagggtgggacacacaca

SEQ ID NO: 223588 - DNA, 25 bp, Mus musculus
gcggctcggcaacctaggccacaaa

SEQ ID NO: 223589 - DNA, 25 bp, Mus musculus
accgggaagcggctcggcaacctag

SEQ ID NO: 223590 - DNA, 25 bp, Mus musculus
ttcctccactgagcggctgaccggg

SEQ ID NO: 223591 - DNA, 25 bp, Mus musculus
gagcggctgcacctcactggcggct

SEQ ID NO: 223592 - DNA, 25 bp, Mus musculus
ttgggacagccgagctgagaaagcc

SEQ ID NO: 223593 - DNA, 25 bp, Mus musculus
aagaccaccgagagggcgggactca

SEQ ID NO: 223594 - DNA, 25 bp, Mus musculus
gaactcctgagaattcgccccactt

SEQ ID NO: 223595 - DNA, 25 bp, Mus musculus
tctctttaagaccaccgagagggcg

SEQ ID NO: 223596 - DNA, 25 bp, Mus musculus
cggatctccggcttccgggattgga

SEQ ID NO: 223597 - DNA, 25 bp, Mus musculus
cgggactcagcaccgagttacttgg

SEQ ID NO: 223598 - DNA, 25 bp, Mus musculus
tcagcaccgagttacttggcgctcc

SEQ ID NO: 223599 - DNA, 25 bp, Mus musculus
ttacttggcgctccggtgtcttccg

SEQ ID NO: 223600 - DNA, 25 bp, Mus musculus
tgtcttccgcgttttccgagtcttc

SEQ ID NO: 223601 - DNA, 25 bp, Mus musculus
ttttccgagtcttcgctgggtgacc

SEQ ID NO: 223602 - DNA, 25 bp, Mus musculus
gggtgaccgcgtttgctttaagaga

SEQ ID NO: 223603 - DNA, 25 bp, Mus musculus
ccgcgtttgctttaagagaggaggc

SEQ ID NO: 223604 - DNA, 25 bp, Mus musculus
gaggaggcggagaaatctaacaccc

SEQ ID NO: 223605 - DNA, 25 bp, Mus musculus
cacttcgcctgtctctttaagacca

SEQ ID NO: 223606 - DNA, 25 bp, Mus musculus
tccggcttccgggattggactgacc

SEQ ID NO: 223607 - DNA, 25 bp, Mus musculus
ttcctgcctttgaacagtggtggcg

SEQ ID NO: 223608 - DNA, 25 bp, Mus musculus
atgcagcaccgtcgccctttgtttt

SEQ ID NO: 223609 - DNA, 25 bp, Mus musculus
gccctttgtttttgacgcccagatg

SEQ ID NO: 223610 - DNA, 25 bp, Mus musculus
cgcccagatggaccctgcttcggaa

SEQ ID NO: 223611 - DNA, 25 bp, Mus musculus
aggactttttggactccagaggacg

SEQ ID NO: 223612 - DNA, 25 bp, Mus musculus
ccagaggacgcttcctcgagtcaca

SEQ ID NO: 223613 - DNA, 25 bp, Mus musculus
gagtcacagcccacctggaggcatg

SEQ ID NO: 223614 - DNA, 25 bp, Mus musculus
tggcggctttgcagaaccctgccca

SEQ ID NO: 223615 - DNA, 25 bp, Mus musculus
atctccatggccacggctgcgagcg

SEQ ID NO: 223616 - DNA, 25 bp, Mus musculus
atcctttggcgcgtgagttagcgag

SEQ ID NO: 223617 - DNA, 25 bp, Mus musculus
gcgcttggctaaaggggcctgtctt

SEQ ID NO: 223618 - DNA, 25 bp, Mus musculus
gcctgtcttggaggcgctttaggaa

SEQ ID NO: 223619 - DNA, 25 bp, Mus musculus
aggaatagcgtgtagggatctgacc

SEQ ID NO: 223620 - DNA, 25 bp, Mus musculus
ccggttgagtctgttcaggcgaagc

SEQ ID NO: 223621 - DNA, 25 bp, Mus musculus
aaattctgcgtctgcacccggcggc

SEQ ID NO: 223622 - DNA, 25 bp, Mus musculus
tctagggatggagtttcccgctttc

SEQ ID NO: 223623 - DNA, 25 bp, Mus musculus
ctggaaatgatgctgaggctccggc

SEQ ID NO: 223624 - DNA, 25 bp, Mus musculus
atcctcagcccggtgtctggctagt

SEQ ID NO: 223625 - DNA, 25 bp, Mus musculus
agccagggacccatctgagtctttc

SEQ ID NO: 223626 - DNA, 25 bp, Mus musculus
ccctgtgaccctgctctgggagtca

SEQ ID NO: 223627 - DNA, 25 bp, Mus musculus
aggaactcccatcccatcctagttt

SEQ ID NO: 223628 - DNA, 25 bp, Mus musculus
gggaactcccatcctatccttggtc

SEQ ID NO: 223629 - DNA, 25 bp, Mus musculus
ggtcttagttttgccattcgtctga

SEQ ID NO: 223630 - DNA, 25 bp, Mus musculus
attcgtctgaagagggctgaccctg

SEQ ID NO: 223631 - DNA, 25 bp, Mus musculus
gattctccggaacgtgcgggcctag

SEQ ID NO: 223632 - DNA, 25 bp, Mus musculus
tcaggactaaatagaacgtgactgc

SEQ ID NO: 223633 - DNA, 25 bp, Mus musculus
acgtgactgcccaaactgtgatcta

SEQ ID NO: 223634 - DNA, 25 bp, Mus musculus
ctcctggatttacggctctcgagtg

SEQ ID NO: 223635 - DNA, 25 bp, Mus musculus
tggatcttcagggtcagttgccgca

SEQ ID NO: 223636 - DNA, 25 bp, Mus musculus
agttttctggaggaggtcgacctga

SEQ ID NO: 223637 - DNA, 25 bp, Mus musculus
gtcgacctgaacctgcagaccctgg

SEQ ID NO: 223638 - DNA, 25 bp, Mus musculus
gtcacgcggttcttctcctgatcca

SEQ ID NO: 223639 - DNA, 25 bp, Mus musculus
gctcgcgccgcagagcttctgtaga

SEQ ID NO: 223640 - DNA, 25 bp, Mus musculus
ccttgtatatggtcttctcctgtga

SEQ ID NO: 223641 - DNA, 25 bp, Mus musculus
catgatgatcttttcctgcagggca

SEQ ID NO: 223642 - DNA, 25 bp, Mus musculus
gcgatcctcctcgaagctgagcctg

SEQ ID NO: 223643 - DNA, 25 bp, Mus musculus
tcgggtccttctgggtgaccaccac

SEQ ID NO: 223644 - DNA, 25 bp, Mus musculus
cctctccagcagcagtaacttgttc

SEQ ID NO: 223645 - DNA, 25 bp, Mus musculus
tgttctgcagctcgtacacagcatc

SEQ ID NO: 223646 - DNA, 25 bp, Mus musculus
tcgtgccgcacgacttctttgctca

SEQ ID NO: 223647 - DNA, 25 bp, Mus musculus
tcaccatcttggtctccaccttgga

SEQ ID NO: 223648 - DNA, 25 bp, Mus musculus
acctctccaggtcaggatctttctc

SEQ ID NO: 223649 - DNA, 25 bp, Mus musculus
tccgggtagcaaagctccggcctgg

SEQ ID NO: 223650 - DNA, 25 bp, Mus musculus
tcggctgcacgaggctgggcttacc

SEQ ID NO: 223651 - DNA, 25 bp, Mus musculus
gctgggcttaccgtagtcggcgaac

SEQ ID NO: 223652 - DNA, 25 bp, Mus musculus
gtgctgatccgggtagcaaagctcc

SEQ ID NO: 223653 - DNA, 25 bp, Mus musculus
gtggcatgagctggggcagccacgc

SEQ ID NO: 223654 - DNA, 25 bp, Mus musculus
agccacgcggaggaacggtcgcgca

SEQ ID NO: 223655 - DNA, 25 bp, Mus musculus
cccgggcggccacttgggcccagct

SEQ ID NO: 223656 - DNA, 25 bp, Mus musculus
gcctctcgaggaagcaagtggccgt

SEQ ID NO: 223657 - DNA, 25 bp, Mus musculus
ccggaaccgccctaggcagtgggca

SEQ ID NO: 223658 - DNA, 25 bp, Mus musculus
cgccctaggcagtgggcaaatgctg

SEQ ID NO: 223659 - DNA, 25 bp, Mus musculus
cagtgggcaaatgctggagctcaag

SEQ ID NO: 223660 - DNA, 25 bp, Mus musculus
agccctaggaggcagctggggaccc

SEQ ID NO: 223661 - DNA, 25 bp, Mus musculus
accctgcgtgcccacggtcgccacc

SEQ ID NO: 223662 - DNA, 25 bp, Mus musculus
ggcttaccgtagtcggcgaacggca

SEQ ID NO: 223663 - DNA, 25 bp, Mus musculus
atgagcgaagtggtacagtcttttc

SEQ ID NO: 223664 - DNA, 25 bp, Mus musculus
ctgtgccatcagtcggtcctgcagt

SEQ ID NO: 223665 - DNA, 25 bp, Mus musculus
ccagcgcggcttgctgaagctacta

SEQ ID NO: 223666 - DNA, 25 bp, Mus musculus
atgcgatgaggacaacgactgctcg

SEQ ID NO: 223667 - DNA, 25 bp, Mus musculus
ttcccttggtgtggagatgcgatga

SEQ ID NO: 223668 - DNA, 25 bp, Mus musculus
tcggaacgagcgctgcattcccttg

SEQ ID NO: 223669 - DNA, 25 bp, Mus musculus
ctcggaattaaggtgcttggagatc

SEQ ID NO: 223670 - DNA, 25 bp, Mus musculus
ggcatcctgtcctttctcggaatta

SEQ ID NO: 223671 - DNA, 25 bp, Mus musculus
ccgttaagcgcttgtcgggtctcgc

SEQ ID NO: 223672 - DNA, 25 bp, Mus musculus
tggacctgacttggcgttgtgtgta

SEQ ID NO: 223673 - DNA, 25 bp, Mus musculus
tctgacaatgcgtttccggggaccc

SEQ ID NO: 223674 - DNA, 25 bp, Mus musculus
tggtttaatttgacacgcgcgctcc

SEQ ID NO: 223675 - DNA, 25 bp, Mus musculus
cagctccgggcaccctcttaatggg

SEQ ID NO: 223676 - DNA, 25 bp, Mus musculus
cagactaggtttgtgtggacctgac

SEQ ID NO: 223677 - DNA, 25 bp, Mus musculus
gaccgccagttcgactgcgaggacc

SEQ ID NO: 223678 - DNA, 25 bp, Mus musculus
tgcaaggacaagtctgacgaggccg

SEQ ID NO: 223679 - DNA, 25 bp, Mus musculus
accgcgactgcaaggacaagtctga

SEQ ID NO: 223680 - DNA, 25 bp, Mus musculus
acggcgaccgcgactgcaaggacaa

SEQ ID NO: 223681 - DNA, 25 bp, Mus musculus
catacacctgggctggcgctgcgac

SEQ ID NO: 223682 - DNA, 25 bp, Mus musculus
agcggcgagtgcatacacctgggct

SEQ ID NO: 223683 - DNA, 25 bp, Mus musculus
tcgactgcgaggaccgctcggatga

SEQ ID NO: 223684 - DNA, 25 bp, Mus musculus
ctgggtctgcgaccgccagttcgac

SEQ ID NO: 223685 - DNA, 25 bp, Mus musculus
catccctgagcgctgggtctgcgac

SEQ ID NO: 223686 - DNA, 25 bp, Mus musculus
gaggcggcacctgcatccctgagcg

SEQ ID NO: 223687 - DNA, 25 bp, Mus musculus
agttccagtgcagcaaccgctcctg

SEQ ID NO: 223688 - DNA, 25 bp, Mus musculus
cgcacgagttccagtgcagcaaccg

SEQ ID NO: 223689 - DNA, 25 bp, Mus musculus
accggctctctgtcctgcgcagtgt

SEQ ID NO: 223690 - DNA, 25 bp, Mus musculus
ttcacctgccgcagcggcgagtgca

SEQ ID NO: 223691 - DNA, 25 bp, Mus musculus
atagacctggtgaagcgggactact

SEQ ID NO: 223692 - DNA, 25 bp, Mus musculus
gaagcgggactactcgcgcctcatc

SEQ ID NO: 223693 - DNA, 25 bp, Mus musculus
gcagccggcaagagcccatctctga

SEQ ID NO: 223694 - DNA, 25 bp, Mus musculus
agagcccatctctgatcttcacgaa

SEQ ID NO: 223695 - DNA, 25 bp, Mus musculus
ttcacgaaccgacacgaggtgcgga

SEQ ID NO: 223696 - DNA, 25 bp, Mus musculus
ccgcaagatctacaggtgagtgtca

SEQ ID NO: 223697 - DNA, 25 bp, Mus musculus
tggaagtagccaccaatcgcatata

SEQ ID NO: 223698 - DNA, 25 bp, Mus musculus
cccatgctcaagaatgtcgtggcgc

SEQ ID NO: 223699 - DNA, 25 bp, Mus musculus
tcaagaatgtcgtggcgctggacgt

SEQ ID NO: 223700 - DNA, 25 bp, Mus musculus
ctgatcttcacgaaccgacacgagg

SEQ ID NO: 223701 - DNA, 25 bp, Mus musculus
cgctggacgtggaagtagccaccaa

SEQ ID NO: 223702 - DNA, 25 bp, Mus musculus
tctcctaccgcaagatctacaggtg

SEQ ID NO: 223703 - DNA, 25 bp, Mus musculus
atcgcatatactggtgcgacctctc

SEQ ID NO: 223704 - DNA, 25 bp, Mus musculus
tggtgcgacctctcctaccgcaaga

SEQ ID NO: 223705 - DNA, 25 bp, Mus musculus
tctttcgcacagctttcaatttgtg

SEQ ID NO: 223706 - DNA, 25 bp, Mus musculus
tcaatttgtgctttagaacgctccg

SEQ ID NO: 223707 - DNA, 25 bp, Mus musculus
acggacgttctttcgcacagctttc

SEQ ID NO: 223708 - DNA, 25 bp, Mus musculus
cggagatgacatcacggacgttctt

SEQ ID NO: 223709 - DNA, 25 bp, Mus musculus
acggggcgcacggagatgacatcac

SEQ ID NO: 223710 - DNA, 25 bp, Mus musculus
tacgcgccaggcgattggccctgac

SEQ ID NO: 223711 - DNA, 25 bp, Mus musculus
cagcacaaagctacgcgccaggcga

SEQ ID NO: 223712 - DNA, 25 bp, Mus musculus
ccggaagctgggattgtgcgattaa

SEQ ID NO: 223713 - DNA, 25 bp, Mus musculus
ctgaaaccgggagacgccgacatgg

SEQ ID NO: 223714 - DNA, 25 bp, Mus musculus
tctaaccactgaaaccgggagacgc

SEQ ID NO: 223715 - DNA, 25 bp, Mus musculus
ggctccggatccaggtctaaccact

SEQ ID NO: 223716 - DNA, 25 bp, Mus musculus
aaggagatccgcacctcaggagggc

SEQ ID NO: 223717 - DNA, 25 bp, Mus musculus
gacctcctccatgacgaccaggcgg

SEQ ID NO: 223718 - DNA, 25 bp, Mus musculus
attgtgcgattaaggacgcgcccgg

SEQ ID NO: 223719 - DNA, 25 bp, Mus musculus
aggcattcttttgtcggcttcattg

SEQ ID NO: 223720 - DNA, 25 bp, Mus musculus
gcctccggagagtgagaaactctta

SEQ ID NO: 223721 - DNA, 25 bp, Mus musculus
aaactcttagtgtcgcggtggcaga

SEQ ID NO: 223722 - DNA, 25 bp, Mus musculus
gcgcgccaccattacgccagtataa

SEQ ID NO: 223723 - DNA, 25 bp, Mus musculus
ccgtggtagtgtcatccgttcctaa

SEQ ID NO: 223724 - DNA, 25 bp, Mus musculus
ctccttgtcccttgcgaggcatgga

SEQ ID NO: 223725 - DNA, 25 bp, Mus musculus
tggagagtgacttttacctgcgtta

SEQ ID NO: 223726 - DNA, 25 bp, Mus musculus
cctgcgttactacgtgggccacaaa

SEQ ID NO: 223727 - DNA, 25 bp, Mus musculus
ggccacaaaggcaagttcggtcatg

SEQ ID NO: 223728 - DNA, 25 bp, Mus musculus
gttctttctcttcatccgctggcga

SEQ ID NO: 223729 - DNA, 25 bp, Mus musculus
accaccgtgctgttgggtcgtgaaa

SEQ ID NO: 223730 - DNA, 25 bp, Mus musculus
tggtaatctcgttcccgcctccgga

SEQ ID NO: 223731 - DNA, 25 bp, Mus musculus
tggcgatcttgacccagcgtctagg

SEQ ID NO: 223732 - DNA, 25 bp, Mus musculus
ttcggtcatgagttcctggagtttg

SEQ ID NO: 223733 - DNA, 25 bp, Mus musculus
ggacaagctagaaaacgccagccta

SEQ ID NO: 223734 - DNA, 25 bp, Mus musculus
gtttacatcggttccagcaaaccta

SEQ ID NO: 223735 - DNA, 25 bp, Mus musculus
acgaggccttgcactcagcgtgtcc

SEQ ID NO: 223736 - DNA, 25 bp, Mus musculus
atcccgtctggtagtagcccagtga

SEQ ID NO: 223737 - DNA, 25 bp, Mus musculus
gctagtcgccattggggcatcccgt

SEQ ID NO: 223738 - DNA, 25 bp, Mus musculus
acttaacgtggaccggcagctatgg

SEQ ID NO: 223739 - DNA, 25 bp, Mus musculus
tttacgacgggtcggaaagcagctg

SEQ ID NO: 223740 - DNA, 25 bp, Mus musculus
gcaaacctaccgaaaacagccgagc

SEQ ID NO: 223741 - DNA, 25 bp, Mus musculus
ttctcagaaaatcgcactgcagctc

SEQ ID NO: 223742 - DNA, 25 bp, Mus musculus
ctgcagctcaaagccacgctggaga

SEQ ID NO: 223743 - DNA, 25 bp, Mus musculus
acgctggagaacgtcacgaaccttc

SEQ ID NO: 223744 - DNA, 25 bp, Mus musculus
gtcacgaaccttcggccagtgggcg

SEQ ID NO: 223745 - DNA, 25 bp, Mus musculus
ttccggtggtacctgaaggtgcgac

SEQ ID NO: 223746 - DNA, 25 bp, Mus musculus
ctgtcgcagcgacttaacgtggacc

SEQ ID NO: 223747 - DNA, 25 bp, Mus musculus
cggcatcatcgtcccgggcggcaat

SEQ ID NO: 223748 - DNA, 25 bp, Mus musculus
acatcgtggccacgcccaagaggcg

SEQ ID NO: 223749 - DNA, 25 bp, Mus musculus
cacaggggcacttccgggcaccgat

SEQ ID NO: 223750 - DNA, 25 bp, Mus musculus
ccgtagagacttaacgtccagttca

SEQ ID NO: 223751 - DNA, 25 bp, Mus musculus
agttcccgagcaagcaggccgctgc

SEQ ID NO: 223752 - DNA, 25 bp, Mus musculus
cacttccgggcaccgataggcggtg

SEQ ID NO: 223753 - DNA, 25 bp, Mus musculus
tcacgcaacagcaggcgcggcatca

SEQ ID NO: 223754 - DNA, 25 bp, Mus musculus
gggcaccggggccagtcacgcaaca

SEQ ID NO: 223755 - DNA, 25 bp, Mus musculus
ctcccaggacaagcgaggggcaccg

SEQ ID NO: 223756 - DNA, 25 bp, Mus musculus
ccgactaggggctcccaggacaagc

SEQ ID NO: 223757 - DNA, 25 bp, Mus musculus
gacagcacttaagggccgactaggg

SEQ ID NO: 223758 - DNA, 25 bp, Mus musculus
cgagacagcacttaagggccgacta

SEQ ID NO: 223759 - DNA, 25 bp, Mus musculus
tcaggcccgggacacccgtagagac

SEQ ID NO: 223760 - DNA, 25 bp, Mus musculus
gacttaacgtccagttcaactccgc

SEQ ID NO: 223761 - DNA, 25 bp, Mus musculus
caggcgtagcttgcggaaggcatct

SEQ ID NO: 223762 - DNA, 25 bp, Mus musculus
cccggcttcgcagtcggttgcctgt

SEQ ID NO: 223763 - DNA, 25 bp, Mus musculus
ttgcctgtgaggtagagttcccgaa

SEQ ID NO: 223764 - DNA, 25 bp, Mus musculus
gttcccgaagctgggccatgccagc

SEQ ID NO: 223765 - DNA, 25 bp, Mus musculus
aagctgggccatgccagctagtgcc

SEQ ID NO: 223766 - DNA, 25 bp, Mus musculus
agggcagccagctcattccgcttga

SEQ ID NO: 223767 - DNA, 25 bp, Mus musculus
ttccgcttgaccttgagcacgtgta

SEQ ID NO: 223768 - DNA, 25 bp, Mus musculus
cttgaccttgagcacgtgtacgttt

SEQ ID NO: 223769 - DNA, 25 bp, Mus musculus
acgtgtacgtttttcggcaggcctg

SEQ ID NO: 223770 - DNA, 25 bp, Mus musculus
acgtttttcggcaggcctggaggca

SEQ ID NO: 223771 - DNA, 25 bp, Mus musculus
aggcagtgtttgcagacggttgcca

SEQ ID NO: 223772 - DNA, 25 bp, Mus musculus
ttgcagacggttgccagacaagtca

SEQ ID NO: 223773 - DNA, 25 bp, Mus musculus
gtcaagtgaacgcagcaggcgtagc

SEQ ID NO: 223774 - DNA, 25 bp, Mus musculus
ttgccagacaagtcaagtgaacgca

SEQ ID NO: 223775 - DNA, 25 bp, Mus musculus
cccgcacctgaggagaaccgagagg

SEQ ID NO: 223776 - DNA, 25 bp, Mus musculus
tgaggagaaccgagagggctccttc

SEQ ID NO: 223777 - DNA, 25 bp, Mus musculus
ctctcccgacacaggcgcagggtcc

SEQ ID NO: 223778 - DNA, 25 bp, Mus musculus
caagttttgttgtgggttctctctc

SEQ ID NO: 223779 - DNA, 25 bp, Mus musculus
ggcgcagcgagccaagttttgttgt

SEQ ID NO: 223780 - DNA, 25 bp, Mus musculus
cattcaagtcgagccgtgggcgcag

SEQ ID NO: 223781 - DNA, 25 bp, Mus musculus
ctgtcattcaagtcgagccgtgggc

SEQ ID NO: 223782 - DNA, 25 bp, Mus musculus
acagggtgggatacggcgatcctcc

SEQ ID NO: 223783 - DNA, 25 bp, Mus musculus
atatggaggtgtgcctaaccgtgcc

SEQ ID NO: 223784 - DNA, 25 bp, Mus musculus
cccatatggaggtgtgcctaaccgt

SEQ ID NO: 223785 - DNA, 25 bp, Mus musculus
ggcagggactgaatatcgagtaaaa

SEQ ID NO: 223786 - DNA, 25 bp, Mus musculus
gcagattctttccagatgtgcgcag

SEQ ID NO: 223787 - DNA, 25 bp, Mus musculus
catccgctcgcagattctttccaga

SEQ ID NO: 223788 - DNA, 25 bp, Mus musculus
cgccggctcctgtcattcaagtcga

SEQ ID NO: 223789 - DNA, 25 bp, Mus musculus
ctgcttcgtgcagccttgcaggtgg

SEQ ID NO: 223790 - DNA, 25 bp, Mus musculus
gggtccggcatgaggtcactccaat

SEQ ID NO: 223791 - DNA, 25 bp, Mus musculus
tgcccagactctgtcggcgccacga

SEQ ID NO: 223792 - DNA, 25 bp, Mus musculus
cgagacggccatgagcaagaagatg

SEQ ID NO: 223793 - DNA, 25 bp, Mus musculus
atactctcgcctcacgccagcgggg

SEQ ID NO: 223794 - DNA, 25 bp, Mus musculus
cgattgaagcgagacggccatgagc

SEQ ID NO: 223795 - DNA, 25 bp, Mus musculus
ccggcatgaggtcactccaatcctg

SEQ ID NO: 223796 - DNA, 25 bp, Mus musculus
gaggtcactccaatcctgctgcagg

SEQ ID NO: 223797 - DNA, 25 bp, Mus musculus
atcctgctgcaggatgcggccttgt

SEQ ID NO: 223798 - DNA, 25 bp, Mus musculus
caggatgcggccttgttgatcggcc

SEQ ID NO: 223799 - DNA, 25 bp, Mus musculus
tgttgatcggccagggcgctcagct

SEQ ID NO: 223800 - DNA, 25 bp, Mus musculus
cgctcagctgcttcgtgcagccttg

SEQ ID NO: 223801 - DNA, 25 bp, Mus musculus
aggtgggtgtacaggctgcccagac

SEQ ID NO: 223802 - DNA, 25 bp, Mus musculus
gagcaagaagatggcccgagacacc

SEQ ID NO: 223803 - DNA, 25 bp, Mus musculus
gtctcctacagactgaggctttgca

SEQ ID NO: 223804 - DNA, 25 bp, Mus musculus
ttcaaagcgacagaaggcatggctc

SEQ ID NO: 223805 - DNA, 25 bp, Mus musculus
tcgcctcggactgcggggaataaca

SEQ ID NO: 223806 - DNA, 25 bp, Mus musculus
cgaccacgaacacccggcgcaggcg

SEQ ID NO: 223807 - DNA, 25 bp, Mus musculus
tggtcatgccaacgccgaccacgaa

SEQ ID NO: 223808 - DNA, 25 bp, Mus musculus
ctctcgctgctcacaactctgttta

SEQ ID NO: 223809 - DNA, 25 bp, Mus musculus
caactctgtttaccttggtcatgcc

SEQ ID NO: 223810 - DNA, 25 bp, Mus musculus
cgcaggcgcggagatttcaaagcga

SEQ ID NO: 223811 - DNA, 25 bp, Mus musculus
cgacagaaggcatggctccagcagc

SEQ ID NO: 223812 - DNA, 25 bp, Mus musculus
cagggtagaggatgtacgcatgcgt

SEQ ID NO: 223813 - DNA, 25 bp, Mus musculus
gcagcgaaggtctcctacagactga

SEQ ID NO: 223814 - DNA, 25 bp, Mus musculus
cagactgaggctttgcagaaccaaa

SEQ ID NO: 223815 - DNA, 25 bp, Mus musculus
acagaggcagatctctcgctgctca

SEQ ID NO: 223816 - DNA, 25 bp, Mus musculus
ggctccagcagcgaaggtctcctac

SEQ ID NO: 223817 - DNA, 25 bp, Mus musculus
gactgcgcctctcacgcgacgacca

SEQ ID NO: 223818 - DNA, 25 bp, Mus musculus
tctcacgcgacgaccaggacacccg

SEQ ID NO: 223819 - DNA, 25 bp, Mus musculus
ctcccgtgctcctggaggttctcgg

SEQ ID NO: 223820 - DNA, 25 bp, Mus musculus
ccgcgccaccttgccggcctgctcc

SEQ ID NO: 223821 - DNA, 25 bp, Mus musculus
aggtcccgttctccgcgccaccttg

SEQ ID NO: 223822 - DNA, 25 bp, Mus musculus
tctgccgaggaggtcccgttctccg

SEQ ID NO: 223823 - DNA, 25 bp, Mus musculus
agctctgccgaggaggtcccgttct

SEQ ID NO: 223824 - DNA, 25 bp, Mus musculus
aactacgattttccagctctgccga

SEQ ID NO: 223825 - DNA, 25 bp, Mus musculus
cccggaactacgattttccagctct

SEQ ID NO: 223826 - DNA, 25 bp, Mus musculus
gagcccttggcgaggcctcgcccgc

SEQ ID NO: 223827 - DNA, 25 bp, Mus musculus
tccgcccgtaggtggagcccttggc

SEQ ID NO: 223828 - DNA, 25 bp, Mus musculus
tctccgcccgtaggtggagcccttg

SEQ ID NO: 223829 - DNA, 25 bp, Mus musculus
ggaccgccgcacctttctctccgcc

SEQ ID NO: 223830 - DNA, 25 bp, Mus musculus
ctacgattttccagctctgccgagg

SEQ ID NO: 223831 - DNA, 25 bp, Mus musculus
gagacccacgctgccgagggcgttc

SEQ ID NO: 223832 - DNA, 25 bp, Mus musculus
cttgctgaggtgaggccatctgaag

SEQ ID NO: 223833 - DNA, 25 bp, Mus musculus
ctcagcagcgcagcgaacaggaacc

SEQ ID NO: 223834 - DNA, 25 bp, Mus musculus
cggcctgccggcgacttccagggaa

SEQ ID NO: 223835 - DNA, 25 bp, Mus musculus
cggcgacttccagggaaccgtcacg

SEQ ID NO: 223836 - DNA, 25 bp, Mus musculus
cgcggccacagcaacggatgcaaga

SEQ ID NO: 223837 - DNA, 25 bp, Mus musculus
cagcaacggatgcaagaaatggacc

SEQ ID NO: 223838 - DNA, 25 bp, Mus musculus
gaaatggaccatgacgccgacgccg

SEQ ID NO: 223839 - DNA, 25 bp, Mus musculus
tcggccggcgtttgaatggccgccc

SEQ ID NO: 223840 - DNA, 25 bp, Mus musculus
agggcgttcgcatagcacgcacagc

SEQ ID NO: 223841 - DNA, 25 bp, Mus musculus
tcctcggaggccgagcgccctgaga

SEQ ID NO: 223842 - DNA, 25 bp, Mus musculus
tctgtgcttgctgaggtgaggccat

SEQ ID NO: 223843 - DNA, 25 bp, Mus musculus
cttccgcactcggttcctggggcag

SEQ ID NO: 223844 - DNA, 25 bp, Mus musculus
aatggtcctcgctctccagcctcag

SEQ ID NO: 223845 - DNA, 25 bp, Mus musculus
ctagctcaccatggctgcgtgggcc

SEQ ID NO: 223846 - DNA, 25 bp, Mus musculus
cgcgctagctcaccatggctgcgtg

SEQ ID NO: 223847 - DNA, 25 bp, Mus musculus
ctcaccatggctgcgtgggcctggt

SEQ ID NO: 223848 - DNA, 25 bp, Mus musculus
accatggctgcgtgggcctggtcct

SEQ ID NO: 223849 - DNA, 25 bp, Mus musculus
cgtgggcctggtcctccggcatgca

SEQ ID NO: 223850 - DNA, 25 bp, Mus musculus
atgcagcctcggtcctgcgtgcggt

SEQ ID NO: 223851 - DNA, 25 bp, Mus musculus
ccgagcccgccgctaagatcagccg

SEQ ID NO: 223852 - DNA, 25 bp, Mus musculus
cccgccgctaagatcagccggctcg

SEQ ID NO: 223853 - DNA, 25 bp, Mus musculus
tcggcctcgctcttctgaactacag

SEQ ID NO: 223854 - DNA, 25 bp, Mus musculus
ggcctcgctcttctgaactacagca

SEQ ID NO: 223855 - DNA, 25 bp, Mus musculus
tcgctcttctgaactacagcagccg

SEQ ID NO: 223856 - DNA, 25 bp, Mus musculus
tcttctgaactacagcagccgctgc

SEQ ID NO: 223857 - DNA, 25 bp, Mus musculus
ttctgaactacagcagccgctgccg

SEQ ID NO: 223858 - DNA, 25 bp, Mus musculus
gggcaggccgcgctagctcaccatg

SEQ ID NO: 223859 - DNA, 25 bp, Mus musculus
aaagcgatttgtgggagtcggaatc

SEQ ID NO: 223860 - DNA, 25 bp, Mus musculus
gccaactgcgcagcctgggacatag

SEQ ID NO: 223861 - DNA, 25 bp, Mus musculus
agggtgagcgccaactgcgcagcct

SEQ ID NO: 223862 - DNA, 25 bp, Mus musculus
aatgctaccgcgagaaggacccgga

SEQ ID NO: 223863 - DNA, 25 bp, Mus musculus
cactaccaatgctaccgcgagaagg

SEQ ID NO: 223864 - DNA, 25 bp, Mus musculus
gtggagtgtcactaccaatgctacc

SEQ ID NO: 223865 - DNA, 25 bp, Mus musculus
ccttcctggagaacatggaggtgga

SEQ ID NO: 223866 - DNA, 25 bp, Mus musculus
acgaggagcaggtgaagtccttcct

SEQ ID NO: 223867 - DNA, 25 bp, Mus musculus
aatcatggcgggcttggttgacttc

SEQ ID NO: 223868 - DNA, 25 bp, Mus musculus
agggtggagccacaaagcgatttgt

SEQ ID NO: 223869 - DNA, 25 bp, Mus musculus
tcacgtaactgagggtggagccaca

SEQ ID NO: 223870 - DNA, 25 bp, Mus musculus
cctgggctggctcacgtaactgagg

SEQ ID NO: 223871 - DNA, 25 bp, Mus musculus
cccgtactgaggagcgctgacgtca

SEQ ID NO: 223872 - DNA, 25 bp, Mus musculus
tggttgacttccaggacgaggagca

SEQ ID NO: 223873 - DNA, 25 bp, Mus musculus
cgcagaaacgtctggaaggatggaa

SEQ ID NO: 223874 - DNA, 25 bp, Mus musculus
ctgcttctcgcagaaacgtctggaa

SEQ ID NO: 223875 - DNA, 25 bp, Mus musculus
tgccttgtgacacatcctgggccct

SEQ ID NO: 223876 - DNA, 25 bp, Mus musculus
ccgcgctgtcgctgcagtcatggct

SEQ ID NO: 223877 - DNA, 25 bp, Mus musculus
tcgctgcagtcatggctgctgacgg

SEQ ID NO: 223878 - DNA, 25 bp, Mus musculus
gtggacgaacgttcgcctctgctgt

SEQ ID NO: 223879 - DNA, 25 bp, Mus musculus
aacgttcgcctctgctgtcagcatc

SEQ ID NO: 223880 - DNA, 25 bp, Mus musculus
ctgctgtcagcatcccattcgggaa

SEQ ID NO: 223881 - DNA, 25 bp, Mus musculus
catcccattcgggaaatgtcactcc

SEQ ID NO: 223882 - DNA, 25 bp, Mus musculus
ttcgggaaatgtcactcccacagcc

SEQ ID NO: 223883 - DNA, 25 bp, Mus musculus
cccgccgtacttgcaggaaagcagc

SEQ ID NO: 223884 - DNA, 25 bp, Mus musculus
ggtaaggccggcatagacctttctg

SEQ ID NO: 223885 - DNA, 25 bp, Mus musculus
ggcatagacctttctgcttctcgca

SEQ ID NO: 223886 - DNA, 25 bp, Mus musculus
ctcctgccttgtgacacatcctggg

SEQ ID NO: 223887 - DNA, 25 bp, Mus musculus
cacgcgacagccagagaggcaaggt

SEQ ID NO: 223888 - DNA, 25 bp, Mus musculus
ggtggatatttgaggctctcgcctg

SEQ ID NO: 223889 - DNA, 25 bp, Mus musculus
tgtggtcgcggaagccacagcagaa

SEQ ID NO: 223890 - DNA, 25 bp, Mus musculus
gagacaccacgcgacagccagagag

SEQ ID NO: 223891 - DNA, 25 bp, Mus musculus
cgctgcagagaaaggcacggcgaaa

SEQ ID NO: 223892 - DNA, 25 bp, Mus musculus
atcttgagaaagagcccgagggcca

SEQ ID NO: 223893 - DNA, 25 bp, Mus musculus
cccgcagatcttgagaaagagcccg

SEQ ID NO: 223894 - DNA, 25 bp, Mus musculus
agcgagagacaacggccggagaccc

SEQ ID NO: 223895 - DNA, 25 bp, Mus musculus
agcgctcacgtagctcgagcaggcg

SEQ ID NO: 223896 - DNA, 25 bp, Mus musculus
ctgctcagcgctcacgtagctcgag

SEQ ID NO: 223897 - DNA, 25 bp, Mus musculus
agcgggcagctgaagccgcgcacca

SEQ ID NO: 223898 - DNA, 25 bp, Mus musculus
gcagtacttgtggtcgcggaagcca

SEQ ID NO: 223899 - DNA, 25 bp, Mus musculus
tctcgcctgagcgaggtaccaccgt

SEQ ID NO: 223900 - DNA, 25 bp, Mus musculus
tcgtcgcagcagtacttgtggtcgc

SEQ ID NO: 223901 - DNA, 25 bp, Mus musculus
tggctcctaagctgtgccacgtagc

SEQ ID NO: 223902 - DNA, 25 bp, Mus musculus
tcaccttccgggtgagatcctgagc

SEQ ID NO: 223903 - DNA, 25 bp, Mus musculus
gttgcaccgatctcgcggctgggat

SEQ ID NO: 223904 - DNA, 25 bp, Mus musculus
gtggtgtccgagctgtggcacaccc

SEQ ID NO: 223905 - DNA, 25 bp, Mus musculus
gtggcacacccgagagtagcatccc

SEQ ID NO: 223906 - DNA, 25 bp, Mus musculus
caggcccgcaaggaatcgtcactca

SEQ ID NO: 223907 - DNA, 25 bp, Mus musculus
gaatcgtcactcaccgagccacggt

SEQ ID NO: 223908 - DNA, 25 bp, Mus musculus
cccggatgttgaccgccttgaagtc

SEQ ID NO: 223909 - DNA, 25 bp, Mus musculus
agaagtcctgctcggattgcgcgca

SEQ ID NO: 223910 - DNA, 25 bp, Mus musculus
gtcgccacagctgcaaccatggttc

SEQ ID NO: 223911 - DNA, 25 bp, Mus musculus
accatggttcactcccgaggtggcg

SEQ ID NO: 223912 - DNA, 25 bp, Mus musculus
cttctcagtcgtctctgcaggcgca

SEQ ID NO: 223913 - DNA, 25 bp, Mus musculus
gagccacggtacttctccagcgaca

SEQ ID NO: 223914 - DNA, 25 bp, Mus musculus
gagagcggagggcattcaccttccg

SEQ ID NO: 223915 - DNA, 25 bp, Mus musculus
gacggtgcacgcgaccctaagctcg

SEQ ID NO: 223916 - DNA, 25 bp, Mus musculus
tggagtcctgagctcgtcgtgtcct

SEQ ID NO: 223917 - DNA, 25 bp, Mus musculus
ccacaatgcagttcgcggcgcggcg

SEQ ID NO: 223918 - DNA, 25 bp, Mus musculus
tcagcgggtcctcctctttctctcg

SEQ ID NO: 223919 - DNA, 25 bp, Mus musculus
aggctatctcctcccatcccaatcg

SEQ ID NO: 223920 - DNA, 25 bp, Mus musculus
ctcctccgccgaggtttgacgggtg

SEQ ID NO: 223921 - DNA, 25 bp, Mus musculus
ttgtttccgggcgaccgccacgagc

SEQ ID NO: 223922 - DNA, 25 bp, Mus musculus
cgagccgcgggtagctccgaccctt

SEQ ID NO: 223923 - DNA, 25 bp, Mus musculus
tcggcgtgctggaccgcaggaccct

SEQ ID NO: 223924 - DNA, 25 bp, Mus musculus
agaagcgcgacggtgcacgcgaccc

SEQ ID NO: 223925 - DNA, 25 bp, Mus musculus
gagctcgtcgtgtcctggcctccat

SEQ ID NO: 223926 - DNA, 25 bp, Mus musculus
aggctggggagagcctccgactccc

SEQ ID NO: 223927 - DNA, 25 bp, Mus musculus
ctttctctctccctgcaggcccgct

SEQ ID NO: 223928 - DNA, 25 bp, Mus musculus
gagggagcccctgaacccagctctg

SEQ ID NO: 223929 - DNA, 25 bp, Mus musculus
actgtgagattcgtatttgtaaaca

SEQ ID NO: 223930 - DNA, 25 bp, Mus musculus
tatttgtaaacagacagcacttccc

SEQ ID NO: 223931 - DNA, 25 bp, Mus musculus
tgggtaactgtgagattcgtatttg

SEQ ID NO: 223932 - DNA, 25 bp, Mus musculus
gacgtgggtaactgtgagattcgta

SEQ ID NO: 223933 - DNA, 25 bp, Mus musculus
tttgacgtgggtaactgtgagattc

SEQ ID NO: 223934 - DNA, 25 bp, Mus musculus
gcgcttttgacgtgggtaactgtga

SEQ ID NO: 223935 - DNA, 25 bp, Mus musculus
actgcgcgcttttgacgtgggtaac

SEQ ID NO: 223936 - DNA, 25 bp, Mus musculus
cccagtcgagaggtgctggtactgc

SEQ ID NO: 223937 - DNA, 25 bp, Mus musculus
gtttcctgctcacccgccgtctctg

SEQ ID NO: 223938 - DNA, 25 bp, Mus musculus
tggatttcgtttcctgctcacccgc

SEQ ID NO: 223939 - DNA, 25 bp, Mus musculus
gtgtggatttcgtttcctgctcacc

SEQ ID NO: 223940 - DNA, 25 bp, Mus musculus
aggtttgtgtggatttcgtttcctg

SEQ ID NO: 223941 - DNA, 25 bp, Mus musculus
ggcttgtccttgtcgggagggagca

SEQ ID NO: 223942 - DNA, 25 bp, Mus musculus
aggtgctggtactgcgcgcttttga

SEQ ID NO: 223943 - DNA, 25 bp, Mus musculus
cagtttctgggaggctcctccctgc

SEQ ID NO: 223944 - DNA, 25 bp, Mus musculus
tcctgcacaaccagtctgggaggag

SEQ ID NO: 223945 - DNA, 25 bp, Mus musculus
gctcctgcacaaccagtctgggagg

SEQ ID NO: 223946 - DNA, 25 bp, Mus musculus
cagctcctgcacaaccagtctggga

SEQ ID NO: 223947 - DNA, 25 bp, Mus musculus
cccgacgtgcgcagccagctcctgc

SEQ ID NO: 223948 - DNA, 25 bp, Mus musculus
cctgcaggtgcggtgtctctgccag

SEQ ID NO: 223949 - DNA, 25 bp, Mus musculus
ggcagtttctgggaggctcctccct

SEQ ID NO: 223950 - DNA, 25 bp, Mus musculus
gaaggcagtttctgggaggctcctc

SEQ ID NO: 223951 - DNA, 25 bp, Mus musculus
tcgctggctactagccgggctctgg

SEQ ID NO: 223952 - DNA, 25 bp, Mus musculus
ctcgctggctactagccgggctctg

SEQ ID NO: 223953 - DNA, 25 bp, Mus musculus
gacgcgcgtcctcgctggctactag

SEQ ID NO: 223954 - DNA, 25 bp, Mus musculus
tgcacaaccagtctgggaggagagg

SEQ ID NO: 223955 - DNA, 25 bp, Mus musculus
gtcctcgctggctactagccgggct

SEQ ID NO: 223956 - DNA, 25 bp, Mus musculus
aaggcgacgcgcgtcctcgctggct

SEQ ID NO: 223957 - DNA, 25 bp, Mus musculus
actacgtgttgtagccgtggtctcc

SEQ ID NO: 223958 - DNA, 25 bp, Mus musculus
agaatcacactgtgggcggggtttc

SEQ ID NO: 223959 - DNA, 25 bp, Mus musculus
tccgcgtgcactgcttctgaaaagc

SEQ ID NO: 223960 - DNA, 25 bp, Mus musculus
ttcctgcactgaaggagacctcgga

SEQ ID NO: 223961 - DNA, 25 bp, Mus musculus
tgcatacacgtgcacctagggccgt

SEQ ID NO: 223962 - DNA, 25 bp, Mus musculus
tccagtgcctggactgcaaagcgtc

SEQ ID NO: 223963 - DNA, 25 bp, Mus musculus
gtgccttcagttcttagtcagctga

SEQ ID NO: 223964 - DNA, 25 bp, Mus musculus
gcgaaaagttttctcctgtgccttc

SEQ ID NO: 223965 - DNA, 25 bp, Mus musculus
accgcggaaagccaccagcttcgta

SEQ ID NO: 223966 - DNA, 25 bp, Mus musculus
accggaagctgtggcgtagaactct

SEQ ID NO: 223967 - DNA, 25 bp, Mus musculus
gcgtagaactctttcgccggaatac

SEQ ID NO: 223968 - DNA, 25 bp, Mus musculus
attggcggaagtacgtcatgaaccc

SEQ ID NO: 223969 - DNA, 25 bp, Mus musculus
gcgagtgtccgaaacgccaatcaga

SEQ ID NO: 223970 - DNA, 25 bp, Mus musculus
ggtcgttgtccacggactgcataca

SEQ ID NO: 223971 - DNA, 25 bp, Mus musculus
tgacgcttcgctgttgactgcagtc

SEQ ID NO: 223972 - DNA, 25 bp, Mus musculus
ctcggctgcctattggtagccagta

SEQ ID NO: 223973 - DNA, 25 bp, Mus musculus
cgcgggatcgtgtcttgtttcttaa

SEQ ID NO: 223974 - DNA, 25 bp, Mus musculus
tgtgcgctcacaccagggaacctcg

SEQ ID NO: 223975 - DNA, 25 bp, Mus musculus
actgcagtccgaaatgtgacacttg

SEQ ID NO: 223976 - DNA, 25 bp, Mus musculus
cgcgaagagaaccaggtaagaggcc

SEQ ID NO: 223977 - DNA, 25 bp, Mus musculus
atccgccgcgaggtatgccacgtgc

SEQ ID NO: 223978 - DNA, 25 bp, Mus musculus
ttacctgctccaagatgcctgcgcg

SEQ ID NO: 223979 - DNA, 25 bp, Mus musculus
gccagccggtatcgcgttacctgct

SEQ ID NO: 223980 - DNA, 25 bp, Mus musculus
cacgcctaccgtgggtgaaggacgc

SEQ ID NO: 223981 - DNA, 25 bp, Mus musculus
aaactacggcaggaatggggcacgc

SEQ ID NO: 223982 - DNA, 25 bp, Mus musculus
agaggcctctcggagaaactacggc

SEQ ID NO: 223983 - DNA, 25 bp, Mus musculus
ctgcggcagcggagcatctcattct

SEQ ID NO: 223984 - DNA, 25 bp, Mus musculus
agtggcttacgcctgtgcgctcaca

SEQ ID NO: 223985 - DNA, 25 bp, Mus musculus
gggtcgtcactcagccgagagcctc

SEQ ID NO: 223986 - DNA, 25 bp, Mus musculus
cttacggcgggacaaccgaggcgat

SEQ ID NO: 223987 - DNA, 25 bp, Mus musculus
acaaccgaggcgatgcaggcagacg

SEQ ID NO: 223988 - DNA, 25 bp, Mus musculus
agccgagagcctcgtcctcagcggg

SEQ ID NO: 223989 - DNA, 25 bp, Mus musculus
cccggcccaatagctggcgccagga

SEQ ID NO: 223990 - DNA, 25 bp, Mus musculus
actcagtacgcggagcaggcaagcc

SEQ ID NO: 223991 - DNA, 25 bp, Mus musculus
agtacgcggagcaggcaagccaaag

SEQ ID NO: 223992 - DNA, 25 bp, Mus musculus
aagccaaagctgtttgcaaacaagc

SEQ ID NO: 223993 - DNA, 25 bp, Mus musculus
tgtttgcaaacaagcgtcctctgcc

SEQ ID NO: 223994 - DNA, 25 bp, Mus musculus
gcctccctccgggatgtgctcgaag

SEQ ID NO: 223995 - DNA, 25 bp, Mus musculus
ggccgccagcccgatcttcacgtac

SEQ ID NO: 223996 - DNA, 25 bp, Mus musculus
cggctaagggcttcccggcgactcg

SEQ ID NO: 223997 - DNA, 25 bp, Mus musculus
tcaatctcccggggacccacggaga

SEQ ID NO: 223998 - DNA, 25 bp, Mus musculus
cgcgaagcctcgcactcctgagggg

SEQ ID NO: 223999 - DNA, 25 bp, Mus musculus
tggggaccttccctcaggtgccgac

SEQ ID NO: 224000 - DNA, 25 bp, Mus musculus
ctcactattctgattggcggccggg

SEQ ID NO: 224001 - DNA, 25 bp, Mus musculus
actattctgattggcggccgggctg

SEQ ID NO: 224002 - DNA, 25 bp, Mus musculus
cccttggcgtcccattgtgtctgcg

SEQ ID NO: 224003 - DNA, 25 bp, Mus musculus
tggtgctggggaccttccctcaggt

SEQ ID NO: 224004 - DNA, 25 bp, Mus musculus
cctcccgactacaaagcccagcatg

SEQ ID NO: 224005 - DNA, 25 bp, Mus musculus
cctgcagcggggagggtcctccaac

SEQ ID NO: 224006 - DNA, 25 bp, Mus musculus
gggagggtcctccaacaccagcacg

SEQ ID NO: 224007 - DNA, 25 bp, Mus musculus
accagcacgcggcaagagcaagatg

SEQ ID NO: 224008 - DNA, 25 bp, Mus musculus
gctgcctcagctgagacagagaaag

SEQ ID NO: 224009 - DNA, 25 bp, Mus musculus
ctcgcgcacctcactattctgattg

SEQ ID NO: 224010 - DNA, 25 bp, Mus musculus
gagaggcccacgtgacgcacggccc

SEQ ID NO: 224011 - DNA, 25 bp, Mus musculus
gggtacggcaactgcgcgcctgcct

SEQ ID NO: 224012 - DNA, 25 bp, Mus musculus
agctgagacagagaaagaccgcggc

SEQ ID NO: 224013 - DNA, 25 bp, Mus musculus
aagggcttccgctacgagctgtact

SEQ ID NO: 224014 - DNA, 25 bp, Mus musculus
atccggtctgccttgtttgagaatc

SEQ ID NO: 224015 - DNA, 25 bp, Mus musculus
cttagcgctgcgctttgagtctccc

SEQ ID NO: 224016 - DNA, 25 bp, Mus musculus
tcctcccgaggttctggagtcctta

SEQ ID NO: 224017 - DNA, 25 bp, Mus musculus
gtccgagaaatctgcagagcctgcg

SEQ ID NO: 224018 - DNA, 25 bp, Mus musculus
gccatcaaacccttccgctgtaatg

SEQ ID NO: 224019 - DNA, 25 bp, Mus musculus
tggatccagaggaaatcctgccatc

SEQ ID NO: 224020 - DNA, 25 bp, Mus musculus
gagttctggccgctgtctcaaagga

SEQ ID NO: 224021 - DNA, 25 bp, Mus musculus
gcacgccgctctgcttactttactg

SEQ ID NO: 224022 - DNA, 25 bp, Mus musculus
atcctggactcggtgaactacatca

SEQ ID NO: 224023 - DNA, 25 bp, Mus musculus
aggacccgactgtgtacggcgactc

SEQ ID NO: 224024 - DNA, 25 bp, Mus musculus
ccctggagatcatgccgctcgtcgt

SEQ ID NO: 224025 - DNA, 25 bp, Mus musculus
ttactttactgcgtgcggccgaact

SEQ ID NO: 224026 - DNA, 25 bp, Mus musculus
ctgccggaagttgacgccaaacatc

SEQ ID NO: 224027 - DNA, 25 bp, Mus musculus
aacccatcttcagccagagcctcag

SEQ ID NO: 224028 - DNA, 25 bp, Mus musculus
agtgctggctcgcactccgcacagg

SEQ ID NO: 224029 - DNA, 25 bp, Mus musculus
cgcagcaaagcaggagtgctggctc

SEQ ID NO: 224030 - DNA, 25 bp, Mus musculus
ctccgcacaggtccgccgggaagca

SEQ ID NO: 224031 - DNA, 25 bp, Mus musculus
gcggatcttacatgggttccgccca

SEQ ID NO: 224032 - DNA, 25 bp, Mus musculus
ccagcgggaacccaacccatcttca

SEQ ID NO: 224033 - DNA, 25 bp, Mus musculus
cagccctccgtagccgaggtgggaa

SEQ ID NO: 224034 - DNA, 25 bp, Mus musculus
gaggtgggaaccagacccgcctcgc

SEQ ID NO: 224035 - DNA, 25 bp, Mus musculus
actatcgccaagtgcaacagtccgg

SEQ ID NO: 224036 - DNA, 25 bp, Mus musculus
aacagtccggctgcactgtccgtga

SEQ ID NO: 224037 - DNA, 25 bp, Mus musculus
cactgtccgtgagccagctcttatc

SEQ ID NO: 224038 - DNA, 25 bp, Mus musculus
cgtgagccagctcttatccgaggta

SEQ ID NO: 224039 - DNA, 25 bp, Mus musculus
agctcttatccgaggtaaggggcgc

SEQ ID NO: 224040 - DNA, 25 bp, Mus musculus
tcttacatgggttccgcccaggggc

SEQ ID NO: 224041 - DNA, 25 bp, Mus musculus
cgcgcagaccggctgtctagcggtc

SEQ ID NO: 224042 - DNA, 25 bp, Mus musculus
gtccgctccaccacgccgcgcagac

SEQ ID NO: 224043 - DNA, 25 bp, Mus musculus
accggctgtctagcggtcccgcgag

SEQ ID NO: 224044 - DNA, 25 bp, Mus musculus
tcccgcgaggaaggagctcggagct

SEQ ID NO: 224045 - DNA, 25 bp, Mus musculus
agctcggagtccgaggcggttcacc

SEQ ID NO: 224046 - DNA, 25 bp, Mus musculus
cctgccgcggcgacccaggccgcga

SEQ ID NO: 224047 - DNA, 25 bp, Mus musculus
accctcctgggtcttgaggcggtag

SEQ ID NO: 224048 - DNA, 25 bp, Mus musculus
ccgcaggtgcctgccactgagactg

SEQ ID NO: 224049 - DNA, 25 bp, Mus musculus
tgcctgccactgagactgtcccgaa

SEQ ID NO: 224050 - DNA, 25 bp, Mus musculus
tgccactgagactgtcccgaaggtc

SEQ ID NO: 224051 - DNA, 25 bp, Mus musculus
tgagactgtcccgaaggtcacccgc

SEQ ID NO: 224052 - DNA, 25 bp, Mus musculus
ggtcacccgccatgcacacctgttg

SEQ ID NO: 224053 - DNA, 25 bp, Mus musculus
ctgttgcctggaccgctcgtctcag

SEQ ID NO: 224054 - DNA, 25 bp, Mus musculus
cctccctcacagaggcgggctggct

SEQ ID NO: 224055 - DNA, 25 bp, Mus musculus
ttcgaaatgctctctgggtgcgcca

SEQ ID NO: 224056 - DNA, 25 bp, Mus musculus
cgaagtccacctgcagttgcccgga

SEQ ID NO: 224057 - DNA, 25 bp, Mus musculus
gaaaccctttcctacgctgaccatg

SEQ ID NO: 224058 - DNA, 25 bp, Mus musculus
cggggtctgtgcgaagaatcatcga

SEQ ID NO: 224059 - DNA, 25 bp, Mus musculus
gctacgacttgctggtgaatgctga

SEQ ID NO: 224060 - DNA, 25 bp, Mus musculus
agcgggatgtccagcgctacgactt

SEQ ID NO: 224061 - DNA, 25 bp, Mus musculus
gagtccatagcgtcatcggctgtca

SEQ ID NO: 224062 - DNA, 25 bp, Mus musculus
tttctgcaaacgtgacggccgttgt

SEQ ID NO: 224063 - DNA, 25 bp, Mus musculus
caggaacccggcctatttctattgg

SEQ ID NO: 224064 - DNA, 25 bp, Mus musculus
cccgcccacgtcaggtttcgaaatg

SEQ ID NO: 224065 - DNA, 25 bp, Mus musculus
gacgcacgtcacaatcgcagcaaga

SEQ ID NO: 224066 - DNA, 25 bp, Mus musculus
ttttctcagacacggagcgctacgc

SEQ ID NO: 224067 - DNA, 25 bp, Mus musculus
ttctgtgttttctcgctggggaata

SEQ ID NO: 224068 - DNA, 25 bp, Mus musculus
tactcccattggctgtttctgcaaa

SEQ ID NO: 224069 - DNA, 25 bp, Mus musculus
ctggcgattggccacgggtcacctg

SEQ ID NO: 224070 - DNA, 25 bp, Mus musculus
agcggctggcgattggcggttggcc

SEQ ID NO: 224071 - DNA, 25 bp, Mus musculus
ttggccacgggtcacctgcatggga

SEQ ID NO: 224072 - DNA, 25 bp, Mus musculus
cctggcaaagaggtccctggcgatt

SEQ ID NO: 224073 - DNA, 25 bp, Mus musculus
ggctggccctggcaaagaggtccct

SEQ ID NO: 224074 - DNA, 25 bp, Mus musculus
gcggtccagacgcagccccaattgg

SEQ ID NO: 224075 - DNA, 25 bp, Mus musculus
gccgctggaggacgccctctcccgc

SEQ ID NO: 224076 - DNA, 25 bp, Mus musculus
agcaggagagccattcgcggcggcc

SEQ ID NO: 224077 - DNA, 25 bp, Mus musculus
agcggccagcaggagagccattcgc

SEQ ID NO: 224078 - DNA, 25 bp, Mus musculus
caagcggccagcaggagagccattc

SEQ ID NO: 224079 - DNA, 25 bp, Mus musculus
tccgcaagcggccagcaggagagcc

SEQ ID NO: 224080 - DNA, 25 bp, Mus musculus
agggtctactcactccgcaagcggc

SEQ ID NO: 224081 - DNA, 25 bp, Mus musculus
caagggtctactcactccgcaagcg

SEQ ID NO: 224082 - DNA, 25 bp, Mus musculus
cacgggtcacctgcatgggaggtga

SEQ ID NO: 224083 - DNA, 25 bp, Mus musculus
ggcctcagccactcaccgtgtagta

SEQ ID NO: 224084 - DNA, 25 bp, Mus musculus
cggcctgacgtcagtcgcctatatg

SEQ ID NO: 224085 - DNA, 25 bp, Mus musculus
agcgcagaccctacctagtcacaga

SEQ ID NO: 224086 - DNA, 25 bp, Mus musculus
ctagtcacagaaccactccctgaga

SEQ ID NO: 224087 - DNA, 25 bp, Mus musculus
tgggtccgcatctcccttctggtca

SEQ ID NO: 224088 - DNA, 25 bp, Mus musculus
tccacaagggaacctcgcgtacggc

SEQ ID NO: 224089 - DNA, 25 bp, Mus musculus
tcaccgtgtagtaggagagcagccc

SEQ ID NO: 224090 - DNA, 25 bp, Mus musculus
gagcagccctgcattgtagtccagc

SEQ ID NO: 224091 - DNA, 25 bp, Mus musculus
tgtagtccagcacgaaccaacgata

SEQ ID NO: 224092 - DNA, 25 bp, Mus musculus
tcccttcatcacgttagtccatttg

SEQ ID NO: 224093 - DNA, 25 bp, Mus musculus
tagtccatttgctcagcggcccttc

SEQ ID NO: 224094 - DNA, 25 bp, Mus musculus
tgggagccgccaatgacaacaaacg

SEQ ID NO: 224095 - DNA, 25 bp, Mus musculus
tcgcctatatggcattcggcatgca

SEQ ID NO: 224096 - DNA, 25 bp, Mus musculus
tggtcattggctacccgcacgcaaa

SEQ ID NO: 224097 - DNA, 25 bp, Mus musculus
catgcacacgggaatgccgaaagtg

SEQ ID NO: 224098 - DNA, 25 bp, Mus musculus
gccctccgagcgacacgtagtcatt

SEQ ID NO: 224099 - DNA, 25 bp, Mus musculus
cgtagtcattgcgagttaggccacc

SEQ ID NO: 224100 - DNA, 25 bp, Mus musculus
ttaggccaccgctcgaggatactct

SEQ ID NO: 224101 - DNA, 25 bp, Mus musculus
ctcgaggatactctccaaactcagg

SEQ ID NO: 224102 - DNA, 25 bp, Mus musculus
aactctttgtttgccttcgatccgg

SEQ ID NO: 224103 - DNA, 25 bp, Mus musculus
ccttcgatccggctgaagggcgttc

SEQ ID NO: 224104 - DNA, 25 bp, Mus musculus
tttattctcgtctcctccggcactg

SEQ ID NO: 224105 - DNA, 25 bp, Mus musculus
cgggatctgcttctcagcagccatc

SEQ ID NO: 224106 - DNA, 25 bp, Mus musculus
ccctgagccgcaaagcacgatggaa

SEQ ID NO: 224107 - DNA, 25 bp, Mus musculus
cggcgagagagagcggcactttcca

SEQ ID NO: 224108 - DNA, 25 bp, Mus musculus
cactttccaggctgggccgatggta

SEQ ID NO: 224109 - DNA, 25 bp, Mus musculus
gatggtacactgacggactccgccg

SEQ ID NO: 224110 - DNA, 25 bp, Mus musculus
ggacgagaggcaaaccatgcacacg

SEQ ID NO: 224111 - DNA, 25 bp, Mus musculus
ttctcggcaagtttctcctccgggc

SEQ ID NO: 224112 - DNA, 25 bp, Mus musculus
tcccgtgcatgatggaaacaccatg

SEQ ID NO: 224113 - DNA, 25 bp, Mus musculus
ctccggtggggctcacgctagacag

SEQ ID NO: 224114 - DNA, 25 bp, Mus musculus
gcagggttccctcagcttcgctctg

SEQ ID NO: 224115 - DNA, 25 bp, Mus musculus
cgggagcgacgactgccgagttccc

SEQ ID NO: 224116 - DNA, 25 bp, Mus musculus
agttccctcaagtcagcctggcttc

SEQ ID NO: 224117 - DNA, 25 bp, Mus musculus
tggcttccagaagtcgcatcctgtc

SEQ ID NO: 224118 - DNA, 25 bp, Mus musculus
ctctgatcgtcgtccgaggggtcat

SEQ ID NO: 224119 - DNA, 25 bp, Mus musculus
tggggcgcctctttcctccctggtg

SEQ ID NO: 224120 - DNA, 25 bp, Mus musculus
ccaccggggagataactttgtcctg

SEQ ID NO: 224121 - DNA, 25 bp, Mus musculus
actttgtcctgggacgatctcgacc

SEQ ID NO: 224122 - DNA, 25 bp, Mus musculus
ggacgatctcgaccaaaagctgttc

SEQ ID NO: 224123 - DNA, 25 bp, Mus musculus
gtcgcatcctgtccgggcacttgac

SEQ ID NO: 224124 - DNA, 25 bp, Mus musculus
cagggcctggttccgcggctcagac

SEQ ID NO: 224125 - DNA, 25 bp, Mus musculus
ctggtctcttgcaaaacactggccc

SEQ ID NO: 224126 - DNA, 25 bp, Mus musculus
aggccaggctgtgccgaccttgagc

SEQ ID NO: 224127 - DNA, 25 bp, Mus musculus
catgtctgcgccgatgctccaaggc

SEQ ID NO: 224128 - DNA, 25 bp, Mus musculus
tggagaatttcccagcccgagtggg

SEQ ID NO: 224129 - DNA, 25 bp, Mus musculus
agtgaggctggaccgcgagatctca

SEQ ID NO: 224130 - DNA, 25 bp, Mus musculus
tctccgctaacatggcccggcagtg

SEQ ID NO: 224131 - DNA, 25 bp, Mus musculus
agaagctaggctttctccgctaaca

SEQ ID NO: 224132 - DNA, 25 bp, Mus musculus
tccacgcctgtctgcagaagctagg

SEQ ID NO: 224133 - DNA, 25 bp, Mus musculus
cccgtttgggcaagcggttagaatg

SEQ ID NO: 224134 - DNA, 25 bp, Mus musculus
ccttctggtctcttgcaaaacactg

SEQ ID NO: 224135 - DNA, 25 bp, Mus musculus
tgtgccgaccttgagcgcccgggtc

SEQ ID NO: 224136 - DNA, 25 bp, Mus musculus
ttggcagctccggtccatgtctgcg

SEQ ID NO: 224137 - DNA, 25 bp, Mus musculus
gttagaatgaatgtccacgcctgtc

SEQ ID NO: 224138 - DNA, 25 bp, Mus musculus
tagggaaggtggagaatttcccagc

SEQ ID NO: 224139 - DNA, 25 bp, Mus musculus
gcctcctctcgcacgccgacacaca

SEQ ID NO: 224140 - DNA, 25 bp, Mus musculus
ccagaacgaggctggccaggcctac

SEQ ID NO: 224141 - DNA, 25 bp, Mus musculus
ggggcctcatcctactccgcctcgg

SEQ ID NO: 224142 - DNA, 25 bp, Mus musculus
ggccgtctcggttgcctcagctgct

SEQ ID NO: 224143 - DNA, 25 bp, Mus musculus
ctgctgggcctaatccaggtcagga

SEQ ID NO: 224144 - DNA, 25 bp, Mus musculus
gccacgggctgctgggcctaatcca

SEQ ID NO: 224145 - DNA, 25 bp, Mus musculus
agaaagctgtgacccggtctctcgc

SEQ ID NO: 224146 - DNA, 25 bp, Mus musculus
aggaagaaagctgtgacccggtctc

SEQ ID NO: 224147 - DNA, 25 bp, Mus musculus
atgtcatccgaagtcggggatttga

SEQ ID NO: 224148 - DNA, 25 bp, Mus musculus
cgtgaagcagggagatgtcatccga

SEQ ID NO: 224149 - DNA, 25 bp, Mus musculus
cggtcggactgagactcgtgaagca

SEQ ID NO: 224150 - DNA, 25 bp, Mus musculus
tcgccaaagctagcccggtcggact

SEQ ID NO: 224151 - DNA, 25 bp, Mus musculus
ggctggccaggcctacgtcatgccg

SEQ ID NO: 224152 - DNA, 25 bp, Mus musculus
tccctacctgatatggcggcggcgg

SEQ ID NO: 224153 - DNA, 25 bp, Mus musculus
gggtgcgccggctagccacgatctc

SEQ ID NO: 224154 - DNA, 25 bp, Mus musculus
ctctcctcagctcgcgcactgccct

SEQ ID NO: 224155 - DNA, 25 bp, Mus musculus
ccaactttacccagcgggagggctg

SEQ ID NO: 224156 - DNA, 25 bp, Mus musculus
ctggctgctgtggtcgcccacaact

SEQ ID NO: 224157 - DNA, 25 bp, Mus musculus
tagccacgatctccgcgctcacact

SEQ ID NO: 224158 - DNA, 25 bp, Mus musculus
ttacccacggctgggggctgactct

SEQ ID NO: 224159 - DNA, 25 bp, Mus musculus
ggcctcctttgtagctctcctcccg

SEQ ID NO: 224160 - DNA, 25 bp, Mus musculus
tttgccttttgctgccgcagggttg

SEQ ID NO: 224161 - DNA, 25 bp, Mus musculus
ccgcagggttgtgggcttccaagcc

SEQ ID NO: 224162 - DNA, 25 bp, Mus musculus
tcctaaagctcagggaaggaaactg

SEQ ID NO: 224163 - DNA, 25 bp, Mus musculus
acagccaggtcaagcgaggccacga

SEQ ID NO: 224164 - DNA, 25 bp, Mus musculus
ctcgtgcgggcacgctctgtgcagc

SEQ ID NO: 224165 - DNA, 25 bp, Mus musculus
gccaggaactcaccggcctgctctc

SEQ ID NO: 224166 - DNA, 25 bp, Mus musculus
tcgagggcgcctccaaggttaccca

SEQ ID NO: 224167 - DNA, 25 bp, Mus musculus
tctttggaagtaggagcggtcgcca

SEQ ID NO: 224168 - DNA, 25 bp, Mus musculus
gctgtcgttccctccctttcagatt

SEQ ID NO: 224169 - DNA, 25 bp, Mus musculus
tcggtgccacttggccagttagttc

SEQ ID NO: 224170 - DNA, 25 bp, Mus musculus
ccagttagttcttggcggtcctccg

SEQ ID NO: 224171 - DNA, 25 bp, Mus musculus
gcgagccgcagctgacagtttcttt

SEQ ID NO: 224172 - DNA, 25 bp, Mus musculus
gacagtttcttttgtagtccgactc

SEQ ID NO: 224173 - DNA, 25 bp, Mus musculus
tccgctacagacacttgcgcgtctt

SEQ ID NO: 224174 - DNA, 25 bp, Mus musculus
ttgcgcgtctttcctttaggatctt

SEQ ID NO: 224175 - DNA, 25 bp, Mus musculus
ctttttccgctgaagcaactgctgc

SEQ ID NO: 224176 - DNA, 25 bp, Mus musculus
actgctgctacggttgcctctgaag

SEQ ID NO: 224177 - DNA, 25 bp, Mus musculus
cctctgaaggtactgtgccggtttc

SEQ ID NO: 224178 - DNA, 25 bp, Mus musculus
tgagcgctttttgagttgaaaaacc

SEQ ID NO: 224179 - DNA, 25 bp, Mus musculus
taacggcagagttttaaggaggctc

SEQ ID NO: 224180 - DNA, 25 bp, Mus musculus
agctcgcggcagcatcgctcttgca

SEQ ID NO: 224181 - DNA, 25 bp, Mus musculus
agtcacgtgacagccgcaaagcgcc

SEQ ID NO: 224182 - DNA, 25 bp, Mus musculus
cttcccagcgtttgtttgagcaccg

SEQ ID NO: 224183 - DNA, 25 bp, Mus musculus
tgaagtgtctggctctgctcgcttc

SEQ ID NO: 224184 - DNA, 25 bp, Mus musculus
tccttgcggattttcaggtgaagtg

SEQ ID NO: 224185 - DNA, 25 bp, Mus musculus
acatggaccgggagatgatccttgc

SEQ ID NO: 224186 - DNA, 25 bp, Mus musculus
gtgcatgagcacctagtctcccgcg

SEQ ID NO: 224187 - DNA, 25 bp, Mus musculus
ctgaaggttaccgagtgcatgagca

SEQ ID NO: 224188 - DNA, 25 bp, Mus musculus
caaaatgtgcgacagcccaggcgcc

SEQ ID NO: 224189 - DNA, 25 bp, Mus musculus
aagcgccgctttgcgacctcgatga

SEQ ID NO: 224190 - DNA, 25 bp, Mus musculus
ccaaagcgcttgacaggagggcagt

SEQ ID NO: 224191 - DNA, 25 bp, Mus musculus
cggaataacctgttgcgggtcctca

SEQ ID NO: 224192 - DNA, 25 bp, Mus musculus
actaagcacgtgaggcgccgaatca

SEQ ID NO: 224193 - DNA, 25 bp, Mus musculus
gctttgcgtatgactaagcacgtga

SEQ ID NO: 224194 - DNA, 25 bp, Mus musculus
cgacctcgatgacaggcaaaatgtg

SEQ ID NO: 224195 - DNA, 25 bp, Mus musculus
tctgtctaatggagccctgaggagc

SEQ ID NO: 224196 - DNA, 25 bp, Mus musculus
actgctgtgttcctagaggggtccg

SEQ ID NO: 224197 - DNA, 25 bp, Mus musculus
ggcaggcgccacattgttgtccaat

SEQ ID NO: 224198 - DNA, 25 bp, Mus musculus
tcggacactgtagaatgaggggctc

SEQ ID NO: 224199 - DNA, 25 bp, Mus musculus
agcgtgcggagtttcgaatctttcg

SEQ ID NO: 224200 - DNA, 25 bp, Mus musculus
tgtcacgacatttgcaacgctcctc

SEQ ID NO: 224201 - DNA, 25 bp, Mus musculus
ggcgcacggaaacttcttgtcacga

SEQ ID NO: 224202 - DNA, 25 bp, Mus musculus
ccggacacggtaattaggagcaatt

SEQ ID NO: 224203 - DNA, 25 bp, Mus musculus
agaggggttacacacgtctacgcgg

SEQ ID NO: 224204 - DNA, 25 bp, Mus musculus
cacttgggaagctaggccttgccaa

SEQ ID NO: 224205 - DNA, 25 bp, Mus musculus
tgaattgtcacctgctcctgtcccg

SEQ ID NO: 224206 - DNA, 25 bp, Mus musculus
actcccacttcgacagcggtaattg

SEQ ID NO: 224207 - DNA, 25 bp, Mus musculus
ccatcttggcaagtctgcggtgaac

SEQ ID NO: 224208 - DNA, 25 bp, Mus musculus
attcacacgctctcgggcgcacgga

SEQ ID NO: 224209 - DNA, 25 bp, Mus musculus
gcctctaggcttcagcacgctagct

SEQ ID NO: 224210 - DNA, 25 bp, Mus musculus
gaagtctcccgggaatcctccatcc

SEQ ID NO: 224211 - DNA, 25 bp, Mus musculus
tcccgggaatcctccatcctcagcg

SEQ ID NO: 224212 - DNA, 25 bp, Mus musculus
catcctcagcggtcctggcgctggc

SEQ ID NO: 224213 - DNA, 25 bp, Mus musculus
cagactgggcgggatgcaaaggctc

SEQ ID NO: 224214 - DNA, 25 bp, Mus musculus
ggatgcaaaggctctgacctggtgc

SEQ ID NO: 224215 - DNA, 25 bp, Mus musculus
gccgcgccaccagggtcggatgcaa

SEQ ID NO: 224216 - DNA, 25 bp, Mus musculus
cgcgccaccagggtcggatgcaagt

SEQ ID NO: 224217 - DNA, 25 bp, Mus musculus
atgcaagtgggtgttcgctctgagc

SEQ ID NO: 224218 - DNA, 25 bp, Mus musculus
taggcttcagcacgctagctctcgc

SEQ ID NO: 224219 - DNA, 25 bp, Mus musculus
gctctgcgcggactctcctccctct

SEQ ID NO: 224220 - DNA, 25 bp, Mus musculus
tctaggcttcagcacgctagctctc

SEQ ID NO: 224221 - DNA, 25 bp, Mus musculus
ttcagcacgctagctctcgccgccc

SEQ ID NO: 224222 - DNA, 25 bp, Mus musculus
ggtgttcgctctgagcgcgcgcctc

SEQ ID NO: 224223 - DNA, 25 bp, Mus musculus
acaagcgctactgccgctggaagga

SEQ ID NO: 224224 - DNA, 25 bp, Mus musculus
caaccacggagtggtgtccgcgctc

SEQ ID NO: 224225 - DNA, 25 bp, Mus musculus
gctggaaggactgcctgtgcgccaa

SEQ ID NO: 224226 - DNA, 25 bp, Mus musculus
tgcctgtgcgccaagtgtacgctca

SEQ ID NO: 224227 - DNA, 25 bp, Mus musculus
gcgccaagtgtacgctcatcgccga

SEQ ID NO: 224228 - DNA, 25 bp, Mus musculus
agtgtacgctcatcgccgagcgcca

SEQ ID NO: 224229 - DNA, 25 bp, Mus musculus
agcgccagcgcgtcatggcggctca

SEQ ID NO: 224230 - DNA, 25 bp, Mus musculus
ggcgcgcgagttgcaattgctgtac

SEQ ID NO: 224231 - DNA, 25 bp, Mus musculus
tgcaattgctgtacggcactgccga

SEQ ID NO: 224232 - DNA, 25 bp, Mus musculus
tgctgtacggcactgccgagggcct

SEQ ID NO: 224233 - DNA, 25 bp, Mus musculus
gcggcctgcctacgaagtctttggc

SEQ ID NO: 224234 - DNA, 25 bp, Mus musculus
cctacgaagtctttggctcggtttg

SEQ ID NO: 224235 - DNA, 25 bp, Mus musculus
ctttggctcggtttgcgccaccgac

SEQ ID NO: 224236 - DNA, 25 bp, Mus musculus
gcagcggagaagtacccgcggaccc

SEQ ID NO: 224237 - DNA, 25 bp, Mus musculus
ttgtcaagaggctggggatccctaa

SEQ ID NO: 224238 - DNA, 25 bp, Mus musculus
ccttggtgcagtgtgagtttttata

SEQ ID NO: 224239 - DNA, 25 bp, Mus musculus
tgccgataagcatgggtttccttgg

SEQ ID NO: 224240 - DNA, 25 bp, Mus musculus
gctctctttgttgcttatgccgata

SEQ ID NO: 224241 - DNA, 25 bp, Mus musculus
aaggtgcactttcctcgttgcggta

SEQ ID NO: 224242 - DNA, 25 bp, Mus musculus
ctgactcgagtctttgggacacata

SEQ ID NO: 224243 - DNA, 25 bp, Mus musculus
ggatgtatacatctcttggcactga

SEQ ID NO: 224244 - DNA, 25 bp, Mus musculus
ttgtgtgtcctccaatacccgttcc

SEQ ID NO: 224245 - DNA, 25 bp, Mus musculus
tcaacacgcgctcaggtggatggca

SEQ ID NO: 224246 - DNA, 25 bp, Mus musculus
ggcctgcccgccttgttgtcaagag

SEQ ID NO: 224247 - DNA, 25 bp, Mus musculus
ctcacagttggctttagggacttgc

SEQ ID NO: 224248 - DNA, 25 bp, Mus musculus
ggactacgccttcagcgacctcatg

SEQ ID NO: 224249 - DNA, 25 bp, Mus musculus
ctggtgcccacactcggttttcggc

SEQ ID NO: 224250 - DNA, 25 bp, Mus musculus
atggcaggatggaccagcctcttgt

SEQ ID NO: 224251 - DNA, 25 bp, Mus musculus
ggtcattcgacagctcctctctcgg

SEQ ID NO: 224252 - DNA, 25 bp, Mus musculus
cgctcatcttcctcgtgggcgctgt

SEQ ID NO: 224253 - DNA, 25 bp, Mus musculus
gataccatgaatggctcggacagcc

SEQ ID NO: 224254 - DNA, 25 bp, Mus musculus
cggcgtctgctttggtgataccatg

SEQ ID NO: 224255 - DNA, 25 bp, Mus musculus
cgctcaccaagacccggacggctgc

SEQ ID NO: 224256 - DNA, 25 bp, Mus musculus
agccagggagctacgcgctcaccaa

SEQ ID NO: 224257 - DNA, 25 bp, Mus musculus
agctcgacagtcttgctggggcgct

SEQ ID NO: 224258 - DNA, 25 bp, Mus musculus
tctggctcttggagctcgacagtct

SEQ ID NO: 224259 - DNA, 25 bp, Mus musculus
ggagcggggtaccatcctatactct

SEQ ID NO: 224260 - DNA, 25 bp, Mus musculus
agtcagggtcattcgacagctcctc

SEQ ID NO: 224261 - DNA, 25 bp, Mus musculus
gagccaaatggagtcagggtcattc

SEQ ID NO: 224262 - DNA, 25 bp, Mus musculus
ctcaagtctaaagcagagcgggtcc

SEQ ID NO: 224263 - DNA, 25 bp, Mus musculus
cgctagtgaccgactcaagtctaaa

SEQ ID NO: 224264 - DNA, 25 bp, Mus musculus
atcctatactctgggtgctcgctcc

SEQ ID NO: 224265 - DNA, 25 bp, Mus musculus
ggccagctggaagctcagagctcga

SEQ ID NO: 224266 - DNA, 25 bp, Mus musculus
ctccaattgtttcgaccggtgcggg

SEQ ID NO: 224267 - DNA, 25 bp, Mus musculus
tggcctttaaccgatctccaattgt

SEQ ID NO: 224268 - DNA, 25 bp, Mus musculus
tggctggcctttaaccgatctccaa

SEQ ID NO: 224269 - DNA, 25 bp, Mus musculus
gcacgctgtccgacaccctggctgg

SEQ ID NO: 224270 - DNA, 25 bp, Mus musculus
aatcgagggacagggcacgctgtcc

SEQ ID NO: 224271 - DNA, 25 bp, Mus musculus
acacggtctgaggaatcgagggaca

SEQ ID NO: 224272 - DNA, 25 bp, Mus musculus
tcggcgacacggtctgaggaatcga

SEQ ID NO: 224273 - DNA, 25 bp, Mus musculus
aggccgcgcccacactcacgctgcg

SEQ ID NO: 224274 - DNA, 25 bp, Mus musculus
agtggcccagcgaactcaggccgcg

SEQ ID NO: 224275 - DNA, 25 bp, Mus musculus
cactgcgcgaggcttccctgcgtgt

SEQ ID NO: 224276 - DNA, 25 bp, Mus musculus
ctcagagctcgatgacctgcagggg

SEQ ID NO: 224277 - DNA, 25 bp, Mus musculus
ttgtttcgaccggtgcgggaacgca

SEQ ID NO: 224278 - DNA, 25 bp, Mus musculus
gaagctcagagctcgatgacctgca

SEQ ID NO: 224279 - DNA, 25 bp, Mus musculus
caagagtcacaaaggctgagagccc

SEQ ID NO: 224280 - DNA, 25 bp, Mus musculus
tatctagaaacacaaatcccgggtc

SEQ ID NO: 224281 - DNA, 25 bp, Mus musculus
tctgcaatcgggaaaggcactcaga

SEQ ID NO: 224282 - DNA, 25 bp, Mus musculus
gcctccctgcgcgacaattaacaag

SEQ ID NO: 224283 - DNA, 25 bp, Mus musculus
acttttcggcgccatcagttcagca

SEQ ID NO: 224284 - DNA, 25 bp, Mus musculus
ggaggagaggcacccactcaaattt

SEQ ID NO: 224285 - DNA, 25 bp, Mus musculus
aatttcagtggttctcccaggtgga

SEQ ID NO: 224286 - DNA, 25 bp, Mus musculus
ccctcggaaaggacatggaagctcg

SEQ ID NO: 224287 - DNA, 25 bp, Mus musculus
atggaagctcgttcccgatcccgga

SEQ ID NO: 224288 - DNA, 25 bp, Mus musculus
ttcccgatcccggagtgctggtcag

SEQ ID NO: 224289 - DNA, 25 bp, Mus musculus
tcaggcgccgctacctggttctgga

SEQ ID NO: 224290 - DNA, 25 bp, Mus musculus
gacgagtcgcttctcactgggtccc

SEQ ID NO: 224291 - DNA, 25 bp, Mus musculus
gagccgactccgtcttatctagaaa

SEQ ID NO: 224292 - DNA, 25 bp, Mus musculus
tcagttcagcaaagccacccggagg

SEQ ID NO: 224293 - DNA, 25 bp, Mus musculus
tgactgacggacaacaaaaatggcg

SEQ ID NO: 224294 - DNA, 25 bp, Mus musculus
caaaaatggcggagcggagccagac

SEQ ID NO: 224295 - DNA, 25 bp, Mus musculus
tgggctcattgactgacggacaaca

SEQ ID NO: 224296 - DNA, 25 bp, Mus musculus
tttttgcgtgggctcattgactgac

SEQ ID NO: 224297 - DNA, 25 bp, Mus musculus
ccggtggtttttgcgtgggctcatt

SEQ ID NO: 224298 - DNA, 25 bp, Mus musculus
cagcccgcggatcccaccgctcgct

SEQ ID NO: 224299 - DNA, 25 bp, Mus musculus
agccttttctgtcagcccgcggatc

SEQ ID NO: 224300 - DNA, 25 bp, Mus musculus
tcttcctgagggagccttttctgtc

SEQ ID NO: 224301 - DNA, 25 bp, Mus musculus
agcgtcttcctgagggagccttttc

SEQ ID NO: 224302 - DNA, 25 bp, Mus musculus
cgccgcgcagcgtcttcctgaggga

SEQ ID NO: 224303 - DNA, 25 bp, Mus musculus
gtttccctggcaaccgccgcgcagc

SEQ ID NO: 224304 - DNA, 25 bp, Mus musculus
agcttcggctgcacgctctcttctg

SEQ ID NO: 224305 - DNA, 25 bp, Mus musculus
cggagcttcggctgcacgctctctt

SEQ ID NO: 224306 - DNA, 25 bp, Mus musculus
tgagggagccttttctgtcagcccg

SEQ ID NO: 224307 - DNA, 25 bp, Mus musculus
ggttcctggaggacaacgtctgcta

SEQ ID NO: 224308 - DNA, 25 bp, Mus musculus
gaggcgcttagctaaattcgaaaca

SEQ ID NO: 224309 - DNA, 25 bp, Mus musculus
tgaatccgcccgaaagcgactttta

SEQ ID NO: 224310 - DNA, 25 bp, Mus musculus
gcgacttttagcagcgctcctccta

SEQ ID NO: 224311 - DNA, 25 bp, Mus musculus
tcctctaacgctactatcatatatg

SEQ ID NO: 224312 - DNA, 25 bp, Mus musculus
ttactgcaatcgcactccggctgtg

SEQ ID NO: 224313 - DNA, 25 bp, Mus musculus
gtgattgctcgggtctgacttcgca

SEQ ID NO: 224314 - DNA, 25 bp, Mus musculus
caagtggcggtgtgcttcaaaaccc

SEQ ID NO: 224315 - DNA, 25 bp, Mus musculus
ttttccgcgcccaggcgagagcagc

SEQ ID NO: 224316 - DNA, 25 bp, Mus musculus
gctgttgctccacaaggcccagatc

SEQ ID NO: 224317 - DNA, 25 bp, Mus musculus
ggcgcccaccatgtacgcctttgtg

SEQ ID NO: 224318 - DNA, 25 bp, Mus musculus
tcgcgactggattttgacaaccaga

SEQ ID NO: 224319 - DNA, 25 bp, Mus musculus
agggagccaccgcttgctcttgcct

SEQ ID NO: 224320 - DNA, 25 bp, Mus musculus
agcggggctttcaggaacaataaca

SEQ ID NO: 224321 - DNA, 25 bp, Mus musculus
tccggccttggcgtggctcttccgg

SEQ ID NO: 224322 - DNA, 25 bp, Mus musculus
tcagcctccaagtccgctgcccgcc

SEQ ID NO: 224323 - DNA, 25 bp, Mus musculus
tccgctctgtgagtaccggccctgt

SEQ ID NO: 224324 - DNA, 25 bp, Mus musculus
gctggagatccgctctgtgagtacc

SEQ ID NO: 224325 - DNA, 25 bp, Mus musculus
ccctggcgctggagatccgctctgt

SEQ ID NO: 224326 - DNA, 25 bp, Mus musculus
aaggcgctgcaatgcgccctggcgc

SEQ ID NO: 224327 - DNA, 25 bp, Mus musculus
atgccgaaggtgaaggcgctgcaat

SEQ ID NO: 224328 - DNA, 25 bp, Mus musculus
ctaccctgcgcggatgccgaaggtg

SEQ ID NO: 224329 - DNA, 25 bp, Mus musculus
gccgccacctcatctcctccctgtc

SEQ ID NO: 224330 - DNA, 25 bp, Mus musculus
tcagctgctgttcgggcgggaccca

SEQ ID NO: 224331 - DNA, 25 bp, Mus musculus
tccaggctgccatgacaacgagtcc

SEQ ID NO: 224332 - DNA, 25 bp, Mus musculus
tcttgctccgtagtgtccggccttg

SEQ ID NO: 224333 - DNA, 25 bp, Mus musculus
actgcctcttgctccgtagtgtccg

SEQ ID NO: 224334 - DNA, 25 bp, Mus musculus
ggctgccatgacaacgagtccgcgc

SEQ ID NO: 224335 - DNA, 25 bp, Mus musculus
caccatatcacagcggccattcggc

SEQ ID NO: 224336 - DNA, 25 bp, Mus musculus
cagtcaccatatcacagcggccatt

SEQ ID NO: 224337 - DNA, 25 bp, Mus musculus
agtcaccatatcacagcggccattc

SEQ ID NO: 224338 - DNA, 25 bp, Mus musculus
tcaccatatcacagcggccattcgg

SEQ ID NO: 224339 - DNA, 25 bp, Mus musculus
ccgcgccctggggataccaaggccg

SEQ ID NO: 224340 - DNA, 25 bp, Mus musculus
accatatcacagcggccattcggcc

SEQ ID NO: 224341 - DNA, 25 bp, Mus musculus
catatcacagcggccattcggccag

SEQ ID NO: 224342 - DNA, 25 bp, Mus musculus
atatcacagcggccattcggccagc

SEQ ID NO: 224343 - DNA, 25 bp, Mus musculus
ggtcgccgcgccctggggataccaa

SEQ ID NO: 224344 - DNA, 25 bp, Mus musculus
gtcgccgcgccctggggataccaag

SEQ ID NO: 224345 - DNA, 25 bp, Mus musculus
tcgccgcgccctggggataccaagg

SEQ ID NO: 224346 - DNA, 25 bp, Mus musculus
cgccgcgccctggggataccaaggc

SEQ ID NO: 224347 - DNA, 25 bp, Mus musculus
gtcaccatatcacagcggccattcg

SEQ ID NO: 224348 - DNA, 25 bp, Mus musculus
cgcgccctggggataccaaggccgg

SEQ ID NO: 224349 - DNA, 25 bp, Mus musculus
ccagctgcccgtccatccagtcacc

SEQ ID NO: 224350 - DNA, 25 bp, Mus musculus
agcaccgaagccaccgggtcgccgc

SEQ ID NO: 224351 - DNA, 25 bp, Mus musculus
ttcgtagcgtgtcttcgtgccgaag

SEQ ID NO: 224352 - DNA, 25 bp, Mus musculus
atcttcgtagcgtgtcttcgtgccg

SEQ ID NO: 224353 - DNA, 25 bp, Mus musculus
ttggcatcttcgtagcgtgtcttcg

SEQ ID NO: 224354 - DNA, 25 bp, Mus musculus
cgccaccggatcgaccagcagccag

SEQ ID NO: 224355 - DNA, 25 bp, Mus musculus
ccgtgacggatgagggcgaccagct

SEQ ID NO: 224356 - DNA, 25 bp, Mus musculus
gcagctgcttcagcttgcggatctg

SEQ ID NO: 224357 - DNA, 25 bp, Mus musculus
ggccacttggctcccgccatcccgg

SEQ ID NO: 224358 - DNA, 25 bp, Mus musculus
aagagggcagccagacgcagggcca

SEQ ID NO: 224359 - DNA, 25 bp, Mus musculus
ggtcgtagttctcccggctgaagag

SEQ ID NO: 224360 - DNA, 25 bp, Mus musculus
gctgctgtccacacagcggtgcttg

SEQ ID NO: 224361 - DNA, 25 bp, Mus musculus
cggcgctgctgtccacacagcggtg

SEQ ID NO: 224362 - DNA, 25 bp, Mus musculus
ccctgcagctgcttcagcttgcgga

SEQ ID NO: 224363 - DNA, 25 bp, Mus musculus
gggtgcccagcataacccgagttcc

SEQ ID NO: 224364 - DNA, 25 bp, Mus musculus
gccctctgccgcacttgtcccactg

SEQ ID NO: 224365 - DNA, 25 bp, Mus musculus
gctccagaagatcctcggtgcccag

SEQ ID NO: 224366 - DNA, 25 bp, Mus musculus
cgctcaccctggaatctcaggactg

SEQ ID NO: 224367 - DNA, 25 bp, Mus musculus
gaatctcaggactgccccaggagcc

SEQ ID NO: 224368 - DNA, 25 bp, Mus musculus
cctggaccctgacgcggctccggga

SEQ ID NO: 224369 - DNA, 25 bp, Mus musculus
gctctcagaattccggggctcggcc

SEQ ID NO: 224370 - DNA, 25 bp, Mus musculus
ggtccgacagggacatccagccacg

SEQ ID NO: 224371 - DNA, 25 bp, Mus musculus
gggctcccagcatctcgcgcctgga

SEQ ID NO: 224372 - DNA, 25 bp, Mus musculus
gcgcctggagccctgtgctccagaa

SEQ ID NO: 224373 - DNA, 25 bp, Mus musculus
cctgtgctccagaagatcctcggtg

SEQ ID NO: 224374 - DNA, 25 bp, Mus musculus
tgtgctccagaagatcctcggtgcc

SEQ ID NO: 224375 - DNA, 25 bp, Mus musculus
gcagcccggcacctcagagcagacc

SEQ ID NO: 224376 - DNA, 25 bp, Mus musculus
ctgctagccgccctccttgccaccg

SEQ ID NO: 224377 - DNA, 25 bp, Mus musculus
gctacaacggcgtgcatgccaatta

SEQ ID NO: 224378 - DNA, 25 bp, Mus musculus
gcatgccaattacgcctgcaggcta

SEQ ID NO: 224379 - DNA, 25 bp, Mus musculus
attaagcggtctcggctacaacggc

SEQ ID NO: 224380 - DNA, 25 bp, Mus musculus
atgctttattaagcggtctcggcta

SEQ ID NO: 224381 - DNA, 25 bp, Mus musculus
gcggtgagatatgtaatgctttatt

SEQ ID NO: 224382 - DNA, 25 bp, Mus musculus
ctccgcgtgaggtaatgaaatatgg

SEQ ID NO: 224383 - DNA, 25 bp, Mus musculus
cctctcacaggctccgcgtgaggta

SEQ ID NO: 224384 - DNA, 25 bp, Mus musculus
caaagaatccactgagaagcccgtc

SEQ ID NO: 224385 - DNA, 25 bp, Mus musculus
tcgcggcgtgcatcgcattatttca

SEQ ID NO: 224386 - DNA, 25 bp, Mus musculus
ttatggccggcccttatcgcggcgt

SEQ ID NO: 224387 - DNA, 25 bp, Mus musculus
tgggcctcattatggccggccctta

SEQ ID NO: 224388 - DNA, 25 bp, Mus musculus
aaaaaacgcgacacctggagcaatc

SEQ ID NO: 224389 - DNA, 25 bp, Mus musculus
ctccaagtcctcagagcccaaaaaa

SEQ ID NO: 224390 - DNA, 25 bp, Mus musculus
aacacagctgactcccattagggcc

SEQ ID NO: 224391 - DNA, 25 bp, Mus musculus
tacatcgtgcttaatgtggcggccg

SEQ ID NO: 224392 - DNA, 25 bp, Mus musculus
gagacgcgggtacctcgccactcat

SEQ ID NO: 224393 - DNA, 25 bp, Mus musculus
ccgaggcctccgttgcctgagagac

SEQ ID NO: 224394 - DNA, 25 bp, Mus musculus
ggcgtgaccgaccacccagctatgt

SEQ ID NO: 224395 - DNA, 25 bp, Mus musculus
tgctcggcgcctatctggagcgcca

SEQ ID NO: 224396 - DNA, 25 bp, Mus musculus
cagcacctgttggtgccggagcctc

SEQ ID NO: 224397 - DNA, 25 bp, Mus musculus
cagcacctcctgctctgggtggaga

SEQ ID NO: 224398 - DNA, 25 bp, Mus musculus
agagcctcgactcgctgctcggtgt

SEQ ID NO: 224399 - DNA, 25 bp, Mus musculus
tcctgctcttcgtcgtgggcttcat

SEQ ID NO: 224400 - DNA, 25 bp, Mus musculus
ggcgtcctcattggcacctttatcg

SEQ ID NO: 224401 - DNA, 25 bp, Mus musculus
cggttggggctacatcgtgcttaat

SEQ ID NO: 224402 - DNA, 25 bp, Mus musculus
cggctacctgtacggcttcgtgcta

SEQ ID NO: 224403 - DNA, 25 bp, Mus musculus
acctttatcgctcatgtggtctgca

SEQ ID NO: 224404 - DNA, 25 bp, Mus musculus
tgggcttcatcgtggtctccttccc

SEQ ID NO: 224405 - DNA, 25 bp, Mus musculus
ttggactgccaaggtaaacagtgtc

SEQ ID NO: 224406 - DNA, 25 bp, Mus musculus
cccaacaggtgagagcgctggcgac

SEQ ID NO: 224407 - DNA, 25 bp, Mus musculus
agctggaaaagccatttcgccgccc

SEQ ID NO: 224408 - DNA, 25 bp, Mus musculus
gctccggagctggaaaagccatttc

SEQ ID NO: 224409 - DNA, 25 bp, Mus musculus
cgactgtgtcaacagcgcggcctgg

SEQ ID NO: 224410 - DNA, 25 bp, Mus musculus
tctcattaaaatccgcgactgtgtc

SEQ ID NO: 224411 - DNA, 25 bp, Mus musculus
cagtgtccctggcagttcaaaggtg

SEQ ID NO: 224412 - DNA, 25 bp, Mus musculus
atctgtaaaactgccacttggactg

SEQ ID NO: 224413 - DNA, 25 bp, Mus musculus
ccctcgggtcggtatttaatatctg

SEQ ID NO: 224414 - DNA, 25 bp, Mus musculus
cacgggatcccttggtgcagacagc

SEQ ID NO: 224415 - DNA, 25 bp, Mus musculus
gaatccgaccgccagctgcagggag

SEQ ID NO: 224416 - DNA, 25 bp, Mus musculus
atcgaattaggagacagccgggctg

SEQ ID NO: 224417 - DNA, 25 bp, Mus musculus
cgacacggaaaatcgaattaggaga

SEQ ID NO: 224418 - DNA, 25 bp, Mus musculus
cacgcacgctccagatttctcatta

SEQ ID NO: 224419 - DNA, 25 bp, Mus musculus
aagcgccagggaaaaggctcagagc

SEQ ID NO: 224420 - DNA, 25 bp, Mus musculus
aagatggctccggcgccaagacgca

SEQ ID NO: 224421 - DNA, 25 bp, Mus musculus
gataagatggctccggcgccaagac

SEQ ID NO: 224422 - DNA, 25 bp, Mus musculus
agataagatggctccggcgccaaga

SEQ ID NO: 224423 - DNA, 25 bp, Mus musculus
cagataagatggctccggcgccaag

SEQ ID NO: 224424 - DNA, 25 bp, Mus musculus
tacagataagatggctccggcgcca

SEQ ID NO: 224425 - DNA, 25 bp, Mus musculus
atacagataagatggctccggcgcc

SEQ ID NO: 224426 - DNA, 25 bp, Mus musculus
catacagataagatggctccggcgc

SEQ ID NO: 224427 - DNA, 25 bp, Mus musculus
gccatacagataagatggctccggc

SEQ ID NO: 224428 - DNA, 25 bp, Mus musculus
cggccatacagataagatggctccg

SEQ ID NO: 224429 - DNA, 25 bp, Mus musculus
cgcggccatacagataagatggctc

SEQ ID NO: 224430 - DNA, 25 bp, Mus musculus
ccgcggccatacagataagatggct

SEQ ID NO: 224431 - DNA, 25 bp, Mus musculus
cccgcggccatacagataagatggc

SEQ ID NO: 224432 - DNA, 25 bp, Mus musculus
ggctccggcgccaagacgcagccct

SEQ ID NO: 224433 - DNA, 25 bp, Mus musculus
tacagtcagtcgcagctggccaatc

SEQ ID NO: 224434 - DNA, 25 bp, Mus musculus
gggccctacctgagctactacagtc

SEQ ID NO: 224435 - DNA, 25 bp, Mus musculus
gtcgcgccatggacctctgcacttt

SEQ ID NO: 224436 - DNA, 25 bp, Mus musculus
tgtctttagctacctgttgccagtg

SEQ ID NO: 224437 - DNA, 25 bp, Mus musculus
cagtgctggtgctcagcctgaccta

SEQ ID NO: 224438 - DNA, 25 bp, Mus musculus
ctgcactacctctggcgcacagttg

SEQ ID NO: 224439 - DNA, 25 bp, Mus musculus
cagttgacccagtagctgcaggctc

SEQ ID NO: 224440 - DNA, 25 bp, Mus musculus
tgatcgtcatcgtggcggtactctt

SEQ ID NO: 224441 - DNA, 25 bp, Mus musculus
cttatcctctgcgtgtggtttggtc

SEQ ID NO: 224442 - DNA, 25 bp, Mus musculus
cctgcgcatcctttcacatctagta

SEQ ID NO: 224443 - DNA, 25 bp, Mus musculus
gtatcttatgccaactcgtgtgtca

SEQ ID NO: 224444 - DNA, 25 bp, Mus musculus
cccatcgtttatgctctggtctcca

SEQ ID NO: 224445 - DNA, 25 bp, Mus musculus
tccgcaaaggtttccgcaaaatctg

SEQ ID NO: 224446 - DNA, 25 bp, Mus musculus
cactcaggtatctggccatccgcta

SEQ ID NO: 224447 - DNA, 25 bp, Mus musculus
gcccaacgatggttggaaacaatcc

SEQ ID NO: 224448 - DNA, 25 bp, Mus musculus
ggccagcagccgaactcaaagcaga

SEQ ID NO: 224449 - DNA, 25 bp, Mus musculus
aggtggccagcagccgaactcaaag

SEQ ID NO: 224450 - DNA, 25 bp, Mus musculus
cgatggttggaaacaatcccgagga

SEQ ID NO: 224451 - DNA, 25 bp, Mus musculus
cactgagcccaacgatggttggaaa

SEQ ID NO: 224452 - DNA, 25 bp, Mus musculus
cacagagcactgagcccaacgatgg

SEQ ID NO: 224453 - DNA, 25 bp, Mus musculus
tggagcgaaaagaccaagttgggaa

SEQ ID NO: 224454 - DNA, 25 bp, Mus musculus
ccgcgtggagcgaaaagaccaagtt

SEQ ID NO: 224455 - DNA, 25 bp, Mus musculus
tcgagtccgcgtggagcgaaaagac

SEQ ID NO: 224456 - DNA, 25 bp, Mus musculus
agccatttctgctcgagtccgcgtg

SEQ ID NO: 224457 - DNA, 25 bp, Mus musculus
cagcgactgcgagccatttctgctc

SEQ ID NO: 224458 - DNA, 25 bp, Mus musculus
cggagcagcgactgcgagccatttc

SEQ ID NO: 224459 - DNA, 25 bp, Mus musculus
agccgaactcaaagcagaagccttc

SEQ ID NO: 224460 - DNA, 25 bp, Mus musculus
aatcccgaggaggtggccagcagcc

SEQ ID NO: 224461 - DNA, 25 bp, Mus musculus
ttctcttgcaaggaccgtcgtttaa

SEQ ID NO: 224462 - DNA, 25 bp, Mus musculus
ggcgcctttattcgcctgaccctgg

SEQ ID NO: 224463 - DNA, 25 bp, Mus musculus
gcgtcggcgcctttattcgcctgac

SEQ ID NO: 224464 - DNA, 25 bp, Mus musculus
tgcgtcggcgcctttattcgcctga

SEQ ID NO: 224465 - DNA, 25 bp, Mus musculus
ctgcgtcggcgcctttattcgcctg

SEQ ID NO: 224466 - DNA, 25 bp, Mus musculus
cgtcgtttaaactgcgtcggcgcct

SEQ ID NO: 224467 - DNA, 25 bp, Mus musculus
tgcaaggaccgtcgtttaaactgcg

SEQ ID NO: 224468 - DNA, 25 bp, Mus musculus
ttgcaaggaccgtcgtttaaactgc

SEQ ID NO: 224469 - DNA, 25 bp, Mus musculus
tctcttgcaaggaccgtcgtttaaa

SEQ ID NO: 224470 - DNA, 25 bp, Mus musculus
tttctcttgcaaggaccgtcgttta

SEQ ID NO: 224471 - DNA, 25 bp, Mus musculus
ctttctcttgcaaggaccgtcgttt

SEQ ID NO: 224472 - DNA, 25 bp, Mus musculus
tctttctcttgcaaggaccgtcgtt

SEQ ID NO: 224473 - DNA, 25 bp, Mus musculus
tctctttctcttgcaaggaccgtcg

SEQ ID NO: 224474 - DNA, 25 bp, Mus musculus
cttgcaaggaccgtcgtttaaactg

SEQ ID NO: 224475 - DNA, 25 bp, Mus musculus
cggggctcgcagtcagagcaacctc

SEQ ID NO: 224476 - DNA, 25 bp, Mus musculus
cagcccgtagccgtagccgtaagcg

SEQ ID NO: 224477 - DNA, 25 bp, Mus musculus
ggcgatgtacgaataaggtggtttc

SEQ ID NO: 224478 - DNA, 25 bp, Mus musculus
cagctgcccagggtcatggtgccgc

SEQ ID NO: 224479 - DNA, 25 bp, Mus musculus
gaggacatgatctcgcagcagcagc

SEQ ID NO: 224480 - DNA, 25 bp, Mus musculus
cacgtctatgtctgcgtcgggctca

SEQ ID NO: 224481 - DNA, 25 bp, Mus musculus
gtggtttcaccagagggctccgtgt

SEQ ID NO: 224482 - DNA, 25 bp, Mus musculus
agccgtagccgtaagcgccgtaagc

SEQ ID NO: 224483 - DNA, 25 bp, Mus musculus
taagcgccgtaagcggcgaagctcg

SEQ ID NO: 224484 - DNA, 25 bp, Mus musculus
cagaggctgccgcttgaagcgcttg

SEQ ID NO: 224485 - DNA, 25 bp, Mus musculus
gttgtcgaacatgtcggccgactcc

SEQ ID NO: 224486 - DNA, 25 bp, Mus musculus
aacatgtcggccgactccgggtcga

SEQ ID NO: 224487 - DNA, 25 bp, Mus musculus
acgcaacagcagctccgggtgagga

SEQ ID NO: 224488 - DNA, 25 bp, Mus musculus
gggagctctcggaggacatgatctc

SEQ ID NO: 224489 - DNA, 25 bp, Mus musculus
ctgttctgccacttgcgcgggctgt

SEQ ID NO: 224490 - DNA, 25 bp, Mus musculus
ggtaccacggacaagctcgcactgc

SEQ ID NO: 224491 - DNA, 25 bp, Mus musculus
cagcggaaagcgactcacaggtagc

SEQ ID NO: 224492 - DNA, 25 bp, Mus musculus
agcccggctgtctcaggtaggcttc

SEQ ID NO: 224493 - DNA, 25 bp, Mus musculus
ggccgatcccgccaaggccaggaga

SEQ ID NO: 224494 - DNA, 25 bp, Mus musculus
ggctcaggctgcaagcccaacaggc

SEQ ID NO: 224495 - DNA, 25 bp, Mus musculus
cccaacaggctgtccaggcggaaga

SEQ ID NO: 224496 - DNA, 25 bp, Mus musculus
gaagcccgagaaagcgacttgcgca

SEQ ID NO: 224497 - DNA, 25 bp, Mus musculus
ggcggcttcccacgctgtagtggcc

SEQ ID NO: 224498 - DNA, 25 bp, Mus musculus
caggccggggcagaaggctccacca

SEQ ID NO: 224499 - DNA, 25 bp, Mus musculus
ccatggcaatgagcgcgatgtatga

SEQ ID NO: 224500 - DNA, 25 bp, Mus musculus
tagatggctgccagcgttagacggc

SEQ ID NO: 224501 - DNA, 25 bp, Mus musculus
agcgacttgcgcatccatgtgcggg

SEQ ID NO: 224502 - DNA, 25 bp, Mus musculus
gttgtcgaacatgtcagcggccgcg

SEQ ID NO: 224503 - DNA, 25 bp, Mus musculus
gaccaacggcttcatgaggtggaga

SEQ ID NO: 224504 - DNA, 25 bp, Mus musculus
cagccgacgacagctgctcagcata

SEQ ID NO: 224505 - DNA, 25 bp, Mus musculus
aacgaacacgaccaacggcttcatg

SEQ ID NO: 224506 - DNA, 25 bp, Mus musculus
gcctcacctcgacaatgcgcgcgca

SEQ ID NO: 224507 - DNA, 25 bp, Mus musculus
tggccgtcgggactcgtagtccgct

SEQ ID NO: 224508 - DNA, 25 bp, Mus musculus
acaaagcactcgtagactcgacgcc

SEQ ID NO: 224509 - DNA, 25 bp, Mus musculus
gcggaaacaaagcactcgtagactc

SEQ ID NO: 224510 - DNA, 25 bp, Mus musculus
ggcgcgcggaaacaaagcactcgta

SEQ ID NO: 224511 - DNA, 25 bp, Mus musculus
cccggatcccaggagtggaagcaag

SEQ ID NO: 224512 - DNA, 25 bp, Mus musculus
atgtagcgagaagacccggatccca

SEQ ID NO: 224513 - DNA, 25 bp, Mus musculus
cagccagagatgtagcgagaagacc

SEQ ID NO: 224514 - DNA, 25 bp, Mus musculus
gccggttagccggagactgacagcc

SEQ ID NO: 224515 - DNA, 25 bp, Mus musculus
tcctcgaggccggttagccggagac

SEQ ID NO: 224516 - DNA, 25 bp, Mus musculus
cgacagctgctcagcatacaacgcg

SEQ ID NO: 224517 - DNA, 25 bp, Mus musculus
cgatggcgccctcggttctttaaag

SEQ ID NO: 224518 - DNA, 25 bp, Mus musculus
acaagcggcctgtaaggtcggagtt

SEQ ID NO: 224519 - DNA, 25 bp, Mus musculus
gcccgggaagcacggtgagtaacaa

SEQ ID NO: 224520 - DNA, 25 bp, Mus musculus
cggtggatctttgagctcctgattc

SEQ ID NO: 224521 - DNA, 25 bp, Mus musculus
cgtgacaacagcgacggtggatctt

SEQ ID NO: 224522 - DNA, 25 bp, Mus musculus
acaaccaaaccctagcttggcggcg

SEQ ID NO: 224523 - DNA, 25 bp, Mus musculus
ggatcctgactctgcgtgcccaaca

SEQ ID NO: 224524 - DNA, 25 bp, Mus musculus
atctgagacgctacctggatcctga

SEQ ID NO: 224525 - DNA, 25 bp, Mus musculus
gggccgcagtcatctgagacgctac

SEQ ID NO: 224526 - DNA, 25 bp, Mus musculus
ctttggttccctccagcgagcgctt

SEQ ID NO: 224527 - DNA, 25 bp, Mus musculus
ctgcagttgagacgttgcgtgacga

SEQ ID NO: 224528 - DNA, 25 bp, Mus musculus
ttggtcgtcacagcagtctgcagtt

SEQ ID NO: 224529 - DNA, 25 bp, Mus musculus
tagcgcggtggaaccgatgaccaca

SEQ ID NO: 224530 - DNA, 25 bp, Mus musculus
atagggcgagcgctaatcccaggct

SEQ ID NO: 224531 - DNA, 25 bp, Mus musculus
ttctccacaaggtcggtctggtgta

SEQ ID NO: 224532 - DNA, 25 bp, Mus musculus
agacagtcgcctcccgtggaattgc

SEQ ID NO: 224533 - DNA, 25 bp, Mus musculus
agtgtgaaaccctgcgctgtctggg

SEQ ID NO: 224534 - DNA, 25 bp, Mus musculus
cgttgtatgtaaattgccctgtttc

SEQ ID NO: 224535 - DNA, 25 bp, Mus musculus
atcgcagtgtgtggccttggacaaa

SEQ ID NO: 224536 - DNA, 25 bp, Mus musculus
ctcaccctgtgaggttgtgtgtctg

SEQ ID NO: 224537 - DNA, 25 bp, Mus musculus
gacagtatgccggtctgcctacacc

SEQ ID NO: 224538 - DNA, 25 bp, Mus musculus
tgcctacaccggcttgtgggacaga

SEQ ID NO: 224539 - DNA, 25 bp, Mus musculus
agctagctcgtgttcatctgcttcc

SEQ ID NO: 224540 - DNA, 25 bp, Mus musculus
tgtgtggtcctgtccaacaagagtc

SEQ ID NO: 224541 - DNA, 25 bp, Mus musculus
caagagtcctatgcctgtgtgcctg

SEQ ID NO: 224542 - DNA, 25 bp, Mus musculus
tgtcctttagaggtgcgtttgcaaa

SEQ ID NO: 224543 - DNA, 25 bp, Mus musculus
gcggggagtgggatttcacatttta

SEQ ID NO: 224544 - DNA, 25 bp, Mus musculus
gagattccgacctctctgcgtttta

SEQ ID NO: 224545 - DNA, 25 bp, Mus musculus
tgctctatagccttagccagccgct

SEQ ID NO: 224546 - DNA, 25 bp, Mus musculus
ttaaagggccgcgacgcagtagcag

SEQ ID NO: 224547 - DNA, 25 bp, Mus musculus
gcagtgacccgcaactagagggaca

SEQ ID NO: 224548 - DNA, 25 bp, Mus musculus
tagtcctgctcaacggcgtcgccaa

SEQ ID NO: 224549 - DNA, 25 bp, Mus musculus
caacggcgtcgccaaggagacgagc

SEQ ID NO: 224550 - DNA, 25 bp, Mus musculus
tcgccaaggagacgagccgcgcagc

SEQ ID NO: 224551 - DNA, 25 bp, Mus musculus
cccgtcatcgagctaggagcgcgca

SEQ ID NO: 224552 - DNA, 25 bp, Mus musculus
cgacgcagtagcagccgaagctcgc

SEQ ID NO: 224553 - DNA, 25 bp, Mus musculus
agcagccgaagctcgccttcgggtg

SEQ ID NO: 224554 - DNA, 25 bp, Mus musculus
gggtgcccaccaccgagctgtgcag

SEQ ID NO: 224555 - DNA, 25 bp, Mus musculus
ccgagcgctgctctatagccttagc

SEQ ID NO: 224556 - DNA, 25 bp, Mus musculus
agccgctcgcctcactaggcaggtg

SEQ ID NO: 224557 - DNA, 25 bp, Mus musculus
tcactaggcaggtgagcatcccggt

SEQ ID NO: 224558 - DNA, 25 bp, Mus musculus
agctgtgcagacctcccggacccgc

SEQ ID NO: 224559 - DNA, 25 bp, Mus musculus
actgtggctccagacccagcacgag

SEQ ID NO: 224560 - DNA, 25 bp, Mus musculus
ggggcctactaactgtggctccaga

SEQ ID NO: 224561 - DNA, 25 bp, Mus musculus
ctcctgcgtgacgtcaccaaggggc

SEQ ID NO: 224562 - DNA, 25 bp, Mus musculus
ggcgcggcttactggcaagccttgc

SEQ ID NO: 224563 - DNA, 25 bp, Mus musculus
ctgccaaaggggaagtgagctaaga

SEQ ID NO: 224564 - DNA, 25 bp, Mus musculus
tgagctaagactggagctatggccc

SEQ ID NO: 224565 - DNA, 25 bp, Mus musculus
accgccagcacatccagagaagtcg

SEQ ID NO: 224566 - DNA, 25 bp, Mus musculus
cgctggtggcggaacacttcaggct

SEQ ID NO: 224567 - DNA, 25 bp, Mus musculus
tctcgcgcgggtctctacaaactca

SEQ ID NO: 224568 - DNA, 25 bp, Mus musculus
tctacaaactcaggacagaagccac

SEQ ID NO: 224569 - DNA, 25 bp, Mus musculus
agaagccacgggaaggtgatcatcc

SEQ ID NO: 224570 - DNA, 25 bp, Mus musculus
tcatcccgaatcctggtgggcgtcc

SEQ ID NO: 224571 - DNA, 25 bp, Mus musculus
atccagagaagtcgcgaccgaagca

SEQ ID NO: 224572 - DNA, 25 bp, Mus musculus
ctgtaagttgatgcggtcagccgcg

SEQ ID NO: 224573 - DNA, 25 bp, Mus musculus
tgagacttgcagttaatccaccgaa

SEQ ID NO: 224574 - DNA, 25 bp, Mus musculus
cgttgcgggtggaagcctgacccac

SEQ ID NO: 224575 - DNA, 25 bp, Mus musculus
ttaccctctgaggacccggatcgca

SEQ ID NO: 224576 - DNA, 25 bp, Mus musculus
cccagcaaagaacgcacggcccagc

SEQ ID NO: 224577 - DNA, 25 bp, Mus musculus
tcagtccttaatgccagggtccgcc

SEQ ID NO: 224578 - DNA, 25 bp, Mus musculus
accgaatgcctttcgatcggtcgcg

SEQ ID NO: 224579 - DNA, 25 bp, Mus musculus
gttctccgctccctctcaagggaga

SEQ ID NO: 224580 - DNA, 25 bp, Mus musculus
tccctctcaagggagaattttgtcc

SEQ ID NO: 224581 - DNA, 25 bp, Mus musculus
gtttccctaaaccatgagacttgca

SEQ ID NO: 224582 - DNA, 25 bp, Mus musculus
tgcagttaatccaccgaatgccttt

SEQ ID NO: 224583 - DNA, 25 bp, Mus musculus
gacccggccctgttttagctgcctg

SEQ ID NO: 224584 - DNA, 25 bp, Mus musculus
tgtctgcagcaggactcagtcctta

SEQ ID NO: 224585 - DNA, 25 bp, Mus musculus
tcaagggagaattttgtccagaggg

SEQ ID NO: 224586 - DNA, 25 bp, Mus musculus
cccggcccggaagtctcagttcagg

SEQ ID NO: 224587 - DNA, 25 bp, Mus musculus
ggtgaaaggcgaccaccagcaccca

SEQ ID NO: 224588 - DNA, 25 bp, Mus musculus
cggaagtgtgttcctgccggagctc

SEQ ID NO: 224589 - DNA, 25 bp, Mus musculus
ggcttccgtccctgtcacgcccact

SEQ ID NO: 224590 - DNA, 25 bp, Mus musculus
tgttttagctccaaaccctgctcgg

SEQ ID NO: 224591 - DNA, 25 bp, Mus musculus
tcatagcagcggacagcgctgtccc

SEQ ID NO: 224592 - DNA, 25 bp, Mus musculus
cctcctgcgggggaatcatagcagc

SEQ ID NO: 224593 - DNA, 25 bp, Mus musculus
ctgcttcagtttgtcctcgatctcc

SEQ ID NO: 224594 - DNA, 25 bp, Mus musculus
ccagcgtcacctgcttcagtttgtc

SEQ ID NO: 224595 - DNA, 25 bp, Mus musculus
acccagcacccagcaccacggccta

SEQ ID NO: 224596 - DNA, 25 bp, Mus musculus
cacaagccgatggtgaaaggcgacc

SEQ ID NO: 224597 - DNA, 25 bp, Mus musculus
ggaggacatcaccacaagccgatgg

SEQ ID NO: 224598 - DNA, 25 bp, Mus musculus
gggcagagaggaggacatcaccaca

SEQ ID NO: 224599 - DNA, 25 bp, Mus musculus
ggataaacgacagcgtctcctcctc

SEQ ID NO: 224600 - DNA, 25 bp, Mus musculus
ccctgagcgcctttccttcactttc

SEQ ID NO: 224601 - DNA, 25 bp, Mus musculus
taccgaggcctgtgtgcagtgcgca

SEQ ID NO: 224602 - DNA, 25 bp, Mus musculus
agcacccggaaccttgagcgcgcgg

SEQ ID NO: 224603 - DNA, 25 bp, Mus musculus
ccggaaccttgagcgcgcggaacct

SEQ ID NO: 224604 - DNA, 25 bp, Mus musculus
ggtctctaccgaggcctgtgtgcag

SEQ ID NO: 224605 - DNA, 25 bp, Mus musculus
tggggttcgtgtcaccggcacagtt

SEQ ID NO: 224606 - DNA, 25 bp, Mus musculus
acagttgcgcgtgttcccggtgcgc

SEQ ID NO: 224607 - DNA, 25 bp, Mus musculus
tcagcgagctggaagcgaacccctt

SEQ ID NO: 224608 - DNA, 25 bp, Mus musculus
ttctacgaccgctaccgggacaaga

SEQ ID NO: 224609 - DNA, 25 bp, Mus musculus
gctaccgggacaagatccagcagct

SEQ ID NO: 224610 - DNA, 25 bp, Mus musculus
actcacgaccggcgggcagagcttc

SEQ ID NO: 224611 - DNA, 25 bp, Mus musculus
cagagcttccggcatgcactactct

SEQ ID NO: 224612 - DNA, 25 bp, Mus musculus
ttccggcatgcactactctccggga

SEQ ID NO: 224613 - DNA, 25 bp, Mus musculus
agctgccagcccgaagcgtcgttgt

SEQ ID NO: 224614 - DNA, 25 bp, Mus musculus
tcaccggcacagttgcgcgtgttcc

SEQ ID NO: 224615 - DNA, 25 bp, Mus musculus
aggctaaagagaagagtaagtatcc

SEQ ID NO: 224616 - DNA, 25 bp, Mus musculus
gtccgaggctctcagtgtccgaagt

SEQ ID NO: 224617 - DNA, 25 bp, Mus musculus
agtcctcagcccagggtccgaggct

SEQ ID NO: 224618 - DNA, 25 bp, Mus musculus
ccaaaagcaggctggccacagtcct

SEQ ID NO: 224619 - DNA, 25 bp, Mus musculus
gactccggcccaaaagcaggctggc

SEQ ID NO: 224620 - DNA, 25 bp, Mus musculus
ctcgcgtggcaccttctggaagcga

SEQ ID NO: 224621 - DNA, 25 bp, Mus musculus
tagttcttcttggtcctcgcgtggc

SEQ ID NO: 224622 - DNA, 25 bp, Mus musculus
gggcccagtcttgcttccactttta

SEQ ID NO: 224623 - DNA, 25 bp, Mus musculus
acagagacccggagctgtccactca

SEQ ID NO: 224624 - DNA, 25 bp, Mus musculus
cgctgagacccgcacggcgggatca

SEQ ID NO: 224625 - DNA, 25 bp, Mus musculus
cagatcagactggtgggtagacgct

SEQ ID NO: 224626 - DNA, 25 bp, Mus musculus
cggccgcggcccagatcagactggt

SEQ ID NO: 224627 - DNA, 25 bp, Mus musculus
ctctcagtgtccgaagtccggggtg

SEQ ID NO: 224628 - DNA, 25 bp, Mus musculus
cggagctggcgtctcctcgagcact

SEQ ID NO: 224629 - DNA, 25 bp, Mus musculus
gtggtcaactaaggtaaaagtgagc

SEQ ID NO: 224630 - DNA, 25 bp, Mus musculus
agaaacccgcaacaaccagaggacg

SEQ ID NO: 224631 - DNA, 25 bp, Mus musculus
agaggacgctctgatatgccacgcc

SEQ ID NO: 224632 - DNA, 25 bp, Mus musculus
ctctgatatgccacgcctgcgcagt

SEQ ID NO: 224633 - DNA, 25 bp, Mus musculus
gcctgcgcagtgaactggccttgct

SEQ ID NO: 224634 - DNA, 25 bp, Mus musculus
ctggccttgcttctcgccacgtgtg

SEQ ID NO: 224635 - DNA, 25 bp, Mus musculus
ttctcgccacgtgtggccctcgggg

SEQ ID NO: 224636 - DNA, 25 bp, Mus musculus
cgttctcgacggagacctgcaggtg

SEQ ID NO: 224637 - DNA, 25 bp, Mus musculus
taaaagtgagccagcgaggagtccc

SEQ ID NO: 224638 - DNA, 25 bp, Mus musculus
ggcagacagggccttctgagcagct

SEQ ID NO: 224639 - DNA, 25 bp, Mus musculus
tctgagcagctcgaggttaagaccc

SEQ ID NO: 224640 - DNA, 25 bp, Mus musculus
taagacccggttcttctgcggagga

SEQ ID NO: 224641 - DNA, 25 bp, Mus musculus
acccggttcttctgcggaggagcag

SEQ ID NO: 224642 - DNA, 25 bp, Mus musculus
gcctcttccgcgttctcgacggaga

SEQ ID NO: 224643 - DNA, 25 bp, Mus musculus
tagttgctccggtgctcacaaccca

SEQ ID NO: 224644 - DNA, 25 bp, Mus musculus
tgctcacaacccacgaactcaaagg

SEQ ID NO: 224645 - DNA, 25 bp, Mus musculus
cacgaactcaaaggagcgaaggcga

SEQ ID NO: 224646 - DNA, 25 bp, Mus musculus
agcccgacgaggttggcagcccaca

SEQ ID NO: 224647 - DNA, 25 bp, Mus musculus
acgaggttggcagcccacactggga

SEQ ID NO: 224648 - DNA, 25 bp, Mus musculus
cagcgcgaggttgcagtagaccaca

SEQ ID NO: 224649 - DNA, 25 bp, Mus musculus
gatgctgccacggtctccactgaag

SEQ ID NO: 224650 - DNA, 25 bp, Mus musculus
gtctccactgaagccgctgagagtc

SEQ ID NO: 224651 - DNA, 25 bp, Mus musculus
cgctgagagtcgacagagaggaact

SEQ ID NO: 224652 - DNA, 25 bp, Mus musculus
cagagaggaactgaccgctcatctc

SEQ ID NO: 224653 - DNA, 25 bp, Mus musculus
tgatccagctctcccaggcgaggca

SEQ ID NO: 224654 - DNA, 25 bp, Mus musculus
aggcgaggcacggatcccgcgactc

SEQ ID NO: 224655 - DNA, 25 bp, Mus musculus
tgcagtagaccacagccaggctctg

SEQ ID NO: 224656 - DNA, 25 bp, Mus musculus
ggaattagttgctccggtgctcaca

SEQ ID NO: 224657 - DNA, 25 bp, Mus musculus
gcgcaccgaagggacgcagcttaac

SEQ ID NO: 224658 - DNA, 25 bp, Mus musculus
ggacgcagcttaacttccctcggga

SEQ ID NO: 224659 - DNA, 25 bp, Mus musculus
gtgcagctcagtccagcagcttctg

SEQ ID NO: 224660 - DNA, 25 bp, Mus musculus
agcagcgagcgcacggcacaggaca

SEQ ID NO: 224661 - DNA, 25 bp, Mus musculus
tttgctgcctgctgcgtgtgcagcc

SEQ ID NO: 224662 - DNA, 25 bp, Mus musculus
gcgctcggcttctttgctgcctgct

SEQ ID NO: 224663 - DNA, 25 bp, Mus musculus
cgggacacaacgtgcctctggtggt

SEQ ID NO: 224664 - DNA, 25 bp, Mus musculus
cttcttgccgggacacaacgtgcct

SEQ ID NO: 224665 - DNA, 25 bp, Mus musculus
agctttcgccgccttcttgccggga

SEQ ID NO: 224666 - DNA, 25 bp, Mus musculus
tggcaggcctgaacgtgacactggt

SEQ ID NO: 224667 - DNA, 25 bp, Mus musculus
aagccttctgcgtagcctgccgtcg

SEQ ID NO: 224668 - DNA, 25 bp, Mus musculus
gggccgatgccgcaagcaaagaaga

SEQ ID NO: 224669 - DNA, 25 bp, Mus musculus
ggccgttcccgaagccttctgcgta

SEQ ID NO: 224670 - DNA, 25 bp, Mus musculus
gctgcctcctagtgggccacgagga

SEQ ID NO: 224671 - DNA, 25 bp, Mus musculus
agggtctgtggtgctagtacccagc

SEQ ID NO: 224672 - DNA, 25 bp, Mus musculus
tgcggcgcgcttagagccgttaaac

SEQ ID NO: 224673 - DNA, 25 bp, Mus musculus
tccggtgacctaagggcatatggtt

SEQ ID NO: 224674 - DNA, 25 bp, Mus musculus
tgagctccggtgacctaagggcata

SEQ ID NO: 224675 - DNA, 25 bp, Mus musculus
agatcgagtgagctccggtgaccta

SEQ ID NO: 224676 - DNA, 25 bp, Mus musculus
aaaccctgacagctggggcgatggc

SEQ ID NO: 224677 - DNA, 25 bp, Mus musculus
gtcggcagccaaaccctgacagctg

SEQ ID NO: 224678 - DNA, 25 bp, Mus musculus
tggaccagtcggcagccaaaccctg

SEQ ID NO: 224679 - DNA, 25 bp, Mus musculus
attcctgttgggatggaccagtcgg

SEQ ID NO: 224680 - DNA, 25 bp, Mus musculus
cgcagattcctgttgggatggacca

SEQ ID NO: 224681 - DNA, 25 bp, Mus musculus
cactgcacgcagattcctgttggga

SEQ ID NO: 224682 - DNA, 25 bp, Mus musculus
gcgattcccgcactgcacgcagatt

SEQ ID NO: 224683 - DNA, 25 bp, Mus musculus
ttagagccgttaaacagaggcggga

SEQ ID NO: 224684 - DNA, 25 bp, Mus musculus
ggtgctagtacccagcacgcgattc

SEQ ID NO: 224685 - DNA, 25 bp, Mus musculus
taaatcccagtattgcggggtactc

SEQ ID NO: 224686 - DNA, 25 bp, Mus musculus
cccaggagacaaggagccctaggta

SEQ ID NO: 224687 - DNA, 25 bp, Mus musculus
aaaggatttgtctccgcttaatatc

SEQ ID NO: 224688 - DNA, 25 bp, Mus musculus
tttcaggggcgaagtaatatcttcc

SEQ ID NO: 224689 - DNA, 25 bp, Mus musculus
ttccaaatgaggcaaaaccgtgacg

SEQ ID NO: 224690 - DNA, 25 bp, Mus musculus
accgtgacggatccgaagcgttctc

SEQ ID NO: 224691 - DNA, 25 bp, Mus musculus
tcagcgcttttctacccacgacttg

SEQ ID NO: 224692 - DNA, 25 bp, Mus musculus
tagttctttccttctgtcgccctgg

SEQ ID NO: 224693 - DNA, 25 bp, Mus musculus
ccctaaggcttaagtgtctgtcgcc

SEQ ID NO: 224694 - DNA, 25 bp, Mus musculus
gtgtctgtcgccttccaagtctctc

SEQ ID NO: 224695 - DNA, 25 bp, Mus musculus
ccagactacaggaccgcaaacgagg

SEQ ID NO: 224696 - DNA, 25 bp, Mus musculus
ggctggagctggagttttaaaccgc

SEQ ID NO: 224697 - DNA, 25 bp, Mus musculus
cctcctttctgcctcggaatttcta

SEQ ID NO: 224698 - DNA, 25 bp, Mus musculus
ttcgtgtaaagtcgcaatcccagga

SEQ ID NO: 224699 - DNA, 25 bp, Mus musculus
agcctctctgtatctcgggctcgct

SEQ ID NO: 224700 - DNA, 25 bp, Mus musculus
ctcctggacaggttattagcgcggc

SEQ ID NO: 224701 - DNA, 25 bp, Mus musculus
cacgagccatctcctggacaggtta

SEQ ID NO: 224702 - DNA, 25 bp, Mus musculus
aatttgccacgagccatctcctgga

SEQ ID NO: 224703 - DNA, 25 bp, Mus musculus
tgacaagactaacaaagcaatttgc

SEQ ID NO: 224704 - DNA, 25 bp, Mus musculus
ctggccgcgctgacaagactaacaa

SEQ ID NO: 224705 - DNA, 25 bp, Mus musculus
tcatcttgatccatggcgcgcgctg

SEQ ID NO: 224706 - DNA, 25 bp, Mus musculus
gccatccacggcgattcatcatctt

SEQ ID NO: 224707 - DNA, 25 bp, Mus musculus
cggcttagagctaattcgggagtta

SEQ ID NO: 224708 - DNA, 25 bp, Mus musculus
agcgcgagcagcctctctgtatctc

SEQ ID NO: 224709 - DNA, 25 bp, Mus musculus
tggacaggttattagcgcggccgcc

SEQ ID NO: 224710 - DNA, 25 bp, Mus musculus
ggcgattcatcatcttgatccatgg

SEQ ID NO: 224711 - DNA, 25 bp, Mus musculus
agctaattcgggagttaatggcggt

SEQ ID NO: 224712 - DNA, 25 bp, Mus musculus
gccgcccgcatctgcgccatccacg

SEQ ID NO: 224713 - DNA, 25 bp, Mus musculus
ataatcgggttagcggccgcgctcc

SEQ ID NO: 224714 - DNA, 25 bp, Mus musculus
cctgcggatctgcataatcgggtta

SEQ ID NO: 224715 - DNA, 25 bp, Mus musculus
ccgaggttgaggctaagacgctagt

SEQ ID NO: 224716 - DNA, 25 bp, Mus musculus
cgcgcgattctctcgctgtcactta

SEQ ID NO: 224717 - DNA, 25 bp, Mus musculus
tctcgctgtcacttagggaggctca

SEQ ID NO: 224718 - DNA, 25 bp, Mus musculus
gctcagcgcgatttgcggcctaatc

SEQ ID NO: 224719 - DNA, 25 bp, Mus musculus
aggggccgccagattgttcccttca

SEQ ID NO: 224720 - DNA, 25 bp, Mus musculus
tgttcccttcataattgattgactc

SEQ ID NO: 224721 - DNA, 25 bp, Mus musculus
atcctctagccgcttagggcgagcc

SEQ ID NO: 224722 - DNA, 25 bp, Mus musculus
tgattgactctatttgccggattgg

SEQ ID NO: 224723 - DNA, 25 bp, Mus musculus
tgccggattgggacttcaaagcgcc

SEQ ID NO: 224724 - DNA, 25 bp, Mus musculus
attgggacttcaaagcgccggcggc

SEQ ID NO: 224725 - DNA, 25 bp, Mus musculus
cgccagattgttcccttcataattg

SEQ ID NO: 224726 - DNA, 25 bp, Mus musculus
ttttcctaaatcctctagccgctta

SEQ ID NO: 224727 - DNA, 25 bp, Mus musculus
cgctccgtaaataggcggatggccc

SEQ ID NO: 224728 - DNA, 25 bp, Mus musculus
cttgcatatgcgctttaatgcgggc

SEQ ID NO: 224729 - DNA, 25 bp, Mus musculus
attcatggcttgcatatgcgcttta

SEQ ID NO: 224730 - DNA, 25 bp, Mus musculus
cagttgataattcatggcttgcata

SEQ ID NO: 224731 - DNA, 25 bp, Mus musculus
ctcctttcagttgataattcatggc

SEQ ID NO: 224732 - DNA, 25 bp, Mus musculus
gccggtaattgactcctttcagttg

SEQ ID NO: 224733 - DNA, 25 bp, Mus musculus
ttagagccggtaattgactcctttc

SEQ ID NO: 224734 - DNA, 25 bp, Mus musculus
cactcgtttttagagccggtaattg

SEQ ID NO: 224735 - DNA, 25 bp, Mus musculus
ccgggcgcagacactcgtttttaga

SEQ ID NO: 224736 - DNA, 25 bp, Mus musculus
ggaaatcgctccgtaaataggcgga

SEQ ID NO: 224737 - DNA, 25 bp, Mus musculus
cgagctgcagcacggcgggagcgat

SEQ ID NO: 224738 - DNA, 25 bp, Mus musculus
agacgcccgctctgcggtcctgtct

SEQ ID NO: 224739 - DNA, 25 bp, Mus musculus
cagacactcgtttttagagccggta

SEQ ID NO: 224740 - DNA, 25 bp, Mus musculus
tatgcgctttaatgcgggcgcccgg

SEQ ID NO: 224741 - DNA, 25 bp, Mus musculus
gggagcaccacggaactgaacactc

SEQ ID NO: 224742 - DNA, 25 bp, Mus musculus
ccgctggtaacccagactccagtta

SEQ ID NO: 224743 - DNA, 25 bp, Mus musculus
tcacttccattctgcgacccagggg

SEQ ID NO: 224744 - DNA, 25 bp, Mus musculus
gtcgcctcctccgaacacgaatgtg

SEQ ID NO: 224745 - DNA, 25 bp, Mus musculus
gcccttgaagggtttgttggccaca

SEQ ID NO: 224746 - DNA, 25 bp, Mus musculus
cacaggaccgagttatggaggagca

SEQ ID NO: 224747 - DNA, 25 bp, Mus musculus
agcaggaagcgatctcccgaactcc

SEQ ID NO: 224748 - DNA, 25 bp, Mus musculus
actcctcagatttcattttcgtggc

SEQ ID NO: 224749 - DNA, 25 bp, Mus musculus
ccactacttctgtgggcgaccgatg

SEQ ID NO: 224750 - DNA, 25 bp, Mus musculus
ggggaccggcattaagtagacgctc

SEQ ID NO: 224751 - DNA, 25 bp, Mus musculus
ggaaggcttcttctgctgccatggc

SEQ ID NO: 224752 - DNA, 25 bp, Mus musculus
cttccgctgctgtcattggccagta

SEQ ID NO: 224753 - DNA, 25 bp, Mus musculus
ggcggtcaacatccacaggctgagc

SEQ ID NO: 224754 - DNA, 25 bp, Mus musculus
ctggggcaaagtaggtcatctgatc

SEQ ID NO: 224755 - DNA, 25 bp, Mus musculus
tttccgcgctgcactgctgcatctt

SEQ ID NO: 224756 - DNA, 25 bp, Mus musculus
tgcatcttcagcactaggtggcgcc

SEQ ID NO: 224757 - DNA, 25 bp, Mus musculus
agagtcctgggaacgcgcacgtccc

SEQ ID NO: 224758 - DNA, 25 bp, Mus musculus
aaccgggatggcagcccaccgtact

SEQ ID NO: 224759 - DNA, 25 bp, Mus musculus
cagcccaccgtacttcgggcgttgg

SEQ ID NO: 224760 - DNA, 25 bp, Mus musculus
tgcccaggttagaccggctccagct

SEQ ID NO: 224761 - DNA, 25 bp, Mus musculus
gctccagctaggctgcgaaccgagg

SEQ ID NO: 224762 - DNA, 25 bp, Mus musculus
aagaaccacgcggagttgcccaggc

SEQ ID NO: 224763 - DNA, 25 bp, Mus musculus
ccaaggctggggacgcacgcagacc

SEQ ID NO: 224764 - DNA, 25 bp, Mus musculus
gacgcacgcagaccggagcgtagtt

SEQ ID NO: 224765 - DNA, 25 bp, Mus musculus
ccggagcgtagttaggagaaatcac

SEQ ID NO: 224766 - DNA, 25 bp, Mus musculus
agttaggagaaatcacgcgacacca

SEQ ID NO: 224767 - DNA, 25 bp, Mus musculus
agaccggctccagctaggctgcgaa

SEQ ID NO: 224768 - DNA, 25 bp, Mus musculus
ggtccatcacattcctgccaggacg

SEQ ID NO: 224769 - DNA, 25 bp, Mus musculus
agtacggaatgcattagctcgagga

SEQ ID NO: 224770 - DNA, 25 bp, Mus musculus
ccagcgttttaaggcaggcggaaca

SEQ ID NO: 224771 - DNA, 25 bp, Mus musculus
tccaacggtcaaggtcaagcctaga

SEQ ID NO: 224772 - DNA, 25 bp, Mus musculus
aagctagcagctccaacggtcaagg

SEQ ID NO: 224773 - DNA, 25 bp, Mus musculus
cccggcagcgagagccaagctagca

SEQ ID NO: 224774 - DNA, 25 bp, Mus musculus
atcgcccgcgattccgcttgaggga

SEQ ID NO: 224775 - DNA, 25 bp, Mus musculus
agaggactcggcacgcgcacaccaa

SEQ ID NO: 224776 - DNA, 25 bp, Mus musculus
cagcaagctgcaggctaggcaaacc

SEQ ID NO: 224777 - DNA, 25 bp, Mus musculus
tggctcctggtccatcgcaggacca

SEQ ID NO: 224778 - DNA, 25 bp, Mus musculus
tccgggcagttgaagtcgcagcctt

SEQ ID NO: 224779 - DNA, 25 bp, Mus musculus
ctccaaagcaccagggcggccggtt

SEQ ID NO: 224780 - DNA, 25 bp, Mus musculus
ggcgattctgttccggggctcacat

SEQ ID NO: 224781 - DNA, 25 bp, Mus musculus
cttgtccatggtctccaggccggct

SEQ ID NO: 224782 - DNA, 25 bp, Mus musculus
cctggcgcagaaagagtacggaatg

SEQ ID NO: 224783 - DNA, 25 bp, Mus musculus
gaacacatcttaagacgggcgcagc

SEQ ID NO: 224784 - DNA, 25 bp, Mus musculus
agcttcagcagcttccgaacacatc

SEQ ID NO: 224785 - DNA, 25 bp, Mus musculus
accagaatcctcggggcgcacacga

SEQ ID NO: 224786 - DNA, 25 bp, Mus musculus
aagacgggcgcagccatgtcaacta

SEQ ID NO: 224787 - DNA, 25 bp, Mus musculus
ggcgcagccatgtcaactaacaacg

SEQ ID NO: 224788 - DNA, 25 bp, Mus musculus
tgtcaactaacaacgccaataattc

SEQ ID NO: 224789 - DNA, 25 bp, Mus musculus
acgccaataattccgactgaaactg

SEQ ID NO: 224790 - DNA, 25 bp, Mus musculus
ctgaaactgcagctgcgctctcgcg

SEQ ID NO: 224791 - DNA, 25 bp, Mus musculus
agtccacgagcttcagcagcttccg

SEQ ID NO: 224792 - DNA, 25 bp, Mus musculus
tgcagctgcgctctcgcgggttccg

SEQ ID NO: 224793 - DNA, 25 bp, Mus musculus
aggattgagggctgcttagaatatc

SEQ ID NO: 224794 - DNA, 25 bp, Mus musculus
cttagaatatcagcggcagacaggg

SEQ ID NO: 224795 - DNA, 25 bp, Mus musculus
tccgactgaaactgcagctgcgctc

SEQ ID NO: 224796 - DNA, 25 bp, Mus musculus
accggcgtgaagtccacgagcttca

SEQ ID NO: 224797 - DNA, 25 bp, Mus musculus
acagaaattccgtgactgacagggc

SEQ ID NO: 224798 - DNA, 25 bp, Mus musculus
tccgtaagcacggacaggctcggga

SEQ ID NO: 224799 - DNA, 25 bp, Mus musculus
ctccgggagacgctccgtaagcacg

SEQ ID NO: 224800 - DNA, 25 bp, Mus musculus
cgccgtggcctgtttgacggcccga

SEQ ID NO: 224801 - DNA, 25 bp, Mus musculus
tctcggatctcgaaccgacggggca

SEQ ID NO: 224802 - DNA, 25 bp, Mus musculus
acggaggattctcggatctcgaacc

SEQ ID NO: 224803 - DNA, 25 bp, Mus musculus
tggaccggactgaacggaggattct

SEQ ID NO: 224804 - DNA, 25 bp, Mus musculus
tcggaactgacactgggctggaccg

SEQ ID NO: 224805 - DNA, 25 bp, Mus musculus
gcagagctgccagggccctagcgac

SEQ ID NO: 224806 - DNA, 25 bp, Mus musculus
atggtggagtcggaacagaaattcc

SEQ ID NO: 224807 - DNA, 25 bp, Mus musculus
cagggtatcccggactgcggagcta

SEQ ID NO: 224808 - DNA, 25 bp, Mus musculus
tcgctgctaaactgagctgcgggtc

SEQ ID NO: 224809 - DNA, 25 bp, Mus musculus
gagccacaggctcggaactgacact

SEQ ID NO: 224810 - DNA, 25 bp, Mus musculus
tttggcaggcccgacccgaggcaag

SEQ ID NO: 224811 - DNA, 25 bp, Mus musculus
gggagcagcacgtccccagaggttc

SEQ ID NO: 224812 - DNA, 25 bp, Mus musculus
ttcagggatcttcctgcccaccttg

SEQ ID NO: 224813 - DNA, 25 bp, Mus musculus
cacgtctcgcaagtccggcgtctgg

SEQ ID NO: 224814 - DNA, 25 bp, Mus musculus
caagtccggcgtctgggactccgcg

SEQ ID NO: 224815 - DNA, 25 bp, Mus musculus
gtgggcccaagccagaacaggactg

SEQ ID NO: 224816 - DNA, 25 bp, Mus musculus
agccagaacaggactgggcgaccag

SEQ ID NO: 224817 - DNA, 25 bp, Mus musculus
ttcccaagggtcctcccttctctgc

SEQ ID NO: 224818 - DNA, 25 bp, Mus musculus
cttctctgctacgaacgcggagcga

SEQ ID NO: 224819 - DNA, 25 bp, Mus musculus
ctacgaacgcggagcgaaacccgtg

SEQ ID NO: 224820 - DNA, 25 bp, Mus musculus
gaacgcggagcgaaacccgtggatc

SEQ ID NO: 224821 - DNA, 25 bp, Mus musculus
ggagggcgccgtaacgctcagaaaa

SEQ ID NO: 224822 - DNA, 25 bp, Mus musculus
gcgccgtaacgctcagaaaagccgc

SEQ ID NO: 224823 - DNA, 25 bp, Mus musculus
gcggagcagtccttcagggatcttc

SEQ ID NO: 224824 - DNA, 25 bp, Mus musculus
tcgaagcccgcggagcagtccttca

SEQ ID NO: 224825 - DNA, 25 bp, Mus musculus
agcgcccggactgtaccattctgag

SEQ ID NO: 224826 - DNA, 25 bp, Mus musculus
agcctgtcagtaaccgccgtttgcg

SEQ ID NO: 224827 - DNA, 25 bp, Mus musculus
ccgcttagtaactgaggtccgacca

SEQ ID NO: 224828 - DNA, 25 bp, Mus musculus
ggctatctcctgattggctcgcttg

SEQ ID NO: 224829 - DNA, 25 bp, Mus musculus
tctgattaaagtgtcgagtctcgca

SEQ ID NO: 224830 - DNA, 25 bp, Mus musculus
aggacagtcgagctaccggctcttc

SEQ ID NO: 224831 - DNA, 25 bp, Mus musculus
cggcgctgtcgtggttacctttact

SEQ ID NO: 224832 - DNA, 25 bp, Mus musculus
tacctttactactcgggcacagtcg

SEQ ID NO: 224833 - DNA, 25 bp, Mus musculus
agctgactggactctccaaggggtc

SEQ ID NO: 224834 - DNA, 25 bp, Mus musculus
ttcccagcctgacgcgaatagagcc

SEQ ID NO: 224835 - DNA, 25 bp, Mus musculus
atagagcccgagtcccaatcccaga

SEQ ID NO: 224836 - DNA, 25 bp, Mus musculus
aatcgctctccgcagaccagtggga

SEQ ID NO: 224837 - DNA, 25 bp, Mus musculus
ccgcagctagtctccaggcagaaga

SEQ ID NO: 224838 - DNA, 25 bp, Mus musculus
ggtggcagtcttcatttcttaggca

SEQ ID NO: 224839 - DNA, 25 bp, Mus musculus
acggcgcccaccctcgctggcggac

SEQ ID NO: 224840 - DNA, 25 bp, Mus musculus
gcccaccttacctgctccctgctgt

SEQ ID NO: 224841 - DNA, 25 bp, Mus musculus
gctccgctcctccagtagctgcctc

SEQ ID NO: 224842 - DNA, 25 bp, Mus musculus
caaagactgcggctggggcaactcg

SEQ ID NO: 224843 - DNA, 25 bp, Mus musculus
gctccgcttcatctccgcgtctggg

SEQ ID NO: 224844 - DNA, 25 bp, Mus musculus
gttagcaccgcgactgcgccggcct

SEQ ID NO: 224845 - DNA, 25 bp, Mus musculus
tggcccggcgggcacttgaagccac

SEQ ID NO: 224846 - DNA, 25 bp, Mus musculus
tttccccgcgcttcctgtgggctga

SEQ ID NO: 224847 - DNA, 25 bp, Mus musculus
ctgaggcgccgagaccttcccggcg

SEQ ID NO: 224848 - DNA, 25 bp, Mus musculus
cggcgcgcctcacggaggcagcata

SEQ ID NO: 224849 - DNA, 25 bp, Mus musculus
gcgcctcacggaggcagcatagccg

SEQ ID NO: 224850 - DNA, 25 bp, Mus musculus
cgctggcgaacggtcgcgaagaccc

SEQ ID NO: 224851 - DNA, 25 bp, Mus musculus
cgctgccgcggcaaacccggtccgc

SEQ ID NO: 224852 - DNA, 25 bp, Mus musculus
cgcagcccgatcctcccgcgaggac

SEQ ID NO: 224853 - DNA, 25 bp, Mus musculus
ccaggtttacccagcgacgccggtg

SEQ ID NO: 224854 - DNA, 25 bp, Mus musculus
gccggctccagtctgaaattcctta

SEQ ID NO: 224855 - DNA, 25 bp, Mus musculus
tgtgtttttagcgtcccggagcttc

SEQ ID NO: 224856 - DNA, 25 bp, Mus musculus
cgctctgaccgtccgtgtgttttta

SEQ ID NO: 224857 - DNA, 25 bp, Mus musculus
gctttcgtcctgtcgcctccggagg

SEQ ID NO: 224858 - DNA, 25 bp, Mus musculus
attggagctttggaacgcaccgttc

SEQ ID NO: 224859 - DNA, 25 bp, Mus musculus
gggaacttcctcatgtccagctctc

SEQ ID NO: 224860 - DNA, 25 bp, Mus musculus
ctgcgtgcggtctgtgtttctcaca

SEQ ID NO: 224861 - DNA, 25 bp, Mus musculus
atcagcgccgaagctgcgccttcag

SEQ ID NO: 224862 - DNA, 25 bp, Mus musculus
ccagaagcggagcacgcgcagtaga

SEQ ID NO: 224863 - DNA, 25 bp, Mus musculus
accggctccagtctgaaattcctta

SEQ ID NO: 224864 - DNA, 25 bp, Mus musculus
tctccagaccgggaagagcgagtga

SEQ ID NO: 224865 - DNA, 25 bp, Mus musculus
cgcagtagaaggttcccgcatcagc

SEQ ID NO: 224866 - DNA, 25 bp, Mus musculus
ttctcacagggttgggaacttcctc

SEQ ID NO: 224867 - DNA, 25 bp, Mus musculus
tacagggctcggaaaacacactctt

SEQ ID NO: 224868 - DNA, 25 bp, Mus musculus
ggcttgcctaggactgtagtttcca

SEQ ID NO: 224869 - DNA, 25 bp, Mus musculus
acactcttccgctacttgtttgaca

SEQ ID NO: 224870 - DNA, 25 bp, Mus musculus
caattctagtagttggcgaagcatc

SEQ ID NO: 224871 - DNA, 25 bp, Mus musculus
ggcgaagcatctggttcacaatcga

SEQ ID NO: 224872 - DNA, 25 bp, Mus musculus
catattcacgtgctcccaggccgga

SEQ ID NO: 224873 - DNA, 25 bp, Mus musculus
gcaggagcagcccaacgtttccaga

SEQ ID NO: 224874 - DNA, 25 bp, Mus musculus
agccattttgggaagagctttgtta

SEQ ID NO: 224875 - DNA, 25 bp, Mus musculus
ctttgttatggttgtgggctagtca

SEQ ID NO: 224876 - DNA, 25 bp, Mus musculus
agtcacctctgctggtcggagaagc

SEQ ID NO: 224877 - DNA, 25 bp, Mus musculus
cggcacctaactggccgtctaggaa

SEQ ID NO: 224878 - DNA, 25 bp, Mus musculus
ccaacgggaggagtcttgcacacta

SEQ ID NO: 224879 - DNA, 25 bp, Mus musculus
cggggtcacgaaagctggagctcac

SEQ ID NO: 224880 - DNA, 25 bp, Mus musculus
tatgtgtgtgtctatggcttgccta

SEQ ID NO: 224881 - DNA, 25 bp, Mus musculus
ggtgcgcatttccaggcgctccagc

SEQ ID NO: 224882 - DNA, 25 bp, Mus musculus
catggcagaaacagaagcacagagc

SEQ ID NO: 224883 - DNA, 25 bp, Mus musculus
tgagaggtaaggactcggccctgtc

SEQ ID NO: 224884 - DNA, 25 bp, Mus musculus
ggccctgtcgctgtgctcggactca

SEQ ID NO: 224885 - DNA, 25 bp, Mus musculus
gcccatttgtccctcagaattaaaa

SEQ ID NO: 224886 - DNA, 25 bp, Mus musculus
ttgccggcccagctttggtaggagt

SEQ ID NO: 224887 - DNA, 25 bp, Mus musculus
cccattcgacttggagcgcgagctc

SEQ ID NO: 224888 - DNA, 25 bp, Mus musculus
gcgcgagctcagagaactcaaggaa

SEQ ID NO: 224889 - DNA, 25 bp, Mus musculus
gcactgcaaacgctaggtgcgcatt

SEQ ID NO: 224890 - DNA, 25 bp, Mus musculus
tccagcttcagcctcggtgagttgc

SEQ ID NO: 224891 - DNA, 25 bp, Mus musculus
gcgccagacgcatggcagaaacaga

SEQ ID NO: 224892 - DNA, 25 bp, Mus musculus
tgtgctcggactcaccctgactctg

SEQ ID NO: 224893 - DNA, 25 bp, Mus musculus
gaactcaaggaagaggccaaccgga

SEQ ID NO: 224894 - DNA, 25 bp, Mus musculus
tcagaattaaaacggcgcctccaca

SEQ ID NO: 224895 - DNA, 25 bp, Mus musculus
agcccggggacaacacctggcacag

SEQ ID NO: 224896 - DNA, 25 bp, Mus musculus
tggaagaagcatggtccccgccgca

SEQ ID NO: 224897 - DNA, 25 bp, Mus musculus
agccaataggaaacgagctgcggtg

SEQ ID NO: 224898 - DNA, 25 bp, Mus musculus
accgcggcggcctcagccaatggga

SEQ ID NO: 224899 - DNA, 25 bp, Mus musculus
cctcagaccgcgtgatgtcagcggc

SEQ ID NO: 224900 - DNA, 25 bp, Mus musculus
ttggacgggatgtccacctcctcca

SEQ ID NO: 224901 - DNA, 25 bp, Mus musculus
gtacacggaattggacgggatgtcc

SEQ ID NO: 224902 - DNA, 25 bp, Mus musculus
gtgacctcggtgaccctgcaggcac

SEQ ID NO: 224903 - DNA, 25 bp, Mus musculus
cagattaccacggaggacgcgagcg

SEQ ID NO: 224904 - DNA, 25 bp, Mus musculus
tcgcagagcagattaccacggagga

SEQ ID NO: 224905 - DNA, 25 bp, Mus musculus
gcgtccctgtcgcagagcagattac

SEQ ID NO: 224906 - DNA, 25 bp, Mus musculus
gtgcctgtcagggatgcctctccaa

SEQ ID NO: 224907 - DNA, 25 bp, Mus musculus
tgggattattgctccgggtgcgcct

SEQ ID NO: 224908 - DNA, 25 bp, Mus musculus
caacacctggcacaggtgcctgtca

SEQ ID NO: 224909 - DNA, 25 bp, Mus musculus
gtagggcttctccacagagcaaccc

SEQ ID NO: 224910 - DNA, 25 bp, Mus musculus
atcaggaggggctcaaggaccgact

SEQ ID NO: 224911 - DNA, 25 bp, Mus musculus
cggaaaccagctccgcggcgatggc

SEQ ID NO: 224912 - DNA, 25 bp, Mus musculus
cccgcttacttgtcagcggaaacca

SEQ ID NO: 224913 - DNA, 25 bp, Mus musculus
ggactggcctcaagctcgccacagt

SEQ ID NO: 224914 - DNA, 25 bp, Mus musculus
ggactctccctgaggactggcctca

SEQ ID NO: 224915 - DNA, 25 bp, Mus musculus
ttccggggaaggcagctgtcccacc

SEQ ID NO: 224916 - DNA, 25 bp, Mus musculus
gctcttcgcaagtagggcttctcca

SEQ ID NO: 224917 - DNA, 25 bp, Mus musculus
gcaccctaggagtgcgcgatcagga

SEQ ID NO: 224918 - DNA, 25 bp, Mus musculus
ggtacgtctacagactctctacaga

SEQ ID NO: 224919 - DNA, 25 bp, Mus musculus
tggccaatttctcggtacgtctaca

SEQ ID NO: 224920 - DNA, 25 bp, Mus musculus
ggcgccaaatctgttggccaatttc

SEQ ID NO: 224921 - DNA, 25 bp, Mus musculus
agcctccatcctcgtgtgggttttt

SEQ ID NO: 224922 - DNA, 25 bp, Mus musculus
ctggcgcgccagctcttcgcaagta

SEQ ID NO: 224923 - DNA, 25 bp, Mus musculus
tccgggtcctcacgaggcctaggct

SEQ ID NO: 224924 - DNA, 25 bp, Mus musculus
caaagactcccacaaaccttaggtg

SEQ ID NO: 224925 - DNA, 25 bp, Mus musculus
cctcgcactgtctcgggtgcatctg

SEQ ID NO: 224926 - DNA, 25 bp, Mus musculus
ggccgcgagaacctacctgagctca

SEQ ID NO: 224927 - DNA, 25 bp, Mus musculus
tctcagggaagtccggccgcgagaa

SEQ ID NO: 224928 - DNA, 25 bp, Mus musculus
gcttctacctcaggcctgcgggtct

SEQ ID NO: 224929 - DNA, 25 bp, Mus musculus
cagaagaggggaggcttctacctca

SEQ ID NO: 224930 - DNA, 25 bp, Mus musculus
acaaaccttaggtgctccggccgct

SEQ ID NO: 224931 - DNA, 25 bp, Mus musculus
gtgcgttctcggtgcccgctcttgg

SEQ ID NO: 224932 - DNA, 25 bp, Mus musculus
accacacaggcatggagagcggctg

SEQ ID NO: 224933 - DNA, 25 bp, Mus musculus
aagtcacctgaaatgaccggccagg

SEQ ID NO: 224934 - DNA, 25 bp, Mus musculus
gccgaggagcacacgctgcagagcc

SEQ ID NO: 224935 - DNA, 25 bp, Mus musculus
cccgcgcggtccaggaacaagaaga

SEQ ID NO: 224936 - DNA, 25 bp, Mus musculus
ccgctcttgggattgcggagcagaa

SEQ ID NO: 224937 - DNA, 25 bp, Mus musculus
ggctcccagaactacgcgcaggacg

SEQ ID NO: 224938 - DNA, 25 bp, Mus musculus
tcttgggtggctggccgcgcccaca

SEQ ID NO: 224939 - DNA, 25 bp, Mus musculus
caagctacgtggacagtcttgggtg

SEQ ID NO: 224940 - DNA, 25 bp, Mus musculus
gcgcacaagctacgtggacagtctt

SEQ ID NO: 224941 - DNA, 25 bp, Mus musculus
tgtgcatgcgcacaagctacgtgga

SEQ ID NO: 224942 - DNA, 25 bp, Mus musculus
cgaaactgtgcatgcgcacaagcta

SEQ ID NO: 224943 - DNA, 25 bp, Mus musculus
aactacgcgcaggacggaggagacc

SEQ ID NO: 224944 - DNA, 25 bp, Mus musculus
gggtcccgaaactgtgcatgcgcac

SEQ ID NO: 224945 - DNA, 25 bp, Mus musculus
agctgggactttgcacattcctccc

SEQ ID NO: 224946 - DNA, 25 bp, Mus musculus
gccaaagctgggactttgcacattc

SEQ ID NO: 224947 - DNA, 25 bp, Mus musculus
ggagtagaagccaaagctgggactt

SEQ ID NO: 224948 - DNA, 25 bp, Mus musculus
ccactgtcctgcgaagtagaagagg

SEQ ID NO: 224949 - DNA, 25 bp, Mus musculus
gccgcgcccacaaccggcccacagt

SEQ ID NO: 224950 - DNA, 25 bp, Mus musculus
tagaagagggagtagaagccaaagc

SEQ ID NO: 224951 - DNA, 25 bp, Mus musculus
tgagaaacgcggctcgcgcccatca

SEQ ID NO: 224952 - DNA, 25 bp, Mus musculus
tcagcggccggaagtcgcttttccg

SEQ ID NO: 224953 - DNA, 25 bp, Mus musculus
ccgattcctacggagacttctcagc

SEQ ID NO: 224954 - DNA, 25 bp, Mus musculus
ctccggcgttctagtccgattccta

SEQ ID NO: 224955 - DNA, 25 bp, Mus musculus
aggaacgtaacctccagcgagcttg

SEQ ID NO: 224956 - DNA, 25 bp, Mus musculus
tttgtgctggaacttaccgcgcgca

SEQ ID NO: 224957 - DNA, 25 bp, Mus musculus
ggctaacgttcagtttcctcctctc

SEQ ID NO: 224958 - DNA, 25 bp, Mus musculus
cggacctgttggaaccctgaggcta

SEQ ID NO: 224959 - DNA, 25 bp, Mus musculus
gctggagctctactcgcattcttca

SEQ ID NO: 224960 - DNA, 25 bp, Mus musculus
tttctgtttgtgagacctgtggctc

SEQ ID NO: 224961 - DNA, 25 bp, Mus musculus
gcgttctcacggctctttctgtttg

SEQ ID NO: 224962 - DNA, 25 bp, Mus musculus
ccggcccgtgagaatctcgcgagaa

SEQ ID NO: 224963 - DNA, 25 bp, Mus musculus
ctcgcgagaactttgtaggctataa

SEQ ID NO: 224964 - DNA, 25 bp, Mus musculus
gcattcttcacgtggcgcttagttc

SEQ ID NO: 224965 - DNA, 25 bp, Mus musculus
gggcaactctattagctcgtttgtc

SEQ ID NO: 224966 - DNA, 25 bp, Mus musculus
ggggaccaaggctcggcatccctgc

SEQ ID NO: 224967 - DNA, 25 bp, Mus musculus
ctcaggtaacgtcgggagagtgcct

SEQ ID NO: 224968 - DNA, 25 bp, Mus musculus
cgcggctcagttgtgcctcaggtaa

SEQ ID NO: 224969 - DNA, 25 bp, Mus musculus
agcaatctccggcttctgcccaagg

SEQ ID NO: 224970 - DNA, 25 bp, Mus musculus
aggccatggcagtagcctccagctc

SEQ ID NO: 224971 - DNA, 25 bp, Mus musculus
aagcagctcagaccgcaaggccatg

SEQ ID NO: 224972 - DNA, 25 bp, Mus musculus
gctgccttctcagtcccagcggtga

SEQ ID NO: 224973 - DNA, 25 bp, Mus musculus
agccgagagtttccagctgccttct

SEQ ID NO: 224974 - DNA, 25 bp, Mus musculus
aaggttgacgattgattggctgctc

SEQ ID NO: 224975 - DNA, 25 bp, Mus musculus
tcctaacgttaattgggcaactcta

SEQ ID NO: 224976 - DNA, 25 bp, Mus musculus
ctcgtaccacgtggcattcctaacg

SEQ ID NO: 224977 - DNA, 25 bp, Mus musculus
caggcgtttcagacactcaccggcg

SEQ ID NO: 224978 - DNA, 25 bp, Mus musculus
tggcttttctgtacgcccattgtgc

SEQ ID NO: 224979 - DNA, 25 bp, Mus musculus
gacggtcctactgaccgaagccacg

SEQ ID NO: 224980 - DNA, 25 bp, Mus musculus
ctttcatttgtggtggcgggaacgt

SEQ ID NO: 224981 - DNA, 25 bp, Mus musculus
tcttaaaattacagccgatcgtttc

SEQ ID NO: 224982 - DNA, 25 bp, Mus musculus
tcgtttcacttacacaaactcaggg

SEQ ID NO: 224983 - DNA, 25 bp, Mus musculus
cacaaactcagggttggcatgggca

SEQ ID NO: 224984 - DNA, 25 bp, Mus musculus
tcggagactgcgcaggaggtaatct

SEQ ID NO: 224985 - DNA, 25 bp, Mus musculus
tgagtgtctattggctggacggtcc

SEQ ID NO: 224986 - DNA, 25 bp, Mus musculus
gccttgcgcgcgctgagtgtctatt

SEQ ID NO: 224987 - DNA, 25 bp, Mus musculus
ttcgtctccagaagcgacacggatc

SEQ ID NO: 224988 - DNA, 25 bp, Mus musculus
ggtacgcagagacttccgcttcgtc

SEQ ID NO: 224989 - DNA, 25 bp, Mus musculus
cgccagccttctggaggtacgcaga

SEQ ID NO: 224990 - DNA, 25 bp, Mus musculus
tcatcgtcactgtccgcggccatga

SEQ ID NO: 224991 - DNA, 25 bp, Mus musculus
ggaactggaggcacatcatcgtcac

SEQ ID NO: 224992 - DNA, 25 bp, Mus musculus
aggaggtaatctgtgctttcatttg

SEQ ID NO: 224993 - DNA, 25 bp, Mus musculus
cactgggcaccgaatgatgcgggtc

SEQ ID NO: 224994 - DNA, 25 bp, Mus musculus
aagcacaggttcgtggcactgggca

SEQ ID NO: 224995 - DNA, 25 bp, Mus musculus
tggggcccggtaccctcattcacta

SEQ ID NO: 224996 - DNA, 25 bp, Mus musculus
tcattcactagaaagacagcgtccc

SEQ ID NO: 224997 - DNA, 25 bp, Mus musculus
gccgaagacacgatgtaggtccctc

SEQ ID NO: 224998 - DNA, 25 bp, Mus musculus
cccagctggtacatggaaagcgatg

SEQ ID NO: 224999 - DNA, 25 bp, Mus musculus
cgcagtcatggcgagcccaattgcc

SEQ ID NO: 225000 - DNA, 25 bp, Mus musculus
aattgccggccacccggatctgttc

SEQ ID NO: 225001 - DNA, 25 bp, Mus musculus
ggatctgttcttctgggaccgctca

SEQ ID NO: 225002 - DNA, 25 bp, Mus musculus
gggaccgctcacttgtttagaactc

SEQ ID NO: 225003 - DNA, 25 bp, Mus musculus
ctggtgtatccgaagatcgtgtttc

SEQ ID NO: 225004 - DNA, 25 bp, Mus musculus
ggcagaggtcgcgaagtcaaacttt

SEQ ID NO: 225005 - DNA, 25 bp, Mus musculus
cacaggctctgcagggtaaattgta

SEQ ID NO: 225006 - DNA, 25 bp, Mus musculus
ttgtatgagaaccacgcggacgctg

SEQ ID NO: 225007 - DNA, 25 bp, Mus musculus
gatacggcagttttggatccgcctc

SEQ ID NO: 225008 - DNA, 25 bp, Mus musculus
aggctgcaggtctcgacgctaaacc

SEQ ID NO: 225009 - DNA, 25 bp, Mus musculus
aggtctcgacgctaaacctagcgga

SEQ ID NO: 225010 - DNA, 25 bp, Mus musculus
acctagcggactgcagtagctcgcc

SEQ ID NO: 225011 - DNA, 25 bp, Mus musculus
gctcgccggcttgctagttcttccg

SEQ ID NO: 225012 - DNA, 25 bp, Mus musculus
cttgctagttcttccgggctctagc

SEQ ID NO: 225013 - DNA, 25 bp, Mus musculus
cagcagcccgctcctttaaggatca

SEQ ID NO: 225014 - DNA, 25 bp, Mus musculus
ctcctttaaggatcagccactctga

SEQ ID NO: 225015 - DNA, 25 bp, Mus musculus
taaggatcagccactctgaagccct

SEQ ID NO: 225016 - DNA, 25 bp, Mus musculus
gtgctcttttacctttctcttccgc

SEQ ID NO: 225017 - DNA, 25 bp, Mus musculus
cgccggaagcggctccggaagatac

SEQ ID NO: 225018 - DNA, 25 bp, Mus musculus
cggctccggaagatacggcagtttt

SEQ ID NO: 225019 - DNA, 25 bp, Mus musculus
tagaacaacgccgaggctgcaggtc

SEQ ID NO: 225020 - DNA, 25 bp, Mus musculus
tttggatccgcctccattctcttcg

SEQ ID NO: 225021 - DNA, 25 bp, Mus musculus
tgctgctctctgatgactcgatgac

SEQ ID NO: 225022 - DNA, 25 bp, Mus musculus
tagcgcagggccatgtctgcgggca

SEQ ID NO: 225023 - DNA, 25 bp, Mus musculus
cgagagaagacagtggctgagactc

SEQ ID NO: 225024 - DNA, 25 bp, Mus musculus
gaagacagtggctgagactcggtac

SEQ ID NO: 225025 - DNA, 25 bp, Mus musculus
gcctgcctgtctgcacgccgggatg

SEQ ID NO: 225026 - DNA, 25 bp, Mus musculus
gacccacttacctgctgctctctga

SEQ ID NO: 225027 - DNA, 25 bp, Mus musculus
ttggccgccttcctcatgactgcca

SEQ ID NO: 225028 - DNA, 25 bp, Mus musculus
gctctctgatgactcgatgactgca

SEQ ID NO: 225029 - DNA, 25 bp, Mus musculus
tgactcgatgactgcagggacagca

SEQ ID NO: 225030 - DNA, 25 bp, Mus musculus
ttttgaggaaggctaaggaacagaa

SEQ ID NO: 225031 - DNA, 25 bp, Mus musculus
ctaaggaacagaaagagtctagtga

SEQ ID NO: 225032 - DNA, 25 bp, Mus musculus
aacagaaagagtctagtgaggctgg

SEQ ID NO: 225033 - DNA, 25 bp, Mus musculus
tgaagaaagcaaacgggcgtctgta

SEQ ID NO: 225034 - DNA, 25 bp, Mus musculus
cctgatggcgccagaggagccccga

SEQ ID NO: 225035 - DNA, 25 bp, Mus musculus
cgtctactggtccttcccgcggaat

SEQ ID NO: 225036 - DNA, 25 bp, Mus musculus
ccgcacgagcgctcggattgtgttc

SEQ ID NO: 225037 - DNA, 25 bp, Mus musculus
ctcgcgctggtcctcaggccaacca

SEQ ID NO: 225038 - DNA, 25 bp, Mus musculus
tccgcctcaatcagtcagtcagtca

SEQ ID NO: 225039 - DNA, 25 bp, Mus musculus
atctctccggccaagaggctgtgct

SEQ ID NO: 225040 - DNA, 25 bp, Mus musculus
ggctgtgctcttggcccagcccgca

SEQ ID NO: 225041 - DNA, 25 bp, Mus musculus
acctgcagccggagtccttgctgga

SEQ ID NO: 225042 - DNA, 25 bp, Mus musculus
gtgcagcgccgcatcgtctactggt

SEQ ID NO: 225043 - DNA, 25 bp, Mus musculus
cttcccgcggaatgagcgggagatc

SEQ ID NO: 225044 - DNA, 25 bp, Mus musculus
atgagcgggagatctgcatgtactc

SEQ ID NO: 225045 - DNA, 25 bp, Mus musculus
gatctgcatgtactccagcttccag

SEQ ID NO: 225046 - DNA, 25 bp, Mus musculus
gttccgccggggcatccgtctgctg

SEQ ID NO: 225047 - DNA, 25 bp, Mus musculus
atccgtctgctggacagcggctccg

SEQ ID NO: 225048 - DNA, 25 bp, Mus musculus
agtccttgctggactgcgccgccaa

SEQ ID NO: 225049 - DNA, 25 bp, Mus musculus
gttgagttcaaacaggcctacggta

SEQ ID NO: 225050 - DNA, 25 bp, Mus musculus
ggcgcgccgcgaatgtaaacaaaga

SEQ ID NO: 225051 - DNA, 25 bp, Mus musculus
ccacccgcagatggtaagtgttccc

SEQ ID NO: 225052 - DNA, 25 bp, Mus musculus
ccgccctaagcacgttctttcaaga

SEQ ID NO: 225053 - DNA, 25 bp, Mus musculus
gtattttgtccgcagaccgccctaa

SEQ ID NO: 225054 - DNA, 25 bp, Mus musculus
ggtcagggttttcgagttgagttca

SEQ ID NO: 225055 - DNA, 25 bp, Mus musculus
acgagctgcggcaccaggtcatgat

SEQ ID NO: 225056 - DNA, 25 bp, Mus musculus
cgaatcgaacgtccgtgtgggagcc

SEQ ID NO: 225057 - DNA, 25 bp, Mus musculus
gcccgccgcaggattcgaatcgaac

SEQ ID NO: 225058 - DNA, 25 bp, Mus musculus
cctacggtaggccaatcagcgcatc

SEQ ID NO: 225059 - DNA, 25 bp, Mus musculus
tgtcttccaggaaagagcgctccca

SEQ ID NO: 225060 - DNA, 25 bp, Mus musculus
tcacgccgctgcgtcccgtattttg

SEQ ID NO: 225061 - DNA, 25 bp, Mus musculus
ccaaaacacggaggctggccaatgc

SEQ ID NO: 225062 - DNA, 25 bp, Mus musculus
ccagcgccatgtcggtgaacacgga

SEQ ID NO: 225063 - DNA, 25 bp, Mus musculus
ctgcctgcggcgctagctttcgtgc

SEQ ID NO: 225064 - DNA, 25 bp, Mus musculus
cctggacgagtctcacttcagcggc

SEQ ID NO: 225065 - DNA, 25 bp, Mus musculus
gagtctcacttcagcggcttcgcta

SEQ ID NO: 225066 - DNA, 25 bp, Mus musculus
gcagctcctgggtcgcgtgcgcttc

SEQ ID NO: 225067 - DNA, 25 bp, Mus musculus
cgctagctttcgtgccgcgggaagt

SEQ ID NO: 225068 - DNA, 25 bp, Mus musculus
cgcgggaagtgctctacaagctgta

SEQ ID NO: 225069 - DNA, 25 bp, Mus musculus
agctgtgcaacggccacgggctctg

SEQ ID NO: 225070 - DNA, 25 bp, Mus musculus
acttcagcggcttcgctatggccgg

SEQ ID NO: 225071 - DNA, 25 bp, Mus musculus
ctctgggtgaagttgaccaaggtgc

SEQ ID NO: 225072 - DNA, 25 bp, Mus musculus
tacaagctgtacaaggacccggcgg

SEQ ID NO: 225073 - DNA, 25 bp, Mus musculus
gcaccactggcgaggagctgtgcaa

SEQ ID NO: 225074 - DNA, 25 bp, Mus musculus
cgcctgtgtgcgcaccactggcgag

SEQ ID NO: 225075 - DNA, 25 bp, Mus musculus
ccgtgacagtatcgagctccggcgc

SEQ ID NO: 225076 - DNA, 25 bp, Mus musculus
gcgccgcccgtgacagtatcgagct

SEQ ID NO: 225077 - DNA, 25 bp, Mus musculus
ctgcgctcttggcttgtcagccaga

SEQ ID NO: 225078 - DNA, 25 bp, Mus musculus
tattactcggcactcgttcctcctt

SEQ ID NO: 225079 - DNA, 25 bp, Mus musculus
aaatcgccgggcgagacactgccgg

SEQ ID NO: 225080 - DNA, 25 bp, Mus musculus
gcgctcccgaaatcgccgggcgaga

SEQ ID NO: 225081 - DNA, 25 bp, Mus musculus
gcagacagggactgcgctcccgaaa

SEQ ID NO: 225082 - DNA, 25 bp, Mus musculus
ccagctagccgagcaggacccgagt

SEQ ID NO: 225083 - DNA, 25 bp, Mus musculus
ttcctgtgagggaggccagctagcc

SEQ ID NO: 225084 - DNA, 25 bp, Mus musculus
cggccctggccgtagagccatgcgt

SEQ ID NO: 225085 - DNA, 25 bp, Mus musculus
gttcctccttcctgagtcggcgcgt

SEQ ID NO: 225086 - DNA, 25 bp, Mus musculus
ttgccttctgccatctattactcgg

SEQ ID NO: 225087 - DNA, 25 bp, Mus musculus
gagcatccttgccttctgccatcta

SEQ ID NO: 225088 - DNA, 25 bp, Mus musculus
ggcacgctccgcaagagcatccttg

SEQ ID NO: 225089 - DNA, 25 bp, Mus musculus
tcgtcggtcgcttggtctccggcac

SEQ ID NO: 225090 - DNA, 25 bp, Mus musculus
agtcggcgcgtcgtatcgaaccgct

SEQ ID NO: 225091 - DNA, 25 bp, Mus musculus
tttctcatatttcgggctggacgcg

SEQ ID NO: 225092 - DNA, 25 bp, Mus musculus
cccatcaggccgaagtggtaagagc

SEQ ID NO: 225093 - DNA, 25 bp, Mus musculus
atgagctcattggttgacgtggctg

SEQ ID NO: 225094 - DNA, 25 bp, Mus musculus
agccattgtagtgtatgcgctgccc

SEQ ID NO: 225095 - DNA, 25 bp, Mus musculus
attgtttccttacgcctctttccag

SEQ ID NO: 225096 - DNA, 25 bp, Mus musculus
caccgcccgcggaatttctaataat

SEQ ID NO: 225097 - DNA, 25 bp, Mus musculus
ccggagaactcaccgcggagcttta

SEQ ID NO: 225098 - DNA, 25 bp, Mus musculus
taaccctgatattcctcccgctaaa

SEQ ID NO: 225099 - DNA, 25 bp, Mus musculus
ctcggctagtcccataatttaaata

SEQ ID NO: 225100 - DNA, 25 bp, Mus musculus
gggctgggagtagcacaaacttttc

SEQ ID NO: 225101 - DNA, 25 bp, Mus musculus
gttccgcgcgcctgtcaatctggca

SEQ ID NO: 225102 - DNA, 25 bp, Mus musculus
tgcgcgctacttaaggtcctgctgc

SEQ ID NO: 225103 - DNA, 25 bp, Mus musculus
cagcgacctcgggagtccttgcagc

SEQ ID NO: 225104 - DNA, 25 bp, Mus musculus
gcctctttccagcagccattgtagt

SEQ ID NO: 225105 - DNA, 25 bp, Mus musculus
ccggcgcatcgccatagtgcggccg

SEQ ID NO: 225106 - DNA, 25 bp, Mus musculus
agttccggcccggtcagctgtgcca

SEQ ID NO: 225107 - DNA, 25 bp, Mus musculus
atggcgtccccgttcatggctccgg

SEQ ID NO: 225108 - DNA, 25 bp, Mus musculus
gtagcgcgctgcagatggcgtcccc

SEQ ID NO: 225109 - DNA, 25 bp, Mus musculus
tcgtgccgacgagaccgtgccagag

SEQ ID NO: 225110 - DNA, 25 bp, Mus musculus
agtctgcgtgtcgtgccgacgagac

SEQ ID NO: 225111 - DNA, 25 bp, Mus musculus
cgcacgcgccagtctgcgtgtcgtg

SEQ ID NO: 225112 - DNA, 25 bp, Mus musculus
atgtgtaggtgcttcactgccaccc

SEQ ID NO: 225113 - DNA, 25 bp, Mus musculus
cgtgtggatgtgtaggtgcttcact

SEQ ID NO: 225114 - DNA, 25 bp, Mus musculus
ccggcgccctacctgtcgagcagcg

SEQ ID NO: 225115 - DNA, 25 bp, Mus musculus
cccagcccgcgtctgtgtggggccc

SEQ ID NO: 225116 - DNA, 25 bp, Mus musculus
atagtgcggccggtctgtggaccac

SEQ ID NO: 225117 - DNA, 25 bp, Mus musculus
tccctcctcctggactcggcgggct

SEQ ID NO: 225118 - DNA, 25 bp, Mus musculus
tgcggccggtctgtggaccacccag

SEQ ID NO: 225119 - DNA, 25 bp, Mus musculus
ccggctgcaaggcagcgggtaattt

SEQ ID NO: 225120 - DNA, 25 bp, Mus musculus
cgttcacggcagctaggaatcctca

SEQ ID NO: 225121 - DNA, 25 bp, Mus musculus
cgggctgctcctgtgcatctttacg

SEQ ID NO: 225122 - DNA, 25 bp, Mus musculus
agcccacagatccagcggggcttgg

SEQ ID NO: 225123 - DNA, 25 bp, Mus musculus
acgcggagccctctttggaccacag

SEQ ID NO: 225124 - DNA, 25 bp, Mus musculus
gtgcttcgcagccagtcgggtccac

SEQ ID NO: 225125 - DNA, 25 bp, Mus musculus
acctttagctgtgaggtgcttcgca

SEQ ID NO: 225126 - DNA, 25 bp, Mus musculus
gagatccacagtcgccacctttagc

SEQ ID NO: 225127 - DNA, 25 bp, Mus musculus
tttttctgagcctcctggtgcttcc

SEQ ID NO: 225128 - DNA, 25 bp, Mus musculus
cggcgccgttacctagcaacggatc

SEQ ID NO: 225129 - DNA, 25 bp, Mus musculus
ctagcctatggcagcgctcagataa

SEQ ID NO: 225130 - DNA, 25 bp, Mus musculus
gcacaaggcgccaagctagcctatg

SEQ ID NO: 225131 - DNA, 25 bp, Mus musculus
tggtgcttcccgagatccacagtcg

SEQ ID NO: 225132 - DNA, 25 bp, Mus musculus
acccaggaccgtatggccgttcacg

SEQ ID NO: 225133 - DNA, 25 bp, Mus musculus
agcaggcttcatccggcctcctccg

SEQ ID NO: 225134 - DNA, 25 bp, Mus musculus
cggcgccaccgccaacgcctggacg

SEQ ID NO: 225135 - DNA, 25 bp, Mus musculus
cagcctcgacctgcgccggcgccac

SEQ ID NO: 225136 - DNA, 25 bp, Mus musculus
ctgccatcctcagcctcgacctgcg

SEQ ID NO: 225137 - DNA, 25 bp, Mus musculus
agcggtaatgctcgtcttccctgcc

SEQ ID NO: 225138 - DNA, 25 bp, Mus musculus
ttgcagcggtaatgctcgtcttccc

SEQ ID NO: 225139 - DNA, 25 bp, Mus musculus
ctttgcagcggtaatgctcgtcttc

SEQ ID NO: 225140 - DNA, 25 bp, Mus musculus
tgcaactttgcagcggtaatgctcg

SEQ ID NO: 225141 - DNA, 25 bp, Mus musculus
catagtggtcggctgcaactttgca

SEQ ID NO: 225142 - DNA, 25 bp, Mus musculus
ccaggcagccatagtggtcggctgc

SEQ ID NO: 225143 - DNA, 25 bp, Mus musculus
gcacggagcaggcttcatccggcct

SEQ ID NO: 225144 - DNA, 25 bp, Mus musculus
gagcacggagcaggcttcatccggc

SEQ ID NO: 225145 - DNA, 25 bp, Mus musculus
cagccatagtggtcggctgcaactt

SEQ ID NO: 225146 - DNA, 25 bp, Mus musculus
tgcgggccttctccctgcaggtgag

SEQ ID NO: 225147 - DNA, 25 bp, Mus musculus
gccggggcaagcaaagccagtctca

SEQ ID NO: 225148 - DNA, 25 bp, Mus musculus
ctcagtctcatccacgcagagcttg

SEQ ID NO: 225149 - DNA, 25 bp, Mus musculus
agagcttgtcactgcgtagcacagg

SEQ ID NO: 225150 - DNA, 25 bp, Mus musculus
ggacagctccagaaagccacgggtg

SEQ ID NO: 225151 - DNA, 25 bp, Mus musculus
gctgcccgcttacagagttcccgtg

SEQ ID NO: 225152 - DNA, 25 bp, Mus musculus
gggttgctctaacaccgcctgtgga

SEQ ID NO: 225153 - DNA, 25 bp, Mus musculus
tctgctcttccagggcgcttagctc

SEQ ID NO: 225154 - DNA, 25 bp, Mus musculus
tctgagtttggttactggcgtccgc

SEQ ID NO: 225155 - DNA, 25 bp, Mus musculus
gctcctcgttcccacgtggcagagt

SEQ ID NO: 225156 - DNA, 25 bp, Mus musculus
cacaatctgttcaacctgtagggga

SEQ ID NO: 225157 - DNA, 25 bp, Mus musculus
ctcctctccgtagggcgtgacactt

SEQ ID NO: 225158 - DNA, 25 bp, Mus musculus
ggctgcctggactagctcagtctca

SEQ ID NO: 225159 - DNA, 25 bp, Mus musculus
tccggaagtggatcatttgaaacga

SEQ ID NO: 225160 - DNA, 25 bp, Mus musculus
caacgcagagcacctcgggagctgt

SEQ ID NO: 225161 - DNA, 25 bp, Mus musculus
gactttgaccgcgtaggctatacca

SEQ ID NO: 225162 - DNA, 25 bp, Mus musculus
ctgcatcatcgatctgggcgctccg

SEQ ID NO: 225163 - DNA, 25 bp, Mus musculus
acgcgactctgtgggatgactttga

SEQ ID NO: 225164 - DNA, 25 bp, Mus musculus
cgcgtaggctataccagactcggtg

SEQ ID NO: 225165 - DNA, 25 bp, Mus musculus
cagactcggtgtcagtggcttcata

SEQ ID NO: 225166 - DNA, 25 bp, Mus musculus
cagtggcttcatagcagcgtgcgaa

SEQ ID NO: 225167 - DNA, 25 bp, Mus musculus
cctagaaagaagaagctgcatcatc

SEQ ID NO: 225168 - DNA, 25 bp, Mus musculus
acccttggtgtaggtacggccgctg

SEQ ID NO: 225169 - DNA, 25 bp, Mus musculus
cagcacctcaggttccgatcgcggg

SEQ ID NO: 225170 - DNA, 25 bp, Mus musculus
tgccgagctggttctcggttccgcc

SEQ ID NO: 225171 - DNA, 25 bp, Mus musculus
cctggtttctctacgctgcgatcgc

SEQ ID NO: 225172 - DNA, 25 bp, Mus musculus
gggagtccgacgtttttatcaatga

SEQ ID NO: 225173 - DNA, 25 bp, Mus musculus
cccggtgtttcgtcatctcgagctc

SEQ ID NO: 225174 - DNA, 25 bp, Mus musculus
cttgcccaacaagcgacccttggtg

SEQ ID NO: 225175 - DNA, 25 bp, Mus musculus
acgctgcttcatctgcgggaagacc

SEQ ID NO: 225176 - DNA, 25 bp, Mus musculus
ccctggaagcaaagatggcagagtg

SEQ ID NO: 225177 - DNA, 25 bp, Mus musculus
tctaaatatggatgctgccacgggc

SEQ ID NO: 225178 - DNA, 25 bp, Mus musculus
ctgttgggaaaagcatttggggaca

SEQ ID NO: 225179 - DNA, 25 bp, Mus musculus
cgctctgggcctaaagcgctactgc

SEQ ID NO: 225180 - DNA, 25 bp, Mus musculus
acgctgctagcacacgtggacctga

SEQ ID NO: 225181 - DNA, 25 bp, Mus musculus
ggacctgattgagaagctgcttaac

SEQ ID NO: 225182 - DNA, 25 bp, Mus musculus
tgagaagctgcttaactatgcaccc

SEQ ID NO: 225183 - DNA, 25 bp, Mus musculus
gaagtgaccactggagcctgccctc

SEQ ID NO: 225184 - DNA, 25 bp, Mus musculus
gccaccggcagcctgtcatgctata

SEQ ID NO: 225185 - DNA, 25 bp, Mus musculus
gcctgtcatgctatattcaaactga

SEQ ID NO: 225186 - DNA, 25 bp, Mus musculus
ttcaaactgagctattggggatgtt

SEQ ID NO: 225187 - DNA, 25 bp, Mus musculus
ctattggggatgttggtgtattgcc

SEQ ID NO: 225188 - DNA, 25 bp, Mus musculus
tggaggaacaatgtatatccgttta

SEQ ID NO: 225189 - DNA, 25 bp, Mus musculus
gtgtgcagcatacccaggtgtcatc

SEQ ID NO: 225190 - DNA, 25 bp, Mus musculus
agcgaggacgcaagcctgagcaacc

SEQ ID NO: 225191 - DNA, 25 bp, Mus musculus
gcgcaaagcttcacggtccggtttc

SEQ ID NO: 225192 - DNA, 25 bp, Mus musculus
gctggaaagaggaagcgcaaagctt

SEQ ID NO: 225193 - DNA, 25 bp, Mus musculus
catcgctcggcgctggctggaaaga

SEQ ID NO: 225194 - DNA, 25 bp, Mus musculus
atggagacggatggagctcgctccc

SEQ ID NO: 225195 - DNA, 25 bp, Mus musculus
ggcagccatgttggcccgctcgcag

SEQ ID NO: 225196 - DNA, 25 bp, Mus musculus
aggtgtcatcatccgcgtgcggccc

SEQ ID NO: 225197 - DNA, 25 bp, Mus musculus
gcacgctcagctctccaaggttggc

SEQ ID NO: 225198 - DNA, 25 bp, Mus musculus
gccagttgtcccgagagatgcctgt

SEQ ID NO: 225199 - DNA, 25 bp, Mus musculus
tcttgcggcgcttgtgccagttgtc

SEQ ID NO: 225200 - DNA, 25 bp, Mus musculus
cacgcaccttcgtgttggcagcggg

SEQ ID NO: 225201 - DNA, 25 bp, Mus musculus
gggaaggcagcctctcccagtcgtc

SEQ ID NO: 225202 - DNA, 25 bp, Mus musculus
cccacgacgcagtcgggagtgtgca

SEQ ID NO: 225203 - DNA, 25 bp, Mus musculus
cttgatgctgtctcccttcattttc

SEQ ID NO: 225204 - DNA, 25 bp, Mus musculus
tcgagtggcaaggaccctaccgcca

SEQ ID NO: 225205 - DNA, 25 bp, Mus musculus
ggcgcccgtcctggctagaaaactc

SEQ ID NO: 225206 - DNA, 25 bp, Mus musculus
ccgtcctggctagaaaactctgcta

SEQ ID NO: 225207 - DNA, 25 bp, Mus musculus
aactctgctactctggcctctttgg

SEQ ID NO: 225208 - DNA, 25 bp, Mus musculus
cgggttcgttggcagtcttagaact

SEQ ID NO: 225209 - DNA, 25 bp, Mus musculus
cagtcttagaacttcgcctgggtca

SEQ ID NO: 225210 - DNA, 25 bp, Mus musculus
gaggaatcgagtggcaaggacccta

SEQ ID NO: 225211 - DNA, 25 bp, Mus musculus
tcgcctgggtcaggcttgaagaagt

SEQ ID NO: 225212 - DNA, 25 bp, Mus musculus
ctgtacgcataggaatgtgccggcg

SEQ ID NO: 225213 - DNA, 25 bp, Mus musculus
aatgtgccggcgaggtccctaaggc

SEQ ID NO: 225214 - DNA, 25 bp, Mus musculus
tcgctgtggcttcttgatgctgtct

SEQ ID NO: 225215 - DNA, 25 bp, Mus musculus
ttttcagggaaatgggaggaatcga

SEQ ID NO: 225216 - DNA, 25 bp, Mus musculus
ccctaaggcccactgcgagggagtc

SEQ ID NO: 225217 - DNA, 25 bp, Mus musculus
tcccgcagggctggctagagcttgc

SEQ ID NO: 225218 - DNA, 25 bp, Mus musculus
tgaagacccgcaccttcaccatggc

SEQ ID NO: 225219 - DNA, 25 bp, Mus musculus
cgaagcgactccctggttgctaggc

SEQ ID NO: 225220 - DNA, 25 bp, Mus musculus
ccgaggcgcgaagcgactccctggt

SEQ ID NO: 225221 - DNA, 25 bp, Mus musculus
aggtcacagagtgcggctcggggat

SEQ ID NO: 225222 - DNA, 25 bp, Mus musculus
ggcctgtgctgaagacccgcacctt

SEQ ID NO: 225223 - DNA, 25 bp, Mus musculus
ttgggaaggtgacctaacagcgatg

SEQ ID NO: 225224 - DNA, 25 bp, Mus musculus
gatcccggatcagccctgctggagc

SEQ ID NO: 225225 - DNA, 25 bp, Mus musculus
tcgagatcccggatcagccctgctg

SEQ ID NO: 225226 - DNA, 25 bp, Mus musculus
ttacagcatcgagatcccggatcag

SEQ ID NO: 225227 - DNA, 25 bp, Mus musculus
cgagctggattacagcatcgagatc

SEQ ID NO: 225228 - DNA, 25 bp, Mus musculus
ctcggccgagctggattacagcatc

SEQ ID NO: 225229 - DNA, 25 bp, Mus musculus
ttcaccatggcctcggccgagctgg

SEQ ID NO: 225230 - DNA, 25 bp, Mus musculus
cgactccctggttgctaggcaggga

SEQ ID NO: 225231 - DNA, 25 bp, Mus musculus
cggactcaccattcagtcgggtttg

SEQ ID NO: 225232 - DNA, 25 bp, Mus musculus
tcacgtgagccgtcgccgtaacgcg

SEQ ID NO: 225233 - DNA, 25 bp, Mus musculus
ggccggaccggactcaccattcagt

SEQ ID NO: 225234 - DNA, 25 bp, Mus musculus
ctgatcacgtgagccgtcgccgtaa

SEQ ID NO: 225235 - DNA, 25 bp, Mus musculus
tcaccattcagtcgggtttgccggt

SEQ ID NO: 225236 - DNA, 25 bp, Mus musculus
attcagtcgggtttgccggttggct

SEQ ID NO: 225237 - DNA, 25 bp, Mus musculus
tttgccggttggctcgcactcgcag

SEQ ID NO: 225238 - DNA, 25 bp, Mus musculus
ttggctcgcactcgcaggaaggtct

SEQ ID NO: 225239 - DNA, 25 bp, Mus musculus
ctgggagcaaatcccgggcagatgc

SEQ ID NO: 225240 - DNA, 25 bp, Mus musculus
tcccgggcagatgcaaaaagagaga

SEQ ID NO: 225241 - DNA, 25 bp, Mus musculus
agagaggagagcgtcacacgcggcc

SEQ ID NO: 225242 - DNA, 25 bp, Mus musculus
gcccgggctgctctaacgggagccc

SEQ ID NO: 225243 - DNA, 25 bp, Mus musculus
ccatgttggccctgatcacgtgagc

SEQ ID NO: 225244 - DNA, 25 bp, Mus musculus
cgcaggaaggtctgggagcaaatcc

SEQ ID NO: 225245 - DNA, 25 bp, Mus musculus
ggctgcccttgaacgcctttgccgg

SEQ ID NO: 225246 - DNA, 25 bp, Mus musculus
agatcccgctgtccggctgtcagac

SEQ ID NO: 225247 - DNA, 25 bp, Mus musculus
cacttgctgtgcagatcccgctgtc

SEQ ID NO: 225248 - DNA, 25 bp, Mus musculus
cgacgggaatttcacttgctgtgca

SEQ ID NO: 225249 - DNA, 25 bp, Mus musculus
tcgatccgacgggaatttcacttgc

SEQ ID NO: 225250 - DNA, 25 bp, Mus musculus
cggctttatcgatccgacgggaatt

SEQ ID NO: 225251 - DNA, 25 bp, Mus musculus
ccagcgcttcggctttatcgatccg

SEQ ID NO: 225252 - DNA, 25 bp, Mus musculus
agataaaaccatcgacccgtcgccg

SEQ ID NO: 225253 - DNA, 25 bp, Mus musculus
tccagcccgcagtccggtggccgca

SEQ ID NO: 225254 - DNA, 25 bp, Mus musculus
ctttgccggccggtccgactgtcag

SEQ ID NO: 225255 - DNA, 25 bp, Mus musculus
ggtgcggctgcccttgaacgccttt

SEQ ID NO: 225256 - DNA, 25 bp, Mus musculus
ctgtccggctgtcagacacccggtg

SEQ ID NO: 225257 - DNA, 25 bp, Mus musculus
aataggcccggacgtgagcccacag

SEQ ID NO: 225258 - DNA, 25 bp, Mus musculus
cggggccgagacagataaaaccatc

SEQ ID NO: 225259 - DNA, 25 bp, Mus musculus
caccatggtgatgaggcattccctc

SEQ ID NO: 225260 - DNA, 25 bp, Mus musculus
agccacctcgatgcgggcagccagg

SEQ ID NO: 225261 - DNA, 25 bp, Mus musculus
aacggcagcccggatcgcttctgca

SEQ ID NO: 225262 - DNA, 25 bp, Mus musculus
cgcttctgcatgacaattgactcta

SEQ ID NO: 225263 - DNA, 25 bp, Mus musculus
caggtccgcgtctcaccatggtgat

SEQ ID NO: 225264 - DNA, 25 bp, Mus musculus
agaactgggttcttagagcgtcgtg

SEQ ID NO: 225265 - DNA, 25 bp, Mus musculus
cgcgcggacttctcctgaagagcga

SEQ ID NO: 225266 - DNA, 25 bp, Mus musculus
tggcgaggtcatccgcatccctaaa

SEQ ID NO: 225267 - DNA, 25 bp, Mus musculus
tccctaaagcgcttgtggaaccacc

SEQ ID NO: 225268 - DNA, 25 bp, Mus musculus
gtggaaccacctggccacaggcgct

SEQ ID NO: 225269 - DNA, 25 bp, Mus musculus
cggtcaattaccagccacctcgatg

SEQ ID NO: 225270 - DNA, 25 bp, Mus musculus
gcccggtcgctatcattgccaaaga

SEQ ID NO: 225271 - DNA, 25 bp, Mus musculus
attccctccgtgagaggcgaccgcg

SEQ ID NO: 225272 - DNA, 25 bp, Mus musculus
caattgactctagggagggcgctcg

SEQ ID NO: 225273 - DNA, 25 bp, Mus musculus
gagaaggcggaggacgcacgggctg

SEQ ID NO: 225274 - DNA, 25 bp, Mus musculus
gctgggaatcggaaccgcgggtgaa

SEQ ID NO: 225275 - DNA, 25 bp, Mus musculus
tcctctgtttctccccggctgccga

SEQ ID NO: 225276 - DNA, 25 bp, Mus musculus
ggctgaggcccttcccgcagaaact

SEQ ID NO: 225277 - DNA, 25 bp, Mus musculus
gctgaggcccttcccgcagaaactg

SEQ ID NO: 225278 - DNA, 25 bp, Mus musculus
gcccttcccgcagaaactgggggca

SEQ ID NO: 225279 - DNA, 25 bp, Mus musculus
caccggcggcgtaggaggtggagaa

SEQ ID NO: 225280 - DNA, 25 bp, Mus musculus
gatggtgaacacttgccgccgctga

SEQ ID NO: 225281 - DNA, 25 bp, Mus musculus
tgaacttgggcgccacgttccgggc

SEQ ID NO: 225282 - DNA, 25 bp, Mus musculus
gtgaggatggtgaacacttgccgcc

SEQ ID NO: 225283 - DNA, 25 bp, Mus musculus
tgccgccgctgaccctgcctttcct

SEQ ID NO: 225284 - DNA, 25 bp, Mus musculus
gaggatggtgaacacttgccgccgc

SEQ ID NO: 225285 - DNA, 25 bp, Mus musculus
tcccgcagaaactgggggcaccggc

SEQ ID NO: 225286 - DNA, 25 bp, Mus musculus
accgcgggtgaacttgggcgccacg

SEQ ID NO: 225287 - DNA, 25 bp, Mus musculus
ctcgtgattttacaagatcgtcctc

SEQ ID NO: 225288 - DNA, 25 bp, Mus musculus
cttcatcctgcaggcggaggttttc

SEQ ID NO: 225289 - DNA, 25 bp, Mus musculus
agcacggttcacctcagtggcagca

SEQ ID NO: 225290 - DNA, 25 bp, Mus musculus
gctgggagtttaccggttacagata

SEQ ID NO: 225291 - DNA, 25 bp, Mus musculus
cggccagtccaacccagtggagctg

SEQ ID NO: 225292 - DNA, 25 bp, Mus musculus
ctcgctccttataatcgctggaaga

SEQ ID NO: 225293 - DNA, 25 bp, Mus musculus
ttgtgccctggaagaaaagcctttc

SEQ ID NO: 225294 - DNA, 25 bp, Mus musculus
tctgcccaagtttgttgtgccctgg

SEQ ID NO: 225295 - DNA, 25 bp, Mus musculus
ggacgaacctcgcatccctagatgg

SEQ ID NO: 225296 - DNA, 25 bp, Mus musculus
agaatgtgtcctctgctttccaaca

SEQ ID NO: 225297 - DNA, 25 bp, Mus musculus
cggaccagagaaggcagtgcgttct

SEQ ID NO: 225298 - DNA, 25 bp, Mus musculus
ttgactagagcggtgacccggacca

SEQ ID NO: 225299 - DNA, 25 bp, Mus musculus
cggcgtgctcgctgaaaagttttgc

SEQ ID NO: 225300 - DNA, 25 bp, Mus musculus
gaacgcgttactctaaggccggcca

SEQ ID NO: 225301 - DNA, 25 bp, Mus musculus
cacctggagagagcctgccgtgctg

SEQ ID NO: 225302 - DNA, 25 bp, Mus musculus
ggagctggccctgcttctgcctggc

SEQ ID NO: 225303 - DNA, 25 bp, Mus musculus
tttggagagaagaagccccgcctta

SEQ ID NO: 225304 - DNA, 25 bp, Mus musculus
agctcattggccaaaggcgctagca

SEQ ID NO: 225305 - DNA, 25 bp, Mus musculus
tcattggccaaaggcgctagcagcg

SEQ ID NO: 225306 - DNA, 25 bp, Mus musculus
caaaggcgctagcagcgggctcagc

SEQ ID NO: 225307 - DNA, 25 bp, Mus musculus
ctcagcggttggctaccacgcccgc

SEQ ID NO: 225308 - DNA, 25 bp, Mus musculus
cacgcccgcccgtccaccgcgtcgg

SEQ ID NO: 225309 - DNA, 25 bp, Mus musculus
tgagtcggtgtgttgtggactcgtg

SEQ ID NO: 225310 - DNA, 25 bp, Mus musculus
cctgcttctgcctggccagcgccgc

SEQ ID NO: 225311 - DNA, 25 bp, Mus musculus
cccgctgccgtcaactgcccggagc

SEQ ID NO: 225312 - DNA, 25 bp, Mus musculus
ggcctgcacctggagagagcctgcc

SEQ ID NO: 225313 - DNA, 25 bp, Mus musculus
tggcgacagcctctccggcagctga

SEQ ID NO: 225314 - DNA, 25 bp, Mus musculus
tgcccggagcgtctgctgaggccga

SEQ ID NO: 225315 - DNA, 25 bp, Mus musculus
gcgtcgtagaaacgcaacccttaga

SEQ ID NO: 225316 - DNA, 25 bp, Mus musculus
gaggccagcgccagaatggtccaca

SEQ ID NO: 225317 - DNA, 25 bp, Mus musculus
ctgcagaaagactgtgctaccgtta

SEQ ID NO: 225318 - DNA, 25 bp, Mus musculus
cgtcaagggtcggtacctgcagaaa

SEQ ID NO: 225319 - DNA, 25 bp, Mus musculus
tcacgcccgagggatgaggtagtac

SEQ ID NO: 225320 - DNA, 25 bp, Mus musculus
atgtctcgtacatctgcgcccgtag

SEQ ID NO: 225321 - DNA, 25 bp, Mus musculus
agccggctagcaacccagtgtgcaa

SEQ ID NO: 225322 - DNA, 25 bp, Mus musculus
aggtgtcccttacggtcacactgtc

SEQ ID NO: 225323 - DNA, 25 bp, Mus musculus
cttccggtcggtgcttagacaaaca

SEQ ID NO: 225324 - DNA, 25 bp, Mus musculus
aacttccggctgtgcgtcgtagaaa

SEQ ID NO: 225325 - DNA, 25 bp, Mus musculus
tctctctgaagacccacggatagga

SEQ ID NO: 225326 - DNA, 25 bp, Mus musculus
tcgctcgcctggaattcctgctgtg

SEQ ID NO: 225327 - DNA, 25 bp, Mus musculus
ccacaccaggtttgggtgctgcctc

SEQ ID NO: 225328 - DNA, 25 bp, Mus musculus
tgcttagacaaacaggagccggcta

SEQ ID NO: 225329 - DNA, 25 bp, Mus musculus
atcaccaacaatcaccagtttcttc

SEQ ID NO: 225330 - DNA, 25 bp, Mus musculus
tgcgagctccaagccaagaacagga

SEQ ID NO: 225331 - DNA, 25 bp, Mus musculus
aggctcaaggcgacgactccgagtc

SEQ ID NO: 225332 - DNA, 25 bp, Mus musculus
atgcaaggctcaaggcgacgactcc

SEQ ID NO: 225333 - DNA, 25 bp, Mus musculus
ctggaacttctctgatgcaaggctc

SEQ ID NO: 225334 - DNA, 25 bp, Mus musculus
gtacaaagtacctggaacttctctg

SEQ ID NO: 225335 - DNA, 25 bp, Mus musculus
ctgggatgcagttgtacaaagtacc

SEQ ID NO: 225336 - DNA, 25 bp, Mus musculus
tgaaaacacacaggttctgggatgc

SEQ ID NO: 225337 - DNA, 25 bp, Mus musculus
cagtttcttcctgatggcagccatc

SEQ ID NO: 225338 - DNA, 25 bp, Mus musculus
aagtgaagagggtgttccaccatgc

SEQ ID NO: 225339 - DNA, 25 bp, Mus musculus
agcatgtcttaccacaagctccatc

SEQ ID NO: 225340 - DNA, 25 bp, Mus musculus
gttccaccatgctttggatagagga

SEQ ID NO: 225341 - DNA, 25 bp, Mus musculus
gccatcacttaataaaggtgctgaa

SEQ ID NO: 225342 - DNA, 25 bp, Mus musculus
caagaacaggaagctccgtgggaga

SEQ ID NO: 225343 - DNA, 25 bp, Mus musculus
tgcgtggatgagatagcgtttgctt

SEQ ID NO: 225344 - DNA, 25 bp, Mus musculus
cacacgtggtggctgatgtaacgcc

SEQ ID NO: 225345 - DNA, 25 bp, Mus musculus
acgccagctgagaggcgcacacgtg

SEQ ID NO: 225346 - DNA, 25 bp, Mus musculus
agcaggcagccacacacgggccgga

SEQ ID NO: 225347 - DNA, 25 bp, Mus musculus
cacaggtgaggcctggtttcccgca

SEQ ID NO: 225348 - DNA, 25 bp, Mus musculus
tagccttccttctgggcatgcttgc

SEQ ID NO: 225349 - DNA, 25 bp, Mus musculus
tccggttctcttttgtccgcggctc

SEQ ID NO: 225350 - DNA, 25 bp, Mus musculus
tcctgggaagcagcgaggaagaacc

SEQ ID NO: 225351 - DNA, 25 bp, Mus musculus
gctggctatctatctgggcgccgca

SEQ ID NO: 225352 - DNA, 25 bp, Mus musculus
gaagagcgtcttcggtctttctggg

SEQ ID NO: 225353 - DNA, 25 bp, Mus musculus
tgtgtgtcatcgttgtcaccaagga

SEQ ID NO: 225354 - DNA, 25 bp, Mus musculus
agtgctcgcactgggatgtctgtct

SEQ ID NO: 225355 - DNA, 25 bp, Mus musculus
tctgtggctaagagtgtgagtgctc

SEQ ID NO: 225356 - DNA, 25 bp, Mus musculus
tttgcttgcgggtatctgtggctaa

SEQ ID NO: 225357 - DNA, 25 bp, Mus musculus
gacccacatcgcctgtcgctttagg

SEQ ID NO: 225358 - DNA, 25 bp, Mus musculus
ttctgagttcccttctccctgactg

SEQ ID NO: 225359 - DNA, 25 bp, Mus musculus
ctgactgtcctaacccttcggtcta

SEQ ID NO: 225360 - DNA, 25 bp, Mus musculus
cttcggtctaggatggacccacatc

SEQ ID NO: 225361 - DNA, 25 bp, Mus musculus
gtcgctttagggacgcctggaaatg

SEQ ID NO: 225362 - DNA, 25 bp, Mus musculus
agggcaagcgcaggaaacctctcta

SEQ ID NO: 225363 - DNA, 25 bp, Mus musculus
ctctctagggttaagagtgcgccgc

SEQ ID NO: 225364 - DNA, 25 bp, Mus musculus
ggaccacctcgcttactcagtgatg

SEQ ID NO: 225365 - DNA, 25 bp, Mus musculus
cgcgacacagatgcgtccggatctc

SEQ ID NO: 225366 - DNA, 25 bp, Mus musculus
caccgagtcgagcagctagagcgtc

SEQ ID NO: 225367 - DNA, 25 bp, Mus musculus
catggcatggagagcctgttctgac

SEQ ID NO: 225368 - DNA, 25 bp, Mus musculus
tgttctgacacaggcgccgctgact

SEQ ID NO: 225369 - DNA, 25 bp, Mus musculus
ccagcccgaagtacttctgagttcc

SEQ ID NO: 225370 - DNA, 25 bp, Mus musculus
cctggaaatggcgatggtcagattc

SEQ ID NO: 225371 - DNA, 25 bp, Mus musculus
tcttctgacacgcttttcactgcgc

SEQ ID NO: 225372 - DNA, 25 bp, Mus musculus
agggttctcttctgacacgcttttc

SEQ ID NO: 225373 - DNA, 25 bp, Mus musculus
ccgcttccaggactcccggatatga

SEQ ID NO: 225374 - DNA, 25 bp, Mus musculus
cctgcctgcagcgtttgaaaaatgc

SEQ ID NO: 225375 - DNA, 25 bp, Mus musculus
gcagcgtttgaaaaatgccacaaag

SEQ ID NO: 225376 - DNA, 25 bp, Mus musculus
tgccacaaagccaagcagagactgg

SEQ ID NO: 225377 - DNA, 25 bp, Mus musculus
cgctctcctggagcaccggactggg

SEQ ID NO: 225378 - DNA, 25 bp, Mus musculus
ggtttgaggtccagccactgcaccc

SEQ ID NO: 225379 - DNA, 25 bp, Mus musculus
cacttcgagcataagggttctcttc

SEQ ID NO: 225380 - DNA, 25 bp, Mus musculus
gacaaggcccagattcccatcgtgg

SEQ ID NO: 225381 - DNA, 25 bp, Mus musculus
cccatcgtgggcagtaacggctcca

SEQ ID NO: 225382 - DNA, 25 bp, Mus musculus
gtaacggctccagccgcttccagga

SEQ ID NO: 225383 - DNA, 25 bp, Mus musculus
gaagacgggtttgaggtccagccac

SEQ ID NO: 225384 - DNA, 25 bp, Mus musculus
acgggcaggcgaagtggaaacactt

SEQ ID NO: 225385 - DNA, 25 bp, Mus musculus
gagcgcctctgcgagacacaaggcc

SEQ ID NO: 225386 - DNA, 25 bp, Mus musculus
gcagacccacggaccggcggaccga

SEQ ID NO: 225387 - DNA, 25 bp, Mus musculus
ctgtggacggctctgtcccccatgg

SEQ ID NO: 225388 - DNA, 25 bp, Mus musculus
cagcagctgtggacggctctgtccc

SEQ ID NO: 225389 - DNA, 25 bp, Mus musculus
ggctccagcagctgtggacggctct

SEQ ID NO: 225390 - DNA, 25 bp, Mus musculus
ctccagctcgggtagggatcccggc

SEQ ID NO: 225391 - DNA, 25 bp, Mus musculus
agcgccggtgcctcgctcaccgggt

SEQ ID NO: 225392 - DNA, 25 bp, Mus musculus
ccggagcccaggaggctagcgggat

SEQ ID NO: 225393 - DNA, 25 bp, Mus musculus
cctctgcgagacacaaggccggggc

SEQ ID NO: 225394 - DNA, 25 bp, Mus musculus
ggccgagcgcctctgcgagacacaa

SEQ ID NO: 225395 - DNA, 25 bp, Mus musculus
gaccgacggaccactgcgctgccgc

SEQ ID NO: 225396 - DNA, 25 bp, Mus musculus
tcgggtagggatcccggctccagca

SEQ ID NO: 225397 - DNA, 25 bp, Mus musculus
gcgagcgaggacaatgagggaggcc

SEQ ID NO: 225398 - DNA, 25 bp, Mus musculus
ccgggtctggaatgtcggggccctg

SEQ ID NO: 225399 - DNA, 25 bp, Mus musculus
agaaggccacaaagatcccgaggta

SEQ ID NO: 225400 - DNA, 25 bp, Mus musculus
gcactgtggtggttgtagtttcgtc

SEQ ID NO: 225401 - DNA, 25 bp, Mus musculus
ggtagacgtcatgccgcggagcact

SEQ ID NO: 225402 - DNA, 25 bp, Mus musculus
ctgaccggcgcacgtgatgcgccga

SEQ ID NO: 225403 - DNA, 25 bp, Mus musculus
atcccgaggtagagcaactccagcc

SEQ ID NO: 225404 - DNA, 25 bp, Mus musculus
acaacgaccatgcaggcccagaagg

SEQ ID NO: 225405 - DNA, 25 bp, Mus musculus
gtgtgactctcgcagcccagggccg

SEQ ID NO: 225406 - DNA, 25 bp, Mus musculus
gaccctggaatagccggtgtgactc

SEQ ID NO: 225407 - DNA, 25 bp, Mus musculus
aggtcaggaacctggcgtcgcgacc

SEQ ID NO: 225408 - DNA, 25 bp, Mus musculus
ccaaatatgcggctcgcggagagga

SEQ ID NO: 225409 - DNA, 25 bp, Mus musculus
aagcggggcgcccaaatatgcggct

SEQ ID NO: 225410 - DNA, 25 bp, Mus musculus
tcgctgtttacccaacaagctgtga

SEQ ID NO: 225411 - DNA, 25 bp, Mus musculus
atcctgccggcccaatcgctgttta

SEQ ID NO: 225412 - DNA, 25 bp, Mus musculus
atcggtgggacctgagctaaaccgc

SEQ ID NO: 225413 - DNA, 25 bp, Mus musculus
gcgatacgggcggatcccgacccaa

SEQ ID NO: 225414 - DNA, 25 bp, Mus musculus
gggctgctgaacgtagactccattg

SEQ ID NO: 225415 - DNA, 25 bp, Mus musculus
ctccgcagggctgctgaacgtagac

SEQ ID NO: 225416 - DNA, 25 bp, Mus musculus
gtgaactgtcctggaacgcccgcct

SEQ ID NO: 225417 - DNA, 25 bp, Mus musculus
ggtcttcaggaggagtgaactgtcc

SEQ ID NO: 225418 - DNA, 25 bp, Mus musculus
atacacgcggtccaggtcttcagga

SEQ ID NO: 225419 - DNA, 25 bp, Mus musculus
tccagctcatacacgcggtccaggt

SEQ ID NO: 225420 - DNA, 25 bp, Mus musculus
ttcgtaactcgctccagctcataca

SEQ ID NO: 225421 - DNA, 25 bp, Mus musculus
cgcagacaaatttcgtaactcgctc

SEQ ID NO: 225422 - DNA, 25 bp, Mus musculus
tgacaacctaaatcgcagacaaatt

SEQ ID NO: 225423 - DNA, 25 bp, Mus musculus
acccgctgacaacctaaatcgcaga

SEQ ID NO: 225424 - DNA, 25 bp, Mus musculus
ctctgaaccagacctcacccgctga

SEQ ID NO: 225425 - DNA, 25 bp, Mus musculus
tgctgaacgtagactccattgggcg

SEQ ID NO: 225426 - DNA, 25 bp, Mus musculus
tccgcaacccatacccagaggagag

SEQ ID NO: 225427 - DNA, 25 bp, Mus musculus
atacggagacgtccaaggaagcacg

SEQ ID NO: 225428 - DNA, 25 bp, Mus musculus
gcacgggattgcagtttcgtgagtc

SEQ ID NO: 225429 - DNA, 25 bp, Mus musculus
cgatctgttcgcctcccggcgttgg

SEQ ID NO: 225430 - DNA, 25 bp, Mus musculus
cccagtgactgacagacaggccggc

SEQ ID NO: 225431 - DNA, 25 bp, Mus musculus
ggacctcagcaagactcgggctgtc

SEQ ID NO: 225432 - DNA, 25 bp, Mus musculus
ctgtcgccagtaccaccaacttagg

SEQ ID NO: 225433 - DNA, 25 bp, Mus musculus
cacatcgagacacggcacggcggaa

SEQ ID NO: 225434 - DNA, 25 bp, Mus musculus
cacggcggaactacgcggaaactca

SEQ ID NO: 225435 - DNA, 25 bp, Mus musculus
aactcattccgggtctttggccctg

SEQ ID NO: 225436 - DNA, 25 bp, Mus musculus
ctttggccctgtcctcgtgctagct

SEQ ID NO: 225437 - DNA, 25 bp, Mus musculus
cccgaacaggcgacggaacggcaca

SEQ ID NO: 225438 - DNA, 25 bp, Mus musculus
tgcctgaagcaaggacccgcctcta

SEQ ID NO: 225439 - DNA, 25 bp, Mus musculus
cggcacggccaagcacatcgagaca

SEQ ID NO: 225440 - DNA, 25 bp, Mus musculus
agagcccttcgcgagatacggagac

SEQ ID NO: 225441 - DNA, 25 bp, Mus musculus
ggttcgtctggttcaccaatctttc

SEQ ID NO: 225442 - DNA, 25 bp, Mus musculus
atatcgccgcagaagtcgagtgagg

SEQ ID NO: 225443 - DNA, 25 bp, Mus musculus
tcacgtgctatatcgccgcagaagt

SEQ ID NO: 225444 - DNA, 25 bp, Mus musculus
ggaaaagtcacgcactcacgtgcta

SEQ ID NO: 225445 - DNA, 25 bp, Mus musculus
ctccggagctgggaaaagtcacgca

SEQ ID NO: 225446 - DNA, 25 bp, Mus musculus
agcctgagggccctaagtcttcccg

SEQ ID NO: 225447 - DNA, 25 bp, Mus musculus
ggaaacccacggagcacttccagcg

SEQ ID NO: 225448 - DNA, 25 bp, Mus musculus
tgggcaccggaaacccacggagcac

SEQ ID NO: 225449 - DNA, 25 bp, Mus musculus
gacccagcacgcgacactcgggagt

SEQ ID NO: 225450 - DNA, 25 bp, Mus musculus
cccgctgagcgggaccgagatttcg

SEQ ID NO: 225451 - DNA, 25 bp, Mus musculus
ccacacgaccggttcgtctggttca

SEQ ID NO: 225452 - DNA, 25 bp, Mus musculus
accgcaggggctttactggaacctg

SEQ ID NO: 225453 - DNA, 25 bp, Mus musculus
ctttactggaacctgagggctggac

SEQ ID NO: 225454 - DNA, 25 bp, Mus musculus
gcccttccactcgaggcccgcggat

SEQ ID NO: 225455 - DNA, 25 bp, Mus musculus
aggcttagtcactttcggaggtgtg

SEQ ID NO: 225456 - DNA, 25 bp, Mus musculus
cctcatagcgagtgggccggcagca

SEQ ID NO: 225457 - DNA, 25 bp, Mus musculus
cacgtccatgaaggagacggcctca

SEQ ID NO: 225458 - DNA, 25 bp, Mus musculus
cctccaggtgctgttcacgtccatg

SEQ ID NO: 225459 - DNA, 25 bp, Mus musculus
agaggtggtccacggtcctccaggt

SEQ ID NO: 225460 - DNA, 25 bp, Mus musculus
gccgctgcagaagcggaaacgtatc

SEQ ID NO: 225461 - DNA, 25 bp, Mus musculus
aggctggccagactgagatcgtgct

SEQ ID NO: 225462 - DNA, 25 bp, Mus musculus
agcggaaacgtatcagctcgtcgga

SEQ ID NO: 225463 - DNA, 25 bp, Mus musculus
tcgcagggttctttcgctgcacaaa

SEQ ID NO: 225464 - DNA, 25 bp, Mus musculus
tcacctaccaggcaggtggtccgtg

SEQ ID NO: 225465 - DNA, 25 bp, Mus musculus
cctggaatgaggcttagtcactttc

SEQ ID NO: 225466 - DNA, 25 bp, Mus musculus
gtgtctagagctagcctcgcccttg

SEQ ID NO: 225467 - DNA, 25 bp, Mus musculus
cagcgcccagtaggctggccagact

SEQ ID NO: 225468 - DNA, 25 bp, Mus musculus
tcgctgcacaaatgcgcagtgtgtc

SEQ ID NO: 225469 - DNA, 25 bp, Mus musculus
gccgctccaccctccggatccggtc

SEQ ID NO: 225470 - DNA, 25 bp, Mus musculus
tagtcaagcaaagtagggaactggg

SEQ ID NO: 225471 - DNA, 25 bp, Mus musculus
tcgaagttggtagtcaagcaaagta

SEQ ID NO: 225472 - DNA, 25 bp, Mus musculus
gggccgagcccaactccatccctca

SEQ ID NO: 225473 - DNA, 25 bp, Mus musculus
ggtgtcaaattccagccccggcgtc

SEQ ID NO: 225474 - DNA, 25 bp, Mus musculus
ccgctggctaggctaggtccctcta

SEQ ID NO: 225475 - DNA, 25 bp, Mus musculus
tggctaggctaggtccctctaggtg

SEQ ID NO: 225476 - DNA, 25 bp, Mus musculus
ggggctagacatttggagaagaccc

SEQ ID NO: 225477 - DNA, 25 bp, Mus musculus
cccaggaggcagagtagagatcgcg

SEQ ID NO: 225478 - DNA, 25 bp, Mus musculus
cgggctgcagcgagacgctgaaact

SEQ ID NO: 225479 - DNA, 25 bp, Mus musculus
agcgagacgctgaaactgggaattc

SEQ ID NO: 225480 - DNA, 25 bp, Mus musculus
ctgggaattcgaagttggtagtcaa

SEQ ID NO: 225481 - DNA, 25 bp, Mus musculus
gcccgagggacttgttgctggcaga

SEQ ID NO: 225482 - DNA, 25 bp, Mus musculus
gccgccgtccggtgtcaaattccag

SEQ ID NO: 225483 - DNA, 25 bp, Mus musculus
cccaatggaagccagaggccgaatc

SEQ ID NO: 225484 - DNA, 25 bp, Mus musculus
caggccaatgcgaggcttcgccgca

SEQ ID NO: 225485 - DNA, 25 bp, Mus musculus
gcagccaatgggagcaccggaaccg

SEQ ID NO: 225486 - DNA, 25 bp, Mus musculus
gcggcgggaccaccaatcctgcggt

SEQ ID NO: 225487 - DNA, 25 bp, Mus musculus
aattgcagcgcgaatagcggggaca

SEQ ID NO: 225488 - DNA, 25 bp, Mus musculus
cgcggaggcaattgcagcgcgaata

SEQ ID NO: 225489 - DNA, 25 bp, Mus musculus
caggccttaccgcagcagagaggga

SEQ ID NO: 225490 - DNA, 25 bp, Mus musculus
cgcctgggacactgcacacaggtga

SEQ ID NO: 225491 - DNA, 25 bp, Mus musculus
tgacaaccgctactcttggtgactc

SEQ ID NO: 225492 - DNA, 25 bp, Mus musculus
cgagaagacgtactttgataaactg

SEQ ID NO: 225493 - DNA, 25 bp, Mus musculus
taaactgacccggtcgctccgagga

SEQ ID NO: 225494 - DNA, 25 bp, Mus musculus
gggaaggcagagatgacaaccgcta

SEQ ID NO: 225495 - DNA, 25 bp, Mus musculus
tttgcgctcagactcgcgcgcctgg

SEQ ID NO: 225496 - DNA, 25 bp, Mus musculus
actcttggtgactcccgctaggctt

SEQ ID NO: 225497 - DNA, 25 bp, Mus musculus
cgagcacctcggtgtgtccgcacat

SEQ ID NO: 225498 - DNA, 25 bp, Mus musculus
cgctccagcattgcgtcgatgacga

SEQ ID NO: 225499 - DNA, 25 bp, Mus musculus
tcgtgcttcatacgctccagcattg

SEQ ID NO: 225500 - DNA, 25 bp, Mus musculus
gtcaaccgtcttctcgtgcttcata

SEQ ID NO: 225501 - DNA, 25 bp, Mus musculus
gtggccatagatgtcaaccgtcttc

SEQ ID NO: 225502 - DNA, 25 bp, Mus musculus
tgcacgtcacgtggccatagatgtc

SEQ ID NO: 225503 - DNA, 25 bp, Mus musculus
tttgtgagcgcatgcacgtcacgtg

SEQ ID NO: 225504 - DNA, 25 bp, Mus musculus
accatgtagttcctttgtgagcgca

SEQ ID NO: 225505 - DNA, 25 bp, Mus musculus
acatactggtcctcggtctgcacca

SEQ ID NO: 225506 - DNA, 25 bp, Mus musculus
tgaacacatactggtcctcggtctg

SEQ ID NO: 225507 - DNA, 25 bp, Mus musculus
gggcctcgtggatgaacacatactg

SEQ ID NO: 225508 - DNA, 25 bp, Mus musculus
cacatggcagcctctagcagggcct

SEQ ID NO: 225509 - DNA, 25 bp, Mus musculus
gcattgcgtcgatgacgatgaagca

SEQ ID NO: 225510 - DNA, 25 bp, Mus musculus
gtgtccgcacatggcagcctctagc

SEQ ID NO: 225511 - DNA, 25 bp, Mus musculus
gtcccgtggcgtgcgtgtggaccgc

SEQ ID NO: 225512 - DNA, 25 bp, Mus musculus
ttctgtttttcataacccacgcacg

SEQ ID NO: 225513 - DNA, 25 bp, Mus musculus
tgccttctgtttttcataacccacg

SEQ ID NO: 225514 - DNA, 25 bp, Mus musculus
cctgccttctgtttttcataaccca

SEQ ID NO: 225515 - DNA, 25 bp, Mus musculus
aggaggtcggccagttcctcctgcc

SEQ ID NO: 225516 - DNA, 25 bp, Mus musculus
cgatgaggaggtcggccagttcctc

SEQ ID NO: 225517 - DNA, 25 bp, Mus musculus
ttccctgtccacgaggggcgatgag

SEQ ID NO: 225518 - DNA, 25 bp, Mus musculus
tcttccctgtccacgaggggcgatg

SEQ ID NO: 225519 - DNA, 25 bp, Mus musculus
gctcttccctgtccacgaggggcga

SEQ ID NO: 225520 - DNA, 25 bp, Mus musculus
tggcggctcacgggcgtcttgcttc

SEQ ID NO: 225521 - DNA, 25 bp, Mus musculus
tttggagctgttctggagcggggta

SEQ ID NO: 225522 - DNA, 25 bp, Mus musculus
accgcgcgtttggagctgttctgga

SEQ ID NO: 225523 - DNA, 25 bp, Mus musculus
tgtttttcataacccacgcacgcac

SEQ ID NO: 225524 - DNA, 25 bp, Mus musculus
tggaccgcgcgtttggagctgttct

SEQ ID NO: 225525 - DNA, 25 bp, Mus musculus
gttgcctctgcatatccagtccgca

SEQ ID NO: 225526 - DNA, 25 bp, Mus musculus
gaagactctaagttgcctctgcata

SEQ ID NO: 225527 - DNA, 25 bp, Mus musculus
gtccagaacagtgcagaagactcta

SEQ ID NO: 225528 - DNA, 25 bp, Mus musculus
tgctgtaaaggaagcccaatgctcc

SEQ ID NO: 225529 - DNA, 25 bp, Mus musculus
gcctgctagggtccagaacagtgca

SEQ ID NO: 225530 - DNA, 25 bp, Mus musculus
agctcccgcctgctagggtccagaa

SEQ ID NO: 225531 - DNA, 25 bp, Mus musculus
gcgcctccgcatccaagtcctactg

SEQ ID NO: 225532 - DNA, 25 bp, Mus musculus
acatgtggacatccctggcacgcgc

SEQ ID NO: 225533 - DNA, 25 bp, Mus musculus
tccggctacggactctactgcagac

SEQ ID NO: 225534 - DNA, 25 bp, Mus musculus
tttcaggtgctgtaaaggaagccca

SEQ ID NO: 225535 - DNA, 25 bp, Mus musculus
tgcacacacgcctctacgttttttc

SEQ ID NO: 225536 - DNA, 25 bp, Mus musculus
cggcttccggctacggactctactg

SEQ ID NO: 225537 - DNA, 25 bp, Mus musculus
gggtgcacgggttacgctatagccc

SEQ ID NO: 225538 - DNA, 25 bp, Mus musculus
cctctacgttttttcaggtgctgta

SEQ ID NO: 225539 - DNA, 25 bp, Mus musculus
ctggggaccaggcacacccgaacgg

SEQ ID NO: 225540 - DNA, 25 bp, Mus musculus
aagatcgggaggcagtgagcgacac

SEQ ID NO: 225541 - DNA, 25 bp, Mus musculus
cagggagccggagacacctagggaa

SEQ ID NO: 225542 - DNA, 25 bp, Mus musculus
gaaaccgagaaaggcgccgagacga

SEQ ID NO: 225543 - DNA, 25 bp, Mus musculus
agagactggggaccaggcacacccg

SEQ ID NO: 225544 - DNA, 25 bp, Mus musculus
gagcgcacccgtcctcccgggacga

SEQ ID NO: 225545 - DNA, 25 bp, Mus musculus
aggcgactgagtgaactttcggagc

SEQ ID NO: 225546 - DNA, 25 bp, Mus musculus
ctgagtgaactttcggagcgggtcc

SEQ ID NO: 225547 - DNA, 25 bp, Mus musculus
tttcggagcgggtccgagcgcaccc

SEQ ID NO: 225548 - DNA, 25 bp, Mus musculus
ccgcgctccgtacggagaccaggga

SEQ ID NO: 225549 - DNA, 25 bp, Mus musculus
cccggctcagctccacggacgcggg

SEQ ID NO: 225550 - DNA, 25 bp, Mus musculus
agggccgcgcatcgaggggcccgaa

SEQ ID NO: 225551 - DNA, 25 bp, Mus musculus
gccgagacgaaaacccgggcgcaga

SEQ ID NO: 225552 - DNA, 25 bp, Mus musculus
agacccggcgtcggctgcggctctt

SEQ ID NO: 225553 - DNA, 25 bp, Mus musculus
ggtggcctggccgtacaccgagtcc

SEQ ID NO: 225554 - DNA, 25 bp, Mus musculus
ttcctgacccgaggccgctccctcg

SEQ ID NO: 225555 - DNA, 25 bp, Mus musculus
ttcggggagccaggcccacgctgac

SEQ ID NO: 225556 - DNA, 25 bp, Mus musculus
tgctcatcaacacgccgcggggtgt

SEQ ID NO: 225557 - DNA, 25 bp, Mus musculus
gctggtgctcatcaacacgccgcgg

SEQ ID NO: 225558 - DNA, 25 bp, Mus musculus
gactgcggctggtgctcatcaacac

SEQ ID NO: 225559 - DNA, 25 bp, Mus musculus
gtctcctggctgtttccagagctcc

SEQ ID NO: 225560 - DNA, 25 bp, Mus musculus
ccaacgtctcctggctgtttccaga

SEQ ID NO: 225561 - DNA, 25 bp, Mus musculus
tcggccaacgtctcctggctgtttc

SEQ ID NO: 225562 - DNA, 25 bp, Mus musculus
cttttcggccaacgtctcctggctg

SEQ ID NO: 225563 - DNA, 25 bp, Mus musculus
cgccgccttctgctcgcatggctcc

SEQ ID NO: 225564 - DNA, 25 bp, Mus musculus
ccgctgccctcacttcctgacccga

SEQ ID NO: 225565 - DNA, 25 bp, Mus musculus
ccgaggtggcctggccgtacaccga

SEQ ID NO: 225566 - DNA, 25 bp, Mus musculus
catggctccgctccgcttttcggcc

SEQ ID NO: 225567 - DNA, 25 bp, Mus musculus
ccgggccagggaggttgctccactc

SEQ ID NO: 225568 - DNA, 25 bp, Mus musculus
atcgtggtggcatttgggaaggctc

SEQ ID NO: 225569 - DNA, 25 bp, Mus musculus
cttgattgagcgtggaaaaggatcg

SEQ ID NO: 225570 - DNA, 25 bp, Mus musculus
atcgagcccgctgatgtgagaaggt

SEQ ID NO: 225571 - DNA, 25 bp, Mus musculus
agcgggttgggccttatagccgctg

SEQ ID NO: 225572 - DNA, 25 bp, Mus musculus
gccgcggcaatgcaggtgagaagcg

SEQ ID NO: 225573 - DNA, 25 bp, Mus musculus
agcaagccgtgcgagaaaccggaaa

SEQ ID NO: 225574 - DNA, 25 bp, Mus musculus
ttctgattggtgagcgcagcaagcc

SEQ ID NO: 225575 - DNA, 25 bp, Mus musculus
gatggtcccgttttgagttttctga

SEQ ID NO: 225576 - DNA, 25 bp, Mus musculus
ccggctagttctgtaccgggcagga

SEQ ID NO: 225577 - DNA, 25 bp, Mus musculus
gggaggttgctccactcctgacctc

SEQ ID NO: 225578 - DNA, 25 bp, Mus musculus
ggggcgctccgaggccatcacacag

SEQ ID NO: 225579 - DNA, 25 bp, Mus musculus
aaagtagtgggctgccgcacgcctc

SEQ ID NO: 225580 - DNA, 25 bp, Mus musculus
ctctgacccggctagttctgtaccg

SEQ ID NO: 225581 - DNA, 25 bp, Mus musculus
gccgaacgcgttcttttccagacaa

SEQ ID NO: 225582 - DNA, 25 bp, Mus musculus
tctcgaacacgaactgcgccatggc

SEQ ID NO: 225583 - DNA, 25 bp, Mus musculus
ccgcacagttagtcctcgggatccg

SEQ ID NO: 225584 - DNA, 25 bp, Mus musculus
gacacgccggactgttgttcttaaa

SEQ ID NO: 225585 - DNA, 25 bp, Mus musculus
gttcttaaactctccgctgctagcg

SEQ ID NO: 225586 - DNA, 25 bp, Mus musculus
gctgctagcgttcattggctccttc

SEQ ID NO: 225587 - DNA, 25 bp, Mus musculus
gctccttcaaaacccaactgtctta

SEQ ID NO: 225588 - DNA, 25 bp, Mus musculus
gctacactgaagagggccgggtctt

SEQ ID NO: 225589 - DNA, 25 bp, Mus musculus
agcagtgagtgcaaatcgctctcga

SEQ ID NO: 225590 - DNA, 25 bp, Mus musculus
ccgggagcaaatctcacgagagtgc

SEQ ID NO: 225591 - DNA, 25 bp, Mus musculus
cgagagtgcgacgaccaagcatttg

SEQ ID NO: 225592 - DNA, 25 bp, Mus musculus
gaaggaaatcccgaacccatctctg

SEQ ID NO: 225593 - DNA, 25 bp, Mus musculus
ccttgccgattggtcgctacactga

SEQ ID NO: 225594 - DNA, 25 bp, Mus musculus
tgtggcttcctttgctttgcgctgc

SEQ ID NO: 225595 - DNA, 25 bp, Mus musculus
cacaggagaagacgcctaccaaatc

SEQ ID NO: 225596 - DNA, 25 bp, Mus musculus
gatgcgatcatccttctccagcagc

SEQ ID NO: 225597 - DNA, 25 bp, Mus musculus
ggaaggtgcgcacgatgcgatcatc

SEQ ID NO: 225598 - DNA, 25 bp, Mus musculus
agaaccgttgcgtgccaggtacagg

SEQ ID NO: 225599 - DNA, 25 bp, Mus musculus
acctggtgagaaccgttgcgtgcca

SEQ ID NO: 225600 - DNA, 25 bp, Mus musculus
tcagcgtgacctggtgagaaccgtt

SEQ ID NO: 225601 - DNA, 25 bp, Mus musculus
ccctcagcgtgacctggtgagaacc

SEQ ID NO: 225602 - DNA, 25 bp, Mus musculus
caaatccgagggcttggagaagccc

SEQ ID NO: 225603 - DNA, 25 bp, Mus musculus
gacgcctaccaaatccgagggcttg

SEQ ID NO: 225604 - DNA, 25 bp, Mus musculus
agcaccacccacacaggagaagacg

SEQ ID NO: 225605 - DNA, 25 bp, Mus musculus
cagacacgcaggtcaggaagaaacg

SEQ ID NO: 225606 - DNA, 25 bp, Mus musculus
ggcctcaccagacacgcaggtcagg

SEQ ID NO: 225607 - DNA, 25 bp, Mus musculus
cctaccaaatccgagggcttggaga

SEQ ID NO: 225608 - DNA, 25 bp, Mus musculus
ggtgcgcacgatgcgatcatccttc

SEQ ID NO: 225609 - DNA, 25 bp, Mus musculus
gctggccgacctctggaactccgtt

SEQ ID NO: 225610 - DNA, 25 bp, Mus musculus
cgcttgcgaggtaacccgctgtcct

SEQ ID NO: 225611 - DNA, 25 bp, Mus musculus
ggagtccgcgcttgcgaggtaaccc

SEQ ID NO: 225612 - DNA, 25 bp, Mus musculus
tgctcgctccatcaagcagggcgtc

SEQ ID NO: 225613 - DNA, 25 bp, Mus musculus
actccgcgtctgtcagcagacgagg

SEQ ID NO: 225614 - DNA, 25 bp, Mus musculus
gtggagcttccgctttgcaaacctc

SEQ ID NO: 225615 - DNA, 25 bp, Mus musculus
tgtcctcgcgactgtggcgtcgtct

SEQ ID NO: 225616 - DNA, 25 bp, Mus musculus
agctgtcagtcatggcgctgtcctc

SEQ ID NO: 225617 - DNA, 25 bp, Mus musculus
cagtcccgctgggaagctgtcagtc

SEQ ID NO: 225618 - DNA, 25 bp, Mus musculus
actccgttccggagctgactttcgc

SEQ ID NO: 225619 - DNA, 25 bp, Mus musculus
cacccggagttatttccggtctctg

SEQ ID NO: 225620 - DNA, 25 bp, Mus musculus
gtccctcgcctgagcctgttgtgcg

SEQ ID NO: 225621 - DNA, 25 bp, Mus musculus
tcaggtcctccagcgcgtcgtcagt

SEQ ID NO: 225622 - DNA, 25 bp, Mus musculus
ccgttttgtcaggtcctccagcgcg

SEQ ID NO: 225623 - DNA, 25 bp, Mus musculus
acggagaaacagagcaaggagcgac

SEQ ID NO: 225624 - DNA, 25 bp, Mus musculus
tcctgcacggcagagctcatcagct

SEQ ID NO: 225625 - DNA, 25 bp, Mus musculus
gagctcatcagctgcttcaccagaa

SEQ ID NO: 225626 - DNA, 25 bp, Mus musculus
agctgcttcaccagaaccagcaggg

SEQ ID NO: 225627 - DNA, 25 bp, Mus musculus
cagcagggccagcagacagagcaca

SEQ ID NO: 225628 - DNA, 25 bp, Mus musculus
gccagcagacagagcacagtgccca

SEQ ID NO: 225629 - DNA, 25 bp, Mus musculus
agtgcccacggctagtcgccattcg

SEQ ID NO: 225630 - DNA, 25 bp, Mus musculus
acggctagtcgccattcgccggatc

SEQ ID NO: 225631 - DNA, 25 bp, Mus musculus
gccattcgccggatcggctgctggt

SEQ ID NO: 225632 - DNA, 25 bp, Mus musculus
atcacggccacggagaaacagagca

SEQ ID NO: 225633 - DNA, 25 bp, Mus musculus
cgctgcgcagcaaggccacgtgctg

SEQ ID NO: 225634 - DNA, 25 bp, Mus musculus
gggcctggcgtatgcagttcatatc

SEQ ID NO: 225635 - DNA, 25 bp, Mus musculus
tgcagttcatatcctgcacggcaga

SEQ ID NO: 225636 - DNA, 25 bp, Mus musculus
cagccacaaggatcacggccacgga

SEQ ID NO: 225637 - DNA, 25 bp, Mus musculus
tagagcagttcctatagcaacgaga

SEQ ID NO: 225638 - DNA, 25 bp, Mus musculus
tgcggctatgaacccggaagcggaa

SEQ ID NO: 225639 - DNA, 25 bp, Mus musculus
agcggaagtccctgttgaaaaggca

SEQ ID NO: 225640 - DNA, 25 bp, Mus musculus
ctccgctttcagagtcggactcgga

SEQ ID NO: 225641 - DNA, 25 bp, Mus musculus
tcagatcaagaggtaggccgcagcg

SEQ ID NO: 225642 - DNA, 25 bp, Mus musculus
ttagctctttggtactgaggctccc

SEQ ID NO: 225643 - DNA, 25 bp, Mus musculus
ctgtagttgcaggatgcgttttccc

SEQ ID NO: 225644 - DNA, 25 bp, Mus musculus
ttcccgcggactcctgaagccaggt

SEQ ID NO: 225645 - DNA, 25 bp, Mus musculus
agccaggtctcaatgtcgtgctaga

SEQ ID NO: 225646 - DNA, 25 bp, Mus musculus
tcgtgctagagaagccgaagaaggc

SEQ ID NO: 225647 - DNA, 25 bp, Mus musculus
tccttggaacaggatgcgcacaagc

SEQ ID NO: 225648 - DNA, 25 bp, Mus musculus
tgcctcttgggagaccgattctggt

SEQ ID NO: 225649 - DNA, 25 bp, Mus musculus
ttctggtgggaaagatgcaccctgc

SEQ ID NO: 225650 - DNA, 25 bp, Mus musculus
ggcacgcccaaacgctagagcagtt

SEQ ID NO: 225651 - DNA, 25 bp, Mus musculus
gcttgcttgtagagtgacgatctga

SEQ ID NO: 225652 - DNA, 25 bp, Mus musculus
cgcccattggctaaaagagccgagc

SEQ ID NO: 225653 - DNA, 25 bp, Mus musculus
tcccagcagcaaggtgagtaacggg

SEQ ID NO: 225654 - DNA, 25 bp, Mus musculus
acagctagagcttcgagcgcagcgc

SEQ ID NO: 225655 - DNA, 25 bp, Mus musculus
tctcgcagccggcacagctagagct

SEQ ID NO: 225656 - DNA, 25 bp, Mus musculus
gttacagcgcgtccgttctccgtct

SEQ ID NO: 225657 - DNA, 25 bp, Mus musculus
acgcatagttacagcgcgtccgttc

SEQ ID NO: 225658 - DNA, 25 bp, Mus musculus
tctggcgggagacgcatagttacag

SEQ ID NO: 225659 - DNA, 25 bp, Mus musculus
gacgatctgagctacggggtcttaa

SEQ ID NO: 225660 - DNA, 25 bp, Mus musculus
cagaggcttgcttgtagagtgacga

SEQ ID NO: 225661 - DNA, 25 bp, Mus musculus
taaaaaggcagctccgcgcgctctc

SEQ ID NO: 225662 - DNA, 25 bp, Mus musculus
cggcggtcctataaaaaggcagctc

SEQ ID NO: 225663 - DNA, 25 bp, Mus musculus
cccagaaccaatggcggcggtccta

SEQ ID NO: 225664 - DNA, 25 bp, Mus musculus
agctacggggtcttaagtgcgtcag

SEQ ID NO: 225665 - DNA, 25 bp, Mus musculus
ttcagtaagcgcagacccacgcgta

SEQ ID NO: 225666 - DNA, 25 bp, Mus musculus
atgctagcctctccaatcctgatga

SEQ ID NO: 225667 - DNA, 25 bp, Mus musculus
gcaggcagcatctcaggccttgata

SEQ ID NO: 225668 - DNA, 25 bp, Mus musculus
aggttgctgacgaggtactctcatc

SEQ ID NO: 225669 - DNA, 25 bp, Mus musculus
ctttctcctgaaaggcgtgccagac

SEQ ID NO: 225670 - DNA, 25 bp, Mus musculus
ctggcccagagtcaggacagcacta

SEQ ID NO: 225671 - DNA, 25 bp, Mus musculus
ttcaggctaggtctaagcgacgcca

SEQ ID NO: 225672 - DNA, 25 bp, Mus musculus
acagcagtttcgaggttcagtaagc

SEQ ID NO: 225673 - DNA, 25 bp, Mus musculus
tcttgcggacttcctaagctgttcc

SEQ ID NO: 225674 - DNA, 25 bp, Mus musculus
ggcgcacaatcgtatccggggatcc

SEQ ID NO: 225675 - DNA, 25 bp, Mus musculus
agagctgcgcgcaactctggttcca

SEQ ID NO: 225676 - DNA, 25 bp, Mus musculus
cgggccgccgtgaaattgagcaaaa

SEQ ID NO: 225677 - DNA, 25 bp, Mus musculus
tgtcagcccagtgcttcagttgtcc

SEQ ID NO: 225678 - DNA, 25 bp, Mus musculus
gaggcgctgcatccctactgtgaac

SEQ ID NO: 225679 - DNA, 25 bp, Mus musculus
cgcagcggagggacacacggtaccc

SEQ ID NO: 225680 - DNA, 25 bp, Mus musculus
ttgggactcgcaaaacagcaacttc

SEQ ID NO: 225681 - DNA, 25 bp, Mus musculus
tcgcaaaacagcaacttcccaaaca

SEQ ID NO: 225682 - DNA, 25 bp, Mus musculus
acttcccaaacatcagccttcaagg

SEQ ID NO: 225683 - DNA, 25 bp, Mus musculus
gccttcaaggccttcgcaagagcga

SEQ ID NO: 225684 - DNA, 25 bp, Mus musculus
tcgcaagagcgaaggggccaggctc

SEQ ID NO: 225685 - DNA, 25 bp, Mus musculus
cccacgtcacctctacacagccgcg

SEQ ID NO: 225686 - DNA, 25 bp, Mus musculus
acagccgcgacccacttcactcccg

SEQ ID NO: 225687 - DNA, 25 bp, Mus musculus
actcccgcggctcggtcagggacag

SEQ ID NO: 225688 - DNA, 25 bp, Mus musculus
gagccggaacccagagaggatccgc

SEQ ID NO: 225689 - DNA, 25 bp, Mus musculus
ggaacccagagaggatccgccttca

SEQ ID NO: 225690 - DNA, 25 bp, Mus musculus
agaggatccgccttcacagcgttcg

SEQ ID NO: 225691 - DNA, 25 bp, Mus musculus
cggcctttgggactcgcaaaacagc

SEQ ID NO: 225692 - DNA, 25 bp, Mus musculus
tacccggcggcctttgggactcgca

SEQ ID NO: 225693 - DNA, 25 bp, Mus musculus
actaggaacgcacagcaaggtgctg

SEQ ID NO: 225694 - DNA, 25 bp, Mus musculus
ggagactcgactaggaacgcacagc

SEQ ID NO: 225695 - DNA, 25 bp, Mus musculus
tcagaagtgaggagactcgactagg

SEQ ID NO: 225696 - DNA, 25 bp, Mus musculus
cccattgtgcaggaaactgagactc

SEQ ID NO: 225697 - DNA, 25 bp, Mus musculus
actgtcccattgtgcaggaaactga

SEQ ID NO: 225698 - DNA, 25 bp, Mus musculus
aatgactactgtcccattgtgcagg

SEQ ID NO: 225699 - DNA, 25 bp, Mus musculus
gggaaatggccaggaaatgactact

SEQ ID NO: 225700 - DNA, 25 bp, Mus musculus
atctgctgctcacccggggttggta

SEQ ID NO: 225701 - DNA, 25 bp, Mus musculus
ttctcatctgctgctcacccggggt

SEQ ID NO: 225702 - DNA, 25 bp, Mus musculus
gctttctcgggccttctcatctgct

SEQ ID NO: 225703 - DNA, 25 bp, Mus musculus
ctcggcctctgagacccggccctac

SEQ ID NO: 225704 - DNA, 25 bp, Mus musculus
gttacttgtaagaatgtccctgccc

SEQ ID NO: 225705 - DNA, 25 bp, Mus musculus
cagaaactagaagcccggaaaagct

SEQ ID NO: 225706 - DNA, 25 bp, Mus musculus
ttctgcctttcaaagccttgcagtt

SEQ ID NO: 225707 - DNA, 25 bp, Mus musculus
gcgtaagttgaaaccctcagccttc

SEQ ID NO: 225708 - DNA, 25 bp, Mus musculus
agggctcctgcgatacacacccgaa

SEQ ID NO: 225709 - DNA, 25 bp, Mus musculus
ctcagccttccgtgagccagcagga

SEQ ID NO: 225710 - DNA, 25 bp, Mus musculus
gggtccgccataacagcacctcggt

SEQ ID NO: 225711 - DNA, 25 bp, Mus musculus
acccgcagggagctcagtctaaagc

SEQ ID NO: 225712 - DNA, 25 bp, Mus musculus
gcggggttttctcgttctcagtcca

SEQ ID NO: 225713 - DNA, 25 bp, Mus musculus
tcagtccattgagctgtgcgcatga

SEQ ID NO: 225714 - DNA, 25 bp, Mus musculus
cgcatgagattagaggcggagcctc

SEQ ID NO: 225715 - DNA, 25 bp, Mus musculus
agtttccttgccacgagcttctgga

SEQ ID NO: 225716 - DNA, 25 bp, Mus musculus
acctgctttacgcagaggggaccgc

SEQ ID NO: 225717 - DNA, 25 bp, Mus musculus
acgacctgcgcttcttcggagccgt

SEQ ID NO: 225718 - DNA, 25 bp, Mus musculus
cttgctgagtgaagaactggacctg

SEQ ID NO: 225719 - DNA, 25 bp, Mus musculus
ctggacctggagttcaacaagcgga

SEQ ID NO: 225720 - DNA, 25 bp, Mus musculus
agcggagcccgtacaactacctgca

SEQ ID NO: 225721 - DNA, 25 bp, Mus musculus
ctccgcatgtagtaaggtgggaacc

SEQ ID NO: 225722 - DNA, 25 bp, Mus musculus
aggtgggaaccttcgcctgcgatag

SEQ ID NO: 225723 - DNA, 25 bp, Mus musculus
cgcatagggtctccgcatgtagtaa

SEQ ID NO: 225724 - DNA, 25 bp, Mus musculus
atagggtctccgcatgtagtaaggt

SEQ ID NO: 225725 - DNA, 25 bp, Mus musculus
tctccgcatgtagtaaggtgggaac

SEQ ID NO: 225726 - DNA, 25 bp, Mus musculus
tccgcatgtagtaaggtgggaacct

SEQ ID NO: 225727 - DNA, 25 bp, Mus musculus
ccgcatgtagtaaggtgggaacctt

SEQ ID NO: 225728 - DNA, 25 bp, Mus musculus
cgcatgtagtaaggtgggaaccttc

SEQ ID NO: 225729 - DNA, 25 bp, Mus musculus
catgtagtaaggtgggaaccttcgc

SEQ ID NO: 225730 - DNA, 25 bp, Mus musculus
tagtaaggtgggaaccttcgcctgc

SEQ ID NO: 225731 - DNA, 25 bp, Mus musculus
agtaaggtgggaaccttcgcctgcg

SEQ ID NO: 225732 - DNA, 25 bp, Mus musculus
gtaaggtgggaaccttcgcctgcga

SEQ ID NO: 225733 - DNA, 25 bp, Mus musculus
aaggtgggaaccttcgcctgcgata

SEQ ID NO: 225734 - DNA, 25 bp, Mus musculus
tagggtctccgcatgtagtaaggtg

SEQ ID NO: 225735 - DNA, 25 bp, Mus musculus
gacgcgcagagggaacgttcccaga

SEQ ID NO: 225736 - DNA, 25 bp, Mus musculus
caccatagagtaccgggaggacgcg

SEQ ID NO: 225737 - DNA, 25 bp, Mus musculus
gaagtcggtccaggatctagccgca

SEQ ID NO: 225738 - DNA, 25 bp, Mus musculus
gctaccgatcgaactagcgagaatg

SEQ ID NO: 225739 - DNA, 25 bp, Mus musculus
atcgaactagcgagaatggcgggac

SEQ ID NO: 225740 - DNA, 25 bp, Mus musculus
acctgaccgggtctctagcgcctat

SEQ ID NO: 225741 - DNA, 25 bp, Mus musculus
ggtctctagcgcctattggctcacg

SEQ ID NO: 225742 - DNA, 25 bp, Mus musculus
ggctcctgcgctctcattggtatct

SEQ ID NO: 225743 - DNA, 25 bp, Mus musculus
ctctcattggtatctttagcgacta

SEQ ID NO: 225744 - DNA, 25 bp, Mus musculus
tttagcgactaattcgcccgaccca

SEQ ID NO: 225745 - DNA, 25 bp, Mus musculus
ccatagagaccggaactagaatgag

SEQ ID NO: 225746 - DNA, 25 bp, Mus musculus
actagaatgagagcctcggccgtga

SEQ ID NO: 225747 - DNA, 25 bp, Mus musculus
cggccgtgagcaccatagagtaccg

SEQ ID NO: 225748 - DNA, 25 bp, Mus musculus
aacgttcccagatggggctgcgctc

SEQ ID NO: 225749 - DNA, 25 bp, Mus musculus
acgcagtggaaacggaccgcgattg

SEQ ID NO: 225750 - DNA, 25 bp, Mus musculus
cgtcttaggcaccacgtctgcaaag

SEQ ID NO: 225751 - DNA, 25 bp, Mus musculus
cacgtctgcaaagagctcgattttc

SEQ ID NO: 225752 - DNA, 25 bp, Mus musculus
gctcgattttcatgcgaccaacttc

SEQ ID NO: 225753 - DNA, 25 bp, Mus musculus
tgcgaccaacttcctgcagaagaaa

SEQ ID NO: 225754 - DNA, 25 bp, Mus musculus
aacgggagacgcaacactcagctca

SEQ ID NO: 225755 - DNA, 25 bp, Mus musculus
cgctgtccacgaagctcgaaagctc

SEQ ID NO: 225756 - DNA, 25 bp, Mus musculus
acctggccgccaatgctgacatcga

SEQ ID NO: 225757 - DNA, 25 bp, Mus musculus
tgctgacatcgaagaagaccactgg

SEQ ID NO: 225758 - DNA, 25 bp, Mus musculus
gaccactggattgactggacttgaa

SEQ ID NO: 225759 - DNA, 25 bp, Mus musculus
ggacttgaatttgccaccgccatgg

SEQ ID NO: 225760 - DNA, 25 bp, Mus musculus
ccgccatggctttgacccggaagta

SEQ ID NO: 225761 - DNA, 25 bp, Mus musculus
gcaggtcccgcgaacttcatccgga

SEQ ID NO: 225762 - DNA, 25 bp, Mus musculus
gaacttcatccggagcgcagacgca

SEQ ID NO: 225763 - DNA, 25 bp, Mus musculus
tgacgaagctagtcccacagtcctt

SEQ ID NO: 225764 - DNA, 25 bp, Mus musculus
tgcaaggttgcgtgtgacgaagcta

SEQ ID NO: 225765 - DNA, 25 bp, Mus musculus
tagtcccacagtcctttcgctcggg

SEQ ID NO: 225766 - DNA, 25 bp, Mus musculus
ccgcgcgcagggcacaacggtgtct

SEQ ID NO: 225767 - DNA, 25 bp, Mus musculus
acaacggtgtctctggggcctttgt

SEQ ID NO: 225768 - DNA, 25 bp, Mus musculus
ggggacggtcaagagcacacttctc

SEQ ID NO: 225769 - DNA, 25 bp, Mus musculus
gagccaaccgttaccgggccgagca

SEQ ID NO: 225770 - DNA, 25 bp, Mus musculus
agcaccgcgcgaaggagctcaccgg

SEQ ID NO: 225771 - DNA, 25 bp, Mus musculus
agctcaccggcgatccgaagagatc

SEQ ID NO: 225772 - DNA, 25 bp, Mus musculus
ccgaagagatctggaatgtgcacca

SEQ ID NO: 225773 - DNA, 25 bp, Mus musculus
tgtgcaccacgggaagagcaggtcc

SEQ ID NO: 225774 - DNA, 25 bp, Mus musculus
tgggattttcctgccagcgcgcaga

SEQ ID NO: 225775 - DNA, 25 bp, Mus musculus
gagcaggggactctcagctccagcc

SEQ ID NO: 225776 - DNA, 25 bp, Mus musculus
agaccatgcacgctttgggtggccc

SEQ ID NO: 225777 - DNA, 25 bp, Mus musculus
gagaggcacgccaaccaataaggga

SEQ ID NO: 225778 - DNA, 25 bp, Mus musculus
aaagtcagggcagcagttctgaggc

SEQ ID NO: 225779 - DNA, 25 bp, Mus musculus
gcactgcagtcaccgagccacttcg

SEQ ID NO: 225780 - DNA, 25 bp, Mus musculus
tacttacccgcgcaaagctgcggct

SEQ ID NO: 225781 - DNA, 25 bp, Mus musculus
caagatcgccatctcgcagcaggcg

SEQ ID NO: 225782 - DNA, 25 bp, Mus musculus
atcgccatctcgcagcaggcgtcgg

SEQ ID NO: 225783 - DNA, 25 bp, Mus musculus
agccactcggatcccgcacgccaag

SEQ ID NO: 225784 - DNA, 25 bp, Mus musculus
tgagcctctggtccagaccgggaat

SEQ ID NO: 225785 - DNA, 25 bp, Mus musculus
agaccgggaatccagctgccctcga

SEQ ID NO: 225786 - DNA, 25 bp, Mus musculus
gggaatccagctgccctcgagcatg

SEQ ID NO: 225787 - DNA, 25 bp, Mus musculus
cactccgctcctccgggtcttccag

SEQ ID NO: 225788 - DNA, 25 bp, Mus musculus
gtcaggcggagaggcacgccaacca

SEQ ID NO: 225789 - DNA, 25 bp, Mus musculus
aaaaggacgttctgaggctggcgtc

SEQ ID NO: 225790 - DNA, 25 bp, Mus musculus
cgccaaccaataagggagaggaggt

SEQ ID NO: 225791 - DNA, 25 bp, Mus musculus
gagcgcattctcttcggcctccaga

SEQ ID NO: 225792 - DNA, 25 bp, Mus musculus
tgacacctcagccttgcggatgcta

SEQ ID NO: 225793 - DNA, 25 bp, Mus musculus
ctcgggctacatggcagtcaagttc

SEQ ID NO: 225794 - DNA, 25 bp, Mus musculus
tctcgctaaggctcgaaatgcttgc

SEQ ID NO: 225795 - DNA, 25 bp, Mus musculus
ccgccagtaggtcctgatctcgcta

SEQ ID NO: 225796 - DNA, 25 bp, Mus musculus
attccctttcctatgtccgccagta

SEQ ID NO: 225797 - DNA, 25 bp, Mus musculus
gcgcgcagccgcaaatagtgactat

SEQ ID NO: 225798 - DNA, 25 bp, Mus musculus
atttccgccatctgcactgtagtca

SEQ ID NO: 225799 - DNA, 25 bp, Mus musculus
ggcaactcagccaccaggtccattt

SEQ ID NO: 225800 - DNA, 25 bp, Mus musculus
accttggtgcctccagatgtgatca

SEQ ID NO: 225801 - DNA, 25 bp, Mus musculus
aagttgtccagaaagcgcacggctc

SEQ ID NO: 225802 - DNA, 25 bp, Mus musculus
cgtcgcccgctactgaagttgtcca

SEQ ID NO: 225803 - DNA, 25 bp, Mus musculus
ccggccgcaccatgaacgtgatcta

SEQ ID NO: 225804 - DNA, 25 bp, Mus musculus
cgcgctcggtacaagaacaggactc

SEQ ID NO: 225805 - DNA, 25 bp, Mus musculus
tcctgctccgagcagcgctggcgga

SEQ ID NO: 225806 - DNA, 25 bp, Mus musculus
ccgccgacgacggtgacggcgatct

SEQ ID NO: 225807 - DNA, 25 bp, Mus musculus
tgacggcgatctggtccaggaacac

SEQ ID NO: 225808 - DNA, 25 bp, Mus musculus
tctggtccaggaacaccgcccggaa

SEQ ID NO: 225809 - DNA, 25 bp, Mus musculus
caggatctgcacctgcgggtagtcc

SEQ ID NO: 225810 - DNA, 25 bp, Mus musculus
tcctcgcggatgagccggtcggtca

SEQ ID NO: 225811 - DNA, 25 bp, Mus musculus
ggtcggtcagcagccagacctgcgc

SEQ ID NO: 225812 - DNA, 25 bp, Mus musculus
agcagccagacctgcgcgcacatgg

SEQ ID NO: 225813 - DNA, 25 bp, Mus musculus
cgcacatggcgaccgaagctgcggc

SEQ ID NO: 225814 - DNA, 25 bp, Mus musculus
agcaccgcggctttgcttgcgccgt

SEQ ID NO: 225815 - DNA, 25 bp, Mus musculus
gacccggccggcgaatgctccggat

SEQ ID NO: 225816 - DNA, 25 bp, Mus musculus
cccgggaaccgatgggccactggct

SEQ ID NO: 225817 - DNA, 25 bp, Mus musculus
ctgagctcacctaggtggccgccga

SEQ ID NO: 225818 - DNA, 25 bp, Mus musculus
acctgcgggtagtcctcgcggatga

SEQ ID NO: 225819 - DNA, 25 bp, Mus musculus
gtggccgcctcctcactgatgacca

SEQ ID NO: 225820 - DNA, 25 bp, Mus musculus
atgaccacgcccttgtcctcctcgg

SEQ ID NO: 225821 - DNA, 25 bp, Mus musculus
cagtgggctgctcggcaggcaagat

SEQ ID NO: 225822 - DNA, 25 bp, Mus musculus
gcggccagctcctctatcttggggt

SEQ ID NO: 225823 - DNA, 25 bp, Mus musculus
ctctatcttggggtgctcatcgtcc

SEQ ID NO: 225824 - DNA, 25 bp, Mus musculus
ctatcttggggtgctcatcgtccac

SEQ ID NO: 225825 - DNA, 25 bp, Mus musculus
gtgctcatcgtccacgagcccgttg

SEQ ID NO: 225826 - DNA, 25 bp, Mus musculus
catcgtccacgagcccgttgtcggt

SEQ ID NO: 225827 - DNA, 25 bp, Mus musculus
cacgagcccgttgtcggtctcccag

SEQ ID NO: 225828 - DNA, 25 bp, Mus musculus
ccagctgtcgctgtcgtcctcccac

SEQ ID NO: 225829 - DNA, 25 bp, Mus musculus
tgtcgtcctcccactcatccgagga

SEQ ID NO: 225830 - DNA, 25 bp, Mus musculus
actcatccgaggaggccccactgga

SEQ ID NO: 225831 - DNA, 25 bp, Mus musculus
cttggggtgctcatcgtccacgagc

SEQ ID NO: 225832 - DNA, 25 bp, Mus musculus
ccctggatggcagccgtggccgcct

SEQ ID NO: 225833 - DNA, 25 bp, Mus musculus
cacttgaccatcacgtcctgggaga

SEQ ID NO: 225834 - DNA, 25 bp, Mus musculus
gcacttgaccatcacgtcctgggag

SEQ ID NO: 225835 - DNA, 25 bp, Mus musculus
cgcaaggagagctacgtgtacgcgt

SEQ ID NO: 225836 - DNA, 25 bp, Mus musculus
gcaaggagagctacgtgtacgcgta

SEQ ID NO: 225837 - DNA, 25 bp, Mus musculus
aaggagagctacgtgtacgcgtaca

SEQ ID NO: 225838 - DNA, 25 bp, Mus musculus
aggagagctacgtgtacgcgtacaa

SEQ ID NO: 225839 - DNA, 25 bp, Mus musculus
gagagctacgtgtacgcgtacaagg

SEQ ID NO: 225840 - DNA, 25 bp, Mus musculus
gagctacgtgtacgcgtacaaggtg

SEQ ID NO: 225841 - DNA, 25 bp, Mus musculus
ctacgtgtacgcgtacaaggtgctg

SEQ ID NO: 225842 - DNA, 25 bp, Mus musculus
acgtgtacgcgtacaaggtgctgaa

SEQ ID NO: 225843 - DNA, 25 bp, Mus musculus
acaagcacttgaccatcacgtcctg

SEQ ID NO: 225844 - DNA, 25 bp, Mus musculus
aagcacttgaccatcacgtcctggg

SEQ ID NO: 225845 - DNA, 25 bp, Mus musculus
agcacttgaccatcacgtcctggga

SEQ ID NO: 225846 - DNA, 25 bp, Mus musculus
acttgaccatcacgtcctgggagat

SEQ ID NO: 225847 - DNA, 25 bp, Mus musculus
gggctcgtcctgttcccggcgcgat

SEQ ID NO: 225848 - DNA, 25 bp, Mus musculus
tcacgaggcgcattcctcaggagtt

SEQ ID NO: 225849 - DNA, 25 bp, Mus musculus
cctcaggagttggaatcccgggagt

SEQ ID NO: 225850 - DNA, 25 bp, Mus musculus
tcggccagccgctgtcaagtccgag

SEQ ID NO: 225851 - DNA, 25 bp, Mus musculus
tgtcaagtccgaggcgcaaacactg

SEQ ID NO: 225852 - DNA, 25 bp, Mus musculus
ggcgcaaacactgcaaggcgctccg

SEQ ID NO: 225853 - DNA, 25 bp, Mus musculus
tcccgctggccgcaagcaggcagag

SEQ ID NO: 225854 - DNA, 25 bp, Mus musculus
ggagctcagaggcactacttgtccc

SEQ ID NO: 225855 - DNA, 25 bp, Mus musculus
ggagggatccctcgcacatcgcgca

SEQ ID NO: 225856 - DNA, 25 bp, Mus musculus
cacatcgcgcagcaacgacggggcg

SEQ ID NO: 225857 - DNA, 25 bp, Mus musculus
tctgagggcgccgttgggacctttc

SEQ ID NO: 225858 - DNA, 25 bp, Mus musculus
cctgcgtagcctgaggtgagcacgc

SEQ ID NO: 225859 - DNA, 25 bp, Mus musculus
agcacgcgtcgccagggtctcgtcg

SEQ ID NO: 225860 - DNA, 25 bp, Mus musculus
tgacctgcacctggtccgggctcgt

SEQ ID NO: 225861 - DNA, 25 bp, Mus musculus
cactggtttacgctctgccctctga

SEQ ID NO: 225862 - DNA, 25 bp, Mus musculus
ttattgtggacatttagacgcggtg

SEQ ID NO: 225863 - DNA, 25 bp, Mus musculus
cgatcgctgcgtagcgtgggtctca

SEQ ID NO: 225864 - DNA, 25 bp, Mus musculus
gtggctcgggtccagaagtcctgct

SEQ ID NO: 225865 - DNA, 25 bp, Mus musculus
agctgagccctcagggatgcgcctt

SEQ ID NO: 225866 - DNA, 25 bp, Mus musculus
aagtttgttgacatcggtgcgccgc

SEQ ID NO: 225867 - DNA, 25 bp, Mus musculus
cagatttcggagacccggcgcaacc

SEQ ID NO: 225868 - DNA, 25 bp, Mus musculus
cccgtgttgcactcgtggacagatt

SEQ ID NO: 225869 - DNA, 25 bp, Mus musculus
ctggggaccagttgtccgcgtccta

SEQ ID NO: 225870 - DNA, 25 bp, Mus musculus
gcctctggagcaacctcagcggagc

SEQ ID NO: 225871 - DNA, 25 bp, Mus musculus
ctcggcgctgtggactgagcttgac

SEQ ID NO: 225872 - DNA, 25 bp, Mus musculus
tgagcatccgcgcaagcgcggcttt

SEQ ID NO: 225873 - DNA, 25 bp, Mus musculus
cgtcaagaccgctagcactggttta

SEQ ID NO: 225874 - DNA, 25 bp, Mus musculus
cgtctcccaggccaatcgaaagcga

SEQ ID NO: 225875 - DNA, 25 bp, Mus musculus
ttgtcgctgcctttctcacgccagg

SEQ ID NO: 225876 - DNA, 25 bp, Mus musculus
ggattccattttgtcgctgcctttc

SEQ ID NO: 225877 - DNA, 25 bp, Mus musculus
cccgcgcgtcaatcactcgcagccg

SEQ ID NO: 225878 - DNA, 25 bp, Mus musculus
ggggagcgcgaacctcaagtgaccc

SEQ ID NO: 225879 - DNA, 25 bp, Mus musculus
ctgcctttctcacgccaggtgtctg

SEQ ID NO: 225880 - DNA, 25 bp, Mus musculus
ttctcacgccaggtgtctgggtggc

SEQ ID NO: 225881 - DNA, 25 bp, Mus musculus
cggatggattccttgcgctttattt

SEQ ID NO: 225882 - DNA, 25 bp, Mus musculus
gcgctttatttttccctgattgtgt

SEQ ID NO: 225883 - DNA, 25 bp, Mus musculus
ccctgattgtgttttctcccgcggc

SEQ ID NO: 225884 - DNA, 25 bp, Mus musculus
attgtgttttctcccgcggccgcca

SEQ ID NO: 225885 - DNA, 25 bp, Mus musculus
cgccaccgggaagtgccacagtgct

SEQ ID NO: 225886 - DNA, 25 bp, Mus musculus
gtgccacagtgctgggattccattt

SEQ ID NO: 225887 - DNA, 25 bp, Mus musculus
cacagtgctgggattccattttgtc

SEQ ID NO: 225888 - DNA, 25 bp, Mus musculus
gctgggattccattttgtcgctgcc

SEQ ID NO: 225889 - DNA, 25 bp, Mus musculus
gcgcggcggtcctagcttcccggat

SEQ ID NO: 225890 - DNA, 25 bp, Mus musculus
tgtgcggattctcgtcccttctcag

SEQ ID NO: 225891 - DNA, 25 bp, Mus musculus
actccagggtcctgtgcggattctc

SEQ ID NO: 225892 - DNA, 25 bp, Mus musculus
ccattcgcccttgggtgcgcagact

SEQ ID NO: 225893 - DNA, 25 bp, Mus musculus
ctagggtgacgagcgttcccgcgcc

SEQ ID NO: 225894 - DNA, 25 bp, Mus musculus
catcatcctagggtgacgagcgttc

SEQ ID NO: 225895 - DNA, 25 bp, Mus musculus
acgctacttcagtcatcatcctagg

SEQ ID NO: 225896 - DNA, 25 bp, Mus musculus
tcgcgttttcccaacgctacttcag

SEQ ID NO: 225897 - DNA, 25 bp, Mus musculus
tgcacgcgctctgcgctcgcgtttt

SEQ ID NO: 225898 - DNA, 25 bp, Mus musculus
cctagcttcccggatcccttgggtg

SEQ ID NO: 225899 - DNA, 25 bp, Mus musculus
ggtaagcacggagcacggaacaccc

SEQ ID NO: 225900 - DNA, 25 bp, Mus musculus
ccgcaggtaagcacggagcacggaa

SEQ ID NO: 225901 - DNA, 25 bp, Mus musculus
cagccagcccgaagcgcagagccca

SEQ ID NO: 225902 - DNA, 25 bp, Mus musculus
cggatcccttgggtgcgagcagccc

SEQ ID NO: 225903 - DNA, 25 bp, Mus musculus
acgaggtttcccaacgcgcacatcg

SEQ ID NO: 225904 - DNA, 25 bp, Mus musculus
agcacgaggtttcccaacgcgcaca

SEQ ID NO: 225905 - DNA, 25 bp, Mus musculus
gcaaagccatgctcgctggaccgct

SEQ ID NO: 225906 - DNA, 25 bp, Mus musculus
tgcagcctcccggtgatgtcaggcc

SEQ ID NO: 225907 - DNA, 25 bp, Mus musculus
cacgttcgtccgctggcaagccggg

SEQ ID NO: 225908 - DNA, 25 bp, Mus musculus
ggcaagccgggaacaaagcgtcctc

SEQ ID NO: 225909 - DNA, 25 bp, Mus musculus
gaacaaagcgtcctccgcattcctg

SEQ ID NO: 225910 - DNA, 25 bp, Mus musculus
cgcattcctgcgagctgactcacgg

SEQ ID NO: 225911 - DNA, 25 bp, Mus musculus
cgagctgactcacggccgtcacgta

SEQ ID NO: 225912 - DNA, 25 bp, Mus musculus
tgactcacggccgtcacgtagcgcg

SEQ ID NO: 225913 - DNA, 25 bp, Mus musculus
ccgcgcggctttgcccaaaattggt

SEQ ID NO: 225914 - DNA, 25 bp, Mus musculus
ggccgagcaccacagctgccaccta

SEQ ID NO: 225915 - DNA, 25 bp, Mus musculus
tactcgcaaagccatgctcgctgga

SEQ ID NO: 225916 - DNA, 25 bp, Mus musculus
gcccaaaattggtggcaaggcaagg

SEQ ID NO: 225917 - DNA, 25 bp, Mus musculus
cccttgatgcgcaggaacttggccc

SEQ ID NO: 225918 - DNA, 25 bp, Mus musculus
ggctcccgctaaacatgtcgaggtc

SEQ ID NO: 225919 - DNA, 25 bp, Mus musculus
taaacatgtcgaggtccagatccgc

SEQ ID NO: 225920 - DNA, 25 bp, Mus musculus
tagggcccgggcagcgcatccagca

SEQ ID NO: 225921 - DNA, 25 bp, Mus musculus
cgccgggcagcgtcataaggctgat

SEQ ID NO: 225922 - DNA, 25 bp, Mus musculus
gccgtaggcgctcgccttgcagctg

SEQ ID NO: 225923 - DNA, 25 bp, Mus musculus
tcgccttgcagctgccgaagtagga

SEQ ID NO: 225924 - DNA, 25 bp, Mus musculus
cttgcccttgatgcgcaggaacttg

SEQ ID NO: 225925 - DNA, 25 bp, Mus musculus
cggaagtcagcccacgcctcgtagt

SEQ ID NO: 225926 - DNA, 25 bp, Mus musculus
acgcctcgtagtcgtcactggcatg

SEQ ID NO: 225927 - DNA, 25 bp, Mus musculus
cgtagtcgtcactggcatgtgaggc

SEQ ID NO: 225928 - DNA, 25 bp, Mus musculus
tccgttccggcaggtgcagctgctt

SEQ ID NO: 225929 - DNA, 25 bp, Mus musculus
attgtccatggacacggcccggcgc

SEQ ID NO: 225930 - DNA, 25 bp, Mus musculus
cttcttgctcgccttgcccttgatg

SEQ ID NO: 225931 - DNA, 25 bp, Mus musculus
gcgagttaaaaataaccgtctcatc

SEQ ID NO: 225932 - DNA, 25 bp, Mus musculus
tggcacgggctcgtgcccaggaggc

SEQ ID NO: 225933 - DNA, 25 bp, Mus musculus
cgccgttcattaccttaacgcgagt

SEQ ID NO: 225934 - DNA, 25 bp, Mus musculus
ttagtctgtctgcaattaccgcctg

SEQ ID NO: 225935 - DNA, 25 bp, Mus musculus
gtctgtctgcaattaccgcctggca

SEQ ID NO: 225936 - DNA, 25 bp, Mus musculus
tgtctgcaattaccgcctggcacgg

SEQ ID NO: 225937 - DNA, 25 bp, Mus musculus
tgcaattaccgcctggcacggcgct

SEQ ID NO: 225938 - DNA, 25 bp, Mus musculus
ctgcccgccatcgtcccgctggagc

SEQ ID NO: 225939 - DNA, 25 bp, Mus musculus
ggccctcaccctgtctgtcggtctg

SEQ ID NO: 225940 - DNA, 25 bp, Mus musculus
cctgggtcgcatagggccggtctag

SEQ ID NO: 225941 - DNA, 25 bp, Mus musculus
agtctgccgggcgtgccagcaactg

SEQ ID NO: 225942 - DNA, 25 bp, Mus musculus
tgccagcaactgtgccaggagcggc

SEQ ID NO: 225943 - DNA, 25 bp, Mus musculus
caactgtgccaggagcggctggcac

SEQ ID NO: 225944 - DNA, 25 bp, Mus musculus
cgcgccgttcattaccttaacgcga

SEQ ID NO: 225945 - DNA, 25 bp, Mus musculus
gagctcttcgctttccgcaagggtc

SEQ ID NO: 225946 - DNA, 25 bp, Mus musculus
cagcttctagcacctgccgcctgtc

SEQ ID NO: 225947 - DNA, 25 bp, Mus musculus
ccctagggagcaggcgagaaacgtc

SEQ ID NO: 225948 - DNA, 25 bp, Mus musculus
gtggagctcccgctaagggcgaccc

SEQ ID NO: 225949 - DNA, 25 bp, Mus musculus
aatccttgcttactgggtgccccgc

SEQ ID NO: 225950 - DNA, 25 bp, Mus musculus
ggctggcttgcaccatgccggagcc

SEQ ID NO: 225951 - DNA, 25 bp, Mus musculus
ccgggacgaggctggcttgcaccat

SEQ ID NO: 225952 - DNA, 25 bp, Mus musculus
aagtccgggtccacgtccacctgat

SEQ ID NO: 225953 - DNA, 25 bp, Mus musculus
ctctgcggcgcgaagtccgggtcca

SEQ ID NO: 225954 - DNA, 25 bp, Mus musculus
gcagtcctcggaaccctcggctact

SEQ ID NO: 225955 - DNA, 25 bp, Mus musculus
cacgcgttccgtcgggagctcttcg

SEQ ID NO: 225956 - DNA, 25 bp, Mus musculus
tttccgcaagggtccgacctctgcg

SEQ ID NO: 225957 - DNA, 25 bp, Mus musculus
atcgctggggccgtcgccctgcgtt

SEQ ID NO: 225958 - DNA, 25 bp, Mus musculus
acctgatgcgctcgcagcttcgcag

SEQ ID NO: 225959 - DNA, 25 bp, Mus musculus
atccgaaccgattcgagaggcgcta

SEQ ID NO: 225960 - DNA, 25 bp, Mus musculus
cgggcgctaacccaggaaggagcca

SEQ ID NO: 225961 - DNA, 25 bp, Mus musculus
ctatgaacagcaacaaccggacgga

SEQ ID NO: 225962 - DNA, 25 bp, Mus musculus
cggctggcagcgctatgaacagcaa

SEQ ID NO: 225963 - DNA, 25 bp, Mus musculus
gtggtcagccatcccgcggctggca

SEQ ID NO: 225964 - DNA, 25 bp, Mus musculus
actctcggctgtccacctgcgggag

SEQ ID NO: 225965 - DNA, 25 bp, Mus musculus
gaccacactttcaaggacgcctgca

SEQ ID NO: 225966 - DNA, 25 bp, Mus musculus
ggccgcagtcttgaccacactttca

SEQ ID NO: 225967 - DNA, 25 bp, Mus musculus
agaggcgctaggaaactcaagttcg

SEQ ID NO: 225968 - DNA, 25 bp, Mus musculus
aacctggcaggatccgaaccgattc

SEQ ID NO: 225969 - DNA, 25 bp, Mus musculus
cgatcacgcattttcgacagcaaaa

SEQ ID NO: 225970 - DNA, 25 bp, Mus musculus
gaccgaagtcactagcgatcacgca

SEQ ID NO: 225971 - DNA, 25 bp, Mus musculus
ggagccattacaaacgaccgaagtc

SEQ ID NO: 225972 - DNA, 25 bp, Mus musculus
aaactcaagttcgatggccgcagtc

SEQ ID NO: 225973 - DNA, 25 bp, Mus musculus
tgcagcacggacctcctttagcggt

SEQ ID NO: 225974 - DNA, 25 bp, Mus musculus
gtaagcaaaaaacgccgcactagtg

SEQ ID NO: 225975 - DNA, 25 bp, Mus musculus
gccgcactagtgtaacgccgaacgc

SEQ ID NO: 225976 - DNA, 25 bp, Mus musculus
cttggtctccttcacatgctgcttg

SEQ ID NO: 225977 - DNA, 25 bp, Mus musculus
acatgctgcttgacgccctccgggt

SEQ ID NO: 225978 - DNA, 25 bp, Mus musculus
ggtaccactggacgcgcacgtagcc

SEQ ID NO: 225979 - DNA, 25 bp, Mus musculus
atgaggcgtaccagcccgaagtgca

SEQ ID NO: 225980 - DNA, 25 bp, Mus musculus
ccgaagtgcaccgagccgcggtaac

SEQ ID NO: 225981 - DNA, 25 bp, Mus musculus
gagccgcggtaacggccggacacca

SEQ ID NO: 225982 - DNA, 25 bp, Mus musculus
gacaccaggtcgtgggagaacagca

SEQ ID NO: 225983 - DNA, 25 bp, Mus musculus
tgcgggatccgccataactgctctg

SEQ ID NO: 225984 - DNA, 25 bp, Mus musculus
cataactgctctgcgcgagtctcgg

SEQ ID NO: 225985 - DNA, 25 bp, Mus musculus
tcctcgccgtggatgaggcgtacca

SEQ ID NO: 225986 - DNA, 25 bp, Mus musculus
ttcccttcggaaagcacaatgcagc

SEQ ID NO: 225987 - DNA, 25 bp, Mus musculus
acgcgtcgccagagagattcgcctg

SEQ ID NO: 225988 - DNA, 25 bp, Mus musculus
ggattcgaacctgggacctcagagg

SEQ ID NO: 225989 - DNA, 25 bp, Mus musculus
gacctcagaggacgtcattcacttg

SEQ ID NO: 225990 - DNA, 25 bp, Mus musculus
tcattcacttgtctgggagacgcga

SEQ ID NO: 225991 - DNA, 25 bp, Mus musculus
tctgggagacgcgagcaatccagtg

SEQ ID NO: 225992 - DNA, 25 bp, Mus musculus
caatccagtgggtcgcggctttttt

SEQ ID NO: 225993 - DNA, 25 bp, Mus musculus
ggcggccgtgtcaacccggccagaa

SEQ ID NO: 225994 - DNA, 25 bp, Mus musculus
acacagtgggcttggagctttcttc

SEQ ID NO: 225995 - DNA, 25 bp, Mus musculus
cttggagctttcttcaggggtcccg

SEQ ID NO: 225996 - DNA, 25 bp, Mus musculus
gagactcacttgtgtcacctgcctg

SEQ ID NO: 225997 - DNA, 25 bp, Mus musculus
tcacctgcctggagccgggcaaaca

SEQ ID NO: 225998 - DNA, 25 bp, Mus musculus
cacccggcggctacagaaggtttcg

SEQ ID NO: 225999 - DNA, 25 bp, Mus musculus
gaaggtttcgaacctgagacaggga

SEQ ID NO: 226000 - DNA, 25 bp, Mus musculus
tcgctccctgcgcagcggaaacatg

SEQ ID NO: 226001 - DNA, 25 bp, Mus musculus
cacgctgacgtagtggcctcaagaa

SEQ ID NO: 226002 - DNA, 25 bp, Mus musculus
ccgcaatagccggtggacactctca

SEQ ID NO: 226003 - DNA, 25 bp, Mus musculus
gggcctttgcctggtcccgcaatag

SEQ ID NO: 226004 - DNA, 25 bp, Mus musculus
tgactcgcatctaaccggaaccctg

SEQ ID NO: 226005 - DNA, 25 bp, Mus musculus
cctcgcccgaggtctagaggatgct

SEQ ID NO: 226006 - DNA, 25 bp, Mus musculus
cgccgcagcttgttgagtggctact

SEQ ID NO: 226007 - DNA, 25 bp, Mus musculus
atgcgccagccgtctttctgagagg

SEQ ID NO: 226008 - DNA, 25 bp, Mus musculus
cttcggagtctcgtgtcagccacag

SEQ ID NO: 226009 - DNA, 25 bp, Mus musculus
cgggatccctgaagtctgcctacct

SEQ ID NO: 226010 - DNA, 25 bp, Mus musculus
ccctgattggtgagaagagacgttt

SEQ ID NO: 226011 - DNA, 25 bp, Mus musculus
ctcccgttagagatgcagcccattg

SEQ ID NO: 226012 - DNA, 25 bp, Mus musculus
gccgtgaggcccagcgaacctacaa

SEQ ID NO: 226013 - DNA, 25 bp, Mus musculus
tggcctcaagaacgccagcatcttc

SEQ ID NO: 226014 - DNA, 25 bp, Mus musculus
tgcgggccaaatcatctcgtgctct

SEQ ID NO: 226015 - DNA, 25 bp, Mus musculus
gctcccgcctggctaatgactgggc

SEQ ID NO: 226016 - DNA, 25 bp, Mus musculus
cggagccgcgcaattaccctaatta

SEQ ID NO: 226017 - DNA, 25 bp, Mus musculus
gagccgcgcaattaccctaattaca

SEQ ID NO: 226018 - DNA, 25 bp, Mus musculus
gcgcaattaccctaattacagcctg

SEQ ID NO: 226019 - DNA, 25 bp, Mus musculus
attaccctaattacagcctggcctc

SEQ ID NO: 226020 - DNA, 25 bp, Mus musculus
ggagcgtgggaacctccgtgccctc

SEQ ID NO: 226021 - DNA, 25 bp, Mus musculus
gccctgatgcgcgataagcccgccc

SEQ ID NO: 226022 - DNA, 25 bp, Mus musculus
gcggagccgcgcaattaccctaatt

SEQ ID NO: 226023 - DNA, 25 bp, Mus musculus
ccgcctggctaatgactgggccgct

SEQ ID NO: 226024 - DNA, 25 bp, Mus musculus
cctggctaatgactgggccgctctg

SEQ ID NO: 226025 - DNA, 25 bp, Mus musculus
actgggccgctctgagcacgcggcc

SEQ ID NO: 226026 - DNA, 25 bp, Mus musculus
cccaaattgtcaggcgaagccgagt

SEQ ID NO: 226027 - DNA, 25 bp, Mus musculus
ttgtcaggcgaagccgagtggctac

SEQ ID NO: 226028 - DNA, 25 bp, Mus musculus
ggaggccctgatgcgcgataagccc

SEQ ID NO: 226029 - DNA, 25 bp, Mus musculus
tggcgttcccgcctcttggtataaa

SEQ ID NO: 226030 - DNA, 25 bp, Mus musculus
tccggacttcaaggcactgcgcgaa

SEQ ID NO: 226031 - DNA, 25 bp, Mus musculus
ctgggaacccttgggctgtctgttt

SEQ ID NO: 226032 - DNA, 25 bp, Mus musculus
tttgcggcctgcaactactgctgtg

SEQ ID NO: 226033 - DNA, 25 bp, Mus musculus
agacccgggtgagacagtgaacgaa

SEQ ID NO: 226034 - DNA, 25 bp, Mus musculus
tccgatttattcttcctctgcctgg

SEQ ID NO: 226035 - DNA, 25 bp, Mus musculus
tgactgtccgccagctgctatggcc

SEQ ID NO: 226036 - DNA, 25 bp, Mus musculus
tgctatggccgaccacctgatgctc

SEQ ID NO: 226037 - DNA, 25 bp, Mus musculus
gagggctactgcctgctacaggtgc

SEQ ID NO: 226038 - DNA, 25 bp, Mus musculus
gctgcatggacaccgagctcatcga

SEQ ID NO: 226039 - DNA, 25 bp, Mus musculus
gctcatcgacgaagaggcgctgacg

SEQ ID NO: 226040 - DNA, 25 bp, Mus musculus
cggccagagcgagttcgattgcttc

SEQ ID NO: 226041 - DNA, 25 bp, Mus musculus
cgattgcttctcagacctggggtca

SEQ ID NO: 226042 - DNA, 25 bp, Mus musculus
ttttcgtgccgagacggctccagcc

SEQ ID NO: 226043 - DNA, 25 bp, Mus musculus
gacagagatgtcctcgtggtctaca

SEQ ID NO: 226044 - DNA, 25 bp, Mus musculus
ccagcagcagatccaacttatgttc

SEQ ID NO: 226045 - DNA, 25 bp, Mus musculus
cggaggcagcgcgagtagaagccca

SEQ ID NO: 226046 - DNA, 25 bp, Mus musculus
tatgttcgatggactgcacctggtg

SEQ ID NO: 226047 - DNA, 25 bp, Mus musculus
agcggcacttgcacagtgcccaggc

SEQ ID NO: 226048 - DNA, 25 bp, Mus musculus
tgagaggtgatgctggaccccaaga

SEQ ID NO: 226049 - DNA, 25 bp, Mus musculus
ggtctacagggctgtggtagtccga

SEQ ID NO: 226050 - DNA, 25 bp, Mus musculus
tctgtgcggagacagagatgtcctc

SEQ ID NO: 226051 - DNA, 25 bp, Mus musculus
caacttatgttcgatggactgcacc

SEQ ID NO: 226052 - DNA, 25 bp, Mus musculus
gtcgaagagcggcacttgcacagtg

SEQ ID NO: 226053 - DNA, 25 bp, Mus musculus
gcgggactagatatggggacgagac

SEQ ID NO: 226054 - DNA, 25 bp, Mus musculus
cctaaggaagacagttggcctgggc

SEQ ID NO: 226055 - DNA, 25 bp, Mus musculus
agtccgaggtgatgtcggggtcgaa

SEQ ID NO: 226056 - DNA, 25 bp, Mus musculus
cccaggctggccgaggtgccagagc

SEQ ID NO: 226057 - DNA, 25 bp, Mus musculus
ccagatcccggcctgggcgaggcat

SEQ ID NO: 226058 - DNA, 25 bp, Mus musculus
aggccggctttctaccacaaggaat

SEQ ID NO: 226059 - DNA, 25 bp, Mus musculus
cggctttctaccacaaggaattcta

SEQ ID NO: 226060 - DNA, 25 bp, Mus musculus
cacaaggaattctaccggttctaag

SEQ ID NO: 226061 - DNA, 25 bp, Mus musculus
ccaaaaaggccgacagagcgaggga

SEQ ID NO: 226062 - DNA, 25 bp, Mus musculus
ttctaaggtgcgagccaccagaccc

SEQ ID NO: 226063 - DNA, 25 bp, Mus musculus
cggggctttgccactgcaaactcca

SEQ ID NO: 226064 - DNA, 25 bp, Mus musculus
attaacaattgaaaatgctgcggcc

SEQ ID NO: 226065 - DNA, 25 bp, Mus musculus
caattgaaaatgctgcggcctgaaa

SEQ ID NO: 226066 - DNA, 25 bp, Mus musculus
aatgctgcggcctgaaaggcgagca

SEQ ID NO: 226067 - DNA, 25 bp, Mus musculus
gccaagcggaaagtgtgaaggtgct

SEQ ID NO: 226068 - DNA, 25 bp, Mus musculus
aaggtgctgccgcgtcaccgaggcc

SEQ ID NO: 226069 - DNA, 25 bp, Mus musculus
ggcggagagagtgcattcaacaccc

SEQ ID NO: 226070 - DNA, 25 bp, Mus musculus
taccggttctaaggtgcgagccacc

SEQ ID NO: 226071 - DNA, 25 bp, Mus musculus
acccagttctgcaggcggcggtagc

SEQ ID NO: 226072 - DNA, 25 bp, Mus musculus
tgaagacgtggtagacgaaggccca

SEQ ID NO: 226073 - DNA, 25 bp, Mus musculus
ctccagcacgttgtagacccagttc

SEQ ID NO: 226074 - DNA, 25 bp, Mus musculus
ttgtagacccagttctgcaggcggc

SEQ ID NO: 226075 - DNA, 25 bp, Mus musculus
ctgttcactctgcacggccgtgagc

SEQ ID NO: 226076 - DNA, 25 bp, Mus musculus
gcggctcagagtcgcatggctcgaa

SEQ ID NO: 226077 - DNA, 25 bp, Mus musculus
gctcagagtcgcatggctcgaaccc

SEQ ID NO: 226078 - DNA, 25 bp, Mus musculus
tggggcggctctttccgactccaac

SEQ ID NO: 226079 - DNA, 25 bp, Mus musculus
ttccgactccaactctcttattacg

SEQ ID NO: 226080 - DNA, 25 bp, Mus musculus
aactctcttattacgcgctccatgc

SEQ ID NO: 226081 - DNA, 25 bp, Mus musculus
atgccgctcgcctttccacctgccg

SEQ ID NO: 226082 - DNA, 25 bp, Mus musculus
ggcgcgccgctcacatgtcaccctc

SEQ ID NO: 226083 - DNA, 25 bp, Mus musculus
gggctccaacttacatgaagacgtg

SEQ ID NO: 226084 - DNA, 25 bp, Mus musculus
cgtgagcgccaccaactccgcgcgg

SEQ ID NO: 226085 - DNA, 25 bp, Mus musculus
ccacgctggcattagagggaccgtc

SEQ ID NO: 226086 - DNA, 25 bp, Mus musculus
cgcgagaattgtcttgcctggccaa

SEQ ID NO: 226087 - DNA, 25 bp, Mus musculus
tcccagcaacgcgtagtgcgcagcg

SEQ ID NO: 226088 - DNA, 25 bp, Mus musculus
agcgtgcgtcacgaaaaaccggagc

SEQ ID NO: 226089 - DNA, 25 bp, Mus musculus
ctgctgcgccgtcgggcaatgcaga

SEQ ID NO: 226090 - DNA, 25 bp, Mus musculus
tctactccggcgtccagcgaagaaa

SEQ ID NO: 226091 - DNA, 25 bp, Mus musculus
gctttcatacactcacaggcctcta

SEQ ID NO: 226092 - DNA, 25 bp, Mus musculus
agctctccgccattggcgggaagca

SEQ ID NO: 226093 - DNA, 25 bp, Mus musculus
gggcccggcgaacacataacatggc

SEQ ID NO: 226094 - DNA, 25 bp, Mus musculus
gtcgccttccgccaatgggagaaag

SEQ ID NO: 226095 - DNA, 25 bp, Mus musculus
caataaggtgccaggtccgcggcct

SEQ ID NO: 226096 - DNA, 25 bp, Mus musculus
agccggcgtgaccaataaggtgcca

SEQ ID NO: 226097 - DNA, 25 bp, Mus musculus
ggaggcgtttctcggtgacctccga

SEQ ID NO: 226098 - DNA, 25 bp, Mus musculus
agcctgagcagctagcatcccgaca

SEQ ID NO: 226099 - DNA, 25 bp, Mus musculus
tgcggcgccactccgccagcggaat

SEQ ID NO: 226100 - DNA, 25 bp, Mus musculus
cgccgagcgctacgtagggatgtat

SEQ ID NO: 226101 - DNA, 25 bp, Mus musculus
gcgctacgtagggatgtatgccaga

SEQ ID NO: 226102 - DNA, 25 bp, Mus musculus
tcccgccagccgtggcttgggcttt

SEQ ID NO: 226103 - DNA, 25 bp, Mus musculus
ctcggggtaagtcagcaggccttgc

SEQ ID NO: 226104 - DNA, 25 bp, Mus musculus
cccacctcggggtaagtcagcaggc

SEQ ID NO: 226105 - DNA, 25 bp, Mus musculus
agcggaatcccgctccaggcgtgga

SEQ ID NO: 226106 - DNA, 25 bp, Mus musculus
ggcgatgcccccgtgagtctctgtc

SEQ ID NO: 226107 - DNA, 25 bp, Mus musculus
ggcagcacctgcctcgccttgcggc

SEQ ID NO: 226108 - DNA, 25 bp, Mus musculus
gaactgtgtggcgactgcggagcca

SEQ ID NO: 226109 - DNA, 25 bp, Mus musculus
acccggcggcgactgagaactgtgt

SEQ ID NO: 226110 - DNA, 25 bp, Mus musculus
ttgggctttgcacccggcggcgact

SEQ ID NO: 226111 - DNA, 25 bp, Mus musculus
cagccgtggcttgggctttgcaccc

SEQ ID NO: 226112 - DNA, 25 bp, Mus musculus
acgtagggatgtatgccagatctgg

SEQ ID NO: 226113 - DNA, 25 bp, Mus musculus
agaccctacaaccatggctccgaga

SEQ ID NO: 226114 - DNA, 25 bp, Mus musculus
cggactgcacttcccagaggcctga

SEQ ID NO: 226115 - DNA, 25 bp, Mus musculus
gccggattgcgattgcgatcgcgat

SEQ ID NO: 226116 - DNA, 25 bp, Mus musculus
gatcgcgatggcgaacctgggctac

SEQ ID NO: 226117 - DNA, 25 bp, Mus musculus
ctgctgtgcttgttgggtttgctac

SEQ ID NO: 226118 - DNA, 25 bp, Mus musculus
gggtttgctactatgcgggctttca

SEQ ID NO: 226119 - DNA, 25 bp, Mus musculus
cgatggacaagcttggagcacgctc

SEQ ID NO: 226120 - DNA, 25 bp, Mus musculus
agtcccgggatgtccagaccctaca

SEQ ID NO: 226121 - DNA, 25 bp, Mus musculus
ttggagcacgctcccagagccttct

SEQ ID NO: 226122 - DNA, 25 bp, Mus musculus
ggcccatcatcggtaaggaggcttg

SEQ ID NO: 226123 - DNA, 25 bp, Mus musculus
ccggtagtctgcgaggcgctctgtt

SEQ ID NO: 226124 - DNA, 25 bp, Mus musculus
gcgctctgtttctcagcggtgcaga

SEQ ID NO: 226125 - DNA, 25 bp, Mus musculus
gggctttcaagtcccgggatgtcca

SEQ ID NO: 226126 - DNA, 25 bp, Mus musculus
cgcgcctggctgaagaaccttttta

SEQ ID NO: 226127 - DNA, 25 bp, Mus musculus
actactctggcggtgtgagccttcc

SEQ ID NO: 226128 - DNA, 25 bp, Mus musculus
ctttaggcgtcctggtcccagcaga

SEQ ID NO: 226129 - DNA, 25 bp, Mus musculus
cgcgcccagacatctggtgactgtg

SEQ ID NO: 226130 - DNA, 25 bp, Mus musculus
taaacttttgcgcaaaccacgcgcc

SEQ ID NO: 226131 - DNA, 25 bp, Mus musculus
tgttccaacactgggcagtgccctc

SEQ ID NO: 226132 - DNA, 25 bp, Mus musculus
gaggcggagtcgcatgttccaacac

SEQ ID NO: 226133 - DNA, 25 bp, Mus musculus
caggggaatatagtcttaaggtcta

SEQ ID NO: 226134 - DNA, 25 bp, Mus musculus
ctttggaagttcacccgggagacag

SEQ ID NO: 226135 - DNA, 25 bp, Mus musculus
gcacaaaacgctgcccgaggacttt

SEQ ID NO: 226136 - DNA, 25 bp, Mus musculus
cctgttactaccacggcggcgaagc

SEQ ID NO: 226137 - DNA, 25 bp, Mus musculus
tggtcccagcagaggccaaggatct

SEQ ID NO: 226138 - DNA, 25 bp, Mus musculus
ttcacccgggagacaggggaatata

SEQ ID NO: 226139 - DNA, 25 bp, Mus musculus
gcggcgaagctccacgcacaaaacg

SEQ ID NO: 226140 - DNA, 25 bp, Mus musculus
acgctgcccgaggactttggaagtt

SEQ ID NO: 226141 - DNA, 25 bp, Mus musculus
ggcctctcccgcttctcacccgccg

SEQ ID NO: 226142 - DNA, 25 bp, Mus musculus
agcagagtcgcctactcaccggagg

SEQ ID NO: 226143 - DNA, 25 bp, Mus musculus
cggctgcggctcagatgcccgagct

SEQ ID NO: 226144 - DNA, 25 bp, Mus musculus
acttcgcaggcagccacccggtcga

SEQ ID NO: 226145 - DNA, 25 bp, Mus musculus
gacccagatcccggaagccggaagc

SEQ ID NO: 226146 - DNA, 25 bp, Mus musculus
agggacacaggacaccgtcggcctc

SEQ ID NO: 226147 - DNA, 25 bp, Mus musculus
tggcttccgagggacacaggacacc

SEQ ID NO: 226148 - DNA, 25 bp, Mus musculus
tgctgagggtctcctgtaccccgtg

SEQ ID NO: 226149 - DNA, 25 bp, Mus musculus
gcccagtgcgcagcgtggcttccga

SEQ ID NO: 226150 - DNA, 25 bp, Mus musculus
gttcccgccagccttccacgctcac

SEQ ID NO: 226151 - DNA, 25 bp, Mus musculus
ggaggatctccggatccgttcccgc

SEQ ID NO: 226152 - DNA, 25 bp, Mus musculus
agtcgcctactcaccggaggatctc

SEQ ID NO: 226153 - DNA, 25 bp, Mus musculus
cgacccatcggcagaacttcgcagg

SEQ ID NO: 226154 - DNA, 25 bp, Mus musculus
gccttctgtcccagcccaggacctg

SEQ ID NO: 226155 - DNA, 25 bp, Mus musculus
cccagaagtggcctaggtggagcga

SEQ ID NO: 226156 - DNA, 25 bp, Mus musculus
cgcccaccgcgctgcactgggctct

SEQ ID NO: 226157 - DNA, 25 bp, Mus musculus
ctccacccagcccaacccgcgcatg

SEQ ID NO: 226158 - DNA, 25 bp, Mus musculus
tgcgaccagctcagccgccacctcc

SEQ ID NO: 226159 - DNA, 25 bp, Mus musculus
cccgagtgttgagggtctgcccgct

SEQ ID NO: 226160 - DNA, 25 bp, Mus musculus
aggcgtgcgggacgcacacttgacc

SEQ ID NO: 226161 - DNA, 25 bp, Mus musculus
agcagccccggggtcagagccgtca

SEQ ID NO: 226162 - DNA, 25 bp, Mus musculus
acttgcctgtcatggccagggtgcc

SEQ ID NO: 226163 - DNA, 25 bp, Mus musculus
tcaccgacttgcctgtcatggccag

SEQ ID NO: 226164 - DNA, 25 bp, Mus musculus
gtccttcaccgacttgcctgtcatg

SEQ ID NO: 226165 - DNA, 25 bp, Mus musculus
gcctggtaccgatccacgtccttca

SEQ ID NO: 226166 - DNA, 25 bp, Mus musculus
caccgcctacttccggcagctcttc

SEQ ID NO: 226167 - DNA, 25 bp, Mus musculus
tcctaggaaccaatccgggaagagc

SEQ ID NO: 226168 - DNA, 25 bp, Mus musculus
tgttgagggtctgcccgctgtgctt

SEQ ID NO: 226169 - DNA, 25 bp, Mus musculus
agatccagtccgaggctccgaaagc

SEQ ID NO: 226170 - DNA, 25 bp, Mus musculus
tctagctgcgttttcgggagatcca

SEQ ID NO: 226171 - DNA, 25 bp, Mus musculus
ctgcgttttcgggagatccagtccg

SEQ ID NO: 226172 - DNA, 25 bp, Mus musculus
tttcgggagatccagtccgaggctc

SEQ ID NO: 226173 - DNA, 25 bp, Mus musculus
tccagtccgaggctccgaaagcagc

SEQ ID NO: 226174 - DNA, 25 bp, Mus musculus
tgttcgccatgaccgccgtgcccgc

SEQ ID NO: 226175 - DNA, 25 bp, Mus musculus
cccgcagcctgttcgttctcctcca

SEQ ID NO: 226176 - DNA, 25 bp, Mus musculus
ctcgccctggctcagatcgtaagtc

SEQ ID NO: 226177 - DNA, 25 bp, Mus musculus
gccctggctcagatcgtaagtcctg

SEQ ID NO: 226178 - DNA, 25 bp, Mus musculus
ctggctcagatcgtaagtcctgtca

SEQ ID NO: 226179 - DNA, 25 bp, Mus musculus
ctcagatcgtaagtcctgtcacttc

SEQ ID NO: 226180 - DNA, 25 bp, Mus musculus
agatcgtaagtcctgtcacttctct

SEQ ID NO: 226181 - DNA, 25 bp, Mus musculus
cggcccgtctagctgcgttttcggg

SEQ ID NO: 226182 - DNA, 25 bp, Mus musculus
ctccagaacccgctgttcgccatga

SEQ ID NO: 226183 - DNA, 25 bp, Mus musculus
actgaagtcgggttacggcagagct

SEQ ID NO: 226184 - DNA, 25 bp, Mus musculus
ccgaatgttggtcctctcagaagtc

SEQ ID NO: 226185 - DNA, 25 bp, Mus musculus
tccgtcactaggacgccgaatgttg

SEQ ID NO: 226186 - DNA, 25 bp, Mus musculus
ggcgccaactttatccgtcactagg

SEQ ID NO: 226187 - DNA, 25 bp, Mus musculus
cctggcgacgctggcgccaacttta

SEQ ID NO: 226188 - DNA, 25 bp, Mus musculus
caatcgcccgtgttagtgacgcacc

SEQ ID NO: 226189 - DNA, 25 bp, Mus musculus
gcgcgtaggcaaccaaaccacgtga

SEQ ID NO: 226190 - DNA, 25 bp, Mus musculus
agccatggactcagtctcgacttcg

SEQ ID NO: 226191 - DNA, 25 bp, Mus musculus
ctgccagagacacggtcgtaggccc

SEQ ID NO: 226192 - DNA, 25 bp, Mus musculus
aagatgagacctcggacacctcctg

SEQ ID NO: 226193 - DNA, 25 bp, Mus musculus
ctccggcagtagctcaaagatgaga

SEQ ID NO: 226194 - DNA, 25 bp, Mus musculus
tcacctggcagaagctccggcagta

SEQ ID NO: 226195 - DNA, 25 bp, Mus musculus
acagcctagcaacggcgagattcta

SEQ ID NO: 226196 - DNA, 25 bp, Mus musculus
gaggcggatcccgagtctcttctcc

SEQ ID NO: 226197 - DNA, 25 bp, Mus musculus
aggaagaagtttggccgctccgctc

SEQ ID NO: 226198 - DNA, 25 bp, Mus musculus
ggcgtgtccacggttggtcacgccc

SEQ ID NO: 226199 - DNA, 25 bp, Mus musculus
aagggctccgcctccaagggaggtg

SEQ ID NO: 226200 - DNA, 25 bp, Mus musculus
atctggcttaggagcgtttggaaaa

SEQ ID NO: 226201 - DNA, 25 bp, Mus musculus
aagtttggccgctccgctcgtgact

SEQ ID NO: 226202 - DNA, 25 bp, Mus musculus
tcacctccggactgcgatcagccgc

SEQ ID NO: 226203 - DNA, 25 bp, Mus musculus
cactggctgtaacgctagcccgggg

SEQ ID NO: 226204 - DNA, 25 bp, Mus musculus
atgaaccactggctgtaacgctagc

SEQ ID NO: 226205 - DNA, 25 bp, Mus musculus
cccaccggaaatgaaccactggctg

SEQ ID NO: 226206 - DNA, 25 bp, Mus musculus
cgcgacccacttccgggccctcact

SEQ ID NO: 226207 - DNA, 25 bp, Mus musculus
cccagcggtcttcgcgcgacccact

SEQ ID NO: 226208 - DNA, 25 bp, Mus musculus
ttccggcaagaaccgcccagcggtc

SEQ ID NO: 226209 - DNA, 25 bp, Mus musculus
cagccgctctccacttccggcaaga

SEQ ID NO: 226210 - DNA, 25 bp, Mus musculus
gccaccggagagagaatctggctta

SEQ ID NO: 226211 - DNA, 25 bp, Mus musculus
tagcaaaccaggaacgccggcgatg

SEQ ID NO: 226212 - DNA, 25 bp, Mus musculus
cctggaccggccgttcactggcttg

SEQ ID NO: 226213 - DNA, 25 bp, Mus musculus
gccgttcactggcttggaggatgct

SEQ ID NO: 226214 - DNA, 25 bp, Mus musculus
tcggcgccttctcctttggccatga

SEQ ID NO: 226215 - DNA, 25 bp, Mus musculus
ctcttgtgttctgccggccggcact

SEQ ID NO: 226216 - DNA, 25 bp, Mus musculus
actcgcctgtggctccgatcctagg

SEQ ID NO: 226217 - DNA, 25 bp, Mus musculus
gaacgccggcgatgaaaactcccta

SEQ ID NO: 226218 - DNA, 25 bp, Mus musculus
ggcgatgaaaactccctagcacgtc

SEQ ID NO: 226219 - DNA, 25 bp, Mus musculus
cgcgcctcttaaaggttcgggcctg

SEQ ID NO: 226220 - DNA, 25 bp, Mus musculus
tcgctgctcagccacgttctcaaag

SEQ ID NO: 226221 - DNA, 25 bp, Mus musculus
ctcttaaaggttcgggcctgcgcct

SEQ ID NO: 226222 - DNA, 25 bp, Mus musculus
tctcggctggcggagcctcgctgct

SEQ ID NO: 226223 - DNA, 25 bp, Mus musculus
gccactactacgttcgctagcactt

SEQ ID NO: 226224 - DNA, 25 bp, Mus musculus
ttcgctagcacttagcaaaccagga

SEQ ID NO: 226225 - DNA, 25 bp, Mus musculus
ccaggcttcccaggagcagggacca

SEQ ID NO: 226226 - DNA, 25 bp, Mus musculus
tcgggaaacaatgcgcctgcagatc

SEQ ID NO: 226227 - DNA, 25 bp, Mus musculus
aggctgcagactgccttcgagacag

SEQ ID NO: 226228 - DNA, 25 bp, Mus musculus
caaagtttgctttgaactcgctccc

SEQ ID NO: 226229 - DNA, 25 bp, Mus musculus
gcggacatggacttcgactcgtatc

SEQ ID NO: 226230 - DNA, 25 bp, Mus musculus
tacgactatgactgcggagaggatt

SEQ ID NO: 226231 - DNA, 25 bp, Mus musculus
agaggatttctaccgctccacggcg

SEQ ID NO: 226232 - DNA, 25 bp, Mus musculus
aagaaattcgagctggtgccgtcgc

SEQ ID NO: 226233 - DNA, 25 bp, Mus musculus
cccagcctctgggattaatcccggg

SEQ ID NO: 226234 - DNA, 25 bp, Mus musculus
aagcctggggcaggaattatgcttc

SEQ ID NO: 226235 - DNA, 25 bp, Mus musculus
attatgcttccatcattcgccgtga

SEQ ID NO: 226236 - DNA, 25 bp, Mus musculus
cattcgccgtgactgcatgtggagc

SEQ ID NO: 226237 - DNA, 25 bp, Mus musculus
ccgggcacgcgacgagatataaagc

SEQ ID NO: 226238 - DNA, 25 bp, Mus musculus
cttcgactcgtatcagcactatttc

SEQ ID NO: 226239 - DNA, 25 bp, Mus musculus
ccacttgtagtgattctcggggcta

SEQ ID NO: 226240 - DNA, 25 bp, Mus musculus
acaccctgtcgcgtggctgtagtgg

SEQ ID NO: 226241 - DNA, 25 bp, Mus musculus
gcctctggactaggggacaccctgt

SEQ ID NO: 226242 - DNA, 25 bp, Mus musculus
gccgactccatgcaggtatggcagc

SEQ ID NO: 226243 - DNA, 25 bp, Mus musculus
ggcgagatcgtcagcgccgactcca

SEQ ID NO: 226244 - DNA, 25 bp, Mus musculus
gctctgcagttaggccagcggctcg

SEQ ID NO: 226245 - DNA, 25 bp, Mus musculus
ggctactgggactggcaagtccacc

SEQ ID NO: 226246 - DNA, 25 bp, Mus musculus
cctgcggcgaacactgccacttgta

SEQ ID NO: 226247 - DNA, 25 bp, Mus musculus
tcctgtgagctctggattccgaggc

SEQ ID NO: 226248 - DNA, 25 bp, Mus musculus
gctgctgcacgagcagttcctgtga

SEQ ID NO: 226249 - DNA, 25 bp, Mus musculus
cgcatgctcagatgccttcaagatg

SEQ ID NO: 226250 - DNA, 25 bp, Mus musculus
ggacagctgcttcggcgcatgctca

SEQ ID NO: 226251 - DNA, 25 bp, Mus musculus
cgcactgactgttgccatggggaca

SEQ ID NO: 226252 - DNA, 25 bp, Mus musculus
caagtccaccctggctctgcagtta

SEQ ID NO: 226253 - DNA, 25 bp, Mus musculus
cctggcagcttctggcgacagaatg

SEQ ID NO: 226254 - DNA, 25 bp, Mus musculus
tccgctaaacgtccgagatggctgc

SEQ ID NO: 226255 - DNA, 25 bp, Mus musculus
tcgctggatgcgagtccgctaaacg

SEQ ID NO: 226256 - DNA, 25 bp, Mus musculus
tcccatccttgtcgtcgaggcgtcg

SEQ ID NO: 226257 - DNA, 25 bp, Mus musculus
agtcgtcttagagctgcccgcgaca

SEQ ID NO: 226258 - DNA, 25 bp, Mus musculus
ctcatcggtgaaggaggcgtcttcc

SEQ ID NO: 226259 - DNA, 25 bp, Mus musculus
caccctgtagacgtgtgtccgcgct

SEQ ID NO: 226260 - DNA, 25 bp, Mus musculus
gggcccaggacacccatgatggctt

SEQ ID NO: 226261 - DNA, 25 bp, Mus musculus
tctgcttcagagacaccgacgtctc

SEQ ID NO: 226262 - DNA, 25 bp, Mus musculus
caccctcgaggcatggttggcatcc

SEQ ID NO: 226263 - DNA, 25 bp, Mus musculus
atgttggacctgtaccgtgccatga

SEQ ID NO: 226264 - DNA, 25 bp, Mus musculus
ggtcctgctccggacactcgctatt

SEQ ID NO: 226265 - DNA, 25 bp, Mus musculus
attcgctccaaggtgcaggtgtctg

SEQ ID NO: 226266 - DNA, 25 bp, Mus musculus
ccacctttagtagtagcggtacaga

SEQ ID NO: 226267 - DNA, 25 bp, Mus musculus
cctgcacagtgaaaacggaatcctg

SEQ ID NO: 226268 - DNA, 25 bp, Mus musculus
atccgccgctatgtttcggaccgca

SEQ ID NO: 226269 - DNA, 25 bp, Mus musculus
cgcagcgggagtgtccatttctaca

SEQ ID NO: 226270 - DNA, 25 bp, Mus musculus
aacctgatcggtgcgctgaagacca

SEQ ID NO: 226271 - DNA, 25 bp, Mus musculus
gcccgatggccacctgattactcta

SEQ ID NO: 226272 - DNA, 25 bp, Mus musculus
tgctagagcacgctatccgcgctga

SEQ ID NO: 226273 - DNA, 25 bp, Mus musculus
ggcagcgcgcgcaacttcaatgtgc

SEQ ID NO: 226274 - DNA, 25 bp, Mus musculus
caacatctatgtggaccgcgtgatc

SEQ ID NO: 226275 - DNA, 25 bp, Mus musculus
tcgagcgcctaaccacacgtgacag

SEQ ID NO: 226276 - DNA, 25 bp, Mus musculus
gcgcccgggagcaaagacaatgacc

SEQ ID NO: 226277 - DNA, 25 bp, Mus musculus
tgccaatctgggcatcgggatccct

SEQ ID NO: 226278 - DNA, 25 bp, Mus musculus
ccctgtcttggcgagcaactacatc

SEQ ID NO: 226279 - DNA, 25 bp, Mus musculus
ccgcgctgacttcgcactgatcaag

SEQ ID NO: 226280 - DNA, 25 bp, Mus musculus
aagatgaccgtctacctgcacagtg

SEQ ID NO: 226281 - DNA, 25 bp, Mus musculus
agcctgaaccgccttcctctccgcc

SEQ ID NO: 226282 - DNA, 25 bp, Mus musculus
cgctgtcacccttcccgtcctgggc

SEQ ID NO: 226283 - DNA, 25 bp, Mus musculus
ccgccaagaagggagcgacacctac

SEQ ID NO: 226284 - DNA, 25 bp, Mus musculus
agggagcgacacctacctcaccagg

SEQ ID NO: 226285 - DNA, 25 bp, Mus musculus
agcgacacctacctcaccaggatgg

SEQ ID NO: 226286 - DNA, 25 bp, Mus musculus
cacgtcctcgcagttggcatacagc

SEQ ID NO: 226287 - DNA, 25 bp, Mus musculus
ctcgcagttggcatacagccgggcc

SEQ ID NO: 226288 - DNA, 25 bp, Mus musculus
tacagccgggcccacgtagcctgaa

SEQ ID NO: 226289 - DNA, 25 bp, Mus musculus
ctctccgcctcggacagctcctcgc

SEQ ID NO: 226290 - DNA, 25 bp, Mus musculus
tcctcgctcctctccctacgctcta

SEQ ID NO: 226291 - DNA, 25 bp, Mus musculus
tacgctctatctccatgtcgcccgg

SEQ ID NO: 226292 - DNA, 25 bp, Mus musculus
ggcactttctccatgagcagctccg

SEQ ID NO: 226293 - DNA, 25 bp, Mus musculus
actttctccatgagcagctccgagc

SEQ ID NO: 226294 - DNA, 25 bp, Mus musculus
agttggcatacagccgggcccacgt

SEQ ID NO: 226295 - DNA, 25 bp, Mus musculus
agacgctttcctgctgcgcttcctg

SEQ ID NO: 226296 - DNA, 25 bp, Mus musculus
gcaccacgtgggcttctttaagagg

SEQ ID NO: 226297 - DNA, 25 bp, Mus musculus
gcttctttaagagggcgccgtgacc

SEQ ID NO: 226298 - DNA, 25 bp, Mus musculus
aagagggcgccgtgacccttgcacc

SEQ ID NO: 226299 - DNA, 25 bp, Mus musculus
gggccattggttgggaaacagctca

SEQ ID NO: 226300 - DNA, 25 bp, Mus musculus
cattggttgggaaacagctcaacga

SEQ ID NO: 226301 - DNA, 25 bp, Mus musculus
agctcaacgagctgcccgaccactc

SEQ ID NO: 226302 - DNA, 25 bp, Mus musculus
cccgcagcctctcacagacgctttc

SEQ ID NO: 226303 - DNA, 25 bp, Mus musculus
gcccgggatttcgatctggatctgg

SEQ ID NO: 226304 - DNA, 25 bp, Mus musculus
tttcgatctggatctggcctggcgc

SEQ ID NO: 226305 - DNA, 25 bp, Mus musculus
ctggcctggcgcgtaagtgtgcacc

SEQ ID NO: 226306 - DNA, 25 bp, Mus musculus
agagctcggcgacggcggaatccac

SEQ ID NO: 226307 - DNA, 25 bp, Mus musculus
agtgtgactgcaggcgcgcccagaa

SEQ ID NO: 226308 - DNA, 25 bp, Mus musculus
tgcccgaccactcgccgctgctcca

SEQ ID NO: 226309 - DNA, 25 bp, Mus musculus
aggcgggtcttatgcaaatcgtgtc

SEQ ID NO: 226310 - DNA, 25 bp, Mus musculus
aagctcggagccatctagcgactcg

SEQ ID NO: 226311 - DNA, 25 bp, Mus musculus
tcgtccgcctgatagccagccttgt

SEQ ID NO: 226312 - DNA, 25 bp, Mus musculus
tacagagcctgtcgtccgcctgata

SEQ ID NO: 226313 - DNA, 25 bp, Mus musculus
atagtgatacaagaactggggaggc

SEQ ID NO: 226314 - DNA, 25 bp, Mus musculus
agccatctagcgactcggcgagcgg

SEQ ID NO: 226315 - DNA, 25 bp, Mus musculus
tgcaaatcgtgtcgccttcgagaag

SEQ ID NO: 226316 - DNA, 25 bp, Mus musculus
atgtccaaagttgctgagaggaggc

SEQ ID NO: 226317 - DNA, 25 bp, Mus musculus
gccgaaccaatcgatgtccaaagtt

SEQ ID NO: 226318 - DNA, 25 bp, Mus musculus
tcggtgccagccgaaccaatcgatg

SEQ ID NO: 226319 - DNA, 25 bp, Mus musculus
tggtagcctagactcacaggccacc

SEQ ID NO: 226320 - DNA, 25 bp, Mus musculus
gcgctcttgtggtagcctagactca

SEQ ID NO: 226321 - DNA, 25 bp, Mus musculus
cgggccctagaagcaacctcgcggg

SEQ ID NO: 226322 - DNA, 25 bp, Mus musculus
cgccttcgagaagcaaatagtgata

SEQ ID NO: 226323 - DNA, 25 bp, Mus musculus
tcccgtggcagcttcgagcagaagc

SEQ ID NO: 226324 - DNA, 25 bp, Mus musculus
gcatgctttccgcaccttcgacaag

SEQ ID NO: 226325 - DNA, 25 bp, Mus musculus
cgcaccttcgacaagaacggcgatg

SEQ ID NO: 226326 - DNA, 25 bp, Mus musculus
gacaagaacggcgatggcaccatcg

SEQ ID NO: 226327 - DNA, 25 bp, Mus musculus
atggcaccatcgacttccgggagtt

SEQ ID NO: 226328 - DNA, 25 bp, Mus musculus
ttccgggagttcatctgcgcccttt

SEQ ID NO: 226329 - DNA, 25 bp, Mus musculus
tttctgtcacctcccgtggcagctt

SEQ ID NO: 226330 - DNA, 25 bp, Mus musculus
gcgtccaagtttgcgcagcatgctt

SEQ ID NO: 226331 - DNA, 25 bp, Mus musculus
cgagcagaagctcaactgggccttt

SEQ ID NO: 226332 - DNA, 25 bp, Mus musculus
aactgggcctttgagatgtacgatc

SEQ ID NO: 226333 - DNA, 25 bp, Mus musculus
atgtacgatctggacggtgacggcc

SEQ ID NO: 226334 - DNA, 25 bp, Mus musculus
atctggacggtgacggccgcatcac

SEQ ID NO: 226335 - DNA, 25 bp, Mus musculus
cggccgcatcacacggctggagatg

SEQ ID NO: 226336 - DNA, 25 bp, Mus musculus
gggagttcatctgcgccctttctgt

SEQ ID NO: 226337 - DNA, 25 bp, Mus musculus
tcggagcatggaaccagggcagccc

SEQ ID NO: 226338 - DNA, 25 bp, Mus musculus
ggtcggtcgaggaatcagagttccc

SEQ ID NO: 226339 - DNA, 25 bp, Mus musculus
cgaggaatcagagttcccctaaatg

SEQ ID NO: 226340 - DNA, 25 bp, Mus musculus
aagagggcggctcggacctgacggt

SEQ ID NO: 226341 - DNA, 25 bp, Mus musculus
gggcaggctcactcgcactccctcc

SEQ ID NO: 226342 - DNA, 25 bp, Mus musculus
actcgcactccctcccggccctgcc

SEQ ID NO: 226343 - DNA, 25 bp, Mus musculus
ccggtgccgagagctccgcgtctcc

SEQ ID NO: 226344 - DNA, 25 bp, Mus musculus
tctccactgctgtcttctcccgccg

SEQ ID NO: 226345 - DNA, 25 bp, Mus musculus
cccgccgggccggatagaatccgag

SEQ ID NO: 226346 - DNA, 25 bp, Mus musculus
cgccgggccggatagaatccgagtc

SEQ ID NO: 226347 - DNA, 25 bp, Mus musculus
gccggatagaatccgagtcggagca

SEQ ID NO: 226348 - DNA, 25 bp, Mus musculus
cggatagaatccgagtcggagcatg

SEQ ID NO: 226349 - DNA, 25 bp, Mus musculus
caggggcagagaccgccgcggtacc

SEQ ID NO: 226350 - DNA, 25 bp, Mus musculus
atccgagtcggagcatggaaccagg

SEQ ID NO: 226351 - DNA, 25 bp, Mus musculus
acggcgagtctgatggacccatcga

SEQ ID NO: 226352 - DNA, 25 bp, Mus musculus
tgaggcggggcccaacaaccaactc

SEQ ID NO: 226353 - DNA, 25 bp, Mus musculus
accaactccagggatcgcagggctg

SEQ ID NO: 226354 - DNA, 25 bp, Mus musculus
agctttcggcatgaagcggcccagg

SEQ ID NO: 226355 - DNA, 25 bp, Mus musculus
acccatcgatgtgggtcaagagaac

SEQ ID NO: 226356 - DNA, 25 bp, Mus musculus
tgggtcaagagaacgatcttaggta

SEQ ID NO: 226357 - DNA, 25 bp, Mus musculus
tgcagcgactccagtgcgtccatag

SEQ ID NO: 226358 - DNA, 25 bp, Mus musculus
cccgcagccagctttcggcatgaag

SEQ ID NO: 226359 - DNA, 25 bp, Mus musculus
tccagtgcgtccatagcaccaatgc

SEQ ID NO: 226360 - DNA, 25 bp, Mus musculus
acgatcttaggtaagacagggtgga

SEQ ID NO: 226361 - DNA, 25 bp, Mus musculus
tgcgcagccctcaggtgtcagccaa

SEQ ID NO: 226362 - DNA, 25 bp, Mus musculus
cactcaagtttgtgcgcagccctca

SEQ ID NO: 226363 - DNA, 25 bp, Mus musculus
gaaagtccagcacactcaagtttgt

SEQ ID NO: 226364 - DNA, 25 bp, Mus musculus
ggggtgagaaagtccagcacactca

SEQ ID NO: 226365 - DNA, 25 bp, Mus musculus
tctcgaggcgcccttcgaccagcag

SEQ ID NO: 226366 - DNA, 25 bp, Mus musculus
gcccaggtctcgaggcgcccttcga

SEQ ID NO: 226367 - DNA, 25 bp, Mus musculus
cgcccttcgaccagcagcgcccggg

SEQ ID NO: 226368 - DNA, 25 bp, Mus musculus
gcgcccttcgaccagcagcgcccgg

SEQ ID NO: 226369 - DNA, 25 bp, Mus musculus
gaggcgcccttcgaccagcagcgcc

SEQ ID NO: 226370 - DNA, 25 bp, Mus musculus
cgaggcgcccttcgaccagcagcgc

SEQ ID NO: 226371 - DNA, 25 bp, Mus musculus
ctcgaggcgcccttcgaccagcagc

SEQ ID NO: 226372 - DNA, 25 bp, Mus musculus
gtggcggctccagccgcctctctcc

SEQ ID NO: 226373 - DNA, 25 bp, Mus musculus
cccaggtctcgaggcgcccttcgac

SEQ ID NO: 226374 - DNA, 25 bp, Mus musculus
gggcacgactgcgcccaggtctcga

SEQ ID NO: 226375 - DNA, 25 bp, Mus musculus
gcgggcacgactgcgcccaggtctc

SEQ ID NO: 226376 - DNA, 25 bp, Mus musculus
agtgggcgggcacgactgcgcccag

SEQ ID NO: 226377 - DNA, 25 bp, Mus musculus
agagtgggcgggcacgactgcgccc

SEQ ID NO: 226378 - DNA, 25 bp, Mus musculus
aggtctcgaggcgcccttcgaccag

SEQ ID NO: 226379 - DNA, 25 bp, Mus musculus
aggccttgttagaagtcctcctggc

SEQ ID NO: 226380 - DNA, 25 bp, Mus musculus
ctgcagtaggccttgttagaagtcc

SEQ ID NO: 226381 - DNA, 25 bp, Mus musculus
cccttttgtcctgcagtaggccttg

SEQ ID NO: 226382 - DNA, 25 bp, Mus musculus
tctgtccgtccggtggtgagccatc

SEQ ID NO: 226383 - DNA, 25 bp, Mus musculus
ggcgcgtgccatagctcctcggagc

SEQ ID NO: 226384 - DNA, 25 bp, Mus musculus
ggagtccggggcctatatttatcac

SEQ ID NO: 226385 - DNA, 25 bp, Mus musculus
atattgtttttgagagccttttgtc

SEQ ID NO: 226386 - DNA, 25 bp, Mus musculus
cagctggagagtacaaactccagga

SEQ ID NO: 226387 - DNA, 25 bp, Mus musculus
agccaggacagctggagagtacaaa

SEQ ID NO: 226388 - DNA, 25 bp, Mus musculus
acgcgtgttcccaaggcggccgtga

SEQ ID NO: 226389 - DNA, 25 bp, Mus musculus
tcacgaaacgcgtgttcccaaggcg

SEQ ID NO: 226390 - DNA, 25 bp, Mus musculus
ggggcctatatttatcacgaaacgc

SEQ ID NO: 226391 - DNA, 25 bp, Mus musculus
cgccggcacccgcaaagatttggtt

SEQ ID NO: 226392 - DNA, 25 bp, Mus musculus
agccttttgtcttggggcttttgca

SEQ ID NO: 226393 - DNA, 25 bp, Mus musculus
gctgatgtagttgctcgccaagaca

SEQ ID NO: 226394 - DNA, 25 bp, Mus musculus
cactgtgcaggtagacggtcatctt

SEQ ID NO: 226395 - DNA, 25 bp, Mus musculus
gcgctcgatgcgcttctcgaacttc

SEQ ID NO: 226396 - DNA, 25 bp, Mus musculus
cgcgtcctggaagggtcattgtctt

SEQ ID NO: 226397 - DNA, 25 bp, Mus musculus
gatcacgcggtccacatagatgttg

SEQ ID NO: 226398 - DNA, 25 bp, Mus musculus
tccagcccttgatcagtgcgaagtc

SEQ ID NO: 226399 - DNA, 25 bp, Mus musculus
tctcgcggctcacttagagtaatca

SEQ ID NO: 226400 - DNA, 25 bp, Mus musculus
tgcggcgtcatctccagttccagct

SEQ ID NO: 226401 - DNA, 25 bp, Mus musculus
cccacgttgctgctgacgatcttca

SEQ ID NO: 226402 - DNA, 25 bp, Mus musculus
gatcttcaggtccttcacgcccttg

SEQ ID NO: 226403 - DNA, 25 bp, Mus musculus
tggtcttcagcgcaccgatcaggtt

SEQ ID NO: 226404 - DNA, 25 bp, Mus musculus
agaaatggacactcccgctgcggtc

SEQ ID NO: 226405 - DNA, 25 bp, Mus musculus
gcccaagcccaggattccgttttca

SEQ ID NO: 226406 - DNA, 25 bp, Mus musculus
tccgcggccttgcacatgggcacat

SEQ ID NO: 226407 - DNA, 25 bp, Mus musculus
ctcatgaccaggtcggcacggccta

SEQ ID NO: 226408 - DNA, 25 bp, Mus musculus
ccgtcgtcgtcatcggtcatggcgt

SEQ ID NO: 226409 - DNA, 25 bp, Mus musculus
gtcatggcgtggtataggtccaaca

SEQ ID NO: 226410 - DNA, 25 bp, Mus musculus
cggtagcccgagcaccgccaggatt

SEQ ID NO: 226411 - DNA, 25 bp, Mus musculus
ccgccaggatttcacgctgcatgtc

SEQ ID NO: 226412 - DNA, 25 bp, Mus musculus
cgcgcacagagcaaggcccaatagc

SEQ ID NO: 226413 - DNA, 25 bp, Mus musculus
gcccaatagccagagtggcccggga

SEQ ID NO: 226414 - DNA, 25 bp, Mus musculus
gggacgcatagccatctcggacttt

SEQ ID NO: 226415 - DNA, 25 bp, Mus musculus
catccactggtagctggtcgggctc

SEQ ID NO: 226416 - DNA, 25 bp, Mus musculus
cgcacctgtcgctggcagctttaca

SEQ ID NO: 226417 - DNA, 25 bp, Mus musculus
tctcacggcgctgacttgcgagtgt

SEQ ID NO: 226418 - DNA, 25 bp, Mus musculus
gactttggtggcagctcagaccgcc

SEQ ID NO: 226419 - DNA, 25 bp, Mus musculus
ggggatggtcgcactactacttgtg

SEQ ID NO: 226420 - DNA, 25 bp, Mus musculus
ctgcactcacccatgttgacgaagc

SEQ ID NO: 226421 - DNA, 25 bp, Mus musculus
gcagcagtaagtcccgtgtcctgtg

SEQ ID NO: 226422 - DNA, 25 bp, Mus musculus
taccagccggtagtggctagggcca

SEQ ID NO: 226423 - DNA, 25 bp, Mus musculus
cgcttctttccaaccggcgggatgg

SEQ ID NO: 226424 - DNA, 25 bp, Mus musculus
gcagtcctggtcatgccgggcaaat

SEQ ID NO: 226425 - DNA, 25 bp, Mus musculus
ctcacccacgggagtaatagtgtcc

SEQ ID NO: 226426 - DNA, 25 bp, Mus musculus
tcacacgccgctggctggaagtgct

SEQ ID NO: 226427 - DNA, 25 bp, Mus musculus
tggccgggaacaaaaggctccgctc

SEQ ID NO: 226428 - DNA, 25 bp, Mus musculus
gcatgcaaacttctggccgggaaca

SEQ ID NO: 226429 - DNA, 25 bp, Mus musculus
tgcatgacaagcagtcgcctctttt

SEQ ID NO: 226430 - DNA, 25 bp, Mus musculus
tagtttgtccctccggcagcagtaa

SEQ ID NO: 226431 - DNA, 25 bp, Mus musculus
ctagcgctcaggaagttagtttgtc

SEQ ID NO: 226432 - DNA, 25 bp, Mus musculus
ggcagtctggactcacttagcaccg

SEQ ID NO: 226433 - DNA, 25 bp, Mus musculus
cccacgctgggcctttcagaaggcg

SEQ ID NO: 226434 - DNA, 25 bp, Mus musculus
agctgtcacggtcccggcatgcaaa

SEQ ID NO: 226435 - DNA, 25 bp, Mus musculus
atgctcggcgtcctaggctcccgag

SEQ ID NO: 226436 - DNA, 25 bp, Mus musculus
tcctcctgcagagtcccatagcagg

SEQ ID NO: 226437 - DNA, 25 bp, Mus musculus
agtcccatagcaggcggtctccgga

SEQ ID NO: 226438 - DNA, 25 bp, Mus musculus
ttcggatccggccagataatagagc

SEQ ID NO: 226439 - DNA, 25 bp, Mus musculus
taatagagcaaacagtgtgaccgga

SEQ ID NO: 226440 - DNA, 25 bp, Mus musculus
gacgcttatctcaactccacagaag

SEQ ID NO: 226441 - DNA, 25 bp, Mus musculus
aactccacagaagccagcccgggag

SEQ ID NO: 226442 - DNA, 25 bp, Mus musculus
cgactcctccgaagaggcagggaga

SEQ ID NO: 226443 - DNA, 25 bp, Mus musculus
gaactccttctcctggctgcggttg

SEQ ID NO: 226444 - DNA, 25 bp, Mus musculus
tgacccggcacgtagccggccatgg

SEQ ID NO: 226445 - DNA, 25 bp, Mus musculus
cccagtctcggcctttgtgcggttc

SEQ ID NO: 226446 - DNA, 25 bp, Mus musculus
ttggctctctcgctctcagatctgc

SEQ ID NO: 226447 - DNA, 25 bp, Mus musculus
atgagagcgtctccctcgagcccaa

SEQ ID NO: 226448 - DNA, 25 bp, Mus musculus
cccgggaaaccgaatgagagcgtct

SEQ ID NO: 226449 - DNA, 25 bp, Mus musculus
tgtgtacacccttcacgaggtgggg

SEQ ID NO: 226450 - DNA, 25 bp, Mus musculus
gaacttgcagacaaatccgggcttc

SEQ ID NO: 226451 - DNA, 25 bp, Mus musculus
aggaggaacttgcagacaaatccgg

SEQ ID NO: 226452 - DNA, 25 bp, Mus musculus
cttgggaggaggaacttgcagacaa

SEQ ID NO: 226453 - DNA, 25 bp, Mus musculus
gtcaaacacacccaggcatcgcctg

SEQ ID NO: 226454 - DNA, 25 bp, Mus musculus
ggggatctgactcaaagtcaaacac

SEQ ID NO: 226455 - DNA, 25 bp, Mus musculus
gaggtggggatctgactcaaagtca

SEQ ID NO: 226456 - DNA, 25 bp, Mus musculus
tcacgaggtggggatctgactcaaa

SEQ ID NO: 226457 - DNA, 25 bp, Mus musculus
gtacacccttcacgaggtggggatc

SEQ ID NO: 226458 - DNA, 25 bp, Mus musculus
acttgcagacaaatccgggcttccc

SEQ ID NO: 226459 - DNA, 25 bp, Mus musculus
tgtgtgtacacccttcacgaggtgg

SEQ ID NO: 226460 - DNA, 25 bp, Mus musculus
gggaggaggaacttgcagacaaatc

SEQ ID NO: 226461 - DNA, 25 bp, Mus musculus
cccttcacgaggtggggatctgact

SEQ ID NO: 226462 - DNA, 25 bp, Mus musculus
cacacccaggcatcgcctgcttggg

SEQ ID NO: 226463 - DNA, 25 bp, Mus musculus
ggtcacctgggtccgctacaagcat

SEQ ID NO: 226464 - DNA, 25 bp, Mus musculus
tggtcactccatccagtcctggttg

SEQ ID NO: 226465 - DNA, 25 bp, Mus musculus
atccagtcctggttggaaggaacgc

SEQ ID NO: 226466 - DNA, 25 bp, Mus musculus
ggttggaaggaacgcgcgcccacac

SEQ ID NO: 226467 - DNA, 25 bp, Mus musculus
gctacaagcatctgacccggcactg

SEQ ID NO: 226468 - DNA, 25 bp, Mus musculus
gtggcaccgaccgatctcaggaatc

SEQ ID NO: 226469 - DNA, 25 bp, Mus musculus
caggaatccggaggcgacttgccct

SEQ ID NO: 226470 - DNA, 25 bp, Mus musculus
acacgcctccttttggccggggcag

SEQ ID NO: 226471 - DNA, 25 bp, Mus musculus
cagcggtgctggttgcctgtcaacc

SEQ ID NO: 226472 - DNA, 25 bp, Mus musculus
ggttgcctgtcaaccggtccgccag

SEQ ID NO: 226473 - DNA, 25 bp, Mus musculus
gcgccttaccctgtgagcgcgagga

SEQ ID NO: 226474 - DNA, 25 bp, Mus musculus
ggagcggctcccacaatggccgagc

SEQ ID NO: 226475 - DNA, 25 bp, Mus musculus
gttcacgcacactcacacctgtgtg

SEQ ID NO: 226476 - DNA, 25 bp, Mus musculus
atctgacccggcactgacaggctgc

SEQ ID NO: 226477 - DNA, 25 bp, Mus musculus
gagcgacgccgtaaatcaaccaccg

SEQ ID NO: 226478 - DNA, 25 bp, Mus musculus
ggaggacgcagacgcctgccgtaaa

SEQ ID NO: 226479 - DNA, 25 bp, Mus musculus
tgccgtaaaggacgcccgcagcacg

SEQ ID NO: 226480 - DNA, 25 bp, Mus musculus
acgacatctccagagcgacgccgta

SEQ ID NO: 226481 - DNA, 25 bp, Mus musculus
caaccaccggccgaggaactgtaga

SEQ ID NO: 226482 - DNA, 25 bp, Mus musculus
ggccgaggaactgtagaaaccaagc

SEQ ID NO: 226483 - DNA, 25 bp, Mus musculus
tagaaaccaagcacagcgggtctgc

SEQ ID NO: 226484 - DNA, 25 bp, Mus musculus
aagcacagcgggtctgcgcctgcgc

SEQ ID NO: 226485 - DNA, 25 bp, Mus musculus
tgcgcagcaagcagcccagcctcca

SEQ ID NO: 226486 - DNA, 25 bp, Mus musculus
cgctgacagctgataaaccgacttt

SEQ ID NO: 226487 - DNA, 25 bp, Mus musculus
tgacagctgataaaccgactttccc

SEQ ID NO: 226488 - DNA, 25 bp, Mus musculus
ctactgcgcccggtagtgagttctc

SEQ ID NO: 226489 - DNA, 25 bp, Mus musculus
cggtagtgagttctccctttcagca

SEQ ID NO: 226490 - DNA, 25 bp, Mus musculus
aaaggacgcccgcagcacgacatct

SEQ ID NO: 226491 - DNA, 25 bp, Mus musculus
ctccaatggcgcctccggcacccgg

SEQ ID NO: 226492 - DNA, 25 bp, Mus musculus
ttcacgctctctgccggagtggcct

SEQ ID NO: 226493 - DNA, 25 bp, Mus musculus
agtggcctgggaggtctttcgcacc

SEQ ID NO: 226494 - DNA, 25 bp, Mus musculus
tctttcgcacctgcgcggcaggggc

SEQ ID NO: 226495 - DNA, 25 bp, Mus musculus
catggcgccccctgcggaagaagta

SEQ ID NO: 226496 - DNA, 25 bp, Mus musculus
tggcttcctgccaagtccgcagcag

SEQ ID NO: 226497 - DNA, 25 bp, Mus musculus
cgaaaaccgacactgtggggtcact

SEQ ID NO: 226498 - DNA, 25 bp, Mus musculus
tctcccaaggccgatatggggtgcg

SEQ ID NO: 226499 - DNA, 25 bp, Mus musculus
tcctttttctcccaaggccgatatg

SEQ ID NO: 226500 - DNA, 25 bp, Mus musculus
ggatgtctctcgtccccggaagcaa

SEQ ID NO: 226501 - DNA, 25 bp, Mus musculus
gggtcactgcccttcccggatgtct

SEQ ID NO: 226502 - DNA, 25 bp, Mus musculus
aaccgacactgtggggtcactgccc

SEQ ID NO: 226503 - DNA, 25 bp, Mus musculus
tgatctcggccggtgtccacgaccc

SEQ ID NO: 226504 - DNA, 25 bp, Mus musculus
cagcgcaggttaccgggagttggaa

SEQ ID NO: 226505 - DNA, 25 bp, Mus musculus
ggctccgaggagacagggatacaca

SEQ ID NO: 226506 - DNA, 25 bp, Mus musculus
agtctctccaacttccgttgctttc

SEQ ID NO: 226507 - DNA, 25 bp, Mus musculus
tgcagctgttgcaaagtctctccaa

SEQ ID NO: 226508 - DNA, 25 bp, Mus musculus
ccggactgaaactcttgcagctgtt

SEQ ID NO: 226509 - DNA, 25 bp, Mus musculus
agcagttccggaggtacttggagaa

SEQ ID NO: 226510 - DNA, 25 bp, Mus musculus
aggccgccgactcgaagcgcgagca

SEQ ID NO: 226511 - DNA, 25 bp, Mus musculus
ggctgtcactatggcccattacaaa

SEQ ID NO: 226512 - DNA, 25 bp, Mus musculus
gttccgcgcatgagcagtgaggctt

SEQ ID NO: 226513 - DNA, 25 bp, Mus musculus
gatacacagcgtcccggtcgccatg

SEQ ID NO: 226514 - DNA, 25 bp, Mus musculus
aagacgcgagactgcccggaaccgc

SEQ ID NO: 226515 - DNA, 25 bp, Mus musculus
atcgccgcggcaaccggaacaggaa

SEQ ID NO: 226516 - DNA, 25 bp, Mus musculus
tcttgctaggcaaccgaatcgccgc

SEQ ID NO: 226517 - DNA, 25 bp, Mus musculus
tttacctaaacctcgcctcttgcta

SEQ ID NO: 226518 - DNA, 25 bp, Mus musculus
ccggtcgccatgaaaacaggccaca

SEQ ID NO: 226519 - DNA, 25 bp, Mus musculus
tccgggcacgtgatagtaccactta

SEQ ID NO: 226520 - DNA, 25 bp, Mus musculus
actgtccacacctgcgagcgcagag

SEQ ID NO: 226521 - DNA, 25 bp, Mus musculus
gagaacttggtgagcgtgctgtccc

SEQ ID NO: 226522 - DNA, 25 bp, Mus musculus
gcccttgtggcgttgacgaaaccga

SEQ ID NO: 226523 - DNA, 25 bp, Mus musculus
tagaactcctcccttctggtcgctg

SEQ ID NO: 226524 - DNA, 25 bp, Mus musculus
aggtgccggtcaccgccctagaact

SEQ ID NO: 226525 - DNA, 25 bp, Mus musculus
ccgaggatcctgcttatggggctcc

SEQ ID NO: 226526 - DNA, 25 bp, Mus musculus
cgctgacagctccaagccgaggatc

SEQ ID NO: 226527 - DNA, 25 bp, Mus musculus
cagttacggcgcagccgactcgttc

SEQ ID NO: 226528 - DNA, 25 bp, Mus musculus
ggtccagcaccatgtccctgcagta

SEQ ID NO: 226529 - DNA, 25 bp, Mus musculus
tctgccgctgctagtcaggtgattc

SEQ ID NO: 226530 - DNA, 25 bp, Mus musculus
agcggcaaatcctccatccagaagg

SEQ ID NO: 226531 - DNA, 25 bp, Mus musculus
ggcagcccgcccagccaataataaa

SEQ ID NO: 226532 - DNA, 25 bp, Mus musculus
gtaccacttaccctgttgtcccaga

SEQ ID NO: 226533 - DNA, 25 bp, Mus musculus
aagggttgctccgtctgtctccgag

SEQ ID NO: 226534 - DNA, 25 bp, Mus musculus
gtctggggcgcagcactgagtcaca

SEQ ID NO: 226535 - DNA, 25 bp, Mus musculus
agtcacagcggctgacccagcaaag

SEQ ID NO: 226536 - DNA, 25 bp, Mus musculus
agcggctgacccagcaaagtgctgc

SEQ ID NO: 226537 - DNA, 25 bp, Mus musculus
ccagcaaagtgctgcgagtgtgacc

SEQ ID NO: 226538 - DNA, 25 bp, Mus musculus
caaagtgctgcgagtgtgaccggaa

SEQ ID NO: 226539 - DNA, 25 bp, Mus musculus
aatgaagggttgctccgtctgtctc

SEQ ID NO: 226540 - DNA, 25 bp, Mus musculus
gtgtgcacagccacgtgcgccagcc

SEQ ID NO: 226541 - DNA, 25 bp, Mus musculus
ctccgtctgtctccgaggtggcgtg

SEQ ID NO: 226542 - DNA, 25 bp, Mus musculus
aggtggcgtggcagatcaaatcaca

SEQ ID NO: 226543 - DNA, 25 bp, Mus musculus
tggcgtggcagatcaaatcacagcg

SEQ ID NO: 226544 - DNA, 25 bp, Mus musculus
tggcagatcaaatcacagcggatca

SEQ ID NO: 226545 - DNA, 25 bp, Mus musculus
tgtgaccggaatgaagggttgctcc

SEQ ID NO: 226546 - DNA, 25 bp, Mus musculus
agcactgagtcacagcggctgaccc

SEQ ID NO: 226547 - DNA, 25 bp, Mus musculus
ctctcagggctctttacatttgctc

SEQ ID NO: 226548 - DNA, 25 bp, Mus musculus
gtttgagtagcagcggcccagactc

SEQ ID NO: 226549 - DNA, 25 bp, Mus musculus
gcccgcgcctgtgtttgagtagcag

SEQ ID NO: 226550 - DNA, 25 bp, Mus musculus
ctgagcgccgacttctccaaagggc

SEQ ID NO: 226551 - DNA, 25 bp, Mus musculus
tagcgtttccgctgagcgccgactt

SEQ ID NO: 226552 - DNA, 25 bp, Mus musculus
cccgcggagttagcgtttccgctga

SEQ ID NO: 226553 - DNA, 25 bp, Mus musculus
acatttgctcttgcccgcggagtta

SEQ ID NO: 226554 - DNA, 25 bp, Mus musculus
cccggcttctgctgatctgtctttt

SEQ ID NO: 226555 - DNA, 25 bp, Mus musculus
ttgcacaaagtgctctcagggctct

SEQ ID NO: 226556 - DNA, 25 bp, Mus musculus
cacttcccggcctgatatttgcaca

SEQ ID NO: 226557 - DNA, 25 bp, Mus musculus
tgacggcaaagtgaattagcgcgca

SEQ ID NO: 226558 - DNA, 25 bp, Mus musculus
ccgcgcccttagaacgcttcgtctg

SEQ ID NO: 226559 - DNA, 25 bp, Mus musculus
ttttgctccattaggcagggccgcg

SEQ ID NO: 226560 - DNA, 25 bp, Mus musculus
tgctgatctgtcttttgctccatta

SEQ ID NO: 226561 - DNA, 25 bp, Mus musculus
tgggacgcgtctcacctagctcgcg

SEQ ID NO: 226562 - DNA, 25 bp, Mus musculus
agaaaggcccgtcagtgaatcgctg

SEQ ID NO: 226563 - DNA, 25 bp, Mus musculus
tgaatcgctgggaaaacatgcccta

SEQ ID NO: 226564 - DNA, 25 bp, Mus musculus
atgccctaacaaacgccctgtaatg

SEQ ID NO: 226565 - DNA, 25 bp, Mus musculus
gccctgtaatgaggggctccgcttt

SEQ ID NO: 226566 - DNA, 25 bp, Mus musculus
ctccgcttttgcaggcgtagcagtg

SEQ ID NO: 226567 - DNA, 25 bp, Mus musculus
tagcccgtttttgttgtgtggctcc

SEQ ID NO: 226568 - DNA, 25 bp, Mus musculus
cccggtgcctttgtgtgcaaatttc

SEQ ID NO: 226569 - DNA, 25 bp, Mus musculus
tgcaaatttcccaccggggccaagc

SEQ ID NO: 226570 - DNA, 25 bp, Mus musculus
gggccaagcaactttccacaattta

SEQ ID NO: 226571 - DNA, 25 bp, Mus musculus
taagtggctttagagtccggagttg

SEQ ID NO: 226572 - DNA, 25 bp, Mus musculus
agagtccggagttggcctaacaagc

SEQ ID NO: 226573 - DNA, 25 bp, Mus musculus
ggcctaacaagctcccgttcatgaa

SEQ ID NO: 226574 - DNA, 25 bp, Mus musculus
cgttcatgaatgaaagatttgtccc

SEQ ID NO: 226575 - DNA, 25 bp, Mus musculus
agcgctgctttcacaccgactcgag

SEQ ID NO: 226576 - DNA, 25 bp, Mus musculus
ccgcaccgcgaaactttacgctgta

SEQ ID NO: 226577 - DNA, 25 bp, Mus musculus
agttaatccactgaagcgtagccca

SEQ ID NO: 226578 - DNA, 25 bp, Mus musculus
gtagcccaaaataagcgcactgcct

SEQ ID NO: 226579 - DNA, 25 bp, Mus musculus
actgcctaatgtgccgggaactgcc

SEQ ID NO: 226580 - DNA, 25 bp, Mus musculus
caaggccagactgcaagcggatgtc

SEQ ID NO: 226581 - DNA, 25 bp, Mus musculus
cggagcctgcatttagcgccagcga

SEQ ID NO: 226582 - DNA, 25 bp, Mus musculus
cgagccgcgagtttatggatcttga

SEQ ID NO: 226583 - DNA, 25 bp, Mus musculus
ggatcttgattgcacccagcaggga

SEQ ID NO: 226584 - DNA, 25 bp, Mus musculus
cccagcagggaatcctttttagtga

SEQ ID NO: 226585 - DNA, 25 bp, Mus musculus
ctttgcattgggtgtgttggacaca

SEQ ID NO: 226586 - DNA, 25 bp, Mus musculus
gttggacacacttccctgcttcgga

SEQ ID NO: 226587 - DNA, 25 bp, Mus musculus
tgtcagcaggccagaacgcgcctct

SEQ ID NO: 226588 - DNA, 25 bp, Mus musculus
cttcggaatcagacatatgcgggtt

SEQ ID NO: 226589 - DNA, 25 bp, Mus musculus
gcagcctgagattaaggcggcaaaa

SEQ ID NO: 226590 - DNA, 25 bp, Mus musculus
caaaaggcgcgtcgccgcttcgagt

SEQ ID NO: 226591 - DNA, 25 bp, Mus musculus
cgcttcgagtcgctccagggtgtcc

SEQ ID NO: 226592 - DNA, 25 bp, Mus musculus
aacctgggtctcaggggactgctgc

SEQ ID NO: 226593 - DNA, 25 bp, Mus musculus
tacagcatgaggaggatcccagagc

SEQ ID NO: 226594 - DNA, 25 bp, Mus musculus
ctggtggcaacgagcaacaacatcc

SEQ ID NO: 226595 - DNA, 25 bp, Mus musculus
caggccttaggtcgcagcaactcca

SEQ ID NO: 226596 - DNA, 25 bp, Mus musculus
cagcaactccagagactgagcgtct

SEQ ID NO: 226597 - DNA, 25 bp, Mus musculus
tgagcgtctctaaggccgtcgtgca

SEQ ID NO: 226598 - DNA, 25 bp, Mus musculus
ccctgaggctgctctccaacgagag

SEQ ID NO: 226599 - DNA, 25 bp, Mus musculus
gatgtacctattccagagtcgggca

SEQ ID NO: 226600 - DNA, 25 bp, Mus musculus
tcgggcagggatgtacggttctcac

SEQ ID NO: 226601 - DNA, 25 bp, Mus musculus
aacatccgaaagagccagcggcgcg

SEQ ID NO: 226602 - DNA, 25 bp, Mus musculus
cagcgtgctccggaccgagcaaagg

SEQ ID NO: 226603 - DNA, 25 bp, Mus musculus
aggagaccgactcgtccagcggcag

SEQ ID NO: 226604 - DNA, 25 bp, Mus musculus
tcaatggctacccacgggaggaggc

SEQ ID NO: 226605 - DNA, 25 bp, Mus musculus
cacgtccatcgaggtgggtgtcaaa

SEQ ID NO: 226606 - DNA, 25 bp, Mus musculus
gggcctagcgcaccctcaatggcta

SEQ ID NO: 226607 - DNA, 25 bp, Mus musculus
ccaacctggacaagatcgcggcgca

SEQ ID NO: 226608 - DNA, 25 bp, Mus musculus
ccgcacctggaacacggcaaggcag

SEQ ID NO: 226609 - DNA, 25 bp, Mus musculus
acaaggcggcacagcgcaccacttg

SEQ ID NO: 226610 - DNA, 25 bp, Mus musculus
tgcaccacgcactgcacgaggacgg

SEQ ID NO: 226611 - DNA, 25 bp, Mus musculus
acacggacacgcacacggacatgca

SEQ ID NO: 226612 - DNA, 25 bp, Mus musculus
cactcggacgaggatgctcccagct

SEQ ID NO: 226613 - DNA, 25 bp, Mus musculus
tcgccaagcagttcaagcaacgacg

SEQ ID NO: 226614 - DNA, 25 bp, Mus musculus
ctgggcaccctctacggtaacgtgt

SEQ ID NO: 226615 - DNA, 25 bp, Mus musculus
gcgtaccgcgaagtgcagaagctga

SEQ ID NO: 226616 - DNA, 25 bp, Mus musculus
acggccacgaggcacagctggagcc

SEQ ID NO: 226617 - DNA, 25 bp, Mus musculus
ctcggctcggttcctggcctagcag

SEQ ID NO: 226618 - DNA, 25 bp, Mus musculus
caagaaccttgcgcctgtttcccta

SEQ ID NO: 226619 - DNA, 25 bp, Mus musculus
gccttgcccctcctggccttaacga

SEQ ID NO: 226620 - DNA, 25 bp, Mus musculus
gagcacgcatcgcgggccactgctt

SEQ ID NO: 226621 - DNA, 25 bp, Mus musculus
acccgcaagaccgagcacgcatcgc

SEQ ID NO: 226622 - DNA, 25 bp, Mus musculus
atctccacccgcaagaccgagcacg

SEQ ID NO: 226623 - DNA, 25 bp, Mus musculus
ggggcatctccacccgcaagaccga

SEQ ID NO: 226624 - DNA, 25 bp, Mus musculus
gaaggggcatctccacccgcaagac

SEQ ID NO: 226625 - DNA, 25 bp, Mus musculus
ggaaggggcatctccacccgcaaga

SEQ ID NO: 226626 - DNA, 25 bp, Mus musculus
tgggaaggggcatctccacccgcaa

SEQ ID NO: 226627 - DNA, 25 bp, Mus musculus
cgcacacccgggtgggaaggggcat

SEQ ID NO: 226628 - DNA, 25 bp, Mus musculus
ggctcggttcctggcctagcagaga

SEQ ID NO: 226629 - DNA, 25 bp, Mus musculus
tcggctcggttcctggcctagcaga

SEQ ID NO: 226630 - DNA, 25 bp, Mus musculus
ttgcgcctgtttccctaccgcttcc

SEQ ID NO: 226631 - DNA, 25 bp, Mus musculus
ctcctgcgggcaagagctaccaggc

SEQ ID NO: 226632 - DNA, 25 bp, Mus musculus
aggcacagataacctggaagggaca

SEQ ID NO: 226633 - DNA, 25 bp, Mus musculus
gctctgccggctcaccggtctttag

SEQ ID NO: 226634 - DNA, 25 bp, Mus musculus
tctttagccgggagcttcggatcca

SEQ ID NO: 226635 - DNA, 25 bp, Mus musculus
gacagagccctacaagccagtccga

SEQ ID NO: 226636 - DNA, 25 bp, Mus musculus
gccagtccgaaaagcgggctgtttc

SEQ ID NO: 226637 - DNA, 25 bp, Mus musculus
ggctgtttccagacccggacgcact

SEQ ID NO: 226638 - DNA, 25 bp, Mus musculus
ggacgcactgggcacttaccagctg

SEQ ID NO: 226639 - DNA, 25 bp, Mus musculus
ctgcagtgcgcagagacagaccagc

SEQ ID NO: 226640 - DNA, 25 bp, Mus musculus
cagcagcgccgcttgagagagatct

SEQ ID NO: 226641 - DNA, 25 bp, Mus musculus
tccggctgtatcctgcgacttcaga

SEQ ID NO: 226642 - DNA, 25 bp, Mus musculus
gcggccggctttctgctttcggact

SEQ ID NO: 226643 - DNA, 25 bp, Mus musculus
gctcgctgtcgcctttgttaatctg

SEQ ID NO: 226644 - DNA, 25 bp, Mus musculus
acccaagcgcgtgggaccagaagtg

SEQ ID NO: 226645 - DNA, 25 bp, Mus musculus
gtctaggaaatgctcagcaaactcc

SEQ ID NO: 226646 - DNA, 25 bp, Mus musculus
cgtccgccaagacaccggaagcagg

SEQ ID NO: 226647 - DNA, 25 bp, Mus musculus
cctactgaggtctaggaaatgctca

SEQ ID NO: 226648 - DNA, 25 bp, Mus musculus
gctgtcccgtatccggatgcaggga

SEQ ID NO: 226649 - DNA, 25 bp, Mus musculus
ccgtatccggatgcagggacagcga

SEQ ID NO: 226650 - DNA, 25 bp, Mus musculus
cctgaggcttgcgagggcctacctg

SEQ ID NO: 226651 - DNA, 25 bp, Mus musculus
cgagggcctacctggcttcgttctc

SEQ ID NO: 226652 - DNA, 25 bp, Mus musculus
tggcttcgttctcggtgttcccgct

SEQ ID NO: 226653 - DNA, 25 bp, Mus musculus
tcggtgttcccgctgccgggtcttg

SEQ ID NO: 226654 - DNA, 25 bp, Mus musculus
tggctgccttgcgaaaagccgccga

SEQ ID NO: 226655 - DNA, 25 bp, Mus musculus
gaaaagccgccgacatgcctactga

SEQ ID NO: 226656 - DNA, 25 bp, Mus musculus
ccgccgacatgcctactgaggtcta

SEQ ID NO: 226657 - DNA, 25 bp, Mus musculus
acaccggaagcaggcccaagacgcg

SEQ ID NO: 226658 - DNA, 25 bp, Mus musculus
ggaaatgctcagcaaactccaccac

SEQ ID NO: 226659 - DNA, 25 bp, Mus musculus
tcgaggaggtcagagcaccaggttc

SEQ ID NO: 226660 - DNA, 25 bp, Mus musculus
cttctgctggggcatcccgaattcg

SEQ ID NO: 226661 - DNA, 25 bp, Mus musculus
ctgtcttctgctggggcatcccgaa

SEQ ID NO: 226662 - DNA, 25 bp, Mus musculus
ctcggaccagggtcgctctctgggc

SEQ ID NO: 226663 - DNA, 25 bp, Mus musculus
gcgcccgcttcgaggtgagagtccc

SEQ ID NO: 226664 - DNA, 25 bp, Mus musculus
agccgccgggcgatcggctcccgcc

SEQ ID NO: 226665 - DNA, 25 bp, Mus musculus
gcctggcccacaggtaggagccgcc

SEQ ID NO: 226666 - DNA, 25 bp, Mus musculus
cagccggctacctcgccgctgctct

SEQ ID NO: 226667 - DNA, 25 bp, Mus musculus
ccacacagtcagtcgcagccggcta

SEQ ID NO: 226668 - DNA, 25 bp, Mus musculus
cacttcctcggaggcttagggccgc

SEQ ID NO: 226669 - DNA, 25 bp, Mus musculus
gcccgagcacttcctcggaggctta

SEQ ID NO: 226670 - DNA, 25 bp, Mus musculus
cagagcaccaggttcgactgggctg

SEQ ID NO: 226671 - DNA, 25 bp, Mus musculus
gaggtcagagcaccaggttcgactg

SEQ ID NO: 226672 - DNA, 25 bp, Mus musculus
ctgctggggcatcccgaattcggga

SEQ ID NO: 226673 - DNA, 25 bp, Mus musculus
cgcctctcgtgattcactggcgggg

SEQ ID NO: 226674 - DNA, 25 bp, Mus musculus
gccaaaaaaggcaaggaagcagctg

SEQ ID NO: 226675 - DNA, 25 bp, Mus musculus
gcggttgaactgaggcggcaggtat

SEQ ID NO: 226676 - DNA, 25 bp, Mus musculus
gccgctggctctgcggttgaactga

SEQ ID NO: 226677 - DNA, 25 bp, Mus musculus
tagcctggccgctggctctgcggtt

SEQ ID NO: 226678 - DNA, 25 bp, Mus musculus
cgatggggcggagcactcccctgct

SEQ ID NO: 226679 - DNA, 25 bp, Mus musculus
tcccagcatgaatgggtcatggccc

SEQ ID NO: 226680 - DNA, 25 bp, Mus musculus
tccgattcccagcatgaatgggtca

SEQ ID NO: 226681 - DNA, 25 bp, Mus musculus
ctggatccgattcccagcatgaatg

SEQ ID NO: 226682 - DNA, 25 bp, Mus musculus
ccgggagaacatctggatccgattc

SEQ ID NO: 226683 - DNA, 25 bp, Mus musculus
gcacgcgccgggagaacatctggat

SEQ ID NO: 226684 - DNA, 25 bp, Mus musculus
aaaggcaaggaagcagctgcacgcg

SEQ ID NO: 226685 - DNA, 25 bp, Mus musculus
tcgcggccgcacgtttttttgccaa

SEQ ID NO: 226686 - DNA, 25 bp, Mus musculus
tgctggacgccctagcctggccgct

SEQ ID NO: 226687 - DNA, 25 bp, Mus musculus
gctcggcactctggcctcgttaacg

SEQ ID NO: 226688 - DNA, 25 bp, Mus musculus
cgcactcgggccatgcaagatgtga

SEQ ID NO: 226689 - DNA, 25 bp, Mus musculus
tgcagcttcgggaccagatcaattc

SEQ ID NO: 226690 - DNA, 25 bp, Mus musculus
atgtgttaccgtttgcctttctgca

SEQ ID NO: 226691 - DNA, 25 bp, Mus musculus
tcgggtgctctttccaactgctaaa

SEQ ID NO: 226692 - DNA, 25 bp, Mus musculus
tcgcgctgtatttggcctcggagct

SEQ ID NO: 226693 - DNA, 25 bp, Mus musculus
tgggacctaaaccaataagcgcatc

SEQ ID NO: 226694 - DNA, 25 bp, Mus musculus
cacgcggaactttggtgcagccgga

SEQ ID NO: 226695 - DNA, 25 bp, Mus musculus
cttacgaagaagtccacggtgagtg

SEQ ID NO: 226696 - DNA, 25 bp, Mus musculus
ctatcatgaggagaaggaacggctt

SEQ ID NO: 226697 - DNA, 25 bp, Mus musculus
ttagagcagcaacggcgctatcatg

SEQ ID NO: 226698 - DNA, 25 bp, Mus musculus
gtccgccttgaaacgccgtggccaa

SEQ ID NO: 226699 - DNA, 25 bp, Mus musculus
tagcacccgcttgctctcttcgtgg

SEQ ID NO: 226700 - DNA, 25 bp, Mus musculus
tttccggcagtgttagtggtccgcc

SEQ ID NO: 226701 - DNA, 25 bp, Mus musculus
gatcccgagttcgagtggctgtcaa

SEQ ID NO: 226702 - DNA, 25 bp, Mus musculus
ggctgtcaagacacacatgcgcgga

SEQ ID NO: 226703 - DNA, 25 bp, Mus musculus
gagcccgatgccgagtcgccgaaac

SEQ ID NO: 226704 - DNA, 25 bp, Mus musculus
ttcgcgcccattggaggaagcaggc

SEQ ID NO: 226705 - DNA, 25 bp, Mus musculus
ggaagcaggcatcagtctcggaatg

SEQ ID NO: 226706 - DNA, 25 bp, Mus musculus
ctacattctgctttggggcggagcc

SEQ ID NO: 226707 - DNA, 25 bp, Mus musculus
agttctgctgggaagttactctccg

SEQ ID NO: 226708 - DNA, 25 bp, Mus musculus
ccggaatttctattggcggaggaga

SEQ ID NO: 226709 - DNA, 25 bp, Mus musculus
gtgacctcgtgctgcttgcttactc

SEQ ID NO: 226710 - DNA, 25 bp, Mus musculus
tgcttactcccattggcgttttggt

SEQ ID NO: 226711 - DNA, 25 bp, Mus musculus
tttctccggccgaggtagttcctca

SEQ ID NO: 226712 - DNA, 25 bp, Mus musculus
tagttcctcagtcctggcctttcga

SEQ ID NO: 226713 - DNA, 25 bp, Mus musculus
agccgctgaggagccggaatttcta

SEQ ID NO: 226714 - DNA, 25 bp, Mus musculus
caggtacccgggagtcctaaggcag

SEQ ID NO: 226715 - DNA, 25 bp, Mus musculus
taaaagcagaggctggactcggctg

SEQ ID NO: 226716 - DNA, 25 bp, Mus musculus
gctctgctcagcgttccggtcctgg

SEQ ID NO: 226717 - DNA, 25 bp, Mus musculus
ctggcctacgcatctggaaggcggc

SEQ ID NO: 226718 - DNA, 25 bp, Mus musculus
cggcggctgactgcagccttcttgc

SEQ ID NO: 226719 - DNA, 25 bp, Mus musculus
gcagccttcttgctgcagctgtgga

SEQ ID NO: 226720 - DNA, 25 bp, Mus musculus
tggggctgagaacacctcgacttca

SEQ ID NO: 226721 - DNA, 25 bp, Mus musculus
ttcaccgctgatgtcgcgtatcctc

SEQ ID NO: 226722 - DNA, 25 bp, Mus musculus
cgaaacagcccgctctctatggtca

SEQ ID NO: 226723 - DNA, 25 bp, Mus musculus
ctctctatggtcagcttcccggtgc

SEQ ID NO: 226724 - DNA, 25 bp, Mus musculus
ccaggtgaactatgctgcgtgggta

SEQ ID NO: 226725 - DNA, 25 bp, Mus musculus
atcacgaacagcagcaggcccaggg

SEQ ID NO: 226726 - DNA, 25 bp, Mus musculus
actggggctccctgccgtagccatt

SEQ ID NO: 226727 - DNA, 25 bp, Mus musculus
agaagtttctggagggctctgctca

SEQ ID NO: 226728 - DNA, 25 bp, Mus musculus
ccctggagagtagaagccaatcacg

SEQ ID NO: 226729 - DNA, 25 bp, Mus musculus
gaagcggctcggcacggatgtctac

SEQ ID NO: 226730 - DNA, 25 bp, Mus musculus
atccgctctagacagtcggtcgaga

SEQ ID NO: 226731 - DNA, 25 bp, Mus musculus
gcgaggagtccgctaagccgagccc

SEQ ID NO: 226732 - DNA, 25 bp, Mus musculus
ggctcgccaagatccgctctagaca

SEQ ID NO: 226733 - DNA, 25 bp, Mus musculus
aagttgcgtccgtgcgtcacttcct

SEQ ID NO: 226734 - DNA, 25 bp, Mus musculus
gcacggatgtctacggcgcgtccgt

SEQ ID NO: 226735 - DNA, 25 bp, Mus musculus
tacggcctggcctgctcggcgagca

SEQ ID NO: 226736 - DNA, 25 bp, Mus musculus
cctgagttgcgtgtaccgcctcaaa

SEQ ID NO: 226737 - DNA, 25 bp, Mus musculus
taccgcctcaaaggccgcagcgagg

SEQ ID NO: 226738 - DNA, 25 bp, Mus musculus
ccgacgtctacaggtgaggcggccc

SEQ ID NO: 226739 - DNA, 25 bp, Mus musculus
gtttccggtgacagcctcgggagac

SEQ ID NO: 226740 - DNA, 25 bp, Mus musculus
aggaatccggaactggagattggtc

SEQ ID NO: 226741 - DNA, 25 bp, Mus musculus
gagcgctgacggctcgccaagatcc

SEQ ID NO: 226742 - DNA, 25 bp, Mus musculus
accgttctccttcaagtcgcctggg

SEQ ID NO: 226743 - DNA, 25 bp, Mus musculus
ccacggcgatctcggagcgtacctg

SEQ ID NO: 226744 - DNA, 25 bp, Mus musculus
tggagtgattcggagttcggacctt

SEQ ID NO: 226745 - DNA, 25 bp, Mus musculus
ccctcgcgccctggagtgattcgga

SEQ ID NO: 226746 - DNA, 25 bp, Mus musculus
caggggcggagtttcgtcaagccca

SEQ ID NO: 226747 - DNA, 25 bp, Mus musculus
gccagcagctcgaccggcgactcca

SEQ ID NO: 226748 - DNA, 25 bp, Mus musculus
cagcagcagccaggcgagcagcagc

SEQ ID NO: 226749 - DNA, 25 bp, Mus musculus
ggcctcgtccgaggcggtgctctcc

SEQ ID NO: 226750 - DNA, 25 bp, Mus musculus
gcaagactctggaggttcaggcggc

SEQ ID NO: 226751 - DNA, 25 bp, Mus musculus
tgcaggctccggggcgcaagactct

SEQ ID NO: 226752 - DNA, 25 bp, Mus musculus
cggcgatctcggagcgtacctgcct

SEQ ID NO: 226753 - DNA, 25 bp, Mus musculus
ttcggaccttgggaggcgctgaaaa

SEQ ID NO: 226754 - DNA, 25 bp, Mus musculus
cggcgactccatcgcgccgtggccg

SEQ ID NO: 226755 - DNA, 25 bp, Mus musculus
ctccgccacgcgctcggactggctc

SEQ ID NO: 226756 - DNA, 25 bp, Mus musculus
cagcgccgtgaccagcgcgggtagc

SEQ ID NO: 226757 - DNA, 25 bp, Mus musculus
cgccgaccaagtgatcgcgagtgga

SEQ ID NO: 226758 - DNA, 25 bp, Mus musculus
tcccagtggatatagtggccctcgc

SEQ ID NO: 226759 - DNA, 25 bp, Mus musculus
gcgggctcccgtaccacgaatagta

SEQ ID NO: 226760 - DNA, 25 bp, Mus musculus
ccacgaatagtaaaaagcatgcaga

SEQ ID NO: 226761 - DNA, 25 bp, Mus musculus
gcatgcagatcggagtagacgcgca

SEQ ID NO: 226762 - DNA, 25 bp, Mus musculus
gacgcctctcgaacggtgctagttc

SEQ ID NO: 226763 - DNA, 25 bp, Mus musculus
ctaacagctccggagtcgcgccatt

SEQ ID NO: 226764 - DNA, 25 bp, Mus musculus
acacaagatgcagtggcgccgacca

SEQ ID NO: 226765 - DNA, 25 bp, Mus musculus
cccaagtcatctggagggctgtggc

SEQ ID NO: 226766 - DNA, 25 bp, Mus musculus
ccgagcgtacctgagatctgggtcg

SEQ ID NO: 226767 - DNA, 25 bp, Mus musculus
gggcccggcacacacaagatgcagt

SEQ ID NO: 226768 - DNA, 25 bp, Mus musculus
tccgggtagaagctggagcccaagt

SEQ ID NO: 226769 - DNA, 25 bp, Mus musculus
cacgcgggtaactggccgagatctt

SEQ ID NO: 226770 - DNA, 25 bp, Mus musculus
cccagtgcggcaccatgacatggtc

SEQ ID NO: 226771 - DNA, 25 bp, Mus musculus
agtgcctacttctcaggattcaggg

SEQ ID NO: 226772 - DNA, 25 bp, Mus musculus
ccatggatgatggtgaccagcgaga

SEQ ID NO: 226773 - DNA, 25 bp, Mus musculus
cgcggcgatgcctagcgattggtcc

SEQ ID NO: 226774 - DNA, 25 bp, Mus musculus
attggtggacctcccgcggcgatgc

SEQ ID NO: 226775 - DNA, 25 bp, Mus musculus
tctgctgacccggattggtggacct

SEQ ID NO: 226776 - DNA, 25 bp, Mus musculus
gcaaccctgctaacgctcagagctg

SEQ ID NO: 226777 - DNA, 25 bp, Mus musculus
gcccacagtgcctacttctcaggat

SEQ ID NO: 226778 - DNA, 25 bp, Mus musculus
tcaggattcagggagctaaggttta

SEQ ID NO: 226779 - DNA, 25 bp, Mus musculus
ttaagggtctctagtccaccgacgc

SEQ ID NO: 226780 - DNA, 25 bp, Mus musculus
gccagcttgtctcgctcgccagcaa

SEQ ID NO: 226781 - DNA, 25 bp, Mus musculus
ctcatcctctgctgacccggattgg

SEQ ID NO: 226782 - DNA, 25 bp, Mus musculus
atgatggtgaccagcgagactccgc

SEQ ID NO: 226783 - DNA, 25 bp, Mus musculus
ccctccgtaagccacgcccacagtg

SEQ ID NO: 226784 - DNA, 25 bp, Mus musculus
agggtctctagtccaccgacgccag

SEQ ID NO: 226785 - DNA, 25 bp, Mus musculus
gcagatgcctgccaggatgcaattc

SEQ ID NO: 226786 - DNA, 25 bp, Mus musculus
gctgcccgtggaactgtccgcagtg

SEQ ID NO: 226787 - DNA, 25 bp, Mus musculus
cgcagtgctgaatcgagatcgagtc

SEQ ID NO: 226788 - DNA, 25 bp, Mus musculus
ggatttgggtctgtcggcgacatta

SEQ ID NO: 226789 - DNA, 25 bp, Mus musculus
ggcgacattagcaccggagtcttgc

SEQ ID NO: 226790 - DNA, 25 bp, Mus musculus
cggagtcttgcctatgcgcttggaa

SEQ ID NO: 226791 - DNA, 25 bp, Mus musculus
cctatgcgcttggaactgtatgttc

SEQ ID NO: 226792 - DNA, 25 bp, Mus musculus
atgttcagttgaatccagacgcgtc

SEQ ID NO: 226793 - DNA, 25 bp, Mus musculus
tccagacgcgtcacaaccaggtgca

SEQ ID NO: 226794 - DNA, 25 bp, Mus musculus
accaggtgcagaacctgagatgctg

SEQ ID NO: 226795 - DNA, 25 bp, Mus musculus
cggtcggtgacgaaaacccagcaca

SEQ ID NO: 226796 - DNA, 25 bp, Mus musculus
agactctgcccgcagggtctgtcct

SEQ ID NO: 226797 - DNA, 25 bp, Mus musculus
atgcaattcccaggcacggtcggtg

SEQ ID NO: 226798 - DNA, 25 bp, Mus musculus
tgagatgctggaacagactctgccc

SEQ ID NO: 226799 - DNA, 25 bp, Mus musculus
cagatgccactctgcaagagaaaga

SEQ ID NO: 226800 - DNA, 25 bp, Mus musculus
aaggcaagtgtaaagcggccgcgtc

SEQ ID NO: 226801 - DNA, 25 bp, Mus musculus
gaagagcgtgtaccagatgccactc

SEQ ID NO: 226802 - DNA, 25 bp, Mus musculus
gcaggttactggaagagcgtgtacc

SEQ ID NO: 226803 - DNA, 25 bp, Mus musculus
cgttgctccagatggcgcaggttac

SEQ ID NO: 226804 - DNA, 25 bp, Mus musculus
ggcaaagtcactcacgctgccgttg

SEQ ID NO: 226805 - DNA, 25 bp, Mus musculus
cacgggcgacttggggcaaagtcac

SEQ ID NO: 226806 - DNA, 25 bp, Mus musculus
gacgaacgcatgcaccgagggaaca

SEQ ID NO: 226807 - DNA, 25 bp, Mus musculus
cccgagaaagttggacgaacgcatg

SEQ ID NO: 226808 - DNA, 25 bp, Mus musculus
cccggacacccaaagcaatgaggaa

SEQ ID NO: 226809 - DNA, 25 bp, Mus musculus
aacactgaagttcgcggctcgggag

SEQ ID NO: 226810 - DNA, 25 bp, Mus musculus
ggcaagattctggagcgaacactga

SEQ ID NO: 226811 - DNA, 25 bp, Mus musculus
gtcttccctggcgtcggttgcttag

SEQ ID NO: 226812 - DNA, 25 bp, Mus musculus
gcggccacagccactttataattaa

SEQ ID NO: 226813 - DNA, 25 bp, Mus musculus
ctgtacaccgtgaaggccggcatga

SEQ ID NO: 226814 - DNA, 25 bp, Mus musculus
ccactcagataggagatggactcgg

SEQ ID NO: 226815 - DNA, 25 bp, Mus musculus
tggactcggggtatttgagcagccc

SEQ ID NO: 226816 - DNA, 25 bp, Mus musculus
agcagcccgcccaagtgcagcttga

SEQ ID NO: 226817 - DNA, 25 bp, Mus musculus
tagagcaggtctccgctgtacaccg

SEQ ID NO: 226818 - DNA, 25 bp, Mus musculus
tgtgcatggcgatctcgcggtcgat

SEQ ID NO: 226819 - DNA, 25 bp, Mus musculus
cgcctgggtagaatggcaggcctcc

SEQ ID NO: 226820 - DNA, 25 bp, Mus musculus
gagcccgctccacgtgcttgaaggc

SEQ ID NO: 226821 - DNA, 25 bp, Mus musculus
cacaagtggcctgtcttgggcttgc

SEQ ID NO: 226822 - DNA, 25 bp, Mus musculus
tgcgcgagtacagcttgccacagta

SEQ ID NO: 226823 - DNA, 25 bp, Mus musculus
tcttgagcccgtacttgcgcgagta

SEQ ID NO: 226824 - DNA, 25 bp, Mus musculus
ccgcatgtggatcttgagcccgtac

SEQ ID NO: 226825 - DNA, 25 bp, Mus musculus
ctgccatctcggacagctgctgtgt

SEQ ID NO: 226826 - DNA, 25 bp, Mus musculus
tgcttgaaggccgacgcctcttccg

SEQ ID NO: 226827 - DNA, 25 bp, Mus musculus
caactggcttcagacaggctggatc

SEQ ID NO: 226828 - DNA, 25 bp, Mus musculus
gtctactacaagcagtgccgcgcca

SEQ ID NO: 226829 - DNA, 25 bp, Mus musculus
ctgatgagagcttcacgcagggtga

SEQ ID NO: 226830 - DNA, 25 bp, Mus musculus
agaccttcaacgcatactacctaga

SEQ ID NO: 226831 - DNA, 25 bp, Mus musculus
cacgggcacctgcaaagagaccttc

SEQ ID NO: 226832 - DNA, 25 bp, Mus musculus
agtagcataccaggtgccacgggca

SEQ ID NO: 226833 - DNA, 25 bp, Mus musculus
ccgcatgcactgtggtgccgatggc

SEQ ID NO: 226834 - DNA, 25 bp, Mus musculus
ttcgtggagctgcagttcacactgc

SEQ ID NO: 226835 - DNA, 25 bp, Mus musculus
ttctccacgctggtggaagtggctg

SEQ ID NO: 226836 - DNA, 25 bp, Mus musculus
gctggagcccaaccaggacaactgg

SEQ ID NO: 226837 - DNA, 25 bp, Mus musculus
gtcccatccgcacgtaccaagtgtg

SEQ ID NO: 226838 - DNA, 25 bp, Mus musculus
cgtggatgaacacgaccgtcccatc

SEQ ID NO: 226839 - DNA, 25 bp, Mus musculus
cacactgcgcgactgcagtagcata

SEQ ID NO: 226840 - DNA, 25 bp, Mus musculus
tggtctcggtgcgtgtctactacaa

SEQ ID NO: 226841 - DNA, 25 bp, Mus musculus
agcgcgccgccacgctgctgcacct

SEQ ID NO: 226842 - DNA, 25 bp, Mus musculus
gacctgcagtacagcctgagccgct

SEQ ID NO: 226843 - DNA, 25 bp, Mus musculus
gcgcaggtcacagtgtccaccggac

SEQ ID NO: 226844 - DNA, 25 bp, Mus musculus
cctatgcgcaggtcacagtgtccac

SEQ ID NO: 226845 - DNA, 25 bp, Mus musculus
gtggccgcgctcaacggcgtctcag

SEQ ID NO: 226846 - DNA, 25 bp, Mus musculus
acctactcgctgctgtgcctgcgct

SEQ ID NO: 226847 - DNA, 25 bp, Mus musculus
cctcgatctccgtacccgcgctgct

SEQ ID NO: 226848 - DNA, 25 bp, Mus musculus
cccacgtctgccaccttccttactg

SEQ ID NO: 226849 - DNA, 25 bp, Mus musculus
tccttactgctcctacgccgggtgt

SEQ ID NO: 226850 - DNA, 25 bp, Mus musculus
ttactgctcctacgccgggtgtcca

SEQ ID NO: 226851 - DNA, 25 bp, Mus musculus
ccctgcccggttccactcagcgcct

SEQ ID NO: 226852 - DNA, 25 bp, Mus musculus
ggccgctccgacgtcacctactcgc

SEQ ID NO: 226853 - DNA, 25 bp, Mus musculus
ccgcgggacctgcagtacagcctga

SEQ ID NO: 226854 - DNA, 25 bp, Mus musculus
gggagccacctatgcgcaggtcaca

SEQ ID NO: 226855 - DNA, 25 bp, Mus musculus
gtccttcaggaaggaggcgagcttc

SEQ ID NO: 226856 - DNA, 25 bp, Mus musculus
ctcagcgttgacatcgcaggattta

SEQ ID NO: 226857 - DNA, 25 bp, Mus musculus
ttaccctcgcggtcgaagtccttca

SEQ ID NO: 226858 - DNA, 25 bp, Mus musculus
ttcagtcgttggagtctaggtttcc

SEQ ID NO: 226859 - DNA, 25 bp, Mus musculus
cctgcaggtcccaaaacacagtctg

SEQ ID NO: 226860 - DNA, 25 bp, Mus musculus
ctcaacgggcacagcctagccaata

SEQ ID NO: 226861 - DNA, 25 bp, Mus musculus
taggacggttctcaccacgcccaat

SEQ ID NO: 226862 - DNA, 25 bp, Mus musculus
ttccgccagccaatcctcatggagg

SEQ ID NO: 226863 - DNA, 25 bp, Mus musculus
ccagatgtcattgcggcacacgcca

SEQ ID NO: 226864 - DNA, 25 bp, Mus musculus
acgccatcttttcgcgactccagag

SEQ ID NO: 226865 - DNA, 25 bp, Mus musculus
cagagtcgtgctaactggaagtaga

SEQ ID NO: 226866 - DNA, 25 bp, Mus musculus
cgttcttgtgaataagcgcggtgta

SEQ ID NO: 226867 - DNA, 25 bp, Mus musculus
gcgcggtgtagtttttgatgtactc

SEQ ID NO: 226868 - DNA, 25 bp, Mus musculus
tggaggacttcaatgcccagatgtc

SEQ ID NO: 226869 - DNA, 25 bp, Mus musculus
ttcgccatacagcagacggcgcgtc

SEQ ID NO: 226870 - DNA, 25 bp, Mus musculus
tgtgacccaaccctgacccacgcga

SEQ ID NO: 226871 - DNA, 25 bp, Mus musculus
agccttgcccatgcatcccagctgc

SEQ ID NO: 226872 - DNA, 25 bp, Mus musculus
agctgcaactcagctgcgactcagc

SEQ ID NO: 226873 - DNA, 25 bp, Mus musculus
acacaccctagagcagcgacccagc

SEQ ID NO: 226874 - DNA, 25 bp, Mus musculus
cacgcgaccgggtctggttcgcgta

SEQ ID NO: 226875 - DNA, 25 bp, Mus musculus
cctcccagcctgacgcagtagaagg

SEQ ID NO: 226876 - DNA, 25 bp, Mus musculus
cctgacgcagtagaaggccgatgcg

SEQ ID NO: 226877 - DNA, 25 bp, Mus musculus
ctgggtccacgtccgggcgcagtca

SEQ ID NO: 226878 - DNA, 25 bp, Mus musculus
aagggaacgtgagctcgcagcgttc

SEQ ID NO: 226879 - DNA, 25 bp, Mus musculus
gacggcgcgtccctagtcctggtgt

SEQ ID NO: 226880 - DNA, 25 bp, Mus musculus
agctcgcagcgttcgccatacagca

SEQ ID NO: 226881 - DNA, 25 bp, Mus musculus
gcatcccaacggcaacccagctgtg

SEQ ID NO: 226882 - DNA, 25 bp, Mus musculus
ccgagaaggcattgagcaactgggc

SEQ ID NO: 226883 - DNA, 25 bp, Mus musculus
ccctgtgagcctaagtgggtgcgcc

SEQ ID NO: 226884 - DNA, 25 bp, Mus musculus
gccaaacgaccgaccggtccaatga

SEQ ID NO: 226885 - DNA, 25 bp, Mus musculus
cgaccgaccggtccaatgacaacta

SEQ ID NO: 226886 - DNA, 25 bp, Mus musculus
gaccggtccaatgacaactaaacca

SEQ ID NO: 226887 - DNA, 25 bp, Mus musculus
ggtccaatgacaactaaaccatgtg

SEQ ID NO: 226888 - DNA, 25 bp, Mus musculus
tgacaactaaaccatgtgcacagcc

SEQ ID NO: 226889 - DNA, 25 bp, Mus musculus
tgggtgcgccggtgcactctctcag

SEQ ID NO: 226890 - DNA, 25 bp, Mus musculus
aactaaaccatgtgcacagcctcgc

SEQ ID NO: 226891 - DNA, 25 bp, Mus musculus
gggaacaggtcaaacgctcaccctg

SEQ ID NO: 226892 - DNA, 25 bp, Mus musculus
caggtcaaacgctcaccctgtgagc

SEQ ID NO: 226893 - DNA, 25 bp, Mus musculus
aacgctcaccctgtgagcctaagtg

SEQ ID NO: 226894 - DNA, 25 bp, Mus musculus
ctcaccctgtgagcctaagtgggtg

SEQ ID NO: 226895 - DNA, 25 bp, Mus musculus
gccggtgcactctctcagcgggcgt

SEQ ID NO: 226896 - DNA, 25 bp, Mus musculus
gagcccgaggttcaaggaggccaaa

SEQ ID NO: 226897 - DNA, 25 bp, Mus musculus
cgcctcctcacgcaccgagtgcaga

SEQ ID NO: 226898 - DNA, 25 bp, Mus musculus
tccgctcgtccactccaagccctcc

SEQ ID NO: 226899 - DNA, 25 bp, Mus musculus
tccttagagccgctcctcggtcgcc

SEQ ID NO: 226900 - DNA, 25 bp, Mus musculus
tcagaagcagctaccgccaccgagt

SEQ ID NO: 226901 - DNA, 25 bp, Mus musculus
ccctgctggagccgcgtggaacagc

SEQ ID NO: 226902 - DNA, 25 bp, Mus musculus
agcgagccctgccagagccgcggtt

SEQ ID NO: 226903 - DNA, 25 bp, Mus musculus
tctctccgcagagacaggcgttgcc

SEQ ID NO: 226904 - DNA, 25 bp, Mus musculus
agagccgcggttcagcgcccagatc

SEQ ID NO: 226905 - DNA, 25 bp, Mus musculus
tcggccgccaccaccatcattacct

SEQ ID NO: 226906 - DNA, 25 bp, Mus musculus
cgccgcacctctcacactaacccta

SEQ ID NO: 226907 - DNA, 25 bp, Mus musculus
tacccacggcggctcaacctccgtc

SEQ ID NO: 226908 - DNA, 25 bp, Mus musculus
gccagctgcggtccctgtcacccaa

SEQ ID NO: 226909 - DNA, 25 bp, Mus musculus
tccgcagagacaggcgttgccagct

SEQ ID NO: 226910 - DNA, 25 bp, Mus musculus
tgtcacccaagccttgctgttagac

SEQ ID NO: 226911 - DNA, 25 bp, Mus musculus
cgttgctatggaagggacgcttgac

SEQ ID NO: 226912 - DNA, 25 bp, Mus musculus
gacgcttgacggttgctagacccgg

SEQ ID NO: 226913 - DNA, 25 bp, Mus musculus
aagcgccgcgcgctctcaggaagtc

SEQ ID NO: 226914 - DNA, 25 bp, Mus musculus
gctctcaggaagtcgcgtagcgcga

SEQ ID NO: 226915 - DNA, 25 bp, Mus musculus
acgtcgcgcgtgttcagggtccaac

SEQ ID NO: 226916 - DNA, 25 bp, Mus musculus
ttcagggtccaacgtgcttcacaca

SEQ ID NO: 226917 - DNA, 25 bp, Mus musculus
tgcttcacacaggacgctttcccgg

SEQ ID NO: 226918 - DNA, 25 bp, Mus musculus
cgctttcccggctgggaagtcgtga

SEQ ID NO: 226919 - DNA, 25 bp, Mus musculus
gaagtcgtgaagtggtttacctcgc

SEQ ID NO: 226920 - DNA, 25 bp, Mus musculus
ttacctcgcgagtagcagagcggtg

SEQ ID NO: 226921 - DNA, 25 bp, Mus musculus
tcggtactgtcgtcaggatggtgaa

SEQ ID NO: 226922 - DNA, 25 bp, Mus musculus
tggtgaagcccaagtacaaaggacg

SEQ ID NO: 226923 - DNA, 25 bp, Mus musculus
tacaaaggacggagcaccatcaacc

SEQ ID NO: 226924 - DNA, 25 bp, Mus musculus
cggtgccctggacgttgctatggaa

SEQ ID NO: 226925 - DNA, 25 bp, Mus musculus
cgacaccgtgaaggcttctgggata

SEQ ID NO: 226926 - DNA, 25 bp, Mus musculus
cggaagtgcaaagctgtccgtcact

SEQ ID NO: 226927 - DNA, 25 bp, Mus musculus
gtccgtcacttcctacggctcaagt

SEQ ID NO: 226928 - DNA, 25 bp, Mus musculus
tacggctcaagtggctcaacggacc

SEQ ID NO: 226929 - DNA, 25 bp, Mus musculus
tcaacggaccgtgcaagtgactctc

SEQ ID NO: 226930 - DNA, 25 bp, Mus musculus
cgacaccggtcaggcgacgctctga

SEQ ID NO: 226931 - DNA, 25 bp, Mus musculus
tggtgaaacaggagcgtctgagccc

SEQ ID NO: 226932 - DNA, 25 bp, Mus musculus
tctggagtgcagagcacctgttgag

SEQ ID NO: 226933 - DNA, 25 bp, Mus musculus
cctgttgagttgaaatgagatttcc

SEQ ID NO: 226934 - DNA, 25 bp, Mus musculus
cgtctgcctacaaagacacgttggg

SEQ ID NO: 226935 - DNA, 25 bp, Mus musculus
acacgttgggtcttggcgacttctt

SEQ ID NO: 226936 - DNA, 25 bp, Mus musculus
gcgacttcttcgcagcactcattcg

SEQ ID NO: 226937 - DNA, 25 bp, Mus musculus
ctctgacgaccgtggtggtgaaaca

SEQ ID NO: 226938 - DNA, 25 bp, Mus musculus
agcgtctgagactcaaacacctggg

SEQ ID NO: 226939 - DNA, 25 bp, Mus musculus
gcccaacatggcgatgcacaacaag

SEQ ID NO: 226940 - DNA, 25 bp, Mus musculus
ggcaccctgctgactgccctgtagg

SEQ ID NO: 226941 - DNA, 25 bp, Mus musculus
tttggattggtgacgcgcaccagga

SEQ ID NO: 226942 - DNA, 25 bp, Mus musculus
acgcagcctagggaatttggattgg

SEQ ID NO: 226943 - DNA, 25 bp, Mus musculus
gcgggagacccaagacgcagcctag

SEQ ID NO: 226944 - DNA, 25 bp, Mus musculus
ggtgtatttgaggatgccaaggaac

SEQ ID NO: 226945 - DNA, 25 bp, Mus musculus
atgcacgatggattccatgggcggc

SEQ ID NO: 226946 - DNA, 25 bp, Mus musculus
cctggagaagatgcacgatggattc

SEQ ID NO: 226947 - DNA, 25 bp, Mus musculus
acttggcctcgcaggcagctccgga

SEQ ID NO: 226948 - DNA, 25 bp, Mus musculus
gatgcacaacaagacggcgccgccg

SEQ ID NO: 226949 - DNA, 25 bp, Mus musculus
cgacagtgcgcagggtccgcctact

SEQ ID NO: 226950 - DNA, 25 bp, Mus musculus
aggctcccgccttttacggcgagca

SEQ ID NO: 226951 - DNA, 25 bp, Mus musculus
gccgcttgagcccaacatggcgatg

SEQ ID NO: 226952 - DNA, 25 bp, Mus musculus
agatcccagacacccggcgggagct

SEQ ID NO: 226953 - DNA, 25 bp, Mus musculus
ttctattctgggaaggacaagtttc

SEQ ID NO: 226954 - DNA, 25 bp, Mus musculus
ttccacgcaccagggtgaactcagc

SEQ ID NO: 226955 - DNA, 25 bp, Mus musculus
ccggacgtcgtctgtaaggtgtcca

SEQ ID NO: 226956 - DNA, 25 bp, Mus musculus
taaggtgtccatggagccgagtctc

SEQ ID NO: 226957 - DNA, 25 bp, Mus musculus
tgacggcaccttcgtagccgcgaca

SEQ ID NO: 226958 - DNA, 25 bp, Mus musculus
ctttaagggcaatgacgcggaagcc

SEQ ID NO: 226959 - DNA, 25 bp, Mus musculus
gccacacgaagtctgggcggctcca

SEQ ID NO: 226960 - DNA, 25 bp, Mus musculus
aggcttgtaccacccgactgcttaa

SEQ ID NO: 226961 - DNA, 25 bp, Mus musculus
ttaacgccggctctgcagaagcagg

SEQ ID NO: 226962 - DNA, 25 bp, Mus musculus
gcagaagcaggttccgtgcaccatg

SEQ ID NO: 226963 - DNA, 25 bp, Mus musculus
gtgcaccatgcaaaaccggaataga

SEQ ID NO: 226964 - DNA, 25 bp, Mus musculus
cggcctcgcaggttcacttcaacaa

SEQ ID NO: 226965 - DNA, 25 bp, Mus musculus
agtctcatacttcggctcagggaca

SEQ ID NO: 226966 - DNA, 25 bp, Mus musculus
ggtcccagcgatggagacactgccc

SEQ ID NO: 226967 - DNA, 25 bp, Mus musculus
cccagtaagatgtgcgcagcgccgc

SEQ ID NO: 226968 - DNA, 25 bp, Mus musculus
cacctcgctggagcaaggggtacag

SEQ ID NO: 226969 - DNA, 25 bp, Mus musculus
tggggaaggcgccaacttctctccc

SEQ ID NO: 226970 - DNA, 25 bp, Mus musculus
acctagttctgggactggcttctgc

SEQ ID NO: 226971 - DNA, 25 bp, Mus musculus
caaggatggccgcagacctagttct

SEQ ID NO: 226972 - DNA, 25 bp, Mus musculus
tgtggcgaaggttctagccctaagc

SEQ ID NO: 226973 - DNA, 25 bp, Mus musculus
tggctagggaacctggatacgctcc

SEQ ID NO: 226974 - DNA, 25 bp, Mus musculus
aacctccctctaggctgcagggttc

SEQ ID NO: 226975 - DNA, 25 bp, Mus musculus
cgtgatccgaaagattgtcccaacc

SEQ ID NO: 226976 - DNA, 25 bp, Mus musculus
agtggtgctctgaacgtgatccgaa

SEQ ID NO: 226977 - DNA, 25 bp, Mus musculus
cgtcatccggatcggtaagggctcc

SEQ ID NO: 226978 - DNA, 25 bp, Mus musculus
gtgcgccttctggatcccagactcg

SEQ ID NO: 226979 - DNA, 25 bp, Mus musculus
cgccggattaggatggcggatttcc

SEQ ID NO: 226980 - DNA, 25 bp, Mus musculus
cgcctccggagtctggtttgggaat

SEQ ID NO: 226981 - DNA, 25 bp, Mus musculus
cgggcatgcactgcgccttttcaat

SEQ ID NO: 226982 - DNA, 25 bp, Mus musculus
tgcgccttttcaatccgggcgggcg

SEQ ID NO: 226983 - DNA, 25 bp, Mus musculus
cgccttttggcactgcgagcgcaag

SEQ ID NO: 226984 - DNA, 25 bp, Mus musculus
tgcgtcttctgtccgcggagtgacg

SEQ ID NO: 226985 - DNA, 25 bp, Mus musculus
ccgacgtgcgtcttctgtccgcgga

SEQ ID NO: 226986 - DNA, 25 bp, Mus musculus
gaaccaggagcagccgcatgcagag

SEQ ID NO: 226987 - DNA, 25 bp, Mus musculus
tgacagaaccaggagcagccgcatg

SEQ ID NO: 226988 - DNA, 25 bp, Mus musculus
gttccgtgcattgttgccaccgccg

SEQ ID NO: 226989 - DNA, 25 bp, Mus musculus
gcgagaagttccgtgcattgttgcc

SEQ ID NO: 226990 - DNA, 25 bp, Mus musculus
agtcagcgttcacgctggtggccga

SEQ ID NO: 226991 - DNA, 25 bp, Mus musculus
gatgcagcagtcagcgttcacgctg

SEQ ID NO: 226992 - DNA, 25 bp, Mus musculus
aagccagccgggatgcagcagtcag

SEQ ID NO: 226993 - DNA, 25 bp, Mus musculus
gcccaaggcgcaagccagccgggat

SEQ ID NO: 226994 - DNA, 25 bp, Mus musculus
ctccacggggcgcaagtgacagaac

SEQ ID NO: 226995 - DNA, 25 bp, Mus musculus
gaaccgctcactcgtgtctccgaaa

SEQ ID NO: 226996 - DNA, 25 bp, Mus musculus
tctggcatgacaggcgcctgcatta

SEQ ID NO: 226997 - DNA, 25 bp, Mus musculus
gcggtccacggagatgttccctttc

SEQ ID NO: 226998 - DNA, 25 bp, Mus musculus
ggagatgttccctttcaactttatg

SEQ ID NO: 226999 - DNA, 25 bp, Mus musculus
actttatgaacttcgctgacaatga

SEQ ID NO: 227000 - DNA, 25 bp, Mus musculus
ctgacaatgaataaaagcgctctgg

SEQ ID NO: 227001 - DNA, 25 bp, Mus musculus
ataaaagcgctctggcatgacaggc

SEQ ID NO: 227002 - DNA, 25 bp, Mus musculus
cgcctgcattattctgcgcgattcc

SEQ ID NO: 227003 - DNA, 25 bp, Mus musculus
tctgcgcgattcctggttcctaatg

SEQ ID NO: 227004 - DNA, 25 bp, Mus musculus
tcctggttcctaatgtcatcaatta

SEQ ID NO: 227005 - DNA, 25 bp, Mus musculus
ataatcagatcaccgtaacacaggg

SEQ ID NO: 227006 - DNA, 25 bp, Mus musculus
atcaccgtaacacagggctggagcg

SEQ ID NO: 227007 - DNA, 25 bp, Mus musculus
gtttggaaccgctcactcgtgtctc

SEQ ID NO: 227008 - DNA, 25 bp, Mus musculus
cgaccgcggctgtttggaaccgctc

SEQ ID NO: 227009 - DNA, 25 bp, Mus musculus
tggctgcgcccatgtaacctggatc

SEQ ID NO: 227010 - DNA, 25 bp, Mus musculus
gtagcgccagtctgctctctgcgcg

SEQ ID NO: 227011 - DNA, 25 bp, Mus musculus
cggaagtagcgccagtctgctctct

SEQ ID NO: 227012 - DNA, 25 bp, Mus musculus
tctgttcgtgcccaggcggtgacac

SEQ ID NO: 227013 - DNA, 25 bp, Mus musculus
tgcgctgagctctgttcgtgcccag

SEQ ID NO: 227014 - DNA, 25 bp, Mus musculus
tcgagtcgggagtcaacatgctgcg

SEQ ID NO: 227015 - DNA, 25 bp, Mus musculus
ccatgtaacctggatccaccgcgga

SEQ ID NO: 227016 - DNA, 25 bp, Mus musculus
tggtcgagcccgaaccgtcatggct

SEQ ID NO: 227017 - DNA, 25 bp, Mus musculus
gaaccgtcatggctgcgcccatgta

SEQ ID NO: 227018 - DNA, 25 bp, Mus musculus
gcgctctcacctcgattggtcgagc

SEQ ID NO: 227019 - DNA, 25 bp, Mus musculus
ctcagccctcggcagctcttgtcgc

SEQ ID NO: 227020 - DNA, 25 bp, Mus musculus
ggaaccgatccattcgctcagccct

SEQ ID NO: 227021 - DNA, 25 bp, Mus musculus
ccgtcgagtcgggagtcaacatgct

SEQ ID NO: 227022 - DNA, 25 bp, Mus musculus
tcggcagctcttgtcgcgctctcac

SEQ ID NO: 227023 - DNA, 25 bp, Mus musculus
ccaccatgtgattggttcgcctttc

SEQ ID NO: 227024 - DNA, 25 bp, Mus musculus
gactctaggcgaacgactccgaaga

SEQ ID NO: 227025 - DNA, 25 bp, Mus musculus
tccgaagacgctggggttgattttc

SEQ ID NO: 227026 - DNA, 25 bp, Mus musculus
ttttcctagtttccggtgcgatggc

SEQ ID NO: 227027 - DNA, 25 bp, Mus musculus
tcccggcgacaccaaagctaaactg

SEQ ID NO: 227028 - DNA, 25 bp, Mus musculus
gtgcgcgcctccgtttgaaccaatc

SEQ ID NO: 227029 - DNA, 25 bp, Mus musculus
ccctgaagcgatctttgtcacttaa

SEQ ID NO: 227030 - DNA, 25 bp, Mus musculus
tgtcacttaacccaataagcgccgg

SEQ ID NO: 227031 - DNA, 25 bp, Mus musculus
gctgctaaatcacaaaccctggggt

SEQ ID NO: 227032 - DNA, 25 bp, Mus musculus
ccggcactatgtcggttcggactct

SEQ ID NO: 227033 - DNA, 25 bp, Mus musculus
cggggagatgctttacgtcctagac

SEQ ID NO: 227034 - DNA, 25 bp, Mus musculus
tagaccagcgactgagggcccagaa

SEQ ID NO: 227035 - DNA, 25 bp, Mus musculus
ggaccgggacgctagacgactctag

SEQ ID NO: 227036 - DNA, 25 bp, Mus musculus
tggggttcttccttcatctaccctg

SEQ ID NO: 227037 - DNA, 25 bp, Mus musculus
tccacgttatcctgcgggaacaaca

SEQ ID NO: 227038 - DNA, 25 bp, Mus musculus
ggccaattagcaaagacacccgtga

SEQ ID NO: 227039 - DNA, 25 bp, Mus musculus
tcccgttaggacactggaacaagtc

SEQ ID NO: 227040 - DNA, 25 bp, Mus musculus
gtccagtggcggataaaggtgtccc

SEQ ID NO: 227041 - DNA, 25 bp, Mus musculus
tgagcaatggcacacacgagcaagg

SEQ ID NO: 227042 - DNA, 25 bp, Mus musculus
tcagcgggtagctctcgtagtagtt

SEQ ID NO: 227043 - DNA, 25 bp, Mus musculus
tccagtcgagcgagtccttgagctc

SEQ ID NO: 227044 - DNA, 25 bp, Mus musculus
cggatgcgcttcttgctcttgtggt

SEQ ID NO: 227045 - DNA, 25 bp, Mus musculus
ctcttgtggttcatcgtgagccgct

SEQ ID NO: 227046 - DNA, 25 bp, Mus musculus
gcgcctttaaagtcgccttccagaa

SEQ ID NO: 227047 - DNA, 25 bp, Mus musculus
tgcacgccaattgggcgccatgttg

SEQ ID NO: 227048 - DNA, 25 bp, Mus musculus
ttggcctacgcaacacttccgtctg

SEQ ID NO: 227049 - DNA, 25 bp, Mus musculus
cgaactctttcaccgacagctgtaa

SEQ ID NO: 227050 - DNA, 25 bp, Mus musculus
tcccacgaccgagcgagttttgaca

SEQ ID NO: 227051 - DNA, 25 bp, Mus musculus
acttgtagtccgcatcctgcgaggc

SEQ ID NO: 227052 - DNA, 25 bp, Mus musculus
tggctgcggacttttcttcccaaac

SEQ ID NO: 227053 - DNA, 25 bp, Mus musculus
ccctggcgcactggctgcggacttt

SEQ ID NO: 227054 - DNA, 25 bp, Mus musculus
agggcgcgctgggacccgtcctctt

SEQ ID NO: 227055 - DNA, 25 bp, Mus musculus
tagggcagtcgagagtggggactag

SEQ ID NO: 227056 - DNA, 25 bp, Mus musculus
gcatcacgcggtgggtagggcagtc

SEQ ID NO: 227057 - DNA, 25 bp, Mus musculus
cgcatcctgcgaggcgcatgctctg

SEQ ID NO: 227058 - DNA, 25 bp, Mus musculus
gcactggctgcggacttttcttccc

SEQ ID NO: 227059 - DNA, 25 bp, Mus musculus
tagtccgcatcctgcgaggcgcatg

SEQ ID NO: 227060 - DNA, 25 bp, Mus musculus
cgcggaaggcggaaggcatcacgcg

SEQ ID NO: 227061 - DNA, 25 bp, Mus musculus
tgcgaggcgcatgctctgatgctct

SEQ ID NO: 227062 - DNA, 25 bp, Mus musculus
ctgatgctctgggtcttccgcggtt

SEQ ID NO: 227063 - DNA, 25 bp, Mus musculus
gctctgggtcttccgcggttgccat

SEQ ID NO: 227064 - DNA, 25 bp, Mus musculus
ctcggtgggtggtgcccctagacac

SEQ ID NO: 227065 - DNA, 25 bp, Mus musculus
gacagcccgaagctgaccggcgcga

SEQ ID NO: 227066 - DNA, 25 bp, Mus musculus
cactggaggtctgtccttcccggca

SEQ ID NO: 227067 - DNA, 25 bp, Mus musculus
ccagtcatcgaagcagccggcgttt

SEQ ID NO: 227068 - DNA, 25 bp, Mus musculus
agacccactcaaccagtcatcgaag

SEQ ID NO: 227069 - DNA, 25 bp, Mus musculus
atgggcactgctcgccttgcccaga

SEQ ID NO: 227070 - DNA, 25 bp, Mus musculus
ctgggaaatgggcactgctcgcctt

SEQ ID NO: 227071 - DNA, 25 bp, Mus musculus
cgcagccctgggaaatgggcactgc

SEQ ID NO: 227072 - DNA, 25 bp, Mus musculus
gcctcggtcttttgccgcagccctg

SEQ ID NO: 227073 - DNA, 25 bp, Mus musculus
gtcatcgaagcagccggcgtttggc

SEQ ID NO: 227074 - DNA, 25 bp, Mus musculus
ccggcgcgaccagaacggctatagt

SEQ ID NO: 227075 - DNA, 25 bp, Mus musculus
actatgggcaaggagcgctgattcc

SEQ ID NO: 227076 - DNA, 25 bp, Mus musculus
gtcacttccgttgtcaggtggcggc

SEQ ID NO: 227077 - DNA, 25 bp, Mus musculus
ccgagagcctatgcgtcacttccgt

SEQ ID NO: 227078 - DNA, 25 bp, Mus musculus
accagaacggctatagtgaattccc

SEQ ID NO: 227079 - DNA, 25 bp, Mus musculus
cccaagaagggacatggagctactc

SEQ ID NO: 227080 - DNA, 25 bp, Mus musculus
cgtgaacgaatcctgcgggagatct

SEQ ID NO: 227081 - DNA, 25 bp, Mus musculus
aagacctgacctgggtgacctcgca

SEQ ID NO: 227082 - DNA, 25 bp, Mus musculus
tggagctactcagcaacagcctggc

SEQ ID NO: 227083 - DNA, 25 bp, Mus musculus
gaccctggatctctcccagatggga

SEQ ID NO: 227084 - DNA, 25 bp, Mus musculus
cagatgggacgactccagcctgtca

SEQ ID NO: 227085 - DNA, 25 bp, Mus musculus
cctctacttcgtgcttggcgtctgc

SEQ ID NO: 227086 - DNA, 25 bp, Mus musculus
tgctgctgaccctatgcctgctggt

SEQ ID NO: 227087 - DNA, 25 bp, Mus musculus
gcctgctggtcatcagcatctcctg

SEQ ID NO: 227088 - DNA, 25 bp, Mus musculus
gcagcaccctagagccggaagacga

SEQ ID NO: 227089 - DNA, 25 bp, Mus musculus
acaccatgacgaggctgggtcccga

SEQ ID NO: 227090 - DNA, 25 bp, Mus musculus
gtcccgatgacacgctgcagggcca

SEQ ID NO: 227091 - DNA, 25 bp, Mus musculus
cctggcagcctatgcgcacatcaga

SEQ ID NO: 227092 - DNA, 25 bp, Mus musculus
tcaatgtcttcacgtcagcagagga

SEQ ID NO: 227093 - DNA, 25 bp, Mus musculus
tgcccttcggaaagtgtttagaaga

SEQ ID NO: 227094 - DNA, 25 bp, Mus musculus
ccaggaccaggacctctacgggcgg

SEQ ID NO: 227095 - DNA, 25 bp, Mus musculus
cgctcggtatctggccaggaccagg

SEQ ID NO: 227096 - DNA, 25 bp, Mus musculus
ccctcgagcggagcattgtacttca

SEQ ID NO: 227097 - DNA, 25 bp, Mus musculus
cggagcattgtacttcaagccaatc

SEQ ID NO: 227098 - DNA, 25 bp, Mus musculus
ggctgcaaaatagccgcgggtgccc

SEQ ID NO: 227099 - DNA, 25 bp, Mus musculus
acagccgtcatgttccacgcgggca

SEQ ID NO: 227100 - DNA, 25 bp, Mus musculus
actcacggcgactacggcgcggaaa

SEQ ID NO: 227101 - DNA, 25 bp, Mus musculus
gcctccggaatctcctgggaaaatc

SEQ ID NO: 227102 - DNA, 25 bp, Mus musculus
ggaaaatcacataggggcggcacta

SEQ ID NO: 227103 - DNA, 25 bp, Mus musculus
cactaggcacaaggcccgaggctga

SEQ ID NO: 227104 - DNA, 25 bp, Mus musculus
ctcacctgcaccaggcgcttgggga

SEQ ID NO: 227105 - DNA, 25 bp, Mus musculus
tccgtctgcgctcggtatctggcca

SEQ ID NO: 227106 - DNA, 25 bp, Mus musculus
ctacgggcggaagcgagctaagaaa

SEQ ID NO: 227107 - DNA, 25 bp, Mus musculus
gcacagaagtgtgcaagctgtttca

SEQ ID NO: 227108 - DNA, 25 bp, Mus musculus
aagctgtttcagagagaaggcggcc

SEQ ID NO: 227109 - DNA, 25 bp, Mus musculus
ggaagccgccgcacgctaggcctaa

SEQ ID NO: 227110 - DNA, 25 bp, Mus musculus
cagccggcgcccagaaaagaggaaa

SEQ ID NO: 227111 - DNA, 25 bp, Mus musculus
cacagagattagctgagctgtcctc

SEQ ID NO: 227112 - DNA, 25 bp, Mus musculus
gccggagcgactacagctgcaatct

SEQ ID NO: 227113 - DNA, 25 bp, Mus musculus
tgcaatctcgcaacggcacaaccgg

SEQ ID NO: 227114 - DNA, 25 bp, Mus musculus
tcgctccgctacctcctgggaaatg

SEQ ID NO: 227115 - DNA, 25 bp, Mus musculus
ggtttctctctcctgactcaccgga

SEQ ID NO: 227116 - DNA, 25 bp, Mus musculus
ccggacgtcctctcgaactctattt

SEQ ID NO: 227117 - DNA, 25 bp, Mus musculus
tttcccacaaggcagagcgagcgtt

SEQ ID NO: 227118 - DNA, 25 bp, Mus musculus
cgctttgcgtcacgcgcccgaagat

SEQ ID NO: 227119 - DNA, 25 bp, Mus musculus
cgcgcccgaagatcggcggtcacgt

SEQ ID NO: 227120 - DNA, 25 bp, Mus musculus
cgtcgttcccgcacagtgcacagaa

SEQ ID NO: 227121 - DNA, 25 bp, Mus musculus
catcgcggcgctcagtctcggagcg

SEQ ID NO: 227122 - DNA, 25 bp, Mus musculus
ttgtagccaaggacgcagcccggac

SEQ ID NO: 227123 - DNA, 25 bp, Mus musculus
ccgggagtcttcaaacttgtagcca

SEQ ID NO: 227124 - DNA, 25 bp, Mus musculus
gggctctgggaacgccaccagatga

SEQ ID NO: 227125 - DNA, 25 bp, Mus musculus
cctctgaatagaaaggctgagccgg

SEQ ID NO: 227126 - DNA, 25 bp, Mus musculus
ggtgggacattaaggccgcctctga

SEQ ID NO: 227127 - DNA, 25 bp, Mus musculus
aggtcagaaccgaccagctgctctg

SEQ ID NO: 227128 - DNA, 25 bp, Mus musculus
ctccggtccgcaccggagaaggaga

SEQ ID NO: 227129 - DNA, 25 bp, Mus musculus
ggcgaccagcatcggccgggccaaa

SEQ ID NO: 227130 - DNA, 25 bp, Mus musculus
gctcccgcggcggtaacaggttgcc

SEQ ID NO: 227131 - DNA, 25 bp, Mus musculus
agcgaaatccctcctacacgggagg

SEQ ID NO: 227132 - DNA, 25 bp, Mus musculus
ccagaggccctgttaaagcgaaatc

SEQ ID NO: 227133 - DNA, 25 bp, Mus musculus
tatcgacttaaaatgggcggccaga

SEQ ID NO: 227134 - DNA, 25 bp, Mus musculus
tgggtccgcgagtcaccgaacaacc

SEQ ID NO: 227135 - DNA, 25 bp, Mus musculus
aggcactctagggaccctcacagtc

SEQ ID NO: 227136 - DNA, 25 bp, Mus musculus
cccgccatgggtttgctaggggtca

SEQ ID NO: 227137 - DNA, 25 bp, Mus musculus
aagtttcggattctctgtttcagcc

SEQ ID NO: 227138 - DNA, 25 bp, Mus musculus
agcttccgctcctgttcttcgcgtt

SEQ ID NO: 227139 - DNA, 25 bp, Mus musculus
tctgccaaaggcctccataagtttc

SEQ ID NO: 227140 - DNA, 25 bp, Mus musculus
gcttcctctcggtctgtggtgcccg

SEQ ID NO: 227141 - DNA, 25 bp, Mus musculus
aagcccaccgattgccagccaagat

SEQ ID NO: 227142 - DNA, 25 bp, Mus musculus
tgggcacctgcttctgcagtcgctc

SEQ ID NO: 227143 - DNA, 25 bp, Mus musculus
tctcgcattcgcctggaggacccag

SEQ ID NO: 227144 - DNA, 25 bp, Mus musculus
ctggaggacccaggaaactcaagtt

SEQ ID NO: 227145 - DNA, 25 bp, Mus musculus
actcaagtttggtctgcgcctcttc

SEQ ID NO: 227146 - DNA, 25 bp, Mus musculus
gcgcctcttcttcaggcactctagg

SEQ ID NO: 227147 - DNA, 25 bp, Mus musculus
ggtcacactcacttgtccctttcag

SEQ ID NO: 227148 - DNA, 25 bp, Mus musculus
ttttcagccaggagccgcgtggctt

SEQ ID NO: 227149 - DNA, 25 bp, Mus musculus
cgagcgcgggcacactggcacggct

SEQ ID NO: 227150 - DNA, 25 bp, Mus musculus
aaggagagggtgggcgtcatcagac

SEQ ID NO: 227151 - DNA, 25 bp, Mus musculus
ctgcgactccgagccaggaaggaga

SEQ ID NO: 227152 - DNA, 25 bp, Mus musculus
cgctgcgactccgagccaggaagga

SEQ ID NO: 227153 - DNA, 25 bp, Mus musculus
cgcgctgcgactccgagccaggaag

SEQ ID NO: 227154 - DNA, 25 bp, Mus musculus
gtgtgaccgcgctgcgactccgagc

SEQ ID NO: 227155 - DNA, 25 bp, Mus musculus
agtgtgaccgcgctgcgactccgag

SEQ ID NO: 227156 - DNA, 25 bp, Mus musculus
ctggtccctgccgttgcggggcagt

SEQ ID NO: 227157 - DNA, 25 bp, Mus musculus
cttccagccggcggcgcgccagcgc

SEQ ID NO: 227158 - DNA, 25 bp, Mus musculus
cgggcacactggcacggctgcagag

SEQ ID NO: 227159 - DNA, 25 bp, Mus musculus
ctccgaggggcgctacaaggcgtca

SEQ ID NO: 227160 - DNA, 25 bp, Mus musculus
cggggtgcagcggtgcgcgctccga

SEQ ID NO: 227161 - DNA, 25 bp, Mus musculus
ccaccggcgccgggcttgcgccgct

SEQ ID NO: 227162 - DNA, 25 bp, Mus musculus
cggctgcagagggatgagtgcggtc

SEQ ID NO: 227163 - DNA, 25 bp, Mus musculus
tggcagccaccgctaaagacctccc

SEQ ID NO: 227164 - DNA, 25 bp, Mus musculus
tatccggcgggttacttggcagcca

SEQ ID NO: 227165 - DNA, 25 bp, Mus musculus
tccggcgggttacttggcagccacc

SEQ ID NO: 227166 - DNA, 25 bp, Mus musculus
ggcgggttacttggcagccaccgct

SEQ ID NO: 227167 - DNA, 25 bp, Mus musculus
cgggttacttggcagccaccgctaa

SEQ ID NO: 227168 - DNA, 25 bp, Mus musculus
ggttacttggcagccaccgctaaag

SEQ ID NO: 227169 - DNA, 25 bp, Mus musculus
acttggcagccaccgctaaagacct

SEQ ID NO: 227170 - DNA, 25 bp, Mus musculus
tttatccggcgggttacttggcagc

SEQ ID NO: 227171 - DNA, 25 bp, Mus musculus
ctggtcggcccacaacagcaacagg

SEQ ID NO: 227172 - DNA, 25 bp, Mus musculus
tggtcggcccacaacagcaacaggc

SEQ ID NO: 227173 - DNA, 25 bp, Mus musculus
acaacagcaacaggccctttgcgcg

SEQ ID NO: 227174 - DNA, 25 bp, Mus musculus
agcaacaggccctttgcgcggcagc

SEQ ID NO: 227175 - DNA, 25 bp, Mus musculus
ccctttgcgcggcagctggacggat

SEQ ID NO: 227176 - DNA, 25 bp, Mus musculus
tacttggcagccaccgctaaagacc

SEQ ID NO: 227177 - DNA, 25 bp, Mus musculus
gcagagcacccgaacctgacggacg

SEQ ID NO: 227178 - DNA, 25 bp, Mus musculus
ccgacgcgcccgtatttctcgaaga

SEQ ID NO: 227179 - DNA, 25 bp, Mus musculus
atttctcgaagacgcgcctcagggt

SEQ ID NO: 227180 - DNA, 25 bp, Mus musculus
tgcggtaggtcaggttgtccacctt

SEQ ID NO: 227181 - DNA, 25 bp, Mus musculus
tgtccaccttgagggaggtcatgcc

SEQ ID NO: 227182 - DNA, 25 bp, Mus musculus
gaggtcatgccctccacatcgggag

SEQ ID NO: 227183 - DNA, 25 bp, Mus musculus
tcaggcgctcggtagctacagtcct

SEQ ID NO: 227184 - DNA, 25 bp, Mus musculus
tcccgcggaatgtacacgtcgccga

SEQ ID NO: 227185 - DNA, 25 bp, Mus musculus
acggacgcctgagcagcaactaagc

SEQ ID NO: 227186 - DNA, 25 bp, Mus musculus
gcgccacccggaaatgaatctcctg

SEQ ID NO: 227187 - DNA, 25 bp, Mus musculus
cccattcggccgtgttgcgtaacgt

SEQ ID NO: 227188 - DNA, 25 bp, Mus musculus
aggcagttagaaagcccgccaaatg

SEQ ID NO: 227189 - DNA, 25 bp, Mus musculus
ccaaatgctctaccgtgggtgcgtc

SEQ ID NO: 227190 - DNA, 25 bp, Mus musculus
ggaaacgcagctccgtcaggcgctc

SEQ ID NO: 227191 - DNA, 25 bp, Mus musculus
ccggtggctaacgaagctctgagta

SEQ ID NO: 227192 - DNA, 25 bp, Mus musculus
ccgcgcgcctgaagactatgtaggg

SEQ ID NO: 227193 - DNA, 25 bp, Mus musculus
gggcacgctgctggccacactgact

SEQ ID NO: 227194 - DNA, 25 bp, Mus musculus
ggaacttcacgatgctccttctgtg

SEQ ID NO: 227195 - DNA, 25 bp, Mus musculus
tgcgatgcagctcccggaacttcac

SEQ ID NO: 227196 - DNA, 25 bp, Mus musculus
cgggcacaaccagagggctccgaca

SEQ ID NO: 227197 - DNA, 25 bp, Mus musculus
gagtacggagccaccacgggcacaa

SEQ ID NO: 227198 - DNA, 25 bp, Mus musculus
cccgcagtgatggagtacggagcca

SEQ ID NO: 227199 - DNA, 25 bp, Mus musculus
tctccgaatgtaccaagtgcgcggg

SEQ ID NO: 227200 - DNA, 25 bp, Mus musculus
ggcctggcctctccgaatgtaccaa

SEQ ID NO: 227201 - DNA, 25 bp, Mus musculus
tggtcgcggcccaaccctattgtac

SEQ ID NO: 227202 - DNA, 25 bp, Mus musculus
gaggtcggtcctccgcgaccgcgat

SEQ ID NO: 227203 - DNA, 25 bp, Mus musculus
tctgagtagccagctacccgaggtc

SEQ ID NO: 227204 - DNA, 25 bp, Mus musculus
actatgtagggagctctcgggtgac

SEQ ID NO: 227205 - DNA, 25 bp, Mus musculus
ctgccggatgctgtagtctgacttt

SEQ ID NO: 227206 - DNA, 25 bp, Mus musculus
gagctgcagctcgagctgaatcacg

SEQ ID NO: 227207 - DNA, 25 bp, Mus musculus
cgagctgaatcacgggtgggacttc

SEQ ID NO: 227208 - DNA, 25 bp, Mus musculus
acttccgggtagaactgccggatgc

SEQ ID NO: 227209 - DNA, 25 bp, Mus musculus
tggtcagccgaaccacaagtcccgg

SEQ ID NO: 227210 - DNA, 25 bp, Mus musculus
cggctgggttgaatcggcgactccc

SEQ ID NO: 227211 - DNA, 25 bp, Mus musculus
ttgaatcggcgactcccggggtctg

SEQ ID NO: 227212 - DNA, 25 bp, Mus musculus
cggcactgaacggtgggcaccatgt

SEQ ID NO: 227213 - DNA, 25 bp, Mus musculus
ggcaccatgtcgaggcaggcgaacc

SEQ ID NO: 227214 - DNA, 25 bp, Mus musculus
accgtggcacggagagcaagaaaat

SEQ ID NO: 227215 - DNA, 25 bp, Mus musculus
cacggagagcaagaaaatggtaact

SEQ ID NO: 227216 - DNA, 25 bp, Mus musculus
aatggtaactgagcgcgtgacccgg

SEQ ID NO: 227217 - DNA, 25 bp, Mus musculus
gctggtagcattccggagctgcagc

SEQ ID NO: 227218 - DNA, 25 bp, Mus musculus
tcagtcctagacgctgaggggccgc

SEQ ID NO: 227219 - DNA, 25 bp, Mus musculus
tgtggaaagagcaaggcggaggccc

SEQ ID NO: 227220 - DNA, 25 bp, Mus musculus
tcagaggctgctagcccgctgcgct

SEQ ID NO: 227221 - DNA, 25 bp, Mus musculus
ctttgcagcgccgttgtctcctgca

SEQ ID NO: 227222 - DNA, 25 bp, Mus musculus
ttgcagcgccgttgtctcctgcagc

SEQ ID NO: 227223 - DNA, 25 bp, Mus musculus
gccgttgtctcctgcagccgtctag

SEQ ID NO: 227224 - DNA, 25 bp, Mus musculus
cgttgtctcctgcagccgtctaggg

SEQ ID NO: 227225 - DNA, 25 bp, Mus musculus
ctgcagccgtctagggcaggggtcc

SEQ ID NO: 227226 - DNA, 25 bp, Mus musculus
cagagcgacgcggagttctggcggt

SEQ ID NO: 227227 - DNA, 25 bp, Mus musculus
cctgcaggtaaaggcgggcagcatt

SEQ ID NO: 227228 - DNA, 25 bp, Mus musculus
gccggatgcagccaggtgtccagcc

SEQ ID NO: 227229 - DNA, 25 bp, Mus musculus
ctcaggccccagtgcgaggacagga

SEQ ID NO: 227230 - DNA, 25 bp, Mus musculus
acaggacctggaggcgactagcgct

SEQ ID NO: 227231 - DNA, 25 bp, Mus musculus
tggctgtggctgtggaaagagcaag

SEQ ID NO: 227232 - DNA, 25 bp, Mus musculus
ggcgcgcacccttggctgtggctgt

SEQ ID NO: 227233 - DNA, 25 bp, Mus musculus
accagggaccagacgcctcggtcag

SEQ ID NO: 227234 - DNA, 25 bp, Mus musculus
gattctgctcgggtcgggttccacc

SEQ ID NO: 227235 - DNA, 25 bp, Mus musculus
aggacttgcagctgtccaaacaccg

SEQ ID NO: 227236 - DNA, 25 bp, Mus musculus
cccgttaaggacttgcagctgtcca

SEQ ID NO: 227237 - DNA, 25 bp, Mus musculus
aatggagttttacggcgatttgttg

SEQ ID NO: 227238 - DNA, 25 bp, Mus musculus
ctgacttggacgaaatggagtttta

SEQ ID NO: 227239 - DNA, 25 bp, Mus musculus
ccaaaacgctgacttggacgaaatg

SEQ ID NO: 227240 - DNA, 25 bp, Mus musculus
ggaggccaggctgccccaaaacgct

SEQ ID NO: 227241 - DNA, 25 bp, Mus musculus
ccagtctcctctgcatctgggagga

SEQ ID NO: 227242 - DNA, 25 bp, Mus musculus
gatggagcgggaacacacctgggac

SEQ ID NO: 227243 - DNA, 25 bp, Mus musculus
ggtcacagcagcctcaccctgcgcc

SEQ ID NO: 227244 - DNA, 25 bp, Mus musculus
tgaatcagcgtctcctgaacgcgtc

SEQ ID NO: 227245 - DNA, 25 bp, Mus musculus
tgaacgcgtcccacctccgctgagg

SEQ ID NO: 227246 - DNA, 25 bp, Mus musculus
cagccagtctcctctgcatctggga

SEQ ID NO: 227247 - DNA, 25 bp, Mus musculus
ggactgatgccaggctgacggtatc

SEQ ID NO: 227248 - DNA, 25 bp, Mus musculus
aagctggtcacgacggaactggcca

SEQ ID NO: 227249 - DNA, 25 bp, Mus musculus
caggcaacctcggaagcgcgagatg

SEQ ID NO: 227250 - DNA, 25 bp, Mus musculus
cccacatcgggccagcagtttgaga

SEQ ID NO: 227251 - DNA, 25 bp, Mus musculus
cacgcgggaactggctctagccaag

SEQ ID NO: 227252 - DNA, 25 bp, Mus musculus
tagccaaggttttaggcgaggcctg

SEQ ID NO: 227253 - DNA, 25 bp, Mus musculus
ctctgaatgtggtcatggctggaga

SEQ ID NO: 227254 - DNA, 25 bp, Mus musculus
ggctggagacctacaaccacggaga

SEQ ID NO: 227255 - DNA, 25 bp, Mus musculus
accgattcgatccaggggccttcag

SEQ ID NO: 227256 - DNA, 25 bp, Mus musculus
ccttcagcctcgtgacttcgtggga

SEQ ID NO: 227257 - DNA, 25 bp, Mus musculus
gctccaggctctcgacgtgactcag

SEQ ID NO: 227258 - DNA, 25 bp, Mus musculus
tctcgacgtgactcaggactgatgc

SEQ ID NO: 227259 - DNA, 25 bp, Mus musculus
gacggtatcgtgtgcctcgtagaca

SEQ ID NO: 227260 - DNA, 25 bp, Mus musculus
agagctggagcaaaccgattcgatc

SEQ ID NO: 227261 - DNA, 25 bp, Mus musculus
cggagccgatttccattcatggagc

SEQ ID NO: 227262 - DNA, 25 bp, Mus musculus
acccgctgtgcctgacggcgacaat

SEQ ID NO: 227263 - DNA, 25 bp, Mus musculus
agccagagccttgcgggagcaacaa

SEQ ID NO: 227264 - DNA, 25 bp, Mus musculus
tcggcagctcgcctggagccagagc

SEQ ID NO: 227265 - DNA, 25 bp, Mus musculus
cacagatgctgacgcgtgcagcttc

SEQ ID NO: 227266 - DNA, 25 bp, Mus musculus
ccggaacttgcgtcgcccacagatg

SEQ ID NO: 227267 - DNA, 25 bp, Mus musculus
acgctggaaccaggtccggaacttg

SEQ ID NO: 227268 - DNA, 25 bp, Mus musculus
agtcctgagtgaggacgctggaacc

SEQ ID NO: 227269 - DNA, 25 bp, Mus musculus
ctcacctgcggagccgatttccatt

SEQ ID NO: 227270 - DNA, 25 bp, Mus musculus
ccctcggaaagctccgggcacaaga

SEQ ID NO: 227271 - DNA, 25 bp, Mus musculus
cacaagaggcacagtcgggagagac

SEQ ID NO: 227272 - DNA, 25 bp, Mus musculus
caatcccgagcgagaggccagcttt

SEQ ID NO: 227273 - DNA, 25 bp, Mus musculus
taagagcggcgacagtcctgagtga

SEQ ID NO: 227274 - DNA, 25 bp, Mus musculus
ttcacgagagaagggtgccaccaca

SEQ ID NO: 227275 - DNA, 25 bp, Mus musculus
ctgctagcgcccgagtagctgccag

SEQ ID NO: 227276 - DNA, 25 bp, Mus musculus
cactcgtagccgtgcagcctggcgg

SEQ ID NO: 227277 - DNA, 25 bp, Mus musculus
tctggcggccactcgtagccgtgca

SEQ ID NO: 227278 - DNA, 25 bp, Mus musculus
cgacggcaacaaaggccaatggaga

SEQ ID NO: 227279 - DNA, 25 bp, Mus musculus
cgctcgacggcaacaaaggccaatg

SEQ ID NO: 227280 - DNA, 25 bp, Mus musculus
tcaagcggggcgctcgacggcaaca

SEQ ID NO: 227281 - DNA, 25 bp, Mus musculus
cgcccgagtagctgccagtgcgcag

SEQ ID NO: 227282 - DNA, 25 bp, Mus musculus
gagggtcccgcttccatcccatata

SEQ ID NO: 227283 - DNA, 25 bp, Mus musculus
gtacctcgcacttgcactgctcggg

SEQ ID NO: 227284 - DNA, 25 bp, Mus musculus
gcctaggtacctcgcacttgcactg

SEQ ID NO: 227285 - DNA, 25 bp, Mus musculus
tgaggggcctaggtacctcgcactt

SEQ ID NO: 227286 - DNA, 25 bp, Mus musculus
cgggagactgaggagtccagcgtga

SEQ ID NO: 227287 - DNA, 25 bp, Mus musculus
ccatatacccgtgcggaggacaggc

SEQ ID NO: 227288 - DNA, 25 bp, Mus musculus
ccatcccatatacccgtgcggagga

SEQ ID NO: 227289 - DNA, 25 bp, Mus musculus
tgtgtctatggtcgctccgcgggcc

SEQ ID NO: 227290 - DNA, 25 bp, Mus musculus
cgtgtttccttagctcccgcctcaa

SEQ ID NO: 227291 - DNA, 25 bp, Mus musculus
ctcaacaagcccattggcggtcggg

SEQ ID NO: 227292 - DNA, 25 bp, Mus musculus
gggcggttgctagcttcctccgcaa

SEQ ID NO: 227293 - DNA, 25 bp, Mus musculus
tagcttcctccgcaactagggcggg

SEQ ID NO: 227294 - DNA, 25 bp, Mus musculus
tttgtctgccggaaccggtgtacgc

SEQ ID NO: 227295 - DNA, 25 bp, Mus musculus
ccggaaccggtgtacgccgctcagt

SEQ ID NO: 227296 - DNA, 25 bp, Mus musculus
tacgccgctcagtgttgtcgaccgg

SEQ ID NO: 227297 - DNA, 25 bp, Mus musculus
ttgtcgaccggcgtcaaggcgacga

SEQ ID NO: 227298 - DNA, 25 bp, Mus musculus
ctgtggagttcagcccagccagtct

SEQ ID NO: 227299 - DNA, 25 bp, Mus musculus
ccagccagtctggtaggagcacagt

SEQ ID NO: 227300 - DNA, 25 bp, Mus musculus
tggtaggagcacagtcgtccggact

SEQ ID NO: 227301 - DNA, 25 bp, Mus musculus
agtcgtccggactgtgtctatggtc

SEQ ID NO: 227302 - DNA, 25 bp, Mus musculus
tccggactgtgtctatggtcgctcc

SEQ ID NO: 227303 - DNA, 25 bp, Mus musculus
cagacacacggtcccatttgaggcc

SEQ ID NO: 227304 - DNA, 25 bp, Mus musculus
tcttccggcctcagcgacaacaaaa

SEQ ID NO: 227305 - DNA, 25 bp, Mus musculus
gggacccgactctgtcacggctctt

SEQ ID NO: 227306 - DNA, 25 bp, Mus musculus
ctctggaatattggcgctgaagcgg

SEQ ID NO: 227307 - DNA, 25 bp, Mus musculus
ttgctctctggaatattggcgctga

SEQ ID NO: 227308 - DNA, 25 bp, Mus musculus
ggagccgcgtaacgcttgctctctg

SEQ ID NO: 227309 - DNA, 25 bp, Mus musculus
ggtcgggcagcgacagtcccttccg

SEQ ID NO: 227310 - DNA, 25 bp, Mus musculus
gacctagagtcttcagctggggcgt

SEQ ID NO: 227311 - DNA, 25 bp, Mus musculus
ggtcccgaatagacctagagtcttc

SEQ ID NO: 227312 - DNA, 25 bp, Mus musculus
tagacgggtcccgaatagacctaga

SEQ ID NO: 227313 - DNA, 25 bp, Mus musculus
gggaactcgggtcacctcttgagcc

SEQ ID NO: 227314 - DNA, 25 bp, Mus musculus
cagagatctaaggtccgaacaggtc

SEQ ID NO: 227315 - DNA, 25 bp, Mus musculus
ctcagcgacaacaaaaacaatcccg

SEQ ID NO: 227316 - DNA, 25 bp, Mus musculus
tcgcggcgaccgtggacagagatct

SEQ ID NO: 227317 - DNA, 25 bp, Mus musculus
tcaaggttgagcgttgtaccgcgtc

SEQ ID NO: 227318 - DNA, 25 bp, Mus musculus
tttctaagccatagcgcgggatctc

SEQ ID NO: 227319 - DNA, 25 bp, Mus musculus
tctgtttgacaagagcagccgcaac

SEQ ID NO: 227320 - DNA, 25 bp, Mus musculus
tccctcggattggtgcaaaccctca

SEQ ID NO: 227321 - DNA, 25 bp, Mus musculus
tctgggcgcgaaagctcgaacttcg

SEQ ID NO: 227322 - DNA, 25 bp, Mus musculus
agctgtcgccgtcaagttgaggtta

SEQ ID NO: 227323 - DNA, 25 bp, Mus musculus
ctgcagacacgttctcctggagctg

SEQ ID NO: 227324 - DNA, 25 bp, Mus musculus
ctgaggtgagtttaggctctggtcc

SEQ ID NO: 227325 - DNA, 25 bp, Mus musculus
ggacagtcaacccagcagggccaga

SEQ ID NO: 227326 - DNA, 25 bp, Mus musculus
ctccgagaccactggactgagtctg

SEQ ID NO: 227327 - DNA, 25 bp, Mus musculus
cgggtcctcagcttgtcactgcagc

SEQ ID NO: 227328 - DNA, 25 bp, Mus musculus
gccttgctctttggcgcgtttcctg

SEQ ID NO: 227329 - DNA, 25 bp, Mus musculus
cggtacgacccatcgaacgaagaca

SEQ ID NO: 227330 - DNA, 25 bp, Mus musculus
tcgaacttcgctgccgagctggaga

SEQ ID NO: 227331 - DNA, 25 bp, Mus musculus
atgcagttaccggagcagcctcggc

SEQ ID NO: 227332 - DNA, 25 bp, Mus musculus
tctccggtctgctggatgccctagg

SEQ ID NO: 227333 - DNA, 25 bp, Mus musculus
ctgctggatgccctaggaagttgca

SEQ ID NO: 227334 - DNA, 25 bp, Mus musculus
cctaggaagttgcatggtccaggga

SEQ ID NO: 227335 - DNA, 25 bp, Mus musculus
gagcgcagcgagactgcggccacca

SEQ ID NO: 227336 - DNA, 25 bp, Mus musculus
tgcggccaccagatggcgctcaggc

SEQ ID NO: 227337 - DNA, 25 bp, Mus musculus
tcctcagagggaacaatgcggcgcc

SEQ ID NO: 227338 - DNA, 25 bp, Mus musculus
acaatgcggcgcctcgggttgtagc

SEQ ID NO: 227339 - DNA, 25 bp, Mus musculus
gttccttcccaaagccatgggcgcg

SEQ ID NO: 227340 - DNA, 25 bp, Mus musculus
ttcccaaagccatgggcgcggcgct

SEQ ID NO: 227341 - DNA, 25 bp, Mus musculus
gccagcgagcctagcaggcagacgc

SEQ ID NO: 227342 - DNA, 25 bp, Mus musculus
ccgcagcggcttcgtggttcccgag

SEQ ID NO: 227343 - DNA, 25 bp, Mus musculus
cgggccgcctcctcagagggaacaa

SEQ ID NO: 227344 - DNA, 25 bp, Mus musculus
ccctgcgcgatgcagttaccggagc

SEQ ID NO: 227345 - DNA, 25 bp, Mus musculus
agctgcctctgcagagattagggtc

SEQ ID NO: 227346 - DNA, 25 bp, Mus musculus
aggaggcatttcgtcgccatgtctg

SEQ ID NO: 227347 - DNA, 25 bp, Mus musculus
gcagagctcggaccactgccaagtc

SEQ ID NO: 227348 - DNA, 25 bp, Mus musculus
ctgggaaacccaggaaggaggcatt

SEQ ID NO: 227349 - DNA, 25 bp, Mus musculus
gccatgtctgcagcaaggagaacca

SEQ ID NO: 227350 - DNA, 25 bp, Mus musculus
agaaccaatggatccgtggcgcctc

SEQ ID NO: 227351 - DNA, 25 bp, Mus musculus
tggttaggagatgacaccggaccta

SEQ ID NO: 227352 - DNA, 25 bp, Mus musculus
tgacaccggacctacaaggctctcg

SEQ ID NO: 227353 - DNA, 25 bp, Mus musculus
gctagggccgctgtgcctggaccaa

SEQ ID NO: 227354 - DNA, 25 bp, Mus musculus
gtgcctggaccaagcagccgcgtca

SEQ ID NO: 227355 - DNA, 25 bp, Mus musculus
gtgcacgcgcaggtccaggaatccc

SEQ ID NO: 227356 - DNA, 25 bp, Mus musculus
ctaggccgtgagtccgggccctgat

SEQ ID NO: 227357 - DNA, 25 bp, Mus musculus
agattagggtcgcagagctcggacc

SEQ ID NO: 227358 - DNA, 25 bp, Mus musculus
ctacaaggctctcgggtcaagctgc

SEQ ID NO: 227359 - DNA, 25 bp, Mus musculus
ccgcctgctctctcgcgagaggtga

SEQ ID NO: 227360 - DNA, 25 bp, Mus musculus
gccgccagcaatattgtccagatga

SEQ ID NO: 227361 - DNA, 25 bp, Mus musculus
cgagtggccgccagcaatattgtcc

SEQ ID NO: 227362 - DNA, 25 bp, Mus musculus
tgtcctcgtcgcttccgaccgagtg

SEQ ID NO: 227363 - DNA, 25 bp, Mus musculus
agggcccagactatgtcctcgtcgc

SEQ ID NO: 227364 - DNA, 25 bp, Mus musculus
tcattggcatccagggcccagacta

SEQ ID NO: 227365 - DNA, 25 bp, Mus musculus
ggagtacctcattggcatccagggc

SEQ ID NO: 227366 - DNA, 25 bp, Mus musculus
cggcaccatggagtacctcattggc

SEQ ID NO: 227367 - DNA, 25 bp, Mus musculus
tctcagcgcggaaaagcacccaagc

SEQ ID NO: 227368 - DNA, 25 bp, Mus musculus
ctcagtccgggtgtgctgtctcact

SEQ ID NO: 227369 - DNA, 25 bp, Mus musculus
tctcactggtgaggtcgtgtacccg

SEQ ID NO: 227370 - DNA, 25 bp, Mus musculus
attgtccagatgaaggacggtgaga

SEQ ID NO: 227371 - DNA, 25 bp, Mus musculus
ggaagtgtccctgtccgtggcctct

SEQ ID NO: 227372 - DNA, 25 bp, Mus musculus
ctctctcgcgagaggtgacgtcatt

SEQ ID NO: 227373 - DNA, 25 bp, Mus musculus
ccacctggcgaagcgtcgagtccga

SEQ ID NO: 227374 - DNA, 25 bp, Mus musculus
tcaccaaggcgggagtttctttcgc

SEQ ID NO: 227375 - DNA, 25 bp, Mus musculus
ccgagacgcttcagggttccaaggc

SEQ ID NO: 227376 - DNA, 25 bp, Mus musculus
ccttcacgccgagacgcttcagggt

SEQ ID NO: 227377 - DNA, 25 bp, Mus musculus
ggcgcaaggtcccttcacgccgaga

SEQ ID NO: 227378 - DNA, 25 bp, Mus musculus
atagaaaacagtgtccagagtcttc

SEQ ID NO: 227379 - DNA, 25 bp, Mus musculus
gggcggtcgctcaccatagaaaaca

SEQ ID NO: 227380 - DNA, 25 bp, Mus musculus
agaaagcgcccgataacgttgaaag

SEQ ID NO: 227381 - DNA, 25 bp, Mus musculus
cgataacgttgaaagggcctgagta

SEQ ID NO: 227382 - DNA, 25 bp, Mus musculus
gcctgagtaccaacagcagtagcta

SEQ ID NO: 227383 - DNA, 25 bp, Mus musculus
cagagtcttcagaaagcgcccgata

SEQ ID NO: 227384 - DNA, 25 bp, Mus musculus
tatggccacccacctggcgaagcgt

SEQ ID NO: 227385 - DNA, 25 bp, Mus musculus
tcgagtccgacgttcaccgtttaga

SEQ ID NO: 227386 - DNA, 25 bp, Mus musculus
gtagctaacctgtcacctatggcca

SEQ ID NO: 227387 - DNA, 25 bp, Mus musculus
ccaggctggagaccaaccacgtacg

SEQ ID NO: 227388 - DNA, 25 bp, Mus musculus
ggagcccttacagcccacggggatc

SEQ ID NO: 227389 - DNA, 25 bp, Mus musculus
gtccagaaggtacggggtactcagc

SEQ ID NO: 227390 - DNA, 25 bp, Mus musculus
tgagcggccgaaaagacaccagccc

SEQ ID NO: 227391 - DNA, 25 bp, Mus musculus
ttcctgggctgccaagaggccctac

SEQ ID NO: 227392 - DNA, 25 bp, Mus musculus
cctaccttcgcgatttcgttggcgc

SEQ ID NO: 227393 - DNA, 25 bp, Mus musculus
tttggaggcttcagcagccaggctc

SEQ ID NO: 227394 - DNA, 25 bp, Mus musculus
gggacccgagtctactcaccatggc

SEQ ID NO: 227395 - DNA, 25 bp, Mus musculus
ccatggcggagtatgtgtgcaccaa

SEQ ID NO: 227396 - DNA, 25 bp, Mus musculus
agacacagccctcgttcgacggcga

SEQ ID NO: 227397 - DNA, 25 bp, Mus musculus
gagcgtccatggaaatgggccagac

SEQ ID NO: 227398 - DNA, 25 bp, Mus musculus
acgggagctgatggcacttggaaaa

SEQ ID NO: 227399 - DNA, 25 bp, Mus musculus
taggtgacccatgagcggccgaaaa

SEQ ID NO: 227400 - DNA, 25 bp, Mus musculus
ccacggggatcaccgtctggaagct

SEQ ID NO: 227401 - DNA, 25 bp, Mus musculus
cggccatcttgcttgtgggcaattg

SEQ ID NO: 227402 - DNA, 25 bp, Mus musculus
gtcacggagagatcacagcgaaatc

SEQ ID NO: 227403 - DNA, 25 bp, Mus musculus
aatcacgacatgaaggggacagccc

SEQ ID NO: 227404 - DNA, 25 bp, Mus musculus
tctcggcatcgatcagcgccggttc

SEQ ID NO: 227405 - DNA, 25 bp, Mus musculus
actcttggctccaggctgctacagc

SEQ ID NO: 227406 - DNA, 25 bp, Mus musculus
cacacttcacgatggcgcggtgatg

SEQ ID NO: 227407 - DNA, 25 bp, Mus musculus
gaccaatggcacagcagggcgctaa

SEQ ID NO: 227408 - DNA, 25 bp, Mus musculus
agtctcgacagggtacggtgatgtc

SEQ ID NO: 227409 - DNA, 25 bp, Mus musculus
cctgagtgctcgagctaaggaggaa

SEQ ID NO: 227410 - DNA, 25 bp, Mus musculus
acgtcctcgcttgtgcgtagctctc

SEQ ID NO: 227411 - DNA, 25 bp, Mus musculus
tggctcagcgtgaagagtatgtttc

SEQ ID NO: 227412 - DNA, 25 bp, Mus musculus
tcctcctctgcgtgaggggagagaa

SEQ ID NO: 227413 - DNA, 25 bp, Mus musculus
atcgctctcgaccaatcggcgctgg

SEQ ID NO: 227414 - DNA, 25 bp, Mus musculus
ggcgaagtctttctccgggcgcgat

SEQ ID NO: 227415 - DNA, 25 bp, Mus musculus
aggaggattattttctctcagagaa

SEQ ID NO: 227416 - DNA, 25 bp, Mus musculus
agacaccggcgcttcacccgctgcg

SEQ ID NO: 227417 - DNA, 25 bp, Mus musculus
accaccacccacacgccggcaaagg

SEQ ID NO: 227418 - DNA, 25 bp, Mus musculus
cccgtgaggaggattattttctctc

SEQ ID NO: 227419 - DNA, 25 bp, Mus musculus
taatggcctccaaggggccccgtga

SEQ ID NO: 227420 - DNA, 25 bp, Mus musculus
cgcgcttagccgcagctcctggggt

SEQ ID NO: 227421 - DNA, 25 bp, Mus musculus
tcttaaagggatctccaaaccagcc

SEQ ID NO: 227422 - DNA, 25 bp, Mus musculus
agagaaattcctccgccagtggttt

SEQ ID NO: 227423 - DNA, 25 bp, Mus musculus
agctttgtcccacctgccgagggga

SEQ ID NO: 227424 - DNA, 25 bp, Mus musculus
ctccctccggccgtcgaccaccgcg

SEQ ID NO: 227425 - DNA, 25 bp, Mus musculus
gaccaccgcgccacccgtgagctcc

SEQ ID NO: 227426 - DNA, 25 bp, Mus musculus
tccacctcccgctccgccatgttgg

SEQ ID NO: 227427 - DNA, 25 bp, Mus musculus
tctcagagaaattcctccgccagtg

SEQ ID NO: 227428 - DNA, 25 bp, Mus musculus
ctcacctcacctaccctctttcggg

SEQ ID NO: 227429 - DNA, 25 bp, Mus musculus
gcatgggcctcaaccagaaccgcgg

SEQ ID NO: 227430 - DNA, 25 bp, Mus musculus
gccggaagcgctcctgcgcatgctt

SEQ ID NO: 227431 - DNA, 25 bp, Mus musculus
tacagctatgtctcgggatcggttc

SEQ ID NO: 227432 - DNA, 25 bp, Mus musculus
ccatcgacgccgagcagcggagtct

SEQ ID NO: 227433 - DNA, 25 bp, Mus musculus
ctggcggtccaaaaggcggcaagat

SEQ ID NO: 227434 - DNA, 25 bp, Mus musculus
caagatgcccggtgggcctaagcct

SEQ ID NO: 227435 - DNA, 25 bp, Mus musculus
tgggcgctcctggtggccacccgaa

SEQ ID NO: 227436 - DNA, 25 bp, Mus musculus
agccaccacaccgaggtggcggcga

SEQ ID NO: 227437 - DNA, 25 bp, Mus musculus
gaagatctccgactcggaggtgagc

SEQ ID NO: 227438 - DNA, 25 bp, Mus musculus
tgagcgggttctcgagcaaagccgt

SEQ ID NO: 227439 - DNA, 25 bp, Mus musculus
gttctcgagcaaagccgtccgtttc

SEQ ID NO: 227440 - DNA, 25 bp, Mus musculus
agccgtccgtttccctaagatggcg

SEQ ID NO: 227441 - DNA, 25 bp, Mus musculus
agcctagagggcctccattttgtcc

SEQ ID NO: 227442 - DNA, 25 bp, Mus musculus
accgcgcacggaggagaagatctcc

SEQ ID NO: 227443 - DNA, 25 bp, Mus musculus
aaatgccgcctctctctggaaaagc

SEQ ID NO: 227444 - DNA, 25 bp, Mus musculus
atggactaagcaggagaggttgacg

SEQ ID NO: 227445 - DNA, 25 bp, Mus musculus
tctcccggaggcctttgcggctgag

SEQ ID NO: 227446 - DNA, 25 bp, Mus musculus
tcgcattttgccgtgcaaacaaccc

SEQ ID NO: 227447 - DNA, 25 bp, Mus musculus
gcccactcgcattttgccgtgcaaa

SEQ ID NO: 227448 - DNA, 25 bp, Mus musculus
cgggaagcgcccactcgcattttgc

SEQ ID NO: 227449 - DNA, 25 bp, Mus musculus
ggctgatctgtctccaactcagcgg

SEQ ID NO: 227450 - DNA, 25 bp, Mus musculus
cgaggatggctgatctgtctccaac

SEQ ID NO: 227451 - DNA, 25 bp, Mus musculus
gctccacgaggatggctgatctgtc

SEQ ID NO: 227452 - DNA, 25 bp, Mus musculus
gcgtcaccctcctcaggacgggaga

SEQ ID NO: 227453 - DNA, 25 bp, Mus musculus
cctctctctggaaaagcgggcctga

SEQ ID NO: 227454 - DNA, 25 bp, Mus musculus
ggacgggagaaatgccgcctctctc

SEQ ID NO: 227455 - DNA, 25 bp, Mus musculus
ctttgcggctgagcatgcgcaccgc

SEQ ID NO: 227456 - DNA, 25 bp, Mus musculus
aaagcgggcctgagcggctccacga

SEQ ID NO: 227457 - DNA, 25 bp, Mus musculus
gggtgcattcatggcctgacgaaga

SEQ ID NO: 227458 - DNA, 25 bp, Mus musculus
cgctctgctaacttggggtgcattc

SEQ ID NO: 227459 - DNA, 25 bp, Mus musculus
gtcgatcctatacctgagcccacgt

SEQ ID NO: 227460 - DNA, 25 bp, Mus musculus
tggcgacgccaaatattaggttagg

SEQ ID NO: 227461 - DNA, 25 bp, Mus musculus
agacacagctttttggcgacgccaa

SEQ ID NO: 227462 - DNA, 25 bp, Mus musculus
tcgtctttttggtgacccgggcatg

SEQ ID NO: 227463 - DNA, 25 bp, Mus musculus
ctgacgaagagcctagacacagctt

SEQ ID NO: 227464 - DNA, 25 bp, Mus musculus
ggagccaggccgagtctcgtctttt

SEQ ID NO: 227465 - DNA, 25 bp, Mus musculus
attcacaaaggcaccaggcggcctc

SEQ ID NO: 227466 - DNA, 25 bp, Mus musculus
taccctcgcgtccagattcacaaag

SEQ ID NO: 227467 - DNA, 25 bp, Mus musculus
ccagcctagaaagagaggtttccta

SEQ ID NO: 227468 - DNA, 25 bp, Mus musculus
tgggcgacgagaccttcctgtacgt

SEQ ID NO: 227469 - DNA, 25 bp, Mus musculus
aaccactgtgtcttcgcttgggcga

SEQ ID NO: 227470 - DNA, 25 bp, Mus musculus
ccaggctttggggtcactgtaacca

SEQ ID NO: 227471 - DNA, 25 bp, Mus musculus
cctaccgggctagagaaagccgctc

SEQ ID NO: 227472 - DNA, 25 bp, Mus musculus
cgccggagagcttgcgacattcaga

SEQ ID NO: 227473 - DNA, 25 bp, Mus musculus
attctggttgcgaacgggaacgccg

SEQ ID NO: 227474 - DNA, 25 bp, Mus musculus
cgctccgttggagactgagttcctc

SEQ ID NO: 227475 - DNA, 25 bp, Mus musculus
agcatcctcaggctcgctgcagttg

SEQ ID NO: 227476 - DNA, 25 bp, Mus musculus
cggagtggcagctcatcacgtgacc

SEQ ID NO: 227477 - DNA, 25 bp, Mus musculus
cgccgcaggaagttctgggtaacct

SEQ ID NO: 227478 - DNA, 25 bp, Mus musculus
ttttgtgcattctccgactggcgtc

SEQ ID NO: 227479 - DNA, 25 bp, Mus musculus
ccacctgagaccttgaatgcttttg

SEQ ID NO: 227480 - DNA, 25 bp, Mus musculus
ttcctcaggcgattccagtaaagta

SEQ ID NO: 227481 - DNA, 25 bp, Mus musculus
caaggcgttgcgttgccattcctca

SEQ ID NO: 227482 - DNA, 25 bp, Mus musculus
cgcacgcgcagttgtcaaggcgttg

SEQ ID NO: 227483 - DNA, 25 bp, Mus musculus
ggaacgtccaattacctcaggtcta

SEQ ID NO: 227484 - DNA, 25 bp, Mus musculus
ggtaacctcacgtgacaggaccgtc

SEQ ID NO: 227485 - DNA, 25 bp, Mus musculus
tgctgaacaggtgagcacaggctcc

SEQ ID NO: 227486 - DNA, 25 bp, Mus musculus
tgccacagccaggacaagccctagg

SEQ ID NO: 227487 - DNA, 25 bp, Mus musculus
cctaggcactgggagagaagacgaa

SEQ ID NO: 227488 - DNA, 25 bp, Mus musculus
gtgtgccaggacttggttgcagctc

SEQ ID NO: 227489 - DNA, 25 bp, Mus musculus
gccaggactgggtagcaacccgaga

SEQ ID NO: 227490 - DNA, 25 bp, Mus musculus
cggggcagcgttctgatagccatcc

SEQ ID NO: 227491 - DNA, 25 bp, Mus musculus
gtcctttggcactgggtcctagcca

SEQ ID NO: 227492 - DNA, 25 bp, Mus musculus
agaggccgcgacagctttgtcctga

SEQ ID NO: 227493 - DNA, 25 bp, Mus musculus
ttgttctacctgcagatgccctgtg

SEQ ID NO: 227494 - DNA, 25 bp, Mus musculus
cctgtgtgtgtccatgctcacgcct

SEQ ID NO: 227495 - DNA, 25 bp, Mus musculus
tcgcatcctcacgttgtatcacttc

SEQ ID NO: 227496 - DNA, 25 bp, Mus musculus
actcttatcccagctttgcgctttg

SEQ ID NO: 227497 - DNA, 25 bp, Mus musculus
tgcgccagaggatccgcaaagtgct

SEQ ID NO: 227498 - DNA, 25 bp, Mus musculus
tgtggtgaccaccatcgagaacctg

SEQ ID NO: 227499 - DNA, 25 bp, Mus musculus
ggagcttagttaggttccaacactg

SEQ ID NO: 227500 - DNA, 25 bp, Mus musculus
ctttgaaatgtttgagaaggctctc

SEQ ID NO: 227501 - DNA, 25 bp, Mus musculus
agcctccgccactttgaaatgtttg

SEQ ID NO: 227502 - DNA, 25 bp, Mus musculus
ggccttgtgcacgttagactagcta

SEQ ID NO: 227503 - DNA, 25 bp, Mus musculus
atttccagcgctgaggaccgcacct

SEQ ID NO: 227504 - DNA, 25 bp, Mus musculus
tgtagcctgcttttcatttccagcg

SEQ ID NO: 227505 - DNA, 25 bp, Mus musculus
gcacagtgccagcatttgtagcctg

SEQ ID NO: 227506 - DNA, 25 bp, Mus musculus
gggaccaactcctcgggagcacagt

SEQ ID NO: 227507 - DNA, 25 bp, Mus musculus
aggttccaacactggggcgagcctg

SEQ ID NO: 227508 - DNA, 25 bp, Mus musculus
ggttctggaaacatgggagcttagt

SEQ ID NO: 227509 - DNA, 25 bp, Mus musculus
gcagatggacgagcctgaaggttct

SEQ ID NO: 227510 - DNA, 25 bp, Mus musculus
agggacgataactaagcagatggac

SEQ ID NO: 227511 - DNA, 25 bp, Mus musculus
ggcctttctacacaaagggacgata

SEQ ID NO: 227512 - DNA, 25 bp, Mus musculus
cgagcctgaagaaaggggaccaact

SEQ ID NO: 227513 - DNA, 25 bp, Mus musculus
gcgtggacacacacccgatactccg

SEQ ID NO: 227514 - DNA, 25 bp, Mus musculus
gaaggacagtgtgtgctcggttccc

SEQ ID NO: 227515 - DNA, 25 bp, Mus musculus
cccgtgtcacaacagatggtgagcg

SEQ ID NO: 227516 - DNA, 25 bp, Mus musculus
caccggggctgccaagctctttcag

SEQ ID NO: 227517 - DNA, 25 bp, Mus musculus
gttctgcttggcgtcttcttcgcgc

SEQ ID NO: 227518 - DNA, 25 bp, Mus musculus
ctatgtcgttcagggtaggcgtgtt

SEQ ID NO: 227519 - DNA, 25 bp, Mus musculus
gtcttcttcgcgctcaccggggctg

SEQ ID NO: 227520 - DNA, 25 bp, Mus musculus
aaggcgggcgctgctatgtcgttca

SEQ ID NO: 227521 - DNA, 25 bp, Mus musculus
gcgggccggaccgactgtagtcttc

SEQ ID NO: 227522 - DNA, 25 bp, Mus musculus
cctgtaaggaaaggcctcagtgggc

SEQ ID NO: 227523 - DNA, 25 bp, Mus musculus
gtacagcctgtaaggaaaggcctca

SEQ ID NO: 227524 - DNA, 25 bp, Mus musculus
ccctccacaatgagtacagcctgta

SEQ ID NO: 227525 - DNA, 25 bp, Mus musculus
ggcttcatgccttcgggctcgaggc

SEQ ID NO: 227526 - DNA, 25 bp, Mus musculus
tgccaagctctttcaggtctcggcc

SEQ ID NO: 227527 - DNA, 25 bp, Mus musculus
ggtgaggcagccgtgtgtctccccc

SEQ ID NO: 227528 - DNA, 25 bp, Mus musculus
ggaccacgcgctccgcagacgcgct

SEQ ID NO: 227529 - DNA, 25 bp, Mus musculus
gagcccgaccgggccaggtaagcaa

SEQ ID NO: 227530 - DNA, 25 bp, Mus musculus
ctcagcactcgctcggggctccgca

SEQ ID NO: 227531 - DNA, 25 bp, Mus musculus
cagcctccgtggcttggccgcctcc

SEQ ID NO: 227532 - DNA, 25 bp, Mus musculus
cgccggctgcgacctcggtcctcgc

SEQ ID NO: 227533 - DNA, 25 bp, Mus musculus
ctgtcgctcagagacgcgggcgctc

SEQ ID NO: 227534 - DNA, 25 bp, Mus musculus
ttcctgggtcttcggtacacaccga

SEQ ID NO: 227535 - DNA, 25 bp, Mus musculus
caccgaatgtgctggttcctgggtc

SEQ ID NO: 227536 - DNA, 25 bp, Mus musculus
gtcgtgacaccgaatgtgctggttc

SEQ ID NO: 227537 - DNA, 25 bp, Mus musculus
cgcggtcgtgacaccgaatgtgctg

SEQ ID NO: 227538 - DNA, 25 bp, Mus musculus
tgctgtgcgcggtcgtgacaccgaa

SEQ ID NO: 227539 - DNA, 25 bp, Mus musculus
tcccggtgcccaggtctgctgtgcg

SEQ ID NO: 227540 - DNA, 25 bp, Mus musculus
ctctgggcttgggtcccggtgccca

SEQ ID NO: 227541 - DNA, 25 bp, Mus musculus
cggtccgcagccttcaacttcagaa

SEQ ID NO: 227542 - DNA, 25 bp, Mus musculus
aggagctgcggagcttggcacgaca

SEQ ID NO: 227543 - DNA, 25 bp, Mus musculus
atcatcaagaccatccctggccggg

SEQ ID NO: 227544 - DNA, 25 bp, Mus musculus
cctcgagttggcaccggtgccaccc

SEQ ID NO: 227545 - DNA, 25 bp, Mus musculus
acgcaccctcgagttggcaccggtg

SEQ ID NO: 227546 - DNA, 25 bp, Mus musculus
agcttcaccgcagcagagggcccgg

SEQ ID NO: 227547 - DNA, 25 bp, Mus musculus
agagcttcaccgcagcagagggccc

SEQ ID NO: 227548 - DNA, 25 bp, Mus musculus
cacgagagcttcaccgcagcagagg

SEQ ID NO: 227549 - DNA, 25 bp, Mus musculus
agcaccgactctgcccacgagagct

SEQ ID NO: 227550 - DNA, 25 bp, Mus musculus
ccgcccagagcagcaccgactctgc

SEQ ID NO: 227551 - DNA, 25 bp, Mus musculus
gcagccttcaacttcagaaaggccc

SEQ ID NO: 227552 - DNA, 25 bp, Mus musculus
tccgcagccttcaacttcagaaagg

SEQ ID NO: 227553 - DNA, 25 bp, Mus musculus
ggtccgcagccttcaacttcagaaa

SEQ ID NO: 227554 - DNA, 25 bp, Mus musculus
agcttggcacgacagcggaagtggc

SEQ ID NO: 227555 - DNA, 25 bp, Mus musculus
cacctactcagtcttccgcacggtc

SEQ ID NO: 227556 - DNA, 25 bp, Mus musculus
gtcttccgcacggtccacacacagg

SEQ ID NO: 227557 - DNA, 25 bp, Mus musculus
tccgcacggtccacacacagggcca

SEQ ID NO: 227558 - DNA, 25 bp, Mus musculus
acacagggccagtgggcctaccgcg

SEQ ID NO: 227559 - DNA, 25 bp, Mus musculus
ccagtgggcctaccgcgagggctac

SEQ ID NO: 227560 - DNA, 25 bp, Mus musculus
cgagggctacccactgccgtatgag

SEQ ID NO: 227561 - DNA, 25 bp, Mus musculus
gagggctacccactgccgtatgagc

SEQ ID NO: 227562 - DNA, 25 bp, Mus musculus
gggctacccactgccgtatgagccg

SEQ ID NO: 227563 - DNA, 25 bp, Mus musculus
tacccactgccgtatgagccgccgg

SEQ ID NO: 227564 - DNA, 25 bp, Mus musculus
tatgagccgccggccaccgatgggt

SEQ ID NO: 227565 - DNA, 25 bp, Mus musculus
ccaccgatgggtcgcctggccctac

SEQ ID NO: 227566 - DNA, 25 bp, Mus musculus
atggagcggggttcacgtagcctcc

SEQ ID NO: 227567 - DNA, 25 bp, Mus musculus
gctccttccagaggcacgcctctga

SEQ ID NO: 227568 - DNA, 25 bp, Mus musculus
tggagcggggttcacgtagcctccc

SEQ ID NO: 227569 - DNA, 25 bp, Mus musculus
caggggttttgaccagctttgacct

SEQ ID NO: 227570 - DNA, 25 bp, Mus musculus
cgtggggatcaagcttcgtggcttt

SEQ ID NO: 227571 - DNA, 25 bp, Mus musculus
ccatcttcctggtccgacgctttga

SEQ ID NO: 227572 - DNA, 25 bp, Mus musculus
tgtacacccagcgtcgaggtcactg

SEQ ID NO: 227573 - DNA, 25 bp, Mus musculus
ttccgccacagttcggctaccgaga

SEQ ID NO: 227574 - DNA, 25 bp, Mus musculus
gccgataccaaagaagccctcgcgg

SEQ ID NO: 227575 - DNA, 25 bp, Mus musculus
ccatcccatggggaacttgcacggg

SEQ ID NO: 227576 - DNA, 25 bp, Mus musculus
gtcccattgggagactcacgaaatc

SEQ ID NO: 227577 - DNA, 25 bp, Mus musculus
ggccaattctagacgctgtcccatt

SEQ ID NO: 227578 - DNA, 25 bp, Mus musculus
agctttgacctcgtgcgcctgcaag

SEQ ID NO: 227579 - DNA, 25 bp, Mus musculus
gcgctcgagcccgttattctttgga

SEQ ID NO: 227580 - DNA, 25 bp, Mus musculus
gggcaccatctctgccattatttta

SEQ ID NO: 227581 - DNA, 25 bp, Mus musculus
ccagtcccagcgatgtggccaattc

SEQ ID NO: 227582 - DNA, 25 bp, Mus musculus
cgtggctttttatgaagaatcccga

SEQ ID NO: 227583 - DNA, 25 bp, Mus musculus
tcctagttgagggagcgatggtttc

SEQ ID NO: 227584 - DNA, 25 bp, Mus musculus
cgaagggtgacgaagccacgcgtgt

SEQ ID NO: 227585 - DNA, 25 bp, Mus musculus
ccctgcaggccgaagggtgacgaag

SEQ ID NO: 227586 - DNA, 25 bp, Mus musculus
tggtcagatctcgtccgcctcaggc

SEQ ID NO: 227587 - DNA, 25 bp, Mus musculus
gactgtggtcagatctcgtccgcct

SEQ ID NO: 227588 - DNA, 25 bp, Mus musculus
cgagtgtggactgtggtcagatctc

SEQ ID NO: 227589 - DNA, 25 bp, Mus musculus
ggagcgatggtttccgtgacccgct

SEQ ID NO: 227590 - DNA, 25 bp, Mus musculus
ggaacggctcctcctagttgaggga

SEQ ID NO: 227591 - DNA, 25 bp, Mus musculus
ccacgggaacggctcctcctagttg

SEQ ID NO: 227592 - DNA, 25 bp, Mus musculus
gctgagggcacttcgcttcccagga

SEQ ID NO: 227593 - DNA, 25 bp, Mus musculus
cagggctgagggcacttcgcttccc

SEQ ID NO: 227594 - DNA, 25 bp, Mus musculus
accgcaggtgagttcccagggctga

SEQ ID NO: 227595 - DNA, 25 bp, Mus musculus
gtccctgttgctcccggctagcggg

SEQ ID NO: 227596 - DNA, 25 bp, Mus musculus
atggtttccgtgacccgctcggcct

SEQ ID NO: 227597 - DNA, 25 bp, Mus musculus
tcccgcagtggagtgaaccgtttcc

SEQ ID NO: 227598 - DNA, 25 bp, Mus musculus
ggggggcaagcaagcctcagccctc

SEQ ID NO: 227599 - DNA, 25 bp, Mus musculus
tcagccctcccgcagtggagtgaac

SEQ ID NO: 227600 - DNA, 25 bp, Mus musculus
ctcccgcagtggagtgaaccgtttc

SEQ ID NO: 227601 - DNA, 25 bp, Mus musculus
tgcttgcccggctggcccaggtaga

SEQ ID NO: 227602 - DNA, 25 bp, Mus musculus
acgaccgtggccgaagctgcgcctg

SEQ ID NO: 227603 - DNA, 25 bp, Mus musculus
ccgaagctgcgcctgcgggaatcct

SEQ ID NO: 227604 - DNA, 25 bp, Mus musculus
ctgcgcctgcgggaatcctgcagga

SEQ ID NO: 227605 - DNA, 25 bp, Mus musculus
tgcgggaatcctgcaggaccgcgcc

SEQ ID NO: 227606 - DNA, 25 bp, Mus musculus
cccgcaggacgccttaaatagcgcg

SEQ ID NO: 227607 - DNA, 25 bp, Mus musculus
caggacgccttaaatagcgcgcagc

SEQ ID NO: 227608 - DNA, 25 bp, Mus musculus
acgccttaaatagcgcgcagctgcg

SEQ ID NO: 227609 - DNA, 25 bp, Mus musculus
gtggcttcagtcgcgtctggcgccc

SEQ ID NO: 227610 - DNA, 25 bp, Mus musculus
ctggcccaggtagaggggacgaccg

SEQ ID NO: 227611 - DNA, 25 bp, Mus musculus
tgggccgagcgatgtagcaatccac

SEQ ID NO: 227612 - DNA, 25 bp, Mus musculus
cgcggtaggctacatgcaggatgac

SEQ ID NO: 227613 - DNA, 25 bp, Mus musculus
ttctggcgatgcttccgttcccgct

SEQ ID NO: 227614 - DNA, 25 bp, Mus musculus
ggctgtacagtttggcgcattgctc

SEQ ID NO: 227615 - DNA, 25 bp, Mus musculus
cgccatgcttcttgcccgggtggct

SEQ ID NO: 227616 - DNA, 25 bp, Mus musculus
agtaggtccaccacaggccgccatg

SEQ ID NO: 227617 - DNA, 25 bp, Mus musculus
atgaggctaaacaagtaggtccacc

SEQ ID NO: 227618 - DNA, 25 bp, Mus musculus
caggaagaccaattcgatgatgagc

SEQ ID NO: 227619 - DNA, 25 bp, Mus musculus
cgtgtggagaacgtacaggaagacc

SEQ ID NO: 227620 - DNA, 25 bp, Mus musculus
atggtgaagccatgccagagcgtgt

SEQ ID NO: 227621 - DNA, 25 bp, Mus musculus
cactgtaccagacgcggcatggtga

SEQ ID NO: 227622 - DNA, 25 bp, Mus musculus
cagggtactatgctggcgcactgta

SEQ ID NO: 227623 - DNA, 25 bp, Mus musculus
atgaccagcatagacggacacgtga

SEQ ID NO: 227624 - DNA, 25 bp, Mus musculus
tgtagcaatccacggtgttggggca

SEQ ID NO: 227625 - DNA, 25 bp, Mus musculus
tcgtctcctaagacccgcaggtgga

SEQ ID NO: 227626 - DNA, 25 bp, Mus musculus
gcgcagagctgcgacccgcaccgca

SEQ ID NO: 227627 - DNA, 25 bp, Mus musculus
ccttaaaagggctccgattgggcag

SEQ ID NO: 227628 - DNA, 25 bp, Mus musculus
gttcgtctcctaagacccgcaggtg

SEQ ID NO: 227629 - DNA, 25 bp, Mus musculus
gggcgttcgtctcctaagacccgca

SEQ ID NO: 227630 - DNA, 25 bp, Mus musculus
ttcagtgggttcaagcgcaacggct

SEQ ID NO: 227631 - DNA, 25 bp, Mus musculus
ttctttcagtgggttcaagcgcaac

SEQ ID NO: 227632 - DNA, 25 bp, Mus musculus
ccgtcgagagctgggattctttcag

SEQ ID NO: 227633 - DNA, 25 bp, Mus musculus
cacactcctgccgtcgagagctggg

SEQ ID NO: 227634 - DNA, 25 bp, Mus musculus
tttgcgtgtcagtcgctcccacact

SEQ ID NO: 227635 - DNA, 25 bp, Mus musculus
cggatttgcgtgtcagtcgctccca

SEQ ID NO: 227636 - DNA, 25 bp, Mus musculus
gtcagcggatttgcgtgtcagtcgc

SEQ ID NO: 227637 - DNA, 25 bp, Mus musculus
gacccgcaccgcagagggtcccaac

SEQ ID NO: 227638 - DNA, 25 bp, Mus musculus
agctgggattctttcagtgggttca

SEQ ID NO: 227639 - DNA, 25 bp, Mus musculus
gatcacatggtcgtaagcctggctg

SEQ ID NO: 227640 - DNA, 25 bp, Mus musculus
ggccgggatctggaacttcgactct

SEQ ID NO: 227641 - DNA, 25 bp, Mus musculus
cctttgagaaggcaagggactaatt

SEQ ID NO: 227642 - DNA, 25 bp, Mus musculus
ggctcacgacccattcttcgaacta

SEQ ID NO: 227643 - DNA, 25 bp, Mus musculus
cctttggctaaggagagggctcacg

SEQ ID NO: 227644 - DNA, 25 bp, Mus musculus
aggactaaagtcctctgggtcagtg

SEQ ID NO: 227645 - DNA, 25 bp, Mus musculus
agcgggtaagcgacgagcagtttac

SEQ ID NO: 227646 - DNA, 25 bp, Mus musculus
gcgacagcggtattccggaaccgga

SEQ ID NO: 227647 - DNA, 25 bp, Mus musculus
actacgcaggcgcaaccgctttctg

SEQ ID NO: 227648 - DNA, 25 bp, Mus musculus
gacttcagccgaaaagcggatgtta

SEQ ID NO: 227649 - DNA, 25 bp, Mus musculus
tcgtcccgtcggtaagatcacatgg

SEQ ID NO: 227650 - DNA, 25 bp, Mus musculus
attcacttccgggtgagaaccaccg

SEQ ID NO: 227651 - DNA, 25 bp, Mus musculus
gggcgccatcttgtcttgttcatga

SEQ ID NO: 227652 - DNA, 25 bp, Mus musculus
cctggctgagaatcagtgtgacttc

SEQ ID NO: 227653 - DNA, 25 bp, Mus musculus
tgacccgaaggccagagcgaccttc

SEQ ID NO: 227654 - DNA, 25 bp, Mus musculus
ctctcccgggactcccatgggagga

SEQ ID NO: 227655 - DNA, 25 bp, Mus musculus
tgggattcagaaacctctcccggga

SEQ ID NO: 227656 - DNA, 25 bp, Mus musculus
cctcccgaaggcgatcgtgggattc

SEQ ID NO: 227657 - DNA, 25 bp, Mus musculus
gctccgtgcagaggggatgcatcct

SEQ ID NO: 227658 - DNA, 25 bp, Mus musculus
aggagaactcgcgtgctccgtgcag

SEQ ID NO: 227659 - DNA, 25 bp, Mus musculus
tccggccggaagtgcatttgcagag

SEQ ID NO: 227660 - DNA, 25 bp, Mus musculus
tggtaaatcttcagttccggccgga

SEQ ID NO: 227661 - DNA, 25 bp, Mus musculus
cagagcgaccttctagcggccgtct

SEQ ID NO: 227662 - DNA, 25 bp, Mus musculus
tttaaggccgacctggatgacccga

SEQ ID NO: 227663 - DNA, 25 bp, Mus musculus
tggccgctctaaccgcgtctagaac

SEQ ID NO: 227664 - DNA, 25 bp, Mus musculus
gcgtggaactctggccgctctaacc

SEQ ID NO: 227665 - DNA, 25 bp, Mus musculus
tgtagacgaggtcccaccgccgcgt

SEQ ID NO: 227666 - DNA, 25 bp, Mus musculus
gcggccgtctcgatggtaaatcttc

SEQ ID NO: 227667 - DNA, 25 bp, Mus musculus
accggagcaaggatgttgcggctgc

SEQ ID NO: 227668 - DNA, 25 bp, Mus musculus
gaagcggctccggagtgattaatcc

SEQ ID NO: 227669 - DNA, 25 bp, Mus musculus
ctccggagtgattaatccggggata

SEQ ID NO: 227670 - DNA, 25 bp, Mus musculus
ggagtgattaatccggggataattc

SEQ ID NO: 227671 - DNA, 25 bp, Mus musculus
aagcgggattggagcgagtcatttc

SEQ ID NO: 227672 - DNA, 25 bp, Mus musculus
attggagcgagtcatttccgagagc

SEQ ID NO: 227673 - DNA, 25 bp, Mus musculus
agcgagtcatttccgagagcgcagc

SEQ ID NO: 227674 - DNA, 25 bp, Mus musculus
ccgggcggacacttggttcattcca

SEQ ID NO: 227675 - DNA, 25 bp, Mus musculus
acacttggttcattccagccgcaga

SEQ ID NO: 227676 - DNA, 25 bp, Mus musculus
tggttcattccagccgcagaagctc

SEQ ID NO: 227677 - DNA, 25 bp, Mus musculus
ctcagggctcccgcgtaccgggatt

SEQ ID NO: 227678 - DNA, 25 bp, Mus musculus
cctgacctcctttctcctcggcggc

SEQ ID NO: 227679 - DNA, 25 bp, Mus musculus
aaatcgggatttgggcgcttgtgcc

SEQ ID NO: 227680 - DNA, 25 bp, Mus musculus
aaagctacagagctctcctgacctc

SEQ ID NO: 227681 - DNA, 25 bp, Mus musculus
ccctctactggctcctactccgcgc

SEQ ID NO: 227682 - DNA, 25 bp, Mus musculus
cgtgcaatctttcttgaagggctca

SEQ ID NO: 227683 - DNA, 25 bp, Mus musculus
atctttcttgaagggctcatgtgaa

SEQ ID NO: 227684 - DNA, 25 bp, Mus musculus
gaatgtcactgccagggtccgtgcc

SEQ ID NO: 227685 - DNA, 25 bp, Mus musculus
cctactccgcgccaaagtgcccttt

SEQ ID NO: 227686 - DNA, 25 bp, Mus musculus
ctgctgcagccaaacgcctgggctg

SEQ ID NO: 227687 - DNA, 25 bp, Mus musculus
caaacgcctgggctgcggcatccgt

SEQ ID NO: 227688 - DNA, 25 bp, Mus musculus
gggtggcagactcgatctccttaag

SEQ ID NO: 227689 - DNA, 25 bp, Mus musculus
gcagactcgatctccttaagccagc

SEQ ID NO: 227690 - DNA, 25 bp, Mus musculus
atctccttaagccagcccggacaga

SEQ ID NO: 227691 - DNA, 25 bp, Mus musculus
aagccagcccggacagacctgaagg

SEQ ID NO: 227692 - DNA, 25 bp, Mus musculus
cagcccggacagacctgaagggtgt

SEQ ID NO: 227693 - DNA, 25 bp, Mus musculus
ggggtccgtgcaatctttcttgaag

SEQ ID NO: 227694 - DNA, 25 bp, Mus musculus
aaagtgccctttcccgcgccctgct

SEQ ID NO: 227695 - DNA, 25 bp, Mus musculus
gttgaagtctttgccgcattctgtg

SEQ ID NO: 227696 - DNA, 25 bp, Mus musculus
ccaggctggagctcttgctgaaact

SEQ ID NO: 227697 - DNA, 25 bp, Mus musculus
tggttagccaggctggagctcttgc

SEQ ID NO: 227698 - DNA, 25 bp, Mus musculus
gcttggaacgctcgctgaagcactt

SEQ ID NO: 227699 - DNA, 25 bp, Mus musculus
cacactcggggcattcgtagggctt

SEQ ID NO: 227700 - DNA, 25 bp, Mus musculus
ggagcggtctcggaagaacttgcca

SEQ ID NO: 227701 - DNA, 25 bp, Mus musculus
gctggagctctggttgaagcacttc

SEQ ID NO: 227702 - DNA, 25 bp, Mus musculus
aatccgctggtgaatgatgaggctg

SEQ ID NO: 227703 - DNA, 25 bp, Mus musculus
ttgctgaaactcttcccgcacacgg

SEQ ID NO: 227704 - DNA, 25 bp, Mus musculus
ttgccgcattctgtgcacttgtagg

SEQ ID NO: 227705 - DNA, 25 bp, Mus musculus
tgggagctgttgttgaagtctttgc

SEQ ID NO: 227706 - DNA, 25 bp, Mus musculus
cgcacacggcacactcatacggctt

SEQ ID NO: 227707 - DNA, 25 bp, Mus musculus
tccctcccgcgtgggttctgcggtg

SEQ ID NO: 227708 - DNA, 25 bp, Mus musculus
ttctgtgcacttgtagggtttctcg

SEQ ID NO: 227709 - DNA, 25 bp, Mus musculus
tcccaggatggacctggccggagtc

SEQ ID NO: 227710 - DNA, 25 bp, Mus musculus
caccagatgtgcttgatcgcgtgga

SEQ ID NO: 227711 - DNA, 25 bp, Mus musculus
cttgcccaaggacagatacttcctg

SEQ ID NO: 227712 - DNA, 25 bp, Mus musculus
aaaaatgcctcaggcctgtaagccc

SEQ ID NO: 227713 - DNA, 25 bp, Mus musculus
gggctcctgtttatgagagagaaca

SEQ ID NO: 227714 - DNA, 25 bp, Mus musculus
tgagagagaacaatccacgtctctg

SEQ ID NO: 227715 - DNA, 25 bp, Mus musculus
tctgctcccttaaacaagtgtgttg

SEQ ID NO: 227716 - DNA, 25 bp, Mus musculus
tgttggagccaactgcaccagatgt

SEQ ID NO: 227717 - DNA, 25 bp, Mus musculus
ggaagtacatcaggggacacgcaca

SEQ ID NO: 227718 - DNA, 25 bp, Mus musculus
cacacccgactggacctggtgggga

SEQ ID NO: 227719 - DNA, 25 bp, Mus musculus
gcgtagcctcatggacgctccttta

SEQ ID NO: 227720 - DNA, 25 bp, Mus musculus
cctcagcaaaacgtggggatcccag

SEQ ID NO: 227721 - DNA, 25 bp, Mus musculus
ggagtccatcatcccggctagtatt

SEQ ID NO: 227722 - DNA, 25 bp, Mus musculus
ggacgctcctttataaacctcagca

SEQ ID NO: 227723 - DNA, 25 bp, Mus musculus
catggccaccggttcagtcccagag

SEQ ID NO: 227724 - DNA, 25 bp, Mus musculus
taggagagccgctgaagtccctgca

SEQ ID NO: 227725 - DNA, 25 bp, Mus musculus
aggaccgcggcgatctctggagtca

SEQ ID NO: 227726 - DNA, 25 bp, Mus musculus
ccgcgatgaggaccgcggcgatctc

SEQ ID NO: 227727 - DNA, 25 bp, Mus musculus
cagcgcggtggacaccggttcaccg

SEQ ID NO: 227728 - DNA, 25 bp, Mus musculus
cacccagctgtcacggtgcggcgag

SEQ ID NO: 227729 - DNA, 25 bp, Mus musculus
gtatgctaatacatggtaatcgccc

SEQ ID NO: 227730 - DNA, 25 bp, Mus musculus
cacgtgacactctccggtatgctaa

SEQ ID NO: 227731 - DNA, 25 bp, Mus musculus
ctggagtgggcacgtgacactctcc

SEQ ID NO: 227732 - DNA, 25 bp, Mus musculus
cttctccgagtgacgattggctgga

SEQ ID NO: 227733 - DNA, 25 bp, Mus musculus
ttcaatctccgccttctccgagtga

SEQ ID NO: 227734 - DNA, 25 bp, Mus musculus
accaaggcgtgttcaattcaatctc

SEQ ID NO: 227735 - DNA, 25 bp, Mus musculus
tcccagagcagcaccaaggcgtgtt

SEQ ID NO: 227736 - DNA, 25 bp, Mus musculus
tgaagtccctgcagtcgcgtgatct

SEQ ID NO: 227737 - DNA, 25 bp, Mus musculus
gacaagttgttttgtgcctgtcctc

SEQ ID NO: 227738 - DNA, 25 bp, Mus musculus
cagaatgcgaactggtgaagttgtc

SEQ ID NO: 227739 - DNA, 25 bp, Mus musculus
caggtaatgtgcacggccagaatgc

SEQ ID NO: 227740 - DNA, 25 bp, Mus musculus
aagttgacgtccagagaggcaggta

SEQ ID NO: 227741 - DNA, 25 bp, Mus musculus
gcgtctgtttaagttgacgtccaga

SEQ ID NO: 227742 - DNA, 25 bp, Mus musculus
tccggaatctttgagcgtctgttta

SEQ ID NO: 227743 - DNA, 25 bp, Mus musculus
gtctgagggctctttacgttaaatc

SEQ ID NO: 227744 - DNA, 25 bp, Mus musculus
ccaagcgaaggtatgctgcgtctga

SEQ ID NO: 227745 - DNA, 25 bp, Mus musculus
gccctcccgtgccaagcgaaggtat

SEQ ID NO: 227746 - DNA, 25 bp, Mus musculus
gtgcctgtcctcttccatttttagg

SEQ ID NO: 227747 - DNA, 25 bp, Mus musculus
acgccttcgagccttccggaggacg

SEQ ID NO: 227748 - DNA, 25 bp, Mus musculus
tgaagttgtcgccagagcgcctgag

SEQ ID NO: 227749 - DNA, 25 bp, Mus musculus
atcttgccgtgccaggaacgggcgc

SEQ ID NO: 227750 - DNA, 25 bp, Mus musculus
aggagagcgttttctcgccctcccg

SEQ ID NO: 227751 - DNA, 25 bp, Mus musculus
actatgtgtttacggatcgcccgga

SEQ ID NO: 227752 - DNA, 25 bp, Mus musculus
gcgactggccaacagctggaccata

SEQ ID NO: 227753 - DNA, 25 bp, Mus musculus
cgatttctactaccacgctgcggtg

SEQ ID NO: 227754 - DNA, 25 bp, Mus musculus
ctgtcgttaagcgaaggcgatttct

SEQ ID NO: 227755 - DNA, 25 bp, Mus musculus
tgccctacgagagggacaagcgatc

SEQ ID NO: 227756 - DNA, 25 bp, Mus musculus
cagatttggtggcacagctgcacgc

SEQ ID NO: 227757 - DNA, 25 bp, Mus musculus
gacgtggaccagtacttcaccggta

SEQ ID NO: 227758 - DNA, 25 bp, Mus musculus
tgtggctgcactgctcaagctgacg

SEQ ID NO: 227759 - DNA, 25 bp, Mus musculus
actttgtgttctgcctggacgtgga

SEQ ID NO: 227760 - DNA, 25 bp, Mus musculus
ccataagcgcggcattgaggcactc

SEQ ID NO: 227761 - DNA, 25 bp, Mus musculus
atgcccacgctacacgaggctctgg

SEQ ID NO: 227762 - DNA, 25 bp, Mus musculus
gcctgctgcgggcaaaacccgtgca

SEQ ID NO: 227763 - DNA, 25 bp, Mus musculus
atcgcccggaagcagtgccctatgt

SEQ ID NO: 227764 - DNA, 25 bp, Mus musculus
cggccagaacgtggtgtactatgtg

SEQ ID NO: 227765 - DNA, 25 bp, Mus musculus
tctggctgctctgtcccgcagaatt

SEQ ID NO: 227766 - DNA, 25 bp, Mus musculus
gggatctcctcctcgcagcatctat

SEQ ID NO: 227767 - DNA, 25 bp, Mus musculus
ctatcccttgggagtgtctggtcct

SEQ ID NO: 227768 - DNA, 25 bp, Mus musculus
tgtctggtcctctagatcctcctcg

SEQ ID NO: 227769 - DNA, 25 bp, Mus musculus
caaggacgagctgctgtgctccatc

SEQ ID NO: 227770 - DNA, 25 bp, Mus musculus
ctgagcatctaccaggacccggtga

SEQ ID NO: 227771 - DNA, 25 bp, Mus musculus
atcgacgatgccttcgaggagttgc

SEQ ID NO: 227772 - DNA, 25 bp, Mus musculus
gggctgcgagcactacttctgccgc

SEQ ID NO: 227773 - DNA, 25 bp, Mus musculus
ctggccaacatcgtggagcgctaca

SEQ ID NO: 227774 - DNA, 25 bp, Mus musculus
ggctcacgacaaggtcaagctcttc

SEQ ID NO: 227775 - DNA, 25 bp, Mus musculus
gcgcactgctctgcttcttctgtga

SEQ ID NO: 227776 - DNA, 25 bp, Mus musculus
gcttcttctgtgatgagcccgcgct

SEQ ID NO: 227777 - DNA, 25 bp, Mus musculus
gcgctgcacgagcaacaccaggtca

SEQ ID NO: 227778 - DNA, 25 bp, Mus musculus
caccaggtcactggcatcgacgatg

SEQ ID NO: 227779 - DNA, 25 bp, Mus musculus
gcaggagcacatggctcgacgccga

SEQ ID NO: 227780 - DNA, 25 bp, Mus musculus
ggcgaacacgaggtcgacccatgtc

SEQ ID NO: 227781 - DNA, 25 bp, Mus musculus
atacggaagtgacgtcaagagaacg

SEQ ID NO: 227782 - DNA, 25 bp, Mus musculus
gtaaagtctattcctcctcccggca

SEQ ID NO: 227783 - DNA, 25 bp, Mus musculus
ttgcccaagtcggtaaagtctattc

SEQ ID NO: 227784 - DNA, 25 bp, Mus musculus
attcggcagtttgcccaagtcggta

SEQ ID NO: 227785 - DNA, 25 bp, Mus musculus
ttccacctatggattcggcagtttg

SEQ ID NO: 227786 - DNA, 25 bp, Mus musculus
ctggctttccacctatggattcggc

SEQ ID NO: 227787 - DNA, 25 bp, Mus musculus
cggagcgcatttctggctttccacc

SEQ ID NO: 227788 - DNA, 25 bp, Mus musculus
cccggctgcggagcgcatttctggc

SEQ ID NO: 227789 - DNA, 25 bp, Mus musculus
ctgtcccggttgtcaggttcccgtg

SEQ ID NO: 227790 - DNA, 25 bp, Mus musculus
atgtcgctgctgtcccggttgtcag

SEQ ID NO: 227791 - DNA, 25 bp, Mus musculus
aggtcgacccatgtcgctgctgtcc

SEQ ID NO: 227792 - DNA, 25 bp, Mus musculus
ggttcttggatacggaagtgacgtc

SEQ ID NO: 227793 - DNA, 25 bp, Mus musculus
ttctgtccgcgggacggctctctca

SEQ ID NO: 227794 - DNA, 25 bp, Mus musculus
gcccataggtctccccagcgagtga

SEQ ID NO: 227795 - DNA, 25 bp, Mus musculus
tttacacggcttcggcccataggtc

SEQ ID NO: 227796 - DNA, 25 bp, Mus musculus
aacgcatttacacggcttcggccca

SEQ ID NO: 227797 - DNA, 25 bp, Mus musculus
taaaacgcatttacacggcttcggc

SEQ ID NO: 227798 - DNA, 25 bp, Mus musculus
tcctgcactcgccttaaaacgcatt

SEQ ID NO: 227799 - DNA, 25 bp, Mus musculus
gcccaaagccgaggacgcccgctcc

SEQ ID NO: 227800 - DNA, 25 bp, Mus musculus
agggtcagcgcccaaagccgaggac

SEQ ID NO: 227801 - DNA, 25 bp, Mus musculus
tggcaattgcggagccgaggcccct

SEQ ID NO: 227802 - DNA, 25 bp, Mus musculus
tgacctcgaaacttgtgcaacaccc

SEQ ID NO: 227803 - DNA, 25 bp, Mus musculus
cggtgacctcgaaacttgtgcaaca

SEQ ID NO: 227804 - DNA, 25 bp, Mus musculus
tcgccggtgacctcgaaacttgtgc

SEQ ID NO: 227805 - DNA, 25 bp, Mus musculus
cgcgggacggctctctcaagtgcag

SEQ ID NO: 227806 - DNA, 25 bp, Mus musculus
tccccagcgagtgaatcggatcctc

SEQ ID NO: 227807 - DNA, 25 bp, Mus musculus
gcacccggtaatcatcctcctttta

SEQ ID NO: 227808 - DNA, 25 bp, Mus musculus
ctcctgtgccatttggcggtggtca

SEQ ID NO: 227809 - DNA, 25 bp, Mus musculus
ctgtggctgctaactgcgaagcctc

SEQ ID NO: 227810 - DNA, 25 bp, Mus musculus
cgagtcctggcagaccaagtcctga

SEQ ID NO: 227811 - DNA, 25 bp, Mus musculus
tacgcacgcgcagatctgtaactcg

SEQ ID NO: 227812 - DNA, 25 bp, Mus musculus
ccgacccggtccttctgacaagagg

SEQ ID NO: 227813 - DNA, 25 bp, Mus musculus
tgacaagaggtaagctcgcgtcgtc

SEQ ID NO: 227814 - DNA, 25 bp, Mus musculus
ccgaccctgggctgattttcaaata

SEQ ID NO: 227815 - DNA, 25 bp, Mus musculus
ccaagccaagatctggcccaagttc

SEQ ID NO: 227816 - DNA, 25 bp, Mus musculus
gcgagcaagctggtccttcagtgta

SEQ ID NO: 227817 - DNA, 25 bp, Mus musculus
tcttaataaaggcatcacgcagtgc

SEQ ID NO: 227818 - DNA, 25 bp, Mus musculus
cgcagtgcttgcatcttctctccta

SEQ ID NO: 227819 - DNA, 25 bp, Mus musculus
cctccttttatttgagagatacccg

SEQ ID NO: 227820 - DNA, 25 bp, Mus musculus
cgctcgccatctcggagactgcgga

SEQ ID NO: 227821 - DNA, 25 bp, Mus musculus
tgtaggaggcggaacccttccgctg

SEQ ID NO: 227822 - DNA, 25 bp, Mus musculus
ccttccgctggggatttgttgtgag

SEQ ID NO: 227823 - DNA, 25 bp, Mus musculus
agtaggattctagtcgcgatgtgga

SEQ ID NO: 227824 - DNA, 25 bp, Mus musculus
tctcgtggggttcgtctcctggaaa

SEQ ID NO: 227825 - DNA, 25 bp, Mus musculus
cctcgcctaacttcacggtcgggtg

SEQ ID NO: 227826 - DNA, 25 bp, Mus musculus
aggttcttccgcacgcctcgggtgc

SEQ ID NO: 227827 - DNA, 25 bp, Mus musculus
ctccgtggggtctggttaaaagcag

SEQ ID NO: 227828 - DNA, 25 bp, Mus musculus
ctggttaaaagcagcgccgcgctgc

SEQ ID NO: 227829 - DNA, 25 bp, Mus musculus
gggacctggtgttgctctctccagc

SEQ ID NO: 227830 - DNA, 25 bp, Mus musculus
acaaccctccaggtctgagaagcca

SEQ ID NO: 227831 - DNA, 25 bp, Mus musculus
gctgaggactaaggatctgggcctc

SEQ ID NO: 227832 - DNA, 25 bp, Mus musculus
cctcggagagcgtgtctcttgtgcc

SEQ ID NO: 227833 - DNA, 25 bp, Mus musculus
ttgcgttctatgagcttgtggcccg

SEQ ID NO: 227834 - DNA, 25 bp, Mus musculus
cgacctttgccctattttatttgcg

SEQ ID NO: 227835 - DNA, 25 bp, Mus musculus
tcgttcccaattctgcccaatcgga

SEQ ID NO: 227836 - DNA, 25 bp, Mus musculus
tctgcccaatcggaaacagaatttt

SEQ ID NO: 227837 - DNA, 25 bp, Mus musculus
gaattttcttagtctcgtcgtacga

SEQ ID NO: 227838 - DNA, 25 bp, Mus musculus
ctcgtcgtacgattggtaaatgaaa

SEQ ID NO: 227839 - DNA, 25 bp, Mus musculus
gtaaatgaaagtgcccgtcaagttc

SEQ ID NO: 227840 - DNA, 25 bp, Mus musculus
cccggagtaggatgtacgctggcct

SEQ ID NO: 227841 - DNA, 25 bp, Mus musculus
tacgctggcctggaagcgctagacc

SEQ ID NO: 227842 - DNA, 25 bp, Mus musculus
ctgttggagtgaagctttggaagac

SEQ ID NO: 227843 - DNA, 25 bp, Mus musculus
tggaagacatggctcccaacgtgtt

SEQ ID NO: 227844 - DNA, 25 bp, Mus musculus
caacgtgttggcttccgaaccggag

SEQ ID NO: 227845 - DNA, 25 bp, Mus musculus
cgaaccggagattccgaagggcatc

SEQ ID NO: 227846 - DNA, 25 bp, Mus musculus
gtggagcccgagaagctacaaggtc

SEQ ID NO: 227847 - DNA, 25 bp, Mus musculus
tcggagagccggaagctcctttccc

SEQ ID NO: 227848 - DNA, 25 bp, Mus musculus
agccgagagccgcacgcgctctgtt

SEQ ID NO: 227849 - DNA, 25 bp, Mus musculus
gcaaagaaagggttttgaggcatcc

SEQ ID NO: 227850 - DNA, 25 bp, Mus musculus
cgtgctctctctagggatgtaatgc

SEQ ID NO: 227851 - DNA, 25 bp, Mus musculus
cgcacccgcactgcgtgtctgggaa

SEQ ID NO: 227852 - DNA, 25 bp, Mus musculus
gaagctagtcacgtggcaccgccac

SEQ ID NO: 227853 - DNA, 25 bp, Mus musculus
tcttccctggaaggccctggaggga

SEQ ID NO: 227854 - DNA, 25 bp, Mus musculus
tccctcttcgatgcagcggactgcg

SEQ ID NO: 227855 - DNA, 25 bp, Mus musculus
gctgcggctacaattccctggtttc

SEQ ID NO: 227856 - DNA, 25 bp, Mus musculus
ttagcggaaaacaccgcgagcgctg

SEQ ID NO: 227857 - DNA, 25 bp, Mus musculus
ccctccaaagaatggggtatccttg

SEQ ID NO: 227858 - DNA, 25 bp, Mus musculus
agagaacgacggatgctgcagccta

SEQ ID NO: 227859 - DNA, 25 bp, Mus musculus
ctggtgtagttgtccgagagaacga

SEQ ID NO: 227860 - DNA, 25 bp, Mus musculus
cctcccacagagaagctggtgtagt

SEQ ID NO: 227861 - DNA, 25 bp, Mus musculus
gcccgcgaatctccgcgagcgagaa

SEQ ID NO: 227862 - DNA, 25 bp, Mus musculus
tggggtatccttgaccttagcggaa

SEQ ID NO: 227863 - DNA, 25 bp, Mus musculus
ctctgcgggccatgggctccgagaa

SEQ ID NO: 227864 - DNA, 25 bp, Mus musculus
ggcttctgtctctgggaggactgcc

SEQ ID NO: 227865 - DNA, 25 bp, Mus musculus
cgccgctcatgcacaagtacgaaga

SEQ ID NO: 227866 - DNA, 25 bp, Mus musculus
atgggctccgagaaggactccgagt

SEQ ID NO: 227867 - DNA, 25 bp, Mus musculus
gccggtggaagctctgccctccgag

SEQ ID NO: 227868 - DNA, 25 bp, Mus musculus
acgaagagttcatgctgcgccggta

SEQ ID NO: 227869 - DNA, 25 bp, Mus musculus
agtgcccgctgtgcctggtgcgcct

SEQ ID NO: 227870 - DNA, 25 bp, Mus musculus
gcggaggctttataaccacttcgta

SEQ ID NO: 227871 - DNA, 25 bp, Mus musculus
cactacctgcgcctggagatcagcg

SEQ ID NO: 227872 - DNA, 25 bp, Mus musculus
ctgcgcctggagatcagcgagagcc

SEQ ID NO: 227873 - DNA, 25 bp, Mus musculus
cgagtgcagcgagcggctcaaccca

SEQ ID NO: 227874 - DNA, 25 bp, Mus musculus
acgacatccgtctgctgctggccga

SEQ ID NO: 227875 - DNA, 25 bp, Mus musculus
tgctgcgccggtacctggcctcgga

SEQ ID NO: 227876 - DNA, 25 bp, Mus musculus
aaccacttcgtagcggctggtcggc

SEQ ID NO: 227877 - DNA, 25 bp, Mus musculus
gggtcgcgctcacatgctaacacca

SEQ ID NO: 227878 - DNA, 25 bp, Mus musculus
ccaggagcctgcttgggcgggaaga

SEQ ID NO: 227879 - DNA, 25 bp, Mus musculus
aagggagccgccaggagcctgcttg

SEQ ID NO: 227880 - DNA, 25 bp, Mus musculus
tccgaccggcctcggcaacgcgcgc

SEQ ID NO: 227881 - DNA, 25 bp, Mus musculus
gcgcctggctcagcagcaggggcgt

SEQ ID NO: 227882 - DNA, 25 bp, Mus musculus
caatgtccatcggtggaatgggcgt

SEQ ID NO: 227883 - DNA, 25 bp, Mus musculus
agcctcaatgtccatcggtggaatg

SEQ ID NO: 227884 - DNA, 25 bp, Mus musculus
ccttagagcctcaatgtccatcggt

SEQ ID NO: 227885 - DNA, 25 bp, Mus musculus
gctaacaccaccagctcccagcacg

SEQ ID NO: 227886 - DNA, 25 bp, Mus musculus
atggaagcgagaccccgctgagacc

SEQ ID NO: 227887 - DNA, 25 bp, Mus musculus
cggggtcgcgctcacatgctaacac

SEQ ID NO: 227888 - DNA, 25 bp, Mus musculus
tagagcctcaatgtccatcggtgga

SEQ ID NO: 227889 - DNA, 25 bp, Mus musculus
agctcccagcacggccgatggagac

SEQ ID NO: 227890 - DNA, 25 bp, Mus musculus
cacggccgatggagaccccttagag

SEQ ID NO: 227891 - DNA, 25 bp, Mus musculus
cactgggttcgaggtccctcctgga

SEQ ID NO: 227892 - DNA, 25 bp, Mus musculus
ggactgctctcccaagccgggaaca

SEQ ID NO: 227893 - DNA, 25 bp, Mus musculus
ctacaagtcgacacggaggggcaag

SEQ ID NO: 227894 - DNA, 25 bp, Mus musculus
ccagctctacaagtcgacacggagg

SEQ ID NO: 227895 - DNA, 25 bp, Mus musculus
agagagaacagaacgccctcgctgc

SEQ ID NO: 227896 - DNA, 25 bp, Mus musculus
ccctcccgggagagagaacagaacg

SEQ ID NO: 227897 - DNA, 25 bp, Mus musculus
atcccacgaagctcagggaggagcg

SEQ ID NO: 227898 - DNA, 25 bp, Mus musculus
tgggaggaatcccacgaagctcagg

SEQ ID NO: 227899 - DNA, 25 bp, Mus musculus
accctggagagcgacgcgcgatttc

SEQ ID NO: 227900 - DNA, 25 bp, Mus musculus
ccaggagccggccacttggcggtca

SEQ ID NO: 227901 - DNA, 25 bp, Mus musculus
ccattcttcccgcactgggttcgag

SEQ ID NO: 227902 - DNA, 25 bp, Mus musculus
tcgctctgagggaggaatccgatag

SEQ ID NO: 227903 - DNA, 25 bp, Mus musculus
aggaatccgataggcaccctcgctg

SEQ ID NO: 227904 - DNA, 25 bp, Mus musculus
cacttggcggtcaggaccctggaga

SEQ ID NO: 227905 - DNA, 25 bp, Mus musculus
gggacagacagaatctaggcctagc

SEQ ID NO: 227906 - DNA, 25 bp, Mus musculus
acccgacgggactagcgtgacagtt

SEQ ID NO: 227907 - DNA, 25 bp, Mus musculus
cctagcaagcggagcgacgagctca

SEQ ID NO: 227908 - DNA, 25 bp, Mus musculus
tctctgctgctcctgactcggggat

SEQ ID NO: 227909 - DNA, 25 bp, Mus musculus
ccttcctgtttcatcgattctttcg

SEQ ID NO: 227910 - DNA, 25 bp, Mus musculus
cagctccacctacactgttttggtt

SEQ ID NO: 227911 - DNA, 25 bp, Mus musculus
agcaagcagtgattggcaggaaacc

SEQ ID NO: 227912 - DNA, 25 bp, Mus musculus
agaagcagcccttccctcagcgaga

SEQ ID NO: 227913 - DNA, 25 bp, Mus musculus
gccatcacctctggcgcgagaagca

SEQ ID NO: 227914 - DNA, 25 bp, Mus musculus
cgtcactcgcccacggatgtggagg

SEQ ID NO: 227915 - DNA, 25 bp, Mus musculus
gctcccttttcctcagcgggatgag

SEQ ID NO: 227916 - DNA, 25 bp, Mus musculus
gggacagacgctgactgccacatct

SEQ ID NO: 227917 - DNA, 25 bp, Mus musculus
acgcggccctgtggagaagcaacag

SEQ ID NO: 227918 - DNA, 25 bp, Mus musculus
agctcagctgatgcaacccgacggg

SEQ ID NO: 227919 - DNA, 25 bp, Mus musculus
agctgcccactgcttcggatgctgg

SEQ ID NO: 227920 - DNA, 25 bp, Mus musculus
actgcttcggatgctggccgtgtct

SEQ ID NO: 227921 - DNA, 25 bp, Mus musculus
tcgctcaggtttgggcggcaaccct

SEQ ID NO: 227922 - DNA, 25 bp, Mus musculus
agacagctgcccactgcttcggatg

SEQ ID NO: 227923 - DNA, 25 bp, Mus musculus
tttcatcttacgcagggacacactc

SEQ ID NO: 227924 - DNA, 25 bp, Mus musculus
ctgctgctttcgctcaggtttgggc

SEQ ID NO: 227925 - DNA, 25 bp, Mus musculus
ggccgtttcatcttacgcagggaca

SEQ ID NO: 227926 - DNA, 25 bp, Mus musculus
ggggaggccgtttcatcttacgcag

SEQ ID NO: 227927 - DNA, 25 bp, Mus musculus
tgtctgaggtctccgcagtgctacc

SEQ ID NO: 227928 - DNA, 25 bp, Mus musculus
ccgcgctgatggagggagtaggtcc

SEQ ID NO: 227929 - DNA, 25 bp, Mus musculus
gcggcaaccctaagggcccatcagg

SEQ ID NO: 227930 - DNA, 25 bp, Mus musculus
tgggcggcaaccctaagggcccatc

SEQ ID NO: 227931 - DNA, 25 bp, Mus musculus
ctttcgctcaggtttgggcggcaac

SEQ ID NO: 227932 - DNA, 25 bp, Mus musculus
gatgctggccgtgtctgaggtctcc

SEQ ID NO: 227933 - DNA, 25 bp, Mus musculus
tctgtttctgcttccagagcctgca

SEQ ID NO: 227934 - DNA, 25 bp, Mus musculus
cccgggcatccaccaccactgctca

SEQ ID NO: 227935 - DNA, 25 bp, Mus musculus
ttccgcaggcctgaaacagacatgg

SEQ ID NO: 227936 - DNA, 25 bp, Mus musculus
acggttgttccgcaggcctgaaaca

SEQ ID NO: 227937 - DNA, 25 bp, Mus musculus
agtgcccggtgcctcacggttgttc

SEQ ID NO: 227938 - DNA, 25 bp, Mus musculus
acagcgtcccgtgaaccaggaggct

SEQ ID NO: 227939 - DNA, 25 bp, Mus musculus
accatccaccgtggggatgcggaca

SEQ ID NO: 227940 - DNA, 25 bp, Mus musculus
agaccggggcgaccatccaccgtgg

SEQ ID NO: 227941 - DNA, 25 bp, Mus musculus
agagcctgcagggacactcggaccc

SEQ ID NO: 227942 - DNA, 25 bp, Mus musculus
tccttctgcacgtgctgaggcagcc

SEQ ID NO: 227943 - DNA, 25 bp, Mus musculus
ctctgcatctgtgccggcctctgtt

SEQ ID NO: 227944 - DNA, 25 bp, Mus musculus
ctgctcaccgaccaaggctcaccga

SEQ ID NO: 227945 - DNA, 25 bp, Mus musculus
tgtccctaaggccagaccggggcga

SEQ ID NO: 227946 - DNA, 25 bp, Mus musculus
ctgaaacagacatggggtcagcgga

SEQ ID NO: 227947 - DNA, 25 bp, Mus musculus
cgcccgcgggtatgagtgggtacgt

SEQ ID NO: 227948 - DNA, 25 bp, Mus musculus
gggagccggcacaagcacccaagcg

SEQ ID NO: 227949 - DNA, 25 bp, Mus musculus
tgcgggagccggcacaagcacccaa

SEQ ID NO: 227950 - DNA, 25 bp, Mus musculus
tgagttgcccatgatgagtgcggga

SEQ ID NO: 227951 - DNA, 25 bp, Mus musculus
ttgtggtgtgagttgcccatgatga

SEQ ID NO: 227952 - DNA, 25 bp, Mus musculus
ctcttgtggtgtgagttgcccatga

SEQ ID NO: 227953 - DNA, 25 bp, Mus musculus
ttcctcttgtggtgtgagttgccca

SEQ ID NO: 227954 - DNA, 25 bp, Mus musculus
gggccttcctcttgtggtgtgagtt

SEQ ID NO: 227955 - DNA, 25 bp, Mus musculus
cgatcgcccgaagcgccagaagctg

SEQ ID NO: 227956 - DNA, 25 bp, Mus musculus
acctgcgggccgcttcgccgatcgc

SEQ ID NO: 227957 - DNA, 25 bp, Mus musculus
ctgcgcagcacgggcagcgactgca

SEQ ID NO: 227958 - DNA, 25 bp, Mus musculus
tgggatctgagcggattcccggccc

SEQ ID NO: 227959 - DNA, 25 bp, Mus musculus
tccatgcgcatgtgaggggtgggat

SEQ ID NO: 227960 - DNA, 25 bp, Mus musculus
tgggtacgtgtgtgtccatgcgcat

SEQ ID NO: 227961 - DNA, 25 bp, Mus musculus
ggatagtgctcagccgggctcccta

SEQ ID NO: 227962 - DNA, 25 bp, Mus musculus
aagaagtcctactcaggtgggcgcc

SEQ ID NO: 227963 - DNA, 25 bp, Mus musculus
gggctccctaaaccagtgtcctggc

SEQ ID NO: 227964 - DNA, 25 bp, Mus musculus
agtgtcctggcactccgcgactgtt

SEQ ID NO: 227965 - DNA, 25 bp, Mus musculus
cactccgcgactgttccgttggtgg

SEQ ID NO: 227966 - DNA, 25 bp, Mus musculus
gacctgtgcgagtcacctgagcgct

SEQ ID NO: 227967 - DNA, 25 bp, Mus musculus
gttgcggtgacttactttcggcttc

SEQ ID NO: 227968 - DNA, 25 bp, Mus musculus
gccaccttccggaagaggacacgga

SEQ ID NO: 227969 - DNA, 25 bp, Mus musculus
cggtgacttactttcggcttcaggg

SEQ ID NO: 227970 - DNA, 25 bp, Mus musculus
ttcggcgacccggattagccacctg

SEQ ID NO: 227971 - DNA, 25 bp, Mus musculus
cgacccggattagccacctgggagc

SEQ ID NO: 227972 - DNA, 25 bp, Mus musculus
gccaccacactttcctgggagcggc

SEQ ID NO: 227973 - DNA, 25 bp, Mus musculus
ggcggcaccatgaagaagtcctact

SEQ ID NO: 227974 - DNA, 25 bp, Mus musculus
tggcacccgtggatagtgctcagcc

SEQ ID NO: 227975 - DNA, 25 bp, Mus musculus
gccggcaccggcacaatcgccgacg

SEQ ID NO: 227976 - DNA, 25 bp, Mus musculus
tctggtgtccgctgcagctggcagt

SEQ ID NO: 227977 - DNA, 25 bp, Mus musculus
tcgccgacggcgttggctattaata

SEQ ID NO: 227978 - DNA, 25 bp, Mus musculus
ccgccgggatctggtgtccgctgca

SEQ ID NO: 227979 - DNA, 25 bp, Mus musculus
ttggctattaataacactccgggcg

SEQ ID NO: 227980 - DNA, 25 bp, Mus musculus
attaataacactccgggcgagcccg

SEQ ID NO: 227981 - DNA, 25 bp, Mus musculus
cgcagccatggccagcccggaaccc

SEQ ID NO: 227982 - DNA, 25 bp, Mus musculus
aatcgtccggccaagtgggcgcgtc

SEQ ID NO: 227983 - DNA, 25 bp, Mus musculus
ccgggcctcgaggtaggatcctcta

SEQ ID NO: 227984 - DNA, 25 bp, Mus musculus
taggatcctctagggctcgtgtcgc

SEQ ID NO: 227985 - DNA, 25 bp, Mus musculus
tagggctcgtgtcgccgcccagtag

SEQ ID NO: 227986 - DNA, 25 bp, Mus musculus
cttttcccttggctgtgggtagtgg

SEQ ID NO: 227987 - DNA, 25 bp, Mus musculus
tcccttggctgtgggtagtggtcat

SEQ ID NO: 227988 - DNA, 25 bp, Mus musculus
ccgcgggtaatcgtccggccaagtg

SEQ ID NO: 227989 - DNA, 25 bp, Mus musculus
ccagatctccgctcgccgtccgcgt

SEQ ID NO: 227990 - DNA, 25 bp, Mus musculus
gggctcggctcagccgcagccatcg

SEQ ID NO: 227991 - DNA, 25 bp, Mus musculus
ggggtaggtgacattatcccgcctc

SEQ ID NO: 227992 - DNA, 25 bp, Mus musculus
aggtgacattatcccgcctctgttg

SEQ ID NO: 227993 - DNA, 25 bp, Mus musculus
gcccaggggagcaatgacatcacgt

SEQ ID NO: 227994 - DNA, 25 bp, Mus musculus
agcaatgacatcacgtggccctttc

SEQ ID NO: 227995 - DNA, 25 bp, Mus musculus
atgacatcacgtggccctttccacg

SEQ ID NO: 227996 - DNA, 25 bp, Mus musculus
tttccacgcgctgacacaaagagcg

SEQ ID NO: 227997 - DNA, 25 bp, Mus musculus
gctgacacaaagagcgcctgcgaga

SEQ ID NO: 227998 - DNA, 25 bp, Mus musculus
ctgcgcaccgctgaacccgcccgct

SEQ ID NO: 227999 - DNA, 25 bp, Mus musculus
ggggcccagccatcccagatctccg

SEQ ID NO: 228000 - DNA, 25 bp, Mus musculus
gttggctttgcctcgtccaggccgt

SEQ ID NO: 228001 - DNA, 25 bp, Mus musculus
agccagccgcgcagcatgcactggg

SEQ ID NO: 228002 - DNA, 25 bp, Mus musculus
caaagagcgcctgcgagaggcctcg

SEQ ID NO: 228003 - DNA, 25 bp, Mus musculus
ttcgcgccaacaccgaccaatgaga

SEQ ID NO: 228004 - DNA, 25 bp, Mus musculus
cgcggcctctattgtttcctgcggc

SEQ ID NO: 228005 - DNA, 25 bp, Mus musculus
acgctcgagagtcgttttctccaga

SEQ ID NO: 228006 - DNA, 25 bp, Mus musculus
aggcccgtgcagatcacgtgacata

SEQ ID NO: 228007 - DNA, 25 bp, Mus musculus
gtgacatacaccctacacgctcatg

SEQ ID NO: 228008 - DNA, 25 bp, Mus musculus
gccatcttcttagcaggccgttatg

SEQ ID NO: 228009 - DNA, 25 bp, Mus musculus
ggccgttatgctgacaactccctca

SEQ ID NO: 228010 - DNA, 25 bp, Mus musculus
gtctggttagcaactcggagggcca

SEQ ID NO: 228011 - DNA, 25 bp, Mus musculus
ggccagacgaggagaaaacgcatca

SEQ ID NO: 228012 - DNA, 25 bp, Mus musculus
acgcatcaccgtttagacttacagg

SEQ ID NO: 228013 - DNA, 25 bp, Mus musculus
gcctaattcaaggtggcgtctttta

SEQ ID NO: 228014 - DNA, 25 bp, Mus musculus
ttaactgactccctcggtactaata

SEQ ID NO: 228015 - DNA, 25 bp, Mus musculus
tccctcagggtagcgaaagaatttg

SEQ ID NO: 228016 - DNA, 25 bp, Mus musculus
accttccttgtcagccatggcggca

SEQ ID NO: 228017 - DNA, 25 bp, Mus musculus
tgaatcctattccaaacacgtctcg

SEQ ID NO: 228018 - DNA, 25 bp, Mus musculus
agcccagaactgtcgcgtcgtgatg

SEQ ID NO: 228019 - DNA, 25 bp, Mus musculus
gccctcggttctaagcccagaactg

SEQ ID NO: 228020 - DNA, 25 bp, Mus musculus
ggctccatatttctgccctcggttc

SEQ ID NO: 228021 - DNA, 25 bp, Mus musculus
gccagctggggctccatatttctgc

SEQ ID NO: 228022 - DNA, 25 bp, Mus musculus
agatgccagggacattctgccgcgg

SEQ ID NO: 228023 - DNA, 25 bp, Mus musculus
cagtgtctccaggtgggagatgcca

SEQ ID NO: 228024 - DNA, 25 bp, Mus musculus
gggactaaagccgacagtgtctcca

SEQ ID NO: 228025 - DNA, 25 bp, Mus musculus
cgtctcgcaaagacgtggattacga

SEQ ID NO: 228026 - DNA, 25 bp, Mus musculus
gtgcccgctaggtgtgaatcctatt

SEQ ID NO: 228027 - DNA, 25 bp, Mus musculus
actgtcgcgtcgtgatggaaaacca

SEQ ID NO: 228028 - DNA, 25 bp, Mus musculus
cgccagagcgcgaagggactaaagc

SEQ ID NO: 228029 - DNA, 25 bp, Mus musculus
accgcacggtcaagggcgagtaagc

SEQ ID NO: 228030 - DNA, 25 bp, Mus musculus
tggattacgaataaccgcacggtca

SEQ ID NO: 228031 - DNA, 25 bp, Mus musculus
ctttccgaagccgaggctttgcgcc

SEQ ID NO: 228032 - DNA, 25 bp, Mus musculus
gctttgcgccctaaaacaagtagcc

SEQ ID NO: 228033 - DNA, 25 bp, Mus musculus
tgggagaaacaaaaggtatttgctg

SEQ ID NO: 228034 - DNA, 25 bp, Mus musculus
caaaaggtatttgctgacgtgggcg

SEQ ID NO: 228035 - DNA, 25 bp, Mus musculus
tatttgctgacgtgggcgttggaca

SEQ ID NO: 228036 - DNA, 25 bp, Mus musculus
tgcaccctccgcaggcactagggcg

SEQ ID NO: 228037 - DNA, 25 bp, Mus musculus
cgttggacagaaacgcccgagggct

SEQ ID NO: 228038 - DNA, 25 bp, Mus musculus
cccgagggctgaggacacaattaaa

SEQ ID NO: 228039 - DNA, 25 bp, Mus musculus
gacacaattaaaggggcaacgcaca

SEQ ID NO: 228040 - DNA, 25 bp, Mus musculus
aggggcaacgcacagatttcaggca

SEQ ID NO: 228041 - DNA, 25 bp, Mus musculus
acgcacagatttcaggcaccaacca

SEQ ID NO: 228042 - DNA, 25 bp, Mus musculus
tttcaggcaccaaccagcagcttcg

SEQ ID NO: 228043 - DNA, 25 bp, Mus musculus
tgtccgtgcccacgcccgactgcac

SEQ ID NO: 228044 - DNA, 25 bp, Mus musculus
agccgaggctttgcgccctaaaaca

SEQ ID NO: 228045 - DNA, 25 bp, Mus musculus
tcgcatttgggacatggattggaca

SEQ ID NO: 228046 - DNA, 25 bp, Mus musculus
aagcggccggaaaagcctcatctcc

SEQ ID NO: 228047 - DNA, 25 bp, Mus musculus
gcctcgccttctaattggcggtcta

SEQ ID NO: 228048 - DNA, 25 bp, Mus musculus
gcggtctaacgagcctgccgaaatt

SEQ ID NO: 228049 - DNA, 25 bp, Mus musculus
cctgccgaaattggcccggagaggc

SEQ ID NO: 228050 - DNA, 25 bp, Mus musculus
ctaccgggaaagctagcggctggtt

SEQ ID NO: 228051 - DNA, 25 bp, Mus musculus
tgggacccgaggacaatcttacaca

SEQ ID NO: 228052 - DNA, 25 bp, Mus musculus
tgagcttggcgttccgctttctggc

SEQ ID NO: 228053 - DNA, 25 bp, Mus musculus
ttcagaggcgggacaaatcgcattt

SEQ ID NO: 228054 - DNA, 25 bp, Mus musculus
ggattggacaaaggccagacacatt

SEQ ID NO: 228055 - DNA, 25 bp, Mus musculus
gcggagagttgtccttgtgttaaga

SEQ ID NO: 228056 - DNA, 25 bp, Mus musculus
ttgtgttaagattggggcacgctca

SEQ ID NO: 228057 - DNA, 25 bp, Mus musculus
tcggtaaatagtggtgatgtcatgc

SEQ ID NO: 228058 - DNA, 25 bp, Mus musculus
cacaccattggatcgagagttcaga

SEQ ID NO: 228059 - DNA, 25 bp, Mus musculus
ccagggctcgggcagttgcttccag

SEQ ID NO: 228060 - DNA, 25 bp, Mus musculus
agctacggatcaaaaccctgtcagg

SEQ ID NO: 228061 - DNA, 25 bp, Mus musculus
ccggagcctgtagctacggatcaaa

SEQ ID NO: 228062 - DNA, 25 bp, Mus musculus
agtcccaggatagcccggagcctgt

SEQ ID NO: 228063 - DNA, 25 bp, Mus musculus
cctggacatgagtgcccaggagacc

SEQ ID NO: 228064 - DNA, 25 bp, Mus musculus
cccggggcctggacatgagtgccca

SEQ ID NO: 228065 - DNA, 25 bp, Mus musculus
agccacgacacaggagacgggcacg

SEQ ID NO: 228066 - DNA, 25 bp, Mus musculus
ggcaggtaagccacgacacaggaga

SEQ ID NO: 228067 - DNA, 25 bp, Mus musculus
gatcggggtcacaatgcagtcctcc

SEQ ID NO: 228068 - DNA, 25 bp, Mus musculus
gttgcttccagcctgggaccggcct

SEQ ID NO: 228069 - DNA, 25 bp, Mus musculus
ggcccgtgctacctgagtgcgcctg

SEQ ID NO: 228070 - DNA, 25 bp, Mus musculus
acgctgaggtcgcacgcgccgagca

SEQ ID NO: 228071 - DNA, 25 bp, Mus musculus
tcggcctctggcaggtaagccacga

SEQ ID NO: 228072 - DNA, 25 bp, Mus musculus
tgtcaggtgagtccgtcgtcccacc

SEQ ID NO: 228073 - DNA, 25 bp, Mus musculus
ggagactactgagcccgcagcgtca

SEQ ID NO: 228074 - DNA, 25 bp, Mus musculus
cagcgtcaccgcctgctgggtagtg

SEQ ID NO: 228075 - DNA, 25 bp, Mus musculus
tcaccgcctgctgggtagtgcctgt

SEQ ID NO: 228076 - DNA, 25 bp, Mus musculus
agtgcctgtcgctagcccgagcgca

SEQ ID NO: 228077 - DNA, 25 bp, Mus musculus
gaagctgctctgtccgggccaccgg

SEQ ID NO: 228078 - DNA, 25 bp, Mus musculus
cctggcgacctgctgacggtgaaag

SEQ ID NO: 228079 - DNA, 25 bp, Mus musculus
acctgctgacggtgaaaggaccaac

SEQ ID NO: 228080 - DNA, 25 bp, Mus musculus
ctgacggtgaaaggaccaacgctgg

SEQ ID NO: 228081 - DNA, 25 bp, Mus musculus
accaacgctggttaaggcacccaga

SEQ ID NO: 228082 - DNA, 25 bp, Mus musculus
aggcacccagactcagaagtggttc

SEQ ID NO: 228083 - DNA, 25 bp, Mus musculus
cagactcagaagtggttcgggcaac

SEQ ID NO: 228084 - DNA, 25 bp, Mus musculus
tcagaagtggttcgggcaacaggaa

SEQ ID NO: 228085 - DNA, 25 bp, Mus musculus
ctctaggggaaagaaggtgtggcca

SEQ ID NO: 228086 - DNA, 25 bp, Mus musculus
agccggggagactactgagcccgca

SEQ ID NO: 228087 - DNA, 25 bp, Mus musculus
cccggattgggtgctcatttaaatg

SEQ ID NO: 228088 - DNA, 25 bp, Mus musculus
atccaggcccggtgaggttccgcgc

SEQ ID NO: 228089 - DNA, 25 bp, Mus musculus
cccgcccagtagtgctgggcaaggc

SEQ ID NO: 228090 - DNA, 25 bp, Mus musculus
ctgcttcccgcccagtagtgctggg

SEQ ID NO: 228091 - DNA, 25 bp, Mus musculus
cctgggaaaataggccgtccaggtg

SEQ ID NO: 228092 - DNA, 25 bp, Mus musculus
cacaaagcgcaagcctgggaaaata

SEQ ID NO: 228093 - DNA, 25 bp, Mus musculus
ggggctgatcacacaaagcgcaagc

SEQ ID NO: 228094 - DNA, 25 bp, Mus musculus
cggccgggctcgtcgccttctttgt

SEQ ID NO: 228095 - DNA, 25 bp, Mus musculus
ggtccctttgttctcggcgccgcag

SEQ ID NO: 228096 - DNA, 25 bp, Mus musculus
cccgcgaaggccaacggacaggtga

SEQ ID NO: 228097 - DNA, 25 bp, Mus musculus
gccgggccgtcccagccgaactatc

SEQ ID NO: 228098 - DNA, 25 bp, Mus musculus
tcgggcgcgtacatataggcggctc

SEQ ID NO: 228099 - DNA, 25 bp, Mus musculus
gttccgcgcggaaaatagagagcgc

SEQ ID NO: 228100 - DNA, 25 bp, Mus musculus
agcctcgggcgcgtacatataggcg

SEQ ID NO: 228101 - DNA, 25 bp, Mus musculus
gccacttaggcttccctccaggaat

SEQ ID NO: 228102 - DNA, 25 bp, Mus musculus
ccgcagctcaccgtcgtagtagtaa

SEQ ID NO: 228103 - DNA, 25 bp, Mus musculus
gtcgtagtagtaacagactttcctc

SEQ ID NO: 228104 - DNA, 25 bp, Mus musculus
acagactttcctcttggtgccctga

SEQ ID NO: 228105 - DNA, 25 bp, Mus musculus
tttcctcttggtgccctgagtctgc

SEQ ID NO: 228106 - DNA, 25 bp, Mus musculus
tgagtctgcgccatcttgctcgccg

SEQ ID NO: 228107 - DNA, 25 bp, Mus musculus
ggatcacctatagccgcacagcccg

SEQ ID NO: 228108 - DNA, 25 bp, Mus musculus
ggcctcactctaaccaatcggcatg

SEQ ID NO: 228109 - DNA, 25 bp, Mus musculus
ctaaccaatcggcatgcgcggggtc

SEQ ID NO: 228110 - DNA, 25 bp, Mus musculus
ctgggcctgtaccaaagtccggcgc

SEQ ID NO: 228111 - DNA, 25 bp, Mus musculus
cctgtaccaaagtccggcgcggagg

SEQ ID NO: 228112 - DNA, 25 bp, Mus musculus
ccgtaccatcgagtcccgggagagg

SEQ ID NO: 228113 - DNA, 25 bp, Mus musculus
gagtcggctccgtaaactctgcagc

SEQ ID NO: 228114 - DNA, 25 bp, Mus musculus
agaatctccgccaccgggattaccg

SEQ ID NO: 228115 - DNA, 25 bp, Mus musculus
gcaacagccagtgccgagtcgcgga

SEQ ID NO: 228116 - DNA, 25 bp, Mus musculus
ctccaggcccagttttgacaggcgg

SEQ ID NO: 228117 - DNA, 25 bp, Mus musculus
acaggcgggcgcaacagccagtgcc

SEQ ID NO: 228118 - DNA, 25 bp, Mus musculus
tgtagaagcagctctggttccatcc

SEQ ID NO: 228119 - DNA, 25 bp, Mus musculus
cgacccagcggttgcttggcgagct

SEQ ID NO: 228120 - DNA, 25 bp, Mus musculus
cccaggtcgtgtgcctgggactctg

SEQ ID NO: 228121 - DNA, 25 bp, Mus musculus
ttcagactttgaaggtgggtgcccg

SEQ ID NO: 228122 - DNA, 25 bp, Mus musculus
agctggacgggatcatttcagactt

SEQ ID NO: 228123 - DNA, 25 bp, Mus musculus
cgcacagctggacgggatcatttca

SEQ ID NO: 228124 - DNA, 25 bp, Mus musculus
cccattcattcagccgaccgtgggg

SEQ ID NO: 228125 - DNA, 25 bp, Mus musculus
tacgggaacctgatccagccgggag

SEQ ID NO: 228126 - DNA, 25 bp, Mus musculus
ctggggtacgggaacctgatccagc

SEQ ID NO: 228127 - DNA, 25 bp, Mus musculus
ggactctgcagtccctgtagaagca

SEQ ID NO: 228128 - DNA, 25 bp, Mus musculus
caggaacctccaggcgggcctgaga

SEQ ID NO: 228129 - DNA, 25 bp, Mus musculus
aagacggctaaaggatggcgcagtc

SEQ ID NO: 228130 - DNA, 25 bp, Mus musculus
gacatgctggatctccggttctatc

SEQ ID NO: 228131 - DNA, 25 bp, Mus musculus
cagtcggagatcgtgccctcctaca

SEQ ID NO: 228132 - DNA, 25 bp, Mus musculus
ctacacagccggatctgtgcagctg

SEQ ID NO: 228133 - DNA, 25 bp, Mus musculus
atctgtgcagctggatcggtccatc

SEQ ID NO: 228134 - DNA, 25 bp, Mus musculus
tcggtccatccgcagcgttccagta

SEQ ID NO: 228135 - DNA, 25 bp, Mus musculus
cgcagcgttccagtatctcaagtga

SEQ ID NO: 228136 - DNA, 25 bp, Mus musculus
tatctcaagtgactcggacaccacc

SEQ ID NO: 228137 - DNA, 25 bp, Mus musculus
ggacaccaccactccatgctgtaag

SEQ ID NO: 228138 - DNA, 25 bp, Mus musculus
ccatgctgtaagaagccgaggatgc

SEQ ID NO: 228139 - DNA, 25 bp, Mus musculus
gatgcagcggccgaacaccacaagt

SEQ ID NO: 228140 - DNA, 25 bp, Mus musculus
acaccacaagtggaagacatgctgg

SEQ ID NO: 228141 - DNA, 25 bp, Mus musculus
ggatctccggttctatcccggcgtc

SEQ ID NO: 228142 - DNA, 25 bp, Mus musculus
cccaagctgagatccgagagaagac

SEQ ID NO: 228143 - DNA, 25 bp, Mus musculus
cagtcgctcacagggtctttggcca

SEQ ID NO: 228144 - DNA, 25 bp, Mus musculus
tactgaggtgcgtctagctctcacg

SEQ ID NO: 228145 - DNA, 25 bp, Mus musculus
taaaggctctcttcgggaatactga

SEQ ID NO: 228146 - DNA, 25 bp, Mus musculus
cagctgttgcaggagataaaggctc

SEQ ID NO: 228147 - DNA, 25 bp, Mus musculus
cctttgctttcagggcaggtgcttg

SEQ ID NO: 228148 - DNA, 25 bp, Mus musculus
aatgctgagccacgcaccctggtct

SEQ ID NO: 228149 - DNA, 25 bp, Mus musculus
gagctctgttctcagtctcctggca

SEQ ID NO: 228150 - DNA, 25 bp, Mus musculus
tctcgctcccggaagtagaagggcc

SEQ ID NO: 228151 - DNA, 25 bp, Mus musculus
aaagactagggacgacttccggatg

SEQ ID NO: 228152 - DNA, 25 bp, Mus musculus
gcctggaactcaccatcctggcggt

SEQ ID NO: 228153 - DNA, 25 bp, Mus musculus
atctgcgtgatggaccgctcatggc

SEQ ID NO: 228154 - DNA, 25 bp, Mus musculus
gtctccttcgcggttatacttgatc

SEQ ID NO: 228155 - DNA, 25 bp, Mus musculus
tgaaaatttcaccataggtcggccg

SEQ ID NO: 228156 - DNA, 25 bp, Mus musculus
ccacggtgaagagaaggtctccttc

SEQ ID NO: 228157 - DNA, 25 bp, Mus musculus
ctccctcttcaaggtctcgacgttc

SEQ ID NO: 228158 - DNA, 25 bp, Mus musculus
gcccacgcgtgcctatggtgctgcg

SEQ ID NO: 228159 - DNA, 25 bp, Mus musculus
gcagccctgacttccctctcacgcg

SEQ ID NO: 228160 - DNA, 25 bp, Mus musculus
acgctcacggcgagctgcggacgct

SEQ ID NO: 228161 - DNA, 25 bp, Mus musculus
tctcttgggcctggcacgctcacgg

SEQ ID NO: 228162 - DNA, 25 bp, Mus musculus
gcctatggtgctgcgccgctgtgct

SEQ ID NO: 228163 - DNA, 25 bp, Mus musculus
gctctgggcccacgcgtgcctatgg

SEQ ID NO: 228164 - DNA, 25 bp, Mus musculus
gcccagttccggaccctgcagggta

SEQ ID NO: 228165 - DNA, 25 bp, Mus musculus
tcctgtcgcggctctcttgggcctg

SEQ ID NO: 228166 - DNA, 25 bp, Mus musculus
cggcgaagctctgttcgcccagttc

SEQ ID NO: 228167 - DNA, 25 bp, Mus musculus
accctgcagggtacggcgctttctt

SEQ ID NO: 228168 - DNA, 25 bp, Mus musculus
ggcttgcggcgaagctctgttcgcc

SEQ ID NO: 228169 - DNA, 25 bp, Mus musculus
atactgggagccgtctcctgctgcc

SEQ ID NO: 228170 - DNA, 25 bp, Mus musculus
agcacgggatactgggagccgtctc

SEQ ID NO: 228171 - DNA, 25 bp, Mus musculus
attccatcccgacctgcaatgtaga

SEQ ID NO: 228172 - DNA, 25 bp, Mus musculus
tgggcttctccgtcagacgcacgca

SEQ ID NO: 228173 - DNA, 25 bp, Mus musculus
ccagagctccgcattcttcagtgca

SEQ ID NO: 228174 - DNA, 25 bp, Mus musculus
agatgttatgtgacagcatttcgcc

SEQ ID NO: 228175 - DNA, 25 bp, Mus musculus
aggtgcactcgcaattccatcccga

SEQ ID NO: 228176 - DNA, 25 bp, Mus musculus
tgcaatgtagacacctttcgaagga

SEQ ID NO: 228177 - DNA, 25 bp, Mus musculus
ccgctcctgggcatgcgcaaacata

SEQ ID NO: 228178 - DNA, 25 bp, Mus musculus
aggtcgggatccatctcctcgccaa

SEQ ID NO: 228179 - DNA, 25 bp, Mus musculus
tctccagggacacacgctgggcttc

SEQ ID NO: 228180 - DNA, 25 bp, Mus musculus
tcactcgcttgcgtgcgtttgcgca

SEQ ID NO: 228181 - DNA, 25 bp, Mus musculus
cgtttgcgcagtgagtcttcagaca

SEQ ID NO: 228182 - DNA, 25 bp, Mus musculus
gagtcttcagacagcgccgctcctg

SEQ ID NO: 228183 - DNA, 25 bp, Mus musculus
tcgaaggaaaaggtcgggatccatc

SEQ ID NO: 228184 - DNA, 25 bp, Mus musculus
agcatttcgccggaaggtccagccc

SEQ ID NO: 228185 - DNA, 25 bp, Mus musculus
acgcacgcgcaacactggggcaggc

SEQ ID NO: 228186 - DNA, 25 bp, Mus musculus
gtcccacgtacagcccatagacata

SEQ ID NO: 228187 - DNA, 25 bp, Mus musculus
gacatacttcaccacggacgtccgg

SEQ ID NO: 228188 - DNA, 25 bp, Mus musculus
gcaccggaaacctaggtaactgctg

SEQ ID NO: 228189 - DNA, 25 bp, Mus musculus
gcagccaatcaacagcaaacgcggg

SEQ ID NO: 228190 - DNA, 25 bp, Mus musculus
ctcagagccgcagactgacgtggcg

SEQ ID NO: 228191 - DNA, 25 bp, Mus musculus
cgcggagcttgctgggaaaaaagaa

SEQ ID NO: 228192 - DNA, 25 bp, Mus musculus
ggtaactgctgccaacaggaccgcc

SEQ ID NO: 228193 - DNA, 25 bp, Mus musculus
gaagaggcctcctttctcccgaatg

SEQ ID NO: 228194 - DNA, 25 bp, Mus musculus
tcacggtcccatggaaggtttccga

SEQ ID NO: 228195 - DNA, 25 bp, Mus musculus
tcgcccgggatttcacggtcccatg

SEQ ID NO: 228196 - DNA, 25 bp, Mus musculus
gaagcttcaaacagaccggtcggtc

SEQ ID NO: 228197 - DNA, 25 bp, Mus musculus
gggatgctccagtcccgatcggctc

SEQ ID NO: 228198 - DNA, 25 bp, Mus musculus
tctagacctagagtacgcacgcgca

SEQ ID NO: 228199 - DNA, 25 bp, Mus musculus
acaatatggcggacctgcaggacgg

SEQ ID NO: 228200 - DNA, 25 bp, Mus musculus
gaggccaccacgtggggacagccca

SEQ ID NO: 228201 - DNA, 25 bp, Mus musculus
tgctaaaacgcgttcttaaccctca

SEQ ID NO: 228202 - DNA, 25 bp, Mus musculus
cgaggaagcaggctctccgcggcca

SEQ ID NO: 228203 - DNA, 25 bp, Mus musculus
tataccgtgctaaaacgcgttctta

SEQ ID NO: 228204 - DNA, 25 bp, Mus musculus
ggacagcccaggacgctagcagtgc

SEQ ID NO: 228205 - DNA, 25 bp, Mus musculus
gacgctagcagtgcggaacaagccc

SEQ ID NO: 228206 - DNA, 25 bp, Mus musculus
cagccctaaactggcccgaggggcg

SEQ ID NO: 228207 - DNA, 25 bp, Mus musculus
catgcctctctggatgcttccgaca

SEQ ID NO: 228208 - DNA, 25 bp, Mus musculus
tccgacatctgcttcggacgagaga

SEQ ID NO: 228209 - DNA, 25 bp, Mus musculus
ggacgagagacaggccctcgccaga

SEQ ID NO: 228210 - DNA, 25 bp, Mus musculus
ccgcagcggtagcttcagcggtagc

SEQ ID NO: 228211 - DNA, 25 bp, Mus musculus
cggtagcctcggcagacaatatggc

SEQ ID NO: 228212 - DNA, 25 bp, Mus musculus
aagcgcgagctctgacccgaggcca

SEQ ID NO: 228213 - DNA, 25 bp, Mus musculus
cggcgctctccgctcaccgccgcag

SEQ ID NO: 228214 - DNA, 25 bp, Mus musculus
aagctgtgctaacgctctttgtctt

SEQ ID NO: 228215 - DNA, 25 bp, Mus musculus
ttggacaaaagctgtgctaacgctc

SEQ ID NO: 228216 - DNA, 25 bp, Mus musculus
ggccgtttggacaaaagctgtgcta

SEQ ID NO: 228217 - DNA, 25 bp, Mus musculus
ctcaatttgcatgctaggcgggctg

SEQ ID NO: 228218 - DNA, 25 bp, Mus musculus
tccggctgctcaatttgcatgctag

SEQ ID NO: 228219 - DNA, 25 bp, Mus musculus
tccctccggctgctcaatttgcatg

SEQ ID NO: 228220 - DNA, 25 bp, Mus musculus
agagaggactaaccgccgcagcccg

SEQ ID NO: 228221 - DNA, 25 bp, Mus musculus
ggaggcagttcgcagccaggctccc

SEQ ID NO: 228222 - DNA, 25 bp, Mus musculus
ctcctgcgggcaatatgtcggaggc

SEQ ID NO: 228223 - DNA, 25 bp, Mus musculus
agagattctggagcgggcgaaccca

SEQ ID NO: 228224 - DNA, 25 bp, Mus musculus
cagctctgctcacccatctccttcc

SEQ ID NO: 228225 - DNA, 25 bp, Mus musculus
ctcaagagattctggagcgggcgaa

SEQ ID NO: 228226 - DNA, 25 bp, Mus musculus
ggccgagagaggactaaccgccgca

SEQ ID NO: 228227 - DNA, 25 bp, Mus musculus
ggcctcgtccgtggctcagaaatct

SEQ ID NO: 228228 - DNA, 25 bp, Mus musculus
agaaatcttcccttacaccctgagc

SEQ ID NO: 228229 - DNA, 25 bp, Mus musculus
tgtgggtgcagaatctcgaaggcca

SEQ ID NO: 228230 - DNA, 25 bp, Mus musculus
tcgaaggccaggtcgagatgacaac

SEQ ID NO: 228231 - DNA, 25 bp, Mus musculus
atgacaactctcgatgcccgggctc

SEQ ID NO: 228232 - DNA, 25 bp, Mus musculus
ccacagtcaggaccgggagacccag

SEQ ID NO: 228233 - DNA, 25 bp, Mus musculus
acagcagctgcatggcgtgagtgaa

SEQ ID NO: 228234 - DNA, 25 bp, Mus musculus
tcgagcgagtccttctcggccatga

SEQ ID NO: 228235 - DNA, 25 bp, Mus musculus
ggccatgagttcaggcaggtactta

SEQ ID NO: 228236 - DNA, 25 bp, Mus musculus
caggtacttattctccggctccatc

SEQ ID NO: 228237 - DNA, 25 bp, Mus musculus
cccagcgagagagcaccggaaatga

SEQ ID NO: 228238 - DNA, 25 bp, Mus musculus
gcccttgagtttctccgcggagaac

SEQ ID NO: 228239 - DNA, 25 bp, Mus musculus
accgcttacctacggacagcagctg

SEQ ID NO: 228240 - DNA, 25 bp, Mus musculus
gcgctctgagatcgcgagtcctctt

SEQ ID NO: 228241 - DNA, 25 bp, Mus musculus
cggaggacgcacgtgtactgtccgc

SEQ ID NO: 228242 - DNA, 25 bp, Mus musculus
tcctgtacccgctgatcggcagggc

SEQ ID NO: 228243 - DNA, 25 bp, Mus musculus
aaggcttcctgtacccgctgatcgg

SEQ ID NO: 228244 - DNA, 25 bp, Mus musculus
cccgccacggggtgtgcgtctgact

SEQ ID NO: 228245 - DNA, 25 bp, Mus musculus
tgtcgccaatatctacagctcctct

SEQ ID NO: 228246 - DNA, 25 bp, Mus musculus
ccacgaattctgtcgccaatatcta

SEQ ID NO: 228247 - DNA, 25 bp, Mus musculus
tggcacccggaccacgaattctgtc

SEQ ID NO: 228248 - DNA, 25 bp, Mus musculus
tccagccgaagatttccagctccaa

SEQ ID NO: 228249 - DNA, 25 bp, Mus musculus
caggttccagccgaagatttccagc

SEQ ID NO: 228250 - DNA, 25 bp, Mus musculus
cccatcgggtgcgatgcaggttcca

SEQ ID NO: 228251 - DNA, 25 bp, Mus musculus
gggagagccggttctgcagaggact

SEQ ID NO: 228252 - DNA, 25 bp, Mus musculus
cggaccacgaattctgtcgccaata

SEQ ID NO: 228253 - DNA, 25 bp, Mus musculus
cgatgcaggttccagccgaagattt

SEQ ID NO: 228254 - DNA, 25 bp, Mus musculus
atttccagctccaactggcacccgg

SEQ ID NO: 228255 - DNA, 25 bp, Mus musculus
gccattagagcaggcccgagacacg

SEQ ID NO: 228256 - DNA, 25 bp, Mus musculus
cgatcggccgggctgtaaccgtcgt

SEQ ID NO: 228257 - DNA, 25 bp, Mus musculus
tggccagaggcgctaacttagaccc

SEQ ID NO: 228258 - DNA, 25 bp, Mus musculus
gcccagggcagtgggtcaaagctct

SEQ ID NO: 228259 - DNA, 25 bp, Mus musculus
gagccgccggcagccaatcatcggt

SEQ ID NO: 228260 - DNA, 25 bp, Mus musculus
gccaatcatcggttccgagggcgtg

SEQ ID NO: 228261 - DNA, 25 bp, Mus musculus
agtgggtcaaagctctgtaggcaga

SEQ ID NO: 228262 - DNA, 25 bp, Mus musculus
cccagcttgccagcgtgagtgcgcc

SEQ ID NO: 228263 - DNA, 25 bp, Mus musculus
aggcgccgctgccattagagcaggc

SEQ ID NO: 228264 - DNA, 25 bp, Mus musculus
aatccgcccgcgaccttgcgggtca

SEQ ID NO: 228265 - DNA, 25 bp, Mus musculus
gcgctaacttagacccaggtgcgga

SEQ ID NO: 228266 - DNA, 25 bp, Mus musculus
gcgcttccctcagccacgttcgtca

SEQ ID NO: 228267 - DNA, 25 bp, Mus musculus
cgcgccggtcacatgtatacgcctt

SEQ ID NO: 228268 - DNA, 25 bp, Mus musculus
ggtcacatgtatacgccttccgtcg

SEQ ID NO: 228269 - DNA, 25 bp, Mus musculus
ccaagccttccctgcggagggtgga

SEQ ID NO: 228270 - DNA, 25 bp, Mus musculus
atcgacatctcctccaagcaggtgg

SEQ ID NO: 228271 - DNA, 25 bp, Mus musculus
cgcacagagatctccatcgacatct

SEQ ID NO: 228272 - DNA, 25 bp, Mus musculus
gtctcgacgcacagagatctccatc

SEQ ID NO: 228273 - DNA, 25 bp, Mus musculus
tgagcccatgtctcgacgcacagag

SEQ ID NO: 228274 - DNA, 25 bp, Mus musculus
caaggcgcctgagcccatgtctcga

SEQ ID NO: 228275 - DNA, 25 bp, Mus musculus
ttgtagactccctgagccagcgctc

SEQ ID NO: 228276 - DNA, 25 bp, Mus musculus
gccttgtagactccctgagccagcg

SEQ ID NO: 228277 - DNA, 25 bp, Mus musculus
ggtgaagaactcagagcccgctgcc

SEQ ID NO: 228278 - DNA, 25 bp, Mus musculus
cagccagaaattccaggacctgggg

SEQ ID NO: 228279 - DNA, 25 bp, Mus musculus
caagcaggtggagagcacggcctcc

SEQ ID NO: 228280 - DNA, 25 bp, Mus musculus
tcgaggagattgagccgcccaactc

SEQ ID NO: 228281 - DNA, 25 bp, Mus musculus
ccagctccagccagaaattccagga

SEQ ID NO: 228282 - DNA, 25 bp, Mus musculus
cgtttgaagtcgaggagattgagcc

SEQ ID NO: 228283 - DNA, 25 bp, Mus musculus
gtctcggccaagatcccagcagtgc

SEQ ID NO: 228284 - DNA, 25 bp, Mus musculus
gcagtcggctcggtccgagagcaca

SEQ ID NO: 228285 - DNA, 25 bp, Mus musculus
cctcagcctggaattggggccgtgt

SEQ ID NO: 228286 - DNA, 25 bp, Mus musculus
ccctttccaatctctgatgcaagtc

SEQ ID NO: 228287 - DNA, 25 bp, Mus musculus
ccactctgcccggagtcgtttcggt

SEQ ID NO: 228288 - DNA, 25 bp, Mus musculus
tccgcgccacggctagtgcagaacg

SEQ ID NO: 228289 - DNA, 25 bp, Mus musculus
gcgagtcttgccctgtctcggccaa

SEQ ID NO: 228290 - DNA, 25 bp, Mus musculus
tgccacaccgctgtcgcgagtcttg

SEQ ID NO: 228291 - DNA, 25 bp, Mus musculus
cccacctttagaatcttgacccaga

SEQ ID NO: 228292 - DNA, 25 bp, Mus musculus
tctcctccggccagaacagagtctg

SEQ ID NO: 228293 - DNA, 25 bp, Mus musculus
gaacagagtctgtccagcgctcacc

SEQ ID NO: 228294 - DNA, 25 bp, Mus musculus
cagaacgggcgaccagtctgttgcc

SEQ ID NO: 228295 - DNA, 25 bp, Mus musculus
agtgcccgcactcagggtgctccgt

SEQ ID NO: 228296 - DNA, 25 bp, Mus musculus
tccgtgagccggtcttgcttaattc

SEQ ID NO: 228297 - DNA, 25 bp, Mus musculus
ctctgtcatcggtccgggaaggcct

SEQ ID NO: 228298 - DNA, 25 bp, Mus musculus
ggagcaaccctctctgtcatcggtc

SEQ ID NO: 228299 - DNA, 25 bp, Mus musculus
ggccagcctttctctcggtgtctgc

SEQ ID NO: 228300 - DNA, 25 bp, Mus musculus
atcccagttggctcggccagccttt

SEQ ID NO: 228301 - DNA, 25 bp, Mus musculus
gctccagctgctgcaaagttccggg

SEQ ID NO: 228302 - DNA, 25 bp, Mus musculus
ggttcctgtagcaaccgctccagct

SEQ ID NO: 228303 - DNA, 25 bp, Mus musculus
caaaagctttcggttcctgtagcaa

SEQ ID NO: 228304 - DNA, 25 bp, Mus musculus
cctgacactggggaacaaaagcttt

SEQ ID NO: 228305 - DNA, 25 bp, Mus musculus
gggagtggcaacctctgagctatcc

SEQ ID NO: 228306 - DNA, 25 bp, Mus musculus
tcggttattcgtcttctggcggtgc

SEQ ID NO: 228307 - DNA, 25 bp, Mus musculus
ccgtggtgctctctggtcggttatt

SEQ ID NO: 228308 - DNA, 25 bp, Mus musculus
ttggagctgccaggtggataaacgc

SEQ ID NO: 228309 - DNA, 25 bp, Mus musculus
caggcaccgatgaagctgaggatga

SEQ ID NO: 228310 - DNA, 25 bp, Mus musculus
ataaacgcgacggatgtgcgcgtcg

SEQ ID NO: 228311 - DNA, 25 bp, Mus musculus
gccacgtgcttccttgcagtgcacg

SEQ ID NO: 228312 - DNA, 25 bp, Mus musculus
aaattgcggaactcctgattggtgg

SEQ ID NO: 228313 - DNA, 25 bp, Mus musculus
accggccacgtgcttccttgcagtg

SEQ ID NO: 228314 - DNA, 25 bp, Mus musculus
gtgcttccttgcagtgcacggcgtg

SEQ ID NO: 228315 - DNA, 25 bp, Mus musculus
gggtcctggagcctgtgctcccgca

SEQ ID NO: 228316 - DNA, 25 bp, Mus musculus
tggagcctgtgctcccgcagctgcg

SEQ ID NO: 228317 - DNA, 25 bp, Mus musculus
ccagcacggcggcaaggcctgcgag

SEQ ID NO: 228318 - DNA, 25 bp, Mus musculus
cccgagctgcagactaaactctgca

SEQ ID NO: 228319 - DNA, 25 bp, Mus musculus
agactaaactctgcagtatggccgc

SEQ ID NO: 228320 - DNA, 25 bp, Mus musculus
aaactctgcagtatggccgcctgcc

SEQ ID NO: 228321 - DNA, 25 bp, Mus musculus
gcctgcccgggtcagtagcgccaag

SEQ ID NO: 228322 - DNA, 25 bp, Mus musculus
gcgccaaggggcttctaggcaggcg

SEQ ID NO: 228323 - DNA, 25 bp, Mus musculus
cgtaaaattgcggaactcctgattg

SEQ ID NO: 228324 - DNA, 25 bp, Mus musculus
cttccttgcagtgcacggcgtgtgg

SEQ ID NO: 228325 - DNA, 25 bp, Mus musculus
ggttgcgcgtctcctcctgcagccc

SEQ ID NO: 228326 - DNA, 25 bp, Mus musculus
tgcagcccgcgaggactcttcagct

SEQ ID NO: 228327 - DNA, 25 bp, Mus musculus
agccctggatgctcagccgtcagct

SEQ ID NO: 228328 - DNA, 25 bp, Mus musculus
ttgatgccttctcccacgtccggag

SEQ ID NO: 228329 - DNA, 25 bp, Mus musculus
gatgccttctcccacgtccggaggt

SEQ ID NO: 228330 - DNA, 25 bp, Mus musculus
gctgcttccaggaaacctggctctc

SEQ ID NO: 228331 - DNA, 25 bp, Mus musculus
atgctcagccgtcagctgccgggag

SEQ ID NO: 228332 - DNA, 25 bp, Mus musculus
ctcttcagctgggataaagggcggc

SEQ ID NO: 228333 - DNA, 25 bp, Mus musculus
cagctgggataaagggcggcctccc

SEQ ID NO: 228334 - DNA, 25 bp, Mus musculus
cctgcaggagccctggatgctcagc

SEQ ID NO: 228335 - DNA, 25 bp, Mus musculus
tcagctgccgggaggcgctgatttc

SEQ ID NO: 228336 - DNA, 25 bp, Mus musculus
aggcgctgatttcgttcccgcgcgg

SEQ ID NO: 228337 - DNA, 25 bp, Mus musculus
gcgaggactcttcagctgggataaa

SEQ ID NO: 228338 - DNA, 25 bp, Mus musculus
gaggtcgctgcttccaggaaacctg

SEQ ID NO: 228339 - DNA, 25 bp, Mus musculus
cgcagccgccgaaccctcgcggtct

SEQ ID NO: 228340 - DNA, 25 bp, Mus musculus
tgcaagcaggcgtgtgagtgtgcgc

SEQ ID NO: 228341 - DNA, 25 bp, Mus musculus
gccctcttccctctccaggagcggc

SEQ ID NO: 228342 - DNA, 25 bp, Mus musculus
gttccattagcctcttggcaggccc

SEQ ID NO: 228343 - DNA, 25 bp, Mus musculus
tgtgttccattagcctcttggcagg

SEQ ID NO: 228344 - DNA, 25 bp, Mus musculus
agctgtgttccattagcctcttggc

SEQ ID NO: 228345 - DNA, 25 bp, Mus musculus
ccagctgtgttccattagcctcttg

SEQ ID NO: 228346 - DNA, 25 bp, Mus musculus
tctccaggagcggccggcagttcct

SEQ ID NO: 228347 - DNA, 25 bp, Mus musculus
gccggcccagctgtgttccattagc

SEQ ID NO: 228348 - DNA, 25 bp, Mus musculus
gtgcaggccaatggccagtgcctcc

SEQ ID NO: 228349 - DNA, 25 bp, Mus musculus
ctcacccgcaggctcacctggctgg

SEQ ID NO: 228350 - DNA, 25 bp, Mus musculus
gccttgctccgctcacccgcaggct

SEQ ID NO: 228351 - DNA, 25 bp, Mus musculus
ggcacgcagggtcccgccttgctcc

SEQ ID NO: 228352 - DNA, 25 bp, Mus musculus
ggcccagctgtgttccattagcctc

SEQ ID NO: 228353 - DNA, 25 bp, Mus musculus
cgtcgcgctcgttttacgtcacata

SEQ ID NO: 228354 - DNA, 25 bp, Mus musculus
tcagcaccgtcctgcgaccgaataa

SEQ ID NO: 228355 - DNA, 25 bp, Mus musculus
ttacgtcacataggaccactcgagg

SEQ ID NO: 228356 - DNA, 25 bp, Mus musculus
accgtcctgcgaccgaataatctcg

SEQ ID NO: 228357 - DNA, 25 bp, Mus musculus
ccactcgaggggttgtttatattgc

SEQ ID NO: 228358 - DNA, 25 bp, Mus musculus
ttatattgcgcaaaactggctttgg

SEQ ID NO: 228359 - DNA, 25 bp, Mus musculus
gctgtgaattgatccgggctgaacc

SEQ ID NO: 228360 - DNA, 25 bp, Mus musculus
tgaaccggaccagggtgcttaactc

SEQ ID NO: 228361 - DNA, 25 bp, Mus musculus
tgcttaactcaggtctccgtggggc

SEQ ID NO: 228362 - DNA, 25 bp, Mus musculus
cctctgtgctctcgaggcgtttaga

SEQ ID NO: 228363 - DNA, 25 bp, Mus musculus
ttagagctctttttcccttggagtc

SEQ ID NO: 228364 - DNA, 25 bp, Mus musculus
tcccttggagtctttctgggcgtaa

SEQ ID NO: 228365 - DNA, 25 bp, Mus musculus
aacaagttgcccgactctctcagca

SEQ ID NO: 228366 - DNA, 25 bp, Mus musculus
ttctgggcgtaacttgataaaaaca

SEQ ID NO: 228367 - DNA, 25 bp, Mus musculus
attcacgcgtccactggctcattca

SEQ ID NO: 228368 - DNA, 25 bp, Mus musculus
ccggcattcagcacgcacctggggt

SEQ ID NO: 228369 - DNA, 25 bp, Mus musculus
tgcgggtaagcaccttcctaggaga

SEQ ID NO: 228370 - DNA, 25 bp, Mus musculus
cctaggagagacgaaaggaggatcc

SEQ ID NO: 228371 - DNA, 25 bp, Mus musculus
tcctcacgccaagaaacaggcttct

SEQ ID NO: 228372 - DNA, 25 bp, Mus musculus
gcaggccgctctccattcataaatc

SEQ ID NO: 228373 - DNA, 25 bp, Mus musculus
atggacagtcctttcgagagcccta

SEQ ID NO: 228374 - DNA, 25 bp, Mus musculus
ttggcctaccgatttcccagcggga

SEQ ID NO: 228375 - DNA, 25 bp, Mus musculus
agcaagtgcgctaaagggtacctcc

SEQ ID NO: 228376 - DNA, 25 bp, Mus musculus
cacctgccgatgctcttctggaatc

SEQ ID NO: 228377 - DNA, 25 bp, Mus musculus
gcatcctccgttgctggaacctgga

SEQ ID NO: 228378 - DNA, 25 bp, Mus musculus
aacctggaccttgctcgcgggactt

SEQ ID NO: 228379 - DNA, 25 bp, Mus musculus
gacttcgccttggtgcggaactgga

SEQ ID NO: 228380 - DNA, 25 bp, Mus musculus
tgtctgcactcgaggtcacccagct

SEQ ID NO: 228381 - DNA, 25 bp, Mus musculus
agactgcgcgccgaaagaggatgca

SEQ ID NO: 228382 - DNA, 25 bp, Mus musculus
tcggatcccggatccggtgggactc

SEQ ID NO: 228383 - DNA, 25 bp, Mus musculus
gaagccgctcgtcactttccggcga

SEQ ID NO: 228384 - DNA, 25 bp, Mus musculus
cactcacgcagctgagcagggagca

SEQ ID NO: 228385 - DNA, 25 bp, Mus musculus
cggcctcagtatcccggttctcgga

SEQ ID NO: 228386 - DNA, 25 bp, Mus musculus
ccctggagagagacgcgccacgcaa

SEQ ID NO: 228387 - DNA, 25 bp, Mus musculus
gttacacaaagagtcccgcgccctg

SEQ ID NO: 228388 - DNA, 25 bp, Mus musculus
aaagacagtaagctcagcggggccg

SEQ ID NO: 228389 - DNA, 25 bp, Mus musculus
cagacgctctgccagaaagacagta

SEQ ID NO: 228390 - DNA, 25 bp, Mus musculus
ggggcagacagaatgacagacgctc

SEQ ID NO: 228391 - DNA, 25 bp, Mus musculus
cctagagaagtgaacgggacaaaca

SEQ ID NO: 228392 - DNA, 25 bp, Mus musculus
cagacagtgcccgaatcctagagaa

SEQ ID NO: 228393 - DNA, 25 bp, Mus musculus
ttacgacgacgttcagacagacaga

SEQ ID NO: 228394 - DNA, 25 bp, Mus musculus
tgcagacggagctggttacgacgac

SEQ ID NO: 228395 - DNA, 25 bp, Mus musculus
tcagtaaataaagcctgaagcgctt

SEQ ID NO: 228396 - DNA, 25 bp, Mus musculus
ctcagaggtcagtaaataaagcctg

SEQ ID NO: 228397 - DNA, 25 bp, Mus musculus
gcacaagctcagaggtcagtaaata

SEQ ID NO: 228398 - DNA, 25 bp, Mus musculus
ctggcacaagctcagaggtcagtaa

SEQ ID NO: 228399 - DNA, 25 bp, Mus musculus
gaagaacgaccctggcacaagctca

SEQ ID NO: 228400 - DNA, 25 bp, Mus musculus
ctgaagcgctttcaggcagcggcga

SEQ ID NO: 228401 - DNA, 25 bp, Mus musculus
acaaattgtcttcgcggagtgaaga

SEQ ID NO: 228402 - DNA, 25 bp, Mus musculus
agtgaagaacgaccctggcacaagc

SEQ ID NO: 228403 - DNA, 25 bp, Mus musculus
agacaaattgtcttcgcggagtgaa

SEQ ID NO: 228404 - DNA, 25 bp, Mus musculus
gaaccctctgaatagacaaattgtc

SEQ ID NO: 228405 - DNA, 25 bp, Mus musculus
cggaagaaccctctgaatagacaaa

SEQ ID NO: 228406 - DNA, 25 bp, Mus musculus
gccggaagaaccctctgaatagaca

SEQ ID NO: 228407 - DNA, 25 bp, Mus musculus
cggagtgaagaacgaccctggcaca

SEQ ID NO: 228408 - DNA, 25 bp, Mus musculus
cttcgcggagtgaagaacgaccctg

SEQ ID NO: 228409 - DNA, 25 bp, Mus musculus
cctggaagctagtggacagcaagaa

SEQ ID NO: 228410 - DNA, 25 bp, Mus musculus
ccggcttcctatttcgggagcgagg

SEQ ID NO: 228411 - DNA, 25 bp, Mus musculus
aacgaacggcgcaggatctagggtc

SEQ ID NO: 228412 - DNA, 25 bp, Mus musculus
gtcactcggtgagcgaacgaacggc

SEQ ID NO: 228413 - DNA, 25 bp, Mus musculus
cagcaagaattttgatgactacatg

SEQ ID NO: 228414 - DNA, 25 bp, Mus musculus
cgcctttgtcggtacctggaagcta

SEQ ID NO: 228415 - DNA, 25 bp, Mus musculus
tcatcgcaccatggcggacgccttt

SEQ ID NO: 228416 - DNA, 25 bp, Mus musculus
ccgggagctgcggttctcagtgcct

SEQ ID NO: 228417 - DNA, 25 bp, Mus musculus
gctatttaaagaggctgtccagccg

SEQ ID NO: 228418 - DNA, 25 bp, Mus musculus
tcatcatgtgatgcgagggctattt

SEQ ID NO: 228419 - DNA, 25 bp, Mus musculus
ggtgtgggccactttcatcatgtga

SEQ ID NO: 228420 - DNA, 25 bp, Mus musculus
tgggttagatggcaccaacaggacc

SEQ ID NO: 228421 - DNA, 25 bp, Mus musculus
atggcaccaacaggaccgcgggcgc

SEQ ID NO: 228422 - DNA, 25 bp, Mus musculus
gatgactacatgaagtcactcggtg

SEQ ID NO: 228423 - DNA, 25 bp, Mus musculus
ctccgagccatgtgacccggtgggc

SEQ ID NO: 228424 - DNA, 25 bp, Mus musculus
ccacgcgggaaccagattttcgatc

SEQ ID NO: 228425 - DNA, 25 bp, Mus musculus
atgccgggtctccacgcgggaacca

SEQ ID NO: 228426 - DNA, 25 bp, Mus musculus
aactctggttggcagaccggccctg

SEQ ID NO: 228427 - DNA, 25 bp, Mus musculus
ggcctggaactctggttggcagacc

SEQ ID NO: 228428 - DNA, 25 bp, Mus musculus
gagtcctcgctctttgttcttccag

SEQ ID NO: 228429 - DNA, 25 bp, Mus musculus
aggcagcccgactttcagctgctgg

SEQ ID NO: 228430 - DNA, 25 bp, Mus musculus
ctctgctcggctccgagccatgtga

SEQ ID NO: 228431 - DNA, 25 bp, Mus musculus
aggctccttgttccgaggccacaaa

SEQ ID NO: 228432 - DNA, 25 bp, Mus musculus
agacttgccctgctgctgtcgcctg

SEQ ID NO: 228433 - DNA, 25 bp, Mus musculus
tatccgcagacttgccctgctgctg

SEQ ID NO: 228434 - DNA, 25 bp, Mus musculus
ctgtcattttcctcttatccgcaga

SEQ ID NO: 228435 - DNA, 25 bp, Mus musculus
tccgcggataccctgtcattttcct

SEQ ID NO: 228436 - DNA, 25 bp, Mus musculus
actttcagctgctggggtgagtcct

SEQ ID NO: 228437 - DNA, 25 bp, Mus musculus
cgttggcatggcaaccgggcaacct

SEQ ID NO: 228438 - DNA, 25 bp, Mus musculus
aaccgggcaacctgttccagagccg

SEQ ID NO: 228439 - DNA, 25 bp, Mus musculus
cagcgagccgatgcgcctctcgtat

SEQ ID NO: 228440 - DNA, 25 bp, Mus musculus
gcctctcgtattggcgtttggcagc

SEQ ID NO: 228441 - DNA, 25 bp, Mus musculus
cgagaaagggcttagagacgccgcc

SEQ ID NO: 228442 - DNA, 25 bp, Mus musculus
ctccgctcgtacgtgtttgggaggc

SEQ ID NO: 228443 - DNA, 25 bp, Mus musculus
gaggccctattgttatccgcgagga

SEQ ID NO: 228444 - DNA, 25 bp, Mus musculus
agtccctagaggttggtgttgccgt

SEQ ID NO: 228445 - DNA, 25 bp, Mus musculus
ttttttggatggatctgagcagccc

SEQ ID NO: 228446 - DNA, 25 bp, Mus musculus
ctccttggacttggctggagcttcc

SEQ ID NO: 228447 - DNA, 25 bp, Mus musculus
cagcgccgagggaggaacaatacaa

SEQ ID NO: 228448 - DNA, 25 bp, Mus musculus
gggaggaacaatacaaggctttaga

SEQ ID NO: 228449 - DNA, 25 bp, Mus musculus
tcacacaggccctgccgttggcatg

SEQ ID NO: 228450 - DNA, 25 bp, Mus musculus
ccgccatgttgtcggagtgaaaggt

SEQ ID NO: 228451 - DNA, 25 bp, Mus musculus
ctcgcacacggcgtgcttcgcggat

SEQ ID NO: 228452 - DNA, 25 bp, Mus musculus
ggtgtgtcccggtctcatggggtcc

SEQ ID NO: 228453 - DNA, 25 bp, Mus musculus
tgtctttgcgtgtcccctcgtcgcg

SEQ ID NO: 228454 - DNA, 25 bp, Mus musculus
cgtgtaccccgcgtgtctttgcgtg

SEQ ID NO: 228455 - DNA, 25 bp, Mus musculus
gccccaagagggtccccagcgtgta

SEQ ID NO: 228456 - DNA, 25 bp, Mus musculus
cccgcgggctgttgctgccaccgct

SEQ ID NO: 228457 - DNA, 25 bp, Mus musculus
acaccgccacccatgcgcccggggc

SEQ ID NO: 228458 - DNA, 25 bp, Mus musculus
agcgcgtggacaccgccacccatgc

SEQ ID NO: 228459 - DNA, 25 bp, Mus musculus
accgcacaggggcagcgcgtggaca

SEQ ID NO: 228460 - DNA, 25 bp, Mus musculus
acaaaggccgccatgaagcccgggc

SEQ ID NO: 228461 - DNA, 25 bp, Mus musculus
gcgccgcgaacaaaggccgccatga

SEQ ID NO: 228462 - DNA, 25 bp, Mus musculus
cgtgcttcgcggatccacagtaggg

SEQ ID NO: 228463 - DNA, 25 bp, Mus musculus
gaagcgtgtgcgtccggtatccgct

SEQ ID NO: 228464 - DNA, 25 bp, Mus musculus
acacggcgtgcttcgcggatccaca

SEQ ID NO: 228465 - DNA, 25 bp, Mus musculus
gggccagccaatagcagggtgttcc

SEQ ID NO: 228466 - DNA, 25 bp, Mus musculus
ggctccctgcgcgttcttgcatgtg

SEQ ID NO: 228467 - DNA, 25 bp, Mus musculus
ggagcgcgtgctcaaacccaggctc

SEQ ID NO: 228468 - DNA, 25 bp, Mus musculus
ttttgcccacgctgggatcccgggc

SEQ ID NO: 228469 - DNA, 25 bp, Mus musculus
ttccgattttttgcccacgctggga

SEQ ID NO: 228470 - DNA, 25 bp, Mus musculus
gcagcctattggttccgattttttg

SEQ ID NO: 228471 - DNA, 25 bp, Mus musculus
gcttggcagcctattggttccgatt

SEQ ID NO: 228472 - DNA, 25 bp, Mus musculus
atgcccaggcttggcagcctattgg

SEQ ID NO: 228473 - DNA, 25 bp, Mus musculus
gccggtccaaactgtcatagcaaca

SEQ ID NO: 228474 - DNA, 25 bp, Mus musculus
cagccaatagcagggtgttccggtg

SEQ ID NO: 228475 - DNA, 25 bp, Mus musculus
tgtcatagcaacagcgcgcaccggc

SEQ ID NO: 228476 - DNA, 25 bp, Mus musculus
cttgcatgtggccttgcgcgcgcac

SEQ ID NO: 228477 - DNA, 25 bp, Mus musculus
ttccggtgaggtaatgcccaggctt

SEQ ID NO: 228478 - DNA, 25 bp, Mus musculus
cgcaacgccggtccaaactgtcata

SEQ ID NO: 228479 - DNA, 25 bp, Mus musculus
gccagtggcattgagctgttcgcca

SEQ ID NO: 228480 - DNA, 25 bp, Mus musculus
cattgagctgttcgccatcggcgtg

SEQ ID NO: 228481 - DNA, 25 bp, Mus musculus
ccgcgtggacaaggctacgctgcga

SEQ ID NO: 228482 - DNA, 25 bp, Mus musculus
acaaggctacgctgcgacagatcgc

SEQ ID NO: 228483 - DNA, 25 bp, Mus musculus
cgctgcgacagatcgctagcgagcc

SEQ ID NO: 228484 - DNA, 25 bp, Mus musculus
agatcgctagcgagccgcaggacga

SEQ ID NO: 228485 - DNA, 25 bp, Mus musculus
cgtggattacgtggagagctacaat

SEQ ID NO: 228486 - DNA, 25 bp, Mus musculus
ttacgtggagagctacaatgtcatc

SEQ ID NO: 228487 - DNA, 25 bp, Mus musculus
gtggagagctacaatgtcatcgaga

SEQ ID NO: 228488 - DNA, 25 bp, Mus musculus
acaatgtcatcgagaagctggccaa

SEQ ID NO: 228489 - DNA, 25 bp, Mus musculus
gttccaagaggccttctgcggttcg

SEQ ID NO: 228490 - DNA, 25 bp, Mus musculus
caagaggccttctgcggttcgagac

SEQ ID NO: 228491 - DNA, 25 bp, Mus musculus
cgcaggacgagcacgtggattacgt

SEQ ID NO: 228492 - DNA, 25 bp, Mus musculus
gccttctgcggttcgagaccaggag

SEQ ID NO: 228493 - DNA, 25 bp, Mus musculus
cagctccggtgtgcatgactttgca

SEQ ID NO: 228494 - DNA, 25 bp, Mus musculus
gcaagagtgtatatccgggttagga

SEQ ID NO: 228495 - DNA, 25 bp, Mus musculus
tgagtccgctacaaaggcgcccgct

SEQ ID NO: 228496 - DNA, 25 bp, Mus musculus
cccgagtagaggtggtagagcaccc

SEQ ID NO: 228497 - DNA, 25 bp, Mus musculus
tgaaggacattgctctcgcggaccc

SEQ ID NO: 228498 - DNA, 25 bp, Mus musculus
ccttggacttctcgtgaaggacatt

SEQ ID NO: 228499 - DNA, 25 bp, Mus musculus
ggtcatcttatcatcggcgccctcg

SEQ ID NO: 228500 - DNA, 25 bp, Mus musculus
tacgtcgccgctggtcatcttatca

SEQ ID NO: 228501 - DNA, 25 bp, Mus musculus
acatcttgcggttggacagtacgtc

SEQ ID NO: 228502 - DNA, 25 bp, Mus musculus
ggccgtcttgagcaggtagaacatc

SEQ ID NO: 228503 - DNA, 25 bp, Mus musculus
ccagcacctacctgcacgttgggga

SEQ ID NO: 228504 - DNA, 25 bp, Mus musculus
tgactttgcacacactacatgggtg

SEQ ID NO: 228505 - DNA, 25 bp, Mus musculus
cggagtggaaaagccacaagctctc

SEQ ID NO: 228506 - DNA, 25 bp, Mus musculus
tcgctcagcaggtctgaccgagctc

SEQ ID NO: 228507 - DNA, 25 bp, Mus musculus
caccgtgaagctcggctgcgaatag

SEQ ID NO: 228508 - DNA, 25 bp, Mus musculus
actgggcgctctggttaaaggagcc

SEQ ID NO: 228509 - DNA, 25 bp, Mus musculus
tcgccatgactctcggagccggact

SEQ ID NO: 228510 - DNA, 25 bp, Mus musculus
ttagacgctgcggtcgccatgactc

SEQ ID NO: 228511 - DNA, 25 bp, Mus musculus
acagcgcggtgatccactggtgagc

SEQ ID NO: 228512 - DNA, 25 bp, Mus musculus
gctgtaccaccaccgagggcttgat

SEQ ID NO: 228513 - DNA, 25 bp, Mus musculus
tgttgatgctgttgctgcagcgctc

SEQ ID NO: 228514 - DNA, 25 bp, Mus musculus
tgcaccagatgtggcggtcgctgtt

SEQ ID NO: 228515 - DNA, 25 bp, Mus musculus
ctgcgaatagagcaaaccgccgttg

SEQ ID NO: 228516 - DNA, 25 bp, Mus musculus
gcctctgcttgaattgcttggcgaa

SEQ ID NO: 228517 - DNA, 25 bp, Mus musculus
taaatccgagtttgatccgcctctg

SEQ ID NO: 228518 - DNA, 25 bp, Mus musculus
cccacgtctgcttgagtaaatccga

SEQ ID NO: 228519 - DNA, 25 bp, Mus musculus
aacacgttgccgtacagggtgccaa

SEQ ID NO: 228520 - DNA, 25 bp, Mus musculus
aaccgccgttggaagctcccatgga

SEQ ID NO: 228521 - DNA, 25 bp, Mus musculus
atttccagtgtaaataccgcgcggc

SEQ ID NO: 228522 - DNA, 25 bp, Mus musculus
gacgggcaaagcgtatccctaggga

SEQ ID NO: 228523 - DNA, 25 bp, Mus musculus
atcacacggccgacgggcaaagcgt

SEQ ID NO: 228524 - DNA, 25 bp, Mus musculus
ctgaatcaatcacacggccgacggg

SEQ ID NO: 228525 - DNA, 25 bp, Mus musculus
ccagtgtaaataccgcgcggccaag

SEQ ID NO: 228526 - DNA, 25 bp, Mus musculus
ttccactcgtttatcatcggaaatg

SEQ ID NO: 228527 - DNA, 25 bp, Mus musculus
tgcaatttatttttccactcgttta

SEQ ID NO: 228528 - DNA, 25 bp, Mus musculus
tgtagtgtttgacacttgcaattta

SEQ ID NO: 228529 - DNA, 25 bp, Mus musculus
actctcctaatgtagtgtttgacac

SEQ ID NO: 228530 - DNA, 25 bp, Mus musculus
tcttgctcactctcctaatgtagtg

SEQ ID NO: 228531 - DNA, 25 bp, Mus musculus
ttacaaattcgctggctgcggaggc

SEQ ID NO: 228532 - DNA, 25 bp, Mus musculus
ctcgggcttacaaattcgctggctg

SEQ ID NO: 228533 - DNA, 25 bp, Mus musculus
cgctcgatcatttctcgggcttaca

SEQ ID NO: 228534 - DNA, 25 bp, Mus musculus
cgcggccaagctgaatcaatcacac

SEQ ID NO: 228535 - DNA, 25 bp, Mus musculus
gggccttcctcaaggccaatcggct

SEQ ID NO: 228536 - DNA, 25 bp, Mus musculus
cagcggaaaagtggccaggaagcga

SEQ ID NO: 228537 - DNA, 25 bp, Mus musculus
gcctaccgaggccagcggaaaagtg

SEQ ID NO: 228538 - DNA, 25 bp, Mus musculus
atcctgctctgagcggcctaccgag

SEQ ID NO: 228539 - DNA, 25 bp, Mus musculus
tacagatcctgctctgagcggccta

SEQ ID NO: 228540 - DNA, 25 bp, Mus musculus
cgcaacggtacagatcctgctctga

SEQ ID NO: 228541 - DNA, 25 bp, Mus musculus
cctgggacacgcaacggtacagatc

SEQ ID NO: 228542 - DNA, 25 bp, Mus musculus
agttggagacgccagcaccacgcgg

SEQ ID NO: 228543 - DNA, 25 bp, Mus musculus
ctgcaaagttggagacgccagcacc

SEQ ID NO: 228544 - DNA, 25 bp, Mus musculus
tgagctctgcaaagttggagacgcc

SEQ ID NO: 228545 - DNA, 25 bp, Mus musculus
ctgacctttgacgatgagctctgca

SEQ ID NO: 228546 - DNA, 25 bp, Mus musculus
tcggctgacctttgacgatgagctc

SEQ ID NO: 228547 - DNA, 25 bp, Mus musculus
cgacggtggctgatgtgccgcaccc

SEQ ID NO: 228548 - DNA, 25 bp, Mus musculus
aggccaatcggctgacctttgacga

SEQ ID NO: 228549 - DNA, 25 bp, Mus musculus
tgcaacacaggatcagacgcaactc

SEQ ID NO: 228550 - DNA, 25 bp, Mus musculus
aaatactcccacagggtcactcgtg

SEQ ID NO: 228551 - DNA, 25 bp, Mus musculus
gtcactcgtgggcacagagctcaca

SEQ ID NO: 228552 - DNA, 25 bp, Mus musculus
agctcacacaggttccgacccggtt

SEQ ID NO: 228553 - DNA, 25 bp, Mus musculus
ttgggcacaatccaccgagtcctca

SEQ ID NO: 228554 - DNA, 25 bp, Mus musculus
caggcataaacaaacacgcgggttt

SEQ ID NO: 228555 - DNA, 25 bp, Mus musculus
cgggttttcaaacgcaccagcaaca

SEQ ID NO: 228556 - DNA, 25 bp, Mus musculus
cacttggcagcgtggacaaacatga

SEQ ID NO: 228557 - DNA, 25 bp, Mus musculus
ccgggaggccgcacaaagttgcaaa

SEQ ID NO: 228558 - DNA, 25 bp, Mus musculus
cccgaaatgtcggagtcggcggcta

SEQ ID NO: 228559 - DNA, 25 bp, Mus musculus
gacgcaactctagccaagccactga

SEQ ID NO: 228560 - DNA, 25 bp, Mus musculus
ccaacgcctctgacgagctacgatg

SEQ ID NO: 228561 - DNA, 25 bp, Mus musculus
agcgccgctcggaacttgcgaaaca

SEQ ID NO: 228562 - DNA, 25 bp, Mus musculus
caacaaacagtactcccgcctaggg

SEQ ID NO: 228563 - DNA, 25 bp, Mus musculus
gcgccggattctgccagtgctggaa

SEQ ID NO: 228564 - DNA, 25 bp, Mus musculus
tgctgtcctacagatgccgagaccc

SEQ ID NO: 228565 - DNA, 25 bp, Mus musculus
acaccggtgctttccggcggccaag

SEQ ID NO: 228566 - DNA, 25 bp, Mus musculus
ctgtcgcggacgaatgacgtagtcc

SEQ ID NO: 228567 - DNA, 25 bp, Mus musculus
atgacgtagtccagagcgccggatt

SEQ ID NO: 228568 - DNA, 25 bp, Mus musculus
aagcagcatgttggtcagccagcga

SEQ ID NO: 228569 - DNA, 25 bp, Mus musculus
tcctcgaggcttggtaccgccacgg

SEQ ID NO: 228570 - DNA, 25 bp, Mus musculus
cgctctctctgagccgtcacgggtg

SEQ ID NO: 228571 - DNA, 25 bp, Mus musculus
ctggtctatggcaaccatggggatc

SEQ ID NO: 228572 - DNA, 25 bp, Mus musculus
caaccatggggatccagccaaggtc

SEQ ID NO: 228573 - DNA, 25 bp, Mus musculus
cagccaaggtcgtccagtaagagtc

SEQ ID NO: 228574 - DNA, 25 bp, Mus musculus
cgaggaagagggttctgctgtccta

SEQ ID NO: 228575 - DNA, 25 bp, Mus musculus
gggcacctcagcttgcgggtctcct

SEQ ID NO: 228576 - DNA, 25 bp, Mus musculus
cttgctgacccgacaccggtgcttt

SEQ ID NO: 228577 - DNA, 25 bp, Mus musculus
cgacgcggctttaaagcaagacgga

SEQ ID NO: 228578 - DNA, 25 bp, Mus musculus
gtgaaagatggctgctccggcttca

SEQ ID NO: 228579 - DNA, 25 bp, Mus musculus
ccgcacaggccgtgcccgggtgaaa

SEQ ID NO: 228580 - DNA, 25 bp, Mus musculus
gcaccgggccagagtccagtgatgc

SEQ ID NO: 228581 - DNA, 25 bp, Mus musculus
aggcatggagctgccggaccctgtt

SEQ ID NO: 228582 - DNA, 25 bp, Mus musculus
ggttgccaagggaaccgccacgcgc

SEQ ID NO: 228583 - DNA, 25 bp, Mus musculus
attctgtagcgttcggggaagccca

SEQ ID NO: 228584 - DNA, 25 bp, Mus musculus
ccaaggggaagcctctggaggattc

SEQ ID NO: 228585 - DNA, 25 bp, Mus musculus
cctggctcgcctctccaaggggaag

SEQ ID NO: 228586 - DNA, 25 bp, Mus musculus
actaggccacgttaggctgcgggcc

SEQ ID NO: 228587 - DNA, 25 bp, Mus musculus
ttttcagcagcactaggccacgtta

SEQ ID NO: 228588 - DNA, 25 bp, Mus musculus
gaacccgccattttcagcagcacta

SEQ ID NO: 228589 - DNA, 25 bp, Mus musculus
agcaagacggaggaacccgccattt

SEQ ID NO: 228590 - DNA, 25 bp, Mus musculus
gatgcggatcaggaacgccttcttc

SEQ ID NO: 228591 - DNA, 25 bp, Mus musculus
tacatcggccgcctgagctaccagg

SEQ ID NO: 228592 - DNA, 25 bp, Mus musculus
tggcttgccgcgcttcaagccttga

SEQ ID NO: 228593 - DNA, 25 bp, Mus musculus
cgttctcgagctgcgtgctcgcgta

SEQ ID NO: 228594 - DNA, 25 bp, Mus musculus
cgatgtggagcgcttctttaagggc

SEQ ID NO: 228595 - DNA, 25 bp, Mus musculus
atcctggaggtggatctgaagaacg

SEQ ID NO: 228596 - DNA, 25 bp, Mus musculus
ttccgtcgctggactatgggtccga

SEQ ID NO: 228597 - DNA, 25 bp, Mus musculus
agcagatgagggttccggccctctt

SEQ ID NO: 228598 - DNA, 25 bp, Mus musculus
ttcccggcgtgtgtttctgaggact

SEQ ID NO: 228599 - DNA, 25 bp, Mus musculus
tgaggactggagctctggctttttc

SEQ ID NO: 228600 - DNA, 25 bp, Mus musculus
tggctttttcgcgtgccacactttg

SEQ ID NO: 228601 - DNA, 25 bp, Mus musculus
tgggcgggagacactagtttttgta

SEQ ID NO: 228602 - DNA, 25 bp, Mus musculus
tagtgcagtgacagtttcgaaagta

SEQ ID NO: 228603 - DNA, 25 bp, Mus musculus
ctttaagggctacgggaagatcctg

SEQ ID NO: 228604 - DNA, 25 bp, Mus musculus
tttcgaaagtactggcttgccgcgc

SEQ ID NO: 228605 - DNA, 25 bp, Mus musculus
acaaggcctcctggagcggctccag

SEQ ID NO: 228606 - DNA, 25 bp, Mus musculus
tggctcccagctccgctgcggaaaa

SEQ ID NO: 228607 - DNA, 25 bp, Mus musculus
ccctcgctgcggtatgtaaagcgca

SEQ ID NO: 228608 - DNA, 25 bp, Mus musculus
gagaagccggagtcagagacacctc

SEQ ID NO: 228609 - DNA, 25 bp, Mus musculus
tgcagctccagtgccggctgaggaa

SEQ ID NO: 228610 - DNA, 25 bp, Mus musculus
gcggtttttcccagagtctagctca

SEQ ID NO: 228611 - DNA, 25 bp, Mus musculus
ctggtctcggccagagcggtttttc

SEQ ID NO: 228612 - DNA, 25 bp, Mus musculus
atcctggacaaagtccgccgttgcc

SEQ ID NO: 228613 - DNA, 25 bp, Mus musculus
cttctggaggagtggagaagaatcc

SEQ ID NO: 228614 - DNA, 25 bp, Mus musculus
gtccggcgaggacctgcgtccagca

SEQ ID NO: 228615 - DNA, 25 bp, Mus musculus
aacagccttgcctgggccggcgagc

SEQ ID NO: 228616 - DNA, 25 bp, Mus musculus
acaccgcaatctgggaacagccttg

SEQ ID NO: 228617 - DNA, 25 bp, Mus musculus
agcccgaatcggaaacaccgcaatc

SEQ ID NO: 228618 - DNA, 25 bp, Mus musculus
gtcagtgtctgcctctctgctcttc

SEQ ID NO: 228619 - DNA, 25 bp, Mus musculus
agcccgacgaacaatggcaggaggc

SEQ ID NO: 228620 - DNA, 25 bp, Mus musculus
tgcaggctggctgagtaaagccgcc

SEQ ID NO: 228621 - DNA, 25 bp, Mus musculus
ctcggattccgcctgacttctcggg

SEQ ID NO: 228622 - DNA, 25 bp, Mus musculus
agcttcagcccgacgaacaatggca

SEQ ID NO: 228623 - DNA, 25 bp, Mus musculus
gaagacaccccacgcctaactttga

SEQ ID NO: 228624 - DNA, 25 bp, Mus musculus
caccgcacggtgactgacaggccgg

SEQ ID NO: 228625 - DNA, 25 bp, Mus musculus
ggtttcctgccagggctcccgccca

SEQ ID NO: 228626 - DNA, 25 bp, Mus musculus
caccgctgcccacctggtttcctgc

SEQ ID NO: 228627 - DNA, 25 bp, Mus musculus
cttcgcggtccaccgcaccgctgcc

SEQ ID NO: 228628 - DNA, 25 bp, Mus musculus
agcggcacccaacaccttcgcggtc

SEQ ID NO: 228629 - DNA, 25 bp, Mus musculus
gcttctccatcaccaggggctcgct

SEQ ID NO: 228630 - DNA, 25 bp, Mus musculus
ctgacttctcgggtctgcccagctt

SEQ ID NO: 228631 - DNA, 25 bp, Mus musculus
attccgcctgacttctcgggtctgc

SEQ ID NO: 228632 - DNA, 25 bp, Mus musculus
cctcccgcctttcctccgcgagacg

SEQ ID NO: 228633 - DNA, 25 bp, Mus musculus
tgcggacgaacacccacgacaggac

SEQ ID NO: 228634 - DNA, 25 bp, Mus musculus
agtagcccgactgtcgcaaccggga

SEQ ID NO: 228635 - DNA, 25 bp, Mus musculus
acaactgccaatctttggggcggcg

SEQ ID NO: 228636 - DNA, 25 bp, Mus musculus
tcctgtaattggtgcagacaactgc

SEQ ID NO: 228637 - DNA, 25 bp, Mus musculus
cacctgcactgacagggcaactctg

SEQ ID NO: 228638 - DNA, 25 bp, Mus musculus
ttctgggtcttgcaccttgtccctc

SEQ ID NO: 228639 - DNA, 25 bp, Mus musculus
gctcccggaacgatcgggctcctta

SEQ ID NO: 228640 - DNA, 25 bp, Mus musculus
aggatcctgtgaccctcggctcgca

SEQ ID NO: 228641 - DNA, 25 bp, Mus musculus
ccctagggacctcaagtttggagca

SEQ ID NO: 228642 - DNA, 25 bp, Mus musculus
cgctgagtcctgctgcggacgaaca

SEQ ID NO: 228643 - DNA, 25 bp, Mus musculus
tcagttacgtaaggacccgagcagg

SEQ ID NO: 228644 - DNA, 25 bp, Mus musculus
ccgggtccggaaactcaagattcag

SEQ ID NO: 228645 - DNA, 25 bp, Mus musculus
aagggccaccctgaccggcagagct

SEQ ID NO: 228646 - DNA, 25 bp, Mus musculus
tttggagcatgcagctcaggacctc

SEQ ID NO: 228647 - DNA, 25 bp, Mus musculus
atgaggccatagcacaccgtgatga

SEQ ID NO: 228648 - DNA, 25 bp, Mus musculus
gcaggcgcagtagcatgaggccata

SEQ ID NO: 228649 - DNA, 25 bp, Mus musculus
aagcagcgcttgaagttctcgtcca

SEQ ID NO: 228650 - DNA, 25 bp, Mus musculus
accgtgatgatgaggatcggcacca

SEQ ID NO: 228651 - DNA, 25 bp, Mus musculus
agcaccatgcgcgtgatgcgccgca

SEQ ID NO: 228652 - DNA, 25 bp, Mus musculus
gcgtccagacgatgacgaagatgtg

SEQ ID NO: 228653 - DNA, 25 bp, Mus musculus
tgcggtccttctccttggaaccgga

SEQ ID NO: 228654 - DNA, 25 bp, Mus musculus
ccacaagtgggtcgcgccgattgat

SEQ ID NO: 228655 - DNA, 25 bp, Mus musculus
atgcacaggtgcagtgcggccacca

SEQ ID NO: 228656 - DNA, 25 bp, Mus musculus
ttggcgtagcccagcgcaatgcaca

SEQ ID NO: 228657 - DNA, 25 bp, Mus musculus
ctcgtccaggaaggcgtagagaacc

SEQ ID NO: 228658 - DNA, 25 bp, Mus musculus
tgcaggcagtgacacgctcacgcgt

SEQ ID NO: 228659 - DNA, 25 bp, Mus musculus
gccgattgatgtccaccagcgtcca

SEQ ID NO: 228660 - DNA, 25 bp, Mus musculus
tggaaccggacagcagacgcacgct

SEQ ID NO: 228661 - DNA, 25 bp, Mus musculus
gactcaccggacgatgccaaacatg

SEQ ID NO: 228662 - DNA, 25 bp, Mus musculus
acgccgcaggctgcagcgctcgctc

SEQ ID NO: 228663 - DNA, 25 bp, Mus musculus
tccgtctccaccgtgcgccctgggc

SEQ ID NO: 228664 - DNA, 25 bp, Mus musculus
gcagagggcaccagctccatggcgc

SEQ ID NO: 228665 - DNA, 25 bp, Mus musculus
acgggcagagggcaccagctccatg

SEQ ID NO: 228666 - DNA, 25 bp, Mus musculus
aggactgcagctccgcacgggcaga

SEQ ID NO: 228667 - DNA, 25 bp, Mus musculus
acgaggcactacgggctcccggcga

SEQ ID NO: 228668 - DNA, 25 bp, Mus musculus
cacacagccgagtagagcgcggtga

SEQ ID NO: 228669 - DNA, 25 bp, Mus musculus
cactgcgcacacagccgagtagagc

SEQ ID NO: 228670 - DNA, 25 bp, Mus musculus
gatgccaaacatgacgagcacgttg

SEQ ID NO: 228671 - DNA, 25 bp, Mus musculus
gaccgcccgcagtgctcgcccaagc

SEQ ID NO: 228672 - DNA, 25 bp, Mus musculus
ccggacgatgccaaacatgacgagc

SEQ ID NO: 228673 - DNA, 25 bp, Mus musculus
tgacgagcacgttgcccagaagccc

SEQ ID NO: 228674 - DNA, 25 bp, Mus musculus
tcggctgactcaccggacgatgcca

SEQ ID NO: 228675 - DNA, 25 bp, Mus musculus
gcctgtctgtgcaactttcgcgtta

SEQ ID NO: 228676 - DNA, 25 bp, Mus musculus
tccgggagtggctgaattgtttata

SEQ ID NO: 228677 - DNA, 25 bp, Mus musculus
agttccacccttctcagtgcgcaga

SEQ ID NO: 228678 - DNA, 25 bp, Mus musculus
cgactaacgagatgtggtgctcttc

SEQ ID NO: 228679 - DNA, 25 bp, Mus musculus
tggagcgggccagaaaaattcatca

SEQ ID NO: 228680 - DNA, 25 bp, Mus musculus
gggcctcggagcatcttcatctaga

SEQ ID NO: 228681 - DNA, 25 bp, Mus musculus
ccggctggttctttcggccaaattg

SEQ ID NO: 228682 - DNA, 25 bp, Mus musculus
agatccggggatcacaaatggcctc

SEQ ID NO: 228683 - DNA, 25 bp, Mus musculus
atctaagctcaaactccggtcccgg

SEQ ID NO: 228684 - DNA, 25 bp, Mus musculus
atctgccgggagacagaacatcctg

SEQ ID NO: 228685 - DNA, 25 bp, Mus musculus
taaactctcgagcaggacccagggc

SEQ ID NO: 228686 - DNA, 25 bp, Mus musculus
ctgctctgcttttgtcggtaaactc

SEQ ID NO: 228687 - DNA, 25 bp, Mus musculus
gctggggagtcctttctaagtagta

SEQ ID NO: 228688 - DNA, 25 bp, Mus musculus
agccttgactgcgaatctccacgtg

SEQ ID NO: 228689 - DNA, 25 bp, Mus musculus
acctgcgacccgagcggcttcggaa

SEQ ID NO: 228690 - DNA, 25 bp, Mus musculus
tgaccttttggtctctgcgagagga

SEQ ID NO: 228691 - DNA, 25 bp, Mus musculus
gacgtcgccgagcagcaagtcgtcc

SEQ ID NO: 228692 - DNA, 25 bp, Mus musculus
gcagcaagtcgtccgagaagaaaac

SEQ ID NO: 228693 - DNA, 25 bp, Mus musculus
acccggcagccacacgagggaaaga

SEQ ID NO: 228694 - DNA, 25 bp, Mus musculus
tgaggcccgaatcccgagccgcgag

SEQ ID NO: 228695 - DNA, 25 bp, Mus musculus
gtctcgcctcacacaatggccgaga

SEQ ID NO: 228696 - DNA, 25 bp, Mus musculus
cacaatggccgagacatgcgggctg

SEQ ID NO: 228697 - DNA, 25 bp, Mus musculus
tgggcctgtacctgctccaagaggc

SEQ ID NO: 228698 - DNA, 25 bp, Mus musculus
ctgctggccgacatggctctcggat

SEQ ID NO: 228699 - DNA, 25 bp, Mus musculus
ctctcggatcctcacggggaacgac

SEQ ID NO: 228700 - DNA, 25 bp, Mus musculus
tttgtccctgacactcggagcctcg

SEQ ID NO: 228701 - DNA, 25 bp, Mus musculus
gcgcgagcgctgactctcacagtcg

SEQ ID NO: 228702 - DNA, 25 bp, Mus musculus
cagcagagacacagcgcgcgactcg

SEQ ID NO: 228703 - DNA, 25 bp, Mus musculus
tgcctcctctcctaagccctccaaa

SEQ ID NO: 228704 - DNA, 25 bp, Mus musculus
cggacccagcggcagcgtcccccca

SEQ ID NO: 228705 - DNA, 25 bp, Mus musculus
cgcgcaaggcccaagctcccaaacc

SEQ ID NO: 228706 - DNA, 25 bp, Mus musculus
gctcctccgcgcaaggcccaagctc

SEQ ID NO: 228707 - DNA, 25 bp, Mus musculus
ccaggcctgacccagctcctccgcg

SEQ ID NO: 228708 - DNA, 25 bp, Mus musculus
gcgaaggcttgaccctattccctgc

SEQ ID NO: 228709 - DNA, 25 bp, Mus musculus
tcgggcgaaggcttgaccctattcc

SEQ ID NO: 228710 - DNA, 25 bp, Mus musculus
ccctcgggcgaaggcttgaccctat

SEQ ID NO: 228711 - DNA, 25 bp, Mus musculus
tcctctccaggtctggtggcccagg

SEQ ID NO: 228712 - DNA, 25 bp, Mus musculus
gacgctgcctcctctcctaagccct

SEQ ID NO: 228713 - DNA, 25 bp, Mus musculus
gaaggcttgaccctattccctgcac

SEQ ID NO: 228714 - DNA, 25 bp, Mus musculus
ggcgccgcgacgtccgctcgctccc

SEQ ID NO: 228715 - DNA, 25 bp, Mus musculus
tctccaggtctggtggcccaggcct

SEQ ID NO: 228716 - DNA, 25 bp, Mus musculus
ggcgaaggcttgaccctattccctg

SEQ ID NO: 228717 - DNA, 25 bp, Mus musculus
gtcacgctcgtgaaagagatgagtc

SEQ ID NO: 228718 - DNA, 25 bp, Mus musculus
cgcgcagtcggaccggctgctgaga

SEQ ID NO: 228719 - DNA, 25 bp, Mus musculus
agagccgcgcgtttccgggttggag

SEQ ID NO: 228720 - DNA, 25 bp, Mus musculus
catctgcgcctgcgctagtgaggcg

SEQ ID NO: 228721 - DNA, 25 bp, Mus musculus
gggacgcagagtagacccacgccac

SEQ ID NO: 228722 - DNA, 25 bp, Mus musculus
taggggacgcagagtagacccacgc

SEQ ID NO: 228723 - DNA, 25 bp, Mus musculus
gacagggattcacgccgtggtaggg

SEQ ID NO: 228724 - DNA, 25 bp, Mus musculus
gaaagagatgagtcgtaaagaaaca

SEQ ID NO: 228725 - DNA, 25 bp, Mus musculus
cgctcgtgaaagagatgagtcgtaa

SEQ ID NO: 228726 - DNA, 25 bp, Mus musculus
ccggtcacgctcgtgaaagagatga

SEQ ID NO: 228727 - DNA, 25 bp, Mus musculus
ttaccggtcacgctcgtgaaagaga

SEQ ID NO: 228728 - DNA, 25 bp, Mus musculus
ggttaccggtcacgctcgtgaaaga

SEQ ID NO: 228729 - DNA, 25 bp, Mus musculus
tcggttaccggtcacgctcgtgaaa

SEQ ID NO: 228730 - DNA, 25 bp, Mus musculus
tcgtgaaagagatgagtcgtaaaga

SEQ ID NO: 228731 - DNA, 25 bp, Mus musculus
gaaaccgagtagctccaccgcattc

SEQ ID NO: 228732 - DNA, 25 bp, Mus musculus
ccggtagctccacggatacggatgc

SEQ ID NO: 228733 - DNA, 25 bp, Mus musculus
caccgcattccgctgacaggcgccc

SEQ ID NO: 228734 - DNA, 25 bp, Mus musculus
cgcgacccgcggtcggctgagctga

SEQ ID NO: 228735 - DNA, 25 bp, Mus musculus
ccgctggcatcctacggggaccggt

SEQ ID NO: 228736 - DNA, 25 bp, Mus musculus
catcctacggggaccggtagctcca

SEQ ID NO: 228737 - DNA, 25 bp, Mus musculus
cggccagtcacgtcctggggaccaa

SEQ ID NO: 228738 - DNA, 25 bp, Mus musculus
tagctccacggatacggatgcccgg

SEQ ID NO: 228739 - DNA, 25 bp, Mus musculus
acggatacggatgcccggtgcttcc

SEQ ID NO: 228740 - DNA, 25 bp, Mus musculus
ttccgactggctgagcttgggattc

SEQ ID NO: 228741 - DNA, 25 bp, Mus musculus
gagcttgggattccgggctctgcac

SEQ ID NO: 228742 - DNA, 25 bp, Mus musculus
gattccgggctctgcacggttgcct

SEQ ID NO: 228743 - DNA, 25 bp, Mus musculus
gccttggaaaccgagtagctccacc

SEQ ID NO: 228744 - DNA, 25 bp, Mus musculus
ctgagctgagcggagcggccagtca

SEQ ID NO: 228745 - DNA, 25 bp, Mus musculus
actcgcagcccagcgggtagttgca

SEQ ID NO: 228746 - DNA, 25 bp, Mus musculus
gcacctgaagcactcttggcctgcg

SEQ ID NO: 228747 - DNA, 25 bp, Mus musculus
ctgaagcactcttggcctgcggtgt

SEQ ID NO: 228748 - DNA, 25 bp, Mus musculus
tcttggcctgcggtgtcccagagct

SEQ ID NO: 228749 - DNA, 25 bp, Mus musculus
tgcagtttgactcgcagcccagcgg

SEQ ID NO: 228750 - DNA, 25 bp, Mus musculus
tgcagcgcgcggctgtagaactcca

SEQ ID NO: 228751 - DNA, 25 bp, Mus musculus
gcgcggctgtagaactccacgccta

SEQ ID NO: 228752 - DNA, 25 bp, Mus musculus
aactccacgcctacagtgggttcgg

SEQ ID NO: 228753 - DNA, 25 bp, Mus musculus
ccgccacgtaacaccgtagcagtga

SEQ ID NO: 228754 - DNA, 25 bp, Mus musculus
caccgtagcagtgacgtcttgccca

SEQ ID NO: 228755 - DNA, 25 bp, Mus musculus
gcagcgcgatccgaaattggtagct

SEQ ID NO: 228756 - DNA, 25 bp, Mus musculus
gatccgaaattggtagctgcagccg

SEQ ID NO: 228757 - DNA, 25 bp, Mus musculus
cgaaattggtagctgcagccggccg

SEQ ID NO: 228758 - DNA, 25 bp, Mus musculus
tcccagagctgcagtttgactcgca

SEQ ID NO: 228759 - DNA, 25 bp, Mus musculus
cgccttgtacttctacccaacgttg

SEQ ID NO: 228760 - DNA, 25 bp, Mus musculus
ctgttttcgttatggcgccttgtac

SEQ ID NO: 228761 - DNA, 25 bp, Mus musculus
tcaggtggatgacgcagactcagta

SEQ ID NO: 228762 - DNA, 25 bp, Mus musculus
tagagggcgcgagagtatataatcc

SEQ ID NO: 228763 - DNA, 25 bp, Mus musculus
tatataatcctggtgcaggccgttc

SEQ ID NO: 228764 - DNA, 25 bp, Mus musculus
gtgcaggccgttctcagtcctttct

SEQ ID NO: 228765 - DNA, 25 bp, Mus musculus
agtcctttctcgcttcatccgcggt

SEQ ID NO: 228766 - DNA, 25 bp, Mus musculus
ccgcctctccggatgattcgtgaga

SEQ ID NO: 228767 - DNA, 25 bp, Mus musculus
tgattcgtgagataccgagcctgcc

SEQ ID NO: 228768 - DNA, 25 bp, Mus musculus
tttccgtctggtccaaggaagcacg

SEQ ID NO: 228769 - DNA, 25 bp, Mus musculus
aggaagcacgggttatggccacatg

SEQ ID NO: 228770 - DNA, 25 bp, Mus musculus
tggccacatgcgcagtgataactca

SEQ ID NO: 228771 - DNA, 25 bp, Mus musculus
catgcgcagtgataactcagggccc

SEQ ID NO: 228772 - DNA, 25 bp, Mus musculus
atccgcggtccctgtctgttttcgt

SEQ ID NO: 228773 - DNA, 25 bp, Mus musculus
gcgggcaaaccctcagcagccgaga

SEQ ID NO: 228774 - DNA, 25 bp, Mus musculus
cgcagccatatttataccttaagta

SEQ ID NO: 228775 - DNA, 25 bp, Mus musculus
cgcgccgacgcagccatatttatac

SEQ ID NO: 228776 - DNA, 25 bp, Mus musculus
ctagagagacagacccgcgccgacg

SEQ ID NO: 228777 - DNA, 25 bp, Mus musculus
agagcgacgcctagagagacagacc

SEQ ID NO: 228778 - DNA, 25 bp, Mus musculus
gcacaccaagagagcgacgcctaga

SEQ ID NO: 228779 - DNA, 25 bp, Mus musculus
gagcagcgcactgtactcaccaaga

SEQ ID NO: 228780 - DNA, 25 bp, Mus musculus
tcacgccatgctcggctagtgagcc

SEQ ID NO: 228781 - DNA, 25 bp, Mus musculus
gtgacctcacgccatgctcggctag

SEQ ID NO: 228782 - DNA, 25 bp, Mus musculus
tcggaggcgcgtgacctcacgccat

SEQ ID NO: 228783 - DNA, 25 bp, Mus musculus
aagtaacgcccggaagtcaggcgtg

SEQ ID NO: 228784 - DNA, 25 bp, Mus musculus
aagtcaggcgtggtcgactatgcct

SEQ ID NO: 228785 - DNA, 25 bp, Mus musculus
cgtggtcgactatgcctgcgcctgc

SEQ ID NO: 228786 - DNA, 25 bp, Mus musculus
ctcaccaagaacaagcacaccaaga

SEQ ID NO: 228787 - DNA, 25 bp, Mus musculus
gcgactccgtgcactgccacaaaag

SEQ ID NO: 228788 - DNA, 25 bp, Mus musculus
gggcaccttgcccagttctgagcaa

SEQ ID NO: 228789 - DNA, 25 bp, Mus musculus
tataaacggatttgggcaccttgcc

SEQ ID NO: 228790 - DNA, 25 bp, Mus musculus
cggtgcactgcatataaacggattt

SEQ ID NO: 228791 - DNA, 25 bp, Mus musculus
gccagagtccggtgcactgcatata

SEQ ID NO: 228792 - DNA, 25 bp, Mus musculus
tactctgccgatctgggcatgcgcc

SEQ ID NO: 228793 - DNA, 25 bp, Mus musculus
caaaatggcgggaactgccggccct

SEQ ID NO: 228794 - DNA, 25 bp, Mus musculus
gacttgtagtccactgcagtggcca

SEQ ID NO: 228795 - DNA, 25 bp, Mus musculus
tcccggaaatcctacctggtctctg

SEQ ID NO: 228796 - DNA, 25 bp, Mus musculus
gggaacttacccaagtcgccgctgc

SEQ ID NO: 228797 - DNA, 25 bp, Mus musculus
ggaggtgctcactttcccaagtttg

SEQ ID NO: 228798 - DNA, 25 bp, Mus musculus
tagtcgagccgagcctgccgctgct

SEQ ID NO: 228799 - DNA, 25 bp, Mus musculus
gaaaagcggcgcagacaaaagggcc

SEQ ID NO: 228800 - DNA, 25 bp, Mus musculus
ggacacgttcgggaacagactctcc

SEQ ID NO: 228801 - DNA, 25 bp, Mus musculus
tgactcacgtctcccatccataggc

SEQ ID NO: 228802 - DNA, 25 bp, Mus musculus
tgtggcgcgcaaccgcgccagtctg

SEQ ID NO: 228803 - DNA, 25 bp, Mus musculus
tgcagcacctcctgcgcacacgctg

SEQ ID NO: 228804 - DNA, 25 bp, Mus musculus
cggccagagcgatccgggttttcct

SEQ ID NO: 228805 - DNA, 25 bp, Mus musculus
ttctacgggctagggagtggctcca

SEQ ID NO: 228806 - DNA, 25 bp, Mus musculus
taagaacggaaggacagctagtgac

SEQ ID NO: 228807 - DNA, 25 bp, Mus musculus
cctcggctggggcacagtaggccta

SEQ ID NO: 228808 - DNA, 25 bp, Mus musculus
ggcctagctggcaccggctctgaag

SEQ ID NO: 228809 - DNA, 25 bp, Mus musculus
gctctttaataaaaccgcgcaaatg

SEQ ID NO: 228810 - DNA, 25 bp, Mus musculus
cgcgcaaatgcgtctataattattg

SEQ ID NO: 228811 - DNA, 25 bp, Mus musculus
attgagttaaggtttgctctctgta

SEQ ID NO: 228812 - DNA, 25 bp, Mus musculus
ttgctctctgtagggaataccaagc

SEQ ID NO: 228813 - DNA, 25 bp, Mus musculus
tagggaataccaagcataagaacgg

SEQ ID NO: 228814 - DNA, 25 bp, Mus musculus
accctgagggcctgtggcgcgcaac

SEQ ID NO: 228815 - DNA, 25 bp, Mus musculus
cggagacccgcctttgtcaccattg

SEQ ID NO: 228816 - DNA, 25 bp, Mus musculus
acagggcggccacaagcaactccgg

SEQ ID NO: 228817 - DNA, 25 bp, Mus musculus
cacacgtggtcggaggacttaattt

SEQ ID NO: 228818 - DNA, 25 bp, Mus musculus
tttaggatgaaccaaagacgtggca

SEQ ID NO: 228819 - DNA, 25 bp, Mus musculus
gcgacgttcaagttccacgggcata

SEQ ID NO: 228820 - DNA, 25 bp, Mus musculus
cgggcatactttgctgatctcagga

SEQ ID NO: 228821 - DNA, 25 bp, Mus musculus
tctcaggagaccctaactgtggacc

SEQ ID NO: 228822 - DNA, 25 bp, Mus musculus
aggttgcgatctcggcctaccacga

SEQ ID NO: 228823 - DNA, 25 bp, Mus musculus
ctgcgtcccgcaaaggtcacggaga

SEQ ID NO: 228824 - DNA, 25 bp, Mus musculus
agcggcacggaacaaccgggtgaca

SEQ ID NO: 228825 - DNA, 25 bp, Mus musculus
acaggccacggtctgtgaacgctgc

SEQ ID NO: 228826 - DNA, 25 bp, Mus musculus
cccgcgcatcagtcgtttgaatctc

SEQ ID NO: 228827 - DNA, 25 bp, Mus musculus
gcagcccgccatgtaggttgcgatc

SEQ ID NO: 228828 - DNA, 25 bp, Mus musculus
actgtggacccacggaagactcgcc

SEQ ID NO: 228829 - DNA, 25 bp, Mus musculus
agtggagtcccgacctccagaagga

SEQ ID NO: 228830 - DNA, 25 bp, Mus musculus
gaaggaagacaagggcgagaagcgg

SEQ ID NO: 228831 - DNA, 25 bp, Mus musculus
gtcaggtcctggctgctttccggga

SEQ ID NO: 228832 - DNA, 25 bp, Mus musculus
atcgccgagtcaggtcctggctgct

SEQ ID NO: 228833 - DNA, 25 bp, Mus musculus
ctagcgatcgccgagtcaggtcctg

SEQ ID NO: 228834 - DNA, 25 bp, Mus musculus
tccctggctagcgatcgccgagtca

SEQ ID NO: 228835 - DNA, 25 bp, Mus musculus
cagaaggactgctacggaaggcgta

SEQ ID NO: 228836 - DNA, 25 bp, Mus musculus
ctccagaaggactgctacggaaggc

SEQ ID NO: 228837 - DNA, 25 bp, Mus musculus
gtcccgacctccagaaggactgcta

SEQ ID NO: 228838 - DNA, 25 bp, Mus musculus
tccgggagtggagtcccgacctcca

SEQ ID NO: 228839 - DNA, 25 bp, Mus musculus
ctgcacccgagatcagcaggggtgt

SEQ ID NO: 228840 - DNA, 25 bp, Mus musculus
cctggcctcctcctgcacccgagat

SEQ ID NO: 228841 - DNA, 25 bp, Mus musculus
cggggtcccacagtcctggcctcct

SEQ ID NO: 228842 - DNA, 25 bp, Mus musculus
cgacctccagaaggactgctacgga

SEQ ID NO: 228843 - DNA, 25 bp, Mus musculus
cagccgggacacgtgtgcacttaca

SEQ ID NO: 228844 - DNA, 25 bp, Mus musculus
gtgcaagagcgcacgcgcaaggttc

SEQ ID NO: 228845 - DNA, 25 bp, Mus musculus
cgccttctggcaccggtgtgcaaga

SEQ ID NO: 228846 - DNA, 25 bp, Mus musculus
agagggcaaggaacgcgcccgcctt

SEQ ID NO: 228847 - DNA, 25 bp, Mus musculus
acttccggtaggaagctgagggaca

SEQ ID NO: 228848 - DNA, 25 bp, Mus musculus
tctcccttcagcacttccggtagga

SEQ ID NO: 228849 - DNA, 25 bp, Mus musculus
gccgccagcgcagagccagagaaac

SEQ ID NO: 228850 - DNA, 25 bp, Mus musculus
caaatgccgccagcgcagagccaga

SEQ ID NO: 228851 - DNA, 25 bp, Mus musculus
cacgcgtgcacacccgcaatccgca

SEQ ID NO: 228852 - DNA, 25 bp, Mus musculus
ctggaattaaatccacgcgtgcaca

SEQ ID NO: 228853 - DNA, 25 bp, Mus musculus
tccttgtaaagctggaattaaatcc

SEQ ID NO: 228854 - DNA, 25 bp, Mus musculus
ccgcgctacagatccttgtaaagct

SEQ ID NO: 228855 - DNA, 25 bp, Mus musculus
tgtgcacttacactagcaacacgtc

SEQ ID NO: 228856 - DNA, 25 bp, Mus musculus
acttacactagcaacacgtctccgt

SEQ ID NO: 228857 - DNA, 25 bp, Mus musculus
tgattggccattccgccctccggta

SEQ ID NO: 228858 - DNA, 25 bp, Mus musculus
gaggcgtggtcttttcgtgacgaac

SEQ ID NO: 228859 - DNA, 25 bp, Mus musculus
ttttcgtgacgaaccaatgggatcg

SEQ ID NO: 228860 - DNA, 25 bp, Mus musculus
aaccaatgggatcgggagcactgcc

SEQ ID NO: 228861 - DNA, 25 bp, Mus musculus
ggagctcaggatcagggcgctgatt

SEQ ID NO: 228862 - DNA, 25 bp, Mus musculus
acgcgcggtctggacgaccacagcg

SEQ ID NO: 228863 - DNA, 25 bp, Mus musculus
ttccgccctccggtatgcagatgcg

SEQ ID NO: 228864 - DNA, 25 bp, Mus musculus
gccggtacgacttcctgttggaggc

SEQ ID NO: 228865 - DNA, 25 bp, Mus musculus
acgacttcctgttggaggcccacgc

SEQ ID NO: 228866 - DNA, 25 bp, Mus musculus
ggggttcttgtcagttagagcaaca

SEQ ID NO: 228867 - DNA, 25 bp, Mus musculus
ttagagcaacaagatggccgcggtg

SEQ ID NO: 228868 - DNA, 25 bp, Mus musculus
cgcggcccgccgagacttaggagca

SEQ ID NO: 228869 - DNA, 25 bp, Mus musculus
gcggccgagagcgacctctccaccg

SEQ ID NO: 228870 - DNA, 25 bp, Mus musculus
tggcagctccgcacctcagcgcgac

SEQ ID NO: 228871 - DNA, 25 bp, Mus musculus
gagcgcaccagacttagaccgggtc

SEQ ID NO: 228872 - DNA, 25 bp, Mus musculus
cttagaccgggtctgcccgaagctc

SEQ ID NO: 228873 - DNA, 25 bp, Mus musculus
tgaacggcaggtagcccttgatctc

SEQ ID NO: 228874 - DNA, 25 bp, Mus musculus
tccgtccaatcagcatcgacaagcg

SEQ ID NO: 228875 - DNA, 25 bp, Mus musculus
ggcgcagccaatcagatgcctgttt

SEQ ID NO: 228876 - DNA, 25 bp, Mus musculus
ggacacaaaagtcccacggcgcagc

SEQ ID NO: 228877 - DNA, 25 bp, Mus musculus
cggagtccgctacgatcatggtgta

SEQ ID NO: 228878 - DNA, 25 bp, Mus musculus
ggctgttgcttacctctcgggtctc

SEQ ID NO: 228879 - DNA, 25 bp, Mus musculus
ccagcttggaaaactgcggccggcc

SEQ ID NO: 228880 - DNA, 25 bp, Mus musculus
ccttgatctcggaatggcactcgga

SEQ ID NO: 228881 - DNA, 25 bp, Mus musculus
acgatcatggtgtacgccaggaccc

SEQ ID NO: 228882 - DNA, 25 bp, Mus musculus
gctgtctctcgggattaggagaacc

SEQ ID NO: 228883 - DNA, 25 bp, Mus musculus
gcgctacggcgatagacactccttt

SEQ ID NO: 228884 - DNA, 25 bp, Mus musculus
gacactcctttcagcccagcttgga

SEQ ID NO: 228885 - DNA, 25 bp, Mus musculus
agggcggctgaactgccaatctaga

SEQ ID NO: 228886 - DNA, 25 bp, Mus musculus
ggctgcttctctcctagcgcgctaa

SEQ ID NO: 228887 - DNA, 25 bp, Mus musculus
cgatcctcttcagccttttctcgtt

SEQ ID NO: 228888 - DNA, 25 bp, Mus musculus
gcacaacaagggagagagaacctgc

SEQ ID NO: 228889 - DNA, 25 bp, Mus musculus
aacgccgagcctgccattgtcttcg

SEQ ID NO: 228890 - DNA, 25 bp, Mus musculus
aagcctcgggtttgcaggaccttca

SEQ ID NO: 228891 - DNA, 25 bp, Mus musculus
gccacctaccgagtccgagacgaag

SEQ ID NO: 228892 - DNA, 25 bp, Mus musculus
attgtcttcggcgttgctcagctcg

SEQ ID NO: 228893 - DNA, 25 bp, Mus musculus
gtcgtggacgtgaaaagaaaaggca

SEQ ID NO: 228894 - DNA, 25 bp, Mus musculus
atgctatccgactgcaaagagagtc

SEQ ID NO: 228895 - DNA, 25 bp, Mus musculus
gagccagcgcccgtatccatgctat

SEQ ID NO: 228896 - DNA, 25 bp, Mus musculus
tcgttttccgaaggctccaccagct

SEQ ID NO: 228897 - DNA, 25 bp, Mus musculus
actgccaatctagacgccggggagg

SEQ ID NO: 228898 - DNA, 25 bp, Mus musculus
tccaccagcttctcggatggagcca

SEQ ID NO: 228899 - DNA, 25 bp, Mus musculus
ctacagtgaggtgagcccggagtaa

SEQ ID NO: 228900 - DNA, 25 bp, Mus musculus
gaggcatttatgaccttctacagtg

SEQ ID NO: 228901 - DNA, 25 bp, Mus musculus
cagcacagaggaggcatttatgacc

SEQ ID NO: 228902 - DNA, 25 bp, Mus musculus
gaaaatggcggcttcgggagagagt

SEQ ID NO: 228903 - DNA, 25 bp, Mus musculus
cagaacggtcacgtggtggttagcc

SEQ ID NO: 228904 - DNA, 25 bp, Mus musculus
cgcttgcgcagaacggtcacgtggt

SEQ ID NO: 228905 - DNA, 25 bp, Mus musculus
tgcgcgaccgccactgtggctactg

SEQ ID NO: 228906 - DNA, 25 bp, Mus musculus
ctgcggagtgcatgcgcgaccgcca

SEQ ID NO: 228907 - DNA, 25 bp, Mus musculus
aggacgaccgtgctccggcttcgtc

SEQ ID NO: 228908 - DNA, 25 bp, Mus musculus
gcccggagtaaggatggtggcctta

SEQ ID NO: 228909 - DNA, 25 bp, Mus musculus
ccttctacagtgaggtgagcccgga

SEQ ID NO: 228910 - DNA, 25 bp, Mus musculus
ctgggcctgtggacccagacccgga

SEQ ID NO: 228911 - DNA, 25 bp, Mus musculus
atggtggccttaggacgaccgtgct

SEQ ID NO: 228912 - DNA, 25 bp, Mus musculus
gaccgccactgtggctactgaggtc

SEQ ID NO: 228913 - DNA, 25 bp, Mus musculus
gtcccgcatctacttccggtggcta

SEQ ID NO: 228914 - DNA, 25 bp, Mus musculus
ctggtcctctgggttctgtcggaac

SEQ ID NO: 228915 - DNA, 25 bp, Mus musculus
ggtttccgccactctgttggttcca

SEQ ID NO: 228916 - DNA, 25 bp, Mus musculus
ccgtaatcgtcccatgtcgtgctgg

SEQ ID NO: 228917 - DNA, 25 bp, Mus musculus
tgtggattgttaggcggtcccgcat

SEQ ID NO: 228918 - DNA, 25 bp, Mus musculus
tgaagaggtcctccttggtcgtgct

SEQ ID NO: 228919 - DNA, 25 bp, Mus musculus
cccgagacgattgactggtcctctg

SEQ ID NO: 228920 - DNA, 25 bp, Mus musculus
agggagtcaatcacgcaactgggtc

SEQ ID NO: 228921 - DNA, 25 bp, Mus musculus
ctcgtgcgtaagatccagggagtca

SEQ ID NO: 228922 - DNA, 25 bp, Mus musculus
tcctcggaaagtcatctcgtgcgta

SEQ ID NO: 228923 - DNA, 25 bp, Mus musculus
gcggcaatttagcagcaccagcatc

SEQ ID NO: 228924 - DNA, 25 bp, Mus musculus
agtacttttcacgaaggcggcggca

SEQ ID NO: 228925 - DNA, 25 bp, Mus musculus
tccagagtgggtccgtaatcgtccc

SEQ ID NO: 228926 - DNA, 25 bp, Mus musculus
atgcgcatccgggtcacgctaacgc

SEQ ID NO: 228927 - DNA, 25 bp, Mus musculus
gttctcatttgtgtcctggccagga

SEQ ID NO: 228928 - DNA, 25 bp, Mus musculus
tttgtggcgccagtgcaaagtagcc

SEQ ID NO: 228929 - DNA, 25 bp, Mus musculus
gtagccagaaggctgccacgccaga

SEQ ID NO: 228930 - DNA, 25 bp, Mus musculus
tgccacgccagagcggcacagagtt

SEQ ID NO: 228931 - DNA, 25 bp, Mus musculus
gcacagagttcccaagtgttcttag

SEQ ID NO: 228932 - DNA, 25 bp, Mus musculus
ttcttagttttcgtgtccgagcgtc

SEQ ID NO: 228933 - DNA, 25 bp, Mus musculus
ctctctccggagaactgcgaccagg

SEQ ID NO: 228934 - DNA, 25 bp, Mus musculus
ctgcgaccaggatgtggaatagtaa

SEQ ID NO: 228935 - DNA, 25 bp, Mus musculus
acagcggtcgccaggtatagagatg

SEQ ID NO: 228936 - DNA, 25 bp, Mus musculus
agcgcagactctgacgacggtcgtt

SEQ ID NO: 228937 - DNA, 25 bp, Mus musculus
cgcaggcggattcgaaagcttcagc

SEQ ID NO: 228938 - DNA, 25 bp, Mus musculus
cagcagctccacctatggcggagca

SEQ ID NO: 228939 - DNA, 25 bp, Mus musculus
ggtacgtagactgacggctccgttc

SEQ ID NO: 228940 - DNA, 25 bp, Mus musculus
tcgcaggcggagaagaaatcggtac

SEQ ID NO: 228941 - DNA, 25 bp, Mus musculus
gggtccaggccgctcacaaagtcct

SEQ ID NO: 228942 - DNA, 25 bp, Mus musculus
ccctcaggtcgggagccctacaggg

SEQ ID NO: 228943 - DNA, 25 bp, Mus musculus
aggccgctcacaaagtcctgcagcg

SEQ ID NO: 228944 - DNA, 25 bp, Mus musculus
acaaagtcctgcagcggcaccggct

SEQ ID NO: 228945 - DNA, 25 bp, Mus musculus
ggcaccggctccatggtcgcgttcc

SEQ ID NO: 228946 - DNA, 25 bp, Mus musculus
gtcgcgttccgactagatttgctca

SEQ ID NO: 228947 - DNA, 25 bp, Mus musculus
gagcagacccgcagcacgcgcggaa

SEQ ID NO: 228948 - DNA, 25 bp, Mus musculus
ttccgactagatttgctcagactga

SEQ ID NO: 228949 - DNA, 25 bp, Mus musculus
ctagatttgctcagactgatcggca

SEQ ID NO: 228950 - DNA, 25 bp, Mus musculus
ttgctcagactgatcggcagcttgc

SEQ ID NO: 228951 - DNA, 25 bp, Mus musculus
cttgcagaggacagtccggaagcca

SEQ ID NO: 228952 - DNA, 25 bp, Mus musculus
gaggacagtccggaagccacgccca

SEQ ID NO: 228953 - DNA, 25 bp, Mus musculus
tcgggagccctacagggttctctga

SEQ ID NO: 228954 - DNA, 25 bp, Mus musculus
gccctacagggttctctgaagcgcc

SEQ ID NO: 228955 - DNA, 25 bp, Mus musculus
ctgggtttgaagtctgcagtgtttg

SEQ ID NO: 228956 - DNA, 25 bp, Mus musculus
agccggagttcacggctgccgccat

SEQ ID NO: 228957 - DNA, 25 bp, Mus musculus
cccatttggcgggtctgaagcacgc

SEQ ID NO: 228958 - DNA, 25 bp, Mus musculus
cgggtctgaagcacgccgggaaact

SEQ ID NO: 228959 - DNA, 25 bp, Mus musculus
agcacgccgggaaactaagagctcg

SEQ ID NO: 228960 - DNA, 25 bp, Mus musculus
aagaggcggcatcccagcagcctgt

SEQ ID NO: 228961 - DNA, 25 bp, Mus musculus
cgtgcgtgcgcacgcgcaacgcaag

SEQ ID NO: 228962 - DNA, 25 bp, Mus musculus
ggacgctctcctgggagcgcctctg

SEQ ID NO: 228963 - DNA, 25 bp, Mus musculus
tgaagtctgcagtgtttgctggaga

SEQ ID NO: 228964 - DNA, 25 bp, Mus musculus
tgtctccttggtcacggggtcagga

SEQ ID NO: 228965 - DNA, 25 bp, Mus musculus
tcaggagtggtttgtaccttgatgc

SEQ ID NO: 228966 - DNA, 25 bp, Mus musculus
tggtttgtaccttgatgcggctttc

SEQ ID NO: 228967 - DNA, 25 bp, Mus musculus
ttgtaccttgatgcggctttcgcgc

SEQ ID NO: 228968 - DNA, 25 bp, Mus musculus
gcaacgcaaggacgctctcctggga

SEQ ID NO: 228969 - DNA, 25 bp, Mus musculus
ctaagggaccgtaggacatgacagt

SEQ ID NO: 228970 - DNA, 25 bp, Mus musculus
agacccgactcctccagctgtgaag

SEQ ID NO: 228971 - DNA, 25 bp, Mus musculus
cccggggttccgatacatgtctaag

SEQ ID NO: 228972 - DNA, 25 bp, Mus musculus
atccgctggatgttgccactgcatg

SEQ ID NO: 228973 - DNA, 25 bp, Mus musculus
ccggacttcttcagcctgtcgtcta

SEQ ID NO: 228974 - DNA, 25 bp, Mus musculus
catgacagtgagcagagaccgggtc

SEQ ID NO: 228975 - DNA, 25 bp, Mus musculus
gctgtgaagccagtacaggaccgga

SEQ ID NO: 228976 - DNA, 25 bp, Mus musculus
gtctggatgatgctgttgaagtccc

SEQ ID NO: 228977 - DNA, 25 bp, Mus musculus
cggtgggtcgtctcttgagagtttt

SEQ ID NO: 228978 - DNA, 25 bp, Mus musculus
agagttttcgaactgctggcggtga

SEQ ID NO: 228979 - DNA, 25 bp, Mus musculus
gacttggcagcttcaccaccgtctg

SEQ ID NO: 228980 - DNA, 25 bp, Mus musculus
gcccagcagctgagaggaaaaccgg

SEQ ID NO: 228981 - DNA, 25 bp, Mus musculus
acggcctcaaggtgtggcctgagct

SEQ ID NO: 228982 - DNA, 25 bp, Mus musculus
tgagcgttctcgcaagacccgactc

SEQ ID NO: 228983 - DNA, 25 bp, Mus musculus
gcgtcactaagtgcttttgcgagca

SEQ ID NO: 228984 - DNA, 25 bp, Mus musculus
tgcgagcacccggttctatagaaaa

SEQ ID NO: 228985 - DNA, 25 bp, Mus musculus
tatagaaaaccgaccgccttggatc

SEQ ID NO: 228986 - DNA, 25 bp, Mus musculus
gggttcgaactttccagctcctctg

SEQ ID NO: 228987 - DNA, 25 bp, Mus musculus
cacagctgccgggttcgaactttcc

SEQ ID NO: 228988 - DNA, 25 bp, Mus musculus
cgccttggatccttgtgtattctca

SEQ ID NO: 228989 - DNA, 25 bp, Mus musculus
gtgtattctcaaaatctctcctaag

SEQ ID NO: 228990 - DNA, 25 bp, Mus musculus
tctctcctaagaagtctttggtgga

SEQ ID NO: 228991 - DNA, 25 bp, Mus musculus
ctttggtggaaagatgcctcttccc

SEQ ID NO: 228992 - DNA, 25 bp, Mus musculus
tgcggcttccctggttgcctcggtt

SEQ ID NO: 228993 - DNA, 25 bp, Mus musculus
cgcgcgctgagagtcgcgtcactaa

SEQ ID NO: 228994 - DNA, 25 bp, Mus musculus
tgctcaccggcgtaagctgcggctt

SEQ ID NO: 228995 - DNA, 25 bp, Mus musculus
aactaccctggcgttggcgacctag

SEQ ID NO: 228996 - DNA, 25 bp, Mus musculus
ggctcgaattcctcgcagcaagcgc

SEQ ID NO: 228997 - DNA, 25 bp, Mus musculus
gttggactacgccactgtgacgctc

SEQ ID NO: 228998 - DNA, 25 bp, Mus musculus
ctcggggccgcgattatgtaaagcg

SEQ ID NO: 228999 - DNA, 25 bp, Mus musculus
gtcgggcaacgtcggattcgaacta

SEQ ID NO: 229000 - DNA, 25 bp, Mus musculus
tggagcttcccgctagccgaaggag

SEQ ID NO: 229001 - DNA, 25 bp, Mus musculus
tctcgcgatactcgatgaagttgtg

SEQ ID NO: 229002 - DNA, 25 bp, Mus musculus
gggagcattggagcttctcgcgata

SEQ ID NO: 229003 - DNA, 25 bp, Mus musculus
tccgagtaggatagcggaagccctc

SEQ ID NO: 229004 - DNA, 25 bp, Mus musculus
ttgctaagcaccaggacacgccggc

SEQ ID NO: 229005 - DNA, 25 bp, Mus musculus
ctctgattcggtccgggttggacta

SEQ ID NO: 229006 - DNA, 25 bp, Mus musculus
cgccgctttatctgacagtctcagg

SEQ ID NO: 229007 - DNA, 25 bp, Mus musculus
ctcgctggaccgagagttccgaacc

SEQ ID NO: 229008 - DNA, 25 bp, Mus musculus
cggctcagctcgtccgcaaaacggg

SEQ ID NO: 229009 - DNA, 25 bp, Mus musculus
ggggctcccacaagtaccctgcagt

SEQ ID NO: 229010 - DNA, 25 bp, Mus musculus
ggcgccgcctgaaaagagcgtcttc

SEQ ID NO: 229011 - DNA, 25 bp, Mus musculus
cgcgggtgttgcactacttccaact

SEQ ID NO: 229012 - DNA, 25 bp, Mus musculus
ctgggccaccttgacggagagcgca

SEQ ID NO: 229013 - DNA, 25 bp, Mus musculus
tcttctccgagtcactggtctgggc

SEQ ID NO: 229014 - DNA, 25 bp, Mus musculus
cgtccaaatgtatcttctccgagtc

SEQ ID NO: 229015 - DNA, 25 bp, Mus musculus
cggaaggccttctcgtccaaatgta

SEQ ID NO: 229016 - DNA, 25 bp, Mus musculus
gttgtacagccaacggaaggccttc

SEQ ID NO: 229017 - DNA, 25 bp, Mus musculus
agccatttggtcctcgttgtacagc

SEQ ID NO: 229018 - DNA, 25 bp, Mus musculus
tgccatcgaagagcttctccacagc

SEQ ID NO: 229019 - DNA, 25 bp, Mus musculus
tgcggatgccatcgaagagcttctc

SEQ ID NO: 229020 - DNA, 25 bp, Mus musculus
acggcatcagcagcaaatttgcgga

SEQ ID NO: 229021 - DNA, 25 bp, Mus musculus
atctgctccaaccttacggcatcag

SEQ ID NO: 229022 - DNA, 25 bp, Mus musculus
attcgttccgtgaacatctgctcca

SEQ ID NO: 229023 - DNA, 25 bp, Mus musculus
gcgctgaacattcgttccgtgaaca

SEQ ID NO: 229024 - DNA, 25 bp, Mus musculus
tacttccaactctcagcgctgaaca

SEQ ID NO: 229025 - DNA, 25 bp, Mus musculus
gagcagtcaatcacttgactcctgc

SEQ ID NO: 229026 - DNA, 25 bp, Mus musculus
gcctgcgctgcagtggagcactgca

SEQ ID NO: 229027 - DNA, 25 bp, Mus musculus
ccgcctgcgctgcagtggagcactg

SEQ ID NO: 229028 - DNA, 25 bp, Mus musculus
gcaacccggactggcacccggcacg

SEQ ID NO: 229029 - DNA, 25 bp, Mus musculus
cgcctagggaagttttctggagctc

SEQ ID NO: 229030 - DNA, 25 bp, Mus musculus
ttcgcctagggaagttttctggagc

SEQ ID NO: 229031 - DNA, 25 bp, Mus musculus
tgccttcgcctagggaagttttctg

SEQ ID NO: 229032 - DNA, 25 bp, Mus musculus
ctgccttcgcctagggaagttttct

SEQ ID NO: 229033 - DNA, 25 bp, Mus musculus
ttgactcctgcaagatcgccctcca

SEQ ID NO: 229034 - DNA, 25 bp, Mus musculus
gaaagagcagtcaatcacttgactc

SEQ ID NO: 229035 - DNA, 25 bp, Mus musculus
cggaaagagcagtcaatcacttgac

SEQ ID NO: 229036 - DNA, 25 bp, Mus musculus
gacggaaagagcagtcaatcacttg

SEQ ID NO: 229037 - DNA, 25 bp, Mus musculus
cgcgacggaaagagcagtcaatcac

SEQ ID NO: 229038 - DNA, 25 bp, Mus musculus
ctgcaagatcgccctccagaaggca

SEQ ID NO: 229039 - DNA, 25 bp, Mus musculus
attcatccgggccagggatactccg

SEQ ID NO: 229040 - DNA, 25 bp, Mus musculus
cggaatgttcctaacccttgaggag

SEQ ID NO: 229041 - DNA, 25 bp, Mus musculus
gcgagccatgctgtcagcgacggca

SEQ ID NO: 229042 - DNA, 25 bp, Mus musculus
gtcctagataaaacgggattcatcc

SEQ ID NO: 229043 - DNA, 25 bp, Mus musculus
ctgccgccggcggaagatagacgcc

SEQ ID NO: 229044 - DNA, 25 bp, Mus musculus
atactccggcatagggtccgctccg

SEQ ID NO: 229045 - DNA, 25 bp, Mus musculus
agcggccgaacagggactacaagtc

SEQ ID NO: 229046 - DNA, 25 bp, Mus musculus
agcgagcgaggcagaccagacagac

SEQ ID NO: 229047 - DNA, 25 bp, Mus musculus
gagagggaatccagctaccaccacc

SEQ ID NO: 229048 - DNA, 25 bp, Mus musculus
agcgtctgctttctgtcctcatttc

SEQ ID NO: 229049 - DNA, 25 bp, Mus musculus
ccacccagctcggagagcagagaaa

SEQ ID NO: 229050 - DNA, 25 bp, Mus musculus
ggcgtcttccctcccaggtttgcaa

SEQ ID NO: 229051 - DNA, 25 bp, Mus musculus
cgcagatagcgaaggagtaatcgtg

SEQ ID NO: 229052 - DNA, 25 bp, Mus musculus
cccttgaggaggatcagcagtccta

SEQ ID NO: 229053 - DNA, 25 bp, Mus musculus
agccaccagccgcaatcaggcggtg

SEQ ID NO: 229054 - DNA, 25 bp, Mus musculus
aggcggtgttagcaattctgccgct

SEQ ID NO: 229055 - DNA, 25 bp, Mus musculus
gctcgaccggccgagcaagcgagtc

SEQ ID NO: 229056 - DNA, 25 bp, Mus musculus
caggaaaaagccgaaaacagcgcgg

SEQ ID NO: 229057 - DNA, 25 bp, Mus musculus
gcccgcatgtggctctccttcgggg

SEQ ID NO: 229058 - DNA, 25 bp, Mus musculus
tctccttcggggagccttggcagcc

SEQ ID NO: 229059 - DNA, 25 bp, Mus musculus
gagagcttctggaatttcctgcagc

SEQ ID NO: 229060 - DNA, 25 bp, Mus musculus
gcttctggaatttcctgcagctgga

SEQ ID NO: 229061 - DNA, 25 bp, Mus musculus
tccgccggagtcagaagccctgcgg

SEQ ID NO: 229062 - DNA, 25 bp, Mus musculus
cggcggcaaaactccggagcggctt

SEQ ID NO: 229063 - DNA, 25 bp, Mus musculus
cgcaatcaggcggtgttagcaattc

SEQ ID NO: 229064 - DNA, 25 bp, Mus musculus
cgaggcgtcgaagggcttcctctct

SEQ ID NO: 229065 - DNA, 25 bp, Mus musculus
agcggcttctttcggccggcagacc

SEQ ID NO: 229066 - DNA, 25 bp, Mus musculus
gcaaaactccggagcggcttctttc

SEQ ID NO: 229067 - DNA, 25 bp, Mus musculus
agtacagcttcttctcttcgcccag

SEQ ID NO: 229068 - DNA, 25 bp, Mus musculus
ggcgtgtgaacctgcgtccagtagt

SEQ ID NO: 229069 - DNA, 25 bp, Mus musculus
ccttgccaagggagacgacctgcta

SEQ ID NO: 229070 - DNA, 25 bp, Mus musculus
acccggcgacttgcagtacagcttc

SEQ ID NO: 229071 - DNA, 25 bp, Mus musculus
acctgcagcacagcggtgtgcatct

SEQ ID NO: 229072 - DNA, 25 bp, Mus musculus
cccattgtccctcaccggctccaga

SEQ ID NO: 229073 - DNA, 25 bp, Mus musculus
tccgccactgggacaacgggcgtgt

SEQ ID NO: 229074 - DNA, 25 bp, Mus musculus
ggagacgacctgctacctcctcggg

SEQ ID NO: 229075 - DNA, 25 bp, Mus musculus
cgtccagtagtgcagctgattgaca

SEQ ID NO: 229076 - DNA, 25 bp, Mus musculus
tgcagctgattgacatcatgaagga

SEQ ID NO: 229077 - DNA, 25 bp, Mus musculus
tcatgaaggacttgacaaggctgtc

SEQ ID NO: 229078 - DNA, 25 bp, Mus musculus
cttgacaaggctgtcgcaggacctg

SEQ ID NO: 229079 - DNA, 25 bp, Mus musculus
gtcgcaggacctgcagcacagcggt

SEQ ID NO: 229080 - DNA, 25 bp, Mus musculus
cgtccaccagtccttgccaagggag

SEQ ID NO: 229081 - DNA, 25 bp, Mus musculus
tccagccaggcccaatgatgacagc

SEQ ID NO: 229082 - DNA, 25 bp, Mus musculus
tgagcccttggtcccgggacgctat

SEQ ID NO: 229083 - DNA, 25 bp, Mus musculus
tttccctccttgaggtccagccagg

SEQ ID NO: 229084 - DNA, 25 bp, Mus musculus
tcatctttccctccttgaggtccag

SEQ ID NO: 229085 - DNA, 25 bp, Mus musculus
gaggtccagccaggcccaatgatga

SEQ ID NO: 229086 - DNA, 25 bp, Mus musculus
cccacgcgctcctctcagatcctga

SEQ ID NO: 229087 - DNA, 25 bp, Mus musculus
tccagcttccctcgtcactcggtcg

SEQ ID NO: 229088 - DNA, 25 bp, Mus musculus
taatggatggccacgggcactgccc

SEQ ID NO: 229089 - DNA, 25 bp, Mus musculus
gcatactaatggatggccacgggca

SEQ ID NO: 229090 - DNA, 25 bp, Mus musculus
cgccaccacctgtgggaggagaggt

SEQ ID NO: 229091 - DNA, 25 bp, Mus musculus
ttggtcccgggacgctatcgcctca

SEQ ID NO: 229092 - DNA, 25 bp, Mus musculus
agcctggtcctgcggggctacctgc

SEQ ID NO: 229093 - DNA, 25 bp, Mus musculus
ggagcgcggccgcatactaatggat

SEQ ID NO: 229094 - DNA, 25 bp, Mus musculus
agatcctgagcccttggtcccggga

SEQ ID NO: 229095 - DNA, 25 bp, Mus musculus
atttaattggcattggattcagacc

SEQ ID NO: 229096 - DNA, 25 bp, Mus musculus
cgaggtcaggtgagcaacaagtccc

SEQ ID NO: 229097 - DNA, 25 bp, Mus musculus
ttcatgtcgctgagggcgactgcgc

SEQ ID NO: 229098 - DNA, 25 bp, Mus musculus
tgcccagcccttcatgtcgctgagg

SEQ ID NO: 229099 - DNA, 25 bp, Mus musculus
ccggctgagtagcagcccgcgaagc

SEQ ID NO: 229100 - DNA, 25 bp, Mus musculus
aaatcgcgtaatggcggactcaggc

SEQ ID NO: 229101 - DNA, 25 bp, Mus musculus
tggattcagaccaatgggatagctg

SEQ ID NO: 229102 - DNA, 25 bp, Mus musculus
cgtcttttgcgtacttatttaattg

SEQ ID NO: 229103 - DNA, 25 bp, Mus musculus
actacctttgaatacgtcttttgcg

SEQ ID NO: 229104 - DNA, 25 bp, Mus musculus
cgggacactacctttgaatacgtct

SEQ ID NO: 229105 - DNA, 25 bp, Mus musculus
ctccgattgcggaagtcgctcgggt

SEQ ID NO: 229106 - DNA, 25 bp, Mus musculus
cgcctctgtttactccgattgcgga

SEQ ID NO: 229107 - DNA, 25 bp, Mus musculus
gcaccgggtgtctgctctgacggtc

SEQ ID NO: 229108 - DNA, 25 bp, Mus musculus
cagggagccaatcagaacggttggc

SEQ ID NO: 229109 - DNA, 25 bp, Mus musculus
ctcccgcgcggcctgtgtttagtca

SEQ ID NO: 229110 - DNA, 25 bp, Mus musculus
gttcacagagtcacccacgggcatc

SEQ ID NO: 229111 - DNA, 25 bp, Mus musculus
cagagtcacccacgggcatcgcggg

SEQ ID NO: 229112 - DNA, 25 bp, Mus musculus
gggcagaagtttttgaattgtcagc

SEQ ID NO: 229113 - DNA, 25 bp, Mus musculus
ttgaattgtcagcaagtgctgcgcc

SEQ ID NO: 229114 - DNA, 25 bp, Mus musculus
actctgagctcatcgctggaggtgg

SEQ ID NO: 229115 - DNA, 25 bp, Mus musculus
tgctgttcacagagtcacccacggg

SEQ ID NO: 229116 - DNA, 25 bp, Mus musculus
aaatggtgtcggagccgcccttgga

SEQ ID NO: 229117 - DNA, 25 bp, Mus musculus
cgcggcctgtgtttagtcagcactt

SEQ ID NO: 229118 - DNA, 25 bp, Mus musculus
tgtttagtcagcacttggccgccag

SEQ ID NO: 229119 - DNA, 25 bp, Mus musculus
ccgccagagctggtgactgacaggc

SEQ ID NO: 229120 - DNA, 25 bp, Mus musculus
ccctggcagaagacaaaatggtgtc

SEQ ID NO: 229121 - DNA, 25 bp, Mus musculus
gacaaaatggtgtcggagccgccct

SEQ ID NO: 229122 - DNA, 25 bp, Mus musculus
agccactctgagctcatcgctggag

SEQ ID NO: 229123 - DNA, 25 bp, Mus musculus
ctcaggttctggcagagcaaggtgt

SEQ ID NO: 229124 - DNA, 25 bp, Mus musculus
gtacccgcggcagggcccactactc

SEQ ID NO: 229125 - DNA, 25 bp, Mus musculus
actactcaccggtggctcaggaccg

SEQ ID NO: 229126 - DNA, 25 bp, Mus musculus
cgcctccactcaggttctggcagag

SEQ ID NO: 229127 - DNA, 25 bp, Mus musculus
aaggtgtgcgcggaccccaagaagc

SEQ ID NO: 229128 - DNA, 25 bp, Mus musculus
tttggtgacgccagaagcccagcag

SEQ ID NO: 229129 - DNA, 25 bp, Mus musculus
acgccagaagcccagcaggccaatg

SEQ ID NO: 229130 - DNA, 25 bp, Mus musculus
cagaagcccagcaggccaatgggcg

SEQ ID NO: 229131 - DNA, 25 bp, Mus musculus
ctgcgcggcatagtaatgaggcctc

SEQ ID NO: 229132 - DNA, 25 bp, Mus musculus
gcatagtaatgaggcctcgcgccgc

SEQ ID NO: 229133 - DNA, 25 bp, Mus musculus
cccattcataaaaagtgaccgtggc

SEQ ID NO: 229134 - DNA, 25 bp, Mus musculus
cataaaaagtgaccgtggccgcggc

SEQ ID NO: 229135 - DNA, 25 bp, Mus musculus
tgtgtcctcccagactccgggtacc

SEQ ID NO: 229136 - DNA, 25 bp, Mus musculus
ggccaccggtttggtgacgccagaa

SEQ ID NO: 229137 - DNA, 25 bp, Mus musculus
cgccttaaatcgcacagcagagcgg

SEQ ID NO: 229138 - DNA, 25 bp, Mus musculus
cgccacaccagctgtccgccgaccc

SEQ ID NO: 229139 - DNA, 25 bp, Mus musculus
gaaaggacgcgccacaccagctgtc

SEQ ID NO: 229140 - DNA, 25 bp, Mus musculus
tagtcaagaaaggacgcgccacacc

SEQ ID NO: 229141 - DNA, 25 bp, Mus musculus
agtgtagtcaagaaaggacgcgcca

SEQ ID NO: 229142 - DNA, 25 bp, Mus musculus
ctagccgggcgagtgtagtcaagaa

SEQ ID NO: 229143 - DNA, 25 bp, Mus musculus
cccaggtttggctctggctagccgg

SEQ ID NO: 229144 - DNA, 25 bp, Mus musculus
cgctgcccaggtttggctctggcta

SEQ ID NO: 229145 - DNA, 25 bp, Mus musculus
gcccacaaggcaaccacgctccagc

SEQ ID NO: 229146 - DNA, 25 bp, Mus musculus
tcccagaggtctcggcctctagcca

SEQ ID NO: 229147 - DNA, 25 bp, Mus musculus
agagcggggctctacctggaccctc

SEQ ID NO: 229148 - DNA, 25 bp, Mus musculus
agcagagcggggctctacctggacc

SEQ ID NO: 229149 - DNA, 25 bp, Mus musculus
gcgccttgcgtgctgctctctgcgg

SEQ ID NO: 229150 - DNA, 25 bp, Mus musculus
ttaaatcgcacagcagagcggggct

SEQ ID NO: 229151 - DNA, 25 bp, Mus musculus
ctaccctttgcgacgctggcgctag

SEQ ID NO: 229152 - DNA, 25 bp, Mus musculus
cggaacaggacgtccagcccatctc

SEQ ID NO: 229153 - DNA, 25 bp, Mus musculus
tggatccacaccttcagcctcgtgc

SEQ ID NO: 229154 - DNA, 25 bp, Mus musculus
gagccggcctctcagtgtggtctac

SEQ ID NO: 229155 - DNA, 25 bp, Mus musculus
cctctcagtgtggtctacgtgctga

SEQ ID NO: 229156 - DNA, 25 bp, Mus musculus
tggtctacgtgctgacccgggagcc

SEQ ID NO: 229157 - DNA, 25 bp, Mus musculus
agccgctgccgttgcgatgcctgcg

SEQ ID NO: 229158 - DNA, 25 bp, Mus musculus
tcagctccagggcacacggccaccc

SEQ ID NO: 229159 - DNA, 25 bp, Mus musculus
tggcgctaggcgacaccgctgcgct

SEQ ID NO: 229160 - DNA, 25 bp, Mus musculus
gctgcgctggactccttctacaacg

SEQ ID NO: 229161 - DNA, 25 bp, Mus musculus
tggactccttctacaacgcgggtga

SEQ ID NO: 229162 - DNA, 25 bp, Mus musculus
tctacaacgcgggtgagcgtctcgg

SEQ ID NO: 229163 - DNA, 25 bp, Mus musculus
caaggggcggagctttagaaccctg

SEQ ID NO: 229164 - DNA, 25 bp, Mus musculus
atgcctgcgcgaggcctgcgctcag

SEQ ID NO: 229165 - DNA, 25 bp, Mus musculus
ccaggcatcggcacgattttcagtg

SEQ ID NO: 229166 - DNA, 25 bp, Mus musculus
ggcagccccctagaaagtgagccct

SEQ ID NO: 229167 - DNA, 25 bp, Mus musculus
gcttggacatggaagatggcagccc

SEQ ID NO: 229168 - DNA, 25 bp, Mus musculus
tcctcaggacggcttggacatggaa

SEQ ID NO: 229169 - DNA, 25 bp, Mus musculus
ggcccgtcctgagaggtgcccatta

SEQ ID NO: 229170 - DNA, 25 bp, Mus musculus
cagtggcacacaggcggttgccacc

SEQ ID NO: 229171 - DNA, 25 bp, Mus musculus
tcggcacgattttcagtggcacaca

SEQ ID NO: 229172 - DNA, 25 bp, Mus musculus
tatgccaggcatcggcacgattttc

SEQ ID NO: 229173 - DNA, 25 bp, Mus musculus
ccatttatgcagtatgccaggcatc

SEQ ID NO: 229174 - DNA, 25 bp, Mus musculus
gcttccatttatgcagtatgccagg

SEQ ID NO: 229175 - DNA, 25 bp, Mus musculus
ctgcggtaccctgcttccatttatg

SEQ ID NO: 229176 - DNA, 25 bp, Mus musculus
gttttctgggctgctgcggtaccct

SEQ ID NO: 229177 - DNA, 25 bp, Mus musculus
tttattgttttctgggctgctgcgg

SEQ ID NO: 229178 - DNA, 25 bp, Mus musculus
ttttcagtggcacacaggcggttgc

SEQ ID NO: 229179 - DNA, 25 bp, Mus musculus
gaagtggagcggctatgcgcctccc

SEQ ID NO: 229180 - DNA, 25 bp, Mus musculus
ggcctgaatcccaggcggcctcgga

SEQ ID NO: 229181 - DNA, 25 bp, Mus musculus
caacacctgagggaggcagagcaac

SEQ ID NO: 229182 - DNA, 25 bp, Mus musculus
ctgtgcggatgctgccttacgccat

SEQ ID NO: 229183 - DNA, 25 bp, Mus musculus
ttacgccatggcagacaagcgcttc

SEQ ID NO: 229184 - DNA, 25 bp, Mus musculus
acaagcgcttcatccggtgggtgcc

SEQ ID NO: 229185 - DNA, 25 bp, Mus musculus
ctcggctactctggacgagctgcgc

SEQ ID NO: 229186 - DNA, 25 bp, Mus musculus
tcagatggattactcaagggcgccc

SEQ ID NO: 229187 - DNA, 25 bp, Mus musculus
gcgcccactgggatgtttcgccagt

SEQ ID NO: 229188 - DNA, 25 bp, Mus musculus
tgtcaccacggtcctgcagggaact

SEQ ID NO: 229189 - DNA, 25 bp, Mus musculus
agcccgagggagtgaagaccacctt

SEQ ID NO: 229190 - DNA, 25 bp, Mus musculus
agaccaccttctggcagcggtggca

SEQ ID NO: 229191 - DNA, 25 bp, Mus musculus
ctccggaggatgcatctgtcagatg

SEQ ID NO: 229192 - DNA, 25 bp, Mus musculus
ccagtggtcggtgcagtcaggacca

SEQ ID NO: 229193 - DNA, 25 bp, Mus musculus
tcgagctgggataagaatttatagt

SEQ ID NO: 229194 - DNA, 25 bp, Mus musculus
ccccctggtggtcgagctgggataa

SEQ ID NO: 229195 - DNA, 25 bp, Mus musculus
tggtcgagctgggataagaatttat

SEQ ID NO: 229196 - DNA, 25 bp, Mus musculus
gtcgagctgggataagaatttatag

SEQ ID NO: 229197 - DNA, 25 bp, Mus musculus
cgagctgggataagaatttatagtc

SEQ ID NO: 229198 - DNA, 25 bp, Mus musculus
gagctgggataagaatttatagtcc

SEQ ID NO: 229199 - DNA, 25 bp, Mus musculus
agctgggataagaatttatagtcca

SEQ ID NO: 229200 - DNA, 25 bp, Mus musculus
gctgggataagaatttatagtccac

SEQ ID NO: 229201 - DNA, 25 bp, Mus musculus
ctgggataagaatttatagtccacc

SEQ ID NO: 229202 - DNA, 25 bp, Mus musculus
tgggataagaatttatagtccaccg

SEQ ID NO: 229203 - DNA, 25 bp, Mus musculus
ggataagaatttatagtccaccggc

SEQ ID NO: 229204 - DNA, 25 bp, Mus musculus
gataagaatttatagtccaccggcg

SEQ ID NO: 229205 - DNA, 25 bp, Mus musculus
ataagaatttatagtccaccggcga

SEQ ID NO: 229206 - DNA, 25 bp, Mus musculus
ggtcgagctgggataagaatttata

SEQ ID NO: 229207 - DNA, 25 bp, Mus musculus
gctatctcgaagttagggctatgca

SEQ ID NO: 229208 - DNA, 25 bp, Mus musculus
gtccaccggcgagcatctctgttga

SEQ ID NO: 229209 - DNA, 25 bp, Mus musculus
tagggctatgcaataacaggtcgcg

SEQ ID NO: 229210 - DNA, 25 bp, Mus musculus
agacgcggtgaggaagctatctcga

SEQ ID NO: 229211 - DNA, 25 bp, Mus musculus
tcgcctttccagacgcggtgaggaa

SEQ ID NO: 229212 - DNA, 25 bp, Mus musculus
ctgcgcttttgaaggggccgctctt

SEQ ID NO: 229213 - DNA, 25 bp, Mus musculus
ctgcaagctcagctgcgggcccaga

SEQ ID NO: 229214 - DNA, 25 bp, Mus musculus
cttcggtgccttggggcacaaatcc

SEQ ID NO: 229215 - DNA, 25 bp, Mus musculus
catgtggaacttctgcttcggtgcc

SEQ ID NO: 229216 - DNA, 25 bp, Mus musculus
ctcgactcagcaagattcatgtgga

SEQ ID NO: 229217 - DNA, 25 bp, Mus musculus
cctctttttaggactctcgactcag

SEQ ID NO: 229218 - DNA, 25 bp, Mus musculus
ggatgcgaacatccacggacgtccc

SEQ ID NO: 229219 - DNA, 25 bp, Mus musculus
tctctgttgactgcggatgcgaaca

SEQ ID NO: 229220 - DNA, 25 bp, Mus musculus
aggagctgcggaccctgcaagctca

SEQ ID NO: 229221 - DNA, 25 bp, Mus musculus
ttcgcgctgacatcggaagacactc

SEQ ID NO: 229222 - DNA, 25 bp, Mus musculus
cggagcatttccgtggacctcagga

SEQ ID NO: 229223 - DNA, 25 bp, Mus musculus
tcccgtgtttgtagcggagcatttc

SEQ ID NO: 229224 - DNA, 25 bp, Mus musculus
ttctgggcccggctagtttagcctc

SEQ ID NO: 229225 - DNA, 25 bp, Mus musculus
cggggaattggagccttgtccttct

SEQ ID NO: 229226 - DNA, 25 bp, Mus musculus
ggagtgtcctctcggtcgatcttcc

SEQ ID NO: 229227 - DNA, 25 bp, Mus musculus
ccctgtgtcatcacttccgggaggc

SEQ ID NO: 229228 - DNA, 25 bp, Mus musculus
cggctgtaacagaagcggagaactc

SEQ ID NO: 229229 - DNA, 25 bp, Mus musculus
gcgtttctacttccgccatccgagg

SEQ ID NO: 229230 - DNA, 25 bp, Mus musculus
cggacccgtggtactgcttcatgtc

SEQ ID NO: 229231 - DNA, 25 bp, Mus musculus
tccacaccacgcagtaggggaagcg

SEQ ID NO: 229232 - DNA, 25 bp, Mus musculus
gcaccgggatgggtgtccacaccac

SEQ ID NO: 229233 - DNA, 25 bp, Mus musculus
tggacctcaggaagctctcagtcga

SEQ ID NO: 229234 - DNA, 25 bp, Mus musculus
gaagacactcacgtgagcaccggga

SEQ ID NO: 229235 - DNA, 25 bp, Mus musculus
cccggtcaacgtctgctgccggtgg

SEQ ID NO: 229236 - DNA, 25 bp, Mus musculus
gtttttcgccatcgcagaggtcctg

SEQ ID NO: 229237 - DNA, 25 bp, Mus musculus
atcatgggagtcgtagtttttcgcc

SEQ ID NO: 229238 - DNA, 25 bp, Mus musculus
ggctcagctctggagtatcatggga

SEQ ID NO: 229239 - DNA, 25 bp, Mus musculus
gtggcgcccactaacctgctagcgg

SEQ ID NO: 229240 - DNA, 25 bp, Mus musculus
tttcctgaatagtgagcgcgggccc

SEQ ID NO: 229241 - DNA, 25 bp, Mus musculus
atggcgctcggcagtttcctgaata

SEQ ID NO: 229242 - DNA, 25 bp, Mus musculus
ctgtttatctcctccagctgtctgg

SEQ ID NO: 229243 - DNA, 25 bp, Mus musculus
gcaacttcaggagcccatgtcggtc

SEQ ID NO: 229244 - DNA, 25 bp, Mus musculus
gaccagcagcggagcaacttcagga

SEQ ID NO: 229245 - DNA, 25 bp, Mus musculus
gtcaggtctcttcccaggaccagca

SEQ ID NO: 229246 - DNA, 25 bp, Mus musculus
gcggcgacccgtacctgtcaggtct

SEQ ID NO: 229247 - DNA, 25 bp, Mus musculus
ccgactcgacatctgcggcggggat

SEQ ID NO: 229248 - DNA, 25 bp, Mus musculus
caatcggcttcaccgctcgcgggaa

SEQ ID NO: 229249 - DNA, 25 bp, Mus musculus
gggcgctgacaggtctctctagctt

SEQ ID NO: 229250 - DNA, 25 bp, Mus musculus
gacaggtctctctagcttgctgcgc

SEQ ID NO: 229251 - DNA, 25 bp, Mus musculus
tctctagcttgctgcgcctgctact

SEQ ID NO: 229252 - DNA, 25 bp, Mus musculus
gcctgctactcgttggtgcctataa

SEQ ID NO: 229253 - DNA, 25 bp, Mus musculus
ctcgttggtgcctataaatggctgc

SEQ ID NO: 229254 - DNA, 25 bp, Mus musculus
cctataaatggctgcgctgtgctca

SEQ ID NO: 229255 - DNA, 25 bp, Mus musculus
ctgcgctgtgctcagcgaggcatca

SEQ ID NO: 229256 - DNA, 25 bp, Mus musculus
tgctcagcgaggcatcagtccgcta

SEQ ID NO: 229257 - DNA, 25 bp, Mus musculus
cgaggcatcagtccgctaccgcggg

SEQ ID NO: 229258 - DNA, 25 bp, Mus musculus
ctgtgtcaggtctggaagtggagct

SEQ ID NO: 229259 - DNA, 25 bp, Mus musculus
agctggagctgaccgaaggagctgc

SEQ ID NO: 229260 - DNA, 25 bp, Mus musculus
aacacagctctgcaccggggtctta

SEQ ID NO: 229261 - DNA, 25 bp, Mus musculus
tgttgctgctggctcactgcgagcc

SEQ ID NO: 229262 - DNA, 25 bp, Mus musculus
cacagctctgcaccggggtcttaag

SEQ ID NO: 229263 - DNA, 25 bp, Mus musculus
cggggatttaccgaccaggcagagg

SEQ ID NO: 229264 - DNA, 25 bp, Mus musculus
gaccagccgtgtgggcgcggagaat

SEQ ID NO: 229265 - DNA, 25 bp, Mus musculus
ctgcagctagtgaccagccgtgtgg

SEQ ID NO: 229266 - DNA, 25 bp, Mus musculus
tctgcagctagtgaccagccgtgtg

SEQ ID NO: 229267 - DNA, 25 bp, Mus musculus
gtgtctgcagctagtgaccagccgt

SEQ ID NO: 229268 - DNA, 25 bp, Mus musculus
ctgtgtctgcagctagtgaccagcc

SEQ ID NO: 229269 - DNA, 25 bp, Mus musculus
gcccgcggtgtgttcctaggaccca

SEQ ID NO: 229270 - DNA, 25 bp, Mus musculus
gtgtgttcctaggacccacggctcc

SEQ ID NO: 229271 - DNA, 25 bp, Mus musculus
ccgcggtgtgttcctaggacccacg

SEQ ID NO: 229272 - DNA, 25 bp, Mus musculus
cctcgcccgcggtgtgttcctagga

SEQ ID NO: 229273 - DNA, 25 bp, Mus musculus
ccctctgacgtcaatgcccgagcct

SEQ ID NO: 229274 - DNA, 25 bp, Mus musculus
aggttccgcccctctgacgtcaatg

SEQ ID NO: 229275 - DNA, 25 bp, Mus musculus
cgcggagaatgaggctgagcggcag

SEQ ID NO: 229276 - DNA, 25 bp, Mus musculus
cggtgtgttcctaggacccacggct

SEQ ID NO: 229277 - DNA, 25 bp, Mus musculus
ccaggcatgcggtaattcgaagggc

SEQ ID NO: 229278 - DNA, 25 bp, Mus musculus
cagcttctttaaagaccaaaggagg

SEQ ID NO: 229279 - DNA, 25 bp, Mus musculus
agcagcagcttctttaaagaccaaa

SEQ ID NO: 229280 - DNA, 25 bp, Mus musculus
tgtccctctaagtcccggcaggctc

SEQ ID NO: 229281 - DNA, 25 bp, Mus musculus
tggagggcgctgtccctctaagtcc

SEQ ID NO: 229282 - DNA, 25 bp, Mus musculus
tccctcgacttctgccgctggaggg

SEQ ID NO: 229283 - DNA, 25 bp, Mus musculus
ggcaacattactctacacagacctc

SEQ ID NO: 229284 - DNA, 25 bp, Mus musculus
acacggcaacattactctacacaga

SEQ ID NO: 229285 - DNA, 25 bp, Mus musculus
gccttgtcaacacggcaacattact

SEQ ID NO: 229286 - DNA, 25 bp, Mus musculus
tcaaaggaataaattagaaagcggc

SEQ ID NO: 229287 - DNA, 25 bp, Mus musculus
tcgaagggccaatcaaaggaataaa

SEQ ID NO: 229288 - DNA, 25 bp, Mus musculus
gcggtaattcgaagggccaatcaaa

SEQ ID NO: 229289 - DNA, 25 bp, Mus musculus
caaaggagggaattcggtccgagag

SEQ ID NO: 229290 - DNA, 25 bp, Mus musculus
catgcggtaattcgaagggccaatc

SEQ ID NO: 229291 - DNA, 25 bp, Mus musculus
gctgaaagagccgatccccattcac

SEQ ID NO: 229292 - DNA, 25 bp, Mus musculus
ccattcacggacgaggcaacttccc

SEQ ID NO: 229293 - DNA, 25 bp, Mus musculus
cccattcacggacgaggcaacttcc

SEQ ID NO: 229294 - DNA, 25 bp, Mus musculus
cgatccccattcacggacgaggcaa

SEQ ID NO: 229295 - DNA, 25 bp, Mus musculus
agccgatccccattcacggacgagg

SEQ ID NO: 229296 - DNA, 25 bp, Mus musculus
agagccgatccccattcacggacga

SEQ ID NO: 229297 - DNA, 25 bp, Mus musculus
agtcggctgagctggccacaggtga

SEQ ID NO: 229298 - DNA, 25 bp, Mus musculus
gaaagagccgatccccattcacgga

SEQ ID NO: 229299 - DNA, 25 bp, Mus musculus
gctgctgaaagagccgatccccatt

SEQ ID NO: 229300 - DNA, 25 bp, Mus musculus
cgctgctgaaagagccgatccccat

SEQ ID NO: 229301 - DNA, 25 bp, Mus musculus
gccacaggtgaagcggctggacgcg

SEQ ID NO: 229302 - DNA, 25 bp, Mus musculus
ctggccacaggtgaagcggctggac

SEQ ID NO: 229303 - DNA, 25 bp, Mus musculus
ctgagctggccacaggtgaagcggc

SEQ ID NO: 229304 - DNA, 25 bp, Mus musculus
attcacggacgaggcaacttcccca

SEQ ID NO: 229305 - DNA, 25 bp, Mus musculus
ccctgggacggcaccagagtcggct

SEQ ID NO: 229306 - DNA, 25 bp, Mus musculus
cccgcggcctataagtgtcagctgg

SEQ ID NO: 229307 - DNA, 25 bp, Mus musculus
gcggcccgcggcctataagtgtcag

SEQ ID NO: 229308 - DNA, 25 bp, Mus musculus
ctataagtgtcagctgggcccgagc

SEQ ID NO: 229309 - DNA, 25 bp, Mus musculus
agccgcctggctctaagatctgtta

SEQ ID NO: 229310 - DNA, 25 bp, Mus musculus
cgcctggctctaagatctgttagtc

SEQ ID NO: 229311 - DNA, 25 bp, Mus musculus
tctgttagtcctccctgccgtcggg

SEQ ID NO: 229312 - DNA, 25 bp, Mus musculus
gtgttccctgggtttgcctcgccgc

SEQ ID NO: 229313 - DNA, 25 bp, Mus musculus
gccttggcccgtgcacagccactct

SEQ ID NO: 229314 - DNA, 25 bp, Mus musculus
cattcccgggtttctgccgtccagg

SEQ ID NO: 229315 - DNA, 25 bp, Mus musculus
gtttctgccgtccaggcaccggggc

SEQ ID NO: 229316 - DNA, 25 bp, Mus musculus
cgggtgaatgatgccgtcggagagt

SEQ ID NO: 229317 - DNA, 25 bp, Mus musculus
ctgagagcctggagcagccagctgc

SEQ ID NO: 229318 - DNA, 25 bp, Mus musculus
agatctgttagtcctccctgccgtc

SEQ ID NO: 229319 - DNA, 25 bp, Mus musculus
cgccgctgacactcaaggaagccta

SEQ ID NO: 229320 - DNA, 25 bp, Mus musculus
aaagtgtgcaccgacctggaccgct

SEQ ID NO: 229321 - DNA, 25 bp, Mus musculus
ggagcctcatctctctgtccaacaa

SEQ ID NO: 229322 - DNA, 25 bp, Mus musculus
agttcgtggactctgtgagacgcca

SEQ ID NO: 229323 - DNA, 25 bp, Mus musculus
gagacgccagttcgaattcagcatc

SEQ ID NO: 229324 - DNA, 25 bp, Mus musculus
actcgctgctcctctttggccagtg

SEQ ID NO: 229325 - DNA, 25 bp, Mus musculus
atccacacctatgtcggaggccttc

SEQ ID NO: 229326 - DNA, 25 bp, Mus musculus
ggagcacctgcagcaccgtgtcatc

SEQ ID NO: 229327 - DNA, 25 bp, Mus musculus
gtggtggcctcctcaagtactgcca

SEQ ID NO: 229328 - DNA, 25 bp, Mus musculus
aagtactgccacctcctggtacggg

SEQ ID NO: 229329 - DNA, 25 bp, Mus musculus
gcgccctccagcgatacatgtgttc

SEQ ID NO: 229330 - DNA, 25 bp, Mus musculus
ttcatcgactttccggacctggtgg

SEQ ID NO: 229331 - DNA, 25 bp, Mus musculus
acctggtggaacagaggcgcattct

SEQ ID NO: 229332 - DNA, 25 bp, Mus musculus
ccgggccaagataacgccgctgaca

SEQ ID NO: 229333 - DNA, 25 bp, Mus musculus
agctcctgcccttccacgggtgtct

SEQ ID NO: 229334 - DNA, 25 bp, Mus musculus
gccgcccagcatcttatagcacatg

SEQ ID NO: 229335 - DNA, 25 bp, Mus musculus
gatgacgccgtccatctggccagca

SEQ ID NO: 229336 - DNA, 25 bp, Mus musculus
catcttatagcacatggggcggagc

SEQ ID NO: 229337 - DNA, 25 bp, Mus musculus
caggcgctgattcggcagcccggca

SEQ ID NO: 229338 - DNA, 25 bp, Mus musculus
ggcggccctccacttctagcagtcg

SEQ ID NO: 229339 - DNA, 25 bp, Mus musculus
tgcagctgcagcacccggctctcca

SEQ ID NO: 229340 - DNA, 25 bp, Mus musculus
gcagccaagaagactcggtgcagct

SEQ ID NO: 229341 - DNA, 25 bp, Mus musculus
cagctccgcagccaagaagactcgg

SEQ ID NO: 229342 - DNA, 25 bp, Mus musculus
cccttcttgagacgggacccgtgcg

SEQ ID NO: 229343 - DNA, 25 bp, Mus musculus
gcgcgcacccttcttgagacgggac

SEQ ID NO: 229344 - DNA, 25 bp, Mus musculus
agactcgcctgcctcgggaagccag

SEQ ID NO: 229345 - DNA, 25 bp, Mus musculus
cagcacctggatccgtccgtccgtc

SEQ ID NO: 229346 - DNA, 25 bp, Mus musculus
gcagagcccacacccaggccgcacg

SEQ ID NO: 229347 - DNA, 25 bp, Mus musculus
ccatccgcggctcggtggcgaaagc

SEQ ID NO: 229348 - DNA, 25 bp, Mus musculus
aggcaggcctgtcgccttgttggca

SEQ ID NO: 229349 - DNA, 25 bp, Mus musculus
cccgccgcaccctggaccactggtc

SEQ ID NO: 229350 - DNA, 25 bp, Mus musculus
tgttccactccggaccttgtctccc

SEQ ID NO: 229351 - DNA, 25 bp, Mus musculus
ttttgtcgcctgttccactccggac

SEQ ID NO: 229352 - DNA, 25 bp, Mus musculus
tccagcccgtgggttttgtcgcctg

SEQ ID NO: 229353 - DNA, 25 bp, Mus musculus
gagtccaccagcgaggacccggagc

SEQ ID NO: 229354 - DNA, 25 bp, Mus musculus
catggtgagtccaccagcgaggacc

SEQ ID NO: 229355 - DNA, 25 bp, Mus musculus
cgcctcgtgagcatggtgagtccac

SEQ ID NO: 229356 - DNA, 25 bp, Mus musculus
cctcaggtggtgacgcgcctcgtga

SEQ ID NO: 229357 - DNA, 25 bp, Mus musculus
tgtctcagcctcaggtggtgacgcg

SEQ ID NO: 229358 - DNA, 25 bp, Mus musculus
acctgcggcgcttcctgtctcagcc

SEQ ID NO: 229359 - DNA, 25 bp, Mus musculus
gcacggcacagcaggtggccggcac

SEQ ID NO: 229360 - DNA, 25 bp, Mus musculus
aagcgacatggagagcggggcctat

SEQ ID NO: 229361 - DNA, 25 bp, Mus musculus
tccttaccgtactttcagcctcttg

SEQ ID NO: 229362 - DNA, 25 bp, Mus musculus
cctcgcaaactctcaacggtacgga

SEQ ID NO: 229363 - DNA, 25 bp, Mus musculus
tcttcggagcccgaacgtaactgcc

SEQ ID NO: 229364 - DNA, 25 bp, Mus musculus
cggagagctggccacctcgcaaact

SEQ ID NO: 229365 - DNA, 25 bp, Mus musculus
cagcctcttgcagcttgtcttcgga

SEQ ID NO: 229366 - DNA, 25 bp, Mus musculus
gagaaccgtgaagagcgaatccctg

SEQ ID NO: 229367 - DNA, 25 bp, Mus musculus
gaatccctggacttgtccgggccga

SEQ ID NO: 229368 - DNA, 25 bp, Mus musculus
ctgcgttccgcgttctaggtttgcg

SEQ ID NO: 229369 - DNA, 25 bp, Mus musculus
ttctggacctgttgccttcagcttc

SEQ ID NO: 229370 - DNA, 25 bp, Mus musculus
ttcagcttctctgctttcacgttgg

SEQ ID NO: 229371 - DNA, 25 bp, Mus musculus
gtgctgagggcacattttggatctc

SEQ ID NO: 229372 - DNA, 25 bp, Mus musculus
tttggatctccgaggtagctcctta

SEQ ID NO: 229373 - DNA, 25 bp, Mus musculus
gaccctacttccaggcttcagcgga

SEQ ID NO: 229374 - DNA, 25 bp, Mus musculus
tgcgcgagggcctcaaaacccacgg

SEQ ID NO: 229375 - DNA, 25 bp, Mus musculus
ctggggtgctaggacccagcaccgt

SEQ ID NO: 229376 - DNA, 25 bp, Mus musculus
cgctgaccatacgtttgcctggaca

SEQ ID NO: 229377 - DNA, 25 bp, Mus musculus
gcggctcgctgaccatacgtttgcc

SEQ ID NO: 229378 - DNA, 25 bp, Mus musculus
ctgcgcccgagctgagcagagctga

SEQ ID NO: 229379 - DNA, 25 bp, Mus musculus
gggtgcacagtaccctgcgcccgag

SEQ ID NO: 229380 - DNA, 25 bp, Mus musculus
ctcctgcttgcagatgagacagtgg

SEQ ID NO: 229381 - DNA, 25 bp, Mus musculus
gcggctcctgcttgcagatgagaca

SEQ ID NO: 229382 - DNA, 25 bp, Mus musculus
acggcaacgcgagccctgccgcctg

SEQ ID NO: 229383 - DNA, 25 bp, Mus musculus
tacctgcgacccaggtgagtgccga

SEQ ID NO: 229384 - DNA, 25 bp, Mus musculus
ctaggacccagcaccgtgcgtggaa

SEQ ID NO: 229385 - DNA, 25 bp, Mus musculus
atacgtttgcctggacagaggctgc

SEQ ID NO: 229386 - DNA, 25 bp, Mus musculus
ctcacctggctgggcaggtaaggcc

SEQ ID NO: 229387 - DNA, 25 bp, Mus musculus
ccagcaccgtgcgtggaacagcgtc

SEQ ID NO: 229388 - DNA, 25 bp, Mus musculus
gcgagacgcttacctgcgacccagg

SEQ ID NO: 229389 - DNA, 25 bp, Mus musculus
ggtgcccattgagctcccggaacac

SEQ ID NO: 229390 - DNA, 25 bp, Mus musculus
cgagacttcactcgcgggctgggca

SEQ ID NO: 229391 - DNA, 25 bp, Mus musculus
tgcggcgcgggccacgtcgtttacc

SEQ ID NO: 229392 - DNA, 25 bp, Mus musculus
tgcgccatggccagcagcatgccgt

SEQ ID NO: 229393 - DNA, 25 bp, Mus musculus
agcagcatgccgtcgaagcgctcct

SEQ ID NO: 229394 - DNA, 25 bp, Mus musculus
gagctccgcactcgcgttctgcgat

SEQ ID NO: 229395 - DNA, 25 bp, Mus musculus
gagccggaaacacgcaggagccgcc

SEQ ID NO: 229396 - DNA, 25 bp, Mus musculus
cggcgttggagcgagacttcactcg

SEQ ID NO: 229397 - DNA, 25 bp, Mus musculus
aacccgcttctctggccattggcta

SEQ ID NO: 229398 - DNA, 25 bp, Mus musculus
tctctggccattggctaagccgagg

SEQ ID NO: 229399 - DNA, 25 bp, Mus musculus
taagccgaggagcaaatcaacagtc

SEQ ID NO: 229400 - DNA, 25 bp, Mus musculus
caaatcaacagtcgcggtcccaagg

SEQ ID NO: 229401 - DNA, 25 bp, Mus musculus
aacagtcgcggtcccaaggcagtgg

SEQ ID NO: 229402 - DNA, 25 bp, Mus musculus
tagccttccgcagcggagccggaaa

SEQ ID NO: 229403 - DNA, 25 bp, Mus musculus
gggacctggcttcccggtcgctgtc

SEQ ID NO: 229404 - DNA, 25 bp, Mus musculus
gtgctctcgcgagagtggacgccaa

SEQ ID NO: 229405 - DNA, 25 bp, Mus musculus
gtggacgccaagcaatcatgtgaca

SEQ ID NO: 229406 - DNA, 25 bp, Mus musculus
caatcatgtgacaggccaagatggc

SEQ ID NO: 229407 - DNA, 25 bp, Mus musculus
gctggacgaagagtcgccggtttac

SEQ ID NO: 229408 - DNA, 25 bp, Mus musculus
tttacctggtggtgagcgggatccc

SEQ ID NO: 229409 - DNA, 25 bp, Mus musculus
agcgggatccctgccgtgttacgct

SEQ ID NO: 229410 - DNA, 25 bp, Mus musculus
tgccgtgttacgctcggctcagtta

SEQ ID NO: 229411 - DNA, 25 bp, Mus musculus
tcggctcagttacggagctacttta

SEQ ID NO: 229412 - DNA, 25 bp, Mus musculus
gctactttagccagttccgggaaca

SEQ ID NO: 229413 - DNA, 25 bp, Mus musculus
tgaggatccggttctcgcccaggct

SEQ ID NO: 229414 - DNA, 25 bp, Mus musculus
cagcggctgcttcgcatgtactccg

SEQ ID NO: 229415 - DNA, 25 bp, Mus musculus
gtcgctgtctcatccgcaggcttag

SEQ ID NO: 229416 - DNA, 25 bp, Mus musculus
gcatgtactccggtcgccggtggct

SEQ ID NO: 229417 - DNA, 25 bp, Mus musculus
cggttgcgtgaccacagcctatgcc

SEQ ID NO: 229418 - DNA, 25 bp, Mus musculus
tgcatggagtacctggaagccaacc

SEQ ID NO: 229419 - DNA, 25 bp, Mus musculus
gtggcctgctctactgcatggagta

SEQ ID NO: 229420 - DNA, 25 bp, Mus musculus
actgccttacgagtgtgcggtggac

SEQ ID NO: 229421 - DNA, 25 bp, Mus musculus
ccgctaacgacggactgccttacga

SEQ ID NO: 229422 - DNA, 25 bp, Mus musculus
gcatgagtgagttcctgcgcgctct

SEQ ID NO: 229423 - DNA, 25 bp, Mus musculus
aagaccacgtactgcctgggcatga

SEQ ID NO: 229424 - DNA, 25 bp, Mus musculus
tctccagacaagttccggcggaatc

SEQ ID NO: 229425 - DNA, 25 bp, Mus musculus
aggccactactttctcttcgactgc

SEQ ID NO: 229426 - DNA, 25 bp, Mus musculus
tgccttagtgaagcctggggaaatc

SEQ ID NO: 229427 - DNA, 25 bp, Mus musculus
cagtttacccggcatggagatctgc

SEQ ID NO: 229428 - DNA, 25 bp, Mus musculus
tcggtgcgagaataaaccagtttac

SEQ ID NO: 229429 - DNA, 25 bp, Mus musculus
ccctctgcctagagacggatcggtg

SEQ ID NO: 229430 - DNA, 25 bp, Mus musculus
tctgcttgagtttacttggtgaggc

SEQ ID NO: 229431 - DNA, 25 bp, Mus musculus
agctccctgcggctcttcccaccca

SEQ ID NO: 229432 - DNA, 25 bp, Mus musculus
agctcgcgcccgctcctcttcagcc

SEQ ID NO: 229433 - DNA, 25 bp, Mus musculus
ggagactaagttttgcgcgcggccc

SEQ ID NO: 229434 - DNA, 25 bp, Mus musculus
aggccgtgggctgctcagcccagct

SEQ ID NO: 229435 - DNA, 25 bp, Mus musculus
agagtccgtccagtgattgggccgt

SEQ ID NO: 229436 - DNA, 25 bp, Mus musculus
gctctgtagagagtccgtccagtga

SEQ ID NO: 229437 - DNA, 25 bp, Mus musculus
ttcgctctcccattggtcaaccgtg

SEQ ID NO: 229438 - DNA, 25 bp, Mus musculus
gcgggaggactcacccttcgctctc

SEQ ID NO: 229439 - DNA, 25 bp, Mus musculus
tcttttccagaagggtagcgcggcc

SEQ ID NO: 229440 - DNA, 25 bp, Mus musculus
ttcgtcttttccagaagggtagcgc

SEQ ID NO: 229441 - DNA, 25 bp, Mus musculus
gccgcaacttcttcgtcttttccag

SEQ ID NO: 229442 - DNA, 25 bp, Mus musculus
ccgagccgcaacttcttcgtctttt

SEQ ID NO: 229443 - DNA, 25 bp, Mus musculus
gtggcaacttgtctgagtgaaaccg

SEQ ID NO: 229444 - DNA, 25 bp, Mus musculus
cgggtggcaacttgtctgagtgaaa

SEQ ID NO: 229445 - DNA, 25 bp, Mus musculus
ccacgttcttgtaagctacggaaag

SEQ ID NO: 229446 - DNA, 25 bp, Mus musculus
aagctacggaaagcaggtttcgctc

SEQ ID NO: 229447 - DNA, 25 bp, Mus musculus
gtaagctacggaaagcaggtttcgc

SEQ ID NO: 229448 - DNA, 25 bp, Mus musculus
tgtaagctacggaaagcaggtttcg

SEQ ID NO: 229449 - DNA, 25 bp, Mus musculus
ttgtaagctacggaaagcaggtttc

SEQ ID NO: 229450 - DNA, 25 bp, Mus musculus
tcttgtaagctacggaaagcaggtt

SEQ ID NO: 229451 - DNA, 25 bp, Mus musculus
gttcttgtaagctacggaaagcagg

SEQ ID NO: 229452 - DNA, 25 bp, Mus musculus
cgttcttgtaagctacggaaagcag

SEQ ID NO: 229453 - DNA, 25 bp, Mus musculus
cacgttcttgtaagctacggaaagc

SEQ ID NO: 229454 - DNA, 25 bp, Mus musculus
caccacgttcttgtaagctacggaa

SEQ ID NO: 229455 - DNA, 25 bp, Mus musculus
ctacggaaagcaggtttcgctcctc

SEQ ID NO: 229456 - DNA, 25 bp, Mus musculus
tacggaaagcaggtttcgctcctcg

SEQ ID NO: 229457 - DNA, 25 bp, Mus musculus
acgttcttgtaagctacggaaagca

SEQ ID NO: 229458 - DNA, 25 bp, Mus musculus
agctacggaaagcaggtttcgctcc

SEQ ID NO: 229459 - DNA, 25 bp, Mus musculus
tcgcaggagagctcctcgccctttt

SEQ ID NO: 229460 - DNA, 25 bp, Mus musculus
atgctggacaggaccctccaggccg

SEQ ID NO: 229461 - DNA, 25 bp, Mus musculus
gctcgatgctggacaggaccctcca

SEQ ID NO: 229462 - DNA, 25 bp, Mus musculus
ttctgctcgatgctggacaggaccc

SEQ ID NO: 229463 - DNA, 25 bp, Mus musculus
ctcctcgttgctcttctgctcgatg

SEQ ID NO: 229464 - DNA, 25 bp, Mus musculus
tctgcatctccagcccctttgatga

SEQ ID NO: 229465 - DNA, 25 bp, Mus musculus
gtagtcacccttcatcttcaggtag

SEQ ID NO: 229466 - DNA, 25 bp, Mus musculus
gtagtagtcacccttcatcttcagg

SEQ ID NO: 229467 - DNA, 25 bp, Mus musculus
gcggtagtagtcacccttcatcttc

SEQ ID NO: 229468 - DNA, 25 bp, Mus musculus
gtagcggtagtagtcacccttcatc

SEQ ID NO: 229469 - DNA, 25 bp, Mus musculus
taggtagcggtagtagtcacccttc

SEQ ID NO: 229470 - DNA, 25 bp, Mus musculus
cctcggctaggtagcggtagtagtc

SEQ ID NO: 229471 - DNA, 25 bp, Mus musculus
ccacctcggctaggtagcggtagta

SEQ ID NO: 229472 - DNA, 25 bp, Mus musculus
tggccacctcggctaggtagcggta

SEQ ID NO: 229473 - DNA, 25 bp, Mus musculus
aggcccgagggctcacggatgcggg

SEQ ID NO: 229474 - DNA, 25 bp, Mus musculus
ggtgggcgaactcactcgaagacga

SEQ ID NO: 229475 - DNA, 25 bp, Mus musculus
gtgggcgaactcactcgaagacgaa

SEQ ID NO: 229476 - DNA, 25 bp, Mus musculus
gggcgaactcactcgaagacgaaga

SEQ ID NO: 229477 - DNA, 25 bp, Mus musculus
acgaagaagaggatggtggtgctga

SEQ ID NO: 229478 - DNA, 25 bp, Mus musculus
ggtggtgctgaggatgagcagcagc

SEQ ID NO: 229479 - DNA, 25 bp, Mus musculus
tgagcagcagcgtgagcgcgaagac

SEQ ID NO: 229480 - DNA, 25 bp, Mus musculus
tggccggccagcatgagccggcctc

SEQ ID NO: 229481 - DNA, 25 bp, Mus musculus
agccggcctccgcagtagaagcggt

SEQ ID NO: 229482 - DNA, 25 bp, Mus musculus
ccggcctccgcagtagaagcggttg

SEQ ID NO: 229483 - DNA, 25 bp, Mus musculus
cggcctccgcagtagaagcggttgc

SEQ ID NO: 229484 - DNA, 25 bp, Mus musculus
cctccgcagtagaagcggttgcggc

SEQ ID NO: 229485 - DNA, 25 bp, Mus musculus
tccgcagtagaagcggttgcggccc

SEQ ID NO: 229486 - DNA, 25 bp, Mus musculus
ggcacccaaggtccgggtggcgaga

SEQ ID NO: 229487 - DNA, 25 bp, Mus musculus
agttgcagagctggcgccggatcct

SEQ ID NO: 229488 - DNA, 25 bp, Mus musculus
agagccacgcgttctctcggtgttc

SEQ ID NO: 229489 - DNA, 25 bp, Mus musculus
tctgacttcccggtgtgagccgagg

SEQ ID NO: 229490 - DNA, 25 bp, Mus musculus
ccctgccgtgagcagcctctgactt

SEQ ID NO: 229491 - DNA, 25 bp, Mus musculus
actcgccagcagtttgtgcgcgggc

SEQ ID NO: 229492 - DNA, 25 bp, Mus musculus
ggcctcttgactcgccagcagtttg

SEQ ID NO: 229493 - DNA, 25 bp, Mus musculus
acctgaggagtaggcctcttgactc

SEQ ID NO: 229494 - DNA, 25 bp, Mus musculus
accttcccggcgtggtgacacctga

SEQ ID NO: 229495 - DNA, 25 bp, Mus musculus
tcggcggccatgttgaccccagcta

SEQ ID NO: 229496 - DNA, 25 bp, Mus musculus
ccggaggactccagagttgcagagc

SEQ ID NO: 229497 - DNA, 25 bp, Mus musculus
tctcggcctgcgtttgacagcttcc

SEQ ID NO: 229498 - DNA, 25 bp, Mus musculus
tttctctcggcctgcgtttgacagc

SEQ ID NO: 229499 - DNA, 25 bp, Mus musculus
cgcctaatttctctcggcctgcgtt

SEQ ID NO: 229500 - DNA, 25 bp, Mus musculus
gcggtgagtcgcaccttcccggcgt

SEQ ID NO: 229501 - DNA, 25 bp, Mus musculus
ccaagcccttgcctgggaatgaggg

SEQ ID NO: 229502 - DNA, 25 bp, Mus musculus
tccgccatgttgttggtggaagacg

SEQ ID NO: 229503 - DNA, 25 bp, Mus musculus
tgactctccgctttctgctgccgga

SEQ ID NO: 229504 - DNA, 25 bp, Mus musculus
cgctgccaggccagggctttgttgt

SEQ ID NO: 229505 - DNA, 25 bp, Mus musculus
ggctccggccgtaggcttgcccgaa

SEQ ID NO: 229506 - DNA, 25 bp, Mus musculus
taggcttgcccgaagccgtaggctg

SEQ ID NO: 229507 - DNA, 25 bp, Mus musculus
ccgcgttcccgttcgagttcttcag

SEQ ID NO: 229508 - DNA, 25 bp, Mus musculus
cgttcgagttcttcaggtccggctc

SEQ ID NO: 229509 - DNA, 25 bp, Mus musculus
gtcctgcagctcctttcccagcggc

SEQ ID NO: 229510 - DNA, 25 bp, Mus musculus
tcccgctgttgctgctcggctttct

SEQ ID NO: 229511 - DNA, 25 bp, Mus musculus
tcggctttcttcagctccgagggcg

SEQ ID NO: 229512 - DNA, 25 bp, Mus musculus
agagacccggccctgtcttcgtctt

SEQ ID NO: 229513 - DNA, 25 bp, Mus musculus
cgctgtgactctccgctttctgctg

SEQ ID NO: 229514 - DNA, 25 bp, Mus musculus
gagttcttcaggtccggctccgcgc

SEQ ID NO: 229515 - DNA, 25 bp, Mus musculus
gctgcggaagattcgagtcagaata

SEQ ID NO: 229516 - DNA, 25 bp, Mus musculus
ggaaccgcagcagaaggtacaactc

SEQ ID NO: 229517 - DNA, 25 bp, Mus musculus
cgcccacaaggccaggcgcagatgg

SEQ ID NO: 229518 - DNA, 25 bp, Mus musculus
gcccgcgcgatttgaatcctgcgtt

SEQ ID NO: 229519 - DNA, 25 bp, Mus musculus
atcctgcgtttgagtcgtcttggcg

SEQ ID NO: 229520 - DNA, 25 bp, Mus musculus
tgtggtgacgccatcatgggagctc

SEQ ID NO: 229521 - DNA, 25 bp, Mus musculus
tctggcagctgtacctcaagaacta

SEQ ID NO: 229522 - DNA, 25 bp, Mus musculus
caagaactggcccttcctggaggac

SEQ ID NO: 229523 - DNA, 25 bp, Mus musculus
cagagcgagtgagtcccagcttcca

SEQ ID NO: 229524 - DNA, 25 bp, Mus musculus
agtgagtcccagcttccagcgactc

SEQ ID NO: 229525 - DNA, 25 bp, Mus musculus
ccgacggtgccttagttgtgtgacc

SEQ ID NO: 229526 - DNA, 25 bp, Mus musculus
gccttagttgtgtgacccgggatca

SEQ ID NO: 229527 - DNA, 25 bp, Mus musculus
tgacccgggatcagaacccgctatc

SEQ ID NO: 229528 - DNA, 25 bp, Mus musculus
gtcagaatagcaagaaggaaccgca

SEQ ID NO: 229529 - DNA, 25 bp, Mus musculus
attatagggttaggacagcgctctc

SEQ ID NO: 229530 - DNA, 25 bp, Mus musculus
gacggcaatcggcaaaagtggactg

SEQ ID NO: 229531 - DNA, 25 bp, Mus musculus
caccaagccgggcaggacggcaatc

SEQ ID NO: 229532 - DNA, 25 bp, Mus musculus
agagttcttatcaccaagccgggca

SEQ ID NO: 229533 - DNA, 25 bp, Mus musculus
gctggctctcacaggagagttctta

SEQ ID NO: 229534 - DNA, 25 bp, Mus musculus
actaaagtctcgttcgctggctctc

SEQ ID NO: 229535 - DNA, 25 bp, Mus musculus
acatggaaaccggactaaagtctcg

SEQ ID NO: 229536 - DNA, 25 bp, Mus musculus
ggactgaatcgttgacatggaaacc

SEQ ID NO: 229537 - DNA, 25 bp, Mus musculus
cccacacccaggcagctcaggaatc

SEQ ID NO: 229538 - DNA, 25 bp, Mus musculus
gccaccggcagcctgatggcaaata

SEQ ID NO: 229539 - DNA, 25 bp, Mus musculus
ggacagcgctctcctctcgaaagcg

SEQ ID NO: 229540 - DNA, 25 bp, Mus musculus
atcggcaaaagtggactggatccgg

SEQ ID NO: 229541 - DNA, 25 bp, Mus musculus
cctgatggcaaatatggactgaatc

SEQ ID NO: 229542 - DNA, 25 bp, Mus musculus
aatcccggcgcagattatagggtta

SEQ ID NO: 229543 - DNA, 25 bp, Mus musculus
tgcagcagtgatgatcgcgcgctct

SEQ ID NO: 229544 - DNA, 25 bp, Mus musculus
gctgcagcagtgatgatcgcgcgct

SEQ ID NO: 229545 - DNA, 25 bp, Mus musculus
cagcagtgatgatcgcgcgctctgg

SEQ ID NO: 229546 - DNA, 25 bp, Mus musculus
atgcgagtcggtgtgcgcgctaccc

SEQ ID NO: 229547 - DNA, 25 bp, Mus musculus
cgcgctcccgaactccaggggcttc

SEQ ID NO: 229548 - DNA, 25 bp, Mus musculus
atgtgtcggcaggaagagaaagcca

SEQ ID NO: 229549 - DNA, 25 bp, Mus musculus
tgtcggcaggaagagaaagccagcc

SEQ ID NO: 229550 - DNA, 25 bp, Mus musculus
cggcaggaagagaaagccagccagc

SEQ ID NO: 229551 - DNA, 25 bp, Mus musculus
gcaggaagagaaagccagccagccc

SEQ ID NO: 229552 - DNA, 25 bp, Mus musculus
tggcgcgtgcgacccggcccgctct

SEQ ID NO: 229553 - DNA, 25 bp, Mus musculus
cagcagccggtctccagcctcccct

SEQ ID NO: 229554 - DNA, 25 bp, Mus musculus
ctccgccctcctgccggtgcgcgct

SEQ ID NO: 229555 - DNA, 25 bp, Mus musculus
gctcccgcacccgagccgcttgtcg

SEQ ID NO: 229556 - DNA, 25 bp, Mus musculus
acccgagccgcttgtcgcgggtcac

SEQ ID NO: 229557 - DNA, 25 bp, Mus musculus
cggcggacacctgtttcttccgtgg

SEQ ID NO: 229558 - DNA, 25 bp, Mus musculus
tcccaccgcacgcatgcgcgtcgcg

SEQ ID NO: 229559 - DNA, 25 bp, Mus musculus
acggagactcctgccgtgcccgtcc

SEQ ID NO: 229560 - DNA, 25 bp, Mus musculus
gctcgggcgtgctaccgaagagtcc

SEQ ID NO: 229561 - DNA, 25 bp, Mus musculus
tgctaccgaagagtccgctccgggt

SEQ ID NO: 229562 - DNA, 25 bp, Mus musculus
ccactttaactctgtgagcgcttcg

SEQ ID NO: 229563 - DNA, 25 bp, Mus musculus
actctgtgagcgcttcgagcgcgcg

SEQ ID NO: 229564 - DNA, 25 bp, Mus musculus
gcgcttcactccaccgggcgcgccc

SEQ ID NO: 229565 - DNA, 25 bp, Mus musculus
gagcccgcggccggaactcgttgta

SEQ ID NO: 229566 - DNA, 25 bp, Mus musculus
gggcctccatccttgtctctccacg

SEQ ID NO: 229567 - DNA, 25 bp, Mus musculus
cttgtctctccacggttccgacccg

SEQ ID NO: 229568 - DNA, 25 bp, Mus musculus
gaggaactacttaacgtgtccgtgc

SEQ ID NO: 229569 - DNA, 25 bp, Mus musculus
cgctcggagctcttcctggaaactc

SEQ ID NO: 229570 - DNA, 25 bp, Mus musculus
agaacaacgggttcccgctgctgcc

SEQ ID NO: 229571 - DNA, 25 bp, Mus musculus
ggcaccagctccatgagcggccagg

SEQ ID NO: 229572 - DNA, 25 bp, Mus musculus
tttcccgggctttgtgccgctttgc

SEQ ID NO: 229573 - DNA, 25 bp, Mus musculus
ctgcccaccggaggctccgcgggtt

SEQ ID NO: 229574 - DNA, 25 bp, Mus musculus
ccagcccactgtcggccctgcccac

SEQ ID NO: 229575 - DNA, 25 bp, Mus musculus
ggagtcagccttgccttcacgagag

SEQ ID NO: 229576 - DNA, 25 bp, Mus musculus
cacttcggctcgctccgtcacccgg

SEQ ID NO: 229577 - DNA, 25 bp, Mus musculus
cgcgcccattggctacctgcgcggg

SEQ ID NO: 229578 - DNA, 25 bp, Mus musculus
ccgccgcggcactcgcacttcggct

SEQ ID NO: 229579 - DNA, 25 bp, Mus musculus
ccctcgcgctctggatgggccgtcc

SEQ ID NO: 229580 - DNA, 25 bp, Mus musculus
ggggtccctgctgctacaccgagac

SEQ ID NO: 229581 - DNA, 25 bp, Mus musculus
ccgggcagcgctgcctctgggccac

SEQ ID NO: 229582 - DNA, 25 bp, Mus musculus
cagggctccttgagctgggcgagcg

SEQ ID NO: 229583 - DNA, 25 bp, Mus musculus
cccgggctttgtgccgctttgcaga

SEQ ID NO: 229584 - DNA, 25 bp, Mus musculus
gtcagccttgccttcacgagagacc

SEQ ID NO: 229585 - DNA, 25 bp, Mus musculus
cgcgttccgacacatggcacgactg

SEQ ID NO: 229586 - DNA, 25 bp, Mus musculus
ccggaggacggtctgatgttgtcat

SEQ ID NO: 229587 - DNA, 25 bp, Mus musculus
ccttccgttgatggaccggaggacg

SEQ ID NO: 229588 - DNA, 25 bp, Mus musculus
taggcgatctactctccagacaccg

SEQ ID NO: 229589 - DNA, 25 bp, Mus musculus
acgcgtggccacctaggcgatctac

SEQ ID NO: 229590 - DNA, 25 bp, Mus musculus
cccagaggacccagtgcggtcactg

SEQ ID NO: 229591 - DNA, 25 bp, Mus musculus
agcttccagtttcgggcccagagga

SEQ ID NO: 229592 - DNA, 25 bp, Mus musculus
tggacgacgtcagatcagacgcttg

SEQ ID NO: 229593 - DNA, 25 bp, Mus musculus
agccgtacatgagctgggcggtcct

SEQ ID NO: 229594 - DNA, 25 bp, Mus musculus
tagccaaagctggtccctgggaagc

SEQ ID NO: 229595 - DNA, 25 bp, Mus musculus
cctcctgggactggcgatagccaaa

SEQ ID NO: 229596 - DNA, 25 bp, Mus musculus
ctagggccagcatcgagcacccaaa

SEQ ID NO: 229597 - DNA, 25 bp, Mus musculus
ccatttccgagataccctagggcca

SEQ ID NO: 229598 - DNA, 25 bp, Mus musculus
tggcacgactggagcccatttccga

SEQ ID NO: 229599 - DNA, 25 bp, Mus musculus
acactgggcacatctcggccgcttt

SEQ ID NO: 229600 - DNA, 25 bp, Mus musculus
cacagggagcgggataaacagctgc

SEQ ID NO: 229601 - DNA, 25 bp, Mus musculus
tcgggtttgaatcgcccgctcgttc

SEQ ID NO: 229602 - DNA, 25 bp, Mus musculus
cgggataaacagctgccaacatggc

SEQ ID NO: 229603 - DNA, 25 bp, Mus musculus
tctccaagccgtgcgacactgggca

SEQ ID NO: 229604 - DNA, 25 bp, Mus musculus
ctggcttttgcaaactaccaagttc

SEQ ID NO: 229605 - DNA, 25 bp, Mus musculus
cgcgcctcggagtcggaggtaataa

SEQ ID NO: 229606 - DNA, 25 bp, Mus musculus
taaagtttttatagcgctgggagcc

SEQ ID NO: 229607 - DNA, 25 bp, Mus musculus
ctttcttttgggcatggtggcggca

SEQ ID NO: 229608 - DNA, 25 bp, Mus musculus
gctcgcgccacgtacctttcttttg

SEQ ID NO: 229609 - DNA, 25 bp, Mus musculus
tccaatatggcttctggcgcccgcg

SEQ ID NO: 229610 - DNA, 25 bp, Mus musculus
caccgagcctccaatatggcttctg

SEQ ID NO: 229611 - DNA, 25 bp, Mus musculus
cctcgcggacgcagttttggcggca

SEQ ID NO: 229612 - DNA, 25 bp, Mus musculus
cgctcattggcccagttggggtcac

SEQ ID NO: 229613 - DNA, 25 bp, Mus musculus
cactcccgggcgacttacgacttgg

SEQ ID NO: 229614 - DNA, 25 bp, Mus musculus
tgcacgttaggcgagttgagcctga

SEQ ID NO: 229615 - DNA, 25 bp, Mus musculus
gcaagccctgcacgttaggcgagtt

SEQ ID NO: 229616 - DNA, 25 bp, Mus musculus
ggtctcctattgcaagccctgcacg

SEQ ID NO: 229617 - DNA, 25 bp, Mus musculus
cctacctcttgggtctcctattgca

SEQ ID NO: 229618 - DNA, 25 bp, Mus musculus
gtcacgtgagccgatactcctacct

SEQ ID NO: 229619 - DNA, 25 bp, Mus musculus
gcgagttcttgcgagttggctattg

SEQ ID NO: 229620 - DNA, 25 bp, Mus musculus
acgtcacctctacgtgattggctcc

SEQ ID NO: 229621 - DNA, 25 bp, Mus musculus
atcgagatgtgttcggcccacgcat

SEQ ID NO: 229622 - DNA, 25 bp, Mus musculus
cgacttacgacttggcgctgaaaga

SEQ ID NO: 229623 - DNA, 25 bp, Mus musculus
aggagaaggcgcttttccaccactc

SEQ ID NO: 229624 - DNA, 25 bp, Mus musculus
agccgatactcctacctcttgggtc

SEQ ID NO: 229625 - DNA, 25 bp, Mus musculus
acttggcgctgaaagaacacgtcac

SEQ ID NO: 229626 - DNA, 25 bp, Mus musculus
agttggctattggtggccgctctcg

SEQ ID NO: 229627 - DNA, 25 bp, Mus musculus
aagtccgcatcctcacgtgggcgtc

SEQ ID NO: 229628 - DNA, 25 bp, Mus musculus
tcaggtgagaccctgccaaggggcc

SEQ ID NO: 229629 - DNA, 25 bp, Mus musculus
ggaccatcaatgtcaggtgagaccc

SEQ ID NO: 229630 - DNA, 25 bp, Mus musculus
gcgtgggaccatcaatgtcaggtga

SEQ ID NO: 229631 - DNA, 25 bp, Mus musculus
ctgtgagcgtgggaccatcaatgtc

SEQ ID NO: 229632 - DNA, 25 bp, Mus musculus
agcagctctgtgagcgtgggaccat

SEQ ID NO: 229633 - DNA, 25 bp, Mus musculus
atgtggaccggcgagtgagcagctc

SEQ ID NO: 229634 - DNA, 25 bp, Mus musculus
caccacgactgtggtgggaggccat

SEQ ID NO: 229635 - DNA, 25 bp, Mus musculus
ttccaggaatcgtgaggaatggcgt

SEQ ID NO: 229636 - DNA, 25 bp, Mus musculus
gagccaagtccgcatcctcacgtgg

SEQ ID NO: 229637 - DNA, 25 bp, Mus musculus
ccaaggggccgcaatgtgacccgaa

SEQ ID NO: 229638 - DNA, 25 bp, Mus musculus
gccgcaatgtgacccgaacggtccg

SEQ ID NO: 229639 - DNA, 25 bp, Mus musculus
tgacgcgcacggtgaggaccaccac

SEQ ID NO: 229640 - DNA, 25 bp, Mus musculus
agaccctgccaaggggccgcaatgt

SEQ ID NO: 229641 - DNA, 25 bp, Mus musculus
aagccatccacgtgctcagcggcgt

SEQ ID NO: 229642 - DNA, 25 bp, Mus musculus
tccacgtgctcagcggcgtgtgagt

SEQ ID NO: 229643 - DNA, 25 bp, Mus musculus
gcctatgagcgggttggcttctccg

SEQ ID NO: 229644 - DNA, 25 bp, Mus musculus
ggcttctccggcgaacagttcatcc

SEQ ID NO: 229645 - DNA, 25 bp, Mus musculus
cggcgaacagttcatcctggagaag

SEQ ID NO: 229646 - DNA, 25 bp, Mus musculus
ctggagaagggcgtgtaccgtaact

SEQ ID NO: 229647 - DNA, 25 bp, Mus musculus
ccgtaactgcgacgactggggctcc

SEQ ID NO: 229648 - DNA, 25 bp, Mus musculus
ctggggctccggcaattgcgccctt

SEQ ID NO: 229649 - DNA, 25 bp, Mus musculus
ggctccggcaattgcgcccttggct

SEQ ID NO: 229650 - DNA, 25 bp, Mus musculus
ccttggctcccttcagccagttgtg

SEQ ID NO: 229651 - DNA, 25 bp, Mus musculus
tcagccagttgtgcaggtgtgtatc

SEQ ID NO: 229652 - DNA, 25 bp, Mus musculus
ttgtgcaggtgtgtatctgagcgat

SEQ ID NO: 229653 - DNA, 25 bp, Mus musculus
ggcgtgtaccgtaactgcgacgact

SEQ ID NO: 229654 - DNA, 25 bp, Mus musculus
ggacccagcacgcaagccatccacg

SEQ ID NO: 229655 - DNA, 25 bp, Mus musculus
tggtcgcctgggaaaccccgagaca

SEQ ID NO: 229656 - DNA, 25 bp, Mus musculus
gatgtcgcgcagctatcaggctgtc

SEQ ID NO: 229657 - DNA, 25 bp, Mus musculus
attaggaggatgtcgcgcagctatc

SEQ ID NO: 229658 - DNA, 25 bp, Mus musculus
cccagcaaaggattaggaggatgtc

SEQ ID NO: 229659 - DNA, 25 bp, Mus musculus
tgccaacgtgcccagcaaaggatta

SEQ ID NO: 229660 - DNA, 25 bp, Mus musculus
aaccttcttagtgccaacgtgccca

SEQ ID NO: 229661 - DNA, 25 bp, Mus musculus
ggctttgggcgcactaaccttctta

SEQ ID NO: 229662 - DNA, 25 bp, Mus musculus
catactcaccgtgtccgcgcgtgga

SEQ ID NO: 229663 - DNA, 25 bp, Mus musculus
aagtggggaccatactcaccgtgtc

SEQ ID NO: 229664 - DNA, 25 bp, Mus musculus
tcggcgacatgcatgacttggctca

SEQ ID NO: 229665 - DNA, 25 bp, Mus musculus
ctcgtcctgactccgagggtcggcg

SEQ ID NO: 229666 - DNA, 25 bp, Mus musculus
ccgctaagtcttcccgcaggccgcg

SEQ ID NO: 229667 - DNA, 25 bp, Mus musculus
ctatcaggctgtcgcctggtgtgtc

SEQ ID NO: 229668 - DNA, 25 bp, Mus musculus
tggtgagtgccatctccgggccttt

SEQ ID NO: 229669 - DNA, 25 bp, Mus musculus
agctcttctcgcattccgggctctg

SEQ ID NO: 229670 - DNA, 25 bp, Mus musculus
tcacatggccctgctagccaccttg

SEQ ID NO: 229671 - DNA, 25 bp, Mus musculus
tgctagccaccttgctcctgagcgc

SEQ ID NO: 229672 - DNA, 25 bp, Mus musculus
tgctcctgagcgcagccctgggcgc

SEQ ID NO: 229673 - DNA, 25 bp, Mus musculus
gggcgccttactcagcttcgcgctg

SEQ ID NO: 229674 - DNA, 25 bp, Mus musculus
cttcgcgctgctggcagcggctgtc

SEQ ID NO: 229675 - DNA, 25 bp, Mus musculus
agcggctgtcgccagcgactactgg

SEQ ID NO: 229676 - DNA, 25 bp, Mus musculus
tgtcgccagcgactactggtacatc

SEQ ID NO: 229677 - DNA, 25 bp, Mus musculus
agcgactactggtacatcctggagg

SEQ ID NO: 229678 - DNA, 25 bp, Mus musculus
ctactggtacatcctggaggtggcg

SEQ ID NO: 229679 - DNA, 25 bp, Mus musculus
gcctcggtggcgtgcagctcttctc

SEQ ID NO: 229680 - DNA, 25 bp, Mus musculus
tcttctcgcattccgggctctggcg

SEQ ID NO: 229681 - DNA, 25 bp, Mus musculus
ctgctgtctggctctaactcacatg

SEQ ID NO: 229682 - DNA, 25 bp, Mus musculus
tctggctctaactcacatggccctg

SEQ ID NO: 229683 - DNA, 25 bp, Mus musculus
tggtcggagcacagagacggcccac

SEQ ID NO: 229684 - DNA, 25 bp, Mus musculus
ttacttctcgggagccggtgaccga

SEQ ID NO: 229685 - DNA, 25 bp, Mus musculus
ccggtgaccgacgtgctgtagacgc

SEQ ID NO: 229686 - DNA, 25 bp, Mus musculus
ctgtagacgcgcaggccactcatgc

SEQ ID NO: 229687 - DNA, 25 bp, Mus musculus
cgcaggccactcatgctgcaggcgg

SEQ ID NO: 229688 - DNA, 25 bp, Mus musculus
gacacagaccaactgagggacggtg

SEQ ID NO: 229689 - DNA, 25 bp, Mus musculus
agcggcagctgcacggctaggaact

SEQ ID NO: 229690 - DNA, 25 bp, Mus musculus
gctgcacggctaggaactacgctgc

SEQ ID NO: 229691 - DNA, 25 bp, Mus musculus
acggctaggaactacgctgccgccg

SEQ ID NO: 229692 - DNA, 25 bp, Mus musculus
cgccgcgcttgggagcggtttcctt

SEQ ID NO: 229693 - DNA, 25 bp, Mus musculus
ttgggagcggtttccttcctgctcc

SEQ ID NO: 229694 - DNA, 25 bp, Mus musculus
actgctctcgggaccaatgagctgc

SEQ ID NO: 229695 - DNA, 25 bp, Mus musculus
ctcgggaccaatgagctgcgcaggc

SEQ ID NO: 229696 - DNA, 25 bp, Mus musculus
gcacacacttacttctcgggagccg

SEQ ID NO: 229697 - DNA, 25 bp, Mus musculus
ctgcgcatgacacagaggctactta

SEQ ID NO: 229698 - DNA, 25 bp, Mus musculus
ccttcagtttctcggccctttgtga

SEQ ID NO: 229699 - DNA, 25 bp, Mus musculus
ggctacttagctcggtcttctcgca

SEQ ID NO: 229700 - DNA, 25 bp, Mus musculus
aatggacactcaggccgctctcgtg

SEQ ID NO: 229701 - DNA, 25 bp, Mus musculus
actcactctgggacactgacggcga

SEQ ID NO: 229702 - DNA, 25 bp, Mus musculus
caagaagctaggtcccgactttcca

SEQ ID NO: 229703 - DNA, 25 bp, Mus musculus
tggaattaccgctcggtccgtctgc

SEQ ID NO: 229704 - DNA, 25 bp, Mus musculus
tccttagccagggaactcagccggt

SEQ ID NO: 229705 - DNA, 25 bp, Mus musculus
aagtatggaatctgccgtggggtca

SEQ ID NO: 229706 - DNA, 25 bp, Mus musculus
gcgtctggcacacaagtatggaatc

SEQ ID NO: 229707 - DNA, 25 bp, Mus musculus
gggccgtgggctcttaaccagagca

SEQ ID NO: 229708 - DNA, 25 bp, Mus musculus
gaacgtctattcttgcccggctctt

SEQ ID NO: 229709 - DNA, 25 bp, Mus musculus
cgagtgacaacttgccgaacgtcta

SEQ ID NO: 229710 - DNA, 25 bp, Mus musculus
gtgaaaggtctccactcgccgagtg

SEQ ID NO: 229711 - DNA, 25 bp, Mus musculus
cgtgcgtagtgaactaagggcatca

SEQ ID NO: 229712 - DNA, 25 bp, Mus musculus
aaggaatcccggagcccaaggcagc

SEQ ID NO: 229713 - DNA, 25 bp, Mus musculus
cccaggcctccggtgacattgaggt

SEQ ID NO: 229714 - DNA, 25 bp, Mus musculus
ggagtcgtgagtgcagtccctccca

SEQ ID NO: 229715 - DNA, 25 bp, Mus musculus
cgagagatcagcaagaggaagccct

SEQ ID NO: 229716 - DNA, 25 bp, Mus musculus
acttcaacgtggagaagcgagcgga

SEQ ID NO: 229717 - DNA, 25 bp, Mus musculus
ctaagggcatcatgatttagagatg

SEQ ID NO: 229718 - DNA, 25 bp, Mus musculus
cggtggcttctacacgtgcgtagtg

SEQ ID NO: 229719 - DNA, 25 bp, Mus musculus
tcaccggtgccggtggcttctacac

SEQ ID NO: 229720 - DNA, 25 bp, Mus musculus
atgctccgtgcgtacagaggtcacc

SEQ ID NO: 229721 - DNA, 25 bp, Mus musculus
cgagcgcgtcctcggcgttttaccg

SEQ ID NO: 229722 - DNA, 25 bp, Mus musculus
aacgcccagatgtctgcgcatgcgc

SEQ ID NO: 229723 - DNA, 25 bp, Mus musculus
ggcgtccctgacaacgcccagatgt

SEQ ID NO: 229724 - DNA, 25 bp, Mus musculus
gtgacccgcgccttaaggaacttca

SEQ ID NO: 229725 - DNA, 25 bp, Mus musculus
ctaaggaatgtgctcggtgcgcgcc

SEQ ID NO: 229726 - DNA, 25 bp, Mus musculus
aggggagccggtcccactattctgc

SEQ ID NO: 229727 - DNA, 25 bp, Mus musculus
cccagatggtcgtcgatgatagtga

SEQ ID NO: 229728 - DNA, 25 bp, Mus musculus
actgcctctgatgacgtcacggtcg

SEQ ID NO: 229729 - DNA, 25 bp, Mus musculus
agcaggattggacagactgcctctg

SEQ ID NO: 229730 - DNA, 25 bp, Mus musculus
agacccacacgtgttggcgcttccg

SEQ ID NO: 229731 - DNA, 25 bp, Mus musculus
gagacacccacacacaagaccaaga

SEQ ID NO: 229732 - DNA, 25 bp, Mus musculus
tccgccgagagcgacccatgatcag

SEQ ID NO: 229733 - DNA, 25 bp, Mus musculus
tcttggccttcatctggcgggctaa

SEQ ID NO: 229734 - DNA, 25 bp, Mus musculus
atgaatctcatccaggtccggccgc

SEQ ID NO: 229735 - DNA, 25 bp, Mus musculus
gcctcagctcgcgatgaatctcatc

SEQ ID NO: 229736 - DNA, 25 bp, Mus musculus
aagccagacagcgatgcaggccgcc

SEQ ID NO: 229737 - DNA, 25 bp, Mus musculus
tggactcacgcgcaagccagacagc

SEQ ID NO: 229738 - DNA, 25 bp, Mus musculus
cgacccatgatcagagagacaccca

SEQ ID NO: 229739 - DNA, 25 bp, Mus musculus
gaccaggattctgggacgcgttcgc

SEQ ID NO: 229740 - DNA, 25 bp, Mus musculus
cccgagacacgggaggcggatccag

SEQ ID NO: 229741 - DNA, 25 bp, Mus musculus
ggaggctaccgagtgccccgagaca

SEQ ID NO: 229742 - DNA, 25 bp, Mus musculus
ctgacgaggaggctaccgagtgccc

SEQ ID NO: 229743 - DNA, 25 bp, Mus musculus
acaagcctgacgaggaggctaccga

SEQ ID NO: 229744 - DNA, 25 bp, Mus musculus
aggcggccacagctgagaccgagcc

SEQ ID NO: 229745 - DNA, 25 bp, Mus musculus
ggccacagctgagaccgagccgcgc

SEQ ID NO: 229746 - DNA, 25 bp, Mus musculus
cggaccaggattctgggacgcgttc

SEQ ID NO: 229747 - DNA, 25 bp, Mus musculus
aggacaagcctgacgaggaggctac

SEQ ID NO: 229748 - DNA, 25 bp, Mus musculus
caggattctgggacgcgttcgccag

SEQ ID NO: 229749 - DNA, 25 bp, Mus musculus
ttctgggacgcgttcgccagcaggt

SEQ ID NO: 229750 - DNA, 25 bp, Mus musculus
cggcgtccatgctgcgcggcgtgga

SEQ ID NO: 229751 - DNA, 25 bp, Mus musculus
tgcgcggcgtggagaccgccgcgga

SEQ ID NO: 229752 - DNA, 25 bp, Mus musculus
ccgagccgcgcggaccaggattctg

SEQ ID NO: 229753 - DNA, 25 bp, Mus musculus
ctggcagccgtacaaccactggatg

SEQ ID NO: 229754 - DNA, 25 bp, Mus musculus
tggtggtcacacctcagactcgcgc

SEQ ID NO: 229755 - DNA, 25 bp, Mus musculus
cgtccctgtcgctggatgtccaatc

SEQ ID NO: 229756 - DNA, 25 bp, Mus musculus
ctggatgtccaatcgctggtgtccc

SEQ ID NO: 229757 - DNA, 25 bp, Mus musculus
cgctccaagccgcagtagttgaaga

SEQ ID NO: 229758 - DNA, 25 bp, Mus musculus
ctttctccgacagtggcagcgagca

SEQ ID NO: 229759 - DNA, 25 bp, Mus musculus
tttcctgtcgcctctggtgtatccg

SEQ ID NO: 229760 - DNA, 25 bp, Mus musculus
ccttggcgttctctttgttcaccga

SEQ ID NO: 229761 - DNA, 25 bp, Mus musculus
tgcagtccctcttctggcggtaaaa

SEQ ID NO: 229762 - DNA, 25 bp, Mus musculus
ataagggagtcaggtcttggctgtc

SEQ ID NO: 229763 - DNA, 25 bp, Mus musculus
ggctggctcctgacgacgtacaatc

SEQ ID NO: 229764 - DNA, 25 bp, Mus musculus
caatcacctggtgcgtcttgacgta

SEQ ID NO: 229765 - DNA, 25 bp, Mus musculus
acgtacttggctttgtcggcttcca

SEQ ID NO: 229766 - DNA, 25 bp, Mus musculus
gcacccaggaaaaggcgtcgtacta

SEQ ID NO: 229767 - DNA, 25 bp, Mus musculus
tggccaagcagcaagctcactccgg

SEQ ID NO: 229768 - DNA, 25 bp, Mus musculus
ctggctgcacctacgttccgaggca

SEQ ID NO: 229769 - DNA, 25 bp, Mus musculus
gatgcccggtgcatcttcctcgctg

SEQ ID NO: 229770 - DNA, 25 bp, Mus musculus
tcttcagacctaccgagcggcgggc

SEQ ID NO: 229771 - DNA, 25 bp, Mus musculus
cagagcggaccaatgctgccctgca

SEQ ID NO: 229772 - DNA, 25 bp, Mus musculus
cacagccgagcgtttccagcggtgt

SEQ ID NO: 229773 - DNA, 25 bp, Mus musculus
tgcaggccgccattatcgcgcagct

SEQ ID NO: 229774 - DNA, 25 bp, Mus musculus
gccaggtttacctcagggcagccgc

SEQ ID NO: 229775 - DNA, 25 bp, Mus musculus
agaccggttctgactgcggggcatc

SEQ ID NO: 229776 - DNA, 25 bp, Mus musculus
ccactgagaggtccgtgacaggcct

SEQ ID NO: 229777 - DNA, 25 bp, Mus musculus
ttcccggggatgactccactgagag

SEQ ID NO: 229778 - DNA, 25 bp, Mus musculus
gtcgcttcaactcctggcggctgca

SEQ ID NO: 229779 - DNA, 25 bp, Mus musculus
agcgggcctcgcagtcgcttcaact

SEQ ID NO: 229780 - DNA, 25 bp, Mus musculus
acgttccgaggcaccgagctgtgtt

SEQ ID NO: 229781 - DNA, 25 bp, Mus musculus
gctcagctccttcgggctccgggga

SEQ ID NO: 229782 - DNA, 25 bp, Mus musculus
agctgggcagcatcacacgtacctc

SEQ ID NO: 229783 - DNA, 25 bp, Mus musculus
gcgcggagcccggtaagttcaagcc

SEQ ID NO: 229784 - DNA, 25 bp, Mus musculus
cagactatggacaagcagaacctgc

SEQ ID NO: 229785 - DNA, 25 bp, Mus musculus
agaggcggcatgcagactatggaca

SEQ ID NO: 229786 - DNA, 25 bp, Mus musculus
gcgcaacttcgagggcgcaccgaga

SEQ ID NO: 229787 - DNA, 25 bp, Mus musculus
ctcctctttgaccatctcggctgtg

SEQ ID NO: 229788 - DNA, 25 bp, Mus musculus
aaggtgactgcgagctgccatcgtc

SEQ ID NO: 229789 - DNA, 25 bp, Mus musculus
cttttgcacacgacgcgcggcgggc

SEQ ID NO: 229790 - DNA, 25 bp, Mus musculus
cgcgggcttttgcacacgacgcgcg

SEQ ID NO: 229791 - DNA, 25 bp, Mus musculus
agagccgcaattccctttgcagccg

SEQ ID NO: 229792 - DNA, 25 bp, Mus musculus
gggcagagccgcaattccctttgca

SEQ ID NO: 229793 - DNA, 25 bp, Mus musculus
accatctcggctgtggttggtccga

SEQ ID NO: 229794 - DNA, 25 bp, Mus musculus
gcttgaactgggacccgatccgagg

SEQ ID NO: 229795 - DNA, 25 bp, Mus musculus
cccattgtctgaaggagagcgaggc

SEQ ID NO: 229796 - DNA, 25 bp, Mus musculus
gcacgtgccgtcacccgcagccaat

SEQ ID NO: 229797 - DNA, 25 bp, Mus musculus
gcagccaatgcggagcgcctggtct

SEQ ID NO: 229798 - DNA, 25 bp, Mus musculus
cgcctggtctgggtcacgtgccgct

SEQ ID NO: 229799 - DNA, 25 bp, Mus musculus
acgtgccgctgtttggcgcttttgt

SEQ ID NO: 229800 - DNA, 25 bp, Mus musculus
tttggcgcttttgtgcgcgcccagg

SEQ ID NO: 229801 - DNA, 25 bp, Mus musculus
tctgttggtgctcagagtgtggcca

SEQ ID NO: 229802 - DNA, 25 bp, Mus musculus
ctcgggcggagccttggcttttgtc

SEQ ID NO: 229803 - DNA, 25 bp, Mus musculus
ctattccctggagatgcgggctgga

SEQ ID NO: 229804 - DNA, 25 bp, Mus musculus
ggcgtgagccgtcctctgcatctac

SEQ ID NO: 229805 - DNA, 25 bp, Mus musculus
gacagctctgggcactccgtcagtg

SEQ ID NO: 229806 - DNA, 25 bp, Mus musculus
cactccgtcagtgggtgaaggccgt

SEQ ID NO: 229807 - DNA, 25 bp, Mus musculus
cgtgttctgattggcccgggccgcc

SEQ ID NO: 229808 - DNA, 25 bp, Mus musculus
acaataggaggcgtgagccgtcctc

SEQ ID NO: 229809 - DNA, 25 bp, Mus musculus
ccgccacttttctggaagccgtaca

SEQ ID NO: 229810 - DNA, 25 bp, Mus musculus
tctggaagccgtacatctatgctgg

SEQ ID NO: 229811 - DNA, 25 bp, Mus musculus
tacatctatgctggctaccggccgc

SEQ ID NO: 229812 - DNA, 25 bp, Mus musculus
taccggccgctgcatcagaactggt

SEQ ID NO: 229813 - DNA, 25 bp, Mus musculus
gccgctgcatcagaactggtgtttc

SEQ ID NO: 229814 - DNA, 25 bp, Mus musculus
gaactggtgtttctacttccgcaca

SEQ ID NO: 229815 - DNA, 25 bp, Mus musculus
gcacactgtttcagcggcacaacga

SEQ ID NO: 229816 - DNA, 25 bp, Mus musculus
tttcagcggcacaacgaggctgtga

SEQ ID NO: 229817 - DNA, 25 bp, Mus musculus
aacgaggctgtgaacgtgtggaccc

SEQ ID NO: 229818 - DNA, 25 bp, Mus musculus
tgtgaacgtgtggacccacctcctg

SEQ ID NO: 229819 - DNA, 25 bp, Mus musculus
aacgtgtggacccacctcctggcgg

SEQ ID NO: 229820 - DNA, 25 bp, Mus musculus
gcaagtgtggacttccgggaagacc

SEQ ID NO: 229821 - DNA, 25 bp, Mus musculus
ggtgtttctacttccgcacactgtt

SEQ ID NO: 229822 - DNA, 25 bp, Mus musculus
caggtgccgccacttttctggaagc

SEQ ID NO: 229823 - DNA, 25 bp, Mus musculus
gtgcaccactgagcgtcctcaaatg

SEQ ID NO: 229824 - DNA, 25 bp, Mus musculus
aggacagtctcttccgtgccagcgg

SEQ ID NO: 229825 - DNA, 25 bp, Mus musculus
cactcgtctttctcggccgcaggag

SEQ ID NO: 229826 - DNA, 25 bp, Mus musculus
gcatagcatggctgtggcactcgtc

SEQ ID NO: 229827 - DNA, 25 bp, Mus musculus
aacaggctgcgtagcatggcggccc

SEQ ID NO: 229828 - DNA, 25 bp, Mus musculus
ttcctagaccactgagcccagggca

SEQ ID NO: 229829 - DNA, 25 bp, Mus musculus
tcaccgtgtcgctgcgtaggtccac

SEQ ID NO: 229830 - DNA, 25 bp, Mus musculus
gcttcggccatagcgcgcctcatgg

SEQ ID NO: 229831 - DNA, 25 bp, Mus musculus
gggtcttcgccgtaatcatcgtctc

SEQ ID NO: 229832 - DNA, 25 bp, Mus musculus
tcaccgtggaccgtagggtcttcgc

SEQ ID NO: 229833 - DNA, 25 bp, Mus musculus
tcctgtcagaaccacggacagcgtc

SEQ ID NO: 229834 - DNA, 25 bp, Mus musculus
tctgcgtccgtgctgtcctgtcaga

SEQ ID NO: 229835 - DNA, 25 bp, Mus musculus
cgtcctcaaatgtcagcgaggcacc

SEQ ID NO: 229836 - DNA, 25 bp, Mus musculus
aacccgtgtaactggactcttctga

SEQ ID NO: 229837 - DNA, 25 bp, Mus musculus
aggcctttgaactggcgcctcaggc

SEQ ID NO: 229838 - DNA, 25 bp, Mus musculus
ccggcttccttagcgcactgggcgt

SEQ ID NO: 229839 - DNA, 25 bp, Mus musculus
tccttagcgcactgggcgtggttag

SEQ ID NO: 229840 - DNA, 25 bp, Mus musculus
gcttacgtcattacggccgggcaga

SEQ ID NO: 229841 - DNA, 25 bp, Mus musculus
tgcctcctgcagtggcgggagatct

SEQ ID NO: 229842 - DNA, 25 bp, Mus musculus
atctgaacgcgggttggcgctaacg

SEQ ID NO: 229843 - DNA, 25 bp, Mus musculus
cgctaacgccggctgcagtggtgcg

SEQ ID NO: 229844 - DNA, 25 bp, Mus musculus
ccgccatgaggcatagagggcccga

SEQ ID NO: 229845 - DNA, 25 bp, Mus musculus
gatgcaggtgggacgccaatattga

SEQ ID NO: 229846 - DNA, 25 bp, Mus musculus
tgggacgccaatattgaggcgatac

SEQ ID NO: 229847 - DNA, 25 bp, Mus musculus
atattgaggcgatacgcgggctttg

SEQ ID NO: 229848 - DNA, 25 bp, Mus musculus
tcggcataaagggaggacgggattc

SEQ ID NO: 229849 - DNA, 25 bp, Mus musculus
cagcgtgaggcctttgaactggcgc

SEQ ID NO: 229850 - DNA, 25 bp, Mus musculus
actggcagcgtgaggcctttgaact

SEQ ID NO: 229851 - DNA, 25 bp, Mus musculus
ctccggcagccgctgtaagcacttg

SEQ ID NO: 229852 - DNA, 25 bp, Mus musculus
ggcttgcttttaagaaaccgctgta

SEQ ID NO: 229853 - DNA, 25 bp, Mus musculus
ctgtaggcgacactaacttggcttc

SEQ ID NO: 229854 - DNA, 25 bp, Mus musculus
ctagacgctctagccggttccgcag

SEQ ID NO: 229855 - DNA, 25 bp, Mus musculus
tcctgggccagggagaaactttagc

SEQ ID NO: 229856 - DNA, 25 bp, Mus musculus
ggagaaactttagcccagcggtgcc

SEQ ID NO: 229857 - DNA, 25 bp, Mus musculus
ctcagtagcctccaggccggcgtag

SEQ ID NO: 229858 - DNA, 25 bp, Mus musculus
cagcaactacgcctggggaccagtg

SEQ ID NO: 229859 - DNA, 25 bp, Mus musculus
gcgactcccgcgagaacttgcacgg

SEQ ID NO: 229860 - DNA, 25 bp, Mus musculus
aacttgcacgggaacagggaacgcg

SEQ ID NO: 229861 - DNA, 25 bp, Mus musculus
acccgcctccggaagcaatcatttg

SEQ ID NO: 229862 - DNA, 25 bp, Mus musculus
aatcatttgcagctgcgcggcgagc

SEQ ID NO: 229863 - DNA, 25 bp, Mus musculus
caaggtcggccaagttcctaccgcg

SEQ ID NO: 229864 - DNA, 25 bp, Mus musculus
tggaagtaaccgaacggcccatatc

SEQ ID NO: 229865 - DNA, 25 bp, Mus musculus
tgcagggaaggggatcgcacggcgc

SEQ ID NO: 229866 - DNA, 25 bp, Mus musculus
actttttaccctgtcctggccattg

SEQ ID NO: 229867 - DNA, 25 bp, Mus musculus
ctttttaccctgtcctggccattgt

SEQ ID NO: 229868 - DNA, 25 bp, Mus musculus
cggggtagagctttgctctgcgcct

SEQ ID NO: 229869 - DNA, 25 bp, Mus musculus
ggggtagagctttgctctgcgcctc

SEQ ID NO: 229870 - DNA, 25 bp, Mus musculus
tgcagccactgtccccctcctgtcc

SEQ ID NO: 229871 - DNA, 25 bp, Mus musculus
cgaggagcgcgcaggcccgggcagc

SEQ ID NO: 229872 - DNA, 25 bp, Mus musculus
cagcagggtggactgccggcccatc

SEQ ID NO: 229873 - DNA, 25 bp, Mus musculus
gcagggtggactgccggcccatcac

SEQ ID NO: 229874 - DNA, 25 bp, Mus musculus
tgccggcccatcactgccggggaaa

SEQ ID NO: 229875 - DNA, 25 bp, Mus musculus
cggcccatcactgccggggaaagag

SEQ ID NO: 229876 - DNA, 25 bp, Mus musculus
aggtcccgagggcacagcgcctgct

SEQ ID NO: 229877 - DNA, 25 bp, Mus musculus
gcacagcgcctgctcagccggtcca

SEQ ID NO: 229878 - DNA, 25 bp, Mus musculus
ccgcctgggcgtcggcgaggagcgc

SEQ ID NO: 229879 - DNA, 25 bp, Mus musculus
tgtccgcaaagttccgggaggcagc

SEQ ID NO: 229880 - DNA, 25 bp, Mus musculus
agacctcgcggagggctgtgaccct

SEQ ID NO: 229881 - DNA, 25 bp, Mus musculus
ggctccgccgagcagacctcgcgga

SEQ ID NO: 229882 - DNA, 25 bp, Mus musculus
cgatgtcctgcgctgcttcgggcct

SEQ ID NO: 229883 - DNA, 25 bp, Mus musculus
ggccacgcgatgtcctgcgctgctt

SEQ ID NO: 229884 - DNA, 25 bp, Mus musculus
ggcagccggcaacccggagaggctc

SEQ ID NO: 229885 - DNA, 25 bp, Mus musculus
aagcggctgactcggcagccggcaa

SEQ ID NO: 229886 - DNA, 25 bp, Mus musculus
ttccctggcaggcgagcgcatcctg

SEQ ID NO: 229887 - DNA, 25 bp, Mus musculus
ttccgggaggcagcggtcgcctact

SEQ ID NO: 229888 - DNA, 25 bp, Mus musculus
ctgcggtgcgatgtccgcaaagttc

SEQ ID NO: 229889 - DNA, 25 bp, Mus musculus
ctttaagagcgagcgctggttaacc

SEQ ID NO: 229890 - DNA, 25 bp, Mus musculus
gcgcctttaagagcgagcgctggtt

SEQ ID NO: 229891 - DNA, 25 bp, Mus musculus
gcctaaccagcagcgggcgccttta

SEQ ID NO: 229892 - DNA, 25 bp, Mus musculus
gccttttgtgcgaggtgtgagcgct

SEQ ID NO: 229893 - DNA, 25 bp, Mus musculus
ccgagcaaggctgcgcacctcgagg

SEQ ID NO: 229894 - DNA, 25 bp, Mus musculus
tcgggacacgtccacaactttgctc

SEQ ID NO: 229895 - DNA, 25 bp, Mus musculus
cttcccgcgccggagtggtcacatg

SEQ ID NO: 229896 - DNA, 25 bp, Mus musculus
gggtctcctgctgcgatcacctgtt

SEQ ID NO: 229897 - DNA, 25 bp, Mus musculus
gcctgccgctgagccaggaagcctt

SEQ ID NO: 229898 - DNA, 25 bp, Mus musculus
acccaggggcttcagatgctcgcgc

SEQ ID NO: 229899 - DNA, 25 bp, Mus musculus
tctggagcagtttgcaaagggaacc

SEQ ID NO: 229900 - DNA, 25 bp, Mus musculus
acccgaagtttcagcctctggagca

SEQ ID NO: 229901 - DNA, 25 bp, Mus musculus
gagtggtcacatgccgtccgcgacg

SEQ ID NO: 229902 - DNA, 25 bp, Mus musculus
tcagggagtttggagcgagtcctcc

SEQ ID NO: 229903 - DNA, 25 bp, Mus musculus
tcctcagagtcctcaagggtgggga

SEQ ID NO: 229904 - DNA, 25 bp, Mus musculus
cccgggagtcctcagagtcctcaag

SEQ ID NO: 229905 - DNA, 25 bp, Mus musculus
gaaaaggaacttctgcggcagccgc

SEQ ID NO: 229906 - DNA, 25 bp, Mus musculus
aagcctgcagctggcctctgtcagc

SEQ ID NO: 229907 - DNA, 25 bp, Mus musculus
cccagacgtgcagccggacatgacc

SEQ ID NO: 229908 - DNA, 25 bp, Mus musculus
gacgaagccacccagtccaccttgg

SEQ ID NO: 229909 - DNA, 25 bp, Mus musculus
taccgccgccaaaactcctccagga

SEQ ID NO: 229910 - DNA, 25 bp, Mus musculus
ccagactggggctccggattagcgc

SEQ ID NO: 229911 - DNA, 25 bp, Mus musculus
gcccagctctgcttggccagactgg

SEQ ID NO: 229912 - DNA, 25 bp, Mus musculus
gcgcatacactcactgcggtgccgg

SEQ ID NO: 229913 - DNA, 25 bp, Mus musculus
cccgagttaagcctgatccctgtcg

SEQ ID NO: 229914 - DNA, 25 bp, Mus musculus
tgggtagagaggctctagacgtccc

SEQ ID NO: 229915 - DNA, 25 bp, Mus musculus
gacctgcgaaactccagcgtccaga

SEQ ID NO: 229916 - DNA, 25 bp, Mus musculus
aggcagggacctgcgaaactccagc

SEQ ID NO: 229917 - DNA, 25 bp, Mus musculus
cgggaccctgaatggcacccgggct

SEQ ID NO: 229918 - DNA, 25 bp, Mus musculus
ggaagcgggaccctgaatggcaccc

SEQ ID NO: 229919 - DNA, 25 bp, Mus musculus
gttaagcctgatccctgtcgacctg

SEQ ID NO: 229920 - DNA, 25 bp, Mus musculus
ccggggcgcatacactcactgcggt

SEQ ID NO: 229921 - DNA, 25 bp, Mus musculus
atgtgcttcagtcagccgcgtcctt

SEQ ID NO: 229922 - DNA, 25 bp, Mus musculus
agcttactgcagtcggcgttccgcc

SEQ ID NO: 229923 - DNA, 25 bp, Mus musculus
cggccggtcacacagacatggagcc

SEQ ID NO: 229924 - DNA, 25 bp, Mus musculus
ggacggcccgcatagccaatcgaag

SEQ ID NO: 229925 - DNA, 25 bp, Mus musculus
ccgctgaggcaacacggacccttaa

SEQ ID NO: 229926 - DNA, 25 bp, Mus musculus
ggacagaaggacacaccaatcagga

SEQ ID NO: 229927 - DNA, 25 bp, Mus musculus
tcaggataaggcctagacgcgtggc

SEQ ID NO: 229928 - DNA, 25 bp, Mus musculus
ggccgggcctatcagaaaagagtta

SEQ ID NO: 229929 - DNA, 25 bp, Mus musculus
atgccttgttgcgaaggtacgcttc

SEQ ID NO: 229930 - DNA, 25 bp, Mus musculus
cccgcctggcgtgtgagaaccgaac

SEQ ID NO: 229931 - DNA, 25 bp, Mus musculus
ccgcgtccttatgtaagagggcgtc

SEQ ID NO: 229932 - DNA, 25 bp, Mus musculus
ggaccttgcgctgacatgtgcttca

SEQ ID NO: 229933 - DNA, 25 bp, Mus musculus
cctgccgtagataccctcggtgatc

SEQ ID NO: 229934 - DNA, 25 bp, Mus musculus
tacgcttcgcggttattgggctgcg

SEQ ID NO: 229935 - DNA, 25 bp, Mus musculus
ccgagtcagtgcgcatgcggatcga

SEQ ID NO: 229936 - DNA, 25 bp, Mus musculus
actccagttctgcaagaaaacaaaa

SEQ ID NO: 229937 - DNA, 25 bp, Mus musculus
agccacaggcaatcagactcccgga

SEQ ID NO: 229938 - DNA, 25 bp, Mus musculus
cggatgtcgatgtgccggtccgccc

SEQ ID NO: 229939 - DNA, 25 bp, Mus musculus
tcagactcccggatgtcgatgtgcc

SEQ ID NO: 229940 - DNA, 25 bp, Mus musculus
gggtgcagcctatgggccacgccca

SEQ ID NO: 229941 - DNA, 25 bp, Mus musculus
tggtagcctcggtttactccagttc

SEQ ID NO: 229942 - DNA, 25 bp, Mus musculus
ctcacgtccaagtccggagttggga

SEQ ID NO: 229943 - DNA, 25 bp, Mus musculus
cgcactcacgtccaagtccggagtt

SEQ ID NO: 229944 - DNA, 25 bp, Mus musculus
gctccacagttctggggaagagtcc

SEQ ID NO: 229945 - DNA, 25 bp, Mus musculus
atgagcgtgcccagctccacagttc

SEQ ID NO: 229946 - DNA, 25 bp, Mus musculus
acgcgccaccgtcggatgagcgtgc

SEQ ID NO: 229947 - DNA, 25 bp, Mus musculus
ctcggtttactccagttctgcaaga

SEQ ID NO: 229948 - DNA, 25 bp, Mus musculus
ggcacggccactgccgcgagttcga

SEQ ID NO: 229949 - DNA, 25 bp, Mus musculus
gcgtgtctccaaggcgcagccaaca

SEQ ID NO: 229950 - DNA, 25 bp, Mus musculus
caccggtggtcgtactacgcgatca

SEQ ID NO: 229951 - DNA, 25 bp, Mus musculus
ggtactacaagtcgccgtcgcccta

SEQ ID NO: 229952 - DNA, 25 bp, Mus musculus
tatcaccgcgacagccgttacgagc

SEQ ID NO: 229953 - DNA, 25 bp, Mus musculus
tctccgcaggagaaagcctcgccgt

SEQ ID NO: 229954 - DNA, 25 bp, Mus musculus
atacgtgaacgacatgtggcccggc

SEQ ID NO: 229955 - DNA, 25 bp, Mus musculus
ctcggccgccatgtctaaatacgtg

SEQ ID NO: 229956 - DNA, 25 bp, Mus musculus
ccgttttcagaagggagccatgtcc

SEQ ID NO: 229957 - DNA, 25 bp, Mus musculus
tctctgtagttcctagacgccgttg

SEQ ID NO: 229958 - DNA, 25 bp, Mus musculus
cccacctggatgatagactcttgac

SEQ ID NO: 229959 - DNA, 25 bp, Mus musculus
tcgcgagctcttcatccgtttaagg

SEQ ID NO: 229960 - DNA, 25 bp, Mus musculus
ttcgatgctgacgtcgccactaagc

SEQ ID NO: 229961 - DNA, 25 bp, Mus musculus
ccgccctttcgcacggatgtctgtg

SEQ ID NO: 229962 - DNA, 25 bp, Mus musculus
cggcgccagcttccagtattttcga

SEQ ID NO: 229963 - DNA, 25 bp, Mus musculus
ggaaggcgcaccacgcaccagatct

SEQ ID NO: 229964 - DNA, 25 bp, Mus musculus
tacgcaagttccgtgagctgcatct

SEQ ID NO: 229965 - DNA, 25 bp, Mus musculus
gcgggagcagagactacgcaagttc

SEQ ID NO: 229966 - DNA, 25 bp, Mus musculus
gaagccggttatgatcgcaggtccc

SEQ ID NO: 229967 - DNA, 25 bp, Mus musculus
acgccgagcctgaagccggttatga

SEQ ID NO: 229968 - DNA, 25 bp, Mus musculus
tatcaccggcttcgcgtaggtgtca

SEQ ID NO: 229969 - DNA, 25 bp, Mus musculus
gactgaagttgtggtgagtatcacc

SEQ ID NO: 229970 - DNA, 25 bp, Mus musculus
ctgtaatggcggctgtgactgaagt

SEQ ID NO: 229971 - DNA, 25 bp, Mus musculus
ccggaagtgctcagcgttgttgacg

SEQ ID NO: 229972 - DNA, 25 bp, Mus musculus
acgccatcgggaaggcttgagtctg

SEQ ID NO: 229973 - DNA, 25 bp, Mus musculus
aggccggaagaaactgacgccatcg

SEQ ID NO: 229974 - DNA, 25 bp, Mus musculus
ctcgggttgagatcgctttgacaca

SEQ ID NO: 229975 - DNA, 25 bp, Mus musculus
gcgtcagtccctcccactaaaagga

SEQ ID NO: 229976 - DNA, 25 bp, Mus musculus
gcgcatagccataccacgcgtcagt

SEQ ID NO: 229977 - DNA, 25 bp, Mus musculus
gcttactggaaacgcgctcccgagc

SEQ ID NO: 229978 - DNA, 25 bp, Mus musculus
agctgcacagccagctgcctccctt

SEQ ID NO: 229979 - DNA, 25 bp, Mus musculus
tcccttcccggtatgcgcgcgggaa

SEQ ID NO: 229980 - DNA, 25 bp, Mus musculus
cagggctgcgttgggcccatgccac

SEQ ID NO: 229981 - DNA, 25 bp, Mus musculus
ccgcgccatcgtgcagggctgcgtt

SEQ ID NO: 229982 - DNA, 25 bp, Mus musculus
actggccgcgccatcgtgcagggct

SEQ ID NO: 229983 - DNA, 25 bp, Mus musculus
ccgcccttggccgagggcagagctg

SEQ ID NO: 229984 - DNA, 25 bp, Mus musculus
actgtcgggaacagctgcgctggct

SEQ ID NO: 229985 - DNA, 25 bp, Mus musculus
cgggccaaactgtcgggaacagctg

SEQ ID NO: 229986 - DNA, 25 bp, Mus musculus
tgtgtgcgcccgcaccgggccaaac

SEQ ID NO: 229987 - DNA, 25 bp, Mus musculus
tgcattgatcgctggcgtagacgcg

SEQ ID NO: 229988 - DNA, 25 bp, Mus musculus
tgcttgcattgatcgctggcgtaga

SEQ ID NO: 229989 - DNA, 25 bp, Mus musculus
agccggggatgcttgcattgatcgc

SEQ ID NO: 229990 - DNA, 25 bp, Mus musculus
gctggctcgcgcttactggaaacgc

SEQ ID NO: 229991 - DNA, 25 bp, Mus musculus
gcaaagggcccacgcgtgaaccgat

SEQ ID NO: 229992 - DNA, 25 bp, Mus musculus
gcccacgcgtgaaccgatcttgcag

SEQ ID NO: 229993 - DNA, 25 bp, Mus musculus
ccgatcttgcagcaggtgtcgctcc

SEQ ID NO: 229994 - DNA, 25 bp, Mus musculus
aagtgtcgctcgctcgctagatggc

SEQ ID NO: 229995 - DNA, 25 bp, Mus musculus
agatggctgcgtccgttcgccacag

SEQ ID NO: 229996 - DNA, 25 bp, Mus musculus
gaggtgccttcacgacacgccgcgg

SEQ ID NO: 229997 - DNA, 25 bp, Mus musculus
cgcggccctgacagatctgataaag

SEQ ID NO: 229998 - DNA, 25 bp, Mus musculus
aagccggcgacgctgcggatctgaa

SEQ ID NO: 229999 - DNA, 25 bp, Mus musculus
cgctgcggatctgaactgacaactc

SEQ ID NO: 230000 - DNA, 25 bp, Mus musculus
ctgagagagggtcgcctgcgccctc

SEQ ID NO: 230001 - DNA, 25 bp, Mus musculus
ccctctgccggctgtttggagaaag

SEQ ID NO: 230002 - DNA, 25 bp, Mus musculus
gctgtttggagaaagccttcgcccg

SEQ ID NO: 230003 - DNA, 25 bp, Mus musculus
tagctgccacgcaaacctggcagtg

SEQ ID NO: 230004 - DNA, 25 bp, Mus musculus
caaacctggcagtgtgccgggcaca

SEQ ID NO: 230005 - DNA, 25 bp, Mus musculus
ccgacgtgtggaaaatttgatgtcc

SEQ ID NO: 230006 - DNA, 25 bp, Mus musculus
atgtcctccatgctgttctcgtcga

SEQ ID NO: 230007 - DNA, 25 bp, Mus musculus
taacggcgccgatttcactcctact

SEQ ID NO: 230008 - DNA, 25 bp, Mus musculus
cgccgtgagagaggaagcccagtct

SEQ ID NO: 230009 - DNA, 25 bp, Mus musculus
tccagcgctgaaacacatgagagag

SEQ ID NO: 230010 - DNA, 25 bp, Mus musculus
gtttctgcagcgttttcaagagccc

SEQ ID NO: 230011 - DNA, 25 bp, Mus musculus
gaggtactcatccagtttctgcagc

SEQ ID NO: 230012 - DNA, 25 bp, Mus musculus
cgccgtccagaaaccgacgtgtgga

SEQ ID NO: 230013 - DNA, 25 bp, Mus musculus
taatgtcatctcatcgccgtccaga

SEQ ID NO: 230014 - DNA, 25 bp, Mus musculus
ggttacagtctgctaatgtcatctc

SEQ ID NO: 230015 - DNA, 25 bp, Mus musculus
gcttgggcagcaggttacagtctgc

SEQ ID NO: 230016 - DNA, 25 bp, Mus musculus
accttgacaatgtggagcttgggca

SEQ ID NO: 230017 - DNA, 25 bp, Mus musculus
ctcccggtgggcctaccttgacaat

SEQ ID NO: 230018 - DNA, 25 bp, Mus musculus
ctgttctcgtcgatttcgtcgggga

SEQ ID NO: 230019 - DNA, 25 bp, Mus musculus
tcgctcgggacggtgagcgctcacc

SEQ ID NO: 230020 - DNA, 25 bp, Mus musculus
ctggttgggtgccaagtgacctcat

SEQ ID NO: 230021 - DNA, 25 bp, Mus musculus
tagcttccacggaccgaccactagg

SEQ ID NO: 230022 - DNA, 25 bp, Mus musculus
gacagcggagcgctctagcttccac

SEQ ID NO: 230023 - DNA, 25 bp, Mus musculus
cttcaaaccgctgggcggagcccta

SEQ ID NO: 230024 - DNA, 25 bp, Mus musculus
gtctggctgcccgtggcctcagatc

SEQ ID NO: 230025 - DNA, 25 bp, Mus musculus
ctcgttcgctggacagtcccggcgt

SEQ ID NO: 230026 - DNA, 25 bp, Mus musculus
tcactcgctggcttgctcgttcgct

SEQ ID NO: 230027 - DNA, 25 bp, Mus musculus
tccttcagcccgttcaggggcatcg

SEQ ID NO: 230028 - DNA, 25 bp, Mus musculus
cgcggagcccagacaatgggaatga

SEQ ID NO: 230029 - DNA, 25 bp, Mus musculus
agggtccgccaaggtcccgctgcga

SEQ ID NO: 230030 - DNA, 25 bp, Mus musculus
tgacagtacccacgcggcgcagctg

SEQ ID NO: 230031 - DNA, 25 bp, Mus musculus
tgccaagtgacctcatgcggcggcc

SEQ ID NO: 230032 - DNA, 25 bp, Mus musculus
cgttcaggggcatcgacagcgccat

SEQ ID NO: 230033 - DNA, 25 bp, Mus musculus
tttcctcaaacacctctcaggacgg

SEQ ID NO: 230034 - DNA, 25 bp, Mus musculus
gtgaggttcggctccagcccattcc

SEQ ID NO: 230035 - DNA, 25 bp, Mus musculus
ctcgggtcttacaaacaagcctctc

SEQ ID NO: 230036 - DNA, 25 bp, Mus musculus
cgctcggacttacgcggaagaatcc

SEQ ID NO: 230037 - DNA, 25 bp, Mus musculus
gaagaatcccgcgtccatcttgccg

SEQ ID NO: 230038 - DNA, 25 bp, Mus musculus
ggagatcgctccctatcccagcgtg

SEQ ID NO: 230039 - DNA, 25 bp, Mus musculus
tgctcagtgcgccacgagaacgacg

SEQ ID NO: 230040 - DNA, 25 bp, Mus musculus
gctgggcgactggaaccaatggaaa

SEQ ID NO: 230041 - DNA, 25 bp, Mus musculus
gagggagaatctttgggtcgcccaa

SEQ ID NO: 230042 - DNA, 25 bp, Mus musculus
gcatgatcagcggtgttcgcgcgac

SEQ ID NO: 230043 - DNA, 25 bp, Mus musculus
ttcgcgcgacttgagttgatccttc

SEQ ID NO: 230044 - DNA, 25 bp, Mus musculus
tgatccttcctttgatccgtagtgg

SEQ ID NO: 230045 - DNA, 25 bp, Mus musculus
tgcgccgccgggaaagcttaagacc

SEQ ID NO: 230046 - DNA, 25 bp, Mus musculus
ctgtccgggattttgagcgcctccc

SEQ ID NO: 230047 - DNA, 25 bp, Mus musculus
gctgcactggggactttgcaagctc

SEQ ID NO: 230048 - DNA, 25 bp, Mus musculus
ttcgcgaacagaaacgcgactgccg

SEQ ID NO: 230049 - DNA, 25 bp, Mus musculus
cctgcgtcaaggaaattcgcgaaca

SEQ ID NO: 230050 - DNA, 25 bp, Mus musculus
cagagggccaagagacctgcgtcaa

SEQ ID NO: 230051 - DNA, 25 bp, Mus musculus
ggcagacacgtcagccttcagcctg

SEQ ID NO: 230052 - DNA, 25 bp, Mus musculus
ggaaacggcagacacgtcagccttc

SEQ ID NO: 230053 - DNA, 25 bp, Mus musculus
ggatctcctcccaggcgtccgccat

SEQ ID NO: 230054 - DNA, 25 bp, Mus musculus
gactctgcaaactgcgcccgctgga

SEQ ID NO: 230055 - DNA, 25 bp, Mus musculus
ttgcgtggactctgcaaactgcgcc

SEQ ID NO: 230056 - DNA, 25 bp, Mus musculus
cagggaaccagcacctttgcgtgga

SEQ ID NO: 230057 - DNA, 25 bp, Mus musculus
agcgagcgcctctaccgacagccgc

SEQ ID NO: 230058 - DNA, 25 bp, Mus musculus
aagctcgccctaggccgggcagcga

SEQ ID NO: 230059 - DNA, 25 bp, Mus musculus
agaaacgcgactgccgagctctccg

SEQ ID NO: 230060 - DNA, 25 bp, Mus musculus
gactttgcaagctcgccctaggccg

SEQ ID NO: 230061 - DNA, 25 bp, Mus musculus
tccggagagctatcttccgcgggcc

SEQ ID NO: 230062 - DNA, 25 bp, Mus musculus
tccctcccaactagtgaccaccctc

SEQ ID NO: 230063 - DNA, 25 bp, Mus musculus
ccatccctcccaactagtgaccacc

SEQ ID NO: 230064 - DNA, 25 bp, Mus musculus
cctgcgccctacctgctccacaccc

SEQ ID NO: 230065 - DNA, 25 bp, Mus musculus
gtgccctgcgccctacctgctccac

SEQ ID NO: 230066 - DNA, 25 bp, Mus musculus
cccgcgttccgtgccctgcgcccta

SEQ ID NO: 230067 - DNA, 25 bp, Mus musculus
ccctgtgcgctgtccttccaagccc

SEQ ID NO: 230068 - DNA, 25 bp, Mus musculus
gagctatcttccgcgggcctgagcc

SEQ ID NO: 230069 - DNA, 25 bp, Mus musculus
gagagctatcttccgcgggcctgag

SEQ ID NO: 230070 - DNA, 25 bp, Mus musculus
ccggagagctatcttccgcgggcct

SEQ ID NO: 230071 - DNA, 25 bp, Mus musculus
cggctcacgccaaggcgcgcgccag

SEQ ID NO: 230072 - DNA, 25 bp, Mus musculus
cccacgtcgctctctcctcctgccg

SEQ ID NO: 230073 - DNA, 25 bp, Mus musculus
gtccggagagctatcttccgcgggc

SEQ ID NO: 230074 - DNA, 25 bp, Mus musculus
ggagagctatcttccgcgggcctga

SEQ ID NO: 230075 - DNA, 25 bp, Mus musculus
tgtcaccaggtgtgtgactgcgcgc

SEQ ID NO: 230076 - DNA, 25 bp, Mus musculus
ccctgcgaaggggagactcacctgt

SEQ ID NO: 230077 - DNA, 25 bp, Mus musculus
ccctgggccggcactcttaaggcag

SEQ ID NO: 230078 - DNA, 25 bp, Mus musculus
cggcactcttaaggcagaggctttc

SEQ ID NO: 230079 - DNA, 25 bp, Mus musculus
aggctttccttgacctccagaacgg

SEQ ID NO: 230080 - DNA, 25 bp, Mus musculus
tctctctttttgctgacctcacgtg

SEQ ID NO: 230081 - DNA, 25 bp, Mus musculus
ttgctgacctcacgtgacagtgaca

SEQ ID NO: 230082 - DNA, 25 bp, Mus musculus
gtgacaggaacagctagccgggata

SEQ ID NO: 230083 - DNA, 25 bp, Mus musculus
tagccgggatactaggaaccttctc

SEQ ID NO: 230084 - DNA, 25 bp, Mus musculus
tcctgtgagcttaacccggggtagc

SEQ ID NO: 230085 - DNA, 25 bp, Mus musculus
ggggtagccttctaggaacctggca

SEQ ID NO: 230086 - DNA, 25 bp, Mus musculus
cttctaggaacctggcagccggatg

SEQ ID NO: 230087 - DNA, 25 bp, Mus musculus
tggcagccggatgtgcccgacctcg

SEQ ID NO: 230088 - DNA, 25 bp, Mus musculus
ctcccgtcgcccagtagaggcgatg

SEQ ID NO: 230089 - DNA, 25 bp, Mus musculus
tgagcatgaacctgcgcgtggagct

SEQ ID NO: 230090 - DNA, 25 bp, Mus musculus
cgtggagcttccagcgcgctcattt

SEQ ID NO: 230091 - DNA, 25 bp, Mus musculus
tgggcgggacatcctgaaataattg

SEQ ID NO: 230092 - DNA, 25 bp, Mus musculus
gctgtcaatcatcctagtagtcccg

SEQ ID NO: 230093 - DNA, 25 bp, Mus musculus
taatttcccggtacgcctgcagctc

SEQ ID NO: 230094 - DNA, 25 bp, Mus musculus
acctgttggctgtattgcgtcctta

SEQ ID NO: 230095 - DNA, 25 bp, Mus musculus
cagagccctgacacgtctcggggac

SEQ ID NO: 230096 - DNA, 25 bp, Mus musculus
tccagtatcgaaacccagcagagcc

SEQ ID NO: 230097 - DNA, 25 bp, Mus musculus
gcttccatcaggtagctccagtatc

SEQ ID NO: 230098 - DNA, 25 bp, Mus musculus
ctccacctgccggacaagtaggctg

SEQ ID NO: 230099 - DNA, 25 bp, Mus musculus
ctctagcggccaaaggaagaagtcc

SEQ ID NO: 230100 - DNA, 25 bp, Mus musculus
ctcgcttgaagcgtaggggcgacct

SEQ ID NO: 230101 - DNA, 25 bp, Mus musculus
ggctgcgtcgccaagctcgcttgaa

SEQ ID NO: 230102 - DNA, 25 bp, Mus musculus
ctcatttttcagcacgcgccgttca

SEQ ID NO: 230103 - DNA, 25 bp, Mus musculus
gcccgagcttaatgagggcttttaa

SEQ ID NO: 230104 - DNA, 25 bp, Mus musculus
ttcgaccacaaaaccgcagcggggc

SEQ ID NO: 230105 - DNA, 25 bp, Mus musculus
ggcaatcatggtttcgaccacaaaa

SEQ ID NO: 230106 - DNA, 25 bp, Mus musculus
tgctcctggcaatcatggtttcgac

SEQ ID NO: 230107 - DNA, 25 bp, Mus musculus
cgacaaaaatttgctcctggcaatc

SEQ ID NO: 230108 - DNA, 25 bp, Mus musculus
acacctcctgcacgacaaaaatttg

SEQ ID NO: 230109 - DNA, 25 bp, Mus musculus
aataacacacctcctgcacgacaaa

SEQ ID NO: 230110 - DNA, 25 bp, Mus musculus
cagccgcgtaactccgacttttaat

SEQ ID NO: 230111 - DNA, 25 bp, Mus musculus
ttttcattcaccagccgcgtaactc

SEQ ID NO: 230112 - DNA, 25 bp, Mus musculus
tgagggcttttaacttttcattcac

SEQ ID NO: 230113 - DNA, 25 bp, Mus musculus
ggcggcgctccgagttaactctttc

SEQ ID NO: 230114 - DNA, 25 bp, Mus musculus
gttttacagcccgagcttaatgagg

SEQ ID NO: 230115 - DNA, 25 bp, Mus musculus
ccgagttaactctttcagcgctgcg

SEQ ID NO: 230116 - DNA, 25 bp, Mus musculus
taacttttcattcaccagccgcgta

SEQ ID NO: 230117 - DNA, 25 bp, Mus musculus
ccgtggctttactcactcaagttca

SEQ ID NO: 230118 - DNA, 25 bp, Mus musculus
tcactcaagttcattcgacatcttc

SEQ ID NO: 230119 - DNA, 25 bp, Mus musculus
ttccttctccgaggttccagcgatc

SEQ ID NO: 230120 - DNA, 25 bp, Mus musculus
ttccagcgatccgtctctggttggc

SEQ ID NO: 230121 - DNA, 25 bp, Mus musculus
ctctggttggctcgcaggcgctgct

SEQ ID NO: 230122 - DNA, 25 bp, Mus musculus
gcgctgctgaccactcgtctcttaa

SEQ ID NO: 230123 - DNA, 25 bp, Mus musculus
cactcgtctcttaattctcctctga

SEQ ID NO: 230124 - DNA, 25 bp, Mus musculus
tcttaattctcctctgacacagaca

SEQ ID NO: 230125 - DNA, 25 bp, Mus musculus
ttcctgcccggggaagcgtttgctc

SEQ ID NO: 230126 - DNA, 25 bp, Mus musculus
cgtttgctctacgttgcgctttgga

SEQ ID NO: 230127 - DNA, 25 bp, Mus musculus
tgcgctttggatgttgagattttgc

SEQ ID NO: 230128 - DNA, 25 bp, Mus musculus
ttgagattttgctgacagcggtccc

SEQ ID NO: 230129 - DNA, 25 bp, Mus musculus
gggaggccagacatccgtggcttta

SEQ ID NO: 230130 - DNA, 25 bp, Mus musculus
ttcgacatcttccttctccgaggtt

SEQ ID NO: 230131 - DNA, 25 bp, Mus musculus
tgctcacaggcacactaagccgctg

SEQ ID NO: 230132 - DNA, 25 bp, Mus musculus
aaggcctgaggaattcgcagctggc

SEQ ID NO: 230133 - DNA, 25 bp, Mus musculus
acctcacagcctgcgaggaagtcgg

SEQ ID NO: 230134 - DNA, 25 bp, Mus musculus
acccgagatcgggattcccggcgcg

SEQ ID NO: 230135 - DNA, 25 bp, Mus musculus
cacggaggagtcagtagagacccga

SEQ ID NO: 230136 - DNA, 25 bp, Mus musculus
ctggcatcgcactctgggttgagaa

SEQ ID NO: 230137 - DNA, 25 bp, Mus musculus
caagacccaggctcggagatggcga

SEQ ID NO: 230138 - DNA, 25 bp, Mus musculus
caggcagaagccaagacccaggctc

SEQ ID NO: 230139 - DNA, 25 bp, Mus musculus
gaatagctttccttccgggcagggc

SEQ ID NO: 230140 - DNA, 25 bp, Mus musculus
ctgggaccctggcacccaacaggga

SEQ ID NO: 230141 - DNA, 25 bp, Mus musculus
gcagcgccagctcccgaaatagggc

SEQ ID NO: 230142 - DNA, 25 bp, Mus musculus
ggtgtgaacgcgttcccttctgctc

SEQ ID NO: 230143 - DNA, 25 bp, Mus musculus
acagggacctgggtgcaaggaccaa

SEQ ID NO: 230144 - DNA, 25 bp, Mus musculus
ggccctgcccagaatagctttcctt

SEQ ID NO: 230145 - DNA, 25 bp, Mus musculus
aattgcgtgcctaggtgacgcggat

SEQ ID NO: 230146 - DNA, 25 bp, Mus musculus
gatctcgcgggaaaaagccgttgtc

SEQ ID NO: 230147 - DNA, 25 bp, Mus musculus
cacgcccagagatctcgcgggaaaa

SEQ ID NO: 230148 - DNA, 25 bp, Mus musculus
aagcgcagcgctaaagaaagaaaga

SEQ ID NO: 230149 - DNA, 25 bp, Mus musculus
ttaacccgagcgctcgccgagagga

SEQ ID NO: 230150 - DNA, 25 bp, Mus musculus
tcatggtagtttaacccgagcgctc

SEQ ID NO: 230151 - DNA, 25 bp, Mus musculus
ctcccgagcccggtcatggtagttt

SEQ ID NO: 230152 - DNA, 25 bp, Mus musculus
ttccggagcagcctctagctggctc

SEQ ID NO: 230153 - DNA, 25 bp, Mus musculus
tccgaacagcggattccggagcagc

SEQ ID NO: 230154 - DNA, 25 bp, Mus musculus
gaagcccaggcgcaactccgaacag

SEQ ID NO: 230155 - DNA, 25 bp, Mus musculus
ctctctggccagagatctgataaga

SEQ ID NO: 230156 - DNA, 25 bp, Mus musculus
agaatctctaagttcctctctctgg

SEQ ID NO: 230157 - DNA, 25 bp, Mus musculus
tgagcgcaccggagcagctactgcg

SEQ ID NO: 230158 - DNA, 25 bp, Mus musculus
ttgcacgcacggcacgccgaaagct

SEQ ID NO: 230159 - DNA, 25 bp, Mus musculus
ttcgtgattaacttgggtgaacgga

SEQ ID NO: 230160 - DNA, 25 bp, Mus musculus
ggaccttcgtgattaacttgggtga

SEQ ID NO: 230161 - DNA, 25 bp, Mus musculus
tggagagaccgctcccgttagggac

SEQ ID NO: 230162 - DNA, 25 bp, Mus musculus
aacgaggtgctggagagaccgctcc

SEQ ID NO: 230163 - DNA, 25 bp, Mus musculus
ttgaaaacgaggtgctggagagacc

SEQ ID NO: 230164 - DNA, 25 bp, Mus musculus
ctctttgaaaacgaggtgctggaga

SEQ ID NO: 230165 - DNA, 25 bp, Mus musculus
ttcgcggaaatctctttgaaaacga

SEQ ID NO: 230166 - DNA, 25 bp, Mus musculus
cgtgttttcgcggaaatctctttga

SEQ ID NO: 230167 - DNA, 25 bp, Mus musculus
atccacgtgttttcgcggaaatctc

SEQ ID NO: 230168 - DNA, 25 bp, Mus musculus
agtgatccacgtgttttcgcggaaa

SEQ ID NO: 230169 - DNA, 25 bp, Mus musculus
atggagtgatccacgtgttttcgcg

SEQ ID NO: 230170 - DNA, 25 bp, Mus musculus
tttttcggttaaatggagtgatcca

SEQ ID NO: 230171 - DNA, 25 bp, Mus musculus
cagcactcagaagacgggtctggga

SEQ ID NO: 230172 - DNA, 25 bp, Mus musculus
agattggggcgagtgtaacaatttt

SEQ ID NO: 230173 - DNA, 25 bp, Mus musculus
cgcacagtgaacctgcaagctcgca

SEQ ID NO: 230174 - DNA, 25 bp, Mus musculus
gcacggatctaacagcccacgaacg

SEQ ID NO: 230175 - DNA, 25 bp, Mus musculus
actcaccgacttcgagcggcggcgg

SEQ ID NO: 230176 - DNA, 25 bp, Mus musculus
ttacttccgtgaccagacctctgcg

SEQ ID NO: 230177 - DNA, 25 bp, Mus musculus
cagggagaaacgatgcacggatcta

SEQ ID NO: 230178 - DNA, 25 bp, Mus musculus
aggcccaacaatggtgcccgcgatg

SEQ ID NO: 230179 - DNA, 25 bp, Mus musculus
gcccacgaacgagtcacggatcaca

SEQ ID NO: 230180 - DNA, 25 bp, Mus musculus
atcacaactccgtctggggaccaac

SEQ ID NO: 230181 - DNA, 25 bp, Mus musculus
tcctactgcctttcccgacaaaatg

SEQ ID NO: 230182 - DNA, 25 bp, Mus musculus
ttcccgacaaaatggaggccgctgc

SEQ ID NO: 230183 - DNA, 25 bp, Mus musculus
actgtgcagccaatgaggacgcggc

SEQ ID NO: 230184 - DNA, 25 bp, Mus musculus
tggctgttgtcatggtttgaaatcc

SEQ ID NO: 230185 - DNA, 25 bp, Mus musculus
tgtcgggaataactggcccgcttcg

SEQ ID NO: 230186 - DNA, 25 bp, Mus musculus
gcctccttccctctacagggagaaa

SEQ ID NO: 230187 - DNA, 25 bp, Mus musculus
ctcgtacctgttcatcagcagcttg

SEQ ID NO: 230188 - DNA, 25 bp, Mus musculus
cgtgatcttcgcctgcaactttgtc

SEQ ID NO: 230189 - DNA, 25 bp, Mus musculus
tggccagcgtgatcttcgcctgcaa

SEQ ID NO: 230190 - DNA, 25 bp, Mus musculus
tgacttcctggccagcgtgatcttc

SEQ ID NO: 230191 - DNA, 25 bp, Mus musculus
cagcttggctggagctgacttcctg

SEQ ID NO: 230192 - DNA, 25 bp, Mus musculus
cctgttcatcagcagcttggctgga

SEQ ID NO: 230193 - DNA, 25 bp, Mus musculus
cgcagaaagccctcgtacctgttca

SEQ ID NO: 230194 - DNA, 25 bp, Mus musculus
gctctatattatcctgtcctcccgg

SEQ ID NO: 230195 - DNA, 25 bp, Mus musculus
catggccgtgctctatattatcctg

SEQ ID NO: 230196 - DNA, 25 bp, Mus musculus
gcgccctggagaacatggccgtgct

SEQ ID NO: 230197 - DNA, 25 bp, Mus musculus
tccacgtcttccacggggtcgactc

SEQ ID NO: 230198 - DNA, 25 bp, Mus musculus
actttgtcatcttccacgtcttcca

SEQ ID NO: 230199 - DNA, 25 bp, Mus musculus
ctgtgcaccctgatggggctgctga

SEQ ID NO: 230200 - DNA, 25 bp, Mus musculus
gcctgcaactttgtcatcttccacg

SEQ ID NO: 230201 - DNA, 25 bp, Mus musculus
ttcttccacccggatcagtgggccg

SEQ ID NO: 230202 - DNA, 25 bp, Mus musculus
aagcaaggatgtaggagctgaactt

SEQ ID NO: 230203 - DNA, 25 bp, Mus musculus
gcgctgcctgacctcggaaggtcca

SEQ ID NO: 230204 - DNA, 25 bp, Mus musculus
cgttactctgagaggcggggctact

SEQ ID NO: 230205 - DNA, 25 bp, Mus musculus
aggaccctacgttctgcatctcgga

SEQ ID NO: 230206 - DNA, 25 bp, Mus musculus
atgacagaaaactacccgcccggct

SEQ ID NO: 230207 - DNA, 25 bp, Mus musculus
ggcctaccagcgcttcatgacagaa

SEQ ID NO: 230208 - DNA, 25 bp, Mus musculus
catctcggaggaaggacgctaaaga

SEQ ID NO: 230209 - DNA, 25 bp, Mus musculus
cccgcctggggcagtgaatggttct

SEQ ID NO: 230210 - DNA, 25 bp, Mus musculus
gccaagttcggggtgttcgtgcact

SEQ ID NO: 230211 - DNA, 25 bp, Mus musculus
ccgagctggttcgatgaggccaagt

SEQ ID NO: 230212 - DNA, 25 bp, Mus musculus
cagagcttggactcgcggccactgc

SEQ ID NO: 230213 - DNA, 25 bp, Mus musculus
actcgccggcgcttgcgtgttaaga

SEQ ID NO: 230214 - DNA, 25 bp, Mus musculus
atcagtgggccgaactctttcaggc

SEQ ID NO: 230215 - DNA, 25 bp, Mus musculus
tcggctaacccggtccattccgagc

SEQ ID NO: 230216 - DNA, 25 bp, Mus musculus
cccaggctcggaaggagcgctgact

SEQ ID NO: 230217 - DNA, 25 bp, Mus musculus
gtctcccgagcctggtgcctggcct

SEQ ID NO: 230218 - DNA, 25 bp, Mus musculus
ccgggcccaagctcctcctcgcggt

SEQ ID NO: 230219 - DNA, 25 bp, Mus musculus
gcctgcagtgcatcgccgggcccaa

SEQ ID NO: 230220 - DNA, 25 bp, Mus musculus
gacccggcggccacttcatcccggc

SEQ ID NO: 230221 - DNA, 25 bp, Mus musculus
cccggtcagctcagccctccgttgc

SEQ ID NO: 230222 - DNA, 25 bp, Mus musculus
cccttcggtgcggaggagcaaacgc

SEQ ID NO: 230223 - DNA, 25 bp, Mus musculus
ctggctccaagttccctccctcgct

SEQ ID NO: 230224 - DNA, 25 bp, Mus musculus
cggctgcgcagagacacgcgctctg

SEQ ID NO: 230225 - DNA, 25 bp, Mus musculus
tgccggctgcgcagagacacgcgct

SEQ ID NO: 230226 - DNA, 25 bp, Mus musculus
ctccctcgctctcctgcggagcctg

SEQ ID NO: 230227 - DNA, 25 bp, Mus musculus
ccacccaggtcatcccgtgggcgcg

SEQ ID NO: 230228 - DNA, 25 bp, Mus musculus
gggccgcagcaactggctccaagtt

SEQ ID NO: 230229 - DNA, 25 bp, Mus musculus
cagcgagggaaagctccatccaggg

SEQ ID NO: 230230 - DNA, 25 bp, Mus musculus
ccagcgagggaaagctccatccagg

SEQ ID NO: 230231 - DNA, 25 bp, Mus musculus
gcggcgctgtcctagtagcgtagcc

SEQ ID NO: 230232 - DNA, 25 bp, Mus musculus
gcgctgtcctagtagcgtagccgga

SEQ ID NO: 230233 - DNA, 25 bp, Mus musculus
gctgtcctagtagcgtagccggagt

SEQ ID NO: 230234 - DNA, 25 bp, Mus musculus
tgtcctagtagcgtagccggagtcc

SEQ ID NO: 230235 - DNA, 25 bp, Mus musculus
tcctagtagcgtagccggagtccgg

SEQ ID NO: 230236 - DNA, 25 bp, Mus musculus
ggggtagccaagaggcgagagcggc

SEQ ID NO: 230237 - DNA, 25 bp, Mus musculus
tcaaggcaccgggtgaggaaagatc

SEQ ID NO: 230238 - DNA, 25 bp, Mus musculus
aaggcaccgggtgaggaaagatcca

SEQ ID NO: 230239 - DNA, 25 bp, Mus musculus
gtgaggaaagatccagggctccaga

SEQ ID NO: 230240 - DNA, 25 bp, Mus musculus
tctcttcccatctcccgggctgccg

SEQ ID NO: 230241 - DNA, 25 bp, Mus musculus
cgctctcttcccatctcccgggctg

SEQ ID NO: 230242 - DNA, 25 bp, Mus musculus
agcgagggaaagctccatccagggc

SEQ ID NO: 230243 - DNA, 25 bp, Mus musculus
cctccggagtgaagatggcgtcagt

SEQ ID NO: 230244 - DNA, 25 bp, Mus musculus
gcgtcagtgaggaaggctttcccgc

SEQ ID NO: 230245 - DNA, 25 bp, Mus musculus
cttgacgtccctccgggctgtaagt

SEQ ID NO: 230246 - DNA, 25 bp, Mus musculus
gatcgggcgggcctcctcagctgct

SEQ ID NO: 230247 - DNA, 25 bp, Mus musculus
ctcctcagctgctgtgacaggcgga

SEQ ID NO: 230248 - DNA, 25 bp, Mus musculus
aggatttgagagttccggacccagc

SEQ ID NO: 230249 - DNA, 25 bp, Mus musculus
cggacccagccggtctggctcagat

SEQ ID NO: 230250 - DNA, 25 bp, Mus musculus
ggtctggctcagatccattgcaaga

SEQ ID NO: 230251 - DNA, 25 bp, Mus musculus
ccattgcaagaaacggggaaactga

SEQ ID NO: 230252 - DNA, 25 bp, Mus musculus
ggaagagaatcgacccgctgtgact

SEQ ID NO: 230253 - DNA, 25 bp, Mus musculus
atcgacccgctgtgactgtggagac

SEQ ID NO: 230254 - DNA, 25 bp, Mus musculus
tgactgtggagaccggggacaccat

SEQ ID NO: 230255 - DNA, 25 bp, Mus musculus
ctaaccacgcccacagagggatcgg

SEQ ID NO: 230256 - DNA, 25 bp, Mus musculus
cccacagagggatcggcggtcacgt

SEQ ID NO: 230257 - DNA, 25 bp, Mus musculus
tgccttgtacagacagggaaaactg

SEQ ID NO: 230258 - DNA, 25 bp, Mus musculus
gtcttcgcgcaatgcgggagctgca

SEQ ID NO: 230259 - DNA, 25 bp, Mus musculus
gagcagcctttctgccaccagagtc

SEQ ID NO: 230260 - DNA, 25 bp, Mus musculus
catttgtccctccagggttgccgtc

SEQ ID NO: 230261 - DNA, 25 bp, Mus musculus
cagtacacacgtttcctggagggcg

SEQ ID NO: 230262 - DNA, 25 bp, Mus musculus
ttaaagcctgtgcagaccatttgtc

SEQ ID NO: 230263 - DNA, 25 bp, Mus musculus
ttcggccggtagaatgaagggctta

SEQ ID NO: 230264 - DNA, 25 bp, Mus musculus
gcttagtgagctcggaagggccaat

SEQ ID NO: 230265 - DNA, 25 bp, Mus musculus
ttcgtgttcggaacagggccaggct

SEQ ID NO: 230266 - DNA, 25 bp, Mus musculus
tctgctcgcgttttccgcaaccgta

SEQ ID NO: 230267 - DNA, 25 bp, Mus musculus
agcccattcattcggggctcggctc

SEQ ID NO: 230268 - DNA, 25 bp, Mus musculus
agacccgaagtccagagctaagctc

SEQ ID NO: 230269 - DNA, 25 bp, Mus musculus
ttccgccctcgatggaagcgcactg

SEQ ID NO: 230270 - DNA, 25 bp, Mus musculus
gccgtccaggcagtaacccagtaca

SEQ ID NO: 230271 - DNA, 25 bp, Mus musculus
cagtggcttccgagaccgttcgggc

SEQ ID NO: 230272 - DNA, 25 bp, Mus musculus
cagcctcgctgagcgaacgcctgga

SEQ ID NO: 230273 - DNA, 25 bp, Mus musculus
cctcgctgagcgaacgcctggatac

SEQ ID NO: 230274 - DNA, 25 bp, Mus musculus
tcgctgagcgaacgcctggatacct

SEQ ID NO: 230275 - DNA, 25 bp, Mus musculus
gagcgaacgcctggatacctcactc

SEQ ID NO: 230276 - DNA, 25 bp, Mus musculus
tggatacctcactcccagtggcttc

SEQ ID NO: 230277 - DNA, 25 bp, Mus musculus
gcttccgagaccgttcgggcgattc

SEQ ID NO: 230278 - DNA, 25 bp, Mus musculus
tccgagaccgttcgggcgattctcc

SEQ ID NO: 230279 - DNA, 25 bp, Mus musculus
aagtagcccggccagcagtacggaa

SEQ ID NO: 230280 - DNA, 25 bp, Mus musculus
gtagcccggccagcagtacggaacc

SEQ ID NO: 230281 - DNA, 25 bp, Mus musculus
ccagcagtacggaacccggaagcga

SEQ ID NO: 230282 - DNA, 25 bp, Mus musculus
cgggactggacagcgccctccggcc

SEQ ID NO: 230283 - DNA, 25 bp, Mus musculus
agcagtacggaacccggaagcgagt

SEQ ID NO: 230284 - DNA, 25 bp, Mus musculus
cggccagcagtacggaacccggaag

SEQ ID NO: 230285 - DNA, 25 bp, Mus musculus
ccgaagataacagtgccagcggatg

SEQ ID NO: 230286 - DNA, 25 bp, Mus musculus
agcggctcacaaacacctgatctgc

SEQ ID NO: 230287 - DNA, 25 bp, Mus musculus
tgcggcaccctagaccagcgcagtg

SEQ ID NO: 230288 - DNA, 25 bp, Mus musculus
gcggctcagggtgtcgctgccctct

SEQ ID NO: 230289 - DNA, 25 bp, Mus musculus
ccctctccctgtgggtgcaggaaga

SEQ ID NO: 230290 - DNA, 25 bp, Mus musculus
gggaacccgatggaacgtatgcgca

SEQ ID NO: 230291 - DNA, 25 bp, Mus musculus
ccgatggaacgtatgcgcagacaac

SEQ ID NO: 230292 - DNA, 25 bp, Mus musculus
cgcagacaacgcaggagccacagaa

SEQ ID NO: 230293 - DNA, 25 bp, Mus musculus
aacgcaggagccacagaagagcggc

SEQ ID NO: 230294 - DNA, 25 bp, Mus musculus
ttgtctagggacacctccagctcgg

SEQ ID NO: 230295 - DNA, 25 bp, Mus musculus
tcgctccatgcgcaatgcgcggacg

SEQ ID NO: 230296 - DNA, 25 bp, Mus musculus
tcagctccagcacttgttgccgcgg

SEQ ID NO: 230297 - DNA, 25 bp, Mus musculus
ggcggccgctgagccttactctcgg

SEQ ID NO: 230298 - DNA, 25 bp, Mus musculus
tttggggacccgaagataacagtgc

SEQ ID NO: 230299 - DNA, 25 bp, Mus musculus
tcgctccaggtcgatgcgcaggtac

SEQ ID NO: 230300 - DNA, 25 bp, Mus musculus
cctttctccggcgtggtggataagg

SEQ ID NO: 230301 - DNA, 25 bp, Mus musculus
agcggccacctttctccggcgtggt

SEQ ID NO: 230302 - DNA, 25 bp, Mus musculus
agcgtgcgctttcttccctagcggc

SEQ ID NO: 230303 - DNA, 25 bp, Mus musculus
tcccgagccaaagcgtgcgctttct

SEQ ID NO: 230304 - DNA, 25 bp, Mus musculus
acgcgtggcagggacgcgaatcctc

SEQ ID NO: 230305 - DNA, 25 bp, Mus musculus
cgttcaagcgtggaaactgtagggc

SEQ ID NO: 230306 - DNA, 25 bp, Mus musculus
tgtcgctcagtggtaccgttcaagc

SEQ ID NO: 230307 - DNA, 25 bp, Mus musculus
cctgcgccagcagagctggacgctg

SEQ ID NO: 230308 - DNA, 25 bp, Mus musculus
attgacgtggacctgcgccagcaga

SEQ ID NO: 230309 - DNA, 25 bp, Mus musculus
tgccctcgcggctctcgttgaggca

SEQ ID NO: 230310 - DNA, 25 bp, Mus musculus
atgcgcaggtacagcccgtaggcca

SEQ ID NO: 230311 - DNA, 25 bp, Mus musculus
tcgttgaggcactgcagtcgctcca

SEQ ID NO: 230312 - DNA, 25 bp, Mus musculus
gccaccgaggcgtcgtaaaaggcgc

SEQ ID NO: 230313 - DNA, 25 bp, Mus musculus
atctaggagaatcagccaccgactg

SEQ ID NO: 230314 - DNA, 25 bp, Mus musculus
accgactgtgtgcgaccgccgctgt

SEQ ID NO: 230315 - DNA, 25 bp, Mus musculus
atcagccaccgactgtgtgcgaccg

SEQ ID NO: 230316 - DNA, 25 bp, Mus musculus
gagaatcagccaccgactgtgtgcg

SEQ ID NO: 230317 - DNA, 25 bp, Mus musculus
ctaggagaatcagccaccgactgtg

SEQ ID NO: 230318 - DNA, 25 bp, Mus musculus
agaggagtgggcaccgggatctcgc

SEQ ID NO: 230319 - DNA, 25 bp, Mus musculus
tgaaatctaggagaatcagccaccg

SEQ ID NO: 230320 - DNA, 25 bp, Mus musculus
ccctggggccccgtattcatcgaca

SEQ ID NO: 230321 - DNA, 25 bp, Mus musculus
caaaggcggtttccccagtcgcagt

SEQ ID NO: 230322 - DNA, 25 bp, Mus musculus
gatggctgcagctggaaaggactcc

SEQ ID NO: 230323 - DNA, 25 bp, Mus musculus
agatggctgcagctggaaaggactc

SEQ ID NO: 230324 - DNA, 25 bp, Mus musculus
cctcgcttgtcggagcgagatggct

SEQ ID NO: 230325 - DNA, 25 bp, Mus musculus
cttcctcgcttgtcggagcgagatg

SEQ ID NO: 230326 - DNA, 25 bp, Mus musculus
aggagaatcagccaccgactgtgtg

SEQ ID NO: 230327 - DNA, 25 bp, Mus musculus
tacagcacaggggtcctcgagccgc

SEQ ID NO: 230328 - DNA, 25 bp, Mus musculus
cgcctttccagtcatacgctcgttt

SEQ ID NO: 230329 - DNA, 25 bp, Mus musculus
caaactctggctttaactctcacgc

SEQ ID NO: 230330 - DNA, 25 bp, Mus musculus
ccaagcctgtattctgcaagccaaa

SEQ ID NO: 230331 - DNA, 25 bp, Mus musculus
tgtcgaatacagcacaggtcacgcc

SEQ ID NO: 230332 - DNA, 25 bp, Mus musculus
gcccactatatcacggcgatctgtc

SEQ ID NO: 230333 - DNA, 25 bp, Mus musculus
ggagttaacacgctcacgccctcat

SEQ ID NO: 230334 - DNA, 25 bp, Mus musculus
tgtatgtgtggaaggcctcaggacc

SEQ ID NO: 230335 - DNA, 25 bp, Mus musculus
agacggaagcgcgaatggtcccttc

SEQ ID NO: 230336 - DNA, 25 bp, Mus musculus
gctcggctgcaacggggaaacagct

SEQ ID NO: 230337 - DNA, 25 bp, Mus musculus
tttctcggctaaagggcagggtaca

SEQ ID NO: 230338 - DNA, 25 bp, Mus musculus
ctccaggagcagagctcgaaaaacc

SEQ ID NO: 230339 - DNA, 25 bp, Mus musculus
atacgctcgttttcgcctaagggtg

SEQ ID NO: 230340 - DNA, 25 bp, Mus musculus
aggcgcgcctggagcttctccacaa

SEQ ID NO: 230341 - DNA, 25 bp, Mus musculus
ctccgcgtttggaagagaacgaaca

SEQ ID NO: 230342 - DNA, 25 bp, Mus musculus
agtcccgccgggcttaatgccaaca

SEQ ID NO: 230343 - DNA, 25 bp, Mus musculus
cgacgcagatattgaggcagagctt

SEQ ID NO: 230344 - DNA, 25 bp, Mus musculus
cagagcttgcggatgcgcagttccc

SEQ ID NO: 230345 - DNA, 25 bp, Mus musculus
cagttcccgcatggggttctccttt

SEQ ID NO: 230346 - DNA, 25 bp, Mus musculus
tcttgctgcgaagagggacacagcc

SEQ ID NO: 230347 - DNA, 25 bp, Mus musculus
cccgtcagagacgagaaacagccaa

SEQ ID NO: 230348 - DNA, 25 bp, Mus musculus
ccattcttaggatgggcggcgatgc

SEQ ID NO: 230349 - DNA, 25 bp, Mus musculus
gctctgacttctatcgtcccggatc

SEQ ID NO: 230350 - DNA, 25 bp, Mus musculus
agagagcctgaatcccaagcggatc

SEQ ID NO: 230351 - DNA, 25 bp, Mus musculus
tccacgagtagggaacagacactag

SEQ ID NO: 230352 - DNA, 25 bp, Mus musculus
ctacaggaagtaccggcctctgcgc

SEQ ID NO: 230353 - DNA, 25 bp, Mus musculus
ttcccaagctagcacgggtcctgcg

SEQ ID NO: 230354 - DNA, 25 bp, Mus musculus
gccaaggtcttctccgctctgactt

SEQ ID NO: 230355 - DNA, 25 bp, Mus musculus
gaccgcctgggtccttcgcccacgc

SEQ ID NO: 230356 - DNA, 25 bp, Mus musculus
ggatcgcaaggtgccaccctctcaa

SEQ ID NO: 230357 - DNA, 25 bp, Mus musculus
ggacccgaggatcgcaaggtgccac

SEQ ID NO: 230358 - DNA, 25 bp, Mus musculus
cccgtctcgagcgggacccgaggat

SEQ ID NO: 230359 - DNA, 25 bp, Mus musculus
ggggccgcccactcgcagacagccc

SEQ ID NO: 230360 - DNA, 25 bp, Mus musculus
tgctctttagggaggggccgcccac

SEQ ID NO: 230361 - DNA, 25 bp, Mus musculus
gctccgctttcactgctctttaggg

SEQ ID NO: 230362 - DNA, 25 bp, Mus musculus
ccgctttcactgctctttagggagg

SEQ ID NO: 230363 - DNA, 25 bp, Mus musculus
ggacgctccgctttcactgctcttt

SEQ ID NO: 230364 - DNA, 25 bp, Mus musculus
agaacagtgcacctgctgcgctcgc

SEQ ID NO: 230365 - DNA, 25 bp, Mus musculus
ccgcggagaacagtgcacctgctgc

SEQ ID NO: 230366 - DNA, 25 bp, Mus musculus
acacccgcggagaacagtgcacctg

SEQ ID NO: 230367 - DNA, 25 bp, Mus musculus
ccctctcaacctgtgcgcctggctt

SEQ ID NO: 230368 - DNA, 25 bp, Mus musculus
ttcactgctctttagggaggggccg

SEQ ID NO: 230369 - DNA, 25 bp, Mus musculus
cgctgtggccgtcggagcagccaca

SEQ ID NO: 230370 - DNA, 25 bp, Mus musculus
cgcagctgcgcgccaacactggggt

SEQ ID NO: 230371 - DNA, 25 bp, Mus musculus
cgggcgattgtgtgtcccgcagctg

SEQ ID NO: 230372 - DNA, 25 bp, Mus musculus
agaaagcggcttttgttgaacgagg

SEQ ID NO: 230373 - DNA, 25 bp, Mus musculus
ctgttgtgggaaaagaaagcggctt

SEQ ID NO: 230374 - DNA, 25 bp, Mus musculus
tggtctttaatctgttgtgggaaaa

SEQ ID NO: 230375 - DNA, 25 bp, Mus musculus
cctggtctttaatctgttgtgggaa

SEQ ID NO: 230376 - DNA, 25 bp, Mus musculus
ccctcctggtctttaatctgttgtg

SEQ ID NO: 230377 - DNA, 25 bp, Mus musculus
gctggagaagctatttttcaccccc

SEQ ID NO: 230378 - DNA, 25 bp, Mus musculus
attcgccatcaaagcgtccccaaag

SEQ ID NO: 230379 - DNA, 25 bp, Mus musculus
tccgggtttcccacacattcgccat

SEQ ID NO: 230380 - DNA, 25 bp, Mus musculus
gagcagccacattcctccgggtttc

SEQ ID NO: 230381 - DNA, 25 bp, Mus musculus
gtggccgtcggagcagccacattcc

SEQ ID NO: 230382 - DNA, 25 bp, Mus musculus
caggccgagctagggtgcccgggaa

SEQ ID NO: 230383 - DNA, 25 bp, Mus musculus
gggaaatcctgcctttgacagaaca

SEQ ID NO: 230384 - DNA, 25 bp, Mus musculus
actcagcttagccaggtggaaatcc

SEQ ID NO: 230385 - DNA, 25 bp, Mus musculus
gcgggtcgcaccaaatgagccttgg

SEQ ID NO: 230386 - DNA, 25 bp, Mus musculus
ctctataagagtcggccgctgcagg

SEQ ID NO: 230387 - DNA, 25 bp, Mus musculus
tgtcggaacgtagcctggccattgc

SEQ ID NO: 230388 - DNA, 25 bp, Mus musculus
gcctcttagcctcttggacgacatg

SEQ ID NO: 230389 - DNA, 25 bp, Mus musculus
ctactctccaacatgaaggcgctga

SEQ ID NO: 230390 - DNA, 25 bp, Mus musculus
cctgcagcgtgtcatagactacatc

SEQ ID NO: 230391 - DNA, 25 bp, Mus musculus
cctcgaccttcaggtggtcctggca

SEQ ID NO: 230392 - DNA, 25 bp, Mus musculus
agtcccttggctaactcgtctccta

SEQ ID NO: 230393 - DNA, 25 bp, Mus musculus
gctgagctcactccggaacttgtga

SEQ ID NO: 230394 - DNA, 25 bp, Mus musculus
tctccaaggacaagaggagcttttg

SEQ ID NO: 230395 - DNA, 25 bp, Mus musculus
gagcttttgccactgacccggtcgt

SEQ ID NO: 230396 - DNA, 25 bp, Mus musculus
cgcgcactgtttgctgctttaggtg

SEQ ID NO: 230397 - DNA, 25 bp, Mus musculus
ctgagcgcgactggattcctagagg

SEQ ID NO: 230398 - DNA, 25 bp, Mus musculus
ctcaggaccgagtggtgatgaacca

SEQ ID NO: 230399 - DNA, 25 bp, Mus musculus
tgaaccacctcagggccaactcggg

SEQ ID NO: 230400 - DNA, 25 bp, Mus musculus
atccaggcagacaaggacgggctca

SEQ ID NO: 230401 - DNA, 25 bp, Mus musculus
cggtgcggacactaacctagcggcg

SEQ ID NO: 230402 - DNA, 25 bp, Mus musculus
aggacgcacttgtcctggcggcctt

SEQ ID NO: 230403 - DNA, 25 bp, Mus musculus
gagtccctgtgggtctcagttccgg

SEQ ID NO: 230404 - DNA, 25 bp, Mus musculus
ggcctcacaattgctcaccggggtc

SEQ ID NO: 230405 - DNA, 25 bp, Mus musculus
cgcgtggacccaccggataagagaa

SEQ ID NO: 230406 - DNA, 25 bp, Mus musculus
gaaccgtgaatcctaccagggctga

SEQ ID NO: 230407 - DNA, 25 bp, Mus musculus
taccagggctgacagctcttgcggc

SEQ ID NO: 230408 - DNA, 25 bp, Mus musculus
ggctccaggggttgaatctccgaga

SEQ ID NO: 230409 - DNA, 25 bp, Mus musculus
tgaatctccgagaaggcggggcttc

SEQ ID NO: 230410 - DNA, 25 bp, Mus musculus
aggtcccgcctcctaaaggacagcg

SEQ ID NO: 230411 - DNA, 25 bp, Mus musculus
gacgctcctcctcaattttaagtct

SEQ ID NO: 230412 - DNA, 25 bp, Mus musculus
gcaagaagcggctccgcggcgccag

SEQ ID NO: 230413 - DNA, 25 bp, Mus musculus
cactagcccgcctccaggcaagaag

SEQ ID NO: 230414 - DNA, 25 bp, Mus musculus
actgcagctctacccactagcccgc

SEQ ID NO: 230415 - DNA, 25 bp, Mus musculus
gctttcccgcaaaactgcagctcta

SEQ ID NO: 230416 - DNA, 25 bp, Mus musculus
tctctctggctttcccgcaaaactg

SEQ ID NO: 230417 - DNA, 25 bp, Mus musculus
aaaacttctctctctggctttcccg

SEQ ID NO: 230418 - DNA, 25 bp, Mus musculus
ggctgcacccttaaaacttctctct

SEQ ID NO: 230419 - DNA, 25 bp, Mus musculus
ggcagtccgtggttaccactctttc

SEQ ID NO: 230420 - DNA, 25 bp, Mus musculus
agtcttccgagtagttacggcagtc

SEQ ID NO: 230421 - DNA, 25 bp, Mus musculus
cgattctcggcccacgtggcccagt

SEQ ID NO: 230422 - DNA, 25 bp, Mus musculus
ttccgagtagttacggcagtccgtg

SEQ ID NO: 230423 - DNA, 25 bp, Mus musculus
ttacggcagtccgtggttaccactc

SEQ ID NO: 230424 - DNA, 25 bp, Mus musculus
tcctcaattttaagtcttccgagta

SEQ ID NO: 230425 - DNA, 25 bp, Mus musculus
tgccgaccttccgagagtggcctct

SEQ ID NO: 230426 - DNA, 25 bp, Mus musculus
tgcacgaggctttgccgaccttccg

SEQ ID NO: 230427 - DNA, 25 bp, Mus musculus
cctctggccaccaggcttccctgtc

SEQ ID NO: 230428 - DNA, 25 bp, Mus musculus
tggcctctggccaccaggcttccct

SEQ ID NO: 230429 - DNA, 25 bp, Mus musculus
gccgaccttccgagagtggcctctg

SEQ ID NO: 230430 - DNA, 25 bp, Mus musculus
tttgccgaccttccgagagtggcct

SEQ ID NO: 230431 - DNA, 25 bp, Mus musculus
ctttgccgaccttccgagagtggcc

SEQ ID NO: 230432 - DNA, 25 bp, Mus musculus
gctttgccgaccttccgagagtggc

SEQ ID NO: 230433 - DNA, 25 bp, Mus musculus
ggctttgccgaccttccgagagtgg

SEQ ID NO: 230434 - DNA, 25 bp, Mus musculus
aggctttgccgaccttccgagagtg

SEQ ID NO: 230435 - DNA, 25 bp, Mus musculus
gaggctttgccgaccttccgagagt

SEQ ID NO: 230436 - DNA, 25 bp, Mus musculus
cgaggctttgccgaccttccgagag

SEQ ID NO: 230437 - DNA, 25 bp, Mus musculus
gcacgaggctttgccgaccttccga

SEQ ID NO: 230438 - DNA, 25 bp, Mus musculus
ccgaccttccgagagtggcctctgg

SEQ ID NO: 230439 - DNA, 25 bp, Mus musculus
agcgcacattcctcgggcgcctgcg

SEQ ID NO: 230440 - DNA, 25 bp, Mus musculus
tcagccgcaccccaactcgggtttc

SEQ ID NO: 230441 - DNA, 25 bp, Mus musculus
ccggaggcggcctgcatcgcaccct

SEQ ID NO: 230442 - DNA, 25 bp, Mus musculus
tgctgcccccatcggcgctcaggcc

SEQ ID NO: 230443 - DNA, 25 bp, Mus musculus
tgcatcgcaccctgctccttccttc

SEQ ID NO: 230444 - DNA, 25 bp, Mus musculus
ctgcgacatgccctgcacgaggctt

SEQ ID NO: 230445 - DNA, 25 bp, Mus musculus
tcaggcagcgcacattcctcgggcg

SEQ ID NO: 230446 - DNA, 25 bp, Mus musculus
tttcaggcagcgcacattcctcggg

SEQ ID NO: 230447 - DNA, 25 bp, Mus musculus
ttccttcattctttcaggcagcgca

SEQ ID NO: 230448 - DNA, 25 bp, Mus musculus
ttctttcaggcagcgcacattcctc

SEQ ID NO: 230449 - DNA, 25 bp, Mus musculus
cattctttcaggcagcgcacattcc

SEQ ID NO: 230450 - DNA, 25 bp, Mus musculus
cgctcaggccgctgcagcatcagcc

SEQ ID NO: 230451 - DNA, 25 bp, Mus musculus
ccttcattctttcaggcagcgcaca

SEQ ID NO: 230452 - DNA, 25 bp, Mus musculus
ttcattctttcaggcagcgcacatt

SEQ ID NO: 230453 - DNA, 25 bp, Mus musculus
ggaagtcggagctttctgtgtcgtc

SEQ ID NO: 230454 - DNA, 25 bp, Mus musculus
gactcttcctggcagagggcggcaa

SEQ ID NO: 230455 - DNA, 25 bp, Mus musculus
cggtggccgggaagtgactcttcct

SEQ ID NO: 230456 - DNA, 25 bp, Mus musculus
ttcgcatagctgctccggggctcct

SEQ ID NO: 230457 - DNA, 25 bp, Mus musculus
gctcagcgcggacattcttcgcata

SEQ ID NO: 230458 - DNA, 25 bp, Mus musculus
tctgtaatcccgttgccgtggcgac

SEQ ID NO: 230459 - DNA, 25 bp, Mus musculus
agcgctctgcgtctgtaatcccgtt

SEQ ID NO: 230460 - DNA, 25 bp, Mus musculus
ctgagaataaacagcgctctgcgtc

SEQ ID NO: 230461 - DNA, 25 bp, Mus musculus
gagtttcctggcactgggctgagaa

SEQ ID NO: 230462 - DNA, 25 bp, Mus musculus
tcccggccgagtttcctggcactgg

SEQ ID NO: 230463 - DNA, 25 bp, Mus musculus
cttgtgaccaatgacggactctctc

SEQ ID NO: 230464 - DNA, 25 bp, Mus musculus
gggtcagtgacccttgtgaccaatg

SEQ ID NO: 230465 - DNA, 25 bp, Mus musculus
gagctttctgtgtcgtctccgggag

SEQ ID NO: 230466 - DNA, 25 bp, Mus musculus
aagaagcgcagggaccgaaacatga

SEQ ID NO: 230467 - DNA, 25 bp, Mus musculus
tgtacttcccgtatacgtgtctggg

SEQ ID NO: 230468 - DNA, 25 bp, Mus musculus
tgggacgccctacggcttgattaca

SEQ ID NO: 230469 - DNA, 25 bp, Mus musculus
ccgtgaagtaatctcgcctgctgtc

SEQ ID NO: 230470 - DNA, 25 bp, Mus musculus
actccggacgcccagatattcgggg

SEQ ID NO: 230471 - DNA, 25 bp, Mus musculus
ccaaattgtgcgatgtgcacccgca

SEQ ID NO: 230472 - DNA, 25 bp, Mus musculus
ccacggacccgagggccaaattgtg

SEQ ID NO: 230473 - DNA, 25 bp, Mus musculus
cgctttacacgcagacggtgccttc

SEQ ID NO: 230474 - DNA, 25 bp, Mus musculus
cctacaaagagcttgccggcgctga

SEQ ID NO: 230475 - DNA, 25 bp, Mus musculus
cacgcgatctccgagtggcgatctc

SEQ ID NO: 230476 - DNA, 25 bp, Mus musculus
cacaggacacccttcgcgggtcaga

SEQ ID NO: 230477 - DNA, 25 bp, Mus musculus
cggcatatagtttggcgctaaaaaa

SEQ ID NO: 230478 - DNA, 25 bp, Mus musculus
tttccgcgggagatccgaatttggc

SEQ ID NO: 230479 - DNA, 25 bp, Mus musculus
gactggcagtagagagaaccctttc

SEQ ID NO: 230480 - DNA, 25 bp, Mus musculus
cggccacggcgcaacctacaaagag

SEQ ID NO: 230481 - DNA, 25 bp, Mus musculus
gccgtcaccgcagaggacctcagtt

SEQ ID NO: 230482 - DNA, 25 bp, Mus musculus
tgtcgcggagttcctggccgtcacc

SEQ ID NO: 230483 - DNA, 25 bp, Mus musculus
agcagctcagtgtcgcggagttcct

SEQ ID NO: 230484 - DNA, 25 bp, Mus musculus
accatgcccgagcagctcagtgtcg

SEQ ID NO: 230485 - DNA, 25 bp, Mus musculus
gtgttttcgcctcgttcccaccatg

SEQ ID NO: 230486 - DNA, 25 bp, Mus musculus
aggcagctccggtgttttcgcctcg

SEQ ID NO: 230487 - DNA, 25 bp, Mus musculus
ccagcactgttaagtgcagcgtccc

SEQ ID NO: 230488 - DNA, 25 bp, Mus musculus
gcagctataccagcactgttaagtg

SEQ ID NO: 230489 - DNA, 25 bp, Mus musculus
gcgcagagcagctataccagcactg

SEQ ID NO: 230490 - DNA, 25 bp, Mus musculus
aagaggcctcgactaggacgctgcg

SEQ ID NO: 230491 - DNA, 25 bp, Mus musculus
agtgaagaggcctcgactaggacgc

SEQ ID NO: 230492 - DNA, 25 bp, Mus musculus
gccagggaggtagacaagtggtctg

SEQ ID NO: 230493 - DNA, 25 bp, Mus musculus
tggtcagggagttaccagcgagtcg

SEQ ID NO: 230494 - DNA, 25 bp, Mus musculus
gagcagctgccttcgccgccaagat

SEQ ID NO: 230495 - DNA, 25 bp, Mus musculus
cccaggggaggacatttaggagtct

SEQ ID NO: 230496 - DNA, 25 bp, Mus musculus
tgcaactttttccttggccgcggga

SEQ ID NO: 230497 - DNA, 25 bp, Mus musculus
caggagttctgtttgcaactttttc

SEQ ID NO: 230498 - DNA, 25 bp, Mus musculus
ttgggtgacttcaaaaaggatcgga

SEQ ID NO: 230499 - DNA, 25 bp, Mus musculus
ccggctacttgctggccactttagg

SEQ ID NO: 230500 - DNA, 25 bp, Mus musculus
cgcgcgactgttgcaagtcactgtg

SEQ ID NO: 230501 - DNA, 25 bp, Mus musculus
tctggaggggatcgtacagagtccc

SEQ ID NO: 230502 - DNA, 25 bp, Mus musculus
cccgccgtgcgttgtggaccaacat

SEQ ID NO: 230503 - DNA, 25 bp, Mus musculus
ccaacatgggcctggaagaggagct

SEQ ID NO: 230504 - DNA, 25 bp, Mus musculus
aggagctgttgaggatcgccaaaaa

SEQ ID NO: 230505 - DNA, 25 bp, Mus musculus
ccaaaaagctggagaagatggtgtc

SEQ ID NO: 230506 - DNA, 25 bp, Mus musculus
acggtgaggctgcagagtttgcaac

SEQ ID NO: 230507 - DNA, 25 bp, Mus musculus
ccactttaggatgggcatgtgcatg

SEQ ID NO: 230508 - DNA, 25 bp, Mus musculus
cggtgactgaagtgccaggagttct

SEQ ID NO: 230509 - DNA, 25 bp, Mus musculus
cctaccactgtaacgagtgcgggga

SEQ ID NO: 230510 - DNA, 25 bp, Mus musculus
gccagaactccgacctggtgcggca

SEQ ID NO: 230511 - DNA, 25 bp, Mus musculus
gcgggaagaacttcagccagaactc

SEQ ID NO: 230512 - DNA, 25 bp, Mus musculus
agcactaccgcgtgcacaccgggga

SEQ ID NO: 230513 - DNA, 25 bp, Mus musculus
ccctacgagtgccacgagtgcgggc

SEQ ID NO: 230514 - DNA, 25 bp, Mus musculus
caccgagtgcggcaaaagcttctgc

SEQ ID NO: 230515 - DNA, 25 bp, Mus musculus
agaagcctcacaagtgcaccgagtg

SEQ ID NO: 230516 - DNA, 25 bp, Mus musculus
caacgagtgcgggaaaagcttcggc

SEQ ID NO: 230517 - DNA, 25 bp, Mus musculus
cggccctacgactgcaacgagtgcg

SEQ ID NO: 230518 - DNA, 25 bp, Mus musculus
acaggccctacaagtgctacgagtg

SEQ ID NO: 230519 - DNA, 25 bp, Mus musculus
gccttcagtcagatttcagacctca

SEQ ID NO: 230520 - DNA, 25 bp, Mus musculus
catttgttctcagtgtgggaaagcc

SEQ ID NO: 230521 - DNA, 25 bp, Mus musculus
cggggaaaacttcagccgcatctcc

SEQ ID NO: 230522 - DNA, 25 bp, Mus musculus
gcgggcatccgctaccacatttgtt

SEQ ID NO: 230523 - DNA, 25 bp, Mus musculus
gtcaagctgcccgtcatacggtctc

SEQ ID NO: 230524 - DNA, 25 bp, Mus musculus
gcggcgggaggcctagatttttcaa

SEQ ID NO: 230525 - DNA, 25 bp, Mus musculus
gggtgcaagtcccagggttacctga

SEQ ID NO: 230526 - DNA, 25 bp, Mus musculus
tcaacctcttaacggtggtagaaga

SEQ ID NO: 230527 - DNA, 25 bp, Mus musculus
ctctctcttattggcccgtcaagct

SEQ ID NO: 230528 - DNA, 25 bp, Mus musculus
cgtcatacggtctcgtgggccgatt

SEQ ID NO: 230529 - DNA, 25 bp, Mus musculus
gcacggagtccctggaagcagttcc

SEQ ID NO: 230530 - DNA, 25 bp, Mus musculus
cgggatcgcgtctcggtccatgcga

SEQ ID NO: 230531 - DNA, 25 bp, Mus musculus
cgcgcgcgccatttcttgtcgtttt

SEQ ID NO: 230532 - DNA, 25 bp, Mus musculus
ttgtcgttttcaaagcgcctcgcgc

SEQ ID NO: 230533 - DNA, 25 bp, Mus musculus
agctctgccctggtgagtctcgcgc

SEQ ID NO: 230534 - DNA, 25 bp, Mus musculus
cctgcagtttgggtctttgctccga

SEQ ID NO: 230535 - DNA, 25 bp, Mus musculus
atgtgttgataaccgggtcgcgccc

SEQ ID NO: 230536 - DNA, 25 bp, Mus musculus
acggccacaccgattggtcctcgga

SEQ ID NO: 230537 - DNA, 25 bp, Mus musculus
aatcggggagccctctaccggccag

SEQ ID NO: 230538 - DNA, 25 bp, Mus musculus
tacctcccggcagggagctggtaag

SEQ ID NO: 230539 - DNA, 25 bp, Mus musculus
gtcctgatgggtcacctggcgtccc

SEQ ID NO: 230540 - DNA, 25 bp, Mus musculus
cctgcgtcctcctaccgtggggttg

SEQ ID NO: 230541 - DNA, 25 bp, Mus musculus
ctctgtgcgcctctcggacgggaca

SEQ ID NO: 230542 - DNA, 25 bp, Mus musculus
gagcgcacggaaagacggtcccaaa

SEQ ID NO: 230543 - DNA, 25 bp, Mus musculus
cccgaagggagcatcccggatggtt

SEQ ID NO: 230544 - DNA, 25 bp, Mus musculus
tgttccgtacctcccggcagggagc

SEQ ID NO: 230545 - DNA, 25 bp, Mus musculus
tgtccaaagccctggatcgtggggt

SEQ ID NO: 230546 - DNA, 25 bp, Mus musculus
gaccctgggagagcgtcctccgtgt

SEQ ID NO: 230547 - DNA, 25 bp, Mus musculus
tgtcccgcgctctgggaagatccca

SEQ ID NO: 230548 - DNA, 25 bp, Mus musculus
aagatcccactggacaagagtgccc

SEQ ID NO: 230549 - DNA, 25 bp, Mus musculus
ctctaccggccaggtcaggggtgac

SEQ ID NO: 230550 - DNA, 25 bp, Mus musculus
tcccggatggttgtccaaagccctg

SEQ ID NO: 230551 - DNA, 25 bp, Mus musculus
tcttctggcggcaggccacggctca

SEQ ID NO: 230552 - DNA, 25 bp, Mus musculus
ggccgcccggagtcgaatcctgaac

SEQ ID NO: 230553 - DNA, 25 bp, Mus musculus
ggccgcatatacgtggccgcccgga

SEQ ID NO: 230554 - DNA, 25 bp, Mus musculus
gctcattatcctgtatggccgcata

SEQ ID NO: 230555 - DNA, 25 bp, Mus musculus
tatcccatccatcttgctcattatc

SEQ ID NO: 230556 - DNA, 25 bp, Mus musculus
tgtggcgccttctatatcccatcca

SEQ ID NO: 230557 - DNA, 25 bp, Mus musculus
ctactcgacctgtggcgccttctat

SEQ ID NO: 230558 - DNA, 25 bp, Mus musculus
tttcttacaccatctactcgacctg

SEQ ID NO: 230559 - DNA, 25 bp, Mus musculus
gcctggtgaacacatctcagatttc

SEQ ID NO: 230560 - DNA, 25 bp, Mus musculus
cggctcacgaggagatgtccgactg

SEQ ID NO: 230561 - DNA, 25 bp, Mus musculus
cggccgtctggatcatctctatttg

SEQ ID NO: 230562 - DNA, 25 bp, Mus musculus
cagcagccatgattgcggccgtctg

SEQ ID NO: 230563 - DNA, 25 bp, Mus musculus
caggccacgcagcagccatgattgc

SEQ ID NO: 230564 - DNA, 25 bp, Mus musculus
tgtccgactgcctggtgaacacatc

SEQ ID NO: 230565 - DNA, 25 bp, Mus musculus
tccctgggtgcagcgagctgtcacc

SEQ ID NO: 230566 - DNA, 25 bp, Mus musculus
ctgcatcgcggcgtccctgggtgca

SEQ ID NO: 230567 - DNA, 25 bp, Mus musculus
tgggaaaagctcgagccgctgcatc

SEQ ID NO: 230568 - DNA, 25 bp, Mus musculus
tccttcggcttcaggaagcgcgctg

SEQ ID NO: 230569 - DNA, 25 bp, Mus musculus
aaggcgtggacccagagctcgcttt

SEQ ID NO: 230570 - DNA, 25 bp, Mus musculus
aagacgcggcttcctggccgcattc

SEQ ID NO: 230571 - DNA, 25 bp, Mus musculus
cgtggacccagagctcgctttgagg

SEQ ID NO: 230572 - DNA, 25 bp, Mus musculus
ccgcattccggagaaggagctttgc

SEQ ID NO: 230573 - DNA, 25 bp, Mus musculus
gagaaggagctttgcgccgcaagtc

SEQ ID NO: 230574 - DNA, 25 bp, Mus musculus
ccggtcgtccggctcaggaaacgca

SEQ ID NO: 230575 - DNA, 25 bp, Mus musculus
tcgtccggctcaggaaacgcagaga

SEQ ID NO: 230576 - DNA, 25 bp, Mus musculus
ctcaggaaacgcagagaaagccagg

SEQ ID NO: 230577 - DNA, 25 bp, Mus musculus
cgagttcacaagacgcggcttcctg

SEQ ID NO: 230578 - DNA, 25 bp, Mus musculus
ccatccctgcgccagtgcggcagcc

SEQ ID NO: 230579 - DNA, 25 bp, Mus musculus
caggtggaccagcatctgctacaca

SEQ ID NO: 230580 - DNA, 25 bp, Mus musculus
ctctgagctgatggttatgtctgca

SEQ ID NO: 230581 - DNA, 25 bp, Mus musculus
ctgcagtctgtgttgacgctgaatc

SEQ ID NO: 230582 - DNA, 25 bp, Mus musculus
agtaccctactttggaacagcctga

SEQ ID NO: 230583 - DNA, 25 bp, Mus musculus
agcttgcgtttctaaggttgatttc

SEQ ID NO: 230584 - DNA, 25 bp, Mus musculus
accggtacctcatctgacaagcttg

SEQ ID NO: 230585 - DNA, 25 bp, Mus musculus
tgctgctaagcagtgtcacaatacc

SEQ ID NO: 230586 - DNA, 25 bp, Mus musculus
ggaggcttcttttgaccacaggata

SEQ ID NO: 230587 - DNA, 25 bp, Mus musculus
ccacagtgagagttggttcgaaacc

SEQ ID NO: 230588 - DNA, 25 bp, Mus musculus
gaggccaccgagtgagaagtctccc

SEQ ID NO: 230589 - DNA, 25 bp, Mus musculus
gaagtctcccgtcacttggcccagg

SEQ ID NO: 230590 - DNA, 25 bp, Mus musculus
ctccgggagtccaagtagccagtcc

SEQ ID NO: 230591 - DNA, 25 bp, Mus musculus
tccctgcgtctcctttgaaccattg

SEQ ID NO: 230592 - DNA, 25 bp, Mus musculus
accttttggtgcctgtagttggagc

SEQ ID NO: 230593 - DNA, 25 bp, Mus musculus
ccgaggactaattaatggtggaatc

SEQ ID NO: 230594 - DNA, 25 bp, Mus musculus
tccgaggtgcctgcggtttctgcta

SEQ ID NO: 230595 - DNA, 25 bp, Mus musculus
gacctctccgaggtgcctgcggttt

SEQ ID NO: 230596 - DNA, 25 bp, Mus musculus
gccgcttttggcctgcggctggcca

SEQ ID NO: 230597 - DNA, 25 bp, Mus musculus
aagcgcaggaatgaagtgcggtttc

SEQ ID NO: 230598 - DNA, 25 bp, Mus musculus
cgcggtgaactttccgcagcgcgca

SEQ ID NO: 230599 - DNA, 25 bp, Mus musculus
aatggtggaatctgcaggggcactc

SEQ ID NO: 230600 - DNA, 25 bp, Mus musculus
tgccagtcgacagtcccgaggacta

SEQ ID NO: 230601 - DNA, 25 bp, Mus musculus
gtttaagttgccagtcgacagtccc

SEQ ID NO: 230602 - DNA, 25 bp, Mus musculus
cgaggcattcgctttgtttaagttg

SEQ ID NO: 230603 - DNA, 25 bp, Mus musculus
gcccgggaaggaattcgaggcattc

SEQ ID NO: 230604 - DNA, 25 bp, Mus musculus
ttggagggagagactcagagatttt

SEQ ID NO: 230605 - DNA, 25 bp, Mus musculus
ccctcattgtcagtctgggggagcc

SEQ ID NO: 230606 - DNA, 25 bp, Mus musculus
aatctgcaggggcactcgggtagcc

SEQ ID NO: 230607 - DNA, 25 bp, Mus musculus
acgcacaccacacgagggacaacaa

SEQ ID NO: 230608 - DNA, 25 bp, Mus musculus
ggcgaccaagtcctcagcagcttct

SEQ ID NO: 230609 - DNA, 25 bp, Mus musculus
cctcagcagcttctctggagcagtg

SEQ ID NO: 230610 - DNA, 25 bp, Mus musculus
ctgcgggcgacactgcagcgacctt

SEQ ID NO: 230611 - DNA, 25 bp, Mus musculus
gagggacaacaaagcccggccgagc

SEQ ID NO: 230612 - DNA, 25 bp, Mus musculus
gcggcccagaagagccgagttgtca

SEQ ID NO: 230613 - DNA, 25 bp, Mus musculus
gcagtcctccttacccgcagggaag

SEQ ID NO: 230614 - DNA, 25 bp, Mus musculus
cgcctcggcttctgggcggaaactt

SEQ ID NO: 230615 - DNA, 25 bp, Mus musculus
cttaacggctgttcagcgacggccc

SEQ ID NO: 230616 - DNA, 25 bp, Mus musculus
ctccggggctcaaagcgaatctgca

SEQ ID NO: 230617 - DNA, 25 bp, Mus musculus
ggctcaaagcgaatctgcagctgcg

SEQ ID NO: 230618 - DNA, 25 bp, Mus musculus
cgcccggcagaaccttaggcagcgg

SEQ ID NO: 230619 - DNA, 25 bp, Mus musculus
gtctcaatcggcgaccaagtcctca

SEQ ID NO: 230620 - DNA, 25 bp, Mus musculus
aagcccggccgagcggcccagaaga

SEQ ID NO: 230621 - DNA, 25 bp, Mus musculus
tttagaccgtgtctcaggcccagcc

SEQ ID NO: 230622 - DNA, 25 bp, Mus musculus
aggcgcactcctgggcgaatcaggc

SEQ ID NO: 230623 - DNA, 25 bp, Mus musculus
gccgtgaagtctacaaaggggctcc

SEQ ID NO: 230624 - DNA, 25 bp, Mus musculus
cccagatgttggcagccgtgaagtc

SEQ ID NO: 230625 - DNA, 25 bp, Mus musculus
tcccgaagcgaaatctccggccttg

SEQ ID NO: 230626 - DNA, 25 bp, Mus musculus
cgggaatcagggatcttcggttctc

SEQ ID NO: 230627 - DNA, 25 bp, Mus musculus
ccagagaaaactcgcgcgtggaagt

SEQ ID NO: 230628 - DNA, 25 bp, Mus musculus
cccagtctgagtatgacgggaatca

SEQ ID NO: 230629 - DNA, 25 bp, Mus musculus
ggtgccaaacccgagatatgtgaga

SEQ ID NO: 230630 - DNA, 25 bp, Mus musculus
gatggggagagacacaagagcccta

SEQ ID NO: 230631 - DNA, 25 bp, Mus musculus
gccctaggaggacgcccagagaaaa

SEQ ID NO: 230632 - DNA, 25 bp, Mus musculus
ggaactcgactgtcctcggtcactg

SEQ ID NO: 230633 - DNA, 25 bp, Mus musculus
tagagtcagagttagagccgcctcg

SEQ ID NO: 230634 - DNA, 25 bp, Mus musculus
gtcctcagtggcgagggcgaaaaaa

SEQ ID NO: 230635 - DNA, 25 bp, Mus musculus
gtctcggctattccggtctccatgg

SEQ ID NO: 230636 - DNA, 25 bp, Mus musculus
atccgcctgacttcgggttctgagc

SEQ ID NO: 230637 - DNA, 25 bp, Mus musculus
agtgcgacccagcatatccgcctga

SEQ ID NO: 230638 - DNA, 25 bp, Mus musculus
ccctgcgattgggagtgcgacccag

SEQ ID NO: 230639 - DNA, 25 bp, Mus musculus
atcgcgaggctgacctagagcgccc

SEQ ID NO: 230640 - DNA, 25 bp, Mus musculus
gccgcagctccgatcgcgaggctga

SEQ ID NO: 230641 - DNA, 25 bp, Mus musculus
aggctccttctttcggggagtgcgc

SEQ ID NO: 230642 - DNA, 25 bp, Mus musculus
agcggttcgatcacggcctcacctt

SEQ ID NO: 230643 - DNA, 25 bp, Mus musculus
agtcagaccatcagggtcacaccct

SEQ ID NO: 230644 - DNA, 25 bp, Mus musculus
caaacgcgtcgggaagccatctttc

SEQ ID NO: 230645 - DNA, 25 bp, Mus musculus
tccgcacacatcagacacacaggta

SEQ ID NO: 230646 - DNA, 25 bp, Mus musculus
tcagacacacaggtagacaaacgcg

SEQ ID NO: 230647 - DNA, 25 bp, Mus musculus
ccagagagcgacgtcctggaggcta

SEQ ID NO: 230648 - DNA, 25 bp, Mus musculus
gaagccatctttcccagtcagacca

SEQ ID NO: 230649 - DNA, 25 bp, Mus musculus
gctgctggcttctatggcagcggca

SEQ ID NO: 230650 - DNA, 25 bp, Mus musculus
gggcctcaacacctacggagtgctg

SEQ ID NO: 230651 - DNA, 25 bp, Mus musculus
ggcttcgacgtaccgggcctcaaca

SEQ ID NO: 230652 - DNA, 25 bp, Mus musculus
ggtgcggttctacccactggatcgc

SEQ ID NO: 230653 - DNA, 25 bp, Mus musculus
cctggttgtctctggagtcccagca

SEQ ID NO: 230654 - DNA, 25 bp, Mus musculus
ccgcgtcttccagttgcacgtggcg

SEQ ID NO: 230655 - DNA, 25 bp, Mus musculus
cgcattgcgagaggctgagcttgcc

SEQ ID NO: 230656 - DNA, 25 bp, Mus musculus
tggatacgctgctgccagccctgga

SEQ ID NO: 230657 - DNA, 25 bp, Mus musculus
gcgcttgggatttgtgctgttgcta

SEQ ID NO: 230658 - DNA, 25 bp, Mus musculus
gtacaccctgggagttccacgagag

SEQ ID NO: 230659 - DNA, 25 bp, Mus musculus
ttgctagtgaaaccggtacaccctg

SEQ ID NO: 230660 - DNA, 25 bp, Mus musculus
tgcgcccacggctactttgctagtg

SEQ ID NO: 230661 - DNA, 25 bp, Mus musculus
tcgggccagatgtactcgacagctg

SEQ ID NO: 230662 - DNA, 25 bp, Mus musculus
cccgctctacgatctgggctggtac

SEQ ID NO: 230663 - DNA, 25 bp, Mus musculus
cgttcacggcctggatctcgaaggt

SEQ ID NO: 230664 - DNA, 25 bp, Mus musculus
tccactctagcatgagggacgtctc

SEQ ID NO: 230665 - DNA, 25 bp, Mus musculus
tggggtccactctagcatgagggac

SEQ ID NO: 230666 - DNA, 25 bp, Mus musculus
gttgtaaacaagatcctcgcgaccc

SEQ ID NO: 230667 - DNA, 25 bp, Mus musculus
gctcttgcagatgatgttgtaaaca

SEQ ID NO: 230668 - DNA, 25 bp, Mus musculus
gccacagctcttgcagatgatgttg

SEQ ID NO: 230669 - DNA, 25 bp, Mus musculus
ggccggagccacagctcttgcagat

SEQ ID NO: 230670 - DNA, 25 bp, Mus musculus
cggggcgcgtactgcacgttgtccc

SEQ ID NO: 230671 - DNA, 25 bp, Mus musculus
atgcgcggctcagtcaggcccagct

SEQ ID NO: 230672 - DNA, 25 bp, Mus musculus
gtcactgatgtagatgcgcggctca

SEQ ID NO: 230673 - DNA, 25 bp, Mus musculus
tgtgtgccagcaggtcactgatgta

SEQ ID NO: 230674 - DNA, 25 bp, Mus musculus
tcgaaggtgtactgcgtgtgtgcca

SEQ ID NO: 230675 - DNA, 25 bp, Mus musculus
gcctggatctcgaaggtgtactgcg

SEQ ID NO: 230676 - DNA, 25 bp, Mus musculus
tagcatgagggacgtctcgttgacg

SEQ ID NO: 230677 - DNA, 25 bp, Mus musculus
gattcggcgcggctgtcactctcgc

SEQ ID NO: 230678 - DNA, 25 bp, Mus musculus
cgcggctgtcactctcgccttccgc

SEQ ID NO: 230679 - DNA, 25 bp, Mus musculus
cgccttccgcgcctctaattggatt

SEQ ID NO: 230680 - DNA, 25 bp, Mus musculus
cgcgcctctaattggattcgcaaca

SEQ ID NO: 230681 - DNA, 25 bp, Mus musculus
gcctctaattggattcgcaacacgc

SEQ ID NO: 230682 - DNA, 25 bp, Mus musculus
ttggattcgcaacacgcagaggtca

SEQ ID NO: 230683 - DNA, 25 bp, Mus musculus
ttcgcaacacgcagaggtcagcaga

SEQ ID NO: 230684 - DNA, 25 bp, Mus musculus
cacgcagaggtcagcagaaacgcta

SEQ ID NO: 230685 - DNA, 25 bp, Mus musculus
cagaggtcagcagaaacgctatgga

SEQ ID NO: 230686 - DNA, 25 bp, Mus musculus
cagaaacgctatggagaggagaatc

SEQ ID NO: 230687 - DNA, 25 bp, Mus musculus
aaggggcgtccggatataaagagag

SEQ ID NO: 230688 - DNA, 25 bp, Mus musculus
ttcttcccgggccacaaagacggca

SEQ ID NO: 230689 - DNA, 25 bp, Mus musculus
ccgcgttgggcccagcatgacaagc

SEQ ID NO: 230690 - DNA, 25 bp, Mus musculus
ttgggcccagcatgacaagcaggcc

SEQ ID NO: 230691 - DNA, 25 bp, Mus musculus
tacagtagagtttgatgggcacatc

SEQ ID NO: 230692 - DNA, 25 bp, Mus musculus
cgcgcacagcaatgagggacataca

SEQ ID NO: 230693 - DNA, 25 bp, Mus musculus
ccgaagcttcgcacctcagtgttga

SEQ ID NO: 230694 - DNA, 25 bp, Mus musculus
gcacttccggtagaagacgcgcaca

SEQ ID NO: 230695 - DNA, 25 bp, Mus musculus
cgagaacttcatctccacgtggatg

SEQ ID NO: 230696 - DNA, 25 bp, Mus musculus
tgttgattttcatgacgcggccacc

SEQ ID NO: 230697 - DNA, 25 bp, Mus musculus
ggtgccgttctccacagcctcgaag

SEQ ID NO: 230698 - DNA, 25 bp, Mus musculus
ccaggtccacctgagagaagctctc

SEQ ID NO: 230699 - DNA, 25 bp, Mus musculus
tggtgtccaccttcacccacggatt

SEQ ID NO: 230700 - DNA, 25 bp, Mus musculus
ctccatccagttgggaaaggttttg

SEQ ID NO: 230701 - DNA, 25 bp, Mus musculus
gctgcagtcacgcaccgagaacttc

SEQ ID NO: 230702 - DNA, 25 bp, Mus musculus
acggcctcttacctcggcagacggt

SEQ ID NO: 230703 - DNA, 25 bp, Mus musculus
gccttgcacatgcagcgacctatgg

SEQ ID NO: 230704 - DNA, 25 bp, Mus musculus
atacagccgccatagtcctggaagg

SEQ ID NO: 230705 - DNA, 25 bp, Mus musculus
ctcctcctggcacagtcaatcagcg

SEQ ID NO: 230706 - DNA, 25 bp, Mus musculus
ttcgggtggcccaggctgcatccaa

SEQ ID NO: 230707 - DNA, 25 bp, Mus musculus
cctcggaacgctccctgccaaactt

SEQ ID NO: 230708 - DNA, 25 bp, Mus musculus
ccctgagctcggtgccgaggcattg

SEQ ID NO: 230709 - DNA, 25 bp, Mus musculus
cttctaaatcttttgagtcccttcg

SEQ ID NO: 230710 - DNA, 25 bp, Mus musculus
aagcctcggcaagatggtcccttcg

SEQ ID NO: 230711 - DNA, 25 bp, Mus musculus
agccagcagaatgagccatccagcc

SEQ ID NO: 230712 - DNA, 25 bp, Mus musculus
atgagccatccagcccgggcagaac

SEQ ID NO: 230713 - DNA, 25 bp, Mus musculus
gagccggggttggactgccaatcct

SEQ ID NO: 230714 - DNA, 25 bp, Mus musculus
ttggactgccaatcctgtgcctctg

SEQ ID NO: 230715 - DNA, 25 bp, Mus musculus
acgggttgcaccacgcccgagtcat

SEQ ID NO: 230716 - DNA, 25 bp, Mus musculus
accacgcccgagtcatgatcttcta

SEQ ID NO: 230717 - DNA, 25 bp, Mus musculus
cgcccgagtcatgatcttctaaatc

SEQ ID NO: 230718 - DNA, 25 bp, Mus musculus
ccggctggctacaaagcctcggcaa

SEQ ID NO: 230719 - DNA, 25 bp, Mus musculus
caggcaccttgcaggtgaacttgcc

SEQ ID NO: 230720 - DNA, 25 bp, Mus musculus
gagaaggcgactttctgtgtagccc

SEQ ID NO: 230721 - DNA, 25 bp, Mus musculus
ctgttgatggtcctcagggcagaga

SEQ ID NO: 230722 - DNA, 25 bp, Mus musculus
tcgcaaggggctgttgatggtcctc

SEQ ID NO: 230723 - DNA, 25 bp, Mus musculus
cgaatgacctggttcggtcgcaagg

SEQ ID NO: 230724 - DNA, 25 bp, Mus musculus
cttttcgaagcgaatgacctggttc

SEQ ID NO: 230725 - DNA, 25 bp, Mus musculus
ggtgatcaccttttcgaagcgaatg

SEQ ID NO: 230726 - DNA, 25 bp, Mus musculus
tctcgttcgcgttggtgatcacctt

SEQ ID NO: 230727 - DNA, 25 bp, Mus musculus
tgaacttgccgttgcgtggctcata

SEQ ID NO: 230728 - DNA, 25 bp, Mus musculus
agaggccaggcaccttgcaggtgaa

SEQ ID NO: 230729 - DNA, 25 bp, Mus musculus
agctggcatgataggtgaagtagta

SEQ ID NO: 230730 - DNA, 25 bp, Mus musculus
cgaacgagattcacacacaggttgc

SEQ ID NO: 230731 - DNA, 25 bp, Mus musculus
cgatcgcggccacgaacgagattca

SEQ ID NO: 230732 - DNA, 25 bp, Mus musculus
tggctcatagttctcgttcgcgttg

SEQ ID NO: 230733 - DNA, 25 bp, Mus musculus
ggtctccttgcaggtacctaacacc

SEQ ID NO: 230734 - DNA, 25 bp, Mus musculus
gcactgcacacgcacttgccgatgg

SEQ ID NO: 230735 - DNA, 25 bp, Mus musculus
agtacatcttgggtgtgtcgcgctc

SEQ ID NO: 230736 - DNA, 25 bp, Mus musculus
ccgcctccgagaaggctgccaggtt

SEQ ID NO: 230737 - DNA, 25 bp, Mus musculus
aggcaggcacctatgtcctggaagg

SEQ ID NO: 230738 - DNA, 25 bp, Mus musculus
cgtgttcagcttgagcctccgcaca

SEQ ID NO: 230739 - DNA, 25 bp, Mus musculus
tgtcaatcttgaggaactggctctc

SEQ ID NO: 230740 - DNA, 25 bp, Mus musculus
tcgcggtcagactccaggtagtgaa

SEQ ID NO: 230741 - DNA, 25 bp, Mus musculus
ccctgggatgctattgcagtcacgc

SEQ ID NO: 230742 - DNA, 25 bp, Mus musculus
cacgcagggtgaatttgatctcggc

SEQ ID NO: 230743 - DNA, 25 bp, Mus musculus
gcacccagttcgtgcgcagccagtt

SEQ ID NO: 230744 - DNA, 25 bp, Mus musculus
tggggctcatgacgttgcatacttg

SEQ ID NO: 230745 - DNA, 25 bp, Mus musculus
catacttggtacgtgtggatgggcc

SEQ ID NO: 230746 - DNA, 25 bp, Mus musculus
aactggctctcttgtgtgctggccc

SEQ ID NO: 230747 - DNA, 25 bp, Mus musculus
acaacctaggctgcgcccgaagtga

SEQ ID NO: 230748 - DNA, 25 bp, Mus musculus
tctccgtgcaacttcactgctggga

SEQ ID NO: 230749 - DNA, 25 bp, Mus musculus
ttccacgggacgcaacaacctaggc

SEQ ID NO: 230750 - DNA, 25 bp, Mus musculus
acgaccatagctgcgtctccgtgca

SEQ ID NO: 230751 - DNA, 25 bp, Mus musculus
gcgcagagtcccagcgccgtttcta

SEQ ID NO: 230752 - DNA, 25 bp, Mus musculus
gcgccgtttctatggttacctgctc

SEQ ID NO: 230753 - DNA, 25 bp, Mus musculus
acctgctcagcaccgattcaaactg

SEQ ID NO: 230754 - DNA, 25 bp, Mus musculus
cgttctttattgacagcgccattga

SEQ ID NO: 230755 - DNA, 25 bp, Mus musculus
gcgccattgaggacacgaacactcc

SEQ ID NO: 230756 - DNA, 25 bp, Mus musculus
ctgcccgaagggaacaataaagctt

SEQ ID NO: 230757 - DNA, 25 bp, Mus musculus
gctttctccattcaacagcgctgga

SEQ ID NO: 230758 - DNA, 25 bp, Mus musculus
ctggagacgccaaaaggcagccatc

SEQ ID NO: 230759 - DNA, 25 bp, Mus musculus
gaaggctgtccctgcatcacgtgca

SEQ ID NO: 230760 - DNA, 25 bp, Mus musculus
ctgctgggagctgaagttttatttc

SEQ ID NO: 230761 - DNA, 25 bp, Mus musculus
tgacccagaaattccacagccagcg

SEQ ID NO: 230762 - DNA, 25 bp, Mus musculus
atccggggttagctgggcaccagcc

SEQ ID NO: 230763 - DNA, 25 bp, Mus musculus
cctcagtccgctgggctggaggtac

SEQ ID NO: 230764 - DNA, 25 bp, Mus musculus
tggaggtacgctcccggactctggc

SEQ ID NO: 230765 - DNA, 25 bp, Mus musculus
cggcgccaatcttcgggccacctct

SEQ ID NO: 230766 - DNA, 25 bp, Mus musculus
ggccacctctgccagtgctctgtga

SEQ ID NO: 230767 - DNA, 25 bp, Mus musculus
ccagtgctctgtgacccagaaattc

SEQ ID NO: 230768 - DNA, 25 bp, Mus musculus
acagccagcgaatgctcctgtcctg

SEQ ID NO: 230769 - DNA, 25 bp, Mus musculus
cctccgaaactgtggcagagtcccg

SEQ ID NO: 230770 - DNA, 25 bp, Mus musculus
aaactgtggcagagtcccgcacgcg

SEQ ID NO: 230771 - DNA, 25 bp, Mus musculus
cagtgacccagcagcttctggcgcg

SEQ ID NO: 230772 - DNA, 25 bp, Mus musculus
ccagcagcttctggcgcgtggtttc

SEQ ID NO: 230773 - DNA, 25 bp, Mus musculus
tttccactgctagccgctgccctgt

SEQ ID NO: 230774 - DNA, 25 bp, Mus musculus
accgtccgttctttccactgctagc

SEQ ID NO: 230775 - DNA, 25 bp, Mus musculus
ttggccggagtgaatcagccctgcg

SEQ ID NO: 230776 - DNA, 25 bp, Mus musculus
cctgttcgcgctcgcactgtcaata

SEQ ID NO: 230777 - DNA, 25 bp, Mus musculus
tgtcaataaagttctcgcgcgccgg

SEQ ID NO: 230778 - DNA, 25 bp, Mus musculus
tgagttggccggagtgaatcagccc

SEQ ID NO: 230779 - DNA, 25 bp, Mus musculus
ttcctcacatcctgccggagacatt

SEQ ID NO: 230780 - DNA, 25 bp, Mus musculus
cacatcctgccggagacatttctca

SEQ ID NO: 230781 - DNA, 25 bp, Mus musculus
tgccggagacatttctcaatcctga

SEQ ID NO: 230782 - DNA, 25 bp, Mus musculus
tcaatcctgactcaatcggtactca

SEQ ID NO: 230783 - DNA, 25 bp, Mus musculus
gactcaatcggtactcaggcccgtg

SEQ ID NO: 230784 - DNA, 25 bp, Mus musculus
tactcaggcccgtgaagaggaaaca

SEQ ID NO: 230785 - DNA, 25 bp, Mus musculus
ggcccgtgaagaggaaacactcgaa

SEQ ID NO: 230786 - DNA, 25 bp, Mus musculus
gaggaaacactcgaaactctttctg

SEQ ID NO: 230787 - DNA, 25 bp, Mus musculus
tcgaaactctttctgcgcgcgttcg

SEQ ID NO: 230788 - DNA, 25 bp, Mus musculus
gcctctccgaccgtctgggcaggag

SEQ ID NO: 230789 - DNA, 25 bp, Mus musculus
tctagctcggcccaactgggcggcg

SEQ ID NO: 230790 - DNA, 25 bp, Mus musculus
actgtccggtcttccctctggaggt

SEQ ID NO: 230791 - DNA, 25 bp, Mus musculus
ggctcccggcaggtgtctcagccgt

SEQ ID NO: 230792 - DNA, 25 bp, Mus musculus
gccgccgcgagcaattggctgtaag

SEQ ID NO: 230793 - DNA, 25 bp, Mus musculus
ttcgccgtgttctcggccgccgcga

SEQ ID NO: 230794 - DNA, 25 bp, Mus musculus
tgcgactcctcgtcttcgccgtgtt

SEQ ID NO: 230795 - DNA, 25 bp, Mus musculus
atgagcccccgttcgtgcctgcggt

SEQ ID NO: 230796 - DNA, 25 bp, Mus musculus
tgcgcgcgagtagcagccgctctcg

SEQ ID NO: 230797 - DNA, 25 bp, Mus musculus
cacgccgctggacccgcccaggtaa

SEQ ID NO: 230798 - DNA, 25 bp, Mus musculus
gagctgtgcccgctcgtccctaagg

SEQ ID NO: 230799 - DNA, 25 bp, Mus musculus
tgctgccccagtccggctcggggta

SEQ ID NO: 230800 - DNA, 25 bp, Mus musculus
tcccgccggttcctcctgccggcca

SEQ ID NO: 230801 - DNA, 25 bp, Mus musculus
gccaccgccgcatcccggctctggg

SEQ ID NO: 230802 - DNA, 25 bp, Mus musculus
cgagcaattggctgtaagtcgggcc

SEQ ID NO: 230803 - DNA, 25 bp, Mus musculus
taaagacgtgctggcgtgctgtacc

SEQ ID NO: 230804 - DNA, 25 bp, Mus musculus
agatgcacacgtgccggtgaccatg

SEQ ID NO: 230805 - DNA, 25 bp, Mus musculus
ctgcttcgtcaagtgccggcagtgc

SEQ ID NO: 230806 - DNA, 25 bp, Mus musculus
gcggcttccacacagcgcaagtgga

SEQ ID NO: 230807 - DNA, 25 bp, Mus musculus
gccattgacggctgcgagctactgt

SEQ ID NO: 230808 - DNA, 25 bp, Mus musculus
ggccgcacgtgcaacaagacatcta

SEQ ID NO: 230809 - DNA, 25 bp, Mus musculus
gacatccgcagtggcgtgctaggca

SEQ ID NO: 230810 - DNA, 25 bp, Mus musculus
ttctgtgagcaggacatccgcagtg

SEQ ID NO: 230811 - DNA, 25 bp, Mus musculus
agcctagcccggacttctgtgagca

SEQ ID NO: 230812 - DNA, 25 bp, Mus musculus
acctggtatacctggagcctagccc

SEQ ID NO: 230813 - DNA, 25 bp, Mus musculus
gccacatacagatgaggacctggta

SEQ ID NO: 230814 - DNA, 25 bp, Mus musculus
ctcctgcgaggtaaagacgtgctgg

SEQ ID NO: 230815 - DNA, 25 bp, Mus musculus
tggccacgcgctaaaggagaagttt

SEQ ID NO: 230816 - DNA, 25 bp, Mus musculus
cggaatgcacagttcaagccacata

SEQ ID NO: 230817 - DNA, 25 bp, Mus musculus
ggaagcaggaagtcgaggcccacaa

SEQ ID NO: 230818 - DNA, 25 bp, Mus musculus
tcccggatggcaaagaggccggccc

SEQ ID NO: 230819 - DNA, 25 bp, Mus musculus
cagagccgcccggtccgtcacctcg

SEQ ID NO: 230820 - DNA, 25 bp, Mus musculus
ccgccagccgcaacgcgtccgtggc

SEQ ID NO: 230821 - DNA, 25 bp, Mus musculus
aagtcgaggcccacaacggagagac

SEQ ID NO: 230822 - DNA, 25 bp, Mus musculus
cccgcctcgcttccctcagaacccg

SEQ ID NO: 230823 - DNA, 25 bp, Mus musculus
accgcccgcaagcaccgggatgccc

SEQ ID NO: 230824 - DNA, 25 bp, Mus musculus
ccgcgagcatcctcgagaaccgaga

SEQ ID NO: 230825 - DNA, 25 bp, Mus musculus
catcctcgagaaccgagagaggacg

SEQ ID NO: 230826 - DNA, 25 bp, Mus musculus
agacgctcccgcagggaggcttctc

SEQ ID NO: 230827 - DNA, 25 bp, Mus musculus
aggggcacgcgcctgacgtcagcac

SEQ ID NO: 230828 - DNA, 25 bp, Mus musculus
ctgacgtcagcacgcaggggacgca

SEQ ID NO: 230829 - DNA, 25 bp, Mus musculus
tgcttaggcaggtcccggatggcaa

SEQ ID NO: 230830 - DNA, 25 bp, Mus musculus
cgccgccattccagccctaagcctc

SEQ ID NO: 230831 - DNA, 25 bp, Mus musculus
aggagcccaagaccacagtccgcta

SEQ ID NO: 230832 - DNA, 25 bp, Mus musculus
ccaagcgctgtttgggcttcgcctt

SEQ ID NO: 230833 - DNA, 25 bp, Mus musculus
ctcttctccatgcttcggggccaag

SEQ ID NO: 230834 - DNA, 25 bp, Mus musculus
ctatggttttaactcgcctcttctc

SEQ ID NO: 230835 - DNA, 25 bp, Mus musculus
ccgtgtcacgctagtctatggtttt

SEQ ID NO: 230836 - DNA, 25 bp, Mus musculus
gtcgctctagacctcaaccgtgtca

SEQ ID NO: 230837 - DNA, 25 bp, Mus musculus
cagtccgctaccgagtccggaaaag

SEQ ID NO: 230838 - DNA, 25 bp, Mus musculus
cgagttaatacgaaccaggagccca

SEQ ID NO: 230839 - DNA, 25 bp, Mus musculus
gcccacgtcgtcgtccgagttaata

SEQ ID NO: 230840 - DNA, 25 bp, Mus musculus
aaggaaggagcggagcatctacctc

SEQ ID NO: 230841 - DNA, 25 bp, Mus musculus
tataacacatggtcctcgcccaggc

SEQ ID NO: 230842 - DNA, 25 bp, Mus musculus
cggggcacggagcaaatataacaca

SEQ ID NO: 230843 - DNA, 25 bp, Mus musculus
tggacttcccgccagtggaggtcaa

SEQ ID NO: 230844 - DNA, 25 bp, Mus musculus
gccagctctttatcgcgggacttcc

SEQ ID NO: 230845 - DNA, 25 bp, Mus musculus
tcctaggggacgtcccagggatcca

SEQ ID NO: 230846 - DNA, 25 bp, Mus musculus
gttgggcctcatcccacatcgaggg

SEQ ID NO: 230847 - DNA, 25 bp, Mus musculus
tcaaagtcgcctctgggcatggccc

SEQ ID NO: 230848 - DNA, 25 bp, Mus musculus
cactccaagccacgtctggcgtgga

SEQ ID NO: 230849 - DNA, 25 bp, Mus musculus
gccggccacgttgttcaggctcaaa

SEQ ID NO: 230850 - DNA, 25 bp, Mus musculus
ttggggcccagacaaaggcacagtc

SEQ ID NO: 230851 - DNA, 25 bp, Mus musculus
tccagagagcctagctcgcggctag

SEQ ID NO: 230852 - DNA, 25 bp, Mus musculus
ctatatggtcaggacgcgttgcctc

SEQ ID NO: 230853 - DNA, 25 bp, Mus musculus
ctagggctcctgaacttggcgcctc

SEQ ID NO: 230854 - DNA, 25 bp, Mus musculus
agtccgaaggactcggcaggacagc

SEQ ID NO: 230855 - DNA, 25 bp, Mus musculus
ctgctagcggtgagtttgcgtgacc

SEQ ID NO: 230856 - DNA, 25 bp, Mus musculus
acccttgcagcgtggggctttccta

SEQ ID NO: 230857 - DNA, 25 bp, Mus musculus
ggtggcgtctcagtcctatcccaca

SEQ ID NO: 230858 - DNA, 25 bp, Mus musculus
tcttgtggggtgtggctaaatgttt

SEQ ID NO: 230859 - DNA, 25 bp, Mus musculus
cggacggctcgttccacctgagcaa

SEQ ID NO: 230860 - DNA, 25 bp, Mus musculus
ggaacagccctctcagttcagcctg

SEQ ID NO: 230861 - DNA, 25 bp, Mus musculus
attctccatctccaggtgctcgggg

SEQ ID NO: 230862 - DNA, 25 bp, Mus musculus
tgcccgatctgaacattctccatct

SEQ ID NO: 230863 - DNA, 25 bp, Mus musculus
agccgcgcccaggtaccggcaagag

SEQ ID NO: 230864 - DNA, 25 bp, Mus musculus
ttagtcgccagtgcagcagctcctc

SEQ ID NO: 230865 - DNA, 25 bp, Mus musculus
gcttctgcatgggagttagtcgcca

SEQ ID NO: 230866 - DNA, 25 bp, Mus musculus
ctgcctcaagtgcttctgcatggga

SEQ ID NO: 230867 - DNA, 25 bp, Mus musculus
cgcttgtgcaacgagtgctcggacg

SEQ ID NO: 230868 - DNA, 25 bp, Mus musculus
ttccacctgagcaagcaaaacccgg

SEQ ID NO: 230869 - DNA, 25 bp, Mus musculus
acaccaccagcgagggggtctcgtc

SEQ ID NO: 230870 - DNA, 25 bp, Mus musculus
agttcagcctgagcaacgccgccgg

SEQ ID NO: 230871 - DNA, 25 bp, Mus musculus
agcaaaacccggacggctgcctcaa

SEQ ID NO: 230872 - DNA, 25 bp, Mus musculus
gggcctcggaacagccctctcagtt

SEQ ID NO: 230873 - DNA, 25 bp, Mus musculus
agcgcagctgcagcgcgtcttcctg

SEQ ID NO: 230874 - DNA, 25 bp, Mus musculus
tcgtagaattgcaggtaggagcccg

SEQ ID NO: 230875 - DNA, 25 bp, Mus musculus
gatggccgaggacaggctgtaaacc

SEQ ID NO: 230876 - DNA, 25 bp, Mus musculus
ggacaggctgtaaaccagaaagaag

SEQ ID NO: 230877 - DNA, 25 bp, Mus musculus
agcggaactggaagcgcatcctgtc

SEQ ID NO: 230878 - DNA, 25 bp, Mus musculus
catcctgtcttcaggggctgcagca

SEQ ID NO: 230879 - DNA, 25 bp, Mus musculus
ggctgcagcacgcaaccacagaatg

SEQ ID NO: 230880 - DNA, 25 bp, Mus musculus
gcaaccacagaatgcagtcagtgtc

SEQ ID NO: 230881 - DNA, 25 bp, Mus musculus
agtcagtgtccggagtcacgaagta

SEQ ID NO: 230882 - DNA, 25 bp, Mus musculus
tccggagtcacgaagtagaacttgc

SEQ ID NO: 230883 - DNA, 25 bp, Mus musculus
tagaacttgcgtgaagccgagtgcg

SEQ ID NO: 230884 - DNA, 25 bp, Mus musculus
caggtctgtccgcacaggtccgtca

SEQ ID NO: 230885 - DNA, 25 bp, Mus musculus
ctcttgcgggccgtcgtagaattgc

SEQ ID NO: 230886 - DNA, 25 bp, Mus musculus
cacaggtccgtcaggtccgctgcgg

SEQ ID NO: 230887 - DNA, 25 bp, Mus musculus
actcgcccaggctcaagtgaaatcc

SEQ ID NO: 230888 - DNA, 25 bp, Mus musculus
gcacggtgttactgcatctcctttc

SEQ ID NO: 230889 - DNA, 25 bp, Mus musculus
taccgcatctggctggagccttgta

SEQ ID NO: 230890 - DNA, 25 bp, Mus musculus
tgtcgcaggagcacatcgagaccgc

SEQ ID NO: 230891 - DNA, 25 bp, Mus musculus
ctacctcggtcaaggctatggctcc

SEQ ID NO: 230892 - DNA, 25 bp, Mus musculus
ggtgattgactgctctcctgtctga

SEQ ID NO: 230893 - DNA, 25 bp, Mus musculus
cgccagtcggattacatgggctttc

SEQ ID NO: 230894 - DNA, 25 bp, Mus musculus
gctgccttcaccatggcggaaaaaa

SEQ ID NO: 230895 - DNA, 25 bp, Mus musculus
ggctgaagcgtagctagctgccttc

SEQ ID NO: 230896 - DNA, 25 bp, Mus musculus
gcaagctctcgctcgtcggagtaga

SEQ ID NO: 230897 - DNA, 25 bp, Mus musculus
cctatggtgtgcgttgagtactcta

SEQ ID NO: 230898 - DNA, 25 bp, Mus musculus
ccggctgcctcggtttctgctatta

SEQ ID NO: 230899 - DNA, 25 bp, Mus musculus
ctttcagtttgcacgacccgggagc

SEQ ID NO: 230900 - DNA, 25 bp, Mus musculus
atcctcgatccgactgtggcgttcc

SEQ ID NO: 230901 - DNA, 25 bp, Mus musculus
ctgtgcatgggatcccggcagggag

SEQ ID NO: 230902 - DNA, 25 bp, Mus musculus
tgagtgccagctctgtgcatgggat

SEQ ID NO: 230903 - DNA, 25 bp, Mus musculus
tgcggtgagtgccagctctgtgcat

SEQ ID NO: 230904 - DNA, 25 bp, Mus musculus
cccaggcctgcggtgagtgccagct

SEQ ID NO: 230905 - DNA, 25 bp, Mus musculus
caagcccaggacaacccggcccagg

SEQ ID NO: 230906 - DNA, 25 bp, Mus musculus
gagtgccaagcccaggacaacccgg

SEQ ID NO: 230907 - DNA, 25 bp, Mus musculus
accggagtgccaagcccaggacaac

SEQ ID NO: 230908 - DNA, 25 bp, Mus musculus
gcaccggagtgccaagcccaggaca

SEQ ID NO: 230909 - DNA, 25 bp, Mus musculus
gcagagagcgagtcccggcagagct

SEQ ID NO: 230910 - DNA, 25 bp, Mus musculus
agcgctcggcggtcacgtgacgttc

SEQ ID NO: 230911 - DNA, 25 bp, Mus musculus
gagcggcgccgagaaggagcgctcg

SEQ ID NO: 230912 - DNA, 25 bp, Mus musculus
cgctcccgcgcctggggctcaggct

SEQ ID NO: 230913 - DNA, 25 bp, Mus musculus
gcaggggttgcctccctgccgctcc

SEQ ID NO: 230914 - DNA, 25 bp, Mus musculus
cccggcgggcaccagccatgccgcg

SEQ ID NO: 230915 - DNA, 25 bp, Mus musculus
gaggctgcgaggcaagctaacatcc

SEQ ID NO: 230916 - DNA, 25 bp, Mus musculus
ggccttgctcgggtgccatggcctc

SEQ ID NO: 230917 - DNA, 25 bp, Mus musculus
tgcatgtgctcagccggggccttgc

SEQ ID NO: 230918 - DNA, 25 bp, Mus musculus
gaggcaagctaacatccgagtcgtg

SEQ ID NO: 230919 - DNA, 25 bp, Mus musculus
cccgtgtgcgagtgcatgtgctcag

SEQ ID NO: 230920 - DNA, 25 bp, Mus musculus
caccttcggtgcctatggagggtag

SEQ ID NO: 230921 - DNA, 25 bp, Mus musculus
ggaagcgcagcttcaccttcggtgc

SEQ ID NO: 230922 - DNA, 25 bp, Mus musculus
cgacgataccatgagcggccggaag

SEQ ID NO: 230923 - DNA, 25 bp, Mus musculus
acgggcagcggcgacgataccatga

SEQ ID NO: 230924 - DNA, 25 bp, Mus musculus
cggcgttgccaaggtgacccgcgct

SEQ ID NO: 230925 - DNA, 25 bp, Mus musculus
ttctgtgccgggacctcagctggcg

SEQ ID NO: 230926 - DNA, 25 bp, Mus musculus
acaagcggccctttctgtgccggga

SEQ ID NO: 230927 - DNA, 25 bp, Mus musculus
ccggagcgaacaagcggccctttct

SEQ ID NO: 230928 - DNA, 25 bp, Mus musculus
tccgagtcgtgctcggagctcgtga

SEQ ID NO: 230929 - DNA, 25 bp, Mus musculus
aaccctcaggctcgagtgacactca

SEQ ID NO: 230930 - DNA, 25 bp, Mus musculus
agcaggcgactcgtcttaaagacta

SEQ ID NO: 230931 - DNA, 25 bp, Mus musculus
tcatgaccctcagcgctccggttaa

SEQ ID NO: 230932 - DNA, 25 bp, Mus musculus
ctggagcccgaaagcaattcccggt

SEQ ID NO: 230933 - DNA, 25 bp, Mus musculus
aggcccgggtgactctcagttcacg

SEQ ID NO: 230934 - DNA, 25 bp, Mus musculus
tcagttcacggcgacccaaaggtcc

SEQ ID NO: 230935 - DNA, 25 bp, Mus musculus
aggccctcgagcgtctgggcagtca

SEQ ID NO: 230936 - DNA, 25 bp, Mus musculus
tagctgtcatcgtcctccatggtgc

SEQ ID NO: 230937 - DNA, 25 bp, Mus musculus
ccacagccaaaacgcgcgtgcgtga

SEQ ID NO: 230938 - DNA, 25 bp, Mus musculus
gacctctttagtttgcgtttacgca

SEQ ID NO: 230939 - DNA, 25 bp, Mus musculus
tgcgtttacgcaagcgcggcaccta

SEQ ID NO: 230940 - DNA, 25 bp, Mus musculus
aggctctgcctatctatgactccgc

SEQ ID NO: 230941 - DNA, 25 bp, Mus musculus
aagtcacgccctctctccttaggta

SEQ ID NO: 230942 - DNA, 25 bp, Mus musculus
gagtaacctcggtcctggagcccga

SEQ ID NO: 230943 - DNA, 25 bp, Mus musculus
tgccttaggaagtgtgtaaaacgcc

SEQ ID NO: 230944 - DNA, 25 bp, Mus musculus
cgccagttccgatcgcgcacattta

SEQ ID NO: 230945 - DNA, 25 bp, Mus musculus
tcgcaggtcctgaacttcgaagaga

SEQ ID NO: 230946 - DNA, 25 bp, Mus musculus
ctcgtcttctgccagtgagatgatc

SEQ ID NO: 230947 - DNA, 25 bp, Mus musculus
aagtctcgcgaaacctgttcctcgg

SEQ ID NO: 230948 - DNA, 25 bp, Mus musculus
gccgaggccctttcgcaaaagtctc

SEQ ID NO: 230949 - DNA, 25 bp, Mus musculus
atttactacgtcacggcgtccagtc

SEQ ID NO: 230950 - DNA, 25 bp, Mus musculus
cggagttcatctttcccgctggatc

SEQ ID NO: 230951 - DNA, 25 bp, Mus musculus
caggcagaaagcgacggagttcatc

SEQ ID NO: 230952 - DNA, 25 bp, Mus musculus
ggcacgacgcggctcaaaagaaaca

SEQ ID NO: 230953 - DNA, 25 bp, Mus musculus
cccgacatgaagaggtgcccaatga

SEQ ID NO: 230954 - DNA, 25 bp, Mus musculus
ggctcacggctgaaaacccgacatg

SEQ ID NO: 230955 - DNA, 25 bp, Mus musculus
gctaacttccattagtgagcgctca

SEQ ID NO: 230956 - DNA, 25 bp, Mus musculus
acgccactggtgtctctctacgatg

SEQ ID NO: 230957 - DNA, 25 bp, Mus musculus
gcaaagaaagtgcttaagcaccatc

SEQ ID NO: 230958 - DNA, 25 bp, Mus musculus
tgtatgtttttggactgacacccga

SEQ ID NO: 230959 - DNA, 25 bp, Mus musculus
tgggtgtgtatgtttttggactgac

SEQ ID NO: 230960 - DNA, 25 bp, Mus musculus
agtctggcagtctgtgcctgaaccc

SEQ ID NO: 230961 - DNA, 25 bp, Mus musculus
tacccagagtctggcagtctgtgcc

SEQ ID NO: 230962 - DNA, 25 bp, Mus musculus
gtcagccttactacccagagtctgg

SEQ ID NO: 230963 - DNA, 25 bp, Mus musculus
ccagggccatcagtcagccttacta

SEQ ID NO: 230964 - DNA, 25 bp, Mus musculus
cacagaagtgcctgaggcttcccgc

SEQ ID NO: 230965 - DNA, 25 bp, Mus musculus
agctgtcccaagaaccttgtccttg

SEQ ID NO: 230966 - DNA, 25 bp, Mus musculus
ttaagcaccatctccagtactcctg

SEQ ID NO: 230967 - DNA, 25 bp, Mus musculus
tttggactgacacccgaactacacg

SEQ ID NO: 230968 - DNA, 25 bp, Mus musculus
gacccagggccatcagtcagcctta

SEQ ID NO: 230969 - DNA, 25 bp, Mus musculus
gggcacagctgtcccaagaaccttg

SEQ ID NO: 230970 - DNA, 25 bp, Mus musculus
tgctcacagaagtgcctgaggcttc

SEQ ID NO: 230971 - DNA, 25 bp, Mus musculus
ctcgcgagcggcagccctaaggagc

SEQ ID NO: 230972 - DNA, 25 bp, Mus musculus
tccttacctgcaggcactcgtgggg

SEQ ID NO: 230973 - DNA, 25 bp, Mus musculus
gcagcatgctttccttacctgcagg

SEQ ID NO: 230974 - DNA, 25 bp, Mus musculus
agtcgcgcaagccacgggcgcagca

SEQ ID NO: 230975 - DNA, 25 bp, Mus musculus
caccgtggctgggacagtcactgcg

SEQ ID NO: 230976 - DNA, 25 bp, Mus musculus
gccacaagagatgcgcgcggagtcc

SEQ ID NO: 230977 - DNA, 25 bp, Mus musculus
tcctgccaggccacaagagatgcgc

SEQ ID NO: 230978 - DNA, 25 bp, Mus musculus
ccacgaagggcgcagctgtggacta

SEQ ID NO: 230979 - DNA, 25 bp, Mus musculus
acagagtgccaagggaccacgaagg

SEQ ID NO: 230980 - DNA, 25 bp, Mus musculus
tttagacaccaacgggacagagtgc

SEQ ID NO: 230981 - DNA, 25 bp, Mus musculus
gatcgcagcacgtgccttcttcctg

SEQ ID NO: 230982 - DNA, 25 bp, Mus musculus
gcctgcttatgaaggcggcctggcc

SEQ ID NO: 230983 - DNA, 25 bp, Mus musculus
ggtctccgatctctcccgccaaaga

SEQ ID NO: 230984 - DNA, 25 bp, Mus musculus
cgccaaagatcgcagcacgtgcctt

SEQ ID NO: 230985 - DNA, 25 bp, Mus musculus
aggtgcatcctaagcccggccgttc

SEQ ID NO: 230986 - DNA, 25 bp, Mus musculus
tcccggcgaggtgtagattaggcac

SEQ ID NO: 230987 - DNA, 25 bp, Mus musculus
attaggcacgccaagctggaggttc

SEQ ID NO: 230988 - DNA, 25 bp, Mus musculus
gacccaccggtatccggggcagcta

SEQ ID NO: 230989 - DNA, 25 bp, Mus musculus
ggcagctagagtatccagcgctcca

SEQ ID NO: 230990 - DNA, 25 bp, Mus musculus
agcgctccagcatgccaagggttaa

SEQ ID NO: 230991 - DNA, 25 bp, Mus musculus
ggagtctaaccgacgcttctgattg

SEQ ID NO: 230992 - DNA, 25 bp, Mus musculus
attggctgtttcttcggggcccgca

SEQ ID NO: 230993 - DNA, 25 bp, Mus musculus
gcacttctgtattggttcgcggcgg

SEQ ID NO: 230994 - DNA, 25 bp, Mus musculus
cagctagccctgaggttcgagcgta

SEQ ID NO: 230995 - DNA, 25 bp, Mus musculus
gcgtagagctcagcccagcgcactt

SEQ ID NO: 230996 - DNA, 25 bp, Mus musculus
cagcgcacttggagctggagcctta

SEQ ID NO: 230997 - DNA, 25 bp, Mus musculus
agcgacggtgagtactcccgcagcc

SEQ ID NO: 230998 - DNA, 25 bp, Mus musculus
gtcccgctgttcactggcttggacc

SEQ ID NO: 230999 - DNA, 25 bp, Mus musculus
ctacaagcgggccacgctggacgaa

SEQ ID NO: 231000 - DNA, 25 bp, Mus musculus
ggcatgcgcagtcttgcgtctcctc

SEQ ID NO: 231001 - DNA, 25 bp, Mus musculus
tacaggtaggaactctgatccttgc

SEQ ID NO: 231002 - DNA, 25 bp, Mus musculus
cccaatggcctacaggtaggaactc

SEQ ID NO: 231003 - DNA, 25 bp, Mus musculus
actcactctccgagggcgatgtgta

SEQ ID NO: 231004 - DNA, 25 bp, Mus musculus
ccacgctggacgaagaggatctggt

SEQ ID NO: 231005 - DNA, 25 bp, Mus musculus
tgtcaacctacaagcgggccacgct

SEQ ID NO: 231006 - DNA, 25 bp, Mus musculus
ttggcattgcagatgtcaacctaca

SEQ ID NO: 231007 - DNA, 25 bp, Mus musculus
gtccgtactacatttggcattgcag

SEQ ID NO: 231008 - DNA, 25 bp, Mus musculus
cgctgagggagtccgtactacattt

SEQ ID NO: 231009 - DNA, 25 bp, Mus musculus
cccatttgggcaatggagacgctga

SEQ ID NO: 231010 - DNA, 25 bp, Mus musculus
gccatccatccgtgggctgatctcg

SEQ ID NO: 231011 - DNA, 25 bp, Mus musculus
gagctcgaggggacccaacccagac

SEQ ID NO: 231012 - DNA, 25 bp, Mus musculus
aggatctggtggactcactctccga

SEQ ID NO: 231013 - DNA, 25 bp, Mus musculus
aacattgccgacaacgggggactca

SEQ ID NO: 231014 - DNA, 25 bp, Mus musculus
tccacaggtcgggagtacgacaagg

SEQ ID NO: 231015 - DNA, 25 bp, Mus musculus
aggatgggaaccttcgaccctggtg

SEQ ID NO: 231016 - DNA, 25 bp, Mus musculus
agaactcgtccgtggaggcgttcaa

SEQ ID NO: 231017 - DNA, 25 bp, Mus musculus
ccgtggaggcgttcaagcagcagac

SEQ ID NO: 231018 - DNA, 25 bp, Mus musculus
cgtcatccacaggtcgggagtacga

SEQ ID NO: 231019 - DNA, 25 bp, Mus musculus
tcaagcagcagacggagtgcatggt

SEQ ID NO: 231020 - DNA, 25 bp, Mus musculus
acggagtgcatggtgcagcaataca

SEQ ID NO: 231021 - DNA, 25 bp, Mus musculus
gcatggtgcagcaatacagcaacta

SEQ ID NO: 231022 - DNA, 25 bp, Mus musculus
tacagcaactacagcgtgaacgggg

SEQ ID NO: 231023 - DNA, 25 bp, Mus musculus
aactacagcgtgaacggggagcccg

SEQ ID NO: 231024 - DNA, 25 bp, Mus musculus
ggagcccgtgaacggtcgacacacc

SEQ ID NO: 231025 - DNA, 25 bp, Mus musculus
tcgacacaccctcggggagaacatt

SEQ ID NO: 231026 - DNA, 25 bp, Mus musculus
cctcggggagaacattgccgacaac

SEQ ID NO: 231027 - DNA, 25 bp, Mus musculus
cggcgagtggcatctgttatgttaa

SEQ ID NO: 231028 - DNA, 25 bp, Mus musculus
atagccgagagagcttgccaccctc

SEQ ID NO: 231029 - DNA, 25 bp, Mus musculus
tcgcggtctccggaaatagccgaga

SEQ ID NO: 231030 - DNA, 25 bp, Mus musculus
tttcccgagaaagagtgtcagctcc

SEQ ID NO: 231031 - DNA, 25 bp, Mus musculus
cggatcaccgatctttcccgagaaa

SEQ ID NO: 231032 - DNA, 25 bp, Mus musculus
gctgagctctctccctacagacgtg

SEQ ID NO: 231033 - DNA, 25 bp, Mus musculus
actattgttcttcgaggctgagctc

SEQ ID NO: 231034 - DNA, 25 bp, Mus musculus
cctcgggtgccgttactattgttct

SEQ ID NO: 231035 - DNA, 25 bp, Mus musculus
ggacgacgtgtcgacataatgccca

SEQ ID NO: 231036 - DNA, 25 bp, Mus musculus
aactgtcggtttgtgctctggctta

SEQ ID NO: 231037 - DNA, 25 bp, Mus musculus
tcggtctgccgagtccttccgaaaa

SEQ ID NO: 231038 - DNA, 25 bp, Mus musculus
taatgcccatggctggcgacgtcaa

SEQ ID NO: 231039 - DNA, 25 bp, Mus musculus
ctctcgacgcttgcttggcaggtct

SEQ ID NO: 231040 - DNA, 25 bp, Mus musculus
cgttccatttcgcactttgggcatc

SEQ ID NO: 231041 - DNA, 25 bp, Mus musculus
ctcccggcttgacccgagcttttgg

SEQ ID NO: 231042 - DNA, 25 bp, Mus musculus
gtgaacactactagctccaccgggc

SEQ ID NO: 231043 - DNA, 25 bp, Mus musculus
tgctcccggcttgacccgagctttt

SEQ ID NO: 231044 - DNA, 25 bp, Mus musculus
gcttgacccgagcttttggggtgca

SEQ ID NO: 231045 - DNA, 25 bp, Mus musculus
ttgacccgagcttttggggtgcacc

SEQ ID NO: 231046 - DNA, 25 bp, Mus musculus
tgacccgagcttttggggtgcaccg

SEQ ID NO: 231047 - DNA, 25 bp, Mus musculus
agcttttggggtgcaccggtgacag

SEQ ID NO: 231048 - DNA, 25 bp, Mus musculus
ggaccctctgcggtaccgtgaacac

SEQ ID NO: 231049 - DNA, 25 bp, Mus musculus
accctctgcggtaccgtgaacacta

SEQ ID NO: 231050 - DNA, 25 bp, Mus musculus
ctctgcggtaccgtgaacactacta

SEQ ID NO: 231051 - DNA, 25 bp, Mus musculus
ctgcggtaccgtgaacactactagc

SEQ ID NO: 231052 - DNA, 25 bp, Mus musculus
gcggtaccgtgaacactactagctc

SEQ ID NO: 231053 - DNA, 25 bp, Mus musculus
tgacagcattgctggggaccccggg

SEQ ID NO: 231054 - DNA, 25 bp, Mus musculus
ggtaccgtgaacactactagctcca

SEQ ID NO: 231055 - DNA, 25 bp, Mus musculus
agccctattggctgcgggcttgcgc

SEQ ID NO: 231056 - DNA, 25 bp, Mus musculus
cctccgtgcttgtctcagtgcgcat

SEQ ID NO: 231057 - DNA, 25 bp, Mus musculus
cgctcccgcctttgtcttcgctgct

SEQ ID NO: 231058 - DNA, 25 bp, Mus musculus
ggcttgcgcatgctccgaggcctgt

SEQ ID NO: 231059 - DNA, 25 bp, Mus musculus
cctcggcctactgtcaacttgtctt

SEQ ID NO: 231060 - DNA, 25 bp, Mus musculus
actgtcaacttgtcttcaagcccgg

SEQ ID NO: 231061 - DNA, 25 bp, Mus musculus
ttcaagcccggttcgaaagatgccg

SEQ ID NO: 231062 - DNA, 25 bp, Mus musculus
aaagatgccggcactagtgagtggc

SEQ ID NO: 231063 - DNA, 25 bp, Mus musculus
ctcagaggtaacgcgggatggaccc

SEQ ID NO: 231064 - DNA, 25 bp, Mus musculus
tggccgccattacggagtccccagt

SEQ ID NO: 231065 - DNA, 25 bp, Mus musculus
ggcgtggtctctgcgcggtacctcc

SEQ ID NO: 231066 - DNA, 25 bp, Mus musculus
cgctgtcaccgccacggctctctgt

SEQ ID NO: 231067 - DNA, 25 bp, Mus musculus
cccggttcgaaagatgccggcacta

SEQ ID NO: 231068 - DNA, 25 bp, Mus musculus
ggcagctcttctcgggtcgggccca

SEQ ID NO: 231069 - DNA, 25 bp, Mus musculus
agagcgacaaggaggagccaaccca

SEQ ID NO: 231070 - DNA, 25 bp, Mus musculus
agatcgctgtctgcgctcgcacgcg

SEQ ID NO: 231071 - DNA, 25 bp, Mus musculus
atggtgacgcttgcgagatcgctgt

SEQ ID NO: 231072 - DNA, 25 bp, Mus musculus
cctccgagaacctagcgctgcgtgg

SEQ ID NO: 231073 - DNA, 25 bp, Mus musculus
accatacctccctttctggcgccgg

SEQ ID NO: 231074 - DNA, 25 bp, Mus musculus
gccggcagttgccatcacctcagtc

SEQ ID NO: 231075 - DNA, 25 bp, Mus musculus
agggtcttcccagagcgagccgcac

SEQ ID NO: 231076 - DNA, 25 bp, Mus musculus
aaacggagctgtgagacctgccagg

SEQ ID NO: 231077 - DNA, 25 bp, Mus musculus
agccaacccaggtcgcagcgtgggc

SEQ ID NO: 231078 - DNA, 25 bp, Mus musculus
ctcaccgagtctggacagcttcgtg

SEQ ID NO: 231079 - DNA, 25 bp, Mus musculus
cgtcttccctatccagccttgtgta

SEQ ID NO: 231080 - DNA, 25 bp, Mus musculus
cagcttcgtggaggaagagcgacaa

SEQ ID NO: 231081 - DNA, 25 bp, Mus musculus
caggtaccctcgcagcctctgattg

SEQ ID NO: 231082 - DNA, 25 bp, Mus musculus
gccctgagctcaccgagtctggaca

SEQ ID NO: 231083 - DNA, 25 bp, Mus musculus
gctaacggcgacttgtctccctgga

SEQ ID NO: 231084 - DNA, 25 bp, Mus musculus
gatccctgtcccttgcgtccgatgt

SEQ ID NO: 231085 - DNA, 25 bp, Mus musculus
cgtccgatgttctttctgcgttccc

SEQ ID NO: 231086 - DNA, 25 bp, Mus musculus
gcacctgtcagccttcgctggagtc

SEQ ID NO: 231087 - DNA, 25 bp, Mus musculus
cgacgtttaaaggagccgcactgca

SEQ ID NO: 231088 - DNA, 25 bp, Mus musculus
cgcgtgaagggcacgttcgccttaa

SEQ ID NO: 231089 - DNA, 25 bp, Mus musculus
tctgctattcgcgacgcacacgtca

SEQ ID NO: 231090 - DNA, 25 bp, Mus musculus
aggcctgccagtctacgcgatgacg

SEQ ID NO: 231091 - DNA, 25 bp, Mus musculus
cgcaagcgcgtagagctaaaagctc

SEQ ID NO: 231092 - DNA, 25 bp, Mus musculus
acttccgcttgcgtgcctgacattg

SEQ ID NO: 231093 - DNA, 25 bp, Mus musculus
ctgacattgccagtgcgcaggccca

SEQ ID NO: 231094 - DNA, 25 bp, Mus musculus
agctcagggctcacgttcagtgcaa

SEQ ID NO: 231095 - DNA, 25 bp, Mus musculus
ttcagtgcaagccaccgaggctttg

SEQ ID NO: 231096 - DNA, 25 bp, Mus musculus
aatgtgctccctgagtccgcgtgaa

SEQ ID NO: 231097 - DNA, 25 bp, Mus musculus
agcagttcaccttcgatggcgccta

SEQ ID NO: 231098 - DNA, 25 bp, Mus musculus
acgtcacggaggttgcccagcaacg

SEQ ID NO: 231099 - DNA, 25 bp, Mus musculus
gttgcccagcaacggcgaacgccga

SEQ ID NO: 231100 - DNA, 25 bp, Mus musculus
cagccatggcctcggagtcagtgaa

SEQ ID NO: 231101 - DNA, 25 bp, Mus musculus
tcagtgaaagtggtcgtgcgctgcc

SEQ ID NO: 231102 - DNA, 25 bp, Mus musculus
gtgcgctgccgacccatgaacaagc

SEQ ID NO: 231103 - DNA, 25 bp, Mus musculus
gacccatgaacaagcgcgagcgcga

SEQ ID NO: 231104 - DNA, 25 bp, Mus musculus
cttcattcagaacccgggagcggcg

SEQ ID NO: 231105 - DNA, 25 bp, Mus musculus
cgtcccgagactgaagggccaggct

SEQ ID NO: 231106 - DNA, 25 bp, Mus musculus
tggcgcctactacatagaacacttc

SEQ ID NO: 231107 - DNA, 25 bp, Mus musculus
catagaacacttcaccgagcagatc

SEQ ID NO: 231108 - DNA, 25 bp, Mus musculus
ttcaccgagcagatctacaacgaga

SEQ ID NO: 231109 - DNA, 25 bp, Mus musculus
caacgagatcgcctacccgctggtg

SEQ ID NO: 231110 - DNA, 25 bp, Mus musculus
gcgcgcggccaatgcttcattcaga

SEQ ID NO: 231111 - DNA, 25 bp, Mus musculus
acacctgtgtgcaagtctctcaatc

SEQ ID NO: 231112 - DNA, 25 bp, Mus musculus
gggctccacccaagagtcgagttta

SEQ ID NO: 231113 - DNA, 25 bp, Mus musculus
agcgagctgccatgtgatgcgcatc

SEQ ID NO: 231114 - DNA, 25 bp, Mus musculus
cagggcttccaagaggggacacctt

SEQ ID NO: 231115 - DNA, 25 bp, Mus musculus
gtggctgtgcgctcagctgtcagcc

SEQ ID NO: 231116 - DNA, 25 bp, Mus musculus
agcagctgtcagacccatggccctg

SEQ ID NO: 231117 - DNA, 25 bp, Mus musculus
aggagccgagggtaataagtcagtc

SEQ ID NO: 231118 - DNA, 25 bp, Mus musculus
cgtcgccgggtgttttggaacagca

SEQ ID NO: 231119 - DNA, 25 bp, Mus musculus
cattgtattttgctcgcgtcgccgg

SEQ ID NO: 231120 - DNA, 25 bp, Mus musculus
ggcgaggcggcattgtattttgctc

SEQ ID NO: 231121 - DNA, 25 bp, Mus musculus
ccgcctgcctgtttacggcgggcga

SEQ ID NO: 231122 - DNA, 25 bp, Mus musculus
cttatggcattttctaggaacggga

SEQ ID NO: 231123 - DNA, 25 bp, Mus musculus
gcccacggccgccttatggcatttt

SEQ ID NO: 231124 - DNA, 25 bp, Mus musculus
tttaaggaagggacaactcgctgca

SEQ ID NO: 231125 - DNA, 25 bp, Mus musculus
cagggattcctctcctgaccgggtt

SEQ ID NO: 231126 - DNA, 25 bp, Mus musculus
cggagcctcaagtgcgtttcgccaa

SEQ ID NO: 231127 - DNA, 25 bp, Mus musculus
ggggagttcctctatgacaacctta

SEQ ID NO: 231128 - DNA, 25 bp, Mus musculus
cccagcttgtccctcattaagtacg

SEQ ID NO: 231129 - DNA, 25 bp, Mus musculus
agctcaccttcaagaccgcagatga

SEQ ID NO: 231130 - DNA, 25 bp, Mus musculus
tctttcctccagaccggggctttga

SEQ ID NO: 231131 - DNA, 25 bp, Mus musculus
tgttcttccgcagcctgaagggtga

SEQ ID NO: 231132 - DNA, 25 bp, Mus musculus
gtgctgctggacaacctgaacgtgc

SEQ ID NO: 231133 - DNA, 25 bp, Mus musculus
ctgctgggagatgaagatggatccc

SEQ ID NO: 231134 - DNA, 25 bp, Mus musculus
ggaccgcttccaagtggtactccgc

SEQ ID NO: 231135 - DNA, 25 bp, Mus musculus
tggcgttccctgcttcttggtccgt

SEQ ID NO: 231136 - DNA, 25 bp, Mus musculus
aaggtacagagactcggcctccgga

SEQ ID NO: 231137 - DNA, 25 bp, Mus musculus
cggggctttgagctcaccttcaaga

SEQ ID NO: 231138 - DNA, 25 bp, Mus musculus
gtgcgtttcgccaataaggtacaga

SEQ ID NO: 231139 - DNA, 25 bp, Mus musculus
gctctcacctggatctcctgacagg

SEQ ID NO: 231140 - DNA, 25 bp, Mus musculus
ggcagttctcctgcgcagcacgcgg

SEQ ID NO: 231141 - DNA, 25 bp, Mus musculus
cggctggcctcagggctacactctg

SEQ ID NO: 231142 - DNA, 25 bp, Mus musculus
cgtctgggacaacaacaaacttcgg

SEQ ID NO: 231143 - DNA, 25 bp, Mus musculus
cagtgcctgtcgcaccgccatggtg

SEQ ID NO: 231144 - DNA, 25 bp, Mus musculus
cagcgcccgacccagctgcaggcct

SEQ ID NO: 231145 - DNA, 25 bp, Mus musculus
tcagggctacactctggcccggttc

SEQ ID NO: 231146 - DNA, 25 bp, Mus musculus
tgctccggggcttacgacctggcct

SEQ ID NO: 231147 - DNA, 25 bp, Mus musculus
ctgcctctggatccgcgccgccagc

SEQ ID NO: 231148 - DNA, 25 bp, Mus musculus
gggcccgcaccatgaactgcctctg

SEQ ID NO: 231149 - DNA, 25 bp, Mus musculus
ccaggaagaccgctcggccgcaagg

SEQ ID NO: 231150 - DNA, 25 bp, Mus musculus
cagcccgaaggccaggaagaccgct

SEQ ID NO: 231151 - DNA, 25 bp, Mus musculus
gatctcctgacaggccgaggcggcc

SEQ ID NO: 231152 - DNA, 25 bp, Mus musculus
accgccacaaacgtctgggacaaca

SEQ ID NO: 231153 - DNA, 25 bp, Mus musculus
cggacccagggtcagtttcatcttc

SEQ ID NO: 231154 - DNA, 25 bp, Mus musculus
cggtaagcgcacttggcgttgagca

SEQ ID NO: 231155 - DNA, 25 bp, Mus musculus
gcggccgaagacagtccttgtgaga

SEQ ID NO: 231156 - DNA, 25 bp, Mus musculus
aacacagcgtggcagcgcagcacca

SEQ ID NO: 231157 - DNA, 25 bp, Mus musculus
tccttgtgagagatgcccagtatcc

SEQ ID NO: 231158 - DNA, 25 bp, Mus musculus
aatcctgcccacagcgtcgtcggtg

SEQ ID NO: 231159 - DNA, 25 bp, Mus musculus
ttgcccaggtaccacacggtgtagg

SEQ ID NO: 231160 - DNA, 25 bp, Mus musculus
gtggggtcctccttgttaagctcca

SEQ ID NO: 231161 - DNA, 25 bp, Mus musculus
tgttaagctccactttctggcgccg

SEQ ID NO: 231162 - DNA, 25 bp, Mus musculus
gctcaggctcttcgccttgcgcttg

SEQ ID NO: 231163 - DNA, 25 bp, Mus musculus
gtcctccactagcacgaatttgttc

SEQ ID NO: 231164 - DNA, 25 bp, Mus musculus
gcacgaatttgttccgtctccaggg

SEQ ID NO: 231165 - DNA, 25 bp, Mus musculus
accgcccaggacttgcgacaagctg

SEQ ID NO: 231166 - DNA, 25 bp, Mus musculus
cagccgcttgaagtcgctgaaggcc

SEQ ID NO: 231167 - DNA, 25 bp, Mus musculus
gagcaagaacgtctagaaacccgga

SEQ ID NO: 231168 - DNA, 25 bp, Mus musculus
cggagggagagctcccacgtgacca

SEQ ID NO: 231169 - DNA, 25 bp, Mus musculus
caccggtttcccaggaggccgcagt

SEQ ID NO: 231170 - DNA, 25 bp, Mus musculus
gaggccgcagtaacgtcgcaaccac

SEQ ID NO: 231171 - DNA, 25 bp, Mus musculus
cgcaaccacctaggcaacgtctttg

SEQ ID NO: 231172 - DNA, 25 bp, Mus musculus
tcgccatggagagcggttcgcgacc

SEQ ID NO: 231173 - DNA, 25 bp, Mus musculus
gttcgcgaccgtcgctcggccaggt

SEQ ID NO: 231174 - DNA, 25 bp, Mus musculus
ggccaggtcatcctgctgggcacca

SEQ ID NO: 231175 - DNA, 25 bp, Mus musculus
tgggcaccagttcgatggtcaccgc

SEQ ID NO: 231176 - DNA, 25 bp, Mus musculus
ggtcaccgccgtactgtactccata

SEQ ID NO: 231177 - DNA, 25 bp, Mus musculus
tctagaaacccggagggagagctcc

SEQ ID NO: 231178 - DNA, 25 bp, Mus musculus
gggcagcccggtctcactggcagct

SEQ ID NO: 231179 - DNA, 25 bp, Mus musculus
tcgcgcaggaactcaaggtcagtgc

SEQ ID NO: 231180 - DNA, 25 bp, Mus musculus
gtactccatataccggcagaaggcc

SEQ ID NO: 231181 - DNA, 25 bp, Mus musculus
gacgtgggccagatcttctcgtgcc

SEQ ID NO: 231182 - DNA, 25 bp, Mus musculus
cctacggcgacgagaagctgagccc

SEQ ID NO: 231183 - DNA, 25 bp, Mus musculus
aggtgctgccctacggcgacgagaa

SEQ ID NO: 231184 - DNA, 25 bp, Mus musculus
acgcgaccatgtcggaggtgctgcc

SEQ ID NO: 231185 - DNA, 25 bp, Mus musculus
cgaggatgtgagtcctgcccgccgc

SEQ ID NO: 231186 - DNA, 25 bp, Mus musculus
agcgccgaggatgtgagtcctgccc

SEQ ID NO: 231187 - DNA, 25 bp, Mus musculus
tccgggctcgcagggacaccctcct

SEQ ID NO: 231188 - DNA, 25 bp, Mus musculus
tctgcctctccgatccaaatctagt

SEQ ID NO: 231189 - DNA, 25 bp, Mus musculus
aggctgctccttcgtccctgcctcc

SEQ ID NO: 231190 - DNA, 25 bp, Mus musculus
tgggctggcattctccctagcagct

SEQ ID NO: 231191 - DNA, 25 bp, Mus musculus
gcctcgctttcagcctgggctggca

SEQ ID NO: 231192 - DNA, 25 bp, Mus musculus
gggccagatcttctcgtgccgcctg

SEQ ID NO: 231193 - DNA, 25 bp, Mus musculus
cccgtgacgtcgcttagcttccagg

SEQ ID NO: 231194 - DNA, 25 bp, Mus musculus
tcgcttagcttccagggatctctcc

SEQ ID NO: 231195 - DNA, 25 bp, Mus musculus
gcctgcagttggttggcgaagctca

SEQ ID NO: 231196 - DNA, 25 bp, Mus musculus
aggtcctttcccattcggcttcatg

SEQ ID NO: 231197 - DNA, 25 bp, Mus musculus
cccattcggcttcatgacagctgca

SEQ ID NO: 231198 - DNA, 25 bp, Mus musculus
tgacagctgcacctcgaggtcacct

SEQ ID NO: 231199 - DNA, 25 bp, Mus musculus
tcacctctcagacccgctcggaccc

SEQ ID NO: 231200 - DNA, 25 bp, Mus musculus
gaccctgccgcagcgttccaccaag

SEQ ID NO: 231201 - DNA, 25 bp, Mus musculus
gttccaccaagcctgacccttgctt

SEQ ID NO: 231202 - DNA, 25 bp, Mus musculus
ggttggcgaagctcacaaactcttc

SEQ ID NO: 231203 - DNA, 25 bp, Mus musculus
gttccgccgctccttggccagcgcc

SEQ ID NO: 231204 - DNA, 25 bp, Mus musculus
tcgtcccgcttacgctccgcctcgg

SEQ ID NO: 231205 - DNA, 25 bp, Mus musculus
ctcttcgccgcttgctttcgggaca

SEQ ID NO: 231206 - DNA, 25 bp, Mus musculus
cgccgcttgctttcgggacatggct

SEQ ID NO: 231207 - DNA, 25 bp, Mus musculus
cacacggcttcgccgcggaaggagc

SEQ ID NO: 231208 - DNA, 25 bp, Mus musculus
cacaaactcttcttcgcagccgctg

SEQ ID NO: 231209 - DNA, 25 bp, Mus musculus
cgctctcgcttcctggggagcggga

SEQ ID NO: 231210 - DNA, 25 bp, Mus musculus
ctctcgggactcctgagtagctgga

SEQ ID NO: 231211 - DNA, 25 bp, Mus musculus
agtgctctcgggactcctgagtagc

SEQ ID NO: 231212 - DNA, 25 bp, Mus musculus
acccggaagtgctctcgggactcct

SEQ ID NO: 231213 - DNA, 25 bp, Mus musculus
tgcgcttccgaacccggaagtgctc

SEQ ID NO: 231214 - DNA, 25 bp, Mus musculus
acgccgcctccactgcgcttccgaa

SEQ ID NO: 231215 - DNA, 25 bp, Mus musculus
gaagttctgccgtcgtcccatccgt

SEQ ID NO: 231216 - DNA, 25 bp, Mus musculus
ctgcggggctgccagaagttctgcc

SEQ ID NO: 231217 - DNA, 25 bp, Mus musculus
aggccagcacccgggcgatggcttt

SEQ ID NO: 231218 - DNA, 25 bp, Mus musculus
agacacagaagtgcgggtcccgtcc

SEQ ID NO: 231219 - DNA, 25 bp, Mus musculus
tgatgccaacgagcatgccagcggc

SEQ ID NO: 231220 - DNA, 25 bp, Mus musculus
gcctgccagcacagcccagggcacc

SEQ ID NO: 231221 - DNA, 25 bp, Mus musculus
acagaagtgcgggtcccgtcccaag

SEQ ID NO: 231222 - DNA, 25 bp, Mus musculus
ggggaaactgatgccaacgagcatg

SEQ ID NO: 231223 - DNA, 25 bp, Mus musculus
ccatacagcgcgttcagcatggctg

SEQ ID NO: 231224 - DNA, 25 bp, Mus musculus
catcacgtcgaaggcggtccaaagc

SEQ ID NO: 231225 - DNA, 25 bp, Mus musculus
tcccaccatcaggtccgacgtgaag

SEQ ID NO: 231226 - DNA, 25 bp, Mus musculus
cctcagaggagtaggtggcaaaaca

SEQ ID NO: 231227 - DNA, 25 bp, Mus musculus
aacagggttcttaggtcaccgagca

SEQ ID NO: 231228 - DNA, 25 bp, Mus musculus
gtcaccgagcaaccattacaagagg

SEQ ID NO: 231229 - DNA, 25 bp, Mus musculus
ggccacctggagtactcgggtaaga

SEQ ID NO: 231230 - DNA, 25 bp, Mus musculus
ccgatgcgccgagtccatgaaagtt

SEQ ID NO: 231231 - DNA, 25 bp, Mus musculus
agccctggaatggaatagagccacc

SEQ ID NO: 231232 - DNA, 25 bp, Mus musculus
tgagtacgcttgatcacgagctgtc

SEQ ID NO: 231233 - DNA, 25 bp, Mus musculus
tggcccaagaacaggagcgcagctc

SEQ ID NO: 231234 - DNA, 25 bp, Mus musculus
cggcggaaagcaggtctcctttctc

SEQ ID NO: 231235 - DNA, 25 bp, Mus musculus
cctaggcactgaaggatcccgggta

SEQ ID NO: 231236 - DNA, 25 bp, Mus musculus
aggcgctgcagcacatcacgtcgaa

SEQ ID NO: 231237 - DNA, 25 bp, Mus musculus
ctgcgtacctgactgcgcgctggat

SEQ ID NO: 231238 - DNA, 25 bp, Mus musculus
gctggattggcactcacacacgaaa

SEQ ID NO: 231239 - DNA, 25 bp, Mus musculus
cacgctgcgctgtagggccatgcgc

SEQ ID NO: 231240 - DNA, 25 bp, Mus musculus
cccggcttttgttgtgcccagcctg

SEQ ID NO: 231241 - DNA, 25 bp, Mus musculus
ttattgcgctccgaggatcctctgc

SEQ ID NO: 231242 - DNA, 25 bp, Mus musculus
gccgagccgccgttttattgcgctc

SEQ ID NO: 231243 - DNA, 25 bp, Mus musculus
tgtcctctttgtcaaggggcgcagc

SEQ ID NO: 231244 - DNA, 25 bp, Mus musculus
ccgcgcaaactttctgtcctctttg

SEQ ID NO: 231245 - DNA, 25 bp, Mus musculus
caaaacgcctgttgcgggtgcaccg

SEQ ID NO: 231246 - DNA, 25 bp, Mus musculus
cgtctgcattgcaaaacgcctgttg

SEQ ID NO: 231247 - DNA, 25 bp, Mus musculus
agccgcttacctacgtctgcattgc

SEQ ID NO: 231248 - DNA, 25 bp, Mus musculus
gcgcgaacccgggtacagccgctta

SEQ ID NO: 231249 - DNA, 25 bp, Mus musculus
ccgctgccttctatggctgtgtttg

SEQ ID NO: 231250 - DNA, 25 bp, Mus musculus
acgaaaacggccagctgtgcgactc

SEQ ID NO: 231251 - DNA, 25 bp, Mus musculus
gtgagtccagtgtaccagcgctgcc

SEQ ID NO: 231252 - DNA, 25 bp, Mus musculus
aagggcacgagccaagcgtccggcc

SEQ ID NO: 231253 - DNA, 25 bp, Mus musculus
acagggatgaaagggcacgagccaa

SEQ ID NO: 231254 - DNA, 25 bp, Mus musculus
tccactcgtgagcaggggcgcccga

SEQ ID NO: 231255 - DNA, 25 bp, Mus musculus
tcagctccaaatagggagtgagggc

SEQ ID NO: 231256 - DNA, 25 bp, Mus musculus
cgtcagggtgtctcagctccaaata

SEQ ID NO: 231257 - DNA, 25 bp, Mus musculus
ccgagcgcctccgacgtcagggtgt

SEQ ID NO: 231258 - DNA, 25 bp, Mus musculus
ctgcgtaacacgagggtcgcgagct

SEQ ID NO: 231259 - DNA, 25 bp, Mus musculus
ctggccgccgggctgcgtaacacga

SEQ ID NO: 231260 - DNA, 25 bp, Mus musculus
tgaaactcctacaagaaacggagcc

SEQ ID NO: 231261 - DNA, 25 bp, Mus musculus
tggcggtgaaactcctacaagaaac

SEQ ID NO: 231262 - DNA, 25 bp, Mus musculus
cagtcctggcggtgaaactcctaca

SEQ ID NO: 231263 - DNA, 25 bp, Mus musculus
ggccgcttcccaggcttcgattccc

SEQ ID NO: 231264 - DNA, 25 bp, Mus musculus
ctcctactctcagtcctggcggtga

SEQ ID NO: 231265 - DNA, 25 bp, Mus musculus
cgcgatttcaggcaagctccttcac

SEQ ID NO: 231266 - DNA, 25 bp, Mus musculus
ggtcatttccgagctaccgtggcga

SEQ ID NO: 231267 - DNA, 25 bp, Mus musculus
gagcagcgcgcctaacatctgcatc

SEQ ID NO: 231268 - DNA, 25 bp, Mus musculus
ccgtgacctcacaaagtgtgtcgtc

SEQ ID NO: 231269 - DNA, 25 bp, Mus musculus
tgtcgtcacaggacgcgtgtccaaa

SEQ ID NO: 231270 - DNA, 25 bp, Mus musculus
actgcggccattcttccggagaata

SEQ ID NO: 231271 - DNA, 25 bp, Mus musculus
tccaactgcagacccgaggcgggtt

SEQ ID NO: 231272 - DNA, 25 bp, Mus musculus
gcggttaagcgccttcttctatgac

SEQ ID NO: 231273 - DNA, 25 bp, Mus musculus
cccagggcctaccagaggcagatga

SEQ ID NO: 231274 - DNA, 25 bp, Mus musculus
gagctcacctagcttcacgaccgtg

SEQ ID NO: 231275 - DNA, 25 bp, Mus musculus
gactccgacatgttcctcactggca

SEQ ID NO: 231276 - DNA, 25 bp, Mus musculus
tcctactgatggcaagtctcgcgag

SEQ ID NO: 231277 - DNA, 25 bp, Mus musculus
atatcgcgggatcacatacgtcgtc

SEQ ID NO: 231278 - DNA, 25 bp, Mus musculus
actcacgacgagacaggtcatttcc

SEQ ID NO: 231279 - DNA, 25 bp, Mus musculus
tggtgacgtcttttccgcggagaaa

SEQ ID NO: 231280 - DNA, 25 bp, Mus musculus
ctggggcgagcacccggaacatcgc

SEQ ID NO: 231281 - DNA, 25 bp, Mus musculus
tcgaggagccagctgccgtcctcgg

SEQ ID NO: 231282 - DNA, 25 bp, Mus musculus
tgccgcctgggatggcttacgctct

SEQ ID NO: 231283 - DNA, 25 bp, Mus musculus
cttaccgtgagctgcgattggtgga

SEQ ID NO: 231284 - DNA, 25 bp, Mus musculus
cttatctaattggttgtcggcgctc

SEQ ID NO: 231285 - DNA, 25 bp, Mus musculus
agtttggcgccaactggaatctttt

SEQ ID NO: 231286 - DNA, 25 bp, Mus musculus
ccacttccgctctggtgacgtcttt

SEQ ID NO: 231287 - DNA, 25 bp, Mus musculus
tccgccttcaatggcgggaactggc

SEQ ID NO: 231288 - DNA, 25 bp, Mus musculus
agtaagtaccagagtttggcgccaa

SEQ ID NO: 231289 - DNA, 25 bp, Mus musculus
tcggagccacagaagagtaagtacc

SEQ ID NO: 231290 - DNA, 25 bp, Mus musculus
ccgttgtcactgaggtcacggcccg

SEQ ID NO: 231291 - DNA, 25 bp, Mus musculus
gaacatcgccgggtctacagcgcgc

SEQ ID NO: 231292 - DNA, 25 bp, Mus musculus
gcgccgagacgtgctttgcgtctta

SEQ ID NO: 231293 - DNA, 25 bp, Mus musculus
atgcaggttccgctcgctctgtagg

SEQ ID NO: 231294 - DNA, 25 bp, Mus musculus
ctaggcagacgccactcttcgggtc

SEQ ID NO: 231295 - DNA, 25 bp, Mus musculus
cacagacgccgggacagggaccgtc

SEQ ID NO: 231296 - DNA, 25 bp, Mus musculus
tcactcttgggcacccggggaagtg

SEQ ID NO: 231297 - DNA, 25 bp, Mus musculus
acccggatgttcactcttgggcacc

SEQ ID NO: 231298 - DNA, 25 bp, Mus musculus
ccgcgctctcattggtcgggagctg

SEQ ID NO: 231299 - DNA, 25 bp, Mus musculus
ggcgctccatacttggcgatcgctg

SEQ ID NO: 231300 - DNA, 25 bp, Mus musculus
tcctgagacaggacacgcccactcg

SEQ ID NO: 231301 - DNA, 25 bp, Mus musculus
gcaagtagacccagtccctccggaa

SEQ ID NO: 231302 - DNA, 25 bp, Mus musculus
tcagaggagggacgcaagtagaccc

SEQ ID NO: 231303 - DNA, 25 bp, Mus musculus
ctgcgagaagcgaggctgacagtca

SEQ ID NO: 231304 - DNA, 25 bp, Mus musculus
ccaggggaaccagtgaaccgctcca

SEQ ID NO: 231305 - DNA, 25 bp, Mus musculus
atcctccgcccaggggaaccagtga

SEQ ID NO: 231306 - DNA, 25 bp, Mus musculus
agacgccactcttcgggtccggagt

SEQ ID NO: 231307 - DNA, 25 bp, Mus musculus
ggcgactgcacaggtaaccgctgca

SEQ ID NO: 231308 - DNA, 25 bp, Mus musculus
aacaaggccgcccagtccagggaag

SEQ ID NO: 231309 - DNA, 25 bp, Mus musculus
cccgcaccgagtagagctgagccgg

SEQ ID NO: 231310 - DNA, 25 bp, Mus musculus
tgcgacggccagtccgagaacatcc

SEQ ID NO: 231311 - DNA, 25 bp, Mus musculus
gacacggccttcatgtactgcgacg

SEQ ID NO: 231312 - DNA, 25 bp, Mus musculus
tcgcatggatgcgagtgctagcgcc

SEQ ID NO: 231313 - DNA, 25 bp, Mus musculus
ccgctacggtgctgggcaccatgga

SEQ ID NO: 231314 - DNA, 25 bp, Mus musculus
ctccatgctgcgtgcagcgtccaga

SEQ ID NO: 231315 - DNA, 25 bp, Mus musculus
cgggatcagctgacctccgcgaagt

SEQ ID NO: 231316 - DNA, 25 bp, Mus musculus
agccggtgtcagcttcaggatccga

SEQ ID NO: 231317 - DNA, 25 bp, Mus musculus
cagttcaagatccacagccggtgtc

SEQ ID NO: 231318 - DNA, 25 bp, Mus musculus
tagaaaagacttagctgggcgcgtc

SEQ ID NO: 231319 - DNA, 25 bp, Mus musculus
caggttgggcagagacccacgatcc

SEQ ID NO: 231320 - DNA, 25 bp, Mus musculus
cggagcctgaagcttcgagtgcgca

SEQ ID NO: 231321 - DNA, 25 bp, Mus musculus
gcctcggcggaactatacagcggcg

SEQ ID NO: 231322 - DNA, 25 bp, Mus musculus
cgcctcggcggaactatacagcggc

SEQ ID NO: 231323 - DNA, 25 bp, Mus musculus
cctcggcggaactatacagcggcgc

SEQ ID NO: 231324 - DNA, 25 bp, Mus musculus
ctcggcggaactatacagcggcgcc

SEQ ID NO: 231325 - DNA, 25 bp, Mus musculus
cggcggaactatacagcggcgccga

SEQ ID NO: 231326 - DNA, 25 bp, Mus musculus
gcggaactatacagcggcgccgaag

SEQ ID NO: 231327 - DNA, 25 bp, Mus musculus
cggaactatacagcggcgccgaagg

SEQ ID NO: 231328 - DNA, 25 bp, Mus musculus
actatacagcggcgccgaaggagcc

SEQ ID NO: 231329 - DNA, 25 bp, Mus musculus
gttggcctctgatagccgggtccct

SEQ ID NO: 231330 - DNA, 25 bp, Mus musculus
ttggcctctgatagccgggtccctg

SEQ ID NO: 231331 - DNA, 25 bp, Mus musculus
tggcctctgatagccgggtccctgt

SEQ ID NO: 231332 - DNA, 25 bp, Mus musculus
tcctcccagcggtggcgcagggtct

SEQ ID NO: 231333 - DNA, 25 bp, Mus musculus
ttcgtgtgtggaacctggggctaaa

SEQ ID NO: 231334 - DNA, 25 bp, Mus musculus
tcgtgtgtggaacctggggctaaac

SEQ ID NO: 231335 - DNA, 25 bp, Mus musculus
aggacacactggtccataagcagcc

SEQ ID NO: 231336 - DNA, 25 bp, Mus musculus
ctgcaggacacactggtccataagc

SEQ ID NO: 231337 - DNA, 25 bp, Mus musculus
ctctgcaggacacactggtccataa

SEQ ID NO: 231338 - DNA, 25 bp, Mus musculus
actctgcaggacacactggtccata

SEQ ID NO: 231339 - DNA, 25 bp, Mus musculus
cctaggagaagtgagggagagcgcc

SEQ ID NO: 231340 - DNA, 25 bp, Mus musculus
aagcaagagtgtgggctagcgagtc

SEQ ID NO: 231341 - DNA, 25 bp, Mus musculus
actggtccataagcagccgcgggtc

SEQ ID NO: 231342 - DNA, 25 bp, Mus musculus
caggacacactggtccataagcagc

SEQ ID NO: 231343 - DNA, 25 bp, Mus musculus
cactggtccataagcagccgcgggt

SEQ ID NO: 231344 - DNA, 25 bp, Mus musculus
gcactatgcggagaaaccccagccg

SEQ ID NO: 231345 - DNA, 25 bp, Mus musculus
acactggtccataagcagccgcggg

SEQ ID NO: 231346 - DNA, 25 bp, Mus musculus
acacactggtccataagcagccgcg

SEQ ID NO: 231347 - DNA, 25 bp, Mus musculus
tgcaggacacactggtccataagca

SEQ ID NO: 231348 - DNA, 25 bp, Mus musculus
gacacactggtccataagcagccgc

SEQ ID NO: 231349 - DNA, 25 bp, Mus musculus
tgcggccgcggtctacgaagaccaa

SEQ ID NO: 231350 - DNA, 25 bp, Mus musculus
gtacaggtgacgcttctccaggacg

SEQ ID NO: 231351 - DNA, 25 bp, Mus musculus
cgaagaccaagtgggcaagtttgac

SEQ ID NO: 231352 - DNA, 25 bp, Mus musculus
tctggatctgggctgctgtgctgct

SEQ ID NO: 231353 - DNA, 25 bp, Mus musculus
cttgggcttcaatcatggcggtcgc

SEQ ID NO: 231354 - DNA, 25 bp, Mus musculus
caggcggtgcttgggcttcaatcat

SEQ ID NO: 231355 - DNA, 25 bp, Mus musculus
cctctctatggctctgcggagggag

SEQ ID NO: 231356 - DNA, 25 bp, Mus musculus
ctcgcgaaccggttcctctctatgg

SEQ ID NO: 231357 - DNA, 25 bp, Mus musculus
cagtgtcctgaaggccacttctctg

SEQ ID NO: 231358 - DNA, 25 bp, Mus musculus
tgcgctccgcccagtgtcctgaagg

SEQ ID NO: 231359 - DNA, 25 bp, Mus musculus
gtgcctgaactgtggcgagccctct

SEQ ID NO: 231360 - DNA, 25 bp, Mus musculus
tgtctcgcttggatttgggcatcgc

SEQ ID NO: 231361 - DNA, 25 bp, Mus musculus
gaacctacctttcttgtctcgcttg

SEQ ID NO: 231362 - DNA, 25 bp, Mus musculus
caagtttgactggtgcgtacaggtg

SEQ ID NO: 231363 - DNA, 25 bp, Mus musculus
ccctcctctggcattttcaatcgtg

SEQ ID NO: 231364 - DNA, 25 bp, Mus musculus
agtccactctgtcagggaatccacc

SEQ ID NO: 231365 - DNA, 25 bp, Mus musculus
gccggttcgtgagtccactctgtca

SEQ ID NO: 231366 - DNA, 25 bp, Mus musculus
tggtggcctcagtcatcgagaggta

SEQ ID NO: 231367 - DNA, 25 bp, Mus musculus
ttcgagatgaaggagttgccgcagc

SEQ ID NO: 231368 - DNA, 25 bp, Mus musculus
gtcctactccgccttcgagatgaag

SEQ ID NO: 231369 - DNA, 25 bp, Mus musculus
ccgcagtagtacgacgaaagatggc

SEQ ID NO: 231370 - DNA, 25 bp, Mus musculus
ctgtctgacgcgcacgattgcgtca

SEQ ID NO: 231371 - DNA, 25 bp, Mus musculus
caggtctttgcgtttttgttgggcg

SEQ ID NO: 231372 - DNA, 25 bp, Mus musculus
aagtcagaggccgtccaggtctttg

SEQ ID NO: 231373 - DNA, 25 bp, Mus musculus
ggttaagcccgcagaagtcagaggc

SEQ ID NO: 231374 - DNA, 25 bp, Mus musculus
gcattttcaatcgtgcgcaggcgca

SEQ ID NO: 231375 - DNA, 25 bp, Mus musculus
cggtagttactgcttcccgcgagca

SEQ ID NO: 231376 - DNA, 25 bp, Mus musculus
gcaggcgcactaccctgggttaagc

SEQ ID NO: 231377 - DNA, 25 bp, Mus musculus
cctatgtccgcagagggcggtccag

SEQ ID NO: 231378 - DNA, 25 bp, Mus musculus
agctggagccgcatctggagccacg

SEQ ID NO: 231379 - DNA, 25 bp, Mus musculus
agcggagccgcatctggcacctaac

SEQ ID NO: 231380 - DNA, 25 bp, Mus musculus
gccggtccacagcagctctgacagt

SEQ ID NO: 231381 - DNA, 25 bp, Mus musculus
agggaggaaggccttcgcctataga

SEQ ID NO: 231382 - DNA, 25 bp, Mus musculus
taactcgctgctgttcggagagatg

SEQ ID NO: 231383 - DNA, 25 bp, Mus musculus
gcgggacgatctgggttccaacatc

SEQ ID NO: 231384 - DNA, 25 bp, Mus musculus
tcaaggggctcaacgtgcgtttccg

SEQ ID NO: 231385 - DNA, 25 bp, Mus musculus
tgcgtttccgctgcttcttggccaa

SEQ ID NO: 231386 - DNA, 25 bp, Mus musculus
ggcgcaaccggctcctggagaaaca

SEQ ID NO: 231387 - DNA, 25 bp, Mus musculus
gcagccggcgcatggttaactcgct

SEQ ID NO: 231388 - DNA, 25 bp, Mus musculus
accatctggagctacacgcaggtgc

SEQ ID NO: 231389 - DNA, 25 bp, Mus musculus
ggcggctgcgctacaagaccttctc

SEQ ID NO: 231390 - DNA, 25 bp, Mus musculus
tgagagtcctctgcgagccgctgct

SEQ ID NO: 231391 - DNA, 25 bp, Mus musculus
gcgggtggcaacaggccccagaaca

SEQ ID NO: 231392 - DNA, 25 bp, Mus musculus
tccggcacccgtcacagcctagctg

SEQ ID NO: 231393 - DNA, 25 bp, Mus musculus
tttcgcttgagcttgtaattgaggc

SEQ ID NO: 231394 - DNA, 25 bp, Mus musculus
ggcgcaccgtcactcacccactgag

SEQ ID NO: 231395 - DNA, 25 bp, Mus musculus
cactgagggcctggctccggagcct

SEQ ID NO: 231396 - DNA, 25 bp, Mus musculus
cgcctacctgcgtagggccggacag

SEQ ID NO: 231397 - DNA, 25 bp, Mus musculus
cggcagtctctgttctgcgcctgcg

SEQ ID NO: 231398 - DNA, 25 bp, Mus musculus
tctaagtgtcttcctgcgccgcact

SEQ ID NO: 231399 - DNA, 25 bp, Mus musculus
tctcggttgcctacagccacgtctt

SEQ ID NO: 231400 - DNA, 25 bp, Mus musculus
acagccacgtcttcccggcagcctt

SEQ ID NO: 231401 - DNA, 25 bp, Mus musculus
gcctttgctctatgtgtcttcctct

SEQ ID NO: 231402 - DNA, 25 bp, Mus musculus
ctctactcgcccacccagtctctgc

SEQ ID NO: 231403 - DNA, 25 bp, Mus musculus
aatcgtagtttttcgcttgagcttg

SEQ ID NO: 231404 - DNA, 25 bp, Mus musculus
cgcttgagcttgtaattgaggcgcg

SEQ ID NO: 231405 - DNA, 25 bp, Mus musculus
gcggcgcaagaagccgaggctatcc

SEQ ID NO: 231406 - DNA, 25 bp, Mus musculus
gccaaacgcttcattcactcggagg

SEQ ID NO: 231407 - DNA, 25 bp, Mus musculus
tttacccgtcatgccaaacgcttca

SEQ ID NO: 231408 - DNA, 25 bp, Mus musculus
gtggccgtcaccctaggcatcacga

SEQ ID NO: 231409 - DNA, 25 bp, Mus musculus
tgacgtaagtggtgtggccgtcacc

SEQ ID NO: 231410 - DNA, 25 bp, Mus musculus
caaagggctcatgagtgacgtaagt

SEQ ID NO: 231411 - DNA, 25 bp, Mus musculus
ctggtggtgttcaaagggctcatga

SEQ ID NO: 231412 - DNA, 25 bp, Mus musculus
caaggccgagctggtggtgttcaaa

SEQ ID NO: 231413 - DNA, 25 bp, Mus musculus
aagattgagcggctcaaggccgagc

SEQ ID NO: 231414 - DNA, 25 bp, Mus musculus
ccgaggctatccaggaggagatgaa

SEQ ID NO: 231415 - DNA, 25 bp, Mus musculus
gaggctcgagctcggcttatagtta

SEQ ID NO: 231416 - DNA, 25 bp, Mus musculus
tcgagctcggcttatagttacagtc

SEQ ID NO: 231417 - DNA, 25 bp, Mus musculus
atgaacgagaagattgagcggctca

SEQ ID NO: 231418 - DNA, 25 bp, Mus musculus
ttcattcactcggaggctcgagctc

SEQ ID NO: 231419 - DNA, 25 bp, Mus musculus
gctcggcattcgagtacggcggcca

SEQ ID NO: 231420 - DNA, 25 bp, Mus musculus
gcacccagtgatggccacactctgt

SEQ ID NO: 231421 - DNA, 25 bp, Mus musculus
ggccacactctgtgccctgcagagt

SEQ ID NO: 231422 - DNA, 25 bp, Mus musculus
actctgtgccctgcagagtgtggcg

SEQ ID NO: 231423 - DNA, 25 bp, Mus musculus
tgtggcgggaagaatttccattttg

SEQ ID NO: 231424 - DNA, 25 bp, Mus musculus
ttccattttgtgcacagctcggccg

SEQ ID NO: 231425 - DNA, 25 bp, Mus musculus
attttgtgcacagctcggccgacgt

SEQ ID NO: 231426 - DNA, 25 bp, Mus musculus
ggacgctgcgctcggcattcgagta

SEQ ID NO: 231427 - DNA, 25 bp, Mus musculus
tcgctgtggccgcagatcaaagggc

SEQ ID NO: 231428 - DNA, 25 bp, Mus musculus
ctctacgtgccgaagtcgctgtggc

SEQ ID NO: 231429 - DNA, 25 bp, Mus musculus
tgctcgcgcctctacgtgccgaagt

SEQ ID NO: 231430 - DNA, 25 bp, Mus musculus
gccagaagtgctcagcctgctcgcg

SEQ ID NO: 231431 - DNA, 25 bp, Mus musculus
tacggcggccagaagtgctcagcct

SEQ ID NO: 231432 - DNA, 25 bp, Mus musculus
acagctcggccgacgtggacagcgt

SEQ ID NO: 231433 - DNA, 25 bp, Mus musculus
gtctttgtggccttcatcacggccg

SEQ ID NO: 231434 - DNA, 25 bp, Mus musculus
gtttctggatgcgttaccacgggcc

SEQ ID NO: 231435 - DNA, 25 bp, Mus musculus
gccaagcgcctacggtttctggatg

SEQ ID NO: 231436 - DNA, 25 bp, Mus musculus
gacgcctgccaagcgcctacggttt

SEQ ID NO: 231437 - DNA, 25 bp, Mus musculus
cttcaagatggccagacgcctgcca

SEQ ID NO: 231438 - DNA, 25 bp, Mus musculus
tgtgtgcgtcttcaagatggccaga

SEQ ID NO: 231439 - DNA, 25 bp, Mus musculus
ttccagattgtgtgcgtcttcaaga

SEQ ID NO: 231440 - DNA, 25 bp, Mus musculus
gtgcgctccttccagattgtgtgcg

SEQ ID NO: 231441 - DNA, 25 bp, Mus musculus
tcttcaccgtttgcttctccgtctg

SEQ ID NO: 231442 - DNA, 25 bp, Mus musculus
gccctacgtctttgtggccttcatc

SEQ ID NO: 231443 - DNA, 25 bp, Mus musculus
tgccgccaggctttcttcaccgttt

SEQ ID NO: 231444 - DNA, 25 bp, Mus musculus
tgtttctgccgccaggctttcttca

SEQ ID NO: 231445 - DNA, 25 bp, Mus musculus
catgtgcttcctgatgctggtgccc

SEQ ID NO: 231446 - DNA, 25 bp, Mus musculus
ctggatgcgttaccacgggccctac

SEQ ID NO: 231447 - DNA, 25 bp, Mus musculus
gacgcgaatttcactctcagaagga

SEQ ID NO: 231448 - DNA, 25 bp, Mus musculus
ttcccttcctactagcagtggcgcg

SEQ ID NO: 231449 - DNA, 25 bp, Mus musculus
ctcagaaggatcagtcaaccggcta

SEQ ID NO: 231450 - DNA, 25 bp, Mus musculus
ggctaacctcaaaagctacttccgc

SEQ ID NO: 231451 - DNA, 25 bp, Mus musculus
ccgcgggttgatgacgcaacgtgaa

SEQ ID NO: 231452 - DNA, 25 bp, Mus musculus
ggccggagactatggagcacctctc

SEQ ID NO: 231453 - DNA, 25 bp, Mus musculus
agcacctctctgtggagctggtatc

SEQ ID NO: 231454 - DNA, 25 bp, Mus musculus
cgccgccaagaacgagaagagcagc

SEQ ID NO: 231455 - DNA, 25 bp, Mus musculus
gcagcggcgagctgaacaggttcct

SEQ ID NO: 231456 - DNA, 25 bp, Mus musculus
tttcggggtcagcttccatttcctc

SEQ ID NO: 231457 - DNA, 25 bp, Mus musculus
tggtggagttcatgcccttcaggaa

SEQ ID NO: 231458 - DNA, 25 bp, Mus musculus
gtttttctgcgaggctgcttctgtc

SEQ ID NO: 231459 - DNA, 25 bp, Mus musculus
agctcctcgtttggcgacgcgaatt

SEQ ID NO: 231460 - DNA, 25 bp, Mus musculus
tgaattccttcaccacgtgtgtgtc

SEQ ID NO: 231461 - DNA, 25 bp, Mus musculus
ggtcgcgaacactcagccgaggaga

SEQ ID NO: 231462 - DNA, 25 bp, Mus musculus
cgtcccaagttgcaagcataatgtg

SEQ ID NO: 231463 - DNA, 25 bp, Mus musculus
tgctttctcgtgcaaagcggtctcg

SEQ ID NO: 231464 - DNA, 25 bp, Mus musculus
gagacattcatcgacgcgtcccaag

SEQ ID NO: 231465 - DNA, 25 bp, Mus musculus
agccttggtgctccagcatcggtca

SEQ ID NO: 231466 - DNA, 25 bp, Mus musculus
aacggaggcagcactttgctttctc

SEQ ID NO: 231467 - DNA, 25 bp, Mus musculus
agcggtctcgcttttcaatgttccc

SEQ ID NO: 231468 - DNA, 25 bp, Mus musculus
ccctggctctgaagacaaaacctgg

SEQ ID NO: 231469 - DNA, 25 bp, Mus musculus
gaggactctcagacccaagaactta

SEQ ID NO: 231470 - DNA, 25 bp, Mus musculus
cggcgcgctcgcctctaattaagcg

SEQ ID NO: 231471 - DNA, 25 bp, Mus musculus
ctaattaagcggctggatcccggga

SEQ ID NO: 231472 - DNA, 25 bp, Mus musculus
gagccgcctttgtactggtgtcacc

SEQ ID NO: 231473 - DNA, 25 bp, Mus musculus
ggtgtcacccaacgccgagcatcaa

SEQ ID NO: 231474 - DNA, 25 bp, Mus musculus
acaaaacctggagctgaggactctc

SEQ ID NO: 231475 - DNA, 25 bp, Mus musculus
gcaggggactccacttgctagtctc

SEQ ID NO: 231476 - DNA, 25 bp, Mus musculus
cctcactcttgtcttgggttccgga

SEQ ID NO: 231477 - DNA, 25 bp, Mus musculus
gtgtcgcttagtctcagatccctcc

SEQ ID NO: 231478 - DNA, 25 bp, Mus musculus
cgcctcattgtagtgtcgcttagtc

SEQ ID NO: 231479 - DNA, 25 bp, Mus musculus
ctttgtaacagttatcgcctcattg

SEQ ID NO: 231480 - DNA, 25 bp, Mus musculus
cgagcgcgtgttcgcctttgtaaca

SEQ ID NO: 231481 - DNA, 25 bp, Mus musculus
aagcgccgtttgcagactttattta

SEQ ID NO: 231482 - DNA, 25 bp, Mus musculus
ttaggcacccgtttatctgaagcgc

SEQ ID NO: 231483 - DNA, 25 bp, Mus musculus
ctagcccgtcacactagatttaggc

SEQ ID NO: 231484 - DNA, 25 bp, Mus musculus
ggtgcacgcgaatcttttaggtaca

SEQ ID NO: 231485 - DNA, 25 bp, Mus musculus
gctagtctccagcaactcctgtacg

SEQ ID NO: 231486 - DNA, 25 bp, Mus musculus
tacagacgccttgaaacggccctgg

SEQ ID NO: 231487 - DNA, 25 bp, Mus musculus
cgccttgtcagctcagtgtgggctc

SEQ ID NO: 231488 - DNA, 25 bp, Mus musculus
gtcttctattagattacgctccttc

SEQ ID NO: 231489 - DNA, 25 bp, Mus musculus
gctcggcgatctgcgactttttccc

SEQ ID NO: 231490 - DNA, 25 bp, Mus musculus
tctgcgactttttcccagctgtggc

SEQ ID NO: 231491 - DNA, 25 bp, Mus musculus
gcgactttttcccagctgtggcagg

SEQ ID NO: 231492 - DNA, 25 bp, Mus musculus
ttgattctgagcactcggctaatcg

SEQ ID NO: 231493 - DNA, 25 bp, Mus musculus
ttcccgaacttgattctgagcactc

SEQ ID NO: 231494 - DNA, 25 bp, Mus musculus
atcgatgctgtgtttggctttcttc

SEQ ID NO: 231495 - DNA, 25 bp, Mus musculus
caggatgccatcgatgctgtgtttg

SEQ ID NO: 231496 - DNA, 25 bp, Mus musculus
ttgtcgcccaggatgccatcgatgc

SEQ ID NO: 231497 - DNA, 25 bp, Mus musculus
acctttgtcgcccaggatgccatcg

SEQ ID NO: 231498 - DNA, 25 bp, Mus musculus
tctccggcgtctcgggccacggtag

SEQ ID NO: 231499 - DNA, 25 bp, Mus musculus
cacgagttctcaccagaggcgtggg

SEQ ID NO: 231500 - DNA, 25 bp, Mus musculus
atccgcacgagttctcaccagaggc

SEQ ID NO: 231501 - DNA, 25 bp, Mus musculus
gcaggggttaatccgcacgagttct

SEQ ID NO: 231502 - DNA, 25 bp, Mus musculus
tggctttcttctcgccatcttcttc

SEQ ID NO: 231503 - DNA, 25 bp, Mus musculus
gtgtccgctctagaaacttcccgtg

SEQ ID NO: 231504 - DNA, 25 bp, Mus musculus
gccgggtctcatcatcctggggacc

SEQ ID NO: 231505 - DNA, 25 bp, Mus musculus
tgtgtcagagaagagtgggaaaccc

SEQ ID NO: 231506 - DNA, 25 bp, Mus musculus
ggaccctgtaaaggcctcctgcgcg

SEQ ID NO: 231507 - DNA, 25 bp, Mus musculus
ccctggattgctgtaccctcttttg

SEQ ID NO: 231508 - DNA, 25 bp, Mus musculus
ccagagtcggctggataaacctctt

SEQ ID NO: 231509 - DNA, 25 bp, Mus musculus
gtcagcggagtccacgcagaaactg

SEQ ID NO: 231510 - DNA, 25 bp, Mus musculus
ttttgcgggaaataaggcactatgc

SEQ ID NO: 231511 - DNA, 25 bp, Mus musculus
gagacccgggaactctgttgtgtca

SEQ ID NO: 231512 - DNA, 25 bp, Mus musculus
cccgagtggctagagactcaaaaca

SEQ ID NO: 231513 - DNA, 25 bp, Mus musculus
ctggctgaaagccttccataggttt

SEQ ID NO: 231514 - DNA, 25 bp, Mus musculus
aagacccttcggtgactggctgaaa

SEQ ID NO: 231515 - DNA, 25 bp, Mus musculus
ttaccggagcgcaaaacggaccaga

SEQ ID NO: 231516 - DNA, 25 bp, Mus musculus
catcccgactttgagggaccaattc

SEQ ID NO: 231517 - DNA, 25 bp, Mus musculus
ctgtgtgtgccagggcaaatgtatc

SEQ ID NO: 231518 - DNA, 25 bp, Mus musculus
tgttcctgggtcgagaatcggagca

SEQ ID NO: 231519 - DNA, 25 bp, Mus musculus
atctcattggcgcacaccgtggctg

SEQ ID NO: 231520 - DNA, 25 bp, Mus musculus
cagggcaaatgtatcgtttgggaga

SEQ ID NO: 231521 - DNA, 25 bp, Mus musculus
cccggtgacaaagatctcattggcg

SEQ ID NO: 231522 - DNA, 25 bp, Mus musculus
aatcggagcagcaagtagcgcaggc

SEQ ID NO: 231523 - DNA, 25 bp, Mus musculus
catctcggccgtgcggtccttgctg

SEQ ID NO: 231524 - DNA, 25 bp, Mus musculus
gtcaaaacggtagagaaagccattc

SEQ ID NO: 231525 - DNA, 25 bp, Mus musculus
ctgcggttgaggtcaaaacggtaga

SEQ ID NO: 231526 - DNA, 25 bp, Mus musculus
cggtacacgctgatgcccaggctgc

SEQ ID NO: 231527 - DNA, 25 bp, Mus musculus
caccaacgctgttcctgggtcgaga

SEQ ID NO: 231528 - DNA, 25 bp, Mus musculus
tccagcggtccaggcgagggtcata

SEQ ID NO: 231529 - DNA, 25 bp, Mus musculus
acgctgatgcccaggctgcggttga

SEQ ID NO: 231530 - DNA, 25 bp, Mus musculus
gagaaagccattcacagccaccatc

SEQ ID NO: 231531 - DNA, 25 bp, Mus musculus
cgatctgcgggttgagggtccaggt

SEQ ID NO: 231532 - DNA, 25 bp, Mus musculus
gcgctccgtgtagggacgtccagcc

SEQ ID NO: 231533 - DNA, 25 bp, Mus musculus
gctccgtgtagggacgtccagcccg

SEQ ID NO: 231534 - DNA, 25 bp, Mus musculus
gtccaggtgagcagggcccgcacct

SEQ ID NO: 231535 - DNA, 25 bp, Mus musculus
agcagggcccgcacctccaccgtgc

SEQ ID NO: 231536 - DNA, 25 bp, Mus musculus
cctccaccgtgccatcgctgcctgg

SEQ ID NO: 231537 - DNA, 25 bp, Mus musculus
cggctgtggcgcaggaagtagaccg

SEQ ID NO: 231538 - DNA, 25 bp, Mus musculus
cggctcggcgctgtgtacccaacgg

SEQ ID NO: 231539 - DNA, 25 bp, Mus musculus
caacgggggaactctcggctcacca

SEQ ID NO: 231540 - DNA, 25 bp, Mus musculus
cactgtctctgggatgttttccgtg

SEQ ID NO: 231541 - DNA, 25 bp, Mus musculus
tgtctctgggatgttttccgtggtg

SEQ ID NO: 231542 - DNA, 25 bp, Mus musculus
tgttttccgtggtgggctgcacgaa

SEQ ID NO: 231543 - DNA, 25 bp, Mus musculus
gctgcacgaagaggctggggtcctg

SEQ ID NO: 231544 - DNA, 25 bp, Mus musculus
aagtagaccggctcggcgctgtgta

SEQ ID NO: 231545 - DNA, 25 bp, Mus musculus
cgtggacagatcctagccggaactc

SEQ ID NO: 231546 - DNA, 25 bp, Mus musculus
tgtcgcttgcggacaaacctacgtc

SEQ ID NO: 231547 - DNA, 25 bp, Mus musculus
gacactgtctgtcgcttgcggacaa

SEQ ID NO: 231548 - DNA, 25 bp, Mus musculus
tcgtgcagcgcgacactgtctgtcg

SEQ ID NO: 231549 - DNA, 25 bp, Mus musculus
tggccatgctgcctgtcgtgcagcg

SEQ ID NO: 231550 - DNA, 25 bp, Mus musculus
tcatggagacctcgtcggtgctgac

SEQ ID NO: 231551 - DNA, 25 bp, Mus musculus
tcgctgacagtcatggagacctcgt

SEQ ID NO: 231552 - DNA, 25 bp, Mus musculus
cttagcggtcggcagtcgctgacag

SEQ ID NO: 231553 - DNA, 25 bp, Mus musculus
agccggaactcggtgcgagccaacc

SEQ ID NO: 231554 - DNA, 25 bp, Mus musculus
ccgcttgcagaacgtggacagatcc

SEQ ID NO: 231555 - DNA, 25 bp, Mus musculus
tacacccgccgcttgcagaacgtgg

SEQ ID NO: 231556 - DNA, 25 bp, Mus musculus
ttatttaactcaggctctacacccg

SEQ ID NO: 231557 - DNA, 25 bp, Mus musculus
cgtctctccggttatttaactcagg

SEQ ID NO: 231558 - DNA, 25 bp, Mus musculus
aggcccaggcttgcgattggctgtt

SEQ ID NO: 231559 - DNA, 25 bp, Mus musculus
actctattatagaccgcgagcttgc

SEQ ID NO: 231560 - DNA, 25 bp, Mus musculus
cagcctcccgctaatgaaagcgtta

SEQ ID NO: 231561 - DNA, 25 bp, Mus musculus
agtggaattagctccctgcggctcc

SEQ ID NO: 231562 - DNA, 25 bp, Mus musculus
tgaaagcgttactccacaaagcagc

SEQ ID NO: 231563 - DNA, 25 bp, Mus musculus
tccacaaagcagcaaggtatgagtt

SEQ ID NO: 231564 - DNA, 25 bp, Mus musculus
caaggtatgagttgtcactgtttca

SEQ ID NO: 231565 - DNA, 25 bp, Mus musculus
gttgtcactgtttcaattatttatc

SEQ ID NO: 231566 - DNA, 25 bp, Mus musculus
ttatttatctgtttactcggctgca

SEQ ID NO: 231567 - DNA, 25 bp, Mus musculus
tatctgtttactcggctgcagtttt

SEQ ID NO: 231568 - DNA, 25 bp, Mus musculus
gcgctaacagcctgcgaccaggcgg

SEQ ID NO: 231569 - DNA, 25 bp, Mus musculus
cgcttgtctcagcaactctattata

SEQ ID NO: 231570 - DNA, 25 bp, Mus musculus
tagaccgcgagcttgcagcctctcg

SEQ ID NO: 231571 - DNA, 25 bp, Mus musculus
acgcgcacgcctggtctccacagcc

SEQ ID NO: 231572 - DNA, 25 bp, Mus musculus
tgcagttttccgcttgtctcagcaa

SEQ ID NO: 231573 - DNA, 25 bp, Mus musculus
tcctgacgcagtcggggtttcccac

SEQ ID NO: 231574 - DNA, 25 bp, Mus musculus
gtcaaagctccagggcgccggaata

SEQ ID NO: 231575 - DNA, 25 bp, Mus musculus
ccgtgtgcatcccaggttgagaaga

SEQ ID NO: 231576 - DNA, 25 bp, Mus musculus
cgtcttctcggtggcgctggaaccc

SEQ ID NO: 231577 - DNA, 25 bp, Mus musculus
ggagcaagcccttcccgcagcctgc

SEQ ID NO: 231578 - DNA, 25 bp, Mus musculus
agctagcgagccgagtcaaagctcc

SEQ ID NO: 231579 - DNA, 25 bp, Mus musculus
cacgtgccctggttccacgcgttca

SEQ ID NO: 231580 - DNA, 25 bp, Mus musculus
ccggaatagctctccgcagccaagc

SEQ ID NO: 231581 - DNA, 25 bp, Mus musculus
ttcgttacaccgtgtgcatcccagg

SEQ ID NO: 231582 - DNA, 25 bp, Mus musculus
tgagaagaaggggagcttcccgttc

SEQ ID NO: 231583 - DNA, 25 bp, Mus musculus
ctgctccctgcagcgtccaggtgag

SEQ ID NO: 231584 - DNA, 25 bp, Mus musculus
tcccgtgcctttctacaacgtctag

SEQ ID NO: 231585 - DNA, 25 bp, Mus musculus
aacgtctagcgtcttctcggtggcg

SEQ ID NO: 231586 - DNA, 25 bp, Mus musculus
cgcagcctgcagaagctagcgagcc

SEQ ID NO: 231587 - DNA, 25 bp, Mus musculus
actggctgctccgggctgcaccgga

SEQ ID NO: 231588 - DNA, 25 bp, Mus musculus
tgctcccggctggttggctgcgata

SEQ ID NO: 231589 - DNA, 25 bp, Mus musculus
atgctactgtagcccggccgccagg

SEQ ID NO: 231590 - DNA, 25 bp, Mus musculus
ggctgcaccagacgcactggctgct

SEQ ID NO: 231591 - DNA, 25 bp, Mus musculus
ggctactctgggctgtaataggatg

SEQ ID NO: 231592 - DNA, 25 bp, Mus musculus
caccaccaggctactctgggctgta

SEQ ID NO: 231593 - DNA, 25 bp, Mus musculus
ctgctctgggctgtaccgggatgct

SEQ ID NO: 231594 - DNA, 25 bp, Mus musculus
gggaggtccccatgctactgtagcc

SEQ ID NO: 231595 - DNA, 25 bp, Mus musculus
ctcagaagcgcttgtgacccgggcc

SEQ ID NO: 231596 - DNA, 25 bp, Mus musculus
gggtcccctcgccatgggctcagaa

SEQ ID NO: 231597 - DNA, 25 bp, Mus musculus
cttggagcagcttgcatggtgtcca

SEQ ID NO: 231598 - DNA, 25 bp, Mus musculus
tcaccgcgtgccaggtccagaatcg

SEQ ID NO: 231599 - DNA, 25 bp, Mus musculus
gcgcccttctcggtctttgcgcgca

SEQ ID NO: 231600 - DNA, 25 bp, Mus musculus
cgtgccaggtccagaatcgcggcga

SEQ ID NO: 231601 - DNA, 25 bp, Mus musculus
aatggcggtagccttgtccaccaga

SEQ ID NO: 231602 - DNA, 25 bp, Mus musculus
gtccaccagagatgatagccacaga

SEQ ID NO: 231603 - DNA, 25 bp, Mus musculus
tccggacccagacgtcagggtcatc

SEQ ID NO: 231604 - DNA, 25 bp, Mus musculus
agggtcatcggccatctcgtagatg

SEQ ID NO: 231605 - DNA, 25 bp, Mus musculus
atggacccgtcctcctcactgtgtt

SEQ ID NO: 231606 - DNA, 25 bp, Mus musculus
cactgtgttccagagccgagccatc

SEQ ID NO: 231607 - DNA, 25 bp, Mus musculus
caggtgctggctcccgcacagacaa

SEQ ID NO: 231608 - DNA, 25 bp, Mus musculus
gcggtattggagcaggatgcctttc

SEQ ID NO: 231609 - DNA, 25 bp, Mus musculus
agcaggatgcctttcttgcgggtca

SEQ ID NO: 231610 - DNA, 25 bp, Mus musculus
ttgcgggtcagctcccgagctgtgt

SEQ ID NO: 231611 - DNA, 25 bp, Mus musculus
ctgtcaggcccaggcacggtttcat

SEQ ID NO: 231612 - DNA, 25 bp, Mus musculus
acggtttcatgagcctgcccgtctg

SEQ ID NO: 231613 - DNA, 25 bp, Mus musculus
aggccacctggagcaccgccgaaat

SEQ ID NO: 231614 - DNA, 25 bp, Mus musculus
gcagatctccttgcggtgggcatca

SEQ ID NO: 231615 - DNA, 25 bp, Mus musculus
cacacgagtagggaaagcgcacgga

SEQ ID NO: 231616 - DNA, 25 bp, Mus musculus
ccgcagcagcttccgtgggcaacat

SEQ ID NO: 231617 - DNA, 25 bp, Mus musculus
cgcttccgtgaccagggtgcccgag

SEQ ID NO: 231618 - DNA, 25 bp, Mus musculus
gcggaaaacccaggactcgcgcatc

SEQ ID NO: 231619 - DNA, 25 bp, Mus musculus
gagctcctgggttctccgcggaaaa

SEQ ID NO: 231620 - DNA, 25 bp, Mus musculus
tcccgtaaaagcgaccgagctcctg

SEQ ID NO: 231621 - DNA, 25 bp, Mus musculus
agcaagggtgctcaaaaggcacaca

SEQ ID NO: 231622 - DNA, 25 bp, Mus musculus
tctcagttatacacagcaagggtgc

SEQ ID NO: 231623 - DNA, 25 bp, Mus musculus
agcataatggcggtcttctcagtta

SEQ ID NO: 231624 - DNA, 25 bp, Mus musculus
caaacggaatttgccagcataatgg

SEQ ID NO: 231625 - DNA, 25 bp, Mus musculus
gcttccaggatgcaaacggaatttg

SEQ ID NO: 231626 - DNA, 25 bp, Mus musculus
cctgcgtgctgtaggataaagtgta

SEQ ID NO: 231627 - DNA, 25 bp, Mus musculus
ccctgacgctgaagcaggtactgct

SEQ ID NO: 231628 - DNA, 25 bp, Mus musculus
cgcaacgatcgaggcgacctgcgtg

SEQ ID NO: 231629 - DNA, 25 bp, Mus musculus
gcccggcgaccatgcccaggaagaa

SEQ ID NO: 231630 - DNA, 25 bp, Mus musculus
gaaggcggatccacgtggtttaatc

SEQ ID NO: 231631 - DNA, 25 bp, Mus musculus
ccacgtggtttaatcggagacagac

SEQ ID NO: 231632 - DNA, 25 bp, Mus musculus
tcggagacagacagagatcccattg

SEQ ID NO: 231633 - DNA, 25 bp, Mus musculus
gacagagatcccattgttcaaaatc

SEQ ID NO: 231634 - DNA, 25 bp, Mus musculus
gagatcccattgttcaaaatcaata

SEQ ID NO: 231635 - DNA, 25 bp, Mus musculus
ttttcgcgcgtgctcgcaggtgctt

SEQ ID NO: 231636 - DNA, 25 bp, Mus musculus
ccgagcacacgaaggagcgcgtcgt

SEQ ID NO: 231637 - DNA, 25 bp, Mus musculus
aggagccgagttcgggcaacggcac

SEQ ID NO: 231638 - DNA, 25 bp, Mus musculus
caagcgcacagccaggccggcgacg

SEQ ID NO: 231639 - DNA, 25 bp, Mus musculus
ggccgcgatcatcacggagcccgag

SEQ ID NO: 231640 - DNA, 25 bp, Mus musculus
gcgatcatcacggagcccgagcaca

SEQ ID NO: 231641 - DNA, 25 bp, Mus musculus
ccagtttgcagggtctgggaaagtt

SEQ ID NO: 231642 - DNA, 25 bp, Mus musculus
aaagttcctcttttcgcgcgtgctc

SEQ ID NO: 231643 - DNA, 25 bp, Mus musculus
cagcaggtgcttattcctgggagca

SEQ ID NO: 231644 - DNA, 25 bp, Mus musculus
cttgacggacgggtttgcagatcca

SEQ ID NO: 231645 - DNA, 25 bp, Mus musculus
gcagccgcctatacgggaaaatatg

SEQ ID NO: 231646 - DNA, 25 bp, Mus musculus
gcttattcctgggagcagcacggaa

SEQ ID NO: 231647 - DNA, 25 bp, Mus musculus
gtgtacgtgctgggcacgcagctct

SEQ ID NO: 231648 - DNA, 25 bp, Mus musculus
tacctgcagcaggtgcttattcctg

SEQ ID NO: 231649 - DNA, 25 bp, Mus musculus
agcagcggagggcttacctgcagca

SEQ ID NO: 231650 - DNA, 25 bp, Mus musculus
cggctgctgcttaaggccgccggct

SEQ ID NO: 231651 - DNA, 25 bp, Mus musculus
atccaatccaagaggagtccggcgg

SEQ ID NO: 231652 - DNA, 25 bp, Mus musculus
ttgcagatccaatccaagaggagtc

SEQ ID NO: 231653 - DNA, 25 bp, Mus musculus
cggacgggtttgcagatccaatcca

SEQ ID NO: 231654 - DNA, 25 bp, Mus musculus
ccgcctatacgggaaaatatgctgc

SEQ ID NO: 231655 - DNA, 25 bp, Mus musculus
aatatgctgcgggaacggaccgtgc

SEQ ID NO: 231656 - DNA, 25 bp, Mus musculus
gcagcacggaatgcagccgcctata

SEQ ID NO: 231657 - DNA, 25 bp, Mus musculus
accggaagcggccttccactcgttg

SEQ ID NO: 231658 - DNA, 25 bp, Mus musculus
cctgtacattggctcggagaaaccg

SEQ ID NO: 231659 - DNA, 25 bp, Mus musculus
ccttccactcgttggcgcttaggcg

SEQ ID NO: 231660 - DNA, 25 bp, Mus musculus
cgcttaggcggctagcggtcctcag

SEQ ID NO: 231661 - DNA, 25 bp, Mus musculus
tcccaccgcggtgttcgacgggatg

SEQ ID NO: 231662 - DNA, 25 bp, Mus musculus
gctgacgtcaggagccaaaatggcg

SEQ ID NO: 231663 - DNA, 25 bp, Mus musculus
ggtctccttgaagcgcggcttcccg

SEQ ID NO: 231664 - DNA, 25 bp, Mus musculus
ccgtcaccgaggctgcctgggtaga

SEQ ID NO: 231665 - DNA, 25 bp, Mus musculus
gggaggacttaacccggcatcctgc

SEQ ID NO: 231666 - DNA, 25 bp, Mus musculus
ggcatcctgctcttgagcatccttt

SEQ ID NO: 231667 - DNA, 25 bp, Mus musculus
agcatcctttcagacagccattccg

SEQ ID NO: 231668 - DNA, 25 bp, Mus musculus
gcgcttctccatcaccggagagaga

SEQ ID NO: 231669 - DNA, 25 bp, Mus musculus
ccgttctcggcagagtcggcctgca

SEQ ID NO: 231670 - DNA, 25 bp, Mus musculus
gcacacacgcacttcctgtacattg

SEQ ID NO: 231671 - DNA, 25 bp, Mus musculus
aagatctcagcgagctccggacaga

SEQ ID NO: 231672 - DNA, 25 bp, Mus musculus
ctgagtgacaggtcccagtgatgga

SEQ ID NO: 231673 - DNA, 25 bp, Mus musculus
tgcattcgaccctgagtgacaggtc

SEQ ID NO: 231674 - DNA, 25 bp, Mus musculus
tctgaatgcattcgaccctgagtga

SEQ ID NO: 231675 - DNA, 25 bp, Mus musculus
taggttgccgctgcgctcaccctag

SEQ ID NO: 231676 - DNA, 25 bp, Mus musculus
cagatttaggttgccgctgcgctca

SEQ ID NO: 231677 - DNA, 25 bp, Mus musculus
gtcgcgtcttgcaggtgctgcccag

SEQ ID NO: 231678 - DNA, 25 bp, Mus musculus
gactgcggcacagttccagtcgccg

SEQ ID NO: 231679 - DNA, 25 bp, Mus musculus
cgagctccggacagaggccagactg

SEQ ID NO: 231680 - DNA, 25 bp, Mus musculus
tgcccacagcatcaagatctcagcg

SEQ ID NO: 231681 - DNA, 25 bp, Mus musculus
gtcccagtgatggacgcggtgcacc

SEQ ID NO: 231682 - DNA, 25 bp, Mus musculus
cccagagacagatttaggttgccgc

SEQ ID NO: 231683 - DNA, 25 bp, Mus musculus
cgcagactgcggcacagttccagtc

SEQ ID NO: 231684 - DNA, 25 bp, Mus musculus
tccagtcgccgtcgcgtcttgcagg

SEQ ID NO: 231685 - DNA, 25 bp, Mus musculus
gggcggcactttcagccgcactaga

SEQ ID NO: 231686 - DNA, 25 bp, Mus musculus
gcggcactttcagccgcactagagc

SEQ ID NO: 231687 - DNA, 25 bp, Mus musculus
ttcagccgcactagagcacagcgca

SEQ ID NO: 231688 - DNA, 25 bp, Mus musculus
cagccgcactagagcacagcgcaga

SEQ ID NO: 231689 - DNA, 25 bp, Mus musculus
cgcactagagcacagcgcagaggcc

SEQ ID NO: 231690 - DNA, 25 bp, Mus musculus
cgcagaggccccaacaggtaggcgc

SEQ ID NO: 231691 - DNA, 25 bp, Mus musculus
gcacgtccaggggtgtctaagcaca

SEQ ID NO: 231692 - DNA, 25 bp, Mus musculus
cgtccaggggtgtctaagcacaatg

SEQ ID NO: 231693 - DNA, 25 bp, Mus musculus
ccaggggtgtctaagcacaatgctc

SEQ ID NO: 231694 - DNA, 25 bp, Mus musculus
ggggtgtctaagcacaatgctccga

SEQ ID NO: 231695 - DNA, 25 bp, Mus musculus
ggtgtctaagcacaatgctccgagc

SEQ ID NO: 231696 - DNA, 25 bp, Mus musculus
gtctaagcacaatgctccgagctcg

SEQ ID NO: 231697 - DNA, 25 bp, Mus musculus
cggggcggcactttcagccgcacta

SEQ ID NO: 231698 - DNA, 25 bp, Mus musculus
actttcagccgcactagagcacagc

SEQ ID NO: 231699 - DNA, 25 bp, Mus musculus
aggggagccagtcactttggagcca

SEQ ID NO: 231700 - DNA, 25 bp, Mus musculus
ctcccgcgcctttgaaaaagttgcg

SEQ ID NO: 231701 - DNA, 25 bp, Mus musculus
tttgaaaaagttgcgagcgaagccc

SEQ ID NO: 231702 - DNA, 25 bp, Mus musculus
cgcttacctgttggaggtagaggaa

SEQ ID NO: 231703 - DNA, 25 bp, Mus musculus
agcatgctgccggagttggacagca

SEQ ID NO: 231704 - DNA, 25 bp, Mus musculus
gcagcccgagttcgccatggagcac

SEQ ID NO: 231705 - DNA, 25 bp, Mus musculus
ctcgctgcgtccctcggtgtgtgcg

SEQ ID NO: 231706 - DNA, 25 bp, Mus musculus
ccagtcactttggagccaccggagc

SEQ ID NO: 231707 - DNA, 25 bp, Mus musculus
ccaccggagccctgtctgcaaagag

SEQ ID NO: 231708 - DNA, 25 bp, Mus musculus
ccctgtctgcaaagagtggtgcgtg

SEQ ID NO: 231709 - DNA, 25 bp, Mus musculus
ggagtccctggcgtactccaacatc

SEQ ID NO: 231710 - DNA, 25 bp, Mus musculus
ggcgtactccaacatcaaacggagc

SEQ ID NO: 231711 - DNA, 25 bp, Mus musculus
gcaccactgccggtcccgcacttaa

SEQ ID NO: 231712 - DNA, 25 bp, Mus musculus
ccatggagcacagcatggggcgtca

SEQ ID NO: 231713 - DNA, 25 bp, Mus musculus
ctggggagctggacactcggcccag

SEQ ID NO: 231714 - DNA, 25 bp, Mus musculus
gcaccacgcgcctcctccagggagc

SEQ ID NO: 231715 - DNA, 25 bp, Mus musculus
agaagcctcttctcggcaccacgcg

SEQ ID NO: 231716 - DNA, 25 bp, Mus musculus
gagtccagaagcctcttctcggcac

SEQ ID NO: 231717 - DNA, 25 bp, Mus musculus
gcagagtccagaagcctcttctcgg

SEQ ID NO: 231718 - DNA, 25 bp, Mus musculus
gggcagagtccagaagcctcttctc

SEQ ID NO: 231719 - DNA, 25 bp, Mus musculus
tgcgggcagagtccagaagcctctt

SEQ ID NO: 231720 - DNA, 25 bp, Mus musculus
gctgcgggcagagtccagaagcctc

SEQ ID NO: 231721 - DNA, 25 bp, Mus musculus
tcgacctccagaccctgcgcccggc

SEQ ID NO: 231722 - DNA, 25 bp, Mus musculus
gggcaagctcgacctccagaccctg

SEQ ID NO: 231723 - DNA, 25 bp, Mus musculus
tccacgcgggcaagctcgacctcca

SEQ ID NO: 231724 - DNA, 25 bp, Mus musculus
cgccgctgcgcctccacgcgggcaa

SEQ ID NO: 231725 - DNA, 25 bp, Mus musculus
tcctccagggagcccaacaggcctc

SEQ ID NO: 231726 - DNA, 25 bp, Mus musculus
agcgcaggccgcctagctgggcctc

SEQ ID NO: 231727 - DNA, 25 bp, Mus musculus
cctgtttgctggtatgcgcttgaga

SEQ ID NO: 231728 - DNA, 25 bp, Mus musculus
ggctccagacgggaagactccaata

SEQ ID NO: 231729 - DNA, 25 bp, Mus musculus
tccaataaggacgtaccgctggttg

SEQ ID NO: 231730 - DNA, 25 bp, Mus musculus
caagccaagtccaaaggggatcgtc

SEQ ID NO: 231731 - DNA, 25 bp, Mus musculus
gctcgacctaagagaaaggcctccg

SEQ ID NO: 231732 - DNA, 25 bp, Mus musculus
cggaggcttaggagacgactccaac

SEQ ID NO: 231733 - DNA, 25 bp, Mus musculus
cctcctgctggagaaaagcggcaag

SEQ ID NO: 231734 - DNA, 25 bp, Mus musculus
cgccaaaggggcgtgacgtaaccat

SEQ ID NO: 231735 - DNA, 25 bp, Mus musculus
aggctctcccgcaaggggctaggaa

SEQ ID NO: 231736 - DNA, 25 bp, Mus musculus
gttcttcctgatgcccgccgttatt

SEQ ID NO: 231737 - DNA, 25 bp, Mus musculus
cgccgttattgctatggactgccca

SEQ ID NO: 231738 - DNA, 25 bp, Mus musculus
agcgggatcgtctgaaccttccgta

SEQ ID NO: 231739 - DNA, 25 bp, Mus musculus
agcgtcccagctgcagaggcttacc

SEQ ID NO: 231740 - DNA, 25 bp, Mus musculus
ctgtattcgcgccagacctgtttgc

SEQ ID NO: 231741 - DNA, 25 bp, Mus musculus
agggaacccactgcgctctcgggtc

SEQ ID NO: 231742 - DNA, 25 bp, Mus musculus
cgggcgcctcagatcagaccgtgaa

SEQ ID NO: 231743 - DNA, 25 bp, Mus musculus
caagttctgtctagagcggaagctc

SEQ ID NO: 231744 - DNA, 25 bp, Mus musculus
gatgcgactctatgaccaagttctg

SEQ ID NO: 231745 - DNA, 25 bp, Mus musculus
ttcaggaccggaagtgatgcgactc

SEQ ID NO: 231746 - DNA, 25 bp, Mus musculus
gcttgacacacagaacagactcgta

SEQ ID NO: 231747 - DNA, 25 bp, Mus musculus
agacgtggacctccggcttgacaca

SEQ ID NO: 231748 - DNA, 25 bp, Mus musculus
cggtcacctgtaaccacggttggtg

SEQ ID NO: 231749 - DNA, 25 bp, Mus musculus
cccgattaaagtagccacagggctc

SEQ ID NO: 231750 - DNA, 25 bp, Mus musculus
agcgctgtgacacgacccgtagacc

SEQ ID NO: 231751 - DNA, 25 bp, Mus musculus
gggatcccgtcacgactgtcggtta

SEQ ID NO: 231752 - DNA, 25 bp, Mus musculus
gcagggttttctgggatcccgtcac

SEQ ID NO: 231753 - DNA, 25 bp, Mus musculus
gataggaacagcgtccctgggcttc

SEQ ID NO: 231754 - DNA, 25 bp, Mus musculus
gaagattaagccaggaacggtcacc

SEQ ID NO: 231755 - DNA, 25 bp, Mus musculus
acgcagggctttcctcaatggacca

SEQ ID NO: 231756 - DNA, 25 bp, Mus musculus
agggctttcctcaatggaccacgcc

SEQ ID NO: 231757 - DNA, 25 bp, Mus musculus
aggcacgcagggctttcctcaatgg

SEQ ID NO: 231758 - DNA, 25 bp, Mus musculus
cctgcgccttgaagcgcgcctgagt

SEQ ID NO: 231759 - DNA, 25 bp, Mus musculus
agcgacctcctcatcttccatctta

SEQ ID NO: 231760 - DNA, 25 bp, Mus musculus
ccaggtccgcccagccctaccgcgg

SEQ ID NO: 231761 - DNA, 25 bp, Mus musculus
gaggcttccctcacgccaggtccgc

SEQ ID NO: 231762 - DNA, 25 bp, Mus musculus
gcctctcttccacctccggcccggc

SEQ ID NO: 231763 - DNA, 25 bp, Mus musculus
ctttaagaggccttcacggcgatcc

SEQ ID NO: 231764 - DNA, 25 bp, Mus musculus
agagagaaatggaacgcggcccctt

SEQ ID NO: 231765 - DNA, 25 bp, Mus musculus
agaggacacatggtcgcttgctccc

SEQ ID NO: 231766 - DNA, 25 bp, Mus musculus
ggtcccagaggacacatggtcgctt

SEQ ID NO: 231767 - DNA, 25 bp, Mus musculus
ggcccagagcccagtggtcccagag

SEQ ID NO: 231768 - DNA, 25 bp, Mus musculus
tccgagccaggcactccacccgagc

SEQ ID NO: 231769 - DNA, 25 bp, Mus musculus
cctttgcagccagctctcgggatgg

SEQ ID NO: 231770 - DNA, 25 bp, Mus musculus
agccgcgccgatcctgataagagtc

SEQ ID NO: 231771 - DNA, 25 bp, Mus musculus
tgtcgtctcccggtctgagcagcag

SEQ ID NO: 231772 - DNA, 25 bp, Mus musculus
cgagcacagcaagcaccggcctgag

SEQ ID NO: 231773 - DNA, 25 bp, Mus musculus
cgtcgccggagacgcgaaaccgaga

SEQ ID NO: 231774 - DNA, 25 bp, Mus musculus
gtctgggccaggtgaggcctctccc

SEQ ID NO: 231775 - DNA, 25 bp, Mus musculus
cgcttgctgccctcctgaattgggg

SEQ ID NO: 231776 - DNA, 25 bp, Mus musculus
taagagtcctagaaagctccgcgcc

SEQ ID NO: 231777 - DNA, 25 bp, Mus musculus
cctggggtcttgctgtcgtcatcct

SEQ ID NO: 231778 - DNA, 25 bp, Mus musculus
gatgggcgcagacctgtgccctctc

SEQ ID NO: 231779 - DNA, 25 bp, Mus musculus
ctgtgccctctcctcagcagggtgg

SEQ ID NO: 231780 - DNA, 25 bp, Mus musculus
ttcggggtgtcatggagcctcaccc

SEQ ID NO: 231781 - DNA, 25 bp, Mus musculus
aaccctgaagtcctcggtgaagagc

SEQ ID NO: 231782 - DNA, 25 bp, Mus musculus
gcctcttgcgcttcatgcccgggga

SEQ ID NO: 231783 - DNA, 25 bp, Mus musculus
agccgtgctccaaacgaccgtggga

SEQ ID NO: 231784 - DNA, 25 bp, Mus musculus
gaccgtgggaactgcccttgccctg

SEQ ID NO: 231785 - DNA, 25 bp, Mus musculus
ccttgccctgggctgcggaagagtt

SEQ ID NO: 231786 - DNA, 25 bp, Mus musculus
cccggagccagacggccactaagga

SEQ ID NO: 231787 - DNA, 25 bp, Mus musculus
cccatgagcgctcctggaggattac

SEQ ID NO: 231788 - DNA, 25 bp, Mus musculus
cgctcctggaggattactagcactc

SEQ ID NO: 231789 - DNA, 25 bp, Mus musculus
gccggcgactatgcccagtaccttt

SEQ ID NO: 231790 - DNA, 25 bp, Mus musculus
gccgctggtcattgcacacgatcct

SEQ ID NO: 231791 - DNA, 25 bp, Mus musculus
gggtggctcccactgggacccacga

SEQ ID NO: 231792 - DNA, 25 bp, Mus musculus
aggacacccgcgctgagggctgttt

SEQ ID NO: 231793 - DNA, 25 bp, Mus musculus
tgagggctgtttcctcagcggcatc

SEQ ID NO: 231794 - DNA, 25 bp, Mus musculus
tttcctcagcggcatcgggcaccag

SEQ ID NO: 231795 - DNA, 25 bp, Mus musculus
attactagcactcgcaggagccggc

SEQ ID NO: 231796 - DNA, 25 bp, Mus musculus
aaggcggcgcacaaggccctaaggc

SEQ ID NO: 231797 - DNA, 25 bp, Mus musculus
tgagggaatcccgaagagccgagac

SEQ ID NO: 231798 - DNA, 25 bp, Mus musculus
cccgcttcctccttaattgtacgtg

SEQ ID NO: 231799 - DNA, 25 bp, Mus musculus
aagccgactcaggatcccagcagcg

SEQ ID NO: 231800 - DNA, 25 bp, Mus musculus
tcctaggctggacacgcaagacaag

SEQ ID NO: 231801 - DNA, 25 bp, Mus musculus
tcctgacgctctttcctaggctgga

SEQ ID NO: 231802 - DNA, 25 bp, Mus musculus
gatgcaaagaggtcctgacgctctt

SEQ ID NO: 231803 - DNA, 25 bp, Mus musculus
aggtacccacctctctcttggggct

SEQ ID NO: 231804 - DNA, 25 bp, Mus musculus
tggtctggtggaacccaggtaccca

SEQ ID NO: 231805 - DNA, 25 bp, Mus musculus
gtcgatctaaacgaggtccacggtg

SEQ ID NO: 231806 - DNA, 25 bp, Mus musculus
aagggcggacagtgtgtcgcttcca

SEQ ID NO: 231807 - DNA, 25 bp, Mus musculus
attgtacgtgcgaagatgctgcgag

SEQ ID NO: 231808 - DNA, 25 bp, Mus musculus
gcagcgccactgagaggcgccagtc

SEQ ID NO: 231809 - DNA, 25 bp, Mus musculus
gtcgcttccaggacccgtcgatcta

SEQ ID NO: 231810 - DNA, 25 bp, Mus musculus
ctggacacgcaagacaagccgactc

SEQ ID NO: 231811 - DNA, 25 bp, Mus musculus
ctggcggagatatgcagagcgcgcc

SEQ ID NO: 231812 - DNA, 25 bp, Mus musculus
cccagcgtttgggactgatcgggct

SEQ ID NO: 231813 - DNA, 25 bp, Mus musculus
ggctgctaaagacctgtgacatccc

SEQ ID NO: 231814 - DNA, 25 bp, Mus musculus
gcggctgctaaagacctgtgacatc

SEQ ID NO: 231815 - DNA, 25 bp, Mus musculus
ctcaaaggcgacacctgcggggtcg

SEQ ID NO: 231816 - DNA, 25 bp, Mus musculus
tggcgaccctcaaaggcgacacctg

SEQ ID NO: 231817 - DNA, 25 bp, Mus musculus
ataaacctcacgtggcgaccctcaa

SEQ ID NO: 231818 - DNA, 25 bp, Mus musculus
ggcgcagacgcgaccgcgccataaa

SEQ ID NO: 231819 - DNA, 25 bp, Mus musculus
ttttacgaggcgcagacgcgaccgc

SEQ ID NO: 231820 - DNA, 25 bp, Mus musculus
tctgctggcgcgaccccttttacga

SEQ ID NO: 231821 - DNA, 25 bp, Mus musculus
tgcgccctgtttccaaggcgacggg

SEQ ID NO: 231822 - DNA, 25 bp, Mus musculus
gggatgcgccctgtttccaaggcga

SEQ ID NO: 231823 - DNA, 25 bp, Mus musculus
acccgcctggccctccgcggggatg

SEQ ID NO: 231824 - DNA, 25 bp, Mus musculus
ggactgatcgggctctgcgctccac

SEQ ID NO: 231825 - DNA, 25 bp, Mus musculus
ggcgatcagcctcttagtaacccga

SEQ ID NO: 231826 - DNA, 25 bp, Mus musculus
tcctctctgggacgcacctttggaa

SEQ ID NO: 231827 - DNA, 25 bp, Mus musculus
cagtcggtttctgcctggcgctgct

SEQ ID NO: 231828 - DNA, 25 bp, Mus musculus
cgcacctttggaaactgacttatgg

SEQ ID NO: 231829 - DNA, 25 bp, Mus musculus
ctcagtagggttttcccggcgatca

SEQ ID NO: 231830 - DNA, 25 bp, Mus musculus
ccctcagaggaaaggacgctcagta

SEQ ID NO: 231831 - DNA, 25 bp, Mus musculus
ggcgctctcggtccctcagaggaaa

SEQ ID NO: 231832 - DNA, 25 bp, Mus musculus
ttctctggaactaagggatctcggc

SEQ ID NO: 231833 - DNA, 25 bp, Mus musculus
ccctgagatcctaggttctctggaa

SEQ ID NO: 231834 - DNA, 25 bp, Mus musculus
tcttggggatccataccctgagatc

SEQ ID NO: 231835 - DNA, 25 bp, Mus musculus
tccggaacgatcttggggatccata

SEQ ID NO: 231836 - DNA, 25 bp, Mus musculus
gtctcagtgcgcaaggttaggcaga

SEQ ID NO: 231837 - DNA, 25 bp, Mus musculus
gacttatggctgctgggtctcagtg

SEQ ID NO: 231838 - DNA, 25 bp, Mus musculus
ccacgcggtttcagccctgtggcgg

SEQ ID NO: 231839 - DNA, 25 bp, Mus musculus
gttcgcacatgcgtgtcaagtttta

SEQ ID NO: 231840 - DNA, 25 bp, Mus musculus
ttctgcgtctgggttttcaagcgac

SEQ ID NO: 231841 - DNA, 25 bp, Mus musculus
tcagtctccggcaaacactcgtttt

SEQ ID NO: 231842 - DNA, 25 bp, Mus musculus
tgcggataacttcatgatgtgattc

SEQ ID NO: 231843 - DNA, 25 bp, Mus musculus
aagcgtgccctgattactgcggata

SEQ ID NO: 231844 - DNA, 25 bp, Mus musculus
tctaatttctgggagcaagcgtgcc

SEQ ID NO: 231845 - DNA, 25 bp, Mus musculus
ggaaccctcccttaattcgatgaga

SEQ ID NO: 231846 - DNA, 25 bp, Mus musculus
gccagaaaatctcccatcgagcggg

SEQ ID NO: 231847 - DNA, 25 bp, Mus musculus
tttgccctgacacggccagaaaatc

SEQ ID NO: 231848 - DNA, 25 bp, Mus musculus
aacaggcttcttctccattaccgaa

SEQ ID NO: 231849 - DNA, 25 bp, Mus musculus
acgctgttaggccttaattccaaca

SEQ ID NO: 231850 - DNA, 25 bp, Mus musculus
cccggtggcctcaatcttgcagaga

SEQ ID NO: 231851 - DNA, 25 bp, Mus musculus
ggtcttggctgagaatctacgattc

SEQ ID NO: 231852 - DNA, 25 bp, Mus musculus
tccgatccttaaatgaggtcttggc

SEQ ID NO: 231853 - DNA, 25 bp, Mus musculus
gaggccgagcgcatctttattgagc

SEQ ID NO: 231854 - DNA, 25 bp, Mus musculus
ggcctctcatgcactgcacggtgga

SEQ ID NO: 231855 - DNA, 25 bp, Mus musculus
ttgctgtcgctgtctccgatacaca

SEQ ID NO: 231856 - DNA, 25 bp, Mus musculus
tccgttcgcgtctactacaagaagt

SEQ ID NO: 231857 - DNA, 25 bp, Mus musculus
cgagatcacggtcagcagtgacttc

SEQ ID NO: 231858 - DNA, 25 bp, Mus musculus
cagaagcgccagttcaccaagattg

SEQ ID NO: 231859 - DNA, 25 bp, Mus musculus
gatgtggactatggcaccaacttcc

SEQ ID NO: 231860 - DNA, 25 bp, Mus musculus
tggcgccagctcatgcaaagagacc

SEQ ID NO: 231861 - DNA, 25 bp, Mus musculus
ctacgagaaggtcgaggatgcctgc

SEQ ID NO: 231862 - DNA, 25 bp, Mus musculus
ttattgagctcaagttcacggtgcg

SEQ ID NO: 231863 - DNA, 25 bp, Mus musculus
tggtatccggcgaccaggacaactg

SEQ ID NO: 231864 - DNA, 25 bp, Mus musculus
tacaagaagtgtcccgagatgctgc

SEQ ID NO: 231865 - DNA, 25 bp, Mus musculus
cacggtgcgagactgtaacagcttc

SEQ ID NO: 231866 - DNA, 25 bp, Mus musculus
ggctcgcaatgtcaagctgaacgta

SEQ ID NO: 231867 - DNA, 25 bp, Mus musculus
ccacggagacatgagcgcgcggccg

SEQ ID NO: 231868 - DNA, 25 bp, Mus musculus
cccgtgatgggatcctgtgtgtcgc

SEQ ID NO: 231869 - DNA, 25 bp, Mus musculus
cctgtgtgtcgcgaggtgaggacag

SEQ ID NO: 231870 - DNA, 25 bp, Mus musculus
ggcccgggacgcagcgagaagcggg

SEQ ID NO: 231871 - DNA, 25 bp, Mus musculus
agccagggtgggtgtccgcccttca

SEQ ID NO: 231872 - DNA, 25 bp, Mus musculus
tgggtgtccgcccttcatggatcag

SEQ ID NO: 231873 - DNA, 25 bp, Mus musculus
gtgtccgcccttcatggatcagccg

SEQ ID NO: 231874 - DNA, 25 bp, Mus musculus
cgcccttcatggatcagccgcgccc

SEQ ID NO: 231875 - DNA, 25 bp, Mus musculus
cccacggggacagagctcgggaggg

SEQ ID NO: 231876 - DNA, 25 bp, Mus musculus
cagaggggacggaggtctccgcacc

SEQ ID NO: 231877 - DNA, 25 bp, Mus musculus
atccggacgcggcagcggggactag

SEQ ID NO: 231878 - DNA, 25 bp, Mus musculus
cagcggggactaggagcgagaggag

SEQ ID NO: 231879 - DNA, 25 bp, Mus musculus
cccggcccacggagacatgagcgcg

SEQ ID NO: 231880 - DNA, 25 bp, Mus musculus
ggtgtccgcccttcatggatcagcc

SEQ ID NO: 231881 - DNA, 25 bp, Mus musculus
ctgagcgaacctgcggtaaacgcgt

SEQ ID NO: 231882 - DNA, 25 bp, Mus musculus
agtggcccacctcatcgagtggaaa

SEQ ID NO: 231883 - DNA, 25 bp, Mus musculus
ccagcagtcaggctgggagctgtcc

SEQ ID NO: 231884 - DNA, 25 bp, Mus musculus
cccgcagaggacgaacattactgct

SEQ ID NO: 231885 - DNA, 25 bp, Mus musculus
acgaacattactgctgcctcccgga

SEQ ID NO: 231886 - DNA, 25 bp, Mus musculus
aacattactgctgcctcccggacga

SEQ ID NO: 231887 - DNA, 25 bp, Mus musculus
ttactgctgcctcccggacgagctg

SEQ ID NO: 231888 - DNA, 25 bp, Mus musculus
ccacgggctgggtgttcagcctgaa

SEQ ID NO: 231889 - DNA, 25 bp, Mus musculus
gggtctgagcgaacctgcggtaaac

SEQ ID NO: 231890 - DNA, 25 bp, Mus musculus
ggccgagtggcccacctcatcgagt

SEQ ID NO: 231891 - DNA, 25 bp, Mus musculus
tgcggtaaacgcgtaaacgcgcagg

SEQ ID NO: 231892 - DNA, 25 bp, Mus musculus
taaacgcgtaaacgcgcaggatggt

SEQ ID NO: 231893 - DNA, 25 bp, Mus musculus
cctgaagcggggtctgagcgaacct

SEQ ID NO: 231894 - DNA, 25 bp, Mus musculus
cccacctcatcgagtggaaaggctg

SEQ ID NO: 231895 - DNA, 25 bp, Mus musculus
gcgagaagaccacgtcagccggaga

SEQ ID NO: 231896 - DNA, 25 bp, Mus musculus
gattccgctgggctatttgcagccc

SEQ ID NO: 231897 - DNA, 25 bp, Mus musculus
aagaccacgtcagccggagagccag

SEQ ID NO: 231898 - DNA, 25 bp, Mus musculus
gggcgcagtatttccagcctcgtga

SEQ ID NO: 231899 - DNA, 25 bp, Mus musculus
tcgtgagtcacggattccgctgggc

SEQ ID NO: 231900 - DNA, 25 bp, Mus musculus
cacggattccgctgggctatttgca

SEQ ID NO: 231901 - DNA, 25 bp, Mus musculus
ttccagcctcgtgagtcacggattc

SEQ ID NO: 231902 - DNA, 25 bp, Mus musculus
ccaacactcatcagcgcggggctgg

SEQ ID NO: 231903 - DNA, 25 bp, Mus musculus
ggggctgacaaccttctccactcga

SEQ ID NO: 231904 - DNA, 25 bp, Mus musculus
ccacccgaggtcaggttcaccttgg

SEQ ID NO: 231905 - DNA, 25 bp, Mus musculus
tcaggttcaccttggcgagaagacc

SEQ ID NO: 231906 - DNA, 25 bp, Mus musculus
ttcaccttggcgagaagaccacgtc

SEQ ID NO: 231907 - DNA, 25 bp, Mus musculus
ccttggcgagaagaccacgtcagcc

SEQ ID NO: 231908 - DNA, 25 bp, Mus musculus
gcagtatttccagcctcgtgagtca

SEQ ID NO: 231909 - DNA, 25 bp, Mus musculus
catggcggcgccctttgtctgctgt

SEQ ID NO: 231910 - DNA, 25 bp, Mus musculus
agcgctgcgccagcgacggaagtcc

SEQ ID NO: 231911 - DNA, 25 bp, Mus musculus
gacggaagtcccagccgggaagcca

SEQ ID NO: 231912 - DNA, 25 bp, Mus musculus
gaagccagcgaggtcggttccgccc

SEQ ID NO: 231913 - DNA, 25 bp, Mus musculus
ttccgcccggttctaacatggcggc

SEQ ID NO: 231914 - DNA, 25 bp, Mus musculus
cggtcgcgcacctcggacgagcgct

SEQ ID NO: 231915 - DNA, 25 bp, Mus musculus
ctttgtctgctgtgaagcgctgccc

SEQ ID NO: 231916 - DNA, 25 bp, Mus musculus
gcggccgtgatgcacctccatctgt

SEQ ID NO: 231917 - DNA, 25 bp, Mus musculus
tgatgcacctccatctgtggtgggg

SEQ ID NO: 231918 - DNA, 25 bp, Mus musculus
gtgacaccgcggctggtggcatctc

SEQ ID NO: 231919 - DNA, 25 bp, Mus musculus
agccgcactgacctcccgtcacaga

SEQ ID NO: 231920 - DNA, 25 bp, Mus musculus
ccatccctccatcccgtttccctcg

SEQ ID NO: 231921 - DNA, 25 bp, Mus musculus
ccctgacagatctgaggacagagca

SEQ ID NO: 231922 - DNA, 25 bp, Mus musculus
ccgtcacagaccgttcattcattca

SEQ ID NO: 231923 - DNA, 25 bp, Mus musculus
acctacggggatcgcactgagtcca

SEQ ID NO: 231924 - DNA, 25 bp, Mus musculus
cacagggaacttcaaacggcacatc

SEQ ID NO: 231925 - DNA, 25 bp, Mus musculus
gggatcgcactgagtccaaggctta

SEQ ID NO: 231926 - DNA, 25 bp, Mus musculus
tcgcactgagtccaaggcttacggc

SEQ ID NO: 231927 - DNA, 25 bp, Mus musculus
tgagtccaaggcttacggctccatc

SEQ ID NO: 231928 - DNA, 25 bp, Mus musculus
gtccaaggcttacggctccatcatc

SEQ ID NO: 231929 - DNA, 25 bp, Mus musculus
aaggcttacggctccatcatccaca

SEQ ID NO: 231930 - DNA, 25 bp, Mus musculus
tacggctccatcatccacaagtgcg

SEQ ID NO: 231931 - DNA, 25 bp, Mus musculus
ctccatcatccacaagtgcgaggtg

SEQ ID NO: 231932 - DNA, 25 bp, Mus musculus
atcatccacaagtgcgaggtgcggg

SEQ ID NO: 231933 - DNA, 25 bp, Mus musculus
ggagttcacgcacacagggaacttc

SEQ ID NO: 231934 - DNA, 25 bp, Mus musculus
cacgcacacagggaacttcaaacgg

SEQ ID NO: 231935 - DNA, 25 bp, Mus musculus
gggaacttcaaacggcacatccgca

SEQ ID NO: 231936 - DNA, 25 bp, Mus musculus
ctcgggcacctacggggatcgcact

SEQ ID NO: 231937 - DNA, 25 bp, Mus musculus
ctgcggaccggaaccctacagcgag

SEQ ID NO: 231938 - DNA, 25 bp, Mus musculus
ggacttacaggtgcgcaggcatgga

SEQ ID NO: 231939 - DNA, 25 bp, Mus musculus
ccaagtgcgcgggacttacaggtgc

SEQ ID NO: 231940 - DNA, 25 bp, Mus musculus
caggagcgtgggtcctccaggccac

SEQ ID NO: 231941 - DNA, 25 bp, Mus musculus
caggcgccgcaagcgggtgaaagat

SEQ ID NO: 231942 - DNA, 25 bp, Mus musculus
cccttccacagtcgctaagcaacca

SEQ ID NO: 231943 - DNA, 25 bp, Mus musculus
gtgggagtcacggagtggctccgcc

SEQ ID NO: 231944 - DNA, 25 bp, Mus musculus
cctctccaaggcagtgggagtcacg

SEQ ID NO: 231945 - DNA, 25 bp, Mus musculus
ccctctccaaggcagtgggagtcac

SEQ ID NO: 231946 - DNA, 25 bp, Mus musculus
gaacaccacgaacccggcacggctc

SEQ ID NO: 231947 - DNA, 25 bp, Mus musculus
cctacagcgagtgcgcaccggctgg

SEQ ID NO: 231948 - DNA, 25 bp, Mus musculus
gaaccctacagcgagtgcgcaccgg

SEQ ID NO: 231949 - DNA, 25 bp, Mus musculus
accggaaccctacagcgagtgcgca

SEQ ID NO: 231950 - DNA, 25 bp, Mus musculus
cggaccggaaccctacagcgagtgc

SEQ ID NO: 231951 - DNA, 25 bp, Mus musculus
gcgcctggcgagcaatccttggccg

SEQ ID NO: 231952 - DNA, 25 bp, Mus musculus
tggacacccgaattctctctagggg

SEQ ID NO: 231953 - DNA, 25 bp, Mus musculus
ccagtgcgctctggacacccgaatt

SEQ ID NO: 231954 - DNA, 25 bp, Mus musculus
tgtgtgacaagcgtcaggtgactcg

SEQ ID NO: 231955 - DNA, 25 bp, Mus musculus
gaatgcatctcgtgtcgcacccggg

SEQ ID NO: 231956 - DNA, 25 bp, Mus musculus
ccagacaccctgaatgcatctcgtg

SEQ ID NO: 231957 - DNA, 25 bp, Mus musculus
cgctgcaggtggtatccgcgtctcc

SEQ ID NO: 231958 - DNA, 25 bp, Mus musculus
cagggtcggatgtcgagctaaaaga

SEQ ID NO: 231959 - DNA, 25 bp, Mus musculus
atgggcccgagtcctcggacgccga

SEQ ID NO: 231960 - DNA, 25 bp, Mus musculus
tgatgagccaagtgctgggcaagcc

SEQ ID NO: 231961 - DNA, 25 bp, Mus musculus
cccacgcgggaccttggaggcaagc

SEQ ID NO: 231962 - DNA, 25 bp, Mus musculus
gtgactcgggtcacgcagtcactcc

SEQ ID NO: 231963 - DNA, 25 bp, Mus musculus
cccgggccacgcttgcagagaaagc

SEQ ID NO: 231964 - DNA, 25 bp, Mus musculus
ctaaaagaagcagctggcggcagcg

SEQ ID NO: 231965 - DNA, 25 bp, Mus musculus
cccttctgatgtattcacccgcagc

SEQ ID NO: 231966 - DNA, 25 bp, Mus musculus
ctgctgtgcctgttgtggccgtcac

SEQ ID NO: 231967 - DNA, 25 bp, Mus musculus
acccgtcacggctgctgtgcctgtt

SEQ ID NO: 231968 - DNA, 25 bp, Mus musculus
tggggcagtcactgcacccgtcacg

SEQ ID NO: 231969 - DNA, 25 bp, Mus musculus
ctgcttgcccttggctgctggggca

SEQ ID NO: 231970 - DNA, 25 bp, Mus musculus
ctgttctcattgctactggcccgct

SEQ ID NO: 231971 - DNA, 25 bp, Mus musculus
tggaagcggctgttctcattgctac

SEQ ID NO: 231972 - DNA, 25 bp, Mus musculus
tcactgacatggacccagggtggaa

SEQ ID NO: 231973 - DNA, 25 bp, Mus musculus
tggccgtcacgccacaggcagcagt

SEQ ID NO: 231974 - DNA, 25 bp, Mus musculus
tctgctggtcggtcatcaatcactg

SEQ ID NO: 231975 - DNA, 25 bp, Mus musculus
gccttccgtcttctgtcccgagtag

SEQ ID NO: 231976 - DNA, 25 bp, Mus musculus
gcgccagagcccgtgtctgctggtc

SEQ ID NO: 231977 - DNA, 25 bp, Mus musculus
ggtcggtcatcaatcactgacatgg

SEQ ID NO: 231978 - DNA, 25 bp, Mus musculus
tgtcccgagtagctcagcagcacga

SEQ ID NO: 231979 - DNA, 25 bp, Mus musculus
aacttctcagccttggcgatctcca

SEQ ID NO: 231980 - DNA, 25 bp, Mus musculus
ggctctgctccatctgtttccggta

SEQ ID NO: 231981 - DNA, 25 bp, Mus musculus
ctggttctttctgagtcctcgctga

SEQ ID NO: 231982 - DNA, 25 bp, Mus musculus
tttcttcggactgccaaacttctca

SEQ ID NO: 231983 - DNA, 25 bp, Mus musculus
gtagtcatctacatctttcttcgga

SEQ ID NO: 231984 - DNA, 25 bp, Mus musculus
aggctgcgcctttcgtagtcatcta

SEQ ID NO: 231985 - DNA, 25 bp, Mus musculus
ttgcccacctcgtggacaaggctgc

SEQ ID NO: 231986 - DNA, 25 bp, Mus musculus
gagtcatcagtgacatcctgagggg

SEQ ID NO: 231987 - DNA, 25 bp, Mus musculus
tgatccgtccttcgcttcttgctgg

SEQ ID NO: 231988 - DNA, 25 bp, Mus musculus
gatatcgaaatccacgtgatccgtc

SEQ ID NO: 231989 - DNA, 25 bp, Mus musculus
ctctctcttttggtacagatatcga

SEQ ID NO: 231990 - DNA, 25 bp, Mus musculus
cgtgaacttcggtagtttctctctc

SEQ ID NO: 231991 - DNA, 25 bp, Mus musculus
tcctcgctgatctggcgtgaacttc

SEQ ID NO: 231992 - DNA, 25 bp, Mus musculus
cactcggagagcagctggttctttc

SEQ ID NO: 231993 - DNA, 25 bp, Mus musculus
gccgagtcggcacgccctcaacacc

SEQ ID NO: 231994 - DNA, 25 bp, Mus musculus
tcaacaccgaacctagagcctggtc

SEQ ID NO: 231995 - DNA, 25 bp, Mus musculus
ttgctctagtttgtagagctgggtg

SEQ ID NO: 231996 - DNA, 25 bp, Mus musculus
accggatggagaagttgctctagtt

SEQ ID NO: 231997 - DNA, 25 bp, Mus musculus
gagaccggatggagaagttgctcta

SEQ ID NO: 231998 - DNA, 25 bp, Mus musculus
cacacccaagcatggatcacgcggg

SEQ ID NO: 231999 - DNA, 25 bp, Mus musculus
acccaagcatggatcacgcgggacc

SEQ ID NO: 232000 - DNA, 25 bp, Mus musculus
caaggtgaggcccaggaaaaagccg

SEQ ID NO: 232001 - DNA, 25 bp, Mus musculus
cgtgccaaggtgaggcccaggaaaa

SEQ ID NO: 232002 - DNA, 25 bp, Mus musculus
tacgtgccaaggtgaggcccaggaa

SEQ ID NO: 232003 - DNA, 25 bp, Mus musculus
agcgctacgtgccaaggtgaggccc

SEQ ID NO: 232004 - DNA, 25 bp, Mus musculus
cccagagcgctacgtgccaaggtga

SEQ ID NO: 232005 - DNA, 25 bp, Mus musculus
aagcatggatcacgcgggacccgga

SEQ ID NO: 232006 - DNA, 25 bp, Mus musculus
ccaagcatggatcacgcgggacccg

SEQ ID NO: 232007 - DNA, 25 bp, Mus musculus
ccctgtctctgctgagtttggtgga

SEQ ID NO: 232008 - DNA, 25 bp, Mus musculus
gtggtcccggtcagattcgaatctc

SEQ ID NO: 232009 - DNA, 25 bp, Mus musculus
actctggcttcgctctatgggtctc

SEQ ID NO: 232010 - DNA, 25 bp, Mus musculus
ttggcaatctctccgaatgcgcagg

SEQ ID NO: 232011 - DNA, 25 bp, Mus musculus
gccgagccttctccagcttatcgta

SEQ ID NO: 232012 - DNA, 25 bp, Mus musculus
gttttttgtgtagcgctccagccga

SEQ ID NO: 232013 - DNA, 25 bp, Mus musculus
gctcgggatcgaaagtgcgctcttt

SEQ ID NO: 232014 - DNA, 25 bp, Mus musculus
ggagtgagcctttcctttccgcttc

SEQ ID NO: 232015 - DNA, 25 bp, Mus musculus
ctcggtcattttcctgctcggtttc

SEQ ID NO: 232016 - DNA, 25 bp, Mus musculus
tcgggtcagaaccacgcaaggcacg

SEQ ID NO: 232017 - DNA, 25 bp, Mus musculus
tgctcgatgaccttgccctcctttt

SEQ ID NO: 232018 - DNA, 25 bp, Mus musculus
ggaggaccttctccctcagcgcttt

SEQ ID NO: 232019 - DNA, 25 bp, Mus musculus
gtttccggagcttagtcctgccctc

SEQ ID NO: 232020 - DNA, 25 bp, Mus musculus
ctcggtttccgaaggctgagaacta

SEQ ID NO: 232021 - DNA, 25 bp, Mus musculus
gaggcctctaccagttacccggaca

SEQ ID NO: 232022 - DNA, 25 bp, Mus musculus
tttccacaggcgatcgcagatttgc

SEQ ID NO: 232023 - DNA, 25 bp, Mus musculus
cccggtcagagcaacggccaacaga

SEQ ID NO: 232024 - DNA, 25 bp, Mus musculus
ttcccaggcctcaccaaagaggttc

SEQ ID NO: 232025 - DNA, 25 bp, Mus musculus
ctagaccgggcgacacaacccattt

SEQ ID NO: 232026 - DNA, 25 bp, Mus musculus
gtgaggacgttccttctcctaatta

SEQ ID NO: 232027 - DNA, 25 bp, Mus musculus
gcgctaaatgctaccaacgggtatg

SEQ ID NO: 232028 - DNA, 25 bp, Mus musculus
ggaattcagagtacgcccaacttgg

SEQ ID NO: 232029 - DNA, 25 bp, Mus musculus
acgaatctccggagagcggccactg

SEQ ID NO: 232030 - DNA, 25 bp, Mus musculus
gctacgttctttctcaatgtgcgga

SEQ ID NO: 232031 - DNA, 25 bp, Mus musculus
cgtttctgggagcaaataagcgcta

SEQ ID NO: 232032 - DNA, 25 bp, Mus musculus
gcactttttggctacttcactaacg

SEQ ID NO: 232033 - DNA, 25 bp, Mus musculus
agccgcgcagagagctgaagcatcc

SEQ ID NO: 232034 - DNA, 25 bp, Mus musculus
tgcaccgactggatagtgggaattc

SEQ ID NO: 232035 - DNA, 25 bp, Mus musculus
agtttctggaaagagggctacaaag

SEQ ID NO: 232036 - DNA, 25 bp, Mus musculus
tctgagagaagacagcgaaaagtcc

SEQ ID NO: 232037 - DNA, 25 bp, Mus musculus
ctcccatccaaggaggaagcgtggg

SEQ ID NO: 232038 - DNA, 25 bp, Mus musculus
gtgtgcgctctgacctgcccgtcta

SEQ ID NO: 232039 - DNA, 25 bp, Mus musculus
gttcacggggatgtgacgcgcacac

SEQ ID NO: 232040 - DNA, 25 bp, Mus musculus
gcacacgcgcgcgagctcatggaca

SEQ ID NO: 232041 - DNA, 25 bp, Mus musculus
ctcatggacagcgtgggaaggaacc

SEQ ID NO: 232042 - DNA, 25 bp, Mus musculus
tgccattttgtagcgcggccgccat

SEQ ID NO: 232043 - DNA, 25 bp, Mus musculus
aagcgagccattttctgagagaaga

SEQ ID NO: 232044 - DNA, 25 bp, Mus musculus
cttctcatcacacaggcaacgcgga

SEQ ID NO: 232045 - DNA, 25 bp, Mus musculus
ccaaggaacgcgaggtcgcccgagt

SEQ ID NO: 232046 - DNA, 25 bp, Mus musculus
gggaggcaacctttccattgtgaga

SEQ ID NO: 232047 - DNA, 25 bp, Mus musculus
ggccgagctaccctgagaagtttct

SEQ ID NO: 232048 - DNA, 25 bp, Mus musculus
ctttccattgtgagagagcaccgcc

SEQ ID NO: 232049 - DNA, 25 bp, Mus musculus
tcttcaccgacagcgagatgttctc

SEQ ID NO: 232050 - DNA, 25 bp, Mus musculus
cctcacagagccagaatcgcataga

SEQ ID NO: 232051 - DNA, 25 bp, Mus musculus
agcccggatcgcatagacccaggac

SEQ ID NO: 232052 - DNA, 25 bp, Mus musculus
ggggactcacacagcccggatcgca

SEQ ID NO: 232053 - DNA, 25 bp, Mus musculus
aatcgcatagatccggcaccgcaga

SEQ ID NO: 232054 - DNA, 25 bp, Mus musculus
gacctgcagacctaggggactcaca

SEQ ID NO: 232055 - DNA, 25 bp, Mus musculus
ctgggagctcagagatccggagccc

SEQ ID NO: 232056 - DNA, 25 bp, Mus musculus
atgttctccaggattcggtccttca

SEQ ID NO: 232057 - DNA, 25 bp, Mus musculus
agccttcccgaggtgtcacgggcca

SEQ ID NO: 232058 - DNA, 25 bp, Mus musculus
tcacgggccagtcgcgggaagacaa

SEQ ID NO: 232059 - DNA, 25 bp, Mus musculus
tccgaggacgctgacctcaactttg

SEQ ID NO: 232060 - DNA, 25 bp, Mus musculus
tctttaaaaatagctcggaggccgc

SEQ ID NO: 232061 - DNA, 25 bp, Mus musculus
cgggagtcgcctgcttctccagcag

SEQ ID NO: 232062 - DNA, 25 bp, Mus musculus
gcagagcctcgggacctcaaacacg

SEQ ID NO: 232063 - DNA, 25 bp, Mus musculus
ttggagcggtccaaataagcgaacc

SEQ ID NO: 232064 - DNA, 25 bp, Mus musculus
cgtaaagcgcgccaggctgccggca

SEQ ID NO: 232065 - DNA, 25 bp, Mus musculus
ttcctccctcacacgcgcgcaatga

SEQ ID NO: 232066 - DNA, 25 bp, Mus musculus
acagtacacggtgagcagcatggcc

SEQ ID NO: 232067 - DNA, 25 bp, Mus musculus
ggagaggtccctccgcacacagtac

SEQ ID NO: 232068 - DNA, 25 bp, Mus musculus
tgcagctcgaagtcggcgtcgacct

SEQ ID NO: 232069 - DNA, 25 bp, Mus musculus
cacagcgcgcggaagttgtgcagct

SEQ ID NO: 232070 - DNA, 25 bp, Mus musculus
actcgagctcgcacagcgcgcggaa

SEQ ID NO: 232071 - DNA, 25 bp, Mus musculus
gatgccggactcgagctcgcacagc

SEQ ID NO: 232072 - DNA, 25 bp, Mus musculus
cctctagctgcagtgggtgcatcca

SEQ ID NO: 232073 - DNA, 25 bp, Mus musculus
aagtcaggagatcccggatgaggac

SEQ ID NO: 232074 - DNA, 25 bp, Mus musculus
tctggtcggaaagtcaggagatccc

SEQ ID NO: 232075 - DNA, 25 bp, Mus musculus
caaactggtatttctggtcggaaag

SEQ ID NO: 232076 - DNA, 25 bp, Mus musculus
aggcgtcgttctcccagtgatccaa

SEQ ID NO: 232077 - DNA, 25 bp, Mus musculus
cagcgtccgtgctccagtgaatccg

SEQ ID NO: 232078 - DNA, 25 bp, Mus musculus
ggggcagtcacgtgtcacttaaaga

SEQ ID NO: 232079 - DNA, 25 bp, Mus musculus
gccgcacacgcgatgaacctatttt

SEQ ID NO: 232080 - DNA, 25 bp, Mus musculus
cctattttggccttgacggtcaccg

SEQ ID NO: 232081 - DNA, 25 bp, Mus musculus
acggtcaccgtaggcacctggatct

SEQ ID NO: 232082 - DNA, 25 bp, Mus musculus
ctggatctggcgcagttgctatagg

SEQ ID NO: 232083 - DNA, 25 bp, Mus musculus
ttgctataggaacggagagcgctct

SEQ ID NO: 232084 - DNA, 25 bp, Mus musculus
ctggctgggtctgaaagcttgctct

SEQ ID NO: 232085 - DNA, 25 bp, Mus musculus
tcttgactagcgaggccagaacgtg

SEQ ID NO: 232086 - DNA, 25 bp, Mus musculus
agaacgtgccttctagcgaggcgga

SEQ ID NO: 232087 - DNA, 25 bp, Mus musculus
gcggagtcgctatgcatcacgggat

SEQ ID NO: 232088 - DNA, 25 bp, Mus musculus
catcacgggataccaggaagacctc

SEQ ID NO: 232089 - DNA, 25 bp, Mus musculus
ctggccaacaggtagccctcggcgt

SEQ ID NO: 232090 - DNA, 25 bp, Mus musculus
cacagaccggtttaggccgcacacg

SEQ ID NO: 232091 - DNA, 25 bp, Mus musculus
gcgttatcatgtgaggcaggtctta

SEQ ID NO: 232092 - DNA, 25 bp, Mus musculus
cgcgcgacatgatcgaggatattca

SEQ ID NO: 232093 - DNA, 25 bp, Mus musculus
tcgagagctcttcacgcgcgacatg

SEQ ID NO: 232094 - DNA, 25 bp, Mus musculus
cgctctgctgagtcgagagctcttc

SEQ ID NO: 232095 - DNA, 25 bp, Mus musculus
tcgcggagctctgggacgctctgct

SEQ ID NO: 232096 - DNA, 25 bp, Mus musculus
agcgagctgcaagtcgcggagctct

SEQ ID NO: 232097 - DNA, 25 bp, Mus musculus
tgcgcctagtgagcgagctgcaagt

SEQ ID NO: 232098 - DNA, 25 bp, Mus musculus
accggcagctcctgcggcgatgcag

SEQ ID NO: 232099 - DNA, 25 bp, Mus musculus
ccgcaatcggctcgccatggacgag

SEQ ID NO: 232100 - DNA, 25 bp, Mus musculus
gggtcccgcaatcggctcgccatgg

SEQ ID NO: 232101 - DNA, 25 bp, Mus musculus
cccagtgagcgcgagtcacaggccg

SEQ ID NO: 232102 - DNA, 25 bp, Mus musculus
tcttagtccgtacggcgaagtgatg

SEQ ID NO: 232103 - DNA, 25 bp, Mus musculus
tgatcgaggatattcaggtgcgccc

SEQ ID NO: 232104 - DNA, 25 bp, Mus musculus
catgtgaggcaggtcttagtccgta

SEQ ID NO: 232105 - DNA, 25 bp, Mus musculus
gcgccgccctgaaggtgggacttag

SEQ ID NO: 232106 - DNA, 25 bp, Mus musculus
caactcgtccgtggccatggtggcc

SEQ ID NO: 232107 - DNA, 25 bp, Mus musculus
tcgccctccatctgcagcctccggc

SEQ ID NO: 232108 - DNA, 25 bp, Mus musculus
cgccttcgccctccatctgcagcct

SEQ ID NO: 232109 - DNA, 25 bp, Mus musculus
cagtctcgtcgggagcctcggccgc

SEQ ID NO: 232110 - DNA, 25 bp, Mus musculus
caacgcctgggcagtctcgtcggga

SEQ ID NO: 232111 - DNA, 25 bp, Mus musculus
gtcgtccgcgctgcccaacgcctgg

SEQ ID NO: 232112 - DNA, 25 bp, Mus musculus
tggcgctcagctcgtcgtccgcgct

SEQ ID NO: 232113 - DNA, 25 bp, Mus musculus
atgccctggttgaggtccgcgcgcc

SEQ ID NO: 232114 - DNA, 25 bp, Mus musculus
ccgatgccctggttgaggtccgcgc

SEQ ID NO: 232115 - DNA, 25 bp, Mus musculus
ctcgccgatgccctggttgaggtcc

SEQ ID NO: 232116 - DNA, 25 bp, Mus musculus
tgtggctcgccgatgccctggttga

SEQ ID NO: 232117 - DNA, 25 bp, Mus musculus
ggcgactgtggctcgccgatgccct

SEQ ID NO: 232118 - DNA, 25 bp, Mus musculus
tggccaactcgtccgtggccatggt

SEQ ID NO: 232119 - DNA, 25 bp, Mus musculus
acaacctgaagagcccgggtgagcc

SEQ ID NO: 232120 - DNA, 25 bp, Mus musculus
tggagacccgctacaacctgaagag

SEQ ID NO: 232121 - DNA, 25 bp, Mus musculus
gcgaagcaggagacagccgagccaa

SEQ ID NO: 232122 - DNA, 25 bp, Mus musculus
ttcctcccggtgtctgcggagcgaa

SEQ ID NO: 232123 - DNA, 25 bp, Mus musculus
ttcagaccgacctgtcccatttatg

SEQ ID NO: 232124 - DNA, 25 bp, Mus musculus
tccgggctcgcgctttacgcgaggc

SEQ ID NO: 232125 - DNA, 25 bp, Mus musculus
tgccgagtgaccgaccgccacgaag

SEQ ID NO: 232126 - DNA, 25 bp, Mus musculus
gagctccctgcgagctccgcgggaa

SEQ ID NO: 232127 - DNA, 25 bp, Mus musculus
tcggagaagcgcacatcacggcgcc

SEQ ID NO: 232128 - DNA, 25 bp, Mus musculus
ggagctaggggccactcccgtccat

SEQ ID NO: 232129 - DNA, 25 bp, Mus musculus
tgccttagctaaccgcaccgcggag

SEQ ID NO: 232130 - DNA, 25 bp, Mus musculus
atttctgggaggttctgatgcaccc

SEQ ID NO: 232131 - DNA, 25 bp, Mus musculus
gcgtttttattaacattccaggcga

SEQ ID NO: 232132 - DNA, 25 bp, Mus musculus
gacctgtcccatttatgcgttttta

SEQ ID NO: 232133 - DNA, 25 bp, Mus musculus
agcgcggcccaaagcagcgagagca

SEQ ID NO: 232134 - DNA, 25 bp, Mus musculus
gccctagtctagctcgggagtgttc

SEQ ID NO: 232135 - DNA, 25 bp, Mus musculus
gatcgccacttcgagccctagtcta

SEQ ID NO: 232136 - DNA, 25 bp, Mus musculus
tcagctcacgctttcggtcagcttc

SEQ ID NO: 232137 - DNA, 25 bp, Mus musculus
gtaaactcaccttcttgtgcgcgca

SEQ ID NO: 232138 - DNA, 25 bp, Mus musculus
cggcgacctcacctggctgtaaact

SEQ ID NO: 232139 - DNA, 25 bp, Mus musculus
ctcctactctgaggctggggaatgg

SEQ ID NO: 232140 - DNA, 25 bp, Mus musculus
acctctgtggcgatcagccagcgcg

SEQ ID NO: 232141 - DNA, 25 bp, Mus musculus
aaggcaaagggccacgcttggtctc

SEQ ID NO: 232142 - DNA, 25 bp, Mus musculus
taccgtgctcttttcggcgcgagga

SEQ ID NO: 232143 - DNA, 25 bp, Mus musculus
atgatgctcccggacgcacggatac

SEQ ID NO: 232144 - DNA, 25 bp, Mus musculus
gggagaactccacatcagccgggtg

SEQ ID NO: 232145 - DNA, 25 bp, Mus musculus
ctcgaggccaaagccagagcgacgc

SEQ ID NO: 232146 - DNA, 25 bp, Mus musculus
tctactggggcacttgagggataat

SEQ ID NO: 232147 - DNA, 25 bp, Mus musculus
tgaaagtttcccgtccgttctgcga

SEQ ID NO: 232148 - DNA, 25 bp, Mus musculus
aggtggagccgcagtgaaagtttcc

SEQ ID NO: 232149 - DNA, 25 bp, Mus musculus
tcgcgggcaacgctgctagttatca

SEQ ID NO: 232150 - DNA, 25 bp, Mus musculus
cagaatgggctgtagtttagtgaaa

SEQ ID NO: 232151 - DNA, 25 bp, Mus musculus
tggagtgccgccgtgtaaataaaaa

SEQ ID NO: 232152 - DNA, 25 bp, Mus musculus
aagtttctcaagtcgcagctgcacg

SEQ ID NO: 232153 - DNA, 25 bp, Mus musculus
acaatgtagtggtgctggataaccc

SEQ ID NO: 232154 - DNA, 25 bp, Mus musculus
ctggataacccgtcgcctttctaca

SEQ ID NO: 232155 - DNA, 25 bp, Mus musculus
acccgttccagttcgagatcacctt

SEQ ID NO: 232156 - DNA, 25 bp, Mus musculus
ccttcgagtgcatcgaggacctgtc

SEQ ID NO: 232157 - DNA, 25 bp, Mus musculus
ggccatgcgagggaaacttgaagtt

SEQ ID NO: 232158 - DNA, 25 bp, Mus musculus
cgcgccgcaacttgcgagcaacttg

SEQ ID NO: 232159 - DNA, 25 bp, Mus musculus
agggagccatgttgtcagctttgtc

SEQ ID NO: 232160 - DNA, 25 bp, Mus musculus
ggagccatcttacccggcggcacga

SEQ ID NO: 232161 - DNA, 25 bp, Mus musculus
agcctgattaagacatccgccctga

SEQ ID NO: 232162 - DNA, 25 bp, Mus musculus
gaccacctcgccagcgcctctcttc

SEQ ID NO: 232163 - DNA, 25 bp, Mus musculus
catgcccaccctacagcggccctga

SEQ ID NO: 232164 - DNA, 25 bp, Mus musculus
gcaggcgccttctctacaactttct

SEQ ID NO: 232165 - DNA, 25 bp, Mus musculus
gaggcggcagctcgatcctccctct

SEQ ID NO: 232166 - DNA, 25 bp, Mus musculus
tagctcccacgcagggaggcctctg

SEQ ID NO: 232167 - DNA, 25 bp, Mus musculus
agtgcgcttagctcccacgcaggga

SEQ ID NO: 232168 - DNA, 25 bp, Mus musculus
gtgtgcagtgcgcttagctcccacg

SEQ ID NO: 232169 - DNA, 25 bp, Mus musculus
caactttctcccttcccagtagtcg

SEQ ID NO: 232170 - DNA, 25 bp, Mus musculus
ccagtagtcgctcacctggagggtc

SEQ ID NO: 232171 - DNA, 25 bp, Mus musculus
ctcacctggagggtctggttttaat

SEQ ID NO: 232172 - DNA, 25 bp, Mus musculus
accagcgcagcctgattaagacatc

SEQ ID NO: 232173 - DNA, 25 bp, Mus musculus
aagacatccgccctgatccgcgatg

SEQ ID NO: 232174 - DNA, 25 bp, Mus musculus
tctggttttaattagtgtaatatcc

SEQ ID NO: 232175 - DNA, 25 bp, Mus musculus
tgggttatcaccagtccgcgtcttc

SEQ ID NO: 232176 - DNA, 25 bp, Mus musculus
tctcgcacgctccatggctcatcca

SEQ ID NO: 232177 - DNA, 25 bp, Mus musculus
ttgcttccctctggcgaagactcga

SEQ ID NO: 232178 - DNA, 25 bp, Mus musculus
cggtgggttatcaccagtccgcgtc

SEQ ID NO: 232179 - DNA, 25 bp, Mus musculus
ctctggcgaagactcgagagatgga

SEQ ID NO: 232180 - DNA, 25 bp, Mus musculus
accagtccgcgtcttcctctatgta

SEQ ID NO: 232181 - DNA, 25 bp, Mus musculus
agtccgcgtcttcctctatgtaata

SEQ ID NO: 232182 - DNA, 25 bp, Mus musculus
ccgcgtcttcctctatgtaataatc

SEQ ID NO: 232183 - DNA, 25 bp, Mus musculus
ctctatgtaataatcaggggcggta

SEQ ID NO: 232184 - DNA, 25 bp, Mus musculus
taatcaggggcggtaccatcaaaga

SEQ ID NO: 232185 - DNA, 25 bp, Mus musculus
gtaccatcaaagaggcccgggtcga

SEQ ID NO: 232186 - DNA, 25 bp, Mus musculus
gggacttccgttgcttccctctggc

SEQ ID NO: 232187 - DNA, 25 bp, Mus musculus
acttccgttgcttccctctggcgaa

SEQ ID NO: 232188 - DNA, 25 bp, Mus musculus
acagacacgcccgtgggcaatgggc

SEQ ID NO: 232189 - DNA, 25 bp, Mus musculus
ccagtgatcggggacacaactttgc

SEQ ID NO: 232190 - DNA, 25 bp, Mus musculus
cgcgcgagcacctaccgggctggat

SEQ ID NO: 232191 - DNA, 25 bp, Mus musculus
ctaccgggctggatgccgaagccat

SEQ ID NO: 232192 - DNA, 25 bp, Mus musculus
cgaagccatcggctgcatcggggac

SEQ ID NO: 232193 - DNA, 25 bp, Mus musculus
tagtgtccgcgcatagcttgcaggc

SEQ ID NO: 232194 - DNA, 25 bp, Mus musculus
gcatagcttgcaggctccgggctcc

SEQ ID NO: 232195 - DNA, 25 bp, Mus musculus
gtcggctggccgtatgccgcaagct

SEQ ID NO: 232196 - DNA, 25 bp, Mus musculus
caagctggcggacgcgctcccatga

SEQ ID NO: 232197 - DNA, 25 bp, Mus musculus
cgcaccggaggaatccggcgcgatc

SEQ ID NO: 232198 - DNA, 25 bp, Mus musculus
ccggcgcgatcctctcacgtgggaa

SEQ ID NO: 232199 - DNA, 25 bp, Mus musculus
gggacacaactttgccaccagcggc

SEQ ID NO: 232200 - DNA, 25 bp, Mus musculus
gctagcgaggtaccctctggccaca

SEQ ID NO: 232201 - DNA, 25 bp, Mus musculus
gctccttccgggctagcgaggtacc

SEQ ID NO: 232202 - DNA, 25 bp, Mus musculus
cgtgggaacaactccagatcctggg

SEQ ID NO: 232203 - DNA, 25 bp, Mus musculus
aaacagcccgaacgcgctgggattg

SEQ ID NO: 232204 - DNA, 25 bp, Mus musculus
agagacaaggggcagaccaatcaga

SEQ ID NO: 232205 - DNA, 25 bp, Mus musculus
agaccaatcagaaacgcggttgttg

SEQ ID NO: 232206 - DNA, 25 bp, Mus musculus
cgggcgctcaggcacaagttcgcaa

SEQ ID NO: 232207 - DNA, 25 bp, Mus musculus
cgccgaccgcaaacagctgtcggga

SEQ ID NO: 232208 - DNA, 25 bp, Mus musculus
attgccgtgattcagcagcgggccg

SEQ ID NO: 232209 - DNA, 25 bp, Mus musculus
cagagcccggaaaaggtcaccgcga

SEQ ID NO: 232210 - DNA, 25 bp, Mus musculus
aaggtcaccgcgacgctacgggcaa

SEQ ID NO: 232211 - DNA, 25 bp, Mus musculus
tacctctccggctcttcggggagct

SEQ ID NO: 232212 - DNA, 25 bp, Mus musculus
gctcttcctcaatcgcagctgctat

SEQ ID NO: 232213 - DNA, 25 bp, Mus musculus
cagctgctatctcggggttgtcttc

SEQ ID NO: 232214 - DNA, 25 bp, Mus musculus
attgtaccagaccaggagctcctcg

SEQ ID NO: 232215 - DNA, 25 bp, Mus musculus
gccaggcgcgattggctaccaaaga

SEQ ID NO: 232216 - DNA, 25 bp, Mus musculus
tcctgcgctgtcagccgggccggaa

SEQ ID NO: 232217 - DNA, 25 bp, Mus musculus
atgcacgtatgcaccagtgggtcga

SEQ ID NO: 232218 - DNA, 25 bp, Mus musculus
atcgtggaagaacactgacctgtta

SEQ ID NO: 232219 - DNA, 25 bp, Mus musculus
taaggtctatttcgtgtctcgctcg

SEQ ID NO: 232220 - DNA, 25 bp, Mus musculus
gctcgtcaccctcggagacatagta

SEQ ID NO: 232221 - DNA, 25 bp, Mus musculus
gtagatggatcttttgacgaacgca

SEQ ID NO: 232222 - DNA, 25 bp, Mus musculus
ccagtcctatgtatgctagcgcaca

SEQ ID NO: 232223 - DNA, 25 bp, Mus musculus
cgaggagcccactggcaggtttata

SEQ ID NO: 232224 - DNA, 25 bp, Mus musculus
aggcacagaaccaactcgaggattg

SEQ ID NO: 232225 - DNA, 25 bp, Mus musculus
gatgcgctcgcacattcaacccggg

SEQ ID NO: 232226 - DNA, 25 bp, Mus musculus
cccgggacacaaaagagcagagatc

SEQ ID NO: 232227 - DNA, 25 bp, Mus musculus
tcctcactgacaccaagggacattc

SEQ ID NO: 232228 - DNA, 25 bp, Mus musculus
tgtcgccctctctgtcaatcacgga

SEQ ID NO: 232229 - DNA, 25 bp, Mus musculus
aacggtaagtgctaggccattggcc

SEQ ID NO: 232230 - DNA, 25 bp, Mus musculus
cccgaggagctcaacacgacggtca

SEQ ID NO: 232231 - DNA, 25 bp, Mus musculus
ctggtcaagctgagcctggccaaca

SEQ ID NO: 232232 - DNA, 25 bp, Mus musculus
gtcctccttgctgcgagctgagtcc

SEQ ID NO: 232233 - DNA, 25 bp, Mus musculus
cccataccgtggactgtcgcgatcg

SEQ ID NO: 232234 - DNA, 25 bp, Mus musculus
tagtggccggcaaccgcatccagca

SEQ ID NO: 232235 - DNA, 25 bp, Mus musculus
ttccatggagatctggtgtatctgg

SEQ ID NO: 232236 - DNA, 25 bp, Mus musculus
ggaacaactcgctgcgctcgctgga

SEQ ID NO: 232237 - DNA, 25 bp, Mus musculus
ccaacaaccatctggccggtgtaca

SEQ ID NO: 232238 - DNA, 25 bp, Mus musculus
ccggtgtacatgaggctgccttcga

SEQ ID NO: 232239 - DNA, 25 bp, Mus musculus
aggctgccttcgagagcctggagtc

SEQ ID NO: 232240 - DNA, 25 bp, Mus musculus
cctggagtccttgcaggtgctggaa

SEQ ID NO: 232241 - DNA, 25 bp, Mus musculus
caggtgctggaactcaacgacaaca

SEQ ID NO: 232242 - DNA, 25 bp, Mus musculus
gcagcctcaacgtggcggctttgga

SEQ ID NO: 232243 - DNA, 25 bp, Mus musculus
ctggacctgagctacaacaacctca

SEQ ID NO: 232244 - DNA, 25 bp, Mus musculus
gcaagctggcctttctggacctgag

SEQ ID NO: 232245 - DNA, 25 bp, Mus musculus
tcttagggtctcagaaaacgggtga

SEQ ID NO: 232246 - DNA, 25 bp, Mus musculus
cagaggcagatttctaggctttcaa

SEQ ID NO: 232247 - DNA, 25 bp, Mus musculus
ggcagatttctaggctttcaagggt

SEQ ID NO: 232248 - DNA, 25 bp, Mus musculus
gctttcaagggtagcttggtctata

SEQ ID NO: 232249 - DNA, 25 bp, Mus musculus
tatgtctagttcttagggtctcaga

SEQ ID NO: 232250 - DNA, 25 bp, Mus musculus
gcctgcagagctggctcattggtta

SEQ ID NO: 232251 - DNA, 25 bp, Mus musculus
cagagctggctcattggttaaaaac

SEQ ID NO: 232252 - DNA, 25 bp, Mus musculus
acttgttctggcagggcctagtgga

SEQ ID NO: 232253 - DNA, 25 bp, Mus musculus
ttctggcagggcctagtggagccca

SEQ ID NO: 232254 - DNA, 25 bp, Mus musculus
gccgttcgagaacttgtcttggaca

SEQ ID NO: 232255 - DNA, 25 bp, Mus musculus
tgtcttggacaattgcaaagcaatg

SEQ ID NO: 232256 - DNA, 25 bp, Mus musculus
gcaaagcaatggatggaaaaatgga

SEQ ID NO: 232257 - DNA, 25 bp, Mus musculus
cccggcagccgttcgagaacttgtc

SEQ ID NO: 232258 - DNA, 25 bp, Mus musculus
gcttggtctatatgtctagttctta

SEQ ID NO: 232259 - DNA, 25 bp, Mus musculus
ggagcctgagacgtccaatcaagtg

SEQ ID NO: 232260 - DNA, 25 bp, Mus musculus
catgctaggattaagtgccgagtta

SEQ ID NO: 232261 - DNA, 25 bp, Mus musculus
ggcccgagcttatttcagcggcgtg

SEQ ID NO: 232262 - DNA, 25 bp, Mus musculus
cgttgtgttaaagcttcggcggcca

SEQ ID NO: 232263 - DNA, 25 bp, Mus musculus
agcgcttcctgtcaggtctctgtga

SEQ ID NO: 232264 - DNA, 25 bp, Mus musculus
cggctcggagacatcttgcttctgt

SEQ ID NO: 232265 - DNA, 25 bp, Mus musculus
tgtccatctctggtaagccattttg

SEQ ID NO: 232266 - DNA, 25 bp, Mus musculus
cggaggatcgcttcaacccttggta

SEQ ID NO: 232267 - DNA, 25 bp, Mus musculus
ttccagacacgtcggggagacttga

SEQ ID NO: 232268 - DNA, 25 bp, Mus musculus
cgctgacaggataaggccgttcttt

SEQ ID NO: 232269 - DNA, 25 bp, Mus musculus
gggcccgccaggaaatcagtgcgtc

SEQ ID NO: 232270 - DNA, 25 bp, Mus musculus
cagtgcgtcgtttcgggcttcaaac

SEQ ID NO: 232271 - DNA, 25 bp, Mus musculus
ggcttcaaacacttccggcatgcta

SEQ ID NO: 232272 - DNA, 25 bp, Mus musculus
gccattttgtccctcagtagcagca

SEQ ID NO: 232273 - DNA, 25 bp, Mus musculus
gccgcagccactcagaggcacgata

SEQ ID NO: 232274 - DNA, 25 bp, Mus musculus
ttcctgagcccaagaatagcaatga

SEQ ID NO: 232275 - DNA, 25 bp, Mus musculus
tcgcgtttaagcaatttcctgagcc

SEQ ID NO: 232276 - DNA, 25 bp, Mus musculus
ggtgctggcaatcagatcgcgttta

SEQ ID NO: 232277 - DNA, 25 bp, Mus musculus
cacttctcctgcacggtgctggcaa

SEQ ID NO: 232278 - DNA, 25 bp, Mus musculus
ggcgagctgtgcacgagaagaaact

SEQ ID NO: 232279 - DNA, 25 bp, Mus musculus
ggactagggcagcaagttccagctt

SEQ ID NO: 232280 - DNA, 25 bp, Mus musculus
tatccacgagtgctccacagtacgg

SEQ ID NO: 232281 - DNA, 25 bp, Mus musculus
gcagactagggcgtcctatccacga

SEQ ID NO: 232282 - DNA, 25 bp, Mus musculus
ttcgagttccggctgcgagccctcg

SEQ ID NO: 232283 - DNA, 25 bp, Mus musculus
ggcacgatagtgaagcctcccaaca

SEQ ID NO: 232284 - DNA, 25 bp, Mus musculus
cttgcagaaatgagaagcgagtccc

SEQ ID NO: 232285 - DNA, 25 bp, Mus musculus
atagcaatgagtcgggagactttcg

SEQ ID NO: 232286 - DNA, 25 bp, Mus musculus
gtcaatcagacttaatggggtatta

SEQ ID NO: 232287 - DNA, 25 bp, Mus musculus
cactgcgacacctggagtgggcgct

SEQ ID NO: 232288 - DNA, 25 bp, Mus musculus
ccctctgcaaatgatctatttggta

SEQ ID NO: 232289 - DNA, 25 bp, Mus musculus
tgcgggtgcggaaaccagcgccaac

SEQ ID NO: 232290 - DNA, 25 bp, Mus musculus
ggtagtgttccctctgcaaatgatc

SEQ ID NO: 232291 - DNA, 25 bp, Mus musculus
ttcccacctgctgcgggtgcggaaa

SEQ ID NO: 232292 - DNA, 25 bp, Mus musculus
atttggtaaccaaagcagccgtggg

SEQ ID NO: 232293 - DNA, 25 bp, Mus musculus
ccaaagcagccgtgggaatggtgtt

SEQ ID NO: 232294 - DNA, 25 bp, Mus musculus
cccaagcttcgggacttgtcgcggg

SEQ ID NO: 232295 - DNA, 25 bp, Mus musculus
tcagtcctcatcaccggcggtggga

SEQ ID NO: 232296 - DNA, 25 bp, Mus musculus
gagaggcatcggacgccacctcgct

SEQ ID NO: 232297 - DNA, 25 bp, Mus musculus
cacctcgctcgggagttcgcagagc

SEQ ID NO: 232298 - DNA, 25 bp, Mus musculus
agagcgtggcgccagaaaggtacac

SEQ ID NO: 232299 - DNA, 25 bp, Mus musculus
gcgctggtagtgttccctctgcaaa

SEQ ID NO: 232300 - DNA, 25 bp, Mus musculus
acttgtcgcgggagtcagtcctcat

SEQ ID NO: 232301 - DNA, 25 bp, Mus musculus
ctggcccggagtggctcaccttgac

SEQ ID NO: 232302 - DNA, 25 bp, Mus musculus
cttggcagccctccgcaaggctagg

SEQ ID NO: 232303 - DNA, 25 bp, Mus musculus
cttggccgcccttggcaacgcttag

SEQ ID NO: 232304 - DNA, 25 bp, Mus musculus
ggcagtccttgccagtcctatgcaa

SEQ ID NO: 232305 - DNA, 25 bp, Mus musculus
tcttatctgacttcggcaacgctcg

SEQ ID NO: 232306 - DNA, 25 bp, Mus musculus
cggcgctcggctgtcttatctgact

SEQ ID NO: 232307 - DNA, 25 bp, Mus musculus
cgcggtgctcttcgtaggccagctc

SEQ ID NO: 232308 - DNA, 25 bp, Mus musculus
cgcactcgaagaagcgcgtgagctc

SEQ ID NO: 232309 - DNA, 25 bp, Mus musculus
gtctggtactccgactggtctggca

SEQ ID NO: 232310 - DNA, 25 bp, Mus musculus
ggcgcagcgatgctctccagcgcag

SEQ ID NO: 232311 - DNA, 25 bp, Mus musculus
gcaccgctcggctgtcctaatcagt

SEQ ID NO: 232312 - DNA, 25 bp, Mus musculus
caacgcttagctgtccttggcagcc

SEQ ID NO: 232313 - DNA, 25 bp, Mus musculus
gtcgtactcgcacaggaaggccacc

SEQ ID NO: 232314 - DNA, 25 bp, Mus musculus
ctatgcaacgctcggcggcaccttg

SEQ ID NO: 232315 - DNA, 25 bp, Mus musculus
cccgactgctgtccgaggaggtttc

SEQ ID NO: 232316 - DNA, 25 bp, Mus musculus
agagccgaggaggacctcagtcctc

SEQ ID NO: 232317 - DNA, 25 bp, Mus musculus
ctccttgaggtcatcagtcagtccc

SEQ ID NO: 232318 - DNA, 25 bp, Mus musculus
agcagccctcccgagcctgaggatg

SEQ ID NO: 232319 - DNA, 25 bp, Mus musculus
tcgcacgccgtagcgcatcagggtc

SEQ ID NO: 232320 - DNA, 25 bp, Mus musculus
atcagggtcgccagccgtgcttcca

SEQ ID NO: 232321 - DNA, 25 bp, Mus musculus
agccgtgcttccagccctgcgggtt

SEQ ID NO: 232322 - DNA, 25 bp, Mus musculus
atcctgggagttcccagagccgggc

SEQ ID NO: 232323 - DNA, 25 bp, Mus musculus
ccctcgcgatggtcgtgaccgaggt

SEQ ID NO: 232324 - DNA, 25 bp, Mus musculus
tggaagcccagggtctggctactca

SEQ ID NO: 232325 - DNA, 25 bp, Mus musculus
ggctactcacgggttcagcgttccc

SEQ ID NO: 232326 - DNA, 25 bp, Mus musculus
gtctccggagaccacgcgagctgct

SEQ ID NO: 232327 - DNA, 25 bp, Mus musculus
cgttcctctggctggctcggctgaa

SEQ ID NO: 232328 - DNA, 25 bp, Mus musculus
ggttccggagcaacggctccgtgtc

SEQ ID NO: 232329 - DNA, 25 bp, Mus musculus
acgttggaatcaagcctcgggagac

SEQ ID NO: 232330 - DNA, 25 bp, Mus musculus
ccactcctcaatggcggtgactaga

SEQ ID NO: 232331 - DNA, 25 bp, Mus musculus
cccggttctgcgaggtgcttcctct

SEQ ID NO: 232332 - DNA, 25 bp, Mus musculus
ctacctgtcgctgtagctgtagcta

SEQ ID NO: 232333 - DNA, 25 bp, Mus musculus
gctttccttgaggtcctccgccttg

SEQ ID NO: 232334 - DNA, 25 bp, Mus musculus
ccgtcggagcacagccaggtcgatc

SEQ ID NO: 232335 - DNA, 25 bp, Mus musculus
cctgaagtgccagcgactctcgggc

SEQ ID NO: 232336 - DNA, 25 bp, Mus musculus
ctcgggagacgtgacacccaaaatc

SEQ ID NO: 232337 - DNA, 25 bp, Mus musculus
aagagacactcgcacgttggaatca

SEQ ID NO: 232338 - DNA, 25 bp, Mus musculus
ccactaggggtgtgctgaagagaca

SEQ ID NO: 232339 - DNA, 25 bp, Mus musculus
caatcgagtggctacgtacctgggc

SEQ ID NO: 232340 - DNA, 25 bp, Mus musculus
ctagagcgctagactcgaccaatcg

SEQ ID NO: 232341 - DNA, 25 bp, Mus musculus
ctagcgtccgcagccgttcctgtaa

SEQ ID NO: 232342 - DNA, 25 bp, Mus musculus
aatccagtggtgtctccaggctgca

SEQ ID NO: 232343 - DNA, 25 bp, Mus musculus
gatggcctctcatgctgtcccggaa

SEQ ID NO: 232344 - DNA, 25 bp, Mus musculus
accgcgggacagaagggatttcgca

SEQ ID NO: 232345 - DNA, 25 bp, Mus musculus
agttcgaagaccagcgcgacccaga

SEQ ID NO: 232346 - DNA, 25 bp, Mus musculus
gtggcccacagctgcagttcgaaga

SEQ ID NO: 232347 - DNA, 25 bp, Mus musculus
gggcactttgtgatgcgcagctgtc

SEQ ID NO: 232348 - DNA, 25 bp, Mus musculus
atttcgcaaggatgaacagtgttcc

SEQ ID NO: 232349 - DNA, 25 bp, Mus musculus
cccggaattgtgcagtagcagtagc

SEQ ID NO: 232350 - DNA, 25 bp, Mus musculus
tggaacataaggctgtcgggaaccg

SEQ ID NO: 232351 - DNA, 25 bp, Mus musculus
agccactgggtatttctggaacata

SEQ ID NO: 232352 - DNA, 25 bp, Mus musculus
ctcgcggagaaagccactgggtatt

SEQ ID NO: 232353 - DNA, 25 bp, Mus musculus
agccctgatcaagctcgcggagaaa

SEQ ID NO: 232354 - DNA, 25 bp, Mus musculus
agccctgctgggtgttattcgagcc

SEQ ID NO: 232355 - DNA, 25 bp, Mus musculus
tgaacagtgttcctgagccctgctg

SEQ ID NO: 232356 - DNA, 25 bp, Mus musculus
tagcagtagctggaatgggcacttt

SEQ ID NO: 232357 - DNA, 25 bp, Mus musculus
tccgcggaagaggatagggaggcga

SEQ ID NO: 232358 - DNA, 25 bp, Mus musculus
agagttccgcggaagaggataggga

SEQ ID NO: 232359 - DNA, 25 bp, Mus musculus
gacccctagcgcagcgggagacagc

SEQ ID NO: 232360 - DNA, 25 bp, Mus musculus
tagtcgtgctgttcccaagagggac

SEQ ID NO: 232361 - DNA, 25 bp, Mus musculus
atagtcgtgctgttcccaagaggga

SEQ ID NO: 232362 - DNA, 25 bp, Mus musculus
aatagtcgtgctgttcccaagaggg

SEQ ID NO: 232363 - DNA, 25 bp, Mus musculus
cttgcctaatagtcgtgctgttccc

SEQ ID NO: 232364 - DNA, 25 bp, Mus musculus
ttgcctaatagtcgtgctgttccca

SEQ ID NO: 232365 - DNA, 25 bp, Mus musculus
tgcctaatagtcgtgctgttcccaa

SEQ ID NO: 232366 - DNA, 25 bp, Mus musculus
gcctaatagtcgtgctgttcccaag

SEQ ID NO: 232367 - DNA, 25 bp, Mus musculus
cctaatagtcgtgctgttcccaaga

SEQ ID NO: 232368 - DNA, 25 bp, Mus musculus
ctaatagtcgtgctgttcccaagag

SEQ ID NO: 232369 - DNA, 25 bp, Mus musculus
taatagtcgtgctgttcccaagagg

SEQ ID NO: 232370 - DNA, 25 bp, Mus musculus
aagaggatagggaggcgagcggcgc

SEQ ID NO: 232371 - DNA, 25 bp, Mus musculus
tctgcgtttcataactaccacgacc

SEQ ID NO: 232372 - DNA, 25 bp, Mus musculus
tcgggctttcagattatttggctcc

SEQ ID NO: 232373 - DNA, 25 bp, Mus musculus
ttcgggctttcagattatttggctc

SEQ ID NO: 232374 - DNA, 25 bp, Mus musculus
gtttcgggctttcagattatttggc

SEQ ID NO: 232375 - DNA, 25 bp, Mus musculus
gagtttcgggctttcagattatttg

SEQ ID NO: 232376 - DNA, 25 bp, Mus musculus
aggagtttcgggctttcagattatt

SEQ ID NO: 232377 - DNA, 25 bp, Mus musculus
ggtcttgcggtgaattagcccgttg

SEQ ID NO: 232378 - DNA, 25 bp, Mus musculus
cggtcttgcggtgaattagcccgtt

SEQ ID NO: 232379 - DNA, 25 bp, Mus musculus
gacggtcttgcggtgaattagcccg

SEQ ID NO: 232380 - DNA, 25 bp, Mus musculus
tccgacggtcttgcggtgaattagc

SEQ ID NO: 232381 - DNA, 25 bp, Mus musculus
actccgacggtcttgcggtgaatta

SEQ ID NO: 232382 - DNA, 25 bp, Mus musculus
tccactccgacggtcttgcggtgaa

SEQ ID NO: 232383 - DNA, 25 bp, Mus musculus
gctccactccgacggtcttgcggtg

SEQ ID NO: 232384 - DNA, 25 bp, Mus musculus
gacgaccatccactgcagatgcgcg

SEQ ID NO: 232385 - DNA, 25 bp, Mus musculus
tagctgatcaaaggaatgaaatttc

SEQ ID NO: 232386 - DNA, 25 bp, Mus musculus
ccaagacaatataattgaaaaatcc

SEQ ID NO: 232387 - DNA, 25 bp, Mus musculus
ttgaaagatcaataccaagacaata

SEQ ID NO: 232388 - DNA, 25 bp, Mus musculus
gaaacattagggatagaaacaatta

SEQ ID NO: 232389 - DNA, 25 bp, Mus musculus
tttctcatgactgggaaacattagg

SEQ ID NO: 232390 - DNA, 25 bp, Mus musculus
gctgatcaaaggaatgaaatttctc

SEQ ID NO: 232391 - DNA, 25 bp, Mus musculus
tgtatgaaagtagctgatcaaagga

SEQ ID NO: 232392 - DNA, 25 bp, Mus musculus
gacacatgtatgaaagtagctgatc

SEQ ID NO: 232393 - DNA, 25 bp, Mus musculus
gctctaaacagacacatgtatgaaa

SEQ ID NO: 232394 - DNA, 25 bp, Mus musculus
gttgctctaaacagacacatgtatg

SEQ ID NO: 232395 - DNA, 25 bp, Mus musculus
ggaatgaaatttctcatgactggga

SEQ ID NO: 232396 - DNA, 25 bp, Mus musculus
ggagatgttgctctaaacagacaca

SEQ ID NO: 232397 - DNA, 25 bp, Mus musculus
tacaggagatgttgctctaaacaga

SEQ ID NO: 232398 - DNA, 25 bp, Mus musculus
caggagatgttgctctaaacagaca

SEQ ID NO: 232399 - DNA, 25 bp, Mus musculus
tgccccgcggcttgttggggtcacc

SEQ ID NO: 232400 - DNA, 25 bp, Mus musculus
gttttgcagagttctccgcgccacg

SEQ ID NO: 232401 - DNA, 25 bp, Mus musculus
ttgttttgcagagttctccgcgcca

SEQ ID NO: 232402 - DNA, 25 bp, Mus musculus
tcttgttttgcagagttctccgcgc

SEQ ID NO: 232403 - DNA, 25 bp, Mus musculus
gcctcttgttttgcagagttctccg

SEQ ID NO: 232404 - DNA, 25 bp, Mus musculus
cagcctcttgttttgcagagttctc

SEQ ID NO: 232405 - DNA, 25 bp, Mus musculus
cccagcctcttgttttgcagagttc

SEQ ID NO: 232406 - DNA, 25 bp, Mus musculus
gcagagagacttccttccccaagct

SEQ ID NO: 232407 - DNA, 25 bp, Mus musculus
tgctgcgagcgctgcttccctcaga

SEQ ID NO: 232408 - DNA, 25 bp, Mus musculus
gtacgaggacattttgccccgcggc

SEQ ID NO: 232409 - DNA, 25 bp, Mus musculus
atgcttcttcttgtgctcctcgcgg

SEQ ID NO: 232410 - DNA, 25 bp, Mus musculus
gatgcttcttcttgtgctcctcgcg

SEQ ID NO: 232411 - DNA, 25 bp, Mus musculus
gggatgcttcttcttgtgctcctcg

SEQ ID NO: 232412 - DNA, 25 bp, Mus musculus
tgcttccctcagacctccgcagaga

SEQ ID NO: 232413 - DNA, 25 bp, Mus musculus
cggataaagtggatggcttgacccg

SEQ ID NO: 232414 - DNA, 25 bp, Mus musculus
gccgtcaggcctgcccggcgtccgc

SEQ ID NO: 232415 - DNA, 25 bp, Mus musculus
tccgtccgccctcttccgggcgtca

SEQ ID NO: 232416 - DNA, 25 bp, Mus musculus
gcgcaggcccgtcgtgcctgtgctc

SEQ ID NO: 232417 - DNA, 25 bp, Mus musculus
cgtcgtgcctgtgctccgccgattg

SEQ ID NO: 232418 - DNA, 25 bp, Mus musculus
gtcgtgcctgtgctccgccgattgc

SEQ ID NO: 232419 - DNA, 25 bp, Mus musculus
tcgtgcctgtgctccgccgattgcc

SEQ ID NO: 232420 - DNA, 25 bp, Mus musculus
gcctcggataaagtggatggcttga

SEQ ID NO: 232421 - DNA, 25 bp, Mus musculus
cctcggataaagtggatggcttgac

SEQ ID NO: 232422 - DNA, 25 bp, Mus musculus
ctcggataaagtggatggcttgacc

SEQ ID NO: 232423 - DNA, 25 bp, Mus musculus
tcggataaagtggatggcttgaccc

SEQ ID NO: 232424 - DNA, 25 bp, Mus musculus
gataaagtggatggcttgacccgga

SEQ ID NO: 232425 - DNA, 25 bp, Mus musculus
cgctaaggggccgtcaggcctgccc

SEQ ID NO: 232426 - DNA, 25 bp, Mus musculus
taaagtggatggcttgacccggaaa

SEQ ID NO: 232427 - DNA, 25 bp, Mus musculus
tggacccacgaaggcaggaattact

SEQ ID NO: 232428 - DNA, 25 bp, Mus musculus
ccaggttcactggagttggtgtaag

SEQ ID NO: 232429 - DNA, 25 bp, Mus musculus
gacccacgaaggcaggaattactag

SEQ ID NO: 232430 - DNA, 25 bp, Mus musculus
acccacgaaggcaggaattactaga

SEQ ID NO: 232431 - DNA, 25 bp, Mus musculus
cccacgaaggcaggaattactagag

SEQ ID NO: 232432 - DNA, 25 bp, Mus musculus
ccacgaaggcaggaattactagagg

SEQ ID NO: 232433 - DNA, 25 bp, Mus musculus
cacgaaggcaggaattactagaggc

SEQ ID NO: 232434 - DNA, 25 bp, Mus musculus
gcaggaattactagaggccaggttc

SEQ ID NO: 232435 - DNA, 25 bp, Mus musculus
caggaattactagaggccaggttca

SEQ ID NO: 232436 - DNA, 25 bp, Mus musculus
aggaattactagaggccaggttcac

SEQ ID NO: 232437 - DNA, 25 bp, Mus musculus
ggaattactagaggccaggttcact

SEQ ID NO: 232438 - DNA, 25 bp, Mus musculus
gccaggttcactggagttggtgtaa

SEQ ID NO: 232439 - DNA, 25 bp, Mus musculus
cagcgtggggtccttgagtgataaa

SEQ ID NO: 232440 - DNA, 25 bp, Mus musculus
ctggacccacgaaggcaggaattac

SEQ ID NO: 232441 - DNA, 25 bp, Mus musculus
cgaacaacgttagctattagcaccg

SEQ ID NO: 232442 - DNA, 25 bp, Mus musculus
cggtctggatgtgcagctcccttcc

SEQ ID NO: 232443 - DNA, 25 bp, Mus musculus
tggaggagcatctgttgccaaggta

SEQ ID NO: 232444 - DNA, 25 bp, Mus musculus
ctgttgccaaggtaacccgcggcct

SEQ ID NO: 232445 - DNA, 25 bp, Mus musculus
cgcctggggctggaccactgcgttc

SEQ ID NO: 232446 - DNA, 25 bp, Mus musculus
tggaccactgcgttcgaggcgagct

SEQ ID NO: 232447 - DNA, 25 bp, Mus musculus
ttcgaggcgagctgagctcagagct

SEQ ID NO: 232448 - DNA, 25 bp, Mus musculus
gaagcggatgcagtgcaggaatccc

SEQ ID NO: 232449 - DNA, 25 bp, Mus musculus
gcaggaatcccgcatgcacttcatg

SEQ ID NO: 232450 - DNA, 25 bp, Mus musculus
gcacttcatggctcaccattgcaca

SEQ ID NO: 232451 - DNA, 25 bp, Mus musculus
gcacacactaggcacggaaatacac

SEQ ID NO: 232452 - DNA, 25 bp, Mus musculus
ctaggcacggaaatacacgcaaaaa

SEQ ID NO: 232453 - DNA, 25 bp, Mus musculus
cccagggatcgtgtctagagcaccc

SEQ ID NO: 232454 - DNA, 25 bp, Mus musculus
ttagcaccggagcttgcaaatgacc

SEQ ID NO: 232455 - DNA, 25 bp, Mus musculus
atgtcaggtgttggcccggcgtcaa

SEQ ID NO: 232456 - DNA, 25 bp, Mus musculus
ccaacacctccctgttcgtcaggaa

SEQ ID NO: 232457 - DNA, 25 bp, Mus musculus
tctggtggcactgcgctctgcaggc

SEQ ID NO: 232458 - DNA, 25 bp, Mus musculus
agaggcatgtctcgctacaccaggc

SEQ ID NO: 232459 - DNA, 25 bp, Mus musculus
tgctggccctggctctggtggcact

SEQ ID NO: 232460 - DNA, 25 bp, Mus musculus
ttcgtcaggaacgtcgcagacgcca

SEQ ID NO: 232461 - DNA, 25 bp, Mus musculus
tcgcagacgccaccaggtgagtgga

SEQ ID NO: 232462 - DNA, 25 bp, Mus musculus
ggctgtctggatgacgatgccgccc

SEQ ID NO: 232463 - DNA, 25 bp, Mus musculus
agctgcaagctgttggggtgccatt

SEQ ID NO: 232464 - DNA, 25 bp, Mus musculus
catttgggcgtcagggtaccggtct

SEQ ID NO: 232465 - DNA, 25 bp, Mus musculus
gtaccggtcttgtgttggggcactg

SEQ ID NO: 232466 - DNA, 25 bp, Mus musculus
gccactgcgggctgtcggagtatct

SEQ ID NO: 232467 - DNA, 25 bp, Mus musculus
gccgcgagaggcatgtctcgctaca

SEQ ID NO: 232468 - DNA, 25 bp, Mus musculus
ctggatgacgatgccgcccgggtac

SEQ ID NO: 232469 - DNA, 25 bp, Mus musculus
tccgggtcaagccatccactttatc

SEQ ID NO: 232470 - DNA, 25 bp, Mus musculus
tgacgcccggaagagggcggacgga

SEQ ID NO: 232471 - DNA, 25 bp, Mus musculus
gagcacaggcacgacgggcctgcgc

SEQ ID NO: 232472 - DNA, 25 bp, Mus musculus
aatcggcggagcacaggcacgacgg

SEQ ID NO: 232473 - DNA, 25 bp, Mus musculus
gcaatcggcggagcacaggcacgac

SEQ ID NO: 232474 - DNA, 25 bp, Mus musculus
tcaagccatccactttatccgaggc

SEQ ID NO: 232475 - DNA, 25 bp, Mus musculus
gtcaagccatccactttatccgagg

SEQ ID NO: 232476 - DNA, 25 bp, Mus musculus
ggtcaagccatccactttatccgag

SEQ ID NO: 232477 - DNA, 25 bp, Mus musculus
tttccgggtcaagccatccacttta

SEQ ID NO: 232478 - DNA, 25 bp, Mus musculus
cgggtcaagccatccactttatccg

SEQ ID NO: 232479 - DNA, 25 bp, Mus musculus
ccgggcaggcctgacggccccttag

SEQ ID NO: 232480 - DNA, 25 bp, Mus musculus
cggagcacaggcacgacgggcctgc

SEQ ID NO: 232481 - DNA, 25 bp, Mus musculus
gggtcaagccatccactttatccga

SEQ ID NO: 232482 - DNA, 25 bp, Mus musculus
caatcggcggagcacaggcacgacg

SEQ ID NO: 232483 - DNA, 25 bp, Mus musculus
tggcgcggagaactctgcaaaacaa

SEQ ID NO: 232484 - DNA, 25 bp, Mus musculus
cgaggagcacaagaagaagcatccc

SEQ ID NO: 232485 - DNA, 25 bp, Mus musculus
cgcgaggagcacaagaagaagcatc

SEQ ID NO: 232486 - DNA, 25 bp, Mus musculus
cgcggggcaaaatgtcctcgtacgc

SEQ ID NO: 232487 - DNA, 25 bp, Mus musculus
gccgcggggcaaaatgtcctcgtac

SEQ ID NO: 232488 - DNA, 25 bp, Mus musculus
aagccgcggggcaaaatgtcctcgt

SEQ ID NO: 232489 - DNA, 25 bp, Mus musculus
caagccgcggggcaaaatgtcctcg

SEQ ID NO: 232490 - DNA, 25 bp, Mus musculus
ctctctgcggaggtctgagggaagc

SEQ ID NO: 232491 - DNA, 25 bp, Mus musculus
agcttggggaaggaagtctctctgc

SEQ ID NO: 232492 - DNA, 25 bp, Mus musculus
actctgcaaaacaagaggctgggga

SEQ ID NO: 232493 - DNA, 25 bp, Mus musculus
gaactctgcaaaacaagaggctggg

SEQ ID NO: 232494 - DNA, 25 bp, Mus musculus
cggagaactctgcaaaacaagaggc

SEQ ID NO: 232495 - DNA, 25 bp, Mus musculus
gcgcggagaactctgcaaaacaaga

SEQ ID NO: 232496 - DNA, 25 bp, Mus musculus
tctgagggaagcagcgctcgcagca

SEQ ID NO: 232497 - DNA, 25 bp, Mus musculus
cctggcgaaagctcagctaaggatg

SEQ ID NO: 232498 - DNA, 25 bp, Mus musculus
acctggcacctgagaccgagctccg

SEQ ID NO: 232499 - DNA, 25 bp, Mus musculus
tccgagttctgggtcaaggccgctg

SEQ ID NO: 232500 - DNA, 25 bp, Mus musculus
ccgagttctgggtcaaggccgctgt

SEQ ID NO: 232501 - DNA, 25 bp, Mus musculus
ggactaggaagacgttccctggcga

SEQ ID NO: 232502 - DNA, 25 bp, Mus musculus
taggaagacgttccctggcgaaagc

SEQ ID NO: 232503 - DNA, 25 bp, Mus musculus
gaagacgttccctggcgaaagctca

SEQ ID NO: 232504 - DNA, 25 bp, Mus musculus
acgttccctggcgaaagctcagcta

SEQ ID NO: 232505 - DNA, 25 bp, Mus musculus
cgaaagctcagctaaggatggcgcc

SEQ ID NO: 232506 - DNA, 25 bp, Mus musculus
ttccctggcgaaagctcagctaagg

SEQ ID NO: 232507 - DNA, 25 bp, Mus musculus
cgcgctcccgctgtctctggaccta

SEQ ID NO: 232508 - DNA, 25 bp, Mus musculus
tggcgaaagctcagctaaggatggc

SEQ ID NO: 232509 - DNA, 25 bp, Mus musculus
cgttccctggcgaaagctcagctaa

SEQ ID NO: 232510 - DNA, 25 bp, Mus musculus
aaagctcagctaaggatggcgccag

SEQ ID NO: 232511 - DNA, 25 bp, Mus musculus
cgctgacatgcttcttcgaggccct

SEQ ID NO: 232512 - DNA, 25 bp, Mus musculus
atgcttcttcgaggccctgcccact

SEQ ID NO: 232513 - DNA, 25 bp, Mus musculus
acatgcttcttcgaggccctgccca

SEQ ID NO: 232514 - DNA, 25 bp, Mus musculus
tgacatgcttcttcgaggccctgcc

SEQ ID NO: 232515 - DNA, 25 bp, Mus musculus
gctgacatgcttcttcgaggccctg

SEQ ID NO: 232516 - DNA, 25 bp, Mus musculus
aatgtcaagcccgtgagctaaggtg

SEQ ID NO: 232517 - DNA, 25 bp, Mus musculus
ctaaggtggcaggacgatgaaggcc

SEQ ID NO: 232518 - DNA, 25 bp, Mus musculus
ccgtgagctaaggtggcaggacgat

SEQ ID NO: 232519 - DNA, 25 bp, Mus musculus
tcaagcccgtgagctaaggtggcag

SEQ ID NO: 232520 - DNA, 25 bp, Mus musculus
gtcaagcccgtgagctaaggtggca

SEQ ID NO: 232521 - DNA, 25 bp, Mus musculus
tgtcaagcccgtgagctaaggtggc

SEQ ID NO: 232522 - DNA, 25 bp, Mus musculus
atgtcaagcccgtgagctaaggtgg

SEQ ID NO: 232523 - DNA, 25 bp, Mus musculus
atccaaagtcacttaatgtcaagcc

SEQ ID NO: 232524 - DNA, 25 bp, Mus musculus
ctgacatgcttcttcgaggccctgc

SEQ ID NO: 232525 - DNA, 25 bp, Mus musculus
agtgtcgcgctcgcccaagcggctt

SEQ ID NO: 232526 - DNA, 25 bp, Mus musculus
ttggaaggcaaaaagagatccaaga

SEQ ID NO: 232527 - DNA, 25 bp, Mus musculus
cacttggaaggcaaaaagagatcca

SEQ ID NO: 232528 - DNA, 25 bp, Mus musculus
acagccagaacatgtcgtctgcggt

SEQ ID NO: 232529 - DNA, 25 bp, Mus musculus
tcgcgctcgcccaagcggcttccct

SEQ ID NO: 232530 - DNA, 25 bp, Mus musculus
tctgagtaggggatctcccctcggg

SEQ ID NO: 232531 - DNA, 25 bp, Mus musculus
cccgggacttaagtgtctgagtagg

SEQ ID NO: 232532 - DNA, 25 bp, Mus musculus
tcccgggacttaagtgtctgagtag

SEQ ID NO: 232533 - DNA, 25 bp, Mus musculus
cacagccagaacatgtcgtctgcgg

SEQ ID NO: 232534 - DNA, 25 bp, Mus musculus
ggcaagctggagtacctggtcaagt

SEQ ID NO: 232535 - DNA, 25 bp, Mus musculus
tctggcgcccatttgttgcatgcgc

SEQ ID NO: 232536 - DNA, 25 bp, Mus musculus
cgccctctggccaaacaatagcttt

SEQ ID NO: 232537 - DNA, 25 bp, Mus musculus
aacaatagctttccgcagggacctg

SEQ ID NO: 232538 - DNA, 25 bp, Mus musculus
gcagcctcccgacacagtgcagaga

SEQ ID NO: 232539 - DNA, 25 bp, Mus musculus
gtcttcgccgccgagtgcatcctga

SEQ ID NO: 232540 - DNA, 25 bp, Mus musculus
cgagtgcatcctgagcaagcggctc

SEQ ID NO: 232541 - DNA, 25 bp, Mus musculus
cgctcttatctctccgcagggcaag

SEQ ID NO: 232542 - DNA, 25 bp, Mus musculus
tggtcctccaagtgagtctccggtg

SEQ ID NO: 232543 - DNA, 25 bp, Mus musculus
aagtcctgtgcctcgggacccagag

SEQ ID NO: 232544 - DNA, 25 bp, Mus musculus
ccagaggactctggccgactggcgc

SEQ ID NO: 232545 - DNA, 25 bp, Mus musculus
tggcgctgccctttgtttacgagcc

SEQ ID NO: 232546 - DNA, 25 bp, Mus musculus
ggtgggaaccctcgcatcgcaggcc

SEQ ID NO: 232547 - DNA, 25 bp, Mus musculus
tttacgagcccacggggagcgagca

SEQ ID NO: 232548 - DNA, 25 bp, Mus musculus
cccagctcaaagatgccacttcaaa

SEQ ID NO: 232549 - DNA, 25 bp, Mus musculus
ccagaagctacaacagtgctgtgta

SEQ ID NO: 232550 - DNA, 25 bp, Mus musculus
gaagctacaacagtgctgtgtactg

SEQ ID NO: 232551 - DNA, 25 bp, Mus musculus
ctacaacagtgctgtgtactgtttg

SEQ ID NO: 232552 - DNA, 25 bp, Mus musculus
cagtgctgtgtactgtttgatttca

SEQ ID NO: 232553 - DNA, 25 bp, Mus musculus
gctgtgtactgtttgatttcatgga

SEQ ID NO: 232554 - DNA, 25 bp, Mus musculus
gtactgtttgatttcatggactctg

SEQ ID NO: 232555 - DNA, 25 bp, Mus musculus
tgtttgatttcatggactctgtttc

SEQ ID NO: 232556 - DNA, 25 bp, Mus musculus
tgatttcatggactctgtttcagac

SEQ ID NO: 232557 - DNA, 25 bp, Mus musculus
ttcatggactctgtttcagacttga

SEQ ID NO: 232558 - DNA, 25 bp, Mus musculus
atggactctgtttcagacttgaaga

SEQ ID NO: 232559 - DNA, 25 bp, Mus musculus
caaagatgccacttcaaatgaacag

SEQ ID NO: 232560 - DNA, 25 bp, Mus musculus
cagctcaaagatgccacttcaaatg

SEQ ID NO: 232561 - DNA, 25 bp, Mus musculus
ctgccagaagctacaacagtgctgt

SEQ ID NO: 232562 - DNA, 25 bp, Mus musculus
caccactcgagcgagcgtcacggaa

SEQ ID NO: 232563 - DNA, 25 bp, Mus musculus
caccgcggccagtgttgttacccga

SEQ ID NO: 232564 - DNA, 25 bp, Mus musculus
aacaaatagcgctggccaccgcggc

SEQ ID NO: 232565 - DNA, 25 bp, Mus musculus
gcggcgcagcaacaaatagcgctgg

SEQ ID NO: 232566 - DNA, 25 bp, Mus musculus
tcggagcaaggaccatgactcgggc

SEQ ID NO: 232567 - DNA, 25 bp, Mus musculus
aggttcggagcaaggaccatgactc

SEQ ID NO: 232568 - DNA, 25 bp, Mus musculus
ccgctcagagcgagatctcgctgtg

SEQ ID NO: 232569 - DNA, 25 bp, Mus musculus
ctaagcggccgctcagagcgagatc

SEQ ID NO: 232570 - DNA, 25 bp, Mus musculus
gagcgagcgtcacggaaacttccct

SEQ ID NO: 232571 - DNA, 25 bp, Mus musculus
cccattggctggctccggagccaat

SEQ ID NO: 232572 - DNA, 25 bp, Mus musculus
aaatgcaggctgttgctgggccgta

SEQ ID NO: 232573 - DNA, 25 bp, Mus musculus
gccaagcttctaaatgcaggctgtt

SEQ ID NO: 232574 - DNA, 25 bp, Mus musculus
cccagagcgctgcacgtagcgggct

SEQ ID NO: 232575 - DNA, 25 bp, Mus musculus
accggccctacctccttcgcgagtg

SEQ ID NO: 232576 - DNA, 25 bp, Mus musculus
ccttagctgagctttcgccagggaa

SEQ ID NO: 232577 - DNA, 25 bp, Mus musculus
taggtccagagacagcgggagcgcg

SEQ ID NO: 232578 - DNA, 25 bp, Mus musculus
cggagctcggtctcaggtgccaggt

SEQ ID NO: 232579 - DNA, 25 bp, Mus musculus
cagcggccttgacccagaactcgga

SEQ ID NO: 232580 - DNA, 25 bp, Mus musculus
acagcggccttgacccagaactcgg

SEQ ID NO: 232581 - DNA, 25 bp, Mus musculus
agccgccctgccaaccgcgcctcgg

SEQ ID NO: 232582 - DNA, 25 bp, Mus musculus
tcgccagggaacgtcttcctagtcc

SEQ ID NO: 232583 - DNA, 25 bp, Mus musculus
gctttcgccagggaacgtcttccta

SEQ ID NO: 232584 - DNA, 25 bp, Mus musculus
gccatccttagctgagctttcgcca

SEQ ID NO: 232585 - DNA, 25 bp, Mus musculus
tagctgagctttcgccagggaacgt

SEQ ID NO: 232586 - DNA, 25 bp, Mus musculus
tggcgccatccttagctgagctttc

SEQ ID NO: 232587 - DNA, 25 bp, Mus musculus
catccttagctgagctttcgccagg

SEQ ID NO: 232588 - DNA, 25 bp, Mus musculus
ggcgccatccttagctgagctttcg

SEQ ID NO: 232589 - DNA, 25 bp, Mus musculus
tgagctttcgccagggaacgtcttc

SEQ ID NO: 232590 - DNA, 25 bp, Mus musculus
aatcaactctcggagagaaggcgcc

SEQ ID NO: 232591 - DNA, 25 bp, Mus musculus
aactctcggagagaaggcgccgggt

SEQ ID NO: 232592 - DNA, 25 bp, Mus musculus
tcaactctcggagagaaggcgccgg

SEQ ID NO: 232593 - DNA, 25 bp, Mus musculus
aagagaatcaactctcggagagaag

SEQ ID NO: 232594 - DNA, 25 bp, Mus musculus
atcaactctcggagagaaggcgccg

SEQ ID NO: 232595 - DNA, 25 bp, Mus musculus
gagaatcaactctcggagagaaggc

SEQ ID NO: 232596 - DNA, 25 bp, Mus musculus
gctgtgttccagaggaagtgttatc

SEQ ID NO: 232597 - DNA, 25 bp, Mus musculus
ccagaggaagtgttatctctgtcgc

SEQ ID NO: 232598 - DNA, 25 bp, Mus musculus
tgtgttccagaggaagtgttatctc

SEQ ID NO: 232599 - DNA, 25 bp, Mus musculus
gtgttccagaggaagtgttatctct

SEQ ID NO: 232600 - DNA, 25 bp, Mus musculus
ttccagaggaagtgttatctctgtc

SEQ ID NO: 232601 - DNA, 25 bp, Mus musculus
gaggaagtgttatctctgtcgcggc

SEQ ID NO: 232602 - DNA, 25 bp, Mus musculus
gaagtgttatctctgtcgcggctgg

SEQ ID NO: 232603 - DNA, 25 bp, Mus musculus
gtgttatctctgtcgcggctggaga

SEQ ID NO: 232604 - DNA, 25 bp, Mus musculus
tgttatctctgtcgcggctggagac

SEQ ID NO: 232605 - DNA, 25 bp, Mus musculus
tatctctgtcgcggctggagacgtc

SEQ ID NO: 232606 - DNA, 25 bp, Mus musculus
cccgcttcttcggacctgggctccg

SEQ ID NO: 232607 - DNA, 25 bp, Mus musculus
ggaagtgttatctctgtcgcggctg

SEQ ID NO: 232608 - DNA, 25 bp, Mus musculus
cgaggccgcagctcgccgttgcgcc

SEQ ID NO: 232609 - DNA, 25 bp, Mus musculus
aagtgttatctctgtcgcggctgga

SEQ ID NO: 232610 - DNA, 25 bp, Mus musculus
ttctggccctctgggctctctcttg

SEQ ID NO: 232611 - DNA, 25 bp, Mus musculus
tggccctctgggctctctcttgtct

SEQ ID NO: 232612 - DNA, 25 bp, Mus musculus
tcttgtctcccacccataactcatt

SEQ ID NO: 232613 - DNA, 25 bp, Mus musculus
acagggcctcgaggaagtggtgctt

SEQ ID NO: 232614 - DNA, 25 bp, Mus musculus
ggctctctcttgtctcccacccata

SEQ ID NO: 232615 - DNA, 25 bp, Mus musculus
actgcccgctaacaggggatggcta

SEQ ID NO: 232616 - DNA, 25 bp, Mus musculus
aagtggtgctttgggcctcctctcc

SEQ ID NO: 232617 - DNA, 25 bp, Mus musculus
agactttctagaggtttctctccaa

SEQ ID NO: 232618 - DNA, 25 bp, Mus musculus
tgcccgctaacaggggatggctaac

SEQ ID NO: 232619 - DNA, 25 bp, Mus musculus
ttctactgctccatatttccattca

SEQ ID NO: 232620 - DNA, 25 bp, Mus musculus
aatctccaaattctactgctccata

SEQ ID NO: 232621 - DNA, 25 bp, Mus musculus
aggtttctctccaatctccaaattc

SEQ ID NO: 232622 - DNA, 25 bp, Mus musculus
tagaggtttctctccaatctccaaa

SEQ ID NO: 232623 - DNA, 25 bp, Mus musculus
ctataagactttctagaggtttctc

SEQ ID NO: 232624 - DNA, 25 bp, Mus musculus
ataaaaggacgccaacgctctccgc

SEQ ID NO: 232625 - DNA, 25 bp, Mus musculus
tatttgtttcttcgcatccggaagc

SEQ ID NO: 232626 - DNA, 25 bp, Mus musculus
tgccaggacgccttatatttgtttc

SEQ ID NO: 232627 - DNA, 25 bp, Mus musculus
attgacagtgccaggacgccttata

SEQ ID NO: 232628 - DNA, 25 bp, Mus musculus
gtcctgctcggccaattgacagtgc

SEQ ID NO: 232629 - DNA, 25 bp, Mus musculus
tgtcctaattggctaaggctggggc

SEQ ID NO: 232630 - DNA, 25 bp, Mus musculus
ggcggaacctccagtggttgtccta

SEQ ID NO: 232631 - DNA, 25 bp, Mus musculus
cggctgccatggataaaaggacgcc

SEQ ID NO: 232632 - DNA, 25 bp, Mus musculus
tggtcccgagatcagcggctgccat

SEQ ID NO: 232633 - DNA, 25 bp, Mus musculus
cacgcctctgtggtcccgagatcag

SEQ ID NO: 232634 - DNA, 25 bp, Mus musculus
tctagcgggacgaaggcacgcctct

SEQ ID NO: 232635 - DNA, 25 bp, Mus musculus
ccttctctaccggtctagcgggacg

SEQ ID NO: 232636 - DNA, 25 bp, Mus musculus
cgcactcaggcagggtgcacaccgg

SEQ ID NO: 232637 - DNA, 25 bp, Mus musculus
ctccagtggttgtcctaattggcta

SEQ ID NO: 232638 - DNA, 25 bp, Mus musculus
cgtgcctggtaaccgtcccgtgtct

SEQ ID NO: 232639 - DNA, 25 bp, Mus musculus
aaacgcccgtgtgacccgagcctga

SEQ ID NO: 232640 - DNA, 25 bp, Mus musculus
ccagcgtcctaagccgggtggctca

SEQ ID NO: 232641 - DNA, 25 bp, Mus musculus
aagccgggtggctcaggactctccc

SEQ ID NO: 232642 - DNA, 25 bp, Mus musculus
actagccggcgccacaccgagagaa

SEQ ID NO: 232643 - DNA, 25 bp, Mus musculus
cccggacgagccgatggcctctgaa

SEQ ID NO: 232644 - DNA, 25 bp, Mus musculus
atggcctctgaacgctgtcacctca

SEQ ID NO: 232645 - DNA, 25 bp, Mus musculus
tctgaacgctgtcacctcaacctta

SEQ ID NO: 232646 - DNA, 25 bp, Mus musculus
ataccacagtgtctaggaactccgc

SEQ ID NO: 232647 - DNA, 25 bp, Mus musculus
ttgtagtttggatcagcgtccgtca

SEQ ID NO: 232648 - DNA, 25 bp, Mus musculus
tctcgtgcagatgacgtaagctgta

SEQ ID NO: 232649 - DNA, 25 bp, Mus musculus
ctcccagcgcgtcatgggagttgta

SEQ ID NO: 232650 - DNA, 25 bp, Mus musculus
tcccgtgtctcgtgcagatgacgta

SEQ ID NO: 232651 - DNA, 25 bp, Mus musculus
aggaactccgcgctccaaaaggagc

SEQ ID NO: 232652 - DNA, 25 bp, Mus musculus
tgtcgctggactttaaatgatgatg

SEQ ID NO: 232653 - DNA, 25 bp, Mus musculus
catccgcagagagtggagcaggctt

SEQ ID NO: 232654 - DNA, 25 bp, Mus musculus
gaaaaaagccgtggatgcatccgca

SEQ ID NO: 232655 - DNA, 25 bp, Mus musculus
ccctggcttgaaggactttttggtg

SEQ ID NO: 232656 - DNA, 25 bp, Mus musculus
tcgctcctaccttgggatcccgttg

SEQ ID NO: 232657 - DNA, 25 bp, Mus musculus
ggcacccgttcgtgatcctattcgc

SEQ ID NO: 232658 - DNA, 25 bp, Mus musculus
catccttgatggcacccgttcgtga

SEQ ID NO: 232659 - DNA, 25 bp, Mus musculus
gctgtcagctaaatttccatccttg

SEQ ID NO: 232660 - DNA, 25 bp, Mus musculus
actgcttctccctgctgtcagctaa

SEQ ID NO: 232661 - DNA, 25 bp, Mus musculus
gaaagtccaggcctctgcctactgc

SEQ ID NO: 232662 - DNA, 25 bp, Mus musculus
tctgcggccgcagaaagaaagtcca

SEQ ID NO: 232663 - DNA, 25 bp, Mus musculus
ggtaaactcagttgcactgtctaca

SEQ ID NO: 232664 - DNA, 25 bp, Mus musculus
gctgtcccgtgctgtggtaaactca

SEQ ID NO: 232665 - DNA, 25 bp, Mus musculus
agcaggcttgcataccactgtcgtc

SEQ ID NO: 232666 - DNA, 25 bp, Mus musculus
cggtcctcggcgagacagacggcca

SEQ ID NO: 232667 - DNA, 25 bp, Mus musculus
gtggacagatgaccgcaacccagct

SEQ ID NO: 232668 - DNA, 25 bp, Mus musculus
gtcacccgcgggcaagtggacagat

SEQ ID NO: 232669 - DNA, 25 bp, Mus musculus
agacagacggccaggcacagctccg

SEQ ID NO: 232670 - DNA, 25 bp, Mus musculus
agcttggcgtcatccttcgcctgga

SEQ ID NO: 232671 - DNA, 25 bp, Mus musculus
gtcatccttcgcctggaccagaaga

SEQ ID NO: 232672 - DNA, 25 bp, Mus musculus
cagaagaagccaggccaacggggcc

SEQ ID NO: 232673 - DNA, 25 bp, Mus musculus
ccaggagcagcagggaccgcatagc

SEQ ID NO: 232674 - DNA, 25 bp, Mus musculus
accgcatagcggagtctcgggaaca

SEQ ID NO: 232675 - DNA, 25 bp, Mus musculus
gagtctcgggaacaacccgccggca

SEQ ID NO: 232676 - DNA, 25 bp, Mus musculus
acaacccgccggcactgagacagaa

SEQ ID NO: 232677 - DNA, 25 bp, Mus musculus
ctgagacagaagctgaactggaaac

SEQ ID NO: 232678 - DNA, 25 bp, Mus musculus
tgaactggaaacttcgcgacggggc

SEQ ID NO: 232679 - DNA, 25 bp, Mus musculus
ttcgcctggaccagaagaagccagg

SEQ ID NO: 232680 - DNA, 25 bp, Mus musculus
ggccgcttttccaccttgtcgcaaa

SEQ ID NO: 232681 - DNA, 25 bp, Mus musculus
tatctgcagcgcatccagctcaaca

SEQ ID NO: 232682 - DNA, 25 bp, Mus musculus
ctgcgtgctactgcaggaggacttc

SEQ ID NO: 232683 - DNA, 25 bp, Mus musculus
tacgcccgctgaatgtggtggccga

SEQ ID NO: 232684 - DNA, 25 bp, Mus musculus
ttcgtgcagctacgcccgctgaatg

SEQ ID NO: 232685 - DNA, 25 bp, Mus musculus
ggacttcgtgcccttcgtgcagcta

SEQ ID NO: 232686 - DNA, 25 bp, Mus musculus
tccaacaaccggctgtgggtgacgc

SEQ ID NO: 232687 - DNA, 25 bp, Mus musculus
tggacgcctccaacaaccggctgtg

SEQ ID NO: 232688 - DNA, 25 bp, Mus musculus
cctggtggccaacggcttcctggct

SEQ ID NO: 232689 - DNA, 25 bp, Mus musculus
tgctgctcctgtggttcgcgagctc

SEQ ID NO: 232690 - DNA, 25 bp, Mus musculus
cgtttgacgtctaggaggcaaccaa

SEQ ID NO: 232691 - DNA, 25 bp, Mus musculus
aagactcagcgacgccttacggccg

SEQ ID NO: 232692 - DNA, 25 bp, Mus musculus
gctcaacaatcccacggagcgcgtg

SEQ ID NO: 232693 - DNA, 25 bp, Mus musculus
tccaccttgtcgcaaaagactcagc

SEQ ID NO: 232694 - DNA, 25 bp, Mus musculus
ggccaggtggaaccgcctatctagt

SEQ ID NO: 232695 - DNA, 25 bp, Mus musculus
gcggggcttccatttcgcctgacct

SEQ ID NO: 232696 - DNA, 25 bp, Mus musculus
gggcttccatttcgcctgacctcgg

SEQ ID NO: 232697 - DNA, 25 bp, Mus musculus
gccgcggagtcgaacctgaatgaaa

SEQ ID NO: 232698 - DNA, 25 bp, Mus musculus
ctgaatgaaagtggcgcgccgctga

SEQ ID NO: 232699 - DNA, 25 bp, Mus musculus
agctatcggcgaggcggcacagaca

SEQ ID NO: 232700 - DNA, 25 bp, Mus musculus
ggcggcacagacatggcttacaaca

SEQ ID NO: 232701 - DNA, 25 bp, Mus musculus
gcttacaacaagatcccgccgcggt

SEQ ID NO: 232702 - DNA, 25 bp, Mus musculus
atcccgccgcggtggctgaactgtc

SEQ ID NO: 232703 - DNA, 25 bp, Mus musculus
gctgcgggagggttcgaatctcact

SEQ ID NO: 232704 - DNA, 25 bp, Mus musculus
ttcgaatctcactgcgccggccggg

SEQ ID NO: 232705 - DNA, 25 bp, Mus musculus
accgcgcgcttggtggtcgccagtc

SEQ ID NO: 232706 - DNA, 25 bp, Mus musculus
gtcgccagtcgggactcccgcaagg

SEQ ID NO: 232707 - DNA, 25 bp, Mus musculus
aaccgcctatctagttctcagcagc

SEQ ID NO: 232708 - DNA, 25 bp, Mus musculus
cggatagattcgcagagtcgggaac

SEQ ID NO: 232709 - DNA, 25 bp, Mus musculus
ccgcgcaagggctcattctacaatg

SEQ ID NO: 232710 - DNA, 25 bp, Mus musculus
cgggaacacaccaccgcaagctaga

SEQ ID NO: 232711 - DNA, 25 bp, Mus musculus
taacgcaaaaggcttgggacgctgc

SEQ ID NO: 232712 - DNA, 25 bp, Mus musculus
cgccaccgatctgacgcaagaggta

SEQ ID NO: 232713 - DNA, 25 bp, Mus musculus
ccttcttcgccagccctagggaggt

SEQ ID NO: 232714 - DNA, 25 bp, Mus musculus
gtcctgtttcccttagcaaccgaca

SEQ ID NO: 232715 - DNA, 25 bp, Mus musculus
ctcgtctcgtagatgtggcttccgc

SEQ ID NO: 232716 - DNA, 25 bp, Mus musculus
catgacgcagtacttggctggcttc

SEQ ID NO: 232717 - DNA, 25 bp, Mus musculus
ggcaacgcctcttgtcatcctgtca

SEQ ID NO: 232718 - DNA, 25 bp, Mus musculus
gtaagctggatgcttcccgagccca

SEQ ID NO: 232719 - DNA, 25 bp, Mus musculus
cctcggagtccagagagaggttata

SEQ ID NO: 232720 - DNA, 25 bp, Mus musculus
ttaattcaagctggccgaggccctc

SEQ ID NO: 232721 - DNA, 25 bp, Mus musculus
gcttgcttcgttcaaaactcaaaga

SEQ ID NO: 232722 - DNA, 25 bp, Mus musculus
tggtagccatctgggccatcaggcc

SEQ ID NO: 232723 - DNA, 25 bp, Mus musculus
gcaggtgctcttcggggagcagccc

SEQ ID NO: 232724 - DNA, 25 bp, Mus musculus
aagctgagctgcaggtgctcttcgg

SEQ ID NO: 232725 - DNA, 25 bp, Mus musculus
ggaagctgagctgcaggtgctcttc

SEQ ID NO: 232726 - DNA, 25 bp, Mus musculus
ctggaagctgagctgcaggtgctct

SEQ ID NO: 232727 - DNA, 25 bp, Mus musculus
agctgctgctggaagctgagctgca

SEQ ID NO: 232728 - DNA, 25 bp, Mus musculus
tgatccaactgcagatggcgcagct

SEQ ID NO: 232729 - DNA, 25 bp, Mus musculus
aggtgatccaactgcagatggcgca

SEQ ID NO: 232730 - DNA, 25 bp, Mus musculus
cggcaggtgatccaactgcagatgg

SEQ ID NO: 232731 - DNA, 25 bp, Mus musculus
cagcggcaggtgatccaactgcaga

SEQ ID NO: 232732 - DNA, 25 bp, Mus musculus
cgcagcggcaggtgatccaactgca

SEQ ID NO: 232733 - DNA, 25 bp, Mus musculus
atctgggccatcaggcctggctgcc

SEQ ID NO: 232734 - DNA, 25 bp, Mus musculus
agcagccctcctctgaggggcccgg

SEQ ID NO: 232735 - DNA, 25 bp, Mus musculus
ccatctgggccatcaggcctggctg

SEQ ID NO: 232736 - DNA, 25 bp, Mus musculus
cccgtgccagcctgggtctgtccgg

SEQ ID NO: 232737 - DNA, 25 bp, Mus musculus
cccaggtgtccctctccgtgtccgc

SEQ ID NO: 232738 - DNA, 25 bp, Mus musculus
ggggctctggaccttcccttctgct

SEQ ID NO: 232739 - DNA, 25 bp, Mus musculus
ttcccttctgctccgactccgttcc

SEQ ID NO: 232740 - DNA, 25 bp, Mus musculus
cggccaccttcaagttcacggcagg

SEQ ID NO: 232741 - DNA, 25 bp, Mus musculus
ccttcaagttcacggcaggcagctc

SEQ ID NO: 232742 - DNA, 25 bp, Mus musculus
ctcctgggctccgaactcgggaaca

SEQ ID NO: 232743 - DNA, 25 bp, Mus musculus
gctccatcccgacccggcggagggc

SEQ ID NO: 232744 - DNA, 25 bp, Mus musculus
gtcgcgttgcgccagttccaacggc

SEQ ID NO: 232745 - DNA, 25 bp, Mus musculus
cgccagttccaacggcgggaggcca

SEQ ID NO: 232746 - DNA, 25 bp, Mus musculus
aactcgcgcggccacgtgactgcag

SEQ ID NO: 232747 - DNA, 25 bp, Mus musculus
ccacgtgactgcagccggttgctag

SEQ ID NO: 232748 - DNA, 25 bp, Mus musculus
cgcggggactcctgggctccgaact

SEQ ID NO: 232749 - DNA, 25 bp, Mus musculus
aagttcacggcaggcagctccatcc

SEQ ID NO: 232750 - DNA, 25 bp, Mus musculus
cgagccttacctgtcgggcggacgg

SEQ ID NO: 232751 - DNA, 25 bp, Mus musculus
accgagggctcagggccgagcgcct

SEQ ID NO: 232752 - DNA, 25 bp, Mus musculus
agcgcctgcgggagtggagcgcagc

SEQ ID NO: 232753 - DNA, 25 bp, Mus musculus
agctccgcgacctcccgccgagggc

SEQ ID NO: 232754 - DNA, 25 bp, Mus musculus
cgctgcgccctagccagctgcgctc

SEQ ID NO: 232755 - DNA, 25 bp, Mus musculus
tagccagctgcgctcgccgatcgcc

SEQ ID NO: 232756 - DNA, 25 bp, Mus musculus
cggggcagacaaaggaggcagacaa

SEQ ID NO: 232757 - DNA, 25 bp, Mus musculus
ggaggcagacaaaggcgagcgcagc

SEQ ID NO: 232758 - DNA, 25 bp, Mus musculus
tgcgtaaaacccacctcggcgaggc

SEQ ID NO: 232759 - DNA, 25 bp, Mus musculus
cagcggtggcgcatctggagtggcc

SEQ ID NO: 232760 - DNA, 25 bp, Mus musculus
cccaacaatagattcaggctgtgag

SEQ ID NO: 232761 - DNA, 25 bp, Mus musculus
acaatagattcaggctgtgagttca

SEQ ID NO: 232762 - DNA, 25 bp, Mus musculus
tgtgagttcagctgcggctgcgtct

SEQ ID NO: 232763 - DNA, 25 bp, Mus musculus
ttcaggctgtgagttcagctgcggc

SEQ ID NO: 232764 - DNA, 25 bp, Mus musculus
tcggttgccttgagtccctacagac

SEQ ID NO: 232765 - DNA, 25 bp, Mus musculus
tggaacctgaggtcgaaaccggagc

SEQ ID NO: 232766 - DNA, 25 bp, Mus musculus
agcccggtcgtagattggaacctga

SEQ ID NO: 232767 - DNA, 25 bp, Mus musculus
tctcagacggtggtttctatagccc

SEQ ID NO: 232768 - DNA, 25 bp, Mus musculus
tcccaacagggcgaggttctgattg

SEQ ID NO: 232769 - DNA, 25 bp, Mus musculus
agctcgttccttggagattcctgta

SEQ ID NO: 232770 - DNA, 25 bp, Mus musculus
cacctgaaatccaaaggcggtttag

SEQ ID NO: 232771 - DNA, 25 bp, Mus musculus
aaatctcttgatcgctcccacctga

SEQ ID NO: 232772 - DNA, 25 bp, Mus musculus
agcgatcatacgcagaggccatgga

SEQ ID NO: 232773 - DNA, 25 bp, Mus musculus
tgcagcaggttctcacttgcaacta

SEQ ID NO: 232774 - DNA, 25 bp, Mus musculus
cccttggtacccagctgtgcttgca

SEQ ID NO: 232775 - DNA, 25 bp, Mus musculus
tttcggttgggcaagctaagagtcc

SEQ ID NO: 232776 - DNA, 25 bp, Mus musculus
aggcggccaaggatgaccaccctca

SEQ ID NO: 232777 - DNA, 25 bp, Mus musculus
tggagcgtctcggttgcttcttacc

SEQ ID NO: 232778 - DNA, 25 bp, Mus musculus
ggtcacgagcggacgtcctacccta

SEQ ID NO: 232779 - DNA, 25 bp, Mus musculus
ctagcgcctgaagcccggcgtccca

SEQ ID NO: 232780 - DNA, 25 bp, Mus musculus
cgtcccaaggagaagccggtgtcgc

SEQ ID NO: 232781 - DNA, 25 bp, Mus musculus
agaagccggtgtcgccaccgtccgg

SEQ ID NO: 232782 - DNA, 25 bp, Mus musculus
gggaccctcgcgtgcctacagcagg

SEQ ID NO: 232783 - DNA, 25 bp, Mus musculus
gtgcctacagcaggcccggcgtccc

SEQ ID NO: 232784 - DNA, 25 bp, Mus musculus
gccggactcgagagcacctgccgca

SEQ ID NO: 232785 - DNA, 25 bp, Mus musculus
cccacgagcgcgtgacctgcgcccg

SEQ ID NO: 232786 - DNA, 25 bp, Mus musculus
gctctccagggccttgggcctggac

SEQ ID NO: 232787 - DNA, 25 bp, Mus musculus
tcggcgacccggtcctctgtcacct

SEQ ID NO: 232788 - DNA, 25 bp, Mus musculus
cccgtcttcccactggcgtcacgca

SEQ ID NO: 232789 - DNA, 25 bp, Mus musculus
cgtcacgcaccgaccagcgggcctt

SEQ ID NO: 232790 - DNA, 25 bp, Mus musculus
ccttccgcgtcggtgcgaagatggt

SEQ ID NO: 232791 - DNA, 25 bp, Mus musculus
ggacgtcctaccctagcgcctgaag

SEQ ID NO: 232792 - DNA, 25 bp, Mus musculus
gcgcctttctgccagagttggttca

SEQ ID NO: 232793 - DNA, 25 bp, Mus musculus
cccatcacagcgtaggaaaattacc

SEQ ID NO: 232794 - DNA, 25 bp, Mus musculus
tagtccgactccatatgtcctcctg

SEQ ID NO: 232795 - DNA, 25 bp, Mus musculus
acgctgggtactggaactgcgcctt

SEQ ID NO: 232796 - DNA, 25 bp, Mus musculus
gggtacaggactcccagcccttagc

SEQ ID NO: 232797 - DNA, 25 bp, Mus musculus
tagaagcccacccattctgtagctg

SEQ ID NO: 232798 - DNA, 25 bp, Mus musculus
ttctccgtcaccagcttttagtccg

SEQ ID NO: 232799 - DNA, 25 bp, Mus musculus
tgcgacccgcccactgtttgtcaga

SEQ ID NO: 232800 - DNA, 25 bp, Mus musculus
cccttggatcctggggatgagcctt

SEQ ID NO: 232801 - DNA, 25 bp, Mus musculus
ccaaacgtctccttgctggggcgct

SEQ ID NO: 232802 - DNA, 25 bp, Mus musculus
aactacttttggtcgcgctgcgcca

SEQ ID NO: 232803 - DNA, 25 bp, Mus musculus
tctcttgacagcaccgcagcgatgg

SEQ ID NO: 232804 - DNA, 25 bp, Mus musculus
agccgggttacgttggagaacagca

SEQ ID NO: 232805 - DNA, 25 bp, Mus musculus
ctgtcacctgctcttagccgggtta

SEQ ID NO: 232806 - DNA, 25 bp, Mus musculus
ctcggggacagatttgtgcttttga

SEQ ID NO: 232807 - DNA, 25 bp, Mus musculus
ttgtgcttttgagtccgagctgcgc

SEQ ID NO: 232808 - DNA, 25 bp, Mus musculus
cgtcgagttcacgtggagagcactc

SEQ ID NO: 232809 - DNA, 25 bp, Mus musculus
ggagagcactcccagaatcgaaaag

SEQ ID NO: 232810 - DNA, 25 bp, Mus musculus
ggactataaattacagcttttgctt

SEQ ID NO: 232811 - DNA, 25 bp, Mus musculus
agttctactgcgcattcttggatgg

SEQ ID NO: 232812 - DNA, 25 bp, Mus musculus
tcttggatggaaaccctgccgagcc

SEQ ID NO: 232813 - DNA, 25 bp, Mus musculus
ggccatgagctccacctgaccaagt

SEQ ID NO: 232814 - DNA, 25 bp, Mus musculus
tgaccaagttccaactcgggctgcg

SEQ ID NO: 232815 - DNA, 25 bp, Mus musculus
ggccgctcgctcctctaaaagcagg

SEQ ID NO: 232816 - DNA, 25 bp, Mus musculus
agccaggcttgtccgagtcttcctg

SEQ ID NO: 232817 - DNA, 25 bp, Mus musculus
gccgccctgtcttctggcgaatcta

SEQ ID NO: 232818 - DNA, 25 bp, Mus musculus
cgactgtaggctcggggacagattt

SEQ ID NO: 232819 - DNA, 25 bp, Mus musculus
cggcggagtctgaacgtcgagttca

SEQ ID NO: 232820 - DNA, 25 bp, Mus musculus
ccactgtggctgctcaagtgccagc

SEQ ID NO: 232821 - DNA, 25 bp, Mus musculus
ccagctacggagctggtgcaggcct

SEQ ID NO: 232822 - DNA, 25 bp, Mus musculus
atgaggagcgggaccactggcaaca

SEQ ID NO: 232823 - DNA, 25 bp, Mus musculus
cgggaccactggcaacagttctact

SEQ ID NO: 232824 - DNA, 25 bp, Mus musculus
tggcaacagttctactttctgagca

SEQ ID NO: 232825 - DNA, 25 bp, Mus musculus
acagttctactttctgagcaagagg

SEQ ID NO: 232826 - DNA, 25 bp, Mus musculus
aagaggaggcgcaacctgctgcgca

SEQ ID NO: 232827 - DNA, 25 bp, Mus musculus
cctgctgcgcaacccttgtggggaa

SEQ ID NO: 232828 - DNA, 25 bp, Mus musculus
gtgagggccgcataattggatgccc

SEQ ID NO: 232829 - DNA, 25 bp, Mus musculus
gccgcataattggatgcccaccgtc

SEQ ID NO: 232830 - DNA, 25 bp, Mus musculus
tggatgcccaccgtctcttctagaa

SEQ ID NO: 232831 - DNA, 25 bp, Mus musculus
tctcttctagaaaacggccctcggc

SEQ ID NO: 232832 - DNA, 25 bp, Mus musculus
tcttctagaaaacggccctcggcgc

SEQ ID NO: 232833 - DNA, 25 bp, Mus musculus
ccgagctgccagctacggagctggt

SEQ ID NO: 232834 - DNA, 25 bp, Mus musculus
cctcatggggcttccagcagaactc

SEQ ID NO: 232835 - DNA, 25 bp, Mus musculus
tgtctgagtggcaacagtgtccctc

SEQ ID NO: 232836 - DNA, 25 bp, Mus musculus
ggcccatgccgtcgtagtagatctt

SEQ ID NO: 232837 - DNA, 25 bp, Mus musculus
cgattcgccaatgcgcgtgtgtttg

SEQ ID NO: 232838 - DNA, 25 bp, Mus musculus
tctcgtggatcgtgactagacgctc

SEQ ID NO: 232839 - DNA, 25 bp, Mus musculus
agacgctcgctcgtgaaaatgttgc

SEQ ID NO: 232840 - DNA, 25 bp, Mus musculus
aaaatgttgcgctccgcgtctccgc

SEQ ID NO: 232841 - DNA, 25 bp, Mus musculus
gcgtctccgcgagccagaaagatga

SEQ ID NO: 232842 - DNA, 25 bp, Mus musculus
atgcctcgtggttgcggatctcaaa

SEQ ID NO: 232843 - DNA, 25 bp, Mus musculus
cgtcaaagcgctgtgatgcctcgtg

SEQ ID NO: 232844 - DNA, 25 bp, Mus musculus
ccgggtggtccatgattttacgctc

SEQ ID NO: 232845 - DNA, 25 bp, Mus musculus
ctgattggttacctgaccctccggg

SEQ ID NO: 232846 - DNA, 25 bp, Mus musculus
cgctcacataggtgcgcgagtaatc

SEQ ID NO: 232847 - DNA, 25 bp, Mus musculus
cgctcactcgaattggctgctgatg

SEQ ID NO: 232848 - DNA, 25 bp, Mus musculus
tcacctcgctggctgagccgagcta

SEQ ID NO: 232849 - DNA, 25 bp, Mus musculus
gggcagcctttagagtcgcgcctcc

SEQ ID NO: 232850 - DNA, 25 bp, Mus musculus
tcaccgtccggcttaggcttgctct

SEQ ID NO: 232851 - DNA, 25 bp, Mus musculus
ggtacagccagcttcccgtgttggc

SEQ ID NO: 232852 - DNA, 25 bp, Mus musculus
gccttttatctgctgcccgcctttg

SEQ ID NO: 232853 - DNA, 25 bp, Mus musculus
cccagcgtgttggtgcaagcttcgg

SEQ ID NO: 232854 - DNA, 25 bp, Mus musculus
ggcgaacacttgtcccttgagggta

SEQ ID NO: 232855 - DNA, 25 bp, Mus musculus
gctctgagatctgaactctgtccca

SEQ ID NO: 232856 - DNA, 25 bp, Mus musculus
gaactctgtcccattagccggcttt

SEQ ID NO: 232857 - DNA, 25 bp, Mus musculus
ttagccggctttctcagggcgttga

SEQ ID NO: 232858 - DNA, 25 bp, Mus musculus
cctgagagcgagagaacttcccgca

SEQ ID NO: 232859 - DNA, 25 bp, Mus musculus
gcgcatgtggcacgttagacccttc

SEQ ID NO: 232860 - DNA, 25 bp, Mus musculus
tttcaggaggaaaggtcctcagagc

SEQ ID NO: 232861 - DNA, 25 bp, Mus musculus
ccgagctaggctgatacacgggtgc

SEQ ID NO: 232862 - DNA, 25 bp, Mus musculus
ccaattaaggtttgatccgtgcaca

SEQ ID NO: 232863 - DNA, 25 bp, Mus musculus
gtgatgggaccacgcttcataaatg

SEQ ID NO: 232864 - DNA, 25 bp, Mus musculus
ggctcattaacacgtgatgggacca

SEQ ID NO: 232865 - DNA, 25 bp, Mus musculus
ccagggcaggacaaaggctcattaa

SEQ ID NO: 232866 - DNA, 25 bp, Mus musculus
cgcagatcccttggcggagtctctg

SEQ ID NO: 232867 - DNA, 25 bp, Mus musculus
ggtaccgcgcagcaaagtttggagc

SEQ ID NO: 232868 - DNA, 25 bp, Mus musculus
atgagcagcgctggtgattaacggc

SEQ ID NO: 232869 - DNA, 25 bp, Mus musculus
ttcgccgtgataaatgtaaagacca

SEQ ID NO: 232870 - DNA, 25 bp, Mus musculus
cttcataaatgggactggagcgaga

SEQ ID NO: 232871 - DNA, 25 bp, Mus musculus
cagacggcggagtggaaccaattaa

SEQ ID NO: 232872 - DNA, 25 bp, Mus musculus
gcggagacctcacttggccggcctt

SEQ ID NO: 232873 - DNA, 25 bp, Mus musculus
acctccagtgaggtcctggcaatga

SEQ ID NO: 232874 - DNA, 25 bp, Mus musculus
agtggaaccaattaacgagcatgtc

SEQ ID NO: 232875 - DNA, 25 bp, Mus musculus
acgctcgtgtatagggttgcaattc

SEQ ID NO: 232876 - DNA, 25 bp, Mus musculus
ttctaaaagtgagccactcaagggg

SEQ ID NO: 232877 - DNA, 25 bp, Mus musculus
aggcgcacttgtgcctccaggatcg

SEQ ID NO: 232878 - DNA, 25 bp, Mus musculus
gccatcttgtgcgtcggcctcagga

SEQ ID NO: 232879 - DNA, 25 bp, Mus musculus
agcgaagcctgtctggggtcgcttc

SEQ ID NO: 232880 - DNA, 25 bp, Mus musculus
tccaggatcgttcgggaagcctgtc

SEQ ID NO: 232881 - DNA, 25 bp, Mus musculus
acctgtcacctgagcgaagcctgtc

SEQ ID NO: 232882 - DNA, 25 bp, Mus musculus
actgaagacagcaaccaggccatgc

SEQ ID NO: 232883 - DNA, 25 bp, Mus musculus
gaagcctgtcctgctcgggccattc

SEQ ID NO: 232884 - DNA, 25 bp, Mus musculus
tgctcgggccattcgttcttctgcg

SEQ ID NO: 232885 - DNA, 25 bp, Mus musculus
ctctcctgccaggatattaatcttc

SEQ ID NO: 232886 - DNA, 25 bp, Mus musculus
gcctgtaccgcagccatggaagcta

SEQ ID NO: 232887 - DNA, 25 bp, Mus musculus
gtggctaaagtcaattctaaaagtg

SEQ ID NO: 232888 - DNA, 25 bp, Mus musculus
atggaagctacacgtggctaaagtc

SEQ ID NO: 232889 - DNA, 25 bp, Mus musculus
gacagcctggcctgacctttctctg

SEQ ID NO: 232890 - DNA, 25 bp, Mus musculus
gctcttcggaatagtccttcgcctc

SEQ ID NO: 232891 - DNA, 25 bp, Mus musculus
acctccctggcctagaagacagcgg

SEQ ID NO: 232892 - DNA, 25 bp, Mus musculus
gcccgctgattggttgtagcgctta

SEQ ID NO: 232893 - DNA, 25 bp, Mus musculus
catcttcgagctcggcccgctgatt

SEQ ID NO: 232894 - DNA, 25 bp, Mus musculus
catgattattggtggatgttcctcc

SEQ ID NO: 232895 - DNA, 25 bp, Mus musculus
agccggtcccgaagctccaattctt

SEQ ID NO: 232896 - DNA, 25 bp, Mus musculus
ttcgcctccttttgcttgccactgg

SEQ ID NO: 232897 - DNA, 25 bp, Mus musculus
actcacgactgattggctcttcgga

SEQ ID NO: 232898 - DNA, 25 bp, Mus musculus
tcgtggaagtgaccgaagtcaactc

SEQ ID NO: 232899 - DNA, 25 bp, Mus musculus
tagtagcgacgtaccggaagtgttc

SEQ ID NO: 232900 - DNA, 25 bp, Mus musculus
cgtggctccacacggtcacagcgtg

SEQ ID NO: 232901 - DNA, 25 bp, Mus musculus
cagttctttcaacaggtccttaggg

SEQ ID NO: 232902 - DNA, 25 bp, Mus musculus
aagccgcctgtctgaaccgtacagc

SEQ ID NO: 232903 - DNA, 25 bp, Mus musculus
tgccactggttgctcgttttgtcta

SEQ ID NO: 232904 - DNA, 25 bp, Mus musculus
cccgatgcagacagcttcgtaaagg

SEQ ID NO: 232905 - DNA, 25 bp, Mus musculus
tcgggcagccggaacaatctcgcga

SEQ ID NO: 232906 - DNA, 25 bp, Mus musculus
gccggaacaatctcgcgagaagagc

SEQ ID NO: 232907 - DNA, 25 bp, Mus musculus
agagccgccctaggacggaaaaatg

SEQ ID NO: 232908 - DNA, 25 bp, Mus musculus
ggcgaccagtgcgaccaagcctgac

SEQ ID NO: 232909 - DNA, 25 bp, Mus musculus
gcggagatggtactgcctggcttcc

SEQ ID NO: 232910 - DNA, 25 bp, Mus musculus
gcatgcgtgttacgcccgcctcggg

SEQ ID NO: 232911 - DNA, 25 bp, Mus musculus
cccaatctcgtgggttgactgtccc

SEQ ID NO: 232912 - DNA, 25 bp, Mus musculus
acagcttcgtaaaggtgagttcgcg

SEQ ID NO: 232913 - DNA, 25 bp, Mus musculus
ctgttctggccggaaacgggtctga

SEQ ID NO: 232914 - DNA, 25 bp, Mus musculus
tggcttcgcgtgtcgagccgtgtcc

SEQ ID NO: 232915 - DNA, 25 bp, Mus musculus
gcgtccttgtcactacctctcccga

SEQ ID NO: 232916 - DNA, 25 bp, Mus musculus
gctgctgccctgacgtccgttaccc

SEQ ID NO: 232917 - DNA, 25 bp, Mus musculus
gaccaagcctgacgcggagatggta

SEQ ID NO: 232918 - DNA, 25 bp, Mus musculus
gtaaataaaagtcccatgtgcgccc

SEQ ID NO: 232919 - DNA, 25 bp, Mus musculus
gacatcctcgtcttccgcaggtatg

SEQ ID NO: 232920 - DNA, 25 bp, Mus musculus
cacgatctgctcaaaccctacgggg

SEQ ID NO: 232921 - DNA, 25 bp, Mus musculus
gcactaccctgctgcggctgacaga

SEQ ID NO: 232922 - DNA, 25 bp, Mus musculus
acggcccaaccaatcactgctagtt

SEQ ID NO: 232923 - DNA, 25 bp, Mus musculus
agcccggggagccaatgaactcctg

SEQ ID NO: 232924 - DNA, 25 bp, Mus musculus
atgaactcctggtgaagctgcgggc

SEQ ID NO: 232925 - DNA, 25 bp, Mus musculus
tgtgcgcccagactagacacgatct

SEQ ID NO: 232926 - DNA, 25 bp, Mus musculus
cgccggtgcagctgtcagaagttct

SEQ ID NO: 232927 - DNA, 25 bp, Mus musculus
ctgcgtccacgtgtcactatcggga

SEQ ID NO: 232928 - DNA, 25 bp, Mus musculus
aggacagggacctaacctcccagtg

SEQ ID NO: 232929 - DNA, 25 bp, Mus musculus
tctctgcccgcagtaaaacctacgg

SEQ ID NO: 232930 - DNA, 25 bp, Mus musculus
gagcagctgcttcaccaccggcgat

SEQ ID NO: 232931 - DNA, 25 bp, Mus musculus
gcgatcgcggtaccaagacatcctc

SEQ ID NO: 232932 - DNA, 25 bp, Mus musculus
ccgtgcgcgacagacaacgttgatg

SEQ ID NO: 232933 - DNA, 25 bp, Mus musculus
gcggtagatggcttcgcctgaccaa

SEQ ID NO: 232934 - DNA, 25 bp, Mus musculus
cgacaatctacagggactaggacgc

SEQ ID NO: 232935 - DNA, 25 bp, Mus musculus
gcccgtggcttcacagccaagcaga

SEQ ID NO: 232936 - DNA, 25 bp, Mus musculus
actgcccgcgcttaggccttaacga

SEQ ID NO: 232937 - DNA, 25 bp, Mus musculus
gggcctctccgaagcaacactcgag

SEQ ID NO: 232938 - DNA, 25 bp, Mus musculus
cggaggtccaagtcccatggtgaca

SEQ ID NO: 232939 - DNA, 25 bp, Mus musculus
aaggaatccgacaacagccgcgcta

SEQ ID NO: 232940 - DNA, 25 bp, Mus musculus
gctccgtgcccacaaaatggcgcta

SEQ ID NO: 232941 - DNA, 25 bp, Mus musculus
cctcccagaggctcggatgctagca

SEQ ID NO: 232942 - DNA, 25 bp, Mus musculus
gctagcaggctcttcggcgtataga

SEQ ID NO: 232943 - DNA, 25 bp, Mus musculus
cagctgggtctgaaaaactgacaga

SEQ ID NO: 232944 - DNA, 25 bp, Mus musculus
atgaaggacagaacggccactcggc

SEQ ID NO: 232945 - DNA, 25 bp, Mus musculus
cgctaggccactgctaggaagcaca

SEQ ID NO: 232946 - DNA, 25 bp, Mus musculus
ccaggccgggaagtctaatgtgccc

SEQ ID NO: 232947 - DNA, 25 bp, Mus musculus
cccaggccgggaagtctaatgtgcc

SEQ ID NO: 232948 - DNA, 25 bp, Mus musculus
ggccgggaagtctaatgtgcccgca

SEQ ID NO: 232949 - DNA, 25 bp, Mus musculus
gggaagtctaatgtgcccgcagccg

SEQ ID NO: 232950 - DNA, 25 bp, Mus musculus
gaagtctaatgtgcccgcagccgtt

SEQ ID NO: 232951 - DNA, 25 bp, Mus musculus
cccgccgcgctaatgtgcggtcgcc

SEQ ID NO: 232952 - DNA, 25 bp, Mus musculus
gagcgcaaatcgatacgcatcaggc

SEQ ID NO: 232953 - DNA, 25 bp, Mus musculus
cgcaaatcgatacgcatcaggcggc

SEQ ID NO: 232954 - DNA, 25 bp, Mus musculus
caaatcgatacgcatcaggcggcgg

SEQ ID NO: 232955 - DNA, 25 bp, Mus musculus
atcgatacgcatcaggcggcgggct

SEQ ID NO: 232956 - DNA, 25 bp, Mus musculus
ctaatgtgcccgcagccgttccggg

SEQ ID NO: 232957 - DNA, 25 bp, Mus musculus
cacagcgcccgccttgcaggagcca

SEQ ID NO: 232958 - DNA, 25 bp, Mus musculus
gtcccaggccgggaagtctaatgtg

SEQ ID NO: 232959 - DNA, 25 bp, Mus musculus
cccgagcgcaaatcgatacgcatca

SEQ ID NO: 232960 - DNA, 25 bp, Mus musculus
ccagccgccgttgatgcacaatgca

SEQ ID NO: 232961 - DNA, 25 bp, Mus musculus
cgcagagatgcctcagtccctttta

SEQ ID NO: 232962 - DNA, 25 bp, Mus musculus
cccgacgcgaagatggcaagtccca

SEQ ID NO: 232963 - DNA, 25 bp, Mus musculus
gggattcccgacaaacatcagtatg

SEQ ID NO: 232964 - DNA, 25 bp, Mus musculus
tcgggctcttctagacgacgtaagc

SEQ ID NO: 232965 - DNA, 25 bp, Mus musculus
ctagtgcactttctgtctcgggctc

SEQ ID NO: 232966 - DNA, 25 bp, Mus musculus
ctccagacctgggtgcagagctagt

SEQ ID NO: 232967 - DNA, 25 bp, Mus musculus
cctatgaccatcgaggcagagccta

SEQ ID NO: 232968 - DNA, 25 bp, Mus musculus
tcagtcctgagagaagtcaaccctg

SEQ ID NO: 232969 - DNA, 25 bp, Mus musculus
gaatccatcctgaagcgagaccctg

SEQ ID NO: 232970 - DNA, 25 bp, Mus musculus
agccagtgtttaccgcctgaatcca

SEQ ID NO: 232971 - DNA, 25 bp, Mus musculus
cctgctcttggtctccagtcgcata

SEQ ID NO: 232972 - DNA, 25 bp, Mus musculus
gcccgacctcggaacacacaattta

SEQ ID NO: 232973 - DNA, 25 bp, Mus musculus
gtcgcttgcgccgaacctactaatt

SEQ ID NO: 232974 - DNA, 25 bp, Mus musculus
agcgcggagccttcacaatattgtg

SEQ ID NO: 232975 - DNA, 25 bp, Mus musculus
tggcagcttcgcgaatgacggctgc

SEQ ID NO: 232976 - DNA, 25 bp, Mus musculus
cgggagcgcggagccttcacaatat

SEQ ID NO: 232977 - DNA, 25 bp, Mus musculus
tgcattattcatcggcagcccgcgt

SEQ ID NO: 232978 - DNA, 25 bp, Mus musculus
atgcattattcatcggcagcccgcg

SEQ ID NO: 232979 - DNA, 25 bp, Mus musculus
agtcatgcattattcatcggcagcc

SEQ ID NO: 232980 - DNA, 25 bp, Mus musculus
ccttagtcatgcattattcatcggc

SEQ ID NO: 232981 - DNA, 25 bp, Mus musculus
gcgccttagtcatgcattattcatc

SEQ ID NO: 232982 - DNA, 25 bp, Mus musculus
gggcgccttagtcatgcattattca

SEQ ID NO: 232983 - DNA, 25 bp, Mus musculus
ggggcgccttagtcatgcattattc

SEQ ID NO: 232984 - DNA, 25 bp, Mus musculus
ggcgcgaagtttccgggctgcagga

SEQ ID NO: 232985 - DNA, 25 bp, Mus musculus
tattgtggcagcttcgcgaatgacg

SEQ ID NO: 232986 - DNA, 25 bp, Mus musculus
caatattgtggcagcttcgcgaatg

SEQ ID NO: 232987 - DNA, 25 bp, Mus musculus
cgcggagccttcacaatattgtggc

SEQ ID NO: 232988 - DNA, 25 bp, Mus musculus
gaatgtgcagctgatgaccgtcggc

SEQ ID NO: 232989 - DNA, 25 bp, Mus musculus
acaccggggtgtatgttctgccagc

SEQ ID NO: 232990 - DNA, 25 bp, Mus musculus
ctctctcttttcgaagccagcgcga

SEQ ID NO: 232991 - DNA, 25 bp, Mus musculus
ctcggtggcatttgcagaatgtgca

SEQ ID NO: 232992 - DNA, 25 bp, Mus musculus
atcaggggaccctgccagacagacc

SEQ ID NO: 232993 - DNA, 25 bp, Mus musculus
tcgaccttcactatacaggagcgtc

SEQ ID NO: 232994 - DNA, 25 bp, Mus musculus
gctgaaatcggctcctggcagagga

SEQ ID NO: 232995 - DNA, 25 bp, Mus musculus
tcgccctggatctggggaaaagttc

SEQ ID NO: 232996 - DNA, 25 bp, Mus musculus
tccgaccgctctgctgtcggctgaa

SEQ ID NO: 232997 - DNA, 25 bp, Mus musculus
cggcaagtggcgcttcttactcttt

SEQ ID NO: 232998 - DNA, 25 bp, Mus musculus
tctatctgtgcctgggaagtttatc

SEQ ID NO: 232999 - DNA, 25 bp, Mus musculus
agtttatctcaagtgcgccgctcca

SEQ ID NO: 233000 - DNA, 25 bp, Mus musculus
accaggactcttgggtcgaccttca

SEQ ID NO: 233001 - DNA, 25 bp, Mus musculus
cctcctagggtggagagattcgacc

SEQ ID NO: 233002 - DNA, 25 bp, Mus musculus
gaggagagtcccttggctcccaccg

SEQ ID NO: 233003 - DNA, 25 bp, Mus musculus
ggggcgctcagtggcctttctctcc

SEQ ID NO: 233004 - DNA, 25 bp, Mus musculus
gtgaccggtggaacgccagtgttat

SEQ ID NO: 233005 - DNA, 25 bp, Mus musculus
gtggaacgccagtgttatgtaaata

SEQ ID NO: 233006 - DNA, 25 bp, Mus musculus
gttatgtaaatagcggggcctgccc

SEQ ID NO: 233007 - DNA, 25 bp, Mus musculus
gggacagacacagcaccgtgcgctt

SEQ ID NO: 233008 - DNA, 25 bp, Mus musculus
tgcgcttggctccaaacctgtttgt

SEQ ID NO: 233009 - DNA, 25 bp, Mus musculus
ggctgcgacccgctccagttttgtc

SEQ ID NO: 233010 - DNA, 25 bp, Mus musculus
cgcggcatccctttcggacttcaaa

SEQ ID NO: 233011 - DNA, 25 bp, Mus musculus
ggcagtggccctgaaaacgtgatca

SEQ ID NO: 233012 - DNA, 25 bp, Mus musculus
aaaacgtgatcagaggcggcccggt

SEQ ID NO: 233013 - DNA, 25 bp, Mus musculus
ccagcattgtctgcgcctgcgggca

SEQ ID NO: 233014 - DNA, 25 bp, Mus musculus
gcaccaccctggttacagcgcagct

SEQ ID NO: 233015 - DNA, 25 bp, Mus musculus
tggattcctccctttgccgccagca

SEQ ID NO: 233016 - DNA, 25 bp, Mus musculus
tttaagtgaattcggctttcgactc

SEQ ID NO: 233017 - DNA, 25 bp, Mus musculus
tccctgagctttgggagaagtcgcc

SEQ ID NO: 233018 - DNA, 25 bp, Mus musculus
tctgatctttcacctgccggagccg

SEQ ID NO: 233019 - DNA, 25 bp, Mus musculus
tgccaaactgttaccctgagtgtta

SEQ ID NO: 233020 - DNA, 25 bp, Mus musculus
ctgagtgttaccgtcaggagcaatg

SEQ ID NO: 233021 - DNA, 25 bp, Mus musculus
caggagcaatgacatcaggatttta

SEQ ID NO: 233022 - DNA, 25 bp, Mus musculus
ttcggggagtaatcagttgcaatta

SEQ ID NO: 233023 - DNA, 25 bp, Mus musculus
cgtgaggcgcggagcaaactttccc

SEQ ID NO: 233024 - DNA, 25 bp, Mus musculus
cagcccaagggcacctcggaaggga

SEQ ID NO: 233025 - DNA, 25 bp, Mus musculus
ggctttcgactctccgactatggtg

SEQ ID NO: 233026 - DNA, 25 bp, Mus musculus
tccgactatggtgagtaccggcagc

SEQ ID NO: 233027 - DNA, 25 bp, Mus musculus
gacagccacgggcagtttctgtttt

SEQ ID NO: 233028 - DNA, 25 bp, Mus musculus
tctgttttagttggtggaactcgga

SEQ ID NO: 233029 - DNA, 25 bp, Mus musculus
cgcgcgtgccgcaaaaagtctcgca

SEQ ID NO: 233030 - DNA, 25 bp, Mus musculus
ctgtggtttcggactcgggcacttc

SEQ ID NO: 233031 - DNA, 25 bp, Mus musculus
gactcgggcacttcgccttcgttct

SEQ ID NO: 233032 - DNA, 25 bp, Mus musculus
cgcctccgccgctggaggtgacatt

SEQ ID NO: 233033 - DNA, 25 bp, Mus musculus
aggtgacattcgatgcctgcgaggc

SEQ ID NO: 233034 - DNA, 25 bp, Mus musculus
aggatcagccatccgacggccagca

SEQ ID NO: 233035 - DNA, 25 bp, Mus musculus
acggccgcccaaagcacagtcgcag

SEQ ID NO: 233036 - DNA, 25 bp, Mus musculus
ctctggaggagaggctgcttcgaac

SEQ ID NO: 233037 - DNA, 25 bp, Mus musculus
aggctgcttcgaacagtggccagaa

SEQ ID NO: 233038 - DNA, 25 bp, Mus musculus
aacagtggccagaaggcgctgcgct

SEQ ID NO: 233039 - DNA, 25 bp, Mus musculus
cccaccgtgtctggtaaccattgag

SEQ ID NO: 233040 - DNA, 25 bp, Mus musculus
gtctggtaaccattgaggcgtcacc

SEQ ID NO: 233041 - DNA, 25 bp, Mus musculus
aaccattgaggcgtcaccgcgcgtc

SEQ ID NO: 233042 - DNA, 25 bp, Mus musculus
cggcatcggcctcggctgtggtttc

SEQ ID NO: 233043 - DNA, 25 bp, Mus musculus
ggccacagcgggttcctggacgcct

SEQ ID NO: 233044 - DNA, 25 bp, Mus musculus
ggctgcggcttcaccttcacctcca

SEQ ID NO: 233045 - DNA, 25 bp, Mus musculus
ccaccagccagcaatcgtccgcatc

SEQ ID NO: 233046 - DNA, 25 bp, Mus musculus
agcaagaactccagcctgagcgcct

SEQ ID NO: 233047 - DNA, 25 bp, Mus musculus
ctgccctgagcagcaagaactccag

SEQ ID NO: 233048 - DNA, 25 bp, Mus musculus
gacttctctgccctgagcagcaaga

SEQ ID NO: 233049 - DNA, 25 bp, Mus musculus
ctcgtggacttctctgccctgagca

SEQ ID NO: 233050 - DNA, 25 bp, Mus musculus
acgatgacctcgtggacttctctgc

SEQ ID NO: 233051 - DNA, 25 bp, Mus musculus
ggaatccagcaacgatgacctcgtg

SEQ ID NO: 233052 - DNA, 25 bp, Mus musculus
cacggagcacgaggaatccagcaac

SEQ ID NO: 233053 - DNA, 25 bp, Mus musculus
gccaaggacacggagcacgaggaat

SEQ ID NO: 233054 - DNA, 25 bp, Mus musculus
agcgcaagcacgagcggcggcacat

SEQ ID NO: 233055 - DNA, 25 bp, Mus musculus
agatgacctcacacaagcgcaagca

SEQ ID NO: 233056 - DNA, 25 bp, Mus musculus
aatcgtccgcatccctggccgctgc

SEQ ID NO: 233057 - DNA, 25 bp, Mus musculus
agccagatgacctcacacaagcgca

SEQ ID NO: 233058 - DNA, 25 bp, Mus musculus
gcggacgcacgcacatgtacaagca

SEQ ID NO: 233059 - DNA, 25 bp, Mus musculus
tggcttctgccagttcagctcgagc

SEQ ID NO: 233060 - DNA, 25 bp, Mus musculus
ctagaactgctctgtatgtgaaccc

SEQ ID NO: 233061 - DNA, 25 bp, Mus musculus
gggctcgctgctcttcctgcagaca

SEQ ID NO: 233062 - DNA, 25 bp, Mus musculus
cagatggactcgcacaagcgcaagc

SEQ ID NO: 233063 - DNA, 25 bp, Mus musculus
gccacacagtggtgggcatgtcgca

SEQ ID NO: 233064 - DNA, 25 bp, Mus musculus
gtgcccgactgcaagtacaagctca

SEQ ID NO: 233065 - DNA, 25 bp, Mus musculus
caccacggcaagcaggacgtgatca

SEQ ID NO: 233066 - DNA, 25 bp, Mus musculus
tgcacagacagcaccaaggtcactg

SEQ ID NO: 233067 - DNA, 25 bp, Mus musculus
gctgccgcttccgttgcacagacag

SEQ ID NO: 233068 - DNA, 25 bp, Mus musculus
tggacgacttcaagcgcttcaaggc

SEQ ID NO: 233069 - DNA, 25 bp, Mus musculus
acaacctggtgctggacgacttcaa

SEQ ID NO: 233070 - DNA, 25 bp, Mus musculus
tgtacaagcacgcacagcaccacga

SEQ ID NO: 233071 - DNA, 25 bp, Mus musculus
ccacgaccgcgtggacaacctggtg

SEQ ID NO: 233072 - DNA, 25 bp, Mus musculus
tagaaggtcccgagcatgtcgatgg

SEQ ID NO: 233073 - DNA, 25 bp, Mus musculus
ctggcccaagtttctcccaagagcg

SEQ ID NO: 233074 - DNA, 25 bp, Mus musculus
gttctcccgactagaccaaagtaga

SEQ ID NO: 233075 - DNA, 25 bp, Mus musculus
cagggcctgagacccggtcgagacc

SEQ ID NO: 233076 - DNA, 25 bp, Mus musculus
ccaaagtagaaggtcccgagcatgt

SEQ ID NO: 233077 - DNA, 25 bp, Mus musculus
ctcccaagagcgcttgcactagttc

SEQ ID NO: 233078 - DNA, 25 bp, Mus musculus
agtcgaccgccgctggcccaagttt

SEQ ID NO: 233079 - DNA, 25 bp, Mus musculus
aggcctgactagtcgaccgccgctg

SEQ ID NO: 233080 - DNA, 25 bp, Mus musculus
gccatcttcctcaggcctgactagt

SEQ ID NO: 233081 - DNA, 25 bp, Mus musculus
ctgcctgctccgacgacgccatctt

SEQ ID NO: 233082 - DNA, 25 bp, Mus musculus
cctgacagtcgcgacggggcagtcc

SEQ ID NO: 233083 - DNA, 25 bp, Mus musculus
gcttcaaggcgtcagggtcgccgcc

SEQ ID NO: 233084 - DNA, 25 bp, Mus musculus
tcctccgcttcaaggcgtcagggtc

SEQ ID NO: 233085 - DNA, 25 bp, Mus musculus
gcgcttgcactagttctcccgacta

SEQ ID NO: 233086 - DNA, 25 bp, Mus musculus
ccagtctcgaggagctgaggagcaa

SEQ ID NO: 233087 - DNA, 25 bp, Mus musculus
tgggctacctgggatttcccagagt

SEQ ID NO: 233088 - DNA, 25 bp, Mus musculus
cggcgtggcagcctccagtctcgag

SEQ ID NO: 233089 - DNA, 25 bp, Mus musculus
acagccgcgatcagcacggcgtggc

SEQ ID NO: 233090 - DNA, 25 bp, Mus musculus
tcaaaccgtgtctgctacgccgcaa

SEQ ID NO: 233091 - DNA, 25 bp, Mus musculus
cccggacgatgtccggcctctcaaa

SEQ ID NO: 233092 - DNA, 25 bp, Mus musculus
cccactttgaggatggagctgtcgc

SEQ ID NO: 233093 - DNA, 25 bp, Mus musculus
tcgtgccctggaacgcccgtgatta

SEQ ID NO: 233094 - DNA, 25 bp, Mus musculus
acgcccgtgattagccgccactaga

SEQ ID NO: 233095 - DNA, 25 bp, Mus musculus
ttagccgccactagaactacatctc

SEQ ID NO: 233096 - DNA, 25 bp, Mus musculus
gtgccttggtctcgcgtaacttgct

SEQ ID NO: 233097 - DNA, 25 bp, Mus musculus
gtctcgcgtaacttgctgagagaac

SEQ ID NO: 233098 - DNA, 25 bp, Mus musculus
tacatctcccgtcaggcagcgggag

SEQ ID NO: 233099 - DNA, 25 bp, Mus musculus
tgggatttcccagagtcgccaggtc

SEQ ID NO: 233100 - DNA, 25 bp, Mus musculus
tgtgacccggggttcaagcatctgt

SEQ ID NO: 233101 - DNA, 25 bp, Mus musculus
acacccggactctggcgagctggac

SEQ ID NO: 233102 - DNA, 25 bp, Mus musculus
cccatttattttatacctgccggtg

SEQ ID NO: 233103 - DNA, 25 bp, Mus musculus
atacctgccggtgagagaactcctg

SEQ ID NO: 233104 - DNA, 25 bp, Mus musculus
ggtgagagaactcctgcggctcctc

SEQ ID NO: 233105 - DNA, 25 bp, Mus musculus
gcgcgccactgtcggctcagacttt

SEQ ID NO: 233106 - DNA, 25 bp, Mus musculus
tgtcggctcagactttcccgcgcta

SEQ ID NO: 233107 - DNA, 25 bp, Mus musculus
ccgagggtcaaagcgcgaagcgcct

SEQ ID NO: 233108 - DNA, 25 bp, Mus musculus
gttcaagcatctgtaagaacgtgcg

SEQ ID NO: 233109 - DNA, 25 bp, Mus musculus
cagctcgcggaagggtcttagcgtt

SEQ ID NO: 233110 - DNA, 25 bp, Mus musculus
acccggggttcaagcatctgtaaga

SEQ ID NO: 233111 - DNA, 25 bp, Mus musculus
ccgaccctcacagcgccgggacacc

SEQ ID NO: 233112 - DNA, 25 bp, Mus musculus
ggtcaaagcgcgaagcgcctccttc

SEQ ID NO: 233113 - DNA, 25 bp, Mus musculus
tgcagccgagcgacgcatgcgcaca

SEQ ID NO: 233114 - DNA, 25 bp, Mus musculus
aaagtccgctgagtggattgccgcc

SEQ ID NO: 233115 - DNA, 25 bp, Mus musculus
acgcgggctgatttggagctgttaa

SEQ ID NO: 233116 - DNA, 25 bp, Mus musculus
ttctttgggtacgtttcaactgcgc

SEQ ID NO: 233117 - DNA, 25 bp, Mus musculus
cgcgtcctccagcttgaggctgagg

SEQ ID NO: 233118 - DNA, 25 bp, Mus musculus
tacgtttcaactgcgcggcttggcg

SEQ ID NO: 233119 - DNA, 25 bp, Mus musculus
ggcgtcggacctgcccaatcttggc

SEQ ID NO: 233120 - DNA, 25 bp, Mus musculus
caatcttggccacgcacgcgggctg

SEQ ID NO: 233121 - DNA, 25 bp, Mus musculus
tttggagctgttaagtgagcggttc

SEQ ID NO: 233122 - DNA, 25 bp, Mus musculus
gttctgaggcgtggccatgtgtacc

SEQ ID NO: 233123 - DNA, 25 bp, Mus musculus
catgtgtaccatggcctctgcaggg

SEQ ID NO: 233124 - DNA, 25 bp, Mus musculus
gtggctaatctcctgccgtcttgga

SEQ ID NO: 233125 - DNA, 25 bp, Mus musculus
tcttggagctggatctgcctgcacc

SEQ ID NO: 233126 - DNA, 25 bp, Mus musculus
tcgcgactccacagcaggactgaaa

SEQ ID NO: 233127 - DNA, 25 bp, Mus musculus
ccaggcctcggctagttctttgggt

SEQ ID NO: 233128 - DNA, 25 bp, Mus musculus
cagccgcaagctcccacgaaggggt

SEQ ID NO: 233129 - DNA, 25 bp, Mus musculus
cgactgcgcgtgtcggtcactcact

SEQ ID NO: 233130 - DNA, 25 bp, Mus musculus
aagtacagtgaagtccggctcccgg

SEQ ID NO: 233131 - DNA, 25 bp, Mus musculus
cccggcgcctcgagaggcttacaga

SEQ ID NO: 233132 - DNA, 25 bp, Mus musculus
ggcttacagagacgctggccaatca

SEQ ID NO: 233133 - DNA, 25 bp, Mus musculus
ccacgctattgggtctctgcggcgc

SEQ ID NO: 233134 - DNA, 25 bp, Mus musculus
tgcggcgcctgttataccacctgag

SEQ ID NO: 233135 - DNA, 25 bp, Mus musculus
tataccacctgagggcaaacggacc

SEQ ID NO: 233136 - DNA, 25 bp, Mus musculus
gcccagatctgtagagcgccgagca

SEQ ID NO: 233137 - DNA, 25 bp, Mus musculus
cgccgagcagtcgatggcacctcga

SEQ ID NO: 233138 - DNA, 25 bp, Mus musculus
ctcgagctggagaggagcgtttaaa

SEQ ID NO: 233139 - DNA, 25 bp, Mus musculus
ctaagtgttctagcgggaccttgca

SEQ ID NO: 233140 - DNA, 25 bp, Mus musculus
ctgcccgtcgttccttatggcctgg

SEQ ID NO: 233141 - DNA, 25 bp, Mus musculus
ccgagcgctccgaggcaagtacagt

SEQ ID NO: 233142 - DNA, 25 bp, Mus musculus
agccggccgagtcagaagacgccga

SEQ ID NO: 233143 - DNA, 25 bp, Mus musculus
actggacggtccagatgccatccgg

SEQ ID NO: 233144 - DNA, 25 bp, Mus musculus
ggggacaaaaagtggctcagtgacc

SEQ ID NO: 233145 - DNA, 25 bp, Mus musculus
gaatgacccgcttcgtaaggggaca

SEQ ID NO: 233146 - DNA, 25 bp, Mus musculus
cctgtgtagccgaatgacccgcttc

SEQ ID NO: 233147 - DNA, 25 bp, Mus musculus
gaagccggtgtccagagttccctcc

SEQ ID NO: 233148 - DNA, 25 bp, Mus musculus
gagcgacggagacactcgagcgccc

SEQ ID NO: 233149 - DNA, 25 bp, Mus musculus
tgaccaatagtaaagcgtggctgga

SEQ ID NO: 233150 - DNA, 25 bp, Mus musculus
agaccttgagacagatgaccaatag

SEQ ID NO: 233151 - DNA, 25 bp, Mus musculus
gtgaccaatcgcgatgaagaccttg

SEQ ID NO: 233152 - DNA, 25 bp, Mus musculus
agaccgacgcggaaggtgaccaatc

SEQ ID NO: 233153 - DNA, 25 bp, Mus musculus
agagaagcccggatccgagctgtcg

SEQ ID NO: 233154 - DNA, 25 bp, Mus musculus
tgccatccggagagctgggattatg

SEQ ID NO: 233155 - DNA, 25 bp, Mus musculus
gccgcccagctctgcatcgaggatt

SEQ ID NO: 233156 - DNA, 25 bp, Mus musculus
gtgacgcggcagctgcgtttttttc

SEQ ID NO: 233157 - DNA, 25 bp, Mus musculus
cgaggcactgaatcgccttggcttc

SEQ ID NO: 233158 - DNA, 25 bp, Mus musculus
tctggccacggccaccgctatgggg

SEQ ID NO: 233159 - DNA, 25 bp, Mus musculus
tcagcttcccaggttacccagggcg

SEQ ID NO: 233160 - DNA, 25 bp, Mus musculus
gggcccaggcgggaacagctccact

SEQ ID NO: 233161 - DNA, 25 bp, Mus musculus
gaacagctccactgcacactggatg

SEQ ID NO: 233162 - DNA, 25 bp, Mus musculus
gcgaagccctcgctggaagcgtaaa

SEQ ID NO: 233163 - DNA, 25 bp, Mus musculus
ctcgctggaagcgtaaatcctccta

SEQ ID NO: 233164 - DNA, 25 bp, Mus musculus
tcatcaaaacaacagggcggccatc

SEQ ID NO: 233165 - DNA, 25 bp, Mus musculus
tcgctctgggattcgccagccaata

SEQ ID NO: 233166 - DNA, 25 bp, Mus musculus
tgggattcgccagccaataagcagc

SEQ ID NO: 233167 - DNA, 25 bp, Mus musculus
agccaataagcagcgggcgtcgcgc

SEQ ID NO: 233168 - DNA, 25 bp, Mus musculus
cgatttcctcttcgcttgcatcctg

SEQ ID NO: 233169 - DNA, 25 bp, Mus musculus
gctatggggtcctctccaggcgcca

SEQ ID NO: 233170 - DNA, 25 bp, Mus musculus
agccatgggagggaagttgcatcca

SEQ ID NO: 233171 - DNA, 25 bp, Mus musculus
ttctcagctctgcacagcgaggtcc

SEQ ID NO: 233172 - DNA, 25 bp, Mus musculus
aatccgccctttctccgtgtcatta

SEQ ID NO: 233173 - DNA, 25 bp, Mus musculus
ccgtgtcattacacctttgcacaga

SEQ ID NO: 233174 - DNA, 25 bp, Mus musculus
acctttgcacagacagctcagcctg

SEQ ID NO: 233175 - DNA, 25 bp, Mus musculus
acagacagctcagcctgtgctttgg

SEQ ID NO: 233176 - DNA, 25 bp, Mus musculus
tgctttggggaaggaccgagcctcc

SEQ ID NO: 233177 - DNA, 25 bp, Mus musculus
tctgcacagcgaggtcctgcagcct

SEQ ID NO: 233178 - DNA, 25 bp, Mus musculus
ctggtggacgcttcgagttgaaact

SEQ ID NO: 233179 - DNA, 25 bp, Mus musculus
agttgaaactcaaagtggccattcg

SEQ ID NO: 233180 - DNA, 25 bp, Mus musculus
cctgcagagaagcagcgggagccat

SEQ ID NO: 233181 - DNA, 25 bp, Mus musculus
aagttgcatccagcgcgcctggtgc

SEQ ID NO: 233182 - DNA, 25 bp, Mus musculus
cctggtgcagctgtcacgtcattgc

SEQ ID NO: 233183 - DNA, 25 bp, Mus musculus
agtggccattcgttccagtctgcgc

SEQ ID NO: 233184 - DNA, 25 bp, Mus musculus
caatctcctaagctcccatgtgcgg

SEQ ID NO: 233185 - DNA, 25 bp, Mus musculus
cacgcgctccgctgtgacaacatga

SEQ ID NO: 233186 - DNA, 25 bp, Mus musculus
tcctaagctcccatgtgcggggcgt

SEQ ID NO: 233187 - DNA, 25 bp, Mus musculus
aacatgaaactgctcacccacaatc

SEQ ID NO: 233188 - DNA, 25 bp, Mus musculus
ctgtgacaacatgaaactgctcacc

SEQ ID NO: 233189 - DNA, 25 bp, Mus musculus
ccgactgaaggctatgagcacgacg

SEQ ID NO: 233190 - DNA, 25 bp, Mus musculus
ggtccgcatcaaccccgtggagttc

SEQ ID NO: 233191 - DNA, 25 bp, Mus musculus
cccaaagagccgactgaaggctatg

SEQ ID NO: 233192 - DNA, 25 bp, Mus musculus
ccgaggtacccaaagagccgactga

SEQ ID NO: 233193 - DNA, 25 bp, Mus musculus
cttggccgaggtacccaaagagccg

SEQ ID NO: 233194 - DNA, 25 bp, Mus musculus
tggcgcggatgatccccaaagtgga

SEQ ID NO: 233195 - DNA, 25 bp, Mus musculus
cgtggagttcaacccggagttcgtg

SEQ ID NO: 233196 - DNA, 25 bp, Mus musculus
gcaggccactgaggtccgcatcaac

SEQ ID NO: 233197 - DNA, 25 bp, Mus musculus
tcaacccggagttcgtggcgcggat

SEQ ID NO: 233198 - DNA, 25 bp, Mus musculus
ccgcaggatttgaatcggcggcgtt

SEQ ID NO: 233199 - DNA, 25 bp, Mus musculus
gaacttgggatcgtgcgccttggat

SEQ ID NO: 233200 - DNA, 25 bp, Mus musculus
cttggatgacgggagtcgtagtttc

SEQ ID NO: 233201 - DNA, 25 bp, Mus musculus
aagtatctccggatggagccttccc

SEQ ID NO: 233202 - DNA, 25 bp, Mus musculus
tgggtaaccgcctttcaggccgatc

SEQ ID NO: 233203 - DNA, 25 bp, Mus musculus
cggcggcgttgttattgacgccata

SEQ ID NO: 233204 - DNA, 25 bp, Mus musculus
ttattgacgccatattggggccggc

SEQ ID NO: 233205 - DNA, 25 bp, Mus musculus
aagagagggtcgagtgcattgctta

SEQ ID NO: 233206 - DNA, 25 bp, Mus musculus
gcattgcttagctctgtacggccgg

SEQ ID NO: 233207 - DNA, 25 bp, Mus musculus
acgagcttccgtctgcaccggcgtg

SEQ ID NO: 233208 - DNA, 25 bp, Mus musculus
cactggccgggtccacttccgaagg

SEQ ID NO: 233209 - DNA, 25 bp, Mus musculus
actctggatttcgacccgctgctga

SEQ ID NO: 233210 - DNA, 25 bp, Mus musculus
gcctcgccgcagaagtatctccgga

SEQ ID NO: 233211 - DNA, 25 bp, Mus musculus
agtttctgtgacttctgggtaaccg

SEQ ID NO: 233212 - DNA, 25 bp, Mus musculus
tggttccaaaccctgggatccgcta

SEQ ID NO: 233213 - DNA, 25 bp, Mus musculus
ggtcaccgggctaacgctcgcacag

SEQ ID NO: 233214 - DNA, 25 bp, Mus musculus
gctcgcacaggctcgtctcctagga

SEQ ID NO: 233215 - DNA, 25 bp, Mus musculus
ctcctaggacctcggtgggttgctt

SEQ ID NO: 233216 - DNA, 25 bp, Mus musculus
tgggttgcttaccaggccttgaagg

SEQ ID NO: 233217 - DNA, 25 bp, Mus musculus
caaacggccctagtcctccaggaga

SEQ ID NO: 233218 - DNA, 25 bp, Mus musculus
tagtcctccaggagacaacctcggc

SEQ ID NO: 233219 - DNA, 25 bp, Mus musculus
cggaagtgctcgctccatgcggtcc

SEQ ID NO: 233220 - DNA, 25 bp, Mus musculus
aggaggttgtcctgttttccgatca

SEQ ID NO: 233221 - DNA, 25 bp, Mus musculus
ctgttttccgatcagggaggacgga

SEQ ID NO: 233222 - DNA, 25 bp, Mus musculus
aagcgtttcgcaggcgtaggactcc

SEQ ID NO: 233223 - DNA, 25 bp, Mus musculus
gacctgcacacctcggcgggagctt

SEQ ID NO: 233224 - DNA, 25 bp, Mus musculus
ctgccttatttttgctccggtggtc

SEQ ID NO: 233225 - DNA, 25 bp, Mus musculus
cacagccggaagtgcgcgaatccag

SEQ ID NO: 233226 - DNA, 25 bp, Mus musculus
tgcttgtcatcgtctgtccaccctc

SEQ ID NO: 233227 - DNA, 25 bp, Mus musculus
tgttcctttcccgctctaggggctc

SEQ ID NO: 233228 - DNA, 25 bp, Mus musculus
tcctggtcccattgccctgtctctt

SEQ ID NO: 233229 - DNA, 25 bp, Mus musculus
gtctgtccaccctcctggtcccatt

SEQ ID NO: 233230 - DNA, 25 bp, Mus musculus
gtgttaaccaatgcctgttcctttc

SEQ ID NO: 233231 - DNA, 25 bp, Mus musculus
cccaaaggtgtgttaaccaatgcct

SEQ ID NO: 233232 - DNA, 25 bp, Mus musculus
tcccggccgcggtgactcacggaga

SEQ ID NO: 233233 - DNA, 25 bp, Mus musculus
ccacacccggcgctgctacctcccg

SEQ ID NO: 233234 - DNA, 25 bp, Mus musculus
cgccgcagaccaccctgctgccttc

SEQ ID NO: 233235 - DNA, 25 bp, Mus musculus
ggggtctcctccacaggtgtcccag

SEQ ID NO: 233236 - DNA, 25 bp, Mus musculus
gtctcctccacaggtgtcccagttg

SEQ ID NO: 233237 - DNA, 25 bp, Mus musculus
ccacaggtgtcccagttgctcaccc

SEQ ID NO: 233238 - DNA, 25 bp, Mus musculus
tctgggcccgcgtgcttgtcatcgt

SEQ ID NO: 233239 - DNA, 25 bp, Mus musculus
aggtgtgttaaccaatgcctgttcc

SEQ ID NO: 233240 - DNA, 25 bp, Mus musculus
gtaccctcgccggacccgagagaga

SEQ ID NO: 233241 - DNA, 25 bp, Mus musculus
caggacccagtgcaggaatagtgtc

SEQ ID NO: 233242 - DNA, 25 bp, Mus musculus
caggtgcacaggtacaggacccagt

SEQ ID NO: 233243 - DNA, 25 bp, Mus musculus
gggcccagatcgtatcaggtgcaca

SEQ ID NO: 233244 - DNA, 25 bp, Mus musculus
gcagatcgtctccagcaaggttcgg

SEQ ID NO: 233245 - DNA, 25 bp, Mus musculus
tgggtccgagttcgggcatagtaac

SEQ ID NO: 233246 - DNA, 25 bp, Mus musculus
tcatattgggcaaggttgggtccga

SEQ ID NO: 233247 - DNA, 25 bp, Mus musculus
ttcggatacgagtgcgcgagtcata

SEQ ID NO: 233248 - DNA, 25 bp, Mus musculus
tgtatcaggcaaggttcgggtccga

SEQ ID NO: 233249 - DNA, 25 bp, Mus musculus
tcctagtgcgcgcattgtatcaggc

SEQ ID NO: 233250 - DNA, 25 bp, Mus musculus
aagtgctgcagtcctgtagggcctc

SEQ ID NO: 233251 - DNA, 25 bp, Mus musculus
ttgggccgaatgcagaagtcatgcg

SEQ ID NO: 233252 - DNA, 25 bp, Mus musculus
ggaatagtgtcagcgcacagggatc

SEQ ID NO: 233253 - DNA, 25 bp, Mus musculus
tcagaaccgagtgcaaggttgggcc

SEQ ID NO: 233254 - DNA, 25 bp, Mus musculus
cgcctctgggaaatgctcctggact

SEQ ID NO: 233255 - DNA, 25 bp, Mus musculus
tcctcctccgtgatgcgcccacgct

SEQ ID NO: 233256 - DNA, 25 bp, Mus musculus
ttccaagaccggagctcacctcctc

SEQ ID NO: 233257 - DNA, 25 bp, Mus musculus
aagctccacgcccaatcccagctcc

SEQ ID NO: 233258 - DNA, 25 bp, Mus musculus
agggtgaggcctccaagctccacgc

SEQ ID NO: 233259 - DNA, 25 bp, Mus musculus
cgcagacagggtgaggcctccaagc

SEQ ID NO: 233260 - DNA, 25 bp, Mus musculus
catgttcgtacagttccccggatcc

SEQ ID NO: 233261 - DNA, 25 bp, Mus musculus
ggtccttctcatgttcgtacagttc

SEQ ID NO: 233262 - DNA, 25 bp, Mus musculus
accaggtccttctcatgttcgtaca

SEQ ID NO: 233263 - DNA, 25 bp, Mus musculus
ttccacaccaggtccttctcatgtt

SEQ ID NO: 233264 - DNA, 25 bp, Mus musculus
ttcgtggcgcatcttccacaccagg

SEQ ID NO: 233265 - DNA, 25 bp, Mus musculus
cctggacttcgtggcgcatcttcca

SEQ ID NO: 233266 - DNA, 25 bp, Mus musculus
aaatgctcctggacttcgtggcgca

SEQ ID NO: 233267 - DNA, 25 bp, Mus musculus
ctctgggaaatgctcctggacttcg

SEQ ID NO: 233268 - DNA, 25 bp, Mus musculus
ttgcgaaagccgtccctgggacgtc

SEQ ID NO: 233269 - DNA, 25 bp, Mus musculus
accaccacccacgtgctaggaagga

SEQ ID NO: 233270 - DNA, 25 bp, Mus musculus
agagtgaaatggctgcaccaccacc

SEQ ID NO: 233271 - DNA, 25 bp, Mus musculus
ctgtgagcccgagagtgaaatggct

SEQ ID NO: 233272 - DNA, 25 bp, Mus musculus
ctctcttggcctagaaggggaggcg

SEQ ID NO: 233273 - DNA, 25 bp, Mus musculus
tccctgggacgtcggaggctctctt

SEQ ID NO: 233274 - DNA, 25 bp, Mus musculus
tggtgtggttgcgaaagccgtccct

SEQ ID NO: 233275 - DNA, 25 bp, Mus musculus
agcggctaaaccagcacgcatgcgc

SEQ ID NO: 233276 - DNA, 25 bp, Mus musculus
agaaacttctctcctcgagtgcctg

SEQ ID NO: 233277 - DNA, 25 bp, Mus musculus
ggtggctagcccagagaaacttctc

SEQ ID NO: 233278 - DNA, 25 bp, Mus musculus
attcgcccgggctggtggctagccc

SEQ ID NO: 233279 - DNA, 25 bp, Mus musculus
cgtgctaggaaggacgcttagacgc

SEQ ID NO: 233280 - DNA, 25 bp, Mus musculus
acccacgtgctaggaaggacgctta

SEQ ID NO: 233281 - DNA, 25 bp, Mus musculus
cttggacgtggtttagattcgcccg

SEQ ID NO: 233282 - DNA, 25 bp, Mus musculus
cccaaggctaggcgcgagtgagcca

SEQ ID NO: 233283 - DNA, 25 bp, Mus musculus
ttaccggtccagcagctgggtcggc

SEQ ID NO: 233284 - DNA, 25 bp, Mus musculus
agcacttaccggtccagcagctggg

SEQ ID NO: 233285 - DNA, 25 bp, Mus musculus
ggagagcacttaccggtccagcagc

SEQ ID NO: 233286 - DNA, 25 bp, Mus musculus
tcctgtggagagcacttaccggtcc

SEQ ID NO: 233287 - DNA, 25 bp, Mus musculus
cgataaatcctgtggagagcactta

SEQ ID NO: 233288 - DNA, 25 bp, Mus musculus
acttctgcgataaatcctgtggaga

SEQ ID NO: 233289 - DNA, 25 bp, Mus musculus
ctccacacttctgcgataaatcctg

SEQ ID NO: 233290 - DNA, 25 bp, Mus musculus
cagtcttctccacacttctgcgata

SEQ ID NO: 233291 - DNA, 25 bp, Mus musculus
cgccaccttccgatccagtcttctc

SEQ ID NO: 233292 - DNA, 25 bp, Mus musculus
tcaaggcgcactggctgtgcctgct

SEQ ID NO: 233293 - DNA, 25 bp, Mus musculus
gggacagcccgcctactgacagtcc

SEQ ID NO: 233294 - DNA, 25 bp, Mus musculus
ccaggaggcgcccaaagtcaaggcg

SEQ ID NO: 233295 - DNA, 25 bp, Mus musculus
gcccaaagtcaaggcgcactggctg

SEQ ID NO: 233296 - DNA, 25 bp, Mus musculus
gcaatccggtagagcaccacgccgg

SEQ ID NO: 233297 - DNA, 25 bp, Mus musculus
cggctgctccccgacgaggctttta

SEQ ID NO: 233298 - DNA, 25 bp, Mus musculus
gtggcggagaatgcgtcccgcattc

SEQ ID NO: 233299 - DNA, 25 bp, Mus musculus
aatgcgtcccgcattcgcgagcagg

SEQ ID NO: 233300 - DNA, 25 bp, Mus musculus
gcattcgcgagcaggcctggtccgc

SEQ ID NO: 233301 - DNA, 25 bp, Mus musculus
gggcagctagccagcagcgcgctca

SEQ ID NO: 233302 - DNA, 25 bp, Mus musculus
cgccgtgaccttcgccgctttgtag

SEQ ID NO: 233303 - DNA, 25 bp, Mus musculus
tacggaagccctcggcactggctcg

SEQ ID NO: 233304 - DNA, 25 bp, Mus musculus
gaagccctcggcactggctcggacg

SEQ ID NO: 233305 - DNA, 25 bp, Mus musculus
agcgtccacagttgcaaagccactc

SEQ ID NO: 233306 - DNA, 25 bp, Mus musculus
gttgcaaagccactctctagagctg

SEQ ID NO: 233307 - DNA, 25 bp, Mus musculus
tctagagctggaaggagtcccgcct

SEQ ID NO: 233308 - DNA, 25 bp, Mus musculus
gctggaaggagtcccgcctgcgcct

SEQ ID NO: 233309 - DNA, 25 bp, Mus musculus
gcgcgggccgcaaaagagactccca

SEQ ID NO: 233310 - DNA, 25 bp, Mus musculus
cggcgctttccagccgctaggcaga

SEQ ID NO: 233311 - DNA, 25 bp, Mus musculus
ccggatcccgtacgcctattggacg

SEQ ID NO: 233312 - DNA, 25 bp, Mus musculus
cagcgcagtacctcctgggctagct

SEQ ID NO: 233313 - DNA, 25 bp, Mus musculus
tggcttcgctgccttcctcaggcag

SEQ ID NO: 233314 - DNA, 25 bp, Mus musculus
ttctctttctgctgagtgcccgtcg

SEQ ID NO: 233315 - DNA, 25 bp, Mus musculus
cgaagagatgaagcagcgtgttctc

SEQ ID NO: 233316 - DNA, 25 bp, Mus musculus
aacgcggattcccaaggccacggca

SEQ ID NO: 233317 - DNA, 25 bp, Mus musculus
tgacagtcacaccagccaggaattg

SEQ ID NO: 233318 - DNA, 25 bp, Mus musculus
aaaacgccaggaggccggagccaca

SEQ ID NO: 233319 - DNA, 25 bp, Mus musculus
tgaccgcagcgtgatcaggaaaacg

SEQ ID NO: 233320 - DNA, 25 bp, Mus musculus
cgcacctctgcagcggtgagtgacc

SEQ ID NO: 233321 - DNA, 25 bp, Mus musculus
gtggtgcagaccagcatccgttccc

SEQ ID NO: 233322 - DNA, 25 bp, Mus musculus
tcaaaaggagaatacggcgagaggc

SEQ ID NO: 233323 - DNA, 25 bp, Mus musculus
catttaccgtcccacgtggtgcaga

SEQ ID NO: 233324 - DNA, 25 bp, Mus musculus
taccatccgattcaggctgctcttg

SEQ ID NO: 233325 - DNA, 25 bp, Mus musculus
tggagctggttcctgcagcaagcgc

SEQ ID NO: 233326 - DNA, 25 bp, Mus musculus
aaccggtcttcggtgtcccatgccg

SEQ ID NO: 233327 - DNA, 25 bp, Mus musculus
ccctctcagttctctcagcgtggtg

SEQ ID NO: 233328 - DNA, 25 bp, Mus musculus
tccggggacccaagatcgatcatgg

SEQ ID NO: 233329 - DNA, 25 bp, Mus musculus
gctcatcttagggagcgactgtccc

SEQ ID NO: 233330 - DNA, 25 bp, Mus musculus
atcagaaccctaaggcgccctggga

SEQ ID NO: 233331 - DNA, 25 bp, Mus musculus
ggactagggccgctacaaatcagag

SEQ ID NO: 233332 - DNA, 25 bp, Mus musculus
cataacctcggttgcccggagaagc

SEQ ID NO: 233333 - DNA, 25 bp, Mus musculus
gcgggacaactcatcctctgctcta

SEQ ID NO: 233334 - DNA, 25 bp, Mus musculus
tttctcggtttgcagcctaggctca

SEQ ID NO: 233335 - DNA, 25 bp, Mus musculus
gcgactcctgcgctgagaagaaaaa

SEQ ID NO: 233336 - DNA, 25 bp, Mus musculus
gtgtcaccaggcagtctcccagaga

SEQ ID NO: 233337 - DNA, 25 bp, Mus musculus
ctaacttaactcagcagggtcgcga

SEQ ID NO: 233338 - DNA, 25 bp, Mus musculus
atgccgcagagtcgggctgcgcagc

SEQ ID NO: 233339 - DNA, 25 bp, Mus musculus
agcaccgtgggacccgagccaccac

SEQ ID NO: 233340 - DNA, 25 bp, Mus musculus
aaggatcggtgactcgggcgagcac

SEQ ID NO: 233341 - DNA, 25 bp, Mus musculus
ctggcgtgtcctcggatgcaagaaa

SEQ ID NO: 233342 - DNA, 25 bp, Mus musculus
ggccaagtttagcccgggatgccgc

SEQ ID NO: 233343 - DNA, 25 bp, Mus musculus
cctgggctggctagcacgacaggca

SEQ ID NO: 233344 - DNA, 25 bp, Mus musculus
catctcgctcgtccgggaagtggcc

SEQ ID NO: 233345 - DNA, 25 bp, Mus musculus
ggtgcagcttacttcatctcgctcg

SEQ ID NO: 233346 - DNA, 25 bp, Mus musculus
gtggggtgcagcttacttcatctcg

SEQ ID NO: 233347 - DNA, 25 bp, Mus musculus
attcgcagcccagagcaagcggggt

SEQ ID NO: 233348 - DNA, 25 bp, Mus musculus
atgcaagaaattcgcagcccagagc

SEQ ID NO: 233349 - DNA, 25 bp, Mus musculus
gtgtcctcggatgcaagaaattcgc

SEQ ID NO: 233350 - DNA, 25 bp, Mus musculus
cgacgcctttattccgcggaaggag

SEQ ID NO: 233351 - DNA, 25 bp, Mus musculus
cttacttcatctcgctcgtccggga

SEQ ID NO: 233352 - DNA, 25 bp, Mus musculus
gtgcatgcatcagccttagggtggt

SEQ ID NO: 233353 - DNA, 25 bp, Mus musculus
gcgattccaactccggcgaagcctg

SEQ ID NO: 233354 - DNA, 25 bp, Mus musculus
gagatgtggccataccgaccattta

SEQ ID NO: 233355 - DNA, 25 bp, Mus musculus
ttcttcccaggtgacagagatgtgg

SEQ ID NO: 233356 - DNA, 25 bp, Mus musculus
tgacccactttttcttcccaggtga

SEQ ID NO: 233357 - DNA, 25 bp, Mus musculus
cctggccaacgcatagaccagcgtg

SEQ ID NO: 233358 - DNA, 25 bp, Mus musculus
tcggtgcccttacggtgtccggcca

SEQ ID NO: 233359 - DNA, 25 bp, Mus musculus
atgtctgcaacctgcgcgataggac

SEQ ID NO: 233360 - DNA, 25 bp, Mus musculus
cctggctggaaagacgcggcttcca

SEQ ID NO: 233361 - DNA, 25 bp, Mus musculus
acaagggacgctgcgcaaactctga

SEQ ID NO: 233362 - DNA, 25 bp, Mus musculus
gtacccggaagaatcgcgatggccc

SEQ ID NO: 233363 - DNA, 25 bp, Mus musculus
cgcaaactctgagctctcgctgggg

SEQ ID NO: 233364 - DNA, 25 bp, Mus musculus
tgcgggacccaatgtctgcaacctg

SEQ ID NO: 233365 - DNA, 25 bp, Mus musculus
tgcgccctgaaactaggcagcgagc

SEQ ID NO: 233366 - DNA, 25 bp, Mus musculus
cctcgtcggacttgccaaacaggca

SEQ ID NO: 233367 - DNA, 25 bp, Mus musculus
tcctccttgcgctgcggagtgggaa

SEQ ID NO: 233368 - DNA, 25 bp, Mus musculus
ctgttctccgcggagccagagctga

SEQ ID NO: 233369 - DNA, 25 bp, Mus musculus
tgcccatcaaacctcgtcggacttg

SEQ ID NO: 233370 - DNA, 25 bp, Mus musculus
ggacctgggcaaagccgcccgagtc

SEQ ID NO: 233371 - DNA, 25 bp, Mus musculus
tgccaaacaggcaccgcgaatctga

SEQ ID NO: 233372 - DNA, 25 bp, Mus musculus
accgcgaatctgaggcgagcgccac

SEQ ID NO: 233373 - DNA, 25 bp, Mus musculus
ccttagacacggaggaggtggccat

SEQ ID NO: 233374 - DNA, 25 bp, Mus musculus
cctggcggaagcagaggcgacttcc

SEQ ID NO: 233375 - DNA, 25 bp, Mus musculus
gctttcgtaggtcgatcgcctgtca

SEQ ID NO: 233376 - DNA, 25 bp, Mus musculus
tcgcctgtcaggtacagtccagagc

SEQ ID NO: 233377 - DNA, 25 bp, Mus musculus
gtacagtccagagcggcgagccagc

SEQ ID NO: 233378 - DNA, 25 bp, Mus musculus
agggtgcagcctaggccgaccctgc

SEQ ID NO: 233379 - DNA, 25 bp, Mus musculus
cggagccagagctgatgcccatcaa

SEQ ID NO: 233380 - DNA, 25 bp, Mus musculus
ttgagcttgaggctgaaagagcatc

SEQ ID NO: 233381 - DNA, 25 bp, Mus musculus
cgctggagcttcagattcggatgtg

SEQ ID NO: 233382 - DNA, 25 bp, Mus musculus
ctcatgaaggggctaccagcttgga

SEQ ID NO: 233383 - DNA, 25 bp, Mus musculus
actcgggacgagattagagtgctca

SEQ ID NO: 233384 - DNA, 25 bp, Mus musculus
actcagggtaggattgtagagctca

SEQ ID NO: 233385 - DNA, 25 bp, Mus musculus
gaccgctgttgtgtagttgttagac

SEQ ID NO: 233386 - DNA, 25 bp, Mus musculus
tgctactcttcctgtcgctagcgga

SEQ ID NO: 233387 - DNA, 25 bp, Mus musculus
tctcggctgcctcgtacttctacgg

SEQ ID NO: 233388 - DNA, 25 bp, Mus musculus
cttctacggagtgctgcaggacttt

SEQ ID NO: 233389 - DNA, 25 bp, Mus musculus
gcacttcgtgggattgcgtccttca

SEQ ID NO: 233390 - DNA, 25 bp, Mus musculus
ttcagggcgctctctctactttcgc

SEQ ID NO: 233391 - DNA, 25 bp, Mus musculus
catcagggcggagcaatgcgcaagt

SEQ ID NO: 233392 - DNA, 25 bp, Mus musculus
tcagcatcgtccgaactacgcgcgg

SEQ ID NO: 233393 - DNA, 25 bp, Mus musculus
accagctccttcttctggacggtgg

SEQ ID NO: 233394 - DNA, 25 bp, Mus musculus
ctaggaggcccgtctggctcattcc

SEQ ID NO: 233395 - DNA, 25 bp, Mus musculus
gtctggctcattcctgactttgctc

SEQ ID NO: 233396 - DNA, 25 bp, Mus musculus
attcctgactttgctccctgttctc

SEQ ID NO: 233397 - DNA, 25 bp, Mus musculus
agcaccaggcgctctcggagtaccg

SEQ ID NO: 233398 - DNA, 25 bp, Mus musculus
aggcgctctcggagtaccggcccat

SEQ ID NO: 233399 - DNA, 25 bp, Mus musculus
tcctccacttccacggcagataaga

SEQ ID NO: 233400 - DNA, 25 bp, Mus musculus
gaagttggtcctcattccgctcata

SEQ ID NO: 233401 - DNA, 25 bp, Mus musculus
ttggtcctcattccgctcatattca

SEQ ID NO: 233402 - DNA, 25 bp, Mus musculus
tcattccgctcatattcatctgcct

SEQ ID NO: 233403 - DNA, 25 bp, Mus musculus
tccgcgtctggagcaccgtgcgctt

SEQ ID NO: 233404 - DNA, 25 bp, Mus musculus
agcaccgtgcgctttgtcctgacgc

SEQ ID NO: 233405 - DNA, 25 bp, Mus musculus
gtggttccccggctgtacagacacc

SEQ ID NO: 233406 - DNA, 25 bp, Mus musculus
cacggcagataagaagttggtcctc

SEQ ID NO: 233407 - DNA, 25 bp, Mus musculus
cattggacgcgcgcataggtggtct

SEQ ID NO: 233408 - DNA, 25 bp, Mus musculus
cgcaggcgcagtatccatgcatttc

SEQ ID NO: 233409 - DNA, 25 bp, Mus musculus
ctactagcttcgcttggggacccgg

SEQ ID NO: 233410 - DNA, 25 bp, Mus musculus
atggtccttgtctccaccggggtca

SEQ ID NO: 233411 - DNA, 25 bp, Mus musculus
ttaacgagcaggaaaggaagacaga

SEQ ID NO: 233412 - DNA, 25 bp, Mus musculus
cttctattggagtgatggcacgctg

SEQ ID NO: 233413 - DNA, 25 bp, Mus musculus
gcctcggtcacgctcttctattgga

SEQ ID NO: 233414 - DNA, 25 bp, Mus musculus
ctaggcccagaaaggcaggacaacc

SEQ ID NO: 233415 - DNA, 25 bp, Mus musculus
aggctcgccaggcattccagctatg

SEQ ID NO: 233416 - DNA, 25 bp, Mus musculus
gccacgccgagtgcgtgtgagactc

SEQ ID NO: 233417 - DNA, 25 bp, Mus musculus
cacccaattccacgcgggagtgagg

SEQ ID NO: 233418 - DNA, 25 bp, Mus musculus
gtgggcacgtgcacccactagcctg

SEQ ID NO: 233419 - DNA, 25 bp, Mus musculus
accggggtcagctctcctactagct

SEQ ID NO: 233420 - DNA, 25 bp, Mus musculus
agccgcgaaggtcatcagcaaggtc

SEQ ID NO: 233421 - DNA, 25 bp, Mus musculus
cctactgccaggtatggtccttgtc

SEQ ID NO: 233422 - DNA, 25 bp, Mus musculus
cgagcggccgcaccatataaggaca

SEQ ID NO: 233423 - DNA, 25 bp, Mus musculus
gagacgcacagctggccgagctgcc

SEQ ID NO: 233424 - DNA, 25 bp, Mus musculus
cacatctggccaagtgcggtgtcca

SEQ ID NO: 233425 - DNA, 25 bp, Mus musculus
aagtgcggtgtccaccgcggacctc

SEQ ID NO: 233426 - DNA, 25 bp, Mus musculus
agcggagaacaaggtatagcctgta

SEQ ID NO: 233427 - DNA, 25 bp, Mus musculus
gcctgtatttaggttccagtcctta

SEQ ID NO: 233428 - DNA, 25 bp, Mus musculus
cttatatggcgatgcgcacgagcgc

SEQ ID NO: 233429 - DNA, 25 bp, Mus musculus
atataaggacacacggcaggcgccg

SEQ ID NO: 233430 - DNA, 25 bp, Mus musculus
agctggtgcacgctcattggccgac

SEQ ID NO: 233431 - DNA, 25 bp, Mus musculus
attggccgacgcgtctctcggcaac

SEQ ID NO: 233432 - DNA, 25 bp, Mus musculus
gcaaccgggctctcacgagtggaaa

SEQ ID NO: 233433 - DNA, 25 bp, Mus musculus
tctcacgagtggaaaggagccagcc

SEQ ID NO: 233434 - DNA, 25 bp, Mus musculus
attctttctcccttggcatcccggt

SEQ ID NO: 233435 - DNA, 25 bp, Mus musculus
tccagtccttatatggcgatgcgca

SEQ ID NO: 233436 - DNA, 25 bp, Mus musculus
ttgaggtagaccatcccgagggtca

SEQ ID NO: 233437 - DNA, 25 bp, Mus musculus
ccatcccgagggtcagtacagggct

SEQ ID NO: 233438 - DNA, 25 bp, Mus musculus
cgagcagggcggaccaagcacaaag

SEQ ID NO: 233439 - DNA, 25 bp, Mus musculus
gggcggaccaagcacaaagccgcgc

SEQ ID NO: 233440 - DNA, 25 bp, Mus musculus
ggcggggagcccatctcccaggttc

SEQ ID NO: 233441 - DNA, 25 bp, Mus musculus
ccgcccggagcgtgcactaagggct

SEQ ID NO: 233442 - DNA, 25 bp, Mus musculus
ttgccttctgctcattttattaaaa

SEQ ID NO: 233443 - DNA, 25 bp, Mus musculus
aaagaaaatggaagagcgagctgga

SEQ ID NO: 233444 - DNA, 25 bp, Mus musculus
agcgagctggagcaaacatcccgcc

SEQ ID NO: 233445 - DNA, 25 bp, Mus musculus
tattggcccgtcctctactgacgtc

SEQ ID NO: 233446 - DNA, 25 bp, Mus musculus
gtcctctactgacgtcacgaagaga

SEQ ID NO: 233447 - DNA, 25 bp, Mus musculus
cgtcacgaagagacagaccaatggt

SEQ ID NO: 233448 - DNA, 25 bp, Mus musculus
ccaatggtgatggtcgatactgcga

SEQ ID NO: 233449 - DNA, 25 bp, Mus musculus
gacccgcttgaggtagaccatcccg

SEQ ID NO: 233450 - DNA, 25 bp, Mus musculus
cttttgtttggaggtgcaattcacc

SEQ ID NO: 233451 - DNA, 25 bp, Mus musculus
cggcctccttttgtttggaggtgca

SEQ ID NO: 233452 - DNA, 25 bp, Mus musculus
cattgtgtgtgctagccccatggtg

SEQ ID NO: 233453 - DNA, 25 bp, Mus musculus
cagcccgggttttgctggccgccgt

SEQ ID NO: 233454 - DNA, 25 bp, Mus musculus
gtcgcgctcaggcggctctttctct

SEQ ID NO: 233455 - DNA, 25 bp, Mus musculus
ctctttctctctagtctgggtcaca

SEQ ID NO: 233456 - DNA, 25 bp, Mus musculus
tctctagtctgggtcacaggcacgt

SEQ ID NO: 233457 - DNA, 25 bp, Mus musculus
ctcaaggagttcgagtgagcgctgt

SEQ ID NO: 233458 - DNA, 25 bp, Mus musculus
tctcgccctggggtttgcgggatcc

SEQ ID NO: 233459 - DNA, 25 bp, Mus musculus
ggcgcttgtagcagcccggacccac

SEQ ID NO: 233460 - DNA, 25 bp, Mus musculus
caagtctccggctggaagttggaca

SEQ ID NO: 233461 - DNA, 25 bp, Mus musculus
ttggaggtgcaattcaccgcccagc

SEQ ID NO: 233462 - DNA, 25 bp, Mus musculus
aggactggcccagccgcacgggcaa

SEQ ID NO: 233463 - DNA, 25 bp, Mus musculus
ggacgcaagtctccggctggaagtt

SEQ ID NO: 233464 - DNA, 25 bp, Mus musculus
ggccctggcgggtagcaagtttcac

SEQ ID NO: 233465 - DNA, 25 bp, Mus musculus
gtttcgctgcctcactgtgggcatg

SEQ ID NO: 233466 - DNA, 25 bp, Mus musculus
tggcgggagcaaacgcctcagccgc

SEQ ID NO: 233467 - DNA, 25 bp, Mus musculus
gaaggccgccttggctccgattgct

SEQ ID NO: 233468 - DNA, 25 bp, Mus musculus
gcggcctctttacctgtagctgcga

SEQ ID NO: 233469 - DNA, 25 bp, Mus musculus
tagctgcgagtctccctcggatcgg

SEQ ID NO: 233470 - DNA, 25 bp, Mus musculus
ctggaaccgggcaaagtgaaagtct

SEQ ID NO: 233471 - DNA, 25 bp, Mus musculus
ggctccaggactaccggctccttgt

SEQ ID NO: 233472 - DNA, 25 bp, Mus musculus
agatcggcccgagacacttctgcga

SEQ ID NO: 233473 - DNA, 25 bp, Mus musculus
caccgttgaggtgacctgctgctct

SEQ ID NO: 233474 - DNA, 25 bp, Mus musculus
tccgcgggtgaaaagcagctatgtt

SEQ ID NO: 233475 - DNA, 25 bp, Mus musculus
ttggtttattgcaacgcgggctgtt

SEQ ID NO: 233476 - DNA, 25 bp, Mus musculus
tttgttgtttgctccttcctgcagc

SEQ ID NO: 233477 - DNA, 25 bp, Mus musculus
gaaggcatctgcttccgcgggtgaa

SEQ ID NO: 233478 - DNA, 25 bp, Mus musculus
cgtccagacgggaggcatccctttc

SEQ ID NO: 233479 - DNA, 25 bp, Mus musculus
cggtacctgtacgtccagacgggag

SEQ ID NO: 233480 - DNA, 25 bp, Mus musculus
cgcaggaggaaacgcccggtacctg

SEQ ID NO: 233481 - DNA, 25 bp, Mus musculus
gtgacgtcacggctgcatcccgccg

SEQ ID NO: 233482 - DNA, 25 bp, Mus musculus
tgtacgtccagacgggaggcatccc

SEQ ID NO: 233483 - DNA, 25 bp, Mus musculus
agacgggaggcatccctttcccagg

SEQ ID NO: 233484 - DNA, 25 bp, Mus musculus
gacgggaggcatccctttcccaggc

SEQ ID NO: 233485 - DNA, 25 bp, Mus musculus
ttcctggttcttcggggtacagctc

SEQ ID NO: 233486 - DNA, 25 bp, Mus musculus
tggttcttcggggtacagctccgtc

SEQ ID NO: 233487 - DNA, 25 bp, Mus musculus
tcttcggggtacagctccgtcctag

SEQ ID NO: 233488 - DNA, 25 bp, Mus musculus
ttcggggtacagctccgtcctagcc

SEQ ID NO: 233489 - DNA, 25 bp, Mus musculus
acagctccgtcctagcccggcgccc

SEQ ID NO: 233490 - DNA, 25 bp, Mus musculus
ggcagctgcagcatcaccccgtggg

SEQ ID NO: 233491 - DNA, 25 bp, Mus musculus
cctgtacgtccagacgggaggcatc

SEQ ID NO: 233492 - DNA, 25 bp, Mus musculus
gattgctagtccctggttggtacca

SEQ ID NO: 233493 - DNA, 25 bp, Mus musculus
ccctcaggagacgaggctgctagcg

SEQ ID NO: 233494 - DNA, 25 bp, Mus musculus
ccacgcaaactcttcggtagcggca

SEQ ID NO: 233495 - DNA, 25 bp, Mus musculus
aaactcttcggtagcggcatcgccc

SEQ ID NO: 233496 - DNA, 25 bp, Mus musculus
ggcgttgacgtcacgttgtcgctca

SEQ ID NO: 233497 - DNA, 25 bp, Mus musculus
gtcacgttgtcgctcaccgtataaa

SEQ ID NO: 233498 - DNA, 25 bp, Mus musculus
ttgtcgctcaccgtataaatacggg

SEQ ID NO: 233499 - DNA, 25 bp, Mus musculus
ataaatacgggcgtcggctgcgccg

SEQ ID NO: 233500 - DNA, 25 bp, Mus musculus
acacgacacgtctccacagcctggg

SEQ ID NO: 233501 - DNA, 25 bp, Mus musculus
cggcccggaaagcttctgcgagaag

SEQ ID NO: 233502 - DNA, 25 bp, Mus musculus
cagaggcggcccaaatagaaacgtc

SEQ ID NO: 233503 - DNA, 25 bp, Mus musculus
cttgagtctcggtgagactcggcga

SEQ ID NO: 233504 - DNA, 25 bp, Mus musculus
tggttggtaccagtcttgagtctcg

SEQ ID NO: 233505 - DNA, 25 bp, Mus musculus
gtgggctcggagattgctagtccct

SEQ ID NO: 233506 - DNA, 25 bp, Mus musculus
tcggaggcactttccgcgtgctttc

SEQ ID NO: 233507 - DNA, 25 bp, Mus musculus
gctagccgccactcggaggcacttt

SEQ ID NO: 233508 - DNA, 25 bp, Mus musculus
cccacgcatcacaactttggtcaag

SEQ ID NO: 233509 - DNA, 25 bp, Mus musculus
tgcgctcgctccaacccggaggatg

SEQ ID NO: 233510 - DNA, 25 bp, Mus musculus
tccaacccggaggatgctgtgcaga

SEQ ID NO: 233511 - DNA, 25 bp, Mus musculus
acccggaggatgctgtgcagagcct

SEQ ID NO: 233512 - DNA, 25 bp, Mus musculus
gcctcctccacccacgcgaagccac

SEQ ID NO: 233513 - DNA, 25 bp, Mus musculus
gaagccaccgctagtccgcaggaac

SEQ ID NO: 233514 - DNA, 25 bp, Mus musculus
gcaggaacctcgcacccgacgtgta

SEQ ID NO: 233515 - DNA, 25 bp, Mus musculus
acccgacgtgtacccagcacgcatg

SEQ ID NO: 233516 - DNA, 25 bp, Mus musculus
agcgaatagaggctactgcggctgc

SEQ ID NO: 233517 - DNA, 25 bp, Mus musculus
ggctgcgcagcgcttgtaccatctc

SEQ ID NO: 233518 - DNA, 25 bp, Mus musculus
cgggaacagctagccgccactcgga

SEQ ID NO: 233519 - DNA, 25 bp, Mus musculus
acaactttggtcaagccttccagta

SEQ ID NO: 233520 - DNA, 25 bp, Mus musculus
ctcggagcccacgaaaggtcaggtc

SEQ ID NO: 233521 - DNA, 25 bp, Mus musculus
ttcgcagccggaaagtttctgggga

SEQ ID NO: 233522 - DNA, 25 bp, Mus musculus
gcgcgaactgctcttgcgggactca

SEQ ID NO: 233523 - DNA, 25 bp, Mus musculus
ttggctgagcctaatcgtagtgggc

SEQ ID NO: 233524 - DNA, 25 bp, Mus musculus
gctgccgtcgattggctgagcctaa

SEQ ID NO: 233525 - DNA, 25 bp, Mus musculus
agaggcgcacggctcacttccgtca

SEQ ID NO: 233526 - DNA, 25 bp, Mus musculus
cttgccggaagtgagtcggctgacc

SEQ ID NO: 233527 - DNA, 25 bp, Mus musculus
tcccacagagcaacgcttgccggaa

SEQ ID NO: 233528 - DNA, 25 bp, Mus musculus
ccgggacgctgtgaacgcttctcgg

SEQ ID NO: 233529 - DNA, 25 bp, Mus musculus
acctgcgaggggactagacccgcct

SEQ ID NO: 233530 - DNA, 25 bp, Mus musculus
gaaattctgactcggagacctgcga

SEQ ID NO: 233531 - DNA, 25 bp, Mus musculus
tctgacctttaaggccacgctggcg

SEQ ID NO: 233532 - DNA, 25 bp, Mus musculus
cgagtaccgcgaccttgcggacttc

SEQ ID NO: 233533 - DNA, 25 bp, Mus musculus
agagtgggcgagctctgacctttaa

SEQ ID NO: 233534 - DNA, 25 bp, Mus musculus
aaaaaaggatgggatccgctcagtc

SEQ ID NO: 233535 - DNA, 25 bp, Mus musculus
agactgctccttggccggcgaccag

SEQ ID NO: 233536 - DNA, 25 bp, Mus musculus
ttggccggcgaccagctgcagcctg

SEQ ID NO: 233537 - DNA, 25 bp, Mus musculus
ccagctgcagcctgggcagactttc

SEQ ID NO: 233538 - DNA, 25 bp, Mus musculus
tgcagcctgggcagactttcacagt

SEQ ID NO: 233539 - DNA, 25 bp, Mus musculus
ctgggcagactttcacagtggtata

SEQ ID NO: 233540 - DNA, 25 bp, Mus musculus
gcagactttcacagtggtatacctg

SEQ ID NO: 233541 - DNA, 25 bp, Mus musculus
gtggtatacctgtgtctctttgaga

SEQ ID NO: 233542 - DNA, 25 bp, Mus musculus
gcgcgcaggcaaggagtgcgaatga

SEQ ID NO: 233543 - DNA, 25 bp, Mus musculus
gcgtctggccctgctggacgctccc

SEQ ID NO: 233544 - DNA, 25 bp, Mus musculus
ctcagtccacctggaggaatcaacc

SEQ ID NO: 233545 - DNA, 25 bp, Mus musculus
ggatccgctcagtccacctggagga

SEQ ID NO: 233546 - DNA, 25 bp, Mus musculus
tgggactggcatgagactgctcctt

SEQ ID NO: 233547 - DNA, 25 bp, Mus musculus
gcgcgcccagaggtagaaggaaaaa

SEQ ID NO: 233548 - DNA, 25 bp, Mus musculus
tgtggccctcgacctggctcggacc

SEQ ID NO: 233549 - DNA, 25 bp, Mus musculus
gcgactgtctcagctaccgacattc

SEQ ID NO: 233550 - DNA, 25 bp, Mus musculus
agcgactgtctcagctaccgacatt

SEQ ID NO: 233551 - DNA, 25 bp, Mus musculus
agagcgactgtctcagctaccgaca

SEQ ID NO: 233552 - DNA, 25 bp, Mus musculus
acagagcgactgtctcagctaccga

SEQ ID NO: 233553 - DNA, 25 bp, Mus musculus
gcggtgctatgctggcatccagtgg

SEQ ID NO: 233554 - DNA, 25 bp, Mus musculus
gactgtctcagctaccgacattcag

SEQ ID NO: 233555 - DNA, 25 bp, Mus musculus
tgcggaaatgttgaagcgctatgtc

SEQ ID NO: 233556 - DNA, 25 bp, Mus musculus
ggaatgcggaaatgttgaagcgcta

SEQ ID NO: 233557 - DNA, 25 bp, Mus musculus
ggacgagtgaaagtgtgacgtacct

SEQ ID NO: 233558 - DNA, 25 bp, Mus musculus
aagggcagccccttctcacaccggg

SEQ ID NO: 233559 - DNA, 25 bp, Mus musculus
acaggacgagtgaaagtgtgacgta

SEQ ID NO: 233560 - DNA, 25 bp, Mus musculus
caacaactacgaaaaagtggaggag

SEQ ID NO: 233561 - DNA, 25 bp, Mus musculus
ctggcatccagtgggggtcgctcca

SEQ ID NO: 233562 - DNA, 25 bp, Mus musculus
ggaaagaagtgccaatgaacagata

SEQ ID NO: 233563 - DNA, 25 bp, Mus musculus
acaaaacacactccgctcagtacgt

SEQ ID NO: 233564 - DNA, 25 bp, Mus musculus
gcagtgcgtccacgttgttgagccc

SEQ ID NO: 233565 - DNA, 25 bp, Mus musculus
gccacgcagtgcgtccacgttgttg

SEQ ID NO: 233566 - DNA, 25 bp, Mus musculus
cgccagcacaaagccacgcagtgcg

SEQ ID NO: 233567 - DNA, 25 bp, Mus musculus
taaacgaagagaggcgccagcacaa

SEQ ID NO: 233568 - DNA, 25 bp, Mus musculus
gtgccaatgaacagataaacgaaga

SEQ ID NO: 233569 - DNA, 25 bp, Mus musculus
gccagcaggaaagaagtgccaatga

SEQ ID NO: 233570 - DNA, 25 bp, Mus musculus
accggccagcaggaaagaagtgcca

SEQ ID NO: 233571 - DNA, 25 bp, Mus musculus
cacgaaaccggccagcaggaaagaa

SEQ ID NO: 233572 - DNA, 25 bp, Mus musculus
ggacactgaagactccgatgcgcac

SEQ ID NO: 233573 - DNA, 25 bp, Mus musculus
tagaggacactgaagactccgatgc

SEQ ID NO: 233574 - DNA, 25 bp, Mus musculus
acagtgtagaggacactgaagactc

SEQ ID NO: 233575 - DNA, 25 bp, Mus musculus
cagataaacgaagagaggcgccagc

SEQ ID NO: 233576 - DNA, 25 bp, Mus musculus
cagccctgcggggagtttagaaatt

SEQ ID NO: 233577 - DNA, 25 bp, Mus musculus
cgccattcgcgggtgcgcgctcatt

SEQ ID NO: 233578 - DNA, 25 bp, Mus musculus
ctttggaaagcatttggaaattcgc

SEQ ID NO: 233579 - DNA, 25 bp, Mus musculus
tccacaggtggttggctgtggcctc

SEQ ID NO: 233580 - DNA, 25 bp, Mus musculus
ttaaaggatgcggacgagacctgac

SEQ ID NO: 233581 - DNA, 25 bp, Mus musculus
gacctgacgctaaccacgggaggga

SEQ ID NO: 233582 - DNA, 25 bp, Mus musculus
ggacctcacgctgcggtggtcactt

SEQ ID NO: 233583 - DNA, 25 bp, Mus musculus
cggtggtcacttacgggctcaacac

SEQ ID NO: 233584 - DNA, 25 bp, Mus musculus
acgcactgtcttggtcgccgggacc

SEQ ID NO: 233585 - DNA, 25 bp, Mus musculus
ctctcgctcggcctctgaaggactt

SEQ ID NO: 233586 - DNA, 25 bp, Mus musculus
cctctgaaggacttgagcttcccgc

SEQ ID NO: 233587 - DNA, 25 bp, Mus musculus
attcaggctggcaggaattccgcgg

SEQ ID NO: 233588 - DNA, 25 bp, Mus musculus
tacgggctcaacacgcactgtcttg

SEQ ID NO: 233589 - DNA, 25 bp, Mus musculus
gaaattcgcttctaatccacaggtg

SEQ ID NO: 233590 - DNA, 25 bp, Mus musculus
aggcggaccgtactgcagataacca

SEQ ID NO: 233591 - DNA, 25 bp, Mus musculus
caactactggttgctgcattgcgca

SEQ ID NO: 233592 - DNA, 25 bp, Mus musculus
tgcgcatgcgcacattcaactactg

SEQ ID NO: 233593 - DNA, 25 bp, Mus musculus
aacactggccttcgactgcgcatgc

SEQ ID NO: 233594 - DNA, 25 bp, Mus musculus
aggcctacgtactgcggataaccga

SEQ ID NO: 233595 - DNA, 25 bp, Mus musculus
cgggtaactgcacggataggcttta

SEQ ID NO: 233596 - DNA, 25 bp, Mus musculus
cctccgaaaactgggtaactgcgca

SEQ ID NO: 233597 - DNA, 25 bp, Mus musculus
cgggtaactgcgcagaccatccgta

SEQ ID NO: 233598 - DNA, 25 bp, Mus musculus
ccgtactgcggataactggataatc

SEQ ID NO: 233599 - DNA, 25 bp, Mus musculus
caggcaggccataccacggataact

SEQ ID NO: 233600 - DNA, 25 bp, Mus musculus
ggataattggtaactgcggccgccc

SEQ ID NO: 233601 - DNA, 25 bp, Mus musculus
taggctggccgtaccacagataacc

SEQ ID NO: 233602 - DNA, 25 bp, Mus musculus
accgggtaactacgtaggctgatca

SEQ ID NO: 233603 - DNA, 25 bp, Mus musculus
ccagctgtgccatgcataaccagta

SEQ ID NO: 233604 - DNA, 25 bp, Mus musculus
gctcagccgtcgtaaagcgcagccg

SEQ ID NO: 233605 - DNA, 25 bp, Mus musculus
tttatgtagggccttcgtgctgccc

SEQ ID NO: 233606 - DNA, 25 bp, Mus musculus
cgtagaccgggcaccctttatgtag

SEQ ID NO: 233607 - DNA, 25 bp, Mus musculus
agtgttgttttcttcctgcggaggc

SEQ ID NO: 233608 - DNA, 25 bp, Mus musculus
ggccatgttgccgtagtgttgtttt

SEQ ID NO: 233609 - DNA, 25 bp, Mus musculus
cgaaactgtgtctgtgcgctgctct

SEQ ID NO: 233610 - DNA, 25 bp, Mus musculus
ctactgctgcaaggcgatttatgtc

SEQ ID NO: 233611 - DNA, 25 bp, Mus musculus
tcgatgtagcgttcgcgcgcctcaa

SEQ ID NO: 233612 - DNA, 25 bp, Mus musculus
tttcctaagaccctacgcgcgaggc

SEQ ID NO: 233613 - DNA, 25 bp, Mus musculus
taggatgctctggagtccgtctttg

SEQ ID NO: 233614 - DNA, 25 bp, Mus musculus
gaaacctcgtcctcaaagccgcagg

SEQ ID NO: 233615 - DNA, 25 bp, Mus musculus
cttggggacttgctttaggatgctc

SEQ ID NO: 233616 - DNA, 25 bp, Mus musculus
ttatgtcgactttacggcgtgtggc

SEQ ID NO: 233617 - DNA, 25 bp, Mus musculus
tccgtctttgaggtcgtggtaccta

SEQ ID NO: 233618 - DNA, 25 bp, Mus musculus
tcgggactgtgttctccgttaccca

SEQ ID NO: 233619 - DNA, 25 bp, Mus musculus
tcgagagttcgagactagcccaacg

SEQ ID NO: 233620 - DNA, 25 bp, Mus musculus
ccgtggagtcataggtatctggatc

SEQ ID NO: 233621 - DNA, 25 bp, Mus musculus
gattattggttttcgctgaagcgcc

SEQ ID NO: 233622 - DNA, 25 bp, Mus musculus
tgcgaaggttctgctaagcgtatct

SEQ ID NO: 233623 - DNA, 25 bp, Mus musculus
attggtctagcgcagtgtcattctc

SEQ ID NO: 233624 - DNA, 25 bp, Mus musculus
cctagctcgcttgtgattgggtatg

SEQ ID NO: 233625 - DNA, 25 bp, Mus musculus
caagagctggcaatcttcggccgga

SEQ ID NO: 233626 - DNA, 25 bp, Mus musculus
gccgagcatcatcactctgccaaga

SEQ ID NO: 233627 - DNA, 25 bp, Mus musculus
cgcactcttggtctttgggccctag

SEQ ID NO: 233628 - DNA, 25 bp, Mus musculus
aaataagcgcacctcccggactctg

SEQ ID NO: 233629 - DNA, 25 bp, Mus musculus
cgggacactcgagccctgttagaag

SEQ ID NO: 233630 - DNA, 25 bp, Mus musculus
ggttcgccagctgggaagagccaaa

SEQ ID NO: 233631 - DNA, 25 bp, Mus musculus
ccgggttttcagcacggttcgccag

SEQ ID NO: 233632 - DNA, 25 bp, Mus musculus
agctcgggataattcggtccgtgtc

SEQ ID NO: 233633 - DNA, 25 bp, Mus musculus
tccgtgtcttcgtcttaatttagca

SEQ ID NO: 233634 - DNA, 25 bp, Mus musculus
agcccgcgctctgtcaagttgcaga

SEQ ID NO: 233635 - DNA, 25 bp, Mus musculus
tgtcaagttgcagaagacccgggtg

SEQ ID NO: 233636 - DNA, 25 bp, Mus musculus
ggcgcgttgcaaactccagctgcga

SEQ ID NO: 233637 - DNA, 25 bp, Mus musculus
tggtctctctgcacatccttcttgg

SEQ ID NO: 233638 - DNA, 25 bp, Mus musculus
agacccaggtgagcgactgctgtcc

SEQ ID NO: 233639 - DNA, 25 bp, Mus musculus
ggtgccttttgctggcttctctggc

SEQ ID NO: 233640 - DNA, 25 bp, Mus musculus
ttctctggcatcagagagcccgctc

SEQ ID NO: 233641 - DNA, 25 bp, Mus musculus
gagagaggctgcaacccactcgcac

SEQ ID NO: 233642 - DNA, 25 bp, Mus musculus
cactcgcaccttccggggatgtcag

SEQ ID NO: 233643 - DNA, 25 bp, Mus musculus
tgagcacggtgtttcagaggcgaca

SEQ ID NO: 233644 - DNA, 25 bp, Mus musculus
catccctgtgatcagagcccggcgg

SEQ ID NO: 233645 - DNA, 25 bp, Mus musculus
gggttagcctaagcgagctcccacc

SEQ ID NO: 233646 - DNA, 25 bp, Mus musculus
aggaatctcaggtctcgggtcatgc

SEQ ID NO: 233647 - DNA, 25 bp, Mus musculus
accgcgccatgtaagggaaggtctc

SEQ ID NO: 233648 - DNA, 25 bp, Mus musculus
tcccagactgccgtgactccggatg

SEQ ID NO: 233649 - DNA, 25 bp, Mus musculus
gccgcgcctgcaaaggaccaagatg

SEQ ID NO: 233650 - DNA, 25 bp, Mus musculus
ggataagaagaaccctcgccctgcc

SEQ ID NO: 233651 - DNA, 25 bp, Mus musculus
aggtgactcaggctttcagagcttc

SEQ ID NO: 233652 - DNA, 25 bp, Mus musculus
cctgggcaatcacaaggatcgcgta

SEQ ID NO: 233653 - DNA, 25 bp, Mus musculus
caagatgttgagctgtgtggagacc

SEQ ID NO: 233654 - DNA, 25 bp, Mus musculus
agaccgcgggtagaaagcctctcac

SEQ ID NO: 233655 - DNA, 25 bp, Mus musculus
ctctcacacctgctagctgagggga

SEQ ID NO: 233656 - DNA, 25 bp, Mus musculus
ggcggaatccgagccggtttcatca

SEQ ID NO: 233657 - DNA, 25 bp, Mus musculus
gcgtcagcttccagggcaccaatga

SEQ ID NO: 233658 - DNA, 25 bp, Mus musculus
tgacaagagtccatcctgcgcgcgg

SEQ ID NO: 233659 - DNA, 25 bp, Mus musculus
gtcatgcctgcgagacctgacaaga

SEQ ID NO: 233660 - DNA, 25 bp, Mus musculus
gctgcctgccttccgcagcgtcttc

SEQ ID NO: 233661 - DNA, 25 bp, Mus musculus
ccctctcggagcatcatgggaaatg

SEQ ID NO: 233662 - DNA, 25 bp, Mus musculus
ttcgtcacaacggagccctctcgga

SEQ ID NO: 233663 - DNA, 25 bp, Mus musculus
tgcgcttgttccgttcgtcacaacg

SEQ ID NO: 233664 - DNA, 25 bp, Mus musculus
gtctgcgcttgttccgttcgtcaca

SEQ ID NO: 233665 - DNA, 25 bp, Mus musculus
gagagccgacttgggaatagcgccc

SEQ ID NO: 233666 - DNA, 25 bp, Mus musculus
ctgctggtgcccgagagccgacttg

SEQ ID NO: 233667 - DNA, 25 bp, Mus musculus
tgtcatcgcctcagcccaacatggc

SEQ ID NO: 233668 - DNA, 25 bp, Mus musculus
cggccgcctcctgtcatcgcctcag

SEQ ID NO: 233669 - DNA, 25 bp, Mus musculus
ttagcttgggaacagctccccctca

SEQ ID NO: 233670 - DNA, 25 bp, Mus musculus
gcgcagccgcgctcaagggcatcga

SEQ ID NO: 233671 - DNA, 25 bp, Mus musculus
acaacggagccctctcggagcatca

SEQ ID NO: 233672 - DNA, 25 bp, Mus musculus
ctcagagccctgactctccgcctcc

SEQ ID NO: 233673 - DNA, 25 bp, Mus musculus
cggggcgtccttgcccgcatcgatg

SEQ ID NO: 233674 - DNA, 25 bp, Mus musculus
ccatctgagtagctcccaatttatc

SEQ ID NO: 233675 - DNA, 25 bp, Mus musculus
ggtctcgcatcgaccttgcgccata

SEQ ID NO: 233676 - DNA, 25 bp, Mus musculus
gcgccatacatacggttctgcacca

SEQ ID NO: 233677 - DNA, 25 bp, Mus musculus
tgcaccaagaggcagcaccctagga

SEQ ID NO: 233678 - DNA, 25 bp, Mus musculus
gatgaggaacccgagaccctaggtg

SEQ ID NO: 233679 - DNA, 25 bp, Mus musculus
ccctgcagacaaagagtcactttaa

SEQ ID NO: 233680 - DNA, 25 bp, Mus musculus
aatttatcagtctgtcgccgcgctc

SEQ ID NO: 233681 - DNA, 25 bp, Mus musculus
ggctttgtagttctcggcccgaatc

SEQ ID NO: 233682 - DNA, 25 bp, Mus musculus
cgagcctgatgagccaccgaactac

SEQ ID NO: 233683 - DNA, 25 bp, Mus musculus
caagacccatgataccctgcgactg

SEQ ID NO: 233684 - DNA, 25 bp, Mus musculus
tgcgactggtgctacattctgcgtg

SEQ ID NO: 233685 - DNA, 25 bp, Mus musculus
tcgggctcaccacttagatcctgca

SEQ ID NO: 233686 - DNA, 25 bp, Mus musculus
agatcctgcaggtcagggctgtcaa

SEQ ID NO: 233687 - DNA, 25 bp, Mus musculus
ctggagcgcagcaatgaggctcacc

SEQ ID NO: 233688 - DNA, 25 bp, Mus musculus
tccaattcccgaggcagagtccaga

SEQ ID NO: 233689 - DNA, 25 bp, Mus musculus
ttctcttgtggtgggttaaccttgc

SEQ ID NO: 233690 - DNA, 25 bp, Mus musculus
tccatgggtgaaaccgcgacttttc

SEQ ID NO: 233691 - DNA, 25 bp, Mus musculus
aagcttctctcctgcgtgctccatg

SEQ ID NO: 233692 - DNA, 25 bp, Mus musculus
gtcctgcaggctcccatggtctgag

SEQ ID NO: 233693 - DNA, 25 bp, Mus musculus
gagtccagacctcgcacggctctga

SEQ ID NO: 233694 - DNA, 25 bp, Mus musculus
gttaaccttgcctcgctcgatgacg

SEQ ID NO: 233695 - DNA, 25 bp, Mus musculus
tgctcttcgtgggttttactccgga

SEQ ID NO: 233696 - DNA, 25 bp, Mus musculus
cacgctcctggaagtctccgtggga

SEQ ID NO: 233697 - DNA, 25 bp, Mus musculus
gtcagtctgtccatcgattccacgc

SEQ ID NO: 233698 - DNA, 25 bp, Mus musculus
ctggcctttgtgtccgtcagtctgt

SEQ ID NO: 233699 - DNA, 25 bp, Mus musculus
tagacctcccagagcctggcctttg

SEQ ID NO: 233700 - DNA, 25 bp, Mus musculus
gggcggccacggaatcctagacctc

SEQ ID NO: 233701 - DNA, 25 bp, Mus musculus
tctgaggcacagctcgggtcctgca

SEQ ID NO: 233702 - DNA, 25 bp, Mus musculus
cctgcacgcgggttgtgctgtgctc

SEQ ID NO: 233703 - DNA, 25 bp, Mus musculus
gctccgtgttgttagcgggcttccc

SEQ ID NO: 233704 - DNA, 25 bp, Mus musculus
cccaggcactcgtgtttcctcttcc

SEQ ID NO: 233705 - DNA, 25 bp, Mus musculus
tgtcagcaaaagaggtttctgctgc

SEQ ID NO: 233706 - DNA, 25 bp, Mus musculus
aaaagaggtttctgctgctgccgcc

SEQ ID NO: 233707 - DNA, 25 bp, Mus musculus
ccttggctctaaagccgtggcagcc

SEQ ID NO: 233708 - DNA, 25 bp, Mus musculus
tctcgcccttctcttccctgcgctc

SEQ ID NO: 233709 - DNA, 25 bp, Mus musculus
gtcagcaccgcgcacaatgagaaaa

SEQ ID NO: 233710 - DNA, 25 bp, Mus musculus
ccgcgcacaatgagaaaatgaaagc

SEQ ID NO: 233711 - DNA, 25 bp, Mus musculus
tgagaaaatgaaagctacccttttg

SEQ ID NO: 233712 - DNA, 25 bp, Mus musculus
aaagctacccttttgcgctggtgcg

SEQ ID NO: 233713 - DNA, 25 bp, Mus musculus
ttgtgctgtgctccgtgttgttagc

SEQ ID NO: 233714 - DNA, 25 bp, Mus musculus
actggactccatcgctgtggctgct

SEQ ID NO: 233715 - DNA, 25 bp, Mus musculus
gtgcgctggtgcactggactccatc

SEQ ID NO: 233716 - DNA, 25 bp, Mus musculus
gaaggccgcgcactaattttaatca

SEQ ID NO: 233717 - DNA, 25 bp, Mus musculus
ttttgaagctcagttcgcgtggacc

SEQ ID NO: 233718 - DNA, 25 bp, Mus musculus
cgcgcctcttggacttccttggtag

SEQ ID NO: 233719 - DNA, 25 bp, Mus musculus
gagaaaccagagtttgtgcccgccc

SEQ ID NO: 233720 - DNA, 25 bp, Mus musculus
ttcaggttccggttaggctcaaaga

SEQ ID NO: 233721 - DNA, 25 bp, Mus musculus
ccactgtatgcgaagaaggagcgta

SEQ ID NO: 233722 - DNA, 25 bp, Mus musculus
ttacggttagatggtggggacctca

SEQ ID NO: 233723 - DNA, 25 bp, Mus musculus
gactcgcaggcggaagttgctttcc

SEQ ID NO: 233724 - DNA, 25 bp, Mus musculus
cgtgctctcaagcagggctgcctgc

SEQ ID NO: 233725 - DNA, 25 bp, Mus musculus
cgcgggccgaaaagaaccaactatg

SEQ ID NO: 233726 - DNA, 25 bp, Mus musculus
cgcgtggacccatccgtctcaaatt

SEQ ID NO: 233727 - DNA, 25 bp, Mus musculus
accaactatgggagcccgtcgtggc

SEQ ID NO: 233728 - DNA, 25 bp, Mus musculus
tgcctgccgcaggaaagtgtttgtg

SEQ ID NO: 233729 - DNA, 25 bp, Mus musculus
cgactcacactttgcaggctctgta

SEQ ID NO: 233730 - DNA, 25 bp, Mus musculus
taaactgtggatctctgtgtgggcc

SEQ ID NO: 233731 - DNA, 25 bp, Mus musculus
ctctgtgtgggccatgggaatttta

SEQ ID NO: 233732 - DNA, 25 bp, Mus musculus
tcgaggttgataaactgtggatctc

SEQ ID NO: 233733 - DNA, 25 bp, Mus musculus
cgcctcccgcttatcgaggttgata

SEQ ID NO: 233734 - DNA, 25 bp, Mus musculus
ctttgagtgttctcgtcgcctcccg

SEQ ID NO: 233735 - DNA, 25 bp, Mus musculus
tgcccttgttcaaggttgttaccgc

SEQ ID NO: 233736 - DNA, 25 bp, Mus musculus
ggcgccctgcccttgttcaaggttg

SEQ ID NO: 233737 - DNA, 25 bp, Mus musculus
ctccgggaatctgcgtgggctccga

SEQ ID NO: 233738 - DNA, 25 bp, Mus musculus
agccgccgagcccagcaaatcctcc

SEQ ID NO: 233739 - DNA, 25 bp, Mus musculus
ctgctgagccctgcgggctgagact

SEQ ID NO: 233740 - DNA, 25 bp, Mus musculus
cattgccgcggccagcatgggcgtc

SEQ ID NO: 233741 - DNA, 25 bp, Mus musculus
gctttgtacacattgccgcggccag

SEQ ID NO: 233742 - DNA, 25 bp, Mus musculus
cggccgtgcgctttgtacacattgc

SEQ ID NO: 233743 - DNA, 25 bp, Mus musculus
ggccatgggaattttatactttata

SEQ ID NO: 233744 - DNA, 25 bp, Mus musculus
gcgccgctttggcagccattttctg

SEQ ID NO: 233745 - DNA, 25 bp, Mus musculus
gccgctttggcagccattttctgca

SEQ ID NO: 233746 - DNA, 25 bp, Mus musculus
cattttctgcagctgcctgggtccg

SEQ ID NO: 233747 - DNA, 25 bp, Mus musculus
agctgcctgggtccgggctgatctc

SEQ ID NO: 233748 - DNA, 25 bp, Mus musculus
cggcggtcagccaatgcaggatcgc

SEQ ID NO: 233749 - DNA, 25 bp, Mus musculus
tcagccaatgcaggatcgcgggcag

SEQ ID NO: 233750 - DNA, 25 bp, Mus musculus
ggcgcccgggactctaggagacctc

SEQ ID NO: 233751 - DNA, 25 bp, Mus musculus
cgggactctaggagacctcgggact

SEQ ID NO: 233752 - DNA, 25 bp, Mus musculus
gactctaggagacctcgggactggc

SEQ ID NO: 233753 - DNA, 25 bp, Mus musculus
ctctaggagacctcgggactggcgc

SEQ ID NO: 233754 - DNA, 25 bp, Mus musculus
gggctgcgacgcgtgcagagcgcct

SEQ ID NO: 233755 - DNA, 25 bp, Mus musculus
cagagcgcctgcgatcccacccttt

SEQ ID NO: 233756 - DNA, 25 bp, Mus musculus
cgactggcgccgctttggcagccat

SEQ ID NO: 233757 - DNA, 25 bp, Mus musculus
ctttggcagccattttctgcagctg

SEQ ID NO: 233758 - DNA, 25 bp, Mus musculus
gcaagcggatcatcctgttcctgtt

SEQ ID NO: 233759 - DNA, 25 bp, Mus musculus
cctggctacatcttcggcaagcgga

SEQ ID NO: 233760 - DNA, 25 bp, Mus musculus
ctgttcctgttcctcatgtccttcg

SEQ ID NO: 233761 - DNA, 25 bp, Mus musculus
gttcctcatgtccttcgccgggata

SEQ ID NO: 233762 - DNA, 25 bp, Mus musculus
gccgggatactcaaccattacctca

SEQ ID NO: 233763 - DNA, 25 bp, Mus musculus
tcatcttcttcttcggaagcgactt

SEQ ID NO: 233764 - DNA, 25 bp, Mus musculus
tcactgggtgaactgggtgtcgttt

SEQ ID NO: 233765 - DNA, 25 bp, Mus musculus
cggaagcgactttgagaactacatc

SEQ ID NO: 233766 - DNA, 25 bp, Mus musculus
gagacgcatcataacgcaacgccgc

SEQ ID NO: 233767 - DNA, 25 bp, Mus musculus
ctcaccagatcaatagagacgcatc

SEQ ID NO: 233768 - DNA, 25 bp, Mus musculus
gagacagagaaggacgctcaccaga

SEQ ID NO: 233769 - DNA, 25 bp, Mus musculus
ctttgagaactacatcagaacggta

SEQ ID NO: 233770 - DNA, 25 bp, Mus musculus
tcagaacggtaagcacgacgatctc

SEQ ID NO: 233771 - DNA, 25 bp, Mus musculus
gtcgtttgtgatgcatctacggccc

SEQ ID NO: 233772 - DNA, 25 bp, Mus musculus
aggcacgggacactcccagcttttc

SEQ ID NO: 233773 - DNA, 25 bp, Mus musculus
cccagcgctccaatagctaaagtca

SEQ ID NO: 233774 - DNA, 25 bp, Mus musculus
gctcctcgatgacagcgtagcacga

SEQ ID NO: 233775 - DNA, 25 bp, Mus musculus
ctccaagattgctccgctgggtaaa

SEQ ID NO: 233776 - DNA, 25 bp, Mus musculus
ctaaagtcagactcaggcgcattcc

SEQ ID NO: 233777 - DNA, 25 bp, Mus musculus
ctgggtaaaagttagccggctgtct

SEQ ID NO: 233778 - DNA, 25 bp, Mus musculus
gagtagatctagactggcccggcgc

SEQ ID NO: 233779 - DNA, 25 bp, Mus musculus
cgcgttcatgtctcactcggttgga

SEQ ID NO: 233780 - DNA, 25 bp, Mus musculus
ccgccacggagttctctgcggagta

SEQ ID NO: 233781 - DNA, 25 bp, Mus musculus
gggacgtaagtccttcaccagcttg

SEQ ID NO: 233782 - DNA, 25 bp, Mus musculus
gaagaccttcttggcgccttcgtcg

SEQ ID NO: 233783 - DNA, 25 bp, Mus musculus
ggctccagcgtctcgatcacgtaga

SEQ ID NO: 233784 - DNA, 25 bp, Mus musculus
cgagcacccggttgatgagaatggt

SEQ ID NO: 233785 - DNA, 25 bp, Mus musculus
cgcattcctgaatgaccctccaaga

SEQ ID NO: 233786 - DNA, 25 bp, Mus musculus
cccaggctcctacttacggggtgca

SEQ ID NO: 233787 - DNA, 25 bp, Mus musculus
aaacgcagtccagtggtgaggcctc

SEQ ID NO: 233788 - DNA, 25 bp, Mus musculus
ctctccggtcacgaacttgctgttg

SEQ ID NO: 233789 - DNA, 25 bp, Mus musculus
gctcccgacgccgaaaaactattga

SEQ ID NO: 233790 - DNA, 25 bp, Mus musculus
cttctgtcgcttaagtggtgactcc

SEQ ID NO: 233791 - DNA, 25 bp, Mus musculus
gggcagttttcgttccagttgactc

SEQ ID NO: 233792 - DNA, 25 bp, Mus musculus
ggtcccaatcgctcagccttatgta

SEQ ID NO: 233793 - DNA, 25 bp, Mus musculus
ggcgccattggctaaaactgaccga

SEQ ID NO: 233794 - DNA, 25 bp, Mus musculus
tgtagcctactgaggagaactttcc

SEQ ID NO: 233795 - DNA, 25 bp, Mus musculus
gccgctcagctaccaatccaaaagg

SEQ ID NO: 233796 - DNA, 25 bp, Mus musculus
ggcttaccctgcaagactgcgctca

SEQ ID NO: 233797 - DNA, 25 bp, Mus musculus
agtcgggaagatgcctccggcttac

SEQ ID NO: 233798 - DNA, 25 bp, Mus musculus
cctcggtgctttgcatgctaggata

SEQ ID NO: 233799 - DNA, 25 bp, Mus musculus
tctgcagcattttactcaccggcgc

SEQ ID NO: 233800 - DNA, 25 bp, Mus musculus
gcaggaccacctacaaccgcgccgg

SEQ ID NO: 233801 - DNA, 25 bp, Mus musculus
accctctgcttgtgcttactccgtg

SEQ ID NO: 233802 - DNA, 25 bp, Mus musculus
cgtgtgcaccctctgcttgtgctta

SEQ ID NO: 233803 - DNA, 25 bp, Mus musculus
cccactgtgtacactccgtgcgccc

SEQ ID NO: 233804 - DNA, 25 bp, Mus musculus
ggcattcatgccacggcccgccgtg

SEQ ID NO: 233805 - DNA, 25 bp, Mus musculus
tgcactccgcactccaccgtagcta

SEQ ID NO: 233806 - DNA, 25 bp, Mus musculus
tagaaactttacaagaggccgcgcc

SEQ ID NO: 233807 - DNA, 25 bp, Mus musculus
ccgcgcaactgctagaaactttaca

SEQ ID NO: 233808 - DNA, 25 bp, Mus musculus
gccagagccgcgcaactgctagaaa

SEQ ID NO: 233809 - DNA, 25 bp, Mus musculus
tgttcagctgctccgcgggtaagta

SEQ ID NO: 233810 - DNA, 25 bp, Mus musculus
cgctgctggcgctgttcagctgctc

SEQ ID NO: 233811 - DNA, 25 bp, Mus musculus
ttgcgagcgtacaccggggcgctcc

SEQ ID NO: 233812 - DNA, 25 bp, Mus musculus
tgcttgtgcttactccgtgcccggc

SEQ ID NO: 233813 - DNA, 25 bp, Mus musculus
caaccgcgccggttgcgagcgtaca

SEQ ID NO: 233814 - DNA, 25 bp, Mus musculus
ctgcacacctacactatgcgctgaa

SEQ ID NO: 233815 - DNA, 25 bp, Mus musculus
cacctacactatgcgctgaactgga

SEQ ID NO: 233816 - DNA, 25 bp, Mus musculus
agccagacactccagcagccaatga

SEQ ID NO: 233817 - DNA, 25 bp, Mus musculus
aggaccggtggcacactgccctgca

SEQ ID NO: 233818 - DNA, 25 bp, Mus musculus
gagagtttgatggatccctggtccc

SEQ ID NO: 233819 - DNA, 25 bp, Mus musculus
cggagagtttgatggatccctggtc

SEQ ID NO: 233820 - DNA, 25 bp, Mus musculus
tccgggacaaagttaggcgcggaga

SEQ ID NO: 233821 - DNA, 25 bp, Mus musculus
gtctcggcagcagctgacggcatcc

SEQ ID NO: 233822 - DNA, 25 bp, Mus musculus
accgtctcggcagcagctgacggca

SEQ ID NO: 233823 - DNA, 25 bp, Mus musculus
cttcctaaggtaccagctctgctca

SEQ ID NO: 233824 - DNA, 25 bp, Mus musculus
ggcatcgcgccctcttcctaaggta

SEQ ID NO: 233825 - DNA, 25 bp, Mus musculus
aattcggcggccctgggtgaaacag

SEQ ID NO: 233826 - DNA, 25 bp, Mus musculus
ctgcacttgacagtggcggtcgccc

SEQ ID NO: 233827 - DNA, 25 bp, Mus musculus
actatgcgctgaactggagcgcagc

SEQ ID NO: 233828 - DNA, 25 bp, Mus musculus
agccgtgaggcgttgccgtcagtca

SEQ ID NO: 233829 - DNA, 25 bp, Mus musculus
cgccggattacctaacgtgtgtgtc

SEQ ID NO: 233830 - DNA, 25 bp, Mus musculus
tgcagtcgccggattacctaacgtg

SEQ ID NO: 233831 - DNA, 25 bp, Mus musculus
ccgttctgcagtcgccggattacct

SEQ ID NO: 233832 - DNA, 25 bp, Mus musculus
cgcgtccagagtccgcggtagctgc

SEQ ID NO: 233833 - DNA, 25 bp, Mus musculus
atccggcgcgtccagagtccgcggt

SEQ ID NO: 233834 - DNA, 25 bp, Mus musculus
tcccagagggatccggcgcgtccag

SEQ ID NO: 233835 - DNA, 25 bp, Mus musculus
ctgacaccccggaggagccagtcga

SEQ ID NO: 233836 - DNA, 25 bp, Mus musculus
gcgttgccgtcagtcagctaccgct

SEQ ID NO: 233837 - DNA, 25 bp, Mus musculus
cggattacctaacgtgtgtgtctcg

SEQ ID NO: 233838 - DNA, 25 bp, Mus musculus
cccgtcgcggggtcatgacgtcacg

SEQ ID NO: 233839 - DNA, 25 bp, Mus musculus
ccgcggcgtcctcccagagggatcc

SEQ ID NO: 233840 - DNA, 25 bp, Mus musculus
gtcagtcagctaccgctgcgggagc

SEQ ID NO: 233841 - DNA, 25 bp, Mus musculus
aggccgtgagggacgcgcctgacac

SEQ ID NO: 233842 - DNA, 25 bp, Mus musculus
cgcaggaggtagaggtgtttcctaa

SEQ ID NO: 233843 - DNA, 25 bp, Mus musculus
gtgtttcctaaagctgtggcggcgc

SEQ ID NO: 233844 - DNA, 25 bp, Mus musculus
tggccagcgtggtttttcccgagcc

SEQ ID NO: 233845 - DNA, 25 bp, Mus musculus
gctctcattacctggccagcgtggt

SEQ ID NO: 233846 - DNA, 25 bp, Mus musculus
ccaccagcttttcccgaagagcagt

SEQ ID NO: 233847 - DNA, 25 bp, Mus musculus
ggtttctctgcagtcaccaccagct

SEQ ID NO: 233848 - DNA, 25 bp, Mus musculus
aactcgctccggtgacagcgcctgt

SEQ ID NO: 233849 - DNA, 25 bp, Mus musculus
gatccaccagatctcaaagcgggcc

SEQ ID NO: 233850 - DNA, 25 bp, Mus musculus
tgcgccgatccaccagatctcaaag

SEQ ID NO: 233851 - DNA, 25 bp, Mus musculus
cagagcacctgtgcgccttcgcagc

SEQ ID NO: 233852 - DNA, 25 bp, Mus musculus
tcgcgagtgatcgaatttgggcgcc

SEQ ID NO: 233853 - DNA, 25 bp, Mus musculus
ccgcttacgcaattcgcgagtgatc

SEQ ID NO: 233854 - DNA, 25 bp, Mus musculus
cccgaagggccgcttacgcaattcg

SEQ ID NO: 233855 - DNA, 25 bp, Mus musculus
tgccgctgttggaggctcagcctcc

SEQ ID NO: 233856 - DNA, 25 bp, Mus musculus
caagatcccttctaagaatccgggg

SEQ ID NO: 233857 - DNA, 25 bp, Mus musculus
tatggggattgaagtccggcgtccc

SEQ ID NO: 233858 - DNA, 25 bp, Mus musculus
gctcacgcccggcattatggggatt

SEQ ID NO: 233859 - DNA, 25 bp, Mus musculus
aggattacccatgcagcaccgcggg

SEQ ID NO: 233860 - DNA, 25 bp, Mus musculus
agtttcatacgcaagatggccgcca

SEQ ID NO: 233861 - DNA, 25 bp, Mus musculus
gagaccgtccaaaacgtagctatta

SEQ ID NO: 233862 - DNA, 25 bp, Mus musculus
ctccgggaagacgagagaccgtcca

SEQ ID NO: 233863 - DNA, 25 bp, Mus musculus
gcgaacacacgaacctccgggaaga

SEQ ID NO: 233864 - DNA, 25 bp, Mus musculus
accgggacccatcgctctgtaagca

SEQ ID NO: 233865 - DNA, 25 bp, Mus musculus
gctcagacgaaaccggaaatacctc

SEQ ID NO: 233866 - DNA, 25 bp, Mus musculus
gcgccagccgttcgctcagacgaaa

SEQ ID NO: 233867 - DNA, 25 bp, Mus musculus
ggcttccacgctcgcagtgaggcga

SEQ ID NO: 233868 - DNA, 25 bp, Mus musculus
cgcagtcctcgtttacctcaaggca

SEQ ID NO: 233869 - DNA, 25 bp, Mus musculus
acaggcttctcttggggcttccacg

SEQ ID NO: 233870 - DNA, 25 bp, Mus musculus
tgacactctaaaagtttgcggtccg

SEQ ID NO: 233871 - DNA, 25 bp, Mus musculus
cacgcgcctgagcgagaagccgtgc

SEQ ID NO: 233872 - DNA, 25 bp, Mus musculus
attccactgacactctaaaagtttg

SEQ ID NO: 233873 - DNA, 25 bp, Mus musculus
tctgcaccgttattccactgacact

SEQ ID NO: 233874 - DNA, 25 bp, Mus musculus
ccccacggcggtacggacagtgtgc

SEQ ID NO: 233875 - DNA, 25 bp, Mus musculus
gctgagcctcgcgtgtcccggtgtc

SEQ ID NO: 233876 - DNA, 25 bp, Mus musculus
ccacgctccatttttctagcggggc

SEQ ID NO: 233877 - DNA, 25 bp, Mus musculus
agggagcgcctcttcatcgcctcag

SEQ ID NO: 233878 - DNA, 25 bp, Mus musculus
gtaacggaaagggagcgcctcttca

SEQ ID NO: 233879 - DNA, 25 bp, Mus musculus
tcttggcgccattttgaagcggaga

SEQ ID NO: 233880 - DNA, 25 bp, Mus musculus
gcggagctgctcttggcgccatttt

SEQ ID NO: 233881 - DNA, 25 bp, Mus musculus
tccgccgcggttcgattggagcagc

SEQ ID NO: 233882 - DNA, 25 bp, Mus musculus
gcgctgagaacccacgcggcgctct

SEQ ID NO: 233883 - DNA, 25 bp, Mus musculus
tccatttttctagcggggcgtgcgc

SEQ ID NO: 233884 - DNA, 25 bp, Mus musculus
tgtaccattgggacctgccacagcg

SEQ ID NO: 233885 - DNA, 25 bp, Mus musculus
ggcgcctgctctggataatcattgc

SEQ ID NO: 233886 - DNA, 25 bp, Mus musculus
tctgcttccgccacttcggtggtca

SEQ ID NO: 233887 - DNA, 25 bp, Mus musculus
agggattatgccgagctctgcttcc

SEQ ID NO: 233888 - DNA, 25 bp, Mus musculus
cggtggtcaggtcaagtactggatc

SEQ ID NO: 233889 - DNA, 25 bp, Mus musculus
tggccgaccatttcagggattatgc

SEQ ID NO: 233890 - DNA, 25 bp, Mus musculus
cacctatggcggatgggccaatcgc

SEQ ID NO: 233891 - DNA, 25 bp, Mus musculus
acagcgcctgcaggacacctatggc

SEQ ID NO: 233892 - DNA, 25 bp, Mus musculus
agccggtggttaccctgtaccattg

SEQ ID NO: 233893 - DNA, 25 bp, Mus musculus
aacgtctaccgcgacacagaggggc

SEQ ID NO: 233894 - DNA, 25 bp, Mus musculus
gtggccagcgatagttacaacaacg

SEQ ID NO: 233895 - DNA, 25 bp, Mus musculus
gggacactttcacccatcactctgg

SEQ ID NO: 233896 - DNA, 25 bp, Mus musculus
cagcacggcaaaggcgcgtccatct

SEQ ID NO: 233897 - DNA, 25 bp, Mus musculus
actaccgcttctccatatcgtgggc

SEQ ID NO: 233898 - DNA, 25 bp, Mus musculus
gccaagcgattccttgctcaatgtc

SEQ ID NO: 233899 - DNA, 25 bp, Mus musculus
atgccgcgagtcgtttcaaggacgc

SEQ ID NO: 233900 - DNA, 25 bp, Mus musculus
ctgtgcacgtgttttgaaggcccgc

SEQ ID NO: 233901 - DNA, 25 bp, Mus musculus
cgcagcccacctgtgcacgtgtttt

SEQ ID NO: 233902 - DNA, 25 bp, Mus musculus
tgggtgtgtggcctcgcagcccacc

SEQ ID NO: 233903 - DNA, 25 bp, Mus musculus
aaacccagttgtccgtgagatggta

SEQ ID NO: 233904 - DNA, 25 bp, Mus musculus
gacccaccggctagaggggcagaaa

SEQ ID NO: 233905 - DNA, 25 bp, Mus musculus
ttggccggtctcgaggaggacccac

SEQ ID NO: 233906 - DNA, 25 bp, Mus musculus
ggccgccgaacttggccggtctcga

SEQ ID NO: 233907 - DNA, 25 bp, Mus musculus
taggcatgggccactgagctgagtc

SEQ ID NO: 233908 - DNA, 25 bp, Mus musculus
ccctgcttattgtaggcatgggcca

SEQ ID NO: 233909 - DNA, 25 bp, Mus musculus
tcctgtgcgcacctgcagaagctcg

SEQ ID NO: 233910 - DNA, 25 bp, Mus musculus
tcaaggacgcaactgtgcctcaacg

SEQ ID NO: 233911 - DNA, 25 bp, Mus musculus
gctcaatgtcctgtgcgcacctgca

SEQ ID NO: 233912 - DNA, 25 bp, Mus musculus
ggtccgcgcacaggccagctgtcag

SEQ ID NO: 233913 - DNA, 25 bp, Mus musculus
cagctgtcaggcactgtgcccgatc

SEQ ID NO: 233914 - DNA, 25 bp, Mus musculus
actgtgcccgatctgactggtcaga

SEQ ID NO: 233915 - DNA, 25 bp, Mus musculus
tgactggtcagaacctgcacccagg

SEQ ID NO: 233916 - DNA, 25 bp, Mus musculus
tcgcggacgttcctccacagcagat

SEQ ID NO: 233917 - DNA, 25 bp, Mus musculus
gcagatcccaggctctggcgctgga

SEQ ID NO: 233918 - DNA, 25 bp, Mus musculus
gtcccgcagctgctcgcttagcgat

SEQ ID NO: 233919 - DNA, 25 bp, Mus musculus
ctcgcttagcgatctccggagaggc

SEQ ID NO: 233920 - DNA, 25 bp, Mus musculus
agaggcgcgtacaccgctcttcgtg

SEQ ID NO: 233921 - DNA, 25 bp, Mus musculus
ctcttcgtgggctgctcatctcaga

SEQ ID NO: 233922 - DNA, 25 bp, Mus musculus
gtgggctgctcatctcagacgagtc

SEQ ID NO: 233923 - DNA, 25 bp, Mus musculus
atctcagacgagtcctcatggcgcg

SEQ ID NO: 233924 - DNA, 25 bp, Mus musculus
tccgacgtttggacgctcggccacg

SEQ ID NO: 233925 - DNA, 25 bp, Mus musculus
agtggaggactctggtccgcgcaca

SEQ ID NO: 233926 - DNA, 25 bp, Mus musculus
ccgcgcgggaacacgctagaaggct

SEQ ID NO: 233927 - DNA, 25 bp, Mus musculus
agtctggagcgggaacggacctcac

SEQ ID NO: 233928 - DNA, 25 bp, Mus musculus
cagaagggcgggacccaagactcct

SEQ ID NO: 233929 - DNA, 25 bp, Mus musculus
gctttatgcgctccgccagaagggc

SEQ ID NO: 233930 - DNA, 25 bp, Mus musculus
ggtaggctttatgcgctccgccaga

SEQ ID NO: 233931 - DNA, 25 bp, Mus musculus
aacattccagagacaccgcggcggc

SEQ ID NO: 233932 - DNA, 25 bp, Mus musculus
ttcctcccttcagaacattccagag

SEQ ID NO: 233933 - DNA, 25 bp, Mus musculus
ctggctctcggtgcggtagcgccat

SEQ ID NO: 233934 - DNA, 25 bp, Mus musculus
cgctagaaggctggatatccgggcc

SEQ ID NO: 233935 - DNA, 25 bp, Mus musculus
ttcgcagtccggttccggttgtagc

SEQ ID NO: 233936 - DNA, 25 bp, Mus musculus
cagcggaagttaccgcctccaaggc

SEQ ID NO: 233937 - DNA, 25 bp, Mus musculus
gcaagcgatcaaagatggagaaatc

SEQ ID NO: 233938 - DNA, 25 bp, Mus musculus
cgaggcctgcaagcgatcaaagatg

SEQ ID NO: 233939 - DNA, 25 bp, Mus musculus
agcccagctcccttgaggcgcaggt

SEQ ID NO: 233940 - DNA, 25 bp, Mus musculus
cgcttgacacacaaggcgcggcgcc

SEQ ID NO: 233941 - DNA, 25 bp, Mus musculus
gcactgccttcgagaccctccgggc

SEQ ID NO: 233942 - DNA, 25 bp, Mus musculus
cgttttccccggcatgaagtgtggg

SEQ ID NO: 233943 - DNA, 25 bp, Mus musculus
ggctggccgttggaagcactccgta

SEQ ID NO: 233944 - DNA, 25 bp, Mus musculus
tggccgttggaagcactccgtagcc

SEQ ID NO: 233945 - DNA, 25 bp, Mus musculus
agccggagtcgtcgagtcgcacgac

SEQ ID NO: 233946 - DNA, 25 bp, Mus musculus
agcccgcgtgtgtagaatgccaatg

SEQ ID NO: 233947 - DNA, 25 bp, Mus musculus
ccgcgtgtgtagaatgccaatgagc

SEQ ID NO: 233948 - DNA, 25 bp, Mus musculus
cgtgtgtagaatgccaatgagctgc

SEQ ID NO: 233949 - DNA, 25 bp, Mus musculus
tgtagaatgccaatgagctgccctc

SEQ ID NO: 233950 - DNA, 25 bp, Mus musculus
tagaatgccaatgagctgccctccc

SEQ ID NO: 233951 - DNA, 25 bp, Mus musculus
cggccggggtctgcactgccttcga

SEQ ID NO: 233952 - DNA, 25 bp, Mus musculus
cggggtctgcactgccttcgagacc

SEQ ID NO: 233953 - DNA, 25 bp, Mus musculus
ggccgttggaagcactccgtagccc

SEQ ID NO: 233954 - DNA, 25 bp, Mus musculus
gctagtctcctaggcttcccataca

SEQ ID NO: 233955 - DNA, 25 bp, Mus musculus
agccagagagagaactcgctccttc

SEQ ID NO: 233956 - DNA, 25 bp, Mus musculus
tcccatacagcaggtacccggtggc

SEQ ID NO: 233957 - DNA, 25 bp, Mus musculus
cgattcctctttgctccagttctgg

SEQ ID NO: 233958 - DNA, 25 bp, Mus musculus
gccctgtattcagtctccacgattc

SEQ ID NO: 233959 - DNA, 25 bp, Mus musculus
ctcgcggtccagatttaaggtggtc

SEQ ID NO: 233960 - DNA, 25 bp, Mus musculus
cggtccgcgcagagttaactgtagc

SEQ ID NO: 233961 - DNA, 25 bp, Mus musculus
ggctgaggtaccctacgtgtccacg

SEQ ID NO: 233962 - DNA, 25 bp, Mus musculus
gctcagcgctcttgcagctctgcga

SEQ ID NO: 233963 - DNA, 25 bp, Mus musculus
agctgaaaggcgtctaccgtggctc

SEQ ID NO: 233964 - DNA, 25 bp, Mus musculus
cccgggatcgataacgcaggagtaa

SEQ ID NO: 233965 - DNA, 25 bp, Mus musculus
tgcaaccctagtcccgggatcgata

SEQ ID NO: 233966 - DNA, 25 bp, Mus musculus
cgggctgttccactcttgttttctc

SEQ ID NO: 233967 - DNA, 25 bp, Mus musculus
cacgcctggcctctttgcatcagta

SEQ ID NO: 233968 - DNA, 25 bp, Mus musculus
aacctgaggacttgtgagctgtccc

SEQ ID NO: 233969 - DNA, 25 bp, Mus musculus
cgtccgcggaacctgaggacttgtg

SEQ ID NO: 233970 - DNA, 25 bp, Mus musculus
gtgcgtgtgcgctcctccttgcgct

SEQ ID NO: 233971 - DNA, 25 bp, Mus musculus
tgcgctcggctctcccttcctcgct

SEQ ID NO: 233972 - DNA, 25 bp, Mus musculus
ggctcgttcgttccctctggcgctg

SEQ ID NO: 233973 - DNA, 25 bp, Mus musculus
ctggtaacggaacacatcggagttg

SEQ ID NO: 233974 - DNA, 25 bp, Mus musculus
gttcgttccctctggcgctgcctgg

SEQ ID NO: 233975 - DNA, 25 bp, Mus musculus
cggaacctgaggacttgtgagctgt

SEQ ID NO: 233976 - DNA, 25 bp, Mus musculus
ttctcttcctatataaccttgcctg

SEQ ID NO: 233977 - DNA, 25 bp, Mus musculus
ctatataaccttgcctgccgctgct

SEQ ID NO: 233978 - DNA, 25 bp, Mus musculus
gctgctgcaggggacttgtctccga

SEQ ID NO: 233979 - DNA, 25 bp, Mus musculus
cccacccagactggggctgcgatgg

SEQ ID NO: 233980 - DNA, 25 bp, Mus musculus
tgccggtcgctggtaacggaacaca

SEQ ID NO: 233981 - DNA, 25 bp, Mus musculus
cggaacacatcggagttgggtctcg

SEQ ID NO: 233982 - DNA, 25 bp, Mus musculus
gtgaaaaggcctgcatcccgcaaca

SEQ ID NO: 233983 - DNA, 25 bp, Mus musculus
caacaggccacacgataccgggagc

SEQ ID NO: 233984 - DNA, 25 bp, Mus musculus
taccgggagccaagacacaatcgtg

SEQ ID NO: 233985 - DNA, 25 bp, Mus musculus
tggcgacgccacacagctcgcaaaa

SEQ ID NO: 233986 - DNA, 25 bp, Mus musculus
tcgcaaaacagtcgaggggccgtta

SEQ ID NO: 233987 - DNA, 25 bp, Mus musculus
gggccgttatcaagtctttcgactg

SEQ ID NO: 233988 - DNA, 25 bp, Mus musculus
cagcagaaagcgcactccaaagagc

SEQ ID NO: 233989 - DNA, 25 bp, Mus musculus
gtcagcgcatcctcgggacgcatca

SEQ ID NO: 233990 - DNA, 25 bp, Mus musculus
gcagcggaaaggacgccattcaaaa

SEQ ID NO: 233991 - DNA, 25 bp, Mus musculus
caggaaaggccgttgtgagtttgtc

SEQ ID NO: 233992 - DNA, 25 bp, Mus musculus
cccgcagcgctgtctgaagtataaa

SEQ ID NO: 233993 - DNA, 25 bp, Mus musculus
gcctgcgctgcacaaggctgtgata

SEQ ID NO: 233994 - DNA, 25 bp, Mus musculus
gacctcacggaccagatttccaacg

SEQ ID NO: 233995 - DNA, 25 bp, Mus musculus
ggctgtgatataacgagggacctca

SEQ ID NO: 233996 - DNA, 25 bp, Mus musculus
caggatcggaaaacgccgcctgagc

SEQ ID NO: 233997 - DNA, 25 bp, Mus musculus
aagaaactatgggaccgtgctggtc

SEQ ID NO: 233998 - DNA, 25 bp, Mus musculus
gtctacgctgcgctcctgggtccaa

SEQ ID NO: 233999 - DNA, 25 bp, Mus musculus
gcaccgtggactctcgcacttggct

SEQ ID NO: 234000 - DNA, 25 bp, Mus musculus
cacttggctgtggaagtgctgctcc

SEQ ID NO: 234001 - DNA, 25 bp, Mus musculus
ctatacagtctctcgtggccggaca

SEQ ID NO: 234002 - DNA, 25 bp, Mus musculus
ccacctagaccgcagcaggatcgga

SEQ ID NO: 234003 - DNA, 25 bp, Mus musculus
gctcagggagaagcggttcaagata

SEQ ID NO: 234004 - DNA, 25 bp, Mus musculus
ttcaagatacaagaggcggggaatg

SEQ ID NO: 234005 - DNA, 25 bp, Mus musculus
cgggacttgtgcgtcactctgagag

SEQ ID NO: 234006 - DNA, 25 bp, Mus musculus
gtcactctgagagcgccgtacgtca

SEQ ID NO: 234007 - DNA, 25 bp, Mus musculus
gccgtacgtcagagaagagcgcctc

SEQ ID NO: 234008 - DNA, 25 bp, Mus musculus
tcgctaggcgccttggagagagact

SEQ ID NO: 234009 - DNA, 25 bp, Mus musculus
tggccggacagaaacgccacctaga

SEQ ID NO: 234010 - DNA, 25 bp, Mus musculus
aagcgggcacttctagcggccaacg

SEQ ID NO: 234011 - DNA, 25 bp, Mus musculus
atccgaaagctggaacggtgcctcg

SEQ ID NO: 234012 - DNA, 25 bp, Mus musculus
ggccaaggctaaaggtgctcctgga

SEQ ID NO: 234013 - DNA, 25 bp, Mus musculus
gagactcgacgaccgcccactgagg

SEQ ID NO: 234014 - DNA, 25 bp, Mus musculus
ggccttaacgatggcccggagactc

SEQ ID NO: 234015 - DNA, 25 bp, Mus musculus
gcgcctgcagaggacagtaggctcc

SEQ ID NO: 234016 - DNA, 25 bp, Mus musculus
cttcgtaaggagaagcgacacctga

SEQ ID NO: 234017 - DNA, 25 bp, Mus musculus
cgaaagagccgcaaggagcttcgta

SEQ ID NO: 234018 - DNA, 25 bp, Mus musculus
tggaagacttcgtgcggactacctc

SEQ ID NO: 234019 - DNA, 25 bp, Mus musculus
ctctcttgaaacgtagcggcgtccg

SEQ ID NO: 234020 - DNA, 25 bp, Mus musculus
ttaacggcgtctataggcatggggc

SEQ ID NO: 234021 - DNA, 25 bp, Mus musculus
cccttccggaagtgatgccgcggaa

SEQ ID NO: 234022 - DNA, 25 bp, Mus musculus
cgcgcgacggtctggactacatcct

SEQ ID NO: 234023 - DNA, 25 bp, Mus musculus
ctcggcctccacaagcgtaagaaga

SEQ ID NO: 234024 - DNA, 25 bp, Mus musculus
tgaggacccaagctgctaccgccgg

SEQ ID NO: 234025 - DNA, 25 bp, Mus musculus
ggtagttcccattcgcagtcccagc

SEQ ID NO: 234026 - DNA, 25 bp, Mus musculus
gctctgcgcagcacagaatcggttg

SEQ ID NO: 234027 - DNA, 25 bp, Mus musculus
gcacagaatcggttgcgcaggccca

SEQ ID NO: 234028 - DNA, 25 bp, Mus musculus
cccaggagataaggcgcgcgccttt

SEQ ID NO: 234029 - DNA, 25 bp, Mus musculus
tacccagctgggtaaaccgcgctct

SEQ ID NO: 234030 - DNA, 25 bp, Mus musculus
tcgtagacgcgctttgtcagacttc

SEQ ID NO: 234031 - DNA, 25 bp, Mus musculus
taaaacgaggccaccagctggagct

SEQ ID NO: 234032 - DNA, 25 bp, Mus musculus
gcctcctactggatgcggattccgg

SEQ ID NO: 234033 - DNA, 25 bp, Mus musculus
cctggcgcgccctaaagtgatttac

SEQ ID NO: 234034 - DNA, 25 bp, Mus musculus
gtcaccagcttcgtgtagcccgcgg

SEQ ID NO: 234035 - DNA, 25 bp, Mus musculus
cctccggggacaatggctcgtagac

SEQ ID NO: 234036 - DNA, 25 bp, Mus musculus
ctcagggccgtgtggctaggaatat

SEQ ID NO: 234037 - DNA, 25 bp, Mus musculus
ttgtcagacttcgtgtgtacccggg

SEQ ID NO: 234038 - DNA, 25 bp, Mus musculus
tcacctgcaggcataatctggcgtg

SEQ ID NO: 234039 - DNA, 25 bp, Mus musculus
ctaagactgactggcagcggcgtct

SEQ ID NO: 234040 - DNA, 25 bp, Mus musculus
tagaagaggtttcgctagaggacta

SEQ ID NO: 234041 - DNA, 25 bp, Mus musculus
cctcgccctagaagaggtttcgcta

SEQ ID NO: 234042 - DNA, 25 bp, Mus musculus
gagagcgtacaagcattcgggaccc

SEQ ID NO: 234043 - DNA, 25 bp, Mus musculus
ccagagggtgagagcgtacaagcat

SEQ ID NO: 234044 - DNA, 25 bp, Mus musculus
cccacgaatccagagggtgagagcg

SEQ ID NO: 234045 - DNA, 25 bp, Mus musculus
aatctggcgtgagaaactggccacc

SEQ ID NO: 234046 - DNA, 25 bp, Mus musculus
ttttgctgcgtttccatttcattcg

SEQ ID NO: 234047 - DNA, 25 bp, Mus musculus
ggcctttttgctgcgtttccatttc

SEQ ID NO: 234048 - DNA, 25 bp, Mus musculus
gctctttggcctttttgctgcgttt

SEQ ID NO: 234049 - DNA, 25 bp, Mus musculus
cgcctcctgcgcagcctgctctttg

SEQ ID NO: 234050 - DNA, 25 bp, Mus musculus
gcgtgagaaactggccacccgcatc

SEQ ID NO: 234051 - DNA, 25 bp, Mus musculus
ttcgctagaggactaagactgactg

SEQ ID NO: 234052 - DNA, 25 bp, Mus musculus
ttcttctcctcagaggcaccggctg

SEQ ID NO: 234053 - DNA, 25 bp, Mus musculus
ttttcactgcctgcatgccgttctc

SEQ ID NO: 234054 - DNA, 25 bp, Mus musculus
gccgttctccatgtacttgctcata

SEQ ID NO: 234055 - DNA, 25 bp, Mus musculus
cacagcgcaagtctatgggttcatc

SEQ ID NO: 234056 - DNA, 25 bp, Mus musculus
gcctcgcccgacttgattttcactg

SEQ ID NO: 234057 - DNA, 25 bp, Mus musculus
gctcctcggcagcacgtttcttgtg

SEQ ID NO: 234058 - DNA, 25 bp, Mus musculus
taaaagtcctgtcgccctggggatg

SEQ ID NO: 234059 - DNA, 25 bp, Mus musculus
ggagagctttcgagaccctaggtcc

SEQ ID NO: 234060 - DNA, 25 bp, Mus musculus
ttgcagggcacttcggctttcttct

SEQ ID NO: 234061 - DNA, 25 bp, Mus musculus
tagcggttgctcaccaaaggcctcc

SEQ ID NO: 234062 - DNA, 25 bp, Mus musculus
tcaaccgcttcttacagggctcacg

SEQ ID NO: 234063 - DNA, 25 bp, Mus musculus
tctaaaaggatgacctcgggctgcg

SEQ ID NO: 234064 - DNA, 25 bp, Mus musculus
tgggttcatccaggtctgagtctaa

SEQ ID NO: 234065 - DNA, 25 bp, Mus musculus
acttgctcataacgatcacgatgcg

SEQ ID NO: 234066 - DNA, 25 bp, Mus musculus
ctcctcggcgcggattgactgggac

SEQ ID NO: 234067 - DNA, 25 bp, Mus musculus
tcccactgtgatccgggagagctgg

SEQ ID NO: 234068 - DNA, 25 bp, Mus musculus
cgtgctgcggattactggtccagaa

SEQ ID NO: 234069 - DNA, 25 bp, Mus musculus
aaagttccaagctcagccggccggc

SEQ ID NO: 234070 - DNA, 25 bp, Mus musculus
ccgggagtgcttcggcacaaagttc

SEQ ID NO: 234071 - DNA, 25 bp, Mus musculus
ggagcctccagcaaccaaagcagca

SEQ ID NO: 234072 - DNA, 25 bp, Mus musculus
gttcgccgttgtactgctgcccgct

SEQ ID NO: 234073 - DNA, 25 bp, Mus musculus
agaccggcgtcctcctgattcgtgt

SEQ ID NO: 234074 - DNA, 25 bp, Mus musculus
aactggtgcacctccagaccggcgt

SEQ ID NO: 234075 - DNA, 25 bp, Mus musculus
acaggaagaacttgagctcggcgga

SEQ ID NO: 234076 - DNA, 25 bp, Mus musculus
tagcgcctgctccagtacggtgcac

SEQ ID NO: 234077 - DNA, 25 bp, Mus musculus
tgcctttgtcggacgtgttctggcc

SEQ ID NO: 234078 - DNA, 25 bp, Mus musculus
tccagaactctggtagcaaggaggg

SEQ ID NO: 234079 - DNA, 25 bp, Mus musculus
ccgccgcggaaacttgcggttcatg

SEQ ID NO: 234080 - DNA, 25 bp, Mus musculus
cggccgggaccagatactgtagtcg

SEQ ID NO: 234081 - DNA, 25 bp, Mus musculus
tctcaagagctcaagcgaccgcatc

SEQ ID NO: 234082 - DNA, 25 bp, Mus musculus
gggagaccggctctctgctctcaag

SEQ ID NO: 234083 - DNA, 25 bp, Mus musculus
ggtatgaacttccaccggagcgctc

SEQ ID NO: 234084 - DNA, 25 bp, Mus musculus
gaccgcgctccactcactggtatga

SEQ ID NO: 234085 - DNA, 25 bp, Mus musculus
aactcagctgagagcgaccatcgtc

SEQ ID NO: 234086 - DNA, 25 bp, Mus musculus
tttttgccaataaagtcgcagccgg

SEQ ID NO: 234087 - DNA, 25 bp, Mus musculus
tggggccggtattgttactgcgatt

SEQ ID NO: 234088 - DNA, 25 bp, Mus musculus
ttggatttttccatcggctcgattg

SEQ ID NO: 234089 - DNA, 25 bp, Mus musculus
cacacttgaagctcagggcggtctg

SEQ ID NO: 234090 - DNA, 25 bp, Mus musculus
gcagctgctgccgaataactgtaga

SEQ ID NO: 234091 - DNA, 25 bp, Mus musculus
gtgtccatagagagccgcctgtgca

SEQ ID NO: 234092 - DNA, 25 bp, Mus musculus
tcggctcgattggagctgacaatca

SEQ ID NO: 234093 - DNA, 25 bp, Mus musculus
cgccctgcacctgagggtatgagta

SEQ ID NO: 234094 - DNA, 25 bp, Mus musculus
ccgtattatcgatggcggccctggc

SEQ ID NO: 234095 - DNA, 25 bp, Mus musculus
cctgacaggtttgtgaggaggctcc

SEQ ID NO: 234096 - DNA, 25 bp, Mus musculus
cccaaagtgtctctcggtggcgcga

SEQ ID NO: 234097 - DNA, 25 bp, Mus musculus
cgacttcaagacaaggcccaaagtg

SEQ ID NO: 234098 - DNA, 25 bp, Mus musculus
gttcagcttcgaaggcgacttcaag

SEQ ID NO: 234099 - DNA, 25 bp, Mus musculus
ataagcggcgaagatgttcagcttc

SEQ ID NO: 234100 - DNA, 25 bp, Mus musculus
gtggcgcgctgtggataaataagca

SEQ ID NO: 234101 - DNA, 25 bp, Mus musculus
atcttggtacctacggcagcgcggt

SEQ ID NO: 234102 - DNA, 25 bp, Mus musculus
cgatgaccgcgcacgttcacgggac

SEQ ID NO: 234103 - DNA, 25 bp, Mus musculus
cggctgggtcattcattgcgacctc

SEQ ID NO: 234104 - DNA, 25 bp, Mus musculus
gccgggaggagcaccgtattatcga

SEQ ID NO: 234105 - DNA, 25 bp, Mus musculus
aaatcgtctggtggcatgacgcacg

SEQ ID NO: 234106 - DNA, 25 bp, Mus musculus
cgggcggtcaccatcttggtaccta

SEQ ID NO: 234107 - DNA, 25 bp, Mus musculus
cacgcaggcaagtccaagggctgcc

SEQ ID NO: 234108 - DNA, 25 bp, Mus musculus
gctagaccagcgctatcaagtccga

SEQ ID NO: 234109 - DNA, 25 bp, Mus musculus
cggtccgcttccctagttctctggt

SEQ ID NO: 234110 - DNA, 25 bp, Mus musculus
cgtttgccgttcttggtcaggccta

SEQ ID NO: 234111 - DNA, 25 bp, Mus musculus
tcttgtgtctaggtctggggcttaa

SEQ ID NO: 234112 - DNA, 25 bp, Mus musculus
cgaacgggttccagtctaggctgta

SEQ ID NO: 234113 - DNA, 25 bp, Mus musculus
tactgctcacaaggccgaacgggtt

SEQ ID NO: 234114 - DNA, 25 bp, Mus musculus
gctaacccgcttggctcccggaata

SEQ ID NO: 234115 - DNA, 25 bp, Mus musculus
aaggcctgcgaatgggctaacccgc

SEQ ID NO: 234116 - DNA, 25 bp, Mus musculus
aggctgctgcgcacgttagcttcag

SEQ ID NO: 234117 - DNA, 25 bp, Mus musculus
gagaatcttccggaacgctagacca

SEQ ID NO: 234118 - DNA, 25 bp, Mus musculus
tcgcctatgtaaaccctccagaatc

SEQ ID NO: 234119 - DNA, 25 bp, Mus musculus
ttcggctacagtcgcctcaggcttt

SEQ ID NO: 234120 - DNA, 25 bp, Mus musculus
aacgcaggctccttggttcggctac

SEQ ID NO: 234121 - DNA, 25 bp, Mus musculus
cgcggcgaaaagcagggttgactac

SEQ ID NO: 234122 - DNA, 25 bp, Mus musculus
ctcagctgctgagcatcggactgca

SEQ ID NO: 234123 - DNA, 25 bp, Mus musculus
cctgcctcaggtactggagttctcc

SEQ ID NO: 234124 - DNA, 25 bp, Mus musculus
ttccggccgccagaatccgtggcag

SEQ ID NO: 234125 - DNA, 25 bp, Mus musculus
gtcagcgacaaaaccaggaccttcc

SEQ ID NO: 234126 - DNA, 25 bp, Mus musculus
tctggcagcagtgtagtcagcgaca

SEQ ID NO: 234127 - DNA, 25 bp, Mus musculus
tcggagccaaccaccagcataacgg

SEQ ID NO: 234128 - DNA, 25 bp, Mus musculus
cgcagcgcaaaatgtgctccacctg

SEQ ID NO: 234129 - DNA, 25 bp, Mus musculus
gcgcacgggaagtttaggactccta

SEQ ID NO: 234130 - DNA, 25 bp, Mus musculus
tcctagaacctcagagcccgggtta

SEQ ID NO: 234131 - DNA, 25 bp, Mus musculus
gttagggctatccaagaacgctcgc

SEQ ID NO: 234132 - DNA, 25 bp, Mus musculus
cccagttacctctcaggctgtatcg

SEQ ID NO: 234133 - DNA, 25 bp, Mus musculus
aggctgtatcgtgcctgcatgccga

SEQ ID NO: 234134 - DNA, 25 bp, Mus musculus
ctgcatgccgaacaccgacagggtg

SEQ ID NO: 234135 - DNA, 25 bp, Mus musculus
ctccttcttgaagccgcagcgcaaa

SEQ ID NO: 234136 - DNA, 25 bp, Mus musculus
cgacgttgggcacgcgactcccgag

SEQ ID NO: 234137 - DNA, 25 bp, Mus musculus
agaaacgacgttgggcacgcgactc

SEQ ID NO: 234138 - DNA, 25 bp, Mus musculus
gcatgggcgctttcccgctggacct

SEQ ID NO: 234139 - DNA, 25 bp, Mus musculus
gctggacctcatcgtcagccgctgc

SEQ ID NO: 234140 - DNA, 25 bp, Mus musculus
acgctcgcctgcctcggaccaggta

SEQ ID NO: 234141 - DNA, 25 bp, Mus musculus
ggaggatgcgaaaagtcggggcttc

SEQ ID NO: 234142 - DNA, 25 bp, Mus musculus
tcccgaggctcagctgggctgccag

SEQ ID NO: 234143 - DNA, 25 bp, Mus musculus
ctgcgctggagcatgggcgctttcc

SEQ ID NO: 234144 - DNA, 25 bp, Mus musculus
ggagcgccgcttcggcccaggagga

SEQ ID NO: 234145 - DNA, 25 bp, Mus musculus
cgcgcagcccgacctgtgcgggaat

SEQ ID NO: 234146 - DNA, 25 bp, Mus musculus
agcccgacctgtgcgggaatgcccg

SEQ ID NO: 234147 - DNA, 25 bp, Mus musculus
gcgcccatgccatggagaagctggc

SEQ ID NO: 234148 - DNA, 25 bp, Mus musculus
ccatgccatggagaagctggcggcc

SEQ ID NO: 234149 - DNA, 25 bp, Mus musculus
caggtacccggtgtctagaggggag

SEQ ID NO: 234150 - DNA, 25 bp, Mus musculus
gagggacactgctacaagctggtca

SEQ ID NO: 234151 - DNA, 25 bp, Mus musculus
ggacctcatctccttcgggatcgtg

SEQ ID NO: 234152 - DNA, 25 bp, Mus musculus
ctgcgccgagatcccttacgaagag

SEQ ID NO: 234153 - DNA, 25 bp, Mus musculus
ccggcgacagcgatcaggattacgt

SEQ ID NO: 234154 - DNA, 25 bp, Mus musculus
aatactccactgctgtgcgcgaggc

SEQ ID NO: 234155 - DNA, 25 bp, Mus musculus
gcgagcgcttcgatccggacgaata

SEQ ID NO: 234156 - DNA, 25 bp, Mus musculus
ggtcagcatcatctccaagacggtg

SEQ ID NO: 234157 - DNA, 25 bp, Mus musculus
agatgccctgtctcatctgcatgaa

SEQ ID NO: 234158 - DNA, 25 bp, Mus musculus
cgccaggcccgtcaaaagcaagatg

SEQ ID NO: 234159 - DNA, 25 bp, Mus musculus
ttctgtgcgccaagacgaccaagga

SEQ ID NO: 234160 - DNA, 25 bp, Mus musculus
gtacaacttcacactgcacgcaggc

SEQ ID NO: 234161 - DNA, 25 bp, Mus musculus
cgaggacagcgaggtgtacaacttc

SEQ ID NO: 234162 - DNA, 25 bp, Mus musculus
cgctgcacttcctgctgcttacgga

SEQ ID NO: 234163 - DNA, 25 bp, Mus musculus
acgagctcactctcatgggccaggc

SEQ ID NO: 234164 - DNA, 25 bp, Mus musculus
gttcctgaaggcactccgagactct

SEQ ID NO: 234165 - DNA, 25 bp, Mus musculus
cggctgtagagattgagaacgcgtc

SEQ ID NO: 234166 - DNA, 25 bp, Mus musculus
cggtgtcttctgtctgcatttgtca

SEQ ID NO: 234167 - DNA, 25 bp, Mus musculus
cctttgctgtgagggtcgaagtccc

SEQ ID NO: 234168 - DNA, 25 bp, Mus musculus
aggtgccactttgctcccgactctt

SEQ ID NO: 234169 - DNA, 25 bp, Mus musculus
gcgcgcttctcggttttcttctgat

SEQ ID NO: 234170 - DNA, 25 bp, Mus musculus
cggacgtttgtcagtctggacttga

SEQ ID NO: 234171 - DNA, 25 bp, Mus musculus
gcagcccgtaaatgccgcggtgatg

SEQ ID NO: 234172 - DNA, 25 bp, Mus musculus
tgactttctgctcaggcgttcagcg

SEQ ID NO: 234173 - DNA, 25 bp, Mus musculus
ctaagcgagccgaaaggatgatttc

SEQ ID NO: 234174 - DNA, 25 bp, Mus musculus
gggtgtcctaagtgccgccttacta

SEQ ID NO: 234175 - DNA, 25 bp, Mus musculus
cgggacgccaccatcttgagcagaa

SEQ ID NO: 234176 - DNA, 25 bp, Mus musculus
actgagactgccaatcgcccgggac

SEQ ID NO: 234177 - DNA, 25 bp, Mus musculus
cacctctggagcgtaggatcctgaa

SEQ ID NO: 234178 - DNA, 25 bp, Mus musculus
aagtacaaggtagagaaggcgagca

SEQ ID NO: 234179 - DNA, 25 bp, Mus musculus
ctgtcgggctttgacaagtacaagg

SEQ ID NO: 234180 - DNA, 25 bp, Mus musculus
ccagagcagctgtcgggctttgaca

SEQ ID NO: 234181 - DNA, 25 bp, Mus musculus
tacgaatacgtgagcccagagcagc

SEQ ID NO: 234182 - DNA, 25 bp, Mus musculus
tcgggtcgtcatggctggctacgaa

SEQ ID NO: 234183 - DNA, 25 bp, Mus musculus
gcgttcagttttcgggtcgtcatgg

SEQ ID NO: 234184 - DNA, 25 bp, Mus musculus
tttcattgccctgtcgcgcagtgtc

SEQ ID NO: 234185 - DNA, 25 bp, Mus musculus
ccgtgtgctgctcctgtttcattgc

SEQ ID NO: 234186 - DNA, 25 bp, Mus musculus
tttcctagctctgcacaacgccgtg

SEQ ID NO: 234187 - DNA, 25 bp, Mus musculus
tctttaccagcccaggctttcctag

SEQ ID NO: 234188 - DNA, 25 bp, Mus musculus
gcggagcgcgcctctaccttcttta

SEQ ID NO: 234189 - DNA, 25 bp, Mus musculus
catcccgtgccgattggattgaggc

SEQ ID NO: 234190 - DNA, 25 bp, Mus musculus
aagcttgggagcatcctaggccggc

SEQ ID NO: 234191 - DNA, 25 bp, Mus musculus
ggacttggcgatggccatcccgtgc

SEQ ID NO: 234192 - DNA, 25 bp, Mus musculus
tggagatccgcgagcgcagccatgc

SEQ ID NO: 234193 - DNA, 25 bp, Mus musculus
ttggctctcatcgtgtgcaccttca

SEQ ID NO: 234194 - DNA, 25 bp, Mus musculus
tgttcgacgcactggagtcggagcc

SEQ ID NO: 234195 - DNA, 25 bp, Mus musculus
tgcgggcgcgctacaacctcagcga

SEQ ID NO: 234196 - DNA, 25 bp, Mus musculus
acaacctcagcgagggcggctacga

SEQ ID NO: 234197 - DNA, 25 bp, Mus musculus
gtgctgcgcctcaagccgcacaagg

SEQ ID NO: 234198 - DNA, 25 bp, Mus musculus
tgacttcgacctgtctccagtccgg

SEQ ID NO: 234199 - DNA, 25 bp, Mus musculus
tccagtccggccagccctaagttgg

SEQ ID NO: 234200 - DNA, 25 bp, Mus musculus
ccctaagttggccttgccgggctgt

SEQ ID NO: 234201 - DNA, 25 bp, Mus musculus
aagggccggagagagcgccactcct

SEQ ID NO: 234202 - DNA, 25 bp, Mus musculus
gtccacacctgctgggcgttgggaa

SEQ ID NO: 234203 - DNA, 25 bp, Mus musculus
aggcacgtagatgccggaaagctgc

SEQ ID NO: 234204 - DNA, 25 bp, Mus musculus
ggaaagctgcactccgcgacacacg

SEQ ID NO: 234205 - DNA, 25 bp, Mus musculus
cagaatgtgcgcacgttggctctca

SEQ ID NO: 234206 - DNA, 25 bp, Mus musculus
cgagaactcatgcaaatcccggacg

SEQ ID NO: 234207 - DNA, 25 bp, Mus musculus
gatgctctccaccgcgaagacgtgc

SEQ ID NO: 234208 - DNA, 25 bp, Mus musculus
aacagctggcagctccatggccgaa

SEQ ID NO: 234209 - DNA, 25 bp, Mus musculus
cgaacccgagcgctcaggggcgcaa

SEQ ID NO: 234210 - DNA, 25 bp, Mus musculus
gcgcggctgcagacacagctagctc

SEQ ID NO: 234211 - DNA, 25 bp, Mus musculus
cgatacgatcctgcgcgtggacctc

SEQ ID NO: 234212 - DNA, 25 bp, Mus musculus
cgtatccgcttcttttcgatgctct

SEQ ID NO: 234213 - DNA, 25 bp, Mus musculus
ccgcggcacgagaactcatgcaaat

SEQ ID NO: 234214 - DNA, 25 bp, Mus musculus
atccgcttcttttcgatgctctcca

SEQ ID NO: 234215 - DNA, 25 bp, Mus musculus
tgcaaatcccggacgtcagcgggcg

SEQ ID NO: 234216 - DNA, 25 bp, Mus musculus
acgcgcctcggattggcgcagcccg

SEQ ID NO: 234217 - DNA, 25 bp, Mus musculus
gcgcagcccggcctacccgaggccc

SEQ ID NO: 234218 - DNA, 25 bp, Mus musculus
ctcagacaactgagcccgggccgcc

SEQ ID NO: 234219 - DNA, 25 bp, Mus musculus
cgaagacgtgctcgccaacagctgg

SEQ ID NO: 234220 - DNA, 25 bp, Mus musculus
cagagcctgggtgaacgcatcaaca

SEQ ID NO: 234221 - DNA, 25 bp, Mus musculus
aggtgctgcacttccagtccatgtg

SEQ ID NO: 234222 - DNA, 25 bp, Mus musculus
atgtgctcgtgcctctggtacaaga

SEQ ID NO: 234223 - DNA, 25 bp, Mus musculus
tgtacatcctcacgggcctcacggt

SEQ ID NO: 234224 - DNA, 25 bp, Mus musculus
cctcaacctcgtggtgctgcgattc

SEQ ID NO: 234225 - DNA, 25 bp, Mus musculus
tgtggccttcagcttcgtgtacatc

SEQ ID NO: 234226 - DNA, 25 bp, Mus musculus
ggactttcttccaggcctattacta

SEQ ID NO: 234227 - DNA, 25 bp, Mus musculus
catcggtttcgtgtcgtgcatcagc

SEQ ID NO: 234228 - DNA, 25 bp, Mus musculus
accttcgtgaggtacctgctgcacc

SEQ ID NO: 234229 - DNA, 25 bp, Mus musculus
gggcatcccgctcacactagtcatg

SEQ ID NO: 234230 - DNA, 25 bp, Mus musculus
gttctgcatgttctacgcgctgctg

SEQ ID NO: 234231 - DNA, 25 bp, Mus musculus
ttccgcaacgtctatgccgaggtgc

SEQ ID NO: 234232 - DNA, 25 bp, Mus musculus
ttcatgaccatgaacgccgaggacg

SEQ ID NO: 234233 - DNA, 25 bp, Mus musculus
ggccaacatggtgctcatcggtttc

SEQ ID NO: 234234 - DNA, 25 bp, Mus musculus
ctcggacaaagttctcctcaacttc

SEQ ID NO: 234235 - DNA, 25 bp, Mus musculus
cgcattttccctcctttgtaagcaa

SEQ ID NO: 234236 - DNA, 25 bp, Mus musculus
ccggctgcggttcaatgaggtcgca

SEQ ID NO: 234237 - DNA, 25 bp, Mus musculus
ttgccgatcttctcggccggctgcg

SEQ ID NO: 234238 - DNA, 25 bp, Mus musculus
gatgcggctgaaactctcggacaaa

SEQ ID NO: 234239 - DNA, 25 bp, Mus musculus
ggcaacttcgcgaaactggtccagc

SEQ ID NO: 234240 - DNA, 25 bp, Mus musculus
caatgaggtcgcacatctgggcggc

SEQ ID NO: 234241 - DNA, 25 bp, Mus musculus
cctttgtaagcaagagccgcgcggc

SEQ ID NO: 234242 - DNA, 25 bp, Mus musculus
cagtccacccggtgcggtccgtgtt

SEQ ID NO: 234243 - DNA, 25 bp, Mus musculus
cgtgttggcccacgacccggaaatg

SEQ ID NO: 234244 - DNA, 25 bp, Mus musculus
tccgacgaggtgctcgaagaccttg

SEQ ID NO: 234245 - DNA, 25 bp, Mus musculus
ctcgaagaccttggggacgcattcg

SEQ ID NO: 234246 - DNA, 25 bp, Mus musculus
tcgactacactcaccgatgcggctg

SEQ ID NO: 234247 - DNA, 25 bp, Mus musculus
cactggggacagtcgactacactca

SEQ ID NO: 234248 - DNA, 25 bp, Mus musculus
cccggaagttcttgagtaggagact

SEQ ID NO: 234249 - DNA, 25 bp, Mus musculus
gcggtcacttctatctctgagcctc

SEQ ID NO: 234250 - DNA, 25 bp, Mus musculus
ggccactttgattcgcggtcacttc

SEQ ID NO: 234251 - DNA, 25 bp, Mus musculus
agcgggcatttgaaggccactttga

SEQ ID NO: 234252 - DNA, 25 bp, Mus musculus
agccctccacattaccgagagttca

SEQ ID NO: 234253 - DNA, 25 bp, Mus musculus
ctttcggcaaagtgagtctgggtca

SEQ ID NO: 234254 - DNA, 25 bp, Mus musculus
ggctccatcaacacgctttcggcaa

SEQ ID NO: 234255 - DNA, 25 bp, Mus musculus
cttatgctggtcaccggctccatca

SEQ ID NO: 234256 - DNA, 25 bp, Mus musculus
accagttgttcctggccgggcttat

SEQ ID NO: 234257 - DNA, 25 bp, Mus musculus
accactatggcctggactaagtacc

SEQ ID NO: 234258 - DNA, 25 bp, Mus musculus
tggtctctcgtgtccaccactatgg

SEQ ID NO: 234259 - DNA, 25 bp, Mus musculus
agctgctgattcaagtggtctctcg

SEQ ID NO: 234260 - DNA, 25 bp, Mus musculus
cgaagggttggatcagtttctcccg

SEQ ID NO: 234261 - DNA, 25 bp, Mus musculus
gtaggagactccacatcccgggtga

SEQ ID NO: 234262 - DNA, 25 bp, Mus musculus
gcgggtgattttttgaactgctggc

SEQ ID NO: 234263 - DNA, 25 bp, Mus musculus
tgaactgctggcgaccgagttctgg

SEQ ID NO: 234264 - DNA, 25 bp, Mus musculus
cgaccgagttctggcggtcctgacg

SEQ ID NO: 234265 - DNA, 25 bp, Mus musculus
tcctgacgcgcaccttgggcttgct

SEQ ID NO: 234266 - DNA, 25 bp, Mus musculus
caccttgggcttgctcgcgttcggt

SEQ ID NO: 234267 - DNA, 25 bp, Mus musculus
cgcgttcggtttcggcagcaggacc

SEQ ID NO: 234268 - DNA, 25 bp, Mus musculus
cagcaggaccaagaaggcttaggga

SEQ ID NO: 234269 - DNA, 25 bp, Mus musculus
cgcctggaccctcgcgacagagctc

SEQ ID NO: 234270 - DNA, 25 bp, Mus musculus
acagagctccagtgtaggtaagcga

SEQ ID NO: 234271 - DNA, 25 bp, Mus musculus
cagtgtaggtaagcgagcctgccct

SEQ ID NO: 234272 - DNA, 25 bp, Mus musculus
tccgaggccggtgcggtcatcctgt

SEQ ID NO: 234273 - DNA, 25 bp, Mus musculus
cctgtagagggacggttcctggtca

SEQ ID NO: 234274 - DNA, 25 bp, Mus musculus
tggtcacggcttgccgctaacctcg

SEQ ID NO: 234275 - DNA, 25 bp, Mus musculus
tgattttttgaactgctggcgaccg

SEQ ID NO: 234276 - DNA, 25 bp, Mus musculus
cgctagttaccatgggaccagaaag

SEQ ID NO: 234277 - DNA, 25 bp, Mus musculus
tgggaacccgcagcctcggagagac

SEQ ID NO: 234278 - DNA, 25 bp, Mus musculus
aggcgatgtgtcctccggagacgcc

SEQ ID NO: 234279 - DNA, 25 bp, Mus musculus
cctgggctttgtgaagtgtcgctag

SEQ ID NO: 234280 - DNA, 25 bp, Mus musculus
ccatgggaccagaaaggaacgctga

SEQ ID NO: 234281 - DNA, 25 bp, Mus musculus
cggtaggacgctaatccgatggcgc

SEQ ID NO: 234282 - DNA, 25 bp, Mus musculus
aggtcctggggccatgccctctgtc

SEQ ID NO: 234283 - DNA, 25 bp, Mus musculus
ttgtagtcccaaaggcggcggcaac

SEQ ID NO: 234284 - DNA, 25 bp, Mus musculus
ccgcctaacctgctagctcgaggtg

SEQ ID NO: 234285 - DNA, 25 bp, Mus musculus
tgctagctcgaggtggcgagcactt

SEQ ID NO: 234286 - DNA, 25 bp, Mus musculus
gccctcggatccgtgattggcccag

SEQ ID NO: 234287 - DNA, 25 bp, Mus musculus
cgcaaggcagccaccgagagagcgc

SEQ ID NO: 234288 - DNA, 25 bp, Mus musculus
atccgatggcgcaactgggaacccg

SEQ ID NO: 234289 - DNA, 25 bp, Mus musculus
cagaaaggaacgctgagaatggcgc

SEQ ID NO: 234290 - DNA, 25 bp, Mus musculus
accagtcagtttcttcccctcgttg

SEQ ID NO: 234291 - DNA, 25 bp, Mus musculus
cgtgttctgcgggtctccgtcctcg

SEQ ID NO: 234292 - DNA, 25 bp, Mus musculus
ctcccgcactgtgagtccgggctga

SEQ ID NO: 234293 - DNA, 25 bp, Mus musculus
tcggtgcttttaagccggagaccgc

SEQ ID NO: 234294 - DNA, 25 bp, Mus musculus
cccgcagtctcggtgcttttaagcc

SEQ ID NO: 234295 - DNA, 25 bp, Mus musculus
tagaggtaggggttgtccgcttctg

SEQ ID NO: 234296 - DNA, 25 bp, Mus musculus
ccattgctaggacgaggtagaggta

SEQ ID NO: 234297 - DNA, 25 bp, Mus musculus
gccgccattgctaggacgaggtaga

SEQ ID NO: 234298 - DNA, 25 bp, Mus musculus
tcccgccgccattgctaggacgagg

SEQ ID NO: 234299 - DNA, 25 bp, Mus musculus
agggattgttctcctctctcgcacc

SEQ ID NO: 234300 - DNA, 25 bp, Mus musculus
gcgatctagagggattgttctcctc

SEQ ID NO: 234301 - DNA, 25 bp, Mus musculus
ctatggcgatctagagggattgttc

SEQ ID NO: 234302 - DNA, 25 bp, Mus musculus
tgcgggtctccgtcctcggtggcct

SEQ ID NO: 234303 - DNA, 25 bp, Mus musculus
ccctcgttgctatggcgatctagag

SEQ ID NO: 234304 - DNA, 25 bp, Mus musculus
gcaaatggagtgttgaaatacgacc

SEQ ID NO: 234305 - DNA, 25 bp, Mus musculus
ctccgctgcataggtcggaagcgga

SEQ ID NO: 234306 - DNA, 25 bp, Mus musculus
gtcatctccgctgcataggtcggaa

SEQ ID NO: 234307 - DNA, 25 bp, Mus musculus
aggtggtcatctccgctgcataggt

SEQ ID NO: 234308 - DNA, 25 bp, Mus musculus
acagcacgaggagaggtggtcatct

SEQ ID NO: 234309 - DNA, 25 bp, Mus musculus
ccacggtgactcagggacagcacga

SEQ ID NO: 234310 - DNA, 25 bp, Mus musculus
tgagctgtgagtatccgccgccgcc

SEQ ID NO: 234311 - DNA, 25 bp, Mus musculus
gcagggtagggatttttgcgcccca

SEQ ID NO: 234312 - DNA, 25 bp, Mus musculus
gtgttgaaatacgacctgagctgtg

SEQ ID NO: 234313 - DNA, 25 bp, Mus musculus
cgacctggagcaagcagcggtgggc

SEQ ID NO: 234314 - DNA, 25 bp, Mus musculus
gagctgaagtcatggcggccagatc

SEQ ID NO: 234315 - DNA, 25 bp, Mus musculus
gtggcgcgaacggactacgaatccc

SEQ ID NO: 234316 - DNA, 25 bp, Mus musculus
cgccgtggcgcgaacggactacgaa

SEQ ID NO: 234317 - DNA, 25 bp, Mus musculus
acgacctgagctgtgagtatccgcc

SEQ ID NO: 234318 - DNA, 25 bp, Mus musculus
gcagcattcgtagtcccaaacaccg

SEQ ID NO: 234319 - DNA, 25 bp, Mus musculus
cgcatcatcagaacaacatgcttta

SEQ ID NO: 234320 - DNA, 25 bp, Mus musculus
aaacctggagcagaagcagcattcg

SEQ ID NO: 234321 - DNA, 25 bp, Mus musculus
tttcatcacgccgaaaaccaaagga

SEQ ID NO: 234322 - DNA, 25 bp, Mus musculus
tctgcttagcgagaggaaggccgcc

SEQ ID NO: 234323 - DNA, 25 bp, Mus musculus
tttagcctcaatccggctcacggcg

SEQ ID NO: 234324 - DNA, 25 bp, Mus musculus
ggtgcgagcctgcaagcccgccttt

SEQ ID NO: 234325 - DNA, 25 bp, Mus musculus
caccgaaactaatgtctgcttagcg

SEQ ID NO: 234326 - DNA, 25 bp, Mus musculus
cggagcgaatgtctttcgcatcatc

SEQ ID NO: 234327 - DNA, 25 bp, Mus musculus
ccgacacttcagctgacggagcgaa

SEQ ID NO: 234328 - DNA, 25 bp, Mus musculus
ctcggtcttcccttctggcctgggt

SEQ ID NO: 234329 - DNA, 25 bp, Mus musculus
ataggggtccctcgctcccgtggct

SEQ ID NO: 234330 - DNA, 25 bp, Mus musculus
tgcatcccagcgtccagggcatagg

SEQ ID NO: 234331 - DNA, 25 bp, Mus musculus
tcacggcgagctcctgccgcagggt

SEQ ID NO: 234332 - DNA, 25 bp, Mus musculus
caagagacttcttgtttcctggcag

SEQ ID NO: 234333 - DNA, 25 bp, Mus musculus
gcgggccgttaaccgcctacagaga

SEQ ID NO: 234334 - DNA, 25 bp, Mus musculus
cggcaccgcggctctctggttttgt

SEQ ID NO: 234335 - DNA, 25 bp, Mus musculus
tgcagctgcggccaataggcaagag

SEQ ID NO: 234336 - DNA, 25 bp, Mus musculus
gcggccaataggcaagagacttctt

SEQ ID NO: 234337 - DNA, 25 bp, Mus musculus
agacgcctagtgagccgcacacggc

SEQ ID NO: 234338 - DNA, 25 bp, Mus musculus
ccgcctacagagaagacgcctagtg

SEQ ID NO: 234339 - DNA, 25 bp, Mus musculus
tttactgggcgggtagccagctgca

SEQ ID NO: 234340 - DNA, 25 bp, Mus musculus
accaatggcagtgcgctttactggg

SEQ ID NO: 234341 - DNA, 25 bp, Mus musculus
gctctctggttttgtgtgggtcccg

SEQ ID NO: 234342 - DNA, 25 bp, Mus musculus
gtggcgaccaatggcagtgcgcttt

SEQ ID NO: 234343 - DNA, 25 bp, Mus musculus
gcacggaaccctgcgtggcgaccaa

SEQ ID NO: 234344 - DNA, 25 bp, Mus musculus
tgccaacgtgcacggaaccctgcgt

SEQ ID NO: 234345 - DNA, 25 bp, Mus musculus
tcacaggtacctgccaacgtgcacg

SEQ ID NO: 234346 - DNA, 25 bp, Mus musculus
gcgccactttcattcctgcttcttg

SEQ ID NO: 234347 - DNA, 25 bp, Mus musculus
gcgcgcgcaaaagagccggtcttag

SEQ ID NO: 234348 - DNA, 25 bp, Mus musculus
cgtagtgctagctggggaacaacgc

SEQ ID NO: 234349 - DNA, 25 bp, Mus musculus
cctgagccggaacttcgtagtgcta

SEQ ID NO: 234350 - DNA, 25 bp, Mus musculus
cacaaactcgaggtaggcgacctga

SEQ ID NO: 234351 - DNA, 25 bp, Mus musculus
gactccgacactacagacgcacaaa

SEQ ID NO: 234352 - DNA, 25 bp, Mus musculus
ctcgcctatgaaacggcgcctgcga

SEQ ID NO: 234353 - DNA, 25 bp, Mus musculus
tgagcctcgattcacgcactccttg

SEQ ID NO: 234354 - DNA, 25 bp, Mus musculus
cgtgatcatcctgtggacaagggga

SEQ ID NO: 234355 - DNA, 25 bp, Mus musculus
ggcgagctgcacgtccgtgatcatc

SEQ ID NO: 234356 - DNA, 25 bp, Mus musculus
gacacgcccagcatgttggcgaaga

SEQ ID NO: 234357 - DNA, 25 bp, Mus musculus
tgccacgtagtgatagaggaccaca

SEQ ID NO: 234358 - DNA, 25 bp, Mus musculus
aggcggagcctagaatggccgtcct

SEQ ID NO: 234359 - DNA, 25 bp, Mus musculus
ctgcttcttggggttgtttactgcc

SEQ ID NO: 234360 - DNA, 25 bp, Mus musculus
tgggtttcactagcccaccgcctgg

SEQ ID NO: 234361 - DNA, 25 bp, Mus musculus
agaacccgcgtagtgctggatctgc

SEQ ID NO: 234362 - DNA, 25 bp, Mus musculus
tctgcggtgcagatagactagaggt

SEQ ID NO: 234363 - DNA, 25 bp, Mus musculus
cctgggcacccttggggccacaaat

SEQ ID NO: 234364 - DNA, 25 bp, Mus musculus
agggccgttcctccgcattgcggca

SEQ ID NO: 234365 - DNA, 25 bp, Mus musculus
ccgggaccatatttcatacatgatc

SEQ ID NO: 234366 - DNA, 25 bp, Mus musculus
ccgggcacagcacgcagagtagctg

SEQ ID NO: 234367 - DNA, 25 bp, Mus musculus
cccttgcagtttgctctcgggtgcc

SEQ ID NO: 234368 - DNA, 25 bp, Mus musculus
cggggcccacacacaggccagattt

SEQ ID NO: 234369 - DNA, 25 bp, Mus musculus
caaccagagctagctgctgcagcca

SEQ ID NO: 234370 - DNA, 25 bp, Mus musculus
aagaaatgaaaatcgctccggcgga

SEQ ID NO: 234371 - DNA, 25 bp, Mus musculus
cccgaagagatcgtcagccgaggcg

SEQ ID NO: 234372 - DNA, 25 bp, Mus musculus
acacaattgtccaccgctgctgcta

SEQ ID NO: 234373 - DNA, 25 bp, Mus musculus
atgatctttgaagccgacacaattg

SEQ ID NO: 234374 - DNA, 25 bp, Mus musculus
cggactcagggtcacggccaccggt

SEQ ID NO: 234375 - DNA, 25 bp, Mus musculus
ccactgcgaaggctggcagcgttcc

SEQ ID NO: 234376 - DNA, 25 bp, Mus musculus
ccgtcacgtgacaccgttaatctgg

SEQ ID NO: 234377 - DNA, 25 bp, Mus musculus
cgtgacaccgttaatctggcgcggg

SEQ ID NO: 234378 - DNA, 25 bp, Mus musculus
cgagggagagaacgcttgcttctgt

SEQ ID NO: 234379 - DNA, 25 bp, Mus musculus
gaacgcttgcttctgtgctccgcct

SEQ ID NO: 234380 - DNA, 25 bp, Mus musculus
tgctccgcctgcgaaggcgaagttt

SEQ ID NO: 234381 - DNA, 25 bp, Mus musculus
aggcgaagtttctgttgccagactg

SEQ ID NO: 234382 - DNA, 25 bp, Mus musculus
ttctgttgccagactgtgctagtcc

SEQ ID NO: 234383 - DNA, 25 bp, Mus musculus
agactgtgctagtccgggtggtcca

SEQ ID NO: 234384 - DNA, 25 bp, Mus musculus
agggatcggaaaggcgatgcattac

SEQ ID NO: 234385 - DNA, 25 bp, Mus musculus
ggcgatgcattactagtgcgctttc

SEQ ID NO: 234386 - DNA, 25 bp, Mus musculus
agtgcgctttcgctttgacagctga

SEQ ID NO: 234387 - DNA, 25 bp, Mus musculus
ggcgctaggccagaaccactgcgaa

SEQ ID NO: 234388 - DNA, 25 bp, Mus musculus
caggcccgggcagagtccggagcga

SEQ ID NO: 234389 - DNA, 25 bp, Mus musculus
ccgccgcccactaagccctggccca

SEQ ID NO: 234390 - DNA, 25 bp, Mus musculus
taagccctggcccatgccggagtct

SEQ ID NO: 234391 - DNA, 25 bp, Mus musculus
agccctggcccatgccggagtctga

SEQ ID NO: 234392 - DNA, 25 bp, Mus musculus
ccatgccggagtctgacccacctgc

SEQ ID NO: 234393 - DNA, 25 bp, Mus musculus
ggctccggcttcgtgaactctatag

SEQ ID NO: 234394 - DNA, 25 bp, Mus musculus
ctccggcttcgtgaactctataggc

SEQ ID NO: 234395 - DNA, 25 bp, Mus musculus
cggcttcgtgaactctataggcacc

SEQ ID NO: 234396 - DNA, 25 bp, Mus musculus
ttcgtgaactctataggcaccgcgc

SEQ ID NO: 234397 - DNA, 25 bp, Mus musculus
gtgaactctataggcaccgcgccgc

SEQ ID NO: 234398 - DNA, 25 bp, Mus musculus
ggcggctccacgtggccattccacg

SEQ ID NO: 234399 - DNA, 25 bp, Mus musculus
cctccttgggcagacctgtcccgca

SEQ ID NO: 234400 - DNA, 25 bp, Mus musculus
gacagccacgggagggccaccgccc

SEQ ID NO: 234401 - DNA, 25 bp, Mus musculus
gccattccacgtcgccctcccggct

SEQ ID NO: 234402 - DNA, 25 bp, Mus musculus
ttgcaaaagactcggaaacgggagc

SEQ ID NO: 234403 - DNA, 25 bp, Mus musculus
agcgagcaggtcagcgttacacaac

SEQ ID NO: 234404 - DNA, 25 bp, Mus musculus
gccgtcagccgctgggtccaaaata

SEQ ID NO: 234405 - DNA, 25 bp, Mus musculus
ggtccaaaatagcagccagctcgca

SEQ ID NO: 234406 - DNA, 25 bp, Mus musculus
gcggctccacactcctcggagggga

SEQ ID NO: 234407 - DNA, 25 bp, Mus musculus
acttttccacgtccacccatgtggg

SEQ ID NO: 234408 - DNA, 25 bp, Mus musculus
ttcacgcaacaccttcaactacttg

SEQ ID NO: 234409 - DNA, 25 bp, Mus musculus
agcgttacacaaccagcgccgtcag

SEQ ID NO: 234410 - DNA, 25 bp, Mus musculus
gcttcagggaaccagtcaggctctc

SEQ ID NO: 234411 - DNA, 25 bp, Mus musculus
ctccgctcgggaataccttggctgc

SEQ ID NO: 234412 - DNA, 25 bp, Mus musculus
cttggctgccgggaactacagttcc

SEQ ID NO: 234413 - DNA, 25 bp, Mus musculus
ttcctagcatccatcgggccgctgg

SEQ ID NO: 234414 - DNA, 25 bp, Mus musculus
ggccgcgggccaattcctgagacca

SEQ ID NO: 234415 - DNA, 25 bp, Mus musculus
acccatgtgggcaacctttcaaatg

SEQ ID NO: 234416 - DNA, 25 bp, Mus musculus
cctgccaatggcttgcaagaggcgg

SEQ ID NO: 234417 - DNA, 25 bp, Mus musculus
tgcaagaggcgggtgcacgacaaac

SEQ ID NO: 234418 - DNA, 25 bp, Mus musculus
ccgcaagcggaagagtcaaagttca

SEQ ID NO: 234419 - DNA, 25 bp, Mus musculus
gtgcacgacaaaccgcaagcggaag

SEQ ID NO: 234420 - DNA, 25 bp, Mus musculus
cgggtgcacgacaaaccgcaagcgg

SEQ ID NO: 234421 - DNA, 25 bp, Mus musculus
tcaaagttcaggagctagaggcgcc

SEQ ID NO: 234422 - DNA, 25 bp, Mus musculus
cggaagagtcaaagttcaggagcta

SEQ ID NO: 234423 - DNA, 25 bp, Mus musculus
ccctcgcctcagaactggcggtggg

SEQ ID NO: 234424 - DNA, 25 bp, Mus musculus
aggttaggcagacagccagacaccg

SEQ ID NO: 234425 - DNA, 25 bp, Mus musculus
gctagtgaggttaggcagacagcca

SEQ ID NO: 234426 - DNA, 25 bp, Mus musculus
gactccgctactgccgctggggcta

SEQ ID NO: 234427 - DNA, 25 bp, Mus musculus
aggatcgtgggcgactccgctactg

SEQ ID NO: 234428 - DNA, 25 bp, Mus musculus
gcagaagcctgccaatggcttgcaa

SEQ ID NO: 234429 - DNA, 25 bp, Mus musculus
agaggcgggtgcacgacaaaccgca

SEQ ID NO: 234430 - DNA, 25 bp, Mus musculus
tcacggaaccctggcgtcggatccg

SEQ ID NO: 234431 - DNA, 25 bp, Mus musculus
gggtctatccgaagcgcgtacaacg

SEQ ID NO: 234432 - DNA, 25 bp, Mus musculus
gaacggggcccggtacagctccaca

SEQ ID NO: 234433 - DNA, 25 bp, Mus musculus
tcgcctccgaaagctcaggaacttg

SEQ ID NO: 234434 - DNA, 25 bp, Mus musculus
gctcaggaacttggcgctagagttt

SEQ ID NO: 234435 - DNA, 25 bp, Mus musculus
cgctagagttttccggaagactgcc

SEQ ID NO: 234436 - DNA, 25 bp, Mus musculus
agcactggacttgccaccactcaaa

SEQ ID NO: 234437 - DNA, 25 bp, Mus musculus
tcttgcaggcgttcagtgcgcacgc

SEQ ID NO: 234438 - DNA, 25 bp, Mus musculus
tgcgcaagcgcaagacgccaatccg

SEQ ID NO: 234439 - DNA, 25 bp, Mus musculus
tagcgggacgcgctgtcacggaacc

SEQ ID NO: 234440 - DNA, 25 bp, Mus musculus
acgccattctttatgccggtcttgg

SEQ ID NO: 234441 - DNA, 25 bp, Mus musculus
ccgcagcgatgagcagcccagtctt

SEQ ID NO: 234442 - DNA, 25 bp, Mus musculus
cagcccagtcttggggtctatccga

SEQ ID NO: 234443 - DNA, 25 bp, Mus musculus
ccaatccgcgtcagcactagcggga

SEQ ID NO: 234444 - DNA, 25 bp, Mus musculus
tggaagctaagcctcgcctcaaggc

SEQ ID NO: 234445 - DNA, 25 bp, Mus musculus
ctcaaggcaactaagcgctaactgg

SEQ ID NO: 234446 - DNA, 25 bp, Mus musculus
ttactaagggcggatggagctgccc

SEQ ID NO: 234447 - DNA, 25 bp, Mus musculus
ctcgcctcaaggctggcgcgtgaca

SEQ ID NO: 234448 - DNA, 25 bp, Mus musculus
cgagctgtcaagacggtggaaagca

SEQ ID NO: 234449 - DNA, 25 bp, Mus musculus
gcagcccgaacctgcgggcaaatta

SEQ ID NO: 234450 - DNA, 25 bp, Mus musculus
ggcaaattacgcctcgggctccacg

SEQ ID NO: 234451 - DNA, 25 bp, Mus musculus
agcgcaggacaggagctcagaattc

SEQ ID NO: 234452 - DNA, 25 bp, Mus musculus
tggtgggtctgtccaccgcgagcaa

SEQ ID NO: 234453 - DNA, 25 bp, Mus musculus
gctaactggacaggcctgcgctcca

SEQ ID NO: 234454 - DNA, 25 bp, Mus musculus
gagggtcatgcagtagctcaaggca

SEQ ID NO: 234455 - DNA, 25 bp, Mus musculus
tgacaggatttggaagctaagcctc

SEQ ID NO: 234456 - DNA, 25 bp, Mus musculus
tcagaattccgcgagcagcccgaac

SEQ ID NO: 234457 - DNA, 25 bp, Mus musculus
ctcggttctcgcgagctgtcaagac

SEQ ID NO: 234458 - DNA, 25 bp, Mus musculus
gcgcagcgagccacgtggaccaact

SEQ ID NO: 234459 - DNA, 25 bp, Mus musculus
gaaggcagtcatctcctccgggatt

SEQ ID NO: 234460 - DNA, 25 bp, Mus musculus
ttctccactcacgaccgaaggcagt

SEQ ID NO: 234461 - DNA, 25 bp, Mus musculus
ctttggggccgctgtgtcgactgct

SEQ ID NO: 234462 - DNA, 25 bp, Mus musculus
tgtctcagctccgacccgatggcgg

SEQ ID NO: 234463 - DNA, 25 bp, Mus musculus
tgttcgcttggttccagtggggctc

SEQ ID NO: 234464 - DNA, 25 bp, Mus musculus
ttagggctctggcttgccgctcccg

SEQ ID NO: 234465 - DNA, 25 bp, Mus musculus
tcactacgcttagggctctggcttg

SEQ ID NO: 234466 - DNA, 25 bp, Mus musculus
gtcgtgcttcagctcactacgctta

SEQ ID NO: 234467 - DNA, 25 bp, Mus musculus
cttgcgccgtcgcagtcgtgcttca

SEQ ID NO: 234468 - DNA, 25 bp, Mus musculus
tgacgttgccggctgcttgcgccgt

SEQ ID NO: 234469 - DNA, 25 bp, Mus musculus
cgtctgcgtgcttgccctgtctcag

SEQ ID NO: 234470 - DNA, 25 bp, Mus musculus
ctcctccgggatttgctgctctcgg

SEQ ID NO: 234471 - DNA, 25 bp, Mus musculus
acgtggaccaactccggcgcgcggt

SEQ ID NO: 234472 - DNA, 25 bp, Mus musculus
tcagtggcgagagctcagtgacctt

SEQ ID NO: 234473 - DNA, 25 bp, Mus musculus
tgtccctgcagtctgctcgccagtt

SEQ ID NO: 234474 - DNA, 25 bp, Mus musculus
ccagttctgccacacggtcgggtac

SEQ ID NO: 234475 - DNA, 25 bp, Mus musculus
ctcctatgtgctcagcggtgctgct

SEQ ID NO: 234476 - DNA, 25 bp, Mus musculus
gcccgtgttgcctccaggagatcga

SEQ ID NO: 234477 - DNA, 25 bp, Mus musculus
tgctgctatgaatgtggcgtacacc

SEQ ID NO: 234478 - DNA, 25 bp, Mus musculus
tcccggctcctagataccatcggta

SEQ ID NO: 234479 - DNA, 25 bp, Mus musculus
cccgtagtcatctccaagttcattc

SEQ ID NO: 234480 - DNA, 25 bp, Mus musculus
gtactcgctgggtcacaggcacagt

SEQ ID NO: 234481 - DNA, 25 bp, Mus musculus
agggatggcttgtgtctgacaacgc

SEQ ID NO: 234482 - DNA, 25 bp, Mus musculus
caacgctgtttcaccaaagggcaag

SEQ ID NO: 234483 - DNA, 25 bp, Mus musculus
ctcagccgagaaccgattcaagttc

SEQ ID NO: 234484 - DNA, 25 bp, Mus musculus
accatcggtatcagccagcctcagt

SEQ ID NO: 234485 - DNA, 25 bp, Mus musculus
acctggagcgtttcctgagcagtgc

SEQ ID NO: 234486 - DNA, 25 bp, Mus musculus
cccgtctgtgcggagccgggaatac

SEQ ID NO: 234487 - DNA, 25 bp, Mus musculus
ctcggagtccgaactgcagagcccg

SEQ ID NO: 234488 - DNA, 25 bp, Mus musculus
agcggtccaaggaccactcggactc

SEQ ID NO: 234489 - DNA, 25 bp, Mus musculus
ggccttgcgccaaatccgagcggtc

SEQ ID NO: 234490 - DNA, 25 bp, Mus musculus
ccagaccgtctaggccgcacagagg

SEQ ID NO: 234491 - DNA, 25 bp, Mus musculus
ggtggccagagaaggctccatgtcc

SEQ ID NO: 234492 - DNA, 25 bp, Mus musculus
ctgctgcggtctcgggcactcacta

SEQ ID NO: 234493 - DNA, 25 bp, Mus musculus
ggtctgtcctacctcttcaatcgca

SEQ ID NO: 234494 - DNA, 25 bp, Mus musculus
acgaaatggaccgatggcatcagtc

SEQ ID NO: 234495 - DNA, 25 bp, Mus musculus
ccgcgccaagggagacaacgaaatg

SEQ ID NO: 234496 - DNA, 25 bp, Mus musculus
gccggcagatctgcgtcgcgaagtt

SEQ ID NO: 234497 - DNA, 25 bp, Mus musculus
ctttgcccggccaggagaacatggg

SEQ ID NO: 234498 - DNA, 25 bp, Mus musculus
aggcgcacggagcaatgcggacatc

SEQ ID NO: 234499 - DNA, 25 bp, Mus musculus
taaagctgggattccaatgcccgga

SEQ ID NO: 234500 - DNA, 25 bp, Mus musculus
acctctcgagggtccacgatcactg

SEQ ID NO: 234501 - DNA, 25 bp, Mus musculus
cgccgggctagcagttgaagcgcct

SEQ ID NO: 234502 - DNA, 25 bp, Mus musculus
gctagcagttgaagcgcctgggtta

SEQ ID NO: 234503 - DNA, 25 bp, Mus musculus
cagttgaagcgcctgggttacctaa

SEQ ID NO: 234504 - DNA, 25 bp, Mus musculus
gcgcctgggttacctaaccttctca

SEQ ID NO: 234505 - DNA, 25 bp, Mus musculus
gcctgggttacctaaccttctcata

SEQ ID NO: 234506 - DNA, 25 bp, Mus musculus
ctgggttacctaaccttctcataag

SEQ ID NO: 234507 - DNA, 25 bp, Mus musculus
cctaaccttctcataaggaggtttg

SEQ ID NO: 234508 - DNA, 25 bp, Mus musculus
cttctcataaggaggtttgggcggc

SEQ ID NO: 234509 - DNA, 25 bp, Mus musculus
gtcacctctcgagggtccacgatca

SEQ ID NO: 234510 - DNA, 25 bp, Mus musculus
ctctcgagggtccacgatcactgtt

SEQ ID NO: 234511 - DNA, 25 bp, Mus musculus
ctcgagggtccacgatcactgttta

SEQ ID NO: 234512 - DNA, 25 bp, Mus musculus
cgagggtccacgatcactgtttatc

SEQ ID NO: 234513 - DNA, 25 bp, Mus musculus
tctgtcacctctcgagggtccacga

SEQ ID NO: 234514 - DNA, 25 bp, Mus musculus
tgttcgatttgtcagcaggtaactc

SEQ ID NO: 234515 - DNA, 25 bp, Mus musculus
agggacgctgcttgttcgatttgtc

SEQ ID NO: 234516 - DNA, 25 bp, Mus musculus
ttggggaaagacaacggcccagaga

SEQ ID NO: 234517 - DNA, 25 bp, Mus musculus
tgctcgtttggggaaagacaacggc

SEQ ID NO: 234518 - DNA, 25 bp, Mus musculus
aactgtaacgcggtgctcgtttggg

SEQ ID NO: 234519 - DNA, 25 bp, Mus musculus
cctacttaactgtaacgcggtgctc

SEQ ID NO: 234520 - DNA, 25 bp, Mus musculus
cagcaggtaactccttccttaccta

SEQ ID NO: 234521 - DNA, 25 bp, Mus musculus
ttgtcagcaggtaactccttcctta

SEQ ID NO: 234522 - DNA, 25 bp, Mus musculus
cgatttgtcagcaggtaactccttc

SEQ ID NO: 234523 - DNA, 25 bp, Mus musculus
acgctgcttgttcgatttgtcagca

SEQ ID NO: 234524 - DNA, 25 bp, Mus musculus
atcactgtttatcgagggacgctgc

SEQ ID NO: 234525 - DNA, 25 bp, Mus musculus
ggcccagagaaaggactcacttaca

SEQ ID NO: 234526 - DNA, 25 bp, Mus musculus
gaaaggactcacttacaagccgtcg

SEQ ID NO: 234527 - DNA, 25 bp, Mus musculus
actgtttatcgagggacgctgcttg

SEQ ID NO: 234528 - DNA, 25 bp, Mus musculus
tgaataatgactgatgtggaagggc

SEQ ID NO: 234529 - DNA, 25 bp, Mus musculus
gttcctccatggctttagttcccac

SEQ ID NO: 234530 - DNA, 25 bp, Mus musculus
gggagccgatcagtgttcctccatg

SEQ ID NO: 234531 - DNA, 25 bp, Mus musculus
aaggaaccagtcaggaccgagcctg

SEQ ID NO: 234532 - DNA, 25 bp, Mus musculus
cccaacacggggagccagtcaggac

SEQ ID NO: 234533 - DNA, 25 bp, Mus musculus
ccagctcactgagacctgagcatgc

SEQ ID NO: 234534 - DNA, 25 bp, Mus musculus
caggttccttccttgaacttctgtc

SEQ ID NO: 234535 - DNA, 25 bp, Mus musculus
ctgcgtgagatattttcttgaataa

SEQ ID NO: 234536 - DNA, 25 bp, Mus musculus
ccaccagattggtctgcgtgagata

SEQ ID NO: 234537 - DNA, 25 bp, Mus musculus
gacgccttcatgattggccaccaga

SEQ ID NO: 234538 - DNA, 25 bp, Mus musculus
ctagttatttgggaggacgccttca

SEQ ID NO: 234539 - DNA, 25 bp, Mus musculus
tggccagatccaatctagttatttg

SEQ ID NO: 234540 - DNA, 25 bp, Mus musculus
ttttgtgttggccagatccaatcta

SEQ ID NO: 234541 - DNA, 25 bp, Mus musculus
ctgagcatgccacagggagccagtc

SEQ ID NO: 234542 - DNA, 25 bp, Mus musculus
tggggaaccgatttagacacgcctg

SEQ ID NO: 234543 - DNA, 25 bp, Mus musculus
cctgattccaatcgcgctggtgctg

SEQ ID NO: 234544 - DNA, 25 bp, Mus musculus
gcacagagcattccggactgccctg

SEQ ID NO: 234545 - DNA, 25 bp, Mus musculus
cacgcctgggtcgatgacgacaaca

SEQ ID NO: 234546 - DNA, 25 bp, Mus musculus
ctgcacttcagagatggctatacta

SEQ ID NO: 234547 - DNA, 25 bp, Mus musculus
ctggagtggccaaagagcaagatgc

SEQ ID NO: 234548 - DNA, 25 bp, Mus musculus
ctctggggatttcccttcctgggca

SEQ ID NO: 234549 - DNA, 25 bp, Mus musculus
aaggtcaccttgttggcccacgtca

SEQ ID NO: 234550 - DNA, 25 bp, Mus musculus
atgtccctgtccagctaagccagcg

SEQ ID NO: 234551 - DNA, 25 bp, Mus musculus
cgccgtcggttttctaaattcgctg

SEQ ID NO: 234552 - DNA, 25 bp, Mus musculus
gaaaatccagcctgcacgtcctagg

SEQ ID NO: 234553 - DNA, 25 bp, Mus musculus
agccagcgagcttatcatgccgacc

SEQ ID NO: 234554 - DNA, 25 bp, Mus musculus
ccctgtgcgatggtgtctggaccaa

SEQ ID NO: 234555 - DNA, 25 bp, Mus musculus
ctcagcttgcgtctcaggaggacaa

SEQ ID NO: 234556 - DNA, 25 bp, Mus musculus
aggcctgcactgacccgactctgat

SEQ ID NO: 234557 - DNA, 25 bp, Mus musculus
gagccaagggatgctgaggatctgc

SEQ ID NO: 234558 - DNA, 25 bp, Mus musculus
cgcacacccgaagcgggagccaagg

SEQ ID NO: 234559 - DNA, 25 bp, Mus musculus
accgcctagcgctctgaaaagtgca

SEQ ID NO: 234560 - DNA, 25 bp, Mus musculus
agcacccgctcaccgggcggttaat

SEQ ID NO: 234561 - DNA, 25 bp, Mus musculus
cttgttcgtttggagcacccgctca

SEQ ID NO: 234562 - DNA, 25 bp, Mus musculus
cctagcgctctgaaaagtgcacgtt

SEQ ID NO: 234563 - DNA, 25 bp, Mus musculus
agctgtcgggagtgccttgttcgtt

SEQ ID NO: 234564 - DNA, 25 bp, Mus musculus
gcgctctgaaaagtgcacgtttccc

SEQ ID NO: 234565 - DNA, 25 bp, Mus musculus
cgtgtaatagaacccccgctgcctg

SEQ ID NO: 234566 - DNA, 25 bp, Mus musculus
ggagcctgcaaggtaccgtgtaata

SEQ ID NO: 234567 - DNA, 25 bp, Mus musculus
ctgcaaggtaccgtgtaatagaacc

SEQ ID NO: 234568 - DNA, 25 bp, Mus musculus
gcactgacccgactctgatccagag

SEQ ID NO: 234569 - DNA, 25 bp, Mus musculus
tgatccagagcgcacacccgaagcg

SEQ ID NO: 234570 - DNA, 25 bp, Mus musculus
aagcgctccgctaacagcaagagga

SEQ ID NO: 234571 - DNA, 25 bp, Mus musculus
agctagctccagcagggtccgcagc

SEQ ID NO: 234572 - DNA, 25 bp, Mus musculus
tgctctccgggcgaagctgtgccaa

SEQ ID NO: 234573 - DNA, 25 bp, Mus musculus
gagcagccgcaggtaacacgagccc

SEQ ID NO: 234574 - DNA, 25 bp, Mus musculus
atatgatgcggttctgctctgcgcg

SEQ ID NO: 234575 - DNA, 25 bp, Mus musculus
ggggccgatcacttgcccaccgaat

SEQ ID NO: 234576 - DNA, 25 bp, Mus musculus
ctggctctgtgtccgagctagctcc

SEQ ID NO: 234577 - DNA, 25 bp, Mus musculus
tgcccaccgaatcgaatatgatgcg

SEQ ID NO: 234578 - DNA, 25 bp, Mus musculus
ccatcgcagattcggatcctggacc

SEQ ID NO: 234579 - DNA, 25 bp, Mus musculus
tgtgccaagagcagcaacgccacca

SEQ ID NO: 234580 - DNA, 25 bp, Mus musculus
aacgccaccaggagcgtagcgcgtc

SEQ ID NO: 234581 - DNA, 25 bp, Mus musculus
tctgtatcatggtgccgcctgccct

SEQ ID NO: 234582 - DNA, 25 bp, Mus musculus
gccctggacacacaggggcagcata

SEQ ID NO: 234583 - DNA, 25 bp, Mus musculus
tgcacttggagcagccgcaggtaac

SEQ ID NO: 234584 - DNA, 25 bp, Mus musculus
aggtgacgtctcagcggatccgcgc

SEQ ID NO: 234585 - DNA, 25 bp, Mus musculus
cgcgcgtactgacgtcactactggt

SEQ ID NO: 234586 - DNA, 25 bp, Mus musculus
gacaaacttcggtcgggcgcgcgta

SEQ ID NO: 234587 - DNA, 25 bp, Mus musculus
cgcagaatccggacaaacttcggtc

SEQ ID NO: 234588 - DNA, 25 bp, Mus musculus
gcaccatgagctccaaggggcagga

SEQ ID NO: 234589 - DNA, 25 bp, Mus musculus
cactactggtcgcagaggtgacgtc

SEQ ID NO: 234590 - DNA, 25 bp, Mus musculus
tttctcaacaaagcgcaaccgcagc

SEQ ID NO: 234591 - DNA, 25 bp, Mus musculus
gtcacgaacctttctcaacaaagcg

SEQ ID NO: 234592 - DNA, 25 bp, Mus musculus
gaagacaccaaagctggggagaccc

SEQ ID NO: 234593 - DNA, 25 bp, Mus musculus
cgaggaacgacaacccaggaggaga

SEQ ID NO: 234594 - DNA, 25 bp, Mus musculus
aggggcaggactcccgcccgcagaa

SEQ ID NO: 234595 - DNA, 25 bp, Mus musculus
tgcgtgctgcatcgcgctcgaggaa

SEQ ID NO: 234596 - DNA, 25 bp, Mus musculus
aggagagcggcgaagacaccaaagc

SEQ ID NO: 234597 - DNA, 25 bp, Mus musculus
aagcgcaaccgcagcgcaccatgag

SEQ ID NO: 234598 - DNA, 25 bp, Mus musculus
cgcgctacatacaccgaattgggga

SEQ ID NO: 234599 - DNA, 25 bp, Mus musculus
gttctcgggagaagcgcaaaggcta

SEQ ID NO: 234600 - DNA, 25 bp, Mus musculus
gccttagcgctacggcaaaagaatg

SEQ ID NO: 234601 - DNA, 25 bp, Mus musculus
gcgccaaagtccttccggaagtcca

SEQ ID NO: 234602 - DNA, 25 bp, Mus musculus
tccaagttcgaagatggcgccgcct

SEQ ID NO: 234603 - DNA, 25 bp, Mus musculus
gtcgcggttttatgacgaaatcttg

SEQ ID NO: 234604 - DNA, 25 bp, Mus musculus
cgaaatcttgatcggctcttccttg

SEQ ID NO: 234605 - DNA, 25 bp, Mus musculus
cccgagacaaggtaaacgcaagctt

SEQ ID NO: 234606 - DNA, 25 bp, Mus musculus
gcgtttcctgccgagctttctttta

SEQ ID NO: 234607 - DNA, 25 bp, Mus musculus
tgtgttccataatgcagcgcggcgc

SEQ ID NO: 234608 - DNA, 25 bp, Mus musculus
tgcagggccttctgggaatttcagc

SEQ ID NO: 234609 - DNA, 25 bp, Mus musculus
ccagcagccttgtggaaaagcattg

SEQ ID NO: 234610 - DNA, 25 bp, Mus musculus
tgagtccagtttaccgcgctacata

SEQ ID NO: 234611 - DNA, 25 bp, Mus musculus
ggaatcggttcccattgccttagcg

SEQ ID NO: 234612 - DNA, 25 bp, Mus musculus
ggtcagtcacccttctgggaacagc

SEQ ID NO: 234613 - DNA, 25 bp, Mus musculus
gcactattgtcatctccgggaggga

SEQ ID NO: 234614 - DNA, 25 bp, Mus musculus
agccatctcatgtctcagtttcgta

SEQ ID NO: 234615 - DNA, 25 bp, Mus musculus
ttccattcctgaaacggagtcccgc

SEQ ID NO: 234616 - DNA, 25 bp, Mus musculus
ctgccttagggaacatgcacttttc

SEQ ID NO: 234617 - DNA, 25 bp, Mus musculus
tgcgaacctggtagtacggagctct

SEQ ID NO: 234618 - DNA, 25 bp, Mus musculus
cctcggagttcaggcccaccaaaat

SEQ ID NO: 234619 - DNA, 25 bp, Mus musculus
ttgggttcccaattaggagcgtctc

SEQ ID NO: 234620 - DNA, 25 bp, Mus musculus
ggactacaacttccggcgtgcactg

SEQ ID NO: 234621 - DNA, 25 bp, Mus musculus
accgcagccatgactgtgggtccta

SEQ ID NO: 234622 - DNA, 25 bp, Mus musculus
taccacttggtgcatctagcccttc

SEQ ID NO: 234623 - DNA, 25 bp, Mus musculus
ccgcatcagcgatccagtgttcatc

SEQ ID NO: 234624 - DNA, 25 bp, Mus musculus
ggactgggccttctgcttgaaaccc

SEQ ID NO: 234625 - DNA, 25 bp, Mus musculus
tgcgccctagatcttgtaaaccaga

SEQ ID NO: 234626 - DNA, 25 bp, Mus musculus
gcgcacagccggcatgagtacagta

SEQ ID NO: 234627 - DNA, 25 bp, Mus musculus
gcacagccggcatgagtacagtagc

SEQ ID NO: 234628 - DNA, 25 bp, Mus musculus
gtgtctgcatgtgccgcttcaggtg

SEQ ID NO: 234629 - DNA, 25 bp, Mus musculus
cttcaggtggctcgagtagtgggac

SEQ ID NO: 234630 - DNA, 25 bp, Mus musculus
tagtgggacacgaaggcgcacagcc

SEQ ID NO: 234631 - DNA, 25 bp, Mus musculus
acacgaaggcgcacagccggcatga

SEQ ID NO: 234632 - DNA, 25 bp, Mus musculus
cgaaggcgcacagccggcatgagta

SEQ ID NO: 234633 - DNA, 25 bp, Mus musculus
gcagcggccacagcggaacggcttc

SEQ ID NO: 234634 - DNA, 25 bp, Mus musculus
tcaggttgacgagctgggctgaggc

SEQ ID NO: 234635 - DNA, 25 bp, Mus musculus
tatgtcgcgtcaggttgacgagctg

SEQ ID NO: 234636 - DNA, 25 bp, Mus musculus
tcgccagtatgggtgcgggtatgtc

SEQ ID NO: 234637 - DNA, 25 bp, Mus musculus
agccggcatgagtacagtagccgtg

SEQ ID NO: 234638 - DNA, 25 bp, Mus musculus
cacagccggcatgagtacagtagcc

SEQ ID NO: 234639 - DNA, 25 bp, Mus musculus
tgtgtctgcatgtgccgcttcaggt

SEQ ID NO: 234640 - DNA, 25 bp, Mus musculus
ggaatccagctcaggtcgctcccgc

SEQ ID NO: 234641 - DNA, 25 bp, Mus musculus
ctttgcttccttcggggcatcgtga

SEQ ID NO: 234642 - DNA, 25 bp, Mus musculus
catttcacgggctgtggatggcttt

SEQ ID NO: 234643 - DNA, 25 bp, Mus musculus
cgggctgtggatggctttgcttcct

SEQ ID NO: 234644 - DNA, 25 bp, Mus musculus
gccgtcggtccttgctcttaggatc

SEQ ID NO: 234645 - DNA, 25 bp, Mus musculus
cgccaccgcagagcaacacgggatg

SEQ ID NO: 234646 - DNA, 25 bp, Mus musculus
ttgctcttaggatccacgaaccgcc

SEQ ID NO: 234647 - DNA, 25 bp, Mus musculus
ccgaagaccagctggtacctccgta

SEQ ID NO: 234648 - DNA, 25 bp, Mus musculus
agagcaacacgggatgcgtagttca

SEQ ID NO: 234649 - DNA, 25 bp, Mus musculus
aacacgggatgcgtagttcatgggc

SEQ ID NO: 234650 - DNA, 25 bp, Mus musculus
tgcgtagttcatgggctgtacaacc

SEQ ID NO: 234651 - DNA, 25 bp, Mus musculus
ttcatgggctgtacaaccggagcgc

SEQ ID NO: 234652 - DNA, 25 bp, Mus musculus
tgggctgtacaaccggagcgcagtc

SEQ ID NO: 234653 - DNA, 25 bp, Mus musculus
ggtccttgctcttaggatccacgaa

SEQ ID NO: 234654 - DNA, 25 bp, Mus musculus
actagcgtttgtactgcgcttccgc

SEQ ID NO: 234655 - DNA, 25 bp, Mus musculus
ttctgcggttttgtcagccctgtcc

SEQ ID NO: 234656 - DNA, 25 bp, Mus musculus
gcttccagttgcgttctgcggtttt

SEQ ID NO: 234657 - DNA, 25 bp, Mus musculus
cctgaagtctctattgtgtgggacc

SEQ ID NO: 234658 - DNA, 25 bp, Mus musculus
ctctggtctcagcagtttttgcctg

SEQ ID NO: 234659 - DNA, 25 bp, Mus musculus
gggccctgtctcacctccatggaga

SEQ ID NO: 234660 - DNA, 25 bp, Mus musculus
ggcggaaggtgcctcttctcacatg

SEQ ID NO: 234661 - DNA, 25 bp, Mus musculus
gatgtgcggccatctccacgctgac

SEQ ID NO: 234662 - DNA, 25 bp, Mus musculus
cgggcggtcatttccttagcaactc

SEQ ID NO: 234663 - DNA, 25 bp, Mus musculus
cagtcgacgcaaggtgccggcgaaa

SEQ ID NO: 234664 - DNA, 25 bp, Mus musculus
cacttcaccgtgttgggctgagaga

SEQ ID NO: 234665 - DNA, 25 bp, Mus musculus
cgccagccttgcatggcggagaagc

SEQ ID NO: 234666 - DNA, 25 bp, Mus musculus
tcaggttcctgccatgcagtggcca

SEQ ID NO: 234667 - DNA, 25 bp, Mus musculus
tccacgctgaccgtgctttagcacg

SEQ ID NO: 234668 - DNA, 25 bp, Mus musculus
gactgccttgagagcctcggtctgt

SEQ ID NO: 234669 - DNA, 25 bp, Mus musculus
gcagtagactgccttgagagcctcg

SEQ ID NO: 234670 - DNA, 25 bp, Mus musculus
cgctgccctgtccaatggaaacctg

SEQ ID NO: 234671 - DNA, 25 bp, Mus musculus
tccaatggaaacctggcggcggtgc

SEQ ID NO: 234672 - DNA, 25 bp, Mus musculus
ccactgttggtccggacgccgcgag

SEQ ID NO: 234673 - DNA, 25 bp, Mus musculus
gcccgcagttcggttgcgctgcgga

SEQ ID NO: 234674 - DNA, 25 bp, Mus musculus
tcgctgggatccgaggccccggaac

SEQ ID NO: 234675 - DNA, 25 bp, Mus musculus
gagctccggagaaagaggccctgga

SEQ ID NO: 234676 - DNA, 25 bp, Mus musculus
ggcggccctgctttctcgggagtca

SEQ ID NO: 234677 - DNA, 25 bp, Mus musculus
tttctcgggagtcaggcccgaccta

SEQ ID NO: 234678 - DNA, 25 bp, Mus musculus
cccgccctcctggtgtctccggcgt

SEQ ID NO: 234679 - DNA, 25 bp, Mus musculus
cccggcgttctcttggaactctggc

SEQ ID NO: 234680 - DNA, 25 bp, Mus musculus
gcgttctcttggaactctggccgcg

SEQ ID NO: 234681 - DNA, 25 bp, Mus musculus
aggagacccggcagtagactgcctt

SEQ ID NO: 234682 - DNA, 25 bp, Mus musculus
gcccaggcagggcttatcaggacct

SEQ ID NO: 234683 - DNA, 25 bp, Mus musculus
ccagagacatggctgagcgcgcgtt

SEQ ID NO: 234684 - DNA, 25 bp, Mus musculus
tgagcgcgcgtttccattctccgca

SEQ ID NO: 234685 - DNA, 25 bp, Mus musculus
tccgcacgcttgagcccaggcaggg

SEQ ID NO: 234686 - DNA, 25 bp, Mus musculus
caggcagggcttatcaggacctgca

SEQ ID NO: 234687 - DNA, 25 bp, Mus musculus
gaccacggtcagaggcatggatatt

SEQ ID NO: 234688 - DNA, 25 bp, Mus musculus
atggatattggcctgcgtcctgccc

SEQ ID NO: 234689 - DNA, 25 bp, Mus musculus
atattggcctgcgtcctgcccggca

SEQ ID NO: 234690 - DNA, 25 bp, Mus musculus
ccggcaccgtcaggatttcggtggc

SEQ ID NO: 234691 - DNA, 25 bp, Mus musculus
gtggcttttggatcctcctgtcaca

SEQ ID NO: 234692 - DNA, 25 bp, Mus musculus
ttttggatcctcctgtcacagggcg

SEQ ID NO: 234693 - DNA, 25 bp, Mus musculus
ggcgcacgcagagctgtggagccac

SEQ ID NO: 234694 - DNA, 25 bp, Mus musculus
tgtggagccacggtgtaagcctccc

SEQ ID NO: 234695 - DNA, 25 bp, Mus musculus
gcgtttccattctccgcacgcttga

SEQ ID NO: 234696 - DNA, 25 bp, Mus musculus
gacaaagccaggtccaggtagagcc

SEQ ID NO: 234697 - DNA, 25 bp, Mus musculus
tgtacggctttctaccgcacctgtg

SEQ ID NO: 234698 - DNA, 25 bp, Mus musculus
ctaccttgcagatgccgcccgaggg

SEQ ID NO: 234699 - DNA, 25 bp, Mus musculus
atgcgcgtgggactcgcgctgatcc

SEQ ID NO: 234700 - DNA, 25 bp, Mus musculus
atcctggtgggccacgtgaacctcc

SEQ ID NO: 234701 - DNA, 25 bp, Mus musculus
tgaacctcctggtgggagctgtgtt

SEQ ID NO: 234702 - DNA, 25 bp, Mus musculus
agctgtgttgcatggtactgttctg

SEQ ID NO: 234703 - DNA, 25 bp, Mus musculus
actgttctgcggcacgtggccaacc

SEQ ID NO: 234704 - DNA, 25 bp, Mus musculus
gaggcgcggtcactcctgagtacac

SEQ ID NO: 234705 - DNA, 25 bp, Mus musculus
tcctgagtacaccacagccaatgtc

SEQ ID NO: 234706 - DNA, 25 bp, Mus musculus
cagccaatgtcatttctgtgggttc

SEQ ID NO: 234707 - DNA, 25 bp, Mus musculus
tcatttctgtgggttcgggactact

SEQ ID NO: 234708 - DNA, 25 bp, Mus musculus
cgtcgggacaaagccaggtccaggt

SEQ ID NO: 234709 - DNA, 25 bp, Mus musculus
cctgtggtcccacagggcgacgctg

SEQ ID NO: 234710 - DNA, 25 bp, Mus musculus
acaccggtctcggatgctcactgac

SEQ ID NO: 234711 - DNA, 25 bp, Mus musculus
acaagtcttcggtcctctccggatt

SEQ ID NO: 234712 - DNA, 25 bp, Mus musculus
tggctgcatgcaaacctaacgcaaa

SEQ ID NO: 234713 - DNA, 25 bp, Mus musculus
ccgcgaccaatcctgtggctgcatg

SEQ ID NO: 234714 - DNA, 25 bp, Mus musculus
tgtggaattctctccgcgaccaatc

SEQ ID NO: 234715 - DNA, 25 bp, Mus musculus
cccataagaggggttgtggaattct

SEQ ID NO: 234716 - DNA, 25 bp, Mus musculus
agtgagtcctaaggcgggcccataa

SEQ ID NO: 234717 - DNA, 25 bp, Mus musculus
agcgaacaggacgtgcgcaagcgca

SEQ ID NO: 234718 - DNA, 25 bp, Mus musculus
tcataaggtcacgtagtgggttcgc

SEQ ID NO: 234719 - DNA, 25 bp, Mus musculus
tgagtgcgacatacgtcataaggtc

SEQ ID NO: 234720 - DNA, 25 bp, Mus musculus
taaccgctgacgcacaggcaacgtg

SEQ ID NO: 234721 - DNA, 25 bp, Mus musculus
tggttacctggacaacccgccaagc

SEQ ID NO: 234722 - DNA, 25 bp, Mus musculus
tctccggattctacgtcaccatatc

SEQ ID NO: 234723 - DNA, 25 bp, Mus musculus
ctgaccgagacaactcccgtggtta

SEQ ID NO: 234724 - DNA, 25 bp, Mus musculus
gacgcgctggcctgtctcgccgccg

SEQ ID NO: 234725 - DNA, 25 bp, Mus musculus
cgcctccgcataacccgggtgccca

SEQ ID NO: 234726 - DNA, 25 bp, Mus musculus
gcgcggtctcatcagcccacaccca

SEQ ID NO: 234727 - DNA, 25 bp, Mus musculus
accgtcccggcgagccagccgccgc

SEQ ID NO: 234728 - DNA, 25 bp, Mus musculus
cctgcagcgggatgtgaccgtcccg

SEQ ID NO: 234729 - DNA, 25 bp, Mus musculus
cagtgcggcggccaaagctggtccc

SEQ ID NO: 234730 - DNA, 25 bp, Mus musculus
ctgcgtccccggtgcagaggacagt

SEQ ID NO: 234731 - DNA, 25 bp, Mus musculus
caagggccccgcgtggtctgactct

SEQ ID NO: 234732 - DNA, 25 bp, Mus musculus
ccaaggcgggcagcgacggccgagc

SEQ ID NO: 234733 - DNA, 25 bp, Mus musculus
cccattctgacaccggcccgccaag

SEQ ID NO: 234734 - DNA, 25 bp, Mus musculus
cagagggcggcccatcgccagactg

SEQ ID NO: 234735 - DNA, 25 bp, Mus musculus
ctcccgggtcctcgtggtcggtcag

SEQ ID NO: 234736 - DNA, 25 bp, Mus musculus
ccacccgcgcggtctcatcagccca

SEQ ID NO: 234737 - DNA, 25 bp, Mus musculus
gcgttgccagcgaggcctgcgtccc

SEQ ID NO: 234738 - DNA, 25 bp, Mus musculus
agttatcacgtgactcctttcccgc

SEQ ID NO: 234739 - DNA, 25 bp, Mus musculus
cccttgggtgaaattgttaggcgtg

SEQ ID NO: 234740 - DNA, 25 bp, Mus musculus
cggagcccttgggtgaaattgttag

SEQ ID NO: 234741 - DNA, 25 bp, Mus musculus
ctgtccggagcccttgggtgaaatt

SEQ ID NO: 234742 - DNA, 25 bp, Mus musculus
tggcgttggtctgtccggagccctt

SEQ ID NO: 234743 - DNA, 25 bp, Mus musculus
ccgctgagaccacatccgggagagg

SEQ ID NO: 234744 - DNA, 25 bp, Mus musculus
ttagtcgccgctgagaccacatccg

SEQ ID NO: 234745 - DNA, 25 bp, Mus musculus
aacagggttagtcgccgctgagacc

SEQ ID NO: 234746 - DNA, 25 bp, Mus musculus
ggtgttcagaacagggttagtcgcc

SEQ ID NO: 234747 - DNA, 25 bp, Mus musculus
agtgatgtcttccagactcggtgca

SEQ ID NO: 234748 - DNA, 25 bp, Mus musculus
ccctcggaagcagctaggcggaagt

SEQ ID NO: 234749 - DNA, 25 bp, Mus musculus
cgaagaagagttatcacgtgactcc

SEQ ID NO: 234750 - DNA, 25 bp, Mus musculus
gtcttccagactcggtgcagtcacc

SEQ ID NO: 234751 - DNA, 25 bp, Mus musculus
ctaggcggaagtaggtgttcagaac

SEQ ID NO: 234752 - DNA, 25 bp, Mus musculus
acgagccctggcagaaaacacgctg

SEQ ID NO: 234753 - DNA, 25 bp, Mus musculus
cgggagacaaaggagaccagtgact

SEQ ID NO: 234754 - DNA, 25 bp, Mus musculus
aacttcaccaaaagagggtctgctg

SEQ ID NO: 234755 - DNA, 25 bp, Mus musculus
cttacggaagctgggagagccaaac

SEQ ID NO: 234756 - DNA, 25 bp, Mus musculus
gttgctaacacaagcccgggcgttg

SEQ ID NO: 234757 - DNA, 25 bp, Mus musculus
cagcgcgctccagttgctaacacaa

SEQ ID NO: 234758 - DNA, 25 bp, Mus musculus
acaggaggaccaaggcacccagcgc

SEQ ID NO: 234759 - DNA, 25 bp, Mus musculus
gctgttagtgcccacaggaggacca

SEQ ID NO: 234760 - DNA, 25 bp, Mus musculus
agcggacatccaactgctgttagtg

SEQ ID NO: 234761 - DNA, 25 bp, Mus musculus
aaacacgctgctgagctagggagga

SEQ ID NO: 234762 - DNA, 25 bp, Mus musculus
gaggtcttaggtgcgtccgcagcca

SEQ ID NO: 234763 - DNA, 25 bp, Mus musculus
caaacaccgggattgtgcggggact

SEQ ID NO: 234764 - DNA, 25 bp, Mus musculus
gccgcagcaacatagcggacatcca

SEQ ID NO: 234765 - DNA, 25 bp, Mus musculus
gggactgccggtcttcgtcctgccg

SEQ ID NO: 234766 - DNA, 25 bp, Mus musculus
cgagcggtttggatagtctggccaa

SEQ ID NO: 234767 - DNA, 25 bp, Mus musculus
tacctttgtacaggtgacgtgcacc

SEQ ID NO: 234768 - DNA, 25 bp, Mus musculus
ggaattcagagagcccgcaggccgc

SEQ ID NO: 234769 - DNA, 25 bp, Mus musculus
atcgcagcccggaattcagagagcc

SEQ ID NO: 234770 - DNA, 25 bp, Mus musculus
gattttcctaccaatcgcagcccgg

SEQ ID NO: 234771 - DNA, 25 bp, Mus musculus
aggacggattttcctaccaatcgca

SEQ ID NO: 234772 - DNA, 25 bp, Mus musculus
cctgtacgcaagaggacggattttc

SEQ ID NO: 234773 - DNA, 25 bp, Mus musculus
aatcgtagccctgtacgcaagagga

SEQ ID NO: 234774 - DNA, 25 bp, Mus musculus
tcgttcgaccaatcgtagccctgta

SEQ ID NO: 234775 - DNA, 25 bp, Mus musculus
aggccggatcgttcgaccaatcgta

SEQ ID NO: 234776 - DNA, 25 bp, Mus musculus
taaactcagagaggccggatcgttc

SEQ ID NO: 234777 - DNA, 25 bp, Mus musculus
ggccaatcgcaaccctaaactcaga

SEQ ID NO: 234778 - DNA, 25 bp, Mus musculus
tgacgtgcaccgtgcagaagcggta

SEQ ID NO: 234779 - DNA, 25 bp, Mus musculus
gatagtctggccaatcgcaacccta

SEQ ID NO: 234780 - DNA, 25 bp, Mus musculus
ttccgtgtctcggtaccatgctgta

SEQ ID NO: 234781 - DNA, 25 bp, Mus musculus
ttggcacccgcaccttgaaagacac

SEQ ID NO: 234782 - DNA, 25 bp, Mus musculus
gggcttttatctctacgatctggga

SEQ ID NO: 234783 - DNA, 25 bp, Mus musculus
cacattttgagattgcacccggcta

SEQ ID NO: 234784 - DNA, 25 bp, Mus musculus
gtgacatatgtctggagcatccttc

SEQ ID NO: 234785 - DNA, 25 bp, Mus musculus
cgggagacttgctagttgtgacata

SEQ ID NO: 234786 - DNA, 25 bp, Mus musculus
cacgagctgctgctttttcgggaga

SEQ ID NO: 234787 - DNA, 25 bp, Mus musculus
tacagtctcgaaaccctgaagggtg

SEQ ID NO: 234788 - DNA, 25 bp, Mus musculus
tcctccgtaccgagagccatcgtgg

SEQ ID NO: 234789 - DNA, 25 bp, Mus musculus
aagaaagaatgtctcgcggcgcagc

SEQ ID NO: 234790 - DNA, 25 bp, Mus musculus
ggttttaccagtgccttccgcagta

SEQ ID NO: 234791 - DNA, 25 bp, Mus musculus
cccaggaagtcagtagcgagtttaa

SEQ ID NO: 234792 - DNA, 25 bp, Mus musculus
acccggctaaggatggctgatccta

SEQ ID NO: 234793 - DNA, 25 bp, Mus musculus
ccgcacttactgtagagtccacgtc

SEQ ID NO: 234794 - DNA, 25 bp, Mus musculus
cgctgtctcttgtaagtcggtctga

SEQ ID NO: 234795 - DNA, 25 bp, Mus musculus
agaatgtctactggccgctgtggta

SEQ ID NO: 234796 - DNA, 25 bp, Mus musculus
tccgaagaatgtctactggccgctg

SEQ ID NO: 234797 - DNA, 25 bp, Mus musculus
caggggtgtccgaagaatgtctact

SEQ ID NO: 234798 - DNA, 25 bp, Mus musculus
tctcttgtaagtcggtctgaggcgg

SEQ ID NO: 234799 - DNA, 25 bp, Mus musculus
ctctccgctgtctcttgtaagtcgg

SEQ ID NO: 234800 - DNA, 25 bp, Mus musculus
ggtggaccatgctgctctccgctgt

SEQ ID NO: 234801 - DNA, 25 bp, Mus musculus
tctcggtgagaatcggtggaccatg

SEQ ID NO: 234802 - DNA, 25 bp, Mus musculus
ctttaggcgggtctcggtgagaatc

SEQ ID NO: 234803 - DNA, 25 bp, Mus musculus
ttgagctctttaggcgggtctcggt

SEQ ID NO: 234804 - DNA, 25 bp, Mus musculus
agtcgttgagctctttaggcgggtc

SEQ ID NO: 234805 - DNA, 25 bp, Mus musculus
cccggaagtagtcgttgagctcttt

SEQ ID NO: 234806 - DNA, 25 bp, Mus musculus
agaatcggtggaccatgctgctctc

SEQ ID NO: 234807 - DNA, 25 bp, Mus musculus
gtcgccctctgcaggggtgtccgaa

SEQ ID NO: 234808 - DNA, 25 bp, Mus musculus
ttggctagtcctgatccctctggga

SEQ ID NO: 234809 - DNA, 25 bp, Mus musculus
tcttcaagagaaggcccgcgttcca

SEQ ID NO: 234810 - DNA, 25 bp, Mus musculus
acagcacgcggattccctcaagagc

SEQ ID NO: 234811 - DNA, 25 bp, Mus musculus
accaggtcggtcatgcaggaaccca

SEQ ID NO: 234812 - DNA, 25 bp, Mus musculus
tgcccgaaatctctccggcctttgg

SEQ ID NO: 234813 - DNA, 25 bp, Mus musculus
ccacggcgagaatgacagagcgcgc

SEQ ID NO: 234814 - DNA, 25 bp, Mus musculus
aagcactaggccagagctcccggga

SEQ ID NO: 234815 - DNA, 25 bp, Mus musculus
agctcccgggaaccttcaggcgcta

SEQ ID NO: 234816 - DNA, 25 bp, Mus musculus
agtcgccggttactgatcggactta

SEQ ID NO: 234817 - DNA, 25 bp, Mus musculus
atcggacttaagttccaggtacctg

SEQ ID NO: 234818 - DNA, 25 bp, Mus musculus
ttggatctcagtcgcacaggtggcg

SEQ ID NO: 234819 - DNA, 25 bp, Mus musculus
gcgcagagagccatgtttgagtatg

SEQ ID NO: 234820 - DNA, 25 bp, Mus musculus
ggccagagagctagcctcttcaaga

SEQ ID NO: 234821 - DNA, 25 bp, Mus musculus
ttactaatcctgctcaaccctgacg

SEQ ID NO: 234822 - DNA, 25 bp, Mus musculus
agatttatttcactagggcggccga

SEQ ID NO: 234823 - DNA, 25 bp, Mus musculus
ggaagccagctcacgttccggagca

SEQ ID NO: 234824 - DNA, 25 bp, Mus musculus
cgcaccaaagggaggccggcgactt

SEQ ID NO: 234825 - DNA, 25 bp, Mus musculus
ccggcgacttgcatcagcacagatt

SEQ ID NO: 234826 - DNA, 25 bp, Mus musculus
ttccgtgatgctctgcagacgtctg

SEQ ID NO: 234827 - DNA, 25 bp, Mus musculus
gctgctggctttacgggaagccaca

SEQ ID NO: 234828 - DNA, 25 bp, Mus musculus
gaggccttggaggaagctcctgctc

SEQ ID NO: 234829 - DNA, 25 bp, Mus musculus
cccgcgttactggaaggactgtgtg

SEQ ID NO: 234830 - DNA, 25 bp, Mus musculus
ggagagacccagaagctcacgatta

SEQ ID NO: 234831 - DNA, 25 bp, Mus musculus
ctcacgattattgaatgcgggctgg

SEQ ID NO: 234832 - DNA, 25 bp, Mus musculus
cagcccgtgcggctcgaaggaaaac

SEQ ID NO: 234833 - DNA, 25 bp, Mus musculus
caggcagggatcaaagcgctctcag

SEQ ID NO: 234834 - DNA, 25 bp, Mus musculus
acccgcagaacacagggcgaggcga

SEQ ID NO: 234835 - DNA, 25 bp, Mus musculus
ccaaaagtgcgtctgttcgtgctgc

SEQ ID NO: 234836 - DNA, 25 bp, Mus musculus
cagacaggcgaggaccgagtctcct

SEQ ID NO: 234837 - DNA, 25 bp, Mus musculus
gatcccagaagaaccctgataccca

SEQ ID NO: 234838 - DNA, 25 bp, Mus musculus
gaaccgccacgtcgtcccgagtgga

SEQ ID NO: 234839 - DNA, 25 bp, Mus musculus
cccgggtccggtgcgtgcagattcc

SEQ ID NO: 234840 - DNA, 25 bp, Mus musculus
ggcgtccccagcaagatccgggttc

SEQ ID NO: 234841 - DNA, 25 bp, Mus musculus
tctcactcgagggtggagttcccag

SEQ ID NO: 234842 - DNA, 25 bp, Mus musculus
tcccaaagcagagagtctcactcga

SEQ ID NO: 234843 - DNA, 25 bp, Mus musculus
gggcccactcccaaagcagagagtc

SEQ ID NO: 234844 - DNA, 25 bp, Mus musculus
aggcgaggaccgagtctcctcgagt

SEQ ID NO: 234845 - DNA, 25 bp, Mus musculus
cacagctccagacaggcgaggaccg

SEQ ID NO: 234846 - DNA, 25 bp, Mus musculus
ccgcgatcccagaagaaccctgata

SEQ ID NO: 234847 - DNA, 25 bp, Mus musculus
ccaccgccgccgaaagcgaggcgcg

SEQ ID NO: 234848 - DNA, 25 bp, Mus musculus
cgagtgggcccactcccaaagcaga

SEQ ID NO: 234849 - DNA, 25 bp, Mus musculus
cgtgcagattccagggtacccagga

SEQ ID NO: 234850 - DNA, 25 bp, Mus musculus
ggaaacccgcattcgcgtcctctaa

SEQ ID NO: 234851 - DNA, 25 bp, Mus musculus
cggggctcctagtctttttgcgttg

SEQ ID NO: 234852 - DNA, 25 bp, Mus musculus
ttttcgcctttttggcgccctgaga

SEQ ID NO: 234853 - DNA, 25 bp, Mus musculus
acagaagtttctcccaaccggcagc

SEQ ID NO: 234854 - DNA, 25 bp, Mus musculus
cgagttggccacaggaagtttattc

SEQ ID NO: 234855 - DNA, 25 bp, Mus musculus
tcctaagtcaagtgtccgagtcgcc

SEQ ID NO: 234856 - DNA, 25 bp, Mus musculus
agcctagaatcccacgggcgctgtc

SEQ ID NO: 234857 - DNA, 25 bp, Mus musculus
agtgactcatctcgggcagagcgca

SEQ ID NO: 234858 - DNA, 25 bp, Mus musculus
actcgtgccattgtagtgactcatc

SEQ ID NO: 234859 - DNA, 25 bp, Mus musculus
tctaaggttgacgtgagtggatcca

SEQ ID NO: 234860 - DNA, 25 bp, Mus musculus
tcccagcaaggtggagtctaaggtt

SEQ ID NO: 234861 - DNA, 25 bp, Mus musculus
cgtgcgccaatggaacagaccaagg

SEQ ID NO: 234862 - DNA, 25 bp, Mus musculus
ttttgcgttgcccatttttctccag

SEQ ID NO: 234863 - DNA, 25 bp, Mus musculus
gtcctctaacgcaaatgaccatctt

SEQ ID NO: 234864 - DNA, 25 bp, Mus musculus
ggaatcgctcctgcgcgttagcaac

SEQ ID NO: 234865 - DNA, 25 bp, Mus musculus
gttcacaagcaaggcaggctccgcc

SEQ ID NO: 234866 - DNA, 25 bp, Mus musculus
ctgttcgttgcagtggaacgcctga

SEQ ID NO: 234867 - DNA, 25 bp, Mus musculus
aacgcctgagagagggaatcgctcc

SEQ ID NO: 234868 - DNA, 25 bp, Mus musculus
tttatttccagtgggcgccgccagc

SEQ ID NO: 234869 - DNA, 25 bp, Mus musculus
cgccgagaagcctgttaacgcttta

SEQ ID NO: 234870 - DNA, 25 bp, Mus musculus
tgaacgtggacagcctcatcacccg

SEQ ID NO: 234871 - DNA, 25 bp, Mus musculus
ccttcccgctcgagctgaggtcgga

SEQ ID NO: 234872 - DNA, 25 bp, Mus musculus
gaggcccatcggctggtacagtctt

SEQ ID NO: 234873 - DNA, 25 bp, Mus musculus
ggcctctgcagaccgttccgaagaa

SEQ ID NO: 234874 - DNA, 25 bp, Mus musculus
ccgtggaatgtgtatttctcggttc

SEQ ID NO: 234875 - DNA, 25 bp, Mus musculus
tctcggttctctttgtgcgttgccc

SEQ ID NO: 234876 - DNA, 25 bp, Mus musculus
cgccggctctgcgttcacaagcaag

SEQ ID NO: 234877 - DNA, 25 bp, Mus musculus
cgtgactcgtaggtgagaacgccga

SEQ ID NO: 234878 - DNA, 25 bp, Mus musculus
cccagcagacagcagagcgcgagtt

SEQ ID NO: 234879 - DNA, 25 bp, Mus musculus
tgcggccggactcaggtaagctcgc

SEQ ID NO: 234880 - DNA, 25 bp, Mus musculus
tggcctcgcgacgtaggcagctgac

SEQ ID NO: 234881 - DNA, 25 bp, Mus musculus
accgggcagctctaggcctcggcat

SEQ ID NO: 234882 - DNA, 25 bp, Mus musculus
tgtccgcctactggtcccggagtct

SEQ ID NO: 234883 - DNA, 25 bp, Mus musculus
ctggaagttgaggagaaacttctcc

SEQ ID NO: 234884 - DNA, 25 bp, Mus musculus
agtgtctcgtctcctgggctcacta

SEQ ID NO: 234885 - DNA, 25 bp, Mus musculus
tgggctcactacctgcttgcccagt

SEQ ID NO: 234886 - DNA, 25 bp, Mus musculus
tgtccagtacttcccgattctgcgg

SEQ ID NO: 234887 - DNA, 25 bp, Mus musculus
agtccggatagtggtccagcctatg

SEQ ID NO: 234888 - DNA, 25 bp, Mus musculus
gtcactcccgaatgaggaccagagg

SEQ ID NO: 234889 - DNA, 25 bp, Mus musculus
ccttctcgtcctagcggctggaggt

SEQ ID NO: 234890 - DNA, 25 bp, Mus musculus
gacgcccgcagcaactgtctggagc

SEQ ID NO: 234891 - DNA, 25 bp, Mus musculus
agggaaccacatgccgctgctgctt

SEQ ID NO: 234892 - DNA, 25 bp, Mus musculus
ttcctgtcagacctactcgcggcga

SEQ ID NO: 234893 - DNA, 25 bp, Mus musculus
gctgggcccggaagcttctgcgtac

SEQ ID NO: 234894 - DNA, 25 bp, Mus musculus
atcaggaacgtgaaaggctgggccc

SEQ ID NO: 234895 - DNA, 25 bp, Mus musculus
caccgggccaatcaggaacgtgaaa

SEQ ID NO: 234896 - DNA, 25 bp, Mus musculus
gcttggtctgtgctgatccctaccc

SEQ ID NO: 234897 - DNA, 25 bp, Mus musculus
ctctcagagcctggcttggtctgtg

SEQ ID NO: 234898 - DNA, 25 bp, Mus musculus
gaactggcttcgctctcagagcctg

SEQ ID NO: 234899 - DNA, 25 bp, Mus musculus
tgtcagacctactcgcggcgagccg

SEQ ID NO: 234900 - DNA, 25 bp, Mus musculus
aaaggtggctccgtgtccttcctgt

SEQ ID NO: 234901 - DNA, 25 bp, Mus musculus
tgaagccgaaaggtggctccgtgtc

SEQ ID NO: 234902 - DNA, 25 bp, Mus musculus
gtagcacctgttctgaagccgaaag

SEQ ID NO: 234903 - DNA, 25 bp, Mus musculus
ccacgcggtggcttgtagcacctgt

SEQ ID NO: 234904 - DNA, 25 bp, Mus musculus
agccggcgacgagaactggcttcgc

SEQ ID NO: 234905 - DNA, 25 bp, Mus musculus
gaagcttctgcgtacggctccgcct

SEQ ID NO: 234906 - DNA, 25 bp, Mus musculus
tctaccagatcttcgggagccgagg

SEQ ID NO: 234907 - DNA, 25 bp, Mus musculus
ggtcgtgggactgcccaggcctctt

SEQ ID NO: 234908 - DNA, 25 bp, Mus musculus
tgtggcctcctccacggctcgtgct

SEQ ID NO: 234909 - DNA, 25 bp, Mus musculus
ggctcgtgctcatccctccactttg

SEQ ID NO: 234910 - DNA, 25 bp, Mus musculus
cgccaactctaccagatcttcggga

SEQ ID NO: 234911 - DNA, 25 bp, Mus musculus
agggcgctccagcttccaccgcttc

SEQ ID NO: 234912 - DNA, 25 bp, Mus musculus
acctaccgcacttcctcatccgggg

SEQ ID NO: 234913 - DNA, 25 bp, Mus musculus
tcatccggggccaaagccagccatg

SEQ ID NO: 234914 - DNA, 25 bp, Mus musculus
ccaaagccagccatgcggacgggtc

SEQ ID NO: 234915 - DNA, 25 bp, Mus musculus
gccagccatgcggacgggtctcgat

SEQ ID NO: 234916 - DNA, 25 bp, Mus musculus
gcgcaatccggagggcggctcttcc

SEQ ID NO: 234917 - DNA, 25 bp, Mus musculus
ggctggtacctccaccctccgctag

SEQ ID NO: 234918 - DNA, 25 bp, Mus musculus
tccgctagctccagacacgctcagc

SEQ ID NO: 234919 - DNA, 25 bp, Mus musculus
atccctccactttggcgtcggctgc

SEQ ID NO: 234920 - DNA, 25 bp, Mus musculus
gctctgggaagaccgacggggataa

SEQ ID NO: 234921 - DNA, 25 bp, Mus musculus
acctccgagacgctcgccacgccgc

SEQ ID NO: 234922 - DNA, 25 bp, Mus musculus
tacgtggatcccgcccgcgtttaca

SEQ ID NO: 234923 - DNA, 25 bp, Mus musculus
gagcagccctacgtggatcccgccc

SEQ ID NO: 234924 - DNA, 25 bp, Mus musculus
gcgatcttgcggagaccccccgtgg

SEQ ID NO: 234925 - DNA, 25 bp, Mus musculus
ggcctacggagtgctcctcccgccc

SEQ ID NO: 234926 - DNA, 25 bp, Mus musculus
gagctcccgggcctacggagtgctc

SEQ ID NO: 234927 - DNA, 25 bp, Mus musculus
tccacgccctcttctccgagccacg

SEQ ID NO: 234928 - DNA, 25 bp, Mus musculus
ctggccacccggctcacctccacgc

SEQ ID NO: 234929 - DNA, 25 bp, Mus musculus
gatcggccacctcggcgctctggcc

SEQ ID NO: 234930 - DNA, 25 bp, Mus musculus
gcacagcacccgctgctcggcgacc

SEQ ID NO: 234931 - DNA, 25 bp, Mus musculus
ggaaagatgcggctcccgcacagca

SEQ ID NO: 234932 - DNA, 25 bp, Mus musculus
gaatgcgtgcgacggacgccctcca

SEQ ID NO: 234933 - DNA, 25 bp, Mus musculus
cgcgtttacactccactacctccga

SEQ ID NO: 234934 - DNA, 25 bp, Mus musculus
ttcaaattttccatgcaaagcgggc

SEQ ID NO: 234935 - DNA, 25 bp, Mus musculus
atctgtccggaatctggcctcgggc

SEQ ID NO: 234936 - DNA, 25 bp, Mus musculus
tcctggggagatctgtccggaatct

SEQ ID NO: 234937 - DNA, 25 bp, Mus musculus
ttcctagagccctggtgcggaagct

SEQ ID NO: 234938 - DNA, 25 bp, Mus musculus
tgctgtctgtctggttcctagagcc

SEQ ID NO: 234939 - DNA, 25 bp, Mus musculus
agcgctcttcggtggtgctgtctgt

SEQ ID NO: 234940 - DNA, 25 bp, Mus musculus
ggaactcggtttgaagtcggactca

SEQ ID NO: 234941 - DNA, 25 bp, Mus musculus
cgcgaggtaagagtcgactctctcg

SEQ ID NO: 234942 - DNA, 25 bp, Mus musculus
ggctgtggctctattttcaaatttt

SEQ ID NO: 234943 - DNA, 25 bp, Mus musculus
aacgaaggtcttggctgtggctcta

SEQ ID NO: 234944 - DNA, 25 bp, Mus musculus
tcgctcttctgaaacgaaggtcttg

SEQ ID NO: 234945 - DNA, 25 bp, Mus musculus
gaaatcacttcgctcttctgaaacg

SEQ ID NO: 234946 - DNA, 25 bp, Mus musculus
gtttgaagtcggactcaacgccacg

SEQ ID NO: 234947 - DNA, 25 bp, Mus musculus
cgactctctcgagtttctcctatta

SEQ ID NO: 234948 - DNA, 25 bp, Mus musculus
gaccgcttgctggaggtggcaacac

SEQ ID NO: 234949 - DNA, 25 bp, Mus musculus
ggaggaagtcgcgttcctgcttcta

SEQ ID NO: 234950 - DNA, 25 bp, Mus musculus
acgatatggcctccgccatgaaggc

SEQ ID NO: 234951 - DNA, 25 bp, Mus musculus
gctatttatagtaggtgacgtcacc

SEQ ID NO: 234952 - DNA, 25 bp, Mus musculus
ccctcgccgcggctatttatagtag

SEQ ID NO: 234953 - DNA, 25 bp, Mus musculus
aactgcagtactcctaaggcgcctg

SEQ ID NO: 234954 - DNA, 25 bp, Mus musculus
aacgctgcggcggtaaactgcagta

SEQ ID NO: 234955 - DNA, 25 bp, Mus musculus
agggctgcgacaacgcctgcctgcg

SEQ ID NO: 234956 - DNA, 25 bp, Mus musculus
gggttctgtagcgttttcctggcca

SEQ ID NO: 234957 - DNA, 25 bp, Mus musculus
cccgagctctatcatgggttctgta

SEQ ID NO: 234958 - DNA, 25 bp, Mus musculus
ggtatctgcttctcaagcccgagct

SEQ ID NO: 234959 - DNA, 25 bp, Mus musculus
tacagggttatctgcgggtatctgc

SEQ ID NO: 234960 - DNA, 25 bp, Mus musculus
gcctcggcttttccatacagggtta

SEQ ID NO: 234961 - DNA, 25 bp, Mus musculus
gcgttcctgcttctagacccttctg

SEQ ID NO: 234962 - DNA, 25 bp, Mus musculus
gagctttgctcggtcttcttaaggc

SEQ ID NO: 234963 - DNA, 25 bp, Mus musculus
gtcttcttaaggcactgcacaccta

SEQ ID NO: 234964 - DNA, 25 bp, Mus musculus
tgcacacctaggagctgcttcccga

SEQ ID NO: 234965 - DNA, 25 bp, Mus musculus
cttcccgacggtgcggtgcagcgca

SEQ ID NO: 234966 - DNA, 25 bp, Mus musculus
cgcagcagcacaggggcccagcgtt

SEQ ID NO: 234967 - DNA, 25 bp, Mus musculus
tccctcggggctgatcattaactca

SEQ ID NO: 234968 - DNA, 25 bp, Mus musculus
gagagggactcgtcgccaccgccat

SEQ ID NO: 234969 - DNA, 25 bp, Mus musculus
accgccatggacagtagcaccttga

SEQ ID NO: 234970 - DNA, 25 bp, Mus musculus
gtcctacgagcgcattcgcaatgcg

SEQ ID NO: 234971 - DNA, 25 bp, Mus musculus
tcgcaatgcggctgacatctcagtc

SEQ ID NO: 234972 - DNA, 25 bp, Mus musculus
gcggctgacatctcagtcatcgtca

SEQ ID NO: 234973 - DNA, 25 bp, Mus musculus
gtcatcgtcatctacttcgtggtgg

SEQ ID NO: 234974 - DNA, 25 bp, Mus musculus
aagcagtataaggagtgagtggccc

SEQ ID NO: 234975 - DNA, 25 bp, Mus musculus
gcgcccgcagactctcttgagcttt

SEQ ID NO: 234976 - DNA, 25 bp, Mus musculus
cgtaagtggtccaaatccaggtgcc

SEQ ID NO: 234977 - DNA, 25 bp, Mus musculus
ggcttcggcgcagtctgctactccg

SEQ ID NO: 234978 - DNA, 25 bp, Mus musculus
agcggcaggcccttgttgagcaagt

SEQ ID NO: 234979 - DNA, 25 bp, Mus musculus
acgcgcgtgcagcagttcgcgcatg

SEQ ID NO: 234980 - DNA, 25 bp, Mus musculus
catcggaaaatagggacgcgcacgc

SEQ ID NO: 234981 - DNA, 25 bp, Mus musculus
tcggtcacagtctgggtcgcaccac

SEQ ID NO: 234982 - DNA, 25 bp, Mus musculus
ctgggtgtccacgagaaggatcctc

SEQ ID NO: 234983 - DNA, 25 bp, Mus musculus
tcgtcactccgggaacacctaggtc

SEQ ID NO: 234984 - DNA, 25 bp, Mus musculus
atgcggaatccgcaggctcgtcact

SEQ ID NO: 234985 - DNA, 25 bp, Mus musculus
gtgccaagctgagcatcactaagtc

SEQ ID NO: 234986 - DNA, 25 bp, Mus musculus
tcggttggtctgctgtttgcaggca

SEQ ID NO: 234987 - DNA, 25 bp, Mus musculus
ttgagcaagtgggagctgcccattg

SEQ ID NO: 234988 - DNA, 25 bp, Mus musculus
gtgataggcatgtaggccacccatg

SEQ ID NO: 234989 - DNA, 25 bp, Mus musculus
ttcgcgcatgcgcatcacccgttgg

SEQ ID NO: 234990 - DNA, 25 bp, Mus musculus
cagcgagttcctgctttggagaatc

SEQ ID NO: 234991 - DNA, 25 bp, Mus musculus
attctagttcgtgcccgcagtacca

SEQ ID NO: 234992 - DNA, 25 bp, Mus musculus
taaagtccgggattctagttcgtgc

SEQ ID NO: 234993 - DNA, 25 bp, Mus musculus
agacagcaggctccggtaaagtccg

SEQ ID NO: 234994 - DNA, 25 bp, Mus musculus
tgaccttagtaagacagcaggctcc

SEQ ID NO: 234995 - DNA, 25 bp, Mus musculus
cagccacggacggtgaccttagtaa

SEQ ID NO: 234996 - DNA, 25 bp, Mus musculus
tttggagaatcgagcagagacacgc

SEQ ID NO: 234997 - DNA, 25 bp, Mus musculus
cagggccgactgtcagcgagttcct

SEQ ID NO: 234998 - DNA, 25 bp, Mus musculus
agctggtgaaggctgtctccggccc

SEQ ID NO: 234999 - DNA, 25 bp, Mus musculus
ccgcctacgcaggaggtcgtgtgac

SEQ ID NO: 235000 - DNA, 25 bp, Mus musculus
ggggcgcagcgataacactcacacg

SEQ ID NO: 235001 - DNA, 25 bp, Mus musculus
gcgatgacgtcctatggctgccatt

SEQ ID NO: 235002 - DNA, 25 bp, Mus musculus
gagacacgcggcataggtgagaccc

SEQ ID NO: 235003 - DNA, 25 bp, Mus musculus
tatggctgccattccaacacctgcg

SEQ ID NO: 235004 - DNA, 25 bp, Mus musculus
gtacgtagcacgtcactatccggcg

SEQ ID NO: 235005 - DNA, 25 bp, Mus musculus
tccgaacgtccatggcgtcgggatc

SEQ ID NO: 235006 - DNA, 25 bp, Mus musculus
gaccacaacgtgagtcgtctcagcc

SEQ ID NO: 235007 - DNA, 25 bp, Mus musculus
cctacgccagcggacaattcaatga

SEQ ID NO: 235008 - DNA, 25 bp, Mus musculus
cgggcatgcctctggtgctaattag

SEQ ID NO: 235009 - DNA, 25 bp, Mus musculus
ctctcggtgtactgtgacctaggtg

SEQ ID NO: 235010 - DNA, 25 bp, Mus musculus
acccgaccctcaaggtgcgttctag

SEQ ID NO: 235011 - DNA, 25 bp, Mus musculus
ggcccagctgtccatgaccctgaag

SEQ ID NO: 235012 - DNA, 25 bp, Mus musculus
ccgctctctagagctgccggcgatt

SEQ ID NO: 235013 - DNA, 25 bp, Mus musculus
gtgacacgattggtgcagactcata

SEQ ID NO: 235014 - DNA, 25 bp, Mus musculus
agatgattggctctggccttcttcc

SEQ ID NO: 235015 - DNA, 25 bp, Mus musculus
tggtcgagcccgtgaaagatgattg

SEQ ID NO: 235016 - DNA, 25 bp, Mus musculus
cctgtgaccactacgggaggcgact

SEQ ID NO: 235017 - DNA, 25 bp, Mus musculus
accattcagagataacggccaccga

SEQ ID NO: 235018 - DNA, 25 bp, Mus musculus
agagagctctgtctacaccggaagg

SEQ ID NO: 235019 - DNA, 25 bp, Mus musculus
cgcgcttagttcttctcgatctgcc

SEQ ID NO: 235020 - DNA, 25 bp, Mus musculus
tgcctcatctgaaagggactggacc

SEQ ID NO: 235021 - DNA, 25 bp, Mus musculus
aacaagctgctgcatcctgcgggcc

SEQ ID NO: 235022 - DNA, 25 bp, Mus musculus
ctgagggacgctggtactacgtctc

SEQ ID NO: 235023 - DNA, 25 bp, Mus musculus
ctacgtctcctgaggcagcgagtgc

SEQ ID NO: 235024 - DNA, 25 bp, Mus musculus
tggctggtcagattctcggcccgca

SEQ ID NO: 235025 - DNA, 25 bp, Mus musculus
gcctcctttttctcgcgcttagttc

SEQ ID NO: 235026 - DNA, 25 bp, Mus musculus
ctgtcgcttgcagagagcgagtttc

SEQ ID NO: 235027 - DNA, 25 bp, Mus musculus
agcgagtttcttgtgcggccagttt

SEQ ID NO: 235028 - DNA, 25 bp, Mus musculus
gtgcggccagtttgcttaaaattta

SEQ ID NO: 235029 - DNA, 25 bp, Mus musculus
gcagttgtccagagactgtcgcttg

SEQ ID NO: 235030 - DNA, 25 bp, Mus musculus
tggagccgctccaggcaaatgacgg

SEQ ID NO: 235031 - DNA, 25 bp, Mus musculus
gcggtaacgtcacccacacagctga

SEQ ID NO: 235032 - DNA, 25 bp, Mus musculus
aattaccgcgggcaatgatccttcg

SEQ ID NO: 235033 - DNA, 25 bp, Mus musculus
tgctccagcgggtatgcattcctcc

SEQ ID NO: 235034 - DNA, 25 bp, Mus musculus
gccgatgcttcgcttcctagttttc

SEQ ID NO: 235035 - DNA, 25 bp, Mus musculus
tttacaggacagtctcggcggacga

SEQ ID NO: 235036 - DNA, 25 bp, Mus musculus
tgtgcaccgtcttgtccagtctgga

SEQ ID NO: 235037 - DNA, 25 bp, Mus musculus
caggtggcctacataaagatcgata

SEQ ID NO: 235038 - DNA, 25 bp, Mus musculus
ctggatcaaattagggacgactcga

SEQ ID NO: 235039 - DNA, 25 bp, Mus musculus
ccgctgccctcgattgctgtttttc

SEQ ID NO: 235040 - DNA, 25 bp, Mus musculus
gttctgagtctctccagggtcttca

SEQ ID NO: 235041 - DNA, 25 bp, Mus musculus
gtaccgctaaggcaggtctctcctg

SEQ ID NO: 235042 - DNA, 25 bp, Mus musculus
gagttggcctggacatcccagctca

SEQ ID NO: 235043 - DNA, 25 bp, Mus musculus
tttccgcgtctggagcaatctggtc

SEQ ID NO: 235044 - DNA, 25 bp, Mus musculus
cctaacaaatcagaagggccgtttg

SEQ ID NO: 235045 - DNA, 25 bp, Mus musculus
cgcccgcgagtgacgctcattagaa

SEQ ID NO: 235046 - DNA, 25 bp, Mus musculus
aaagagacgcccatgctcgccttgg

SEQ ID NO: 235047 - DNA, 25 bp, Mus musculus
ccgcagtatcgtccacaggggaagc

SEQ ID NO: 235048 - DNA, 25 bp, Mus musculus
ccgacaggtagcgagtggccttaaa

SEQ ID NO: 235049 - DNA, 25 bp, Mus musculus
gtcctggcaccgagattcagaggtg

SEQ ID NO: 235050 - DNA, 25 bp, Mus musculus
caggaccaacgactgaaaccttaga

SEQ ID NO: 235051 - DNA, 25 bp, Mus musculus
tctcttctgtaggaacggctatcta

SEQ ID NO: 235052 - DNA, 25 bp, Mus musculus
cctgcgcacactcgtttataaattt

SEQ ID NO: 235053 - DNA, 25 bp, Mus musculus
ctacaaagtgcttggagcaggccac

SEQ ID NO: 235054 - DNA, 25 bp, Mus musculus
gcttcctgtgctttattaagagttc

SEQ ID NO: 235055 - DNA, 25 bp, Mus musculus
aaacttgttctccagcgccacgagc

SEQ ID NO: 235056 - DNA, 25 bp, Mus musculus
gtacgtctgcgagcccagcacgaag

SEQ ID NO: 235057 - DNA, 25 bp, Mus musculus
gaaaacgcccgcatggcttcctgtg

SEQ ID NO: 235058 - DNA, 25 bp, Mus musculus
gatcggcatcctacggcgccagagc

SEQ ID NO: 235059 - DNA, 25 bp, Mus musculus
gcgccagagccttcgggaaaacgcc

SEQ ID NO: 235060 - DNA, 25 bp, Mus musculus
gttgacgctgacatactggagcata

SEQ ID NO: 235061 - DNA, 25 bp, Mus musculus
gggtgtcctgtcctcaactcccagg

SEQ ID NO: 235062 - DNA, 25 bp, Mus musculus
ctcccaggtcttagcaggacaacta

SEQ ID NO: 235063 - DNA, 25 bp, Mus musculus
aggacaactattccctcaggcgaca

SEQ ID NO: 235064 - DNA, 25 bp, Mus musculus
tcaggcgacacgtagccagtcatcc

SEQ ID NO: 235065 - DNA, 25 bp, Mus musculus
acctttccagaagcgtgcagcagtg

SEQ ID NO: 235066 - DNA, 25 bp, Mus musculus
tctctctaggaacggaaggtcaatg

SEQ ID NO: 235067 - DNA, 25 bp, Mus musculus
tccctgagcgttctggtccatgaga

SEQ ID NO: 235068 - DNA, 25 bp, Mus musculus
catgcgccgtaatgggatatcgacc

SEQ ID NO: 235069 - DNA, 25 bp, Mus musculus
ttccagagataaccagcgttttgtc

SEQ ID NO: 235070 - DNA, 25 bp, Mus musculus
gtcaccaagtcagtcgccgcatgtc

SEQ ID NO: 235071 - DNA, 25 bp, Mus musculus
agatgaatcctggaccgtagtcgca

SEQ ID NO: 235072 - DNA, 25 bp, Mus musculus
agccgcgagttcctcgtagaccaac

SEQ ID NO: 235073 - DNA, 25 bp, Mus musculus
gccggtgttcagctctcagatcgag

SEQ ID NO: 235074 - DNA, 25 bp, Mus musculus
gtctgcgatgtagcgggtgtttaac

SEQ ID NO: 235075 - DNA, 25 bp, Mus musculus
aggggtgcaggctgtccctctccct

SEQ ID NO: 235076 - DNA, 25 bp, Mus musculus
cccagaaaagaccaatacgagtgca

SEQ ID NO: 235077 - DNA, 25 bp, Mus musculus
gccagagtcctggtaccgcataccg

SEQ ID NO: 235078 - DNA, 25 bp, Mus musculus
ccgtgcagagaacacgccagagtcc

SEQ ID NO: 235079 - DNA, 25 bp, Mus musculus
tagtcaggcatgcacggatcggacc

SEQ ID NO: 235080 - DNA, 25 bp, Mus musculus
cgcctaaagtgtagtcaggcatgca

SEQ ID NO: 235081 - DNA, 25 bp, Mus musculus
ggctggaatccaaacgcctaaagtg

SEQ ID NO: 235082 - DNA, 25 bp, Mus musculus
ctgcagcgattcgtgtctgcgctcg

SEQ ID NO: 235083 - DNA, 25 bp, Mus musculus
ccgacacggcgcagaactgcagcga

SEQ ID NO: 235084 - DNA, 25 bp, Mus musculus
cgactgcccaggtgaagacacacta

SEQ ID NO: 235085 - DNA, 25 bp, Mus musculus
agtactgagaggagacagctcacga

SEQ ID NO: 235086 - DNA, 25 bp, Mus musculus
agacctgggtgcttgagtactgaga

SEQ ID NO: 235087 - DNA, 25 bp, Mus musculus
tttaacggtggatgtcggagacctg

SEQ ID NO: 235088 - DNA, 25 bp, Mus musculus
attacgaaagcaaaacagatctggc

SEQ ID NO: 235089 - DNA, 25 bp, Mus musculus
gtgccggggtaatatgtgctcatta

SEQ ID NO: 235090 - DNA, 25 bp, Mus musculus
cagatctggcatgaataaacgcggg

SEQ ID NO: 235091 - DNA, 25 bp, Mus musculus
tgctcactcgcaacgtgacagcatg

SEQ ID NO: 235092 - DNA, 25 bp, Mus musculus
gacagcatgatcagtggcggcagta

SEQ ID NO: 235093 - DNA, 25 bp, Mus musculus
gtggcggcagtaatcgcagagaatc

SEQ ID NO: 235094 - DNA, 25 bp, Mus musculus
tcgcagagaatcgagggctaaatta

SEQ ID NO: 235095 - DNA, 25 bp, Mus musculus
gggctaaattattccataaccgtga

SEQ ID NO: 235096 - DNA, 25 bp, Mus musculus
taaccgtgatttgaggggacagccc

SEQ ID NO: 235097 - DNA, 25 bp, Mus musculus
tgcggcaccatgacgtgtcctgata

SEQ ID NO: 235098 - DNA, 25 bp, Mus musculus
gtgtcctgataaaacatccttccca

SEQ ID NO: 235099 - DNA, 25 bp, Mus musculus
gggccgcgcttgactaatctgccgc

SEQ ID NO: 235100 - DNA, 25 bp, Mus musculus
ccttcatcctctttgtgccggggta

SEQ ID NO: 235101 - DNA, 25 bp, Mus musculus
taaacgcgggatgaagtgctcactc

SEQ ID NO: 235102 - DNA, 25 bp, Mus musculus
gttcacgggcccacggactcagcat

SEQ ID NO: 235103 - DNA, 25 bp, Mus musculus
cgagtgagcaccgagctccgtagct

SEQ ID NO: 235104 - DNA, 25 bp, Mus musculus
gcactctccgcgaggcgagtgagca

SEQ ID NO: 235105 - DNA, 25 bp, Mus musculus
gaacgacggcgcagagcactctccg

SEQ ID NO: 235106 - DNA, 25 bp, Mus musculus
tcttagcgatgagcaggcgaacgac

SEQ ID NO: 235107 - DNA, 25 bp, Mus musculus
gatcgcagcgcaaggacacggcgtt

SEQ ID NO: 235108 - DNA, 25 bp, Mus musculus
gccgacgtacggagactccgggatc

SEQ ID NO: 235109 - DNA, 25 bp, Mus musculus
gggcccagggttctttcagatgctg

SEQ ID NO: 235110 - DNA, 25 bp, Mus musculus
aacagaatgcttggggcctggccta

SEQ ID NO: 235111 - DNA, 25 bp, Mus musculus
ggagcgcgcacaacagaatgcttgg

SEQ ID NO: 235112 - DNA, 25 bp, Mus musculus
tgattcaacaagtggcagcgcgccc

SEQ ID NO: 235113 - DNA, 25 bp, Mus musculus
ggtctcaaagtcgacatgaaaagtg

SEQ ID NO: 235114 - DNA, 25 bp, Mus musculus
tgagcctcagtcaccgcggaacaaa

SEQ ID NO: 235115 - DNA, 25 bp, Mus musculus
actcagcatggcgacaacaggtctc

SEQ ID NO: 235116 - DNA, 25 bp, Mus musculus
catttcgcctgttgccgggcgacgc

SEQ ID NO: 235117 - DNA, 25 bp, Mus musculus
cagcagattcccaaggcccgcggag

SEQ ID NO: 235118 - DNA, 25 bp, Mus musculus
agcaagcggcctgcgaacgagactc

SEQ ID NO: 235119 - DNA, 25 bp, Mus musculus
gcctgcgaacgagactcgggactca

SEQ ID NO: 235120 - DNA, 25 bp, Mus musculus
cgagactcgggactcaccggcttct

SEQ ID NO: 235121 - DNA, 25 bp, Mus musculus
gcttctccgtgggacccgacggcga

SEQ ID NO: 235122 - DNA, 25 bp, Mus musculus
agggtcaccagcagggctcactgga

SEQ ID NO: 235123 - DNA, 25 bp, Mus musculus
gctcactggaaaccgactgggacct

SEQ ID NO: 235124 - DNA, 25 bp, Mus musculus
ctgcagttgtgcatttcgcctgttg

SEQ ID NO: 235125 - DNA, 25 bp, Mus musculus
gcgacgctgtagtgatcctggatcc

SEQ ID NO: 235126 - DNA, 25 bp, Mus musculus
ccacacttggagaccaactgctctg

SEQ ID NO: 235127 - DNA, 25 bp, Mus musculus
aactgctctgtagcgattacgccgt

SEQ ID NO: 235128 - DNA, 25 bp, Mus musculus
ctgtagcgattacgccgtccgcggt

SEQ ID NO: 235129 - DNA, 25 bp, Mus musculus
ctgggacctggtcgaaatctgcagt

SEQ ID NO: 235130 - DNA, 25 bp, Mus musculus
cggcaacagcactgacgaggtctga

SEQ ID NO: 235131 - DNA, 25 bp, Mus musculus
cgaaaccatgagacgcgcacctgca

SEQ ID NO: 235132 - DNA, 25 bp, Mus musculus
ggcccaccgagatgcagtccaagat

SEQ ID NO: 235133 - DNA, 25 bp, Mus musculus
ctctcaaagtcaggaggtgtggcca

SEQ ID NO: 235134 - DNA, 25 bp, Mus musculus
agtgcgcgccactgcctctcaaagt

SEQ ID NO: 235135 - DNA, 25 bp, Mus musculus
acaacgcctaatgcggccgtccgaa

SEQ ID NO: 235136 - DNA, 25 bp, Mus musculus
tgcgggcagtcgctaaactacaacg

SEQ ID NO: 235137 - DNA, 25 bp, Mus musculus
actcgtagaccgcatgacccgctta

SEQ ID NO: 235138 - DNA, 25 bp, Mus musculus
acagacggcgagaagtcgaggactc

SEQ ID NO: 235139 - DNA, 25 bp, Mus musculus
tcagggaacccttagcttacagacg

SEQ ID NO: 235140 - DNA, 25 bp, Mus musculus
ccaagcaccgatggttcagggaacc

SEQ ID NO: 235141 - DNA, 25 bp, Mus musculus
gagactccatctcgcaggggaccgc

SEQ ID NO: 235142 - DNA, 25 bp, Mus musculus
ccacctttcaggtcggtggtccgca

SEQ ID NO: 235143 - DNA, 25 bp, Mus musculus
cccaagccttgggattgcgggcagt

SEQ ID NO: 235144 - DNA, 25 bp, Mus musculus
tcctgcgaatctgagcgcctcctgt

SEQ ID NO: 235145 - DNA, 25 bp, Mus musculus
agattctgcactgtgagcccggccg

SEQ ID NO: 235146 - DNA, 25 bp, Mus musculus
ctgtggaacgccaactttcggtatt

SEQ ID NO: 235147 - DNA, 25 bp, Mus musculus
gacagttggtttgttgccgcagcca

SEQ ID NO: 235148 - DNA, 25 bp, Mus musculus
tccgttttcttagcgcgaagcgggc

SEQ ID NO: 235149 - DNA, 25 bp, Mus musculus
caggcacccgcaaagcattctagga

SEQ ID NO: 235150 - DNA, 25 bp, Mus musculus
gagacactgcaactgggtccattta

SEQ ID NO: 235151 - DNA, 25 bp, Mus musculus
ggcgaactggtttccaaccgcattc

SEQ ID NO: 235152 - DNA, 25 bp, Mus musculus
ttcgcggccgaccatgagattttct

SEQ ID NO: 235153 - DNA, 25 bp, Mus musculus
ccgatgctagaccacagttcccata

SEQ ID NO: 235154 - DNA, 25 bp, Mus musculus
gcgggaccagtatggcttgcaattg

SEQ ID NO: 235155 - DNA, 25 bp, Mus musculus
ccacaggtggctctacggaagcctc

SEQ ID NO: 235156 - DNA, 25 bp, Mus musculus
ggaagcctcttctccaacgcgctga

SEQ ID NO: 235157 - DNA, 25 bp, Mus musculus
ccaggtaggccaacgtgaaggtcac

SEQ ID NO: 235158 - DNA, 25 bp, Mus musculus
cccagcgcgagtgtgctaagttgaa

SEQ ID NO: 235159 - DNA, 25 bp, Mus musculus
gttgaagctataaattacccacggc

SEQ ID NO: 235160 - DNA, 25 bp, Mus musculus
ataaattacccacggcctcagccag

SEQ ID NO: 235161 - DNA, 25 bp, Mus musculus
ggggctcagactctgtaaatcggcc

SEQ ID NO: 235162 - DNA, 25 bp, Mus musculus
cagactctgtaaatcggccctttca

SEQ ID NO: 235163 - DNA, 25 bp, Mus musculus
aaatcggccctttcaccgctggagg

SEQ ID NO: 235164 - DNA, 25 bp, Mus musculus
ttcaccgctggaggcctcgcacgaa

SEQ ID NO: 235165 - DNA, 25 bp, Mus musculus
tggaggcctcgcacgaaagaaaaac

SEQ ID NO: 235166 - DNA, 25 bp, Mus musculus
ttttattaaagcaacatcagggttg

SEQ ID NO: 235167 - DNA, 25 bp, Mus musculus
agcaacatcagggttgtggccgcca

SEQ ID NO: 235168 - DNA, 25 bp, Mus musculus
gcgagtgtgctaagttgaagctata

SEQ ID NO: 235169 - DNA, 25 bp, Mus musculus
cgacagtaagactgggcaccaggca

SEQ ID NO: 235170 - DNA, 25 bp, Mus musculus
ccgagaggcgccgacagtaagactg

SEQ ID NO: 235171 - DNA, 25 bp, Mus musculus
acatcagggttgtggccgccaggcc

SEQ ID NO: 235172 - DNA, 25 bp, Mus musculus
cgacgacacgggacaggcgacagcc

SEQ ID NO: 235173 - DNA, 25 bp, Mus musculus
cgcgtccctgcaaccggcaaatctg

SEQ ID NO: 235174 - DNA, 25 bp, Mus musculus
tccagcccatagctccgcgtccctg

SEQ ID NO: 235175 - DNA, 25 bp, Mus musculus
tcctcaacccgcagccaaactctca

SEQ ID NO: 235176 - DNA, 25 bp, Mus musculus
agtttgcagcttctcagcccgcagc

SEQ ID NO: 235177 - DNA, 25 bp, Mus musculus
cgcgagggtggccacgtcatttccc

SEQ ID NO: 235178 - DNA, 25 bp, Mus musculus
agcgccgttaccaggacgcgcggct

SEQ ID NO: 235179 - DNA, 25 bp, Mus musculus
gctagcgtcccgcaagaagcggcca

SEQ ID NO: 235180 - DNA, 25 bp, Mus musculus
cctcggcttggcgacgtcgcggcta

SEQ ID NO: 235181 - DNA, 25 bp, Mus musculus
atgttgccagctcatgcccggggtc

SEQ ID NO: 235182 - DNA, 25 bp, Mus musculus
tagtgatgttgccagctcatgcccg

SEQ ID NO: 235183 - DNA, 25 bp, Mus musculus
ctaccgtaatagtgatgttgccagc

SEQ ID NO: 235184 - DNA, 25 bp, Mus musculus
cccggacgtggagctaccgtaatag

SEQ ID NO: 235185 - DNA, 25 bp, Mus musculus
acgtcgcggctagcgtcccgcaaga

SEQ ID NO: 235186 - DNA, 25 bp, Mus musculus
gacacacatggcgatccgctcgcta

SEQ ID NO: 235187 - DNA, 25 bp, Mus musculus
cggcgggagaatcaagctgctcgcc

SEQ ID NO: 235188 - DNA, 25 bp, Mus musculus
catggcaaccgcagcgctaagcggc

SEQ ID NO: 235189 - DNA, 25 bp, Mus musculus
cgctccttcgcagctgactgcgttg

SEQ ID NO: 235190 - DNA, 25 bp, Mus musculus
tctcggctccttggatgtccgcagc

SEQ ID NO: 235191 - DNA, 25 bp, Mus musculus
ttgccgtcgctaagcgcctgcggct

SEQ ID NO: 235192 - DNA, 25 bp, Mus musculus
cgatattccgcgctccgcgggattc

SEQ ID NO: 235193 - DNA, 25 bp, Mus musculus
ggcgctccaggtctcgcgatattcc

SEQ ID NO: 235194 - DNA, 25 bp, Mus musculus
agacaactgcaagccgcggcgggaa

SEQ ID NO: 235195 - DNA, 25 bp, Mus musculus
tccggattccgcagaaagacaactg

SEQ ID NO: 235196 - DNA, 25 bp, Mus musculus
gcgttagccgccatgatccggattc

SEQ ID NO: 235197 - DNA, 25 bp, Mus musculus
acgtcgccatcgtggcgttagccgc

SEQ ID NO: 235198 - DNA, 25 bp, Mus musculus
ccactgaagagcctggctgactgca

SEQ ID NO: 235199 - DNA, 25 bp, Mus musculus
cgctcgctacacgagccactgaaga

SEQ ID NO: 235200 - DNA, 25 bp, Mus musculus
gcgctgaaagctggggtcacgctcc

SEQ ID NO: 235201 - DNA, 25 bp, Mus musculus
tagcgaacattagcggcctttgagc

SEQ ID NO: 235202 - DNA, 25 bp, Mus musculus
ccggcgcggagattatgcaaatccc

SEQ ID NO: 235203 - DNA, 25 bp, Mus musculus
acattagcggcctttgagcggcgcc

SEQ ID NO: 235204 - DNA, 25 bp, Mus musculus
aatccctaacgaggcgctggggccg

SEQ ID NO: 235205 - DNA, 25 bp, Mus musculus
cagcccggcgcggagattatgcaaa

SEQ ID NO: 235206 - DNA, 25 bp, Mus musculus
cgcgcaccgcttctcgccgagtccc

SEQ ID NO: 235207 - DNA, 25 bp, Mus musculus
ctttcagccgcctgttgttgggcca

SEQ ID NO: 235208 - DNA, 25 bp, Mus musculus
tcagccgcctgttgttgggccaaca

SEQ ID NO: 235209 - DNA, 25 bp, Mus musculus
ttgttgggccaacagctcgggccgc

SEQ ID NO: 235210 - DNA, 25 bp, Mus musculus
tgaaaggccgggattagcgaacatt

SEQ ID NO: 235211 - DNA, 25 bp, Mus musculus
caactccacgacctggccgcccacc

SEQ ID NO: 235212 - DNA, 25 bp, Mus musculus
aggccgggattagcgaacattagcg

SEQ ID NO: 235213 - DNA, 25 bp, Mus musculus
taattaaatccctaacgaggcgctg

SEQ ID NO: 235214 - DNA, 25 bp, Mus musculus
aagctcagcttcagggtttcgcatg

SEQ ID NO: 235215 - DNA, 25 bp, Mus musculus
atagtagtatcccagccaaagctca

SEQ ID NO: 235216 - DNA, 25 bp, Mus musculus
gttattgattcagccgttctcccgg

SEQ ID NO: 235217 - DNA, 25 bp, Mus musculus
gcgagctgacttcccacgattccta

SEQ ID NO: 235218 - DNA, 25 bp, Mus musculus
ctttggcaatggtgaacagcccttg

SEQ ID NO: 235219 - DNA, 25 bp, Mus musculus
ctcctggtccagagcagcgagttgt

SEQ ID NO: 235220 - DNA, 25 bp, Mus musculus
ggagctacttccgagcctcctggtc

SEQ ID NO: 235221 - DNA, 25 bp, Mus musculus
tcctgtagtctccacagaggcgttc

SEQ ID NO: 235222 - DNA, 25 bp, Mus musculus
tgccctccggagtaactcagtgctc

SEQ ID NO: 235223 - DNA, 25 bp, Mus musculus
cgggcttcccgctctggaaagtttg

SEQ ID NO: 235224 - DNA, 25 bp, Mus musculus
cagggtttcgcatgacaaggtgaca

SEQ ID NO: 235225 - DNA, 25 bp, Mus musculus
tcgggttgattagcaccacaggggc

SEQ ID NO: 235226 - DNA, 25 bp, Mus musculus
aaagtttgcggctactgcctccgtc

SEQ ID NO: 235227 - DNA, 25 bp, Mus musculus
taaggactgacccaaggtgttcttc

SEQ ID NO: 235228 - DNA, 25 bp, Mus musculus
gcggagcgcacaccctctctgtgcc

SEQ ID NO: 235229 - DNA, 25 bp, Mus musculus
gagaccacattagcatgtgtattca

SEQ ID NO: 235230 - DNA, 25 bp, Mus musculus
ccacattagcatgtgtattcagatg

SEQ ID NO: 235231 - DNA, 25 bp, Mus musculus
gcatgtgtattcagatgaagatatt

SEQ ID NO: 235232 - DNA, 25 bp, Mus musculus
tgaagatattacttcttgcgtcggg

SEQ ID NO: 235233 - DNA, 25 bp, Mus musculus
gatattacttcttgcgtcgggtgtc

SEQ ID NO: 235234 - DNA, 25 bp, Mus musculus
ctctctgtgcctcaggcagtgacgg

SEQ ID NO: 235235 - DNA, 25 bp, Mus musculus
ctctgtgcctcaggcagtgacggtg

SEQ ID NO: 235236 - DNA, 25 bp, Mus musculus
cctcaggcagtgacggtggcctcct

SEQ ID NO: 235237 - DNA, 25 bp, Mus musculus
tggcctcctggcacgaccctgctgc

SEQ ID NO: 235238 - DNA, 25 bp, Mus musculus
cctgctgcgggaaccgaagctgagc

SEQ ID NO: 235239 - DNA, 25 bp, Mus musculus
cgcccgggatcggtgggatcgcccg

SEQ ID NO: 235240 - DNA, 25 bp, Mus musculus
tcttgcgtcgggtgtcagtgagctc

SEQ ID NO: 235241 - DNA, 25 bp, Mus musculus
tacttcttgcgtcgggtgtcagtga

SEQ ID NO: 235242 - DNA, 25 bp, Mus musculus
tgtccagcacaagcggctcagagcg

SEQ ID NO: 235243 - DNA, 25 bp, Mus musculus
gcctcagcttcctcggcggatcttg

SEQ ID NO: 235244 - DNA, 25 bp, Mus musculus
ggcggcgttctatagctgcctcagc

SEQ ID NO: 235245 - DNA, 25 bp, Mus musculus
ctcctgagcaagatggacgccatgc

SEQ ID NO: 235246 - DNA, 25 bp, Mus musculus
ggtcgtttgcgcagcaccagcttac

SEQ ID NO: 235247 - DNA, 25 bp, Mus musculus
aagcgctcagctcaaggacccggca

SEQ ID NO: 235248 - DNA, 25 bp, Mus musculus
cggtcgcccacaacaggtcgtttgc

SEQ ID NO: 235249 - DNA, 25 bp, Mus musculus
gggcaactaaggtcacaggaagctg

SEQ ID NO: 235250 - DNA, 25 bp, Mus musculus
gacctgcggcgacctgggcaactaa

SEQ ID NO: 235251 - DNA, 25 bp, Mus musculus
ggaactttctcagcgcctcggtcgg

SEQ ID NO: 235252 - DNA, 25 bp, Mus musculus
gccacggccctaaggaactttctca

SEQ ID NO: 235253 - DNA, 25 bp, Mus musculus
atgtcccggcacaaacgtccgtagg

SEQ ID NO: 235254 - DNA, 25 bp, Mus musculus
gtgcttgtcattgccgcgctgcctc

SEQ ID NO: 235255 - DNA, 25 bp, Mus musculus
ggaggcttgcctctcccgactacaa

SEQ ID NO: 235256 - DNA, 25 bp, Mus musculus
ctagactgaagtgtgaccgaacaac

SEQ ID NO: 235257 - DNA, 25 bp, Mus musculus
gcaaagcgcacttttcccgcggctt

SEQ ID NO: 235258 - DNA, 25 bp, Mus musculus
gggtgacgtgtgacatctagactga

SEQ ID NO: 235259 - DNA, 25 bp, Mus musculus
ggcagccaatcagcaaagcgcactt

SEQ ID NO: 235260 - DNA, 25 bp, Mus musculus
gaacaactgagtcccacagcctggc

SEQ ID NO: 235261 - DNA, 25 bp, Mus musculus
ggccaagttgacacatgaaattagc

SEQ ID NO: 235262 - DNA, 25 bp, Mus musculus
ttagccatcacaacatccaagaaga

SEQ ID NO: 235263 - DNA, 25 bp, Mus musculus
cgcctgggtatcctaacacatcaga

SEQ ID NO: 235264 - DNA, 25 bp, Mus musculus
gtacagaagcgcaggagtccctatg

SEQ ID NO: 235265 - DNA, 25 bp, Mus musculus
tccctatggtggatcccagggctcc

SEQ ID NO: 235266 - DNA, 25 bp, Mus musculus
cacacacatgcgctaagatggaata

SEQ ID NO: 235267 - DNA, 25 bp, Mus musculus
acaatcctggccaatgctgcgggag

SEQ ID NO: 235268 - DNA, 25 bp, Mus musculus
aggatgcgttgcagcgtaggtcact

SEQ ID NO: 235269 - DNA, 25 bp, Mus musculus
cgccgatctccgtgtcaatgtgggg

SEQ ID NO: 235270 - DNA, 25 bp, Mus musculus
gcgcccagcttgttgtgcagccaca

SEQ ID NO: 235271 - DNA, 25 bp, Mus musculus
gcccagcggctggaagtactaaggt

SEQ ID NO: 235272 - DNA, 25 bp, Mus musculus
cgtcccgagcagtagcttgagcttc

SEQ ID NO: 235273 - DNA, 25 bp, Mus musculus
cggtgtcactctccctcatggaagc

SEQ ID NO: 235274 - DNA, 25 bp, Mus musculus
cggggtctcgagtgcaactgcaaat

SEQ ID NO: 235275 - DNA, 25 bp, Mus musculus
gaactctgggtttccgtaacgcatg

SEQ ID NO: 235276 - DNA, 25 bp, Mus musculus
cgtagccatttgagtcgcatccgtg

SEQ ID NO: 235277 - DNA, 25 bp, Mus musculus
gtaccgcagtgaggcgcaacagttt

SEQ ID NO: 235278 - DNA, 25 bp, Mus musculus
cgcaacagtttggtttcccggtgtg

SEQ ID NO: 235279 - DNA, 25 bp, Mus musculus
ggctcgttctccacagacagtcttg

SEQ ID NO: 235280 - DNA, 25 bp, Mus musculus
ttgcccgtcctgcatacagtgctgc

SEQ ID NO: 235281 - DNA, 25 bp, Mus musculus
cagtgctgcctcaggtccgcataca

SEQ ID NO: 235282 - DNA, 25 bp, Mus musculus
tccgcatacaggtccgttccgtgtc

SEQ ID NO: 235283 - DNA, 25 bp, Mus musculus
tcgtcgagatgttccgctcagagta

SEQ ID NO: 235284 - DNA, 25 bp, Mus musculus
tgtccaccctcacgtgacgctgatt

SEQ ID NO: 235285 - DNA, 25 bp, Mus musculus
tggtctcccacacgaatgggccttg

SEQ ID NO: 235286 - DNA, 25 bp, Mus musculus
cggccaggaactgaacggtcactgt

SEQ ID NO: 235287 - DNA, 25 bp, Mus musculus
cggccagagtgacaaggtcgcagta

SEQ ID NO: 235288 - DNA, 25 bp, Mus musculus
ggtcgcagtaggcaccctcaactga

SEQ ID NO: 235289 - DNA, 25 bp, Mus musculus
aactgatctccggtgtcctcagctg

SEQ ID NO: 235290 - DNA, 25 bp, Mus musculus
gccgcggtgtttctatgacgacgac

SEQ ID NO: 235291 - DNA, 25 bp, Mus musculus
ccggggcatcaccagtggaacggtt

SEQ ID NO: 235292 - DNA, 25 bp, Mus musculus
tcaggtccttgctgtcgccacggac

SEQ ID NO: 235293 - DNA, 25 bp, Mus musculus
tttgaattcatgcagcgcgcccttc

SEQ ID NO: 235294 - DNA, 25 bp, Mus musculus
ggcgtctttgtttcctgagcggtca

SEQ ID NO: 235295 - DNA, 25 bp, Mus musculus
cgtggattgccacgcatttgaattc

SEQ ID NO: 235296 - DNA, 25 bp, Mus musculus
gcgcgcccttcaggacctacggaaa

SEQ ID NO: 235297 - DNA, 25 bp, Mus musculus
gccacggactttactgctgctgctg

SEQ ID NO: 235298 - DNA, 25 bp, Mus musculus
acatactgttctgacgaggcggcgc

SEQ ID NO: 235299 - DNA, 25 bp, Mus musculus
gctgagctgtaagctgcggaacccg

SEQ ID NO: 235300 - DNA, 25 bp, Mus musculus
gttggcattttccagccgccgagtc

SEQ ID NO: 235301 - DNA, 25 bp, Mus musculus
cattcaggtgcaagttggcattttc

SEQ ID NO: 235302 - DNA, 25 bp, Mus musculus
gtccaccagggaatcggagtcctcc

SEQ ID NO: 235303 - DNA, 25 bp, Mus musculus
aggacaacttcctgagtccaccagg

SEQ ID NO: 235304 - DNA, 25 bp, Mus musculus
aggcgggctgaagatgtgtttttta

SEQ ID NO: 235305 - DNA, 25 bp, Mus musculus
ctggcgaaccagtccacatactgtt

SEQ ID NO: 235306 - DNA, 25 bp, Mus musculus
acacttaggggacctggcgaaccag

SEQ ID NO: 235307 - DNA, 25 bp, Mus musculus
cggcagcagcccagaacacttaggg

SEQ ID NO: 235308 - DNA, 25 bp, Mus musculus
cccacagcggctgcttggactgagg

SEQ ID NO: 235309 - DNA, 25 bp, Mus musculus
tctgtacagggagcgtggcgttcct

SEQ ID NO: 235310 - DNA, 25 bp, Mus musculus
gcgttcctccgtgggtccaagagct

SEQ ID NO: 235311 - DNA, 25 bp, Mus musculus
ggatgcagccgacgcagtctgtaca

SEQ ID NO: 235312 - DNA, 25 bp, Mus musculus
ggagatggagacacttccgtgatta

SEQ ID NO: 235313 - DNA, 25 bp, Mus musculus
ttctacgacggcatcttggagcgca

SEQ ID NO: 235314 - DNA, 25 bp, Mus musculus
atacttctccaaaatgcggcgcagc

SEQ ID NO: 235315 - DNA, 25 bp, Mus musculus
ttccgtgattactgccagcggccgc

SEQ ID NO: 235316 - DNA, 25 bp, Mus musculus
gaggacgctttgctgcaggaacgca

SEQ ID NO: 235317 - DNA, 25 bp, Mus musculus
cgaagatcgtggctacggaggacca

SEQ ID NO: 235318 - DNA, 25 bp, Mus musculus
tgcatgcattgtgggcctcccgaca

SEQ ID NO: 235319 - DNA, 25 bp, Mus musculus
caccggcgccgctgcattataaata

SEQ ID NO: 235320 - DNA, 25 bp, Mus musculus
tcggcagccaatgcagtggacgcta

SEQ ID NO: 235321 - DNA, 25 bp, Mus musculus
atcacatggtgaccctcggcagcca

SEQ ID NO: 235322 - DNA, 25 bp, Mus musculus
cacgcagcccaagtgtgccatcggg

SEQ ID NO: 235323 - DNA, 25 bp, Mus musculus
gctgtcgttcactgaggaccacttc

SEQ ID NO: 235324 - DNA, 25 bp, Mus musculus
gtaggaggcgtccatcactctccga

SEQ ID NO: 235325 - DNA, 25 bp, Mus musculus
cccgacatggtctgcgagacgaaga

SEQ ID NO: 235326 - DNA, 25 bp, Mus musculus
acacatgggcgcgagtgatcactac

SEQ ID NO: 235327 - DNA, 25 bp, Mus musculus
acacagtggagctgctccgcatgtc

SEQ ID NO: 235328 - DNA, 25 bp, Mus musculus
tccgcatgtccgtggactcgcgttt

SEQ ID NO: 235329 - DNA, 25 bp, Mus musculus
cgtttccgcggaaaaggcatcgcca

SEQ ID NO: 235330 - DNA, 25 bp, Mus musculus
aaaggcatcgccaaggctctgggca

SEQ ID NO: 235331 - DNA, 25 bp, Mus musculus
tggagtttgccatgctgcacaacta

SEQ ID NO: 235332 - DNA, 25 bp, Mus musculus
gcacaactactctgcagtggtactg

SEQ ID NO: 235333 - DNA, 25 bp, Mus musculus
tggtactgggcaccacagccgttaa

SEQ ID NO: 235334 - DNA, 25 bp, Mus musculus
cagccgttaaggtggccgcccacaa

SEQ ID NO: 235335 - DNA, 25 bp, Mus musculus
ggccgcccacaagctctatgagtca

SEQ ID NO: 235336 - DNA, 25 bp, Mus musculus
tgagtcactgggcttcagacacatg

SEQ ID NO: 235337 - DNA, 25 bp, Mus musculus
tggcatgaccctctcgctggccgag

SEQ ID NO: 235338 - DNA, 25 bp, Mus musculus
caacgttgtgggcatcgtggccgca

SEQ ID NO: 235339 - DNA, 25 bp, Mus musculus
tggccgagcgcctcttcttccaggt

SEQ ID NO: 235340 - DNA, 25 bp, Mus musculus
agtcctctcatcttcgccaggaagg

SEQ ID NO: 235341 - DNA, 25 bp, Mus musculus
cgatgccgggttcctccactagtcg

SEQ ID NO: 235342 - DNA, 25 bp, Mus musculus
caaaggcagccacggaacgcgatgc

SEQ ID NO: 235343 - DNA, 25 bp, Mus musculus
ccgagaagggccataaaagctggca

SEQ ID NO: 235344 - DNA, 25 bp, Mus musculus
cccgccatggctaaggagggcctgc

SEQ ID NO: 235345 - DNA, 25 bp, Mus musculus
ccgtgaaaggcgttctgcgctaggc

SEQ ID NO: 235346 - DNA, 25 bp, Mus musculus
gtgacacccgagtgtccgtgaaagg

SEQ ID NO: 235347 - DNA, 25 bp, Mus musculus
agagttggctgtgcagcagctcctc

SEQ ID NO: 235348 - DNA, 25 bp, Mus musculus
ggcggaactcctccggtggcacttc

SEQ ID NO: 235349 - DNA, 25 bp, Mus musculus
caccgtaccttgagaagtcctctca

SEQ ID NO: 235350 - DNA, 25 bp, Mus musculus
tcggcggaaccaccgtaccttgaga

SEQ ID NO: 235351 - DNA, 25 bp, Mus musculus
gagggtcgctgagcgcccaaagaca

SEQ ID NO: 235352 - DNA, 25 bp, Mus musculus
ctccacggctcaggagggtcgctga

SEQ ID NO: 235353 - DNA, 25 bp, Mus musculus
tggcacttccggatagagttggctg

SEQ ID NO: 235354 - DNA, 25 bp, Mus musculus
cggtttaacgtttgcctcgtatgat

SEQ ID NO: 235355 - DNA, 25 bp, Mus musculus
aggctcaagaggattggttttctca

SEQ ID NO: 235356 - DNA, 25 bp, Mus musculus
cgtccttcccgctaggctcaagagg

SEQ ID NO: 235357 - DNA, 25 bp, Mus musculus
attggctttcctgacggacgcaccg

SEQ ID NO: 235358 - DNA, 25 bp, Mus musculus
tatcccggagaaagcgaaggaggac

SEQ ID NO: 235359 - DNA, 25 bp, Mus musculus
acaacatccgtaaagtcagcgcagg

SEQ ID NO: 235360 - DNA, 25 bp, Mus musculus
gcgcacgcgcagattacaacatccg

SEQ ID NO: 235361 - DNA, 25 bp, Mus musculus
tcaggaaagccgcagtcactgctct

SEQ ID NO: 235362 - DNA, 25 bp, Mus musculus
tacaagacccttacctcaggaaagc

SEQ ID NO: 235363 - DNA, 25 bp, Mus musculus
ctatcgatgcctcaagcaggctgta

SEQ ID NO: 235364 - DNA, 25 bp, Mus musculus
tgggcccagcgacctctatcgatgc

SEQ ID NO: 235365 - DNA, 25 bp, Mus musculus
ccgcagtatccgaaaaataaagcta

SEQ ID NO: 235366 - DNA, 25 bp, Mus musculus
ggttttctcactataggctctgccc

SEQ ID NO: 235367 - DNA, 25 bp, Mus musculus
ggccttgggttttatccgcagtatc

SEQ ID NO: 235368 - DNA, 25 bp, Mus musculus
gcagcagagagttcagctccatcct

SEQ ID NO: 235369 - DNA, 25 bp, Mus musculus
tgcctcaggccctcaaattgacaca

SEQ ID NO: 235370 - DNA, 25 bp, Mus musculus
cgagcagcagtcgacgcagccaata

SEQ ID NO: 235371 - DNA, 25 bp, Mus musculus
cgcagccaataggtgtgggcgctcc

SEQ ID NO: 235372 - DNA, 25 bp, Mus musculus
ggttcttgtctagccttgcccaata

SEQ ID NO: 235373 - DNA, 25 bp, Mus musculus
tgcccaatagggactggccgaacgc

SEQ ID NO: 235374 - DNA, 25 bp, Mus musculus
cctcgggcagagctgagaatgttga

SEQ ID NO: 235375 - DNA, 25 bp, Mus musculus
agcccaagcttagcaacagcacgtg

SEQ ID NO: 235376 - DNA, 25 bp, Mus musculus
tggcggccatcgtgcatgttaagta

SEQ ID NO: 235377 - DNA, 25 bp, Mus musculus
agtaggcattgcacgccgattgggc

SEQ ID NO: 235378 - DNA, 25 bp, Mus musculus
cgattgggccagaacggtctatgta

SEQ ID NO: 235379 - DNA, 25 bp, Mus musculus
ctatgtaaattgagtccgcggacca

SEQ ID NO: 235380 - DNA, 25 bp, Mus musculus
tccgcggaccaatggccagtgacag

SEQ ID NO: 235381 - DNA, 25 bp, Mus musculus
gccgtctttgttttcttccttgcga

SEQ ID NO: 235382 - DNA, 25 bp, Mus musculus
tgacagtacacccaggcccgaaaga

SEQ ID NO: 235383 - DNA, 25 bp, Mus musculus
cgcggtgcttcacggcttaagagca

SEQ ID NO: 235384 - DNA, 25 bp, Mus musculus
aatctgttcatcatcgccgcgccgg

SEQ ID NO: 235385 - DNA, 25 bp, Mus musculus
tgggtttgtacagccactttcggaa

SEQ ID NO: 235386 - DNA, 25 bp, Mus musculus
gagccgctcaccttgggtttgtaca

SEQ ID NO: 235387 - DNA, 25 bp, Mus musculus
tctatctatcaaggagggacctgca

SEQ ID NO: 235388 - DNA, 25 bp, Mus musculus
gggccaaggaaacgaggtctatcta

SEQ ID NO: 235389 - DNA, 25 bp, Mus musculus
tcccatgaactggagaaagaaattc

SEQ ID NO: 235390 - DNA, 25 bp, Mus musculus
tcaatgcgcgccaggtacatggtct

SEQ ID NO: 235391 - DNA, 25 bp, Mus musculus
ccagacgaggagaaacatgacagta

SEQ ID NO: 235392 - DNA, 25 bp, Mus musculus
ggagccagcccatctagtatccaga

SEQ ID NO: 235393 - DNA, 25 bp, Mus musculus
tgaaacggtcggttcccaagtgcga

SEQ ID NO: 235394 - DNA, 25 bp, Mus musculus
ctggtcggagatccaaaagggtgca

SEQ ID NO: 235395 - DNA, 25 bp, Mus musculus
atggtctgtccaagtcgcggaatgc

SEQ ID NO: 235396 - DNA, 25 bp, Mus musculus
ccaaatcagcgggtgagctgagcag

SEQ ID NO: 235397 - DNA, 25 bp, Mus musculus
aggcagacagcaccgcagctcacgt

SEQ ID NO: 235398 - DNA, 25 bp, Mus musculus
cgggccctacgtccaaatcagcggg

SEQ ID NO: 235399 - DNA, 25 bp, Mus musculus
ctacgtccaaatcagcgggtgagct

SEQ ID NO: 235400 - DNA, 25 bp, Mus musculus
gagctgagcaggaagcaacctttcg

SEQ ID NO: 235401 - DNA, 25 bp, Mus musculus
tgggaaagctgatggcctaagtgtc

SEQ ID NO: 235402 - DNA, 25 bp, Mus musculus
gctgatggcctaagtgtctgagaac

SEQ ID NO: 235403 - DNA, 25 bp, Mus musculus
agtgtctgagaacagggcccaccgc

SEQ ID NO: 235404 - DNA, 25 bp, Mus musculus
caccgcctcctcgaccgaccttggg

SEQ ID NO: 235405 - DNA, 25 bp, Mus musculus
atgcagcactggctggagctggacc

SEQ ID NO: 235406 - DNA, 25 bp, Mus musculus
ctgcgggcaaggcaagaggcaaatc

SEQ ID NO: 235407 - DNA, 25 bp, Mus musculus
caagaggcaaatcgcacctgccacg

SEQ ID NO: 235408 - DNA, 25 bp, Mus musculus
agctgaacgccgcaggcagacagca

SEQ ID NO: 235409 - DNA, 25 bp, Mus musculus
aggaagcaacctttcggatctgggg

SEQ ID NO: 235410 - DNA, 25 bp, Mus musculus
ggtacgcctcattaacgaccgagga

SEQ ID NO: 235411 - DNA, 25 bp, Mus musculus
ttccttgctgatgacgcagcctttg

SEQ ID NO: 235412 - DNA, 25 bp, Mus musculus
cctgagcgaggtttttgttccttgc

SEQ ID NO: 235413 - DNA, 25 bp, Mus musculus
cggagaacctctttcgccaagtagg

SEQ ID NO: 235414 - DNA, 25 bp, Mus musculus
cgtcgtcggaagtagggaaatgtct

SEQ ID NO: 235415 - DNA, 25 bp, Mus musculus
tccaagtaaggctgggctccgcagc

SEQ ID NO: 235416 - DNA, 25 bp, Mus musculus
agctcatcagccgaggcgtctggca

SEQ ID NO: 235417 - DNA, 25 bp, Mus musculus
aggcttgcttgaacgggtctcctca

SEQ ID NO: 235418 - DNA, 25 bp, Mus musculus
gcgtgaccggaagaaggtgtatttc

SEQ ID NO: 235419 - DNA, 25 bp, Mus musculus
cactctcgcgggaagtggaagctcc

SEQ ID NO: 235420 - DNA, 25 bp, Mus musculus
accgccaagttctcgtgggaggagc

SEQ ID NO: 235421 - DNA, 25 bp, Mus musculus
caggtcagaagccaaacgaaaagtc

SEQ ID NO: 235422 - DNA, 25 bp, Mus musculus
gccgtatctaagttgcgagagtgcc

SEQ ID NO: 235423 - DNA, 25 bp, Mus musculus
aagggccaccgtataccaggtcaga

SEQ ID NO: 235424 - DNA, 25 bp, Mus musculus
gcacgactaactgcgcgtggcccta

SEQ ID NO: 235425 - DNA, 25 bp, Mus musculus
cctagaagtttctgggtaccgcctg

SEQ ID NO: 235426 - DNA, 25 bp, Mus musculus
cgcgggcggctggaactacagctcc

SEQ ID NO: 235427 - DNA, 25 bp, Mus musculus
cttgtgtccgccatattggactctt

SEQ ID NO: 235428 - DNA, 25 bp, Mus musculus
gtccgccatattggactcttaactc

SEQ ID NO: 235429 - DNA, 25 bp, Mus musculus
ggtggactcgcgtcgctctcgccag

SEQ ID NO: 235430 - DNA, 25 bp, Mus musculus
atgagcccggccgacgctaagcgcg

SEQ ID NO: 235431 - DNA, 25 bp, Mus musculus
acgctaagcgcggagccaagcgccg

SEQ ID NO: 235432 - DNA, 25 bp, Mus musculus
caagcgccggaagaacaagcgcggc

SEQ ID NO: 235433 - DNA, 25 bp, Mus musculus
gccggaggctacttcgaggtaagca

SEQ ID NO: 235434 - DNA, 25 bp, Mus musculus
tacttcgaggtaagcagcaggggtc

SEQ ID NO: 235435 - DNA, 25 bp, Mus musculus
ccgaggcacaccgactgtggccttg

SEQ ID NO: 235436 - DNA, 25 bp, Mus musculus
ccgactgtggccttgaaaagtgccc

SEQ ID NO: 235437 - DNA, 25 bp, Mus musculus
tacagattccacagggccacgcggc

SEQ ID NO: 235438 - DNA, 25 bp, Mus musculus
acctgccgcagctgggtctccgaag

SEQ ID NO: 235439 - DNA, 25 bp, Mus musculus
tgtcgtcgcagctgctcacggaagc

SEQ ID NO: 235440 - DNA, 25 bp, Mus musculus
acggaagcgctccacctgatccaga

SEQ ID NO: 235441 - DNA, 25 bp, Mus musculus
acctgatccagaagtgcgtccacga

SEQ ID NO: 235442 - DNA, 25 bp, Mus musculus
aagtgcgtccacgagtgacggcgcc

SEQ ID NO: 235443 - DNA, 25 bp, Mus musculus
agtgacggcgccgtgtgcccttcca

SEQ ID NO: 235444 - DNA, 25 bp, Mus musculus
tgtgcccttccagagccgcgaggcg

SEQ ID NO: 235445 - DNA, 25 bp, Mus musculus
acgcgcggccagctgatccttcagg

SEQ ID NO: 235446 - DNA, 25 bp, Mus musculus
tccttcaggcgctgtagttgctggc

SEQ ID NO: 235447 - DNA, 25 bp, Mus musculus
ccggcctcgtggtacaggccacaga

SEQ ID NO: 235448 - DNA, 25 bp, Mus musculus
tacaggccacagagcgctgcggccg

SEQ ID NO: 235449 - DNA, 25 bp, Mus musculus
cgtcctgtctaccagaccttgggtc

SEQ ID NO: 235450 - DNA, 25 bp, Mus musculus
gggacttgggcgtctccaacttctc

SEQ ID NO: 235451 - DNA, 25 bp, Mus musculus
cccagacgacatggctgtaggcctt

SEQ ID NO: 235452 - DNA, 25 bp, Mus musculus
acatgcgcggcacagtggtgtctca

SEQ ID NO: 235453 - DNA, 25 bp, Mus musculus
taaggcactgcatgggtttcgggac

SEQ ID NO: 235454 - DNA, 25 bp, Mus musculus
gagtgttctgtgtccctccggtccc

SEQ ID NO: 235455 - DNA, 25 bp, Mus musculus
cggcacagtggtgtctcagagacct

SEQ ID NO: 235456 - DNA, 25 bp, Mus musculus
cacagtggtgtctcagagacctgcc

SEQ ID NO: 235457 - DNA, 25 bp, Mus musculus
tcagagacctgcctgggtcccttga

SEQ ID NO: 235458 - DNA, 25 bp, Mus musculus
gacctgcctgggtcccttgaacctg

SEQ ID NO: 235459 - DNA, 25 bp, Mus musculus
gtcccttgaacctgtgtcccgctgt

SEQ ID NO: 235460 - DNA, 25 bp, Mus musculus
ggctgcgggcctcactggccgcaaa

SEQ ID NO: 235461 - DNA, 25 bp, Mus musculus
ttgaacctgtgtcccgctgtgaggt

SEQ ID NO: 235462 - DNA, 25 bp, Mus musculus
tcagtctaggagatagggctggttt

SEQ ID NO: 235463 - DNA, 25 bp, Mus musculus
ctggtttggcgagtgttctgtgtcc

SEQ ID NO: 235464 - DNA, 25 bp, Mus musculus
ctgcctgggtcccttgaacctgtgt

SEQ ID NO: 235465 - DNA, 25 bp, Mus musculus
tgcgggcctcactggccgcaaagcg

SEQ ID NO: 235466 - DNA, 25 bp, Mus musculus
acggcgctgacacagcacagaggca

SEQ ID NO: 235467 - DNA, 25 bp, Mus musculus
ctggtctcccgagactggaaggcgc

SEQ ID NO: 235468 - DNA, 25 bp, Mus musculus
agcctctggtctcccgagactggaa

SEQ ID NO: 235469 - DNA, 25 bp, Mus musculus
agcggacgagggcacagcagcctct

SEQ ID NO: 235470 - DNA, 25 bp, Mus musculus
accatggcgtatcccgggcaccctg

SEQ ID NO: 235471 - DNA, 25 bp, Mus musculus
agtctgcaccatggcgtatcccggg

SEQ ID NO: 235472 - DNA, 25 bp, Mus musculus
gcagtctgcaccatggcgtatcccg

SEQ ID NO: 235473 - DNA, 25 bp, Mus musculus
ggcgcagtctgcaccatggcgtatc

SEQ ID NO: 235474 - DNA, 25 bp, Mus musculus
ctgacacagcacagaggcagcaggg

SEQ ID NO: 235475 - DNA, 25 bp, Mus musculus
tcgcagacggcgctgacacagcaca

SEQ ID NO: 235476 - DNA, 25 bp, Mus musculus
ggcggtcccagatgctccctgcgag

SEQ ID NO: 235477 - DNA, 25 bp, Mus musculus
gacgagggcacagcagcctctggtc

SEQ ID NO: 235478 - DNA, 25 bp, Mus musculus
gaacgggcggcactcgggatgccgc

SEQ ID NO: 235479 - DNA, 25 bp, Mus musculus
actacccaggcggggtaagtgcagc

SEQ ID NO: 235480 - DNA, 25 bp, Mus musculus
gtgacttcctcattcgcattggtgg

SEQ ID NO: 235481 - DNA, 25 bp, Mus musculus
tcctcattcgcattggtggcttcct

SEQ ID NO: 235482 - DNA, 25 bp, Mus musculus
ttcctcattcgcattggtggcttcc

SEQ ID NO: 235483 - DNA, 25 bp, Mus musculus
cttcctcattcgcattggtggcttc

SEQ ID NO: 235484 - DNA, 25 bp, Mus musculus
tgacttcctcattcgcattggtggc

SEQ ID NO: 235485 - DNA, 25 bp, Mus musculus
cgtgacttcctcattcgcattggtg

SEQ ID NO: 235486 - DNA, 25 bp, Mus musculus
agcgtgacttcctcattcgcattgg

SEQ ID NO: 235487 - DNA, 25 bp, Mus musculus
tgagcgtgacttcctcattcgcatt

SEQ ID NO: 235488 - DNA, 25 bp, Mus musculus
tatgagcgtgacttcctcattcgca

SEQ ID NO: 235489 - DNA, 25 bp, Mus musculus
ggaatatgagcgtgacttcctcatt

SEQ ID NO: 235490 - DNA, 25 bp, Mus musculus
ttgggaatatgagcgtgacttcctc

SEQ ID NO: 235491 - DNA, 25 bp, Mus musculus
tgttgggaatatgagcgtgacttcc

SEQ ID NO: 235492 - DNA, 25 bp, Mus musculus
gagcgtgacttcctcattcgcattg

SEQ ID NO: 235493 - DNA, 25 bp, Mus musculus
gacttcctcattcgcattggtggct

SEQ ID NO: 235494 - DNA, 25 bp, Mus musculus
tctggattatacagacacaagtttc

SEQ ID NO: 235495 - DNA, 25 bp, Mus musculus
tcagttcagacttccactcctcaga

SEQ ID NO: 235496 - DNA, 25 bp, Mus musculus
tctgagcatccacactcagttcaga

SEQ ID NO: 235497 - DNA, 25 bp, Mus musculus
agccctggttctgagcatccacact

SEQ ID NO: 235498 - DNA, 25 bp, Mus musculus
ggacaccgtgagtactgatcctgcc

SEQ ID NO: 235499 - DNA, 25 bp, Mus musculus
cgcgtggacaccgtgagtactgatc

SEQ ID NO: 235500 - DNA, 25 bp, Mus musculus
ggctctacgagctatggcgggctca

SEQ ID NO: 235501 - DNA, 25 bp, Mus musculus
agcccttacactaccgcccgcgagg

SEQ ID NO: 235502 - DNA, 25 bp, Mus musculus
agtttccacttattgcagcccacca

SEQ ID NO: 235503 - DNA, 25 bp, Mus musculus
ccttgtttgtctggatggctcttaa

SEQ ID NO: 235504 - DNA, 25 bp, Mus musculus
ctggatggctcttaattctggatta

SEQ ID NO: 235505 - DNA, 25 bp, Mus musculus
tctgcaccacgacccgggaccgaaa

SEQ ID NO: 235506 - DNA, 25 bp, Mus musculus
caccaccctcagtgcagtgggtgga

SEQ ID NO: 235507 - DNA, 25 bp, Mus musculus
ttggtggcttccttgtttgtctgga

SEQ ID NO: 235508 - DNA, 25 bp, Mus musculus
gagtcccaggaccaacagaattgtg

SEQ ID NO: 235509 - DNA, 25 bp, Mus musculus
ctatcagtagcacgttgcgcgagtg

SEQ ID NO: 235510 - DNA, 25 bp, Mus musculus
cagaattgtgcagcaggccagtccc

SEQ ID NO: 235511 - DNA, 25 bp, Mus musculus
tcagggtaagcggttccggctcgtc

SEQ ID NO: 235512 - DNA, 25 bp, Mus musculus
ccactctgtttctgagattcctgcg

SEQ ID NO: 235513 - DNA, 25 bp, Mus musculus
gagattcctgcggactcagctaccg

SEQ ID NO: 235514 - DNA, 25 bp, Mus musculus
cccagtggccgcttctgggagcagc

SEQ ID NO: 235515 - DNA, 25 bp, Mus musculus
agaccctgagtctcagcgtccggtg

SEQ ID NO: 235516 - DNA, 25 bp, Mus musculus
ctgagtcctcgggtgagccctactc

SEQ ID NO: 235517 - DNA, 25 bp, Mus musculus
caaaccattagagtccgggccgcct

SEQ ID NO: 235518 - DNA, 25 bp, Mus musculus
ggccgccttactccaggttctcaga

SEQ ID NO: 235519 - DNA, 25 bp, Mus musculus
caggttctcagacttgtttgtgttc

SEQ ID NO: 235520 - DNA, 25 bp, Mus musculus
accgccacttcggaagaccctgagt

SEQ ID NO: 235521 - DNA, 25 bp, Mus musculus
agggacggcggcactcaccaactat

SEQ ID NO: 235522 - DNA, 25 bp, Mus musculus
ggacactgcatcgtcgcttcccagg

SEQ ID NO: 235523 - DNA, 25 bp, Mus musculus
gttctctgtggaagcggcttgctcg

SEQ ID NO: 235524 - DNA, 25 bp, Mus musculus
gcttcccaggatggcccggacggac

SEQ ID NO: 235525 - DNA, 25 bp, Mus musculus
cagtcagtttgtgggtctgaccgtc

SEQ ID NO: 235526 - DNA, 25 bp, Mus musculus
gggagaactagcgttcctgtgagca

SEQ ID NO: 235527 - DNA, 25 bp, Mus musculus
agaccgtgtccgttcgcagtcagtt

SEQ ID NO: 235528 - DNA, 25 bp, Mus musculus
ttcctgtgagcaggtgcaccagccc

SEQ ID NO: 235529 - DNA, 25 bp, Mus musculus
ggaggccggagtctacccttctctc

SEQ ID NO: 235530 - DNA, 25 bp, Mus musculus
cccttgcttaagattgaccaataac

SEQ ID NO: 235531 - DNA, 25 bp, Mus musculus
ttgaccaataacagagagtagtgct

SEQ ID NO: 235532 - DNA, 25 bp, Mus musculus
gttcagaccaatggggctgtgcatt

SEQ ID NO: 235533 - DNA, 25 bp, Mus musculus
actcggacccgggaagccgtgctct

SEQ ID NO: 235534 - DNA, 25 bp, Mus musculus
gcctgaagcgcacctagaccgtgtc

SEQ ID NO: 235535 - DNA, 25 bp, Mus musculus
tctgaccgtctcagtgggagaacta

SEQ ID NO: 235536 - DNA, 25 bp, Mus musculus
ctctggccggggtgatgacgcttct

SEQ ID NO: 235537 - DNA, 25 bp, Mus musculus
cgccgctcaggcacagttttcagaa

SEQ ID NO: 235538 - DNA, 25 bp, Mus musculus
gcacagttttcagaagcagcagcga

SEQ ID NO: 235539 - DNA, 25 bp, Mus musculus
tcagaagcagcagcgagagaagaca

SEQ ID NO: 235540 - DNA, 25 bp, Mus musculus
cgagagaagacaagatggctgcact

SEQ ID NO: 235541 - DNA, 25 bp, Mus musculus
acaagatggctgcactctggccggg

SEQ ID NO: 235542 - DNA, 25 bp, Mus musculus
aggggcagaacggaagcagtcccaa

SEQ ID NO: 235543 - DNA, 25 bp, Mus musculus
ggaagcagtcccaagtcgaagacta

SEQ ID NO: 235544 - DNA, 25 bp, Mus musculus
tcgaagactaaggtgtggacgaaca

SEQ ID NO: 235545 - DNA, 25 bp, Mus musculus
tggacgaacattacacacgatcacg

SEQ ID NO: 235546 - DNA, 25 bp, Mus musculus
tcacgtgaaacccttgctgcagtct

SEQ ID NO: 235547 - DNA, 25 bp, Mus musculus
attcgggcacttgctcgccgctcag

SEQ ID NO: 235548 - DNA, 25 bp, Mus musculus
ctgcagtctctctcgtccggtgtct

SEQ ID NO: 235549 - DNA, 25 bp, Mus musculus
acgatcacgtgaaacccttgctgca

SEQ ID NO: 235550 - DNA, 25 bp, Mus musculus
cagtgcgtacagaccaagcagttca

SEQ ID NO: 235551 - DNA, 25 bp, Mus musculus
agctggaacccgtagcgagcctacc

SEQ ID NO: 235552 - DNA, 25 bp, Mus musculus
ggagaccgctctcgagtttgtaagc

SEQ ID NO: 235553 - DNA, 25 bp, Mus musculus
ggcccagctgtcttgcgagttaact

SEQ ID NO: 235554 - DNA, 25 bp, Mus musculus
ctctcgggctccctctggaggaaaa

SEQ ID NO: 235555 - DNA, 25 bp, Mus musculus
cgagagccgccacagtatcctcaga

SEQ ID NO: 235556 - DNA, 25 bp, Mus musculus
tttcgcgagaagtacacaagtcctg

SEQ ID NO: 235557 - DNA, 25 bp, Mus musculus
gcttcgtctcgcgatgagtgcgtca

SEQ ID NO: 235558 - DNA, 25 bp, Mus musculus
ttcaagaaactcgtgcataggatgc

SEQ ID NO: 235559 - DNA, 25 bp, Mus musculus
gccacactttggacgacagtgcgta

SEQ ID NO: 235560 - DNA, 25 bp, Mus musculus
cagaagccgcgttcctcaaaggaca

SEQ ID NO: 235561 - DNA, 25 bp, Mus musculus
tgggccttatgggatctgtagtgtc

SEQ ID NO: 235562 - DNA, 25 bp, Mus musculus
tgatgtaaaaccacgcccagcttcg

SEQ ID NO: 235563 - DNA, 25 bp, Mus musculus
gagtgcgtcagcttcccgtatttcg

SEQ ID NO: 235564 - DNA, 25 bp, Mus musculus
cattcattgccttgctgctaagtgg

SEQ ID NO: 235565 - DNA, 25 bp, Mus musculus
caagatggctgagcgccttggttcc

SEQ ID NO: 235566 - DNA, 25 bp, Mus musculus
acgggcccaagatggctgagcgcct

SEQ ID NO: 235567 - DNA, 25 bp, Mus musculus
atgacgtcacgggacgcactcgccg

SEQ ID NO: 235568 - DNA, 25 bp, Mus musculus
gtctccgccggcatgacgtcacggg

SEQ ID NO: 235569 - DNA, 25 bp, Mus musculus
cggggcggagagtcttaaactagca

SEQ ID NO: 235570 - DNA, 25 bp, Mus musculus
aattctgcgggtctggcgtggcctc

SEQ ID NO: 235571 - DNA, 25 bp, Mus musculus
tggttccgcttctgcctgccgcgca

SEQ ID NO: 235572 - DNA, 25 bp, Mus musculus
cctgtcaattctgcgggtctggcgt

SEQ ID NO: 235573 - DNA, 25 bp, Mus musculus
aggacgacgcatccgcctgtcaatt

SEQ ID NO: 235574 - DNA, 25 bp, Mus musculus
acttcgggaaagaggacgacgcatc

SEQ ID NO: 235575 - DNA, 25 bp, Mus musculus
gcctgcgtcctgacttcgggaaaga

SEQ ID NO: 235576 - DNA, 25 bp, Mus musculus
gagagtcttaaactagcagaggccc

SEQ ID NO: 235577 - DNA, 25 bp, Mus musculus
attgccttgctgctaagtggcgccg

SEQ ID NO: 235578 - DNA, 25 bp, Mus musculus
ggcaagaacgcagggcagcccacag

SEQ ID NO: 235579 - DNA, 25 bp, Mus musculus
tcagagtcccgaagcgcacaacggc

SEQ ID NO: 235580 - DNA, 25 bp, Mus musculus
caggagtcggagctcctctctcagg

SEQ ID NO: 235581 - DNA, 25 bp, Mus musculus
tccaaggacccgaactgaggaaatg

SEQ ID NO: 235582 - DNA, 25 bp, Mus musculus
tgggcagagaccgtatccaaggacc

SEQ ID NO: 235583 - DNA, 25 bp, Mus musculus
tcgcgcgtctttcttctctggcgcg

SEQ ID NO: 235584 - DNA, 25 bp, Mus musculus
cccgcggtctcattgtttgggcaga

SEQ ID NO: 235585 - DNA, 25 bp, Mus musculus
tcgcgcgggactccgggaacttgcc

SEQ ID NO: 235586 - DNA, 25 bp, Mus musculus
ctgaggaaatgtagggcaagaacgc

SEQ ID NO: 235587 - DNA, 25 bp, Mus musculus
agcccaccggactcgggcgggatct

SEQ ID NO: 235588 - DNA, 25 bp, Mus musculus
gatctgacccggctcagaagccggc

SEQ ID NO: 235589 - DNA, 25 bp, Mus musculus
cggctggccatgaggggactttaat

SEQ ID NO: 235590 - DNA, 25 bp, Mus musculus
ttaatgtccaactcagcccgcggtc

SEQ ID NO: 235591 - DNA, 25 bp, Mus musculus
acggcggtgaccgttgatgctttcg

SEQ ID NO: 235592 - DNA, 25 bp, Mus musculus
ggtaaccggagagtcgaagccgctc

SEQ ID NO: 235593 - DNA, 25 bp, Mus musculus
ggtgccagctctcccgaaatagccg

SEQ ID NO: 235594 - DNA, 25 bp, Mus musculus
gggacctggccacccgcaacacaga

SEQ ID NO: 235595 - DNA, 25 bp, Mus musculus
cctacaaccggtggctgaggtgcca

SEQ ID NO: 235596 - DNA, 25 bp, Mus musculus
tgaggtgccagctctcccgaaatag

SEQ ID NO: 235597 - DNA, 25 bp, Mus musculus
tgccggccctacaaccggtggctga

SEQ ID NO: 235598 - DNA, 25 bp, Mus musculus
gcgggtctcagcgagccatccggac

SEQ ID NO: 235599 - DNA, 25 bp, Mus musculus
gctgcgcaagccatcgccggtggca

SEQ ID NO: 235600 - DNA, 25 bp, Mus musculus
gctggtgctgcgcaagccatcgccg

SEQ ID NO: 235601 - DNA, 25 bp, Mus musculus
gtcctgtctccgcagtggaagagta

SEQ ID NO: 235602 - DNA, 25 bp, Mus musculus
ggcggcttctcacgctgtcctgtct

SEQ ID NO: 235603 - DNA, 25 bp, Mus musculus
tgacagaagatgaccgaggcagcgc

SEQ ID NO: 235604 - DNA, 25 bp, Mus musculus
cggcgggaaccatgacagaagatga

SEQ ID NO: 235605 - DNA, 25 bp, Mus musculus
ctgtctccgcagtggaagagtaggt

SEQ ID NO: 235606 - DNA, 25 bp, Mus musculus
actgacaggactgggtcttgtagga

SEQ ID NO: 235607 - DNA, 25 bp, Mus musculus
ctgaagcgctagcagactgacagga

SEQ ID NO: 235608 - DNA, 25 bp, Mus musculus
ggcgccatcttcctctgaagcgcta

SEQ ID NO: 235609 - DNA, 25 bp, Mus musculus
tagagaccctctctcttcgaggcgc

SEQ ID NO: 235610 - DNA, 25 bp, Mus musculus
ggggcagcgtagagaccctctctct

SEQ ID NO: 235611 - DNA, 25 bp, Mus musculus
aacagcactagcagttggagccggg

SEQ ID NO: 235612 - DNA, 25 bp, Mus musculus
gcagcaacaacagcactagcagttg

SEQ ID NO: 235613 - DNA, 25 bp, Mus musculus
ctggggcacaagcatcagcggcagc

SEQ ID NO: 235614 - DNA, 25 bp, Mus musculus
ctgctatgggctggggcacaagcat

SEQ ID NO: 235615 - DNA, 25 bp, Mus musculus
tcgcgagtacttgccgccatggcct

SEQ ID NO: 235616 - DNA, 25 bp, Mus musculus
ccggctcgttcttctctcgcgagta

SEQ ID NO: 235617 - DNA, 25 bp, Mus musculus
ggtcttgtaggaccgcccatctgta

SEQ ID NO: 235618 - DNA, 25 bp, Mus musculus
ttggccttctcccatagctggttca

SEQ ID NO: 235619 - DNA, 25 bp, Mus musculus
agctggttcagcttctccatgcgga

SEQ ID NO: 235620 - DNA, 25 bp, Mus musculus
cgcaagcggtagagtacaacctgaa

SEQ ID NO: 235621 - DNA, 25 bp, Mus musculus
gtgcaccagcttggacaccgcatct

SEQ ID NO: 235622 - DNA, 25 bp, Mus musculus
agctctgcacttacgcgcgcggcag

SEQ ID NO: 235623 - DNA, 25 bp, Mus musculus
accgcgtagctctcgggaggaccat

SEQ ID NO: 235624 - DNA, 25 bp, Mus musculus
gtggtgggtttcctcatcgttttca

SEQ ID NO: 235625 - DNA, 25 bp, Mus musculus
tttcaccgtggtaggcaatgtgctc

SEQ ID NO: 235626 - DNA, 25 bp, Mus musculus
cacactggtcatgcccttttctctg

SEQ ID NO: 235627 - DNA, 25 bp, Mus musculus
cttttctctggccaatgagctcatg

SEQ ID NO: 235628 - DNA, 25 bp, Mus musculus
tgagctcatggcctactggtacttc

SEQ ID NO: 235629 - DNA, 25 bp, Mus musculus
tggtgtatacctggcactggacgtg

SEQ ID NO: 235630 - DNA, 25 bp, Mus musculus
tgtgtgccattagtctggaccgcta

SEQ ID NO: 235631 - DNA, 25 bp, Mus musculus
accgctactggtcggtgacgcaagc

SEQ ID NO: 235632 - DNA, 25 bp, Mus musculus
gcgccgtgtcaaggccaccatcgtg

SEQ ID NO: 235633 - DNA, 25 bp, Mus musculus
accatcgtggccgtgtggctcatct

SEQ ID NO: 235634 - DNA, 25 bp, Mus musculus
cgggataatcgcgtggtgagtattc

SEQ ID NO: 235635 - DNA, 25 bp, Mus musculus
catagaggtggtaagaggactcgcg

SEQ ID NO: 235636 - DNA, 25 bp, Mus musculus
gggccgcttcggcttcttctcgggc

SEQ ID NO: 235637 - DNA, 25 bp, Mus musculus
ttcttctcgggcctgctccctcggc

SEQ ID NO: 235638 - DNA, 25 bp, Mus musculus
ctccctcggcggcttcccgcgcctt

SEQ ID NO: 235639 - DNA, 25 bp, Mus musculus
cccgcgccttcagccggccaccatg

SEQ ID NO: 235640 - DNA, 25 bp, Mus musculus
caccatggggaaacgggataatcgc

SEQ ID NO: 235641 - DNA, 25 bp, Mus musculus
tggcgcatacggtctccccggattg

SEQ ID NO: 235642 - DNA, 25 bp, Mus musculus
ataatcgcgtggtgagtattcggcg

SEQ ID NO: 235643 - DNA, 25 bp, Mus musculus
cggcaggcgaacgagcggaagccgt

SEQ ID NO: 235644 - DNA, 25 bp, Mus musculus
gtcctcagcgtcctgctcggccgac

SEQ ID NO: 235645 - DNA, 25 bp, Mus musculus
cccgcagcggtaagggctgtgagcc

SEQ ID NO: 235646 - DNA, 25 bp, Mus musculus
ccgccggtgccgagaggcccagacc

SEQ ID NO: 235647 - DNA, 25 bp, Mus musculus
gccaccatggggaaacgggataatc

SEQ ID NO: 235648 - DNA, 25 bp, Mus musculus
tccagcaaggctgtgcgccaaggag

SEQ ID NO: 235649 - DNA, 25 bp, Mus musculus
cagggcgctgatcttacctaggtca

SEQ ID NO: 235650 - DNA, 25 bp, Mus musculus
agaactttttcgtgccaggcgtctg

SEQ ID NO: 235651 - DNA, 25 bp, Mus musculus
tttgcgagccagatgtctgccctca

SEQ ID NO: 235652 - DNA, 25 bp, Mus musculus
caactgcagcagaacttttgcgagc

SEQ ID NO: 235653 - DNA, 25 bp, Mus musculus
cgtgtcctcgcgtaaagcggtccca

SEQ ID NO: 235654 - DNA, 25 bp, Mus musculus
cccattaactctcgggttgcggaca

SEQ ID NO: 235655 - DNA, 25 bp, Mus musculus
ccaagtttcggtttcactgcaggca

SEQ ID NO: 235656 - DNA, 25 bp, Mus musculus
agcggccacttccttcatgttccaa

SEQ ID NO: 235657 - DNA, 25 bp, Mus musculus
atgctgtttcattgggtgccggtcc

SEQ ID NO: 235658 - DNA, 25 bp, Mus musculus
ccaccaggcggggaattccagcaag

SEQ ID NO: 235659 - DNA, 25 bp, Mus musculus
tacctaggtcaaagccgggagcctc

SEQ ID NO: 235660 - DNA, 25 bp, Mus musculus
agtccctgaatggtgcctgcgtcct

SEQ ID NO: 235661 - DNA, 25 bp, Mus musculus
tcgctctggacaagcgagctaggcc

SEQ ID NO: 235662 - DNA, 25 bp, Mus musculus
tccagggcaaccctaagcaaacgcg

SEQ ID NO: 235663 - DNA, 25 bp, Mus musculus
gctggttgtgctgagtttcatcctc

SEQ ID NO: 235664 - DNA, 25 bp, Mus musculus
ggttgtgctgagtttcatcctcgcc

SEQ ID NO: 235665 - DNA, 25 bp, Mus musculus
cggtacaccgcatttccagggcaac

SEQ ID NO: 235666 - DNA, 25 bp, Mus musculus
gcatttccagggcaaccctaagcaa

SEQ ID NO: 235667 - DNA, 25 bp, Mus musculus
cagggcaaccctaagcaaacgcggg

SEQ ID NO: 235668 - DNA, 25 bp, Mus musculus
cctgggcagtgtggaggaccatctc

SEQ ID NO: 235669 - DNA, 25 bp, Mus musculus
ggcagtgtggaggaccatctcccga

SEQ ID NO: 235670 - DNA, 25 bp, Mus musculus
gtgtggaggaccatctcccgaaccc

SEQ ID NO: 235671 - DNA, 25 bp, Mus musculus
cgccactcacctgcggtccgccagg

SEQ ID NO: 235672 - DNA, 25 bp, Mus musculus
ccgcacccgcgtgtcgagctggttg

SEQ ID NO: 235673 - DNA, 25 bp, Mus musculus
gtcgagctggttgtgctgagtttca

SEQ ID NO: 235674 - DNA, 25 bp, Mus musculus
cgagctggttgtgctgagtttcatc

SEQ ID NO: 235675 - DNA, 25 bp, Mus musculus
accgcatttccagggcaaccctaag

SEQ ID NO: 235676 - DNA, 25 bp, Mus musculus
agcatctccggcaatggcttctctc

SEQ ID NO: 235677 - DNA, 25 bp, Mus musculus
ccgcgatgccggatgagctgaccga

SEQ ID NO: 235678 - DNA, 25 bp, Mus musculus
tcctcatcgagaacctgctagcagc

SEQ ID NO: 235679 - DNA, 25 bp, Mus musculus
cgttggggctgagcctacgaaactc

SEQ ID NO: 235680 - DNA, 25 bp, Mus musculus
gacgacgactacagcggcggcgaca

SEQ ID NO: 235681 - DNA, 25 bp, Mus musculus
cggaacgcatctcgcggggtcgtac

SEQ ID NO: 235682 - DNA, 25 bp, Mus musculus
gactgcggcccagtcggcaatagtc

SEQ ID NO: 235683 - DNA, 25 bp, Mus musculus
tgtagccaatggtcgacctcccagc

SEQ ID NO: 235684 - DNA, 25 bp, Mus musculus
ctgggcttcacagcgaccctgtagc

SEQ ID NO: 235685 - DNA, 25 bp, Mus musculus
agcaaggctctcctcggatgcgatt

SEQ ID NO: 235686 - DNA, 25 bp, Mus musculus
gtcacagggactcacgcacaaaccg

SEQ ID NO: 235687 - DNA, 25 bp, Mus musculus
gcgcgcaaatacacagtcacaggga

SEQ ID NO: 235688 - DNA, 25 bp, Mus musculus
ggcaatagtccttacccgcgcgcaa

SEQ ID NO: 235689 - DNA, 25 bp, Mus musculus
cggcgacctgaaccgctcggagaaa

SEQ ID NO: 235690 - DNA, 25 bp, Mus musculus
ccgcaggaagaagacgcgcacggtc

SEQ ID NO: 235691 - DNA, 25 bp, Mus musculus
cgtgtttcccagtttgtagcgtttg

SEQ ID NO: 235692 - DNA, 25 bp, Mus musculus
cagatgccggctccgagtcagcaaa

SEQ ID NO: 235693 - DNA, 25 bp, Mus musculus
gtgactcctaaaggcagacccttag

SEQ ID NO: 235694 - DNA, 25 bp, Mus musculus
gtcagcaaacggacacttggaatgg

SEQ ID NO: 235695 - DNA, 25 bp, Mus musculus
ccagctcgagtccactttcgatctg

SEQ ID NO: 235696 - DNA, 25 bp, Mus musculus
tttcgatctgaagcgctacctgagc

SEQ ID NO: 235697 - DNA, 25 bp, Mus musculus
ctcgctgcagctcacggagacgcag

SEQ ID NO: 235698 - DNA, 25 bp, Mus musculus
tgccggtgctctaccacgagagtcc

SEQ ID NO: 235699 - DNA, 25 bp, Mus musculus
gtgggcagctgctctacagtgtacc

SEQ ID NO: 235700 - DNA, 25 bp, Mus musculus
tacagtgtaccggacagcggcggca

SEQ ID NO: 235701 - DNA, 25 bp, Mus musculus
tggagacccgttccgatggaaagcc

SEQ ID NO: 235702 - DNA, 25 bp, Mus musculus
atgcgctagctctcgccggcacgga

SEQ ID NO: 235703 - DNA, 25 bp, Mus musculus
tgggaggaagccagtctcagtgact

SEQ ID NO: 235704 - DNA, 25 bp, Mus musculus
tcgcgaccttgcaacacagtgtggg

SEQ ID NO: 235705 - DNA, 25 bp, Mus musculus
tcttctgtttctggagcaccgggga

SEQ ID NO: 235706 - DNA, 25 bp, Mus musculus
ctgggctggagaccgctaaacagac

SEQ ID NO: 235707 - DNA, 25 bp, Mus musculus
tccagacgcctgctagccatggttc

SEQ ID NO: 235708 - DNA, 25 bp, Mus musculus
gcccgggacacagcgacgttattct

SEQ ID NO: 235709 - DNA, 25 bp, Mus musculus
ccagtggccgtgatccttcttctca

SEQ ID NO: 235710 - DNA, 25 bp, Mus musculus
ctgccatgcgggaagtgactccttc

SEQ ID NO: 235711 - DNA, 25 bp, Mus musculus
ttggtcctgcctcccactatgggtc

SEQ ID NO: 235712 - DNA, 25 bp, Mus musculus
cgaggccctgtttcgccatcaggta

SEQ ID NO: 235713 - DNA, 25 bp, Mus musculus
tccgaccttactgggcttagacgct

SEQ ID NO: 235714 - DNA, 25 bp, Mus musculus
ccgcctttctggtctgggatctagg

SEQ ID NO: 235715 - DNA, 25 bp, Mus musculus
cctttccgagccgagggcatgtaac

SEQ ID NO: 235716 - DNA, 25 bp, Mus musculus
tgcccagtcacatagtaaaggttcc

SEQ ID NO: 235717 - DNA, 25 bp, Mus musculus
atcctgcgtgtccttacgcgggcta

SEQ ID NO: 235718 - DNA, 25 bp, Mus musculus
agctccgaagcacagcgaccgcttg

SEQ ID NO: 235719 - DNA, 25 bp, Mus musculus
agaaaattaaacacacgcgcacacg

SEQ ID NO: 235720 - DNA, 25 bp, Mus musculus
agaagcggtgttcggtatagaaaat

SEQ ID NO: 235721 - DNA, 25 bp, Mus musculus
catctgcgcgcagagaagcggtgtt

SEQ ID NO: 235722 - DNA, 25 bp, Mus musculus
cggccgctagccaatcggttctgca

SEQ ID NO: 235723 - DNA, 25 bp, Mus musculus
ttcggcccttctgccggggcaagca

SEQ ID NO: 235724 - DNA, 25 bp, Mus musculus
tgccctgggacacggacccatgctt

SEQ ID NO: 235725 - DNA, 25 bp, Mus musculus
agaagagccaggcagctccgaagca

SEQ ID NO: 235726 - DNA, 25 bp, Mus musculus
cgaaccttccgactcagaccggaga

SEQ ID NO: 235727 - DNA, 25 bp, Mus musculus
agaggcttccggagtcagaccctcg

SEQ ID NO: 235728 - DNA, 25 bp, Mus musculus
gactagatcttcagaggcttccgga

SEQ ID NO: 235729 - DNA, 25 bp, Mus musculus
ggcgctcaccttagactagatcttc

SEQ ID NO: 235730 - DNA, 25 bp, Mus musculus
ggaacctggcgctcaccttagacta

SEQ ID NO: 235731 - DNA, 25 bp, Mus musculus
ctgggacacggacccatgcttcggc

SEQ ID NO: 235732 - DNA, 25 bp, Mus musculus
gtctcaatgtggcaccttcaggata

SEQ ID NO: 235733 - DNA, 25 bp, Mus musculus
ccttcaggatattctacccaggtga

SEQ ID NO: 235734 - DNA, 25 bp, Mus musculus
tgcgacctacaaggagagaaaagtt

SEQ ID NO: 235735 - DNA, 25 bp, Mus musculus
agaaaagttcccaggtggctggaga

SEQ ID NO: 235736 - DNA, 25 bp, Mus musculus
ctggagaaaggggtatctaaatcta

SEQ ID NO: 235737 - DNA, 25 bp, Mus musculus
taaatctacccacaggggcggctgg

SEQ ID NO: 235738 - DNA, 25 bp, Mus musculus
cattgtcggcatggtgggcacagat

SEQ ID NO: 235739 - DNA, 25 bp, Mus musculus
ttacaaccggcagcgccagacactg

SEQ ID NO: 235740 - DNA, 25 bp, Mus musculus
gccagacactggagaagggattcta

SEQ ID NO: 235741 - DNA, 25 bp, Mus musculus
caggaactccgcctcctaaagaaag

SEQ ID NO: 235742 - DNA, 25 bp, Mus musculus
acttgccctcttatgggaggctctg

SEQ ID NO: 235743 - DNA, 25 bp, Mus musculus
ctggggagctagtcgtcaaatgctt

SEQ ID NO: 235744 - DNA, 25 bp, Mus musculus
ttctgtactggctaaggtctcaatg

SEQ ID NO: 235745 - DNA, 25 bp, Mus musculus
cccaggtgacagaatgcgacctaca

SEQ ID NO: 235746 - DNA, 25 bp, Mus musculus
gccacagaggaaggccagcatttcc

SEQ ID NO: 235747 - DNA, 25 bp, Mus musculus
ctcgctttcgggatgacagtcctga

SEQ ID NO: 235748 - DNA, 25 bp, Mus musculus
tcctgagaatcaggtcgagctcctg

SEQ ID NO: 235749 - DNA, 25 bp, Mus musculus
cggcttcaggctgaggacccaacga

SEQ ID NO: 235750 - DNA, 25 bp, Mus musculus
agcatttccggattggcgtggacga

SEQ ID NO: 235751 - DNA, 25 bp, Mus musculus
aggctttgggagactcggtcccata

SEQ ID NO: 235752 - DNA, 25 bp, Mus musculus
ccgactctggctctcctttaggaga

SEQ ID NO: 235753 - DNA, 25 bp, Mus musculus
gtcctttttgctgggcggtagcttc

SEQ ID NO: 235754 - DNA, 25 bp, Mus musculus
ttgttggccacctgtggcctctcca

SEQ ID NO: 235755 - DNA, 25 bp, Mus musculus
ctgcaggtagcagggcatcaggatc

SEQ ID NO: 235756 - DNA, 25 bp, Mus musculus
cggaagcgcattgactcacgggagt

SEQ ID NO: 235757 - DNA, 25 bp, Mus musculus
ctcacgggagttagagcctggaccc

SEQ ID NO: 235758 - DNA, 25 bp, Mus musculus
ggccatccctttgtcctttttgctg

SEQ ID NO: 235759 - DNA, 25 bp, Mus musculus
ctcggtcccatagcgagttcaggtc

SEQ ID NO: 235760 - DNA, 25 bp, Mus musculus
gcgcgcacacgtcggcataagtatg

SEQ ID NO: 235761 - DNA, 25 bp, Mus musculus
cacagccagcgtggccagaatggcc

SEQ ID NO: 235762 - DNA, 25 bp, Mus musculus
actggagtcccggagacctgcaacg

SEQ ID NO: 235763 - DNA, 25 bp, Mus musculus
cggagacctgcaacgcacgacggct

SEQ ID NO: 235764 - DNA, 25 bp, Mus musculus
aacgcacgacggctggcggcctgca

SEQ ID NO: 235765 - DNA, 25 bp, Mus musculus
tcggcataagtatgcccgtctgtgc

SEQ ID NO: 235766 - DNA, 25 bp, Mus musculus
cacacacagtgtgggtccaacggca

SEQ ID NO: 235767 - DNA, 25 bp, Mus musculus
tgggtccaacggcagcggcacacgc

SEQ ID NO: 235768 - DNA, 25 bp, Mus musculus
ctggcagcgcacaccaggcagcagt

SEQ ID NO: 235769 - DNA, 25 bp, Mus musculus
caccaggcagcagttgcagaggtca

SEQ ID NO: 235770 - DNA, 25 bp, Mus musculus
gttgcagaggtcaggcacatagccc

SEQ ID NO: 235771 - DNA, 25 bp, Mus musculus
tcggacagcgcgacacgtcgcagcg

SEQ ID NO: 235772 - DNA, 25 bp, Mus musculus
gcccgtctgtgccacacacagtgtg

SEQ ID NO: 235773 - DNA, 25 bp, Mus musculus
ggccagagccaacacagccagcgtg

SEQ ID NO: 235774 - DNA, 25 bp, Mus musculus
taccaccagtctgcgcctgagcgga

SEQ ID NO: 235775 - DNA, 25 bp, Mus musculus
tgcttcagtaaagggatccaggtcc

SEQ ID NO: 235776 - DNA, 25 bp, Mus musculus
ggcgtcactccttgcttctcgtggg

SEQ ID NO: 235777 - DNA, 25 bp, Mus musculus
gaatttcttcccaccgtgccagcta

SEQ ID NO: 235778 - DNA, 25 bp, Mus musculus
aactttttctccagggtgtgcagcc

SEQ ID NO: 235779 - DNA, 25 bp, Mus musculus
tctagccaattcctgagcccagcgg

SEQ ID NO: 235780 - DNA, 25 bp, Mus musculus
acctgcagtgcgtagccaattcctc

SEQ ID NO: 235781 - DNA, 25 bp, Mus musculus
gtctcgaggactggatacacctgca

SEQ ID NO: 235782 - DNA, 25 bp, Mus musculus
tcgtagcggcaacctcagtagggtc

SEQ ID NO: 235783 - DNA, 25 bp, Mus musculus
ctcaagcgtgctgaggatcctgcca

SEQ ID NO: 235784 - DNA, 25 bp, Mus musculus
agcgcctacacttcccaggatgcga

SEQ ID NO: 235785 - DNA, 25 bp, Mus musculus
tttgtagtccgcacgtccaactgcg

SEQ ID NO: 235786 - DNA, 25 bp, Mus musculus
gtcgccgcagtcctaaccgtagaga

SEQ ID NO: 235787 - DNA, 25 bp, Mus musculus
ggaacacacagcctgccgggatttg

SEQ ID NO: 235788 - DNA, 25 bp, Mus musculus
gagcccgaagcgaaatcagatcagc

SEQ ID NO: 235789 - DNA, 25 bp, Mus musculus
gcccagcctctctttgttcctcctg

SEQ ID NO: 235790 - DNA, 25 bp, Mus musculus
caactccctaaccattggctagagg

SEQ ID NO: 235791 - DNA, 25 bp, Mus musculus
ctagagggcgggttcttgctgttca

SEQ ID NO: 235792 - DNA, 25 bp, Mus musculus
tcgcaccggcggtgtctgggctcca

SEQ ID NO: 235793 - DNA, 25 bp, Mus musculus
tctgggctccaggtcccgactgaga

SEQ ID NO: 235794 - DNA, 25 bp, Mus musculus
cccgactgagagatcgctgagctgc

SEQ ID NO: 235795 - DNA, 25 bp, Mus musculus
cccgggctccattgttgaggcagcg

SEQ ID NO: 235796 - DNA, 25 bp, Mus musculus
ccattgttgaggcagcgggcgctcc

SEQ ID NO: 235797 - DNA, 25 bp, Mus musculus
cgtccagtgctcacgagccactgaa

SEQ ID NO: 235798 - DNA, 25 bp, Mus musculus
cacgagccactgaatcctgaggtga

SEQ ID NO: 235799 - DNA, 25 bp, Mus musculus
cggcggcgactttgaacccgtagcg

SEQ ID NO: 235800 - DNA, 25 bp, Mus musculus
ggccaggtgtcccacgatgtcctcg

SEQ ID NO: 235801 - DNA, 25 bp, Mus musculus
atcagatcagcgcagagtcccgggt

SEQ ID NO: 235802 - DNA, 25 bp, Mus musculus
tgggcttgcatttcccaaacctgtg

SEQ ID NO: 235803 - DNA, 25 bp, Mus musculus
cccgtttgatgttcgtgtcctatta

SEQ ID NO: 235804 - DNA, 25 bp, Mus musculus
ccttctcagtgtggcttgatggaca

SEQ ID NO: 235805 - DNA, 25 bp, Mus musculus
ctgccggaagttgcagccagccttt

SEQ ID NO: 235806 - DNA, 25 bp, Mus musculus
ctgggaaactgaccctcggtgctgc

SEQ ID NO: 235807 - DNA, 25 bp, Mus musculus
tcaaagcctcgaggcgctagccatg

SEQ ID NO: 235808 - DNA, 25 bp, Mus musculus
tccggaagtgacgtcctcaaagcct

SEQ ID NO: 235809 - DNA, 25 bp, Mus musculus
ccaatcttttcagagcggggccgaa

SEQ ID NO: 235810 - DNA, 25 bp, Mus musculus
ggatgcaactgctggccaatctttt

SEQ ID NO: 235811 - DNA, 25 bp, Mus musculus
cctggcagtaattggaaccgcgtta

SEQ ID NO: 235812 - DNA, 25 bp, Mus musculus
tgcggacccgaacctggcagtaatt

SEQ ID NO: 235813 - DNA, 25 bp, Mus musculus
cgtgctcatacgcaatgtgtcgatg

SEQ ID NO: 235814 - DNA, 25 bp, Mus musculus
cgcttccctggtagtgctgagctac

SEQ ID NO: 235815 - DNA, 25 bp, Mus musculus
tcctattagggaacaagcccggctg

SEQ ID NO: 235816 - DNA, 25 bp, Mus musculus
tgtccagtgtaccatcgcctggttg

SEQ ID NO: 235817 - DNA, 25 bp, Mus musculus
aagaatgcccagcagagtgaccgcg

SEQ ID NO: 235818 - DNA, 25 bp, Mus musculus
tctccctgggtatcccgaggtgtcc

SEQ ID NO: 235819 - DNA, 25 bp, Mus musculus
cggaggtcacttacgctgctgttct

SEQ ID NO: 235820 - DNA, 25 bp, Mus musculus
ctgctgttctctcctgtccagtgta

SEQ ID NO: 235821 - DNA, 25 bp, Mus musculus
gtcgcgtctcccttgagcacgaacg

SEQ ID NO: 235822 - DNA, 25 bp, Mus musculus
gacgctgggttctgattctcgtgcc

SEQ ID NO: 235823 - DNA, 25 bp, Mus musculus
ctcgtgcctgtggatctttgcgatc

SEQ ID NO: 235824 - DNA, 25 bp, Mus musculus
gatctttgcgatcgccggactccgt

SEQ ID NO: 235825 - DNA, 25 bp, Mus musculus
gcgggcagcagcctagtgatctgca

SEQ ID NO: 235826 - DNA, 25 bp, Mus musculus
tagtgatctgcacaccgggaccctg

SEQ ID NO: 235827 - DNA, 25 bp, Mus musculus
ctgaaagctccggtccggcgcagta

SEQ ID NO: 235828 - DNA, 25 bp, Mus musculus
cccaagtagccaagaatgcccagca

SEQ ID NO: 235829 - DNA, 25 bp, Mus musculus
acgacgtgctgatgagcgagacctg

SEQ ID NO: 235830 - DNA, 25 bp, Mus musculus
gtgcggcttttagagggtcctccag

SEQ ID NO: 235831 - DNA, 25 bp, Mus musculus
ccagcctgtagctaagtggcttcta

SEQ ID NO: 235832 - DNA, 25 bp, Mus musculus
gcttcgggcgccagcctgtagctaa

SEQ ID NO: 235833 - DNA, 25 bp, Mus musculus
ctgcattgtgcctggcgagcgcttc

SEQ ID NO: 235834 - DNA, 25 bp, Mus musculus
ctcagtgctgcattgtgcctggcga

SEQ ID NO: 235835 - DNA, 25 bp, Mus musculus
tccgtggcctcagtgctgcattgtg

SEQ ID NO: 235836 - DNA, 25 bp, Mus musculus
ttcccagctcgagccgctaccgcag

SEQ ID NO: 235837 - DNA, 25 bp, Mus musculus
cgctcagctgctcttgcccgggcct

SEQ ID NO: 235838 - DNA, 25 bp, Mus musculus
agacgcagagcagccagaaggacgc

SEQ ID NO: 235839 - DNA, 25 bp, Mus musculus
cccaagacgcagagcagccagaagg

SEQ ID NO: 235840 - DNA, 25 bp, Mus musculus
aaatgcgaacttacctgcccgaccg

SEQ ID NO: 235841 - DNA, 25 bp, Mus musculus
agagtcctggaaaccccggcaaatg

SEQ ID NO: 235842 - DNA, 25 bp, Mus musculus
gctaagtggcttctagcgcctccca

SEQ ID NO: 235843 - DNA, 25 bp, Mus musculus
ttttagagggtcctccaggctccaa

SEQ ID NO: 235844 - DNA, 25 bp, Mus musculus
gacacaacgcgcttgcggcatagta

SEQ ID NO: 235845 - DNA, 25 bp, Mus musculus
ctgtcgttcaggtaagagagcttca

SEQ ID NO: 235846 - DNA, 25 bp, Mus musculus
gcggtcacggattagctaaaaagca

SEQ ID NO: 235847 - DNA, 25 bp, Mus musculus
gtccatcagaacaacagcggtcacg

SEQ ID NO: 235848 - DNA, 25 bp, Mus musculus
ccgtcatgactcgtaattattggtg

SEQ ID NO: 235849 - DNA, 25 bp, Mus musculus
agcaccagtcacttggcacgagttc

SEQ ID NO: 235850 - DNA, 25 bp, Mus musculus
gcatagtagagatggggtccgtccc

SEQ ID NO: 235851 - DNA, 25 bp, Mus musculus
gagagcttcactcctctgcgtcggc

SEQ ID NO: 235852 - DNA, 25 bp, Mus musculus
ggtgcccgtgcaccctgaagtcaca

SEQ ID NO: 235853 - DNA, 25 bp, Mus musculus
tgaagtcacatcctcaccatcgagt

SEQ ID NO: 235854 - DNA, 25 bp, Mus musculus
gtgcctgttctcaacgcgcggctgt

SEQ ID NO: 235855 - DNA, 25 bp, Mus musculus
tcctggtgtttactgtgcggcactg

SEQ ID NO: 235856 - DNA, 25 bp, Mus musculus
actgcgcgaactgggctcaagagac

SEQ ID NO: 235857 - DNA, 25 bp, Mus musculus
ccgcagaaggtagcaggagcctaaa

SEQ ID NO: 235858 - DNA, 25 bp, Mus musculus
ctctcgcggacagccgagtctttgc

SEQ ID NO: 235859 - DNA, 25 bp, Mus musculus
gtcgctcgagatcaaggttagctcc

SEQ ID NO: 235860 - DNA, 25 bp, Mus musculus
ggcacagctcgatgtcctggcactc

SEQ ID NO: 235861 - DNA, 25 bp, Mus musculus
gttagctccgaacctctgactccgg

SEQ ID NO: 235862 - DNA, 25 bp, Mus musculus
agtgtgaatcgtccgccgtctacca

SEQ ID NO: 235863 - DNA, 25 bp, Mus musculus
tggacagccactacggggacatcga

SEQ ID NO: 235864 - DNA, 25 bp, Mus musculus
gcgggtcgaaaatggacagccacta

SEQ ID NO: 235865 - DNA, 25 bp, Mus musculus
cccgggaaacctaacagcaggcatc

SEQ ID NO: 235866 - DNA, 25 bp, Mus musculus
cttcattggcctaatattgccggga

SEQ ID NO: 235867 - DNA, 25 bp, Mus musculus
tcacctgttcgcagatcttcattgg

SEQ ID NO: 235868 - DNA, 25 bp, Mus musculus
cctctcgggaaccagcgtccaatta

SEQ ID NO: 235869 - DNA, 25 bp, Mus musculus
cctcggccaagcagtacacgcagta

SEQ ID NO: 235870 - DNA, 25 bp, Mus musculus
cgtctaccagctggtagccgtggta

SEQ ID NO: 235871 - DNA, 25 bp, Mus musculus
tgactccggccaaccctgtagagca

SEQ ID NO: 235872 - DNA, 25 bp, Mus musculus
tgcactcgggctcacatgcacacag

SEQ ID NO: 235873 - DNA, 25 bp, Mus musculus
ggcaggacactcaatcgctcacaga

SEQ ID NO: 235874 - DNA, 25 bp, Mus musculus
tggccggaacggcaggacactcaat

SEQ ID NO: 235875 - DNA, 25 bp, Mus musculus
gatctacacgcagctccacactggg

SEQ ID NO: 235876 - DNA, 25 bp, Mus musculus
tgcctctggaccacggatctacacg

SEQ ID NO: 235877 - DNA, 25 bp, Mus musculus
tgagtggaggccagcctcgctcctg

SEQ ID NO: 235878 - DNA, 25 bp, Mus musculus
ctccatgcccagtgagtggaggcca

SEQ ID NO: 235879 - DNA, 25 bp, Mus musculus
gccggcggctccatgcccagtgagt

SEQ ID NO: 235880 - DNA, 25 bp, Mus musculus
caccatgaacgccaggcctcagagg

SEQ ID NO: 235881 - DNA, 25 bp, Mus musculus
taagactcaccatgaacgccaggcc

SEQ ID NO: 235882 - DNA, 25 bp, Mus musculus
gcagacccgcataagactcaccatg

SEQ ID NO: 235883 - DNA, 25 bp, Mus musculus
ccaagctgggatggcagacccgcat

SEQ ID NO: 235884 - DNA, 25 bp, Mus musculus
tcgctcacagatgcagcgattcccg

SEQ ID NO: 235885 - DNA, 25 bp, Mus musculus
cctggaagggcaggccgagacacta

SEQ ID NO: 235886 - DNA, 25 bp, Mus musculus
cacgtcgcgacaagcgctggccgag

SEQ ID NO: 235887 - DNA, 25 bp, Mus musculus
gggcccgcaactcgctgggctaaga

SEQ ID NO: 235888 - DNA, 25 bp, Mus musculus
agagcgtagactccgcagatgccca

SEQ ID NO: 235889 - DNA, 25 bp, Mus musculus
agcctcagcaggtgcttgccggccg

SEQ ID NO: 235890 - DNA, 25 bp, Mus musculus
gcggctaaaagcagccagcgccaga

SEQ ID NO: 235891 - DNA, 25 bp, Mus musculus
cgccgcagctccgtagagcttagga

SEQ ID NO: 235892 - DNA, 25 bp, Mus musculus
ccgtagagcttaggagcctgctatt

SEQ ID NO: 235893 - DNA, 25 bp, Mus musculus
ggagcctgctatttactaccgctgc

SEQ ID NO: 235894 - DNA, 25 bp, Mus musculus
tgccaagtatccgtcctgggtttcg

SEQ ID NO: 235895 - DNA, 25 bp, Mus musculus
agttgtgtccctggcccttttctgt

SEQ ID NO: 235896 - DNA, 25 bp, Mus musculus
agttccgagagagtcacagtgtcca

SEQ ID NO: 235897 - DNA, 25 bp, Mus musculus
acagtgtccataccggcaccgcaga

SEQ ID NO: 235898 - DNA, 25 bp, Mus musculus
gaaagcagcgcatggggctgatcca

SEQ ID NO: 235899 - DNA, 25 bp, Mus musculus
gtggcagcggtcagccatccgcaac

SEQ ID NO: 235900 - DNA, 25 bp, Mus musculus
gaggatccgaggctttgaagcttta

SEQ ID NO: 235901 - DNA, 25 bp, Mus musculus
cccgaccgccgaaggacaaagctga

SEQ ID NO: 235902 - DNA, 25 bp, Mus musculus
gcctacctgccaaggctaccgggtg

SEQ ID NO: 235903 - DNA, 25 bp, Mus musculus
cctggcctgcgccttacgtaaagcg

SEQ ID NO: 235904 - DNA, 25 bp, Mus musculus
gctccgctgcgttacctggcaacag

SEQ ID NO: 235905 - DNA, 25 bp, Mus musculus
ccaggcgccgggattacatcagcgc

SEQ ID NO: 235906 - DNA, 25 bp, Mus musculus
cagcaggcgcgcaggactggattct

SEQ ID NO: 235907 - DNA, 25 bp, Mus musculus
ctgacaccacgaggccgacctgagg

SEQ ID NO: 235908 - DNA, 25 bp, Mus musculus
gctttgaagctttaccaggccctga

SEQ ID NO: 235909 - DNA, 25 bp, Mus musculus
taccaggccctgagagagggctcct

SEQ ID NO: 235910 - DNA, 25 bp, Mus musculus
tgacctcccgctgggtcactgagac

SEQ ID NO: 235911 - DNA, 25 bp, Mus musculus
actgagacccggctttgcagagccc

SEQ ID NO: 235912 - DNA, 25 bp, Mus musculus
tttgcagagcccttccaacacaaac

SEQ ID NO: 235913 - DNA, 25 bp, Mus musculus
ctggggtcctgaagatcctgacacc

SEQ ID NO: 235914 - DNA, 25 bp, Mus musculus
catctcggccgccttagcgtggatc

SEQ ID NO: 235915 - DNA, 25 bp, Mus musculus
agtcctcatgcggtggaggcgcaca

SEQ ID NO: 235916 - DNA, 25 bp, Mus musculus
ggtctgtcaccgcagccagggaagt

SEQ ID NO: 235917 - DNA, 25 bp, Mus musculus
ccgaaacaggactggcggctcgtac

SEQ ID NO: 235918 - DNA, 25 bp, Mus musculus
ctgatggtatgcagcagcctccgga

SEQ ID NO: 235919 - DNA, 25 bp, Mus musculus
tgcttccggcgcctcctaaagacgt

SEQ ID NO: 235920 - DNA, 25 bp, Mus musculus
cgatccggccgtagatgcgcctcat

SEQ ID NO: 235921 - DNA, 25 bp, Mus musculus
ggatcatgtccagcatgcccacgaa

SEQ ID NO: 235922 - DNA, 25 bp, Mus musculus
acacgctcagagctgcggtctgtca

SEQ ID NO: 235923 - DNA, 25 bp, Mus musculus
cgttacggtctgagatgcctgcttc

SEQ ID NO: 235924 - DNA, 25 bp, Mus musculus
ttccggtgctgagcgattgcgttac

SEQ ID NO: 235925 - DNA, 25 bp, Mus musculus
gacctctcgagacagggttccgacg

SEQ ID NO: 235926 - DNA, 25 bp, Mus musculus
ggcctcctcggtagagacctctcga

SEQ ID NO: 235927 - DNA, 25 bp, Mus musculus
cgcacgaaggcctccagcttgtcga

SEQ ID NO: 235928 - DNA, 25 bp, Mus musculus
ggcgagcgacgaacaaaatggagtc

SEQ ID NO: 235929 - DNA, 25 bp, Mus musculus
ctgacattaggtcggcctccctttc

SEQ ID NO: 235930 - DNA, 25 bp, Mus musculus
tgcggccgcgcgctgacattaggtc

SEQ ID NO: 235931 - DNA, 25 bp, Mus musculus
ccctctttacggccgcgctgaaagg

SEQ ID NO: 235932 - DNA, 25 bp, Mus musculus
tcaaccagcgctcggcgctttgcga

SEQ ID NO: 235933 - DNA, 25 bp, Mus musculus
ggagtctcaaccgtcaaccagcgct

SEQ ID NO: 235934 - DNA, 25 bp, Mus musculus
aatggagtctcaaccgtcaaccagc

SEQ ID NO: 235935 - DNA, 25 bp, Mus musculus
ccgccgacgatttgctattactcct

SEQ ID NO: 235936 - DNA, 25 bp, Mus musculus
cgacgatttgctattactccttccc

SEQ ID NO: 235937 - DNA, 25 bp, Mus musculus
ggcctagtttactcccgaggcgaca

SEQ ID NO: 235938 - DNA, 25 bp, Mus musculus
gtttactcccgaggcgacaagccag

SEQ ID NO: 235939 - DNA, 25 bp, Mus musculus
agccacggagacgagtgactgccga

SEQ ID NO: 235940 - DNA, 25 bp, Mus musculus
ccacggagacgagtgactgccgagc

SEQ ID NO: 235941 - DNA, 25 bp, Mus musculus
cgctgacattaggtcggcctccctt

SEQ ID NO: 235942 - DNA, 25 bp, Mus musculus
ggctgagctgcccgcggccacaaca

SEQ ID NO: 235943 - DNA, 25 bp, Mus musculus
ggccacaacagcaacagctggccga

SEQ ID NO: 235944 - DNA, 25 bp, Mus musculus
cacaacagcaacagctggccgagta

SEQ ID NO: 235945 - DNA, 25 bp, Mus musculus
caacagcaacagctggccgagtagc

SEQ ID NO: 235946 - DNA, 25 bp, Mus musculus
acagcaacagctggccgagtagcgg

SEQ ID NO: 235947 - DNA, 25 bp, Mus musculus
caacagctggccgagtagcggcagc

SEQ ID NO: 235948 - DNA, 25 bp, Mus musculus
acagctggccgagtagcggcagcca

SEQ ID NO: 235949 - DNA, 25 bp, Mus musculus
gtcctgggtagagcggtccacttcc

SEQ ID NO: 235950 - DNA, 25 bp, Mus musculus
ccgcctgtcggcaggaatgcgcgag

SEQ ID NO: 235951 - DNA, 25 bp, Mus musculus
aatgcgcgagcgctgccagccacgg

SEQ ID NO: 235952 - DNA, 25 bp, Mus musculus
cagccacgggcagggcacgagcttt

SEQ ID NO: 235953 - DNA, 25 bp, Mus musculus
cacgagctttgtgtggtacggcgcc

SEQ ID NO: 235954 - DNA, 25 bp, Mus musculus
acgagctttgtgtggtacggcgccc

SEQ ID NO: 235955 - DNA, 25 bp, Mus musculus
ctttgtgtggtacggcgccccttgt

SEQ ID NO: 235956 - DNA, 25 bp, Mus musculus
ttggcagcccgcctagcgcctgagg

SEQ ID NO: 235957 - DNA, 25 bp, Mus musculus
gcctgcgcagcacagtggacggcct

SEQ ID NO: 235958 - DNA, 25 bp, Mus musculus
cgcagcacagtggacggcctgagac

SEQ ID NO: 235959 - DNA, 25 bp, Mus musculus
ggctccaactctgagcaggctgtca

SEQ ID NO: 235960 - DNA, 25 bp, Mus musculus
agcaggctgtcagcttgacgggtcc

SEQ ID NO: 235961 - DNA, 25 bp, Mus musculus
tgacgggtccgcctctctgagatcc

SEQ ID NO: 235962 - DNA, 25 bp, Mus musculus
tgagatccgctctgcacaccgcgtt

SEQ ID NO: 235963 - DNA, 25 bp, Mus musculus
gcacaccgcgttgccatgacaactg

SEQ ID NO: 235964 - DNA, 25 bp, Mus musculus
gttgccatgacaactggctcgccga

SEQ ID NO: 235965 - DNA, 25 bp, Mus musculus
tgacaactggctcgccgaggcagcg

SEQ ID NO: 235966 - DNA, 25 bp, Mus musculus
agcggcgtcgtacgttcgagtccca

SEQ ID NO: 235967 - DNA, 25 bp, Mus musculus
gtacgttcgagtcccagctgcggct

SEQ ID NO: 235968 - DNA, 25 bp, Mus musculus
ccgacacgcgcctgcttttggcagc

SEQ ID NO: 235969 - DNA, 25 bp, Mus musculus
ctccgctgcttgtggtgtcgcttga

SEQ ID NO: 235970 - DNA, 25 bp, Mus musculus
gtaacgtacgtgttgtctgagaccc

SEQ ID NO: 235971 - DNA, 25 bp, Mus musculus
ttaaccacagcttcctgcgggacca

SEQ ID NO: 235972 - DNA, 25 bp, Mus musculus
gcaccgaatgccctccgaaggtttg

SEQ ID NO: 235973 - DNA, 25 bp, Mus musculus
tggatcgggccctgactatcattta

SEQ ID NO: 235974 - DNA, 25 bp, Mus musculus
ctgcagcagatctggcgtggaaatc

SEQ ID NO: 235975 - DNA, 25 bp, Mus musculus
aatccttcatttgccctttcagcgg

SEQ ID NO: 235976 - DNA, 25 bp, Mus musculus
ctagattgcccactccctggagagg

SEQ ID NO: 235977 - DNA, 25 bp, Mus musculus
ggagctactgttttattcctaggta

SEQ ID NO: 235978 - DNA, 25 bp, Mus musculus
gctgggccagaccttcatggttttc

SEQ ID NO: 235979 - DNA, 25 bp, Mus musculus
ggggcatcctacctcaaacaggttc

SEQ ID NO: 235980 - DNA, 25 bp, Mus musculus
cctttgctaatgtgacggtaacttc

SEQ ID NO: 235981 - DNA, 25 bp, Mus musculus
gggagtaccagacctagccacagta

SEQ ID NO: 235982 - DNA, 25 bp, Mus musculus
tccattgccagatcctctagggttc

SEQ ID NO: 235983 - DNA, 25 bp, Mus musculus
ccttcaatgggcgaggacacggaca

SEQ ID NO: 235984 - DNA, 25 bp, Mus musculus
caggtgacagctgcgtcatgcagtt

SEQ ID NO: 235985 - DNA, 25 bp, Mus musculus
cggacgctcctcaggcggcagacag

SEQ ID NO: 235986 - DNA, 25 bp, Mus musculus
agtcgaaggcaaacttgagggcacc

SEQ ID NO: 235987 - DNA, 25 bp, Mus musculus
ttgagggcaccgtgcactgtgctac

SEQ ID NO: 235988 - DNA, 25 bp, Mus musculus
ctgttcgatcttcacgtgcctccgg

SEQ ID NO: 235989 - DNA, 25 bp, Mus musculus
tcatgcagttgaggcagctgatggc

SEQ ID NO: 235990 - DNA, 25 bp, Mus musculus
gccttgagctcgaagacgggccact

SEQ ID NO: 235991 - DNA, 25 bp, Mus musculus
gaagacgggccacttgctacccagg

SEQ ID NO: 235992 - DNA, 25 bp, Mus musculus
ccctcgaggatggtgctgaactcta

SEQ ID NO: 235993 - DNA, 25 bp, Mus musculus
cgcaggttcagcagcacgtccttga

SEQ ID NO: 235994 - DNA, 25 bp, Mus musculus
cacgtccttgaactcgctgctggca

SEQ ID NO: 235995 - DNA, 25 bp, Mus musculus
tgctggcacggagaacaatgtcctt

SEQ ID NO: 235996 - DNA, 25 bp, Mus musculus
caatgtccttggtgatgtcgtcctc

SEQ ID NO: 235997 - DNA, 25 bp, Mus musculus
tgtgctacgccagtcctgttcgatc

SEQ ID NO: 235998 - DNA, 25 bp, Mus musculus
aggtactccagttaaccctgtgtgg

SEQ ID NO: 235999 - DNA, 25 bp, Mus musculus
aggccctccgcaggaagactctcta

SEQ ID NO: 236000 - DNA, 25 bp, Mus musculus
acccgcgcattgtctgaagcctgca

SEQ ID NO: 236001 - DNA, 25 bp, Mus musculus
ccatacccgggagaggtgctttgct

SEQ ID NO: 236002 - DNA, 25 bp, Mus musculus
ctttgctgtggatcctcatggtctc

SEQ ID NO: 236003 - DNA, 25 bp, Mus musculus
gtctcgaggttcatggcagccacca

SEQ ID NO: 236004 - DNA, 25 bp, Mus musculus
caggcacctacatgctgggtccgca

SEQ ID NO: 236005 - DNA, 25 bp, Mus musculus
ggccgcgaacacaaagctcccaggg

SEQ ID NO: 236006 - DNA, 25 bp, Mus musculus
caggaagaggctgtagctcagaccc

SEQ ID NO: 236007 - DNA, 25 bp, Mus musculus
gagccgcggcggttaaagatttgaa

SEQ ID NO: 236008 - DNA, 25 bp, Mus musculus
ggctccgctctgcatacttggagtg

SEQ ID NO: 236009 - DNA, 25 bp, Mus musculus
aggcttcacctcgtggtcgacatca

SEQ ID NO: 236010 - DNA, 25 bp, Mus musculus
cgacatcacctgctaggctggctga

SEQ ID NO: 236011 - DNA, 25 bp, Mus musculus
tagaaccctccgtggaaccagccag

SEQ ID NO: 236012 - DNA, 25 bp, Mus musculus
ggcccacagcttaagtttccgagtg

SEQ ID NO: 236013 - DNA, 25 bp, Mus musculus
gcacttcgtgccaggcgccctaatt

SEQ ID NO: 236014 - DNA, 25 bp, Mus musculus
actgactaaggtcgcgcacttcgtg

SEQ ID NO: 236015 - DNA, 25 bp, Mus musculus
tcttcagacttcagaccggctatta

SEQ ID NO: 236016 - DNA, 25 bp, Mus musculus
aggaacaagtctcgcgccacctttg

SEQ ID NO: 236017 - DNA, 25 bp, Mus musculus
gagtcctggcctccaacttctagca

SEQ ID NO: 236018 - DNA, 25 bp, Mus musculus
cccaagcttgtaagcctgctgctta

SEQ ID NO: 236019 - DNA, 25 bp, Mus musculus
atggcacaacgaccctgaagaactt

SEQ ID NO: 236020 - DNA, 25 bp, Mus musculus
cgccttgcagcgacttgctctcttg

SEQ ID NO: 236021 - DNA, 25 bp, Mus musculus
aatcactatgtgctgtcgcgaatca

SEQ ID NO: 236022 - DNA, 25 bp, Mus musculus
gccggcaagcctgccaatcactatg

SEQ ID NO: 236023 - DNA, 25 bp, Mus musculus
cccagggagactcggctcgttaagt

SEQ ID NO: 236024 - DNA, 25 bp, Mus musculus
ctgaagaacttaccggccgcagtgc

SEQ ID NO: 236025 - DNA, 25 bp, Mus musculus
ctgctgcttaacaggtggttggacc

SEQ ID NO: 236026 - DNA, 25 bp, Mus musculus
cccgttccagtcctgagggtctctg

SEQ ID NO: 236027 - DNA, 25 bp, Mus musculus
tgactggcgggagaaaacaccaatc

SEQ ID NO: 236028 - DNA, 25 bp, Mus musculus
ctgttctatctcgtccattttaagg

SEQ ID NO: 236029 - DNA, 25 bp, Mus musculus
acccagtgggtgaaccctgcaacga

SEQ ID NO: 236030 - DNA, 25 bp, Mus musculus
tgcaacgaggacaccgctacctttg

SEQ ID NO: 236031 - DNA, 25 bp, Mus musculus
aacactggcccgttgcttccctgtg

SEQ ID NO: 236032 - DNA, 25 bp, Mus musculus
tgtgtcgctcacaccacatcgcttt

SEQ ID NO: 236033 - DNA, 25 bp, Mus musculus
agcctcctcggctacggtccaggtt

SEQ ID NO: 236034 - DNA, 25 bp, Mus musculus
atcagctccatggtgctgcccggtt

SEQ ID NO: 236035 - DNA, 25 bp, Mus musculus
ctctgcctaggtggagcccagagta

SEQ ID NO: 236036 - DNA, 25 bp, Mus musculus
agcccagagtatgtaggggtgaccc

SEQ ID NO: 236037 - DNA, 25 bp, Mus musculus
ggaggccgccctggtgatatcccac

SEQ ID NO: 236038 - DNA, 25 bp, Mus musculus
aaggctggtatccaccctgtgcccg

SEQ ID NO: 236039 - DNA, 25 bp, Mus musculus
gtctcgtccttacatcccggagtga

SEQ ID NO: 236040 - DNA, 25 bp, Mus musculus
cgcaggacctttgatggcgagcgcc

SEQ ID NO: 236041 - DNA, 25 bp, Mus musculus
tctcggaactcaaggccaagctgca

SEQ ID NO: 236042 - DNA, 25 bp, Mus musculus
aagacgaaggaactgcaggcgctgc

SEQ ID NO: 236043 - DNA, 25 bp, Mus musculus
cgcggaccgccaagatcaaggaagg

SEQ ID NO: 236044 - DNA, 25 bp, Mus musculus
aggccacgctgaatgtgctgcgcga

SEQ ID NO: 236045 - DNA, 25 bp, Mus musculus
tcaagactgcattgctggccgacgc

SEQ ID NO: 236046 - DNA, 25 bp, Mus musculus
cgcaaacaggcggaagaggcactca

SEQ ID NO: 236047 - DNA, 25 bp, Mus musculus
catcaagcgggagtgcgaacgtgac

SEQ ID NO: 236048 - DNA, 25 bp, Mus musculus
cgctgcgtaccaggcgcaccaggat

SEQ ID NO: 236049 - DNA, 25 bp, Mus musculus
agacaaggccaaagccgccgacctg

SEQ ID NO: 236050 - DNA, 25 bp, Mus musculus
ggcactcagtaactgcatgcaggca

SEQ ID NO: 236051 - DNA, 25 bp, Mus musculus
cgaacgtgacatccgcagactggta

SEQ ID NO: 236052 - DNA, 25 bp, Mus musculus
tggcgccgcagacaaagtcaagact

SEQ ID NO: 236053 - DNA, 25 bp, Mus musculus
caccaggatgaggtgcaccgcatca

SEQ ID NO: 236054 - DNA, 25 bp, Mus musculus
ccgcagtttctagccggtcccttgg

SEQ ID NO: 236055 - DNA, 25 bp, Mus musculus
gggcctcctgctggctcagctgcag

SEQ ID NO: 236056 - DNA, 25 bp, Mus musculus
aggccgcggactcgtcgcccattat

SEQ ID NO: 236057 - DNA, 25 bp, Mus musculus
gggagctccggaccgcagtttctag

SEQ ID NO: 236058 - DNA, 25 bp, Mus musculus
tcaggctgcgggagcacagcgccac

SEQ ID NO: 236059 - DNA, 25 bp, Mus musculus
aactgcgctgctgcgtgtatgggct

SEQ ID NO: 236060 - DNA, 25 bp, Mus musculus
gcccatcaaaatcggcgcctgcggg

SEQ ID NO: 236061 - DNA, 25 bp, Mus musculus
gtcgcccattatggggagctccgga

SEQ ID NO: 236062 - DNA, 25 bp, Mus musculus
aaaatcggcgcctgcgggcccagct

SEQ ID NO: 236063 - DNA, 25 bp, Mus musculus
ctgacgttgtcggagattggcctgc

SEQ ID NO: 236064 - DNA, 25 bp, Mus musculus
gaggagctcgcccatcaaaatcggc

SEQ ID NO: 236065 - DNA, 25 bp, Mus musculus
ggtggaggagctcgcccatcaaaat

SEQ ID NO: 236066 - DNA, 25 bp, Mus musculus
agattggcctgcacagccaggtgga

SEQ ID NO: 236067 - DNA, 25 bp, Mus musculus
ttgtcggagattggcctgcacagcc

SEQ ID NO: 236068 - DNA, 25 bp, Mus musculus
gggcgcctacgagaacaagaccatc

SEQ ID NO: 236069 - DNA, 25 bp, Mus musculus
cgctggtcttggtcaccgtaggctc

SEQ ID NO: 236070 - DNA, 25 bp, Mus musculus
atcgcgatgacagaccgccagcgtt

SEQ ID NO: 236071 - DNA, 25 bp, Mus musculus
ctgctgtcagttcgccaggcgatcg

SEQ ID NO: 236072 - DNA, 25 bp, Mus musculus
cgagccctcgggctctgctgtcagt

SEQ ID NO: 236073 - DNA, 25 bp, Mus musculus
acacggccagtgatgtgagcgagcc

SEQ ID NO: 236074 - DNA, 25 bp, Mus musculus
acttcgacgcctacagcgtgggccg

SEQ ID NO: 236075 - DNA, 25 bp, Mus musculus
gccagcgttgcgcatccgatgtcct

SEQ ID NO: 236076 - DNA, 25 bp, Mus musculus
tatgtgtgttgtgcacccgcgcacc

SEQ ID NO: 236077 - DNA, 25 bp, Mus musculus
gccctgcgctccttctagaggcgga

SEQ ID NO: 236078 - DNA, 25 bp, Mus musculus
ccacggtcctttgtagctggcagtg

SEQ ID NO: 236079 - DNA, 25 bp, Mus musculus
cgtggaacacggaggacgacctgcc

SEQ ID NO: 236080 - DNA, 25 bp, Mus musculus
gcgccagaagtacggcggcatgttc

SEQ ID NO: 236081 - DNA, 25 bp, Mus musculus
acaatggccaggtaccctcggggca

SEQ ID NO: 236082 - DNA, 25 bp, Mus musculus
tggtcgccatcagggtccagaccca

SEQ ID NO: 236083 - DNA, 25 bp, Mus musculus
aagcgcttcctggttcgagccgaaa

SEQ ID NO: 236084 - DNA, 25 bp, Mus musculus
ggagccgagcttctgtcctttcttt

SEQ ID NO: 236085 - DNA, 25 bp, Mus musculus
agcgccaggcagacgttagttccag

SEQ ID NO: 236086 - DNA, 25 bp, Mus musculus
aggcagacgttagttccagcggccg

SEQ ID NO: 236087 - DNA, 25 bp, Mus musculus
gggccatgtctcatcaggggaagaa

SEQ ID NO: 236088 - DNA, 25 bp, Mus musculus
ctcatcaggggaagaagagcatccc

SEQ ID NO: 236089 - DNA, 25 bp, Mus musculus
agagcatcccgcacatcaccgtaag

SEQ ID NO: 236090 - DNA, 25 bp, Mus musculus
accctgccgcagtgctttgtggctt

SEQ ID NO: 236091 - DNA, 25 bp, Mus musculus
ccggaggattcctgcgtcgccgcga

SEQ ID NO: 236092 - DNA, 25 bp, Mus musculus
ggggctggagtatccagtccctctc

SEQ ID NO: 236093 - DNA, 25 bp, Mus musculus
agtccctctctctgcgggcgtgaag

SEQ ID NO: 236094 - DNA, 25 bp, Mus musculus
tccctcctcaggatgtgccgggagg

SEQ ID NO: 236095 - DNA, 25 bp, Mus musculus
ccggaggatgcggagctgaacaaaa

SEQ ID NO: 236096 - DNA, 25 bp, Mus musculus
agccacaagccaaggcctaggccga

SEQ ID NO: 236097 - DNA, 25 bp, Mus musculus
tccctacagtgcactgagcatgcgc

SEQ ID NO: 236098 - DNA, 25 bp, Mus musculus
caaactttcagcctttccgggccat

SEQ ID NO: 236099 - DNA, 25 bp, Mus musculus
gctcaggcgggtgacccgctgcatc

SEQ ID NO: 236100 - DNA, 25 bp, Mus musculus
tctttagtgcaggtcatggagggct

SEQ ID NO: 236101 - DNA, 25 bp, Mus musculus
gctgcagccgcgcatctttagtgca

SEQ ID NO: 236102 - DNA, 25 bp, Mus musculus
ctaggccgagaacgccacccagtag

SEQ ID NO: 236103 - DNA, 25 bp, Mus musculus
agtggctcgcgcgacagccaagcca

SEQ ID NO: 236104 - DNA, 25 bp, Mus musculus
cgcaatcgcaatcgcagtcaggaga

SEQ ID NO: 236105 - DNA, 25 bp, Mus musculus
tcgcagtcaggagacgcaaagctgg

SEQ ID NO: 236106 - DNA, 25 bp, Mus musculus
ttcagggaatgcagcccaggactcc

SEQ ID NO: 236107 - DNA, 25 bp, Mus musculus
aagaggagggcgctcgatcctcccg

SEQ ID NO: 236108 - DNA, 25 bp, Mus musculus
cggctgcgctggaacccacctggag

SEQ ID NO: 236109 - DNA, 25 bp, Mus musculus
ccacctggagccgtgcgcgcaagtg

SEQ ID NO: 236110 - DNA, 25 bp, Mus musculus
atggccacaagacaagctcggttcg

SEQ ID NO: 236111 - DNA, 25 bp, Mus musculus
ccctttgtaggtgtatgtgagcgtt

SEQ ID NO: 236112 - DNA, 25 bp, Mus musculus
gctcggttcgcttgctccacactaa

SEQ ID NO: 236113 - DNA, 25 bp, Mus musculus
tcgcagccctcttcttcctaaatag

SEQ ID NO: 236114 - DNA, 25 bp, Mus musculus
tcctaaatagtcaacgtcggtgtcc

SEQ ID NO: 236115 - DNA, 25 bp, Mus musculus
tcgcgaggccgaacaatgattcatg

SEQ ID NO: 236116 - DNA, 25 bp, Mus musculus
tggctgaaagccacggagcactctg

SEQ ID NO: 236117 - DNA, 25 bp, Mus musculus
cccggaaacgagagcccgcactatg

SEQ ID NO: 236118 - DNA, 25 bp, Mus musculus
ccgcactatgcactcgtcagggcta

SEQ ID NO: 236119 - DNA, 25 bp, Mus musculus
gctaaggccttctcggatctgtgga

SEQ ID NO: 236120 - DNA, 25 bp, Mus musculus
gatctgtggatcaaacccttcctgc

SEQ ID NO: 236121 - DNA, 25 bp, Mus musculus
ggagcttcttcccttaccgctctgg

SEQ ID NO: 236122 - DNA, 25 bp, Mus musculus
agcgacttcgcatctacaggggttc

SEQ ID NO: 236123 - DNA, 25 bp, Mus musculus
gctttaattgtgtgcggaccggccc

SEQ ID NO: 236124 - DNA, 25 bp, Mus musculus
gcttgcggcctccaaactccagatg

SEQ ID NO: 236125 - DNA, 25 bp, Mus musculus
caaactccagatgccagcgttccag

SEQ ID NO: 236126 - DNA, 25 bp, Mus musculus
cagcgttccagaaaactttccaggc

SEQ ID NO: 236127 - DNA, 25 bp, Mus musculus
cagaaaactttccaggcggttcgca

SEQ ID NO: 236128 - DNA, 25 bp, Mus musculus
gggtccggaagctccgcgactctgc

SEQ ID NO: 236129 - DNA, 25 bp, Mus musculus
ctccgcgactctgcggggcctgtgt

SEQ ID NO: 236130 - DNA, 25 bp, Mus musculus
gcctgtgtggggtctgtagccacca

SEQ ID NO: 236131 - DNA, 25 bp, Mus musculus
tgtgtggggtctgtagccaccagat

SEQ ID NO: 236132 - DNA, 25 bp, Mus musculus
tctgtagccaccagatgggggcgac

SEQ ID NO: 236133 - DNA, 25 bp, Mus musculus
gctggctgggaatatcctggccgct

SEQ ID NO: 236134 - DNA, 25 bp, Mus musculus
gctgggaatatcctggccgctgccc

SEQ ID NO: 236135 - DNA, 25 bp, Mus musculus
tggccgctgccctggtactgggctc

SEQ ID NO: 236136 - DNA, 25 bp, Mus musculus
agctccctcctacgcagcttgcggc

SEQ ID NO: 236137 - DNA, 25 bp, Mus musculus
tgccagcgttccagaaaactttcca

SEQ ID NO: 236138 - DNA, 25 bp, Mus musculus
cggggatcccgagctgtcgaacaga

SEQ ID NO: 236139 - DNA, 25 bp, Mus musculus
accagtcgggctcacctaggggcct

SEQ ID NO: 236140 - DNA, 25 bp, Mus musculus
acggtacgacgcctggtcttctgtg

SEQ ID NO: 236141 - DNA, 25 bp, Mus musculus
ctggtcttctgtgagtctcctgggc

SEQ ID NO: 236142 - DNA, 25 bp, Mus musculus
ggctgtccttccagaatcggctatc

SEQ ID NO: 236143 - DNA, 25 bp, Mus musculus
cagaatcggctatccgagccacgta

SEQ ID NO: 236144 - DNA, 25 bp, Mus musculus
cgagccacgtaacccagaaactagg

SEQ ID NO: 236145 - DNA, 25 bp, Mus musculus
aactaggcactctgaatgcgagccc

SEQ ID NO: 236146 - DNA, 25 bp, Mus musculus
cgaatagttgaaaggcggccgctgc

SEQ ID NO: 236147 - DNA, 25 bp, Mus musculus
cgggcgccagccgaatagttgaaag

SEQ ID NO: 236148 - DNA, 25 bp, Mus musculus
tcaggtgctcccgatggcttgaagg

SEQ ID NO: 236149 - DNA, 25 bp, Mus musculus
gtgcagaagaggagagtgaacattt

SEQ ID NO: 236150 - DNA, 25 bp, Mus musculus
cgcagacctgaaccagtcgggctca

SEQ ID NO: 236151 - DNA, 25 bp, Mus musculus
ctgtcgaacagagtgaagggatccc

SEQ ID NO: 236152 - DNA, 25 bp, Mus musculus
cgagctggagaattccgcgcgctcg

SEQ ID NO: 236153 - DNA, 25 bp, Mus musculus
gcctcctgcagtctcttggccttag

SEQ ID NO: 236154 - DNA, 25 bp, Mus musculus
tcctgcagtctcttggccttagcgc

SEQ ID NO: 236155 - DNA, 25 bp, Mus musculus
gcgcgctcggcaatagacaggtact

SEQ ID NO: 236156 - DNA, 25 bp, Mus musculus
gcaggaccgccaagaggaaaagaga

SEQ ID NO: 236157 - DNA, 25 bp, Mus musculus
ctcggcaatagacaggtactgcttc

SEQ ID NO: 236158 - DNA, 25 bp, Mus musculus
cagcaggcggcaacatgggtttcgc

SEQ ID NO: 236159 - DNA, 25 bp, Mus musculus
aggtactgcttctggcggaacttgc

SEQ ID NO: 236160 - DNA, 25 bp, Mus musculus
caacatgggtttcgcggccatcttc

SEQ ID NO: 236161 - DNA, 25 bp, Mus musculus
cactgtagagtgaggcgcccgcagc

SEQ ID NO: 236162 - DNA, 25 bp, Mus musculus
aattccgcgcgctcggcaatagaca

SEQ ID NO: 236163 - DNA, 25 bp, Mus musculus
ggtttcgcggccatcttcagcttct

SEQ ID NO: 236164 - DNA, 25 bp, Mus musculus
tgtagagtcccacgggcgctacagg

SEQ ID NO: 236165 - DNA, 25 bp, Mus musculus
caccgctgcaggaccgccaagagga

SEQ ID NO: 236166 - DNA, 25 bp, Mus musculus
cgtcattcttccagcagggcggagc

SEQ ID NO: 236167 - DNA, 25 bp, Mus musculus
ggcagcctccaagcgaggaccctga

SEQ ID NO: 236168 - DNA, 25 bp, Mus musculus
accctgagacgcgagggctagccca

SEQ ID NO: 236169 - DNA, 25 bp, Mus musculus
ttctctcaacgatggcagcccgccg

SEQ ID NO: 236170 - DNA, 25 bp, Mus musculus
accgcacgtcattcttccagcaggg

SEQ ID NO: 236171 - DNA, 25 bp, Mus musculus
ccctgcacctatgggaacaaggccg

SEQ ID NO: 236172 - DNA, 25 bp, Mus musculus
cctatgggaacaaggccgctacgga

SEQ ID NO: 236173 - DNA, 25 bp, Mus musculus
ccgctacggagagagccaatgacga

SEQ ID NO: 236174 - DNA, 25 bp, Mus musculus
cccaggagcttttaaagaggctcgc

SEQ ID NO: 236175 - DNA, 25 bp, Mus musculus
agcttttaaagaggctcgcttaagc

SEQ ID NO: 236176 - DNA, 25 bp, Mus musculus
gcctctgtcagaacgcgggtcggct

SEQ ID NO: 236177 - DNA, 25 bp, Mus musculus
tcggctcgtgcagcaccttggtgag

SEQ ID NO: 236178 - DNA, 25 bp, Mus musculus
cagtcagtcgggcaccggtacccag

SEQ ID NO: 236179 - DNA, 25 bp, Mus musculus
tccaagcgaggaccctgagacgcga

SEQ ID NO: 236180 - DNA, 25 bp, Mus musculus
catccacggggtccgatctagtttc

SEQ ID NO: 236181 - DNA, 25 bp, Mus musculus
cgcctagctaagtcaggtgggcatc

SEQ ID NO: 236182 - DNA, 25 bp, Mus musculus
ctggggagcttttccgcctagctaa

SEQ ID NO: 236183 - DNA, 25 bp, Mus musculus
agaaccattgggctgtgctcgtgcc

SEQ ID NO: 236184 - DNA, 25 bp, Mus musculus
ttgttaataaggcaaggccagcgtg

SEQ ID NO: 236185 - DNA, 25 bp, Mus musculus
cccagaaggccaactcgagcgagcg

SEQ ID NO: 236186 - DNA, 25 bp, Mus musculus
gcggagtcctccactttgacaccga

SEQ ID NO: 236187 - DNA, 25 bp, Mus musculus
caccgagtggcaaagaagtcatagc

SEQ ID NO: 236188 - DNA, 25 bp, Mus musculus
agtcctccgactgagaaatggccga

SEQ ID NO: 236189 - DNA, 25 bp, Mus musculus
catcttctggcagcttgaggagtcc

SEQ ID NO: 236190 - DNA, 25 bp, Mus musculus
ggctttcggccttcaccagagcatc

SEQ ID NO: 236191 - DNA, 25 bp, Mus musculus
gatctagtttctcggggctttcggc

SEQ ID NO: 236192 - DNA, 25 bp, Mus musculus
acagccctggatcatgggtttcggg

SEQ ID NO: 236193 - DNA, 25 bp, Mus musculus
ctcctcatctgtgcccatggcggtt

SEQ ID NO: 236194 - DNA, 25 bp, Mus musculus
gtgtagacaacttcagggactcgtg

SEQ ID NO: 236195 - DNA, 25 bp, Mus musculus
acggaccgtaattcatgcctggcaa

SEQ ID NO: 236196 - DNA, 25 bp, Mus musculus
agcgctaaccggaggtgctgctatc

SEQ ID NO: 236197 - DNA, 25 bp, Mus musculus
gcctgttatctcacggcagcgctaa

SEQ ID NO: 236198 - DNA, 25 bp, Mus musculus
tgtctgacctttgcggatttcctgg

SEQ ID NO: 236199 - DNA, 25 bp, Mus musculus
caggcaacctcggagctcatttttg

SEQ ID NO: 236200 - DNA, 25 bp, Mus musculus
gccatgtggctcattcccgaaaacg

SEQ ID NO: 236201 - DNA, 25 bp, Mus musculus
atgctaaactctacccaagggctgc

SEQ ID NO: 236202 - DNA, 25 bp, Mus musculus
tccagagcgcaggacccatgctaaa

SEQ ID NO: 236203 - DNA, 25 bp, Mus musculus
ccctgggcttttagagtaggtctca

SEQ ID NO: 236204 - DNA, 25 bp, Mus musculus
acgaggatgttgtttttaggcgcca

SEQ ID NO: 236205 - DNA, 25 bp, Mus musculus
cggggataaacaatctgtcacgatc

SEQ ID NO: 236206 - DNA, 25 bp, Mus musculus
tgtactggcccagagtcttaattcc

SEQ ID NO: 236207 - DNA, 25 bp, Mus musculus
cctgagaagggctgcatcgctaatt

SEQ ID NO: 236208 - DNA, 25 bp, Mus musculus
ctttgatgggatacatgtgcttggc

SEQ ID NO: 236209 - DNA, 25 bp, Mus musculus
ctaagtggttcgagcgatgcttgcc

SEQ ID NO: 236210 - DNA, 25 bp, Mus musculus
atttgcggtttgctaagtggttcga

SEQ ID NO: 236211 - DNA, 25 bp, Mus musculus
ccgaggcctctgaaatttgcggttt

SEQ ID NO: 236212 - DNA, 25 bp, Mus musculus
taaaacgcagatgtgccgaggcctc

SEQ ID NO: 236213 - DNA, 25 bp, Mus musculus
tccggaaaaagctgataaaacgcag

SEQ ID NO: 236214 - DNA, 25 bp, Mus musculus
tgcttggggtaatactatccggaaa

SEQ ID NO: 236215 - DNA, 25 bp, Mus musculus
ctgcagacaattgcttggggtaata

SEQ ID NO: 236216 - DNA, 25 bp, Mus musculus
tgtcggccgatctgcagacaattgc

SEQ ID NO: 236217 - DNA, 25 bp, Mus musculus
cttgaacgtctcagctgtcggccga

SEQ ID NO: 236218 - DNA, 25 bp, Mus musculus
ctccgtaattcagcgcttgaacgtc

SEQ ID NO: 236219 - DNA, 25 bp, Mus musculus
gcttggctttatctccggccctttc

SEQ ID NO: 236220 - DNA, 25 bp, Mus musculus
cggcaggctgctttcattactttga

SEQ ID NO: 236221 - DNA, 25 bp, Mus musculus
ggccctttctccgtaattcagcgct

SEQ ID NO: 236222 - DNA, 25 bp, Mus musculus
tgggaaatctccgagcgtctgatcc

SEQ ID NO: 236223 - DNA, 25 bp, Mus musculus
ccgcccgtctcctaaagaatcataa

SEQ ID NO: 236224 - DNA, 25 bp, Mus musculus
gatgctttcgttcctgaagtccaga

SEQ ID NO: 236225 - DNA, 25 bp, Mus musculus
ctgatcccgctgagttttgcagaga

SEQ ID NO: 236226 - DNA, 25 bp, Mus musculus
ggtagctgtctggaacggagaattc

SEQ ID NO: 236227 - DNA, 25 bp, Mus musculus
gagaattccggctctgggttaaagc

SEQ ID NO: 236228 - DNA, 25 bp, Mus musculus
cggagtgcggaacctttcttctatg

SEQ ID NO: 236229 - DNA, 25 bp, Mus musculus
ttcttctatgctcacagttcccagg

SEQ ID NO: 236230 - DNA, 25 bp, Mus musculus
ggagtgcgaaatcggaacgtccctc

SEQ ID NO: 236231 - DNA, 25 bp, Mus musculus
acgtccctcagcaaccgagttcttg

SEQ ID NO: 236232 - DNA, 25 bp, Mus musculus
tcgctatggcggtggacatcacact

SEQ ID NO: 236233 - DNA, 25 bp, Mus musculus
gacatcacactgctcttccgggcta

SEQ ID NO: 236234 - DNA, 25 bp, Mus musculus
ttccgggctagcgtcaagacagtga

SEQ ID NO: 236235 - DNA, 25 bp, Mus musculus
gagcgatctttctagcttcccgatg

SEQ ID NO: 236236 - DNA, 25 bp, Mus musculus
gacgcggcgatctagccagatcaga

SEQ ID NO: 236237 - DNA, 25 bp, Mus musculus
ggcacagccagaaggactccgcaca

SEQ ID NO: 236238 - DNA, 25 bp, Mus musculus
ccagatcagagtctcaggctgtgta

SEQ ID NO: 236239 - DNA, 25 bp, Mus musculus
ctcaggctgtgtattgactaacatt

SEQ ID NO: 236240 - DNA, 25 bp, Mus musculus
taaggggacgctacccgtgcccagc

SEQ ID NO: 236241 - DNA, 25 bp, Mus musculus
cgtgcccagcctttctggacgcgta

SEQ ID NO: 236242 - DNA, 25 bp, Mus musculus
gacgcgtaccctgtcgggtggcact

SEQ ID NO: 236243 - DNA, 25 bp, Mus musculus
ctctgcttgagagatgctcctctgc

SEQ ID NO: 236244 - DNA, 25 bp, Mus musculus
ctccggaagatctgggctccaagcg

SEQ ID NO: 236245 - DNA, 25 bp, Mus musculus
tcccgcgcacagcaatggcggaggc

SEQ ID NO: 236246 - DNA, 25 bp, Mus musculus
ggatcggtcgcacaaaggagcacgc

SEQ ID NO: 236247 - DNA, 25 bp, Mus musculus
tgagactcccaatgcccgactaagg

SEQ ID NO: 236248 - DNA, 25 bp, Mus musculus
actaagggaatacccgagcgggctg

SEQ ID NO: 236249 - DNA, 25 bp, Mus musculus
cgaaagacacgaggctgcggcctgc

SEQ ID NO: 236250 - DNA, 25 bp, Mus musculus
tcacacagcgctgcgagtaagccgc

SEQ ID NO: 236251 - DNA, 25 bp, Mus musculus
ggccagatggtacggttagtcctca

SEQ ID NO: 236252 - DNA, 25 bp, Mus musculus
tggagatattgcatcccggttttta

SEQ ID NO: 236253 - DNA, 25 bp, Mus musculus
ctagccttttgagttcctggagata

SEQ ID NO: 236254 - DNA, 25 bp, Mus musculus
cgctcgcgggcaaaacctagccttt

SEQ ID NO: 236255 - DNA, 25 bp, Mus musculus
gcatggctgccttccttgaggactc

SEQ ID NO: 236256 - DNA, 25 bp, Mus musculus
tcggctgacaggtgagaactgcttg

SEQ ID NO: 236257 - DNA, 25 bp, Mus musculus
tctcggtgtcaactgcaggactcca

SEQ ID NO: 236258 - DNA, 25 bp, Mus musculus
gccaacccacgggagtcgagtgtcc

SEQ ID NO: 236259 - DNA, 25 bp, Mus musculus
agcttagctttgtgctccgccgagc

SEQ ID NO: 236260 - DNA, 25 bp, Mus musculus
aataagcgcctctcctatctcgggg

SEQ ID NO: 236261 - DNA, 25 bp, Mus musculus
atggaacaccatggcacctaggatc

SEQ ID NO: 236262 - DNA, 25 bp, Mus musculus
ggcgctgcagtaatagcatcctaca

SEQ ID NO: 236263 - DNA, 25 bp, Mus musculus
ctttctcgtcgcactctcggtgtca

SEQ ID NO: 236264 - DNA, 25 bp, Mus musculus
gaggacggaacaccgagctctacgc

SEQ ID NO: 236265 - DNA, 25 bp, Mus musculus
taaggatcttcgaacgctctgccgc

SEQ ID NO: 236266 - DNA, 25 bp, Mus musculus
tctccgaggtttagcctcaataagg

SEQ ID NO: 236267 - DNA, 25 bp, Mus musculus
tcgcgctcagagttcgagataaaga

SEQ ID NO: 236268 - DNA, 25 bp, Mus musculus
cagcacagtcggagaagccgccctg

SEQ ID NO: 236269 - DNA, 25 bp, Mus musculus
agccacgaagcagaaggccagcacg

SEQ ID NO: 236270 - DNA, 25 bp, Mus musculus
tcgttcctgggtaggagagagccac

SEQ ID NO: 236271 - DNA, 25 bp, Mus musculus
ataagcccagtgtccctgtgctgtc

SEQ ID NO: 236272 - DNA, 25 bp, Mus musculus
gagttttcactgtggctccagagca

SEQ ID NO: 236273 - DNA, 25 bp, Mus musculus
ggcgtcctccttgatgtgctgatga

SEQ ID NO: 236274 - DNA, 25 bp, Mus musculus
gggccttggcaatatggcgtcctcc

SEQ ID NO: 236275 - DNA, 25 bp, Mus musculus
tggcttattggacgcgccgtagata

SEQ ID NO: 236276 - DNA, 25 bp, Mus musculus
acgctcgaagaggtttggcttattg

SEQ ID NO: 236277 - DNA, 25 bp, Mus musculus
agctctacgccctagcaggggtaga

SEQ ID NO: 236278 - DNA, 25 bp, Mus musculus
cgccaagatggacgctccgtgggct

SEQ ID NO: 236279 - DNA, 25 bp, Mus musculus
atacagttttattccgagcgtccgg

SEQ ID NO: 236280 - DNA, 25 bp, Mus musculus
agcgtccggagattccgcccttgga

SEQ ID NO: 236281 - DNA, 25 bp, Mus musculus
cgcccttggacctggcgccggaagt

SEQ ID NO: 236282 - DNA, 25 bp, Mus musculus
cggaagtgctgcgtgcggtcacttc

SEQ ID NO: 236283 - DNA, 25 bp, Mus musculus
ttccgtcgcactggcgggcgccaag

SEQ ID NO: 236284 - DNA, 25 bp, Mus musculus
cagctacggcggcgttacctgtttc

SEQ ID NO: 236285 - DNA, 25 bp, Mus musculus
cttccgaagtagagctggactgcga

SEQ ID NO: 236286 - DNA, 25 bp, Mus musculus
cggtgtccagggtcctgacaggtct

SEQ ID NO: 236287 - DNA, 25 bp, Mus musculus
ctgagccgtatttccgcattccgtg

SEQ ID NO: 236288 - DNA, 25 bp, Mus musculus
ccgcattccgtggagagtcgactta

SEQ ID NO: 236289 - DNA, 25 bp, Mus musculus
tccgtggagagtcgacttaatgccg

SEQ ID NO: 236290 - DNA, 25 bp, Mus musculus
cactaaaaccgccaaggtaatacag

SEQ ID NO: 236291 - DNA, 25 bp, Mus musculus
ctgtttccttccgaagtagagctgg

SEQ ID NO: 236292 - DNA, 25 bp, Mus musculus
gcggcacctgttgcagtcccgcgtt

SEQ ID NO: 236293 - DNA, 25 bp, Mus musculus
cagctgctctggatgctgtggtacg

SEQ ID NO: 236294 - DNA, 25 bp, Mus musculus
aaccgcgcttatgctgctgcagctg

SEQ ID NO: 236295 - DNA, 25 bp, Mus musculus
ctgctgtgcgttctaaccgcgctta

SEQ ID NO: 236296 - DNA, 25 bp, Mus musculus
caagagcgacctgctgtgcgttcta

SEQ ID NO: 236297 - DNA, 25 bp, Mus musculus
actctgagcagccagtatggactga

SEQ ID NO: 236298 - DNA, 25 bp, Mus musculus
agctggcggagactctgagcagcca

SEQ ID NO: 236299 - DNA, 25 bp, Mus musculus
gagggtctccacaagcttccggtcc

SEQ ID NO: 236300 - DNA, 25 bp, Mus musculus
ctagcccgagggtctccacaagctt

SEQ ID NO: 236301 - DNA, 25 bp, Mus musculus
ggggatcgcggcatgccctctgtcc

SEQ ID NO: 236302 - DNA, 25 bp, Mus musculus
cccggggaccagactggaagatgcc

SEQ ID NO: 236303 - DNA, 25 bp, Mus musculus
gggaccagagtagaccatcaggagc

SEQ ID NO: 236304 - DNA, 25 bp, Mus musculus
tacgtgggtcgcagctacatgcagc

SEQ ID NO: 236305 - DNA, 25 bp, Mus musculus
tgcagtcccgcgtttccggggagcc

SEQ ID NO: 236306 - DNA, 25 bp, Mus musculus
tgcgcgccaaaatgaccaacatctt

SEQ ID NO: 236307 - DNA, 25 bp, Mus musculus
cgtcctagtgtgtgctgctatcgtc

SEQ ID NO: 236308 - DNA, 25 bp, Mus musculus
cttgctcggcaacgtcctagtgtgt

SEQ ID NO: 236309 - DNA, 25 bp, Mus musculus
ttaatcgtctggaccttgctcggca

SEQ ID NO: 236310 - DNA, 25 bp, Mus musculus
gctggcctcctgactctcttaatcg

SEQ ID NO: 236311 - DNA, 25 bp, Mus musculus
tcctgggcgcaatggcaccgcacat

SEQ ID NO: 236312 - DNA, 25 bp, Mus musculus
agtgagcccgagctacccagcgcga

SEQ ID NO: 236313 - DNA, 25 bp, Mus musculus
aagttgggatcgcacgcagtgagcc

SEQ ID NO: 236314 - DNA, 25 bp, Mus musculus
gaggcgcgcaagactgataccatta

SEQ ID NO: 236315 - DNA, 25 bp, Mus musculus
tcccatcctggggactagaggcgcg

SEQ ID NO: 236316 - DNA, 25 bp, Mus musculus
ctacgactcagaaccagacgcagcg

SEQ ID NO: 236317 - DNA, 25 bp, Mus musculus
cttcatcgtatctctggccgtctca

SEQ ID NO: 236318 - DNA, 25 bp, Mus musculus
gcagccaccgcgctagagagatcgc

SEQ ID NO: 236319 - DNA, 25 bp, Mus musculus
ggccgctctgcgtttctacgactca

SEQ ID NO: 236320 - DNA, 25 bp, Mus musculus
aatgatcgcccttggggtctccacc

SEQ ID NO: 236321 - DNA, 25 bp, Mus musculus
gactctgaaggtagctcgcagggta

SEQ ID NO: 236322 - DNA, 25 bp, Mus musculus
ccgccgggcacaagagtactcacat

SEQ ID NO: 236323 - DNA, 25 bp, Mus musculus
atgtttcttaggatgacgcacttgc

SEQ ID NO: 236324 - DNA, 25 bp, Mus musculus
acgcacttgccattggtgtagagga

SEQ ID NO: 236325 - DNA, 25 bp, Mus musculus
tccaccgaggatcttagagacgccc

SEQ ID NO: 236326 - DNA, 25 bp, Mus musculus
tacaaacccggcacggtgcatgagg

SEQ ID NO: 236327 - DNA, 25 bp, Mus musculus
ggacccagggagttgcagtcagtca

SEQ ID NO: 236328 - DNA, 25 bp, Mus musculus
gcactcactgatctcgtacggcatc

SEQ ID NO: 236329 - DNA, 25 bp, Mus musculus
gtacggcatcctcgcccacttgtta

SEQ ID NO: 236330 - DNA, 25 bp, Mus musculus
cgctcgagtggaacctcgcagtggc

SEQ ID NO: 236331 - DNA, 25 bp, Mus musculus
ccatatatagtcaagcgctcggctc

SEQ ID NO: 236332 - DNA, 25 bp, Mus musculus
gtgacgtgacgcgacccgtgaaaag

SEQ ID NO: 236333 - DNA, 25 bp, Mus musculus
ccttctctggggagatacaaacccg

SEQ ID NO: 236334 - DNA, 25 bp, Mus musculus
tgttccggataccagagcctggtcc

SEQ ID NO: 236335 - DNA, 25 bp, Mus musculus
ggtgtcagcgtcctcgtgagtctgt

SEQ ID NO: 236336 - DNA, 25 bp, Mus musculus
tgtcagcgtcctcgtgagtctgtgg

SEQ ID NO: 236337 - DNA, 25 bp, Mus musculus
cgggtgttccggataccagagcctg

SEQ ID NO: 236338 - DNA, 25 bp, Mus musculus
gtgttccggataccagagcctggtc

SEQ ID NO: 236339 - DNA, 25 bp, Mus musculus
gttccggataccagagcctggtccg

SEQ ID NO: 236340 - DNA, 25 bp, Mus musculus
tccggataccagagcctggtccggg

SEQ ID NO: 236341 - DNA, 25 bp, Mus musculus
ataccagagcctggtccgggtgtca

SEQ ID NO: 236342 - DNA, 25 bp, Mus musculus
taccagagcctggtccgggtgtcag

SEQ ID NO: 236343 - DNA, 25 bp, Mus musculus
accagagcctggtccgggtgtcagc

SEQ ID NO: 236344 - DNA, 25 bp, Mus musculus
agcctggtccgggtgtcagcgtcct

SEQ ID NO: 236345 - DNA, 25 bp, Mus musculus
ctggtccgggtgtcagcgtcctcgt

SEQ ID NO: 236346 - DNA, 25 bp, Mus musculus
cgggtgtcagcgtcctcgtgagtct

SEQ ID NO: 236347 - DNA, 25 bp, Mus musculus
ggtgttccggataccagagcctggt

SEQ ID NO: 236348 - DNA, 25 bp, Mus musculus
gtggatctcgctgcccagctcgcag

SEQ ID NO: 236349 - DNA, 25 bp, Mus musculus
agtctgtggggaccaagtggcgaca

SEQ ID NO: 236350 - DNA, 25 bp, Mus musculus
gtggcgacagccacaagtcgctcca

SEQ ID NO: 236351 - DNA, 25 bp, Mus musculus
ttcaggacggtgttttccgcgccag

SEQ ID NO: 236352 - DNA, 25 bp, Mus musculus
tcaggacggtgttttccgcgccagc

SEQ ID NO: 236353 - DNA, 25 bp, Mus musculus
gttttccgcgccagccctgtgctgt

SEQ ID NO: 236354 - DNA, 25 bp, Mus musculus
tccgcgccagccctgtgctgtggat

SEQ ID NO: 236355 - DNA, 25 bp, Mus musculus
cgcgccagccctgtgctgtggatct

SEQ ID NO: 236356 - DNA, 25 bp, Mus musculus
agccctgtgctgtggatctcgctgc

SEQ ID NO: 236357 - DNA, 25 bp, Mus musculus
cctgtgctgtggatctcgctgccca

SEQ ID NO: 236358 - DNA, 25 bp, Mus musculus
gtgctgtggatctcgctgcccagct

SEQ ID NO: 236359 - DNA, 25 bp, Mus musculus
ccaagtggcgacagccacaagtcgc

SEQ ID NO: 236360 - DNA, 25 bp, Mus musculus
ggtgacacagcttcccgggattccc

SEQ ID NO: 236361 - DNA, 25 bp, Mus musculus
tgtggatctcgctgcccagctcgca

SEQ ID NO: 236362 - DNA, 25 bp, Mus musculus
tctcagaggccgagaggctttaaaa

SEQ ID NO: 236363 - DNA, 25 bp, Mus musculus
ctccaaagacaatgccagcgtggtc

SEQ ID NO: 236364 - DNA, 25 bp, Mus musculus
gccagcgtggtcctcaagtttattg

SEQ ID NO: 236365 - DNA, 25 bp, Mus musculus
caagtttattgttggcgcgctcgca

SEQ ID NO: 236366 - DNA, 25 bp, Mus musculus
ccggtcacagatggggtgtcttcca

SEQ ID NO: 236367 - DNA, 25 bp, Mus musculus
ggggtgtcttccaaacgctgaaagc

SEQ ID NO: 236368 - DNA, 25 bp, Mus musculus
aagccgcgtcaagccagtctcagag

SEQ ID NO: 236369 - DNA, 25 bp, Mus musculus
ggctttaaaaatggcctcctgacga

SEQ ID NO: 236370 - DNA, 25 bp, Mus musculus
tcctgacgacacttcctgctcgggg

SEQ ID NO: 236371 - DNA, 25 bp, Mus musculus
gctcggggccgaggcatcttttaaa

SEQ ID NO: 236372 - DNA, 25 bp, Mus musculus
gagccggcgctgcacaaaggccgca

SEQ ID NO: 236373 - DNA, 25 bp, Mus musculus
tcccagatcccagcggacggacagg

SEQ ID NO: 236374 - DNA, 25 bp, Mus musculus
ggacaggcgtctagaccgccggcta

SEQ ID NO: 236375 - DNA, 25 bp, Mus musculus
cgctgaaagccaaagccgcgtcaag

SEQ ID NO: 236376 - DNA, 25 bp, Mus musculus
gccctttggagcaaattcacactca

SEQ ID NO: 236377 - DNA, 25 bp, Mus musculus
agcggtgaagggacacaggcactca

SEQ ID NO: 236378 - DNA, 25 bp, Mus musculus
ggacacaggcactcaccgagagaga

SEQ ID NO: 236379 - DNA, 25 bp, Mus musculus
caccgagagagacccggcggtgacc

SEQ ID NO: 236380 - DNA, 25 bp, Mus musculus
gctgcagcgcactgaggaccttgca

SEQ ID NO: 236381 - DNA, 25 bp, Mus musculus
tgaggaccttgcaggcaggcgtttt

SEQ ID NO: 236382 - DNA, 25 bp, Mus musculus
aagaggatctcgagcgcccactgct

SEQ ID NO: 236383 - DNA, 25 bp, Mus musculus
ctgccttgttggctctggtactgcc

SEQ ID NO: 236384 - DNA, 25 bp, Mus musculus
gccgacttccagcaagccagttaag

SEQ ID NO: 236385 - DNA, 25 bp, Mus musculus
gcaagccagttaagcacccgatttc

SEQ ID NO: 236386 - DNA, 25 bp, Mus musculus
agcacccgatttctgcgcttttggg

SEQ ID NO: 236387 - DNA, 25 bp, Mus musculus
ttctgcgcttttgggtcccgaagga

SEQ ID NO: 236388 - DNA, 25 bp, Mus musculus
gcaggcgttttggtgccggttctac

SEQ ID NO: 236389 - DNA, 25 bp, Mus musculus
cgccaagtacctgcgccctttggag

SEQ ID NO: 236390 - DNA, 25 bp, Mus musculus
aggacgcagtgctggacagcgctcc

SEQ ID NO: 236391 - DNA, 25 bp, Mus musculus
agtacgtagacgcagaccgggcgtc

SEQ ID NO: 236392 - DNA, 25 bp, Mus musculus
agcgtcactcaaaagacgtcccgtc

SEQ ID NO: 236393 - DNA, 25 bp, Mus musculus
agggagaatcactcaccggccgcca

SEQ ID NO: 236394 - DNA, 25 bp, Mus musculus
cctgaaggaagccagggagaatcac

SEQ ID NO: 236395 - DNA, 25 bp, Mus musculus
acatggtgtccgaggatgctggcct

SEQ ID NO: 236396 - DNA, 25 bp, Mus musculus
cctcagagtctgacatggtgtccga

SEQ ID NO: 236397 - DNA, 25 bp, Mus musculus
tggctctcctcctcagagtctgaca

SEQ ID NO: 236398 - DNA, 25 bp, Mus musculus
ttcagttgccggtcctggctctcct

SEQ ID NO: 236399 - DNA, 25 bp, Mus musculus
cccagcacgacgattttcagttgcc

SEQ ID NO: 236400 - DNA, 25 bp, Mus musculus
ggtccgctggaggactgaccttccc

SEQ ID NO: 236401 - DNA, 25 bp, Mus musculus
cgctttctgcaacccagggagccgg

SEQ ID NO: 236402 - DNA, 25 bp, Mus musculus
ggaccacgctttctgcaacccaggg

SEQ ID NO: 236403 - DNA, 25 bp, Mus musculus
cagaccgggcgtcccggtttgctcg
